United States Patent 12,624,385 (RIBOREGULATORS AND METHODS OF USE THEREOF) - sequence listing, part 11

SEQ ID NO: 171056 - DNA, 103 bp, Artificial Sequence
  Synthetic Polynucleotide
taatacgactcactatagggcaccgccttctgcagcgcgcacagctctttaacagaggagaaaagagatgtgcgcgctgaacctggcggcagcgcaaaagatg

SEQ ID NO: 171057 - DNA, 103 bp, Artificial Sequence
  Synthetic Polynucleotide
taatacgactcactatagggtctccagctccaccgccttctgcagcgcgcaacagaggagagcgcgcatgagaaggcggaacctggcggcagcgcaaaagatg

SEQ ID NO: 171058 - DNA, 103 bp, Artificial Sequence
  Synthetic Polynucleotide
taatacgactcactataggggcctctgtcttctccagctccaccgccttcaacagaggagagaaggcatgggagctggaaacctggcggcagcgcaaaagatg

SEQ ID NO: 171059 - DNA, 103 bp, Artificial Sequence
  Synthetic Polynucleotide
taatacgactcactatagggcgcgttgtccgcctctgtcttctccagctcaacagaggagagagctgatgaagacagagaacctggcggcagcgcaaaagatg

SEQ ID NO: 171060 - DNA, 103 bp, Artificial Sequence
  Synthetic Polynucleotide
taatacgactcactatagggggggccgctccgcgttgtccgcctctgtctaacagaggagaagacagatgcggacaacgaacctggcggcagcgcaaaagatg

SEQ ID NO: 171061 - DNA, 103 bp, Artificial Sequence
  Synthetic Polynucleotide
taatacgactcactatagggcgtcgcgcccggggccgctccgcgttgtccaacagaggagaggacaaatgggagcggccaacctggcggcagcgcaaaagatg

SEQ ID NO: 171062 - DNA, 103 bp, Artificial Sequence
  Synthetic Polynucleotide
taatacgactcactatagggcaggtttaggatgtctttgactgagaagggaacagaggagacccttcatggtcaaagacaacctggcggcagcgcaaaagatg

SEQ ID NO: 171063 - DNA, 103 bp, Artificial Sequence
  Synthetic Polynucleotide
taatacgactcactatagggcttcctccgccgtcgcgcccggggccgctcaacagaggagagagcggatgcgggcgcgaaacctggcggcagcgcaaaagatg

SEQ ID NO: 171064 - DNA, 103 bp, Artificial Sequence
  Synthetic Polynucleotide
taatacgactcactataggggcacgcgcggcttcctccgccgtcgcgcccaacagaggagagggcgcatgggcggaggaaacctggcggcagcgcaaaagatg

SEQ ID NO: 171065 - DNA, 103 bp, Artificial Sequence
  Synthetic Polynucleotide
taatacgactcactatagggtgcgagaagagcacgcgcggcttcctccgcaacagaggagagcggagatggccgcgcgtaacctggcggcagcgcaaaagatg

SEQ ID NO: 171066 - DNA, 103 bp, Artificial Sequence
  Synthetic Polynucleotide
taatacgactcactataggggacctgcgcctgcgagaagagcacgcgcggaacagaggagaccgcgcatgctcttctcgaacctggcggcagcgcaaaagatg

SEQ ID NO: 171067 - DNA, 103 bp, Artificial Sequence
  Synthetic Polynucleotide
taatacgactcactatagggccagctcatagacctgcgcctgcgagaagaaacagaggagatcttctatgaggcgcaggaacctggcggcagcgcaaaagatg

SEQ ID NO: 171068 - DNA, 103 bp, Artificial Sequence
  Synthetic Polynucleotide
taatacgactcactatagggaagcgccgctccagctcatagacctgcgccaacagaggagaggcgcaatgctatgagctaacctggcggcagcgcaaaagatg

SEQ ID NO: 171069 - DNA, 103 bp, Artificial Sequence
  Synthetic Polynucleotide
taatacgactcactatagggctgctgcttgaagcgccgctccagctcataaacagaggagatatgagatggagcggcgcaacctggcggcagcgcaaaagatg

SEQ ID NO: 171070 - DNA, 103 bp, Artificial Sequence
  Synthetic Polynucleotide
taatacgactcactatagggacaggtaccgctgctgcttgaagcgccgctaacagaggagaagcggcatgtcaagcagcaacctggcggcagcgcaaaagatg

SEQ ID NO: 171071 - DNA, 103 bp, Artificial Sequence
  Synthetic Polynucleotide
taatacgactcactatagggtcgggggccgacaggtaccgctgctgcttgaacagaggagacaagcaatggcggtacctaacctggcggcagcgcaaaagatg

SEQ ID NO: 171072 - DNA, 103 bp, Artificial Sequence
  Synthetic Polynucleotide
taatacgactcactatagggctggtcgcgttcgggggccgacaggtaccgaacagaggagacggtacatgtcggcccccaacctggcggcagcgcaaaagatg

SEQ ID NO: 171073 - DNA, 103 bp, Artificial Sequence
  Synthetic Polynucleotide
taatacgactcactataggggctgctgttccaggtttaggatgtctttgaaacagaggagatcaaagatgtcctaaaccaacctggcggcagcgcaaaagatg

SEQ ID NO: 171074 - DNA, 103 bp, Artificial Sequence
  Synthetic Polynucleotide
taatacgactcactatagggcgctggccagctggtcgcgttcgggggccgaacagaggagacggcccatgaacgcgaccaacctggcggcagcgcaaaagatg

SEQ ID NO: 171075 - DNA, 103 bp, Artificial Sequence
  Synthetic Polynucleotide
taatacgactcactatagggagtttcagcacgctggccagctggtcgcgtaacagaggagaacgcgaatggctggccagaacctggcggcagcgcaaaagatg

SEQ ID NO: 171076 - DNA, 103 bp, Artificial Sequence
  Synthetic Polynucleotide
taatacgactcactatagggcgtggacgtgagtttcagcacgctggccagaacagaggagactggccatggtgctgaaaaacctggcggcagcgcaaaagatg

SEQ ID NO: 171077 - DNA, 103 bp, Artificial Sequence
  Synthetic Polynucleotide
taatacgactcactatagggtcttgacctgcgtggacgtgagtttcagcaaacagaggagatgctgaatgtcacgtccaaacctggcggcagcgcaaaagatg

SEQ ID NO: 171078 - DNA, 103 bp, Artificial Sequence
  Synthetic Polynucleotide
taatacgactcactatagggtggaaccagatcttgacctgcgtggacgtgaacagaggagacacgtcatggcaggtcaaaacctggcggcagcgcaaaagatg

SEQ ID NO: 171079 - DNA, 103 bp, Artificial Sequence
  Synthetic Polynucleotide
taatacgactcactataggggcgccggttctggaaccagatcttgacctgaacagaggagacaggtcatgatctggttcaacctggcggcagcgcaaaagatg

SEQ ID NO: 171080 - DNA, 103 bp, Artificial Sequence
  Synthetic Polynucleotide
taatacgactcactatagggtgcacttgtagcgccggttctggaaccagaaacagaggagatctggtatgagaaccggcaacctggcggcagcgcaaaagatg

SEQ ID NO: 171081 - DNA, 103 bp, Artificial Sequence
  Synthetic Polynucleotide
taatacgactcactatagggcgctgccgcttgcacttgtagcgccggttcaacagaggagagaaccgatgctacaagtgaacctggcggcagcgcaaaagatg

SEQ ID NO: 171082 - DNA, 103 bp, Artificial Sequence
  Synthetic Polynucleotide
taatacgactcactatagggctggtcctgccgctgccgcttgcacttgtaaacagaggagatacaagatgaagcggcagaacctggcggcagcgcaaaagatg

SEQ ID NO: 171083 - DNA, 103 bp, Artificial Sequence
  Synthetic Polynucleotide
taatacgactcactataggggctccagagtctggtcctgccgctgccgctaacagaggagaagcggcatgggcaggaccaacctggcggcagcgcaaaagatg

SEQ ID NO: 171084 - DNA, 103 bp, Artificial Sequence
  Synthetic Polynucleotide
taatacgactcactatagggaggctgcgctgctgctgttccaggtttaggaacagaggagacctaaaatgggaacagcaaacctggcggcagcgcaaaagatg

SEQ ID NO: 171085 - DNA, 103 bp, Artificial Sequence
  Synthetic Polynucleotide
taatacgactcactatagggagccccaccagctccagagtctggtcctgcaacagaggagagcaggaatggactctggaaacctggcggcagcgcaaaagatg

SEQ ID NO: 171086 - DNA, 103 bp, Artificial Sequence
  Synthetic Polynucleotide
taatacgactcactatagggcggcgggggcagccccaccagctccagagtaacagaggagaactctgatgctggtggggaacctggcggcagcgcaaaagatg

SEQ ID NO: 171087 - DNA, 103 bp, Artificial Sequence
  Synthetic Polynucleotide
taatacgactcactataggggcggcggcggcggcgggggcagccccaccaaacagaggagatggtggatgtgcccccgcaacctggcggcagcgcaaaagatg

SEQ ID NO: 171088 - DNA, 103 bp, Artificial Sequence
  Synthetic Polynucleotide
taatacgactcactatagggctgcgggcaggcggcggcggcggcgggggcaacagaggagagcccccatggccgccgccaacctggcggcagcgcaaaagatg

SEQ ID NO: 171089 - DNA, 103 bp, Artificial Sequence
  Synthetic Polynucleotide
taatacgactcactatagggcaccgcgatcctgcgggcaggcggcggcggaacagaggagaccgccgatgcctgcccgcaacctggcggcagcgcaaaagatg

SEQ ID NO: 171090 - DNA, 103 bp, Artificial Sequence
  Synthetic Polynucleotide
taatacgactcactatagggccagcactggcaccgcgatcctgcgggcagaacagaggagactgcccatgggatcgcggaacctggcggcagcgcaaaagatg

SEQ ID NO: 171091 - DNA, 103 bp, Artificial Sequence
  Synthetic Polynucleotide
taatacgactcactatagggccatcgcgcaccagcactggcaccgcgatcaacagaggagagatcgcatggccagtgctaacctggcggcagcgcaaaagatg

SEQ ID NO: 171092 - DNA, 103 bp, Artificial Sequence
  Synthetic Polynucleotide
taatacgactcactataggggcatggcttgccatcgcgcaccagcactggaacagaggagaccagtgatggtgcgcgataacctggcggcagcgcaaaagatg

SEQ ID NO: 171093 - DNA, 103 bp, Artificial Sequence
  Synthetic Polynucleotide
taatacgactcactatagggagtcccctaggcatggcttgccatcgcgcaaacagaggagatgcgcgatggcaagccataacctggcggcagcgcaaaagatg

SEQ ID NO: 171094 - DNA, 103 bp, Artificial Sequence
  Synthetic Polynucleotide
taatacgactcactatagggtagggcgccgagtcccctaggcatggcttgaacagaggagacaagccatgcctaggggaaacctggcggcagcgcaaaagatg

SEQ ID NO: 171095 - DNA, 103 bp, Artificial Sequence
  Synthetic Polynucleotide
taatacgactcactatagggggcggcagccaggctgcgctgctgctgttcaacagaggagagaacagatgcagcgcagcaacctggcggcagcgcaaaagatg

SEQ ID NO: 171096 - DNA, 103 bp, Artificial Sequence
  Synthetic Polynucleotide
taatacgactcactatagggggcaggcgcgtagggcgccgagtcccctagaacagaggagactagggatgtcggcgcccaacctggcggcagcgcaaaagatg

SEQ ID NO: 171097 - DNA, 103 bp, Artificial Sequence
  Synthetic Polynucleotide
taatacgactcactatagggccacgccgtaggcaggcgcgtagggcgccgaacagaggagacggcgcatgacgcgcctgaacctggcggcagcgcaaaagatg

SEQ ID NO: 171098 - DNA, 103 bp, Artificial Sequence
  Synthetic Polynucleotide
taatacgactcactatagggggattgaggcccacgccgtaggcaggcgcgaacagaggagacgcgccatgctacggcgtaacctggcggcagcgcaaaagatg

SEQ ID NO: 171099 - DNA, 103 bp, Artificial Sequence
  Synthetic Polynucleotide
taatacgactcactatagggataaccgtagggattgaggcccacgccgtaaacagaggagatacggcatgggcctcaataacctggcggcagcgcaaaagatg

SEQ ID NO: 171100 - DNA, 103 bp, Artificial Sequence
  Synthetic Polynucleotide
taatacgactcactatagggggtaggcgttataaccgtagggattgaggcaacagaggagagcctcaatgcctacggttaacctggcggcagcgcaaaagatg

SEQ ID NO: 171101 - DNA, 103 bp, Artificial Sequence
  Synthetic Polynucleotide
taatacgactcactatagggggataggcggggtaggcgttataaccgtagaacagaggagactacggatgtaacgcctaaacctggcggcagcgcaaaagatg

SEQ ID NO: 171102 - DNA, 103 bp, Artificial Sequence
  Synthetic Polynucleotide
taatacgactcactataggggccgtaacccggataggcggggtaggcgttaacagaggagaaacgccatgcccgcctataacctggcggcagcgcaaaagatg

SEQ ID NO: 171103 - DNA, 103 bp, Artificial Sequence
  Synthetic Polynucleotide
taatacgactcactatagggaggccgcgccgccgtaacccggataggcggaacagaggagaccgcctatgcgggttacgaacctggcggcagcgcaaaagatg

SEQ ID NO: 171104 - DNA, 103 bp, Artificial Sequence
  Synthetic Polynucleotide
taatacgactcactatagggccagggctgcaggccgcgccgccgtaacccaacagaggagagggttaatgcggcgcggcaacctggcggcagcgcaaaagatg

SEQ ID NO: 171105 - DNA, 103 bp, Artificial Sequence
  Synthetic Polynucleotide
taatacgactcactataggggcagctgtagccagggctgcaggccgcgccaacagaggagaggcgcgatgtgcagccctaacctggcggcagcgcaaaagatg

SEQ ID NO: 171106 - DNA, 103 bp, Artificial Sequence
  Synthetic Polynucleotide
taatacgactcactatagggagagctctccggcggcagccaggctgcgctaacagaggagaagcgcaatgtggctgccgaacctggcggcagcgcaaaagatg

SEQ ID NO: 171107 - DNA, 103 bp, Artificial Sequence
  Synthetic Polynucleotide
taatacgactcactatagggaagcggcagtgcagctgtagccagggctgcaacagaggagagcagccatggctacagctaacctggcggcagcgcaaaagatg

SEQ ID NO: 171108 - DNA, 103 bp, Artificial Sequence
  Synthetic Polynucleotide
taatacgactcactatagggccggcggggtaagcggcagtgcagctgtagaacagaggagactacagatgcactgccgcaacctggcggcagcgcaaaagatg

SEQ ID NO: 171109 - DNA, 103 bp, Artificial Sequence
  Synthetic Polynucleotide
taatacgactcactatagggtggggaaggcccggcggggtaagcggcagtaacagaggagaactgccatgtaccccgccaacctggcggcagcgcaaaagatg

SEQ ID NO: 171110 - DNA, 103 bp, Artificial Sequence
  Synthetic Polynucleotide
taatacgactcactatagggccggctgcgctggggaaggcccggcggggtaacagaggagaaccccgatgggccttcccaacctggcggcagcgcaaaagatg

SEQ ID NO: 171111 - DNA, 103 bp, Artificial Sequence
  Synthetic Polynucleotide
taatacgactcactataggggcggcagtggccggctgcgctggggaaggcaacagaggagagccttcatgagcgcagccaacctggcggcagcgcaaaagatg

SEQ ID NO: 171112 - DNA, 103 bp, Artificial Sequence
  Synthetic Polynucleotide
taatacgactcactataggggttgttggcggcggcagtggccggctgcgcaacagaggagagcgcagatggccactgccaacctggcggcagcgcaaaagatg

SEQ ID NO: 171113 - DNA, 103 bp, Artificial Sequence
  Synthetic Polynucleotide
taatacgactcactatagggtcacgaagttgttgttggcggcggcagtggaacagaggagaccactgatgccgccaacaaacctggcggcagcgcaaaagatg

SEQ ID NO: 171114 - DNA, 103 bp, Artificial Sequence
  Synthetic Polynucleotide
taatacgactcactatagggacgccgaagttcacgaagttgttgttggcgaacagaggagacgccaaatgcaacttcgtaacctggcggcagcgcaaaagatg

SEQ ID NO: 171115 - DNA, 103 bp, Artificial Sequence
  Synthetic Polynucleotide
taatacgactcactatagggcaagtccccgacgccgaagttcacgaagttaacagaggagaaacttcatgaacttcggcaacctggcggcagcgcaaaagatg

SEQ ID NO: 171116 - DNA, 103 bp, Artificial Sequence
  Synthetic Polynucleotide
taatacgactcactataggggaaccgcattcaagtccccgacgccgaagtaacagaggagaacttcgatgtcggggactaacctggcggcagcgcaaaagatg

SEQ ID NO: 171117 - DNA, 103 bp, Artificial Sequence
  Synthetic Polynucleotide
taatacgactcactatagggaggcgggcagagagctctccggcggcagccaacagaggagaggctgcatgcggagagctaacctggcggcagcgcaaaagatg

SEQ ID NO: 171118 - DNA, 103 bp, Artificial Sequence
  Synthetic Polynucleotide
taatacgactcactatagggccggggctctgaaccgcattcaagtccccgaacagaggagacggggaatggaatgcggtaacctggcggcagcgcaaaagatg

SEQ ID NO: 171119 - DNA, 103 bp, Artificial Sequence
  Synthetic Polynucleotide
taatacgactcactatagggctgcggaatcccggggctctgaaccgcattaacagaggagaaatgcgatgcagagccccaacctggcggcagcgcaaaagatg

SEQ ID NO: 171120 - DNA, 103 bp, Artificial Sequence
  Synthetic Polynucleotide
taatacgactcactatagggccgagttgctctgcggaatcccggggctctaacagaggagaagagccatgggattccgcaacctggcggcagcgcaaaagatg

SEQ ID NO: 171121 - DNA, 103 bp, Artificial Sequence
  Synthetic Polynucleotide
taatacgactcactataggggtggacactcccgagttgctctgcggaatcaacagaggagagattccatggagcaactcaacctggcggcagcgcaaaagatg

SEQ ID NO: 171122 - DNA, 103 bp, Artificial Sequence
  Synthetic Polynucleotide
taatacgactcactatagggaccatgcagcgtggacactcccgagttgctaacagaggagaagcaacatgggagtgtccaacctggcggcagcgcaaaagatg

SEQ ID NO: 171123 - DNA, 103 bp, Artificial Sequence
  Synthetic Polynucleotide
taatacgactcactatagggaggctcggataccatgcagcgtggacactcaacagaggagagagtgtatgcgctgcatgaacctggcggcagcgcaaaagatg

SEQ ID NO: 171124 - DNA, 103 bp, Artificial Sequence
  Synthetic Polynucleotide
taatacgactcactataggggggggtggaggtgacggggctcagcagcataacagaggagaatgctgatgagccccgtcaacctggcggcagcgcaaaagatg

SEQ ID NO: 171125 - DNA, 103 bp, Artificial Sequence
  Synthetic Polynucleotide
taatacgactcactataggggttttccgggctcttccgcacccgcggatgaacagaggagacatccgatggtgcggaagaacctggcggcagcgcaaaagatg

SEQ ID NO: 171126 - DNA, 103 bp, Artificial Sequence
  Synthetic Polynucleotide
taatacgactcactatagggggtactgaaagttttccgggctcttccgcaaacagaggagatgcggaatggcccggaaaaacctggcggcagcgcaaaagatg

SEQ ID NO: 171127 - DNA, 103 bp, Artificial Sequence
  Synthetic Polynucleotide
taatacgactcactatagggtccattctcaggtactgaaagttttccgggaacagaggagacccggaatgctttcagtaaacctggcggcagcgcaaaagatg

SEQ ID NO: 171128 - DNA, 103 bp, Artificial Sequence
  Synthetic Polynucleotide
taatacgactcactatagggcggctctgcgtccattctcaggtactgaaaaacagaggagatttcagatgctgagaatgaacctggcggcagcgcaaaagatg

SEQ ID NO: 171129 - DNA, 103 bp, Artificial Sequence
  Synthetic Polynucleotide
taatacgactcactatagggctgaccctcgcggctctgcgtccattctcaaacagaggagatgagaaatgacgcagagcaacctggcggcagcgcaaaagatg

SEQ ID NO: 171130 - DNA, 103 bp, Artificial Sequence
  Synthetic Polynucleotide
taatacgactcactatagggttgtgaacctctgaccctcgcggctctgcgaacagaggagacgcagaatggcgagggtcaacctggcggcagcgcaaaagatg

SEQ ID NO: 171131 - DNA, 103 bp, Artificial Sequence
  Synthetic Polynucleotide
taatacgactcactataggggccaccagcgttgtgaacctctgaccctcgaacagaggagacgagggatggaggttcacaacctggcggcagcgcaaaagatg

SEQ ID NO: 171132 - DNA, 103 bp, Artificial Sequence
  Synthetic Polynucleotide
taatacgactcactatagggcaccgccgccgccaccagcgttgtgaacctaacagaggagaaggttcatgacgctggtgaacctggcggcagcgcaaaagatg

SEQ ID NO: 171133 - DNA, 103 bp, Artificial Sequence
  Synthetic Polynucleotide
taatacgactcactatagggagctttctgtcaccgccgccgccaccagcgaacagaggagacgctggatgcggcggcggaacctggcggcagcgcaaaagatg

SEQ ID NO: 171134 - DNA, 103 bp, Artificial Sequence
  Synthetic Polynucleotide
taatacgactcactatagggcgaaccatccagctttctgtcaccgccgccaacagaggagaggcggcatggacagaaagaacctggcggcagcgcaaaagatg

SEQ ID NO: 171135 - DNA, 103 bp, Artificial Sequence
  Synthetic Polynucleotide
taatacgactcactatagggtgaccgagaagggggtggaggtgacggggcaacagaggagagccccgatgcctccacccaacctggcggcagcgcaaaagatg

SEQ ID NO: 171136 - DNA, 103 bp, Artificial Sequence
  Synthetic Polynucleotide
taatacgactcactatagggcaggaggctccgaaccatccagctttctgtaacagaggagaacagaaatgtggatggttaacctggcggcagcgcaaaagatg

SEQ ID NO: 171137 - DNA, 103 bp, Artificial Sequence
  Synthetic Polynucleotide
taatacgactcactatagggcagggacccccaggaggctccgaaccatccaacagaggagaggatggatgggagcctccaacctggcggcagcgcaaaagatg

SEQ ID NO: 171138 - DNA, 103 bp, Artificial Sequence
  Synthetic Polynucleotide
taatacgactcactataggggactgcctcacagggacccccaggaggctcaacagaggagagagcctatggggggtcccaacctggcggcagcgcaaaagatg

SEQ ID NO: 171139 - DNA, 103 bp, Artificial Sequence
  Synthetic Polynucleotide
taatacgactcactatagggccatctccaagactgcctcacagggaccccaacagaggagaggggtcatggtgaggcagaacctggcggcagcgcaaaagatg

SEQ ID NO: 171140 - DNA, 103 bp, Artificial Sequence
  Synthetic Polynucleotide
taatacgactcactatagggcgttccgcgtccatctccaagactgcctcaaacagaggagatgaggcatgcttggagataacctggcggcagcgcaaaagatg

SEQ ID NO: 171141 - DNA, 103 bp, Artificial Sequence
  Synthetic Polynucleotide
taatacgactcactatagggctcccccatccgttccgcgtccatctccaaaacagaggagattggagatggacgcggaaaacctggcggcagcgcaaaagatg

SEQ ID NO: 171142 - DNA, 103 bp, Artificial Sequence
  Synthetic Polynucleotide
taatacgactcactatagggcgggctgtggctcccccatccgttccgcgtaacagaggagaacgcggatgggatgggggaacctggcggcagcgcaaaagatg

SEQ ID NO: 171143 - DNA, 103 bp, Artificial Sequence
  Synthetic Polynucleotide
taatacgactcactataggggcgttcaggccgggctgtggctcccccatcaacagaggagagatgggatggccacagccaacctggcggcagcgcaaaagatg

SEQ ID NO: 171144 - DNA, 103 bp, Artificial Sequence
  Synthetic Polynucleotide
taatacgactcactataggggggcgaggccgcgttcaggccgggctgtggaacagaggagaccacagatgggcctgaacaacctggcggcagcgcaaaagatg

SEQ ID NO: 171145 - DNA, 103 bp, Artificial Sequence
  Synthetic Polynucleotide
taatacgactcactatagggcgccgccgaggggcgaggccgcgttcaggcaacagaggagagcctgaatgcggcctcgcaacctggcggcagcgcaaaagatg

SEQ ID NO: 171146 - DNA, 103 bp, Artificial Sequence
  Synthetic Polynucleotide
taatacgactcactatagggaggatgtccttgaccgagaagggggtggagaacagaggagactccacatgcttctcggtaacctggcggcagcgcaaaagatg

SEQ ID NO: 171147 - DNA, 103 bp, Artificial Sequence
  Synthetic Polynucleotide
taatacgactcactatagggaccctggtcccgccgccgaggggcgaggccaacagaggagaggcctcatgcctcggcggaacctggcggcagcgcaaaagatg

SEQ ID NO: 171148 - DNA, 103 bp, Artificial Sequence
  Synthetic Polynucleotide
taatacgactcactataggggcgctctggcaccctggtcccgccgccgagaacagaggagactcggcatggggaccaggaacctggcggcagcgcaaaagatg

SEQ ID NO: 171149 - DNA, 103 bp, Artificial Sequence
  Synthetic Polynucleotide
taatacgactcactatagggtgccaacgccgcgctctggcaccctggtccaacagaggagaggaccaatgtgccagagcaacctggcggcagcgcaaaagatg

SEQ ID NO: 171150 - DNA, 103 bp, Artificial Sequence
  Synthetic Polynucleotide
taatacgactcactatagggtcgccgctgttgccaacgccgcgctctggcaacagaggagagccagaatgcggcgttggaacctggcggcagcgcaaaagatg

SEQ ID NO: 171151 - DNA, 103 bp, Artificial Sequence
  Synthetic Polynucleotide
taatacgactcactatagggccgcacgctgtcgccgctgttgccaacgccaacagaggagaggcgttatgaacagcggcaacctggcggcagcgcaaaagatg

SEQ ID NO: 171152 - DNA, 103 bp, Artificial Sequence
  Synthetic Polynucleotide
taatacgactcactatagggagcggccaccccgcacgctgtcgccgctgtaacagaggagaacagcgatgacagcgtgcaacctggcggcagcgcaaaagatg

SEQ ID NO: 171153 - DNA, 103 bp, Artificial Sequence
  Synthetic Polynucleotide
taatacgactcactatagggggctgctccgagcggccaccccgcacgctgaacagaggagacagcgtatggggtggccgaacctggcggcagcgcaaaagatg

SEQ ID NO: 171154 - DNA, 103 bp, Artificial Sequence
  Synthetic Polynucleotide
taatacgactcactatagggccgcgccttgggctgctccgagcggccaccaacagaggagaggtggcatgtcggagcagaacctggcggcagcgcaaaagatg

SEQ ID NO: 171155 - DNA, 103 bp, Artificial Sequence
  Synthetic Polynucleotide
taatacgactcactatagggtccgtcgttgccgcgccttgggctgctccgaacagaggagacggagcatgccaaggcgcaacctggcggcagcgcaaaagatg

SEQ ID NO: 171156 - DNA, 103 bp, Artificial Sequence
  Synthetic Polynucleotide
taatacgactcactatagggacgcgcggcttccgtcgttgccgcgccttgaacagaggagacaaggcatggcaacgacgaacctggcggcagcgcaaaagatg

SEQ ID NO: 171157 - DNA, 103 bp, Artificial Sequence
  Synthetic Polynucleotide
taatacgactcactatagggctccagtcgcaggatgtccttgaccgagaaaacagaggagattctcgatgaaggacatcaacctggcggcagcgcaaaagatg

SEQ ID NO: 171158 - DNA, 103 bp, Artificial Sequence
  Synthetic Polynucleotide
taatacgactcactatagggcgaaaagagcacgcgcggcttccgtcgttgaacagaggagacaacgaatgaagccgcgcaacctggcggcagcgcaaaagatg

SEQ ID NO: 171159 - DNA, 103 bp, Artificial Sequence
  Synthetic Polynucleotide
taatacgactcactatagggcctgcgcctgcgaaaagagcacgcgcggctaacagaggagaagccgcatgtgctcttttaacctggcggcagcgcaaaagatg

SEQ ID NO: 171160 - DNA, 103 bp, Artificial Sequence
  Synthetic Polynucleotide
taatacgactcactatagggagggccagcacctgcgcctgcgaaaagagcaacagaggagagctcttatggcaggcgcaaacctggcggcagcgcaaaagatg

SEQ ID NO: 171161 - DNA, 103 bp, Artificial Sequence
  Synthetic Polynucleotide
taatacgactcactataggggcgccgctccagggccagcacctgcgcctgaacagaggagacaggcgatggtgctggccaacctggcggcagcgcaaaagatg

SEQ ID NO: 171162 - DNA, 103 bp, Artificial Sequence
  Synthetic Polynucleotide
taatacgactcactataggggctgcttgaagcgccgctccagggccagcaaacagaggagatgctggatgtggagcggcaacctggcggcagcgcaaaagatg

SEQ ID NO: 171163 - DNA, 103 bp, Artificial Sequence
  Synthetic Polynucleotide
taatacgactcactatagggaggtaccgctgctgcttgaagcgccgctccaacagaggagaggagcgatgcttcaagcaaacctggcggcagcgcaaaagatg

SEQ ID NO: 171164 - DNA, 103 bp, Artificial Sequence
  Synthetic Polynucleotide
taatacgactcactataggggggcgctgacaggtaccgctgctgcttgaaaacagaggagattcaagatgcagcggtacaacctggcggcagcgcaaaagatg

SEQ ID NO: 171165 - DNA, 103 bp, Artificial Sequence
  Synthetic Polynucleotide
taatacgactcactataggggctcgcgctcgggcgctgacaggtaccgctaacagaggagaagcggtatgtgtcagcgcaacctggcggcagcgcaaaagatg

SEQ ID NO: 171166 - DNA, 103 bp, Artificial Sequence
  Synthetic Polynucleotide
taatacgactcactatagggctggccaggtgctcgcgctcgggcgctgacaacagaggagagtcagcatgcgagcgcgaaacctggcggcagcgcaaaagatg

SEQ ID NO: 171167 - DNA, 103 bp, Artificial Sequence
  Synthetic Polynucleotide
taatacgactcactatagggctgcagcgcgctggccaggtgctcgcgctcaacagaggagagagcgcatgcacctggccaacctggcggcagcgcaaaagatg

SEQ ID NO: 171168 - DNA, 103 bp, Artificial Sequence
  Synthetic Polynucleotide
taatacgactcactatagggtccgctcgcgctccagtcgcaggatgtcctaacagaggagaaggacaatgtgcgactggaacctggcggcagcgcaaaagatg

SEQ ID NO: 171169 - DNA, 103 bp, Artificial Sequence
  Synthetic Polynucleotide
taatacgactcactatagggtggacgtgagctgcagcgcgctggccaggtaacagaggagaacctggatggcgcgctgcaacctggcggcagcgcaaaagatg

SEQ ID NO: 171170 - DNA, 103 bp, Artificial Sequence
  Synthetic Polynucleotide
taatacgactcactatagggttgacctgcgtggacgtgagctgcagcgcgaacagaggagacgcgctatggctcacgtcaacctggcggcagcgcaaaagatg

SEQ ID NO: 171171 - DNA, 103 bp, Artificial Sequence
  Synthetic Polynucleotide
taatacgactcactataggggaaccagatcttgacctgcgtggacgtgagaacagaggagactcacgatgacgcaggtcaacctggcggcagcgcaaaagatg

SEQ ID NO: 171172 - DNA, 103 bp, Artificial Sequence
  Synthetic Polynucleotide
taatacgactcactataggggtcggttctggaaccagatcttgacctgcgaacagaggagacgcaggatgagatctggtaacctggcggcagcgcaaaagatg

SEQ ID NO: 171173 - DNA, 103 bp, Artificial Sequence
  Synthetic Polynucleotide
taatacgactcactatagggcatttgtagcgtcggttctggaaccagatcaacagaggagagatctgatgccagaaccgaacctggcggcagcgcaaaagatg

SEQ ID NO: 171174 - DNA, 103 bp, Artificial Sequence
  Synthetic Polynucleotide
taatacgactcactatagggctgtctcttgcatttgtagcgtcggttctgaacagaggagacagaacatgcgctacaaaaacctggcggcagcgcaaaagatg

SEQ ID NO: 171175 - DNA, 103 bp, Artificial Sequence
  Synthetic Polynucleotide
taatacgactcactatagggtgtcctggcgctgtctcttgcatttgtagcaacagaggagagctacaatggcaagagacaacctggcggcagcgcaaaagatg

SEQ ID NO: 171176 - DNA, 103 bp, Artificial Sequence
  Synthetic Polynucleotide
taatacgactcactatagggtccagcgacttgtcctggcgctgtctcttgaacagaggagacaagagatggcgccaggaaacctggcggcagcgcaaaagatg

SEQ ID NO: 171177 - DNA, 103 bp, Artificial Sequence
  Synthetic Polynucleotide
taatacgactcactataggggccagccagttccagcgacttgtcctggcgaacagaggagacgccagatgaagtcgctgaacctggcggcagcgcaaaagatg

SEQ ID NO: 171178 - DNA, 103 bp, Artificial Sequence
  Synthetic Polynucleotide
taatacgactcactatagggttagagggtggccagccagttccagcgactaacagaggagaagtcgcatgaactggctgaacctggcggcagcgcaaaagatg

SEQ ID NO: 171179 - DNA, 103 bp, Artificial Sequence
  Synthetic Polynucleotide
taatacgactcactataggggcggggcagctccgctcgcgctccagtcgcaacagaggagagcgactatggcgcgagcgaacctggcggcagcgcaaaagatg

SEQ ID NO: 171180 - DNA, 103 bp, Artificial Sequence
  Synthetic Polynucleotide
taatacgactcactatagggcggcgcggcgttagagggtggccagccagtaacagaggagaactggcatgccaccctctaacctggcggcagcgcaaaagatg

SEQ ID NO: 171181 - DNA, 103 bp, Artificial Sequence
  Synthetic Polynucleotide
taatacgactcactatagggcacagctactcggcgcggcgttagagggtgaacagaggagacaccctatgacgccgcgcaacctggcggcagcgcaaaagatg

SEQ ID NO: 171182 - DNA, 103 bp, Artificial Sequence
  Synthetic Polynucleotide
taatacgactcactatagggccaggacgggcacagctactcggcgcggcgaacagaggagacgccgcatggagtagctgaacctggcggcagcgcaaaagatg

SEQ ID NO: 171183 - DNA, 103 bp, Artificial Sequence
  Synthetic Polynucleotide
taatacgactcactatagggccatcgcgcaccaggacgggcacagctactaacagaggagaagtagcatggcccgtcctaacctggcggcagcgcaaaagatg

SEQ ID NO: 171184 - DNA, 103 bp, Artificial Sequence
  Synthetic Polynucleotide
taatacgactcactataggggcagggcttgccatcgcgcaccaggacgggaacagaggagacccgtcatggtgcgcgataacctggcggcagcgcaaaagatg

SEQ ID NO: 171185 - DNA, 103 bp, Artificial Sequence
  Synthetic Polynucleotide
taatacgactcactatagggcggggcccaggcagggcttgccatcgcgcaaacagaggagatgcgcgatggcaagccctaacctggcggcagcgcaaaagatg

SEQ ID NO: 171186 - DNA, 103 bp, Artificial Sequence
  Synthetic Polynucleotide
taatacgactcactataggggcgccgggcccggggcccaggcagggcttgaacagaggagacaagccatgcctgggcccaacctggcggcagcgcaaaagatg

SEQ ID NO: 171187 - DNA, 103 bp, Artificial Sequence
  Synthetic Polynucleotide
taatacgactcactataggggaaggcaggtgcgccgggcccggggcccagaacagaggagactgggcatggggcccggcaacctggcggcagcgcaaaagatg

SEQ ID NO: 171188 - DNA, 103 bp, Artificial Sequence
  Synthetic Polynucleotide
taatacgactcactatagggaggggctggggaaggcaggtgcgccgggccaacagaggagaggcccgatgcacctgcctaacctggcggcagcgcaaaagatg

SEQ ID NO: 171189 - DNA, 103 bp, Artificial Sequence
  Synthetic Polynucleotide
taatacgactcactataggggctgcactgtaggggctggggaaggcaggtaacagaggagaacctgcatgccccagcccaacctggcggcagcgcaaaagatg

SEQ ID NO: 171190 - DNA, 103 bp, Artificial Sequence
  Synthetic Polynucleotide
taatacgactcactatagggtggcgaagccgcggggcagctccgctcgcgaacagaggagacgcgagatgagctgccccaacctggcggcagcgcaaaagatg

SEQ ID NO: 171191 - DNA, 103 bp, Artificial Sequence
  Synthetic Polynucleotide
taatacgactcactataggggggcgacactgctgcactgtaggggctgggaacagaggagacccagcatgtacagtgcaaacctggcggcagcgcaaaagatg

SEQ ID NO: 171192 - DNA, 103 bp, Artificial Sequence
  Synthetic Polynucleotide
taatacgactcactatagggagcaagagtagggcgacactgctgcactgtaacagaggagaacagtgatgcagtgtcgcaacctggcggcagcgcaaaagatg

SEQ ID NO: 171193 - DNA, 103 bp, Artificial Sequence
  Synthetic Polynucleotide
taatacgactcactatagggtagcctccgtagcaagagtagggcgacactaacagaggagaagtgtcatgctactcttgaacctggcggcagcgcaaaagatg

SEQ ID NO: 171194 - DNA, 103 bp, Artificial Sequence
  Synthetic Polynucleotide
taatacgactcactatagggtgctccgctgtagcctccgtagcaagagtaaacagaggagatactctatgtacggaggcaacctggcggcagcgcaaaagatg

SEQ ID NO: 171195 - DNA, 103 bp, Artificial Sequence
  Synthetic Polynucleotide
taatacgactcactatagggcgccgtagggtgctccgctgtagcctccgtaacagaggagaacggagatgacagcggagaacctggcggcagcgcaaaagatg

SEQ ID NO: 171196 - DNA, 103 bp, Artificial Sequence
  Synthetic Polynucleotide
taatacgactcactatagggccgtagcctgcgccgtagggtgctccgctgaacagaggagacagcggatgaccctacggaacctggcggcagcgcaaaagatg

SEQ ID NO: 171197 - DNA, 103 bp, Artificial Sequence
  Synthetic Polynucleotide
taatacgactcactataggggtagcaggtgccgtagcctgcgccgtagggaacagaggagaccctacatggcaggctacaacctggcggcagcgcaaaagatg

SEQ ID NO: 171198 - DNA, 103 bp, Artificial Sequence
  Synthetic Polynucleotide
taatacgactcactataggggcgcgcccgcgtagcaggtgccgtagcctgaacagaggagacaggctatggcacctgctaacctggcggcagcgcaaaagatg

SEQ ID NO: 171199 - DNA, 103 bp, Artificial Sequence
  Synthetic Polynucleotide
taatacgactcactatagggggacccgagggcgcgcccgcgtagcaggtgaacagaggagacacctgatgcgcgggcgcaacctggcggcagcgcaaaagatg

SEQ ID NO: 171200 - DNA, 103 bp, Artificial Sequence
  Synthetic Polynucleotide
taatacgactcactataggggtgtggcgcaggacccgagggcgcgcccgcaacagaggagagcgggcatgccctcgggtaacctggcggcagcgcaaaagatg

SEQ ID NO: 171201 - DNA, 103 bp, Artificial Sequence
  Synthetic Polynucleotide
taatacgactcactatagggcccgcggatgtggcgaagccgcggggcagcaacagaggagagctgccatgcggcttcgcaacctggcggcagcgcaaaagatg

SEQ ID NO: 171202 - DNA, 103 bp, Artificial Sequence
  Synthetic Polynucleotide
taatacgactcactatagggccagtggtgtgtgtggcgcaggacccgaggaacagaggagacctcggatgctgcgccacaacctggcggcagcgcaaaagatg

SEQ ID NO: 171203 - DNA, 103 bp, Artificial Sequence
  Synthetic Polynucleotide
taatacgactcactatagggcccgcgctggccagtggtgtgtgtggcgcaaacagaggagatgcgccatgcacaccactaacctggcggcagcgcaaaagatg

SEQ ID NO: 171204 - DNA, 103 bp, Artificial Sequence
  Synthetic Polynucleotide
taatacgactcactataggggtgtccgaagcccgcgctggccagtggtgtaacagaggagaacaccaatggccagcgcgaacctggcggcagcgcaaaagatg

SEQ ID NO: 171205 - DNA, 103 bp, Artificial Sequence
  Synthetic Polynucleotide
taatacgactcactatagggtctggccaccgtgtccgaagcccgcgctggaacagaggagaccagcgatggcttcggacaacctggcggcagcgcaaaagatg

SEQ ID NO: 171206 - DNA, 103 bp, Artificial Sequence
  Synthetic Polynucleotide
taatacgactcactatagggggggtggcattctggccaccgtgtccgaagaacagaggagacttcggatgcggtggccaaacctggcggcagcgcaaaagatg

SEQ ID NO: 171207 - DNA, 103 bp, Artificial Sequence
  Synthetic Polynucleotide
taatacgactcactatagggatggccctgcggggtggcattctggccaccaacagaggagaggtggcatgaatgccaccaacctggcggcagcgcaaaagatg

SEQ ID NO: 171208 - DNA, 103 bp, Artificial Sequence
  Synthetic Polynucleotide
taatacgactcactatagggtggctgccagatggccctgcggggtggcataacagaggagaatgccaatgcgcagggccaacctggcggcagcgcaaaagatg

SEQ ID NO: 171209 - DNA, 103 bp, Artificial Sequence
  Synthetic Polynucleotide
taatacgactcactatagggccctgcagcgtggctgccagatggccctgcaacagaggagagcagggatgtctggcagcaacctggcggcagcgcaaaagatg

SEQ ID NO: 171210 - DNA, 103 bp, Artificial Sequence
  Synthetic Polynucleotide
taatacgactcactatagggggccctgacaccctgcagcgtggctgccagaacagaggagactggcaatgacgctgcagaacctggcggcagcgcaaaagatg

SEQ ID NO: 171211 - DNA, 103 bp, Artificial Sequence
  Synthetic Polynucleotide
taatacgactcactatagggctcttccgcacccgcggatgtggcgaagccaacagaggagaggcttcatgacatccgcgaacctggcggcagcgcaaaagatg

SEQ ID NO: 171212 - DNA, 103 bp, Artificial Sequence
  Synthetic Polynucleotide
taatacgactcactatagggggtgaagctcaggcgtccagaggtggccataacagaggagaatggccatgtctggacgcaacctggcggcagcgcaaaagatg

SEQ ID NO: 171213 - DNA, 103 bp, Artificial Sequence
  Synthetic Polynucleotide
taatacgactcactataggggcaggggtcgggctggggggcgcgtggttcaacagaggagagaaccaatggccccccagaacctggcggcagcgcaaaagatg

SEQ ID NO: 171214 - DNA, 103 bp, Artificial Sequence
  Synthetic Polynucleotide
taatacgactcactataggggccaggcggcgcaggggtcgggctggggggaacagaggagaccccccatgccgacccctaacctggcggcagcgcaaaagatg

SEQ ID NO: 171215 - DNA, 103 bp, Artificial Sequence
  Synthetic Polynucleotide
taatacgactcactatagggtccgaatccagccaggcggcgcaggggtcgaacagaggagacgacccatgcgccgcctgaacctggcggcagcgcaaaagatg

SEQ ID NO: 171216 - DNA, 103 bp, Artificial Sequence
  Synthetic Polynucleotide
taatacgactcactataggggtggccgcgctccgaatccagccaggcggcaacagaggagagccgccatgctggattcgaacctggcggcagcgcaaaagatg

SEQ ID NO: 171217 - DNA, 103 bp, Artificial Sequence
  Synthetic Polynucleotide
taatacgactcactatagggaggaagggtagtggccgcgctccgaatccaaacagaggagatggattatgagcgcggccaacctggcggcagcgcaaaagatg

SEQ ID NO: 171218 - DNA, 103 bp, Artificial Sequence
  Synthetic Polynucleotide
taatacgactcactatagggctctcgtccgaggaagggtagtggccgcgcaacagaggagagcgcggatgctacccttcaacctggcggcagcgcaaaagatg

SEQ ID NO: 171219 - DNA, 103 bp, Artificial Sequence
  Synthetic Polynucleotide
taatacgactcactatagggctccaggctgctctcgtccgaggaagggtaaacagaggagataccctatgtcggacgagaacctggcggcagcgcaaaagatg

SEQ ID NO: 171220 - DNA, 103 bp, Artificial Sequence
  Synthetic Polynucleotide
taatacgactcactataggggcgggctggtctccaggctgctctcgtccgaacagaggagacggacgatggcagcctggaacctggcggcagcgcaaaagatg

SEQ ID NO: 171221 - DNA, 103 bp, Artificial Sequence
  Synthetic Polynucleotide
taatacgactcactataggggacgagtctggcgggctggtctccaggctgaacagaggagacagcctatggaccagcccaacctggcggcagcgcaaaagatg

SEQ ID NO: 171222 - DNA, 103 bp, Artificial Sequence
  Synthetic Polynucleotide
taatacgactcactatagggcggccgctgcgacgagtctggcgggctggtaacagaggagaaccagcatgccagactcgaacctggcggcagcgcaaaagatg

SEQ ID NO: 171223 - DNA, 103 bp, Artificial Sequence
  Synthetic Polynucleotide
taatacgactcactatagggggctgcgcacggtgaagctcaggcgtccagaacagaggagactggacatgtgagcttcaaacctggcggcagcgcaaaagatg

SEQ ID NO: 171224 - DNA, 103 bp, Artificial Sequence
  Synthetic Polynucleotide
taatacgactcactataggggcctagcggacggccgctgcgacgagtctgaacagaggagacagactatgcgcagcggcaacctggcggcagcgcaaaagatg

SEQ ID NO: 171225 - DNA, 103 bp, Artificial Sequence
  Synthetic Polynucleotide
taatacgactcactatagggggagacgcgggcctagcggacggccgctgcaacagaggagagcagcgatggtccgctagaacctggcggcagcgcaaaagatg

SEQ ID NO: 171226 - DNA, 103 bp, Artificial Sequence
  Synthetic Polynucleotide
taatacgactcactataggggtccgagcccggagacgcgggcctagcggaaacagaggagatccgctatgcccgcgtctaacctggcggcagcgcaaaagatg

SEQ ID NO: 171227 - DNA, 103 bp, Artificial Sequence
  Synthetic Polynucleotide
taatacgactcactatagggttttctcggcgtccgagcccggagacgcggaacagaggagaccgcgtatgcgggctcggaacctggcggcagcgcaaaagatg

SEQ ID NO: 171228 - DNA, 103 bp, Artificial Sequence
  Synthetic Polynucleotide
taatacgactcactatagggcgcttcttccttttctcggcgtccgagcccaacagaggagagggctcatgcgccgagaaaacctggcggcagcgcaaaagatg

SEQ ID NO: 171229 - DNA, 103 bp, Artificial Sequence
  Synthetic Polynucleotide
taatacgactcactatagggtagcacccgccgcttcttccttttctcggcaacagaggagagccgagatgaggaagaagaacctggcggcagcgcaaaagatg

SEQ ID NO: 171230 - DNA, 103 bp, Artificial Sequence
  Synthetic Polynucleotide
taatacgactcactatagggccttggagaatagcacccgccgcttcttccaacagaggagaggaagaatgggcgggtgcaacctggcggcagcgcaaaagatg

SEQ ID NO: 171231 - DNA, 103 bp, Artificial Sequence
  Synthetic Polynucleotide
taatacgactcactatagggagcgtctgcgccttggagaatagcacccgcaacagaggagagcgggtatgattctccaaaacctggcggcagcgcaaaagatg

SEQ ID NO: 171232 - DNA, 103 bp, Artificial Sequence
  Synthetic Polynucleotide
taatacgactcactatagggctccaactccagcgtctgcgccttggagaaaacagaggagattctccatggcgcagacgaacctggcggcagcgcaaaagatg

SEQ ID NO: 171233 - DNA, 103 bp, Artificial Sequence
  Synthetic Polynucleotide
taatacgactcactatagggggaagcgccgctccaactccagcgtctgcgaacagaggagacgcagaatgtggagttggaacctggcggcagcgcaaaagatg

SEQ ID NO: 171234 - DNA, 103 bp, Artificial Sequence
  Synthetic Polynucleotide
taatacgactcactatagggaaatctagaaggctgcgcacggtgaagctcaacagaggagagagcttatgcgtgcgcagaacctggcggcagcgcaaaagatg

SEQ ID NO: 171235 - DNA, 103 bp, Artificial Sequence
  Synthetic Polynucleotide
taatacgactcactatagggcgctgctgccggaagcgccgctccaactccaacagaggagaggagttatggcggcgcttaacctggcggcagcgcaaaagatg

SEQ ID NO: 171236 - DNA, 103 bp, Artificial Sequence
  Synthetic Polynucleotide
taatacgactcactatagggagacaggtaccgctgctgccggaagcgccgaacagaggagacggcgcatgcggcagcagaacctggcggcagcgcaaaagatg

SEQ ID NO: 171237 - DNA, 103 bp, Artificial Sequence
  Synthetic Polynucleotide
taatacgactcactataggggctcgggcgcagacaggtaccgctgctgccaacagaggagaggcagcatgggtacctgtaacctggcggcagcgcaaaagatg

SEQ ID NO: 171238 - DNA, 103 bp, Artificial Sequence
  Synthetic Polynucleotide
taatacgactcactatagggagctgctcgcgctcgggcgcagacaggtacaacagaggagagtacctatgtgcgcccgaaacctggcggcagcgcaaaagatg

SEQ ID NO: 171239 - DNA, 103 bp, Artificial Sequence
  Synthetic Polynucleotide
taatacgactcactatagggcaggctcgccagctgctcgcgctcgggcgcaacagaggagagcgcccatgcgcgagcagaacctggcggcagcgcaaaagatg

SEQ ID NO: 171240 - DNA, 103 bp, Artificial Sequence
  Synthetic Polynucleotide
taatacgactcactatagggtgaggcgaagcaggctcgccagctgctcgcaacagaggagagcgagcatgtggcgagccaacctggcggcagcgcaaaagatg

SEQ ID NO: 171241 - DNA, 103 bp, Artificial Sequence
  Synthetic Polynucleotide
taatacgactcactatagggtgcgtgggcgtgaggcgaagcaggctcgccaacagaggagaggcgagatggcttcgcctaacctggcggcagcgcaaaagatg

SEQ ID NO: 171242 - DNA, 103 bp, Artificial Sequence
  Synthetic Polynucleotide
taatacgactcactataggggatcttgacctgcgtgggcgtgaggcgaagaacagaggagacttcgcatgacgcccacgaacctggcggcagcgcaaaagatg

SEQ ID NO: 171243 - DNA, 103 bp, Artificial Sequence
  Synthetic Polynucleotide
taatacgactcactatagggtctggaaccagatcttgacctgcgtgggcgaacagaggagacgcccaatgaggtcaagaaacctggcggcagcgcaaaagatg

SEQ ID NO: 171244 - DNA, 103 bp, Artificial Sequence
  Synthetic Polynucleotide
taatacgactcactatagggtagcgatgattctggaaccagatcttgaccaacagaggagaggtcaaatgctggttccaaacctggcggcagcgcaaaagatg

SEQ ID NO: 171245 - DNA, 103 bp, Artificial Sequence
  Synthetic Polynucleotide
taatacgactcactatagggctgctcgggtaaatctagaaggctgcgcacaacagaggagagtgcgcatgcttctagataacctggcggcagcgcaaaagatg

SEQ ID NO: 171246 - DNA, 103 bp, Artificial Sequence
  Synthetic Polynucleotide
taatacgactcactatagggcttcagcttgtagcgatgattctggaaccaaacagaggagatggttcatgaatcatcgcaacctggcggcagcgcaaaagatg

SEQ ID NO: 171247 - DNA, 103 bp, Artificial Sequence
  Synthetic Polynucleotide
taatacgactcactatagggcgcgagcgcgcttcagcttgtagcgatgataacagaggagaatcatcatgacaagctgaaacctggcggcagcgcaaaagatg

SEQ ID NO: 171248 - DNA, 103 bp, Artificial Sequence
  Synthetic Polynucleotide
taatacgactcactataggggcccctggagcgcgagcgcgcttcagcttgaacagaggagacaagctatggcgcgctcgaacctggcggcagcgcaaaagatg

SEQ ID NO: 171249 - DNA, 103 bp, Artificial Sequence
  Synthetic Polynucleotide
taatacgactcactatagggcgactccgccgcccctggagcgcgagcgcgaacagaggagacgcgctatggctccagggaacctggcggcagcgcaaaagatg

SEQ ID NO: 171250 - DNA, 103 bp, Artificial Sequence
  Synthetic Polynucleotide
taatacgactcactatagggccaggtcaggcgactccgccgcccctggagaacagaggagactccagatgcggcggagtaacctggcggcagcgcaaaagatg

SEQ ID NO: 171251 - DNA, 103 bp, Artificial Sequence
  Synthetic Polynucleotide
taatacgactcactataggggcggatgctgccaggtcaggcgactccgccaacagaggagaggcggaatggcctgacctaacctggcggcagcgcaaaagatg

SEQ ID NO: 171252 - DNA, 103 bp, Artificial Sequence
  Synthetic Polynucleotide
taatacgactcactataggggtgcagctcggcggatgctgccaggtcaggaacagaggagacctgacatggcagcatccaacctggcggcagcgcaaaagatg

SEQ ID NO: 171253 - DNA, 103 bp, Artificial Sequence
  Synthetic Polynucleotide
taatacgactcactatagggcgggcgcggcgtgcagctcggcggatgctgaacagaggagacagcatatgccgagctgcaacctggcggcagcgcaaaagatg

SEQ ID NO: 171254 - DNA, 103 bp, Artificial Sequence
  Synthetic Polynucleotide
taatacgactcactatagggcgcagcaggccgggcgcggcgtgcagctcgaacagaggagacgagctatgcgccgcgccaacctggcggcagcgcaaaagatg

SEQ ID NO: 171255 - DNA, 103 bp, Artificial Sequence
  Synthetic Polynucleotide
taatacgactcactatagggcaccacgcgacgcagcaggccgggcgcggcaacagaggagagccgcgatgggcctgctgaacctggcggcagcgcaaaagatg

SEQ ID NO: 171256 - DNA, 103 bp, Artificial Sequence
  Synthetic Polynucleotide
taatacgactcactataggggttgcgcgtcctgctcgggtaaatctagaaaacagaggagattctagatgtacccgagcaacctggcggcagcgcaaaagatg

SEQ ID NO: 171257 - DNA, 103 bp, Artificial Sequence
  Synthetic Polynucleotide
taatacgactcactataggggcaccggcaccaccacgcgacgcagcaggcaacagaggagagcctgcatggtcgcgtggaacctggcggcagcgcaaaagatg

SEQ ID NO: 171258 - DNA, 103 bp, Artificial Sequence
  Synthetic Polynucleotide
taatacgactcactatagggtcgcgaacaagcaccggcaccaccacgcgaaacagaggagatcgcgtatgggtgccggtaacctggcggcagcgcaaaagatg

SEQ ID NO: 171259 - DNA, 103 bp, Artificial Sequence
  Synthetic Polynucleotide
taatacgactcactatagggcggctgcccgtcgcgaacaagcaccggcacaacagaggagagtgccgatgcttgttcgcaacctggcggcagcgcaaaagatg

SEQ ID NO: 171260 - DNA, 103 bp, Artificial Sequence
  Synthetic Polynucleotide
taatacgactcactatagggcgccgccgcacggctgcccgtcgcgaacaaaacagaggagattgttcatgacgggcagcaacctggcggcagcgcaaaagatg

SEQ ID NO: 171261 - DNA, 103 bp, Artificial Sequence
  Synthetic Polynucleotide
taatacgactcactatagggccaccgccgccgccgccgcacggctgcccgaacagaggagacgggcaatggtgcggcggaacctggcggcagcgcaaaagatg

SEQ ID NO: 171262 - DNA, 103 bp, Artificial Sequence
  Synthetic Polynucleotide
taatacgactcactatagggtcccacctcgccaccgccgccgccgccgcaaacagaggagatgcggcatgggcggcggtaacctggcggcagcgcaaaagatg

SEQ ID NO: 171263 - DNA, 103 bp, Artificial Sequence
  Synthetic Polynucleotide
taatacgactcactatagggccgcggcggttcccacctcgccaccgccgcaacagaggagagcggcgatggcgaggtggaacctggcggcagcgcaaaagatg

SEQ ID NO: 171264 - DNA, 103 bp, Artificial Sequence
  Synthetic Polynucleotide
taatacgactcactatagggttctcctgggccgcggcggttcccacctcgaacagaggagacgaggtatgaaccgccgcaacctggcggcagcgcaaaagatg

SEQ ID NO: 171265 - DNA, 103 bp, Artificial Sequence
  Synthetic Polynucleotide
taatacgactcactatagggggcgccgcacttctcctgggccgcggcggtaacagaggagaaccgccatggcccaggagaacctggcggcagcgcaaaagatg

SEQ ID NO: 171266 - DNA, 103 bp, Artificial Sequence
  Synthetic Polynucleotide
taatacgactcactatagggcggctggaggggcgccgcacttctcctgggaacagaggagacccaggatgagtgcggcgaacctggcggcagcgcaaaagatg

SEQ ID NO: 171267 - DNA, 103 bp, Artificial Sequence
  Synthetic Polynucleotide
taatacgactcactatagggctcggcaggtgttgcgcgtcctgctcgggtaacagaggagaacccgaatgggacgcgcaaacctggcggcagcgcaaaagatg

SEQ ID NO: 171268 - DNA, 103 bp, Artificial Sequence
  Synthetic Polynucleotide
taatacgactcactataggggggcaggcggcggctggaggggcgccgcacaacagaggagagtgcggatgccctccagcaacctggcggcagcgcaaaagatg

SEQ ID NO: 171269 - DNA, 103 bp, Artificial Sequence
  Synthetic Polynucleotide
taatacgactcactataggggcccggcagagggcaggcggcggctggaggaacagaggagacctccaatggccgcctgcaacctggcggcagcgcaaaagatg

SEQ ID NO: 171270 - DNA, 103 bp, Artificial Sequence
  Synthetic Polynucleotide
taatacgactcactatagggaggcagggtagcccggcagagggcaggcggaacagaggagaccgcctatgctctgccggaacctggcggcagcgcaaaagatg

SEQ ID NO: 171271 - DNA, 103 bp, Artificial Sequence
  Synthetic Polynucleotide
taatacgactcactatagggccgggaccgaaggcagggtagcccggcagaaacagaggagatctgccatgctaccctgcaacctggcggcagcgcaaaagatg

SEQ ID NO: 171272 - DNA, 103 bp, Artificial Sequence
  Synthetic Polynucleotide
taatacgactcactatagggaagcgccgagccgggaccgaaggcagggtaaacagaggagataccctatgttcggtcccaacctggcggcagcgcaaaagatg

SEQ ID NO: 171273 - DNA, 103 bp, Artificial Sequence
  Synthetic Polynucleotide
taatacgactcactatagggggaagaggccaagcgccgagccgggaccgaaacagaggagatcggtcatggctcggcgcaacctggcggcagcgcaaaagatg

SEQ ID NO: 171274 - DNA, 103 bp, Artificial Sequence
  Synthetic Polynucleotide
taatacgactcactatagggtggtaggcggggaagaggccaagcgccgagaacagaggagactcggcatgtggcctcttaacctggcggcagcgcaaaagatg

SEQ ID NO: 171275 - DNA, 103 bp, Artificial Sequence
  Synthetic Polynucleotide
taatacgactcactatagggtgctaagtgctggtaggcggggaagaggccaacagaggagaggcctcatgcccgcctacaacctggcggcagcgcaaaagatg

SEQ ID NO: 171276 - DNA, 103 bp, Artificial Sequence
  Synthetic Polynucleotide
taatacgactcactataggggggcgggggatgctaagtgctggtaggcggaacagaggagaccgcctatgagcacttagaacctggcggcagcgcaaaagatg

SEQ ID NO: 171277 - DNA, 103 bp, Artificial Sequence
  Synthetic Polynucleotide
taatacgactcactatagggcaggagaccagggcgggggatgctaagtgcaacagaggagagcacttatgatcccccgcaacctggcggcagcgcaaaagatg

SEQ ID NO: 171278 - DNA, 103 bp, Artificial Sequence
  Synthetic Polynucleotide
taatacgactcactatagggtggctcccgcctcggcaggtgttgcgcgtcaacagaggagagacgcgatgcacctgccgaacctggcggcagcgcaaaagatg

SEQ ID NO: 171279 - DNA, 103 bp, Artificial Sequence
  Synthetic Polynucleotide
taatacgactcactatagggtcaccagttccaggagaccagggcgggggaaacagaggagatcccccatgctggtctccaacctggcggcagcgcaaaagatg

SEQ ID NO: 171280 - DNA, 103 bp, Artificial Sequence
  Synthetic Polynucleotide
taatacgactcactatagggcgcgtggttctggctcccgcctcggcaggtaacagaggagaacctgcatgggcgggagcaacctggcggcagcgcaaaagatg

SEQ ID NO: 171281 - DNA, 103 bp, Artificial Sequence
  Synthetic Polynucleotide
taatacgactcactatagggggctggggggcgcgtggttctggctcccgcaacagaggagagcgggaatgagaaccacgaacctggcggcagcgcaaaagatg

SEQ ID NO: 171282 - DNA, 103 bp, Artificial Sequence
  Synthetic Polynucleotide
taatacgactcactatagggcccgggccgcggctccggaaccctgagcataacagaggagaatgctcatggttccggagaacctggcggcagcgcaaaagatg

SEQ ID NO: 171283 - DNA, 103 bp, Artificial Sequence
  Synthetic Polynucleotide
taatacgactcactatagggctgcgcgccgtcccgcaggatgtcctggataacagaggagaatccagatgatcctgcggaacctggcggcagcgcaaaagatg

SEQ ID NO: 171284 - DNA, 103 bp, Artificial Sequence
  Synthetic Polynucleotide
taatacgactcactatagggcgccttgccgctgcgcgccgtcccgcaggaaacagaggagatcctgcatgacggcgcgcaacctggcggcagcgcaaaagatg

SEQ ID NO: 171285 - DNA, 103 bp, Artificial Sequence
  Synthetic Polynucleotide
taatacgactcactatagggctcgtgcggccgccttgccgctgcgcgccgaacagaggagacggcgcatggcggcaaggaacctggcggcagcgcaaaagatg

SEQ ID NO: 171286 - DNA, 103 bp, Artificial Sequence
  Synthetic Polynucleotide
taatacgactcactatagggtctctggctgctcgtgcggccgccttgccgaacagaggagacggcaaatgggccgcacgaacctggcggcagcgcaaaagatg

SEQ ID NO: 171287 - DNA, 103 bp, Artificial Sequence
  Synthetic Polynucleotide
taatacgactcactatagggggtcgcgctgtctctggctgctcgtgcggcaacagaggagagccgcaatggcagccagaaacctggcggcagcgcaaaagatg

SEQ ID NO: 171288 - DNA, 103 bp, Artificial Sequence
  Synthetic Polynucleotide
taatacgactcactatagggtccggctccgggtcgcgctgtctctggctgaacagaggagacagccaatgacagcgcgaaacctggcggcagcgcaaaagatg

SEQ ID NO: 171289 - DNA, 103 bp, Artificial Sequence
  Synthetic Polynucleotide
taatacgactcactatagggtggctctggctccggctccgggtcgcgctgaacagaggagacagcgcatgccggagccgaacctggcggcagcgcaaaagatg

SEQ ID NO: 171290 - DNA, 103 bp, Artificial Sequence
  Synthetic Polynucleotide
taatacgactcactatagggcctctggctctggctctggctccggctccgaacagaggagacggagcatgagccagagcaacctggcggcagcgcaaaagatg

SEQ ID NO: 171291 - DNA, 103 bp, Artificial Sequence
  Synthetic Polynucleotide
taatacgactcactatagggctgcgtcctccctctggctctggctctggcaacagaggagagccagaatgagagccagaaacctggcggcagcgcaaaagatg

SEQ ID NO: 171292 - DNA, 103 bp, Artificial Sequence
  Synthetic Polynucleotide
taatacgactcactatagggcccggcgcggctgcgtcctccctctggctcaacagaggagagagccaatgggaggacgcaacctggcggcagcgcaaaagatg

SEQ ID NO: 171293 - DNA, 103 bp, Artificial Sequence
  Synthetic Polynucleotide
taatacgactcactatagggctttcgcctccccgggccgcggctccggaaaacagaggagattccggatgcgcggcccgaacctggcggcagcgcaaaagatg

SEQ ID NO: 171294 - DNA, 103 bp, Artificial Sequence
  Synthetic Polynucleotide
taatacgactcactatagggcgttctgcgccccggcgcggctgcgtcctcaacagaggagagaggacatggccgcgccgaacctggcggcagcgcaaaagatg

SEQ ID NO: 171295 - DNA, 103 bp, Artificial Sequence
  Synthetic Polynucleotide
taatacgactcactatagggctcagctggtcgttctgcgccccggcgcggaacagaggagaccgcgcatgggcgcagaaaacctggcggcagcgcaaaagatg

SEQ ID NO: 171296 - DNA, 103 bp, Artificial Sequence
  Synthetic Polynucleotide
taatacgactcactataggggggcccggtgctcagctggtcgttctgcgcaacagaggagagcgcagatggaccagctgaacctggcggcagcgcaaaagatg

SEQ ID NO: 171297 - DNA, 103 bp, Artificial Sequence
  Synthetic Polynucleotide
taatacgactcactataggggcgcggcgcggggcccggtgctcagctggtaacagaggagaaccagcatggcaccgggcaacctggcggcagcgcaaaagatg

SEQ ID NO: 171298 - DNA, 103 bp, Artificial Sequence
  Synthetic Polynucleotide
taatacgactcactataggggcctcctccggcgcggcgcggggcccggtgaacagaggagacaccggatgccgcgccgcaacctggcggcagcgcaaaagatg

SEQ ID NO: 171299 - DNA, 103 bp, Artificial Sequence
  Synthetic Polynucleotide
taatacgactcactatagggcagcgtctcggcctcctccggcgcggcgcgaacagaggagacgcgccatgccggaggagaacctggcggcagcgcaaaagatg

SEQ ID NO: 171300 - DNA, 103 bp, Artificial Sequence
  Synthetic Polynucleotide
taatacgactcactatagggcggtctctgccagcgtctcggcctcctccgaacagaggagacggaggatgccgagacgcaacctggcggcagcgcaaaagatg

SEQ ID NO: 171301 - DNA, 103 bp, Artificial Sequence
  Synthetic Polynucleotide
taatacgactcactatagggctttctggctcggtctctgccagcgtctcgaacagaggagacgagacatgggcagagacaacctggcggcagcgcaaaagatg

SEQ ID NO: 171302 - DNA, 103 bp, Artificial Sequence
  Synthetic Polynucleotide
taatacgactcactatagggccccaagtgcctttctggctcggtctctgcaacagaggagagcagagatggagccagaaaacctggcggcagcgcaaaagatg

SEQ ID NO: 171303 - DNA, 103 bp, Artificial Sequence
  Synthetic Polynucleotide
taatacgactcactatagggacagataagaccccaagtgcctttctggctaacagaggagaagccagatgggcacttggaacctggcggcagcgcaaaagatg

SEQ ID NO: 171304 - DNA, 103 bp, Artificial Sequence
  Synthetic Polynucleotide
taatacgactcactataggggccccctccgctttcgcctccccgggccgcaacagaggagagcggccatgggaggcgaaaacctggcggcagcgcaaaagatg

SEQ ID NO: 171305 - DNA, 103 bp, Artificial Sequence
  Synthetic Polynucleotide
taatacgactcactatagggtcagagtccaacagataagaccccaagtgcaacagaggagagcacttatggtcttatctaacctggcggcagcgcaaaagatg

SEQ ID NO: 171306 - DNA, 103 bp, Artificial Sequence
  Synthetic Polynucleotide
taatacgactcactatagggtgaagtgttttcagagtccaacagataagaaacagaggagatcttatatgttggactctaacctggcggcagcgcaaaagatg

SEQ ID NO: 171307 - DNA, 103 bp, Artificial Sequence
  Synthetic Polynucleotide
taatacgactcactataggggaagggcgcctgaagtgttttcagagtccaaacagaggagatggactatgaaaacacttaacctggcggcagcgcaaaagatg

SEQ ID NO: 171308 - DNA, 103 bp, Artificial Sequence
  Synthetic Polynucleotide
taatacgactcactatagggggaagccttggaagggcgcctgaagtgtttaacagaggagaaaacacatgaggcgccctaacctggcggcagcgcaaaagatg

SEQ ID NO: 171309 - DNA, 103 bp, Artificial Sequence
  Synthetic Polynucleotide
taatacgactcactatagggaggggtttggggaagccttggaagggcgccaacagaggagaggcgccatgccaaggcttaacctggcggcagcgcaaaagatg

SEQ ID NO: 171310 - DNA, 103 bp, Artificial Sequence
  Synthetic Polynucleotide
taatacgactcactataggggcggctgcttaggggtttggggaagccttgaacagaggagacaaggcatgcccaaacccaacctggcggcagcgcaaaagatg

SEQ ID NO: 171311 - DNA, 103 bp, Artificial Sequence
  Synthetic Polynucleotide
taatacgactcactataggggagcgcttctgcggctgcttaggggtttggaacagaggagaccaaacatgtaagcagccaacctggcggcagcgcaaaagatg

SEQ ID NO: 171312 - DNA, 103 bp, Artificial Sequence
  Synthetic Polynucleotide
taatacgactcactatagggggcagctcgggagcgcttctgcggctgcttaacagaggagaaagcagatgcagaagcgcaacctggcggcagcgcaaaagatg

SEQ ID NO: 171313 - DNA, 103 bp, Artificial Sequence
  Synthetic Polynucleotide
taatacgactcactatagggtgtgggagaaggcagctcgggagcgcttctaacagaggagaagaagcatgcccgagctgaacctggcggcagcgcaaaagatg

SEQ ID NO: 171314 - DNA, 103 bp, Artificial Sequence
  Synthetic Polynucleotide
taatacgactcactatagggatcacctgagtgtgggagaaggcagctcggaacagaggagaccgagcatgcttctcccaaacctggcggcagcgcaaaagatg

SEQ ID NO: 171315 - DNA, 103 bp, Artificial Sequence
  Synthetic Polynucleotide
taatacgactcactatagggcggcggcgcggccccctccgctttcgcctcaacagaggagagaggcgatggcggaggggaacctggcggcagcgcaaaagatg

SEQ ID NO: 171316 - DNA, 103 bp, Artificial Sequence
  Synthetic Polynucleotide
taatacgactcactatagggctccaactcgatcacctgagtgtgggagaaaacagaggagattctccatgactcaggtgaacctggcggcagcgcaaaagatg

SEQ ID NO: 171317 - DNA, 103 bp, Artificial Sequence
  Synthetic Polynucleotide
taatacgactcactatagggtgaacttcctctccaactcgatcacctgagaacagaggagactcaggatgtcgagttggaacctggcggcagcgcaaaagatg

SEQ ID NO: 171318 - DNA, 103 bp, Artificial Sequence
  Synthetic Polynucleotide
taatacgactcactatagggttctgatggctgaacttcctctccaactcgaacagaggagacgagttatggaggaagttaacctggcggcagcgcaaaagatg

SEQ ID NO: 171319 - DNA, 103 bp, Artificial Sequence
  Synthetic Polynucleotide
taatacgactcactatagggcgacaggtacttctgatggctgaacttcctaacagaggagaaggaagatgagccatcagaacctggcggcagcgcaaaagatg

SEQ ID NO: 171320 - DNA, 103 bp, Artificial Sequence
  Synthetic Polynucleotide
taatacgactcactataggggttcaggggccgacaggtacttctgatggcaacagaggagagccatcatgagtacctgtaacctggcggcagcgcaaaagatg

SEQ ID NO: 171321 - DNA, 103 bp, Artificial Sequence
  Synthetic Polynucleotide
taatacgactcactatagggaggtgggcccgttcaggggccgacaggtacaacagaggagagtacctatgggcccctgaaacctggcggcagcgcaaaagatg

SEQ ID NO: 171322 - DNA, 103 bp, Artificial Sequence
  Synthetic Polynucleotide
taatacgactcactataggggttcttggccaggtgggcccgttcaggggcaacagaggagagcccctatgcgggcccacaacctggcggcagcgcaaaagatg

SEQ ID NO: 171323 - DNA, 103 bp, Artificial Sequence
  Synthetic Polynucleotide
taatacgactcactatagggtgagcttgaggttcttggccaggtgggcccaacagaggagagggcccatgtggccaagaaacctggcggcagcgcaaaagatg

SEQ ID NO: 171324 - DNA, 103 bp, Artificial Sequence
  Synthetic Polynucleotide
taatacgactcactatagggtgggtctccgtgagcttgaggttcttggccaacagaggagaggccaaatgcctcaagctaacctggcggcagcgcaaaagatg

SEQ ID NO: 171325 - DNA, 103 bp, Artificial Sequence
  Synthetic Polynucleotide
taatacgactcactatagggtatcttcacttgggtctccgtgagcttgagaacagaggagactcaagatgacggagaccaacctggcggcagcgcaaaagatg

SEQ ID NO: 171326 - DNA, 103 bp, Artificial Sequence
  Synthetic Polynucleotide
taatacgactcactatagggtggacggggtcggcggcgcggccccctccgaacagaggagacggaggatgccgcgccgcaacctggcggcagcgcaaaagatg

SEQ ID NO: 171327 - DNA, 103 bp, Artificial Sequence
  Synthetic Polynucleotide
taatacgactcactatagggtctggaaccatatcttcacttgggtctccgaacagaggagacggagaatgaagtgaagaaacctggcggcagcgcaaaagatg

SEQ ID NO: 171328 - DNA, 103 bp, Artificial Sequence
  Synthetic Polynucleotide
taatacgactcactatagggtagcgtctgttctggaaccatatcttcactaacagaggagaagtgaaatgatggttccaaacctggcggcagcgcaaaagatg

SEQ ID NO: 171329 - DNA, 103 bp, Artificial Sequence
  Synthetic Polynucleotide
taatacgactcactatagggcttagtcttatagcgtctgttctggaaccaaacagaggagatggttcatgaacagacgcaacctggcggcagcgcaaaagatg

SEQ ID NO: 171330 - DNA, 103 bp, Artificial Sequence
  Synthetic Polynucleotide
taatacgactcactataggggctgctttcgcttagtcttatagcgtctgtaacagaggagaacagacatgataagactaaacctggcggcagcgcaaaagatg

SEQ ID NO: 171331 - DNA, 103 bp, Artificial Sequence
  Synthetic Polynucleotide
taatacgactcactatagggtccgaggagagctgctttcgcttagtcttaaacagaggagataagacatggcgaaagcaaacctggcggcagcgcaaaagatg

SEQ ID NO: 171332 - DNA, 103 bp, Artificial Sequence
  Synthetic Polynucleotide
taatacgactcactataggggtctcccagctccgaggagagctgctttcgaacagaggagacgaaagatgctctcctcgaacctggcggcagcgcaaaagatg

SEQ ID NO: 171333 - DNA, 103 bp, Artificial Sequence
  Synthetic Polynucleotide
taatacgactcactataggggcttctccaagtctcccagctccgaggagaaacagaggagatctcctatgagctgggagaacctggcggcagcgcaaaagatg

SEQ ID NO: 171334 - DNA, 103 bp, Artificial Sequence
  Synthetic Polynucleotide
taatacgactcactatagggaaagaggagtgcttctccaagtctcccagcaacagaggagagctgggatgcttggagaaaacctggcggcagcgcaaaagatg

SEQ ID NO: 171335 - DNA, 103 bp, Artificial Sequence
  Synthetic Polynucleotide
taatacgactcactatagggcagggccggcaaagaggagtgcttctccaaaacagaggagattggagatgcactcctctaacctggcggcagcgcaaaagatg

SEQ ID NO: 171336 - DNA, 103 bp, Artificial Sequence
  Synthetic Polynucleotide
taatacgactcactatagggcctcctctttcagggccggcaaagaggagtaacagaggagaactcctatgtgccggcccaacctggcggcagcgcaaaagatg

SEQ ID NO: 171337 - DNA, 103 bp, Artificial Sequence
  Synthetic Polynucleotide
taatacgactcactataggggtgagcggcttggacggggtcggcggcgcgaacagaggagacgcgccatggaccccgtcaacctggcggcagcgcaaaagatg

SEQ ID NO: 171338 - DNA, 103 bp, Artificial Sequence
  Synthetic Polynucleotide
taatacgactcactatagggcgggagaaggcctcctctttcagggccggcaacagaggagagccggcatggaaagaggaaacctggcggcagcgcaaaagatg

SEQ ID NO: 171339 - DNA, 103 bp, Artificial Sequence
  Synthetic Polynucleotide
taatacgactcactatagggcagggaggcccgggagaaggcctcctctttaacagaggagaaaagagatggccttctccaacctggcggcagcgcaaaagatg

SEQ ID NO: 171340 - DNA, 103 bp, Artificial Sequence
  Synthetic Polynucleotide
taatacgactcactatagggacacggagaccagggaggcccgggagaaggaacagaggagaccttctatggggcctcccaacctggcggcagcgcaaaagatg

SEQ ID NO: 171341 - DNA, 103 bp, Artificial Sequence
  Synthetic Polynucleotide
taatacgactcactatagggtagctgttatacacggagaccagggaggccaacagaggagaggcctcatgggtctccgtaacctggcggcagcgcaaaagatg

SEQ ID NO: 171342 - DNA, 103 bp, Artificial Sequence
  Synthetic Polynucleotide
taatacgactcactataggggtagtaaggatagctgttatacacggagacaacagaggagagtctccatgtataacagcaacctggcggcagcgcaaaagatg

SEQ ID NO: 171343 - DNA, 103 bp, Artificial Sequence
  Synthetic Polynucleotide
taatacgactcactatagggacaggtatgggtagtaaggatagctgttataacagaggagaataacaatgatccttactaacctggcggcagcgcaaaagatg

SEQ ID NO: 171344 - DNA, 103 bp, Artificial Sequence
  Synthetic Polynucleotide
taatacgactcactatagggcccacgcagtacaggtatgggtagtaaggaaacagaggagatccttaatgcccatacctaacctggcggcagcgcaaaagatg

SEQ ID NO: 171345 - DNA, 103 bp, Artificial Sequence
  Synthetic Polynucleotide
taatacgactcactataggggctccagctgcccacgcagtacaggtatggaacagaggagaccatacatgtactgcgtgaacctggcggcagcgcaaaagatg

SEQ ID NO: 171346 - DNA, 103 bp, Artificial Sequence
  Synthetic Polynucleotide
taatacgactcactatagggaaaaagctgggctccagctgcccacgcagtaacagaggagaactgcgatggcagctggaaacctggcggcagcgcaaaagatg

SEQ ID NO: 171347 - DNA, 103 bp, Artificial Sequence
  Synthetic Polynucleotide
taatacgactcactataggggaggaaggacgtgagcggcttggacggggtaacagaggagaaccccgatgaagccgctcaacctggcggcagcgcaaaagatg

SEQ ID NO: 171348 - DNA, 103 bp, Artificial Sequence
  Synthetic Polynucleotide
taatacgactcactatagggtgtcctggatgaggaaggacgtgagcggctaacagaggagaagccgcatgcgtccttccaacctggcggcagcgcaaaagatg

SEQ ID NO: 171349 - DNA, 103 bp, Artificial Sequence
  Synthetic Polynucleotide
taatacgactcactatagggtcccgcaggatgtcctggatgaggaaggacaacagaggagagtccttatgcatccaggaaacctggcggcagcgcaaaagatg

SEQ ID NO: 171350 - DNA, 103 bp, Artificial Sequence
  Synthetic Polynucleotide
taatacgactcactatagggcgtcaaggtgttggcgccgcgcacagccataacagaggagaatggctatgcgcggcgccaacctggcggcagcgcaaaagatg

SEQ ID NO: 171351 - DNA, 103 bp, Artificial Sequence
  Synthetic Polynucleotide
taatacgactcactatagggcgctgtgcccccgggcgccgggcgcccctcaacagaggagagaggggatgccggcgcccaacctggcggcagcgcaaaagatg

SEQ ID NO: 171352 - DNA, 103 bp, Artificial Sequence
  Synthetic Polynucleotide
taatacgactcactatagggccaccgatgccgctgtgcccccgggcgccgaacagaggagacggcgcatgggggcacagaacctggcggcagcgcaaaagatg

SEQ ID NO: 171353 - DNA, 103 bp, Artificial Sequence
  Synthetic Polynucleotide
taatacgactcactatagggggagccgcggccaccgatgccgctgtgcccaacagaggagagggcacatgggcatcggtaacctggcggcagcgcaaaagatg

SEQ ID NO: 171354 - DNA, 103 bp, Artificial Sequence
  Synthetic Polynucleotide
taatacgactcactataggggcagacagcgggagccgcggccaccgatgcaacagaggagagcatcgatggccgcggctaacctggcggcagcgcaaaagatg

SEQ ID NO: 171355 - DNA, 103 bp, Artificial Sequence
  Synthetic Polynucleotide
taatacgactcactataggggccgccaacagcagacagcgggagccgcggaacagaggagaccgcggatgccgctgtctaacctggcggcagcgcaaaagatg

SEQ ID NO: 171356 - DNA, 103 bp, Artificial Sequence
  Synthetic Polynucleotide
taatacgactcactatagggtccccaaagagccgccaacagcagacagcgaacagaggagacgctgtatgctgttggcgaacctggcggcagcgcaaaagatg

SEQ ID NO: 171357 - DNA, 103 bp, Artificial Sequence
  Synthetic Polynucleotide
taatacgactcactatagggcgcgtccctctccccaaagagccgccaacaaacagaggagatgttggatgctctttgggaacctggcggcagcgcaaaagatg

SEQ ID NO: 171358 - DNA, 103 bp, Artificial Sequence
  Synthetic Polynucleotide
taatacgactcactatagggccaacgcgcccgcgtccctctccccaaagaaacagaggagatctttgatgagagggacgaacctggcggcagcgcaaaagatg

SEQ ID NO: 171359 - DNA, 103 bp, Artificial Sequence
  Synthetic Polynucleotide
taatacgactcactatagggtcggcgccccccaacgcgcccgcgtccctcaacagaggagagagggaatggggcgcgttaacctggcggcagcgcaaaagatg

SEQ ID NO: 171360 - DNA, 103 bp, Artificial Sequence
  Synthetic Polynucleotide
taatacgactcactatagggcagagagtcctcggcgccccccaacgcgccaacagaggagaggcgcgatggggggcgccaacctggcggcagcgcaaaagatg

SEQ ID NO: 171361 - DNA, 103 bp, Artificial Sequence
  Synthetic Polynucleotide
taatacgactcactatagggtggagaaggacgtcaaggtgttggcgccgcaacagaggagagcggcgatgacaccttgaaacctggcggcagcgcaaaagatg

SEQ ID NO: 171362 - DNA, 103 bp, Artificial Sequence
  Synthetic Polynucleotide
taatacgactcactataggggagacgccagcagagagtcctcggcgccccaacagaggagaggggcgatgaggactctcaacctggcggcagcgcaaaagatg

SEQ ID NO: 171363 - DNA, 103 bp, Artificial Sequence
  Synthetic Polynucleotide
taatacgactcactataggggtaccggcaggagacgccagcagagagtccaacagaggagaggactcatggctggcgtcaacctggcggcagcgcaaaagatg

SEQ ID NO: 171364 - DNA, 103 bp, Artificial Sequence
  Synthetic Polynucleotide
taatacgactcactatagggagctgttctggtaccggcaggagacgccagaacagaggagactggcgatgcctgccggtaacctggcggcagcgcaaaagatg

SEQ ID NO: 171365 - DNA, 103 bp, Artificial Sequence
  Synthetic Polynucleotide
taatacgactcactatagggtccgccccgcagctgttctggtaccggcagaacagaggagactgccgatgccagaacagaacctggcggcagcgcaaaagatg

SEQ ID NO: 171366 - DNA, 103 bp, Artificial Sequence
  Synthetic Polynucleotide
taatacgactcactatagggctctccgcagtccgccccgcagctgttctgaacagaggagacagaacatgtgcggggcgaacctggcggcagcgcaaaagatg

SEQ ID NO: 171367 - DNA, 103 bp, Artificial Sequence
  Synthetic Polynucleotide
taatacgactcactataggggccttccgggctctccgcagtccgccccgcaacagaggagagcggggatgactgcggagaacctggcggcagcgcaaaagatg

SEQ ID NO: 171368 - DNA, 103 bp, Artificial Sequence
  Synthetic Polynucleotide
taatacgactcactatagggccgagtcccagccttccgggctctccgcagaacagaggagactgcggatggcccggaagaacctggcggcagcgcaaaagatg

SEQ ID NO: 171369 - DNA, 103 bp, Artificial Sequence
  Synthetic Polynucleotide
taatacgactcactatagggagcgcggagtccgagtcccagccttccgggaacagaggagacccggaatgctgggactcaacctggcggcagcgcaaaagatg

SEQ ID NO: 171370 - DNA, 103 bp, Artificial Sequence
  Synthetic Polynucleotide
taatacgactcactatagggctcctcgctgagcgcggagtccgagtcccaaacagaggagatgggacatggactccgcgaacctggcggcagcgcaaaagatg

SEQ ID NO: 171371 - DNA, 103 bp, Artificial Sequence
  Synthetic Polynucleotide
taatacgactcactatagggtgctctcgttctcctcgctgagcgcggagtaacagaggagaactccgatgtcagcgaggaacctggcggcagcgcaaaagatg

SEQ ID NO: 171372 - DNA, 103 bp, Artificial Sequence
  Synthetic Polynucleotide
taatacgactcactatagggatcgcctggatggagaaggacgtcaaggtgaacagaggagacaccttatggtccttctcaacctggcggcagcgcaaaagatg

SEQ ID NO: 171373 - DNA, 103 bp, Artificial Sequence
  Synthetic Polynucleotide
taatacgactcactatagggcagcgccgcctgctctcgttctcctcgctgaacagaggagacagcgaatggaacgagagaacctggcggcagcgcaaaagatg

SEQ ID NO: 171374 - DNA, 103 bp, Artificial Sequence
  Synthetic Polynucleotide
taatacgactcactatagggcgcgtccgcgcagcgccgcctgctctcgttaacagaggagaaacgagatgaggcggcgcaacctggcggcagcgcaaaagatg

SEQ ID NO: 171375 - DNA, 103 bp, Artificial Sequence
  Synthetic Polynucleotide
taatacgactcactatagggtggccccccgcgcgtccgcgcagcgccgccaacagaggagaggcggcatggcgcggacgaacctggcggcagcgcaaaagatg

SEQ ID NO: 171376 - DNA, 103 bp, Artificial Sequence
  Synthetic Polynucleotide
taatacgactcactatagggccggccccgctggccccccgcgcgtccgcgaacagaggagacgcggaatggcggggggcaacctggcggcagcgcaaaagatg

SEQ ID NO: 171377 - DNA, 103 bp, Artificial Sequence
  Synthetic Polynucleotide
taatacgactcactatagggccccgcaaggccggccccgctggccccccgaacagaggagacgggggatgagcggggccaacctggcggcagcgcaaaagatg

SEQ ID NO: 171378 - DNA, 103 bp, Artificial Sequence
  Synthetic Polynucleotide
taatacgactcactatagggtcaaggatccccccgcaaggccggccccgcaacagaggagagcggggatggccttgcggaacctggcggcagcgcaaaagatg

SEQ ID NO: 171379 - DNA, 103 bp, Artificial Sequence
  Synthetic Polynucleotide
taatacgactcactatagggtggccgaggctcaaggatccccccgcaaggaacagaggagaccttgcatggggatccttaacctggcggcagcgcaaaagatg

SEQ ID NO: 171380 - DNA, 103 bp, Artificial Sequence
  Synthetic Polynucleotide
taatacgactcactatagggacagaccggctggccgaggctcaaggatccaacagaggagaggatccatgagcctcggcaacctggcggcagcgcaaaagatg

SEQ ID NO: 171381 - DNA, 103 bp, Artificial Sequence
  Synthetic Polynucleotide
taatacgactcactatagggcggccagctcacagaccggctggccgaggcaacagaggagagcctcgatgagccggtctaacctggcggcagcgcaaaagatg

SEQ ID NO: 171382 - DNA, 103 bp, Artificial Sequence
  Synthetic Polynucleotide
taatacgactcactatagggtctttggaagcggccagctcacagaccggcaacagaggagagccggtatgtgagctggcaacctggcggcagcgcaaaagatg

SEQ ID NO: 171383 - DNA, 103 bp, Artificial Sequence
  Synthetic Polynucleotide
taatacgactcactatagggcttgttgaggatcgcctggatggagaaggaaacagaggagatccttcatgatccaggcgaacctggcggcagcgcaaaagatg

SEQ ID NO: 171384 - DNA, 103 bp, Artificial Sequence
  Synthetic Polynucleotide
taatacgactcactatagggctcctctaggtctttggaagcggccagctcaacagaggagagagctgatggcttccaaaaacctggcggcagcgcaaaagatg

SEQ ID NO: 171385 - DNA, 103 bp, Artificial Sequence
  Synthetic Polynucleotide
taatacgactcactatagggccgcggcttcctcctctaggtctttggaagaacagaggagacttccaatgacctagaggaacctggcggcagcgcaaaagatg

SEQ ID NO: 171386 - DNA, 103 bp, Artificial Sequence
  Synthetic Polynucleotide
taatacgactcactatagggtcgctccggcccgcggcttcctcctctaggaacagaggagacctagaatgggaagccgcaacctggcggcagcgcaaaagatg

SEQ ID NO: 171387 - DNA, 103 bp, Artificial Sequence
  Synthetic Polynucleotide
taatacgactcactatagggcatctcgctgtcgctccggcccgcggcttcaacagaggagagaagccatgggccggagcaacctggcggcagcgcaaaagatg

SEQ ID NO: 171388 - DNA, 103 bp, Artificial Sequence
  Synthetic Polynucleotide
taatacgactcactatagggcgctggcggacatctcgctgtcgctccggcaacagaggagagccggaatgacagcgagaaacctggcggcagcgcaaaagatg

SEQ ID NO: 171389 - DNA, 103 bp, Artificial Sequence
  Synthetic Polynucleotide
taatacgactcactatagggtcgcctgagacgctggcggacatctcgctgaacagaggagacagcgaatggtccgccagaacctggcggcagcgcaaaagatg

SEQ ID NO: 171390 - DNA, 103 bp, Artificial Sequence
  Synthetic Polynucleotide
taatacgactcactatagggtgggctgcggtcgcctgagacgctggcggaaacagaggagatccgccatggtctcaggcaacctggcggcagcgcaaaagatg

SEQ ID NO: 171391 - DNA, 103 bp, Artificial Sequence
  Synthetic Polynucleotide
taatacgactcactatagggcctcggtccttgggctgcggtcgcctgagaaacagaggagatctcagatgaccgcagccaacctggcggcagcgcaaaagatg

SEQ ID NO: 171392 - DNA, 103 bp, Artificial Sequence
  Synthetic Polynucleotide
taatacgactcactatagggacaccgtcgtcctcggtccttgggctgcggaacagaggagaccgcagatgaaggaccgaaacctggcggcagcgcaaaagatg

SEQ ID NO: 171393 - DNA, 103 bp, Artificial Sequence
  Synthetic Polynucleotide
taatacgactcactatagggtctggggccaacaccgtcgtcctcggtcctaacagaggagaaggaccatggacgacggtaacctggcggcagcgcaaaagatg

SEQ ID NO: 171394 - DNA, 103 bp, Artificial Sequence
  Synthetic Polynucleotide
taatacgactcactataggggctcctctttcttgttgaggatcgcctggaaacagaggagatccaggatgtcctcaacaaacctggcggcagcgcaaaagatg

SEQ ID NO: 171395 - DNA, 103 bp, Artificial Sequence
  Synthetic Polynucleotide
taatacgactcactatagggcgtgtgcacctctggggccaacaccgtcgtaacagaggagaacgacgatgttggccccaaacctggcggcagcgcaaaagatg

SEQ ID NO: 171396 - DNA, 103 bp, Artificial Sequence
  Synthetic Polynucleotide
taatacgactcactatagggagcgcggacacgtgtgcacctctggggccaaacagaggagatggcccatgaggtgcacaaacctggcggcagcgcaaaagatg

SEQ ID NO: 171397 - DNA, 103 bp, Artificial Sequence
  Synthetic Polynucleotide
taatacgactcactatagggcccgctgcacagcgcggacacgtgtgcaccaacagaggagaggtgcaatggtgtccgcgaacctggcggcagcgcaaaagatg

SEQ ID NO: 171398 - DNA, 103 bp, Artificial Sequence
  Synthetic Polynucleotide
taatacgactcactatagggcgccgccggccccgctgcacagcgcggacaaacagaggagatgtccgatgtgtgcagcgaacctggcggcagcgcaaaagatg

SEQ ID NO: 171399 - DNA, 103 bp, Artificial Sequence
  Synthetic Polynucleotide
taatacgactcactatagggctgccgcccccgccgccggccccgctgcacaacagaggagagtgcagatgggccggcggaacctggcggcagcgcaaaagatg

SEQ ID NO: 171400 - DNA, 103 bp, Artificial Sequence
  Synthetic Polynucleotide
taatacgactcactatagggtgccggcccgctgccgcccccgccgccggcaacagaggagagccggcatggggggcggcaacctggcggcagcgcaaaagatg

SEQ ID NO: 171401 - DNA, 103 bp, Artificial Sequence
  Synthetic Polynucleotide
taatacgactcactatagggccgcgacgcctgccggcccgctgccgccccaacagaggagaggggcgatggcgggccggaacctggcggcagcgcaaaagatg

SEQ ID NO: 171402 - DNA, 103 bp, Artificial Sequence
  Synthetic Polynucleotide
taatacgactcactatagggtcctcctcctccgcgacgcctgccggcccgaacagaggagacgggccatgaggcgtcgcaacctggcggcagcgcaaaagatg

SEQ ID NO: 171403 - DNA, 103 bp, Artificial Sequence
  Synthetic Polynucleotide
taatacgactcactatagggcgccggctcctcctcctcctccgcgacgccaacagaggagaggcgtcatggaggaggagaacctggcggcagcgcaaaagatg

SEQ ID NO: 171404 - DNA, 103 bp, Artificial Sequence
  Synthetic Polynucleotide
taatacgactcactataggggcttgggcgccgccggctcctcctcctcctaacagaggagaaggaggatgaggagccggaacctggcggcagcgcaaaagatg

SEQ ID NO: 171405 - DNA, 103 bp, Artificial Sequence
  Synthetic Polynucleotide
taatacgactcactatagggagcccgccgcgctcctctttcttgttgaggaacagaggagacctcaaatggaaagaggaaacctggcggcagcgcaaaagatg

SEQ ID NO: 171406 - DNA, 103 bp, Artificial Sequence
  Synthetic Polynucleotide
taatacgactcactatagggttcttgcgtggcttgggcgccgccggctccaacagaggagaggagccatgggcgcccaaaacctggcggcagcgcaaaagatg

SEQ ID NO: 171407 - DNA, 103 bp, Artificial Sequence
  Synthetic Polynucleotide
taatacgactcactatagggccgcgagcgcttcttgcgtggcttgggcgcaacagaggagagcgcccatgccacgcaagaacctggcggcagcgcaaaagatg

SEQ ID NO: 171408 - DNA, 103 bp, Artificial Sequence
  Synthetic Polynucleotide
taatacgactcactatagggagaaagcggcccgcgagcgcttcttgcgtgaacagaggagacacgcaatgagcgctcgcaacctggcggcagcgcaaaagatg

SEQ ID NO: 171409 - DNA, 103 bp, Artificial Sequence
  Synthetic Polynucleotide
taatacgactcactatagggtgcgcgtgggagaaagcggcccgcgagcgcaacagaggagagcgctcatgggccgctttaacctggcggcagcgcaaaagatg

SEQ ID NO: 171410 - DNA, 103 bp, Artificial Sequence
  Synthetic Polynucleotide
taatacgactcactatagggctcgaagacctgcgcgtgggagaaagcggcaacagaggagagccgctatgtcccacgcgaacctggcggcagcgcaaaagatg

SEQ ID NO: 171411 - DNA, 103 bp, Artificial Sequence
  Synthetic Polynucleotide
taatacgactcactatagggggcgctccagctcgaagacctgcgcgtgggaacagaggagacccacgatgaggtcttcgaacctggcggcagcgcaaaagatg

SEQ ID NO: 171412 - DNA, 103 bp, Artificial Sequence
  Synthetic Polynucleotide
taatacgactcactatagggtggttaaagcggcgctccagctcgaagaccaacagaggagaggtcttatggctggagcgaacctggcggcagcgcaaaagatg

SEQ ID NO: 171413 - DNA, 103 bp, Artificial Sequence
  Synthetic Polynucleotide
taatacgactcactataggggtagcgctggtggttaaagcggcgctccagaacagaggagactggagatgcgctttaacaacctggcggcagcgcaaaagatg

SEQ ID NO: 171414 - DNA, 103 bp, Artificial Sequence
  Synthetic Polynucleotide
taatacgactcactataggggcccggacaggtagcgctggtggttaaagcaacagaggagagctttaatgaccagcgctaacctggcggcagcgcaaaagatg

SEQ ID NO: 171415 - DNA, 103 bp, Artificial Sequence
  Synthetic Polynucleotide
taatacgactcactataggggcgcgctcgggcccggacaggtagcgctggaacagaggagaccagcgatgcctgtccggaacctggcggcagcgcaaaagatg

SEQ ID NO: 171416 - DNA, 103 bp, Artificial Sequence
  Synthetic Polynucleotide
taatacgactcactatagggtggcgcggccagcccgccgcgctcctctttaacagaggagaaaagagatgcgcggcgggaacctggcggcagcgcaaaagatg

SEQ ID NO: 171417 - DNA, 103 bp, Artificial Sequence
  Synthetic Polynucleotide
taatacgactcactatagggggccaggtctgcgcgctcgggcccggacagaacagaggagactgtccatgcccgagcgcaacctggcggcagcgcaaaagatg

SEQ ID NO: 171418 - DNA, 103 bp, Artificial Sequence
  Synthetic Polynucleotide
taatacgactcactatagggtcagcgacgcggccaggtctgcgcgctcggaacagaggagaccgagcatgcagacctggaacctggcggcagcgcaaaagatg

SEQ ID NO: 171419 - DNA, 103 bp, Artificial Sequence
  Synthetic Polynucleotide
taatacgactcactatagggtcggtgagcttcagcgacgcggccaggtctaacagaggagaagacctatgcgcgtcgctaacctggcggcagcgcaaaagatg

SEQ ID NO: 171420 - DNA, 103 bp, Artificial Sequence
  Synthetic Polynucleotide
taatacgactcactatagggcacctgcgtctcggtgagcttcagcgacgcaacagaggagagcgtcgatgaagctcaccaacctggcggcagcgcaaaagatg

SEQ ID NO: 171421 - DNA, 103 bp, Artificial Sequence
  Synthetic Polynucleotide
taatacgactcactatagggaccagattttcacctgcgtctcggtgagctaacagaggagaagctcaatgagacgcaggaacctggcggcagcgcaaaagatg

SEQ ID NO: 171422 - DNA, 103 bp, Artificial Sequence
  Synthetic Polynucleotide
taatacgactcactatagggcggttctggaaccagattttcacctgcgtcaacagaggagagacgcaatggaaaatctgaacctggcggcagcgcaaaagatg

SEQ ID NO: 171423 - DNA, 103 bp, Artificial Sequence
  Synthetic Polynucleotide
taatacgactcactatagggcttgtagcgacggttctggaaccagattttaacagaggagaaaaatcatgttccagaacaacctggcggcagcgcaaaagatg

SEQ ID NO: 171424 - DNA, 103 bp, Artificial Sequence
  Synthetic Polynucleotide
taatacgactcactatagggggcgctttgtcttgtagcgacggttctggaaacagaggagatccagaatggtcgctacaaacctggcggcagcgcaaaagatg

SEQ ID NO: 171425 - DNA, 103 bp, Artificial Sequence
  Synthetic Polynucleotide
taatacgactcactataggggccatctgccggcgctttgtcttgtagcgaaacagaggagatcgctaatggacaaagcgaacctggcggcagcgcaaaagatg

SEQ ID NO: 171426 - DNA, 103 bp, Artificial Sequence
  Synthetic Polynucleotide
taatacgactcactatagggcaggtcggctgccatctgccggcgctttgtaacagaggagaacaaagatgcggcagatgaacctggcggcagcgcaaaagatg

SEQ ID NO: 171427 - DNA, 103 bp, Artificial Sequence
  Synthetic Polynucleotide
taatacgactcactatagggggcgcccctctggcgcggccagcccgccgcaacagaggagagcggcgatgtggccgcgcaacctggcggcagcgcaaaagatg

SEQ ID NO: 171428 - DNA, 103 bp, Artificial Sequence
  Synthetic Polynucleotide
taatacgactcactatagggccgaggccagcaggtcggctgccatctgccaacagaggagaggcagaatgcagccgaccaacctggcggcagcgcaaaagatg

SEQ ID NO: 171429 - DNA, 103 bp, Artificial Sequence
  Synthetic Polynucleotide
taatacgactcactataggggcggcgggcgccgaggccagcaggtcggctaacagaggagaagccgaatggctggcctcaacctggcggcagcgcaaaagatg

SEQ ID NO: 171430 - DNA, 103 bp, Artificial Sequence
  Synthetic Polynucleotide
taatacgactcactatagggcaccttcttggcggcgggcgccgaggccagaacagaggagactggccatggcgcccgccaacctggcggcagcgcaaaagatg

SEQ ID NO: 171431 - DNA, 103 bp, Artificial Sequence
  Synthetic Polynucleotide
taatacgactcactatagggcctttacggccaccttcttggcggcgggcgaacagaggagacgcccgatgccaagaaggaacctggcggcagcgcaaaagatg

SEQ ID NO: 171432 - DNA, 103 bp, Artificial Sequence
  Synthetic Polynucleotide
taatacgactcactatagggcgcaccagcacctttacggccaccttcttgaacagaggagacaagaaatgggccgtaaaaacctggcggcagcgcaaaagatg

SEQ ID NO: 171433 - DNA, 103 bp, Artificial Sequence
  Synthetic Polynucleotide
taatacgactcactatagggctggtcgtcgcgcaccagcacctttacggcaacagaggagagccgtaatggtgctggtgaacctggcggcagcgcaaaagatg

SEQ ID NO: 171434 - DNA, 103 bp, Artificial Sequence
  Synthetic Polynucleotide
taatacgactcactatagggggtattgtctctggtcgtcgcgcaccagcaaacagaggagatgctggatggcgacgaccaacctggcggcagcgcaaaagatg

SEQ ID NO: 171435 - DNA, 103 bp, Artificial Sequence
  Synthetic Polynucleotide
taatacgactcactatagggtcgccgggcaggtattgtctctggtcgtcgaacagaggagacgacgaatggagacaataaacctggcggcagcgcaaaagatg

SEQ ID NO: 171436 - DNA, 103 bp, Artificial Sequence
  Synthetic Polynucleotide
taatacgactcactatagggccgcagcacttcgccgggcaggtattgtctaacagaggagaagacaaatgctgcccggcaacctggcggcagcgcaaaagatg

SEQ ID NO: 171437 - DNA, 103 bp, Artificial Sequence
  Synthetic Polynucleotide
taatacgactcactataggggcgagggtggccgcagcacttcgccgggcaaacagaggagatgcccgatgaagtgctgcaacctggcggcagcgcaaaagatg

SEQ ID NO: 171438 - DNA, 103 bp, Artificial Sequence
  Synthetic Polynucleotide
taatacgactcactatagggccgggcgccgggcgcccctctggcgcggccaacagaggagaggccgcatgagaggggcgaacctggcggcagcgcaaaagatg

SEQ ID NO: 171439 - DNA, 103 bp, Artificial Sequence
  Synthetic Polynucleotide
taatacgactcactatagggagtggcagaagcgagggtggccgcagcactaacagaggagaagtgctatggccaccctcaacctggcggcagcgcaaaagatg

SEQ ID NO: 171440 - DNA, 103 bp, Artificial Sequence
  Synthetic Polynucleotide
taatacgactcactatagggggagggctgcagtggcagaagcgagggtggaacagaggagaccacccatgcttctgccaaacctggcggcagcgcaaaagatg

SEQ ID NO: 171441 - DNA, 103 bp, Artificial Sequence
  Synthetic Polynucleotide
taatacgactcactatagggggtaatagtaggagggctgcagtggcagaaaacagaggagattctgcatgtgcagccctaacctggcggcagcgcaaaagatg

SEQ ID NO: 171442 - DNA, 103 bp, Artificial Sequence
  Synthetic Polynucleotide
taatacgactcactatagggcagtagtacgggtaatagtaggagggctgcaacagaggagagcagccatgctactattaaacctggcggcagcgcaaaagatg

SEQ ID NO: 171443 - DNA, 103 bp, Artificial Sequence
  Synthetic Polynucleotide
taatacgactcactataggggcctgggaggcagtagtacgggtaatagtaaacagaggagatactatatgccgtactacaacctggcggcagcgcaaaagatg

SEQ ID NO: 171444 - DNA, 103 bp, Artificial Sequence
  Synthetic Polynucleotide
taatacgactcactatagggagagcgcccagcctgggaggcagtagtacgaacagaggagacgtactatggcctcccagaacctggcggcagcgcaaaagatg

SEQ ID NO: 171445 - DNA, 103 bp, Artificial Sequence
  Synthetic Polynucleotide
taatacgactcactataggggcgcaggtggagagcgcccagcctgggaggaacagaggagacctcccatgctgggcgctaacctggcggcagcgcaaaagatg

SEQ ID NO: 171446 - DNA, 103 bp, Artificial Sequence
  Synthetic Polynucleotide
taatacgactcactatagggtgcggcagctgcgcaggtggagagcgcccaaacagaggagatgggcgatgtccacctgcaacctggcggcagcgcaaaagatg

SEQ ID NO: 171447 - DNA, 103 bp, Artificial Sequence
  Synthetic Polynucleotide
taatacgactcactatagggactgggtgcctgcggcagctgcgcaggtggaacagaggagaccacctatgcagctgccgaacctggcggcagcgcaaaagatg

SEQ ID NO: 171448 - DNA, 103 bp, Artificial Sequence
  Synthetic Polynucleotide
taatacgactcactatagggggtgccctccattgcccccaccgctaacataacagaggagaatgttaatggtgggggcaaacctggcggcagcgcaaaagatg

SEQ ID NO: 171449 - DNA, 103 bp, Artificial Sequence
  Synthetic Polynucleotide
taatacgactcactatagggatacgcggcagggtacagcggggtcttcataacagaggagaatgaagatgccgctgtacaacctggcggcagcgcaaaagatg

SEQ ID NO: 171450 - DNA, 103 bp, Artificial Sequence
  Synthetic Polynucleotide
taatacgactcactatagggcgtgattttctcgtcgtccgagttgggatcaacagaggagagatcccatgtcggacgacaacctggcggcagcgcaaaagatg

SEQ ID NO: 171451 - DNA, 103 bp, Artificial Sequence
  Synthetic Polynucleotide
taatacgactcactatagggtcaacagctgcgtgattttctcgtcgtccgaacagaggagacggacgatgagaaaatcaaacctggcggcagcgcaaaagatg

SEQ ID NO: 171452 - DNA, 103 bp, Artificial Sequence
  Synthetic Polynucleotide
taatacgactcactatagggttgtgcttcttcaacagctgcgtgattttcaacagaggagagaaaatatggcagctgttaacctggcggcagcgcaaaagatg

SEQ ID NO: 171453 - DNA, 103 bp, Artificial Sequence
  Synthetic Polynucleotide
taatacgactcactataggggctgctggacttgtgcttcttcaacagctgaacagaggagacagctgatgaagaagcacaacctggcggcagcgcaaaagatg

SEQ ID NO: 171454 - DNA, 103 bp, Artificial Sequence
  Synthetic Polynucleotide
taatacgactcactatagggcgccgccgccgctgctggacttgtgcttctaacagaggagaagaagcatgagtccagcaaacctggcggcagcgcaaaagatg

SEQ ID NO: 171455 - DNA, 103 bp, Artificial Sequence
  Synthetic Polynucleotide
taatacgactcactatagggaggaggccgccgccgccgccgctgctggacaacagaggagagtccagatgcggcggcggaacctggcggcagcgcaaaagatg

SEQ ID NO: 171456 - DNA, 103 bp, Artificial Sequence
  Synthetic Polynucleotide
taatacgactcactatagggcgcgtgcagtaggaggccgccgccgccgccaacagaggagaggcggcatgggcggcctcaacctggcggcagcgcaaaagatg

SEQ ID NO: 171457 - DNA, 103 bp, Artificial Sequence
  Synthetic Polynucleotide
taatacgactcactatagggccggctcggacgcgtgcagtaggaggccgcaacagaggagagcggccatgtactgcacgaacctggcggcagcgcaaaagatg

SEQ ID NO: 171458 - DNA, 103 bp, Artificial Sequence
  Synthetic Polynucleotide
taatacgactcactataggggatgagctctccggctcggacgcgtgcagtaacagaggagaactgcaatggtccgagccaacctggcggcagcgcaaaagatg

SEQ ID NO: 171459 - DNA, 103 bp, Artificial Sequence
  Synthetic Polynucleotide
taatacgactcactataggggcagcgggggatacgcggcagggtacagcgaacagaggagacgctgtatgctgccgcgtaacctggcggcagcgcaaaagatg

SEQ ID NO: 171460 - DNA, 103 bp, Artificial Sequence
  Synthetic Polynucleotide
taatacgactcactataggggggccggcaggcagcgggggatacgcggcaaacagaggagatgccgcatgtcccccgctaacctggcggcagcgcaaaagatg

SEQ ID NO: 171461 - DNA, 103 bp, Artificial Sequence
  Synthetic Polynucleotide
taatacgactcactatagggggaggagggggggccggcaggcagcgggggaacagaggagacccccgatgcctgccggcaacctggcggcagcgcaaaagatg

SEQ ID NO: 171462 - DNA, 103 bp, Artificial Sequence
  Synthetic Polynucleotide
taatacgactcactatagggacgaggacgaggaggagggggggccggcagaacagaggagactgccgatgccccctcctaacctggcggcagcgcaaaagatg

SEQ ID NO: 171463 - DNA, 103 bp, Artificial Sequence
  Synthetic Polynucleotide
taatacgactcactataggggaggacgacgacgaggacgaggaggaggggaacagaggagacccctcatgctcgtcctcaacctggcggcagcgcaaaagatg

SEQ ID NO: 171464 - DNA, 103 bp, Artificial Sequence
  Synthetic Polynucleotide
taatacgactcactataggggggcgacgaggaggacgacgacgaggacgaaacagaggagatcgtccatgtcgtcgtccaacctggcggcagcgcaaaagatg

SEQ ID NO: 171465 - DNA, 103 bp, Artificial Sequence
  Synthetic Polynucleotide
taatacgactcactataggggaggcggggagggcgacgaggaggacgacgaacagaggagacgtcgtatgcctcgtcgcaacctggcggcagcgcaaaagatg

SEQ ID NO: 171466 - DNA, 103 bp, Artificial Sequence
  Synthetic Polynucleotide
taatacgactcactatagggtgggtgcccagaggcggggagggcgacgagaacagaggagactcgtcatgctccccgccaacctggcggcagcgcaaaagatg

SEQ ID NO: 171467 - DNA, 103 bp, Artificial Sequence
  Synthetic Polynucleotide
taatacgactcactataggggcctgggttgtgggtgcccagaggcggggaaacagaggagatccccgatgctgggcaccaacctggcggcagcgcaaaagatg

SEQ ID NO: 171468 - DNA, 103 bp, Artificial Sequence
  Synthetic Polynucleotide
taatacgactcactatagggcgctctgccgggtgccctccattgcccccaaacagaggagatgggggatgtggagggcaaacctggcggcagcgcaaaagatg

SEQ ID NO: 171469 - DNA, 103 bp, Artificial Sequence
  Synthetic Polynucleotide
taatacgactcactataggggcttcaggccgcctgggttgtgggtgcccaaacagaggagatgggcaatgacaacccagaacctggcggcagcgcaaaagatg

SEQ ID NO: 171470 - DNA, 103 bp, Artificial Sequence
  Synthetic Polynucleotide
taatacgactcactataggggtggccgggggcttcaggccgcctgggttgaacagaggagacaacccatgcggcctgaaaacctggcggcagcgcaaaagatg

SEQ ID NO: 171471 - DNA, 103 bp, Artificial Sequence
  Synthetic Polynucleotide
taatacgactcactataggggagcccccccgtggccgggggcttcaggccaacagaggagaggcctgatgcccccggccaacctggcggcagcgcaaaagatg

SEQ ID NO: 171472 - DNA, 103 bp, Artificial Sequence
  Synthetic Polynucleotide
taatacgactcactatagggcgagggatgagagcccccccgtggccggggaacagaggagaccccggatgcgggggggcaacctggcggcagcgcaaaagatg

SEQ ID NO: 171473 - DNA, 103 bp, Artificial Sequence
  Synthetic Polynucleotide
taatacgactcactatagggggggggctgccgagggatgagagcccccccaacagaggagaggggggatgctcatccctaacctggcggcagcgcaaaagatg

SEQ ID NO: 171474 - DNA, 103 bp, Artificial Sequence
  Synthetic Polynucleotide
taatacgactcactataggggagctgctgcggggggctgccgagggatgaaacagaggagatcatccatgggcagccccaacctggcggcagcgcaaaagatg

SEQ ID NO: 171475 - DNA, 103 bp, Artificial Sequence
  Synthetic Polynucleotide
taatacgactcactatagggtggcggccgagagctgctgcggggggctgcaacagaggagagcagccatgcgcagcagcaacctggcggcagcgcaaaagatg

SEQ ID NO: 171476 - DNA, 103 bp, Artificial Sequence
  Synthetic Polynucleotide
taatacgactcactatagggccgtgtggggtggcggccgagagctgctgcaacagaggagagcagcaatgctcggccgcaacctggcggcagcgcaaaagatg

SEQ ID NO: 171477 - DNA, 103 bp, Artificial Sequence
  Synthetic Polynucleotide
taatacgactcactatagggatcgttgatgccgtgtggggtggcggccgaaacagaggagatcggccatgaccccacacaacctggcggcagcgcaaaagatg

SEQ ID NO: 171478 - DNA, 103 bp, Artificial Sequence
  Synthetic Polynucleotide
taatacgactcactatagggggctcaggatatcgttgatgccgtgtggggaacagaggagaccccacatggcatcaacgaacctggcggcagcgcaaaagatg

SEQ ID NO: 171479 - DNA, 103 bp, Artificial Sequence
  Synthetic Polynucleotide
taatacgactcactatagggagcaggaatgcgctctgccgggtgccctccaacagaggagaggagggatgccggcagagaacctggcggcagcgcaaaagatg

SEQ ID NO: 171480 - DNA, 103 bp, Artificial Sequence
  Synthetic Polynucleotide
taatacgactcactatagggatggagggccggctcaggatatcgttgatgaacagaggagacatcaaatgtatcctgagaacctggcggcagcgcaaaagatg

SEQ ID NO: 171481 - DNA, 103 bp, Artificial Sequence
  Synthetic Polynucleotide
taatacgactcactatagggggccacgggcatggagggccggctcaggataacagaggagaatcctgatgcggccctccaacctggcggcagcgcaaaagatg

SEQ ID NO: 171482 - DNA, 103 bp, Artificial Sequence
  Synthetic Polynucleotide
taatacgactcactatagggcggcccccgaggccacgggcatggagggccaacagaggagaggccctatgtgcccgtggaacctggcggcagcgcaaaagatg

SEQ ID NO: 171483 - DNA, 103 bp, Artificial Sequence
  Synthetic Polynucleotide
taatacgactcactataggggagggcagggcggcccccgaggccacgggcaacagaggagagcccgtatgctcgggggcaacctggcggcagcgcaaaagatg

SEQ ID NO: 171484 - DNA, 103 bp, Artificial Sequence
  Synthetic Polynucleotide
taatacgactcactataggggggcgaggcggagggcagggcggcccccgaaacagaggagatcggggatggccctgcccaacctggcggcagcgcaaaagatg

SEQ ID NO: 171485 - DNA, 103 bp, Artificial Sequence
  Synthetic Polynucleotide
taatacgactcactatagggaggaaccggagggcgaggcggagggcagggaacagaggagaccctgcatgccgcctcgcaacctggcggcagcgcaaaagatg

SEQ ID NO: 171486 - DNA, 103 bp, Artificial Sequence
  Synthetic Polynucleotide
taatacgactcactataggggaggaggaggaggaaccggagggcgaggcgaacagaggagacgcctcatgctccggttcaacctggcggcagcgcaaaagatg

SEQ ID NO: 171487 - DNA, 103 bp, Artificial Sequence
  Synthetic Polynucleotide
taatacgactcactatagggggacgaggaagaggaggaggaggaaccggaaacagaggagatccggtatgtcctcctccaacctggcggcagcgcaaaagatg

SEQ ID NO: 171488 - DNA, 103 bp, Artificial Sequence
  Synthetic Polynucleotide
taatacgactcactatagggaggcagaggcggacgaggaagaggaggaggaacagaggagacctcctatgcttcctcgtaacctggcggcagcgcaaaagatg

SEQ ID NO: 171489 - DNA, 103 bp, Artificial Sequence
  Synthetic Polynucleotide
taatacgactcactataggggaggcggaggaggcagaggcggacgaggaaaacagaggagattcctcatgcgcctctgcaacctggcggcagcgcaaaagatg

SEQ ID NO: 171490 - DNA, 103 bp, Artificial Sequence
  Synthetic Polynucleotide
taatacgactcactatagggagggctgctgagcaggaatgcgctctgccgaacagaggagacggcagatggcattcctgaacctggcggcagcgcaaaagatg

SEQ ID NO: 171491 - DNA, 103 bp, Artificial Sequence
  Synthetic Polynucleotide
taatacgactcactatagggggcggcggcagaggcggaggaggcagaggcaacagaggagagcctctatgtcctccgccaacctggcggcagcgcaaaagatg

SEQ ID NO: 171492 - DNA, 103 bp, Artificial Sequence
  Synthetic Polynucleotide
taatacgactcactatagggcagcagccgcggcggcggcagaggcggaggaacagaggagacctccgatgctgccgccgaacctggcggcagcgcaaaagatg

SEQ ID NO: 171493 - DNA, 103 bp, Artificial Sequence
  Synthetic Polynucleotide
taatacgactcactataggggcggccgcggcagcagccgcggcggcggcaaacagaggagatgccgcatgcgcggctgcaacctggcggcagcgcaaaagatg

SEQ ID NO: 171494 - DNA, 103 bp, Artificial Sequence
  Synthetic Polynucleotide
taatacgactcactatagggggcggcggctgcggccgcggcagcagccgcaacagaggagagcggctatggccgcggccaacctggcggcagcgcaaaagatg

SEQ ID NO: 171495 - DNA, 103 bp, Artificial Sequence
  Synthetic Polynucleotide
taatacgactcactatagggccggggatgaggcggcggctgcggccgcggaacagaggagaccgcggatgcagccgccgaacctggcggcagcgcaaaagatg

SEQ ID NO: 171496 - DNA, 103 bp, Artificial Sequence
  Synthetic Polynucleotide
taatacgactcactatagggagcagccccgccggggatgaggcggcggctaacagaggagaagccgcatgctcatccccaacctggcggcagcgcaaaagatg

SEQ ID NO: 171497 - DNA, 103 bp, Artificial Sequence
  Synthetic Polynucleotide
taatacgactcactatagggcagtccggccagcagccccgccggggatgaaacagaggagatcatccatggcggggctgaacctggcggcagcgcaaaagatg

SEQ ID NO: 171498 - DNA, 103 bp, Artificial Sequence
  Synthetic Polynucleotide
taatacgactcactatagggtaaagcgtggcagtccggccagcagccccgaacagaggagacggggcatgtggccggacaacctggcggcagcgcaaaagatg

SEQ ID NO: 171499 - DNA, 103 bp, Artificial Sequence
  Synthetic Polynucleotide
taatacgactcactatagggctcaggctgctaaagcgtggcagtccggccaacagaggagaggccggatggccacgcttaacctggcggcagcgcaaaagatg

SEQ ID NO: 171500 - DNA, 103 bp, Artificial Sequence
  Synthetic Polynucleotide
taatacgactcactatagggcggcggcgggctcaggctgctaaagcgtggaacagaggagaccacgcatgagcagcctgaacctggcggcagcgcaaaagatg

SEQ ID NO: 171501 - DNA, 103 bp, Artificial Sequence
  Synthetic Polynucleotide
taatacgactcactatagggcggccaggggagggctgctgagcaggaatgaacagaggagacattccatgtcagcagccaacctggcggcagcgcaaaagatg

SEQ ID NO: 171502 - DNA, 103 bp, Artificial Sequence
  Synthetic Polynucleotide
taatacgactcactatagggcgggcggcggcggcggcgggctcaggctgcaacagaggagagcagccatggcccgccgcaacctggcggcagcgcaaaagatg

SEQ ID NO: 171503 - DNA, 103 bp, Artificial Sequence
  Synthetic Polynucleotide
taatacgactcactatagggaagtagagcccgggcggcggcggcggcgggaacagaggagacccgccatggccgccgccaacctggcggcagcgcaaaagatg

SEQ ID NO: 171504 - DNA, 103 bp, Artificial Sequence
  Synthetic Polynucleotide
taatacgactcactataggggctggggctgaagtagagcccgggcggcggaacagaggagaccgccgatggggctctacaacctggcggcagcgcaaaagatg

SEQ ID NO: 171505 - DNA, 103 bp, Artificial Sequence
  Synthetic Polynucleotide
taatacgactcactatagggcggccgcggcgctggggctgaagtagagccaacagaggagaggctctatgtcagccccaaacctggcggcagcgcaaaagatg

SEQ ID NO: 171506 - DNA, 103 bp, Artificial Sequence
  Synthetic Polynucleotide
taatacgactcactatagggacggcggccacggccgcggcgctggggctgaacagaggagacagcccatgcgccgcggcaacctggcggcagcgcaaaagatg

SEQ ID NO: 171507 - DNA, 103 bp, Artificial Sequence
  Synthetic Polynucleotide
taatacgactcactataggggtaccggcccacggcggccacggccgcggcaacagaggagagccgcgatggtggccgccaacctggcggcagcgcaaaagatg

SEQ ID NO: 171508 - DNA, 103 bp, Artificial Sequence
  Synthetic Polynucleotide
taatacgactcactataggggcggcttggggtaccggcccacggcggccaaacagaggagatggccgatgtgggccggtaacctggcggcagcgcaaaagatg

SEQ ID NO: 171509 - DNA, 103 bp, Artificial Sequence
  Synthetic Polynucleotide
taatacgactcactatagggagctcagccagcggcttggggtaccggcccaacagaggagagggccgatgccccaagccaacctggcggcagcgcaaaagatg

SEQ ID NO: 171510 - DNA, 103 bp, Artificial Sequence
  Synthetic Polynucleotide
taatacgactcactatagggccggccaggcagctcagccagcggcttgggaacagaggagacccaagatgctggctgagaacctggcggcagcgcaaaagatg

SEQ ID NO: 171511 - DNA, 103 bp, Artificial Sequence
  Synthetic Polynucleotide
taatacgactcactatagggagatgggcgtccggccaggcagctcagccaaacagaggagatggctgatgtgcctggccaacctggcggcagcgcaaaagatg

SEQ ID NO: 171512 - DNA, 103 bp, Artificial Sequence
  Synthetic Polynucleotide
taatacgactcactatagggctgtgcagggcggccaggggagggctgctgaacagaggagacagcagatgtcccctggcaacctggcggcagcgcaaaagatg

SEQ ID NO: 171513 - DNA, 103 bp, Artificial Sequence
  Synthetic Polynucleotide
taatacgactcactatagggccgggccagaagatgggcgtccggccaggcaacagaggagagcctggatggacgcccataacctggcggcagcgcaaaagatg

SEQ ID NO: 171514 - DNA, 103 bp, Artificial Sequence
  Synthetic Polynucleotide
taatacgactcactatagggctgcatcactccgggccagaagatgggcgtaacagaggagaacgcccatgttctggcccaacctggcggcagcgcaaaagatg

SEQ ID NO: 171515 - DNA, 103 bp, Artificial Sequence
  Synthetic Polynucleotide
taatacgactcactatagggagggcgggctctgcatcactccgggccagaaacagaggagatctggcatggagtgatgcaacctggcggcagcgcaaaagatg

SEQ ID NO: 171516 - DNA, 103 bp, Artificial Sequence
  Synthetic Polynucleotide
taatacgactcactataggggcgtccctccagggcgggctctgcatcactaacagaggagaagtgatatggagcccgccaacctggcggcagcgcaaaagatg

SEQ ID NO: 171517 - DNA, 103 bp, Artificial Sequence
  Synthetic Polynucleotide
taatacgactcactatagggggccaggcgtgcgtccctccagggcgggctaacagaggagaagcccgatgtggagggacaacctggcggcagcgcaaaagatg

SEQ ID NO: 171518 - DNA, 103 bp, Artificial Sequence
  Synthetic Polynucleotide
taatacgactcactataggggaggggtacaggccaggcgtgcgtccctccaacagaggagaggagggatgcacgcctggaacctggcggcagcgcaaaagatg

SEQ ID NO: 171519 - DNA, 103 bp, Artificial Sequence
  Synthetic Polynucleotide
taatacgactcactataggggatccttgatgaggggtacaggccaggcgtaacagaggagaacgcctatgctgtaccccaacctggcggcagcgcaaaagatg

SEQ ID NO: 171520 - DNA, 103 bp, Artificial Sequence
  Synthetic Polynucleotide
taatacgactcactatagggcaacaaaatggatccttgatgaggggtacaaacagaggagatgtaccatgcatcaaggaaacctggcggcagcgcaaaagatg

SEQ ID NO: 171521 - DNA, 103 bp, Artificial Sequence
  Synthetic Polynucleotide
taatacgactcactatagggcgtctttgtccaacaaaatggatccttgataacagaggagaatcaagatgccattttgtaacctggcggcagcgcaaaagatg

SEQ ID NO: 171522 - DNA, 103 bp, Artificial Sequence
  Synthetic Polynucleotide
taatacgactcactatagggtttctcttcccgtctttgtccaacaaaatgaacagaggagacattttatgggacaaagaaacctggcggcagcgcaaaagatg

SEQ ID NO: 171523 - DNA, 103 bp, Artificial Sequence
  Synthetic Polynucleotide
taatacgactcactatagggctcggccatgctgtgcagggcggccaggggaacagaggagacccctgatggccctgcacaacctggcggcagcgcaaaagatg

SEQ ID NO: 171524 - DNA, 103 bp, Artificial Sequence
  Synthetic Polynucleotide
taatacgactcactatagggtctcgtgtgttttctcttcccgtctttgtcaacagaggagagacaaaatggggaagagaaacctggcggcagcgcaaaagatg

SEQ ID NO: 171525 - DNA, 103 bp, Artificial Sequence
  Synthetic Polynucleotide
taatacgactcactatagggaaaaagtgggtctcgtgtgttttctcttccaacagaggagaggaagaatgaacacacgaaacctggcggcagcgcaaaagatg

SEQ ID NO: 171526 - DNA, 103 bp, Artificial Sequence
  Synthetic Polynucleotide
taatacgactcactatagggtgctgtccggaaaaagtgggtctcgtgtgtaacagaggagaacacacatgacccactttaacctggcggcagcgcaaaagatg

SEQ ID NO: 171527 - DNA, 103 bp, Artificial Sequence
  Synthetic Polynucleotide
taatacgactcactatagggggcgaagatctgctgtccggaaaaagtgggaacagaggagacccactatgtccggacagaacctggcggcagcgcaaaagatg

SEQ ID NO: 171528 - DNA, 103 bp, Artificial Sequence
  Synthetic Polynucleotide
taatacgactcactatagggtcttctccagggcgaagatctgctgtccggaacagaggagaccggacatgagatcttcgaacctggcggcagcgcaaaagatg

SEQ ID NO: 171529 - DNA, 103 bp, Artificial Sequence
  Synthetic Polynucleotide
taatacgactcactatagggtgttcgaaagtcttctccagggcgaagatcaacagaggagagatcttatgcctggagaaaacctggcggcagcgcaaaagatg

SEQ ID NO: 171530 - DNA, 103 bp, Artificial Sequence
  Synthetic Polynucleotide
taatacgactcactataggggtattttgtttgttcgaaagtcttctccagaacagaggagactggagatgactttcgaaaacctggcggcagcgcaaaagatg

SEQ ID NO: 171531 - DNA, 103 bp, Artificial Sequence
  Synthetic Polynucleotide
taatacgactcactataggggccccgccaagtattttgtttgttcgaaagaacagaggagactttcgatgaaacaaaataacctggcggcagcgcaaaagatg

SEQ ID NO: 171532 - DNA, 103 bp, Artificial Sequence
  Synthetic Polynucleotide
taatacgactcactataggggccctctcgggccccgccaagtattttgttaacagaggagaaacaaaatgcttggcgggaacctggcggcagcgcaaaagatg

SEQ ID NO: 171533 - DNA, 103 bp, Artificial Sequence
  Synthetic Polynucleotide
taatacgactcactatagggggccaaacgagccctctcgggccccgccaaaacagaggagattggcgatgcccgagaggaacctggcggcagcgcaaaagatg

SEQ ID NO: 171534 - DNA, 103 bp, Artificial Sequence
  Synthetic Polynucleotide
taatacgactcactataggggggtcttcatctcggccatgctgtgcagggaacagaggagaccctgcatggcatggccgaacctggcggcagcgcaaaagatg

SEQ ID NO: 171535 - DNA, 103 bp, Artificial Sequence
  Synthetic Polynucleotide
taatacgactcactatagggccaacgaataggccaaacgagccctctcggaacagaggagaccgagaatgctcgtttggaacctggcggcagcgcaaaagatg

SEQ ID NO: 171536 - DNA, 103 bp, Artificial Sequence
  Synthetic Polynucleotide
taatacgactcactatagggtctgtcatccccaacgaataggccaaacgaaacagaggagatcgtttatgctattcgttaacctggcggcagcgcaaaagatg

SEQ ID NO: 171537 - DNA, 103 bp, Artificial Sequence
  Synthetic Polynucleotide
taatacgactcactataggggacctgactctctgtcatccccaacgaataaacagaggagatattcgatggggatgacaaacctggcggcagcgcaaaagatg

SEQ ID NO: 171538 - DNA, 103 bp, Artificial Sequence
  Synthetic Polynucleotide
taatacgactcactatagggaccagaccttgacctgactctctgtcatccaacagaggagaggatgaatgagagtcaggaacctggcggcagcgcaaaagatg

SEQ ID NO: 171539 - DNA, 103 bp, Artificial Sequence
  Synthetic Polynucleotide
taatacgactcactatagggcggttctggaaccagaccttgacctgactcaacagaggagagagtcaatgcaaggtctgaacctggcggcagcgcaaaagatg

SEQ ID NO: 171540 - DNA, 103 bp, Artificial Sequence
  Synthetic Polynucleotide
taatacgactcactatagggcttggtccggcggttctggaaccagaccttaacagaggagaaaggtcatgttccagaacaacctggcggcagcgcaaaagatg

SEQ ID NO: 171541 - DNA, 103 bp, Artificial Sequence
  Synthetic Polynucleotide
taatacgactcactatagggtcttcctccacttggtccggcggttctggaaacagaggagatccagaatggccggaccaaacctggcggcagcgcaaaagatg

SEQ ID NO: 171542 - DNA, 103 bp, Artificial Sequence
  Synthetic Polynucleotide
taatacgactcactataggggcagcgtgcttcttcctccacttggtccggaacagaggagaccggacatggtggaggaaaacctggcggcagcgcaaaagatg

SEQ ID NO: 171543 - DNA, 103 bp, Artificial Sequence
  Synthetic Polynucleotide
taatacgactcactatagggggccatctcggcagcgtgcttcttcctccaaacagaggagatggaggatgaagcacgctaacctggcggcagcgcaaaagatg

SEQ ID NO: 171544 - DNA, 103 bp, Artificial Sequence
  Synthetic Polynucleotide
taatacgactcactatagggtcttggccgtggccatctcggcagcgtgctaacagaggagaagcacgatgccgagatggaacctggcggcagcgcaaaagatg

SEQ ID NO: 171545 - DNA, 103 bp, Artificial Sequence
  Synthetic Polynucleotide
taatacgactcactataggggggtacagcggggtcttcatctcggccatgaacagaggagacatggcatggatgaagacaacctggcggcagcgcaaaagatg

SEQ ID NO: 171546 - DNA, 103 bp, Artificial Sequence
  Synthetic Polynucleotide
taatacgactcactatagggtcctgcttcttcttggccgtggccatctcgaacagaggagacgagatatgcacggccaaaacctggcggcagcgcaaaagatg

SEQ ID NO: 171547 - DNA, 103 bp, Artificial Sequence
  Synthetic Polynucleotide
taatacgactcactatagggtgtctccgagtcctgcttcttcttggccgtaacagaggagaacggccatgaagaagcagaacctggcggcagcgcaaaagatg

SEQ ID NO: 171548 - DNA, 103 bp, Artificial Sequence
  Synthetic Polynucleotide
taatacgactcactatagggtgaggcgctctgtctccgagtcctgcttctaacagaggagaagaagcatgactcggagaaacctggcggcagcgcaaaagatg

SEQ ID NO: 171549 - DNA, 103 bp, Artificial Sequence
  Synthetic Polynucleotide
taatacgactcactataggggaggcccccttgaggcgctctgtctccgagaacagaggagactcggaatgagagcgcctaacctggcggcagcgcaaaagatg

SEQ ID NO: 171550 - DNA, 103 bp, Artificial Sequence
  Synthetic Polynucleotide
taatacgactcactatagggctcgttctccgaggcccccttgaggcgctcaacagaggagagagcgcatgaagggggccaacctggcggcagcgcaaaagatg

SEQ ID NO: 171551 - DNA, 103 bp, Artificial Sequence
  Synthetic Polynucleotide
taatacgactcactatagggcgtcctcttcctcgttctccgaggccccctaacagaggagaagggggatgcggagaacgaacctggcggcagcgcaaaagatg

SEQ ID NO: 171552 - DNA, 103 bp, Artificial Sequence
  Synthetic Polynucleotide
taatacgactcactatagggttgtagtcgtcgtcctcttcctcgttctccaacagaggagaggagaaatgggaagaggaaacctggcggcagcgcaaaagatg

SEQ ID NO: 171553 - DNA, 103 bp, Artificial Sequence
  Synthetic Polynucleotide
taatacgactcactatagggcagaggcttattgtagtcgtcgtcctcttcaacagaggagagaagagatggacgactacaacctggcggcagcgcaaaagatg

SEQ ID NO: 171554 - DNA, 103 bp, Artificial Sequence
  Synthetic Polynucleotide
taatacgactcactatagggagttgggatccagaggcttattgtagtcgtaacagaggagaacgactatgataagcctcaacctggcggcagcgcaaaagatg

SEQ ID NO: 171555 - DNA, 103 bp, Artificial Sequence
  Synthetic Polynucleotide
taatacgactcactatagggtcgtcgtccgagttgggatccagaggcttaaacagaggagataagccatgggatcccaaaacctggcggcagcgcaaaagatg

SEQ ID NO: 171556 - DNA, 103 bp, Artificial Sequence
  Synthetic Polynucleotide
taatacgactcactatagggcacgaacgcgcccgggcggttagtgtccataacagaggagaatggacatgaaccgcccgaacctggcggcagcgcaaaagatg

SEQ ID NO: 171557 - DNA, 103 bp, Artificial Sequence
  Synthetic Polynucleotide
taatacgactcactataggggaagccggccggaccctgcagcgcgtagggaacagaggagaccctacatgctgcagggtaacctggcggcagcgcaaaagatg

SEQ ID NO: 171558 - DNA, 103 bp, Artificial Sequence
  Synthetic Polynucleotide
taatacgactcactatagggcgggcgccttgaagccggccggaccctgcaaacagaggagatgcaggatgcggccggctaacctggcggcagcgcaaaagatg

SEQ ID NO: 171559 - DNA, 103 bp, Artificial Sequence
  Synthetic Polynucleotide
taatacgactcactatagggccccccagcgcgggcgccttgaagccggccaacagaggagaggccggatgcaaggcgccaacctggcggcagcgcaaaagatg

SEQ ID NO: 171560 - DNA, 103 bp, Artificial Sequence
  Synthetic Polynucleotide
taatacgactcactatagggcgcgcccaggccccccagcgcgggcgccttaacagaggagaaaggcgatggcgctggggaacctggcggcagcgcaaaagatg

SEQ ID NO: 171561 - DNA, 103 bp, Artificial Sequence
  Synthetic Polynucleotide
taatacgactcactataggggcgggagctgcgcgcccaggccccccagcgaacagaggagacgctggatggcctgggcgaacctggcggcagcgcaaaagatg

SEQ ID NO: 171562 - DNA, 103 bp, Artificial Sequence
  Synthetic Polynucleotide
taatacgactcactatagggggggtcccgagcgggagctgcgcgcccaggaacagaggagacctgggatggcagctcccaacctggcggcagcgcaaaagatg

SEQ ID NO: 171563 - DNA, 103 bp, Artificial Sequence
  Synthetic Polynucleotide
taatacgactcactataggggatgccgtgcggggtcccgagcgggagctgaacagaggagacagctcatgctcgggaccaacctggcggcagcgcaaaagatg

SEQ ID NO: 171564 - DNA, 103 bp, Artificial Sequence
  Synthetic Polynucleotide
taatacgactcactatagggggatgtcgctgatgccgtgcggggtcccgaaacagaggagatcgggaatgcgcacggcaaacctggcggcagcgcaaaagatg

SEQ ID NO: 171565 - DNA, 103 bp, Artificial Sequence
  Synthetic Polynucleotide
taatacgactcactatagggggccggcccaggatgtcgctgatgccgtgcaacagaggagagcacggatgcagcgacataacctggcggcagcgcaaaagatg

SEQ ID NO: 171566 - DNA, 103 bp, Artificial Sequence
  Synthetic Polynucleotide
taatacgactcactatagggcgcgcccacgggccggcccaggatgtcgctaacagaggagaagcgacatgctgggccggaacctggcggcagcgcaaaagatg

SEQ ID NO: 171567 - DNA, 103 bp, Artificial Sequence
  Synthetic Polynucleotide
taatacgactcactatagggcactgctcagcacgaacgcgcccgggcggtaacagaggagaaccgccatggcgcgttcgaacctggcggcagcgcaaaagatg

SEQ ID NO: 171568 - DNA, 103 bp, Artificial Sequence
  Synthetic Polynucleotide
taatacgactcactatagggccccgcccgccgcgcccacgggccggcccaaacagaggagatgggccatgccgtgggcgaacctggcggcagcgcaaaagatg

SEQ ID NO: 171569 - DNA, 103 bp, Artificial Sequence
  Synthetic Polynucleotide
taatacgactcactatagggcccaggaggcccccgcccgccgcgcccacgaacagaggagacgtgggatgggcgggcggaacctggcggcagcgcaaaagatg

SEQ ID NO: 171570 - DNA, 103 bp, Artificial Sequence
  Synthetic Polynucleotide
taatacgactcactataggggggcagcccccccaggaggcccccgcccgcaacagaggagagcgggcatgggcctcctgaacctggcggcagcgcaaaagatg

SEQ ID NO: 171571 - DNA, 103 bp, Artificial Sequence
  Synthetic Polynucleotide
taatacgactcactatagggcgttgagccggggcagcccccccaggaggcaacagaggagagcctccatggggggctgcaacctggcggcagcgcaaaagatg

SEQ ID NO: 171572 - DNA, 103 bp, Artificial Sequence
  Synthetic Polynucleotide
taatacgactcactataggggacgcgagcccgttgagccggggcagccccaacagaggagaggggctatgccggctcaaaacctggcggcagcgcaaaagatg

SEQ ID NO: 171573 - DNA, 103 bp, Artificial Sequence
  Synthetic Polynucleotide
taatacgactcactataggggccggcggacgacgcgagcccgttgagccgaacagaggagacggctcatggggctcgcgaacctggcggcagcgcaaaagatg

SEQ ID NO: 171574 - DNA, 103 bp, Artificial Sequence
  Synthetic Polynucleotide
taatacgactcactatagggcgaagtaaacgccggcggacgacgcgagccaacagaggagaggctcgatgcgtccgccgaacctggcggcagcgcaaaagatg

SEQ ID NO: 171575 - DNA, 103 bp, Artificial Sequence
  Synthetic Polynucleotide
taatacgactcactataggggccgcgggcccgaagtaaacgccggcggacaacagaggagagtccgcatgcgtttacttaacctggcggcagcgcaaaagatg

SEQ ID NO: 171576 - DNA, 103 bp, Artificial Sequence
  Synthetic Polynucleotide
taatacgactcactatagggcgccacagcggccgcgggcccgaagtaaacaacagaggagagtttacatggggcccgcgaacctggcggcagcgcaaaagatg

SEQ ID NO: 171577 - DNA, 103 bp, Artificial Sequence
  Synthetic Polynucleotide
taatacgactcactatagggggtagccgcgcgccacagcggccgcgggccaacagaggagaggcccgatgccgctgtggaacctggcggcagcgcaaaagatg

SEQ ID NO: 171578 - DNA, 103 bp, Artificial Sequence
  Synthetic Polynucleotide
taatacgactcactataggggccagcggggcactgctcagcacgaacgcgaacagaggagacgcgttatggctgagcagaacctggcggcagcgcaaaagatg

SEQ ID NO: 171579 - DNA, 103 bp, Artificial Sequence
  Synthetic Polynucleotide
taatacgactcactatagggaggggcttggggtagccgcgcgccacagcgaacagaggagacgctgtatggcgcggctaaacctggcggcagcgcaaaagatg

SEQ ID NO: 171580 - DNA, 103 bp, Artificial Sequence
  Synthetic Polynucleotide
taatacgactcactatagggcagctcggccaggggcttggggtagccgcgaacagaggagacgcggcatgcccaagcccaacctggcggcagcgcaaaagatg

SEQ ID NO: 171581 - DNA, 103 bp, Artificial Sequence
  Synthetic Polynucleotide
taatacgactcactatagggggcgccccggcagctcggccaggggcttggaacagaggagaccaagcatgtggccgagcaacctggcggcagcgcaaaagatg

SEQ ID NO: 171582 - DNA, 103 bp, Artificial Sequence
  Synthetic Polynucleotide
taatacgactcactatagggaagatgggcgggcgccccggcagctcggccaacagaggagaggccgaatggccggggcgaacctggcggcagcgcaaaagatg

SEQ ID NO: 171583 - DNA, 103 bp, Artificial Sequence
  Synthetic Polynucleotide
taatacgactcactataggggccgggccagaagatgggcgggcgccccggaacagaggagaccggggatgccgcccatcaacctggcggcagcgcaaaagatg

SEQ ID NO: 171584 - DNA, 103 bp, Artificial Sequence
  Synthetic Polynucleotide
taatacgactcactatagggcctgcaccacgccgggccagaagatgggcgaacagaggagacgcccaatgtctggcccgaacctggcggcagcgcaaaagatg

SEQ ID NO: 171585 - DNA, 103 bp, Artificial Sequence
  Synthetic Polynucleotide
taatacgactcactatagggcagggcgcgccctgcaccacgccgggccagaacagaggagactggccatgcgtggtgcaaacctggcggcagcgcaaaagatg

SEQ ID NO: 171586 - DNA, 103 bp, Artificial Sequence
  Synthetic Polynucleotide
taatacgactcactatagggcgggtccctccagggcgcgccctgcaccacaacagaggagagtggtgatgggcgcgcccaacctggcggcagcgcaaaagatg

SEQ ID NO: 171587 - DNA, 103 bp, Artificial Sequence
  Synthetic Polynucleotide
taatacgactcactatagggcagccagacgcgggtccctccagggcgcgcaacagaggagagcgcgcatgggagggaccaacctggcggcagcgcaaaagatg

SEQ ID NO: 171588 - DNA, 103 bp, Artificial Sequence
  Synthetic Polynucleotide
taatacgactcactatagggggggccgggccagccagacgcgggtccctcaacagaggagagagggaatggcgtctggcaacctggcggcagcgcaaaagatg

SEQ ID NO: 171589 - DNA, 103 bp, Artificial Sequence
  Synthetic Polynucleotide
taatacgactcactataggggtgcagcgcggccagcggggcactgctcagaacagaggagactgagcatggccccgctgaacctggcggcagcgcaaaagatg

SEQ ID NO: 171590 - DNA, 103 bp, Artificial Sequence
  Synthetic Polynucleotide
taatacgactcactataggggccgccggccggggccgggccagccagacgaacagaggagacgtctgatgggcccggccaacctggcggcagcgcaaaagatg

SEQ ID NO: 171591 - DNA, 103 bp, Artificial Sequence
  Synthetic Polynucleotide
taatacgactcactatagggtgtccaggacgccgccggccggggccgggcaacagaggagagcccggatgcggccggcgaacctggcggcagcgcaaaagatg

SEQ ID NO: 171592 - DNA, 103 bp, Artificial Sequence
  Synthetic Polynucleotide
taatacgactcactatagggttcccgtccttgtccaggacgccgccggccaacagaggagaggccggatgcgtcctggaaacctggcggcagcgcaaaagatg

SEQ ID NO: 171593 - DNA, 103 bp, Artificial Sequence
  Synthetic Polynucleotide
taatacgactcactataggggtgcttcttcttcccgtccttgtccaggacaacagaggagagtcctgatgaaggacgggaacctggcggcagcgcaaaagatg

SEQ ID NO: 171594 - DNA, 103 bp, Artificial Sequence
  Synthetic Polynucleotide
taatacgactcactatagggtcgggcgcgagtgcttcttcttcccgtcctaacagaggagaaggacgatgagaagaagcaacctggcggcagcgcaaaagatg

SEQ ID NO: 171595 - DNA, 103 bp, Artificial Sequence
  Synthetic Polynucleotide
taatacgactcactatagggcccgagaaggtcgggcgcgagtgcttcttcaacagaggagagaagaaatgctcgcgcccaacctggcggcagcgcaaaagatg

SEQ ID NO: 171596 - DNA, 103 bp, Artificial Sequence
  Synthetic Polynucleotide
taatacgactcactataggggatctgctggcccgagaaggtcgggcgcgaaacagaggagatcgcgcatgaccttctcgaacctggcggcagcgcaaaagatg

SEQ ID NO: 171597 - DNA, 103 bp, Artificial Sequence
  Synthetic Polynucleotide
taatacgactcactatagggccagcgcgaagatctgctggcccgagaaggaacagaggagaccttctatggccagcagaaacctggcggcagcgcaaaagatg

SEQ ID NO: 171598 - DNA, 103 bp, Artificial Sequence
  Synthetic Polynucleotide
taatacgactcactatagggaaggttttctccagcgcgaagatctgctggaacagaggagaccagcaatgcttcgcgctaacctggcggcagcgcaaaagatg

SEQ ID NO: 171599 - DNA, 103 bp, Artificial Sequence
  Synthetic Polynucleotide
taatacgactcactatagggggtctgctcgaaggttttctccagcgcgaaaacagaggagattcgcgatggagaaaaccaacctggcggcagcgcaaaagatg

SEQ ID NO: 171600 - DNA, 103 bp, Artificial Sequence
  Synthetic Polynucleotide
taatacgactcactatagggcggccatgttgtgcagcgcggccagcggggaacagaggagaccccgcatgccgcgctgcaacctggcggcagcgcaaaagatg

SEQ ID NO: 171601 - DNA, 103 bp, Artificial Sequence
  Synthetic Polynucleotide
taatacgactcactatagggccaggtacttggtctgctcgaaggttttctaacagaggagaagaaaaatgtcgagcagaaacctggcggcagcgcaaaagatg

SEQ ID NO: 171602 - DNA, 103 bp, Artificial Sequence
  Synthetic Polynucleotide
taatacgactcactatagggtccgggcccgccaggtacttggtctgctcgaacagaggagacgagcaatgcaagtacctaacctggcggcagcgcaaaagatg

SEQ ID NO: 171603 - DNA, 103 bp, Artificial Sequence
  Synthetic Polynucleotide
taatacgactcactatagggacgcgcgcgctccgggcccgccaggtacttaacagaggagaaagtacatggcgggcccgaacctggcggcagcgcaaaagatg

SEQ ID NO: 171604 - DNA, 103 bp, Artificial Sequence
  Synthetic Polynucleotide
taatacgactcactatagggagtaggcgagacgcgcgcgctccgggcccgaacagaggagacgggccatgagcgcgcgcaacctggcggcagcgcaaaagatg

SEQ ID NO: 171605 - DNA, 103 bp, Artificial Sequence
  Synthetic Polynucleotide
taatacgactcactatagggatgcccagcgagtaggcgagacgcgcgcgcaacagaggagagcgcgcatgtctcgcctaaacctggcggcagcgcaaaagatg

SEQ ID NO: 171606 - DNA, 103 bp, Artificial Sequence
  Synthetic Polynucleotide
taatacgactcactataggggctctcggtcatgcccagcgagtaggcgagaacagaggagactcgccatgtcgctgggcaacctggcggcagcgcaaaagatg

SEQ ID NO: 171607 - DNA, 103 bp, Artificial Sequence
  Synthetic Polynucleotide
taatacgactcactatagggccttcacctggctctcggtcatgcccagcgaacagaggagacgctggatgtgaccgagaaacctggcggcagcgcaaaagatg

SEQ ID NO: 171608 - DNA, 103 bp, Artificial Sequence
  Synthetic Polynucleotide
taatacgactcactatagggtggaaccagaccttcacctggctctcggtcaacagaggagagaccgaatgccaggtgaaaacctggcggcagcgcaaaagatg

SEQ ID NO: 171609 - DNA, 103 bp, Artificial Sequence
  Synthetic Polynucleotide
taatacgactcactatagggccggcggttctggaaccagaccttcacctgaacagaggagacaggtgatggtctggttcaacctggcggcagcgcaaaagatg

SEQ ID NO: 171610 - DNA, 103 bp, Artificial Sequence
  Synthetic Polynucleotide
taatacgactcactataggggccacttggtccggcggttctggaaccagaaacagaggagatctggtatgagaaccgccaacctggcggcagcgcaaaagatg

SEQ ID NO: 171611 - DNA, 103 bp, Artificial Sequence
  Synthetic Polynucleotide
taatacgactcactataggggtcttcatctcggccatgttgtgcagcgcgaacagaggagacgcgctatgcaacatggcaacctggcggcagcgcaaaagatg

SEQ ID NO: 171612 - DNA, 103 bp, Artificial Sequence
  Synthetic Polynucleotide
taatacgactcactatagggtgccgcttgcgccacttggtccggcggttcaacagaggagagaaccgatggaccaagtgaacctggcggcagcgcaaaagatg

SEQ ID NO: 171613 - DNA, 103 bp, Artificial Sequence
  Synthetic Polynucleotide
taatacgactcactatagggctccaccgcgtgccgcttgcgccacttggtaacagaggagaaccaagatgcgcaagcggaacctggcggcagcgcaaaagatg

SEQ ID NO: 171614 - DNA, 103 bp, Artificial Sequence
  Synthetic Polynucleotide
taatacgactcactatagggccgacgccatctccaccgcgtgccgcttgcaacagaggagagcaagcatgacgcggtggaacctggcggcagcgcaaaagatg

SEQ ID NO: 171615 - DNA, 103 bp, Artificial Sequence
  Synthetic Polynucleotide
taatacgactcactatagggttcttcttggccgacgccatctccaccgcgaacagaggagacgcggtatggatggcgtcaacctggcggcagcgcaaaagatg

SEQ ID NO: 171616 - DNA, 103 bp, Artificial Sequence
  Synthetic Polynucleotide
taatacgactcactatagggcgagtcctgcttcttcttggccgacgccataacagaggagaatggcgatggccaagaagaacctggcggcagcgcaaaagatg

SEQ ID NO: 171617 - DNA, 103 bp, Artificial Sequence
  Synthetic Polynucleotide
taatacgactcactatagggtctcggcgtccgagtcctgcttcttcttggaacagaggagaccaagaatgagcaggactaacctggcggcagcgcaaaagatg

SEQ ID NO: 171618 - DNA, 103 bp, Artificial Sequence
  Synthetic Polynucleotide
taatacgactcactatagggaccttcagcttctcggcgtccgagtcctgcaacagaggagagcaggaatgggacgccgaaacctggcggcagcgcaaaagatg

SEQ ID NO: 171619 - DNA, 103 bp, Artificial Sequence
  Synthetic Polynucleotide
taatacgactcactatagggcgagccgcccaccttcagcttctcggcgtcaacagaggagagacgccatgaagctgaagaacctggcggcagcgcaaaagatg

SEQ ID NO: 171620 - DNA, 103 bp, Artificial Sequence
  Synthetic Polynucleotide
taatacgactcactatagggcctccgcgtccgagccgcccaccttcagctaacagaggagaagctgaatgtgggcggctaacctggcggcagcgcaaaagatg

SEQ ID NO: 171621 - DNA, 103 bp, Artificial Sequence
  Synthetic Polynucleotide
taatacgactcactatagggtcgtcgtcgtcctccgcgtccgagccgcccaacagaggagagggcggatgggacgcggaaacctggcggcagcgcaaaagatg

SEQ ID NO: 171622 - DNA, 103 bp, Artificial Sequence
  Synthetic Polynucleotide
taatacgactcactataggggaacagcgacgtcttcatctcggccatgttaacagaggagaaacatgatggagatgaagaacctggcggcagcgcaaaagatg

SEQ ID NO: 171623 - DNA, 103 bp, Artificial Sequence
  Synthetic Polynucleotide
taatacgactcactatagggccggttgtattcgtcgtcgtcctccgcgtcaacagaggagagacgcgatggacgacgacaacctggcggcagcgcaaaagatg

SEQ ID NO: 171624 - DNA, 103 bp, Artificial Sequence
  Synthetic Polynucleotide
taatacgactcactatagggggtccaggggccggttgtattcgtcgtcgtaacagaggagaacgacgatgaatacaaccaacctggcggcagcgcaaaagatg

SEQ ID NO: 171625 - DNA, 103 bp, Artificial Sequence
  Synthetic Polynucleotide
taatacgactcactatagggtccgagttggggtccaggggccggttgtataacagaggagaatacaaatggcccctggaaacctggcggcagcgcaaaagatg

SEQ ID NO: 171626 - DNA, 103 bp, Artificial Sequence
  Synthetic Polynucleotide
taatacgactcactatagggcttctcgtcgtccgagttggggtccaggggaacagaggagacccctgatgcccaactcgaacctggcggcagcgcaaaagatg

SEQ ID NO: 171627 - DNA, 103 bp, Artificial Sequence
  Synthetic Polynucleotide
taatacgactcactataggggccgcgtgatcttctcgtcgtccgagttggaacagaggagaccaactatgacgacgagaaacctggcggcagcgcaaaagatg

SEQ ID NO: 171628 - DNA, 103 bp, Artificial Sequence
  Synthetic Polynucleotide
taatacgactcactatagggttcttgagcagccgcgtgatcttctcgtcgaacagaggagacgacgaatggatcacgcgaacctggcggcagcgcaaaagatg

SEQ ID NO: 171629 - DNA, 103 bp, Artificial Sequence
  Synthetic Polynucleotide
taatacgactcactataggggggtttgtgcttcttgagcagccgcgtgataacagaggagaatcacgatgctgctcaagaacctggcggcagcgcaaaagatg

SEQ ID NO: 171630 - DNA, 103 bp, Artificial Sequence
  Synthetic Polynucleotide
taatacgactcactatagggccaagttcgagggtttgtgcttcttgagcaaacagaggagatgctcaatgagcacaaacaacctggcggcagcgcaaaagatg

SEQ ID NO: 171631 - DNA, 103 bp, Artificial Sequence
  Synthetic Polynucleotide
taatacgactcactatagggctgaccagcgccaagttcgagggtttgtgcaacagaggagagcacaaatgctcgaacttaacctggcggcagcgcaaaagatg

SEQ ID NO: 171632 - DNA, 103 bp, Artificial Sequence
  Synthetic Polynucleotide
taatacgactcactataggggccgcacgggctgaccagcgccaagttcgaaacagaggagatcgaacatggcgctggtcaacctggcggcagcgcaaaagatg

SEQ ID NO: 171633 - DNA, 103 bp, Artificial Sequence
  Synthetic Polynucleotide
taatacgactcactataggggcgcgtaggggaacagcgacgtcttcatctaacagaggagaagatgaatgcgtcgctgtaacctggcggcagcgcaaaagatg

SEQ ID NO: 171634 - DNA, 103 bp, Artificial Sequence
  Synthetic Polynucleotide
taatacgactcactatagggccgcgccgccgccgcacgggctgaccagcgaacagaggagacgctggatggcccgtgcgaacctggcggcagcgcaaaagatg

SEQ ID NO: 171635 - DNA, 103 bp, Artificial Sequence
  Synthetic Polynucleotide
taatacgactcactatagggaaggcgtcccccgcgccgccgccgcacgggaacagaggagacccgtgatgcggcggcgcaacctggcggcagcgcaaaagatg

SEQ ID NO: 171636 - DNA, 103 bp, Artificial Sequence
  Synthetic Polynucleotide
taatacgactcactatagggggaccctgcagcgcgtaggggaacagcgacaacagaggagagtcgctatgcccctacgcaacctggcggcagcgcaaaagatg

SEQ ID NO: 171637 - DNA, 103 bp, Artificial Sequence
  Synthetic Polynucleotide
taatacgactcactataggggttgccgagctggaggccaacggggtccataacagaggagaatggacatggttggcctcaacctggcggcagcgcaaaagatg

SEQ ID NO: 171638 - DNA, 103 bp, Artificial Sequence
  Synthetic Polynucleotide
taatacgactcactataggggtccgtgttggggaggaagaacttcatcttaacagaggagaaagatgatgttcttcctcaacctggcggcagcgcaaaagatg

SEQ ID NO: 171639 - DNA, 103 bp, Artificial Sequence
  Synthetic Polynucleotide
taatacgactcactataggggcagccaggcaggagggtcccattgcagagaacagaggagactctgcatggggaccctcaacctggcggcagcgcaaaagatg

SEQ ID NO: 171640 - DNA, 103 bp, Artificial Sequence
  Synthetic Polynucleotide
taatacgactcactatagggccatcacccggcagccaggcaggagggtccaacagaggagaggacccatgtgcctggctaacctggcggcagcgcaaaagatg

SEQ ID NO: 171641 - DNA, 103 bp, Artificial Sequence
  Synthetic Polynucleotide
taatacgactcactatagggcgggaggtagccatcacccggcagccaggcaacagaggagagcctggatgccgggtgataacctggcggcagcgcaaaagatg

SEQ ID NO: 171642 - DNA, 103 bp, Artificial Sequence
  Synthetic Polynucleotide
taatacgactcactatagggcttccctggacgggaggtagccatcacccgaacagaggagacgggtgatggctacctccaacctggcggcagcgcaaaagatg

SEQ ID NO: 171643 - DNA, 103 bp, Artificial Sequence
  Synthetic Polynucleotide
taatacgactcactatagggaggcaggcagcttccctggacgggaggtagaacagaggagactacctatggtccagggaaacctggcggcagcgcaaaagatg

SEQ ID NO: 171644 - DNA, 103 bp, Artificial Sequence
  Synthetic Polynucleotide
taatacgactcactataggggcaggcaggcaggcaggcagcttccctggaaacagaggagatccaggatggctgcctgcaacctggcggcagcgcaaaagatg

SEQ ID NO: 171645 - DNA, 103 bp, Artificial Sequence
  Synthetic Polynucleotide
taatacgactcactatagggggctgcctctgcaggcaggcaggcaggcagaacagaggagactgcctatgtgcctgcctaacctggcggcagcgcaaaagatg

SEQ ID NO: 171646 - DNA, 103 bp, Artificial Sequence
  Synthetic Polynucleotide
taatacgactcactatagggtgtggaccatggctgcctctgcaggcaggcaacagaggagagcctgcatgcagaggcagaacctggcggcagcgcaaaagatg

SEQ ID NO: 171647 - DNA, 103 bp, Artificial Sequence
  Synthetic Polynucleotide
taatacgactcactatagggaagcccaacatgtggaccatggctgcctctaacagaggagaagaggcatgcatggtccaaacctggcggcagcgcaaaagatg

SEQ ID NO: 171648 - DNA, 103 bp, Artificial Sequence
  Synthetic Polynucleotide
taatacgactcactatagggtggcccatcaaagcccaacatgtggaccataacagaggagaatggtcatgatgttgggcaacctggcggcagcgcaaaagatg

SEQ ID NO: 171649 - DNA, 103 bp, Artificial Sequence
  Synthetic Polynucleotide
taatacgactcactatagggtggaatccaggtccgtgttggggaggaagaaacagaggagatcttccatgccaacacggaacctggcggcagcgcaaaagatg

SEQ ID NO: 171650 - DNA, 103 bp, Artificial Sequence
  Synthetic Polynucleotide
taatacgactcactatagggcttccacccgtggcccatcaaagcccaacaaacagaggagatgttggatgttgatgggcaacctggcggcagcgcaaaagatg

SEQ ID NO: 171651 - DNA, 103 bp, Artificial Sequence
  Synthetic Polynucleotide
taatacgactcactatagggttcacatattcttccacccgtggcccatcaaacagaggagatgatggatgacgggtggaaacctggcggcagcgcaaaagatg

SEQ ID NO: 171652 - DNA, 103 bp, Artificial Sequence
  Synthetic Polynucleotide
taatacgactcactataggggaagaagtgattcacatattcttccacccgaacagaggagacgggtgatggaatatgtgaacctggcggcagcgcaaaagatg

SEQ ID NO: 171653 - DNA, 103 bp, Artificial Sequence
  Synthetic Polynucleotide
taatacgactcactataggggctgggcgctgaagaagtgattcacatattaacagaggagaaatatgatgatcacttctaacctggcggcagcgcaaaagatg

SEQ ID NO: 171654 - DNA, 103 bp, Artificial Sequence
  Synthetic Polynucleotide
taatacgactcactatagggtcccgcgatggctgggcgctgaagaagtgaaacagaggagatcacttatgcagcgcccaaacctggcggcagcgcaaaagatg

SEQ ID NO: 171655 - DNA, 103 bp, Artificial Sequence
  Synthetic Polynucleotide
taatacgactcactatagggcagggccccctcccgcgatggctgggcgctaacagaggagaagcgccatgccatcgcggaacctggcggcagcgcaaaagatg

SEQ ID NO: 171656 - DNA, 103 bp, Artificial Sequence
  Synthetic Polynucleotide
taatacgactcactataggggtaactccaccagggccccctcccgcgatgaacagaggagacatcgcatgagggggcccaacctggcggcagcgcaaaagatg

SEQ ID NO: 171657 - DNA, 103 bp, Artificial Sequence
  Synthetic Polynucleotide
taatacgactcactatagggccatttgtctgtaactccaccagggcccccaacagaggagagggggcatgggtggagttaacctggcggcagcgcaaaagatg

SEQ ID NO: 171658 - DNA, 103 bp, Artificial Sequence
  Synthetic Polynucleotide
taatacgactcactatagggtcggagacgtccatttgtctgtaactccacaacagaggagagtggagatgcagacaaataacctggcggcagcgcaaaagatg

SEQ ID NO: 171659 - DNA, 103 bp, Artificial Sequence
  Synthetic Polynucleotide
taatacgactcactatagggcacacaggcttcggagacgtccatttgtctaacagaggagaagacaaatggacgtctccaacctggcggcagcgcaaaagatg

SEQ ID NO: 171660 - DNA, 103 bp, Artificial Sequence
  Synthetic Polynucleotide
taatacgactcactataggggtctcgttcctggaatccaggtccgtgttgaacagaggagacaacacatgcctggattcaacctggcggcagcgcaaaagatg

SEQ ID NO: 171661 - DNA, 103 bp, Artificial Sequence
  Synthetic Polynucleotide
taatacgactcactataggggcgggcaccgcacacaggcttcggagacgtaacagaggagaacgtctatgaagcctgtgaacctggcggcagcgcaaaagatg

SEQ ID NO: 171662 - DNA, 103 bp, Artificial Sequence
  Synthetic Polynucleotide
taatacgactcactatagggttggcacagtgcgggcaccgcacacaggctaacagaggagaagcctgatggcggtgcccaacctggcggcagcgcaaaagatg

SEQ ID NO: 171663 - DNA, 103 bp, Artificial Sequence
  Synthetic Polynucleotide
taatacgactcactataggggacaggcgacttggcacagtgcgggcaccgaacagaggagacggtgcatgcactgtgccaacctggcggcagcgcaaaagatg

SEQ ID NO: 171664 - DNA, 103 bp, Artificial Sequence
  Synthetic Polynucleotide
taatacgactcactatagggtggaggcagagacaggcgacttggcacagtaacagaggagaactgtgatgagtcgcctgaacctggcggcagcgcaaaagatg

SEQ ID NO: 171665 - DNA, 103 bp, Artificial Sequence
  Synthetic Polynucleotide
taatacgactcactatagggaagcagatggtggaggcagagacaggcgacaacagaggagagtcgccatgctctgcctcaacctggcggcagcgcaaaagatg

SEQ ID NO: 171666 - DNA, 103 bp, Artificial Sequence
  Synthetic Polynucleotide
taatacgactcactatagggcgtggtcaggaagcagatggtggaggcagaaacagaggagatctgccatgaccatctgcaacctggcggcagcgcaaaagatg

SEQ ID NO: 171667 - DNA, 103 bp, Artificial Sequence
  Synthetic Polynucleotide
taatacgactcactatagggtggcctggggcgtggtcaggaagcagatggaacagaggagaccatctatgtcctgaccaaacctggcggcagcgcaaaagatg

SEQ ID NO: 171668 - DNA, 103 bp, Artificial Sequence
  Synthetic Polynucleotide
taatacgactcactatagggggccacagactggcctggggcgtggtcaggaacagaggagacctgacatggccccaggcaacctggcggcagcgcaaaagatg

SEQ ID NO: 171669 - DNA, 103 bp, Artificial Sequence
  Synthetic Polynucleotide
taatacgactcactatagggtgggcaggagggccacagactggcctggggaacagaggagaccccagatgagtctgtggaacctggcggcagcgcaaaagatg

SEQ ID NO: 171670 - DNA, 103 bp, Artificial Sequence
  Synthetic Polynucleotide
taatacgactcactatagggtgagtcatgttgggcaggagggccacagacaacagaggagagtctgtatgcctcctgccaacctggcggcagcgcaaaagatg

SEQ ID NO: 171671 - DNA, 103 bp, Artificial Sequence
  Synthetic Polynucleotide
taatacgactcactatagggagggtccaaggtctcgttcctggaatccagaacagaggagactggatatgaggaacgagaacctggcggcagcgcaaaagatg

SEQ ID NO: 171672 - DNA, 103 bp, Artificial Sequence
  Synthetic Polynucleotide
taatacgactcactatagggcatatagagctgagtcatgttgggcaggagaacagaggagactcctgatgaacatgactaacctggcggcagcgcaaaagatg

SEQ ID NO: 171673 - DNA, 103 bp, Artificial Sequence
  Synthetic Polynucleotide
taatacgactcactataggggcaccatctgcatatagagctgagtcatgtaacagaggagaacatgaatgagctctataaacctggcggcagcgcaaaagatg

SEQ ID NO: 171674 - DNA, 103 bp, Artificial Sequence
  Synthetic Polynucleotide
taatacgactcactatagggctgagggcgagcaccatctgcatatagagcaacagaggagagctctaatggcagatggtaacctggcggcagcgcaaaagatg

SEQ ID NO: 171675 - DNA, 103 bp, Artificial Sequence
  Synthetic Polynucleotide
taatacgactcactatagggcccaggggggctgagggcgagcaccatctgaacagaggagacagatgatgctcgccctcaacctggcggcagcgcaaaagatg

SEQ ID NO: 171676 - DNA, 103 bp, Artificial Sequence
  Synthetic Polynucleotide
taatacgactcactatagggtgggcaagtgcccaggggggctgagggcgaaacagaggagatcgcccatggcccccctgaacctggcggcagcgcaaaagatg

SEQ ID NO: 171677 - DNA, 103 bp, Artificial Sequence
  Synthetic Polynucleotide
taatacgactcactatagggagggacgaggtgggcaagtgcccaggggggaacagaggagaccccccatggcacttgccaacctggcggcagcgcaaaagatg

SEQ ID NO: 171678 - DNA, 103 bp, Artificial Sequence
  Synthetic Polynucleotide
taatacgactcactatagggcaggtccagtagggacgaggtgggcaagtgaacagaggagacacttgatgacctcgtccaacctggcggcagcgcaaaagatg

SEQ ID NO: 171679 - DNA, 103 bp, Artificial Sequence
  Synthetic Polynucleotide
taatacgactcactatagggccacctcccccaggtccagtagggacgaggaacagaggagacctcgtatgtactggaccaacctggcggcagcgcaaaagatg

SEQ ID NO: 171680 - DNA, 103 bp, Artificial Sequence
  Synthetic Polynucleotide
taatacgactcactatagggcccctcagggccacctcccccaggtccagtaacagaggagaactggaatggggggaggtaacctggcggcagcgcaaaagatg

SEQ ID NO: 171681 - DNA, 103 bp, Artificial Sequence
  Synthetic Polynucleotide
taatacgactcactatagggtgtctccaggcccctcagggccacctccccaacagaggagaggggagatggccctgaggaacctggcggcagcgcaaaagatg

SEQ ID NO: 171682 - DNA, 103 bp, Artificial Sequence
  Synthetic Polynucleotide
taatacgactcactatagggctctctgttcagggtccaaggtctcgttccaacagaggagaggaacgatgccttggaccaacctggcggcagcgcaaaagatg

SEQ ID NO: 171683 - DNA, 103 bp, Artificial Sequence
  Synthetic Polynucleotide
taatacgactcactatagggtaaccttccctgtctccaggcccctcagggaacagaggagaccctgaatggcctggagaaacctggcggcagcgcaaaagatg

SEQ ID NO: 171684 - DNA, 103 bp, Artificial Sequence
  Synthetic Polynucleotide
taatacgactcactataggggcatagaagataaccttccctgtctccaggaacagaggagacctggaatgagggaaggtaacctggcggcagcgcaaaagatg

SEQ ID NO: 171685 - DNA, 103 bp, Artificial Sequence
  Synthetic Polynucleotide
taatacgactcactatagggaatatcttttgcatagaagataaccttcccaacagaggagagggaagatgatcttctataacctggcggcagcgcaaaagatg

SEQ ID NO: 171686 - DNA, 103 bp, Artificial Sequence
  Synthetic Polynucleotide
taatacgactcactatagggagggtggagcaatatcttttgcatagaagaaacagaggagatcttctatgcaaaagataaacctggcggcagcgcaaaagatg

SEQ ID NO: 171687 - DNA, 103 bp, Artificial Sequence
  Synthetic Polynucleotide
taatacgactcactatagggaaagctatcaagggtggagcaatatcttttaacagaggagaaaaagaatgtgctccaccaacctggcggcagcgcaaaagatg

SEQ ID NO: 171688 - DNA, 103 bp, Artificial Sequence
  Synthetic Polynucleotide
taatacgactcactatagggagtggccccaaaagctatcaagggtggagcaacagaggagagctccaatgttgatagctaacctggcggcagcgcaaaagatg

SEQ ID NO: 171689 - DNA, 103 bp, Artificial Sequence
  Synthetic Polynucleotide
taatacgactcactataggggcaggctgtgagtggccccaaaagctatcaaacagaggagatgatagatgttggggccaaacctggcggcagcgcaaaagatg

SEQ ID NO: 171690 - DNA, 103 bp, Artificial Sequence
  Synthetic Polynucleotide
taatacgactcactatagggaaggaagtcagcaggctgtgagtggccccaaacagaggagatggggcatgtcacagcctaacctggcggcagcgcaaaagatg

SEQ ID NO: 171691 - DNA, 103 bp, Artificial Sequence
  Synthetic Polynucleotide
taatacgactcactataggggcagacgcagaaggaagtcagcaggctgtgaacagaggagacacagcatgctgacttccaacctggcggcagcgcaaaagatg

SEQ ID NO: 171692 - DNA, 103 bp, Artificial Sequence
  Synthetic Polynucleotide
taatacgactcactatagggcagggcctgtgcagacgcagaaggaagtcaaacagaggagatgacttatgtctgcgtctaacctggcggcagcgcaaaagatg

SEQ ID NO: 171693 - DNA, 103 bp, Artificial Sequence
  Synthetic Polynucleotide
taatacgactcactatagggtgcaggatgactctctgttcagggtccaagaacagaggagacttggaatgtgaacagagaacctggcggcagcgcaaaagatg

SEQ ID NO: 171694 - DNA, 103 bp, Artificial Sequence
  Synthetic Polynucleotide
taatacgactcactatagggtgctggtgcccagggcctgtgcagacgcagaacagaggagactgcgtatgcacaggcccaacctggcggcagcgcaaaagatg

SEQ ID NO: 171695 - DNA, 103 bp, Artificial Sequence
  Synthetic Polynucleotide
taatacgactcactatagggatagcctgtctgctggtgcccagggcctgtaacagaggagaacaggcatggggcaccagaacctggcggcagcgcaaaagatg

SEQ ID NO: 171696 - DNA, 103 bp, Artificial Sequence
  Synthetic Polynucleotide
taatacgactcactataggggggtgaaagcatagcctgtctgctggtgccaacagaggagaggcaccatgagacaggctaacctggcggcagcgcaaaagatg

SEQ ID NO: 171697 - DNA, 103 bp, Artificial Sequence
  Synthetic Polynucleotide
taatacgactcactatagggaggctgaggtgggtgaaagcatagcctgtcaacagaggagagacaggatgtgctttcacaacctggcggcagcgcaaaagatg

SEQ ID NO: 171698 - DNA, 103 bp, Artificial Sequence
  Synthetic Polynucleotide
taatacgactcactatagggaaactcctgcaggctgaggtgggtgaaagcaacagaggagagctttcatgcacctcagcaacctggcggcagcgcaaaagatg

SEQ ID NO: 171699 - DNA, 103 bp, Artificial Sequence
  Synthetic Polynucleotide
taatacgactcactataggggggcagcaagaaactcctgcaggctgaggtaacagaggagaacctcaatgtgcaggagtaacctggcggcagcgcaaaagatg

SEQ ID NO: 171700 - DNA, 103 bp, Artificial Sequence
  Synthetic Polynucleotide
taatacgactcactatagggatcaggtgcagggcagcaagaaactcctgcaacagaggagagcaggaatgtcttgctgcaacctggcggcagcgcaaaagatg

SEQ ID NO: 171701 - DNA, 103 bp, Artificial Sequence
  Synthetic Polynucleotide
taatacgactcactatagggggggctggccatcaggtgcagggcagcaagaacagaggagacttgctatgctgcacctgaacctggcggcagcgcaaaagatg

SEQ ID NO: 171702 - DNA, 103 bp, Artificial Sequence
  Synthetic Polynucleotide
taatacgactcactatagggtgttcaccttggggctggccatcaggtgcaaacagaggagatgcaccatgtggccagccaacctggcggcagcgcaaaagatg

SEQ ID NO: 171703 - DNA, 103 bp, Artificial Sequence
  Synthetic Polynucleotide
taatacgactcactatagggagtgtgtctttgttcaccttggggctggccaacagaggagaggccagatgcaaggtgaaaacctggcggcagcgcaaaagatg

SEQ ID NO: 171704 - DNA, 103 bp, Artificial Sequence
  Synthetic Polynucleotide
taatacgactcactatagggcttgttgagttgcaggatgactctctgttcaacagaggagagaacagatggtcatcctgaacctggcggcagcgcaaaagatg

SEQ ID NO: 171705 - DNA, 103 bp, Artificial Sequence
  Synthetic Polynucleotide
taatacgactcactatagggatactgggtaagtgtgtctttgttcaccttaacagaggagaaaggtgatgaaagacacaaacctggcggcagcgcaaaagatg

SEQ ID NO: 171706 - DNA, 103 bp, Artificial Sequence
  Synthetic Polynucleotide
taatacgactcactatagggggagggtaacatactgggtaagtgtgtcttaacagaggagaaagacaatgttacccagtaacctggcggcagcgcaaaagatg

SEQ ID NO: 171707 - DNA, 103 bp, Artificial Sequence
  Synthetic Polynucleotide
taatacgactcactatagggcagcgggaatggagggtaacatactgggtaaacagaggagatacccaatgtgttaccctaacctggcggcagcgcaaaagatg

SEQ ID NO: 171708 - DNA, 103 bp, Artificial Sequence
  Synthetic Polynucleotide
taatacgactcactatagggccgctgtacccagcgggaatggagggtaacaacagaggagagttaccatgcattcccgcaacctggcggcagcgcaaaagatg

SEQ ID NO: 171709 - DNA, 103 bp, Artificial Sequence
  Synthetic Polynucleotide
taatacgactcactatagggtagctttggtccgctgtacccagcgggaataacagaggagaattcccatggggtacagcaacctggcggcagcgcaaaagatg

SEQ ID NO: 171710 - DNA, 103 bp, Artificial Sequence
  Synthetic Polynucleotide
taatacgactcactatagggaggcccagtctagctttggtccgctgtaccaacagaggagaggtacaatggaccaaagcaacctggcggcagcgcaaaagatg

SEQ ID NO: 171711 - DNA, 103 bp, Artificial Sequence
  Synthetic Polynucleotide
taatacgactcactataggggtggtctgagaggcccagtctagctttggtaacagaggagaaccaaaatgagactgggcaacctggcggcagcgcaaaagatg

SEQ ID NO: 171712 - DNA, 103 bp, Artificial Sequence
  Synthetic Polynucleotide
taatacgactcactatagggaggtggggaggtggtctgagaggcccagtcaacagaggagagactggatgtctcagaccaacctggcggcagcgcaaaagatg

SEQ ID NO: 171713 - DNA, 103 bp, Artificial Sequence
  Synthetic Polynucleotide
taatacgactcactatagggcccgccaggaaggtggggaggtggtctgagaacagaggagactcagaatgcctccccacaacctggcggcagcgcaaaagatg

SEQ ID NO: 171714 - DNA, 103 bp, Artificial Sequence
  Synthetic Polynucleotide
taatacgactcactatagggggatgccaggcccgccaggaaggtggggagaacagaggagactccccatgttcctggcgaacctggcggcagcgcaaaagatg

SEQ ID NO: 171715 - DNA, 103 bp, Artificial Sequence
  Synthetic Polynucleotide
taatacgactcactatagggggacatgcagcttgttgagttgcaggatgaaacagaggagatcatccatgaactcaacaaacctggcggcagcgcaaaagatg

SEQ ID NO: 171716 - DNA, 103 bp, Artificial Sequence
  Synthetic Polynucleotide
taatacgactcactatagggggcaggtgcaggatgccaggcccgccaggaaacagaggagatcctggatggcctggcataacctggcggcagcgcaaaagatg

SEQ ID NO: 171717 - DNA, 103 bp, Artificial Sequence
  Synthetic Polynucleotide
taatacgactcactatagggaggaaggggcggcaggtgcaggatgccaggaacagaggagacctggcatgctgcacctgaacctggcggcagcgcaaaagatg

SEQ ID NO: 171718 - DNA, 103 bp, Artificial Sequence
  Synthetic Polynucleotide
taatacgactcactatagggcaggtggctaaggaaggggcggcaggtgcaaacagaggagatgcaccatgcgccccttcaacctggcggcagcgcaaaagatg

SEQ ID NO: 171719 - DNA, 103 bp, Artificial Sequence
  Synthetic Polynucleotide
taatacgactcactatagggtgccctgcgccaggtggctaaggaaggggcaacagaggagagcccctatgttagccaccaacctggcggcagcgcaaaagatg

SEQ ID NO: 171720 - DNA, 103 bp, Artificial Sequence
  Synthetic Polynucleotide
taatacgactcactatagggcagtcctcattgccctgcgccaggtggctaaacagaggagatagccaatgggcgcagggaacctggcggcagcgcaaaagatg

SEQ ID NO: 171721 - DNA, 103 bp, Artificial Sequence
  Synthetic Polynucleotide
taatacgactcactatagggggcacccacacagtcctcattgccctgcgcaacagaggagagcgcagatgaatgaggacaacctggcggcagcgcaaaagatg

SEQ ID NO: 171722 - DNA, 103 bp, Artificial Sequence
  Synthetic Polynucleotide
taatacgactcactatagggcagcctgcttggcacccacacagtcctcataacagaggagaatgaggatggtgtgggtgaacctggcggcagcgcaaaagatg

SEQ ID NO: 171723 - DNA, 103 bp, Artificial Sequence
  Synthetic Polynucleotide
taatacgactcactatagggtgcactacagcagcctgcttggcacccacaaacagaggagatgtgggatgcaagcaggcaacctggcggcagcgcaaaagatg

SEQ ID NO: 171724 - DNA, 103 bp, Artificial Sequence
  Synthetic Polynucleotide
taatacgactcactatagggcttcaacacctgcactacagcagcctgcttaacagaggagaaagcagatggctgtagtgaacctggcggcagcgcaaaagatg

SEQ ID NO: 171725 - DNA, 103 bp, Artificial Sequence
  Synthetic Polynucleotide
taatacgactcactatagggtggccaacttcttcaacacctgcactacagaacagaggagactgtagatgaggtgttgaaacctggcggcagcgcaaaagatg

SEQ ID NO: 171726 - DNA, 103 bp, Artificial Sequence
  Synthetic Polynucleotide
taatacgactcactatagggtccgaaccctggacatgcagcttgttgagtaacagaggagaactcaaatggctgcatgtaacctggcggcagcgcaaaagatg

SEQ ID NO: 171727 - DNA, 103 bp, Artificial Sequence
  Synthetic Polynucleotide
taatacgactcactatagggagcttgcgggtggccaacttcttcaacaccaacagaggagaggtgttatggaagttggcaacctggcggcagcgcaaaagatg

SEQ ID NO: 171728 - DNA, 103 bp, Artificial Sequence
  Synthetic Polynucleotide
taatacgactcactatagggtggccctgtgagcttgcgggtggccaacttaacagaggagaaagttgatgacccgcaagaacctggcggcagcgcaaaagatg

SEQ ID NO: 171729 - DNA, 103 bp, Artificial Sequence
  Synthetic Polynucleotide
taatacgactcactatagggctacaacctttggccctgtgagcttgcgggaacagaggagacccgcaatgtcacagggcaacctggcggcagcgcaaaagatg

SEQ ID NO: 171730 - DNA, 103 bp, Artificial Sequence
  Synthetic Polynucleotide
taatacgactcactatagggtgacacagctctacaacctttggccctgtgaacagaggagacacaggatgaaaggttgtaacctggcggcagcgcaaaagatg

SEQ ID NO: 171731 - DNA, 103 bp, Artificial Sequence
  Synthetic Polynucleotide
taatacgactcactatagggatccacacagtgacacagctctacaaccttaacagaggagaaaggttatggagctgtgtaacctggcggcagcgcaaaagatg

SEQ ID NO: 171732 - DNA, 103 bp, Artificial Sequence
  Synthetic Polynucleotide
taatacgactcactatagggcctgtgtctcatccacacagtgacacagctaacagaggagaagctgtatgactgtgtggaacctggcggcagcgcaaaagatg

SEQ ID NO: 171733 - DNA, 103 bp, Artificial Sequence
  Synthetic Polynucleotide
taatacgactcactatagggagctcaggctcctgtgtctcatccacacagaacagaggagactgtgtatgtgagacacaaacctggcggcagcgcaaaagatg

SEQ ID NO: 171734 - DNA, 103 bp, Artificial Sequence
  Synthetic Polynucleotide
taatacgactcactataggggagactggccagctcaggctcctgtgtctcaacagaggagagagacaatggagcctgagaacctggcggcagcgcaaaagatg

SEQ ID NO: 171735 - DNA, 103 bp, Artificial Sequence
  Synthetic Polynucleotide
taatacgactcactatagggtttgtgcggtgagactggccagctcaggctaacagaggagaagcctgatgtggccagtcaacctggcggcagcgcaaaagatg

SEQ ID NO: 171736 - DNA, 103 bp, Artificial Sequence
  Synthetic Polynucleotide
taatacgactcactatagggtaggggaggctttgtgcggtgagactggccaacagaggagaggccagatgcaccgcacaaacctggcggcagcgcaaaagatg

SEQ ID NO: 171737 - DNA, 103 bp, Artificial Sequence
  Synthetic Polynucleotide
taatacgactcactatagggctgccaggtgtccgaaccctggacatgcagaacagaggagactgcatatgcagggttcgaacctggcggcagcgcaaaagatg

SEQ ID NO: 171738 - DNA, 103 bp, Artificial Sequence
  Synthetic Polynucleotide
taatacgactcactataggggggcagttgataggggaggctttgtgcggtaacagaggagaaccgcaatgagcctccccaacctggcggcagcgcaaaagatg

SEQ ID NO: 171739 - DNA, 103 bp, Artificial Sequence
  Synthetic Polynucleotide
taatacgactcactatagggaattgtggaagggcagttgataggggaggcaacagaggagagcctccatgatcaactgcaacctggcggcagcgcaaaagatg

SEQ ID NO: 171740 - DNA, 103 bp, Artificial Sequence
  Synthetic Polynucleotide
taatacgactcactataggggtcagtgggaaattgtggaagggcagttgaaacagaggagatcaactatgcttccacaaaacctggcggcagcgcaaaagatg

SEQ ID NO: 171741 - DNA, 103 bp, Artificial Sequence
  Synthetic Polynucleotide
taatacgactcactataggggtcggtgcaggtcagtgggaaattgtggaaaacagaggagattccacatgttcccactgaacctggcggcagcgcaaaagatg

SEQ ID NO: 171742 - DNA, 103 bp, Artificial Sequence
  Synthetic Polynucleotide
taatacgactcactataggggggtggccaggtcggtgcaggtcagtgggaaacagaggagatcccacatgcctgcaccgaacctggcggcagcgcaaaagatg

SEQ ID NO: 171743 - DNA, 103 bp, Artificial Sequence
  Synthetic Polynucleotide
taatacgactcactatagggatgttggtcagggtggccaggtcggtgcagaacagaggagactgcacatgcctggccacaacctggcggcagcgcaaaagatg

SEQ ID NO: 171744 - DNA, 103 bp, Artificial Sequence
  Synthetic Polynucleotide
taatacgactcactataggggtgctctaggatgttggtcagggtggccagaacagaggagactggccatgctgaccaacaacctggcggcagcgcaaaagatg

SEQ ID NO: 171745 - DNA, 103 bp, Artificial Sequence
  Synthetic Polynucleotide
taatacgactcactataggggggcctccctgtgctctaggatgttggtcaaacagaggagatgaccaatgtcctagagcaacctggcggcagcgcaaaagatg

SEQ ID NO: 171746 - DNA, 103 bp, Artificial Sequence
  Synthetic Polynucleotide
taatacgactcactatagggaggtggatgggggcctccctgtgctctaggaacagaggagacctagaatgcagggaggcaacctggcggcagcgcaaaagatg

SEQ ID NO: 171747 - DNA, 103 bp, Artificial Sequence
  Synthetic Polynucleotide
taatacgactcactatagggatcaaaatccaggtggatgggggcctccctaacagaggagaagggagatgcccatccacaacctggcggcagcgcaaaagatg

SEQ ID NO: 171748 - DNA, 103 bp, Artificial Sequence
  Synthetic Polynucleotide
taatacgactcactatagggacaggttcttgttgccgagctggaggccaaaacagaggagattggccatgagctcggcaaacctggcggcagcgcaaaagatg

SEQ ID NO: 171749 - DNA, 103 bp, Artificial Sequence
  Synthetic Polynucleotide
taatacgactcactataggggaatgaaagactgccaggtgtccgaaccctaacagaggagaagggttatgacacctggcaacctggcggcagcgcaaaagatg

SEQ ID NO: 171750 - DNA, 103 bp, Artificial Sequence
  Synthetic Polynucleotide
taatacgactcactatagggggggacagccatcaaaatccaggtggatggaacagaggagaccatccatgtggattttgaacctggcggcagcgcaaaagatg

SEQ ID NO: 171751 - DNA, 103 bp, Artificial Sequence
  Synthetic Polynucleotide
taatacgactcactatagggtggggctccaggggacagccatcaaaatccaacagaggagaggatttatgtggctgtccaacctggcggcagcgcaaaagatg

SEQ ID NO: 171752 - DNA, 103 bp, Artificial Sequence
  Synthetic Polynucleotide
taatacgactcactatagggctcagggcagtggggctccaggggacagccaacagaggagaggctgtatgctggagcccaacctggcggcagcgcaaaagatg

SEQ ID NO: 171753 - DNA, 103 bp, Artificial Sequence
  Synthetic Polynucleotide
taatacgactcactatagggctaccagagcctcagggcagtggggctccaaacagaggagatggagcatgactgccctgaacctggcggcagcgcaaaagatg

SEQ ID NO: 171754 - DNA, 103 bp, Artificial Sequence
  Synthetic Polynucleotide
taatacgactcactatagggtgcccacagcctaccagagcctcagggcagaacagaggagactgcccatgggctctggtaacctggcggcagcgcaaaagatg

SEQ ID NO: 171755 - DNA, 103 bp, Artificial Sequence
  Synthetic Polynucleotide
taatacgactcactatagggattctctatctgcccacagcctaccagagcaacagaggagagctctgatgggctgtgggaacctggcggcagcgcaaaagatg

SEQ ID NO: 171756 - DNA, 103 bp, Artificial Sequence
  Synthetic Polynucleotide
taatacgactcactatagggtaaagctgagattctctatctgcccacagcaacagaggagagctgtgatgagatagagaaacctggcggcagcgcaaaagatg

SEQ ID NO: 171757 - DNA, 103 bp, Artificial Sequence
  Synthetic Polynucleotide
taatacgactcactatagggttcctgctcttaaagctgagattctctatcaacagaggagagatagaatgtctcagcttaacctggcggcagcgcaaaagatg

SEQ ID NO: 171758 - DNA, 103 bp, Artificial Sequence
  Synthetic Polynucleotide
taatacgactcactatagggatccccacacttcctgctcttaaagctgagaacagaggagactcagcatgaagagcaggaacctggcggcagcgcaaaagatg

SEQ ID NO: 171759 - DNA, 103 bp, Artificial Sequence
  Synthetic Polynucleotide
taatacgactcactatagggctgcaaaggcatccccacacttcctgctctaacagaggagaagagcaatgagtgtggggaacctggcggcagcgcaaaagatg

SEQ ID NO: 171760 - DNA, 103 bp, Artificial Sequence
  Synthetic Polynucleotide
taatacgactcactatagggcacacacaatgaatgaaagactgccaggtgaacagaggagacacctgatggtctttcataacctggcggcagcgcaaaagatg

SEQ ID NO: 171761 - DNA, 103 bp, Artificial Sequence
  Synthetic Polynucleotide
taatacgactcactataggggagagggcttctgcaaaggcatccccacacaacagaggagagtgtggatgtgcctttgcaacctggcggcagcgcaaaagatg

SEQ ID NO: 171762 - DNA, 103 bp, Artificial Sequence
  Synthetic Polynucleotide
taatacgactcactatagggcaagctcctggagagggcttctgcaaaggcaacagaggagagcctttatggaagccctcaacctggcggcagcgcaaaagatg

SEQ ID NO: 171763 - DNA, 103 bp, Artificial Sequence
  Synthetic Polynucleotide
taatacgactcactatagggccattgtcggcaagctcctggagagggcttaacagaggagaaagcccatgccaggagctaacctggcggcagcgcaaaagatg

SEQ ID NO: 171764 - DNA, 103 bp, Artificial Sequence
  Synthetic Polynucleotide
taatacgactcactatagggtgcagcctccccattgtcggcaagctcctgaacagaggagacaggagatggccgacaataacctggcggcagcgcaaaagatg

SEQ ID NO: 171765 - DNA, 103 bp, Artificial Sequence
  Synthetic Polynucleotide
taatacgactcactatagggccccagcatctgcagcctccccattgtcggaacagaggagaccgacaatggggaggctgaacctggcggcagcgcaaaagatg

SEQ ID NO: 171766 - DNA, 103 bp, Artificial Sequence
  Synthetic Polynucleotide
taatacgactcactatagggttcctgctaaccccagcatctgcagcctccaacagaggagaggaggcatgagatgctggaacctggcggcagcgcaaaagatg

SEQ ID NO: 171767 - DNA, 103 bp, Artificial Sequence
  Synthetic Polynucleotide
taatacgactcactataggggtgattttacttcctgctaaccccagcatcaacagaggagagatgctatggttagcaggaacctggcggcagcgcaaaagatg

SEQ ID NO: 171768 - DNA, 103 bp, Artificial Sequence
  Synthetic Polynucleotide
taatacgactcactataggggcctcgggcagtgattttacttcctgctaaaacagaggagattagcaatgagtaaaatcaacctggcggcagcgcaaaagatg

SEQ ID NO: 171769 - DNA, 103 bp, Artificial Sequence
  Synthetic Polynucleotide
taatacgactcactatagggggtggctgatgcctcgggcagtgattttacaacagaggagagtaaaaatgctgcccgagaacctggcggcagcgcaaaagatg

SEQ ID NO: 171770 - DNA, 103 bp, Artificial Sequence
  Synthetic Polynucleotide
taatacgactcactataggggctttcaccaggtggctgatgcctcgggcaaacagaggagatgcccgatgcatcagccaaacctggcggcagcgcaaaagatg

SEQ ID NO: 171771 - DNA, 103 bp, Artificial Sequence
  Synthetic Polynucleotide
taatacgactcactatagggcagctgcatgcacacacaatgaatgaaagaaacagaggagatctttcatgcattgtgtgaacctggcggcagcgcaaaagatg

SEQ ID NO: 171772 - DNA, 103 bp, Artificial Sequence
  Synthetic Polynucleotide
taatacgactcactataggggagaggcaaagctttcaccaggtggctgataacagaggagaatcagcatgctggtgaaaaacctggcggcagcgcaaaagatg

SEQ ID NO: 171773 - DNA, 103 bp, Artificial Sequence
  Synthetic Polynucleotide
taatacgactcactataggggctgtggacagagaggcaaagctttcaccaaacagaggagatggtgaatgctttgcctcaacctggcggcagcgcaaaagatg

SEQ ID NO: 171774 - DNA, 103 bp, Artificial Sequence
  Synthetic Polynucleotide
taatacgactcactatagggacttctttcagctgtggacagagaggcaaaaacagaggagatttgccatgctgtccacaaacctggcggcagcgcaaaagatg

SEQ ID NO: 171775 - DNA, 103 bp, Artificial Sequence
  Synthetic Polynucleotide
taatacgactcactatagggccgaaaactgacttctttcagctgtggacaaacagaggagatgtccaatgctgaaagaaaacctggcggcagcgcaaaagatg

SEQ ID NO: 171776 - DNA, 103 bp, Artificial Sequence
  Synthetic Polynucleotide
taatacgactcactataggggctggttgtcccgaaaactgacttctttcaaacagaggagatgaaagatgtcagttttcaacctggcggcagcgcaaaagatg

SEQ ID NO: 171777 - DNA, 103 bp, Artificial Sequence
  Synthetic Polynucleotide
taatacgactcactatagggtggtcactgagctggttgtcccgaaaactgaacagaggagacagtttatgggacaaccaaacctggcggcagcgcaaaagatg

SEQ ID NO: 171778 - DNA, 103 bp, Artificial Sequence
  Synthetic Polynucleotide
taatacgactcactatagggcagcaccacctggtcactgagctggttgtcaacagaggagagacaacatgctcagtgacaacctggcggcagcgcaaaagatg

SEQ ID NO: 171779 - DNA, 103 bp, Artificial Sequence
  Synthetic Polynucleotide
taatacgactcactatagggccacaatgttcagcaccacctggtcactgaaacagaggagatcagtgatgaggtggtgcaacctggcggcagcgcaaaagatg

SEQ ID NO: 171780 - DNA, 103 bp, Artificial Sequence
  Synthetic Polynucleotide
taatacgactcactataggggggagaacctccacaatgttcagcaccaccaacagaggagaggtggtatggaacattgtaacctggcggcagcgcaaaagatg

SEQ ID NO: 171781 - DNA, 103 bp, Artificial Sequence
  Synthetic Polynucleotide
taatacgactcactatagggtggtaggtgagggagaacctccacaatgttaacagaggagaaacattatggaggttctcaacctggcggcagcgcaaaagatg

SEQ ID NO: 171782 - DNA, 103 bp, Artificial Sequence
  Synthetic Polynucleotide
taatacgactcactataggggaggcacctccagctgcatgcacacacaataacagaggagaattgtgatggcatgcagcaacctggcggcagcgcaaaagatg

SEQ ID NO: 171783 - DNA, 103 bp, Artificial Sequence
  Synthetic Polynucleotide
taatacgactcactatagggtccggagccgtggtaggtgagggagaacctaacagaggagaaggttcatgctcacctacaacctggcggcagcgcaaaagatg

SEQ ID NO: 171784 - DNA, 103 bp, Artificial Sequence
  Synthetic Polynucleotide
taatacgactcactatagggaggtcaagcttccggagccgtggtaggtgaaacagaggagatcacctatgacggctccgaacctggcggcagcgcaaaagatg

SEQ ID NO: 171785 - DNA, 103 bp, Artificial Sequence
  Synthetic Polynucleotide
taatacgactcactataggggttgctgctcaggtcaagcttccggagccgaacagaggagacggctcatgaagcttgacaacctggcggcagcgcaaaagatg

SEQ ID NO: 171786 - DNA, 103 bp, Artificial Sequence
  Synthetic Polynucleotide
taatacgactcactatagggcgcagatgctgttgctgctcaggtcaagctaacagaggagaagcttgatgtgagcagcaaacctggcggcagcgcaaaagatg

SEQ ID NO: 171787 - DNA, 103 bp, Artificial Sequence
  Synthetic Polynucleotide
taatacgactcactatagggagggttgacacgcagatgctgttgctgctcaacagaggagagagcagatgcagcatctgaacctggcggcagcgcaaaagatg

SEQ ID NO: 171788 - DNA, 103 bp, Artificial Sequence
  Synthetic Polynucleotide
taatacgactcactatagggcaagcagagtagggttgacacgcagatgctaacagaggagaagcatcatggtgtcaaccaacctggcggcagcgcaaaagatg

SEQ ID NO: 171789 - DNA, 103 bp, Artificial Sequence
  Synthetic Polynucleotide
taatacgactcactatagggccacccttgccaagcagagtagggttgacaaacagaggagatgtcaaatgtactctgctaacctggcggcagcgcaaaagatg

SEQ ID NO: 171790 - DNA, 103 bp, Artificial Sequence
  Synthetic Polynucleotide
taatacgactcactatagggcacgtgactgccacccttgccaagcagagtaacagaggagaactctgatgggcaagggtaacctggcggcagcgcaaaagatg

SEQ ID NO: 171791 - DNA, 103 bp, Artificial Sequence
  Synthetic Polynucleotide
taatacgactcactataggggacggtaggacacgtgactgccacccttgcaacagaggagagcaaggatggcagtcacgaacctggcggcagcgcaaaagatg

SEQ ID NO: 171792 - DNA, 103 bp, Artificial Sequence
  Synthetic Polynucleotide
taatacgactcactataggggaagcatcctgacggtaggacacgtgactgaacagaggagacagtcaatggtcctaccgaacctggcggcagcgcaaaagatg

SEQ ID NO: 171793 - DNA, 103 bp, Artificial Sequence
  Synthetic Polynucleotide
taatacgactcactatagggtccaggtccagaggcacctccagctgcatgaacagaggagacatgcaatgggaggtgccaacctggcggcagcgcaaaagatg

SEQ ID NO: 171794 - DNA, 103 bp, Artificial Sequence
  Synthetic Polynucleotide
taatacgactcactatagggtccctggcctgaagcatcctgacggtaggaaacagaggagatcctacatgcaggatgctaacctggcggcagcgcaaaagatg

SEQ ID NO: 171795 - DNA, 103 bp, Artificial Sequence
  Synthetic Polynucleotide
taatacgactcactataggggaggtccgcctccctggcctgaagcatcctaacagaggagaaggatgatgcaggccaggaacctggcggcagcgcaaaagatg

SEQ ID NO: 171796 - DNA, 103 bp, Artificial Sequence
  Synthetic Polynucleotide
taatacgactcactataggggaaggaagatgaggtccgcctccctggcctaacagaggagaaggccaatgaggcggaccaacctggcggcagcgcaaaagatg

SEQ ID NO: 171797 - DNA, 103 bp, Artificial Sequence
  Synthetic Polynucleotide
taatacgactcactatagggggcggggaaagaaggaagatgaggtccgccaacagaggagaggcggaatgcatcttcctaacctggcggcagcgcaaaagatg

SEQ ID NO: 171798 - DNA, 103 bp, Artificial Sequence
  Synthetic Polynucleotide
taatacgactcactatagggtgtctctgtgggcggggaaagaaggaagataacagaggagaatcttcatgctttccccgaacctggcggcagcgcaaaagatg

SEQ ID NO: 171799 - DNA, 103 bp, Artificial Sequence
  Synthetic Polynucleotide
taatacgactcactataggggctctgcagttgtctctgtgggcggggaaaaacagaggagatttcccatgccacagagaaacctggcggcagcgcaaaagatg

SEQ ID NO: 171800 - DNA, 103 bp, Artificial Sequence
  Synthetic Polynucleotide
taatacgactcactataggggctctttgtagctctgcagttgtctctgtgaacagaggagacacagaatgaactgcagaaacctggcggcagcgcaaaagatg

SEQ ID NO: 171801 - DNA, 103 bp, Artificial Sequence
  Synthetic Polynucleotide
taatacgactcactatagggcaggtctggagctctttgtagctctgcagtaacagaggagaactgcaatgctacaaagaaacctggcggcagcgcaaaagatg

SEQ ID NO: 171802 - DNA, 103 bp, Artificial Sequence
  Synthetic Polynucleotide
taatacgactcactatagggcactttcctgcaggtctggagctctttgtaaacagaggagatacaaaatgctccagaccaacctggcggcagcgcaaaagatg

SEQ ID NO: 171803 - DNA, 103 bp, Artificial Sequence
  Synthetic Polynucleotide
taatacgactcactatagggctctggccgtcactttcctgcaggtctggaaacagaggagatccagaatggcaggaaagaacctggcggcagcgcaaaagatg

SEQ ID NO: 171804 - DNA, 103 bp, Artificial Sequence
  Synthetic Polynucleotide
taatacgactcactatagggcagcagcacctccaggtccagaggcacctcaacagaggagagaggtgatgctggacctgaacctggcggcagcgcaaaagatg

SEQ ID NO: 171805 - DNA, 103 bp, Artificial Sequence
  Synthetic Polynucleotide
taatacgactcactatagggagcccctttcctctggccgtcactttcctgaacagaggagacaggaaatggacggccagaacctggcggcagcgcaaaagatg

SEQ ID NO: 171806 - DNA, 103 bp, Artificial Sequence
  Synthetic Polynucleotide
taatacgactcactatagggttctgctctgagcccctttcctctggccgtaacagaggagaacggccatgggaaaggggaacctggcggcagcgcaaaagatg

SEQ ID NO: 171807 - DNA, 103 bp, Artificial Sequence
  Synthetic Polynucleotide
taatacgactcactatagggagcgtcaagcttctgctctgagcccctttcaacagaggagagaaaggatgtcagagcagaacctggcggcagcgcaaaagatg

SEQ ID NO: 171808 - DNA, 103 bp, Artificial Sequence
  Synthetic Polynucleotide
taatacgactcactatagggctgcagcctgagcgtcaagcttctgctctgaacagaggagacagagcatgagcttgacgaacctggcggcagcgcaaaagatg

SEQ ID NO: 171809 - DNA, 103 bp, Artificial Sequence
  Synthetic Polynucleotide
taatacgactcactataggggctgacacttctgcagcctgagcgtcaagcaacagaggagagcttgaatgtcaggctgcaacctggcggcagcgcaaaagatg

SEQ ID NO: 171810 - DNA, 103 bp, Artificial Sequence
  Synthetic Polynucleotide
taatacgactcactatagggtggacctggagctgacacttctgcagcctgaacagaggagacaggctatggaagtgtcaaacctggcggcagcgcaaaagatg

SEQ ID NO: 171811 - DNA, 103 bp, Artificial Sequence
  Synthetic Polynucleotide
taatacgactcactatagggctccgcatcgtggacctggagctgacacttaacagaggagaaagtgtatgctccaggtcaacctggcggcagcgcaaaagatg

SEQ ID NO: 171812 - DNA, 103 bp, Artificial Sequence
  Synthetic Polynucleotide
taatacgactcactatagggctatgagggcctccgcatcgtggacctggaaacagaggagatccaggatgacgatgcggaacctggcggcagcgcaaaagatg

SEQ ID NO: 171813 - DNA, 103 bp, Artificial Sequence
  Synthetic Polynucleotide
taatacgactcactatagggtggagcagggctatgagggcctccgcatcgaacagaggagacgatgcatgggccctcataacctggcggcagcgcaaaagatg

SEQ ID NO: 171814 - DNA, 103 bp, Artificial Sequence
  Synthetic Polynucleotide
taatacgactcactatagggagggccttcctggagcagggctatgagggcaacagaggagagccctcatggccctgctcaacctggcggcagcgcaaaagatg

SEQ ID NO: 171815 - DNA, 103 bp, Artificial Sequence
  Synthetic Polynucleotide
taatacgactcactatagggaagtactcagcagcagcacctccaggtccaaacagaggagatggaccatgaggtgctgcaacctggcggcagcgcaaaagatg

SEQ ID NO: 171816 - DNA, 103 bp, Artificial Sequence
  Synthetic Polynucleotide
taatacgactcactatagggcctccaggtgagggccttcctggagcagggaacagaggagaccctgcatgaggaaggccaacctggcggcagcgcaaaagatg

SEQ ID NO: 171817 - DNA, 103 bp, Artificial Sequence
  Synthetic Polynucleotide
taatacgactcactatagggaggtccacttcctccaggtgagggccttccaacagaggagaggaaggatgtcacctggaaacctggcggcagcgcaaaagatg

SEQ ID NO: 171818 - DNA, 103 bp, Artificial Sequence
  Synthetic Polynucleotide
taatacgactcactataggggttccctgagaggtccacttcctccaggtgaacagaggagacacctgatggaagtggacaacctggcggcagcgcaaaagatg

SEQ ID NO: 171819 - DNA, 103 bp, Artificial Sequence
  Synthetic Polynucleotide
taatacgactcactatagggcttccagctggttccctgagaggtccacttaacagaggagaaagtggatgtctcagggaaacctggcggcagcgcaaaagatg

SEQ ID NO: 171820 - DNA, 103 bp, Artificial Sequence
  Synthetic Polynucleotide
taatacgactcactatagggcagccttcatcttccagctggttccctgagaacagaggagactcaggatgccagctggaaacctggcggcagcgcaaaagatg

SEQ ID NO: 171821 - DNA, 103 bp, Artificial Sequence
  Synthetic Polynucleotide
taatacgactcactatagggcatcagccgacagccttcatcttccagctgaacagaggagacagctgatggatgaaggcaacctggcggcagcgcaaaagatg

SEQ ID NO: 171822 - DNA, 103 bp, Artificial Sequence
  Synthetic Polynucleotide
taatacgactcactatagggcagcctctgccatcagccgacagccttcataacagaggagaatgaagatggtcggctgaaacctggcggcagcgcaaaagatg

SEQ ID NO: 171823 - DNA, 103 bp, Artificial Sequence
  Synthetic Polynucleotide
taatacgactcactatagggagctgggatgcagcctctgccatcagccgaaacagaggagatcggctatgggcagaggcaacctggcggcagcgcaaaagatg

SEQ ID NO: 171824 - DNA, 103 bp, Artificial Sequence
  Synthetic Polynucleotide
taatacgactcactatagggggcgatgtgcagctgggatgcagcctctgcaacagaggagagcagagatggcatcccagaacctggcggcagcgcaaaagatg

SEQ ID NO: 171825 - DNA, 103 bp, Artificial Sequence
  Synthetic Polynucleotide
taatacgactcactatagggccagcttcctggcgatgtgcagctgggatgaacagaggagacatcccatgtgcacatcgaacctggcggcagcgcaaaagatg

SEQ ID NO: 171826 - DNA, 103 bp, Artificial Sequence
  Synthetic Polynucleotide
taatacgactcactatagggtcatagccaaaagtactcagcagcagcaccaacagaggagaggtgctatggctgagtacaacctggcggcagcgcaaaagatg

SEQ ID NO: 171827 - DNA, 103 bp, Artificial Sequence
  Synthetic Polynucleotide
taatacgactcactatagggttactgaggtccagcttcctggcgatgtgcaacagaggagagcacatatgcaggaagctaacctggcggcagcgcaaaagatg

SEQ ID NO: 171828 - DNA, 103 bp, Artificial Sequence
  Synthetic Polynucleotide
taatacgactcactatagggaagcccgttgttactgaggtccagcttcctaacagaggagaaggaagatggacctcagtaacctggcggcagcgcaaaagatg

SEQ ID NO: 171829 - DNA, 103 bp, Artificial Sequence
  Synthetic Polynucleotide
taatacgactcactatagggcggccacagaaagcccgttgttactgaggtaacagaggagaacctcaatgacaacgggcaacctggcggcagcgcaaaagatg

SEQ ID NO: 171830 - DNA, 103 bp, Artificial Sequence
  Synthetic Polynucleotide
taatacgactcactatagggcaatgcaccccggccacagaaagcccgttgaacagaggagacaacggatgttctgtggcaacctggcggcagcgcaaaagatg

SEQ ID NO: 171831 - DNA, 103 bp, Artificial Sequence
  Synthetic Polynucleotide
taatacgactcactatagggcctcagcacacaatgcaccccggccacagaaacagaggagatctgtgatgggggtgcataacctggcggcagcgcaaaagatg

SEQ ID NO: 171832 - DNA, 103 bp, Artificial Sequence
  Synthetic Polynucleotide
taatacgactcactatagggcactcacggccctcagcacacaatgcacccaacagaggagagggtgcatggtgtgctgaaacctggcggcagcgcaaaagatg

SEQ ID NO: 171833 - DNA, 103 bp, Artificial Sequence
  Synthetic Polynucleotide
taatacgactcactataggggtccagcacgcactcacggccctcagcacaaacagaggagatgtgctatgggccgtgagaacctggcggcagcgcaaaagatg

SEQ ID NO: 171834 - DNA, 103 bp, Artificial Sequence
  Synthetic Polynucleotide
taatacgactcactatagggctctgccagggtccagcacgcactcacggcaacagaggagagccgtgatggcgtgctggaacctggcggcagcgcaaaagatg

SEQ ID NO: 171835 - DNA, 103 bp, Artificial Sequence
  Synthetic Polynucleotide
taatacgactcactatagggtgatgtgcagctctgccagggtccagcacgaacagaggagacgtgctatgccctggcagaacctggcggcagcgcaaaagatg

SEQ ID NO: 171836 - DNA, 103 bp, Artificial Sequence
  Synthetic Polynucleotide
taatacgactcactatagggtgctgcaggctgatgtgcagctctgccaggaacagaggagacctggcatggctgcacataacctggcggcagcgcaaaagatg

SEQ ID NO: 171837 - DNA, 103 bp, Artificial Sequence
  Synthetic Polynucleotide
taatacgactcactataggggaacccatcatcatagccaaaagtactcagaacagaggagactgagtatgtttggctataacctggcggcagcgcaaaagatg

SEQ ID NO: 171838 - DNA, 103 bp, Artificial Sequence
  Synthetic Polynucleotide
taatacgactcactatagggcacagttttgtgctgcaggctgatgtgcagaacagaggagactgcacatgagcctgcagaacctggcggcagcgcaaaagatg

SEQ ID NO: 171839 - DNA, 103 bp, Artificial Sequence
  Synthetic Polynucleotide
taatacgactcactatagggacatgaagatcacagttttgtgctgcaggcaacagaggagagcctgcatgacaaaactgaacctggcggcagcgcaaaagatg

SEQ ID NO: 171840 - DNA, 103 bp, Artificial Sequence
  Synthetic Polynucleotide
taatacgactcactatagggtcctgggcaaacatgaagatcacagttttgaacagaggagacaaaacatggatcttcataacctggcggcagcgcaaaagatg

SEQ ID NO: 171841 - DNA, 103 bp, Artificial Sequence
  Synthetic Polynucleotide
taatacgactcactatagggctcctctggctcctgggcaaacatgaagataacagaggagaatcttcatgtttgcccagaacctggcggcagcgcaaaagatg

SEQ ID NO: 171842 - DNA, 103 bp, Artificial Sequence
  Synthetic Polynucleotide
taatacgactcactataggggccccttctgctcctctggctcctgggcaaaacagaggagattgcccatgagccagaggaacctggcggcagcgcaaaagatg

SEQ ID NO: 171843 - DNA, 103 bp, Artificial Sequence
  Synthetic Polynucleotide
taatacgactcactatagggctctcctggggccccttctgctcctctggcaacagaggagagccagaatggcagaagggaacctggcggcagcgcaaaagatg

SEQ ID NO: 171844 - DNA, 103 bp, Artificial Sequence
  Synthetic Polynucleotide
taatacgactcactatagggaaatgcagccctctcctggggccccttctgaacagaggagacagaagatgccccaggagaacctggcggcagcgcaaaagatg

SEQ ID NO: 171845 - DNA, 103 bp, Artificial Sequence
  Synthetic Polynucleotide
taatacgactcactatagggggctgtcaagaaatgcagccctctcctgggaacagaggagacccaggatggggctgcataacctggcggcagcgcaaaagatg

SEQ ID NO: 171846 - DNA, 103 bp, Artificial Sequence
  Synthetic Polynucleotide
taatacgactcactatagggtggagcatgaggctgtcaagaaatgcagccaacagaggagaggctgcatgtcttgacagaacctggcggcagcgcaaaagatg

SEQ ID NO: 171847 - DNA, 103 bp, Artificial Sequence
  Synthetic Polynucleotide
taatacgactcactatagggagagggcatctggagcatgaggctgtcaagaacagaggagacttgacatgctcatgctcaacctggcggcagcgcaaaagatg

SEQ ID NO: 171848 - DNA, 103 bp, Artificial Sequence
  Synthetic Polynucleotide
taatacgactcactataggggctggctggtgaacccatcatcatagccaaaacagaggagattggctatgatgatgggtaacctggcggcagcgcaaaagatg

SEQ ID NO: 171849 - DNA, 103 bp, Artificial Sequence
  Synthetic Polynucleotide
taatacgactcactataggggaggcagctcagagggcatctggagcatgaaacagaggagatcatgcatgagatgccctaacctggcggcagcgcaaaagatg

SEQ ID NO: 171850 - DNA, 103 bp, Artificial Sequence
  Synthetic Polynucleotide
taatacgactcactatagggcgggagctcagaggcagctcagagggcatcaacagaggagagatgccatgtgagctgccaacctggcggcagcgcaaaagatg

SEQ ID NO: 171851 - DNA, 103 bp, Artificial Sequence
  Synthetic Polynucleotide
taatacgactcactatagggcctcatccttcgggagctcagaggcagctcaacagaggagagagctgatgctgagctccaacctggcggcagcgcaaaagatg

SEQ ID NO: 171852 - DNA, 103 bp, Artificial Sequence
  Synthetic Polynucleotide
taatacgactcactatagggaatgtgtcagcctcatccttcgggagctcaaacagaggagatgagctatggaaggatgaaacctggcggcagcgcaaaagatg

SEQ ID NO: 171853 - DNA, 103 bp, Artificial Sequence
  Synthetic Polynucleotide
taatacgactcactatagggtggaggccacaatgtgtcagcctcatccttaacagaggagaaaggatatggctgacacaaacctggcggcagcgcaaaagatg

SEQ ID NO: 171854 - DNA, 103 bp, Artificial Sequence
  Synthetic Polynucleotide
taatacgactcactataggggtgcttttcttggaggccacaatgtgtcagaacagaggagactgacaatgtgtggcctcaacctggcggcagcgcaaaagatg

SEQ ID NO: 171855 - DNA, 103 bp, Artificial Sequence
  Synthetic Polynucleotide
taatacgactcactataggggctgctctaggtgcttttcttggaggccacaacagaggagagtggccatgaagaaaagcaacctggcggcagcgcaaaagatg

SEQ ID NO: 171856 - DNA, 103 bp, Artificial Sequence
  Synthetic Polynucleotide
taatacgactcactataggggccttgcagagctgctctaggtgcttttctaacagaggagaagaaaaatgcctagagcaaacctggcggcagcgcaaaagatg

SEQ ID NO: 171857 - DNA, 103 bp, Artificial Sequence
  Synthetic Polynucleotide
taatacgactcactatagggtcctcccagagccttgcagagctgctctagaacagaggagactagagatgctctgcaagaacctggcggcagcgcaaaagatg

SEQ ID NO: 171858 - DNA, 103 bp, Artificial Sequence
  Synthetic Polynucleotide
taatacgactcactatagggggtggcagcttcctcccagagccttgcagaaacagaggagatctgcaatgctctgggagaacctggcggcagcgcaaaagatg

SEQ ID NO: 171859 - DNA, 103 bp, Artificial Sequence
  Synthetic Polynucleotide
taatacgactcactatagggagacagctccacaggttcttgttgccgagcaacagaggagagctcggatgcaagaacctaacctggcggcagcgcaaaagatg

SEQ ID NO: 171860 - DNA, 103 bp, Artificial Sequence
  Synthetic Polynucleotide
taatacgactcactatagggtcagctcccagctggctggtgaacccatcaaacagaggagatgatggatgcaccagccaaacctggcggcagcgcaaaagatg

SEQ ID NO: 171861 - DNA, 103 bp, Artificial Sequence
  Synthetic Polynucleotide
taatacgactcactatagggaggtgaccgaggtggcagcttcctcccagaaacagaggagatctgggatgaagctgccaaacctggcggcagcgcaaaagatg

SEQ ID NO: 171862 - DNA, 103 bp, Artificial Sequence
  Synthetic Polynucleotide
taatacgactcactataggggtcgaggtggaggtgaccgaggtggcagctaacagaggagaagctgcatgctcggtcacaacctggcggcagcgcaaaagatg

SEQ ID NO: 171863 - DNA, 103 bp, Artificial Sequence
  Synthetic Polynucleotide
taatacgactcactatagggtgcctgagaagtcgaggtggaggtgaccgaaacagaggagatcggtcatgtccacctcgaacctggcggcagcgcaaaagatg

SEQ ID NO: 171864 - DNA, 103 bp, Artificial Sequence
  Synthetic Polynucleotide
taatacgactcactatagggcccagagcattgcctgagaagtcgaggtggaacagaggagaccacctatgcttctcaggaacctggcggcagcgcaaaagatg

SEQ ID NO: 171865 - DNA, 103 bp, Artificial Sequence
  Synthetic Polynucleotide
taatacgactcactatagggaccttcatcccccagagcattgcctgagaaaacagaggagattctcaatgaatgctctgaacctggcggcagcgcaaaagatg

SEQ ID NO: 171866 - DNA, 103 bp, Artificial Sequence
  Synthetic Polynucleotide
taatacgactcactataggggccgggctgcaccttcatcccccagagcataacagaggagaatgctcatggggatgaagaacctggcggcagcgcaaaagatg

SEQ ID NO: 171867 - DNA, 103 bp, Artificial Sequence
  Synthetic Polynucleotide
taatacgactcactatagggagctgagccagccgggctgcaccttcatccaacagaggagaggatgaatgtgcagcccgaacctggcggcagcgcaaaagatg

SEQ ID NO: 171868 - DNA, 103 bp, Artificial Sequence
  Synthetic Polynucleotide
taatacgactcactatagggccctgggagcagctgagccagccgggctgcaacagaggagagcagccatgctggctcagaacctggcggcagcgcaaaagatg

SEQ ID NO: 171869 - DNA, 103 bp, Artificial Sequence
  Synthetic Polynucleotide
taatacgactcactataggggagctcccagccctgggagcagctgagccaaacagaggagatggctcatgtgctcccagaacctggcggcagcgcaaaagatg

SEQ ID NO: 171870 - DNA, 103 bp, Artificial Sequence
  Synthetic Polynucleotide
taatacgactcactatagggaaggactgcagagctcccagccctgggagcaacagaggagagctcccatggctgggagcaacctggcggcagcgcaaaagatg

SEQ ID NO: 171871 - DNA, 103 bp, Artificial Sequence
  Synthetic Polynucleotide
taatacgactcactataggggcttttcccctcagctcccagctggctggtaacagaggagaaccagcatgctgggagctaacctggcggcagcgcaaaagatg

SEQ ID NO: 171872 - DNA, 103 bp, Artificial Sequence
  Synthetic Polynucleotide
taatacgactcactatagggactgaggttcaaggactgcagagctcccagaacagaggagactgggaatgctgcagtccaacctggcggcagcgcaaaagatg

SEQ ID NO: 171873 - DNA, 103 bp, Artificial Sequence
  Synthetic Polynucleotide
taatacgactcactatagggaaccgttctcactgaggttcaaggactgcaaacagaggagatgcagtatgtgaacctcaaacctggcggcagcgcaaaagatg

SEQ ID NO: 171874 - DNA, 103 bp, Artificial Sequence
  Synthetic Polynucleotide
taatacgactcactatagggtccagggacaaaccgttctcactgaggttcaacagaggagagaacctatgtgagaacggaacctggcggcagcgcaaaagatg

SEQ ID NO: 171875 - DNA, 103 bp, Artificial Sequence
  Synthetic Polynucleotide
taatacgactcactatagggcaacacggcatccagggacaaaccgttctcaacagaggagagagaacatgttgtccctgaacctggcggcagcgcaaaagatg

SEQ ID NO: 171876 - DNA, 103 bp, Artificial Sequence
  Synthetic Polynucleotide
taatacgactcactataggggaaccaaacccaacacggcatccagggacaaacagaggagatgtcccatgatgccgtgtaacctggcggcagcgcaaaagatg

SEQ ID NO: 171877 - DNA, 103 bp, Artificial Sequence
  Synthetic Polynucleotide
taatacgactcactataggggagaagcaccgaaccaaacccaacacggcaaacagaggagatgccgtatggggtttggtaacctggcggcagcgcaaaagatg

SEQ ID NO: 171878 - DNA, 103 bp, Artificial Sequence
  Synthetic Polynucleotide
taatacgactcactatagggctgcagagtggagaagcaccgaaccaaaccaacagaggagaggtttgatgcggtgcttcaacctggcggcagcgcaaaagatg

SEQ ID NO: 171879 - DNA, 103 bp, Artificial Sequence
  Synthetic Polynucleotide
taatacgactcactatagggggaagagccactgcagagtggagaagcaccaacagaggagaggtgctatgccactctgcaacctggcggcagcgcaaaagatg

SEQ ID NO: 171880 - DNA, 103 bp, Artificial Sequence
  Synthetic Polynucleotide
taatacgactcactatagggatgtccaagcggaagagccactgcagagtgaacagaggagacactctatggtggctcttaacctggcggcagcgcaaaagatg

SEQ ID NO: 171881 - DNA, 103 bp, Artificial Sequence
  Synthetic Polynucleotide
taatacgactcactatagggttcaaagctgatgtccaagcggaagagccaaacagaggagatggctcatgcgcttggacaacctggcggcagcgcaaaagatg

SEQ ID NO: 171882 - DNA, 103 bp, Artificial Sequence
  Synthetic Polynucleotide
taatacgactcactatagggattcaggttggcttttcccctcagctcccaaacagaggagatgggagatgaggggaaaaaacctggcggcagcgcaaaagatg

SEQ ID NO: 171883 - DNA, 103 bp, Artificial Sequence
  Synthetic Polynucleotide
taatacgactcactatagggtgtgttggctttcaaagctgatgtccaagcaacagaggagagcttggatgtcagctttgaacctggcggcagcgcaaaagatg

SEQ ID NO: 171884 - DNA, 103 bp, Artificial Sequence
  Synthetic Polynucleotide
taatacgactcactatagggctcaggaggatgtgttggctttcaaagctgaacagaggagacagcttatgaagccaacaaacctggcggcagcgcaaaagatg

SEQ ID NO: 171885 - DNA, 103 bp, Artificial Sequence
  Synthetic Polynucleotide
taatacgactcactatagggcttgtcccctctcaggaggatgtgttggctaacagaggagaagccaaatgatcctcctgaacctggcggcagcgcaaaagatg

SEQ ID NO: 171886 - DNA, 103 bp, Artificial Sequence
  Synthetic Polynucleotide
taatacgactcactatagggccctgcttgtcttgtcccctctcaggaggaaacagaggagatcctccatggaggggacaaacctggcggcagcgcaaaagatg

SEQ ID NO: 171887 - DNA, 103 bp, Artificial Sequence
  Synthetic Polynucleotide
taatacgactcactataggggcccacatatccctgcttgtcttgtcccctaacagaggagaaggggaatggacaagcagaacctggcggcagcgcaaaagatg

SEQ ID NO: 171888 - DNA, 103 bp, Artificial Sequence
  Synthetic Polynucleotide
taatacgactcactatagggagatccagtggcccacatatccctgcttgtaacagaggagaacaagcatggatatgtggaacctggcggcagcgcaaaagatg

SEQ ID NO: 171889 - DNA, 103 bp, Artificial Sequence
  Synthetic Polynucleotide
taatacgactcactatagggagtctggcaaagatccagtggcccacatataacagaggagaatatgtatgccactggataacctggcggcagcgcaaaagatg

SEQ ID NO: 171890 - DNA, 103 bp, Artificial Sequence
  Synthetic Polynucleotide
taatacgactcactataggggcagctgggaagtctggcaaagatccagtgaacagaggagacactggatgtttgccagaaacctggcggcagcgcaaaagatg

SEQ ID NO: 171891 - DNA, 103 bp, Artificial Sequence
  Synthetic Polynucleotide
taatacgactcactataggggaacttggctgcagctgggaagtctggcaaaacagaggagattgccaatgttcccagctaacctggcggcagcgcaaaagatg

SEQ ID NO: 171892 - DNA, 103 bp, Artificial Sequence
  Synthetic Polynucleotide
taatacgactcactatagggggaaccctaagaacttggctgcagctgggaaacagaggagatcccagatgcagccaagtaacctggcggcagcgcaaaagatg

SEQ ID NO: 171893 - DNA, 103 bp, Artificial Sequence
  Synthetic Polynucleotide
taatacgactcactatagggtggagctgagattcaggttggcttttccccaacagaggagaggggaaatgccaacctgaaacctggcggcagcgcaaaagatg

SEQ ID NO: 171894 - DNA, 103 bp, Artificial Sequence
  Synthetic Polynucleotide
taatacgactcactatagggcagcgctgacggaaccctaagaacttggctaacagaggagaagccaaatgcttagggttaacctggcggcagcgcaaaagatg

SEQ ID NO: 171895 - DNA, 103 bp, Artificial Sequence
  Synthetic Polynucleotide
taatacgactcactatagggcctggggatgcagcgctgacggaaccctaaaacagaggagattagggatgcgtcagcgcaacctggcggcagcgcaaaagatg

SEQ ID NO: 171896 - DNA, 103 bp, Artificial Sequence
  Synthetic Polynucleotide
taatacgactcactatagggggcagaggctcctggggatgcagcgctgacaacagaggagagtcagcatggcatccccaaacctggcggcagcgcaaaagatg

SEQ ID NO: 171897 - DNA, 103 bp, Artificial Sequence
  Synthetic Polynucleotide
taatacgactcactatagggcactcactgaggcagaggctcctggggatgaacagaggagacatcccatggagcctctgaacctggcggcagcgcaaaagatg

SEQ ID NO: 171898 - DNA, 103 bp, Artificial Sequence
  Synthetic Polynucleotide
taatacgactcactatagggctccagaggacactcactgaggcagaggctaacagaggagaagcctcatgctcagtgagaacctggcggcagcgcaaaagatg

SEQ ID NO: 171899 - DNA, 103 bp, Artificial Sequence
  Synthetic Polynucleotide
taatacgactcactatagggggcttgggggctccagaggacactcactgaaacagaggagatcagtgatggtcctctggaacctggcggcagcgcaaaagatg

SEQ ID NO: 171900 - DNA, 103 bp, Artificial Sequence
  Synthetic Polynucleotide
taatacgactcactatagggaggcgggtgaggcttgggggctccagaggaaacagaggagatcctctatggcccccaagaacctggcggcagcgcaaaagatg

SEQ ID NO: 171901 - DNA, 103 bp, Artificial Sequence
  Synthetic Polynucleotide
taatacgactcactatagggagtggcacagaggcgggtgaggcttgggggaacagaggagacccccaatgctcacccgcaacctggcggcagcgcaaaagatg

SEQ ID NO: 171902 - DNA, 103 bp, Artificial Sequence
  Synthetic Polynucleotide
taatacgactcactatagggagtccttcagagtggcacagaggcgggtgaaacagaggagatcacccatgtctgtgccaaacctggcggcagcgcaaaagatg

SEQ ID NO: 171903 - DNA, 103 bp, Artificial Sequence
  Synthetic Polynucleotide
taatacgactcactatagggggtcccgggcagtccttcagagtggcacagaacagaggagactgtgcatgtctgaaggaaacctggcggcagcgcaaaagatg

SEQ ID NO: 171904 - DNA, 103 bp, Artificial Sequence
  Synthetic Polynucleotide
taatacgactcactatagggcaggccatggtggagctgagattcaggttgaacagaggagacaacctatgtctcagctcaacctggcggcagcgcaaaagatg

SEQ ID NO: 171905 - DNA, 103 bp, Artificial Sequence
  Synthetic Polynucleotide
taatacgactcactatagggcagttccaggggtcccgggcagtccttcagaacagaggagactgaagatgtgcccgggaaacctggcggcagcgcaaaagatg

SEQ ID NO: 171906 - DNA, 103 bp, Artificial Sequence
  Synthetic Polynucleotide
taatacgactcactatagggaggacaattgcagttccaggggtcccgggcaacagaggagagcccggatgccctggaacaacctggcggcagcgcaaaagatg

SEQ ID NO: 171907 - DNA, 103 bp, Artificial Sequence
  Synthetic Polynucleotide
taatacgactcactatagggaggaactcacaggacaattgcagttccaggaacagaggagacctggaatggcaattgtcaacctggcggcagcgcaaaagatg

SEQ ID NO: 171908 - DNA, 103 bp, Artificial Sequence
  Synthetic Polynucleotide
taatacgactcactatagggctggtcactcaggaactcacaggacaattgaacagaggagacaattgatgtgtgagttcaacctggcggcagcgcaaaagatg

SEQ ID NO: 171909 - DNA, 103 bp, Artificial Sequence
  Synthetic Polynucleotide
taatacgactcactatagggtctccaggctctggtcactcaggaactcacaacagaggagagtgagtatgtgagtgaccaacctggcggcagcgcaaaagatg

SEQ ID NO: 171910 - DNA, 103 bp, Artificial Sequence
  Synthetic Polynucleotide
taatacgactcactatagggtccagtagagtctccaggctctggtcactcaacagaggagagagtgaatggagcctggaaacctggcggcagcgcaaaagatg

SEQ ID NO: 171911 - DNA, 103 bp, Artificial Sequence
  Synthetic Polynucleotide
taatacgactcactatagggaggtaagcagtccagtagagtctccaggctaacagaggagaagcctgatgactctactgaacctggcggcagcgcaaaagatg

SEQ ID NO: 171912 - DNA, 103 bp, Artificial Sequence
  Synthetic Polynucleotide
taatacgactcactataggggagggagttgaggtaagcagtccagtagagaacagaggagactctacatgactgcttacaacctggcggcagcgcaaaagatg

SEQ ID NO: 171913 - DNA, 103 bp, Artificial Sequence
  Synthetic Polynucleotide
taatacgactcactatagggaggctcagctgagggagttgaggtaagcagaacagaggagactgcttatgtcaactcccaacctggcggcagcgcaaaagatg

SEQ ID NO: 171914 - DNA, 103 bp, Artificial Sequence
  Synthetic Polynucleotide
taatacgactcactatagggcagctgcagcaggctcagctgagggagttgaacagaggagacaactcatgcagctgagcaacctggcggcagcgcaaaagatg

SEQ ID NO: 171915 - DNA, 103 bp, Artificial Sequence
  Synthetic Polynucleotide
taatacgactcactataggggtgggcgcttcaggccatggtggagctgagaacagaggagactcagcatgaccatggccaacctggcggcagcgcaaaagatg

SEQ ID NO: 171916 - DNA, 103 bp, Artificial Sequence
  Synthetic Polynucleotide
taatacgactcactatagggccgtctggctcagctgcagcaggctcagctaacagaggagaagctgaatgtgctgcagcaacctggcggcagcgcaaaagatg

SEQ ID NO: 171917 - DNA, 103 bp, Artificial Sequence
  Synthetic Polynucleotide
taatacgactcactatagggggggacagtcccgtctggctcagctgcagcaacagaggagagctgcaatggagccagacaacctggcggcagcgcaaaagatg

SEQ ID NO: 171918 - DNA, 103 bp, Artificial Sequence
  Synthetic Polynucleotide
taatacgactcactatagggggggcttttcggggacagtcccgtctggctaacagaggagaagccagatgggactgtccaacctggcggcagcgcaaaagatg

SEQ ID NO: 171919 - DNA, 103 bp, Artificial Sequence
  Synthetic Polynucleotide
taatacgactcactatagggccagcaggaaggggcttttcggggacagtcaacagaggagagactgtatgcgaaaagccaacctggcggcagcgcaaaagatg

SEQ ID NO: 171920 - DNA, 103 bp, Artificial Sequence
  Synthetic Polynucleotide
taatacgactcactatagggaaggtgttggccagcaggaaggggcttttcaacagaggagagaaaagatgcttcctgctaacctggcggcagcgcaaaagatg

SEQ ID NO: 171921 - DNA, 103 bp, Artificial Sequence
  Synthetic Polynucleotide
taatacgactcactatagggacacaggcttaaggtgttggccagcaggaaaacagaggagattcctgatggccaacaccaacctggcggcagcgcaaaagatg

SEQ ID NO: 171922 - DNA, 103 bp, Artificial Sequence
  Synthetic Polynucleotide
taatacgactcactatagggtaacccgtggacacaggcttaaggtgttggaacagaggagaccaacaatgtaagcctgtaacctggcggcagcgcaaaagatg

SEQ ID NO: 171923 - DNA, 103 bp, Artificial Sequence
  Synthetic Polynucleotide
taatacgactcactatagggtccacctttttaacccgtggacacaggcttaacagaggagaaagcctatgtccacgggtaacctggcggcagcgcaaaagatg

SEQ ID NO: 171924 - DNA, 103 bp, Artificial Sequence
  Synthetic Polynucleotide
taatacgactcactatagggggacctgagatccacctttttaacccgtggaacagaggagaccacggatgaaaaaggtgaacctggcggcagcgcaaaagatg

SEQ ID NO: 171925 - DNA, 103 bp, Artificial Sequence
  Synthetic Polynucleotide
taatacgactcactatagggcatggtgcagggacctgagatccaccttttaacagaggagaaaaaggatgatctcaggtaacctggcggcagcgcaaaagatg

SEQ ID NO: 171926 - DNA, 103 bp, Artificial Sequence
  Synthetic Polynucleotide
taatacgactcactatagggcagctctgatgtgggcgcttcaggccatggaacagaggagaccatggatggaagcgcccaacctggcggcagcgcaaaagatg

SEQ ID NO: 171927 - DNA, 103 bp, Artificial Sequence
  Synthetic Polynucleotide
taatacgactcactatagggtgcaaagttgcatggtgcagggacctgagaaacagaggagatctcagatgcctgcaccaaacctggcggcagcgcaaaagatg

SEQ ID NO: 171928 - DNA, 103 bp, Artificial Sequence
  Synthetic Polynucleotide
taatacgactcactatagggggatctgaagtgcaaagttgcatggtgcagaacagaggagactgcacatggcaactttgaacctggcggcagcgcaaaagatg

SEQ ID NO: 171929 - DNA, 103 bp, Artificial Sequence
  Synthetic Polynucleotide
taatacgactcactatagggcctcctcgttggatctgaagtgcaaagttgaacagaggagacaacttatgacttcagataacctggcggcagcgcaaaagatg

SEQ ID NO: 171930 - DNA, 103 bp, Artificial Sequence
  Synthetic Polynucleotide
taatacgactcactatagggacgccttcctcctcctcgttggatctgaagaacagaggagacttcagatgcaacgaggaaacctggcggcagcgcaaaagatg

SEQ ID NO: 171931 - DNA, 103 bp, Artificial Sequence
  Synthetic Polynucleotide
taatacgactcactataggggccacagcacacgccttcctcctcctcgttaacagaggagaaacgagatggaggaaggcaacctggcggcagcgcaaaagatg

SEQ ID NO: 171932 - DNA, 103 bp, Artificial Sequence
  Synthetic Polynucleotide
taatacgactcactatagggctgtgaacctgccacagcacacgccttcctaacagaggagaaggaagatgtgtgctgtgaacctggcggcagcgcaaaagatg

SEQ ID NO: 171933 - DNA, 103 bp, Artificial Sequence
  Synthetic Polynucleotide
taatacgactcactatagggaggctgcagcctgtgaacctgccacagcacaacagaggagagtgctgatgcaggttcacaacctggcggcagcgcaaaagatg

SEQ ID NO: 171934 - DNA, 103 bp, Artificial Sequence
  Synthetic Polynucleotide
taatacgactcactatagggctcctggctgaggctgcagcctgtgaacctaacagaggagaaggttcatgggctgcagcaacctggcggcagcgcaaaagatg

SEQ ID NO: 171935 - DNA, 103 bp, Artificial Sequence
  Synthetic Polynucleotide
taatacgactcactatagggactctacgtgctcctggctgaggctgcagcaacagaggagagctgcaatgtcagccaggaacctggcggcagcgcaaaagatg

SEQ ID NO: 171936 - DNA, 103 bp, Artificial Sequence
  Synthetic Polynucleotide
taatacgactcactatagggcagcagagtgactctacgtgctcctggctgaacagaggagacagccaatggcacgtagaaacctggcggcagcgcaaaagatg

SEQ ID NO: 171937 - DNA, 103 bp, Artificial Sequence
  Synthetic Polynucleotide
taatacgactcactatagggtgaggacccacagctctgatgtgggcgcttaacagaggagaaagcgcatgcatcagagcaacctggcggcagcgcaaaagatg

SEQ ID NO: 171938 - DNA, 103 bp, Artificial Sequence
  Synthetic Polynucleotide
taatacgactcactataggggctcagcaaccagcagagtgactctacgtgaacagaggagacacgtaatgtcactctgcaacctggcggcagcgcaaaagatg

SEQ ID NO: 171939 - DNA, 103 bp, Artificial Sequence
  Synthetic Polynucleotide
taatacgactcactatagggctttacacttgctcagcaaccagcagagtgaacagaggagacactctatgggttgctgaaacctggcggcagcgcaaaagatg

SEQ ID NO: 171940 - DNA, 103 bp, Artificial Sequence
  Synthetic Polynucleotide
taatacgactcactatagggtggctgaggtctttacacttgctcagcaacaacagaggagagttgctatgcaagtgtaaaacctggcggcagcgcaaaagatg

SEQ ID NO: 171941 - DNA, 103 bp, Artificial Sequence
  Synthetic Polynucleotide
taatacgactcactataggggagatccacctggctgaggtctttacacttaacagaggagaaagtgtatggacctcagcaacctggcggcagcgcaaaagatg

SEQ ID NO: 171942 - DNA, 103 bp, Artificial Sequence
  Synthetic Polynucleotide
taatacgactcactatagggggtttgctgagagatccacctggctgaggtaacagaggagaacctcaatgaggtggatcaacctggcggcagcgcaaaagatg

SEQ ID NO: 171943 - DNA, 103 bp, Artificial Sequence
  Synthetic Polynucleotide
taatacgactcactatagggtcgcccagcaggtttgctgagagatccaccaacagaggagaggtggaatgctcagcaaaaacctggcggcagcgcaaaagatg

SEQ ID NO: 171944 - DNA, 103 bp, Artificial Sequence
  Synthetic Polynucleotide
taatacgactcactataggggagtccgctgtcgcccagcaggtttgctgaaacagaggagatcagcaatgctgctgggcaacctggcggcagcgcaaaagatg

SEQ ID NO: 171945 - DNA, 103 bp, Artificial Sequence
  Synthetic Polynucleotide
taatacgactcactataggggaaggcatctgagtccgctgtcgcccagcaaacagaggagatgctggatgacagcggacaacctggcggcagcgcaaaagatg

SEQ ID NO: 171946 - DNA, 103 bp, Artificial Sequence
  Synthetic Polynucleotide
taatacgactcactatagggagacattccagaaggcatctgagtccgctgaacagaggagacagcggatgcagatgcctaacctggcggcagcgcaaaagatg

SEQ ID NO: 171947 - DNA, 103 bp, Artificial Sequence
  Synthetic Polynucleotide
taatacgactcactatagggcacctgcggcagacattccagaaggcatctaacagaggagaagatgcatgctggaatgtaacctggcggcagcgcaaaagatg

SEQ ID NO: 171948 - DNA, 103 bp, Artificial Sequence
  Synthetic Polynucleotide
taatacgactcactatagggtccggcggggtgaggacccacagctctgataacagaggagaatcagaatggtgggtcctaacctggcggcagcgcaaaagatg

SEQ ID NO: 171949 - DNA, 103 bp, Artificial Sequence
  Synthetic Polynucleotide
taatacgactcactatagggcggagatgggcacctgcggcagacattccaaacagaggagatggaatatgtgccgcaggaacctggcggcagcgcaaaagatg

SEQ ID NO: 171950 - DNA, 103 bp, Artificial Sequence
  Synthetic Polynucleotide
taatacgactcactatagggtcaagcaaaccggagatgggcacctgcggcaacagaggagagccgcaatggcccatctcaacctggcggcagcgcaaaagatg

SEQ ID NO: 171951 - DNA, 103 bp, Artificial Sequence
  Synthetic Polynucleotide
taatacgactcactataggggtgactcagatcaagcaaaccggagatgggaacagaggagacccatcatgggtttgcttaacctggcggcagcgcaaaagatg

SEQ ID NO: 171952 - DNA, 103 bp, Artificial Sequence
  Synthetic Polynucleotide
taatacgactcactatagggaaatgctgttgtgactcagatcaagcaaacaacagaggagagtttgcatgatctgagtcaacctggcggcagcgcaaaagatg

SEQ ID NO: 171953 - DNA, 103 bp, Artificial Sequence
  Synthetic Polynucleotide
taatacgactcactatagggctttcctgagaaatgctgttgtgactcagaaacagaggagatctgagatgcaacagcataacctggcggcagcgcaaaagatg

SEQ ID NO: 171954 - DNA, 103 bp, Artificial Sequence
  Synthetic Polynucleotide
taatacgactcactataggggtacagggcactttcctgagaaatgctgttaacagaggagaaacagcatgtctcaggaaaacctggcggcagcgcaaaagatg

SEQ ID NO: 171955 - DNA, 103 bp, Artificial Sequence
  Synthetic Polynucleotide
taatacgactcactatagggtctccagcaggtacagggcactttcctgagaacagaggagactcaggatggtgccctgtaacctggcggcagcgcaaaagatg

SEQ ID NO: 171956 - DNA, 103 bp, Artificial Sequence
  Synthetic Polynucleotide
taatacgactcactataggggagggcagtgtctccagcaggtacagggcaaacagaggagatgccctatgcctgctggaaacctggcggcagcgcaaaagatg

SEQ ID NO: 171957 - DNA, 103 bp, Artificial Sequence
  Synthetic Polynucleotide
taatacgactcactatagggacgtgggcaggagggcagtgtctccagcagaacagaggagactgctgatgacactgcccaacctggcggcagcgcaaaagatg

SEQ ID NO: 171958 - DNA, 103 bp, Artificial Sequence
  Synthetic Polynucleotide
taatacgactcactatagggcctcccggacacgtgggcaggagggcagtgaacagaggagacactgcatgcctgcccacaacctggcggcagcgcaaaagatg

SEQ ID NO: 171959 - DNA, 103 bp, Artificial Sequence
  Synthetic Polynucleotide
taatacgactcactatagggttgcactgcttccggcggggtgaggacccaaacagaggagatgggtcatgaccccgccgaacctggcggcagcgcaaaagatg

SEQ ID NO: 171960 - DNA, 103 bp, Artificial Sequence
  Synthetic Polynucleotide
taatacgactcactatagggttcactgaggcctcccggacacgtgggcagaacagaggagactgcccatgtgtccgggaaacctggcggcagcgcaaaagatg

SEQ ID NO: 171961 - DNA, 103 bp, Artificial Sequence
  Synthetic Polynucleotide
taatacgactcactatagggagagcccaggttcactgaggcctcccggacaacagaggagagtccggatggcctcagtgaacctggcggcagcgcaaaagatg

SEQ ID NO: 171962 - DNA, 103 bp, Artificial Sequence
  Synthetic Polynucleotide
taatacgactcactatagggagctctgctcagagcccaggttcactgaggaacagaggagacctcagatgacctgggctaacctggcggcagcgcaaaagatg

SEQ ID NO: 171963 - DNA, 103 bp, Artificial Sequence
  Synthetic Polynucleotide
taatacgactcactatagggtgaatccggaagctctgctcagagcccaggaacagaggagacctgggatgtgagcagagaacctggcggcagcgcaaaagatg

SEQ ID NO: 171964 - DNA, 103 bp, Artificial Sequence
  Synthetic Polynucleotide
taatacgactcactatagggtctggagaagtgaatccggaagctctgctcaacagaggagagagcagatgttccggattaacctggcggcagcgcaaaagatg

SEQ ID NO: 171965 - DNA, 103 bp, Artificial Sequence
  Synthetic Polynucleotide
taatacgactcactatagggcctggtcctctctggagaagtgaatccggaaacagaggagatccggaatgacttctccaaacctggcggcagcgcaaaagatg

SEQ ID NO: 171966 - DNA, 103 bp, Artificial Sequence
  Synthetic Polynucleotide
taatacgactcactataggggtcttcccagcctggtcctctctggagaagaacagaggagacttctcatgagaggaccaaacctggcggcagcgcaaaagatg

SEQ ID NO: 171967 - DNA, 103 bp, Artificial Sequence
  Synthetic Polynucleotide
taatacgactcactatagggtagcctgagtgtcttcccagcctggtcctcaacagaggagagaggacatggctgggaagaacctggcggcagcgcaaaagatg

SEQ ID NO: 171968 - DNA, 103 bp, Artificial Sequence
  Synthetic Polynucleotide
taatacgactcactatagggtgcactcacttagcctgagtgtcttcccagaacagaggagactgggaatgcactcaggcaacctggcggcagcgcaaaagatg

SEQ ID NO: 171969 - DNA, 103 bp, Artificial Sequence
  Synthetic Polynucleotide
taatacgactcactatagggggccggaagctgcactcacttagcctgagtaacagaggagaactcagatgaagtgagtgaacctggcggcagcgcaaaagatg

SEQ ID NO: 171970 - DNA, 103 bp, Artificial Sequence
  Synthetic Polynucleotide
taatacgactcactatagggcagcctcacaagacagctccacaggttcttaacagaggagaaagaacatgtggagctgtaacctggcggcagcgcaaaagatg

SEQ ID NO: 171971 - DNA, 103 bp, Artificial Sequence
  Synthetic Polynucleotide
taatacgactcactatagggctgctgcttcttgcactgcttccggcggggaacagaggagaccccgcatgaagcagtgcaacctggcggcagcgcaaaagatg

SEQ ID NO: 171972 - DNA, 103 bp, Artificial Sequence
  Synthetic Polynucleotide
taatacgactcactatagggcacgtgctctggccggaagctgcactcactaacagaggagaagtgagatgagcttccggaacctggcggcagcgcaaaagatg

SEQ ID NO: 171973 - DNA, 103 bp, Artificial Sequence
  Synthetic Polynucleotide
taatacgactcactatagggccagcctggacacgtgctctggccggaagcaacagaggagagcttccatgcagagcacgaacctggcggcagcgcaaaagatg

SEQ ID NO: 171974 - DNA, 103 bp, Artificial Sequence
  Synthetic Polynucleotide
taatacgactcactatagggaagccggtggccagcctggacacgtgctctaacagaggagaagagcaatggtccaggctaacctggcggcagcgcaaaagatg

SEQ ID NO: 171975 - DNA, 103 bp, Artificial Sequence
  Synthetic Polynucleotide
taatacgactcactatagggggacttgctcaagccggtggccagcctggaaacagaggagatccaggatggccaccggcaacctggcggcagcgcaaaagatg

SEQ ID NO: 171976 - DNA, 103 bp, Artificial Sequence
  Synthetic Polynucleotide
taatacgactcactatagggtcagctgcagggacttgctcaagccggtggaacagaggagaccaccgatgtgagcaagtaacctggcggcagcgcaaaagatg

SEQ ID NO: 171977 - DNA, 103 bp, Artificial Sequence
  Synthetic Polynucleotide
taatacgactcactataggggtgagctccgtcagctgcagggacttgctcaacagaggagagagcaaatgcctgcagctaacctggcggcagcgcaaaagatg

SEQ ID NO: 171978 - DNA, 103 bp, Artificial Sequence
  Synthetic Polynucleotide
taatacgactcactatagggctgggtcagcgtgagctccgtcagctgcagaacagaggagactgcagatgacggagctcaacctggcggcagcgcaaaagatg

SEQ ID NO: 171979 - DNA, 103 bp, Artificial Sequence
  Synthetic Polynucleotide
taatacgactcactatagggccaggcagcactgggtcagcgtgagctccgaacagaggagacggagcatgcgctgacccaacctggcggcagcgcaaaagatg

SEQ ID NO: 171980 - DNA, 103 bp, Artificial Sequence
  Synthetic Polynucleotide
taatacgactcactatagggtgcttctggcccaggcagcactgggtcagcaacagaggagagctgacatggtgctgcctaacctggcggcagcgcaaaagatg

SEQ ID NO: 171981 - DNA, 103 bp, Artificial Sequence
  Synthetic Polynucleotide
taatacgactcactataggggatggccagctgcttctggcccaggcagcaaacagaggagatgctgcatgggccagaagaacctggcggcagcgcaaaagatg

SEQ ID NO: 171982 - DNA, 103 bp, Artificial Sequence
  Synthetic Polynucleotide
taatacgactcactatagggccaactctagctgctgcttcttgcactgctaacagaggagaagcagtatgagaagcagcaacctggcggcagcgcaaaagatg

SEQ ID NO: 171983 - DNA, 103 bp, Artificial Sequence
  Synthetic Polynucleotide
taatacgactcactatagggagctcaggaggatggccagctgcttctggcaacagaggagagccagaatgagctggccaaacctggcggcagcgcaaaagatg

SEQ ID NO: 171984 - DNA, 103 bp, Artificial Sequence
  Synthetic Polynucleotide
taatacgactcactatagggcgccccaccaagctcaggaggatggccagcaacagaggagagctggcatgcctcctgagaacctggcggcagcgcaaaagatg

SEQ ID NO: 171985 - DNA, 103 bp, Artificial Sequence
  Synthetic Polynucleotide
taatacgactcactatagggccctgcgggtcgccccaccaagctcaggagaacagaggagactcctgatgttggtggggaacctggcggcagcgcaaaagatg

SEQ ID NO: 171986 - DNA, 103 bp, Artificial Sequence
  Synthetic Polynucleotide
taatacgactcactatagggggctgaacagccctgcgggtcgccccaccaaacagaggagatggtggatggacccgcagaacctggcggcagcgcaaaagatg

SEQ ID NO: 171987 - DNA, 103 bp, Artificial Sequence
  Synthetic Polynucleotide
taatacgactcactatagggtgcaccctgaggctgaacagccctgcgggtaacagaggagaacccgcatggctgttcagaacctggcggcagcgcaaaagatg

SEQ ID NO: 171988 - DNA, 103 bp, Artificial Sequence
  Synthetic Polynucleotide
taatacgactcactatagggccacggctcctgcaccctgaggctgaacagaacagaggagactgttcatgctcagggtgaacctggcggcagcgcaaaagatg

SEQ ID NO: 171989 - DNA, 103 bp, Artificial Sequence
  Synthetic Polynucleotide
taatacgactcactatagggctctgtccgcccacggctcctgcaccctgaaacagaggagatcagggatgaggagccgtaacctggcggcagcgcaaaagatg

SEQ ID NO: 171990 - DNA, 103 bp, Artificial Sequence
  Synthetic Polynucleotide
taatacgactcactatagggagaaccctggctctgtccgcccacggctccaacagaggagaggagccatgggcggacagaacctggcggcagcgcaaaagatg

SEQ ID NO: 171991 - DNA, 103 bp, Artificial Sequence
  Synthetic Polynucleotide
taatacgactcactatagggtaacagggagagaaccctggctctgtccgcaacagaggagagcggacatggccagggttaacctggcggcagcgcaaaagatg

SEQ ID NO: 171992 - DNA, 103 bp, Artificial Sequence
  Synthetic Polynucleotide
taatacgactcactatagggcgcagacttctaacagggagagaaccctggaacagaggagaccagggatgtctccctgtaacctggcggcagcgcaaaagatg

SEQ ID NO: 171993 - DNA, 103 bp, Artificial Sequence
  Synthetic Polynucleotide
taatacgactcactatagggtacttcttggccaactctagctgctgcttcaacagaggagagaagcaatggctagagttaacctggcggcagcgcaaaagatg

SEQ ID NO: 171994 - DNA, 103 bp, Artificial Sequence
  Synthetic Polynucleotide
taatacgactcactataggggaggcctgggcgcagacttctaacagggagaacagaggagactccctatgagaagtctgaacctggcggcagcgcaaaagatg

SEQ ID NO: 171995 - DNA, 103 bp, Artificial Sequence
  Synthetic Polynucleotide
taatacgactcactataggggacactgcctgaggcctgggcgcagacttcaacagaggagagaagtcatggcccaggccaacctggcggcagcgcaaaagatg

SEQ ID NO: 171996 - DNA, 103 bp, Artificial Sequence
  Synthetic Polynucleotide
taatacgactcactatagggtgatttcagtgacactgcctgaggcctgggaacagaggagacccaggatgcaggcagtgaacctggcggcagcgcaaaagatg

SEQ ID NO: 171997 - DNA, 103 bp, Artificial Sequence
  Synthetic Polynucleotide
taatacgactcactatagggtcggagatgctgatttcagtgacactgcctaacagaggagaaggcagatgcactgaaataacctggcggcagcgcaaaagatg

SEQ ID NO: 171998 - DNA, 103 bp, Artificial Sequence
  Synthetic Polynucleotide
taatacgactcactatagggctgctgggtctcggagatgctgatttcagtaacagaggagaactgaaatgagcatctccaacctggcggcagcgcaaaagatg

SEQ ID NO: 171999 - DNA, 103 bp, Artificial Sequence
  Synthetic Polynucleotide
taatacgactcactatagggcacagagctgctgctgggtctcggagatgcaacagaggagagcatctatgagacccagcaacctggcggcagcgcaaaagatg

SEQ ID NO: 172000 - DNA, 103 bp, Artificial Sequence
  Synthetic Polynucleotide
taatacgactcactatagggtccagctggacacagagctgctgctgggtcaacagaggagagacccaatggcagctctgaacctggcggcagcgcaaaagatg

SEQ ID NO: 172001 - DNA, 103 bp, Artificial Sequence
  Synthetic Polynucleotide
taatacgactcactataggggcgaggaaattccagctggacacagagctgaacagaggagacagctcatggtccagctgaacctggcggcagcgcaaaagatg

SEQ ID NO: 172002 - DNA, 103 bp, Artificial Sequence
  Synthetic Polynucleotide
taatacgactcactatagggtctcttcctggcgaggaaattccagctggaaacagaggagatccagcatgaatttcctcaacctggcggcagcgcaaaagatg

SEQ ID NO: 172003 - DNA, 103 bp, Artificial Sequence
  Synthetic Polynucleotide
taatacgactcactataggggcttctggattctcttcctggcgaggaaataacagaggagaatttccatgccaggaagaaacctggcggcagcgcaaaagatg

SEQ ID NO: 172004 - DNA, 103 bp, Artificial Sequence
  Synthetic Polynucleotide
taatacgactcactataggggagctgcaggtacttcttggccaactctagaacagaggagactagagatggccaagaagaacctggcggcagcgcaaaagatg

SEQ ID NO: 172005 - DNA, 103 bp, Artificial Sequence
  Synthetic Polynucleotide
taatacgactcactataggggagtgccacagcttctggattctcttcctgaacagaggagacaggaaatgaatccagaaaacctggcggcagcgcaaaagatg

SEQ ID NO: 172006 - DNA, 103 bp, Artificial Sequence
  Synthetic Polynucleotide
taatacgactcactataggggagccaacctgagtgccacagcttctggataacagaggagaatccagatgctgtggcacaacctggcggcagcgcaaaagatg

SEQ ID NO: 172007 - DNA, 103 bp, Artificial Sequence
  Synthetic Polynucleotide
taatacgactcactatagggaggtcacagtgagccaacctgagtgccacaaacagaggagatgtggcatgcaggttggcaacctggcggcagcgcaaaagatg

SEQ ID NO: 172008 - DNA, 103 bp, Artificial Sequence
  Synthetic Polynucleotide
taatacgactcactataggggtgggctccaaggtcacagtgagccaacctaacagaggagaaggttgatgcactgtgacaacctggcggcagcgcaaaagatg

SEQ ID NO: 172009 - DNA, 103 bp, Artificial Sequence
  Synthetic Polynucleotide
taatacgactcactataggggaaggctgtggtgggctccaaggtcacagtaacagaggagaactgtgatgttggagcccaacctggcggcagcgcaaaagatg

SEQ ID NO: 172010 - DNA, 103 bp, Artificial Sequence
  Synthetic Polynucleotide
taatacgactcactatagggtgcccgacaagaaggctgtggtgggctccaaacagaggagatggagcatgccacagcctaacctggcggcagcgcaaaagatg

SEQ ID NO: 172011 - DNA, 103 bp, Artificial Sequence
  Synthetic Polynucleotide
taatacgactcactatagggctccatcagctgcccgacaagaaggctgtgaacagaggagacacagcatgcttgtcgggaacctggcggcagcgcaaaagatg

SEQ ID NO: 172012 - DNA, 103 bp, Artificial Sequence
  Synthetic Polynucleotide
taatacgactcactatagggtggcacatgtctccatcagctgcccgacaaaacagaggagattgtcgatgagctgatggaacctggcggcagcgcaaaagatg

SEQ ID NO: 172013 - DNA, 103 bp, Artificial Sequence
  Synthetic Polynucleotide
taatacgactcactatagggtgctgcagcctggcacatgtctccatcagcaacagaggagagctgatatggacatgtgcaacctggcggcagcgcaaaagatg

SEQ ID NO: 172014 - DNA, 103 bp, Artificial Sequence
  Synthetic Polynucleotide
taatacgactcactatagggcaagctgagctgctgcagcctggcacatgtaacagaggagaacatgtatgaggctgcagaacctggcggcagcgcaaaagatg

SEQ ID NO: 172015 - DNA, 103 bp, Artificial Sequence
  Synthetic Polynucleotide
taatacgactcactatagggaggtccgcaggagctgcaggtacttcttggaacagaggagaccaagaatgacctgcagcaacctggcggcagcgcaaaagatg

SEQ ID NO: 172016 - DNA, 103 bp, Artificial Sequence
  Synthetic Polynucleotide
taatacgactcactatagggtaacctgagacaagctgagctgctgcagccaacagaggagaggctgcatgagctcagctaacctggcggcagcgcaaaagatg

SEQ ID NO: 172017 - DNA, 103 bp, Artificial Sequence
  Synthetic Polynucleotide
taatacgactcactatagggtcacagaggttaacctgagacaagctgagcaacagaggagagctcagatggtctcaggtaacctggcggcagcgcaaaagatg

SEQ ID NO: 172018 - DNA, 103 bp, Artificial Sequence
  Synthetic Polynucleotide
taatacgactcactatagggatcatcgtcctcacagaggttaacctgagaaacagaggagatctcagatgaacctctgtaacctggcggcagcgcaaaagatg

SEQ ID NO: 172019 - DNA, 103 bp, Artificial Sequence
  Synthetic Polynucleotide
taatacgactcactataggggggaactggcatcatcgtcctcacagaggtaacagaggagaacctctatgaggacgatgaacctggcggcagcgcaaaagatg

SEQ ID NO: 172020 - DNA, 103 bp, Artificial Sequence
  Synthetic Polynucleotide
taatacgactcactatagggtgcagcagcagggaactggcatcatcgtccaacagaggagaggacgaatgtgccagttcaacctggcggcagcgcaaaagatg

SEQ ID NO: 172021 - DNA, 103 bp, Artificial Sequence
  Synthetic Polynucleotide
taatacgactcactatagggcaggaggctctgcagcagcagggaactggcaacagaggagagccagtatgctgctgctgaacctggcggcagcgcaaaagatg

SEQ ID NO: 172022 - DNA, 103 bp, Artificial Sequence
  Synthetic Polynucleotide
taatacgactcactatagggagagggacagcaggaggctctgcagcagcaaacagaggagatgctgcatgagagcctccaacctggcggcagcgcaaaagatg

SEQ ID NO: 172023 - DNA, 103 bp, Artificial Sequence
  Synthetic Polynucleotide
taatacgactcactatagggttcagctcagagagggacagcaggaggctcaacagaggagagagcctatggctgtccctaacctggcggcagcgcaaaagatg

SEQ ID NO: 172024 - DNA, 103 bp, Artificial Sequence
  Synthetic Polynucleotide
taatacgactcactatagggccgaaatgtcttcagctcagagagggacagaacagaggagactgtccatgtctgagctgaacctggcggcagcgcaaaagatg

SEQ ID NO: 172025 - DNA, 103 bp, Artificial Sequence
  Synthetic Polynucleotide
taatacgactcactatagggtggaggtcagccgaaatgtcttcagctcagaacagaggagactgagcatgagacatttcaacctggcggcagcgcaaaagatg

SEQ ID NO: 172026 - DNA, 103 bp, Artificial Sequence
  Synthetic Polynucleotide
taatacgactcactatagggtgctgggcagaggtccgcaggagctgcaggaacagaggagacctgcaatgcctgcggacaacctggcggcagcgcaaaagatg

SEQ ID NO: 172027 - DNA, 103 bp, Artificial Sequence
  Synthetic Polynucleotide
taatacgactcactatagggctcacacagctggaggtcagccgaaatgtcaacagaggagagacattatggctgacctcaacctggcggcagcgcaaaagatg

SEQ ID NO: 172028 - DNA, 103 bp, Artificial Sequence
  Synthetic Polynucleotide
taatacgactcactataggggccctcggtgctcacacagctggaggtcagaacagaggagactgaccatgagctgtgtgaacctggcggcagcgcaaaagatg

SEQ ID NO: 172029 - DNA, 103 bp, Artificial Sequence
  Synthetic Polynucleotide
taatacgactcactatagggggtgggcgaggccctcggtgctcacacagcaacagaggagagctgtgatggcaccgaggaacctggcggcagcgcaaaagatg

SEQ ID NO: 172030 - DNA, 103 bp, Artificial Sequence
  Synthetic Polynucleotide
taatacgactcactatagggccagatgccaggtgggcgaggccctcggtgaacagaggagacaccgaatgcctcgcccaaacctggcggcagcgcaaaagatg

SEQ ID NO: 172031 - DNA, 103 bp, Artificial Sequence
  Synthetic Polynucleotide
taatacgactcactataggggtggcccagaccagatgccaggtgggcgagaacagaggagactcgccatgctggcatctaacctggcggcagcgcaaaagatg

SEQ ID NO: 172032 - DNA, 103 bp, Artificial Sequence
  Synthetic Polynucleotide
taatacgactcactatagggagtggtggcagtggcccagaccagatgccaaacagaggagatggcatatggtctgggccaacctggcggcagcgcaaaagatg

SEQ ID NO: 172033 - DNA, 103 bp, Artificial Sequence
  Synthetic Polynucleotide
taatacgactcactatagggagctcctccaagtggtggcagtggcccagaaacagaggagatctgggatgctgccaccaaacctggcggcagcgcaaaagatg

SEQ ID NO: 172034 - DNA, 103 bp, Artificial Sequence
  Synthetic Polynucleotide
taatacgactcactatagggagacaagtccagctcctccaagtggtggcaaacagaggagatgccacatgttggaggagaacctggcggcagcgcaaaagatg

SEQ ID NO: 172035 - DNA, 103 bp, Artificial Sequence
  Synthetic Polynucleotide
taatacgactcactatagggattgattgttagacaagtccagctcctccaaacagaggagatggaggatgtggacttgtaacctggcggcagcgcaaaagatg

SEQ ID NO: 172036 - DNA, 103 bp, Artificial Sequence
  Synthetic Polynucleotide
taatacgactcactatagggtcctcatcaaattgattgttagacaagtccaacagaggagaggacttatgtaacaatcaaacctggcggcagcgcaaaagatg

SEQ ID NO: 172037 - DNA, 103 bp, Artificial Sequence
  Synthetic Polynucleotide
taatacgactcactatagggcctgtagcgctgctgggcagaggtccgcagaacagaggagactgcggatgtctgcccagaacctggcggcagcgcaaaagatg

SEQ ID NO: 172038 - DNA, 103 bp, Artificial Sequence
  Synthetic Polynucleotide
taatacgactcactatagggcttggtgccctcctcatcaaattgattgttaacagaggagaaacaatatgtttgatgagaacctggcggcagcgcaaaagatg

SEQ ID NO: 172039 - DNA, 103 bp, Artificial Sequence
  Synthetic Polynucleotide
taatacgactcactatagggtcatcagcgccttggtgccctcctcatcaaaacagaggagattgatgatgagggcaccaaacctggcggcagcgcaaaagatg

SEQ ID NO: 172040 - DNA, 103 bp, Artificial Sequence
  Synthetic Polynucleotide
taatacgactcactatagggtcaagggccctcatcagcgccttggtgcccaacagaggagagggcacatgggcgctgataacctggcggcagcgcaaaagatg

SEQ ID NO: 172041 - DNA, 103 bp, Artificial Sequence
  Synthetic Polynucleotide
taatacgactcactatagggccatttcccctcaagggccctcatcagcgcaacagaggagagcgctgatgagggcccttaacctggcggcagcgcaaaagatg

SEQ ID NO: 172042 - DNA, 103 bp, Artificial Sequence
  Synthetic Polynucleotide
taatacgactcactatagggtctttagcatccatttcccctcaagggcccaacagaggagagggcccatgaggggaaataacctggcggcagcgcaaaagatg

SEQ ID NO: 172043 - DNA, 103 bp, Artificial Sequence
  Synthetic Polynucleotide
taatacgactcactatagggaggtccagcctctttagcatccatttccccaacagaggagaggggaaatggatgctaaaaacctggcggcagcgcaaaagatg

SEQ ID NO: 172044 - DNA, 103 bp, Artificial Sequence
  Synthetic Polynucleotide
taatacgactcactatagggaaggtgactgaggtccagcctctttagcataacagaggagaatgctaatgaggctggacaacctggcggcagcgcaaaagatg

SEQ ID NO: 172045 - DNA, 103 bp, Artificial Sequence
  Synthetic Polynucleotide
taatacgactcactatagggtgttcagcagaaggtgactgaggtccagccaacagaggagaggctggatgtcagtcaccaacctggcggcagcgcaaaagatg

SEQ ID NO: 172046 - DNA, 103 bp, Artificial Sequence
  Synthetic Polynucleotide
taatacgactcactatagggaaggtggagctgttcagcagaaggtgactgaacagaggagacagtcaatgtctgctgaaaacctggcggcagcgcaaaagatg

SEQ ID NO: 172047 - DNA, 103 bp, Artificial Sequence
  Synthetic Polynucleotide
taatacgactcactatagggaagcaaggccaaggtggagctgttcagcagaacagaggagactgctgatgagctccaccaacctggcggcagcgcaaaagatg

SEQ ID NO: 172048 - DNA, 103 bp, Artificial Sequence
  Synthetic Polynucleotide
taatacgactcactatagggggatttggctcctgtagcgctgctgggcagaacagaggagactgcccatgagcgctacaaacctggcggcagcgcaaaagatg

SEQ ID NO: 172049 - DNA, 103 bp, Artificial Sequence
  Synthetic Polynucleotide
taatacgactcactataggggtctgtgagtaagcaaggccaaggtggagcaacagaggagagctccaatgtggccttgcaacctggcggcagcgcaaaagatg

SEQ ID NO: 172050 - DNA, 103 bp, Artificial Sequence
  Synthetic Polynucleotide
taatacgactcactatagggatctggcttagtctgtgagtaagcaaggccaacagaggagaggccttatgtactcacagaacctggcggcagcgcaaaagatg

SEQ ID NO: 172051 - DNA, 103 bp, Artificial Sequence
  Synthetic Polynucleotide
taatacgactcactatagggcaggcaggtcatctggcttagtctgtgagtaacagaggagaactcacatgctaagccagaacctggcggcagcgcaaaagatg

SEQ ID NO: 172052 - DNA, 103 bp, Artificial Sequence
  Synthetic Polynucleotide
taatacgactcactatagggtgaggctctgcaggcaggtcatctggcttaaacagaggagataagccatgtgacctgccaacctggcggcagcgcaaaagatg

SEQ ID NO: 172053 - DNA, 103 bp, Artificial Sequence
  Synthetic Polynucleotide
taatacgactcactatagggctgttcagtctgaggctctgcaggcaggtcaacagaggagagacctgatggcagagcctaacctggcggcagcgcaaaagatg

SEQ ID NO: 172054 - DNA, 103 bp, Artificial Sequence
  Synthetic Polynucleotide
taatacgactcactataggggatactgttcctgttcagtctgaggctctgaacagaggagacagagcatgagactgaacaacctggcggcagcgcaaaagatg

SEQ ID NO: 172055 - DNA, 103 bp, Artificial Sequence
  Synthetic Polynucleotide
taatacgactcactatagggcgacatcaccgatactgttcctgttcagtcaacagaggagagactgaatgggaacagtaaacctggcggcagcgcaaaagatg

SEQ ID NO: 172056 - DNA, 103 bp, Artificial Sequence
  Synthetic Polynucleotide
taatacgactcactatagggtggcagcaaccgacatcaccgatactgttcaacagaggagagaacagatgcggtgatgtaacctggcggcagcgcaaaagatg

SEQ ID NO: 172057 - DNA, 103 bp, Artificial Sequence
  Synthetic Polynucleotide
taatacgactcactatagggctcagaaaggtggcagcaaccgacatcaccaacagaggagaggtgatatgggttgctgcaacctggcggcagcgcaaaagatg

SEQ ID NO: 172058 - DNA, 103 bp, Artificial Sequence
  Synthetic Polynucleotide
taatacgactcactatagggccctgagagcctcagaaaggtggcagcaacaacagaggagagttgctatgacctttctgaacctggcggcagcgcaaaagatg

SEQ ID NO: 172059 - DNA, 103 bp, Artificial Sequence
  Synthetic Polynucleotide
taatacgactcactatagggcctgacccagggatttggctcctgtagcgcaacagaggagagcgctaatggagccaaataacctggcggcagcgcaaaagatg

SEQ ID NO: 172060 - DNA, 103 bp, Artificial Sequence
  Synthetic Polynucleotide
taatacgactcactatagggctggtggcagccctgagagcctcagaaaggaacagaggagacctttcatgggctctcagaacctggcggcagcgcaaaagatg

SEQ ID NO: 172061 - DNA, 103 bp, Artificial Sequence
  Synthetic Polynucleotide
taatacgactcactatagggctcctctaggctggtggcagccctgagagcaacagaggagagctctcatggctgccaccaacctggcggcagcgcaaaagatg

SEQ ID NO: 172062 - DNA, 103 bp, Artificial Sequence
  Synthetic Polynucleotide
taatacgactcactatagggtcaagtccagctcctctaggctggtggcagaacagaggagactgccaatggcctagaggaacctggcggcagcgcaaaagatg

SEQ ID NO: 172063 - DNA, 103 bp, Artificial Sequence
  Synthetic Polynucleotide
taatacgactcactatagggtggttgtggctcaagtccagctcctctaggaacagaggagacctagaatggctggacttaacctggcggcagcgcaaaagatg

SEQ ID NO: 172064 - DNA, 103 bp, Artificial Sequence
  Synthetic Polynucleotide
taatacgactcactataggggtctccaatctggttgtggctcaagtccagaacagaggagactggacatgagccacaacaacctggcggcagcgcaaaagatg

SEQ ID NO: 172065 - DNA, 103 bp, Artificial Sequence
  Synthetic Polynucleotide
taatacgactcactatagggggacaccagcgtctccaatctggttgtggcaacagaggagagccacaatgagattggagaacctggcggcagcgcaaaagatg

SEQ ID NO: 172066 - DNA, 103 bp, Artificial Sequence
  Synthetic Polynucleotide
taatacgactcactataggggctaagtgctggacaccagcgtctccaatcaacagaggagagattggatgcgctggtgtaacctggcggcagcgcaaaagatg

SEQ ID NO: 172067 - DNA, 103 bp, Artificial Sequence
  Synthetic Polynucleotide
taatacgactcactatagggcaggatggtagctaagtgctggacaccagcaacagaggagagctggtatgcagcacttaaacctggcggcagcgcaaaagatg

SEQ ID NO: 172068 - DNA, 103 bp, Artificial Sequence
  Synthetic Polynucleotide
taatacgactcactataggggcagcccaggcaggatggtagctaagtgctaacagaggagaagcactatgctaccatccaacctggcggcagcgcaaaagatg

SEQ ID NO: 172069 - DNA, 103 bp, Artificial Sequence
  Synthetic Polynucleotide
taatacgactcactatagggctgagctctggcagcccaggcaggatggtaaacagaggagataccatatggcctgggctaacctggcggcagcgcaaaagatg

SEQ ID NO: 172070 - DNA, 103 bp, Artificial Sequence
  Synthetic Polynucleotide
taatacgactcactataggggtggggctgccctgacccagggatttggctaacagaggagaagccaaatgcctgggtcaaacctggcggcagcgcaaaagatg

SEQ ID NO: 172071 - DNA, 103 bp, Artificial Sequence
  Synthetic Polynucleotide
taatacgactcactataggggtctatcttcctgagctctggcagcccaggaacagaggagacctgggatgccagagctcaacctggcggcagcgcaaaagatg

SEQ ID NO: 172072 - DNA, 103 bp, Artificial Sequence
  Synthetic Polynucleotide
taatacgactcactatagggtccctgagaggtctatcttcctgagctctgaacagaggagacagagcatgggaagatagaacctggcggcagcgcaaaagatg

SEQ ID NO: 172073 - DNA, 103 bp, Artificial Sequence
  Synthetic Polynucleotide
taatacgactcactatagggctgatgctattccctgagaggtctatcttcaacagaggagagaagatatgcctctcaggaacctggcggcagcgcaaaagatg

SEQ ID NO: 172074 - DNA, 103 bp, Artificial Sequence
  Synthetic Polynucleotide
taatacgactcactatagggcccggctgagctgatgctattccctgagagaacagaggagactctcaatgaatagcatcaacctggcggcagcgcaaaagatg

SEQ ID NO: 172075 - DNA, 103 bp, Artificial Sequence
  Synthetic Polynucleotide
taatacgactcactatagggactgcactcccccggctgagctgatgctataacagaggagaatagcaatggctcagccgaacctggcggcagcgcaaaagatg

SEQ ID NO: 172076 - DNA, 103 bp, Artificial Sequence
  Synthetic Polynucleotide
taatacgactcactataggggactctgccaactgcactcccccggctgagaacagaggagactcagcatggggagtgcaaacctggcggcagcgcaaaagatg

SEQ ID NO: 172077 - DNA, 103 bp, Artificial Sequence
  Synthetic Polynucleotide
taatacgactcactatagggaagaacgagagactctgccaactgcactccaacagaggagaggagtgatgttggcagagaacctggcggcagcgcaaaagatg

SEQ ID NO: 172078 - DNA, 103 bp, Artificial Sequence
  Synthetic Polynucleotide
taatacgactcactatagggggcgcctgcaaagaacgagagactctgccaaacagaggagatggcagatgctctcgttcaacctggcggcagcgcaaaagatg

SEQ ID NO: 172079 - DNA, 103 bp, Artificial Sequence
  Synthetic Polynucleotide
taatacgactcactatagggaactcctccaggcgcctgcaaagaacgagaaacagaggagatctcgtatgttgcaggcgaacctggcggcagcgcaaaagatg

SEQ ID NO: 172080 - DNA, 103 bp, Artificial Sequence
  Synthetic Polynucleotide
taatacgactcactataggggccaagcatcaactcctccaggcgcctgcaaacagaggagatgcaggatgctggaggagaacctggcggcagcgcaaaagatg

SEQ ID NO: 172081 - DNA, 103 bp, Artificial Sequence
  Synthetic Polynucleotide
taatacgactcactatagggctttggtgagcagcctcacaagacagctccaacagaggagaggagctatgttgtgaggcaacctggcggcagcgcaaaagatg

SEQ ID NO: 172082 - DNA, 103 bp, Artificial Sequence
  Synthetic Polynucleotide
taatacgactcactatagggggtggaaggcgtggggctgccctgacccagaacagaggagactgggtatgggcagccccaacctggcggcagcgcaaaagatg

SEQ ID NO: 172083 - DNA, 103 bp, Artificial Sequence
  Synthetic Polynucleotide
taatacgactcactataggggggcattgcagccaagcatcaactcctccaaacagaggagatggaggatgtgatgcttgaacctggcggcagcgcaaaagatg

SEQ ID NO: 172084 - DNA, 103 bp, Artificial Sequence
  Synthetic Polynucleotide
taatacgactcactatagggggatcccccagggcattgcagccaagcatcaacagaggagagatgctatgctgcaatgcaacctggcggcagcgcaaaagatg

SEQ ID NO: 172085 - DNA, 103 bp, Artificial Sequence
  Synthetic Polynucleotide
taatacgactcactatagggcagggctgtgggatcccccagggcattgcaaacagaggagatgcaatatgctgggggataacctggcggcagcgcaaaagatg

SEQ ID NO: 172086 - DNA, 103 bp, Artificial Sequence
  Synthetic Polynucleotide
taatacgactcactataggggagccagccccagggctgtgggatcccccaaacagaggagatgggggatgccacagcccaacctggcggcagcgcaaaagatg

SEQ ID NO: 172087 - DNA, 103 bp, Artificial Sequence
  Synthetic Polynucleotide
taatacgactcactatagggggcagctcctgagccagccccagggctgtgaacagaggagacacagcatgggggctggcaacctggcggcagcgcaaaagatg

SEQ ID NO: 172088 - DNA, 103 bp, Artificial Sequence
  Synthetic Polynucleotide
taatacgactcactatagggcaggtgctggggcagctcctgagccagcccaacagaggagagggctgatgcaggagctgaacctggcggcagcgcaaaagatg

SEQ ID NO: 172089 - DNA, 103 bp, Artificial Sequence
  Synthetic Polynucleotide
taatacgactcactataggggtaggaccctcaggtgctggggcagctcctaacagaggagaaggagcatgcccagcaccaacctggcggcagcgcaaaagatg

SEQ ID NO: 172090 - DNA, 103 bp, Artificial Sequence
  Synthetic Polynucleotide
taatacgactcactatagggaatggtaggtgtaggaccctcaggtgctggaacagaggagaccagcaatggagggtcctaacctggcggcagcgcaaaagatg

SEQ ID NO: 172091 - DNA, 103 bp, Artificial Sequence
  Synthetic Polynucleotide
taatacgactcactatagggcagatggctgaatggtaggtgtaggaccctaacagaggagaagggtcatgcacctaccaaacctggcggcagcgcaaaagatg

SEQ ID NO: 172092 - DNA, 103 bp, Artificial Sequence
  Synthetic Polynucleotide
taatacgactcactatagggcacctgggcccagatggctgaatggtaggtaacagaggagaacctacatgtcagccatcaacctggcggcagcgcaaaagatg

SEQ ID NO: 172093 - DNA, 103 bp, Artificial Sequence
  Synthetic Polynucleotide
taatacgactcactatagggacatagacctggtggaaggcgtggggctgcaacagaggagagcagccatgcgccttccaaacctggcggcagcgcaaaagatg

SEQ ID NO: 172094 - DNA, 103 bp, Artificial Sequence
  Synthetic Polynucleotide
taatacgactcactatagggctcagggccccacctgggcccagatggctgaacagaggagacagccaatggggcccaggaacctggcggcagcgcaaaagatg

SEQ ID NO: 172095 - DNA, 103 bp, Artificial Sequence
  Synthetic Polynucleotide
taatacgactcactatagggctgggccaggctcagggccccacctgggccaacagaggagaggcccaatgggggccctgaacctggcggcagcgcaaaagatg

SEQ ID NO: 172096 - DNA, 103 bp, Artificial Sequence
  Synthetic Polynucleotide
taatacgactcactatagggcatccagggcctgggccaggctcagggcccaacagaggagagggcccatggcctggcccaacctggcggcagcgcaaaagatg

SEQ ID NO: 172097 - DNA, 103 bp, Artificial Sequence
  Synthetic Polynucleotide
taatacgactcactatagggtggggggatccatccagggcctgggccaggaacagaggagacctggcatgggccctggaaacctggcggcagcgcaaaagatg

SEQ ID NO: 172098 - DNA, 103 bp, Artificial Sequence
  Synthetic Polynucleotide
taatacgactcactatagggctcttccaaatggggggatccatccagggcaacagaggagagccctgatgggatcccccaacctggcggcagcgcaaaagatg

SEQ ID NO: 172099 - DNA, 103 bp, Artificial Sequence
  Synthetic Polynucleotide
taatacgactcactatagggccaagctgatctcttccaaatggggggatcaacagaggagagatcccatgatttggaagaacctggcggcagcgcaaaagatg

SEQ ID NO: 172100 - DNA, 103 bp, Artificial Sequence
  Synthetic Polynucleotide
taatacgactcactatagggttgttttccgccaagctgatctcttccaaaaacagaggagatttggaatggatcagcttaacctggcggcagcgcaaaagatg

SEQ ID NO: 172101 - DNA, 103 bp, Artificial Sequence
  Synthetic Polynucleotide
taatacgactcactatagggtccagccaggttgttttccgccaagctgataacagaggagaatcagcatggcggaaaacaacctggcggcagcgcaaaagatg

SEQ ID NO: 172102 - DNA, 103 bp, Artificial Sequence
  Synthetic Polynucleotide
taatacgactcactataggggcaggacccctccagccaggttgttttccgaacagaggagacggaaaatgacctggctgaacctggcggcagcgcaaaagatg

SEQ ID NO: 172103 - DNA, 103 bp, Artificial Sequence
  Synthetic Polynucleotide
taatacgactcactatagggatacagaaacgcaggacccctccagccaggaacagaggagacctggcatgaggggtcctaacctggcggcagcgcaaaagatg

SEQ ID NO: 172104 - DNA, 103 bp, Artificial Sequence
  Synthetic Polynucleotide
taatacgactcactataggggattggagggacatagacctggtggaaggcaacagaggagagccttcatgcaggtctataacctggcggcagcgcaaaagatg

SEQ ID NO: 172105 - DNA, 103 bp, Artificial Sequence
  Synthetic Polynucleotide
taatacgactcactatagggcgggagctccatacagaaacgcaggaccccaacagaggagaggggtcatgcgtttctgtaacctggcggcagcgcaaaagatg

SEQ ID NO: 172106 - DNA, 103 bp, Artificial Sequence
  Synthetic Polynucleotide
taatacgactcactataggggtctgagcagcgggagctccatacagaaacaacagaggagagtttctatgtggagctccaacctggcggcagcgcaaaagatg

SEQ ID NO: 172107 - DNA, 103 bp, Artificial Sequence
  Synthetic Polynucleotide
taatacgactcactatagggaggtctatctgtctgagcagcgggagctccaacagaggagaggagctatggctgctcagaacctggcggcagcgcaaaagatg

SEQ ID NO: 172108 - DNA, 103 bp, Artificial Sequence
  Synthetic Polynucleotide
taatacgactcactatagggacaggaaaccaggtctatctgtctgagcagaacagaggagactgctcatgcagatagacaacctggcggcagcgcaaaagatg

SEQ ID NO: 172109 - DNA, 103 bp, Artificial Sequence
  Synthetic Polynucleotide
taatacgactcactatagggtgtcaatcttacaggaaaccaggtctatctaacagaggagaagatagatgtggtttcctaacctggcggcagcgcaaaagatg

SEQ ID NO: 172110 - DNA, 103 bp, Artificial Sequence
  Synthetic Polynucleotide
taatacgactcactataggggcagtctggttgtcaatcttacaggaaaccaacagaggagaggtttcatgtaagattgaaacctggcggcagcgcaaaagatg

SEQ ID NO: 172111 - DNA, 103 bp, Artificial Sequence
  Synthetic Polynucleotide
taatacgactcactataggggaggagcttggcagtctggttgtcaatcttaacagaggagaaagattatgaaccagactaacctggcggcagcgcaaaagatg

SEQ ID NO: 172112 - DNA, 103 bp, Artificial Sequence
  Synthetic Polynucleotide
taatacgactcactatagggagctggaggtgaggagcttggcagtctggtaacagaggagaaccagaatgccaagctccaacctggcggcagcgcaaaagatg

SEQ ID NO: 172113 - DNA, 103 bp, Artificial Sequence
  Synthetic Polynucleotide
taatacgactcactatagggcagctcgtgaagctggaggtgaggagcttgaacagaggagacaagctatgcacctccagaacctggcggcagcgcaaaagatg

SEQ ID NO: 172114 - DNA, 103 bp, Artificial Sequence
  Synthetic Polynucleotide
taatacgactcactatagggcagggcagggcagctcgtgaagctggaggtaacagaggagaacctccatgttcacgagcaacctggcggcagcgcaaaagatg

SEQ ID NO: 172115 - DNA, 103 bp, Artificial Sequence
  Synthetic Polynucleotide
taatacgactcactatagggcccggcgcaggattggagggacatagacctaacagaggagaaggtctatgtccctccaaaacctggcggcagcgcaaaagatg

SEQ ID NO: 172116 - DNA, 103 bp, Artificial Sequence
  Synthetic Polynucleotide
taatacgactcactatagggagattacttccagggcagggcagctcgtgaaacagaggagatcacgaatggccctgcccaacctggcggcagcgcaaaagatg

SEQ ID NO: 172117 - DNA, 103 bp, Artificial Sequence
  Synthetic Polynucleotide
taatacgactcactatagggcaggacagcaagattacttccagggcagggaacagaggagaccctgcatgggaagtaataacctggcggcagcgcaaaagatg

SEQ ID NO: 172118 - DNA, 103 bp, Artificial Sequence
  Synthetic Polynucleotide
taatacgactcactataggggaggagattccaggacagcaagattacttcaacagaggagagaagtaatgttgctgtccaacctggcggcagcgcaaaagatg

SEQ ID NO: 172119 - DNA, 103 bp, Artificial Sequence
  Synthetic Polynucleotide
taatacgactcactatagggcctcatccccgaggagattccaggacagcaaacagaggagatgctgtatgggaatctccaacctggcggcagcgcaaaagatg

SEQ ID NO: 172120 - DNA, 103 bp, Artificial Sequence
  Synthetic Polynucleotide
taatacgactcactatagggtcggcagctgcctcatccccgaggagattcaacagaggagagaatctatgcggggatgaaacctggcggcagcgcaaaagatg

SEQ ID NO: 172121 - DNA, 103 bp, Artificial Sequence
  Synthetic Polynucleotide
taatacgactcactatagggctgggccagctcggcagctgcctcatccccaacagaggagaggggatatggcagctgccaacctggcggcagcgcaaaagatg

SEQ ID NO: 172122 - DNA, 103 bp, Artificial Sequence
  Synthetic Polynucleotide
taatacgactcactataggggcggcagcacctgggccagctcggcagctgaacagaggagacagctgatgagctggcccaacctggcggcagcgcaaaagatg

SEQ ID NO: 172123 - DNA, 103 bp, Artificial Sequence
  Synthetic Polynucleotide
taatacgactcactatagggcggcccatctgcggcagcacctgggccagcaacagaggagagctggcatgggtgctgccaacctggcggcagcgcaaaagatg

SEQ ID NO: 172124 - DNA, 103 bp, Artificial Sequence
  Synthetic Polynucleotide
taatacgactcactatagggtctcttcagccggcccatctgcggcagcacaacagaggagagtgctgatgcagatgggcaacctggcggcagcgcaaaagatg

SEQ ID NO: 172125 - DNA, 103 bp, Artificial Sequence
  Synthetic Polynucleotide
taatacgactcactatagggccaggtccactctcttcagccggcccatctaacagaggagaagatggatgggctgaagaaacctggcggcagcgcaaaagatg

SEQ ID NO: 172126 - DNA, 103 bp, Artificial Sequence
  Synthetic Polynucleotide
taatacgactcactataggggatgctgtggcccggcgcaggattggagggaacagaggagaccctccatgcctgcgccgaacctggcggcagcgcaaaagatg

SEQ ID NO: 172127 - DNA, 103 bp, Artificial Sequence
  Synthetic Polynucleotide
taatacgactcactatagggtgattcttctccaggtccactctcttcagcaacagaggagagctgaaatgagtggacctaacctggcggcagcgcaaaagatg

SEQ ID NO: 172128 - DNA, 103 bp, Artificial Sequence
  Synthetic Polynucleotide
taatacgactcactatagggagctgtgatctgattcttctccaggtccacaacagaggagagtggacatggagaagaataacctggcggcagcgcaaaagatg

SEQ ID NO: 172129 - DNA, 103 bp, Artificial Sequence
  Synthetic Polynucleotide
taatacgactcactatagggaggcccccaaagctgtgatctgattcttctaacagaggagaagaagaatgagatcacagaacctggcggcagcgcaaaagatg

SEQ ID NO: 172130 - DNA, 103 bp, Artificial Sequence
  Synthetic Polynucleotide
taatacgactcactataggggccaggagccaggcccccaaagctgtgatcaacagaggagagatcacatgtttgggggcaacctggcggcagcgcaaaagatg

SEQ ID NO: 172131 - DNA, 103 bp, Artificial Sequence
  Synthetic Polynucleotide
taatacgactcactatagggcagtccttcagccaggagccaggcccccaaaacagaggagattggggatgtggctcctgaacctggcggcagcgcaaaagatg

SEQ ID NO: 172132 - DNA, 103 bp, Artificial Sequence
  Synthetic Polynucleotide
taatacgactcactatagggacccctgggccagtccttcagccaggagccaacagaggagaggctccatgctgaaggacaacctggcggcagcgcaaaagatg

SEQ ID NO: 172133 - DNA, 103 bp, Artificial Sequence
  Synthetic Polynucleotide
taatacgactcactatagggtggatgctagacccctgggccagtccttcaaacagaggagatgaaggatgggcccagggaacctggcggcagcgcaaaagatg

SEQ ID NO: 172134 - DNA, 103 bp, Artificial Sequence
  Synthetic Polynucleotide
taatacgactcactataggggcggatgacttggatgctagacccctgggcaacagaggagagcccagatgtctagcatcaacctggcggcagcgcaaaagatg

SEQ ID NO: 172135 - DNA, 103 bp, Artificial Sequence
  Synthetic Polynucleotide
taatacgactcactatagggtattccagaggcggatgacttggatgctagaacagaggagactagcaatgaagtcatccaacctggcggcagcgcaaaagatg

SEQ ID NO: 172136 - DNA, 103 bp, Artificial Sequence
  Synthetic Polynucleotide
taatacgactcactatagggggaatggggttattccagaggcggatgactaacagaggagaagtcatatgcctctggaaaacctggcggcagcgcaaaagatg

SEQ ID NO: 172137 - DNA, 103 bp, Artificial Sequence
  Synthetic Polynucleotide
taatacgactcactatagggagtgtctaaggatgctgtggcccggcgcagaacagaggagactgcgcatggccacagcaaacctggcggcagcgcaaaagatg

SEQ ID NO: 172138 - DNA, 103 bp, Artificial Sequence
  Synthetic Polynucleotide
taatacgactcactatagggcatgtcgcagggaatggggttattccagagaacagaggagactctggatgaaccccattaacctggcggcagcgcaaaagatg

SEQ ID NO: 172139 - DNA, 103 bp, Artificial Sequence
  Synthetic Polynucleotide
taatacgactcactatagggggtgctgggccatgtcgcagggaatggggtaacagaggagaaccccaatgcctgcgacaaacctggcggcagcgcaaaagatg

SEQ ID NO: 172140 - DNA, 103 bp, Artificial Sequence
  Synthetic Polynucleotide
taatacgactcactatagggtggctcttcaggtgctgggccatgtcgcagaacagaggagactgcgaatgggcccagcaaacctggcggcagcgcaaaagatg

SEQ ID NO: 172141 - DNA, 103 bp, Artificial Sequence
  Synthetic Polynucleotide
taatacgactcactatagggcctgggctcctggctcttcaggtgctgggcaacagaggagagcccagatgctgaagagcaacctggcggcagcgcaaaagatg

SEQ ID NO: 172142 - DNA, 103 bp, Artificial Sequence
  Synthetic Polynucleotide
taatacgactcactatagggcaaagtccagcctgggctcctggctcttcaaacagaggagatgaagaatgaggagcccaaacctggcggcagcgcaaaagatg

SEQ ID NO: 172143 - DNA, 103 bp, Artificial Sequence
  Synthetic Polynucleotide
taatacgactcactatagggtcaaagaaggcaaagtccagcctgggctccaacagaggagaggagccatggctggacttaacctggcggcagcgcaaaagatg

SEQ ID NO: 172144 - DNA, 103 bp, Artificial Sequence
  Synthetic Polynucleotide
taatacgactcactataggggggctggttgtcaaagaaggcaaagtccagaacagaggagactggacatggccttctttaacctggcggcagcgcaaaagatg

SEQ ID NO: 172145 - DNA, 103 bp, Artificial Sequence
  Synthetic Polynucleotide
taatacgactcactatagggaaggggcctggggctggttgtcaaagaaggaacagaggagaccttctatgacaaccagcaacctggcggcagcgcaaaagatg

SEQ ID NO: 172146 - DNA, 103 bp, Artificial Sequence
  Synthetic Polynucleotide
taatacgactcactatagggcaagtaccccaaggggcctggggctggttgaacagaggagacaaccaatgccaggccccaacctggcggcagcgcaaaagatg

SEQ ID NO: 172147 - DNA, 103 bp, Artificial Sequence
  Synthetic Polynucleotide
taatacgactcactatagggccccctccggagtgtctaaggatgctgtggaacagaggagaccacagatgccttagacaaacctggcggcagcgcaaaagatg

SEQ ID NO: 172148 - DNA, 103 bp, Artificial Sequence
  Synthetic Polynucleotide
taatacgactcactatagggcccataatggccccctccggagtgtctaagaacagaggagacttagaatgtccggagggaacctggcggcagcgcaaaagatg

SEQ ID NO: 172149 - DNA, 103 bp, Artificial Sequence
  Synthetic Polynucleotide
taatacgactcactatagggcttgacgtcccccataatggccccctccggaacagaggagaccggagatggccattatgaacctggcggcagcgcaaaagatg

SEQ ID NO: 172150 - DNA, 103 bp, Artificial Sequence
  Synthetic Polynucleotide
taatacgactcactatagggcatcttccaccttgacgtcccccataatggaacagaggagaccattaatggggacgtcaaacctggcggcagcgcaaaagatg

SEQ ID NO: 172151 - DNA, 103 bp, Artificial Sequence
  Synthetic Polynucleotide
taatacgactcactatagggcattctgggtctttggtgagcagcctcacaaacagaggagatgtgagatggctcaccaaaacctggcggcagcgcaaaagatg

SEQ ID NO: 172152 - DNA, 103 bp, Artificial Sequence
  Synthetic Polynucleotide
taatacgactcactatagggacgtcagcaccatcttccaccttgacgtccaacagaggagaggacgtatgggtggaagaaacctggcggcagcgcaaaagatg

SEQ ID NO: 172153 - DNA, 103 bp, Artificial Sequence
  Synthetic Polynucleotide
taatacgactcactatagggcgagatgctcacgtcagcaccatcttccacaacagaggagagtggaaatgggtgctgacaacctggcggcagcgcaaaagatg

SEQ ID NO: 172154 - DNA, 103 bp, Artificial Sequence
  Synthetic Polynucleotide
taatacgactcactatagggtgaagaggtccgagatgctcacgtcagcacaacagaggagagtgctgatgtgagcatctaacctggcggcagcgcaaaagatg

SEQ ID NO: 172155 - DNA, 103 bp, Artificial Sequence
  Synthetic Polynucleotide
taatacgactcactatagggaccctggtgttgaagaggtccgagatgctcaacagaggagagagcatatgggacctcttaacctggcggcagcgcaaaagatg

SEQ ID NO: 172156 - DNA, 103 bp, Artificial Sequence
  Synthetic Polynucleotide
taatacgactcactataggggcccttgttaaccctggtgttgaagaggtcaacagaggagagacctcatgaacaccaggaacctggcggcagcgcaaaagatg

SEQ ID NO: 172157 - DNA, 103 bp, Artificial Sequence
  Synthetic Polynucleotide
taatacgactcactatagggtcaccctcgggcccttgttaaccctggtgtaacagaggagaacaccaatgttaacaaggaacctggcggcagcgcaaaagatg

SEQ ID NO: 172158 - DNA, 103 bp, Artificial Sequence
  Synthetic Polynucleotide
taatacgactcactatagggaaaagcacggtcaccctcgggcccttgttaaacagaggagataacaaatgcccgagggtaacctggcggcagcgcaaaagatg

SEQ ID NO: 172159 - DNA, 103 bp, Artificial Sequence
  Synthetic Polynucleotide
taatacgactcactatagggagccttccccaaaagcacggtcaccctcggaacagaggagaccgaggatgaccgtgcttaacctggcggcagcgcaaaagatg

SEQ ID NO: 172160 - DNA, 103 bp, Artificial Sequence
  Synthetic Polynucleotide
taatacgactcactatagggtgcccatgccagccttccccaaaagcacggaacagaggagaccgtgcatgtggggaaggaacctggcggcagcgcaaaagatg

SEQ ID NO: 172161 - DNA, 103 bp, Artificial Sequence
  Synthetic Polynucleotide
taatacgactcactatagggagcgtggtcttgcccatgccagccttccccaacagaggagaggggaaatgtggcatgggaacctggcggcagcgcaaaagatg

SEQ ID NO: 172162 - DNA, 103 bp, Artificial Sequence
  Synthetic Polynucleotide
taatacgactcactatagggggcgttcagccattctgggtctttggtgagaacagaggagactcaccatggacccagaaaacctggcggcagcgcaaaagatg

SEQ ID NO: 172163 - DNA, 103 bp, Artificial Sequence
  Synthetic Polynucleotide
taatacgactcactatagggccggtgggccagcgtggtcttgcccatgccaacagaggagaggcatgatgaagaccacgaacctggcggcagcgcaaaagatg

SEQ ID NO: 172164 - DNA, 103 bp, Artificial Sequence
  Synthetic Polynucleotide
taatacgactcactatagggtctggcagagccggtgggccagcgtggtctaacagaggagaagaccaatgtggcccaccaacctggcggcagcgcaaaagatg

SEQ ID NO: 172165 - DNA, 103 bp, Artificial Sequence
  Synthetic Polynucleotide
taatacgactcactatagggtctgcccacttctggcagagccggtgggccaacagaggagaggcccaatggctctgccaaacctggcggcagcgcaaaagatg

SEQ ID NO: 172166 - DNA, 103 bp, Artificial Sequence
  Synthetic Polynucleotide
taatacgactcactatagggcagatggccctctgcccacttctggcagagaacagaggagactctgcatgaagtgggcaaacctggcggcagcgcaaaagatg

SEQ ID NO: 172167 - DNA, 103 bp, Artificial Sequence
  Synthetic Polynucleotide
taatacgactcactatagggggaaacagttcagatggccctctgcccactaacagaggagaagtgggatgagggccatcaacctggcggcagcgcaaaagatg

SEQ ID NO: 172168 - DNA, 103 bp, Artificial Sequence
  Synthetic Polynucleotide
taatacgactcactatagggaacagggcctggaaacagttcagatggcccaacagaggagagggccaatggaactgtttaacctggcggcagcgcaaaagatg

SEQ ID NO: 172169 - DNA, 103 bp, Artificial Sequence
  Synthetic Polynucleotide
taatacgactcactatagggttcaaaaaggaacagggcctggaaacagttaacagaggagaaactgtatgcaggccctgaacctggcggcagcgcaaaagatg

SEQ ID NO: 172170 - DNA, 103 bp, Artificial Sequence
  Synthetic Polynucleotide
taatacgactcactataggggctggcggaattcaaaaaggaacagggcctaacagaggagaaggcccatgtcctttttgaacctggcggcagcgcaaaagatg

SEQ ID NO: 172171 - DNA, 103 bp, Artificial Sequence
  Synthetic Polynucleotide
taatacgactcactatagggatcaagttgagctggcggaattcaaaaaggaacagaggagaccttttatgattccgccaaacctggcggcagcgcaaaagatg

SEQ ID NO: 172172 - DNA, 103 bp, Artificial Sequence
  Synthetic Polynucleotide
taatacgactcactataggggaacctcgtgatcaagttgagctggcggaaaacagaggagattccgcatgctcaacttgaacctggcggcagcgcaaaagatg

SEQ ID NO: 172173 - DNA, 103 bp, Artificial Sequence
  Synthetic Polynucleotide
taatacgactcactatagggacttcatcttggcgttcagccattctgggtaacagaggagaacccagatgggctgaacgaacctggcggcagcgcaaaagatg

SEQ ID NO: 172174 - DNA, 103 bp, Artificial Sequence
  Synthetic Polynucleotide
taatacgactcactatagggacggtgtcaggaacctcgtgatcaagttgaaacagaggagatcaactatgtcacgaggtaacctggcggcagcgcaaaagatg

SEQ ID NO: 172175 - DNA, 103 bp, Artificial Sequence
  Synthetic Polynucleotide
taatacgactcactatagggaggagctcggacggtgtcaggaacctcgtgaacagaggagacacgagatgcctgacaccaacctggcggcagcgcaaaagatg

SEQ ID NO: 172176 - DNA, 103 bp, Artificial Sequence
  Synthetic Polynucleotide
taatacgactcactatagggcagatcaaaaaggagctcggacggtgtcagaacagaggagactgacaatgtccgagctcaacctggcggcagcgcaaaagatg

SEQ ID NO: 172177 - DNA, 103 bp, Artificial Sequence
  Synthetic Polynucleotide
taatacgactcactatagggggctcaggtacagatcaaaaaggagctcggaacagaggagaccgagcatgtttttgatcaacctggcggcagcgcaaaagatg

SEQ ID NO: 172178 - DNA, 103 bp, Artificial Sequence
  Synthetic Polynucleotide
taatacgactcactatagggtccgattcagggctcaggtacagatcaaaaaacagaggagattttgaatggtacctgagaacctggcggcagcgcaaaagatg

SEQ ID NO: 172179 - DNA, 103 bp, Artificial Sequence
  Synthetic Polynucleotide
taatacgactcactatagggagtgtcgtggtccgattcagggctcaggtaaacagaggagatacctgatgcctgaatcgaacctggcggcagcgcaaaagatg

SEQ ID NO: 172180 - DNA, 103 bp, Artificial Sequence
  Synthetic Polynucleotide
taatacgactcactatagggactggaagacagtgtcgtggtccgattcagaacagaggagactgaatatgaccacgacaaacctggcggcagcgcaaaagatg

SEQ ID NO: 172181 - DNA, 103 bp, Artificial Sequence
  Synthetic Polynucleotide
taatacgactcactatagggttctccaggtactggaagacagtgtcgtggaacagaggagaccacgaatgtgtcttccaaacctggcggcagcgcaaaagatg

SEQ ID NO: 172182 - DNA, 103 bp, Artificial Sequence
  Synthetic Polynucleotide
taatacgactcactataggggtcagcgttcttctccaggtactggaagacaacagaggagagtcttcatgtacctggagaacctggcggcagcgcaaaagatg

SEQ ID NO: 172183 - DNA, 103 bp, Artificial Sequence
  Synthetic Polynucleotide
taatacgactcactataggggcaggacttggtcagcgttcttctccaggtaacagaggagaacctggatgagaacgctgaacctggcggcagcgcaaaagatg

SEQ ID NO: 172184 - DNA, 103 bp, Artificial Sequence
  Synthetic Polynucleotide
taatacgactcactataggggggaggaagaacttcatcttggcgttcagcaacagaggagagctgaaatgcaagatgaaaacctggcggcagcgcaaaagatg

SEQ ID NO: 172185 - DNA, 103 bp, Artificial Sequence
  Synthetic Polynucleotide
taatacgactcactatagggtcaaagatcagcaggacttggtcagcgttcaacagaggagagaacgcatgccaagtcctaacctggcggcagcgcaaaagatg

SEQ ID NO: 172186 - DNA, 103 bp, Artificial Sequence
  Synthetic Polynucleotide
taatacgactcactatagggatctagcccatcaaagatcagcaggacttgaacagaggagacaagtcatgctgatctttaacctggcggcagcgcaaaagatg

SEQ ID NO: 172187 - DNA, 103 bp, Artificial Sequence
  Synthetic Polynucleotide
taatacgactcactatagggggagggcctcatctagcccatcaaagatcaaacagaggagatgatctatgatgggctagaacctggcggcagcgcaaaagatg

SEQ ID NO: 172188 - DNA, 103 bp, Artificial Sequence
  Synthetic Polynucleotide
taatacgactcactatagggcccataggctggagggcctcatctagcccaaacagaggagatgggctatgtgaggccctaacctggcggcagcgcaaaagatg

SEQ ID NO: 172189 - DNA, 103 bp, Artificial Sequence
  Synthetic Polynucleotide
taatacgactcactataggggccatcaggacccataggctggagggcctcaacagaggagagaggccatgcagcctatgaacctggcggcagcgcaaaagatg

SEQ ID NO: 172190 - DNA, 103 bp, Artificial Sequence
  Synthetic Polynucleotide
taatacgactcactatagggctgggcctgggccatcaggacccataggctaacagaggagaagcctaatggtcctgatgaacctggcggcagcgcaaaagatg

SEQ ID NO: 172191 - DNA, 103 bp, Artificial Sequence
  Synthetic Polynucleotide
taatacgactcactatagggagggtgaggactgggcctgggccatcaggaaacagaggagatcctgaatgcccaggcccaacctggcggcagcgcaaaagatg

SEQ ID NO: 172192 - DNA, 103 bp, Artificial Sequence
  Synthetic Polynucleotide
taatacgactcactatagggatgggagaaaagggtgaggactgggcctggaacagaggagaccaggcatggtcctcaccaacctggcggcagcgcaaaagatg

SEQ ID NO: 172193 - DNA, 103 bp, Artificial Sequence
  Synthetic Polynucleotide
taatacgactcactatagggcattgcagagatgggagaaaagggtgaggaaacagaggagatcctcaatgttttctcccaacctggcggcagcgcaaaagatg

SEQ ID NO: 172194 - DNA, 103 bp, Artificial Sequence
  Synthetic Polynucleotide
taatacgactcactatagggaggagggtcccattgcagagatgggagaaaaacagaggagatttctcatgtctctgcaaaacctggcggcagcgcaaaagatg

SEQ ID NO: 172195 - DNA, 103 bp, Artificial Sequence
  Synthetic Polynucleotide
taatacgactcactataggggacgatccctaaagtagacagtagcaccataacagaggagaatggtgatgctgtctactaacctggcggcagcgcaaaagatg

SEQ ID NO: 172196 - DNA, 103 bp, Artificial Sequence
  Synthetic Polynucleotide
taatacgactcactatagggcccatctggtttgatcgcaatgaaggtacgaacagaggagacgtaccatgattgcgatcaacctggcggcagcgcaaaagatg

SEQ ID NO: 172197 - DNA, 103 bp, Artificial Sequence
  Synthetic Polynucleotide
taatacgactcactatagggcccgctggaccccatctggtttgatcgcaaaacagaggagattgcgaatgaaccagatgaacctggcggcagcgcaaaagatg

SEQ ID NO: 172198 - DNA, 103 bp, Artificial Sequence
  Synthetic Polynucleotide
taatacgactcactatagggcccacaagaccccgctggaccccatctggtaacagaggagaaccagaatgggtccagcgaacctggcggcagcgcaaaagatg

SEQ ID NO: 172199 - DNA, 103 bp, Artificial Sequence
  Synthetic Polynucleotide
taatacgactcactataggggataatctctcccacaagaccccgctggacaacagaggagagtccagatgggtcttgtgaacctggcggcagcgcaaaagatg

SEQ ID NO: 172200 - DNA, 103 bp, Artificial Sequence
  Synthetic Polynucleotide
taatacgactcactatagggcaaaacgcttgataatctctcccacaagacaacagaggagagtcttgatggagagattaaacctggcggcagcgcaaaagatg

SEQ ID NO: 172201 - DNA, 103 bp, Artificial Sequence
  Synthetic Polynucleotide
taatacgactcactatagggcctttctgctcaaaacgcttgataatctctaacagaggagaagagatatgcaagcgtttaacctggcggcagcgcaaaagatg

SEQ ID NO: 172202 - DNA, 103 bp, Artificial Sequence
  Synthetic Polynucleotide
taatacgactcactatagggaaggcggaatcctttctgctcaaaacgcttaacagaggagaaagcgtatggagcagaaaaacctggcggcagcgcaaaagatg

SEQ ID NO: 172203 - DNA, 103 bp, Artificial Sequence
  Synthetic Polynucleotide
taatacgactcactatagggtcagaccaacaaggcggaatcctttctgctaacagaggagaagcagaatggattccgccaacctggcggcagcgcaaaagatg

SEQ ID NO: 172204 - DNA, 103 bp, Artificial Sequence
  Synthetic Polynucleotide
taatacgactcactatagggtgcatgaatttcagaccaacaaggcggaataacagaggagaattccgatgtgttggtctaacctggcggcagcgcaaaagatg

SEQ ID NO: 172205 - DNA, 103 bp, Artificial Sequence
  Synthetic Polynucleotide
taatacgactcactatagggttcggaagcttgcatgaatttcagaccaacaacagaggagagttggtatgaaattcatgaacctggcggcagcgcaaaagatg

SEQ ID NO: 172206 - DNA, 103 bp, Artificial Sequence
  Synthetic Polynucleotide
taatacgactcactatagggcgccttgaaagacgatccctaaagtagacaaacagaggagatgtctaatgtagggatcgaacctggcggcagcgcaaaagatg

SEQ ID NO: 172207 - DNA, 103 bp, Artificial Sequence
  Synthetic Polynucleotide
taatacgactcactatagggtgagaagatcttcggaagcttgcatgaattaacagaggagaaattcaatgaagcttccgaacctggcggcagcgcaaaagatg

SEQ ID NO: 172208 - DNA, 103 bp, Artificial Sequence
  Synthetic Polynucleotide
taatacgactcactatagggtagtgttccttgagaagatcttcggaagctaacagaggagaagcttcatgagatcttctaacctggcggcagcgcaaaagatg

SEQ ID NO: 172209 - DNA, 103 bp, Artificial Sequence
  Synthetic Polynucleotide
taatacgactcactatagggcaggtcaacgtagtgttccttgagaagatcaacagaggagagatcttatgaaggaacacaacctggcggcagcgcaaaagatg

SEQ ID NO: 172210 - DNA, 103 bp, Artificial Sequence
  Synthetic Polynucleotide
taatacgactcactataggggacggtccttcaggtcaacgtagtgttcctaacagaggagaaggaacatgacgttgaccaacctggcggcagcgcaaaagatg

SEQ ID NO: 172211 - DNA, 103 bp, Artificial Sequence
  Synthetic Polynucleotide
taatacgactcactataggggcaaagaatggacggtccttcaggtcaacgaacagaggagacgttgaatggaaggaccgaacctggcggcagcgcaaaagatg

SEQ ID NO: 172212 - DNA, 103 bp, Artificial Sequence
  Synthetic Polynucleotide
taatacgactcactatagggcaccaggccggcaaagaatggacggtccttaacagaggagaaaggacatgccattctttaacctggcggcagcgcaaaagatg

SEQ ID NO: 172213 - DNA, 103 bp, Artificial Sequence
  Synthetic Polynucleotide
taatacgactcactataggggcatgtatttcaccaggccggcaaagaatgaacagaggagacattctatgccggcctggaacctggcggcagcgcaaaagatg

SEQ ID NO: 172214 - DNA, 103 bp, Artificial Sequence
  Synthetic Polynucleotide
taatacgactcactatagggggccctgagtgcatgtatttcaccaggccgaacagaggagacggcctatggaaatacataacctggcggcagcgcaaaagatg

SEQ ID NO: 172215 - DNA, 103 bp, Artificial Sequence
  Synthetic Polynucleotide
taatacgactcactatagggggcaactaccggccctgagtgcatgtatttaacagaggagaaaatacatgcactcagggaacctggcggcagcgcaaaagatg

SEQ ID NO: 172216 - DNA, 103 bp, Artificial Sequence
  Synthetic Polynucleotide
taatacgactcactatagggcccagaccatggcaactaccggccctgagtaacagaggagaactcagatgcggtagttgaacctggcggcagcgcaaaagatg

SEQ ID NO: 172217 - DNA, 103 bp, Artificial Sequence
  Synthetic Polynucleotide
taatacgactcactatagggggaggcccctcgccttgaaagacgatccctaacagaggagaagggatatgctttcaaggaacctggcggcagcgcaaaagatg

SEQ ID NO: 172218 - DNA, 103 bp, Artificial Sequence
  Synthetic Polynucleotide
taatacgactcactatagggttcagcccctcccagaccatggcaactaccaacagaggagaggtagtatgcatggtctgaacctggcggcagcgcaaaagatg

SEQ ID NO: 172219 - DNA, 103 bp, Artificial Sequence
  Synthetic Polynucleotide
taatacgactcactatagggcttcaccacattcagcccctcccagaccataacagaggagaatggtcatggaggggctgaacctggcggcagcgcaaaagatg

SEQ ID NO: 172220 - DNA, 103 bp, Artificial Sequence
  Synthetic Polynucleotide
taatacgactcactatagggctcggcccgtcttcaccacattcagcccctaacagaggagaaggggcatgatgtggtgaaacctggcggcagcgcaaaagatg

SEQ ID NO: 172221 - DNA, 103 bp, Artificial Sequence
  Synthetic Polynucleotide
taatacgactcactatagggccgagcatgactcggcccgtcttcaccacaaacagaggagatgtggtatggacgggccgaacctggcggcagcgcaaaagatg

SEQ ID NO: 172222 - DNA, 103 bp, Artificial Sequence
  Synthetic Polynucleotide
taatacgactcactataggggttggtctccccgagcatgactcggcccgtaacagaggagaacgggcatggtcatgctcaacctggcggcagcgcaaaagatg

SEQ ID NO: 172223 - DNA, 103 bp, Artificial Sequence
  Synthetic Polynucleotide
taatacgactcactatagggagtctgcagggttggtctccccgagcatgaaacagaggagatcatgcatggggagaccaaacctggcggcagcgcaaaagatg

SEQ ID NO: 172224 - DNA, 103 bp, Artificial Sequence
  Synthetic Polynucleotide
taatacgactcactatagggccaggcttggagtctgcagggttggtctccaacagaggagaggagacatgccctgcagaaacctggcggcagcgcaaaagatg

SEQ ID NO: 172225 - DNA, 103 bp, Artificial Sequence
  Synthetic Polynucleotide
taatacgactcactatagggacggatggtcccaggcttggagtctgcaggaacagaggagacctgcaatgtccaagcctaacctggcggcagcgcaaaagatg

SEQ ID NO: 172226 - DNA, 103 bp, Artificial Sequence
  Synthetic Polynucleotide
taatacgactcactatagggagaagtctccacggatggtcccaggcttggaacagaggagaccaagcatgggaccatccaacctggcggcagcgcaaaagatg

SEQ ID NO: 172227 - DNA, 103 bp, Artificial Sequence
  Synthetic Polynucleotide
taatacgactcactatagggacttgtatgcagaagtctccacggatggtcaacagaggagagaccatatgtggagacttaacctggcggcagcgcaaaagatg

SEQ ID NO: 172228 - DNA, 103 bp, Artificial Sequence
  Synthetic Polynucleotide
taatacgactcactataggggcttgagataggaggcccctcgccttgaaaaacagaggagatttcaaatggaggggcctaacctggcggcagcgcaaaagatg

SEQ ID NO: 172229 - DNA, 103 bp, Artificial Sequence
  Synthetic Polynucleotide
taatacgactcactataggggttcctgccaacttgtatgcagaagtctccaacagaggagaggagacatgtgcatacaaaacctggcggcagcgcaaaagatg

SEQ ID NO: 172230 - DNA, 103 bp, Artificial Sequence
  Synthetic Polynucleotide
taatacgactcactatagggcatgtataatgttcctgccaacttgtatgcaacagaggagagcatacatgttggcaggaaacctggcggcagcgcaaaagatg

SEQ ID NO: 172231 - DNA, 103 bp, Artificial Sequence
  Synthetic Polynucleotide
taatacgactcactataggggaatcactgccatgtataatgttcctgccaaacagaggagatggcagatgcattatacaaacctggcggcagcgcaaaagatg

SEQ ID NO: 172232 - DNA, 103 bp, Artificial Sequence
  Synthetic Polynucleotide
taatacgactcactatagggactctccacagaatcactgccatgtataataacagaggagaattataatgggcagtgataacctggcggcagcgcaaaagatg

SEQ ID NO: 172233 - DNA, 103 bp, Artificial Sequence
  Synthetic Polynucleotide
taatacgactcactatagggccttctctgcactctccacagaatcactgcaacagaggagagcagtgatgctgtggagaaacctggcggcagcgcaaaagatg

SEQ ID NO: 172234 - DNA, 103 bp, Artificial Sequence
  Synthetic Polynucleotide
taatacgactcactatagggaagccgatctccttctctgcactctccacaaacagaggagatgtggaatgtgcagagaaaacctggcggcagcgcaaaagatg

SEQ ID NO: 172235 - DNA, 103 bp, Artificial Sequence
  Synthetic Polynucleotide
taatacgactcactataggggtgaaaccacaagccgatctccttctctgcaacagaggagagcagagatggagatcggcaacctggcggcagcgcaaaagatg

SEQ ID NO: 172236 - DNA, 103 bp, Artificial Sequence
  Synthetic Polynucleotide
taatacgactcactataggggttcctcagggtgaaaccacaagccgatctaacagaggagaagatcgatgtgtggtttcaacctggcggcagcgcaaaagatg

SEQ ID NO: 172237 - DNA, 103 bp, Artificial Sequence
  Synthetic Polynucleotide
taatacgactcactatagggtaatctaccagttcctcagggtgaaaccacaacagaggagagtggttatgccctgaggaaacctggcggcagcgcaaaagatg

SEQ ID NO: 172238 - DNA, 103 bp, Artificial Sequence
  Synthetic Polynucleotide
taatacgactcactatagggacagctcgtgtaatctaccagttcctcaggaacagaggagacctgagatgctggtagataacctggcggcagcgcaaaagatg

SEQ ID NO: 172239 - DNA, 103 bp, Artificial Sequence
  Synthetic Polynucleotide
taatacgactcactatagggctgtatcacagcttgagataggaggcccctaacagaggagaaggggcatgctatctcaaaacctggcggcagcgcaaaagatg

SEQ ID NO: 172240 - DNA, 103 bp, Artificial Sequence
  Synthetic Polynucleotide
taatacgactcactatagggagttctgagcacagctcgtgtaatctaccaaacagaggagatggtagatgacacgagctaacctggcggcagcgcaaaagatg

SEQ ID NO: 172241 - DNA, 103 bp, Artificial Sequence
  Synthetic Polynucleotide
taatacgactcactatagggtcatagatccagttctgagcacagctcgtgaacagaggagacacgagatgtgctcagaaaacctggcggcagcgcaaaagatg

SEQ ID NO: 172242 - DNA, 103 bp, Artificial Sequence
  Synthetic Polynucleotide
taatacgactcactataggggccatggttcctgtatcacagcttgagataaacagaggagatatctcatgctgtgatacaacctggcggcagcgcaaaagatg

SEQ ID NO: 172243 - DNA, 103 bp, Artificial Sequence
  Synthetic Polynucleotide
taatacgactcactatagggctcacagttggccatggttcctgtatcacaaacagaggagatgtgatatgggaaccatgaacctggcggcagcgcaaaagatg

SEQ ID NO: 172244 - DNA, 103 bp, Artificial Sequence
  Synthetic Polynucleotide
taatacgactcactatagggtgaaggtacgctcacagttggccatggttcaacagaggagagaaccaatgccaactgtgaacctggcggcagcgcaaaagatg

SEQ ID NO: 172245 - DNA, 103 bp, Artificial Sequence
  Synthetic Polynucleotide
taatacgactcactatagggttgatcgcaatgaaggtacgctcacagttgaacagaggagacaactgatggcgtaccttaacctggcggcagcgcaaaagatg

SEQ ID NO: 172246 - DNA, 103 bp, Artificial Sequence
  Synthetic Polynucleotide
taatacgactcactatagggctccaagttaaaagttttattactctgcataacagaggagaatgcagatgaataaaactaacctggcggcagcgcaaaagatg

SEQ ID NO: 172247 - DNA, 103 bp, Artificial Sequence
  Synthetic Polynucleotide
taatacgactcactatagggtggcggtggtggcggctgctgctgttgctgaacagaggagacagcaaatgcagcagccgaacctggcggcagcgcaaaagatg

SEQ ID NO: 172248 - DNA, 103 bp, Artificial Sequence
  Synthetic Polynucleotide
taatacgactcactatagggcagttgctttcgtttttgcacctcttggttaacagaggagaaaccaaatggtgcaaaaaaacctggcggcagcgcaaaagatg

SEQ ID NO: 172249 - DNA, 103 bp, Artificial Sequence
  Synthetic Polynucleotide
taatacgactcactataggggcctgagctccagttgctttcgtttttgcaaacagaggagatgcaaaatggaaagcaacaacctggcggcagcgcaaaagatg

SEQ ID NO: 172250 - DNA, 103 bp, Artificial Sequence
  Synthetic Polynucleotide
taatacgactcactatagggtcttcctcctgcctgagctccagttgctttaacagaggagaaaagcaatgggagctcagaacctggcggcagcgcaaaagatg

SEQ ID NO: 172251 - DNA, 103 bp, Artificial Sequence
  Synthetic Polynucleotide
taatacgactcactataggggcgcctgcgctcttcctcctgcctgagctcaacagaggagagagctcatgcaggaggaaaacctggcggcagcgcaaaagatg

SEQ ID NO: 172252 - DNA, 103 bp, Artificial Sequence
  Synthetic Polynucleotide
taatacgactcactatagggcttcttcacggcgcctgcgctcttcctcctaacagaggagaaggaggatgagcgcaggcaacctggcggcagcgcaaaagatg

SEQ ID NO: 172253 - DNA, 103 bp, Artificial Sequence
  Synthetic Polynucleotide
taatacgactcactatagggcgccgcatctcttcttcacggcgcctgcgcaacagaggagagcgcagatgccgtgaagaaacctggcggcagcgcaaaagatg

SEQ ID NO: 172254 - DNA, 103 bp, Artificial Sequence
  Synthetic Polynucleotide
taatacgactcactatagggttcttgctgccgccgcatctcttcttcacgaacagaggagacgtgaaatggagatgcggaacctggcggcagcgcaaaagatg

SEQ ID NO: 172255 - DNA, 103 bp, Artificial Sequence
  Synthetic Polynucleotide
taatacgactcactataggggcatcatttcttcttgctgccgccgcatctaacagaggagaagatgcatgggcagcaagaacctggcggcagcgcaaaagatg

SEQ ID NO: 172256 - DNA, 103 bp, Artificial Sequence
  Synthetic Polynucleotide
taatacgactcactatagggtgctgtcgccgcatcatttcttcttgctgcaacagaggagagcagcaatgagaaatgataacctggcggcagcgcaaaagatg

SEQ ID NO: 172257 - DNA, 103 bp, Artificial Sequence
  Synthetic Polynucleotide
taatacgactcactataggggaatccttcctgctgtcgccgcatcatttcaacagaggagagaaatgatgcggcgacagaacctggcggcagcgcaaaagatg

SEQ ID NO: 172258 - DNA, 103 bp, Artificial Sequence
  Synthetic Polynucleotide
taatacgactcactatagggttgcaggtattggcggtggtggcggctgctaacagaggagaagcagcatgcaccaccgcaacctggcggcagcgcaaaagatg

SEQ ID NO: 172259 - DNA, 103 bp, Artificial Sequence
  Synthetic Polynucleotide
taatacgactcactatagggaggttcccttgaatccttcctgctgtcgccaacagaggagaggcgacatgaggaaggataacctggcggcagcgcaaaagatg

SEQ ID NO: 172260 - DNA, 103 bp, Artificial Sequence
  Synthetic Polynucleotide
taatacgactcactataggggcatcagggaaggttcccttgaatccttccaacagaggagaggaaggatgcaagggaacaacctggcggcagcgcaaaagatg

SEQ ID NO: 172261 - DNA, 103 bp, Artificial Sequence
  Synthetic Polynucleotide
taatacgactcactatagggctgctctctcgcatcagggaaggttcccttaacagaggagaaagggaatgttccctgataacctggcggcagcgcaaaagatg

SEQ ID NO: 172262 - DNA, 103 bp, Artificial Sequence
  Synthetic Polynucleotide
taatacgactcactatagggtccgaatctcctgctctctcgcatcagggaaacagaggagatccctgatgcgagagagcaacctggcggcagcgcaaaagatg

SEQ ID NO: 172263 - DNA, 103 bp, Artificial Sequence
  Synthetic Polynucleotide
taatacgactcactatagggatctgacccatccgaatctcctgctctctcaacagaggagagagagaatgggagattcgaacctggcggcagcgcaaaagatg

SEQ ID NO: 172264 - DNA, 103 bp, Artificial Sequence
  Synthetic Polynucleotide
taatacgactcactatagggtcccatagccatctgacccatccgaatctcaacagaggagagagattatgatgggtcagaacctggcggcagcgcaaaagatg

SEQ ID NO: 172265 - DNA, 103 bp, Artificial Sequence
  Synthetic Polynucleotide
taatacgactcactatagggccatagcacctcccatagccatctgacccaaacagaggagatgggtcatgtggctatggaacctggcggcagcgcaaaagatg

SEQ ID NO: 172266 - DNA, 103 bp, Artificial Sequence
  Synthetic Polynucleotide
taatacgactcactatagggttgtttatgcccatagcacctcccatagccaacagaggagaggctatatgaggtgctataacctggcggcagcgcaaaagatg

SEQ ID NO: 172267 - DNA, 103 bp, Artificial Sequence
  Synthetic Polynucleotide
taatacgactcactatagggggcacctctgttgtttatgcccatagcaccaacagaggagaggtgctatgggcataaacaacctggcggcagcgcaaaagatg

SEQ ID NO: 172268 - DNA, 103 bp, Artificial Sequence
  Synthetic Polynucleotide
taatacgactcactatagggcagggggcatggcacctctgttgtttatgcaacagaggagagcataaatgacagaggtgaacctggcggcagcgcaaaagatg

SEQ ID NO: 172269 - DNA, 103 bp, Artificial Sequence
  Synthetic Polynucleotide
taatacgactcactatagggtgttgcccatttgcaggtattggcggtggtaacagaggagaaccaccatgaatacctgcaacctggcggcagcgcaaaagatg

SEQ ID NO: 172270 - DNA, 103 bp, Artificial Sequence
  Synthetic Polynucleotide
taatacgactcactatagggggcacaggagcagggggcatggcacctctgaacagaggagacagaggatgcatgcccccaacctggcggcagcgcaaaagatg

SEQ ID NO: 172271 - DNA, 103 bp, Artificial Sequence
  Synthetic Polynucleotide
taatacgactcactatagggggtaccagctggcacaggagcagggggcataacagaggagaatgcccatggctcctgtgaacctggcggcagcgcaaaagatg

SEQ ID NO: 172272 - DNA, 103 bp, Artificial Sequence
  Synthetic Polynucleotide
taatacgactcactataggggaggagctggggtaccagctggcacaggagaacagaggagactcctgatgcagctggtaaacctggcggcagcgcaaaagatg

SEQ ID NO: 172273 - DNA, 103 bp, Artificial Sequence
  Synthetic Polynucleotide
taatacgactcactataggggcaggtcctggaggagctggggtaccagctaacagaggagaagctggatgcccagctccaacctggcggcagcgcaaaagatg

SEQ ID NO: 172274 - DNA, 103 bp, Artificial Sequence
  Synthetic Polynucleotide
taatacgactcactatagggcatcatagtggcaggtcctggaggagctggaacagaggagaccagctatgccaggacctaacctggcggcagcgcaaaagatg

SEQ ID NO: 172275 - DNA, 103 bp, Artificial Sequence
  Synthetic Polynucleotide
taatacgactcactatagggttccatccggcatcatagtggcaggtcctgaacagaggagacaggacatgccactatgaaacctggcggcagcgcaaaagatg

SEQ ID NO: 172276 - DNA, 103 bp, Artificial Sequence
  Synthetic Polynucleotide
taatacgactcactatagggaatcccaaagttccatccggcatcatagtgaacagaggagacactatatggccggatggaacctggcggcagcgcaaaagatg

SEQ ID NO: 172277 - DNA, 103 bp, Artificial Sequence
  Synthetic Polynucleotide
taatacgactcactatagggtggtggggtcaatcccaaagttccatccggaacagaggagaccggatatgactttgggaaacctggcggcagcgcaaaagatg

SEQ ID NO: 172278 - DNA, 103 bp, Artificial Sequence
  Synthetic Polynucleotide
taatacgactcactataggggttcagttgttggtggggtcaatcccaaagaacagaggagactttggatgtgaccccacaacctggcggcagcgcaaaagatg

SEQ ID NO: 172279 - DNA, 103 bp, Artificial Sequence
  Synthetic Polynucleotide
taatacgactcactatagggtgaccaaagcgttcagttgttggtggggtcaacagaggagagaccccatgaacaactgaaacctggcggcagcgcaaaagatg

SEQ ID NO: 172280 - DNA, 103 bp, Artificial Sequence
  Synthetic Polynucleotide
taatacgactcactataggggctgctggcctgttgcccatttgcaggtataacagaggagaatacctatgaatgggcaaaacctggcggcagcgcaaaagatg

SEQ ID NO: 172281 - DNA, 103 bp, Artificial Sequence
  Synthetic Polynucleotide
taatacgactcactatagggtgtagcagcctgaccaaagcgttcagttgtaacagaggagaacaactatgcgctttggtaacctggcggcagcgcaaaagatg

SEQ ID NO: 172282 - DNA, 103 bp, Artificial Sequence
  Synthetic Polynucleotide
taatacgactcactatagggttccttccattgtagcagcctgaccaaagcaacagaggagagctttgatgaggctgctaaacctggcggcagcgcaaaagatg

SEQ ID NO: 172283 - DNA, 103 bp, Artificial Sequence
  Synthetic Polynucleotide
taatacgactcactatagggattgccccaattccttccattgtagcagccaacagaggagaggctgcatgaatggaaggaacctggcggcagcgcaaaagatg

SEQ ID NO: 172284 - DNA, 103 bp, Artificial Sequence
  Synthetic Polynucleotide
taatacgactcactatagggagttccaccaattgccccaattccttccataacagaggagaatggaaatgattggggcaaacctggcggcagcgcaaaagatg

SEQ ID NO: 172285 - DNA, 103 bp, Artificial Sequence
  Synthetic Polynucleotide
taatacgactcactatagggatgcaggaggagttccaccaattgccccaaaacagaggagattggggatgttggtggaaaacctggcggcagcgcaaaagatg

SEQ ID NO: 172286 - DNA, 103 bp, Artificial Sequence
  Synthetic Polynucleotide
taatacgactcactataggggcacggttgaatgcaggaggagttccaccaaacagaggagatggtggatgtcctcctgcaacctggcggcagcgcaaaagatg

SEQ ID NO: 172287 - DNA, 103 bp, Artificial Sequence
  Synthetic Polynucleotide
taatacgactcactatagggtccaggagctgcacggttgaatgcaggaggaacagaggagacctcctatgttcaaccgtaacctggcggcagcgcaaaagatg

SEQ ID NO: 172288 - DNA, 103 bp, Artificial Sequence
  Synthetic Polynucleotide
taatacgactcactatagggcaaattcagctccaggagctgcacggttgaaacagaggagatcaaccatgcagctcctgaacctggcggcagcgcaaaagatg

SEQ ID NO: 172289 - DNA, 103 bp, Artificial Sequence
  Synthetic Polynucleotide
taatacgactcactatagggttgtttggggcaaattcagctccaggagctaacagaggagaagctccatgagctgaattaacctggcggcagcgcaaaagatg

SEQ ID NO: 172290 - DNA, 103 bp, Artificial Sequence
  Synthetic Polynucleotide
taatacgactcactatagggtcggcgacgtttgtttggggcaaattcagcaacagaggagagctgaaatggccccaaacaacctggcggcagcgcaaaagatg

SEQ ID NO: 172291 - DNA, 103 bp, Artificial Sequence
  Synthetic Polynucleotide
taatacgactcactatagggcttcattttggctgctggcctgttgcccataacagaggagaatgggcatgaggccagcaaacctggcggcagcgcaaaagatg

SEQ ID NO: 172292 - DNA, 103 bp, Artificial Sequence
  Synthetic Polynucleotide
taatacgactcactatagggatagtcaagccttcattttggctgctggccaacagaggagaggccagatgccaaaatgaaacctggcggcagcgcaaaagatg

SEQ ID NO: 172293 - DNA, 103 bp, Artificial Sequence
  Synthetic Polynucleotide
taatacgactcactatagggcttcaggtcaatagtcaagccttcattttgaacagaggagacaaaatatgggcttgactaacctggcggcagcgcaaaagatg

SEQ ID NO: 172294 - DNA, 103 bp, Artificial Sequence
  Synthetic Polynucleotide
taatacgactcactatagggttctaaaattcttcaggtcaatagtcaagcaacagaggagagcttgaatgttgacctgaaacctggcggcagcgcaaaagatg

SEQ ID NO: 172295 - DNA, 103 bp, Artificial Sequence
  Synthetic Polynucleotide
taatacgactcactatagggtctcctggttttctaaaattcttcaggtcaaacagaggagatgacctatggaattttagaacctggcggcagcgcaaaagatg

SEQ ID NO: 172296 - DNA, 103 bp, Artificial Sequence
  Synthetic Polynucleotide
taatacgactcactataggggaaggtcttctctcctggttttctaaaattaacagaggagaaattttatgaaaccaggaaacctggcggcagcgcaaaagatg

SEQ ID NO: 172297 - DNA, 103 bp, Artificial Sequence
  Synthetic Polynucleotide
taatacgactcactatagggggttttgcttctccaagttaaaagttttataacagaggagaataaaaatgttaacttggaacctggcggcagcgcaaaagatg

SEQ ID NO: 172298 - DNA, 103 bp, Artificial Sequence
  Synthetic Polynucleotide
taatacgactcactatagggttcgttgggtgaaggtcttctctcctggttaacagaggagaaaccagatgagaagacctaacctggcggcagcgcaaaagatg

SEQ ID NO: 172299 - DNA, 103 bp, Artificial Sequence
  Synthetic Polynucleotide
taatacgactcactatagggaaaagacggcttcgttgggtgaaggtcttcaacagaggagagaagacatgcacccaacgaacctggcggcagcgcaaaagatg

SEQ ID NO: 172300 - DNA, 103 bp, Artificial Sequence
  Synthetic Polynucleotide
taatacgactcactatagggatttcccacaaaaagacggcttcgttgggtaacagaggagaacccaaatgagccgtcttaacctggcggcagcgcaaaagatg

SEQ ID NO: 172301 - DNA, 103 bp, Artificial Sequence
  Synthetic Polynucleotide
taatacgactcactatagggcgggaggaagatttcccacaaaaagacggcaacagaggagagccgtcatgttgtgggaaaacctggcggcagcgcaaaagatg

SEQ ID NO: 172302 - DNA, 103 bp, Artificial Sequence
  Synthetic Polynucleotide
taatacgactcactatagggtcagtgatgtcgggaggaagatttcccacaaacagaggagatgtgggatgtcttcctccaacctggcggcagcgcaaaagatg

SEQ ID NO: 172303 - DNA, 103 bp, Artificial Sequence
  Synthetic Polynucleotide
taatacgactcactatagggcatttcttcctcagtgatgtcgggaggaagaacagaggagacttcctatggacatcactaacctggcggcagcgcaaaagatg

SEQ ID NO: 172304 - DNA, 103 bp, Artificial Sequence
  Synthetic Polynucleotide
taatacgactcactatagggatagtttcctcatttcttcctcagtgatgtaacagaggagaacatcaatgaggaagaaaaacctggcggcagcgcaaaagatg

SEQ ID NO: 172305 - DNA, 103 bp, Artificial Sequence
  Synthetic Polynucleotide
taatacgactcactatagggtatttctcaaatagtttcctcatttcttccaacagaggagaggaagaatggaggaaactaacctggcggcagcgcaaaagatg

SEQ ID NO: 172306 - DNA, 103 bp, Artificial Sequence
  Synthetic Polynucleotide
taatacgactcactatagggtgcctttccatatttctcaaatagtttcctaacagaggagaaggaaaatgtttgagaaaaacctggcggcagcgcaaaagatg

SEQ ID NO: 172307 - DNA, 103 bp, Artificial Sequence
  Synthetic Polynucleotide
taatacgactcactatagggagacttcgcctgcctttccatatttctcaaaacagaggagattgagaatgatggaaaggaacctggcggcagcgcaaaagatg

SEQ ID NO: 172308 - DNA, 103 bp, Artificial Sequence
  Synthetic Polynucleotide
taatacgactcactatagggcttggagtatggttttgcttctccaagttaaacagaggagataacttatggaagcaaaaaacctggcggcagcgcaaaagatg

SEQ ID NO: 172309 - DNA, 103 bp, Artificial Sequence
  Synthetic Polynucleotide
taatacgactcactatagggttatgaatgaagacttcgcctgcctttccaaacagaggagatggaaaatgaggcgaagtaacctggcggcagcgcaaaagatg

SEQ ID NO: 172310 - DNA, 103 bp, Artificial Sequence
  Synthetic Polynucleotide
taatacgactcactatagggtcctttatccttatgaatgaagacttcgccaacagaggagaggcgaaatgttcattcataacctggcggcagcgcaaaagatg

SEQ ID NO: 172311 - DNA, 103 bp, Artificial Sequence
  Synthetic Polynucleotide
taatacgactcactatagggtaaagccaaatcctttatccttatgaatgaaacagaggagatcattcatgaggataaagaacctggcggcagcgcaaaagatg

SEQ ID NO: 172312 - DNA, 103 bp, Artificial Sequence
  Synthetic Polynucleotide
taatacgactcactatagggtccaagcggataaagccaaatcctttatccaacagaggagaggataaatgatttggcttaacctggcggcagcgcaaaagatg

SEQ ID NO: 172313 - DNA, 103 bp, Artificial Sequence
  Synthetic Polynucleotide
taatacgactcactatagggggttcgggtttccaagcggataaagccaaaaacagaggagatttggcatgatccgcttgaacctggcggcagcgcaaaagatg

SEQ ID NO: 172314 - DNA, 103 bp, Artificial Sequence
  Synthetic Polynucleotide
taatacgactcactatagggtctccgctagggttcgggtttccaagcggaaacagaggagatccgctatgaaacccgaaaacctggcggcagcgcaaaagatg

SEQ ID NO: 172315 - DNA, 103 bp, Artificial Sequence
  Synthetic Polynucleotide
taatacgactcactatagggactttggcaatctccgctagggttcgggttaacagaggagaaacccgatgcctagcggaaacctggcggcagcgcaaaagatg

SEQ ID NO: 172316 - DNA, 103 bp, Artificial Sequence
  Synthetic Polynucleotide
taatacgactcactataggggtccagctccactttggcaatctccgctagaacagaggagactagcgatgattgccaaaaacctggcggcagcgcaaaagatg

SEQ ID NO: 172317 - DNA, 103 bp, Artificial Sequence
  Synthetic Polynucleotide
taatacgactcactataggggtggcatattgtccagctccactttggcaaaacagaggagattgccaatgtggagctggaacctggcggcagcgcaaaagatg

SEQ ID NO: 172318 - DNA, 103 bp, Artificial Sequence
  Synthetic Polynucleotide
taatacgactcactatagggtttccacggagtggcatattgtccagctccaacagaggagaggagctatgcaatatgccaacctggcggcagcgcaaaagatg

SEQ ID NO: 172319 - DNA, 103 bp, Artificial Sequence
  Synthetic Polynucleotide
taatacgactcactatagggatgatgctttcttggagtatggttttgcttaacagaggagaaagcaaatgcatactccaaacctggcggcagcgcaaaagatg

SEQ ID NO: 172320 - DNA, 103 bp, Artificial Sequence
  Synthetic Polynucleotide
taatacgactcactatagggacgcagctgctttccacggagtggcatattaacagaggagaaatatgatgctccgtggaaacctggcggcagcgcaaaagatg

SEQ ID NO: 172321 - DNA, 103 bp, Artificial Sequence
  Synthetic Polynucleotide
taatacgactcactatagggcaaagcgcacacgcagctgctttccacggaaacagaggagatccgtgatgagcagctgcaacctggcggcagcgcaaaagatg

SEQ ID NO: 172322 - DNA, 103 bp, Artificial Sequence
  Synthetic Polynucleotide
taatacgactcactatagggctatggcaggcaaagcgcacacgcagctgcaacagaggagagcagctatgtgtgcgcttaacctggcggcagcgcaaaagatg

SEQ ID NO: 172323 - DNA, 103 bp, Artificial Sequence
  Synthetic Polynucleotide
taatacgactcactatagggaagggatgcactatggcaggcaaagcgcacaacagaggagagtgcgcatggcctgccataacctggcggcagcgcaaaagatg

SEQ ID NO: 172324 - DNA, 103 bp, Artificial Sequence
  Synthetic Polynucleotide
taatacgactcactatagggttcgaactgtaagggatgcactatggcaggaacagaggagacctgccatggtgcatcccaacctggcggcagcgcaaaagatg

SEQ ID NO: 172325 - DNA, 103 bp, Artificial Sequence
  Synthetic Polynucleotide
taatacgactcactatagggtgaggaaggtttcgaactgtaagggatgcaaacagaggagatgcatcatgtacagttcgaacctggcggcagcgcaaaagatg

SEQ ID NO: 172326 - DNA, 103 bp, Artificial Sequence
  Synthetic Polynucleotide
taatacgactcactatagggggacacatactgaggaaggtttcgaactgtaacagaggagaacagttatgaaccttcctaacctggcggcagcgcaaaagatg

SEQ ID NO: 172327 - DNA, 103 bp, Artificial Sequence
  Synthetic Polynucleotide
taatacgactcactataggggcagttcgttggacacatactgaggaaggtaacagaggagaaccttcatgagtatgtgtaacctggcggcagcgcaaaagatg

SEQ ID NO: 172328 - DNA, 103 bp, Artificial Sequence
  Synthetic Polynucleotide
taatacgactcactataggggcttcttccagcagttcgttggacacatacaacagaggagagtatgtatgcaacgaactaacctggcggcagcgcaaaagatg

SEQ ID NO: 172329 - DNA, 103 bp, Artificial Sequence
  Synthetic Polynucleotide
taatacgactcactatagggcacagaaaaggcttcttccagcagttcgttaacagaggagaaacgaaatgctggaagaaaacctggcggcagcgcaaaagatg

SEQ ID NO: 172330 - DNA, 103 bp, Artificial Sequence
  Synthetic Polynucleotide
taatacgactcactatagggggtgatgttgatgatgctttcttggagtataacagaggagaatactcatggaaagcatcaacctggcggcagcgcaaaagatg

SEQ ID NO: 172331 - DNA, 103 bp, Artificial Sequence
  Synthetic Polynucleotide
taatacgactcactatagggcctggccaaacacagaaaaggcttcttccaaacagaggagatggaagatgccttttctgaacctggcggcagcgcaaaagatg

SEQ ID NO: 172332 - DNA, 103 bp, Artificial Sequence
  Synthetic Polynucleotide
taatacgactcactataggggccctctctacctggccaaacacagaaaagaacagaggagacttttcatggtttggccaaacctggcggcagcgcaaaagatg

SEQ ID NO: 172333 - DNA, 103 bp, Artificial Sequence
  Synthetic Polynucleotide
taatacgactcactatagggaatgactacagccctctctacctggccaaaaacagaggagatttggcatggtagagaggaacctggcggcagcgcaaaagatg

SEQ ID NO: 172334 - DNA, 103 bp, Artificial Sequence
  Synthetic Polynucleotide
taatacgactcactataggggatcatccacaatgactacagccctctctaaacagaggagatagagaatgctgtagtcaaacctggcggcagcgcaaaagatg

SEQ ID NO: 172335 - DNA, 103 bp, Artificial Sequence
  Synthetic Polynucleotide
taatacgactcactatagggggccttcctcgatcatccacaatgactacaaacagaggagatgtagtatgtgtggatgaaacctggcggcagcgcaaaagatg

SEQ ID NO: 172336 - DNA, 103 bp, Artificial Sequence
  Synthetic Polynucleotide
taatacgactcactatagggttttcctgagggccttcctcgatcatccacaacagaggagagtggatatgcgaggaaggaacctggcggcagcgcaaaagatg

SEQ ID NO: 172337 - DNA, 103 bp, Artificial Sequence
  Synthetic Polynucleotide
taatacgactcactatagggcaacaatgccttttcctgagggccttcctcaacagaggagagaggaaatgcctcaggaaaacctggcggcagcgcaaaagatg

SEQ ID NO: 172338 - DNA, 103 bp, Artificial Sequence
  Synthetic Polynucleotide
taatacgactcactatagggcctgagaactcaacaatgccttttcctgagaacagaggagactcaggatgaggcattgtaacctggcggcagcgcaaaagatg

SEQ ID NO: 172339 - DNA, 103 bp, Artificial Sequence
  Synthetic Polynucleotide
taatacgactcactatagggagctggcttccctgagaactcaacaatgccaacagaggagaggcattatggagttctcaaacctggcggcagcgcaaaagatg

SEQ ID NO: 172340 - DNA, 103 bp, Artificial Sequence
  Synthetic Polynucleotide
taatacgactcactatagggctttccgagcagctggcttccctgagaactaacagaggagaagttctatgggaagccagaacctggcggcagcgcaaaagatg

SEQ ID NO: 172341 - DNA, 103 bp, Artificial Sequence
  Synthetic Polynucleotide
taatacgactcactatagggtgctgctggtggtgatgttgatgatgctttaacagaggagaaaagcaatgtcaacatcaaacctggcggcagcgcaaaagatg

SEQ ID NO: 172342 - DNA, 103 bp, Artificial Sequence
  Synthetic Polynucleotide
taatacgactcactatagggctgtccagagctttccgagcagctggcttcaacagaggagagaagccatgtgctcggaaaacctggcggcagcgcaaaagatg

SEQ ID NO: 172343 - DNA, 103 bp, Artificial Sequence
  Synthetic Polynucleotide
taatacgactcactatagggttcactgcatctgtccagagctttccgagcaacagaggagagctcggatggctctggacaacctggcggcagcgcaaaagatg

SEQ ID NO: 172344 - DNA, 103 bp, Artificial Sequence
  Synthetic Polynucleotide
taatacgactcactatagggggaaggagccttcactgcatctgtccagagaacagaggagactctggatggatgcagtgaacctggcggcagcgcaaaagatg

SEQ ID NO: 172345 - DNA, 103 bp, Artificial Sequence
  Synthetic Polynucleotide
taatacgactcactataggggtggttagcaggaaggagccttcactgcataacagaggagaatgcagatgaggctccttaacctggcggcagcgcaaaagatg

SEQ ID NO: 172346 - DNA, 103 bp, Artificial Sequence
  Synthetic Polynucleotide
taatacgactcactatagggacgaggaaatgtggttagcaggaaggagccaacagaggagaggctccatgctgctaaccaacctggcggcagcgcaaaagatg

SEQ ID NO: 172347 - DNA, 103 bp, Artificial Sequence
  Synthetic Polynucleotide
taatacgactcactatagggcagtcacaggacgaggaaatgtggttagcaaacagaggagatgctaaatgcatttcctcaacctggcggcagcgcaaaagatg

SEQ ID NO: 172348 - DNA, 103 bp, Artificial Sequence
  Synthetic Polynucleotide
taatacgactcactatagggatgggctccacagtcacaggacgaggaaataacagaggagaatttccatgtcctgtgacaacctggcggcagcgcaaaagatg

SEQ ID NO: 172349 - DNA, 103 bp, Artificial Sequence
  Synthetic Polynucleotide
taatacgactcactatagggtaactggtccatgggctccacagtcacaggaacagaggagacctgtgatggtggagcccaacctggcggcagcgcaaaagatg

SEQ ID NO: 172350 - DNA, 103 bp, Artificial Sequence
  Synthetic Polynucleotide
taatacgactcactatagggcttcatcatctaactggtccatgggctccaaacagaggagatggagcatgtggaccagtaacctggcggcagcgcaaaagatg

SEQ ID NO: 172351 - DNA, 103 bp, Artificial Sequence
  Synthetic Polynucleotide
taatacgactcactatagggggaagtccctcttcatcatctaactggtccaacagaggagaggaccaatgagatgatgaaacctggcggcagcgcaaaagatg

SEQ ID NO: 172352 - DNA, 103 bp, Artificial Sequence
  Synthetic Polynucleotide
taatacgactcactatagggctggtggtgctgctgctggtggtgatgttgaacagaggagacaacatatgcaccagcagaacctggcggcagcgcaaaagatg

SEQ ID NO: 172353 - DNA, 103 bp, Artificial Sequence
  Synthetic Polynucleotide
taatacgactcactatagggcagcttctctggaagtccctcttcatcatcaacagaggagagatgatatggagggacttaacctggcggcagcgcaaaagatg

SEQ ID NO: 172354 - DNA, 103 bp, Artificial Sequence
  Synthetic Polynucleotide
taatacgactcactatagggtttttataaccagcttctctggaagtccctaacagaggagaagggacatgcagagaagcaacctggcggcagcgcaaaagatg

SEQ ID NO: 172355 - DNA, 103 bp, Artificial Sequence
  Synthetic Polynucleotide
taatacgactcactatagggaattgctggttttttataaccagcttctctaacagaggagaagagaaatgggttataaaaacctggcggcagcgcaaaagatg

SEQ ID NO: 172356 - DNA, 103 bp, Artificial Sequence
  Synthetic Polynucleotide
taatacgactcactatagggttccttgtgaaattgctggttttttataacaacagaggagagttataatgaaccagcaaaacctggcggcagcgcaaaagatg

SEQ ID NO: 172357 - DNA, 103 bp, Artificial Sequence
  Synthetic Polynucleotide
taatacgactcactataggggctgctctcgttccttgtgaaattgctggtaacagaggagaaccagcatgttcacaaggaacctggcggcagcgcaaaagatg

SEQ ID NO: 172358 - DNA, 103 bp, Artificial Sequence
  Synthetic Polynucleotide
taatacgactcactatagggaatctgggtggctgctctcgttccttgtgaaacagaggagatcacaaatgacgagagcaaacctggcggcagcgcaaaagatg

SEQ ID NO: 172359 - DNA, 103 bp, Artificial Sequence
  Synthetic Polynucleotide
taatacgactcactatagggaggctgtgcaaatctgggtggctgctctcgaacagaggagacgagagatgccacccagaaacctggcggcagcgcaaaagatg

SEQ ID NO: 172360 - DNA, 103 bp, Artificial Sequence
  Synthetic Polynucleotide
taatacgactcactatagggcaaaggagccaggctgtgcaaatctgggtgaacagaggagacacccaatgttgcacagcaacctggcggcagcgcaaaagatg

SEQ ID NO: 172361 - DNA, 103 bp, Artificial Sequence
  Synthetic Polynucleotide
taatacgactcactatagggtattcatactcaaaggagccaggctgtgcaaacagaggagatgcacaatgtggctccttaacctggcggcagcgcaaaagatg

SEQ ID NO: 172362 - DNA, 103 bp, Artificial Sequence
  Synthetic Polynucleotide
taatacgactcactataggggcgcatggcatattcatactcaaaggagccaacagaggagaggctccatggagtatgaaaacctggcggcagcgcaaaagatg

SEQ ID NO: 172363 - DNA, 103 bp, Artificial Sequence
  Synthetic Polynucleotide
taatacgactcactataggggctgttgctgctggtggtgctgctgctggtaacagaggagaaccagcatgagcaccaccaacctggcggcagcgcaaaagatg

SEQ ID NO: 172364 - DNA, 103 bp, Artificial Sequence
  Synthetic Polynucleotide
taatacgactcactataggggtgccttccagcgcatggcatattcatactaacagaggagaagtatgatgatgccatgcaacctggcggcagcgcaaaagatg

SEQ ID NO: 172365 - DNA, 103 bp, Artificial Sequence
  Synthetic Polynucleotide
taatacgactcactatagggatctcaatgagtgccttccagcgcatggcaaacagaggagatgccatatgctggaaggcaacctggcggcagcgcaaaagatg

SEQ ID NO: 172366 - DNA, 103 bp, Artificial Sequence
  Synthetic Polynucleotide
taatacgactcactatagggctgcttctccatctcaatgagtgccttccaaacagaggagatggaagatgctcattgagaacctggcggcagcgcaaaagatg

SEQ ID NO: 172367 - DNA, 103 bp, Artificial Sequence
  Synthetic Polynucleotide
taatacgactcactatagggggtcctgctgctgcttctccatctcaatgaaacagaggagatcattgatgtggagaagcaacctggcggcagcgcaaaagatg

SEQ ID NO: 172368 - DNA, 103 bp, Artificial Sequence
  Synthetic Polynucleotide
taatacgactcactatagggcggtccacttggtcctgctgctgcttctccaacagaggagaggagaaatggcagcaggaaacctggcggcagcgcaaaagatg

SEQ ID NO: 172369 - DNA, 103 bp, Artificial Sequence
  Synthetic Polynucleotide
taatacgactcactatagggcttgatgttgcggtccacttggtcctgctgaacagaggagacagcagatgcaagtggacaacctggcggcagcgcaaaagatg

SEQ ID NO: 172370 - DNA, 103 bp, Artificial Sequence
  Synthetic Polynucleotide
taatacgactcactatagggcacgagcctccttgatgttgcggtccacttaacagaggagaaagtggatggcaacatcaaacctggcggcagcgcaaaagatg

SEQ ID NO: 172371 - DNA, 103 bp, Artificial Sequence
  Synthetic Polynucleotide
taatacgactcactatagggtccagcttctcacgagcctccttgatgttgaacagaggagacaacatatgggaggctcgaacctggcggcagcgcaaaagatg

SEQ ID NO: 172372 - DNA, 103 bp, Artificial Sequence
  Synthetic Polynucleotide
taatacgactcactatagggcatctccatctccagcttctcacgagcctcaacagaggagagaggctatggagaagctgaacctggcggcagcgcaaaagatg

SEQ ID NO: 172373 - DNA, 103 bp, Artificial Sequence
  Synthetic Polynucleotide
taatacgactcactataggggtgcagcttccatctccatctccagcttctaacagaggagaagaagcatgagatggagaaacctggcggcagcgcaaaagatg

SEQ ID NO: 172374 - DNA, 103 bp, Artificial Sequence
  Synthetic Polynucleotide
taatacgactcactatagggggcggctgctgctgttgctgctggtggtgcaacagaggagagcaccaatggcagcaacaaacctggcggcagcgcaaaagatg

SEQ ID NO: 172375 - DNA, 103 bp, Artificial Sequence
  Synthetic Polynucleotide
taatacgactcactatagggtgctcatggcgtgcagcttccatctccatcaacagaggagagatggaatgggaagctgcaacctggcggcagcgcaaaagatg

SEQ ID NO: 172376 - DNA, 103 bp, Artificial Sequence
  Synthetic Polynucleotide
taatacgactcactatagggcatgacctggtgctcatggcgtgcagcttcaacagaggagagaagctatgcgccatgagaacctggcggcagcgcaaaagatg

SEQ ID NO: 172377 - DNA, 103 bp, Artificial Sequence
  Synthetic Polynucleotide
taatacgactcactataggggtctcattagcatgacctggtgctcatggcaacagaggagagccatgatgaccaggtcaaacctggcggcagcgcaaaagatg

SEQ ID NO: 172378 - DNA, 103 bp, Artificial Sequence
  Synthetic Polynucleotide
taatacgactcactatagggatcaaatcctgtctcattagcatgacctggaacagaggagaccaggtatggctaatgagaacctggcggcagcgcaaaagatg

SEQ ID NO: 172379 - DNA, 103 bp, Artificial Sequence
  Synthetic Polynucleotide
taatacgactcactatagggttggcgcctcatcaaatcctgtctcattagaacagaggagactaatgatgcaggatttgaacctggcggcagcgcaaaagatg

SEQ ID NO: 172380 - DNA, 103 bp, Artificial Sequence
  Synthetic Polynucleotide
taatacgactcactataggggaagttcttcttggcgcctcatcaaatcctaacagaggagaaggattatgtgaggcgccaacctggcggcagcgcaaaagatg

SEQ ID NO: 172381 - DNA, 103 bp, Artificial Sequence
  Synthetic Polynucleotide
taatacgactcactatagggtccatcctccgaagttcttcttggcgcctcaacagaggagagaggcgatgagaagaactaacctggcggcagcgcaaaagatg

SEQ ID NO: 172382 - DNA, 103 bp, Artificial Sequence
  Synthetic Polynucleotide
taatacgactcactataggggtgcagctcttccatcctccgaagttcttcaacagaggagagaagaaatgcggaggatgaacctggcggcagcgcaaaagatg

SEQ ID NO: 172383 - DNA, 103 bp, Artificial Sequence
  Synthetic Polynucleotide
taatacgactcactatagggcctcttggttgtgcagctcttccatcctccaacagaggagaggaggaatgaagagctgcaacctggcggcagcgcaaaagatg

SEQ ID NO: 172384 - DNA, 103 bp, Artificial Sequence
  Synthetic Polynucleotide
taatacgactcactatagggcgtttttgcacctcttggttgtgcagctctaacagaggagaagagctatgcaaccaagaaacctggcggcagcgcaaaagatg

SEQ ID NO: 172385 - DNA, 103 bp, Artificial Sequence
  Synthetic Polynucleotide
taatacgactcactataggggcagagcaggggcgccaggagcggcggcataacagaggagaatgccgatgctcctggcgaacctggcggcagcgcaaaagatg

SEQ ID NO: 172386 - DNA, 103 bp, Artificial Sequence
  Synthetic Polynucleotide
taatacgactcactatagggggccgcttcacacttcccgccattcaggcaaacagaggagatgcctgatgggcgggaagaacctggcggcagcgcaaaagatg

SEQ ID NO: 172387 - DNA, 103 bp, Artificial Sequence
  Synthetic Polynucleotide
taatacgactcactatagggggcacagtcatcaatgttctcgctgcagtcaacagaggagagactgcatggagaacattaacctggcggcagcgcaaaagatg

SEQ ID NO: 172388 - DNA, 103 bp, Artificial Sequence
  Synthetic Polynucleotide
taatacgactcactatagggaggcggcgctggcacagtcatcaatgttctaacagaggagaagaacaatgatgactgtgaacctggcggcagcgcaaaagatg

SEQ ID NO: 172389 - DNA, 103 bp, Artificial Sequence
  Synthetic Polynucleotide
taatacgactcactatagggccgtggaagcaggcggcgctggcacagtcaaacagaggagatgactgatgcagcgccgcaacctggcggcagcgcaaaagatg

SEQ ID NO: 172390 - DNA, 103 bp, Artificial Sequence
  Synthetic Polynucleotide
taatacgactcactataggggcaggtggcgccgtggaagcaggcggcgctaacagaggagaagcgccatgtgcttccacaacctggcggcagcgcaaaagatg

SEQ ID NO: 172391 - DNA, 103 bp, Artificial Sequence
  Synthetic Polynucleotide
taatacgactcactatagggcacggtcatggcaggtggcgccgtggaagcaacagaggagagcttccatggcgccacctaacctggcggcagcgcaaaagatg

SEQ ID NO: 172392 - DNA, 103 bp, Artificial Sequence
  Synthetic Polynucleotide
taatacgactcactatagggaaggaggccacacggtcatggcaggtggcgaacagaggagacgccacatgccatgaccgaacctggcggcagcgcaaaagatg

SEQ ID NO: 172393 - DNA, 103 bp, Artificial Sequence
  Synthetic Polynucleotide
taatacgactcactatagggctcgcagtagaaggaggccacacggtcatgaacagaggagacatgacatggtggcctccaacctggcggcagcgcaaaagatg

SEQ ID NO: 172394 - DNA, 103 bp, Artificial Sequence
  Synthetic Polynucleotide
taatacgactcactatagggcatggggacactcgcagtagaaggaggccaaacagaggagatggcctatgtctactgcgaacctggcggcagcgcaaaagatg

SEQ ID NO: 172395 - DNA, 103 bp, Artificial Sequence
  Synthetic Polynucleotide
taatacgactcactatagggcctgtgcggccatggggacactcgcagtagaacagaggagactactgatggtgtccccaaacctggcggcagcgcaaaagatg

SEQ ID NO: 172396 - DNA, 103 bp, Artificial Sequence
  Synthetic Polynucleotide
taatacgactcactataggggcacagcagacctgtgcggccatggggacaaacagaggagatgtcccatgggccgcacaaacctggcggcagcgcaaaagatg

SEQ ID NO: 172397 - DNA, 103 bp, Artificial Sequence
  Synthetic Polynucleotide
taatacgactcactatagggccgtgccattggccgcttcacacttcccgcaacagaggagagcgggaatggtgaagcggaacctggcggcagcgcaaaagatg

SEQ ID NO: 172398 - DNA, 103 bp, Artificial Sequence
  Synthetic Polynucleotide
taatacgactcactatagggcgttgaggtggcacagcagacctgtgcggcaacagaggagagccgcaatggtctgctgtaacctggcggcagcgcaaaagatg

SEQ ID NO: 172399 - DNA, 103 bp, Artificial Sequence
  Synthetic Polynucleotide
taatacgactcactatagggatgcatgcgtcgttgaggtggcacagcagaaacagaggagatctgctatgccacctcaaaacctggcggcagcgcaaaagatg

SEQ ID NO: 172400 - DNA, 103 bp, Artificial Sequence
  Synthetic Polynucleotide
taatacgactcactatagggggggttgctgatgcatgcgtcgttgaggtgaacagaggagacacctcatggacgcatgcaacctggcggcagcgcaaaagatg

SEQ ID NO: 172401 - DNA, 103 bp, Artificial Sequence
  Synthetic Polynucleotide
taatacgactcactatagggcctcgttacaggggttgctgatgcatgcgtaacagaggagaacgcatatgtcagcaaccaacctggcggcagcgcaaaagatg

SEQ ID NO: 172402 - DNA, 103 bp, Artificial Sequence
  Synthetic Polynucleotide
taatacgactcactatagggcagttggagccctcgttacaggggttgctgaacagaggagacagcaaatgctgtaacgaaacctggcggcagcgcaaaagatg

SEQ ID NO: 172403 - DNA, 103 bp, Artificial Sequence
  Synthetic Polynucleotide
taatacgactcactataggggttggtgtcgcagttggagccctcgttacaaacagaggagatgtaacatgggctccaacaacctggcggcagcgcaaaagatg

SEQ ID NO: 172404 - DNA, 103 bp, Artificial Sequence
  Synthetic Polynucleotide
taatacgactcactatagggcattgacagggttggtgtcgcagttggagcaacagaggagagctccaatggcgacaccaaacctggcggcagcgcaaaagatg

SEQ ID NO: 172405 - DNA, 103 bp, Artificial Sequence
  Synthetic Polynucleotide
taatacgactcactatagggatggccttgccattgacagggttggtgtcgaacagaggagacgacacatgccctgtcaaaacctggcggcagcgcaaaagatg

SEQ ID NO: 172406 - DNA, 103 bp, Artificial Sequence
  Synthetic Polynucleotide
taatacgactcactataggggcaggtgcagatggccttgccattgacaggaacagaggagacctgtcatgggcaaggccaacctggcggcagcgcaaaagatg

SEQ ID NO: 172407 - DNA, 103 bp, Artificial Sequence
  Synthetic Polynucleotide
taatacgactcactatagggaccccgaggggcaggtgcagatggccttgcaacagaggagagcaaggatgtctgcacctaacctggcggcagcgcaaaagatg

SEQ ID NO: 172408 - DNA, 103 bp, Artificial Sequence
  Synthetic Polynucleotide
taatacgactcactatagggacgcaggcctccgtgccattggccgcttcaaacagaggagatgaagcatgcaatggcacaacctggcggcagcgcaaaagatg

SEQ ID NO: 172409 - DNA, 103 bp, Artificial Sequence
  Synthetic Polynucleotide
taatacgactcactataggggggcccgtgtaccccgaggggcaggtgcagaacagaggagactgcacatgcccctcgggaacctggcggcagcgcaaaagatg

SEQ ID NO: 172410 - DNA, 103 bp, Artificial Sequence
  Synthetic Polynucleotide
taatacgactcactataggggctgcaggccgggcccgtgtaccccgagggaacagaggagaccctcgatgtacacgggcaacctggcggcagcgcaaaagatg

SEQ ID NO: 172411 - DNA, 103 bp, Artificial Sequence
  Synthetic Polynucleotide
taatacgactcactatagggccacgtcctggctgcaggccgggcccgtgtaacagaggagaacacggatgcggcctgcaaacctggcggcagcgcaaaagatg

SEQ ID NO: 172412 - DNA, 103 bp, Artificial Sequence
  Synthetic Polynucleotide
taatacgactcactataggggagcactcatccacgtcctggctgcaggccaacagaggagaggcctgatgccaggacgtaacctggcggcagcgcaaaagatg

SEQ ID NO: 172413 - DNA, 103 bp, Artificial Sequence
  Synthetic Polynucleotide
taatacgactcactatagggggcacccagcgagcactcatccacgtcctgaacagaggagacaggacatggatgagtgcaacctggcggcagcgcaaaagatg

SEQ ID NO: 172414 - DNA, 103 bp, Artificial Sequence
  Synthetic Polynucleotide
taatacgactcactatagggcgcaggggttggcacccagcgagcactcataacagaggagaatgagtatgcgctgggtgaacctggcggcagcgcaaaagatg

SEQ ID NO: 172415 - DNA, 103 bp, Artificial Sequence
  Synthetic Polynucleotide
taatacgactcactatagggcccgcatgctcgcaggggttggcacccagcaacagaggagagctgggatgcaacccctgaacctggcggcagcgcaaaagatg

SEQ ID NO: 172416 - DNA, 103 bp, Artificial Sequence
  Synthetic Polynucleotide
taatacgactcactataggggatgcacttgcccgcatgctcgcaggggttaacagaggagaaaccccatggagcatgcgaacctggcggcagcgcaaaagatg

SEQ ID NO: 172417 - DNA, 103 bp, Artificial Sequence
  Synthetic Polynucleotide
taatacgactcactatagggccagcgtgttgatgcacttgcccgcatgctaacagaggagaagcatgatggcaagtgcaaacctggcggcagcgcaaaagatg

SEQ ID NO: 172418 - DNA, 103 bp, Artificial Sequence
  Synthetic Polynucleotide
taatacgactcactatagggtcgaaggagcccagcgtgttgatgcacttgaacagaggagacaagtgatgcaacacgctaacctggcggcagcgcaaaagatg

SEQ ID NO: 172419 - DNA, 103 bp, Artificial Sequence
  Synthetic Polynucleotide
taatacgactcactatagggcccgccacagacgcaggcctccgtgccattaacagaggagaaatggcatggaggcctgcaacctggcggcagcgcaaaagatg

SEQ ID NO: 172420 - DNA, 103 bp, Artificial Sequence
  Synthetic Polynucleotide
taatacgactcactatagggacactggcactcgaaggagcccagcgtgttaacagaggagaaacacgatgggctccttcaacctggcggcagcgcaaaagatg

SEQ ID NO: 172421 - DNA, 103 bp, Artificial Sequence
  Synthetic Polynucleotide
taatacgactcactatagggagccctgcagacactggcactcgaaggagcaacagaggagagctcctatgagtgccagtaacctggcggcagcgcaaaagatg

SEQ ID NO: 172422 - DNA, 103 bp, Artificial Sequence
  Synthetic Polynucleotide
taatacgactcactataggggggcccgtgtagccctgcagacactggcacaacagaggagagtgccaatgtctgcagggaacctggcggcagcgcaaaagatg

SEQ ID NO: 172423 - DNA, 103 bp, Artificial Sequence
  Synthetic Polynucleotide
taatacgactcactatagggctcgcatcgggggcccgtgtagccctgcagaacagaggagactgcagatgtacacgggcaacctggcggcagcgcaaaagatg

SEQ ID NO: 172424 - DNA, 103 bp, Artificial Sequence
  Synthetic Polynucleotide
taatacgactcactatagggtgacgtcgatctcgcatcgggggcccgtgtaacagaggagaacacggatgcccgatgcgaacctggcggcagcgcaaaagatg

SEQ ID NO: 172425 - DNA, 103 bp, Artificial Sequence
  Synthetic Polynucleotide
taatacgactcactatagggacgcactcgttgacgtcgatctcgcatcggaacagaggagaccgatgatggatcgacgtaacctggcggcagcgcaaaagatg

SEQ ID NO: 172426 - DNA, 103 bp, Artificial Sequence
  Synthetic Polynucleotide
taatacgactcactatagggcgggttcgagacgcactcgttgacgtcgataacagaggagaatcgacatgaacgagtgcaacctggcggcagcgcaaaagatg

SEQ ID NO: 172427 - DNA, 103 bp, Artificial Sequence
  Synthetic Polynucleotide
taatacgactcactatagggcgttctggcacgggttcgagacgcactcgtaacagaggagaacgagtatgtctcgaaccaacctggcggcagcgcaaaagatg

SEQ ID NO: 172428 - DNA, 103 bp, Artificial Sequence
  Synthetic Polynucleotide
taatacgactcactatagggcaggtggcgtcgttctggcacgggttcgagaacagaggagactcgaaatggtgccagaaaacctggcggcagcgcaaaagatg

SEQ ID NO: 172429 - DNA, 103 bp, Artificial Sequence
  Synthetic Polynucleotide
taatacgactcactatagggctggtccaggcaggtggcgtcgttctggcaaacagaggagatgccagatggacgccaccaacctggcggcagcgcaaaagatg

SEQ ID NO: 172430 - DNA, 103 bp, Artificial Sequence
  Synthetic Polynucleotide
taatacgactcactatagggccacgaaggccccgccacagacgcaggcctaacagaggagaaggcctatgtctgtggcgaacctggcggcagcgcaaaagatg

SEQ ID NO: 172431 - DNA, 103 bp, Artificial Sequence
  Synthetic Polynucleotide
taatacgactcactatagggactccccaatctggtccaggcaggtggcgtaacagaggagaacgccaatggcctggaccaacctggcggcagcgcaaaagatg

SEQ ID NO: 172432 - DNA, 103 bp, Artificial Sequence
  Synthetic Polynucleotide
taatacgactcactatagggatgcactggaactccccaatctggtccaggaacagaggagacctggaatggattggggaaacctggcggcagcgcaaaagatg

SEQ ID NO: 172433 - DNA, 103 bp, Artificial Sequence
  Synthetic Polynucleotide
taatacgactcactataggggggcatgcagatgcactggaactccccaataacagaggagaattgggatgttccagtgcaacctggcggcagcgcaaaagatg

SEQ ID NO: 172434 - DNA, 103 bp, Artificial Sequence
  Synthetic Polynucleotide
taatacgactcactatagggcctcgtagccgggcatgcagatgcactggaaacagaggagatccagtatgtctgcatgcaacctggcggcagcgcaaaagatg

SEQ ID NO: 172435 - DNA, 103 bp, Artificial Sequence
  Synthetic Polynucleotide
taatacgactcactatagggcagtgcacaccctcgtagccgggcatgcagaacagaggagactgcatatgcggctacgaaacctggcggcagcgcaaaagatg

SEQ ID NO: 172436 - DNA, 103 bp, Artificial Sequence
  Synthetic Polynucleotide
taatacgactcactataggggttgacctcgcagtgcacaccctcgtagccaacagaggagaggctacatgggtgtgcacaacctggcggcagcgcaaaagatg

SEQ ID NO: 172437 - DNA, 103 bp, Artificial Sequence
  Synthetic Polynucleotide
taatacgactcactatagggactcgtctgtgttgacctcgcagtgcacacaacagaggagagtgtgcatggcgaggtcaaacctggcggcagcgcaaaagatg

SEQ ID NO: 172438 - DNA, 103 bp, Artificial Sequence
  Synthetic Polynucleotide
taatacgactcactatagggctgctggcacactcgtctgtgttgacctcgaacagaggagacgaggtatgcacagacgaaacctggcggcagcgcaaaagatg

SEQ ID NO: 172439 - DNA, 103 bp, Artificial Sequence
  Synthetic Polynucleotide
taatacgactcactatagggcaggcaggggctgctggcacactcgtctgtaacagaggagaacagacatgtgtgccagcaacctggcggcagcgcaaaagatg

SEQ ID NO: 172440 - DNA, 103 bp, Artificial Sequence
  Synthetic Polynucleotide
taatacgactcactatagggggccattgtgcaggcaggggctgctggcacaacagaggagagtgccaatggcccctgccaacctggcggcagcgcaaaagatg

SEQ ID NO: 172441 - DNA, 103 bp, Artificial Sequence
  Synthetic Polynucleotide
taatacgactcactatagggcatcgcgggcccacgaaggccccgccacagaacagaggagactgtggatgggccttcgtaacctggcggcagcgcaaaagatg

SEQ ID NO: 172442 - DNA, 103 bp, Artificial Sequence
  Synthetic Polynucleotide
taatacgactcactatagggtccaggcagcggccattgtgcaggcaggggaacagaggagacccctgatggcacaatggaacctggcggcagcgcaaaagatg

SEQ ID NO: 172443 - DNA, 103 bp, Artificial Sequence
  Synthetic Polynucleotide
taatacgactcactatagggattgatcttgtccaggcagcggccattgtgaacagaggagacacaatatgcgctgcctgaacctggcggcagcgcaaaagatg

SEQ ID NO: 172444 - DNA, 103 bp, Artificial Sequence
  Synthetic Polynucleotide
taatacgactcactatagggactggaactcattgatcttgtccaggcagcaacagaggagagctgccatgacaagatcaaacctggcggcagcgcaaaagatg

SEQ ID NO: 172445 - DNA, 103 bp, Artificial Sequence
  Synthetic Polynucleotide
taatacgactcactataggggggcactcgcactggaactcattgatcttgaacagaggagacaagatatgtgagttccaaacctggcggcagcgcaaaagatg

SEQ ID NO: 172446 - DNA, 103 bp, Artificial Sequence
  Synthetic Polynucleotide
taatacgactcactataggggaagcccgtggggcactcgcactggaactcaacagaggagagagttcatgtgcgagtgcaacctggcggcagcgcaaaagatg

SEQ ID NO: 172447 - DNA, 103 bp, Artificial Sequence
  Synthetic Polynucleotide
taatacgactcactataggggatgcccagtgaagcccgtggggcactcgcaacagaggagagcgagtatgccacgggctaacctggcggcagcgcaaaagatg

SEQ ID NO: 172448 - DNA, 103 bp, Artificial Sequence
  Synthetic Polynucleotide
taatacgactcactatagggtactggcacagatgcccagtgaagcccgtgaacagaggagacacgggatgcactgggcaaacctggcggcagcgcaaaagatg

SEQ ID NO: 172449 - DNA, 103 bp, Artificial Sequence
  Synthetic Polynucleotide
taatacgactcactataggggtccacatcgtactggcacagatgcccagtaacagaggagaactgggatgctgtgccagaacctggcggcagcgcaaaagatg

SEQ ID NO: 172450 - DNA, 103 bp, Artificial Sequence
  Synthetic Polynucleotide
taatacgactcactatagggtggcacactcgtccacatcgtactggcacaaacagaggagatgtgccatgacgatgtggaacctggcggcagcgcaaaagatg

SEQ ID NO: 172451 - DNA, 103 bp, Artificial Sequence
  Synthetic Polynucleotide
taatacgactcactatagggcagggggtgctggcacactcgtccacatcgaacagaggagacgatgtatgcgagtgtgcaacctggcggcagcgcaaaagatg

SEQ ID NO: 172452 - DNA, 103 bp, Artificial Sequence
  Synthetic Polynucleotide
taatacgactcactatagggggggtcctggcatcgcgggcccacgaaggcaacagaggagagccttcatgggcccgcgaaacctggcggcagcgcaaaagatg

SEQ ID NO: 172453 - DNA, 103 bp, Artificial Sequence
  Synthetic Polynucleotide
taatacgactcactatagggaccattcttgcagggggtgctggcacactcaacagaggagagagtgtatgagcacccccaacctggcggcagcgcaaaagatg

SEQ ID NO: 172454 - DNA, 103 bp, Artificial Sequence
  Synthetic Polynucleotide
taatacgactcactatagggggcacttggcaccattcttgcagggggtgcaacagaggagagcacccatggcaagaatgaacctggcggcagcgcaaaagatg

SEQ ID NO: 172455 - DNA, 103 bp, Artificial Sequence
  Synthetic Polynucleotide
taatacgactcactatagggggtccgtccaggcacttggcaccattcttgaacagaggagacaagaaatgtgccaagtgaacctggcggcagcgcaaaagatg

SEQ ID NO: 172456 - DNA, 103 bp, Artificial Sequence
  Synthetic Polynucleotide
taatacgactcactataggggtaagtgttgggtccgtccaggcacttggcaacagaggagagccaagatgctggacggaaacctggcggcagcgcaaaagatg

SEQ ID NO: 172457 - DNA, 103 bp, Artificial Sequence
  Synthetic Polynucleotide
taatacgactcactatagggacacacaggtgtaagtgttgggtccgtccaaacagaggagatggacgatgccaacacttaacctggcggcagcgcaaaagatg

SEQ ID NO: 172458 - DNA, 103 bp, Artificial Sequence
  Synthetic Polynucleotide
taatacgactcactatagggccttccgtgcacacacaggtgtaagtgttgaacagaggagacaacacatgcacctgtgtaacctggcggcagcgcaaaagatg

SEQ ID NO: 172459 - DNA, 103 bp, Artificial Sequence
  Synthetic Polynucleotide
taatacgactcactatagggccccgtgtacccttccgtgcacacacaggtaacagaggagaacctgtatgtgcacggaaaacctggcggcagcgcaaaagatg

SEQ ID NO: 172460 - DNA, 103 bp, Artificial Sequence
  Synthetic Polynucleotide
taatacgactcactatagggcgcagtgcgtccccgtgtacccttccgtgcaacagaggagagcacggatgggtacacggaacctggcggcagcgcaaaagatg

SEQ ID NO: 172461 - DNA, 103 bp, Artificial Sequence
  Synthetic Polynucleotide
taatacgactcactatagggatgtccacctcgcagtgcgtccccgtgtacaacagaggagagtacacatggacgcactgaacctggcggcagcgcaaaagatg

SEQ ID NO: 172462 - DNA, 103 bp, Artificial Sequence
  Synthetic Polynucleotide
taatacgactcactataggggcactcatcgatgtccacctcgcagtgcgtaacagaggagaacgcacatggaggtggacaacctggcggcagcgcaaaagatg

SEQ ID NO: 172463 - DNA, 103 bp, Artificial Sequence
  Synthetic Polynucleotide
taatacgactcactatagggggcacgggttggggtcctggcatcgcgggcaacagaggagagcccgcatggccaggaccaacctggcggcagcgcaaaagatg

SEQ ID NO: 172464 - DNA, 103 bp, Artificial Sequence
  Synthetic Polynucleotide
taatacgactcactatagggggtcggggtcgcactcatcgatgtccacctaacagaggagaaggtggatgtcgatgagtaacctggcggcagcgcaaaagatg

SEQ ID NO: 172465 - DNA, 103 bp, Artificial Sequence
  Synthetic Polynucleotide
taatacgactcactatagggtagtggcaggggtcggggtcgcactcatcgaacagaggagacgatgaatgcgaccccgaaacctggcggcagcgcaaaagatg

SEQ ID NO: 172466 - DNA, 103 bp, Artificial Sequence
  Synthetic Polynucleotide
taatacgactcactataggggcaggagccgtagtggcaggggtcggggtcaacagaggagagaccccatgccctgccacaacctggcggcagcgcaaaagatg

SEQ ID NO: 172467 - DNA, 103 bp, Artificial Sequence
  Synthetic Polynucleotide
taatacgactcactatagggcgccgtccttgcaggagccgtagtggcaggaacagaggagacctgccatgacggctcctaacctggcggcagcgcaaaagatg

SEQ ID NO: 172468 - DNA, 103 bp, Artificial Sequence
  Synthetic Polynucleotide
taatacgactcactatagggaaggtggcgacgccgtccttgcaggagccgaacagaggagacggctcatgcaaggacggaacctggcggcagcgcaaaagatg

SEQ ID NO: 172469 - DNA, 103 bp, Artificial Sequence
  Synthetic Polynucleotide
taatacgactcactataggggaggcaggtgaaggtggcgacgccgtccttaacagaggagaaaggacatggtcgccaccaacctggcggcagcgcaaaagatg

SEQ ID NO: 172470 - DNA, 103 bp, Artificial Sequence
  Synthetic Polynucleotide
taatacgactcactatagggctgggcggcagaggcaggtgaaggtggcgaaacagaggagatcgccaatgtcacctgccaacctggcggcagcgcaaaagatg

SEQ ID NO: 172471 - DNA, 103 bp, Artificial Sequence
  Synthetic Polynucleotide
taatacgactcactatagggcccgtgtagcctgggcggcagaggcaggtgaacagaggagacacctgatgctgccgcccaacctggcggcagcgcaaaagatg

SEQ ID NO: 172472 - DNA, 103 bp, Artificial Sequence
  Synthetic Polynucleotide
taatacgactcactataggggcagtggtggcccgtgtagcctgggcggcaaacagaggagatgccgcatgggctacacgaacctggcggcagcgcaaaagatg

SEQ ID NO: 172473 - DNA, 103 bp, Artificial Sequence
  Synthetic Polynucleotide
taatacgactcactatagggtgttggtctcgcagtggtggcccgtgtagcaacagaggagagctacaatggccaccactaacctggcggcagcgcaaaagatg

SEQ ID NO: 172474 - DNA, 103 bp, Artificial Sequence
  Synthetic Polynucleotide
taatacgactcactatagggggggtgctgaggcacgggttggggtcctggaacagaggagaccaggaatgcaacccgtgaacctggcggcagcgcaaaagatg

SEQ ID NO: 172475 - DNA, 103 bp, Artificial Sequence
  Synthetic Polynucleotide
taatacgactcactatagggcactcgttgatgttggtctcgcagtggtggaacagaggagaccaccaatgcgagaccaaaacctggcggcagcgcaaaagatg

SEQ ID NO: 172476 - DNA, 103 bp, Artificial Sequence
  Synthetic Polynucleotide
taatacgactcactatagggctggctggagcactcgttgatgttggtctcaacagaggagagagaccatgatcaacgagaacctggcggcagcgcaaaagatg

SEQ ID NO: 172477 - DNA, 103 bp, Artificial Sequence
  Synthetic Polynucleotide
taatacgactcactatagggggcggcagggctggctggagcactcgttgaaacagaggagatcaacgatggctccagccaacctggcggcagcgcaaaagatg

SEQ ID NO: 172478 - DNA, 103 bp, Artificial Sequence
  Synthetic Polynucleotide
taatacgactcactataggggtgcccccgtggcggcagggctggctggagaacagaggagactccagatggccctgccgaacctggcggcagcgcaaaagatg

SEQ ID NO: 172479 - DNA, 103 bp, Artificial Sequence
  Synthetic Polynucleotide
taatacgactcactataggggtcctggcaggtgcccccgtggcggcagggaacagaggagaccctgcatgcacgggggcaacctggcggcagcgcaaaagatg

SEQ ID NO: 172480 - DNA, 103 bp, Artificial Sequence
  Synthetic Polynucleotide
taatacgactcactatagggcgttgtcgcggtcctggcaggtgcccccgtaacagaggagaacggggatgcctgccaggaacctggcggcagcgcaaaagatg

SEQ ID NO: 172481 - DNA, 103 bp, Artificial Sequence
  Synthetic Polynucleotide
taatacgactcactatagggcagaggtaggcgttgtcgcggtcctggcagaacagaggagactgccaatgccgcgacaaaacctggcggcagcgcaaaagatg

SEQ ID NO: 172482 - DNA, 103 bp, Artificial Sequence
  Synthetic Polynucleotide
taatacgactcactatagggcaggcagaagcagaggtaggcgttgtcgcgaacagaggagacgcgacatggcctacctcaacctggcggcagcgcaaaagatg

SEQ ID NO: 172483 - DNA, 103 bp, Artificial Sequence
  Synthetic Polynucleotide
taatacgactcactatagggtggtccccttcaggcagaagcagaggtaggaacagaggagacctaccatggcttctgccaacctggcggcagcgcaaaagatg

SEQ ID NO: 172484 - DNA, 103 bp, Artificial Sequence
  Synthetic Polynucleotide
taatacgactcactatagggttgggtcctgtggtccccttcaggcagaagaacagaggagacttctgatggaaggggacaacctggcggcagcgcaaaagatg

SEQ ID NO: 172485 - DNA, 103 bp, Artificial Sequence
  Synthetic Polynucleotide
taatacgactcactataggggttcttgcagggggtgctgaggcacgggttaacagaggagaaacccgatgctcagcaccaacctggcggcagcgcaaaagatg

SEQ ID NO: 172486 - DNA, 103 bp, Artificial Sequence
  Synthetic Polynucleotide
taatacgactcactataggggatctcgcagttgggtcctgtggtccccttaacagaggagaaaggggatgacaggacccaacctggcggcagcgcaaaagatg

SEQ ID NO: 172487 - DNA, 103 bp, Artificial Sequence
  Synthetic Polynucleotide
taatacgactcactatagggcatccaggttgatctcgcagttgggtcctgaacagaggagacaggacatgactgcgagaaacctggcggcagcgcaaaagatg

SEQ ID NO: 172488 - DNA, 103 bp, Artificial Sequence
  Synthetic Polynucleotide
taatacgactcactatagggctggcacagtcatccaggttgatctcgcagaacagaggagactgcgaatgcaacctggaaacctggcggcagcgcaaaagatg

SEQ ID NO: 172489 - DNA, 103 bp, Artificial Sequence
  Synthetic Polynucleotide
taatacgactcactataggggcaggggctgctggcacagtcatccaggttaacagaggagaaacctgatggactgtgccaacctggcggcagcgcaaaagatg

SEQ ID NO: 172490 - DNA, 103 bp, Artificial Sequence
  Synthetic Polynucleotide
taatacgactcactatagggtgcccgagtcgcaggggctgctggcacagtaacagaggagaactgtgatggcagcccctaacctggcggcagcgcaaaagatg

SEQ ID NO: 172491 - DNA, 103 bp, Artificial Sequence
  Synthetic Polynucleotide
taatacgactcactatagggtccagacaggtgcccgagtcgcaggggctgaacagaggagacagcccatgcgactcgggaacctggcggcagcgcaaaagatg

SEQ ID NO: 172492 - DNA, 103 bp, Artificial Sequence
  Synthetic Polynucleotide
taatacgactcactatagggatcgatcttgtccagacaggtgcccgagtcaacagaggagagactcgatgacctgtctgaacctggcggcagcgcaaaagatg

SEQ ID NO: 172493 - DNA, 103 bp, Artificial Sequence
  Synthetic Polynucleotide
taatacgactcactatagggactcgtagccatcgatcttgtccagacaggaacagaggagacctgtcatgacaagatcgaacctggcggcagcgcaaaagatg

SEQ ID NO: 172494 - DNA, 103 bp, Artificial Sequence
  Synthetic Polynucleotide
taatacgactcactatagggtcacaggcacactcgtagccatcgatcttgaacagaggagacaagatatgtggctacgaaacctggcggcagcgcaaaagatg

SEQ ID NO: 172495 - DNA, 103 bp, Artificial Sequence
  Synthetic Polynucleotide
taatacgactcactataggggtagcccggctcacaggcacactcgtagccaacagaggagaggctacatgtgtgcctgtaacctggcggcagcgcaaaagatg

SEQ ID NO: 172496 - DNA, 103 bp, Artificial Sequence
  Synthetic Polynucleotide
taatacgactcactataggggcagcgccaggcagagcaggggcgccaggaaacagaggagatcctggatgccctgctctaacctggcggcagcgcaaaagatg

SEQ ID NO: 172497 - DNA, 103 bp, Artificial Sequence
  Synthetic Polynucleotide
taatacgactcactatagggatgtcccggcgttcttgcagggggtgctgaaacagaggagatcagcaatgcctgcaagaaacctggcggcagcgcaaaagatg

SEQ ID NO: 172498 - DNA, 103 bp, Artificial Sequence
  Synthetic Polynucleotide
taatacgactcactatagggtgctccctgtgtagcccggctcacaggcacaacagaggagagtgcctatgagccgggctaacctggcggcagcgcaaaagatg

SEQ ID NO: 172499 - DNA, 103 bp, Artificial Sequence
  Synthetic Polynucleotide
taatacgactcactatagggatgttacacatgctccctgtgtagcccggcaacagaggagagccgggatgcacagggagaacctggcggcagcgcaaaagatg

SEQ ID NO: 172500 - DNA, 103 bp, Artificial Sequence
  Synthetic Polynucleotide
taatacgactcactatagggatcgatgttgatgttacacatgctccctgtaacagaggagaacagggatgatgtgtaacaacctggcggcagcgcaaaagatg

SEQ ID NO: 172501 - DNA, 103 bp, Artificial Sequence
  Synthetic Polynucleotide
taatacgactcactatagggccgcacactcatcgatgttgatgttacacaaacagaggagatgtgtaatgtcaacatcgaacctggcggcagcgcaaaagatg

SEQ ID NO: 172502 - DNA, 103 bp, Artificial Sequence
  Synthetic Polynucleotide
taatacgactcactatagggcaggggttgcccgcacactcatcgatgttgaacagaggagacaacatatgtgagtgtgcaacctggcggcagcgcaaaagatg

SEQ ID NO: 172503 - DNA, 103 bp, Artificial Sequence
  Synthetic Polynucleotide
taatacgactcactatagggcccgttgtggcaggggttgcccgcacactcaacagaggagagagtgtatgggcaaccccaacctggcggcagcgcaaaagatg

SEQ ID NO: 172504 - DNA, 103 bp, Artificial Sequence
  Synthetic Polynucleotide
taatacgactcactatagggcgcaggtgcccccgttgtggcaggggttgcaacagaggagagcaaccatggccacaacgaacctggcggcagcgcaaaagatg

SEQ ID NO: 172505 - DNA, 103 bp, Artificial Sequence
  Synthetic Polynucleotide
taatacgactcactatagggatgccgtcctcgcaggtgcccccgttgtggaacagaggagaccacaaatggggcacctgaacctggcggcagcgcaaaagatg

SEQ ID NO: 172506 - DNA, 103 bp, Artificial Sequence
  Synthetic Polynucleotide
taatacgactcactataggggaagccattgatgccgtcctcgcaggtgccaacagaggagaggcaccatggaggacggcaacctggcggcagcgcaaaagatg

SEQ ID NO: 172507 - DNA, 103 bp, Artificial Sequence
  Synthetic Polynucleotide
taatacgactcactatagggagcggcaggtgaagccattgatgccgtcctaacagaggagaaggacgatgtcaatggctaacctggcggcagcgcaaaagatg

SEQ ID NO: 172508 - DNA, 103 bp, Artificial Sequence
  Synthetic Polynucleotide
taatacgactcactatagggaccacgtggcatgtcccggcgttcttgcagaacagaggagactgcaaatgcgccgggacaacctggcggcagcgcaaaagatg

SEQ ID NO: 172509 - DNA, 103 bp, Artificial Sequence
  Synthetic Polynucleotide
taatacgactcactatagggccctcggggcagcggcaggtgaagccattgaacagaggagacaatggatgcacctgccgaacctggcggcagcgcaaaagatg

SEQ ID NO: 172510 - DNA, 103 bp, Artificial Sequence
  Synthetic Polynucleotide
taatacgactcactataggggtcgtggtagccctcggggcagcggcaggtaacagaggagaacctgcatgtgccccgagaacctggcggcagcgcaaaagatg

SEQ ID NO: 172511 - DNA, 103 bp, Artificial Sequence
  Synthetic Polynucleotide
taatacgactcactatagggggcaggtggggtcgtggtagccctcggggcaacagaggagagccccgatggctaccacgaacctggcggcagcgcaaaagatg

SEQ ID NO: 172512 - DNA, 103 bp, Artificial Sequence
  Synthetic Polynucleotide
taatacgactcactatagggacctcagacaggcaggtggggtcgtggtagaacagaggagactaccaatgccccacctgaacctggcggcagcgcaaaagatg

SEQ ID NO: 172513 - DNA, 103 bp, Artificial Sequence
  Synthetic Polynucleotide
taatacgactcactataggggcactcattgacctcagacaggcaggtgggaacagaggagacccaccatgctgtctgagaacctggcggcagcgcaaaagatg

SEQ ID NO: 172514 - DNA, 103 bp, Artificial Sequence
  Synthetic Polynucleotide
taatacgactcactatagggggttgctgttgcactcattgacctcagacaaacagaggagatgtctgatgtcaatgagtaacctggcggcagcgcaaaagatg

SEQ ID NO: 172515 - DNA, 103 bp, Artificial Sequence
  Synthetic Polynucleotide
taatacgactcactatagggtggacgcaggggttgctgttgcactcattgaacagaggagacaatgaatgcaacagcaaaacctggcggcagcgcaaaagatg

SEQ ID NO: 172516 - DNA, 103 bp, Artificial Sequence
  Synthetic Polynucleotide
taatacgactcactataggggcaggccccgtggacgcaggggttgctgttaacagaggagaaacagcatgccctgcgtcaacctggcggcagcgcaaaagatg

SEQ ID NO: 172517 - DNA, 103 bp, Artificial Sequence
  Synthetic Polynucleotide
taatacgactcactatagggggctgtcccggcaggccccgtggacgcaggaacagaggagacctgcgatgacggggcctaacctggcggcagcgcaaaagatg

SEQ ID NO: 172518 - DNA, 103 bp, Artificial Sequence
  Synthetic Polynucleotide
taatacgactcactatagggtacccgttgaggctgtcccggcaggccccgaacagaggagacggggcatgccgggacagaacctggcggcagcgcaaaagatg

SEQ ID NO: 172519 - DNA, 103 bp, Artificial Sequence
  Synthetic Polynucleotide
taatacgactcactatagggtctgcggtccaccacgtggcatgtcccggcaacagaggagagccgggatgtgccacgtgaacctggcggcagcgcaaaagatg

SEQ ID NO: 172520 - DNA, 103 bp, Artificial Sequence
  Synthetic Polynucleotide
taatacgactcactataggggtcgcacttgtacccgttgaggctgtcccgaacagaggagacgggacatgctcaacgggaacctggcggcagcgcaaaagatg

SEQ ID NO: 172521 - DNA, 103 bp, Artificial Sequence
  Synthetic Polynucleotide
taatacgactcactatagggcagggtcacagtcgcacttgtacccgttgaaacagaggagatcaacgatgacaagtgcgaacctggcggcagcgcaaaagatg

SEQ ID NO: 172522 - DNA, 103 bp, Artificial Sequence
  Synthetic Polynucleotide
taatacgactcactatagggccactccacccagggtcacagtcgcacttgaacagaggagacaagtgatgctgtgacccaacctggcggcagcgcaaaagatg

SEQ ID NO: 172523 - DNA, 103 bp, Artificial Sequence
  Synthetic Polynucleotide
taatacgactcactatagggacagttggtcccactccacccagggtcacaaacagaggagatgtgacatggggtggagtaacctggcggcagcgcaaaagatg

SEQ ID NO: 172524 - DNA, 103 bp, Artificial Sequence
  Synthetic Polynucleotide
taatacgactcactatagggtgttgatgtcacagttggtcccactccaccaacagaggagaggtggaatgggaccaactaacctggcggcagcgcaaaagatg

SEQ ID NO: 172525 - DNA, 103 bp, Artificial Sequence
  Synthetic Polynucleotide
taatacgactcactatagggcactcattgttgttgatgtcacagttggtcaacagaggagagaccaaatgtgacatcaaaacctggcggcagcgcaaaagatg

SEQ ID NO: 172526 - DNA, 103 bp, Artificial Sequence
  Synthetic Polynucleotide
taatacgactcactataggggttggattcacactcattgttgttgatgtcaacagaggagagacatcatgaacaatgagaacctggcggcagcgcaaaagatg

SEQ ID NO: 172527 - DNA, 103 bp, Artificial Sequence
  Synthetic Polynucleotide
taatacgactcactatagggtgacacaagggttggattcacactcattgtaacagaggagaacaatgatggtgaatccaaacctggcggcagcgcaaaagatg

SEQ ID NO: 172528 - DNA, 103 bp, Artificial Sequence
  Synthetic Polynucleotide
taatacgactcactataggggtgccgccgttgacacaagggttggattcaaacagaggagatgaatcatgcccttgtgtaacctggcggcagcgcaaaagatg

SEQ ID NO: 172529 - DNA, 103 bp, Artificial Sequence
  Synthetic Polynucleotide
taatacgactcactataggggtctttgcaggtgccgccgttgacacaaggaacagaggagaccttgtatgaacggcggcaacctggcggcagcgcaaaagatg

SEQ ID NO: 172530 - DNA, 103 bp, Artificial Sequence
  Synthetic Polynucleotide
taatacgactcactatagggctgccacgcctctgcggtccaccacgtggcaacagaggagagccacgatgtggaccgcaaacctggcggcagcgcaaaagatg

SEQ ID NO: 172531 - DNA, 103 bp, Artificial Sequence
  Synthetic Polynucleotide
taatacgactcactatagggcactggtcatgtctttgcaggtgccgccgtaacagaggagaacggcgatgcctgcaaagaacctggcggcagcgcaaaagatg

SEQ ID NO: 172532 - DNA, 103 bp, Artificial Sequence
  Synthetic Polynucleotide
taatacgactcactatagggcacacgtagccactggtcatgtctttgcagaacagaggagactgcaaatgcatgaccagaacctggcggcagcgcaaaagatg

SEQ ID NO: 172533 - DNA, 103 bp, Artificial Sequence
  Synthetic Polynucleotide
taatacgactcactatagggccggcaggtgcacacgtagccactggtcataacagaggagaatgaccatgggctacgtgaacctggcggcagcgcaaaagatg

SEQ ID NO: 172534 - DNA, 103 bp, Artificial Sequence
  Synthetic Polynucleotide
taatacgactcactatagggtgaagccctcccggcaggtgcacacgtagcaacagaggagagctacgatggcacctgccaacctggcggcagcgcaaaagatg

SEQ ID NO: 172535 - DNA, 103 bp, Artificial Sequence
  Synthetic Polynucleotide
taatacgactcactatagggttgggaccgctgaagccctcccggcaggtgaacagaggagacacctgatgggagggcttaacctggcggcagcgcaaaagatg

SEQ ID NO: 172536 - DNA, 103 bp, Artificial Sequence
  Synthetic Polynucleotide
taatacgactcactatagggggtctggcagttgggaccgctgaagccctcaacagaggagagagggcatgagcggtcccaacctggcggcagcgcaaaagatg

SEQ ID NO: 172537 - DNA, 103 bp, Artificial Sequence
  Synthetic Polynucleotide
taatacgactcactatagggcgttgatgttggtctggcagttgggaccgcaacagaggagagcggtcatgactgccagaaacctggcggcagcgcaaaagatg

SEQ ID NO: 172538 - DNA, 103 bp, Artificial Sequence
  Synthetic Polynucleotide
taatacgactcactataggggacgcacactcgttgatgttggtctggcagaacagaggagactgccaatgcaacatcaaaacctggcggcagcgcaaaagatg

SEQ ID NO: 172539 - DNA, 103 bp, Artificial Sequence
  Synthetic Polynucleotide
taatacgactcactatagggacatgggttggacgcacactcgttgatgttaacagaggagaaacatcatggagtgtgcgaacctggcggcagcgcaaaagatg

SEQ ID NO: 172540 - DNA, 103 bp, Artificial Sequence
  Synthetic Polynucleotide
taatacgactcactatagggcctggttcagacatgggttggacgcacactaacagaggagaagtgtgatgccaacccataacctggcggcagcgcaaaagatg

SEQ ID NO: 172541 - DNA, 103 bp, Artificial Sequence
  Synthetic Polynucleotide
taatacgactcactatagggcaggcatagtctgccacgcctctgcggtccaacagaggagaggaccgatgaggcgtggcaacctggcggcagcgcaaaagatg

SEQ ID NO: 172542 - DNA, 103 bp, Artificial Sequence
  Synthetic Polynucleotide
taatacgactcactatagggatacacgtgccctggttcagacatgggttgaacagaggagacaacccatgtctgaaccaaacctggcggcagcgcaaaagatg

SEQ ID NO: 172543 - DNA, 103 bp, Artificial Sequence
  Synthetic Polynucleotide
taatacgactcactatagggaacgtcgtcaatacacgtgccctggttcagaacagaggagactgaacatgggcacgtgtaacctggcggcagcgcaaaagatg

SEQ ID NO: 172544 - DNA, 103 bp, Artificial Sequence
  Synthetic Polynucleotide
taatacgactcactatagggtgtacccggcaacgtcgtcaatacacgtgcaacagaggagagcacgtatgttgacgacgaacctggcggcagcgcaaaagatg

SEQ ID NO: 172545 - DNA, 103 bp, Artificial Sequence
  Synthetic Polynucleotide
taatacgactcactatagggcagttgcacttgtacccggcaacgtcgtcaaacagaggagatgacgaatgtgccgggtaaacctggcggcagcgcaaaagatg

SEQ ID NO: 172546 - DNA, 103 bp, Artificial Sequence
  Synthetic Polynucleotide
taatacgactcactataggggggcagcaggcagttgcacttgtacccggcaacagaggagagccgggatgaagtgcaacaacctggcggcagcgcaaaagatg

SEQ ID NO: 172547 - DNA, 103 bp, Artificial Sequence
  Synthetic Polynucleotide
taatacgactcactatagggcacctgtgtagggcagcaggcagttgcactaacagaggagaagtgcaatggcctgctgcaacctggcggcagcgcaaaagatg

SEQ ID NO: 172548 - DNA, 103 bp, Artificial Sequence
  Synthetic Polynucleotide
taatacgactcactatagggtcacacgtggcacctgtgtagggcagcaggaacagaggagacctgctatgctacacaggaacctggcggcagcgcaaaagatg

SEQ ID NO: 172549 - DNA, 103 bp, Artificial Sequence
  Synthetic Polynucleotide
taatacgactcactatagggcagcaccacctcacacgtggcacctgtgtaaacagaggagatacacaatggccacgtgtaacctggcggcagcgcaaaagatg

SEQ ID NO: 172550 - DNA, 103 bp, Artificial Sequence
  Synthetic Polynucleotide
taatacgactcactatagggcacacggggccagcaccacctcacacgtggaacagaggagaccacgtatgaggtggtgcaacctggcggcagcgcaaaagatg

SEQ ID NO: 172551 - DNA, 103 bp, Artificial Sequence
  Synthetic Polynucleotide
taatacgactcactataggggggctgggggcacacggggccagcaccaccaacagaggagaggtggtatgggccccgtgaacctggcggcagcgcaaaagatg

SEQ ID NO: 172552 - DNA, 103 bp, Artificial Sequence
  Synthetic Polynucleotide
taatacgactcactatagggggcacagctgcaggcatagtctgccacgccaacagaggagaggcgtgatggactatgccaacctggcggcagcgcaaaagatg

SEQ ID NO: 172553 - DNA, 103 bp, Artificial Sequence
  Synthetic Polynucleotide
taatacgactcactataggggtttctgcaggggctgggggcacacggggcaacagaggagagccccgatggcccccagcaacctggcggcagcgcaaaagatg

SEQ ID NO: 172554 - DNA, 103 bp, Artificial Sequence
  Synthetic Polynucleotide
taatacgactcactatagggactccccgccgtttctgcaggggctgggggaacagaggagacccccaatgcctgcagaaaacctggcggcagcgcaaaagatg

SEQ ID NO: 172555 - DNA, 103 bp, Artificial Sequence
  Synthetic Polynucleotide
taatacgactcactataggggattgcctgcactccccgccgtttctgcagaacagaggagactgcagatgcggcggggaaacctggcggcagcgcaaaagatg

SEQ ID NO: 172556 - DNA, 103 bp, Artificial Sequence
  Synthetic Polynucleotide
taatacgactcactatagggatagtcctcggattgcctgcactccccgccaacagaggagaggcgggatgtgcaggcaaaacctggcggcagcgcaaaagatg

SEQ ID NO: 172557 - DNA, 103 bp, Artificial Sequence
  Synthetic Polynucleotide
taatacgactcactatagggagaagctctcatagtcctcggattgcctgcaacagaggagagcaggcatgccgaggactaacctggcggcagcgcaaaagatg

SEQ ID NO: 172558 - DNA, 103 bp, Artificial Sequence
  Synthetic Polynucleotide
taatacgactcactatagggcagacacaggagaagctctcatagtcctcgaacagaggagacgaggaatgtgagagcttaacctggcggcagcgcaaaagatg

SEQ ID NO: 172559 - DNA, 103 bp, Artificial Sequence
  Synthetic Polynucleotide
taatacgactcactataggggcccgtggggcagacacaggagaagctctcaacagaggagagagagcatgtcctgtgtcaacctggcggcagcgcaaaagatg

SEQ ID NO: 172560 - DNA, 103 bp, Artificial Sequence
  Synthetic Polynucleotide
taatacgactcactataggggcccttgccagcccgtggggcagacacaggaacagaggagacctgtgatggccccacggaacctggcggcagcgcaaaagatg

SEQ ID NO: 172561 - DNA, 103 bp, Artificial Sequence
  Synthetic Polynucleotide
taatacgactcactatagggtcacaggtctgcccttgccagcccgtggggaacagaggagaccccacatgctggcaaggaacctggcggcagcgcaaaagatg

SEQ ID NO: 172562 - DNA, 103 bp, Artificial Sequence
  Synthetic Polynucleotide
taatacgactcactataggggatgtcgacctcacaggtctgcccttgccaaacagaggagatggcaaatgcagacctgtaacctggcggcagcgcaaaagatg

SEQ ID NO: 172563 - DNA, 103 bp, Artificial Sequence
  Synthetic Polynucleotide
taatacgactcactatagggagaagcccagggcacagctgcaggcatagtaacagaggagaactatgatggcagctgtgaacctggcggcagcgcaaaagatg

SEQ ID NO: 172564 - DNA, 103 bp, Artificial Sequence
  Synthetic Polynucleotide
taatacgactcactatagggcgcactcgttgatgtcgacctcacaggtctaacagaggagaagacctatgaggtcgacaaacctggcggcagcgcaaaagatg

SEQ ID NO: 172565 - DNA, 103 bp, Artificial Sequence
  Synthetic Polynucleotide
taatacgactcactataggggggctcagaacgcactcgttgatgtcgaccaacagaggagaggtcgaatgcaacgagtgaacctggcggcagcgcaaaagatg

SEQ ID NO: 172566 - DNA, 103 bp, Artificial Sequence
  Synthetic Polynucleotide
taatacgactcactataggggtgccggcacgggctcagaacgcactcgttaacagaggagaaacgagatggttctgagcaacctggcggcagcgcaaaagatg

SEQ ID NO: 172567 - DNA, 103 bp, Artificial Sequence
  Synthetic Polynucleotide
taatacgactcactatagggaggatgcgccgtgccggcacgggctcagaaaacagaggagattctgaatgcgtgccggcaacctggcggcagcgcaaaagatg

SEQ ID NO: 172568 - DNA, 103 bp, Artificial Sequence
  Synthetic Polynucleotide
taatacgactcactataggggtgttctggcaggatgcgccgtgccggcacaacagaggagagtgccgatgcggcgcatcaacctggcggcagcgcaaaagatg

SEQ ID NO: 172569 - DNA, 103 bp, Artificial Sequence
  Synthetic Polynucleotide
taatacgactcactataggggccgccgtgggtgttctggcaggatgcgccaacagaggagaggcgcaatgtgccagaacaacctggcggcagcgcaaaagatg

SEQ ID NO: 172570 - DNA, 103 bp, Artificial Sequence
  Synthetic Polynucleotide
taatacgactcactatagggggcagcggtagccgccgtgggtgttctggcaacagaggagagccagaatgcccacggcgaacctggcggcagcgcaaaagatg

SEQ ID NO: 172571 - DNA, 103 bp, Artificial Sequence
  Synthetic Polynucleotide
taatacgactcactataggggcctggcagtggcagcggtagccgccgtggaacagaggagaccacggatgctaccgctgaacctggcggcagcgcaaaagatg

SEQ ID NO: 172572 - DNA, 103 bp, Artificial Sequence
  Synthetic Polynucleotide
taatacgactcactatagggactgtagccggcctggcagtggcagcggtaaacagaggagataccgcatgcactgccagaacctggcggcagcgcaaaagatg

SEQ ID NO: 172573 - DNA, 103 bp, Artificial Sequence
  Synthetic Polynucleotide
taatacgactcactatagggagttgcgcccactgtagccggcctggcagtaacagaggagaactgccatgccggctacaaacctggcggcagcgcaaaagatg

SEQ ID NO: 172574 - DNA, 103 bp, Artificial Sequence
  Synthetic Polynucleotide
taatacgactcactatagggaggggcccagagaagcccagggcacagctgaacagaggagacagctgatgcctgggcttaacctggcggcagcgcaaaagatg

SEQ ID NO: 172575 - DNA, 103 bp, Artificial Sequence
  Synthetic Polynucleotide
taatacgactcactatagggtcggtctcgcagttgcgcccactgtagccgaacagaggagacggctaatgtgggcgcaaaacctggcggcagcgcaaaagatg

SEQ ID NO: 172576 - DNA, 103 bp, Artificial Sequence
  Synthetic Polynucleotide
taatacgactcactataggggtcgtcgatgtcggtctcgcagttgcgcccaacagaggagagggcgcatgtgcgagaccaacctggcggcagcgcaaaagatg

SEQ ID NO: 172577 - DNA, 103 bp, Artificial Sequence
  Synthetic Polynucleotide
taatacgactcactatagggtgggccggcagtcgtcgatgtcggtctcgcaacagaggagagcgagaatgacatcgacgaacctggcggcagcgcaaaagatg

SEQ ID NO: 172578 - DNA, 103 bp, Artificial Sequence
  Synthetic Polynucleotide
taatacgactcactatagggtgacacgggttgggccggcagtcgtcgatgaacagaggagacatcgaatgctgccggccaacctggcggcagcgcaaaagatg

SEQ ID NO: 172579 - DNA, 103 bp, Artificial Sequence
  Synthetic Polynucleotide
taatacgactcactataggggcccccgttgtgacacgggttgggccggcaaacagaggagatgccggatgaacccgtgtaacctggcggcagcgcaaaagatg

SEQ ID NO: 172580 - DNA, 103 bp, Artificial Sequence
  Synthetic Polynucleotide
taatacgactcactatagggctgtgcaggagcccccgttgtgacacgggtaacagaggagaacccgtatgacaacggggaacctggcggcagcgcaaaagatg

SEQ ID NO: 172581 - DNA, 103 bp, Artificial Sequence
  Synthetic Polynucleotide
taatacgactcactatagggttgatgccgtctgtgcaggagcccccgttgaacagaggagacaacggatgctcctgcacaacctggcggcagcgcaaaagatg

SEQ ID NO: 172582 - DNA, 103 bp, Artificial Sequence
  Synthetic Polynucleotide
taatacgactcactataggggaaggccgtgttgatgccgtctgtgcaggaaacagaggagatcctgcatggacggcatcaacctggcggcagcgcaaaagatg

SEQ ID NO: 172583 - DNA, 103 bp, Artificial Sequence
  Synthetic Polynucleotide
taatacgactcactatagggggcagtcgcagaaggccgtgttgatgccgtaacagaggagaacggcaatgacacggcctaacctggcggcagcgcaaaagatg

SEQ ID NO: 172584 - DNA, 103 bp, Artificial Sequence
  Synthetic Polynucleotide
taatacgactcactatagggaagccgggcaggcagtcgcagaaggccgtgaacagaggagacacggcatgctgcgactgaacctggcggcagcgcaaaagatg

SEQ ID NO: 172585 - DNA, 103 bp, Artificial Sequence
  Synthetic Polynucleotide
taatacgactcactatagggtgtcaggcagaggggcccagagaagcccagaacagaggagactgggcatgtctgggcccaacctggcggcagcgcaaaagatg

SEQ ID NO: 172586 - DNA, 103 bp, Artificial Sequence
  Synthetic Polynucleotide
taatacgactcactatagggagtgccccggaagccgggcaggcagtcgcaaacagaggagatgcgacatgctgcccggcaacctggcggcagcgcaaaagatg

SEQ ID NO: 172587 - DNA, 103 bp, Artificial Sequence
  Synthetic Polynucleotide
taatacgactcactatagggcctcacagaaagtgccccggaagccgggcaaacagaggagatgcccgatgtccggggcaaacctggcggcagcgcaaaagatg

SEQ ID NO: 172588 - DNA, 103 bp, Artificial Sequence
  Synthetic Polynucleotide
taatacgactcactatagggttgatgtcctcctcacagaaagtgccccggaacagaggagaccggggatgtttctgtgaaacctggcggcagcgcaaaagatg

SEQ ID NO: 172589 - DNA, 103 bp, Artificial Sequence
  Synthetic Polynucleotide
taatacgactcactatagggggcacactcgttgatgtcctcctcacagaaaacagaggagattctgtatggaggacatcaacctggcggcagcgcaaaagatg

SEQ ID NO: 172590 - DNA, 103 bp, Artificial Sequence
  Synthetic Polynucleotide
taatacgactcactatagggaggggtcactggcacactcgttgatgtcctaacagaggagaaggacaatgacgagtgtgaacctggcggcagcgcaaaagatg

SEQ ID NO: 172591 - DNA, 103 bp, Artificial Sequence
  Synthetic Polynucleotide
taatacgactcactatagggccgttgcggcaggggtcactggcacactcgaacagaggagacgagtgatgcagtgacccaacctggcggcagcgcaaaagatg

SEQ ID NO: 172592 - DNA, 103 bp, Artificial Sequence
  Synthetic Polynucleotide
taatacgactcactataggggcagttggccccgttgcggcaggggtcactaacagaggagaagtgacatgtgccgcaacaacctggcggcagcgcaaaagatg

SEQ ID NO: 172593 - DNA, 103 bp, Artificial Sequence
  Synthetic Polynucleotide
taatacgactcactatagggcgcagtccgtgcagttggccccgttgcggcaacagaggagagccgcaatggggccaactaacctggcggcagcgcaaaagatg

SEQ ID NO: 172594 - DNA, 103 bp, Artificial Sequence
  Synthetic Polynucleotide
taatacgactcactatagggtagctgtccacgcagtccgtgcagttggccaacagaggagaggccaaatgcacggactgaacctggcggcagcgcaaaagatg

SEQ ID NO: 172595 - DNA, 103 bp, Artificial Sequence
  Synthetic Polynucleotide
taatacgactcactatagggggtgcacgtgtagctgtccacgcagtccgtaacagaggagaacggacatggtggacagcaacctggcggcagcgcaaaagatg

SEQ ID NO: 172596 - DNA, 103 bp, Artificial Sequence
  Synthetic Polynucleotide
taatacgactcactatagggtgtccaggggtgtcaggcagaggggcccagaacagaggagactgggcatgtctgcctgaaacctggcggcagcgcaaaagatg

SEQ ID NO: 172597 - DNA, 103 bp, Artificial Sequence
  Synthetic Polynucleotide
taatacgactcactatagggctgcggggcaggtgcacgtgtagctgtccaaacagaggagatggacaatgacacgtgcaaacctggcggcagcgcaaaagatg

SEQ ID NO: 172598 - DNA, 103 bp, Artificial Sequence
  Synthetic Polynucleotide
taatacgactcactatagggccgctgaagcctgcggggcaggtgcacgtgaacagaggagacacgtgatgctgccccgcaacctggcggcagcgcaaaagatg

SEQ ID NO: 172599 - DNA, 103 bp, Artificial Sequence
  Synthetic Polynucleotide
taatacgactcactatagggacagtggatcccgctgaagcctgcggggcaaacagaggagatgccccatgggcttcagcaacctggcggcagcgcaaaagatg

SEQ ID NO: 172600 - DNA, 103 bp, Artificial Sequence
  Synthetic Polynucleotide
taatacgactcactatagggtgttgttctcacagtggatcccgctgaagcaacagaggagagcttcaatgggatccactaacctggcggcagcgcaaaagatg

SEQ ID NO: 172601 - DNA, 103 bp, Artificial Sequence
  Synthetic Polynucleotide
taatacgactcactatagggcagtcaggcgtgttgttctcacagtggatcaacagaggagagatccaatgtgagaacaaaacctggcggcagcgcaaaagatg

SEQ ID NO: 172602 - DNA, 103 bp, Artificial Sequence
  Synthetic Polynucleotide
taatacgactcactataggggctctctgtgcagtcaggcgtgttgttctcaacagaggagagagaacatgacgcctgacaacctggcggcagcgcaaaagatg

SEQ ID NO: 172603 - DNA, 103 bp, Artificial Sequence
  Synthetic Polynucleotide
taatacgactcactatagggtgaagcaggagctctctgtgcagtcaggcgaacagaggagacgcctgatggcacagagaaacctggcggcagcgcaaaagatg

SEQ ID NO: 172604 - DNA, 103 bp, Artificial Sequence
  Synthetic Polynucleotide
taatacgactcactataggggtgccaccgttgaagcaggagctctctgtgaacagaggagacacagaatgctcctgcttaacctggcggcagcgcaaaagatg

SEQ ID NO: 172605 - DNA, 103 bp, Artificial Sequence
  Synthetic Polynucleotide
taatacgactcactataggggtccacgcaggtgccaccgttgaagcaggaaacagaggagatcctgcatgaacggtggcaacctggcggcagcgcaaaagatg

SEQ ID NO: 172606 - DNA, 103 bp, Artificial Sequence
  Synthetic Polynucleotide
taatacgactcactatagggagttgatgccgtccacgcaggtgccaccgtaacagaggagaacggtgatgcctgcgtggaacctggcggcagcgcaaaagatg

SEQ ID NO: 172607 - DNA, 103 bp, Artificial Sequence
  Synthetic Polynucleotide
taatacgactcactatagggagcgcgggcagcagcgccaggcagagcaggaacagaggagacctgctatgcctggcgctaacctggcggcagcgcaaaagatg

SEQ ID NO: 172608 - DNA, 103 bp, Artificial Sequence
  Synthetic Polynucleotide
taatacgactcactatagggaggcaggcattgtccaggggtgtcaggcagaacagaggagactgcctatgacccctggaaacctggcggcagcgcaaaagatg

SEQ ID NO: 172609 - DNA, 103 bp, Artificial Sequence
  Synthetic Polynucleotide
taatacgactcactatagggcaggtgaacgagttgatgccgtccacgcagaacagaggagactgcgtatgcggcatcaaaacctggcggcagcgcaaaagatg

SEQ ID NO: 172610 - DNA, 103 bp, Artificial Sequence
  Synthetic Polynucleotide
taatacgactcactatagggtggacacaggcaggtgaacgagttgatgccaacagaggagaggcatcatgtcgttcaccaacctggcggcagcgcaaaagatg

SEQ ID NO: 172611 - DNA, 103 bp, Artificial Sequence
  Synthetic Polynucleotide
taatacgactcactatagggtgaagccgggtggacacaggcaggtgaacgaacagaggagacgttcaatggcctgtgtcaacctggcggcagcgcaaaagatg

SEQ ID NO: 172612 - DNA, 103 bp, Artificial Sequence
  Synthetic Polynucleotide
taatacgactcactatagggtagctgcccgtgaagccgggtggacacaggaacagaggagacctgtgatgacccggcttaacctggcggcagcgcaaaagatg

SEQ ID NO: 172613 - DNA, 103 bp, Artificial Sequence
  Synthetic Polynucleotide
taatacgactcactataggggtgctggcagtagctgcccgtgaagccgggaacagaggagacccggcatgacgggcagcaacctggcggcagcgcaaaagatg

SEQ ID NO: 172614 - DNA, 103 bp, Artificial Sequence
  Synthetic Polynucleotide
taatacgactcactatagggcattgacatcgtgctggcagtagctgcccgaacagaggagacgggcaatgactgccagcaacctggcggcagcgcaaaagatg

SEQ ID NO: 172615 - DNA, 103 bp, Artificial Sequence
  Synthetic Polynucleotide
taatacgactcactataggggagtcgcactcattgacatcgtgctggcagaacagaggagactgccaatgcgatgtcaaaacctggcggcagcgcaaaagatg

SEQ ID NO: 172616 - DNA, 103 bp, Artificial Sequence
  Synthetic Polynucleotide
taatacgactcactataggggcagggctgtgagtcgcactcattgacatcaacagaggagagatgtcatggagtgcgacaacctggcggcagcgcaaaagatg

SEQ ID NO: 172617 - DNA, 103 bp, Artificial Sequence
  Synthetic Polynucleotide
taatacgactcactatagggcgccatgcaggcagggctgtgagtcgcactaacagaggagaagtgcgatgcacagccctaacctggcggcagcgcaaaagatg

SEQ ID NO: 172618 - DNA, 103 bp, Artificial Sequence
  Synthetic Polynucleotide
taatacgactcactatagggtgacaggtgccgccatgcaggcagggctgtaacagaggagaacagccatgcctgcatggaacctggcggcagcgcaaaagatg

SEQ ID NO: 172619 - DNA, 103 bp, Artificial Sequence
  Synthetic Polynucleotide
taatacgactcactatagggggggttggtgaggcaggcattgtccaggggaacagaggagacccctgatgaatgcctgcaacctggcggcagcgcaaaagatg

SEQ ID NO: 172620 - DNA, 103 bp, Artificial Sequence
  Synthetic Polynucleotide
taatacgactcactataggggcagccgtcctgacaggtgccgccatgcagaacagaggagactgcatatgggcacctgtaacctggcggcagcgcaaaagatg

SEQ ID NO: 172621 - DNA, 103 bp, Artificial Sequence
  Synthetic Polynucleotide
taatacgactcactatagggtgtaggagccgcagccgtcctgacaggtgcaacagaggagagcacctatgaggacggctaacctggcggcagcgcaaaagatg

SEQ ID NO: 172622 - DNA, 103 bp, Artificial Sequence
  Synthetic Polynucleotide
taatacgactcactatagggcaggtgcacctgtaggagccgcagccgtccaacagaggagaggacggatgcggctcctaaacctggcggcagcgcaaaagatg

SEQ ID NO: 172623 - DNA, 103 bp, Artificial Sequence
  Synthetic Polynucleotide
taatacgactcactataggggccctgggggcaggtgcacctgtaggagccaacagaggagaggctccatgaggtgcaccaacctggcggcagcgcaaaagatg

SEQ ID NO: 172624 - DNA, 103 bp, Artificial Sequence
  Synthetic Polynucleotide
taatacgactcactatagggggccagtgtagccctgggggcaggtgcaccaacagaggagaggtgcaatggcccccaggaacctggcggcagcgcaaaagatg

SEQ ID NO: 172625 - DNA, 103 bp, Artificial Sequence
  Synthetic Polynucleotide
taatacgactcactatagggtggcagttggggccagtgtagccctgggggaacagaggagacccccaatgctacactggaacctggcggcagcgcaaaagatg

SEQ ID NO: 172626 - DNA, 103 bp, Artificial Sequence
  Synthetic Polynucleotide
taatacgactcactatagggcacaaggttctggcagttggggccagtgtaaacagaggagatacactatgcccaactgcaacctggcggcagcgcaaaagatg

SEQ ID NO: 172627 - DNA, 103 bp, Artificial Sequence
  Synthetic Polynucleotide
taatacgactcactatagggcacaccagtgcacaaggttctggcagttggaacagaggagaccaactatgagaaccttgaacctggcggcagcgcaaaagatg

SEQ ID NO: 172628 - DNA, 103 bp, Artificial Sequence
  Synthetic Polynucleotide
taatacgactcactatagggggcgaggagtcacaccagtgcacaaggttcaacagaggagagaacctatggcactggtgaacctggcggcagcgcaaaagatg

SEQ ID NO: 172629 - DNA, 103 bp, Artificial Sequence
  Synthetic Polynucleotide
taatacgactcactataggggttcttgcagggcgaggagtcacaccagtgaacagaggagacactggatggactcctcgaacctggcggcagcgcaaaagatg

SEQ ID NO: 172630 - DNA, 103 bp, Artificial Sequence
  Synthetic Polynucleotide
taatacgactcactatagggcgttgcggcaggggttggtgaggcaggcataacagaggagaatgcctatgtcaccaaccaacctggcggcagcgcaaaagatg

SEQ ID NO: 172631 - DNA, 103 bp, Artificial Sequence
  Synthetic Polynucleotide
taatacgactcactatagggatttgccgccgttcttgcagggcgaggagtaacagaggagaactcctatgcctgcaagaaacctggcggcagcgcaaaagatg

SEQ ID NO: 172632 - DNA, 103 bp, Artificial Sequence
  Synthetic Polynucleotide
taatacgactcactataggggtctgccagcatttgccgccgttcttgcagaacagaggagactgcaaatgcggcggcaaaacctggcggcagcgcaaaagatg

SEQ ID NO: 172633 - DNA, 103 bp, Artificial Sequence
  Synthetic Polynucleotide
taatacgactcactatagggctgggtgtgggtctgccagcatttgccgccaacagaggagaggcggcatgtgctggcagaacctggcggcagcgcaaaagatg

SEQ ID NO: 172634 - DNA, 103 bp, Artificial Sequence
  Synthetic Polynucleotide
taatacgactcactatagggcgcagcggtactgggtgtgggtctgccagcaacagaggagagctggcatgcccacacccaacctggcggcagcgcaaaagatg

SEQ ID NO: 172635 - DNA, 103 bp, Artificial Sequence
  Synthetic Polynucleotide
taatacgactcactatagggctggggcactcgcagcggtactgggtgtggaacagaggagaccacacatggtaccgctgaacctggcggcagcgcaaaagatg

SEQ ID NO: 172636 - DNA, 103 bp, Artificial Sequence
  Synthetic Polynucleotide
taatacgactcactatagggggtccagccgctggggcactcgcagcggtaaacagaggagataccgcatggagtgccccaacctggcggcagcgcaaaagatg

SEQ ID NO: 172637 - DNA, 103 bp, Artificial Sequence
  Synthetic Polynucleotide
taatacgactcactatagggagtaaaggccggtccagccgctggggcactaacagaggagaagtgccatggcggctggaaacctggcggcagcgcaaaagatg

SEQ ID NO: 172638 - DNA, 103 bp, Artificial Sequence
  Synthetic Polynucleotide
taatacgactcactatagggggcacgtcgcagtaaaggccggtccagccgaacagaggagacggctgatgcggcctttaaacctggcggcagcgcaaaagatg

SEQ ID NO: 172639 - DNA, 103 bp, Artificial Sequence
  Synthetic Polynucleotide
taatacgactcactatagggggacacgctgggcacgtcgcagtaaaggccaacagaggagaggccttatgtgcgacgtgaacctggcggcagcgcaaaagatg

SEQ ID NO: 172640 - DNA, 103 bp, Artificial Sequence
  Synthetic Polynucleotide
taatacgactcactatagggccacctcacaggacacgctgggcacgtcgcaacagaggagagcgacgatgccagcgtgtaacctggcggcagcgcaaaagatg

SEQ ID NO: 172641 - DNA, 103 bp, Artificial Sequence
  Synthetic Polynucleotide
taatacgactcactatagggcaggtgcccccgttgcggcaggggttggtgaacagaggagacaccaaatgctgccgcaaaacctggcggcagcgcaaaagatg

SEQ ID NO: 172642 - DNA, 103 bp, Artificial Sequence
  Synthetic Polynucleotide
taatacgactcactatagggcgctgcgcagccacctcacaggacacgctgaacagaggagacagcgtatgctgtgaggtaacctggcggcagcgcaaaagatg

SEQ ID NO: 172643 - DNA, 103 bp, Artificial Sequence
  Synthetic Polynucleotide
taatacgactcactatagggaacaccttgtcgctgcgcagccacctcacaaacagaggagatgtgagatggctgcgcagaacctggcggcagcgcaaaagatg

SEQ ID NO: 172644 - DNA, 103 bp, Artificial Sequence
  Synthetic Polynucleotide
taatacgactcactataggggggcaacgtcaacaccttgtcgctgcgcagaacagaggagactgcgcatggacaaggtgaacctggcggcagcgcaaaagatg

SEQ ID NO: 172645 - DNA, 103 bp, Artificial Sequence
  Synthetic Polynucleotide
taatacgactcactatagggtggcacaggcgggcaacgtcaacaccttgtaacagaggagaacaaggatgtgacgttgcaacctggcggcagcgcaaaagatg

SEQ ID NO: 172646 - DNA, 103 bp, Artificial Sequence
  Synthetic Polynucleotide
taatacgactcactatagggccctccatgctggcacaggcgggcaacgtcaacagaggagagacgttatgcgcctgtgcaacctggcggcagcgcaaaagatg

SEQ ID NO: 172647 - DNA, 103 bp, Artificial Sequence
  Synthetic Polynucleotide
taatacgactcactatagggccacacagagccctccatgctggcacaggcaacagaggagagcctgtatgagcatggagaacctggcggcagcgcaaaagatg

SEQ ID NO: 172648 - DNA, 103 bp, Artificial Sequence
  Synthetic Polynucleotide
taatacgactcactatagggttgcccgcgtccacacagagccctccatgcaacagaggagagcatggatggctctgtgtaacctggcggcagcgcaaaagatg

SEQ ID NO: 172649 - DNA, 103 bp, Artificial Sequence
  Synthetic Polynucleotide
taatacgactcactataggggtggtgcgtgttgcccgcgtccacacagagaacagaggagactctgtatggacgcgggcaacctggcggcagcgcaaaagatg

SEQ ID NO: 172650 - DNA, 103 bp, Artificial Sequence
  Synthetic Polynucleotide
taatacgactcactatagggggcagcggcagtggtgcgtgttgcccgcgtaacagaggagaacgcggatgacacgcaccaacctggcggcagcgcaaaagatg

SEQ ID NO: 172651 - DNA, 103 bp, Artificial Sequence
  Synthetic Polynucleotide
taatacgactcactatagggtagcccgcctggcagcggcagtggtgcgtgaacagaggagacacgcaatgctgccgctgaacctggcggcagcgcaaaagatg

SEQ ID NO: 172652 - DNA, 103 bp, Artificial Sequence
  Synthetic Polynucleotide
taatacgactcactataggggagcaggtcgcaggtgcccccgttgcggcaaacagaggagatgccgcatggggggcaccaacctggcggcagcgcaaaagatg

SEQ ID NO: 172653 - DNA, 103 bp, Artificial Sequence
  Synthetic Polynucleotide
taatacgactcactataggggctgcctgtgtagcccgcctggcagcggcaaacagaggagatgccgcatgcaggcgggcaacctggcggcagcgcaaaagatg

SEQ ID NO: 172654 - DNA, 103 bp, Artificial Sequence
  Synthetic Polynucleotide
taatacgactcactatagggcctcacagtagctgcctgtgtagcccgcctaacagaggagaaggcggatgacacaggcaaacctggcggcagcgcaaaagatg

SEQ ID NO: 172655 - DNA, 103 bp, Artificial Sequence
  Synthetic Polynucleotide
taatacgactcactatagggtccaccaggtcctcacagtagctgcctgtgaacagaggagacacaggatgctactgtgaaacctggcggcagcgcaaaagatg

SEQ ID NO: 172656 - DNA, 103 bp, Artificial Sequence
  Synthetic Polynucleotide
taatacgactcactatagggtgagcactcgtccaccaggtcctcacagtaaacagaggagatactgtatggacctggtgaacctggcggcagcgcaaaagatg

SEQ ID NO: 172657 - DNA, 103 bp, Artificial Sequence
  Synthetic Polynucleotide
taatacgactcactatagggaggggctgggtgagcactcgtccaccaggtaacagaggagaacctggatgacgagtgctaacctggcggcagcgcaaaagatg

SEQ ID NO: 172658 - DNA, 103 bp, Artificial Sequence
  Synthetic Polynucleotide
taatacgactcactatagggccgttctggcaggggctgggtgagcactcgaacagaggagacgagtgatgacccagcccaacctggcggcagcgcaaaagatg

SEQ ID NO: 172659 - DNA, 103 bp, Artificial Sequence
  Synthetic Polynucleotide
taatacgactcactataggggcaggtggccccgttctggcaggggctgggaacagaggagacccagcatgtgccagaacaacctggcggcagcgcaaaagatg

SEQ ID NO: 172660 - DNA, 103 bp, Artificial Sequence
  Synthetic Polynucleotide
taatacgactcactatagggggtagtccgtgcaggtggccccgttctggcaacagaggagagccagaatggggccacctaacctggcggcagcgcaaaagatg

SEQ ID NO: 172661 - DNA, 103 bp, Artificial Sequence
  Synthetic Polynucleotide
taatacgactcactatagggtagccgcccaggtagtccgtgcaggtggccaacagaggagaggccacatgcacggactaaacctggcggcagcgcaaaagatg

SEQ ID NO: 172662 - DNA, 103 bp, Artificial Sequence
  Synthetic Polynucleotide
taatacgactcactatagggcttgcaggagtagccgcccaggtagtccgtaacagaggagaacggacatgctgggcggcaacctggcggcagcgcaaaagatg

SEQ ID NO: 172663 - DNA, 103 bp, Artificial Sequence
  Synthetic Polynucleotide
taatacgactcactatagggccgtcagcgtgagcaggtcgcaggtgccccaacagaggagaggggcaatggcgacctgcaacctggcggcagcgcaaaagatg

SEQ ID NO: 172664 - DNA, 103 bp, Artificial Sequence
  Synthetic Polynucleotide
taatacgactcactatagggcggccacgcacttgcaggagtagccgcccaaacagaggagatgggcgatgactcctgcaaacctggcggcagcgcaaaagatg

SEQ ID NO: 172665 - DNA, 103 bp, Artificial Sequence
  Synthetic Polynucleotide
taatacgactcactatagggccgtggtagccggccacgcacttgcaggagaacagaggagactcctgatggtgcgtggcaacctggcggcagcgcaaaagatg

SEQ ID NO: 172666 - DNA, 103 bp, Artificial Sequence
  Synthetic Polynucleotide
taatacgactcactataggggcagttcaccccgtggtagccggccacgcaaacagaggagatgcgtgatgggctaccacaacctggcggcagcgcaaaagatg

SEQ ID NO: 172667 - DNA, 103 bp, Artificial Sequence
  Synthetic Polynucleotide
taatacgactcactatagggtctcctcagagcagttcaccccgtggtagcaacagaggagagctaccatggggtgaactaacctggcggcagcgcaaaagatg

SEQ ID NO: 172668 - DNA, 103 bp, Artificial Sequence
  Synthetic Polynucleotide
taatacgactcactatagggcactcgtcgatctcctcagagcagttcaccaacagaggagaggtgaaatgctctgaggaaacctggcggcagcgcaaaagatg

SEQ ID NO: 172669 - DNA, 103 bp, Artificial Sequence
  Synthetic Polynucleotide
taatacgactcactataggggtgggagaggcactcgtcgatctcctcagaaacagaggagatctgagatgatcgacgagaacctggcggcagcgcaaaagatg

SEQ ID NO: 172670 - DNA, 103 bp, Artificial Sequence
  Synthetic Polynucleotide
taatacgactcactatagggtctggcaggggtgggagaggcactcgtcgaaacagaggagatcgacgatggcctctcccaacctggcggcagcgcaaaagatg

SEQ ID NO: 172671 - DNA, 103 bp, Artificial Sequence
  Synthetic Polynucleotide
taatacgactcactataggggtgcccccgttctggcaggggtgggagaggaacagaggagacctctcatgcccctgccaaacctggcggcagcgcaaaagatg

SEQ ID NO: 172672 - DNA, 103 bp, Artificial Sequence
  Synthetic Polynucleotide
taatacgactcactataggggtcgaggcaggtgcccccgttctggcagggaacagaggagaccctgcatgaacgggggcaacctggcggcagcgcaaaagatg

SEQ ID NO: 172673 - DNA, 103 bp, Artificial Sequence
  Synthetic Polynucleotide
taatacgactcactatagggtgttggggaggtcgaggcaggtgcccccgtaacagaggagaacggggatgcctgcctcgaacctggcggcagcgcaaaagatg

SEQ ID NO: 172674 - DNA, 103 bp, Artificial Sequence
  Synthetic Polynucleotide
taatacgactcactatagggcacttgtactccgtcagcgtgagcaggtcgaacagaggagacgacctatgcacgctgacaacctggcggcagcgcaaaagatg

SEQ ID NO: 172675 - DNA, 103 bp, Artificial Sequence
  Synthetic Polynucleotide
taatacgactcactatagggcacttgtaggtgttggggaggtcgaggcagaacagaggagactgcctatgcctccccaaaacctggcggcagcgcaaaagatg

SEQ ID NO: 172676 - DNA, 103 bp, Artificial Sequence
  Synthetic Polynucleotide
taatacgactcactatagggtgggcaggagcacttgtaggtgttggggagaacagaggagactccccatgacctacaagaacctggcggcagcgcaaaagatg

SEQ ID NO: 172677 - DNA, 103 bp, Artificial Sequence
  Synthetic Polynucleotide
taatacgactcactataggggagtgccccgtgggcaggagcacttgtaggaacagaggagacctacaatggctcctgccaacctggcggcagcgcaaaagatg

SEQ ID NO: 172678 - DNA, 103 bp, Artificial Sequence
  Synthetic Polynucleotide
taatacgactcactatagggtgcacaccctgagtgccccgtgggcaggagaacagaggagactcctgatgacggggcacaacctggcggcagcgcaaaagatg

SEQ ID NO: 172679 - DNA, 103 bp, Artificial Sequence
  Synthetic Polynucleotide
taatacgactcactataggggatctcacagtgcacaccctgagtgccccgaacagaggagacggggcatgcagggtgtgaacctggcggcagcgcaaaagatg

SEQ ID NO: 172680 - DNA, 103 bp, Artificial Sequence
  Synthetic Polynucleotide
taatacgactcactatagggcgtccacgttgatctcacagtgcacaccctaacagaggagaagggtgatgactgtgagaaacctggcggcagcgcaaaagatg

SEQ ID NO: 172681 - DNA, 103 bp, Artificial Sequence
  Synthetic Polynucleotide
taatacgactcactatagggggattgcagtcgtccacgttgatctcacagaacagaggagactgtgaatgcaacgtggaaacctggcggcagcgcaaaagatg

SEQ ID NO: 172682 - DNA, 103 bp, Artificial Sequence
  Synthetic Polynucleotide
taatacgactcactataggggtcaacggggggattgcagtcgtccacgttaacagaggagaaacgtgatggactgcaataacctggcggcagcgcaaaagatg

SEQ ID NO: 172683 - DNA, 103 bp, Artificial Sequence
  Synthetic Polynucleotide
taatacgactcactataggggggacacggggtcaacggggggattgcagtaacagaggagaactgcaatgcccccgttgaacctggcggcagcgcaaaagatg

SEQ ID NO: 172684 - DNA, 103 bp, Artificial Sequence
  Synthetic Polynucleotide
taatacgactcactatagggttggggctccgggacacggggtcaacggggaacagaggagaccccgtatgccccgtgtcaacctggcggcagcgcaaaagatg

SEQ ID NO: 172685 - DNA, 103 bp, Artificial Sequence
  Synthetic Polynucleotide
taatacgactcactatagggcgggcagcggcacttgtactccgtcagcgtaacagaggagaacgctgatggagtacaagaacctggcggcagcgcaaaagatg

SEQ ID NO: 172686 - DNA, 103 bp, Artificial Sequence
  Synthetic Polynucleotide
taatacgactcactataggggttaaagcacttggggctccgggacacgggaacagaggagacccgtgatgcggagccccaacctggcggcagcgcaaaagatg

SEQ ID NO: 172687 - DNA, 103 bp, Artificial Sequence
  Synthetic Polynucleotide
taatacgactcactatagggaggtgccgttgttaaagcacttggggctccaacagaggagaggagccatgagtgctttaaacctggcggcagcgcaaaagatg

SEQ ID NO: 172688 - DNA, 103 bp, Artificial Sequence
  Synthetic Polynucleotide
taatacgactcactatagggtggtccacgcaggtgccgttgttaaagcacaacagaggagagtgcttatgcaacggcacaacctggcggcagcgcaaaagatg

SEQ ID NO: 172689 - DNA, 103 bp, Artificial Sequence
  Synthetic Polynucleotide
taatacgactcactataggggccgcccacctggtccacgcaggtgccgttaacagaggagaaacggcatgtgcgtggacaacctggcggcagcgcaaaagatg

SEQ ID NO: 172690 - DNA, 103 bp, Artificial Sequence
  Synthetic Polynucleotide
taatacgactcactatagggtgcagctgtagccgcccacctggtccacgcaacagaggagagcgtggatgaggtgggcgaacctggcggcagcgcaaaagatg

SEQ ID NO: 172691 - DNA, 103 bp, Artificial Sequence
  Synthetic Polynucleotide
taatacgactcactatagggggcgggcaggtgcagctgtagccgcccaccaacagaggagaggtgggatgctacagctgaacctggcggcagcgcaaaagatg

SEQ ID NO: 172692 - DNA, 103 bp, Artificial Sequence
  Synthetic Polynucleotide
taatacgactcactatagggcacgaagcccggcgggcaggtgcagctgtaaacagaggagatacagcatgacctgcccgaacctggcggcagcgcaaaagatg

SEQ ID NO: 172693 - DNA, 103 bp, Artificial Sequence
  Synthetic Polynucleotide
taatacgactcactatagggagcgctcacccacgaagcccggcgggcaggaacagaggagacctgccatgcgggcttcgaacctggcggcagcgcaaaagatg

SEQ ID NO: 172694 - DNA, 103 bp, Artificial Sequence
  Synthetic Polynucleotide
taatacgactcactatagggtccccctcacagcgctcacccacgaagcccaacagaggagagggcttatggggtgagcgaacctggcggcagcgcaaaagatg

SEQ ID NO: 172695 - DNA, 103 bp, Artificial Sequence
  Synthetic Polynucleotide
taatacgactcactatagggctcgttgacatccccctcacagcgctcaccaacagaggagaggtgagatgtgtgaggggaacctggcggcagcgcaaaagatg

SEQ ID NO: 172696 - DNA, 103 bp, Artificial Sequence
  Synthetic Polynucleotide
taatacgactcactatagggaccagccgggcgggcagcggcacttgtactaacagaggagaagtacaatggccgctgccaacctggcggcagcgcaaaagatg

SEQ ID NO: 172697 - DNA, 103 bp, Artificial Sequence
  Synthetic Polynucleotide
taatacgactcactatagggtggacaggcactcgttgacatccccctcacaacagaggagagtgaggatgatgtcaacgaacctggcggcagcgcaaaagatg

SEQ ID NO: 172698 - DNA, 103 bp, Artificial Sequence
  Synthetic Polynucleotide
taatacgactcactatagggtcgcagggattggacaggcactcgttgacaaacagaggagatgtcaaatggtgcctgtcaacctggcggcagcgcaaaagatg

SEQ ID NO: 172699 - DNA, 103 bp, Artificial Sequence
  Synthetic Polynucleotide
taatacgactcactataggggccacgggcgtcgcagggattggacaggcaaacagaggagatgcctgatgaatccctgcaacctggcggcagcgcaaaagatg

SEQ ID NO: 172700 - DNA, 103 bp, Artificial Sequence
  Synthetic Polynucleotide
taatacgactcactatagggagttctgggtgccacgggcgtcgcagggataacagaggagaatccctatgacgcccgtgaacctggcggcagcgcaaaagatg

SEQ ID NO: 172701 - DNA, 103 bp, Artificial Sequence
  Synthetic Polynucleotide
taatacgactcactatagggcgctgcacgcagttctgggtgccacgggcgaacagaggagacgcccgatgcacccagaaaacctggcggcagcgcaaaagatg

SEQ ID NO: 172702 - DNA, 103 bp, Artificial Sequence
  Synthetic Polynucleotide
taatacgactcactataggggtcattgacgcgctgcacgcagttctgggtaacagaggagaacccagatgtgcgtgcagaacctggcggcagcgcaaaagatg

SEQ ID NO: 172703 - DNA, 103 bp, Artificial Sequence
  Synthetic Polynucleotide
taatacgactcactatagggcgcagtggaagtcattgacgcgctgcacgcaacagaggagagcgtgcatggcgtcaatgaacctggcggcagcgcaaaagatg

SEQ ID NO: 172704 - DNA, 103 bp, Artificial Sequence
  Synthetic Polynucleotide
taatacgactcactataggggcacggcactcgcagtggaagtcattgacgaacagaggagacgtcaaatgcttccactgaacctggcggcagcgcaaaagatg

SEQ ID NO: 172705 - DNA, 103 bp, Artificial Sequence
  Synthetic Polynucleotide
taatacgactcactatagggggtgtgaccagcacggcactcgcagtggaaaacagaggagattccacatggagtgccgtaacctggcggcagcgcaaaagatg

SEQ ID NO: 172706 - DNA, 103 bp, Artificial Sequence
  Synthetic Polynucleotide
taatacgactcactatagggagcggcgcccggtgtgaccagcacggcactaacagaggagaagtgccatgctggtcacaaacctggcggcagcgcaaaagatg

SEQ ID NO: 172707 - DNA, 103 bp, Artificial Sequence
  Synthetic Polynucleotide
taatacgactcactataggggatttccctgaccagccgggcgggcagcggaacagaggagaccgctgatggcccggctgaacctggcggcagcgcaaaagatg

SEQ ID NO: 172708 - DNA, 103 bp, Artificial Sequence
  Synthetic Polynucleotide
taatacgactcactatagggacggactcgcagcggcgcccggtgtgaccaaacagaggagatggtcaatgcgggcgccgaacctggcggcagcgcaaaagatg

SEQ ID NO: 172709 - DNA, 103 bp, Artificial Sequence
  Synthetic Polynucleotide
taatacgactcactataggggccattgatgacggactcgcagcggcgcccaacagaggagagggcgcatgtgcgagtccaacctggcggcagcgcaaaagatg

SEQ ID NO: 172710 - DNA, 103 bp, Artificial Sequence
  Synthetic Polynucleotide
taatacgactcactatagggtgcctttgcagccattgatgacggactcgcaacagaggagagcgagtatgtcatcaatgaacctggcggcagcgcaaaagatg

SEQ ID NO: 172711 - DNA, 103 bp, Artificial Sequence
  Synthetic Polynucleotide
taatacgactcactatagggttgcagggcttgcctttgcagccattgatgaacagaggagacatcaaatgctgcaaaggaacctggcggcagcgcaaaagatg

SEQ ID NO: 172712 - DNA, 103 bp, Artificial Sequence
  Synthetic Polynucleotide
taatacgactcactataggggcccccattcttgcagggcttgcctttgcaaacagaggagatgcaaaatgaagccctgcaacctggcggcagcgcaaaagatg

SEQ ID NO: 172713 - DNA, 103 bp, Artificial Sequence
  Synthetic Polynucleotide
taatacgactcactatagggcggcgcaggtgcccccattcttgcagggctaacagaggagaagccctatgagaatggggaacctggcggcagcgcaaaagatg

SEQ ID NO: 172714 - DNA, 103 bp, Artificial Sequence
  Synthetic Polynucleotide
taatacgactcactatagggttggaggccacggcgcaggtgcccccattcaacagaggagagaatggatgcacctgcgcaacctggcggcagcgcaaaagatg

SEQ ID NO: 172715 - DNA, 103 bp, Artificial Sequence
  Synthetic Polynucleotide
taatacgactcactataggggcgggcggtgttggaggccacggcgcaggtaacagaggagaacctgcatggtggcctccaacctggcggcagcgcaaaagatg

SEQ ID NO: 172716 - DNA, 103 bp, Artificial Sequence
  Synthetic Polynucleotide
taatacgactcactatagggagatgaacccgcgggcggtgttggaggccaaacagaggagatggcctatgacaccgcccaacctggcggcagcgcaaaagatg

SEQ ID NO: 172717 - DNA, 103 bp, Artificial Sequence
  Synthetic Polynucleotide
taatacgactcactataggggggcacttgcagatgaacccgcgggcggtgaacagaggagacaccgcatgcgggttcataacctggcggcagcgcaaaagatg

SEQ ID NO: 172718 - DNA, 103 bp, Artificial Sequence
  Synthetic Polynucleotide
taatacgactcactatagggtcgtgcggcgagcgcgggcagcagcgccagaacagaggagactggcgatgctgcccgcgaacctggcggcagcgcaaaagatg

SEQ ID NO: 172719 - DNA, 103 bp, Artificial Sequence
  Synthetic Polynucleotide
taatacgactcactatagggctgctggcacgatttccctgaccagccgggaacagaggagacccggcatgtcagggaaaaacctggcggcagcgcaaaagatg

SEQ ID NO: 172720 - DNA, 103 bp, Artificial Sequence
  Synthetic Polynucleotide
taatacgactcactataggggaagcccgcagggcacttgcagatgaacccaacagaggagagggttcatgtgcaagtgcaacctggcggcagcgcaaaagatg

SEQ ID NO: 172721 - DNA, 103 bp, Artificial Sequence
  Synthetic Polynucleotide
taatacgactcactatagggtggcgccctcgaagcccgcagggcacttgcaacagaggagagcaagtatgctgcgggctaacctggcggcagcgcaaaagatg

SEQ ID NO: 172722 - DNA, 103 bp, Artificial Sequence
  Synthetic Polynucleotide
taatacgactcactatagggttctcacacgtggcgccctcgaagcccgcaaacagaggagatgcgggatgcgagggcgcaacctggcggcagcgcaaaagatg

SEQ ID NO: 172723 - DNA, 103 bp, Artificial Sequence
  Synthetic Polynucleotide
taatacgactcactatagggacgagcgtcattctcacacgtggcgccctcaacagaggagagagggcatgacgtgtgagaacctggcggcagcgcaaaagatg

SEQ ID NO: 172724 - DNA, 103 bp, Artificial Sequence
  Synthetic Polynucleotide
taatacgactcactatagggtgccgcaggtacgagcgtcattctcacacgaacagaggagacgtgtgatgatgacgctcaacctggcggcagcgcaaaagatg

SEQ ID NO: 172725 - DNA, 103 bp, Artificial Sequence
  Synthetic Polynucleotide
taatacgactcactatagggcagcgcaggctgccgcaggtacgagcgtcaaacagaggagatgacgcatgtacctgcggaacctggcggcagcgcaaaagatg

SEQ ID NO: 172726 - DNA, 103 bp, Artificial Sequence
  Synthetic Polynucleotide
taatacgactcactataggggccgttgaggcagcgcaggctgccgcaggtaacagaggagaacctgcatgagcctgcgcaacctggcggcagcgcaaaagatg

SEQ ID NO: 172727 - DNA, 103 bp, Artificial Sequence
  Synthetic Polynucleotide
taatacgactcactatagggtgcatgtgccgccgttgaggcagcgcaggcaacagaggagagcctgcatggcctcaacgaacctggcggcagcgcaaaagatg

SEQ ID NO: 172728 - DNA, 103 bp, Artificial Sequence
  Synthetic Polynucleotide
taatacgactcactataggggggccggagatgcatgtgccgccgttgaggaacagaggagacctcaaatgcggcacatgaacctggcggcagcgcaaaagatg

SEQ ID NO: 172729 - DNA, 103 bp, Artificial Sequence
  Synthetic Polynucleotide
taatacgactcactatagggggggctgcgcgggccggagatgcatgtgccaacagaggagaggcacaatgatctccggcaacctggcggcagcgcaaaagatg

SEQ ID NO: 172730 - DNA, 103 bp, Artificial Sequence
  Synthetic Polynucleotide
taatacgactcactatagggacgggtcagcctgctggcacgatttccctgaacagaggagacagggaatgcgtgccagcaacctggcggcagcgcaaaagatg

SEQ ID NO: 172731 - DNA, 103 bp, Artificial Sequence
  Synthetic Polynucleotide
taatacgactcactatagggacaggcaggtggggctgcgcgggccggagaaacagaggagatctccgatgcgcgcagccaacctggcggcagcgcaaaagatg

SEQ ID NO: 172732 - DNA, 103 bp, Artificial Sequence
  Synthetic Polynucleotide
taatacgactcactataggggggcccaggcacaggcaggtggggctgcgcaacagaggagagcgcagatgcacctgcctaacctggcggcagcgcaaaagatg

SEQ ID NO: 172733 - DNA, 103 bp, Artificial Sequence
  Synthetic Polynucleotide
taatacgactcactataggggcccgtgaaggggcccaggcacaggcaggtaacagaggagaacctgcatgtgcctgggcaacctggcggcagcgcaaaagatg

SEQ ID NO: 172734 - DNA, 103 bp, Artificial Sequence
  Synthetic Polynucleotide
taatacgactcactatagggggcattcggggcccgtgaaggggcccaggcaacagaggagagcctggatgccttcacggaacctggcggcagcgcaaaagatg

SEQ ID NO: 172735 - DNA, 103 bp, Artificial Sequence
  Synthetic Polynucleotide
taatacgactcactataggggccgggaactggcattcggggcccgtgaagaacagaggagacttcacatgccccgaatgaacctggcggcagcgcaaaagatg

SEQ ID NO: 172736 - DNA, 103 bp, Artificial Sequence
  Synthetic Polynucleotide
taatacgactcactatagggggggctgctggccgggaactggcattcgggaacagaggagacccgaaatgcagttcccgaacctggcggcagcgcaaaagatg

SEQ ID NO: 172737 - DNA, 103 bp, Artificial Sequence
  Synthetic Polynucleotide
taatacgactcactatagggcgcccaggcaggggctgctggccgggaactaacagaggagaagttccatgccagcagccaacctggcggcagcgcaaaagatg

SEQ ID NO: 172738 - DNA, 103 bp, Artificial Sequence
  Synthetic Polynucleotide
taatacgactcactatagggcaggggttgccgcccaggcaggggctgctgaacagaggagacagcagatgctgcctgggaacctggcggcagcgcaaaagatg

SEQ ID NO: 172739 - DNA, 103 bp, Artificial Sequence
  Synthetic Polynucleotide
taatacgactcactatagggctggttgtagcaggggttgccgcccaggcaaacagaggagatgcctgatgggcaaccccaacctggcggcagcgcaaaagatg

SEQ ID NO: 172740 - DNA, 103 bp, Artificial Sequence
  Synthetic Polynucleotide
taatacgactcactatagggcacaggtcccctggttgtagcaggggttgcaacagaggagagcaaccatggctacaaccaacctggcggcagcgcaaaagatg

SEQ ID NO: 172741 - DNA, 103 bp, Artificial Sequence
  Synthetic Polynucleotide
taatacgactcactatagggttggaggcgcacgggtcagcctgctggcacaacagaggagagtgccaatgggctgacccaacctggcggcagcgcaaaagatg

SEQ ID NO: 172742 - DNA, 103 bp, Artificial Sequence
  Synthetic Polynucleotide
taatacgactcactataggggatgtgggctcacaggtcccctggttgtagaacagaggagactacaaatgggggacctgaacctggcggcagcgcaaaagatg

SEQ ID NO: 172743 - DNA, 103 bp, Artificial Sequence
  Synthetic Polynucleotide
taatacgactcactatagggggggctctcggatgtgggctcacaggtcccaacagaggagagggaccatggagcccacaaacctggcggcagcgcaaaagatg

SEQ ID NO: 172744 - DNA, 103 bp, Artificial Sequence
  Synthetic Polynucleotide
taatacgactcactatagggaacggtagaaggggctctcggatgtgggctaacagaggagaagcccaatgccgagagccaacctggcggcagcgcaaaagatg

SEQ ID NO: 172745 - DNA, 103 bp, Artificial Sequence
  Synthetic Polynucleotide
taatacgactcactataggggggcacaggcaacggtagaaggggctctcgaacagaggagacgagagatgcttctaccgaacctggcggcagcgcaaaagatg

SEQ ID NO: 172746 - DNA, 103 bp, Artificial Sequence
  Synthetic Polynucleotide
taatacgactcactataggggaatttggcggggcacaggcaacggtagaaaacagaggagattctacatgtgcctgtgcaacctggcggcagcgcaaaagatg

SEQ ID NO: 172747 - DNA, 103 bp, Artificial Sequence
  Synthetic Polynucleotide
taatacgactcactatagggagagcccgttgaatttggcggggcacaggcaacagaggagagcctgtatgccgccaaataacctggcggcagcgcaaaagatg

SEQ ID NO: 172748 - DNA, 103 bp, Artificial Sequence
  Synthetic Polynucleotide
taatacgactcactatagggatgtggcacaagagcccgttgaatttggcgaacagaggagacgccaaatgcaacgggctaacctggcggcagcgcaaaagatg

SEQ ID NO: 172749 - DNA, 103 bp, Artificial Sequence
  Synthetic Polynucleotide
taatacgactcactataggggtagtccaggatgtggcacaagagcccgttaacagaggagaaacgggatgttgtgccacaacctggcggcagcgcaaaagatg

SEQ ID NO: 172750 - DNA, 103 bp, Artificial Sequence
  Synthetic Polynucleotide
taatacgactcactatagggccccgaagctgtagtccaggatgtggcacaaacagaggagatgtgccatgtcctggactaacctggcggcagcgcaaaagatg

SEQ ID NO: 172751 - DNA, 103 bp, Artificial Sequence
  Synthetic Polynucleotide
taatacgactcactatagggccggccccacccccgaagctgtagtccaggaacagaggagacctggaatgcagcttcggaacctggcggcagcgcaaaagatg

SEQ ID NO: 172752 - DNA, 103 bp, Artificial Sequence
  Synthetic Polynucleotide
taatacgactcactatagggggcgcaggggttggaggcgcacgggtcagcaacagaggagagctgacatgtgcgcctccaacctggcggcagcgcaaaagatg

SEQ ID NO: 172753 - DNA, 103 bp, Artificial Sequence
  Synthetic Polynucleotide
taatacgactcactataggggatgtcgcgcccggccccacccccgaagctaacagaggagaagcttcatgggtggggccaacctggcggcagcgcaaaagatg

SEQ ID NO: 172754 - DNA, 103 bp, Artificial Sequence
  Synthetic Polynucleotide
taatacgactcactataggggcggcggggggatgtcgcgcccggccccacaacagaggagagtggggatgggcgcgacaaacctggcggcagcgcaaaagatg

SEQ ID NO: 172755 - DNA, 103 bp, Artificial Sequence
  Synthetic Polynucleotide
taatacgactcactatagggtcctcgatcagcggcggggggatgtcgcgcaacagaggagagcgcgaatgccccccgccaacctggcggcagcgcaaaagatg

SEQ ID NO: 172756 - DNA, 103 bp, Artificial Sequence
  Synthetic Polynucleotide
taatacgactcactatagggctcgcacgcctcctcgatcagcggcgggggaacagaggagacccccgatgctgatcgagaacctggcggcagcgcaaaagatg

SEQ ID NO: 172757 - DNA, 103 bp, Artificial Sequence
  Synthetic Polynucleotide
taatacgactcactatagggactcgggcagctcgcacgcctcctcgatcaaacagaggagatgatcgatgaggcgtgcgaacctggcggcagcgcaaaagatg

SEQ ID NO: 172758 - DNA, 103 bp, Artificial Sequence
  Synthetic Polynucleotide
taatacgactcactatagggtcctcctggcactcgggcagctcgcacgccaacagaggagaggcgtgatggctgcccgaaacctggcggcagcgcaaaagatg

SEQ ID NO: 172759 - DNA, 103 bp, Artificial Sequence
  Synthetic Polynucleotide
taatacgactcactataggggttgcccgcgtcctcctggcactcgggcagaacagaggagactgcccatgtgccaggagaacctggcggcagcgcaaaagatg

SEQ ID NO: 172760 - DNA, 103 bp, Artificial Sequence
  Synthetic Polynucleotide
taatacgactcactatagggtgcagaccttgttgcccgcgtcctcctggcaacagaggagagccaggatgacgcgggcaaacctggcggcagcgcaaaagatg

SEQ ID NO: 172761 - DNA, 103 bp, Artificial Sequence
  Synthetic Polynucleotide
taatacgactcactatagggcactgcaggctgcagaccttgttgcccgcgaacagaggagacgcgggatgcaaggtctgaacctggcggcagcgcaaaagatg

SEQ ID NO: 172762 - DNA, 103 bp, Artificial Sequence
  Synthetic Polynucleotide
taatacgactcactataggggtggttgttgcactgcaggctgcagaccttaacagaggagaaaggtcatgagcctgcagaacctggcggcagcgcaaaagatg

SEQ ID NO: 172763 - DNA, 103 bp, Artificial Sequence
  Synthetic Polynucleotide
taatacgactcactatagggggccaccgttggcgcaggggttggaggcgcaacagaggagagcgcctatgacccctgcgaacctggcggcagcgcaaaagatg

SEQ ID NO: 172764 - DNA, 103 bp, Artificial Sequence
  Synthetic Polynucleotide
taatacgactcactatagggagccgcacgcgtggttgttgcactgcaggcaacagaggagagcctgcatggcaacaaccaacctggcggcagcgcaaaagatg

SEQ ID NO: 172765 - DNA, 103 bp, Artificial Sequence
  Synthetic Polynucleotide
taatacgactcactatagggccgccgtcccagccgcacgcgtggttgttgaacagaggagacaacaaatgcgcgtgcggaacctggcggcagcgcaaaagatg

SEQ ID NO: 172766 - DNA, 103 bp, Artificial Sequence
  Synthetic Polynucleotide
taatacgactcactatagggggagcagtcaccgccgtcccagccgcacgcaacagaggagagcgtgcatgtgggacggcaacctggcggcagcgcaaaagatg

SEQ ID NO: 172767 - DNA, 103 bp, Artificial Sequence
  Synthetic Polynucleotide
taatacgactcactatagggtgaagttgagggagcagtcaccgccgtcccaacagaggagagggacgatggtgactgctaacctggcggcagcgcaaaagatg

SEQ ID NO: 172768 - DNA, 103 bp, Artificial Sequence
  Synthetic Polynucleotide
taatacgactcactatagggcaggggtcattgaagttgagggagcagtcaaacagaggagatgactgatgcctcaacttaacctggcggcagcgcaaaagatg

SEQ ID NO: 172769 - DNA, 103 bp, Artificial Sequence
  Synthetic Polynucleotide
taatacgactcactataggggcagttcttccaggggtcattgaagttgagaacagaggagactcaacatgaatgaccccaacctggcggcagcgcaaaagatg

SEQ ID NO: 172770 - DNA, 103 bp, Artificial Sequence
  Synthetic Polynucleotide
taatacgactcactataggggagactgcgtgcagttcttccaggggtcataacagaggagaatgaccatgggaagaactaacctggcggcagcgcaaaagatg

SEQ ID NO: 172771 - DNA, 103 bp, Artificial Sequence
  Synthetic Polynucleotide
taatacgactcactatagggcagcactgcagagactgcgtgcagttcttcaacagaggagagaagaaatgcacgcagtcaacctggcggcagcgcaaaagatg

SEQ ID NO: 172772 - DNA, 103 bp, Artificial Sequence
  Synthetic Polynucleotide
taatacgactcactataggggaagtacttccagcactgcagagactgcgtaacagaggagaacgcagatgctgcagtgcaacctggcggcagcgcaaaagatg

SEQ ID NO: 172773 - DNA, 103 bp, Artificial Sequence
  Synthetic Polynucleotide
taatacgactcactatagggggccgtcactgaagtacttccagcactgcaaacagaggagatgcagtatgggaagtactaacctggcggcagcgcaaaagatg

SEQ ID NO: 172774 - DNA, 103 bp, Artificial Sequence
  Synthetic Polynucleotide
taatacgactcactatagggggcaggcactggccaccgttggcgcaggggaacagaggagacccctgatgcaacggtggaacctggcggcagcgcaaaagatg

SEQ ID NO: 172775 - DNA, 103 bp, Artificial Sequence
  Synthetic Polynucleotide
taatacgactcactatagggctgtcacagtggccgtcactgaagtacttcaacagaggagagaagtaatgcagtgacggaacctggcggcagcgcaaaagatg

SEQ ID NO: 172776 - DNA, 103 bp, Artificial Sequence
  Synthetic Polynucleotide
taatacgactcactataggggttgcactggctgtcacagtggccgtcactaacagaggagaagtgacatgcactgtgacaacctggcggcagcgcaaaagatg

SEQ ID NO: 172777 - DNA, 103 bp, Artificial Sequence
  Synthetic Polynucleotide
taatacgactcactatagggagccggctgagttgcactggctgtcacagtaacagaggagaactgtgatggccagtgcaaacctggcggcagcgcaaaagatg

SEQ ID NO: 172778 - DNA, 103 bp, Artificial Sequence
  Synthetic Polynucleotide
taatacgactcactatagggtcgaagaggcagccggctgagttgcactggaacagaggagaccagtgatgctcagccggaacctggcggcagcgcaaaagatg

SEQ ID NO: 172779 - DNA, 103 bp, Artificial Sequence
  Synthetic Polynucleotide
taatacgactcactataggggtcaaagccgtcgaagaggcagccggctgaaacagaggagatcagccatgtgcctcttcaacctggcggcagcgcaaaagatg

SEQ ID NO: 172780 - DNA, 103 bp, Artificial Sequence
  Synthetic Polynucleotide
taatacgactcactatagggcacgctggcagtcaaagccgtcgaagaggcaacagaggagagcctctatgacggctttgaacctggcggcagcgcaaaagatg

SEQ ID NO: 172781 - DNA, 103 bp, Artificial Sequence
  Synthetic Polynucleotide
taatacgactcactatagggtggccttccgcacgctggcagtcaaagccgaacagaggagacggcttatgctgccagcgaacctggcggcagcgcaaaagatg

SEQ ID NO: 172782 - DNA, 103 bp, Artificial Sequence
  Synthetic Polynucleotide
taatacgactcactatagggggggttgcactggccttccgcacgctggcaaacagaggagatgccagatggcggaaggcaacctggcggcagcgcaaaagatg

SEQ ID NO: 172783 - DNA, 103 bp, Artificial Sequence
  Synthetic Polynucleotide
taatacgactcactatagggggtcgtacagggggttgcactggccttccgaacagaggagacggaagatgagtgcaaccaacctggcggcagcgcaaaagatg

SEQ ID NO: 172784 - DNA, 103 bp, Artificial Sequence
  Synthetic Polynucleotide
taatacgactcactatagggttgcagtactggtcgtacagggggttgcacaacagaggagagtgcaaatgcctgtacgaaacctggcggcagcgcaaaagatg

SEQ ID NO: 172785 - DNA, 103 bp, Artificial Sequence
  Synthetic Polynucleotide
taatacgactcactatagggggcctcgaagggcaggcactggccaccgttaacagaggagaaacggtatgcagtgcctgaacctggcggcagcgcaaaagatg

SEQ ID NO: 172786 - DNA, 103 bp, Artificial Sequence
  Synthetic Polynucleotide
taatacgactcactataggggaagtggtccttgcagtactggtcgtacagaacagaggagactgtacatgcagtactgcaacctggcggcagcgcaaaagatg

SEQ ID NO: 172787 - DNA, 103 bp, Artificial Sequence
  Synthetic Polynucleotide
taatacgactcactataggggcccgtcgctgaagtggtccttgcagtactaacagaggagaagtactatgaggaccactaacctggcggcagcgcaaaagatg

SEQ ID NO: 172788 - DNA, 103 bp, Artificial Sequence
  Synthetic Polynucleotide
taatacgactcactatagggtggtcgcagtgcccgtcgctgaagtggtccaacagaggagaggaccaatgcagcgacggaacctggcggcagcgcaaaagatg

SEQ ID NO: 172789 - DNA, 103 bp, Artificial Sequence
  Synthetic Polynucleotide
taatacgactcactataggggttgcagccctggtcgcagtgcccgtcgctaacagaggagaagcgacatgcactgcgacaacctggcggcagcgcaaaagatg

SEQ ID NO: 172790 - DNA, 103 bp, Artificial Sequence
  Synthetic Polynucleotide
taatacgactcactatagggactccgcgctgttgcagccctggtcgcagtaacagaggagaactgcgatgagggctgcaaacctggcggcagcgcaaaagatg

SEQ ID NO: 172791 - DNA, 103 bp, Artificial Sequence
  Synthetic Polynucleotide
taatacgactcactatagggtcccactcgcactccgcgctgttgcagcccaacagaggagagggctgatgcagcgcggaaacctggcggcagcgcaaaagatg

SEQ ID NO: 172792 - DNA, 103 bp, Artificial Sequence
  Synthetic Polynucleotide
taatacgactcactataggggtccagcccgtcccactcgcactccgcgctaacagaggagaagcgcgatgtgcgagtggaacctggcggcagcgcaaaagatg

SEQ ID NO: 172793 - DNA, 103 bp, Artificial Sequence
  Synthetic Polynucleotide
taatacgactcactataggggctccgcacagtccagcccgtcccactcgcaacagaggagagcgagtatgacgggctggaacctggcggcagcgcaaaagatg

SEQ ID NO: 172794 - DNA, 103 bp, Artificial Sequence
  Synthetic Polynucleotide
taatacgactcactatagggtcgggtacatgctccgcacagtccagcccgaacagaggagacgggctatgctgtgcggaaacctggcggcagcgcaaaagatg

SEQ ID NO: 172795 - DNA, 103 bp, Artificial Sequence
  Synthetic Polynucleotide
taatacgactcactatagggcgccagcctctcgggtacatgctccgcacaaacagaggagatgtgcgatgcatgtacccaacctggcggcagcgcaaaagatg

SEQ ID NO: 172796 - DNA, 103 bp, Artificial Sequence
  Synthetic Polynucleotide
taatacgactcactatagggagatgtaggaggcctcgaagggcaggcactaacagaggagaagtgccatgccttcgaggaacctggcggcagcgcaaaagatg

SEQ ID NO: 172797 - DNA, 103 bp, Artificial Sequence
  Synthetic Polynucleotide
taatacgactcactataggggcgtgccggccgccagcctctcgggtacataacagaggagaatgtacatgagaggctggaacctggcggcagcgcaaaagatg

SEQ ID NO: 172798 - DNA, 103 bp, Artificial Sequence
  Synthetic Polynucleotide
taatacgactcactatagggaccaccaccagcgtgccggccgccagcctcaacagaggagagaggctatgggccggcacaacctggcggcagcgcaaaagatg

SEQ ID NO: 172799 - DNA, 103 bp, Artificial Sequence
  Synthetic Polynucleotide
taatacgactcactatagggcatcagcaccaccaccaccagcgtgccggcaacagaggagagccggcatgctggtggtgaacctggcggcagcgcaaaagatg

SEQ ID NO: 172800 - DNA, 103 bp, Artificial Sequence
  Synthetic Polynucleotide
taatacgactcactataggggctccggcggcatcagcaccaccaccaccaaacagaggagatggtggatgtggtgctgaaacctggcggcagcgcaaaagatg

SEQ ID NO: 172801 - DNA, 103 bp, Artificial Sequence
  Synthetic Polynucleotide
taatacgactcactatagggttgcgcagctgctccggcggcatcagcaccaacagaggagaggtgctatggccgccggaaacctggcggcagcgcaaaagatg

SEQ ID NO: 172802 - DNA, 103 bp, Artificial Sequence
  Synthetic Polynucleotide
taatacgactcactataggggaaggagctgttgcgcagctgctccggcggaacagaggagaccgccgatgcagctgcgcaacctggcggcagcgcaaaagatg

SEQ ID NO: 172803 - DNA, 103 bp, Artificial Sequence
  Synthetic Polynucleotide
taatacgactcactataggggcaggaagtggaaggagctgttgcgcagctaacagaggagaagctgcatgacagctcctaacctggcggcagcgcaaaagatg

SEQ ID NO: 172804 - DNA, 103 bp, Artificial Sequence
  Synthetic Polynucleotide
taatacgactcactatagggctgagctcccgcaggaagtggaaggagctgaacagaggagacagctcatgccacttcctaacctggcggcagcgcaaaagatg

SEQ ID NO: 172805 - DNA, 103 bp, Artificial Sequence
  Synthetic Polynucleotide
taatacgactcactatagggcagcacgcggctgagctcccgcaggaagtgaacagaggagacacttcatgcgggagctcaacctggcggcagcgcaaaagatg

SEQ ID NO: 172806 - DNA, 103 bp, Artificial Sequence
  Synthetic Polynucleotide
taatacgactcactatagggcgttggtgtgcagcacgcggctgagctcccaacagaggagagggagcatggccgcgtgcaacctggcggcagcgcaaaagatg

SEQ ID NO: 172807 - DNA, 103 bp, Artificial Sequence
  Synthetic Polynucleotide
taatacgactcactataggggggcagtggcagatgtaggaggcctcgaagaacagaggagacttcgaatgctcctacataacctggcggcagcgcaaaagatg

SEQ ID NO: 172808 - DNA, 103 bp, Artificial Sequence
  Synthetic Polynucleotide
taatacgactcactatagggttgaagaccacgttggtgtgcagcacgcggaacagaggagaccgcgtatggcacaccaaaacctggcggcagcgcaaaagatg

SEQ ID NO: 172809 - DNA, 103 bp, Artificial Sequence
  Synthetic Polynucleotide
taatacgactcactatagggtgcgtcacgcttgaagaccacgttggtgtgaacagaggagacacaccatggtggtcttcaacctggcggcagcgcaaaagatg

SEQ ID NO: 172810 - DNA, 103 bp, Artificial Sequence
  Synthetic Polynucleotide
taatacgactcactataggggctggccgtgtgcgtcacgcttgaagaccaaacagaggagatggtctatgagcgtgacgaacctggcggcagcgcaaaagatg

SEQ ID NO: 172811 - DNA, 103 bp, Artificial Sequence
  Synthetic Polynucleotide
taatacgactcactatagggaagatcatctgctggccgtgtgcgtcacgcaacagaggagagcgtgaatgacacggccaaacctggcggcagcgcaaaagatg

SEQ ID NO: 172812 - DNA, 103 bp, Artificial Sequence
  Synthetic Polynucleotide
taatacgactcactataggggtagtaggggaagatcatctgctggccgtgaacagaggagacacggcatgcagatgatcaacctggcggcagcgcaaaagatg

SEQ ID NO: 172813 - DNA, 103 bp, Artificial Sequence
  Synthetic Polynucleotide
taatacgactcactatagggcctcgcggccgtagtaggggaagatcatctaacagaggagaagatgaatgtcccctactaacctggcggcagcgcaaaagatg

SEQ ID NO: 172814 - DNA, 103 bp, Artificial Sequence
  Synthetic Polynucleotide
taatacgactcactatagggcgcagctcctcctcgcggccgtagtaggggaacagaggagacccctaatgcggccgcgaaacctggcggcagcgcaaaagatg

SEQ ID NO: 172815 - DNA, 103 bp, Artificial Sequence
  Synthetic Polynucleotide
taatacgactcactatagggggggtgcttgcgcagctcctcctcgcggccaacagaggagaggccgcatggaggagctgaacctggcggcagcgcaaaagatg

SEQ ID NO: 172816 - DNA, 103 bp, Artificial Sequence
  Synthetic Polynucleotide
taatacgactcactatagggcacgcttgatggggtgcttgcgcagctcctaacagaggagaaggagcatggcaagcaccaacctggcggcagcgcaaaagatg

SEQ ID NO: 172817 - DNA, 103 bp, Artificial Sequence
  Synthetic Polynucleotide
taatacgactcactatagggccctcggcggcacgcttgatggggtgcttgaacagaggagacaagcaatgcatcaagcgaacctggcggcagcgcaaaagatg

SEQ ID NO: 172818 - DNA, 103 bp, Artificial Sequence
  Synthetic Polynucleotide
taatacgactcactataggggaagctgggtgggcagtggcagatgtaggaaacagaggagatcctacatgtgccactgcaacctggcggcagcgcaaaagatg

SEQ ID NO: 172819 - DNA, 103 bp, Artificial Sequence
  Synthetic Polynucleotide
taatacgactcactatagggtgcggcccagccctcggcggcacgcttgataacagaggagaatcaagatggccgccgagaacctggcggcagcgcaaaagatg

SEQ ID NO: 172820 - DNA, 103 bp, Artificial Sequence
  Synthetic Polynucleotide
taatacgactcactataggggggcgtcaggtgcggcccagccctcggcggaacagaggagaccgccgatggctgggccgaacctggcggcagcgcaaaagatg

SEQ ID NO: 172821 - DNA, 103 bp, Artificial Sequence
  Synthetic Polynucleotide
taatacgactcactatagggtggcccagcagggcgtcaggtgcggcccagaacagaggagactgggcatgacctgacgcaacctggcggcagcgcaaaagatg

SEQ ID NO: 172822 - DNA, 103 bp, Artificial Sequence
  Synthetic Polynucleotide
taatacgactcactatagggggccttcacctggcccagcagggcgtcaggaacagaggagacctgacatgctgctgggcaacctggcggcagcgcaaaagatg

SEQ ID NO: 172823 - DNA, 103 bp, Artificial Sequence
  Synthetic Polynucleotide
taatacgactcactatagggggagcagcgaggccttcacctggcccagcaaacagaggagatgctggatgaggtgaaggaacctggcggcagcgcaaaagatg

SEQ ID NO: 172824 - DNA, 103 bp, Artificial Sequence
  Synthetic Polynucleotide
taatacgactcactatagggctgccaccagggagcagcgaggccttcaccaacagaggagaggtgaaatgctcgctgctaacctggcggcagcgcaaaagatg

SEQ ID NO: 172825 - DNA, 103 bp, Artificial Sequence
  Synthetic Polynucleotide
taatacgactcactatagggcccaccctcgctgccaccagggagcagcgaaacagaggagatcgctgatgcctggtggcaacctggcggcagcgcaaaagatg

SEQ ID NO: 172826 - DNA, 103 bp, Artificial Sequence
  Synthetic Polynucleotide
taatacgactcactatagggtccgccgccgcccaccctcgctgccaccagaacagaggagactggtgatggcgagggtgaacctggcggcagcgcaaaagatg

SEQ ID NO: 172827 - DNA, 103 bp, Artificial Sequence
  Synthetic Polynucleotide
taatacgactcactatagggtccagctccctccgccgccgcccaccctcgaacagaggagacgagggatggcggcggcgaacctggcggcagcgcaaaagatg

SEQ ID NO: 172828 - DNA, 103 bp, Artificial Sequence
  Synthetic Polynucleotide
taatacgactcactataggggtccatggggtccagctccctccgccgccgaacagaggagacggcggatgagggagctgaacctggcggcagcgcaaaagatg

SEQ ID NO: 172829 - DNA, 103 bp, Artificial Sequence
  Synthetic Polynucleotide
taatacgactcactatagggatcgcgggcctcgtgcggcgagcgcgggcaaacagaggagatgcccgatgtcgccgcacaacctggcggcagcgcaaaagatg

SEQ ID NO: 172830 - DNA, 103 bp, Artificial Sequence
  Synthetic Polynucleotide
taatacgactcactatagggtggggccatggaagctgggtgggcagtggcaacagaggagagccactatgcacccagctaacctggcggcagcgcaaaagatg

SEQ ID NO: 172831 - DNA, 103 bp, Artificial Sequence
  Synthetic Polynucleotide
taatacgactcactatagggagccgcggacgtccatggggtccagctcccaacagaggagagggagcatgaccccatggaacctggcggcagcgcaaaagatg

SEQ ID NO: 172832 - DNA, 103 bp, Artificial Sequence
  Synthetic Polynucleotide
taatacgactcactatagggtagacgatggagccgcggacgtccatggggaacagaggagaccccatatgcgtccgcggaacctggcggcagcgcaaaagatg

SEQ ID NO: 172833 - DNA, 103 bp, Artificial Sequence
  Synthetic Polynucleotide
taatacgactcactatagggaatctccaggtagacgatggagccgcggacaacagaggagagtccgcatgtccatcgtcaacctggcggcagcgcaaaagatg

SEQ ID NO: 172834 - DNA, 103 bp, Artificial Sequence
  Synthetic Polynucleotide
taatacgactcactataggggccggttgtcaatctccaggtagacgatggaacagaggagaccatcgatgacctggagaaacctggcggcagcgcaaaagatg

SEQ ID NO: 172835 - DNA, 103 bp, Artificial Sequence
  Synthetic Polynucleotide
taatacgactcactatagggtgcacacactgccggttgtcaatctccaggaacagaggagacctggaatgtgacaaccgaacctggcggcagcgcaaaagatg

SEQ ID NO: 172836 - DNA, 103 bp, Artificial Sequence
  Synthetic Polynucleotide
taatacgactcactatagggcgaggaggcctgcacacactgccggttgtcaacagaggagagacaacatgcagtgtgtgaacctggcggcagcgcaaaagatg

SEQ ID NO: 172837 - DNA, 103 bp, Artificial Sequence
  Synthetic Polynucleotide
taatacgactcactatagggggaagcactgcgaggaggcctgcacacactaacagaggagaagtgtgatgaggcctcctaacctggcggcagcgcaaaagatg

SEQ ID NO: 172838 - DNA, 103 bp, Artificial Sequence
  Synthetic Polynucleotide
taatacgactcactataggggtggcactctggaagcactgcgaggaggccaacagaggagaggcctcatggcagtgcttaacctggcggcagcgcaaaagatg

SEQ ID NO: 172839 - DNA, 103 bp, Artificial Sequence
  Synthetic Polynucleotide
taatacgactcactatagggggccacgtcggtggcactctggaagcactgaacagaggagacagtgcatgcagagtgccaacctggcggcagcgcaaaagatg

SEQ ID NO: 172840 - DNA, 103 bp, Artificial Sequence
  Synthetic Polynucleotide
taatacgactcactatagggccaggaatgcggccacgtcggtggcactctaacagaggagaagagtgatgccgacgtggaacctggcggcagcgcaaaagatg

SEQ ID NO: 172841 - DNA, 103 bp, Artificial Sequence
  Synthetic Polynucleotide
taatacgactcactatagggtgccggcaggtggggccatggaagctgggtaacagaggagaacccagatgccatggcccaacctggcggcagcgcaaaagatg

SEQ ID NO: 172842 - DNA, 103 bp, Artificial Sequence
  Synthetic Polynucleotide
taatacgactcactataggggcgagcgctcccaggaatgcggccacgtcgaacagaggagacgacgtatgcgcattcctaacctggcggcagcgcaaaagatg

SEQ ID NO: 172843 - DNA, 103 bp, Artificial Sequence
  Synthetic Polynucleotide
taatacgactcactataggggcccagcgaggcgagcgctcccaggaatgcaacagaggagagcattcatgggagcgctcaacctggcggcagcgcaaaagatg

SEQ ID NO: 172844 - DNA, 103 bp, Artificial Sequence
  Synthetic Polynucleotide
taatacgactcactatagggtgttgaggctgcccagcgaggcgagcgctcaacagaggagagagcgcatgcctcgctggaacctggcggcagcgcaaaagatg

SEQ ID NO: 172845 - DNA, 103 bp, Artificial Sequence
  Synthetic Polynucleotide
taatacgactcactatagggttgtaggggatgttgaggctgcccagcgagaacagaggagactcgctatgcagcctcaaaacctggcggcagcgcaaaagatg

SEQ ID NO: 172846 - DNA, 103 bp, Artificial Sequence
  Synthetic Polynucleotide
taatacgactcactatagggggcctcgatcttgtaggggatgttgaggctaacagaggagaagcctcatgatcccctacaacctggcggcagcgcaaaagatg

SEQ ID NO: 172847 - DNA, 103 bp, Artificial Sequence
  Synthetic Polynucleotide
taatacgactcactatagggcactctgcacggcctcgatcttgtaggggaaacagaggagatcccctatgagatcgaggaacctggcggcagcgcaaaagatg

SEQ ID NO: 172848 - DNA, 103 bp, Artificial Sequence
  Synthetic Polynucleotide
taatacgactcactatagggtccacggtctcactctgcacggcctcgatcaacagaggagagatcgaatgcgtgcagagaacctggcggcagcgcaaaagatg

SEQ ID NO: 172849 - DNA, 103 bp, Artificial Sequence
  Synthetic Polynucleotide
taatacgactcactatagggcgggggcggctccacggtctcactctgcacaacagaggagagtgcagatggagaccgtgaacctggcggcagcgcaaaagatg

SEQ ID NO: 172850 - DNA, 103 bp, Artificial Sequence
  Synthetic Polynucleotide
taatacgactcactataggggctgcgccggcgggggcggctccacggtctaacagaggagaagaccgatgagccgccccaacctggcggcagcgcaaaagatg

SEQ ID NO: 172851 - DNA, 103 bp, Artificial Sequence
  Synthetic Polynucleotide
taatacgactcactatagggatgaagtgcagctgcgccggcgggggcggcaacagaggagagccgccatggccggcgcaaacctggcggcagcgcaaaagatg

SEQ ID NO: 172852 - DNA, 103 bp, Artificial Sequence
  Synthetic Polynucleotide
taatacgactcactataggggttgacatcctgccggcaggtggggccatgaacagaggagacatggcatgacctgccggaacctggcggcagcgcaaaagatg

SEQ ID NO: 172853 - DNA, 103 bp, Artificial Sequence
  Synthetic Polynucleotide
taatacgactcactatagggcgccacgtacatgaagtgcagctgcgccggaacagaggagaccggcgatgctgcacttcaacctggcggcagcgcaaaagatg

SEQ ID NO: 172854 - DNA, 103 bp, Artificial Sequence
  Synthetic Polynucleotide
taatacgactcactatagggaggcggccgccgccacgtacatgaagtgcaaacagaggagatgcactatgtgtacgtggaacctggcggcagcgcaaaagatg

SEQ ID NO: 172855 - DNA, 103 bp, Artificial Sequence
  Synthetic Polynucleotide
taatacgactcactatagggagaagcacaaaggcggccgccgccacgtacaacagaggagagtacgtatgggcggccgcaacctggcggcagcgcaaaagatg

SEQ ID NO: 172856 - DNA, 103 bp, Artificial Sequence
  Synthetic Polynucleotide
taatacgactcactatagggcacgaagaacagaagcacaaaggcggccgcaacagaggagagcggccatgtttgtgcttaacctggcggcagcgcaaaagatg

SEQ ID NO: 172857 - DNA, 103 bp, Artificial Sequence
  Synthetic Polynucleotide
taatacgactcactatagggccccgcagcccacgaagaacagaagcacaaaacagaggagattgtgcatgtgttcttcgaacctggcggcagcgcaaaagatg

SEQ ID NO: 172858 - DNA, 103 bp, Artificial Sequence
  Synthetic Polynucleotide
taatacgactcactataggggacagcagcaccccgcagcccacgaagaacaacagaggagagttcttatggggctgcggaacctggcggcagcgcaaaagatg

SEQ ID NO: 172859 - DNA, 103 bp, Artificial Sequence
  Synthetic Polynucleotide
taatacgactcactataggggcgcttgcgggacagcagcaccccgcagccaacagaggagaggctgcatggtgctgctgaacctggcggcagcgcaaaagatg

SEQ ID NO: 172860 - DNA, 103 bp, Artificial Sequence
  Synthetic Polynucleotide
taatacgactcactataggggctgccgccggcgcttgcgggacagcagcaaacagaggagatgctgcatgcccgcaagcaacctggcggcagcgcaaaagatg

SEQ ID NO: 172861 - DNA, 103 bp, Artificial Sequence
  Synthetic Polynucleotide
taatacgactcactatagggagctggccatgctgccgccggcgcttgcggaacagaggagaccgcaaatgccggcggcaaacctggcggcagcgcaaaagatg

SEQ ID NO: 172862 - DNA, 103 bp, Artificial Sequence
  Synthetic Polynucleotide
taatacgactcactatagggagggaaccagagctggccatgctgccgccgaacagaggagacggcggatgcatggccagaacctggcggcagcgcaaaagatg

SEQ ID NO: 172863 - DNA, 103 bp, Artificial Sequence
  Synthetic Polynucleotide
taatacgactcactatagggggccacactcgttgacatcctgccggcaggaacagaggagacctgccatgaggatgtcaaacctggcggcagcgcaaaagatg

SEQ ID NO: 172864 - DNA, 103 bp, Artificial Sequence
  Synthetic Polynucleotide
taatacgactcactatagggtgaagccctcagggaaccagagctggccataacagaggagaatggccatgtctggttccaacctggcggcagcgcaaaagatg

SEQ ID NO: 172865 - DNA, 103 bp, Artificial Sequence
  Synthetic Polynucleotide
taatacgactcactatagggtcagacactttgaagccctcagggaaccagaacagaggagactggttatgtgagggcttaacctggcggcagcgcaaaagatg

SEQ ID NO: 172866 - DNA, 103 bp, Artificial Sequence
  Synthetic Polynucleotide
taatacgactcactatagggcttgctggcctcagacactttgaagccctcaacagaggagagagggcatgaaagtgtctaacctggcggcagcgcaaaagatg

SEQ ID NO: 172867 - DNA, 103 bp, Artificial Sequence
  Synthetic Polynucleotide
taatacgactcactataggggccgcttcttcttgctggcctcagacacttaacagaggagaaagtgtatgaggccagcaaacctggcggcagcgcaaaagatg

SEQ ID NO: 172868 - DNA, 103 bp, Artificial Sequence
  Synthetic Polynucleotide
taatacgactcactatagggaggggctcccgccgcttcttcttgctggccaacagaggagaggccagatggaagaagcgaacctggcggcagcgcaaaagatg

SEQ ID NO: 172869 - DNA, 103 bp, Artificial Sequence
  Synthetic Polynucleotide
taatacgactcactataggggtcctcgccgaggggctcccgccgcttcttaacagaggagaaagaagatgcgggagcccaacctggcggcagcgcaaaagatg

SEQ ID NO: 172870 - DNA, 103 bp, Artificial Sequence
  Synthetic Polynucleotide
taatacgactcactatagggggcccacggagtcctcgccgaggggctcccaacagaggagagggagcatgtcggcgaggaacctggcggcagcgcaaaagatg

SEQ ID NO: 172871 - DNA, 103 bp, Artificial Sequence
  Synthetic Polynucleotide
taatacgactcactatagggaggggcttgaggcccacggagtcctcgccgaacagaggagacggcgaatgctccgtgggaacctggcggcagcgcaaaagatg

SEQ ID NO: 172872 - DNA, 103 bp, Artificial Sequence
  Synthetic Polynucleotide
taatacgactcactatagggagcgttcttcaggggcttgaggcccacggaaacagaggagatccgtgatgctcaagcccaacctggcggcagcgcaaaagatg

SEQ ID NO: 172873 - DNA, 103 bp, Artificial Sequence
  Synthetic Polynucleotide
taatacgactcactatagggcaccgtctgaagcgttcttcaggggcttgaaacagaggagatcaagcatgtgaagaacgaacctggcggcagcgcaaaagatg

SEQ ID NO: 172874 - DNA, 103 bp, Artificial Sequence
  Synthetic Polynucleotide
taatacgactcactatagggccgggcttctggccacactcgttgacatccaacagaggagaggatgtatgcgagtgtggaacctggcggcagcgcaaaagatg

SEQ ID NO: 172875 - DNA, 103 bp, Artificial Sequence
  Synthetic Polynucleotide
taatacgactcactatagggtccatgagggcaccgtctgaagcgttcttcaacagaggagagaagaaatgttcagacggaacctggcggcagcgcaaaagatg

SEQ ID NO: 172876 - DNA, 103 bp, Artificial Sequence
  Synthetic Polynucleotide
taatacgactcactatagggctggttgtcgtccatgagggcaccgtctgaaacagaggagatcagacatggccctcatgaacctggcggcagcgcaaaagatg

SEQ ID NO: 172877 - DNA, 103 bp, Artificial Sequence
  Synthetic Polynucleotide
taatacgactcactatagggcccactcattctggttgtcgtccatgagggaacagaggagaccctcaatgacgacaaccaacctggcggcagcgcaaaagatg

SEQ ID NO: 172878 - DNA, 103 bp, Artificial Sequence
  Synthetic Polynucleotide
taatacgactcactatagggtcctcgtccccccactcattctggttgtcgaacagaggagacgacaaatggaatgagtgaacctggcggcagcgcaaaagatg

SEQ ID NO: 172879 - DNA, 103 bp, Artificial Sequence
  Synthetic Polynucleotide
taatacgactcactatagggggtctccaggtcctcgtccccccactcattaacagaggagaaatgagatgggggacgagaacctggcggcagcgcaaaagatg

SEQ ID NO: 172880 - DNA, 103 bp, Artificial Sequence
  Synthetic Polynucleotide
taatacgactcactatagggggaacttcttggtctccaggtcctcgtcccaacagaggagagggacgatgacctggagaaacctggcggcagcgcaaaagatg

SEQ ID NO: 172881 - DNA, 103 bp, Artificial Sequence
  Synthetic Polynucleotide
taatacgactcactatagggtcctcgaaccggaacttcttggtctccaggaacagaggagacctggaatgcaagaagttaacctggcggcagcgcaaaagatg

SEQ ID NO: 172882 - DNA, 103 bp, Artificial Sequence
  Synthetic Polynucleotide
taatacgactcactatagggaaccacgggctcctcgaaccggaacttcttaacagaggagaaagaagatgcggttcgagaacctggcggcagcgcaaaagatg

SEQ ID NO: 172883 - DNA, 103 bp, Artificial Sequence
  Synthetic Polynucleotide
taatacgactcactatagggggtcaggcagaaccacgggctcctcgaaccaacagaggagaggttcgatgagcccgtggaacctggcggcagcgcaaaagatg

SEQ ID NO: 172884 - DNA, 103 bp, Artificial Sequence
  Synthetic Polynucleotide
taatacgactcactatagggtggtcgtccaggtcaggcagaaccacgggcaacagaggagagcccgtatgtctgcctgaaacctggcggcagcgcaaaagatg

SEQ ID NO: 172885 - DNA, 103 bp, Artificial Sequence
  Synthetic Polynucleotide
taatacgactcactataggggcggcaaagcccgggcttctggccacactcaacagaggagagagtgtatgcagaagcccaacctggcggcagcgcaaaagatg

SEQ ID NO: 172886 - DNA, 103 bp, Artificial Sequence
  Synthetic Polynucleotide
taatacgactcactataggggtggtctgtctggtcgtccaggtcaggcagaacagaggagactgcctatgctggacgacaacctggcggcagcgcaaaagatg

SEQ ID NO: 172887 - DNA, 103 bp, Artificial Sequence
  Synthetic Polynucleotide
taatacgactcactatagggtccactgccggtggtctgtctggtcgtccaaacagaggagatggacgatgagacagaccaacctggcggcagcgcaaaagatg

SEQ ID NO: 172888 - DNA, 103 bp, Artificial Sequence
  Synthetic Polynucleotide
taatacgactcactatagggtgctgctgagtccactgccggtggtctgtcaacagaggagagacagaatgccggcagtgaacctggcggcagcgcaaaagatg

SEQ ID NO: 172889 - DNA, 103 bp, Artificial Sequence
  Synthetic Polynucleotide
taatacgactcactatagggggcatccaggtgctgctgagtccactgccgaacagaggagacggcagatgactcagcagaacctggcggcagcgcaaaagatg

SEQ ID NO: 172890 - DNA, 103 bp, Artificial Sequence
  Synthetic Polynucleotide
taatacgactcactataggggcaggtcagcggcatccaggtgctgctgagaacagaggagactcagcatgacctggatgaacctggcggcagcgcaaaagatg

SEQ ID NO: 172891 - DNA, 103 bp, Artificial Sequence
  Synthetic Polynucleotide
taatacgactcactataggggcagacatgcgcaggtcagcggcatccaggaacagaggagacctggaatgcgctgacctaacctggcggcagcgcaaaagatg

SEQ ID NO: 172892 - DNA, 103 bp, Artificial Sequence
  Synthetic Polynucleotide
taatacgactcactataggggggggccatggcagacatgcgcaggtcagcaacagaggagagctgacatgcgcatgtctaacctggcggcagcgcaaaagatg

SEQ ID NO: 172893 - DNA, 103 bp, Artificial Sequence
  Synthetic Polynucleotide
taatacgactcactatagggggggcggtgtgggggccatggcagacatgcaacagaggagagcatgtatgccatggcccaacctggcggcagcgcaaaagatg

SEQ ID NO: 172894 - DNA, 103 bp, Artificial Sequence
  Synthetic Polynucleotide
taatacgactcactatagggacctcaccctggggcggtgtgggggccatgaacagaggagacatggcatgcacaccgccaacctggcggcagcgcaaaagatg

SEQ ID NO: 172895 - DNA, 103 bp, Artificial Sequence
  Synthetic Polynucleotide
taatacgactcactataggggtcggcgtcaacctcaccctggggcggtgtaacagaggagaacaccgatgcagggtgagaacctggcggcagcgcaaaagatg

SEQ ID NO: 172896 - DNA, 103 bp, Artificial Sequence
  Synthetic Polynucleotide
taatacgactcactatagggtgcctccgtggcggcaaagcccgggcttctaacagaggagaagaagcatgggctttgccaacctggcggcagcgcaaaagatg

SEQ ID NO: 172897 - DNA, 103 bp, Artificial Sequence
  Synthetic Polynucleotide
taatacgactcactatagggcgtccatgcagtcggcgtcaacctcaccctaacagaggagaagggtgatgttgacgccgaacctggcggcagcgcaaaagatg

SEQ ID NO: 172898 - DNA, 103 bp, Artificial Sequence
  Synthetic Polynucleotide
taatacgactcactatagggcggacattgacgtccatgcagtcggcgtcaaacagaggagatgacgcatgctgcatggaaacctggcggcagcgcaaaagatg

SEQ ID NO: 172899 - DNA, 103 bp, Artificial Sequence
  Synthetic Polynucleotide
taatacgactcactatagggatcaggcccgcggacattgacgtccatgcaaacagaggagatgcatgatggtcaatgtcaacctggcggcagcgcaaaagatg

SEQ ID NO: 172900 - DNA, 103 bp, Artificial Sequence
  Synthetic Polynucleotide
taatacgactcactataggggggtgaagccatcaggcccgcggacattgaaacagaggagatcaatgatggcgggcctgaacctggcggcagcgcaaaagatg

SEQ ID NO: 172901 - DNA, 103 bp, Artificial Sequence
  Synthetic Polynucleotide
taatacgactcactatagggatcatgagcggggtgaagccatcaggcccgaacagaggagacgggccatgtggcttcacaacctggcggcagcgcaaaagatg

SEQ ID NO: 172902 - DNA, 103 bp, Artificial Sequence
  Synthetic Polynucleotide
taatacgactcactataggggcaggaggcgatcatgagcggggtgaagccaacagaggagaggcttcatgccgctcatgaacctggcggcagcgcaaaagatg

SEQ ID NO: 172903 - DNA, 103 bp, Artificial Sequence
  Synthetic Polynucleotide
taatacgactcactatagggcgcccccgctgcaggaggcgatcatgagcgaacagaggagacgctcaatgtcgcctcctaacctggcggcagcgcaaaagatg

SEQ ID NO: 172904 - DNA, 103 bp, Artificial Sequence
  Synthetic Polynucleotide
taatacgactcactataggggtctccaggccgcccccgctgcaggaggcgaacagaggagacgcctcatgcagcgggggaacctggcggcagcgcaaaagatg

SEQ ID NO: 172905 - DNA, 103 bp, Artificial Sequence
  Synthetic Polynucleotide
taatacgactcactataggggctgttgcccgtctccaggccgcccccgctaacagaggagaagcgggatgggcctggagaacctggcggcagcgcaaaagatg

SEQ ID NO: 172906 - DNA, 103 bp, Artificial Sequence
  Synthetic Polynucleotide
taatacgactcactatagggcctcttcctcgctgttgcccgtctccaggcaacagaggagagcctggatgcgggcaacaaacctggcggcagcgcaaaagatg

SEQ ID NO: 172907 - DNA, 103 bp, Artificial Sequence
  Synthetic Polynucleotide
taatacgactcactatagggttgtggcaggtgcctccgtggcggcaaagcaacagaggagagctttgatgccacggaggaacctggcggcagcgcaaaagatg

SEQ ID NO: 172908 - DNA, 103 bp, Artificial Sequence
  Synthetic Polynucleotide
taatacgactcactatagggggcgcgtcctcctcttcctcgctgttgcccaacagaggagagggcaaatgcgaggaagaaacctggcggcagcgcaaaagatg

SEQ ID NO: 172909 - DNA, 103 bp, Artificial Sequence
  Synthetic Polynucleotide
taatacgactcactataggggatgacggccggcgcgtcctcctcttcctcaacagaggagagaggaaatggaggacgcgaacctggcggcagcgcaaaagatg

SEQ ID NO: 172910 - DNA, 103 bp, Artificial Sequence
  Synthetic Polynucleotide
taatacgactcactatagggtgaagtcggagatgacggccggcgcgtcctaacagaggagaaggacgatgcggccgtcaaacctggcggcagcgcaaaagatg

SEQ ID NO: 172911 - DNA, 103 bp, Artificial Sequence
  Synthetic Polynucleotide
taatacgactcactatagggccctggtagatgaagtcggagatgacggccaacagaggagaggccgtatgctccgacttaacctggcggcagcgcaaaagatg

SEQ ID NO: 172912 - DNA, 103 bp, Artificial Sequence
  Synthetic Polynucleotide
taatacgactcactatagggcaggctggcgccctggtagatgaagtcggaaacagaggagatccgacatgatctaccagaacctggcggcagcgcaaaagatg

SEQ ID NO: 172913 - DNA, 103 bp, Artificial Sequence
  Synthetic Polynucleotide
taatacgactcactatagggtctggttgtgcaggctggcgccctggtagaaacagaggagatctaccatggcgccagccaacctggcggcagcgcaaaagatg

SEQ ID NO: 172914 - DNA, 103 bp, Artificial Sequence
  Synthetic Polynucleotide
taatacgactcactataggggtgcggtctgtctggttgtgcaggctggcgaacagaggagacgccagatggcacaaccaaacctggcggcagcgcaaaagatg

SEQ ID NO: 172915 - DNA, 103 bp, Artificial Sequence
  Synthetic Polynucleotide
taatacgactcactatagggggtctcgcccgtgcggtctgtctggttgtgaacagaggagacacaacatgacagaccgcaacctggcggcagcgcaaaagatg

SEQ ID NO: 172916 - DNA, 103 bp, Artificial Sequence
  Synthetic Polynucleotide
taatacgactcactatagggggtgcaaggcggtctcgcccgtgcggtctgaacagaggagacagaccatgcgggcgagaaacctggcggcagcgcaaaagatg

SEQ ID NO: 172917 - DNA, 103 bp, Artificial Sequence
  Synthetic Polynucleotide
taatacgactcactatagggcgggcggccaggtgcaaggcggtctcgcccaacagaggagagggcgaatgcgccttgcaaacctggcggcagcgcaaaagatg

SEQ ID NO: 172918 - DNA, 103 bp, Artificial Sequence
  Synthetic Polynucleotide
taatacgactcactataggggccgacctcgttgtggcaggtgcctccgtgaacagaggagacacggaatgacctgccacaacctggcggcagcgcaaaagatg

SEQ ID NO: 172919 - DNA, 103 bp, Artificial Sequence
  Synthetic Polynucleotide
taatacgactcactataggggcgtgagtagcgggcggccaggtgcaaggcaacagaggagagccttgatgctggccgccaacctggcggcagcgcaaaagatg

SEQ ID NO: 172920 - DNA, 103 bp, Artificial Sequence
  Synthetic Polynucleotide
taatacgactcactatagggcggcatcagagcgtgagtagcgggcggccaaacagaggagatggccgatggctactcacaacctggcggcagcgcaaaagatg

SEQ ID NO: 172921 - DNA, 103 bp, Artificial Sequence
  Synthetic Polynucleotide
taatacgactcactatagggaggcgcttggcggcatcagagcgtgagtagaacagaggagactactcatgctctgatgcaacctggcggcagcgcaaaagatg

SEQ ID NO: 172922 - DNA, 103 bp, Artificial Sequence
  Synthetic Polynucleotide
taatacgactcactatagggggcctccagcaggcgcttggcggcatcagaaacagaggagatctgatatggccaagcgcaacctggcggcagcgcaaaagatg

SEQ ID NO: 172923 - DNA, 103 bp, Artificial Sequence
  Synthetic Polynucleotide
taatacgactcactatagggcatctgcgctggcctccagcaggcgcttggaacagaggagaccaagcatgtgctggaggaacctggcggcagcgcaaaagatg

SEQ ID NO: 172924 - DNA, 103 bp, Artificial Sequence
  Synthetic Polynucleotide
taatacgactcactatagggtggatgttggcatctgcgctggcctccagcaacagaggagagctggaatgcagcgcagaaacctggcggcagcgcaaaagatg

SEQ ID NO: 172925 - DNA, 103 bp, Artificial Sequence
  Synthetic Polynucleotide
taatacgactcactatagggcatgttgtcctggatgttggcatctgcgctaacagaggagaagcgcaatggccaacatcaacctggcggcagcgcaaaagatg

SEQ ID NO: 172926 - DNA, 103 bp, Artificial Sequence
  Synthetic Polynucleotide
taatacgactcactataggggggtgcggcccatgttgtcctggatgttggaacagaggagaccaacaatgaggacaacaaacctggcggcagcgcaaaagatg

SEQ ID NO: 172927 - DNA, 103 bp, Artificial Sequence
  Synthetic Polynucleotide
taatacgactcactataggggcatgcagcggggtgcggcccatgttgtccaacagaggagaggacaaatggggccgcacaacctggcggcagcgcaaaagatg

SEQ ID NO: 172928 - DNA, 103 bp, Artificial Sequence
  Synthetic Polynucleotide
taatacgactcactatagggagacacagccgcatgcagcggggtgcggccaacagaggagaggccgcatgccgctgcataacctggcggcagcgcaaaagatg

SEQ ID NO: 172929 - DNA, 103 bp, Artificial Sequence
  Synthetic Polynucleotide
taatacgactcactatagggagcggtaggagccgacctcgttgtggcaggaacagaggagacctgccatgacgaggtcgaacctggcggcagcgcaaaagatg

SEQ ID NO: 172930 - DNA, 103 bp, Artificial Sequence
  Synthetic Polynucleotide
taatacgactcactataggggtgcgtcggcagacacagccgcatgcagcgaacagaggagacgctgcatgcggctgtgtaacctggcggcagcgcaaaagatg

SEQ ID NO: 172931 - DNA, 103 bp, Artificial Sequence
  Synthetic Polynucleotide
taatacgactcactatagggaagacaccttgtgcgtcggcagacacagccaacagaggagaggctgtatgtgccgacgcaacctggcggcagcgcaaaagatg

SEQ ID NO: 172932 - DNA, 103 bp, Artificial Sequence
  Synthetic Polynucleotide
taatacgactcactatagggcaggatctggaagacaccttgtgcgtcggcaacagaggagagccgacatgcaaggtgtcaacctggcggcagcgcaaaagatg

SEQ ID NO: 172933 - DNA, 103 bp, Artificial Sequence
  Synthetic Polynucleotide
taatacgactcactatagggggttccggatcaggatctggaagacaccttaacagaggagaaaggtgatgtccagatccaacctggcggcagcgcaaaagatg

SEQ ID NO: 172934 - DNA, 103 bp, Artificial Sequence
  Synthetic Polynucleotide
taatacgactcactatagggtctgtggctcggttccggatcaggatctggaacagaggagaccagatatggatccggaaaacctggcggcagcgcaaaagatg

SEQ ID NO: 172935 - DNA, 103 bp, Artificial Sequence
  Synthetic Polynucleotide
taatacgactcactatagggggcatccaggtctgtggctcggttccggataacagaggagaatccggatgcgagccacaaacctggcggcagcgcaaaagatg

SEQ ID NO: 172936 - DNA, 103 bp, Artificial Sequence
  Synthetic Polynucleotide
taatacgactcactatagggcatgcatgcgggcatccaggtctgtggctcaacagaggagagagccaatgacctggatgaacctggcggcagcgcaaaagatg

SEQ ID NO: 172937 - DNA, 103 bp, Artificial Sequence
  Synthetic Polynucleotide
taatacgactcactataggggtcgtgccatcatgcatgcgggcatccaggaacagaggagacctggaatgccgcatgcaaacctggcggcagcgcaaaagatg

SEQ ID NO: 172938 - DNA, 103 bp, Artificial Sequence
  Synthetic Polynucleotide
taatacgactcactataggggatcagtggcgtcgtgccatcatgcatgcgaacagaggagacgcatgatggatggcacgaacctggcggcagcgcaaaagatg

SEQ ID NO: 172939 - DNA, 103 bp, Artificial Sequence
  Synthetic Polynucleotide
taatacgactcactataggggggcagccaggatcagtggcgtcgtgccataacagaggagaatggcaatgcgccactgaaacctggcggcagcgcaaaagatg

SEQ ID NO: 172940 - DNA, 103 bp, Artificial Sequence
  Synthetic Polynucleotide
taatacgactcactatagggggctgggagcatcgcgggcctcgtgcggcgaacagaggagacgccgcatgaggcccgcgaacctggcggcagcgcaaaagatg

SEQ ID NO: 172941 - DNA, 103 bp, Artificial Sequence
  Synthetic Polynucleotide
taatacgactcactatagggcggcagacgcagcggtaggagccgacctcgaacagaggagacgaggtatgctcctaccgaacctggcggcagcgcaaaagatg

SEQ ID NO: 172942 - DNA, 103 bp, Artificial Sequence
  Synthetic Polynucleotide
taatacgactcactatagggacggccaggcgggcagccaggatcagtggcaacagaggagagccactatgcctggctgcaacctggcggcagcgcaaaagatg

SEQ ID NO: 172943 - DNA, 103 bp, Artificial Sequence
  Synthetic Polynucleotide
taatacgactcactatagggcatgccctccacggccaggcgggcagccagaacagaggagactggctatgcgcctggccaacctggcggcagcgcaaaagatg

SEQ ID NO: 172944 - DNA, 103 bp, Artificial Sequence
  Synthetic Polynucleotide
taatacgactcactatagggggtcctccagcatgccctccacggccaggcaacagaggagagcctggatgtggagggcaaacctggcggcagcgcaaaagatg

SEQ ID NO: 172945 - DNA, 103 bp, Artificial Sequence
  Synthetic Polynucleotide
taatacgactcactataggggagttgatgaggtcctccagcatgccctccaacagaggagaggagggatggctggaggaaacctggcggcagcgcaaaagatg

SEQ ID NO: 172946 - DNA, 103 bp, Artificial Sequence
  Synthetic Polynucleotide
taatacgactcactataggggtcggcgtgtgagttgatgaggtcctccagaacagaggagactggagatgctcatcaacaacctggcggcagcgcaaaagatg

SEQ ID NO: 172947 - DNA, 103 bp, Artificial Sequence
  Synthetic Polynucleotide
taatacgactcactatagggcggcgttgacgtcggcgtgtgagttgatgaaacagaggagatcatcaatgcacacgccgaacctggcggcagcgcaaaagatg

SEQ ID NO: 172948 - DNA, 103 bp, Artificial Sequence
  Synthetic Polynucleotide
taatacgactcactatagggaggtcatctacggcgttgacgtcggcgtgtaacagaggagaacacgcatgcgtcaacgcaacctggcggcagcgcaaaagatg

SEQ ID NO: 172949 - DNA, 103 bp, Artificial Sequence
  Synthetic Polynucleotide
taatacgactcactatagggggacttgcccaggtcatctacggcgttgacaacagaggagagtcaacatggtagatgacaacctggcggcagcgcaaaagatg

SEQ ID NO: 172950 - DNA, 103 bp, Artificial Sequence
  Synthetic Polynucleotide
taatacgactcactatagggagtgcagggcggacttgcccaggtcatctaaacagaggagatagatgatgtgggcaagtaacctggcggcagcgcaaaagatg

SEQ ID NO: 172951 - DNA, 103 bp, Artificial Sequence
  Synthetic Polynucleotide
taatacgactcactataggggcggcggcccagtgcagggcggacttgcccaacagaggagagggcaaatgcgccctgcaaacctggcggcagcgcaaaagatg

SEQ ID NO: 172952 - DNA, 103 bp, Artificial Sequence
  Synthetic Polynucleotide
taatacgactcactataggggtgggtggcgcggcagacgcagcggtaggaaacagaggagatcctacatgtgcgtctgcaacctggcggcagcgcaaaagatg

SEQ ID NO: 172953 - DNA, 103 bp, Artificial Sequence
  Synthetic Polynucleotide
taatacgactcactatagggattgttcacggcggcggcccagtgcagggcaacagaggagagccctgatgtgggccgccaacctggcggcagcgcaaaagatg

SEQ ID NO: 172954 - DNA, 103 bp, Artificial Sequence
  Synthetic Polynucleotide
taatacgactcactatagggcggcatccacattgttcacggcggcggcccaacagaggagagggccgatgccgtgaacaaacctggcggcagcgcaaaagatg

SEQ ID NO: 172955 - DNA, 103 bp, Artificial Sequence
  Synthetic Polynucleotide
taatacgactcactatagggagcacaactgcggcatccacattgttcacgaacagaggagacgtgaaatgtgtggatgcaacctggcggcagcgcaaaagatg

SEQ ID NO: 172956 - DNA, 103 bp, Artificial Sequence
  Synthetic Polynucleotide
taatacgactcactataggggttcttcaggagcacaactgcggcatccacaacagaggagagtggatatggcagttgtgaacctggcggcagcgcaaaagatg

SEQ ID NO: 172957 - DNA, 103 bp, Artificial Sequence
  Synthetic Polynucleotide
taatacgactcactatagggtgttagccccgttcttcaggagcacaactgaacagaggagacagttgatgtcctgaagaaacctggcggcagcgcaaaagatg

SEQ ID NO: 172958 - DNA, 103 bp, Artificial Sequence
  Synthetic Polynucleotide
taatacgactcactatagggtgcatatctttgttagccccgttcttcaggaacagaggagacctgaaatgcggggctaaaacctggcggcagcgcaaaagatg

SEQ ID NO: 172959 - DNA, 103 bp, Artificial Sequence
  Synthetic Polynucleotide
taatacgactcactatagggcctgttgttctgcatatctttgttagccccaacagaggagaggggctatgaaagatatgaacctggcggcagcgcaaaagatg

SEQ ID NO: 172960 - DNA, 103 bp, Artificial Sequence
  Synthetic Polynucleotide
taatacgactcactataggggtgtctcctccctgttgttctgcatatcttaacagaggagaaagataatgagaacaacaaacctggcggcagcgcaaaagatg

SEQ ID NO: 172961 - DNA, 103 bp, Artificial Sequence
  Synthetic Polynucleotide
taatacgactcactatagggagaaacaggggtgtctcctccctgttgttcaacagaggagagaacaaatgggaggagacaacctggcggcagcgcaaaagatg

SEQ ID NO: 172962 - DNA, 103 bp, Artificial Sequence
  Synthetic Polynucleotide
taatacgactcactatagggccgggcggccagaaacaggggtgtctcctcaacagaggagagaggagatgcccctgtttaacctggcggcagcgcaaaagatg

SEQ ID NO: 172963 - DNA, 103 bp, Artificial Sequence
  Synthetic Polynucleotide
taatacgactcactatagggtggggccagtgtgggtggcgcggcagacgcaacagaggagagcgtctatggcgccacccaacctggcggcagcgcaaaagatg

SEQ ID NO: 172964 - DNA, 103 bp, Artificial Sequence
  Synthetic Polynucleotide
taatacgactcactatagggagctgccctcccgggcggccagaaacagggaacagaggagaccctgtatgtggccgcccaacctggcggcagcgcaaaagatg

SEQ ID NO: 172965 - DNA, 103 bp, Artificial Sequence
  Synthetic Polynucleotide
taatacgactcactataggggcggtctcgtagctgccctcccgggcggccaacagaggagaggccgcatgggagggcagaacctggcggcagcgcaaaagatg

SEQ ID NO: 172966 - DNA, 103 bp, Artificial Sequence
  Synthetic Polynucleotide
taatacgactcactatagggcagcaccttggcggtctcgtagctgccctcaacagaggagagagggcatgtacgagaccaacctggcggcagcgcaaaagatg

SEQ ID NO: 172967 - DNA, 103 bp, Artificial Sequence
  Synthetic Polynucleotide
taatacgactcactatagggagtggtccagcagcaccttggcggtctcgtaacagaggagaacgagaatgccaaggtgcaacctggcggcagcgcaaaagatg

SEQ ID NO: 172968 - DNA, 103 bp, Artificial Sequence
  Synthetic Polynucleotide
taatacgactcactatagggcggttggcaaagtggtccagcagcaccttgaacagaggagacaaggtatggctggaccaaacctggcggcagcgcaaaagatg

SEQ ID NO: 172969 - DNA, 103 bp, Artificial Sequence
  Synthetic Polynucleotide
taatacgactcactatagggcgtgatgtcccggttggcaaagtggtccagaacagaggagactggacatgtttgccaacaacctggcggcagcgcaaaagatg

SEQ ID NO: 172970 - DNA, 103 bp, Artificial Sequence
  Synthetic Polynucleotide
taatacgactcactatagggccatatgatccgtgatgtcccggttggcaaaacagaggagattgccaatggggacatcaaacctggcggcagcgcaaaagatg

SEQ ID NO: 172971 - DNA, 103 bp, Artificial Sequence
  Synthetic Polynucleotide
taatacgactcactatagggggcaggcggtccatatgatccgtgatgtccaacagaggagaggacatatgggatcatataacctggcggcagcgcaaaagatg

SEQ ID NO: 172972 - DNA, 103 bp, Artificial Sequence
  Synthetic Polynucleotide
taatacgactcactataggggatgtcgcgcggcaggcggtccatatgatcaacagaggagagatcatatggaccgcctgaacctggcggcagcgcaaaagatg

SEQ ID NO: 172973 - DNA, 103 bp, Artificial Sequence
  Synthetic Polynucleotide
taatacgactcactataggggctcctgtgcgatgtcgcgcggcaggcggtaacagaggagaaccgccatgcgcgcgacaaacctggcggcagcgcaaaagatg

SEQ ID NO: 172974 - DNA, 103 bp, Artificial Sequence
  Synthetic Polynucleotide
taatacgactcactatagggcgctcgcagttggggccagtgtgggtggcgaacagaggagacgccacatgcactggcccaacctggcggcagcgcaaaagatg

SEQ ID NO: 172975 - DNA, 103 bp, Artificial Sequence
  Synthetic Polynucleotide
taatacgactcactatagggtgatgcatgcgctcctgtgcgatgtcgcgcaacagaggagagcgcgaatgcgcacaggaaacctggcggcagcgcaaaagatg

SEQ ID NO: 172976 - DNA, 103 bp, Artificial Sequence
  Synthetic Polynucleotide
taatacgactcactatagggcacgatgtcgtgatgcatgcgctcctgtgcaacagaggagagcacagatgcgcatgcataacctggcggcagcgcaaaagatg

SEQ ID NO: 172977 - DNA, 103 bp, Artificial Sequence
  Synthetic Polynucleotide
taatacgactcactatagggccagcagcctcacgatgtcgtgatgcatgcaacagaggagagcatgcatgacgacatcgaacctggcggcagcgcaaaagatg

SEQ ID NO: 172978 - DNA, 103 bp, Artificial Sequence
  Synthetic Polynucleotide
taatacgactcactatagggttgtactcgtccagcagcctcacgatgtcgaacagaggagacgacatatggaggctgctaacctggcggcagcgcaaaagatg

SEQ ID NO: 172979 - DNA, 103 bp, Artificial Sequence
  Synthetic Polynucleotide
taatacgactcactataggggcgcaccaggttgtactcgtccagcagcctaacagaggagaaggctgatggacgagtacaacctggcggcagcgcaaaagatg

SEQ ID NO: 172980 - DNA, 103 bp, Artificial Sequence
  Synthetic Polynucleotide
taatacgactcactataggggctgcgggctgcgcaccaggttgtactcgtaacagaggagaacgagtatgacctggtgcaacctggcggcagcgcaaaagatg

SEQ ID NO: 172981 - DNA, 103 bp, Artificial Sequence
  Synthetic Polynucleotide
taatacgactcactataggggctccgtgcagctgcgggctgcgcaccaggaacagaggagacctggtatgcagcccgcaaacctggcggcagcgcaaaagatg

SEQ ID NO: 172982 - DNA, 103 bp, Artificial Sequence
  Synthetic Polynucleotide
taatacgactcactatagggccccagcggggctccgtgcagctgcgggctaacagaggagaagcccgatgctgcacggaaacctggcggcagcgcaaaagatg

SEQ ID NO: 172983 - DNA, 103 bp, Artificial Sequence
  Synthetic Polynucleotide
taatacgactcactatagggtgggcgtgccccccagcggggctccgtgcaaacagaggagatgcacgatgccccgctggaacctggcggcagcgcaaaagatg

SEQ ID NO: 172984 - DNA, 103 bp, Artificial Sequence
  Synthetic Polynucleotide
taatacgactcactatagggggcgacagggtgggcgtgccccccagcgggaacagaggagacccgctatggggcacgccaacctggcggcagcgcaaaagatg

SEQ ID NO: 172985 - DNA, 103 bp, Artificial Sequence
  Synthetic Polynucleotide
taatacgactcactatagggcacgtagggccgctcgcagttggggccagtaacagaggagaactggcatgaactgcgagaacctggcggcagcgcaaaagatg

SEQ ID NO: 172986 - DNA, 103 bp, Artificial Sequence
  Synthetic Polynucleotide
taatacgactcactataggggcagagcgggggcgacagggtgggcgtgccaacagaggagaggcacgatgaccctgtcgaacctggcggcagcgcaaaagatg

SEQ ID NO: 172987 - DNA, 103 bp, Artificial Sequence
  Synthetic Polynucleotide
taatacgactcactatagggcgttgggcgagcagagcgggggcgacagggaacagaggagaccctgtatgccccgctctaacctggcggcagcgcaaaagatg

SEQ ID NO: 172988 - DNA, 103 bp, Artificial Sequence
  Synthetic Polynucleotide
taatacgactcactatagggcccaggtagccgttgggcgagcagagcgggaacagaggagacccgctatgctcgcccaaaacctggcggcagcgcaaaagatg

SEQ ID NO: 172989 - DNA, 103 bp, Artificial Sequence
  Synthetic Polynucleotide
taatacgactcactatagggcttgaggctgcccaggtagccgttgggcgaaacagaggagatcgcccatgggctacctgaacctggcggcagcgcaaaagatg

SEQ ID NO: 172990 - DNA, 103 bp, Artificial Sequence
  Synthetic Polynucleotide
taatacgactcactataggggcacgccgggcttgaggctgcccaggtagcaacagaggagagctaccatggcagcctcaaacctggcggcagcgcaaaagatg

SEQ ID NO: 172991 - DNA, 103 bp, Artificial Sequence
  Synthetic Polynucleotide
taatacgactcactatagggttcttgccctgcacgccgggcttgaggctgaacagaggagacagcctatggcccggcgtaacctggcggcagcgcaaaagatg

SEQ ID NO: 172992 - DNA, 103 bp, Artificial Sequence
  Synthetic Polynucleotide
taatacgactcactatagggcttgcggaccttcttgccctgcacgccgggaacagaggagacccggcatgcagggcaagaacctggcggcagcgcaaaagatg

SEQ ID NO: 172993 - DNA, 103 bp, Artificial Sequence
  Synthetic Polynucleotide
taatacgactcactatagggtgctgctgggcttgcggaccttcttgccctaacagaggagaagggcaatgaggtccgcaaacctggcggcagcgcaaaagatg

SEQ ID NO: 172994 - DNA, 103 bp, Artificial Sequence
  Synthetic Polynucleotide
taatacgactcactataggggccaggcctttgctgctgggcttgcggaccaacagaggagaggtccgatggcccagcagaacctggcggcagcgcaaaagatg

SEQ ID NO: 172995 - DNA, 103 bp, Artificial Sequence
  Synthetic Polynucleotide
taatacgactcactataggggcttccacaggccaggcctttgctgctgggaacagaggagacccagcatgaaaggcctgaacctggcggcagcgcaaaagatg

SEQ ID NO: 172996 - DNA, 103 bp, Artificial Sequence
  Synthetic Polynucleotide
taatacgactcactatagggggctgcagggcacgtagggccgctcgcagtaacagaggagaactgcgatgggccctacgaacctggcggcagcgcaaaagatg

SEQ ID NO: 172997 - DNA, 103 bp, Artificial Sequence
  Synthetic Polynucleotide
taatacgactcactatagggtggcctccttgcttccacaggccaggccttaacagaggagaaaggccatgcctgtggaaaacctggcggcagcgcaaaagatg

SEQ ID NO: 172998 - DNA, 103 bp, Artificial Sequence
  Synthetic Polynucleotide
taatacgactcactatagggttgaggtccttggcctccttgcttccacagaacagaggagactgtggatgcaaggaggcaacctggcggcagcgcaaaagatg

SEQ ID NO: 172999 - DNA, 103 bp, Artificial Sequence
  Synthetic Polynucleotide
taatacgactcactatagggcctccgtgccttgaggtccttggcctccttaacagaggagaaaggagatgaaggacctcaacctggcggcagcgcaaaagatg

SEQ ID NO: 173000 - DNA, 103 bp, Artificial Sequence
  Synthetic Polynucleotide
taatacgactcactataggggggacttcttcctccgtgccttgaggtcctaacagaggagaaggaccatgaggcacggaaacctggcggcagcgcaaaagatg

SEQ ID NO: 173001 - DNA, 103 bp, Artificial Sequence
  Synthetic Polynucleotide
taatacgactcactatagggttgccgtcctgggacttcttcctccgtgccaacagaggagaggcacgatggaagaagtcaacctggcggcagcgcaaaagatg

SEQ ID NO: 173002 - DNA, 103 bp, Artificial Sequence
  Synthetic Polynucleotide
taatacgactcactatagggcaggcagcccttgccgtcctgggacttcttaacagaggagaaagaagatgcaggacggcaacctggcggcagcgcaaaagatg

SEQ ID NO: 173003 - DNA, 103 bp, Artificial Sequence
  Synthetic Polynucleotide
taatacgactcactatagggagctgtccagcaggcagcccttgccgtcctaacagaggagaaggacgatgagggctgccaacctggcggcagcgcaaaagatg

SEQ ID NO: 173004 - DNA, 103 bp, Artificial Sequence
  Synthetic Polynucleotide
taatacgactcactatagggagcatgccggagctgtccagcaggcagcccaacagaggagagggctgatggctggacagaacctggcggcagcgcaaaagatg

SEQ ID NO: 173005 - DNA, 103 bp, Artificial Sequence
  Synthetic Polynucleotide
taatacgactcactatagggcacgggcgagagcatgccggagctgtccagaacagaggagactggacatgtccggcatgaacctggcggcagcgcaaaagatg

SEQ ID NO: 173006 - DNA, 103 bp, Artificial Sequence
  Synthetic Polynucleotide
taatacgactcactatagggccagggagtccacgggcgagagcatgccggaacagaggagaccggcaatgtctcgcccgaacctggcggcagcgcaaaagatg

SEQ ID NO: 173007 - DNA, 103 bp, Artificial Sequence
  Synthetic Polynucleotide
taatacgactcactatagggcagggcgaggggctgcagggcacgtagggcaacagaggagagccctaatggccctgcagaacctggcggcagcgcaaaagatg

SEQ ID NO: 173008 - DNA, 103 bp, Artificial Sequence
  Synthetic Polynucleotide
taatacgactcactatagggtggggtgactccagggagtccacgggcgagaacagaggagactcgccatgggactccctaacctggcggcagcgcaaaagatg

SEQ ID NO: 173009 - DNA, 103 bp, Artificial Sequence
  Synthetic Polynucleotide
taatacgactcactatagggcaggtagccatggggtgactccagggagtcaacagaggagagactccatggagtcacccaacctggcggcagcgcaaaagatg

SEQ ID NO: 173010 - DNA, 103 bp, Artificial Sequence
  Synthetic Polynucleotide
taatacgactcactatagggccacgtctgacaggtagccatggggtgactaacagaggagaagtcacatgatggctaccaacctggcggcagcgcaaaagatg

SEQ ID NO: 173011 - DNA, 103 bp, Artificial Sequence
  Synthetic Polynucleotide
taatacgactcactatagggggcggcgaggccacgtctgacaggtagccaaacagaggagatggctaatggtcagacgtaacctggcggcagcgcaaaagatg

SEQ ID NO: 173012 - DNA, 103 bp, Artificial Sequence
  Synthetic Polynucleotide
taatacgactcactataggggggcagcagtggcggcgaggccacgtctgaaacagaggagatcagacatggcctcgccgaacctggcggcagcgcaaaagatg

SEQ ID NO: 173013 - DNA, 103 bp, Artificial Sequence
  Synthetic Polynucleotide
taatacgactcactatagggggaacggggagggcagcagtggcggcgaggaacagaggagacctcgcatgcactgctgcaacctggcggcagcgcaaaagatg

SEQ ID NO: 173014 - DNA, 103 bp, Artificial Sequence
  Synthetic Polynucleotide
taatacgactcactatagggggagactgctggaacggggagggcagcagtaacagaggagaactgctatgctccccgttaacctggcggcagcgcaaaagatg

SEQ ID NO: 173015 - DNA, 103 bp, Artificial Sequence
  Synthetic Polynucleotide
taatacgactcactataggggggcacggacggagactgctggaacggggaaacagaggagatccccgatgcagcagtctaacctggcggcagcgcaaaagatg

SEQ ID NO: 173016 - DNA, 103 bp, Artificial Sequence
  Synthetic Polynucleotide
taatacgactcactatagggggtggttgaggggcacggacggagactgctaacagaggagaagcagtatgcgtccgtgcaacctggcggcagcgcaaaagatg

SEQ ID NO: 173017 - DNA, 103 bp, Artificial Sequence
  Synthetic Polynucleotide
taatacgactcactatagggatcccaggcaggtggttgaggggcacggacaacagaggagagtccgtatgcctcaaccaaacctggcggcagcgcaaaagatg

SEQ ID NO: 173018 - DNA, 103 bp, Artificial Sequence
  Synthetic Polynucleotide
taatacgactcactatagggcccgttctggcagggcgaggggctgcagggaacagaggagaccctgcatgccctcgcccaacctggcggcagcgcaaaagatg

SEQ ID NO: 173019 - DNA, 103 bp, Artificial Sequence
  Synthetic Polynucleotide
taatacgactcactatagggggtgtcgggcatcccaggcaggtggttgagaacagaggagactcaacatgctgcctgggaacctggcggcagcgcaaaagatg

SEQ ID NO: 173020 - DNA, 103 bp, Artificial Sequence
  Synthetic Polynucleotide
taatacgactcactatagggtgcccaggtgggtgtcgggcatcccaggcaaacagaggagatgcctgatgtgcccgacaaacctggcggcagcgcaaaagatg

SEQ ID NO: 173021 - DNA, 103 bp, Artificial Sequence
  Synthetic Polynucleotide
taatacgactcactatagggaggtgcccgatgcccaggtgggtgtcgggcaacagaggagagcccgaatgccacctgggaacctggcggcagcgcaaaagatg

SEQ ID NO: 173022 - DNA, 103 bp, Artificial Sequence
  Synthetic Polynucleotide
taatacgactcactatagggcgccacgttcaggtgcccgatgcccaggtgaacagaggagacacctgatgatcgggcacaacctggcggcagcgcaaaagatg

SEQ ID NO: 173023 - DNA, 103 bp, Artificial Sequence
  Synthetic Polynucleotide
taatacgactcactatagggcgggcttggccgccacgttcaggtgcccgaaacagaggagatcgggcatgtgaacgtggaacctggcggcagcgcaaaagatg

SEQ ID NO: 173024 - DNA, 103 bp, Artificial Sequence
  Synthetic Polynucleotide
taatacgactcactataggggccgccatctcgggcttggccgccacgttcaacagaggagagaacgtatgggccaagccaacctggcggcagcgcaaaagatg

SEQ ID NO: 173025 - DNA, 103 bp, Artificial Sequence
  Synthetic Polynucleotide
taatacgactcactatagggcccacccagcgccgccatctcgggcttggcaacagaggagagccaagatggagatggcgaacctggcggcagcgcaaaagatg

SEQ ID NO: 173026 - DNA, 103 bp, Artificial Sequence
  Synthetic Polynucleotide
taatacgactcactataggggccggccgcccccacccagcgccgccatctaacagaggagaagatggatgcgctgggtgaacctggcggcagcgcaaaagatg

SEQ ID NO: 173027 - DNA, 103 bp, Artificial Sequence
  Synthetic Polynucleotide
taatacgactcactatagggtcaaaggccagccggccgcccccacccagcaacagaggagagctgggatggggcggccgaacctggcggcagcgcaaaagatg

SEQ ID NO: 173028 - DNA, 103 bp, Artificial Sequence
  Synthetic Polynucleotide
taatacgactcactatagggtgggccagtctcaaaggccagccggccgccaacagaggagaggcggcatgctggcctttaacctggcggcagcgcaaaagatg

SEQ ID NO: 173029 - DNA, 103 bp, Artificial Sequence
  Synthetic Polynucleotide
taatacgactcactatagggggcaggtgcccccgttctggcagggcgaggaacagaggagacctcgcatggccagaacgaacctggcggcagcgcaaaagatg

SEQ ID NO: 173030 - DNA, 103 bp, Artificial Sequence
  Synthetic Polynucleotide
taatacgactcactatagggagagacgaggtgggccagtctcaaaggccaaacagaggagatggcctatgagactggccaacctggcggcagcgcaaaagatg

SEQ ID NO: 173031 - DNA, 103 bp, Artificial Sequence
  Synthetic Polynucleotide
taatacgactcactatagggggcaggtgggagagacgaggtgggccagtcaacagaggagagactggatgacctcgtctaacctggcggcagcgcaaaagatg

SEQ ID NO: 173032 - DNA, 103 bp, Artificial Sequence
  Synthetic Polynucleotide
taatacgactcactatagggagaggccacaggcaggtgggagagacgaggaacagaggagacctcgtatgtcccacctgaacctggcggcagcgcaaaagatg

SEQ ID NO: 173033 - DNA, 103 bp, Artificial Sequence
  Synthetic Polynucleotide
taatacgactcactatagggtgctggtgccagaggccacaggcaggtgggaacagaggagacccaccatgctgtggcctaacctggcggcagcgcaaaagatg

SEQ ID NO: 173034 - DNA, 103 bp, Artificial Sequence
  Synthetic Polynucleotide
taatacgactcactatagggcccaggacggtgctggtgccagaggccacaaacagaggagatgtggcatgtggcaccagaacctggcggcagcgcaaaagatg

SEQ ID NO: 173035 - DNA, 103 bp, Artificial Sequence
  Synthetic Polynucleotide
taatacgactcactataggggctgctggagcccaggacggtgctggtgccaacagaggagaggcaccatgaccgtcctgaacctggcggcagcgcaaaagatg

SEQ ID NO: 173036 - DNA, 103 bp, Artificial Sequence
  Synthetic Polynucleotide
taatacgactcactataggggggcccctccgctgctggagcccaggacggaacagaggagaccgtccatggctccagcaaacctggcggcagcgcaaaagatg

SEQ ID NO: 173037 - DNA, 103 bp, Artificial Sequence
  Synthetic Polynucleotide
taatacgactcactataggggtgaaattcagggcccctccgctgctggagaacagaggagactccagatgcggaggggcaacctggcggcagcgcaaaagatg

SEQ ID NO: 173038 - DNA, 103 bp, Artificial Sequence
  Synthetic Polynucleotide
taatacgactcactatagggcccgcccacagtgaaattcagggcccctccaacagaggagaggagggatgctgaatttcaacctggcggcagcgcaaaagatg

SEQ ID NO: 173039 - DNA, 103 bp, Artificial Sequence
  Synthetic Polynucleotide
taatacgactcactatagggaactggtggacccgcccacagtgaaattcaaacagaggagatgaattatgctgtgggcgaacctggcggcagcgcaaaagatg

SEQ ID NO: 173040 - DNA, 103 bp, Artificial Sequence
  Synthetic Polynucleotide
taatacgactcactatagggcccgtggggcggcaggtgcccccgttctggaacagaggagaccagaaatggggcacctgaacctggcggcagcgcaaaagatg

SEQ ID NO: 173041 - DNA, 103 bp, Artificial Sequence
  Synthetic Polynucleotide
taatacgactcactatagggtgaccattcaaactggtggacccgcccacaaacagaggagatgtgggatggtccaccagaacctggcggcagcgcaaaagatg

SEQ ID NO: 173042 - DNA, 103 bp, Artificial Sequence
  Synthetic Polynucleotide
taatacgactcactatagggccactcgcattgaccattcaaactggtggaaacagaggagatccaccatgttgaatggtaacctggcggcagcgcaaaagatg

SEQ ID NO: 173043 - DNA, 103 bp, Artificial Sequence
  Synthetic Polynucleotide
taatacgactcactataggggccgggacagccactcgcattgaccattcaaacagaggagatgaatgatgaatgcgagtaacctggcggcagcgcaaaagatg

SEQ ID NO: 173044 - DNA, 103 bp, Artificial Sequence
  Synthetic Polynucleotide
taatacgactcactatagggccgctctgcagccgggacagccactcgcataacagaggagaatgcgaatggctgtcccgaacctggcggcagcgcaaaagatg

SEQ ID NO: 173045 - DNA, 103 bp, Artificial Sequence
  Synthetic Polynucleotide
taatacgactcactatagggcggcaccatgccgctctgcagccgggacagaacagaggagactgtccatgctgcagagcaacctggcggcagcgcaaaagatg

SEQ ID NO: 173046 - DNA, 103 bp, Artificial Sequence
  Synthetic Polynucleotide
taatacgactcactatagggtgtattggttcggcaccatgccgctctgcaaacagaggagatgcagaatggcatggtgcaacctggcggcagcgcaaaagatg

SEQ ID NO: 173047 - DNA, 103 bp, Artificial Sequence
  Synthetic Polynucleotide
taatacgactcactatagggcgcagagggttgtattggttcggcaccatgaacagaggagacatggtatggaaccaataaacctggcggcagcgcaaaagatg

SEQ ID NO: 173048 - DNA, 103 bp, Artificial Sequence
  Synthetic Polynucleotide
taatacgactcactatagggcacactcccccgcagagggttgtattggttaacagaggagaaaccaaatgaaccctctgaacctggcggcagcgcaaaagatg

SEQ ID NO: 173049 - DNA, 103 bp, Artificial Sequence
  Synthetic Polynucleotide
taatacgactcactatagggggcctggtgccacactcccccgcagagggtaacagaggagaaccctcatggggggagtgaacctggcggcagcgcaaaagatg

SEQ ID NO: 173050 - DNA, 103 bp, Artificial Sequence
  Synthetic Polynucleotide
taatacgactcactataggggtgctcagggggcctggtgccacactccccaacagaggagaggggagatgggcaccaggaacctggcggcagcgcaaaagatg

SEQ ID NO: 173051 - DNA, 103 bp, Artificial Sequence
  Synthetic Polynucleotide
taatacgactcactatagggggtctcaccgggctgggagcatcgcgggccaacagaggagaggcccgatgtgctcccagaacctggcggcagcgcaaaagatg

SEQ ID NO: 173052 - DNA, 103 bp, Artificial Sequence
  Synthetic Polynucleotide
taatacgactcactatagggggtgacgtcgcccgtggggcggcaggtgccaacagaggagaggcaccatgcgccccacgaacctggcggcagcgcaaaagatg

SEQ ID NO: 173053 - DNA, 103 bp, Artificial Sequence
  Synthetic Polynucleotide
taatacgactcactataggggggggcctgtgtgctcagggggcctggtgcaacagaggagagcaccaatgcccctgagcaacctggcggcagcgcaaaagatg

SEQ ID NO: 173054 - DNA, 103 bp, Artificial Sequence
  Synthetic Polynucleotide
taatacgactcactataggggctgcagggagggggcctgtgtgctcagggaacagaggagaccctgaatgcacaggcccaacctggcggcagcgcaaaagatg

SEQ ID NO: 173055 - DNA, 103 bp, Artificial Sequence
  Synthetic Polynucleotide
taatacgactcactatagggaccatgccatgctgcagggagggggcctgtaacagaggagaacaggcatgctccctgcaaacctggcggcagcgcaaaagatg

SEQ ID NO: 173056 - DNA, 103 bp, Artificial Sequence
  Synthetic Polynucleotide
taatacgactcactatagggcagcgggcctaccatgccatgctgcagggaaacagaggagatccctgatgcatggcatgaacctggcggcagcgcaaaagatg

SEQ ID NO: 173057 - DNA, 103 bp, Artificial Sequence
  Synthetic Polynucleotide
taatacgactcactatagggggctactgtgcagcgggcctaccatgccataacagaggagaatggcaatgtaggcccgcaacctggcggcagcgcaaaagatg

SEQ ID NO: 173058 - DNA, 103 bp, Artificial Sequence
  Synthetic Polynucleotide
taatacgactcactatagggctggcagcaaggctactgtgcagcgggcctaacagaggagaaggcccatggcacagtagaacctggcggcagcgcaaaagatg

SEQ ID NO: 173059 - DNA, 103 bp, Artificial Sequence
  Synthetic Polynucleotide
taatacgactcactatagggggacagggcgctggcagcaaggctactgtgaacagaggagacacagtatgcttgctgccaacctggcggcagcgcaaaagatg

SEQ ID NO: 173060 - DNA, 103 bp, Artificial Sequence
  Synthetic Polynucleotide
taatacgactcactatagggtcatcatctgggacagggcgctggcagcaaaacagaggagattgctgatggcgccctgtaacctggcggcagcgcaaaagatg

SEQ ID NO: 173061 - DNA, 103 bp, Artificial Sequence
  Synthetic Polynucleotide
taatacgactcactatagggccctggtagctcatcatctgggacagggcgaacagaggagacgccctatgccagatgataacctggcggcagcgcaaaagatg

SEQ ID NO: 173062 - DNA, 103 bp, Artificial Sequence
  Synthetic Polynucleotide
taatacgactcactataggggctgggcaggccctggtagctcatcatctgaacagaggagacagatgatgagctaccagaacctggcggcagcgcaaaagatg

SEQ ID NO: 173063 - DNA, 103 bp, Artificial Sequence
  Synthetic Polynucleotide
taatacgactcactatagggcacactcgtgggtgacgtcgcccgtggggcaacagaggagagccccaatggcgacgtcaaacctggcggcagcgcaaaagatg

SEQ ID NO: 173064 - DNA, 103 bp, Artificial Sequence
  Synthetic Polynucleotide
taatacgactcactatagggccagccgggtgctgggcaggccctggtagcaacagaggagagctaccatggcctgcccaaacctggcggcagcgcaaaagatg

SEQ ID NO: 173065 - DNA, 103 bp, Artificial Sequence
  Synthetic Polynucleotide
taatacgactcactatagggggctgggtggccagccgggtgctgggcaggaacagaggagacctgccatgcacccggctaacctggcggcagcgcaaaagatg

SEQ ID NO: 173066 - DNA, 103 bp, Artificial Sequence
  Synthetic Polynucleotide
taatacgactcactatagggcaccaggtgaggctgggtggccagccgggtaacagaggagaacccggatggccacccagaacctggcggcagcgcaaaagatg

SEQ ID NO: 173067 - DNA, 103 bp, Artificial Sequence
  Synthetic Polynucleotide
taatacgactcactataggggctgggtctgcaccaggtgaggctgggtggaacagaggagaccacccatgctcacctggaacctggcggcagcgcaaaagatg

SEQ ID NO: 173068 - DNA, 103 bp, Artificial Sequence
  Synthetic Polynucleotide
taatacgactcactatagggggctgcacctgctgggtctgcaccaggtgaaacagaggagatcacctatggcagacccaaacctggcggcagcgcaaaagatg

SEQ ID NO: 173069 - DNA, 103 bp, Artificial Sequence
  Synthetic Polynucleotide
taatacgactcactatagggtaagttttgtggctgcacctgctgggtctgaacagaggagacagaccatgcaggtgcagaacctggcggcagcgcaaaagatg

SEQ ID NO: 173070 - DNA, 103 bp, Artificial Sequence
  Synthetic Polynucleotide
taatacgactcactataggggctgcatctgtaagttttgtggctgcacctaacagaggagaaggtgcatgcacaaaactaacctggcggcagcgcaaaagatg

SEQ ID NO: 173071 - DNA, 103 bp, Artificial Sequence
  Synthetic Polynucleotide
taatacgactcactatagggaggttctgctgctgcatctgtaagttttgtaacagaggagaacaaaaatgacagatgcaaacctggcggcagcgcaaaagatg

SEQ ID NO: 173072 - DNA, 103 bp, Artificial Sequence
  Synthetic Polynucleotide
taatacgactcactatagggtgctggctgcaggttctgctgctgcatctgaacagaggagacagatgatgcagcagaacaacctggcggcagcgcaaaagatg

SEQ ID NO: 173073 - DNA, 103 bp, Artificial Sequence
  Synthetic Polynucleotide
taatacgactcactataggggctggatgtttgctggctgcaggttctgctaacagaggagaagcagaatgtgcagccagaacctggcggcagcgcaaaagatg

SEQ ID NO: 173074 - DNA, 103 bp, Artificial Sequence
  Synthetic Polynucleotide
taatacgactcactatagggggcaggcaggcacactcgtgggtgacgtcgaacagaggagacgacgtatgccacgagtgaacctggcggcagcgcaaaagatg

SEQ ID NO: 173075 - DNA, 103 bp, Artificial Sequence
  Synthetic Polynucleotide
taatacgactcactatagggctttgctgctgctggatgtttgctggctgcaacagaggagagcagccatgaaacatccaaacctggcggcagcgcaaaagatg

SEQ ID NO: 173076 - DNA, 103 bp, Artificial Sequence
  Synthetic Polynucleotide
taatacgactcactatagggcggctgcaggctttgctgctgctggatgttaacagaggagaaacatcatgcagcagcaaaacctggcggcagcgcaaaagatg

SEQ ID NO: 173077 - DNA, 103 bp, Artificial Sequence
  Synthetic Polynucleotide
taatacgactcactataggggtggtggtggcggctgcaggctttgctgctaacagaggagaagcagcatggcctgcagcaacctggcggcagcgcaaaagatg

SEQ ID NO: 173078 - DNA, 103 bp, Artificial Sequence
  Synthetic Polynucleotide
taatacgactcactatagggggctgtggtggtggtggtggcggctgcaggaacagaggagacctgcaatggccaccaccaacctggcggcagcgcaaaagatg

SEQ ID NO: 173079 - DNA, 103 bp, Artificial Sequence
  Synthetic Polynucleotide
taatacgactcactataggggccaaggtgcggctgtggtggtggtggtggaacagaggagaccaccaatgccaccacagaacctggcggcagcgcaaaagatg

SEQ ID NO: 173080 - DNA, 103 bp, Artificial Sequence
  Synthetic Polynucleotide
taatacgactcactatagggctgagctcacgccaaggtgcggctgtggtgaacagaggagacaccacatgcgcaccttgaacctggcggcagcgcaaaagatg

SEQ ID NO: 173081 - DNA, 103 bp, Artificial Sequence
  Synthetic Polynucleotide
taatacgactcactatagggccgctggctgctgagctcacgccaaggtgcaacagaggagagcacctatgcgtgagctcaacctggcggcagcgcaaaagatg

SEQ ID NO: 173082 - DNA, 103 bp, Artificial Sequence
  Synthetic Polynucleotide
taatacgactcactataggggcccaggtggccgctggctgctgagctcacaacagaggagagtgagcatggcagccagcaacctggcggcagcgcaaaagatg

SEQ ID NO: 173083 - DNA, 103 bp, Artificial Sequence
  Synthetic Polynucleotide
taatacgactcactatagggggaagctccggcccaggtggccgctggctgaacagaggagacagccaatggccacctggaacctggcggcagcgcaaaagatg

SEQ ID NO: 173084 - DNA, 103 bp, Artificial Sequence
  Synthetic Polynucleotide
taatacgactcactatagggtctccactcaggaagctccggcccaggtggaacagaggagaccacctatgccggagcttaacctggcggcagcgcaaaagatg

SEQ ID NO: 173085 - DNA, 103 bp, Artificial Sequence
  Synthetic Polynucleotide
taatacgactcactatagggggtgaagcctggcaggcaggcacactcgtgaacagaggagacacgagatggcctgcctgaacctggcggcagcgcaaaagatg

SEQ ID NO: 173086 - DNA, 103 bp, Artificial Sequence
  Synthetic Polynucleotide
taatacgactcactatagggctggctcggctctccactcaggaagctccgaacagaggagacggagcatgctgagtggaaacctggcggcagcgcaaaagatg

SEQ ID NO: 173087 - DNA, 103 bp, Artificial Sequence
  Synthetic Polynucleotide
taatacgactcactataggggcacgtctgcctggctcggctctccactcaaacagaggagatgagtgatgagccgagccaacctggcggcagcgcaaaagatg

SEQ ID NO: 173088 - DNA, 103 bp, Artificial Sequence
  Synthetic Polynucleotide
taatacgactcactatagggcccagtggctgcacgtctgcctggctcggcaacagaggagagccgagatgggcagacgtaacctggcggcagcgcaaaagatg

SEQ ID NO: 173089 - DNA, 103 bp, Artificial Sequence
  Synthetic Polynucleotide
taatacgactcactataggggctgctggggcccagtggctgcacgtctgcaacagaggagagcagacatgcagccactgaacctggcggcagcgcaaaagatg

SEQ ID NO: 173090 - DNA, 103 bp, Artificial Sequence
  Synthetic Polynucleotide
taatacgactcactataggggcaccgccaggctgctggggcccagtggctaacagaggagaagccacatggccccagcaaacctggcggcagcgcaaaagatg

SEQ ID NO: 173091 - DNA, 103 bp, Artificial Sequence
  Synthetic Polynucleotide
taatacgactcactatagggagaatagtgtgcaccgccaggctgctggggaacagaggagaccccagatgcctggcggtaacctggcggcagcgcaaaagatg

SEQ ID NO: 173092 - DNA, 103 bp, Artificial Sequence
  Synthetic Polynucleotide
taatacgactcactatagggctcctggggcagaatagtgtgcaccgccagaacagaggagactggcgatgcacactattaacctggcggcagcgcaaaagatg

SEQ ID NO: 173093 - DNA, 103 bp, Artificial Sequence
  Synthetic Polynucleotide
taatacgactcactataggggggcggggctctcctggggcagaatagtgtaacagaggagaacactaatgtgccccaggaacctggcggcagcgcaaaagatg

SEQ ID NO: 173094 - DNA, 103 bp, Artificial Sequence
  Synthetic Polynucleotide
taatacgactcactataggggacgtgggcagggcggggctctcctggggcaacagaggagagccccaatggagccccgcaacctggcggcagcgcaaaagatg

SEQ ID NO: 173095 - DNA, 103 bp, Artificial Sequence
  Synthetic Polynucleotide
taatacgactcactatagggggatggcagcgacgtgggcagggcggggctaacagaggagaagccccatgctgcccacgaacctggcggcagcgcaaaagatg

SEQ ID NO: 173096 - DNA, 103 bp, Artificial Sequence
  Synthetic Polynucleotide
taatacgactcactatagggagttctggccggtgaagcctggcaggcaggaacagaggagacctgccatgcaggcttcaaacctggcggcagcgcaaaagatg

SEQ ID NO: 173097 - DNA, 103 bp, Artificial Sequence
  Synthetic Polynucleotide
taatacgactcactatagggggaccagcgaggatggcagcgacgtgggcaaacagaggagatgcccaatgcgctgccataacctggcggcagcgcaaaagatg

SEQ ID NO: 173098 - DNA, 103 bp, Artificial Sequence
  Synthetic Polynucleotide
taatacgactcactataggggtcacgggtgggaccagcgaggatggcagcaacagaggagagctgccatgctcgctggtaacctggcggcagcgcaaaagatg

SEQ ID NO: 173099 - DNA, 103 bp, Artificial Sequence
  Synthetic Polynucleotide
taatacgactcactatagggctgggctgcggtcacgggtgggaccagcgaaacagaggagatcgctgatgccacccgtgaacctggcggcagcgcaaaagatg

SEQ ID NO: 173100 - DNA, 103 bp, Artificial Sequence
  Synthetic Polynucleotide
taatacgactcactataggggcgtcaggaactgggctgcggtcacgggtgaacagaggagacacccgatgccgcagcccaacctggcggcagcgcaaaagatg

SEQ ID NO: 173101 - DNA, 103 bp, Artificial Sequence
  Synthetic Polynucleotide
taatacgactcactatagggtgcgaggggggcgtcaggaactgggctgcgaacagaggagacgcagcatggttcctgacaacctggcggcagcgcaaaagatg

SEQ ID NO: 173102 - DNA, 103 bp, Artificial Sequence
  Synthetic Polynucleotide
taatacgactcactataggggtagctgtgctgcgaggggggcgtcaggaaaacagaggagattcctgatgcccccctcgaacctggcggcagcgcaaaagatg

SEQ ID NO: 173103 - DNA, 103 bp, Artificial Sequence
  Synthetic Polynucleotide
taatacgactcactatagggcaggcgaggagtagctgtgctgcgagggggaacagaggagaccccctatgagcacagctaacctggcggcagcgcaaaagatg

SEQ ID NO: 173104 - DNA, 103 bp, Artificial Sequence
  Synthetic Polynucleotide
taatacgactcactataggggtgttgtccacaggcgaggagtagctgtgcaacagaggagagcacagatgctcctcgccaacctggcggcagcgcaaaagatg

SEQ ID NO: 173105 - DNA, 103 bp, Artificial Sequence
  Synthetic Polynucleotide
taatacgactcactataggggtggctgggggtgttgtccacaggcgaggaaacagaggagatcctcgatggtggacaacaacctggcggcagcgcaaaagatg

SEQ ID NO: 173106 - DNA, 103 bp, Artificial Sequence
  Synthetic Polynucleotide
taatacgactcactatagggcctgtagctggtggctgggggtgttgtccaaacagaggagatggacaatgcccccagccaacctggcggcagcgcaaaagatg

SEQ ID NO: 173107 - DNA, 103 bp, Artificial Sequence
  Synthetic Polynucleotide
taatacgactcactatagggttttcctcacagttctggccggtgaagcctaacagaggagaaggcttatgcggccagaaaacctggcggcagcgcaaaagatg

SEQ ID NO: 173108 - DNA, 103 bp, Artificial Sequence
  Synthetic Polynucleotide
taatacgactcactatagggtgctcaggcacctgtagctggtggctggggaacagaggagaccccagatgccagctacaaacctggcggcagcgcaaaagatg

SEQ ID NO: 173109 - DNA, 103 bp, Artificial Sequence
  Synthetic Polynucleotide
taatacgactcactataggggaggaaggggtgctcaggcacctgtagctgaacagaggagacagctaatggtgcctgagaacctggcggcagcgcaaaagatg

SEQ ID NO: 173110 - DNA, 103 bp, Artificial Sequence
  Synthetic Polynucleotide
taatacgactcactataggggggacggggtgaggaaggggtgctcaggcaaacagaggagatgcctgatgaccccttccaacctggcggcagcgcaaaagatg

SEQ ID NO: 173111 - DNA, 103 bp, Artificial Sequence
  Synthetic Polynucleotide
taatacgactcactatagggggggactcaggggacggggtgaggaaggggaacagaggagaccccttatgcaccccgtcaacctggcggcagcgcaaaagatg

SEQ ID NO: 173112 - DNA, 103 bp, Artificial Sequence
  Synthetic Polynucleotide
taatacgactcactatagggccactggtcaggggactcaggggacggggtaacagaggagaaccccgatgcctgagtccaacctggcggcagcgcaaaagatg

SEQ ID NO: 173113 - DNA, 103 bp, Artificial Sequence
  Synthetic Polynucleotide
taatacgactcactatagggacgagctggaccactggtcaggggactcagaacagaggagactgagtatgctgaccagtaacctggcggcagcgcaaaagatg

SEQ ID NO: 173114 - DNA, 103 bp, Artificial Sequence
  Synthetic Polynucleotide
taatacgactcactataggggaatgcggggacgagctggaccactggtcaaacagaggagatgaccaatggtccagctcaacctggcggcagcgcaaaagatg

SEQ ID NO: 173115 - DNA, 103 bp, Artificial Sequence
  Synthetic Polynucleotide
taatacgactcactatagggggagacgttggaatgcggggacgagctggaaacagaggagatccagcatgtccccgcataacctggcggcagcgcaaaagatg

SEQ ID NO: 173116 - DNA, 103 bp, Artificial Sequence
  Synthetic Polynucleotide
taatacgactcactatagggcggaccagtcggagacgttggaatgcggggaacagaggagaccccgcatgccaacgtctaacctggcggcagcgcaaaagatg

SEQ ID NO: 173117 - DNA, 103 bp, Artificial Sequence
  Synthetic Polynucleotide
taatacgactcactataggggagacgccctcggaccagtcggagacgttgaacagaggagacaacgtatgcgactggtcaacctggcggcagcgcaaaagatg

SEQ ID NO: 173118 - DNA, 103 bp, Artificial Sequence
  Synthetic Polynucleotide
taatacgactcactatagggatcgtcgatattttcctcacagttctggccaacagaggagaggccagatgtgtgaggaaaacctggcggcagcgcaaaagatg

SEQ ID NO: 173119 - DNA, 103 bp, Artificial Sequence
  Synthetic Polynucleotide
taatacgactcactataggggggagggctggagacgccctcggaccagtcaacagaggagagactggatggagggcgtcaacctggcggcagcgcaaaagatg

SEQ ID NO: 173120 - DNA, 103 bp, Artificial Sequence
  Synthetic Polynucleotide
taatacgactcactataggggcatgctggtgggagggctggagacgccctaacagaggagaagggcgatgccagccctcaacctggcggcagcgcaaaagatg

SEQ ID NO: 173121 - DNA, 103 bp, Artificial Sequence
  Synthetic Polynucleotide
taatacgactcactatagggatctgggactgcatgctggtgggagggctgaacagaggagacagcccatgcaccagcataacctggcggcagcgcaaaagatg

SEQ ID NO: 173122 - DNA, 103 bp, Artificial Sequence
  Synthetic Polynucleotide
taatacgactcactatagggaatgcgggcgatctgggactgcatgctggtaacagaggagaaccagcatgcagtcccagaacctggcggcagcgcaaaagatg

SEQ ID NO: 173123 - DNA, 103 bp, Artificial Sequence
  Synthetic Polynucleotide
taatacgactcactatagggaggcctccggaatgcgggcgatctgggactaacagaggagaagtcccatgtcgcccgcaaacctggcggcagcgcaaaagatg

SEQ ID NO: 173124 - DNA, 103 bp, Artificial Sequence
  Synthetic Polynucleotide
taatacgactcactatagggttcctggacaatcgtcgatattttcctcacaacagaggagagtgaggatgatatcgacgaacctggcggcagcgcaaaagatg

SEQ ID NO: 173125 - DNA, 103 bp, Artificial Sequence
  Synthetic Polynucleotide
taatacgactcactatagggttgcagttgtttcctggacaatcgtcgataaacagaggagatatcgaatgttgtccaggaacctggcggcagcgcaaaagatg

SEQ ID NO: 173126 - DNA, 103 bp, Artificial Sequence
  Synthetic Polynucleotide
taatacgactcactatagggacccccgttcttgcagttgtttcctggacaaacagaggagatgtccaatgaacaactgcaacctggcggcagcgcaaaagatg

SEQ ID NO: 173127 - DNA, 103 bp, Artificial Sequence
  Synthetic Polynucleotide
taatacgactcactatagggcattcaggcaggtctcaccgggctgggagcaacagaggagagctcccatgccggtgagaaacctggcggcagcgcaaaagatg

SEQ ID NO: 173128 - DNA, 103 bp, Artificial Sequence
  Synthetic Polynucleotide
taatacgactcactatagggccacacaggcacccccgttcttgcagttgtaacagaggagaacaactatgagaacggggaacctggcggcagcgcaaaagatg

SEQ ID NO: 173129 - DNA, 103 bp, Artificial Sequence
  Synthetic Polynucleotide
taatacgactcactatagggttcacgccgtccacacaggcacccccgttcaacagaggagagaacggatgtgcctgtgtaacctggcggcagcgcaaaagatg

SEQ ID NO: 173130 - DNA, 103 bp, Artificial Sequence
  Synthetic Polynucleotide
taatacgactcactataggggttgtaggtgttcacgccgtccacacaggcaacagaggagagcctgtatggacggcgtgaacctggcggcagcgcaaaagatg

SEQ ID NO: 173131 - DNA, 103 bp, Artificial Sequence
  Synthetic Polynucleotide
taatacgactcactatagggggcagcggcagttgtaggtgttcacgccgtaacagaggagaacggcgatgacacctacaaacctggcggcagcgcaaaagatg

SEQ ID NO: 173132 - DNA, 103 bp, Artificial Sequence
  Synthetic Polynucleotide
taatacgactcactatagggcactctggcgggcagcggcagttgtaggtgaacagaggagacacctaatgctgccgctgaacctggcggcagcgcaaaagatg

SEQ ID NO: 173133 - DNA, 103 bp, Artificial Sequence
  Synthetic Polynucleotide
taatacgactcactatagggctgacctgtccactctggcgggcagcggcaaacagaggagatgccgcatgccgccagagaacctggcggcagcgcaaaagatg

SEQ ID NO: 173134 - DNA, 103 bp, Artificial Sequence
  Synthetic Polynucleotide
taatacgactcactatagggcggtacagtactgacctgtccactctggcgaacagaggagacgccagatgggacaggtcaacctggcggcagcgcaaaagatg

SEQ ID NO: 173135 - DNA, 103 bp, Artificial Sequence
  Synthetic Polynucleotide
taatacgactcactatagggtccacatcctcggtacagtactgacctgtcaacagaggagagacaggatggtactgtacaacctggcggcagcgcaaaagatg

SEQ ID NO: 173136 - DNA, 103 bp, Artificial Sequence
  Synthetic Polynucleotide
taatacgactcactatagggctggcactcgtccacatcctcggtacagtaaacagaggagatactgtatggaggatgtgaacctggcggcagcgcaaaagatg

SEQ ID NO: 173137 - DNA, 103 bp, Artificial Sequence
  Synthetic Polynucleotide
taatacgactcactatagggttggcatcagctggcactcgtccacatcctaacagaggagaaggatgatgacgagtgccaacctggcggcagcgcaaaagatg

SEQ ID NO: 173138 - DNA, 103 bp, Artificial Sequence
  Synthetic Polynucleotide
taatacgactcactatagggcacttcccgccattcaggcaggtctcaccgaacagaggagacggtgaatgctgcctgaaaacctggcggcagcgcaaaagatg

SEQ ID NO: 173139 - DNA, 103 bp, Artificial Sequence
  Synthetic Polynucleotide
taatacgactcactatagggtggcaggcatttggcatcagctggcactcgaacagaggagacgagtgatggctgatgccaacctggcggcagcgcaaaagatg

SEQ ID NO: 173140 - DNA, 103 bp, Artificial Sequence
  Synthetic Polynucleotide
taatacgactcactatagggcccgccgttctggcaggcatttggcatcagaacagaggagactgatgatgaatgcctgcaacctggcggcagcgcaaaagatg

SEQ ID NO: 173141 - DNA, 103 bp, Artificial Sequence
  Synthetic Polynucleotide
taatacgactcactatagggtgtggcaggtcccgccgttctggcaggcataacagaggagaatgcctatgagaacggcgaacctggcggcagcgcaaaagatg

SEQ ID NO: 173142 - DNA, 103 bp, Artificial Sequence
  Synthetic Polynucleotide
taatacgactcactatagggccgtgggtgttgtggcaggtcccgccgttcaacagaggagagaacggatggacctgccaaacctggcggcagcgcaaaagatg

SEQ ID NO: 173143 - DNA, 103 bp, Artificial Sequence
  Synthetic Polynucleotide
taatacgactcactataggggttgtagccaccgtgggtgttgtggcaggtaacagaggagaacctgcatgaacacccacaacctggcggcagcgcaaaagatg

SEQ ID NO: 173144 - DNA, 103 bp, Artificial Sequence
  Synthetic Polynucleotide
taatacgactcactatagggcacacacgcagttgtagccaccgtgggtgtaacagaggagaacacccatggtggctacaaacctggcggcagcgcaaaagatg

SEQ ID NO: 173145 - DNA, 103 bp, Artificial Sequence
  Synthetic Polynucleotide
taatacgactcactatagggcagccgttgacacacacgcagttgtagccaaacagaggagatggctaatgctgcgtgtgaacctggcggcagcgcaaaagatg

SEQ ID NO: 173146 - DNA, 103 bp, Artificial Sequence
  Synthetic Polynucleotide
taatacgactcactatagggctcaccagtccagccgttgacacacacgcaaacagaggagatgcgtgatggtcaacggcaacctggcggcagcgcaaaagatg

SEQ ID NO: 173147 - DNA, 103 bp, Artificial Sequence
  Synthetic Polynucleotide
taatacgactcactatagggcgctgcagtcctcaccagtccagccgttgaaacagaggagatcaacgatgggactggtgaacctggcggcagcgcaaaagatg

SEQ ID NO: 173148 - DNA, 103 bp, Artificial Sequence
  Synthetic Polynucleotide
taatacgactcactatagggtcaatgttctcgctgcagtcctcaccagtcaacagaggagagactggatgggactgcagaacctggcggcagcgcaaaagatg

SEQ ID NO: 173149 - DNA, 103 bp, Artificial Sequence
  Synthetic Polynucleotide
taatacgactcactatagggcttggctctgtctttctcatcttcatccataacagaggagaatggatatggatgagaaaaacctggcggcagcgcaaaagatg

SEQ ID NO: 173150 - DNA, 103 bp, Artificial Sequence
  Synthetic Polynucleotide
taatacgactcactatagggcgtgttgccagggagcatggaactgagctcaacagaggagagagctcatgtccatgctcaacctggcggcagcgcaaaagatg

SEQ ID NO: 173151 - DNA, 103 bp, Artificial Sequence
  Synthetic Polynucleotide
taatacgactcactatagggcttggagttccactgatggtaggtgatgtaaacagaggagatacatcatgtaccatcagaacctggcggcagcgcaaaagatg

SEQ ID NO: 173152 - DNA, 103 bp, Artificial Sequence
  Synthetic Polynucleotide
taatacgactcactatagggtgaactcgggcttggagttccactgatggtaacagaggagaaccatcatgggaactccaaacctggcggcagcgcaaaagatg

SEQ ID NO: 173153 - DNA, 103 bp, Artificial Sequence
  Synthetic Polynucleotide
taatacgactcactataggggtgcacacgatgaactcgggcttggagttcaacagaggagagaactcatggcccgagttaacctggcggcagcgcaaaagatg

SEQ ID NO: 173154 - DNA, 103 bp, Artificial Sequence
  Synthetic Polynucleotide
taatacgactcactatagggcaccgagtgtgtgcacacgatgaactcgggaacagaggagacccgagatgatcgtgtgcaacctggcggcagcgcaaaagatg

SEQ ID NO: 173155 - DNA, 103 bp, Artificial Sequence
  Synthetic Polynucleotide
taatacgactcactatagggcgtaactgaccaccgagtgtgtgcacacgaaacagaggagatcgtgtatgcacactcggaacctggcggcagcgcaaaagatg

SEQ ID NO: 173156 - DNA, 103 bp, Artificial Sequence
  Synthetic Polynucleotide
taatacgactcactatagggcggacatctgcgtaactgaccaccgagtgtaacagaggagaacactcatgggtcagttaaacctggcggcagcgcaaaagatg

SEQ ID NO: 173157 - DNA, 103 bp, Artificial Sequence
  Synthetic Polynucleotide
taatacgactcactatagggcctttccacccggacatctgcgtaactgacaacagaggagagtcagtatggcagatgtcaacctggcggcagcgcaaaagatg

SEQ ID NO: 173158 - DNA, 103 bp, Artificial Sequence
  Synthetic Polynucleotide
taatacgactcactataggggctcctgcctcctttccacccggacatctgaacagaggagacagatgatggggtggaaaaacctggcggcagcgcaaaagatg

SEQ ID NO: 173159 - DNA, 103 bp, Artificial Sequence
  Synthetic Polynucleotide
taatacgactcactatagggtccagagccagctcctgcctcctttccaccaacagaggagaggtggaatggaggcaggaaacctggcggcagcgcaaaagatg

SEQ ID NO: 173160 - DNA, 103 bp, Artificial Sequence
  Synthetic Polynucleotide
taatacgactcactatagggtggcgggtcttccagagccagctcctgcctaacagaggagaaggcagatgctggctctgaacctggcggcagcgcaaaagatg

SEQ ID NO: 173161 - DNA, 103 bp, Artificial Sequence
  Synthetic Polynucleotide
taatacgactcactatagggccattttccgcgtgttgccagggagcatggaacagaggagaccatgcatgctggcaacaaacctggcggcagcgcaaaagatg

SEQ ID NO: 173162 - DNA, 103 bp, Artificial Sequence
  Synthetic Polynucleotide
taatacgactcactataggggggcctcggatggcgggtcttccagagccaaacagaggagatggctcatgaagacccgcaacctggcggcagcgcaaaagatg

SEQ ID NO: 173163 - DNA, 103 bp, Artificial Sequence
  Synthetic Polynucleotide
taatacgactcactataggggaggagtggagggcctcggatggcgggtctaacagaggagaagacccatgatccgaggcaacctggcggcagcgcaaaagatg

SEQ ID NO: 173164 - DNA, 103 bp, Artificial Sequence
  Synthetic Polynucleotide
taatacgactcactatagggctttagtgctgaggagtggagggcctcggaaacagaggagatccgagatgctccactccaacctggcggcagcgcaaaagatg

SEQ ID NO: 173165 - DNA, 103 bp, Artificial Sequence
  Synthetic Polynucleotide
taatacgactcactatagggagcccttgtcctttagtgctgaggagtggaaacagaggagatccactatgcagcactaaaacctggcggcagcgcaaaagatg

SEQ ID NO: 173166 - DNA, 103 bp, Artificial Sequence
  Synthetic Polynucleotide
taatacgactcactatagggtccaggcttgagcccttgtcctttagtgctaacagaggagaagcactatgggacaagggaacctggcggcagcgcaaaagatg

SEQ ID NO: 173167 - DNA, 103 bp, Artificial Sequence
  Synthetic Polynucleotide
taatacgactcactatagggctgccgaggttccaggcttgagcccttgtcaacagaggagagacaagatgtcaagcctgaacctggcggcagcgcaaaagatg

SEQ ID NO: 173168 - DNA, 103 bp, Artificial Sequence
  Synthetic Polynucleotide
taatacgactcactatagggtgttaaagtgctgccgaggttccaggcttgaacagaggagacaagccatgaacctcggcaacctggcggcagcgcaaaagatg

SEQ ID NO: 173169 - DNA, 103 bp, Artificial Sequence
  Synthetic Polynucleotide
taatacgactcactatagggacgtcgagtgtgttaaagtgctgccgaggtaacagaggagaacctcgatggcactttaaaacctggcggcagcgcaaaagatg

SEQ ID NO: 173170 - DNA, 103 bp, Artificial Sequence
  Synthetic Polynucleotide
taatacgactcactatagggcgaggcacccacgtcgagtgtgttaaagtgaacagaggagacactttatgacactcgacaacctggcggcagcgcaaaagatg

SEQ ID NO: 173171 - DNA, 103 bp, Artificial Sequence
  Synthetic Polynucleotide
taatacgactcactatagggtattaaggcccgaggcacccacgtcgagtgaacagaggagacactcgatgtgggtgcctaacctggcggcagcgcaaaagatg

SEQ ID NO: 173172 - DNA, 103 bp, Artificial Sequence
  Synthetic Polynucleotide
taatacgactcactataggggtggttttgtccattttccgcgtgttgccaaacagaggagatggcaaatggcggaaaataacctggcggcagcgcaaaagatg

SEQ ID NO: 173173 - DNA, 103 bp, Artificial Sequence
  Synthetic Polynucleotide
taatacgactcactataggggaatgactggtattaaggcccgaggcacccaacagaggagagggtgcatggggccttaaaacctggcggcagcgcaaaagatg

SEQ ID NO: 173174 - DNA, 103 bp, Artificial Sequence
  Synthetic Polynucleotide
taatacgactcactatagggcgccgatggcgaatgactggtattaaggccaacagaggagaggccttatgaccagtcataacctggcggcagcgcaaaagatg

SEQ ID NO: 173175 - DNA, 103 bp, Artificial Sequence
  Synthetic Polynucleotide
taatacgactcactatagggttcttgaggacgccgatggcgaatgactggaacagaggagaccagtcatgcgccatcggaacctggcggcagcgcaaaagatg

SEQ ID NO: 173176 - DNA, 103 bp, Artificial Sequence
  Synthetic Polynucleotide
taatacgactcactatagggttgtgggaacttcttgaggacgccgatggcaacagaggagagccatcatggtcctcaagaacctggcggcagcgcaaaagatg

SEQ ID NO: 173177 - DNA, 103 bp, Artificial Sequence
  Synthetic Polynucleotide
taatacgactcactataggggtgcgaggatttgtgggaacttcttgaggaaacagaggagatcctcaatgagttcccacaacctggcggcagcgcaaaagatg

SEQ ID NO: 173178 - DNA, 103 bp, Artificial Sequence
  Synthetic Polynucleotide
taatacgactcactatagggacatggctgtgtgcgaggatttgtgggaacaacagaggagagttcccatgaatcctcgcaacctggcggcagcgcaaaagatg

SEQ ID NO: 173179 - DNA, 103 bp, Artificial Sequence
  Synthetic Polynucleotide
taatacgactcactataggggtgggttctgacatggctgtgtgcgaggataacagaggagaatcctcatgcacagccataacctggcggcagcgcaaaagatg

SEQ ID NO: 173180 - DNA, 103 bp, Artificial Sequence
  Synthetic Polynucleotide
taatacgactcactataggggggagtggaggtgggttctgacatggctgtaacagaggagaacagccatgtcagaacccaacctggcggcagcgcaaaagatg

SEQ ID NO: 173181 - DNA, 103 bp, Artificial Sequence
  Synthetic Polynucleotide
taatacgactcactatagggtcagcttggtgggagtggaggtgggttctgaacagaggagacagaacatgcctccactcaacctggcggcagcgcaaaagatg

SEQ ID NO: 173182 - DNA, 103 bp, Artificial Sequence
  Synthetic Polynucleotide
taatacgactcactataggggcctctgccatcagcttggtgggagtggagaacagaggagactccacatgcaccaagctaacctggcggcagcgcaaaagatg

SEQ ID NO: 173183 - DNA, 103 bp, Artificial Sequence
  Synthetic Polynucleotide
taatacgactcactatagggttccaacacggtggttttgtccattttccgaacagaggagacggaaaatggacaaaaccaacctggcggcagcgcaaaagatg

SEQ ID NO: 173184 - DNA, 103 bp, Artificial Sequence
  Synthetic Polynucleotide
taatacgactcactatagggcggggtgctggcctctgccatcagcttggtaacagaggagaaccaagatgatggcagagaacctggcggcagcgcaaaagatg

SEQ ID NO: 173185 - DNA, 103 bp, Artificial Sequence
  Synthetic Polynucleotide
taatacgactcactatagggttggcaaagccggggtgctggcctctgccaaacagaggagatggcagatgccagcacccaacctggcggcagcgcaaaagatg

SEQ ID NO: 173186 - DNA, 103 bp, Artificial Sequence
  Synthetic Polynucleotide
taatacgactcactataggggtggctgatcttggcaaagccggggtgctgaacagaggagacagcacatgggctttgccaacctggcggcagcgcaaaagatg

SEQ ID NO: 173187 - DNA, 103 bp, Artificial Sequence
  Synthetic Polynucleotide
taatacgactcactatagggttggggcagggtggctgatcttggcaaagcaacagaggagagctttgatgagatcagccaacctggcggcagcgcaaaagatg

SEQ ID NO: 173188 - DNA, 103 bp, Artificial Sequence
  Synthetic Polynucleotide
taatacgactcactatagggcaggtaactcttggggcagggtggctgatcaacagaggagagatcagatgccctgccccaacctggcggcagcgcaaaagatg

SEQ ID NO: 173189 - DNA, 103 bp, Artificial Sequence
  Synthetic Polynucleotide
taatacgactcactatagggagcccggggacaggtaactcttggggcaggaacagaggagacctgccatgagagttaccaacctggcggcagcgcaaaagatg

SEQ ID NO: 173190 - DNA, 103 bp, Artificial Sequence
  Synthetic Polynucleotide
taatacgactcactatagggtgcctggctgagcccggggacaggtaactcaacagaggagagagttaatggtccccgggaacctggcggcagcgcaaaagatg

SEQ ID NO: 173191 - DNA, 103 bp, Artificial Sequence
  Synthetic Polynucleotide
taatacgactcactataggggcatggtggctgcctggctgagcccggggaaacagaggagatccccgatgtcagccaggaacctggcggcagcgcaaaagatg

SEQ ID NO: 173192 - DNA, 103 bp, Artificial Sequence
  Synthetic Polynucleotide
taatacgactcactatagggagaggggccggcatggtggctgcctggctgaacagaggagacagccaatgagccaccataacctggcggcagcgcaaaagatg

SEQ ID NO: 173193 - DNA, 103 bp, Artificial Sequence
  Synthetic Polynucleotide
taatacgactcactatagggtggggaaggcagaggggccggcatggtggcaacagaggagagccaccatgccggcccctaacctggcggcagcgcaaaagatg

SEQ ID NO: 173194 - DNA, 103 bp, Artificial Sequence
  Synthetic Polynucleotide
taatacgactcactatagggcgatgaccttttccaacacggtggttttgtaacagaggagaacaaaaatgccgtgttggaacctggcggcagcgcaaaagatg

SEQ ID NO: 173195 - DNA, 103 bp, Artificial Sequence
  Synthetic Polynucleotide
taatacgactcactatagggcgcaggacgatggggaaggcagaggggccgaacagaggagacggcccatgtgccttcccaacctggcggcagcgcaaaagatg

SEQ ID NO: 173196 - DNA, 103 bp, Artificial Sequence
  Synthetic Polynucleotide
taatacgactcactatagggtgtgtgaggtcgcaggacgatggggaaggcaacagaggagagccttcatgatcgtcctgaacctggcggcagcgcaaaagatg

SEQ ID NO: 173197 - DNA, 103 bp, Artificial Sequence
  Synthetic Polynucleotide
taatacgactcactatagggcaggagctgctgtgtgaggtcgcaggacgaaacagaggagatcgtccatggacctcacaaacctggcggcagcgcaaaagatg

SEQ ID NO: 173198 - DNA, 103 bp, Artificial Sequence
  Synthetic Polynucleotide
taatacgactcactatagggcggtctgaggcaggagctgctgtgtgaggtaacagaggagaacctcaatgagcagctccaacctggcggcagcgcaaaagatg

SEQ ID NO: 173199 - DNA, 103 bp, Artificial Sequence
  Synthetic Polynucleotide
taatacgactcactatagggctctgcagaacggtctgaggcaggagctgcaacagaggagagcagctatggcctcagacaacctggcggcagcgcaaaagatg

SEQ ID NO: 173200 - DNA, 103 bp, Artificial Sequence
  Synthetic Polynucleotide
taatacgactcactatagggagcgggcgtgctctgcagaacggtctgaggaacagaggagacctcagatggttctgcagaacctggcggcagcgcaaaagatg

SEQ ID NO: 173201 - DNA, 103 bp, Artificial Sequence
  Synthetic Polynucleotide
taatacgactcactataggggtgccatgggagcgggcgtgctctgcagaaaacagaggagattctgcatggcacgcccgaacctggcggcagcgcaaaagatg

SEQ ID NO: 173202 - DNA, 103 bp, Artificial Sequence
  Synthetic Polynucleotide
taatacgactcactataggggccgaaaactgtgccatgggagcgggcgtgaacagaggagacacgccatgtcccatggcaacctggcggcagcgcaaaagatg

SEQ ID NO: 173203 - DNA, 103 bp, Artificial Sequence
  Synthetic Polynucleotide
taatacgactcactataggggctgaactgtgccgaaaactgtgccatgggaacagaggagacccatgatgcagttttcgaacctggcggcagcgcaaaagatg

SEQ ID NO: 173204 - DNA, 103 bp, Artificial Sequence
  Synthetic Polynucleotide
taatacgactcactatagggtctggaacatgctgaactgtgccgaaaactaacagaggagaagttttatgcacagttcaaacctggcggcagcgcaaaagatg

SEQ ID NO: 173205 - DNA, 103 bp, Artificial Sequence
  Synthetic Polynucleotide
taatacgactcactatagggtgcaaaaatccgatgaccttttccaacacgaacagaggagacgtgttatgaaaggtcataacctggcggcagcgcaaaagatg

SEQ ID NO: 173206 - DNA, 103 bp, Artificial Sequence
  Synthetic Polynucleotide
taatacgactcactatagggtctttgatggtctggaacatgctgaactgtaacagaggagaacagttatgcatgttccaaacctggcggcagcgcaaaagatg

SEQ ID NO: 173207 - DNA, 103 bp, Artificial Sequence
  Synthetic Polynucleotide
taatacgactcactatagggctctagctggtctttgatggtctggaacataacagaggagaatgttcatgaccatcaaaaacctggcggcagcgcaaaagatg

SEQ ID NO: 173208 - DNA, 103 bp, Artificial Sequence
  Synthetic Polynucleotide
taatacgactcactataggggcgtccgctgctctagctggtctttgatggaacagaggagaccatcaatgaccagctagaacctggcggcagcgcaaaagatg

SEQ ID NO: 173209 - DNA, 103 bp, Artificial Sequence
  Synthetic Polynucleotide
taatacgactcactatagggtgcaggatccgcgtccgctgctctagctggaacagaggagaccagctatggcagcggacaacctggcggcagcgcaaaagatg

SEQ ID NO: 173210 - DNA, 103 bp, Artificial Sequence
  Synthetic Polynucleotide
taatacgactcactataggggatattggcctgcaggatccgcgtccgctgaacagaggagacagcggatgcggatcctgaacctggcggcagcgcaaaagatg

SEQ ID NO: 173211 - DNA, 103 bp, Artificial Sequence
  Synthetic Polynucleotide
taatacgactcactataggggttgccaccggatattggcctgcaggatccaacagaggagaggatccatgaggccaataaacctggcggcagcgcaaaagatg

SEQ ID NO: 173212 - DNA, 103 bp, Artificial Sequence
  Synthetic Polynucleotide
taatacgactcactatagggagctcttcctgttgccaccggatattggccaacagaggagaggccaaatgccggtggcaaacctggcggcagcgcaaaagatg

SEQ ID NO: 173213 - DNA, 103 bp, Artificial Sequence
  Synthetic Polynucleotide
taatacgactcactataggggatcttgtggagctcttcctgttgccaccgaacagaggagacggtggatgcaggaagagaacctggcggcagcgcaaaagatg

SEQ ID NO: 173214 - DNA, 103 bp, Artificial Sequence
  Synthetic Polynucleotide
taatacgactcactataggggctgctcctggatcttgtggagctcttcctaacagaggagaaggaagatgtccacaagaaacctggcggcagcgcaaaagatg

SEQ ID NO: 173215 - DNA, 103 bp, Artificial Sequence
  Synthetic Polynucleotide
taatacgactcactatagggaccaggcagagctgctcctggatcttgtggaacagaggagaccacaaatgccaggagcaaacctggcggcagcgcaaaagatg

SEQ ID NO: 173216 - DNA, 103 bp, Artificial Sequence
  Synthetic Polynucleotide
taatacgactcactatagggattgtgtttctgcaaaaatccgatgaccttaacagaggagaaaggtcatgggatttttgaacctggcggcagcgcaaaagatg

SEQ ID NO: 173217 - DNA, 103 bp, Artificial Sequence
  Synthetic Polynucleotide
taatacgactcactatagggggagtcctggaccaggcagagctgctcctgaacagaggagacaggagatgctctgcctgaacctggcggcagcgcaaaagatg

SEQ ID NO: 173218 - DNA, 103 bp, Artificial Sequence
  Synthetic Polynucleotide
taatacgactcactatagggtctggacgttggagtcctggaccaggcagaaacagaggagatctgccatgtccaggactaacctggcggcagcgcaaaagatg

SEQ ID NO: 173219 - DNA, 103 bp, Artificial Sequence
  Synthetic Polynucleotide
taatacgactcactatagggtgcaggaacatctggacgttggagtcctggaacagaggagaccaggaatgcaacgtccaaacctggcggcagcgcaaaagatg

SEQ ID NO: 173220 - DNA, 103 bp, Artificial Sequence
  Synthetic Polynucleotide
taatacgactcactatagggagctggctgctgcaggaacatctggacgttaacagaggagaaacgtcatgatgttcctgaacctggcggcagcgcaaaagatg

SEQ ID NO: 173221 - DNA, 103 bp, Artificial Sequence
  Synthetic Polynucleotide
taatacgactcactatagggtcagggatacagctggctgctgcaggaacaaacagaggagatgttccatgagcagccagaacctggcggcagcgcaaaagatg

SEQ ID NO: 173222 - DNA, 103 bp, Artificial Sequence
  Synthetic Polynucleotide
taatacgactcactatagggctgctgaagctcagggatacagctggctgcaacagaggagagcagccatgtgtatccctaacctggcggcagcgcaaaagatg

SEQ ID NO: 173223 - DNA, 103 bp, Artificial Sequence
  Synthetic Polynucleotide
taatacgactcactatagggtcgctgggtgctgctgaagctcagggatacaacagaggagagtatccatgagcttcagcaacctggcggcagcgcaaaagatg

SEQ ID NO: 173224 - DNA, 103 bp, Artificial Sequence
  Synthetic Polynucleotide
taatacgactcactataggggagcctcaggtcgctgggtgctgctgaagcaacagaggagagcttcaatggcacccagcaacctggcggcagcgcaaaagatg

SEQ ID NO: 173225 - DNA, 103 bp, Artificial Sequence
  Synthetic Polynucleotide
taatacgactcactatagggagctgctgctgagcctcaggtcgctgggtgaacagaggagacacccaatgacctgaggcaacctggcggcagcgcaaaagatg

SEQ ID NO: 173226 - DNA, 103 bp, Artificial Sequence
  Synthetic Polynucleotide
taatacgactcactatagggcctttgctgtagctgctgctgagcctcaggaacagaggagacctgagatgcagcagcagaacctggcggcagcgcaaaagatg

SEQ ID NO: 173227 - DNA, 103 bp, Artificial Sequence
  Synthetic Polynucleotide
taatacgactcactatagggctgagacttcattgtgtttctgcaaaaatcaacagaggagagattttatgagaaacacaaacctggcggcagcgcaaaagatg

SEQ ID NO: 173228 - DNA, 103 bp, Artificial Sequence
  Synthetic Polynucleotide
taatacgactcactatagggctgcagctgacctttgctgtagctgctgctaacagaggagaagcagcatgtacagcaaaaacctggcggcagcgcaaaagatg

SEQ ID NO: 173229 - DNA, 103 bp, Artificial Sequence
  Synthetic Polynucleotide
taatacgactcactatagggggctgagtcactgcagctgacctttgctgtaacagaggagaacagcaatggtcagctgcaacctggcggcagcgcaaaagatg

SEQ ID NO: 173230 - DNA, 103 bp, Artificial Sequence
  Synthetic Polynucleotide
taatacgactcactatagggcccgagctggggctgagtcactgcagctgaaacagaggagatcagctatggtgactcagaacctggcggcagcgcaaaagatg

SEQ ID NO: 173231 - DNA, 103 bp, Artificial Sequence
  Synthetic Polynucleotide
taatacgactcactataggggggggcccgccccgagctggggctgagtcaaacagaggagatgactcatgcccagctcgaacctggcggcagcgcaaaagatg

SEQ ID NO: 173232 - DNA, 103 bp, Artificial Sequence
  Synthetic Polynucleotide
taatacgactcactatagggcctggaagttgggggcccgccccgagctggaacagaggagaccagctatgggcgggcccaacctggcggcagcgcaaaagatg

SEQ ID NO: 173233 - DNA, 103 bp, Artificial Sequence
  Synthetic Polynucleotide
taatacgactcactatagggggagatctgccctggaagttgggggcccgcaacagaggagagcgggcatgcaacttccaaacctggcggcagcgcaaaagatg

SEQ ID NO: 173234 - DNA, 103 bp, Artificial Sequence
  Synthetic Polynucleotide
taatacgactcactatagggcctgggcagaggagatctgccctggaagttaacagaggagaaacttcatgggcagatctaacctggcggcagcgcaaaagatg

SEQ ID NO: 173235 - DNA, 103 bp, Artificial Sequence
  Synthetic Polynucleotide
taatacgactcactatagggtggcttgtgacctgggcagaggagatctgcaacagaggagagcagatatgctctgcccaaacctggcggcagcgcaaaagatg

SEQ ID NO: 173236 - DNA, 103 bp, Artificial Sequence
  Synthetic Polynucleotide
taatacgactcactataggggagcaggtgctggcttgtgacctgggcagaaacagaggagatctgccatggtcacaagcaacctggcggcagcgcaaaagatg

SEQ ID NO: 173237 - DNA, 103 bp, Artificial Sequence
  Synthetic Polynucleotide
taatacgactcactatagggttgattctctgagcaggtgctggcttgtgaaacagaggagatcacaaatgagcacctgcaacctggcggcagcgcaaaagatg

SEQ ID NO: 173238 - DNA, 103 bp, Artificial Sequence
  Synthetic Polynucleotide
taatacgactcactatagggtccgtttgcgctgagacttcattgtgtttcaacagaggagagaaacaatgtgaagtctcaacctggcggcagcgcaaaagatg

SEQ ID NO: 173239 - DNA, 103 bp, Artificial Sequence
  Synthetic Polynucleotide
taatacgactcactataggggatatcacacttgattctctgagcaggtgcaacagaggagagcacctatgcagagaatcaacctggcggcagcgcaaaagatg

SEQ ID NO: 173240 - DNA, 103 bp, Artificial Sequence
  Synthetic Polynucleotide
taatacgactcactatagggaccctgggttgatatcacacttgattctctaacagaggagaagagaaatgagtgtgataaacctggcggcagcgcaaaagatg

SEQ ID NO: 173241 - DNA, 103 bp, Artificial Sequence
  Synthetic Polynucleotide
taatacgactcactatagggttggctttggaccctgggttgatatcacacaacagaggagagtgtgaatgcaacccaggaacctggcggcagcgcaaaagatg

SEQ ID NO: 173242 - DNA, 103 bp, Artificial Sequence
  Synthetic Polynucleotide
taatacgactcactataggggagcttctcattggctttggaccctgggttaacagaggagaaacccaatgtccaaagccaacctggcggcagcgcaaaagatg

SEQ ID NO: 173243 - DNA, 103 bp, Artificial Sequence
  Synthetic Polynucleotide
taatacgactcactatagggcattagctgtgagcttctcattggctttggaacagaggagaccaaagatgatgagaagcaacctggcggcagcgcaaaagatg

SEQ ID NO: 173244 - DNA, 103 bp, Artificial Sequence
  Synthetic Polynucleotide
taatacgactcactatagggcgctgctctgcattagctgtgagcttctcaaacagaggagatgagaaatgcacagctaaaacctggcggcagcgcaaaagatg

SEQ ID NO: 173245 - DNA, 103 bp, Artificial Sequence
  Synthetic Polynucleotide
taatacgactcactatagggccagagcggccgctgctctgcattagctgtaacagaggagaacagctatggcagagcagaacctggcggcagcgcaaaagatg

SEQ ID NO: 173246 - DNA, 103 bp, Artificial Sequence
  Synthetic Polynucleotide
taatacgactcactatagggtaggctgcttccagagcggccgctgctctgaacagaggagacagagcatgggccgctctaacctggcggcagcgcaaaagatg

SEQ ID NO: 173247 - DNA, 103 bp, Artificial Sequence
  Synthetic Polynucleotide
taatacgactcactatagggacggggacactaggctgcttccagagcggcaacagaggagagccgctatggaagcagccaacctggcggcagcgcaaaagatg

SEQ ID NO: 173248 - DNA, 103 bp, Artificial Sequence
  Synthetic Polynucleotide
taatacgactcactataggggcgctgctgaacggggacactaggctgcttaacagaggagaaagcagatgagtgtccccaacctggcggcagcgcaaaagatg

SEQ ID NO: 173249 - DNA, 103 bp, Artificial Sequence
  Synthetic Polynucleotide
taatacgactcactataggggtcacagatttccgtttgcgctgagacttcaacagaggagagaagtcatggcgcaaacgaacctggcggcagcgcaaaagatg

SEQ ID NO: 173250 - DNA, 103 bp, Artificial Sequence
  Synthetic Polynucleotide
taatacgactcactatagggcgcagctgtggcgctgctgaacggggacacaacagaggagagtgtccatgttcagcagcaacctggcggcagcgcaaaagatg

SEQ ID NO: 173251 - DNA, 103 bp, Artificial Sequence
  Synthetic Polynucleotide
taatacgactcactatagggttggcgggagcgcagctgtggcgctgctgaaacagaggagatcagcaatgccacagctgaacctggcggcagcgcaaaagatg

SEQ ID NO: 173252 - DNA, 103 bp, Artificial Sequence
  Synthetic Polynucleotide
taatacgactcactatagggagattcagacttggcgggagcgcagctgtgaacagaggagacacagcatggctcccgccaacctggcggcagcgcaaaagatg

SEQ ID NO: 173253 - DNA, 103 bp, Artificial Sequence
  Synthetic Polynucleotide
taatacgactcactatagggaggtgtggtcagattcagacttggcgggagaacagaggagactcccgatgagtctgaataacctggcggcagcgcaaaagatg

SEQ ID NO: 173254 - DNA, 103 bp, Artificial Sequence
  Synthetic Polynucleotide
taatacgactcactatagggaggtggaagcaggtgtggtcagattcagacaacagaggagagtctgaatgtgaccacacaacctggcggcagcgcaaaagatg

SEQ ID NO: 173255 - DNA, 103 bp, Artificial Sequence
  Synthetic Polynucleotide
taatacgactcactataggggcatcctgggaggtggaagcaggtgtggtcaacagaggagagaccacatgtgcttccacaacctggcggcagcgcaaaagatg

SEQ ID NO: 173256 - DNA, 103 bp, Artificial Sequence
  Synthetic Polynucleotide
taatacgactcactataggggcactggctggcatcctgggaggtggaagcaacagaggagagcttccatgtcccaggataacctggcggcagcgcaaaagatg

SEQ ID NO: 173257 - DNA, 103 bp, Artificial Sequence
  Synthetic Polynucleotide
taatacgactcactatagggggctgggctggcactggctggcatcctgggaacagaggagacccaggatgccagccagtaacctggcggcagcgcaaaagatg

SEQ ID NO: 173258 - DNA, 103 bp, Artificial Sequence
  Synthetic Polynucleotide
taatacgactcactatagggctgaagtctgggctgggctggcactggctgaacagaggagacagccaatgccagcccagaacctggcggcagcgcaaaagatg

SEQ ID NO: 173259 - DNA, 103 bp, Artificial Sequence
  Synthetic Polynucleotide
taatacgactcactatagggccgatcatggctgaagtctgggctgggctgaacagaggagacagcccatgccagacttcaacctggcggcagcgcaaaagatg

SEQ ID NO: 173260 - DNA, 103 bp, Artificial Sequence
  Synthetic Polynucleotide
taatacgactcactataggggagaagctctcttggctctgtctttctcataacagaggagaatgagaatgacagagccaaacctggcggcagcgcaaaagatg

SEQ ID NO: 173261 - DNA, 103 bp, Artificial Sequence
  Synthetic Polynucleotide
taatacgactcactatagggcttgctgaatgtcacagatttccgtttgcgaacagaggagacgcaaaatgaaatctgtgaacctggcggcagcgcaaaagatg

SEQ ID NO: 173262 - DNA, 103 bp, Artificial Sequence
  Synthetic Polynucleotide
taatacgactcactataggggcctgagctgccgatcatggctgaagtctgaacagaggagacagactatggccatgatcaacctggcggcagcgcaaaagatg

SEQ ID NO: 173263 - DNA, 103 bp, Artificial Sequence
  Synthetic Polynucleotide
taatacgactcactatagggctcagcaacagcctgagctgccgatcatggaacagaggagaccatgaatggcagctcagaacctggcggcagcgcaaaagatg

SEQ ID NO: 173264 - DNA, 103 bp, Artificial Sequence
  Synthetic Polynucleotide
taatacgactcactataggggatgggctggctcagcaacagcctgagctgaacagaggagacagctcatgctgttgctgaacctggcggcagcgcaaaagatg

SEQ ID NO: 173265 - DNA, 103 bp, Artificial Sequence
  Synthetic Polynucleotide
taatacgactcactatagggtcatgggctggatgggctggctcagcaacaaacagaggagatgttgcatggccagcccaaacctggcggcagcgcaaaagatg

SEQ ID NO: 173266 - DNA, 103 bp, Artificial Sequence
  Synthetic Polynucleotide
taatacgactcactataggggacccgggcatcatgggctggatgggctggaacagaggagaccagccatgccagcccataacctggcggcagcgcaaaagatg

SEQ ID NO: 173267 - DNA, 103 bp, Artificial Sequence
  Synthetic Polynucleotide
taatacgactcactatagggtgcgtcacaggacccgggcatcatgggctgaacagaggagacagcccatgatgcccgggaacctggcggcagcgcaaaagatg

SEQ ID NO: 173268 - DNA, 103 bp, Artificial Sequence
  Synthetic Polynucleotide
taatacgactcactatagggagggctgccttgcgtcacaggacccgggcaaacagaggagatgcccgatgcctgtgacgaacctggcggcagcgcaaaagatg

SEQ ID NO: 173269 - DNA, 103 bp, Artificial Sequence
  Synthetic Polynucleotide
taatacgactcactatagggctgacttccgagggctgccttgcgtcacagaacagaggagactgtgaatgaaggcagccaacctggcggcagcgcaaaagatg

SEQ ID NO: 173270 - DNA, 103 bp, Artificial Sequence
  Synthetic Polynucleotide
taatacgactcactatagggtcccgtcctgctgacttccgagggctgcctaacagaggagaaggcagatgtcggaagtcaacctggcggcagcgcaaaagatg

SEQ ID NO: 173271 - DNA, 103 bp, Artificial Sequence
  Synthetic Polynucleotide
taatacgactcactatagggtgacttgccgtcccgtcctgctgacttccgaacagaggagacggaagatggcaggacggaacctggcggcagcgcaaaagatg

SEQ ID NO: 173272 - DNA, 103 bp, Artificial Sequence
  Synthetic Polynucleotide
taatacgactcactatagggggcttccagtcttgctgaatgtcacagattaacagaggagaaatctgatgcattcagcaaacctggcggcagcgcaaaagatg

SEQ ID NO: 173273 - DNA, 103 bp, Artificial Sequence
  Synthetic Polynucleotide
taatacgactcactatagggtgggcgtacttgacttgccgtcccgtcctgaacagaggagacaggacatgacggcaagtaacctggcggcagcgcaaaagatg

SEQ ID NO: 173274 - DNA, 103 bp, Artificial Sequence
  Synthetic Polynucleotide
taatacgactcactatagggggtctggctctgggcgtacttgacttgccgaacagaggagacggcaaatgaagtacgccaacctggcggcagcgcaaaagatg

SEQ ID NO: 173275 - DNA, 103 bp, Artificial Sequence
  Synthetic Polynucleotide
taatacgactcactatagggtttgaaacacggtctggctctgggcgtactaacagaggagaagtacgatgagagccagaaacctggcggcagcgcaaaagatg

SEQ ID NO: 173276 - DNA, 103 bp, Artificial Sequence
  Synthetic Polynucleotide
taatacgactcactataggggcgtctggattttgaaacacggtctggctcaacagaggagagagccaatgcgtgtttcaaacctggcggcagcgcaaaagatg

SEQ ID NO: 173277 - DNA, 103 bp, Artificial Sequence
  Synthetic Polynucleotide
taatacgactcactatagggggcggggtgtgcgtctggattttgaaacacaacagaggagagtgtttatgaatccagacaacctggcggcagcgcaaaagatg

SEQ ID NO: 173278 - DNA, 103 bp, Artificial Sequence
  Synthetic Polynucleotide
taatacgactcactatagggtgctgctgttggcggggtgtgcgtctggataacagaggagaatccagatgcacaccccgaacctggcggcagcgcaaaagatg

SEQ ID NO: 173279 - DNA, 103 bp, Artificial Sequence
  Synthetic Polynucleotide
taatacgactcactatagggatcggggcgctgctgctgttggcggggtgtaacagaggagaacacccatgcaacagcagaacctggcggcagcgcaaaagatg

SEQ ID NO: 173280 - DNA, 103 bp, Artificial Sequence
  Synthetic Polynucleotide
taatacgactcactatagggcaggacgggcatcggggcgctgctgctgttaacagaggagaaacagcatgagcgccccgaacctggcggcagcgcaaaagatg

SEQ ID NO: 173281 - DNA, 103 bp, Artificial Sequence
  Synthetic Polynucleotide
taatacgactcactataggggccccatcagcaggacgggcatcggggcgcaacagaggagagcgcccatgtgcccgtccaacctggcggcagcgcaaaagatg

SEQ ID NO: 173282 - DNA, 103 bp, Artificial Sequence
  Synthetic Polynucleotide
taatacgactcactatagggagcaccgcctgccccatcagcaggacgggcaacagaggagagcccgtatggctgatgggaacctggcggcagcgcaaaagatg

SEQ ID NO: 173283 - DNA, 103 bp, Artificial Sequence
  Synthetic Polynucleotide
taatacgactcactataggggaggaatgaaggcttccagtcttgctgaataacagaggagaattcagatggactggaagaacctggcggcagcgcaaaagatg

SEQ ID NO: 173284 - DNA, 103 bp, Artificial Sequence
  Synthetic Polynucleotide
taatacgactcactataggggctggggtggagcaccgcctgccccatcagaacagaggagactgatgatgcaggcggtgaacctggcggcagcgcaaaagatg

SEQ ID NO: 173285 - DNA, 103 bp, Artificial Sequence
  Synthetic Polynucleotide
taatacgactcactatagggaggcagggaagctggggtggagcaccgcctaacagaggagaaggcggatgtccaccccaaacctggcggcagcgcaaaagatg

SEQ ID NO: 173286 - DNA, 103 bp, Artificial Sequence
  Synthetic Polynucleotide
taatacgactcactataggggatggttgggaggcagggaagctggggtggaacagaggagaccacccatgcttccctgcaacctggcggcagcgcaaaagatg

SEQ ID NO: 173287 - DNA, 103 bp, Artificial Sequence
  Synthetic Polynucleotide
taatacgactcactatagggctgcaggggcgatggttgggaggcagggaaaacagaggagattccctatgtcccaaccaaacctggcggcagcgcaaaagatg

SEQ ID NO: 173288 - DNA, 103 bp, Artificial Sequence
  Synthetic Polynucleotide
taatacgactcactatagggcctgtgcaggctgcaggggcgatggttgggaacagaggagacccaacatgcgcccctgcaacctggcggcagcgcaaaagatg

SEQ ID NO: 173289 - DNA, 103 bp, Artificial Sequence
  Synthetic Polynucleotide
taatacgactcactatagggtgctgccgggcctgtgcaggctgcaggggcaacagaggagagcccctatggcctgcacaaacctggcggcagcgcaaaagatg

SEQ ID NO: 173290 - DNA, 103 bp, Artificial Sequence
  Synthetic Polynucleotide
taatacgactcactatagggctgcggtggctgctgccgggcctgtgcaggaacagaggagacctgcaatggcccggcagaacctggcggcagcgcaaaagatg

SEQ ID NO: 173291 - DNA, 103 bp, Artificial Sequence
  Synthetic Polynucleotide
taatacgactcactataggggcaggtagtgctgcggtggctgctgccgggaacagaggagacccggcatgagccaccgcaacctggcggcagcgcaaaagatg

SEQ ID NO: 173292 - DNA, 103 bp, Artificial Sequence
  Synthetic Polynucleotide
taatacgactcactataggggcctgtacctgcaggtagtgctgcggtggcaacagaggagagccaccatggcactacctaacctggcggcagcgcaaaagatg

SEQ ID NO: 173293 - DNA, 103 bp, Artificial Sequence
  Synthetic Polynucleotide
taatacgactcactatagggagaggttggtgcctgtacctgcaggtagtgaacagaggagacactacatgcaggtacagaacctggcggcagcgcaaaagatg

SEQ ID NO: 173294 - DNA, 103 bp, Artificial Sequence
  Synthetic Polynucleotide
taatacgactcactatagggcttcattactgaggaatgaaggcttccagtaacagaggagaactggaatgcttcattccaacctggcggcagcgcaaaagatg

SEQ ID NO: 173295 - DNA, 103 bp, Artificial Sequence
  Synthetic Polynucleotide
taatacgactcactatagggcactgtgcaaagaggttggtgcctgtacctaacagaggagaaggtacatgcaccaacctaacctggcggcagcgcaaaagatg

SEQ ID NO: 173296 - DNA, 103 bp, Artificial Sequence
  Synthetic Polynucleotide
taatacgactcactatagggtcctgctgctcactgtgcaaagaggttggtaacagaggagaaccaacatgtttgcacagaacctggcggcagcgcaaaagatg

SEQ ID NO: 173297 - DNA, 103 bp, Artificial Sequence
  Synthetic Polynucleotide
taatacgactcactatagggaagtagcgagtcctgctgctcactgtgcaaaacagaggagattgcacatggagcagcagaacctggcggcagcgcaaaagatg

SEQ ID NO: 173298 - DNA, 103 bp, Artificial Sequence
  Synthetic Polynucleotide
taatacgactcactatagggaggtggagagaagtagcgagtcctgctgctaacagaggagaagcagcatgactcgctacaacctggcggcagcgcaaaagatg

SEQ ID NO: 173299 - DNA, 103 bp, Artificial Sequence
  Synthetic Polynucleotide
taatacgactcactatagggtgttgtgagtaggtggagagaagtagcgagaacagaggagactcgctatgtctctccacaacctggcggcagcgcaaaagatg

SEQ ID NO: 173300 - DNA, 103 bp, Artificial Sequence
  Synthetic Polynucleotide
taatacgactcactatagggggtccctggctgttgtgagtaggtggagagaacagaggagactctccatgtactcacaaaacctggcggcagcgcaaaagatg

SEQ ID NO: 173301 - DNA, 103 bp, Artificial Sequence
  Synthetic Polynucleotide
taatacgactcactatagggggtagcccagggtccctggctgttgtgagtaacagaggagaactcacatgagccagggaaacctggcggcagcgcaaaagatg

SEQ ID NO: 173302 - DNA, 103 bp, Artificial Sequence
  Synthetic Polynucleotide
taatacgactcactatagggggtggttgggggtagcccagggtccctggcaacagaggagagccaggatgcctgggctaaacctggcggcagcgcaaaagatg

SEQ ID NO: 173303 - DNA, 103 bp, Artificial Sequence
  Synthetic Polynucleotide
taatacgactcactatagggctgtgctgggggtggttgggggtagcccagaacagaggagactgggcatgccccaaccaaacctggcggcagcgcaaaagatg

SEQ ID NO: 173304 - DNA, 103 bp, Artificial Sequence
  Synthetic Polynucleotide
taatacgactcactatagggggggctggggctgtgctgggggtggttgggaacagaggagacccaacatgccccagcacaacctggcggcagcgcaaaagatg

SEQ ID NO: 173305 - DNA, 103 bp, Artificial Sequence
  Synthetic Polynucleotide
taatacgactcactatagggtgggtgaattcttcattactgaggaatgaaaacagaggagattcattatgcagtaatgaaacctggcggcagcgcaaaagatg

SEQ ID NO: 173306 - DNA, 103 bp, Artificial Sequence
  Synthetic Polynucleotide
taatacgactcactatagggggaggacgtaggggctggggctgtgctgggaacagaggagacccagcatggccccagccaacctggcggcagcgcaaaagatg

SEQ ID NO: 173307 - DNA, 103 bp, Artificial Sequence
  Synthetic Polynucleotide
taatacgactcactataggggacccttcggggaggacgtaggggctggggaacagaggagaccccagatgctacgtcctaacctggcggcagcgcaaaagatg

SEQ ID NO: 173308 - DNA, 103 bp, Artificial Sequence
  Synthetic Polynucleotide
taatacgactcactatagggacagactgctgacccttcggggaggacgtaaacagaggagatacgtcatgcccgaagggaacctggcggcagcgcaaaagatg

SEQ ID NO: 173309 - DNA, 103 bp, Artificial Sequence
  Synthetic Polynucleotide
taatacgactcactataggggacgactcagacagactgctgacccttcggaacagaggagaccgaagatgcagcagtctaacctggcggcagcgcaaaagatg

SEQ ID NO: 173310 - DNA, 103 bp, Artificial Sequence
  Synthetic Polynucleotide
taatacgactcactatagggctggaggcctgacgactcagacagactgctaacagaggagaagcagtatgtctgagtcgaacctggcggcagcgcaaaagatg

SEQ ID NO: 173311 - DNA, 103 bp, Artificial Sequence
  Synthetic Polynucleotide
taatacgactcactatagggggggcggctgctggaggcctgacgactcagaacagaggagactgagtatgcaggcctccaacctggcggcagcgcaaaagatg

SEQ ID NO: 173312 - DNA, 103 bp, Artificial Sequence
  Synthetic Polynucleotide
taatacgactcactatagggcaacatcagctgggtgaattcttcattactaacagaggagaagtaatatggaattcaccaacctggcggcagcgcaaaagatg

SEQ ID NO: 173313 - DNA, 103 bp, Artificial Sequence
  Synthetic Polynucleotide
taatacgactcactatagggctaatgcctccaacatcagctgggtgaattaacagaggagaaattcaatgagctgatgtaacctggcggcagcgcaaaagatg

SEQ ID NO: 173314 - DNA, 103 bp, Artificial Sequence
  Synthetic Polynucleotide
taatacgactcactatagggatgaagccatctaatgcctccaacatcagcaacagaggagagctgatatgggaggcattaacctggcggcagcgcaaaagatg

SEQ ID NO: 173315 - DNA, 103 bp, Artificial Sequence
  Synthetic Polynucleotide
taatacgactcactatagggcactgcgataatgaagccatctaatgcctcaacagaggagagaggcaatggatggcttcaacctggcggcagcgcaaaagatg

SEQ ID NO: 173316 - DNA, 103 bp, Artificial Sequence
  Synthetic Polynucleotide
taatacgactcactatagggcgtctgttgtcactgcgataatgaagccataacagaggagaatggctatgttatcgcagaacctggcggcagcgcaaaagatg

SEQ ID NO: 173317 - DNA, 103 bp, Artificial Sequence
  Synthetic Polynucleotide
taatacgactcactataggggacttgtttcgagaagctctcttggctctgaacagaggagacagagcatggagagcttcaacctggcggcagcgcaaaagatg

SEQ ID NO: 173318 - DNA, 103 bp, Artificial Sequence
  Synthetic Polynucleotide
taatacgactcactatagggatgatgctgccgtctgttgtcactgcgataaacagaggagatatcgcatggacaacagaaacctggcggcagcgcaaaagatg

SEQ ID NO: 173319 - DNA, 103 bp, Artificial Sequence
  Synthetic Polynucleotide
taatacgactcactatagggagagacatagatgatgctgccgtctgttgtaacagaggagaacaacaatgggcagcatcaacctggcggcagcgcaaaagatg

SEQ ID NO: 173320 - DNA, 103 bp, Artificial Sequence
  Synthetic Polynucleotide
taatacgactcactatagggtgatactgtcagagacatagatgatgctgcaacagaggagagcagcaatgtctatgtctaacctggcggcagcgcaaaagatg

SEQ ID NO: 173321 - DNA, 103 bp, Artificial Sequence
  Synthetic Polynucleotide
taatacgactcactatagggaggagaggcgtgatactgtcagagacatagaacagaggagactatgtatgtgacagtataacctggcggcagcgcaaaagatg

SEQ ID NO: 173322 - DNA, 103 bp, Artificial Sequence
  Synthetic Polynucleotide
taatacgactcactatagggtaaatgcccaaggagaggcgtgatactgtcaacagaggagagacagtatgacgcctctcaacctggcggcagcgcaaaagatg

SEQ ID NO: 173323 - DNA, 103 bp, Artificial Sequence
  Synthetic Polynucleotide
taatacgactcactatagggcatccgacggtaaatgcccaaggagaggcgaacagaggagacgcctcatgttgggcattaacctggcggcagcgcaaaagatg

SEQ ID NO: 173324 - DNA, 103 bp, Artificial Sequence
  Synthetic Polynucleotide
taatacgactcactatagggtgatccatgacatccgacggtaaatgcccaaacagaggagatgggcaatgaccgtcggaaacctggcggcagcgcaaaagatg

SEQ ID NO: 173325 - DNA, 103 bp, Artificial Sequence
  Synthetic Polynucleotide
taatacgactcactatagggtaacaaattctgatccatgacatccgacggaacagaggagaccgtcgatggtcatggataacctggcggcagcgcaaaagatg

SEQ ID NO: 173326 - DNA, 103 bp, Artificial Sequence
  Synthetic Polynucleotide
taatacgactcactatagggggaggaaatttaacaaattctgatccatgaaacagaggagatcatggatgagaatttgtaacctggcggcagcgcaaaagatg

SEQ ID NO: 173327 - DNA, 103 bp, Artificial Sequence
  Synthetic Polynucleotide
taatacgactcactatagggtcttgttctgggaggaaatttaacaaattcaacagaggagagaatttatgaaatttcctaacctggcggcagcgcaaaagatg

SEQ ID NO: 173328 - DNA, 103 bp, Artificial Sequence
  Synthetic Polynucleotide
taatacgactcactatagggcttcttctcagacttgtttcgagaagctctaacagaggagaagagctatgcgaaacaagaacctggcggcagcgcaaaagatg

SEQ ID NO: 173329 - DNA, 103 bp, Artificial Sequence
  Synthetic Polynucleotide
taatacgactcactatagggttctgaatgttcttgttctgggaggaaattaacagaggagaaatttcatgccagaacaaaacctggcggcagcgcaaaagatg

SEQ ID NO: 173330 - DNA, 103 bp, Artificial Sequence
  Synthetic Polynucleotide
taatacgactcactatagggttttataaacttctgaatgttcttgttctgaacagaggagacagaacatgaacattcagaacctggcggcagcgcaaaagatg

SEQ ID NO: 173331 - DNA, 103 bp, Artificial Sequence
  Synthetic Polynucleotide
taatacgactcactataggggaagaaaggattttataaacttctgaatgtaacagaggagaacattcatgagtttataaaacctggcggcagcgcaaaagatg

SEQ ID NO: 173332 - DNA, 103 bp, Artificial Sequence
  Synthetic Polynucleotide
taatacgactcactatagggaagcatatgggaagaaaggattttataaacaacagaggagagtttatatgatcctttctaacctggcggcagcgcaaaagatg

SEQ ID NO: 173333 - DNA, 103 bp, Artificial Sequence
  Synthetic Polynucleotide
taatacgactcactatagggaatccgtcacaagcatatgggaagaaaggaaacagaggagatcctttatgcccatatgcaacctggcggcagcgcaaaagatg

SEQ ID NO: 173334 - DNA, 103 bp, Artificial Sequence
  Synthetic Polynucleotide
taatacgactcactatagggggggagggggaatccgtcacaagcatatggaacagaggagaccatatatgtgtgacggaaacctggcggcagcgcaaaagatg

SEQ ID NO: 173335 - DNA, 103 bp, Artificial Sequence
  Synthetic Polynucleotide
taatacgactcactatagggtaagtattctggggagggggaatccgtcacaacagaggagagtgacgatgtccccctccaacctggcggcagcgcaaaagatg

SEQ ID NO: 173336 - DNA, 103 bp, Artificial Sequence
  Synthetic Polynucleotide
taatacgactcactatagggtgtcagattttaagtattctggggagggggaacagaggagaccccctatgcagaatactaacctggcggcagcgcaaaagatg

SEQ ID NO: 173337 - DNA, 103 bp, Artificial Sequence
  Synthetic Polynucleotide
taatacgactcactatagggtctaaatcgctgtcagattttaagtattctaacagaggagaagaataatgaaaatctgaaacctggcggcagcgcaaaagatg

SEQ ID NO: 173338 - DNA, 103 bp, Artificial Sequence
  Synthetic Polynucleotide
taatacgactcactataggggcaataaaactctaaatcgctgtcagatttaacagaggagaaaatctatgagcgatttaaacctggcggcagcgcaaaagatg

SEQ ID NO: 173339 - DNA, 103 bp, Artificial Sequence
  Synthetic Polynucleotide
taatacgactcactatagggggtcccgacgcttcttctcagacttgtttcaacagaggagagaaacaatgctgagaagaaacctggcggcagcgcaaaagatg

SEQ ID NO: 173340 - DNA, 103 bp, Artificial Sequence
  Synthetic Polynucleotide
taatacgactcactatagggtgagaagatggcaataaaactctaaatcgcaacagaggagagcgattatgagttttattaacctggcggcagcgcaaaagatg

SEQ ID NO: 173341 - DNA, 103 bp, Artificial Sequence
  Synthetic Polynucleotide
taatacgactcactatagggaagctgcctctgagaagatggcaataaaacaacagaggagagttttaatgccatcttctaacctggcggcagcgcaaaagatg

SEQ ID NO: 173342 - DNA, 103 bp, Artificial Sequence
  Synthetic Polynucleotide
taatacgactcactatagggctttgggttcaagctgcctctgagaagatgaacagaggagacatcttatgagaggcagcaacctggcggcagcgcaaaagatg

SEQ ID NO: 173343 - DNA, 103 bp, Artificial Sequence
  Synthetic Polynucleotide
taatacgactcactatagggttggaaattcctttgggttcaagctgcctcaacagaggagagaggcaatgtgaacccaaaacctggcggcagcgcaaaagatg

SEQ ID NO: 173344 - DNA, 103 bp, Artificial Sequence
  Synthetic Polynucleotide
taatacgactcactatagggtattcataagttggaaattcctttgggttcaacagaggagagaacccatgggaatttccaacctggcggcagcgcaaaagatg

SEQ ID NO: 173345 - DNA, 103 bp, Artificial Sequence
  Synthetic Polynucleotide
taatacgactcactatagggaaattttatgtattcataagttggaaattcaacagaggagagaatttatgacttatgaaaacctggcggcagcgcaaaagatg

SEQ ID NO: 173346 - DNA, 103 bp, Artificial Sequence
  Synthetic Polynucleotide
taatacgactcactatagggaatttcctacaaattttatgtattcataagaacagaggagacttatgatgacataaaataacctggcggcagcgcaaaagatg

SEQ ID NO: 173347 - DNA, 103 bp, Artificial Sequence
  Synthetic Polynucleotide
taatacgactcactatagggtaagagcgaaaatttcctacaaattttatgaacagaggagacataaaatgtgtaggaaaaacctggcggcagcgcaaaagatg

SEQ ID NO: 173348 - DNA, 103 bp, Artificial Sequence
  Synthetic Polynucleotide
taatacgactcactatagggcacattgttgtaagagcgaaaatttcctacaacagaggagagtaggaatgtttcgctctaacctggcggcagcgcaaaagatg

SEQ ID NO: 173349 - DNA, 103 bp, Artificial Sequence
  Synthetic Polynucleotide
taatacgactcactatagggaggggctaggcacattgttgtaagagcgaaaacagaggagattcgctatgacaacaatgaacctggcggcagcgcaaaagatg

SEQ ID NO: 173350 - DNA, 103 bp, Artificial Sequence
  Synthetic Polynucleotide
taatacgactcactatagggacattgaactggtcccgacgcttcttctcaaacagaggagatgagaaatggcgtcgggaaacctggcggcagcgcaaaagatg

SEQ ID NO: 173351 - DNA, 103 bp, Artificial Sequence
  Synthetic Polynucleotide
taatacgactcactatagggccattacaggaggggctaggcacattgttgaacagaggagacaacaaatggcctagcccaacctggcggcagcgcaaaagatg

SEQ ID NO: 173352 - DNA, 103 bp, Artificial Sequence
  Synthetic Polynucleotide
taatacgactcactataggggttgtcaaaaccattacaggaggggctaggaacagaggagacctagcatgtcctgtaataacctggcggcagcgcaaaagatg

SEQ ID NO: 173353 - DNA, 103 bp, Artificial Sequence
  Synthetic Polynucleotide
taatacgactcactatagggttgaaagggtgttgtcaaaaccattacaggaacagaggagacctgtaatggttttgacaaacctggcggcagcgcaaaagatg

SEQ ID NO: 173354 - DNA, 103 bp, Artificial Sequence
  Synthetic Polynucleotide
taatacgactcactatagggcggcaaggtcttgaaagggtgttgtcaaaaaacagaggagattttgaatgcaccctttcaacctggcggcagcgcaaaagatg

SEQ ID NO: 173355 - DNA, 103 bp, Artificial Sequence
  Synthetic Polynucleotide
taatacgactcactatagggtagtggcacccggcaaggtcttgaaagggtaacagaggagaacccttatgagaccttgcaacctggcggcagcgcaaaagatg

SEQ ID NO: 173356 - DNA, 103 bp, Artificial Sequence
  Synthetic Polynucleotide
taatacgactcactatagggcctcctttcctagtggcacccggcaaggtcaacagaggagagaccttatggggtgccacaacctggcggcagcgcaaaagatg

SEQ ID NO: 173357 - DNA, 103 bp, Artificial Sequence
  Synthetic Polynucleotide
taatacgactcactatagggatgaagcaaacctcctttcctagtggcaccaacagaggagaggtgccatgaggaaaggaaacctggcggcagcgcaaaagatg

SEQ ID NO: 173358 - DNA, 103 bp, Artificial Sequence
  Synthetic Polynucleotide
taatacgactcactatagggaacggtggcaatgaagcaaacctcctttccaacagaggagaggaaagatggtttgcttcaacctggcggcagcgcaaaagatg

SEQ ID NO: 173359 - DNA, 103 bp, Artificial Sequence
  Synthetic Polynucleotide
taatacgactcactatagggttgccagacgaacggtggcaatgaagcaaaaacagaggagatttgctatgttgccaccgaacctggcggcagcgcaaaagatg

SEQ ID NO: 173360 - DNA, 103 bp, Artificial Sequence
  Synthetic Polynucleotide
taatacgactcactatagggaattgtggtgttgccagacgaacggtggcaaacagaggagatgccacatgtcgtctggcaacctggcggcagcgcaaaagatg

SEQ ID NO: 173361 - DNA, 103 bp, Artificial Sequence
  Synthetic Polynucleotide
taatacgactcactatagggtttgatgagaacattgaactggtcccgacgaacagaggagacgtcggatgcagttcaataacctggcggcagcgcaaaagatg

SEQ ID NO: 173362 - DNA, 103 bp, Artificial Sequence
  Synthetic Polynucleotide
taatacgactcactatagggttcctttaagaattgtggtgttgccagacgaacagaggagacgtctgatgacaccacaaaacctggcggcagcgcaaaagatg

SEQ ID NO: 173363 - DNA, 103 bp, Artificial Sequence
  Synthetic Polynucleotide
taatacgactcactatagggctatgcacatttcctttaagaattgtggtgaacagaggagacaccacatgtcttaaaggaacctggcggcagcgcaaaagatg

SEQ ID NO: 173364 - DNA, 103 bp, Artificial Sequence
  Synthetic Polynucleotide
taatacgactcactatagggggttcgtcaactatgcacatttcctttaagaacagaggagacttaaaatgaatgtgcataacctggcggcagcgcaaaagatg

SEQ ID NO: 173365 - DNA, 103 bp, Artificial Sequence
  Synthetic Polynucleotide
taatacgactcactatagggttcctctaaaggttcgtcaactatgcacataacagaggagaatgtgcatggttgacgaaaacctggcggcagcgcaaaagatg

SEQ ID NO: 173366 - DNA, 103 bp, Artificial Sequence
  Synthetic Polynucleotide
taatacgactcactatagggttgaagtgaattcctctaaaggttcgtcaaaacagaggagattgacgatgctttagaggaacctggcggcagcgcaaaagatg

SEQ ID NO: 173367 - DNA, 103 bp, Artificial Sequence
  Synthetic Polynucleotide
taatacgactcactatagggaagctatgccttgaagtgaattcctctaaaaacagaggagatttagaatgattcacttcaacctggcggcagcgcaaaagatg

SEQ ID NO: 173368 - DNA, 103 bp, Artificial Sequence
  Synthetic Polynucleotide
taatacgactcactatagggtttccattccaagctatgccttgaagtgaaaacagaggagattcactatgaggcatagcaacctggcggcagcgcaaaagatg

SEQ ID NO: 173369 - DNA, 103 bp, Artificial Sequence
  Synthetic Polynucleotide
taatacgactcactataggggaaataaaaatttccattccaagctatgccaacagaggagaggcataatgtggaatggaaacctggcggcagcgcaaaagatg

SEQ ID NO: 173370 - DNA, 103 bp, Artificial Sequence
  Synthetic Polynucleotide
taatacgactcactatagggctgtgatccagaaataaaaatttccattccaacagaggagaggaatgatgatttttattaacctggcggcagcgcaaaagatg

SEQ ID NO: 173371 - DNA, 103 bp, Artificial Sequence
  Synthetic Polynucleotide
taatacgactcactatagggtggaggtgctctgtgatccagaaataaaaaaacagaggagatttttaatgctggatcacaacctggcggcagcgcaaaagatg

SEQ ID NO: 173372 - DNA, 103 bp, Artificial Sequence
  Synthetic Polynucleotide
taatacgactcactatagggaactgagctctttgatgagaacattgaactaacagaggagaagttcaatgttctcatcaaacctggcggcagcgcaaaagatg

SEQ ID NO: 173373 - DNA, 103 bp, Artificial Sequence
  Synthetic Polynucleotide
taatacgactcactatagggatcctatgattggaggtgctctgtgatccaaacagaggagatggatcatggagcacctcaacctggcggcagcgcaaaagatg

SEQ ID NO: 173374 - DNA, 103 bp, Artificial Sequence
  Synthetic Polynucleotide
taatacgactcactatagggaaaggcaggtatcctatgattggaggtgctaacagaggagaagcaccatgaatcataggaacctggcggcagcgcaaaagatg

SEQ ID NO: 173375 - DNA, 103 bp, Artificial Sequence
  Synthetic Polynucleotide
taatacgactcactatagggcagcacttcaaaaggcaggtatcctatgataacagaggagaatcataatgtacctgcctaacctggcggcagcgcaaaagatg

SEQ ID NO: 173376 - DNA, 103 bp, Artificial Sequence
  Synthetic Polynucleotide
taatacgactcactatagggctgaggttcccagcacttcaaaaggcaggtaacagaggagaacctgcatgttgaagtgcaacctggcggcagcgcaaaagatg

SEQ ID NO: 173377 - DNA, 103 bp, Artificial Sequence
  Synthetic Polynucleotide
taatacgactcactatagggtagtcatagcctgaggttcccagcacttcaaacagaggagatgaagtatggggaacctcaacctggcggcagcgcaaaagatg

SEQ ID NO: 173378 - DNA, 103 bp, Artificial Sequence
  Synthetic Polynucleotide
taatacgactcactatagggaatgtggtagtagtcatagcctgaggttccaacagaggagaggaaccatgggctatgacaacctggcggcagcgcaaaagatg

SEQ ID NO: 173379 - DNA, 103 bp, Artificial Sequence
  Synthetic Polynucleotide
taatacgactcactatagggccaggtcatcaatgtggtagtagtcatagcaacagaggagagctatgatgactaccacaaacctggcggcagcgcaaaagatg

SEQ ID NO: 173380 - DNA, 103 bp, Artificial Sequence
  Synthetic Polynucleotide
taatacgactcactataggggccaggagctccaggtcatcaatgtggtagaacagaggagactaccaatgtgatgacctaacctggcggcagcgcaaaagatg

SEQ ID NO: 173381 - DNA, 103 bp, Artificial Sequence
  Synthetic Polynucleotide
taatacgactcactataggggtgacacctggccaggagctccaggtcatcaacagaggagagatgacatggagctcctgaacctggcggcagcgcaaaagatg

SEQ ID NO: 173382 - DNA, 103 bp, Artificial Sequence
  Synthetic Polynucleotide
taatacgactcactatagggtcaggtgctggtgacacctggccaggagctaacagaggagaagctccatgccaggtgtcaacctggcggcagcgcaaaagatg

SEQ ID NO: 173383 - DNA, 103 bp, Artificial Sequence
  Synthetic Polynucleotide
taatacgactcactataggggggagcatggaactgagctctttgatgagaaacagaggagatctcatatgagagctcagaacctggcggcagcgcaaaagatg

SEQ ID NO: 173384 - DNA, 103 bp, Artificial Sequence
  Synthetic Polynucleotide
taatacgactcactatagggccaaactgcatcaggtgctggtgacacctgaacagaggagacaggtgatgccagcacctaacctggcggcagcgcaaaagatg

SEQ ID NO: 173385 - DNA, 103 bp, Artificial Sequence
  Synthetic Polynucleotide
taatacgactcactatagggcttccctttgccaaactgcatcaggtgctgaacagaggagacagcacatgatgcagtttaacctggcggcagcgcaaaagatg

SEQ ID NO: 173386 - DNA, 103 bp, Artificial Sequence
  Synthetic Polynucleotide
taatacgactcactatagggagcaacacgacttccctttgccaaactgcaaacagaggagatgcagtatggcaaagggaaacctggcggcagcgcaaaagatg

SEQ ID NO: 173387 - DNA, 103 bp, Artificial Sequence
  Synthetic Polynucleotide
taatacgactcactatagggagaaaccggtagcaacacgacttccctttgaacagaggagacaaaggatggtcgtgttgaacctggcggcagcgcaaaagatg

SEQ ID NO: 173388 - DNA, 103 bp, Artificial Sequence
  Synthetic Polynucleotide
taatacgactcactatagggacctttggtcagaaaccggtagcaacacgaaacagaggagatcgtgtatgtaccggtttaacctggcggcagcgcaaaagatg

SEQ ID NO: 173389 - DNA, 103 bp, Artificial Sequence
  Synthetic Polynucleotide
taatacgactcactatagggtccactgctgacctttggtcagaaaccggtaacagaggagaaccggtatgtgaccaaagaacctggcggcagcgcaaaagatg

SEQ ID NO: 173390 - DNA, 103 bp, Artificial Sequence
  Synthetic Polynucleotide
taatacgactcactatagggtgcagccagatccactgctgacctttggtcaacagaggagagaccaaatgtcagcagtgaacctggcggcagcgcaaaagatg

SEQ ID NO: 173391 - DNA, 103 bp, Artificial Sequence
  Synthetic Polynucleotide
taatacgactcactataggggtagtgagtctgcagccagatccactgctgaacagaggagacagcagatgatctggctgaacctggcggcagcgcaaaagatg

SEQ ID NO: 173392 - DNA, 103 bp, Artificial Sequence
  Synthetic Polynucleotide
taatacgactcactatagggaggtgatgtagtagtgagtctgcagccagaaacagaggagatctggcatgagactcactaacctggcggcagcgcaaaagatg

SEQ ID NO: 173393 - DNA, 103 bp, Artificial Sequence
  Synthetic Polynucleotide
taatacgactcactatagggcactgatggtaggtgatgtagtagtgagtcaacagaggagagactcaatgctacatcacaacctggcggcagcgcaaaagatg

SEQ ID NO: 173394 - DNA, 103 bp, Artificial Sequence
  Synthetic Polynucleotide
taatacgactcactatagggcttggaggcgcccttggtggagcggtacataacagaggagaatgtacatgtccaccaagaacctggcggcagcgcaaaagatg

SEQ ID NO: 173395 - DNA, 103 bp, Artificial Sequence
  Synthetic Polynucleotide
taatacgactcactatagggcaggtaggacagccggaccttgtccgcttcaacagaggagagaagcgatgaaggtccggaacctggcggcagcgcaaaagatg

SEQ ID NO: 173396 - DNA, 103 bp, Artificial Sequence
  Synthetic Polynucleotide
taatacgactcactatagggcggagtgcccaggacataagctgcctgggtaacagaggagaacccagatggcttatgtcaacctggcggcagcgcaaaagatg

SEQ ID NO: 173397 - DNA, 103 bp, Artificial Sequence
  Synthetic Polynucleotide
taatacgactcactataggggcagcatggtcggagtgcccaggacataagaacagaggagacttatgatgtgggcactcaacctggcggcagcgcaaaagatg

SEQ ID NO: 173398 - DNA, 103 bp, Artificial Sequence
  Synthetic Polynucleotide
taatacgactcactataggggggaatgagggcagcatggtcggagtgcccaacagaggagagggcacatggaccatgctaacctggcggcagcgcaaaagatg

SEQ ID NO: 173399 - DNA, 103 bp, Artificial Sequence
  Synthetic Polynucleotide
taatacgactcactatagggaatgttttcagggaatgagggcagcatggtaacagaggagaaccatgatgccctcattcaacctggcggcagcgcaaaagatg

SEQ ID NO: 173400 - DNA, 103 bp, Artificial Sequence
  Synthetic Polynucleotide
taatacgactcactatagggcctgggaaagaatgttttcagggaatgaggaacagaggagacctcatatgctgaaaacaaacctggcggcagcgcaaaagatg

SEQ ID NO: 173401 - DNA, 103 bp, Artificial Sequence
  Synthetic Polynucleotide
taatacgactcactataggggagcactcttcctgggaaagaatgttttcaaacagaggagatgaaaaatgtctttcccaaacctggcggcagcgcaaaagatg

SEQ ID NO: 173402 - DNA, 103 bp, Artificial Sequence
  Synthetic Polynucleotide
taatacgactcactataggggttagtgctggagcactcttcctgggaaagaacagaggagactttccatggaagagtgcaacctggcggcagcgcaaaagatg

SEQ ID NO: 173403 - DNA, 103 bp, Artificial Sequence
  Synthetic Polynucleotide
taatacgactcactatagggtgaagagtgggttagtgctggagcactcttaacagaggagaaagagtatgccagcactaaacctggcggcagcgcaaaagatg

SEQ ID NO: 173404 - DNA, 103 bp, Artificial Sequence
  Synthetic Polynucleotide
taatacgactcactatagggagtgctgcggtgaagagtgggttagtgctgaacagaggagacagcacatgcccactcttaacctggcggcagcgcaaaagatg

SEQ ID NO: 173405 - DNA, 103 bp, Artificial Sequence
  Synthetic Polynucleotide
taatacgactcactataggggggagcccccagtgctgcggtgaagagtggaacagaggagaccactcatgaccgcagcaaacctggcggcagcgcaaaagatg

SEQ ID NO: 173406 - DNA, 103 bp, Artificial Sequence
  Synthetic Polynucleotide
taatacgactcactatagggtcatgatgtgcaggtaggacagccggacctaacagaggagaaggtccatgtgtcctaccaacctggcggcagcgcaaaagatg

SEQ ID NO: 173407 - DNA, 103 bp, Artificial Sequence
  Synthetic Polynucleotide
taatacgactcactatagggtggtgcttctgggagcccccagtgctgcggaacagaggagaccgcagatgtgggggctcaacctggcggcagcgcaaaagatg

SEQ ID NO: 173408 - DNA, 103 bp, Artificial Sequence
  Synthetic Polynucleotide
taatacgactcactatagggctggggaagctggtgcttctgggagcccccaacagaggagagggggcatgcagaagcacaacctggcggcagcgcaaaagatg

SEQ ID NO: 173409 - DNA, 103 bp, Artificial Sequence
  Synthetic Polynucleotide
taatacgactcactatagggttcaggagcactggggaagctggtgcttctaacagaggagaagaagcatgagcttccccaacctggcggcagcgcaaaagatg

SEQ ID NO: 173410 - DNA, 103 bp, Artificial Sequence
  Synthetic Polynucleotide
taatacgactcactatagggcaacactcagttcaggagcactggggaagcaacagaggagagcttccatggtgctcctgaacctggcggcagcgcaaaagatg

SEQ ID NO: 173411 - DNA, 103 bp, Artificial Sequence
  Synthetic Polynucleotide
taatacgactcactataggggatgcagagacaacactcagttcaggagcaaacagaggagatgctccatgactgagtgtaacctggcggcagcgcaaaagatg

SEQ ID NO: 173412 - DNA, 103 bp, Artificial Sequence
  Synthetic Polynucleotide
taatacgactcactatagggaagctcttctgatgcagagacaacactcagaacagaggagactgagtatggtctctgcaaacctggcggcagcgcaaaagatg

SEQ ID NO: 173413 - DNA, 103 bp, Artificial Sequence
  Synthetic Polynucleotide
taatacgactcactatagggagggtcggggaagctcttctgatgcagagaaacagaggagatctctgatgcagaagagcaacctggcggcagcgcaaaagatg

SEQ ID NO: 173414 - DNA, 103 bp, Artificial Sequence
  Synthetic Polynucleotide
taatacgactcactatagggagttctttggagggtcggggaagctcttctaacagaggagaagaagaatgtccccgaccaacctggcggcagcgcaaaagatg

SEQ ID NO: 173415 - DNA, 103 bp, Artificial Sequence
  Synthetic Polynucleotide
taatacgactcactatagggactgaagtccagttctttggagggtcggggaacagaggagaccccgaatgtccaaagaaaacctggcggcagcgcaaaagatg

SEQ ID NO: 173416 - DNA, 103 bp, Artificial Sequence
  Synthetic Polynucleotide
taatacgactcactatagggatgtcaggtaactgaagtccagttctttggaacagaggagaccaaagatgtggacttcaaacctggcggcagcgcaaaagatg

SEQ ID NO: 173417 - DNA, 103 bp, Artificial Sequence
  Synthetic Polynucleotide
taatacgactcactatagggcaggcgaggctcatgatgtgcaggtaggacaacagaggagagtcctaatggcacatcataacctggcggcagcgcaaaagatg

SEQ ID NO: 173418 - DNA, 103 bp, Artificial Sequence
  Synthetic Polynucleotide
taatacgactcactatagggccagaagggaatgtcaggtaactgaagtccaacagaggagaggacttatgttacctgacaacctggcggcagcgcaaaagatg

SEQ ID NO: 173419 - DNA, 103 bp, Artificial Sequence
  Synthetic Polynucleotide
taatacgactcactatagggaggctcaggcccagaagggaatgtcaggtaaacagaggagatacctgatgttcccttctaacctggcggcagcgcaaaagatg

SEQ ID NO: 173420 - DNA, 103 bp, Artificial Sequence
  Synthetic Polynucleotide
taatacgactcactatagggcttggagagaaggctcaggcccagaagggaaacagaggagatcccttatgggcctgagcaacctggcggcagcgcaaaagatg

SEQ ID NO: 173421 - DNA, 103 bp, Artificial Sequence
  Synthetic Polynucleotide
taatacgactcactatagggcttagttctgcttggagagaaggctcaggcaacagaggagagcctgaatgttctctccaaacctggcggcagcgcaaaagatg

SEQ ID NO: 173422 - DNA, 103 bp, Artificial Sequence
  Synthetic Polynucleotide
taatacgactcactatagggaagatccttgcttagttctgcttggagagaaacagaggagatctctcatggcagaactaaacctggcggcagcgcaaaagatg

SEQ ID NO: 173423 - DNA, 103 bp, Artificial Sequence
  Synthetic Polynucleotide
taatacgactcactataggggagtgcacacaagatccttgcttagttctgaacagaggagacagaacatggcaaggatcaacctggcggcagcgcaaaagatg

SEQ ID NO: 173424 - DNA, 103 bp, Artificial Sequence
  Synthetic Polynucleotide
taatacgactcactataggggtgtaaggtggagtgcacacaagatccttgaacagaggagacaaggaatgtgtgtgcacaacctggcggcagcgcaaaagatg

SEQ ID NO: 173425 - DNA, 103 bp, Artificial Sequence
  Synthetic Polynucleotide
taatacgactcactatagggctgatggggcgtgtaaggtggagtgcacacaacagaggagagtgtgcatgccaccttacaacctggcggcagcgcaaaagatg

SEQ ID NO: 173426 - DNA, 103 bp, Artificial Sequence
  Synthetic Polynucleotide
taatacgactcactatagggagcctcctggctgatggggcgtgtaaggtgaacagaggagacaccttatgcgccccatcaacctggcggcagcgcaaaagatg

SEQ ID NO: 173427 - DNA, 103 bp, Artificial Sequence
  Synthetic Polynucleotide
taatacgactcactatagggaggaaggcacagcctcctggctgatggggcaacagaggagagccccaatggccaggaggaacctggcggcagcgcaaaagatg

SEQ ID NO: 173428 - DNA, 103 bp, Artificial Sequence
  Synthetic Polynucleotide
taatacgactcactatagggagtgtagatgcaggcgaggctcatgatgtgaacagaggagacacatcatgagcctcgccaacctggcggcagcgcaaaagatg

SEQ ID NO: 173429 - DNA, 103 bp, Artificial Sequence
  Synthetic Polynucleotide
taatacgactcactataggggaggctgaagaggaaggcacagcctcctggaacagaggagaccaggaatgtgtgccttcaacctggcggcagcgcaaaagatg

SEQ ID NO: 173430 - DNA, 103 bp, Artificial Sequence
  Synthetic Polynucleotide
taatacgactcactatagggagggctcatggaggctgaagaggaaggcacaacagaggagagtgcctatgtcttcagccaacctggcggcagcgcaaaagatg

SEQ ID NO: 173431 - DNA, 103 bp, Artificial Sequence
  Synthetic Polynucleotide
taatacgactcactatagggtgggtctggaagggctcatggaggctgaagaacagaggagacttcagatgccatgagccaacctggcggcagcgcaaaagatg

SEQ ID NO: 173432 - DNA, 103 bp, Artificial Sequence
  Synthetic Polynucleotide
taatacgactcactatagggggtgggcaaatgggtctggaagggctcatgaacagaggagacatgagatgttccagaccaacctggcggcagcgcaaaagatg

SEQ ID NO: 173433 - DNA, 103 bp, Artificial Sequence
  Synthetic Polynucleotide
taatacgactcactatagggtgctggatggggtgggcaaatgggtctggaaacagaggagatccagaatgatttgcccaaacctggcggcagcgcaaaagatg

SEQ ID NO: 173434 - DNA, 103 bp, Artificial Sequence
  Synthetic Polynucleotide
taatacgactcactatagggtcttgaagagtgctggatggggtgggcaaaaacagaggagatttgccatgcccatccagaacctggcggcagcgcaaaagatg

SEQ ID NO: 173435 - DNA, 103 bp, Artificial Sequence
  Synthetic Polynucleotide
taatacgactcactatagggagtcagctgttcttgaagagtgctggatggaacagaggagaccatccatgactcttcaaaacctggcggcagcgcaaaagatg

SEQ ID NO: 173436 - DNA, 103 bp, Artificial Sequence
  Synthetic Polynucleotide
taatacgactcactatagggcagtgcttggagtcagctgttcttgaagagaacagaggagactcttcatgaacagctgaaacctggcggcagcgcaaaagatg

SEQ ID NO: 173437 - DNA, 103 bp, Artificial Sequence
  Synthetic Polynucleotide
taatacgactcactataggggagaaggtcgcagtgcttggagtcagctgtaacagaggagaacagctatgtccaagcacaacctggcggcagcgcaaaagatg

SEQ ID NO: 173438 - DNA, 103 bp, Artificial Sequence
  Synthetic Polynucleotide
taatacgactcactatagggcaactgatcagagaaggtcgcagtgcttggaacagaggagaccaagcatggcgaccttcaacctggcggcagcgcaaaagatg

SEQ ID NO: 173439 - DNA, 103 bp, Artificial Sequence
  Synthetic Polynucleotide
taatacgactcactatagggcgcccttgcgagtgtagatgcaggcgaggcaacagaggagagcctcgatggcatctacaaacctggcggcagcgcaaaagatg

SEQ ID NO: 173440 - DNA, 103 bp, Artificial Sequence
  Synthetic Polynucleotide
taatacgactcactatagggtgctgggcgtcaactgatcagagaaggtcgaacagaggagacgacctatgctgatcagtaacctggcggcagcgcaaaagatg

SEQ ID NO: 173441 - DNA, 103 bp, Artificial Sequence
  Synthetic Polynucleotide
taatacgactcactatagggaaggttgcactgctgggcgtcaactgatcaaacagaggagatgatcaatggacgcccagaacctggcggcagcgcaaaagatg

SEQ ID NO: 173442 - DNA, 103 bp, Artificial Sequence
  Synthetic Polynucleotide
taatacgactcactatagggtggatctgggaaggttgcactgctgggcgtaacagaggagaacgcccatgagtgcaaccaacctggcggcagcgcaaaagatg

SEQ ID NO: 173443 - DNA, 103 bp, Artificial Sequence
  Synthetic Polynucleotide
taatacgactcactatagggggctagttagtggatctgggaaggttgcacaacagaggagagtgcaaatgtcccagatcaacctggcggcagcgcaaaagatg

SEQ ID NO: 173444 - DNA, 103 bp, Artificial Sequence
  Synthetic Polynucleotide
taatacgactcactatagggccttgcagtgggctagttagtggatctgggaacagaggagacccagaatgactaactagaacctggcggcagcgcaaaagatg

SEQ ID NO: 173445 - DNA, 103 bp, Artificial Sequence
  Synthetic Polynucleotide
taatacgactcactatagggagtcaactggccttgcagtgggctagttagaacagaggagactaactatgccactgcaaaacctggcggcagcgcaaaagatg

SEQ ID NO: 173446 - DNA, 103 bp, Artificial Sequence
  Synthetic Polynucleotide
taatacgactcactatagggccgaggtttcagtcaactggccttgcagtgaacagaggagacactgcatggccagttgaaacctggcggcagcgcaaaagatg

SEQ ID NO: 173447 - DNA, 103 bp, Artificial Sequence
  Synthetic Polynucleotide
taatacgactcactatagggtagcttctgaccgaggtttcagtcaactggaacagaggagaccagttatgtgaaacctcaacctggcggcagcgcaaaagatg

SEQ ID NO: 173448 - DNA, 103 bp, Artificial Sequence
  Synthetic Polynucleotide
taatacgactcactatagggctggtcttcatagcttctgaccgaggtttcaacagaggagagaaaccatggtcagaagcaacctggcggcagcgcaaaagatg

SEQ ID NO: 173449 - DNA, 103 bp, Artificial Sequence
  Synthetic Polynucleotide
taatacgactcactatagggagggagtcaactggtcttcatagcttctgaaacagaggagatcagaaatgatgaagaccaacctggcggcagcgcaaaagatg

SEQ ID NO: 173450 - DNA, 103 bp, Artificial Sequence
  Synthetic Polynucleotide
taatacgactcactataggggcgaagaagacgcccttgcgagtgtagatgaacagaggagacatctaatgtcgcaagggaacctggcggcagcgcaaaagatg

SEQ ID NO: 173451 - DNA, 103 bp, Artificial Sequence
  Synthetic Polynucleotide
taatacgactcactataggggtggaggtgcagggagtcaactggtcttcaaacagaggagatgaagaatggttgactccaacctggcggcagcgcaaaagatg

SEQ ID NO: 173452 - DNA, 103 bp, Artificial Sequence
  Synthetic Polynucleotide
taatacgactcactataggggtctgggaaggtggaggtgcagggagtcaaaacagaggagattgactatgtgcacctccaacctggcggcagcgcaaaagatg

SEQ ID NO: 173453 - DNA, 103 bp, Artificial Sequence
  Synthetic Polynucleotide
taatacgactcactataggggaagcagctggtctgggaaggtggaggtgcaacagaggagagcacctatgccttcccagaacctggcggcagcgcaaaagatg

SEQ ID NO: 173454 - DNA, 103 bp, Artificial Sequence
  Synthetic Polynucleotide
taatacgactcactataggggctgtgctgggaagcagctggtctgggaagaacagaggagacttcccatgccagctgctaacctggcggcagcgcaaaagatg

SEQ ID NO: 173455 - DNA, 103 bp, Artificial Sequence
  Synthetic Polynucleotide
taatacgactcactatagggtgggaaggtggctgtgctgggaagcagctgaacagaggagacagctgatgcccagcacaaacctggcggcagcgcaaaagatg

SEQ ID NO: 173456 - DNA, 103 bp, Artificial Sequence
  Synthetic Polynucleotide
taatacgactcactatagggccagaggctctgggaaggtggctgtgctggaacagaggagaccagcaatgccaccttccaacctggcggcagcgcaaaagatg

SEQ ID NO: 173457 - DNA, 103 bp, Artificial Sequence
  Synthetic Polynucleotide
taatacgactcactataggggcagggctgcccagaggctctgggaaggtgaacagaggagacaccttatgagagcctctaacctggcggcagcgcaaaagatg

SEQ ID NO: 173458 - DNA, 103 bp, Artificial Sequence
  Synthetic Polynucleotide
taatacgactcactatagggctgttcatgggcagggctgcccagaggctcaacagaggagagagcctatgggcagccctaacctggcggcagcgcaaaagatg

SEQ ID NO: 173459 - DNA, 103 bp, Artificial Sequence
  Synthetic Polynucleotide
taatacgactcactataggggaggagtcagctgttcatgggcagggctgcaacagaggagagcagccatgcccatgaacaacctggcggcagcgcaaaagatg

SEQ ID NO: 173460 - DNA, 103 bp, Artificial Sequence
  Synthetic Polynucleotide
taatacgactcactataggggctgtgctgggaggagtcagctgttcatggaacagaggagaccatgaatggctgactccaacctggcggcagcgcaaaagatg

SEQ ID NO: 173461 - DNA, 103 bp, Artificial Sequence
  Synthetic Polynucleotide
taatacgactcactatagggagtgccaccagcgaagaagacgcccttgcgaacagaggagacgcaagatggtcttcttcaacctggcggcagcgcaaaagatg

SEQ ID NO: 173462 - DNA, 103 bp, Artificial Sequence
  Synthetic Polynucleotide
taatacgactcactatagggtgcttggaatgctgtgctgggaggagtcagaacagaggagactgactatgcccagcacaaacctggcggcagcgcaaaagatg

SEQ ID NO: 173463 - DNA, 103 bp, Artificial Sequence
  Synthetic Polynucleotide
taatacgactcactatagggtgtccaggtgtgcttggaatgctgtgctggaacagaggagaccagcaatgcattccaagaacctggcggcagcgcaaaagatg

SEQ ID NO: 173464 - DNA, 103 bp, Artificial Sequence
  Synthetic Polynucleotide
taatacgactcactatagggtggctggggctgtccaggtgtgcttggaataacagaggagaattccaatgacacctggaaacctggcggcagcgcaaaagatg

SEQ ID NO: 173465 - DNA, 103 bp, Artificial Sequence
  Synthetic Polynucleotide
taatacgactcactatagggtgggaaggtttggctggggctgtccaggtgaacagaggagacacctgatgagccccagcaacctggcggcagcgcaaaagatg

SEQ ID NO: 173466 - DNA, 103 bp, Artificial Sequence
  Synthetic Polynucleotide
taatacgactcactatagggtcagttgctctgggaaggtttggctggggcaacagaggagagccccaatgaaaccttccaacctggcggcagcgcaaaagatg

SEQ ID NO: 173467 - DNA, 103 bp, Artificial Sequence
  Synthetic Polynucleotide
taatacgactcactataggggggttggggctcagttgctctgggaaggttaacagaggagaaaccttatgagagcaactaacctggcggcagcgcaaaagatg

SEQ ID NO: 173468 - DNA, 103 bp, Artificial Sequence
  Synthetic Polynucleotide
taatacgactcactatagggagtcttggtagggttggggctcagttgctcaacagaggagagagcaaatgagccccaacaacctggcggcagcgcaaaagatg

SEQ ID NO: 173469 - DNA, 103 bp, Artificial Sequence
  Synthetic Polynucleotide
taatacgactcactataggggggcaaagtaagtcttggtagggttggggcaacagaggagagccccaatgctaccaagaaacctggcggcagcgcaaaagatg

SEQ ID NO: 173470 - DNA, 103 bp, Artificial Sequence
  Synthetic Polynucleotide
taatacgactcactatagggcatccctcctgggcaaagtaagtcttggtaaacagaggagataccaaatgttactttgcaacctggcggcagcgcaaaagatg

SEQ ID NO: 173471 - DNA, 103 bp, Artificial Sequence
  Synthetic Polynucleotide
taatacgactcactataggggagaaaactgcatccctcctgggcaaagtaaacagaggagatactttatgcaggagggaaacctggcggcagcgcaaaagatg

SEQ ID NO: 173472 - DNA, 103 bp, Artificial Sequence
  Synthetic Polynucleotide
taatacgactcactatagggccgccagaggagtgccaccagcgaagaagaaacagaggagatcttctatgctggtggcaaacctggcggcagcgcaaaagatg

SEQ ID NO: 173473 - DNA, 103 bp, Artificial Sequence
  Synthetic Polynucleotide
taatacgactcactatagggacttctcatagagaaaactgcatccctcctaacagaggagaaggaggatggcagttttcaacctggcggcagcgcaaaagatg

SEQ ID NO: 173474 - DNA, 103 bp, Artificial Sequence
  Synthetic Polynucleotide
taatacgactcactatagggcttgggggcaacttctcatagagaaaactgaacagaggagacagtttatgctatgagaaaacctggcggcagcgcaaaagatg

SEQ ID NO: 173475 - DNA, 103 bp, Artificial Sequence
  Synthetic Polynucleotide
taatacgactcactataggggctgctaggacttgggggcaacttctcataaacagaggagatatgagatgttgcccccaaacctggcggcagcgcaaaagatg

SEQ ID NO: 173476 - DNA, 103 bp, Artificial Sequence
  Synthetic Polynucleotide
taatacgactcactatagggcattaccagggctgctaggacttgggggcaaacagaggagatgccccatggtcctagcaaacctggcggcagcgcaaaagatg

SEQ ID NO: 173477 - DNA, 103 bp, Artificial Sequence
  Synthetic Polynucleotide
taatacgactcactataggggtgcagtccccattaccagggctgctaggaaacagaggagatcctagatgccctggtaaaacctggcggcagcgcaaaagatg

SEQ ID NO: 173478 - DNA, 103 bp, Artificial Sequence
  Synthetic Polynucleotide
taatacgactcactatagggggccaagagcgtgcagtccccattaccaggaacagaggagacctggtatgggggactgcaacctggcggcagcgcaaaagatg

SEQ ID NO: 173479 - DNA, 103 bp, Artificial Sequence
  Synthetic Polynucleotide
taatacgactcactataggggctgggctagggccaagagcgtgcagtcccaacagaggagagggactatgcgctcttggaacctggcggcagcgcaaaagatg

SEQ ID NO: 173480 - DNA, 103 bp, Artificial Sequence
  Synthetic Polynucleotide
taatacgactcactataggggggccccggagctgggctagggccaagagcaacagaggagagctcttatgcctagcccaaacctggcggcagcgcaaaagatg

SEQ ID NO: 173481 - DNA, 103 bp, Artificial Sequence
  Synthetic Polynucleotide
taatacgactcactatagggcacagagagggggccccggagctgggctagaacagaggagactagccatgctccggggcaacctggcggcagcgcaaaagatg

SEQ ID NO: 173482 - DNA, 103 bp, Artificial Sequence
  Synthetic Polynucleotide
taatacgactcactataggggggggacatccacagagagggggccccggaaacagaggagatccgggatgccctctctgaacctggcggcagcgcaaaagatg

SEQ ID NO: 173483 - DNA, 103 bp, Artificial Sequence
  Synthetic Polynucleotide
taatacgactcactatagggcccgtggggcccgccagaggagtgccaccaaacagaggagatggtggatgtcctctggcaacctggcggcagcgcaaaagatg

SEQ ID NO: 173484 - DNA, 103 bp, Artificial Sequence
  Synthetic Polynucleotide
taatacgactcactatagggtcgggcaccagggggacatccacagagaggaacagaggagacctctcatgggatgtcccaacctggcggcagcgcaaaagatg

SEQ ID NO: 173485 - DNA, 103 bp, Artificial Sequence
  Synthetic Polynucleotide
taatacgactcactataggggagcaggccttcgggcaccagggggacatcaacagaggagagatgtcatgctggtgcccaacctggcggcagcgcaaaagatg

SEQ ID NO: 173486 - DNA, 103 bp, Artificial Sequence
  Synthetic Polynucleotide
taatacgactcactatagggcctcaggtgtgagcaggccttcgggcaccaaacagaggagatggtgcatgaaggcctgcaacctggcggcagcgcaaaagatg

SEQ ID NO: 173487 - DNA, 103 bp, Artificial Sequence
  Synthetic Polynucleotide
taatacgactcactatagggactggagaggcctcaggtgtgagcaggcctaacagaggagaaggcctatgcacacctgaaacctggcggcagcgcaaaagatg

SEQ ID NO: 173488 - DNA, 103 bp, Artificial Sequence
  Synthetic Polynucleotide
taatacgactcactatagggactctgcttgactggagaggcctcaggtgtaacagaggagaacacctatggcctctccaaacctggcggcagcgcaaaagatg

SEQ ID NO: 173489 - DNA, 103 bp, Artificial Sequence
  Synthetic Polynucleotide
taatacgactcactatagggagtggaagaaactctgcttgactggagaggaacagaggagacctctcatgtcaagcagaaacctggcggcagcgcaaaagatg

SEQ ID NO: 173490 - DNA, 103 bp, Artificial Sequence
  Synthetic Polynucleotide
taatacgactcactatagggttttcagagtagtggaagaaactctgcttgaacagaggagacaagcaatgtttcttccaaacctggcggcagcgcaaaagatg

SEQ ID NO: 173491 - DNA, 103 bp, Artificial Sequence
  Synthetic Polynucleotide
taatacgactcactatagggattctgctccttttcagagtagtggaagaaaacagaggagattcttcatgtactctgaaaacctggcggcagcgcaaaagatg

SEQ ID NO: 173492 - DNA, 103 bp, Artificial Sequence
  Synthetic Polynucleotide
taatacgactcactatagggggtctatctcattctgctccttttcagagtaacagaggagaactctgatgaggagcagaaacctggcggcagcgcaaaagatg

SEQ ID NO: 173493 - DNA, 103 bp, Artificial Sequence
  Synthetic Polynucleotide
taatacgactcactatagggtggatgagacggtctatctcattctgctccaacagaggagaggagcaatgtgagatagaaacctggcggcagcgcaaaagatg

SEQ ID NO: 173494 - DNA, 103 bp, Artificial Sequence
  Synthetic Polynucleotide
taatacgactcactatagggtgagagaagccccgtggggcccgccagaggaacagaggagacctctgatgggccccacgaacctggcggcagcgcaaaagatg

SEQ ID NO: 173495 - DNA, 103 bp, Artificial Sequence
  Synthetic Polynucleotide
taatacgactcactataggggctaatctgctggatgagacggtctatctcaacagaggagagagataatgcgtctcatcaacctggcggcagcgcaaaagatg

SEQ ID NO: 173496 - DNA, 103 bp, Artificial Sequence
  Synthetic Polynucleotide
taatacgactcactataggggagccaattggctaatctgctggatgagacaacagaggagagtctcaatgagcagattaaacctggcggcagcgcaaaagatg

SEQ ID NO: 173497 - DNA, 103 bp, Artificial Sequence
  Synthetic Polynucleotide
taatacgactcactatagggtccatgccctgagccaattggctaatctgcaacagaggagagcagatatgccaattggcaacctggcggcagcgcaaaagatg

SEQ ID NO: 173498 - DNA, 103 bp, Artificial Sequence
  Synthetic Polynucleotide
taatacgactcactataggggaagggtctgtccatgccctgagccaattgaacagaggagacaattgatgcagggcatgaacctggcggcagcgcaaaagatg

SEQ ID NO: 173499 - DNA, 103 bp, Artificial Sequence
  Synthetic Polynucleotide
taatacgactcactatagggcctcagctgagaagggtctgtccatgccctaacagaggagaagggcaatgacagaccctaacctggcggcagcgcaaaagatg

SEQ ID NO: 173500 - DNA, 103 bp, Artificial Sequence
  Synthetic Polynucleotide
taatacgactcactatagggccagtgccagcctcagctgagaagggtctgaacagaggagacagaccatgctcagctgaaacctggcggcagcgcaaaagatg

SEQ ID NO: 173501 - DNA, 103 bp, Artificial Sequence
  Synthetic Polynucleotide
taatacgactcactatagggctctagtccgccagtgccagcctcagctgaaacagaggagatcagctatggctggcactaacctggcggcagcgcaaaagatg

SEQ ID NO: 173502 - DNA, 103 bp, Artificial Sequence
  Synthetic Polynucleotide
taatacgactcactatagggctccaagtggctctagtccgccagtgccagaacagaggagactggcaatggcggactagaacctggcggcagcgcaaaagatg

SEQ ID NO: 173503 - DNA, 103 bp, Artificial Sequence
  Synthetic Polynucleotide
taatacgactcactatagggggctccagtcctccaagtggctctagtccgaacagaggagacggactatggccacttggaacctggcggcagcgcaaaagatg

SEQ ID NO: 173504 - DNA, 103 bp, Artificial Sequence
  Synthetic Polynucleotide
taatacgactcactatagggggagtccaggggctccagtcctccaagtggaacagaggagaccacttatgggactggagaacctggcggcagcgcaaaagatg

SEQ ID NO: 173505 - DNA, 103 bp, Artificial Sequence
  Synthetic Polynucleotide
taatacgactcactatagggcccggcgcgccttggaggcgcccttggtggaacagaggagaccaccaatggcgcctccaaacctggcggcagcgcaaaagatg

SEQ ID NO: 173506 - DNA, 103 bp, Artificial Sequence
  Synthetic Polynucleotide
taatacgactcactataggggctcttgagctgagagaagccccgtggggcaacagaggagagccccaatgggcttctctaacctggcggcagcgcaaaagatg

SEQ ID NO: 173507 - DNA, 103 bp, Artificial Sequence
  Synthetic Polynucleotide
taatacgactcactataggggggacaggttggagtccaggggctccagtcaacagaggagagactggatgccctggactaacctggcggcagcgcaaaagatg

SEQ ID NO: 173508 - DNA, 103 bp, Artificial Sequence
  Synthetic Polynucleotide
taatacgactcactataggggcccctgacagggacaggttggagtccaggaacagaggagacctggaatgcaacctgtcaacctggcggcagcgcaaaagatg

SEQ ID NO: 173509 - DNA, 103 bp, Artificial Sequence
  Synthetic Polynucleotide
taatacgactcactatagggaggggggcctgcccctgacagggacaggttaacagaggagaaacctgatgctgtcagggaacctggcggcagcgcaaaagatg

SEQ ID NO: 173510 - DNA, 103 bp, Artificial Sequence
  Synthetic Polynucleotide
taatacgactcactatagggggctgagcacaggggggcctgcccctgacaaacagaggagatgtcagatgcaggcccccaacctggcggcagcgcaaaagatg

SEQ ID NO: 173511 - DNA, 103 bp, Artificial Sequence
  Synthetic Polynucleotide
taatacgactcactatagggttcaggtccaggctgagcacaggggggcctaacagaggagaaggcccatgtgtgctcagaacctggcggcagcgcaaaagatg

SEQ ID NO: 173512 - DNA, 103 bp, Artificial Sequence
  Synthetic Polynucleotide
taatacgactcactatagggtttccagggtttcaggtccaggctgagcacaacagaggagagtgctcatgctggacctgaacctggcggcagcgcaaaagatg

SEQ ID NO: 173513 - DNA, 103 bp, Artificial Sequence
  Synthetic Polynucleotide
taatacgactcactataggggctcctggcatttccagggtttcaggtccaaacagaggagatggaccatgaaccctggaaacctggcggcagcgcaaaagatg

SEQ ID NO: 173514 - DNA, 103 bp, Artificial Sequence
  Synthetic Polynucleotide
taatacgactcactatagggaggaagtccagctcctggcatttccagggtaacagaggagaaccctgatgatgccaggaaacctggcggcagcgcaaaagatg

SEQ ID NO: 173515 - DNA, 103 bp, Artificial Sequence
  Synthetic Polynucleotide
taatacgactcactatagggagggtcagccaggaagtccagctcctggcaaacagaggagatgccagatgctggacttcaacctggcggcagcgcaaaagatg

SEQ ID NO: 173516 - DNA, 103 bp, Artificial Sequence
  Synthetic Polynucleotide
taatacgactcactatagggacatgttatcagggtcagccaggaagtccaaacagaggagatggactatgtggctgaccaacctggcggcagcgcaaaagatg

SEQ ID NO: 173517 - DNA, 103 bp, Artificial Sequence
  Synthetic Polynucleotide
taatacgactcactatagggatgtcctcaagctcttgagctgagagaagcaacagaggagagcttctatgagctcaagaaacctggcggcagcgcaaaagatg

SEQ ID NO: 173518 - DNA, 103 bp, Artificial Sequence
  Synthetic Polynucleotide
taatacgactcactatagggtcttccaggaacatgttatcagggtcagccaacagaggagaggctgaatgtgataacataacctggcggcagcgcaaaagatg

SEQ ID NO: 173519 - DNA, 103 bp, Artificial Sequence
  Synthetic Polynucleotide
taatacgactcactatagggcacgggcgtctcttccaggaacatgttatcaacagaggagagataacatgttcctggaaaacctggcggcagcgcaaaagatg

SEQ ID NO: 173520 - DNA, 103 bp, Artificial Sequence
  Synthetic Polynucleotide
taatacgactcactatagggagatgtcttccacgggcgtctcttccaggaaacagaggagatcctggatgagacgcccgaacctggcggcagcgcaaaagatg

SEQ ID NO: 173521 - DNA, 103 bp, Artificial Sequence
  Synthetic Polynucleotide
taatacgactcactatagggagatccatgaagatgtcttccacgggcgtcaacagaggagagacgccatgggaagacataacctggcggcagcgcaaaagatg

SEQ ID NO: 173522 - DNA, 103 bp, Artificial Sequence
  Synthetic Polynucleotide
taatacgactcactatagggtggggtagagagatccatgaagatgtcttcaacagaggagagaagacatgttcatggataacctggcggcagcgcaaaagatg

SEQ ID NO: 173523 - DNA, 103 bp, Artificial Sequence
  Synthetic Polynucleotide
taatacgactcactatagggcactgggatctggggtagagagatccatgaaacagaggagatcatggatgtctctacccaacctggcggcagcgcaaaagatg

SEQ ID NO: 173524 - DNA, 103 bp, Artificial Sequence
  Synthetic Polynucleotide
taatacgactcactatagggccccattcctcactgggatctggggtagagaacagaggagactctacatgagatcccagaacctggcggcagcgcaaaagatg

SEQ ID NO: 173525 - DNA, 103 bp, Artificial Sequence
  Synthetic Polynucleotide
taatacgactcactatagggatcccctgagccccattcctcactgggatcaacagaggagagatcccatggaggaatggaacctggcggcagcgcaaaagatg

SEQ ID NO: 173526 - DNA, 103 bp, Artificial Sequence
  Synthetic Polynucleotide
taatacgactcactatagggctgcctcaggatcccctgagccccattcctaacagaggagaaggaatatggctcaggggaacctggcggcagcgcaaaagatg

SEQ ID NO: 173527 - DNA, 103 bp, Artificial Sequence
  Synthetic Polynucleotide
taatacgactcactatagggcctgggccctctgcctcaggatcccctgagaacagaggagactcaggatgtcctgaggcaacctggcggcagcgcaaaagatg

SEQ ID NO: 173528 - DNA, 103 bp, Artificial Sequence
  Synthetic Polynucleotide
taatacgactcactatagggtgccgctacgatgtcctcaagctcttgagcaacagaggagagctcaaatgcttgaggacaacctggcggcagcgcaaaagatg

SEQ ID NO: 173529 - DNA, 103 bp, Artificial Sequence
  Synthetic Polynucleotide
taatacgactcactatagggtggggcccctcctgggccctctgcctcaggaacagaggagacctgagatggagggcccaaacctggcggcagcgcaaaagatg

SEQ ID NO: 173530 - DNA, 103 bp, Artificial Sequence
  Synthetic Polynucleotide
taatacgactcactatagggtgcaaggcgatggggcccctcctgggccctaacagaggagaagggccatggaggggcccaacctggcggcagcgcaaaagatg

SEQ ID NO: 173531 - DNA, 103 bp, Artificial Sequence
  Synthetic Polynucleotide
taatacgactcactataggggacaggttgttgcaaggcgatggggcccctaacagaggagaaggggcatgatcgccttgaacctggcggcagcgcaaaagatg

SEQ ID NO: 173532 - DNA, 103 bp, Artificial Sequence
  Synthetic Polynucleotide
taatacgactcactataggggtcttctggggacaggttgttgcaaggcgaaacagaggagatcgcctatgaacaacctgaacctggcggcagcgcaaaagatg

SEQ ID NO: 173533 - DNA, 103 bp, Artificial Sequence
  Synthetic Polynucleotide
taatacgactcactatagggggaagctgtggtcttctggggacaggttgtaacagaggagaacaaccatgccccagaagaacctggcggcagcgcaaaagatg

SEQ ID NO: 173534 - DNA, 103 bp, Artificial Sequence
  Synthetic Polynucleotide
taatacgactcactatagggaggtcctccaggaagctgtggtcttctgggaacagaggagacccagaatgccacagcttaacctggcggcagcgcaaaagatg

SEQ ID NO: 173535 - DNA, 103 bp, Artificial Sequence
  Synthetic Polynucleotide
taatacgactcactatagggatatgtggccaggtcctccaggaagctgtgaacagaggagacacagcatgctggaggacaacctggcggcagcgcaaaagatg

SEQ ID NO: 173536 - DNA, 103 bp, Artificial Sequence
  Synthetic Polynucleotide
taatacgactcactatagggaggcggtttcatatgtggccaggtcctccaaacagaggagatggaggatgtggccacataacctggcggcagcgcaaaagatg

SEQ ID NO: 173537 - DNA, 103 bp, Artificial Sequence
  Synthetic Polynucleotide
taatacgactcactatagggcctgtctcaaaggcggtttcatatgtggccaacagaggagaggccacatgtgaaaccgcaacctggcggcagcgcaaaagatg

SEQ ID NO: 173538 - DNA, 103 bp, Artificial Sequence
  Synthetic Polynucleotide
taatacgactcactatagggtgctgagacacctgtctcaaaggcggtttcaacagaggagagaaaccatgtttgagacaaacctggcggcagcgcaaaagatg

SEQ ID NO: 173539 - DNA, 103 bp, Artificial Sequence
  Synthetic Polynucleotide
taatacgactcactatagggagccgggtagtgccgctacgatgtcctcaaaacagaggagattgaggatgtcgtagcggaacctggcggcagcgcaaaagatg

SEQ ID NO: 173540 - DNA, 103 bp, Artificial Sequence
  Synthetic Polynucleotide
taatacgactcactatagggcataggggaatgctgagacacctgtctcaaaacagaggagattgagaatggtgtctcagaacctggcggcagcgcaaaagatg

SEQ ID NO: 173541 - DNA, 103 bp, Artificial Sequence
  Synthetic Polynucleotide
taatacgactcactataggggtaaacccatcataggggaatgctgagacaaacagaggagatgtctcatgattcccctaaacctggcggcagcgcaaaagatg

SEQ ID NO: 173542 - DNA, 103 bp, Artificial Sequence
  Synthetic Polynucleotide
taatacgactcactatagggcaactcatcagtaaacccatcataggggaaaacagaggagattccccatggatgggtttaacctggcggcagcgcaaaagatg

SEQ ID NO: 173543 - DNA, 103 bp, Artificial Sequence
  Synthetic Polynucleotide
taatacgactcactatagggggagttgatgcaactcatcagtaaacccataacagaggagaatgggtatgctgatgagtaacctggcggcagcgcaaaagatg

SEQ ID NO: 173544 - DNA, 103 bp, Artificial Sequence
  Synthetic Polynucleotide
taatacgactcactatagggacttggctctggagttgatgcaactcatcaaacagaggagatgatgaatggcatcaactaacctggcggcagcgcaaaagatg

SEQ ID NO: 173545 - DNA, 103 bp, Artificial Sequence
  Synthetic Polynucleotide
taatacgactcactataggggctgtcttgaacttggctctggagttgatgaacagaggagacatcaaatgcagagccaaaacctggcggcagcgcaaaagatg

SEQ ID NO: 173546 - DNA, 103 bp, Artificial Sequence
  Synthetic Polynucleotide
taatacgactcactatagggcttcatggaagctgtcttgaacttggctctaacagaggagaagagccatgttcaagacaaacctggcggcagcgcaaaagatg

SEQ ID NO: 173547 - DNA, 103 bp, Artificial Sequence
  Synthetic Polynucleotide
taatacgactcactatagggccacttccatcttcatggaagctgtcttgaaacagaggagatcaagaatgcttccatgaaacctggcggcagcgcaaaagatg

SEQ ID NO: 173548 - DNA, 103 bp, Artificial Sequence
  Synthetic Polynucleotide
taatacgactcactatagggtggttcccctccacttccatcttcatggaaaacagaggagattccatatggatggaagtaacctggcggcagcgcaaaagatg

SEQ ID NO: 173549 - DNA, 103 bp, Artificial Sequence
  Synthetic Polynucleotide
taatacgactcactatagggacaagcagaaagccgggtagtgccgctacgaacagaggagacgtagcatgactacccggaacctggcggcagcgcaaaagatg

SEQ ID NO: 173550 - DNA, 103 bp, Artificial Sequence
  Synthetic Polynucleotide
taatacgactcactatagggggctgtgaacacaagcagaaagccgggtagaacagaggagactacccatgtttctgcttaacctggcggcagcgcaaaagatg

SEQ ID NO: 173551 - DNA, 103 bp, Artificial Sequence
  Synthetic Polynucleotide
taatacgactcactatagggatttcccctcggctgtgaacacaagcagaaaacagaggagattctgcatgtgttcacagaacctggcggcagcgcaaaagatg

SEQ ID NO: 173552 - DNA, 103 bp, Artificial Sequence
  Synthetic Polynucleotide
taatacgactcactatagggaggtagagcaatttcccctcggctgtgaacaacagaggagagttcacatgcgaggggaaaacctggcggcagcgcaaaagatg

SEQ ID NO: 173553 - DNA, 103 bp, Artificial Sequence
  Synthetic Polynucleotide
taatacgactcactatagggactctcagacaggtagagcaatttcccctcaacagaggagagaggggatgttgctctacaacctggcggcagcgcaaaagatg

SEQ ID NO: 173554 - DNA, 103 bp, Artificial Sequence
  Synthetic Polynucleotide
taatacgactcactataggggctcgctcacactctcagacaggtagagcaaacagaggagatgctctatgtgtctgagaaacctggcggcagcgcaaaagatg

SEQ ID NO: 173555 - DNA, 103 bp, Artificial Sequence
  Synthetic Polynucleotide
taatacgactcactatagggttgatctggtcccggcgcgccttggaggcgaacagaggagacgcctcatgggcgcgccgaacctggcggcagcgcaaaagatg

SEQ ID NO: 173556 - DNA, 103 bp, Artificial Sequence
  Synthetic Polynucleotide
taatacgactcactatagggtggcccagatgctcgctcacactctcagacaacagaggagagtctgaatgtgtgagcgaaacctggcggcagcgcaaaagatg

SEQ ID NO: 173557 - DNA, 103 bp, Artificial Sequence
  Synthetic Polynucleotide
taatacgactcactatagggcaccatggagtggcccagatgctcgctcacaacagaggagagtgagcatgcatctgggcaacctggcggcagcgcaaaagatg

SEQ ID NO: 173558 - DNA, 103 bp, Artificial Sequence
  Synthetic Polynucleotide
taatacgactcactatagggcaaccaggtccaccatggagtggcccagataacagaggagaatctggatgactccatggaacctggcggcagcgcaaaagatg

SEQ ID NO: 173559 - DNA, 103 bp, Artificial Sequence
  Synthetic Polynucleotide
taatacgactcactatagggtcaccctgggcaaccaggtccaccatggagaacagaggagactccatatgggacctggtaacctggcggcagcgcaaaagatg

SEQ ID NO: 173560 - DNA, 103 bp, Artificial Sequence
  Synthetic Polynucleotide
taatacgactcactataggggtagatgctgtcaccctgggcaaccaggtcaacagaggagagacctgatggcccagggtaacctggcggcagcgcaaaagatg

SEQ ID NO: 173561 - DNA, 103 bp, Artificial Sequence
  Synthetic Polynucleotide
taatacgactcactatagggcaatgatgtcgtagatgctgtcaccctgggaacagaggagacccaggatgacagcatctaacctggcggcagcgcaaaagatg

SEQ ID NO: 173562 - DNA, 103 bp, Artificial Sequence
  Synthetic Polynucleotide
taatacgactcactatagggtcagctgggtcaatgatgtcgtagatgctgaacagaggagacagcatatgcgacatcataacctggcggcagcgcaaaagatg

SEQ ID NO: 173563 - DNA, 103 bp, Artificial Sequence
  Synthetic Polynucleotide
taatacgactcactatagggagtgaggtggtcagctgggtcaatgatgtcaacagaggagagacatcatggacccagctaacctggcggcagcgcaaaagatg

SEQ ID NO: 173564 - DNA, 103 bp, Artificial Sequence
  Synthetic Polynucleotide
taatacgactcactataggggctggcgcacagtgaggtggtcagctgggtaacagaggagaacccagatgaccacctcaaacctggcggcagcgcaaaagatg

SEQ ID NO: 173565 - DNA, 103 bp, Artificial Sequence
  Synthetic Polynucleotide
taatacgactcactatagggagggtgagttgctggcgcacagtgaggtggaacagaggagaccacctatgtgtgcgccaaacctggcggcagcgcaaaagatg

SEQ ID NO: 173566 - DNA, 103 bp, Artificial Sequence
  Synthetic Polynucleotide
taatacgactcactataggggatctcggcgttgatctggtcccggcgcgcaacagaggagagcgcgcatggaccagatcaacctggcggcagcgcaaaagatg

SEQ ID NO: 173567 - DNA, 103 bp, Artificial Sequence
  Synthetic Polynucleotide
taatacgactcactatagggggcagagggcagggtgagttgctggcgcacaacagaggagagtgcgcatgcaactcaccaacctggcggcagcgcaaaagatg

SEQ ID NO: 173568 - DNA, 103 bp, Artificial Sequence
  Synthetic Polynucleotide
taatacgactcactatagggcagtgtccagggcagagggcagggtgagttaacagaggagaaactcaatgtgccctctgaacctggcggcagcgcaaaagatg

SEQ ID NO: 173569 - DNA, 103 bp, Artificial Sequence
  Synthetic Polynucleotide
taatacgactcactatagggaagaggcgatcagtgtccagggcagagggcaacagaggagagccctcatgcctggacacaacctggcggcagcgcaaaagatg

SEQ ID NO: 173570 - DNA, 103 bp, Artificial Sequence
  Synthetic Polynucleotide
taatacgactcactataggggcggcagcggaagaggcgatcagtgtccagaacagaggagactggacatggatcgcctcaacctggcggcagcgcaaaagatg

SEQ ID NO: 173571 - DNA, 103 bp, Artificial Sequence
  Synthetic Polynucleotide
taatacgactcactatagggaggtgttgaagcggcagcggaagaggcgataacagaggagaatcgccatgtccgctgccaacctggcggcagcgcaaaagatg

SEQ ID NO: 173572 - DNA, 103 bp, Artificial Sequence
  Synthetic Polynucleotide
taatacgactcactatagggagggacttggaggtgttgaagcggcagcggaacagaggagaccgctgatgcttcaacacaacctggcggcagcgcaaaagatg

SEQ ID NO: 173573 - DNA, 103 bp, Artificial Sequence
  Synthetic Polynucleotide
taatacgactcactatagggctggcgcctgagggacttggaggtgttgaaaacagaggagattcaacatgtccaagtccaacctggcggcagcgcaaaagatg

SEQ ID NO: 173574 - DNA, 103 bp, Artificial Sequence
  Synthetic Polynucleotide
taatacgactcactatagggtgcctgcactctggcgcctgagggacttggaacagaggagaccaagtatgtcaggcgccaacctggcggcagcgcaaaagatg

SEQ ID NO: 173575 - DNA, 103 bp, Artificial Sequence
  Synthetic Polynucleotide
taatacgactcactatagggacgagtttgttgcctgcactctggcgcctgaacagaggagacaggcgatggagtgcaggaacctggcggcagcgcaaaagatg

SEQ ID NO: 173576 - DNA, 103 bp, Artificial Sequence
  Synthetic Polynucleotide
taatacgactcactatagggtcgaataagcacgagtttgttgcctgcactaacagaggagaagtgcaatgaacaaactcaacctggcggcagcgcaaaagatg

SEQ ID NO: 173577 - DNA, 103 bp, Artificial Sequence
  Synthetic Polynucleotide
taatacgactcactatagggtgaggttccggatctcggcgttgatctggtaacagaggagaaccagaatgacgccgagaaacctggcggcagcgcaaaagatg

SEQ ID NO: 173578 - DNA, 103 bp, Artificial Sequence
  Synthetic Polynucleotide
taatacgactcactatagggggaatcggcctcgaataagcacgagtttgtaacagaggagaacaaacatgtgcttattcaacctggcggcagcgcaaaagatg

SEQ ID NO: 173579 - DNA, 103 bp, Artificial Sequence
  Synthetic Polynucleotide
taatacgactcactataggggggtgagcatggaatcggcctcgaataagcaacagaggagagcttatatgaggccgattaacctggcggcagcgcaaaagatg

SEQ ID NO: 173580 - DNA, 103 bp, Artificial Sequence
  Synthetic Polynucleotide
taatacgactcactatagggggctccaggtgggtgagcatggaatcggccaacagaggagaggccgaatgcatgctcacaacctggcggcagcgcaaaagatg

SEQ ID NO: 173581 - DNA, 103 bp, Artificial Sequence
  Synthetic Polynucleotide
taatacgactcactatagggctgcccagtaggctccaggtgggtgagcataacagaggagaatgctcatgcacctggagaacctggcggcagcgcaaaagatg

SEQ ID NO: 173582 - DNA, 103 bp, Artificial Sequence
  Synthetic Polynucleotide
taatacgactcactatagggacgggatttcctgcccagtaggctccaggtaacagaggagaacctggatgctactgggcaacctggcggcagcgcaaaagatg

SEQ ID NO: 173583 - DNA, 103 bp, Artificial Sequence
  Synthetic Polynucleotide
taatacgactcactatagggagctgtgaacacgggatttcctgcccagtaaacagaggagatactggatgggaaatcccaacctggcggcagcgcaaaagatg

SEQ ID NO: 173584 - DNA, 103 bp, Artificial Sequence
  Synthetic Polynucleotide
taatacgactcactataggggggcacagaaagctgtgaacacgggatttcaacagaggagagaaatcatgtgttcacagaacctggcggcagcgcaaaagatg

SEQ ID NO: 173585 - DNA, 103 bp, Artificial Sequence
  Synthetic Polynucleotide
taatacgactcactatagggggctccagaggggcacagaaagctgtgaacaacagaggagagttcacatgtttctgtgcaacctggcggcagcgcaaaagatg

SEQ ID NO: 173586 - DNA, 103 bp, Artificial Sequence
  Synthetic Polynucleotide
taatacgactcactataggggcggggtctcggctccagaggggcacagaaaacagaggagattctgtatgcctctggagaacctggcggcagcgcaaaagatg

SEQ ID NO: 173587 - DNA, 103 bp, Artificial Sequence
  Synthetic Polynucleotide
taatacgactcactatagggcaggacctgggcggggtctcggctccagagaacagaggagactctggatgcgagaccccaacctggcggcagcgcaaaagatg

SEQ ID NO: 173588 - DNA, 103 bp, Artificial Sequence
  Synthetic Polynucleotide
taatacgactcactatagggagcagctccttgaggttccggatctcggcgaacagaggagacgccgaatgccggaacctaacctggcggcagcgcaaaagatg

SEQ ID NO: 173589 - DNA, 103 bp, Artificial Sequence
  Synthetic Polynucleotide
taatacgactcactataggggggccagggccaggacctgggcggggtctcaacagaggagagagaccatgcccaggtccaacctggcggcagcgcaaaagatg

SEQ ID NO: 173590 - DNA, 103 bp, Artificial Sequence
  Synthetic Polynucleotide
taatacgactcactatagggggcagggccagggccagggccaggacctggaacagaggagaccaggtatgggccctggcaacctggcggcagcgcaaaagatg

SEQ ID NO: 173591 - DNA, 103 bp, Artificial Sequence
  Synthetic Polynucleotide
taatacgactcactatagggggaagagcgaggcagggccagggccagggcaacagaggagagccctgatgctggccctgaacctggcggcagcgcaaaagatg

SEQ ID NO: 173592 - DNA, 103 bp, Artificial Sequence
  Synthetic Polynucleotide
taatacgactcactatagggaacatggccaggaagagcgaggcagggccaaacagaggagatggcccatgctcgctcttaacctggcggcagcgcaaaagatg

SEQ ID NO: 173593 - DNA, 103 bp, Artificial Sequence
  Synthetic Polynucleotide
taatacgactcactataggggcggctctggaacatggccaggaagagcgaaacagaggagatcgctcatgctggccatgaacctggcggcagcgcaaaagatg

SEQ ID NO: 173594 - DNA, 103 bp, Artificial Sequence
  Synthetic Polynucleotide
taatacgactcactatagggctttagcatggcggctctggaacatggccaaacagaggagatggccaatgtccagagccaacctggcggcagcgcaaaagatg

SEQ ID NO: 173595 - DNA, 103 bp, Artificial Sequence
  Synthetic Polynucleotide
taatacgactcactatagggagagccaggtctttagcatggcggctctggaacagaggagaccagagatgccatgctaaaacctggcggcagcgcaaaagatg

SEQ ID NO: 173596 - DNA, 103 bp, Artificial Sequence
  Synthetic Polynucleotide
taatacgactcactataggggatgtccagtagagccaggtctttagcatgaacagaggagacatgctatggacctggctaacctggcggcagcgcaaaagatg

SEQ ID NO: 173597 - DNA, 103 bp, Artificial Sequence
  Synthetic Polynucleotide
taatacgactcactatagggcactctcggagatgtccagtagagccaggtaacagaggagaacctggatgtactggacaaacctggcggcagcgcaaaagatg

SEQ ID NO: 173598 - DNA, 103 bp, Artificial Sequence
  Synthetic Polynucleotide
taatacgactcactatagggtagattaggacactctcggagatgtccagtaacagaggagaactggaatgctccgagagaacctggcggcagcgcaaaagatg

SEQ ID NO: 173599 - DNA, 103 bp, Artificial Sequence
  Synthetic Polynucleotide
taatacgactcactatagggggccagcggcagcagctccttgaggttccgaacagaggagacggaacatgaaggagctgaacctggcggcagcgcaaaagatg

SEQ ID NO: 173600 - DNA, 103 bp, Artificial Sequence
  Synthetic Polynucleotide
taatacgactcactatagggaaagcccaggtagattaggacactctcggaaacagaggagatccgagatggtcctaatcaacctggcggcagcgcaaaagatg

SEQ ID NO: 173601 - DNA, 103 bp, Artificial Sequence
  Synthetic Polynucleotide
taatacgactcactatagggcactgcgctcaaagcccaggtagattaggaaacagaggagatcctaaatgacctgggctaacctggcggcagcgcaaaagatg

SEQ ID NO: 173602 - DNA, 103 bp, Artificial Sequence
  Synthetic Polynucleotide
taatacgactcactatagggcaaagcagttcactgcgctcaaagcccaggaacagaggagacctgggatgtgagcgcagaacctggcggcagcgcaaaagatg

SEQ ID NO: 173603 - DNA, 103 bp, Artificial Sequence
  Synthetic Polynucleotide
taatacgactcactatagggccatgatttacaaagcagttcactgcgctcaacagaggagagagcgcatggaactgcttaacctggcggcagcgcaaaagatg

SEQ ID NO: 173604 - DNA, 103 bp, Artificial Sequence
  Synthetic Polynucleotide
taatacgactcactataggggcagtccataccatgatttacaaagcagttaacagaggagaaactgcatggtaaatcataacctggcggcagcgcaaaagatg

SEQ ID NO: 173605 - DNA, 103 bp, Artificial Sequence
  Synthetic Polynucleotide
taatacgactcactatagggtcggggtgcagcagtccataccatgatttaaacagaggagataaatcatggtatggactaacctggcggcagcgcaaaagatg

SEQ ID NO: 173606 - DNA, 103 bp, Artificial Sequence
  Synthetic Polynucleotide
taatacgactcactatagggggccaggtcctcggggtgcagcagtccataaacagaggagatatggaatgctgcaccccaacctggcggcagcgcaaaagatg

SEQ ID NO: 173607 - DNA, 103 bp, Artificial Sequence
  Synthetic Polynucleotide
taatacgactcactatagggcagaagcgtgggccaggtcctcggggtgcaaacagaggagatgcaccatgaggacctggaacctggcggcagcgcaaaagatg

SEQ ID NO: 173608 - DNA, 103 bp, Artificial Sequence
  Synthetic Polynucleotide
taatacgactcactatagggtagtgttgagcagaagcgtgggccaggtccaacagaggagaggacctatgccacgcttcaacctggcggcagcgcaaaagatg

SEQ ID NO: 173609 - DNA, 103 bp, Artificial Sequence
  Synthetic Polynucleotide
taatacgactcactatagggcaacaggcggtagtgttgagcagaagcgtgaacagaggagacacgctatggctcaacacaacctggcggcagcgcaaaagatg

SEQ ID NO: 173610 - DNA, 103 bp, Artificial Sequence
  Synthetic Polynucleotide
taatacgactcactatagggtgtccgcttcggccagcggcagcagctcctaacagaggagaaggagcatgtgccgctggaacctggcggcagcgcaaaagatg

SEQ ID NO: 173611 - DNA, 103 bp, Artificial Sequence
  Synthetic Polynucleotide
taatacgactcactatagggcactctcagccaacaggcggtagtgttgagaacagaggagactcaacatgaccgcctgtaacctggcggcagcgcaaaagatg

SEQ ID NO: 173612 - DNA, 103 bp, Artificial Sequence
  Synthetic Polynucleotide
taatacgactcactatagggtgaatatctccactctcagccaacaggcggaacagaggagaccgcctatgggctgagagaacctggcggcagcgcaaaagatg

SEQ ID NO: 173613 - DNA, 103 bp, Artificial Sequence
  Synthetic Polynucleotide
taatacgactcactatagggcatctctgcctgaatatctccactctcagcaacagaggagagctgagatgggagatattaacctggcggcagcgcaaaagatg

SEQ ID NO: 173614 - DNA, 103 bp, Artificial Sequence
  Synthetic Polynucleotide
taatacgactcactataggggcctcaccaccatctctgcctgaatatctcaacagaggagagagataatgaggcagagaaacctggcggcagcgcaaaagatg

SEQ ID NO: 173615 - DNA, 103 bp, Artificial Sequence
  Synthetic Polynucleotide
taatacgactcactatagggttggcctgtagcctcaccaccatctctgccaacagaggagaggcagaatgggtggtgagaacctggcggcagcgcaaaagatg

SEQ ID NO: 173616 - DNA, 103 bp, Artificial Sequence
  Synthetic Polynucleotide
taatacgactcactataggggcctccagtcttggcctgtagcctcaccacaacagaggagagtggtgatgctacaggccaacctggcggcagcgcaaaagatg

SEQ ID NO: 173617 - DNA, 103 bp, Artificial Sequence
  Synthetic Polynucleotide
taatacgactcactatagggtccatgcccagcctccagtcttggcctgtaaacagaggagatacaggatgagactggagaacctggcggcagcgcaaaagatg

SEQ ID NO: 173618 - DNA, 103 bp, Artificial Sequence
  Synthetic Polynucleotide
taatacgactcactatagggaggcagtaaatccatgcccagcctccagtcaacagaggagagactggatgctgggcatgaacctggcggcagcgcaaaagatg

SEQ ID NO: 173619 - DNA, 103 bp, Artificial Sequence
  Synthetic Polynucleotide
taatacgactcactatagggtgagtataacaggcagtaaatccatgcccaaacagaggagatgggcaatgatttactgcaacctggcggcagcgcaaaagatg

SEQ ID NO: 173620 - DNA, 103 bp, Artificial Sequence
  Synthetic Polynucleotide
taatacgactcactatagggctggaccttctgagtataacaggcagtaaaaacagaggagatttactatgtgttatactaacctggcggcagcgcaaaagatg

SEQ ID NO: 173621 - DNA, 103 bp, Artificial Sequence
  Synthetic Polynucleotide
taatacgactcactatagggagccggaccttgtccgcttcggccagcggcaacagaggagagccgctatgcgaagcggaaacctggcggcagcgcaaaagatg

SEQ ID NO: 173622 - DNA, 103 bp, Artificial Sequence
  Synthetic Polynucleotide
taatacgactcactatagggatgggtccctctggaccttctgagtataacaacagaggagagttataatgagaaggtccaacctggcggcagcgcaaaagatg

SEQ ID NO: 173623 - DNA, 103 bp, Artificial Sequence
  Synthetic Polynucleotide
taatacgactcactatagggattggcagtaatgggtccctctggaccttcaacagaggagagaaggtatggagggacccaacctggcggcagcgcaaaagatg

SEQ ID NO: 173624 - DNA, 103 bp, Artificial Sequence
  Synthetic Polynucleotide
taatacgactcactatagggttgggtagttattggcagtaatgggtccctaacagaggagaagggacatgttactgccaaacctggcggcagcgcaaaagatg

SEQ ID NO: 173625 - DNA, 103 bp, Artificial Sequence
  Synthetic Polynucleotide
taatacgactcactatagggatgtcactgattgggtagttattggcagtaaacagaggagatactgcatgtaactacccaacctggcggcagcgcaaaagatg

SEQ ID NO: 173626 - DNA, 103 bp, Artificial Sequence
  Synthetic Polynucleotide
taatacgactcactatagggccaggcttccatgtcactgattgggtagttaacagaggagaaactacatgatcagtgacaacctggcggcagcgcaaaagatg

SEQ ID NO: 173627 - DNA, 103 bp, Artificial Sequence
  Synthetic Polynucleotide
taatacgactcactatagggggcggaggctccaggcttccatgtcactgaaacagaggagatcagtgatgtggaagcctaacctggcggcagcgcaaaagatg

SEQ ID NO: 173628 - DNA, 103 bp, Artificial Sequence
  Synthetic Polynucleotide
taatacgactcactatagggttcaactgctggcggaggctccaggcttccaacagaggagaggaagcatggagcctccgaacctggcggcagcgcaaaagatg

SEQ ID NO: 173629 - DNA, 103 bp, Artificial Sequence
  Synthetic Polynucleotide
taatacgactcactataggggtcttcagagttcaactgctggcggaggctaacagaggagaagcctcatgcagcagttgaacctggcggcagcgcaaaagatg

SEQ ID NO: 173630 - DNA, 103 bp, Artificial Sequence
  Synthetic Polynucleotide
taatacgactcactatagggctgcctgggtgtcttcagagttcaactgctaacagaggagaagcagtatgactctgaagaacctggcggcagcgcaaaagatg

SEQ ID NO: 173631 - DNA, 103 bp, Artificial Sequence
  Synthetic Polynucleotide
taatacgactcactatagggaggacataagctgcctgggtgtcttcagagaacagaggagactctgaatgcacccaggcaacctggcggcagcgcaaaagatg

SEQ ID NO: 173632 - DNA, 103 bp, Artificial Sequence
  Synthetic Polynucleotide
taatacgactcactataggggctcatgtccatgtccatcgaatcttccataacagaggagaatggaaatgtcgatggacaacctggcggcagcgcaaaagatg

SEQ ID NO: 173633 - DNA, 103 bp, Artificial Sequence
  Synthetic Polynucleotide
taatacgactcactataggggtgctcattttcatcattatccaccttaaaaacagaggagatttaagatggataatgataacctggcggcagcgcaaaagatg

SEQ ID NO: 173634 - DNA, 103 bp, Artificial Sequence
  Synthetic Polynucleotide
taatacgactcactatagggaagataactggtgctcattttcatcattataacagaggagaataatgatgaaaatgagcaacctggcggcagcgcaaaagatg

SEQ ID NO: 173635 - DNA, 103 bp, Artificial Sequence
  Synthetic Polynucleotide
taatacgactcactatagggaccgttcttaaagataactggtgctcatttaacagaggagaaaatgaatgccagttatcaacctggcggcagcgcaaaagatg

SEQ ID NO: 173636 - DNA, 103 bp, Artificial Sequence
  Synthetic Polynucleotide
taatacgactcactatagggccctaaactgaccgttcttaaagataactgaacagaggagacagttaatgttaagaacgaacctggcggcagcgcaaaagatg

SEQ ID NO: 173637 - DNA, 103 bp, Artificial Sequence
  Synthetic Polynucleotide
taatacgactcactatagggttgcaccagcccctaaactgaccgttcttaaacagaggagataagaaatgtcagtttagaacctggcggcagcgcaaaagatg

SEQ ID NO: 173638 - DNA, 103 bp, Artificial Sequence
  Synthetic Polynucleotide
taatacgactcactatagggaactcatcctttgcaccagcccctaaactgaacagaggagacagtttatgggctggtgcaacctggcggcagcgcaaaagatg

SEQ ID NO: 173639 - DNA, 103 bp, Artificial Sequence
  Synthetic Polynucleotide
taatacgactcactatagggaacaatgtgcaactcatcctttgcaccagcaacagaggagagctggtatgaaggatgagaacctggcggcagcgcaaaagatg

SEQ ID NO: 173640 - DNA, 103 bp, Artificial Sequence
  Synthetic Polynucleotide
taatacgactcactatagggcctctgcttcaacaatgtgcaactcatcctaacagaggagaaggatgatgtgcacattgaacctggcggcagcgcaaaagatg

SEQ ID NO: 173641 - DNA, 103 bp, Artificial Sequence
  Synthetic Polynucleotide
taatacgactcactatagggtaattcattgcctctgcttcaacaatgtgcaacagaggagagcacatatgtgaagcagaaacctggcggcagcgcaaaagatg

SEQ ID NO: 173642 - DNA, 103 bp, Artificial Sequence
  Synthetic Polynucleotide
taatacgactcactatagggactgccttcgtaattcattgcctctgcttcaacagaggagagaagcaatggcaatgaataacctggcggcagcgcaaaagatg

SEQ ID NO: 173643 - DNA, 103 bp, Artificial Sequence
  Synthetic Polynucleotide
taatacgactcactataggggcctcagggggctcatgtccatgtccatcgaacagaggagacgatggatgtggacatgaaacctggcggcagcgcaaaagatg

SEQ ID NO: 173644 - DNA, 103 bp, Artificial Sequence
  Synthetic Polynucleotide
taatacgactcactatagggctttaattggactgccttcgtaattcattgaacagaggagacaatgaatgacgaaggcaaacctggcggcagcgcaaaagatg

SEQ ID NO: 173645 - DNA, 103 bp, Artificial Sequence
  Synthetic Polynucleotide
taatacgactcactataggggccagtgttactttaattggactgccttcgaacagaggagacgaaggatgtccaattaaaacctggcggcagcgcaaaagatg

SEQ ID NO: 173646 - DNA, 103 bp, Artificial Sequence
  Synthetic Polynucleotide
taatacgactcactatagggtttcaaagttgccagtgttactttaattggaacagaggagaccaattatggtaacactgaacctggcggcagcgcaaaagatg

SEQ ID NO: 173647 - DNA, 103 bp, Artificial Sequence
  Synthetic Polynucleotide
taatacgactcactataggggtacagacattttcaaagttgccagtgttaaacagaggagataacacatgcaactttgaaacctggcggcagcgcaaaagatg

SEQ ID NO: 173648 - DNA, 103 bp, Artificial Sequence
  Synthetic Polynucleotide
taatacgactcactatagggaccgttggctgtacagacattttcaaagttaacagaggagaaactttatgaatgtctgtaacctggcggcagcgcaaaagatg

SEQ ID NO: 173649 - DNA, 103 bp, Artificial Sequence
  Synthetic Polynucleotide
taatacgactcactatagggcccaagggaaaccgttggctgtacagacataacagaggagaatgtctatgcagccaacgaacctggcggcagcgcaaaagatg

SEQ ID NO: 173650 - DNA, 103 bp, Artificial Sequence
  Synthetic Polynucleotide
taatacgactcactatagggtttcaaagcccccaagggaaaccgttggctaacagaggagaagccaaatgtttcccttgaacctggcggcagcgcaaaagatg

SEQ ID NO: 173651 - DNA, 103 bp, Artificial Sequence
  Synthetic Polynucleotide
taatacgactcactatagggggtggtgttatttcaaagcccccaagggaaaacagaggagattccctatggggctttgaaacctggcggcagcgcaaaagatg

SEQ ID NO: 173652 - DNA, 103 bp, Artificial Sequence
  Synthetic Polynucleotide
taatacgactcactatagggtaagaccactggtggtgttatttcaaagccaacagaggagaggctttatgataacaccaaacctggcggcagcgcaaaagatg

SEQ ID NO: 173653 - DNA, 103 bp, Artificial Sequence
  Synthetic Polynucleotide
taatacgactcactatagggacttcaaccttaagaccactggtggtgttaaacagaggagataacacatgcagtggtctaacctggcggcagcgcaaaagatg

SEQ ID NO: 173654 - DNA, 103 bp, Artificial Sequence
  Synthetic Polynucleotide
taatacgactcactatagggtagttctggggcctcagggggctcatgtccaacagaggagaggacatatgccccctgagaacctggcggcagcgcaaaagatg

SEQ ID NO: 173655 - DNA, 103 bp, Artificial Sequence
  Synthetic Polynucleotide
taatacgactcactatagggcctgaaccacacttcaaccttaagaccactaacagaggagaagtggtatgaaggttgaaaacctggcggcagcgcaaaagatg

SEQ ID NO: 173656 - DNA, 103 bp, Artificial Sequence
  Synthetic Polynucleotide
taatacgactcactatagggatgcactggccctgaaccacacttcaacctaacagaggagaaggttgatgtgtggttcaaacctggcggcagcgcaaaagatg

SEQ ID NO: 173657 - DNA, 103 bp, Artificial Sequence
  Synthetic Polynucleotide
taatacgactcactataggggtccactaatatgcactggccctgaaccacaacagaggagagtggttatgggccagtgcaacctggcggcagcgcaaaagatg

SEQ ID NO: 173658 - DNA, 103 bp, Artificial Sequence
  Synthetic Polynucleotide
taatacgactcactatagggactaagtgctgtccactaatatgcactggcaacagaggagagccagtatgtattagtggaacctggcggcagcgcaaaagatg

SEQ ID NO: 173659 - DNA, 103 bp, Artificial Sequence
  Synthetic Polynucleotide
taatacgactcactatagggctccacagctactaagtgctgtccactaataacagaggagaattagtatgcagcacttaaacctggcggcagcgcaaaagatg

SEQ ID NO: 173660 - DNA, 103 bp, Artificial Sequence
  Synthetic Polynucleotide
taatacgactcactatagggctgcatcttcctccacagctactaagtgctaacagaggagaagcactatgtagctgtggaacctggcggcagcgcaaaagatg

SEQ ID NO: 173661 - DNA, 103 bp, Artificial Sequence
  Synthetic Polynucleotide
taatacgactcactatagggtcttctgactctgcatcttcctccacagctaacagaggagaagctgtatgggaagatgcaacctggcggcagcgcaaaagatg

SEQ ID NO: 173662 - DNA, 103 bp, Artificial Sequence
  Synthetic Polynucleotide
taatacgactcactatagggctcctcttcatcttctgactctgcatcttcaacagaggagagaagatatggagtcagaaaacctggcggcagcgcaaaagatg

SEQ ID NO: 173663 - DNA, 103 bp, Artificial Sequence
  Synthetic Polynucleotide
taatacgactcactatagggtcacatcctcctcctcttcatcttctgactaacagaggagaagtcagatgatgaagaggaacctggcggcagcgcaaaagatg

SEQ ID NO: 173664 - DNA, 103 bp, Artificial Sequence
  Synthetic Polynucleotide
taatacgactcactatagggcttaagagtttcacatcctcctcctcttcaaacagaggagatgaagaatgggaggatgtaacctggcggcagcgcaaaagatg

SEQ ID NO: 173665 - DNA, 103 bp, Artificial Sequence
  Synthetic Polynucleotide
taatacgactcactatagggaccgaaaagatagttctggggcctcaggggaacagaggagacccctgatgccccagaacaacctggcggcagcgcaaaagatg

SEQ ID NO: 173666 - DNA, 103 bp, Artificial Sequence
  Synthetic Polynucleotide
taatacgactcactatagggtccagatatacttaagagtttcacatcctcaacagaggagagaggatatgaaactcttaaacctggcggcagcgcaaaagatg

SEQ ID NO: 173667 - DNA, 103 bp, Artificial Sequence
  Synthetic Polynucleotide
taatacgactcactatagggcagaccgctttccagatatacttaagagttaacagaggagaaactctatggtatatctgaacctggcggcagcgcaaaagatg

SEQ ID NO: 173668 - DNA, 103 bp, Artificial Sequence
  Synthetic Polynucleotide
taatacgactcactatagggcctccaggggcagaccgctttccagatataaacagaggagatatatcatgaaagcggtcaacctggcggcagcgcaaaagatg

SEQ ID NO: 173669 - DNA, 103 bp, Artificial Sequence
  Synthetic Polynucleotide
taatacgactcactatagggcttgctaccacctccaggggcagaccgcttaacagaggagaaagcggatggcccctggaaacctggcggcagcgcaaaagatg

SEQ ID NO: 173670 - DNA, 103 bp, Artificial Sequence
  Synthetic Polynucleotide
taatacgactcactatagggtctgtggaaccttgctaccacctccaggggaacagaggagacccctgatggtggtagcaaacctggcggcagcgcaaaagatg

SEQ ID NO: 173671 - DNA, 103 bp, Artificial Sequence
  Synthetic Polynucleotide
taatacgactcactatagggtttacttttttctgtggaaccttgctaccaaacagaggagatggtagatgggttccacaaacctggcggcagcgcaaaagatg

SEQ ID NO: 173672 - DNA, 103 bp, Artificial Sequence
  Synthetic Polynucleotide
taatacgactcactatagggagcagcaagttttacttttttctgtggaacaacagaggagagttccaatgaaaaaagtaaacctggcggcagcgcaaaagatg

SEQ ID NO: 173673 - DNA, 103 bp, Artificial Sequence
  Synthetic Polynucleotide
taatacgactcactatagggcatcttcatcagcagcaagttttactttttaacagaggagaaaaaagatgaacttgctgaacctggcggcagcgcaaaagatg

SEQ ID NO: 173674 - DNA, 103 bp, Artificial Sequence
  Synthetic Polynucleotide
taatacgactcactatagggtcatcgtcatcatcttcatcagcagcaagtaacagaggagaacttgcatgtgatgaagaaacctggcggcagcgcaaaagatg

SEQ ID NO: 173675 - DNA, 103 bp, Artificial Sequence
  Synthetic Polynucleotide
taatacgactcactatagggctcttcatcatcatcgtcatcatcttcatcaacagaggagagatgaaatggatgacgataacctggcggcagcgcaaaagatg

SEQ ID NO: 173676 - DNA, 103 bp, Artificial Sequence
  Synthetic Polynucleotide
taatacgactcactatagggttagttcacaaccgaaaagatagttctgggaacagaggagacccagaatgatcttttcgaacctggcggcagcgcaaaagatg

SEQ ID NO: 173677 - DNA, 103 bp, Artificial Sequence
  Synthetic Polynucleotide
taatacgactcactatagggcatcatcatcctcttcatcatcatcgtcataacagaggagaatgacgatgatgatgaagaacctggcggcagcgcaaaagatg

SEQ ID NO: 173678 - DNA, 103 bp, Artificial Sequence
  Synthetic Polynucleotide
taatacgactcactatagggtcatcatcttcatcatcatcctcttcatcaaacagaggagatgatgaatgggatgatgaaacctggcggcagcgcaaaagatg

SEQ ID NO: 173679 - DNA, 103 bp, Artificial Sequence
  Synthetic Polynucleotide
taatacgactcactatagggatcatcatcatcatcatcttcatcatcatcaacagaggagagatgatatggaagatgataacctggcggcagcgcaaaagatg

SEQ ID NO: 173680 - DNA, 103 bp, Artificial Sequence
  Synthetic Polynucleotide
taatacgactcactatagggcatcatcaaaatcatcatcatcatcatcttaacagaggagaaagatgatgatgatgatgaacctggcggcagcgcaaaagatg

SEQ ID NO: 173681 - DNA, 103 bp, Artificial Sequence
  Synthetic Polynucleotide
taatacgactcactatagggtcagcttcctcatcatcaaaatcatcatcaaacagaggagatgatgaatgttttgatgaaacctggcggcagcgcaaaagatg

SEQ ID NO: 173682 - DNA, 103 bp, Artificial Sequence
  Synthetic Polynucleotide
taatacgactcactatagggcgctttttcttcagcttcctcatcatcaaaaacagaggagatttgatatggaggaagctaacctggcggcagcgcaaaagatg

SEQ ID NO: 173683 - DNA, 103 bp, Artificial Sequence
  Synthetic Polynucleotide
taatacgactcactatagggtcttcactggcgctttttcttcagcttcctaacagaggagaaggaagatgaagaaaaagaacctggcggcagcgcaaaagatg

SEQ ID NO: 173684 - DNA, 103 bp, Artificial Sequence
  Synthetic Polynucleotide
taatacgactcactatagggcgtatagatttcttcactggcgctttttctaacagaggagaagaaaaatggccagtgaaaacctggcggcagcgcaaaagatg

SEQ ID NO: 173685 - DNA, 103 bp, Artificial Sequence
  Synthetic Polynucleotide
taatacgactcactatagggtggagtatctcgtatagatttcttcactggaacagaggagaccagtgatgaaatctataaacctggcggcagcgcaaaagatg

SEQ ID NO: 173686 - DNA, 103 bp, Artificial Sequence
  Synthetic Polynucleotide
taatacgactcactatagggcatttttggctggagtatctcgtatagattaacagaggagaaatctaatggagatactcaacctggcggcagcgcaaaagatg

SEQ ID NO: 173687 - DNA, 103 bp, Artificial Sequence
  Synthetic Polynucleotide
taatacgactcactatagggttgtcggcctttagttcacaaccgaaaagaaacagaggagatcttttatgttgtgaactaacctggcggcagcgcaaaagatg

SEQ ID NO: 173688 - DNA, 103 bp, Artificial Sequence
  Synthetic Polynucleotide
taatacgactcactataggggacttttgtgcatttttggctggagtatctaacagaggagaagatacatgagccaaaaaaacctggcggcagcgcaaaagatg

SEQ ID NO: 173689 - DNA, 103 bp, Artificial Sequence
  Synthetic Polynucleotide
taatacgactcactatagggattctgatttgacttttgtgcatttttggcaacagaggagagccaaaatggcacaaaagaacctggcggcagcgcaaaagatg

SEQ ID NO: 173690 - DNA, 103 bp, Artificial Sequence
  Synthetic Polynucleotide
taatacgactcactatagggagtcttttccattctgatttgacttttgtgaacagaggagacacaaaatgcaaatcagaaacctggcggcagcgcaaaagatg

SEQ ID NO: 173691 - DNA, 103 bp, Artificial Sequence
  Synthetic Polynucleotide
taatacgactcactataggggatggttttgagtcttttccattctgatttaacagaggagaaaatcaatgtggaaaagaaacctggcggcagcgcaaaagatg

SEQ ID NO: 173692 - DNA, 103 bp, Artificial Sequence
  Synthetic Polynucleotide
taatacgactcactatagggtggtgttgatgatggttttgagtcttttccaacagaggagaggaaaaatgtcaaaaccaaacctggcggcagcgcaaaagatg

SEQ ID NO: 173693 - DNA, 103 bp, Artificial Sequence
  Synthetic Polynucleotide
taatacgactcactatagggcttttgatcttggtgttgatgatggttttgaacagaggagacaaaacatgcatcaacacaacctggcggcagcgcaaaagatg

SEQ ID NO: 173694 - DNA, 103 bp, Artificial Sequence
  Synthetic Polynucleotide
taatacgactcactataggggattcttgtccttttgatcttggtgttgataacagaggagaatcaacatgaagatcaaaaacctggcggcagcgcaaaagatg

SEQ ID NO: 173695 - DNA, 103 bp, Artificial Sequence
  Synthetic Polynucleotide
taatacgactcactatagggtttcttgaaggattcttgtccttttgatctaacagaggagaagatcaatgggacaagaaaacctggcggcagcgcaaaagatg

SEQ ID NO: 173696 - DNA, 103 bp, Artificial Sequence
  Synthetic Polynucleotide
taatacgactcactatagggttttttcctgtttcttgaaggattcttgtcaacagaggagagacaagatgccttcaagaaacctggcggcagcgcaaaagatg

SEQ ID NO: 173697 - DNA, 103 bp, Artificial Sequence
  Synthetic Polynucleotide
taatacgactcactataggggttttaggagttttttcctgtttcttgaagaacagaggagacttcaaatgacaggaaaaaacctggcggcagcgcaaaagatg

SEQ ID NO: 173698 - DNA, 103 bp, Artificial Sequence
  Synthetic Polynucleotide
taatacgactcactataggggtgataatctttgtcggcctttagttcacaaacagaggagatgtgaaatgaaggccgacaacctggcggcagcgcaaaagatg

SEQ ID NO: 173699 - DNA, 103 bp, Artificial Sequence
  Synthetic Polynucleotide
taatacgactcactatagggtccttttggtgttttaggagttttttcctgaacagaggagacaggaaatgactcctaaaaacctggcggcagcgcaaaagatg

SEQ ID NO: 173700 - DNA, 103 bp, Artificial Sequence
  Synthetic Polynucleotide
taatacgactcactatagggcagaactaggtccttttggtgttttaggagaacagaggagactcctaatgcaccaaaagaacctggcggcagcgcaaaagatg

SEQ ID NO: 173701 - DNA, 103 bp, Artificial Sequence
  Synthetic Polynucleotide
taatacgactcactatagggatgtcttctacagaactaggtccttttggtaacagaggagaaccaaaatgacctagttcaacctggcggcagcgcaaaagatg

SEQ ID NO: 173702 - DNA, 103 bp, Artificial Sequence
  Synthetic Polynucleotide
taatacgactcactatagggttttgctttaatgtcttctacagaactaggaacagaggagacctagtatggtagaagacaacctggcggcagcgcaaaagatg

SEQ ID NO: 173703 - DNA, 103 bp, Artificial Sequence
  Synthetic Polynucleotide
taatacgactcactatagggttgcttgcatttttgctttaatgtcttctaaacagaggagatagaagatgttaaagcaaaacctggcggcagcgcaaaagatg

SEQ ID NO: 173704 - DNA, 103 bp, Artificial Sequence
  Synthetic Polynucleotide
taatacgactcactatagggttttctatacttgcttgcatttttgctttaaacagaggagataaagcatgaatgcaagcaacctggcggcagcgcaaaagatg

SEQ ID NO: 173705 - DNA, 103 bp, Artificial Sequence
  Synthetic Polynucleotide
taatacgactcactatagggagaaccacctttttctatacttgcttgcataacagaggagaatgcaaatgagtatagaaaacctggcggcagcgcaaaagatg

SEQ ID NO: 173706 - DNA, 103 bp, Artificial Sequence
  Synthetic Polynucleotide
taatacgactcactatagggctttgggaagagaaccacctttttctatacaacagaggagagtatagatgaaggtggttaacctggcggcagcgcaaaagatg

SEQ ID NO: 173707 - DNA, 103 bp, Artificial Sequence
  Synthetic Polynucleotide
taatacgactcactatagggttggcttccactttgggaagagaaccacctaacagaggagaaggtggatgtcttcccaaaacctggcggcagcgcaaaagatg

SEQ ID NO: 173708 - DNA, 103 bp, Artificial Sequence
  Synthetic Polynucleotide
taatacgactcactatagggattgatgaatttggcttccactttgggaagaacagaggagacttcccatggtggaagccaacctggcggcagcgcaaaagatg

SEQ ID NO: 173709 - DNA, 103 bp, Artificial Sequence
  Synthetic Polynucleotide
taatacgactcactatagggccaccttaaagtgataatctttgtcggcctaacagaggagaaggccgatgaagattatcaacctggcggcagcgcaaaagatg

SEQ ID NO: 173710 - DNA, 103 bp, Artificial Sequence
  Synthetic Polynucleotide
taatacgactcactatagggtcttcacataattgatgaatttggcttccaaacagaggagatggaagatgaattcatcaaacctggcggcagcgcaaaagatg

SEQ ID NO: 173711 - DNA, 103 bp, Artificial Sequence
  Synthetic Polynucleotide
taatacgactcactatagggcggaagcaattcttcacataattgatgaataacagaggagaattcatatgttatgtgaaaacctggcggcagcgcaaaagatg

SEQ ID NO: 173712 - DNA, 103 bp, Artificial Sequence
  Synthetic Polynucleotide
taatacgactcactataggggtcagtcatccggaagcaattcttcacataaacagaggagatatgtgatgaattgcttcaacctggcggcagcgcaaaagatg

SEQ ID NO: 173713 - DNA, 103 bp, Artificial Sequence
  Synthetic Polynucleotide
taatacgactcactatagggtagcctcttggtcagtcatccggaagcaataacagaggagaattgctatgggatgactgaacctggcggcagcgcaaaagatg

SEQ ID NO: 173714 - DNA, 103 bp, Artificial Sequence
  Synthetic Polynucleotide
taatacgactcactatagggagatcttgaatagcctcttggtcagtcatcaacagaggagagatgacatgccaagaggcaacctggcggcagcgcaaaagatg

SEQ ID NO: 173715 - DNA, 103 bp, Artificial Sequence
  Synthetic Polynucleotide
taatacgactcactatagggccactgccagagatcttgaatagcctcttgaacagaggagacaagagatgattcaagataacctggcggcagcgcaaaagatg

SEQ ID NO: 173716 - DNA, 103 bp, Artificial Sequence
  Synthetic Polynucleotide
taatacgactcactataggggagacttcctccactgccagagatcttgaaaacagaggagattcaagatgtctggcagtaacctggcggcagcgcaaaagatg

SEQ ID NO: 173717 - DNA, 103 bp, Artificial Sequence
  Synthetic Polynucleotide
taatacgactcactatagggtcatcattatccaccttaaagtgataatctaacagaggagaagattaatgctttaaggtaacctggcggcagcgcaaaagatg

SEQ ID NO: 173718 - DNA, 103 bp, Artificial Sequence
  Synthetic Polynucleotide
taatacgactcactatagggtgtgttgttgttggagtccagggtcgtcataacagaggagaatgacgatgctggactccaacctggcggcagcgcaaaagatg

SEQ ID NO: 173719 - DNA, 103 bp, Artificial Sequence
  Synthetic Polynucleotide
taatacgactcactataggggctgccattggagttgtcactatagagggaaacagaggagatccctcatgagtgacaacaacctggcggcagcgcaaaagatg

SEQ ID NO: 173720 - DNA, 103 bp, Artificial Sequence
  Synthetic Polynucleotide
taatacgactcactataggggggggcaggtgggcagccctgattttcccaaacagaggagatgggaaatgcagggctgcaacctggcggcagcgcaaaagatg

SEQ ID NO: 173721 - DNA, 103 bp, Artificial Sequence
  Synthetic Polynucleotide
taatacgactcactatagggtgttgtcattgggggcaggtgggcagccctaacagaggagaagggctatgcacctgcccaacctggcggcagcgcaaaagatg

SEQ ID NO: 173722 - DNA, 103 bp, Artificial Sequence
  Synthetic Polynucleotide
taatacgactcactataggggccaaggtgttgttgtcattgggggcaggtaacagaggagaacctgcatgcaatgacaaaacctggcggcagcgcaaaagatg

SEQ ID NO: 173723 - DNA, 103 bp, Artificial Sequence
  Synthetic Polynucleotide
taatacgactcactatagggacgctgggcagccaaggtgttgttgtcattaacagaggagaaatgacatgaacaccttgaacctggcggcagcgcaaaagatg

SEQ ID NO: 173724 - DNA, 103 bp, Artificial Sequence
  Synthetic Polynucleotide
taatacgactcactatagggcctcgttatgacgctgggcagccaaggtgtaacagaggagaacacctatgctgcccagcaacctggcggcagcgcaaaagatg

SEQ ID NO: 173725 - DNA, 103 bp, Artificial Sequence
  Synthetic Polynucleotide
taatacgactcactatagggccatttagggcctcgttatgacgctgggcaaacagaggagatgcccaatgtcataacgaaacctggcggcagcgcaaaagatg

SEQ ID NO: 173726 - DNA, 103 bp, Artificial Sequence
  Synthetic Polynucleotide
taatacgactcactatagggctggcgcagaccatttagggcctcgttatgaacagaggagacataacatggccctaaataacctggcggcagcgcaaaagatg

SEQ ID NO: 173727 - DNA, 103 bp, Artificial Sequence
  Synthetic Polynucleotide
taatacgactcactatagggaggagggagcctggcgcagaccatttagggaacagaggagaccctaaatggtctgcgccaacctggcggcagcgcaaaagatg

SEQ ID NO: 173728 - DNA, 103 bp, Artificial Sequence
  Synthetic Polynucleotide
taatacgactcactatagggggagggtaggaggagggagcctggcgcagaaacagaggagatctgcgatgggctccctcaacctggcggcagcgcaaaagatg

SEQ ID NO: 173729 - DNA, 103 bp, Artificial Sequence
  Synthetic Polynucleotide
taatacgactcactatagggaggccaggtgggagggtaggaggagggagcaacagaggagagctcccatgtcctaccctaacctggcggcagcgcaaaagatg

SEQ ID NO: 173730 - DNA, 103 bp, Artificial Sequence
  Synthetic Polynucleotide
taatacgactcactataggggggactggaagctgccattggagttgtcacaacagaggagagtgacaatgccaatggcaaacctggcggcagcgcaaaagatg

SEQ ID NO: 173731 - DNA, 103 bp, Artificial Sequence
  Synthetic Polynucleotide
taatacgactcactatagggcagggccaggaggccaggtgggagggtaggaacagaggagacctaccatgccacctggcaacctggcggcagcgcaaaagatg

SEQ ID NO: 173732 - DNA, 103 bp, Artificial Sequence
  Synthetic Polynucleotide
taatacgactcactatagggctgtggtgtgcagggccaggaggccaggtgaacagaggagacacctgatgtcctggcccaacctggcggcagcgcaaaagatg

SEQ ID NO: 173733 - DNA, 103 bp, Artificial Sequence
  Synthetic Polynucleotide
taatacgactcactatagggctggtggcagctgtggtgtgcagggccaggaacagaggagacctggcatggcacaccacaacctggcggcagcgcaaaagatg

SEQ ID NO: 173734 - DNA, 103 bp, Artificial Sequence
  Synthetic Polynucleotide
taatacgactcactatagggtgctgttggactggtggcagctgtggtgtgaacagaggagacacaccatggctgccaccaacctggcggcagcgcaaaagatg

SEQ ID NO: 173735 - DNA, 103 bp, Artificial Sequence
  Synthetic Polynucleotide
taatacgactcactatagggcggtgcccgttgctgttggactggtggcagaacagaggagactgccaatggtccaacagaacctggcggcagcgcaaaagatg

SEQ ID NO: 173736 - DNA, 103 bp, Artificial Sequence
  Synthetic Polynucleotide
taatacgactcactatagggggggcatagacggtgcccgttgctgttggaaacagaggagatccaacatgaacgggcacaacctggcggcagcgcaaaagatg

SEQ ID NO: 173737 - DNA, 103 bp, Artificial Sequence
  Synthetic Polynucleotide
taatacgactcactatagggacacgtgggtggggcatagacggtgcccgtaacagaggagaacgggcatggtctatgccaacctggcggcagcgcaaaagatg

SEQ ID NO: 173738 - DNA, 103 bp, Artificial Sequence
  Synthetic Polynucleotide
taatacgactcactatagggggggctgcatacacgtgggtggggcatagaaacagaggagatctatgatgcacccacgtaacctggcggcagcgcaaaagatg

SEQ ID NO: 173739 - DNA, 103 bp, Artificial Sequence
  Synthetic Polynucleotide
taatacgactcactatagggcttgccttctggggctgcatacacgtgggtaacagaggagaacccacatgtatgcagccaacctggcggcagcgcaaaagatg

SEQ ID NO: 173740 - DNA, 103 bp, Artificial Sequence
  Synthetic Polynucleotide
taatacgactcactatagggtggcaggtgccttgccttctggggctgcataacagaggagaatgcagatgcagaaggcaaacctggcggcagcgcaaaagatg

SEQ ID NO: 173741 - DNA, 103 bp, Artificial Sequence
  Synthetic Polynucleotide
taatacgactcactatagggccttgggtcagggactggaagctgccattgaacagaggagacaatggatgcttccagtcaacctggcggcagcgcaaaagatg

SEQ ID NO: 173742 - DNA, 103 bp, Artificial Sequence
  Synthetic Polynucleotide
taatacgactcactatagggcggggactgttggcaggtgccttgccttctaacagaggagaagaaggatgggcacctgcaacctggcggcagcgcaaaagatg

SEQ ID NO: 173743 - DNA, 103 bp, Artificial Sequence
  Synthetic Polynucleotide
taatacgactcactataggggttgccctgccggggactgttggcaggtgcaacagaggagagcacctatgaacagtcccaacctggcggcagcgcaaaagatg

SEQ ID NO: 173744 - DNA, 103 bp, Artificial Sequence
  Synthetic Polynucleotide
taatacgactcactatagggcattctttgagttgccctgccggggactgtaacagaggagaacagtcatgggcagggcaaacctggcggcagcgcaaaagatg

SEQ ID NO: 173745 - DNA, 103 bp, Artificial Sequence
  Synthetic Polynucleotide
taatacgactcactataggggccagcagaacattctttgagttgccctgcaacagaggagagcagggatgctcaaagaaaacctggcggcagcgcaaaagatg

SEQ ID NO: 173746 - DNA, 103 bp, Artificial Sequence
  Synthetic Polynucleotide
taatacgactcactatagggcataggacatgccagcagaacattctttgaaacagaggagatcaaagatggttctgctgaacctggcggcagcgcaaaagatg

SEQ ID NO: 173747 - DNA, 103 bp, Artificial Sequence
  Synthetic Polynucleotide
taatacgactcactatagggggtacatgttcataggacatgccagcagaaaacagaggagattctgcatgcatgtcctaaacctggcggcagcgcaaaagatg

SEQ ID NO: 173748 - DNA, 103 bp, Artificial Sequence
  Synthetic Polynucleotide
taatacgactcactatagggcgtccatgcgggtacatgttcataggacataacagaggagaatgtccatggaacatgtaaacctggcggcagcgcaaaagatg

SEQ ID NO: 173749 - DNA, 103 bp, Artificial Sequence
  Synthetic Polynucleotide
taatacgactcactatagggtcgcccactgcgtccatgcgggtacatgttaacagaggagaaacatgatgccgcatggaaacctggcggcagcgcaaaagatg

SEQ ID NO: 173750 - DNA, 103 bp, Artificial Sequence
  Synthetic Polynucleotide
taatacgactcactatagggcctgcaccgttcgcccactgcgtccatgcgaacagaggagacgcatgatggcagtgggcaacctggcggcagcgcaaaagatg

SEQ ID NO: 173751 - DNA, 103 bp, Artificial Sequence
  Synthetic Polynucleotide
taatacgactcactatagggtcccagatctcctgcaccgttcgcccactgaacagaggagacagtggatgaacggtgcaaacctggcggcagcgcaaaagatg

SEQ ID NO: 173752 - DNA, 103 bp, Artificial Sequence
  Synthetic Polynucleotide
taatacgactcactatagggggtgggacagccttgggtcagggactggaaaacagaggagattccagatgctgacccaaaacctggcggcagcgcaaaagatg

SEQ ID NO: 173753 - DNA, 103 bp, Artificial Sequence
  Synthetic Polynucleotide
taatacgactcactatagggggagaaatcctcccagatctcctgcaccgtaacagaggagaacggtgatggagatctggaacctggcggcagcgcaaaagatg

SEQ ID NO: 173754 - DNA, 103 bp, Artificial Sequence
  Synthetic Polynucleotide
taatacgactcactatagggtgaagctcatggagaaatcctcccagatctaacagaggagaagatctatgaggatttctaacctggcggcagcgcaaaagatg

SEQ ID NO: 173755 - DNA, 103 bp, Artificial Sequence
  Synthetic Polynucleotide
taatacgactcactatagggacagcgggcgtgaagctcatggagaaatccaacagaggagaggatttatgcatgagcttaacctggcggcagcgcaaaagatg

SEQ ID NO: 173756 - DNA, 103 bp, Artificial Sequence
  Synthetic Polynucleotide
taatacgactcactatagggcacctcccgcacagcgggcgtgaagctcataacagaggagaatgagcatgacgcccgctaacctggcggcagcgcaaaagatg

SEQ ID NO: 173757 - DNA, 103 bp, Artificial Sequence
  Synthetic Polynucleotide
taatacgactcactatagggcaaactctaccacctcccgcacagcgggcgaacagaggagacgcccgatgtgcgggaggaacctggcggcagcgcaaaagatg

SEQ ID NO: 173758 - DNA, 103 bp, Artificial Sequence
  Synthetic Polynucleotide
taatacgactcactatagggatgtgtttggcaaactctaccacctcccgcaacagaggagagcgggaatgggtagagttaacctggcggcagcgcaaaagatg

SEQ ID NO: 173759 - DNA, 103 bp, Artificial Sequence
  Synthetic Polynucleotide
taatacgactcactataggggaagcccgggatgtgtttggcaaactctacaacagaggagagtagagatggccaaacacaacctggcggcagcgcaaaagatg

SEQ ID NO: 173760 - DNA, 103 bp, Artificial Sequence
  Synthetic Polynucleotide
taatacgactcactatagggaaaggtcacggaagcccgggatgtgtttggaacagaggagaccaaacatgtcccgggctaacctggcggcagcgcaaaagatg

SEQ ID NO: 173761 - DNA, 103 bp, Artificial Sequence
  Synthetic Polynucleotide
taatacgactcactatagggtcatgctgagaaaggtcacggaagcccgggaacagaggagacccgggatgccgtgacctaacctggcggcagcgcaaaagatg

SEQ ID NO: 173762 - DNA, 103 bp, Artificial Sequence
  Synthetic Polynucleotide
taatacgactcactatagggggtgacttggtcatgctgagaaaggtcacgaacagaggagacgtgacatgtctcagcataacctggcggcagcgcaaaagatg

SEQ ID NO: 173763 - DNA, 103 bp, Artificial Sequence
  Synthetic Polynucleotide
taatacgactcactataggggtgggaagtaggtgggacagccttgggtcaaacagaggagatgacccatggctgtcccaaacctggcggcagcgcaaaagatg

SEQ ID NO: 173764 - DNA, 103 bp, Artificial Sequence
  Synthetic Polynucleotide
taatacgactcactatagggccttaagcagggtgacttggtcatgctgagaacagaggagactcagcatgaccaagtcaaacctggcggcagcgcaaaagatg

SEQ ID NO: 173765 - DNA, 103 bp, Artificial Sequence
  Synthetic Polynucleotide
taatacgactcactatagggaaggtgccagccttaagcagggtgacttggaacagaggagaccaagtatgcctgcttaaaacctggcggcagcgcaaaagatg

SEQ ID NO: 173766 - DNA, 103 bp, Artificial Sequence
  Synthetic Polynucleotide
taatacgactcactatagggcagcacctcaaaggtgccagccttaagcagaacagaggagactgcttatggctggcaccaacctggcggcagcgcaaaagatg

SEQ ID NO: 173767 - DNA, 103 bp, Artificial Sequence
  Synthetic Polynucleotide
taatacgactcactatagggagcgcaccatcagcacctcaaaggtgccagaacagaggagactggcaatgttgaggtgcaacctggcggcagcgcaaaagatg

SEQ ID NO: 173768 - DNA, 103 bp, Artificial Sequence
  Synthetic Polynucleotide
taatacgactcactatagggaacgaagcaaagcgcaccatcagcacctcaaacagaggagatgaggtatggatggtgcgaacctggcggcagcgcaaaagatg

SEQ ID NO: 173769 - DNA, 103 bp, Artificial Sequence
  Synthetic Polynucleotide
taatacgactcactatagggcacgttgaacaacgaagcaaagcgcaccataacagaggagaatggtgatgtttgcttcgaacctggcggcagcgcaaaagatg

SEQ ID NO: 173770 - DNA, 103 bp, Artificial Sequence
  Synthetic Polynucleotide
taatacgactcactatagggtctggtccttcacgttgaacaacgaagcaaaacagaggagattgcttatgtgttcaacgaacctggcggcagcgcaaaagatg

SEQ ID NO: 173771 - DNA, 103 bp, Artificial Sequence
  Synthetic Polynucleotide
taatacgactcactatagggaacatcactgtctggtccttcacgttgaacaacagaggagagttcaaatggaaggaccaaacctggcggcagcgcaaaagatg

SEQ ID NO: 173772 - DNA, 103 bp, Artificial Sequence
  Synthetic Polynucleotide
taatacgactcactataggggcggcttaggaacatcactgtctggtccttaacagaggagaaaggacatgacagtgatgaacctggcggcagcgcaaaagatg

SEQ ID NO: 173773 - DNA, 103 bp, Artificial Sequence
  Synthetic Polynucleotide
taatacgactcactatagggtgtaggtggtgcggcttaggaacatcactgaacagaggagacagtgaatgtcctaagccaacctggcggcagcgcaaaagatg

SEQ ID NO: 173774 - DNA, 103 bp, Artificial Sequence
  Synthetic Polynucleotide
taatacgactcactataggggtgggggatggtgggaagtaggtgggacagaacagaggagactgtccatgctacttcccaacctggcggcagcgcaaaagatg

SEQ ID NO: 173775 - DNA, 103 bp, Artificial Sequence
  Synthetic Polynucleotide
taatacgactcactatagggtcctgcaggctgtaggtggtgcggcttaggaacagaggagacctaagatgcaccacctaaacctggcggcagcgcaaaagatg

SEQ ID NO: 173776 - DNA, 103 bp, Artificial Sequence
  Synthetic Polynucleotide
taatacgactcactatagggggcaccaagctcctgcaggctgtaggtggtaacagaggagaaccaccatgagcctgcagaacctggcggcagcgcaaaagatg

SEQ ID NO: 173777 - DNA, 103 bp, Artificial Sequence
  Synthetic Polynucleotide
taatacgactcactatagggccatgcccatggcaccaagctcctgcaggcaacagaggagagcctgcatgagcttggtgaacctggcggcagcgcaaaagatg

SEQ ID NO: 173778 - DNA, 103 bp, Artificial Sequence
  Synthetic Polynucleotide
taatacgactcactatagggagcaggtctcccatgcccatggcaccaagcaacagaggagagcttggatgcatgggcataacctggcggcagcgcaaaagatg

SEQ ID NO: 173779 - DNA, 103 bp, Artificial Sequence
  Synthetic Polynucleotide
taatacgactcactatagggcatggcactgagcaggtctcccatgcccataacagaggagaatgggcatgggagacctgaacctggcggcagcgcaaaagatg

SEQ ID NO: 173780 - DNA, 103 bp, Artificial Sequence
  Synthetic Polynucleotide
taatacgactcactatagggtgaagtcgaacatggcactgagcaggtctcaacagaggagagagaccatgtcagtgccaaacctggcggcagcgcaaaagatg

SEQ ID NO: 173781 - DNA, 103 bp, Artificial Sequence
  Synthetic Polynucleotide
taatacgactcactatagggagcttctcgctgaagtcgaacatggcactgaacagaggagacagtgcatggttcgacttaacctggcggcagcgcaaaagatg

SEQ ID NO: 173782 - DNA, 103 bp, Artificial Sequence
  Synthetic Polynucleotide
taatacgactcactatagggcagggagttgagcttctcgctgaagtcgaaaacagaggagattcgacatgagcgagaagaacctggcggcagcgcaaaagatg

SEQ ID NO: 173783 - DNA, 103 bp, Artificial Sequence
  Synthetic Polynucleotide
taatacgactcactatagggcggtaagcgccagggagttgagcttctcgcaacagaggagagcgagaatgtcaactcccaacctggcggcagcgcaaaagatg

SEQ ID NO: 173784 - DNA, 103 bp, Artificial Sequence
  Synthetic Polynucleotide
taatacgactcactatagggagctcctcctcggtaagcgccagggagttgaacagaggagacaactcatgggcgcttacaacctggcggcagcgcaaaagatg

SEQ ID NO: 173785 - DNA, 103 bp, Artificial Sequence
  Synthetic Polynucleotide
taatacgactcactataggggagggagccagtgggggatggtgggaagtaaacagaggagatacttcatgccatcccccaacctggcggcagcgcaaaagatg

SEQ ID NO: 173786 - DNA, 103 bp, Artificial Sequence
  Synthetic Polynucleotide
taatacgactcactataggggaagaggcccagctcctcctcggtaagcgcaacagaggagagcgcttatggaggaggagaacctggcggcagcgcaaaagatg

SEQ ID NO: 173787 - DNA, 103 bp, Artificial Sequence
  Synthetic Polynucleotide
taatacgactcactatagggccaccgcggtgaagaggcccagctcctcctaacagaggagaaggaggatgtgggcctctaacctggcggcagcgcaaaagatg

SEQ ID NO: 173788 - DNA, 103 bp, Artificial Sequence
  Synthetic Polynucleotide
taatacgactcactataggggagacaagcaccaccgcggtgaagaggcccaacagaggagagggcctatgcaccgcggtaacctggcggcagcgcaaaagatg

SEQ ID NO: 173789 - DNA, 103 bp, Artificial Sequence
  Synthetic Polynucleotide
taatacgactcactataggggcggtctgcagagacaagcaccaccgcggtaacagaggagaaccgcgatggtgcttgtcaacctggcggcagcgcaaaagatg

SEQ ID NO: 173790 - DNA, 103 bp, Artificial Sequence
  Synthetic Polynucleotide
taatacgactcactatagggccatgcccgagcggtctgcagagacaagcaaacagaggagatgcttgatgctgcagaccaacctggcggcagcgcaaaagatg

SEQ ID NO: 173791 - DNA, 103 bp, Artificial Sequence
  Synthetic Polynucleotide
taatacgactcactataggggcggaattctccatgcccgagcggtctgcaaacagaggagatgcagaatgctcgggcataacctggcggcagcgcaaaagatg

SEQ ID NO: 173792 - DNA, 103 bp, Artificial Sequence
  Synthetic Polynucleotide
taatacgactcactatagggctccaccgaagcggaattctccatgcccgaaacagaggagatcgggcatggagaattccaacctggcggcagcgcaaaagatg

SEQ ID NO: 173793 - DNA, 103 bp, Artificial Sequence
  Synthetic Polynucleotide
taatacgactcactatagggcctggagctgctccaccgaagcggaattctaacagaggagaagaattatgcttcggtggaacctggcggcagcgcaaaagatg

SEQ ID NO: 173794 - DNA, 103 bp, Artificial Sequence
  Synthetic Polynucleotide
taatacgactcactatagggagcagcgtctcctggagctgctccaccgaaaacagaggagattcggtatggcagctccaaacctggcggcagcgcaaaagatg

SEQ ID NO: 173795 - DNA, 103 bp, Artificial Sequence
  Synthetic Polynucleotide
taatacgactcactatagggaagagcccgcagcagcgtctcctggagctgaacagaggagacagctcatggagacgctgaacctggcggcagcgcaaaagatg

SEQ ID NO: 173796 - DNA, 103 bp, Artificial Sequence
  Synthetic Polynucleotide
taatacgactcactatagggggtcttgggtgagggagccagtgggggatgaacagaggagacatcccatgctggctcccaacctggcggcagcgcaaaagatg

SEQ ID NO: 173797 - DNA, 103 bp, Artificial Sequence
  Synthetic Polynucleotide
taatacgactcactatagggccagagcccgaagagcccgcagcagcgtctaacagaggagaagacgcatgtgcgggctcaacctggcggcagcgcaaaagatg

SEQ ID NO: 173798 - DNA, 103 bp, Artificial Sequence
  Synthetic Polynucleotide
taatacgactcactatagggttcttcagcaccagagcccgaagagcccgcaacagaggagagcgggcatgtcgggctctaacctggcggcagcgcaaaagatg

SEQ ID NO: 173799 - DNA, 103 bp, Artificial Sequence
  Synthetic Polynucleotide
taatacgactcactatagggcaagggccggttcttcagcaccagagcccgaacagaggagacgggctatggtgctgaagaacctggcggcagcgcaaaagatg

SEQ ID NO: 173800 - DNA, 103 bp, Artificial Sequence
  Synthetic Polynucleotide
taatacgactcactataggggggaagtctccaagggccggttcttcagcaaacagaggagatgctgaatgaccggccctaacctggcggcagcgcaaaagatg

SEQ ID NO: 173801 - DNA, 103 bp, Artificial Sequence
  Synthetic Polynucleotide
taatacgactcactatagggttggtgaagcgggaagtctccaagggccggaacagaggagaccggccatgggagacttcaacctggcggcagcgcaaaagatg

SEQ ID NO: 173802 - DNA, 103 bp, Artificial Sequence
  Synthetic Polynucleotide
taatacgactcactataggggagcagcagcttggtgaagcgggaagtctcaacagaggagagagactatgcgcttcaccaacctggcggcagcgcaaaagatg

SEQ ID NO: 173803 - DNA, 103 bp, Artificial Sequence
  Synthetic Polynucleotide
taatacgactcactatagggccggcagcttgagcagcagcttggtgaagcaacagaggagagcttcaatgagctgctgcaacctggcggcagcgcaaaagatg

SEQ ID NO: 173804 - DNA, 103 bp, Artificial Sequence
  Synthetic Polynucleotide
taatacgactcactataggggtccgcaggtccggcagcttgagcagcagcaacagaggagagctgctatgcaagctgccaacctggcggcagcgcaaaagatg

SEQ ID NO: 173805 - DNA, 103 bp, Artificial Sequence
  Synthetic Polynucleotide
taatacgactcactataggggttgttcagggtccgcaggtccggcagcttaacagaggagaaagctgatggacctgcggaacctggcggcagcgcaaaagatg

SEQ ID NO: 173806 - DNA, 103 bp, Artificial Sequence
  Synthetic Polynucleotide
taatacgactcactatagggcggaatgcatgttgttcagggtccgcaggtaacagaggagaacctgcatgccctgaacaaacctggcggcagcgcaaaagatg

SEQ ID NO: 173807 - DNA, 103 bp, Artificial Sequence
  Synthetic Polynucleotide
taatacgactcactataggggagcgagccgggtcttgggtgagggagccaaacagaggagatggctcatgcacccaagaaacctggcggcagcgcaaaagatg

SEQ ID NO: 173808 - DNA, 103 bp, Artificial Sequence
  Synthetic Polynucleotide
taatacgactcactatagggagcagcttctcggaatgcatgttgttcaggaacagaggagacctgaaatgcatgcattcaacctggcggcagcgcaaaagatg

SEQ ID NO: 173809 - DNA, 103 bp, Artificial Sequence
  Synthetic Polynucleotide
taatacgactcactatagggccggaaggacagcagcttctcggaatgcataacagaggagaatgcatatggagaagctgaacctggcggcagcgcaaaagatg

SEQ ID NO: 173810 - DNA, 103 bp, Artificial Sequence
  Synthetic Polynucleotide
taatacgactcactataggggggcgtccacccggaaggacagcagcttctaacagaggagaagaagcatgtgtccttccaacctggcggcagcgcaaaagatg

SEQ ID NO: 173811 - DNA, 103 bp, Artificial Sequence
  Synthetic Polynucleotide
taatacgactcactataggggctcccaaaggagcgagccgggtcttgggtaacagaggagaacccaaatgccggctcgcaacctggcggcagcgcaaaagatg

SEQ ID NO: 173812 - DNA, 103 bp, Artificial Sequence
  Synthetic Polynucleotide
taatacgactcactatagggtgacgccacctgtgttgttgttggagtccaaacagaggagatggactatgacaacaacaaacctggcggcagcgcaaaagatg

SEQ ID NO: 173813 - DNA, 103 bp, Artificial Sequence
  Synthetic Polynucleotide
taatacgactcactatagggtgggtggaatgctcccaaaggagcgagccgaacagaggagacggctcatgcctttgggaaacctggcggcagcgcaaaagatg

SEQ ID NO: 173814 - DNA, 103 bp, Artificial Sequence
  Synthetic Polynucleotide
taatacgactcactatagggtcactcaggctgggtggaatgctcccaaagaacagaggagactttggatgcattccaccaacctggcggcagcgcaaaagatg

SEQ ID NO: 173815 - DNA, 103 bp, Artificial Sequence
  Synthetic Polynucleotide
taatacgactcactatagggggagccgtcatcactcaggctgggtggaataacagaggagaattccaatgagcctgagtaacctggcggcagcgcaaaagatg

SEQ ID NO: 173816 - DNA, 103 bp, Artificial Sequence
  Synthetic Polynucleotide
taatacgactcactatagggaggaagaaggggagccgtcatcactcaggcaacagaggagagcctgaatgatgacggctaacctggcggcagcgcaaaagatg

SEQ ID NO: 173817 - DNA, 103 bp, Artificial Sequence
  Synthetic Polynucleotide
taatacgactcactataggggaggaagatgaggaagaaggggagccgtcaaacagaggagatgacggatgcccttcttcaacctggcggcagcgcaaaagatg

SEQ ID NO: 173818 - DNA, 103 bp, Artificial Sequence
  Synthetic Polynucleotide
taatacgactcactatagggggatgacgacgaggaagatgaggaagaaggaacagaggagaccttctatgtcatcttccaacctggcggcagcgcaaaagatg

SEQ ID NO: 173819 - DNA, 103 bp, Artificial Sequence
  Synthetic Polynucleotide
taatacgactcactatagggaggaggaggaggatgacgacgaggaagatgaacagaggagacatcttatgcgtcgtcataacctggcggcagcgcaaaagatg

SEQ ID NO: 173820 - DNA, 103 bp, Artificial Sequence
  Synthetic Polynucleotide
taatacgactcactatagggccattatagaaggaggaggaggatgacgacaacagaggagagtcgtcatgctcctcctcaacctggcggcagcgcaaaagatg

SEQ ID NO: 173821 - DNA, 103 bp, Artificial Sequence
  Synthetic Polynucleotide
taatacgactcactatagggaggggggctcccattatagaaggaggaggaaacagaggagatcctccatgttctataataacctggcggcagcgcaaaagatg

SEQ ID NO: 173822 - DNA, 103 bp, Artificial Sequence
  Synthetic Polynucleotide
taatacgactcactataggggtagactcccaggggggctcccattatagaaacagaggagatctataatgggagcccccaacctggcggcagcgcaaaagatg

SEQ ID NO: 173823 - DNA, 103 bp, Artificial Sequence
  Synthetic Polynucleotide
taatacgactcactatagggatgtaggtgatgacgccacctgtgttgttgaacagaggagacaacaaatgaggtggcgtaacctggcggcagcgcaaaagatg

SEQ ID NO: 173824 - DNA, 103 bp, Artificial Sequence
  Synthetic Polynucleotide
taatacgactcactatagggatggccacttgtagactcccaggggggctcaacagaggagagagcccatgtgggagtctaacctggcggcagcgcaaaagatg

SEQ ID NO: 173825 - DNA, 103 bp, Artificial Sequence
  Synthetic Polynucleotide
taatacgactcactataggggctgtcctccatggccacttgtagactcccaacagaggagagggagtatgcaagtggccaacctggcggcagcgcaaaagatg

SEQ ID NO: 173826 - DNA, 103 bp, Artificial Sequence
  Synthetic Polynucleotide
taatacgactcactatagggacactcggctgctgtcctccatggccacttaacagaggagaaagtggatgtggaggacaaacctggcggcagcgcaaaagatg

SEQ ID NO: 173827 - DNA, 103 bp, Artificial Sequence
  Synthetic Polynucleotide
taatacgactcactatagggttgctgggggacactcggctgctgtcctccaacagaggagaggaggaatgcagccgagtaacctggcggcagcgcaaaagatg

SEQ ID NO: 173828 - DNA, 103 bp, Artificial Sequence
  Synthetic Polynucleotide
taatacgactcactataggggctggtgctcttgctgggggacactcggctaacagaggagaagccgaatgtcccccagcaacctggcggcagcgcaaaagatg

SEQ ID NO: 173829 - DNA, 103 bp, Artificial Sequence
  Synthetic Polynucleotide
taatacgactcactatagggtggtgatgttgctggtgctcttgctgggggaacagaggagacccccaatgagagcaccaaacctggcggcagcgcaaaagatg

SEQ ID NO: 173830 - DNA, 103 bp, Artificial Sequence
  Synthetic Polynucleotide
taatacgactcactatagggccattcagcttggtgatgttgctggtgctcaacagaggagagagcacatgcaacatcacaacctggcggcagcgcaaaagatg

SEQ ID NO: 173831 - DNA, 103 bp, Artificial Sequence
  Synthetic Polynucleotide
taatacgactcactatagggtaacaccatgccattcagcttggtgatgttaacagaggagaaacatcatgaagctgaataacctggcggcagcgcaaaagatg

SEQ ID NO: 173832 - DNA, 103 bp, Artificial Sequence
  Synthetic Polynucleotide
taatacgactcactatagggctttacacagtaacaccatgccattcagctaacagaggagaagctgaatggcatggtgtaacctggcggcagcgcaaaagatg

SEQ ID NO: 173833 - DNA, 103 bp, Artificial Sequence
  Synthetic Polynucleotide
taatacgactcactatagggtccccacacactttacacagtaacaccatgaacagaggagacatggtatgactgtgtaaaacctggcggcagcgcaaaagatg

SEQ ID NO: 173834 - DNA, 103 bp, Artificial Sequence
  Synthetic Polynucleotide
taatacgactcactatagggactggagccaatgtaggtgatgacgccaccaacagaggagaggtggcatgatcacctacaacctggcggcagcgcaaaagatg

SEQ ID NO: 173835 - DNA, 103 bp, Artificial Sequence
  Synthetic Polynucleotide
taatacgactcactatagggcgaggcaacgtccccacacactttacacagaacagaggagactgtgtatggtgtgtgggaacctggcggcagcgcaaaagatg

SEQ ID NO: 173836 - DNA, 103 bp, Artificial Sequence
  Synthetic Polynucleotide
taatacgactcactatagggagtggaagcccgaggcaacgtccccacacaaacagaggagatgtgtgatgacgttgcctaacctggcggcagcgcaaaagatg

SEQ ID NO: 173837 - DNA, 103 bp, Artificial Sequence
  Synthetic Polynucleotide
taatacgactcactatagggtgcacaccgtagtggaagcccgaggcaacgaacagaggagacgttgcatggggcttccaaacctggcggcagcgcaaaagatg

SEQ ID NO: 173838 - DNA, 103 bp, Artificial Sequence
  Synthetic Polynucleotide
taatacgactcactatagggctcgcaggcgtgcacaccgtagtggaagccaacagaggagaggcttcatgtacggtgtgaacctggcggcagcgcaaaagatg

SEQ ID NO: 173839 - DNA, 103 bp, Artificial Sequence
  Synthetic Polynucleotide
taatacgactcactatagggccttgcagccctcgcaggcgtgcacaccgtaacagaggagaacggtgatgacgcctgcgaacctggcggcagcgcaaaagatg

SEQ ID NO: 173840 - DNA, 103 bp, Artificial Sequence
  Synthetic Polynucleotide
taatacgactcactatagggcggaaaaagcccttgcagccctcgcaggcgaacagaggagacgcctgatggggctgcaaaacctggcggcagcgcaaaagatg

SEQ ID NO: 173841 - DNA, 103 bp, Artificial Sequence
  Synthetic Polynucleotide
taatacgactcactataggggatgctccgacggaaaaagcccttgcagccaacagaggagaggctgcatgggctttttcaacctggcggcagcgcaaaagatg

SEQ ID NO: 173842 - DNA, 103 bp, Artificial Sequence
  Synthetic Polynucleotide
taatacgactcactatagggtgttctgctggatgctccgacggaaaaagcaacagaggagagcttttatggtcggagcaaacctggcggcagcgcaaaagatg

SEQ ID NO: 173843 - DNA, 103 bp, Artificial Sequence
  Synthetic Polynucleotide
taatacgactcactatagggttgtactggatgttctgctggatgctccgaaacagaggagatcggagatgccagcagaaaacctggcggcagcgcaaaagatg

SEQ ID NO: 173844 - DNA, 103 bp, Artificial Sequence
  Synthetic Polynucleotide
taatacgactcactatagggcagacaccttttgtactggatgttctgctgaacagaggagacagcagatgatccagtacaacctggcggcagcgcaaaagatg

SEQ ID NO: 173845 - DNA, 103 bp, Artificial Sequence
  Synthetic Polynucleotide
taatacgactcactataggggggaggagccactggagccaatgtaggtgaaacagaggagatcacctatgttggctccaaacctggcggcagcgcaaaagatg

SEQ ID NO: 173846 - DNA, 103 bp, Artificial Sequence
  Synthetic Polynucleotide
taatacgactcactatagggtctcattcttcagacaccttttgtactggaaacagaggagatccagtatgaaaggtgtcaacctggcggcagcgcaaaagatg

SEQ ID NO: 173847 - DNA, 103 bp, Artificial Sequence
  Synthetic Polynucleotide
taatacgactcactatagggatggagcaattctcattcttcagacaccttaacagaggagaaaggtgatggaagaatgaaacctggcggcagcgcaaaagatg

SEQ ID NO: 173848 - DNA, 103 bp, Artificial Sequence
  Synthetic Polynucleotide
taatacgactcactataggggatgcggacgatggagcaattctcattcttaacagaggagaaagaatatgaattgctccaacctggcggcagcgcaaaagatg

SEQ ID NO: 173849 - DNA, 103 bp, Artificial Sequence
  Synthetic Polynucleotide
taatacgactcactatagggggttgcgattgatgcggacgatggagcaataacagaggagaattgctatgtcgtccgcaaacctggcggcagcgcaaaagatg

SEQ ID NO: 173850 - DNA, 103 bp, Artificial Sequence
  Synthetic Polynucleotide
taatacgactcactatagggtgctggcagcggttgcgattgatgcggacgaacagaggagacgtccgatgcaatcgcaaaacctggcggcagcgcaaaagatg

SEQ ID NO: 173851 - DNA, 103 bp, Artificial Sequence
  Synthetic Polynucleotide
taatacgactcactataggggaagcgacattgctggcagcggttgcgattaacagaggagaaatcgcatgcgctgccagaacctggcggcagcgcaaaagatg

SEQ ID NO: 173852 - DNA, 103 bp, Artificial Sequence
  Synthetic Polynucleotide
taatacgactcactataggggacacttcttgaagcgacattgctggcagcaacagaggagagctgccatgaatgtcgctaacctggcggcagcgcaaaagatg

SEQ ID NO: 173853 - DNA, 103 bp, Artificial Sequence
  Synthetic Polynucleotide
taatacgactcactatagggcccacagagagacacttcttgaagcgacataacagaggagaatgtcgatgcaagaagtgaacctggcggcagcgcaaaagatg

SEQ ID NO: 173854 - DNA, 103 bp, Artificial Sequence
  Synthetic Polynucleotide
taatacgactcactatagggtcgagacatgcccacagagagacacttcttaacagaggagaaagaagatgctctctgtgaacctggcggcagcgcaaaagatg

SEQ ID NO: 173855 - DNA, 103 bp, Artificial Sequence
  Synthetic Polynucleotide
taatacgactcactataggggcacagcgtctcgagacatgcccacagagaaacagaggagatctctgatggcatgtctcaacctggcggcagcgcaaaagatg

SEQ ID NO: 173856 - DNA, 103 bp, Artificial Sequence
  Synthetic Polynucleotide
taatacgactcactataggggtgcggcttggggaggagccactggagccaaacagaggagatggctcatgtggctcctcaacctggcggcagcgcaaaagatg

SEQ ID NO: 173857 - DNA, 103 bp, Artificial Sequence
  Synthetic Polynucleotide
taatacgactcactatagggcgcccaaaacgcacagcgtctcgagacatgaacagaggagacatgtcatgagacgctgtaacctggcggcagcgcaaaagatg

SEQ ID NO: 173858 - DNA, 103 bp, Artificial Sequence
  Synthetic Polynucleotide
taatacgactcactatagggtttggggatgcgcccaaaacgcacagcgtcaacagaggagagacgctatgcgttttgggaacctggcggcagcgcaaaagatg

SEQ ID NO: 173859 - DNA, 103 bp, Artificial Sequence
  Synthetic Polynucleotide
taatacgactcactataggggcttctctcgtttggggatgcgcccaaaacaacagaggagagttttgatggcatccccaaacctggcggcagcgcaaaagatg

SEQ ID NO: 173860 - DNA, 103 bp, Artificial Sequence
  Synthetic Polynucleotide
taatacgactcactatagggagcatccgctgcttctctcgtttggggatgaacagaggagacatcccatgacgagagaaaacctggcggcagcgcaaaagatg

SEQ ID NO: 173861 - DNA, 103 bp, Artificial Sequence
  Synthetic Polynucleotide
taatacgactcactatagggcatctcagcaagcatccgctgcttctctcgaacagaggagacgagagatgcagcggatgaacctggcggcagcgcaaaagatg

SEQ ID NO: 173862 - DNA, 103 bp, Artificial Sequence
  Synthetic Polynucleotide
taatacgactcactatagggtggcactctgcatctcagcaagcatccgctaacagaggagaagcggaatgttgctgagaaacctggcggcagcgcaaaagatg

SEQ ID NO: 173863 - DNA, 103 bp, Artificial Sequence
  Synthetic Polynucleotide
taatacgactcactataggggccaggttcatggcactctgcatctcagcaaacagaggagatgctgaatggcagagtgcaacctggcggcagcgcaaaagatg

SEQ ID NO: 173864 - DNA, 103 bp, Artificial Sequence
  Synthetic Polynucleotide
taatacgactcactatagggctggttgttggccaggttcatggcactctgaacagaggagacagagtatgatgaacctgaacctggcggcagcgcaaaagatg

SEQ ID NO: 173865 - DNA, 103 bp, Artificial Sequence
  Synthetic Polynucleotide
taatacgactcactatagggggctgctcaactggttgttggccaggttcaaacagaggagatgaaccatgccaacaaccaacctggcggcagcgcaaaagatg

SEQ ID NO: 173866 - DNA, 103 bp, Artificial Sequence
  Synthetic Polynucleotide
taatacgactcactatagggagcgggcactggctgctcaactggttgttgaacagaggagacaacaaatggttgagcagaacctggcggcagcgcaaaagatg

SEQ ID NO: 173867 - DNA, 103 bp, Artificial Sequence
  Synthetic Polynucleotide
taatacgactcactatagggttcagggctggtgcggcttggggaggagccaacagaggagaggctccatgccaagccgcaacctggcggcagcgcaaaagatg

SEQ ID NO: 173868 - DNA, 103 bp, Artificial Sequence
  Synthetic Polynucleotide
taatacgactcactatagggtgaagtctccagcgggcactggctgctcaaaacagaggagattgagcatgcagtgcccgaacctggcggcagcgcaaaagatg

SEQ ID NO: 173869 - DNA, 103 bp, Artificial Sequence
  Synthetic Polynucleotide
taatacgactcactataggggctgggtgggtgaagtctccagcgggcactaacagaggagaagtgccatgtggagacttaacctggcggcagcgcaaaagatg

SEQ ID NO: 173870 - DNA, 103 bp, Artificial Sequence
  Synthetic Polynucleotide
taatacgactcactatagggggggtggggtgctgggtgggtgaagtctccaacagaggagaggagacatgacccacccaaacctggcggcagcgcaaaagatg

SEQ ID NO: 173871 - DNA, 103 bp, Artificial Sequence
  Synthetic Polynucleotide
taatacgactcactatagggcatggggcctggggtggggtgctgggtgggaacagaggagacccaccatgcaccccaccaacctggcggcagcgcaaaagatg

SEQ ID NO: 173872 - DNA, 103 bp, Artificial Sequence
  Synthetic Polynucleotide
taatacgactcactataggggcgaggggcccatggggcctggggtggggtaacagaggagaaccccaatgcaggccccaaacctggcggcagcgcaaaagatg

SEQ ID NO: 173873 - DNA, 103 bp, Artificial Sequence
  Synthetic Polynucleotide
taatacgactcactataggggcagggggtggcgaggggcccatggggcctaacagaggagaaggcccatggggcccctcaacctggcggcagcgcaaaagatg

SEQ ID NO: 173874 - DNA, 103 bp, Artificial Sequence
  Synthetic Polynucleotide
taatacgactcactatagggggggaccggagcagggggtggcgaggggccaacagaggagaggccccatgccaccccctaacctggcggcagcgcaaaagatg

SEQ ID NO: 173875 - DNA, 103 bp, Artificial Sequence
  Synthetic Polynucleotide
taatacgactcactatagggccaggggtgaggggaccggagcagggggtgaacagaggagacaccccatgctccggtccaacctggcggcagcgcaaaagatg

SEQ ID NO: 173876 - DNA, 103 bp, Artificial Sequence
  Synthetic Polynucleotide
taatacgactcactataggggagaagcccaccaggggtgaggggaccggaaacagaggagatccggtatgctcacccctaacctggcggcagcgcaaaagatg

SEQ ID NO: 173877 - DNA, 103 bp, Artificial Sequence
  Synthetic Polynucleotide
taatacgactcactatagggtggaaactgggagaagcccaccaggggtgaaacagaggagatcacccatggtgggcttcaacctggcggcagcgcaaaagatg

SEQ ID NO: 173878 - DNA, 103 bp, Artificial Sequence
  Synthetic Polynucleotide
taatacgactcactatagggtatagagggattcagggctggtgcggcttgaacagaggagacaagccatgccagccctgaacctggcggcagcgcaaaagatg

SEQ ID NO: 173879 - DNA, 103 bp, Artificial Sequence
  Synthetic Polynucleotide
taatacgactcactatagggtcagctgttgtggaaactgggagaagcccaaacagaggagatgggctatgcccagtttcaacctggcggcagcgcaaaagatg

SEQ ID NO: 173880 - DNA, 103 bp, Artificial Sequence
  Synthetic Polynucleotide
taatacgactcactatagggctgggaggcgtcagctgttgtggaaactggaacagaggagaccagttatgacaacagctaacctggcggcagcgcaaaagatg

SEQ ID NO: 173881 - DNA, 103 bp, Artificial Sequence
  Synthetic Polynucleotide
taatacgactcactataggggcttggggatctgggaggcgtcagctgttgaacagaggagacaacagatgacgcctcccaacctggcggcagcgcaaaagatg

SEQ ID NO: 173882 - DNA, 103 bp, Artificial Sequence
  Synthetic Polynucleotide
taatacgactcactatagggtgggctcagggcttggggatctgggaggcgaacagaggagacgcctcatggatccccaaaacctggcggcagcgcaaaagatg

SEQ ID NO: 173883 - DNA, 103 bp, Artificial Sequence
  Synthetic Polynucleotide
taatacgactcactatagggtcctccactgtgggctcagggcttggggataacagaggagaatccccatgccctgagccaacctggcggcagcgcaaaagatg

SEQ ID NO: 173884 - DNA, 103 bp, Artificial Sequence
  Synthetic Polynucleotide
taatacgactcactatagggggatatcacatcctccactgtgggctcaggaacagaggagacctgagatgacagtggagaacctggcggcagcgcaaaagatg

SEQ ID NO: 173885 - DNA, 103 bp, Artificial Sequence
  Synthetic Polynucleotide
taatacgactcactataggggggccacctgggatatcacatcctccactgaacagaggagacagtggatgatgtgatataacctggcggcagcgcaaaagatg

SEQ ID NO: 173886 - DNA, 103 bp, Artificial Sequence
  Synthetic Polynucleotide
taatacgactcactatagggcgatgggcccgggccacctgggatatcacaaacagaggagatgtgatatgccaggtggcaacctggcggcagcgcaaaagatg

SEQ ID NO: 173887 - DNA, 103 bp, Artificial Sequence
  Synthetic Polynucleotide
taatacgactcactataggggaagatctctcgatgggcccgggccacctgaacagaggagacaggtgatgcgggcccataacctggcggcagcgcaaaagatg

SEQ ID NO: 173888 - DNA, 103 bp, Artificial Sequence
  Synthetic Polynucleotide
taatacgactcactataggggggcgtaggtgaagatctctcgatgggcccaacagaggagagggcccatggagagatctaacctggcggcagcgcaaaagatg

SEQ ID NO: 173889 - DNA, 103 bp, Artificial Sequence
  Synthetic Polynucleotide
taatacgactcactataggggagttgtcactatagagggattcagggctgaacagaggagacagcccatgatccctctaaacctggcggcagcgcaaaagatg

SEQ ID NO: 173890 - DNA, 103 bp, Artificial Sequence
  Synthetic Polynucleotide
taatacgactcactatagggagcttgtcatgggcgtaggtgaagatctctaacagaggagaagagatatgcacctacgcaacctggcggcagcgcaaaagatg

SEQ ID NO: 173891 - DNA, 103 bp, Artificial Sequence
  Synthetic Polynucleotide
taatacgactcactatagggtgagctgcccagcttgtcatgggcgtaggtaacagaggagaacctacatgcatgacaagaacctggcggcagcgcaaaagatg

SEQ ID NO: 173892 - DNA, 103 bp, Artificial Sequence
  Synthetic Polynucleotide
taatacgactcactatagggagttgccaggtgagctgcccagcttgtcataacagaggagaatgacaatgtgggcagctaacctggcggcagcgcaaaagatg

SEQ ID NO: 173893 - DNA, 103 bp, Artificial Sequence
  Synthetic Polynucleotide
taatacgactcactatagggttggcattgaagttgccaggtgagctgcccaacagaggagagggcagatgacctggcaaaacctggcggcagcgcaaaagatg

SEQ ID NO: 173894 - DNA, 103 bp, Artificial Sequence
  Synthetic Polynucleotide
taatacgactcactatagggtgatgcatggttggcattgaagttgccaggaacagaggagacctggcatgttcaatgccaacctggcggcagcgcaaaagatg

SEQ ID NO: 173895 - DNA, 103 bp, Artificial Sequence
  Synthetic Polynucleotide
taatacgactcactataggggagggctacctgatgcatggttggcattgaaacagaggagatcaatgatgaccatgcataacctggcggcagcgcaaaagatg

SEQ ID NO: 173896 - DNA, 103 bp, Artificial Sequence
  Synthetic Polynucleotide
taatacgactcactataggggtggtggctggagggctacctgatgcatggaacagaggagaccatgcatgaggtagcccaacctggcggcagcgcaaaagatg

SEQ ID NO: 173897 - DNA, 103 bp, Artificial Sequence
  Synthetic Polynucleotide
taatacgactcactataggggcgatgtggggtggtggctggagggctaccaacagaggagaggtagcatgccagccaccaacctggcggcagcgcaaaagatg

SEQ ID NO: 173898 - DNA, 103 bp, Artificial Sequence
  Synthetic Polynucleotide
taatacgactcactataggggattttcccagcgatgtggggtggtggctgaacagaggagacagccaatgccccacatcaacctggcggcagcgcaaaagatg

SEQ ID NO: 173899 - DNA, 103 bp, Artificial Sequence
  Synthetic Polynucleotide
taatacgactcactataggggggcagccctgattttcccagcgatgtgggaacagaggagacccacaatgctgggaaaaaacctggcggcagcgcaaaagatg

SEQ ID NO: 173900 - DNA, 103 bp, Artificial Sequence
  Synthetic Polynucleotide
taatacgactcactatagggggcaatcacacctcctgcattcacctccataacagaggagaatggagatgaatgcaggaaacctggcggcagcgcaaaagatg

SEQ ID NO: 173901 - DNA, 103 bp, Artificial Sequence
  Synthetic Polynucleotide
taatacgactcactatagggaacagaagaggaggaggactggaaactattaacagaggagaaatagtatgcagtcctccaacctggcggcagcgcaaaagatg

SEQ ID NO: 173902 - DNA, 103 bp, Artificial Sequence
  Synthetic Polynucleotide
taatacgactcactatagggatttgcaatacaaatggcatgaccatttggaacagaggagaccaaatatgcatgccattaacctggcggcagcgcaaaagatg

SEQ ID NO: 173903 - DNA, 103 bp, Artificial Sequence
  Synthetic Polynucleotide
taatacgactcactatagggtacaatgtccatttgcaatacaaatggcataacagaggagaatgccaatggtattgcaaaacctggcggcagcgcaaaagatg

SEQ ID NO: 173904 - DNA, 103 bp, Artificial Sequence
  Synthetic Polynucleotide
taatacgactcactataggggagaagttcatacaatgtccatttgcaataaacagaggagatattgcatgtggacattgaacctggcggcagcgcaaaagatg

SEQ ID NO: 173905 - DNA, 103 bp, Artificial Sequence
  Synthetic Polynucleotide
taatacgactcactatagggataagcattggagaagttcatacaatgtccaacagaggagaggacatatgatgaacttcaacctggcggcagcgcaaaagatg

SEQ ID NO: 173906 - DNA, 103 bp, Artificial Sequence
  Synthetic Polynucleotide
taatacgactcactatagggctctttgagtataagcattggagaagttcaaacagaggagatgaactatgccaatgcttaacctggcggcagcgcaaaagatg

SEQ ID NO: 173907 - DNA, 103 bp, Artificial Sequence
  Synthetic Polynucleotide
taatacgactcactatagggctatcacatactctttgagtataagcattgaacagaggagacaatgcatgtactcaaagaacctggcggcagcgcaaaagatg

SEQ ID NO: 173908 - DNA, 103 bp, Artificial Sequence
  Synthetic Polynucleotide
taatacgactcactatagggtatcggaactctatcacatactctttgagtaacagaggagaactcaaatggtatgtgataacctggcggcagcgcaaaagatg

SEQ ID NO: 173909 - DNA, 103 bp, Artificial Sequence
  Synthetic Polynucleotide
taatacgactcactatagggaaaatccatctatcggaactctatcacataaacagaggagatatgtgatggagttccgaaacctggcggcagcgcaaaagatg

SEQ ID NO: 173910 - DNA, 103 bp, Artificial Sequence
  Synthetic Polynucleotide
taatacgactcactatagggtcattctgagaaaatccatctatcggaactaacagaggagaagttccatgagatggattaacctggcggcagcgcaaaagatg

SEQ ID NO: 173911 - DNA, 103 bp, Artificial Sequence
  Synthetic Polynucleotide
taatacgactcactatagggattcttgttctcattctgagaaaatccatcaacagaggagagatggaatgtctcagaataacctggcggcagcgcaaaagatg

SEQ ID NO: 173912 - DNA, 103 bp, Artificial Sequence
  Synthetic Polynucleotide
taatacgactcactataggggagaagatggaacagaagaggaggaggactaacagaggagaagtcctatgcctcttctgaacctggcggcagcgcaaaagatg

SEQ ID NO: 173913 - DNA, 103 bp, Artificial Sequence
  Synthetic Polynucleotide
taatacgactcactatagggacaggtaactattcttgttctcattctgagaacagaggagactcagaatgagaacaagaaacctggcggcagcgcaaaagatg

SEQ ID NO: 173914 - DNA, 103 bp, Artificial Sequence
  Synthetic Polynucleotide
taatacgactcactatagggccagtgttgcacaggtaactattcttgttcaacagaggagagaacaaatgtagttacctaacctggcggcagcgcaaaagatg

SEQ ID NO: 173915 - DNA, 103 bp, Artificial Sequence
  Synthetic Polynucleotide
taatacgactcactatagggcattcttcctccagtgttgcacaggtaactaacagaggagaagttacatgtgcaacactaacctggcggcagcgcaaaagatg

SEQ ID NO: 173916 - DNA, 103 bp, Artificial Sequence
  Synthetic Polynucleotide
taatacgactcactatagggaaaccagatgcattcttcctccagtgttgcaacagaggagagcaacaatggaggaagaaaacctggcggcagcgcaaaagatg

SEQ ID NO: 173917 - DNA, 103 bp, Artificial Sequence
  Synthetic Polynucleotide
taatacgactcactatagggctcattggacaaaccagatgcattcttcctaacagaggagaaggaagatggcatctggtaacctggcggcagcgcaaaagatg

SEQ ID NO: 173918 - DNA, 103 bp, Artificial Sequence
  Synthetic Polynucleotide
taatacgactcactatagggtggagacttactcattggacaaaccagatgaacagaggagacatctgatgtgtccaatgaacctggcggcagcgcaaaagatg

SEQ ID NO: 173919 - DNA, 103 bp, Artificial Sequence
  Synthetic Polynucleotide
taatacgactcactataggggatccacatatggagacttactcattggacaacagaggagagtccaaatggtaagtctcaacctggcggcagcgcaaaagatg

SEQ ID NO: 173920 - DNA, 103 bp, Artificial Sequence
  Synthetic Polynucleotide
taatacgactcactataggggatttatgaggatccacatatggagacttaaacagaggagataagtcatgatatgtggaaacctggcggcagcgcaaaagatg

SEQ ID NO: 173921 - DNA, 103 bp, Artificial Sequence
  Synthetic Polynucleotide
taatacgactcactatagggttcatgtcctgatttatgaggatccacataaacagaggagatatgtgatgcctcataaaaacctggcggcagcgcaaaagatg

SEQ ID NO: 173922 - DNA, 103 bp, Artificial Sequence
  Synthetic Polynucleotide
taatacgactcactatagggcttcccagatttcatgtcctgatttatgagaacagaggagactcataatgcaggacatgaacctggcggcagcgcaaaagatg

SEQ ID NO: 173923 - DNA, 103 bp, Artificial Sequence
  Synthetic Polynucleotide
taatacgactcactataggggagctatttggagaagatggaacagaagagaacagaggagactcttcatgtccatcttcaacctggcggcagcgcaaaagatg

SEQ ID NO: 173924 - DNA, 103 bp, Artificial Sequence
  Synthetic Polynucleotide
taatacgactcactatagggatcgaaaattcttcccagatttcatgtcctaacagaggagaaggacaatgaatctgggaaacctggcggcagcgcaaaagatg

SEQ ID NO: 173925 - DNA, 103 bp, Artificial Sequence
  Synthetic Polynucleotide
taatacgactcactatagggagtgaagctcatcgaaaattcttcccagataacagaggagaatctggatggaattttcgaacctggcggcagcgcaaaagatg

SEQ ID NO: 173926 - DNA, 103 bp, Artificial Sequence
  Synthetic Polynucleotide
taatacgactcactatagggtcactgctggagtgaagctcatcgaaaattaacagaggagaaattttatgtgagcttcaaacctggcggcagcgcaaaagatg

SEQ ID NO: 173927 - DNA, 103 bp, Artificial Sequence
  Synthetic Polynucleotide
taatacgactcactatagggaccacttctttcactgctggagtgaagctcaacagaggagagagcttatgtccagcagtaacctggcggcagcgcaaaagatg

SEQ ID NO: 173928 - DNA, 103 bp, Artificial Sequence
  Synthetic Polynucleotide
taatacgactcactatagggtgcaaattccaccacttctttcactgctggaacagaggagaccagcaatgaaagaagtgaacctggcggcagcgcaaaagatg

SEQ ID NO: 173929 - DNA, 103 bp, Artificial Sequence
  Synthetic Polynucleotide
taatacgactcactataggggaatacgctttgcaaattccaccacttcttaacagaggagaaagaagatgtggaatttgaacctggcggcagcgcaaaagatg

SEQ ID NO: 173930 - DNA, 103 bp, Artificial Sequence
  Synthetic Polynucleotide
taatacgactcactatagggctgaacccaggaatacgctttgcaaattccaacagaggagaggaattatgaaagcgtataacctggcggcagcgcaaaagatg

SEQ ID NO: 173931 - DNA, 103 bp, Artificial Sequence
  Synthetic Polynucleotide
taatacgactcactatagggagagagatctctgaacccaggaatacgcttaacagaggagaaagcgtatgcctgggttcaacctggcggcagcgcaaaagatg

SEQ ID NO: 173932 - DNA, 103 bp, Artificial Sequence
  Synthetic Polynucleotide
taatacgactcactatagggggtcatgctgagagagatctctgaacccagaacagaggagactgggtatggagatctctaacctggcggcagcgcaaaagatg

SEQ ID NO: 173933 - DNA, 103 bp, Artificial Sequence
  Synthetic Polynucleotide
taatacgactcactatagggaggttgacctggtcatgctgagagagatctaacagaggagaagatctatgtcagcatgaaacctggcggcagcgcaaaagatg

SEQ ID NO: 173934 - DNA, 103 bp, Artificial Sequence
  Synthetic Polynucleotide
taatacgactcactatagggatcagaattagagctatttggagaagatggaacagaggagaccatctatgccaaatagcaacctggcggcagcgcaaaagatg

SEQ ID NO: 173935 - DNA, 103 bp, Artificial Sequence
  Synthetic Polynucleotide
taatacgactcactatagggagcctttaaaaggttgacctggtcatgctgaacagaggagacagcatatgcaggtcaacaacctggcggcagcgcaaaagatg

SEQ ID NO: 173936 - DNA, 103 bp, Artificial Sequence
  Synthetic Polynucleotide
taatacgactcactatagggcaaaagtcccagcctttaaaaggttgacctaacagaggagaaggtcaatgttttaaaggaacctggcggcagcgcaaaagatg

SEQ ID NO: 173937 - DNA, 103 bp, Artificial Sequence
  Synthetic Polynucleotide
taatacgactcactatagggattaaaacctcaaaagtcccagcctttaaaaacagaggagatttaaaatgtgggactttaacctggcggcagcgcaaaagatg

SEQ ID NO: 173938 - DNA, 103 bp, Artificial Sequence
  Synthetic Polynucleotide
taatacgactcactataggggaaccgtaccattaaaacctcaaaagtcccaacagaggagagggactatggaggttttaaacctggcggcagcgcaaaagatg

SEQ ID NO: 173939 - DNA, 103 bp, Artificial Sequence
  Synthetic Polynucleotide
taatacgactcactatagggataatgatgcgaaccgtaccattaaaacctaacagaggagaaggtttatgtggtacggtaacctggcggcagcgcaaaagatg

SEQ ID NO: 173940 - DNA, 103 bp, Artificial Sequence
  Synthetic Polynucleotide
taatacgactcactatagggtttgcatcaaataatgatgcgaaccgtaccaacagaggagaggtacgatgcgcatcattaacctggcggcagcgcaaaagatg

SEQ ID NO: 173941 - DNA, 103 bp, Artificial Sequence
  Synthetic Polynucleotide
taatacgactcactatagggagtacgttcctttgcatcaaataatgatgcaacagaggagagcatcaatgtttgatgcaaacctggcggcagcgcaaaagatg

SEQ ID NO: 173942 - DNA, 103 bp, Artificial Sequence
  Synthetic Polynucleotide
taatacgactcactatagggaaaaggtgacagtacgttcctttgcatcaaaacagaggagattgatgatgaggaacgtaaacctggcggcagcgcaaaagatg

SEQ ID NO: 173943 - DNA, 103 bp, Artificial Sequence
  Synthetic Polynucleotide
taatacgactcactatagggtttccacttaaaaaggtgacagtacgttccaacagaggagaggaacgatgtgtcaccttaacctggcggcagcgcaaaagatg

SEQ ID NO: 173944 - DNA, 103 bp, Artificial Sequence
  Synthetic Polynucleotide
taatacgactcactatagggactatatttctttccacttaaaaaggtgacaacagaggagagtcaccatgttaagtggaaacctggcggcagcgcaaaagatg

SEQ ID NO: 173945 - DNA, 103 bp, Artificial Sequence
  Synthetic Polynucleotide
taatacgactcactatagggtaccattggtatcagaattagagctatttgaacagaggagacaaataatgctaattctgaacctggcggcagcgcaaaagatg

SEQ ID NO: 173946 - DNA, 103 bp, Artificial Sequence
  Synthetic Polynucleotide
taatacgactcactatagggaatcatccacactatatttctttccacttaaacagaggagataagtgatgagaaatataaacctggcggcagcgcaaaagatg

SEQ ID NO: 173947 - DNA, 103 bp, Artificial Sequence
  Synthetic Polynucleotide
taatacgactcactatagggattgagtgtaaatcatccacactatatttcaacagaggagagaaataatgtgtggatgaaacctggcggcagcgcaaaagatg

SEQ ID NO: 173948 - DNA, 103 bp, Artificial Sequence
  Synthetic Polynucleotide
taatacgactcactatagggccctgctcccattgagtgtaaatcatccacaacagaggagagtggatatgttacactcaaacctggcggcagcgcaaaagatg

SEQ ID NO: 173949 - DNA, 103 bp, Artificial Sequence
  Synthetic Polynucleotide
taatacgactcactatagggttagcagatcccctgctcccattgagtgtaaacagaggagatacactatgtgggagcagaacctggcggcagcgcaaaagatg

SEQ ID NO: 173950 - DNA, 103 bp, Artificial Sequence
  Synthetic Polynucleotide
taatacgactcactatagggaacatagagtttagcagatcccctgctcccaacagaggagagggagcatgggatctgctaacctggcggcagcgcaaaagatg

SEQ ID NO: 173951 - DNA, 103 bp, Artificial Sequence
  Synthetic Polynucleotide
taatacgactcactatagggactaaattcaaacatagagtttagcagatcaacagaggagagatctgatgaactctatgaacctggcggcagcgcaaaagatg

SEQ ID NO: 173952 - DNA, 103 bp, Artificial Sequence
  Synthetic Polynucleotide
taatacgactcactatagggttagcttctcactaaattcaaacatagagtaacagaggagaactctaatgttgaatttaaacctggcggcagcgcaaaagatg

SEQ ID NO: 173953 - DNA, 103 bp, Artificial Sequence
  Synthetic Polynucleotide
taatacgactcactatagggtggagggcatttagcttctcactaaattcaaacagaggagatgaattatgtgagaagctaacctggcggcagcgcaaaagatg

SEQ ID NO: 173954 - DNA, 103 bp, Artificial Sequence
  Synthetic Polynucleotide
taatacgactcactatagggatcactaagttggagggcatttagcttctcaacagaggagagagaagatgaatgccctcaacctggcggcagcgcaaaagatg

SEQ ID NO: 173955 - DNA, 103 bp, Artificial Sequence
  Synthetic Polynucleotide
taatacgactcactatagggtcatctcttcatcactaagttggagggcataacagaggagaatgcccatgaacttagtgaacctggcggcagcgcaaaagatg

SEQ ID NO: 173956 - DNA, 103 bp, Artificial Sequence
  Synthetic Polynucleotide
taatacgactcactatagggttcttgggattaccattggtatcagaattaaacagaggagataattcatgtaccaatggaacctggcggcagcgcaaaagatg

SEQ ID NO: 173957 - DNA, 103 bp, Artificial Sequence
  Synthetic Polynucleotide
taatacgactcactataggggtaaacaaactcatctcttcatcactaagtaacagaggagaacttagatgtgaagagataacctggcggcagcgcaaaagatg

SEQ ID NO: 173958 - DNA, 103 bp, Artificial Sequence
  Synthetic Polynucleotide
taatacgactcactataggggacaacagctgtaaacaaactcatctcttcaacagaggagagaagagatgagtttgtttaacctggcggcagcgcaaaagatg

SEQ ID NO: 173959 - DNA, 103 bp, Artificial Sequence
  Synthetic Polynucleotide
taatacgactcactatagggcagataccaggacaacagctgtaaacaaacaacagaggagagtttgtatgcagctgttgaacctggcggcagcgcaaaagatg

SEQ ID NO: 173960 - DNA, 103 bp, Artificial Sequence
  Synthetic Polynucleotide
taatacgactcactataggggatcgatctgcagataccaggacaacagctaacagaggagaagctgtatgcctggtatcaacctggcggcagcgcaaaagatg

SEQ ID NO: 173961 - DNA, 103 bp, Artificial Sequence
  Synthetic Polynucleotide
taatacgactcactatagggttctattccagatcgatctgcagataccagaacagaggagactggtaatggcagatcgaaacctggcggcagcgcaaaagatg

SEQ ID NO: 173962 - DNA, 103 bp, Artificial Sequence
  Synthetic Polynucleotide
taatacgactcactatagggagttgacgttttctattccagatcgatctgaacagaggagacagatcatgctggaatagaacctggcggcagcgcaaaagatg

SEQ ID NO: 173963 - DNA, 103 bp, Artificial Sequence
  Synthetic Polynucleotide
taatacgactcactataggggcctccacagagttgacgttttctattccaaacagaggagatggaatatgaaacgtcaaaacctggcggcagcgcaaaagatg

SEQ ID NO: 173964 - DNA, 103 bp, Artificial Sequence
  Synthetic Polynucleotide
taatacgactcactatagggttcctgcaaagcctccacagagttgacgttaacagaggagaaacgtcatgtctgtggagaacctggcggcagcgcaaaagatg

SEQ ID NO: 173965 - DNA, 103 bp, Artificial Sequence
  Synthetic Polynucleotide
taatacgactcactataggggaatgagagtttcctgcaaagcctccacagaacagaggagactgtggatgctttgcaggaacctggcggcagcgcaaaagatg

SEQ ID NO: 173966 - DNA, 103 bp, Artificial Sequence
  Synthetic Polynucleotide
taatacgactcactatagggcttagtgcacgaatgagagtttcctgcaaaaacagaggagatttgcaatgaactctcataacctggcggcagcgcaaaagatg

SEQ ID NO: 173967 - DNA, 103 bp, Artificial Sequence
  Synthetic Polynucleotide
taatacgactcactataggggagatcaccattcttgggattaccattggtaacagaggagaaccaatatgaatcccaagaacctggcggcagcgcaaaagatg

SEQ ID NO: 173968 - DNA, 103 bp, Artificial Sequence
  Synthetic Polynucleotide
taatacgactcactatagggtattaaggtccttagtgcacgaatgagagtaacagaggagaactctcatgcgtgcactaaacctggcggcagcgcaaaagatg

SEQ ID NO: 173969 - DNA, 103 bp, Artificial Sequence
  Synthetic Polynucleotide
taatacgactcactatagggggtttttcattattaaggtccttagtgcacaacagaggagagtgcacatgggaccttaaaacctggcggcagcgcaaaagatg

SEQ ID NO: 173970 - DNA, 103 bp, Artificial Sequence
  Synthetic Polynucleotide
taatacgactcactatagggtcatttggatggtttttcattattaaggtcaacagaggagagaccttatgaatgaaaaaaacctggcggcagcgcaaaagatg

SEQ ID NO: 173971 - DNA, 103 bp, Artificial Sequence
  Synthetic Polynucleotide
taatacgactcactatagggaatagaggcctcatttggatggtttttcataacagaggagaatgaaaatgcatccaaataacctggcggcagcgcaaaagatg

SEQ ID NO: 173972 - DNA, 103 bp, Artificial Sequence
  Synthetic Polynucleotide
taatacgactcactataggggttttgtaaaaatagaggcctcatttggataacagaggagaatccaaatgaggcctctaaacctggcggcagcgcaaaagatg

SEQ ID NO: 173973 - DNA, 103 bp, Artificial Sequence
  Synthetic Polynucleotide
taatacgactcactatagggtttagaagcagttttgtaaaaatagaggccaacagaggagaggcctcatgttttacaaaaacctggcggcagcgcaaaagatg

SEQ ID NO: 173974 - DNA, 103 bp, Artificial Sequence
  Synthetic Polynucleotide
taatacgactcactatagggatctggcaactttagaagcagttttgtaaaaacagaggagatttacaatgctgcttctaaacctggcggcagcgcaaaagatg

SEQ ID NO: 173975 - DNA, 103 bp, Artificial Sequence
  Synthetic Polynucleotide
taatacgactcactatagggaagatcgaagatctggcaactttagaagcaaacagaggagatgcttcatgagttgccagaacctggcggcagcgcaaaagatg

SEQ ID NO: 173976 - DNA, 103 bp, Artificial Sequence
  Synthetic Polynucleotide
taatacgactcactatagggatgttgtttaaagatcgaagatctggcaacaacagaggagagttgccatgtcttcgatcaacctggcggcagcgcaaaagatg

SEQ ID NO: 173977 - DNA, 103 bp, Artificial Sequence
  Synthetic Polynucleotide
taatacgactcactatagggctcagagtgcatgttgtttaaagatcgaagaacagaggagacttcgaatgttaaacaacaacctggcggcagcgcaaaagatg

SEQ ID NO: 173978 - DNA, 103 bp, Artificial Sequence
  Synthetic Polynucleotide
taatacgactcactatagggcaatattggcgagatcaccattcttgggataacagaggagaatcccaatgatggtgatcaacctggcggcagcgcaaaagatg

SEQ ID NO: 173979 - DNA, 103 bp, Artificial Sequence
  Synthetic Polynucleotide
taatacgactcactatagggccaagagctcctcagagtgcatgttgtttaaacagaggagataaacaatgtgcactctgaacctggcggcagcgcaaaagatg

SEQ ID NO: 173980 - DNA, 103 bp, Artificial Sequence
  Synthetic Polynucleotide
taatacgactcactatagggactttaaaggccaagagctcctcagagtgcaacagaggagagcactcatgggagctcttaacctggcggcagcgcaaaagatg

SEQ ID NO: 173981 - DNA, 103 bp, Artificial Sequence
  Synthetic Polynucleotide
taatacgactcactatagggttaagggtgaactttaaaggccaagagctcaacagaggagagagctcatggcctttaaaaacctggcggcagcgcaaaagatg

SEQ ID NO: 173982 - DNA, 103 bp, Artificial Sequence
  Synthetic Polynucleotide
taatacgactcactatagggaagatgccttcaatattggcgagatcaccaaacagaggagatggtgaatgcgccaatataacctggcggcagcgcaaaagatg

SEQ ID NO: 173983 - DNA, 103 bp, Artificial Sequence
  Synthetic Polynucleotide
taatacgactcactatagggatcattcttcaagatgccttcaatattggcaacagaggagagccaatatggaaggcatcaacctggcggcagcgcaaaagatg

SEQ ID NO: 173984 - DNA, 103 bp, Artificial Sequence
  Synthetic Polynucleotide
taatacgactcactatagggaactgatataggcaatcacacctcctgcataacagaggagaatgcagatggtgtgattgaacctggcggcagcgcaaaagatg

SEQ ID NO: 173985 - DNA, 103 bp, Artificial Sequence
  Synthetic Polynucleotide
taatacgactcactatagggaatctattcgatcattcttcaagatgccttaacagaggagaaaggcaatgtgaagaatgaacctggcggcagcgcaaaagatg

SEQ ID NO: 173986 - DNA, 103 bp, Artificial Sequence
  Synthetic Polynucleotide
taatacgactcactatagggttcatagaacaatctattcgatcattcttcaacagaggagagaagaaatgtcgaatagaaacctggcggcagcgcaaaagatg

SEQ ID NO: 173987 - DNA, 103 bp, Artificial Sequence
  Synthetic Polynucleotide
taatacgactcactatagggtttgcttgttttcatagaacaatctattcgaacagaggagacgaataatgtgttctatgaacctggcggcagcgcaaaagatg

SEQ ID NO: 173988 - DNA, 103 bp, Artificial Sequence
  Synthetic Polynucleotide
taatacgactcactataggggtgcactcgatttgcttgttttcatagaacaacagaggagagttctaatgaaacaagcaaacctggcggcagcgcaaaagatg

SEQ ID NO: 173989 - DNA, 103 bp, Artificial Sequence
  Synthetic Polynucleotide
taatacgactcactataggggtcatcccaggtgcactcgatttgcttgttaacagaggagaaacaagatgatcgagtgcaacctggcggcagcgcaaaagatg

SEQ ID NO: 173990 - DNA, 103 bp, Artificial Sequence
  Synthetic Polynucleotide
taatacgactcactatagggatgactttttgtcatcccaggtgcactcgaaacagaggagatcgagtatgcctgggatgaacctggcggcagcgcaaaagatg

SEQ ID NO: 173991 - DNA, 103 bp, Artificial Sequence
  Synthetic Polynucleotide
taatacgactcactatagggtcacaccactatgactttttgtcatcccagaacagaggagactgggaatgcaaaaagtcaacctggcggcagcgcaaaagatg

SEQ ID NO: 173992 - DNA, 103 bp, Artificial Sequence
  Synthetic Polynucleotide
taatacgactcactatagggctaaattttgtcacaccactatgactttttaacagaggagaaaaaagatgtagtggtgtaacctggcggcagcgcaaaagatg

SEQ ID NO: 173993 - DNA, 103 bp, Artificial Sequence
  Synthetic Polynucleotide
taatacgactcactatagggaaccatgccactaaattttgtcacaccactaacagaggagaagtggtatgacaaaatttaacctggcggcagcgcaaaagatg

SEQ ID NO: 173994 - DNA, 103 bp, Artificial Sequence
  Synthetic Polynucleotide
taatacgactcactatagggtacacagtagaaccatgccactaaattttgaacagaggagacaaaatatggtggcatggaacctggcggcagcgcaaaagatg

SEQ ID NO: 173995 - DNA, 103 bp, Artificial Sequence
  Synthetic Polynucleotide
taatacgactcactataggggagctggaagaactgatataggcaatcacaaacagaggagatgtgatatgctatatcagaacctggcggcagcgcaaaagatg

SEQ ID NO: 173996 - DNA, 103 bp, Artificial Sequence
  Synthetic Polynucleotide
taatacgactcactatagggccacagactttacacagtagaaccatgccaaacagaggagatggcatatgtctactgtgaacctggcggcagcgcaaaagatg

SEQ ID NO: 173997 - DNA, 103 bp, Artificial Sequence
  Synthetic Polynucleotide
taatacgactcactatagggcgccacatccccacagactttacacagtagaacagaggagactactgatgaaagtctgtaacctggcggcagcgcaaaagatg

SEQ ID NO: 173998 - DNA, 103 bp, Artificial Sequence
  Synthetic Polynucleotide
taatacgactcactatagggggaatcctgacgccacatccccacagacttaacagaggagaaagtctatggggatgtggaacctggcggcagcgcaaaagatg

SEQ ID NO: 173999 - DNA, 103 bp, Artificial Sequence
  Synthetic Polynucleotide
taatacgactcactatagggactccatagtggaatcctgacgccacatccaacagaggagaggatgtatggtcaggattaacctggcggcagcgcaaaagatg

SEQ ID NO: 174000 - DNA, 103 bp, Artificial Sequence
  Synthetic Polynucleotide
taatacgactcactataggggcaagcatgaactccatagtggaatcctgaaacagaggagatcaggaatgcactatggaaacctggcggcagcgcaaaagatg

SEQ ID NO: 174001 - DNA, 103 bp, Artificial Sequence
  Synthetic Polynucleotide
taatacgactcactatagggtacagccttcgcaagcatgaactccatagtaacagaggagaactatgatgttcatgcttaacctggcggcagcgcaaaagatg

SEQ ID NO: 174002 - DNA, 103 bp, Artificial Sequence
  Synthetic Polynucleotide
taatacgactcactatagggaagaaacccttacagccttcgcaagcatgaaacagaggagatcatgcatgcgaaggctgaacctggcggcagcgcaaaagatg

SEQ ID NO: 174003 - DNA, 103 bp, Artificial Sequence
  Synthetic Polynucleotide
taatacgactcactatagggacttctccgaaagaaacccttacagccttcaacagaggagagaaggcatgaagggtttcaacctggcggcagcgcaaaagatg

SEQ ID NO: 174004 - DNA, 103 bp, Artificial Sequence
  Synthetic Polynucleotide
taatacgactcactatagggtttgttgaatacttctccgaaagaaaccctaacagaggagaagggttatgttcggagaaaacctggcggcagcgcaaaagatg

SEQ ID NO: 174005 - DNA, 103 bp, Artificial Sequence
  Synthetic Polynucleotide
taatacgactcactatagggtactggatgttttgttgaatacttctccgaaacagaggagatcggagatgtattcaacaaacctggcggcagcgcaaaagatg

SEQ ID NO: 174006 - DNA, 103 bp, Artificial Sequence
  Synthetic Polynucleotide
taatacgactcactataggggcttgaggctgagctggaagaactgatataaacagaggagatatatcatgtcttccagcaacctggcggcagcgcaaaagatg

SEQ ID NO: 174007 - DNA, 103 bp, Artificial Sequence
  Synthetic Polynucleotide
taatacgactcactataggggcacttcttgtactggatgttttgttgaataacagaggagaattcaaatgaacatccagaacctggcggcagcgcaaaagatg

SEQ ID NO: 174008 - DNA, 103 bp, Artificial Sequence
  Synthetic Polynucleotide
taatacgactcactatagggcattcttcaggcacttcttgtactggatgtaacagaggagaacatccatgacaagaagtaacctggcggcagcgcaaaagatg

SEQ ID NO: 174009 - DNA, 103 bp, Artificial Sequence
  Synthetic Polynucleotide
taatacgactcactataggggaacagttttcattcttcaggcacttcttgaacagaggagacaagaaatgcctgaagaaaacctggcggcagcgcaaaagatg

SEQ ID NO: 174010 - DNA, 103 bp, Artificial Sequence
  Synthetic Polynucleotide
taatacgactcactatagggtctcattatagaacagttttcattcttcagaacagaggagactgaagatggaaaactgtaacctggcggcagcgcaaaagatg

SEQ ID NO: 174011 - DNA, 103 bp, Artificial Sequence
  Synthetic Polynucleotide
taatacgactcactatagggtcctattcattctcattatagaacagttttaacagaggagaaaaactatgctataatgaaacctggcggcagcgcaaaagatg

SEQ ID NO: 174012 - DNA, 103 bp, Artificial Sequence
  Synthetic Polynucleotide
taatacgactcactatagggtgacatctgttcctattcattctcattataaacagaggagatataatatgaatgaatagaacctggcggcagcgcaaaagatg

SEQ ID NO: 174013 - DNA, 103 bp, Artificial Sequence
  Synthetic Polynucleotide
taatacgactcactataggggcgacattgctgacatctgttcctattcataacagaggagaatgaatatgaacagatgtaacctggcggcagcgcaaaagatg

SEQ ID NO: 174014 - DNA, 103 bp, Artificial Sequence
  Synthetic Polynucleotide
taatacgactcactatagggactttttgaagcgacattgctgacatctgtaacagaggagaacagatatgagcaatgtcaacctggcggcagcgcaaaagatg

SEQ ID NO: 174015 - DNA, 103 bp, Artificial Sequence
  Synthetic Polynucleotide
taatacgactcactatagggacagacagacactttttgaagcgacattgcaacagaggagagcaatgatgcttcaaaaaaacctggcggcagcgcaaaagatg

SEQ ID NO: 174016 - DNA, 103 bp, Artificial Sequence
  Synthetic Polynucleotide
taatacgactcactatagggtgacattccaacagacagacactttttgaaaacagaggagattcaaaatgtgtctgtctaacctggcggcagcgcaaaagatg

SEQ ID NO: 174017 - DNA, 103 bp, Artificial Sequence
  Synthetic Polynucleotide
taatacgactcactatagggaagaggcagggcttgaggctgagctggaagaacagaggagacttccaatgcagcctcaaaacctggcggcagcgcaaaagatg

SEQ ID NO: 174018 - DNA, 103 bp, Artificial Sequence
  Synthetic Polynucleotide
taatacgactcactatagggcagcatctcttgacattccaacagacagacaacagaggagagtctgtatgttggaatgtaacctggcggcagcgcaaaagatg

SEQ ID NO: 174019 - DNA, 103 bp, Artificial Sequence
  Synthetic Polynucleotide
taatacgactcactatagggccaaaccgaacagcatctcttgacattccaaacagaggagatggaatatgaagagatgcaacctggcggcagcgcaaaagatg

SEQ ID NO: 174020 - DNA, 103 bp, Artificial Sequence
  Synthetic Polynucleotide
taatacgactcactatagggaggaatacgaccaaaccgaacagcatctctaacagaggagaagagatatggttcggtttaacctggcggcagcgcaaaagatg

SEQ ID NO: 174021 - DNA, 103 bp, Artificial Sequence
  Synthetic Polynucleotide
taatacgactcactatagggtttcacgcttaggaatacgaccaaaccgaaaacagaggagattcggtatggtcgtattcaacctggcggcagcgcaaaagatg

SEQ ID NO: 174022 - DNA, 103 bp, Artificial Sequence
  Synthetic Polynucleotide
taatacgactcactatagggatcctctgtttttcacgcttaggaatacgaaacagaggagatcgtatatgtaagcgtgaaacctggcggcagcgcaaaagatg

SEQ ID NO: 174023 - DNA, 103 bp, Artificial Sequence
  Synthetic Polynucleotide
taatacgactcactatagggttcaattagcatcctctgtttttcacgcttaacagaggagaaagcgtatgaaacagaggaacctggcggcagcgcaaaagatg

SEQ ID NO: 174024 - DNA, 103 bp, Artificial Sequence
  Synthetic Polynucleotide
taatacgactcactatagggcactttgcatttcaattagcatcctctgttaacagaggagaaacagaatgtgctaattgaacctggcggcagcgcaaaagatg

SEQ ID NO: 174025 - DNA, 103 bp, Artificial Sequence
  Synthetic Polynucleotide
taatacgactcactataggggtcttcattgcactttgcatttcaattagcaacagaggagagctaatatgaatgcaaagaacctggcggcagcgcaaaagatg

SEQ ID NO: 174026 - DNA, 103 bp, Artificial Sequence
  Synthetic Polynucleotide
taatacgactcactataggggttcatcatggtcttcattgcactttgcataacagaggagaatgcaaatggcaatgaagaacctggcggcagcgcaaaagatg

SEQ ID NO: 174027 - DNA, 103 bp, Artificial Sequence
  Synthetic Polynucleotide
taatacgactcactatagggtgaactggctgttcatcatggtcttcattgaacagaggagacaatgaatgccatgatgaaacctggcggcagcgcaaaagatg

SEQ ID NO: 174028 - DNA, 103 bp, Artificial Sequence
  Synthetic Polynucleotide
taatacgactcactatagggtcactgtgacaagaggcagggcttgaggctaacagaggagaagcctcatgccctgcctcaacctggcggcagcgcaaaagatg

SEQ ID NO: 174029 - DNA, 103 bp, Artificial Sequence
  Synthetic Polynucleotide
taatacgactcactatagggaagtgaccactgaactggctgttcatcatgaacagaggagacatgatatgcagccagttaacctggcggcagcgcaaaagatg

SEQ ID NO: 174030 - DNA, 103 bp, Artificial Sequence
  Synthetic Polynucleotide
taatacgactcactataggggtcattttgcaagtgaccactgaactggctaacagaggagaagccagatgagtggtcacaacctggcggcagcgcaaaagatg

SEQ ID NO: 174031 - DNA, 103 bp, Artificial Sequence
  Synthetic Polynucleotide
taatacgactcactatagggctactaatgtgtcattttgcaagtgaccacaacagaggagagtggtcatgtgcaaaatgaacctggcggcagcgcaaaagatg

SEQ ID NO: 174032 - DNA, 103 bp, Artificial Sequence
  Synthetic Polynucleotide
taatacgactcactatagggtcatgatgttctactaatgtgtcattttgcaacagaggagagcaaaaatgcacattagtaacctggcggcagcgcaaaagatg

SEQ ID NO: 174033 - DNA, 103 bp, Artificial Sequence
  Synthetic Polynucleotide
taatacgactcactatagggggctgtctgttcatgatgttctactaatgtaacagaggagaacattaatggaacatcataacctggcggcagcgcaaaagatg

SEQ ID NO: 174034 - DNA, 103 bp, Artificial Sequence
  Synthetic Polynucleotide
taatacgactcactataggggggctggcaaggctgtctgttcatgatgttaacagaggagaaacatcatgaacagacagaacctggcggcagcgcaaaagatg

SEQ ID NO: 174035 - DNA, 103 bp, Artificial Sequence
  Synthetic Polynucleotide
taatacgactcactatagggagctgttcctgggctggcaaggctgtctgtaacagaggagaacagacatgcttgccagcaacctggcggcagcgcaaaagatg

SEQ ID NO: 174036 - DNA, 103 bp, Artificial Sequence
  Synthetic Polynucleotide
taatacgactcactatagggcttgggtcgcagctgttcctgggctggcaaaacagaggagattgccaatgcaggaacagaacctggcggcagcgcaaaagatg

SEQ ID NO: 174037 - DNA, 103 bp, Artificial Sequence
  Synthetic Polynucleotide
taatacgactcactatagggccagttggggcttgggtcgcagctgttcctaacagaggagaaggaacatgtgcgacccaaacctggcggcagcgcaaaagatg

SEQ ID NO: 174038 - DNA, 103 bp, Artificial Sequence
  Synthetic Polynucleotide
taatacgactcactatagggttttcttgctccagttggggcttgggtcgcaacagaggagagcgaccatggccccaactaacctggcggcagcgcaaaagatg

SEQ ID NO: 174039 - DNA, 103 bp, Artificial Sequence
  Synthetic Polynucleotide
taatacgactcactatagggctcagaaccctcactgtgacaagaggcaggaacagaggagacctgccatgtgtcacagtaacctggcggcagcgcaaaagatg

SEQ ID NO: 174040 - DNA, 103 bp, Artificial Sequence
  Synthetic Polynucleotide
taatacgactcactataggggcttttgatgttttcttgctccagttggggaacagaggagaccccaaatggagcaagaaaacctggcggcagcgcaaaagatg

SEQ ID NO: 174041 - DNA, 103 bp, Artificial Sequence
  Synthetic Polynucleotide
taatacgactcactataggggaggagaagagcttttgatgttttcttgctaacagaggagaagcaagatgacatcaaaaaacctggcggcagcgcaaaagatg

SEQ ID NO: 174042 - DNA, 103 bp, Artificial Sequence
  Synthetic Polynucleotide
taatacgactcactatagggtcagaagatggaggagaagagcttttgatgaacagaggagacatcaaatgctcttctccaacctggcggcagcgcaaaagatg

SEQ ID NO: 174043 - DNA, 103 bp, Artificial Sequence
  Synthetic Polynucleotide
taatacgactcactatagggctttgcaaaatcagaagatggaggagaagaaacagaggagatcttctatgccatcttctaacctggcggcagcgcaaaagatg

SEQ ID NO: 174044 - DNA, 103 bp, Artificial Sequence
  Synthetic Polynucleotide
taatacgactcactatagggtcacttcttcctttgcaaaatcagaagatgaacagaggagacatcttatgattttgcaaaacctggcggcagcgcaaaagatg

SEQ ID NO: 174045 - DNA, 103 bp, Artificial Sequence
  Synthetic Polynucleotide
taatacgactcactatagggaccatgccaatcacttcttcctttgcaaaaaacagaggagattttgcatgggaagaagtaacctggcggcagcgcaaaagatg

SEQ ID NO: 174046 - DNA, 103 bp, Artificial Sequence
  Synthetic Polynucleotide
taatacgactcactatagggagctctggtcaccatgccaatcacttcttcaacagaggagagaagaaatgattggcatgaacctggcggcagcgcaaaagatg

SEQ ID NO: 174047 - DNA, 103 bp, Artificial Sequence
  Synthetic Polynucleotide
taatacgactcactatagggtatccttgtgagctctggtcaccatgccaaaacagaggagattggcaatgtgaccagagaacctggcggcagcgcaaaagatg

SEQ ID NO: 174048 - DNA, 103 bp, Artificial Sequence
  Synthetic Polynucleotide
taatacgactcactatagggtacataaaggtatccttgtgagctctggtcaacagaggagagaccagatgtcacaaggaaacctggcggcagcgcaaaagatg

SEQ ID NO: 174049 - DNA, 103 bp, Artificial Sequence
  Synthetic Polynucleotide
taatacgactcactatagggctcttgattatacataaaggtatccttgtgaacagaggagacacaagatgacctttatgaacctggcggcagcgcaaaagatg

SEQ ID NO: 174050 - DNA, 103 bp, Artificial Sequence
  Synthetic Polynucleotide
taatacgactcactatagggggaaactattctcagaaccctcactgtgacaacagaggagagtcacaatgagggttctgaacctggcggcagcgcaaaagatg

SEQ ID NO: 174051 - DNA, 103 bp, Artificial Sequence
  Synthetic Polynucleotide
taatacgactcactatagggtttcttgctgctcttgattatacataaaggaacagaggagacctttaatgataatcaagaacctggcggcagcgcaaaagatg

SEQ ID NO: 174052 - DNA, 103 bp, Artificial Sequence
  Synthetic Polynucleotide
taatacgactcactatagggtcagctgagttttcttgctgctcttgattaaacagaggagataatcaatggcagcaagaaacctggcggcagcgcaaaagatg

SEQ ID NO: 174053 - DNA, 103 bp, Artificial Sequence
  Synthetic Polynucleotide
taatacgactcactatagggctgcatgctctcagctgagttttcttgctgaacagaggagacagcaaatgaactcagctaacctggcggcagcgcaaaagatg

SEQ ID NO: 174054 - DNA, 103 bp, Artificial Sequence
  Synthetic Polynucleotide
taatacgactcactatagggctctctggggctgcatgctctcagctgagtaacagaggagaactcagatgagagcatgcaacctggcggcagcgcaaaagatg

SEQ ID NO: 174055 - DNA, 103 bp, Artificial Sequence
  Synthetic Polynucleotide
taatacgactcactatagggatccgttctcctctctggggctgcatgctcaacagaggagagagcatatggccccagagaacctggcggcagcgcaaaagatg

SEQ ID NO: 174056 - DNA, 103 bp, Artificial Sequence
  Synthetic Polynucleotide
taatacgactcactataggggttcttgggaatccgttctcctctctggggaacagaggagaccccagatgggagaacggaacctggcggcagcgcaaaagatg

SEQ ID NO: 174057 - DNA, 103 bp, Artificial Sequence
  Synthetic Polynucleotide
taatacgactcactatagggattgctccatgttcttgggaatccgttctcaacagaggagagagaacatgttcccaagaaacctggcggcagcgcaaaagatg

SEQ ID NO: 174058 - DNA, 103 bp, Artificial Sequence
  Synthetic Polynucleotide
taatacgactcactatagggtttaaattatattgctccatgttcttgggaaacagaggagatcccaaatgcatggagcaaacctggcggcagcgcaaaagatg

SEQ ID NO: 174059 - DNA, 103 bp, Artificial Sequence
  Synthetic Polynucleotide
taatacgactcactatagggatgatcatgatttaaattatattgctccataacagaggagaatggagatgtataatttaaacctggcggcagcgcaaaagatg

SEQ ID NO: 174060 - DNA, 103 bp, Artificial Sequence
  Synthetic Polynucleotide
taatacgactcactatagggcattgccgcaatgatcatgatttaaattataacagaggagaataattatgatcatgatcaacctggcggcagcgcaaaagatg

SEQ ID NO: 174061 - DNA, 103 bp, Artificial Sequence
  Synthetic Polynucleotide
taatacgactcactataggggaggaggactggaaactattctcagaacccaacagaggagagggttcatggaatagtttaacctggcggcagcgcaaaagatg

SEQ ID NO: 174062 - DNA, 103 bp, Artificial Sequence
  Synthetic Polynucleotide
taatacgactcactatagggctgctaagcccattgccgcaatgatcatgaaacagaggagatcatgaatgttgcggcaaaacctggcggcagcgcaaaagatg

SEQ ID NO: 174063 - DNA, 103 bp, Artificial Sequence
  Synthetic Polynucleotide
taatacgactcactataggggggaaaatggctgctaagcccattgccgcaaacagaggagatgcggcatggggcttagcaacctggcggcagcgcaaaagatg

SEQ ID NO: 174064 - DNA, 103 bp, Artificial Sequence
  Synthetic Polynucleotide
taatacgactcactatagggtctcactacagggaaaatggctgctaagccaacagaggagaggcttaatggccattttcaacctggcggcagcgcaaaagatg

SEQ ID NO: 174065 - DNA, 103 bp, Artificial Sequence
  Synthetic Polynucleotide
taatacgactcactatagggtgctgctggctctcactacagggaaaatggaacagaggagaccatttatgctgtagtgaaacctggcggcagcgcaaaagatg

SEQ ID NO: 174066 - DNA, 103 bp, Artificial Sequence
  Synthetic Polynucleotide
taatacgactcactatagggtccattgagatgctgctggctctcactacaaacagaggagatgtagtatgagccagcagaacctggcggcagcgcaaaagatg

SEQ ID NO: 174067 - DNA, 103 bp, Artificial Sequence
  Synthetic Polynucleotide
taatacgactcactatagggctttgaactgtccattgagatgctgctggcaacagaggagagccagcatgatctcaatgaacctggcggcagcgcaaaagatg

SEQ ID NO: 174068 - DNA, 103 bp, Artificial Sequence
  Synthetic Polynucleotide
taatacgactcactatagggatattcctccctttgaactgtccattgagaaacagaggagatctcaaatgacagttcaaaacctggcggcagcgcaaaagatg

SEQ ID NO: 174069 - DNA, 103 bp, Artificial Sequence
  Synthetic Polynucleotide
taatacgactcactataggggtaatgcattatattcctccctttgaactgaacagaggagacagttcatggggaggaataacctggcggcagcgcaaaagatg

SEQ ID NO: 174070 - DNA, 103 bp, Artificial Sequence
  Synthetic Polynucleotide
taatacgactcactataggggaccatttgggtaatgcattatattcctccaacagaggagaggaggaatgtaatgcattaacctggcggcagcgcaaaagatg

SEQ ID NO: 174071 - DNA, 103 bp, Artificial Sequence
  Synthetic Polynucleotide
taatacgactcactatagggcaaatggcatgaccatttgggtaatgcattaacagaggagaaatgcaatgcccaaatggaacctggcggcagcgcaaaagatg

SEQ ID NO: 174072 - DNA, 103 bp, Artificial Sequence
  Synthetic Polynucleotide
taatacgactcactatagggatccagggaactcgtggtaggagaggacataacagaggagaatgtccatgcctaccacgaacctggcggcagcgcaaaagatg

SEQ ID NO: 174073 - DNA, 103 bp, Artificial Sequence
  Synthetic Polynucleotide
taatacgactcactatagggcccgggccacggctccggaccctcctccttaacagaggagaaaggagatgggtccggagaacctggcggcagcgcaaaagatg

SEQ ID NO: 174074 - DNA, 103 bp, Artificial Sequence
  Synthetic Polynucleotide
taatacgactcactataggggtggaagtcgtccttgctgtaggtgaagtcaacagaggagagacttcatgtacagcaagaacctggcggcagcgcaaaagatg

SEQ ID NO: 174075 - DNA, 103 bp, Artificial Sequence
  Synthetic Polynucleotide
taatacgactcactatagggggcctgcacggtggaagtcgtccttgctgtaacagaggagaacagcaatgacgacttccaacctggcggcagcgcaaaagatg

SEQ ID NO: 174076 - DNA, 103 bp, Artificial Sequence
  Synthetic Polynucleotide
taatacgactcactatagggtccacctgcaggcctgcacggtggaagtcgaacagaggagacgacttatgccgtgcaggaacctggcggcagcgcaaaagatg

SEQ ID NO: 174077 - DNA, 103 bp, Artificial Sequence
  Synthetic Polynucleotide
taatacgactcactataggggttgatgaactccacctgcaggcctgcacgaacagaggagacgtgcaatgctgcaggtgaacctggcggcagcgcaaaagatg

SEQ ID NO: 174078 - DNA, 103 bp, Artificial Sequence
  Synthetic Polynucleotide
taatacgactcactatagggcgaagatggggttgatgaactccacctgcaaacagaggagatgcaggatgagttcatcaaacctggcggcagcgcaaaagatg

SEQ ID NO: 174079 - DNA, 103 bp, Artificial Sequence
  Synthetic Polynucleotide
taatacgactcactatagggcgcgagaactcgaagatggggttgatgaacaacagaggagagttcatatgccccatcttaacctggcggcagcgcaaaagatg

SEQ ID NO: 174080 - DNA, 103 bp, Artificial Sequence
  Synthetic Polynucleotide
taatacgactcactatagggccgcatggcccgcgagaactcgaagatgggaacagaggagacccatcatggagttctcgaacctggcggcagcgcaaaagatg

SEQ ID NO: 174081 - DNA, 103 bp, Artificial Sequence
  Synthetic Polynucleotide
taatacgactcactatagggggcccagccgccgcatggcccgcgagaactaacagaggagaagttctatggggccatgcaacctggcggcagcgcaaaagatg

SEQ ID NO: 174082 - DNA, 103 bp, Artificial Sequence
  Synthetic Polynucleotide
taatacgactcactataggggcgtcgtccaggcccagccgccgcatggccaacagaggagaggccatatggcggctgggaacctggcggcagcgcaaaagatg

SEQ ID NO: 174083 - DNA, 103 bp, Artificial Sequence
  Synthetic Polynucleotide
taatacgactcactatagggggcgtactcagcgtcgtccaggcccagccgaacagaggagacggctgatgctggacgacaacctggcggcagcgcaaaagatg

SEQ ID NO: 174084 - DNA, 103 bp, Artificial Sequence
  Synthetic Polynucleotide
taatacgactcactatagggggtccggacccccgggccacggctccggacaacagaggagagtccggatgcgtggcccgaacctggcggcagcgcaaaagatg

SEQ ID NO: 174085 - DNA, 103 bp, Artificial Sequence
  Synthetic Polynucleotide
taatacgactcactatagggcgatgagcagggcgtactcagcgtcgtccaaacagaggagatggacgatgctgagtacgaacctggcggcagcgcaaaagatg

SEQ ID NO: 174086 - DNA, 103 bp, Artificial Sequence
  Synthetic Polynucleotide
taatacgactcactatagggatgttgatggcgatgagcagggcgtactcaaacagaggagatgagtaatgcctgctcataacctggcggcagcgcaaaagatg

SEQ ID NO: 174087 - DNA, 103 bp, Artificial Sequence
  Synthetic Polynucleotide
taatacgactcactatagggggccgagaagatgttgatggcgatgagcagaacagaggagactgctcatggccatcaacaacctggcggcagcgcaaaagatg

SEQ ID NO: 174088 - DNA, 103 bp, Artificial Sequence
  Synthetic Polynucleotide
taatacgactcactatagggtgggccggtcggccgagaagatgttgatggaacagaggagaccatcaatgtcttctcggaacctggcggcagcgcaaaagatg

SEQ ID NO: 174089 - DNA, 103 bp, Artificial Sequence
  Synthetic Polynucleotide
taatacgactcactatagggtcctgcacgttgggccggtcggccgagaagaacagaggagacttctcatgcgaccggccaacctggcggcagcgcaaaagatg

SEQ ID NO: 174090 - DNA, 103 bp, Artificial Sequence
  Synthetic Polynucleotide
taatacgactcactataggggcggcccggctcctgcacgttgggccggtcaacagaggagagaccggatgaacgtgcagaacctggcggcagcgcaaaagatg

SEQ ID NO: 174091 - DNA, 103 bp, Artificial Sequence
  Synthetic Polynucleotide
taatacgactcactatagggacgcctccacgcggcccggctcctgcacgtaacagaggagaacgtgcatgagccgggccaacctggcggcagcgcaaaagatg

SEQ ID NO: 174092 - DNA, 103 bp, Artificial Sequence
  Synthetic Polynucleotide
taatacgactcactatagggggctgctgcaacgcctccacgcggcccggcaacagaggagagccgggatgcgtggaggcaacctggcggcagcgcaaaagatg

SEQ ID NO: 174093 - DNA, 103 bp, Artificial Sequence
  Synthetic Polynucleotide
taatacgactcactatagggctccacgtagggctgctgcaacgcctccacaacagaggagagtggagatgttgcagcagaacctggcggcagcgcaaaagatg

SEQ ID NO: 174094 - DNA, 103 bp, Artificial Sequence
  Synthetic Polynucleotide
taatacgactcactatagggacagcagcgcctccacgtagggctgctgcaaacagaggagatgcagcatgcctacgtggaacctggcggcagcgcaaaagatg

SEQ ID NO: 174095 - DNA, 103 bp, Artificial Sequence
  Synthetic Polynucleotide
taatacgactcactataggggggacatcagggtccggacccccgggccacaacagaggagagtggccatggggtccggaaacctggcggcagcgcaaaagatg

SEQ ID NO: 174096 - DNA, 103 bp, Artificial Sequence
  Synthetic Polynucleotide
taatacgactcactatagggcgcgtgtaggacagcagcgcctccacgtagaacagaggagactacgtatgggcgctgctaacctggcggcagcgcaaaagatg

SEQ ID NO: 174097 - DNA, 103 bp, Artificial Sequence
  Synthetic Polynucleotide
taatacgactcactatagggcctcttgatgcgcgtgtaggacagcagcgcaacagaggagagcgctgatgtcctacacgaacctggcggcagcgcaaaagatg

SEQ ID NO: 174098 - DNA, 103 bp, Artificial Sequence
  Synthetic Polynucleotide
taatacgactcactatagggggtcctgcggcctcttgatgcgcgtgtaggaacagaggagacctacaatggcatcaagaaacctggcggcagcgcaaaagatg

SEQ ID NO: 174099 - DNA, 103 bp, Artificial Sequence
  Synthetic Polynucleotide
taatacgactcactatagggaagcgcagctggtcctgcggcctcttgatgaacagaggagacatcaaatggccgcaggaaacctggcggcagcgcaaaagatg

SEQ ID NO: 174100 - DNA, 103 bp, Artificial Sequence
  Synthetic Polynucleotide
taatacgactcactatagggcatgcgcgggaagcgcagctggtcctgcggaacagaggagaccgcagatgcagctgcgcaacctggcggcagcgcaaaagatg

SEQ ID NO: 174101 - DNA, 103 bp, Artificial Sequence
  Synthetic Polynucleotide
taatacgactcactataggggcttcatgagcatgcgcgggaagcgcagctaacagaggagaagctgcatgtcccgcgcaaacctggcggcagcgcaaaagatg

SEQ ID NO: 174102 - DNA, 103 bp, Artificial Sequence
  Synthetic Polynucleotide
taatacgactcactatagggaggctcaccagcttcatgagcatgcgcgggaacagaggagacccgcgatggctcatgaaaacctggcggcagcgcaaaagatg

SEQ ID NO: 174103 - DNA, 103 bp, Artificial Sequence
  Synthetic Polynucleotide
taatacgactcactatagggcagcgtgcgcaggctcaccagcttcatgagaacagaggagactcatgatgctggtgagcaacctggcggcagcgcaaaagatg

SEQ ID NO: 174104 - DNA, 103 bp, Artificial Sequence
  Synthetic Polynucleotide
taatacgactcactataggggcacagagctcagcgtgcgcaggctcaccaaacagaggagatggtgaatgtgcgcacgcaacctggcggcagcgcaaaagatg

SEQ ID NO: 174105 - DNA, 103 bp, Artificial Sequence
  Synthetic Polynucleotide
taatacgactcactatagggtgctccgagtgcacagagctcagcgtgcgcaacagaggagagcgcacatggagctctgtaacctggcggcagcgcaaaagatg

SEQ ID NO: 174106 - DNA, 103 bp, Artificial Sequence
  Synthetic Polynucleotide
taatacgactcactatagggatcagtgcctgggacatcagggtccggaccaacagaggagaggtccgatgcctgatgtcaacctggcggcagcgcaaaagatg

SEQ ID NO: 174107 - DNA, 103 bp, Artificial Sequence
  Synthetic Polynucleotide
taatacgactcactatagggggcgaagacctgctccgagtgcacagagctaacagaggagaagctctatgcactcggagaacctggcggcagcgcaaaagatg

SEQ ID NO: 174108 - DNA, 103 bp, Artificial Sequence
  Synthetic Polynucleotide
taatacgactcactatagggggagccgcaaggcgaagacctgctccgagtaacagaggagaactcggatgaggtcttcgaacctggcggcagcgcaaaagatg

SEQ ID NO: 174109 - DNA, 103 bp, Artificial Sequence
  Synthetic Polynucleotide
taatacgactcactatagggttcttgtcctggagccgcaaggcgaagaccaacagaggagaggtcttatgcttgcggctaacctggcggcagcgcaaaagatg

SEQ ID NO: 174110 - DNA, 103 bp, Artificial Sequence
  Synthetic Polynucleotide
taatacgactcactatagggaggcggcagcttcttgtcctggagccgcaaaacagaggagattgcggatgcaggacaagaacctggcggcagcgcaaaagatg

SEQ ID NO: 174111 - DNA, 103 bp, Artificial Sequence
  Synthetic Polynucleotide
taatacgactcactatagggccgacagcagaggcggcagcttcttgtcctaacagaggagaaggacaatgagctgccgcaacctggcggcagcgcaaaagatg

SEQ ID NO: 174112 - DNA, 103 bp, Artificial Sequence
  Synthetic Polynucleotide
taatacgactcactatagggtcccagatctccgacagcagaggcggcagcaacagaggagagctgccatgtctgctgtcaacctggcggcagcgcaaaagatg

SEQ ID NO: 174113 - DNA, 103 bp, Artificial Sequence
  Synthetic Polynucleotide
taatacgactcactatagggctcgtggacgtcccagatctccgacagcagaacagaggagactgctgatggagatctggaacctggcggcagcgcaaaagatg

SEQ ID NO: 174114 - DNA, 103 bp, Artificial Sequence
  Synthetic Polynucleotide
taatacgactcactatagggagctggcctcatcagtgcctgggacatcagaacagaggagactgatgatgcaggcactgaacctggcggcagcgcaaaagatg

SEQ ID NO: 174115 - DNA, 103 bp, Artificial Sequence
  Synthetic Polynucleotide
taatacgactcactatagggctgcaggctgagctggcctcatcagtgcctaacagaggagaaggcacatgtgaggccagaacctggcggcagcgcaaaagatg

SEQ ID NO: 174116 - DNA, 103 bp, Artificial Sequence
  Synthetic Polynucleotide
taatacgactcactatagggccagtctgtgctgcaggctgagctggcctcaacagaggagagaggccatgtcagcctgcaacctggcggcagcgcaaaagatg

SEQ ID NO: 174117 - DNA, 103 bp, Artificial Sequence
  Synthetic Polynucleotide
taatacgactcactatagggctgggatgacccagtctgtgctgcaggctgaacagaggagacagcctatggcacagactaacctggcggcagcgcaaaagatg

SEQ ID NO: 174118 - DNA, 103 bp, Artificial Sequence
  Synthetic Polynucleotide
taatacgactcactatagggtcttcgggatctgggatgacccagtctgtgaacagaggagacacagaatgggtcatcccaacctggcggcagcgcaaaagatg

SEQ ID NO: 174119 - DNA, 103 bp, Artificial Sequence
  Synthetic Polynucleotide
taatacgactcactatagggctctggttcctcttcgggatctgggatgacaacagaggagagtcatcatggatcccgaaaacctggcggcagcgcaaaagatg

SEQ ID NO: 174120 - DNA, 103 bp, Artificial Sequence
  Synthetic Polynucleotide
taatacgactcactataggggcaggggggtatccagggaactcgtggtagaacagaggagactaccaatggttccctggaacctggcggcagcgcaaaagatg

SEQ ID NO: 174121 - DNA, 103 bp, Artificial Sequence
  Synthetic Polynucleotide
taatacgactcactatagggttcgcttgcgctctggttcctcttcgggataacagaggagaatcccgatgaggaaccagaacctggcggcagcgcaaaagatg

SEQ ID NO: 174122 - DNA, 103 bp, Artificial Sequence
  Synthetic Polynucleotide
taatacgactcactataggggggcccttctttcgcttgcgctctggttccaacagaggagaggaaccatggcgcaagcgaacctggcggcagcgcaaaagatg

SEQ ID NO: 174123 - DNA, 103 bp, Artificial Sequence
  Synthetic Polynucleotide
taatacgactcactatagggcttcggggctgggcccttctttcgcttgcgaacagaggagacgcaagatgaagaagggcaacctggcggcagcgcaaaagatg

SEQ ID NO: 174124 - DNA, 103 bp, Artificial Sequence
  Synthetic Polynucleotide
taatacgactcactatagggggcccagcatcttcggggctgggcccttctaacagaggagaagaaggatgcagccccgaaacctggcggcagcgcaaaagatg

SEQ ID NO: 174125 - DNA, 103 bp, Artificial Sequence
  Synthetic Polynucleotide
taatacgactcactatagggcaaagctcgtggcccagcatcttcggggctaacagaggagaagccccatggatgctgggaacctggcggcagcgcaaaagatg

SEQ ID NO: 174126 - DNA, 103 bp, Artificial Sequence
  Synthetic Polynucleotide
taatacgactcactatagggacagacacggcaaagctcgtggcccagcataacagaggagaatgctgatgcacgagcttaacctggcggcagcgcaaaagatg

SEQ ID NO: 174127 - DNA, 103 bp, Artificial Sequence
  Synthetic Polynucleotide
taatacgactcactatagggccttgtccccacagacacggcaaagctcgtaacagaggagaacgagcatggccgtgtctaacctggcggcagcgcaaaagatg

SEQ ID NO: 174128 - DNA, 103 bp, Artificial Sequence
  Synthetic Polynucleotide
taatacgactcactatagggaagccggaggccttgtccccacagacacggaacagaggagaccgtgtatgtggggacaaaacctggcggcagcgcaaaagatg

SEQ ID NO: 174129 - DNA, 103 bp, Artificial Sequence
  Synthetic Polynucleotide
taatacgactcactataggggttgtagtggaagccggaggccttgtccccaacagaggagaggggacatggcctccggcaacctggcggcagcgcaaaagatg

SEQ ID NO: 174130 - DNA, 103 bp, Artificial Sequence
  Synthetic Polynucleotide
taatacgactcactatagggagctgagcacgttgtagtggaagccggaggaacagaggagacctccgatgtccactacaaacctggcggcagcgcaaaagatg

SEQ ID NO: 174131 - DNA, 103 bp, Artificial Sequence
  Synthetic Polynucleotide
taatacgactcactatagggccatttccaggcaggggggtatccagggaaaacagaggagattccctatgtacccccctaacctggcggcagcgcaaaagatg

SEQ ID NO: 174132 - DNA, 103 bp, Artificial Sequence
  Synthetic Polynucleotide
taatacgactcactatagggcagccttcgcagctgagcacgttgtagtggaacagaggagaccactaatgcgtgctcagaacctggcggcagcgcaaaagatg

SEQ ID NO: 174133 - DNA, 103 bp, Artificial Sequence
  Synthetic Polynucleotide
taatacgactcactataggggaagcccttgcagccttcgcagctgagcacaacagaggagagtgctcatgtgcgaaggcaacctggcggcagcgcaaaagatg

SEQ ID NO: 174134 - DNA, 103 bp, Artificial Sequence
  Synthetic Polynucleotide
taatacgactcactatagggtgcgccggaagaagcccttgcagccttcgcaacagaggagagcgaagatggcaagggctaacctggcggcagcgcaaaagatg

SEQ ID NO: 174135 - DNA, 103 bp, Artificial Sequence
  Synthetic Polynucleotide
taatacgactcactatagggcggaccacactgcgccggaagaagcccttgaacagaggagacaagggatgcttccggcgaacctggcggcagcgcaaaagatg

SEQ ID NO: 174136 - DNA, 103 bp, Artificial Sequence
  Synthetic Polynucleotide
taatacgactcactatagggggccccaccacggaccacactgcgccggaaaacagaggagattccggatgagtgtggtcaacctggcggcagcgcaaaagatg

SEQ ID NO: 174137 - DNA, 103 bp, Artificial Sequence
  Synthetic Polynucleotide
taatacgactcactatagggcatagcgcctggccccaccacggaccacacaacagaggagagtgtggatggtggtggggaacctggcggcagcgcaaaagatg

SEQ ID NO: 174138 - DNA, 103 bp, Artificial Sequence
  Synthetic Polynucleotide
taatacgactcactatagggccccggcaggcatagcgcctggccccaccaaacagaggagatggtggatgcaggcgctaaacctggcggcagcgcaaaagatg

SEQ ID NO: 174139 - DNA, 103 bp, Artificial Sequence
  Synthetic Polynucleotide
taatacgactcactatagggggttccgccaccccggcaggcatagcgcctaacagaggagaaggcgcatggcctgccggaacctggcggcagcgcaaaagatg

SEQ ID NO: 174140 - DNA, 103 bp, Artificial Sequence
  Synthetic Polynucleotide
taatacgactcactatagggccatctggcaggttccgccaccccggcaggaacagaggagacctgccatggtggcggaaaacctggcggcagcgcaaaagatg

SEQ ID NO: 174141 - DNA, 103 bp, Artificial Sequence
  Synthetic Polynucleotide
taatacgactcactatagggatgaaagcgtccatctggcaggttccgccaaacagaggagatggcggatgctgccagataacctggcggcagcgcaaaagatg

SEQ ID NO: 174142 - DNA, 103 bp, Artificial Sequence
  Synthetic Polynucleotide
taatacgactcactatagggctgaggggggccatttccaggcaggggggtaacagaggagaacccccatgcctggaaataacctggcggcagcgcaaaagatg

SEQ ID NO: 174143 - DNA, 103 bp, Artificial Sequence
  Synthetic Polynucleotide
taatacgactcactatagggcttgcgccgcatgaaagcgtccatctggcaaacagaggagatgccagatggacgctttcaacctggcggcagcgcaaaagatg

SEQ ID NO: 174144 - DNA, 103 bp, Artificial Sequence
  Synthetic Polynucleotide
taatacgactcactatagggactgctggcacttgcgccgcatgaaagcgtaacagaggagaacgcttatgtgcggcgcaaacctggcggcagcgcaaaagatg

SEQ ID NO: 174145 - DNA, 103 bp, Artificial Sequence
  Synthetic Polynucleotide
taatacgactcactatagggcgcagccggcactgctggcacttgcgccgcaacagaggagagcggcgatggtgccagcaaacctggcggcagcgcaaaagatg

SEQ ID NO: 174146 - DNA, 103 bp, Artificial Sequence
  Synthetic Polynucleotide
taatacgactcactatagggcttgcacttgcgcagccggcactgctggcaaacagaggagatgccagatgtgccggctgaacctggcggcagcgcaaaagatg

SEQ ID NO: 174147 - DNA, 103 bp, Artificial Sequence
  Synthetic Polynucleotide
taatacgactcactatagggtccctgcctccttgcacttgcgcagccggcaacagaggagagccggcatggcaagtgcaaacctggcggcagcgcaaaagatg

SEQ ID NO: 174148 - DNA, 103 bp, Artificial Sequence
  Synthetic Polynucleotide
taatacgactcactatagggtgctccctcatccctgcctccttgcacttgaacagaggagacaagtgatgggaggcaggaacctggcggcagcgcaaaagatg

SEQ ID NO: 174149 - DNA, 103 bp, Artificial Sequence
  Synthetic Polynucleotide
taatacgactcactatagggaaggacgcactgctccctcatccctgcctcaacagaggagagaggcaatgatgagggagaacctggcggcagcgcaaaagatg

SEQ ID NO: 174150 - DNA, 103 bp, Artificial Sequence
  Synthetic Polynucleotide
taatacgactcactataggggttcttcagaaaggacgcactgctccctcaaacagaggagatgagggatgagtgcgtccaacctggcggcagcgcaaaagatg

SEQ ID NO: 174151 - DNA, 103 bp, Artificial Sequence
  Synthetic Polynucleotide
taatacgactcactatagggttccggatctgttcttcagaaaggacgcacaacagaggagagtgcgtatgttctgaagaaacctggcggcagcgcaaaagatg

SEQ ID NO: 174152 - DNA, 103 bp, Artificial Sequence
  Synthetic Polynucleotide
taatacgactcactatagggaatcttcttcttccggatctgttcttcagaaacagaggagatctgaaatgcagatccggaacctggcggcagcgcaaaagatg

SEQ ID NO: 174153 - DNA, 103 bp, Artificial Sequence
  Synthetic Polynucleotide
taatacgactcactataggggggcgccaggctgaggggggccatttccagaacagaggagactggaaatggcccccctcaacctggcggcagcgcaaaagatg

SEQ ID NO: 174154 - DNA, 103 bp, Artificial Sequence
  Synthetic Polynucleotide
taatacgactcactataggggctgtttccgaatcttcttcttccggatctaacagaggagaagatccatgagaagaagaaacctggcggcagcgcaaaagatg

SEQ ID NO: 174155 - DNA, 103 bp, Artificial Sequence
  Synthetic Polynucleotide
taatacgactcactataggggactcctgctgctgtttccgaatcttcttcaacagaggagagaagaaatgtcggaaacaaacctggcggcagcgcaaaagatg

SEQ ID NO: 174156 - DNA, 103 bp, Artificial Sequence
  Synthetic Polynucleotide
taatacgactcactatagggctgtgactgtgactcctgctgctgtttccgaacagaggagacggaaaatgcagcaggagaacctggcggcagcgcaaaagatg

SEQ ID NO: 174157 - DNA, 103 bp, Artificial Sequence
  Synthetic Polynucleotide
taatacgactcactataggggtgactgcgactgtgactgtgactcctgctaacagaggagaagcaggatgcacagtcacaacctggcggcagcgcaaaagatg

SEQ ID NO: 174158 - DNA, 103 bp, Artificial Sequence
  Synthetic Polynucleotide
taatacgactcactatagggggccccacaggtgactgcgactgtgactgtaacagaggagaacagtcatggtcgcagtcaacctggcggcagcgcaaaagatg

SEQ ID NO: 174159 - DNA, 103 bp, Artificial Sequence
  Synthetic Polynucleotide
taatacgactcactataggggctgccctgcggccccacaggtgactgcgaaacagaggagatcgcagatgcctgtggggaacctggcggcagcgcaaaagatg

SEQ ID NO: 174160 - DNA, 103 bp, Artificial Sequence
  Synthetic Polynucleotide
taatacgactcactatagggctgagctgctgctgccctgcggccccacagaacagaggagactgtggatgcgcagggcaaacctggcggcagcgcaaaagatg

SEQ ID NO: 174161 - DNA, 103 bp, Artificial Sequence
  Synthetic Polynucleotide
taatacgactcactatagggggcccagaggctgagctgctgctgccctgcaacagaggagagcagggatgcagcagctcaacctggcggcagcgcaaaagatg

SEQ ID NO: 174162 - DNA, 103 bp, Artificial Sequence
  Synthetic Polynucleotide
taatacgactcactatagggggaagccccaggcccagaggctgagctgctaacagaggagaagcagcatggcctctgggaacctggcggcagcgcaaaagatg

SEQ ID NO: 174163 - DNA, 103 bp, Artificial Sequence
  Synthetic Polynucleotide
taatacgactcactatagggatccaccaggggaagccccaggcccagaggaacagaggagacctctgatgctggggcttaacctggcggcagcgcaaaagatg

SEQ ID NO: 174164 - DNA, 103 bp, Artificial Sequence
  Synthetic Polynucleotide
taatacgactcactataggggaagaagaaggggcgccaggctgaggggggaacagaggagaccccccatggcctggcgcaacctggcggcagcgcaaaagatg

SEQ ID NO: 174165 - DNA, 103 bp, Artificial Sequence
  Synthetic Polynucleotide
taatacgactcactatagggcctgcctcagatccaccaggggaagccccaaacagaggagatggggcatgccctggtggaacctggcggcagcgcaaaagatg

SEQ ID NO: 174166 - DNA, 103 bp, Artificial Sequence
  Synthetic Polynucleotide
taatacgactcactataggggccctggctgcctgcctcagatccaccaggaacagaggagacctggtatgtctgaggcaaacctggcggcagcgcaaaagatg

SEQ ID NO: 174167 - DNA, 103 bp, Artificial Sequence
  Synthetic Polynucleotide
taatacgactcactatagggcttccccggagccctggctgcctgcctcagaacagaggagactgaggatggcagccaggaacctggcggcagcgcaaaagatg

SEQ ID NO: 174168 - DNA, 103 bp, Artificial Sequence
  Synthetic Polynucleotide
taatacgactcactatagggacaccctcgccttccccggagccctggctgaacagaggagacagccaatgctccggggaaacctggcggcagcgcaaaagatg

SEQ ID NO: 174169 - DNA, 103 bp, Artificial Sequence
  Synthetic Polynucleotide
taatacgactcactatagggtgttagctggacaccctcgccttccccggaaacagaggagatccgggatgggcgagggtaacctggcggcagcgcaaaagatg

SEQ ID NO: 174170 - DNA, 103 bp, Artificial Sequence
  Synthetic Polynucleotide
taatacgactcactatagggcttgagccgctgttagctggacaccctcgcaacagaggagagcgaggatgtccagctaaaacctggcggcagcgcaaaagatg

SEQ ID NO: 174171 - DNA, 103 bp, Artificial Sequence
  Synthetic Polynucleotide
taatacgactcactatagggatcattagttcttgagccgctgttagctggaacagaggagaccagctatgagcggctcaaacctggcggcagcgcaaaagatg

SEQ ID NO: 174172 - DNA, 103 bp, Artificial Sequence
  Synthetic Polynucleotide
taatacgactcactatagggcaactgctggatcattagttcttgagccgcaacagaggagagcggctatggaactaatgaacctggcggcagcgcaaaagatg

SEQ ID NO: 174173 - DNA, 103 bp, Artificial Sequence
  Synthetic Polynucleotide
taatacgactcactataggggggccgccaccaactgctggatcattagttaacagaggagaaactaaatgtccagcagtaacctggcggcagcgcaaaagatg

SEQ ID NO: 174174 - DNA, 103 bp, Artificial Sequence
  Synthetic Polynucleotide
taatacgactcactatagggcactgcagttgggccgccaccaactgctggaacagaggagaccagcaatgggtggcggcaacctggcggcagcgcaaaagatg

SEQ ID NO: 174175 - DNA, 103 bp, Artificial Sequence
  Synthetic Polynucleotide
taatacgactcactatagggtacagtgggtgaagaagaaggggcgccaggaacagaggagacctggcatgccttcttctaacctggcggcagcgcaaaagatg

SEQ ID NO: 174176 - DNA, 103 bp, Artificial Sequence
  Synthetic Polynucleotide
taatacgactcactataggggcgtttgttgcactgcagttgggccgccacaacagaggagagtggcgatgcaactgcagaacctggcggcagcgcaaaagatg

SEQ ID NO: 174177 - DNA, 103 bp, Artificial Sequence
  Synthetic Polynucleotide
taatacgactcactatagggcggagaaggagcgtttgttgcactgcagttaacagaggagaaactgcatggcaacaaacaacctggcggcagcgcaaaagatg

SEQ ID NO: 174178 - DNA, 103 bp, Artificial Sequence
  Synthetic Polynucleotide
taatacgactcactatagggttgggctggtcggagaaggagcgtttgttgaacagaggagacaacaaatgctccttctcaacctggcggcagcgcaaaagatg

SEQ ID NO: 174179 - DNA, 103 bp, Artificial Sequence
  Synthetic Polynucleotide
taatacgactcactataggggggcgtgactttgggctggtcggagaaggaaacagaggagatccttcatggaccagcccaacctggcggcagcgcaaaagatg

SEQ ID NO: 174180 - DNA, 103 bp, Artificial Sequence
  Synthetic Polynucleotide
taatacgactcactatagggccaggggccagggcgtgactttgggctggtaacagaggagaaccagcatgaagtcacgcaacctggcggcagcgcaaaagatg

SEQ ID NO: 174181 - DNA, 103 bp, Artificial Sequence
  Synthetic Polynucleotide
taatacgactcactataggggggtctgcgcccaggggccagggcgtgactaacagaggagaagtcacatgctggcccctaacctggcggcagcgcaaaagatg

SEQ ID NO: 174182 - DNA, 103 bp, Artificial Sequence
  Synthetic Polynucleotide
taatacgactcactatagggtcgggactgggggtctgcgcccaggggccaaacagaggagatggcccatgggcgcagacaacctggcggcagcgcaaaagatg

SEQ ID NO: 174183 - DNA, 103 bp, Artificial Sequence
  Synthetic Polynucleotide
taatacgactcactatagggggcgggcatctcgggactgggggtctgcgcaacagaggagagcgcagatgcccagtcccaacctggcggcagcgcaaaagatg

SEQ ID NO: 174184 - DNA, 103 bp, Artificial Sequence
  Synthetic Polynucleotide
taatacgactcactatagggaagcgttgctggcgggcatctcgggactggaacagaggagaccagtcatgagatgcccgaacctggcggcagcgcaaaagatg

SEQ ID NO: 174185 - DNA, 103 bp, Artificial Sequence
  Synthetic Polynucleotide
taatacgactcactataggggaagtgggcaaagcgttgctggcgggcatcaacagaggagagatgccatgcagcaacgcaacctggcggcagcgcaaaagatg

SEQ ID NO: 174186 - DNA, 103 bp, Artificial Sequence
  Synthetic Polynucleotide
taatacgactcactatagggcctcctcctttacagtgggtgaagaagaagaacagaggagacttcttatgcacccactgaacctggcggcagcgcaaaagatg

SEQ ID NO: 174187 - DNA, 103 bp, Artificial Sequence
  Synthetic Polynucleotide
taatacgactcactatagggccagctccgtgaagtgggcaaagcgttgctaacagaggagaagcaacatgttgcccactaacctggcggcagcgcaaaagatg

SEQ ID NO: 174188 - DNA, 103 bp, Artificial Sequence
  Synthetic Polynucleotide
taatacgactcactataggggagatgatggccagctccgtgaagtgggcaaacagaggagatgcccaatgcacggagctaacctggcggcagcgcaaaagatg

SEQ ID NO: 174189 - DNA, 103 bp, Artificial Sequence
  Synthetic Polynucleotide
taatacgactcactatagggctcctggactgagatgatggccagctccgtaacagaggagaacggagatggccatcatcaacctggcggcagcgcaaaagatg

SEQ ID NO: 174190 - DNA, 103 bp, Artificial Sequence
  Synthetic Polynucleotide
taatacgactcactatagggagtccacgatctcctggactgagatgatggaacagaggagaccatcaatgcagtccaggaacctggcggcagcgcaaaagatg

SEQ ID NO: 174191 - DNA, 103 bp, Artificial Sequence
  Synthetic Polynucleotide
taatacgactcactatagggtgcttagcgaagtccacgatctcctggactaacagaggagaagtccaatggatcgtggaaacctggcggcagcgcaaaagatg

SEQ ID NO: 174192 - DNA, 103 bp, Artificial Sequence
  Synthetic Polynucleotide
taatacgactcactatagggaccaggcacttgcttagcgaagtccacgataacagaggagaatcgtgatgttcgctaagaacctggcggcagcgcaaaagatg

SEQ ID NO: 174193 - DNA, 103 bp, Artificial Sequence
  Synthetic Polynucleotide
taatacgactcactataggggctgcaggaaaccaggcacttgcttagcgaaacagaggagatcgctaatgaagtgcctgaacctggcggcagcgcaaaagatg

SEQ ID NO: 174194 - DNA, 103 bp, Artificial Sequence
  Synthetic Polynucleotide
taatacgactcactatagggtcccggcccagctgcaggaaaccaggcactaacagaggagaagtgccatgtttcctgcaaacctggcggcagcgcaaaagatg

SEQ ID NO: 174195 - DNA, 103 bp, Artificial Sequence
  Synthetic Polynucleotide
taatacgactcactataggggatctggtcctcccggcccagctgcaggaaaacagaggagattcctgatgctgggccggaacctggcggcagcgcaaaagatg

SEQ ID NO: 174196 - DNA, 103 bp, Artificial Sequence
  Synthetic Polynucleotide
taatacgactcactatagggtcaggagggcgatctggtcctcccggcccaaacagaggagatgggccatgaggaccagaaacctggcggcagcgcaaaagatg

SEQ ID NO: 174197 - DNA, 103 bp, Artificial Sequence
  Synthetic Polynucleotide
taatacgactcactatagggggctccggaccctcctcctttacagtgggtaacagaggagaacccacatgaaaggaggaaacctggcggcagcgcaaaagatg

SEQ ID NO: 174198 - DNA, 103 bp, Artificial Sequence
  Synthetic Polynucleotide
taatacgactcactataggggtggatgccttcaggagggcgatctggtccaacagaggagaggaccaatgcgccctcctaacctggcggcagcgcaaaagatg

SEQ ID NO: 174199 - DNA, 103 bp, Artificial Sequence
  Synthetic Polynucleotide
taatacgactcactataggggatctcgatagtggatgccttcaggagggcaacagaggagagccctcatgaaggcatccaacctggcggcagcgcaaaagatg

SEQ ID NO: 174200 - DNA, 103 bp, Artificial Sequence
  Synthetic Polynucleotide
taatacgactcactatagggctagcagcatgatctcgatagtggatgcctaacagaggagaaggcatatgctatcgagaaacctggcggcagcgcaaaagatg

SEQ ID NO: 174201 - DNA, 103 bp, Artificial Sequence
  Synthetic Polynucleotide
taatacgactcactatagggctggctgtctctagcagcatgatctcgataaacagaggagatatcgaatgcatgctgctaacctggcggcagcgcaaaagatg

SEQ ID NO: 174202 - DNA, 103 bp, Artificial Sequence
  Synthetic Polynucleotide
taatacgactcactataggggttgtagcgcctggctgtctctagcagcataacagaggagaatgctgatggagacagccaacctggcggcagcgcaaaagatg

SEQ ID NO: 174203 - DNA, 103 bp, Artificial Sequence
  Synthetic Polynucleotide
taatacgactcactatagggctgtctcgtggttgtagcgcctggctgtctaacagaggagaagacagatgggcgctacaaacctggcggcagcgcaaaagatg

SEQ ID NO: 174204 - DNA, 103 bp, Artificial Sequence
  Synthetic Polynucleotide
taatacgactcactataggggtgatacactctgtctcgtggttgtagcgcaacagaggagagcgctaatgccacgagacaacctggcggcagcgcaaaagatg

SEQ ID NO: 174205 - DNA, 103 bp, Artificial Sequence
  Synthetic Polynucleotide
taatacgactcactatagggcttcaagaaggtgatacactctgtctcgtgaacagaggagacacgagatggagtgtatcaacctggcggcagcgcaaaagatg

SEQ ID NO: 174206 - DNA, 103 bp, Artificial Sequence
  Synthetic Polynucleotide
taatacgactcactatagggaggtgaagtccttcaagaaggtgatacactaacagaggagaagtgtaatgccttcttgaaacctggcggcagcgcaaaagatg

SEQ ID NO: 174207 - DNA, 103 bp, Artificial Sequence
  Synthetic Polynucleotide
taatacgactcactatagggtccttgctgtaggtgaagtccttcaagaagaacagaggagacttcttatgggacttcacaacctggcggcagcgcaaaagatg

SEQ ID NO: 174208 - DNA, 103 bp, Artificial Sequence
  Synthetic Polynucleotide
taatacgactcactatagggaggcacaggggcccccagccacaaggacataacagaggagaatgtccatgtggctggggaacctggcggcagcgcaaaagatg

SEQ ID NO: 174209 - DNA, 103 bp, Artificial Sequence
  Synthetic Polynucleotide
taatacgactcactataggggaggatgcagctgctgcctccctgggcctgaacagaggagacaggccatgggaggcagcaacctggcggcagcgcaaaagatg

SEQ ID NO: 174210 - DNA, 103 bp, Artificial Sequence
  Synthetic Polynucleotide
taatacgactcactataggggtcatggggatggtggatggagacgtaggcaacagaggagagcctacatgtccatccacaacctggcggcagcgcaaaagatg

SEQ ID NO: 174211 - DNA, 103 bp, Artificial Sequence
  Synthetic Polynucleotide
taatacgactcactatagggacatcagtcggtcatggggatggtggatggaacagaggagaccatccatgatccccatgaacctggcggcagcgcaaaagatg

SEQ ID NO: 174212 - DNA, 103 bp, Artificial Sequence
  Synthetic Polynucleotide
taatacgactcactatagggatccgtgggaacatcagtcggtcatggggaaacagaggagatccccaatgccgactgataacctggcggcagcgcaaaagatg

SEQ ID NO: 174213 - DNA, 103 bp, Artificial Sequence
  Synthetic Polynucleotide
taatacgactcactatagggtttcattagcatccgtgggaacatcagtcgaacagaggagacgactgatgttcccacggaacctggcggcagcgcaaaagatg

SEQ ID NO: 174214 - DNA, 103 bp, Artificial Sequence
  Synthetic Polynucleotide
taatacgactcactatagggggctcaccagtttcattagcatccgtgggaaacagaggagatcccacatgtgctaatgaaacctggcggcagcgcaaaagatg

SEQ ID NO: 174215 - DNA, 103 bp, Artificial Sequence
  Synthetic Polynucleotide
taatacgactcactatagggagggtccggaggctcaccagtttcattagcaacagaggagagctaatatgactggtgagaacctggcggcagcgcaaaagatg

SEQ ID NO: 174216 - DNA, 103 bp, Artificial Sequence
  Synthetic Polynucleotide
taatacgactcactataggggacgctgctcagggtccggaggctcaccagaacagaggagactggtgatgctccggaccaacctggcggcagcgcaaaagatg

SEQ ID NO: 174217 - DNA, 103 bp, Artificial Sequence
  Synthetic Polynucleotide
taatacgactcactataggggctctgagtggacgctgctcagggtccggaaacagaggagatccggaatgtgagcagcgaacctggcggcagcgcaaaagatg

SEQ ID NO: 174218 - DNA, 103 bp, Artificial Sequence
  Synthetic Polynucleotide
taatacgactcactataggggcaaacacttgctctgagtggacgctgctcaacagaggagagagcagatgccactcagaaacctggcggcagcgcaaaagatg

SEQ ID NO: 174219 - DNA, 103 bp, Artificial Sequence
  Synthetic Polynucleotide
taatacgactcactatagggcagacgcagtgcaaacacttgctctgagtgaacagaggagacactcaatgcaagtgtttaacctggcggcagcgcaaaagatg

SEQ ID NO: 174220 - DNA, 103 bp, Artificial Sequence
  Synthetic Polynucleotide
taatacgactcactatagggcttcctctctgaggatgcagctgctgcctcaacagaggagagaggcaatggctgcatccaacctggcggcagcgcaaaagatg

SEQ ID NO: 174221 - DNA, 103 bp, Artificial Sequence
  Synthetic Polynucleotide
taatacgactcactatagggttttgtcctgcagacgcagtgcaaacacttaacagaggagaaagtgtatgcactgcgtcaacctggcggcagcgcaaaagatg

SEQ ID NO: 174222 - DNA, 103 bp, Artificial Sequence
  Synthetic Polynucleotide
taatacgactcactatagggggtgggagctttttgtcctgcagacgcagtaacagaggagaactgcgatggcaggacaaaacctggcggcagcgcaaaagatg

SEQ ID NO: 174223 - DNA, 103 bp, Artificial Sequence
  Synthetic Polynucleotide
taatacgactcactatagggagagagcagcggtgggagctttttgtcctgaacagaggagacaggacatgaagctcccaaacctggcggcagcgcaaaagatg

SEQ ID NO: 174224 - DNA, 103 bp, Artificial Sequence
  Synthetic Polynucleotide
taatacgactcactatagggcccagatctcagagagcagcggtgggagctaacagaggagaagctccatgcgctgctctaacctggcggcagcgcaaaagatg

SEQ ID NO: 174225 - DNA, 103 bp, Artificial Sequence
  Synthetic Polynucleotide
taatacgactcactatagggtcgtgcacatcccagatctcagagagcagcaacagaggagagctgctatgtgagatctgaacctggcggcagcgcaaaagatg

SEQ ID NO: 174226 - DNA, 103 bp, Artificial Sequence
  Synthetic Polynucleotide
taatacgactcactatagggggcatcctggcttcctctctgaggatgcagaacagaggagactgcatatgcagagaggaaacctggcggcagcgcaaaagatg

SEQ ID NO: 174227 - DNA, 103 bp, Artificial Sequence
  Synthetic Polynucleotide
taatacgactcactatagggagcagagtggggcatcctggcttcctctctaacagaggagaagagagatggccaggatgaacctggcggcagcgcaaaagatg

SEQ ID NO: 174228 - DNA, 103 bp, Artificial Sequence
  Synthetic Polynucleotide
taatacgactcactatagggcagtacccccagcagagtggggcatcctggaacagaggagaccaggaatgcccactctgaacctggcggcagcgcaaaagatg

SEQ ID NO: 174229 - DNA, 103 bp, Artificial Sequence
  Synthetic Polynucleotide
taatacgactcactatagggcccacccctgcagtacccccagcagagtggaacagaggagaccactcatgtgggggtacaacctggcggcagcgcaaaagatg

SEQ ID NO: 174230 - DNA, 103 bp, Artificial Sequence
  Synthetic Polynucleotide
taatacgactcactatagggagcctccagccccacccctgcagtacccccaacagaggagagggggtatggcaggggtgaacctggcggcagcgcaaaagatg

SEQ ID NO: 174231 - DNA, 103 bp, Artificial Sequence
  Synthetic Polynucleotide
taatacgactcactatagggtgggctctgcagcctccagccccacccctgaacagaggagacaggggatgggctggaggaacctggcggcagcgcaaaagatg

SEQ ID NO: 174232 - DNA, 103 bp, Artificial Sequence
  Synthetic Polynucleotide
taatacgactcactatagggagcagggctgtgggctctgcagcctccagcaacagaggagagctggaatgtgcagagccaacctggcggcagcgcaaaagatg

SEQ ID NO: 174233 - DNA, 103 bp, Artificial Sequence
  Synthetic Polynucleotide
taatacgactcactatagggtgccctggtgagcagggctgtgggctctgcaacagaggagagcagagatgacagccctgaacctggcggcagcgcaaaagatg

SEQ ID NO: 174234 - DNA, 103 bp, Artificial Sequence
  Synthetic Polynucleotide
taatacgactcactataggggaggaatgtcaggcacaggggcccccagccaacagaggagaggctggatgcccctgtgcaacctggcggcagcgcaaaagatg

SEQ ID NO: 174235 - DNA, 103 bp, Artificial Sequence
  Synthetic Polynucleotide
taatacgactcactatagggaagggggctctgccctggtgagcagggctgaacagaggagacagcccatgtcaccagggaacctggcggcagcgcaaaagatg

SEQ ID NO: 174236 - DNA, 103 bp, Artificial Sequence
  Synthetic Polynucleotide
taatacgactcactataggggtgggttctgaagggggctctgccctggtgaacagaggagacaccagatgagagcccccaacctggcggcagcgcaaaagatg

SEQ ID NO: 174237 - DNA, 103 bp, Artificial Sequence
  Synthetic Polynucleotide
taatacgactcactatagggacggatctctgtgggttctgaagggggctcaacagaggagagagcccatgtcagaacccaacctggcggcagcgcaaaagatg

SEQ ID NO: 174238 - DNA, 103 bp, Artificial Sequence
  Synthetic Polynucleotide
taatacgactcactataggggcttttgtggacggatctctgtgggttctgaacagaggagacagaacatgcagagatccaacctggcggcagcgcaaaagatg

SEQ ID NO: 174239 - DNA, 103 bp, Artificial Sequence
  Synthetic Polynucleotide
taatacgactcactatagggccctttttccgcttttgtggacggatctctaacagaggagaagagatatgtccacaaaaaacctggcggcagcgcaaaagatg

SEQ ID NO: 174240 - DNA, 103 bp, Artificial Sequence
  Synthetic Polynucleotide
taatacgactcactataggggggggctggcccctttttccgcttttgtggaacagaggagaccacaaatgcggaaaaagaacctggcggcagcgcaaaagatg

SEQ ID NO: 174241 - DNA, 103 bp, Artificial Sequence
  Synthetic Polynucleotide
taatacgactcactatagggccagcattttgggggctggcccctttttccaacagaggagaggaaaaatgggccagcccaacctggcggcagcgcaaaagatg

SEQ ID NO: 174242 - DNA, 103 bp, Artificial Sequence
  Synthetic Polynucleotide
taatacgactcactatagggagctcgttccccagcattttgggggctggcaacagaggagagccagcatgcaaaatgctaacctggcggcagcgcaaaagatg

SEQ ID NO: 174243 - DNA, 103 bp, Artificial Sequence
  Synthetic Polynucleotide
taatacgactcactatagggcacgctgcatagctcgttccccagcattttaacagaggagaaaaatgatggggaacgagaacctggcggcagcgcaaaagatg

SEQ ID NO: 174244 - DNA, 103 bp, Artificial Sequence
  Synthetic Polynucleotide
taatacgactcactatagggtgtccccacacacgctgcatagctcgttccaacagaggagaggaacgatgtatgcagcgaacctggcggcagcgcaaaagatg

SEQ ID NO: 174245 - DNA, 103 bp, Artificial Sequence
  Synthetic Polynucleotide
taatacgactcactataggggcagagtcaggaggaatgtcaggcacagggaacagaggagaccctgtatgtgacattccaacctggcggcagcgcaaaagatg

SEQ ID NO: 174246 - DNA, 103 bp, Artificial Sequence
  Synthetic Polynucleotide
taatacgactcactatagggcccgaggccttgtccccacacacgctgcataacagaggagaatgcagatggtgtggggaaacctggcggcagcgcaaaagatg

SEQ ID NO: 174247 - DNA, 103 bp, Artificial Sequence
  Synthetic Polynucleotide
taatacgactcactataggggtagtggaagcccgaggccttgtccccacaaacagaggagatgtgggatgaaggcctcgaacctggcggcagcgcaaaagatg

SEQ ID NO: 174248 - DNA, 103 bp, Artificial Sequence
  Synthetic Polynucleotide
taatacgactcactatagggtcagaacattgtagtggaagcccgaggcctaacagaggagaaggcctatggcttccactaacctggcggcagcgcaaaagatg

SEQ ID NO: 174249 - DNA, 103 bp, Artificial Sequence
  Synthetic Polynucleotide
taatacgactcactatagggccctcgcagctcagaacattgtagtggaagaacagaggagacttccaatgcaatgttctaacctggcggcagcgcaaaagatg

SEQ ID NO: 174250 - DNA, 103 bp, Artificial Sequence
  Synthetic Polynucleotide
taatacgactcactatagggtcccttgcagccctcgcagctcagaacattaacagaggagaaatgttatgagctgcgagaacctggcggcagcgcaaaagatg

SEQ ID NO: 174251 - DNA, 103 bp, Artificial Sequence
  Synthetic Polynucleotide
taatacgactcactatagggggcggaagaatcccttgcagccctcgcagcaacagaggagagctgcgatggctgcaaggaacctggcggcagcgcaaaagatg

SEQ ID NO: 174252 - DNA, 103 bp, Artificial Sequence
  Synthetic Polynucleotide
taatacgactcactatagggatgacgctgcggcggaagaatcccttgcagaacagaggagactgcaaatgattcttccgaacctggcggcagcgcaaaagatg

SEQ ID NO: 174253 - DNA, 103 bp, Artificial Sequence
  Synthetic Polynucleotide
taatacgactcactatagggcgctcccttgatgacgctgcggcggaagaaaacagaggagattcttcatgcgcagcgtcaacctggcggcagcgcaaaagatg

SEQ ID NO: 174254 - DNA, 103 bp, Artificial Sequence
  Synthetic Polynucleotide
taatacgactcactatagggagatgtagtgcgctcccttgatgacgctgcaacagaggagagcagcgatgtcaagggagaacctggcggcagcgcaaaagatg

SEQ ID NO: 174255 - DNA, 103 bp, Artificial Sequence
  Synthetic Polynucleotide
taatacgactcactatagggccactgtggcagatgtagtgcgctcccttgaacagaggagacaagggatggcactacataacctggcggcagcgcaaaagatg

SEQ ID NO: 174256 - DNA, 103 bp, Artificial Sequence
  Synthetic Polynucleotide
taatacgactcactatagggcagctccaccgcagagtcaggaggaatgtcaacagaggagagacattatgcctgactctaacctggcggcagcgcaaaagatg

SEQ ID NO: 174257 - DNA, 103 bp, Artificial Sequence
  Synthetic Polynucleotide
taatacgactcactataggggcagtggccgccactgtggcagatgtagtgaacagaggagacactacatgtgccacagtaacctggcggcagcgcaaaagatg

SEQ ID NO: 174258 - DNA, 103 bp, Artificial Sequence
  Synthetic Polynucleotide
taatacgactcactatagggtgtccatggggcagtggccgccactgtggcaacagaggagagccacaatggcggccactaacctggcggcagcgcaaaagatg

SEQ ID NO: 174259 - DNA, 103 bp, Artificial Sequence
  Synthetic Polynucleotide
taatacgactcactatagggcgcatgtaggtgtccatggggcagtggccgaacagaggagacggccaatgccccatggaaacctggcggcagcgcaaaagatg

SEQ ID NO: 174260 - DNA, 103 bp, Artificial Sequence
  Synthetic Polynucleotide
taatacgactcactataggggcacttgcgacgcatgtaggtgtccatgggaacagaggagacccatgatgacctacatgaacctggcggcagcgcaaaagatg

SEQ ID NO: 174261 - DNA, 103 bp, Artificial Sequence
  Synthetic Polynucleotide
taatacgactcactataggggacactcctggcacttgcgacgcatgtaggaacagaggagacctacaatggtcgcaagtaacctggcggcagcgcaaaagatg

SEQ ID NO: 174262 - DNA, 103 bp, Artificial Sequence
  Synthetic Polynucleotide
taatacgactcactatagggttgcgaagccgacactcctggcacttgcgaaacagaggagatcgcaaatgccaggagtgaacctggcggcagcgcaaaagatg

SEQ ID NO: 174263 - DNA, 103 bp, Artificial Sequence
  Synthetic Polynucleotide
taatacgactcactatagggctgacggcatttgcgaagccgacactcctgaacagaggagacaggagatgcggcttcgcaacctggcggcagcgcaaaagatg

SEQ ID NO: 174264 - DNA, 103 bp, Artificial Sequence
  Synthetic Polynucleotide
taatacgactcactataggggcatgccagcctgacggcatttgcgaagccaacagaggagaggcttcatgaatgccgtcaacctggcggcagcgcaaaagatg

SEQ ID NO: 174265 - DNA, 103 bp, Artificial Sequence
  Synthetic Polynucleotide
taatacgactcactatagggcactcctcccgcatgccagcctgacggcataacagaggagaatgccgatgggctggcataacctggcggcagcgcaaaagatg

SEQ ID NO: 174266 - DNA, 103 bp, Artificial Sequence
  Synthetic Polynucleotide
taatacgactcactatagggtgacaggacacactcctcccgcatgccagcaacagaggagagctggcatgcgggaggagaacctggcggcagcgcaaaagatg

SEQ ID NO: 174267 - DNA, 103 bp, Artificial Sequence
  Synthetic Polynucleotide
taatacgactcactatagggctggcttccacagctccaccgcagagtcagaacagaggagactgactatgcggtggagcaacctggcggcagcgcaaaagatg

SEQ ID NO: 174268 - DNA, 103 bp, Artificial Sequence
  Synthetic Polynucleotide
taatacgactcactatagggtctgttcttctgacaggacacactcctcccaacagaggagagggaggatggtgtcctgtaacctggcggcagcgcaaaagatg

SEQ ID NO: 174269 - DNA, 103 bp, Artificial Sequence
  Synthetic Polynucleotide
taatacgactcactatagggttcaggcggatctgttcttctgacaggacaaacagaggagatgtcctatgagaagaacaaacctggcggcagcgcaaaagatg

SEQ ID NO: 174270 - DNA, 103 bp, Artificial Sequence
  Synthetic Polynucleotide
taatacgactcactatagggcttcagtttcttcaggcggatctgttcttcaacagaggagagaagaaatgatccgcctgaacctggcggcagcgcaaaagatg

SEQ ID NO: 174271 - DNA, 103 bp, Artificial Sequence
  Synthetic Polynucleotide
taatacgactcactatagggcctcttgccgcttcagtttcttcaggcggaaacagaggagatccgccatgagaaactgaaacctggcggcagcgcaaaagatg

SEQ ID NO: 174272 - DNA, 103 bp, Artificial Sequence
  Synthetic Polynucleotide
taatacgactcactataggggcctgttcctcctcttgccgcttcagtttcaacagaggagagaaactatggcggcaagaaacctggcggcagcgcaaaagatg

SEQ ID NO: 174273 - DNA, 103 bp, Artificial Sequence
  Synthetic Polynucleotide
taatacgactcactatagggtgtggcatgagcctgttcctcctcttgccgaacagaggagacggcaaatggaggaacagaacctggcggcagcgcaaaagatg

SEQ ID NO: 174274 - DNA, 103 bp, Artificial Sequence
  Synthetic Polynucleotide
taatacgactcactatagggggggcaaggatgtggcatgagcctgttcctaacagaggagaaggaacatgctcatgccaaacctggcggcagcgcaaaagatg

SEQ ID NO: 174275 - DNA, 103 bp, Artificial Sequence
  Synthetic Polynucleotide
taatacgactcactataggggaagccctggggggcaaggatgtggcatgaaacagaggagatcatgcatgatccttgccaacctggcggcagcgcaaaagatg

SEQ ID NO: 174276 - DNA, 103 bp, Artificial Sequence
  Synthetic Polynucleotide
taatacgactcactatagggggggggtgaggaagccctggggggcaaggaaacagaggagatccttgatgcccagggctaacctggcggcagcgcaaaagatg

SEQ ID NO: 174277 - DNA, 103 bp, Artificial Sequence
  Synthetic Polynucleotide
taatacgactcactataggggcaggatttgggggggtgaggaagccctggaacagaggagaccagggatgcctcaccccaacctggcggcagcgcaaaagatg

SEQ ID NO: 174278 - DNA, 103 bp, Artificial Sequence
  Synthetic Polynucleotide
taatacgactcactatagggtcctgtgcgcctggcttccacagctccaccaacagaggagaggtggaatggtggaagccaacctggcggcagcgcaaaagatg

SEQ ID NO: 174279 - DNA, 103 bp, Artificial Sequence
  Synthetic Polynucleotide
taatacgactcactatagggctgagctggggcaggatttgggggggtgagaacagaggagactcaccatgccaaatcctaacctggcggcagcgcaaaagatg

SEQ ID NO: 174280 - DNA, 103 bp, Artificial Sequence
  Synthetic Polynucleotide
taatacgactcactatagggttgttccgggctgagctggggcaggatttgaacagaggagacaaatcatgccccagctcaacctggcggcagcgcaaaagatg

SEQ ID NO: 174281 - DNA, 103 bp, Artificial Sequence
  Synthetic Polynucleotide
taatacgactcactatagggtcatgcccagttgttccgggctgagctgggaacagaggagacccagcatggcccggaacaacctggcggcagcgcaaaagatg

SEQ ID NO: 174282 - DNA, 103 bp, Artificial Sequence
  Synthetic Polynucleotide
taatacgactcactatagggagcttctcgatcatgcccagttgttccgggaacagaggagacccggaatgactgggcataacctggcggcagcgcaaaagatg

SEQ ID NO: 174283 - DNA, 103 bp, Artificial Sequence
  Synthetic Polynucleotide
taatacgactcactatagggggcagcgacgagcttctcgatcatgcccagaacagaggagactgggcatgatcgagaagaacctggcggcagcgcaaaagatg

SEQ ID NO: 174284 - DNA, 103 bp, Artificial Sequence
  Synthetic Polynucleotide
taatacgactcactatagggactgttgctgggcagcgacgagcttctcgaaacagaggagatcgagaatgtcgtcgctgaacctggcggcagcgcaaaagatg

SEQ ID NO: 174285 - DNA, 103 bp, Artificial Sequence
  Synthetic Polynucleotide
taatacgactcactatagggcgccggttacactgttgctgggcagcgacgaacagaggagacgtcgcatgccagcaacaaacctggcggcagcgcaaaagatg

SEQ ID NO: 174286 - DNA, 103 bp, Artificial Sequence
  Synthetic Polynucleotide
taatacgactcactatagggagaaaaggagcgccggttacactgttgctgaacagaggagacagcaaatgtgtaaccggaacctggcggcagcgcaaaagatg

SEQ ID NO: 174287 - DNA, 103 bp, Artificial Sequence
  Synthetic Polynucleotide
taatacgactcactataggggaagccggtcagaaaaggagcgccggttacaacagaggagagtaaccatggctccttttaacctggcggcagcgcaaaagatg

SEQ ID NO: 174288 - DNA, 103 bp, Artificial Sequence
  Synthetic Polynucleotide
taatacgactcactatagggaccgtgactcgaagccggtcagaaaaggagaacagaggagactccttatgtgaccggctaacctggcggcagcgcaaaagatg

SEQ ID NO: 174289 - DNA, 103 bp, Artificial Sequence
  Synthetic Polynucleotide
taatacgactcactataggggctgcttgcatcctgtgcgcctggcttccaaacagaggagatggaagatgggcgcacagaacctggcggcagcgcaaaagatg

SEQ ID NO: 174290 - DNA, 103 bp, Artificial Sequence
  Synthetic Polynucleotide
taatacgactcactatagggcagaagcatcaccgtgactcgaagccggtcaacagaggagagaccggatgcgagtcacgaacctggcggcagcgcaaaagatg

SEQ ID NO: 174291 - DNA, 103 bp, Artificial Sequence
  Synthetic Polynucleotide
taatacgactcactataggggagatgtctccagaagcatcaccgtgactcaacagaggagagagtcaatgtgatgcttcaacctggcggcagcgcaaaagatg

SEQ ID NO: 174292 - DNA, 103 bp, Artificial Sequence
  Synthetic Polynucleotide
taatacgactcactatagggttgtacctccgagatgtctccagaagcatcaacagaggagagatgctatgggagacatcaacctggcggcagcgcaaaagatg

SEQ ID NO: 174293 - DNA, 103 bp, Artificial Sequence
  Synthetic Polynucleotide
taatacgactcactatagggactcccagggttgtacctccgagatgtctcaacagaggagagagacaatgcggaggtacaacctggcggcagcgcaaaagatg

SEQ ID NO: 174294 - DNA, 103 bp, Artificial Sequence
  Synthetic Polynucleotide
taatacgactcactatagggtgatactctcactcccagggttgtacctccaacagaggagaggaggtatgaccctgggaaacctggcggcagcgcaaaagatg

SEQ ID NO: 174295 - DNA, 103 bp, Artificial Sequence
  Synthetic Polynucleotide
taatacgactcactatagggttgaggaaggtgatactctcactcccagggaacagaggagaccctggatgtgagagtataacctggcggcagcgcaaaagatg

SEQ ID NO: 174296 - DNA, 103 bp, Artificial Sequence
  Synthetic Polynucleotide
taatacgactcactatagggactgaaatccttgaggaaggtgatactctcaacagaggagagagagtatgaccttcctcaacctggcggcagcgcaaaagatg

SEQ ID NO: 174297 - DNA, 103 bp, Artificial Sequence
  Synthetic Polynucleotide
taatacgactcactatagggcccggttataactgaaatccttgaggaaggaacagaggagaccttccatgaggatttcaaacctggcggcagcgcaaaagatg

SEQ ID NO: 174298 - DNA, 103 bp, Artificial Sequence
  Synthetic Polynucleotide
taatacgactcactataggggcaaagtcttcccggttataactgaaatccaacagaggagaggatttatgttataaccgaacctggcggcagcgcaaaagatg

SEQ ID NO: 174299 - DNA, 103 bp, Artificial Sequence
  Synthetic Polynucleotide
taatacgactcactatagggccctgctttggcaaagtcttcccggttataaacagaggagatataacatggaagactttaacctggcggcagcgcaaaagatg

SEQ ID NO: 174300 - DNA, 103 bp, Artificial Sequence
  Synthetic Polynucleotide
taatacgactcactatagggcctgggcctggctgcttgcatcctgtgcgcaacagaggagagcgcacatgatgcaagcaaacctggcggcagcgcaaaagatg

SEQ ID NO: 174301 - DNA, 103 bp, Artificial Sequence
  Synthetic Polynucleotide
taatacgactcactatagggccacttgcagccctgctttggcaaagtcttaacagaggagaaagactatgccaaagcagaacctggcggcagcgcaaaagatg

SEQ ID NO: 174302 - DNA, 103 bp, Artificial Sequence
  Synthetic Polynucleotide
taatacgactcactatagggttgatgaattccacttgcagccctgctttgaacagaggagacaaagcatggctgcaagtaacctggcggcagcgcaaaagatg

SEQ ID NO: 174303 - DNA, 103 bp, Artificial Sequence
  Synthetic Polynucleotide
taatacgactcactataggggaagatggggttgatgaattccacttgcagaacagaggagactgcaaatggaattcatcaacctggcggcagcgcaaaagatg

SEQ ID NO: 174304 - DNA, 103 bp, Artificial Sequence
  Synthetic Polynucleotide
taatacgactcactatagggtggagaactcgaagatggggttgatgaattaacagaggagaaattcaatgaccccatctaacctggcggcagcgcaaaagatg

SEQ ID NO: 174305 - DNA, 103 bp, Artificial Sequence
  Synthetic Polynucleotide
taatacgactcactatagggttcatggccctggagaactcgaagatggggaacagaggagaccccatatgcgagttctcaacctggcggcagcgcaaaagatg

SEQ ID NO: 174306 - DNA, 103 bp, Artificial Sequence
  Synthetic Polynucleotide
taatacgactcactatagggttgcagctcattcatggccctggagaactcaacagaggagagagttcatgagggccatgaacctggcggcagcgcaaaagatg

SEQ ID NO: 174307 - DNA, 103 bp, Artificial Sequence
  Synthetic Polynucleotide
taatacgactcactatagggcatcattgagttgcagctcattcatggcccaacagaggagagggccaatgatgagctgcaacctggcggcagcgcaaaagatg

SEQ ID NO: 174308 - DNA, 103 bp, Artificial Sequence
  Synthetic Polynucleotide
taatacgactcactataggggcaaactcggcatcattgagttgcagctcaaacagaggagatgagctatgactcaatgaaacctggcggcagcgcaaaagatg

SEQ ID NO: 174309 - DNA, 103 bp, Artificial Sequence
  Synthetic Polynucleotide
taatacgactcactatagggaatgagcaaggcaaactcggcatcattgagaacagaggagactcaatatggccgagtttaacctggcggcagcgcaaaagatg

SEQ ID NO: 174310 - DNA, 103 bp, Artificial Sequence
  Synthetic Polynucleotide
taatacgactcactatagggtgctgatagcaatgagcaaggcaaactcggaacagaggagaccgagtatgccttgctcaaacctggcggcagcgcaaaagatg

SEQ ID NO: 174311 - DNA, 103 bp, Artificial Sequence
  Synthetic Polynucleotide
taatacgactcactatagggctgctgcctccctgggcctggctgcttgcaaacagaggagatgcaagatgccaggcccaaacctggcggcagcgcaaaagatg

SEQ ID NO: 174312 - DNA, 103 bp, Artificial Sequence
  Synthetic Polynucleotide
taatacgactcactataggggcagagaagatgctgatagcaatgagcaagaacagaggagacttgctatgtgctatcagaacctggcggcagcgcaaaagatg

SEQ ID NO: 174313 - DNA, 103 bp, Artificial Sequence
  Synthetic Polynucleotide
taatacgactcactataggggggccggtctgcagagaagatgctgatagcaacagaggagagctatcatgatcttctctaacctggcggcagcgcaaaagatg

SEQ ID NO: 174314 - DNA, 103 bp, Artificial Sequence
  Synthetic Polynucleotide
taatacgactcactatagggcctgcacgttgggccggtctgcagagaagaaacagaggagatcttctatgcagaccggcaacctggcggcagcgcaaaagatg

SEQ ID NO: 174315 - DNA, 103 bp, Artificial Sequence
  Synthetic Polynucleotide
taatacgactcactatagggtggagctggtcctgcacgttgggccggtctaacagaggagaagaccgatgcaacgtgcaaacctggcggcagcgcaaaagatg

SEQ ID NO: 174316 - DNA, 103 bp, Artificial Sequence
  Synthetic Polynucleotide
taatacgactcactatagggcctctctacctggagctggtcctgcacgttaacagaggagaaacgtgatggaccagctcaacctggcggcagcgcaaaagatg

SEQ ID NO: 174317 - DNA, 103 bp, Artificial Sequence
  Synthetic Polynucleotide
taatacgactcactatagggtgtgctgcagcctctctacctggagctggtaacagaggagaaccagcatgaggtagagaaacctggcggcagcgcaaaagatg

SEQ ID NO: 174318 - DNA, 103 bp, Artificial Sequence
  Synthetic Polynucleotide
taatacgactcactatagggtccacatatgtgtgctgcagcctctctaccaacagaggagaggtagaatggctgcagcaaacctggcggcagcgcaaaagatg

SEQ ID NO: 174319 - DNA, 103 bp, Artificial Sequence
  Synthetic Polynucleotide
taatacgactcactatagggatgcagggcttccacatatgtgtgctgcagaacagaggagactgcagatgacatatgtgaacctggcggcagcgcaaaagatg

SEQ ID NO: 174320 - DNA, 103 bp, Artificial Sequence
  Synthetic Polynucleotide
taatacgactcactatagggagacgtaggcatgcagggcttccacatatgaacagaggagacatatgatgaagccctgcaacctggcggcagcgcaaaagatg

SEQ ID NO: 174321 - DNA, 103 bp, Artificial Sequence
  Synthetic Polynucleotide
taatacgactcactatagggtggtggatggagacgtaggcatgcagggctaacagaggagaagccctatgtgcctacgtaacctggcggcagcgcaaaagatg

SEQ ID NO: 174322 - DNA, 103 bp, Artificial Sequence
  Synthetic Polynucleotide
taatacgactcactatagggattttctaacccctgaaactgcattaccataacagaggagaatggtaatgcagtttcagaacctggcggcagcgcaaaagatg

SEQ ID NO: 174323 - DNA, 103 bp, Artificial Sequence
  Synthetic Polynucleotide
taatacgactcactatagggtgttaaaacacctttcgcgggcttcatactaacagaggagaagtatgatgcccgcgaaaaacctggcggcagcgcaaaagatg

SEQ ID NO: 174324 - DNA, 103 bp, Artificial Sequence
  Synthetic Polynucleotide
taatacgactcactatagggaaggaacatagcttcaaccgcagaccctttaacagaggagaaaagggatggcggttgaaaacctggcggcagcgcaaaagatg

SEQ ID NO: 174325 - DNA, 103 bp, Artificial Sequence
  Synthetic Polynucleotide
taatacgactcactatagggcagctgaacgaaggaacatagcttcaaccgaacagaggagacggttgatgctatgttccaacctggcggcagcgcaaaagatg

SEQ ID NO: 174326 - DNA, 103 bp, Artificial Sequence
  Synthetic Polynucleotide
taatacgactcactatagggttgaaaatctcagctgaacgaaggaacataaacagaggagatatgttatgtcgttcagcaacctggcggcagcgcaaaagatg

SEQ ID NO: 174327 - DNA, 103 bp, Artificial Sequence
  Synthetic Polynucleotide
taatacgactcactatagggaagtttcttattgaaaatctcagctgaacgaacagaggagacgttcaatggagattttcaacctggcggcagcgcaaaagatg

SEQ ID NO: 174328 - DNA, 103 bp, Artificial Sequence
  Synthetic Polynucleotide
taatacgactcactataggggcccagacggaagtttcttattgaaaatctaacagaggagaagatttatgataagaaacaacctggcggcagcgcaaaagatg

SEQ ID NO: 174329 - DNA, 103 bp, Artificial Sequence
  Synthetic Polynucleotide
taatacgactcactatagggaggtcagaatgcccagacggaagtttcttaaacagaggagataagaaatgtccgtctggaacctggcggcagcgcaaaagatg

SEQ ID NO: 174330 - DNA, 103 bp, Artificial Sequence
  Synthetic Polynucleotide
taatacgactcactatagggttcttccaataggtcagaatgcccagacggaacagaggagaccgtctatgcattctgacaacctggcggcagcgcaaaagatg

SEQ ID NO: 174331 - DNA, 103 bp, Artificial Sequence
  Synthetic Polynucleotide
taatacgactcactatagggttcgaattctttcttccaataggtcagaataacagaggagaattctgatgtattggaagaacctggcggcagcgcaaaagatg

SEQ ID NO: 174332 - DNA, 103 bp, Artificial Sequence
  Synthetic Polynucleotide
taatacgactcactatagggataccactatttcgaattctttcttccaataacagaggagaattggaatgaagaattcgaacctggcggcagcgcaaaagatg

SEQ ID NO: 174333 - DNA, 103 bp, Artificial Sequence
  Synthetic Polynucleotide
taatacgactcactatagggttcatcagagataccactatttcgaattctaacagaggagaagaattatgaatagtggtaacctggcggcagcgcaaaagatg

SEQ ID NO: 174334 - DNA, 103 bp, Artificial Sequence
  Synthetic Polynucleotide
taatacgactcactatagggccacttgttctgttaaaacacctttcgcggaacagaggagaccgcgaatggtgttttaaaacctggcggcagcgcaaaagatg

SEQ ID NO: 174335 - DNA, 103 bp, Artificial Sequence
  Synthetic Polynucleotide
taatacgactcactataggggtgttatatattcatcagagataccactataacagaggagaatagtgatgtctctgatgaacctggcggcagcgcaaaagatg

SEQ ID NO: 174336 - DNA, 103 bp, Artificial Sequence
  Synthetic Polynucleotide
taatacgactcactatagggctaaacataggtgttatatattcatcagagaacagaggagactctgaatgatatataacaacctggcggcagcgcaaaagatg

SEQ ID NO: 174337 - DNA, 103 bp, Artificial Sequence
  Synthetic Polynucleotide
taatacgactcactatagggtttataaaaactaaacataggtgttatataaacagaggagatatataatgcctatgtttaacctggcggcagcgcaaaagatg

SEQ ID NO: 174338 - DNA, 103 bp, Artificial Sequence
  Synthetic Polynucleotide
taatacgactcactatagggccccaatacttttataaaaactaaacatagaacagaggagactatgtatggtttttataaacctggcggcagcgcaaaagatg

SEQ ID NO: 174339 - DNA, 103 bp, Artificial Sequence
  Synthetic Polynucleotide
taatacgactcactatagggattttcagttccccaatacttttataaaaaaacagaggagatttttaatgaagtattggaacctggcggcagcgcaaaagatg

SEQ ID NO: 174340 - DNA, 103 bp, Artificial Sequence
  Synthetic Polynucleotide
taatacgactcactatagggctcttgagtcattttcagttccccaatactaacagaggagaagtattatggaactgaaaaacctggcggcagcgcaaaagatg

SEQ ID NO: 174341 - DNA, 103 bp, Artificial Sequence
  Synthetic Polynucleotide
taatacgactcactataggggagcatactcctcttgagtcattttcagttaacagaggagaaactgaatgtgactcaagaacctggcggcagcgcaaaagatg

SEQ ID NO: 174342 - DNA, 103 bp, Artificial Sequence
  Synthetic Polynucleotide
taatacgactcactataggggctgtaagcagagcatactcctcttgagtcaacagaggagagactcaatgggagtatgcaacctggcggcagcgcaaaagatg

SEQ ID NO: 174343 - DNA, 103 bp, Artificial Sequence
  Synthetic Polynucleotide
taatacgactcactataggggataacaattgctgtaagcagagcatactcaacagaggagagagtatatgctgcttacaaacctggcggcagcgcaaaagatg

SEQ ID NO: 174344 - DNA, 103 bp, Artificial Sequence
  Synthetic Polynucleotide
taatacgactcactatagggctggagacaggataacaattgctgtaagcaaacagaggagatgcttaatgcaattgttaaacctggcggcagcgcaaaagatg

SEQ ID NO: 174345 - DNA, 103 bp, Artificial Sequence
  Synthetic Polynucleotide
taatacgactcactatagggagaggacctgccacttgttctgttaaaacaaacagaggagatgttttatgagaacaagtaacctggcggcagcgcaaaagatg

SEQ ID NO: 174346 - DNA, 103 bp, Artificial Sequence
  Synthetic Polynucleotide
taatacgactcactatagggtattgtctatctggagacaggataacaattaacagaggagaaattgtatgcctgtctccaacctggcggcagcgcaaaagatg

SEQ ID NO: 174347 - DNA, 103 bp, Artificial Sequence
  Synthetic Polynucleotide
taatacgactcactatagggatcctttatgtattgtctatctggagacagaacagaggagactgtctatggatagacaaaacctggcggcagcgcaaaagatg

SEQ ID NO: 174348 - DNA, 103 bp, Artificial Sequence
  Synthetic Polynucleotide
taatacgactcactatagggctgcctctctatcctttatgtattgtctataacagaggagaatagacatgacataaaggaacctggcggcagcgcaaaagatg

SEQ ID NO: 174349 - DNA, 103 bp, Artificial Sequence
  Synthetic Polynucleotide
taatacgactcactatagggagcttctctactgcctctctatcctttatgaacagaggagacataaaatgtagagaggcaacctggcggcagcgcaaaagatg

SEQ ID NO: 174350 - DNA, 103 bp, Artificial Sequence
  Synthetic Polynucleotide
taatacgactcactatagggtggctcctgaagcttctctactgcctctctaacagaggagaagagagatggtagagaagaacctggcggcagcgcaaaagatg

SEQ ID NO: 174351 - DNA, 103 bp, Artificial Sequence
  Synthetic Polynucleotide
taatacgactcactatagggcatcaagaagtggctcctgaagcttctctaaacagaggagatagagaatgttcaggagcaacctggcggcagcgcaaaagatg

SEQ ID NO: 174352 - DNA, 103 bp, Artificial Sequence
  Synthetic Polynucleotide
taatacgactcactatagggttttgtagcacatcaagaagtggctcctgaaacagaggagatcaggaatgacttcttgaaacctggcggcagcgcaaaagatg

SEQ ID NO: 174353 - DNA, 103 bp, Artificial Sequence
  Synthetic Polynucleotide
taatacgactcactatagggcttacacaacttttgtagcacatcaagaagaacagaggagacttcttatggtgctacaaaacctggcggcagcgcaaaagatg

SEQ ID NO: 174354 - DNA, 103 bp, Artificial Sequence
  Synthetic Polynucleotide
taatacgactcactataggggctggtgaatcttacacaacttttgtagcaaacagaggagatgctacatgagttgtgtaaacctggcggcagcgcaaaagatg

SEQ ID NO: 174355 - DNA, 103 bp, Artificial Sequence
  Synthetic Polynucleotide
taatacgactcactatagggggattttcaggctggtgaatcttacacaacaacagaggagagttgtgatggattcaccaaacctggcggcagcgcaaaagatg

SEQ ID NO: 174356 - DNA, 103 bp, Artificial Sequence
  Synthetic Polynucleotide
taatacgactcactataggggttctgtcccagaggacctgccacttgttcaacagaggagagaacaaatggcaggtcctaacctggcggcagcgcaaaagatg

SEQ ID NO: 174357 - DNA, 103 bp, Artificial Sequence
  Synthetic Polynucleotide
taatacgactcactatagggaaagtgttgaggattttcaggctggtgaataacagaggagaattcacatgcctgaaaataacctggcggcagcgcaaaagatg

SEQ ID NO: 174358 - DNA, 103 bp, Artificial Sequence
  Synthetic Polynucleotide
taatacgactcactatagggggagacaggcaaagtgttgaggattttcagaacagaggagactgaaaatgctcaacactaacctggcggcagcgcaaaagatg

SEQ ID NO: 174359 - DNA, 103 bp, Artificial Sequence
  Synthetic Polynucleotide
taatacgactcactatagggaggcgacccaggagacaggcaaagtgttgaaacagaggagatcaacaatgtgcctgtctaacctggcggcagcgcaaaagatg

SEQ ID NO: 174360 - DNA, 103 bp, Artificial Sequence
  Synthetic Polynucleotide
taatacgactcactatagggtaattcagtcaggcgacccaggagacaggcaacagaggagagcctgtatgctgggtcgcaacctggcggcagcgcaaaagatg

SEQ ID NO: 174361 - DNA, 103 bp, Artificial Sequence
  Synthetic Polynucleotide
taatacgactcactatagggtgaatgtccgtaattcagtcaggcgacccaaacagaggagatgggtcatgtgactgaataacctggcggcagcgcaaaagatg

SEQ ID NO: 174362 - DNA, 103 bp, Artificial Sequence
  Synthetic Polynucleotide
taatacgactcactatagggtggtgatgattgaatgtccgtaattcagtcaacagaggagagactgaatgacggacattaacctggcggcagcgcaaaagatg

SEQ ID NO: 174363 - DNA, 103 bp, Artificial Sequence
  Synthetic Polynucleotide
taatacgactcactatagggcatctcagcgtggtgatgattgaatgtccgaacagaggagacggacaatgaatcatcacaacctggcggcagcgcaaaagatg

SEQ ID NO: 174364 - DNA, 103 bp, Artificial Sequence
  Synthetic Polynucleotide
taatacgactcactatagggatgacatcagcatctcagcgtggtgatgataacagaggagaatcatcatgacgctgagaaacctggcggcagcgcaaaagatg

SEQ ID NO: 174365 - DNA, 103 bp, Artificial Sequence
  Synthetic Polynucleotide
taatacgactcactatagggtttactctccatgacatcagcatctcagcgaacagaggagacgctgaatggctgatgtcaacctggcggcagcgcaaaagatg

SEQ ID NO: 174366 - DNA, 103 bp, Artificial Sequence
  Synthetic Polynucleotide
taatacgactcactatagggcttgtggtcgtttactctccatgacatcagaacagaggagactgatgatgtggagagtaaacctggcggcagcgcaaaagatg

SEQ ID NO: 174367 - DNA, 103 bp, Artificial Sequence
  Synthetic Polynucleotide
taatacgactcactatagggccacttccaggttctgtcccagaggacctgaacagaggagacaggtcatgtgggacagaaacctggcggcagcgcaaaagatg

SEQ ID NO: 174368 - DNA, 103 bp, Artificial Sequence
  Synthetic Polynucleotide
taatacgactcactataggggtggggtaaacttgtggtcgtttactctccaacagaggagaggagagatgacgaccacaaacctggcggcagcgcaaaagatg

SEQ ID NO: 174369 - DNA, 103 bp, Artificial Sequence
  Synthetic Polynucleotide
taatacgactcactatagggtcacagagaagtggggtaaacttgtggtcgaacagaggagacgaccaatggtttaccccaacctggcggcagcgcaaaagatg

SEQ ID NO: 174370 - DNA, 103 bp, Artificial Sequence
  Synthetic Polynucleotide
taatacgactcactataggggtcccagatttcacagagaagtggggtaaaaacagaggagatttaccatgcttctctgtaacctggcggcagcgcaaaagatg

SEQ ID NO: 174371 - DNA, 103 bp, Artificial Sequence
  Synthetic Polynucleotide
taatacgactcactataggggagtatggttccacttccaggttctgtcccaacagaggagagggacaatgcctggaagtaacctggcggcagcgcaaaagatg

SEQ ID NO: 174372 - DNA, 103 bp, Artificial Sequence
  Synthetic Polynucleotide
taatacgactcactataggggctgtattgcgagtatggttccacttccagaacagaggagactggaaatggaaccatacaacctggcggcagcgcaaaagatg

SEQ ID NO: 174373 - DNA, 103 bp, Artificial Sequence
  Synthetic Polynucleotide
taatacgactcactatagggactgaacattgctgtattgcgagtatggttaacagaggagaaaccatatgcgcaatacaaacctggcggcagcgcaaaagatg

SEQ ID NO: 174374 - DNA, 103 bp, Artificial Sequence
  Synthetic Polynucleotide
taatacgactcactatagggacttggggaaactgaacattgctgtattgcaacagaggagagcaataatgcaatgttcaaacctggcggcagcgcaaaagatg

SEQ ID NO: 174375 - DNA, 103 bp, Artificial Sequence
  Synthetic Polynucleotide
taatacgactcactatagggctgtggttgaacttggggaaactgaacattaacagaggagaaatgttatgtttccccaaaacctggcggcagcgcaaaagatg

SEQ ID NO: 174376 - DNA, 103 bp, Artificial Sequence
  Synthetic Polynucleotide
taatacgactcactatagggtttgaattggattttctaacccctgaaactaacagaggagaagtttcatgggttagaaaaacctggcggcagcgcaaaagatg

SEQ ID NO: 174377 - DNA, 103 bp, Artificial Sequence
  Synthetic Polynucleotide
taatacgactcactatagggacgaggaaatctgtggttgaacttggggaaaacagaggagattccccatgttcaaccacaacctggcggcagcgcaaaagatg

SEQ ID NO: 174378 - DNA, 103 bp, Artificial Sequence
  Synthetic Polynucleotide
taatacgactcactatagggtaataggatgacgaggaaatctgtggttgaaacagaggagatcaaccatggatttcctcaacctggcggcagcgcaaaagatg

SEQ ID NO: 174379 - DNA, 103 bp, Artificial Sequence
  Synthetic Polynucleotide
taatacgactcactatagggcaggttggaataataggatgacgaggaaataacagaggagaatttccatgtcatcctataacctggcggcagcgcaaaagatg

SEQ ID NO: 174380 - DNA, 103 bp, Artificial Sequence
  Synthetic Polynucleotide
taatacgactcactatagggggtagaaacccaggttggaataataggatgaacagaggagacatcctatgattccaaccaacctggcggcagcgcaaaagatg

SEQ ID NO: 174381 - DNA, 103 bp, Artificial Sequence
  Synthetic Polynucleotide
taatacgactcactatagggggctgctgggggtagaaacccaggttggaaaacagaggagattccaaatggggtttctaaacctggcggcagcgcaaaagatg

SEQ ID NO: 174382 - DNA, 103 bp, Artificial Sequence
  Synthetic Polynucleotide
taatacgactcactatagggccactcttcaggctgctgggggtagaaaccaacagaggagaggtttcatgccccagcagaacctggcggcagcgcaaaagatg

SEQ ID NO: 174383 - DNA, 103 bp, Artificial Sequence
  Synthetic Polynucleotide
taatacgactcactatagggcaggagagtaccactcttcaggctgctgggaacagaggagacccagcatgctgaagagtaacctggcggcagcgcaaaagatg

SEQ ID NO: 174384 - DNA, 103 bp, Artificial Sequence
  Synthetic Polynucleotide
taatacgactcactatagggtcatatattccaggagagtaccactcttcaaacagaggagatgaagaatggtactctccaacctggcggcagcgcaaaagatg

SEQ ID NO: 174385 - DNA, 103 bp, Artificial Sequence
  Synthetic Polynucleotide
taatacgactcactatagggacgcctgagttcatatattccaggagagtaaacagaggagatactctatgggaatatataacctggcggcagcgcaaaagatg

SEQ ID NO: 174386 - DNA, 103 bp, Artificial Sequence
  Synthetic Polynucleotide
taatacgactcactatagggcagctggcatacgcctgagttcatatattcaacagaggagagaatatatgaactcaggcaacctggcggcagcgcaaaagatg

SEQ ID NO: 174387 - DNA, 103 bp, Artificial Sequence
  Synthetic Polynucleotide
taatacgactcactatagggtgaggactaatttgaattggattttctaacaacagaggagagttagaatgtccaattcaaacctggcggcagcgcaaaagatg

SEQ ID NO: 174388 - DNA, 103 bp, Artificial Sequence
  Synthetic Polynucleotide
taatacgactcactatagggtagagagtctcagctggcatacgcctgagtaacagaggagaactcagatgtatgccagcaacctggcggcagcgcaaaagatg

SEQ ID NO: 174389 - DNA, 103 bp, Artificial Sequence
  Synthetic Polynucleotide
taatacgactcactatagggttctccctggtagagagtctcagctggcataacagaggagaatgccaatggagactctcaacctggcggcagcgcaaaagatg

SEQ ID NO: 174390 - DNA, 103 bp, Artificial Sequence
  Synthetic Polynucleotide
taatacgactcactatagggctacctcagtttctccctggtagagagtctaacagaggagaagactcatgaccagggagaacctggcggcagcgcaaaagatg

SEQ ID NO: 174391 - DNA, 103 bp, Artificial Sequence
  Synthetic Polynucleotide
taatacgactcactatagggggcatctctgctacctcagtttctccctggaacagaggagaccagggatgaactgaggtaacctggcggcagcgcaaaagatg

SEQ ID NO: 174392 - DNA, 103 bp, Artificial Sequence
  Synthetic Polynucleotide
taatacgactcactatagggctttgttacaggcatctctgctacctcagtaacagaggagaactgagatggcagagatgaacctggcggcagcgcaaaagatg

SEQ ID NO: 174393 - DNA, 103 bp, Artificial Sequence
  Synthetic Polynucleotide
taatacgactcactatagggtgcggggcttctttgttacaggcatctctgaacagaggagacagagaatgctgtaacaaaacctggcggcagcgcaaaagatg

SEQ ID NO: 174394 - DNA, 103 bp, Artificial Sequence
  Synthetic Polynucleotide
taatacgactcactataggggacgcgcccatgcggggcttctttgttacaaacagaggagatgtaacatggaagccccgaacctggcggcagcgcaaaagatg

SEQ ID NO: 174395 - DNA, 103 bp, Artificial Sequence
  Synthetic Polynucleotide
taatacgactcactatagggcctccctgctgacgcgcccatgcggggcttaacagaggagaaagcccatgatgggcgcgaacctggcggcagcgcaaaagatg

SEQ ID NO: 174396 - DNA, 103 bp, Artificial Sequence
  Synthetic Polynucleotide
taatacgactcactatagggcccctttgatcctccctgctgacgcgcccaaacagaggagatgggcgatgcagcagggaaacctggcggcagcgcaaaagatg

SEQ ID NO: 174397 - DNA, 103 bp, Artificial Sequence
  Synthetic Polynucleotide
taatacgactcactatagggcacagctcatcccctttgatcctccctgctaacagaggagaagcaggatggatcaaaggaacctggcggcagcgcaaaagatg

SEQ ID NO: 174398 - DNA, 103 bp, Artificial Sequence
  Synthetic Polynucleotide
taatacgactcactatagggacagctgcagtgaggactaatttgaattggaacagaggagaccaattatgattagtcctaacctggcggcagcgcaaaagatg

SEQ ID NO: 174399 - DNA, 103 bp, Artificial Sequence
  Synthetic Polynucleotide
taatacgactcactatagggacaaacaacacacagctcatcccctttgataacagaggagaatcaaaatggatgagctgaacctggcggcagcgcaaaagatg

SEQ ID NO: 174400 - DNA, 103 bp, Artificial Sequence
  Synthetic Polynucleotide
taatacgactcactatagggctctgtctccacaaacaacacacagctcataacagaggagaatgagcatggtgttgtttaacctggcggcagcgcaaaagatg

SEQ ID NO: 174401 - DNA, 103 bp, Artificial Sequence
  Synthetic Polynucleotide
taatacgactcactatagggtatccagaggctctgtctccacaaacaacaaacagaggagatgttgtatgtggagacagaacctggcggcagcgcaaaagatg

SEQ ID NO: 174402 - DNA, 103 bp, Artificial Sequence
  Synthetic Polynucleotide
taatacgactcactatagggattatagtggtatccagaggctctgtctccaacagaggagaggagacatggcctctggaaacctggcggcagcgcaaaagatg

SEQ ID NO: 174403 - DNA, 103 bp, Artificial Sequence
  Synthetic Polynucleotide
taatacgactcactatagggaggtcagtgcattatagtggtatccagaggaacagaggagacctctgatgaccactataaacctggcggcagcgcaaaagatg

SEQ ID NO: 174404 - DNA, 103 bp, Artificial Sequence
  Synthetic Polynucleotide
taatacgactcactatagggcacccctcacaggtcagtgcattatagtggaacagaggagaccactaatgtgcactgacaacctggcggcagcgcaaaagatg

SEQ ID NO: 174405 - DNA, 103 bp, Artificial Sequence
  Synthetic Polynucleotide
taatacgactcactataggggaaacctttacacccctcacaggtcagtgcaacagaggagagcactgatgtgtgaggggaacctggcggcagcgcaaaagatg

SEQ ID NO: 174406 - DNA, 103 bp, Artificial Sequence
  Synthetic Polynucleotide
taatacgactcactatagggttctcctgaagaaacctttacacccctcacaacagaggagagtgaggatggtaaaggttaacctggcggcagcgcaaaagatg

SEQ ID NO: 174407 - DNA, 103 bp, Artificial Sequence
  Synthetic Polynucleotide
taatacgactcactatagggttggtaatgcttctcctgaagaaacctttaaacagaggagataaaggatgcttcaggagaacctggcggcagcgcaaaagatg

SEQ ID NO: 174408 - DNA, 103 bp, Artificial Sequence
  Synthetic Polynucleotide
taatacgactcactatagggcacagcgtttttggtaatgcttctcctgaaaacagaggagattcaggatgagcattaccaacctggcggcagcgcaaaagatg

SEQ ID NO: 174409 - DNA, 103 bp, Artificial Sequence
  Synthetic Polynucleotide
taatacgactcactatagggctgacggcgtacagctgcagtgaggactaaaacagaggagattagtcatgactgcagctaacctggcggcagcgcaaaagatg

SEQ ID NO: 174410 - DNA, 103 bp, Artificial Sequence
  Synthetic Polynucleotide
taatacgactcactatagggtacacttgtacacagcgtttttggtaatgcaacagaggagagcattaatgaaaacgctgaacctggcggcagcgcaaaagatg

SEQ ID NO: 174411 - DNA, 103 bp, Artificial Sequence
  Synthetic Polynucleotide
taatacgactcactatagggcccccgtttttacacttgtacacagcgtttaacagaggagaaaacgcatggtacaagtgaacctggcggcagcgcaaaagatg

SEQ ID NO: 174412 - DNA, 103 bp, Artificial Sequence
  Synthetic Polynucleotide
taatacgactcactatagggcacacagttgcccccgtttttacacttgtaaacagaggagatacaagatgaaaaacgggaacctggcggcagcgcaaaagatg

SEQ ID NO: 174413 - DNA, 103 bp, Artificial Sequence
  Synthetic Polynucleotide
taatacgactcactatagggacatatccatcacacagttgcccccgttttaacagaggagaaaaacgatggcaactgtgaacctggcggcagcgcaaaagatg

SEQ ID NO: 174414 - DNA, 103 bp, Artificial Sequence
  Synthetic Polynucleotide
taatacgactcactatagggcttcgcatgtacatatccatcacacagttgaacagaggagacaactgatggatggatataacctggcggcagcgcaaaagatg

SEQ ID NO: 174415 - DNA, 103 bp, Artificial Sequence
  Synthetic Polynucleotide
taatacgactcactatagggttgacactttcttcgcatgtacatatccataacagaggagaatggatatgtacatgcgaaacctggcggcagcgcaaaagatg

SEQ ID NO: 174416 - DNA, 103 bp, Artificial Sequence
  Synthetic Polynucleotide
taatacgactcactataggggtcgacactcttgacactttcttcgcatgtaacagaggagaacatgcatggaaagtgtcaacctggcggcagcgcaaaagatg

SEQ ID NO: 174417 - DNA, 103 bp, Artificial Sequence
  Synthetic Polynucleotide
taatacgactcactatagggcatttccttagtcgacactcttgacactttaacagaggagaaaagtgatgagagtgtcgaacctggcggcagcgcaaaagatg

SEQ ID NO: 174418 - DNA, 103 bp, Artificial Sequence
  Synthetic Polynucleotide
taatacgactcactatagggcatctctttgcatttccttagtcgacactcaacagaggagagagtgtatgctaaggaaaaacctggcggcagcgcaaaagatg

SEQ ID NO: 174419 - DNA, 103 bp, Artificial Sequence
  Synthetic Polynucleotide
taatacgactcactatagggccaacattcccatctctttgcatttccttaaacagaggagataaggaatggcaaagagaaacctggcggcagcgcaaaagatg

SEQ ID NO: 174420 - DNA, 103 bp, Artificial Sequence
  Synthetic Polynucleotide
taatacgactcactatagggatgaaaaatcctgacggcgtacagctgcagaacagaggagactgcagatgtacgccgtcaacctggcggcagcgcaaaagatg

SEQ ID NO: 174421 - DNA, 103 bp, Artificial Sequence
  Synthetic Polynucleotide
taatacgactcactatagggaagcattcagccaacattcccatctctttgaacagaggagacaaagaatggggaatgttaacctggcggcagcgcaaaagatg

SEQ ID NO: 174422 - DNA, 103 bp, Artificial Sequence
  Synthetic Polynucleotide
taatacgactcactatagggttcagttaacaagcattcagccaacattccaacagaggagaggaatgatggctgaatgcaacctggcggcagcgcaaaagatg

SEQ ID NO: 174423 - DNA, 103 bp, Artificial Sequence
  Synthetic Polynucleotide
taatacgactcactatagggtacactgaatttcagttaacaagcattcagaacagaggagactgaatatgtgttaactgaacctggcggcagcgcaaaagatg

SEQ ID NO: 174424 - DNA, 103 bp, Artificial Sequence
  Synthetic Polynucleotide
taatacgactcactatagggcgcttagatttacactgaatttcagttaacaacagaggagagttaacatgaattcagtgaacctggcggcagcgcaaaagatg

SEQ ID NO: 174425 - DNA, 103 bp, Artificial Sequence
  Synthetic Polynucleotide
taatacgactcactatagggttttctcagtcgcttagatttacactgaataacagaggagaattcagatgaaatctaagaacctggcggcagcgcaaaagatg

SEQ ID NO: 174426 - DNA, 103 bp, Artificial Sequence
  Synthetic Polynucleotide
taatacgactcactataggggcttcacattttttctcagtcgcttagattaacagaggagaaatctaatggactgagaaaacctggcggcagcgcaaaagatg

SEQ ID NO: 174427 - DNA, 103 bp, Artificial Sequence
  Synthetic Polynucleotide
taatacgactcactatagggtctgcatgctgcttcacattttttctcagtaacagaggagaactgagatgaaatgtgaaaacctggcggcagcgcaaaagatg

SEQ ID NO: 174428 - DNA, 103 bp, Artificial Sequence
  Synthetic Polynucleotide
taatacgactcactatagggcacggtctgatctgcatgctgcttcacattaacagaggagaaatgtgatgcagcatgcaaacctggcggcagcgcaaaagatg

SEQ ID NO: 174429 - DNA, 103 bp, Artificial Sequence
  Synthetic Polynucleotide
taatacgactcactatagggtgtcttcattcacggtctgatctgcatgctaacagaggagaagcatgatgatcagaccgaacctggcggcagcgcaaaagatg

SEQ ID NO: 174430 - DNA, 103 bp, Artificial Sequence
  Synthetic Polynucleotide
taatacgactcactatagggcgaccttcactgtcttcattcacggtctgaaacagaggagatcagacatggaatgaagaaacctggcggcagcgcaaaagatg

SEQ ID NO: 174431 - DNA, 103 bp, Artificial Sequence
  Synthetic Polynucleotide
taatacgactcactatagggcatcatttccatgaaaaatcctgacggcgtaacagaggagaacgccgatgggatttttcaacctggcggcagcgcaaaagatg

SEQ ID NO: 174432 - DNA, 103 bp, Artificial Sequence
  Synthetic Polynucleotide
taatacgactcactatagggtcgcaagtcacgaccttcactgtcttcattaacagaggagaaatgaaatgagtgaaggtaacctggcggcagcgcaaaagatg

SEQ ID NO: 174433 - DNA, 103 bp, Artificial Sequence
  Synthetic Polynucleotide
taatacgactcactatagggaggtcacttgtcgcaagtcacgaccttcacaacagaggagagtgaagatggtgacttgcaacctggcggcagcgcaaaagatg

SEQ ID NO: 174434 - DNA, 103 bp, Artificial Sequence
  Synthetic Polynucleotide
taatacgactcactatagggtttgttgtcgaggtcacttgtcgcaagtcaaacagaggagatgacttatgacaagtgacaacctggcggcagcgcaaaagatg

SEQ ID NO: 174435 - DNA, 103 bp, Artificial Sequence
  Synthetic Polynucleotide
taatacgactcactatagggcctgcatgactttgttgtcgaggtcacttgaacagaggagacaagtgatgtcgacaacaaacctggcggcagcgcaaaagatg

SEQ ID NO: 174436 - DNA, 103 bp, Artificial Sequence
  Synthetic Polynucleotide
taatacgactcactatagggcagttttctccctgcatgactttgttgtcgaacagaggagacgacaaatgagtcatgcaaacctggcggcagcgcaaaagatg

SEQ ID NO: 174437 - DNA, 103 bp, Artificial Sequence
  Synthetic Polynucleotide
taatacgactcactatagggggggtgagttcagttttctccctgcatgacaacagaggagagtcatgatgggagaaaacaacctggcggcagcgcaaaagatg

SEQ ID NO: 174438 - DNA, 103 bp, Artificial Sequence
  Synthetic Polynucleotide
taatacgactcactatagggctgttgatctggggtgagttcagttttctcaacagaggagagagaaaatggaactcaccaacctggcggcagcgcaaaagatg

SEQ ID NO: 174439 - DNA, 103 bp, Artificial Sequence
  Synthetic Polynucleotide
taatacgactcactataggggtagaagagtctgttgatctggggtgagttaacagaggagaaactcaatgcagatcaacaacctggcggcagcgcaaaagatg

SEQ ID NO: 174440 - DNA, 103 bp, Artificial Sequence
  Synthetic Polynucleotide
taatacgactcactatagggataataaaatgtagaagagtctgttgatctaacagaggagaagatcaatggactcttctaacctggcggcagcgcaaaagatg

SEQ ID NO: 174441 - DNA, 103 bp, Artificial Sequence
  Synthetic Polynucleotide
taatacgactcactatagggatatgaatccataataaaatgtagaagagtaacagaggagaactcttatgcattttattaacctggcggcagcgcaaaagatg

SEQ ID NO: 174442 - DNA, 103 bp, Artificial Sequence
  Synthetic Polynucleotide
taatacgactcactataggggcttcatactcatcatttccatgaaaaatcaacagaggagagattttatgtggaaatgaaacctggcggcagcgcaaaagatg

SEQ ID NO: 174443 - DNA, 103 bp, Artificial Sequence
  Synthetic Polynucleotide
taatacgactcactatagggtctgtttgttatatgaatccataataaaataacagaggagaattttaatgtggattcataacctggcggcagcgcaaaagatg

SEQ ID NO: 174444 - DNA, 103 bp, Artificial Sequence
  Synthetic Polynucleotide
taatacgactcactatagggtgaggcatcctctgtttgttatatgaatccaacagaggagaggattcatgtaacaaacaaacctggcggcagcgcaaaagatg

SEQ ID NO: 174445 - DNA, 103 bp, Artificial Sequence
  Synthetic Polynucleotide
taatacgactcactatagggtgttatttcctgaggcatcctctgtttgttaacagaggagaaacaaaatgaggatgcctaacctggcggcagcgcaaaagatg

SEQ ID NO: 174446 - DNA, 103 bp, Artificial Sequence
  Synthetic Polynucleotide
taatacgactcactatagggaaattttatttgttatttcctgaggcatccaacagaggagaggatgcatgaggaaataaaacctggcggcagcgcaaaagatg

SEQ ID NO: 174447 - DNA, 103 bp, Artificial Sequence
  Synthetic Polynucleotide
taatacgactcactatagggtcttcttttaaaattttatttgttatttccaacagaggagaggaaatatgaaataaaataacctggcggcagcgcaaaagatg

SEQ ID NO: 174448 - DNA, 103 bp, Artificial Sequence
  Synthetic Polynucleotide
taatacgactcactatagggtgcactgaattcttcttttaaaattttattaacagaggagaaataaaatgttaaaagaaaacctggcggcagcgcaaaagatg

SEQ ID NO: 174449 - DNA, 103 bp, Artificial Sequence
  Synthetic Polynucleotide
taatacgactcactatagggaattttcttctgcactgaattcttcttttaaacagaggagataaaagatgaattcagtgaacctggcggcagcgcaaaagatg

SEQ ID NO: 174450 - DNA, 103 bp, Artificial Sequence
  Synthetic Polynucleotide
taatacgactcactatagggaaaatgagaaaattttcttctgcactgaataacagaggagaattcagatgagaagaaaaaacctggcggcagcgcaaaagatg

SEQ ID NO: 174451 - DNA, 103 bp, Artificial Sequence
  Synthetic Polynucleotide
taatacgactcactatagggcatttccgtcaaaatgagaaaattttcttcaacagaggagagaagaaatgtttctcattaacctggcggcagcgcaaaagatg

SEQ ID NO: 174452 - DNA, 103 bp, Artificial Sequence
  Synthetic Polynucleotide
taatacgactcactataggggattggttgccatttccgtcaaaatgagaaaacagaggagattctcaatgtgacggaaaaacctggcggcagcgcaaaagatg

SEQ ID NO: 174453 - DNA, 103 bp, Artificial Sequence
  Synthetic Polynucleotide
taatacgactcactatagggcctttcgcgggcttcatactcatcatttccaacagaggagaggaaatatggagtatgaaaacctggcggcagcgcaaaagatg

SEQ ID NO: 174454 - DNA, 103 bp, Artificial Sequence
  Synthetic Polynucleotide
taatacgactcactatagggacctgtacatgattggttgccatttccgtcaacagaggagagacggaatgggcaaccaaaacctggcggcagcgcaaaagatg

SEQ ID NO: 174455 - DNA, 103 bp, Artificial Sequence
  Synthetic Polynucleotide
taatacgactcactatagggttctacaagaacctgtacatgattggttgcaacagaggagagcaaccatgcatgtacagaacctggcggcagcgcaaaagatg

SEQ ID NO: 174456 - DNA, 103 bp, Artificial Sequence
  Synthetic Polynucleotide
taatacgactcactatagggtttttgtgaattctacaagaacctgtacataacagaggagaatgtacatgttcttgtagaacctggcggcagcgcaaaagatg

SEQ ID NO: 174457 - DNA, 103 bp, Artificial Sequence
  Synthetic Polynucleotide
taatacgactcactatagggcctggtagcttttttgtgaattctacaagaaacagaggagatcttgtatgattcacaaaaacctggcggcagcgcaaaagatg

SEQ ID NO: 174458 - DNA, 103 bp, Artificial Sequence
  Synthetic Polynucleotide
taatacgactcactatagggagtctgaaatcctggtagcttttttgtgaaaacagaggagattcacaatgaagctaccaaacctggcggcagcgcaaaagatg

SEQ ID NO: 174459 - DNA, 103 bp, Artificial Sequence
  Synthetic Polynucleotide
taatacgactcactatagggcatggtccaaagtctgaaatcctggtagctaacagaggagaagctacatggatttcagaaacctggcggcagcgcaaaagatg

SEQ ID NO: 174460 - DNA, 103 bp, Artificial Sequence
  Synthetic Polynucleotide
taatacgactcactatagggatctggtcttcatggtccaaagtctgaaataacagaggagaatttcaatgtttggaccaaacctggcggcagcgcaaaagatg

SEQ ID NO: 174461 - DNA, 103 bp, Artificial Sequence
  Synthetic Polynucleotide
taatacgactcactatagggcagcaaagcaatctggtcttcatggtccaaaacagaggagattggacatggaagaccagaacctggcggcagcgcaaaagatg

SEQ ID NO: 174462 - DNA, 103 bp, Artificial Sequence
  Synthetic Polynucleotide
taatacgactcactatagggcagaccctttcagcaaagcaatctggtcttaacagaggagaaagaccatgttgctttgcaacctggcggcagcgcaaaagatg

SEQ ID NO: 174463 - DNA, 103 bp, Artificial Sequence
  Synthetic Polynucleotide
taatacgactcactataggggcttcaaccgcagaccctttcagcaaagcaaacagaggagatgctttatggaaagggtcaacctggcggcagcgcaaaagatg

SEQ ID NO: 174464 - DNA, 103 bp, Artificial Sequence
  Synthetic Polynucleotide
taatacgactcactatagggcttgaagtggtgagtcctggtgactgtcataacagaggagaatgacaatgaccaggactaacctggcggcagcgcaaaagatg

SEQ ID NO: 174465 - DNA, 103 bp, Artificial Sequence
  Synthetic Polynucleotide
taatacgactcactatagggcaggtttgcttctgggcctcttggatggttaacagaggagaaaccatatgagaggcccaaacctggcggcagcgcaaaagatg

SEQ ID NO: 174466 - DNA, 103 bp, Artificial Sequence
  Synthetic Polynucleotide
taatacgactcactatagggacactcccaggttccagtctccgcgttgaaaacagaggagattcaacatggagactggaaacctggcggcagcgcaaaagatg

SEQ ID NO: 174467 - DNA, 103 bp, Artificial Sequence
  Synthetic Polynucleotide
taatacgactcactatagggacagccggccacactcccaggttccagtctaacagaggagaagactgatgcctgggagtaacctggcggcagcgcaaaagatg

SEQ ID NO: 174468 - DNA, 103 bp, Artificial Sequence
  Synthetic Polynucleotide
taatacgactcactatagggaagcagtaggacagccggccacactcccagaacagaggagactgggaatgtggccggctaacctggcggcagcgcaaaagatg

SEQ ID NO: 174469 - DNA, 103 bp, Artificial Sequence
  Synthetic Polynucleotide
taatacgactcactatagggagtgtcttccaagcagtaggacagccggccaacagaggagaggccggatgtcctactgcaacctggcggcagcgcaaaagatg

SEQ ID NO: 174470 - DNA, 103 bp, Artificial Sequence
  Synthetic Polynucleotide
taatacgactcactatagggagccacctgcagtgtcttccaagcagtaggaacagaggagacctactatgtggaagacaaacctggcggcagcgcaaaagatg

SEQ ID NO: 174471 - DNA, 103 bp, Artificial Sequence
  Synthetic Polynucleotide
taatacgactcactatagggagttgctggaagccacctgcagtgtcttccaacagaggagaggaagaatgtgcaggtggaacctggcggcagcgcaaaagatg

SEQ ID NO: 174472 - DNA, 103 bp, Artificial Sequence
  Synthetic Polynucleotide
taatacgactcactatagggctccagtagaagttgctggaagccacctgcaacagaggagagcaggtatgttccagcaaaacctggcggcagcgcaaaagatg

SEQ ID NO: 174473 - DNA, 103 bp, Artificial Sequence
  Synthetic Polynucleotide
taatacgactcactatagggtcagcatgggctccagtagaagttgctggaaacagaggagatccagcatgttctactggaacctggcggcagcgcaaaagatg

SEQ ID NO: 174474 - DNA, 103 bp, Artificial Sequence
  Synthetic Polynucleotide
taatacgactcactatagggtagtggaatttcagcatgggctccagtagaaacagaggagatctactatggcccatgctaacctggcggcagcgcaaaagatg

SEQ ID NO: 174475 - DNA, 103 bp, Artificial Sequence
  Synthetic Polynucleotide
taatacgactcactatagggcttcagcatgtagtggaatttcagcatgggaacagaggagacccatgatgaaattccacaacctggcggcagcgcaaaagatg

SEQ ID NO: 174476 - DNA, 103 bp, Artificial Sequence
  Synthetic Polynucleotide
taatacgactcactataggggtctcacctccaggtttgcttctgggcctcaacagaggagagaggccatgaagcaaaccaacctggcggcagcgcaaaagatg

SEQ ID NO: 174477 - DNA, 103 bp, Artificial Sequence
  Synthetic Polynucleotide
taatacgactcactataggggctgcagcttcttcagcatgtagtggaattaacagaggagaaattccatgacatgctgaaacctggcggcagcgcaaaagatg

SEQ ID NO: 174478 - DNA, 103 bp, Artificial Sequence
  Synthetic Polynucleotide
taatacgactcactatagggtcctcatgcagctgcagcttcttcagcatgaacagaggagacatgctatggaagctgcaaacctggcggcagcgcaaaagatg

SEQ ID NO: 174479 - DNA, 103 bp, Artificial Sequence
  Synthetic Polynucleotide
taatacgactcactatagggcacatactcctcctcatgcagctgcagcttaacagaggagaaagctgatgctgcatgagaacctggcggcagcgcaaaagatg

SEQ ID NO: 174480 - DNA, 103 bp, Artificial Sequence
  Synthetic Polynucleotide
taatacgactcactatagggcctgcatcagcacatactcctcctcatgcaaacagaggagatgcatgatgaggagtatgaacctggcggcagcgcaaaagatg

SEQ ID NO: 174481 - DNA, 103 bp, Artificial Sequence
  Synthetic Polynucleotide
taatacgactcactatagggagggagatggcctgcatcagcacatactccaacagaggagaggagtaatggctgatgcaaacctggcggcagcgcaaaagatg

SEQ ID NO: 174482 - DNA, 103 bp, Artificial Sequence
  Synthetic Polynucleotide
taatacgactcactatagggtggggagaagagggagatggcctgcatcagaacagaggagactgatgatggccatctccaacctggcggcagcgcaaaagatg

SEQ ID NO: 174483 - DNA, 103 bp, Artificial Sequence
  Synthetic Polynucleotide
taatacgactcactatagggctgggcggtctggggagaagagggagatggaacagaggagaccatctatgtcttctcccaacctggcggcagcgcaaaagatg

SEQ ID NO: 174484 - DNA, 103 bp, Artificial Sequence
  Synthetic Polynucleotide
taatacgactcactatagggtgcagcacacctgggcggtctggggagaagaacagaggagacttctcatgagaccgcccaacctggcggcagcgcaaaagatg

SEQ ID NO: 174485 - DNA, 103 bp, Artificial Sequence
  Synthetic Polynucleotide
taatacgactcactatagggcacgcggtgctgcagcacacctgggcggtcaacagaggagagaccgcatgggtgtgctgaacctggcggcagcgcaaaagatg

SEQ ID NO: 174486 - DNA, 103 bp, Artificial Sequence
  Synthetic Polynucleotide
taatacgactcactataggggctggtccaccacgcggtgctgcagcacacaacagaggagagtgtgcatgagcaccgcgaacctggcggcagcgcaaaagatg

SEQ ID NO: 174487 - DNA, 103 bp, Artificial Sequence
  Synthetic Polynucleotide
taatacgactcactatagggctttctttgggtctcacctccaggtttgctaacagaggagaagcaaaatgggaggtgagaacctggcggcagcgcaaaagatg

SEQ ID NO: 174488 - DNA, 103 bp, Artificial Sequence
  Synthetic Polynucleotide
taatacgactcactatagggtgctcctgcagctggtccaccacgcggtgcaacagaggagagcaccgatgggtggaccaaacctggcggcagcgcaaaagatg

SEQ ID NO: 174489 - DNA, 103 bp, Artificial Sequence
  Synthetic Polynucleotide
taatacgactcactatagggaatggcgaattgctcctgcagctggtccacaacagaggagagtggacatgctgcaggagaacctggcggcagcgcaaaagatg

SEQ ID NO: 174490 - DNA, 103 bp, Artificial Sequence
  Synthetic Polynucleotide
taatacgactcactatagggacttcagagtaatggcgaattgctcctgcaaacagaggagatgcaggatgaattcgccaaacctggcggcagcgcaaaagatg

SEQ ID NO: 174491 - DNA, 103 bp, Artificial Sequence
  Synthetic Polynucleotide
taatacgactcactatagggtcaatgtaggacttcagagtaatggcgaataacagaggagaattcgcatgtactctgaaaacctggcggcagcgcaaaagatg

SEQ ID NO: 174492 - DNA, 103 bp, Artificial Sequence
  Synthetic Polynucleotide
taatacgactcactatagggccgattgcattcaatgtaggacttcagagtaacagaggagaactctgatgtcctacattaacctggcggcagcgcaaaagatg

SEQ ID NO: 174493 - DNA, 103 bp, Artificial Sequence
  Synthetic Polynucleotide
taatacgactcactatagggcaggctggggccgattgcattcaatgtaggaacagaggagacctacaatgaatgcaatcaacctggcggcagcgcaaaagatg

SEQ ID NO: 174494 - DNA, 103 bp, Artificial Sequence
  Synthetic Polynucleotide
taatacgactcactatagggaacctatgagcaggctggggccgattgcataacagaggagaatgcaaatggccccagccaacctggcggcagcgcaaaagatg

SEQ ID NO: 174495 - DNA, 103 bp, Artificial Sequence
  Synthetic Polynucleotide
taatacgactcactatagggcaggaacaagaacctatgagcaggctggggaacagaggagaccccagatggctcataggaacctggcggcagcgcaaaagatg

SEQ ID NO: 174496 - DNA, 103 bp, Artificial Sequence
  Synthetic Polynucleotide
taatacgactcactatagggccatgatcttcaggaacaagaacctatgagaacagaggagactcataatgtcttgttccaacctggcggcagcgcaaaagatg

SEQ ID NO: 174497 - DNA, 103 bp, Artificial Sequence
  Synthetic Polynucleotide
taatacgactcactataggggtgagcatagccatgatcttcaggaacaagaacagaggagacttgttatggaagatcataacctggcggcagcgcaaaagatg

SEQ ID NO: 174498 - DNA, 103 bp, Artificial Sequence
  Synthetic Polynucleotide
taatacgactcactatagggatggttccagctttctttgggtctcacctcaacagaggagagaggtgatgcccaaagaaaacctggcggcagcgcaaaagatg

SEQ ID NO: 174499 - DNA, 103 bp, Artificial Sequence
  Synthetic Polynucleotide
taatacgactcactataggggcggagctcggtgagcatagccatgatcttaacagaggagaaagatcatggctatgctcaacctggcggcagcgcaaaagatg

SEQ ID NO: 174500 - DNA, 103 bp, Artificial Sequence
  Synthetic Polynucleotide
taatacgactcactatagggcattgatgctgcggagctcggtgagcatagaacagaggagactatgcatgccgagctccaacctggcggcagcgcaaaagatg

SEQ ID NO: 174501 - DNA, 103 bp, Artificial Sequence
  Synthetic Polynucleotide
taatacgactcactataggggtgtgctgagcattgatgctgcggagctcgaacagaggagacgagctatgcagcatcaaaacctggcggcagcgcaaaagatg

SEQ ID NO: 174502 - DNA, 103 bp, Artificial Sequence
  Synthetic Polynucleotide
taatacgactcactatagggcagccgctgggtgtgctgagcattgatgctaacagaggagaagcatcatggctcagcacaacctggcggcagcgcaaaagatg

SEQ ID NO: 174503 - DNA, 103 bp, Artificial Sequence
  Synthetic Polynucleotide
taatacgactcactatagggggatgcgcagcagccgctgggtgtgctgagaacagaggagactcagcatgcccagcggcaacctggcggcagcgcaaaagatg

SEQ ID NO: 174504 - DNA, 103 bp, Artificial Sequence
  Synthetic Polynucleotide
taatacgactcactatagggtgtatgtcctggatgcgcagcagccgctggaacagaggagaccagcgatggctgcgcataacctggcggcagcgcaaaagatg

SEQ ID NO: 174505 - DNA, 103 bp, Artificial Sequence
  Synthetic Polynucleotide
taatacgactcactatagggagcaaaggggtgtatgtcctggatgcgcagaacagaggagactgcgcatgcaggacataaacctggcggcagcgcaaaagatg

SEQ ID NO: 174506 - DNA, 103 bp, Artificial Sequence
  Synthetic Polynucleotide
taatacgactcactatagggtgaggggcgtagcaaaggggtgtatgtcctaacagaggagaaggacaatgacccctttgaacctggcggcagcgcaaaagatg

SEQ ID NO: 174507 - DNA, 103 bp, Artificial Sequence
  Synthetic Polynucleotide
taatacgactcactatagggaactcctgcatgaggggcgtagcaaaggggaacagaggagaccccttatgtacgcccctaacctggcggcagcgcaaaagatg

SEQ ID NO: 174508 - DNA, 103 bp, Artificial Sequence
  Synthetic Polynucleotide
taatacgactcactataggggatgccgaacaactcctgcatgaggggcgtaacagaggagaacgcccatgatgcaggagaacctggcggcagcgcaaaagatg

SEQ ID NO: 174509 - DNA, 103 bp, Artificial Sequence
  Synthetic Polynucleotide
taatacgactcactatagggcaaagtcagcatggttccagctttctttggaacagaggagaccaaagatggctggaaccaacctggcggcagcgcaaaagatg

SEQ ID NO: 174510 - DNA, 103 bp, Artificial Sequence
  Synthetic Polynucleotide
taatacgactcactatagggagctacctgtgatgccgaacaactcctgcaaacagaggagatgcaggatgtgttcggcaaacctggcggcagcgcaaaagatg

SEQ ID NO: 174511 - DNA, 103 bp, Artificial Sequence
  Synthetic Polynucleotide
taatacgactcactatagggtcacagtgtacaaagtcagcatggttccagaacagaggagactggaaatgtgctgacttaacctggcggcagcgcaaaagatg

SEQ ID NO: 174512 - DNA, 103 bp, Artificial Sequence
  Synthetic Polynucleotide
taatacgactcactatagggctctgtgtcctcacagtgtacaaagtcagcaacagaggagagctgacatggtacactgtaacctggcggcagcgcaaaagatg

SEQ ID NO: 174513 - DNA, 103 bp, Artificial Sequence
  Synthetic Polynucleotide
taatacgactcactatagggcaggaacagactctgtgtcctcacagtgtaaacagaggagatacactatgaggacacagaacctggcggcagcgcaaaagatg

SEQ ID NO: 174514 - DNA, 103 bp, Artificial Sequence
  Synthetic Polynucleotide
taatacgactcactatagggctgggctttccaggaacagactctgtgtccaacagaggagaggacacatggtctgttccaacctggcggcagcgcaaaagatg

SEQ ID NO: 174515 - DNA, 103 bp, Artificial Sequence
  Synthetic Polynucleotide
taatacgactcactatagggtgcgttgacactgggctttccaggaacagaaacagaggagatctgttatgggaaagcccaacctggcggcagcgcaaaagatg

SEQ ID NO: 174516 - DNA, 103 bp, Artificial Sequence
  Synthetic Polynucleotide
taatacgactcactataggggggacccctccttgaagtggtgagtcctggaacagaggagaccaggaatgaccacttcaaacctggcggcagcgcaaaagatg

SEQ ID NO: 174517 - DNA, 103 bp, Artificial Sequence
  Synthetic Polynucleotide
taatacgactcactatagggcttcctcatctgcgttgacactgggctttcaacagaggagagaaagcatggtgtcaacgaacctggcggcagcgcaaaagatg

SEQ ID NO: 174518 - DNA, 103 bp, Artificial Sequence
  Synthetic Polynucleotide
taatacgactcactatagggggacctccgacttcctcatctgcgttgacaaacagaggagatgtcaaatgagatgaggaaacctggcggcagcgcaaaagatg

SEQ ID NO: 174519 - DNA, 103 bp, Artificial Sequence
  Synthetic Polynucleotide
taatacgactcactataggggcagatttggggacctccgacttcctcatcaacagaggagagatgagatggtcggaggtaacctggcggcagcgcaaaagatg

SEQ ID NO: 174520 - DNA, 103 bp, Artificial Sequence
  Synthetic Polynucleotide
taatacgactcactatagggcacatacacggcagatttggggacctccgaaacagaggagatcggagatgcccaaatctaacctggcggcagcgcaaaagatg

SEQ ID NO: 174521 - DNA, 103 bp, Artificial Sequence
  Synthetic Polynucleotide
taatacgactcactataggggccttgtccccacatacacggcagatttggaacagaggagaccaaatatgccgtgtatgaacctggcggcagcgcaaaagatg

SEQ ID NO: 174522 - DNA, 103 bp, Artificial Sequence
  Synthetic Polynucleotide
taatacgactcactatagggatagccagtggccttgtccccacatacacgaacagaggagacgtgtaatgggggacaagaacctggcggcagcgcaaaagatg

SEQ ID NO: 174523 - DNA, 103 bp, Artificial Sequence
  Synthetic Polynucleotide
taatacgactcactatagggcattgaagtgatagccagtggccttgtcccaacagaggagagggacaatgccactggctaacctggcggcagcgcaaaagatg

SEQ ID NO: 174524 - DNA, 103 bp, Artificial Sequence
  Synthetic Polynucleotide
taatacgactcactatagggcatgtcatgacattgaagtgatagccagtgaacagaggagacactggatgtcacttcaaaacctggcggcagcgcaaaagatg

SEQ ID NO: 174525 - DNA, 103 bp, Artificial Sequence
  Synthetic Polynucleotide
taatacgactcactataggggcatccttcacatgtcatgacattgaagtgaacagaggagacacttcatggtcatgacaaacctggcggcagcgcaaaagatg

SEQ ID NO: 174526 - DNA, 103 bp, Artificial Sequence
  Synthetic Polynucleotide
taatacgactcactatagggaaaagcccttgcatccttcacatgtcatgaaacagaggagatcatgaatggtgaaggataacctggcggcagcgcaaaagatg

SEQ ID NO: 174527 - DNA, 103 bp, Artificial Sequence
  Synthetic Polynucleotide
taatacgactcactatagggggtgctctgagggacccctccttgaagtggaacagaggagaccacttatgggaggggtcaacctggcggcagcgcaaaagatg

SEQ ID NO: 174528 - DNA, 103 bp, Artificial Sequence
  Synthetic Polynucleotide
taatacgactcactataggggccctcctgaaaaagcccttgcatccttcaaacagaggagatgaaggatgcaagggcttaacctggcggcagcgcaaaagatg

SEQ ID NO: 174529 - DNA, 103 bp, Artificial Sequence
  Synthetic Polynucleotide
taatacgactcactataggggcgtttcatggccctcctgaaaaagcccttaacagaggagaaagggcatgttcaggaggaacctggcggcagcgcaaaagatg

SEQ ID NO: 174530 - DNA, 103 bp, Artificial Sequence
  Synthetic Polynucleotide
taatacgactcactataggggccgggcgttgcgtttcatggccctcctgaaacagaggagatcaggaatgccatgaaacaacctggcggcagcgcaaaagatg

SEQ ID NO: 174531 - DNA, 103 bp, Artificial Sequence
  Synthetic Polynucleotide
taatacgactcactataggggggcacctcagccgggcgttgcgtttcatgaacagaggagacatgaaatgcaacgcccgaacctggcggcagcgcaaaagatg

SEQ ID NO: 174532 - DNA, 103 bp, Artificial Sequence
  Synthetic Polynucleotide
taatacgactcactatagggcttccggaaggggcacctcagccgggcgttaacagaggagaaacgccatgctgaggtgcaacctggcggcagcgcaaaagatg

SEQ ID NO: 174533 - DNA, 103 bp, Artificial Sequence
  Synthetic Polynucleotide
taatacgactcactatagggcgcaggcgcccttccggaaggggcacctcaaacagaggagatgaggtatgccttccggaaacctggcggcagcgcaaaagatg

SEQ ID NO: 174534 - DNA, 103 bp, Artificial Sequence
  Synthetic Polynucleotide
taatacgactcactatagggcgggtgatctcgcaggcgcccttccggaagaacagaggagacttccgatggggcgcctgaacctggcggcagcgcaaaagatg

SEQ ID NO: 174535 - DNA, 103 bp, Artificial Sequence
  Synthetic Polynucleotide
taatacgactcactatagggccgggtcttccgggtgatctcgcaggcgccaacagaggagaggcgccatggagatcaccaacctggcggcagcgcaaaagatg

SEQ ID NO: 174536 - DNA, 103 bp, Artificial Sequence
  Synthetic Polynucleotide
taatacgactcactatagggggcactgtcgccgggtcttccgggtgatctaacagaggagaagatcaatgggaagacccaacctggcggcagcgcaaaagatg

SEQ ID NO: 174537 - DNA, 103 bp, Artificial Sequence
  Synthetic Polynucleotide
taatacgactcactatagggcggcaggcctggcactgtcgccgggtcttcaacagaggagagaagacatggcgacagtgaacctggcggcagcgcaaaagatg

SEQ ID NO: 174538 - DNA, 103 bp, Artificial Sequence
  Synthetic Polynucleotide
taatacgactcactataggggggtatggcaggtgctctgagggacccctcaacagaggagagaggggatgctcagagcaaacctggcggcagcgcaaaagatg

SEQ ID NO: 174539 - DNA, 103 bp, Artificial Sequence
  Synthetic Polynucleotide
taatacgactcactatagggcttgcgcaggcggcaggcctggcactgtcgaacagaggagacgacagatgcaggcctgcaacctggcggcagcgcaaaagatg

SEQ ID NO: 174540 - DNA, 103 bp, Artificial Sequence
  Synthetic Polynucleotide
taatacgactcactatagggtctccaggcacttgcgcaggcggcaggcctaacagaggagaaggcctatggcctgcgcaaacctggcggcagcgcaaaagatg

SEQ ID NO: 174541 - DNA, 103 bp, Artificial Sequence
  Synthetic Polynucleotide
taatacgactcactatagggttcatgccgctctccaggcacttgcgcaggaacagaggagacctgcgatggtgcctggaaacctggcggcagcgcaaaagatg

SEQ ID NO: 174542 - DNA, 103 bp, Artificial Sequence
  Synthetic Polynucleotide
taatacgactcactatagggcatctccttcttcatgccgctctccaggcaaacagaggagatgcctgatgagcggcatgaacctggcggcagcgcaaaagatg

SEQ ID NO: 174543 - DNA, 103 bp, Artificial Sequence
  Synthetic Polynucleotide
taatacgactcactatagggcggacatgatcatctccttcttcatgccgcaacagaggagagcggcaatgagaaggagaaacctggcggcagcgcaaaagatg

SEQ ID NO: 174544 - DNA, 103 bp, Artificial Sequence
  Synthetic Polynucleotide
taatacgactcactatagggacggcctcgtcggacatgatcatctccttcaacagaggagagaaggaatggatcatgtcaacctggcggcagcgcaaaagatg

SEQ ID NO: 174545 - DNA, 103 bp, Artificial Sequence
  Synthetic Polynucleotide
taatacgactcactatagggcctctcctccacggcctcgtcggacatgataacagaggagaatcatgatggacgaggccaacctggcggcagcgcaaaagatg

SEQ ID NO: 174546 - DNA, 103 bp, Artificial Sequence
  Synthetic Polynucleotide
taatacgactcactatagggtcaaggcccgcctctcctccacggcctcgtaacagaggagaacgaggatgtggaggagaaacctggcggcagcgcaaaagatg

SEQ ID NO: 174547 - DNA, 103 bp, Artificial Sequence
  Synthetic Polynucleotide
taatacgactcactatagggttccgcttgatcaaggcccgcctctcctccaacagaggagaggaggaatggcgggccttaacctggcggcagcgcaaaagatg

SEQ ID NO: 174548 - DNA, 103 bp, Artificial Sequence
  Synthetic Polynucleotide
taatacgactcactatagggttcacttttcttccgcttgatcaaggcccgaacagaggagacgggccatgatcaagcggaacctggcggcagcgcaaaagatg

SEQ ID NO: 174549 - DNA, 103 bp, Artificial Sequence
  Synthetic Polynucleotide
taatacgactcactatagggcactgtgcaggggtatggcaggtgctctgaaacagaggagatcagagatgctgccatacaacctggcggcagcgcaaaagatg

SEQ ID NO: 174550 - DNA, 103 bp, Artificial Sequence
  Synthetic Polynucleotide
taatacgactcactatagggtccctgtccgttcacttttcttccgcttgaaacagaggagatcaagcatgagaaaagtgaacctggcggcagcgcaaaagatg

SEQ ID NO: 174551 - DNA, 103 bp, Artificial Sequence
  Synthetic Polynucleotide
taatacgactcactatagggagtggctgagtccctgtccgttcacttttcaacagaggagagaaaagatgacggacaggaacctggcggcagcgcaaaagatg

SEQ ID NO: 174552 - DNA, 103 bp, Artificial Sequence
  Synthetic Polynucleotide
taatacgactcactatagggctgcactcccagtggctgagtccctgtccgaacagaggagacggacaatgactcagccaaacctggcggcagcgcaaaagatg

SEQ ID NO: 174553 - DNA, 103 bp, Artificial Sequence
  Synthetic Polynucleotide
taatacgactcactatagggctgtcagcccctgcactcccagtggctgagaacagaggagactcagcatgtgggagtgcaacctggcggcagcgcaaaagatg

SEQ ID NO: 174554 - DNA, 103 bp, Artificial Sequence
  Synthetic Polynucleotide
taatacgactcactatagggcgctgctcctctgtcagcccctgcactcccaacagaggagagggagtatgggggctgacaacctggcggcagcgcaaaagatg

SEQ ID NO: 174555 - DNA, 103 bp, Artificial Sequence
  Synthetic Polynucleotide
taatacgactcactataggggatcatcatccgctgctcctctgtcagcccaacagaggagagggctgatggaggagcagaacctggcggcagcgcaaaagatg

SEQ ID NO: 174556 - DNA, 103 bp, Artificial Sequence
  Synthetic Polynucleotide
taatacgactcactatagggtcagctccctgatcatcatccgctgctcctaacagaggagaaggagcatgggatgatgaaacctggcggcagcgcaaaagatg

SEQ ID NO: 174557 - DNA, 103 bp, Artificial Sequence
  Synthetic Polynucleotide
taatacgactcactatagggtgagcgtccatcagctccctgatcatcatcaacagaggagagatgatatgcagggagctaacctggcggcagcgcaaaagatg

SEQ ID NO: 174558 - DNA, 103 bp, Artificial Sequence
  Synthetic Polynucleotide
taatacgactcactatagggggttttcatctgagcgtccatcagctccctaacagaggagaagggagatgatggacgctaacctggcggcagcgcaaaagatg

SEQ ID NO: 174559 - DNA, 103 bp, Artificial Sequence
  Synthetic Polynucleotide
taatacgactcactatagggtagtgtcaaaggttttcatctgagcgtccaaacagaggagatggacgatgagatgaaaaaacctggcggcagcgcaaaagatg

SEQ ID NO: 174560 - DNA, 103 bp, Artificial Sequence
  Synthetic Polynucleotide
taatacgactcactatagggtcagccgcagcactgtgcaggggtatggcaaacagaggagatgccatatgcctgcacagaacctggcggcagcgcaaaagatg

SEQ ID NO: 174561 - DNA, 103 bp, Artificial Sequence
  Synthetic Polynucleotide
taatacgactcactatagggtgggagaaggtagtgtcaaaggttttcatcaacagaggagagatgaaatgctttgacacaacctggcggcagcgcaaaagatg

SEQ ID NO: 174562 - DNA, 103 bp, Artificial Sequence
  Synthetic Polynucleotide
taatacgactcactatagggattcttgaaatgggagaaggtagtgtcaaaaacagaggagatttgacatgaccttctccaacctggcggcagcgcaaaagatg

SEQ ID NO: 174563 - DNA, 103 bp, Artificial Sequence
  Synthetic Polynucleotide
taatacgactcactataggggcagccggaaattcttgaaatgggagaaggaacagaggagaccttctatgatttcaagaaacctggcggcagcgcaaaagatg

SEQ ID NO: 174564 - DNA, 103 bp, Artificial Sequence
  Synthetic Polynucleotide
taatacgactcactatagggagcacccctggcagccggaaattcttgaaaaacagaggagatttcaaatgtttccggctaacctggcggcagcgcaaaagatg

SEQ ID NO: 174565 - DNA, 103 bp, Artificial Sequence
  Synthetic Polynucleotide
taatacgactcactataggggccactgctaagcacccctggcagccggaaaacagaggagattccggatgccaggggtgaacctggcggcagcgcaaaagatg

SEQ ID NO: 174566 - DNA, 103 bp, Artificial Sequence
  Synthetic Polynucleotide
taatacgactcactataggggcaactcgcagccactgctaagcacccctgaacagaggagacaggggatgttagcagtgaacctggcggcagcgcaaaagatg

SEQ ID NO: 174567 - DNA, 103 bp, Artificial Sequence
  Synthetic Polynucleotide
taatacgactcactatagggagagactctggcaactcgcagccactgctaaacagaggagatagcagatgctgcgagttaacctggcggcagcgcaaaagatg

SEQ ID NO: 174568 - DNA, 103 bp, Artificial Sequence
  Synthetic Polynucleotide
taatacgactcactatagggtggggcctgcagagactctggcaactcgcaaacagaggagatgcgagatgccagagtctaacctggcggcagcgcaaaagatg

SEQ ID NO: 174569 - DNA, 103 bp, Artificial Sequence
  Synthetic Polynucleotide
taatacgactcactatagggcttccctcgatggggcctgcagagactctgaacagaggagacagagtatgtgcaggcccaacctggcggcagcgcaaaagatg

SEQ ID NO: 174570 - DNA, 103 bp, Artificial Sequence
  Synthetic Polynucleotide
taatacgactcactatagggttggcagcttcttccctcgatggggcctgcaacagaggagagcaggcatgatcgagggaaacctggcggcagcgcaaaagatg

SEQ ID NO: 174571 - DNA, 103 bp, Artificial Sequence
  Synthetic Polynucleotide
taatacgactcactatagggtgaagccaactcagccgcagcactgtgcagaacagaggagactgcacatggctgcggctaacctggcggcagcgcaaaagatg

SEQ ID NO: 174572 - DNA, 103 bp, Artificial Sequence
  Synthetic Polynucleotide
taatacgactcactatagggctggctccacttggcagcttcttccctcgaaacagaggagatcgaggatggaagctgccaacctggcggcagcgcaaaagatg

SEQ ID NO: 174573 - DNA, 103 bp, Artificial Sequence
  Synthetic Polynucleotide
taatacgactcactatagggctttccggacctggctccacttggcagcttaacagaggagaaagctgatgagtggagccaacctggcggcagcgcaaaagatg

SEQ ID NO: 174574 - DNA, 103 bp, Artificial Sequence
  Synthetic Polynucleotide
taatacgactcactataggggagcacagatctttccggacctggctccacaacagaggagagtggagatgggtccggaaaacctggcggcagcgcaaaagatg

SEQ ID NO: 174575 - DNA, 103 bp, Artificial Sequence
  Synthetic Polynucleotide
taatacgactcactataggggaccttcaaagagcacagatctttccggacaacagaggagagtccggatggatctgtgcaacctggcggcagcgcaaaagatg

SEQ ID NO: 174576 - DNA, 103 bp, Artificial Sequence
  Synthetic Polynucleotide
taatacgactcactataggggctgcagagagaccttcaaagagcacagataacagaggagaatctgtatgctttgaaggaacctggcggcagcgcaaaagatg

SEQ ID NO: 174577 - DNA, 103 bp, Artificial Sequence
  Synthetic Polynucleotide
taatacgactcactatagggtccccccgcagctgcagagagaccttcaaaaacagaggagatttgaaatgctctctgcaaacctggcggcagcgcaaaagatg

SEQ ID NO: 174578 - DNA, 103 bp, Artificial Sequence
  Synthetic Polynucleotide
taatacgactcactatagggactgccatcctccccccgcagctgcagagaaacagaggagatctctgatgctgcgggggaacctggcggcagcgcaaaagatg

SEQ ID NO: 174579 - DNA, 103 bp, Artificial Sequence
  Synthetic Polynucleotide
taatacgactcactatagggagttccagacactgccatcctccccccgcaaacagaggagatgcgggatgaggatggcaaacctggcggcagcgcaaaagatg

SEQ ID NO: 174580 - DNA, 103 bp, Artificial Sequence
  Synthetic Polynucleotide
taatacgactcactataggggggggtttgtagttccagacactgccatccaacagaggagaggatggatgtgtctggaaaacctggcggcagcgcaaaagatg

SEQ ID NO: 174581 - DNA, 103 bp, Artificial Sequence
  Synthetic Polynucleotide
taatacgactcactatagggactgtcggctgggggtttgtagttccagacaacagaggagagtctggatgtacaaacccaacctggcggcagcgcaaaagatg

SEQ ID NO: 174582 - DNA, 103 bp, Artificial Sequence
  Synthetic Polynucleotide
taatacgactcactatagggttggatggtttgaagccaactcagccgcagaacagaggagactgcggatgagttggcttaacctggcggcagcgcaaaagatg

SEQ ID NO: 174583 - DNA, 103 bp, Artificial Sequence
  Synthetic Polynucleotide
taatacgactcactatagggctttcccgccactgtcggctgggggtttgtaacagaggagaacaaacatgcagccgacaaacctggcggcagcgcaaaagatg

SEQ ID NO: 174584 - DNA, 103 bp, Artificial Sequence
  Synthetic Polynucleotide
taatacgactcactataggggagaagatctctttcccgccactgtcggctaacagaggagaagccgaatgtggcgggaaaacctggcggcagcgcaaaagatg

SEQ ID NO: 174585 - DNA, 103 bp, Artificial Sequence
  Synthetic Polynucleotide
taatacgactcactataggggggcagcagggagaagatctctttcccgccaacagaggagaggcgggatggagatcttcaacctggcggcagcgcaaaagatg

SEQ ID NO: 174586 - DNA, 103 bp, Artificial Sequence
  Synthetic Polynucleotide
taatacgactcactatagggcagccatgtggggcagcagggagaagatctaacagaggagaagatctatgccctgctgcaacctggcggcagcgcaaaagatg

SEQ ID NO: 174587 - DNA, 103 bp, Artificial Sequence
  Synthetic Polynucleotide
taatacgactcactataggggttgacatgtcagccatgtggggcagcaggaacagaggagacctgctatgccacatggcaacctggcggcagcgcaaaagatg

SEQ ID NO: 174588 - DNA, 103 bp, Artificial Sequence
  Synthetic Polynucleotide
taatacgactcactataggggaacatgtaggttgacatgtcagccatgtgaacagaggagacacatgatggacatgtcaaacctggcggcagcgcaaaagatg

SEQ ID NO: 174589 - DNA, 103 bp, Artificial Sequence
  Synthetic Polynucleotide
taatacgactcactatagggtgatgcctttgaacatgtaggttgacatgtaacagaggagaacatgtatgcctacatgtaacctggcggcagcgcaaaagatg

SEQ ID NO: 174590 - DNA, 103 bp, Artificial Sequence
  Synthetic Polynucleotide
taatacgactcactataggggcaaagctgatgatgcctttgaacatgtagaacagaggagactacatatgcaaaggcataacctggcggcagcgcaaaagatg

SEQ ID NO: 174591 - DNA, 103 bp, Artificial Sequence
  Synthetic Polynucleotide
taatacgactcactataggggatgactttggcaaagctgatgatgcctttaacagaggagaaaaggcatgatcagctttaacctggcggcagcgcaaaagatg

SEQ ID NO: 174592 - DNA, 103 bp, Artificial Sequence
  Synthetic Polynucleotide
taatacgactcactatagggtgaagtaggagatgactttggcaaagctgaaacagaggagatcagctatgccaaagtcaaacctggcggcagcgcaaaagatg

SEQ ID NO: 174593 - DNA, 103 bp, Artificial Sequence
  Synthetic Polynucleotide
taatacgactcactatagggtctgggcctcttggatggtttgaagccaacaacagaggagagttggcatgaaaccatccaacctggcggcagcgcaaaagatg

SEQ ID NO: 174594 - DNA, 103 bp, Artificial Sequence
  Synthetic Polynucleotide
taatacgactcactatagggggcaagtccctgaagtaggagatgactttgaacagaggagacaaagtatgctcctacttaacctggcggcagcgcaaaagatg

SEQ ID NO: 174595 - DNA, 103 bp, Artificial Sequence
  Synthetic Polynucleotide
taatacgactcactataggggtcctcgatgggcaagtccctgaagtaggaaacagaggagatcctacatgagggacttgaacctggcggcagcgcaaaagatg

SEQ ID NO: 174596 - DNA, 103 bp, Artificial Sequence
  Synthetic Polynucleotide
taatacgactcactataggggggagatctggtcctcgatgggcaagtcccaacagaggagagggactatgccatcgaggaacctggcggcagcgcaaaagatg

SEQ ID NO: 174597 - DNA, 103 bp, Artificial Sequence
  Synthetic Polynucleotide
taatacgactcactatagggcccttcagcagggagatctggtcctcgatgaacagaggagacatcgaatgccagatctcaacctggcggcagcgcaaaagatg

SEQ ID NO: 174598 - DNA, 103 bp, Artificial Sequence
  Synthetic Polynucleotide
taatacgactcactataggggaaagcggcccccttcagcagggagatctgaacagaggagacagatcatgctgctgaagaacctggcggcagcgcaaaagatg

SEQ ID NO: 174599 - DNA, 103 bp, Artificial Sequence
  Synthetic Polynucleotide
taatacgactcactataggggacacagctcgaaagcggcccccttcagcaaacagaggagatgctgaatggggccgcttaacctggcggcagcgcaaaagatg

SEQ ID NO: 174600 - DNA, 103 bp, Artificial Sequence
  Synthetic Polynucleotide
taatacgactcactatagggaatctcagttgacacagctcgaaagcggccaacagaggagaggccgcatgcgagctgtgaacctggcggcagcgcaaaagatg

SEQ ID NO: 174601 - DNA, 103 bp, Artificial Sequence
  Synthetic Polynucleotide
taatacgactcactatagggcactgtgttgaatctcagttgacacagctcaacagaggagagagctgatgcaactgagaaacctggcggcagcgcaaaagatg

SEQ ID NO: 174602 - DNA, 103 bp, Artificial Sequence
  Synthetic Polynucleotide
taatacgactcactatagggccgcgttgaacactgtgttgaatctcagttaacagaggagaaactgaatgtcaacacagaacctggcggcagcgcaaaagatg

SEQ ID NO: 174603 - DNA, 103 bp, Artificial Sequence
  Synthetic Polynucleotide
taatacgactcactataggggttccagtctccgcgttgaacactgtgttgaacagaggagacaacacatggttcaacgcaacctggcggcagcgcaaaagatg

SEQ ID NO: 174604 - DNA, 103 bp, Artificial Sequence
  Synthetic Polynucleotide
taatacgactcactataggggttcctcagctcatcttccctactggccataacagaggagaatggccatgagggaagataacctggcggcagcgcaaaagatg

SEQ ID NO: 174605 - DNA, 103 bp, Artificial Sequence
  Synthetic Polynucleotide
taatacgactcactataggggctgactgttctcctgaagaaacccttgcaaacagaggagatgcaagatgttcttcaggaacctggcggcagcgcaaaagatg

SEQ ID NO: 174606 - DNA, 103 bp, Artificial Sequence
  Synthetic Polynucleotide
taatacgactcactatagggcaggccctggatgtgctggatttggtacccaacagaggagagggtacatgatccagcacaacctggcggcagcgcaaaagatg

SEQ ID NO: 174607 - DNA, 103 bp, Artificial Sequence
  Synthetic Polynucleotide
taatacgactcactatagggtcatggcagacaggccctggatgtgctggaaacagaggagatccagcatgtccagggccaacctggcggcagcgcaaaagatg

SEQ ID NO: 174608 - DNA, 103 bp, Artificial Sequence
  Synthetic Polynucleotide
taatacgactcactatagggagcagcggcatcatggcagacaggccctggaacagaggagaccagggatggtctgccataacctggcggcagcgcaaaagatg

SEQ ID NO: 174609 - DNA, 103 bp, Artificial Sequence
  Synthetic Polynucleotide
taatacgactcactataggggatctcctggagcagcggcatcatggcagaaacagaggagatctgccatgatgccgctgaacctggcggcagcgcaaaagatg

SEQ ID NO: 174610 - DNA, 103 bp, Artificial Sequence
  Synthetic Polynucleotide
taatacgactcactatagggcaatgcttttgctgactgttctcctgaagaaacagaggagatcttcaatggaacagtcaaacctggcggcagcgcaaaagatg

SEQ ID NO: 174611 - DNA, 103 bp, Artificial Sequence
  Synthetic Polynucleotide
taatacgactcactatagggcaggtgggaccaatgcttttgctgactgttaacagaggagaaacagtatgcaaaagcataacctggcggcagcgcaaaagatg

SEQ ID NO: 174612 - DNA, 103 bp, Artificial Sequence
  Synthetic Polynucleotide
taatacgactcactatagggagcaaaggggcaggtgggaccaatgcttttaacagaggagaaaaagcatgggtcccaccaacctggcggcagcgcaaaagatg

SEQ ID NO: 174613 - DNA, 103 bp, Artificial Sequence
  Synthetic Polynucleotide
taatacgactcactatagggcacagcttccagcaaaggggcaggtgggacaacagaggagagtcccaatggcccctttgaacctggcggcagcgcaaaagatg

SEQ ID NO: 174614 - DNA, 103 bp, Artificial Sequence
  Synthetic Polynucleotide
taatacgactcactatagggttgctgacttcacagcttccagcaaaggggaacagaggagaccccttatgtggaagctgaacctggcggcagcgcaaaagatg

SEQ ID NO: 174615 - DNA, 103 bp, Artificial Sequence
  Synthetic Polynucleotide
taatacgactcactatagggcctctgagtcttgctgacttcacagcttccaacagaggagaggaagcatggaagtcagcaacctggcggcagcgcaaaagatg

SEQ ID NO: 174616 - DNA, 103 bp, Artificial Sequence
  Synthetic Polynucleotide
taatacgactcactatagggggcagtggcgcctctgagtcttgctgacttaacagaggagaaagtcaatgagactcagaaacctggcggcagcgcaaaagatg

SEQ ID NO: 174617 - DNA, 103 bp, Artificial Sequence
  Synthetic Polynucleotide
taatacgactcactatagggctgcaggctgggcagtggcgcctctgagtcaacagaggagagactcaatggcgccactgaacctggcggcagcgcaaaagatg

SEQ ID NO: 174618 - DNA, 103 bp, Artificial Sequence
  Synthetic Polynucleotide
taatacgactcactatagggcttctgcaacctgcaggctgggcagtggcgaacagaggagacgccacatgccagcctgcaacctggcggcagcgcaaaagatg

SEQ ID NO: 174619 - DNA, 103 bp, Artificial Sequence
  Synthetic Polynucleotide
taatacgactcactatagggataccacacagttcctcagctcatcttcccaacagaggagagggaagatgagctgaggaaacctggcggcagcgcaaaagatg

SEQ ID NO: 174620 - DNA, 103 bp, Artificial Sequence
  Synthetic Polynucleotide
taatacgactcactatagggcatctaagcacttctgcaacctgcaggctgaacagaggagacagcctatgggttgcagaaacctggcggcagcgcaaaagatg

SEQ ID NO: 174621 - DNA, 103 bp, Artificial Sequence
  Synthetic Polynucleotide
taatacgactcactatagggctcatgccagcatctaagcacttctgcaacaacagaggagagttgcaatggtgcttagaaacctggcggcagcgcaaaagatg

SEQ ID NO: 174622 - DNA, 103 bp, Artificial Sequence
  Synthetic Polynucleotide
taatacgactcactatagggcatgtctttcctcatgccagcatctaagcaaacagaggagatgcttaatggctggcatgaacctggcggcagcgcaaaagatg

SEQ ID NO: 174623 - DNA, 103 bp, Artificial Sequence
  Synthetic Polynucleotide
taatacgactcactatagggccgacagtatcatgtctttcctcatgccagaacagaggagactggcaatgggaaagacaaacctggcggcagcgcaaaagatg

SEQ ID NO: 174624 - DNA, 103 bp, Artificial Sequence
  Synthetic Polynucleotide
taatacgactcactatagggagggcttctgccgacagtatcatgtctttcaacagaggagagaaagaatggatactgtcaacctggcggcagcgcaaaagatg

SEQ ID NO: 174625 - DNA, 103 bp, Artificial Sequence
  Synthetic Polynucleotide
taatacgactcactatagggccgcaatgccagggcttctgccgacagtataacagaggagaatactgatggcagaagccaacctggcggcagcgcaaaagatg

SEQ ID NO: 174626 - DNA, 103 bp, Artificial Sequence
  Synthetic Polynucleotide
taatacgactcactataggggctttgctcgccgcaatgccagggcttctgaacagaggagacagaagatgtggcattgcaacctggcggcagcgcaaaagatg

SEQ ID NO: 174627 - DNA, 103 bp, Artificial Sequence
  Synthetic Polynucleotide
taatacgactcactatagggcgctgggcctgctttgctcgccgcaatgccaacagaggagaggcattatggcgagcaaaaacctggcggcagcgcaaaagatg

SEQ ID NO: 174628 - DNA, 103 bp, Artificial Sequence
  Synthetic Polynucleotide
taatacgactcactatagggctgtgcccgccgctgggcctgctttgctcgaacagaggagacgagcaatgcaggcccagaacctggcggcagcgcaaaagatg

SEQ ID NO: 174629 - DNA, 103 bp, Artificial Sequence
  Synthetic Polynucleotide
taatacgactcactatagggcaggtgtttgctgtgcccgccgctgggcctaacagaggagaaggcccatgggcgggcacaacctggcggcagcgcaaaagatg

SEQ ID NO: 174630 - DNA, 103 bp, Artificial Sequence
  Synthetic Polynucleotide
taatacgactcactatagggtggtccccacataccacacagttcctcagcaacagaggagagctgagatgctgtgtggtaacctggcggcagcgcaaaagatg

SEQ ID NO: 174631 - DNA, 103 bp, Artificial Sequence
  Synthetic Polynucleotide
taatacgactcactatagggctcagttgcacaggtgtttgctgtgcccgcaacagaggagagcgggcatggcaaacaccaacctggcggcagcgcaaaagatg

SEQ ID NO: 174632 - DNA, 103 bp, Artificial Sequence
  Synthetic Polynucleotide
taatacgactcactatagggttgctccttactcagttgcacaggtgtttgaacagaggagacaaacaatggtgcaactgaacctggcggcagcgcaaaagatg

SEQ ID NO: 174633 - DNA, 103 bp, Artificial Sequence
  Synthetic Polynucleotide
taatacgactcactatagggtcagctcttcttgctccttactcagttgcaaacagaggagatgcaacatggtaaggagcaacctggcggcagcgcaaaagatg

SEQ ID NO: 174634 - DNA, 103 bp, Artificial Sequence
  Synthetic Polynucleotide
taatacgactcactatagggagtgtccggatcagctcttcttgctccttaaacagaggagataaggaatgagaagagctaacctggcggcagcgcaaaagatg

SEQ ID NO: 174635 - DNA, 103 bp, Artificial Sequence
  Synthetic Polynucleotide
taatacgactcactatagggggcccccaggagtgtccggatcagctcttcaacagaggagagaagagatgatccggacaaacctggcggcagcgcaaaagatg

SEQ ID NO: 174636 - DNA, 103 bp, Artificial Sequence
  Synthetic Polynucleotide
taatacgactcactatagggggcgggtgtgggcccccaggagtgtccggaaacagaggagatccggaatgtcctgggggaacctggcggcagcgcaaaagatg

SEQ ID NO: 174637 - DNA, 103 bp, Artificial Sequence
  Synthetic Polynucleotide
taatacgactcactataggggtgcccatgtggcgggtgtgggcccccaggaacagaggagacctgggatgccacacccgaacctggcggcagcgcaaaagatg

SEQ ID NO: 174638 - DNA, 103 bp, Artificial Sequence
  Synthetic Polynucleotide
taatacgactcactatagggttcaaacatggtgcccatgtggcgggtgtgaacagaggagacacaccatgcacatgggcaacctggcggcagcgcaaaagatg

SEQ ID NO: 174639 - DNA, 103 bp, Artificial Sequence
  Synthetic Polynucleotide
taatacgactcactataggggcacaaactgttcaaacatggtgcccatgtaacagaggagaacatggatgccatgtttgaacctggcggcagcgcaaaagatg

SEQ ID NO: 174640 - DNA, 103 bp, Artificial Sequence
  Synthetic Polynucleotide
taatacgactcactatagggggcctaaactgcacaaactgttcaaacatgaacagaggagacatgttatgacagtttgtaacctggcggcagcgcaaaagatg

SEQ ID NO: 174641 - DNA, 103 bp, Artificial Sequence
  Synthetic Polynucleotide
taatacgactcactataggggcctgtggcttggtccccacataccacacaaacagaggagatgtgtgatgtgtggggacaacctggcggcagcgcaaaagatg

SEQ ID NO: 174642 - DNA, 103 bp, Artificial Sequence
  Synthetic Polynucleotide
taatacgactcactatagggatgagctggaggcctaaactgcacaaactgaacagaggagacagtttatgcagtttaggaacctggcggcagcgcaaaagatg

SEQ ID NO: 174643 - DNA, 103 bp, Artificial Sequence
  Synthetic Polynucleotide
taatacgactcactatagggggatgaacagatgagctggaggcctaaactaacagaggagaagtttaatgctccagctcaacctggcggcagcgcaaaagatg

SEQ ID NO: 174644 - DNA, 103 bp, Artificial Sequence
  Synthetic Polynucleotide
taatacgactcactatagggggctggtgatggatgaacagatgagctggaaacagaggagatccagcatgtctgttcataacctggcggcagcgcaaaagatg

SEQ ID NO: 174645 - DNA, 103 bp, Artificial Sequence
  Synthetic Polynucleotide
taatacgactcactatagggggtgggcaagggctggtgatggatgaacagaacagaggagactgttcatgcatcaccagaacctggcggcagcgcaaaagatg

SEQ ID NO: 174646 - DNA, 103 bp, Artificial Sequence
  Synthetic Polynucleotide
taatacgactcactatagggcaggggccagggtgggcaagggctggtgataacagaggagaatcaccatgccttgcccaaacctggcggcagcgcaaaagatg

SEQ ID NO: 174647 - DNA, 103 bp, Artificial Sequence
  Synthetic Polynucleotide
taatacgactcactatagggagaggcagcacaggggccagggtgggcaagaacagaggagacttgccatgcctggccccaacctggcggcagcgcaaaagatg

SEQ ID NO: 174648 - DNA, 103 bp, Artificial Sequence
  Synthetic Polynucleotide
taatacgactcactataggggtgtgtgaccagaggcagcacaggggccagaacagaggagactggccatggtgctgcctaacctggcggcagcgcaaaagatg

SEQ ID NO: 174649 - DNA, 103 bp, Artificial Sequence
  Synthetic Polynucleotide
taatacgactcactatagggtgtctgcgaagtgtgtgaccagaggcagcaaacagaggagatgctgcatgtggtcacacaacctggcggcagcgcaaaagatg

SEQ ID NO: 174650 - DNA, 103 bp, Artificial Sequence
  Synthetic Polynucleotide
taatacgactcactatagggaaagtgttgatgtctgcgaagtgtgtgaccaacagaggagaggtcacatgcttcgcagaaacctggcggcagcgcaaaagatg

SEQ ID NO: 174651 - DNA, 103 bp, Artificial Sequence
  Synthetic Polynucleotide
taatacgactcactatagggcagtaccatgaaagtgttgatgtctgcgaaaacagaggagattcgcaatgatcaacactaacctggcggcagcgcaaaagatg

SEQ ID NO: 174652 - DNA, 103 bp, Artificial Sequence
  Synthetic Polynucleotide
taatacgactcactatagggtaaagtggtagcctgtggcttggtccccacaacagaggagagtggggatgaagccacagaacctggcggcagcgcaaaagatg

SEQ ID NO: 174653 - DNA, 103 bp, Artificial Sequence
  Synthetic Polynucleotide
taatacgactcactatagggtgatgacttgcagtaccatgaaagtgttgaaacagaggagatcaacaatgtcatggtacaacctggcggcagcgcaaaagatg

SEQ ID NO: 174654 - DNA, 103 bp, Artificial Sequence
  Synthetic Polynucleotide
taatacgactcactatagggttagtaaacttgatgacttgcagtaccatgaacagaggagacatggtatggcaagtcataacctggcggcagcgcaaaagatg

SEQ ID NO: 174655 - DNA, 103 bp, Artificial Sequence
  Synthetic Polynucleotide
taatacgactcactataggggggcaggtccttagtaaacttgatgacttgaacagaggagacaagtcatgaagtttactaacctggcggcagcgcaaaagatg

SEQ ID NO: 174656 - DNA, 103 bp, Artificial Sequence
  Synthetic Polynucleotide
taatacgactcactatagggaacggaagacgggcaggtccttagtaaactaacagaggagaagtttaatgaggacctgcaacctggcggcagcgcaaaagatg

SEQ ID NO: 174657 - DNA, 103 bp, Artificial Sequence
  Synthetic Polynucleotide
taatacgactcactatagggatgggcagggaacggaagacgggcaggtccaacagaggagaggacctatgcgtcttccgaacctggcggcagcgcaaaagatg

SEQ ID NO: 174658 - DNA, 103 bp, Artificial Sequence
  Synthetic Polynucleotide
taatacgactcactatagggctggtcttcaatgggcagggaacggaagacaacagaggagagtcttcatgtccctgcccaacctggcggcagcgcaaaagatg

SEQ ID NO: 174659 - DNA, 103 bp, Artificial Sequence
  Synthetic Polynucleotide
taatacgactcactataggggaagggagatctggtcttcaatgggcagggaacagaggagaccctgcatgttgaagaccaacctggcggcagcgcaaaagatg

SEQ ID NO: 174660 - DNA, 103 bp, Artificial Sequence
  Synthetic Polynucleotide
taatacgactcactataggggctcccttgagaagggagatctggtcttcaaacagaggagatgaagaatggatctccctaacctggcggcagcgcaaaagatg

SEQ ID NO: 174661 - DNA, 103 bp, Artificial Sequence
  Synthetic Polynucleotide
taatacgactcactatagggttccacagctgctcccttgagaagggagataacagaggagaatctccatgctcaagggaaacctggcggcagcgcaaaagatg

SEQ ID NO: 174662 - DNA, 103 bp, Artificial Sequence
  Synthetic Polynucleotide
taatacgactcactatagggtgtgacagatttccacagctgctcccttgaaacagaggagatcaaggatgcagctgtggaacctggcggcagcgcaaaagatg

SEQ ID NO: 174663 - DNA, 103 bp, Artificial Sequence
  Synthetic Polynucleotide
taatacgactcactataggggtcagcgcattaaagtggtagcctgtggctaacagaggagaagccacatgctaccacttaacctggcggcagcgcaaaagatg

SEQ ID NO: 174664 - DNA, 103 bp, Artificial Sequence
  Synthetic Polynucleotide
taatacgactcactatagggttgagtacgatgtgacagatttccacagctaacagaggagaagctgtatgaatctgtcaaacctggcggcagcgcaaaagatg

SEQ ID NO: 174665 - DNA, 103 bp, Artificial Sequence
  Synthetic Polynucleotide
taatacgactcactataggggaaagtggtattgagtacgatgtgacagataacagaggagaatctgtatgatcgtactcaacctggcggcagcgcaaaagatg

SEQ ID NO: 174666 - DNA, 103 bp, Artificial Sequence
  Synthetic Polynucleotide
taatacgactcactatagggtttggagacagaaagtggtattgagtacgaaacagaggagatcgtacatgataccacttaacctggcggcagcgcaaaagatg

SEQ ID NO: 174667 - DNA, 103 bp, Artificial Sequence
  Synthetic Polynucleotide
taatacgactcactatagggaagttttgtgtttggagacagaaagtggtaaacagaggagataccacatgctgtctccaaacctggcggcagcgcaaaagatg

SEQ ID NO: 174668 - DNA, 103 bp, Artificial Sequence
  Synthetic Polynucleotide
taatacgactcactatagggcccgcagaggaagttttgtgtttggagacaaacagaggagatgtctcatgacacaaaacaacctggcggcagcgcaaaagatg

SEQ ID NO: 174669 - DNA, 103 bp, Artificial Sequence
  Synthetic Polynucleotide
taatacgactcactatagggagcgaagaggcccgcagaggaagttttgtgaacagaggagacacaaaatgtcctctgcgaacctggcggcagcgcaaaagatg

SEQ ID NO: 174670 - DNA, 103 bp, Artificial Sequence
  Synthetic Polynucleotide
taatacgactcactatagggtcaattgtgtagcgaagaggcccgcagaggaacagaggagacctctgatggcctcttcgaacctggcggcagcgcaaaagatg

SEQ ID NO: 174671 - DNA, 103 bp, Artificial Sequence
  Synthetic Polynucleotide
taatacgactcactatagggggctccatcttcaattgtgtagcgaagaggaacagaggagacctcttatgtacacaattaacctggcggcagcgcaaaagatg

SEQ ID NO: 174672 - DNA, 103 bp, Artificial Sequence
  Synthetic Polynucleotide
taatacgactcactataggggagatacacgggctccatcttcaattgtgtaacagaggagaacacaaatgaagatggagaacctggcggcagcgcaaaagatg

SEQ ID NO: 174673 - DNA, 103 bp, Artificial Sequence
  Synthetic Polynucleotide
taatacgactcactatagggcccactgtgggagatacacgggctccatctaacagaggagaagatggatgccgtgtatcaacctggcggcagcgcaaaagatg

SEQ ID NO: 174674 - DNA, 103 bp, Artificial Sequence
  Synthetic Polynucleotide
taatacgactcactataggggccctcacaagtcagcgcattaaagtggtaaacagaggagataccacatgaatgcgctgaacctggcggcagcgcaaaagatg

SEQ ID NO: 174675 - DNA, 103 bp, Artificial Sequence
  Synthetic Polynucleotide
taatacgactcactatagggtacctggaaccccactgtgggagatacacgaacagaggagacgtgtaatgcccacagtgaacctggcggcagcgcaaaagatg

SEQ ID NO: 174676 - DNA, 103 bp, Artificial Sequence
  Synthetic Polynucleotide
taatacgactcactatagggccaaaaactctacctggaaccccactgtggaacagaggagaccacagatgggttccaggaacctggcggcagcgcaaaagatg

SEQ ID NO: 174677 - DNA, 103 bp, Artificial Sequence
  Synthetic Polynucleotide
taatacgactcactatagggaagagcaactccaaaaactctacctggaacaacagaggagagttccaatgagagtttttaacctggcggcagcgcaaaagatg

SEQ ID NO: 174678 - DNA, 103 bp, Artificial Sequence
  Synthetic Polynucleotide
taatacgactcactatagggatggaagtgaaagagcaactccaaaaactcaacagaggagagagtttatggagttgctcaacctggcggcagcgcaaaagatg

SEQ ID NO: 174679 - DNA, 103 bp, Artificial Sequence
  Synthetic Polynucleotide
taatacgactcactataggggtagtgttccatggaagtgaaagagcaactaacagaggagaagttgcatgttcacttccaacctggcggcagcgcaaaagatg

SEQ ID NO: 174680 - DNA, 103 bp, Artificial Sequence
  Synthetic Polynucleotide
taatacgactcactatagggtgcagttttcgtagtgttccatggaagtgaaacagaggagatcacttatgtggaacactaacctggcggcagcgcaaaagatg

SEQ ID NO: 174681 - DNA, 103 bp, Artificial Sequence
  Synthetic Polynucleotide
taatacgactcactatagggctcttggagctgcagttttcgtagtgttccaacagaggagaggaacaatgcgaaaactgaacctggcggcagcgcaaaagatg

SEQ ID NO: 174682 - DNA, 103 bp, Artificial Sequence
  Synthetic Polynucleotide
taatacgactcactatagggcatactcaggctcttggagctgcagttttcaacagaggagagaaaacatgagctccaagaacctggcggcagcgcaaaagatg

SEQ ID NO: 174683 - DNA, 103 bp, Artificial Sequence
  Synthetic Polynucleotide
taatacgactcactataggggccaagagcacatactcaggctcttggagcaacagaggagagctccaatggcctgagtaaacctggcggcagcgcaaaagatg

SEQ ID NO: 174684 - DNA, 103 bp, Artificial Sequence
  Synthetic Polynucleotide
taatacgactcactatagggggccatggcagccaagagcacatactcaggaacagaggagacctgagatggtgctcttgaacctggcggcagcgcaaaagatg

SEQ ID NO: 174685 - DNA, 103 bp, Artificial Sequence
  Synthetic Polynucleotide
taatacgactcactatagggaacccttgcagccctcacaagtcagcgcataacagaggagaatgcgcatgcttgtgaggaacctggcggcagcgcaaaagatg

SEQ ID NO: 174686 - DNA, 103 bp, Artificial Sequence
  Synthetic Polynucleotide
taatacgactcactataggggagagaagagggccatggcagccaagagcaaacagaggagatgctctatgctgccatggaacctggcggcagcgcaaaagatg

SEQ ID NO: 174687 - DNA, 103 bp, Artificial Sequence
  Synthetic Polynucleotide
taatacgactcactatagggggtcggtcaggagagaagagggccatggcaaacagaggagatgccatatgcctcttctcaacctggcggcagcgcaaaagatg

SEQ ID NO: 174688 - DNA, 103 bp, Artificial Sequence
  Synthetic Polynucleotide
taatacgactcactatagggggtaactccaggtcggtcaggagagaagagaacagaggagactcttcatgcctgaccgaaacctggcggcagcgcaaaagatg

SEQ ID NO: 174689 - DNA, 103 bp, Artificial Sequence
  Synthetic Polynucleotide
taatacgactcactatagggcatctctctgggtaactccaggtcggtcagaacagaggagactgaccatgctggagttaaacctggcggcagcgcaaaagatg

SEQ ID NO: 174690 - DNA, 103 bp, Artificial Sequence
  Synthetic Polynucleotide
taatacgactcactatagggtgatcaatctcatctctctgggtaactccaaacagaggagatggagtatgccagagagaaacctggcggcagcgcaaaagatg

SEQ ID NO: 174691 - DNA, 103 bp, Artificial Sequence
  Synthetic Polynucleotide
taatacgactcactatagggctcttgcagctgatcaatctcatctctctgaacagaggagacagagaatggagattgataacctggcggcagcgcaaaagatg

SEQ ID NO: 174692 - DNA, 103 bp, Artificial Sequence
  Synthetic Polynucleotide
taatacgactcactataggggtgccatctcctcttgcagctgatcaatctaacagaggagaagattgatgagctgcaagaacctggcggcagcgcaaaagatg

SEQ ID NO: 174693 - DNA, 103 bp, Artificial Sequence
  Synthetic Polynucleotide
taatacgactcactatagggtgcagagtcagtgccatctcctcttgcagcaacagaggagagctgcaatgggagatggcaacctggcggcagcgcaaaagatg

SEQ ID NO: 174694 - DNA, 103 bp, Artificial Sequence
  Synthetic Polynucleotide
taatacgactcactataggggatgtagctttgcagagtcagtgccatctcaacagaggagagagatgatgctgactctgaacctggcggcagcgcaaaagatg

SEQ ID NO: 174695 - DNA, 103 bp, Artificial Sequence
  Synthetic Polynucleotide
taatacgactcactataggggctggcccttgatgtagctttgcagagtcaaacagaggagatgactcatgaaagctacaaacctggcggcagcgcaaaagatg

SEQ ID NO: 174696 - DNA, 103 bp, Artificial Sequence
  Synthetic Polynucleotide
taatacgactcactatagggctcctgaagaaacccttgcagccctcacaaaacagaggagattgtgaatgctgcaagggaacctggcggcagcgcaaaagatg

SEQ ID NO: 174697 - DNA, 103 bp, Artificial Sequence
  Synthetic Polynucleotide
taatacgactcactatagggggccttcgctgctggcccttgatgtagcttaacagaggagaaagctaatgcaagggccaaacctggcggcagcgcaaaagatg

SEQ ID NO: 174698 - DNA, 103 bp, Artificial Sequence
  Synthetic Polynucleotide
taatacgactcactatagggccgatcccggggccttcgctgctggcccttaacagaggagaaagggcatgcagcgaaggaacctggcggcagcgcaaaagatg

SEQ ID NO: 174699 - DNA, 103 bp, Artificial Sequence
  Synthetic Polynucleotide
taatacgactcactatagggcatacagaaaccgatcccggggccttcgctaacagaggagaagcgaaatgcccgggatcaacctggcggcagcgcaaaagatg

SEQ ID NO: 174700 - DNA, 103 bp, Artificial Sequence
  Synthetic Polynucleotide
taatacgactcactatagggagcaacttcgcatacagaaaccgatcccggaacagaggagaccgggaatggtttctgtaaacctggcggcagcgcaaaagatg

SEQ ID NO: 174701 - DNA, 103 bp, Artificial Sequence
  Synthetic Polynucleotide
taatacgactcactatagggcagcaggcctagcaacttcgcatacagaaaaacagaggagatttctgatggcgaagttgaacctggcggcagcgcaaaagatg

SEQ ID NO: 174702 - DNA, 103 bp, Artificial Sequence
  Synthetic Polynucleotide
taatacgactcactatagggggagctcagccagcaggcctagcaacttcgaacagaggagacgaagtatgtaggcctgcaacctggcggcagcgcaaaagatg

SEQ ID NO: 174703 - DNA, 103 bp, Artificial Sequence
  Synthetic Polynucleotide
taatacgactcactatagggttaatgctccggagctcagccagcaggcctaacagaggagaaggcctatgggctgagctaacctggcggcagcgcaaaagatg

SEQ ID NO: 174704 - DNA, 103 bp, Artificial Sequence
  Synthetic Polynucleotide
taatacgactcactataggggtaggcctcattaatgctccggagctcagcaacagaggagagctgagatgcggagcattaacctggcggcagcgcaaaagatg

SEQ ID NO: 174705 - DNA, 103 bp, Artificial Sequence
  Synthetic Polynucleotide
taatacgactcactatagggtttggtacccgtaggcctcattaatgctccaacagaggagaggagcaatgatgaggcctaacctggcggcagcgcaaaagatg

SEQ ID NO: 174706 - DNA, 103 bp, Artificial Sequence
  Synthetic Polynucleotide
taatacgactcactatagggatgtgctggatttggtacccgtaggcctcaaacagaggagatgaggcatgcgggtaccaaacctggcggcagcgcaaaagatg

SEQ ID NO: 174707 - DNA, 103 bp, Artificial Sequence
  Synthetic Polynucleotide
taatacgactcactatagggttgatgtgcaatttcttctatggttgccataacagaggagaatggcaatgatagaagaaaacctggcggcagcgcaaaagatg

SEQ ID NO: 174708 - DNA, 103 bp, Artificial Sequence
  Synthetic Polynucleotide
taatacgactcactatagggttgggtattatgatcaagtgctgtcacaataacagaggagaattgtgatggcacttgataacctggcggcagcgcaaaagatg

SEQ ID NO: 174709 - DNA, 103 bp, Artificial Sequence
  Synthetic Polynucleotide
taatacgactcactatagggctggcaggctgtgctctctccaggattcaaaacagaggagattgaatatgggagagagcaacctggcggcagcgcaaaagatg

SEQ ID NO: 174710 - DNA, 103 bp, Artificial Sequence
  Synthetic Polynucleotide
taatacgactcactatagggctactgagctctggcaggctgtgctctctcaacagaggagagagagaatgcagcctgccaacctggcggcagcgcaaaagatg

SEQ ID NO: 174711 - DNA, 103 bp, Artificial Sequence
  Synthetic Polynucleotide
taatacgactcactatagggtccatgcccgctactgagctctggcaggctaacagaggagaagcctgatggagctcagtaacctggcggcagcgcaaaagatg

SEQ ID NO: 174712 - DNA, 103 bp, Artificial Sequence
  Synthetic Polynucleotide
taatacgactcactatagggtacacttccttccatgcccgctactgagctaacagaggagaagctcaatggcgggcatgaacctggcggcagcgcaaaagatg

SEQ ID NO: 174713 - DNA, 103 bp, Artificial Sequence
  Synthetic Polynucleotide
taatacgactcactatagggtgattaggtgtacacttccttccatgcccgaacagaggagacgggcaatgaaggaagtgaacctggcggcagcgcaaaagatg

SEQ ID NO: 174714 - DNA, 103 bp, Artificial Sequence
  Synthetic Polynucleotide
taatacgactcactataggggaatctccagtgattaggtgtacacttcctaacagaggagaaggaagatgacacctaataacctggcggcagcgcaaaagatg

SEQ ID NO: 174715 - DNA, 103 bp, Artificial Sequence
  Synthetic Polynucleotide
taatacgactcactatagggatttatgcttgaatctccagtgattaggtgaacagaggagacacctaatgactggagataacctggcggcagcgcaaaagatg

SEQ ID NO: 174716 - DNA, 103 bp, Artificial Sequence
  Synthetic Polynucleotide
taatacgactcactatagggtttcggtgtaatttatgcttgaatctccagaacagaggagactggagatgcaagcataaaacctggcggcagcgcaaaagatg

SEQ ID NO: 174717 - DNA, 103 bp, Artificial Sequence
  Synthetic Polynucleotide
taatacgactcactatagggggcccctctttttcggtgtaatttatgcttaacagaggagaaagcatatgttacaccgaaacctggcggcagcgcaaaagatg

SEQ ID NO: 174718 - DNA, 103 bp, Artificial Sequence
  Synthetic Polynucleotide
taatacgactcactataggggctgagaagtggcccctctttttcggtgtaaacagaggagatacaccatgaaagaggggaacctggcggcagcgcaaaagatg

SEQ ID NO: 174719 - DNA, 103 bp, Artificial Sequence
  Synthetic Polynucleotide
taatacgactcactatagggactgcttgccttgggtattatgatcaagtgaacagaggagacacttgatgataatacccaacctggcggcagcgcaaaagatg

SEQ ID NO: 174720 - DNA, 103 bp, Artificial Sequence
  Synthetic Polynucleotide
taatacgactcactatagggcatgtgaatcgctgagaagtggcccctcttaacagaggagaaagaggatgcacttctcaaacctggcggcagcgcaaaagatg

SEQ ID NO: 174721 - DNA, 103 bp, Artificial Sequence
  Synthetic Polynucleotide
taatacgactcactatagggctgaaagctacatgtgaatcgctgagaagtaacagaggagaacttctatgcgattcacaaacctggcggcagcgcaaaagatg

SEQ ID NO: 174722 - DNA, 103 bp, Artificial Sequence
  Synthetic Polynucleotide
taatacgactcactatagggcatggtgagcctgaaagctacatgtgaatcaacagaggagagattcaatggtagctttcaacctggcggcagcgcaaaagatg

SEQ ID NO: 174723 - DNA, 103 bp, Artificial Sequence
  Synthetic Polynucleotide
taatacgactcactatagggtaggagaaggcatggtgagcctgaaagctaaacagaggagatagcttatgggctcaccaaacctggcggcagcgcaaaagatg

SEQ ID NO: 174724 - DNA, 103 bp, Artificial Sequence
  Synthetic Polynucleotide
taatacgactcactatagggtactcaggcataggagaaggcatggtgagcaacagaggagagctcacatggccttctccaacctggcggcagcgcaaaagatg

SEQ ID NO: 174725 - DNA, 103 bp, Artificial Sequence
  Synthetic Polynucleotide
taatacgactcactatagggcacattcaggtactcaggcataggagaaggaacagaggagaccttctatgatgcctgagaacctggcggcagcgcaaaagatg

SEQ ID NO: 174726 - DNA, 103 bp, Artificial Sequence
  Synthetic Polynucleotide
taatacgactcactatagggcaatgtagtgcacattcaggtactcaggcaaacagaggagatgcctgatgacctgaatgaacctggcggcagcgcaaaagatg

SEQ ID NO: 174727 - DNA, 103 bp, Artificial Sequence
  Synthetic Polynucleotide
taatacgactcactataggggcagactccccaatgtagtgcacattcaggaacagaggagacctgaaatggcactacataacctggcggcagcgcaaaagatg

SEQ ID NO: 174728 - DNA, 103 bp, Artificial Sequence
  Synthetic Polynucleotide
taatacgactcactatagggcagtctggaggcagactccccaatgtagtgaacagaggagacactacatgggggagtctaacctggcggcagcgcaaaagatg

SEQ ID NO: 174729 - DNA, 103 bp, Artificial Sequence
  Synthetic Polynucleotide
taatacgactcactatagggataagaacagcagtctggaggcagactcccaacagaggagagggagtatgcctccagacaacctggcggcagcgcaaaagatg

SEQ ID NO: 174730 - DNA, 103 bp, Artificial Sequence
  Synthetic Polynucleotide
taatacgactcactataggggtcagaatgaactgcttgccttgggtattaaacagaggagataatacatgaggcaagcaaacctggcggcagcgcaaaagatg

SEQ ID NO: 174731 - DNA, 103 bp, Artificial Sequence
  Synthetic Polynucleotide
taatacgactcactatagggcagtgcattgataagaacagcagtctggagaacagaggagactccagatggctgttcttaacctggcggcagcgcaaaagatg

SEQ ID NO: 174732 - DNA, 103 bp, Artificial Sequence
  Synthetic Polynucleotide
taatacgactcactatagggcgaaagtgcccagtgcattgataagaacagaacagaggagactgttcatgtcaatgcacaacctggcggcagcgcaaaagatg

SEQ ID NO: 174733 - DNA, 103 bp, Artificial Sequence
  Synthetic Polynucleotide
taatacgactcactatagggaagaaggaatcgaaagtgcccagtgcattgaacagaggagacaatgcatggggcactttaacctggcggcagcgcaaaagatg

SEQ ID NO: 174734 - DNA, 103 bp, Artificial Sequence
  Synthetic Polynucleotide
taatacgactcactatagggagagcctggaaagaaggaatcgaaagtgccaacagaggagaggcactatggattccttcaacctggcggcagcgcaaaagatg

SEQ ID NO: 174735 - DNA, 103 bp, Artificial Sequence
  Synthetic Polynucleotide
taatacgactcactatagggttcttgccctagagcctggaaagaaggaataacagaggagaattcctatgttccaggctaacctggcggcagcgcaaaagatg

SEQ ID NO: 174736 - DNA, 103 bp, Artificial Sequence
  Synthetic Polynucleotide
taatacgactcactatagggatatgctgttttcttgccctagagcctggaaacagaggagatccaggatgtagggcaagaacctggcggcagcgcaaaagatg

SEQ ID NO: 174737 - DNA, 103 bp, Artificial Sequence
  Synthetic Polynucleotide
taatacgactcactatagggttcaccagtgatatgctgttttcttgccctaacagaggagaagggcaatgaaacagcataacctggcggcagcgcaaaagatg

SEQ ID NO: 174738 - DNA, 103 bp, Artificial Sequence
  Synthetic Polynucleotide
taatacgactcactatagggccagtaagctttcaccagtgatatgctgttaacagaggagaaacagcatgtcactggtgaacctggcggcagcgcaaaagatg

SEQ ID NO: 174739 - DNA, 103 bp, Artificial Sequence
  Synthetic Polynucleotide
taatacgactcactatagggaaagttcattccagtaagctttcaccagtgaacagaggagacactggatgaagcttactaacctggcggcagcgcaaaagatg

SEQ ID NO: 174740 - DNA, 103 bp, Artificial Sequence
  Synthetic Polynucleotide
taatacgactcactatagggccaagagtaaaaagttcattccagtaagctaacagaggagaagcttaatggaatgaactaacctggcggcagcgcaaaagatg

SEQ ID NO: 174741 - DNA, 103 bp, Artificial Sequence
  Synthetic Polynucleotide
taatacgactcactataggggtcgtgatttgtcagaatgaactgcttgccaacagaggagaggcaagatgttcattctgaacctggcggcagcgcaaaagatg

SEQ ID NO: 174742 - DNA, 103 bp, Artificial Sequence
  Synthetic Polynucleotide
taatacgactcactatagggctgggcaagaccaagagtaaaaagttcattaacagaggagaaatgaaatgtttactcttaacctggcggcagcgcaaaagatg

SEQ ID NO: 174743 - DNA, 103 bp, Artificial Sequence
  Synthetic Polynucleotide
taatacgactcactatagggcttgccagcactgggcaagaccaagagtaaaacagaggagattactcatggtcttgcccaacctggcggcagcgcaaaagatg

SEQ ID NO: 174744 - DNA, 103 bp, Artificial Sequence
  Synthetic Polynucleotide
taatacgactcactatagggacattcatcacttgccagcactgggcaagaaacagaggagatcttgcatggtgctggcaaacctggcggcagcgcaaaagatg

SEQ ID NO: 174745 - DNA, 103 bp, Artificial Sequence
  Synthetic Polynucleotide
taatacgactcactatagggtatagttgctacattcatcacttgccagcaaacagaggagatgctggatggtgatgaataacctggcggcagcgcaaaagatg

SEQ ID NO: 174746 - DNA, 103 bp, Artificial Sequence
  Synthetic Polynucleotide
taatacgactcactatagggatgttgctaatatagttgctacattcatcaaacagaggagatgatgaatgtagcaactaaacctggcggcagcgcaaaagatg

SEQ ID NO: 174747 - DNA, 103 bp, Artificial Sequence
  Synthetic Polynucleotide
taatacgactcactatagggcaattgacaaatgttgctaatatagttgctaacagaggagaagcaacatgattagcaacaacctggcggcagcgcaaaagatg

SEQ ID NO: 174748 - DNA, 103 bp, Artificial Sequence
  Synthetic Polynucleotide
taatacgactcactatagggattgtgaagacaattgacaaatgttgctaaaacagaggagattagcaatgtttgtcaataacctggcggcagcgcaaaagatg

SEQ ID NO: 174749 - DNA, 103 bp, Artificial Sequence
  Synthetic Polynucleotide
taatacgactcactataggggttgaagactattgtgaagacaattgacaaaacagaggagattgtcaatggtcttcacaaacctggcggcagcgcaaaagatg

SEQ ID NO: 174750 - DNA, 103 bp, Artificial Sequence
  Synthetic Polynucleotide
taatacgactcactatagggattttatcttgttgaagactattgtgaagaaacagaggagatcttcaatgtagtcttcaaacctggcggcagcgcaaaagatg

SEQ ID NO: 174751 - DNA, 103 bp, Artificial Sequence
  Synthetic Polynucleotide
taatacgactcactatagggttctgttgacattttatcttgttgaagactaacagaggagaagtcttatgcaagataaaaacctggcggcagcgcaaaagatg

SEQ ID NO: 174752 - DNA, 103 bp, Artificial Sequence
  Synthetic Polynucleotide
taatacgactcactataggggagtagagccgtcgtgatttgtcagaatgaaacagaggagatcattcatgcaaatcacgaacctggcggcagcgcaaaagatg

SEQ ID NO: 174753 - DNA, 103 bp, Artificial Sequence
  Synthetic Polynucleotide
taatacgactcactatagggattttcttctttctgttgacattttatcttaacagaggagaaagataatgtgtcaacagaacctggcggcagcgcaaaagatg

SEQ ID NO: 174754 - DNA, 103 bp, Artificial Sequence
  Synthetic Polynucleotide
taatacgactcactatagggtccatcaataattttcttctttctgttgacaacagaggagagtcaacatgaagaagaaaaacctggcggcagcgcaaaagatg

SEQ ID NO: 174755 - DNA, 103 bp, Artificial Sequence
  Synthetic Polynucleotide
taatacgactcactataggggaagatgtgctccatcaataattttcttctaacagaggagaagaagaatgttattgatgaacctggcggcagcgcaaaagatg

SEQ ID NO: 174756 - DNA, 103 bp, Artificial Sequence
  Synthetic Polynucleotide
taatacgactcactatagggcctgtagtttgaagatgtgctccatcaataaacagaggagatattgaatgagcacatctaacctggcggcagcgcaaaagatg

SEQ ID NO: 174757 - DNA, 103 bp, Artificial Sequence
  Synthetic Polynucleotide
taatacgactcactatagggttacaaaactcctgtagtttgaagatgtgcaacagaggagagcacatatgcaaactacaaacctggcggcagcgcaaaagatg

SEQ ID NO: 174758 - DNA, 103 bp, Artificial Sequence
  Synthetic Polynucleotide
taatacgactcactatagggaaccatgctgttacaaaactcctgtagtttaacagaggagaaaactaatggagttttgtaacctggcggcagcgcaaaagatg

SEQ ID NO: 174759 - DNA, 103 bp, Artificial Sequence
  Synthetic Polynucleotide
taatacgactcactatagggtgcagagtttaaccatgctgttacaaaactaacagaggagaagttttatgacagcatggaacctggcggcagcgcaaaagatg

SEQ ID NO: 174760 - DNA, 103 bp, Artificial Sequence
  Synthetic Polynucleotide
taatacgactcactatagggtatccatcaatgcagagtttaaccatgctgaacagaggagacagcatatgtaaactctgaacctggcggcagcgcaaaagatg

SEQ ID NO: 174761 - DNA, 103 bp, Artificial Sequence
  Synthetic Polynucleotide
taatacgactcactatagggggcatattcgtatccatcaatgcagagtttaacagaggagaaaactcatgattgatggaaacctggcggcagcgcaaaagatg

SEQ ID NO: 174762 - DNA, 103 bp, Artificial Sequence
  Synthetic Polynucleotide
taatacgactcactatagggccttcaggtaggcatattcgtatccatcaaaacagaggagattgatgatgacgaatatgaacctggcggcagcgcaaaagatg

SEQ ID NO: 174763 - DNA, 103 bp, Artificial Sequence
  Synthetic Polynucleotide
taatacgactcactatagggactttgcttggagtagagccgtcgtgatttaacagaggagaaaatcaatgcggctctacaacctggcggcagcgcaaaagatg

SEQ ID NO: 174764 - DNA, 103 bp, Artificial Sequence
  Synthetic Polynucleotide
taatacgactcactatagggagtactattgccttcaggtaggcatattcgaacagaggagacgaataatgctacctgaaaacctggcggcagcgcaaaagatg

SEQ ID NO: 174765 - DNA, 103 bp, Artificial Sequence
  Synthetic Polynucleotide
taatacgactcactatagggtggactgaagagtactattgccttcaggtaaacagaggagatacctgatggcaatagtaaacctggcggcagcgcaaaagatg

SEQ ID NO: 174766 - DNA, 103 bp, Artificial Sequence
  Synthetic Polynucleotide
taatacgactcactatagggttggatgatctggactgaagagtactattgaacagaggagacaatagatgtcttcagtcaacctggcggcagcgcaaaagatg

SEQ ID NO: 174767 - DNA, 103 bp, Artificial Sequence
  Synthetic Polynucleotide
taatacgactcactatagggttttctaggcttggatgatctggactgaagaacagaggagacttcagatgagatcatccaacctggcggcagcgcaaaagatg

SEQ ID NO: 174768 - DNA, 103 bp, Artificial Sequence
  Synthetic Polynucleotide
taatacgactcactatagggctgttccatgttttctaggcttggatgatcaacagaggagagatcatatgagcctagaaaacctggcggcagcgcaaaagatg

SEQ ID NO: 174769 - DNA, 103 bp, Artificial Sequence
  Synthetic Polynucleotide
taatacgactcactatagggatttctctatctgttccatgttttctaggcaacagaggagagcctagatgacatggaacaacctggcggcagcgcaaaagatg

SEQ ID NO: 174770 - DNA, 103 bp, Artificial Sequence
  Synthetic Polynucleotide
taatacgactcactatagggttttcctgaaatttctctatctgttccatgaacagaggagacatggaatggatagagaaaacctggcggcagcgcaaaagatg

SEQ ID NO: 174771 - DNA, 103 bp, Artificial Sequence
  Synthetic Polynucleotide
taatacgactcactatagggcacataagccttttcctgaaatttctctataacagaggagaatagagatgtttcaggaaaacctggcggcagcgcaaaagatg

SEQ ID NO: 174772 - DNA, 103 bp, Artificial Sequence
  Synthetic Polynucleotide
taatacgactcactatagggcttggaattccacataagccttttcctgaaaacagaggagattcaggatgaggcttatgaacctggcggcagcgcaaaagatg

SEQ ID NO: 174773 - DNA, 103 bp, Artificial Sequence
  Synthetic Polynucleotide
taatacgactcactataggggttatataatcttggaattccacataagccaacagaggagaggcttaatgggaattccaaacctggcggcagcgcaaaagatg

SEQ ID NO: 174774 - DNA, 103 bp, Artificial Sequence
  Synthetic Polynucleotide
taatacgactcactatagggggccagaatgactttgcttggagtagagccaacagaggagaggctctatgccaagcaaaaacctggcggcagcgcaaaagatg

SEQ ID NO: 174775 - DNA, 103 bp, Artificial Sequence
  Synthetic Polynucleotide
taatacgactcactatagggatatgttttggttatataatcttggaattcaacagaggagagaattcatggattatataaacctggcggcagcgcaaaagatg

SEQ ID NO: 174776 - DNA, 103 bp, Artificial Sequence
  Synthetic Polynucleotide
taatacgactcactatagggtgtcatctggatatgttttggttatataataacagaggagaattataatgccaaaacataacctggcggcagcgcaaaagatg

SEQ ID NO: 174777 - DNA, 103 bp, Artificial Sequence
  Synthetic Polynucleotide
taatacgactcactatagggaacctgtaggtgtcatctggatatgttttgaacagaggagacaaaacatgtccagatgaaacctggcggcagcgcaaaagatg

SEQ ID NO: 174778 - DNA, 103 bp, Artificial Sequence
  Synthetic Polynucleotide
taatacgactcactatagggtagtctggataacctgtaggtgtcatctggaacagaggagaccagatatgacctacaggaacctggcggcagcgcaaaagatg

SEQ ID NO: 174779 - DNA, 103 bp, Artificial Sequence
  Synthetic Polynucleotide
taatacgactcactatagggatctgagtagtagtctggataacctgtaggaacagaggagacctacaatgtatccagacaacctggcggcagcgcaaaagatg

SEQ ID NO: 174780 - DNA, 103 bp, Artificial Sequence
  Synthetic Polynucleotide
taatacgactcactatagggaaagctggcaatctgagtagtagtctggataacagaggagaatccagatgactactcagaacctggcggcagcgcaaaagatg

SEQ ID NO: 174781 - DNA, 103 bp, Artificial Sequence
  Synthetic Polynucleotide
taatacgactcactatagggcatcagtcttaaagctggcaatctgagtagaacagaggagactactcatgttgccagctaacctggcggcagcgcaaaagatg

SEQ ID NO: 174782 - DNA, 103 bp, Artificial Sequence
  Synthetic Polynucleotide
taatacgactcactatagggtggtagcattcatcagtcttaaagctggcaaacagaggagatgccagatgtaagactgaaacctggcggcagcgcaaaagatg

SEQ ID NO: 174783 - DNA, 103 bp, Artificial Sequence
  Synthetic Polynucleotide
taatacgactcactatagggtcttcagtgatggtagcattcatcagtcttaacagaggagaaagactatggaatgctacaacctggcggcagcgcaaaagatg

SEQ ID NO: 174784 - DNA, 103 bp, Artificial Sequence
  Synthetic Polynucleotide
taatacgactcactataggggaaaaacaattcttcagtgatggtagcattaacagaggagaaatgctatgatcactgaaaacctggcggcagcgcaaaagatg

SEQ ID NO: 174785 - DNA, 103 bp, Artificial Sequence
  Synthetic Polynucleotide
taatacgactcactatagggaatcttgcctggccagaatgactttgcttgaacagaggagacaagcaatgtcattctggaacctggcggcagcgcaaaagatg

SEQ ID NO: 174786 - DNA, 103 bp, Artificial Sequence
  Synthetic Polynucleotide
taatacgactcactatagggtgagacctttgaaaaacaattcttcagtgaaacagaggagatcactgatgaattgttttaacctggcggcagcgcaaaagatg

SEQ ID NO: 174787 - DNA, 103 bp, Artificial Sequence
  Synthetic Polynucleotide
taatacgactcactatagggatattgccaatgagacctttgaaaaacaataacagaggagaattgttatgcaaaggtctaacctggcggcagcgcaaaagatg

SEQ ID NO: 174788 - DNA, 103 bp, Artificial Sequence
  Synthetic Polynucleotide
taatacgactcactataggggtcaattcgtatattgccaatgagacctttaacagaggagaaaaggtatgattggcaataacctggcggcagcgcaaaagatg

SEQ ID NO: 174789 - DNA, 103 bp, Artificial Sequence
  Synthetic Polynucleotide
taatacgactcactatagggggataacactgtcaattcgtatattgccaaaacagaggagattggcaatgtacgaattgaacctggcggcagcgcaaaagatg

SEQ ID NO: 174790 - DNA, 103 bp, Artificial Sequence
  Synthetic Polynucleotide
taatacgactcactatagggaaaatatgtgggataacactgtcaattcgtaacagaggagaacgaatatgcagtgttataacctggcggcagcgcaaaagatg

SEQ ID NO: 174791 - DNA, 103 bp, Artificial Sequence
  Synthetic Polynucleotide
taatacgactcactatagggctccattttcaaaatatgtgggataacactaacagaggagaagtgttatgccacatattaacctggcggcagcgcaaaagatg

SEQ ID NO: 174792 - DNA, 103 bp, Artificial Sequence
  Synthetic Polynucleotide
taatacgactcactatagggaatctgcaggctccattttcaaaatatgtgaacagaggagacacataatgtgaaaatggaacctggcggcagcgcaaaagatg

SEQ ID NO: 174793 - DNA, 103 bp, Artificial Sequence
  Synthetic Polynucleotide
taatacgactcactatagggtgagagttataatctgcaggctccattttcaacagaggagagaaaatatggcctgcagaaacctggcggcagcgcaaaagatg

SEQ ID NO: 174794 - DNA, 103 bp, Artificial Sequence
  Synthetic Polynucleotide
taatacgactcactatagggaccaattatttgagagttataatctgcaggaacagaggagacctgcaatgtataactctaacctggcggcagcgcaaaagatg

SEQ ID NO: 174795 - DNA, 103 bp, Artificial Sequence
  Synthetic Polynucleotide
taatacgactcactatagggaaatgctgtgaccaattatttgagagttataacagaggagaataactatgaaataattgaacctggcggcagcgcaaaagatg

SEQ ID NO: 174796 - DNA, 103 bp, Artificial Sequence
  Synthetic Polynucleotide
taatacgactcactatagggcccggagtggaatcttgcctggccagaatgaacagaggagacattctatgcaggcaagaaacctggcggcagcgcaaaagatg

SEQ ID NO: 174797 - DNA, 103 bp, Artificial Sequence
  Synthetic Polynucleotide
taatacgactcactataggggaaaacttttcccggagtggaatcttgcctaacagaggagaaggcaaatgtccactccgaacctggcggcagcgcaaaagatg

SEQ ID NO: 174798 - DNA, 103 bp, Artificial Sequence
  Synthetic Polynucleotide
taatacgactcactataggggttcaataatttgatgtgcaatttcttctaaacagaggagatagaagatgttgcacatcaacctggcggcagcgcaaaagatg

SEQ ID NO: 174799 - DNA, 103 bp, Artificial Sequence
  Synthetic Polynucleotide
taatacgactcactataggggagttgtaaggaaaacttttcccggagtggaacagaggagaccactcatggaaaagtttaacctggcggcagcgcaaaagatg

SEQ ID NO: 174800 - DNA, 103 bp, Artificial Sequence
  Synthetic Polynucleotide
taatacgactcactataggggctgcatctggagttgtaaggaaaacttttaacagaggagaaaaagtatgccttacaacaacctggcggcagcgcaaaagatg

SEQ ID NO: 174801 - DNA, 103 bp, Artificial Sequence
  Synthetic Polynucleotide
taatacgactcactataggggttgacacctgctgcatctggagttgtaagaacagaggagacttacaatgccagatgcaaacctggcggcagcgcaaaagatg

SEQ ID NO: 174802 - DNA, 103 bp, Artificial Sequence
  Synthetic Polynucleotide
taatacgactcactatagggaaaataactggttgacacctgctgcatctgaacagaggagacagatgatgcaggtgtcaaacctggcggcagcgcaaaagatg

SEQ ID NO: 174803 - DNA, 103 bp, Artificial Sequence
  Synthetic Polynucleotide
taatacgactcactatagggggagtggtaaaaaataactggttgacacctaacagaggagaaggtgtatgccagttattaacctggcggcagcgcaaaagatg

SEQ ID NO: 174804 - DNA, 103 bp, Artificial Sequence
  Synthetic Polynucleotide
taatacgactcactatagggagacagatcaggagtggtaaaaaataactgaacagaggagacagttaatgtttaccactaacctggcggcagcgcaaaagatg

SEQ ID NO: 174805 - DNA, 103 bp, Artificial Sequence
  Synthetic Polynucleotide
taatacgactcactatagggggtgttgtgcagacagatcaggagtggtaaaacagaggagattaccaatgctgatctgtaacctggcggcagcgcaaaagatg

SEQ ID NO: 174806 - DNA, 103 bp, Artificial Sequence
  Synthetic Polynucleotide
taatacgactcactatagggaggagctgcaggtgttgtgcagacagatcaaacagaggagatgatctatgtgcacaacaaacctggcggcagcgcaaaagatg

SEQ ID NO: 174807 - DNA, 103 bp, Artificial Sequence
  Synthetic Polynucleotide
taatacgactcactatagggattatctgttaggagctgcaggtgttgtgcaacagaggagagcacaaatgctgcagctcaacctggcggcagcgcaaaagatg

SEQ ID NO: 174808 - DNA, 103 bp, Artificial Sequence
  Synthetic Polynucleotide
taatacgactcactatagggggtctggagaattatctgttaggagctgcaaacagaggagatgcagcatgtaacagataaacctggcggcagcgcaaaagatg

SEQ ID NO: 174809 - DNA, 103 bp, Artificial Sequence
  Synthetic Polynucleotide
taatacgactcactatagggcccatctgttgttcaataatttgatgtgcaaacagaggagatgcacaatgaattattgaaacctggcggcagcgcaaaagatg

SEQ ID NO: 174810 - DNA, 103 bp, Artificial Sequence
  Synthetic Polynucleotide
taatacgactcactatagggtttggtccttggtctggagaattatctgttaacagaggagaaacagaatgttctccagaaacctggcggcagcgcaaaagatg

SEQ ID NO: 174811 - DNA, 103 bp, Artificial Sequence
  Synthetic Polynucleotide
taatacgactcactatagggaaaaaccttatttggtccttggtctggagaaacagaggagatctccaatgcaaggaccaaacctggcggcagcgcaaaagatg

SEQ ID NO: 174812 - DNA, 103 bp, Artificial Sequence
  Synthetic Polynucleotide
taatacgactcactatagggcgcaaagatcaaaaaccttatttggtccttaacagaggagaaaggacatgataaggtttaacctggcggcagcgcaaaagatg

SEQ ID NO: 174813 - DNA, 103 bp, Artificial Sequence
  Synthetic Polynucleotide
taatacgactcactatagggccacatactacgcaaagatcaaaaaccttaaacagaggagataaggtatgtgatctttgaacctggcggcagcgcaaaagatg

SEQ ID NO: 174814 - DNA, 103 bp, Artificial Sequence
  Synthetic Polynucleotide
taatacgactcactatagggtgctttgtctccacatactacgcaaagatcaacagaggagagatcttatggtagtatgtaacctggcggcagcgcaaaagatg

SEQ ID NO: 174815 - DNA, 103 bp, Artificial Sequence
  Synthetic Polynucleotide
taatacgactcactataggggacgtcctgatgctttgtctccacatactaaacagaggagatagtatatggagacaaagaacctggcggcagcgcaaaagatg

SEQ ID NO: 174816 - DNA, 103 bp, Artificial Sequence
  Synthetic Polynucleotide
taatacgactcactataggggctccataatgacgtcctgatgctttgtctaacagaggagaagacaaatgatcaggacgaacctggcggcagcgcaaaagatg

SEQ ID NO: 174817 - DNA, 103 bp, Artificial Sequence
  Synthetic Polynucleotide
taatacgactcactatagggacaagttactgctccataatgacgtcctgaaacagaggagatcaggaatgcattatggaaacctggcggcagcgcaaaagatg

SEQ ID NO: 174818 - DNA, 103 bp, Artificial Sequence
  Synthetic Polynucleotide
taatacgactcactatagggtgcagccttcacaagttactgctccataataacagaggagaattatgatgcagtaacttaacctggcggcagcgcaaaagatg

SEQ ID NO: 174819 - DNA, 103 bp, Artificial Sequence
  Synthetic Polynucleotide
taatacgactcactatagggaaaaatcctttgcagccttcacaagttactaacagaggagaagtaacatgtgaaggctgaacctggcggcagcgcaaaagatg

SEQ ID NO: 174820 - DNA, 103 bp, Artificial Sequence
  Synthetic Polynucleotide
taatacgactcactatagggaacaatctctcccatctgttgttcaataataacagaggagaattattatgcaacagatgaacctggcggcagcgcaaaagatg

SEQ ID NO: 174821 - DNA, 103 bp, Artificial Sequence
  Synthetic Polynucleotide
taatacgactcactataggggcttcttttaaaaaatcctttgcagccttcaacagaggagagaaggcatgaaaggatttaacctggcggcagcgcaaaagatg

SEQ ID NO: 174822 - DNA, 103 bp, Artificial Sequence
  Synthetic Polynucleotide
taatacgactcactatagggtttttcggatgcttcttttaaaaaatccttaacagaggagaaaggatatgttaaaagaaaacctggcggcagcgcaaaagatg

SEQ ID NO: 174823 - DNA, 103 bp, Artificial Sequence
  Synthetic Polynucleotide
taatacgactcactatagggtatactaaattttttcggatgcttcttttaaacagaggagataaaagatgcatccgaaaaacctggcggcagcgcaaaagatg

SEQ ID NO: 174824 - DNA, 103 bp, Artificial Sequence
  Synthetic Polynucleotide
taatacgactcactatagggtcgacatgaatatactaaattttttcggataacagaggagaatccgaatgaatttagtaaacctggcggcagcgcaaaagatg

SEQ ID NO: 174825 - DNA, 103 bp, Artificial Sequence
  Synthetic Polynucleotide
taatacgactcactatagggcctttgatcctcgacatgaatatactaaataacagaggagaatttagatgattcatgtcaacctggcggcagcgcaaaagatg

SEQ ID NO: 174826 - DNA, 103 bp, Artificial Sequence
  Synthetic Polynucleotide
taatacgactcactatagggataatacaatcctttgatcctcgacatgaaaacagaggagattcatgatgaggatcaaaaacctggcggcagcgcaaaagatg

SEQ ID NO: 174827 - DNA, 103 bp, Artificial Sequence
  Synthetic Polynucleotide
taatacgactcactataggggtgcttattaataatacaatcctttgatccaacagaggagaggatcaatggattgtattaacctggcggcagcgcaaaagatg

SEQ ID NO: 174828 - DNA, 103 bp, Artificial Sequence
  Synthetic Polynucleotide
taatacgactcactatagggggtttcggtggtgcttattaataatacaataacagaggagaattgtaatgttaataagcaacctggcggcagcgcaaaagatg

SEQ ID NO: 174829 - DNA, 103 bp, Artificial Sequence
  Synthetic Polynucleotide
taatacgactcactatagggtattgacagcggtttcggtggtgcttattaaacagaggagataataaatgccaccgaaaaacctggcggcagcgcaaaagatg

SEQ ID NO: 174830 - DNA, 103 bp, Artificial Sequence
  Synthetic Polynucleotide
taatacgactcactatagggtaacctgcagtattgacagcggtttcggtgaacagaggagacaccgaatgcgctgtcaaaacctggcggcagcgcaaaagatg

SEQ ID NO: 174831 - DNA, 103 bp, Artificial Sequence
  Synthetic Polynucleotide
taatacgactcactataggggctgctctgtaacaatctctcccatctgttaacagaggagaaacagaatggagagattgaacctggcggcagcgcaaaagatg

SEQ ID NO: 174832 - DNA, 103 bp, Artificial Sequence
  Synthetic Polynucleotide
taatacgactcactatagggtacatctctgtaacctgcagtattgacagcaacagaggagagctgtcatgactgcaggtaacctggcggcagcgcaaaagatg

SEQ ID NO: 174833 - DNA, 103 bp, Artificial Sequence
  Synthetic Polynucleotide
taatacgactcactatagggccaaacgcaatacatctctgtaacctgcagaacagaggagactgcagatgacagagatgaacctggcggcagcgcaaaagatg

SEQ ID NO: 174834 - DNA, 103 bp, Artificial Sequence
  Synthetic Polynucleotide
taatacgactcactatagggttgcttcattccaaacgcaatacatctctgaacagaggagacagagaatgattgcgtttaacctggcggcagcgcaaaagatg

SEQ ID NO: 174835 - DNA, 103 bp, Artificial Sequence
  Synthetic Polynucleotide
taatacgactcactatagggggacagagtcttgcttcattccaaacgcaaaacagaggagattgcgtatggaatgaagcaacctggcggcagcgcaaaagatg

SEQ ID NO: 174836 - DNA, 103 bp, Artificial Sequence
  Synthetic Polynucleotide
taatacgactcactatagggctttcacattggacagagtcttgcttcattaacagaggagaaatgaaatgagactctgtaacctggcggcagcgcaaaagatg

SEQ ID NO: 174837 - DNA, 103 bp, Artificial Sequence
  Synthetic Polynucleotide
taatacgactcactatagggaatgggttttctttcacattggacagagtcaacagaggagagactctatgcaatgtgaaaacctggcggcagcgcaaaagatg

SEQ ID NO: 174838 - DNA, 103 bp, Artificial Sequence
  Synthetic Polynucleotide
taatacgactcactataggggtgatacttcaatgggttttctttcacattaacagaggagaaatgtgatggaaaacccaaacctggcggcagcgcaaaagatg

SEQ ID NO: 174839 - DNA, 103 bp, Artificial Sequence
  Synthetic Polynucleotide
taatacgactcactataggggatttttctcgtgatacttcaatgggttttaacagaggagaaaaaccatgtgaagtatcaacctggcggcagcgcaaaagatg

SEQ ID NO: 174840 - DNA, 103 bp, Artificial Sequence
  Synthetic Polynucleotide
taatacgactcactatagggacagttggaagatttttctcgtgatacttcaacagaggagagaagtaatgcgagaaaaaaacctggcggcagcgcaaaagatg

SEQ ID NO: 174841 - DNA, 103 bp, Artificial Sequence
  Synthetic Polynucleotide
taatacgactcactatagggttgaagcggcacagttggaagatttttctcaacagaggagagagaaaatgcttccaactaacctggcggcagcgcaaaagatg

SEQ ID NO: 174842 - DNA, 103 bp, Artificial Sequence
  Synthetic Polynucleotide
taatacgactcactatagggtgcccagtttgctgctctgtaacaatctctaacagaggagaagagatatgtacagagcaaacctggcggcagcgcaaaagatg

SEQ ID NO: 174843 - DNA, 103 bp, Artificial Sequence
  Synthetic Polynucleotide
taatacgactcactatagggattttttctgttgaagcggcacagttggaaaacagaggagattccaaatgtgccgcttcaacctggcggcagcgcaaaagatg

SEQ ID NO: 174844 - DNA, 103 bp, Artificial Sequence
  Synthetic Polynucleotide
taatacgactcactatagggtcggatatagattttttctgttgaagcggcaacagaggagagccgctatgacagaaaaaaacctggcggcagcgcaaaagatg

SEQ ID NO: 174845 - DNA, 103 bp, Artificial Sequence
  Synthetic Polynucleotide
taatacgactcactataggggaaggtcctttcggatatagattttttctgaacagaggagacagaaaatgtctatatccaacctggcggcagcgcaaaagatg

SEQ ID NO: 174846 - DNA, 103 bp, Artificial Sequence
  Synthetic Polynucleotide
taatacgactcactatagggaatgggctacgaaggtcctttcggatatagaacagaggagactatatatgaaaggacctaacctggcggcagcgcaaaagatg

SEQ ID NO: 174847 - DNA, 103 bp, Artificial Sequence
  Synthetic Polynucleotide
taatacgactcactatagggagttgcagttaatgggctacgaaggtccttaacagaggagaaaggacatgcgtagcccaaacctggcggcagcgcaaaagatg

SEQ ID NO: 174848 - DNA, 103 bp, Artificial Sequence
  Synthetic Polynucleotide
taatacgactcactatagggcaaaagttggagttgcagttaatgggctacaacagaggagagtagccatgtaactgcaaaacctggcggcagcgcaaaagatg

SEQ ID NO: 174849 - DNA, 103 bp, Artificial Sequence
  Synthetic Polynucleotide
taatacgactcactatagggctatctgttacaaaagttggagttgcagttaacagaggagaaactgcatgtccaactttaacctggcggcagcgcaaaagatg

SEQ ID NO: 174850 - DNA, 103 bp, Artificial Sequence
  Synthetic Polynucleotide
taatacgactcactatagggtgtactttcactatctgttacaaaagttggaacagaggagaccaactatggtaacagataacctggcggcagcgcaaaagatg

SEQ ID NO: 174851 - DNA, 103 bp, Artificial Sequence
  Synthetic Polynucleotide
taatacgactcactatagggctgttgaccttgtactttcactatctgttaaacagaggagataacagatggtgaaagtaaacctggcggcagcgcaaaagatg

SEQ ID NO: 174852 - DNA, 103 bp, Artificial Sequence
  Synthetic Polynucleotide
taatacgactcactatagggtctaacagtcctgttgaccttgtactttcaaacagaggagatgaaagatgaaggtcaacaacctggcggcagcgcaaaagatg

SEQ ID NO: 174853 - DNA, 103 bp, Artificial Sequence
  Synthetic Polynucleotide
taatacgactcactatagggctggattttctgcccagtttgctgctctgtaacagaggagaacagagatgcaaactgggaacctggcggcagcgcaaaagatg

SEQ ID NO: 174854 - DNA, 103 bp, Artificial Sequence
  Synthetic Polynucleotide
taatacgactcactatagggcattcctgaatctaacagtcctgttgacctaacagaggagaaggtcaatgggactgttaaacctggcggcagcgcaaaagatg

SEQ ID NO: 174855 - DNA, 103 bp, Artificial Sequence
  Synthetic Polynucleotide
taatacgactcactatagggtattcatgaacattcctgaatctaacagtcaacagaggagagactgtatgattcaggaaaacctggcggcagcgcaaaagatg

SEQ ID NO: 174856 - DNA, 103 bp, Artificial Sequence
  Synthetic Polynucleotide
taatacgactcactataggggatggatgaatattcatgaacattcctgaaaacagaggagattcaggatggttcatgaaaacctggcggcagcgcaaaagatg

SEQ ID NO: 174857 - DNA, 103 bp, Artificial Sequence
  Synthetic Polynucleotide
taatacgactcactatagggttttactccagatggatgaatattcatgaaaacagaggagattcatgatgattcatccaaacctggcggcagcgcaaaagatg

SEQ ID NO: 174858 - DNA, 103 bp, Artificial Sequence
  Synthetic Polynucleotide
taatacgactcactatagggctgactcagtttttactccagatggatgaaaacagaggagattcatcatgctggagtaaaacctggcggcagcgcaaaagatg

SEQ ID NO: 174859 - DNA, 103 bp, Artificial Sequence
  Synthetic Polynucleotide
taatacgactcactatagggatcagcacagctgactcagtttttactccaaacagaggagatggagtatgaactgagtcaacctggcggcagcgcaaaagatg

SEQ ID NO: 174860 - DNA, 103 bp, Artificial Sequence
  Synthetic Polynucleotide
taatacgactcactatagggatctgatgtcatcagcacagctgactcagtaacagaggagaactgagatggctgtgctgaacctggcggcagcgcaaaagatg

SEQ ID NO: 174861 - DNA, 103 bp, Artificial Sequence
  Synthetic Polynucleotide
taatacgactcactatagggattcagccttatctgatgtcatcagcacagaacagaggagactgtgcatgtgacatcagaacctggcggcagcgcaaaagatg

SEQ ID NO: 174862 - DNA, 103 bp, Artificial Sequence
  Synthetic Polynucleotide
taatacgactcactatagggccctgacatgattcagccttatctgatgtcaacagaggagagacatcatgtaaggctgaaacctggcggcagcgcaaaagatg

SEQ ID NO: 174863 - DNA, 103 bp, Artificial Sequence
  Synthetic Polynucleotide
taatacgactcactatagggacttaaatctccctgacatgattcagccttaacagaggagaaaggctatgtcatgtcagaacctggcggcagcgcaaaagatg

SEQ ID NO: 174864 - DNA, 103 bp, Artificial Sequence
  Synthetic Polynucleotide
taatacgactcactatagggctgtcacaatctggattttctgcccagtttaacagaggagaaaactgatgagaaaatccaacctggcggcagcgcaaaagatg

SEQ ID NO: 174865 - DNA, 103 bp, Artificial Sequence
  Synthetic Polynucleotide
taatacgactcactatagggtggccaatgtacttaaatctccctgacatgaacagaggagacatgtcatggagatttaaaacctggcggcagcgcaaaagatg

SEQ ID NO: 174866 - DNA, 103 bp, Artificial Sequence
  Synthetic Polynucleotide
taatacgactcactataggggtaaccacattggccaatgtacttaaatctaacagaggagaagatttatgtacattggcaacctggcggcagcgcaaaagatg

SEQ ID NO: 174867 - DNA, 103 bp, Artificial Sequence
  Synthetic Polynucleotide
taatacgactcactatagggcgctaatgatgtaaccacattggccaatgtaacagaggagaacattgatgaatgtggttaacctggcggcagcgcaaaagatg

SEQ ID NO: 174868 - DNA, 103 bp, Artificial Sequence
  Synthetic Polynucleotide
taatacgactcactatagggttccaagattcgctaatgatgtaaccacataacagaggagaatgtggatgcatcattagaacctggcggcagcgcaaaagatg

SEQ ID NO: 174869 - DNA, 103 bp, Artificial Sequence
  Synthetic Polynucleotide
taatacgactcactatagggtctttagtttttccaagattcgctaatgataacagaggagaatcattatggaatcttggaacctggcggcagcgcaaaagatg

SEQ ID NO: 174870 - DNA, 103 bp, Artificial Sequence
  Synthetic Polynucleotide
taatacgactcactatagggttgagaaagatctttagtttttccaagattaacagaggagaaatcttatgaaaactaaaaacctggcggcagcgcaaaagatg

SEQ ID NO: 174871 - DNA, 103 bp, Artificial Sequence
  Synthetic Polynucleotide
taatacgactcactatagggcattactattttgagaaagatctttagtttaacagaggagaaaactaatgatctttctcaacctggcggcagcgcaaaagatg

SEQ ID NO: 174872 - DNA, 103 bp, Artificial Sequence
  Synthetic Polynucleotide
taatacgactcactatagggatagacatttcattactattttgagaaagaaacagaggagatctttcatgaaatagtaaaacctggcggcagcgcaaaagatg

SEQ ID NO: 174873 - DNA, 103 bp, Artificial Sequence
  Synthetic Polynucleotide
taatacgactcactataggggctttcaatcatagacatttcattactattaacagaggagaaatagtatggaaatgtctaacctggcggcagcgcaaaagatg

SEQ ID NO: 174874 - DNA, 103 bp, Artificial Sequence
  Synthetic Polynucleotide
taatacgactcactatagggcattgcttaagctttcaatcatagacatttaacagaggagaaaatgtatgtgattgaaaaacctggcggcagcgcaaaagatg

SEQ ID NO: 174875 - DNA, 103 bp, Artificial Sequence
  Synthetic Polynucleotide
taatacgactcactatagggtgatcaagtgctgtcacaatctggattttcaacagaggagagaaaatatggattgtgacaacctggcggcagcgcaaaagatg

SEQ ID NO: 174876 - DNA, 103 bp, Artificial Sequence
  Synthetic Polynucleotide
taatacgactcactataggggaggtatcatcattgcttaagctttcaatcaacagaggagagattgaatgcttaagcaaaacctggcggcagcgcaaaagatg

SEQ ID NO: 174877 - DNA, 103 bp, Artificial Sequence
  Synthetic Polynucleotide
taatacgactcactatagggttcacacaaagaggtatcatcattgcttaaaacagaggagattaagcatggatgataccaacctggcggcagcgcaaaagatg

SEQ ID NO: 174878 - DNA, 103 bp, Artificial Sequence
  Synthetic Polynucleotide
taatacgactcactatagggtttcttgaaattcacacaaagaggtatcataacagaggagaatgataatgctttgtgtgaacctggcggcagcgcaaaagatg

SEQ ID NO: 174879 - DNA, 103 bp, Artificial Sequence
  Synthetic Polynucleotide
taatacgactcactatagggttggtctgcatttcttgaaattcacacaaaaacagaggagatttgtgatgatttcaagaaacctggcggcagcgcaaaagatg

SEQ ID NO: 174880 - DNA, 103 bp, Artificial Sequence
  Synthetic Polynucleotide
taatacgactcactatagggaacatcaccgttggtctgcatttcttgaaaaacagaggagatttcaaatgatgcagaccaacctggcggcagcgcaaaagatg

SEQ ID NO: 174881 - DNA, 103 bp, Artificial Sequence
  Synthetic Polynucleotide
taatacgactcactatagggatgcccttgaaacatcaccgttggtctgcaaacagaggagatgcagaatgacggtgatgaacctggcggcagcgcaaaagatg

SEQ ID NO: 174882 - DNA, 103 bp, Artificial Sequence
  Synthetic Polynucleotide
taatacgactcactatagggagagtgtcaaatgcccttgaaacatcaccgaacagaggagacggtgaatgttcaagggcaacctggcggcagcgcaaaagatg

SEQ ID NO: 174883 - DNA, 103 bp, Artificial Sequence
  Synthetic Polynucleotide
taatacgactcactatagggtgcttttgcaagagtgtcaaatgcccttgaaacagaggagatcaaggatgtttgacactaacctggcggcagcgcaaaagatg

SEQ ID NO: 174884 - DNA, 103 bp, Artificial Sequence
  Synthetic Polynucleotide
taatacgactcactatagggcaggattcaatgcttttgcaagagtgtcaaaacagaggagattgacaatgttgcaaaagaacctggcggcagcgcaaaagatg

SEQ ID NO: 174885 - DNA, 103 bp, Artificial Sequence
  Synthetic Polynucleotide
taatacgactcactataggggtgctctctccaggattcaatgcttttgcaaacagaggagatgcaaaatgattgaatccaacctggcggcagcgcaaaagatg

SEQ ID NO: 174886 - DNA, 103 bp, Artificial Sequence
  Synthetic Polynucleotide
taatacgactcactatagggtatctggatgcgtggggaggggctggtcataacagaggagaatgaccatgccctccccaaacctggcggcagcgcaaaagatg

SEQ ID NO: 174887 - DNA, 103 bp, Artificial Sequence
  Synthetic Polynucleotide
taatacgactcactataggggttcaaagatgtgaaaacactcaatgggccaacagaggagaggcccaatgagtgttttcaacctggcggcagcgcaaaagatg

SEQ ID NO: 174888 - DNA, 103 bp, Artificial Sequence
  Synthetic Polynucleotide
taatacgactcactatagggattaagtgctttagctaaggtatcaaatgcaacagaggagagcatttatgaccttagctaacctggcggcagcgcaaaagatg

SEQ ID NO: 174889 - DNA, 103 bp, Artificial Sequence
  Synthetic Polynucleotide
taatacgactcactatagggtgtctgtggtattaagtgctttagctaaggaacagaggagaccttagatgaagcacttaaacctggcggcagcgcaaaagatg

SEQ ID NO: 174890 - DNA, 103 bp, Artificial Sequence
  Synthetic Polynucleotide
taatacgactcactataggggaagaggagctgtctgtggtattaagtgctaacagaggagaagcactatgtaccacagaaacctggcggcagcgcaaaagatg

SEQ ID NO: 174891 - DNA, 103 bp, Artificial Sequence
  Synthetic Polynucleotide
taatacgactcactatagggcaagcttggagaagaggagctgtctgtggtaacagaggagaaccacaatgagctcctctaacctggcggcagcgcaaaagatg

SEQ ID NO: 174892 - DNA, 103 bp, Artificial Sequence
  Synthetic Polynucleotide
taatacgactcactatagggtcccatctgccaagcttggagaagaggagcaacagaggagagctcctatgctccaagctaacctggcggcagcgcaaaagatg

SEQ ID NO: 174893 - DNA, 103 bp, Artificial Sequence
  Synthetic Polynucleotide
taatacgactcactatagggctggtgtctatcccatctgccaagcttggaaacagaggagatccaagatgggcagatggaacctggcggcagcgcaaaagatg

SEQ ID NO: 174894 - DNA, 103 bp, Artificial Sequence
  Synthetic Polynucleotide
taatacgactcactatagggccctcctccactggtgtctatcccatctgcaacagaggagagcagatatgatagacaccaacctggcggcagcgcaaaagatg

SEQ ID NO: 174895 - DNA, 103 bp, Artificial Sequence
  Synthetic Polynucleotide
taatacgactcactatagggcgtggatgctccctcctccactggtgtctaaacagaggagatagacaatggtggaggagaacctggcggcagcgcaaaagatg

SEQ ID NO: 174896 - DNA, 103 bp, Artificial Sequence
  Synthetic Polynucleotide
taatacgactcactatagggctgctgatgacgtggatgctccctcctccaaacagaggagatggaggatggagcatccaaacctggcggcagcgcaaaagatg

SEQ ID NO: 174897 - DNA, 103 bp, Artificial Sequence
  Synthetic Polynucleotide
taatacgactcactatagggcgactggtctctgctgatgacgtggatgctaacagaggagaagcatcatggtcatcagcaacctggcggcagcgcaaaagatg

SEQ ID NO: 174898 - DNA, 103 bp, Artificial Sequence
  Synthetic Polynucleotide
taatacgactcactatagggtcttctctttgttcaaagatgtgaaaacacaacagaggagagtgtttatgcatctttgaaacctggcggcagcgcaaaagatg

SEQ ID NO: 174899 - DNA, 103 bp, Artificial Sequence
  Synthetic Polynucleotide
taatacgactcactatagggtgatgggtgtcgactggtctctgctgatgaaacagaggagatcatcaatggagaccagtaacctggcggcagcgcaaaagatg

SEQ ID NO: 174900 - DNA, 103 bp, Artificial Sequence
  Synthetic Polynucleotide
taatacgactcactatagggtcaacctcaatgatgggtgtcgactggtctaacagaggagaagaccaatggacacccataacctggcggcagcgcaaaagatg

SEQ ID NO: 174901 - DNA, 103 bp, Artificial Sequence
  Synthetic Polynucleotide
taatacgactcactataggggagggggccttcaacctcaatgatgggtgtaacagaggagaacacccatgattgaggttaacctggcggcagcgcaaaagatg

SEQ ID NO: 174902 - DNA, 103 bp, Artificial Sequence
  Synthetic Polynucleotide
taatacgactcactatagggtgtctgaaaggagggggccttcaacctcaaaacagaggagattgaggatgaaggcccccaacctggcggcagcgcaaaagatg

SEQ ID NO: 174903 - DNA, 103 bp, Artificial Sequence
  Synthetic Polynucleotide
taatacgactcactataggggtgacgtgtgtgtctgaaaggagggggcctaacagaggagaaggcccatgcctttcagaaacctggcggcagcgcaaaagatg

SEQ ID NO: 174904 - DNA, 103 bp, Artificial Sequence
  Synthetic Polynucleotide
taatacgactcactatagggtagcttaaatgtgacgtgtgtgtctgaaagaacagaggagactttcaatgacacacgtcaacctggcggcagcgcaaaagatg

SEQ ID NO: 174905 - DNA, 103 bp, Artificial Sequence
  Synthetic Polynucleotide
taatacgactcactatagggtgggcattgttagcttaaatgtgacgtgtgaacagaggagacacacgatgcatttaagcaacctggcggcagcgcaaaagatg

SEQ ID NO: 174906 - DNA, 103 bp, Artificial Sequence
  Synthetic Polynucleotide
taatacgactcactatagggggcattggactgggcattgttagcttaaataacagaggagaatttaaatgaacaatgccaacctggcggcagcgcaaaagatg

SEQ ID NO: 174907 - DNA, 103 bp, Artificial Sequence
  Synthetic Polynucleotide
taatacgactcactataggggaggtactctggcattggactgggcattgtaacagaggagaacaatgatgagtccaatgaacctggcggcagcgcaaaagatg

SEQ ID NO: 174908 - DNA, 103 bp, Artificial Sequence
  Synthetic Polynucleotide
taatacgactcactatagggagtgcacgttgaggtactctggcattggacaacagaggagagtccaaatgcagagtaccaacctggcggcagcgcaaaagatg

SEQ ID NO: 174909 - DNA, 103 bp, Artificial Sequence
  Synthetic Polynucleotide
taatacgactcactatagggtctgtgacaatcttctctttgttcaaagataacagaggagaatctttatgcaaagagaaaacctggcggcagcgcaaaagatg

SEQ ID NO: 174910 - DNA, 103 bp, Artificial Sequence
  Synthetic Polynucleotide
taatacgactcactatagggtcacagatgtagtgcacgttgaggtactctaacagaggagaagagtaatgcaacgtgcaaacctggcggcagcgcaaaagatg

SEQ ID NO: 174911 - DNA, 103 bp, Artificial Sequence
  Synthetic Polynucleotide
taatacgactcactatagggggatgcagactcacagatgtagtgcacgttaacagaggagaaacgtgatgtacatctgtaacctggcggcagcgcaaaagatg

SEQ ID NO: 174912 - DNA, 103 bp, Artificial Sequence
  Synthetic Polynucleotide
taatacgactcactatagggaaagcagacgggatgcagactcacagatgtaacagaggagaacatctatgagtctgcataacctggcggcagcgcaaaagatg

SEQ ID NO: 174913 - DNA, 103 bp, Artificial Sequence
  Synthetic Polynucleotide
taatacgactcactatagggattgagaggaaaagcagacgggatgcagacaacagaggagagtctgcatgccgtctgctaacctggcggcagcgcaaaagatg

SEQ ID NO: 174914 - DNA, 103 bp, Artificial Sequence
  Synthetic Polynucleotide
taatacgactcactatagggagcccagtgcattgagaggaaaagcagacgaacagaggagacgtctgatgttcctctcaaacctggcggcagcgcaaaagatg

SEQ ID NO: 174915 - DNA, 103 bp, Artificial Sequence
  Synthetic Polynucleotide
taatacgactcactatagggggattgaccgagcccagtgcattgagaggaaacagaggagatcctctatgtgcactgggaacctggcggcagcgcaaaagatg

SEQ ID NO: 174916 - DNA, 103 bp, Artificial Sequence
  Synthetic Polynucleotide
taatacgactcactatagggtgaaaggctgggattgaccgagcccagtgcaacagaggagagcactgatgtcggtcaataacctggcggcagcgcaaaagatg

SEQ ID NO: 174917 - DNA, 103 bp, Artificial Sequence
  Synthetic Polynucleotide
taatacgactcactatagggcccaagtgcctgaaaggctgggattgaccgaacagaggagacggtcaatgccagcctttaacctggcggcagcgcaaaagatg

SEQ ID NO: 174918 - DNA, 103 bp, Artificial Sequence
  Synthetic Polynucleotide
taatacgactcactatagggtgcagtcctgcccaagtgcctgaaaggctgaacagaggagacagcctatgaggcacttgaacctggcggcagcgcaaaagatg

SEQ ID NO: 174919 - DNA, 103 bp, Artificial Sequence
  Synthetic Polynucleotide
taatacgactcactatagggaggctggtgttgcagtcctgcccaagtgccaacagaggagaggcactatggcaggactgaacctggcggcagcgcaaaagatg

SEQ ID NO: 174920 - DNA, 103 bp, Artificial Sequence
  Synthetic Polynucleotide
taatacgactcactatagggtgtctgctggtctgtgacaatcttctctttaacagaggagaaaagagatgattgtcacaaacctggcggcagcgcaaaagatg

SEQ ID NO: 174921 - DNA, 103 bp, Artificial Sequence
  Synthetic Polynucleotide
taatacgactcactatagggggcccgcacaaggctggtgttgcagtcctgaacagaggagacaggacatgaacaccagcaacctggcggcagcgcaaaagatg

SEQ ID NO: 174922 - DNA, 103 bp, Artificial Sequence
  Synthetic Polynucleotide
taatacgactcactatagggcattccagcaggcccgcacaaggctggtgtaacagaggagaacaccaatgttgtgcgggaacctggcggcagcgcaaaagatg

SEQ ID NO: 174923 - DNA, 103 bp, Artificial Sequence
  Synthetic Polynucleotide
taatacgactcactataggggtgaagagctcattccagcaggcccgcacaaacagaggagatgtgcgatgctgctggaaaacctggcggcagcgcaaaagatg

SEQ ID NO: 174924 - DNA, 103 bp, Artificial Sequence
  Synthetic Polynucleotide
taatacgactcactatagggcaggccgagggtgaagagctcattccagcaaacagaggagatgctggatggagctcttcaacctggcggcagcgcaaaagatg

SEQ ID NO: 174925 - DNA, 103 bp, Artificial Sequence
  Synthetic Polynucleotide
taatacgactcactatagggcacactgggccaggccgagggtgaagagctaacagaggagaagctctatgccctcggccaacctggcggcagcgcaaaagatg

SEQ ID NO: 174926 - DNA, 103 bp, Artificial Sequence
  Synthetic Polynucleotide
taatacgactcactatagggatgacctgggcacactgggccaggccgaggaacagaggagacctcggatgggcccagtgaacctggcggcagcgcaaaagatg

SEQ ID NO: 174927 - DNA, 103 bp, Artificial Sequence
  Synthetic Polynucleotide
taatacgactcactatagggggagagactcatgacctgggcacactgggcaacagaggagagcccagatggcccaggtcaacctggcggcagcgcaaaagatg

SEQ ID NO: 174928 - DNA, 103 bp, Artificial Sequence
  Synthetic Polynucleotide
taatacgactcactatagggccaggatggtggagagactcatgacctgggaacagaggagacccaggatgtgagtctctaacctggcggcagcgcaaaagatg

SEQ ID NO: 174929 - DNA, 103 bp, Artificial Sequence
  Synthetic Polynucleotide
taatacgactcactatagggacaatggcagccaggatggtggagagactcaacagaggagagagtctatgcaccatcctaacctggcggcagcgcaaaagatg

SEQ ID NO: 174930 - DNA, 103 bp, Artificial Sequence
  Synthetic Polynucleotide
taatacgactcactatagggcaggtggttgacaatggcagccaggatggtaacagaggagaaccatcatggctgccattaacctggcggcagcgcaaaagatg

SEQ ID NO: 174931 - DNA, 103 bp, Artificial Sequence
  Synthetic Polynucleotide
taatacgactcactatagggttttctgtcctgtctgctggtctgtgacaaaacagaggagattgtcaatgaccagcagaaacctggcggcagcgcaaaagatg

SEQ ID NO: 174932 - DNA, 103 bp, Artificial Sequence
  Synthetic Polynucleotide
taatacgactcactatagggtgctgttctgcaggtggttgacaatggcagaacagaggagactgccaatgtcaaccaccaacctggcggcagcgcaaaagatg

SEQ ID NO: 174933 - DNA, 103 bp, Artificial Sequence
  Synthetic Polynucleotide
taatacgactcactatagggtcttcctggatgctgttctgcaggtggttgaacagaggagacaaccaatggcagaacagaacctggcggcagcgcaaaagatg

SEQ ID NO: 174934 - DNA, 103 bp, Artificial Sequence
  Synthetic Polynucleotide
taatacgactcactatagggagaaagtttatcttcctggatgctgttctgaacagaggagacagaacatgatccaggaaaacctggcggcagcgcaaaagatg

SEQ ID NO: 174935 - DNA, 103 bp, Artificial Sequence
  Synthetic Polynucleotide
taatacgactcactatagggtccggtcaccagaaagtttatcttcctggaaacagaggagatccaggatgataaactttaacctggcggcagcgcaaaagatg

SEQ ID NO: 174936 - DNA, 103 bp, Artificial Sequence
  Synthetic Polynucleotide
taatacgactcactatagggacttgctttatccggtcaccagaaagtttaaacagaggagataaactatgtggtgaccgaacctggcggcagcgcaaaagatg

SEQ ID NO: 174937 - DNA, 103 bp, Artificial Sequence
  Synthetic Polynucleotide
taatacgactcactataggggtgctccatgacttgctttatccggtcaccaacagaggagaggtgacatgataaagcaaaacctggcggcagcgcaaaagatg

SEQ ID NO: 174938 - DNA, 103 bp, Artificial Sequence
  Synthetic Polynucleotide
taatacgactcactataggggcttccagatgtgctccatgacttgctttaaacagaggagataaagcatgtcatggagcaacctggcggcagcgcaaaagatg

SEQ ID NO: 174939 - DNA, 103 bp, Artificial Sequence
  Synthetic Polynucleotide
taatacgactcactatagggaactcctgcagcttccagatgtgctccatgaacagaggagacatggaatgcatctggaaaacctggcggcagcgcaaaagatg

SEQ ID NO: 174940 - DNA, 103 bp, Artificial Sequence
  Synthetic Polynucleotide
taatacgactcactataggggctgttacagaactcctgcagcttccagataacagaggagaatctggatgctgcaggagaacctggcggcagcgcaaaagatg

SEQ ID NO: 174941 - DNA, 103 bp, Artificial Sequence
  Synthetic Polynucleotide
taatacgactcactataggggcttcgccatgctgttacagaactcctgcaaacagaggagatgcaggatgtctgtaacaaacctggcggcagcgcaaaagatg

SEQ ID NO: 174942 - DNA, 103 bp, Artificial Sequence
  Synthetic Polynucleotide
taatacgactcactatagggactatctggattttctgtcctgtctgctggaacagaggagaccagcaatgaggacagaaaacctggcggcagcgcaaaagatg

SEQ ID NO: 174943 - DNA, 103 bp, Artificial Sequence
  Synthetic Polynucleotide
taatacgactcactatagggtctatatccagcttcgccatgctgttacagaacagaggagactgtaaatgcatggcgaaaacctggcggcagcgcaaaagatg

SEQ ID NO: 174944 - DNA, 103 bp, Artificial Sequence
  Synthetic Polynucleotide
taatacgactcactatagggctcatagccatctatatccagcttcgccataacagaggagaatggcgatgctggatataaacctggcggcagcgcaaaagatg

SEQ ID NO: 174945 - DNA, 103 bp, Artificial Sequence
  Synthetic Polynucleotide
taatacgactcactatagggggtatgcatactcatagccatctatatccaaacagaggagatggataatgatggctatgaacctggcggcagcgcaaaagatg

SEQ ID NO: 174946 - DNA, 103 bp, Artificial Sequence
  Synthetic Polynucleotide
taatacgactcactatagggatagctttaaggtatgcatactcatagccaaacagaggagatggctaatggtatgcataaacctggcggcagcgcaaaagatg

SEQ ID NO: 174947 - DNA, 103 bp, Artificial Sequence
  Synthetic Polynucleotide
taatacgactcactatagggaaagagaactatagctttaaggtatgcataaacagaggagatatgcaatgcttaaagctaacctggcggcagcgcaaaagatg

SEQ ID NO: 174948 - DNA, 103 bp, Artificial Sequence
  Synthetic Polynucleotide
taatacgactcactataggggatcggggctaaagagaactatagctttaaaacagaggagattaaagatgtagttctctaacctggcggcagcgcaaaagatg

SEQ ID NO: 174949 - DNA, 103 bp, Artificial Sequence
  Synthetic Polynucleotide
taatacgactcactatagggaaacctggatgatcggggctaaagagaactaacagaggagaagttctatgtagccccgaaacctggcggcagcgcaaaagatg

SEQ ID NO: 174950 - DNA, 103 bp, Artificial Sequence
  Synthetic Polynucleotide
taatacgactcactatagggtgtgctggtcaaacctggatgatcggggctaacagaggagaagccccatgcatccaggtaacctggcggcagcgcaaaagatg

SEQ ID NO: 174951 - DNA, 103 bp, Artificial Sequence
  Synthetic Polynucleotide
taatacgactcactatagggcaatctggcttgtgctggtcaaacctggataacagaggagaatccagatgtgaccagcaaacctggcggcagcgcaaaagatg

SEQ ID NO: 174952 - DNA, 103 bp, Artificial Sequence
  Synthetic Polynucleotide
taatacgactcactatagggtggaatttttcaatctggcttgtgctggtcaacagaggagagaccagatgaagccagataacctggcggcagcgcaaaagatg

SEQ ID NO: 174953 - DNA, 103 bp, Artificial Sequence
  Synthetic Polynucleotide
taatacgactcactatagggcactgcggtgactatctggattttctgtccaacagaggagaggacagatgatccagataaacctggcggcagcgcaaaagatg

SEQ ID NO: 174954 - DNA, 103 bp, Artificial Sequence
  Synthetic Polynucleotide
taatacgactcactatagggtgccttttcttggaatttttcaatctggctaacagaggagaagccagatggaaaaattcaacctggcggcagcgcaaaagatg

SEQ ID NO: 174955 - DNA, 103 bp, Artificial Sequence
  Synthetic Polynucleotide
taatacgactcactatagggactccatctgtgccttttcttggaatttttaacagaggagaaaaaatatgaagaaaaggaacctggcggcagcgcaaaagatg

SEQ ID NO: 174956 - DNA, 103 bp, Artificial Sequence
  Synthetic Polynucleotide
taatacgactcactatagggtagtcctgcaactccatctgtgccttttctaacagaggagaagaaaaatgacagatggaaacctggcggcagcgcaaaagatg

SEQ ID NO: 174957 - DNA, 103 bp, Artificial Sequence
  Synthetic Polynucleotide
taatacgactcactatagggtttctgaacatagtcctgcaactccatctgaacagaggagacagatgatgttgcaggacaacctggcggcagcgcaaaagatg

SEQ ID NO: 174958 - DNA, 103 bp, Artificial Sequence
  Synthetic Polynucleotide
taatacgactcactatagggctgagtaggttttctgaacatagtcctgcaaacagaggagatgcaggatgatgttcagaaacctggcggcagcgcaaaagatg

SEQ ID NO: 174959 - DNA, 103 bp, Artificial Sequence
  Synthetic Polynucleotide
taatacgactcactatagggtaggtgtcttctgagtaggttttctgaacaaacagaggagatgttcaatgaacctactcaacctggcggcagcgcaaaagatg

SEQ ID NO: 174960 - DNA, 103 bp, Artificial Sequence
  Synthetic Polynucleotide
taatacgactcactatagggggccaatcggtaggtgtcttctgagtaggtaacagaggagaacctacatggaagacaccaacctggcggcagcgcaaaagatg

SEQ ID NO: 174961 - DNA, 103 bp, Artificial Sequence
  Synthetic Polynucleotide
taatacgactcactatagggcgaggatccgggccaatcggtaggtgtcttaacagaggagaaagacaatgaccgattggaacctggcggcagcgcaaaagatg

SEQ ID NO: 174962 - DNA, 103 bp, Artificial Sequence
  Synthetic Polynucleotide
taatacgactcactatagggggcaggcgaacgaggatccgggccaatcggaacagaggagaccgattatgccggatcctaacctggcggcagcgcaaaagatg

SEQ ID NO: 174963 - DNA, 103 bp, Artificial Sequence
  Synthetic Polynucleotide
taatacgactcactatagggcctgagtgccggcaggcgaacgaggatccgaacagaggagacggatcatggttcgcctgaacctggcggcagcgcaaaagatg

SEQ ID NO: 174964 - DNA, 103 bp, Artificial Sequence
  Synthetic Polynucleotide
taatacgactcactatagggcggaggcgtccactgcggtgactatctggaaacagaggagatccagaatgtcaccgcagaacctggcggcagcgcaaaagatg

SEQ ID NO: 174965 - DNA, 103 bp, Artificial Sequence
  Synthetic Polynucleotide
taatacgactcactatagggagctcatcagcctgagtgccggcaggcgaaaacagaggagattcgccatgcggcactcaaacctggcggcagcgcaaaagatg

SEQ ID NO: 174966 - DNA, 103 bp, Artificial Sequence
  Synthetic Polynucleotide
taatacgactcactataggggttatgttggagctcatcagcctgagtgccaacagaggagaggcactatggctgatgagaacctggcggcagcgcaaaagatg

SEQ ID NO: 174967 - DNA, 103 bp, Artificial Sequence
  Synthetic Polynucleotide
taatacgactcactatagggaagttcttctgttatgttggagctcatcagaacagaggagactgatgatgtccaacataaacctggcggcagcgcaaaagatg

SEQ ID NO: 174968 - DNA, 103 bp, Artificial Sequence
  Synthetic Polynucleotide
taatacgactcactatagggcagtaaaaaaaagttcttctgttatgttggaacagaggagaccaacaatgcagaagaacaacctggcggcagcgcaaaagatg

SEQ ID NO: 174969 - DNA, 103 bp, Artificial Sequence
  Synthetic Polynucleotide
taatacgactcactatagggccaatgagaccagtaaaaaaaagttcttctaacagaggagaagaagaatgtttttttacaacctggcggcagcgcaaaagatg

SEQ ID NO: 174970 - DNA, 103 bp, Artificial Sequence
  Synthetic Polynucleotide
taatacgactcactatagggcgaaacattgccaatgagaccagtaaaaaaaacagaggagattttttatgggtctcattaacctggcggcagcgcaaaagatg

SEQ ID NO: 174971 - DNA, 103 bp, Artificial Sequence
  Synthetic Polynucleotide
taatacgactcactatagggtgctgtctatcgaaacattgccaatgagacaacagaggagagtctcaatggcaatgtttaacctggcggcagcgcaaaagatg

SEQ ID NO: 174972 - DNA, 103 bp, Artificial Sequence
  Synthetic Polynucleotide
taatacgactcactatagggtaggggattatgctgtctatcgaaacattgaacagaggagacaatgtatggatagacagaacctggcggcagcgcaaaagatg

SEQ ID NO: 174973 - DNA, 103 bp, Artificial Sequence
  Synthetic Polynucleotide
taatacgactcactatagggcttgaggatgtaggggattatgctgtctataacagaggagaatagacatgataatccccaacctggcggcagcgcaaaagatg

SEQ ID NO: 174974 - DNA, 103 bp, Artificial Sequence
  Synthetic Polynucleotide
taatacgactcactatagggctgtctccatcttgaggatgtaggggattaaacagaggagataatccatgacatcctcaaacctggcggcagcgcaaaagatg

SEQ ID NO: 174975 - DNA, 103 bp, Artificial Sequence
  Synthetic Polynucleotide
taatacgactcactatagggttgggggatccggaggcgtccactgcggtgaacagaggagacaccgcatgggacgcctcaacctggcggcagcgcaaaagatg

SEQ ID NO: 174976 - DNA, 103 bp, Artificial Sequence
  Synthetic Polynucleotide
taatacgactcactatagggttatactctgctgtctccatcttgaggatgaacagaggagacatcctatggatggagacaacctggcggcagcgcaaaagatg

SEQ ID NO: 174977 - DNA, 103 bp, Artificial Sequence
  Synthetic Polynucleotide
taatacgactcactataggggatctggccattatactctgctgtctccataacagaggagaatggagatggcagagtataacctggcggcagcgcaaaagatg

SEQ ID NO: 174978 - DNA, 103 bp, Artificial Sequence
  Synthetic Polynucleotide
taatacgactcactatagggtggctccggtgatctggccattatactctgaacagaggagacagagtatgatggccagaaacctggcggcagcgcaaaagatg

SEQ ID NO: 174979 - DNA, 103 bp, Artificial Sequence
  Synthetic Polynucleotide
taatacgactcactataggggaactgctgtttgggggatccggaggcgtcaacagaggagagacgccatgggatcccccaacctggcggcagcgcaaaagatg

SEQ ID NO: 174980 - DNA, 103 bp, Artificial Sequence
  Synthetic Polynucleotide
taatacgactcactatagggcggtggagattatctggatgcgtggggaggaacagaggagacctcccatggcatccagaaacctggcggcagcgcaaaagatg

SEQ ID NO: 174981 - DNA, 103 bp, Artificial Sequence
  Synthetic Polynucleotide
taatacgactcactatagggtggtcaggatgaactgctgtttgggggatcaacagaggagagatcccatgaacagcagtaacctggcggcagcgcaaaagatg

SEQ ID NO: 174982 - DNA, 103 bp, Artificial Sequence
  Synthetic Polynucleotide
taatacgactcactatagggccatctgggctggtcaggatgaactgctgtaacagaggagaacagcaatgcatcctgacaacctggcggcagcgcaaaagatg

SEQ ID NO: 174983 - DNA, 103 bp, Artificial Sequence
  Synthetic Polynucleotide
taatacgactcactatagggagttccagctccatctgggctggtcaggataacagaggagaatcctgatgagcccagataacctggcggcagcgcaaaagatg

SEQ ID NO: 174984 - DNA, 103 bp, Artificial Sequence
  Synthetic Polynucleotide
taatacgactcactatagggtcaccttcccagttccagctccatctgggcaacagaggagagcccagatggagctggaaaacctggcggcagcgcaaaagatg

SEQ ID NO: 174985 - DNA, 103 bp, Artificial Sequence
  Synthetic Polynucleotide
taatacgactcactataggggaagccaggatcaccttcccagttccagctaacagaggagaagctggatgtgggaaggtaacctggcggcagcgcaaaagatg

SEQ ID NO: 174986 - DNA, 103 bp, Artificial Sequence
  Synthetic Polynucleotide
taatacgactcactatagggtgtctctggggaagccaggatcaccttcccaacagaggagagggaagatgatcctggctaacctggcggcagcgcaaaagatg

SEQ ID NO: 174987 - DNA, 103 bp, Artificial Sequence
  Synthetic Polynucleotide
taatacgactcactatagggtggcgctggatgtctctggggaagccaggaaacagaggagatcctggatgccccagagaaacctggcggcagcgcaaaagatg

SEQ ID NO: 174988 - DNA, 103 bp, Artificial Sequence
  Synthetic Polynucleotide
taatacgactcactatagggatgagttgcttggcgctggatgtctctgggaacagaggagacccagaatgatccagcgcaacctggcggcagcgcaaaagatg

SEQ ID NO: 174989 - DNA, 103 bp, Artificial Sequence
  Synthetic Polynucleotide
taatacgactcactatagggggtggtgaatatgagttgcttggcgctggaaacagaggagatccagcatgaagcaactcaacctggcggcagcgcaaaagatg

SEQ ID NO: 174990 - DNA, 103 bp, Artificial Sequence
  Synthetic Polynucleotide
taatacgactcactatagggggttgtctgaggtggtgaatatgagttgctaacagaggagaagcaacatgtattcaccaaacctggcggcagcgcaaaagatg

SEQ ID NO: 174991 - DNA, 103 bp, Artificial Sequence
  Synthetic Polynucleotide
taatacgactcactatagggacagcagagtcggtggagattatctggatgaacagaggagacatccaatgaatctccacaacctggcggcagcgcaaaagatg

SEQ ID NO: 174992 - DNA, 103 bp, Artificial Sequence
  Synthetic Polynucleotide
taatacgactcactatagggccagggacgaggttgtctgaggtggtgaataacagaggagaattcacatgctcagacaaaacctggcggcagcgcaaaagatg

SEQ ID NO: 174993 - DNA, 103 bp, Artificial Sequence
  Synthetic Polynucleotide
taatacgactcactatagggctggatcctgccagggacgaggttgtctgaaacagaggagatcagacatgctcgtccctaacctggcggcagcgcaaaagatg

SEQ ID NO: 174994 - DNA, 103 bp, Artificial Sequence
  Synthetic Polynucleotide
taatacgactcactatagggccgtgacaatctggatcctgccagggacgaaacagaggagatcgtccatggcaggatccaacctggcggcagcgcaaaagatg

SEQ ID NO: 174995 - DNA, 103 bp, Artificial Sequence
  Synthetic Polynucleotide
taatacgactcactataggggaggcagaatccgtgacaatctggatcctgaacagaggagacaggatatggattgtcacaacctggcggcagcgcaaaagatg

SEQ ID NO: 174996 - DNA, 103 bp, Artificial Sequence
  Synthetic Polynucleotide
taatacgactcactatagggacgctccacagaggcagaatccgtgacaataacagaggagaattgtcatggattctgccaacctggcggcagcgcaaaagatg

SEQ ID NO: 174997 - DNA, 103 bp, Artificial Sequence
  Synthetic Polynucleotide
taatacgactcactatagggtccccagtaaacgctccacagaggcagaataacagaggagaattctgatgctgtggagcaacctggcggcagcgcaaaagatg

SEQ ID NO: 174998 - DNA, 103 bp, Artificial Sequence
  Synthetic Polynucleotide
taatacgactcactatagggacgtccgtcttccccagtaaacgctccacaaacagaggagatgtggaatgtttactgggaacctggcggcagcgcaaaagatg

SEQ ID NO: 174999 - DNA, 103 bp, Artificial Sequence
  Synthetic Polynucleotide
taatacgactcactataggggggccgctggacgtccgtcttccccagtaaaacagaggagattactgatgaagacggacaacctggcggcagcgcaaaagatg

SEQ ID NO: 175000 - DNA, 103 bp, Artificial Sequence
  Synthetic Polynucleotide
taatacgactcactatagggctaccacctggggccgctggacgtccgtctaacagaggagaagacggatgtccagcggcaacctggcggcagcgcaaaagatg

SEQ ID NO: 175001 - DNA, 103 bp, Artificial Sequence
  Synthetic Polynucleotide
taatacgactcactatagggacacagtactctaccacctggggccgctggaacagaggagaccagcgatgccaggtggtaacctggcggcagcgcaaaagatg

SEQ ID NO: 175002 - DNA, 103 bp, Artificial Sequence
  Synthetic Polynucleotide
taatacgactcactatagggaggtgaggctacagcagagtcggtggagataacagaggagaatctccatggactctgctaacctggcggcagcgcaaaagatg

SEQ ID NO: 175003 - DNA, 103 bp, Artificial Sequence
  Synthetic Polynucleotide
taatacgactcactataggggccacagaccacacagtactctaccacctgaacagaggagacaggtgatggagtactgtaacctggcggcagcgcaaaagatg

SEQ ID NO: 175004 - DNA, 103 bp, Artificial Sequence
  Synthetic Polynucleotide
taatacgactcactatagggaggctttgtcgccacagaccacacagtactaacagaggagaagtactatgtggtctgtgaacctggcggcagcgcaaaagatg

SEQ ID NO: 175005 - DNA, 103 bp, Artificial Sequence
  Synthetic Polynucleotide
taatacgactcactatagggtgacggccggaggctttgtcgccacagaccaacagaggagaggtctgatgcgacaaagcaacctggcggcagcgcaaaagatg

SEQ ID NO: 175006 - DNA, 103 bp, Artificial Sequence
  Synthetic Polynucleotide
taatacgactcactatagggagccccatagtgacggccggaggctttgtcaacagaggagagacaaaatgtccggccgtaacctggcggcagcgcaaaagatg

SEQ ID NO: 175007 - DNA, 103 bp, Artificial Sequence
  Synthetic Polynucleotide
taatacgactcactatagggcacaactgacagccccatagtgacggccggaacagaggagaccggccatgactatggggaacctggcggcagcgcaaaagatg

SEQ ID NO: 175008 - DNA, 103 bp, Artificial Sequence
  Synthetic Polynucleotide
taatacgactcactatagggttgcaaccttcacaactgacagccccatagaacagaggagactatggatgtgtcagttgaacctggcggcagcgcaaaagatg

SEQ ID NO: 175009 - DNA, 103 bp, Artificial Sequence
  Synthetic Polynucleotide
taatacgactcactataggggaagaaacctttgcaaccttcacaactgacaacagaggagagtcagtatggaaggttgcaacctggcggcagcgcaaaagatg

SEQ ID NO: 175010 - DNA, 103 bp, Artificial Sequence
  Synthetic Polynucleotide
taatacgactcactatagggcactccttttgaagaaacctttgcaaccttaacagaggagaaaggttatgaaggtttctaacctggcggcagcgcaaaagatg

SEQ ID NO: 175011 - DNA, 103 bp, Artificial Sequence
  Synthetic Polynucleotide
taatacgactcactatagggtttttcctcacactccttttgaagaaacctaacagaggagaaggtttatgcaaaaggagaacctggcggcagcgcaaaagatg

SEQ ID NO: 175012 - DNA, 103 bp, Artificial Sequence
  Synthetic Polynucleotide
taatacgactcactataggggtaggtcaaatttttcctcacactccttttaacagaggagaaaaaggatggtgaggaaaaacctggcggcagcgcaaaagatg

SEQ ID NO: 175013 - DNA, 103 bp, Artificial Sequence
  Synthetic Polynucleotide
taatacgactcactataggggaatgcgctgaggtgaggctacagcagagtaacagaggagaactctgatgtagcctcacaacctggcggcagcgcaaaagatg

SEQ ID NO: 175014 - DNA, 103 bp, Artificial Sequence
  Synthetic Polynucleotide
taatacgactcactatagggtccggcagctgtaggtcaaatttttcctcaaacagaggagatgaggaatgatttgacctaacctggcggcagcgcaaaagatg

SEQ ID NO: 175015 - DNA, 103 bp, Artificial Sequence
  Synthetic Polynucleotide
taatacgactcactatagggtcttggttgctccggcagctgtaggtcaaaaacagaggagatttgacatgcagctgccgaacctggcggcagcgcaaaagatg

SEQ ID NO: 175016 - DNA, 103 bp, Artificial Sequence
  Synthetic Polynucleotide
taatacgactcactataggggatgatgcagtcttggttgctccggcagctaacagaggagaagctgcatgagcaaccaaaacctggcggcagcgcaaaagatg

SEQ ID NO: 175017 - DNA, 103 bp, Artificial Sequence
  Synthetic Polynucleotide
taatacgactcactataggggatgtttattgatgatgcagtcttggttgcaacagaggagagcaaccatgactgcatcaaacctggcggcagcgcaaaagatg

SEQ ID NO: 175018 - DNA, 103 bp, Artificial Sequence
  Synthetic Polynucleotide
taatacgactcactatagggcggttccggtgatgtttattgatgatgcagaacagaggagactgcatatgcaataaacaaacctggcggcagcgcaaaagatg

SEQ ID NO: 175019 - DNA, 103 bp, Artificial Sequence
  Synthetic Polynucleotide
taatacgactcactatagggaaactgacagcggttccggtgatgtttattaacagaggagaaataaaatgcaccggaacaacctggcggcagcgcaaaagatg

SEQ ID NO: 175020 - DNA, 103 bp, Artificial Sequence
  Synthetic Polynucleotide
taatacgactcactatagggtcagccggcaaaactgacagcggttccggtaacagaggagaaccggaatggctgtcagtaacctggcggcagcgcaaaagatg

SEQ ID NO: 175021 - DNA, 103 bp, Artificial Sequence
  Synthetic Polynucleotide
taatacgactcactatagggaagcattttttcagccggcaaaactgacagaacagaggagactgtcaatgttgccggctaacctggcggcagcgcaaaagatg

SEQ ID NO: 175022 - DNA, 103 bp, Artificial Sequence
  Synthetic Polynucleotide
taatacgactcactataggggcccatctctaagcattttttcagccggcaaacagaggagatgccggatgaaaaaatgcaacctggcggcagcgcaaaagatg

SEQ ID NO: 175023 - DNA, 103 bp, Artificial Sequence
  Synthetic Polynucleotide
taatacgactcactatagggccattttcatgcccatctctaagcatttttaacagaggagaaaaaatatgtagagatggaacctggcggcagcgcaaaagatg

SEQ ID NO: 175024 - DNA, 103 bp, Artificial Sequence
  Synthetic Polynucleotide
taatacgactcactatagggtcagagccctgaatgcgctgaggtgaggctaacagaggagaagcctcatgtcagcgcataacctggcggcagcgcaaaagatg

SEQ ID NO: 175025 - DNA, 103 bp, Artificial Sequence
  Synthetic Polynucleotide
taatacgactcactatagggtgcacagattccattttcatgcccatctctaacagaggagaagagatatgcatgaaaataacctggcggcagcgcaaaagatg

SEQ ID NO: 175026 - DNA, 103 bp, Artificial Sequence
  Synthetic Polynucleotide
taatacgactcactatagggccgttcactctgcacagattccattttcataacagaggagaatgaaaatggaatctgtgaacctggcggcagcgcaaaagatg

SEQ ID NO: 175027 - DNA, 103 bp, Artificial Sequence
  Synthetic Polynucleotide
taatacgactcactatagggcgaagggcttccgttcactctgcacagattaacagaggagaaatctgatgagagtgaacaacctggcggcagcgcaaaagatg

SEQ ID NO: 175028 - DNA, 103 bp, Artificial Sequence
  Synthetic Polynucleotide
taatacgactcactatagggcgttgcacatcgaagggcttccgttcactcaacagaggagagagtgaatggaagcccttaacctggcggcagcgcaaaagatg

SEQ ID NO: 175029 - DNA, 103 bp, Artificial Sequence
  Synthetic Polynucleotide
taatacgactcactatagggtggtttctcccgttgcacatcgaagggcttaacagaggagaaagcccatggatgtgcaaaacctggcggcagcgcaaaagatg

SEQ ID NO: 175030 - DNA, 103 bp, Artificial Sequence
  Synthetic Polynucleotide
taatacgactcactatagggcacaattgcttggtttctcccgttgcacataacagaggagaatgtgcatggggagaaacaacctggcggcagcgcaaaagatg

SEQ ID NO: 175031 - DNA, 103 bp, Artificial Sequence
  Synthetic Polynucleotide
taatacgactcactataggggttgaagcagcacaattgcttggtttctccaacagaggagaggagaaatgaagcaattgaacctggcggcagcgcaaaagatg

SEQ ID NO: 175032 - DNA, 103 bp, Artificial Sequence
  Synthetic Polynucleotide
taatacgactcactataggggattttctcagttgaagcagcacaattgctaacagaggagaagcaatatggctgcttcaaacctggcggcagcgcaaaagatg

SEQ ID NO: 175033 - DNA, 103 bp, Artificial Sequence
  Synthetic Polynucleotide
taatacgactcactatagggtccggatatagattttctcagttgaagcagaacagaggagactgcttatgctgagaaaaaacctggcggcagcgcaaaagatg

SEQ ID NO: 175034 - DNA, 103 bp, Artificial Sequence
  Synthetic Polynucleotide
taatacgactcactatagggctcaggtctttccggatatagattttctcaaacagaggagatgagaaatgctatatccgaacctggcggcagcgcaaaagatg

SEQ ID NO: 175035 - DNA, 103 bp, Artificial Sequence
  Synthetic Polynucleotide
taatacgactcactatagggagaggcaggttcagagccctgaatgcgctgaacagaggagacagcgcatgcagggctctaacctggcggcagcgcaaaagatg

SEQ ID NO: 175036 - DNA, 103 bp, Artificial Sequence
  Synthetic Polynucleotide
taatacgactcactatagggcaggggacttctcaggtctttccggatataaacagaggagatatatcatgaaagacctgaacctggcggcagcgcaaaagatg

SEQ ID NO: 175037 - DNA, 103 bp, Artificial Sequence
  Synthetic Polynucleotide
taatacgactcactataggggagtagctatcaggggacttctcaggtcttaacagaggagaaagaccatggaagtccccaacctggcggcagcgcaaaagatg

SEQ ID NO: 175038 - DNA, 103 bp, Artificial Sequence
  Synthetic Polynucleotide
taatacgactcactatagggacaaacgtgggagtagctatcaggggacttaacagaggagaaagtccatggatagctacaacctggcggcagcgcaaaagatg

SEQ ID NO: 175039 - DNA, 103 bp, Artificial Sequence
  Synthetic Polynucleotide
taatacgactcactatagggtttgtctgccacaaacgtgggagtagctataacagaggagaatagctatgcccacgtttaacctggcggcagcgcaaaagatg

SEQ ID NO: 175040 - DNA, 103 bp, Artificial Sequence
  Synthetic Polynucleotide
taatacgactcactatagggttgctccatctttgtctgccacaaacgtggaacagaggagaccacgtatgtggcagacaaacctggcggcagcgcaaaagatg

SEQ ID NO: 175041 - DNA, 103 bp, Artificial Sequence
  Synthetic Polynucleotide
taatacgactcactatagggcctgtttgtcttgctccatctttgtctgccaacagaggagaggcagaatgagatggagcaacctggcggcagcgcaaaagatg

SEQ ID NO: 175042 - DNA, 103 bp, Artificial Sequence
  Synthetic Polynucleotide
taatacgactcactatagggatcaagaagacctgtttgtcttgctccatcaacagaggagagatggaatgagacaaacaaacctggcggcagcgcaaaagatg

SEQ ID NO: 175043 - DNA, 103 bp, Artificial Sequence
  Synthetic Polynucleotide
taatacgactcactataggggcatccctggatcaagaagacctgtttgtcaacagaggagagacaaaatggtcttcttgaacctggcggcagcgcaaaagatg

SEQ ID NO: 175044 - DNA, 103 bp, Artificial Sequence
  Synthetic Polynucleotide
taatacgactcactatagggatgttcacaagcatccctggatcaagaagaaacagaggagatcttctatgtccagggataacctggcggcagcgcaaaagatg

SEQ ID NO: 175045 - DNA, 103 bp, Artificial Sequence
  Synthetic Polynucleotide
taatacgactcactatagggaggctgctggatgttcacaagcatccctggaacagaggagaccagggatgcttgtgaacaacctggcggcagcgcaaaagatg

SEQ ID NO: 175046 - DNA, 103 bp, Artificial Sequence
  Synthetic Polynucleotide
taatacgactcactatagggtcaatgggccagaggcaggttcagagccctaacagaggagaagggctatgaacctgcctaacctggcggcagcgcaaaagatg

SEQ ID NO: 175047 - DNA, 103 bp, Artificial Sequence
  Synthetic Polynucleotide
taatacgactcactatagggcacgtatcaaaggctgctggatgttcacaaaacagaggagattgtgaatgtccagcagcaacctggcggcagcgcaaaagatg

SEQ ID NO: 175048 - DNA, 103 bp, Artificial Sequence
  Synthetic Polynucleotide
taatacgactcactataggggtaccatcctcacgtatcaaaggctgctggaacagaggagaccagcaatgtttgatacgaacctggcggcagcgcaaaagatg

SEQ ID NO: 175049 - DNA, 103 bp, Artificial Sequence
  Synthetic Polynucleotide
taatacgactcactatagggcaggagaactgtaccatcctcacgtatcaaaacagaggagattgataatggaggatggtaacctggcggcagcgcaaaagatg

SEQ ID NO: 175050 - DNA, 103 bp, Artificial Sequence
  Synthetic Polynucleotide
taatacgactcactatagggaatccgtggccaggagaactgtaccatcctaacagaggagaaggatgatgcagttctccaacctggcggcagcgcaaaagatg

SEQ ID NO: 175051 - DNA, 103 bp, Artificial Sequence
  Synthetic Polynucleotide
taatacgactcactatagggtcagccttagaatccgtggccaggagaactaacagaggagaagttctatgggccacggaaacctggcggcagcgcaaaagatg

SEQ ID NO: 175052 - DNA, 103 bp, Artificial Sequence
  Synthetic Polynucleotide
taatacgactcactatagggctggcttgtttcagccttagaatccgtggcaacagaggagagccacgatgtctaaggctaacctggcggcagcgcaaaagatg

SEQ ID NO: 175053 - DNA, 103 bp, Artificial Sequence
  Synthetic Polynucleotide
taatacgactcactatagggccagagctccctggcttgtttcagccttagaacagaggagactaaggatgaaacaagccaacctggcggcagcgcaaaagatg

SEQ ID NO: 175054 - DNA, 103 bp, Artificial Sequence
  Synthetic Polynucleotide
taatacgactcactataggggccagtgtgcccagagctccctggcttgttaacagaggagaaacaagatggggagctctaacctggcggcagcgcaaaagatg

SEQ ID NO: 175055 - DNA, 103 bp, Artificial Sequence
  Synthetic Polynucleotide
taatacgactcactatagggcactacatttgccagtgtgcccagagctccaacagaggagaggagctatgggcacactgaacctggcggcagcgcaaaagatg

SEQ ID NO: 175056 - DNA, 103 bp, Artificial Sequence
  Synthetic Polynucleotide
taatacgactcactatagggcaagggaggtcactacatttgccagtgtgcaacagaggagagcacacatgcaaatgtagaacctggcggcagcgcaaaagatg

SEQ ID NO: 175057 - DNA, 103 bp, Artificial Sequence
  Synthetic Polynucleotide
taatacgactcactataggggtgaaaacactcaatgggccagaggcaggtaacagaggagaacctgcatgtggcccattaacctggcggcagcgcaaaagatg

SEQ ID NO: 175058 - DNA, 103 bp, Artificial Sequence
  Synthetic Polynucleotide
taatacgactcactatagggcttaggttggcaagggaggtcactacatttaacagaggagaaaatgtatggacctccctaacctggcggcagcgcaaaagatg

SEQ ID NO: 175059 - DNA, 103 bp, Artificial Sequence
  Synthetic Polynucleotide
taatacgactcactatagggcaaagattcacttaggttggcaagggaggtaacagaggagaacctccatggccaacctaaacctggcggcagcgcaaaagatg

SEQ ID NO: 175060 - DNA, 103 bp, Artificial Sequence
  Synthetic Polynucleotide
taatacgactcactatagggcaccgttgttcaaagattcacttaggttggaacagaggagaccaaccatggtgaatcttaacctggcggcagcgcaaaagatg

SEQ ID NO: 175061 - DNA, 103 bp, Artificial Sequence
  Synthetic Polynucleotide
taatacgactcactatagggtctgaagtgtcaccgttgttcaaagattcaaacagaggagatgaatcatggaacaacggaacctggcggcagcgcaaaagatg

SEQ ID NO: 175062 - DNA, 103 bp, Artificial Sequence
  Synthetic Polynucleotide
taatacgactcactatagggtggctggatttctgaagtgtcaccgttgttaacagaggagaaacaacatggacacttcaaacctggcggcagcgcaaaagatg

SEQ ID NO: 175063 - DNA, 103 bp, Artificial Sequence
  Synthetic Polynucleotide
taatacgactcactatagggactggtcctctggctggatttctgaagtgtaacagaggagaacacttatgaaatccagcaacctggcggcagcgcaaaagatg

SEQ ID NO: 175064 - DNA, 103 bp, Artificial Sequence
  Synthetic Polynucleotide
taatacgactcactatagggtcacttgcagactggtcctctggctggattaacagaggagaaatccaatgagaggaccaaacctggcggcagcgcaaaagatg

SEQ ID NO: 175065 - DNA, 103 bp, Artificial Sequence
  Synthetic Polynucleotide
taatacgactcactatagggccgagttatctcacttgcagactggtcctcaacagaggagagaggacatgtctgcaagtaacctggcggcagcgcaaaagatg

SEQ ID NO: 175066 - DNA, 103 bp, Artificial Sequence
  Synthetic Polynucleotide
taatacgactcactatagggtatcaaatgcccgagttatctcacttgcagaacagaggagactgcaaatgagataactcaacctggcggcagcgcaaaagatg

SEQ ID NO: 175067 - DNA, 103 bp, Artificial Sequence
  Synthetic Polynucleotide
taatacgactcactatagggttagctaaggtatcaaatgcccgagttatcaacagaggagagataacatgggcatttgaaacctggcggcagcgcaaaagatg

SEQ ID NO: 175068 - DNA, 103 bp, Artificial Sequence
  Synthetic Polynucleotide
taatacgactcactataggggctcatcagagctgttggtctggtctccataacagaggagaatggagatgagaccaacaaacctggcggcagcgcaaaagatg

SEQ ID NO: 175069 - DNA, 103 bp, Artificial Sequence
  Synthetic Polynucleotide
taatacgactcactataggggcctgtgggatcctcccccaggccccatctaacagaggagaagatggatgctgggggagaacctggcggcagcgcaaaagatg

SEQ ID NO: 175070 - DNA, 103 bp, Artificial Sequence
  Synthetic Polynucleotide
taatacgactcactatagggctcaggatccttcaggccccgcgtctctggaacagaggagaccagagatgcggggcctgaacctggcggcagcgcaaaagatg

SEQ ID NO: 175071 - DNA, 103 bp, Artificial Sequence
  Synthetic Polynucleotide
taatacgactcactatagggcctctacgtgctcaggatccttcaggccccaacagaggagaggggccatgaggatcctgaacctggcggcagcgcaaaagatg

SEQ ID NO: 175072 - DNA, 103 bp, Artificial Sequence
  Synthetic Polynucleotide
taatacgactcactatagggtcctgcaaggcctctacgtgctcaggatccaacagaggagaggatccatggcacgtagaaacctggcggcagcgcaaaagatg

SEQ ID NO: 175073 - DNA, 103 bp, Artificial Sequence
  Synthetic Polynucleotide
taatacgactcactatagggttgggactggtcctgcaaggcctctacgtgaacagaggagacacgtaatggccttgcagaacctggcggcagcgcaaaagatg

SEQ ID NO: 175074 - DNA, 103 bp, Artificial Sequence
  Synthetic Polynucleotide
taatacgactcactatagggtcagcatcacttgggactggtcctgcaaggaacagaggagaccttgcatgaccagtcccaacctggcggcagcgcaaaagatg

SEQ ID NO: 175075 - DNA, 103 bp, Artificial Sequence
  Synthetic Polynucleotide
taatacgactcactatagggctgtgctggctcagcatcacttgggactggaacagaggagaccagtcatgagtgatgctaacctggcggcagcgcaaaagatg

SEQ ID NO: 175076 - DNA, 103 bp, Artificial Sequence
  Synthetic Polynucleotide
taatacgactcactataggggtgggccttgctgtgctggctcagcatcacaacagaggagagtgatgatgagccagcacaacctggcggcagcgcaaaagatg

SEQ ID NO: 175077 - DNA, 103 bp, Artificial Sequence
  Synthetic Polynucleotide
taatacgactcactatagggggctggggtggtgggccttgctgtgctggcaacagaggagagccagcatggcaaggcccaacctggcggcagcgcaaaagatg

SEQ ID NO: 175078 - DNA, 103 bp, Artificial Sequence
  Synthetic Polynucleotide
taatacgactcactatagggctcacgggctggctggggtggtgggccttgaacagaggagacaaggcatgccaccccagaacctggcggcagcgcaaaagatg

SEQ ID NO: 175079 - DNA, 103 bp, Artificial Sequence
  Synthetic Polynucleotide
taatacgactcactatagggtttcccaaacctcacgggctggctggggtgaacagaggagacaccccatgcagcccgtgaacctggcggcagcgcaaaagatg

SEQ ID NO: 175080 - DNA, 103 bp, Artificial Sequence
  Synthetic Polynucleotide
taatacgactcactatagggaggggctcacgcctgtgggatcctcccccaaacagaggagatgggggatgatcccacagaacctggcggcagcgcaaaagatg

SEQ ID NO: 175081 - DNA, 103 bp, Artificial Sequence
  Synthetic Polynucleotide
taatacgactcactataggggcaggagcaatttcccaaacctcacgggctaacagaggagaagcccgatgggtttgggaaacctggcggcagcgcaaaagatg

SEQ ID NO: 175082 - DNA, 103 bp, Artificial Sequence
  Synthetic Polynucleotide
taatacgactcactataggggacgggaggagcaggagcaatttcccaaacaacagaggagagtttggatgattgctcctaacctggcggcagcgcaaaagatg

SEQ ID NO: 175083 - DNA, 103 bp, Artificial Sequence
  Synthetic Polynucleotide
taatacgactcactatagggaaacctcaaagacgggaggagcaggagcaaaacagaggagattgctcatgctcctcccgaacctggcggcagcgcaaaagatg

SEQ ID NO: 175084 - DNA, 103 bp, Artificial Sequence
  Synthetic Polynucleotide
taatacgactcactatagggccgcagtgataaacctcaaagacgggaggaaacagaggagatcctccatgctttgaggtaacctggcggcagcgcaaaagatg

SEQ ID NO: 175085 - DNA, 103 bp, Artificial Sequence
  Synthetic Polynucleotide
taatacgactcactatagggtcgatgcgttccgcagtgataaacctcaaaaacagaggagatttgagatgtatcactgcaacctggcggcagcgcaaaagatg

SEQ ID NO: 175086 - DNA, 103 bp, Artificial Sequence
  Synthetic Polynucleotide
taatacgactcactatagggaaagaggagctcgatgcgttccgcagtgataacagaggagaatcactatggaacgcatcaacctggcggcagcgcaaaagatg

SEQ ID NO: 175087 - DNA, 103 bp, Artificial Sequence
  Synthetic Polynucleotide
taatacgactcactatagggtcttgcggaaaaagaggagctcgatgcgttaacagaggagaaacgcaatgagctcctctaacctggcggcagcgcaaaagatg

SEQ ID NO: 175088 - DNA, 103 bp, Artificial Sequence
  Synthetic Polynucleotide
taatacgactcactatagggttccctatggtcttgcggaaaaagaggagcaacagaggagagctcctatgtttccgcaaaacctggcggcagcgcaaaagatg

SEQ ID NO: 175089 - DNA, 103 bp, Artificial Sequence
  Synthetic Polynucleotide
taatacgactcactatagggcattggagtattccctatggtcttgcggaaaacagaggagattccgcatgaccatagggaacctggcggcagcgcaaaagatg

SEQ ID NO: 175090 - DNA, 103 bp, Artificial Sequence
  Synthetic Polynucleotide
taatacgactcactatagggggagcttctccattggagtattccctatggaacagaggagaccatagatgatactccaaaacctggcggcagcgcaaaagatg

SEQ ID NO: 175091 - DNA, 103 bp, Artificial Sequence
  Synthetic Polynucleotide
taatacgactcactatagggcactggagcgaggggctcacgcctgtgggaaacagaggagatcccacatgcgtgagcccaacctggcggcagcgcaaaagatg

SEQ ID NO: 175092 - DNA, 103 bp, Artificial Sequence
  Synthetic Polynucleotide
taatacgactcactatagggatatcacaaaggagcttctccattggagtaaacagaggagatactccatgggagaagctaacctggcggcagcgcaaaagatg

SEQ ID NO: 175093 - DNA, 103 bp, Artificial Sequence
  Synthetic Polynucleotide
taatacgactcactataggggtttttgaacatatcacaaaggagcttctcaacagaggagagagaagatgctttgtgataacctggcggcagcgcaaaagatg

SEQ ID NO: 175094 - DNA, 103 bp, Artificial Sequence
  Synthetic Polynucleotide
taatacgactcactataggggcacacgcggcactggagcgaggggctcacaacagaggagagtgagcatgtcgctccagaacctggcggcagcgcaaaagatg

SEQ ID NO: 175095 - DNA, 103 bp, Artificial Sequence
  Synthetic Polynucleotide
taatacgactcactatagggtgctgtctccgcacacgcggcactggagcgaacagaggagacgctccatggccgcgtgtaacctggcggcagcgcaaaagatg

SEQ ID NO: 175096 - DNA, 103 bp, Artificial Sequence
  Synthetic Polynucleotide
taatacgactcactatagggttcccgctgctgctgtctccgcacacgcggaacagaggagaccgcgtatgcggagacagaacctggcggcagcgcaaaagatg

SEQ ID NO: 175097 - DNA, 103 bp, Artificial Sequence
  Synthetic Polynucleotide
taatacgactcactataggggccatagtgcttcccgctgctgctgtctccaacagaggagaggagacatgagcagcgggaacctggcggcagcgcaaaagatg

SEQ ID NO: 175098 - DNA, 103 bp, Artificial Sequence
  Synthetic Polynucleotide
taatacgactcactatagggaggcatagatgccatagtgcttcccgctgcaacagaggagagcagcgatgagcactatgaacctggcggcagcgcaaaagatg

SEQ ID NO: 175099 - DNA, 103 bp, Artificial Sequence
  Synthetic Polynucleotide
taatacgactcactatagggcagccgttgcaggcatagatgccatagtgcaacagaggagagcactaatgcatctatgcaacctggcggcagcgcaaaagatg

SEQ ID NO: 175100 - DNA, 103 bp, Artificial Sequence
  Synthetic Polynucleotide
taatacgactcactataggggaagccgctgcagccgttgcaggcatagataacagaggagaatctatatgtgcaacggcaacctggcggcagcgcaaaagatg

SEQ ID NO: 175101 - DNA, 103 bp, Artificial Sequence
  Synthetic Polynucleotide
taatacgactcactatagggccactgtggagctcatcagagctgttggtcaacagaggagagaccaaatgctctgatgaaacctggcggcagcgcaaaagatg

SEQ ID NO: 175102 - DNA, 103 bp, Artificial Sequence
  Synthetic Polynucleotide
taatacgactcactatagggtcctcttgaagaagccgctgcagccgttgcaacagaggagagcaacgatggcagcggctaacctggcggcagcgcaaaagatg

SEQ ID NO: 175103 - DNA, 103 bp, Artificial Sequence
  Synthetic Polynucleotide
taatacgactcactatagggcgccgtacgctcctcttgaagaagccgctgaacagaggagacagcggatgcttcaagagaacctggcggcagcgcaaaagatg

SEQ ID NO: 175104 - DNA, 103 bp, Artificial Sequence
  Synthetic Polynucleotide
taatacgactcactataggggatgagcctccgccgtacgctcctcttgaaaacagaggagattcaagatgagcgtacggaacctggcggcagcgcaaaagatg

SEQ ID NO: 175105 - DNA, 103 bp, Artificial Sequence
  Synthetic Polynucleotide
taatacgactcactatagggggcacctgtagatgagcctccgccgtacgcaacagaggagagcgtacatgggaggctcaaacctggcggcagcgcaaaagatg

SEQ ID NO: 175106 - DNA, 103 bp, Artificial Sequence
  Synthetic Polynucleotide
taatacgactcactataggggcccccacctggcacctgtagatgagcctcaacagaggagagaggctatgctacaggtgaacctggcggcagcgcaaaagatg

SEQ ID NO: 175107 - DNA, 103 bp, Artificial Sequence
  Synthetic Polynucleotide
taatacgactcactataggggcacatccctgcccccacctggcacctgtaaacagaggagatacaggatgcaggtggggaacctggcggcagcgcaaaagatg

SEQ ID NO: 175108 - DNA, 103 bp, Artificial Sequence
  Synthetic Polynucleotide
taatacgactcactatagggtgtccacggggcacatccctgcccccacctaacagaggagaaggtggatgcagggatgtaacctggcggcagcgcaaaagatg

SEQ ID NO: 175109 - DNA, 103 bp, Artificial Sequence
  Synthetic Polynucleotide
taatacgactcactatagggcggtgggccttgtccacggggcacatccctaacagaggagaagggatatgccccgtggaaacctggcggcagcgcaaaagatg

SEQ ID NO: 175110 - DNA, 103 bp, Artificial Sequence
  Synthetic Polynucleotide
taatacgactcactataggggcactggttgcggtgggccttgtccacgggaacagaggagacccgtgatgaaggcccacaacctggcggcagcgcaaaagatg

SEQ ID NO: 175111 - DNA, 103 bp, Artificial Sequence
  Synthetic Polynucleotide
taatacgactcactatagggggcaggcctggcactggttgcggtgggcctaacagaggagaaggcccatggcaaccagtaacctggcggcagcgcaaaagatg

SEQ ID NO: 175112 - DNA, 103 bp, Artificial Sequence
  Synthetic Polynucleotide
taatacgactcactataggggcagctgcagccactgtggagctcatcagaaacagaggagatctgatatgctccacagtaacctggcggcagcgcaaaagatg

SEQ ID NO: 175113 - DNA, 103 bp, Artificial Sequence
  Synthetic Polynucleotide
taatacgactcactatagggttcttcagccggcaggcctggcactggttgaacagaggagacaaccaatgccaggcctgaacctggcggcagcgcaaaagatg

SEQ ID NO: 175114 - DNA, 103 bp, Artificial Sequence
  Synthetic Polynucleotide
taatacgactcactatagggctgcaggcacttcttcagccggcaggcctgaacagaggagacaggccatgcggctgaagaacctggcggcagcgcaaaagatg

SEQ ID NO: 175115 - DNA, 103 bp, Artificial Sequence
  Synthetic Polynucleotide
taatacgactcactatagggtcatccccgcctgcaggcacttcttcagccaacagaggagaggctgaatgagtgcctgcaacctggcggcagcgcaaaagatg

SEQ ID NO: 175116 - DNA, 103 bp, Artificial Sequence
  Synthetic Polynucleotide
taatacgactcactataggggcgtcctggttcatccccgcctgcaggcacaacagaggagagtgcctatgggcggggataacctggcggcagcgcaaaagatg

SEQ ID NO: 175117 - DNA, 103 bp, Artificial Sequence
  Synthetic Polynucleotide
taatacgactcactataggggttctgcacggcgtcctggttcatccccgcaacagaggagagcggggatgaaccaggacaacctggcggcagcgcaaaagatg

SEQ ID NO: 175118 - DNA, 103 bp, Artificial Sequence
  Synthetic Polynucleotide
taatacgactcactataggggctggcgctcgttctgcacggcgtcctggtaacagaggagaaccaggatgccgtgcagaaacctggcggcagcgcaaaagatg

SEQ ID NO: 175119 - DNA, 103 bp, Artificial Sequence
  Synthetic Polynucleotide
taatacgactcactataggggtgcttcgcggctggcgctcgttctgcacgaacagaggagacgtgcaatgcgagcgccaaacctggcggcagcgcaaaagatg

SEQ ID NO: 175120 - DNA, 103 bp, Artificial Sequence
  Synthetic Polynucleotide
taatacgactcactataggggacctgggctgtgcttcgcggctggcgctcaacagaggagagagcgcatgccgcgaagcaacctggcggcagcgcaaaagatg

SEQ ID NO: 175121 - DNA, 103 bp, Artificial Sequence
  Synthetic Polynucleotide
taatacgactcactatagggtgtccaggtggacctgggctgtgcttcgcgaacagaggagacgcgaaatgcagcccaggaacctggcggcagcgcaaaagatg

SEQ ID NO: 175122 - DNA, 103 bp, Artificial Sequence
  Synthetic Polynucleotide
taatacgactcactataggggactccatgctgtccaggtggacctgggctaacagaggagaagcccaatgccacctggaaacctggcggcagcgcaaaagatg

SEQ ID NO: 175123 - DNA, 103 bp, Artificial Sequence
  Synthetic Polynucleotide
taatacgactcactatagggagctgcaggcgcagctgcagccactgtggaaacagaggagatccacaatggctgcagctaacctggcggcagcgcaaaagatg

SEQ ID NO: 175124 - DNA, 103 bp, Artificial Sequence
  Synthetic Polynucleotide
taatacgactcactatagggctcagtgttggactccatgctgtccaggtgaacagaggagacacctgatgagcatggagaacctggcggcagcgcaaaagatg

SEQ ID NO: 175125 - DNA, 103 bp, Artificial Sequence
  Synthetic Polynucleotide
taatacgactcactatagggccggccgggactcagtgttggactccatgcaacagaggagagcatggatgccaacactgaacctggcggcagcgcaaaagatg

SEQ ID NO: 175126 - DNA, 103 bp, Artificial Sequence
  Synthetic Polynucleotide
taatacgactcactatagggaccagggactccggccgggactcagtgttgaacagaggagacaacacatggtcccggccaacctggcggcagcgcaaaagatg

SEQ ID NO: 175127 - DNA, 103 bp, Artificial Sequence
  Synthetic Polynucleotide
taatacgactcactatagggcgggggagccaccagggactccggccgggaaacagaggagatcccggatggagtccctgaacctggcggcagcgcaaaagatg

SEQ ID NO: 175128 - DNA, 103 bp, Artificial Sequence
  Synthetic Polynucleotide
taatacgactcactatagggctgccggggccgggggagccaccagggactaacagaggagaagtcccatgtggctccccaacctggcggcagcgcaaaagatg

SEQ ID NO: 175129 - DNA, 103 bp, Artificial Sequence
  Synthetic Polynucleotide
taatacgactcactataggggggctgcgccctgccggggccgggggagccaacagaggagaggctccatgggccccggcaacctggcggcagcgcaaaagatg

SEQ ID NO: 175130 - DNA, 103 bp, Artificial Sequence
  Synthetic Polynucleotide
taatacgactcactatagggggggccccgtgggctgcgccctgccggggcaacagaggagagccccgatggggcgcagcaacctggcggcagcgcaaaagatg

SEQ ID NO: 175131 - DNA, 103 bp, Artificial Sequence
  Synthetic Polynucleotide
taatacgactcactatagggacatgggtgtggggccccgtgggctgcgccaacagaggagaggcgcaatgcacggggccaacctggcggcagcgcaaaagatg

SEQ ID NO: 175132 - DNA, 103 bp, Artificial Sequence
  Synthetic Polynucleotide
taatacgactcactatagggctggctgcagacatgggtgtggggccccgtaacagaggagaacggggatgcacacccataacctggcggcagcgcaaaagatg

SEQ ID NO: 175133 - DNA, 103 bp, Artificial Sequence
  Synthetic Polynucleotide
taatacgactcactataggggcccagggctctggctgcagacatgggtgtaacagaggagaacacccatgtctgcagccaacctggcggcagcgcaaaagatg

SEQ ID NO: 175134 - DNA, 103 bp, Artificial Sequence
  Synthetic Polynucleotide
taatacgactcactatagggaggcagccccagctgcaggcgcagctgcagaacagaggagactgcagatgcgcctgcagaacctggcggcagcgcaaaagatg

SEQ ID NO: 175135 - DNA, 103 bp, Artificial Sequence
  Synthetic Polynucleotide
taatacgactcactatagggtgaagtggtggcccagggctctggctgcagaacagaggagactgcagatggagccctggaacctggcggcagcgcaaaagatg

SEQ ID NO: 175136 - DNA, 103 bp, Artificial Sequence
  Synthetic Polynucleotide
taatacgactcactatagggaggctggccatgaagtggtggcccagggctaacagaggagaagccctatgccaccacttaacctggcggcagcgcaaaagatg

SEQ ID NO: 175137 - DNA, 103 bp, Artificial Sequence
  Synthetic Polynucleotide
taatacgactcactatagggagctgttataaggctggccatgaagtggtgaacagaggagacaccacatgatggccagcaacctggcggcagcgcaaaagatg

SEQ ID NO: 175138 - DNA, 103 bp, Artificial Sequence
  Synthetic Polynucleotide
taatacgactcactatagggcacaggtttcagctgttataaggctggccaaacagaggagatggccaatgttataacagaacctggcggcagcgcaaaagatg

SEQ ID NO: 175139 - DNA, 103 bp, Artificial Sequence
  Synthetic Polynucleotide
taatacgactcactatagggtccagcttagcacaggtttcagctgttataaacagaggagatataacatgtgaaacctgaacctggcggcagcgcaaaagatg

SEQ ID NO: 175140 - DNA, 103 bp, Artificial Sequence
  Synthetic Polynucleotide
taatacgactcactatagggatcctctggctccagcttagcacaggtttcaacagaggagagaaaccatggctaagctgaacctggcggcagcgcaaaagatg

SEQ ID NO: 175141 - DNA, 103 bp, Artificial Sequence
  Synthetic Polynucleotide
taatacgactcactatagggtctcatcagcatcctctggctccagcttagaacagaggagactaagcatgagccagaggaacctggcggcagcgcaaaagatg

SEQ ID NO: 175142 - DNA, 103 bp, Artificial Sequence
  Synthetic Polynucleotide
taatacgactcactatagggacatcaatattctcatcagcatcctctggcaacagaggagagccagaatgtgctgatgaaacctggcggcagcgcaaaagatg

SEQ ID NO: 175143 - DNA, 103 bp, Artificial Sequence
  Synthetic Polynucleotide
taatacgactcactatagggattgctggtgacatcaatattctcatcagcaacagaggagagctgatatgaatattgataacctggcggcagcgcaaaagatg

SEQ ID NO: 175144 - DNA, 103 bp, Artificial Sequence
  Synthetic Polynucleotide
taatacgactcactatagggactcagggtcattgctggtgacatcaatataacagaggagaatattgatgtcaccagcaaacctggcggcagcgcaaaagatg

SEQ ID NO: 175145 - DNA, 103 bp, Artificial Sequence
  Synthetic Polynucleotide
taatacgactcactatagggtccttcctggaggcagccccagctgcaggcaacagaggagagcctgcatgtggggctgcaacctggcggcagcgcaaaagatg

SEQ ID NO: 175146 - DNA, 103 bp, Artificial Sequence
  Synthetic Polynucleotide
taatacgactcactataggggaggaggggaactcagggtcattgctggtgaacagaggagacaccagatgtgaccctgaaacctggcggcagcgcaaaagatg

SEQ ID NO: 175147 - DNA, 103 bp, Artificial Sequence
  Synthetic Polynucleotide
taatacgactcactatagggggagtatggagaggaggggaactcagggtcaacagaggagagaccctatgttcccctccaacctggcggcagcgcaaaagatg

SEQ ID NO: 175148 - DNA, 103 bp, Artificial Sequence
  Synthetic Polynucleotide
taatacgactcactataggggggaggaagaggagtatggagaggaggggaaacagaggagatcccctatgctccatactaacctggcggcagcgcaaaagatg

SEQ ID NO: 175149 - DNA, 103 bp, Artificial Sequence
  Synthetic Polynucleotide
taatacgactcactatagggaggccgcagggggaggaagaggagtatggaaacagaggagatccataatgctcttcctcaacctggcggcagcgcaaaagatg

SEQ ID NO: 175150 - DNA, 103 bp, Artificial Sequence
  Synthetic Polynucleotide
taatacgactcactataggggatgctgtccaggccgcagggggaggaagaaacagaggagatcttccatgccctgcggcaacctggcggcagcgcaaaagatg

SEQ ID NO: 175151 - DNA, 103 bp, Artificial Sequence
  Synthetic Polynucleotide
taatacgactcactatagggaggtctcatggatgctgtccaggccgcaggaacagaggagacctgcgatgtggacagcaaacctggcggcagcgcaaaagatg

SEQ ID NO: 175152 - DNA, 103 bp, Artificial Sequence
  Synthetic Polynucleotide
taatacgactcactatagggaggcgagccgaggtctcatggatgctgtccaacagaggagaggacagatgccatgagacaacctggcggcagcgcaaaagatg

SEQ ID NO: 175153 - DNA, 103 bp, Artificial Sequence
  Synthetic Polynucleotide
taatacgactcactatagggcatgaagagtaggcgagccgaggtctcatgaacagaggagacatgagatgtcggctcgcaacctggcggcagcgcaaaagatg

SEQ ID NO: 175154 - DNA, 103 bp, Artificial Sequence
  Synthetic Polynucleotide
taatacgactcactatagggacttgacggccatgaagagtaggcgagccgaacagaggagacggctcatgtactcttcaaacctggcggcagcgcaaaagatg

SEQ ID NO: 175155 - DNA, 103 bp, Artificial Sequence
  Synthetic Polynucleotide
taatacgactcactatagggttcttggcccacttgacggccatgaagagtaacagaggagaactcttatgggccgtcaaaacctggcggcagcgcaaaagatg

SEQ ID NO: 175156 - DNA, 103 bp, Artificial Sequence
  Synthetic Polynucleotide
taatacgactcactataggggcctggagactccttcctggaggcagccccaacagaggagaggggctatgtccaggaagaacctggcggcagcgcaaaagatg

SEQ ID NO: 175157 - DNA, 103 bp, Artificial Sequence
  Synthetic Polynucleotide
taatacgactcactatagggcacaggcaggttcttggcccacttgacggcaacagaggagagccgtcatgtgggccaagaacctggcggcagcgcaaaagatg

SEQ ID NO: 175158 - DNA, 103 bp, Artificial Sequence
  Synthetic Polynucleotide
taatacgactcactatagggggctggagaacacaggcaggttcttggcccaacagaggagagggccaatgacctgcctgaacctggcggcagcgcaaaagatg

SEQ ID NO: 175159 - DNA, 103 bp, Artificial Sequence
  Synthetic Polynucleotide
taatacgactcactatagggcggaagggcaggctggagaacacaggcaggaacagaggagacctgccatggttctccagaacctggcggcagcgcaaaagatg

SEQ ID NO: 175160 - DNA, 103 bp, Artificial Sequence
  Synthetic Polynucleotide
taatacgactcactatagggcacctgatcccggaagggcaggctggagaaaacagaggagattctccatgctgcccttcaacctggcggcagcgcaaaagatg

SEQ ID NO: 175161 - DNA, 103 bp, Artificial Sequence
  Synthetic Polynucleotide
taatacgactcactatagggccagcaggatcacctgatcccggaagggcaaacagaggagatgccctatggggatcaggaacctggcggcagcgcaaaagatg

SEQ ID NO: 175162 - DNA, 103 bp, Artificial Sequence
  Synthetic Polynucleotide
taatacgactcactatagggcacgcctcttccagcaggatcacctgatccaacagaggagaggatcaatggatcctgctaacctggcggcagcgcaaaagatg

SEQ ID NO: 175163 - DNA, 103 bp, Artificial Sequence
  Synthetic Polynucleotide
taatacgactcactataggggagttcactccacgcctcttccagcaggataacagaggagaatcctgatggaagaggcgaacctggcggcagcgcaaaagatg

SEQ ID NO: 175164 - DNA, 103 bp, Artificial Sequence
  Synthetic Polynucleotide
taatacgactcactatagggcgaggagaaagagttcactccacgcctcttaacagaggagaaagaggatgggagtgaacaacctggcggcagcgcaaaagatg

SEQ ID NO: 175165 - DNA, 103 bp, Artificial Sequence
  Synthetic Polynucleotide
taatacgactcactatagggtggatggccccgaggagaaagagttcactcaacagaggagagagtgaatgctttctcctaacctggcggcagcgcaaaagatg

SEQ ID NO: 175166 - DNA, 103 bp, Artificial Sequence
  Synthetic Polynucleotide
taatacgactcactatagggcagagaccactggatggccccgaggagaaaaacagaggagatttctcatgggggccatcaacctggcggcagcgcaaaagatg

SEQ ID NO: 175167 - DNA, 103 bp, Artificial Sequence
  Synthetic Polynucleotide
taatacgactcactatagggggccccatctgcctggagactccttcctggaacagaggagaccaggaatgagtctccagaacctggcggcagcgcaaaagatg

SEQ ID NO: 175168 - DNA, 103 bp, Artificial Sequence
  Synthetic Polynucleotide
taatacgactcactatagggtgtccagaggcagagaccactggatggcccaacagaggagagggccaatgagtggtctcaacctggcggcagcgcaaaagatg

SEQ ID NO: 175169 - DNA, 103 bp, Artificial Sequence
  Synthetic Polynucleotide
taatacgactcactatagggagaggacagctgtccagaggcagagaccacaacagaggagagtggtcatggcctctggaaacctggcggcagcgcaaaagatg

SEQ ID NO: 175170 - DNA, 103 bp, Artificial Sequence
  Synthetic Polynucleotide
taatacgactcactatagggcggtgccagcagaggacagctgtccagaggaacagaggagacctctgatgagctgtcctaacctggcggcagcgcaaaagatg

SEQ ID NO: 175171 - DNA, 103 bp, Artificial Sequence
  Synthetic Polynucleotide
taatacgactcactatagggaggcctcgggcggtgccagcagaggacagcaacagaggagagctgtcatgtgctggcacaacctggcggcagcgcaaaagatg

SEQ ID NO: 175172 - DNA, 103 bp, Artificial Sequence
  Synthetic Polynucleotide
taatacgactcactatagggccggcagcagaggcctcgggcggtgccagcaacagaggagagctggcatggcccgaggcaacctggcggcagcgcaaaagatg

SEQ ID NO: 175173 - DNA, 103 bp, Artificial Sequence
  Synthetic Polynucleotide
taatacgactcactatagggctgggcaccaccggcagcagaggcctcgggaacagaggagacccgagatgtctgctgccaacctggcggcagcgcaaaagatg

SEQ ID NO: 175174 - DNA, 103 bp, Artificial Sequence
  Synthetic Polynucleotide
taatacgactcactatagggtgagccggccctgggcaccaccggcagcagaacagaggagactgctgatggtggtgcccaacctggcggcagcgcaaaagatg

SEQ ID NO: 175175 - DNA, 103 bp, Artificial Sequence
  Synthetic Polynucleotide
taatacgactcactatagggctggccagcgtgagccggccctgggcaccaaacagaggagatggtgcatggggccggctaacctggcggcagcgcaaaagatg

SEQ ID NO: 175176 - DNA, 103 bp, Artificial Sequence
  Synthetic Polynucleotide
taatacgactcactatagggcgtctccatgctggccagcgtgagccggccaacagaggagaggccggatgacgctggccaacctggcggcagcgcaaaagatg

SEQ ID NO: 175177 - DNA, 103 bp, Artificial Sequence
  Synthetic Polynucleotide
taatacgactcactataggggcaggacacgcgtctccatgctggccagcgaacagaggagacgctggatggcatggagaaacctggcggcagcgcaaaagatg

SEQ ID NO: 175178 - DNA, 103 bp, Artificial Sequence
  Synthetic Polynucleotide
taatacgactcactatagggtcctcccccaggccccatctgcctggagacaacagaggagagtctccatgcagatggggaacctggcggcagcgcaaaagatg

SEQ ID NO: 175179 - DNA, 103 bp, Artificial Sequence
  Synthetic Polynucleotide
taatacgactcactatagggatagtttcctgcaggacacgcgtctccatgaacagaggagacatggaatggcgtgtcctaacctggcggcagcgcaaaagatg

SEQ ID NO: 175180 - DNA, 103 bp, Artificial Sequence
  Synthetic Polynucleotide
taatacgactcactataggggaaccgagagatagtttcctgcaggacacgaacagaggagacgtgtcatgcaggaaactaacctggcggcagcgcaaaagatg

SEQ ID NO: 175181 - DNA, 103 bp, Artificial Sequence
  Synthetic Polynucleotide
taatacgactcactatagggccaatgcccggaaccgagagatagtttcctaacagaggagaaggaaaatgtctctcggtaacctggcggcagcgcaaaagatg

SEQ ID NO: 175182 - DNA, 103 bp, Artificial Sequence
  Synthetic Polynucleotide
taatacgactcactataggggggtccaccgccaatgcccggaaccgagagaacagaggagactctcgatgccgggcattaacctggcggcagcgcaaaagatg

SEQ ID NO: 175183 - DNA, 103 bp, Artificial Sequence
  Synthetic Polynucleotide
taatacgactcactatagggaaactccgtggggtccaccgccaatgcccgaacagaggagacgggcaatggcggtggacaacctggcggcagcgcaaaagatg

SEQ ID NO: 175184 - DNA, 103 bp, Artificial Sequence
  Synthetic Polynucleotide
taatacgactcactatagggtcatgcaggcaaactccgtggggtccaccgaacagaggagacggtggatgccacggagtaacctggcggcagcgcaaaagatg

SEQ ID NO: 175185 - DNA, 103 bp, Artificial Sequence
  Synthetic Polynucleotide
taatacgactcactatagggaccaaggccttcatgcaggcaaactccgtgaacagaggagacacggaatgtgcctgcataacctggcggcagcgcaaaagatg

SEQ ID NO: 175186 - DNA, 103 bp, Artificial Sequence
  Synthetic Polynucleotide
taatacgactcactatagggcttgaagaggaccaaggccttcatgcaggcaacagaggagagcctgcatgaaggccttgaacctggcggcagcgcaaaagatg

SEQ ID NO: 175187 - DNA, 103 bp, Artificial Sequence
  Synthetic Polynucleotide
taatacgactcactataggggcgtctctggcttgaagaggaccaaggcctaacagaggagaaggcctatgtcctcttcaaacctggcggcagcgcaaaagatg

SEQ ID NO: 175188 - DNA, 103 bp, Artificial Sequence
  Synthetic Polynucleotide
taatacgactcactatagggttcaggccccgcgtctctggcttgaagaggaacagaggagacctcttatggccagagacaacctggcggcagcgcaaaagatg

SEQ ID NO: 175189 - DNA, 103 bp, Artificial Sequence
  Synthetic Polynucleotide
taatacgactcactatagggatctcgccagctgctaactaccattgccataacagaggagaatggcaatggtagttagcaacctggcggcagcgcaaaagatg

SEQ ID NO: 175190 - DNA, 103 bp, Artificial Sequence
  Synthetic Polynucleotide
taatacgactcactatagggctgctcgccggcgccgccgccgccgccgcgaacagaggagacgcggcatgggcggcggcaacctggcggcagcgcaaaagatg

SEQ ID NO: 175191 - DNA, 103 bp, Artificial Sequence
  Synthetic Polynucleotide
taatacgactcactataggggtgggccgcatccgacaggccacaggcgtcaacagaggagagacgccatgggcctgtcgaacctggcggcagcgcaaaagatg

SEQ ID NO: 175192 - DNA, 103 bp, Artificial Sequence
  Synthetic Polynucleotide
taatacgactcactatagggggctctcgatgtgggccgcatccgacaggcaacagaggagagcctgtatgatgcggcccaacctggcggcagcgcaaaagatg

SEQ ID NO: 175193 - DNA, 103 bp, Artificial Sequence
  Synthetic Polynucleotide
taatacgactcactatagggttctcctgcaggctctcgatgtgggccgcaaacagaggagatgcggcatgcatcgagagaacctggcggcagcgcaaaagatg

SEQ ID NO: 175194 - DNA, 103 bp, Artificial Sequence
  Synthetic Polynucleotide
taatacgactcactataggggcactgcgacttctcctgcaggctctcgataacagaggagaatcgagatgctgcaggagaacctggcggcagcgcaaaagatg

SEQ ID NO: 175195 - DNA, 103 bp, Artificial Sequence
  Synthetic Polynucleotide
taatacgactcactatagggcctccagtgcgcactgcgacttctcctgcaaacagaggagatgcaggatgagtcgcagtaacctggcggcagcgcaaaagatg

SEQ ID NO: 175196 - DNA, 103 bp, Artificial Sequence
  Synthetic Polynucleotide
taatacgactcactatagggctcacgtactcctccagtgcgcactgcgacaacagaggagagtcgcaatgcgcactggaaacctggcggcagcgcaaaagatg

SEQ ID NO: 175197 - DNA, 103 bp, Artificial Sequence
  Synthetic Polynucleotide
taatacgactcactataggggtactggctcctcacgtactcctccagtgcaacagaggagagcactgatggagtacgtgaacctggcggcagcgcaaaagatg

SEQ ID NO: 175198 - DNA, 103 bp, Artificial Sequence
  Synthetic Polynucleotide
taatacgactcactataggggctggttggggtactggctcctcacgtactaacagaggagaagtacgatgggagccagtaacctggcggcagcgcaaaagatg

SEQ ID NO: 175199 - DNA, 103 bp, Artificial Sequence
  Synthetic Polynucleotide
taatacgactcactatagggaaacggctgggctggttggggtactggctcaacagaggagagagccaatgccccaaccaaacctggcggcagcgcaaaagatg

SEQ ID NO: 175200 - DNA, 103 bp, Artificial Sequence
  Synthetic Polynucleotide
taatacgactcactatagggcagtttgccaaaacggctgggctggttgggaacagaggagacccaacatgcccagccgtaacctggcggcagcgcaaaagatg

SEQ ID NO: 175201 - DNA, 103 bp, Artificial Sequence
  Synthetic Polynucleotide
taatacgactcactatagggcctgctgctgctgctcgccggcgccgccgcaacagaggagagcggcgatgccggcgagcaacctggcggcagcgcaaaagatg

SEQ ID NO: 175202 - DNA, 103 bp, Artificial Sequence
  Synthetic Polynucleotide
taatacgactcactataggggtcgcagcagcagtttgccaaaacggctggaacagaggagaccagccatgttggcaaacaacctggcggcagcgcaaaagatg

SEQ ID NO: 175203 - DNA, 103 bp, Artificial Sequence
  Synthetic Polynucleotide
taatacgactcactatagggagcgagggcagtcgcagcagcagtttgccaaacagaggagatggcaaatggctgctgcgaacctggcggcagcgcaaaagatg

SEQ ID NO: 175204 - DNA, 103 bp, Artificial Sequence
  Synthetic Polynucleotide
taatacgactcactatagggcacggtgcgcagcgagggcagtcgcagcagaacagaggagactgctgatgctgccctcgaacctggcggcagcgcaaaagatg

SEQ ID NO: 175205 - DNA, 103 bp, Artificial Sequence
  Synthetic Polynucleotide
taatacgactcactatagggcggaggaggacacggtgcgcagcgagggcaaacagaggagatgccctatgtgcgcaccgaacctggcggcagcgcaaaagatg

SEQ ID NO: 175206 - DNA, 103 bp, Artificial Sequence
  Synthetic Polynucleotide
taatacgactcactatagggtgctcgatgacggaggaggacacggtgcgcaacagaggagagcgcacatggtcctcctcaacctggcggcagcgcaaaagatg

SEQ ID NO: 175207 - DNA, 103 bp, Artificial Sequence
  Synthetic Polynucleotide
taatacgactcactataggggaagaagagctgctcgatgacggaggaggaaacagaggagatcctccatggtcatcgagaacctggcggcagcgcaaaagatg

SEQ ID NO: 175208 - DNA, 103 bp, Artificial Sequence
  Synthetic Polynucleotide
taatacgactcactatagggccaaacggacgaagaagagctgctcgatgaaacagaggagatcatcgatgagctcttctaacctggcggcagcgcaaaagatg

SEQ ID NO: 175209 - DNA, 103 bp, Artificial Sequence
  Synthetic Polynucleotide
taatacgactcactataggggttttacctaccaaacggacgaagaagagcaacagaggagagctcttatgcgtccgtttaacctggcggcagcgcaaaagatg

SEQ ID NO: 175210 - DNA, 103 bp, Artificial Sequence
  Synthetic Polynucleotide
taatacgactcactatagggttcgatgggggttttacctaccaaacggacaacagaggagagtccgtatggtaggtaaaaacctggcggcagcgcaaaagatg

SEQ ID NO: 175211 - DNA, 103 bp, Artificial Sequence
  Synthetic Polynucleotide
taatacgactcactatagggggatgagagtttcgatgggggttttacctaaacagaggagataggtaatgcccccatcgaacctggcggcagcgcaaaagatg

SEQ ID NO: 175212 - DNA, 103 bp, Artificial Sequence
  Synthetic Polynucleotide
taatacgactcactatagggcccgagcccgcctgctgctgctgctcgccgaacagaggagacggcgaatggcagcagcaaacctggcggcagcgcaaaagatg

SEQ ID NO: 175213 - DNA, 103 bp, Artificial Sequence
  Synthetic Polynucleotide
taatacgactcactatagggaacatatcgcggatgagagtttcgatggggaacagaggagaccccatatgaactctcataacctggcggcagcgcaaaagatg

SEQ ID NO: 175214 - DNA, 103 bp, Artificial Sequence
  Synthetic Polynucleotide
taatacgactcactatagggcccagacagtaacatatcgcggatgagagtaacagaggagaactctcatgcgcgatatgaacctggcggcagcgcaaaagatg

SEQ ID NO: 175215 - DNA, 103 bp, Artificial Sequence
  Synthetic Polynucleotide
taatacgactcactatagggtgaagctgctcccagacagtaacatatcgcaacagaggagagcgataatgtactgtctgaacctggcggcagcgcaaaagatg

SEQ ID NO: 175216 - DNA, 103 bp, Artificial Sequence
  Synthetic Polynucleotide
taatacgactcactatagggtaaggccagttgaagctgctcccagacagtaacagaggagaactgtcatggagcagcttaacctggcggcagcgcaaaagatg

SEQ ID NO: 175217 - DNA, 103 bp, Artificial Sequence
  Synthetic Polynucleotide
taatacgactcactataggggatggacatgtaaggccagttgaagctgctaacagaggagaagcagcatgaactggcctaacctggcggcagcgcaaaagatg

SEQ ID NO: 175218 - DNA, 103 bp, Artificial Sequence
  Synthetic Polynucleotide
taatacgactcactatagggaggagcactggatggacatgtaaggccagtaacagaggagaactggcatgacatgtccaaacctggcggcagcgcaaaagatg

SEQ ID NO: 175219 - DNA, 103 bp, Artificial Sequence
  Synthetic Polynucleotide
taatacgactcactataggggtgcggcgcgcccgagcccgcctgctgctgaacagaggagacagcagatggcgggctcgaacctggcggcagcgcaaaagatg

SEQ ID NO: 175220 - DNA, 103 bp, Artificial Sequence
  Synthetic Polynucleotide
taatacgactcactatagggtctgcggcgtgtgcggcgcgcccgagcccgaacagaggagacgggctatggcgcgccgcaacctggcggcagcgcaaaagatg

SEQ ID NO: 175221 - DNA, 103 bp, Artificial Sequence
  Synthetic Polynucleotide
taatacgactcactatagggtggcccggggtctgcggcgtgtgcggcgcgaacagaggagacgcgccatgcacgccgcaaacctggcggcagcgcaaaagatg

SEQ ID NO: 175222 - DNA, 103 bp, Artificial Sequence
  Synthetic Polynucleotide
taatacgactcactatagggcgctccgggctggcccggggtctgcggcgtaacagaggagaacgccgatgaccccgggcaacctggcggcagcgcaaaagatg

SEQ ID NO: 175223 - DNA, 103 bp, Artificial Sequence
  Synthetic Polynucleotide
taatacgactcactataggggggtggcgggcgctccgggctggcccggggaacagaggagaccccggatgagcccggagaacctggcggcagcgcaaaagatg

SEQ ID NO: 175224 - DNA, 103 bp, Artificial Sequence
  Synthetic Polynucleotide
taatacgactcactataggggccgtgccgggggtggcgggcgctccgggcaacagaggagagcccggatggcccgccacaacctggcggcagcgcaaaagatg

SEQ ID NO: 175225 - DNA, 103 bp, Artificial Sequence
  Synthetic Polynucleotide
taatacgactcactatagggcttgtcccccgccgtgccgggggtggcgggaacagaggagacccgccatgcccggcacgaacctggcggcagcgcaaaagatg

SEQ ID NO: 175226 - DNA, 103 bp, Artificial Sequence
  Synthetic Polynucleotide
taatacgactcactatagggcgtcctgcggatctcgccagctgctaactaaacagaggagatagttaatggctggcgagaacctggcggcagcgcaaaagatg

SEQ ID NO: 175227 - DNA, 103 bp, Artificial Sequence
  Synthetic Polynucleotide
taatacgactcactatagggggccctggcccttgtcccccgccgtgccggaacagaggagaccggcaatgcgggggacaaacctggcggcagcgcaaaagatg

SEQ ID NO: 175228 - DNA, 103 bp, Artificial Sequence
  Synthetic Polynucleotide
taatacgactcactataggggaaccgggcgggccctggcccttgtcccccaacagaggagagggggaatggggccagggaacctggcggcagcgcaaaagatg

SEQ ID NO: 175229 - DNA, 103 bp, Artificial Sequence
  Synthetic Polynucleotide
taatacgactcactataggggctctggcccgaaccgggcgggccctggccaacagaggagaggccagatgccgcccggtaacctggcggcagcgcaaaagatg

SEQ ID NO: 175230 - DNA, 103 bp, Artificial Sequence
  Synthetic Polynucleotide
taatacgactcactatagggtgtgctgctggctctggcccgaaccgggcgaacagaggagacgcccgatgcgggccagaaacctggcggcagcgcaaaagatg

SEQ ID NO: 175231 - DNA, 103 bp, Artificial Sequence
  Synthetic Polynucleotide
taatacgactcactatagggacgcactcgatgtgctgctggctctggcccaacagaggagagggccaatgccagcagcaaacctggcggcagcgcaaaagatg

SEQ ID NO: 175232 - DNA, 103 bp, Artificial Sequence
  Synthetic Polynucleotide
taatacgactcactatagggcccgcacaccacgcactcgatgtgctgctgaacagaggagacagcagatgatcgagtgcaacctggcggcagcgcaaaagatg

SEQ ID NO: 175233 - DNA, 103 bp, Artificial Sequence
  Synthetic Polynucleotide
taatacgactcactatagggtcgacttgtccccgcacaccacgcactcgaaacagaggagatcgagtatgtggtgtgcgaacctggcggcagcgcaaaagatg

SEQ ID NO: 175234 - DNA, 103 bp, Artificial Sequence
  Synthetic Polynucleotide
taatacgactcactatagggtgcttgccgctcgacttgtccccgcacaccaacagaggagaggtgtgatgggacaagtcaacctggcggcagcgcaaaagatg

SEQ ID NO: 175235 - DNA, 103 bp, Artificial Sequence
  Synthetic Polynucleotide
taatacgactcactatagggttggccgtagtgcttgccgctcgacttgtcaacagaggagagacaagatgagcggcaagaacctggcggcagcgcaaaagatg

SEQ ID NO: 175236 - DNA, 103 bp, Artificial Sequence
  Synthetic Polynucleotide
taatacgactcactatagggcgcaggtgaattggccgtagtgcttgccgcaacagaggagagcggcaatgactacggccaacctggcggcagcgcaaaagatg

SEQ ID NO: 175237 - DNA, 103 bp, Artificial Sequence
  Synthetic Polynucleotide
taatacgactcactatagggccggccacgtcgtcctgcggatctcgccagaacagaggagactggcgatgtccgcaggaaacctggcggcagcgcaaaagatg

SEQ ID NO: 175238 - DNA, 103 bp, Artificial Sequence
  Synthetic Polynucleotide
taatacgactcactatagggttgcagccctcgcaggtgaattggccgtagaacagaggagactacggatgattcacctgaacctggcggcagcgcaaaagatg

SEQ ID NO: 175239 - DNA, 103 bp, Artificial Sequence
  Synthetic Polynucleotide
taatacgactcactataggggaagaaacttttgcagccctcgcaggtgaaaacagaggagattcaccatggagggctgcaacctggcggcagcgcaaaagatg

SEQ ID NO: 175240 - DNA, 103 bp, Artificial Sequence
  Synthetic Polynucleotide
taatacgactcactatagggcgctcctcttgaagaaacttttgcagccctaacagaggagaagggctatgaaagtttctaacctggcggcagcgcaaaagatg

SEQ ID NO: 175241 - DNA, 103 bp, Artificial Sequence
  Synthetic Polynucleotide
taatacgactcactatagggttcctgcggacgctcctcttgaagaaacttaacagaggagaaagtttatgcaagaggagaacctggcggcagcgcaaaagatg

SEQ ID NO: 175242 - DNA, 103 bp, Artificial Sequence
  Synthetic Polynucleotide
taatacgactcactataggggtaagttaagttcctgcggacgctcctcttaacagaggagaaagaggatggtccgcaggaacctggcggcagcgcaaaagatg

SEQ ID NO: 175243 - DNA, 103 bp, Artificial Sequence
  Synthetic Polynucleotide
taatacgactcactatagggcacggcatgtgtaagttaagttcctgcggaaacagaggagatccgcaatgacttaacttaacctggcggcagcgcaaaagatg

SEQ ID NO: 175244 - DNA, 103 bp, Artificial Sequence
  Synthetic Polynucleotide
taatacgactcactatagggttcctgttggcacggcatgtgtaagttaagaacagaggagacttaacatgcacatgccgaacctggcggcagcgcaaaagatg

SEQ ID NO: 175245 - DNA, 103 bp, Artificial Sequence
  Synthetic Polynucleotide
taatacgactcactataggggatgggacagttcctgttggcacggcatgtaacagaggagaacatgcatggccaacaggaacctggcggcagcgcaaaagatg

SEQ ID NO: 175246 - DNA, 103 bp, Artificial Sequence
  Synthetic Polynucleotide
taatacgactcactatagggggtgctggtcgatgggacagttcctgttggaacagaggagaccaacaatgactgtcccaaacctggcggcagcgcaaaagatg

SEQ ID NO: 175247 - DNA, 103 bp, Artificial Sequence
  Synthetic Polynucleotide
taatacgactcactatagggtggttgcggtggtgctggtcgatgggacagaacagaggagactgtccatgcgaccagcaaacctggcggcagcgcaaaagatg

SEQ ID NO: 175248 - DNA, 103 bp, Artificial Sequence
  Synthetic Polynucleotide
taatacgactcactatagggggggttgcccccggccacgtcgtcctgcggaacagaggagaccgcagatggacgtggccaacctggcggcagcgcaaaagatg

SEQ ID NO: 175249 - DNA, 103 bp, Artificial Sequence
  Synthetic Polynucleotide
taatacgactcactataggggtattggcactggttgcggtggtgctggtcaacagaggagagaccagatgcaccgcaacaacctggcggcagcgcaaaagatg

SEQ ID NO: 175250 - DNA, 103 bp, Artificial Sequence
  Synthetic Polynucleotide
taatacgactcactatagggtgaggcggcagtattggcactggttgcggtaacagaggagaaccgcaatgagtgccaataacctggcggcagcgcaaaagatg

SEQ ID NO: 175251 - DNA, 103 bp, Artificial Sequence
  Synthetic Polynucleotide
taatacgactcactatagggaggcacttcttgaggcggcagtattggcacaacagaggagagtgccaatgctgccgcctaacctggcggcagcgcaaaagatg

SEQ ID NO: 175252 - DNA, 103 bp, Artificial Sequence
  Synthetic Polynucleotide
taatacgactcactataggggcccactttgaggcacttcttgaggcggcaaacagaggagatgccgcatgaagaagtgcaacctggcggcagcgcaaaagatg

SEQ ID NO: 175253 - DNA, 103 bp, Artificial Sequence
  Synthetic Polynucleotide
taatacgactcactatagggcccgcctcatgcccactttgaggcacttctaacagaggagaagaagtatgtcaaagtggaacctggcggcagcgcaaaagatg

SEQ ID NO: 175254 - DNA, 103 bp, Artificial Sequence
  Synthetic Polynucleotide
taatacgactcactatagggtgaaccgcttcccgcctcatgcccactttgaacagaggagacaaagtatgcatgaggcgaacctggcggcagcgcaaaagatg

SEQ ID NO: 175255 - DNA, 103 bp, Artificial Sequence
  Synthetic Polynucleotide
taatacgactcactatagggtcttcctcgctgaaccgcttcccgcctcataacagaggagaatgaggatggaagcggttaacctggcggcagcgcaaaagatg

SEQ ID NO: 175256 - DNA, 103 bp, Artificial Sequence
  Synthetic Polynucleotide
taatacgactcactatagggttggaggcattcttcctcgctgaaccgcttaacagaggagaaagcggatgagcgaggaaaacctggcggcagcgcaaaagatg

SEQ ID NO: 175257 - DNA, 103 bp, Artificial Sequence
  Synthetic Polynucleotide
taatacgactcactatagggttgggctgggttggaggcattcttcctcgcaacagaggagagcgaggatgaatgcctccaacctggcggcagcgcaaaagatg

SEQ ID NO: 175258 - DNA, 103 bp, Artificial Sequence
  Synthetic Polynucleotide
taatacgactcactatagggctggcctggattgggctgggttggaggcataacagaggagaatgcctatgacccagcccaacctggcggcagcgcaaaagatg

SEQ ID NO: 175259 - DNA, 103 bp, Artificial Sequence
  Synthetic Polynucleotide
taatacgactcactatagggtggggccgccggggttgcccccggccacgtaacagaggagaacgtggatgggggcaaccaacctggcggcagcgcaaaagatg

SEQ ID NO: 175260 - DNA, 103 bp, Artificial Sequence
  Synthetic Polynucleotide
taatacgactcactatagggtgagtgcgtactggcctggattgggctgggaacagaggagacccagcatgatccaggccaacctggcggcagcgcaaaagatg

SEQ ID NO: 175261 - DNA, 103 bp, Artificial Sequence
  Synthetic Polynucleotide
taatacgactcactatagggtccccgttggtgagtgcgtactggcctggaaacagaggagatccaggatggtacgcactaacctggcggcagcgcaaaagatg

SEQ ID NO: 175262 - DNA, 103 bp, Artificial Sequence
  Synthetic Polynucleotide
taatacgactcactataggggttgagggggtccccgttggtgagtgcgtaaacagaggagatacgcaatgaccaacgggaacctggcggcagcgcaaaagatg

SEQ ID NO: 175263 - DNA, 103 bp, Artificial Sequence
  Synthetic Polynucleotide
taatacgactcactatagggagcagtggccgttgagggggtccccgttggaacagaggagaccaacgatgaccccctcaaacctggcggcagcgcaaaagatg

SEQ ID NO: 175264 - DNA, 103 bp, Artificial Sequence
  Synthetic Polynucleotide
taatacgactcactatagggccggacaggtagcagtggccgttgagggggaacagaggagaccccctatgcggccactgaacctggcggcagcgcaaaagatg

SEQ ID NO: 175265 - DNA, 103 bp, Artificial Sequence
  Synthetic Polynucleotide
taatacgactcactatagggcgagatgtagccggacaggtagcagtggccaacagaggagaggccacatgtacctgtccaacctggcggcagcgcaaaagatg

SEQ ID NO: 175266 - DNA, 103 bp, Artificial Sequence
  Synthetic Polynucleotide
taatacgactcactataggggcagcagcagcgagatgtagccggacaggtaacagaggagaacctgtatggctacatctaacctggcggcagcgcaaaagatg

SEQ ID NO: 175267 - DNA, 103 bp, Artificial Sequence
  Synthetic Polynucleotide
taatacgactcactatagggggctcggcgcgcagcagcagcgagatgtagaacagaggagactacatatggctgctgctaacctggcggcagcgcaaaagatg

SEQ ID NO: 175268 - DNA, 103 bp, Artificial Sequence
  Synthetic Polynucleotide
taatacgactcactatagggcgtggggtagggctcggcgcgcagcagcagaacagaggagactgctgatgcgcgccgagaacctggcggcagcgcaaaagatg

SEQ ID NO: 175269 - DNA, 103 bp, Artificial Sequence
  Synthetic Polynucleotide
taatacgactcactatagggcgtagcgcgacgtggggtagggctcggcgcaacagaggagagcgccgatgcctaccccaaacctggcggcagcgcaaaagatg

SEQ ID NO: 175270 - DNA, 103 bp, Artificial Sequence
  Synthetic Polynucleotide
taatacgactcactataggggctgcggggttggggccgccggggttgcccaacagaggagagggcaaatgcggcggcccaacctggcggcagcgcaaaagatg

SEQ ID NO: 175271 - DNA, 103 bp, Artificial Sequence
  Synthetic Polynucleotide
taatacgactcactatagggcactggctgccgtagcgcgacgtggggtagaacagaggagactacccatggtcgcgctaaacctggcggcagcgcaaaagatg

SEQ ID NO: 175272 - DNA, 103 bp, Artificial Sequence
  Synthetic Polynucleotide
taatacgactcactataggggggctgcatgcactggctgccgtagcgcgaaacagaggagatcgcgcatgggcagccagaacctggcggcagcgcaaaagatg

SEQ ID NO: 175273 - DNA, 103 bp, Artificial Sequence
  Synthetic Polynucleotide
taatacgactcactatagggtaatgttgttgggctgcatgcactggctgcaacagaggagagcagccatggcatgcagcaacctggcggcagcgcaaaagatg

SEQ ID NO: 175274 - DNA, 103 bp, Artificial Sequence
  Synthetic Polynucleotide
taatacgactcactatagggtcgatgcccataatgttgttgggctgcatgaacagaggagacatgcaatgcaacaacataacctggcggcagcgcaaaagatg

SEQ ID NO: 175275 - DNA, 103 bp, Artificial Sequence
  Synthetic Polynucleotide
taatacgactcactataggggcagatgttctcgatgcccataatgttgttaacagaggagaaacaacatgatgggcatcaacctggcggcagcgcaaaagatg

SEQ ID NO: 175276 - DNA, 103 bp, Artificial Sequence
  Synthetic Polynucleotide
taatacgactcactatagggcggccagctcgcagatgttctcgatgcccaaacagaggagatgggcaatgagaacatctaacctggcggcagcgcaaaagatg

SEQ ID NO: 175277 - DNA, 103 bp, Artificial Sequence
  Synthetic Polynucleotide
taatacgactcactatagggagcaggcgcgcggccagctcgcagatgttcaacagaggagagaacatatgcgagctggcaacctggcggcagcgcaaaagatg

SEQ ID NO: 175278 - DNA, 103 bp, Artificial Sequence
  Synthetic Polynucleotide
taatacgactcactatagggggcgctgaagagcaggcgcgcggccagctcaacagaggagagagctgatggcgcgcctgaacctggcggcagcgcaaaagatg

SEQ ID NO: 175279 - DNA, 103 bp, Artificial Sequence
  Synthetic Polynucleotide
taatacgactcactatagggcccactcgacggcgctgaagagcaggcgcgaacagaggagacgcgccatgtcttcagcgaacctggcggcagcgcaaaagatg

SEQ ID NO: 175280 - DNA, 103 bp, Artificial Sequence
  Synthetic Polynucleotide
taatacgactcactatagggatgttgcgggcccactcgacggcgctgaagaacagaggagacttcagatgcgtcgagtgaacctggcggcagcgcaaaagatg

SEQ ID NO: 175281 - DNA, 103 bp, Artificial Sequence
  Synthetic Polynucleotide
taatacgactcactatagggggccgcctgcgctgcggggttggggccgccaacagaggagaggcggcatgaaccccgcaaacctggcggcagcgcaaaagatg

SEQ ID NO: 175282 - DNA, 103 bp, Artificial Sequence
  Synthetic Polynucleotide
taatacgactcactataggggaagaaggggatgttgcgggcccactcgacaacagaggagagtcgagatggcccgcaacaacctggcggcagcgcaaaagatg

SEQ ID NO: 175283 - DNA, 103 bp, Artificial Sequence
  Synthetic Polynucleotide
taatacgactcactataggggcagatccgggaagaaggggatgttgcgggaacagaggagacccgcaatgtccccttctaacctggcggcagcgcaaaagatg

SEQ ID NO: 175284 - DNA, 103 bp, Artificial Sequence
  Synthetic Polynucleotide
taatacgactcactatagggtcggtgatctgcagatccgggaagaaggggaacagaggagaccccttatgcccggatctaacctggcggcagcgcaaaagatg

SEQ ID NO: 175285 - DNA, 103 bp, Artificial Sequence
  Synthetic Polynucleotide
taatacgactcactatagggggacacctggtcggtgatctgcagatccggaacagaggagaccggatatgcagatcaccaacctggcggcagcgcaaaagatg

SEQ ID NO: 175286 - DNA, 103 bp, Artificial Sequence
  Synthetic Polynucleotide
taatacgactcactatagggggcgtagcagggacacctggtcggtgatctaacagaggagaagatcaatgaccaggtgtaacctggcggcagcgcaaaagatg

SEQ ID NO: 175287 - DNA, 103 bp, Artificial Sequence
  Synthetic Polynucleotide
taatacgactcactatagggctccaggtgaggcgtagcagggacacctggaacagaggagaccaggtatgcctgctacgaacctggcggcagcgcaaaagatg

SEQ ID NO: 175288 - DNA, 103 bp, Artificial Sequence
  Synthetic Polynucleotide
taatacgactcactataggggaacagctcgctccaggtgaggcgtagcagaacagaggagactgctaatgctcacctggaacctggcggcagcgcaaaagatg

SEQ ID NO: 175289 - DNA, 103 bp, Artificial Sequence
  Synthetic Polynucleotide
taatacgactcactatagggcgttgagcacgaacagctcgctccaggtgaaacagaggagatcacctatggcgagctgtaacctggcggcagcgcaaaagatg

SEQ ID NO: 175290 - DNA, 103 bp, Artificial Sequence
  Synthetic Polynucleotide
taatacgactcactatagggcactgggccgcgttgagcacgaacagctcgaacagaggagacgagctatgcgtgctcaaaacctggcggcagcgcaaaagatg

SEQ ID NO: 175291 - DNA, 103 bp, Artificial Sequence
  Synthetic Polynucleotide
taatacgactcactatagggcggcatagagcactgggccgcgttgagcacaacagaggagagtgctcatggcggcccagaacctggcggcagcgcaaaagatg

SEQ ID NO: 175292 - DNA, 103 bp, Artificial Sequence
  Synthetic Polynucleotide
taatacgactcactatagggcgccgccgcgggccgcctgcgctgcggggtaacagaggagaaccccgatgcgcaggcggaacctggcggcagcgcaaaagatg

SEQ ID NO: 175293 - DNA, 103 bp, Artificial Sequence
  Synthetic Polynucleotide
taatacgactcactatagggccacgtgcagcggcatagagcactgggccgaacagaggagacggcccatggctctatgcaacctggcggcagcgcaaaagatg

SEQ ID NO: 175294 - DNA, 103 bp, Artificial Sequence
  Synthetic Polynucleotide
taatacgactcactatagggagcaacggcgccacgtgcagcggcatagagaacagaggagactctatatggctgcacgtaacctggcggcagcgcaaaagatg

SEQ ID NO: 175295 - DNA, 103 bp, Artificial Sequence
  Synthetic Polynucleotide
taatacgactcactatagggggcggcggccagcaacggcgccacgtgcagaacagaggagactgcacatggcgccgttgaacctggcggcagcgcaaaagatg

SEQ ID NO: 175296 - DNA, 103 bp, Artificial Sequence
  Synthetic Polynucleotide
taatacgactcactatagggcatgcaggccggcggcggccagcaacggcgaacagaggagacgccgtatgtggccgccgaacctggcggcagcgcaaaagatg

SEQ ID NO: 175297 - DNA, 103 bp, Artificial Sequence
  Synthetic Polynucleotide
taatacgactcactatagggatgggcgaggcatgcaggccggcggcggccaacagaggagaggccgcatgcggcctgcaaacctggcggcagcgcaaaagatg

SEQ ID NO: 175298 - DNA, 103 bp, Artificial Sequence
  Synthetic Polynucleotide
taatacgactcactataggggtcggcagacatgggcgaggcatgcaggccaacagaggagaggcctgatggcctcgcccaacctggcggcagcgcaaaagatg

SEQ ID NO: 175299 - DNA, 103 bp, Artificial Sequence
  Synthetic Polynucleotide
taatacgactcactatagggccacgacgcggtcggcagacatgggcgaggaacagaggagacctcgcatgtgtctgccgaacctggcggcagcgcaaaagatg

SEQ ID NO: 175300 - DNA, 103 bp, Artificial Sequence
  Synthetic Polynucleotide
taatacgactcactatagggtccatgaaggccacgacgcggtcggcagacaacagaggagagtctgcatgccgcgtcgtaacctggcggcagcgcaaaagatg

SEQ ID NO: 175301 - DNA, 103 bp, Artificial Sequence
  Synthetic Polynucleotide
taatacgactcactataggggcggatgtggtccatgaaggccacgacgcgaacagaggagacgcgtcatggccttcatgaacctggcggcagcgcaaaagatg

SEQ ID NO: 175302 - DNA, 103 bp, Artificial Sequence
  Synthetic Polynucleotide
taatacgactcactatagggcctggaagatgcggatgtggtccatgaaggaacagaggagaccttcaatgaccacatccaacctggcggcagcgcaaaagatg

SEQ ID NO: 175303 - DNA, 103 bp, Artificial Sequence
  Synthetic Polynucleotide
taatacgactcactataggggcgccgccgccgccgccgcgggccgcctgcaacagaggagagcaggcatgccgcggcggaacctggcggcagcgcaaaagatg

SEQ ID NO: 175304 - DNA, 103 bp, Artificial Sequence
  Synthetic Polynucleotide
taatacgactcactatagggtccacctgctcctggaagatgcggatgtggaacagaggagaccacatatgcatcttccaaacctggcggcagcgcaaaagatg

SEQ ID NO: 175305 - DNA, 103 bp, Artificial Sequence
  Synthetic Polynucleotide
taatacgactcactatagggcttgagcttctccacctgctcctggaagataacagaggagaatcttcatggagcaggtgaacctggcggcagcgcaaaagatg

SEQ ID NO: 175306 - DNA, 103 bp, Artificial Sequence
  Synthetic Polynucleotide
taatacgactcactatagggcgtgtagcgccttgagcttctccacctgctaacagaggagaagcaggatgagaagctcaaacctggcggcagcgcaaaagatg

SEQ ID NO: 175307 - DNA, 103 bp, Artificial Sequence
  Synthetic Polynucleotide
taatacgactcactataggggctgagtcgacgtgtagcgccttgagcttcaacagaggagagaagctatgggcgctacaaacctggcggcagcgcaaaagatg

SEQ ID NO: 175308 - DNA, 103 bp, Artificial Sequence
  Synthetic Polynucleotide
taatacgactcactataggggctgtactcggctgagtcgacgtgtagcgcaacagaggagagcgctaatggtcgactcaaacctggcggcagcgcaaaagatg

SEQ ID NO: 175309 - DNA, 103 bp, Artificial Sequence
  Synthetic Polynucleotide
taatacgactcactatagggctttgaggcagctgtactcggctgagtcgaaacagaggagatcgactatgccgagtacaaacctggcggcagcgcaaaagatg

SEQ ID NO: 175310 - DNA, 103 bp, Artificial Sequence
  Synthetic Polynucleotide
taatacgactcactatagggagcacgatggctttgaggcagctgtactcgaacagaggagacgagtaatgctgcctcaaaacctggcggcagcgcaaaagatg

SEQ ID NO: 175311 - DNA, 103 bp, Artificial Sequence
  Synthetic Polynucleotide
taatacgactcactatagggtgacgtgaacagcacgatggctttgaggcaaacagaggagatgcctcatggccatcgtgaacctggcggcagcgcaaaagatg

SEQ ID NO: 175312 - DNA, 103 bp, Artificial Sequence
  Synthetic Polynucleotide
taatacgactcactatagggcacaggcgtctgacgtgaacagcacgatggaacagaggagaccatcgatgtgttcacgtaacctggcggcagcgcaaaagatg

SEQ ID NO: 175313 - DNA, 103 bp, Artificial Sequence
  Synthetic Polynucleotide
taatacgactcactatagggtccgacaggccacaggcgtctgacgtgaacaacagaggagagttcacatgagacgcctgaacctggcggcagcgcaaaagatg

SEQ ID NO: 175314 - DNA, 103 bp, Artificial Sequence
  Synthetic Polynucleotide
taatacgactcactataggggccgccccagccgccggtcaccatggccataacagaggagaatggccatggtgaccggcaacctggcggcagcgcaaaagatg

SEQ ID NO: 175315 - DNA, 103 bp, Artificial Sequence
  Synthetic Polynucleotide
taatacgactcactataggggctggcggcaccggggggcgaggccgagtcaacagaggagagactcgatgtcgccccccaacctggcggcagcgcaaaagatg

SEQ ID NO: 175316 - DNA, 103 bp, Artificial Sequence
  Synthetic Polynucleotide
taatacgactcactatagggccgcacatactcggtgagggccacctgcgcaacagaggagagcgcagatggccctcaccaacctggcggcagcgcaaaagatg

SEQ ID NO: 175317 - DNA, 103 bp, Artificial Sequence
  Synthetic Polynucleotide
taatacgactcactatagggggtactgcgcccgcacatactcggtgagggaacagaggagaccctcaatgagtatgtgcaacctggcggcagcgcaaaagatg

SEQ ID NO: 175318 - DNA, 103 bp, Artificial Sequence
  Synthetic Polynucleotide
taatacgactcactatagggggctgggacgggtactgcgcccgcacatacaacagaggagagtatgtatgggcgcagtaaacctggcggcagcgcaaaagatg

SEQ ID NO: 175319 - DNA, 103 bp, Artificial Sequence
  Synthetic Polynucleotide
taatacgactcactataggggaagcgctggggctgggacgggtactgcgcaacagaggagagcgcagatgccgtcccagaacctggcggcagcgcaaaagatg

SEQ ID NO: 175320 - DNA, 103 bp, Artificial Sequence
  Synthetic Polynucleotide
taatacgactcactataggggcaggcgcccgaagcgctggggctgggacgaacagaggagacgtcccatgcccagcgctaacctggcggcagcgcaaaagatg

SEQ ID NO: 175321 - DNA, 103 bp, Artificial Sequence
  Synthetic Polynucleotide
taatacgactcactatagggagccgcagcagcaggcgcccgaagcgctggaacagaggagaccagcgatgcgggcgcctaacctggcggcagcgcaaaagatg

SEQ ID NO: 175322 - DNA, 103 bp, Artificial Sequence
  Synthetic Polynucleotide
taatacgactcactatagggcagggcggggagccgcagcagcaggcgcccaacagaggagagggcgcatgctgctgcggaacctggcggcagcgcaaaagatg

SEQ ID NO: 175323 - DNA, 103 bp, Artificial Sequence
  Synthetic Polynucleotide
taatacgactcactatagggggaccgcgcgcagggcggggagccgcagcaaacagaggagatgctgcatgtccccgcccaacctggcggcagcgcaaaagatg

SEQ ID NO: 175324 - DNA, 103 bp, Artificial Sequence
  Synthetic Polynucleotide
taatacgactcactatagggagggaggcagggaccgcgcgcagggcggggaacagaggagaccccgcatggcgcgcggtaacctggcggcagcgcaaaagatg

SEQ ID NO: 175325 - DNA, 103 bp, Artificial Sequence
  Synthetic Polynucleotide
taatacgactcactatagggctgggagatgagggaggcagggaccgcgcgaacagaggagacgcgcgatgcctgcctccaacctggcggcagcgcaaaagatg

SEQ ID NO: 175326 - DNA, 103 bp, Artificial Sequence
  Synthetic Polynucleotide
taatacgactcactataggggctcggcgtcgctggcggcaccggggggcgaacagaggagacgccccatggtgccgccaaacctggcggcagcgcaaaagatg

SEQ ID NO: 175327 - DNA, 103 bp, Artificial Sequence
  Synthetic Polynucleotide
taatacgactcactatagggtgaagaacagctgggagatgagggaggcagaacagaggagactgcctatgtcatctcccaacctggcggcagcgcaaaagatg

SEQ ID NO: 175328 - DNA, 103 bp, Artificial Sequence
  Synthetic Polynucleotide
taatacgactcactatagggaccaggcgcatgaagaacagctgggagatgaacagaggagacatctcatggctgttcttaacctggcggcagcgcaaaagatg

SEQ ID NO: 175329 - DNA, 103 bp, Artificial Sequence
  Synthetic Polynucleotide
taatacgactcactatagggcgtcttccccaccaggcgcatgaagaacagaacagaggagactgttcatgatgcgcctgaacctggcggcagcgcaaaagatg

SEQ ID NO: 175330 - DNA, 103 bp, Artificial Sequence
  Synthetic Polynucleotide
taatacgactcactatagggtctcaatgggcgtcttccccaccaggcgcaaacagaggagatgcgccatgtggggaagaaacctggcggcagcgcaaaagatg

SEQ ID NO: 175331 - DNA, 103 bp, Artificial Sequence
  Synthetic Polynucleotide
taatacgactcactatagggctgatcagtgtctcaatgggcgtcttccccaacagaggagaggggaaatggcccattgaaacctggcggcagcgcaaaagatg

SEQ ID NO: 175332 - DNA, 103 bp, Artificial Sequence
  Synthetic Polynucleotide
taatacgactcactatagggcagcatgtctctgatcagtgtctcaatgggaacagaggagacccattatgacactgatcaacctggcggcagcgcaaaagatg

SEQ ID NO: 175333 - DNA, 103 bp, Artificial Sequence
  Synthetic Polynucleotide
taatacgactcactatagggtccccgacagcagcatgtctctgatcagtgaacagaggagacactgaatggagacatgcaacctggcggcagcgcaaaagatg

SEQ ID NO: 175334 - DNA, 103 bp, Artificial Sequence
  Synthetic Polynucleotide
taatacgactcactatagggttgaaggtactccccgacagcagcatgtctaacagaggagaagacatatggctgtcgggaacctggcggcagcgcaaaagatg

SEQ ID NO: 175335 - DNA, 103 bp, Artificial Sequence
  Synthetic Polynucleotide
taatacgactcactataggggtagggccagttgaaggtactccccgacagaacagaggagactgtcgatgagtaccttcaacctggcggcagcgcaaaagatg

SEQ ID NO: 175336 - DNA, 103 bp, Artificial Sequence
  Synthetic Polynucleotide
taatacgactcactatagggggcccgagccgtagggccagttgaaggtacaacagaggagagtacctatgactggccctaacctggcggcagcgcaaaagatg

SEQ ID NO: 175337 - DNA, 103 bp, Artificial Sequence
  Synthetic Polynucleotide
taatacgactcactatagggtcgtcgcccggctcggcgtcgctggcggcaaacagaggagatgccgcatgcgacgccgaaacctggcggcagcgcaaaagatg

SEQ ID NO: 175338 - DNA, 103 bp, Artificial Sequence
  Synthetic Polynucleotide
taatacgactcactatagggcggccgctcctcgtcgcccggctcggcgtcaacagaggagagacgccatgccgggcgacaacctggcggcagcgcaaaagatg

SEQ ID NO: 175339 - DNA, 103 bp, Artificial Sequence
  Synthetic Polynucleotide
taatacgactcactatagggcctgcagccccggccgctcctcgtcgcccgaacagaggagacgggcgatgaggagcggcaacctggcggcagcgcaaaagatg

SEQ ID NO: 175340 - DNA, 103 bp, Artificial Sequence
  Synthetic Polynucleotide
taatacgactcactatagggacgcagtccacctgcagccccggccgctccaacagaggagaggagcgatgggggctgcaaacctggcggcagcgcaaaagatg

SEQ ID NO: 175341 - DNA, 103 bp, Artificial Sequence
  Synthetic Polynucleotide
taatacgactcactatagggcccgcacaccacgcagtccacctgcagcccaacagaggagagggctgatggtggactgcaacctggcggcagcgcaaaagatg

SEQ ID NO: 175342 - DNA, 103 bp, Artificial Sequence
  Synthetic Polynucleotide
taatacgactcactatagggtcgacttgtccccgcacaccacgcagtccaaacagaggagatggactatgtggtgtgcgaacctggcggcagcgcaaaagatg

SEQ ID NO: 175343 - DNA, 103 bp, Artificial Sequence; identical to SEQ ID NO: 175234
  Synthetic Polynucleotide

SEQ ID NO: 175344 - DNA, 103 bp, Artificial Sequence
  Synthetic Polynucleotide
taatacgactcactataggggacaccgtaatgcttgccgctcgacttgtcaacagaggagagacaagatgagcggcaagaacctggcggcagcgcaaaagatg

SEQ ID NO: 175345 - DNA, 103 bp, Artificial Sequence
  Synthetic Polynucleotide
taatacgactcactatagggcgccgccggggccgccccagccgccggtcaaacagaggagatgaccgatggctggggcgaacctggcggcagcgcaaaagatg

SEQ ID NO: 175346 - DNA, 103 bp, Artificial Sequence
  Synthetic Polynucleotide
taatacgactcactatagggcgcaggtgaagacaccgtaatgcttgccgcaacagaggagagcggcaatgattacggtgaacctggcggcagcgcaaaagatg

SEQ ID NO: 175347 - DNA, 103 bp, Artificial Sequence
  Synthetic Polynucleotide
taatacgactcactatagggttgcagccctcgcaggtgaagacaccgtaaaacagaggagattacggatgcttcacctgaacctggcggcagcgcaaaagatg

SEQ ID NO: 175348 - DNA, 103 bp, Artificial Sequence
  Synthetic Polynucleotide
taatacgactcactataggggaaaaagctcttgcagccctcgcaggtgaaaacagaggagattcaccatggagggctgcaacctggcggcagcgcaaaagatg

SEQ ID NO: 175349 - DNA, 103 bp, Artificial Sequence
  Synthetic Polynucleotide
taatacgactcactatagggtgcttcgcttgaaaaagctcttgcagccctaacagaggagaagggctatgagagcttttaacctggcggcagcgcaaaagatg

SEQ ID NO: 175350 - DNA, 103 bp, Artificial Sequence
  Synthetic Polynucleotide
taatacgactcactatagggttgcggcggatgcttcgcttgaaaaagctcaacagaggagagagcttatgcaagcgaagaacctggcggcagcgcaaaagatg

SEQ ID NO: 175351 - DNA, 103 bp, Artificial Sequence
  Synthetic Polynucleotide
taatacgactcactataggggtagctgaggttgcggcggatgcttcgcttaacagaggagaaagcgaatgatccgccgcaacctggcggcagcgcaaaagatg

SEQ ID NO: 175352 - DNA, 103 bp, Artificial Sequence
  Synthetic Polynucleotide
taatacgactcactatagggaccggcaggtgtagctgaggttgcggcggaaacagaggagatccgccatgacctcagctaacctggcggcagcgcaaaagatg

SEQ ID NO: 175353 - DNA, 103 bp, Artificial Sequence
  Synthetic Polynucleotide
taatacgactcactatagggtcacggttggaccggcaggtgtagctgaggaacagaggagacctcagatgcacctgccgaacctggcggcagcgcaaaagatg

SEQ ID NO: 175354 - DNA, 103 bp, Artificial Sequence
  Synthetic Polynucleotide
taatacgactcactataggggatctggcagtcacggttggaccggcaggtaacagaggagaacctgcatgtccaaccgtaacctggcggcagcgcaaaagatg

SEQ ID NO: 175355 - DNA, 103 bp, Artificial Sequence
  Synthetic Polynucleotide
taatacgactcactatagggggtgctggtcgatctggcagtcacggttggaacagaggagaccaaccatgactgccagaaacctggcggcagcgcaaaagatg

SEQ ID NO: 175356 - DNA, 103 bp, Artificial Sequence
  Synthetic Polynucleotide
taatacgactcactatagggccgttcgtgtcgccgccggggccgccccagaacagaggagactggggatgccccggcggaacctggcggcagcgcaaaagatg

SEQ ID NO: 175357 - DNA, 103 bp, Artificial Sequence
  Synthetic Polynucleotide
taatacgactcactatagggtggttccggtggtgctggtcgatctggcagaacagaggagactgccaatgcgaccagcaaacctggcggcagcgcaaaagatg

SEQ ID NO: 175358 - DNA, 103 bp, Artificial Sequence
  Synthetic Polynucleotide
taatacgactcactataggggtactggcactggttccggtggtgctggtcaacagaggagagaccagatgcaccggaacaacctggcggcagcgcaaaagatg

SEQ ID NO: 175359 - DNA, 103 bp, Artificial Sequence
  Synthetic Polynucleotide
taatacgactcactatagggtgagacggcagtactggcactggttccggtaacagaggagaaccggaatgagtgccagtaacctggcggcagcgcaaaagatg

SEQ ID NO: 175360 - DNA, 103 bp, Artificial Sequence
  Synthetic Polynucleotide
taatacgactcactatagggaagcacttcttgagacggcagtactggcacaacagaggagagtgccaatgctgccgtctaacctggcggcagcgcaaaagatg

SEQ ID NO: 175361 - DNA, 103 bp, Artificial Sequence
  Synthetic Polynucleotide
taatacgactcactataggggcccacccggaagcacttcttgagacggcaaacagaggagatgccgtatgaagaagtgcaacctggcggcagcgcaaaagatg

SEQ ID NO: 175362 - DNA, 103 bp, Artificial Sequence
  Synthetic Polynucleotide
taatacgactcactatagggccttcctcatgcccacccggaagcacttctaacagaggagaagaagtatgtccgggtggaacctggcggcagcgcaaaagatg

SEQ ID NO: 175363 - DNA, 103 bp, Artificial Sequence
  Synthetic Polynucleotide
taatacgactcactatagggtgcaccgcctccttcctcatgcccacccggaacagaggagaccgggtatgcatgaggaaaacctggcggcagcgcaaaagatg

SEQ ID NO: 175364 - DNA, 103 bp, Artificial Sequence
  Synthetic Polynucleotide
taatacgactcactataggggcggccgcgctgcaccgcctccttcctcataacagaggagaatgaggatggaggcggtgaacctggcggcagcgcaaaagatg

SEQ ID NO: 175365 - DNA, 103 bp, Artificial Sequence
  Synthetic Polynucleotide
taatacgactcactatagggagtgcgggatgcggccgcgctgcaccgcctaacagaggagaaggcggatgagcgcggccaacctggcggcagcgcaaaagatg

SEQ ID NO: 175366 - DNA, 103 bp, Artificial Sequence
  Synthetic Polynucleotide
taatacgactcactatagggccaggcagcgagtgcgggatgcggccgcgcaacagaggagagcgcggatgcatcccgcaaacctggcggcagcgcaaaagatg

SEQ ID NO: 175367 - DNA, 103 bp, Artificial Sequence
  Synthetic Polynucleotide
taatacgactcactatagggcttgtccacgccgttcgtgtcgccgccgggaacagaggagacccggcatggacacgaacaacctggcggcagcgcaaaagatg

SEQ ID NO: 175368 - DNA, 103 bp, Artificial Sequence
  Synthetic Polynucleotide
taatacgactcactatagggggccacggcaccaggcagcgagtgcgggataacagaggagaatcccgatgtcgctgcctaacctggcggcagcgcaaaagatg

SEQ ID NO: 175369 - DNA, 103 bp, Artificial Sequence
  Synthetic Polynucleotide
taatacgactcactatagggccgaggaggcggccacggcaccaggcagcgaacagaggagacgctgcatggtgccgtggaacctggcggcagcgcaaaagatg

SEQ ID NO: 175370 - DNA, 103 bp, Artificial Sequence
  Synthetic Polynucleotide
taatacgactcactatagggggggggctgcccgaggaggcggccacggcaaacagaggagatgccgtatgcgcctcctcaacctggcggcagcgcaaaagatg

SEQ ID NO: 175371 - DNA, 103 bp, Artificial Sequence
  Synthetic Polynucleotide
taatacgactcactatagggcgccgagcccggggggctgcccgaggaggcaacagaggagagcctccatgggcagccccaacctggcggcagcgcaaaagatg

SEQ ID NO: 175372 - DNA, 103 bp, Artificial Sequence
  Synthetic Polynucleotide
taatacgactcactatagggctgccgccagcgccgagcccggggggctgcaacagaggagagcagccatgcgggctcggaacctggcggcagcgcaaaagatg

SEQ ID NO: 175373 - DNA, 103 bp, Artificial Sequence
  Synthetic Polynucleotide
taatacgactcactatagggccgctcgccactgccgccagcgccgagcccaacagaggagagggctcatggctggcggcaacctggcggcagcgcaaaagatg

SEQ ID NO: 175374 - DNA, 103 bp, Artificial Sequence
  Synthetic Polynucleotide
taatacgactcactataggggaggtctccgccgctcgccactgccgccagaacagaggagactggcgatggtggcgagcaacctggcggcagcgcaaaagatg

SEQ ID NO: 175375 - DNA, 103 bp, Artificial Sequence
  Synthetic Polynucleotide
taatacgactcactataggggccccgggaagaggtctccgccgctcgccaaacagaggagatggcgaatggcggagaccaacctggcggcagcgcaaaagatg

SEQ ID NO: 175376 - DNA, 103 bp, Artificial Sequence
  Synthetic Polynucleotide
taatacgactcactataggggacaccggctgccccgggaagaggtctccgaacagaggagacggagaatgcttcccgggaacctggcggcagcgcaaaagatg

SEQ ID NO: 175377 - DNA, 103 bp, Artificial Sequence
  Synthetic Polynucleotide
taatacgactcactataggggatcagttcggacaccggctgccccgggaaaacagaggagattcccgatgcagccggtgaacctggcggcagcgcaaaagatg

SEQ ID NO: 175378 - DNA, 103 bp, Artificial Sequence
  Synthetic Polynucleotide
taatacgactcactatagggagccgcccgccttgtccacgccgttcgtgtaacagaggagaacacgaatggcgtggacaaacctggcggcagcgcaaaagatg

SEQ ID NO: 175379 - DNA, 103 bp, Artificial Sequence
  Synthetic Polynucleotide
taatacgactcactataggggcagctgcgcgatcagttcggacaccggctaacagaggagaagccggatgccgaactgaaacctggcggcagcgcaaaagatg

SEQ ID NO: 175380 - DNA, 103 bp, Artificial Sequence
  Synthetic Polynucleotide
taatacgactcactatagggtcagcgcgcagcagctgcgcgatcagttcgaacagaggagacgaactatgcgcgcagctaacctggcggcagcgcaaaagatg

SEQ ID NO: 175381 - DNA, 103 bp, Artificial Sequence
  Synthetic Polynucleotide
taatacgactcactatagggagggtagggctcagcgcgcagcagctgcgcaacagaggagagcgcagatgctgcgcgctaacctggcggcagcgcaaaagatg

SEQ ID NO: 175382 - DNA, 103 bp, Artificial Sequence
  Synthetic Polynucleotide
taatacgactcactatagggcggccgccgcagggtagggctcagcgcgcaaacagaggagatgcgcgatgagccctaccaacctggcggcagcgcaaaagatg

SEQ ID NO: 175383 - DNA, 103 bp, Artificial Sequence
  Synthetic Polynucleotide
taatacgactcactatagggccgaagcgtccggccgccgcagggtagggcaacagaggagagccctaatgtgcggcggcaacctggcggcagcgcaaaagatg

SEQ ID NO: 175384 - DNA, 103 bp, Artificial Sequence
  Synthetic Polynucleotide
taatacgactcactataggggccccctgcgccgaagcgtccggccgccgcaacagaggagagcggcgatgggacgcttcaacctggcggcagcgcaaaagatg

SEQ ID NO: 175385 - DNA, 103 bp, Artificial Sequence
  Synthetic Polynucleotide
taatacgactcactatagggccgccgcgccgccccctgcgccgaagcgtcaacagaggagagacgctatggcgcaggggaacctggcggcagcgcaaaagatg

SEQ ID NO: 175386 - DNA, 103 bp, Artificial Sequence
  Synthetic Polynucleotide
taatacgactcactatagggagcaccgcgcccgccgcgccgccccctgcgaacagaggagacgcaggatgcggcgcggcaacctggcggcagcgcaaaagatg

SEQ ID NO: 175387 - DNA, 103 bp, Artificial Sequence
  Synthetic Polynucleotide
taatacgactcactataggggtcgatgcccagcaccgcgcccgccgcgccaacagaggagaggcgcgatgggcgcggtgaacctggcggcagcgcaaaagatg

SEQ ID NO: 175388 - DNA, 103 bp, Artificial Sequence
  Synthetic Polynucleotide
taatacgactcactatagggcgcacacgttgtcgatgcccagcaccgcgcaacagaggagagcgcggatgtgggcatcgaacctggcggcagcgcaaaagatg

SEQ ID NO: 175389 - DNA, 103 bp, Artificial Sequence
  Synthetic Polynucleotide
taatacgactcactataggggcgcgcgggtagccgcccgccttgtccacgaacagaggagacgtggaatgggcgggcggaacctggcggcagcgcaaaagatg

SEQ ID NO: 175390 - DNA, 103 bp, Artificial Sequence
  Synthetic Polynucleotide
taatacgactcactataggggccgccagctcgcacacgttgtcgatgcccaacagaggagagggcatatgcaacgtgtgaacctggcggcagcgcaaaagatg

SEQ ID NO: 175391 - DNA, 103 bp, Artificial Sequence
  Synthetic Polynucleotide
taatacgactcactataggggagcagccgcgccgccagctcgcacacgttaacagaggagaaacgtgatggagctggcgaacctggcggcagcgcaaaagatg

SEQ ID NO: 175392 - DNA, 103 bp, Artificial Sequence
  Synthetic Polynucleotide
taatacgactcactatagggcggtgctgaagagcagccgcgccgccagctaacagaggagaagctggatgcgcggctgcaacctggcggcagcgcaaaagatg

SEQ ID NO: 175393 - DNA, 103 bp, Artificial Sequence
  Synthetic Polynucleotide
taatacgactcactataggggcccactccacggtgctgaagagcagccgcaacagaggagagcggctatgcttcagcacaacctggcggcagcgcaaaagatg

SEQ ID NO: 175394 - DNA, 103 bp, Artificial Sequence
  Synthetic Polynucleotide
taatacgactcactatagggcgcgtggcgcgcccactccacggtgctgaaaacagaggagattcagcatggtggagtggaacctggcggcagcgcaaaagatg

SEQ ID NO: 175395 - DNA, 103 bp, Artificial Sequence
  Synthetic Polynucleotide
taatacgactcactatagggggaagaagggcgcgtggcgcgcccactccaaacagaggagatggagtatgcgcgccacgaacctggcggcagcgcaaaagatg

SEQ ID NO: 175396 - DNA, 103 bp, Artificial Sequence
  Synthetic Polynucleotide
taatacgactcactatagggggcagctcggggaagaagggcgcgtggcgcaacagaggagagcgccaatggcccttcttaacctggcggcagcgcaaaagatg

SEQ ID NO: 175397 - DNA, 103 bp, Artificial Sequence
  Synthetic Polynucleotide
taatacgactcactataggggtcggccaccggcagctcggggaagaagggaacagaggagacccttcatgcccgagctgaacctggcggcagcgcaaaagatg

SEQ ID NO: 175398 - DNA, 103 bp, Artificial Sequence
  Synthetic Polynucleotide
taatacgactcactataggggcgccacctggtcggccaccggcagctcggaacagaggagaccgagcatgcggtggccgaacctggcggcagcgcaaaagatg

SEQ ID NO: 175399 - DNA, 103 bp, Artificial Sequence
  Synthetic Polynucleotide
taatacgactcactatagggaggcgcagcagcgccacctggtcggccaccaacagaggagaggtggcatgccaggtggcaacctggcggcagcgcaaaagatg

SEQ ID NO: 175400 - DNA, 103 bp, Artificial Sequence
  Synthetic Polynucleotide
taatacgactcactataggggtcctcggccgcgcgcgggtagccgcccgcaacagaggagagcgggcatgtacccgcgcaacctggcggcagcgcaaaagatg

SEQ ID NO: 175401 - DNA, 103 bp, Artificial Sequence
  Synthetic Polynucleotide
taatacgactcactataggggctccagctcaggcgcagcagcgccacctgaacagaggagacaggtgatgctgctgcgcaacctggcggcagcgcaaaagatg

SEQ ID NO: 175402 - DNA, 103 bp, Artificial Sequence
  Synthetic Polynucleotide
taatacgactcactatagggcgaagagctcgctccagctcaggcgcagcaaacagaggagatgctgcatgtgagctggaaacctggcggcagcgcaaaagatg

SEQ ID NO: 175403 - DNA, 103 bp, Artificial Sequence
  Synthetic Polynucleotide
taatacgactcactataggggcgttcagcacgaagagctcgctccagctcaacagaggagagagctgatgcgagctcttaacctggcggcagcgcaaaagatg

SEQ ID NO: 175404 - DNA, 103 bp, Artificial Sequence
  Synthetic Polynucleotide
taatacgactcactatagggcgcctgcgccgcgttcagcacgaagagctcaacagaggagagagctcatggtgctgaacaacctggcggcagcgcaaaagatg

SEQ ID NO: 175405 - DNA, 103 bp, Artificial Sequence
  Synthetic Polynucleotide
taatacgactcactatagggggggcagcgccgcctgcgccgcgttcagcaaacagaggagatgctgaatgcggcgcaggaacctggcggcagcgcaaaagatg

SEQ ID NO: 175406 - DNA, 103 bp, Artificial Sequence
  Synthetic Polynucleotide
taatacgactcactataggggccgtgtgcaggggcagcgccgcctgcgccaacagaggagaggcgcaatgggcgctgccaacctggcggcagcgcaaaagatg

SEQ ID NO: 175407 - DNA, 103 bp, Artificial Sequence
  Synthetic Polynucleotide
taatacgactcactatagggcagtagcggcgccgtgtgcaggggcagcgcaacagaggagagcgctgatgctgcacacgaacctggcggcagcgcaaaagatg

SEQ ID NO: 175408 - DNA, 103 bp, Artificial Sequence
  Synthetic Polynucleotide
taatacgactcactatagggcggcggcggccagtagcggcgccgtgtgcaaacagaggagatgcacaatgcgccgctacaacctggcggcagcgcaaaagatg

SEQ ID NO: 175409 - DNA, 103 bp, Artificial Sequence
  Synthetic Polynucleotide
taatacgactcactataggggcgtggaggccggcggcggccagtagcggcaacagaggagagccgctatgggccgccgcaacctggcggcagcgcaaaagatg

SEQ ID NO: 175410 - DNA, 103 bp, Artificial Sequence
  Synthetic Polynucleotide
taatacgactcactatagggcataggcgcggcgtggaggccggcggcggcaacagaggagagccgccatgggcctccacaacctggcggcagcgcaaaagatg

SEQ ID NO: 175411 - DNA, 103 bp, Artificial Sequence
  Synthetic Polynucleotide
taatacgactcactatagggaggccgagtcgtcctcggccgcgcgcgggtaacagaggagaacccgcatgcggccgaggaacctggcggcagcgcaaaagatg

SEQ ID NO: 175412 - DNA, 103 bp, Artificial Sequence
  Synthetic Polynucleotide
taatacgactcactataggggctcggcggccataggcgcggcgtggaggcaacagaggagagcctccatgccgcgcctaaacctggcggcagcgcaaaagatg

SEQ ID NO: 175413 - DNA, 103 bp, Artificial Sequence
  Synthetic Polynucleotide
taatacgactcactataggggccacggcgcgctcggcggccataggcgcgaacagaggagacgcgccatgggccgccgaaacctggcggcagcgcaaaagatg

SEQ ID NO: 175414 - DNA, 103 bp, Artificial Sequence
  Synthetic Polynucleotide
taatacgactcactataggggtccatgaaagccacggcgcgctcggcggcaacagaggagagccgccatgcgcgccgtgaacctggcggcagcgcaaaagatg

SEQ ID NO: 175415 - DNA, 103 bp, Artificial Sequence
  Synthetic Polynucleotide
taatacgactcactatagggcgcgcacctggtccatgaaagccacggcgcaacagaggagagcgccgatgctttcatggaacctggcggcagcgcaaaagatg

SEQ ID NO: 175416 - DNA, 103 bp, Artificial Sequence
  Synthetic Polynucleotide
taatacgactcactatagggtcctggaaggcgcgcacctggtccatgaaaaacagaggagatttcatatgccaggtgcgaacctggcggcagcgcaaaagatg

SEQ ID NO: 175417 - DNA, 103 bp, Artificial Sequence
  Synthetic Polynucleotide
taatacgactcactataggggtccacctgctcctggaaggcgcgcacctgaacagaggagacaggtgatggccttccagaacctggcggcagcgcaaaagatg

SEQ ID NO: 175418 - DNA, 103 bp, Artificial Sequence
  Synthetic Polynucleotide
taatacgactcactatagggggcccagcttgtccacctgctcctggaaggaacagaggagaccttccatgagcaggtggaacctggcggcagcgcaaaagatg

SEQ ID NO: 175419 - DNA, 103 bp, Artificial Sequence
  Synthetic Polynucleotide
taatacgactcactatagggacctgcaggcggcccagcttgtccacctgcaacagaggagagcaggtatgcaagctgggaacctggcggcagcgcaaaagatg

SEQ ID NO: 175420 - DNA, 103 bp, Artificial Sequence
  Synthetic Polynucleotide
taatacgactcactatagggggccgagtcgacctgcaggcggcccagcttaacagaggagaaagctgatgcgcctgcagaacctggcggcagcgcaaaagatg

SEQ ID NO: 175421 - DNA, 103 bp, Artificial Sequence
  Synthetic Polynucleotide
taatacgactcactatagggagccatactcggccgagtcgacctgcaggcaacagaggagagcctgcatgtcgactcggaacctggcggcagcgcaaaagatg

SEQ ID NO: 175422 - DNA, 103 bp, Artificial Sequence
  Synthetic Polynucleotide
taatacgactcactatagggccggggggcgaggccgagtcgtcctcggccaacagaggagaggccgaatgcgactcggcaacctggcggcagcgcaaaagatg

SEQ ID NO: 175423 - DNA, 103 bp, Artificial Sequence
  Synthetic Polynucleotide
taatacgactcactataggggccttgaggcagccatactcggccgagtcgaacagaggagacgactcatgcgagtatggaacctggcggcagcgcaaaagatg

SEQ ID NO: 175424 - DNA, 103 bp, Artificial Sequence
  Synthetic Polynucleotide
taatacgactcactataggggagcgcgatggccttgaggcagccatactcaacagaggagagagtatatgtgcctcaagaacctggcggcagcgcaaaagatg

SEQ ID NO: 175425 - DNA, 103 bp, Artificial Sequence
  Synthetic Polynucleotide
taatacgactcactatagggcgggcgtgaagagcgcgatggccttgaggcaacagaggagagcctcaatgccatcgcgcaacctggcggcagcgcaaaagatg

SEQ ID NO: 175426 - DNA, 103 bp, Artificial Sequence
  Synthetic Polynucleotide
taatacgactcactatagggccacaggcgtcgggcgtgaagagcgcgatgaacagaggagacatcgcatgcttcacgccaacctggcggcagcgcaaaagatg

SEQ ID NO: 175427 - DNA, 103 bp, Artificial Sequence
  Synthetic Polynucleotide
taatacgactcactataggggtctgagaggccacaggcgtcgggcgtgaaaacagaggagattcacgatggacgcctgtaacctggcggcagcgcaaaagatg

SEQ ID NO: 175428 - DNA, 103 bp, Artificial Sequence
  Synthetic Polynucleotide
taatacgactcactatagggcgtgggccgggtctgagaggccacaggcgtaacagaggagaacgcctatggcctctcagaacctggcggcagcgcaaaagatg

SEQ ID NO: 175429 - DNA, 103 bp, Artificial Sequence
  Synthetic Polynucleotide
taatacgactcactatagggaggctctcaacgtgggccgggtctgagaggaacagaggagacctctcatgcccggcccaaacctggcggcagcgcaaaagatg

SEQ ID NO: 175430 - DNA, 103 bp, Artificial Sequence
  Synthetic Polynucleotide
taatacgactcactatagggcttctcctgcaggctctcaacgtgggccggaacagaggagaccggccatggttgagagcaacctggcggcagcgcaaaagatg

SEQ ID NO: 175431 - DNA, 103 bp, Artificial Sequence
  Synthetic Polynucleotide
taatacgactcactatagggccacctgcgccttctcctgcaggctctcaaaacagaggagattgagaatgtgcaggagaaacctggcggcagcgcaaaagatg

SEQ ID NO: 175432 - DNA, 103 bp, Artificial Sequence
  Synthetic Polynucleotide
taatacgactcactatagggtcggtgagggccacctgcgccttctcctgcaacagaggagagcaggaatgggcgcaggtaacctggcggcagcgcaaaagatg

SEQ ID NO: 175433 - DNA, 103 bp, Artificial Sequence
  Synthetic Polynucleotide
taatacgactcactatagggaccaggagttaatgattctttggagtccataacagaggagaatggacatgaaagaatcaaacctggcggcagcgcaaaagatg

SEQ ID NO: 175434 - DNA, 103 bp, Artificial Sequence
  Synthetic Polynucleotide
taatacgactcactatagggcttcacagtagctcctcctcttagggttttaacagaggagaaaaaccatgagaggaggaaacctggcggcagcgcaaaagatg

SEQ ID NO: 175435 - DNA, 103 bp, Artificial Sequence
  Synthetic Polynucleotide
taatacgactcactatagggggatgctgtattcatgtcatagtggtacataacagaggagaatgtacatgtatgacatgaacctggcggcagcgcaaaagatg

SEQ ID NO: 175436 - DNA, 103 bp, Artificial Sequence
  Synthetic Polynucleotide
taatacgactcactataggggttgagaaagggatgctgtattcatgtcataacagaggagaatgacaatgatacagcataacctggcggcagcgcaaaagatg

SEQ ID NO: 175437 - DNA, 103 bp, Artificial Sequence
  Synthetic Polynucleotide
taatacgactcactatagggtgatcctgctgttgagaaagggatgctgtaaacagaggagatacagcatgcctttctcaaacctggcggcagcgcaaaagatg

SEQ ID NO: 175438 - DNA, 103 bp, Artificial Sequence
  Synthetic Polynucleotide
taatacgactcactatagggaataggcttctgatcctgctgttgagaaagaacagaggagactttctatgcagcaggataacctggcggcagcgcaaaagatg

SEQ ID NO: 175439 - DNA, 103 bp, Artificial Sequence
  Synthetic Polynucleotide
taatacgactcactatagggtgacattaaaaataggcttctgatcctgctaacagaggagaagcaggatgagaagcctaaacctggcggcagcgcaaaagatg

SEQ ID NO: 175440 - DNA, 103 bp, Artificial Sequence
  Synthetic Polynucleotide
taatacgactcactatagggattggtggaatgacattaaaaataggcttcaacagaggagagaagccatgttttaatgtaacctggcggcagcgcaaaagatg

SEQ ID NO: 175441 - DNA, 103 bp, Artificial Sequence
  Synthetic Polynucleotide
taatacgactcactatagggaccaacgggaattggtggaatgacattaaaaacagaggagatttaatatgattccaccaaacctggcggcagcgcaaaagatg

SEQ ID NO: 175442 - DNA, 103 bp, Artificial Sequence
  Synthetic Polynucleotide
taatacgactcactatagggaattttcggaaccaacgggaattggtggaaaacagaggagattccacatgttcccgttgaacctggcggcagcgcaaaagatg

SEQ ID NO: 175443 - DNA, 103 bp, Artificial Sequence
  Synthetic Polynucleotide
taatacgactcactatagggcacctattccaattttcggaaccaacgggaaacagaggagatcccgtatgttccgaaaaaacctggcggcagcgcaaaagatg

SEQ ID NO: 175444 - DNA, 103 bp, Artificial Sequence
  Synthetic Polynucleotide
taatacgactcactatagggagatccttggcacctattccaattttcggaaacagaggagatccgaaatgtggaataggaacctggcggcagcgcaaaagatg

SEQ ID NO: 175445 - DNA, 103 bp, Artificial Sequence
  Synthetic Polynucleotide
taatacgactcactatagggacgcagaaaccttcacagtagctcctcctcaacagaggagagaggagatgctactgtgaaacctggcggcagcgcaaaagatg

SEQ ID NO: 175446 - DNA, 103 bp, Artificial Sequence
  Synthetic Polynucleotide
taatacgactcactatagggtgtcatctccagatccttggcacctattccaacagaggagaggaataatggccaaggataacctggcggcagcgcaaaagatg

SEQ ID NO: 175447 - DNA, 103 bp, Artificial Sequence
  Synthetic Polynucleotide
taatacgactcactataggggaagtcaagttgtcatctccagatccttggaacagaggagaccaaggatgtggagatgaaacctggcggcagcgcaaaagatg

SEQ ID NO: 175448 - DNA, 103 bp, Artificial Sequence
  Synthetic Polynucleotide
taatacgactcactatagggagtccccagagaagtcaagttgtcatctccaacagaggagaggagatatgaacttgactaacctggcggcagcgcaaaagatg

SEQ ID NO: 175449 - DNA, 103 bp, Artificial Sequence
  Synthetic Polynucleotide
taatacgactcactatagggggaagttcagagtccccagagaagtcaagtaacagaggagaacttgaatgctctggggaaacctggcggcagcgcaaaagatg

SEQ ID NO: 175450 - DNA, 103 bp, Artificial Sequence
  Synthetic Polynucleotide
taatacgactcactataggggttcgaccagggaagttcagagtccccagaaacagaggagatctgggatgtctgaacttaacctggcggcagcgcaaaagatg

SEQ ID NO: 175451 - DNA, 103 bp, Artificial Sequence
  Synthetic Polynucleotide
taatacgactcactatagggagaaaaaactgttcgaccagggaagttcagaacagaggagactgaacatgcctggtcgaaacctggcggcagcgcaaaagatg

SEQ ID NO: 175452 - DNA, 103 bp, Artificial Sequence
  Synthetic Polynucleotide
taatacgactcactatagggaatagccattagaaaaaactgttcgaccagaacagaggagactggtcatgcagttttttaacctggcggcagcgcaaaagatg

SEQ ID NO: 175453 - DNA, 103 bp, Artificial Sequence
  Synthetic Polynucleotide
taatacgactcactatagggctggggcttgaatagccattagaaaaaactaacagaggagaagttttatgtaatggctaaacctggcggcagcgcaaaagatg

SEQ ID NO: 175454 - DNA, 103 bp, Artificial Sequence
  Synthetic Polynucleotide
taatacgactcactatagggtggtctcatgctggggcttgaatagccattaacagaggagaaatggcatgtcaagccccaacctggcggcagcgcaaaagatg

SEQ ID NO: 175455 - DNA, 103 bp, Artificial Sequence
  Synthetic Polynucleotide
taatacgactcactatagggagcttacatctggtctcatgctggggcttgaacagaggagacaagccatggcatgagacaacctggcggcagcgcaaaagatg

SEQ ID NO: 175456 - DNA, 103 bp, Artificial Sequence
  Synthetic Polynucleotide
taatacgactcactataggggagggtgaagacgcagaaaccttcacagtaaacagaggagatactgtatgggtttctgcaacctggcggcagcgcaaaagatg

SEQ ID NO: 175457 - DNA, 103 bp, Artificial Sequence
  Synthetic Polynucleotide
taatacgactcactataggggatggaggagagcttacatctggtctcatgaacagaggagacatgagatgagatgtaagaacctggcggcagcgcaaaagatg

SEQ ID NO: 175458 - DNA, 103 bp, Artificial Sequence
  Synthetic Polynucleotide
taatacgactcactatagggtgaggagctggatggaggagagcttacatcaacagaggagagatgtaatgtctcctccaaacctggcggcagcgcaaaagatg

SEQ ID NO: 175459 - DNA, 103 bp, Artificial Sequence
  Synthetic Polynucleotide
taatacgactcactatagggttgttgctgttgaggagctggatggaggagaacagaggagactcctcatgccagctcctaacctggcggcagcgcaaaagatg

SEQ ID NO: 175460 - DNA, 103 bp, Artificial Sequence
  Synthetic Polynucleotide
taatacgactcactatagggggtggtcctgttgttgctgttgaggagctgaacagaggagacagctcatgaacagcaacaacctggcggcagcgcaaaagatg

SEQ ID NO: 175461 - DNA, 103 bp, Artificial Sequence
  Synthetic Polynucleotide
taatacgactcactataggggagtttgggaggtggtcctgttgttgctgtaacagaggagaacagcaatgacaggaccaaacctggcggcagcgcaaaagatg

SEQ ID NO: 175462 - DNA, 103 bp, Artificial Sequence
  Synthetic Polynucleotide
taatacgactcactatagggacaccaggcagagtttgggaggtggtcctgaacagaggagacaggacatgctcccaaacaacctggcggcagcgcaaaagatg

SEQ ID NO: 175463 - DNA, 103 bp, Artificial Sequence
  Synthetic Polynucleotide
taatacgactcactatagggtcatcagagcacaccaggcagagtttgggaaacagaggagatcccaaatgctgcctggtaacctggcggcagcgcaaaagatg

SEQ ID NO: 175464 - DNA, 103 bp, Artificial Sequence
  Synthetic Polynucleotide
taatacgactcactatagggtcctgaagcttcatcagagcacaccaggcaaacagaggagatgcctgatgtgctctgataacctggcggcagcgcaaaagatg

SEQ ID NO: 175465 - DNA, 103 bp, Artificial Sequence
  Synthetic Polynucleotide
taatacgactcactatagggcataatgacatcctgaagcttcatcagagcaacagaggagagctctgatgaagcttcagaacctggcggcagcgcaaaagatg

SEQ ID NO: 175466 - DNA, 103 bp, Artificial Sequence
  Synthetic Polynucleotide
taatacgactcactataggggttaagactccataatgacatcctgaagctaacagaggagaagcttcatgatgtcattaaacctggcggcagcgcaaaagatg

SEQ ID NO: 175467 - DNA, 103 bp, Artificial Sequence
  Synthetic Polynucleotide
taatacgactcactataggggacagccagtgagggtgaagacgcagaaacaacagaggagagtttctatgtcttcacccaacctggcggcagcgcaaaagatg

SEQ ID NO: 175468 - DNA, 103 bp, Artificial Sequence
  Synthetic Polynucleotide
taatacgactcactataggggcttccacaagttaagactccataatgacaaacagaggagatgtcatatgggagtcttaaacctggcggcagcgcaaaagatg

SEQ ID NO: 175469 - DNA, 103 bp, Artificial Sequence
  Synthetic Polynucleotide
taatacgactcactatagggaaactttacagcttccacaagttaagactcaacagaggagagagtctatgcttgtggaaaacctggcggcagcgcaaaagatg

SEQ ID NO: 175470 - DNA, 103 bp, Artificial Sequence
  Synthetic Polynucleotide
taatacgactcactatagggcttttgaagaaaactttacagcttccacaaaacagaggagattgtggatgctgtaaagtaacctggcggcagcgcaaaagatg

SEQ ID NO: 175471 - DNA, 103 bp, Artificial Sequence
  Synthetic Polynucleotide
taatacgactcactatagggttccactgctcttttgaagaaaactttacaaacagaggagatgtaaaatgttcttcaaaaacctggcggcagcgcaaaagatg

SEQ ID NO: 175472 - DNA, 103 bp, Artificial Sequence
  Synthetic Polynucleotide
taatacgactcactataggggctgtctaccttccactgctcttttgaagaaacagaggagatcttcaatggagcagtggaacctggcggcagcgcaaaagatg

SEQ ID NO: 175473 - DNA, 103 bp, Artificial Sequence
  Synthetic Polynucleotide
taatacgactcactatagggaggtaattgtgctgtctaccttccactgctaacagaggagaagcagtatgaggtagacaaacctggcggcagcgcaaaagatg

SEQ ID NO: 175474 - DNA, 103 bp, Artificial Sequence
  Synthetic Polynucleotide
taatacgactcactatagggtccagcacataggtaattgtgctgtctaccaacagaggagaggtagaatgcacaattacaacctggcggcagcgcaaaagatg

SEQ ID NO: 175475 - DNA, 103 bp, Artificial Sequence
  Synthetic Polynucleotide
taatacgactcactatagggaatcattccttccagcacataggtaattgtaacagaggagaacaattatgtatgtgctgaacctggcggcagcgcaaaagatg

SEQ ID NO: 175476 - DNA, 103 bp, Artificial Sequence
  Synthetic Polynucleotide
taatacgactcactatagggtcgatgatgcaatcattccttccagcacataacagaggagaatgtgcatgaaggaatgaaacctggcggcagcgcaaaagatg

SEQ ID NO: 175477 - DNA, 103 bp, Artificial Sequence
  Synthetic Polynucleotide
taatacgactcactatagggtcgaattttatcgatgatgcaatcattcctaacagaggagaaggaatatgtgcatcatcaacctggcggcagcgcaaaagatg

SEQ ID NO: 175478 - DNA, 103 bp, Artificial Sequence
  Synthetic Polynucleotide
taatacgactcactatagggattgagaagcgacagccagtgagggtgaagaacagaggagacttcacatgcactggctgaacctggcggcagcgcaaaagatg

SEQ ID NO: 175479 - DNA, 103 bp, Artificial Sequence
  Synthetic Polynucleotide
taatacgactcactatagggagttttttcttcgaattttatcgatgatgcaacagaggagagcatcaatgataaaattcaacctggcggcagcgcaaaagatg

SEQ ID NO: 175480 - DNA, 103 bp, Artificial Sequence
  Synthetic Polynucleotide
taatacgactcactatagggcatgctgggcagttttttcttcgaattttaaacagaggagataaaatatgaagaaaaaaaacctggcggcagcgcaaaagatg

SEQ ID NO: 175481 - DNA, 103 bp, Artificial Sequence
  Synthetic Polynucleotide
taatacgactcactatagggtcgatagcggcatgctgggcagttttttctaacagaggagaagaaaaatgtgcccagcaaacctggcggcagcgcaaaagatg

SEQ ID NO: 175482 - DNA, 103 bp, Artificial Sequence
  Synthetic Polynucleotide
taatacgactcactataggggaagacattttcgatagcggcatgctgggcaacagaggagagcccagatggccgctatcaacctggcggcagcgcaaaagatg

SEQ ID NO: 175483 - DNA, 103 bp, Artificial Sequence
  Synthetic Polynucleotide
taatacgactcactatagggattccagcctgaagacattttcgatagcggaacagaggagaccgctaatgaaaatgtctaacctggcggcagcgcaaaagatg

SEQ ID NO: 175484 - DNA, 103 bp, Artificial Sequence
  Synthetic Polynucleotide
taatacgactcactatagggttccaggttcattccagcctgaagacatttaacagaggagaaaatgtatgcaggctggaaacctggcggcagcgcaaaagatg

SEQ ID NO: 175485 - DNA, 103 bp, Artificial Sequence
  Synthetic Polynucleotide
taatacgactcactatagggtttttcgagcttccaggttcattccagcctaacagaggagaaggctgatgtgaacctggaacctggcggcagcgcaaaagatg

SEQ ID NO: 175486 - DNA, 103 bp, Artificial Sequence
  Synthetic Polynucleotide
taatacgactcactatagggtttttctttgtttttcgagcttccaggttcaacagaggagagaacctatgagctcgaaaaacctggcggcagcgcaaaagatg

SEQ ID NO: 175487 - DNA, 103 bp, Artificial Sequence
  Synthetic Polynucleotide
taatacgactcactatagggtccttttatttttttctttgtttttcgagcaacagaggagagctcgaatgacaaagaaaaacctggcggcagcgcaaaagatg

SEQ ID NO: 175488 - DNA, 103 bp, Artificial Sequence
  Synthetic Polynucleotide
taatacgactcactatagggcctgctgaattccttttatttttttctttgaacagaggagacaaagaatgaaataaaagaacctggcggcagcgcaaaagatg

SEQ ID NO: 175489 - DNA, 103 bp, Artificial Sequence
  Synthetic Polynucleotide
taatacgactcactatagggttggagtctgattgagaagcgacagccagtaacagaggagaactggcatgcgcttctcaaacctggcggcagcgcaaaagatg

SEQ ID NO: 175490 - DNA, 103 bp, Artificial Sequence
  Synthetic Polynucleotide
taatacgactcactatagggcctgtagtggcctgctgaattccttttattaacagaggagaaataaaatgaattcagcaaacctggcggcagcgcaaaagatg

SEQ ID NO: 175491 - DNA, 103 bp, Artificial Sequence
  Synthetic Polynucleotide
taatacgactcactatagggttgtgagactcctgtagtggcctgctgaataacagaggagaattcagatggccactacaaacctggcggcagcgcaaaagatg

SEQ ID NO: 175492 - DNA, 103 bp, Artificial Sequence
  Synthetic Polynucleotide
taatacgactcactatagggcagaggtttcttgtgagactcctgtagtggaacagaggagaccactaatggagtctcacaacctggcggcagcgcaaaagatg

SEQ ID NO: 175493 - DNA, 103 bp, Artificial Sequence
  Synthetic Polynucleotide
taatacgactcactatagggccaggattttcagaggtttcttgtgagactaacagaggagaagtctcatgagaaacctcaacctggcggcagcgcaaaagatg

SEQ ID NO: 175494 - DNA, 103 bp, Artificial Sequence
  Synthetic Polynucleotide
taatacgactcactatagggtgttttgttaccaggattttcagaggtttcaacagaggagagaaaccatggaaaatcctaacctggcggcagcgcaaaagatg

SEQ ID NO: 175495 - DNA, 103 bp, Artificial Sequence
  Synthetic Polynucleotide
taatacgactcactatagggcaggaactattgttttgttaccaggattttaacagaggagaaaaatcatggtaacaaaaaacctggcggcagcgcaaaagatg

SEQ ID NO: 175496 - DNA, 103 bp, Artificial Sequence
  Synthetic Polynucleotide
taatacgactcactatagggggtaacgttgcaggaactattgttttgttaaacagaggagataacaaatgaatagttccaacctggcggcagcgcaaaagatg

SEQ ID NO: 175497 - DNA, 103 bp, Artificial Sequence
  Synthetic Polynucleotide
taatacgactcactatagggggtgagttgtggtaacgttgcaggaactataacagaggagaatagttatggcaacgttaaacctggcggcagcgcaaaagatg

SEQ ID NO: 175498 - DNA, 103 bp, Artificial Sequence
  Synthetic Polynucleotide
taatacgactcactatagggccagggtaggggtgagttgtggtaacgttgaacagaggagacaacgtatgcacaactcaaacctggcggcagcgcaaaagatg

SEQ ID NO: 175499 - DNA, 103 bp, Artificial Sequence
  Synthetic Polynucleotide
taatacgactcactatagggaacagtgacaccagggtaggggtgagttgtaacagaggagaacaactatgccctaccctaacctggcggcagcgcaaaagatg

SEQ ID NO: 175500 - DNA, 103 bp, Artificial Sequence
  Synthetic Polynucleotide
taatacgactcactatagggtcttcgctgcttggagtctgattgagaagcaacagaggagagcttctatgtcagactccaacctggcggcagcgcaaaagatg

SEQ ID NO: 175501 - DNA, 103 bp, Artificial Sequence
  Synthetic Polynucleotide
taatacgactcactatagggaataacctccaacagtgacaccagggtaggaacagaggagacctaccatggtgtcactgaacctggcggcagcgcaaaagatg

SEQ ID NO: 175502 - DNA, 103 bp, Artificial Sequence
  Synthetic Polynucleotide
taatacgactcactatagggcttcaggttcaataacctccaacagtgacaaacagaggagatgtcacatgtggaggttaaacctggcggcagcgcaaaagatg

SEQ ID NO: 175503 - DNA, 103 bp, Artificial Sequence
  Synthetic Polynucleotide
taatacgactcactataggggcatataacacttcaggttcaataacctccaacagaggagaggaggtatgtgaacctgaaacctggcggcagcgcaaaagatg

SEQ ID NO: 175504 - DNA, 103 bp, Artificial Sequence
  Synthetic Polynucleotide
taatacgactcactatagggatcatatcctgcatataacacttcaggttcaacagaggagagaacctatggtgttatataacctggcggcagcgcaaaagatg

SEQ ID NO: 175505 - DNA, 103 bp, Artificial Sequence
  Synthetic Polynucleotide
taatacgactcactataggggaacagagctatcatatcctgcatataacaaacagaggagatgttatatgcaggatatgaacctggcggcagcgcaaaagatg

SEQ ID NO: 175506 - DNA, 103 bp, Artificial Sequence
  Synthetic Polynucleotide
taatacgactcactataggggttgagtctggaacagagctatcatatcctaacagaggagaaggataatgtagctctgtaacctggcggcagcgcaaaagatg

SEQ ID NO: 175507 - DNA, 103 bp, Artificial Sequence
  Synthetic Polynucleotide
taatacgactcactataggggatcctccaagttgagtctggaacagagctaacagaggagaagctctatgccagactcaaacctggcggcagcgcaaaagatg

SEQ ID NO: 175508 - DNA, 103 bp, Artificial Sequence
  Synthetic Polynucleotide
taatacgactcactataggggcgtagtcatgatcctccaagttgagtctgaacagaggagacagactatgcttggaggaaacctggcggcagcgcaaaagatg

SEQ ID NO: 175509 - DNA, 103 bp, Artificial Sequence
  Synthetic Polynucleotide
taatacgactcactatagggaacatgttgagcgtagtcatgatcctccaaaacagaggagattggagatgcatgactacaacctggcggcagcgcaaaagatg

SEQ ID NO: 175510 - DNA, 103 bp, Artificial Sequence
  Synthetic Polynucleotide
taatacgactcactatagggccgccctcctaacatgttgagcgtagtcataacagaggagaatgactatgctcaacatgaacctggcggcagcgcaaaagatg

SEQ ID NO: 175511 - DNA, 103 bp, Artificial Sequence
  Synthetic Polynucleotide
taatacgactcactatagggcaaccaaaagtcttcgctgcttggagtctgaacagaggagacagactatgagcagcgaaaacctggcggcagcgcaaaagatg

SEQ ID NO: 175512 - DNA, 103 bp, Artificial Sequence
  Synthetic Polynucleotide
taatacgactcactatagggcaatcacttgccgccctcctaacatgttgaaacagaggagatcaacaatgtaggagggcaacctggcggcagcgcaaaagatg

SEQ ID NO: 175513 - DNA, 103 bp, Artificial Sequence
  Synthetic Polynucleotide
taatacgactcactatagggttcactgctgcaatcacttgccgccctcctaacagaggagaaggaggatggcaagtgataacctggcggcagcgcaaaagatg

SEQ ID NO: 175514 - DNA, 103 bp, Artificial Sequence
  Synthetic Polynucleotide
taatacgactcactatagggctttgcccatttcactgctgcaatcacttgaacagaggagacaagtgatggcagcagtgaacctggcggcagcgcaaaagatg

SEQ ID NO: 175515 - DNA, 103 bp, Artificial Sequence
  Synthetic Polynucleotide
taatacgactcactatagggctggtattgcctttgcccatttcactgctgaacagaggagacagcagatgaatgggcaaaacctggcggcagcgcaaaagatg

SEQ ID NO: 175516 - DNA, 103 bp, Artificial Sequence
  Synthetic Polynucleotide
taatacgactcactatagggttcctgaaacctggtattgcctttgcccataacagaggagaatgggcatgggcaataccaacctggcggcagcgcaaaagatg

SEQ ID NO: 175517 - DNA, 103 bp, Artificial Sequence
  Synthetic Polynucleotide
taatacgactcactatagggcaggtgtaagttcctgaaacctggtattgcaacagaggagagcaataatgggtttcaggaacctggcggcagcgcaaaagatg

SEQ ID NO: 175518 - DNA, 103 bp, Artificial Sequence
  Synthetic Polynucleotide
taatacgactcactatagggtttggtcatccaggtgtaagttcctgaaacaacagaggagagtttcaatgacttacaccaacctggcggcagcgcaaaagatg

SEQ ID NO: 175519 - DNA, 103 bp, Artificial Sequence
  Synthetic Polynucleotide
taatacgactcactatagggagtagggtcatttggtcatccaggtgtaagaacagaggagacttacaatgggatgaccaaacctggcggcagcgcaaaagatg

SEQ ID NO: 175520 - DNA, 103 bp, Artificial Sequence
  Synthetic Polynucleotide
taatacgactcactatagggggagtactgcagtagggtcatttggtcatcaacagaggagagatgacatgatgaccctaaacctggcggcagcgcaaaagatg

SEQ ID NO: 175521 - DNA, 103 bp, Artificial Sequence
  Synthetic Polynucleotide
taatacgactcactataggggaaacatccaggagtactgcagtagggtcaaacagaggagatgacccatgtgcagtactaacctggcggcagcgcaaaagatg

SEQ ID NO: 175522 - DNA, 103 bp, Artificial Sequence
  Synthetic Polynucleotide
taatacgactcactatagggtttggaaaatcaaccaaaagtcttcgctgcaacagaggagagcagcgatgacttttggtaacctggcggcagcgcaaaagatg

SEQ ID NO: 175523 - DNA, 103 bp, Artificial Sequence
  Synthetic Polynucleotide
taatacgactcactatagggaatgccataagaaacatccaggagtactgcaacagaggagagcagtaatgctggatgttaacctggcggcagcgcaaaagatg

SEQ ID NO: 175524 - DNA, 103 bp, Artificial Sequence
  Synthetic Polynucleotide
taatacgactcactatagggccccagagcaaatgccataagaaacatccaaacagaggagatggatgatgcttatggcaaacctggcggcagcgcaaaagatg

SEQ ID NO: 175525 - DNA, 103 bp, Artificial Sequence
  Synthetic Polynucleotide
taatacgactcactatagggatgatctccaccccagagcaaatgccataaaacagaggagattatggatgttgctctggaacctggcggcagcgcaaaagatg

SEQ ID NO: 175526 - DNA, 103 bp, Artificial Sequence
  Synthetic Polynucleotide
taatacgactcactataggggattgtctatatgatctccaccccagagcaaacagaggagatgctctatggtggagatcaacctggcggcagcgcaaaagatg

SEQ ID NO: 175527 - DNA, 103 bp, Artificial Sequence
  Synthetic Polynucleotide
taatacgactcactataggggtttgcacttgattgtctatatgatctccaaacagaggagatggagaatgtatagacaaaacctggcggcagcgcaaaagatg

SEQ ID NO: 175528 - DNA, 103 bp, Artificial Sequence
  Synthetic Polynucleotide
taatacgactcactatagggaacacagcaggtttgcacttgattgtctataacagaggagaatagacatgcaagtgcaaaacctggcggcagcgcaaaagatg

SEQ ID NO: 175529 - DNA, 103 bp, Artificial Sequence
  Synthetic Polynucleotide
taatacgactcactatagggtcaggagcaaaacacagcaggtttgcacttaacagaggagaaagtgcatgcctgctgtgaacctggcggcagcgcaaaagatg

SEQ ID NO: 175530 - DNA, 103 bp, Artificial Sequence
  Synthetic Polynucleotide
taatacgactcactatagggaataatcagatcaggagcaaaacacagcagaacagaggagactgctgatgtttgctcctaacctggcggcagcgcaaaagatg

SEQ ID NO: 175531 - DNA, 103 bp, Artificial Sequence
  Synthetic Polynucleotide
taatacgactcactatagggtctgctcattaataatcagatcaggagcaaaacagaggagattgctcatgatctgattaaacctggcggcagcgcaaaagatg

SEQ ID NO: 175532 - DNA, 103 bp, Artificial Sequence
  Synthetic Polynucleotide
taatacgactcactatagggagagtcattctctgctcattaataatcagaaacagaggagatctgatatgtaatgagcaaacctggcggcagcgcaaaagatg

SEQ ID NO: 175533 - DNA, 103 bp, Artificial Sequence
  Synthetic Polynucleotide
taatacgactcactatagggtactgagccttttggaaaatcaaccaaaagaacagaggagacttttgatggattttccaaacctggcggcagcgcaaaagatg

SEQ ID NO: 175534 - DNA, 103 bp, Artificial Sequence
  Synthetic Polynucleotide
taatacgactcactatagggcatgcagggtagagtcattctctgctcattaacagaggagaaatgagatgagaatgactaacctggcggcagcgcaaaagatg

SEQ ID NO: 175535 - DNA, 103 bp, Artificial Sequence
  Synthetic Polynucleotide
taatacgactcactatagggattggtcgtacatgcagggtagagtcattcaacagaggagagaatgaatgtaccctgcaaacctggcggcagcgcaaaagatg

SEQ ID NO: 175536 - DNA, 103 bp, Artificial Sequence
  Synthetic Polynucleotide
taatacgactcactatagggatgtgtttacattggtcgtacatgcagggtaacagaggagaaccctgatggtacgaccaaacctggcggcagcgcaaaagatg

SEQ ID NO: 175537 - DNA, 103 bp, Artificial Sequence
  Synthetic Polynucleotide
taatacgactcactatagggaacatacagcatgtgtttacattggtcgtaaacagaggagatacgacatgtgtaaacacaacctggcggcagcgcaaaagatg

SEQ ID NO: 175538 - DNA, 103 bp, Artificial Sequence
  Synthetic Polynucleotide
taatacgactcactatagggactcagaggaaacatacagcatgtgtttacaacagaggagagtaaacatgtgctgtatgaacctggcggcagcgcaaaagatg

SEQ ID NO: 175539 - DNA, 103 bp, Artificial Sequence
  Synthetic Polynucleotide
taatacgactcactatagggagcctgtgtaactcagaggaaacatacagcaacagaggagagctgtaatgttcctctgaaacctggcggcagcgcaaaagatg

SEQ ID NO: 175540 - DNA, 103 bp, Artificial Sequence
  Synthetic Polynucleotide
taatacgactcactatagggagatacctgaagcctgtgtaactcagaggaaacagaggagatcctctatgttacacaggaacctggcggcagcgcaaaagatg

SEQ ID NO: 175541 - DNA, 103 bp, Artificial Sequence
  Synthetic Polynucleotide
taatacgactcactatagggactcttcataagatacctgaagcctgtgtaaacagaggagatacacaatgttcaggtataacctggcggcagcgcaaaagatg

SEQ ID NO: 175542 - DNA, 103 bp, Artificial Sequence
  Synthetic Polynucleotide
taatacgactcactatagggatacagagatactcttcataagatacctgaaacagaggagatcaggtatgttatgaagaaacctggcggcagcgcaaaagatg

SEQ ID NO: 175543 - DNA, 103 bp, Artificial Sequence
  Synthetic Polynucleotide
taatacgactcactatagggtaaggttttcatacagagatactcttcataaacagaggagatatgaaatgtatctctgtaacctggcggcagcgcaaaagatg

SEQ ID NO: 175544 - DNA, 103 bp, Artificial Sequence
  Synthetic Polynucleotide
taatacgactcactatagggtttcttctctaccaggagttaatgattcttaacagaggagaaagaatatgtaactcctgaacctggcggcagcgcaaaagatg

SEQ ID NO: 175545 - DNA, 103 bp, Artificial Sequence
  Synthetic Polynucleotide
taatacgactcactataggggcgcattgcttactgagccttttggaaaataacagaggagaattttcatgaaggctcagaacctggcggcagcgcaaaagatg

SEQ ID NO: 175546 - DNA, 103 bp, Artificial Sequence
  Synthetic Polynucleotide
taatacgactcactatagggagagaagcagtaaggttttcatacagagataacagaggagaatctctatgtgaaaacctaacctggcggcagcgcaaaagatg

SEQ ID NO: 175547 - DNA, 103 bp, Artificial Sequence
  Synthetic Polynucleotide
taatacgactcactatagggggaactgaagagagaagcagtaaggttttcaacagaggagagaaaacatgactgcttctaacctggcggcagcgcaaaagatg

SEQ ID NO: 175548 - DNA, 103 bp, Artificial Sequence
  Synthetic Polynucleotide
taatacgactcactatagggaccgtccttaggaactgaagagagaagcagaacagaggagactgcttatgtcttcagttaacctggcggcagcgcaaaagatg

SEQ ID NO: 175549 - DNA, 103 bp, Artificial Sequence
  Synthetic Polynucleotide
taatacgactcactatagggggctcttcagaccgtccttaggaactgaagaacagaggagacttcagatgctaaggacgaacctggcggcagcgcaaaagatg

SEQ ID NO: 175550 - DNA, 103 bp, Artificial Sequence
  Synthetic Polynucleotide
taatacgactcactatagggaatagctcttggctcttcagaccgtccttaaacagaggagataaggaatgtctgaagagaacctggcggcagcgcaaaagatg

SEQ ID NO: 175551 - DNA, 103 bp, Artificial Sequence
  Synthetic Polynucleotide
taatacgactcactatagggaatttcatcaaatagctcttggctcttcagaacagaggagactgaagatgcaagagctaaacctggcggcagcgcaaaagatg

SEQ ID NO: 175552 - DNA, 103 bp, Artificial Sequence
  Synthetic Polynucleotide
taatacgactcactatagggaggtcattctaatttcatcaaatagctcttaacagaggagaaagagcatgttgatgaaaaacctggcggcagcgcaaaagatg

SEQ ID NO: 175553 - DNA, 103 bp, Artificial Sequence
  Synthetic Polynucleotide
taatacgactcactatagggtctttgatgtaggtcattctaatttcatcaaacagaggagatgatgaatgtagaatgacaacctggcggcagcgcaaaagatg

SEQ ID NO: 175554 - DNA, 103 bp, Artificial Sequence
  Synthetic Polynucleotide
taatacgactcactatagggttttcctagctctttgatgtaggtcattctaacagaggagaagaatgatgtacatcaaaaacctggcggcagcgcaaaagatg

SEQ ID NO: 175555 - DNA, 103 bp, Artificial Sequence
  Synthetic Polynucleotide
taatacgactcactatagggtgacaatggcttttcctagctctttgatgtaacagaggagaacatcaatgagctaggaaaacctggcggcagcgcaaaagatg

SEQ ID NO: 175556 - DNA, 103 bp, Artificial Sequence
  Synthetic Polynucleotide
taatacgactcactatagggtctggctgctgcgcattgcttactgagcctaacagaggagaaggctcatgaagcaatgcaacctggcggcagcgcaaaagatg

SEQ ID NO: 175557 - DNA, 103 bp, Artificial Sequence
  Synthetic Polynucleotide
taatacgactcactatagggccttccctcttgacaatggcttttcctagcaacagaggagagctaggatgagccattgtaacctggcggcagcgcaaaagatg

SEQ ID NO: 175558 - DNA, 103 bp, Artificial Sequence
  Synthetic Polynucleotide
taatacgactcactataggggctggagtttccttccctcttgacaatggcaacagaggagagccattatgaagagggaaaacctggcggcagcgcaaaagatg

SEQ ID NO: 175559 - DNA, 103 bp, Artificial Sequence
  Synthetic Polynucleotide
taatacgactcactataggggccagttctggctggagtttccttccctctaacagaggagaagagggatggaaactccaaacctggcggcagcgcaaaagatg

SEQ ID NO: 175560 - DNA, 103 bp, Artificial Sequence
  Synthetic Polynucleotide
taatacgactcactatagggtaaaaccgctgccagttctggctggagtttaacagaggagaaaactcatgccagaactgaacctggcggcagcgcaaaagatg

SEQ ID NO: 175561 - DNA, 103 bp, Artificial Sequence
  Synthetic Polynucleotide
taatacgactcactatagggtgtcagttgataaaaccgctgccagttctgaacagaggagacagaacatgcagcggtttaacctggcggcagcgcaaaagatg

SEQ ID NO: 175562 - DNA, 103 bp, Artificial Sequence
  Synthetic Polynucleotide
taatacgactcactatagggccaagagttttgtcagttgataaaaccgctaacagaggagaagcggtatgatcaactgaaacctggcggcagcgcaaaagatg

SEQ ID NO: 175563 - DNA, 103 bp, Artificial Sequence
  Synthetic Polynucleotide
taatacgactcactatagggtgcatagaatccaagagttttgtcagttgaaacagaggagatcaactatgaaaactcttaacctggcggcagcgcaaaagatg

SEQ ID NO: 175564 - DNA, 103 bp, Artificial Sequence
  Synthetic Polynucleotide
taatacgactcactatagggaaccacttcatgcatagaatccaagagtttaacagaggagaaaactcatggattctatgaacctggcggcagcgcaaaagatg

SEQ ID NO: 175565 - DNA, 103 bp, Artificial Sequence
  Synthetic Polynucleotide
taatacgactcactatagggggagattttcaaccacttcatgcatagaataacagaggagaattctaatgatgaagtggaacctggcggcagcgcaaaagatg

SEQ ID NO: 175566 - DNA, 103 bp, Artificial Sequence
  Synthetic Polynucleotide
taatacgactcactatagggcaatagttaaggagattttcaaccacttcaaacagaggagatgaagtatgtgaaaatctaacctggcggcagcgcaaaagatg

SEQ ID NO: 175567 - DNA, 103 bp, Artificial Sequence
  Synthetic Polynucleotide
taatacgactcactatagggtttggacagatctggctgctgcgcattgctaacagaggagaagcaatatgcagcagccaaacctggcggcagcgcaaaagatg

SEQ ID NO: 175568 - DNA, 103 bp, Artificial Sequence
  Synthetic Polynucleotide
taatacgactcactatagggtgtttggaagcaatagttaaggagattttcaacagaggagagaaaatatgcttaactataacctggcggcagcgcaaaagatg

SEQ ID NO: 175569 - DNA, 103 bp, Artificial Sequence
  Synthetic Polynucleotide
taatacgactcactatagggtatccaaaaatgtttggaagcaatagttaaaacagaggagattaactatggcttccaaaaacctggcggcagcgcaaaagatg

SEQ ID NO: 175570 - DNA, 103 bp, Artificial Sequence
  Synthetic Polynucleotide
taatacgactcactatagggctcatggtcttatccaaaaatgtttggaagaacagaggagacttccaatgatttttggaaacctggcggcagcgcaaaagatg

SEQ ID NO: 175571 - DNA, 103 bp, Artificial Sequence
  Synthetic Polynucleotide
taatacgactcactataggggaattcaatactcatggtcttatccaaaaaaacagaggagatttttgatgaagaccatgaacctggcggcagcgcaaaagatg

SEQ ID NO: 175572 - DNA, 103 bp, Artificial Sequence
  Synthetic Polynucleotide
taatacgactcactatagggacatctcggggaattcaatactcatggtctaacagaggagaagaccaatggtattgaataacctggcggcagcgcaaaagatg

SEQ ID NO: 175573 - DNA, 103 bp, Artificial Sequence
  Synthetic Polynucleotide
taatacgactcactatagggatttcagctaacatctcggggaattcaataaacagaggagatattgaatgccccgagataacctggcggcagcgcaaaagatg

SEQ ID NO: 175574 - DNA, 103 bp, Artificial Sequence
  Synthetic Polynucleotide
taatacgactcactatagggattggtgatgatttcagctaacatctcgggaacagaggagacccgagatgttagctgaaaacctggcggcagcgcaaaagatg

SEQ ID NO: 175575 - DNA, 103 bp, Artificial Sequence
  Synthetic Polynucleotide
taatacgactcactatagggttggtatctgattggtgatgatttcagctaaacagaggagatagctgatgtcatcaccaaacctggcggcagcgcaaaagatg

SEQ ID NO: 175576 - DNA, 103 bp, Artificial Sequence
  Synthetic Polynucleotide
taatacgactcactatagggtttgaatattttggtatctgattggtgatgaacagaggagacatcacatgtcagataccaacctggcggcagcgcaaaagatg

SEQ ID NO: 175577 - DNA, 103 bp, Artificial Sequence
  Synthetic Polynucleotide
taatacgactcactataggggatatttccatttgaatattttggtatctgaacagaggagacagataatgaaatattcaaacctggcggcagcgcaaaagatg

SEQ ID NO: 175578 - DNA, 103 bp, Artificial Sequence
  Synthetic Polynucleotide
taatacgactcactataggggtgaaactgctttggacagatctggctgctaacagaggagaagcagcatgatctgtccaaacctggcggcagcgcaaaagatg

SEQ ID NO: 175579 - DNA, 103 bp, Artificial Sequence
  Synthetic Polynucleotide
taatacgactcactataggggaagttttttgatatttccatttgaatattaacagaggagaaatattatgatggaaataaacctggcggcagcgcaaaagatg

SEQ ID NO: 175580 - DNA, 103 bp, Artificial Sequence
  Synthetic Polynucleotide
taatacgactcactatagggtgatgaaacagaagttttttgatatttccaaacagaggagatggaaaatgcaaaaaactaacctggcggcagcgcaaaagatg

SEQ ID NO: 175581 - DNA, 103 bp, Artificial Sequence
  Synthetic Polynucleotide
taatacgactcactatagggcccattgagagtgaaactgctttggacagaaacagaggagatctgtcatgagcagtttcaacctggcggcagcgcaaaagatg

SEQ ID NO: 175582 - DNA, 103 bp, Artificial Sequence
  Synthetic Polynucleotide
taatacgactcactatagggcatatacagtcccattgagagtgaaactgcaacagaggagagcagttatgctctcaatgaacctggcggcagcgcaaaagatg

SEQ ID NO: 175583 - DNA, 103 bp, Artificial Sequence
  Synthetic Polynucleotide
taatacgactcactatagggctgtctctcccatatacagtcccattgagaaacagaggagatctcaaatggactgtataaacctggcggcagcgcaaaagatg

SEQ ID NO: 175584 - DNA, 103 bp, Artificial Sequence
  Synthetic Polynucleotide
taatacgactcactatagggacttttgtttctgtctctcccatatacagtaacagaggagaactgtaatggggagagacaacctggcggcagcgcaaaagatg

SEQ ID NO: 175585 - DNA, 103 bp, Artificial Sequence
  Synthetic Polynucleotide
taatacgactcactatagggatttcccatcacttttgtttctgtctctccaacagaggagaggagagatggaaacaaaaaacctggcggcagcgcaaaagatg

SEQ ID NO: 175586 - DNA, 103 bp, Artificial Sequence
  Synthetic Polynucleotide
taatacgactcactatagggatcccaggtcatttcccatcacttttgtttaacagaggagaaaacaaatgtgatgggaaaacctggcggcagcgcaaaagatg

SEQ ID NO: 175587 - DNA, 103 bp, Artificial Sequence
  Synthetic Polynucleotide
taatacgactcactatagggctgctggggttttcttctctaccaggagttaacagaggagaaactccatgtagagaagaaacctggcggcagcgcaaaagatg

SEQ ID NO: 175588 - DNA, 103 bp, Artificial Sequence
  Synthetic Polynucleotide
taatacgactcactatagggtgctgtgggaatcccaggtcatttcccatcaacagaggagagatgggatgtgacctgggaacctggcggcagcgcaaaagatg

SEQ ID NO: 175589 - DNA, 103 bp, Artificial Sequence
  Synthetic Polynucleotide
taatacgactcactataggggatttggccctgctgtgggaatcccaggtcaacagaggagagacctgatgttcccacagaacctggcggcagcgcaaaagatg

SEQ ID NO: 175590 - DNA, 103 bp, Artificial Sequence
  Synthetic Polynucleotide
taatacgactcactatagggaggaaaggctgatttggccctgctgtgggaaacagaggagatcccacatgagggccaaaaacctggcggcagcgcaaaagatg

SEQ ID NO: 175591 - DNA, 103 bp, Artificial Sequence
  Synthetic Polynucleotide
taatacgactcactataggggtttcccccgaggaaaggctgatttggcccaacagaggagagggccaatgcagcctttcaacctggcggcagcgcaaaagatg

SEQ ID NO: 175592 - DNA, 103 bp, Artificial Sequence
  Synthetic Polynucleotide
taatacgactcactatagggctttaagtctgtttcccccgaggaaaggctaacagaggagaagccttatgtcgggggaaaacctggcggcagcgcaaaagatg

SEQ ID NO: 175593 - DNA, 103 bp, Artificial Sequence
  Synthetic Polynucleotide
taatacgactcactatagggcttccaaaagctttaagtctgtttcccccgaacagaggagacgggggatgcagacttaaaacctggcggcagcgcaaaagatg

SEQ ID NO: 175594 - DNA, 103 bp, Artificial Sequence
  Synthetic Polynucleotide
taatacgactcactataggggcaatgctttcttccaaaagctttaagtctaacagaggagaagacttatggcttttggaaacctggcggcagcgcaaaagatg

SEQ ID NO: 175595 - DNA, 103 bp, Artificial Sequence
  Synthetic Polynucleotide
taatacgactcactatagggattgaggtttgcaatgctttcttccaaaagaacagaggagacttttgatggaaagcattaacctggcggcagcgcaaaagatg

SEQ ID NO: 175596 - DNA, 103 bp, Artificial Sequence
  Synthetic Polynucleotide
taatacgactcactatagggtggtcgacctattgaggtttgcaatgctttaacagaggagaaaagcaatgcaaacctcaaacctggcggcagcgcaaaagatg

SEQ ID NO: 175597 - DNA, 103 bp, Artificial Sequence
  Synthetic Polynucleotide
taatacgactcactatagggtctggaacactggtcgacctattgaggtttaacagaggagaaaacctatgtaggtcgacaacctggcggcagcgcaaaagatg

SEQ ID NO: 175598 - DNA, 103 bp, Artificial Sequence
  Synthetic Polynucleotide
taatacgactcactatagggagcaagcacactgctggggttttcttctctaacagaggagaagagaaatgaaccccagcaacctggcggcagcgcaaaagatg

SEQ ID NO: 175599 - DNA, 103 bp, Artificial Sequence
  Synthetic Polynucleotide
taatacgactcactatagggcttggggttctctggaacactggtcgacctaacagaggagaaggtcgatgagtgttccaaacctggcggcagcgcaaaagatg

SEQ ID NO: 175600 - DNA, 103 bp, Artificial Sequence
  Synthetic Polynucleotide
taatacgactcactatagggatgctgaactcttggggttctctggaacacaacagaggagagtgttcatgagaaccccaaacctggcggcagcgcaaaagatg

SEQ ID NO: 175601 - DNA, 103 bp, Artificial Sequence
  Synthetic Polynucleotide
taatacgactcactatagggacagcagtggatgctgaactcttggggttcaacagaggagagaacccatggagttcagcaacctggcggcagcgcaaaagatg

SEQ ID NO: 175602 - DNA, 103 bp, Artificial Sequence
  Synthetic Polynucleotide
taatacgactcactatagggggcagcagacacagcagtggatgctgaactaacagaggagaagttcaatgtccactgctaacctggcggcagcgcaaaagatg

SEQ ID NO: 175603 - DNA, 103 bp, Artificial Sequence
  Synthetic Polynucleotide
taatacgactcactatagggtctctgtgggggcagcagacacagcagtggaacagaggagaccactgatgtgtctgctgaacctggcggcagcgcaaaagatg

SEQ ID NO: 175604 - DNA, 103 bp, Artificial Sequence
  Synthetic Polynucleotide
taatacgactcactatagggggaaactccttctctgtgggggcagcagacaacagaggagagtctgcatgccccacagaaacctggcggcagcgcaaaagatg

SEQ ID NO: 175605 - DNA, 103 bp, Artificial Sequence
  Synthetic Polynucleotide
taatacgactcactataggggtgagtttttggaaactccttctctgtgggaacagaggagacccacaatgaaggagtttaacctggcggcagcgcaaaagatg

SEQ ID NO: 175606 - DNA, 103 bp, Artificial Sequence
  Synthetic Polynucleotide
taatacgactcactatagggatacatcagagtgagtttttggaaactcctaacagaggagaaggagtatgcaaaaactcaacctggcggcagcgcaaaagatg

SEQ ID NO: 175607 - DNA, 103 bp, Artificial Sequence
  Synthetic Polynucleotide
taatacgactcactatagggtgttctgaagatacatcagagtgagtttttaacagaggagaaaaaacatgctctgatgtaacctggcggcagcgcaaaagatg

SEQ ID NO: 175608 - DNA, 103 bp, Artificial Sequence
  Synthetic Polynucleotide
taatacgactcactatagggcaaatgttgctgttctgaagatacatcagaaacagaggagatctgatatgtcttcagaaaacctggcggcagcgcaaaagatg

SEQ ID NO: 175609 - DNA, 103 bp, Artificial Sequence
  Synthetic Polynucleotide
taatacgactcactatagggccctctcctgagcaagcacactgctggggtaacagaggagaaccccaatggtgtgcttgaacctggcggcagcgcaaaagatg

SEQ ID NO: 175610 - DNA, 103 bp, Artificial Sequence
  Synthetic Polynucleotide
taatacgactcactatagggtctggcccttcaaatgttgctgttctgaagaacagaggagacttcagatgagcaacattaacctggcggcagcgcaaaagatg

SEQ ID NO: 175611 - DNA, 103 bp, Artificial Sequence
  Synthetic Polynucleotide
taatacgactcactatagggttggtgccagtctggcccttcaaatgttgcaacagaggagagcaacaatggaagggccaaacctggcggcagcgcaaaagatg

SEQ ID NO: 175612 - DNA, 103 bp, Artificial Sequence
  Synthetic Polynucleotide
taatacgactcactatagggattgccaccgttggtgccagtctggcccttaacagaggagaaagggcatgactggcaccaacctggcggcagcgcaaaagatg

SEQ ID NO: 175613 - DNA, 103 bp, Artificial Sequence
  Synthetic Polynucleotide
taatacgactcactatagggacaatttcacattgccaccgttggtgccagaacagaggagactggcaatgacggtggcaaacctggcggcagcgcaaaagatg

SEQ ID NO: 175614 - DNA, 103 bp, Artificial Sequence
  Synthetic Polynucleotide
taatacgactcactatagggtctgtggtatacaatttcacattgccaccgaacagaggagacggtggatgtgtgaaattaacctggcggcagcgcaaaagatg

SEQ ID NO: 175615 - DNA, 103 bp, Artificial Sequence
  Synthetic Polynucleotide
taatacgactcactatagggggtgctttggtctgtggtatacaatttcacaacagaggagagtgaaaatgtataccacaaacctggcggcagcgcaaaagatg

SEQ ID NO: 175616 - DNA, 103 bp, Artificial Sequence
  Synthetic Polynucleotide
taatacgactcactatagggaaatgtcaaaggtgctttggtctgtggtataacagaggagaataccaatgaccaaagcaaacctggcggcagcgcaaaagatg

SEQ ID NO: 175617 - DNA, 103 bp, Artificial Sequence
  Synthetic Polynucleotide
taatacgactcactatagggaaatcctgcaaaatgtcaaaggtgctttggaacagaggagaccaaagatgctttgacataacctggcggcagcgcaaaagatg

SEQ ID NO: 175618 - DNA, 103 bp, Artificial Sequence
  Synthetic Polynucleotide
taatacgactcactatagggagaaaactccaaatcctgcaaaatgtcaaaaacagaggagatttgacatgttgcaggataacctggcggcagcgcaaaagatg

SEQ ID NO: 175619 - DNA, 103 bp, Artificial Sequence
  Synthetic Polynucleotide
taatacgactcactataggggggacccagaagaaaactccaaatcctgcaaacagaggagatgcaggatgtggagttttaacctggcggcagcgcaaaagatg

SEQ ID NO: 175620 - DNA, 103 bp, Artificial Sequence
  Synthetic Polynucleotide
taatacgactcactatagggatcacatctcccctctcctgagcaagcacaaacagaggagatgtgctatgtcaggagagaacctggcggcagcgcaaaagatg

SEQ ID NO: 175621 - DNA, 103 bp, Artificial Sequence
  Synthetic Polynucleotide
taatacgactcactatagggtctttacctggggacccagaagaaaactccaacagaggagaggagttatgttctgggtcaacctggcggcagcgcaaaagatg

SEQ ID NO: 175622 - DNA, 103 bp, Artificial Sequence
  Synthetic Polynucleotide
taatacgactcactatagggctcattcgtctctttacctggggacccagaaacagaggagatctgggatgccaggtaaaaacctggcggcagcgcaaaagatg

SEQ ID NO: 175623 - DNA, 103 bp, Artificial Sequence
  Synthetic Polynucleotide
taatacgactcactatagggtccaaggactctcattcgtctctttacctgaacagaggagacaggtaatgagacgaatgaacctggcggcagcgcaaaagatg

SEQ ID NO: 175624 - DNA, 103 bp, Artificial Sequence
  Synthetic Polynucleotide
taatacgactcactatagggaggtctgatctccaaggactctcattcgtcaacagaggagagacgaaatggagtccttgaacctggcggcagcgcaaaagatg

SEQ ID NO: 175625 - DNA, 103 bp, Artificial Sequence
  Synthetic Polynucleotide
taatacgactcactatagggatctatcaacaggtctgatctccaaggactaacagaggagaagtcctatgagatcagacaacctggcggcagcgcaaaagatg

SEQ ID NO: 175626 - DNA, 103 bp, Artificial Sequence
  Synthetic Polynucleotide
taatacgactcactatagggaacagttttcatctatcaacaggtctgatcaacagaggagagatcagatgtgttgatagaacctggcggcagcgcaaaagatg

SEQ ID NO: 175627 - DNA, 103 bp, Artificial Sequence
  Synthetic Polynucleotide
taatacgactcactatagggggagaaagcaaacagttttcatctatcaacaacagaggagagttgatatgtgaaaactgaacctggcggcagcgcaaaagatg

SEQ ID NO: 175628 - DNA, 103 bp, Artificial Sequence
  Synthetic Polynucleotide
taatacgactcactatagggtcccgccagaggagaaagcaaacagttttcaacagaggagagaaaacatgttgctttctaacctggcggcagcgcaaaagatg

SEQ ID NO: 175629 - DNA, 103 bp, Artificial Sequence
  Synthetic Polynucleotide
taatacgactcactatagggaatcgtcttctcccgccagaggagaaagcaaacagaggagatgctttatgctctggcggaacctggcggcagcgcaaaagatg

SEQ ID NO: 175630 - DNA, 103 bp, Artificial Sequence
  Synthetic Polynucleotide
taatacgactcactatagggaaaaggaatgaatcgtcttctcccgccagaaacagaggagatctggcatgagaagacgaaacctggcggcagcgcaaaagatg

SEQ ID NO: 175631 - DNA, 103 bp, Artificial Sequence
  Synthetic Polynucleotide
taatacgactcactatagggatagaagtccatcacatctcccctctcctgaacagaggagacaggagatgggagatgtgaacctggcggcagcgcaaaagatg

SEQ ID NO: 175632 - DNA, 103 bp, Artificial Sequence
  Synthetic Polynucleotide
taatacgactcactataggggtttccttccaaaaggaatgaatcgtcttcaacagaggagagaagacatgtcattccttaacctggcggcagcgcaaaagatg

SEQ ID NO: 175633 - DNA, 103 bp, Artificial Sequence
  Synthetic Polynucleotide
taatacgactcactatagggcctcattcgagtttccttccaaaaggaatgaacagaggagacattccatgtggaaggaaaacctggcggcagcgcaaaagatg

SEQ ID NO: 175634 - DNA, 103 bp, Artificial Sequence
  Synthetic Polynucleotide
taatacgactcactatagggggcttgcagtcctcattcgagtttccttccaacagaggagaggaaggatgctcgaatgaaacctggcggcagcgcaaaagatg

SEQ ID NO: 175635 - DNA, 103 bp, Artificial Sequence
  Synthetic Polynucleotide
taatacgactcactatagggtaaaatgagaggcttgcagtcctcattcgaaacagaggagatcgaatatggactgcaagaacctggcggcagcgcaaaagatg

SEQ ID NO: 175636 - DNA, 103 bp, Artificial Sequence
  Synthetic Polynucleotide
taatacgactcactatagggtagtgtccggtaaaatgagaggcttgcagtaacagaggagaactgcaatgctctcatttaacctggcggcagcgcaaaagatg

SEQ ID NO: 175637 - DNA, 103 bp, Artificial Sequence
  Synthetic Polynucleotide
taatacgactcactatagggattttgggtttagtgtccggtaaaatgagaaacagaggagatctcatatgaccggacacaacctggcggcagcgcaaaagatg

SEQ ID NO: 175638 - DNA, 103 bp, Artificial Sequence
  Synthetic Polynucleotide
taatacgactcactatagggattatccttaattttgggtttagtgtccggaacagaggagaccggacatgaaacccaaaaacctggcggcagcgcaaaagatg

SEQ ID NO: 175639 - DNA, 103 bp, Artificial Sequence
  Synthetic Polynucleotide
taatacgactcactatagggccagatctccattatccttaattttgggttaacagaggagaaacccaatgttaaggataaacctggcggcagcgcaaaagatg

SEQ ID NO: 175640 - DNA, 103 bp, Artificial Sequence
  Synthetic Polynucleotide
taatacgactcactatagggcttgacaaaaccagatctccattatccttaaacagaggagataaggaatgtggagatctaacctggcggcagcgcaaaagatg

SEQ ID NO: 175641 - DNA, 103 bp, Artificial Sequence
  Synthetic Polynucleotide
taatacgactcactatagggattactggggcttgacaaaaccagatctccaacagaggagaggagatatggttttgtcaaacctggcggcagcgcaaaagatg

SEQ ID NO: 175642 - DNA, 103 bp, Artificial Sequence
  Synthetic Polynucleotide
taatacgactcactatagggttagggttttatagaagtccatcacatctcaacagaggagagagatgatgtggacttctaacctggcggcagcgcaaaagatg

SEQ ID NO: 175643 - DNA, 103 bp, Artificial Sequence
  Synthetic Polynucleotide
taatacgactcactataggggcagtgttacattactggggcttgacaaaaaacagaggagattttgtatggccccagtaaacctggcggcagcgcaaaagatg

SEQ ID NO: 175644 - DNA, 103 bp, Artificial Sequence
  Synthetic Polynucleotide
taatacgactcactatagggttcacttggggcagtgttacattactggggaacagaggagaccccagatgtgtaacactaacctggcggcagcgcaaaagatg

SEQ ID NO: 175645 - DNA, 103 bp, Artificial Sequence
  Synthetic Polynucleotide
taatacgactcactatagggtttttctgttttcacttggggcagtgttacaacagaggagagtaacaatgccccaagtgaacctggcggcagcgcaaaagatg

SEQ ID NO: 175646 - DNA, 103 bp, Artificial Sequence
  Synthetic Polynucleotide
taatacgactcactatagggtgaaatcttctttttctgttttcacttgggaacagaggagacccaagatgaaacagaaaaacctggcggcagcgcaaaagatg

SEQ ID NO: 175647 - DNA, 103 bp, Artificial Sequence
  Synthetic Polynucleotide
taatacgactcactatagggcagagttcgatgaaatcttctttttctgttaacagaggagaaacagaatgagaagatttaacctggcggcagcgcaaaagatg

SEQ ID NO: 175648 - DNA, 103 bp, Artificial Sequence
  Synthetic Polynucleotide
taatacgactcactatagggcccaggggtgcagagttcgatgaaatcttcaacagaggagagaagatatgatcgaactcaacctggcggcagcgcaaaagatg

SEQ ID NO: 175649 - DNA, 103 bp, Artificial Sequence
  Synthetic Polynucleotide
taatacgactcactataggggcttaattaccccaggggtgcagagttcgaaacagaggagatcgaacatggcacccctgaacctggcggcagcgcaaaagatg

SEQ ID NO: 175650 - DNA, 103 bp, Artificial Sequence
  Synthetic Polynucleotide
taatacgactcactatagggagtttctcttgcttaattaccccaggggtgaacagaggagacaccccatgggtaattaaaacctggcggcagcgcaaaagatg

SEQ ID NO: 175651 - DNA, 103 bp, Artificial Sequence
  Synthetic Polynucleotide
taatacgactcactatagggaactgtgcccagtttctcttgcttaattacaacagaggagagtaattatgcaagagaaaaacctggcggcagcgcaaaagatg

SEQ ID NO: 175652 - DNA, 103 bp, Artificial Sequence
  Synthetic Polynucleotide
taatacgactcactatagggcctgacagtaaactgtgcccagtttctcttaacagaggagaaagagaatgtgggcacagaacctggcggcagcgcaaaagatg

SEQ ID NO: 175653 - DNA, 103 bp, Artificial Sequence
  Synthetic Polynucleotide
taatacgactcactataggggctcctcctcttagggttttatagaagtccaacagaggagaggacttatgtaaaaccctaacctggcggcagcgcaaaagatg

SEQ ID NO: 175654 - DNA, 103 bp, Artificial Sequence
  Synthetic Polynucleotide
taatacgactcactatagggggaaagcttgcctgacagtaaactgtgcccaacagaggagagggcacatgttactgtcaaacctggcggcagcgcaaaagatg

SEQ ID NO: 175655 - DNA, 103 bp, Artificial Sequence
  Synthetic Polynucleotide
taatacgactcactatagggatttgctccaggaaagcttgcctgacagtaaacagaggagatactgtatggcaagctttaacctggcggcagcgcaaaagatg

SEQ ID NO: 175656 - DNA, 103 bp, Artificial Sequence
  Synthetic Polynucleotide
taatacgactcactatagggtaccaattatatttgctccaggaaagcttgaacagaggagacaagctatgctggagcaaaacctggcggcagcgcaaaagatg

SEQ ID NO: 175657 - DNA, 103 bp, Artificial Sequence
  Synthetic Polynucleotide
taatacgactcactataggggacattttattaccaattatatttgctccaaacagaggagatggagcatgtataattggaacctggcggcagcgcaaaagatg

SEQ ID NO: 175658 - DNA, 103 bp, Artificial Sequence
  Synthetic Polynucleotide
taatacgactcactatagggagaaatggcagacattttattaccaattataacagaggagaataattatgaataaaatgaacctggcggcagcgcaaaagatg

SEQ ID NO: 175659 - DNA, 103 bp, Artificial Sequence
  Synthetic Polynucleotide
taatacgactcactatagggcaccatgaacagaaatggcagacattttataacagaggagaataaaaatgctgccatttaacctggcggcagcgcaaaagatg

SEQ ID NO: 175660 - DNA, 103 bp, Artificial Sequence
  Synthetic Polynucleotide
taatacgactcactataggggaggtactcacaccatgaacagaaatggcaaacagaggagatgccatatgtgttcatggaacctggcggcagcgcaaaagatg

SEQ ID NO: 175661 - DNA, 103 bp, Artificial Sequence
  Synthetic Polynucleotide
taatacgactcactatagggctgtcctccagaggtactcacaccatgaacaacagaggagagttcatatggtgagtaccaacctggcggcagcgcaaaagatg

SEQ ID NO: 175662 - DNA, 103 bp, Artificial Sequence
  Synthetic Polynucleotide
taatacgactcactatagggagtggtacatctgtcctccagaggtactcaaacagaggagatgagtaatgctggaggacaacctggcggcagcgcaaaagatg

SEQ ID NO: 175663 - DNA, 103 bp, Artificial Sequence
  Synthetic Polynucleotide
taatacgactcactatagggttcatgtcatagtggtacatctgtcctccaaacagaggagatggaggatggatgtaccaaacctggcggcagcgcaaaagatg

SEQ ID NO: 175664 - DNA, 103 bp, Artificial Sequence
  Synthetic Polynucleotide
taatacgactcactatagggtgtcccatattgggcttggatacagggcataacagaggagaatgcccatgatccaagccaacctggcggcagcgcaaaagatg

SEQ ID NO: 175665 - DNA, 103 bp, Artificial Sequence
  Synthetic Polynucleotide
taatacgactcactatagggggggctggccaggtccatggtgggcttgataacagaggagaatcaagatgaccatggacaacctggcggcagcgcaaaagatg

SEQ ID NO: 175666 - DNA, 103 bp, Artificial Sequence
  Synthetic Polynucleotide
taatacgactcactataggggtctgttcggacaacttccttcaccatgccaacagaggagaggcatgatgaaggaagttaacctggcggcagcgcaaaagatg

SEQ ID NO: 175667 - DNA, 103 bp, Artificial Sequence
  Synthetic Polynucleotide
taatacgactcactatagggccttcaggctgtctgttcggacaacttcctaacagaggagaaggaagatgtccgaacagaacctggcggcagcgcaaaagatg

SEQ ID NO: 175668 - DNA, 103 bp, Artificial Sequence
  Synthetic Polynucleotide
taatacgactcactatagggccccgccgccccttcaggctgtctgttcggaacagaggagaccgaacatgcagcctgaaaacctggcggcagcgcaaaagatg

SEQ ID NO: 175669 - DNA, 103 bp, Artificial Sequence
  Synthetic Polynucleotide
taatacgactcactatagggaggtagccggccccgccgccccttcaggctaacagaggagaagcctgatggggcggcggaacctggcggcagcgcaaaagatg

SEQ ID NO: 175670 - DNA, 103 bp, Artificial Sequence
  Synthetic Polynucleotide
taatacgactcactatagggtgggttttgaaggtagccggccccgccgccaacagaggagaggcggcatggccggctacaacctggcggcagcgcaaaagatg

SEQ ID NO: 175671 - DNA, 103 bp, Artificial Sequence
  Synthetic Polynucleotide
taatacgactcactataggggggggctgcttgggttttgaaggtagccggaacagaggagaccggctatgttcaaaaccaacctggcggcagcgcaaaagatg

SEQ ID NO: 175672 - DNA, 103 bp, Artificial Sequence
  Synthetic Polynucleotide
taatacgactcactatagggggaggcatctgggggctgcttgggttttgaaacagaggagatcaaaaatgaagcagcccaacctggcggcagcgcaaaagatg

SEQ ID NO: 175673 - DNA, 103 bp, Artificial Sequence
  Synthetic Polynucleotide
taatacgactcactataggggattggcaggggaggcatctgggggctgctaacagaggagaagcagcatgcagatgcctaacctggcggcagcgcaaaagatg

SEQ ID NO: 175674 - DNA, 103 bp, Artificial Sequence
  Synthetic Polynucleotide
taatacgactcactataggggaagtgaggagattggcaggggaggcatctaacagaggagaagatgcatgccctgccaaaacctggcggcagcgcaaaagatg

SEQ ID NO: 175675 - DNA, 103 bp, Artificial Sequence
  Synthetic Polynucleotide
taatacgactcactatagggacggaccagggaagtgaggagattggcaggaacagaggagacctgccatgctcctcactaacctggcggcagcgcaaaagatg

SEQ ID NO: 175676 - DNA, 103 bp, Artificial Sequence
  Synthetic Polynucleotide
taatacgactcactataggggggctgcctcggggctggccaggtccatggaacagaggagaccatggatgtggccagccaacctggcggcagcgcaaaagatg

SEQ ID NO: 175677 - DNA, 103 bp, Artificial Sequence
  Synthetic Polynucleotide
taatacgactcactatagggccaggtgtgcacggaccagggaagtgaggaaacagaggagatcctcaatgccctggtccaacctggcggcagcgcaaaagatg

SEQ ID NO: 175678 - DNA, 103 bp, Artificial Sequence
  Synthetic Polynucleotide
taatacgactcactatagggggccctgagtccaggtgtgcacggaccaggaacagaggagacctggtatgtgcacacctaacctggcggcagcgcaaaagatg

SEQ ID NO: 175679 - DNA, 103 bp, Artificial Sequence
  Synthetic Polynucleotide
taatacgactcactatagggggcagtgctgggccctgagtccaggtgtgcaacagaggagagcacacatggactcagggaacctggcggcagcgcaaaagatg

SEQ ID NO: 175680 - DNA, 103 bp, Artificial Sequence
  Synthetic Polynucleotide
taatacgactcactatagggagtccagtttggcagtgctgggccctgagtaacagaggagaactcagatgccagcactgaacctggcggcagcgcaaaagatg

SEQ ID NO: 175681 - DNA, 103 bp, Artificial Sequence
  Synthetic Polynucleotide
taatacgactcactatagggaacttggagtagtccagtttggcagtgctgaacagaggagacagcacatgcaaactggaaacctggcggcagcgcaaaagatg

SEQ ID NO: 175682 - DNA, 103 bp, Artificial Sequence
  Synthetic Polynucleotide
taatacgactcactatagggcagctcctggaacttggagtagtccagtttaacagaggagaaaactgatgtactccaagaacctggcggcagcgcaaaagatg

SEQ ID NO: 175683 - DNA, 103 bp, Artificial Sequence
  Synthetic Polynucleotide
taatacgactcactatagggggggcagcaccagctcctggaacttggagtaacagaggagaactccaatgtccaggagcaacctggcggcagcgcaaaagatg

SEQ ID NO: 175684 - DNA, 103 bp, Artificial Sequence
  Synthetic Polynucleotide
taatacgactcactatagggttcccaaagtggggcagcaccagctcctggaacagaggagaccaggaatgggtgctgccaacctggcggcagcgcaaaagatg

SEQ ID NO: 175685 - DNA, 103 bp, Artificial Sequence
  Synthetic Polynucleotide
taatacgactcactatagggagcatcttccttcccaaagtggggcagcacaacagaggagagtgctgatgcactttgggaacctggcggcagcgcaaaagatg

SEQ ID NO: 175686 - DNA, 103 bp, Artificial Sequence
  Synthetic Polynucleotide
taatacgactcactataggggtacatccccagcatcttccttcccaaagtaacagaggagaactttgatgaggaagatgaacctggcggcagcgcaaaagatg

SEQ ID NO: 175687 - DNA, 103 bp, Artificial Sequence
  Synthetic Polynucleotide
taatacgactcactatagggggggcagcgggggctgcctcggggctggccaacagaggagaggccagatgcgaggcagcaacctggcggcagcgcaaaagatg

SEQ ID NO: 175688 - DNA, 103 bp, Artificial Sequence
  Synthetic Polynucleotide
taatacgactcactatagggtagaactgctgtacatccccagcatcttccaacagaggagaggaagaatgtggggatgtaacctggcggcagcgcaaaagatg

SEQ ID NO: 175689 - DNA, 103 bp, Artificial Sequence
  Synthetic Polynucleotide
taatacgactcactataggggagcaggtcgtagaactgctgtacatccccaacagaggagaggggatatgcagcagttcaacctggcggcagcgcaaaagatg

SEQ ID NO: 175690 - DNA, 103 bp, Artificial Sequence
  Synthetic Polynucleotide
taatacgactcactataggggagaaccggagagcaggtcgtagaactgctaacagaggagaagcagtatgacgacctgcaacctggcggcagcgcaaaagatg

SEQ ID NO: 175691 - DNA, 103 bp, Artificial Sequence
  Synthetic Polynucleotide
taatacgactcactatagggatgacctccagagaaccggagagcaggtcgaacagaggagacgacctatgctccggttcaacctggcggcagcgcaaaagatg

SEQ ID NO: 175692 - DNA, 103 bp, Artificial Sequence
  Synthetic Polynucleotide
taatacgactcactatagggccacttgcggatgacctccagagaaccggaaacagaggagatccggtatgctggaggtcaacctggcggcagcgcaaaagatg

SEQ ID NO: 175693 - DNA, 103 bp, Artificial Sequence
  Synthetic Polynucleotide
taatacgactcactatagggtcttctccgcccacttgcggatgacctccaaacagaggagatggaggatgtccgcaagtaacctggcggcagcgcaaaagatg

SEQ ID NO: 175694 - DNA, 103 bp, Artificial Sequence
  Synthetic Polynucleotide
taatacgactcactatagggaagccagggatcttctccgcccacttgcggaacagaggagaccgcaaatgggcggagaaaacctggcggcagcgcaaaagatg

SEQ ID NO: 175695 - DNA, 103 bp, Artificial Sequence
  Synthetic Polynucleotide
taatacgactcactatagggcagctcagcaaagccagggatcttctccgcaacagaggagagcggagatgatccctggcaacctggcggcagcgcaaaagatg

SEQ ID NO: 175696 - DNA, 103 bp, Artificial Sequence
  Synthetic Polynucleotide
taatacgactcactatagggcagccggtgacagctcagcaaagccagggaaacagaggagatccctgatgttgctgagcaacctggcggcagcgcaaaagatg

SEQ ID NO: 175697 - DNA, 103 bp, Artificial Sequence
  Synthetic Polynucleotide
taatacgactcactatagggaggtcctggtcagccggtgacagctcagcaaacagaggagatgctgaatggtcaccggcaacctggcggcagcgcaaaagatg

SEQ ID NO: 175698 - DNA, 103 bp, Artificial Sequence
  Synthetic Polynucleotide
taatacgactcactatagggcagggcagtgggggcagcgggggctgcctcaacagaggagagaggcaatgcccgctgccaacctggcggcagcgcaaaagatg

SEQ ID NO: 175699 - DNA, 103 bp, Artificial Sequence
  Synthetic Polynucleotide
taatacgactcactatagggctccagcaacaggtcctggtcagccggtgaaacagaggagatcaccgatggaccaggacaacctggcggcagcgcaaaagatg

SEQ ID NO: 175700 - DNA, 103 bp, Artificial Sequence
  Synthetic Polynucleotide
taatacgactcactatagggggaaggccgactccagcaacaggtcctggtaacagaggagaaccaggatgtgttgctggaacctggcggcagcgcaaaagatg

SEQ ID NO: 175701 - DNA, 103 bp, Artificial Sequence
  Synthetic Polynucleotide
taatacgactcactatagggaagagctccaggaaggccgactccagcaacaacagaggagagttgctatggtcggccttaacctggcggcagcgcaaaagatg

SEQ ID NO: 175702 - DNA, 103 bp, Artificial Sequence
  Synthetic Polynucleotide
taatacgactcactataggggcggaggatgaagagctccaggaaggccgaaacagaggagatcggccatgctggagctcaacctggcggcagcgcaaaagatg

SEQ ID NO: 175703 - DNA, 103 bp, Artificial Sequence
  Synthetic Polynucleotide
taatacgactcactatagggtgtacgccaggcggaggatgaagagctccaaacagaggagatggagcatgtcatcctccaacctggcggcagcgcaaaagatg

SEQ ID NO: 175704 - DNA, 103 bp, Artificial Sequence
  Synthetic Polynucleotide
taatacgactcactatagggggcttagacctgtacgccaggcggaggatgaacagaggagacatcctatgcctggcgtaaacctggcggcagcgcaaaagatg

SEQ ID NO: 175705 - DNA, 103 bp, Artificial Sequence
  Synthetic Polynucleotide
taatacgactcactataggggccctcgcctggcttagacctgtacgccagaacagaggagactggcgatgaggtctaagaacctggcggcagcgcaaaagatg

SEQ ID NO: 175706 - DNA, 103 bp, Artificial Sequence
  Synthetic Polynucleotide
taatacgactcactatagggagatgagcttgccctcgcctggcttagaccaacagaggagaggtctaatgcaggcgaggaacctggcggcagcgcaaaagatg

SEQ ID NO: 175707 - DNA, 103 bp, Artificial Sequence
  Synthetic Polynucleotide
taatacgactcactatagggcctgagcagaagatgagcttgccctcgcctaacagaggagaaggcgaatgcaagctcataacctggcggcagcgcaaaagatg

SEQ ID NO: 175708 - DNA, 103 bp, Artificial Sequence
  Synthetic Polynucleotide
taatacgactcactatagggtagcaccaggcctgagcagaagatgagcttaacagaggagaaagctcatgttctgctcaaacctggcggcagcgcaaaagatg

SEQ ID NO: 175709 - DNA, 103 bp, Artificial Sequence
  Synthetic Polynucleotide
taatacgactcactatagggtgaagctgggcagggcagtgggggcagcggaacagaggagaccgctgatgccactgcccaacctggcggcagcgcaaaagatg

SEQ ID NO: 175710 - DNA, 103 bp, Artificial Sequence
  Synthetic Polynucleotide
taatacgactcactataggggcagccggtgtagcaccaggcctgagcagaaacagaggagatctgctatggcctggtgcaacctggcggcagcgcaaaagatg

SEQ ID NO: 175711 - DNA, 103 bp, Artificial Sequence
  Synthetic Polynucleotide
taatacgactcactatagggcgggcacactgcagccggtgtagcaccaggaacagaggagacctggtatgacaccggctaacctggcggcagcgcaaaagatg

SEQ ID NO: 175712 - DNA, 103 bp, Artificial Sequence
  Synthetic Polynucleotide
taatacgactcactatagggcccgaagccacgggcacactgcagccggtgaacagaggagacaccggatgcagtgtgccaacctggcggcagcgcaaaagatg

SEQ ID NO: 175713 - DNA, 103 bp, Artificial Sequence
  Synthetic Polynucleotide
taatacgactcactatagggcaatccagtccccgaagccacgggcacactaacagaggagaagtgtgatggtggcttcgaacctggcggcagcgcaaaagatg

SEQ ID NO: 175714 - DNA, 103 bp, Artificial Sequence
  Synthetic Polynucleotide
taatacgactcactatagggaggatactgtcaatccagtccccgaagccaaacagaggagatggcttatgggactggataacctggcggcagcgcaaaagatg

SEQ ID NO: 175715 - DNA, 103 bp, Artificial Sequence
  Synthetic Polynucleotide
taatacgactcactatagggtgagaaggccaggatactgtcaatccagtcaacagaggagagactggatggacagtatcaacctggcggcagcgcaaaagatg

SEQ ID NO: 175716 - DNA, 103 bp, Artificial Sequence
  Synthetic Polynucleotide
taatacgactcactataggggcagggaccttgagaaggccaggatactgtaacagaggagaacagtaatgtggccttctaacctggcggcagcgcaaaagatg

SEQ ID NO: 175717 - DNA, 103 bp, Artificial Sequence
  Synthetic Polynucleotide
taatacgactcactatagggagcaagctgtgcagggaccttgagaaggccaacagaggagaggccttatgaaggtccctaacctggcggcagcgcaaaagatg

SEQ ID NO: 175718 - DNA, 103 bp, Artificial Sequence
  Synthetic Polynucleotide
taatacgactcactataggggacatcgacaagcaagctgtgcagggacctaacagaggagaaggtccatgcacagcttgaacctggcggcagcgcaaaagatg

SEQ ID NO: 175719 - DNA, 103 bp, Artificial Sequence
  Synthetic Polynucleotide
taatacgactcactatagggcgaaggcagggacatcgacaagcaagctgtaacagaggagaacagctatgttgtcgatgaacctggcggcagcgcaaaagatg

SEQ ID NO: 175720 - DNA, 103 bp, Artificial Sequence
  Synthetic Polynucleotide
taatacgactcactatagggatgaaggtgctgaagctgggcagggcagtgaacagaggagacactgcatggcccagcttaacctggcggcagcgcaaaagatg

SEQ ID NO: 175721 - DNA, 103 bp, Artificial Sequence
  Synthetic Polynucleotide
taatacgactcactataggggagaggcaggcgaaggcagggacatcgacaaacagaggagatgtcgaatgccctgccttaacctggcggcagcgcaaaagatg

SEQ ID NO: 175722 - DNA, 103 bp, Artificial Sequence
  Synthetic Polynucleotide
taatacgactcactataggggacaagggcagagaggcaggcgaaggcaggaacagaggagacctgccatggcctgcctcaacctggcggcagcgcaaaagatg

SEQ ID NO: 175723 - DNA, 103 bp, Artificial Sequence
  Synthetic Polynucleotide
taatacgactcactatagggcggtgatgaggacaagggcagagaggcaggaacagaggagacctgccatgctgcccttgaacctggcggcagcgcaaaagatg

SEQ ID NO: 175724 - DNA, 103 bp, Artificial Sequence
  Synthetic Polynucleotide
taatacgactcactatagggccatgccggtcggtgatgaggacaagggcaaacagaggagatgccctatgcctcatcacaacctggcggcagcgcaaaagatg

SEQ ID NO: 175725 - DNA, 103 bp, Artificial Sequence
  Synthetic Polynucleotide
taatacgactcactatagggctcctgcagcccatgccggtcggtgatgagaacagaggagactcatcatggaccggcataacctggcggcagcgcaaaagatg

SEQ ID NO: 175726 - DNA, 103 bp, Artificial Sequence
  Synthetic Polynucleotide
taatacgactcactatagggcccgccgcggctcctgcagcccatgccggtaacagaggagaaccggcatgggctgcaggaacctggcggcagcgcaaaagatg

SEQ ID NO: 175727 - DNA, 103 bp, Artificial Sequence
  Synthetic Polynucleotide
taatacgactcactatagggagctcctccacccgccgcggctcctgcagcaacagaggagagctgcaatggccgcggcgaacctggcggcagcgcaaaagatg

SEQ ID NO: 175728 - DNA, 103 bp, Artificial Sequence
  Synthetic Polynucleotide
taatacgactcactataggggcggttctgcagctcctccacccgccgcggaacagaggagaccgcggatggtggaggagaacctggcggcagcgcaaaagatg

SEQ ID NO: 175729 - DNA, 103 bp, Artificial Sequence
  Synthetic Polynucleotide
taatacgactcactatagggagctggcgatgcggttctgcagctcctccaaacagaggagatggaggatgtgcagaaccaacctggcggcagcgcaaaagatg

SEQ ID NO: 175730 - DNA, 103 bp, Artificial Sequence
  Synthetic Polynucleotide
taatacgactcactatagggtccttcaggcagctggcgatgcggttctgcaacagaggagagcagaaatgcatcgccagaacctggcggcagcgcaaaagatg

SEQ ID NO: 175731 - DNA, 103 bp, Artificial Sequence
  Synthetic Polynucleotide
taatacgactcactataggggtagccgtccatgaaggtgctgaagctgggaacagaggagacccagcatgagcaccttcaacctggcggcagcgcaaaagatg

SEQ ID NO: 175732 - DNA, 103 bp, Artificial Sequence
  Synthetic Polynucleotide
taatacgactcactatagggtgccacgtgctccttcaggcagctggcgataacagaggagaatcgccatgtgcctgaagaacctggcggcagcgcaaaagatg

SEQ ID NO: 175733 - DNA, 103 bp, Artificial Sequence
  Synthetic Polynucleotide
taatacgactcactatagggccgccacagctgccacgtgctccttcaggcaacagaggagagcctgaatgagcacgtggaacctggcggcagcgcaaaagatg

SEQ ID NO: 175734 - DNA, 103 bp, Artificial Sequence
  Synthetic Polynucleotide
taatacgactcactatagggtggggctcgcccgccacagctgccacgtgcaacagaggagagcacgtatgagctgtggcaacctggcggcagcgcaaaagatg

SEQ ID NO: 175735 - DNA, 103 bp, Artificial Sequence
  Synthetic Polynucleotide
taatacgactcactataggggctggctggctggggctcgcccgccacagcaacagaggagagctgtgatgggcgagcccaacctggcggcagcgcaaaagatg

SEQ ID NO: 175736 - DNA, 103 bp, Artificial Sequence
  Synthetic Polynucleotide
taatacgactcactataggggtgacaggcagctggctggctggggctcgcaacagaggagagcgagcatgagccagccaaacctggcggcagcgcaaaagatg

SEQ ID NO: 175737 - DNA, 103 bp, Artificial Sequence
  Synthetic Polynucleotide
taatacgactcactatagggcccaacagacgtgacaggcagctggctggcaacagaggagagccagcatgctgcctgtcaacctggcggcagcgcaaaagatg

SEQ ID NO: 175738 - DNA, 103 bp, Artificial Sequence
  Synthetic Polynucleotide
taatacgactcactataggggggcagtttgcccaacagacgtgacaggcaaacagaggagatgcctgatgcgtctgttgaacctggcggcagcgcaaaagatg

SEQ ID NO: 175739 - DNA, 103 bp, Artificial Sequence
  Synthetic Polynucleotide
taatacgactcactatagggtccgcagctcgggcagtttgcccaacagacaacagaggagagtctgtatggcaaactgcaacctggcggcagcgcaaaagatg

SEQ ID NO: 175740 - DNA, 103 bp, Artificial Sequence
  Synthetic Polynucleotide
taatacgactcactataggggtgcacagggtccgcagctcgggcagtttgaacagaggagacaaactatgcgagctgcgaacctggcggcagcgcaaaagatg

SEQ ID NO: 175741 - DNA, 103 bp, Artificial Sequence
  Synthetic Polynucleotide
taatacgactcactatagggcaggccctgggtgcacagggtccgcagctcaacagaggagagagctgatgaccctgtgcaacctggcggcagcgcaaaagatg

SEQ ID NO: 175742 - DNA, 103 bp, Artificial Sequence
  Synthetic Polynucleotide
taatacgactcactatagggactctcctgtgtagccgtccatgaaggtgcaacagaggagagcacctatgtggacggctaacctggcggcagcgcaaaagatg

SEQ ID NO: 175743 - DNA, 103 bp, Artificial Sequence
  Synthetic Polynucleotide
taatacgactcactatagggagatgcgctgcaggccctgggtgcacagggaacagaggagaccctgtatgcccagggccaacctggcggcagcgcaaaagatg

SEQ ID NO: 175744 - DNA, 103 bp, Artificial Sequence
  Synthetic Polynucleotide
taatacgactcactatagggttgaggtagaagatgcgctgcaggccctggaacagaggagaccagggatggcagcgcataacctggcggcagcgcaaaagatg

SEQ ID NO: 175745 - DNA, 103 bp, Artificial Sequence
  Synthetic Polynucleotide
taatacgactcactataggggtcctccagcttgaggtagaagatgcgctgaacagaggagacagcgcatgttctacctcaacctggcggcagcgcaaaagatg

SEQ ID NO: 175746 - DNA, 103 bp, Artificial Sequence
  Synthetic Polynucleotide
taatacgactcactatagggggggcaccaagtcctccagcttgaggtagaaacagaggagatctaccatgagctggaggaacctggcggcagcgcaaaagatg

SEQ ID NO: 175747 - DNA, 103 bp, Artificial Sequence
  Synthetic Polynucleotide
taatacgactcactatagggatgggtggagggggcaccaagtcctccagcaacagaggagagctggaatgcttggtgccaacctggcggcagcgcaaaagatg

SEQ ID NO: 175748 - DNA, 103 bp, Artificial Sequence
  Synthetic Polynucleotide
taatacgactcactatagggcttgtcaatgatgggtggagggggcaccaaaacagaggagattggtgatgcctccacccaacctggcggcagcgcaaaagatg

SEQ ID NO: 175749 - DNA, 103 bp, Artificial Sequence
  Synthetic Polynucleotide
taatacgactcactatagggccatgaagatcttgtcaatgatgggtggagaacagaggagactccacatgtcattgacaaacctggcggcagcgcaaaagatg

SEQ ID NO: 175750 - DNA, 103 bp, Artificial Sequence
  Synthetic Polynucleotide
taatacgactcactatagggggcagcgtgtccatgaagatcttgtcaatgaacagaggagacattgaatggatcttcataacctggcggcagcgcaaaagatg

SEQ ID NO: 175751 - DNA, 103 bp, Artificial Sequence
  Synthetic Polynucleotide
taatacgactcactatagggaaggtgtcaaactctcctgtgtagccgtccaacagaggagaggacggatgcacaggagaaacctggcggcagcgcaaaagatg

SEQ ID NO: 175752 - DNA, 103 bp, Artificial Sequence
  Synthetic Polynucleotide
taatacgactcactatagggctggtagaggaaggtgtcaaactctcctgtaacagaggagaacaggaatgtttgacaccaacctggcggcagcgcaaaagatg

SEQ ID NO: 175753 - DNA, 103 bp, Artificial Sequence
  Synthetic Polynucleotide
taatacgactcactatagggtcggtgctggtgtcccatattgggcttggaaacagaggagatccaagatgaatatgggaaacctggcggcagcgcaaaagatg

SEQ ID NO: 175754 - DNA, 103 bp, Artificial Sequence
  Synthetic Polynucleotide
taatacgactcactatagggttcctggcagctggtagaggaaggtgtcaaaacagaggagattgacaatgtcctctaccaacctggcggcagcgcaaaagatg

SEQ ID NO: 175755 - DNA, 103 bp, Artificial Sequence
  Synthetic Polynucleotide
taatacgactcactatagggggctggactgttcctggcagctggtagaggaacagaggagacctctaatggctgccaggaacctggcggcagcgcaaaagatg

SEQ ID NO: 175756 - DNA, 103 bp, Artificial Sequence
  Synthetic Polynucleotide
taatacgactcactatagggtgaggagcatggctggactgttcctggcagaacagaggagactgccaatgacagtccagaacctggcggcagcgcaaaagatg

SEQ ID NO: 175757 - DNA, 103 bp, Artificial Sequence
  Synthetic Polynucleotide
taatacgactcactatagggaggaggaggctgaggagcatggctggactgaacagaggagacagtccatgcatgctcctaacctggcggcagcgcaaaagatg

SEQ ID NO: 175758 - DNA, 103 bp, Artificial Sequence
  Synthetic Polynucleotide
taatacgactcactataggggaggaggccgaggaggaggctgaggagcataacagaggagaatgctcatgagcctcctcaacctggcggcagcgcaaaagatg

SEQ ID NO: 175759 - DNA, 103 bp, Artificial Sequence
  Synthetic Polynucleotide
taatacgactcactatagggcgaggatgtggaggaggccgaggaggaggcaacagaggagagcctccatgtcggcctccaacctggcggcagcgcaaaagatg

SEQ ID NO: 175760 - DNA, 103 bp, Artificial Sequence
  Synthetic Polynucleotide
taatacgactcactatagggtggctgaggacgaggatgtggaggaggccgaacagaggagacggcctatgccacatcctaacctggcggcagcgcaaaagatg

SEQ ID NO: 175761 - DNA, 103 bp, Artificial Sequence
  Synthetic Polynucleotide
taatacgactcactataggggcaggggaggtggctgaggacgaggatgtgaacagaggagacacatcatggtcctcagcaacctggcggcagcgcaaaagatg

SEQ ID NO: 175762 - DNA, 103 bp, Artificial Sequence
  Synthetic Polynucleotide
taatacgactcactatagggggaggcagaggcaggggaggtggctgaggaaacagaggagatcctcaatgacctcccctaacctggcggcagcgcaaaagatg

SEQ ID NO: 175763 - DNA, 103 bp, Artificial Sequence
  Synthetic Polynucleotide
taatacgactcactatagggcgaacttgaaggaggcagaggcaggggaggaacagaggagacctcccatgcctctgcctaacctggcggcagcgcaaaagatg

SEQ ID NO: 175764 - DNA, 103 bp, Artificial Sequence
  Synthetic Polynucleotide
taatacgactcactatagggggtcccggactcggtgctggtgtcccatataacagaggagaatatggatgaccagcaccaacctggcggcagcgcaaaagatg

SEQ ID NO: 175765 - DNA, 103 bp, Artificial Sequence
  Synthetic Polynucleotide
taatacgactcactatagggtggaagtcctcgaacttgaaggaggcagagaacagaggagactctgcatgcttcaagttaacctggcggcagcgcaaaagatg

SEQ ID NO: 175766 - DNA, 103 bp, Artificial Sequence
  Synthetic Polynucleotide
taatacgactcactataggggccgtacacctggaagtcctcgaacttgaaaacagaggagattcaagatggaggacttcaacctggcggcagcgcaaaagatg

SEQ ID NO: 175767 - DNA, 103 bp, Artificial Sequence
  Synthetic Polynucleotide
taatacgactcactatagggcggggtagcagccgtacacctggaagtcctaacagaggagaaggactatgaggtgtacgaacctggcggcagcgcaaaagatg

SEQ ID NO: 175768 - DNA, 103 bp, Artificial Sequence
  Synthetic Polynucleotide
taatacgactcactatagggctcagggggccggggtagcagccgtacaccaacagaggagaggtgtaatgctgctacccaacctggcggcagcgcaaaagatg

SEQ ID NO: 175769 - DNA, 103 bp, Artificial Sequence
  Synthetic Polynucleotide
taatacgactcactatagggcactgggccgctcagggggccggggtagcaaacagaggagatgctacatgggccccctgaacctggcggcagcgcaaaagatg

SEQ ID NO: 175770 - DNA, 103 bp, Artificial Sequence
  Synthetic Polynucleotide
taatacgactcactataggggggcctcatccactgggccgctcagggggcaacagaggagagcccccatggcggcccagaacctggcggcagcgcaaaagatg

SEQ ID NO: 175771 - DNA, 103 bp, Artificial Sequence
  Synthetic Polynucleotide
taatacgactcactatagggctggaggacagggcctcatccactgggccgaacagaggagacggcccatgggatgaggcaacctggcggcagcgcaaaagatg

SEQ ID NO: 175772 - DNA, 103 bp, Artificial Sequence
  Synthetic Polynucleotide
taatacgactcactataggggtcagagccactggaggacagggcctcatcaacagaggagagatgagatgctgtcctccaacctggcggcagcgcaaaagatg

SEQ ID NO: 175773 - DNA, 103 bp, Artificial Sequence
  Synthetic Polynucleotide
taatacgactcactatagggtgccatagtagtcagagccactggaggacaaacagaggagatgtcctatggtggctctgaacctggcggcagcgcaaaagatg

SEQ ID NO: 175774 - DNA, 103 bp, Artificial Sequence
  Synthetic Polynucleotide
taatacgactcactataggggagcaggggctgccatagtagtcagagccaaacagaggagatggctcatgctactatggaacctggcggcagcgcaaaagatg

SEQ ID NO: 175775 - DNA, 103 bp, Artificial Sequence
  Synthetic Polynucleotide
taatacgactcactataggggtggtcacggggtcccggactcggtgctggaacagaggagaccagcaatgagtccgggaaacctggcggcagcgcaaaagatg

SEQ ID NO: 175776 - DNA, 103 bp, Artificial Sequence
  Synthetic Polynucleotide
taatacgactcactatagggcgacggggccgagcaggggctgccatagtaaacagaggagatactatatgagcccctgcaacctggcggcagcgcaaaagatg

SEQ ID NO: 175777 - DNA, 103 bp, Artificial Sequence
  Synthetic Polynucleotide
taatacgactcactataggggcgtggagggcgacggggccgagcaggggcaacagaggagagcccctatgcggccccgtaacctggcggcagcgcaaaagatg

SEQ ID NO: 175778 - DNA, 103 bp, Artificial Sequence
  Synthetic Polynucleotide
taatacgactcactatagggtggaagctgggcgtggagggcgacggggccaacagaggagaggccccatggccctccacaacctggcggcagcgcaaaagatg

SEQ ID NO: 175779 - DNA, 103 bp, Artificial Sequence
  Synthetic Polynucleotide
taatacgactcactatagggctggggcggctggaagctgggcgtggagggaacagaggagaccctccatgcccagcttcaacctggcggcagcgcaaaagatg

SEQ ID NO: 175780 - DNA, 103 bp, Artificial Sequence
  Synthetic Polynucleotide
taatacgactcactatagggagggagagagctggggcggctggaagctggaacagaggagaccagctatgagccgccccaacctggcggcagcgcaaaagatg

SEQ ID NO: 175781 - DNA, 103 bp, Artificial Sequence
  Synthetic Polynucleotide
taatacgactcactataggggagccatcccagggagagagctggggcggcaacagaggagagccgccatggctctctccaacctggcggcagcgcaaaagatg

SEQ ID NO: 175782 - DNA, 103 bp, Artificial Sequence
  Synthetic Polynucleotide
taatacgactcactataggggtggccgaaggagccatcccagggagagagaacagaggagactctctatgtgggatggcaacctggcggcagcgcaaaagatg

SEQ ID NO: 175783 - DNA, 103 bp, Artificial Sequence
  Synthetic Polynucleotide
taatacgactcactatagggtgggcgagaagtggccgaaggagccatcccaacagaggagagggatgatgccttcggccaacctggcggcagcgcaaaagatg

SEQ ID NO: 175784 - DNA, 103 bp, Artificial Sequence
  Synthetic Polynucleotide
taatacgactcactatagggtaagtctggctgggcgagaagtggccgaagaacagaggagacttcggatgcttctcgccaacctggcggcagcgcaaaagatg

SEQ ID NO: 175785 - DNA, 103 bp, Artificial Sequence
  Synthetic Polynucleotide
taatacgactcactatagggcaggccttcgtaagtctggctgggcgagaaaacagaggagattctcgatgagccagactaacctggcggcagcgcaaaagatg

SEQ ID NO: 175786 - DNA, 103 bp, Artificial Sequence
  Synthetic Polynucleotide
taatacgactcactatagggcgcttgccaggtggtcacggggtcccggacaacagaggagagtccggatgcccgtgaccaacctggcggcagcgcaaaagatg

SEQ ID NO: 175787 - DNA, 103 bp, Artificial Sequence
  Synthetic Polynucleotide
taatacgactcactatagggtccatgcccgcaggccttcgtaagtctggcaacagaggagagccagaatgacgaaggccaacctggcggcagcgcaaaagatg

SEQ ID NO: 175788 - DNA, 103 bp, Artificial Sequence
  Synthetic Polynucleotide
taatacgactcactatagggagctgctctgtccatgcccgcaggccttcgaacagaggagacgaaggatggcgggcatgaacctggcggcagcgcaaaagatg

SEQ ID NO: 175789 - DNA, 103 bp, Artificial Sequence
  Synthetic Polynucleotide
taatacgactcactatagggggctttgggcagctgctctgtccatgcccgaacagaggagacgggcaatgacagagcagaacctggcggcagcgcaaaagatg

SEQ ID NO: 175790 - DNA, 103 bp, Artificial Sequence
  Synthetic Polynucleotide
taatacgactcactatagggggggcccagaggctttgggcagctgctctgaacagaggagacagagcatgtgcccaaagaacctggcggcagcgcaaaagatg

SEQ ID NO: 175791 - DNA, 103 bp, Artificial Sequence
  Synthetic Polynucleotide
taatacgactcactatagggggaggctgtgggggcccagaggctttgggcaacagaggagagcccaaatgctctgggccaacctggcggcagcgcaaaagatg

SEQ ID NO: 175792 - DNA, 103 bp, Artificial Sequence
  Synthetic Polynucleotide
taatacgactcactatagggaaagaaggctggaggctgtgggggcccagaaacagaggagatctgggatgccacagcctaacctggcggcagcgcaaaagatg

SEQ ID NO: 175793 - DNA, 103 bp, Artificial Sequence
  Synthetic Polynucleotide
taatacgactcactataggggactgaaggaaaagaaggctggaggctgtgaacagaggagacacagcatgcagccttctaacctggcggcagcgcaaaagatg

SEQ ID NO: 175794 - DNA, 103 bp, Artificial Sequence
  Synthetic Polynucleotide
taatacgactcactatagggccggtgggaggactgaaggaaaagaaggctaacagaggagaagccttatgttccttcagaacctggcggcagcgcaaaagatg

SEQ ID NO: 175795 - DNA, 103 bp, Artificial Sequence
  Synthetic Polynucleotide
taatacgactcactatagggggggctggggccggtgggaggactgaaggaaacagaggagatccttcatgcctcccaccaacctggcggcagcgcaaaagatg

SEQ ID NO: 175796 - DNA, 103 bp, Artificial Sequence
  Synthetic Polynucleotide
taatacgactcactataggggggccaggctggggctggggccggtgggagaacagaggagactcccaatggccccagccaacctggcggcagcgcaaaagatg

SEQ ID NO: 175797 - DNA, 103 bp, Artificial Sequence
  Synthetic Polynucleotide
taatacgactcactataggggtcagggggtcgcttgccaggtggtcacggaacagaggagaccgtgaatgcctggcaagaacctggcggcagcgcaaaagatg

SEQ ID NO: 175798 - DNA, 103 bp, Artificial Sequence
  Synthetic Polynucleotide
taatacgactcactatagggagggggctctgggccaggctggggctggggaacagaggagaccccagatgcagcctggcaacctggcggcagcgcaaaagatg

SEQ ID NO: 175799 - DNA, 103 bp, Artificial Sequence
  Synthetic Polynucleotide
taatacgactcactataggggaacaacttcagggggctctgggccaggctaacagaggagaagcctgatgcagagccccaacctggcggcagcgcaaaagatg

SEQ ID NO: 175800 - DNA, 103 bp, Artificial Sequence
  Synthetic Polynucleotide
taatacgactcactatagggcctgtgaggggaacaacttcagggggctctaacagaggagaagagccatgtgaagttgtaacctggcggcagcgcaaaagatg

SEQ ID NO: 175801 - DNA, 103 bp, Artificial Sequence
  Synthetic Polynucleotide
taatacgactcactatagggtggtgggtggcctgtgaggggaacaacttcaacagaggagagaagttatgcccctcacaaacctggcggcagcgcaaaagatg

SEQ ID NO: 175802 - DNA, 103 bp, Artificial Sequence
  Synthetic Polynucleotide
taatacgactcactatagggctcccccagctggtgggtggcctgtgagggaacagaggagaccctcaatggccacccacaacctggcggcagcgcaaaagatg

SEQ ID NO: 175803 - DNA, 103 bp, Artificial Sequence
  Synthetic Polynucleotide
taatacgactcactatagggagctctctccctcccccagctggtgggtggaacagaggagaccacccatgagctgggggaacctggcggcagcgcaaaagatg

SEQ ID NO: 175804 - DNA, 103 bp, Artificial Sequence
  Synthetic Polynucleotide
taatacgactcactatagggggcatggaatagctctctccctcccccagcaacagaggagagctgggatggggagagagaacctggcggcagcgcaaaagatg

SEQ ID NO: 175805 - DNA, 103 bp, Artificial Sequence
  Synthetic Polynucleotide
taatacgactcactataggggaaggccgtaggcatggaatagctctctccaacagaggagaggagagatgtattccatgaacctggcggcagcgcaaaagatg

SEQ ID NO: 175806 - DNA, 103 bp, Artificial Sequence
  Synthetic Polynucleotide
taatacgactcactatagggccaaacctgggaaggccgtaggcatggaataacagaggagaattccaatgctacggcctaacctggcggcagcgcaaaagatg

SEQ ID NO: 175807 - DNA, 103 bp, Artificial Sequence
  Synthetic Polynucleotide
taatacgactcactataggggaagtgggtgccaaacctgggaaggccgtaaacagaggagatacggcatgcccaggtttaacctggcggcagcgcaaaagatg

SEQ ID NO: 175808 - DNA, 103 bp, Artificial Sequence
  Synthetic Polynucleotide
taatacgactcactataggggaactcaggggtcagggggtcgcttgccagaacagaggagactggcaatggaccccctgaacctggcggcagcgcaaaagatg

SEQ ID NO: 175809 - DNA, 103 bp, Artificial Sequence
  Synthetic Polynucleotide
taatacgactcactatagggaaggtgtggagaagtgggtgccaaacctggaacagaggagaccaggtatggcacccactaacctggcggcagcgcaaaagatg

SEQ ID NO: 175810 - DNA, 103 bp, Artificial Sequence
  Synthetic Polynucleotide
taatacgactcactatagggccgagccctcaaggtgtggagaagtgggtgaacagaggagacacccaatgctccacaccaacctggcggcagcgcaaaagatg

SEQ ID NO: 175811 - DNA, 103 bp, Artificial Sequence
  Synthetic Polynucleotide
taatacgactcactatagggtccagtatccccgagccctcaaggtgtggaaacagaggagatccacaatgtgagggctcaacctggcggcagcgcaaaagatg

SEQ ID NO: 175812 - DNA, 103 bp, Artificial Sequence
  Synthetic Polynucleotide
taatacgactcactatagggcacgggtgtatccagtatccccgagccctcaacagaggagagagggcatggggatactgaacctggcggcagcgcaaaagatg

SEQ ID NO: 175813 - DNA, 103 bp, Artificial Sequence
  Synthetic Polynucleotide
taatacgactcactatagggtggttgaggtcacgggtgtatccagtatccaacagaggagaggatacatgatacacccgaacctggcggcagcgcaaaagatg

SEQ ID NO: 175814 - DNA, 103 bp, Artificial Sequence
  Synthetic Polynucleotide
taatacgactcactatagggctccgggccttggttgaggtcacgggtgtaaacagaggagatacaccatggacctcaacaacctggcggcagcgcaaaagatg

SEQ ID NO: 175815 - DNA, 103 bp, Artificial Sequence
  Synthetic Polynucleotide
taatacgactcactatagggtggggccccgctccgggccttggttgaggtaacagaggagaacctcaatgaaggcccggaacctggcggcagcgcaaaagatg

SEQ ID NO: 175816 - DNA, 103 bp, Artificial Sequence
  Synthetic Polynucleotide
taatacgactcactatagggcacttccacctggggccccgctccgggcctaacagaggagaaggcccatggcggggcccaacctggcggcagcgcaaaagatg

SEQ ID NO: 175817 - DNA, 103 bp, Artificial Sequence
  Synthetic Polynucleotide
taatacgactcactatagggcagcggccttcacttccacctggggccccgaacagaggagacggggcatgaggtggaagaacctggcggcagcgcaaaagatg

SEQ ID NO: 175818 - DNA, 103 bp, Artificial Sequence
  Synthetic Polynucleotide
taatacgactcactatagggacacacagcacagcggccttcacttccaccaacagaggagaggtggaatggaaggccgcaacctggcggcagcgcaaaagatg

SEQ ID NO: 175819 - DNA, 103 bp, Artificial Sequence
  Synthetic Polynucleotide
taatacgactcactatagggtgggcttgatgaactcaggggtcagggggtaacagaggagaacccccatgcccctgagtaacctggcggcagcgcaaaagatg

SEQ ID NO: 175820 - DNA, 103 bp, Artificial Sequence
  Synthetic Polynucleotide
taatacgactcactatagggcgttgtccccacacacagcacagcggccttaacagaggagaaaggccatggtgctgtgtaacctggcggcagcgcaaaagatg

SEQ ID NO: 175821 - DNA, 103 bp, Artificial Sequence
  Synthetic Polynucleotide
taatacgactcactatagggtggcatgaagcgttgtccccacacacagcaaacagaggagatgctgtatgtggggacaaaacctggcggcagcgcaaaagatg

SEQ ID NO: 175822 - DNA, 103 bp, Artificial Sequence
  Synthetic Polynucleotide
taatacgactcactatagggaccataatgctggcatgaagcgttgtccccaacagaggagaggggacatggcttcatgcaacctggcggcagcgcaaaagatg

SEQ ID NO: 175823 - DNA, 103 bp, Artificial Sequence
  Synthetic Polynucleotide
taatacgactcactatagggatgtgcggacaccataatgctggcatgaagaacagaggagacttcatatgagcattatgaacctggcggcagcgcaaaagatg

SEQ ID NO: 175824 - DNA, 103 bp, Artificial Sequence
  Synthetic Polynucleotide
taatacgactcactatagggcagccctcacatgtgcggacaccataatgcaacagaggagagcattaatgtgtccgcacaacctggcggcagcgcaaaagatg

SEQ ID NO: 175825 - DNA, 103 bp, Artificial Sequence
  Synthetic Polynucleotide
taatacgactcactataggggaagcccttgcagccctcacatgtgcggacaacagaggagagtccgcatgtgtgagggcaacctggcggcagcgcaaaagatg

SEQ ID NO: 175826 - DNA, 103 bp, Artificial Sequence
  Synthetic Polynucleotide
taatacgactcactatagggtgcgcttgaagaagcccttgcagccctcacaacagaggagagtgaggatggcaagggctaacctggcggcagcgcaaaagatg

SEQ ID NO: 175827 - DNA, 103 bp, Artificial Sequence
  Synthetic Polynucleotide
taatacgactcactatagggttctgcactgtgcgcttgaagaagcccttgaacagaggagacaagggatgcttcaagcgaacctggcggcagcgcaaaagatg

SEQ ID NO: 175828 - DNA, 103 bp, Artificial Sequence
  Synthetic Polynucleotide
taatacgactcactatagggcttggcgtttttctgcactgtgcgcttgaaaacagaggagattcaagatgacagtgcagaacctggcggcagcgcaaaagatg

SEQ ID NO: 175829 - DNA, 103 bp, Artificial Sequence
  Synthetic Polynucleotide
taatacgactcactatagggggcagatgtacttggcgtttttctgcactgaacagaggagacagtgcatgaaaacgccaaacctggcggcagcgcaaaagatg

SEQ ID NO: 175830 - DNA, 103 bp, Artificial Sequence
  Synthetic Polynucleotide
taatacgactcactatagggaggtccatggtgggcttgatgaactcagggaacagaggagaccctgaatgcatcaagccaacctggcggcagcgcaaaagatg

SEQ ID NO: 175831 - DNA, 103 bp, Artificial Sequence
  Synthetic Polynucleotide
taatacgactcactatagggttgttagccaggcagatgtacttggcgtttaacagaggagaaaacgcatggtacatctgaacctggcggcagcgcaaaagatg

SEQ ID NO: 175832 - DNA, 103 bp, Artificial Sequence
  Synthetic Polynucleotide
taatacgactcactatagggagggcagtccttgttagccaggcagatgtaaacagaggagatacatcatgctggctaacaacctggcggcagcgcaaaagatg

SEQ ID NO: 175833 - DNA, 103 bp, Artificial Sequence
  Synthetic Polynucleotide
taatacgactcactatagggtcttgtccacagggcagtccttgttagccaaacagaggagatggctaatgaggactgccaacctggcggcagcgcaaaagatg

SEQ ID NO: 175834 - DNA, 103 bp, Artificial Sequence
  Synthetic Polynucleotide
taatacgactcactatagggtttcgccgcctcttgtccacagggcagtccaacagaggagaggactgatgtgtggacaaaacctggcggcagcgcaaaagatg

SEQ ID NO: 175835 - DNA, 103 bp, Artificial Sequence
  Synthetic Polynucleotide
taatacgactcactatagggctggcagcggtttcgccgcctcttgtccacaacagaggagagtggacatgaggcggcgaaacctggcggcagcgcaaaagatg

SEQ ID NO: 175836 - DNA, 103 bp, Artificial Sequence
  Synthetic Polynucleotide
taatacgactcactatagggagcggcagaactggcagcggtttcgccgccaacagaggagaggcggcatgaccgctgccaacctggcggcagcgcaaaagatg

SEQ ID NO: 175837 - DNA, 103 bp, Artificial Sequence
  Synthetic Polynucleotide
taatacgactcactatagggcacttctggaagcggcagaactggcagcggaacagaggagaccgctgatggttctgccgaacctggcggcagcgcaaaagatg

SEQ ID NO: 175838 - DNA, 103 bp, Artificial Sequence
  Synthetic Polynucleotide
taatacgactcactatagggcaccgccaggcacttctggaagcggcagaaaacagaggagattctgcatgttccagaagaacctggcggcagcgcaaaagatg

SEQ ID NO: 175839 - DNA, 103 bp, Artificial Sequence
  Synthetic Polynucleotide
taatacgactcactatagggtcaccatgcccaccgccaggcacttctggaaacagaggagatccagaatggcctggcggaacctggcggcagcgcaaaagatg

SEQ ID NO: 175840 - DNA, 103 bp, Artificial Sequence
  Synthetic Polynucleotide
taatacgactcactatagggacaacttccttcaccatgcccaccgccaggaacagaggagacctggcatggggcatggtaacctggcggcagcgcaaaagatg

SEQ ID NO: 175841 - DNA, 103 bp, Artificial Sequence
  Synthetic Polynucleotide
taatacgactcactatagggggacccatactgcgcctgaacacaaggcataacagaggagaatgcctatggttcaggcgaacctggcggcagcgcaaaagatg

SEQ ID NO: 175842 - DNA, 103 bp, Artificial Sequence
  Synthetic Polynucleotide
taatacgactcactataggggacaaactctggagttaagaaatcggagctaacagaggagaagctccatgttcttaactaacctggcggcagcgcaaaagatg

SEQ ID NO: 175843 - DNA, 103 bp, Artificial Sequence
  Synthetic Polynucleotide
taatacgactcactataggggccttttaaactgtctgtgcgaaccacttcaacagaggagagaagtgatgcgcacagacaacctggcggcagcgcaaaagatg

SEQ ID NO: 175844 - DNA, 103 bp, Artificial Sequence
  Synthetic Polynucleotide
taatacgactcactataggggacctctccggccttttaaactgtctgtgcaacagaggagagcacagatggtttaaaagaacctggcggcagcgcaaaagatg

SEQ ID NO: 175845 - DNA, 103 bp, Artificial Sequence
  Synthetic Polynucleotide
taatacgactcactataggggagggcaaacgacctctccggccttttaaaaacagaggagatttaaaatgccggagaggaacctggcggcagcgcaaaagatg

SEQ ID NO: 175846 - DNA, 103 bp, Artificial Sequence
  Synthetic Polynucleotide
taatacgactcactatagggcttcggtttcgagggcaaacgacctctccgaacagaggagacggagaatgcgtttgcccaacctggcggcagcgcaaaagatg

SEQ ID NO: 175847 - DNA, 103 bp, Artificial Sequence
  Synthetic Polynucleotide
taatacgactcactatagggcctgtgggctcttcggtttcgagggcaaacaacagaggagagtttgcatgcgaaaccgaaacctggcggcagcgcaaaagatg

SEQ ID NO: 175848 - DNA, 103 bp, Artificial Sequence
  Synthetic Polynucleotide
taatacgactcactatagggggagagggctcctgtgggctcttcggtttcaacagaggagagaaaccatggagcccacaaacctggcggcagcgcaaaagatg

SEQ ID NO: 175849 - DNA, 103 bp, Artificial Sequence
  Synthetic Polynucleotide
taatacgactcactataggggggcgaagggggagagggctcctgtgggctaacagaggagaagcccaatggagccctctaacctggcggcagcgcaaaagatg

SEQ ID NO: 175850 - DNA, 103 bp, Artificial Sequence
  Synthetic Polynucleotide
taatacgactcactataggggactcaccgggggcgaagggggagagggctaacagaggagaagccctatgccccttcgcaacctggcggcagcgcaaaagatg

SEQ ID NO: 175851 - DNA, 103 bp, Artificial Sequence
  Synthetic Polynucleotide
taatacgactcactataggggcactgatcagactcaccgggggcgaagggaacagaggagacccttcatgcccggtgagaacctggcggcagcgcaaaagatg

SEQ ID NO: 175852 - DNA, 103 bp, Artificial Sequence
  Synthetic Polynucleotide
taatacgactcactatagggcctgacgagggcactgatcagactcaccggaacagaggagaccggtgatgctgatcagtaacctggcggcagcgcaaaagatg

SEQ ID NO: 175853 - DNA, 103 bp, Artificial Sequence
  Synthetic Polynucleotide
taatacgactcactatagggtgctaaacttgacaaactctggagttaagaaacagaggagatcttaaatgcagagtttgaacctggcggcagcgcaaaagatg

SEQ ID NO: 175854 - DNA, 103 bp, Artificial Sequence
  Synthetic Polynucleotide
taatacgactcactatagggcgacatgggccctgacgagggcactgatcaaacagaggagatgatcaatgccctcgtcaaacctggcggcagcgcaaaagatg

SEQ ID NO: 175855 - DNA, 103 bp, Artificial Sequence
  Synthetic Polynucleotide
taatacgactcactataggggggttggagtcgacatgggccctgacgaggaacagaggagacctcgtatgggcccatgtaacctggcggcagcgcaaaagatg

SEQ ID NO: 175856 - DNA, 103 bp, Artificial Sequence
  Synthetic Polynucleotide
taatacgactcactatagggggtcatagccgggttggagtcgacatgggcaacagaggagagcccatatggactccaacaacctggcggcagcgcaaaagatg

SEQ ID NO: 175857 - DNA, 103 bp, Artificial Sequence
  Synthetic Polynucleotide
taatacgactcactatagggagtccaggctggtcatagccgggttggagtaacagaggagaactccaatgcggctatgaaacctggcggcagcgcaaaagatg

SEQ ID NO: 175858 - DNA, 103 bp, Artificial Sequence
  Synthetic Polynucleotide
taatacgactcactatagggaacctggaatagtccaggctggtcatagccaacagaggagaggctatatgcagcctggaaacctggcggcagcgcaaaagatg

SEQ ID NO: 175859 - DNA, 103 bp, Artificial Sequence
  Synthetic Polynucleotide
taatacgactcactataggggttcgcctggaacctggaatagtccaggctaacagaggagaagcctgatgtattccaggaacctggcggcagcgcaaaagatg

SEQ ID NO: 175860 - DNA, 103 bp, Artificial Sequence
  Synthetic Polynucleotide
taatacgactcactataggggatagtcagggttcgcctggaacctggaataacagaggagaattccaatgtccaggcgaaacctggcggcagcgcaaaagatg

SEQ ID NO: 175861 - DNA, 103 bp, Artificial Sequence
  Synthetic Polynucleotide
taatacgactcactatagggccactcatttgatagtcagggttcgcctggaacagaggagaccaggcatgccctgactaaacctggcggcagcgcaaaagatg

SEQ ID NO: 175862 - DNA, 103 bp, Artificial Sequence
  Synthetic Polynucleotide
taatacgactcactatagggggtgtcatctccactcatttgatagtcaggaacagaggagacctgacatgcaaatgagtaacctggcggcagcgcaaaagatg

SEQ ID NO: 175863 - DNA, 103 bp, Artificial Sequence
  Synthetic Polynucleotide
taatacgactcactatagggggatatgctgggtgtcatctccactcatttaacagaggagaaaatgaatggagatgacaaacctggcggcagcgcaaaagatg

SEQ ID NO: 175864 - DNA, 103 bp, Artificial Sequence
  Synthetic Polynucleotide
taatacgactcactataggggtgaggtccatgctaaacttgacaaactctaacagaggagaagagttatgcaagtttagaacctggcggcagcgcaaaagatg

SEQ ID NO: 175865 - DNA, 103 bp, Artificial Sequence
  Synthetic Polynucleotide
taatacgactcactatagggtagaattgctggatatgctgggtgtcatctaacagaggagaagatgaatgccagcatataacctggcggcagcgcaaaagatg

SEQ ID NO: 175866 - DNA, 103 bp, Artificial Sequence
  Synthetic Polynucleotide
taatacgactcactatagggcaggagatcatagaattgctggatatgctgaacagaggagacagcatatgcagcaattcaacctggcggcagcgcaaaagatg

SEQ ID NO: 175867 - DNA, 103 bp, Artificial Sequence
  Synthetic Polynucleotide
taatacgactcactatagggtggagccagtcaggagatcatagaattgctaacagaggagaagcaatatgatgatctccaacctggcggcagcgcaaaagatg

SEQ ID NO: 175868 - DNA, 103 bp, Artificial Sequence
  Synthetic Polynucleotide
taatacgactcactatagggatgatctccatggagccagtcaggagatcaaacagaggagatgatctatggactggctcaacctggcggcagcgcaaaagatg

SEQ ID NO: 175869 - DNA, 103 bp, Artificial Sequence
  Synthetic Polynucleotide
taatacgactcactatagggccagccccggatgatctccatggagccagtaacagaggagaactggcatgatggagatcaacctggcggcagcgcaaaagatg

SEQ ID NO: 175870 - DNA, 103 bp, Artificial Sequence
  Synthetic Polynucleotide
taatacgactcactatagggtcttctctgcccagccccggatgatctccaaacagaggagatggagaatgtccggggctaacctggcggcagcgcaaaagatg

SEQ ID NO: 175871 - DNA, 103 bp, Artificial Sequence
  Synthetic Polynucleotide
taatacgactcactatagggaagccagggatcttctctgcccagccccggaacagaggagaccggggatgggcagagaaaacctggcggcagcgcaaaagatg

SEQ ID NO: 175872 - DNA, 103 bp, Artificial Sequence
  Synthetic Polynucleotide
taatacgactcactatagggcaggtctgcgaagccagggatcttctctgcaacagaggagagcagagatgatccctggcaacctggcggcagcgcaaaagatg

SEQ ID NO: 175873 - DNA, 103 bp, Artificial Sequence
  Synthetic Polynucleotide
taatacgactcactatagggcggctttgggcaggtctgcgaagccagggaaacagaggagatccctgatgtcgcagaccaacctggcggcagcgcaaaagatg

SEQ ID NO: 175874 - DNA, 103 bp, Artificial Sequence
  Synthetic Polynucleotide
taatacgactcactatagggaggtcttggtcggctttgggcaggtctgcgaacagaggagacgcagaatggcccaaagcaacctggcggcagcgcaaaagatg

SEQ ID NO: 175875 - DNA, 103 bp, Artificial Sequence
  Synthetic Polynucleotide
taatacgactcactatagggttcagtgttggtgaggtccatgctaaacttaacagaggagaaagtttatgatggacctcaacctggcggcagcgcaaaagatg

SEQ ID NO: 175876 - DNA, 103 bp, Artificial Sequence
  Synthetic Polynucleotide
taatacgactcactatagggttcaaaaagcaggtcttggtcggctttgggaacagaggagacccaaaatggaccaagacaacctggcggcagcgcaaaagatg

SEQ ID NO: 175877 - DNA, 103 bp, Artificial Sequence
  Synthetic Polynucleotide
taatacgactcactatagggagaaagctgattcaaaaagcaggtcttggtaacagaggagaaccaagatgtgctttttgaacctggcggcagcgcaaaagatg

SEQ ID NO: 175878 - DNA, 103 bp, Artificial Sequence
  Synthetic Polynucleotide
taatacgactcactatagggaacagttctaagaaagctgattcaaaaagcaacagaggagagcttttatgatcagctttaacctggcggcagcgcaaaagatg

SEQ ID NO: 175879 - DNA, 103 bp, Artificial Sequence
  Synthetic Polynucleotide
taatacgactcactatagggtcgaaggacaaacagttctaagaaagctgaaacagaggagatcagctatgttagaactgaacctggcggcagcgcaaaagatg

SEQ ID NO: 175880 - DNA, 103 bp, Artificial Sequence
  Synthetic Polynucleotide
taatacgactcactatagggtgtatgctaatcgaaggacaaacagttctaaacagaggagatagaacatgttgtccttcaacctggcggcagcgcaaaagatg

SEQ ID NO: 175881 - DNA, 103 bp, Artificial Sequence
  Synthetic Polynucleotide
taatacgactcactataggggggttggacctgtatgctaatcgaaggacaaacagaggagatgtcctatgattagcataaacctggcggcagcgcaaaagatg

SEQ ID NO: 175882 - DNA, 103 bp, Artificial Sequence
  Synthetic Polynucleotide
taatacgactcactatagggaccctccactgggttggacctgtatgctaaaacagaggagattagcaatgaggtccaacaacctggcggcagcgcaaaagatg

SEQ ID NO: 175883 - DNA, 103 bp, Artificial Sequence
  Synthetic Polynucleotide
taatacgactcactatagggagatgagtttaccctccactgggttggaccaacagaggagaggtccaatgcagtggaggaacctggcggcagcgcaaaagatg

SEQ ID NO: 175884 - DNA, 103 bp, Artificial Sequence
  Synthetic Polynucleotide
taatacgactcactatagggccattgcaaaagatgagtttaccctccactaacagaggagaagtggaatgtaaactcataacctggcggcagcgcaaaagatg

SEQ ID NO: 175885 - DNA, 103 bp, Artificial Sequence
  Synthetic Polynucleotide
taatacgactcactatagggcaagaccaccccattgcaaaagatgagtttaacagaggagaaaactcatgttttgcaataacctggcggcagcgcaaaagatg

SEQ ID NO: 175886 - DNA, 103 bp, Artificial Sequence
  Synthetic Polynucleotide
taatacgactcactatagggtggcagtgatttcagtgttggtgaggtccaaacagaggagatggaccatgccaacactgaacctggcggcagcgcaaaagatg

SEQ ID NO: 175887 - DNA, 103 bp, Artificial Sequence
  Synthetic Polynucleotide
taatacgactcactataggggcaacctgtgcaagaccaccccattgcaaaaacagaggagatttgcaatggggtggtctaacctggcggcagcgcaaaagatg

SEQ ID NO: 175888 - DNA, 103 bp, Artificial Sequence
  Synthetic Polynucleotide
taatacgactcactatagggcgaacgcattgcaacctgtgcaagaccaccaacagaggagaggtggtatggcacaggttaacctggcggcagcgcaaaagatg

SEQ ID NO: 175889 - DNA, 103 bp, Artificial Sequence
  Synthetic Polynucleotide
taatacgactcactatagggcccaaagccacgaacgcattgcaacctgtgaacagaggagacacaggatgcaatgcgttaacctggcggcagcgcaaaagatg

SEQ ID NO: 175890 - DNA, 103 bp, Artificial Sequence
  Synthetic Polynucleotide
taatacgactcactatagggcaatccattccccaaagccacgaacgcattaacagaggagaaatgcgatggtggctttgaacctggcggcagcgcaaaagatg

SEQ ID NO: 175891 - DNA, 103 bp, Artificial Sequence
  Synthetic Polynucleotide
taatacgactcactatagggacaatggaatcaatccattccccaaagccaaacagaggagatggcttatgggaatggataacctggcggcagcgcaaaagatg

SEQ ID NO: 175892 - DNA, 103 bp, Artificial Sequence
  Synthetic Polynucleotide
taatacgactcactatagggggagaattcaacaatggaatcaatccattcaacagaggagagaatggatggattccattaacctggcggcagcgcaaaagatg

SEQ ID NO: 175893 - DNA, 103 bp, Artificial Sequence
  Synthetic Polynucleotide
taatacgactcactataggggcaagttggaggagaattcaacaatggaataacagaggagaattccaatgttgaattctaacctggcggcagcgcaaaagatg

SEQ ID NO: 175894 - DNA, 103 bp, Artificial Sequence
  Synthetic Polynucleotide
taatacgactcactatagggttcatattctgcaagttggaggagaattcaaacagaggagatgaattatgctccaacttaacctggcggcagcgcaaaagatg

SEQ ID NO: 175895 - DNA, 103 bp, Artificial Sequence
  Synthetic Polynucleotide
taatacgactcactatagggaatgtcgatgttcatattctgcaagttggaaacagaggagatccaacatgcagaatatgaacctggcggcagcgcaaaagatg

SEQ ID NO: 175896 - DNA, 103 bp, Artificial Sequence
  Synthetic Polynucleotide
taatacgactcactatagggagaaggcagaaatgtcgatgttcatattctaacagaggagaagaataatgacatcgacaaacctggcggcagcgcaaaagatg

SEQ ID NO: 175897 - DNA, 103 bp, Artificial Sequence
  Synthetic Polynucleotide
taatacgactcactatagggagagaagtggtggcagtgatttcagtgttgaacagaggagacaacacatgaatcactgcaacctggcggcagcgcaaaagatg

SEQ ID NO: 175898 - DNA, 103 bp, Artificial Sequence
  Synthetic Polynucleotide
taatacgactcactataggggcaatgcaggagaaggcagaaatgtcgatgaacagaggagacatcgaatgttctgccttaacctggcggcagcgcaaaagatg

SEQ ID NO: 175899 - DNA, 103 bp, Artificial Sequence
  Synthetic Polynucleotide
taatacgactcactatagggagccagggcagcaatgcaggagaaggcagaaacagaggagatctgccatgtcctgcattaacctggcggcagcgcaaaagatg

SEQ ID NO: 175900 - DNA, 103 bp, Artificial Sequence
  Synthetic Polynucleotide
taatacgactcactatagggctgtgaccatagccagggcagcaatgcaggaacagaggagacctgcaatgctgccctggaacctggcggcagcgcaaaagatg

SEQ ID NO: 175901 - DNA, 103 bp, Artificial Sequence
  Synthetic Polynucleotide
taatacgactcactatagggccgtgtctctctgtgaccatagccagggcaaacagaggagatgccctatgtatggtcacaacctggcggcagcgcaaaagatg

SEQ ID NO: 175902 - DNA, 103 bp, Artificial Sequence
  Synthetic Polynucleotide
taatacgactcactatagggttccttgagcccgtgtctctctgtgaccataacagaggagaatggtcatggagagacacaacctggcggcagcgcaaaagatg

SEQ ID NO: 175903 - DNA, 103 bp, Artificial Sequence
  Synthetic Polynucleotide
taatacgactcactatagggctctcttgggttccttgagcccgtgtctctaacagaggagaagagacatgggctcaaggaacctggcggcagcgcaaaagatg

SEQ ID NO: 175904 - DNA, 103 bp, Artificial Sequence
  Synthetic Polynucleotide
taatacgactcactatagggagttcttccactctcttgggttccttgagcaacagaggagagctcaaatgacccaagagaacctggcggcagcgcaaaagatg

SEQ ID NO: 175905 - DNA, 103 bp, Artificial Sequence
  Synthetic Polynucleotide
taatacgactcactatagggcttgttttgcagttcttccactctcttgggaacagaggagacccaagatggtggaagaaaacctggcggcagcgcaaaagatg

SEQ ID NO: 175906 - DNA, 103 bp, Artificial Sequence
  Synthetic Polynucleotide
taatacgactcactatagggaatttacaatcttgttttgcagttcttccaaacagaggagatggaagatgtgcaaaacaaacctggcggcagcgcaaaagatg

SEQ ID NO: 175907 - DNA, 103 bp, Artificial Sequence
  Synthetic Polynucleotide
taatacgactcactatagggtctttgagacaatttacaatcttgttttgcaacagaggagagcaaaaatggattgtaaaaacctggcggcagcgcaaaagatg

SEQ ID NO: 175908 - DNA, 103 bp, Artificial Sequence
  Synthetic Polynucleotide
taatacgactcactataggggaagctggggagagaagtggtggcagtgataacagaggagaatcactatgaccacttctaacctggcggcagcgcaaaagatg

SEQ ID NO: 175909 - DNA, 103 bp, Artificial Sequence
  Synthetic Polynucleotide
taatacgactcactatagggagtcacgtggtctttgagacaatttacaataacagaggagaattgtaatgtgtctcaaaaacctggcggcagcgcaaaagatg

SEQ ID NO: 175910 - DNA, 103 bp, Artificial Sequence
  Synthetic Polynucleotide
taatacgactcactatagggcattgttgaaagtcacgtggtctttgagacaacagaggagagtctcaatgaccacgtgaaacctggcggcagcgcaaaagatg

SEQ ID NO: 175911 - DNA, 103 bp, Artificial Sequence
  Synthetic Polynucleotide
taatacgactcactatagggttcaaccccccattgttgaaagtcacgtggaacagaggagaccacgtatgtttcaacaaaacctggcggcagcgcaaaagatg

SEQ ID NO: 175912 - DNA, 103 bp, Artificial Sequence
  Synthetic Polynucleotide
taatacgactcactatagggattggggcggttcaaccccccattgttgaaaacagaggagattcaacatgggggggttgaacctggcggcagcgcaaaagatg

SEQ ID NO: 175913 - DNA, 103 bp, Artificial Sequence
  Synthetic Polynucleotide
taatacgactcactatagggtggacaaataattggggcggttcaacccccaacagaggagagggggtatgaccgccccaaacctggcggcagcgcaaaagatg

SEQ ID NO: 175914 - DNA, 103 bp, Artificial Sequence
  Synthetic Polynucleotide
taatacgactcactatagggcccaacagtttggacaaataattggggcggaacagaggagaccgcccatgttatttgtcaacctggcggcagcgcaaaagatg

SEQ ID NO: 175915 - DNA, 103 bp, Artificial Sequence
  Synthetic Polynucleotide
taatacgactcactatagggtgggagcttccccaacagtttggacaaataaacagaggagatatttgatgaaactgttgaacctggcggcagcgcaaaagatg

SEQ ID NO: 175916 - DNA, 103 bp, Artificial Sequence
  Synthetic Polynucleotide
taatacgactcactatagggtacgaagttctgggagcttccccaacagttaacagaggagaaactgtatgggaagctccaacctggcggcagcgcaaaagatg

SEQ ID NO: 175917 - DNA, 103 bp, Artificial Sequence
  Synthetic Polynucleotide
taatacgactcactataggggtgcaaagggtacgaagttctgggagcttcaacagaggagagaagctatgagaacttcgaacctggcggcagcgcaaaagatg

SEQ ID NO: 175918 - DNA, 103 bp, Artificial Sequence
  Synthetic Polynucleotide
taatacgactcactatagggtagcccctgtgtgcaaagggtacgaagttcaacagaggagagaacttatgaccctttgcaacctggcggcagcgcaaaagatg

SEQ ID NO: 175919 - DNA, 103 bp, Artificial Sequence
  Synthetic Polynucleotide
taatacgactcactatagggtaaaggtactgaagctggggagagaagtggaacagaggagaccacttatgtccccagctaacctggcggcagcgcaaaagatg

SEQ ID NO: 175920 - DNA, 103 bp, Artificial Sequence
  Synthetic Polynucleotide
taatacgactcactatagggaaatgcgctgtagcccctgtgtgcaaagggaacagaggagaccctttatgcacaggggcaacctggcggcagcgcaaaagatg

SEQ ID NO: 175921 - DNA, 103 bp, Artificial Sequence
  Synthetic Polynucleotide
taatacgactcactatagggttcaggtagaaaatgcgctgtagcccctgtaacagaggagaacagggatgacagcgcataacctggcggcagcgcaaaagatg

SEQ ID NO: 175922 - DNA, 103 bp, Artificial Sequence
  Synthetic Polynucleotide
taatacgactcactataggggtcttccaatttcaggtagaaaatgcgctgaacagaggagacagcgcatgttctacctgaacctggcggcagcgcaaaagatg

SEQ ID NO: 175923 - DNA, 103 bp, Artificial Sequence
  Synthetic Polynucleotide
taatacgactcactataggggtggcaccaagtcttccaatttcaggtagaaacagaggagatctaccatgaattggaagaacctggcggcagcgcaaaagatg

SEQ ID NO: 175924 - DNA, 103 bp, Artificial Sequence
  Synthetic Polynucleotide
taatacgactcactatagggattgctggcggtggcaccaagtcttccaataacagaggagaattggaatgcttggtgccaacctggcggcagcgcaaaagatg

SEQ ID NO: 175925 - DNA, 103 bp, Artificial Sequence
  Synthetic Polynucleotide
taatacgactcactatagggtttgtcaattattgctggcggtggcaccaaaacagaggagattggtgatgccgccagcaaacctggcggcagcgcaaaagatg

SEQ ID NO: 175926 - DNA, 103 bp, Artificial Sequence
  Synthetic Polynucleotide
taatacgactcactatagggccaggaaaagtttgtcaattattgctggcgaacagaggagacgccagatgtaattgacaaacctggcggcagcgcaaaagatg

SEQ ID NO: 175927 - DNA, 103 bp, Artificial Sequence
  Synthetic Polynucleotide
taatacgactcactatagggggtaaagtgtccaggaaaagtttgtcaattaacagaggagaaattgaatgacttttcctaacctggcggcagcgcaaaagatg

SEQ ID NO: 175928 - DNA, 103 bp, Artificial Sequence
  Synthetic Polynucleotide
taatacgactcactatagggtagttgtccataaaggtactgaagctggggaacagaggagaccccagatgcagtaccttaacctggcggcagcgcaaaagatg

SEQ ID NO: 175929 - DNA, 103 bp, Artificial Sequence
  Synthetic Polynucleotide
taatacgactcactataggggcctgtgctgtagttgtccataaaggtactaacagaggagaagtaccatgatggacaacaacctggcggcagcgcaaaagatg

SEQ ID NO: 175930 - DNA, 103 bp, Artificial Sequence
  Synthetic Polynucleotide
taatacgactcactatagggcttgaggcgaggacccatactgcgcctgaaaacagaggagattcaggatgagtatgggtaacctggcggcagcgcaaaagatg

SEQ ID NO: 175931 - DNA, 103 bp, Artificial Sequence
  Synthetic Polynucleotide
taatacgactcactatagggtgacgtcgtagcctgtgctgtagttgtccaaacagaggagatggacaatgacagcacagaacctggcggcagcgcaaaagatg

SEQ ID NO: 175932 - DNA, 103 bp, Artificial Sequence
  Synthetic Polynucleotide
taatacgactcactatagggcaaggtggcttgacgtcgtagcctgtgctgaacagaggagacagcacatgctacgacgtaacctggcggcagcgcaaaagatg

SEQ ID NO: 175933 - DNA, 103 bp, Artificial Sequence
  Synthetic Polynucleotide
taatacgactcactatagggttggtacaagcaaggtggcttgacgtcgtaaacagaggagatacgacatgaagccacctaacctggcggcagcgcaaaagatg

SEQ ID NO: 175934 - DNA, 103 bp, Artificial Sequence
  Synthetic Polynucleotide
taatacgactcactatagggacaggggcatttggtacaagcaaggtggctaacagaggagaagccacatggcttgtaccaacctggcggcagcgcaaaagatg

SEQ ID NO: 175935 - DNA, 103 bp, Artificial Sequence
  Synthetic Polynucleotide
taatacgactcactatagggtgctgtccggacaggggcatttggtacaagaacagaggagacttgtaatgaatgcccctaacctggcggcagcgcaaaagatg

SEQ ID NO: 175936 - DNA, 103 bp, Artificial Sequence
  Synthetic Polynucleotide
taatacgactcactatagggaatggaggactgctgtccggacaggggcataacagaggagaatgcccatgtccggacagaacctggcggcagcgcaaaagatg

SEQ ID NO: 175937 - DNA, 103 bp, Artificial Sequence
  Synthetic Polynucleotide
taatacgactcactatagggcttctaccttaatggaggactgctgtccggaacagaggagaccggacatgagtcctccaaacctggcggcagcgcaaaagatg

SEQ ID NO: 175938 - DNA, 103 bp, Artificial Sequence
  Synthetic Polynucleotide
taatacgactcactatagggatctgaatgtcttctaccttaatggaggacaacagaggagagtcctcatgtaaggtagaaacctggcggcagcgcaaaagatg

SEQ ID NO: 175939 - DNA, 103 bp, Artificial Sequence
  Synthetic Polynucleotide
taatacgactcactataggggtagttgtgcatctgaatgtcttctaccttaacagaggagaaaggtaatggacattcagaacctggcggcagcgcaaaagatg

SEQ ID NO: 175940 - DNA, 103 bp, Artificial Sequence
  Synthetic Polynucleotide
taatacgactcactatagggtgtgttgctggtagttgtgcatctgaatgtaacagaggagaacattcatgtgcacaactaacctggcggcagcgcaaaagatg

SEQ ID NO: 175941 - DNA, 103 bp, Artificial Sequence
  Synthetic Polynucleotide
taatacgactcactataggggggctggctccttgaggcgaggacccatacaacagaggagagtatggatgctcgcctcaaacctggcggcagcgcaaaagatg

SEQ ID NO: 175942 - DNA, 103 bp, Artificial Sequence
  Synthetic Polynucleotide
taatacgactcactatagggggcaggtggctgtgttgctggtagttgtgcaacagaggagagcacaaatgccagcaacaaacctggcggcagcgcaaaagatg

SEQ ID NO: 175943 - DNA, 103 bp, Artificial Sequence
  Synthetic Polynucleotide
taatacgactcactatagggagactgggggggcaggtggctgtgttgctgaacagaggagacagcaaatgagccacctgaacctggcggcagcgcaaaagatg

SEQ ID NO: 175944 - DNA, 103 bp, Artificial Sequence
  Synthetic Polynucleotide
taatacgactcactatagggtcatctcctcagactgggggggcaggtggcaacagaggagagccaccatgccccccagtaacctggcggcagcgcaaaagatg

SEQ ID NO: 175945 - DNA, 103 bp, Artificial Sequence
  Synthetic Polynucleotide
taatacgactcactataggggagtgcggcatcatctcctcagactgggggaacagaggagacccccaatgtgaggagataacctggcggcagcgcaaaagatg

SEQ ID NO: 175946 - DNA, 103 bp, Artificial Sequence
  Synthetic Polynucleotide
taatacgactcactatagggaaccgacccggagtgcggcatcatctcctcaacagaggagagaggagatgatgccgcacaacctggcggcagcgcaaaagatg

SEQ ID NO: 175947 - DNA, 103 bp, Artificial Sequence
  Synthetic Polynucleotide
taatacgactcactataggggcttgtagtaaaccgacccggagtgcggcaaacagaggagatgccgcatgccgggtcggaacctggcggcagcgcaaaagatg

SEQ ID NO: 175948 - DNA, 103 bp, Artificial Sequence
  Synthetic Polynucleotide
taatacgactcactatagggggcgaggagggcttgtagtaaaccgacccgaacagaggagacgggtcatgttactacaaaacctggcggcagcgcaaaagatg

SEQ ID NO: 175949 - DNA, 103 bp, Artificial Sequence
  Synthetic Polynucleotide
taatacgactcactataggggggcgtcgggggcgaggagggcttgtagtaaacagaggagatactacatgccctcctcgaacctggcggcagcgcaaaagatg

SEQ ID NO: 175950 - DNA, 103 bp, Artificial Sequence
  Synthetic Polynucleotide
taatacgactcactatagggccggggtggtgggcgtcgggggcgaggaggaacagaggagacctcctatgccccgacgcaacctggcggcagcgcaaaagatg

SEQ ID NO: 175951 - DNA, 103 bp, Artificial Sequence
  Synthetic Polynucleotide
taatacgactcactatagggacctggaagcccggggtggtgggcgtcgggaacagaggagacccgacatgcaccaccccaacctggcggcagcgcaaaagatg

SEQ ID NO: 175952 - DNA, 103 bp, Artificial Sequence
  Synthetic Polynucleotide
taatacgactcactatagggctgagaagcggggctggctccttgaggcgaaacagaggagatcgcctatgggagccagcaacctggcggcagcgcaaaagatg

SEQ ID NO: 175953 - DNA, 103 bp, Artificial Sequence
  Synthetic Polynucleotide
taatacgactcactataggggctgtgctgcacctggaagcccggggtggtaacagaggagaaccaccatgggcttccagaacctggcggcagcgcaaaagatg

SEQ ID NO: 175954 - DNA, 103 bp, Artificial Sequence
  Synthetic Polynucleotide
taatacgactcactatagggcccacatggggctgtgctgcacctggaagcaacagaggagagcttccatgtgcagcacaaacctggcggcagcgcaaaagatg

SEQ ID NO: 175955 - DNA, 103 bp, Artificial Sequence
  Synthetic Polynucleotide
taatacgactcactatagggcccgggtcgtcccacatggggctgtgctgcaacagaggagagcagcaatgccccatgtgaacctggcggcagcgcaaaagatg

SEQ ID NO: 175956 - DNA, 103 bp, Artificial Sequence
  Synthetic Polynucleotide
taatacgactcactataggggtggagagatcccgggtcgtcccacatgggaacagaggagacccatgatggacgacccgaacctggcggcagcgcaaaagatg

SEQ ID NO: 175957 - DNA, 103 bp, Artificial Sequence
  Synthetic Polynucleotide
taatacgactcactatagggggtggaagttgtggagagatcccgggtcgtaacagaggagaacgaccatggatctctccaacctggcggcagcgcaaaagatg

SEQ ID NO: 175958 - DNA, 103 bp, Artificial Sequence
  Synthetic Polynucleotide
taatacgactcactatagggacgtagttctggtggaagttgtggagagataacagaggagaatctctatgcaacttccaaacctggcggcagcgcaaaagatg

SEQ ID NO: 175959 - DNA, 103 bp, Artificial Sequence
  Synthetic Polynucleotide
taatacgactcactatagggcgtagtggccacgtagttctggtggaagttaacagaggagaaacttcatgcagaactacaacctggcggcagcgcaaaagatg

SEQ ID NO: 175960 - DNA, 103 bp, Artificial Sequence
  Synthetic Polynucleotide
taatacgactcactatagggcgatcatgtgcgtagtggccacgtagttctaacagaggagaagaactatgtggccactaaacctggcggcagcgcaaaagatg

SEQ ID NO: 175961 - DNA, 103 bp, Artificial Sequence
  Synthetic Polynucleotide
taatacgactcactatagggttcctctgctcgatcatgtgcgtagtggccaacagaggagaggccacatggcacatgataacctggcggcagcgcaaaagatg

SEQ ID NO: 175962 - DNA, 103 bp, Artificial Sequence
  Synthetic Polynucleotide
taatacgactcactataggggactggcgttttcctctgctcgatcatgtgaacagaggagacacatgatggagcagaggaacctggcggcagcgcaaaagatg

SEQ ID NO: 175963 - DNA, 103 bp, Artificial Sequence
  Synthetic Polynucleotide
taatacgactcactatagggaactgtagctctgagaagcggggctggctcaacagaggagagagccaatgccgcttctcaacctggcggcagcgcaaaagatg

SEQ ID NO: 175964 - DNA, 103 bp, Artificial Sequence
  Synthetic Polynucleotide
taatacgactcactatagggagaggcgggagactggcgttttcctctgctaacagaggagaagcagaatgaaacgccagaacctggcggcagcgcaaaagatg

SEQ ID NO: 175965 - DNA, 103 bp, Artificial Sequence
  Synthetic Polynucleotide
taatacgactcactataggggagaagagggagaggcgggagactggcgttaacagaggagaaacgccatgctcccgcctaacctggcggcagcgcaaaagatg

SEQ ID NO: 175966 - DNA, 103 bp, Artificial Sequence
  Synthetic Polynucleotide
taatacgactcactatagggttgcttaaaggagaagagggagaggcgggaaacagaggagatcccgcatgtccctcttcaacctggcggcagcgcaaaagatg

SEQ ID NO: 175967 - DNA, 103 bp, Artificial Sequence
  Synthetic Polynucleotide
taatacgactcactatagggcagggggcgattgcttaaaggagaagagggaacagaggagaccctctatgcctttaagcaacctggcggcagcgcaaaagatg

SEQ ID NO: 175968 - DNA, 103 bp, Artificial Sequence
  Synthetic Polynucleotide
taatacgactcactatagggaccggggtgccagggggcgattgcttaaagaacagaggagactttaaatgatcgcccccaacctggcggcagcgcaaaagatg

SEQ ID NO: 175969 - DNA, 103 bp, Artificial Sequence
  Synthetic Polynucleotide
taatacgactcactataggggcaactagacaccggggtgccagggggcgaaacagaggagatcgcccatgggcaccccgaacctggcggcagcgcaaaagatg

SEQ ID NO: 175970 - DNA, 103 bp, Artificial Sequence
  Synthetic Polynucleotide
taatacgactcactatagggagcgcatctggcaactagacaccggggtgcaacagaggagagcacccatgtgtctagttaacctggcggcagcgcaaaagatg

SEQ ID NO: 175971 - DNA, 103 bp, Artificial Sequence
  Synthetic Polynucleotide
taatacgactcactatagggggcccgtcgaagcgcatctggcaactagacaacagaggagagtctagatgccagatgcgaacctggcggcagcgcaaaagatg

SEQ ID NO: 175972 - DNA, 103 bp, Artificial Sequence
  Synthetic Polynucleotide
taatacgactcactataggggacgtgcaggggcccgtcgaagcgcatctgaacagaggagacagatgatgttcgacgggaacctggcggcagcgcaaaagatg

SEQ ID NO: 175973 - DNA, 103 bp, Artificial Sequence
  Synthetic Polynucleotide
taatacgactcactatagggggttcatggggacgtgcaggggcccgtcgaaacagaggagatcgacgatgccctgcacgaacctggcggcagcgcaaaagatg

SEQ ID NO: 175974 - DNA, 103 bp, Artificial Sequence
  Synthetic Polynucleotide
taatacgactcactataggggaagagtggtaactgtagctctgagaagcgaacagaggagacgcttcatggagctacagaacctggcggcagcgcaaaagatg

SEQ ID NO: 175975 - DNA, 103 bp, Artificial Sequence
  Synthetic Polynucleotide
taatacgactcactataggggcgggctccgggttcatggggacgtgcaggaacagaggagacctgcaatgccccatgaaaacctggcggcagcgcaaaagatg

SEQ ID NO: 175976 - DNA, 103 bp, Artificial Sequence
  Synthetic Polynucleotide
taatacgactcactataggggtggctgccggcgggctccgggttcatgggaacagaggagacccatgatgccggagcccaacctggcggcagcgcaaaagatg

SEQ ID NO: 175977 - DNA, 103 bp, Artificial Sequence
  Synthetic Polynucleotide
taatacgactcactatagggccaccacgtggtggctgccggcgggctccgaacagaggagacggagcatgccggcagccaacctggcggcagcgcaaaagatg

SEQ ID NO: 175978 - DNA, 103 bp, Artificial Sequence
  Synthetic Polynucleotide
taatacgactcactataggggtctgcccgtccaccacgtggtggctgccgaacagaggagacggcagatgccacgtggtaacctggcggcagcgcaaaagatg

SEQ ID NO: 175979 - DNA, 103 bp, Artificial Sequence
  Synthetic Polynucleotide
taatacgactcactatagggcacagcgaaggtctgcccgtccaccacgtgaacagaggagacacgtgatggacgggcagaacctggcggcagcgcaaaagatg

SEQ ID NO: 175980 - DNA, 103 bp, Artificial Sequence
  Synthetic Polynucleotide
taatacgactcactatagggtggggttgggcacagcgaaggtctgcccgtaacagaggagaacgggcatgccttcgctgaacctggcggcagcgcaaaagatg

SEQ ID NO: 175981 - DNA, 103 bp, Artificial Sequence
  Synthetic Polynucleotide
taatacgactcactatagggggcttgcgaatggggttgggcacagcgaagaacagaggagacttcgcatggcccaacccaacctggcggcagcgcaaaagatg

SEQ ID NO: 175982 - DNA, 103 bp, Artificial Sequence
  Synthetic Polynucleotide
taatacgactcactatagggcatggacgcgggcttgcgaatggggttgggaacagaggagacccaacatgattcgcaagaacctggcggcagcgcaaaagatg

SEQ ID NO: 175983 - DNA, 103 bp, Artificial Sequence
  Synthetic Polynucleotide
taatacgactcactatagggccgggaagcccatggacgcgggcttgcgaaaacagaggagattcgcaatgccgcgtccaaacctggcggcagcgcaaaagatg

SEQ ID NO: 175984 - DNA, 103 bp, Artificial Sequence
  Synthetic Polynucleotide
taatacgactcactatagggatctgcaggcccgggaagcccatggacgcgaacagaggagacgcgtcatggggcttcccaacctggcggcagcgcaaaagatg

SEQ ID NO: 175985 - DNA, 103 bp, Artificial Sequence
  Synthetic Polynucleotide
taatacgactcactataggggtattctcccgaagagtggtaactgtagctaacagaggagaagctacatgtaccactctaacctggcggcagcgcaaaagatg

SEQ ID NO: 175986 - DNA, 103 bp, Artificial Sequence
  Synthetic Polynucleotide
taatacgactcactatagggcgcgtggccgatctgcaggcccgggaagccaacagaggagaggcttcatgggcctgcagaacctggcggcagcgcaaaagatg

SEQ ID NO: 175987 - DNA, 103 bp, Artificial Sequence
  Synthetic Polynucleotide
taatacgactcactataggggcagctgagacgcgtggccgatctgcaggcaacagaggagagcctgcatgtcggccacgaacctggcggcagcgcaaaagatg

SEQ ID NO: 175988 - DNA, 103 bp, Artificial Sequence
  Synthetic Polynucleotide
taatacgactcactatagggtgcgtgtcgagcagctgagacgcgtggccgaacagaggagacggccaatggtctcagctaacctggcggcagcgcaaaagatg

SEQ ID NO: 175989 - DNA, 103 bp, Artificial Sequence
  Synthetic Polynucleotide
taatacgactcactatagggtgagggcacctgcgtgtcgagcagctgagaaacagaggagatctcagatgctcgacacgaacctggcggcagcgcaaaagatg

SEQ ID NO: 175990 - DNA, 103 bp, Artificial Sequence
  Synthetic Polynucleotide
taatacgactcactataggggcgacggcggtgagggcacctgcgtgtcgaaacagaggagatcgacaatgaggtgccctaacctggcggcagcgcaaaagatg

SEQ ID NO: 175991 - DNA, 103 bp, Artificial Sequence
  Synthetic Polynucleotide
taatacgactcactatagggggggagccccgcgacggcggtgagggcaccaacagaggagaggtgccatgaccgccgtcaacctggcggcagcgcaaaagatg

SEQ ID NO: 175992 - DNA, 103 bp, Artificial Sequence
  Synthetic Polynucleotide
taatacgactcactatagggctcgttggagggggagccccgcgacggcggaacagaggagaccgccgatgcggggctccaacctggcggcagcgcaaaagatg

SEQ ID NO: 175993 - DNA, 103 bp, Artificial Sequence
  Synthetic Polynucleotide
taatacgactcactatagggcgcacagcccctcgttggagggggagccccaacagaggagaggggctatgcctccaacgaacctggcggcagcgcaaaagatg

SEQ ID NO: 175994 - DNA, 103 bp, Artificial Sequence
  Synthetic Polynucleotide
taatacgactcactatagggccacacacagcgcacagcccctcgttggagaacagaggagactccaaatgggggctgtgaacctggcggcagcgcaaaagatg

SEQ ID NO: 175995 - DNA, 103 bp, Artificial Sequence
  Synthetic Polynucleotide
taatacgactcactatagggcgcgttgtccccacacacagcgcacagcccaacagaggagagggctgatggctgtgtgtaacctggcggcagcgcaaaagatg

SEQ ID NO: 175996 - DNA, 103 bp, Artificial Sequence
  Synthetic Polynucleotide
taatacgactcactatagggaatcggagctgtattctcccgaagagtggtaacagaggagaaccactatgcgggagaataacctggcggcagcgcaaaagatg

SEQ ID NO: 175997 - DNA, 103 bp, Artificial Sequence
  Synthetic Polynucleotide
taatacgactcactataggggttggcaggccgcgttgtccccacacacagaacagaggagactgtgtatggggacaacgaacctggcggcagcgcaaaagatg

SEQ ID NO: 175998 - DNA, 103 bp, Artificial Sequence
  Synthetic Polynucleotide
taatacgactcactatagggacgccgtagtgttggcaggccgcgttgtccaacagaggagaggacaaatgggcctgccaaacctggcggcagcgcaaaagatg

SEQ ID NO: 175999 - DNA, 103 bp, Artificial Sequence
  Synthetic Polynucleotide
taatacgactcactatagggacaggtgcgcacgccgtagtgttggcaggcaacagaggagagcctgcatgcactacggcaacctggcggcagcgcaaaagatg

SEQ ID NO: 176000 - DNA, 103 bp, Artificial Sequence
  Synthetic Polynucleotide
taatacgactcactatagggtgcagccctcacaggtgcgcacgccgtagtaacagaggagaactacgatgtgcgcacctaacctggcggcagcgcaaaagatg

SEQ ID NO: 176001 - DNA, 103 bp, Artificial Sequence
  Synthetic Polynucleotide
taatacgactcactatagggaagaagcctttgcagccctcacaggtgcgcaacagaggagagcgcacatgtgagggctgaacctggcggcagcgcaaaagatg

SEQ ID NO: 176002 - DNA, 103 bp, Artificial Sequence
  Synthetic Polynucleotide
taatacgactcactatagggtgtgcgcttaaagaagcctttgcagccctcaacagaggagagagggcatgaaaggcttcaacctggcggcagcgcaaaagatg

SEQ ID NO: 176003 - DNA, 103 bp, Artificial Sequence
  Synthetic Polynucleotide
taatacgactcactatagggttttttgcactgtgcgcttaaagaagccttaacagaggagaaaggctatgttaagcgcaaacctggcggcagcgcaaaagatg

SEQ ID NO: 176004 - DNA, 103 bp, Artificial Sequence
  Synthetic Polynucleotide
taatacgactcactatagggtattttgcatttttttgcactgtgcgcttaaacagaggagataagcgatgagtgcaaaaaacctggcggcagcgcaaaagatg

SEQ ID NO: 176005 - DNA, 103 bp, Artificial Sequence
  Synthetic Polynucleotide
taatacgactcactatagggtaaacacacgtattttgcatttttttgcacaacagaggagagtgcaaatgaatgcaaaaaacctggcggcagcgcaaaagatg

SEQ ID NO: 176006 - DNA, 103 bp, Artificial Sequence
  Synthetic Polynucleotide
taatacgactcactatagggttttatttgctaaacacacgtattttgcataacagaggagaatgcaaatgacgtgtgttaacctggcggcagcgcaaaagatg

SEQ ID NO: 176007 - DNA, 103 bp, Artificial Sequence
  Synthetic Polynucleotide
taatacgactcactatagggggagttaagaaatcggagctgtattctcccaacagaggagagggagaatgcagctccgaaacctggcggcagcgcaaaagatg

SEQ ID NO: 176008 - DNA, 103 bp, Artificial Sequence
  Synthetic Polynucleotide
taatacgactcactatagggactgggcagtttttatttgctaaacacacgaacagaggagacgtgtgatgagcaaataaaacctggcggcagcgcaaaagatg

SEQ ID NO: 176009 - DNA, 103 bp, Artificial Sequence
  Synthetic Polynucleotide
taatacgactcactatagggacgcttgtccactgggcagtttttatttgcaacagaggagagcaaatatgaactgcccaaacctggcggcagcgcaaaagatg

SEQ ID NO: 176010 - DNA, 103 bp, Artificial Sequence
  Synthetic Polynucleotide
taatacgactcactataggggattccggcgacgcttgtccactgggcagtaacagaggagaactgccatgtggacaagcaacctggcggcagcgcaaaagatg

SEQ ID NO: 176011 - DNA, 103 bp, Artificial Sequence
  Synthetic Polynucleotide
taatacgactcactatagggtactgacagcgattccggcgacgcttgtccaacagaggagaggacaaatgtcgccggaaaacctggcggcagcgcaaaagatg

SEQ ID NO: 176012 - DNA, 103 bp, Artificial Sequence
  Synthetic Polynucleotide
taatacgactcactatagggaaatcggcagtactgacagcgattccggcgaacagaggagacgccggatgcgctgtcagaacctggcggcagcgcaaaagatg

SEQ ID NO: 176013 - DNA, 103 bp, Artificial Sequence
  Synthetic Polynucleotide
taatacgactcactatagggggcacttctgaaatcggcagtactgacagcaacagaggagagctgtcatgactgccgataacctggcggcagcgcaaaagatg

SEQ ID NO: 176014 - DNA, 103 bp, Artificial Sequence
  Synthetic Polynucleotide
taatacgactcactatagggccaacagccaggcacttctgaaatcggcagaacagaggagactgccgatgtcagaagtgaacctggcggcagcgcaaaagatg

SEQ ID NO: 176015 - DNA, 103 bp, Artificial Sequence
  Synthetic Polynucleotide
taatacgactcactatagggtttgaccatcccaacagccaggcacttctgaacagaggagacagaagatgctggctgttaacctggcggcagcgcaaaagatg

SEQ ID NO: 176016 - DNA, 103 bp, Artificial Sequence
  Synthetic Polynucleotide
taatacgactcactataggggaaccacttctttgaccatcccaacagccaaacagaggagatggctgatgggatggtcaaacctggcggcagcgcaaaagatg

SEQ ID NO: 176017 - DNA, 103 bp, Artificial Sequence
  Synthetic Polynucleotide
taatacgactcactatagggctgtctgtgcgaaccacttctttgaccatcaacagaggagagatggtatgagaagtggtaacctggcggcagcgcaaaagatg

SEQ ID NO: 176018 - DNA, 103 bp, Artificial Sequence
  Synthetic Polynucleotide
taatacgactcactatagggcacatttccaaatctgattgagtcatgcataacagaggagaatgcatatgtcaatcagaaacctggcggcagcgcaaaagatg

SEQ ID NO: 176019 - DNA, 103 bp, Artificial Sequence
  Synthetic Polynucleotide
taatacgactcactatagggctccgtggtgtattccgagctgtatgtctgaacagaggagacagacaatgagctcggaaaacctggcggcagcgcaaaagatg

SEQ ID NO: 176020 - DNA, 103 bp, Artificial Sequence
  Synthetic Polynucleotide
taatacgactcactatagggcaggcaaacatattttgcatttttctgcacaacagaggagagtgcagatgaatgcaaaaaacctggcggcagcgcaaaagatg

SEQ ID NO: 176021 - DNA, 103 bp, Artificial Sequence
  Synthetic Polynucleotide
taatacgactcactatagggttttatttgccaggcaaacatattttgcataacagaggagaatgcaaatgatgtttgccaacctggcggcagcgcaaaagatg

SEQ ID NO: 176022 - DNA, 103 bp, Artificial Sequence
  Synthetic Polynucleotide
taatacgactcactatagggactgggcagtttttatttgccaggcaaacaaacagaggagatgtttgatgggcaaataaaacctggcggcagcgcaaaagatg

SEQ ID NO: 176023 - DNA, 103 bp, Artificial Sequence
  Synthetic Polynucleotide
taatacgactcactatagggtctcttgtctactgggcagtttttatttgcaacagaggagagcaaatatgaactgcccaaacctggcggcagcgcaaaagatg

SEQ ID NO: 176024 - DNA, 103 bp, Artificial Sequence
  Synthetic Polynucleotide
taatacgactcactatagggggtttcgacgtctcttgtctactgggcagtaacagaggagaactgccatgtagacaagaaacctggcggcagcgcaaaagatg

SEQ ID NO: 176025 - DNA, 103 bp, Artificial Sequence
  Synthetic Polynucleotide
taatacgactcactatagggtactgacatcggtttcgacgtctcttgtctaacagaggagaagacaaatgacgtcgaaaaacctggcggcagcgcaaaagatg

SEQ ID NO: 176026 - DNA, 103 bp, Artificial Sequence
  Synthetic Polynucleotide
taatacgactcactatagggaaatcgacagtactgacatcggtttcgacgaacagaggagacgtcgaatgcgatgtcagaacctggcggcagcgcaaaagatg

SEQ ID NO: 176027 - DNA, 103 bp, Artificial Sequence
  Synthetic Polynucleotide
taatacgactcactataggggacacttctgaaatcgacagtactgacatcaacagaggagagatgtcatgactgtcgataacctggcggcagcgcaaaagatg

SEQ ID NO: 176028 - DNA, 103 bp, Artificial Sequence
  Synthetic Polynucleotide
taatacgactcactatagggccaacactgagacacttctgaaatcgacagaacagaggagactgtcgatgtcagaagtgaacctggcggcagcgcaaaagatg

SEQ ID NO: 176029 - DNA, 103 bp, Artificial Sequence
  Synthetic Polynucleotide
taatacgactcactatagggttttaccattccaacactgagacacttctgaacagaggagacagaagatgctcagtgttaacctggcggcagcgcaaaagatg

SEQ ID NO: 176030 - DNA, 103 bp, Artificial Sequence
  Synthetic Polynucleotide
taatacgactcactatagggggttcatgatctccgtggtgtattccgagcaacagaggagagctcggatgacaccacggaacctggcggcagcgcaaaagatg

SEQ ID NO: 176031 - DNA, 103 bp, Artificial Sequence
  Synthetic Polynucleotide
taatacgactcactatagggggacaacttcttttaccattccaacactgaaacagaggagatcagtgatggaatggtaaaacctggcggcagcgcaaaagatg

SEQ ID NO: 176032 - DNA, 103 bp, Artificial Sequence
  Synthetic Polynucleotide
taatacgactcactatagggctatctgtacggacaacttcttttaccattaacagaggagaaatggtatgagaagttgtaacctggcggcagcgcaaaagatg

SEQ ID NO: 176033 - DNA, 103 bp, Artificial Sequence
  Synthetic Polynucleotide
taatacgactcactatagggccctttcagactatctgtacggacaacttcaacagaggagagaagttatgcgtacagataacctggcggcagcgcaaaagatg

SEQ ID NO: 176034 - DNA, 103 bp, Artificial Sequence
  Synthetic Polynucleotide
taatacgactcactataggggacctctcctccctttcagactatctgtacaacagaggagagtacagatggtctgaaagaacctggcggcagcgcaaaagatg

SEQ ID NO: 176035 - DNA, 103 bp, Artificial Sequence
  Synthetic Polynucleotide
taatacgactcactataggggaaggcagacgacctctcctccctttcagaaacagaggagatctgaaatggaggagaggaacctggcggcagcgcaaaagatg

SEQ ID NO: 176036 - DNA, 103 bp, Artificial Sequence
  Synthetic Polynucleotide
taatacgactcactatagggctttggtttggaaggcagacgacctctcctaacagaggagaaggagaatgcgtctgcctaacctggcggcagcgcaaaagatg

SEQ ID NO: 176037 - DNA, 103 bp, Artificial Sequence
  Synthetic Polynucleotide
taatacgactcactataggggtaatgggctctttggtttggaaggcagacaacagaggagagtctgcatgccaaaccaaaacctggcggcagcgcaaaagatg

SEQ ID NO: 176038 - DNA, 103 bp, Artificial Sequence
  Synthetic Polynucleotide
taatacgactcactatagggggttcctgttgtaatgggctctttggtttgaacagaggagacaaaccatggagcccattaacctggcggcagcgcaaaagatg

SEQ ID NO: 176039 - DNA, 103 bp, Artificial Sequence
  Synthetic Polynucleotide
taatacgactcactataggggggctgagaaggttcctgttgtaatgggctaacagaggagaagcccaatgcaacaggaaaacctggcggcagcgcaaaagatg

SEQ ID NO: 176040 - DNA, 103 bp, Artificial Sequence
  Synthetic Polynucleotide
taatacgactcactatagggaaggtggagagggctgagaaggttcctgttaacagaggagaaacaggatgcttctcagcaacctggcggcagcgcaaaagatg

SEQ ID NO: 176041 - DNA, 103 bp, Artificial Sequence
  Synthetic Polynucleotide
taatacgactcactataggggtgtagtcggggttcatgatctccgtggtgaacagaggagacaccacatggatcatgaaaacctggcggcagcgcaaaagatg

SEQ ID NO: 176042 - DNA, 103 bp, Artificial Sequence
  Synthetic Polynucleotide
taatacgactcactatagggattggaggagaaggtggagagggctgagaaaacagaggagattctcaatgctctccaccaacctggcggcagcgcaaaagatg

SEQ ID NO: 176043 - DNA, 103 bp, Artificial Sequence
  Synthetic Polynucleotide
taatacgactcactatagggcatcatgcagattggaggagaaggtggagaaacagaggagatctccaatgtctcctccaaacctggcggcagcgcaaaagatg

SEQ ID NO: 176044 - DNA, 103 bp, Artificial Sequence
  Synthetic Polynucleotide
taatacgactcactatagggcaagggcattcatcatgcagattggaggagaacagaggagactcctcatgtctgcatgaaacctggcggcagcgcaaaagatg

SEQ ID NO: 176045 - DNA, 103 bp, Artificial Sequence
  Synthetic Polynucleotide
taatacgactcactatagggaaagctcggacaagggcattcatcatgcagaacagaggagactgcatatggaatgccctaacctggcggcagcgcaaaagatg

SEQ ID NO: 176046 - DNA, 103 bp, Artificial Sequence
  Synthetic Polynucleotide
taatacgactcactatagggtgagtctgttaaagctcggacaagggcattaacagaggagaaatgccatggtccgagctaacctggcggcagcgcaaaagatg

SEQ ID NO: 176047 - DNA, 103 bp, Artificial Sequence
  Synthetic Polynucleotide
taatacgactcactatagggctctgggtgttgagtctgttaaagctcggaaacagaggagatccgagatgtaacagactaacctggcggcagcgcaaaagatg

SEQ ID NO: 176048 - DNA, 103 bp, Artificial Sequence
  Synthetic Polynucleotide
taatacgactcactatagggtaatcaagatctctgggtgttgagtctgttaacagaggagaaacagaatgaacacccagaacctggcggcagcgcaaaagatg

SEQ ID NO: 176049 - DNA, 103 bp, Artificial Sequence
  Synthetic Polynucleotide
taatacgactcactataggggtatctggaataatcaagatctctgggtgtaacagaggagaacacccatggatcttgataacctggcggcagcgcaaaagatg

SEQ ID NO: 176050 - DNA, 103 bp, Artificial Sequence
  Synthetic Polynucleotide
taatacgactcactatagggcagtgggacagtatctggaataatcaagataacagaggagaatcttgatgattccagataacctggcggcagcgcaaaagatg

SEQ ID NO: 176051 - DNA, 103 bp, Artificial Sequence
  Synthetic Polynucleotide
taatacgactcactataggggcagcctggtcagtgggacagtatctggaaaacagaggagattccagatgctgtcccacaacctggcggcagcgcaaaagatg

SEQ ID NO: 176052 - DNA, 103 bp, Artificial Sequence
  Synthetic Polynucleotide
taatacgactcactatagggggtcagcttggtgtagtcggggttcatgataacagaggagaatcatgatgcccgactacaacctggcggcagcgcaaaagatg

SEQ ID NO: 176053 - DNA, 103 bp, Artificial Sequence
  Synthetic Polynucleotide
taatacgactcactatagggtgtgcctgcagcagcctggtcagtgggacaaacagaggagatgtcccatggaccaggctaacctggcggcagcgcaaaagatg

SEQ ID NO: 176054 - DNA, 103 bp, Artificial Sequence
  Synthetic Polynucleotide
taatacgactcactataggggctcagcatctgtgcctgcagcagcctggtaacagaggagaaccaggatgctgcaggcaaacctggcggcagcgcaaaagatg

SEQ ID NO: 176055 - DNA, 103 bp, Artificial Sequence
  Synthetic Polynucleotide
taatacgactcactatagggtgttgcacatgctcagcatctgtgcctgcaaacagaggagatgcaggatgagatgctgaaacctggcggcagcgcaaaagatg

SEQ ID NO: 176056 - DNA, 103 bp, Artificial Sequence
  Synthetic Polynucleotide
taatacgactcactataggggttgtagaattgttgcacatgctcagcatcaacagaggagagatgctatgcatgtgcaaaacctggcggcagcgcaaaagatg

SEQ ID NO: 176057 - DNA, 103 bp, Artificial Sequence
  Synthetic Polynucleotide
taatacgactcactatagggctgtcaggaggttgtagaattgttgcacataacagaggagaatgtgcatgaattctacaaacctggcggcagcgcaaaagatg

SEQ ID NO: 176058 - DNA, 103 bp, Artificial Sequence
  Synthetic Polynucleotide
taatacgactcactatagggtcaatggaggctgtcaggaggttgtagaataacagaggagaattctaatgcctcctgacaacctggcggcagcgcaaaagatg

SEQ ID NO: 176059 - DNA, 103 bp, Artificial Sequence
  Synthetic Polynucleotide
taatacgactcactatagggtctggatacatcaatggaggctgtcaggagaacagaggagactcctgatggcctccattaacctggcggcagcgcaaaagatg

SEQ ID NO: 176060 - DNA, 103 bp, Artificial Sequence
  Synthetic Polynucleotide
taatacgactcactatagggctgcccagcttctggatacatcaatggaggaacagaggagacctccaatgatgtatccaaacctggcggcagcgcaaaagatg

SEQ ID NO: 176061 - DNA, 103 bp, Artificial Sequence
  Synthetic Polynucleotide
taatacgactcactatagggggaatcttttctgcccagcttctggatacaaacagaggagatgtatcatgaagctgggcaacctggcggcagcgcaaaagatg

SEQ ID NO: 176062 - DNA, 103 bp, Artificial Sequence
  Synthetic Polynucleotide
taatacgactcactatagggagtaaatcccggaatcttttctgcccagctaacagaggagaagctggatggaaaagattaacctggcggcagcgcaaaagatg

SEQ ID NO: 176063 - DNA, 103 bp, Artificial Sequence
  Synthetic Polynucleotide
taatacgactcactatagggcaaggtccatggtcagcttggtgtagtcggaacagaggagaccgactatgccaagctgaaacctggcggcagcgcaaaagatg

SEQ ID NO: 176064 - DNA, 103 bp, Artificial Sequence
  Synthetic Polynucleotide
taatacgactcactatagggtggggagatcagtaaatcccggaatcttttaacagaggagaaaaagaatgcgggatttaaacctggcggcagcgcaaaagatg

SEQ ID NO: 176065 - DNA, 103 bp, Artificial Sequence
  Synthetic Polynucleotide
taatacgactcactatagggtgatcttctttggggagatcagtaaatcccaacagaggagagggattatgtgatctcccaacctggcggcagcgcaaaagatg

SEQ ID NO: 176066 - DNA, 103 bp, Artificial Sequence
  Synthetic Polynucleotide
taatacgactcactatagggaagtaatgtctgatcttctttggggagatcaacagaggagagatctcatgaaagaagataacctggcggcagcgcaaaagatg

SEQ ID NO: 176067 - DNA, 103 bp, Artificial Sequence
  Synthetic Polynucleotide
taatacgactcactatagggctgattcaataagtaatgtctgatcttcttaacagaggagaaagaagatgagacattacaacctggcggcagcgcaaaagatg

SEQ ID NO: 176068 - DNA, 103 bp, Artificial Sequence
  Synthetic Polynucleotide
taatacgactcactatagggtccaaaaaggctgattcaataagtaatgtcaacagaggagagacattatgtattgaatcaacctggcggcagcgcaaaagatg

SEQ ID NO: 176069 - DNA, 103 bp, Artificial Sequence
  Synthetic Polynucleotide
taatacgactcactataggggacaaacagctccaaaaaggctgattcaataacagaggagaattgaaatggcctttttgaacctggcggcagcgcaaaagatg

SEQ ID NO: 176070 - DNA, 103 bp, Artificial Sequence
  Synthetic Polynucleotide
taatacgactcactatagggaaagtctgaggacaaacagctccaaaaaggaacagaggagaccttttatgagctgtttgaacctggcggcagcgcaaaagatg

SEQ ID NO: 176071 - DNA, 103 bp, Artificial Sequence
  Synthetic Polynucleotide
taatacgactcactataggggacctgatggaaagtctgaggacaaacagcaacagaggagagctgttatgcctcagactaacctggcggcagcgcaaaagatg

SEQ ID NO: 176072 - DNA, 103 bp, Artificial Sequence
  Synthetic Polynucleotide
taatacgactcactatagggagcagtgtttgacctgatggaaagtctgagaacagaggagactcagaatgtccatcaggaacctggcggcagcgcaaaagatg

SEQ ID NO: 176073 - DNA, 103 bp, Artificial Sequence
  Synthetic Polynucleotide
taatacgactcactatagggacttatcttcagcagtgtttgacctgatggaacagaggagaccatcaatgcaaacactgaacctggcggcagcgcaaaagatg

SEQ ID NO: 176074 - DNA, 103 bp, Artificial Sequence
  Synthetic Polynucleotide
taatacgactcactatagggtcagtgctgccaaggtccatggtcagcttgaacagaggagacaagctatgcatggacctaacctggcggcagcgcaaaagatg

SEQ ID NO: 176075 - DNA, 103 bp, Artificial Sequence
  Synthetic Polynucleotide
taatacgactcactatagggcagaacacaaacttatcttcagcagtgtttaacagaggagaaaacacatgtgaagataaaacctggcggcagcgcaaaagatg

SEQ ID NO: 176076 - DNA, 103 bp, Artificial Sequence
  Synthetic Polynucleotide
taatacgactcactatagggaagtccattgcagaacacaaacttatcttcaacagaggagagaagatatgtttgtgttcaacctggcggcagcgcaaaagatg

SEQ ID NO: 176077 - DNA, 103 bp, Artificial Sequence
  Synthetic Polynucleotide
taatacgactcactataggggatgcaggacaagtccattgcagaacacaaaacagaggagattgtgtatggcaatggacaacctggcggcagcgcaaaagatg

SEQ ID NO: 176078 - DNA, 103 bp, Artificial Sequence
  Synthetic Polynucleotide
taatacgactcactatagggcactgaagtcgatgcaggacaagtccattgaacagaggagacaatggatgtgtcctgcaaacctggcggcagcgcaaaagatg

SEQ ID NO: 176079 - DNA, 103 bp, Artificial Sequence
  Synthetic Polynucleotide
taatacgactcactatagggtccacgaaggcactgaagtcgatgcaggacaacagaggagagtcctgatgcgacttcagaacctggcggcagcgcaaaagatg

SEQ ID NO: 176080 - DNA, 103 bp, Artificial Sequence
  Synthetic Polynucleotide
taatacgactcactatagggactccccaaatccacgaaggcactgaagtcaacagaggagagacttcatggccttcgtgaacctggcggcagcgcaaaagatg

SEQ ID NO: 176081 - DNA, 103 bp, Artificial Sequence
  Synthetic Polynucleotide
taatacgactcactataggggagtcgagccactccccaaatccacgaaggaacagaggagaccttcgatgatttggggaaacctggcggcagcgcaaaagatg

SEQ ID NO: 176082 - DNA, 103 bp, Artificial Sequence
  Synthetic Polynucleotide
taatacgactcactataggggtctttaatagagtcgagccactccccaaaaacagaggagatttgggatgtggctcgacaacctggcggcagcgcaaaagatg

SEQ ID NO: 176083 - DNA, 103 bp, Artificial Sequence
  Synthetic Polynucleotide
taatacgactcactatagggttaaggaaaagtctttaatagagtcgagccaacagaggagaggctcgatgctattaaagaacctggcggcagcgcaaaagatg

SEQ ID NO: 176084 - DNA, 103 bp, Artificial Sequence
  Synthetic Polynucleotide
taatacgactcactatagggctctgcaaatttaaggaaaagtctttaataaacagaggagatattaaatgcttttccttaacctggcggcagcgcaaaagatg

SEQ ID NO: 176085 - DNA, 103 bp, Artificial Sequence
  Synthetic Polynucleotide
taatacgactcactatagggagccgtgatctcagtgctgccaaggtccataacagaggagaatggacatgggcagcactaacctggcggcagcgcaaaagatg

SEQ ID NO: 176086 - DNA, 103 bp, Artificial Sequence
  Synthetic Polynucleotide
taatacgactcactatagggaaggttcaggctctgcaaatttaaggaaaaaacagaggagattttccatgaatttgcagaacctggcggcagcgcaaaagatg

SEQ ID NO: 176087 - DNA, 103 bp, Artificial Sequence
  Synthetic Polynucleotide
taatacgactcactatagggcttggatatcaaggttcaggctctgcaaataacagaggagaatttgcatggcctgaaccaacctggcggcagcgcaaaagatg

SEQ ID NO: 176088 - DNA, 103 bp, Artificial Sequence
  Synthetic Polynucleotide
taatacgactcactatagggcaggctaaggcttggatatcaaggttcaggaacagaggagacctgaaatgtgatatccaaacctggcggcagcgcaaaagatg

SEQ ID NO: 176089 - DNA, 103 bp, Artificial Sequence
  Synthetic Polynucleotide
taatacgactcactatagggtgctgacaggcaggctaaggcttggatatcaacagaggagagatatcatggccttagccaacctggcggcagcgcaaaagatg

SEQ ID NO: 176090 - DNA, 103 bp, Artificial Sequence
  Synthetic Polynucleotide
taatacgactcactatagggtcatgctcagtgctgacaggcaggctaaggaacagaggagaccttagatggcctgtcagaacctggcggcagcgcaaaagatg

SEQ ID NO: 176091 - DNA, 103 bp, Artificial Sequence
  Synthetic Polynucleotide
taatacgactcactatagggctttctgtgatcatgctcagtgctgacaggaacagaggagacctgtcatgactgagcataacctggcggcagcgcaaaagatg

SEQ ID NO: 176092 - DNA, 103 bp, Artificial Sequence
  Synthetic Polynucleotide
taatacgactcactatagggtaacccatgtctttctgtgatcatgctcagaacagaggagactgagcatgatcacagaaaacctggcggcagcgcaaaagatg

SEQ ID NO: 176093 - DNA, 103 bp, Artificial Sequence
  Synthetic Polynucleotide
taatacgactcactatagggttggttcttttaacccatgtctttctgtgaaacagaggagatcacagatggacatgggtaacctggcggcagcgcaaaagatg

SEQ ID NO: 176094 - DNA, 103 bp, Artificial Sequence
  Synthetic Polynucleotide
taatacgactcactatagggtcgactctctttggttcttttaacccatgtaacagaggagaacatggatgaaaagaaccaacctggcggcagcgcaaaagatg

SEQ ID NO: 176095 - DNA, 103 bp, Artificial Sequence
  Synthetic Polynucleotide
taatacgactcactataggggcatagctcttcgactctctttggttctttaacagaggagaaaagaaatgaagagagtcaacctggcggcagcgcaaaagatg

SEQ ID NO: 176096 - DNA, 103 bp, Artificial Sequence
  Synthetic Polynucleotide
taatacgactcactatagggtggtggctgtagccgtgatctcagtgctgcaacagaggagagcagcaatgagatcacggaacctggcggcagcgcaaaagatg

SEQ ID NO: 176097 - DNA, 103 bp, Artificial Sequence
  Synthetic Polynucleotide
taatacgactcactatagggtgatcttgttgcatagctcttcgactctctaacagaggagaagagagatgaagagctataacctggcggcagcgcaaaagatg

SEQ ID NO: 176098 - DNA, 103 bp, Artificial Sequence
  Synthetic Polynucleotide
taatacgactcactatagggaaactgcttgtgatcttgttgcatagctctaacagaggagaagagctatgcaacaagataacctggcggcagcgcaaaagatg

SEQ ID NO: 176099 - DNA, 103 bp, Artificial Sequence
  Synthetic Polynucleotide
taatacgactcactataggggtggtcttttaaactgcttgtgatcttgttaacagaggagaaacaagatgacaagcagtaacctggcggcagcgcaaaagatg

SEQ ID NO: 176100 - DNA, 103 bp, Artificial Sequence
  Synthetic Polynucleotide
taatacgactcactatagggccttactctggtggtcttttaaactgcttgaacagaggagacaagcaatgtaaaagaccaacctggcggcagcgcaaaagatg

SEQ ID NO: 176101 - DNA, 103 bp, Artificial Sequence
  Synthetic Polynucleotide
taatacgactcactatagggagagcctgtcccttactctggtggtcttttaacagaggagaaaaagaatgccagagtaaaacctggcggcagcgcaaaagatg

SEQ ID NO: 176102 - DNA, 103 bp, Artificial Sequence
  Synthetic Polynucleotide
taatacgactcactatagggggtgggctccagagcctgtcccttactctgaacagaggagacagagtatgggacaggctaacctggcggcagcgcaaaagatg

SEQ ID NO: 176103 - DNA, 103 bp, Artificial Sequence
  Synthetic Polynucleotide
taatacgactcactatagggccttggactcggtgggctccagagcctgtcaacagaggagagacaggatgtggagcccaaacctggcggcagcgcaaaagatg

SEQ ID NO: 176104 - DNA, 103 bp, Artificial Sequence
  Synthetic Polynucleotide
taatacgactcactataggggcacccaggaccttggactcggtgggctccaacagaggagaggagccatgcgagtccaaaacctggcggcagcgcaaaagatg

SEQ ID NO: 176105 - DNA, 103 bp, Artificial Sequence
  Synthetic Polynucleotide
taatacgactcactatagggttctaccagggcacccaggaccttggactcaacagaggagagagtccatggtcctgggtaacctggcggcagcgcaaaagatg

SEQ ID NO: 176106 - DNA, 103 bp, Artificial Sequence
  Synthetic Polynucleotide
taatacgactcactatagggtcttcctcagttctaccagggcacccaggaaacagaggagatcctggatgccctggtagaacctggcggcagcgcaaaagatg

SEQ ID NO: 176107 - DNA, 103 bp, Artificial Sequence
  Synthetic Polynucleotide
taatacgactcactatagggggcagggacgtggtggctgtagccgtgatcaacagaggagagatcacatgtacagccacaacctggcggcagcgcaaaagatg

SEQ ID NO: 176108 - DNA, 103 bp, Artificial Sequence
  Synthetic Polynucleotide
taatacgactcactatagggagggtgcagatcttcctcagttctaccaggaacagaggagacctggtatgactgaggaaaacctggcggcagcgcaaaagatg

SEQ ID NO: 176109 - DNA, 103 bp, Artificial Sequence
  Synthetic Polynucleotide
taatacgactcactatagggctggaggcccagggtgcagatcttcctcagaacagaggagactgaggatgatctgcaccaacctggcggcagcgcaaaagatg

SEQ ID NO: 176110 - DNA, 103 bp, Artificial Sequence
  Synthetic Polynucleotide
taatacgactcactatagggagaagatgcgctggaggcccagggtgcagaaacagaggagatctgcaatgtgggcctccaacctggcggcagcgcaaaagatg

SEQ ID NO: 176111 - DNA, 103 bp, Artificial Sequence
  Synthetic Polynucleotide
taatacgactcactatagggagcttcaggtagaagatgcgctggaggcccaacagaggagagggcctatggcgcatcttaacctggcggcagcgcaaaagatg

SEQ ID NO: 176112 - DNA, 103 bp, Artificial Sequence
  Synthetic Polynucleotide
taatacgactcactatagggcaagtcttccagcttcaggtagaagatgcgaacagaggagacgcatcatgtacctgaagaacctggcggcagcgcaaaagatg

SEQ ID NO: 176113 - DNA, 103 bp, Artificial Sequence
  Synthetic Polynucleotide
taatacgactcactataggggtggagacaccaagtcttccagcttcaggtaacagaggagaacctgaatgtggaagactaacctggcggcagcgcaaaagatg

SEQ ID NO: 176114 - DNA, 103 bp, Artificial Sequence
  Synthetic Polynucleotide
taatacgactcactatagggatgatggaaggtggagacaccaagtcttccaacagaggagaggaagaatgggtgtctccaacctggcggcagcgcaaaagatg

SEQ ID NO: 176115 - DNA, 103 bp, Artificial Sequence
  Synthetic Polynucleotide
taatacgactcactataggggagcttgtcaatgatggaaggtggagacacaacagaggagagtgtctatgccttccatcaacctggcggcagcgcaaaagatg

SEQ ID NO: 176116 - DNA, 103 bp, Artificial Sequence
  Synthetic Polynucleotide
taatacgactcactatagggtgtccaggaagagcttgtcaatgatggaagaacagaggagacttccaatgttgacaagcaacctggcggcagcgcaaaagatg

SEQ ID NO: 176117 - DNA, 103 bp, Artificial Sequence
  Synthetic Polynucleotide
taatacgactcactatagggaaaggtagggtgtccaggaagagcttgtcaaacagaggagatgacaaatgcttcctggaaacctggcggcagcgcaaaagatg

SEQ ID NO: 176118 - DNA, 103 bp, Artificial Sequence
  Synthetic Polynucleotide
taatacgactcactatagggactgatgctgggcagggacgtggtggctgtaacagaggagaacagccatgacgtccctgaacctggcggcagcgcaaaagatg

SEQ ID NO: 176119 - DNA, 103 bp, Artificial Sequence
  Synthetic Polynucleotide
taatacgactcactatagggagggcatatccacatttccaaatctgattgaacagaggagacaatcaatgttggaaatgaacctggcggcagcgcaaaagatg

SEQ ID NO: 176120 - DNA, 103 bp, Artificial Sequence
  Synthetic Polynucleotide
taatacgactcactatagggccacgaaggtactgatgctgggcagggacgaacagaggagacgtcccatgccagcatcaaacctggcggcagcgcaaaagatg

SEQ ID NO: 176121 - DNA, 103 bp, Artificial Sequence
  Synthetic Polynucleotide
taatacgactcactataggggagtagccctccacgaaggtactgatgctgaacagaggagacagcatatgtaccttcgtaacctggcggcagcgcaaaagatg

SEQ ID NO: 176122 - DNA, 103 bp, Artificial Sequence
  Synthetic Polynucleotide
taatacgactcactataggggtagttgctcgagtagccctccacgaaggtaacagaggagaaccttcatggagggctacaacctggcggcagcgcaaaagatg

SEQ ID NO: 176123 - DNA, 103 bp, Artificial Sequence
  Synthetic Polynucleotide
taatacgactcactataggggcttgagttcgtagttgctcgagtagccctaacagaggagaagggctatgcgagcaactaacctggcggcagcgcaaaagatg

SEQ ID NO: 176124 - DNA, 103 bp, Artificial Sequence
  Synthetic Polynucleotide
taatacgactcactatagggacgcaggaaggcttgagttcgtagttgctcaacagaggagagagcaaatgcgaactcaaaacctggcggcagcgcaaaagatg

SEQ ID NO: 176125 - DNA, 103 bp, Artificial Sequence
  Synthetic Polynucleotide
taatacgactcactatagggcatttggtacacgcaggaaggcttgagttcaacagaggagagaactcatgccttcctgcaacctggcggcagcgcaaaagatg

SEQ ID NO: 176126 - DNA, 103 bp, Artificial Sequence
  Synthetic Polynucleotide
taatacgactcactatagggagggccgctgcatttggtacacgcaggaagaacagaggagacttcctatgtgtaccaaaaacctggcggcagcgcaaaagatg

SEQ ID NO: 176127 - DNA, 103 bp, Artificial Sequence
  Synthetic Polynucleotide
taatacgactcactatagggactttgatcaagggccgctgcatttggtacaacagaggagagtaccaatggcagcggccaacctggcggcagcgcaaaagatg

SEQ ID NO: 176128 - DNA, 103 bp, Artificial Sequence
  Synthetic Polynucleotide
taatacgactcactatagggcccctcctccactttgatcaagggccgctgaacagaggagacagcggatgttgatcaaaaacctggcggcagcgcaaaagatg

SEQ ID NO: 176129 - DNA, 103 bp, Artificial Sequence
  Synthetic Polynucleotide
taatacgactcactatagggtgggcgcccgcccctcctccactttgatcaaacagaggagatgatcaatgtggaggaggaacctggcggcagcgcaaaagatg

SEQ ID NO: 176130 - DNA, 103 bp, Artificial Sequence
  Synthetic Polynucleotide
taatacgactcactataggggcttggacgcagggcatatccacatttccaaacagaggagatggaaaatgggatatgccaacctggcggcagcgcaaaagatg

SEQ ID NO: 176131 - DNA, 103 bp, Artificial Sequence
  Synthetic Polynucleotide
taatacgactcactatagggtgatggtagctgggcgcccgcccctcctccaacagaggagaggaggaatggcgggcgccaacctggcggcagcgcaaaagatg

SEQ ID NO: 176132 - DNA, 103 bp, Artificial Sequence
  Synthetic Polynucleotide
taatacgactcactataggggtggtgatggtgatggtagctgggcgcccgaacagaggagacgggcgatgagctaccataacctggcggcagcgcaaaagatg

SEQ ID NO: 176133 - DNA, 103 bp, Artificial Sequence
  Synthetic Polynucleotide
taatacgactcactatagggggtggtggtggtggtgatggtgatggtagcaacagaggagagctaccatgaccatcaccaacctggcggcagcgcaaaagatg

SEQ ID NO: 176134 - DNA, 103 bp, Artificial Sequence
  Synthetic Polynucleotide
taatacgactcactatagggtggtggtggtggtggtggtggtggtgatggaacagaggagaccatcaatgccaccaccaaacctggcggcagcgcaaaagatg

SEQ ID NO: 176135 - DNA, 103 bp, Artificial Sequence
  Synthetic Polynucleotide
taatacgactcactatagggctggtgatggtggtggtggtggtggtggtgaacagaggagacaccacatgcaccaccacaacctggcggcagcgcaaaagatg

SEQ ID NO: 176136 - DNA, 103 bp, Artificial Sequence
  Synthetic Polynucleotide
taatacgactcactataggggatgctgctgctggtgatggtggtggtggtaacagaggagaaccaccatgaccatcaccaacctggcggcagcgcaaaagatg

SEQ ID NO: 176137 - DNA, 103 bp, Artificial Sequence
  Synthetic Polynucleotide
taatacgactcactataggggatggctgctgatgctgctgctggtgatggaacagaggagaccatcaatggcagcagcaaacctggcggcagcgcaaaagatg

SEQ ID NO: 176138 - DNA, 103 bp, Artificial Sequence
  Synthetic Polynucleotide
taatacgactcactatagggtggaggaatggatggctgctgatgctgctgaacagaggagacagcagatgcagcagccaaacctggcggcagcgcaaaagatg

SEQ ID NO: 176139 - DNA, 103 bp, Artificial Sequence
  Synthetic Polynucleotide
taatacgactcactatagggggctggaggctggaggaatggatggctgctaacagaggagaagcagcatgccattcctcaacctggcggcagcgcaaaagatg

SEQ ID NO: 176140 - DNA, 103 bp, Artificial Sequence
  Synthetic Polynucleotide
taatacgactcactatagggtcgtcctccgggctggaggctggaggaatgaacagaggagacattccatgagcctccagaacctggcggcagcgcaaaagatg

SEQ ID NO: 176141 - DNA, 103 bp, Artificial Sequence
  Synthetic Polynucleotide
taatacgactcactataggggctatattgggcttggacgcagggcatatcaacagaggagagatatgatgtgcgtccaaaacctggcggcagcgcaaaagatg

SEQ ID NO: 176142 - DNA, 103 bp, Artificial Sequence
  Synthetic Polynucleotide
taatacgactcactataggggggcagcacctcgtcctccgggctggaggcaacagaggagagcctccatgccggaggacaacctggcggcagcgcaaaagatg

SEQ ID NO: 176143 - DNA, 103 bp, Artificial Sequence
  Synthetic Polynucleotide
taatacgactcactatagggtggaggtgctgggcagcacctcgtcctccgaacagaggagacggaggatgaggtgctgcaacctggcggcagcgcaaaagatg

SEQ ID NO: 176144 - DNA, 103 bp, Artificial Sequence
  Synthetic Polynucleotide
taatacgactcactatagggttgaagtacatggaggtgctgggcagcaccaacagaggagaggtgctatgcagcacctcaacctggcggcagcgcaaaagatg

SEQ ID NO: 176145 - DNA, 103 bp, Artificial Sequence
  Synthetic Polynucleotide
taatacgactcactatagggtggggactgcttgaagtacatggaggtgctaacagaggagaagcaccatgatgtacttcaacctggcggcagcgcaaaagatg

SEQ ID NO: 176146 - DNA, 103 bp, Artificial Sequence
  Synthetic Polynucleotide
taatacgactcactataggggggtggacggtggggactgcttgaagtacaaacagaggagatgtactatgagcagtcccaacctggcggcagcgcaaaagatg

SEQ ID NO: 176147 - DNA, 103 bp, Artificial Sequence
  Synthetic Polynucleotide
taatacgactcactatagggggcgtggtgggggtggacggtggggactgcaacagaggagagcagtcatgaccgtccacaacctggcggcagcgcaaaagatg

SEQ ID NO: 176148 - DNA, 103 bp, Artificial Sequence
  Synthetic Polynucleotide
taatacgactcactatagggggggaaggccggcgtggtgggggtggacggaacagaggagaccgtccatgcccaccacgaacctggcggcagcgcaaaagatg

SEQ ID NO: 176149 - DNA, 103 bp, Artificial Sequence
  Synthetic Polynucleotide
taatacgactcactatagggccgcctgcggggggaaggccggcgtggtggaacagaggagaccaccaatgcggccttccaacctggcggcagcgcaaaagatg

SEQ ID NO: 176150 - DNA, 103 bp, Artificial Sequence
  Synthetic Polynucleotide
taatacgactcactatagggcataacgcccccgcctgcggggggaaggccaacagaggagaggccttatgcccgcaggcaacctggcggcagcgcaaaagatg

SEQ ID NO: 176151 - DNA, 103 bp, Artificial Sequence
  Synthetic Polynucleotide
taatacgactcactatagggtgcctcgtcccataacgcccccgcctgcggaacagaggagaccgcagatgggggcgttaaacctggcggcagcgcaaaagatg

SEQ ID NO: 176152 - DNA, 103 bp, Artificial Sequence
  Synthetic Polynucleotide
taatacgactcactataggggaggggaagggctatattgggcttggacgcaacagaggagagcgtccatgcccaatataaacctggcggcagcgcaaaagatg

SEQ ID NO: 176153 - DNA, 103 bp, Artificial Sequence
  Synthetic Polynucleotide
taatacgactcactatagggccgagggcagtgcctcgtcccataacgcccaacagaggagagggcgtatggggacgaggaacctggcggcagcgcaaaagatg

SEQ ID NO: 176154 - DNA, 103 bp, Artificial Sequence
  Synthetic Polynucleotide
taatacgactcactatagggcagccgggcgccgagggcagtgcctcgtccaacagaggagaggacgaatgactgccctcaacctggcggcagcgcaaaagatg

SEQ ID NO: 176155 - DNA, 103 bp, Artificial Sequence
  Synthetic Polynucleotide
taatacgactcactataggggggtgcgatgcagccgggcgccgagggcagaacagaggagactgcccatggcgcccggcaacctggcggcagcgcaaaagatg

SEQ ID NO: 176156 - DNA, 103 bp, Artificial Sequence
  Synthetic Polynucleotide
taatacgactcactataggggcagcgggccgggtgcgatgcagccgggcgaacagaggagacgcccgatggcatcgcacaacctggcggcagcgcaaaagatg

SEQ ID NO: 176157 - DNA, 103 bp, Artificial Sequence
  Synthetic Polynucleotide
taatacgactcactatagggggcgggtccagcagcgggccgggtgcgatgaacagaggagacatcgcatgcggcccgctaacctggcggcagcgcaaaagatg

SEQ ID NO: 176158 - DNA, 103 bp, Artificial Sequence
  Synthetic Polynucleotide
taatacgactcactatagggcgccttcatcggcgggtccagcagcgggccaacagaggagaggcccgatgctggacccgaacctggcggcagcgcaaaagatg

SEQ ID NO: 176159 - DNA, 103 bp, Artificial Sequence
  Synthetic Polynucleotide
taatacgactcactatagggccgtggggaccgccttcatcggcgggtccaaacagaggagatggaccatgcgatgaaggaacctggcggcagcgcaaaagatg

SEQ ID NO: 176160 - DNA, 103 bp, Artificial Sequence
  Synthetic Polynucleotide
taatacgactcactataggggcgccggccaccgtggggaccgccttcatcaacagaggagagatgaaatgggtccccacaacctggcggcagcgcaaaagatg

SEQ ID NO: 176161 - DNA, 103 bp, Artificial Sequence
  Synthetic Polynucleotide
taatacgactcactatagggcgggaagcgcgcgccggccaccgtggggacaacagaggagagtccccatggtggccggcaacctggcggcagcgcaaaagatg

SEQ ID NO: 176162 - DNA, 103 bp, Artificial Sequence
  Synthetic Polynucleotide
taatacgactcactatagggagtggaagagcgggaagcgcgcgccggccaaacagaggagatggccgatgcgcgcttccaacctggcggcagcgcaaaagatg

SEQ ID NO: 176163 - DNA, 103 bp, Artificial Sequence
  Synthetic Polynucleotide
taatacgactcactatagggctggaacctggaggggaagggctatattggaacagaggagaccaataatgcccttccccaacctggcggcagcgcaaaagatg

SEQ ID NO: 176164 - DNA, 103 bp, Artificial Sequence
  Synthetic Polynucleotide
taatacgactcactataggggagggcttgaagtggaagagcgggaagcgcaacagaggagagcgcttatggctcttccaaacctggcggcagcgcaaaagatg

SEQ ID NO: 176165 - DNA, 103 bp, Artificial Sequence
  Synthetic Polynucleotide
taatacgactcactatagggatgcggcggcgagggcttgaagtggaagagaacagaggagactcttcatgttcaagcccaacctggcggcagcgcaaaagatg

SEQ ID NO: 176166 - DNA, 103 bp, Artificial Sequence
  Synthetic Polynucleotide
taatacgactcactataggggcgcggggggatgcggcggcgagggcttgaaacagaggagatcaagcatgcgccgccgcaacctggcggcagcgcaaaagatg

SEQ ID NO: 176167 - DNA, 103 bp, Artificial Sequence
  Synthetic Polynucleotide
taatacgactcactataggggccgggctgggcgcggggggatgcggcggcaacagaggagagccgccatgtccccccgcaacctggcggcagcgcaaaagatg

SEQ ID NO: 176168 - DNA, 103 bp, Artificial Sequence
  Synthetic Polynucleotide
taatacgactcactataggggtggccgccggccgggctgggcgcggggggaacagaggagaccccccatgcccagcccgaacctggcggcagcgcaaaagatg

SEQ ID NO: 176169 - DNA, 103 bp, Artificial Sequence
  Synthetic Polynucleotide
taatacgactcactatagggagccgaggtggtggccgccggccgggctggaacagaggagaccagccatgccggcggccaacctggcggcagcgcaaaagatg

SEQ ID NO: 176170 - DNA, 103 bp, Artificial Sequence
  Synthetic Polynucleotide
taatacgactcactataggggtcgggtcgtagccgaggtggtggccgccgaacagaggagacggcggatgccacctcggaacctggcggcagcgcaaaagatg

SEQ ID NO: 176171 - DNA, 103 bp, Artificial Sequence
  Synthetic Polynucleotide
taatacgactcactatagggggcagcggccgtcgggtcgtagccgaggtgaacagaggagacacctcatgtacgacccgaacctggcggcagcgcaaaagatg

SEQ ID NO: 176172 - DNA, 103 bp, Artificial Sequence
  Synthetic Polynucleotide
taatacgactcactatagggggctgagcgcggcagcggccgtcgggtcgtaacagaggagaacgaccatgcggccgctgaacctggcggcagcgcaaaagatg

SEQ ID NO: 176173 - DNA, 103 bp, Artificial Sequence
  Synthetic Polynucleotide
taatacgactcactatagggcccagcggcaggctgagcgcggcagcggccaacagaggagaggccgcatgcgcgctcagaacctggcggcagcgcaaaagatg

SEQ ID NO: 176174 - DNA, 103 bp, Artificial Sequence
  Synthetic Polynucleotide
taatacgactcactatagggcgccgcataactggaacctggaggggaaggaacagaggagaccttccatgccaggttccaacctggcggcagcgcaaaagatg

SEQ ID NO: 176175 - DNA, 103 bp, Artificial Sequence
  Synthetic Polynucleotide
taatacgactcactatagggggctgcggctcccagcggcaggctgagcgcaacagaggagagcgctcatgctgccgctgaacctggcggcagcgcaaaagatg

SEQ ID NO: 176176 - DNA, 103 bp, Artificial Sequence
  Synthetic Polynucleotide
taatacgactcactatagggtgcccgcggcggctgcggctcccagcggcaaacagaggagatgccgcatggagccgcagaacctggcggcagcgcaaaagatg

SEQ ID NO: 176177 - DNA, 103 bp, Artificial Sequence
  Synthetic Polynucleotide
taatacgactcactataggggcggcctggctgcccgcggcggctgcggctaacagaggagaagccgcatgcgccgcgggaacctggcggcagcgcaaaagatg

SEQ ID NO: 176178 - DNA, 103 bp, Artificial Sequence
  Synthetic Polynucleotide
taatacgactcactatagggctcaagcgcggcggcctggctgcccgcggcaacagaggagagccgcgatgagccaggccaacctggcggcagcgcaaaagatg

SEQ ID NO: 176179 - DNA, 103 bp, Artificial Sequence
  Synthetic Polynucleotide
taatacgactcactatagggacgggtggctctcaagcgcggcggcctggcaacagaggagagccaggatgccgcgcttgaacctggcggcagcgcaaaagatg

SEQ ID NO: 176180 - DNA, 103 bp, Artificial Sequence
  Synthetic Polynucleotide
taatacgactcactatagggggcagcccgtacgggtggctctcaagcgcgaacagaggagacgcgctatggagccacccaacctggcggcagcgcaaaagatg

SEQ ID NO: 176181 - DNA, 103 bp, Artificial Sequence
  Synthetic Polynucleotide
taatacgactcactatagggcttggccagcggcagcccgtacgggtggctaacagaggagaagccacatgtacgggctgaacctggcggcagcgcaaaagatg

SEQ ID NO: 176182 - DNA, 103 bp, Artificial Sequence
  Synthetic Polynucleotide
taatacgactcactataggggggccgccctcttggccagcggcagcccgtaacagaggagaacgggcatgcgctggccaaacctggcggcagcgcaaaagatg

SEQ ID NO: 176183 - DNA, 103 bp, Artificial Sequence
  Synthetic Polynucleotide
taatacgactcactatagggaaggccagcggggccgccctcttggccagcaacagaggagagctggcatggagggcggcaacctggcggcagcgcaaaagatg

SEQ ID NO: 176184 - DNA, 103 bp, Artificial Sequence
  Synthetic Polynucleotide
taatacgactcactataggggagaggcgggaaggccagcggggccgccctaacagaggagaagggcgatgccgctggccaacctggcggcagcgcaaaagatg

SEQ ID NO: 176185 - DNA, 103 bp, Artificial Sequence
  Synthetic Polynucleotide
taatacgactcactatagggtgtatgtctgcgccgcataactggaacctgaacagaggagacaggttatggttatgcggaacctggcggcagcgcaaaagatg

SEQ ID NO: 176186 - DNA, 103 bp, Artificial Sequence
  Synthetic Polynucleotide
taatacgactcactataggggcgtgaggccgagaggcgggaaggccagcgaacagaggagacgctggatgtcccgcctcaacctggcggcagcgcaaaagatg

SEQ ID NO: 176187 - DNA, 103 bp, Artificial Sequence
  Synthetic Polynucleotide
taatacgactcactataggggtaggggagggcgtgaggccgagaggcgggaacagaggagacccgccatgcggcctcacaacctggcggcagcgcaaaagatg

SEQ ID NO: 176188 - DNA, 103 bp, Artificial Sequence
  Synthetic Polynucleotide
taatacgactcactataggggctggacgcggtaggggagggcgtgaggccaacagaggagaggcctcatgccctcccctaacctggcggcagcgcaaaagatg

SEQ ID NO: 176189 - DNA, 103 bp, Artificial Sequence
  Synthetic Polynucleotide
taatacgactcactatagggcgcccagcaggctggacgcggtaggggaggaacagaggagacctcccatgccgcgtccaaacctggcggcagcgcaaaagatg

SEQ ID NO: 176190 - DNA, 103 bp, Artificial Sequence
  Synthetic Polynucleotide
taatacgactcactatagggctgggactctcgcccagcaggctggacgcgaacagaggagacgcgtcatgcctgctgggaacctggcggcagcgcaaaagatg

SEQ ID NO: 176191 - DNA, 103 bp, Artificial Sequence
  Synthetic Polynucleotide
taatacgactcactatagggcgacggcaggctgggactctcgcccagcagaacagaggagactgctgatggagagtcccaacctggcggcagcgcaaaagatg

SEQ ID NO: 176192 - DNA, 103 bp, Artificial Sequence
  Synthetic Polynucleotide
taatacgactcactatagggtgctgggcggcgacggcaggctgggactctaacagaggagaagagtcatggcctgccgtaacctggcggcagcgcaaaagatg

SEQ ID NO: 176193 - DNA, 103 bp, Artificial Sequence
  Synthetic Polynucleotide
taatacgactcactataggggacgagctcctgctgggcggcgacggcaggaacagaggagacctgccatggccgcccagaacctggcggcagcgcaaaagatg

SEQ ID NO: 176194 - DNA, 103 bp, Artificial Sequence
  Synthetic Polynucleotide
taatacgactcactatagggctcgccagacgacgagctcctgctgggcggaacagaggagaccgcccatgaggagctcgaacctggcggcagcgcaaaagatg

SEQ ID NO: 176195 - DNA, 103 bp, Artificial Sequence
  Synthetic Polynucleotide
taatacgactcactatagggcacacgtgccctcgccagacgacgagctccaacagaggagaggagctatgcgtctggcgaacctggcggcagcgcaaaagatg

SEQ ID NO: 176196 - DNA, 103 bp, Artificial Sequence
  Synthetic Polynucleotide
taatacgactcactatagggtattccgagctgtatgtctgcgccgcataaaacagaggagattatgcatggcagacataaacctggcggcagcgcaaaagatg

SEQ ID NO: 176197 - DNA, 103 bp, Artificial Sequence
  Synthetic Polynucleotide
taatacgactcactatagggccgcacacggcacacgtgccctcgccagacaacagaggagagtctggatggggcacgtgaacctggcggcagcgcaaaagatg

SEQ ID NO: 176198 - DNA, 103 bp, Artificial Sequence
  Synthetic Polynucleotide
taatacgactcactatagggggcgttgtccccgcacacggcacacgtgccaacagaggagaggcacgatggccgtgtgcaacctggcggcagcgcaaaagatg

SEQ ID NO: 176199 - DNA, 103 bp, Artificial Sequence
  Synthetic Polynucleotide
taatacgactcactataggggctggcaggcggcgttgtccccgcacacggaacagaggagaccgtgtatggggacaacgaacctggcggcagcgcaaaagatg

SEQ ID NO: 176200 - DNA, 103 bp, Artificial Sequence
  Synthetic Polynucleotide
taatacgactcactatagggacgccgtagtgctggcaggcggcgttgtccaacagaggagaggacaaatgcgcctgccaaacctggcggcagcgcaaaagatg

SEQ ID NO: 176201 - DNA, 103 bp, Artificial Sequence
  Synthetic Polynucleotide
taatacgactcactataggggcaggttcgcacgccgtagtgctggcaggcaacagaggagagcctgcatgcactacggcaacctggcggcagcgcaaaagatg

SEQ ID NO: 176202 - DNA, 103 bp, Artificial Sequence
  Synthetic Polynucleotide
taatacgactcactatagggtgcagccctcgcaggttcgcacgccgtagtaacagaggagaactacgatgtgcgaacctaacctggcggcagcgcaaaagatg

SEQ ID NO: 176203 - DNA, 103 bp, Artificial Sequence
  Synthetic Polynucleotide
taatacgactcactatagggaaaaagcccttgcagccctcgcaggttcgcaacagaggagagcgaacatgcgagggctgaacctggcggcagcgcaaaagatg

SEQ ID NO: 176204 - DNA, 103 bp, Artificial Sequence
  Synthetic Polynucleotide
taatacgactcactatagggtgttctcttgaaaaagcccttgcagccctcaacagaggagagagggcatgaagggctttaacctggcggcagcgcaaaagatg

SEQ ID NO: 176205 - DNA, 103 bp, Artificial Sequence
  Synthetic Polynucleotide
taatacgactcactatagggttttctgcactgttctcttgaaaaagccctaacagaggagaagggctatgtcaagagaaaacctggcggcagcgcaaaagatg

SEQ ID NO: 176206 - DNA, 103 bp, Artificial Sequence
  Synthetic Polynucleotide
taatacgactcactatagggtattttgcatttttctgcactgttctcttgaacagaggagacaagagatgagtgcagaaaacctggcggcagcgcaaaagatg

SEQ ID NO: 176207 - DNA, 103 bp, Artificial Sequence
  Synthetic Polynucleotide
taatacgactcactataggggtccaggtcctcgtcgtacgaatagtccataacagaggagaatggacatgtcgtacgacaacctggcggcagcgcaaaagatg

SEQ ID NO: 176208 - DNA, 103 bp, Artificial Sequence
  Synthetic Polynucleotide
taatacgactcactatagggcgtgcgcttgaagaagcccttgcagctctcaacagaggagagagagcatgaagggcttcaacctggcggcagcgcaaaagatg

SEQ ID NO: 176209 - DNA, 103 bp, Artificial Sequence
  Synthetic Polynucleotide
taatacgactcactatagggcgcctgggtggccactgtggtcagctccacaacagaggagagtggagatgaccacagtgaacctggcggcagcgcaaaagatg

SEQ ID NO: 176210 - DNA, 103 bp, Artificial Sequence
  Synthetic Polynucleotide
taatacgactcactataggggcagcgagcccgcctgggtggccactgtggaacagaggagaccacagatgccacccaggaacctggcggcagcgcaaaagatg

SEQ ID NO: 176211 - DNA, 103 bp, Artificial Sequence
  Synthetic Polynucleotide
taatacgactcactatagggaggctgtgcagcagcgagcccgcctgggtgaacagaggagacacccaatggggctcgctaacctggcggcagcgcaaaagatg

SEQ ID NO: 176212 - DNA, 103 bp, Artificial Sequence
  Synthetic Polynucleotide
taatacgactcactatagggccgcaacaccaggctgtgcagcagcgagccaacagaggagaggctcgatgctgcacagcaacctggcggcagcgcaaaagatg

SEQ ID NO: 176213 - DNA, 103 bp, Artificial Sequence
  Synthetic Polynucleotide
taatacgactcactataggggctcctgcgcccgcaacaccaggctgtgcaaacagaggagatgcacaatgtggtgttgcaacctggcggcagcgcaaaagatg

SEQ ID NO: 176214 - DNA, 103 bp, Artificial Sequence
  Synthetic Polynucleotide
taatacgactcactatagggtgcagcaccagctcctgcgcccgcaacaccaacagaggagaggtgttatgggcgcaggaaacctggcggcagcgcaaaagatg

SEQ ID NO: 176215 - DNA, 103 bp, Artificial Sequence
  Synthetic Polynucleotide
taatacgactcactatagggcgcaagcagctgcagcaccagctcctgcgcaacagaggagagcgcagatgctggtgctgaacctggcggcagcgcaaaagatg

SEQ ID NO: 176216 - DNA, 103 bp, Artificial Sequence
  Synthetic Polynucleotide
taatacgactcactatagggccagctgcagcgcaagcagctgcagcaccaaacagaggagatggtgcatgagctgcttgaacctggcggcagcgcaaaagatg

SEQ ID NO: 176217 - DNA, 103 bp, Artificial Sequence
  Synthetic Polynucleotide
taatacgactcactatagggtcctgccggtccagctgcagcgcaagcagcaacagaggagagctgctatggctgcagctaacctggcggcagcgcaaaagatg

SEQ ID NO: 176218 - DNA, 103 bp, Artificial Sequence
  Synthetic Polynucleotide
taatacgactcactataggggcagacaaactcctgccggtccagctgcagaacagaggagactgcagatggaccggcagaacctggcggcagcgcaaaagatg

SEQ ID NO: 176219 - DNA, 103 bp, Artificial Sequence
  Synthetic Polynucleotide
taatacgactcactatagggtgttctgcaccgtgcgcttgaagaagccctaacagaggagaagggctatgtcaagcgcaaacctggcggcagcgcaaaagatg

SEQ ID NO: 176220 - DNA, 103 bp, Artificial Sequence
  Synthetic Polynucleotide
taatacgactcactatagggtgaacttgaggcagacaaactcctgccggtaacagaggagaaccggcatgagtttgtctaacctggcggcagcgcaaaagatg

SEQ ID NO: 176221 - DNA, 103 bp, Artificial Sequence
  Synthetic Polynucleotide
taatacgactcactatagggaagaggatgatgaacttgaggcagacaaacaacagaggagagtttgtatgcctcaagttaacctggcggcagcgcaaaagatg

SEQ ID NO: 176222 - DNA, 103 bp, Artificial Sequence
  Synthetic Polynucleotide
taatacgactcactatagggatccaggctgaagaggatgatgaacttgagaacagaggagactcaagatgatcatcctcaacctggcggcagcgcaaaagatg

SEQ ID NO: 176223 - DNA, 103 bp, Artificial Sequence
  Synthetic Polynucleotide
taatacgactcactatagggggaacttcaaatccaggctgaagaggatgaaacagaggagatcatccatgtcagcctggaacctggcggcagcgcaaaagatg

SEQ ID NO: 176224 - DNA, 103 bp, Artificial Sequence
  Synthetic Polynucleotide
taatacgactcactatagggtggttattcaggaacttcaaatccaggctgaacagaggagacagcctatgtttgaagttaacctggcggcagcgcaaaagatg

SEQ ID NO: 176225 - DNA, 103 bp, Artificial Sequence
  Synthetic Polynucleotide
taatacgactcactatagggcaccaggatgtggttattcaggaacttcaaaacagaggagattgaagatgctgaataacaacctggcggcagcgcaaaagatg

SEQ ID NO: 176226 - DNA, 103 bp, Artificial Sequence
  Synthetic Polynucleotide
taatacgactcactataggggagcgtctttcaccaggatgtggttattcaaacagaggagatgaataatgacatcctggaacctggcggcagcgcaaaagatg

SEQ ID NO: 176227 - DNA, 103 bp, Artificial Sequence
  Synthetic Polynucleotide
taatacgactcactataggggccttctcctgagcgtctttcaccaggatgaacagaggagacatcctatggaaagacgcaacctggcggcagcgcaaaagatg

SEQ ID NO: 176228 - DNA, 103 bp, Artificial Sequence
  Synthetic Polynucleotide
taatacgactcactatagggggcggcgttggccttctcctgagcgtctttaacagaggagaaaagacatgcaggagaagaacctggcggcagcgcaaaagatg

SEQ ID NO: 176229 - DNA, 103 bp, Artificial Sequence
  Synthetic Polynucleotide
taatacgactcactatagggagtcaagcagggcggcgttggccttctcctaacagaggagaaggagaatgccaacgccgaacctggcggcagcgcaaaagatg

SEQ ID NO: 176230 - DNA, 103 bp, Artificial Sequence
  Synthetic Polynucleotide
taatacgactcactatagggtagtgcttgttgttctgcaccgtgcgcttgaacagaggagacaagcgatgggtgcagaaaacctggcggcagcgcaaaagatg

SEQ ID NO: 176231 - DNA, 103 bp, Artificial Sequence
  Synthetic Polynucleotide
taatacgactcactatagggcacagggtgtagtcaagcagggcggcgttgaacagaggagacaacgcatgcctgcttgaaacctggcggcagcgcaaaagatg

SEQ ID NO: 176232 - DNA, 103 bp, Artificial Sequence
  Synthetic Polynucleotide
taatacgactcactatagggcgggtagtggcacagggtgtagtcaagcagaacagaggagactgcttatgtacaccctgaacctggcggcagcgcaaaagatg

SEQ ID NO: 176233 - DNA, 103 bp, Artificial Sequence
  Synthetic Polynucleotide
taatacgactcactatagggccccgcagtgcgggtagtggcacagggtgtaacagaggagaacacccatggccactaccaacctggcggcagcgcaaaagatg

SEQ ID NO: 176234 - DNA, 103 bp, Artificial Sequence
  Synthetic Polynucleotide
taatacgactcactatagggtggaatttgtccccgcagtgcgggtagtggaacagaggagaccactaatggcactgcggaacctggcggcagcgcaaaagatg

SEQ ID NO: 176235 - DNA, 103 bp, Artificial Sequence
  Synthetic Polynucleotide
taatacgactcactatagggcagcagctgctggaatttgtccccgcagtgaacagaggagacactgcatggacaaattcaacctggcggcagcgcaaaagatg

SEQ ID NO: 176236 - DNA, 103 bp, Artificial Sequence
  Synthetic Polynucleotide
taatacgactcactatagggccaggcacagcagcagctgctggaatttgtaacagaggagaacaaatatgagcagctgcaacctggcggcagcgcaaaagatg

SEQ ID NO: 176237 - DNA, 103 bp, Artificial Sequence
  Synthetic Polynucleotide
taatacgactcactatagggcgcacctccaccaggcacagcagcagctgcaacagaggagagcagctatggctgtgcctaacctggcggcagcgcaaaagatg

SEQ ID NO: 176238 - DNA, 103 bp, Artificial Sequence
  Synthetic Polynucleotide
taatacgactcactataggggctcagggcccgcacctccaccaggcacagaacagaggagactgtgcatggtggaggtgaacctggcggcagcgcaaaagatg

SEQ ID NO: 176239 - DNA, 103 bp, Artificial Sequence
  Synthetic Polynucleotide
taatacgactcactatagggtggcctgcatgctcagggcccgcacctccaaacagaggagatggaggatggggccctgaaacctggcggcagcgcaaaagatg

SEQ ID NO: 176240 - DNA, 103 bp, Artificial Sequence
  Synthetic Polynucleotide
taatacgactcactatagggaggtactccttggcctgcatgctcagggccaacagaggagaggccctatgcatgcaggcaacctggcggcagcgcaaaagatg

SEQ ID NO: 176241 - DNA, 103 bp, Artificial Sequence
  Synthetic Polynucleotide
taatacgactcactatagggggtgcacgtgtagtgcttgttgttctgcacaacagaggagagtgcagatgaacaagcacaacctggcggcagcgcaaaagatg

SEQ ID NO: 176242 - DNA, 103 bp, Artificial Sequence
  Synthetic Polynucleotide
taatacgactcactatagggcttgtggtacaggtactccttggcctgcataacagaggagaatgcagatgaaggagtacaacctggcggcagcgcaaaagatg

SEQ ID NO: 176243 - DNA, 103 bp, Artificial Sequence
  Synthetic Polynucleotide
taatacgactcactatagggtgcccaggtgcttgtggtacaggtactcctaacagaggagaaggagtatgtgtaccacaaacctggcggcagcgcaaaagatg

SEQ ID NO: 176244 - DNA, 103 bp, Artificial Sequence
  Synthetic Polynucleotide
taatacgactcactatagggggcatctcgttgcccaggtgcttgtggtacaacagaggagagtaccaatggcacctgggaacctggcggcagcgcaaaagatg

SEQ ID NO: 176245 - DNA, 103 bp, Artificial Sequence
  Synthetic Polynucleotide
taatacgactcactataggggttgttgcggggcatctcgttgcccaggtgaacagaggagacacctgatgaacgagatgaacctggcggcagcgcaaaagatg

SEQ ID NO: 176246 - DNA, 103 bp, Artificial Sequence
  Synthetic Polynucleotide
taatacgactcactatagggcgatgagcaggttgttgcggggcatctcgtaacagaggagaacgagaatgcccgcaacaaacctggcggcagcgcaaaagatg

SEQ ID NO: 176247 - DNA, 103 bp, Artificial Sequence
  Synthetic Polynucleotide
taatacgactcactatagggtgcagcatttcgatgagcaggttgttgcggaacagaggagaccgcaaatgcctgctcataacctggcggcagcgcaaaagatg

SEQ ID NO: 176248 - DNA, 103 bp, Artificial Sequence
  Synthetic Polynucleotide
taatacgactcactatagggctgcttggcttgcagcatttcgatgagcagaacagaggagactgctcatggaaatgctgaacctggcggcagcgcaaaagatg

SEQ ID NO: 176249 - DNA, 103 bp, Artificial Sequence
  Synthetic Polynucleotide
taatacgactcactatagggtctggctctcggtgcacgtgtagtgcttgtaacagaggagaacaagcatgacacgtgcaaacctggcggcagcgcaaaagatg

SEQ ID NO: 176250 - DNA, 103 bp, Artificial Sequence
  Synthetic Polynucleotide
taatacgactcactatagggatcttgcagctctggctctcggtgcacgtgaacagaggagacacgtgatgcgagagccaaacctggcggcagcgcaaaagatg

SEQ ID NO: 176251 - DNA, 103 bp, Artificial Sequence
  Synthetic Polynucleotide
taatacgactcactatagggcgtcttgtcgatcttgcagctctggctctcaacagaggagagagagcatgagctgcaagaacctggcggcagcgcaaaagatg

SEQ ID NO: 176252 - DNA, 103 bp, Artificial Sequence
  Synthetic Polynucleotide
taatacgactcactataggggcttgcgctgcgtcttgtcgatcttgcagcaacagaggagagctgcaatgtcgacaagaaacctggcggcagcgcaaaagatg

SEQ ID NO: 176253 - DNA, 103 bp, Artificial Sequence
  Synthetic Polynucleotide
taatacgactcactatagggaagggacagcgcttgcgctgcgtcttgtcgaacagaggagacgacaaatggcagcgcaaaacctggcggcagcgcaaaagatg

SEQ ID NO: 176254 - DNA, 103 bp, Artificial Sequence
  Synthetic Polynucleotide
taatacgactcactataggggaagcggcagaagggacagcgcttgcgctgaacagaggagacagcgcatgcgctgtcccaacctggcggcagcgcaaaagatg

SEQ ID NO: 176255 - DNA, 103 bp, Artificial Sequence
  Synthetic Polynucleotide
taatacgactcactatagggggcacagctcgtccaggtcctcgtcgtacgaacagaggagacgtacgatgaggacctggaacctggcggcagcgcaaaagatg

SEQ ID NO: 176256 - DNA, 103 bp, Artificial Sequence
  Synthetic Polynucleotide
taatacgactcactatagggggcatttctggaagcggcagaagggacagcaacagaggagagctgtcatgtctgccgctaacctggcggcagcgcaaaagatg

SEQ ID NO: 176257 - DNA, 103 bp, Artificial Sequence
  Synthetic Polynucleotide
taatacgactcactatagggcccaccgtcaggcatttctggaagcggcagaacagaggagactgccgatgccagaaatgaacctggcggcagcgcaaaagatg

SEQ ID NO: 176258 - DNA, 103 bp, Artificial Sequence
  Synthetic Polynucleotide
taatacgactcactatagggcaggcgcatccccaccgtcaggcatttctgaacagaggagacagaaaatgctgacggtgaacctggcggcagcgcaaaagatg

SEQ ID NO: 176259 - DNA, 103 bp, Artificial Sequence
  Synthetic Polynucleotide
taatacgactcactataggggcacggcttccaggcgcatccccaccgtcaaacagaggagatgacggatgggatgcgccaacctggcggcagcgcaaaagatg

SEQ ID NO: 176260 - DNA, 103 bp, Artificial Sequence
  Synthetic Polynucleotide
taatacgactcactatagggcggtcagcgcgcacggcttccaggcgcatcaacagaggagagatgcgatgggaagccgtaacctggcggcagcgcaaaagatg

SEQ ID NO: 176261 - DNA, 103 bp, Artificial Sequence
  Synthetic Polynucleotide
taatacgactcactatagggacccctcatacggtcagcgcgcacggcttcaacagaggagagaagccatgcgcgctgacaacctggcggcagcgcaaaagatg

SEQ ID NO: 176262 - DNA, 103 bp, Artificial Sequence
  Synthetic Polynucleotide
taatacgactcactatagggtgttccggccacccctcatacggtcagcgcaacagaggagagcgctgatggtatgagggaacctggcggcagcgcaaaagatg

SEQ ID NO: 176263 - DNA, 103 bp, Artificial Sequence
  Synthetic Polynucleotide
taatacgactcactatagggggcccaaacttgttccggccacccctcataaacagaggagatatgagatgtggccggaaaacctggcggcagcgcaaaagatg

SEQ ID NO: 176264 - DNA, 103 bp, Artificial Sequence
  Synthetic Polynucleotide
taatacgactcactatagggcttgtacatcggcccaaacttgttccggccaacagaggagaggccggatgaagtttgggaacctggcggcagcgcaaaagatg

SEQ ID NO: 176265 - DNA, 103 bp, Artificial Sequence
  Synthetic Polynucleotide
taatacgactcactatagggcccggtcccgcttgtacatcggcccaaactaacagaggagaagtttgatgcgatgtacaaacctggcggcagcgcaaaagatg

SEQ ID NO: 176266 - DNA, 103 bp, Artificial Sequence
  Synthetic Polynucleotide
taatacgactcactatagggccgcacacggggcacagctcgtccaggtccaacagaggagaggacctatgcgagctgtgaacctggcggcagcgcaaaagatg

SEQ ID NO: 176267 - DNA, 103 bp, Artificial Sequence
  Synthetic Polynucleotide
taatacgactcactatagggtgtttcagggcccggtcccgcttgtacatcaacagaggagagatgtaatggcgggaccgaacctggcggcagcgcaaaagatg

SEQ ID NO: 176268 - DNA, 103 bp, Artificial Sequence
  Synthetic Polynucleotide
taatacgactcactatagggcttcttctgctgtttcagggcccggtcccgaacagaggagacgggacatggccctgaaaaacctggcggcagcgcaaaagatg

SEQ ID NO: 176269 - DNA, 103 bp, Artificial Sequence
  Synthetic Polynucleotide
taatacgactcactataggggaatctgtgccttcttctgctgtttcagggaacagaggagaccctgaatgagcagaagaaacctggcggcagcgcaaaagatg

SEQ ID NO: 176270 - DNA, 103 bp, Artificial Sequence
  Synthetic Polynucleotide
taatacgactcactatagggccattggcccgaatctgtgccttcttctgcaacagaggagagcagaaatgggcacagataacctggcggcagcgcaaaagatg

SEQ ID NO: 176271 - DNA, 103 bp, Artificial Sequence
  Synthetic Polynucleotide
taatacgactcactatagggcagcttgaagccattggcccgaatctgtgcaacagaggagagcacagatgcgggccaataacctggcggcagcgcaaaagatg

SEQ ID NO: 176272 - DNA, 103 bp, Artificial Sequence
  Synthetic Polynucleotide
taatacgactcactataggggccctgtctccagcttgaagccattggcccaacagaggagagggccaatggcttcaagcaacctggcggcagcgcaaaagatg

SEQ ID NO: 176273 - DNA, 103 bp, Artificial Sequence
  Synthetic Polynucleotide
taatacgactcactatagggcccatcgggggccctgtctccagcttgaagaacagaggagacttcaaatgggagacaggaacctggcggcagcgcaaaagatg

SEQ ID NO: 176274 - DNA, 103 bp, Artificial Sequence
  Synthetic Polynucleotide
taatacgactcactatagggcgggggcacccccatcgggggccctgtctcaacagaggagagagacaatgcccccgatgaacctggcggcagcgcaaaagatg

SEQ ID NO: 176275 - DNA, 103 bp, Artificial Sequence
  Synthetic Polynucleotide
taatacgactcactataggggagggggcggcgggggcacccccatcggggaacagaggagaccccgaatggggtgccccaacctggcggcagcgcaaaagatg

SEQ ID NO: 176276 - DNA, 103 bp, Artificial Sequence
  Synthetic Polynucleotide
taatacgactcactatagggtccggtgcgggagggggcggcgggggcaccaacagaggagaggtgccatggccgcccccaacctggcggcagcgcaaaagatg

SEQ ID NO: 176277 - DNA, 103 bp, Artificial Sequence
  Synthetic Polynucleotide
taatacgactcactatagggcaccttgtccccgcacacggggcacagctcaacagaggagagagctgatgcccgtgtgcaacctggcggcagcgcaaaagatg

SEQ ID NO: 176278 - DNA, 103 bp, Artificial Sequence
  Synthetic Polynucleotide
taatacgactcactatagggcagcacgtagtccggtgcgggagggggcggaacagaggagaccgcccatgcccgcaccgaacctggcggcagcgcaaaagatg

SEQ ID NO: 176279 - DNA, 103 bp, Artificial Sequence
  Synthetic Polynucleotide
taatacgactcactatagggggctgggaggcagcacgtagtccggtgcggaacagaggagaccgcacatgactacgtgcaacctggcggcagcgcaaaagatg

SEQ ID NO: 176280 - DNA, 103 bp, Artificial Sequence
  Synthetic Polynucleotide
taatacgactcactatagggggcccatgcaggctgggaggcagcacgtagaacagaggagactacgtatggcctcccagaacctggcggcagcgcaaaagatg

SEQ ID NO: 176281 - DNA, 103 bp, Artificial Sequence
  Synthetic Polynucleotide
taatacgactcactatagggcttgggctcaggcccatgcaggctgggaggaacagaggagacctcccatgctgcatgggaacctggcggcagcgcaaaagatg

SEQ ID NO: 176282 - DNA, 103 bp, Artificial Sequence
  Synthetic Polynucleotide
taatacgactcactatagggcggccaggcccttgggctcaggcccatgcaaacagaggagatgcatgatgctgagcccaaacctggcggcagcgcaaaagatg

SEQ ID NO: 176283 - DNA, 103 bp, Artificial Sequence
  Synthetic Polynucleotide
taatacgactcactatagggggtggaccggcggccaggcccttgggctcaaacagaggagatgagccatggggcctggcaacctggcggcagcgcaaaagatg

SEQ ID NO: 176284 - DNA, 103 bp, Artificial Sequence
  Synthetic Polynucleotide
taatacgactcactatagggtggcccagcaggtggaccggcggccaggccaacagaggagaggcctgatggccggtccaaacctggcggcagcgcaaaagatg

SEQ ID NO: 176285 - DNA, 103 bp, Artificial Sequence
  Synthetic Polynucleotide
taatacgactcactatagggagtcgcccagtggcccagcaggtggaccggaacagaggagaccggtcatgctgctgggcaacctggcggcagcgcaaaagatg

SEQ ID NO: 176286 - DNA, 103 bp, Artificial Sequence
  Synthetic Polynucleotide
taatacgactcactatagggggggccccaaagtcgcccagtggcccagcaaacagaggagatgctggatgactgggcgaaacctggcggcagcgcaaaagatg

SEQ ID NO: 176287 - DNA, 103 bp, Artificial Sequence
  Synthetic Polynucleotide
taatacgactcactataggggggcagtgctggggccccaaagtcgcccagaacagaggagactgggcatgtttggggccaacctggcggcagcgcaaaagatg

SEQ ID NO: 176288 - DNA, 103 bp, Artificial Sequence
  Synthetic Polynucleotide
taatacgactcactatagggggtagccggacaccttgtccccgcacacggaacagaggagaccgtgtatggggacaaggaacctggcggcagcgcaaaagatg

SEQ ID NO: 176289 - DNA, 103 bp, Artificial Sequence
  Synthetic Polynucleotide
taatacgactcactataggggcacggccatgggcagtgctggggccccaaaacagaggagattggggatgcagcactgcaacctggcggcagcgcaaaagatg

SEQ ID NO: 176290 - DNA, 103 bp, Artificial Sequence
  Synthetic Polynucleotide
taatacgactcactatagggtgggcaccgggcacggccatgggcagtgctaacagaggagaagcactatgcatggccgtaacctggcggcagcgcaaaagatg

SEQ ID NO: 176291 - DNA, 103 bp, Artificial Sequence
  Synthetic Polynucleotide
taatacgactcactatagggcagtggcccgtgggcaccgggcacggccataacagaggagaatggccatgcccggtgccaacctggcggcagcgcaaaagatg

SEQ ID NO: 176292 - DNA, 103 bp, Artificial Sequence
  Synthetic Polynucleotide
taatacgactcactatagggggtagccagccagtggcccgtgggcaccggaacagaggagaccggtgatgacgggccacaacctggcggcagcgcaaaagatg

SEQ ID NO: 176293 - DNA, 103 bp, Artificial Sequence
  Synthetic Polynucleotide
taatacgactcactataggggcagggtagaggtagccagccagtggcccgaacagaggagacgggccatgggctggctaaacctggcggcagcgcaaaagatg

SEQ ID NO: 176294 - DNA, 103 bp, Artificial Sequence
  Synthetic Polynucleotide
taatacgactcactataggggccaggaaaggcagggtagaggtagccagcaacagaggagagctggcatgctctaccctaacctggcggcagcgcaaaagatg

SEQ ID NO: 176295 - DNA, 103 bp, Artificial Sequence
  Synthetic Polynucleotide
taatacgactcactatagggtgatggcacggccaggaaaggcagggtagaaacagaggagatctaccatgcctttcctgaacctggcggcagcgcaaaagatg

SEQ ID NO: 176296 - DNA, 103 bp, Artificial Sequence
  Synthetic Polynucleotide
taatacgactcactatagggtactcagacttgatggcacggccaggaaagaacagaggagactttccatgccgtgccataacctggcggcagcgcaaaagatg

SEQ ID NO: 176297 - DNA, 103 bp, Artificial Sequence
  Synthetic Polynucleotide
taatacgactcactatagggaggctccgggtactcagacttgatggcacgaacagaggagacgtgccatgaagtctgagaacctggcggcagcgcaaaagatg

SEQ ID NO: 176298 - DNA, 103 bp, Artificial Sequence
  Synthetic Polynucleotide
taatacgactcactatagggggctggcataaggctccgggtactcagactaacagaggagaagtctgatgacccggagcaacctggcggcagcgcaaaagatg

SEQ ID NO: 176299 - DNA, 103 bp, Artificial Sequence
  Synthetic Polynucleotide
taatacgactcactatagggagtccgtagtggtagccggacaccttgtccaacagaggagaggacaaatggtccggctaaacctggcggcagcgcaaaagatg

SEQ ID NO: 176300 - DNA, 103 bp, Artificial Sequence
  Synthetic Polynucleotide
taatacgactcactatagggggctgtggggggctggcataaggctccgggaacagaggagacccggaatgttatgccagaacctggcggcagcgcaaaagatg

SEQ ID NO: 176301 - DNA, 103 bp, Artificial Sequence
  Synthetic Polynucleotide
taatacgactcactatagggcggcagcccaggctgtggggggctggcataaacagaggagatatgccatgcccccacagaacctggcggcagcgcaaaagatg

SEQ ID NO: 176302 - DNA, 103 bp, Artificial Sequence
  Synthetic Polynucleotide
taatacgactcactatagggggtagccgtacggcagcccaggctgtggggaacagaggagaccccacatgctgggctgcaacctggcggcagcgcaaaagatg

SEQ ID NO: 176303 - DNA, 103 bp, Artificial Sequence
  Synthetic Polynucleotide
taatacgactcactatagggaagggctctgggtagccgtacggcagcccaaacagaggagatgggctatggtacggctaaacctggcggcagcgcaaaagatg

SEQ ID NO: 176304 - DNA, 103 bp, Artificial Sequence
  Synthetic Polynucleotide
taatacgactcactatagggccctccagagaagggctctgggtagccgtaaacagaggagatacggcatgccagagcccaacctggcggcagcgcaaaagatg

SEQ ID NO: 176305 - DNA, 103 bp, Artificial Sequence
  Synthetic Polynucleotide
taatacgactcactataggggcacgttgggccctccagagaagggctctgaacagaggagacagagcatgtctctggagaacctggcggcagcgcaaaagatg

SEQ ID NO: 176306 - DNA, 103 bp, Artificial Sequence
  Synthetic Polynucleotide
taatacgactcactatagggatgagctcaggcacgttgggccctccagagaacagaggagactctggatggcccaacgtaacctggcggcagcgcaaaagatg

SEQ ID NO: 176307 - DNA, 103 bp, Artificial Sequence
  Synthetic Polynucleotide
taatacgactcactatagggcagctgcaggatgagctcaggcacgttgggaacagaggagacccaacatgcctgagctcaacctggcggcagcgcaaaagatg

SEQ ID NO: 176308 - DNA, 103 bp, Artificial Sequence
  Synthetic Polynucleotide
taatacgactcactatagggccagctgcagcagctgcaggatgagctcagaacagaggagactgagcatgtcctgcagcaacctggcggcagcgcaaaagatg

SEQ ID NO: 176309 - DNA, 103 bp, Artificial Sequence
  Synthetic Polynucleotide
taatacgactcactatagggtcatccggctccagctgcagcagctgcaggaacagaggagacctgcaatggctgcagctaacctggcggcagcgcaaaagatg

SEQ ID NO: 176310 - DNA, 103 bp, Artificial Sequence
  Synthetic Polynucleotide
taatacgactcactatagggacacgtgagcagtccgtagtggtagccggaaacagaggagatccggcatgcactacggaaacctggcggcagcgcaaaagatg

SEQ ID NO: 176311 - DNA, 103 bp, Artificial Sequence
  Synthetic Polynucleotide
taatacgactcactatagggcacctggtcctcatccggctccagctgcagaacagaggagactgcagatggagccggataacctggcggcagcgcaaaagatg

SEQ ID NO: 176312 - DNA, 103 bp, Artificial Sequence
  Synthetic Polynucleotide
taatacgactcactatagggtgcgggcccgcacctggtcctcatccggctaacagaggagaagccggatgaggaccaggaacctggcggcagcgcaaaagatg

SEQ ID NO: 176313 - DNA, 103 bp, Artificial Sequence
  Synthetic Polynucleotide
taatacgactcactatagggcagcccaagatgcgggcccgcacctggtccaacagaggagaggaccaatggcgggcccgaacctggcggcagcgcaaaagatg

SEQ ID NO: 176314 - DNA, 103 bp, Artificial Sequence
  Synthetic Polynucleotide
taatacgactcactatagggctcctgcaggcagcccaagatgcgggcccgaacagaggagacgggccatgatcttgggcaacctggcggcagcgcaaaagatg

SEQ ID NO: 176315 - DNA, 103 bp, Artificial Sequence
  Synthetic Polynucleotide
taatacgactcactatagggttttggtgggctcctgcaggcagcccaagaaacagaggagatcttggatggcctgcaggaacctggcggcagcgcaaaagatg

SEQ ID NO: 176316 - DNA, 103 bp, Artificial Sequence
  Synthetic Polynucleotide
taatacgactcactatagggtcggggcggcttttggtgggctcctgcaggaacagaggagacctgcaatggcccaccaaaacctggcggcagcgcaaaagatg

SEQ ID NO: 176317 - DNA, 103 bp, Artificial Sequence
  Synthetic Polynucleotide
taatacgactcactatagggcgccggctggtcggggcggcttttggtgggaacagaggagacccaccatgagccgccccaacctggcggcagcgcaaaagatg

SEQ ID NO: 176318 - DNA, 103 bp, Artificial Sequence
  Synthetic Polynucleotide
taatacgactcactatagggggccgaaggccgccggctggtcggggcggcaacagaggagagccgccatgaccagccggaacctggcggcagcgcaaaagatg

SEQ ID NO: 176319 - DNA, 103 bp, Artificial Sequence
  Synthetic Polynucleotide
taatacgactcactatagggctgcacaggaggccgaaggccgccggctggaacagaggagaccagccatgggccttcggaacctggcggcagcgcaaaagatg

SEQ ID NO: 176320 - DNA, 103 bp, Artificial Sequence
  Synthetic Polynucleotide
taatacgactcactataggggtcggccattctgcacaggaggccgaaggcaacagaggagagccttcatgctcctgtgcaacctggcggcagcgcaaaagatg

SEQ ID NO: 176321 - DNA, 103 bp, Artificial Sequence
  Synthetic Polynucleotide
taatacgactcactatagggtgcagctctcacacgtgagcagtccgtagtaacagaggagaactacgatgtgctcacgtaacctggcggcagcgcaaaagatg

SEQ ID NO: 176322 - DNA, 103 bp, Artificial Sequence
  Synthetic Polynucleotide
taatacgactcactatagggtgaaggtctggtcggccattctgcacaggaaacagaggagatcctgtatggaatggccgaacctggcggcagcgcaaaagatg

SEQ ID NO: 176323 - DNA, 103 bp, Artificial Sequence
  Synthetic Polynucleotide
taatacgactcactatagggacgatggagatgaaggtctggtcggccattaacagaggagaaatggcatgccagaccttaacctggcggcagcgcaaaagatg

SEQ ID NO: 176324 - DNA, 103 bp, Artificial Sequence
  Synthetic Polynucleotide
taatacgactcactatagggtgcccagtccacgatggagatgaaggtctgaacagaggagacagaccatgatctccatcaacctggcggcagcgcaaaagatg

SEQ ID NO: 176325 - DNA, 103 bp, Artificial Sequence
  Synthetic Polynucleotide
taatacgactcactatagggtgcacctgcgtgcccagtccacgatggagaaacagaggagatctccaatgtggactgggaacctggcggcagcgcaaaagatg

SEQ ID NO: 176326 - DNA, 103 bp, Artificial Sequence
  Synthetic Polynucleotide
taatacgactcactatagggttgaagaccatgcacctgcgtgcccagtccaacagaggagaggactgatgacgcaggtgaacctggcggcagcgcaaaagatg

SEQ ID NO: 176327 - DNA, 103 bp, Artificial Sequence
  Synthetic Polynucleotide
taatacgactcactatagggctccagctccttgaagaccatgcacctgcgaacagaggagacgcaggatgatggtcttcaacctggcggcagcgcaaaagatg

SEQ ID NO: 176328 - DNA, 103 bp, Artificial Sequence
  Synthetic Polynucleotide
taatacgactcactatagggggtcggccacctccagctccttgaagaccaaacagaggagatggtctatgaggagctggaacctggcggcagcgcaaaagatg

SEQ ID NO: 176329 - DNA, 103 bp, Artificial Sequence
  Synthetic Polynucleotide
taatacgactcactatagggagcgtcatctggtcggccacctccagctccaacagaggagaggagctatgggtggccgaaacctggcggcagcgcaaaagatg

SEQ ID NO: 176330 - DNA, 103 bp, Artificial Sequence
  Synthetic Polynucleotide
taatacgactcactataggggttctgcagcagcgtcatctggtcggccacaacagaggagagtggccatgcagatgacgaacctggcggcagcgcaaaagatg

SEQ ID NO: 176331 - DNA, 103 bp, Artificial Sequence
  Synthetic Polynucleotide
taatacgactcactatagggcgctccagcagttctgcagcagcgtcatctaacagaggagaagatgaatgtgctgcagaaacctggcggcagcgcaaaagatg

SEQ ID NO: 176332 - DNA, 103 bp, Artificial Sequence
  Synthetic Polynucleotide
taatacgactcactatagggaagaagcccttgcagctctcacacgtgagcaacagaggagagctcacatgtgagagctgaacctggcggcagcgcaaaagatg

SEQ ID NO: 176333 - DNA, 103 bp, Artificial Sequence
  Synthetic Polynucleotide
taatacgactcactatagggaccagcagctcgctccagcagttctgcagcaacagaggagagctgcaatgctgctggagaacctggcggcagcgcaaaagatg

SEQ ID NO: 176334 - DNA, 103 bp, Artificial Sequence
  Synthetic Polynucleotide
taatacgactcactataggggtggtcgaacaccagcagctcgctccagcaaacagaggagatgctggatggagctgctgaacctggcggcagcgcaaaagatg

SEQ ID NO: 176335 - DNA, 103 bp, Artificial Sequence
  Synthetic Polynucleotide
taatacgactcactatagggggcggtagatgtggtcgaacaccagcagctaacagaggagaagctgcatgtgttcgaccaacctggcggcagcgcaaaagatg

SEQ ID NO: 176336 - DNA, 103 bp, Artificial Sequence
  Synthetic Polynucleotide
taatacgactcactatagggtgctggacctggcggtagatgtggtcgaacaacagaggagagttcgaatgcatctaccgaacctggcggcagcgcaaaagatg

SEQ ID NO: 176337 - DNA, 103 bp, Artificial Sequence
  Synthetic Polynucleotide
taatacgactcactatagggctccttgccgtgctggacctggcggtagataacagaggagaatctacatgcaggtccagaacctggcggcagcgcaaaagatg

SEQ ID NO: 176338 - DNA, 103 bp, Artificial Sequence
  Synthetic Polynucleotide
taatacgactcactatagggggatgctgccctccttgccgtgctggacctaacagaggagaaggtccatgacggcaaggaacctggcggcagcgcaaaagatg

SEQ ID NO: 176339 - DNA, 103 bp, Artificial Sequence
  Synthetic Polynucleotide
taatacgactcactataggggtgaccagcaggatgctgccctccttgccgaacagaggagacggcaaatggggcagcataacctggcggcagcgcaaaagatg

SEQ ID NO: 176340 - DNA, 103 bp, Artificial Sequence
  Synthetic Polynucleotide
taatacgactcactatagggctcctgcccggtgaccagcaggatgctgccaacagaggagaggcagcatgctgctggtcaacctggcggcagcgcaaaagatg

SEQ ID NO: 176341 - DNA, 103 bp, Artificial Sequence
  Synthetic Polynucleotide
taatacgactcactatagggtcagctccacctcctgcccggtgaccagcaaacagaggagatgctggatgccgggcaggaacctggcggcagcgcaaaagatg

SEQ ID NO: 176342 - DNA, 103 bp, Artificial Sequence
  Synthetic Polynucleotide
taatacgactcactataggggccactgtggtcagctccacctcctgcccgaacagaggagacgggcaatgggtggagctaacctggcggcagcgcaaaagatg

SEQ ID NO: 176343 - DNA, 103 bp, Artificial Sequence
  Synthetic Polynucleotide
taatacgactcactatagggtaaatccccagtatctgaattagaagacataacagaggagaatgtctatgaattcagataacctggcggcagcgcaaaagatg

SEQ ID NO: 176344 - DNA, 103 bp, Artificial Sequence
  Synthetic Polynucleotide
taatacgactcactatagggacaaagctcttccagatcttcatcataggaaacagaggagatcctatatggaagatctgaacctggcggcagcgcaaaagatg

SEQ ID NO: 176345 - DNA, 103 bp, Artificial Sequence
  Synthetic Polynucleotide
taatacgactcactatagggtaagagctcactccagcagttctgaagcagaacagaggagactgcttatgaactgctggaacctggcggcagcgcaaaagatg

SEQ ID NO: 176346 - DNA, 103 bp, Artificial Sequence
  Synthetic Polynucleotide
taatacgactcactatagggggtcgaggattaagagctcactccagcagtaacagaggagaactgctatggtgagctctaacctggcggcagcgcaaaagatg

SEQ ID NO: 176347 - DNA, 103 bp, Artificial Sequence
  Synthetic Polynucleotide
taatacgactcactatagggcggtaaatgtggtcgaggattaagagctcaaacagaggagatgagctatgaatcctcgaaacctggcggcagcgcaaaagatg

SEQ ID NO: 176348 - DNA, 103 bp, Artificial Sequence
  Synthetic Polynucleotide
taatacgactcactatagggtaccacttgtcggtaaatgtggtcgaggataacagaggagaatcctcatgcacatttacaacctggcggcagcgcaaaagatg

SEQ ID NO: 176349 - DNA, 103 bp, Artificial Sequence
  Synthetic Polynucleotide
taatacgactcactatagggcctttccatgtaccacttgtcggtaaatgtaacagaggagaacatttatggacaagtggaacctggcggcagcgcaaaagatg

SEQ ID NO: 176350 - DNA, 103 bp, Artificial Sequence
  Synthetic Polynucleotide
taatacgactcactatagggatggatccttcctttccatgtaccacttgtaacagaggagaacaagtatgacatggaaaaacctggcggcagcgcaaaagatg

SEQ ID NO: 176351 - DNA, 103 bp, Artificial Sequence
  Synthetic Polynucleotide
taatacgactcactatagggaaccaggaagatggatccttcctttccatgaacagaggagacatggaatggaaggatccaacctggcggcagcgcaaaagatg

SEQ ID NO: 176352 - DNA, 103 bp, Artificial Sequence
  Synthetic Polynucleotide
taatacgactcactataggggttgcccagtaaccaggaagatggatccttaacagaggagaaaggatatgtcttcctggaacctggcggcagcgcaaaagatg

SEQ ID NO: 176353 - DNA, 103 bp, Artificial Sequence
  Synthetic Polynucleotide
taatacgactcactatagggtagtccacttgttgcccagtaaccaggaagaacagaggagacttcctatgtactgggcaaacctggcggcagcgcaaaagatg

SEQ ID NO: 176354 - DNA, 103 bp, Artificial Sequence
  Synthetic Polynucleotide
taatacgactcactatagggtattatggaatagtccacttgttgcccagtaacagaggagaactgggatgcaagtggacaacctggcggcagcgcaaaagatg

SEQ ID NO: 176355 - DNA, 103 bp, Artificial Sequence
  Synthetic Polynucleotide
taatacgactcactatagggcacacacgggacaaagctcttccagatcttaacagaggagaaagatcatgaagagctttaacctggcggcagcgcaaaagatg

SEQ ID NO: 176356 - DNA, 103 bp, Artificial Sequence
  Synthetic Polynucleotide
taatacgactcactatagggcttgtgatgctattatggaatagtccacttaacagaggagaaagtggatgattccataaaacctggcggcagcgcaaaagatg

SEQ ID NO: 176357 - DNA, 103 bp, Artificial Sequence
  Synthetic Polynucleotide
taatacgactcactataggggtggctccggcttgtgatgctattatggaaaacagaggagattccatatgagcatcacaaacctggcggcagcgcaaaagatg

SEQ ID NO: 176358 - DNA, 103 bp, Artificial Sequence
  Synthetic Polynucleotide
taatacgactcactataggggttgttgagggtggctccggcttgtgatgcaacagaggagagcatcaatggccggagccaacctggcggcagcgcaaaagatg

SEQ ID NO: 176359 - DNA, 103 bp, Artificial Sequence
  Synthetic Polynucleotide
taatacgactcactataggggactcatgaggttgttgagggtggctccggaacagaggagaccggagatgccctcaacaaacctggcggcagcgcaaaagatg

SEQ ID NO: 176360 - DNA, 103 bp, Artificial Sequence
  Synthetic Polynucleotide
taatacgactcactatagggtcctgtgcatgactcatgaggttgttgaggaacagaggagacctcaaatgcctcatgagaacctggcggcagcgcaaaagatg

SEQ ID NO: 176361 - DNA, 103 bp, Artificial Sequence
  Synthetic Polynucleotide
taatacgactcactatagggtgccactaactcctgtgcatgactcatgagaacagaggagactcatgatgcatgcacagaacctggcggcagcgcaaaagatg

SEQ ID NO: 176362 - DNA, 103 bp, Artificial Sequence
  Synthetic Polynucleotide
taatacgactcactatagggaacgaagttttgccactaactcctgtgcataacagaggagaatgcacatgagttagtggaacctggcggcagcgcaaaagatg

SEQ ID NO: 176363 - DNA, 103 bp, Artificial Sequence
  Synthetic Polynucleotide
taatacgactcactatagggaactggagagaacgaagttttgccactaacaacagaggagagttagtatgaaaacttcgaacctggcggcagcgcaaaagatg

SEQ ID NO: 176364 - DNA, 103 bp, Artificial Sequence
  Synthetic Polynucleotide
taatacgactcactatagggtcgttgatcaaactggagagaacgaagtttaacagaggagaaaacttatgtctctccagaacctggcggcagcgcaaaagatg

SEQ ID NO: 176365 - DNA, 103 bp, Artificial Sequence
  Synthetic Polynucleotide
taatacgactcactatagggatacgaactctcgttgatcaaactggagagaacagaggagactctccatgttgatcaacaacctggcggcagcgcaaaagatg

SEQ ID NO: 176366 - DNA, 103 bp, Artificial Sequence
  Synthetic Polynucleotide
taatacgactcactatagggactttatctccacacacgggacaaagctctaacagaggagaagagctatgtcccgtgtgaacctggcggcagcgcaaaagatg

SEQ ID NO: 176367 - DNA, 103 bp, Artificial Sequence
  Synthetic Polynucleotide
taatacgactcactatagggaatttcagacatacgaactctcgttgatcaaacagaggagatgatcaatgagagttcgtaacctggcggcagcgcaaaagatg

SEQ ID NO: 176368 - DNA, 103 bp, Artificial Sequence
  Synthetic Polynucleotide
taatacgactcactataggggagcaccaagaatttcagacatacgaactcaacagaggagagagttcatgtgtctgaaaaacctggcggcagcgcaaaagatg

SEQ ID NO: 176369 - DNA, 103 bp, Artificial Sequence
  Synthetic Polynucleotide
taatacgactcactatagggctaaactaaagagcaccaagaatttcagacaacagaggagagtctgaatgtcttggtgcaacctggcggcagcgcaaaagatg

SEQ ID NO: 176370 - DNA, 103 bp, Artificial Sequence
  Synthetic Polynucleotide
taatacgactcactatagggtttttgacatctaaactaaagagcaccaagaacagaggagacttggtatgctttagtttaacctggcggcagcgcaaaagatg

SEQ ID NO: 176371 - DNA, 103 bp, Artificial Sequence
  Synthetic Polynucleotide
taatacgactcactataggggttttcaaggtttttgacatctaaactaaaaacagaggagatttagtatggatgtcaaaaacctggcggcagcgcaaaagatg

SEQ ID NO: 176372 - DNA, 103 bp, Artificial Sequence
  Synthetic Polynucleotide
taatacgactcactatagggccagctggaagttttcaaggtttttgacataacagaggagaatgtcaatgaccttgaaaaacctggcggcagcgcaaaagatg

SEQ ID NO: 176373 - DNA, 103 bp, Artificial Sequence
  Synthetic Polynucleotide
taatacgactcactatagggacaccttctaccagctggaagttttcaaggaacagaggagaccttgaatgcttccagctaacctggcggcagcgcaaaagatg

SEQ ID NO: 176374 - DNA, 103 bp, Artificial Sequence
  Synthetic Polynucleotide
taatacgactcactatagggttgttcctggacaccttctaccagctggaaaacagaggagattccagatggtagaaggtaacctggcggcagcgcaaaagatg

SEQ ID NO: 176375 - DNA, 103 bp, Artificial Sequence
  Synthetic Polynucleotide
taatacgactcactatagggcggcattgacttgttcctggacaccttctaaacagaggagatagaagatgtccaggaacaacctggcggcagcgcaaaagatg

SEQ ID NO: 176376 - DNA, 103 bp, Artificial Sequence
  Synthetic Polynucleotide
taatacgactcactatagggtccagcagggcggcattgacttgttcctggaacagaggagaccaggaatgagtcaatgcaacctggcggcagcgcaaaagatg

SEQ ID NO: 176377 - DNA, 103 bp, Artificial Sequence
  Synthetic Polynucleotide
taatacgactcactataggggtacccagacactttatctccacacacgggaacagaggagacccgtgatgggagataaaaacctggcggcagcgcaaaagatg

SEQ ID NO: 176378 - DNA, 103 bp, Artificial Sequence
  Synthetic Polynucleotide
taatacgactcactatagggcattgtgtagtccagcagggcggcattgacaacagaggagagtcaatatggccctgctgaacctggcggcagcgcaaaagatg

SEQ ID NO: 176379 - DNA, 103 bp, Artificial Sequence
  Synthetic Polynucleotide
taatacgactcactatagggggtagttacacattgtgtagtccagcagggaacagaggagaccctgcatgactacacaaaacctggcggcagcgcaaaagatg

SEQ ID NO: 176380 - DNA, 103 bp, Artificial Sequence
  Synthetic Polynucleotide
taatacgactcactataggggtctgctgcgggtagttacacattgtgtagaacagaggagactacacatggtgtaactaaacctggcggcagcgcaaaagatg

SEQ ID NO: 176381 - DNA, 103 bp, Artificial Sequence
  Synthetic Polynucleotide
taatacgactcactatagggaaatttctctgtctgctgcgggtagttacaaacagaggagatgtaacatgccgcagcagaacctggcggcagcgcaaaagatg

SEQ ID NO: 176382 - DNA, 103 bp, Artificial Sequence
  Synthetic Polynucleotide
taatacgactcactataggggtagctgtccaaatttctctgtctgctgcgaacagaggagacgcagcatgcagagaaataacctggcggcagcgcaaaagatg

SEQ ID NO: 176383 - DNA, 103 bp, Artificial Sequence
  Synthetic Polynucleotide
taatacgactcactatagggagtcgaagaagtagctgtccaaatttctctaacagaggagaagagaaatgtggacagctaacctggcggcagcgcaaaagatg

SEQ ID NO: 176384 - DNA, 103 bp, Artificial Sequence
  Synthetic Polynucleotide
taatacgactcactataggggatttcgggtagtcgaagaagtagctgtccaacagaggagaggacagatgcttcttcgaaacctggcggcagcgcaaaagatg

SEQ ID NO: 176385 - DNA, 103 bp, Artificial Sequence
  Synthetic Polynucleotide
taatacgactcactatagggtgatggcccggatttcgggtagtcgaagaaaacagaggagattcttcatgtacccgaaaaacctggcggcagcgcaaaagatg

SEQ ID NO: 176386 - DNA, 103 bp, Artificial Sequence
  Synthetic Polynucleotide
taatacgactcactataggggcctgcatactgatggcccggatttcgggtaacagaggagaacccgaatgccgggccataacctggcggcagcgcaaaagatg

SEQ ID NO: 176387 - DNA, 103 bp, Artificial Sequence
  Synthetic Polynucleotide
taatacgactcactataggggtattcttcagcctgcatactgatggcccgaacagaggagacgggccatgagtatgcagaacctggcggcagcgcaaaagatg

SEQ ID NO: 176388 - DNA, 103 bp, Artificial Sequence
  Synthetic Polynucleotide
taatacgactcactataggggcccataatggtacccagacactttatctcaacagaggagagagataatgtgtctgggtaacctggcggcagcgcaaaagatg

SEQ ID NO: 176389 - DNA, 103 bp, Artificial Sequence
  Synthetic Polynucleotide
taatacgactcactatagggtgtagtagaggtattcttcagcctgcatacaacagaggagagtatgcatgctgaagaataacctggcggcagcgcaaaagatg

SEQ ID NO: 176390 - DNA, 103 bp, Artificial Sequence
  Synthetic Polynucleotide
taatacgactcactatagggttcaggtgcttgtagtagaggtattcttcaaacagaggagatgaagaatgcctctactaaacctggcggcagcgcaaaagatg

SEQ ID NO: 176391 - DNA, 103 bp, Artificial Sequence
  Synthetic Polynucleotide
taatacgactcactatagggcacatccccgttcaggtgcttgtagtagagaacagaggagactctacatgaagcacctgaacctggcggcagcgcaaaagatg

SEQ ID NO: 176392 - DNA, 103 bp, Artificial Sequence
  Synthetic Polynucleotide
taatacgactcactatagggtattatagggcacatccccgttcaggtgctaacagaggagaagcaccatgacggggatgaacctggcggcagcgcaaaagatg

SEQ ID NO: 176393 - DNA, 103 bp, Artificial Sequence
  Synthetic Polynucleotide
taatacgactcactatagggatgagaaggttattatagggcacatccccgaacagaggagacggggaatggccctataaaacctggcggcagcgcaaaagatg

SEQ ID NO: 176394 - DNA, 103 bp, Artificial Sequence
  Synthetic Polynucleotide
taatacgactcactatagggcaacatttcaatgagaaggttattatagggaacagaggagaccctatatgaaccttctcaacctggcggcagcgcaaaagatg

SEQ ID NO: 176395 - DNA, 103 bp, Artificial Sequence
  Synthetic Polynucleotide
taatacgactcactatagggttttggcatgcaacatttcaatgagaaggtaacagaggagaaccttcatgttgaaatgtaacctggcggcagcgcaaaagatg

SEQ ID NO: 176396 - DNA, 103 bp, Artificial Sequence
  Synthetic Polynucleotide
taatacgactcactatagggcaggtgaggagcccataatggtacccagacaacagaggagagtctggatgccattatggaacctggcggcagcgcaaaagatg

SEQ ID NO: 176397 - DNA, 103 bp, Artificial Sequence
  Synthetic Polynucleotide
taatacgactcactataggggcagctttcacaggtgaggagcccataatgaacagaggagacattatatgctcctcaccaacctggcggcagcgcaaaagatg

SEQ ID NO: 176398 - DNA, 103 bp, Artificial Sequence
  Synthetic Polynucleotide
taatacgactcactatagggaaaatcccttgcagctttcacaggtgaggaaacagaggagatcctcaatggtgaaagctaacctggcggcagcgcaaaagatg

SEQ ID NO: 176399 - DNA, 103 bp, Artificial Sequence
  Synthetic Polynucleotide
taatacgactcactataggggttcgcttaaaaaatcccttgcagctttcaaacagaggagatgaaagatgcaagggattaacctggcggcagcgcaaaagatg

SEQ ID NO: 176400 - DNA, 103 bp, Artificial Sequence
  Synthetic Polynucleotide
taatacgactcactatagggattttggactgttcgcttaaaaaatcccttaacagaggagaaagggaatgtttaagcgaaacctggcggcagcgcaaaagatg

SEQ ID NO: 176401 - DNA, 103 bp, Artificial Sequence
  Synthetic Polynucleotide
taatacgactcactatagggaagactcttgtaaatccccagtatctgaataacagaggagaattcagatgctggggattaacctggcggcagcgcaaaagatg

SEQ ID NO: 176402 - DNA, 103 bp, Artificial Sequence
  Synthetic Polynucleotide
taatacgactcactatagggaccttttattattttggactgttcgcttaaaacagaggagattaagcatgcagtccaaaaacctggcggcagcgcaaaagatg

SEQ ID NO: 176403 - DNA, 103 bp, Artificial Sequence
  Synthetic Polynucleotide
taatacgactcactatagggatacatgtgtaccttttattattttggactaacagaggagaagtccaatgtaataaaagaacctggcggcagcgcaaaagatg

SEQ ID NO: 176404 - DNA, 103 bp, Artificial Sequence
  Synthetic Polynucleotide
taatacgactcactatagggctggttttctatacatgtgtaccttttattaacagaggagaaataaaatgtacacatgtaacctggcggcagcgcaaaagatg

SEQ ID NO: 176405 - DNA, 103 bp, Artificial Sequence
  Synthetic Polynucleotide
taatacgactcactatagggtttggcagttctggttttctatacatgtgtaacagaggagaacacatatgtagaaaaccaacctggcggcagcgcaaaagatg

SEQ ID NO: 176406 - DNA, 103 bp, Artificial Sequence
  Synthetic Polynucleotide
taatacgactcactataggggttttgtcaatttggcagttctggttttctaacagaggagaagaaaaatggaactgccaaacctggcggcagcgcaaaagatg

SEQ ID NO: 176407 - DNA, 103 bp, Artificial Sequence
  Synthetic Polynucleotide
taatacgactcactatagggctttctctgtgttttgtcaatttggcagttaacagaggagaaactgcatgattgacaaaaacctggcggcagcgcaaaagatg

SEQ ID NO: 176408 - DNA, 103 bp, Artificial Sequence
  Synthetic Polynucleotide
taatacgactcactatagggaaggacaacgctttctctgtgttttgtcaaaacagaggagattgacaatgcacagagaaaacctggcggcagcgcaaaagatg

SEQ ID NO: 176409 - DNA, 103 bp, Artificial Sequence
  Synthetic Polynucleotide
taatacgactcactatagggaaacgacagtaaggacaacgctttctctgtaacagaggagaacagagatggcgttgtccaacctggcggcagcgcaaaagatg

SEQ ID NO: 176410 - DNA, 103 bp, Artificial Sequence
  Synthetic Polynucleotide
taatacgactcactatagggacatttttgaaaacgacagtaaggacaacgaacagaggagacgttgtatgtactgtcgtaacctggcggcagcgcaaaagatg

SEQ ID NO: 176411 - DNA, 103 bp, Artificial Sequence
  Synthetic Polynucleotide
taatacgactcactatagggcaacacttagacatttttgaaaacgacagtaacagaggagaactgtcatgttcaaaaataacctggcggcagcgcaaaagatg

SEQ ID NO: 176412 - DNA, 103 bp, Artificial Sequence
  Synthetic Polynucleotide
taatacgactcactatagggccgtgctttaaagactcttgtaaatccccaaacagaggagatggggaatgacaagagtcaacctggcggcagcgcaaaagatg

SEQ ID NO: 176413 - DNA, 103 bp, Artificial Sequence
  Synthetic Polynucleotide
taatacgactcactatagggagcttcattccaacacttagacatttttgaaacagaggagatcaaaaatgtctaagtgtaacctggcggcagcgcaaaagatg

SEQ ID NO: 176414 - DNA, 103 bp, Artificial Sequence
  Synthetic Polynucleotide
taatacgactcactatagggtacagcttctagcttcattccaacacttagaacagaggagactaagtatgggaatgaagaacctggcggcagcgcaaaagatg

SEQ ID NO: 176415 - DNA, 103 bp, Artificial Sequence
  Synthetic Polynucleotide
taatacgactcactatagggggtcggcccttacagcttctagcttcattcaacagaggagagaatgaatgtagaagctgaacctggcggcagcgcaaaagatg

SEQ ID NO: 176416 - DNA, 103 bp, Artificial Sequence
  Synthetic Polynucleotide
taatacgactcactatagggccacgcattcggtcggcccttacagcttctaacagaggagaagaagcatgaagggccgaaacctggcggcagcgcaaaagatg

SEQ ID NO: 176417 - DNA, 103 bp, Artificial Sequence
  Synthetic Polynucleotide
taatacgactcactatagggattccttcctccacgcattcggtcggccctaacagaggagaagggccatgcgaatgcgtaacctggcggcagcgcaaaagatg

SEQ ID NO: 176418 - DNA, 103 bp, Artificial Sequence
  Synthetic Polynucleotide
taatacgactcactataggggcccaaacttattccttcctccacgcattcaacagaggagagaatgcatggaggaaggaaacctggcggcagcgcaaaagatg

SEQ ID NO: 176419 - DNA, 103 bp, Artificial Sequence
  Synthetic Polynucleotide
taatacgactcactatagggttgtacattggcccaaacttattccttcctaacagaggagaaggaagatgtaagtttggaacctggcggcagcgcaaaagatg

SEQ ID NO: 176420 - DNA, 103 bp, Artificial Sequence
  Synthetic Polynucleotide
taatacgactcactatagggcctgtctctcttgtacattggcccaaacttaacagaggagaaagtttatgccaatgtacaacctggcggcagcgcaaaagatg

SEQ ID NO: 176421 - DNA, 103 bp, Artificial Sequence
  Synthetic Polynucleotide
taatacgactcactataggggcttcagggccctgtctctcttgtacattgaacagaggagacaatgtatgagagagacaaacctggcggcagcgcaaaagatg

SEQ ID NO: 176422 - DNA, 103 bp, Artificial Sequence
  Synthetic Polynucleotide
taatacgactcactatagggtttttctgttgcttcagggccctgtctctcaacagaggagagagagaatgggccctgaaaacctggcggcagcgcaaaagatg

SEQ ID NO: 176423 - DNA, 103 bp, Artificial Sequence
  Synthetic Polynucleotide
taatacgactcactatagggaggtgtaagtccgtgctttaaagactcttgaacagaggagacaagagatgttaaagcacaacctggcggcagcgcaaaagatg

SEQ ID NO: 176424 - DNA, 103 bp, Artificial Sequence
  Synthetic Polynucleotide
taatacgactcactataggggatgagggcttttttctgttgcttcagggcaacagaggagagccctgatgcaacagaaaaacctggcggcagcgcaaaagatg

SEQ ID NO: 176425 - DNA, 103 bp, Artificial Sequence
  Synthetic Polynucleotide
taatacgactcactatagggcattggctcggatgagggcttttttctgttaacagaggagaaacagaatgaagccctcaaacctggcggcagcgcaaaagatg

SEQ ID NO: 176426 - DNA, 103 bp, Artificial Sequence
  Synthetic Polynucleotide
taatacgactcactatagggagcttaagtccattggctcggatgagggctaacagaggagaagccctatgccgagccaaaacctggcggcagcgcaaaagatg

SEQ ID NO: 176427 - DNA, 103 bp, Artificial Sequence
  Synthetic Polynucleotide
taatacgactcactatagggcatggcttctagcttaagtccattggctcgaacagaggagacgagccatgggacttaagaacctggcggcagcgcaaaagatg

SEQ ID NO: 176428 - DNA, 103 bp, Artificial Sequence
  Synthetic Polynucleotide
taatacgactcactatagggtcacctgagacatggcttctagcttaagtcaacagaggagagacttaatgtagaagccaaacctggcggcagcgcaaaagatg

SEQ ID NO: 176429 - DNA, 103 bp, Artificial Sequence
  Synthetic Polynucleotide
taatacgactcactatagggatagcttggatcacctgagacatggcttctaacagaggagaagaagcatggtctcaggtaacctggcggcagcgcaaaagatg

SEQ ID NO: 176430 - DNA, 103 bp, Artificial Sequence
  Synthetic Polynucleotide
taatacgactcactataggggtcagagggcatagcttggatcacctgagaaacagaggagatctcagatgatccaagctaacctggcggcagcgcaaaagatg

SEQ ID NO: 176431 - DNA, 103 bp, Artificial Sequence
  Synthetic Polynucleotide
taatacgactcactatagggaaatggtcaggtcagagggcatagcttggaaacagaggagatccaagatgtgccctctgaacctggcggcagcgcaaaagatg

SEQ ID NO: 176432 - DNA, 103 bp, Artificial Sequence
  Synthetic Polynucleotide
taatacgactcactatagggattgcagaggaaatggtcaggtcagagggcaacagaggagagccctcatgcctgaccataacctggcggcagcgcaaaagatg

SEQ ID NO: 176433 - DNA, 103 bp, Artificial Sequence
  Synthetic Polynucleotide
taatacgactcactataggggatgttttgaattgcagaggaaatggtcagaacagaggagactgaccatgtcctctgcaaacctggcggcagcgcaaaagatg

SEQ ID NO: 176434 - DNA, 103 bp, Artificial Sequence
  Synthetic Polynucleotide
taatacgactcactataggggagacacaataggtgtaagtccgtgctttaaacagaggagataaagcatggacttacacaacctggcggcagcgcaaaagatg

SEQ ID NO: 176435 - DNA, 103 bp, Artificial Sequence
  Synthetic Polynucleotide
taatacgactcactatagggaggcagagtggatgttttgaattgcagaggaacagaggagacctctgatgttcaaaacaaacctggcggcagcgcaaaagatg

SEQ ID NO: 176436 - DNA, 103 bp, Artificial Sequence
  Synthetic Polynucleotide
taatacgactcactatagggaggcctttggaggcagagtggatgttttgaaacagaggagatcaaaaatgccactctgcaacctggcggcagcgcaaaagatg

SEQ ID NO: 176437 - DNA, 103 bp, Artificial Sequence
  Synthetic Polynucleotide
taatacgactcactataggggttcagaggtaggcctttggaggcagagtgaacagaggagacactctatgtccaaaggcaacctggcggcagcgcaaaagatg

SEQ ID NO: 176438 - DNA, 103 bp, Artificial Sequence
  Synthetic Polynucleotide
taatacgactcactatagggaggcagcatggttcagaggtaggcctttggaacagaggagaccaaagatgtacctctgaaacctggcggcagcgcaaaagatg

SEQ ID NO: 176439 - DNA, 103 bp, Artificial Sequence
  Synthetic Polynucleotide
taatacgactcactataggggtaggaggcaaggcagcatggttcagaggtaacagaggagaacctctatgccatgctgcaacctggcggcagcgcaaaagatg

SEQ ID NO: 176440 - DNA, 103 bp, Artificial Sequence
  Synthetic Polynucleotide
taatacgactcactataggggtcatagtctgtaggaggcaaggcagcatgaacagaggagacatgctatgttgcctcctaacctggcggcagcgcaaaagatg

SEQ ID NO: 176441 - DNA, 103 bp, Artificial Sequence
  Synthetic Polynucleotide
taatacgactcactatagggagggacttctgtcatagtctgtaggaggcaaacagaggagatgcctcatgcagactatgaacctggcggcagcgcaaaagatg

SEQ ID NO: 176442 - DNA, 103 bp, Artificial Sequence
  Synthetic Polynucleotide
taatacgactcactataggggatgttacaaagggacttctgtcatagtctaacagaggagaagactaatgcagaagtccaacctggcggcagcgcaaaagatg

SEQ ID NO: 176443 - DNA, 103 bp, Artificial Sequence
  Synthetic Polynucleotide
taatacgactcactataggggctaatgggggatgttacaaagggacttctaacagaggagaagaagtatgtttgtaacaaacctggcggcagcgcaaaagatg

SEQ ID NO: 176444 - DNA, 103 bp, Artificial Sequence
  Synthetic Polynucleotide
taatacgactcactataggggcattgtcatgctaatgggggatgttacaaaacagaggagattgtaaatgcccccattaaacctggcggcagcgcaaaagatg

SEQ ID NO: 176445 - DNA, 103 bp, Artificial Sequence
  Synthetic Polynucleotide
taatacgactcactatagggattttaaattgagacacaataggtgtaagtaacagaggagaacttacatgtattgtgtcaacctggcggcagcgcaaaagatg

SEQ ID NO: 176446 - DNA, 103 bp, Artificial Sequence
  Synthetic Polynucleotide
taatacgactcactatagggccgtgagggggcattgtcatgctaatggggaacagaggagaccccatatgcatgacaataacctggcggcagcgcaaaagatg

SEQ ID NO: 176447 - DNA, 103 bp, Artificial Sequence
  Synthetic Polynucleotide
taatacgactcactatagggttgcaggctgccgtgagggggcattgtcataacagaggagaatgacaatgccccctcacaacctggcggcagcgcaaaagatg

SEQ ID NO: 176448 - DNA, 103 bp, Artificial Sequence
  Synthetic Polynucleotide
taatacgactcactatagggtttggtaaccttgcaggctgccgtgaggggaacagaggagacccctcatggcagcctgcaacctggcggcagcgcaaaagatg

SEQ ID NO: 176449 - DNA, 103 bp, Artificial Sequence
  Synthetic Polynucleotide
taatacgactcactatagggtggccatatgtttggtaaccttgcaggctgaacagaggagacagcctatgaggttaccaaacctggcggcagcgcaaaagatg

SEQ ID NO: 176450 - DNA, 103 bp, Artificial Sequence
  Synthetic Polynucleotide
taatacgactcactataggggctaggaaagtggccatatgtttggtaaccaacagaggagaggttacatgacatatggcaacctggcggcagcgcaaaagatg

SEQ ID NO: 176451 - DNA, 103 bp, Artificial Sequence
  Synthetic Polynucleotide
taatacgactcactatagggtgatggcccggctaggaaagtggccatatgaacagaggagacatatgatgactttcctaaacctggcggcagcgcaaaagatg

SEQ ID NO: 176452 - DNA, 103 bp, Artificial Sequence
  Synthetic Polynucleotide
taatacgactcactatagggtactcagacttgatggcccggctaggaaagaacagaggagactttccatgccgggccataacctggcggcagcgcaaaagatg

SEQ ID NO: 176453 - DNA, 103 bp, Artificial Sequence
  Synthetic Polynucleotide
taatacgactcactatagggggggtctgggtactcagacttgatggcccgaacagaggagacgggccatgaagtctgagaacctggcggcagcgcaaaagatg

SEQ ID NO: 176454 - DNA, 103 bp, Artificial Sequence
  Synthetic Polynucleotide
taatacgactcactatagggagctggtataggggtctgggtactcagactaacagaggagaagtctgatgacccagaccaacctggcggcagcgcaaaagatg

SEQ ID NO: 176455 - DNA, 103 bp, Artificial Sequence
  Synthetic Polynucleotide
taatacgactcactataggggactcgggtgagctggtataggggtctgggaacagaggagacccagaatgctataccagaacctggcggcagcgcaaaagatg

SEQ ID NO: 176456 - DNA, 103 bp, Artificial Sequence
  Synthetic Polynucleotide
taatacgactcactataggggtaattcaccattttaaattgagacacaataacagaggagaattgtgatgcaatttaaaaacctggcggcagcgcaaaagatg

SEQ ID NO: 176457 - DNA, 103 bp, Artificial Sequence
  Synthetic Polynucleotide
taatacgactcactataggggcccattatggactcgggtgagctggtataaacagaggagatataccatgtcacccgagaacctggcggcagcgcaaaagatg

SEQ ID NO: 176458 - DNA, 103 bp, Artificial Sequence
  Synthetic Polynucleotide
taatacgactcactatagggtatatgaatagcccattatggactcgggtgaacagaggagacacccgatgccataatggaacctggcggcagcgcaaaagatg

SEQ ID NO: 176459 - DNA, 103 bp, Artificial Sequence
  Synthetic Polynucleotide
taatacgactcactatagggtaactatccatatatgaatagcccattatgaacagaggagacataatatgctattcataaacctggcggcagcgcaaaagatg

SEQ ID NO: 176460 - DNA, 103 bp, Artificial Sequence
  Synthetic Polynucleotide
taatacgactcactataggggctcgtctggtaactatccatatatgaataaacagaggagatattcaatgatggatagtaacctggcggcagcgcaaaagatg

SEQ ID NO: 176461 - DNA, 103 bp, Artificial Sequence
  Synthetic Polynucleotide
taatacgactcactatagggttgctggagagctcgtctggtaactatccaaacagaggagatggataatgaccagacgaaacctggcggcagcgcaaaagatg

SEQ ID NO: 176462 - DNA, 103 bp, Artificial Sequence
  Synthetic Polynucleotide
taatacgactcactatagggtgtgggatgcttgctggagagctcgtctggaacagaggagaccagacatgctctccagcaacctggcggcagcgcaaaagatg

SEQ ID NO: 176463 - DNA, 103 bp, Artificial Sequence
  Synthetic Polynucleotide
taatacgactcactatagggcagtatcagatgtgggatgcttgctggagaaacagaggagatctccaatgagcatcccaaacctggcggcagcgcaaaagatg

SEQ ID NO: 176464 - DNA, 103 bp, Artificial Sequence
  Synthetic Polynucleotide
taatacgactcactatagggtcaaaagttccagtatcagatgtgggatgcaacagaggagagcatccatgatctgatacaacctggcggcagcgcaaaagatg

SEQ ID NO: 176465 - DNA, 103 bp, Artificial Sequence
  Synthetic Polynucleotide
taatacgactcactatagggggctcacacttcaaaagttccagtatcagaaacagaggagatctgatatgggaacttttaacctggcggcagcgcaaaagatg

SEQ ID NO: 176466 - DNA, 103 bp, Artificial Sequence
  Synthetic Polynucleotide
taatacgactcactatagggaggctcatctggctcacacttcaaaagttcaacagaggagagaacttatgaagtgtgagaacctggcggcagcgcaaaagatg

SEQ ID NO: 176467 - DNA, 103 bp, Artificial Sequence
  Synthetic Polynucleotide
taatacgactcactatagggcatcataggagtaattcaccattttaaattaacagaggagaaatttaatgtggtgaattaacctggcggcagcgcaaaagatg

SEQ ID NO: 176468 - DNA, 103 bp, Artificial Sequence
  Synthetic Polynucleotide
taatacgactcactatagggcctggacttgaggctcatctggctcacactaacagaggagaagtgtgatgcagatgagcaacctggcggcagcgcaaaagatg

SEQ ID NO: 176469 - DNA, 103 bp, Artificial Sequence
  Synthetic Polynucleotide
taatacgactcactatagggatgattttagcctggacttgaggctcatctaacagaggagaagatgaatgtcaagtccaaacctggcggcagcgcaaaagatg

SEQ ID NO: 176470 - DNA, 103 bp, Artificial Sequence
  Synthetic Polynucleotide
taatacgactcactatagggcaaataggccatgattttagcctggacttgaacagaggagacaagtcatggctaaaatcaacctggcggcagcgcaaaagatg

SEQ ID NO: 176471 - DNA, 103 bp, Artificial Sequence
  Synthetic Polynucleotide
taatacgactcactataggggctcttgctgcaaataggccatgattttagaacagaggagactaaaaatgtggcctattaacctggcggcagcgcaaaagatg

SEQ ID NO: 176472 - DNA, 103 bp, Artificial Sequence
  Synthetic Polynucleotide
taatacgactcactatagggcggttagcctgctcttgctgcaaataggccaacagaggagaggcctaatggcagcaagaaacctggcggcagcgcaaaagatg

SEQ ID NO: 176473 - DNA, 103 bp, Artificial Sequence
  Synthetic Polynucleotide
taatacgactcactataggggtgcttgcttcggttagcctgctcttgctgaacagaggagacagcaaatgcaggctaacaacctggcggcagcgcaaaagatg

SEQ ID NO: 176474 - DNA, 103 bp, Artificial Sequence
  Synthetic Polynucleotide
taatacgactcactatagggtcagcttttcgtgcttgcttcggttagcctaacagaggagaaggctaatggaagcaagcaacctggcggcagcgcaaaagatg

SEQ ID NO: 176475 - DNA, 103 bp, Artificial Sequence
  Synthetic Polynucleotide
taatacgactcactatagggccaaaggtgctcagcttttcgtgcttgcttaacagaggagaaagcaaatgcgaaaagctaacctggcggcagcgcaaaagatg

SEQ ID NO: 176476 - DNA, 103 bp, Artificial Sequence
  Synthetic Polynucleotide
taatacgactcactataggggcacataagcccaaaggtgctcagcttttcaacagaggagagaaaagatgagcacctttaacctggcggcagcgcaaaagatg

SEQ ID NO: 176477 - DNA, 103 bp, Artificial Sequence
  Synthetic Polynucleotide
taatacgactcactatagggctgccattttgcacataagcccaaaggtgcaacagaggagagcacctatgggcttatgtaacctggcggcagcgcaaaagatg

SEQ ID NO: 176478 - DNA, 103 bp, Artificial Sequence
  Synthetic Polynucleotide
taatacgactcactatagggtccagatcttcatcataggagtaattcaccaacagaggagaggtgaaatgctcctatgaaacctggcggcagcgcaaaagatg

SEQ ID NO: 176479 - DNA, 103 bp, Artificial Sequence
  Synthetic Polynucleotide
taatacgactcactatagggagagtttgatctgccattttgcacataagcaacagaggagagcttatatgcaaaatggcaacctggcggcagcgcaaaagatg

SEQ ID NO: 176480 - DNA, 103 bp, Artificial Sequence
  Synthetic Polynucleotide
taatacgactcactatagggaatggagaagagagtttgatctgccattttaacagaggagaaaaatgatggatcaaactaacctggcggcagcgcaaaagatg

SEQ ID NO: 176481 - DNA, 103 bp, Artificial Sequence
  Synthetic Polynucleotide
taatacgactcactatagggcccactcgacaatggagaagagagtttgataacagaggagaatcaaaatgtcttctccaaacctggcggcagcgcaaaagatg

SEQ ID NO: 176482 - DNA, 103 bp, Artificial Sequence
  Synthetic Polynucleotide
taatacgactcactatagggctactcctggcccactcgacaatggagaagaacagaggagacttctcatgtgtcgagtgaacctggcggcagcgcaaaagatg

SEQ ID NO: 176483 - DNA, 103 bp, Artificial Sequence
  Synthetic Polynucleotide
taatacgactcactataggggaagaagatactactcctggcccactcgacaacagaggagagtcgagatggccaggagtaacctggcggcagcgcaaaagatg

SEQ ID NO: 176484 - DNA, 103 bp, Artificial Sequence
  Synthetic Polynucleotide
taatacgactcactatagggtaagttctctgaagaagatactactcctggaacagaggagaccaggaatggtatcttctaacctggcggcagcgcaaaagatg

SEQ ID NO: 176485 - DNA, 103 bp, Artificial Sequence
  Synthetic Polynucleotide
taatacgactcactatagggtcatcaaccttaagttctctgaagaagataaacagaggagatatcttatgcagagaactaacctggcggcagcgcaaaagatg

SEQ ID NO: 176486 - DNA, 103 bp, Artificial Sequence
  Synthetic Polynucleotide
taatacgactcactatagggcttcatttggtcatcaaccttaagttctctaacagaggagaagagaaatgaaggttgataacctggcggcagcgcaaaagatg

SEQ ID NO: 176487 - DNA, 103 bp, Artificial Sequence
  Synthetic Polynucleotide
taatacgactcactatagggtctgaagcagcttcatttggtcatcaacctaacagaggagaaggttgatgaccaaatgaaacctggcggcagcgcaaaagatg

SEQ ID NO: 176488 - DNA, 103 bp, Artificial Sequence
  Synthetic Polynucleotide
taatacgactcactatagggctccagcagttctgaagcagcttcatttggaacagaggagaccaaatatggctgcttcaaacctggcggcagcgcaaaagatg

SEQ ID NO: 176489 - DNA, 103 bp, Artificial Sequence
  Synthetic Polynucleotide
taatacgactcactatagggtccgctaggcggcggttcgtcccgctccataacagaggagaatggagatggacgaaccgaacctggcggcagcgcaaaagatg

SEQ ID NO: 176490 - DNA, 103 bp, Artificial Sequence
  Synthetic Polynucleotide
taatacgactcactatagggcaattcatcctgacagaaaccgttgcgcggaacagaggagaccgcgcatgggtttctgtaacctggcggcagcgcaaaagatg

SEQ ID NO: 176491 - DNA, 103 bp, Artificial Sequence
  Synthetic Polynucleotide
taatacgactcactatagggaaagatctgcttgctgtaaacggtgagggaaacagaggagatccctcatggtttacagcaacctggcggcagcgcaaaagatg

SEQ ID NO: 176492 - DNA, 103 bp, Artificial Sequence
  Synthetic Polynucleotide
taatacgactcactatagggccagttccccaaagatctgcttgctgtaaaaacagaggagatttacaatgagcagatctaacctggcggcagcgcaaaagatg

SEQ ID NO: 176493 - DNA, 103 bp, Artificial Sequence
  Synthetic Polynucleotide
taatacgactcactataggggtgacatcagccagttccccaaagatctgcaacagaggagagcagatatgtggggaactaacctggcggcagcgcaaaagatg

SEQ ID NO: 176494 - DNA, 103 bp, Artificial Sequence
  Synthetic Polynucleotide
taatacgactcactataggggtacttggcagtgacatcagccagttccccaacagaggagaggggaaatggctgatgtcaacctggcggcagcgcaaaagatg

SEQ ID NO: 176495 - DNA, 103 bp, Artificial Sequence
  Synthetic Polynucleotide
taatacgactcactatagggcggagggcgagtacttggcagtgacatcagaacagaggagactgatgatgctgccaagtaacctggcggcagcgcaaaagatg

SEQ ID NO: 176496 - DNA, 103 bp, Artificial Sequence
  Synthetic Polynucleotide
taatacgactcactatagggagttcttcatcggagggcgagtacttggcaaacagaggagatgccaaatgctcgccctcaacctggcggcagcgcaaaagatg

SEQ ID NO: 176497 - DNA, 103 bp, Artificial Sequence
  Synthetic Polynucleotide
taatacgactcactatagggaaatctgtgtagttcttcatcggagggcgaaacagaggagatcgcccatggatgaagaaaacctggcggcagcgcaaaagatg

SEQ ID NO: 176498 - DNA, 103 bp, Artificial Sequence
  Synthetic Polynucleotide
taatacgactcactatagggcttcatcactaaatctgtgtagttcttcataacagaggagaatgaagatgtacacagataacctggcggcagcgcaaaagatg

SEQ ID NO: 176499 - DNA, 103 bp, Artificial Sequence
  Synthetic Polynucleotide
taatacgactcactatagggacctccatcccttcatcactaaatctgtgtaacagaggagaacacagatgtagtgatgaaacctggcggcagcgcaaaagatg

SEQ ID NO: 176500 - DNA, 103 bp, Artificial Sequence
  Synthetic Polynucleotide
taatacgactcactatagggccgctcgatcacctccatcccttcatcactaacagaggagaagtgatatggggatggagaacctggcggcagcgcaaaagatg

SEQ ID NO: 176501 - DNA, 103 bp, Artificial Sequence
  Synthetic Polynucleotide
taatacgactcactatagggcaagctctgccaattcatcctgacagaaacaacagaggagagtttctatgaggatgaataacctggcggcagcgcaaaagatg

SEQ ID NO: 176502 - DNA, 103 bp, Artificial Sequence
  Synthetic Polynucleotide
taatacgactcactatagggggtagatgagccgctcgatcacctccatccaacagaggagaggatggatgtgatcgagcaacctggcggcagcgcaaaagatg

SEQ ID NO: 176503 - DNA, 103 bp, Artificial Sequence
  Synthetic Polynucleotide
taatacgactcactatagggttgtgatagaggtagatgagccgctcgatcaacagaggagagatcgaatggctcatctaaacctggcggcagcgcaaaagatg

SEQ ID NO: 176504 - DNA, 103 bp, Artificial Sequence
  Synthetic Polynucleotide
taatacgactcactatagggctgatggaacttgtgatagaggtagatgagaacagaggagactcatcatgctctatcacaacctggcggcagcgcaaaagatg

SEQ ID NO: 176505 - DNA, 103 bp, Artificial Sequence
  Synthetic Polynucleotide
taatacgactcactatagggtgacctttagctgatggaacttgtgatagaaacagaggagatctatcatgagttccatcaacctggcggcagcgcaaaagatg

SEQ ID NO: 176506 - DNA, 103 bp, Artificial Sequence
  Synthetic Polynucleotide
taatacgactcactatagggtcctcgttgctgacctttagctgatggaacaacagaggagagttccaatggctaaaggtaacctggcggcagcgcaaaagatg

SEQ ID NO: 176507 - DNA, 103 bp, Artificial Sequence
  Synthetic Polynucleotide
taatacgactcactataggggcaagcatactcctcgttgctgacctttagaacagaggagactaaagatgagcaacgagaacctggcggcagcgcaaaagatg

SEQ ID NO: 176508 - DNA, 103 bp, Artificial Sequence
  Synthetic Polynucleotide
taatacgactcactatagggttgctttcatgcaagcatactcctcgttgcaacagaggagagcaacgatgagtatgcttaacctggcggcagcgcaaaagatg

SEQ ID NO: 176509 - DNA, 103 bp, Artificial Sequence
  Synthetic Polynucleotide
taatacgactcactatagggaggaagttaattgctttcatgcaagcatacaacagaggagagtatgcatgcatgaaagcaacctggcggcagcgcaaaagatg

SEQ ID NO: 176510 - DNA, 103 bp, Artificial Sequence
  Synthetic Polynucleotide
taatacgactcactatagggatcttgatttaggaagttaattgctttcataacagaggagaatgaaaatgattaacttcaacctggcggcagcgcaaaagatg

SEQ ID NO: 176511 - DNA, 103 bp, Artificial Sequence
  Synthetic Polynucleotide
taatacgactcactataggggacccctgatatcttgatttaggaagttaaaacagaggagattaactatgtaaatcaagaacctggcggcagcgcaaaagatg

SEQ ID NO: 176512 - DNA, 103 bp, Artificial Sequence
  Synthetic Polynucleotide
taatacgactcactataggggtgcctgggtcaagctctgccaattcatccaacagaggagaggatgaatgggcagagctaacctggcggcagcgcaaaagatg

SEQ ID NO: 176513 - DNA, 103 bp, Artificial Sequence
  Synthetic Polynucleotide
taatacgactcactataggggcactggtcagacccctgatatcttgatttaacagaggagaaaatcaatgtatcaggggaacctggcggcagcgcaaaagatg

SEQ ID NO: 176514 - DNA, 103 bp, Artificial Sequence
  Synthetic Polynucleotide
taatacgactcactatagggcagctgtgaggcactggtcagacccctgataacagaggagaatcaggatgctgaccagtaacctggcggcagcgcaaaagatg

SEQ ID NO: 176515 - DNA, 103 bp, Artificial Sequence
  Synthetic Polynucleotide
taatacgactcactatagggtcaattgttccagctgtgaggcactggtcaaacagaggagatgaccaatgcctcacagcaacctggcggcagcgcaaaagatg

SEQ ID NO: 176516 - DNA, 103 bp, Artificial Sequence
  Synthetic Polynucleotide
taatacgactcactatagggtatcgtttattcaattgttccagctgtgagaacagaggagactcacaatgggaacaattaacctggcggcagcgcaaaagatg

SEQ ID NO: 176517 - DNA, 103 bp, Artificial Sequence
  Synthetic Polynucleotide
taatacgactcactatagggaatgtaccagtatcgtttattcaattgttcaacagaggagagaacaaatgaataaacgaaacctggcggcagcgcaaaagatg

SEQ ID NO: 176518 - DNA, 103 bp, Artificial Sequence
  Synthetic Polynucleotide
taatacgactcactatagggaatcctggcaaatgtaccagtatcgtttataacagaggagaataaacatgactggtacaaacctggcggcagcgcaaaagatg

SEQ ID NO: 176519 - DNA, 103 bp, Artificial Sequence
  Synthetic Polynucleotide
taatacgactcactatagggtattcagtaaaatcctggcaaatgtaccagaacagaggagactggtaatgttgccaggaaacctggcggcagcgcaaaagatg

SEQ ID NO: 176520 - DNA, 103 bp, Artificial Sequence
  Synthetic Polynucleotide
taatacgactcactatagggtgtgtatttatattcagtaaaatcctggcaaacagaggagatgccagatgtttactgaaaacctggcggcagcgcaaaagatg

SEQ ID NO: 176521 - DNA, 103 bp, Artificial Sequence
  Synthetic Polynucleotide
taatacgactcactatagggtcggctgatgtgtgtatttatattcagtaaaacagaggagattactgatgataaatacaaacctggcggcagcgcaaaagatg

SEQ ID NO: 176522 - DNA, 103 bp, Artificial Sequence
  Synthetic Polynucleotide
taatacgactcactatagggggaaagcggttcggctgatgtgtgtatttaaacagaggagataaataatgacatcagccaacctggcggcagcgcaaaagatg

SEQ ID NO: 176523 - DNA, 103 bp, Artificial Sequence
  Synthetic Polynucleotide
taatacgactcactatagggaacagaaatagtgcctgggtcaagctctgcaacagaggagagcagagatggacccaggcaacctggcggcagcgcaaaagatg

SEQ ID NO: 176524 - DNA, 103 bp, Artificial Sequence
  Synthetic Polynucleotide
taatacgactcactatagggcatgagatcaggaaagcggttcggctgatgaacagaggagacatcagatgaaccgctttaacctggcggcagcgcaaaagatg

SEQ ID NO: 176525 - DNA, 103 bp, Artificial Sequence
  Synthetic Polynucleotide
taatacgactcactataggggtaagcacatcatgagatcaggaaagcggtaacagaggagaaccgctatgctgatctcaaacctggcggcagcgcaaaagatg

SEQ ID NO: 176526 - DNA, 103 bp, Artificial Sequence
  Synthetic Polynucleotide
taatacgactcactatagggcgaatctcaggtaagcacatcatgagatcaaacagaggagatgatctatggatgtgcttaacctggcggcagcgcaaaagatg

SEQ ID NO: 176527 - DNA, 103 bp, Artificial Sequence
  Synthetic Polynucleotide
taatacgactcactatagggtgcaatatatcgaatctcaggtaagcacataacagaggagaatgtgcatgcctgagattaacctggcggcagcgcaaaagatg

SEQ ID NO: 176528 - DNA, 103 bp, Artificial Sequence
  Synthetic Polynucleotide
taatacgactcactatagggccatctttcctgcaatatatcgaatctcagaacagaggagactgagaatggatatattgaacctggcggcagcgcaaaagatg

SEQ ID NO: 176529 - DNA, 103 bp, Artificial Sequence
  Synthetic Polynucleotide
taatacgactcactatagggggcacattcaccatctttcctgcaatatataacagaggagaatatatatgaggaaagataacctggcggcagcgcaaaagatg

SEQ ID NO: 176530 - DNA, 103 bp, Artificial Sequence
  Synthetic Polynucleotide
taatacgactcactatagggctgctccaggggcacattcaccatctttccaacagaggagaggaaagatggtgaatgtgaacctggcggcagcgcaaaagatg

SEQ ID NO: 176531 - DNA, 103 bp, Artificial Sequence
  Synthetic Polynucleotide
taatacgactcactatagggggaggggcagctgctccaggggcacattcaaacagaggagatgaatgatgccctggagcaacctggcggcagcgcaaaagatg

SEQ ID NO: 176532 - DNA, 103 bp, Artificial Sequence
  Synthetic Polynucleotide
taatacgactcactatagggaccttaaagaggaggggcagctgctccaggaacagaggagacctggaatggctgcccctaacctggcggcagcgcaaaagatg

SEQ ID NO: 176533 - DNA, 103 bp, Artificial Sequence
  Synthetic Polynucleotide
taatacgactcactatagggatgcagcaccaccttaaagaggaggggcagaacagaggagactgcccatgctctttaagaacctggcggcagcgcaaaagatg

SEQ ID NO: 176534 - DNA, 103 bp, Artificial Sequence
  Synthetic Polynucleotide
taatacgactcactataggggatcatctgaaacagaaatagtgcctgggtaacagaggagaacccagatgctatttctgaacctggcggcagcgcaaaagatg

SEQ ID NO: 176535 - DNA, 103 bp, Artificial Sequence
  Synthetic Polynucleotide
taatacgactcactatagggtcttgcaggaatgcagcaccaccttaaagaaacagaggagatctttaatgtggtgctgcaacctggcggcagcgcaaaagatg

SEQ ID NO: 176536 - DNA, 103 bp, Artificial Sequence
  Synthetic Polynucleotide
taatacgactcactatagggcccacactggtcttgcaggaatgcagcaccaacagaggagaggtgctatgttcctgcaaaacctggcggcagcgcaaaagatg

SEQ ID NO: 176537 - DNA, 103 bp, Artificial Sequence
  Synthetic Polynucleotide
taatacgactcactatagggtcattccttgcccacactggtcttgcaggaaacagaggagatcctgcatgaccagtgtgaacctggcggcagcgcaaaagatg

SEQ ID NO: 176538 - DNA, 103 bp, Artificial Sequence
  Synthetic Polynucleotide
taatacgactcactatagggtgttcagcccgatcatctgaaacagaaataaacagaggagatatttcatgttcagatgaaacctggcggcagcgcaaaagatg

SEQ ID NO: 176539 - DNA, 103 bp, Artificial Sequence
  Synthetic Polynucleotide
taatacgactcactatagggacaggttcgttgttcagcccgatcatctgaaacagaggagatcagatatgcgggctgaaaacctggcggcagcgcaaaagatg

SEQ ID NO: 176540 - DNA, 103 bp, Artificial Sequence
  Synthetic Polynucleotide
taatacgactcactatagggcacaaatgagacaggttcgttgttcagcccaacagaggagagggctgatgaacgaacctaacctggcggcagcgcaaaagatg

SEQ ID NO: 176541 - DNA, 103 bp, Artificial Sequence
  Synthetic Polynucleotide
taatacgactcactataggggcgcggtccccacaaatgagacaggttcgtaacagaggagaacgaacatgtctcatttgaacctggcggcagcgcaaaagatg

SEQ ID NO: 176542 - DNA, 103 bp, Artificial Sequence
  Synthetic Polynucleotide
taatacgactcactatagggcaagcctgtagcgcggtccccacaaatgagaacagaggagactcattatgggggaccgcaacctggcggcagcgcaaaagatg

SEQ ID NO: 176543 - DNA, 103 bp, Artificial Sequence
  Synthetic Polynucleotide
taatacgactcactatagggcgcctccccctccgctaggcggcggttcgtaacagaggagaacgaacatgcgcctagcgaacctggcggcagcgcaaaagatg

SEQ ID NO: 176544 - DNA, 103 bp, Artificial Sequence
  Synthetic Polynucleotide
taatacgactcactatagggtcccatagtgcaagcctgtagcgcggtcccaacagaggagagggaccatgctacaggctaacctggcggcagcgcaaaagatg

SEQ ID NO: 176545 - DNA, 103 bp, Artificial Sequence
  Synthetic Polynucleotide
taatacgactcactatagggcaggagatgatcccatagtgcaagcctgtaaacagaggagatacaggatggcactatggaacctggcggcagcgcaaaagatg

SEQ ID NO: 176546 - DNA, 103 bp, Artificial Sequence
  Synthetic Polynucleotide
taatacgactcactataggggcagccctcacaggagatgatcccatagtgaacagaggagacactatatgatcatctccaacctggcggcagcgcaaaagatg

SEQ ID NO: 176547 - DNA, 103 bp, Artificial Sequence
  Synthetic Polynucleotide
taatacgactcactatagggaaaaccctttgcagccctcacaggagatgaaacagaggagatcatctatggtgagggctaacctggcggcagcgcaaaagatg

SEQ ID NO: 176548 - DNA, 103 bp, Artificial Sequence
  Synthetic Polynucleotide
taatacgactcactatagggctccgcttgaaaaaccctttgcagccctcaaacagaggagatgagggatgcaaagggttaacctggcggcagcgcaaaagatg

SEQ ID NO: 176549 - DNA, 103 bp, Artificial Sequence
  Synthetic Polynucleotide
taatacgactcactataggggttgcaaatgctccgcttgaaaaaccctttaacagaggagaaaagggatgttcaagcggaacctggcggcagcgcaaaagatg

SEQ ID NO: 176550 - DNA, 103 bp, Artificial Sequence
  Synthetic Polynucleotide
taatacgactcactatagggatacccgtttgttgcaaatgctccgcttgaaacagaggagatcaagcatggcatttgcaaacctggcggcagcgcaaaagatg

SEQ ID NO: 176551 - DNA, 103 bp, Artificial Sequence
  Synthetic Polynucleotide
taatacgactcactatagggctgcatcgatatacccgtttgttgcaaatgaacagaggagacatttgatgcaaacgggtaacctggcggcagcgcaaaagatg

SEQ ID NO: 176552 - DNA, 103 bp, Artificial Sequence
  Synthetic Polynucleotide
taatacgactcactatagggcttgtcacgactgcatcgatatacccgtttaacagaggagaaaacggatgtatcgatgcaacctggcggcagcgcaaaagatg

SEQ ID NO: 176553 - DNA, 103 bp, Artificial Sequence
  Synthetic Polynucleotide
taatacgactcactatagggtgacacagttcttgtcacgactgcatcgataacagaggagaatcgatatggtcgtgacaaacctggcggcagcgcaaaagatg

SEQ ID NO: 176554 - DNA, 103 bp, Artificial Sequence
  Synthetic Polynucleotide
taatacgactcactataggggagcccccgccgcctccccctccgctaggcaacagaggagagcctagatgagggggaggaacctggcggcagcgcaaaagatg

SEQ ID NO: 176555 - DNA, 103 bp, Artificial Sequence
  Synthetic Polynucleotide
taatacgactcactatagggttccgagacatgacacagttcttgtcacgaaacagaggagatcgtgaatggaactgtgtaacctggcggcagcgcaaaagatg

SEQ ID NO: 176556 - DNA, 103 bp, Artificial Sequence
  Synthetic Polynucleotide
taatacgactcactataggggttcctctgcttccgagacatgacacagttaacagaggagaaactgtatgatgtctcggaacctggcggcagcgcaaaagatg

SEQ ID NO: 176557 - DNA, 103 bp, Artificial Sequence
  Synthetic Polynucleotide
taatacgactcactatagggactggcacctgttcctctgcttccgagacaaacagaggagatgtctcatgagcagaggaaacctggcggcagcgcaaaagatg

SEQ ID NO: 176558 - DNA, 103 bp, Artificial Sequence
  Synthetic Polynucleotide
taatacgactcactatagggaggcggcagtactggcacctgttcctctgcaacagaggagagcagagatgcaggtgccaaacctggcggcagcgcaaaagatg

SEQ ID NO: 176559 - DNA, 103 bp, Artificial Sequence
  Synthetic Polynucleotide
taatacgactcactataggggcatttgagcaggcggcagtactggcacctaacagaggagaaggtgcatgtactgccgcaacctggcggcagcgcaaaagatg

SEQ ID NO: 176560 - DNA, 103 bp, Artificial Sequence
  Synthetic Polynucleotide
taatacgactcactatagggccatctggaggcatttgagcaggcggcagtaacagaggagaactgccatgtgctcaaataacctggcggcagcgcaaaagatg

SEQ ID NO: 176561 - DNA, 103 bp, Artificial Sequence
  Synthetic Polynucleotide
taatacgactcactatagggcggttcatccccatctggaggcatttgagcaacagaggagagctcaaatgcctccagataacctggcggcagcgcaaaagatg

SEQ ID NO: 176562 - DNA, 103 bp, Artificial Sequence
  Synthetic Polynucleotide
taatacgactcactataggggatagccttccggttcatccccatctggagaacagaggagactccagatggggatgaacaacctggcggcagcgcaaaagatg

SEQ ID NO: 176563 - DNA, 103 bp, Artificial Sequence
  Synthetic Polynucleotide
taatacgactcactatagggcatcttctctgatagccttccggttcatccaacagaggagaggatgaatgggaaggctaaacctggcggcagcgcaaaagatg

SEQ ID NO: 176564 - DNA, 103 bp, Artificial Sequence
  Synthetic Polynucleotide
taatacgactcactatagggccaggcatgccatcttctctgatagccttcaacagaggagagaaggcatgcagagaagaaacctggcggcagcgcaaaagatg

SEQ ID NO: 176565 - DNA, 103 bp, Artificial Sequence
  Synthetic Polynucleotide
taatacgactcactataggggaaccccgccgagcccccgccgcctcccccaacagaggagagggggaatgggcgggggcaacctggcggcagcgcaaaagatg

SEQ ID NO: 176566 - DNA, 103 bp, Artificial Sequence
  Synthetic Polynucleotide
taatacgactcactatagggattccggcctccaggcatgccatcttctctaacagaggagaagagaaatgggcatgcctaacctggcggcagcgcaaaagatg

SEQ ID NO: 176567 - DNA, 103 bp, Artificial Sequence
  Synthetic Polynucleotide
taatacgactcactatagggcaatgctcttattccggcctccaggcatgcaacagaggagagcatgcatggaggccggaaacctggcggcagcgcaaaagatg

SEQ ID NO: 176568 - DNA, 103 bp, Artificial Sequence
  Synthetic Polynucleotide
taatacgactcactatagggtggactggcccaatgctcttattccggcctaacagaggagaaggccgatgtaagagcataacctggcggcagcgcaaaagatg

SEQ ID NO: 176569 - DNA, 103 bp, Artificial Sequence
  Synthetic Polynucleotide
taatacgactcactatagggttccgatatctggactggcccaatgctcttaacagaggagaaagagcatggggccagtcaacctggcggcagcgcaaaagatg

SEQ ID NO: 176570 - DNA, 103 bp, Artificial Sequence
  Synthetic Polynucleotide
taatacgactcactatagggcgatttcttcttccgatatctggactggccaacagaggagaggccagatgagatatcggaacctggcggcagcgcaaaagatg

SEQ ID NO: 176571 - DNA, 103 bp, Artificial Sequence
  Synthetic Polynucleotide
taatacgactcactatagggatgatcctttcgatttcttcttccgatatcaacagaggagagatatcatgagaagaaataacctggcggcagcgcaaaagatg

SEQ ID NO: 176572 - DNA, 103 bp, Artificial Sequence
  Synthetic Polynucleotide
taatacgactcactatagggctgcccagacatgatcctttcgatttcttcaacagaggagagaagaaatggaaaggatcaacctggcggcagcgcaaaagatg

SEQ ID NO: 176573 - DNA, 103 bp, Artificial Sequence
  Synthetic Polynucleotide
taatacgactcactatagggcctcaaactcctgcccagacatgatcctttaacagaggagaaaaggaatgtgtctgggcaacctggcggcagcgcaaaagatg

SEQ ID NO: 176574 - DNA, 103 bp, Artificial Sequence
  Synthetic Polynucleotide
taatacgactcactatagggttggcctcttcctcaaactcctgcccagacaacagaggagagtctggatgggagtttgaaacctggcggcagcgcaaaagatg

SEQ ID NO: 176575 - DNA, 103 bp, Artificial Sequence
  Synthetic Polynucleotide
taatacgactcactataggggctccagtgattggcctcttcctcaaactcaacagaggagagagtttatggaagaggccaacctggcggcagcgcaaaagatg

SEQ ID NO: 176576 - DNA, 103 bp, Artificial Sequence
  Synthetic Polynucleotide
taatacgactcactataggggaggctccaggaaccccgccgagcccccgcaacagaggagagcggggatgcggcggggtaacctggcggcagcgcaaaagatg

SEQ ID NO: 176577 - DNA, 103 bp, Artificial Sequence
  Synthetic Polynucleotide
taatacgactcactatagggcaccatggttgctccagtgattggcctcttaacagaggagaaagaggatgatcactggaaacctggcggcagcgcaaaagatg

SEQ ID NO: 176578 - DNA, 103 bp, Artificial Sequence
  Synthetic Polynucleotide
taatacgactcactatagggtggtcactatcaccatggttgctccagtgaaacagaggagatcactgatgcaaccatggaacctggcggcagcgcaaaagatg

SEQ ID NO: 176579 - DNA, 103 bp, Artificial Sequence
  Synthetic Polynucleotide
taatacgactcactatagggaggggaactgtggtcactatcaccatggttaacagaggagaaaccatatggatagtgacaacctggcggcagcgcaaaagatg

SEQ ID NO: 176580 - DNA, 103 bp, Artificial Sequence
  Synthetic Polynucleotide
taatacgactcactatagggccctgttcccaggggaactgtggtcactataacagaggagaatagtgatgacagttcccaacctggcggcagcgcaaaagatg

SEQ ID NO: 176581 - DNA, 103 bp, Artificial Sequence
  Synthetic Polynucleotide
taatacgactcactatagggctctccgaagccctgttcccaggggaactgaacagaggagacagttcatgtgggaacagaacctggcggcagcgcaaaagatg

SEQ ID NO: 176582 - DNA, 103 bp, Artificial Sequence
  Synthetic Polynucleotide
taatacgactcactataggggggctggttgctctccgaagccctgttcccaacagaggagagggaacatggcttcggagaacctggcggcagcgcaaaagatg

SEQ ID NO: 176583 - DNA, 103 bp, Artificial Sequence
  Synthetic Polynucleotide
taatacgactcactatagggagcctggtgagggctggttgctctccgaagaacagaggagacttcggatggcaaccagcaacctggcggcagcgcaaaagatg

SEQ ID NO: 176584 - DNA, 103 bp, Artificial Sequence
  Synthetic Polynucleotide
taatacgactcactataggggacagtgtggagcctggtgagggctggttgaacagaggagacaaccaatgctcaccaggaacctggcggcagcgcaaaagatg

SEQ ID NO: 176585 - DNA, 103 bp, Artificial Sequence
  Synthetic Polynucleotide
taatacgactcactatagggagacctggaagacagtgtggagcctggtgaaacagaggagatcaccaatgtccacactgaacctggcggcagcgcaaaagatg

SEQ ID NO: 176586 - DNA, 103 bp, Artificial Sequence
  Synthetic Polynucleotide
taatacgactcactatagggtcagttccacagacctggaagacagtgtggaacagaggagaccacacatgcttccaggtaacctggcggcagcgcaaaagatg

SEQ ID NO: 176587 - DNA, 103 bp, Artificial Sequence
  Synthetic Polynucleotide
taatacgactcactatagggagcgcggcgggaggctccaggaaccccgccaacagaggagaggcgggatgcctggagccaacctggcggcagcgcaaaagatg

SEQ ID NO: 176588 - DNA, 103 bp, Artificial Sequence
  Synthetic Polynucleotide
taatacgactcactatagggatgaatccattcagttccacagacctggaaaacagaggagattccagatgtgtggaactaacctggcggcagcgcaaaagatg

SEQ ID NO: 176589 - DNA, 103 bp, Artificial Sequence
  Synthetic Polynucleotide
taatacgactcactatagggcctgaaggccatgaatccattcagttccacaacagaggagagtggaaatgaatggattcaacctggcggcagcgcaaaagatg

SEQ ID NO: 176590 - DNA, 103 bp, Artificial Sequence
  Synthetic Polynucleotide
taatacgactcactatagggtgtactgttccctgaaggccatgaatccataacagaggagaatggatatgtggccttcaaacctggcggcagcgcaaaagatg

SEQ ID NO: 176591 - DNA, 103 bp, Artificial Sequence
  Synthetic Polynucleotide
taatacgactcactataggggacattcccatgtactgttccctgaaggccaacagaggagaggccttatgggaacagtaaacctggcggcagcgcaaaagatg

SEQ ID NO: 176592 - DNA, 103 bp, Artificial Sequence
  Synthetic Polynucleotide
taatacgactcactatagggtggaggcacagacattcccatgtactgttcaacagaggagagaacagatgatgggaatgaacctggcggcagcgcaaaagatg

SEQ ID NO: 176593 - DNA, 103 bp, Artificial Sequence
  Synthetic Polynucleotide
taatacgactcactatagggattggtaatgtggaggcacagacattcccaaacagaggagatgggaaatgctgtgcctcaacctggcggcagcgcaaaagatg

SEQ ID NO: 176594 - DNA, 103 bp, Artificial Sequence
  Synthetic Polynucleotide
taatacgactcactatagggtgcggtatatattggtaatgtggaggcacaaacagaggagatgtgccatgacattaccaaacctggcggcagcgcaaaagatg

SEQ ID NO: 176595 - DNA, 103 bp, Artificial Sequence
  Synthetic Polynucleotide
taatacgactcactataggggctaaaaaggtgcggtatatattggtaatgaacagaggagacattacatgtatataccgaacctggcggcagcgcaaaagatg

SEQ ID NO: 176596 - DNA, 103 bp, Artificial Sequence
  Synthetic Polynucleotide
taatacgactcactatagggggccagaatagctaaaaaggtgcggtatataacagaggagaatatacatgacctttttaaacctggcggcagcgcaaaagatg

SEQ ID NO: 176597 - DNA, 103 bp, Artificial Sequence
  Synthetic Polynucleotide
taatacgactcactatagggagtggtgagtggccagaatagctaaaaaggaacagaggagaccttttatgctattctggaacctggcggcagcgcaaaagatg

SEQ ID NO: 176598 - DNA, 103 bp, Artificial Sequence
  Synthetic Polynucleotide
taatacgactcactatagggcggcggagggagcgcggcgggaggctccagaacagaggagactggagatgcccgccgcgaacctggcggcagcgcaaaagatg

SEQ ID NO: 176599 - DNA, 103 bp, Artificial Sequence
  Synthetic Polynucleotide
taatacgactcactatagggttggggcagaagtggtgagtggccagaataaacagaggagatattctatgcactcaccaaacctggcggcagcgcaaaagatg

SEQ ID NO: 176600 - DNA, 103 bp, Artificial Sequence
  Synthetic Polynucleotide
taatacgactcactatagggtgcgagcttgttggggcagaagtggtgagtaacagaggagaactcacatgttctgccccaacctggcggcagcgcaaaagatg

SEQ ID NO: 176601 - DNA, 103 bp, Artificial Sequence
  Synthetic Polynucleotide
taatacgactcactatagggggatccaggctgcgagcttgttggggcagaaacagaggagatctgccatgacaagctcgaacctggcggcagcgcaaaagatg

SEQ ID NO: 176602 - DNA, 103 bp, Artificial Sequence
  Synthetic Polynucleotide
taatacgactcactataggggtatgactggggatccaggctgcgagcttgaacagaggagacaagctatgagcctggataacctggcggcagcgcaaaagatg

SEQ ID NO: 176603 - DNA, 103 bp, Artificial Sequence
  Synthetic Polynucleotide
taatacgactcactataggggaatcagactgtatgactggggatccaggcaacagaggagagcctggatgcccagtcataacctggcggcagcgcaaaagatg

SEQ ID NO: 176604 - DNA, 103 bp, Artificial Sequence
  Synthetic Polynucleotide
taatacgactcactatagggaacagctggtgaatcagactgtatgactggaacagaggagaccagtcatgcagtctgataacctggcggcagcgcaaaagatg

SEQ ID NO: 176605 - DNA, 103 bp, Artificial Sequence
  Synthetic Polynucleotide
taatacgactcactatagggctcggctgataacagctggtgaatcagactaacagaggagaagtctgatgcaccagctgaacctggcggcagcgcaaaagatg

SEQ ID NO: 176606 - DNA, 103 bp, Artificial Sequence
  Synthetic Polynucleotide
taatacgactcactataggggttccaggtcctcggctgataacagctggtaacagaggagaaccagcatgtatcagccgaacctggcggcagcgcaaaagatg

SEQ ID NO: 176607 - DNA, 103 bp, Artificial Sequence
  Synthetic Polynucleotide
taatacgactcactataggggtgcccaatggttccaggtcctcggctgataacagaggagaatcagcatgggacctggaaacctggcggcagcgcaaaagatg

SEQ ID NO: 176608 - DNA, 103 bp, Artificial Sequence
  Synthetic Polynucleotide
taatacgactcactatagggcaacatgggcgtgcccaatggttccaggtcaacagaggagagacctgatgccattgggcaacctggcggcagcgcaaaagatg

SEQ ID NO: 176609 - DNA, 103 bp, Artificial Sequence
  Synthetic Polynucleotide
taatacgactcactatagggcgttgcgcggcggcggagggagcgcggcggaacagaggagaccgccgatgtccctccgcaacctggcggcagcgcaaaagatg

SEQ ID NO: 176610 - DNA, 103 bp, Artificial Sequence
  Synthetic Polynucleotide
taatacgactcactatagggcatcttcaatcaacatgggcgtgcccaatgaacagaggagacattggatgcgcccatgtaacctggcggcagcgcaaaagatg

SEQ ID NO: 176611 - DNA, 103 bp, Artificial Sequence
  Synthetic Polynucleotide
taatacgactcactatagggacagcgtatccatcttcaatcaacatgggcaacagaggagagcccatatggattgaagaaacctggcggcagcgcaaaagatg

SEQ ID NO: 176612 - DNA, 103 bp, Artificial Sequence
  Synthetic Polynucleotide
taatacgactcactatagggtgcctgtgtcacagcgtatccatcttcaataacagaggagaattgaaatgggatacgctaacctggcggcagcgcaaaagatg

SEQ ID NO: 176613 - DNA, 103 bp, Artificial Sequence
  Synthetic Polynucleotide
taatacgactcactatagggcaaatagttctgcctgtgtcacagcgtatcaacagaggagagatacgatgtgacacaggaacctggcggcagcgcaaaagatg

SEQ ID NO: 176614 - DNA, 103 bp, Artificial Sequence
  Synthetic Polynucleotide
taatacgactcactatagggcaaagcagggcaaatagttctgcctgtgtcaacagaggagagacacaatgagaactattaacctggcggcagcgcaaaagatg

SEQ ID NO: 176615 - DNA, 103 bp, Artificial Sequence
  Synthetic Polynucleotide
taatacgactcactatagggggccaggcggcaaagcagggcaaatagttcaacagaggagagaactaatggccctgcttaacctggcggcagcgcaaaagatg

SEQ ID NO: 176616 - DNA, 103 bp, Artificial Sequence
  Synthetic Polynucleotide
taatacgactcactataggggcagctcgtcggccaggcggcaaagcagggaacagaggagaccctgcatggccgcctggaacctggcggcagcgcaaaagatg

SEQ ID NO: 176617 - DNA, 103 bp, Artificial Sequence
  Synthetic Polynucleotide
taatacgactcactatagggtgcctaaagagcagctcgtcggccaggcggaacagaggagaccgcctatgcgacgagctaacctggcggcagcgcaaaagatg

SEQ ID NO: 176618 - DNA, 103 bp, Artificial Sequence
  Synthetic Polynucleotide
taatacgactcactatagggccaggcaatctgcctaaagagcagctcgtcaacagaggagagacgagatgctctttaggaacctggcggcagcgcaaaagatg

SEQ ID NO: 176619 - DNA, 103 bp, Artificial Sequence
  Synthetic Polynucleotide
taatacgactcactataggggtttcttgatccaggcaatctgcctaaagaaacagaggagatctttaatgagattgcctaacctggcggcagcgcaaaagatg

SEQ ID NO: 176620 - DNA, 103 bp, Artificial Sequence
  Synthetic Polynucleotide
taatacgactcactatagggtgacagaaaccgttgcgcggcggcggagggaacagaggagaccctccatggccgcgcaaaacctggcggcagcgcaaaagatg

SEQ ID NO: 176621 - DNA, 103 bp, Artificial Sequence
  Synthetic Polynucleotide
taatacgactcactatagggaagaaaggcagtttcttgatccaggcaatcaacagaggagagattgcatggatcaagaaaacctggcggcagcgcaaaagatg

SEQ ID NO: 176622 - DNA, 103 bp, Artificial Sequence
  Synthetic Polynucleotide
taatacgactcactataggggagctcgcagaagaaaggcagtttcttgataacagaggagaatcaagatgctgcctttcaacctggcggcagcgcaaaagatg

SEQ ID NO: 176623 - DNA, 103 bp, Artificial Sequence
  Synthetic Polynucleotide
taatacgactcactatagggccttgattgagagctcgcagaagaaaggcaaacagaggagatgccttatgtctgcgagcaacctggcggcagcgcaaaagatg

SEQ ID NO: 176624 - DNA, 103 bp, Artificial Sequence
  Synthetic Polynucleotide
taatacgactcactatagggcacgtgtaatccttgattgagagctcgcagaacagaggagactgcgaatgctcaatcaaaacctggcggcagcgcaaaagatg

SEQ ID NO: 176625 - DNA, 103 bp, Artificial Sequence
  Synthetic Polynucleotide
taatacgactcactataggggctcaagaggcacgtgtaatccttgattgaaacagaggagatcaatcatggattacacgaacctggcggcagcgcaaaagatg

SEQ ID NO: 176626 - DNA, 103 bp, Artificial Sequence
  Synthetic Polynucleotide
taatacgactcactataggggccacgtagagctcaagaggcacgtgtaataacagaggagaattacaatggcctcttgaaacctggcggcagcgcaaaagatg

SEQ ID NO: 176627 - DNA, 103 bp, Artificial Sequence
  Synthetic Polynucleotide
taatacgactcactatagggattagctcctgccacgtagagctcaagaggaacagaggagacctcttatgctctacgtgaacctggcggcagcgcaaaagatg

SEQ ID NO: 176628 - DNA, 103 bp, Artificial Sequence
  Synthetic Polynucleotide
taatacgactcactatagggagacagcaggattagctcctgccacgtagaaacagaggagatctacgatgcaggagctaaacctggcggcagcgcaaaagatg

SEQ ID NO: 176629 - DNA, 103 bp, Artificial Sequence
  Synthetic Polynucleotide
taatacgactcactatagggcggtgagggaagacagcaggattagctcctaacagaggagaaggagcatgtcctgctgtaacctggcggcagcgcaaaagatg

SEQ ID NO: 176630 - DNA, 103 bp, Artificial Sequence
  Synthetic Polynucleotide
taatacgactcactatagggttgctgtaaacggtgagggaagacagcaggaacagaggagacctgctatgttccctcacaacctggcggcagcgcaaaagatg

SEQ ID NO: 176631 - DNA, 103 bp, Artificial Sequence
  Synthetic Polynucleotide
taatacgactcactatagggttcggtttgggtcactccgtgttcctccataacagaggagaatggagatgcacggagtgaacctggcggcagcgcaaaagatg

SEQ ID NO: 176632 - DNA, 103 bp, Artificial Sequence
  Synthetic Polynucleotide
taatacgactcactatagggagcactcagcatactatgctcggtgtaagtaacagaggagaacttacatggagcatagtaacctggcggcagcgcaaaagatg

SEQ ID NO: 176633 - DNA, 103 bp, Artificial Sequence
  Synthetic Polynucleotide
taatacgactcactatagggcgtggttggcaattctgaagcatcagccaaaacagaggagattggctatggcttcagaaaacctggcggcagcgcaaaagatg

SEQ ID NO: 176634 - DNA, 103 bp, Artificial Sequence
  Synthetic Polynucleotide
taatacgactcactatagggcaacggtgaccgtggttggcaattctgaagaacagaggagacttcagatgtgccaaccaaacctggcggcagcgcaaaagatg

SEQ ID NO: 176635 - DNA, 103 bp, Artificial Sequence
  Synthetic Polynucleotide
taatacgactcactatagggttcacttgggcaacggtgaccgtggttggcaacagaggagagccaacatgggtcaccgtaacctggcggcagcgcaaaagatg

SEQ ID NO: 176636 - DNA, 103 bp, Artificial Sequence
  Synthetic Polynucleotide
taatacgactcactatagggggcagaataattcacttgggcaacggtgacaacagaggagagtcaccatggcccaagtgaacctggcggcagcgcaaaagatg

SEQ ID NO: 176637 - DNA, 103 bp, Artificial Sequence
  Synthetic Polynucleotide
taatacgactcactatagggcatcagccacggcagaataattcacttgggaacagaggagacccaagatgattattctgaacctggcggcagcgcaaaagatg

SEQ ID NO: 176638 - DNA, 103 bp, Artificial Sequence
  Synthetic Polynucleotide
taatacgactcactatagggtccacctctccatcagccacggcagaataaaacagaggagattattcatgcgtggctgaaacctggcggcagcgcaaaagatg

SEQ ID NO: 176639 - DNA, 103 bp, Artificial Sequence
  Synthetic Polynucleotide
taatacgactcactatagggccaattttgttccacctctccatcagccacaacagaggagagtggctatgggagaggtgaacctggcggcagcgcaaaagatg

SEQ ID NO: 176640 - DNA, 103 bp, Artificial Sequence
  Synthetic Polynucleotide
taatacgactcactataggggtaacgtggcccaattttgttccacctctcaacagaggagagagaggatgaacaaaattaacctggcggcagcgcaaaagatg

SEQ ID NO: 176641 - DNA, 103 bp, Artificial Sequence
  Synthetic Polynucleotide
taatacgactcactatagggtcacctccctgtaacgtggcccaattttgtaacagaggagaacaaaaatgggccacgttaacctggcggcagcgcaaaagatg

SEQ ID NO: 176642 - DNA, 103 bp, Artificial Sequence
  Synthetic Polynucleotide
taatacgactcactataggggatggtcatctcacctccctgtaacgtggcaacagaggagagccacgatgcagggaggtaacctggcggcagcgcaaaagatg

SEQ ID NO: 176643 - DNA, 103 bp, Artificial Sequence
  Synthetic Polynucleotide
taatacgactcactatagggagtcttcatcagcactcagcatactatgctaacagaggagaagcataatgtgctgagtgaacctggcggcagcgcaaaagatg

SEQ ID NO: 176644 - DNA, 103 bp, Artificial Sequence
  Synthetic Polynucleotide
taatacgactcactataggggcgtcgtctggatggtcatctcacctccctaacagaggagaagggagatgagatgaccaaacctggcggcagcgcaaaagatg

SEQ ID NO: 176645 - DNA, 103 bp, Artificial Sequence
  Synthetic Polynucleotide
taatacgactcactatagggtctgatgcttgcgtcgtctggatggtcatcaacagaggagagatgacatgccagacgacaacctggcggcagcgcaaaagatg

SEQ ID NO: 176646 - DNA, 103 bp, Artificial Sequence
  Synthetic Polynucleotide
taatacgactcactatagggctgggtggcctctgatgcttgcgtcgtctgaacagaggagacagacgatgcaagcatcaaacctggcggcagcgcaaaagatg

SEQ ID NO: 176647 - DNA, 103 bp, Artificial Sequence
  Synthetic Polynucleotide
taatacgactcactatagggatgccaccgcctgggtggcctctgatgcttaacagaggagaaagcatatgaggccacccaacctggcggcagcgcaaaagatg

SEQ ID NO: 176648 - DNA, 103 bp, Artificial Sequence
  Synthetic Polynucleotide
taatacgactcactatagggtctgccaacgatgccaccgcctgggtggccaacagaggagaggccacatgggcggtggcaacctggcggcagcgcaaaagatg

SEQ ID NO: 176649 - DNA, 103 bp, Artificial Sequence
  Synthetic Polynucleotide
taatacgactcactatagggcactgcggcctctgccaacgatgccaccgcaacagaggagagcggtgatgtcgttggcaaacctggcggcagcgcaaaagatg

SEQ ID NO: 176650 - DNA, 103 bp, Artificial Sequence
  Synthetic Polynucleotide
taatacgactcactataggggagaagctgccactgcggcctctgccaacgaacagaggagacgttggatgaggccgcagaacctggcggcagcgcaaaagatg

SEQ ID NO: 176651 - DNA, 103 bp, Artificial Sequence
  Synthetic Polynucleotide
taatacgactcactatagggtgcatctcctgagaagctgccactgcggccaacagaggagaggccgcatgggcagcttcaacctggcggcagcgcaaaagatg

SEQ ID NO: 176652 - DNA, 103 bp, Artificial Sequence
  Synthetic Polynucleotide
taatacgactcactatagggagctccctgctgcatctcctgagaagctgcaacagaggagagcagctatgcaggagatgaacctggcggcagcgcaaaagatg

SEQ ID NO: 176653 - DNA, 103 bp, Artificial Sequence
  Synthetic Polynucleotide
taatacgactcactatagggtagtgactgtagctccctgctgcatctcctaacagaggagaaggagaatgagcagggagaacctggcggcagcgcaaaagatg

SEQ ID NO: 176654 - DNA, 103 bp, Artificial Sequence
  Synthetic Polynucleotide
taatacgactcactataggggaagaaggcgagtcttcatcagcactcagcaacagaggagagctgagatgtgatgaagaaacctggcggcagcgcaaaagatg

SEQ ID NO: 176655 - DNA, 103 bp, Artificial Sequence
  Synthetic Polynucleotide
taatacgactcactatagggttaagcgccatagtgactgtagctccctgcaacagaggagagcagggatgtacagtcacaacctggcggcagcgcaaaagatg

SEQ ID NO: 176656 - DNA, 103 bp, Artificial Sequence
  Synthetic Polynucleotide
taatacgactcactatagggagcttcgctgttaagcgccatagtgactgtaacagaggagaacagtcatgatggcgcttaacctggcggcagcgcaaaagatg

SEQ ID NO: 176657 - DNA, 103 bp, Artificial Sequence
  Synthetic Polynucleotide
taatacgactcactatagggcatgggcggcagcttcgctgttaagcgccaaacagaggagatggcgcatgacagcgaagaacctggcggcagcgcaaaagatg

SEQ ID NO: 176658 - DNA, 103 bp, Artificial Sequence
  Synthetic Polynucleotide
taatacgactcactataggggtggcgacagcatgggcggcagcttcgctgaacagaggagacagcgaatgtgccgcccaaacctggcggcagcgcaaaagatg

SEQ ID NO: 176659 - DNA, 103 bp, Artificial Sequence
  Synthetic Polynucleotide
taatacgactcactatagggctcagccagggtggcgacagcatgggcggcaacagaggagagccgccatggctgtcgccaacctggcggcagcgcaaaagatg

SEQ ID NO: 176660 - DNA, 103 bp, Artificial Sequence
  Synthetic Polynucleotide
taatacgactcactataggggtaaggtggcctcagccagggtggcgacagaacagaggagactgtcgatgccctggctgaacctggcggcagcgcaaaagatg

SEQ ID NO: 176661 - DNA, 103 bp, Artificial Sequence
  Synthetic Polynucleotide
taatacgactcactatagggcccccaccttgtaaggtggcctcagccaggaacagaggagacctggcatgggccaccttaacctggcggcagcgcaaaagatg

SEQ ID NO: 176662 - DNA, 103 bp, Artificial Sequence
  Synthetic Polynucleotide
taatacgactcactataggggacgatctgtcccccaccttgtaaggtggcaacagaggagagccaccatgcaaggtgggaacctggcggcagcgcaaaagatg

SEQ ID NO: 176663 - DNA, 103 bp, Artificial Sequence
  Synthetic Polynucleotide
taatacgactcactatagggccccagacaagacgatctgtcccccaccttaacagaggagaaaggtgatggacagatcgaacctggcggcagcgcaaaagatg

SEQ ID NO: 176664 - DNA, 103 bp, Artificial Sequence
  Synthetic Polynucleotide
taatacgactcactataggggctgcggtttccccagacaagacgatctgtaacagaggagaacagatatgcttgtctggaacctggcggcagcgcaaaagatg

SEQ ID NO: 176665 - DNA, 103 bp, Artificial Sequence
  Synthetic Polynucleotide
taatacgactcactataggggtcctcgggagaagaaggcgagtcttcatcaacagaggagagatgaaatgtcgccttctaacctggcggcagcgcaaaagatg

SEQ ID NO: 176666 - DNA, 103 bp, Artificial Sequence
  Synthetic Polynucleotide
taatacgactcactatagggtccgacggctgctgcggtttccccagacaaaacagaggagattgtctatggaaaccgcaaacctggcggcagcgcaaaagatg

SEQ ID NO: 176667 - DNA, 103 bp, Artificial Sequence
  Synthetic Polynucleotide
taatacgactcactatagggcagtaagtgctccgacggctgctgcggtttaacagaggagaaaaccgatgcagccgtcgaacctggcggcagcgcaaaagatg

SEQ ID NO: 176668 - DNA, 103 bp, Artificial Sequence
  Synthetic Polynucleotide
taatacgactcactatagggtcttggactccagtaagtgctccgacggctaacagaggagaagccgtatgagcacttacaacctggcggcagcgcaaaagatg

SEQ ID NO: 176669 - DNA, 103 bp, Artificial Sequence
  Synthetic Polynucleotide
taatacgactcactataggggccattagcatcttggactccagtaagtgcaacagaggagagcacttatgggagtccaaaacctggcggcagcgcaaaagatg

SEQ ID NO: 176670 - DNA, 103 bp, Artificial Sequence
  Synthetic Polynucleotide
taatacgactcactatagggtctggaccaggccattagcatcttggactcaacagaggagagagtccatgatgctaatgaacctggcggcagcgcaaaagatg

SEQ ID NO: 176671 - DNA, 103 bp, Artificial Sequence
  Synthetic Polynucleotide
taatacgactcactatagggctcacagggatctggaccaggccattagcaaacagaggagatgctaaatgcctggtccaaacctggcggcagcgcaaaagatg

SEQ ID NO: 176672 - DNA, 103 bp, Artificial Sequence
  Synthetic Polynucleotide
taatacgactcactatagggctggtacatgctcacagggatctggaccagaacagaggagactggtcatgatccctgtgaacctggcggcagcgcaaaagatg

SEQ ID NO: 176673 - DNA, 103 bp, Artificial Sequence
  Synthetic Polynucleotide
taatacgactcactatagggtcaccacagtctggtacatgctcacagggaaacagaggagatccctgatggcatgtaccaacctggcggcagcgcaaaagatg

SEQ ID NO: 176674 - DNA, 103 bp, Artificial Sequence
  Synthetic Polynucleotide
taatacgactcactataggggcgaggctggtcaccacagtctggtacatgaacagaggagacatgtaatggactgtggtaacctggcggcagcgcaaaagatg

SEQ ID NO: 176675 - DNA, 103 bp, Artificial Sequence
  Synthetic Polynucleotide
taatacgactcactataggggttgccctgggcgaggctggtcaccacagtaacagaggagaactgtgatgaccagcctcaacctggcggcagcgcaaaagatg

SEQ ID NO: 176676 - DNA, 103 bp, Artificial Sequence
  Synthetic Polynucleotide
taatacgactcactatagggcgtaagaggtgtcctcgggagaagaaggcgaacagaggagacgccttatgctcccgaggaacctggcggcagcgcaaaagatg

SEQ ID NO: 176677 - DNA, 103 bp, Artificial Sequence
  Synthetic Polynucleotide
taatacgactcactataggggcactggtccgttgccctgggcgaggctggaacagaggagaccagccatgcccagggcaaacctggcggcagcgcaaaagatg

SEQ ID NO: 176678 - DNA, 103 bp, Artificial Sequence
  Synthetic Polynucleotide
taatacgactcactatagggatggccacctgcactggtccgttgccctggaacagaggagaccagggatgcggaccagtaacctggcggcagcgcaaaagatg

SEQ ID NO: 176679 - DNA, 103 bp, Artificial Sequence
  Synthetic Polynucleotide
taatacgactcactatagggcacaggggccatggccacctgcactggtccaacagaggagaggaccaatgcaggtggccaacctggcggcagcgcaaaagatg

SEQ ID NO: 176680 - DNA, 103 bp, Artificial Sequence
  Synthetic Polynucleotide
taatacgactcactatagggtcctggtggtcacaggggccatggccacctaacagaggagaaggtggatgtggcccctgaacctggcggcagcgcaaaagatg

SEQ ID NO: 176681 - DNA, 103 bp, Artificial Sequence
  Synthetic Polynucleotide
taatacgactcactatagggctgtctgatatcctggtggtcacaggggccaacagaggagaggccccatggaccaccagaacctggcggcagcgcaaaagatg

SEQ ID NO: 176682 - DNA, 103 bp, Artificial Sequence
  Synthetic Polynucleotide
taatacgactcactatagggggtgactgcgctgtctgatatcctggtggtaacagaggagaaccaccatgatatcagacaacctggcggcagcgcaaaagatg

SEQ ID NO: 176683 - DNA, 103 bp, Artificial Sequence
  Synthetic Polynucleotide
taatacgactcactatagggggccgtccatggtgactgcgctgtctgataaacagaggagatatcagatggcgcagtcaaacctggcggcagcgcaaaagatg

SEQ ID NO: 176684 - DNA, 103 bp, Artificial Sequence
  Synthetic Polynucleotide
taatacgactcactatagggtccacagcttggccgtccatggtgactgcgaacagaggagacgcagtatgcatggacggaacctggcggcagcgcaaaagatg

SEQ ID NO: 176685 - DNA, 103 bp, Artificial Sequence
  Synthetic Polynucleotide
taatacgactcactatagggtgtcaccacctccacagcttggccgtccataacagaggagaatggacatgcaagctgtgaacctggcggcagcgcaaaagatg

SEQ ID NO: 176686 - DNA, 103 bp, Artificial Sequence
  Synthetic Polynucleotide
taatacgactcactatagggactgttccaatgtcaccacctccacagcttaacagaggagaaagctgatgaggtggtgaaacctggcggcagcgcaaaagatg

SEQ ID NO: 176687 - DNA, 103 bp, Artificial Sequence
  Synthetic Polynucleotide
taatacgactcactatagggtctgagtcatcgtaagaggtgtcctcgggaaacagaggagatcccgaatgcacctcttaaacctggcggcagcgcaaaagatg

SEQ ID NO: 176688 - DNA, 103 bp, Artificial Sequence
  Synthetic Polynucleotide
taatacgactcactataggggttgagtatatctgagtcatcgtaagaggtaacagaggagaacctctatggatgactcaaacctggcggcagcgcaaaagatg

SEQ ID NO: 176689 - DNA, 103 bp, Artificial Sequence
  Synthetic Polynucleotide
taatacgactcactatagggctgctgtggagttgagtatatctgagtcataacagaggagaatgactatgatatactcaaacctggcggcagcgcaaaagatg

SEQ ID NO: 176690 - DNA, 103 bp, Artificial Sequence
  Synthetic Polynucleotide
taatacgactcactatagggacctcatcagctgctgtggagttgagtataaacagaggagatatactatgctccacagcaacctggcggcagcgcaaaagatg

SEQ ID NO: 176691 - DNA, 103 bp, Artificial Sequence
  Synthetic Polynucleotide
taatacgactcactatagggatgagctgtcacctcatcagctgctgtggaaacagaggagatccacaatggctgatgagaacctggcggcagcgcaaaagatg

SEQ ID NO: 176692 - DNA, 103 bp, Artificial Sequence
  Synthetic Polynucleotide
taatacgactcactatagggtagccatatgttcggtttgggtcactccgtaacagaggagaacggagatgcccaaaccgaacctggcggcagcgcaaaagatg

SEQ ID NO: 176693 - DNA, 103 bp, Artificial Sequence
  Synthetic Polynucleotide
taatacgactcactatagggcagctgccagatgagctgtcacctcatcagaacagaggagactgatgatgtgacagctcaacctggcggcagcgcaaaagatg

SEQ ID NO: 176694 - DNA, 103 bp, Artificial Sequence
  Synthetic Polynucleotide
taatacgactcactatagggacaggacctgcagctgccagatgagctgtcaacagaggagagacagcatgtctggcagcaacctggcggcagcgcaaaagatg

SEQ ID NO: 176695 - DNA, 103 bp, Artificial Sequence
  Synthetic Polynucleotide
taatacgactcactatagggggccattcccacaggacctgcagctgccagaacagaggagactggcaatggcaggtcctaacctggcggcagcgcaaaagatg

SEQ ID NO: 176696 - DNA, 103 bp, Artificial Sequence
  Synthetic Polynucleotide
taatacgactcactatagggcagcagcagcggccattcccacaggacctgaacagaggagacaggtcatgtgggaatggaacctggcggcagcgcaaaagatg

SEQ ID NO: 176697 - DNA, 103 bp, Artificial Sequence
  Synthetic Polynucleotide
taatacgactcactataggggttgccacagcagcagcagcggccattcccaacagaggagagggaatatgcgctgctgcaacctggcggcagcgcaaaagatg

SEQ ID NO: 176698 - DNA, 103 bp, Artificial Sequence
  Synthetic Polynucleotide
taatacgactcactatagggtttctttcctgttgccacagcagcagcagcaacagaggagagctgctatggctgtggcaaacctggcggcagcgcaaaagatg

SEQ ID NO: 176699 - DNA, 103 bp, Artificial Sequence
  Synthetic Polynucleotide
taatacgactcactataggggccgtttccgtttctttcctgttgccacagaacagaggagactgtggatgcaggaaagaaacctggcggcagcgcaaaagatg

SEQ ID NO: 176700 - DNA, 103 bp, Artificial Sequence
  Synthetic Polynucleotide
taatacgactcactatagggaatacatgaggccgtttccgtttctttcctaacagaggagaaggaaaatgacggaaacgaacctggcggcagcgcaaaagatg

SEQ ID NO: 176701 - DNA, 103 bp, Artificial Sequence
  Synthetic Polynucleotide
taatacgactcactatagggattagactcaaatacatgaggccgtttccgaacagaggagacggaaaatgcctcatgtaaacctggcggcagcgcaaaagatg

SEQ ID NO: 176702 - DNA, 103 bp, Artificial Sequence
  Synthetic Polynucleotide
taatacgactcactatagggggatagatggattagactcaaatacatgagaacagaggagactcatgatgttgagtctaaacctggcggcagcgcaaaagatg

SEQ ID NO: 176703 - DNA, 103 bp, Artificial Sequence
  Synthetic Polynucleotide
taatacgactcactataggggcttctatggtagccatatgttcggtttggaacagaggagaccaaacatgacatatggcaacctggcggcagcgcaaaagatg

SEQ ID NO: 176704 - DNA, 103 bp, Artificial Sequence
  Synthetic Polynucleotide
taatacgactcactatagggtgcctcttccggatagatggattagactcaaacagaggagatgagtcatgtccatctataacctggcggcagcgcaaaagatg

SEQ ID NO: 176705 - DNA, 103 bp, Artificial Sequence
  Synthetic Polynucleotide
taatacgactcactatagggacgtgtttgttgcctcttccggatagatggaacagaggagaccatctatgcggaagaggaacctggcggcagcgcaaaagatg

SEQ ID NO: 176706 - DNA, 103 bp, Artificial Sequence
  Synthetic Polynucleotide
taatacgactcactatagggtccgaagcaaacgtgtttgttgcctcttccaacagaggagaggaagaatgaacaaacacaacctggcggcagcgcaaaagatg

SEQ ID NO: 176707 - DNA, 103 bp, Artificial Sequence
  Synthetic Polynucleotide
taatacgactcactataggggctcgaagtttccgaagcaaacgtgtttgtaacagaggagaacaaacatgtttgcttcgaacctggcggcagcgcaaaagatg

SEQ ID NO: 176708 - DNA, 103 bp, Artificial Sequence
  Synthetic Polynucleotide
taatacgactcactatagggatctaacgtggctcgaagtttccgaagcaaaacagaggagattgcttatgaaacttcgaaacctggcggcagcgcaaaagatg

SEQ ID NO: 176709 - DNA, 103 bp, Artificial Sequence
  Synthetic Polynucleotide
taatacgactcactatagggtagtatattcatctaacgtggctcgaagttaacagaggagaaacttcatgccacgttagaacctggcggcagcgcaaaagatg

SEQ ID NO: 176710 - DNA, 103 bp, Artificial Sequence
  Synthetic Polynucleotide
taatacgactcactatagggcccacacgagtagtatattcatctaacgtgaacagaggagacacgttatgtgaatatacaacctggcggcagcgcaaaagatg

SEQ ID NO: 176711 - DNA, 103 bp, Artificial Sequence
  Synthetic Polynucleotide
taatacgactcactatagggagcttgctgtcccacacgagtagtatattcaacagaggagagaatatatgactcgtgtgaacctggcggcagcgcaaaagatg

SEQ ID NO: 176712 - DNA, 103 bp, Artificial Sequence
  Synthetic Polynucleotide
taatacgactcactatagggagaggacaatagcttgctgtcccacacgagaacagaggagactcgtgatggacagcaagaacctggcggcagcgcaaaagatg

SEQ ID NO: 176713 - DNA, 103 bp, Artificial Sequence
  Synthetic Polynucleotide
taatacgactcactatagggggtgagatacagaggacaatagcttgctgtaacagaggagaacagcaatgtattgtcctaacctggcggcagcgcaaaagatg

SEQ ID NO: 176714 - DNA, 103 bp, Artificial Sequence
  Synthetic Polynucleotide
taatacgactcactatagggcactgcatgtgcttctatggtagccatatgaacagaggagacatatgatgaccatagaaaacctggcggcagcgcaaaagatg

SEQ ID NO: 176715 - DNA, 103 bp, Artificial Sequence
  Synthetic Polynucleotide
taatacgactcactatagggaggtttggagggtgagatacagaggacaataacagaggagaattgtcatgtgtatctcaaacctggcggcagcgcaaaagatg

SEQ ID NO: 176716 - DNA, 103 bp, Artificial Sequence
  Synthetic Polynucleotide
taatacgactcactatagggagacagggttaggtttggagggtgagatacaacagaggagagtatctatgcctccaaacaacctggcggcagcgcaaaagatg

SEQ ID NO: 176717 - DNA, 103 bp, Artificial Sequence
  Synthetic Polynucleotide
taatacgactcactatagggaacactttaaagacagggttaggtttggagaacagaggagactccaaatgtaaccctgtaacctggcggcagcgcaaaagatg

SEQ ID NO: 176718 - DNA, 103 bp, Artificial Sequence
  Synthetic Polynucleotide
taatacgactcactatagggtgctgcaccaaacactttaaagacagggttaacagaggagaaaccctatgtttaaagtgaacctggcggcagcgcaaaagatg

SEQ ID NO: 176719 - DNA, 103 bp, Artificial Sequence
  Synthetic Polynucleotide
taatacgactcactatagggtctccaaaggtgctgcaccaaacactttaaaacagaggagattaaagatgttggtgcagaacctggcggcagcgcaaaagatg

SEQ ID NO: 176720 - DNA, 103 bp, Artificial Sequence
  Synthetic Polynucleotide
taatacgactcactatagggcgcaccacattctccaaaggtgctgcaccaaacagaggagatggtgcatgacctttggaaacctggcggcagcgcaaaagatg

SEQ ID NO: 176721 - DNA, 103 bp, Artificial Sequence
  Synthetic Polynucleotide
taatacgactcactatagggcttgtacttacgcaccacattctccaaaggaacagaggagacctttgatgaatgtggtgaacctggcggcagcgcaaaagatg

SEQ ID NO: 176722 - DNA, 103 bp, Artificial Sequence
  Synthetic Polynucleotide
taatacgactcactatagggggatcatgctcttgtacttacgcaccacataacagaggagaatgtggatggtaagtacaaacctggcggcagcgcaaaagatg

SEQ ID NO: 176723 - DNA, 103 bp, Artificial Sequence
  Synthetic Polynucleotide
taatacgactcactatagggaggtcttccaggatcatgctcttgtacttaaacagaggagataagtaatggagcatgataacctggcggcagcgcaaaagatg

SEQ ID NO: 176724 - DNA, 103 bp, Artificial Sequence
  Synthetic Polynucleotide
taatacgactcactatagggagcagactccaggtcttccaggatcatgctaacagaggagaagcatgatgctggaagacaacctggcggcagcgcaaaagatg

SEQ ID NO: 176725 - DNA, 103 bp, Artificial Sequence
  Synthetic Polynucleotide
taatacgactcactatagggcttgctgggccactgcatgtgcttctatggaacagaggagaccatagatgcacatgcagaacctggcggcagcgcaaaagatg

SEQ ID NO: 176726 - DNA, 103 bp, Artificial Sequence
  Synthetic Polynucleotide
taatacgactcactataggggttctgccagagcagactccaggtcttccaaacagaggagatggaagatgtggagtctgaacctggcggcagcgcaaaagatg

SEQ ID NO: 176727 - DNA, 103 bp, Artificial Sequence
  Synthetic Polynucleotide
taatacgactcactataggggcaggggcgtgttctgccagagcagactccaacagaggagaggagtcatgtctggcagaaacctggcggcagcgcaaaagatg

SEQ ID NO: 176728 - DNA, 103 bp, Artificial Sequence
  Synthetic Polynucleotide
taatacgactcactatagggctcctgtggcgcaggggcgtgttctgccagaacagaggagactggcaatgcacgcccctaacctggcggcagcgcaaaagatg

SEQ ID NO: 176729 - DNA, 103 bp, Artificial Sequence
  Synthetic Polynucleotide
taatacgactcactatagggctgagttaacctcctgtggcgcaggggcgtaacagaggagaacgcccatgcgccacaggaacctggcggcagcgcaaaagatg

SEQ ID NO: 176730 - DNA, 103 bp, Artificial Sequence
  Synthetic Polynucleotide
taatacgactcactatagggggcggcagttctgagttaacctcctgtggcaacagaggagagccacaatgggttaactcaacctggcggcagcgcaaaagatg

SEQ ID NO: 176731 - DNA, 103 bp, Artificial Sequence
  Synthetic Polynucleotide
taatacgactcactataggggatggtgagaggcggcagttctgagttaacaacagaggagagttaacatggaactgccgaacctggcggcagcgcaaaagatg

SEQ ID NO: 176732 - DNA, 103 bp, Artificial Sequence
  Synthetic Polynucleotide
taatacgactcactataggggaattccgtcgatggtgagaggcggcagttaacagaggagaaactgcatgctctcaccaaacctggcggcagcgcaaaagatg

SEQ ID NO: 176733 - DNA, 103 bp, Artificial Sequence
  Synthetic Polynucleotide
taatacgactcactatagggacagagactggaattccgtcgatggtgagaaacagaggagatctcacatgcgacggaataacctggcggcagcgcaaaagatg

SEQ ID NO: 176734 - DNA, 103 bp, Artificial Sequence
  Synthetic Polynucleotide
taatacgactcactatagggcattttgtccacagagactggaattccgtcaacagaggagagacggaatgccagtctctaacctggcggcagcgcaaaagatg

SEQ ID NO: 176735 - DNA, 103 bp, Artificial Sequence
  Synthetic Polynucleotide
taatacgactcactataggggggcctgggtcattttgtccacagagactgaacagaggagacagtctatgtggacaaaaaacctggcggcagcgcaaaagatg

SEQ ID NO: 176736 - DNA, 103 bp, Artificial Sequence
  Synthetic Polynucleotide
taatacgactcactatagggacctgctgcacttgctgggccactgcatgtaacagaggagaacatgcatgggcccagcaaacctggcggcagcgcaaaagatg

SEQ ID NO: 176737 - DNA, 103 bp, Artificial Sequence
  Synthetic Polynucleotide
taatacgactcactataggggcccgaagctgggcctgggtcattttgtccaacagaggagaggacaaatggacccaggcaacctggcggcagcgcaaaagatg

SEQ ID NO: 176738 - DNA, 103 bp, Artificial Sequence
  Synthetic Polynucleotide
taatacgactcactatagggtgggataaatgcccgaagctgggcctgggtaacagaggagaacccagatgcagcttcggaacctggcggcagcgcaaaagatg

SEQ ID NO: 176739 - DNA, 103 bp, Artificial Sequence
  Synthetic Polynucleotide
taatacgactcactatagggtgagcatctctgggataaatgcccgaagctaacagaggagaagcttcatgcatttatccaacctggcggcagcgcaaaagatg

SEQ ID NO: 176740 - DNA, 103 bp, Artificial Sequence
  Synthetic Polynucleotide
taatacgactcactataggggtagagtacttgagcatctctgggataaataacagaggagaatttatatgagagatgctaacctggcggcagcgcaaaagatg

SEQ ID NO: 176741 - DNA, 103 bp, Artificial Sequence
  Synthetic Polynucleotide
taatacgactcactatagggtccccgacctgtagagtacttgagcatctcaacagaggagagagatgatgaagtactctaacctggcggcagcgcaaaagatg

SEQ ID NO: 176742 - DNA, 103 bp, Artificial Sequence
  Synthetic Polynucleotide
taatacgactcactatagggagcctggttttccccgacctgtagagtactaacagaggagaagtactatgcaggtcgggaacctggcggcagcgcaaaagatg

SEQ ID NO: 176743 - DNA, 103 bp, Artificial Sequence
  Synthetic Polynucleotide
taatacgactcactatagggtctttcccccagcctggttttccccgacctaacagaggagaaggtcgatgaaaaccaggaacctggcggcagcgcaaaagatg

SEQ ID NO: 176744 - DNA, 103 bp, Artificial Sequence
  Synthetic Polynucleotide
taatacgactcactatagggcttgcagctttctttcccccagcctggtttaacagaggagaaaaccaatgtgggggaaaaacctggcggcagcgcaaaagatg

SEQ ID NO: 176745 - DNA, 103 bp, Artificial Sequence
  Synthetic Polynucleotide
taatacgactcactatagggaccagatgggcttgcagctttctttcccccaacagaggagagggggaatgaaagctgcaaacctggcggcagcgcaaaagatg

SEQ ID NO: 176746 - DNA, 103 bp, Artificial Sequence
  Synthetic Polynucleotide
taatacgactcactatagggtcttcaggccaccagatgggcttgcagcttaacagaggagaaagctgatggcccatctgaacctggcggcagcgcaaaagatg

SEQ ID NO: 176747 - DNA, 103 bp, Artificial Sequence
  Synthetic Polynucleotide
taatacgactcactatagggagccacatggacctgctgcacttgctgggcaacagaggagagcccagatggtgcagcagaacctggcggcagcgcaaaagatg

SEQ ID NO: 176748 - DNA, 103 bp, Artificial Sequence
  Synthetic Polynucleotide
taatacgactcactatagggccaggggatatcttcaggccaccagatgggaacagaggagacccatcatgtggcctgaaaacctggcggcagcgcaaaagatg

SEQ ID NO: 176749 - DNA, 103 bp, Artificial Sequence
  Synthetic Polynucleotide
taatacgactcactatagggggacatttgcccaggggatatcttcaggccaacagaggagaggcctgatgatatcccctaacctggcggcagcgcaaaagatg

SEQ ID NO: 176750 - DNA, 103 bp, Artificial Sequence
  Synthetic Polynucleotide
taatacgactcactatagggacatcactccggacatttgcccaggggataaacagaggagatatcccatgggcaaatgtaacctggcggcagcgcaaaagatg

SEQ ID NO: 176751 - DNA, 103 bp, Artificial Sequence
  Synthetic Polynucleotide
taatacgactcactatagggttctgtgcggacatcactccggacatttgcaacagaggagagcaaatatgcggagtgataacctggcggcagcgcaaaagatg

SEQ ID NO: 176752 - DNA, 103 bp, Artificial Sequence
  Synthetic Polynucleotide
taatacgactcactataggggcttttgctcttctgtgcggacatcactccaacagaggagaggagtgatgtccgcacagaacctggcggcagcgcaaaagatg

SEQ ID NO: 176753 - DNA, 103 bp, Artificial Sequence
  Synthetic Polynucleotide
taatacgactcactataggggaaaccctctgcttttgctcttctgtgcggaacagaggagaccgcacatgagagcaaaaaacctggcggcagcgcaaaagatg

SEQ ID NO: 176754 - DNA, 103 bp, Artificial Sequence
  Synthetic Polynucleotide
taatacgactcactatagggctgggtccatgaaaccctctgcttttgctcaacagaggagagagcaaatgcagagggttaacctggcggcagcgcaaaagatg

SEQ ID NO: 176755 - DNA, 103 bp, Artificial Sequence
  Synthetic Polynucleotide
taatacgactcactatagggtccgtagtgcctgggtccatgaaaccctctaacagaggagaagagggatgcatggacccaacctggcggcagcgcaaaagatg

SEQ ID NO: 176756 - DNA, 103 bp, Artificial Sequence
  Synthetic Polynucleotide
taatacgactcactatagggttaactatggtccgtagtgcctgggtccataacagaggagaatggacatgggcactacgaacctggcggcagcgcaaaagatg

SEQ ID NO: 176757 - DNA, 103 bp, Artificial Sequence
  Synthetic Polynucleotide
taatacgactcactatagggataacagtttttaactatggtccgtagtgcaacagaggagagcactaatgaccatagttaacctggcggcagcgcaaaagatg

SEQ ID NO: 176758 - DNA, 103 bp, Artificial Sequence
  Synthetic Polynucleotide
taatacgactcactatagggcggtgtaagtagccacatggacctgctgcaaacagaggagatgcagcatgtccatgtggaacctggcggcagcgcaaaagatg

SEQ ID NO: 176759 - DNA, 103 bp, Artificial Sequence
  Synthetic Polynucleotide
taatacgactcactatagggcatgctgtttataacagtttttaactatggaacagaggagaccatagatgaaaactgttaacctggcggcagcgcaaaagatg

SEQ ID NO: 176760 - DNA, 103 bp, Artificial Sequence
  Synthetic Polynucleotide
taatacgactcactatagggtcttcccgcccatgctgtttataacagtttaacagaggagaaaactgatgtaaacagcaaacctggcggcagcgcaaaagatg

SEQ ID NO: 176761 - DNA, 103 bp, Artificial Sequence
  Synthetic Polynucleotide
taatacgactcactatagggatacaaaaggtcttcccgcccatgctgtttaacagaggagaaaacagatggggcgggaaaacctggcggcagcgcaaaagatg

SEQ ID NO: 176762 - DNA, 103 bp, Artificial Sequence
  Synthetic Polynucleotide
taatacgactcactatagggcttcaaaggcatacaaaaggtcttcccgccaacagaggagaggcgggatgaccttttgtaacctggcggcagcgcaaaagatg

SEQ ID NO: 176763 - DNA, 103 bp, Artificial Sequence
  Synthetic Polynucleotide
taatacgactcactataggggtttgctgatcttcaaaggcatacaaaaggaacagaggagaccttttatgtgcctttgaaacctggcggcagcgcaaaagatg

SEQ ID NO: 176764 - DNA, 103 bp, Artificial Sequence
  Synthetic Polynucleotide
taatacgactcactatagggctgtgtttgcgtttgctgatcttcaaaggcaacagaggagagcctttatggatcagcaaaacctggcggcagcgcaaaagatg

SEQ ID NO: 176765 - DNA, 103 bp, Artificial Sequence
  Synthetic Polynucleotide
taatacgactcactatagggtggctgtggcctgtgtttgcgtttgctgataacagaggagaatcagcatgcgcaaacacaacctggcggcagcgcaaaagatg

SEQ ID NO: 176766 - DNA, 103 bp, Artificial Sequence
  Synthetic Polynucleotide
taatacgactcactatagggatactatgtgtggctgtggcctgtgtttgcaacagaggagagcaaacatgggccacagcaacctggcggcagcgcaaaagatg

SEQ ID NO: 176767 - DNA, 103 bp, Artificial Sequence
  Synthetic Polynucleotide
taatacgactcactatagggaagatgagctatactatgtgtggctgtggcaacagaggagagccacaatgacacatagtaacctggcggcagcgcaaaagatg

SEQ ID NO: 176768 - DNA, 103 bp, Artificial Sequence
  Synthetic Polynucleotide
taatacgactcactataggggtgatggtacaagatgagctatactatgtgaacagaggagacacataatgtagctcatcaacctggcggcagcgcaaaagatg

SEQ ID NO: 176769 - DNA, 103 bp, Artificial Sequence
  Synthetic Polynucleotide
taatacgactcactatagggatactatgctcggtgtaagtagccacatggaacagaggagaccatgtatgtacttacacaacctggcggcagcgcaaaagatg

SEQ ID NO: 176770 - DNA, 103 bp, Artificial Sequence
  Synthetic Polynucleotide
taatacgactcactatagggactacagtctgtgatggtacaagatgagctaacagaggagaagctcaatgtgtaccatcaacctggcggcagcgcaaaagatg

SEQ ID NO: 176771 - DNA, 103 bp, Artificial Sequence
  Synthetic Polynucleotide
taatacgactcactatagggaaaagtctggactacagtctgtgatggtacaacagaggagagtaccaatgcagactgtaaacctggcggcagcgcaaaagatg

SEQ ID NO: 176772 - DNA, 103 bp, Artificial Sequence
  Synthetic Polynucleotide
taatacgactcactatagggcagggttactaaaagtctggactacagtctaacagaggagaagactgatgtccagacttaacctggcggcagcgcaaaagatg

SEQ ID NO: 176773 - DNA, 103 bp, Artificial Sequence
  Synthetic Polynucleotide
taatacgactcactatagggacagtgccatcagggttactaaaagtctggaacagaggagaccagacatgtagtaacccaacctggcggcagcgcaaaagatg

SEQ ID NO: 176774 - DNA, 103 bp, Artificial Sequence
  Synthetic Polynucleotide
taatacgactcactataggggataagtgagacagtgccatcagggttactaacagaggagaagtaacatggatggcactaacctggcggcagcgcaaaagatg

SEQ ID NO: 176775 - DNA, 103 bp, Artificial Sequence
  Synthetic Polynucleotide
taatacgactcactatagggtaccaacctggataagtgagacagtgccataacagaggagaatggcaatgtctcacttaaacctggcggcagcgcaaaagatg

SEQ ID NO: 176776 - DNA, 103 bp, Artificial Sequence
  Synthetic Polynucleotide
taatacgactcactataggggttgcccccgtaccaacctggataagtgagaacagaggagactcactatgccaggttggaacctggcggcagcgcaaaagatg

SEQ ID NO: 176777 - DNA, 103 bp, Artificial Sequence
  Synthetic Polynucleotide
taatacgactcactatagggtgtggctactgttgcccccgtaccaacctgaacagaggagacaggttatgacgggggcaaacctggcggcagcgcaaaagatg

SEQ ID NO: 176778 - DNA, 103 bp, Artificial Sequence
  Synthetic Polynucleotide
taatacgactcactatagggcatcagccaatgtggctactgttgcccccgaacagaggagacgggggatgcagtagccaaacctggcggcagcgcaaaagatg

SEQ ID NO: 176779 - DNA, 103 bp, Artificial Sequence
  Synthetic Polynucleotide
taatacgactcactatagggaattctgaagcatcagccaatgtggctactaacagaggagaagtagcatgattggctgaaacctggcggcagcgcaaaagatg

SEQ ID NO: 176780 - DNA, 103 bp, Artificial Sequence
  Synthetic Polynucleotide
taatacgactcactatagggatcagagccaagctcttctccatgagtcataacagaggagaatgactatgggagaagagaacctggcggcagcgcaaaagatg

SEQ ID NO: 176781 - DNA, 103 bp, Artificial Sequence
  Synthetic Polynucleotide
taatacgactcactatagggctttttgtcaacggcagtacctgatcccccaacagaggagagggggaatgggtactgccaacctggcggcagcgcaaaagatg

SEQ ID NO: 176782 - DNA, 103 bp, Artificial Sequence
  Synthetic Polynucleotide
taatacgactcactatagggtttgctagccatcagtttgcttgatgatgtaacagaggagaacatcaatgagcaaactgaacctggcggcagcgcaaaagatg

SEQ ID NO: 176783 - DNA, 103 bp, Artificial Sequence
  Synthetic Polynucleotide
taatacgactcactatagggtagcactacttttgctagccatcagtttgcaacagaggagagcaaacatgtggctagcaaacctggcggcagcgcaaaagatg

SEQ ID NO: 176784 - DNA, 103 bp, Artificial Sequence
  Synthetic Polynucleotide
taatacgactcactatagggtgaaacactgtagcactacttttgctagccaacagaggagaggctagatgaagtagtgcaacctggcggcagcgcaaaagatg

SEQ ID NO: 176785 - DNA, 103 bp, Artificial Sequence
  Synthetic Polynucleotide
taatacgactcactatagggcattggattttgaaacactgtagcactactaacagaggagaagtagtatgacagtgtttaacctggcggcagcgcaaaagatg

SEQ ID NO: 176786 - DNA, 103 bp, Artificial Sequence
  Synthetic Polynucleotide
taatacgactcactataggggaatgatacccattggattttgaaacactgaacagaggagacagtgtatgaaaatccaaaacctggcggcagcgcaaaagatg

SEQ ID NO: 176787 - DNA, 103 bp, Artificial Sequence
  Synthetic Polynucleotide
taatacgactcactatagggggggaagaaggaatgatacccattggatttaacagaggagaaaatccatggggtatcataacctggcggcagcgcaaaagatg

SEQ ID NO: 176788 - DNA, 103 bp, Artificial Sequence
  Synthetic Polynucleotide
taatacgactcactatagggtgcatttttaggggaagaaggaatgataccaacagaggagaggtatcatgccttcttccaacctggcggcagcgcaaaagatg

SEQ ID NO: 176789 - DNA, 103 bp, Artificial Sequence
  Synthetic Polynucleotide
taatacgactcactatagggtcttataacctgcatttttaggggaagaagaacagaggagacttcttatgctaaaaatgaacctggcggcagcgcaaaagatg

SEQ ID NO: 176790 - DNA, 103 bp, Artificial Sequence
  Synthetic Polynucleotide
taatacgactcactatagggtccagtgagttcttataacctgcatttttaaacagaggagataaaaaatgaggttataaaacctggcggcagcgcaaaagatg

SEQ ID NO: 176791 - DNA, 103 bp, Artificial Sequence
  Synthetic Polynucleotide
taatacgactcactatagggattgtttctttccagtgagttcttataaccaacagaggagaggttatatgaactcactgaacctggcggcagcgcaaaagatg

SEQ ID NO: 176792 - DNA, 103 bp, Artificial Sequence
  Synthetic Polynucleotide
taatacgactcactataggggcccagcagactttttgtcaacggcagtacaacagaggagagtactgatgttgacaaaaaacctggcggcagcgcaaaagatg

SEQ ID NO: 176793 - DNA, 103 bp, Artificial Sequence
  Synthetic Polynucleotide
taatacgactcactatagggcttgttttatattgtttctttccagtgagtaacagaggagaactcacatgaaagaaacaaacctggcggcagcgcaaaagatg

SEQ ID NO: 176794 - DNA, 103 bp, Artificial Sequence
  Synthetic Polynucleotide
taatacgactcactatagggttgttagcagcttgttttatattgtttcttaacagaggagaaagaaaatgtataaaacaaacctggcggcagcgcaaaagatg

SEQ ID NO: 176795 - DNA, 103 bp, Artificial Sequence
  Synthetic Polynucleotide
taatacgactcactatagggaagcaaactattgttagcagcttgttttataacagaggagaataaaaatggctgctaacaacctggcggcagcgcaaaagatg

SEQ ID NO: 176796 - DNA, 103 bp, Artificial Sequence
  Synthetic Polynucleotide
taatacgactcactataggggaagatgtaaaagcaaactattgttagcagaacagaggagactgctaatgatagtttgcaacctggcggcagcgcaaaagatg

SEQ ID NO: 176797 - DNA, 103 bp, Artificial Sequence
  Synthetic Polynucleotide
taatacgactcactatagggtggcttttaagaagatgtaaaagcaaactaaacagaggagatagtttatgtttacatctaacctggcggcagcgcaaaagatg

SEQ ID NO: 176798 - DNA, 103 bp, Artificial Sequence
  Synthetic Polynucleotide
taatacgactcactatagggaggtatagtctggcttttaagaagatgtaaaacagaggagattacatatgcttaaaagcaacctggcggcagcgcaaaagatg

SEQ ID NO: 176799 - DNA, 103 bp, Artificial Sequence
  Synthetic Polynucleotide
taatacgactcactatagggtcattggcttaggtatagtctggcttttaaaacagaggagattaaaaatgagactatacaacctggcggcagcgcaaaagatg

SEQ ID NO: 176800 - DNA, 103 bp, Artificial Sequence
  Synthetic Polynucleotide
taatacgactcactatagggctgtgtccattcattggcttaggtatagtcaacagaggagagactatatgtaagccaataacctggcggcagcgcaaaagatg

SEQ ID NO: 176801 - DNA, 103 bp, Artificial Sequence
  Synthetic Polynucleotide
taatacgactcactatagggctcactgtgactgtgtccattcattggcttaacagaggagaaagccaatgaatggacacaacctggcggcagcgcaaaagatg

SEQ ID NO: 176802 - DNA, 103 bp, Artificial Sequence
  Synthetic Polynucleotide
taatacgactcactatagggtgcttcctctctcactgtgactgtgtccataacagaggagaatggacatggtcacagtgaacctggcggcagcgcaaaagatg

SEQ ID NO: 176803 - DNA, 103 bp, Artificial Sequence
  Synthetic Polynucleotide
taatacgactcactatagggtcttcattatgcccagcagactttttgtcaaacagaggagatgacaaatggtctgctggaacctggcggcagcgcaaaagatg

SEQ ID NO: 176804 - DNA, 103 bp, Artificial Sequence
  Synthetic Polynucleotide
taatacgactcactatagggtcctcaaaaatgcttcctctctcactgtgaaacagaggagatcacagatggagaggaagaacctggcggcagcgcaaaagatg

SEQ ID NO: 176805 - DNA, 103 bp, Artificial Sequence
  Synthetic Polynucleotide
taatacgactcactatagggtgtactactttcctcaaaaatgcttcctctaacagaggagaagaggaatgatttttgagaacctggcggcagcgcaaaagatg

SEQ ID NO: 176806 - DNA, 103 bp, Artificial Sequence
  Synthetic Polynucleotide
taatacgactcactatagggtagttgtaggtgtactactttcctcaaaaaaacagaggagatttttgatgaaagtagtaaacctggcggcagcgcaaaagatg

SEQ ID NO: 176807 - DNA, 103 bp, Artificial Sequence
  Synthetic Polynucleotide
taatacgactcactatagggtattcatcaatagttgtaggtgtactacttaacagaggagaaagtagatgacctacaacaacctggcggcagcgcaaaagatg

SEQ ID NO: 176808 - DNA, 103 bp, Artificial Sequence
  Synthetic Polynucleotide
taatacgactcactataggggttatctgaatattcatcaatagttgtaggaacagaggagacctacaatgattgatgaaaacctggcggcagcgcaaaagatg

SEQ ID NO: 176809 - DNA, 103 bp, Artificial Sequence
  Synthetic Polynucleotide
taatacgactcactatagggaactaggattgttatctgaatattcatcaaaacagaggagattgatgatgattcagataaacctggcggcagcgcaaaagatg

SEQ ID NO: 176810 - DNA, 103 bp, Artificial Sequence
  Synthetic Polynucleotide
taatacgactcactatagggtcatctgtaaaactaggattgttatctgaaaacagaggagattcagaatgcaatcctagaacctggcggcagcgcaaaagatg

SEQ ID NO: 176811 - DNA, 103 bp, Artificial Sequence
  Synthetic Polynucleotide
taatacgactcactatagggaccactgctgtcatctgtaaaactaggattaacagaggagaaatcctatgtttacagataacctggcggcagcgcaaaagatg

SEQ ID NO: 176812 - DNA, 103 bp, Artificial Sequence
  Synthetic Polynucleotide
taatacgactcactatagggaactttcatcaccactgctgtcatctgtaaaacagaggagattacagatgacagcagtgaacctggcggcagcgcaaaagatg

SEQ ID NO: 176813 - DNA, 103 bp, Artificial Sequence
  Synthetic Polynucleotide
taatacgactcactatagggttggaataagaactttcatcaccactgctgaacagaggagacagcagatgtgatgaaagaacctggcggcagcgcaaaagatg

SEQ ID NO: 176814 - DNA, 103 bp, Artificial Sequence
  Synthetic Polynucleotide
taatacgactcactataggggttctgatcctcttcattatgcccagcagaaacagaggagatctgctatgcataatgaaaacctggcggcagcgcaaaagatg

SEQ ID NO: 176815 - DNA, 103 bp, Artificial Sequence
  Synthetic Polynucleotide
taatacgactcactataggggggaacacagttggaataagaactttcatcaacagaggagagatgaaatgtcttattccaacctggcggcagcgcaaaagatg

SEQ ID NO: 176816 - DNA, 103 bp, Artificial Sequence
  Synthetic Polynucleotide
taatacgactcactatagggacaagtctatgggaacacagttggaataagaacagaggagacttattatgactgtgttcaacctggcggcagcgcaaaagatg

SEQ ID NO: 176817 - DNA, 103 bp, Artificial Sequence
  Synthetic Polynucleotide
taatacgactcactatagggtgtttgcaagacaagtctatgggaacacagaacagaggagactgtgtatgcatagacttaacctggcggcagcgcaaaagatg

SEQ ID NO: 176818 - DNA, 103 bp, Artificial Sequence
  Synthetic Polynucleotide
taatacgactcactatagggttcagttcggtgtttgcaagacaagtctataacagaggagaatagacatgtcttgcaaaaacctggcggcagcgcaaaagatg

SEQ ID NO: 176819 - DNA, 103 bp, Artificial Sequence
  Synthetic Polynucleotide
taatacgactcactatagggattctgatttttcagttcggtgtttgcaagaacagaggagacttgcaatgaccgaactgaacctggcggcagcgcaaaagatg

SEQ ID NO: 176820 - DNA, 103 bp, Artificial Sequence
  Synthetic Polynucleotide
taatacgactcactatagggggttggtcagattctgatttttcagttcggaacagaggagaccgaacatgaaaatcagaaacctggcggcagcgcaaaagatg

SEQ ID NO: 176821 - DNA, 103 bp, Artificial Sequence
  Synthetic Polynucleotide
taatacgactcactatagggcagggaaacaggttggtcagattctgatttaacagaggagaaaatcaatgtctgaccaaaacctggcggcagcgcaaaagatg

SEQ ID NO: 176822 - DNA, 103 bp, Artificial Sequence
  Synthetic Polynucleotide
taatacgactcactatagggtgaagttatccagggaaacaggttggtcagaacagaggagactgaccatgctgtttcccaacctggcggcagcgcaaaagatg

SEQ ID NO: 176823 - DNA, 103 bp, Artificial Sequence
  Synthetic Polynucleotide
taatacgactcactatagggaaggattgagtgaagttatccagggaaacaaacagaggagatgtttcatgggataacttaacctggcggcagcgcaaaagatg

SEQ ID NO: 176824 - DNA, 103 bp, Artificial Sequence
  Synthetic Polynucleotide
taatacgactcactatagggagtgtttagcaaggattgagtgaagttatcaacagaggagagataacatgactcaatccaacctggcggcagcgcaaaagatg

SEQ ID NO: 176825 - DNA, 103 bp, Artificial Sequence
  Synthetic Polynucleotide
taatacgactcactatagggaaatgttaaagttctgatcctcttcattataacagaggagaataatgatgaggatcagaaacctggcggcagcgcaaaagatg

SEQ ID NO: 176826 - DNA, 103 bp, Artificial Sequence
  Synthetic Polynucleotide
taatacgactcactatagggttggatcccaagtgtttagcaaggattgagaacagaggagactcaatatgtgctaaacaaacctggcggcagcgcaaaagatg

SEQ ID NO: 176827 - DNA, 103 bp, Artificial Sequence
  Synthetic Polynucleotide
taatacgactcactatagggtctgggacttttggatcccaagtgtttagcaacagaggagagctaaaatgttgggatccaacctggcggcagcgcaaaagatg

SEQ ID NO: 176828 - DNA, 103 bp, Artificial Sequence
  Synthetic Polynucleotide
taatacgactcactataggggatatctacatctgggacttttggatcccaaacagaggagatgggatatgaaagtcccaaacctggcggcagcgcaaaagatg

SEQ ID NO: 176829 - DNA, 103 bp, Artificial Sequence
  Synthetic Polynucleotide
taatacgactcactataggggatcttctttgatatctacatctgggacttaacagaggagaaagtccatgatgtagataaacctggcggcagcgcaaaagatg

SEQ ID NO: 176830 - DNA, 103 bp, Artificial Sequence
  Synthetic Polynucleotide
taatacgactcactataggggaggtatcttgatcttctttgatatctacaaacagaggagatgtagaatgcaaagaagaaacctggcggcagcgcaaaagatg

SEQ ID NO: 176831 - DNA, 103 bp, Artificial Sequence
  Synthetic Polynucleotide
taatacgactcactatagggagaattctttgaggtatcttgatcttctttaacagaggagaaaagaaatgcaagataccaacctggcggcagcgcaaaagatg

SEQ ID NO: 176832 - DNA, 103 bp, Artificial Sequence
  Synthetic Polynucleotide
taatacgactcactatagggagtttagcttagaattctttgaggtatcttaacagaggagaaagataatgcaaagaattaacctggcggcagcgcaaaagatg

SEQ ID NO: 176833 - DNA, 103 bp, Artificial Sequence
  Synthetic Polynucleotide
taatacgactcactatagggttctggtgtgagtttagcttagaattctttaacagaggagaaaagaaatgtaagctaaaaacctggcggcagcgcaaaagatg

SEQ ID NO: 176834 - DNA, 103 bp, Artificial Sequence
  Synthetic Polynucleotide
taatacgactcactatagggaagtgttactttctggtgtgagtttagcttaacagaggagaaagctaatgtcacaccagaacctggcggcagcgcaaaagatg

SEQ ID NO: 176835 - DNA, 103 bp, Artificial Sequence
  Synthetic Polynucleotide
taatacgactcactataggggcaattgaagaagtgttactttctggtgtgaacagaggagacacaccatgaagtaacacaacctggcggcagcgcaaaagatg

SEQ ID NO: 176836 - DNA, 103 bp, Artificial Sequence
  Synthetic Polynucleotide
taatacgactcactataggggcactgccagaaatgttaaagttctgatccaacagaggagaggatcaatgctttaacataacctggcggcagcgcaaaagatg

SEQ ID NO: 176837 - DNA, 103 bp, Artificial Sequence
  Synthetic Polynucleotide
taatacgactcactatagggtggccaagtagcaattgaagaagtgttactaacagaggagaagtaacatgtcttcaattaacctggcggcagcgcaaaagatg

SEQ ID NO: 176838 - DNA, 103 bp, Artificial Sequence
  Synthetic Polynucleotide
taatacgactcactatagggttcattcttatggccaagtagcaattgaagaacagaggagacttcaaatgctacttggcaacctggcggcagcgcaaaagatg

SEQ ID NO: 176839 - DNA, 103 bp, Artificial Sequence
  Synthetic Polynucleotide
taatacgactcactatagggctacattttcttcattcttatggccaagtaaacagaggagatacttgatgataagaatgaacctggcggcagcgcaaaagatg

SEQ ID NO: 176840 - DNA, 103 bp, Artificial Sequence
  Synthetic Polynucleotide
taatacgactcactataggggtgtttttttctacattttcttcattcttaaacagaggagataagaaatgagaaaatgtaacctggcggcagcgcaaaagatg

SEQ ID NO: 176841 - DNA, 103 bp, Artificial Sequence
  Synthetic Polynucleotide
taatacgactcactatagggctgagggctggtgtttttttctacattttcaacagaggagagaaaatatggaaaaaaacaacctggcggcagcgcaaaagatg

SEQ ID NO: 176842 - DNA, 103 bp, Artificial Sequence
  Synthetic Polynucleotide
taatacgactcactatagggtgtgtactccctgagggctggtgtttttttaacagaggagaaaaaaaatgccagccctcaacctggcggcagcgcaaaagatg

SEQ ID NO: 176843 - DNA, 103 bp, Artificial Sequence
  Synthetic Polynucleotide
taatacgactcactatagggctcacatcattgtgtactccctgagggctgaacagaggagacagcccatggggagtacaaacctggcggcagcgcaaaagatg

SEQ ID NO: 176844 - DNA, 103 bp, Artificial Sequence
  Synthetic Polynucleotide
taatacgactcactatagggattgaacttgctcacatcattgtgtactccaacagaggagaggagtaatgaatgatgtgaacctggcggcagcgcaaaagatg

SEQ ID NO: 176845 - DNA, 103 bp, Artificial Sequence
  Synthetic Polynucleotide
taatacgactcactatagggaattttgtgtattgaacttgctcacatcataacagaggagaatgatgatggcaagttcaaacctggcggcagcgcaaaagatg

SEQ ID NO: 176846 - DNA, 103 bp, Artificial Sequence
  Synthetic Polynucleotide
taatacgactcactataggggtccttgcataattttgtgtattgaacttgaacagaggagacaagttatgtacacaaaaaacctggcggcagcgcaaaagatg

SEQ ID NO: 176847 - DNA, 103 bp, Artificial Sequence
  Synthetic Polynucleotide
taatacgactcactatagggggtgggaaatgcactgccagaaatgttaaaaacagaggagatttaacatgtctggcagtaacctggcggcagcgcaaaagatg

SEQ ID NO: 176848 - DNA, 103 bp, Artificial Sequence
  Synthetic Polynucleotide
taatacgactcactatagggtatcacagaagtccttgcataattttgtgtaacagaggagaacacaaatgtatgcaaggaacctggcggcagcgcaaaagatg

SEQ ID NO: 176849 - DNA, 103 bp, Artificial Sequence
  Synthetic Polynucleotide
taatacgactcactatagggtggggctttctatcacagaagtccttgcataacagaggagaatgcaaatgcttctgtgaaacctggcggcagcgcaaaagatg

SEQ ID NO: 176850 - DNA, 103 bp, Artificial Sequence
  Synthetic Polynucleotide
taatacgactcactatagggcgatttgtactggggctttctatcacagaaaacagaggagattctgtatgagaaagcccaacctggcggcagcgcaaaagatg

SEQ ID NO: 176851 - DNA, 103 bp, Artificial Sequence
  Synthetic Polynucleotide
taatacgactcactatagggtggagtagtccgatttgtactggggctttcaacagaggagagaaagcatgagtacaaataacctggcggcagcgcaaaagatg

SEQ ID NO: 176852 - DNA, 103 bp, Artificial Sequence
  Synthetic Polynucleotide
taatacgactcactataggggagtgctcactggagtagtccgatttgtacaacagaggagagtacaaatgggactactcaacctggcggcagcgcaaaagatg

SEQ ID NO: 176853 - DNA, 103 bp, Artificial Sequence
  Synthetic Polynucleotide
taatacgactcactatagggagtaaaggtggagtgctcactggagtagtcaacagaggagagactacatgagtgagcacaacctggcggcagcgcaaaagatg

SEQ ID NO: 176854 - DNA, 103 bp, Artificial Sequence
  Synthetic Polynucleotide
taatacgactcactataggggcttgatgtaagtaaaggtggagtgctcacaacagaggagagtgagcatgccacctttaaacctggcggcagcgcaaaagatg

SEQ ID NO: 176855 - DNA, 103 bp, Artificial Sequence
  Synthetic Polynucleotide
taatacgactcactatagggaccctgctttgcttgatgtaagtaaaggtgaacagaggagacaccttatgttacatcaaaacctggcggcagcgcaaaagatg

SEQ ID NO: 176856 - DNA, 103 bp, Artificial Sequence
  Synthetic Polynucleotide
taatacgactcactatagggttgatgggagaccctgctttgcttgatgtaaacagaggagatacatcatgcaaagcaggaacctggcggcagcgcaaaagatg

SEQ ID NO: 176857 - DNA, 103 bp, Artificial Sequence
  Synthetic Polynucleotide
taatacgactcactatagggttgagagagattgatgggagaccctgctttaacagaggagaaaagcaatgtctcccatcaacctggcggcagcgcaaaagatg

SEQ ID NO: 176858 - DNA, 103 bp, Artificial Sequence
  Synthetic Polynucleotide
taatacgactcactatagggtactttgacaggtgggaaatgcactgccagaacagaggagactggcaatgcatttcccaaacctggcggcagcgcaaaagatg

SEQ ID NO: 176859 - DNA, 103 bp, Artificial Sequence
  Synthetic Polynucleotide
taatacgactcactatagggccagagagtgttgagagagattgatgggagaacagaggagactcccaatgatctctctcaacctggcggcagcgcaaaagatg

SEQ ID NO: 176860 - DNA, 103 bp, Artificial Sequence
  Synthetic Polynucleotide
taatacgactcactatagggcatttgatgaccagagagtgttgagagagaaacagaggagatctctcatgacactctctaacctggcggcagcgcaaaagatg

SEQ ID NO: 176861 - DNA, 103 bp, Artificial Sequence
  Synthetic Polynucleotide
taatacgactcactatagggtggggaattccatttgatgaccagagagtgaacagaggagacactctatggtcatcaaaaacctggcggcagcgcaaaagatg

SEQ ID NO: 176862 - DNA, 103 bp, Artificial Sequence
  Synthetic Polynucleotide
taatacgactcactatagggagacatatggtggggaattccatttgatgaaacagaggagatcatcaatgggaattcccaacctggcggcagcgcaaaagatg

SEQ ID NO: 176863 - DNA, 103 bp, Artificial Sequence
  Synthetic Polynucleotide
taatacgactcactatagggtgagtactgcagacatatggtggggaattcaacagaggagagaattcatgaccatatgtaacctggcggcagcgcaaaagatg

SEQ ID NO: 176864 - DNA, 103 bp, Artificial Sequence
  Synthetic Polynucleotide
taatacgactcactatagggcttttcagactgagtactgcagacatatggaacagaggagaccatatatgtgcagtactaacctggcggcagcgcaaaagatg

SEQ ID NO: 176865 - DNA, 103 bp, Artificial Sequence
  Synthetic Polynucleotide
taatacgactcactatagggtatttgttagcttttcagactgagtactgcaacagaggagagcagtaatgagtctgaaaaacctggcggcagcgcaaaagatg

SEQ ID NO: 176866 - DNA, 103 bp, Artificial Sequence
  Synthetic Polynucleotide
taatacgactcactatagggttagatgcagtatttgttagcttttcagacaacagaggagagtctgaatggctaacaaaaacctggcggcagcgcaaaagatg

SEQ ID NO: 176867 - DNA, 103 bp, Artificial Sequence
  Synthetic Polynucleotide
taatacgactcactatagggcattgagtggttagatgcagtatttgttagaacagaggagactaacaatgactgcatctaacctggcggcagcgcaaaagatg

SEQ ID NO: 176868 - DNA, 103 bp, Artificial Sequence
  Synthetic Polynucleotide
taatacgactcactatagggttgtaaggtccattgagtggttagatgcagaacagaggagactgcatatgaccactcaaaacctggcggcagcgcaaaagatg

SEQ ID NO: 176869 - DNA, 103 bp, Artificial Sequence
  Synthetic Polynucleotide
taatacgactcactatagggactggaccattactttgacaggtgggaaataacagaggagaatttccatgctgtcaaagaacctggcggcagcgcaaaagatg

SEQ ID NO: 176870 - DNA, 103 bp, Artificial Sequence
  Synthetic Polynucleotide
taatacgactcactatagggtctttgctttttgtaaggtccattgagtggaacagaggagaccactcatgggaccttacaacctggcggcagcgcaaaagatg

SEQ ID NO: 176871 - DNA, 103 bp, Artificial Sequence
  Synthetic Polynucleotide
taatacgactcactatagggtcctggtgggtctttgctttttgtaaggtcaacagaggagagaccttatgaaaagcaaaaacctggcggcagcgcaaaagatg

SEQ ID NO: 176872 - DNA, 103 bp, Artificial Sequence
  Synthetic Polynucleotide
taatacgactcactatagggctggtttctctcctggtgggtctttgctttaacagaggagaaaagcaatgacccaccagaacctggcggcagcgcaaaagatg

SEQ ID NO: 176873 - DNA, 103 bp, Artificial Sequence
  Synthetic Polynucleotide
taatacgactcactatagggtcattttgggctggtttctctcctggtgggaacagaggagacccaccatgagagaaaccaacctggcggcagcgcaaaagatg

SEQ ID NO: 176874 - DNA, 103 bp, Artificial Sequence
  Synthetic Polynucleotide
taatacgactcactatagggctgtgcaccttcattttgggctggtttctcaacagaggagagagaaaatggcccaaaataacctggcggcagcgcaaaagatg

SEQ ID NO: 176875 - DNA, 103 bp, Artificial Sequence
  Synthetic Polynucleotide
taatacgactcactatagggttgcagagttctgtgcaccttcattttgggaacagaggagacccaaaatgaaggtgcacaacctggcggcagcgcaaaagatg

SEQ ID NO: 176876 - DNA, 103 bp, Artificial Sequence
  Synthetic Polynucleotide
taatacgactcactataggggcactaaacgttgcagagttctgtgcacctaacagaggagaaggtgcatggaactctgcaacctggcggcagcgcaaaagatg

SEQ ID NO: 176877 - DNA, 103 bp, Artificial Sequence
  Synthetic Polynucleotide
taatacgactcactatagggcagcttactggcactaaacgttgcagagttaacagaggagaaactctatgacgtttagtaacctggcggcagcgcaaaagatg

SEQ ID NO: 176878 - DNA, 103 bp, Artificial Sequence
  Synthetic Polynucleotide
taatacgactcactatagggaattttgtaacagcttactggcactaaacgaacagaggagacgtttaatgccagtaagcaacctggcggcagcgcaaaagatg

SEQ ID NO: 176879 - DNA, 103 bp, Artificial Sequence
  Synthetic Polynucleotide
taatacgactcactatagggcattgtgctaaattttgtaacagcttactgaacagaggagacagtaaatggttacaaaaaacctggcggcagcgcaaaagatg

SEQ ID NO: 176880 - DNA, 103 bp, Artificial Sequence
  Synthetic Polynucleotide
taatacgactcactatagggtgtattgagaactggaccattactttgacaaacagaggagatgtcaaatgaatggtccaaacctggcggcagcgcaaaagatg

SEQ ID NO: 176881 - DNA, 103 bp, Artificial Sequence
  Synthetic Polynucleotide
taatacgactcactatagggctgcattccacattgtgctaaattttgtaaaacagaggagattacaaatgttagcacaaaacctggcggcagcgcaaaagatg

SEQ ID NO: 176882 - DNA, 103 bp, Artificial Sequence
  Synthetic Polynucleotide
taatacgactcactatagggacatggatgactgcattccacattgtgctaaacagaggagatagcacatggtggaatgcaacctggcggcagcgcaaaagatg

SEQ ID NO: 176883 - DNA, 103 bp, Artificial Sequence
  Synthetic Polynucleotide
taatacgactcactatagggtcttccactgacatggatgactgcattccaaacagaggagatggaatatggtcatccataacctggcggcagcgcaaaagatg

SEQ ID NO: 176884 - DNA, 103 bp, Artificial Sequence
  Synthetic Polynucleotide
taatacgactcactataggggggtctctgctcttccactgacatggatgaaacagaggagatcatccatgtcagtggaaaacctggcggcagcgcaaaagatg

SEQ ID NO: 176885 - DNA, 103 bp, Artificial Sequence
  Synthetic Polynucleotide
taatacgactcactataggggctgtttgctgggtctctgctcttccactgaacagaggagacagtggatgagcagagacaacctggcggcagcgcaaaagatg

SEQ ID NO: 176886 - DNA, 103 bp, Artificial Sequence
  Synthetic Polynucleotide
taatacgactcactatagggccagttaacagctgtttgctgggtctctgcaacagaggagagcagagatgcagcaaacaaacctggcggcagcgcaaaagatg

SEQ ID NO: 176887 - DNA, 103 bp, Artificial Sequence
  Synthetic Polynucleotide
taatacgactcactatagggatctgtgtttccagttaacagctgtttgctaacagaggagaagcaaaatgctgttaactaacctggcggcagcgcaaaagatg

SEQ ID NO: 176888 - DNA, 103 bp, Artificial Sequence
  Synthetic Polynucleotide
taatacgactcactatagggctatcggtttatctgtgtttccagttaacaaacagaggagatgttaaatggaaacacagaacctggcggcagcgcaaaagatg

SEQ ID NO: 176889 - DNA, 103 bp, Artificial Sequence
  Synthetic Polynucleotide
taatacgactcactatagggtcaatcatacctatcggtttatctgtgtttaacagaggagaaaacacatgtaaaccgataacctggcggcagcgcaaaagatg

SEQ ID NO: 176890 - DNA, 103 bp, Artificial Sequence
  Synthetic Polynucleotide
taatacgactcactatagggatttaatctatcaatcatacctatcggtttaacagaggagaaaaccgatgggtatgattaacctggcggcagcgcaaaagatg

SEQ ID NO: 176891 - DNA, 103 bp, Artificial Sequence
  Synthetic Polynucleotide
taatacgactcactatagggcctggtgcacatcagagccaagctcttctcaacagaggagagagaagatgttggctctgaacctggcggcagcgcaaaagatg

SEQ ID NO: 176892 - DNA, 103 bp, Artificial Sequence
  Synthetic Polynucleotide
taatacgactcactataggggatatgtatgtgtattgagaactggaccataacagaggagaatggtcatgttctcaataaacctggcggcagcgcaaaagatg

SEQ ID NO: 176893 - DNA, 103 bp, Artificial Sequence
  Synthetic Polynucleotide
taatacgactcactataggggcaaagggctatttaatctatcaatcatacaacagaggagagtatgaatgatagattaaaacctggcggcagcgcaaaagatg

SEQ ID NO: 176894 - DNA, 103 bp, Artificial Sequence
  Synthetic Polynucleotide
taatacgactcactatagggttatttgagagcaaagggctatttaatctaaacagaggagatagattatgtagccctttaacctggcggcagcgcaaaagatg

SEQ ID NO: 176895 - DNA, 103 bp, Artificial Sequence
  Synthetic Polynucleotide
taatacgactcactatagggtgcatttgttttatttgagagcaaagggctaacagaggagaagccctatgctctcaaataacctggcggcagcgcaaaagatg

SEQ ID NO: 176896 - DNA, 103 bp, Artificial Sequence
  Synthetic Polynucleotide
taatacgactcactatagggtttcttcaactgcatttgttttatttgagaaacagaggagatctcaaatgaaacaaatgaacctggcggcagcgcaaaagatg

SEQ ID NO: 176897 - DNA, 103 bp, Artificial Sequence
  Synthetic Polynucleotide
taatacgactcactatagggaatgctttattttcttcaactgcatttgttaacagaggagaaacaaaatgagttgaagaaacctggcggcagcgcaaaagatg

SEQ ID NO: 176898 - DNA, 103 bp, Artificial Sequence
  Synthetic Polynucleotide
taatacgactcactatagggttgactactaaatgctttattttcttcaacaacagaggagagttgaaatgaataaagcaaacctggcggcagcgcaaaagatg

SEQ ID NO: 176899 - DNA, 103 bp, Artificial Sequence
  Synthetic Polynucleotide
taatacgactcactataggggacctgttggttgactactaaatgctttataacagaggagaataaagatgttagtagtcaacctggcggcagcgcaaaagatg

SEQ ID NO: 176900 - DNA, 103 bp, Artificial Sequence
  Synthetic Polynucleotide
taatacgactcactatagggcctggttcaggacctgttggttgactactaaacagaggagatagtagatgaccaacaggaacctggcggcagcgcaaaagatg

SEQ ID NO: 176901 - DNA, 103 bp, Artificial Sequence
  Synthetic Polynucleotide
taatacgactcactatagggaccagaaagccctggttcaggacctgttggaacagaggagaccaacaatgcctgaaccaaacctggcggcagcgcaaaagatg

SEQ ID NO: 176902 - DNA, 103 bp, Artificial Sequence
  Synthetic Polynucleotide
taatacgactcactatagggctatttcagaaccagaaagccctggttcagaacagaggagactgaacatgggctttctgaacctggcggcagcgcaaaagatg

SEQ ID NO: 176903 - DNA, 103 bp, Artificial Sequence
  Synthetic Polynucleotide
taatacgactcactatagggccagacccctgatatgtatgtgtattgagaaacagaggagatctcaaatgacatacataaacctggcggcagcgcaaaagatg

SEQ ID NO: 176904 - DNA, 103 bp, Artificial Sequence
  Synthetic Polynucleotide
taatacgactcactatagggagcagattttctatttcagaaccagaaagcaacagaggagagctttcatgttctgaaataacctggcggcagcgcaaaagatg

SEQ ID NO: 176905 - DNA, 103 bp, Artificial Sequence
  Synthetic Polynucleotide
taatacgactcactatagggacgtctttcaagcagattttctatttcagaaacagaggagatctgaaatggaaaatctgaacctggcggcagcgcaaaagatg

SEQ ID NO: 176906 - DNA, 103 bp, Artificial Sequence
  Synthetic Polynucleotide
taatacgactcactatagggggaggacagtacgtctttcaagcagattttaacagaggagaaaaatcatgttgaaagacaacctggcggcagcgcaaaagatg

SEQ ID NO: 176907 - DNA, 103 bp, Artificial Sequence
  Synthetic Polynucleotide
taatacgactcactatagggaggagcaactggaggacagtacgtctttcaaacagaggagatgaaagatgtactgtcctaacctggcggcagcgcaaaagatg

SEQ ID NO: 176908 - DNA, 103 bp, Artificial Sequence
  Synthetic Polynucleotide
taatacgactcactatagggggggttccccaggagcaactggaggacagtaacagaggagaactgtcatgcagttgctcaacctggcggcagcgcaaaagatg

SEQ ID NO: 176909 - DNA, 103 bp, Artificial Sequence
  Synthetic Polynucleotide
taatacgactcactatagggtccctttgttggggttccccaggagcaactaacagaggagaagttgcatgtggggaaccaacctggcggcagcgcaaaagatg

SEQ ID NO: 176910 - DNA, 103 bp, Artificial Sequence
  Synthetic Polynucleotide
taatacgactcactatagggttttcactcttccctttgttggggttccccaacagaggagaggggaaatgcaacaaaggaacctggcggcagcgcaaaagatg

SEQ ID NO: 176911 - DNA, 103 bp, Artificial Sequence
  Synthetic Polynucleotide
taatacgactcactatagggtttctcttttttttcactcttccctttgttaacagaggagaaacaaaatgaagagtgaaaacctggcggcagcgcaaaagatg

SEQ ID NO: 176912 - DNA, 103 bp, Artificial Sequence
  Synthetic Polynucleotide
taatacgactcactatagggttaagggagttttctcttttttttcactctaacagaggagaagagtgatgaaaaagagaaacctggcggcagcgcaaaagatg

SEQ ID NO: 176913 - DNA, 103 bp, Artificial Sequence
  Synthetic Polynucleotide
taatacgactcactatagggctttcatctcttaagggagttttctcttttaacagaggagaaaaagaatgaactcccttaacctggcggcagcgcaaaagatg

SEQ ID NO: 176914 - DNA, 103 bp, Artificial Sequence
  Synthetic Polynucleotide
taatacgactcactataggggtgcagcatgccagacccctgatatgtatgaacagaggagacatacaatgcaggggtctaacctggcggcagcgcaaaagatg

SEQ ID NO: 176915 - DNA, 103 bp, Artificial Sequence
  Synthetic Polynucleotide
taatacgactcactatagggttcctgagtactttcatctcttaagggagtaacagaggagaactcccatgagagatgaaaacctggcggcagcgcaaaagatg

SEQ ID NO: 176916 - DNA, 103 bp, Artificial Sequence
  Synthetic Polynucleotide
taatacgactcactatagggtctctgagtgttcctgagtactttcatctcaacagaggagagagatgatggtactcaggaacctggcggcagcgcaaaagatg

SEQ ID NO: 176917 - DNA, 103 bp, Artificial Sequence
  Synthetic Polynucleotide
taatacgactcactatagggcttaaagctctctctgagtgttcctgagtaaacagaggagatactcaatgacactcagaaacctggcggcagcgcaaaagatg

SEQ ID NO: 176918 - DNA, 103 bp, Artificial Sequence
  Synthetic Polynucleotide
taatacgactcactatagggtatttgttcacttaaagctctctctgagtgaacagaggagacactcaatgagagctttaaacctggcggcagcgcaaaagatg

SEQ ID NO: 176919 - DNA, 103 bp, Artificial Sequence
  Synthetic Polynucleotide
taatacgactcactatagggtcaccatcagtatttgttcacttaaagctcaacagaggagagagcttatggtgaacaaaaacctggcggcagcgcaaaagatg

SEQ ID NO: 176920 - DNA, 103 bp, Artificial Sequence
  Synthetic Polynucleotide
taatacgactcactataggggattttattttcaccatcagtatttgttcaaacagaggagatgaacaatgactgatggtaacctggcggcagcgcaaaagatg

SEQ ID NO: 176921 - DNA, 103 bp, Artificial Sequence
  Synthetic Polynucleotide
taatacgactcactatagggacaaggctcagattttattttcaccatcagaacagaggagactgatgatgaaaataaaaaacctggcggcagcgcaaaagatg

SEQ ID NO: 176922 - DNA, 103 bp, Artificial Sequence
  Synthetic Polynucleotide
taatacgactcactataggggtaagtcatcacaaggctcagattttatttaacagaggagaaaataaatgctgagccttaacctggcggcagcgcaaaagatg

SEQ ID NO: 176923 - DNA, 103 bp, Artificial Sequence
  Synthetic Polynucleotide
taatacgactcactatagggttaggaatttgtaagtcatcacaaggctcaaacagaggagatgagccatgtgatgacttaacctggcggcagcgcaaaagatg

SEQ ID NO: 176924 - DNA, 103 bp, Artificial Sequence
  Synthetic Polynucleotide
taatacgactcactatagggcacatttgtgttaggaatttgtaagtcatcaacagaggagagatgacatgcaaattcctaacctggcggcagcgcaaaagatg

SEQ ID NO: 176925 - DNA, 103 bp, Artificial Sequence
  Synthetic Polynucleotide
taatacgactcactatagggcttttttgaggtgcagcatgccagacccctaacagaggagaaggggtatggcatgctgcaacctggcggcagcgcaaaagatg

SEQ ID NO: 176926 - DNA, 103 bp, Artificial Sequence
  Synthetic Polynucleotide
taatacgactcactatagggggctcaagtgcacatttgtgttaggaatttaacagaggagaaaattcatgacacaaatgaacctggcggcagcgcaaaagatg

SEQ ID NO: 176927 - DNA, 103 bp, Artificial Sequence
  Synthetic Polynucleotide
taatacgactcactatagggttagcatcatggctcaagtgcacatttgtgaacagaggagacacaaaatggcacttgagaacctggcggcagcgcaaaagatg

SEQ ID NO: 176928 - DNA, 103 bp, Artificial Sequence
  Synthetic Polynucleotide
taatacgactcactatagggtggggcactcttagcatcatggctcaagtgaacagaggagacacttgatgcatgatgctaacctggcggcagcgcaaaagatg

SEQ ID NO: 176929 - DNA, 103 bp, Artificial Sequence
  Synthetic Polynucleotide
taatacgactcactatagggtacccaagaatggggcactcttagcatcataacagaggagaatgatgatgagagtgcccaacctggcggcagcgcaaaagatg

SEQ ID NO: 176930 - DNA, 103 bp, Artificial Sequence
  Synthetic Polynucleotide
taatacgactcactataggggcaggagccatacccaagaatggggcactcaacagaggagagagtgcatgattcttgggaacctggcggcagcgcaaaagatg

SEQ ID NO: 176931 - DNA, 103 bp, Artificial Sequence
  Synthetic Polynucleotide
taatacgactcactatagggtctctgcacagcaggagccatacccaagaaaacagaggagattcttgatgatggctcctaacctggcggcagcgcaaaagatg

SEQ ID NO: 176932 - DNA, 103 bp, Artificial Sequence
  Synthetic Polynucleotide
taatacgactcactatagggcaggtgcgcttctctgcacagcaggagccaaacagaggagatggctcatgctgtgcagaaacctggcggcagcgcaaaagatg

SEQ ID NO: 176933 - DNA, 103 bp, Artificial Sequence
  Synthetic Polynucleotide
taatacgactcactatagggactggtaaggcaggtgcgcttctctgcacaaacagaggagatgtgcaatgaagcgcaccaacctggcggcagcgcaaaagatg

SEQ ID NO: 176934 - DNA, 103 bp, Artificial Sequence
  Synthetic Polynucleotide
taatacgactcactataggggtcttcggacactggtaaggcaggtgcgctaacagaggagaagcgcaatggccttaccaaacctggcggcagcgcaaaagatg

SEQ ID NO: 176935 - DNA, 103 bp, Artificial Sequence
  Synthetic Polynucleotide
taatacgactcactatagggccgatttaaagtcttcggacactggtaaggaacagaggagaccttacatgtgtccgaagaacctggcggcagcgcaaaagatg

SEQ ID NO: 176936 - DNA, 103 bp, Artificial Sequence
  Synthetic Polynucleotide
taatacgactcactatagggaacagtctggcttttttgaggtgcagcatgaacagaggagacatgctatgcctcaaaaaaacctggcggcagcgcaaaagatg

SEQ ID NO: 176937 - DNA, 103 bp, Artificial Sequence
  Synthetic Polynucleotide
taatacgactcactataggggaaacaggctccgatttaaagtcttcggacaacagaggagagtccgaatgctttaaatcaacctggcggcagcgcaaaagatg

SEQ ID NO: 176938 - DNA, 103 bp, Artificial Sequence
  Synthetic Polynucleotide
taatacgactcactatagggatcctgaggtgaaacaggctccgatttaaaaacagaggagatttaaaatggagcctgttaacctggcggcagcgcaaaagatg

SEQ ID NO: 176939 - DNA, 103 bp, Artificial Sequence
  Synthetic Polynucleotide
taatacgactcactatagggagaaagaaaaatcctgaggtgaaacaggctaacagaggagaagcctgatgcacctcaggaacctggcggcagcgcaaaagatg

SEQ ID NO: 176940 - DNA, 103 bp, Artificial Sequence
  Synthetic Polynucleotide
taatacgactcactatagggccattcttggagaaagaaaaatcctgaggtaacagaggagaacctcaatgtttttctttaacctggcggcagcgcaaaagatg

SEQ ID NO: 176941 - DNA, 103 bp, Artificial Sequence
  Synthetic Polynucleotide
taatacgactcactatagggacttagcagaccattcttggagaaagaaaaaacagaggagattttctatgtccaagaataacctggcggcagcgcaaaagatg

SEQ ID NO: 176942 - DNA, 103 bp, Artificial Sequence
  Synthetic Polynucleotide
taatacgactcactatagggttagcaatcgacttagcagaccattcttggaacagaggagaccaagaatggtctgctaaaacctggcggcagcgcaaaagatg

SEQ ID NO: 176943 - DNA, 103 bp, Artificial Sequence
  Synthetic Polynucleotide
taatacgactcactatagggtgattttgtcttagcaatcgacttagcagaaacagaggagatctgctatgtcgattgctaacctggcggcagcgcaaaagatg

SEQ ID NO: 176944 - DNA, 103 bp, Artificial Sequence
  Synthetic Polynucleotide
taatacgactcactataggggtaactatcttgattttgtcttagcaatcgaacagaggagacgattgatgagacaaaataacctggcggcagcgcaaaagatg

SEQ ID NO: 176945 - DNA, 103 bp, Artificial Sequence
  Synthetic Polynucleotide
taatacgactcactatagggcatctgccaggtaactatcttgattttgtcaacagaggagagacaaaatgaagatagttaacctggcggcagcgcaaaagatg

SEQ ID NO: 176946 - DNA, 103 bp, Artificial Sequence
  Synthetic Polynucleotide
taatacgactcactatagggctgtctgaatcatctgccaggtaactatctaacagaggagaagatagatgcctggcagaaacctggcggcagcgcaaaagatg

SEQ ID NO: 176947 - DNA, 103 bp, Artificial Sequence
  Synthetic Polynucleotide
taatacgactcactatagggagaagactgcaacagtctggcttttttgagaacagaggagactcaaaatggccagactgaacctggcggcagcgcaaaagatg

SEQ ID NO: 176948 - DNA, 103 bp, Artificial Sequence
  Synthetic Polynucleotide
taatacgactcactatagggtctgtgactcctgtctgaatcatctgccagaacagaggagactggcaatggattcagacaacctggcggcagcgcaaaagatg

SEQ ID NO: 176949 - DNA, 103 bp, Artificial Sequence
  Synthetic Polynucleotide
taatacgactcactatagggtttcattatttctgtgactcctgtctgaataacagaggagaattcagatgggagtcacaaacctggcggcagcgcaaaagatg

SEQ ID NO: 176950 - DNA, 103 bp, Artificial Sequence
  Synthetic Polynucleotide
taatacgactcactatagggagaagtgccatttcattatttctgtgactcaacagaggagagagtcaatgaaataatgaaacctggcggcagcgcaaaagatg

SEQ ID NO: 176951 - DNA, 103 bp, Artificial Sequence
  Synthetic Polynucleotide
taatacgactcactatagggctttgattctagaagtgccatttcattattaacagaggagaaataatatgatggcacttaacctggcggcagcgcaaaagatg

SEQ ID NO: 176952 - DNA, 103 bp, Artificial Sequence
  Synthetic Polynucleotide
taatacgactcactatagggtgcaaagattctttgattctagaagtgccaaacagaggagatggcacatgtagaatcaaaacctggcggcagcgcaaaagatg

SEQ ID NO: 176953 - DNA, 103 bp, Artificial Sequence
  Synthetic Polynucleotide
taatacgactcactatagggttagggaccatgcaaagattctttgattctaacagaggagaagaatcatggaatctttgaacctggcggcagcgcaaaagatg

SEQ ID NO: 176954 - DNA, 103 bp, Artificial Sequence
  Synthetic Polynucleotide
taatacgactcactatagggcttccttttcttagggaccatgcaaagattaacagaggagaaatcttatgatggtccctaacctggcggcagcgcaaaagatg

SEQ ID NO: 176955 - DNA, 103 bp, Artificial Sequence
  Synthetic Polynucleotide
taatacgactcactatagggcagtataaagcttccttttcttagggaccaaacagaggagatggtccatgagaaaaggaaacctggcggcagcgcaaaagatg

SEQ ID NO: 176956 - DNA, 103 bp, Artificial Sequence
  Synthetic Polynucleotide
taatacgactcactatagggtctaatggctcagtataaagcttccttttcaacagaggagagaaaagatggctttatacaacctggcggcagcgcaaaagatg

SEQ ID NO: 176957 - DNA, 103 bp, Artificial Sequence
  Synthetic Polynucleotide
taatacgactcactatagggaaatggattttctaatggctcagtataaagaacagaggagactttatatggagccattaaacctggcggcagcgcaaaagatg

SEQ ID NO: 176958 - DNA, 103 bp, Artificial Sequence
  Synthetic Polynucleotide
taatacgactcactatagggtccagtcctcagaagactgcaacagtctggaacagaggagaccagacatgtgcagtcttaacctggcggcagcgcaaaagatg

SEQ ID NO: 176959 - DNA, 103 bp, Artificial Sequence
  Synthetic Polynucleotide
taatacgactcactatagggtcatctttttaaatggattttctaatggctaacagaggagaagccatatgaaaatccataacctggcggcagcgcaaaagatg

SEQ ID NO: 176960 - DNA, 103 bp, Artificial Sequence
  Synthetic Polynucleotide
taatacgactcactatagggatgttgtttttcatctttttaaatggatttaacagaggagaaaatccatgtaaaaagataacctggcggcagcgcaaaagatg

SEQ ID NO: 176961 - DNA, 103 bp, Artificial Sequence
  Synthetic Polynucleotide
taatacgactcactatagggagcatcaacaatgttgtttttcatctttttaacagaggagaaaaaagatgaaaaacaacaacctggcggcagcgcaaaagatg

SEQ ID NO: 176962 - DNA, 103 bp, Artificial Sequence
  Synthetic Polynucleotide
taatacgactcactataggggattgtttgcagcatcaacaatgttgttttaacagaggagaaaaacaatgttgttgatgaacctggcggcagcgcaaaagatg

SEQ ID NO: 176963 - DNA, 103 bp, Artificial Sequence
  Synthetic Polynucleotide
taatacgactcactatagggggggcactgtgattgtttgcagcatcaacaaacagaggagatgttgaatgtgcaaacaaaacctggcggcagcgcaaaagatg

SEQ ID NO: 176964 - DNA, 103 bp, Artificial Sequence
  Synthetic Polynucleotide
taatacgactcactatagggcagtacttctggggcactgtgattgtttgcaacagaggagagcaaacatgcacagtgccaacctggcggcagcgcaaaagatg

SEQ ID NO: 176965 - DNA, 103 bp, Artificial Sequence
  Synthetic Polynucleotide
taatacgactcactatagggaggacccatacagtacttctggggcactgtaacagaggagaacagtgatgcagaagtacaacctggcggcagcgcaaaagatg

SEQ ID NO: 176966 - DNA, 103 bp, Artificial Sequence
  Synthetic Polynucleotide
taatacgactcactatagggtggttaagcaaggacccatacagtacttctaacagaggagaagaagtatggtatgggtcaacctggcggcagcgcaaaagatg

SEQ ID NO: 176967 - DNA, 103 bp, Artificial Sequence
  Synthetic Polynucleotide
taatacgactcactatagggcagctcttcctggttaagcaaggacccataaacagaggagatatgggatgttgcttaacaacctggcggcagcgcaaaagatg

SEQ ID NO: 176968 - DNA, 103 bp, Artificial Sequence
  Synthetic Polynucleotide
taatacgactcactatagggtgctaaatttcagctcttcctggttaagcaaacagaggagatgcttaatgaggaagagcaacctggcggcagcgcaaaagatg

SEQ ID NO: 176969 - DNA, 103 bp, Artificial Sequence
  Synthetic Polynucleotide
taatacgactcactatagggtttgctgcattccagtcctcagaagactgcaacagaggagagcagtcatgtgaggactgaacctggcggcagcgcaaaagatg

SEQ ID NO: 176970 - DNA, 103 bp, Artificial Sequence
  Synthetic Polynucleotide
taatacgactcactatagggagatcatttctgctaaatttcagctcttccaacagaggagaggaagaatggaaatttagaacctggcggcagcgcaaaagatg

SEQ ID NO: 176971 - DNA, 103 bp, Artificial Sequence
  Synthetic Polynucleotide
taatacgactcactatagggtttaaattcaagatcatttctgctaaatttaacagaggagaaaatttatgagaaatgataacctggcggcagcgcaaaagatg

SEQ ID NO: 176972 - DNA, 103 bp, Artificial Sequence
  Synthetic Polynucleotide
taatacgactcactatagggcagcaggatatttaaattcaagatcatttcaacagaggagagaaatgatgttgaatttaaacctggcggcagcgcaaaagatg

SEQ ID NO: 176973 - DNA, 103 bp, Artificial Sequence
  Synthetic Polynucleotide
taatacgactcactataggggagccatgaccagcaggatatttaaattcaaacagaggagatgaattatgatatcctgcaacctggcggcagcgcaaaagatg

SEQ ID NO: 176974 - DNA, 103 bp, Artificial Sequence
  Synthetic Polynucleotide
taatacgactcactatagggttcgctggctgagccatgaccagcaggataaacagaggagatatcctatgggtcatggcaacctggcggcagcgcaaaagatg

SEQ ID NO: 176975 - DNA, 103 bp, Artificial Sequence
  Synthetic Polynucleotide
taatacgactcactatagggtgtgttcactttcgctggctgagccatgacaacagaggagagtcatgatgcagccagcgaacctggcggcagcgcaaaagatg

SEQ ID NO: 176976 - DNA, 103 bp, Artificial Sequence
  Synthetic Polynucleotide
taatacgactcactataggggcccaactcctgtgttcactttcgctggctaacagaggagaagccagatgaagtgaacaaacctggcggcagcgcaaaagatg

SEQ ID NO: 176977 - DNA, 103 bp, Artificial Sequence
  Synthetic Polynucleotide
taatacgactcactataggggctctctctggcccaactcctgtgttcactaacagaggagaagtgaaatgaggagttggaacctggcggcagcgcaaaagatg

SEQ ID NO: 176978 - DNA, 103 bp, Artificial Sequence
  Synthetic Polynucleotide
taatacgactcactatagggtaaagcttttgctctctctggcccaactccaacagaggagaggagttatgccagagagaaacctggcggcagcgcaaaagatg

SEQ ID NO: 176979 - DNA, 103 bp, Artificial Sequence
  Synthetic Polynucleotide
taatacgactcactatagggttcagaacattaaagcttttgctctctctgaacagaggagacagagaatgcaaaagcttaacctggcggcagcgcaaaagatg

SEQ ID NO: 176980 - DNA, 103 bp, Artificial Sequence
  Synthetic Polynucleotide
taatacgactcactatagggcctcttccgctttgctgcattccagtcctcaacagaggagagaggacatgaatgcagcaaacctggcggcagcgcaaaagatg

SEQ ID NO: 176981 - DNA, 103 bp, Artificial Sequence
  Synthetic Polynucleotide
taatacgactcactatagggaagcagctgtttcagaacattaaagcttttaacagaggagaaaaagcatgaatgttctgaacctggcggcagcgcaaaagatg

SEQ ID NO: 176982 - DNA, 103 bp, Artificial Sequence
  Synthetic Polynucleotide
taatacgactcactatagggtttctgagagaagcagctgtttcagaacataacagaggagaatgttcatgaacagctgcaacctggcggcagcgcaaaagatg

SEQ ID NO: 176983 - DNA, 103 bp, Artificial Sequence
  Synthetic Polynucleotide
taatacgactcactatagggcgcacacagttttctgagagaagcagctgtaacagaggagaacagctatgtctctcagaaacctggcggcagcgcaaaagatg

SEQ ID NO: 176984 - DNA, 103 bp, Artificial Sequence
  Synthetic Polynucleotide
taatacgactcactatagggggacaaatctcgcacacagttttctgagagaacagaggagactctcaatgaactgtgtgaacctggcggcagcgcaaaagatg

SEQ ID NO: 176985 - DNA, 103 bp, Artificial Sequence
  Synthetic Polynucleotide
taatacgactcactatagggttctgtgcggggacaaatctcgcacacagtaacagaggagaactgtgatggagatttgtaacctggcggcagcgcaaaagatg

SEQ ID NO: 176986 - DNA, 103 bp, Artificial Sequence
  Synthetic Polynucleotide
taatacgactcactatagggacagagttacttctgtgcggggacaaatctaacagaggagaagatttatgcccgcacagaacctggcggcagcgcaaaagatg

SEQ ID NO: 176987 - DNA, 103 bp, Artificial Sequence
  Synthetic Polynucleotide
taatacgactcactatagggactgtcagccacagagttacttctgtgcggaacagaggagaccgcacatgagtaactctaacctggcggcagcgcaaaagatg

SEQ ID NO: 176988 - DNA, 103 bp, Artificial Sequence
  Synthetic Polynucleotide
taatacgactcactatagggctttctttttactgtcagccacagagttacaacagaggagagtaactatgtggctgacaaacctggcggcagcgcaaaagatg

SEQ ID NO: 176989 - DNA, 103 bp, Artificial Sequence
  Synthetic Polynucleotide
taatacgactcactatagggtttttgtgtcctttctttttactgtcagccaacagaggagaggctgaatgtaaaaagaaaacctggcggcagcgcaaaagatg

SEQ ID NO: 176990 - DNA, 103 bp, Artificial Sequence
  Synthetic Polynucleotide
taatacgactcactatagggggtcacattatttttgtgtcctttctttttaacagaggagaaaaaagatgggacacaaaaacctggcggcagcgcaaaagatg

SEQ ID NO: 176991 - DNA, 103 bp, Artificial Sequence
  Synthetic Polynucleotide
taatacgactcactatagggaatcagacagcctcttccgctttgctgcataacagaggagaatgcagatgagcggaagaaacctggcggcagcgcaaaagatg

SEQ ID NO: 176992 - DNA, 103 bp, Artificial Sequence
  Synthetic Polynucleotide
taatacgactcactataggggtttgctgttggtcacattatttttgtgtcaacagaggagagacacaatgataatgtgaaacctggcggcagcgcaaaagatg

SEQ ID NO: 176993 - DNA, 103 bp, Artificial Sequence
  Synthetic Polynucleotide
taatacgactcactatagggctaaattcaggtttgctgttggtcacattaaacagaggagataatgtatgcaacagcaaaacctggcggcagcgcaaaagatg

SEQ ID NO: 176994 - DNA, 103 bp, Artificial Sequence
  Synthetic Polynucleotide
taatacgactcactatagggagaagaaatgctaaattcaggtttgctgttaacagaggagaaacagcatgcctgaatttaacctggcggcagcgcaaaagatg

SEQ ID NO: 176995 - DNA, 103 bp, Artificial Sequence
  Synthetic Polynucleotide
taatacgactcactataggggtccatttaaagaagaaatgctaaattcagaacagaggagactgaatatggcatttcttaacctggcggcagcgcaaaagatg

SEQ ID NO: 176996 - DNA, 103 bp, Artificial Sequence
  Synthetic Polynucleotide
taatacgactcactatagggctgtacatcagtccatttaaagaagaaatgaacagaggagacatttcatgtttaaatggaacctggcggcagcgcaaaagatg

SEQ ID NO: 176997 - DNA, 103 bp, Artificial Sequence
  Synthetic Polynucleotide
taatacgactcactatagggctgagtggaactgtacatcagtccatttaaaacagaggagattaaatatgctgatgtacaacctggcggcagcgcaaaagatg

SEQ ID NO: 176998 - DNA, 103 bp, Artificial Sequence
  Synthetic Polynucleotide
taatacgactcactatagggaactgctgggctgagtggaactgtacatcaaacagaggagatgatgtatggttccactcaacctggcggcagcgcaaaagatg

SEQ ID NO: 176999 - DNA, 103 bp, Artificial Sequence
  Synthetic Polynucleotide
taatacgactcactatagggttatccatgcaactgctgggctgagtggaaaacagaggagattccacatggcccagcagaacctggcggcagcgcaaaagatg

SEQ ID NO: 177000 - DNA, 103 bp, Artificial Sequence
  Synthetic Polynucleotide
taatacgactcactatagggaaatgtcctgttatccatgcaactgctgggaacagaggagacccagcatgtgcatggataacctggcggcagcgcaaaagatg

SEQ ID NO: 177001 - DNA, 103 bp, Artificial Sequence
  Synthetic Polynucleotide
taatacgactcactatagggctgggtatgaaaatgtcctgttatccatgcaacagaggagagcatggatgacaggacataacctggcggcagcgcaaaagatg

SEQ ID NO: 177002 - DNA, 103 bp, Artificial Sequence
  Synthetic Polynucleotide
taatacgactcactatagggacaatagaatcctggtgcacatcagagccaaacagaggagatggctcatgtgtgcaccaaacctggcggcagcgcaaaagatg

SEQ ID NO: 177003 - DNA, 103 bp, Artificial Sequence
  Synthetic Polynucleotide
taatacgactcactatagggttcatgatagaatcagacagcctcttccgcaacagaggagagcggaaatggctgtctgaaacctggcggcagcgcaaaagatg

SEQ ID NO: 177004 - DNA, 103 bp, Artificial Sequence
  Synthetic Polynucleotide
taatacgactcactatagggtttactacacctgggtatgaaaatgtcctgaacagaggagacaggacatgttcatacccaacctggcggcagcgcaaaagatg

SEQ ID NO: 177005 - DNA, 103 bp, Artificial Sequence
  Synthetic Polynucleotide
taatacgactcactatagggcacaggagtttttactacacctgggtatgaaacagaggagatcatacatgggtgtagtaaacctggcggcagcgcaaaagatg

SEQ ID NO: 177006 - DNA, 103 bp, Artificial Sequence
  Synthetic Polynucleotide
taatacgactcactatagggaagtaggactcacaggagtttttactacacaacagaggagagtgtagatgaaactcctgaacctggcggcagcgcaaaagatg

SEQ ID NO: 177007 - DNA, 103 bp, Artificial Sequence
  Synthetic Polynucleotide
taatacgactcactatagggtgctcagggaaagtaggactcacaggagttaacagaggagaaactccatggagtcctacaacctggcggcagcgcaaaagatg

SEQ ID NO: 177008 - DNA, 103 bp, Artificial Sequence
  Synthetic Polynucleotide
taatacgactcactatagggacagcccaagtgctcagggaaagtaggactaacagaggagaagtcctatgttccctgagaacctggcggcagcgcaaaagatg

SEQ ID NO: 177009 - DNA, 103 bp, Artificial Sequence
  Synthetic Polynucleotide
taatacgactcactatagggtagaccctgcacagcccaagtgctcagggaaacagaggagatccctgatgacttgggctaacctggcggcagcgcaaaagatg

SEQ ID NO: 177010 - DNA, 103 bp, Artificial Sequence
  Synthetic Polynucleotide
taatacgactcactataggggattctggtctagaccctgcacagcccaagaacagaggagacttgggatgtgcagggtcaacctggcggcagcgcaaaagatg

SEQ ID NO: 177011 - DNA, 103 bp, Artificial Sequence
  Synthetic Polynucleotide
taatacgactcactatagggcaaaagcccagattctggtctagaccctgcaacagaggagagcagggatgagaccagaaaacctggcggcagcgcaaaagatg

SEQ ID NO: 177012 - DNA, 103 bp, Artificial Sequence
  Synthetic Polynucleotide
taatacgactcactatagggaacacccattcaaaagcccagattctggtcaacagaggagagaccagatgctgggctttaacctggcggcagcgcaaaagatg

SEQ ID NO: 177013 - DNA, 103 bp, Artificial Sequence
  Synthetic Polynucleotide
taatacgactcactatagggctgggcatggaacacccattcaaaagcccaaacagaggagatgggctatggaatgggtgaacctggcggcagcgcaaaagatg

SEQ ID NO: 177014 - DNA, 103 bp, Artificial Sequence
  Synthetic Polynucleotide
taatacgactcactatagggtacgtttaaattcatgatagaatcagacagaacagaggagactgtctatgtctatcatgaacctggcggcagcgcaaaagatg

SEQ ID NO: 177015 - DNA, 103 bp, Artificial Sequence
  Synthetic Polynucleotide
taatacgactcactatagggtcctttctcactgggcatggaacacccattaacagaggagaaatgggatgtccatgcccaacctggcggcagcgcaaaagatg

SEQ ID NO: 177016 - DNA, 103 bp, Artificial Sequence
  Synthetic Polynucleotide
taatacgactcactatagggacttaatgggtcctttctcactgggcatggaacagaggagaccatgcatggtgagaaagaacctggcggcagcgcaaaagatg

SEQ ID NO: 177017 - DNA, 103 bp, Artificial Sequence
  Synthetic Polynucleotide
taatacgactcactataggggtgataacccacttaatgggtcctttctcaaacagaggagatgagaaatgacccattaaaacctggcggcagcgcaaaagatg

SEQ ID NO: 177018 - DNA, 103 bp, Artificial Sequence
  Synthetic Polynucleotide
taatacgactcactatagggctccgcatcagtgataacccacttaatgggaacagaggagacccattatgtgggttatcaacctggcggcagcgcaaaagatg

SEQ ID NO: 177019 - DNA, 103 bp, Artificial Sequence
  Synthetic Polynucleotide
taatacgactcactatagggactcattcttctccgcatcagtgataacccaacagaggagagggttaatgctgatgcggaacctggcggcagcgcaaaagatg

SEQ ID NO: 177020 - DNA, 103 bp, Artificial Sequence
  Synthetic Polynucleotide
taatacgactcactatagggtctttttcatactcattcttctccgcatcaaacagaggagatgatgcatggaagaatgaaacctggcggcagcgcaaaagatg

SEQ ID NO: 177021 - DNA, 103 bp, Artificial Sequence
  Synthetic Polynucleotide
taatacgactcactatagggtcttggagagtctttttcatactcattcttaacagaggagaaagaatatgtatgaaaaaaacctggcggcagcgcaaaagatg

SEQ ID NO: 177022 - DNA, 103 bp, Artificial Sequence
  Synthetic Polynucleotide
taatacgactcactatagggttttggtcaatcttggagagtctttttcataacagaggagaatgaaaatgactctccaaaacctggcggcagcgcaaaagatg

SEQ ID NO: 177023 - DNA, 103 bp, Artificial Sequence
  Synthetic Polynucleotide
taatacgactcactatagggattgggttggttttggtcaatcttggagagaacagaggagactctccatgattgaccaaaacctggcggcagcgcaaaagatg

SEQ ID NO: 177024 - DNA, 103 bp, Artificial Sequence
  Synthetic Polynucleotide
taatacgactcactataggggtaatatagtattgggttggttttggtcaaaacagaggagattgaccatgaccaacccaaacctggcggcagcgcaaaagatg

SEQ ID NO: 177025 - DNA, 103 bp, Artificial Sequence
  Synthetic Polynucleotide
taatacgactcactatagggcttccttctttacgtttaaattcatgatagaacagaggagactatcaatgatttaaacgaacctggcggcagcgcaaaagatg

SEQ ID NO: 177026 - DNA, 103 bp, Artificial Sequence
  Synthetic Polynucleotide
taatacgactcactatagggtttgaagcatgtaatatagtattgggttggaacagaggagaccaaccatgtactatattaacctggcggcagcgcaaaagatg

SEQ ID NO: 177027 - DNA, 103 bp, Artificial Sequence
  Synthetic Polynucleotide
taatacgactcactatagggttgcctcctttttgaagcatgtaatatagtaacagaggagaactataatgcatgcttcaaacctggcggcagcgcaaaagatg

SEQ ID NO: 177028 - DNA, 103 bp, Artificial Sequence
  Synthetic Polynucleotide
taatacgactcactatagggggtaacagaattgcctcctttttgaagcataacagaggagaatgcttatgaaaggaggcaacctggcggcagcgcaaaagatg

SEQ ID NO: 177029 - DNA, 103 bp, Artificial Sequence
  Synthetic Polynucleotide
taatacgactcactatagggtttctcgactggtaacagaattgcctccttaacagaggagaaaggagatgattctgttaaacctggcggcagcgcaaaagatg

SEQ ID NO: 177030 - DNA, 103 bp, Artificial Sequence
  Synthetic Polynucleotide
taatacgactcactatagggttgtcttgtgtttctcgactggtaacagaaaacagaggagattctgtatgcagtcgagaaacctggcggcagcgcaaaagatg

SEQ ID NO: 177031 - DNA, 103 bp, Artificial Sequence
  Synthetic Polynucleotide
taatacgactcactatagggccaaatgtccttgtcttgtgtttctcgactaacagaggagaagtcgaatgacacaagacaacctggcggcagcgcaaaagatg

SEQ ID NO: 177032 - DNA, 103 bp, Artificial Sequence
  Synthetic Polynucleotide
taatacgactcactatagggaagcctccctccaaatgtccttgtcttgtgaacagaggagacacaagatgaggacatttaacctggcggcagcgcaaaagatg

SEQ ID NO: 177033 - DNA, 103 bp, Artificial Sequence
  Synthetic Polynucleotide
taatacgactcactatagggtcagcagatgaagcctccctccaaatgtccaacagaggagaggacatatggagggaggcaacctggcggcagcgcaaaagatg

SEQ ID NO: 177034 - DNA, 103 bp, Artificial Sequence
  Synthetic Polynucleotide
taatacgactcactatagggtgagacactttcagcagatgaagcctccctaacagaggagaagggagatgtcatctgctaacctggcggcagcgcaaaagatg

SEQ ID NO: 177035 - DNA, 103 bp, Artificial Sequence
  Synthetic Polynucleotide
taatacgactcactatagggctgtgacctgtgagacactttcagcagatgaacagaggagacatctgatgaaagtgtctaacctggcggcagcgcaaaagatg

SEQ ID NO: 177036 - DNA, 103 bp, Artificial Sequence
  Synthetic Polynucleotide
taatacgactcactataggggctagcaaagcttccttctttacgtttaaaaacagaggagatttaaaatgaaagaaggaaacctggcggcagcgcaaaagatg

SEQ ID NO: 177037 - DNA, 103 bp, Artificial Sequence
  Synthetic Polynucleotide
taatacgactcactatagggtcttctttggctgtgacctgtgagacacttaacagaggagaaagtgtatgacaggtcacaacctggcggcagcgcaaaagatg

SEQ ID NO: 177038 - DNA, 103 bp, Artificial Sequence
  Synthetic Polynucleotide
taatacgactcactatagggaggaagtaactcttctttggctgtgacctgaacagaggagacaggtcatggccaaagaaaacctggcggcagcgcaaaagatg

SEQ ID NO: 177039 - DNA, 103 bp, Artificial Sequence
  Synthetic Polynucleotide
taatacgactcactatagggtttctgcagtaggaagtaactcttctttggaacagaggagaccaaagatgagttacttcaacctggcggcagcgcaaaagatg

SEQ ID NO: 177040 - DNA, 103 bp, Artificial Sequence
  Synthetic Polynucleotide
taatacgactcactataggggaagctttcgtttctgcagtaggaagtaacaacagaggagagttactatgtactgcagaaacctggcggcagcgcaaaagatg

SEQ ID NO: 177041 - DNA, 103 bp, Artificial Sequence
  Synthetic Polynucleotide
taatacgactcactatagggattaaagaaagaagctttcgtttctgcagtaacagaggagaactgcaatgacgaaagctaacctggcggcagcgcaaaagatg

SEQ ID NO: 177042 - DNA, 103 bp, Artificial Sequence
  Synthetic Polynucleotide
taatacgactcactatagggggcttcttaaattaaagaaagaagctttcgaacagaggagacgaaagatgctttctttaaacctggcggcagcgcaaaagatg

SEQ ID NO: 177043 - DNA, 103 bp, Artificial Sequence
  Synthetic Polynucleotide
taatacgactcactatagggctattgtaagggcttcttaaattaaagaaaaacagaggagatttcttatgtttaagaagaacctggcggcagcgcaaaagatg

SEQ ID NO: 177044 - DNA, 103 bp, Artificial Sequence
  Synthetic Polynucleotide
taatacgactcactatagggtcccatatggctattgtaagggcttcttaaaacagaggagattaagaatgccttacaataacctggcggcagcgcaaaagatg

SEQ ID NO: 177045 - DNA, 103 bp, Artificial Sequence
  Synthetic Polynucleotide
taatacgactcactatagggaagcattatttcccatatggctattgtaagaacagaggagacttacaatggccatatggaacctggcggcagcgcaaaagatg

SEQ ID NO: 177046 - DNA, 103 bp, Artificial Sequence
  Synthetic Polynucleotide
taatacgactcactatagggtgtgggcgagaagcattatttcccatatggaacagaggagaccatatatgaaataatgcaacctggcggcagcgcaaaagatg

SEQ ID NO: 177047 - DNA, 103 bp, Artificial Sequence
  Synthetic Polynucleotide
taatacgactcactatagggaaccatgccagctagcaaagcttccttcttaacagaggagaaagaagatggctttgctaaacctggcggcagcgcaaaagatg

SEQ ID NO: 177048 - DNA, 103 bp, Artificial Sequence
  Synthetic Polynucleotide
taatacgactcactatagggatttgcgctgtgtgggcgagaagcattattaacagaggagaaataatatgtctcgcccaaacctggcggcagcgcaaaagatg

SEQ ID NO: 177049 - DNA, 103 bp, Artificial Sequence
  Synthetic Polynucleotide
taatacgactcactatagggaaacttctccatttgcgctgtgtgggcgagaacagaggagactcgccatgacagcgcaaaacctggcggcagcgcaaaagatg

SEQ ID NO: 177050 - DNA, 103 bp, Artificial Sequence
  Synthetic Polynucleotide
taatacgactcactatagggagaagtccataaacttctccatttgcgctgaacagaggagacagcgcatgtggagaagtaacctggcggcagcgcaaaagatg

SEQ ID NO: 177051 - DNA, 103 bp, Artificial Sequence
  Synthetic Polynucleotide
taatacgactcactatagggcacgcttcccagaagtccataaacttctccaacagaggagaggagaaatgtatggacttaacctggcggcagcgcaaaagatg

SEQ ID NO: 177052 - DNA, 103 bp, Artificial Sequence
  Synthetic Polynucleotide
taatacgactcactatagggttatcgttagcacgcttcccagaagtccataacagaggagaatggacatgtgggaagcgaacctggcggcagcgcaaaagatg

SEQ ID NO: 177053 - DNA, 103 bp, Artificial Sequence
  Synthetic Polynucleotide
taatacgactcactataggggattctttctttatcgttagcacgcttcccaacagaggagagggaagatggctaacgataacctggcggcagcgcaaaagatg

SEQ ID NO: 177054 - DNA, 103 bp, Artificial Sequence
  Synthetic Polynucleotide
taatacgactcactataggggcacactgtcaaccatgccagctagcaaagaacagaggagactttgcatgctggcatggaacctggcggcagcgcaaaagatg

SEQ ID NO: 177055 - DNA, 103 bp, Artificial Sequence
  Synthetic Polynucleotide
taatacgactcactatagggttgcctttaggcacactgtcaaccatgccaaacagaggagatggcatatgtgacagtgtaacctggcggcagcgcaaaagatg

SEQ ID NO: 177056 - DNA, 103 bp, Artificial Sequence
  Synthetic Polynucleotide
taatacgactcactataggggctatcctgtttgcctttaggcacactgtcaacagaggagagacagtatgcctaaaggcaacctggcggcagcgcaaaagatg

SEQ ID NO: 177057 - DNA, 103 bp, Artificial Sequence
  Synthetic Polynucleotide
taatacgactcactatagggccagtaatgtgctatcctgtttgcctttagaacagaggagactaaagatgaacaggataaacctggcggcagcgcaaaagatg

SEQ ID NO: 177058 - DNA, 103 bp, Artificial Sequence
  Synthetic Polynucleotide
taatacgactcactatagggagcaaagaggccagtaatgtgctatcctgtaacagaggagaacaggaatgcacattactaacctggcggcagcgcaaaagatg

SEQ ID NO: 177059 - DNA, 103 bp, Artificial Sequence
  Synthetic Polynucleotide
taatacgactcactataggggtaagttaaaacaatagaatcctggtgcacaacagaggagagtgcacatggattctattaacctggcggcagcgcaaaagatg

SEQ ID NO: 177060 - DNA, 103 bp, Artificial Sequence
  Synthetic Polynucleotide
taatacgactcactataggggaatgactgaagcaaagaggccagtaatgtaacagaggagaacattaatggcctctttgaacctggcggcagcgcaaaagatg

SEQ ID NO: 177061 - DNA, 103 bp, Artificial Sequence
  Synthetic Polynucleotide
taatacgactcactataggggcctagagctgaatgactgaagcaaagaggaacagaggagacctcttatgttcagtcataacctggcggcagcgcaaaagatg

SEQ ID NO: 177062 - DNA, 103 bp, Artificial Sequence
  Synthetic Polynucleotide
taatacgactcactatagggacagtctgcagcctagagctgaatgactgaaacagaggagatcagtcatgcagctctagaacctggcggcagcgcaaaagatg

SEQ ID NO: 177063 - DNA, 103 bp, Artificial Sequence
  Synthetic Polynucleotide
taatacgactcactatagggtgacagagcaacagtctgcagcctagagctaacagaggagaagctctatgctgcagactaacctggcggcagcgcaaaagatg

SEQ ID NO: 177064 - DNA, 103 bp, Artificial Sequence
  Synthetic Polynucleotide
taatacgactcactatagggtgatttgttgtgacagagcaacagtctgcaaacagaggagatgcagaatgttgctctgtaacctggcggcagcgcaaaagatg

SEQ ID NO: 177065 - DNA, 103 bp, Artificial Sequence
  Synthetic Polynucleotide
taatacgactcactatagggaggctctgcctgatttgttgtgacagagcaaacagaggagatgctctatgacaacaaataacctggcggcagcgcaaaagatg

SEQ ID NO: 177066 - DNA, 103 bp, Artificial Sequence
  Synthetic Polynucleotide
taatacgactcactatagggttgctccttgaggctctgcctgatttgttgaacagaggagacaacaaatgaggcagagcaacctggcggcagcgcaaaagatg

SEQ ID NO: 177067 - DNA, 103 bp, Artificial Sequence
  Synthetic Polynucleotide
taatacgactcactataggggggcatatccttgctccttgaggctctgccaacagaggagaggcagaatgtcaaggagcaacctggcggcagcgcaaaagatg

SEQ ID NO: 177068 - DNA, 103 bp, Artificial Sequence
  Synthetic Polynucleotide
taatacgactcactatagggtcatgactgagggcatatccttgctccttgaacagaggagacaaggaatgaggatatgcaacctggcggcagcgcaaaagatg

SEQ ID NO: 177069 - DNA, 103 bp, Artificial Sequence
  Synthetic Polynucleotide
taatacgactcactatagggttttaaagaatcatgactgagggcatatccaacagaggagaggatatatgctcagtcataacctggcggcagcgcaaaagatg

SEQ ID NO: 177070 - DNA, 103 bp, Artificial Sequence
  Synthetic Polynucleotide
taatacgactcactatagggatccttctaggtaagttaaaacaatagaataacagaggagaattctaatgttttaacttaacctggcggcagcgcaaaagatg

SEQ ID NO: 177071 - DNA, 103 bp, Artificial Sequence
  Synthetic Polynucleotide
taatacgactcactatagggccttctccacttttaaagaatcatgactgaaacagaggagatcagtcatgattctttaaaacctggcggcagcgcaaaagatg

SEQ ID NO: 177072 - DNA, 103 bp, Artificial Sequence
  Synthetic Polynucleotide
taatacgactcactatagggcaccttaaatccttctccacttttaaagaaaacagaggagattctttatgagtggagaaaacctggcggcagcgcaaaagatg

SEQ ID NO: 177073 - DNA, 103 bp, Artificial Sequence
  Synthetic Polynucleotide
taatacgactcactatagggaacaccatagcaccttaaatccttctccacaacagaggagagtggagatggatttaaggaacctggcggcagcgcaaaagatg

SEQ ID NO: 177074 - DNA, 103 bp, Artificial Sequence
  Synthetic Polynucleotide
taatacgactcactataggggacttgatgcaacaccatagcaccttaaataacagaggagaatttaaatggctatggtgaacctggcggcagcgcaaaagatg

SEQ ID NO: 177075 - DNA, 103 bp, Artificial Sequence
  Synthetic Polynucleotide
taatacgactcactataggggtttttaagtgacttgatgcaacaccatagaacagaggagactatggatgtgcatcaagaacctggcggcagcgcaaaagatg

SEQ ID NO: 177076 - DNA, 103 bp, Artificial Sequence
  Synthetic Polynucleotide
taatacgactcactatagggcttcaacaaagtttttaagtgacttgatgcaacagaggagagcatcaatgcacttaaaaaacctggcggcagcgcaaaagatg

SEQ ID NO: 177077 - DNA, 103 bp, Artificial Sequence
  Synthetic Polynucleotide
taatacgactcactatagggctttacttttcttcaacaaagtttttaagtaacagaggagaacttaaatgctttgttgaaacctggcggcagcgcaaaagatg

SEQ ID NO: 177078 - DNA, 103 bp, Artificial Sequence
  Synthetic Polynucleotide
taatacgactcactatagggtgatctttaactttacttttcttcaacaaaaacagaggagatttgttatggaaaagtaaaacctggcggcagcgcaaaagatg

SEQ ID NO: 177079 - DNA, 103 bp, Artificial Sequence
  Synthetic Polynucleotide
taatacgactcactatagggatcaggcttttgatctttaactttacttttaacagaggagaaaaagtatggttaaagataacctggcggcagcgcaaaagatg

SEQ ID NO: 177080 - DNA, 103 bp, Artificial Sequence
  Synthetic Polynucleotide
taatacgactcactataggggaagattcgtatcaggcttttgatctttaaaacagaggagattaaagatgaaaagcctgaacctggcggcagcgcaaaagatg

SEQ ID NO: 177081 - DNA, 103 bp, Artificial Sequence
  Synthetic Polynucleotide
taatacgactcactatagggtgcattagtaatccttctaggtaagttaaaaacagaggagatttaacatgcctagaaggaacctggcggcagcgcaaaagatg

SEQ ID NO: 177082 - DNA, 103 bp, Artificial Sequence
  Synthetic Polynucleotide
taatacgactcactataggggtcacatcaggaagattcgtatcaggctttaacagaggagaaaagccatgtacgaatctaacctggcggcagcgcaaaagatg

SEQ ID NO: 177083 - DNA, 103 bp, Artificial Sequence
  Synthetic Polynucleotide
taatacgactcactataggggaggtttttagtcacatcaggaagattcgtaacagaggagaacgaatatgcctgatgtgaacctggcggcagcgcaaaagatg

SEQ ID NO: 177084 - DNA, 103 bp, Artificial Sequence
  Synthetic Polynucleotide
taatacgactcactatagggtatctctgatgaggtttttagtcacatcagaacagaggagactgatgatgctaaaaaccaacctggcggcagcgcaaaagatg

SEQ ID NO: 177085 - DNA, 103 bp, Artificial Sequence
  Synthetic Polynucleotide
taatacgactcactatagggtctgcaaacctatctctgatgaggtttttaaacagaggagataaaaaatgcatcagagaaacctggcggcagcgcaaaagatg

SEQ ID NO: 177086 - DNA, 103 bp, Artificial Sequence
  Synthetic Polynucleotide
taatacgactcactatagggatgaggagactctgcaaacctatctctgataacagaggagaatcagaatgaggtttgcaaacctggcggcagcgcaaaagatg

SEQ ID NO: 177087 - DNA, 103 bp, Artificial Sequence
  Synthetic Polynucleotide
taatacgactcactataggggtccaacatgatgaggagactctgcaaaccaacagaggagaggtttgatgagtctcctcaacctggcggcagcgcaaaagatg

SEQ ID NO: 177088 - DNA, 103 bp, Artificial Sequence
  Synthetic Polynucleotide
taatacgactcactataggggttccactttgtccaacatgatgaggagacaacagaggagagtctccatgtcatgttggaacctggcggcagcgcaaaagatg

SEQ ID NO: 177089 - DNA, 103 bp, Artificial Sequence
  Synthetic Polynucleotide
taatacgactcactatagggcatgacctttgttccactttgtccaacatgaacagaggagacatgttatgcaaagtggaaacctggcggcagcgcaaaagatg

SEQ ID NO: 177090 - DNA, 103 bp, Artificial Sequence
  Synthetic Polynucleotide
taatacgactcactatagggacggttcactcatgacctttgttccactttaacagaggagaaaagtgatgcaaaggtcaaacctggcggcagcgcaaaagatg

SEQ ID NO: 177091 - DNA, 103 bp, Artificial Sequence
  Synthetic Polynucleotide
taatacgactcactataggggcacatgacaacggttcactcatgacctttaacagaggagaaaaggtatggagtgaaccaacctggcggcagcgcaaaagatg

SEQ ID NO: 177092 - DNA, 103 bp, Artificial Sequence
  Synthetic Polynucleotide
taatacgactcactatagggtgctgcctgatgcattagtaatccttctagaacagaggagactagaaatgttactaatgaacctggcggcagcgcaaaagatg

SEQ ID NO: 177093 - DNA, 103 bp, Artificial Sequence
  Synthetic Polynucleotide
taatacgactcactatagggtaatcttgcagcacatgacaacggttcactaacagaggagaagtgaaatgttgtcatgtaacctggcggcagcgcaaaagatg

SEQ ID NO: 177094 - DNA, 103 bp, Artificial Sequence
  Synthetic Polynucleotide
taatacgactcactatagggcaacagcctgtaatcttgcagcacatgacaaacagaggagatgtcatatgctgcaagataacctggcggcagcgcaaaagatg

SEQ ID NO: 177095 - DNA, 103 bp, Artificial Sequence
  Synthetic Polynucleotide
taatacgactcactatagggaccatgcttgcaacagcctgtaatcttgcaaacagaggagatgcaagatgacaggctgtaacctggcggcagcgcaaaagatg

SEQ ID NO: 177096 - DNA, 103 bp, Artificial Sequence
  Synthetic Polynucleotide
taatacgactcactatagggccttttttccaccatgcttgcaacagcctgaacagaggagacaggctatggcaagcatgaacctggcggcagcgcaaaagatg

SEQ ID NO: 177097 - DNA, 103 bp, Artificial Sequence
  Synthetic Polynucleotide
taatacgactcactatagggcaggactagcccttttttccaccatgcttgaacagaggagacaagcaatgtggaaaaaaaacctggcggcagcgcaaaagatg

SEQ ID NO: 177098 - DNA, 103 bp, Artificial Sequence
  Synthetic Polynucleotide
taatacgactcactatagggggtgaggtggcaggactagcccttttttccaacagaggagaggaaaaatgggctagtccaacctggcggcagcgcaaaagatg

SEQ ID NO: 177099 - DNA, 103 bp, Artificial Sequence
  Synthetic Polynucleotide
taatacgactcactatagggactaggtttaggtgaggtggcaggactagcaacagaggagagctagtatggccacctcaaacctggcggcagcgcaaaagatg

SEQ ID NO: 177100 - DNA, 103 bp, Artificial Sequence
  Synthetic Polynucleotide
taatacgactcactatagggtacaagcaacactaggtttaggtgaggtggaacagaggagaccacctatgctaaacctaaacctggcggcagcgcaaaagatg

SEQ ID NO: 177101 - DNA, 103 bp, Artificial Sequence
  Synthetic Polynucleotide
taatacgactcactataggggctaactggctacaagcaacactaggtttaaacagaggagataaaccatgtgttgcttgaacctggcggcagcgcaaaagatg

SEQ ID NO: 177102 - DNA, 103 bp, Artificial Sequence
  Synthetic Polynucleotide
taatacgactcactatagggcagaagtaatgctaactggctacaagcaacaacagaggagagttgctatgagccagttaaacctggcggcagcgcaaaagatg

SEQ ID NO: 177103 - DNA, 103 bp, Artificial Sequence
  Synthetic Polynucleotide
taatacgactcactatagggctgatccccctgctgcctgatgcattagtaaacagaggagatactaaatgatcaggcagaacctggcggcagcgcaaaagatg

SEQ ID NO: 177104 - DNA, 103 bp, Artificial Sequence
  Synthetic Polynucleotide
taatacgactcactatagggcttcgcttgacagaagtaatgctaactggcaacagaggagagccagtatgcattacttcaacctggcggcagcgcaaaagatg

SEQ ID NO: 177105 - DNA, 103 bp, Artificial Sequence
  Synthetic Polynucleotide
taatacgactcactatagggtgcaaatgggcttcgcttgacagaagtaataacagaggagaattactatggtcaagcgaaacctggcggcagcgcaaaagatg

SEQ ID NO: 177106 - DNA, 103 bp, Artificial Sequence
  Synthetic Polynucleotide
taatacgactcactatagggagaatactgctgcaaatgggcttcgcttgaaacagaggagatcaagcatggcccatttgaacctggcggcagcgcaaaagatg

SEQ ID NO: 177107 - DNA, 103 bp, Artificial Sequence
  Synthetic Polynucleotide
taatacgactcactatagggcgtgttctcgagaatactgctgcaaatgggaacagaggagacccattatgagcagtattaacctggcggcagcgcaaaagatg

SEQ ID NO: 177108 - DNA, 103 bp, Artificial Sequence
  Synthetic Polynucleotide
taatacgactcactataggggtttttaaagcgtgttctcgagaatactgcaacagaggagagcagtaatgtcgagaacaaacctggcggcagcgcaaaagatg

SEQ ID NO: 177109 - DNA, 103 bp, Artificial Sequence
  Synthetic Polynucleotide
taatacgactcactatagggtgcattttgcgtttttaaagcgtgttctcgaacagaggagacgagaaatggctttaaaaaacctggcggcagcgcaaaagatg

SEQ ID NO: 177110 - DNA, 103 bp, Artificial Sequence
  Synthetic Polynucleotide
taatacgactcactatagggctgcttgatttgcattttgcgtttttaaagaacagaggagactttaaatgcgcaaaatgaacctggcggcagcgcaaaagatg

SEQ ID NO: 177111 - DNA, 103 bp, Artificial Sequence
  Synthetic Polynucleotide
taatacgactcactatagggctttcacttgctgcttgatttgcattttgcaacagaggagagcaaaaatgaaatcaagcaacctggcggcagcgcaaaagatg

SEQ ID NO: 177112 - DNA, 103 bp, Artificial Sequence
  Synthetic Polynucleotide
taatacgactcactatagggagcagcaagtctttcacttgctgcttgattaacagaggagaaatcaaatggcaagtgaaaacctggcggcagcgcaaaagatg

SEQ ID NO: 177113 - DNA, 103 bp, Artificial Sequence
  Synthetic Polynucleotide
taatacgactcactatagggatctggccatagcagcaagtctttcacttgaacagaggagacaagtgatggacttgctgaacctggcggcagcgcaaaagatg

SEQ ID NO: 177114 - DNA, 103 bp, Artificial Sequence
  Synthetic Polynucleotide
taatacgactcactatagggacggcagtacctgatccccctgctgcctgaaacagaggagatcaggcatgagggggatcaacctggcggcagcgcaaaagatg

SEQ ID NO: 177115 - DNA, 103 bp, Artificial Sequence
  Synthetic Polynucleotide
taatacgactcactatagggttttcttgcaatctggccatagcagcaagtaacagaggagaacttgcatgtatggccagaacctggcggcagcgcaaaagatg

SEQ ID NO: 177116 - DNA, 103 bp, Artificial Sequence
  Synthetic Polynucleotide
taatacgactcactatagggcttctggccattttcttgcaatctggccataacagaggagaatggccatgttgcaagaaaacctggcggcagcgcaaaagatg

SEQ ID NO: 177117 - DNA, 103 bp, Artificial Sequence
  Synthetic Polynucleotide
taatacgactcactatagggtgccaacatccttctggccattttcttgcaaacagaggagatgcaagatgatggccagaaacctggcggcagcgcaaaagatg

SEQ ID NO: 177118 - DNA, 103 bp, Artificial Sequence
  Synthetic Polynucleotide
taatacgactcactatagggagctggtaactgccaacatccttctggccaaacagaggagatggccaatgggatgttggaacctggcggcagcgcaaaagatg

SEQ ID NO: 177119 - DNA, 103 bp, Artificial Sequence
  Synthetic Polynucleotide
taatacgactcactatagggtccttttgggagctggtaactgccaacatcaacagaggagagatgttatgagttaccagaacctggcggcagcgcaaaagatg

SEQ ID NO: 177120 - DNA, 103 bp, Artificial Sequence
  Synthetic Polynucleotide
taatacgactcactatagggggcttgacattccttttgggagctggtaacaacagaggagagttaccatgtcccaaaagaacctggcggcagcgcaaaagatg

SEQ ID NO: 177121 - DNA, 103 bp, Artificial Sequence
  Synthetic Polynucleotide
taatacgactcactatagggccattaagatggcttgacattccttttgggaacagaggagacccaaaatgaatgtcaagaacctggcggcagcgcaaaagatg

SEQ ID NO: 177122 - DNA, 103 bp, Artificial Sequence
  Synthetic Polynucleotide
taatacgactcactatagggtcttgcctgaccattaagatggcttgacataacagaggagaatgtcaatgcatcttaataacctggcggcagcgcaaaagatg

SEQ ID NO: 177123 - DNA, 103 bp, Artificial Sequence
  Synthetic Polynucleotide
taatacgactcactatagggttgatgatgttcttgcctgaccattaagataacagaggagaatcttaatggtcaggcaaaacctggcggcagcgcaaaagatg

SEQ ID NO: 177124 - DNA, 103 bp, Artificial Sequence
  Synthetic Polynucleotide
taatacgactcactatagggatcagtttgcttgatgatgttcttgcctgaaacagaggagatcaggcatgaacatcatcaacctggcggcagcgcaaaagatg

SEQ ID NO: 177125 - DNA, 103 bp, Artificial Sequence
  Synthetic Polynucleotide
taatacgactcactatagggcatggccagggggctggggggcagggccataacagaggagaatggccatgccccccagcaacctggcggcagcgcaaaagatg

SEQ ID NO: 177126 - DNA, 103 bp, Artificial Sequence
  Synthetic Polynucleotide
taatacgactcactataggggcccagtgaggctgtaggggggccaggtcgaacagaggagacgacctatgccccctacaaacctggcggcagcgcaaaagatg

SEQ ID NO: 177127 - DNA, 103 bp, Artificial Sequence
  Synthetic Polynucleotide
taatacgactcactatagggaaggtgtggagcccagtgaggctgtaggggaacagaggagacccctaatgcctcactggaacctggcggcagcgcaaaagatg

SEQ ID NO: 177128 - DNA, 103 bp, Artificial Sequence
  Synthetic Polynucleotide
taatacgactcactatagggactgagctgtaaggtgtggagcccagtgagaacagaggagactcactatgctccacaccaacctggcggcagcgcaaaagatg

SEQ ID NO: 177129 - DNA, 103 bp, Artificial Sequence
  Synthetic Polynucleotide
taatacgactcactatagggtgaaggaggcactgagctgtaaggtgtggaaacagaggagatccacaatgtacagctcaaacctggcggcagcgcaaaagatg

SEQ ID NO: 177130 - DNA, 103 bp, Artificial Sequence
  Synthetic Polynucleotide
taatacgactcactatagggtgaaggtgggtgaaggaggcactgagctgtaacagaggagaacagctatgtgcctccttaacctggcggcagcgcaaaagatg

SEQ ID NO: 177131 - DNA, 103 bp, Artificial Sequence
  Synthetic Polynucleotide
taatacgactcactatagggcctggttcactgaaggtgggtgaaggaggcaacagaggagagcctccatgacccaccttaacctggcggcagcgcaaaagatg

SEQ ID NO: 177132 - DNA, 103 bp, Artificial Sequence
  Synthetic Polynucleotide
taatacgactcactatagggccccaccatgcctggttcactgaaggtgggaacagaggagacccaccatgagtgaaccaaacctggcggcagcgcaaaagatg

SEQ ID NO: 177133 - DNA, 103 bp, Artificial Sequence
  Synthetic Polynucleotide
taatacgactcactatagggcctcggttgcccccaccatgcctggttcacaacagaggagagtgaacatggcatggtggaacctggcggcagcgcaaaagatg

SEQ ID NO: 177134 - DNA, 103 bp, Artificial Sequence
  Synthetic Polynucleotide
taatacgactcactatagggggccgggtgccctcggttgcccccaccatgaacagaggagacatggtatgggcaaccgaaacctggcggcagcgcaaaagatg

SEQ ID NO: 177135 - DNA, 103 bp, Artificial Sequence
  Synthetic Polynucleotide
taatacgactcactatagggctccaggcctggccgggtgccctcggttgcaacagaggagagcaaccatgggcacccggaacctggcggcagcgcaaaagatg

SEQ ID NO: 177136 - DNA, 103 bp, Artificial Sequence
  Synthetic Polynucleotide
taatacgactcactatagggtgacatattccatggccagggggctgggggaacagaggagacccccaatgccctggccaaacctggcggcagcgcaaaagatg

SEQ ID NO: 177137 - DNA, 103 bp, Artificial Sequence
  Synthetic Polynucleotide
taatacgactcactatagggagtacagctcctccaggcctggccgggtgcaacagaggagagcacccatgcaggcctggaacctggcggcagcgcaaaagatg

SEQ ID NO: 177138 - DNA, 103 bp, Artificial Sequence
  Synthetic Polynucleotide
taatacgactcactataggggtagccagccagtacagctcctccaggcctaacagaggagaaggcctatgggagctgtaaacctggcggcagcgcaaaagatg

SEQ ID NO: 177139 - DNA, 103 bp, Artificial Sequence
  Synthetic Polynucleotide
taatacgactcactatagggctgctgcagggtagccagccagtacagctcaacagaggagagagctgatgtggctggctaacctggcggcagcgcaaaagatg

SEQ ID NO: 177140 - DNA, 103 bp, Artificial Sequence
  Synthetic Polynucleotide
taatacgactcactatagggcccccagctgctgctgcagggtagccagccaacagaggagaggctggatgccctgcagcaacctggcggcagcgcaaaagatg

SEQ ID NO: 177141 - DNA, 103 bp, Artificial Sequence
  Synthetic Polynucleotide
taatacgactcactataggggcctccccagcccccagctgctgctgcaggaacagaggagacctgcaatggcagctgggaacctggcggcagcgcaaaagatg

SEQ ID NO: 177142 - DNA, 103 bp, Artificial Sequence
  Synthetic Polynucleotide
taatacgactcactatagggcagccccaatgcctccccagcccccagctgaacagaggagacagctgatggctggggagaacctggcggcagcgcaaaagatg

SEQ ID NO: 177143 - DNA, 103 bp, Artificial Sequence
  Synthetic Polynucleotide
taatacgactcactatagggcttcaggactcagccccaatgcctccccagaacagaggagactggggatgcattggggcaacctggcggcagcgcaaaagatg

SEQ ID NO: 177144 - DNA, 103 bp, Artificial Sequence
  Synthetic Polynucleotide
taatacgactcactatagggtccatggcctcttcaggactcagccccaataacagaggagaattgggatggagtcctgaaacctggcggcagcgcaaaagatg

SEQ ID NO: 177145 - DNA, 103 bp, Artificial Sequence
  Synthetic Polynucleotide
taatacgactcactatagggctgcagcagctccatggcctcttcaggactaacagaggagaagtcctatggaggccatgaacctggcggcagcgcaaaagatg

SEQ ID NO: 177146 - DNA, 103 bp, Artificial Sequence
  Synthetic Polynucleotide
taatacgactcactatagggggccctgaccctgcagcagctccatggcctaacagaggagaaggccaatgagctgctgcaacctggcggcagcgcaaaagatg

SEQ ID NO: 177147 - DNA, 103 bp, Artificial Sequence
  Synthetic Polynucleotide
taatacgactcactatagggtcaaagtcattgacatattccatggccaggaacagaggagacctggcatgggaatatgtaacctggcggcagcgcaaaagatg

SEQ ID NO: 177148 - DNA, 103 bp, Artificial Sequence
  Synthetic Polynucleotide
taatacgactcactatagggacagggactgggccctgaccctgcagcagcaacagaggagagctgctatggggtcagggaacctggcggcagcgcaaaagatg

SEQ ID NO: 177149 - DNA, 103 bp, Artificial Sequence
  Synthetic Polynucleotide
taatacgactcactataggggggcccatcaacagggactgggccctgaccaacagaggagaggtcagatgccagtccctaacctggcggcagcgcaaaagatg

SEQ ID NO: 177150 - DNA, 103 bp, Artificial Sequence
  Synthetic Polynucleotide
taatacgactcactatagggagtagccatggggcccatcaacagggactgaacagaggagacagtccatgttgatgggcaacctggcggcagcgcaaaagatg

SEQ ID NO: 177151 - DNA, 103 bp, Artificial Sequence
  Synthetic Polynucleotide
taatacgactcactatagggctccctgggtagtagccatggggcccatcaaacagaggagatgatggatgccatggctaaacctggcggcagcgcaaaagatg

SEQ ID NO: 177152 - DNA, 103 bp, Artificial Sequence
  Synthetic Polynucleotide
taatacgactcactatagggctcctctgggctccctgggtagtagccatgaacagaggagacatggcatgtacccagggaacctggcggcagcgcaaaagatg

SEQ ID NO: 177153 - DNA, 103 bp, Artificial Sequence
  Synthetic Polynucleotide
taatacgactcactataggggggctcctgtctcctctgggctccctgggtaacagaggagaacccagatggcccagaggaacctggcggcagcgcaaaagatg

SEQ ID NO: 177154 - DNA, 103 bp, Artificial Sequence
  Synthetic Polynucleotide
taatacgactcactatagggtggacgtgctgggctcctgtctcctctgggaacagaggagacccagaatggacaggagcaacctggcggcagcgcaaaagatg

SEQ ID NO: 177155 - DNA, 103 bp, Artificial Sequence
  Synthetic Polynucleotide
taatacgactcactatagggctctgccagctggacgtgctgggctcctgtaacagaggagaacaggaatgcagcacgtcaacctggcggcagcgcaaaagatg

SEQ ID NO: 177156 - DNA, 103 bp, Artificial Sequence
  Synthetic Polynucleotide
taatacgactcactatagggcggaaaaccgctctgccagctggacgtgctaacagaggagaagcacgatgagctggcagaacctggcggcagcgcaaaagatg

SEQ ID NO: 177157 - DNA, 103 bp, Artificial Sequence
  Synthetic Polynucleotide
taatacgactcactatagggagcgccgcgtcggaaaaccgctctgccagcaacagaggagagctggcatggcggttttcaacctggcggcagcgcaaaagatg

SEQ ID NO: 177158 - DNA, 103 bp, Artificial Sequence
  Synthetic Polynucleotide
taatacgactcactatagggcttcatcaagtcaaagtcattgacatattcaacagaggagagaatatatgaatgactttaacctggcggcagcgcaaaagatg

SEQ ID NO: 177159 - DNA, 103 bp, Artificial Sequence
  Synthetic Polynucleotide
taatacgactcactatagggcatcgagaccagcgccgcgtcggaaaaccgaacagaggagacggtttatggacgcggcgaacctggcggcagcgcaaaagatg

SEQ ID NO: 177160 - DNA, 103 bp, Artificial Sequence
  Synthetic Polynucleotide
taatacgactcactatagggcccgcacagacatcgagaccagcgccgcgtaacagaggagaacgcggatgtggtctcgaaacctggcggcagcgcaaaagatg

SEQ ID NO: 177161 - DNA, 103 bp, Artificial Sequence
  Synthetic Polynucleotide
taatacgactcactatagggcggtttagctcccgcacagacatcgagaccaacagaggagaggtctcatggtctgtgcgaacctggcggcagcgcaaaagatg

SEQ ID NO: 177162 - DNA, 103 bp, Artificial Sequence
  Synthetic Polynucleotide
taatacgactcactatagggccgcagctgccggtttagctcccgcacagaaacagaggagatctgtgatggagctaaacaacctggcggcagcgcaaaagatg

SEQ ID NO: 177163 - DNA, 103 bp, Artificial Sequence
  Synthetic Polynucleotide
taatacgactcactataggggcccgcagccccgcagctgccggtttagctaacagaggagaagctaaatgggcagctgcaacctggcggcagcgcaaaagatg

SEQ ID NO: 177164 - DNA, 103 bp, Artificial Sequence
  Synthetic Polynucleotide
taatacgactcactataggggcctcgtcgcgcccgcagccccgcagctgcaacagaggagagcagctatggggctgcggaacctggcggcagcgcaaaagatg

SEQ ID NO: 177165 - DNA, 103 bp, Artificial Sequence
  Synthetic Polynucleotide
taatacgactcactatagggcagccgcagcgcctcgtcgcgcccgcagccaacagaggagaggctgcatgcgcgacgagaacctggcggcagcgcaaaagatg

SEQ ID NO: 177166 - DNA, 103 bp, Artificial Sequence
  Synthetic Polynucleotide
taatacgactcactataggggcctctgcttcagccgcagcgcctcgtcgcaacagaggagagcgacgatgcgctgcggcaacctggcggcagcgcaaaagatg

SEQ ID NO: 177167 - DNA, 103 bp, Artificial Sequence
  Synthetic Polynucleotide
taatacgactcactatagggagcgtgcggcgcctctgcttcagccgcagcaacagaggagagctgcgatggaagcagagaacctggcggcagcgcaaaagatg

SEQ ID NO: 177168 - DNA, 103 bp, Artificial Sequence
  Synthetic Polynucleotide
taatacgactcactataggggcggttcttcagcgtgcggcgcctctgcttaacagaggagaaagcagatgcgccgcacgaacctggcggcagcgcaaaagatg

SEQ ID NO: 177169 - DNA, 103 bp, Artificial Sequence
  Synthetic Polynucleotide
taatacgactcactatagggttacctcaaacttcatcaagtcaaagtcataacagaggagaatgactatgacttgatgaaacctggcggcagcgcaaaagatg

SEQ ID NO: 177170 - DNA, 103 bp, Artificial Sequence
  Synthetic Polynucleotide
taatacgactcactataggggcgcgtagccgcggttcttcagcgtgcggcaacagaggagagccgcaatgtgaagaaccaacctggcggcagcgcaaaagatg

SEQ ID NO: 177171 - DNA, 103 bp, Artificial Sequence
  Synthetic Polynucleotide
taatacgactcactatagggcgacaggcctgcgcgtagccgcggttcttcaacagaggagagaagaaatgcggctacgcaacctggcggcagcgcaaaagatg

SEQ ID NO: 177172 - DNA, 103 bp, Artificial Sequence
  Synthetic Polynucleotide
taatacgactcactatagggccgcttggagcgacaggcctgcgcgtagccaacagaggagaggctacatgcaggcctgtaacctggcggcagcgcaaaagatg

SEQ ID NO: 177173 - DNA, 103 bp, Artificial Sequence
  Synthetic Polynucleotide
taatacgactcactataggggctgctgcagccgcttggagcgacaggcctaacagaggagaaggcctatggctccaagcaacctggcggcagcgcaaaagatg

SEQ ID NO: 177174 - DNA, 103 bp, Artificial Sequence
  Synthetic Polynucleotide
taatacgactcactatagggagcccgcgccgctgctgcagccgcttggagaacagaggagactccaaatggctgcagcaaacctggcggcagcgcaaaagatg

SEQ ID NO: 177175 - DNA, 103 bp, Artificial Sequence
  Synthetic Polynucleotide
taatacgactcactatagggctcggcctccagcccgcgccgctgctgcagaacagaggagactgcagatgcggcgcgggaacctggcggcagcgcaaaagatg

SEQ ID NO: 177176 - DNA, 103 bp, Artificial Sequence
  Synthetic Polynucleotide
taatacgactcactatagggggcgggcgcgctcggcctccagcccgcgccaacagaggagaggcgcgatgtggaggccgaacctggcggcagcgcaaaagatg

SEQ ID NO: 177177 - DNA, 103 bp, Artificial Sequence
  Synthetic Polynucleotide
taatacgactcactatagggtgggcggccaggcgggcgcgctcggcctccaacagaggagaggaggcatggcgcgcccgaacctggcggcagcgcaaaagatg

SEQ ID NO: 177178 - DNA, 103 bp, Artificial Sequence
  Synthetic Polynucleotide
taatacgactcactatagggcgcgtccagctgggcggccaggcgggcgcgaacagaggagacgcgccatgctggccgccaacctggcggcagcgcaaaagatg

SEQ ID NO: 177179 - DNA, 103 bp, Artificial Sequence
  Synthetic Polynucleotide
taatacgactcactatagggcggcccgcagcgcgtccagctgggcggccaaacagaggagatggccgatgagctggacgaacctggcggcagcgcaaaagatg

SEQ ID NO: 177180 - DNA, 103 bp, Artificial Sequence
  Synthetic Polynucleotide
taatacgactcactatagggggttcccgctttacctcaaacttcatcaagaacagaggagacttgatatggtttgaggtaacctggcggcagcgcaaaagatg

SEQ ID NO: 177181 - DNA, 103 bp, Artificial Sequence
  Synthetic Polynucleotide
taatacgactcactatagggcgggccacctcggcccgcagcgcgtccagcaacagaggagagctggaatggctgcgggcaacctggcggcagcgcaaaagatg

SEQ ID NO: 177182 - DNA, 103 bp, Artificial Sequence
  Synthetic Polynucleotide
taatacgactcactatagggccgggccaggcgggccacctcggcccgcagaacagaggagactgcggatggaggtggccaacctggcggcagcgcaaaagatg

SEQ ID NO: 177183 - DNA, 103 bp, Artificial Sequence
  Synthetic Polynucleotide
taatacgactcactataggggatcgcgctcccgggccaggcgggccacctaacagaggagaaggtggatggcctggcccaacctggcggcagcgcaaaagatg

SEQ ID NO: 177184 - DNA, 103 bp, Artificial Sequence
  Synthetic Polynucleotide
taatacgactcactataggggccttgtagagatcgcgctcccgggccaggaacagaggagacctggcatgggagcgcgaaacctggcggcagcgcaaaagatg

SEQ ID NO: 177185 - DNA, 103 bp, Artificial Sequence
  Synthetic Polynucleotide
taatacgactcactataggggtcacagcgagccttgtagagatcgcgctcaacagaggagagagcgcatgctctacaagaacctggcggcagcgcaaaagatg

SEQ ID NO: 177186 - DNA, 103 bp, Artificial Sequence
  Synthetic Polynucleotide
taatacgactcactatagggaggttagccggtcacagcgagccttgtagaaacagaggagatctacaatgctcgctgtgaacctggcggcagcgcaaaagatg

SEQ ID NO: 177187 - DNA, 103 bp, Artificial Sequence
  Synthetic Polynucleotide
taatacgactcactataggggggccgctcgaggttagccggtcacagcgaaacagaggagatcgctgatgccggctaacaacctggcggcagcgcaaaagatg

SEQ ID NO: 177188 - DNA, 103 bp, Artificial Sequence
  Synthetic Polynucleotide
taatacgactcactatagggcccggacccggggccgctcgaggttagccgaacagaggagacggctaatgtcgagcggcaacctggcggcagcgcaaaagatg

SEQ ID NO: 177189 - DNA, 103 bp, Artificial Sequence
  Synthetic Polynucleotide
taatacgactcactataggggggaggggtccccggacccggggccgctcgaacagaggagacgagcgatgccgggtccgaacctggcggcagcgcaaaagatg

SEQ ID NO: 177190 - DNA, 103 bp, Artificial Sequence
  Synthetic Polynucleotide
taatacgactcactatagggaggaagaggtgggaggggtccccggacccgaacagaggagacgggtcatgggacccctcaacctggcggcagcgcaaaagatg

SEQ ID NO: 177191 - DNA, 103 bp, Artificial Sequence
  Synthetic Polynucleotide
taatacgactcactataggggccctcagagggttcccgctttacctcaaaaacagaggagatttgagatgaagcgggaaaacctggcggcagcgcaaaagatg

SEQ ID NO: 177192 - DNA, 103 bp, Artificial Sequence
  Synthetic Polynucleotide
taatacgactcactatagggggccaggtcggccctcagagggttcccgctaacagaggagaagcgggatgcctctgaggaacctggcggcagcgcaaaagatg

SEQ ID NO: 177193 - DNA, 103 bp, Artificial Sequence
  Synthetic Polynucleotide
taatacgactcactataggggctgtaggggggccaggtcggccctcagagaacagaggagactctgaatgccgacctggaacctggcggcagcgcaaaagatg

SEQ ID NO: 177194 - DNA, 103 bp, Artificial Sequence
  Synthetic Polynucleotide
taatacgactcactatagggcgaaagggctgtccttgtcttcaggggcataacagaggagaatgcccatgaagacaaggaacctggcggcagcgcaaaagatg

SEQ ID NO: 177195 - DNA, 103 bp, Artificial Sequence
  Synthetic Polynucleotide
taatacgactcactatagggaaatggcaattcctgtgaagtagatgatgaaacagaggagatcatcaatgacttcacagaacctggcggcagcgcaaaagatg

SEQ ID NO: 177196 - DNA, 103 bp, Artificial Sequence
  Synthetic Polynucleotide
taatacgactcactataggggggtttattcttctctcgagaacactttgaaacagaggagatcaaagatgtctcgagagaacctggcggcagcgcaaaagatg

SEQ ID NO: 177197 - DNA, 103 bp, Artificial Sequence
  Synthetic Polynucleotide
taatacgactcactatagggggcttcgttggggtttattcttctctcgagaacagaggagactcgagatgagaataaacaacctggcggcagcgcaaaagatg

SEQ ID NO: 177198 - DNA, 103 bp, Artificial Sequence
  Synthetic Polynucleotide
taatacgactcactatagggccacacaccaggcttcgttggggtttattcaacagaggagagaataaatgccaacgaagaacctggcggcagcgcaaaagatg

SEQ ID NO: 177199 - DNA, 103 bp, Artificial Sequence
  Synthetic Polynucleotide
taatacgactcactatagggcacttttgaaccacacaccaggcttcgttgaacagaggagacaacgaatgctggtgtgtaacctggcggcagcgcaaaagatg

SEQ ID NO: 177200 - DNA, 103 bp, Artificial Sequence
  Synthetic Polynucleotide
taatacgactcactatagggagcagagcttcacttttgaaccacacaccaaacagaggagatggtgtatggttcaaaagaacctggcggcagcgcaaaagatg

SEQ ID NO: 177201 - DNA, 103 bp, Artificial Sequence
  Synthetic Polynucleotide
taatacgactcactataggggctccaatatagcagagcttcacttttgaaaacagaggagattcaaaatggaagctctgaacctggcggcagcgcaaaagatg

SEQ ID NO: 177202 - DNA, 103 bp, Artificial Sequence
  Synthetic Polynucleotide
taatacgactcactatagggctcatcacctgctccaatatagcagagcttaacagaggagaaagctcatgtatattggaaacctggcggcagcgcaaaagatg

SEQ ID NO: 177203 - DNA, 103 bp, Artificial Sequence
  Synthetic Polynucleotide
taatacgactcactatagggttcgcttttcctcatcacctgctccaatataacagaggagaatattgatgcaggtgatgaacctggcggcagcgcaaaagatg

SEQ ID NO: 177204 - DNA, 103 bp, Artificial Sequence
  Synthetic Polynucleotide
taatacgactcactatagggatggaatcacttcgcttttcctcatcacctaacagaggagaaggtgaatgggaaaagcgaacctggcggcagcgcaaaagatg

SEQ ID NO: 177205 - DNA, 103 bp, Artificial Sequence
  Synthetic Polynucleotide
taatacgactcactatagggacagatactaatggaatcacttcgcttttcaacagaggagagaaaagatgagtgattccaacctggcggcagcgcaaaagatg

SEQ ID NO: 177206 - DNA, 103 bp, Artificial Sequence
  Synthetic Polynucleotide
taatacgactcactatagggtaggttgacaaaatggcaattcctgtgaagaacagaggagacttcacatgaattgccataacctggcggcagcgcaaaagatg

SEQ ID NO: 177207 - DNA, 103 bp, Artificial Sequence
  Synthetic Polynucleotide
taatacgactcactatagggcagaagtggtacagatactaatggaatcacaacagaggagagtgattatgttagtatctaacctggcggcagcgcaaaagatg

SEQ ID NO: 177208 - DNA, 103 bp, Artificial Sequence
  Synthetic Polynucleotide
taatacgactcactatagggcttccatcatcagaagtggtacagatactaaacagaggagatagtatatgtaccacttcaacctggcggcagcgcaaaagatg

SEQ ID NO: 177209 - DNA, 103 bp, Artificial Sequence
  Synthetic Polynucleotide
taatacgactcactatagggcaggtcactgcttccatcatcagaagtggtaacagaggagaaccactatggatgatggaaacctggcggcagcgcaaaagatg

SEQ ID NO: 177210 - DNA, 103 bp, Artificial Sequence
  Synthetic Polynucleotide
taatacgactcactatagggctatgggatccaggtcactgcttccatcataacagaggagaatgatgatggcagtgaccaacctggcggcagcgcaaaagatg

SEQ ID NO: 177211 - DNA, 103 bp, Artificial Sequence
  Synthetic Polynucleotide
taatacgactcactataggggagctgtgttctatgggatccaggtcactgaacagaggagacagtgaatgggatcccataacctggcggcagcgcaaaagatg

SEQ ID NO: 177212 - DNA, 103 bp, Artificial Sequence
  Synthetic Polynucleotide
taatacgactcactatagggatcagactctgagctgtgttctatgggatcaacagaggagagatcccatggaacacagcaacctggcggcagcgcaaaagatg

SEQ ID NO: 177213 - DNA, 103 bp, Artificial Sequence
  Synthetic Polynucleotide
taatacgactcactatagggggacactgttatcagactctgagctgtgttaacagaggagaaacacaatgcagagtctgaacctggcggcagcgcaaaagatg

SEQ ID NO: 177214 - DNA, 103 bp, Artificial Sequence
  Synthetic Polynucleotide
taatacgactcactatagggggaatttcaaggacactgttatcagactctaacagaggagaagagtcatgtaacagtgtaacctggcggcagcgcaaaagatg

SEQ ID NO: 177215 - DNA, 103 bp, Artificial Sequence
  Synthetic Polynucleotide
taatacgactcactataggggaaagcatctggaatttcaaggacactgttaacagaggagaaacagtatgcttgaaattaacctggcggcagcgcaaaagatg

SEQ ID NO: 177216 - DNA, 103 bp, Artificial Sequence
  Synthetic Polynucleotide
taatacgactcactatagggctgttctatcgaaagcatctggaatttcaaaacagaggagattgaaaatgcagatgcttaacctggcggcagcgcaaaagatg

SEQ ID NO: 177217 - DNA, 103 bp, Artificial Sequence
  Synthetic Polynucleotide
taatacgactcactataggggactttttcttaggttgacaaaatggcaataacagaggagaattgccatgttgtcaaccaacctggcggcagcgcaaaagatg

SEQ ID NO: 177218 - DNA, 103 bp, Artificial Sequence
  Synthetic Polynucleotide
taatacgactcactatagggaacatgttctctgttctatcgaaagcatctaacagaggagaagatgcatgcgatagaacaacctggcggcagcgcaaaagatg

SEQ ID NO: 177219 - DNA, 103 bp, Artificial Sequence
  Synthetic Polynucleotide
taatacgactcactatagggctgcatagataacatgttctctgttctatcaacagaggagagatagaatggagaacatgaacctggcggcagcgcaaaagatg

SEQ ID NO: 177220 - DNA, 103 bp, Artificial Sequence
  Synthetic Polynucleotide
taatacgactcactatagggtttcatttttctgcatagataacatgttctaacagaggagaagaacaatgtatctatgcaacctggcggcagcgcaaaagatg

SEQ ID NO: 177221 - DNA, 103 bp, Artificial Sequence
  Synthetic Polynucleotide
taatacgactcactatagggtactttatcttttcatttttctgcatagataacagaggagaatctatatggaaaaatgaaacctggcggcagcgcaaaagatg

SEQ ID NO: 177222 - DNA, 103 bp, Artificial Sequence
  Synthetic Polynucleotide
taatacgactcactatagggaaacctagaatactttatcttttcatttttaacagaggagaaaaaatatgaagataaagaacctggcggcagcgcaaaagatg

SEQ ID NO: 177223 - DNA, 103 bp, Artificial Sequence
  Synthetic Polynucleotide
taatacgactcactatagggttgtggcagcaaacctagaatactttatctaacagaggagaagataaatgattctaggtaacctggcggcagcgcaaaagatg

SEQ ID NO: 177224 - DNA, 103 bp, Artificial Sequence
  Synthetic Polynucleotide
taatacgactcactatagggaccctagtgtttgtggcagcaaacctagaaaacagaggagattctagatgtgctgccacaacctggcggcagcgcaaaagatg

SEQ ID NO: 177225 - DNA, 103 bp, Artificial Sequence
  Synthetic Polynucleotide
taatacgactcactatagggttttgcttttaccctagtgtttgtggcagcaacagaggagagctgccatgaacactaggaacctggcggcagcgcaaaagatg

SEQ ID NO: 177226 - DNA, 103 bp, Artificial Sequence
  Synthetic Polynucleotide
taatacgactcactataggggaggcttctgttttgcttttaccctagtgtaacagaggagaacactaatgtaaaagcaaaacctggcggcagcgcaaaagatg

SEQ ID NO: 177227 - DNA, 103 bp, Artificial Sequence
  Synthetic Polynucleotide
taatacgactcactatagggttactaatgagaggcttctgttttgcttttaacagaggagaaaaagcatgacagaagccaacctggcggcagcgcaaaagatg

SEQ ID NO: 177228 - DNA, 103 bp, Artificial Sequence
  Synthetic Polynucleotide
taatacgactcactatagggcagtggcgtagactttttcttaggttgacaaacagaggagatgtcaaatgaagaaaaagaacctggcggcagcgcaaaagatg

SEQ ID NO: 177229 - DNA, 103 bp, Artificial Sequence
  Synthetic Polynucleotide
taatacgactcactatagggtgtatgtgagttactaatgagaggcttctgaacagaggagacagaagatgctcattagtaacctggcggcagcgcaaaagatg

SEQ ID NO: 177230 - DNA, 103 bp, Artificial Sequence
  Synthetic Polynucleotide
taatacgactcactatagggttaagtggtctgtatgtgagttactaatgaaacagaggagatcattaatgactcacataaacctggcggcagcgcaaaagatg

SEQ ID NO: 177231 - DNA, 103 bp, Artificial Sequence
  Synthetic Polynucleotide
taatacgactcactataggggtacaacccattaagtggtctgtatgtgagaacagaggagactcacaatgagaccacttaacctggcggcagcgcaaaagatg

SEQ ID NO: 177232 - DNA, 103 bp, Artificial Sequence
  Synthetic Polynucleotide
taatacgactcactatagggtgcactcttagtacaacccattaagtggtcaacagaggagagaccacatgatgggttgtaacctggcggcagcgcaaaagatg

SEQ ID NO: 177233 - DNA, 103 bp, Artificial Sequence
  Synthetic Polynucleotide
taatacgactcactatagggttccaggctctgcactcttagtacaacccaaacagaggagatgggttatgctaagagtgaacctggcggcagcgcaaaagatg

SEQ ID NO: 177234 - DNA, 103 bp, Artificial Sequence
  Synthetic Polynucleotide
taatacgactcactataggggacgtctcggttccaggctctgcactcttaaacagaggagataagagatgagagcctggaacctggcggcagcgcaaaagatg

SEQ ID NO: 177235 - DNA, 103 bp, Artificial Sequence
  Synthetic Polynucleotide
taatacgactcactatagggattaacctgagacgtctcggttccaggctcaacagaggagagagcctatgaccgagacgaacctggcggcagcgcaaaagatg

SEQ ID NO: 177236 - DNA, 103 bp, Artificial Sequence
  Synthetic Polynucleotide
taatacgactcactataggggatcagagagattaacctgagacgtctcggaacagaggagaccgagaatgctcaggttaaacctggcggcagcgcaaaagatg

SEQ ID NO: 177237 - DNA, 103 bp, Artificial Sequence
  Synthetic Polynucleotide
taatacgactcactataggggatgccttcagatcagagagattaacctgaaacagaggagatcaggtatgtctctctgaaacctggcggcagcgcaaaagatg

SEQ ID NO: 177238 - DNA, 103 bp, Artificial Sequence
  Synthetic Polynucleotide
taatacgactcactatagggaacaagagtagatgccttcagatcagagagaacagaggagactctctatgctgaaggcaaacctggcggcagcgcaaaagatg

SEQ ID NO: 177239 - DNA, 103 bp, Artificial Sequence
  Synthetic Polynucleotide
taatacgactcactatagggcttcatacttcagtggcgtagactttttctaacagaggagaagaaaaatgctacgccacaacctggcggcagcgcaaaagatg

SEQ ID NO: 177240 - DNA, 103 bp, Artificial Sequence
  Synthetic Polynucleotide
taatacgactcactatagggggggtttgtgaacaagagtagatgccttcaaacagaggagatgaaggatgctactcttgaacctggcggcagcgcaaaagatg

SEQ ID NO: 177241 - DNA, 103 bp, Artificial Sequence
  Synthetic Polynucleotide
taatacgactcactatagggaaatctgactggggtttgtgaacaagagtaaacagaggagatactctatgtcacaaaccaacctggcggcagcgcaaaagatg

SEQ ID NO: 177242 - DNA, 103 bp, Artificial Sequence
  Synthetic Polynucleotide
taatacgactcactatagggatcatttgtaaaatctgactggggtttgtgaacagaggagacacaaaatgcagtcagataacctggcggcagcgcaaaagatg

SEQ ID NO: 177243 - DNA, 103 bp, Artificial Sequence
  Synthetic Polynucleotide
taatacgactcactataggggagagagagcatcatttgtaaaatctgactaacagaggagaagtcagatgttacaaatgaacctggcggcagcgcaaaagatg

SEQ ID NO: 177244 - DNA, 103 bp, Artificial Sequence
  Synthetic Polynucleotide
taatacgactcactatagggttgaattttggagagagagcatcatttgtaaacagaggagatacaaaatgtgctctctcaacctggcggcagcgcaaaagatg

SEQ ID NO: 177245 - DNA, 103 bp, Artificial Sequence
  Synthetic Polynucleotide
taatacgactcactatagggtgatgacaggttgaattttggagagagagcaacagaggagagctctcatgccaaaattcaacctggcggcagcgcaaaagatg

SEQ ID NO: 177246 - DNA, 103 bp, Artificial Sequence
  Synthetic Polynucleotide
taatacgactcactatagggtggatatgcttgatgacaggttgaattttgaacagaggagacaaaatatgacctgtcataacctggcggcagcgcaaaagatg

SEQ ID NO: 177247 - DNA, 103 bp, Artificial Sequence
  Synthetic Polynucleotide
taatacgactcactataggggagttctcactggatatgcttgatgacaggaacagaggagacctgtcatgaagcatatcaacctggcggcagcgcaaaagatg

SEQ ID NO: 177248 - DNA, 103 bp, Artificial Sequence
  Synthetic Polynucleotide
taatacgactcactatagggctttattaacgagttctcactggatatgctaacagaggagaagcataatgagtgagaacaacctggcggcagcgcaaaagatg

SEQ ID NO: 177249 - DNA, 103 bp, Artificial Sequence
  Synthetic Polynucleotide
taatacgactcactatagggctgccccaccctttattaacgagttctcacaacagaggagagtgagaatgcgttaataaaacctggcggcagcgcaaaagatg

SEQ ID NO: 177250 - DNA, 103 bp, Artificial Sequence
  Synthetic Polynucleotide
taatacgactcactatagggagatctccaacttcatacttcagtggcgtaaacagaggagatacgccatggaagtatgaaacctggcggcagcgcaaaagatg

SEQ ID NO: 177251 - DNA, 103 bp, Artificial Sequence
  Synthetic Polynucleotide
taatacgactcactataggggcttgatttgctgccccaccctttattaacaacagaggagagttaatatggggtggggcaacctggcggcagcgcaaaagatg

SEQ ID NO: 177252 - DNA, 103 bp, Artificial Sequence
  Synthetic Polynucleotide
taatacgactcactatagggatgtaatagagcttgatttgctgccccaccaacagaggagaggtgggatggcaaatcaaaacctggcggcagcgcaaaagatg

SEQ ID NO: 177253 - DNA, 103 bp, Artificial Sequence
  Synthetic Polynucleotide
taatacgactcactatagggtgcttttcgaatgtaatagagcttgatttgaacagaggagacaaatcatgctctattacaacctggcggcagcgcaaaagatg

SEQ ID NO: 177254 - DNA, 103 bp, Artificial Sequence
  Synthetic Polynucleotide
taatacgactcactatagggttgggctgtttgcttttcgaatgtaatagaaacagaggagatctattatgttcgaaaagaacctggcggcagcgcaaaagatg

SEQ ID NO: 177255 - DNA, 103 bp, Artificial Sequence
  Synthetic Polynucleotide
taatacgactcactatagggacttcggaacttgggctgtttgcttttcgaaacagaggagatcgaaaatgaaacagcccaacctggcggcagcgcaaaagatg

SEQ ID NO: 177256 - DNA, 103 bp, Artificial Sequence
  Synthetic Polynucleotide
taatacgactcactatagggtgcactttatacttcggaacttgggctgttaacagaggagaaacagcatgagttccgaaaacctggcggcagcgcaaaagatg

SEQ ID NO: 177257 - DNA, 103 bp, Artificial Sequence
  Synthetic Polynucleotide
taatacgactcactatagggtctttgtgtttgcactttatacttcggaacaacagaggagagttccgatgtataaagtgaacctggcggcagcgcaaaagatg

SEQ ID NO: 177258 - DNA, 103 bp, Artificial Sequence
  Synthetic Polynucleotide
taatacgactcactatagggaactggattttctttgtgtttgcactttataacagaggagaataaagatgaaacacaaaaacctggcggcagcgcaaaagatg

SEQ ID NO: 177259 - DNA, 103 bp, Artificial Sequence
  Synthetic Polynucleotide
taatacgactcactataggggttctgccataactggattttctttgtgttaacagaggagaaacacaatgaaaatccagaacctggcggcagcgcaaaagatg

SEQ ID NO: 177260 - DNA, 103 bp, Artificial Sequence
  Synthetic Polynucleotide
taatacgactcactatagggataactgggggttctgccataactggatttaacagaggagaaaatccatgtatggcagaaacctggcggcagcgcaaaagatg

SEQ ID NO: 177261 - DNA, 103 bp, Artificial Sequence
  Synthetic Polynucleotide
taatacgactcactatagggtgcccagatgagatctccaacttcatacttaacagaggagaaagtatatggttggagataacctggcggcagcgcaaaagatg

SEQ ID NO: 177262 - DNA, 103 bp, Artificial Sequence
  Synthetic Polynucleotide
taatacgactcactatagggctcctcatttataactgggggttctgccataacagaggagaatggcaatgcccccagttaacctggcggcagcgcaaaagatg

SEQ ID NO: 177263 - DNA, 103 bp, Artificial Sequence
  Synthetic Polynucleotide
taatacgactcactatagggtcaaactgcactcctcatttataactggggaacagaggagaccccagatgtaaatgaggaacctggcggcagcgcaaaagatg

SEQ ID NO: 177264 - DNA, 103 bp, Artificial Sequence
  Synthetic Polynucleotide
taatacgactcactataggggagcagcatttcaaactgcactcctcatttaacagaggagaaaatgaatggtgcagtttaacctggcggcagcgcaaaagatg

SEQ ID NO: 177265 - DNA, 103 bp, Artificial Sequence
  Synthetic Polynucleotide
taatacgactcactatagggggtatcagaagagcagcatttcaaactgcaaacagaggagatgcagtatgaaatgctgcaacctggcggcagcgcaaaagatg

SEQ ID NO: 177266 - DNA, 103 bp, Artificial Sequence
  Synthetic Polynucleotide
taatacgactcactataggggagagcctttggtatcagaagagcagcattaacagaggagaaatgctatgcttctgataaacctggcggcagcgcaaaagatg

SEQ ID NO: 177267 - DNA, 103 bp, Artificial Sequence
  Synthetic Polynucleotide
taatacgactcactatagggctggccaaaggagagcctttggtatcagaaaacagaggagattctgaatgcaaaggctcaacctggcggcagcgcaaaagatg

SEQ ID NO: 177268 - DNA, 103 bp, Artificial Sequence
  Synthetic Polynucleotide
taatacgactcactatagggtttagaaatgctggccaaaggagagcctttaacagaggagaaaaggcatgcctttggccaacctggcggcagcgcaaaagatg

SEQ ID NO: 177269 - DNA, 103 bp, Artificial Sequence
  Synthetic Polynucleotide
taatacgactcactatagggctttcccacttttagaaatgctggccaaagaacagaggagactttggatggcatttctaaacctggcggcagcgcaaaagatg

SEQ ID NO: 177270 - DNA, 103 bp, Artificial Sequence
  Synthetic Polynucleotide
taatacgactcactatagggagaccatccactttcccacttttagaaatgaacagaggagacatttcatgaagtgggaaaacctggcggcagcgcaaaagatg

SEQ ID NO: 177271 - DNA, 103 bp, Artificial Sequence
  Synthetic Polynucleotide
taatacgactcactatagggcagtagttttagaccatccactttcccactaacagaggagaagtgggatggtggatggtaacctggcggcagcgcaaaagatg

SEQ ID NO: 177272 - DNA, 103 bp, Artificial Sequence
  Synthetic Polynucleotide
taatacgactcactatagggtcttgaattttgcccagatgagatctccaaaacagaggagattggagatgtcatctgggaacctggcggcagcgcaaaagatg

SEQ ID NO: 177273 - DNA, 103 bp, Artificial Sequence
  Synthetic Polynucleotide
taatacgactcactataggggcatattgttcagtagttttagaccatccaaacagaggagatggatgatgtaaaactacaacctggcggcagcgcaaaagatg

SEQ ID NO: 177274 - DNA, 103 bp, Artificial Sequence
  Synthetic Polynucleotide
taatacgactcactataggggttttctcatgcatattgttcagtagttttaacagaggagaaaaactatggaacaatataacctggcggcagcgcaaaagatg

SEQ ID NO: 177275 - DNA, 103 bp, Artificial Sequence
  Synthetic Polynucleotide
taatacgactcactatagggtgaatccctggttttctcatgcatattgttaacagaggagaaacaatatgcatgagaaaaacctggcggcagcgcaaaagatg

SEQ ID NO: 177276 - DNA, 103 bp, Artificial Sequence
  Synthetic Polynucleotide
taatacgactcactatagggctatgtcacttgaatccctggttttctcataacagaggagaatgagaatgccagggattaacctggcggcagcgcaaaagatg

SEQ ID NO: 177277 - DNA, 103 bp, Artificial Sequence
  Synthetic Polynucleotide
taatacgactcactatagggactgctgtttctatgtcacttgaatccctgaacagaggagacagggaatgaagtgacataacctggcggcagcgcaaaagatg

SEQ ID NO: 177278 - DNA, 103 bp, Artificial Sequence
  Synthetic Polynucleotide
taatacgactcactatagggatgtttcaccactgctgtttctatgtcactaacagaggagaagtgacatggaaacagcaaacctggcggcagcgcaaaagatg

SEQ ID NO: 177279 - DNA, 103 bp, Artificial Sequence
  Synthetic Polynucleotide
taatacgactcactatagggcggataaaacatgtttcaccactgctgtttaacagaggagaaaacagatgtggtgaaacaacctggcggcagcgcaaaagatg

SEQ ID NO: 177280 - DNA, 103 bp, Artificial Sequence
  Synthetic Polynucleotide
taatacgactcactatagggtccttcaactcggataaaacatgtttcaccaacagaggagaggtgaaatgtgttttatcaacctggcggcagcgcaaaagatg

SEQ ID NO: 177281 - DNA, 103 bp, Artificial Sequence
  Synthetic Polynucleotide
taatacgactcactataggggtaagagagttccttcaactcggataaaacaacagaggagagttttaatggagttgaagaacctggcggcagcgcaaaagatg

SEQ ID NO: 177282 - DNA, 103 bp, Artificial Sequence
  Synthetic Polynucleotide
taatacgactcactatagggctaaggatctgtaagagagttccttcaactaacagaggagaagttgaatgaactctcttaacctggcggcagcgcaaaagatg

SEQ ID NO: 177283 - DNA, 103 bp, Artificial Sequence
  Synthetic Polynucleotide
taatacgactcactatagggcatgggcgtctcttgaattttgcccagatgaacagaggagacatctgatgaaaattcaaaacctggcggcagcgcaaaagatg

SEQ ID NO: 177284 - DNA, 103 bp, Artificial Sequence
  Synthetic Polynucleotide
taatacgactcactatagggacatcctcacctaaggatctgtaagagagtaacagaggagaactctcatgcagatccttaacctggcggcagcgcaaaagatg

SEQ ID NO: 177285 - DNA, 103 bp, Artificial Sequence
  Synthetic Polynucleotide
taatacgactcactatagggagagtcactgacatcctcacctaaggatctaacagaggagaagatccatgggtgaggataacctggcggcagcgcaaaagatg

SEQ ID NO: 177286 - DNA, 103 bp, Artificial Sequence
  Synthetic Polynucleotide
taatacgactcactatagggttgatgttccagagtcactgacatcctcacaacagaggagagtgaggatgtcagtgactaacctggcggcagcgcaaaagatg

SEQ ID NO: 177287 - DNA, 103 bp, Artificial Sequence
  Synthetic Polynucleotide
taatacgactcactatagggtttgatggctttgatgttccagagtcactgaacagaggagacagtgaatgtggaacatcaacctggcggcagcgcaaaagatg

SEQ ID NO: 177288 - DNA, 103 bp, Artificial Sequence
  Synthetic Polynucleotide
taatacgactcactatagggaagtaatggttttgatggctttgatgttccaacagaggagaggaacaatgaagccatcaaacctggcggcagcgcaaaagatg

SEQ ID NO: 177289 - DNA, 103 bp, Artificial Sequence
  Synthetic Polynucleotide
taatacgactcactatagggcagaagagaaaagtaatggttttgatggctaacagaggagaagccatatgaaccattacaacctggcggcagcgcaaaagatg

SEQ ID NO: 177290 - DNA, 103 bp, Artificial Sequence
  Synthetic Polynucleotide
taatacgactcactatagggtgactagaagcagaagagaaaagtaatggtaacagaggagaaccattatgtttctcttcaacctggcggcagcgcaaaagatg

SEQ ID NO: 177291 - DNA, 103 bp, Artificial Sequence
  Synthetic Polynucleotide
taatacgactcactatagggtatgtgattctgactagaagcagaagagaaaacagaggagattctctatggcttctagtaacctggcggcagcgcaaaagatg

SEQ ID NO: 177292 - DNA, 103 bp, Artificial Sequence
  Synthetic Polynucleotide
taatacgactcactataggggttcaataggtatgtgattctgactagaagaacagaggagacttctaatgagaatcacaaacctggcggcagcgcaaaagatg

SEQ ID NO: 177293 - DNA, 103 bp, Artificial Sequence
  Synthetic Polynucleotide
taatacgactcactatagggttgtagtctggttcaataggtatgtgattcaacagaggagagaatcaatgacctattgaaacctggcggcagcgcaaaagatg

SEQ ID NO: 177294 - DNA, 103 bp, Artificial Sequence
  Synthetic Polynucleotide
taatacgactcactataggggcagggccaccatgggcgtctcttgaatttaacagaggagaaaattcatgagacgcccaaacctggcggcagcgcaaaagatg

SEQ ID NO: 177295 - DNA, 103 bp, Artificial Sequence
  Synthetic Polynucleotide
taatacgactcactatagggtgtactgaatttgtagtctggttcaataggaacagaggagacctattatgccagactacaacctggcggcagcgcaaaagatg

SEQ ID NO: 177296 - DNA, 103 bp, Artificial Sequence
  Synthetic Polynucleotide
taatacgactcactatagggtcattagcaatgtactgaatttgtagtctgaacagaggagacagactatgaattcagtaaacctggcggcagcgcaaaagatg

SEQ ID NO: 177297 - DNA, 103 bp, Artificial Sequence
  Synthetic Polynucleotide
taatacgactcactatagggtctttcaacatcattagcaatgtactgaataacagaggagaattcagatgattgctaataacctggcggcagcgcaaaagatg

SEQ ID NO: 177298 - DNA, 103 bp, Artificial Sequence
  Synthetic Polynucleotide
taatacgactcactatagggatcatgcatatctttcaacatcattagcaaaacagaggagattgctaatgatgttgaaaaacctggcggcagcgcaaaagatg

SEQ ID NO: 177299 - DNA, 103 bp, Artificial Sequence
  Synthetic Polynucleotide
taatacgactcactatagggtcgtcttactatcatgcatatctttcaacaaacagaggagatgttgaatgatatgcatgaacctggcggcagcgcaaaagatg

SEQ ID NO: 177300 - DNA, 103 bp, Artificial Sequence
  Synthetic Polynucleotide
taatacgactcactatagggcgctgctccttcgtcttactatcatgcataaacagaggagatatgcaatgtagtaagacaacctggcggcagcgcaaaagatg

SEQ ID NO: 177301 - DNA, 103 bp, Artificial Sequence
  Synthetic Polynucleotide
taatacgactcactatagggagtcatcaaccgctgctccttcgtcttactaacagaggagaagtaagatgaaggagcagaacctggcggcagcgcaaaagatg

SEQ ID NO: 177302 - DNA, 103 bp, Artificial Sequence
  Synthetic Polynucleotide
taatacgactcactatagggggttttgagcagtcatcaaccgctgctcctaacagaggagaaggagcatgggttgatgaaacctggcggcagcgcaaaagatg

SEQ ID NO: 177303 - DNA, 103 bp, Artificial Sequence
  Synthetic Polynucleotide
taatacgactcactatagggtaagagaccaggttttgagcagtcatcaacaacagaggagagttgatatgtgctcaaaaaacctggcggcagcgcaaaagatg

SEQ ID NO: 177304 - DNA, 103 bp, Artificial Sequence
  Synthetic Polynucleotide
taatacgactcactatagggaggactccggtaagagaccaggttttgagcaacagaggagagctcaaatgctggtctctaacctggcggcagcgcaaaagatg

SEQ ID NO: 177305 - DNA, 103 bp, Artificial Sequence
  Synthetic Polynucleotide
taatacgactcactatagggctggatcatccgaaagggctgtccttgtctaacagaggagaagacaaatgcagccctttaacctggcggcagcgcaaaagatg

SEQ ID NO: 177306 - DNA, 103 bp, Artificial Sequence
  Synthetic Polynucleotide
taatacgactcactatagggaacaaatcctgcagggccaccatgggcgtcaacagaggagagacgccatgggtggccctaacctggcggcagcgcaaaagatg

SEQ ID NO: 177307 - DNA, 103 bp, Artificial Sequence
  Synthetic Polynucleotide
taatacgactcactatagggccccacgaccaggactccggtaagagaccaaacagaggagatggtctatgaccggagtcaacctggcggcagcgcaaaagatg

SEQ ID NO: 177308 - DNA, 103 bp, Artificial Sequence
  Synthetic Polynucleotide
taatacgactcactataggggtagaacagtccccacgaccaggactccggaacagaggagaccggagatgtggtcgtggaacctggcggcagcgcaaaagatg

SEQ ID NO: 177309 - DNA, 103 bp, Artificial Sequence
  Synthetic Polynucleotide
taatacgactcactatagggaggactattagtagaacagtccccacgaccaacagaggagaggtcgtatggactgttctaacctggcggcagcgcaaaagatg

SEQ ID NO: 177310 - DNA, 103 bp, Artificial Sequence
  Synthetic Polynucleotide
taatacgactcactatagggagactcctacaggactattagtagaacagtaacagaggagaactgttatgctaatagtcaacctggcggcagcgcaaaagatg

SEQ ID NO: 177311 - DNA, 103 bp, Artificial Sequence
  Synthetic Polynucleotide
taatacgactcactatagggaaaaccttagagactcctacaggactattaaacagaggagataatagatgtgtaggagtaacctggcggcagcgcaaaagatg

SEQ ID NO: 177312 - DNA, 103 bp, Artificial Sequence
  Synthetic Polynucleotide
taatacgactcactatagggtcctgaaaccaaaaccttagagactcctacaacagaggagagtaggaatgtctaaggttaacctggcggcagcgcaaaagatg

SEQ ID NO: 177313 - DNA, 103 bp, Artificial Sequence
  Synthetic Polynucleotide
taatacgactcactataggggtgtggagcctcctgaaaccaaaaccttagaacagaggagactaaggatgtggtttcagaacctggcggcagcgcaaaagatg

SEQ ID NO: 177314 - DNA, 103 bp, Artificial Sequence
  Synthetic Polynucleotide
taatacgactcactatagggtctgaattgtgtgtggagcctcctgaaaccaacagaggagaggtttcatgaggctccacaacctggcggcagcgcaaaagatg

SEQ ID NO: 177315 - DNA, 103 bp, Artificial Sequence
  Synthetic Polynucleotide
taatacgactcactatagggtccctttttctctgaattgtgtgtggagccaacagaggagaggctccatgcacaattcaaacctggcggcagcgcaaaagatg

SEQ ID NO: 177316 - DNA, 103 bp, Artificial Sequence
  Synthetic Polynucleotide
taatacgactcactataggggagtgccatctccctttttctctgaattgtaacagaggagaacaattatgagaaaaaggaacctggcggcagcgcaaaagatg

SEQ ID NO: 177317 - DNA, 103 bp, Artificial Sequence
  Synthetic Polynucleotide
taatacgactcactatagggaacggatcagaacaaatcctgcagggccacaacagaggagagtggccatgcaggatttgaacctggcggcagcgcaaaagatg

SEQ ID NO: 177318 - DNA, 103 bp, Artificial Sequence
  Synthetic Polynucleotide
taatacgactcactataggggcggagttctgagtgccatctccctttttcaacagaggagagaaaaaatgagatggcacaacctggcggcagcgcaaaagatg

SEQ ID NO: 177319 - DNA, 103 bp, Artificial Sequence
  Synthetic Polynucleotide
taatacgactcactataggggctaggattggcggagttctgagtgccatcaacagaggagagatggcatgcagaactccaacctggcggcagcgcaaaagatg

SEQ ID NO: 177320 - DNA, 103 bp, Artificial Sequence
  Synthetic Polynucleotide
taatacgactcactatagggccccactagggctaggattggcggagttctaacagaggagaagaactatgccaatcctaaacctggcggcagcgcaaaagatg

SEQ ID NO: 177321 - DNA, 103 bp, Artificial Sequence
  Synthetic Polynucleotide
taatacgactcactataggggcagagtcacccccactagggctaggattgaacagaggagacaatccatgccctagtggaacctggcggcagcgcaaaagatg

SEQ ID NO: 177322 - DNA, 103 bp, Artificial Sequence
  Synthetic Polynucleotide
taatacgactcactataggggccagataatgcagagtcacccccactaggaacagaggagacctagtatgggtgactctaacctggcggcagcgcaaaagatg

SEQ ID NO: 177323 - DNA, 103 bp, Artificial Sequence
  Synthetic Polynucleotide
taatacgactcactatagggcagacaactcgccagataatgcagagtcacaacagaggagagtgactatgcattatctgaacctggcggcagcgcaaaagatg

SEQ ID NO: 177324 - DNA, 103 bp, Artificial Sequence
  Synthetic Polynucleotide
taatacgactcactatagggggtagggaagcagacaactcgccagataataacagaggagaattatcatgcgagttgtcaacctggcggcagcgcaaaagatg

SEQ ID NO: 177325 - DNA, 103 bp, Artificial Sequence
  Synthetic Polynucleotide
taatacgactcactatagggcagtaagccaggtagggaagcagacaactcaacagaggagagagttgatggcttccctaaacctggcggcagcgcaaaagatg

SEQ ID NO: 177326 - DNA, 103 bp, Artificial Sequence
  Synthetic Polynucleotide
taatacgactcactatagggtcttgtcggacagtaagccaggtagggaagaacagaggagacttcccatgctggcttacaacctggcggcagcgcaaaagatg

SEQ ID NO: 177327 - DNA, 103 bp, Artificial Sequence
  Synthetic Polynucleotide
taatacgactcactataggggggaggtctctcttgtcggacagtaagccaaacagaggagatggcttatggtccgacaaaacctggcggcagcgcaaaagatg

SEQ ID NO: 177328 - DNA, 103 bp, Artificial Sequence
  Synthetic Polynucleotide
taatacgactcactatagggtgtgttaatcaacggatcagaacaaatcctaacagaggagaaggattatgtctgatccgaacctggcggcagcgcaaaagatg

SEQ ID NO: 177329 - DNA, 103 bp, Artificial Sequence
  Synthetic Polynucleotide
taatacgactcactatagggaccagaagcagggaggtctctcttgtcggaaacagaggagatccgacatgagagacctcaacctggcggcagcgcaaaagatg

SEQ ID NO: 177330 - DNA, 103 bp, Artificial Sequence
  Synthetic Polynucleotide
taatacgactcactatagggaacgacttttaccagaagcagggaggtctcaacagaggagagagaccatgctgcttctgaacctggcggcagcgcaaaagatg

SEQ ID NO: 177331 - DNA, 103 bp, Artificial Sequence
  Synthetic Polynucleotide
taatacgactcactatagggacacagtctgaacgacttttaccagaagcaaacagaggagatgcttcatgtaaaagtcgaacctggcggcagcgcaaaagatg

SEQ ID NO: 177332 - DNA, 103 bp, Artificial Sequence
  Synthetic Polynucleotide
taatacgactcactataggggcgcctagtaacacagtctgaacgacttttaacagaggagaaaaagtatgtcagactgtaacctggcggcagcgcaaaagatg

SEQ ID NO: 177333 - DNA, 103 bp, Artificial Sequence
  Synthetic Polynucleotide
taatacgactcactataggggtccacagttgcgcctagtaacacagtctgaacagaggagacagactatgttactaggcaacctggcggcagcgcaaaagatg

SEQ ID NO: 177334 - DNA, 103 bp, Artificial Sequence
  Synthetic Polynucleotide
taatacgactcactatagggggctttgatcgtccacagttgcgcctagtaaacagaggagatactagatgcaactgtggaacctggcggcagcgcaaaagatg

SEQ ID NO: 177335 - DNA, 103 bp, Artificial Sequence
  Synthetic Polynucleotide
taatacgactcactatagggtttggatgaaggctttgatcgtccacagttaacagaggagaaactgtatgcgatcaaagaacctggcggcagcgcaaaagatg

SEQ ID NO: 177336 - DNA, 103 bp, Artificial Sequence
  Synthetic Polynucleotide
taatacgactcactatagggcatctcgcaatttggatgaaggctttgatcaacagaggagagatcaaatgcttcatccaaacctggcggcagcgcaaaagatg

SEQ ID NO: 177337 - DNA, 103 bp, Artificial Sequence
  Synthetic Polynucleotide
taatacgactcactataggggctgaaaaagcatctcgcaatttggatgaaaacagaggagattcatcatgattgcgagaaacctggcggcagcgcaaaagatg

SEQ ID NO: 177338 - DNA, 103 bp, Artificial Sequence
  Synthetic Polynucleotide
taatacgactcactatagggtaccatttgggctgaaaaagcatctcgcaaaacagaggagattgcgaatggctttttcaaacctggcggcagcgcaaaagatg

SEQ ID NO: 177339 - DNA, 103 bp, Artificial Sequence
  Synthetic Polynucleotide
taatacgactcactatagggtttttgaatgtgtgttaatcaacggatcagaacagaggagactgatcatgtgattaacaaacctggcggcagcgcaaaagatg

SEQ ID NO: 177340 - DNA, 103 bp, Artificial Sequence
  Synthetic Polynucleotide
taatacgactcactatagggctgtgttctttaccatttgggctgaaaaagaacagaggagactttttatgcccaaatggaacctggcggcagcgcaaaagatg

SEQ ID NO: 177341 - DNA, 103 bp, Artificial Sequence
  Synthetic Polynucleotide
taatacgactcactatagggttacggttcactgtgttctttaccatttggaacagaggagaccaaatatgaaagaacacaacctggcggcagcgcaaaagatg

SEQ ID NO: 177342 - DNA, 103 bp, Artificial Sequence
  Synthetic Polynucleotide
taatacgactcactatagggctttaaggctttacggttcactgtgttcttaacagaggagaaagaacatggtgaaccgtaacctggcggcagcgcaaaagatg

SEQ ID NO: 177343 - DNA, 103 bp, Artificial Sequence
  Synthetic Polynucleotide
taatacgactcactatagggtgcgctcggtctttaaggctttacggttcaaacagaggagatgaaccatgaagccttaaaacctggcggcagcgcaaaagatg

SEQ ID NO: 177344 - DNA, 103 bp, Artificial Sequence
  Synthetic Polynucleotide
taatacgactcactatagggagttttcttttgcgctcggtctttaaggctaacagaggagaagccttatggaccgagcgaacctggcggcagcgcaaaagatg

SEQ ID NO: 177345 - DNA, 103 bp, Artificial Sequence
  Synthetic Polynucleotide
taatacgactcactatagggaagctgattcagttttcttttgcgctcggtaacagaggagaaccgagatgaaaagaaaaaacctggcggcagcgcaaaagatg

SEQ ID NO: 177346 - DNA, 103 bp, Artificial Sequence
  Synthetic Polynucleotide
taatacgactcactatagggtcacacttggaagctgattcagttttctttaacagaggagaaaagaaatgtgaatcagcaacctggcggcagcgcaaaagatg

SEQ ID NO: 177347 - DNA, 103 bp, Artificial Sequence
  Synthetic Polynucleotide
taatacgactcactataggggcatcaagagtcacacttggaagctgattcaacagaggagagaatcaatgtccaagtgtaacctggcggcagcgcaaaagatg

SEQ ID NO: 177348 - DNA, 103 bp, Artificial Sequence
  Synthetic Polynucleotide
taatacgactcactatagggctgcagtacagcatcaagagtcacacttggaacagaggagaccaagtatgactcttgataacctggcggcagcgcaaaagatg

SEQ ID NO: 177349 - DNA, 103 bp, Artificial Sequence
  Synthetic Polynucleotide
taatacgactcactatagggctcggtctccctgcagtacagcatcaagagaacagaggagactcttgatgctgtactgcaacctggcggcagcgcaaaagatg

SEQ ID NO: 177350 - DNA, 103 bp, Artificial Sequence
  Synthetic Polynucleotide
taatacgactcactataggggaaactttcatttttgaatgtgtgttaatcaacagaggagagattaaatgacattcaaaaacctggcggcagcgcaaaagatg

SEQ ID NO: 177351 - DNA, 103 bp, Artificial Sequence
  Synthetic Polynucleotide
taatacgactcactatagggcctccacgttctcggtctccctgcagtacaaacagaggagatgtactatggggagaccgaacctggcggcagcgcaaaagatg

SEQ ID NO: 177352 - DNA, 103 bp, Artificial Sequence
  Synthetic Polynucleotide
taatacgactcactatagggtctcaatgaacctccacgttctcggtctccaacagaggagaggagacatggaacgtggaaacctggcggcagcgcaaaagatg

SEQ ID NO: 177353 - DNA, 103 bp, Artificial Sequence
  Synthetic Polynucleotide
taatacgactcactatagggctgccccacctctcaatgaacctccacgttaacagaggagaaacgtgatggttcattgaaacctggcggcagcgcaaaagatg

SEQ ID NO: 177354 - DNA, 103 bp, Artificial Sequence
  Synthetic Polynucleotide
taatacgactcactatagggctaggatcttctgccccacctctcaatgaaaacagaggagattcattatgaggtggggcaacctggcggcagcgcaaaagatg

SEQ ID NO: 177355 - DNA, 103 bp, Artificial Sequence
  Synthetic Polynucleotide
taatacgactcactatagggatcctctttactaggatcttctgccccaccaacagaggagaggtgggatggaagatcctaacctggcggcagcgcaaaagatg

SEQ ID NO: 177356 - DNA, 103 bp, Artificial Sequence
  Synthetic Polynucleotide
taatacgactcactatagggtctgaaggggatcctctttactaggatcttaacagaggagaaagatcatggtaaagaggaacctggcggcagcgcaaaagatg

SEQ ID NO: 177357 - DNA, 103 bp, Artificial Sequence
  Synthetic Polynucleotide
taatacgactcactatagggtggcccattatctgaaggggatcctctttaaacagaggagataaagaatgtccccttcaaacctggcggcagcgcaaaagatg

SEQ ID NO: 177358 - DNA, 103 bp, Artificial Sequence
  Synthetic Polynucleotide
taatacgactcactatagggacttgttaagtggcccattatctgaaggggaacagaggagaccccttatgataatgggcaacctggcggcagcgcaaaagatg

SEQ ID NO: 177359 - DNA, 103 bp, Artificial Sequence
  Synthetic Polynucleotide
taatacgactcactatagggcaccatcttcacttgttaagtggcccattaaacagaggagataatggatgacttaacaaaacctggcggcagcgcaaaagatg

SEQ ID NO: 177360 - DNA, 103 bp, Artificial Sequence
  Synthetic Polynucleotide
taatacgactcactataggggaaaaatggtcaccatcttcacttgttaagaacagaggagacttaacatgtgaagatggaacctggcggcagcgcaaaagatg

SEQ ID NO: 177361 - DNA, 103 bp, Artificial Sequence
  Synthetic Polynucleotide
taatacgactcactatagggcctccggttggaaactttcatttttgaatgaacagaggagacattcaatgatgaaagttaacctggcggcagcgcaaaagatg

SEQ ID NO: 177362 - DNA, 103 bp, Artificial Sequence
  Synthetic Polynucleotide
taatacgactcactatagggatgcacatcagaaaaatggtcaccatcttcaacagaggagagaagatatggaccattttaacctggcggcagcgcaaaagatg

SEQ ID NO: 177363 - DNA, 103 bp, Artificial Sequence
  Synthetic Polynucleotide
taatacgactcactatagggtgctatcgaaatgcacatcagaaaaatggtaacagaggagaaccattatgctgatgtgcaacctggcggcagcgcaaaagatg

SEQ ID NO: 177364 - DNA, 103 bp, Artificial Sequence
  Synthetic Polynucleotide
taatacgactcactatagggtgcttaaccttgctatcgaaatgcacatcaaacagaggagatgatgtatgtttcgatagaacctggcggcagcgcaaaagatg

SEQ ID NO: 177365 - DNA, 103 bp, Artificial Sequence
  Synthetic Polynucleotide
taatacgactcactatagggaggatcagattgcttaaccttgctatcgaaaacagaggagattcgatatgaaggttaagaacctggcggcagcgcaaaagatg

SEQ ID NO: 177366 - DNA, 103 bp, Artificial Sequence
  Synthetic Polynucleotide
taatacgactcactatagggaaattttaccaggatcagattgcttaacctaacagaggagaaggttaatgaatctgatcaacctggcggcagcgcaaaagatg

SEQ ID NO: 177367 - DNA, 103 bp, Artificial Sequence
  Synthetic Polynucleotide
taatacgactcactatagggcctttttcagaaattttaccaggatcagataacagaggagaatctgaatgtggtaaaataacctggcggcagcgcaaaagatg

SEQ ID NO: 177368 - DNA, 103 bp, Artificial Sequence
  Synthetic Polynucleotide
taatacgactcactatagggaaaagagagtcctttttcagaaattttaccaacagaggagaggtaaaatgtctgaaaaaaacctggcggcagcgcaaaagatg

SEQ ID NO: 177369 - DNA, 103 bp, Artificial Sequence
  Synthetic Polynucleotide
taatacgactcactatagggttccgttttcaaaagagagtcctttttcagaacagaggagactgaaaatggactctcttaacctggcggcagcgcaaaagatg

SEQ ID NO: 177370 - DNA, 103 bp, Artificial Sequence
  Synthetic Polynucleotide
taatacgactcactatagggtctgggccttttccgttttcaaaagagagtaacagaggagaactctcatgtgaaaacggaacctggcggcagcgcaaaagatg

SEQ ID NO: 177371 - DNA, 103 bp, Artificial Sequence
  Synthetic Polynucleotide
taatacgactcactatagggagagtccagctctgggccttttccgttttcaacagaggagagaaaacatgaaaggcccaaacctggcggcagcgcaaaagatg

SEQ ID NO: 177372 - DNA, 103 bp, Artificial Sequence
  Synthetic Polynucleotide
taatacgactcactataggggccgatagggcctccggttggaaactttcaaacagaggagatgaaagatgccaaccggaaacctggcggcagcgcaaaagatg

SEQ ID NO: 177373 - DNA, 103 bp, Artificial Sequence
  Synthetic Polynucleotide
taatacgactcactatagggtgttcattacagagtccagctctgggccttaacagaggagaaaggccatgagctggactaacctggcggcagcgcaaaagatg

SEQ ID NO: 177374 - DNA, 103 bp, Artificial Sequence
  Synthetic Polynucleotide
taatacgactcactatagggtcattctcactgttcattacagagtccagcaacagaggagagctggaatgtgtaatgaaaacctggcggcagcgcaaaagatg

SEQ ID NO: 177375 - DNA, 103 bp, Artificial Sequence
  Synthetic Polynucleotide
taatacgactcactatagggattgagttcatcattctcactgttcattacaacagaggagagtaatgatgagtgagaataacctggcggcagcgcaaaagatg

SEQ ID NO: 177376 - DNA, 103 bp, Artificial Sequence
  Synthetic Polynucleotide
taatacgactcactataggggatttacaccattgagttcatcattctcacaacagaggagagtgagaatgatgaactcaaacctggcggcagcgcaaaagatg

SEQ ID NO: 177377 - DNA, 103 bp, Artificial Sequence
  Synthetic Polynucleotide
taatacgactcactatagggggcaccacttgatttacaccattgagttcaaacagaggagatgaactatgtggtgtaaaaacctggcggcagcgcaaaagatg

SEQ ID NO: 177378 - DNA, 103 bp, Artificial Sequence
  Synthetic Polynucleotide
taatacgactcactatagggccgctttttaggcaccacttgatttacaccaacagaggagaggtgtaatgcaagtggtgaacctggcggcagcgcaaaagatg

SEQ ID NO: 177379 - DNA, 103 bp, Artificial Sequence
  Synthetic Polynucleotide
taatacgactcactatagggaacgctgccaccgctttttaggcaccacttaacagaggagaaagtggatgctaaaaagcaacctggcggcagcgcaaaagatg

SEQ ID NO: 177380 - DNA, 103 bp, Artificial Sequence
  Synthetic Polynucleotide
taatacgactcactatagggctttggtttaaacgctgccaccgctttttaaacagaggagataaaaaatggtggcagcgaacctggcggcagcgcaaaagatg

SEQ ID NO: 177381 - DNA, 103 bp, Artificial Sequence
  Synthetic Polynucleotide
taatacgactcactatagggtttagtgcgcctttggtttaaacgctgccaaacagaggagatggcagatgttaaaccaaaacctggcggcagcgcaaaagatg

SEQ ID NO: 177382 - DNA, 103 bp, Artificial Sequence
  Synthetic Polynucleotide
taatacgactcactataggggcttacgaggtttagtgcgcctttggtttaaacagaggagataaaccatgggcgcactaaacctggcggcagcgcaaaagatg

SEQ ID NO: 177383 - DNA, 103 bp, Artificial Sequence
  Synthetic Polynucleotide
taatacgactcactatagggacgtagtactgccgatagggcctccggttgaacagaggagacaaccgatggccctatcgaacctggcggcagcgcaaaagatg

SEQ ID NO: 177384 - DNA, 103 bp, Artificial Sequence
  Synthetic Polynucleotide
taatacgactcactatagggctgttcatgcgcttacgaggtttagtgcgcaacagaggagagcgcacatgacctcgtaaaacctggcggcagcgcaaaagatg

SEQ ID NO: 177385 - DNA, 103 bp, Artificial Sequence
  Synthetic Polynucleotide
taatacgactcactatagggctctttaaatctgttcatgcgcttacgaggaacagaggagacctcgtatgcgcatgaacaacctggcggcagcgcaaaagatg

SEQ ID NO: 177386 - DNA, 103 bp, Artificial Sequence
  Synthetic Polynucleotide
taatacgactcactatagggagttttctttctctttaaatctgttcatgcaacagaggagagcatgaatggatttaaagaacctggcggcagcgcaaaagatg

SEQ ID NO: 177387 - DNA, 103 bp, Artificial Sequence
  Synthetic Polynucleotide
taatacgactcactataggggcacactcagagttttctttctctttaaataacagaggagaatttaaatggaaagaaaaaacctggcggcagcgcaaaagatg

SEQ ID NO: 177388 - DNA, 103 bp, Artificial Sequence
  Synthetic Polynucleotide
taatacgactcactataggggaccctaaaggcacactcagagttttctttaacagaggagaaaagaaatgtctgagtgtaacctggcggcagcgcaaaagatg

SEQ ID NO: 177389 - DNA, 103 bp, Artificial Sequence
  Synthetic Polynucleotide
taatacgactcactatagggtaggaagtaagaccctaaaggcacactcagaacagaggagactgagtatgcctttagggaacctggcggcagcgcaaaagatg

SEQ ID NO: 177390 - DNA, 103 bp, Artificial Sequence
  Synthetic Polynucleotide
taatacgactcactatagggacagggtcactaggaagtaagaccctaaagaacagaggagactttagatgcttacttccaacctggcggcagcgcaaaagatg

SEQ ID NO: 177391 - DNA, 103 bp, Artificial Sequence
  Synthetic Polynucleotide
taatacgactcactatagggcccctcctgcacagggtcactaggaagtaaaacagaggagattacttatgagtgaccctaacctggcggcagcgcaaaagatg

SEQ ID NO: 177392 - DNA, 103 bp, Artificial Sequence
  Synthetic Polynucleotide
taatacgactcactatagggactcatcccgcccctcctgcacagggtcacaacagaggagagtgaccatgtgcaggaggaacctggcggcagcgcaaaagatg

SEQ ID NO: 177393 - DNA, 103 bp, Artificial Sequence
  Synthetic Polynucleotide
taatacgactcactatagggtgctctggaaactcatcccgcccctcctgcaacagaggagagcaggaatggcgggatgaaacctggcggcagcgcaaaagatg

SEQ ID NO: 177394 - DNA, 103 bp, Artificial Sequence
  Synthetic Polynucleotide
taatacgactcactatagggaaaagcctccacgtagtactgccgatagggaacagaggagaccctatatgcagtactacaacctggcggcagcgcaaaagatg

SEQ ID NO: 177395 - DNA, 103 bp, Artificial Sequence
  Synthetic Polynucleotide
taatacgactcactatagggaggagttctatgctctggaaactcatcccgaacagaggagacgggatatgtttccagagaacctggcggcagcgcaaaagatg

SEQ ID NO: 177396 - DNA, 103 bp, Artificial Sequence
  Synthetic Polynucleotide
taatacgactcactatagggtgcttgctgaaggagttctatgctctggaaaacagaggagattccagatgatagaactcaacctggcggcagcgcaaaagatg

SEQ ID NO: 177397 - DNA, 103 bp, Artificial Sequence
  Synthetic Polynucleotide
taatacgactcactatagggtcctcaagtatgcttgctgaaggagttctaaacagaggagatagaacatgttcagcaagaacctggcggcagcgcaaaagatg

SEQ ID NO: 177398 - DNA, 103 bp, Artificial Sequence
  Synthetic Polynucleotide
taatacgactcactatagggtgtcagtggttcctcaagtatgcttgctgaaacagaggagatcagcaatgatacttgagaacctggcggcagcgcaaaagatg

SEQ ID NO: 177399 - DNA, 103 bp, Artificial Sequence
  Synthetic Polynucleotide
taatacgactcactataggggattttgctctgtcagtggttcctcaagtaaacagaggagatacttgatgaaccactgaaacctggcggcagcgcaaaagatg

SEQ ID NO: 177400 - DNA, 103 bp, Artificial Sequence
  Synthetic Polynucleotide
taatacgactcactatagggcagtcagcatgattttgctctgtcagtggtaacagaggagaaccactatgagagcaaaaaacctggcggcagcgcaaaagatg

SEQ ID NO: 177401 - DNA, 103 bp, Artificial Sequence
  Synthetic Polynucleotide
taatacgactcactatagggtgaatctaagcagtcagcatgattttgctcaacagaggagagagcaaatgcatgctgacaacctggcggcagcgcaaaagatg

SEQ ID NO: 177402 - DNA, 103 bp, Artificial Sequence
  Synthetic Polynucleotide
taatacgactcactataggggtggcccagctgaatctaagcagtcagcataacagaggagaatgctgatggcttagattaacctggcggcagcgcaaaagatg

SEQ ID NO: 177403 - DNA, 103 bp, Artificial Sequence
  Synthetic Polynucleotide
taatacgactcactatagggacatttaaccgtggcccagctgaatctaagaacagaggagacttagaatgagctgggccaacctggcggcagcgcaaaagatg

SEQ ID NO: 177404 - DNA, 103 bp, Artificial Sequence
  Synthetic Polynucleotide
taatacgactcactatagggtttatcacaaacatttaaccgtggcccagcaacagaggagagctgggatgcggttaaataacctggcggcagcgcaaaagatg

SEQ ID NO: 177405 - DNA, 103 bp, Artificial Sequence
  Synthetic Polynucleotide
taatacgactcactatagggaaggatctccaaaagcctccacgtagtactaacagaggagaagtactatgtggaggcttaacctggcggcagcgcaaaagatg

SEQ ID NO: 177406 - DNA, 103 bp, Artificial Sequence
  Synthetic Polynucleotide
taatacgactcactatagggtggcactggatttatcacaaacatttaaccaacagaggagaggttaaatgtttgtgataaacctggcggcagcgcaaaagatg

SEQ ID NO: 177407 - DNA, 103 bp, Artificial Sequence
  Synthetic Polynucleotide
taatacgactcactatagggtcaccaatgctggcactggatttatcacaaaacagaggagattgtgaatgatccagtgcaacctggcggcagcgcaaaagatg

SEQ ID NO: 177408 - DNA, 103 bp, Artificial Sequence
  Synthetic Polynucleotide
taatacgactcactatagggcttttccatgtcaccaatgctggcactggaaacagaggagatccagtatgagcattggtaacctggcggcagcgcaaaagatg

SEQ ID NO: 177409 - DNA, 103 bp, Artificial Sequence
  Synthetic Polynucleotide
taatacgactcactatagggttcctggctccttttccatgtcaccaatgcaacagaggagagcattgatgacatggaaaaacctggcggcagcgcaaaagatg

SEQ ID NO: 177410 - DNA, 103 bp, Artificial Sequence
  Synthetic Polynucleotide
taatacgactcactatagggaaactgggaattcctggctccttttccatgaacagaggagacatggaatgggagccaggaacctggcggcagcgcaaaagatg

SEQ ID NO: 177411 - DNA, 103 bp, Artificial Sequence
  Synthetic Polynucleotide
taatacgactcactatagggctgtggtgtcaaactgggaattcctggctcaacagaggagagagccaatgattcccagtaacctggcggcagcgcaaaagatg

SEQ ID NO: 177412 - DNA, 103 bp, Artificial Sequence
  Synthetic Polynucleotide
taatacgactcactatagggggagctcagcctgtggtgtcaaactgggaaaacagaggagattcccaatgtgacaccacaacctggcggcagcgcaaaagatg

SEQ ID NO: 177413 - DNA, 103 bp, Artificial Sequence
  Synthetic Polynucleotide
taatacgactcactataggggctggttcagggagctcagcctgtggtgtcaacagaggagagacaccatgggctgagctaacctggcggcagcgcaaaagatg

SEQ ID NO: 177414 - DNA, 103 bp, Artificial Sequence
  Synthetic Polynucleotide
taatacgactcactatagggtgaccgcacagctggttcagggagctcagcaacagaggagagctgagatgcctgaaccaaacctggcggcagcgcaaaagatg

SEQ ID NO: 177415 - DNA, 103 bp, Artificial Sequence
  Synthetic Polynucleotide
taatacgactcactataggggtttcttctctgaccgcacagctggttcagaacagaggagactgaacatgctgtgcggtaacctggcggcagcgcaaaagatg

SEQ ID NO: 177416 - DNA, 103 bp, Artificial Sequence
  Synthetic Polynucleotide
taatacgactcactataggggtactggaatctggatcatccgaaagggctaacagaggagaagccctatgggatgatccaacctggcggcagcgcaaaagatg

SEQ ID NO: 177417 - DNA, 103 bp, Artificial Sequence
  Synthetic Polynucleotide
taatacgactcactataggggctctctcagaaggatctccaaaagcctccaacagaggagaggaggcatgtggagatccaacctggcggcagcgcaaaagatg

SEQ ID NO: 177418 - DNA, 103 bp, Artificial Sequence
  Synthetic Polynucleotide
taatacgactcactatagggttcctaaggcgtttcttctctgaccgcacaaacagaggagatgtgcgatgagagaagaaaacctggcggcagcgcaaaagatg

SEQ ID NO: 177419 - DNA, 103 bp, Artificial Sequence
  Synthetic Polynucleotide
taatacgactcactatagggcttgcttggcttcctaaggcgtttcttctcaacagaggagagagaagatgcgccttaggaacctggcggcagcgcaaaagatg

SEQ ID NO: 177420 - DNA, 103 bp, Artificial Sequence
  Synthetic Polynucleotide
taatacgactcactatagggccaaaagccacttgcttggcttcctaaggcaacagaggagagccttaatgagccaagcaaacctggcggcagcgcaaaagatg

SEQ ID NO: 177421 - DNA, 103 bp, Artificial Sequence
  Synthetic Polynucleotide
taatacgactcactatagggtctgtatattccaaaagccacttgcttggcaacagaggagagccaagatggtggcttttaacctggcggcagcgcaaaagatg

SEQ ID NO: 177422 - DNA, 103 bp, Artificial Sequence
  Synthetic Polynucleotide
taatacgactcactatagggatcatattcttctgtatattccaaaagccaaacagaggagatggcttatggaatatacaaacctggcggcagcgcaaaagatg

SEQ ID NO: 177423 - DNA, 103 bp, Artificial Sequence
  Synthetic Polynucleotide
taatacgactcactatagggcaaatatctgatcatattcttctgtatattaacagaggagaaatataatgaagaatatgaacctggcggcagcgcaaaagatg

SEQ ID NO: 177424 - DNA, 103 bp, Artificial Sequence
  Synthetic Polynucleotide
taatacgactcactatagggttcttaggagcaaatatctgatcatattctaacagaggagaagaataatgtcagatattaacctggcggcagcgcaaaagatg

SEQ ID NO: 177425 - DNA, 103 bp, Artificial Sequence
  Synthetic Polynucleotide
taatacgactcactatagggcttttgttttttcttaggagcaaatatctgaacagaggagacagataatggctcctaagaacctggcggcagcgcaaaagatg

SEQ ID NO: 177426 - DNA, 103 bp, Artificial Sequence
  Synthetic Polynucleotide
taatacgactcactatagggcctgtaccttcttttgttttttcttaggagaacagaggagactcctaatgaaaaacaaaaacctggcggcagcgcaaaagatg

SEQ ID NO: 177427 - DNA, 103 bp, Artificial Sequence
  Synthetic Polynucleotide
taatacgactcactatagggtgcacctgctcctgtaccttcttttgttttaacagaggagaaaaacaatggaaggtacaaacctggcggcagcgcaaaagatg

SEQ ID NO: 177428 - DNA, 103 bp, Artificial Sequence
  Synthetic Polynucleotide
taatacgactcactatagggagccacccaggctctctcagaaggatctccaacagaggagaggagatatgtctgagagaaacctggcggcagcgcaaaagatg

SEQ ID NO: 177429 - DNA, 103 bp, Artificial Sequence
  Synthetic Polynucleotide
taatacgactcactatagggacttaccttgtgcacctgctcctgtaccttaacagaggagaaaggtaatggagcaggtgaacctggcggcagcgcaaaagatg

SEQ ID NO: 177430 - DNA, 103 bp, Artificial Sequence
  Synthetic Polynucleotide
taatacgactcactatagggcacagcgggaacttaccttgtgcacctgctaacagaggagaagcaggatgacaaggtaaaacctggcggcagcgcaaaagatg

SEQ ID NO: 177431 - DNA, 103 bp, Artificial Sequence
  Synthetic Polynucleotide
taatacgactcactatagggctttcctcttcacagcgggaacttaccttgaacagaggagacaaggtatgttcccgctgaacctggcggcagcgcaaaagatg

SEQ ID NO: 177432 - DNA, 103 bp, Artificial Sequence
  Synthetic Polynucleotide
taatacgactcactatagggggctagaaggctttcctcttcacagcgggaaacagaggagatcccgcatggaagaggaaaacctggcggcagcgcaaaagatg

SEQ ID NO: 177433 - DNA, 103 bp, Artificial Sequence
  Synthetic Polynucleotide
taatacgactcactatagggatcgacctcgggctagaaggctttcctcttaacagaggagaaagaggatggccttctagaacctggcggcagcgcaaaagatg

SEQ ID NO: 177434 - DNA, 103 bp, Artificial Sequence
  Synthetic Polynucleotide
taatacgactcactatagggtgagcactagatcgacctcgggctagaaggaacagaggagaccttctatgccgaggtcgaacctggcggcagcgcaaaagatg

SEQ ID NO: 177435 - DNA, 103 bp, Artificial Sequence
  Synthetic Polynucleotide
taatacgactcactatagggctgcttgttctgagcactagatcgacctcgaacagaggagacgaggtatgtctagtgctaacctggcggcagcgcaaaagatg

SEQ ID NO: 177436 - DNA, 103 bp, Artificial Sequence
  Synthetic Polynucleotide
taatacgactcactatagggtctcgtccacctgcttgttctgagcactagaacagaggagactagtgatgagaacaagcaacctggcggcagcgcaaaagatg

SEQ ID NO: 177437 - DNA, 103 bp, Artificial Sequence
  Synthetic Polynucleotide
taatacgactcactatagggatcaaagaattctcgtccacctgcttgttcaacagaggagagaacaaatgggtggacgaaacctggcggcagcgcaaaagatg

SEQ ID NO: 177438 - DNA, 103 bp, Artificial Sequence
  Synthetic Polynucleotide
taatacgactcactatagggtttggttgaaatcaaagaattctcgtccacaacagaggagagtggacatgaattctttgaacctggcggcagcgcaaaagatg

SEQ ID NO: 177439 - DNA, 103 bp, Artificial Sequence
  Synthetic Polynucleotide
taatacgactcactatagggttgcttttccagccacccaggctctctcagaacagaggagactgagaatgcctgggtggaacctggcggcagcgcaaaagatg

SEQ ID NO: 177440 - DNA, 103 bp, Artificial Sequence
  Synthetic Polynucleotide
taatacgactcactataggggaggctcttctttggttgaaatcaaagaataacagaggagaattcttatgtttcaaccaaacctggcggcagcgcaaaagatg

SEQ ID NO: 177441 - DNA, 103 bp, Artificial Sequence
  Synthetic Polynucleotide
taatacgactcactatagggtcaagaactggaggctcttctttggttgaaaacagaggagattcaacatgagaagagccaacctggcggcagcgcaaaagatg

SEQ ID NO: 177442 - DNA, 103 bp, Artificial Sequence
  Synthetic Polynucleotide
taatacgactcactatagggagcctccctttcaagaactggaggctcttcaacagaggagagaagagatgccagttcttaacctggcggcagcgcaaaagatg

SEQ ID NO: 177443 - DNA, 103 bp, Artificial Sequence
  Synthetic Polynucleotide
taatacgactcactatagggccaaaaacggagcctccctttcaagaactgaacagaggagacagttcatgaaagggaggaacctggcggcagcgcaaaagatg

SEQ ID NO: 177444 - DNA, 103 bp, Artificial Sequence
  Synthetic Polynucleotide
taatacgactcactatagggaaggggccctccaaaaacggagcctcccttaacagaggagaaagggaatgtccgtttttaacctggcggcagcgcaaaagatg

SEQ ID NO: 177445 - DNA, 103 bp, Artificial Sequence
  Synthetic Polynucleotide
taatacgactcactatagggtgactgagccaaggggccctccaaaaacggaacagaggagaccgtttatggagggccccaacctggcggcagcgcaaaagatg

SEQ ID NO: 177446 - DNA, 103 bp, Artificial Sequence
  Synthetic Polynucleotide
taatacgactcactatagggctccaagttctgactgagccaaggggccctaacagaggagaagggccatgtggctcagtaacctggcggcagcgcaaaagatg

SEQ ID NO: 177447 - DNA, 103 bp, Artificial Sequence
  Synthetic Polynucleotide
taatacgactcactataggggcatgtccacctccaagttctgactgagccaacagaggagaggctcaatgagaacttggaacctggcggcagcgcaaaagatg

SEQ ID NO: 177448 - DNA, 103 bp, Artificial Sequence
  Synthetic Polynucleotide
taatacgactcactatagggcggcaactcagcatgtccacctccaagttcaacagaggagagaacttatgggtggacataacctggcggcagcgcaaaagatg

SEQ ID NO: 177449 - DNA, 103 bp, Artificial Sequence
  Synthetic Polynucleotide
taatacgactcactatagggaggtcagctgcggcaactcagcatgtccacaacagaggagagtggacatgctgagttgcaacctggcggcagcgcaaaagatg

SEQ ID NO: 177450 - DNA, 103 bp, Artificial Sequence
  Synthetic Polynucleotide
taatacgactcactatagggaacatgacgattgcttttccagccacccagaacagaggagactgggtatgtggaaaagcaacctggcggcagcgcaaaagatg

SEQ ID NO: 177451 - DNA, 103 bp, Artificial Sequence
  Synthetic Polynucleotide
taatacgactcactatagggggcacagacaaggtcagctgcggcaactcaaacagaggagatgagttatggcagctgacaacctggcggcagcgcaaaagatg

SEQ ID NO: 177452 - DNA, 103 bp, Artificial Sequence
  Synthetic Polynucleotide
taatacgactcactatagggcggagccacaggcacagacaaggtcagctgaacagaggagacagctgatgttgtctgtgaacctggcggcagcgcaaaagatg

SEQ ID NO: 177453 - DNA, 103 bp, Artificial Sequence
  Synthetic Polynucleotide
taatacgactcactataggggagagacttccggagccacaggcacagacaaacagaggagatgtctgatgctgtggctcaacctggcggcagcgcaaaagatg

SEQ ID NO: 177454 - DNA, 103 bp, Artificial Sequence
  Synthetic Polynucleotide
taatacgactcactataggggcaggccgtggagagacttccggagccacaaacagaggagatgtggcatgggaagtctcaacctggcggcagcgcaaaagatg

SEQ ID NO: 177455 - DNA, 103 bp, Artificial Sequence
  Synthetic Polynucleotide
taatacgactcactatagggagactcaagggcaggccgtggagagacttcaacagaggagagaagtcatgccacggcctaacctggcggcagcgcaaaagatg

SEQ ID NO: 177456 - DNA, 103 bp, Artificial Sequence
  Synthetic Polynucleotide
taatacgactcactataggggcaattcctcagactcaagggcaggccgtgaacagaggagacacggcatgcccttgagtaacctggcggcagcgcaaaagatg

SEQ ID NO: 177457 - DNA, 103 bp, Artificial Sequence
  Synthetic Polynucleotide
taatacgactcactataggggttttaactagcaattcctcagactcaaggaacagaggagaccttgaatgtgaggaattaacctggcggcagcgcaaaagatg

SEQ ID NO: 177458 - DNA, 103 bp, Artificial Sequence
  Synthetic Polynucleotide
taatacgactcactatagggatttcctggcgttttaactagcaattcctcaacagaggagagaggaaatgctagttaaaaacctggcggcagcgcaaaagatg

SEQ ID NO: 177459 - DNA, 103 bp, Artificial Sequence
  Synthetic Polynucleotide
taatacgactcactatagggtactttcataatttcctggcgttttaactaaacagaggagatagttaatgcgccaggaaaacctggcggcagcgcaaaagatg

SEQ ID NO: 177460 - DNA, 103 bp, Artificial Sequence
  Synthetic Polynucleotide
taatacgactcactatagggctttgacgtttactttcataatttcctggcaacagaggagagccaggatgttatgaaagaacctggcggcagcgcaaaagatg

SEQ ID NO: 177461 - DNA, 103 bp, Artificial Sequence
  Synthetic Polynucleotide
taatacgactcactatagggtctgccttcaaacatgacgattgcttttccaacagaggagaggaaaaatgatcgtcatgaacctggcggcagcgcaaaagatg

SEQ ID NO: 177462 - DNA, 103 bp, Artificial Sequence
  Synthetic Polynucleotide
taatacgactcactatagggagttggttttctttgacgtttactttcataaacagaggagatatgaaatgaaacgtcaaaacctggcggcagcgcaaaagatg

SEQ ID NO: 177463 - DNA, 103 bp, Artificial Sequence
  Synthetic Polynucleotide
taatacgactcactataggggaagtttcttagttggttttctttgacgttaacagaggagaaacgtcatggaaaaccaaaacctggcggcagcgcaaaagatg

SEQ ID NO: 177464 - DNA, 103 bp, Artificial Sequence
  Synthetic Polynucleotide
taatacgactcactatagggttggattcaagaagtttcttagttggttttaacagaggagaaaaaccatgtaagaaactaacctggcggcagcgcaaaagatg

SEQ ID NO: 177465 - DNA, 103 bp, Artificial Sequence
  Synthetic Polynucleotide
taatacgactcactataggggtctaaatcattggattcaagaagtttcttaacagaggagaaagaaaatgcttgaatccaacctggcggcagcgcaaaagatg

SEQ ID NO: 177466 - DNA, 103 bp, Artificial Sequence
  Synthetic Polynucleotide
taatacgactcactatagggtaaatccagggtctaaatcattggattcaaaacagaggagattgaatatgatgatttagaacctggcggcagcgcaaaagatg

SEQ ID NO: 177467 - DNA, 103 bp, Artificial Sequence
  Synthetic Polynucleotide
taatacgactcactatagggttcttgggcataaatccagggtctaaatcaaacagaggagatgatttatgccctggattaacctggcggcagcgcaaaagatg

SEQ ID NO: 177468 - DNA, 103 bp, Artificial Sequence
  Synthetic Polynucleotide
taatacgactcactatagggaaggtcccccttcttgggcataaatccaggaacagaggagacctggaatgatgcccaagaacctggcggcagcgcaaaagatg

SEQ ID NO: 177469 - DNA, 103 bp, Artificial Sequence
  Synthetic Polynucleotide
taatacgactcactatagggtagaaaggccaaggtcccccttcttgggcaaacagaggagatgcccaatgagggggaccaacctggcggcagcgcaaaagatg

SEQ ID NO: 177470 - DNA, 103 bp, Artificial Sequence
  Synthetic Polynucleotide
taatacgactcactatagggtagcactttttagaaaggccaaggtcccccaacagaggagagggggaatgtggcctttcaacctggcggcagcgcaaaagatg

SEQ ID NO: 177471 - DNA, 103 bp, Artificial Sequence
  Synthetic Polynucleotide
taatacgactcactatagggaccagcttcatagcactttttagaaaggccaacagaggagaggccttatgaaaaagtgcaacctggcggcagcgcaaaagatg

SEQ ID NO: 177472 - DNA, 103 bp, Artificial Sequence
  Synthetic Polynucleotide
taatacgactcactatagggcgaattgatgtctgccttcaaacatgacgaaacagaggagatcgtcaatgttgaaggcaaacctggcggcagcgcaaaagatg

SEQ ID NO: 177473 - DNA, 103 bp, Artificial Sequence
  Synthetic Polynucleotide
taatacgactcactatagggtctccaggtgaccagcttcatagcacttttaacagaggagaaaaagtatgatgaagctgaacctggcggcagcgcaaaagatg

SEQ ID NO: 177474 - DNA, 103 bp, Artificial Sequence
  Synthetic Polynucleotide
taatacgactcactataggggttatgccattctccaggtgaccagcttcaaacagaggagatgaagcatgtcacctggaaacctggcggcagcgcaaaagatg

SEQ ID NO: 177475 - DNA, 103 bp, Artificial Sequence
  Synthetic Polynucleotide
taatacgactcactatagggacaagattcagttatgccattctccaggtgaacagaggagacacctgatgaatggcataaacctggcggcagcgcaaaagatg

SEQ ID NO: 177476 - DNA, 103 bp, Artificial Sequence
  Synthetic Polynucleotide
taatacgactcactatagggaagatgtggcacaagattcagttatgccataacagaggagaatggcaatgctgaatcttaacctggcggcagcgcaaaagatg

SEQ ID NO: 177477 - DNA, 103 bp, Artificial Sequence
  Synthetic Polynucleotide
taatacgactcactatagggtcttttgaataagatgtggcacaagattcaaacagaggagatgaatcatgtgccacatcaacctggcggcagcgcaaaagatg

SEQ ID NO: 177478 - DNA, 103 bp, Artificial Sequence
  Synthetic Polynucleotide
taatacgactcactatagggtccaccaaaatcttttgaataagatgtggcaacagaggagagccacaatgtattcaaaaaacctggcggcagcgcaaaagatg

SEQ ID NO: 177479 - DNA, 103 bp, Artificial Sequence
  Synthetic Polynucleotide
taatacgactcactatagggtggtagtgcctccaccaaaatcttttgaataacagaggagaattcaaatgattttggtgaacctggcggcagcgcaaaagatg

SEQ ID NO: 177480 - DNA, 103 bp, Artificial Sequence
  Synthetic Polynucleotide
taatacgactcactatagggtcaaatatcttggtagtgcctccaccaaaaaacagaggagattttggatgaggcactacaacctggcggcagcgcaaaagatg

SEQ ID NO: 177481 - DNA, 103 bp, Artificial Sequence
  Synthetic Polynucleotide
taatacgactcactatagggccttggcttgtcaaatatcttggtagtgccaacagaggagaggcactatgaagatatttaacctggcggcagcgcaaaagatg

SEQ ID NO: 177482 - DNA, 103 bp, Artificial Sequence
  Synthetic Polynucleotide
taatacgactcactataggggttttcgcttccttggcttgtcaaatatctaacagaggagaagatatatgacaagccaaaacctggcggcagcgcaaaagatg

SEQ ID NO: 177483 - DNA, 103 bp, Artificial Sequence
  Synthetic Polynucleotide
taatacgactcactatagggggtagctcttcgaattgatgtctgccttcaaacagaggagatgaaggatgacatcaattaacctggcggcagcgcaaaagatg

SEQ ID NO: 177484 - DNA, 103 bp, Artificial Sequence
  Synthetic Polynucleotide
taatacgactcactatagggtgcctctgtcgttttcgcttccttggcttgaacagaggagacaagccatggaagcgaaaaacctggcggcagcgcaaaagatg

SEQ ID NO: 177485 - DNA, 103 bp, Artificial Sequence
  Synthetic Polynucleotide
taatacgactcactatagggggctgcagcatgcctctgtcgttttcgcttaacagaggagaaagcgaatgcgacagaggaacctggcggcagcgcaaaagatg

SEQ ID NO: 177486 - DNA, 103 bp, Artificial Sequence
  Synthetic Polynucleotide
taatacgactcactatagggactgcatcttggctgcagcatgcctctgtcaacagaggagagacagaatgatgctgcagaacctggcggcagcgcaaaagatg

SEQ ID NO: 177487 - DNA, 103 bp, Artificial Sequence
  Synthetic Polynucleotide
taatacgactcactatagggacttttttacactgcatcttggctgcagcaaacagaggagatgctgcatgcaagatgcaaacctggcggcagcgcaaaagatg

SEQ ID NO: 177488 - DNA, 103 bp, Artificial Sequence
  Synthetic Polynucleotide
taatacgactcactatagggatcatttttcacttttttacactgcatcttaacagaggagaaagatgatgtgtaaaaaaaacctggcggcagcgcaaaagatg

SEQ ID NO: 177489 - DNA, 103 bp, Artificial Sequence
  Synthetic Polynucleotide
taatacgactcactatagggttgacgagtcatcatttttcacttttttacaacagaggagagtaaaaatgtgaaaaatgaacctggcggcagcgcaaaagatg

SEQ ID NO: 177490 - DNA, 103 bp, Artificial Sequence
  Synthetic Polynucleotide
taatacgactcactatagggggaatctcttttgacgagtcatcatttttcaacagaggagagaaaaaatgtgactcgtcaacctggcggcagcgcaaaagatg

SEQ ID NO: 177491 - DNA, 103 bp, Artificial Sequence
  Synthetic Polynucleotide
taatacgactcactatagggctctgagcctggaatctcttttgacgagtcaacagaggagagactcgatgaaagagattaacctggcggcagcgcaaaagatg

SEQ ID NO: 177492 - DNA, 103 bp, Artificial Sequence
  Synthetic Polynucleotide
taatacgactcactatagggttagttctccctctgagcctggaatctcttaacagaggagaaagagaatgcaggctcagaacctggcggcagcgcaaaagatg

SEQ ID NO: 177493 - DNA, 103 bp, Artificial Sequence
  Synthetic Polynucleotide
taatacgactcactatagggctgtgaggcattagttctccctctgagcctaacagaggagaaggctcatggggagaactaacctggcggcagcgcaaaagatg

SEQ ID NO: 177494 - DNA, 103 bp, Artificial Sequence
  Synthetic Polynucleotide
taatacgactcactatagggcctaaggacaggtagctcttcgaattgatgaacagaggagacatcaaatggaagagctaaacctggcggcagcgcaaaagatg

SEQ ID NO: 177495 - DNA, 103 bp, Artificial Sequence
  Synthetic Polynucleotide
taatacgactcactatagggtgtggccgtcctgtgaggcattagttctccaacagaggagaggagaaatgatgcctcacaacctggcggcagcgcaaaagatg

SEQ ID NO: 177496 - DNA, 103 bp, Artificial Sequence
  Synthetic Polynucleotide
taatacgactcactatagggccttggggcttgtggccgtcctgtgaggcaaacagaggagatgcctcatgggacggccaaacctggcggcagcgcaaaagatg

SEQ ID NO: 177497 - DNA, 103 bp, Artificial Sequence
  Synthetic Polynucleotide
taatacgactcactatagggtcaacagtctccttggggcttgtggccgtcaacagaggagagacggcatgaagccccaaaacctggcggcagcgcaaaagatg

SEQ ID NO: 177498 - DNA, 103 bp, Artificial Sequence
  Synthetic Polynucleotide
taatacgactcactatagggtacaccttcctcaacagtctccttggggctaacagaggagaagccccatggagactgttaacctggcggcagcgcaaaagatg

SEQ ID NO: 177499 - DNA, 103 bp, Artificial Sequence
  Synthetic Polynucleotide
taatacgactcactataggggatcgtgttctacaccttcctcaacagtctaacagaggagaagactgatgaggaaggtgaacctggcggcagcgcaaaagatg

SEQ ID NO: 177500 - DNA, 103 bp, Artificial Sequence
  Synthetic Polynucleotide
taatacgactcactatagggggcatcccgggatcgtgttctacaccttccaacagaggagaggaaggatgagaacacgaaacctggcggcagcgcaaaagatg

SEQ ID NO: 177501 - DNA, 103 bp, Artificial Sequence
  Synthetic Polynucleotide
taatacgactcactatagggtttagaggcaggcatcccgggatcgtgttcaacagaggagagaacacatgcccgggatgaacctggcggcagcgcaaaagatg

SEQ ID NO: 177502 - DNA, 103 bp, Artificial Sequence
  Synthetic Polynucleotide
taatacgactcactatagggcctgcatttttttagaggcaggcatcccggaacagaggagaccgggaatgctgcctctaaacctggcggcagcgcaaaagatg

SEQ ID NO: 177503 - DNA, 103 bp, Artificial Sequence
  Synthetic Polynucleotide
taatacgactcactatagggccgcgttcaccctgcatttttttagaggcaaacagaggagatgcctcatgaaaaatgcaaacctggcggcagcgcaaaagatg

SEQ ID NO: 177504 - DNA, 103 bp, Artificial Sequence
  Synthetic Polynucleotide
taatacgactcactatagggagctcctccaccgcgttcaccctgcattttaacagaggagaaaaatgatgggtgaacgcaacctggcggcagcgcaaaagatg

SEQ ID NO: 177505 - DNA, 103 bp, Artificial Sequence
  Synthetic Polynucleotide
taatacgactcactatagggtccctcttctcctaaggacaggtagctcttaacagaggagaaagagcatgctgtccttaaacctggcggcagcgcaaaagatg

SEQ ID NO: 177506 - DNA, 103 bp, Artificial Sequence
  Synthetic Polynucleotide
taatacgactcactatagggccttgagtgcagctcctccaccgcgttcacaacagaggagagtgaacatggtggaggagaacctggcggcagcgcaaaagatg

SEQ ID NO: 177507 - DNA, 103 bp, Artificial Sequence
  Synthetic Polynucleotide
taatacgactcactatagggcagacattctccttgagtgcagctcctccaaacagaggagatggaggatgtgcactcaaaacctggcggcagcgcaaaagatg

SEQ ID NO: 177508 - DNA, 103 bp, Artificial Sequence
  Synthetic Polynucleotide
taatacgactcactatagggacaattctgacagacattctccttgagtgcaacagaggagagcactcatggagaatgtcaacctggcggcagcgcaaaagatg

SEQ ID NO: 177509 - DNA, 103 bp, Artificial Sequence
  Synthetic Polynucleotide
taatacgactcactatagggccaatttttcacaattctgacagacattctaacagaggagaagaatgatggtcagaattaacctggcggcagcgcaaaagatg

SEQ ID NO: 177510 - DNA, 103 bp, Artificial Sequence
  Synthetic Polynucleotide
taatacgactcactatagggagcagctcacccaatttttcacaattctgaaacagaggagatcagaaatgtgaaaaattaacctggcggcagcgcaaaagatg

SEQ ID NO: 177511 - DNA, 103 bp, Artificial Sequence
  Synthetic Polynucleotide
taatacgactcactatagggctcacataacagcagctcacccaatttttcaacagaggagagaaaaaatgggtgagctgaacctggcggcagcgcaaaagatg

SEQ ID NO: 177512 - DNA, 103 bp, Artificial Sequence
  Synthetic Polynucleotide
taatacgactcactatagggagcactgagcctcacataacagcagctcacaacagaggagagtgagcatgtgttatgtgaacctggcggcagcgcaaaagatg

SEQ ID NO: 177513 - DNA, 103 bp, Artificial Sequence
  Synthetic Polynucleotide
taatacgactcactatagggaaagccccacagcactgagcctcacataacaacagaggagagttatgatgggctcagtgaacctggcggcagcgcaaaagatg

SEQ ID NO: 177514 - DNA, 103 bp, Artificial Sequence
  Synthetic Polynucleotide
taatacgactcactatagggctccaggtggaaagccccacagcactgagcaacagaggagagctcagatgtgtggggctaacctggcggcagcgcaaaagatg

SEQ ID NO: 177515 - DNA, 103 bp, Artificial Sequence
  Synthetic Polynucleotide
taatacgactcactatagggatccaaggcactccaggtggaaagccccacaacagaggagagtggggatgtccacctggaacctggcggcagcgcaaaagatg

SEQ ID NO: 177516 - DNA, 103 bp, Artificial Sequence
  Synthetic Polynucleotide
taatacgactcactatagggtctttctgtttccctcttctcctaaggacaaacagaggagatgtcctatggagaagaggaacctggcggcagcgcaaaagatg

SEQ ID NO: 177517 - DNA, 103 bp, Artificial Sequence
  Synthetic Polynucleotide
taatacgactcactatagggatctcagtcaatccaaggcactccaggtggaacagaggagaccacctatggtgccttggaacctggcggcagcgcaaaagatg

SEQ ID NO: 177518 - DNA, 103 bp, Artificial Sequence
  Synthetic Polynucleotide
taatacgactcactatagggtcctcttggcatctcagtcaatccaaggcaaacagaggagatgccttatgttgactgagaacctggcggcagcgcaaaagatg

SEQ ID NO: 177519 - DNA, 103 bp, Artificial Sequence
  Synthetic Polynucleotide
taatacgactcactatagggagataaattttcctcttggcatctcagtcaaacagaggagatgactgatgtgccaagagaacctggcggcagcgcaaaagatg

SEQ ID NO: 177520 - DNA, 103 bp, Artificial Sequence
  Synthetic Polynucleotide
taatacgactcactatagggcattcattgcagataaattttcctcttggcaacagaggagagccaagatgaaaatttataacctggcggcagcgcaaaagatg

SEQ ID NO: 177521 - DNA, 103 bp, Artificial Sequence
  Synthetic Polynucleotide
taatacgactcactatagggtcctgtgcgacattcattgcagataaatttaacagaggagaaaatttatgtgcaatgaaaacctggcggcagcgcaaaagatg

SEQ ID NO: 177522 - DNA, 103 bp, Artificial Sequence
  Synthetic Polynucleotide
taatacgactcactatagggaggtatggattcctgtgcgacattcattgcaacagaggagagcaatgatggtcgcacagaacctggcggcagcgcaaaagatg

SEQ ID NO: 177523 - DNA, 103 bp, Artificial Sequence
  Synthetic Polynucleotide
taatacgactcactatagggcatacaaaacaggtatggattcctgtgcgaaacagaggagatcgcacatgaatccatacaacctggcggcagcgcaaaagatg

SEQ ID NO: 177524 - DNA, 103 bp, Artificial Sequence
  Synthetic Polynucleotide
taatacgactcactatagggactctgcttacatacaaaacaggtatggataacagaggagaatccatatgtgttttgtaaacctggcggcagcgcaaaagatg

SEQ ID NO: 177525 - DNA, 103 bp, Artificial Sequence
  Synthetic Polynucleotide
taatacgactcactatagggcatcttccccactctgcttacatacaaaacaacagaggagagttttgatggtaagcagaaacctggcggcagcgcaaaagatg

SEQ ID NO: 177526 - DNA, 103 bp, Artificial Sequence
  Synthetic Polynucleotide
taatacgactcactatagggcaccttttaacatcttccccactctgcttaaacagaggagataagcaatgtggggaagaaacctggcggcagcgcaaaagatg

SEQ ID NO: 177527 - DNA, 103 bp, Artificial Sequence
  Synthetic Polynucleotide
taatacgactcactatagggtaatgtactggtactggaatctggatcatcaacagaggagagatgatatggattccagtaacctggcggcagcgcaaaagatg

SEQ ID NO: 177528 - DNA, 103 bp, Artificial Sequence
  Synthetic Polynucleotide
taatacgactcactatagggatatcctttttctttctgtttccctcttctaacagaggagaagaagaatgaaacagaaaaacctggcggcagcgcaaaagatg

SEQ ID NO: 177529 - DNA, 103 bp, Artificial Sequence
  Synthetic Polynucleotide
taatacgactcactataggggggtagaaggcaccttttaacatcttccccaacagaggagaggggaaatggttaaaaggaacctggcggcagcgcaaaagatg

SEQ ID NO: 177530 - DNA, 103 bp, Artificial Sequence
  Synthetic Polynucleotide
taatacgactcactatagggttccacacaagggtagaaggcaccttttaaaacagaggagattaaaaatggccttctacaacctggcggcagcgcaaaagatg

SEQ ID NO: 177531 - DNA, 103 bp, Artificial Sequence
  Synthetic Polynucleotide
taatacgactcactatagggtggtaaaactttccacacaagggtagaaggaacagaggagaccttctatgcttgtgtggaacctggcggcagcgcaaaagatg

SEQ ID NO: 177532 - DNA, 103 bp, Artificial Sequence
  Synthetic Polynucleotide
taatacgactcactatagggacactcttcatggtaaaactttccacacaaaacagaggagattgtgtatgaagttttacaacctggcggcagcgcaaaagatg

SEQ ID NO: 177533 - DNA, 103 bp, Artificial Sequence
  Synthetic Polynucleotide
taatacgactcactatagggacttctggacacactcttcatggtaaaactaacagaggagaagttttatgatgaagagtaacctggcggcagcgcaaaagatg

SEQ ID NO: 177534 - DNA, 103 bp, Artificial Sequence
  Synthetic Polynucleotide
taatacgactcactataggggtgggtgggtacttctggacacactcttcaaacagaggagatgaagaatgtgtccagaaaacctggcggcagcgcaaaagatg

SEQ ID NO: 177535 - DNA, 103 bp, Artificial Sequence
  Synthetic Polynucleotide
taatacgactcactatagggctgcataacagtgggtgggtacttctggacaacagaggagagtccagatgtacccacccaacctggcggcagcgcaaaagatg

SEQ ID NO: 177536 - DNA, 103 bp, Artificial Sequence
  Synthetic Polynucleotide
taatacgactcactatagggagcccttgttctgcataacagtgggtgggtaacagaggagaacccacatgctgttatgcaacctggcggcagcgcaaaagatg

SEQ ID NO: 177537 - DNA, 103 bp, Artificial Sequence
  Synthetic Polynucleotide
taatacgactcactataggggagcaccggaagcccttgttctgcataacaaacagaggagatgttatatggaacaagggaacctggcggcagcgcaaaagatg

SEQ ID NO: 177538 - DNA, 103 bp, Artificial Sequence
  Synthetic Polynucleotide
taatacgactcactataggggatgtggagggagcaccggaagcccttgttaacagaggagaaacaagatgttccggtgcaacctggcggcagcgcaaaagatg

SEQ ID NO: 177539 - DNA, 103 bp, Artificial Sequence
  Synthetic Polynucleotide
taatacgactcactatagggccttatgcctatatcctttttctttctgttaacagaggagaaacagaatgaaaaaggataacctggcggcagcgcaaaagatg

SEQ ID NO: 177540 - DNA, 103 bp, Artificial Sequence
  Synthetic Polynucleotide
taatacgactcactatagggaggttatacagatgtggagggagcaccggaaacagaggagatccggtatgccctccacaaacctggcggcagcgcaaaagatg

SEQ ID NO: 177541 - DNA, 103 bp, Artificial Sequence
  Synthetic Polynucleotide
taatacgactcactataggggcagcatgacaggttatacagatgtggaggaacagaggagacctccaatgctgtataacaacctggcggcagcgcaaaagatg

SEQ ID NO: 177542 - DNA, 103 bp, Artificial Sequence
  Synthetic Polynucleotide
taatacgactcactatagggggctggattagcagcatgacaggttatacaaacagaggagatgtataatgtgtcatgctaacctggcggcagcgcaaaagatg

SEQ ID NO: 177543 - DNA, 103 bp, Artificial Sequence
  Synthetic Polynucleotide
taatacgactcactatagggcagaaacattggctggattagcagcatgacaacagaggagagtcatgatgctaatccagaacctggcggcagcgcaaaagatg

SEQ ID NO: 177544 - DNA, 103 bp, Artificial Sequence
  Synthetic Polynucleotide
taatacgactcactatagggcctttagatgcagaaacattggctggattaaacagaggagataatccatgcaatgtttcaacctggcggcagcgcaaaagatg

SEQ ID NO: 177545 - DNA, 103 bp, Artificial Sequence
  Synthetic Polynucleotide
taatacgactcactatagggcatcaaccgacctttagatgcagaaacattaacagaggagaaatgttatggcatctaaaaacctggcggcagcgcaaaagatg

SEQ ID NO: 177546 - DNA, 103 bp, Artificial Sequence
  Synthetic Polynucleotide
taatacgactcactatagggggacacagcgcatcaaccgacctttagatgaacagaggagacatctaatggtcggttgaaacctggcggcagcgcaaaagatg

SEQ ID NO: 177547 - DNA, 103 bp, Artificial Sequence
  Synthetic Polynucleotide
taatacgactcactatagggacaggacagcggacacagcgcatcaaccgaaacagaggagatcggttatggcgctgtgtaacctggcggcagcgcaaaagatg

SEQ ID NO: 177548 - DNA, 103 bp, Artificial Sequence
  Synthetic Polynucleotide
taatacgactcactataggggtggtatgccacaggacagcggacacagcgaacagaggagacgctgtatgcgctgtcctaacctggcggcagcgcaaaagatg

SEQ ID NO: 177549 - DNA, 103 bp, Artificial Sequence
  Synthetic Polynucleotide
taatacgactcactatagggagtcattggcgtggtatgccacaggacagcaacagaggagagctgtcatgtggcataccaacctggcggcagcgcaaaagatg

SEQ ID NO: 177550 - DNA, 103 bp, Artificial Sequence
  Synthetic Polynucleotide
taatacgactcactatagggttctgaggaaccttatgcctatatccttttaacagaggagaaaaaggatgtaggcataaaacctggcggcagcgcaaaagatg

SEQ ID NO: 177551 - DNA, 103 bp, Artificial Sequence
  Synthetic Polynucleotide
taatacgactcactataggggccaggcaaaagtcattggcgtggtatgccaacagaggagaggcataatgcgccaatgaaacctggcggcagcgcaaaagatg

SEQ ID NO: 177552 - DNA, 103 bp, Artificial Sequence
  Synthetic Polynucleotide
taatacgactcactatagggtgacccagcagccaggcaaaagtcattggcaacagaggagagccaatatgttttgcctgaacctggcggcagcgcaaaagatg

SEQ ID NO: 177553 - DNA, 103 bp, Artificial Sequence
  Synthetic Polynucleotide
taatacgactcactatagggcaaggatctttgacccagcagccaggcaaaaacagaggagatttgccatgctgctgggtaacctggcggcagcgcaaaagatg

SEQ ID NO: 177554 - DNA, 103 bp, Artificial Sequence
  Synthetic Polynucleotide
taatacgactcactatagggctattagatgcaaggatctttgacccagcaaacagaggagatgctggatgaaagatcctaacctggcggcagcgcaaaagatg

SEQ ID NO: 177555 - DNA, 103 bp, Artificial Sequence
  Synthetic Polynucleotide
taatacgactcactataggggcagatgatactattagatgcaaggatcttaacagaggagaaagatcatggcatctaataacctggcggcagcgcaaaagatg

SEQ ID NO: 177556 - DNA, 103 bp, Artificial Sequence
  Synthetic Polynucleotide
taatacgactcactatagggagtgattagggcagatgatactattagatgaacagaggagacatctaatggtatcatctaacctggcggcagcgcaaaagatg

SEQ ID NO: 177557 - DNA, 103 bp, Artificial Sequence
  Synthetic Polynucleotide
taatacgactcactatagggctaggggtaaagtgattagggcagatgataaacagaggagatatcatatgccctaatcaaacctggcggcagcgcaaaagatg

SEQ ID NO: 177558 - DNA, 103 bp, Artificial Sequence
  Synthetic Polynucleotide
taatacgactcactataggggcagccccgcctaggggtaaagtgattaggaacagaggagacctaatatgtttacccctaacctggcggcagcgcaaaagatg

SEQ ID NO: 177559 - DNA, 103 bp, Artificial Sequence
  Synthetic Polynucleotide
taatacgactcactatagggcatgatttcggcagccccgcctaggggtaaaacagaggagattacccatgggcggggctaacctggcggcagcgcaaaagatg

SEQ ID NO: 177560 - DNA, 103 bp, Artificial Sequence
  Synthetic Polynucleotide
taatacgactcactatagggttaacatgctcatgatttcggcagccccgcaacagaggagagcggggatgccgaaatcaaacctggcggcagcgcaaaagatg

SEQ ID NO: 177561 - DNA, 103 bp, Artificial Sequence
  Synthetic Polynucleotide
taatacgactcactatagggactcaaaattttctgaggaaccttatgcctaacagaggagaaggcatatggttcctcagaacctggcggcagcgcaaaagatg

SEQ ID NO: 177562 - DNA, 103 bp, Artificial Sequence
  Synthetic Polynucleotide
taatacgactcactatagggccagctaacattaacatgctcatgatttcgaacagaggagacgaaatatggagcatgttaacctggcggcagcgcaaaagatg

SEQ ID NO: 177563 - DNA, 103 bp, Artificial Sequence
  Synthetic Polynucleotide
taatacgactcactatagggacacaaagcaccagctaacattaacatgctaacagaggagaagcatgatgatgttagctaacctggcggcagcgcaaaagatg

SEQ ID NO: 177564 - DNA, 103 bp, Artificial Sequence
  Synthetic Polynucleotide
taatacgactcactatagggccttctgagcacacaaagcaccagctaacaaacagaggagatgttagatggtgctttgtaacctggcggcagcgcaaaagatg

SEQ ID NO: 177565 - DNA, 103 bp, Artificial Sequence
  Synthetic Polynucleotide
taatacgactcactatagggaaggctgcctccttctgagcacacaaagcaaacagaggagatgctttatgtgctcagaaaacctggcggcagcgcaaaagatg

SEQ ID NO: 177566 - DNA, 103 bp, Artificial Sequence
  Synthetic Polynucleotide
taatacgactcactatagggcacagcacagaaggctgcctccttctgagcaacagaggagagctcagatggaggcagccaacctggcggcagcgcaaaagatg

SEQ ID NO: 177567 - DNA, 103 bp, Artificial Sequence
  Synthetic Polynucleotide
taatacgactcactataggggggcaagaatcacagcacagaaggctgcctaacagaggagaaggcagatgtctgtgctgaacctggcggcagcgcaaaagatg

SEQ ID NO: 177568 - DNA, 103 bp, Artificial Sequence
  Synthetic Polynucleotide
taatacgactcactatagggaaaagcagcagggcaagaatcacagcacagaacagaggagactgtgcatggattcttgcaacctggcggcagcgcaaaagatg

SEQ ID NO: 177569 - DNA, 103 bp, Artificial Sequence
  Synthetic Polynucleotide
taatacgactcactatagggattcacgatgaaaagcagcagggcaagaataacagaggagaattcttatgctgctgcttaacctggcggcagcgcaaaagatg

SEQ ID NO: 177570 - DNA, 103 bp, Artificial Sequence
  Synthetic Polynucleotide
taatacgactcactatagggatgttcaggcattcacgatgaaaagcagcaaacagaggagatgctgcatgtcatcgtgaaacctggcggcagcgcaaaagatg

SEQ ID NO: 177571 - DNA, 103 bp, Artificial Sequence
  Synthetic Polynucleotide
taatacgactcactatagggagggatatcaatgttcaggcattcacgatgaacagaggagacatcgtatgtgcctgaacaacctggcggcagcgcaaaagatg

SEQ ID NO: 177572 - DNA, 103 bp, Artificial Sequence
  Synthetic Polynucleotide
taatacgactcactatagggcttcccatttactcaaaattttctgaggaaaacagaggagattcctcatgaaattttgaaacctggcggcagcgcaaaagatg

SEQ ID NO: 177573 - DNA, 103 bp, Artificial Sequence
  Synthetic Polynucleotide
taatacgactcactatagggagtttccttcagggatatcaatgttcaggcaacagaggagagcctgaatgttgatatccaacctggcggcagcgcaaaagatg

SEQ ID NO: 177574 - DNA, 103 bp, Artificial Sequence
  Synthetic Polynucleotide
taatacgactcactatagggttgcaataccagtttccttcagggatatcaaacagaggagatgatatatgtgaaggaaaaacctggcggcagcgcaaaagatg

SEQ ID NO: 177575 - DNA, 103 bp, Artificial Sequence
  Synthetic Polynucleotide
taatacgactcactatagggtttacagtcattgcaataccagtttccttcaacagaggagagaaggaatgtggtattgcaacctggcggcagcgcaaaagatg

SEQ ID NO: 177576 - DNA, 103 bp, Artificial Sequence
  Synthetic Polynucleotide
taatacgactcactatagggttttgcctgctttacagtcattgcaataccaacagaggagaggtattatgatgactgtaaacctggcggcagcgcaaaagatg

SEQ ID NO: 177577 - DNA, 103 bp, Artificial Sequence
  Synthetic Polynucleotide
taatacgactcactatagggtagtgtggctttttgcctgctttacagtcaaacagaggagatgactgatgagcaggcaaaacctggcggcagcgcaaaagatg

SEQ ID NO: 177578 - DNA, 103 bp, Artificial Sequence
  Synthetic Polynucleotide
taatacgactcactatagggaatctccctgtagtgtggctttttgcctgcaacagaggagagcaggcatgaagccacacaacctggcggcagcgcaaaagatg

SEQ ID NO: 177579 - DNA, 103 bp, Artificial Sequence
  Synthetic Polynucleotide
taatacgactcactatagggttacccagacaatctccctgtagtgtggctaacagaggagaagccacatgacagggagaaacctggcggcagcgcaaaagatg

SEQ ID NO: 177580 - DNA, 103 bp, Artificial Sequence
  Synthetic Polynucleotide
taatacgactcactatagggcgtccaacttttacccagacaatctccctgaacagaggagacagggaatgtgtctgggtaacctggcggcagcgcaaaagatg

SEQ ID NO: 177581 - DNA, 103 bp, Artificial Sequence
  Synthetic Polynucleotide
taatacgactcactatagggccacctgtatcgtccaacttttacccagacaacagaggagagtctggatgaaagttggaaacctggcggcagcgcaaaagatg

SEQ ID NO: 177582 - DNA, 103 bp, Artificial Sequence
  Synthetic Polynucleotide
taatacgactcactatagggcagctggccaccacctgtatcgtccaacttaacagaggagaaagttgatggatacaggtaacctggcggcagcgcaaaagatg

SEQ ID NO: 177583 - DNA, 103 bp, Artificial Sequence
  Synthetic Polynucleotide
taatacgactcactatagggccaacactggcttcccatttactcaaaattaacagaggagaaattttatgtaaatgggaaacctggcggcagcgcaaaagatg

SEQ ID NO: 177584 - DNA, 103 bp, Artificial Sequence
  Synthetic Polynucleotide
taatacgactcactatagggtggcagatctcagctggccaccacctgtataacagaggagaatacagatggtggccagcaacctggcggcagcgcaaaagatg

SEQ ID NO: 177585 - DNA, 103 bp, Artificial Sequence
  Synthetic Polynucleotide
taatacgactcactatagggagctcgaggatggcagatctcagctggccaaacagaggagatggccaatggagatctgcaacctggcggcagcgcaaaagatg

SEQ ID NO: 177586 - DNA, 103 bp, Artificial Sequence
  Synthetic Polynucleotide
taatacgactcactatagggtggaaggaacagctcgaggatggcagatctaacagaggagaagatctatgatcctcgagaacctggcggcagcgcaaaagatg

SEQ ID NO: 177587 - DNA, 103 bp, Artificial Sequence
  Synthetic Polynucleotide
taatacgactcactatagggttatcaatgttggaaggaacagctcgaggaaacagaggagatcctcgatgtgttccttcaacctggcggcagcgcaaaagatg

SEQ ID NO: 177588 - DNA, 103 bp, Artificial Sequence
  Synthetic Polynucleotide
taatacgactcactatagggatgtctcatcttatcaatgttggaaggaacaacagaggagagttcctatgaacattgataacctggcggcagcgcaaaagatg

SEQ ID NO: 177589 - DNA, 103 bp, Artificial Sequence
  Synthetic Polynucleotide
taatacgactcactatagggctcccacatcatgtctcatcttatcaatgtaacagaggagaacattgatgagatgagacaacctggcggcagcgcaaaagatg

SEQ ID NO: 177590 - DNA, 103 bp, Artificial Sequence
  Synthetic Polynucleotide
taatacgactcactatagggactgggaactctcccacatcatgtctcatcaacagaggagagatgagatgtgatgtgggaacctggcggcagcgcaaaagatg

SEQ ID NO: 177591 - DNA, 103 bp, Artificial Sequence
  Synthetic Polynucleotide
taatacgactcactatagggaaaaaagaggactgggaactctcccacatcaacagaggagagatgtgatggagttcccaaacctggcggcagcgcaaaagatg

SEQ ID NO: 177592 - DNA, 103 bp, Artificial Sequence
  Synthetic Polynucleotide
taatacgactcactatagggcattagatccaaaaaagaggactgggaactaacagaggagaagttccatgtcctcttttaacctggcggcagcgcaaaagatg

SEQ ID NO: 177593 - DNA, 103 bp, Artificial Sequence
  Synthetic Polynucleotide
taatacgactcactatagggcacaaatagtcattagatccaaaaaagaggaacagaggagacctcttatgtggatctaaaacctggcggcagcgcaaaagatg

SEQ ID NO: 177594 - DNA, 103 bp, Artificial Sequence
  Synthetic Polynucleotide
taatacgactcactatagggttctgcaagtccaacactggcttcccatttaacagaggagaaaatggatggccagtgttaacctggcggcagcgcaaaagatg

SEQ ID NO: 177595 - DNA, 103 bp, Artificial Sequence
  Synthetic Polynucleotide
taatacgactcactatagggctggtgagtccacaaatagtcattagatccaacagaggagaggatctatggactatttgaacctggcggcagcgcaaaagatg

SEQ ID NO: 177596 - DNA, 103 bp, Artificial Sequence
  Synthetic Polynucleotide
taatacgactcactatagggagactcgggcctggtgagtccacaaatagtaacagaggagaactattatgggactcaccaacctggcggcagcgcaaaagatg

SEQ ID NO: 177597 - DNA, 103 bp, Artificial Sequence
  Synthetic Polynucleotide
taatacgactcactatagggatgtaagggaagactcgggcctggtgagtcaacagaggagagactcaatgggcccgagtaacctggcggcagcgcaaaagatg

SEQ ID NO: 177598 - DNA, 103 bp, Artificial Sequence
  Synthetic Polynucleotide
taatacgactcactataggggtcaccctccatgtaagggaagactcgggcaacagaggagagcccgaatgttcccttacaacctggcggcagcgcaaaagatg

SEQ ID NO: 177599 - DNA, 103 bp, Artificial Sequence
  Synthetic Polynucleotide
taatacgactcactatagggtgctgctcacgtcaccctccatgtaagggaaacagaggagatcccttatgtggagggtgaacctggcggcagcgcaaaagatg

SEQ ID NO: 177600 - DNA, 103 bp, Artificial Sequence
  Synthetic Polynucleotide
taatacgactcactatagggatcttatccttgctgctcacgtcaccctccaacagaggagaggagggatgcgtgagcagaacctggcggcagcgcaaaagatg

SEQ ID NO: 177601 - DNA, 103 bp, Artificial Sequence
  Synthetic Polynucleotide
taatacgactcactatagggtcctttgcccatcttatccttgctgctcacaacagaggagagtgagcatgaaggataagaacctggcggcagcgcaaaagatg

SEQ ID NO: 177602 - DNA, 103 bp, Artificial Sequence
  Synthetic Polynucleotide
taatacgactcactatagggtcccatccactcctttgcccatcttatcctaacagaggagaaggataatgtgggcaaagaacctggcggcagcgcaaaagatg

SEQ ID NO: 177603 - DNA, 103 bp, Artificial Sequence
  Synthetic Polynucleotide
taatacgactcactatagggtttttatatgtcccatccactcctttgcccaacagaggagagggcaaatgagtggatggaacctggcggcagcgcaaaagatg

SEQ ID NO: 177604 - DNA, 103 bp, Artificial Sequence
  Synthetic Polynucleotide
taatacgactcactatagggctgaagagcttttttatatgtcccatccacaacagaggagagtggatatgacatataaaaacctggcggcagcgcaaaagatg

SEQ ID NO: 177605 - DNA, 103 bp, Artificial Sequence
  Synthetic Polynucleotide
taatacgactcactatagggcatcatactgttctgcaagtccaacactggaacagaggagaccagtgatggacttgcagaacctggcggcagcgcaaaagatg

SEQ ID NO: 177606 - DNA, 103 bp, Artificial Sequence
  Synthetic Polynucleotide
taatacgactcactatagggctgcagcttcctgaagagcttttttatatgaacagaggagacatataatgaagctcttcaacctggcggcagcgcaaaagatg

SEQ ID NO: 177607 - DNA, 103 bp, Artificial Sequence
  Synthetic Polynucleotide
taatacgactcactatagggtcaaaccttgctgcagcttcctgaagagctaacagaggagaagctctatgggaagctgcaacctggcggcagcgcaaaagatg

SEQ ID NO: 177608 - DNA, 103 bp, Artificial Sequence
  Synthetic Polynucleotide
taatacgactcactatagggctttaattcctcaaaccttgctgcagcttcaacagaggagagaagctatggcaaggtttaacctggcggcagcgcaaaagatg

SEQ ID NO: 177609 - DNA, 103 bp, Artificial Sequence
  Synthetic Polynucleotide
taatacgactcactatagggctttttgggcctttaattcctcaaaccttgaacagaggagacaaggtatgaggaattaaaacctggcggcagcgcaaaagatg

SEQ ID NO: 177610 - DNA, 103 bp, Artificial Sequence
  Synthetic Polynucleotide
taatacgactcactatagggtgtcttagctctttttgggcctttaattccaacagaggagaggaattatgggcccaaaaaacctggcggcagcgcaaaagatg

SEQ ID NO: 177611 - DNA, 103 bp, Artificial Sequence
  Synthetic Polynucleotide
taatacgactcactatagggttcctgcagctgtcttagctctttttgggcaacagaggagagcccaaatggagctaagaaacctggcggcagcgcaaaagatg

SEQ ID NO: 177612 - DNA, 103 bp, Artificial Sequence
  Synthetic Polynucleotide
taatacgactcactatagggtctttcggtcttcctgcagctgtcttagctaacagaggagaagctaaatgagctgcaggaacctggcggcagcgcaaaagatg

SEQ ID NO: 177613 - DNA, 103 bp, Artificial Sequence
  Synthetic Polynucleotide
taatacgactcactatagggttcttgtcattctttcggtcttcctgcagcaacagaggagagctgcaatgagaccgaaaaacctggcggcagcgcaaaagatg

SEQ ID NO: 177614 - DNA, 103 bp, Artificial Sequence
  Synthetic Polynucleotide
taatacgactcactatagggaggtggtggcttcttgtcattctttcggtcaacagaggagagaccgaatgaatgacaagaacctggcggcagcgcaaaagatg

SEQ ID NO: 177615 - DNA, 103 bp, Artificial Sequence
  Synthetic Polynucleotide
taatacgactcactatagggtatgtttataaggtggtggcttcttgtcataacagaggagaatgacaatgagccaccacaacctggcggcagcgcaaaagatg

SEQ ID NO: 177616 - DNA, 103 bp, Artificial Sequence
  Synthetic Polynucleotide
taatacgactcactatagggcccttgggaacatcatactgttctgcaagtaacagaggagaacttgcatgacagtatgaaacctggcggcagcgcaaaagatg

SEQ ID NO: 177617 - DNA, 103 bp, Artificial Sequence
  Synthetic Polynucleotide
taatacgactcactatagggtttacctttatatgtttataaggtggtggcaacagaggagagccaccatgttataaacaaacctggcggcagcgcaaaagatg

SEQ ID NO: 177618 - DNA, 103 bp, Artificial Sequence
  Synthetic Polynucleotide
taatacgactcactatagggaataggacggtttacctttatatgtttataaacagaggagatataaaatgataaaggtaaacctggcggcagcgcaaaagatg

SEQ ID NO: 177619 - DNA, 103 bp, Artificial Sequence
  Synthetic Polynucleotide
taatacgactcactataggggtaccctgccaataggacggtttacctttaaacagaggagataaaggatgaccgtcctaaacctggcggcagcgcaaaagatg

SEQ ID NO: 177620 - DNA, 103 bp, Artificial Sequence
  Synthetic Polynucleotide
taatacgactcactataggggtgaagatctgtaccctgccaataggacggaacagaggagaccgtccatgtggcagggtaacctggcggcagcgcaaaagatg

SEQ ID NO: 177621 - DNA, 103 bp, Artificial Sequence
  Synthetic Polynucleotide
taatacgactcactatagggtaagtctgcagtgaagatctgtaccctgccaacagaggagaggcaggatgcagatcttcaacctggcggcagcgcaaaagatg

SEQ ID NO: 177622 - DNA, 103 bp, Artificial Sequence
  Synthetic Polynucleotide
taatacgactcactataggggtatttcagataagtctgcagtgaagatctaacagaggagaagatctatgctgcagactaacctggcggcagcgcaaaagatg

SEQ ID NO: 177623 - DNA, 103 bp, Artificial Sequence
  Synthetic Polynucleotide
taatacgactcactatagggttgcaacggggtatttcagataagtctgcaaacagaggagatgcagaatgatctgaaataacctggcggcagcgcaaaagatg

SEQ ID NO: 177624 - DNA, 103 bp, Artificial Sequence
  Synthetic Polynucleotide
taatacgactcactatagggagctttacagttgcaacggggtatttcagaaacagaggagatctgaaatgccccgttgcaacctggcggcagcgcaaaagatg

SEQ ID NO: 177625 - DNA, 103 bp, Artificial Sequence
  Synthetic Polynucleotide
taatacgactcactatagggtctcatcagtagctttacagttgcaacgggaacagaggagacccgttatgactgtaaagaacctggcggcagcgcaaaagatg

SEQ ID NO: 177626 - DNA, 103 bp, Artificial Sequence
  Synthetic Polynucleotide
taatacgactcactatagggccacaggggttctcatcagtagctttacagaacagaggagactgtaaatgtactgatgaaacctggcggcagcgcaaaagatg

SEQ ID NO: 177627 - DNA, 103 bp, Artificial Sequence
  Synthetic Polynucleotide
taatacgactcactataggggttctttgaccccttgggaacatcatactgaacagaggagacagtatatggttcccaagaacctggcggcagcgcaaaagatg

SEQ ID NO: 177628 - DNA, 103 bp, Artificial Sequence
  Synthetic Polynucleotide
taatacgactcactatagggagagtctatcccacaggggttctcatcagtaacagaggagaactgatatgaacccctgtaacctggcggcagcgcaaaagatg

SEQ ID NO: 177629 - DNA, 103 bp, Artificial Sequence
  Synthetic Polynucleotide
taatacgactcactatagggtgatgcattcagagtctatcccacaggggtaacagaggagaacccctatgggatagactaacctggcggcagcgcaaaagatg

SEQ ID NO: 177630 - DNA, 103 bp, Artificial Sequence
  Synthetic Polynucleotide
taatacgactcactatagggagcatgcggttgatgcattcagagtctatcaacagaggagagatagaatgtgaatgcataacctggcggcagcgcaaaagatg

SEQ ID NO: 177631 - DNA, 103 bp, Artificial Sequence
  Synthetic Polynucleotide
taatacgactcactatagggctcatagagcagcatgcggttgatgcattcaacagaggagagaatgcatgaaccgcatgaacctggcggcagcgcaaaagatg

SEQ ID NO: 177632 - DNA, 103 bp, Artificial Sequence
  Synthetic Polynucleotide
taatacgactcactatagggtggggtggcactcatagagcagcatgcggtaacagaggagaaccgcaatgtgctctatgaacctggcggcagcgcaaaagatg

SEQ ID NO: 177633 - DNA, 103 bp, Artificial Sequence
  Synthetic Polynucleotide
taatacgactcactatagggggacacactgtggggtggcactcatagagcaacagaggagagctctaatggtgccacccaacctggcggcagcgcaaaagatg

SEQ ID NO: 177634 - DNA, 103 bp, Artificial Sequence
  Synthetic Polynucleotide
taatacgactcactatagggccctccggcaggacacactgtggggtggcaaacagaggagatgccacatgacagtgtgtaacctggcggcagcgcaaaagatg

SEQ ID NO: 177635 - DNA, 103 bp, Artificial Sequence
  Synthetic Polynucleotide
taatacgactcactatagggtttgacagcgccctccggcaggacacactgaacagaggagacagtgtatgctgccggagaacctggcggcagcgcaaaagatg

SEQ ID NO: 177636 - DNA, 103 bp, Artificial Sequence
  Synthetic Polynucleotide
taatacgactcactatagggaagcactggttttgacagcgccctccggcaaacagaggagatgccggatggcgctgtcaaacctggcggcagcgcaaaagatg

SEQ ID NO: 177637 - DNA, 103 bp, Artificial Sequence
  Synthetic Polynucleotide
taatacgactcactataggggcgcttggaaaagcactggttttgacagcgaacagaggagacgctgtatgaaccagtgcaacctggcggcagcgcaaaagatg

SEQ ID NO: 177638 - DNA, 103 bp, Artificial Sequence
  Synthetic Polynucleotide
taatacgactcactataggggcatgtttcctaatgtactggtactggaataacagaggagaattccaatgccagtacataacctggcggcagcgcaaaagatg

SEQ ID NO: 177639 - DNA, 103 bp, Artificial Sequence
  Synthetic Polynucleotide
taatacgactcactatagggtacattttcggttctttgaccccttgggaaaacagaggagattcccaatgggtcaaagaaacctggcggcagcgcaaaagatg

SEQ ID NO: 177640 - DNA, 103 bp, Artificial Sequence
  Synthetic Polynucleotide
taatacgactcactatagggctggatattggcgcttggaaaagcactggtaacagaggagaaccagtatgtttccaagcaacctggcggcagcgcaaaagatg

SEQ ID NO: 177641 - DNA, 103 bp, Artificial Sequence
  Synthetic Polynucleotide
taatacgactcactatagggatttcaacctctggatattggcgcttggaaaacagaggagattccaaatgccaatatccaacctggcggcagcgcaaaagatg

SEQ ID NO: 177642 - DNA, 103 bp, Artificial Sequence
  Synthetic Polynucleotide
taatacgactcactatagggtgtgcggaaaatttcaacctctggatattgaacagaggagacaatatatggaggttgaaaacctggcggcagcgcaaaagatg

SEQ ID NO: 177643 - DNA, 103 bp, Artificial Sequence
  Synthetic Polynucleotide
taatacgactcactatagggcccgctgtaatgtgcggaaaatttcaacctaacagaggagaaggttgatgttttccgcaaacctggcggcagcgcaaaagatg

SEQ ID NO: 177644 - DNA, 103 bp, Artificial Sequence
  Synthetic Polynucleotide
taatacgactcactatagggagaccccaaccccgctgtaatgtgcggaaaaacagaggagatttccgatgattacagcgaacctggcggcagcgcaaaagatg

SEQ ID NO: 177645 - DNA, 103 bp, Artificial Sequence
  Synthetic Polynucleotide
taatacgactcactatagggttttgtccgtagaccccaaccccgctgtaaaacagaggagattacagatgggttggggtaacctggcggcagcgcaaaagatg

SEQ ID NO: 177646 - DNA, 103 bp, Artificial Sequence
  Synthetic Polynucleotide
taatacgactcactatagggtaatatctgtttttgtccgtagaccccaacaacagaggagagttgggatgtacggacaaaacctggcggcagcgcaaaagatg

SEQ ID NO: 177647 - DNA, 103 bp, Artificial Sequence
  Synthetic Polynucleotide
taatacgactcactatagggtcaccctttttaatatctgtttttgtccgtaacagaggagaacggacatgaacagatataacctggcggcagcgcaaaagatg

SEQ ID NO: 177648 - DNA, 103 bp, Artificial Sequence
  Synthetic Polynucleotide
taatacgactcactatagggattcacaaattcaccctttttaatatctgtaacagaggagaacagatatgaaaaagggtaacctggcggcagcgcaaaagatg

SEQ ID NO: 177649 - DNA, 103 bp, Artificial Sequence
  Synthetic Polynucleotide
taatacgactcactatagggccacatactcattcacaaattcacccttttaacagaggagaaaaaggatgaatttgtgaaacctggcggcagcgcaaaagatg

SEQ ID NO: 177650 - DNA, 103 bp, Artificial Sequence
  Synthetic Polynucleotide
taatacgactcactataggggaaccaggaatacattttcggttctttgacaacagaggagagtcaaaatgccgaaaatgaacctggcggcagcgcaaaagatg

SEQ ID NO: 177651 - DNA, 103 bp, Artificial Sequence
  Synthetic Polynucleotide
taatacgactcactatagggataagctcacccacatactcattcacaaataacagaggagaatttgtatgtgagtatgtaacctggcggcagcgcaaaagatg

SEQ ID NO: 177652 - DNA, 103 bp, Artificial Sequence
  Synthetic Polynucleotide
taatacgactcactatagggttcttcatctataagctcacccacatactcaacagaggagagagtatatgggtgagcttaacctggcggcagcgcaaaagatg

SEQ ID NO: 177653 - DNA, 103 bp, Artificial Sequence
  Synthetic Polynucleotide
taatacgactcactatagggctctgcattcttcttcatctataagctcacaacagaggagagtgagcatgtagatgaagaacctggcggcagcgcaaaagatg

SEQ ID NO: 177654 - DNA, 103 bp, Artificial Sequence
  Synthetic Polynucleotide
taatacgactcactatagggcgaattcgagctctgcattcttcttcatctaacagaggagaagatgaatgagaatgcagaacctggcggcagcgcaaaagatg

SEQ ID NO: 177655 - DNA, 103 bp, Artificial Sequence
  Synthetic Polynucleotide
taatacgactcactatagggttgagcatagcgaattcgagctctgcattcaacagaggagagaatgcatggctcgaattaacctggcggcagcgcaaaagatg

SEQ ID NO: 177656 - DNA, 103 bp, Artificial Sequence
  Synthetic Polynucleotide
taatacgactcactatagggtatcatgttcttgagcatagcgaattcgagaacagaggagactcgaaatggctatgctcaacctggcggcagcgcaaaagatg

SEQ ID NO: 177657 - DNA, 103 bp, Artificial Sequence
  Synthetic Polynucleotide
taatacgactcactatagggaaattagtgatatcatgttcttgagcatagaacagaggagactatgcatgagaacatgaaacctggcggcagcgcaaaagatg

SEQ ID NO: 177658 - DNA, 103 bp, Artificial Sequence
  Synthetic Polynucleotide
taatacgactcactataggggagcatatagaaattagtgatatcatgttcaacagaggagagaacatatgatcactaataacctggcggcagcgcaaaagatg

SEQ ID NO: 177659 - DNA, 103 bp, Artificial Sequence
  Synthetic Polynucleotide
taatacgactcactatagggtgtctagggtgagcatatagaaattagtgaaacagaggagatcactaatgtctatatgcaacctggcggcagcgcaaaagatg

SEQ ID NO: 177660 - DNA, 103 bp, Artificial Sequence
  Synthetic Polynucleotide
taatacgactcactatagggattcggtctttgtctagggtgagcatatagaacagaggagactatatatgcaccctagaaacctggcggcagcgcaaaagatg

SEQ ID NO: 177661 - DNA, 103 bp, Artificial Sequence
  Synthetic Polynucleotide
taatacgactcactatagggcaacttgattgaaccaggaatacattttcgaacagaggagacgaaaaatgattcctggtaacctggcggcagcgcaaaagatg

SEQ ID NO: 177662 - DNA, 103 bp, Artificial Sequence
  Synthetic Polynucleotide
taatacgactcactatagggagcatcaatgattcggtctttgtctagggtaacagaggagaaccctaatgaaagaccgaaacctggcggcagcgcaaaagatg

SEQ ID NO: 177663 - DNA, 103 bp, Artificial Sequence
  Synthetic Polynucleotide
taatacgactcactatagggctttgggaccagcatcaatgattcggtcttaacagaggagaaagaccatgtcattgatgaacctggcggcagcgcaaaagatg

SEQ ID NO: 177664 - DNA, 103 bp, Artificial Sequence
  Synthetic Polynucleotide
taatacgactcactataggggcatagtttcctttgggaccagcatcaatgaacagaggagacattgaatgtggtcccaaaacctggcggcagcgcaaaagatg

SEQ ID NO: 177665 - DNA, 103 bp, Artificial Sequence
  Synthetic Polynucleotide
taatacgactcactatagggcatgaaccgagcatagtttcctttgggaccaacagaggagaggtcccatgggaaactataacctggcggcagcgcaaaagatg

SEQ ID NO: 177666 - DNA, 103 bp, Artificial Sequence
  Synthetic Polynucleotide
taatacgactcactatagggagcaatgattcatgaaccgagcatagtttcaacagaggagagaaactatgctcggttcaaacctggcggcagcgcaaaagatg

SEQ ID NO: 177667 - DNA, 103 bp, Artificial Sequence
  Synthetic Polynucleotide
taatacgactcactatagggttgggctggcagcaatgattcatgaaccgaaacagaggagatcggttatggaatcattgaacctggcggcagcgcaaaagatg

SEQ ID NO: 177668 - DNA, 103 bp, Artificial Sequence
  Synthetic Polynucleotide
taatacgactcactatagggtgtttcacagttgggctggcagcaatgattaacagaggagaaatcatatgtgccagcccaacctggcggcagcgcaaaagatg

SEQ ID NO: 177669 - DNA, 103 bp, Artificial Sequence
  Synthetic Polynucleotide
taatacgactcactatagggaccacttctgtgtttcacagttgggctggcaacagaggagagccagcatgactgtgaaaaacctggcggcagcgcaaaagatg

SEQ ID NO: 177670 - DNA, 103 bp, Artificial Sequence
  Synthetic Polynucleotide
taatacgactcactatagggccattcacagaccacttctgtgtttcacagaacagaggagactgtgaatgacagaagtgaacctggcggcagcgcaaaagatg

SEQ ID NO: 177671 - DNA, 103 bp, Artificial Sequence
  Synthetic Polynucleotide
taatacgactcactatagggacgggtatctccattcacagaccacttctgaacagaggagacagaagatgtctgtgaataacctggcggcagcgcaaaagatg

SEQ ID NO: 177672 - DNA, 103 bp, Artificial Sequence
  Synthetic Polynucleotide
taatacgactcactatagggcttcactgtccaacttgattgaaccaggaaaacagaggagattcctgatgcaatcaagtaacctggcggcagcgcaaaagatg

SEQ ID NO: 177673 - DNA, 103 bp, Artificial Sequence
  Synthetic Polynucleotide
taatacgactcactatagggaaaggcctacacgggtatctccattcacagaacagaggagactgtgaatggagatacccaacctggcggcagcgcaaaagatg

SEQ ID NO: 177674 - DNA, 103 bp, Artificial Sequence
  Synthetic Polynucleotide
taatacgactcactatagggcttagtgcaaaaaggcctacacgggtatctaacagaggagaagatacatgtgtaggcctaacctggcggcagcgcaaaagatg

SEQ ID NO: 177675 - DNA, 103 bp, Artificial Sequence
  Synthetic Polynucleotide
taatacgactcactatagggtttaatgtcacttagtgcaaaaaggcctacaacagaggagagtaggcatgtttgcactaaacctggcggcagcgcaaaagatg

SEQ ID NO: 177676 - DNA, 103 bp, Artificial Sequence
  Synthetic Polynucleotide
taatacgactcactatagggcagtgcctgctttaatgtcacttagtgcaaaacagaggagattgcacatggtgacattaaacctggcggcagcgcaaaagatg

SEQ ID NO: 177677 - DNA, 103 bp, Artificial Sequence
  Synthetic Polynucleotide
taatacgactcactatagggaaggtaagttcagtgcctgctttaatgtcaaacagaggagatgacatatgagcaggcacaacctggcggcagcgcaaaagatg

SEQ ID NO: 177678 - DNA, 103 bp, Artificial Sequence
  Synthetic Polynucleotide
taatacgactcactataggggttgtagttgaaggtaagttcagtgcctgcaacagaggagagcaggcatggaacttaccaacctggcggcagcgcaaaagatg

SEQ ID NO: 177679 - DNA, 103 bp, Artificial Sequence
  Synthetic Polynucleotide
taatacgactcactataggggacattctaggttgtagttgaaggtaagttaacagaggagaaacttaatgtcaactacaaacctggcggcagcgcaaaagatg

SEQ ID NO: 177680 - DNA, 103 bp, Artificial Sequence
  Synthetic Polynucleotide
taatacgactcactatagggccattcccaagacattctaggttgtagttgaacagaggagacaactaatgcctagaatgaacctggcggcagcgcaaaagatg

SEQ ID NO: 177681 - DNA, 103 bp, Artificial Sequence
  Synthetic Polynucleotide
taatacgactcactatagggaacagtctttccattcccaagacattctagaacagaggagactagaaatgcttgggaataacctggcggcagcgcaaaagatg

SEQ ID NO: 177682 - DNA, 103 bp, Artificial Sequence
  Synthetic Polynucleotide
taatacgactcactatagggcacatttgcaaacagtctttccattcccaaaacagaggagattgggaatggaaagactgaacctggcggcagcgcaaaagatg

SEQ ID NO: 177683 - DNA, 103 bp, Artificial Sequence
  Synthetic Polynucleotide
taatacgactcactatagggggcatatcttcttcactgtccaacttgattaacagaggagaaatcaaatgggacagtgaaacctggcggcagcgcaaaagatg

SEQ ID NO: 177684 - DNA, 103 bp, Artificial Sequence
  Synthetic Polynucleotide
taatacgactcactatagggttcggggctccacatttgcaaacagtctttaacagaggagaaaagacatgttgcaaatgaacctggcggcagcgcaaaagatg

SEQ ID NO: 177685 - DNA, 103 bp, Artificial Sequence
  Synthetic Polynucleotide
taatacgactcactataggggccactgcagttcggggctccacatttgcaaacagaggagatgcaaaatgggagccccgaacctggcggcagcgcaaaagatg

SEQ ID NO: 177686 - DNA, 103 bp, Artificial Sequence
  Synthetic Polynucleotide
taatacgactcactatagggcacccaagaagccactgcagttcggggctcaacagaggagagagcccatgactgcagtgaacctggcggcagcgcaaaagatg

SEQ ID NO: 177687 - DNA, 103 bp, Artificial Sequence
  Synthetic Polynucleotide
taatacgactcactatagggtttggccttacacccaagaagccactgcagaacagaggagactgcagatgcttcttgggaacctggcggcagcgcaaaagatg

SEQ ID NO: 177688 - DNA, 103 bp, Artificial Sequence
  Synthetic Polynucleotide
taatacgactcactataggggggttgattctttggccttacacccaagaaaacagaggagattcttgatggtaaggccaaacctggcggcagcgcaaaagatg

SEQ ID NO: 177689 - DNA, 103 bp, Artificial Sequence
  Synthetic Polynucleotide
taatacgactcactatagggccgtggcaatgggttgattctttggccttaaacagaggagataaggcatgagaatcaacaacctggcggcagcgcaaaagatg

SEQ ID NO: 177690 - DNA, 103 bp, Artificial Sequence
  Synthetic Polynucleotide
taatacgactcactataggggacttttcttccgtggcaatgggttgattcaacagaggagagaatcaatgcattgccacaacctggcggcagcgcaaaagatg

SEQ ID NO: 177691 - DNA, 103 bp, Artificial Sequence
  Synthetic Polynucleotide
taatacgactcactataggggaatttctttgacttttcttccgtggcaataacagaggagaattgccatggaagaaaagaacctggcggcagcgcaaaagatg

SEQ ID NO: 177692 - DNA, 103 bp, Artificial Sequence
  Synthetic Polynucleotide
taatacgactcactataggggcttcttcttgaatttctttgacttttcttaacagaggagaaagaaaatgcaaagaaataacctggcggcagcgcaaaagatg

SEQ ID NO: 177693 - DNA, 103 bp, Artificial Sequence
  Synthetic Polynucleotide
taatacgactcactatagggtttccctgttgcttcttcttgaatttctttaacagaggagaaaagaaatgcaagaagaaaacctggcggcagcgcaaaagatg

SEQ ID NO: 177694 - DNA, 103 bp, Artificial Sequence
  Synthetic Polynucleotide
taatacgactcactataggggtcttcaaatggcatatcttcttcactgtcaacagaggagagacagtatggaagatatgaacctggcggcagcgcaaaagatg

SEQ ID NO: 177695 - DNA, 103 bp, Artificial Sequence
  Synthetic Polynucleotide
taatacgactcactatagggggtcctgcgctttccctgttgcttcttcttaacagaggagaaagaagatgcaacagggaaacctggcggcagcgcaaaagatg

SEQ ID NO: 177696 - DNA, 103 bp, Artificial Sequence
  Synthetic Polynucleotide
taatacgactcactatagggtttcaccctgggtcctgcgctttccctgttaacagaggagaaacaggatgagcgcaggaaacctggcggcagcgcaaaagatg

SEQ ID NO: 177697 - DNA, 103 bp, Artificial Sequence
  Synthetic Polynucleotide
taatacgactcactatagggtcctttgtgatttcaccctgggtcctgcgcaacagaggagagcgcagatgccagggtgaaacctggcggcagcgcaaaagatg

SEQ ID NO: 177698 - DNA, 103 bp, Artificial Sequence
  Synthetic Polynucleotide
taatacgactcactatagggatcttctcgctcctttgtgatttcaccctgaacagaggagacagggtatgatcacaaagaacctggcggcagcgcaaaagatg

SEQ ID NO: 177699 - DNA, 103 bp, Artificial Sequence
  Synthetic Polynucleotide
taatacgactcactatagggtaaaacactcatcttctcgctcctttgtgaaacagaggagatcacaaatgagcgagaagaacctggcggcagcgcaaaagatg

SEQ ID NO: 177700 - DNA, 103 bp, Artificial Sequence
  Synthetic Polynucleotide
taatacgactcactatagggtccccacaactaaaacactcatcttctcgcaacagaggagagcgagaatgtgagtgtttaacctggcggcagcgcaaaagatg

SEQ ID NO: 177701 - DNA, 103 bp, Artificial Sequence
  Synthetic Polynucleotide
taatacgactcactatagggctggccagcatccccacaactaaaacactcaacagaggagagagtgtatgagttgtgggaacctggcggcagcgcaaaagatg

SEQ ID NO: 177702 - DNA, 103 bp, Artificial Sequence
  Synthetic Polynucleotide
taatacgactcactatagggaggagacgagctggccagcatccccacaacaacagaggagagttgtgatgatgctggccaacctggcggcagcgcaaaagatg

SEQ ID NO: 177703 - DNA, 103 bp, Artificial Sequence
  Synthetic Polynucleotide
taatacgactcactatagggggtttcttgcaggagacgagctggccagcaaacagaggagatgctggatggctcgtctcaacctggcggcagcgcaaaagatg

SEQ ID NO: 177704 - DNA, 103 bp, Artificial Sequence
  Synthetic Polynucleotide
taatacgactcactatagggtgggcagcctggtttcttgcaggagacgagaacagaggagactcgtcatgtgcaagaaaaacctggcggcagcgcaaaagatg

SEQ ID NO: 177705 - DNA, 103 bp, Artificial Sequence
  Synthetic Polynucleotide
taatacgactcactatagggcatttgtgcagtcttcaaatggcatatcttaacagaggagaaagataatgcatttgaagaacctggcggcagcgcaaaagatg

SEQ ID NO: 177706 - DNA, 103 bp, Artificial Sequence
  Synthetic Polynucleotide
taatacgactcactatagggggtaaacttttgggcagcctggtttcttgcaacagaggagagcaagaatgcaggctgccaacctggcggcagcgcaaaagatg

SEQ ID NO: 177707 - DNA, 103 bp, Artificial Sequence
  Synthetic Polynucleotide
taatacgactcactatagggcagtctgcgtggtaaacttttgggcagcctaacagaggagaaggctgatgaaaagtttaaacctggcggcagcgcaaaagatg

SEQ ID NO: 177708 - DNA, 103 bp, Artificial Sequence
  Synthetic Polynucleotide
taatacgactcactatagggcagattgagacagtctgcgtggtaaactttaacagaggagaaaagttatgcacgcagacaacctggcggcagcgcaaaagatg

SEQ ID NO: 177709 - DNA, 103 bp, Artificial Sequence
  Synthetic Polynucleotide
taatacgactcactataggggtcgcttggtcagattgagacagtctgcgtaacagaggagaacgcagatggtctcaatcaacctggcggcagcgcaaaagatg

SEQ ID NO: 177710 - DNA, 103 bp, Artificial Sequence
  Synthetic Polynucleotide
taatacgactcactatagggttccctgctggtcgcttggtcagattgagaaacagaggagatctcaaatggaccaagcgaacctggcggcagcgcaaaagatg

SEQ ID NO: 177711 - DNA, 103 bp, Artificial Sequence
  Synthetic Polynucleotide
taatacgactcactatagggacattcccatttccctgctggtcgcttggtaacagaggagaaccaagatgccagcagggaacctggcggcagcgcaaaagatg

SEQ ID NO: 177712 - DNA, 103 bp, Artificial Sequence
  Synthetic Polynucleotide
taatacgactcactataggggatgccacggacattcccatttccctgctgaacagaggagacagcagatgaatgggaataacctggcggcagcgcaaaagatg

SEQ ID NO: 177713 - DNA, 103 bp, Artificial Sequence
  Synthetic Polynucleotide
taatacgactcactatagggatgtcacactgatgccacggacattcccataacagaggagaatgggaatgtccgtggcaaacctggcggcagcgcaaaagatg

SEQ ID NO: 177714 - DNA, 103 bp, Artificial Sequence
  Synthetic Polynucleotide
taatacgactcactatagggcttcccgcagatgtcacactgatgccacggaacagaggagaccgtggatgcagtgtgacaacctggcggcagcgcaaaagatg

SEQ ID NO: 177715 - DNA, 103 bp, Artificial Sequence
  Synthetic Polynucleotide
taatacgactcactatagggaggctgcttccttcccgcagatgtcacactaacagaggagaagtgtgatgtctgcgggaaacctggcggcagcgcaaaagatg

SEQ ID NO: 177716 - DNA, 103 bp, Artificial Sequence
  Synthetic Polynucleotide
taatacgactcactataggggactcaggatcatttgtgcagtcttcaaataacagaggagaatttgaatgctgcacaaaaacctggcggcagcgcaaaagatg

SEQ ID NO: 177717 - DNA, 103 bp, Artificial Sequence
  Synthetic Polynucleotide
taatacgactcactatagggtcacagaaggaggctgcttccttcccgcagaacagaggagactgcggatgggaagcagcaacctggcggcagcgcaaaagatg

SEQ ID NO: 177718 - DNA, 103 bp, Artificial Sequence
  Synthetic Polynucleotide
taatacgactcactatagggggggcacatctcacagaaggaggctgcttcaacagaggagagaagcaatgtccttctgtaacctggcggcagcgcaaaagatg

SEQ ID NO: 177719 - DNA, 103 bp, Artificial Sequence
  Synthetic Polynucleotide
taatacgactcactatagggaaaaggagctggggcacatctcacagaaggaacagaggagaccttctatgagatgtgccaacctggcggcagcgcaaaagatg

SEQ ID NO: 177720 - DNA, 103 bp, Artificial Sequence
  Synthetic Polynucleotide
taatacgactcactatagggtgctgcttacaaaaggagctggggcacatcaacagaggagagatgtgatgcagctccttaacctggcggcagcgcaaaagatg

SEQ ID NO: 177721 - DNA, 103 bp, Artificial Sequence
  Synthetic Polynucleotide
taatacgactcactatagggcccttctcgatgctgcttacaaaaggagctaacagaggagaagctccatgtgtaagcagaacctggcggcagcgcaaaagatg

SEQ ID NO: 177722 - DNA, 103 bp, Artificial Sequence
  Synthetic Polynucleotide
taatacgactcactatagggtgaaaagcatcccttctcgatgctgcttacaacagaggagagtaagcatgatcgagaagaacctggcggcagcgcaaaagatg

SEQ ID NO: 177723 - DNA, 103 bp, Artificial Sequence
  Synthetic Polynucleotide
taatacgactcactatagggagtttggaaatgaaaagcatcccttctcgaaacagaggagatcgagaatggatgcttttaacctggcggcagcgcaaaagatg

SEQ ID NO: 177724 - DNA, 103 bp, Artificial Sequence
  Synthetic Polynucleotide
taatacgactcactatagggacgcccatccagtttggaaatgaaaagcataacagaggagaatgcttatgatttccaaaaacctggcggcagcgcaaaagatg

SEQ ID NO: 177725 - DNA, 103 bp, Artificial Sequence
  Synthetic Polynucleotide
taatacgactcactatagggtacaagacagacgcccatccagtttggaaaaacagaggagatttccaatgtggatgggcaacctggcggcagcgcaaaagatg

SEQ ID NO: 177726 - DNA, 103 bp, Artificial Sequence
  Synthetic Polynucleotide
taatacgactcactatagggtcatgctcagtacaagacagacgcccatccaacagaggagaggatggatgtctgtcttgaacctggcggcagcgcaaaagatg

SEQ ID NO: 177727 - DNA, 103 bp, Artificial Sequence
  Synthetic Polynucleotide
taatacgactcactataggggtcatgttctgactcaggatcatttgtgcaaacagaggagatgcacaatggatcctgagaacctggcggcagcgcaaaagatg

SEQ ID NO: 177728 - DNA, 103 bp, Artificial Sequence
  Synthetic Polynucleotide
taatacgactcactatagggcccacaggggtcatgctcagtacaagacagaacagaggagactgtctatgactgagcataacctggcggcagcgcaaaagatg

SEQ ID NO: 177729 - DNA, 103 bp, Artificial Sequence
  Synthetic Polynucleotide
taatacgactcactataggggaggattgggcccacaggggtcatgctcagaacagaggagactgagcatgacccctgtgaacctggcggcagcgcaaaagatg

SEQ ID NO: 177730 - DNA, 103 bp, Artificial Sequence
  Synthetic Polynucleotide
taatacgactcactatagggccaggttccagaggattgggcccacaggggaacagaggagacccctgatggcccaatccaacctggcggcagcgcaaaagatg

SEQ ID NO: 177731 - DNA, 103 bp, Artificial Sequence
  Synthetic Polynucleotide
taatacgactcactatagggacggatctccccaggttccagaggattgggaacagaggagacccaatatgctggaacctaacctggcggcagcgcaaaagatg

SEQ ID NO: 177732 - DNA, 103 bp, Artificial Sequence
  Synthetic Polynucleotide
taatacgactcactataggggcacatactcacggatctccccaggttccaaacagaggagatggaacatggggagatccaacctggcggcagcgcaaaagatg

SEQ ID NO: 177733 - DNA, 103 bp, Artificial Sequence
  Synthetic Polynucleotide
taatacgactcactatagggactgggggaggcacatactcacggatctccaacagaggagaggagatatgtgagtatgtaacctggcggcagcgcaaaagatg

SEQ ID NO: 177734 - DNA, 103 bp, Artificial Sequence
  Synthetic Polynucleotide
taatacgactcactatagggaggcagcggtactgggggaggcacatactcaacagaggagagagtatatgcctcccccaaacctggcggcagcgcaaaagatg

SEQ ID NO: 177735 - DNA, 103 bp, Artificial Sequence
  Synthetic Polynucleotide
taatacgactcactatagggttggccctggaggcagcggtactgggggagaacagaggagactccccatgtaccgctgcaacctggcggcagcgcaaaagatg

SEQ ID NO: 177736 - DNA, 103 bp, Artificial Sequence
  Synthetic Polynucleotide
taatacgactcactatagggaggtgagtgcttggccctggaggcagcggtaacagaggagaaccgctatgtccagggccaacctggcggcagcgcaaaagatg

SEQ ID NO: 177737 - DNA, 103 bp, Artificial Sequence
  Synthetic Polynucleotide
taatacgactcactatagggttgctctgccaggtgagtgcttggccctggaacagaggagaccagggatgagcactcacaacctggcggcagcgcaaaagatg

SEQ ID NO: 177738 - DNA, 103 bp, Artificial Sequence
  Synthetic Polynucleotide
taatacgactcactatagggtaagcaacaggtcatgttctgactcaggataacagaggagaatcctgatgcagaacatgaacctggcggcagcgcaaaagatg

SEQ ID NO: 177739 - DNA, 103 bp, Artificial Sequence
  Synthetic Polynucleotide
taatacgactcactatagggttcctgttgattgctctgccaggtgagtgcaacagaggagagcactcatgtggcagagcaacctggcggcagcgcaaaagatg

SEQ ID NO: 177740 - DNA, 103 bp, Artificial Sequence
  Synthetic Polynucleotide
taatacgactcactatagggtgagcagccattcctgttgattgctctgccaacagaggagaggcagaatgatcaacaggaacctggcggcagcgcaaaagatg

SEQ ID NO: 177741 - DNA, 103 bp, Artificial Sequence
  Synthetic Polynucleotide
taatacgactcactatagggtttgggtgcctgagcagccattcctgttgaaacagaggagatcaacaatgatggctgctaacctggcggcagcgcaaaagatg

SEQ ID NO: 177742 - DNA, 103 bp, Artificial Sequence
  Synthetic Polynucleotide
taatacgactcactatagggtatctgacattttgggtgcctgagcagccaaacagaggagatggctgatgaggcacccaaacctggcggcagcgcaaaagatg

SEQ ID NO: 177743 - DNA, 103 bp, Artificial Sequence
  Synthetic Polynucleotide
taatacgactcactataggggcaggaggtttatctgacattttgggtgccaacagaggagaggcaccatgaatgtcagaaacctggcggcagcgcaaaagatg

SEQ ID NO: 177744 - DNA, 103 bp, Artificial Sequence
  Synthetic Polynucleotide
taatacgactcactataggggttggtgtcagcaggaggtttatctgacataacagaggagaatgtcaatgaaacctcctaacctggcggcagcgcaaaagatg

SEQ ID NO: 177745 - DNA, 103 bp, Artificial Sequence
  Synthetic Polynucleotide
taatacgactcactatagggacagcatctggttggtgtcagcaggaggttaacagaggagaaacctcatgctgacaccaaacctggcggcagcgcaaaagatg

SEQ ID NO: 177746 - DNA, 103 bp, Artificial Sequence
  Synthetic Polynucleotide
taatacgactcactatagggttggagagcgacagcatctggttggtgtcaaacagaggagatgacacatgccagatgctaacctggcggcagcgcaaaagatg

SEQ ID NO: 177747 - DNA, 103 bp, Artificial Sequence
  Synthetic Polynucleotide
taatacgactcactatagggcagagcttttttggagagcgacagcatctgaacagaggagacagatgatgtcgctctccaacctggcggcagcgcaaaagatg

SEQ ID NO: 177748 - DNA, 103 bp, Artificial Sequence
  Synthetic Polynucleotide
taatacgactcactatagggaagtccctgccagagcttttttggagagcgaacagaggagacgctctatgaaaaagctcaacctggcggcagcgcaaaagatg

SEQ ID NO: 177749 - DNA, 103 bp, Artificial Sequence
  Synthetic Polynucleotide
taatacgactcactatagggggtaattctagcatgtttcctaatgtactgaacagaggagacagtacatgaggaaacataacctggcggcagcgcaaaagatg

SEQ ID NO: 177750 - DNA, 103 bp, Artificial Sequence
  Synthetic Polynucleotide
taatacgactcactatagggaaacagccattaagcaacaggtcatgttctaacagaggagaagaacaatgcctgttgctaacctggcggcagcgcaaaagatg

SEQ ID NO: 177751 - DNA, 103 bp, Artificial Sequence
  Synthetic Polynucleotide
taatacgactcactatagggggcctctgacaagtccctgccagagcttttaacagaggagaaaaagcatgggcagggacaacctggcggcagcgcaaaagatg

SEQ ID NO: 177752 - DNA, 103 bp, Artificial Sequence
  Synthetic Polynucleotide
taatacgactcactatagggaggtagcaatggcctctgacaagtccctgcaacagaggagagcagggatgtgtcagaggaacctggcggcagcgcaaaagatg

SEQ ID NO: 177753 - DNA, 103 bp, Artificial Sequence
  Synthetic Polynucleotide
taatacgactcactataggggaggtctttcaggtagcaatggcctctgacaacagaggagagtcagaatgcattgctacaacctggcggcagcgcaaaagatg

SEQ ID NO: 177754 - DNA, 103 bp, Artificial Sequence
  Synthetic Polynucleotide
taatacgactcactataggggttctctcaagaggtctttcaggtagcaataacagaggagaattgctatgtgaaagaccaacctggcggcagcgcaaaagatg

SEQ ID NO: 177755 - DNA, 103 bp, Artificial Sequence
  Synthetic Polynucleotide
taatacgactcactatagggcctggagtcagttctctcaagaggtctttcaacagaggagagaaagaatgcttgagagaaacctggcggcagcgcaaaagatg

SEQ ID NO: 177756 - DNA, 103 bp, Artificial Sequence
  Synthetic Polynucleotide
taatacgactcactatagggaaggctggggcctggagtcagttctctcaaaacagaggagattgagaatgctgactccaaacctggcggcagcgcaaaagatg

SEQ ID NO: 177757 - DNA, 103 bp, Artificial Sequence
  Synthetic Polynucleotide
taatacgactcactatagggaccttatctaaaggctggggcctggagtcaaacagaggagatgactcatggccccagccaacctggcggcagcgcaaaagatg

SEQ ID NO: 177758 - DNA, 103 bp, Artificial Sequence
  Synthetic Polynucleotide
taatacgactcactataggggaggtctctgaccttatctaaaggctggggaacagaggagaccccagatgttagataagaacctggcggcagcgcaaaagatg

SEQ ID NO: 177759 - DNA, 103 bp, Artificial Sequence
  Synthetic Polynucleotide
taatacgactcactatagggctgacccagcgaggtctctgaccttatctaaacagaggagatagataatgtcagagaccaacctggcggcagcgcaaaagatg

SEQ ID NO: 177760 - DNA, 103 bp, Artificial Sequence
  Synthetic Polynucleotide
taatacgactcactataggggatttggtccctgacccagcgaggtctctgaacagaggagacagagaatgcgctgggtcaacctggcggcagcgcaaaagatg

SEQ ID NO: 177761 - DNA, 103 bp, Artificial Sequence
  Synthetic Polynucleotide
taatacgactcactatagggcagtgatttcaaacagccattaagcaacagaacagaggagactgttgatgaatggctgtaacctggcggcagcgcaaaagatg

SEQ ID NO: 177762 - DNA, 103 bp, Artificial Sequence
  Synthetic Polynucleotide
taatacgactcactatagggcaaggattgggatttggtccctgacccagcaacagaggagagctgggatggggaccaaaaacctggcggcagcgcaaaagatg

SEQ ID NO: 177763 - DNA, 103 bp, Artificial Sequence
  Synthetic Polynucleotide
taatacgactcactatagggggctggaaaccaaggattgggatttggtccaacagaggagaggaccaatgcccaatcctaacctggcggcagcgcaaaagatg

SEQ ID NO: 177764 - DNA, 103 bp, Artificial Sequence
  Synthetic Polynucleotide
taatacgactcactatagggagtggcctctggctggaaaccaaggattggaacagaggagaccaatcatgggtttccagaacctggcggcagcgcaaaagatg

SEQ ID NO: 177765 - DNA, 103 bp, Artificial Sequence
  Synthetic Polynucleotide
taatacgactcactatagggtggcctgtccagtggcctctggctggaaacaacagaggagagtttccatgcagaggccaaacctggcggcagcgcaaaagatg

SEQ ID NO: 177766 - DNA, 103 bp, Artificial Sequence
  Synthetic Polynucleotide
taatacgactcactatagggccactgctggtggcctgtccagtggcctctaacagaggagaagaggcatgtggacaggcaacctggcggcagcgcaaaagatg

SEQ ID NO: 177767 - DNA, 103 bp, Artificial Sequence
  Synthetic Polynucleotide
taatacgactcactatagggcttggtcctgccactgctggtggcctgtccaacagaggagaggacagatgaccagcagtaacctggcggcagcgcaaaagatg

SEQ ID NO: 177768 - DNA, 103 bp, Artificial Sequence
  Synthetic Polynucleotide
taatacgactcactatagggtagctggggtcttggtcctgccactgctggaacagaggagaccagcaatggcaggaccaaacctggcggcagcgcaaaagatg

SEQ ID NO: 177769 - DNA, 103 bp, Artificial Sequence
  Synthetic Polynucleotide
taatacgactcactataggggtttgtcgcttagctggggtcttggtcctgaacagaggagacaggacatggaccccagcaacctggcggcagcgcaaaagatg

SEQ ID NO: 177770 - DNA, 103 bp, Artificial Sequence
  Synthetic Polynucleotide
taatacgactcactatagggactggagagggtttgtcgcttagctggggtaacagaggagaaccccaatgaagcgacaaaacctggcggcagcgcaaaagatg

SEQ ID NO: 177771 - DNA, 103 bp, Artificial Sequence
  Synthetic Polynucleotide
taatacgactcactatagggtgggctggtcactggagagggtttgtcgctaacagaggagaagcgacatgccctctccaaacctggcggcagcgcaaaagatg

SEQ ID NO: 177772 - DNA, 103 bp, Artificial Sequence
  Synthetic Polynucleotide
taatacgactcactatagggaatcaaaagccagtgatttcaaacagccataacagaggagaatggctatgtgaaatcacaacctggcggcagcgcaaaagatg

SEQ ID NO: 177773 - DNA, 103 bp, Artificial Sequence
  Synthetic Polynucleotide
taatacgactcactataggggtgaggagcttgggctggtcactggagaggaacagaggagacctctcatgtgaccagccaacctggcggcagcgcaaaagatg

SEQ ID NO: 177774 - DNA, 103 bp, Artificial Sequence
  Synthetic Polynucleotide
taatacgactcactatagggctgactgagggtgaggagcttgggctggtcaacagaggagagaccagatgaagctcctcaacctggcggcagcgcaaaagatg

SEQ ID NO: 177775 - DNA, 103 bp, Artificial Sequence
  Synthetic Polynucleotide
taatacgactcactatagggtggttgggacctgactgagggtgaggagctaacagaggagaagctccatgccctcagtcaacctggcggcagcgcaaaagatg

SEQ ID NO: 177776 - DNA, 103 bp, Artificial Sequence
  Synthetic Polynucleotide
taatacgactcactataggggtctttccagtggttgggacctgactgaggaacagaggagacctcagatgggtcccaacaacctggcggcagcgcaaaagatg

SEQ ID NO: 177777 - DNA, 103 bp, Artificial Sequence
  Synthetic Polynucleotide
taatacgactcactataggggtccccagaggtctttccagtggttgggacaacagaggagagtcccaatgactggaaagaacctggcggcagcgcaaaagatg

SEQ ID NO: 177778 - DNA, 103 bp, Artificial Sequence
  Synthetic Polynucleotide
taatacgactcactatagggtgggtcagccgtccccagaggtctttccagaacagaggagactggaaatgcctctggggaacctggcggcagcgcaaaagatg

SEQ ID NO: 177779 - DNA, 103 bp, Artificial Sequence
  Synthetic Polynucleotide
taatacgactcactatagggtatccagccttgggtcagccgtccccagagaacagaggagactctggatgcggctgaccaacctggcggcagcgcaaaagatg

SEQ ID NO: 177780 - DNA, 103 bp, Artificial Sequence
  Synthetic Polynucleotide
taatacgactcactatagggcctatggatttatccagccttgggtcagccaacagaggagaggctgaatgaaggctggaaacctggcggcagcgcaaaagatg

SEQ ID NO: 177781 - DNA, 103 bp, Artificial Sequence
  Synthetic Polynucleotide
taatacgactcactataggggctggcagcacctatggatttatccagcctaacagaggagaaggctgatgaaatccataaacctggcggcagcgcaaaagatg

SEQ ID NO: 177782 - DNA, 103 bp, Artificial Sequence
  Synthetic Polynucleotide
taatacgactcactatagggggggccttgggctggcagcacctatggattaacagaggagaaatccaatggtgctgccaaacctggcggcagcgcaaaagatg

SEQ ID NO: 177783 - DNA, 103 bp, Artificial Sequence
  Synthetic Polynucleotide
taatacgactcactataggggaatgttcagaatcaaaagccagtgatttcaacagaggagagaaatcatgggcttttgaaacctggcggcagcgcaaaagatg

SEQ ID NO: 177784 - DNA, 103 bp, Artificial Sequence
  Synthetic Polynucleotide
taatacgactcactatagggtccagtgactggggccttgggctggcagcaaacagaggagatgctgcatgcccaaggccaacctggcggcagcgcaaaagatg

SEQ ID NO: 177785 - DNA, 103 bp, Artificial Sequence
  Synthetic Polynucleotide
taatacgactcactatagggtgaggttttctccagtgactggggccttggaacagaggagaccaaggatgcagtcactgaacctggcggcagcgcaaaagatg

SEQ ID NO: 177786 - DNA, 103 bp, Artificial Sequence
  Synthetic Polynucleotide
taatacgactcactatagggcagtgggaactgaggttttctccagtgactaacagaggagaagtcacatgagaaaacctaacctggcggcagcgcaaaagatg

SEQ ID NO: 177787 - DNA, 103 bp, Artificial Sequence
  Synthetic Polynucleotide
taatacgactcactatagggagtctcaggccagtgggaactgaggttttcaacagaggagagaaaacatgagttcccacaacctggcggcagcgcaaaagatg

SEQ ID NO: 177788 - DNA, 103 bp, Artificial Sequence
  Synthetic Polynucleotide
taatacgactcactatagggtggcggcggaagtctcaggccagtgggaacaacagaggagagttcccatgggcctgagaaacctggcggcagcgcaaaagatg

SEQ ID NO: 177789 - DNA, 103 bp, Artificial Sequence
  Synthetic Polynucleotide
taatacgactcactataggggcagtctgtctggcggcggaagtctcaggcaacagaggagagcctgaatgttccgccgcaacctggcggcagcgcaaaagatg

SEQ ID NO: 177790 - DNA, 103 bp, Artificial Sequence
  Synthetic Polynucleotide
taatacgactcactatagggctagtaatgagcagtctgtctggcggcggaaacagaggagatccgccatgagacagactaacctggcggcagcgcaaaagatg

SEQ ID NO: 177791 - DNA, 103 bp, Artificial Sequence
  Synthetic Polynucleotide
taatacgactcactatagggtttgggactgctagtaatgagcagtctgtcaacagaggagagacagaatgctcattactaacctggcggcagcgcaaaagatg

SEQ ID NO: 177792 - DNA, 103 bp, Artificial Sequence
  Synthetic Polynucleotide
taatacgactcactatagggaagtctggggtttgggactgctagtaatgaaacagaggagatcattaatggcagtcccaaacctggcggcagcgcaaaagatg

SEQ ID NO: 177793 - DNA, 103 bp, Artificial Sequence
  Synthetic Polynucleotide
taatacgactcactatagggggcctgtctgaagtctggggtttgggactgaacagaggagacagtccatgaccccagacaacctggcggcagcgcaaaagatg

SEQ ID NO: 177794 - DNA, 103 bp, Artificial Sequence
  Synthetic Polynucleotide
taatacgactcactatagggctcatctgcagaatgttcagaatcaaaagcaacagaggagagcttttatgtctgaacataacctggcggcagcgcaaaagatg

SEQ ID NO: 177795 - DNA, 103 bp, Artificial Sequence
  Synthetic Polynucleotide
taatacgactcactatagggtttgtcagtaggcctgtctgaagtctggggaacagaggagaccccagatgtcagacaggaacctggcggcagcgcaaaagatg

SEQ ID NO: 177796 - DNA, 103 bp, Artificial Sequence
  Synthetic Polynucleotide
taatacgactcactatagggaggcatggggtttgtcagtaggcctgtctgaacagaggagacagacaatgctactgacaaacctggcggcagcgcaaaagatg

SEQ ID NO: 177797 - DNA, 103 bp, Artificial Sequence
  Synthetic Polynucleotide
taatacgactcactatagggtgggacaaagaggcatggggtttgtcagtaaacagaggagatactgaatgaccccatgcaacctggcggcagcgcaaaagatg

SEQ ID NO: 177798 - DNA, 103 bp, Artificial Sequence
  Synthetic Polynucleotide
taatacgactcactatagggtgggagtctctgggacaaagaggcatggggaacagaggagaccccatatgtctttgtccaacctggcggcagcgcaaaagatg

SEQ ID NO: 177799 - DNA, 103 bp, Artificial Sequence
  Synthetic Polynucleotide
taatacgactcactatagggtctcaggaggtgggagtctctgggacaaagaacagaggagactttgtatgagagactccaacctggcggcagcgcaaaagatg

SEQ ID NO: 177800 - DNA, 103 bp, Artificial Sequence
  Synthetic Polynucleotide
taatacgactcactataggggatagtactttctcaggaggtgggagtctcaacagaggagagagactatgacctcctgaaacctggcggcagcgcaaaagatg

SEQ ID NO: 177801 - DNA, 103 bp, Artificial Sequence
  Synthetic Polynucleotide
taatacgactcactataggggaccacagctgatagtactttctcaggaggaacagaggagacctcctatgaaagtactaaacctggcggcagcgcaaaagatg

SEQ ID NO: 177802 - DNA, 103 bp, Artificial Sequence
  Synthetic Polynucleotide
taatacgactcactatagggcaagggtctggaccacagctgatagtacttaacagaggagaaagtacatgcagctgtggaacctggcggcagcgcaaaagatg

SEQ ID NO: 177803 - DNA, 103 bp, Artificial Sequence
  Synthetic Polynucleotide
taatacgactcactatagggtctttagctacaagggtctggaccacagctaacagaggagaagctgtatgccagaccctaacctggcggcagcgcaaaagatg

SEQ ID NO: 177804 - DNA, 103 bp, Artificial Sequence
  Synthetic Polynucleotide
taatacgactcactatagggcagtgctttttctttagctacaagggtctgaacagaggagacagaccatggtagctaaaaacctggcggcagcgcaaaagatg

SEQ ID NO: 177805 - DNA, 103 bp, Artificial Sequence
  Synthetic Polynucleotide
taatacgactcactataggggcttttccttctcatctgcagaatgttcagaacagaggagactgaacatgctgcagatgaacctggcggcagcgcaaaagatg

SEQ ID NO: 177806 - DNA, 103 bp, Artificial Sequence
  Synthetic Polynucleotide
taatacgactcactatagggccacaggcctcagtgctttttctttagctaaacagaggagatagctaatgaaaaagcacaacctggcggcagcgcaaaagatg

SEQ ID NO: 177807 - DNA, 103 bp, Artificial Sequence
  Synthetic Polynucleotide
taatacgactcactataggggtattctggtccacaggcctcagtgcttttaacagaggagaaaaagcatggaggcctgtaacctggcggcagcgcaaaagatg

SEQ ID NO: 177808 - DNA, 103 bp, Artificial Sequence
  Synthetic Polynucleotide
taatacgactcactatagggttttgactgagtattctggtccacaggcctaacagaggagaaggcctatggaccagaataacctggcggcagcgcaaaagatg

SEQ ID NO: 177809 - DNA, 103 bp, Artificial Sequence
  Synthetic Polynucleotide
taatacgactcactatagggcagctctattttttgactgagtattctggtaacagaggagaaccagaatgctcagtcaaaacctggcggcagcgcaaaagatg

SEQ ID NO: 177810 - DNA, 103 bp, Artificial Sequence
  Synthetic Polynucleotide
taatacgactcactatagggatcaccaaagcagctctattttttgactgaaacagaggagatcagtcatgaaatagagcaacctggcggcagcgcaaaagatg

SEQ ID NO: 177811 - DNA, 103 bp, Artificial Sequence
  Synthetic Polynucleotide
taatacgactcactatagggtatgagatccatcaccaaagcagctctattaacagaggagaaatagaatggctttggtgaacctggcggcagcgcaaaagatg

SEQ ID NO: 177812 - DNA, 103 bp, Artificial Sequence
  Synthetic Polynucleotide
taatacgactcactataggggagttaggtctatgagatccatcaccaaagaacagaggagactttggatgtggatctcaaacctggcggcagcgcaaaagatg

SEQ ID NO: 177813 - DNA, 103 bp, Artificial Sequence
  Synthetic Polynucleotide
taatacgactcactatagggttctggcgaggagttaggtctatgagatccaacagaggagaggatctatgagacctaacaacctggcggcagcgcaaaagatg

SEQ ID NO: 177814 - DNA, 103 bp, Artificial Sequence
  Synthetic Polynucleotide
taatacgactcactatagggtgcccgctccttctggcgaggagttaggtcaacagaggagagacctaatgcctcgccagaacctggcggcagcgcaaaagatg

SEQ ID NO: 177815 - DNA, 103 bp, Artificial Sequence
  Synthetic Polynucleotide
taatacgactcactataggggaggtgaagctgcccgctccttctggcgagaacagaggagactcgccatgaggagcgggaacctggcggcagcgcaaaagatg

SEQ ID NO: 177816 - DNA, 103 bp, Artificial Sequence
  Synthetic Polynucleotide
taatacgactcactatagggttagcgcaaggcttttccttctcatctgcaaacagaggagatgcagaatggaaggaaaaaacctggcggcagcgcaaaagatg

SEQ ID NO: 177817 - DNA, 103 bp, Artificial Sequence
  Synthetic Polynucleotide
taatacgactcactataggggtgacctgatgaggtgaagctgcccgctccaacagaggagaggagcgatgagcttcaccaacctggcggcagcgcaaaagatg

SEQ ID NO: 177818 - DNA, 103 bp, Artificial Sequence
  Synthetic Polynucleotide
taatacgactcactatagggagcctgtggtgtgacctgatgaggtgaagcaacagaggagagcttcaatgcatcaggtcaacctggcggcagcgcaaaagatg

SEQ ID NO: 177819 - DNA, 103 bp, Artificial Sequence
  Synthetic Polynucleotide
taatacgactcactatagggtcttctcatcagcctgtggtgtgacctgataacagaggagaatcaggatgcaccacaggaacctggcggcagcgcaaaagatg

SEQ ID NO: 177820 - DNA, 103 bp, Artificial Sequence
  Synthetic Polynucleotide
taatacgactcactatagggaacactggcatcttctcatcagcctgtggtaacagaggagaaccacaatgtgatgagaaaacctggcggcagcgcaaaagatg

SEQ ID NO: 177821 - DNA, 103 bp, Artificial Sequence
  Synthetic Polynucleotide
taatacgactcactatagggacttgactccaacactggcatcttctcatcaacagaggagagatgagatgatgccagtgaacctggcggcagcgcaaaagatg

SEQ ID NO: 177822 - DNA, 103 bp, Artificial Sequence
  Synthetic Polynucleotide
taatacgactcactatagggcaggccatgaacttgactccaacactggcaaacagaggagatgccagatgtggagtcaaaacctggcggcagcgcaaaagatg

SEQ ID NO: 177823 - DNA, 103 bp, Artificial Sequence
  Synthetic Polynucleotide
taatacgactcactatagggcctttgctggcaggccatgaacttgactccaacagaggagaggagtcatgttcatggccaacctggcggcagcgcaaaagatg

SEQ ID NO: 177824 - DNA, 103 bp, Artificial Sequence
  Synthetic Polynucleotide
taatacgactcactatagggatgccccagacctttgctggcaggccatgaaacagaggagatcatggatggccagcaaaaacctggcggcagcgcaaaagatg

SEQ ID NO: 177825 - DNA, 103 bp, Artificial Sequence
  Synthetic Polynucleotide
taatacgactcactatagggctctcggcatatgccccagacctttgctggaacagaggagaccagcaatggtctggggcaacctggcggcagcgcaaaagatg

SEQ ID NO: 177826 - DNA, 103 bp, Artificial Sequence
  Synthetic Polynucleotide
taatacgactcactatagggttctcaacagctctcggcatatgccccagaaacagaggagatctgggatgtatgccgagaacctggcggcagcgcaaaagatg

SEQ ID NO: 177827 - DNA, 103 bp, Artificial Sequence
  Synthetic Polynucleotide
taatacgactcactatagggggctcgagatttagcgcaaggcttttccttaacagaggagaaaggaaatgccttgcgctaacctggcggcagcgcaaaagatg

SEQ ID NO: 177828 - DNA, 103 bp, Artificial Sequence
  Synthetic Polynucleotide
taatacgactcactatagggcacacagcctttctcaacagctctcggcataacagaggagaatgccgatggctgttgagaacctggcggcagcgcaaaagatg

SEQ ID NO: 177829 - DNA, 103 bp, Artificial Sequence
  Synthetic Polynucleotide
taatacgactcactataggggaggatctgacacacagcctttctcaacagaacagaggagactgttgatgaaggctgtgaacctggcggcagcgcaaaagatg

SEQ ID NO: 177830 - DNA, 103 bp, Artificial Sequence
  Synthetic Polynucleotide
taatacgactcactataggggatgtctgaagaggatctgacacacagcctaacagaggagaaggctgatggtcagatccaacctggcggcagcgcaaaagatg

SEQ ID NO: 177831 - DNA, 103 bp, Artificial Sequence
  Synthetic Polynucleotide
taatacgactcactatagggtgctttcccagatgtctgaagaggatctgaaacagaggagatcagatatgcttcagacaaacctggcggcagcgcaaaagatg

SEQ ID NO: 177832 - DNA, 103 bp, Artificial Sequence
  Synthetic Polynucleotide
taatacgactcactatagggaaggggctgctgctttcccagatgtctgaaaacagaggagattcagaatgctgggaaagaacctggcggcagcgcaaaagatg

SEQ ID NO: 177833 - DNA, 103 bp, Artificial Sequence
  Synthetic Polynucleotide
taatacgactcactataggggggtcctctgaaggggctgctgctttcccaaacagaggagatgggaaatgagcagccccaacctggcggcagcgcaaaagatg

SEQ ID NO: 177834 - DNA, 103 bp, Artificial Sequence
  Synthetic Polynucleotide
taatacgactcactatagggagcttgccaggggtcctctgaaggggctgcaacagaggagagcagccatgtcagaggacaacctggcggcagcgcaaaagatg

SEQ ID NO: 177835 - DNA, 103 bp, Artificial Sequence
  Synthetic Polynucleotide
taatacgactcactataggggtgatttaacagcttgccaggggtcctctgaacagaggagacagaggatgcctggcaagaacctggcggcagcgcaaaagatg

SEQ ID NO: 177836 - DNA, 103 bp, Artificial Sequence
  Synthetic Polynucleotide
taatacgactcactataggggcctgggtgagtgatttaacagcttgccagaacagaggagactggcaatgtgttaaatcaacctggcggcagcgcaaaagatg

SEQ ID NO: 177837 - DNA, 103 bp, Artificial Sequence
  Synthetic Polynucleotide
taatacgactcactatagggaagaagtctggcctgggtgagtgatttaacaacagaggagagttaaaatgctcacccagaacctggcggcagcgcaaaagatg

SEQ ID NO: 177838 - DNA, 103 bp, Artificial Sequence
  Synthetic Polynucleotide
taatacgactcactatagggagctctttctggctcgagatttagcgcaagaacagaggagacttgcgatgaatctcgagaacctggcggcagcgcaaaagatg

SEQ ID NO: 177839 - DNA, 103 bp, Artificial Sequence
  Synthetic Polynucleotide
taatacgactcactataggggaggctgagaaagaagtctggcctgggtgaaacagaggagatcacccatgccagacttcaacctggcggcagcgcaaaagatg

SEQ ID NO: 177840 - DNA, 103 bp, Artificial Sequence
  Synthetic Polynucleotide
taatacgactcactataggggccttggcaggaggctgagaaagaagtctgaacagaggagacagactatgttctcagccaacctggcggcagcgcaaaagatg

SEQ ID NO: 177841 - DNA, 103 bp, Artificial Sequence
  Synthetic Polynucleotide
taatacgactcactatagggatataaaaaggccttggcaggaggctgagaaacagaggagatctcagatgcctgccaagaacctggcggcagcgcaaaagatg

SEQ ID NO: 177842 - DNA, 103 bp, Artificial Sequence
  Synthetic Polynucleotide
taatacgactcactatagggttgttggctcatataaaaaggccttggcagaacagaggagactgccaatgcctttttataacctggcggcagcgcaaaagatg

SEQ ID NO: 177843 - DNA, 103 bp, Artificial Sequence
  Synthetic Polynucleotide
taatacgactcactataggggaggcctgagttgttggctcatataaaaagaacagaggagactttttatgtgagccaacaacctggcggcagcgcaaaagatg

SEQ ID NO: 177844 - DNA, 103 bp, Artificial Sequence
  Synthetic Polynucleotide
taatacgactcactatagggagctcttcctgaggcctgagttgttggctcaacagaggagagagccaatgactcaggccaacctggcggcagcgcaaaagatg

SEQ ID NO: 177845 - DNA, 103 bp, Artificial Sequence
  Synthetic Polynucleotide
taatacgactcactatagggcccctgcagaagctcttcctgaggcctgagaacagaggagactcaggatgcaggaagagaacctggcggcagcgcaaaagatg

SEQ ID NO: 177846 - DNA, 103 bp, Artificial Sequence
  Synthetic Polynucleotide
taatacgactcactataggggtctgctcagcccctgcagaagctcttcctaacagaggagaaggaagatgttctgcaggaacctggcggcagcgcaaaagatg

SEQ ID NO: 177847 - DNA, 103 bp, Artificial Sequence
  Synthetic Polynucleotide
taatacgactcactatagggaggccctggggtctgctcagcccctgcagaaacagaggagatctgcaatggctgagcagaacctggcggcagcgcaaaagatg

SEQ ID NO: 177848 - DNA, 103 bp, Artificial Sequence
  Synthetic Polynucleotide
taatacgactcactatagggattggctaagaggccctggggtctgctcagaacagaggagactgagcatgccccagggcaacctggcggcagcgcaaaagatg

SEQ ID NO: 177849 - DNA, 103 bp, Artificial Sequence
  Synthetic Polynucleotide
taatacgactcactatagggggattatcagagctctttctggctcgagataacagaggagaatctcgatgcagaaagagaacctggcggcagcgcaaaagatg

SEQ ID NO: 177850 - DNA, 103 bp, Artificial Sequence
  Synthetic Polynucleotide
taatacgactcactatagggaggcccggggattggctaagaggccctgggaacagaggagacccaggatgtcttagccaaacctggcggcagcgcaaaagatg

SEQ ID NO: 177851 - DNA, 103 bp, Artificial Sequence
  Synthetic Polynucleotide
taatacgactcactatagggctgcttcaccaggcccggggattggctaagaacagaggagacttagcatgtccccgggcaacctggcggcagcgcaaaagatg

SEQ ID NO: 177852 - DNA, 103 bp, Artificial Sequence
  Synthetic Polynucleotide
taatacgactcactatagggtctgcttcgcctgcttcaccaggcccggggaacagaggagaccccggatgtggtgaagcaacctggcggcagcgcaaaagatg

SEQ ID NO: 177853 - DNA, 103 bp, Artificial Sequence
  Synthetic Polynucleotide
taatacgactcactatagggcctccgaccatctgcttcgcctgcttcaccaacagaggagaggtgaaatgggcgaagcaaacctggcggcagcgcaaaagatg

SEQ ID NO: 177854 - DNA, 103 bp, Artificial Sequence
  Synthetic Polynucleotide
taatacgactcactatagggtagttgctggcctccgaccatctgcttcgcaacagaggagagcgaagatgatggtcggaaacctggcggcagcgcaaaagatg

SEQ ID NO: 177855 - DNA, 103 bp, Artificial Sequence
  Synthetic Polynucleotide
taatacgactcactatagggcaagtgcaggtagttgctggcctccgaccaaacagaggagatggtcgatggccagcaacaacctggcggcagcgcaaaagatg

SEQ ID NO: 177856 - DNA, 103 bp, Artificial Sequence
  Synthetic Polynucleotide
taatacgactcactatagggctcttggcggcaagtgcaggtagttgctggaacagaggagaccagcaatgacctgcactaacctggcggcagcgcaaaagatg

SEQ ID NO: 177857 - DNA, 103 bp, Artificial Sequence
  Synthetic Polynucleotide
taatacgactcactatagggagattgcccactcttggcggcaagtgcaggaacagaggagacctgcaatggccgccaagaacctggcggcagcgcaaaagatg

SEQ ID NO: 177858 - DNA, 103 bp, Artificial Sequence
  Synthetic Polynucleotide
taatacgactcactataggggagacctaaaagattgcccactcttggcggaacagaggagaccgccaatggtgggcaataacctggcggcagcgcaaaagatg

SEQ ID NO: 177859 - DNA, 103 bp, Artificial Sequence
  Synthetic Polynucleotide
taatacgactcactataggggccttcccgagagacctaaaagattgcccaaacagaggagatgggcaatgttttaggtcaacctggcggcagcgcaaaagatg

SEQ ID NO: 177860 - DNA, 103 bp, Artificial Sequence
  Synthetic Polynucleotide
taatacgactcactatagggtgaagttccaggtaattctagcatgtttccaacagaggagaggaaacatgctagaattaaacctggcggcagcgcaaaagatg

SEQ ID NO: 177861 - DNA, 103 bp, Artificial Sequence
  Synthetic Polynucleotide
taatacgactcactatagggagtcctttttggattatcagagctctttctaacagaggagaagaaagatgtctgataataacctggcggcagcgcaaaagatg

SEQ ID NO: 177862 - DNA, 103 bp, Artificial Sequence
  Synthetic Polynucleotide
taatacgactcactatagggggaggctggggccttcccgagagacctaaaaacagaggagatttaggatgctcgggaagaacctggcggcagcgcaaaagatg

SEQ ID NO: 177863 - DNA, 103 bp, Artificial Sequence
  Synthetic Polynucleotide
taatacgactcactatagggcagtggggagggaggctggggccttcccgaaacagaggagatcgggaatgccccagcctaacctggcggcagcgcaaaagatg

SEQ ID NO: 177864 - DNA, 103 bp, Artificial Sequence
  Synthetic Polynucleotide
taatacgactcactatagggttcttttcttcagtggggagggaggctgggaacagaggagacccagcatgcctccccacaacctggcggcagcgcaaaagatg

SEQ ID NO: 177865 - DNA, 103 bp, Artificial Sequence
  Synthetic Polynucleotide
taatacgactcactatagggggttaccaacttcttttcttcagtggggagaacagaggagactccccatggaagaaaagaacctggcggcagcgcaaaagatg

SEQ ID NO: 177866 - DNA, 103 bp, Artificial Sequence
  Synthetic Polynucleotide
taatacgactcactatagggtttgctctgtggttaccaacttcttttcttaacagaggagaaagaaaatgagttggtaaaacctggcggcagcgcaaaagatg

SEQ ID NO: 177867 - DNA, 103 bp, Artificial Sequence
  Synthetic Polynucleotide
taatacgactcactataggggcccagggactttgctctgtggttaccaacaacagaggagagttggtatgcacagagcaaacctggcggcagcgcaaaagatg

SEQ ID NO: 177868 - DNA, 103 bp, Artificial Sequence
  Synthetic Polynucleotide
taatacgactcactatagggttttcccagggcccagggactttgctctgtaacagaggagaacagagatgagtccctggaacctggcggcagcgcaaaagatg

SEQ ID NO: 177869 - DNA, 103 bp, Artificial Sequence
  Synthetic Polynucleotide
taatacgactcactataggggtgatgaggcttttcccagggcccagggacaacagaggagagtccctatgccctgggaaaacctggcggcagcgcaaaagatg

SEQ ID NO: 177870 - DNA, 103 bp, Artificial Sequence
  Synthetic Polynucleotide
taatacgactcactatagggagccctgcccgtgatgaggcttttcccaggaacagaggagacctgggatgagcctcatcaacctggcggcagcgcaaaagatg

SEQ ID NO: 177871 - DNA, 103 bp, Artificial Sequence
  Synthetic Polynucleotide
taatacgactcactatagggtatgggccagagccctgcccgtgatgaggcaacagaggagagcctcaatgcgggcagggaacctggcggcagcgcaaaagatg

SEQ ID NO: 177872 - DNA, 103 bp, Artificial Sequence
  Synthetic Polynucleotide
taatacgactcactatagggttttcacactagtcctttttggattatcagaacagaggagactgataatgcaaaaaggaaacctggcggcagcgcaaaagatg

SEQ ID NO: 177873 - DNA, 103 bp, Artificial Sequence
  Synthetic Polynucleotide
taatacgactcactataggggtccagccactatgggccagagccctgcccaacagaggagagggcagatgtctggcccaaacctggcggcagcgcaaaagatg

SEQ ID NO: 177874 - DNA, 103 bp, Artificial Sequence
  Synthetic Polynucleotide
taatacgactcactataggggccagtgtctgtccagccactatgggccagaacagaggagactggccatgagtggctggaacctggcggcagcgcaaaagatg

SEQ ID NO: 177875 - DNA, 103 bp, Artificial Sequence
  Synthetic Polynucleotide
taatacgactcactataggggcaagactgtgccagtgtctgtccagccacaacagaggagagtggctatgcagacactgaacctggcggcagcgcaaaagatg

SEQ ID NO: 177876 - DNA, 103 bp, Artificial Sequence
  Synthetic Polynucleotide
taatacgactcactatagggcagcagaccagcaagactgtgccagtgtctaacagaggagaagacacatgcacagtcttaacctggcggcagcgcaaaagatg

SEQ ID NO: 177877 - DNA, 103 bp, Artificial Sequence
  Synthetic Polynucleotide
taatacgactcactatagggtgtgtgctcccagcagaccagcaagactgtaacagaggagaacagtcatgctggtctgcaacctggcggcagcgcaaaagatg

SEQ ID NO: 177878 - DNA, 103 bp, Artificial Sequence
  Synthetic Polynucleotide
taatacgactcactatagggtgccaatgtctgtgtgctcccagcagaccaaacagaggagatggtctatggggagcacaaacctggcggcagcgcaaaagatg

SEQ ID NO: 177879 - DNA, 103 bp, Artificial Sequence
  Synthetic Polynucleotide
taatacgactcactatagggagcaagtctgtgccaatgtctgtgtgctccaacagaggagaggagcaatgagacattggaacctggcggcagcgcaaaagatg

SEQ ID NO: 177880 - DNA, 103 bp, Artificial Sequence
  Synthetic Polynucleotide
taatacgactcactatagggccaagagaccagcaagtctgtgccaatgtcaacagaggagagacattatgacagacttgaacctggcggcagcgcaaaagatg

SEQ ID NO: 177881 - DNA, 103 bp, Artificial Sequence
  Synthetic Polynucleotide
taatacgactcactatagggttgccctcttccaagagaccagcaagtctgaacagaggagacagactatgtggtctcttaacctggcggcagcgcaaaagatg

SEQ ID NO: 177882 - DNA, 103 bp, Artificial Sequence
  Synthetic Polynucleotide
taatacgactcactataggggtttggggtcttgccctcttccaagagaccaacagaggagaggtctcatggaagagggcaacctggcggcagcgcaaaagatg

SEQ ID NO: 177883 - DNA, 103 bp, Artificial Sequence
  Synthetic Polynucleotide
taatacgactcactatagggatgtggccctttttcacactagtcctttttaacagaggagaaaaaagatgtagtgtgaaaacctggcggcagcgcaaaagatg

SEQ ID NO: 177884 - DNA, 103 bp, Artificial Sequence
  Synthetic Polynucleotide
taatacgactcactatagggttttgctctggtttggggtcttgccctcttaacagaggagaaagaggatgagaccccaaaacctggcggcagcgcaaaagatg

SEQ ID NO: 177885 - DNA, 103 bp, Artificial Sequence
  Synthetic Polynucleotide
taatacgactcactatagggtggaagtgtattttgctctggtttggggtcaacagaggagagaccccatgccagagcaaaacctggcggcagcgcaaaagatg

SEQ ID NO: 177886 - DNA, 103 bp, Artificial Sequence
  Synthetic Polynucleotide
taatacgactcactatagggggttaagagctggaagtgtattttgctctgaacagaggagacagagcatgatacacttcaacctggcggcagcgcaaaagatg

SEQ ID NO: 177887 - DNA, 103 bp, Artificial Sequence
  Synthetic Polynucleotide
taatacgactcactataggggaaggagcctggttaagagctggaagtgtaaacagaggagatacactatgagctcttaaaacctggcggcagcgcaaaagatg

SEQ ID NO: 177888 - DNA, 103 bp, Artificial Sequence
  Synthetic Polynucleotide
taatacgactcactatagggcttgtgactggaaggagcctggttaagagcaacagaggagagctcttatgcaggctcctaacctggcggcagcgcaaaagatg

SEQ ID NO: 177889 - DNA, 103 bp, Artificial Sequence
  Synthetic Polynucleotide
taatacgactcactatagggattctgcacacttgtgactggaaggagcctaacagaggagaaggctcatgccagtcacaaacctggcggcagcgcaaaagatg

SEQ ID NO: 177890 - DNA, 103 bp, Artificial Sequence
  Synthetic Polynucleotide
taatacgactcactatagggttctgttctgattctgcacacttgtgactgaacagaggagacagtcaatggtgtgcagaaacctggcggcagcgcaaaagatg

SEQ ID NO: 177891 - DNA, 103 bp, Artificial Sequence
  Synthetic Polynucleotide
taatacgactcactatagggttcaaattgtatgtggccctttttcacactaacagaggagaagtgtgatgaagggccacaacctggcggcagcgcaaaagatg

SEQ ID NO: 177892 - DNA, 103 bp, Artificial Sequence
  Synthetic Polynucleotide
taatacgactcactatagggctttatgtgcttcaaattgtatgtggccctaacagaggagaagggccatgtacaatttgaacctggcggcagcgcaaaagatg

SEQ ID NO: 177893 - DNA, 103 bp, Artificial Sequence
  Synthetic Polynucleotide
taatacgactcactatagggctccgttcatctttatgtgcttcaaattgtaacagaggagaacaattatgagcacataaaacctggcggcagcgcaaaagatg

SEQ ID NO: 177894 - DNA, 103 bp, Artificial Sequence
  Synthetic Polynucleotide
taatacgactcactatagggaatctttcccctccgttcatctttatgtgcaacagaggagagcacatatggatgaacggaacctggcggcagcgcaaaagatg

SEQ ID NO: 177895 - DNA, 103 bp, Artificial Sequence
  Synthetic Polynucleotide
taatacgactcactatagggggttctctggaatctttcccctccgttcataacagaggagaatgaacatgggggaaagaaacctggcggcagcgcaaaagatg

SEQ ID NO: 177896 - DNA, 103 bp, Artificial Sequence
  Synthetic Polynucleotide
taatacgactcactatagggtttaggccaaggttctctggaatctttcccaacagaggagagggaaaatgtccagagaaaacctggcggcagcgcaaaagatg

SEQ ID NO: 177897 - DNA, 103 bp, Artificial Sequence
  Synthetic Polynucleotide
taatacgactcactatagggagagataaagtttaggccaaggttctctggaacagaggagaccagagatgcttggcctaaacctggcggcagcgcaaaagatg

SEQ ID NO: 177898 - DNA, 103 bp, Artificial Sequence
  Synthetic Polynucleotide
taatacgactcactatagggtagatgatgatgaagttccaggtaattctaaacagaggagatagaatatgctggaacttaacctggcggcagcgcaaaagatg

SEQ ID NO: 177899 - DNA, 103 bp, Artificial Sequence
  Synthetic Polynucleotide
taatacgactcactatagggatatatccccagagataaagtttaggccaaaacagaggagattggccatgactttatctaacctggcggcagcgcaaaagatg

SEQ ID NO: 177900 - DNA, 103 bp, Artificial Sequence
  Synthetic Polynucleotide
taatacgactcactatagggtgcgtatcagatatatccccagagataaagaacagaggagactttatatgtggggatataacctggcggcagcgcaaaagatg

SEQ ID NO: 177901 - DNA, 103 bp, Artificial Sequence
  Synthetic Polynucleotide
taatacgactcactatagggattagaggcctgcgtatcagatatatccccaacagaggagaggggatatgtctgatacgaacctggcggcagcgcaaaagatg

SEQ ID NO: 177902 - DNA, 103 bp, Artificial Sequence
  Synthetic Polynucleotide
taatacgactcactatagggtggaaagttcattagaggcctgcgtatcagaacagaggagactgataatgaggcctctaaacctggcggcagcgcaaaagatg

SEQ ID NO: 177903 - DNA, 103 bp, Artificial Sequence
  Synthetic Polynucleotide
taatacgactcactatagggtttgctatcctggaaagttcattagaggccaacagaggagaggcctcatgtgaactttcaacctggcggcagcgcaaaagatg

SEQ ID NO: 177904 - DNA, 103 bp, Artificial Sequence
  Synthetic Polynucleotide
taatacgactcactatagggtgtgaggctatttgctatcctggaaagttcaacagaggagagaacttatgaggatagcaaacctggcggcagcgcaaaagatg

SEQ ID NO: 177905 - DNA, 103 bp, Artificial Sequence
  Synthetic Polynucleotide
taatacgactcactatagggtgttggaccctgtgaggctatttgctatccaacagaggagaggatagatgatagcctcaaacctggcggcagcgcaaaagatg

SEQ ID NO: 177906 - DNA, 103 bp, Artificial Sequence
  Synthetic Polynucleotide
taatacgactcactatagggcctggggcagtgttggaccctgtgaggctaaacagaggagatagcctatgagggtccaaaacctggcggcagcgcaaaagatg

SEQ ID NO: 177907 - DNA, 103 bp, Artificial Sequence
  Synthetic Polynucleotide
taatacgactcactatagggcagaaaacttcctggggcagtgttggacccaacagaggagagggtccatgactgccccaaacctggcggcagcgcaaaagatg

SEQ ID NO: 177908 - DNA, 103 bp, Artificial Sequence
  Synthetic Polynucleotide
taatacgactcactatagggaggaagaaaacagaaaacttcctggggcagaacagaggagactgcccatggaagttttcaacctggcggcagcgcaaaagatg

SEQ ID NO: 177909 - DNA, 103 bp, Artificial Sequence
  Synthetic Polynucleotide
taatacgactcactatagggtcctgtgaagtagatgatgatgaagttccaaacagaggagatggaacatgatcatcatcaacctggcggcagcgcaaaagatg

SEQ ID NO: 177910 - DNA, 103 bp, Artificial Sequence
  Synthetic Polynucleotide
taatacgactcactatagggttttttccacaggaagaaaacagaaaacttaacagaggagaaagtttatggttttcttcaacctggcggcagcgcaaaagatg

SEQ ID NO: 177911 - DNA, 103 bp, Artificial Sequence
  Synthetic Polynucleotide
taatacgactcactatagggctttgcagtgttttttccacaggaagaaaaaacagaggagattttctatgtgtggaaaaaacctggcggcagcgcaaaagatg

SEQ ID NO: 177912 - DNA, 103 bp, Artificial Sequence
  Synthetic Polynucleotide
taatacgactcactatagggcaaattctttctttgcagtgttttttccacaacagaggagagtggaaatgacactgcaaaacctggcggcagcgcaaaagatg

SEQ ID NO: 177913 - DNA, 103 bp, Artificial Sequence
  Synthetic Polynucleotide
taatacgactcactatagggtttgaagtctcaaattctttctttgcagtgaacagaggagacactgcatggaaagaattaacctggcggcagcgcaaaagatg

SEQ ID NO: 177914 - DNA, 103 bp, Artificial Sequence
  Synthetic Polynucleotide
taatacgactcactatagggagagtcaccatttgaagtctcaaattctttaacagaggagaaaagaaatggagacttcaaacctggcggcagcgcaaaagatg

SEQ ID NO: 177915 - DNA, 103 bp, Artificial Sequence
  Synthetic Polynucleotide
taatacgactcactatagggagcccaataaagagtcaccatttgaagtctaacagaggagaagacttatgatggtgactaacctggcggcagcgcaaaagatg

SEQ ID NO: 177916 - DNA, 103 bp, Artificial Sequence
  Synthetic Polynucleotide
taatacgactcactatagggccctcaggcaagcccaataaagagtcaccaaacagaggagatggtgaatgtttattgggaacctggcggcagcgcaaaagatg

SEQ ID NO: 177917 - DNA, 103 bp, Artificial Sequence
  Synthetic Polynucleotide
taatacgactcactataggggatcaaagcaccctcaggcaagcccaataaaacagaggagattattgatgttgcctgagaacctggcggcagcgcaaaagatg

SEQ ID NO: 177918 - DNA, 103 bp, Artificial Sequence
  Synthetic Polynucleotide
taatacgactcactatagggaacactttgagatcaaagcaccctcaggcaaacagaggagatgcctgatggtgctttgaaacctggcggcagcgcaaaagatg

SEQ ID NO: 177919 - DNA, 103 bp, Artificial Sequence
  Synthetic Polynucleotide
taatacgactcactatagggttctctcgagaacactttgagatcaaagcaaacagaggagatgctttatgctcaaagtgaacctggcggcagcgcaaaagatg

SEQ ID NO: 177920 - DNA, 103 bp, Artificial Sequence
  Synthetic Polynucleotide
taatacgactcactataggggcatcgataggcggtgtaggcagccttcataacagaggagaatgaagatggcctacaccaacctggcggcagcgcaaaagatg

SEQ ID NO: 177921 - DNA, 103 bp, Artificial Sequence
  Synthetic Polynucleotide
taatacgactcactatagggactgccgccgccggccggcccgtgcaaagtaacagaggagaactttgatggggccggccaacctggcggcagcgcaaaagatg

SEQ ID NO: 177922 - DNA, 103 bp, Artificial Sequence
  Synthetic Polynucleotide
taatacgactcactatagggctgggccacctctttggtgttgatttcttcaacagaggagagaagaaatgaacaccaaaaacctggcggcagcgcaaaagatg

SEQ ID NO: 177923 - DNA, 103 bp, Artificial Sequence
  Synthetic Polynucleotide
taatacgactcactatagggctgtgatgcgctgggccacctctttggtgtaacagaggagaacaccaatgaggtggcccaacctggcggcagcgcaaaagatg

SEQ ID NO: 177924 - DNA, 103 bp, Artificial Sequence
  Synthetic Polynucleotide
taatacgactcactatagggttcagctccgctgtgatgcgctgggccaccaacagaggagaggtggcatggcgcatcacaacctggcggcagcgcaaaagatg

SEQ ID NO: 177925 - DNA, 103 bp, Artificial Sequence
  Synthetic Polynucleotide
taatacgactcactatagggactgtagcgcttcagctccgctgtgatgcgaacagaggagacgcatcatggcggagctgaacctggcggcagcgcaaaagatg

SEQ ID NO: 177926 - DNA, 103 bp, Artificial Sequence
  Synthetic Polynucleotide
taatacgactcactatagggcctgggggatactgtagcgcttcagctccgaacagaggagacggagcatgagcgctacaaacctggcggcagcgcaaaagatg

SEQ ID NO: 177927 - DNA, 103 bp, Artificial Sequence
  Synthetic Polynucleotide
taatacgactcactataggggcaaagatcgcctgggggatactgtagcgcaacagaggagagcgctaatgtatcccccaaacctggcggcagcgcaaaagatg

SEQ ID NO: 177928 - DNA, 103 bp, Artificial Sequence
  Synthetic Polynucleotide
taatacgactcactatagggcaccctctgcgcaaagatcgcctgggggataacagaggagaatccccatggcgatctttaacctggcggcagcgcaaaagatg

SEQ ID NO: 177929 - DNA, 103 bp, Artificial Sequence
  Synthetic Polynucleotide
taatacgactcactatagggaccggcacagcaccctctgcgcaaagatcgaacagaggagacgatctatgcgcagagggaacctggcggcagcgcaaaagatg

SEQ ID NO: 177930 - DNA, 103 bp, Artificial Sequence
  Synthetic Polynucleotide
taatacgactcactataggggtcccctgagaccggcacagcaccctctgcaacagaggagagcagagatggctgtgccgaacctggcggcagcgcaaaagatg

SEQ ID NO: 177931 - DNA, 103 bp, Artificial Sequence
  Synthetic Polynucleotide
taatacgactcactataggggtcggagagagtcccctgagaccggcacagaacagaggagactgtgcatgtctcaggggaacctggcggcagcgcaaaagatg

SEQ ID NO: 177932 - DNA, 103 bp, Artificial Sequence
  Synthetic Polynucleotide
taatacgactcactatagggcgcccccgccactgccgccgccggccggccaacagaggagaggccggatggcggcggcaaacctggcggcagcgcaaaagatg

SEQ ID NO: 177933 - DNA, 103 bp, Artificial Sequence
  Synthetic Polynucleotide
taatacgactcactatagggtccggagcaggtcggagagagtcccctgagaacagaggagactcaggatgctctctccgaacctggcggcagcgcaaaagatg

SEQ ID NO: 177934 - DNA, 103 bp, Artificial Sequence
  Synthetic Polynucleotide
taatacgactcactatagggggttttggattccggagcaggtcggagagaaacagaggagatctctcatgcctgctccgaacctggcggcagcgcaaaagatg

SEQ ID NO: 177935 - DNA, 103 bp, Artificial Sequence
  Synthetic Polynucleotide
taatacgactcactatagggtttactccacggttttggattccggagcagaacagaggagactgctcatgaatccaaaaaacctggcggcagcgcaaaagatg

SEQ ID NO: 177936 - DNA, 103 bp, Artificial Sequence
  Synthetic Polynucleotide
taatacgactcactatagggcagatttgagtttactccacggttttggataacagaggagaatccaaatgcgtggagtaaacctggcggcagcgcaaaagatg

SEQ ID NO: 177937 - DNA, 103 bp, Artificial Sequence
  Synthetic Polynucleotide
taatacgactcactataggggtctccctgccagatttgagtttactccacaacagaggagagtggagatgactcaaatcaacctggcggcagcgcaaaagatg

SEQ ID NO: 177938 - DNA, 103 bp, Artificial Sequence
  Synthetic Polynucleotide
taatacgactcactatagggcctgcggaaggtctccctgccagatttgagaacagaggagactcaaaatgggcagggagaacctggcggcagcgcaaaagatg

SEQ ID NO: 177939 - DNA, 103 bp, Artificial Sequence
  Synthetic Polynucleotide
taatacgactcactatagggacttccacatcctgcggaaggtctccctgcaacagaggagagcagggatgccttccgcaaacctggcggcagcgcaaaagatg

SEQ ID NO: 177940 - DNA, 103 bp, Artificial Sequence
  Synthetic Polynucleotide
taatacgactcactatagggtcctgaagccacttccacatcctgcggaagaacagaggagacttccgatggatgtggaaaacctggcggcagcgcaaaagatg

SEQ ID NO: 177941 - DNA, 103 bp, Artificial Sequence
  Synthetic Polynucleotide
taatacgactcactataggggaactcgggctcctgaagccacttccacataacagaggagaatgtggatgtggcttcagaacctggcggcagcgcaaaagatg

SEQ ID NO: 177942 - DNA, 103 bp, Artificial Sequence
  Synthetic Polynucleotide
taatacgactcactatagggacatgcgctggaactcgggctcctgaagccaacagaggagaggcttcatgagcccgagtaacctggcggcagcgcaaaagatg

SEQ ID NO: 177943 - DNA, 103 bp, Artificial Sequence
  Synthetic Polynucleotide
taatacgactcactatagggcccccgccgccgcccccgccactgccgccgaacagaggagacggcggatgtggcgggggaacctggcggcagcgcaaaagatg

SEQ ID NO: 177944 - DNA, 103 bp, Artificial Sequence
  Synthetic Polynucleotide
taatacgactcactatagggcgtaaggcggacatgcgctggaactcgggcaacagaggagagcccgaatgccagcgcataacctggcggcagcgcaaaagatg

SEQ ID NO: 177945 - DNA, 103 bp, Artificial Sequence
  Synthetic Polynucleotide
taatacgactcactatagggcgctgccaggcgtaaggcggacatgcgctgaacagaggagacagcgcatgtccgccttaaacctggcggcagcgcaaaagatg

SEQ ID NO: 177946 - DNA, 103 bp, Artificial Sequence
  Synthetic Polynucleotide
taatacgactcactatagggtgcgtttgcacgctgccaggcgtaaggcggaacagaggagaccgcctatggcctggcagaacctggcggcagcgcaaaagatg

SEQ ID NO: 177947 - DNA, 103 bp, Artificial Sequence
  Synthetic Polynucleotide
taatacgactcactatagggtcttgctctttgcgtttgcacgctgccaggaacagaggagacctggcatggtgcaaacgaacctggcggcagcgcaaaagatg

SEQ ID NO: 177948 - DNA, 103 bp, Artificial Sequence
  Synthetic Polynucleotide
taatacgactcactatagggtttgtttggttcttgctctttgcgtttgcaaacagaggagatgcaaaatgaaagagcaaaacctggcggcagcgcaaaagatg

SEQ ID NO: 177949 - DNA, 103 bp, Artificial Sequence
  Synthetic Polynucleotide
taatacgactcactatagggtgttcctgtctttgtttggttcttgctcttaacagaggagaaagagcatgaaccaaacaaacctggcggcagcgcaaaagatg

SEQ ID NO: 177950 - DNA, 103 bp, Artificial Sequence
  Synthetic Polynucleotide
taatacgactcactatagggttctgggaattgttcctgtctttgtttggtaacagaggagaaccaaaatgagacaggaaaacctggcggcagcgcaaaagatg

SEQ ID NO: 177951 - DNA, 103 bp, Artificial Sequence
  Synthetic Polynucleotide
taatacgactcactataggggcgggacttcttctgggaattgttcctgtcaacagaggagagacaggatgaattcccagaacctggcggcagcgcaaaagatg

SEQ ID NO: 177952 - DNA, 103 bp, Artificial Sequence
  Synthetic Polynucleotide
taatacgactcactatagggtgaacaccaggcgggacttcttctgggaataacagaggagaattcccatgagaagtcccaacctggcggcagcgcaaaagatg

SEQ ID NO: 177953 - DNA, 103 bp, Artificial Sequence
  Synthetic Polynucleotide
taatacgactcactatagggtggaggtcagtgaacaccaggcgggacttcaacagaggagagaagtcatgcctggtgttaacctggcggcagcgcaaaagatg

SEQ ID NO: 177954 - DNA, 103 bp, Artificial Sequence
  Synthetic Polynucleotide
taatacgactcactataggggcccccgccgcccccgccgccgcccccgccaacagaggagaggcgggatgggcggcgggaacctggcggcagcgcaaaagatg

SEQ ID NO: 177955 - DNA, 103 bp, Artificial Sequence
  Synthetic Polynucleotide
taatacgactcactatagggtgttcggcgttggaggtcagtgaacaccagaacagaggagactggtgatgactgacctcaacctggcggcagcgcaaaagatg

SEQ ID NO: 177956 - DNA, 103 bp, Artificial Sequence
  Synthetic Polynucleotide
taatacgactcactatagggtggcgaagagtgttcggcgttggaggtcagaacagaggagactgaccatgaacgccgaaaacctggcggcagcgcaaaagatg

SEQ ID NO: 177957 - DNA, 103 bp, Artificial Sequence
  Synthetic Polynucleotide
taatacgactcactatagggtccttgaagatggcgaagagtgttcggcgtaacagaggagaacgccgatgactcttcgcaacctggcggcagcgcaaaagatg

SEQ ID NO: 177958 - DNA, 103 bp, Artificial Sequence
  Synthetic Polynucleotide
taatacgactcactataggggcgtttgttctccttgaagatggcgaagagaacagaggagactcttcatgatcttcaagaacctggcggcagcgcaaaagatg

SEQ ID NO: 177959 - DNA, 103 bp, Artificial Sequence
  Synthetic Polynucleotide
taatacgactcactatagggcctttgacgggcgtttgttctccttgaagaaacagaggagatcttcaatgagaacaaacaacctggcggcagcgcaaaagatg

SEQ ID NO: 177960 - DNA, 103 bp, Artificial Sequence
  Synthetic Polynucleotide
taatacgactcactatagggatctgcatctcctttgacgggcgtttgttcaacagaggagagaacaaatgcccgtcaaaaacctggcggcagcgcaaaagatg

SEQ ID NO: 177961 - DNA, 103 bp, Artificial Sequence
  Synthetic Polynucleotide
taatacgactcactatagggggaaatggtgatctgcatctcctttgacggaacagaggagaccgtcaatggagatgcagaacctggcggcagcgcaaaagatg

SEQ ID NO: 177962 - DNA, 103 bp, Artificial Sequence
  Synthetic Polynucleotide
taatacgactcactatagggccagctgctgggaaatggtgatctgcatctaacagaggagaagatgcatgtcaccatttaacctggcggcagcgcaaaagatg

SEQ ID NO: 177963 - DNA, 103 bp, Artificial Sequence
  Synthetic Polynucleotide
taatacgactcactatagggagctccaggcccagctgctgggaaatggtgaacagaggagacaccatatgccagcagctaacctggcggcagcgcaaaagatg

SEQ ID NO: 177964 - DNA, 103 bp, Artificial Sequence
  Synthetic Polynucleotide
taatacgactcactataggggacggttgtgagctccaggcccagctgctgaacagaggagacagcagatgggcctggagaacctggcggcagcgcaaaagatg

SEQ ID NO: 177965 - DNA, 103 bp, Artificial Sequence
  Synthetic Polynucleotide
taatacgactcactatagggccccgccgccgcccccgccgcccccgccgcaacagaggagagcggcgatggcggcggggaacctggcggcagcgcaaaagatg

SEQ ID NO: 177966 - DNA, 103 bp, Artificial Sequence
  Synthetic Polynucleotide
taatacgactcactatagggagaagttgctgacggttgtgagctccaggcaacagaggagagcctggatgtcacaaccgaacctggcggcagcgcaaaagatg

SEQ ID NO: 177967 - DNA, 103 bp, Artificial Sequence
  Synthetic Polynucleotide
taatacgactcactataggggcgttcatgaagaagttgctgacggttgtgaacagaggagacacaacatgcagcaacttaacctggcggcagcgcaaaagatg

SEQ ID NO: 177968 - DNA, 103 bp, Artificial Sequence
  Synthetic Polynucleotide
taatacgactcactataggggcggcgccgggcgttcatgaagaagttgctaacagaggagaagcaacatgttcatgaacaacctggcggcagcgcaaaagatg

SEQ ID NO: 177969 - DNA, 103 bp, Artificial Sequence
  Synthetic Polynucleotide
taatacgactcactatagggtctccaggctgcggcgccgggcgttcatgaaacagaggagatcatgaatgcccggcgccaacctggcggcagcgcaaaagatg

SEQ ID NO: 177970 - DNA, 103 bp, Artificial Sequence
  Synthetic Polynucleotide
taatacgactcactatagggtcttgccacttctccaggctgcggcgccggaacagaggagaccggcgatgcagcctggaaacctggcggcagcgcaaaagatg

SEQ ID NO: 177971 - DNA, 103 bp, Artificial Sequence
  Synthetic Polynucleotide
taatacgactcactataggggctcagatcgtcttgccacttctccaggctaacagaggagaagcctgatgaagtggcaaaacctggcggcagcgcaaaagatg

SEQ ID NO: 177972 - DNA, 103 bp, Artificial Sequence
  Synthetic Polynucleotide
taatacgactcactatagggagccccctgtgctcagatcgtcttgccactaacagaggagaagtggcatgacgatctgaaacctggcggcagcgcaaaagatg

SEQ ID NO: 177973 - DNA, 103 bp, Artificial Sequence
  Synthetic Polynucleotide
taatacgactcactataggggtggacgaggagccccctgtgctcagatcgaacagaggagacgatctatgcacagggggaacctggcggcagcgcaaaagatg

SEQ ID NO: 177974 - DNA, 103 bp, Artificial Sequence
  Synthetic Polynucleotide
taatacgactcactatagggcgtgctggaggtggacgaggagccccctgtaacagaggagaacagggatgtcctcgtccaacctggcggcagcgcaaaagatg

SEQ ID NO: 177975 - DNA, 103 bp, Artificial Sequence
  Synthetic Polynucleotide
taatacgactcactatagggctttggtacacgtgctggaggtggacgaggaacagaggagacctcgtatgcctccagcaaacctggcggcagcgcaaaagatg

SEQ ID NO: 177976 - DNA, 103 bp, Artificial Sequence
  Synthetic Polynucleotide
taatacgactcactatagggtggcccgggcccccgccgccgcccccgccgaacagaggagacggcggatgcggcggcggaacctggcggcagcgcaaaagatg

SEQ ID NO: 177977 - DNA, 103 bp, Artificial Sequence
  Synthetic Polynucleotide
taatacgactcactatagggctcctgctcatggcccgggcccccgccgccaacagaggagaggcggcatgggcccgggcaacctggcggcagcgcaaaagatg

SEQ ID NO: 177978 - DNA, 103 bp, Artificial Sequence
  Synthetic Polynucleotide
taatacgactcactatagggtggccagcagctcctgctcatggcccgggcaacagaggagagcccggatgatgagcaggaacctggcggcagcgcaaaagatg

SEQ ID NO: 177979 - DNA, 103 bp, Artificial Sequence
  Synthetic Polynucleotide
taatacgactcactataggggggctggggctggccagcagctcctgctcaaacagaggagatgagcaatggctgctggcaacctggcggcagcgcaaaagatg

SEQ ID NO: 177980 - DNA, 103 bp, Artificial Sequence
  Synthetic Polynucleotide
taatacgactcactatagggcgcgtggtgggggctggggctggccagcagaacagaggagactgctgatgagccccagcaacctggcggcagcgcaaaagatg

SEQ ID NO: 177981 - DNA, 103 bp, Artificial Sequence
  Synthetic Polynucleotide
taatacgactcactatagggctttggtgaggcatcgataggcggtgtaggaacagaggagacctacaatgcctatcgataacctggcggcagcgcaaaagatg

SEQ ID NO: 177982 - DNA, 103 bp, Artificial Sequence
  Synthetic Polynucleotide
taatacgactcactatagggcgccgcggcccgcgtggtgggggctggggcaacagaggagagccccaatgcccaccacgaacctggcggcagcgcaaaagatg

SEQ ID NO: 177983 - DNA, 103 bp, Artificial Sequence
  Synthetic Polynucleotide
taatacgactcactataggggagccagcggcgccgcggcccgcgtggtggaacagaggagaccaccaatggggccgcggaacctggcggcagcgcaaaagatg

SEQ ID NO: 177984 - DNA, 103 bp, Artificial Sequence
  Synthetic Polynucleotide
taatacgactcactataggggccccgcagcgagccagcggcgccgcggccaacagaggagaggccgcatggccgctggcaacctggcggcagcgcaaaagatg

SEQ ID NO: 177985 - DNA, 103 bp, Artificial Sequence
  Synthetic Polynucleotide
taatacgactcactataggggcggcggagggccccgcagcgagccagcggaacagaggagaccgctgatgcgctgcgggaacctggcggcagcgcaaaagatg

SEQ ID NO: 177986 - DNA, 103 bp, Artificial Sequence
  Synthetic Polynucleotide
taatacgactcactataggggcggttggaggcggcggagggccccgcagcaacagaggagagctgcgatgccctccgccaacctggcggcagcgcaaaagatg

SEQ ID NO: 177987 - DNA, 103 bp, Artificial Sequence
  Synthetic Polynucleotide
taatacgactcactatagggctcctggtgcgcggttggaggcggcggaggaacagaggagacctccgatgcctccaaccaacctggcggcagcgcaaaagatg

SEQ ID NO: 177988 - DNA, 103 bp, Artificial Sequence
  Synthetic Polynucleotide
taatacgactcactatagggccgtgcccagctcctggtgcgcggttggagaacagaggagactccaaatgcgcaccaggaacctggcggcagcgcaaaagatg

SEQ ID NO: 177989 - DNA, 103 bp, Artificial Sequence
  Synthetic Polynucleotide
taatacgactcactataggggccgctgccgccgtgcccagctcctggtgcaacagaggagagcaccaatggctgggcacaacctggcggcagcgcaaaagatg

SEQ ID NO: 177990 - DNA, 103 bp, Artificial Sequence
  Synthetic Polynucleotide
taatacgactcactatagggcgccgctgccgccgctgccgccgtgcccagaacagaggagactgggcatggcggcagcgaacctggcggcagcgcaaaagatg

SEQ ID NO: 177991 - DNA, 103 bp, Artificial Sequence
  Synthetic Polynucleotide
taatacgactcactatagggagcgcgacgccgccgctgccgccgctgccgaacagaggagacggcagatgcggcagcggaacctggcggcagcgcaaaagatg

SEQ ID NO: 177992 - DNA, 103 bp, Artificial Sequence
  Synthetic Polynucleotide
taatacgactcactatagggccttctaggtctttggtgaggcatcgatagaacagaggagactatcgatgcctcaccaaaacctggcggcagcgcaaaagatg

SEQ ID NO: 177993 - DNA, 103 bp, Artificial Sequence
  Synthetic Polynucleotide
taatacgactcactatagggaccatggccgagcgcgacgccgccgctgccaacagaggagaggcagcatgggcgtcgcgaacctggcggcagcgcaaaagatg

SEQ ID NO: 177994 - DNA, 103 bp, Artificial Sequence
  Synthetic Polynucleotide
taatacgactcactatagggcatgctggtgaccatggccgagcgcgacgcaacagaggagagcgtcgatgtcggccatgaacctggcggcagcgcaaaagatg

SEQ ID NO: 177995 - DNA, 103 bp, Artificial Sequence
  Synthetic Polynucleotide
taatacgactcactatagggggatcgaggccatgctggtgaccatggccgaacagaggagacggccaatgtcaccagcaaacctggcggcagcgcaaaagatg

SEQ ID NO: 177996 - DNA, 103 bp, Artificial Sequence
  Synthetic Polynucleotide
taatacgactcactatagggccgccgtccaggatcgaggccatgctggtgaacagaggagacaccagatgggcctcgataacctggcggcagcgcaaaagatg

SEQ ID NO: 177997 - DNA, 103 bp, Artificial Sequence
  Synthetic Polynucleotide
taatacgactcactatagggccggtagtcgccgccgtccaggatcgaggcaacagaggagagcctcgatgctggacggcaacctggcggcagcgcaaaagatg

SEQ ID NO: 177998 - DNA, 103 bp, Artificial Sequence
  Synthetic Polynucleotide
taatacgactcactatagggagagctcgggccggtagtcgccgccgtccaaacagaggagatggacgatggcgactaccaacctggcggcagcgcaaaagatg

SEQ ID NO: 177999 - DNA, 103 bp, Artificial Sequence
  Synthetic Polynucleotide
taatacgactcactatagggagcgggatggagagctcgggccggtagtcgaacagaggagacgactaatggcccgagctaacctggcggcagcgcaaaagatg

SEQ ID NO: 178000 - DNA, 103 bp, Artificial Sequence
  Synthetic Polynucleotide
taatacgactcactatagggggcgtggtgcagcgggatggagagctcgggaacagaggagacccgagatgtccatcccgaacctggcggcagcgcaaaagatg

SEQ ID NO: 178001 - DNA, 103 bp, Artificial Sequence
  Synthetic Polynucleotide
taatacgactcactatagggacatgctcatggcgtggtgcagcgggatggaacagaggagaccatccatgtgcaccacgaacctggcggcagcgcaaaagatg

SEQ ID NO: 178002 - DNA, 103 bp, Artificial Sequence
  Synthetic Polynucleotide
taatacgactcactataggggagtcgcaggacatgctcatggcgtggtgcaacagaggagagcaccaatgcatgagcataacctggcggcagcgcaaaagatg

SEQ ID NO: 178003 - DNA, 103 bp, Artificial Sequence
  Synthetic Polynucleotide
taatacgactcactatagggcatggcgcagccttctaggtctttggtgagaacagaggagactcaccatggacctagaaaacctggcggcagcgcaaaagatg

SEQ ID NO: 178004 - DNA, 103 bp, Artificial Sequence
  Synthetic Polynucleotide
taatacgactcactatagggaggcggagacgagtcgcaggacatgctcataacagaggagaatgagcatgtcctgcgacaacctggcggcagcgcaaaagatg

SEQ ID NO: 178005 - DNA, 103 bp, Artificial Sequence
  Synthetic Polynucleotide
taatacgactcactatagggtgcccatgccaggcggagacgagtcgcaggaacagaggagacctgcgatgcgtctccgcaacctggcggcagcgcaaaagatg

SEQ ID NO: 178006 - DNA, 103 bp, Artificial Sequence
  Synthetic Polynucleotide
taatacgactcactataggggtgttgctcatgcccatgccaggcggagacaacagaggagagtctccatgtggcatgggaacctggcggcagcgcaaaagatg

SEQ ID NO: 178007 - DNA, 103 bp, Artificial Sequence
  Synthetic Polynucleotide
taatacgactcactatagggcgtggtgtaggtgttgctcatgcccatgccaacagaggagaggcatgatgatgagcaacaacctggcggcagcgcaaaagatg

SEQ ID NO: 178008 - DNA, 103 bp, Artificial Sequence
  Synthetic Polynucleotide
taatacgactcactataggggcggtgtcagcgtggtgtaggtgttgctcaaacagaggagatgagcaatgcctacaccaaacctggcggcagcgcaaaagatg

SEQ ID NO: 178009 - DNA, 103 bp, Artificial Sequence
  Synthetic Polynucleotide
taatacgactcactatagggagcggctggagcggtgtcagcgtggtgtagaacagaggagactacacatggctgacaccaacctggcggcagcgcaaaagatg

SEQ ID NO: 178010 - DNA, 103 bp, Artificial Sequence
  Synthetic Polynucleotide
taatacgactcactataggggatgggtggcagcggctggagcggtgtcagaacagaggagactgacaatgctccagccgaacctggcggcagcgcaaaagatg

SEQ ID NO: 178011 - DNA, 103 bp, Artificial Sequence
  Synthetic Polynucleotide
taatacgactcactatagggacacggtggagatgggtggcagcggctggaaacagaggagatccagcatgtgccacccaaacctggcggcagcgcaaaagatg

SEQ ID NO: 178012 - DNA, 103 bp, Artificial Sequence
  Synthetic Polynucleotide
taatacgactcactatagggaacttgtcagacacggtggagatgggtggcaacagaggagagccaccatgctccaccgtaacctggcggcagcgcaaaagatg

SEQ ID NO: 178013 - DNA, 103 bp, Artificial Sequence
  Synthetic Polynucleotide
taatacgactcactatagggagggtggtggaacttgtcagacacggtggaaacagaggagatccaccatgtctgacaagaacctggcggcagcgcaaaagatg

SEQ ID NO: 178014 - DNA, 103 bp, Artificial Sequence
  Synthetic Polynucleotide
taatacgactcactataggggctccgggttcatggcgcagccttctaggtaacagaggagaacctagatggctgcgccaaacctggcggcagcgcaaaagatg

SEQ ID NO: 178015 - DNA, 103 bp, Artificial Sequence
  Synthetic Polynucleotide
taatacgactcactatagggggtgcgggtgagggtggtggaacttgtcagaacagaggagactgacaatgtccaccaccaacctggcggcagcgcaaaagatg

SEQ ID NO: 178016 - DNA, 103 bp, Artificial Sequence
  Synthetic Polynucleotide
taatacgactcactatagggtgcggatggtggtgcgggtgagggtggtggaacagaggagaccaccaatgtcacccgcaaacctggcggcagcgcaaaagatg

SEQ ID NO: 178017 - DNA, 103 bp, Artificial Sequence
  Synthetic Polynucleotide
taatacgactcactataggggtggtggtggtgcggatggtggtgcgggtgaacagaggagacacccgatgcaccatccgaacctggcggcagcgcaaaagatg

SEQ ID NO: 178018 - DNA, 103 bp, Artificial Sequence
  Synthetic Polynucleotide
taatacgactcactatagggggtggtggtggtggtggtggtgcggatggtaacagaggagaaccatcatgaccaccaccaacctggcggcagcgcaaaagatg

SEQ ID NO: 178019 - DNA, 103 bp, Artificial Sequence
  Synthetic Polynucleotide
taatacgactcactatagggaggcgctggtggtggtggtggtggtggtggaacagaggagaccaccaatgccaccaccaaacctggcggcagcgcaaaagatg

SEQ ID NO: 178020 - DNA, 103 bp, Artificial Sequence
  Synthetic Polynucleotide
taatacgactcactataggggttgccggacaggcgctggtggtggtggtgaacagaggagacaccacatgcaccagcgcaacctggcggcagcgcaaaagatg

SEQ ID NO: 178021 - DNA, 103 bp, Artificial Sequence
  Synthetic Polynucleotide
taatacgactcactatagggtgccgctgacgttgccggacaggcgctggtaacagaggagaaccagcatgtgtccggcaaacctggcggcagcgcaaaagatg

SEQ ID NO: 178022 - DNA, 103 bp, Artificial Sequence
  Synthetic Polynucleotide
taatacgactcactatagggagggtgaagctgccgctgacgttgccggacaacagaggagagtccggatgcgtcagcggaacctggcggcagcgcaaaagatg

SEQ ID NO: 178023 - DNA, 103 bp, Artificial Sequence
  Synthetic Polynucleotide
taatacgactcactataggggtcgcgcatgagggtgaagctgccgctgacaacagaggagagtcagcatgagcttcaccaacctggcggcagcgcaaaagatg

SEQ ID NO: 178024 - DNA, 103 bp, Artificial Sequence
  Synthetic Polynucleotide
taatacgactcactataggggcccgcgctcgtcgcgcatgagggtgaagcaacagaggagagcttcaatgtcatgcgcgaacctggcggcagcgcaaaagatg

SEQ ID NO: 178025 - DNA, 103 bp, Artificial Sequence
  Synthetic Polynucleotide
taatacgactcactatagggtccattgtcagctccgggttcatggcgcagaacagaggagactgcgcatggaacccggaaacctggcggcagcgcaaaagatg

SEQ ID NO: 178026 - DNA, 103 bp, Artificial Sequence
  Synthetic Polynucleotide
taatacgactcactatagggatggccgggagcccgcgctcgtcgcgcatgaacagaggagacatgcgatgcgagcgcggaacctggcggcagcgcaaaagatg

SEQ ID NO: 178027 - DNA, 103 bp, Artificial Sequence
  Synthetic Polynucleotide
taatacgactcactataggggaggttgttcatggccgggagcccgcgctcaacagaggagagagcgcatgctcccggccaacctggcggcagcgcaaaagatg

SEQ ID NO: 178028 - DNA, 103 bp, Artificial Sequence
  Synthetic Polynucleotide
taatacgactcactatagggagggactgtagaggttgttcatggccgggaaacagaggagatcccggatgtgaacaaccaacctggcggcagcgcaaaagatg

SEQ ID NO: 178029 - DNA, 103 bp, Artificial Sequence
  Synthetic Polynucleotide
taatacgactcactatagggatctccttgtagggactgtagaggttgttcaacagaggagagaacaaatgctacagtccaacctggcggcagcgcaaaagatg

SEQ ID NO: 178030 - DNA, 103 bp, Artificial Sequence
  Synthetic Polynucleotide
taatacgactcactatagggcatgccgggcatctccttgtagggactgtaaacagaggagatacagtatgtacaaggagaacctggcggcagcgcaaaagatg

SEQ ID NO: 178031 - DNA, 103 bp, Artificial Sequence
  Synthetic Polynucleotide
taatacgactcactatagggggctctggctcatgccgggcatctccttgtaacagaggagaacaaggatgtgcccggcaaacctggcggcagcgcaaaagatg

SEQ ID NO: 178032 - DNA, 103 bp, Artificial Sequence
  Synthetic Polynucleotide
taatacgactcactatagggagcggggacaggctctggctcatgccgggcaacagaggagagcccggatggagccagagaacctggcggcagcgcaaaagatg

SEQ ID NO: 178033 - DNA, 103 bp, Artificial Sequence
  Synthetic Polynucleotide
taatacgactcactatagggcgtggcggccagcggggacaggctctggctaacagaggagaagccagatgctgtccccgaacctggcggcagcgcaaaagatg

SEQ ID NO: 178034 - DNA, 103 bp, Artificial Sequence
  Synthetic Polynucleotide
taatacgactcactatagggtgcccagcggcgtggcggccagcggggacaaacagaggagatgtcccatgtggccgccaaacctggcggcagcgcaaaagatg

SEQ ID NO: 178035 - DNA, 103 bp, Artificial Sequence
  Synthetic Polynucleotide
taatacgactcactatagggcctagcccgttgcccagcggcgtggcggccaacagaggagaggccgcatggccgctgggaacctggcggcagcgcaaaagatg

SEQ ID NO: 178036 - DNA, 103 bp, Artificial Sequence
  Synthetic Polynucleotide
taatacgactcactataggggcccagactttccattgtcagctccgggttaacagaggagaaacccgatgctgacaatgaacctggcggcagcgcaaaagatg

SEQ ID NO: 178037 - DNA, 103 bp, Artificial Sequence
  Synthetic Polynucleotide
taatacgactcactataggggtggaggccgcctagcccgttgcccagcggaacagaggagaccgctgatgaacgggctaaacctggcggcagcgcaaaagatg

SEQ ID NO: 178038 - DNA, 103 bp, Artificial Sequence
  Synthetic Polynucleotide
taatacgactcactataggggctgcgcgttgtggaggccgcctagcccgtaacagaggagaacgggcatggcggcctccaacctggcggcagcgcaaaagatg

SEQ ID NO: 178039 - DNA, 103 bp, Artificial Sequence
  Synthetic Polynucleotide
taatacgactcactatagggggcagactctgctgcgcgttgtggaggccgaacagaggagacggcctatgcaacgcgcaaacctggcggcagcgcaaaagatg

SEQ ID NO: 178040 - DNA, 103 bp, Artificial Sequence
  Synthetic Polynucleotide
taatacgactcactatagggaccgtagttgggcagactctgctgcgcgttaacagaggagaaacgcgatgcagagtctgaacctggcggcagcgcaaaagatg

SEQ ID NO: 178041 - DNA, 103 bp, Artificial Sequence
  Synthetic Polynucleotide
taatacgactcactatagggggcccggcggaccgtagttgggcagactctaacagaggagaagagtcatgccaactacgaacctggcggcagcgcaaaagatg

SEQ ID NO: 178042 - DNA, 103 bp, Artificial Sequence
  Synthetic Polynucleotide
taatacgactcactatagggattttgtcgtggcccggcggaccgtagttgaacagaggagacaactaatgtccgccgggaacctggcggcagcgcaaaagatg

SEQ ID NO: 178043 - DNA, 103 bp, Artificial Sequence
  Synthetic Polynucleotide
taatacgactcactatagggggggctgagcattttgtcgtggcccggcggaacagaggagaccgccgatgcacgacaaaaacctggcggcagcgcaaaagatg

SEQ ID NO: 178044 - DNA, 103 bp, Artificial Sequence
  Synthetic Polynucleotide
taatacgactcactatagggcgtcgaagttggggctgagcattttgtcgtaacagaggagaacgacaatgtgctcagccaacctggcggcagcgcaaaagatg

SEQ ID NO: 178045 - DNA, 103 bp, Artificial Sequence
  Synthetic Polynucleotide
taatacgactcactataggggtgtggtgcgcgtcgaagttggggctgagcaacagaggagagctcagatgcaacttcgaaacctggcggcagcgcaaaagatg

SEQ ID NO: 178046 - DNA, 103 bp, Artificial Sequence
  Synthetic Polynucleotide
taatacgactcactatagggcagcatggcagtgtggtgcgcgtcgaagttaacagaggagaaacttcatggcgcaccacaacctggcggcagcgcaaaagatg

SEQ ID NO: 178047 - DNA, 103 bp, Artificial Sequence
  Synthetic Polynucleotide
taatacgactcactatagggcgtgcaaagtgcccagactttccattgtcaaacagaggagatgacaaatgaaagtctggaacctggcggcagcgcaaaagatg

SEQ ID NO: 178048 - DNA, 103 bp, Artificial Sequence
  Synthetic Polynucleotide
taatacgactcactatagggcaccgcgggtcagcatggcagtgtggtgcgaacagaggagacgcaccatgctgccatgcaacctggcggcagcgcaaaagatg

SEQ ID NO: 178049 - DNA, 103 bp, Artificial Sequence
  Synthetic Polynucleotide
taatacgactcactatagggaggtgttgctcaccgcgggtcagcatggcaaacagaggagatgccatatggacccgcggaacctggcggcagcgcaaaagatg

SEQ ID NO: 178050 - DNA, 103 bp, Artificial Sequence
  Synthetic Polynucleotide
taatacgactcactataggggccgcgggacaggtgttgctcaccgcgggtaacagaggagaacccgcatggagcaacacaacctggcggcagcgcaaaagatg

SEQ ID NO: 178051 - DNA, 103 bp, Artificial Sequence
  Synthetic Polynucleotide
taatacgactcactataggggggtgcccaggccgcgggacaggtgttgctaacagaggagaagcaacatgtgtcccgcgaacctggcggcagcgcaaaagatg

SEQ ID NO: 178052 - DNA, 103 bp, Artificial Sequence
  Synthetic Polynucleotide
taatacgactcactataggggccgcaggtggggtgcccaggccgcgggacaacagaggagagtcccgatgcctgggcacaacctggcggcagcgcaaaagatg

SEQ ID NO: 178053 - DNA, 103 bp, Artificial Sequence
  Synthetic Polynucleotide
taatacgactcactatagggcgacatcatggccgcaggtggggtgcccagaacagaggagactgggcatgccacctgcgaacctggcggcagcgcaaaagatg

SEQ ID NO: 178054 - DNA, 103 bp, Artificial Sequence
  Synthetic Polynucleotide
taatacgactcactatagggcgttcaggtgcgacatcatggccgcaggtgaacagaggagacacctgatgccatgatgtaacctggcggcagcgcaaaagatg

SEQ ID NO: 178055 - DNA, 103 bp, Artificial Sequence
  Synthetic Polynucleotide
taatacgactcactatagggtggtgcaggccgttcaggtgcgacatcatgaacagaggagacatgatatggcacctgaaaacctggcggcagcgcaaaagatg

SEQ ID NO: 178056 - DNA, 103 bp, Artificial Sequence
  Synthetic Polynucleotide
taatacgactcactataggggtggcccgggtggtgcaggccgttcaggtgaacagaggagacacctgatgggcctgcacaacctggcggcagcgcaaaagatg

SEQ ID NO: 178057 - DNA, 103 bp, Artificial Sequence
  Synthetic Polynucleotide
taatacgactcactataggggagactgagtgtggcccgggtggtgcaggcaacagaggagagcctgcatgacccgggccaacctggcggcagcgcaaaagatg

SEQ ID NO: 178058 - DNA, 103 bp, Artificial Sequence
  Synthetic Polynucleotide
taatacgactcactatagggccggccggcccgtgcaaagtgcccagacttaacagaggagaaagtctatgcactttgcaaacctggcggcagcgcaaaagatg

SEQ ID NO: 178059 - DNA, 103 bp, Artificial Sequence
  Synthetic Polynucleotide
taatacgactcactatagggaccggcccgtgagactgagtgtggcccgggaacagaggagacccgggatgcactcagtcaacctggcggcagcgcaaaagatg

SEQ ID NO: 178060 - DNA, 103 bp, Artificial Sequence
  Synthetic Polynucleotide
taatacgactcactataggggggtgccagcaccggcccgtgagactgagtaacagaggagaactcagatgcacgggccgaacctggcggcagcgcaaaagatg

SEQ ID NO: 178061 - DNA, 103 bp, Artificial Sequence
  Synthetic Polynucleotide
taatacgactcactataggggctcgcgactgggtgccagcaccggcccgtaacagaggagaacgggcatgtgctggcacaacctggcggcagcgcaaaagatg

SEQ ID NO: 178062 - DNA, 103 bp, Artificial Sequence
  Synthetic Polynucleotide
taatacgactcactataggggagggtggccgctcgcgactgggtgccagcaacagaggagagctggcatgcagtcgcgaaacctggcggcagcgcaaaagatg

SEQ ID NO: 178063 - DNA, 103 bp, Artificial Sequence
  Synthetic Polynucleotide
taatacgactcactatagggcgatgaggacgagggtggccgctcgcgactaacagaggagaagtcgcatgcggccacccaacctggcggcagcgcaaaagatg

SEQ ID NO: 178064 - DNA, 103 bp, Artificial Sequence
  Synthetic Polynucleotide
taatacgactcactatagggcctgcgagcccgatgaggacgagggtggccaacagaggagaggccacatgcgtcctcataacctggcggcagcgcaaaagatg

SEQ ID NO: 178065 - DNA, 103 bp, Artificial Sequence
  Synthetic Polynucleotide
taatacgactcactataggggacgtggccacctgcgagcccgatgaggacaacagaggagagtcctcatggggctcgcaaacctggcggcagcgcaaaagatg

SEQ ID NO: 178066 - DNA, 103 bp, Artificial Sequence
  Synthetic Polynucleotide
taatacgactcactatagggcagctggcccgacgtggccacctgcgagccaacagaggagaggctcgatggtggccacgaacctggcggcagcgcaaaagatg

SEQ ID NO: 178067 - DNA, 103 bp, Artificial Sequence
  Synthetic Polynucleotide
taatacgactcactatagggtgatttcttccagctggcccgacgtggccaaacagaggagatggccaatgcgggccagcaacctggcggcagcgcaaaagatg

SEQ ID NO: 178068 - DNA, 103 bp, Artificial Sequence
  Synthetic Polynucleotide
taatacgactcactatagggtctttggtgttgatttcttccagctggcccaacagaggagagggccaatgggaagaaataacctggcggcagcgcaaaagatg

SEQ ID NO: 178069 - DNA, 103 bp, Artificial Sequence
  Synthetic Polynucleotide
taatacgactcactataggggccccccaggctctccaggctcagctccataacagaggagaatggagatgagcctggagaacctggcggcagcgcaaaagatg

SEQ ID NO: 178070 - DNA, 103 bp, Artificial Sequence
  Synthetic Polynucleotide
taatacgactcactatagggcgccaccaggccgcggtgctgcgccgccgcaacagaggagagcggcgatgcagcaccgcaacctggcggcagcgcaaaagatg

SEQ ID NO: 178071 - DNA, 103 bp, Artificial Sequence
  Synthetic Polynucleotide
taatacgactcactatagggcgggatgctgtagcgcttcagctccgccgtaacagaggagaacggcgatgctgaagcgcaacctggcggcagcgcaaaagatg

SEQ ID NO: 178072 - DNA, 103 bp, Artificial Sequence
  Synthetic Polynucleotide
taatacgactcactatagggagattgcctgcgggatgctgtagcgcttcaaacagaggagatgaagcatgacagcatccaacctggcggcagcgcaaaagatg

SEQ ID NO: 178073 - DNA, 103 bp, Artificial Sequence
  Synthetic Polynucleotide
taatacgactcactatagggcgctgcgcgaagattgcctgcgggatgctgaacagaggagacagcatatggcaggcaataacctggcggcagcgcaaaagatg

SEQ ID NO: 178074 - DNA, 103 bp, Artificial Sequence
  Synthetic Polynucleotide
taatacgactcactatagggacacaggatccgctgcgcgaagattgcctgaacagaggagacaggcaatgttcgcgcagaacctggcggcagcgcaaaagatg

SEQ ID NO: 178075 - DNA, 103 bp, Artificial Sequence
  Synthetic Polynucleotide
taatacgactcactatagggcctgagagcgacacaggatccgctgcgcgaaacagaggagatcgcgcatgggatcctgtaacctggcggcagcgcaaaagatg

SEQ ID NO: 178076 - DNA, 103 bp, Artificial Sequence
  Synthetic Polynucleotide
taatacgactcactataggggagagcgtgccctgagagcgacacaggatcaacagaggagagatcctatgtcgctctcaaacctggcggcagcgcaaaagatg

SEQ ID NO: 178077 - DNA, 103 bp, Artificial Sequence
  Synthetic Polynucleotide
taatacgactcactatagggcagcaggtcggagagcgtgccctgagagcgaacagaggagacgctctatgggcacgctcaacctggcggcagcgcaaaagatg

SEQ ID NO: 178078 - DNA, 103 bp, Artificial Sequence
  Synthetic Polynucleotide
taatacgactcactatagggtggggttgcgcagcaggtcggagagcgtgcaacagaggagagcacgcatgccgacctgcaacctggcggcagcgcaaaagatg

SEQ ID NO: 178079 - DNA, 103 bp, Artificial Sequence
  Synthetic Polynucleotide
taatacgactcactatagggctccacggcttggggttgcgcagcaggtcgaacagaggagacgacctatggcgcaacccaacctggcggcagcgcaaaagatg

SEQ ID NO: 178080 - DNA, 103 bp, Artificial Sequence
  Synthetic Polynucleotide
taatacgactcactatagggtttgagcttgctccacggcttggggttgcgaacagaggagacgcaacatgaagccgtggaacctggcggcagcgcaaaagatg

SEQ ID NO: 178081 - DNA, 103 bp, Artificial Sequence
  Synthetic Polynucleotide
taatacgactcactatagggggcgcccgggcgccaccaggccgcggtgctaacagaggagaagcaccatggcctggtggaacctggcggcagcgcaaaagatg

SEQ ID NO: 178082 - DNA, 103 bp, Artificial Sequence
  Synthetic Polynucleotide
taatacgactcactatagggcgcggccggatttgagcttgctccacggctaacagaggagaagccgtatggcaagctcaaacctggcggcagcgcaaaagatg

SEQ ID NO: 178083 - DNA, 103 bp, Artificial Sequence
  Synthetic Polynucleotide
taatacgactcactatagggcggaaggtctcgcggccggatttgagcttgaacagaggagacaagctatgatccggccgaacctggcggcagcgcaaaagatg

SEQ ID NO: 178084 - DNA, 103 bp, Artificial Sequence
  Synthetic Polynucleotide
taatacgactcactatagggccacatcctgcggaaggtctcgcggccggaaacagaggagatccggcatggagaccttcaacctggcggcagcgcaaaagatg

SEQ ID NO: 178085 - DNA, 103 bp, Artificial Sequence
  Synthetic Polynucleotide
taatacgactcactataggggcagccacttccacatcctgcggaaggtctaacagaggagaagacctatggcaggatgtaacctggcggcagcgcaaaagatg

SEQ ID NO: 178086 - DNA, 103 bp, Artificial Sequence
  Synthetic Polynucleotide
taatacgactcactatagggtctggctcctgcagccacttccacatcctgaacagaggagacaggatatggaagtggctaacctggcggcagcgcaaaagatg

SEQ ID NO: 178087 - DNA, 103 bp, Artificial Sequence
  Synthetic Polynucleotide
taatacgactcactataggggcgctggaactctggctcctgcagccacttaacagaggagaaagtggatgcaggagccaaacctggcggcagcgcaaaagatg

SEQ ID NO: 178088 - DNA, 103 bp, Artificial Sequence
  Synthetic Polynucleotide
taatacgactcactataggggcgccgacatgcgctggaactctggctcctaacagaggagaaggagcatgagttccagcaacctggcggcagcgcaaaagatg

SEQ ID NO: 178089 - DNA, 103 bp, Artificial Sequence
  Synthetic Polynucleotide
taatacgactcactataggggccaagcgcagcgccgacatgcgctggaacaacagaggagagttccaatgcatgtcggcaacctggcggcagcgcaaaagatg

SEQ ID NO: 178090 - DNA, 103 bp, Artificial Sequence
  Synthetic Polynucleotide
taatacgactcactatagggcttgcaggctgccaagcgcagcgccgacataacagaggagaatgtcgatgctgcgcttgaacctggcggcagcgcaaaagatg

SEQ ID NO: 178091 - DNA, 103 bp, Artificial Sequence
  Synthetic Polynucleotide
taatacgactcactataggggttccttgcgcttgcaggctgccaagcgcaaacagaggagatgcgctatgcagcctgcaaacctggcggcagcgcaaaagatg

SEQ ID NO: 178092 - DNA, 103 bp, Artificial Sequence
  Synthetic Polynucleotide
taatacgactcactatagggaccaggcccgggcgcccgggcgccaccaggaacagaggagacctggtatggcccgggcgaacctggcggcagcgcaaaagatg

SEQ ID NO: 178093 - DNA, 103 bp, Artificial Sequence
  Synthetic Polynucleotide
taatacgactcactatagggtgctgctcctgttccttgcgcttgcaggctaacagaggagaagcctgatggcgcaaggaaacctggcggcagcgcaaaagatg

SEQ ID NO: 178094 - DNA, 103 bp, Artificial Sequence
  Synthetic Polynucleotide
taatacgactcactataggggcgctccttctgctgctcctgttccttgcgaacagaggagacgcaagatgcaggagcagaacctggcggcagcgcaaaagatg

SEQ ID NO: 178095 - DNA, 103 bp, Artificial Sequence
  Synthetic Polynucleotide
taatacgactcactataggggctgcagggcgcgctccttctgctgctcctaacagaggagaaggagcatgagaaggagcaacctggcggcagcgcaaaagatg

SEQ ID NO: 178096 - DNA, 103 bp, Artificial Sequence
  Synthetic Polynucleotide
taatacgactcactatagggtgcttcttgggctgcagggcgcgctccttcaacagaggagagaaggaatgcgccctgcaaacctggcggcagcgcaaaagatg

SEQ ID NO: 178097 - DNA, 103 bp, Artificial Sequence
  Synthetic Polynucleotide
taatacgactcactatagggcaccaggcgctgcttcttgggctgcagggcaacagaggagagccctgatgcccaagaagaacctggcggcagcgcaaaagatg

SEQ ID NO: 178098 - DNA, 103 bp, Artificial Sequence
  Synthetic Polynucleotide
taatacgactcactatagggggtcggtgaacaccaggcgctgcttcttggaacagaggagaccaagaatgagcgcctggaacctggcggcagcgcaaaagatg

SEQ ID NO: 178099 - DNA, 103 bp, Artificial Sequence
  Synthetic Polynucleotide
taatacgactcactatagggcgtcgctgcaggtcggtgaacaccaggcgcaacagaggagagcgcctatggttcaccgaaacctggcggcagcgcaaaagatg

SEQ ID NO: 178100 - DNA, 103 bp, Artificial Sequence
  Synthetic Polynucleotide
taatacgactcactataggggatcagcgtgcgtcgctgcaggtcggtgaaaacagaggagattcaccatgctgcagcgaaacctggcggcagcgcaaaagatg

SEQ ID NO: 178101 - DNA, 103 bp, Artificial Sequence
  Synthetic Polynucleotide
taatacgactcactatagggtgaagatggcgatcagcgtgcgtcgctgcaaacagaggagatgcagcatggcacgctgaaacctggcggcagcgcaaaagatg

SEQ ID NO: 178102 - DNA, 103 bp, Artificial Sequence
  Synthetic Polynucleotide
taatacgactcactatagggttgttctccttgaagatggcgatcagcgtgaacagaggagacacgctatgcgccatcttaacctggcggcagcgcaaaagatg

SEQ ID NO: 178103 - DNA, 103 bp, Artificial Sequence
  Synthetic Polynucleotide
taatacgactcactatagggcatgccggccaccaggcccgggcgcccgggaacagaggagacccgggatgccgggcctgaacctggcggcagcgcaaaagatg

SEQ ID NO: 178104 - DNA, 103 bp, Artificial Sequence
  Synthetic Polynucleotide
taatacgactcactatagggggacggccgcttgttctccttgaagatggcaacagaggagagccatcatgaaggagaacaacctggcggcagcgcaaaagatg

SEQ ID NO: 178105 - DNA, 103 bp, Artificial Sequence
  Synthetic Polynucleotide
taatacgactcactataggggcatctccttggacggccgcttgttctcctaacagaggagaaggagaatgagcggccgtaacctggcggcagcgcaaaagatg

SEQ ID NO: 178106 - DNA, 103 bp, Artificial Sequence
  Synthetic Polynucleotide
taatacgactcactatagggatggtgacctgcatctccttggacggccgcaacagaggagagcggccatgcaaggagataacctggcggcagcgcaaaagatg

SEQ ID NO: 178107 - DNA, 103 bp, Artificial Sequence
  Synthetic Polynucleotide
taatacgactcactatagggctgctgcgagatggtgacctgcatctccttaacagaggagaaaggagatgcaggtcaccaacctggcggcagcgcaaaagatg

SEQ ID NO: 178108 - DNA, 103 bp, Artificial Sequence
  Synthetic Polynucleotide
taatacgactcactatagggccaagccgagctgctgcgagatggtgacctaacagaggagaaggtcaatgtctcgcagcaacctggcggcagcgcaaaagatg

SEQ ID NO: 178109 - DNA, 103 bp, Artificial Sequence
  Synthetic Polynucleotide
taatacgactcactataggggtgttgagctccaagccgagctgctgcgagaacagaggagactcgcaatggctcggcttaacctggcggcagcgcaaaagatg

SEQ ID NO: 178110 - DNA, 103 bp, Artificial Sequence
  Synthetic Polynucleotide
taatacgactcactataggggttgctgacggtgttgagctccaagccgagaacagaggagactcggcatggagctcaacaacctggcggcagcgcaaaagatg

SEQ ID NO: 178111 - DNA, 103 bp, Artificial Sequence
  Synthetic Polynucleotide
taatacgactcactatagggtcatgaagaagttgctgacggtgttgagctaacagaggagaagctcaatgccgtcagcaaacctggcggcagcgcaaaagatg

SEQ ID NO: 178112 - DNA, 103 bp, Artificial Sequence
  Synthetic Polynucleotide
taatacgactcactatagggcgccgcgcgttcatgaagaagttgctgacgaacagaggagacgtcagatgcttcttcataacctggcggcagcgcaaaagatg

SEQ ID NO: 178113 - DNA, 103 bp, Artificial Sequence
  Synthetic Polynucleotide
taatacgactcactatagggcatgcagcggcgccgcgcgttcatgaagaaaacagaggagattcttcatgaacgcgcggaacctggcggcagcgcaaaagatg

SEQ ID NO: 178114 - DNA, 103 bp, Artificial Sequence
  Synthetic Polynucleotide
taatacgactcactataggggcaggctcgccatgccggccaccaggcccgaacagaggagacgggccatgtggccggcaaacctggcggcagcgcaaaagatg

SEQ ID NO: 178115 - DNA, 103 bp, Artificial Sequence
  Synthetic Polynucleotide
taatacgactcactatagggcccagcggttcatgcagcggcgccgcgcgtaacagaggagaacgcgcatggccgctgcaaacctggcggcagcgcaaaagatg

SEQ ID NO: 178116 - DNA, 103 bp, Artificial Sequence
  Synthetic Polynucleotide
taatacgactcactatagggggctcctcagcccagcggttcatgcagcggaacagaggagaccgctgatggaaccgctgaacctggcggcagcgcaaaagatg

SEQ ID NO: 178117 - DNA, 103 bp, Artificial Sequence
  Synthetic Polynucleotide
taatacgactcactatagggggccgtgctgggctcctcagcccagcggttaacagaggagaaaccgcatggctgaggagaacctggcggcagcgcaaaagatg

SEQ ID NO: 178118 - DNA, 103 bp, Artificial Sequence
  Synthetic Polynucleotide
taatacgactcactatagggggcccccgggggccgtgctgggctcctcagaacagaggagactgaggatgccagcacggaacctggcggcagcgcaaaagatg

SEQ ID NO: 178119 - DNA, 103 bp, Artificial Sequence
  Synthetic Polynucleotide
taatacgactcactataggggcgccggcggggcccccgggggccgtgctgaacagaggagacagcacatgccccgggggaacctggcggcagcgcaaaagatg

SEQ ID NO: 178120 - DNA, 103 bp, Artificial Sequence
  Synthetic Polynucleotide
taatacgactcactatagggagtggccgtggcgccggcggggcccccgggaacagaggagacccgggatgcccgccggcaacctggcggcagcgcaaaagatg

SEQ ID NO: 178121 - DNA, 103 bp, Artificial Sequence
  Synthetic Polynucleotide
taatacgactcactatagggccttggagaaagtggccgtggcgccggcggaacagaggagaccgccgatgccacggccaaacctggcggcagcgcaaaagatg

SEQ ID NO: 178122 - DNA, 103 bp, Artificial Sequence
  Synthetic Polynucleotide
taatacgactcactatagggccgccgtccagcaggctcgccatgccggccaacagaggagaggccggatgggcgagcctaacctggcggcagcgcaaaagatg

SEQ ID NO: 178123 - DNA, 103 bp, Artificial Sequence
  Synthetic Polynucleotide
taatacgactcactataggggccgccgccgccgccgtccagcaggctcgcaacagaggagagcgagcatgctggacggcaacctggcggcagcgcaaaagatg

SEQ ID NO: 178124 - DNA, 103 bp, Artificial Sequence
  Synthetic Polynucleotide
taatacgactcactatagggccccaccgccgccgccgccgccgccgtccaaacagaggagatggacgatggcggcggcgaacctggcggcagcgcaaaagatg

SEQ ID NO: 178125 - DNA, 103 bp, Artificial Sequence
  Synthetic Polynucleotide
taatacgactcactatagggcccccggcgcccccaccgccgccgccgccgaacagaggagacggcggatgcggcggtggaacctggcggcagcgcaaaagatg

SEQ ID NO: 178126 - DNA, 103 bp, Artificial Sequence
  Synthetic Polynucleotide
taatacgactcactataggggccgcccgcgcccccggcgcccccaccgccaacagaggagaggcggtatgggcgccgggaacctggcggcagcgcaaaagatg

SEQ ID NO: 178127 - DNA, 103 bp, Artificial Sequence
  Synthetic Polynucleotide
taatacgactcactatagggcgctgtgcaggccccccaggctctccaggcaacagaggagagcctggatggcctgggggaacctggcggcagcgcaaaagatg

SEQ ID NO: 178128 - DNA, 103 bp, Artificial Sequence
  Synthetic Polynucleotide
taatacgactcactatagggcgctgcccgcgccgcccgcgcccccggcgcaacagaggagagcgccgatggcgcgggcgaacctggcggcagcgcaaaagatg

SEQ ID NO: 178129 - DNA, 103 bp, Artificial Sequence
  Synthetic Polynucleotide
taatacgactcactatagggccgccgcccgcgctgcccgcgccgcccgcgaacagaggagacgcgggatgcgcgggcagaacctggcggcagcgcaaaagatg

SEQ ID NO: 178130 - DNA, 103 bp, Artificial Sequence
  Synthetic Polynucleotide
taatacgactcactataggggaagtccgcgccgccgcccgcgctgcccgcaacagaggagagcgggcatggcgggcggcaacctggcggcagcgcaaaagatg

SEQ ID NO: 178131 - DNA, 103 bp, Artificial Sequence
  Synthetic Polynucleotide
taatacgactcactataggggttccccgcggaagtccgcgccgccgcccgaacagaggagacgggcgatggcgcggactaacctggcggcagcgcaaaagatg

SEQ ID NO: 178132 - DNA, 103 bp, Artificial Sequence
  Synthetic Polynucleotide
taatacgactcactataggggggcccgccagttccccgcggaagtccgcgaacagaggagacgcggaatgccgcggggaaacctggcggcagcgcaaaagatg

SEQ ID NO: 178133 - DNA, 103 bp, Artificial Sequence
  Synthetic Polynucleotide
taatacgactcactatagggcgggtgcagcgggcccgccagttccccgcgaacagaggagacgcgggatgctggcgggcaacctggcggcagcgcaaaagatg

SEQ ID NO: 178134 - DNA, 103 bp, Artificial Sequence
  Synthetic Polynucleotide
taatacgactcactatagggtgcccattgccgggtgcagcgggcccgccaaacagaggagatggcggatgcgctgcaccaacctggcggcagcgcaaaagatg

SEQ ID NO: 178135 - DNA, 103 bp, Artificial Sequence
  Synthetic Polynucleotide
taatacgactcactatagggtcgcaggccatgcccattgccgggtgcagcaacagaggagagctgcaatgggcaatgggaacctggcggcagcgcaaaagatg

SEQ ID NO: 178136 - DNA, 103 bp, Artificial Sequence
  Synthetic Polynucleotide
taatacgactcactataggggcccggcgcctcgcaggccatgcccattgcaacagaggagagcaatgatgatggcctgcaacctggcggcagcgcaaaagatg

SEQ ID NO: 178137 - DNA, 103 bp, Artificial Sequence
  Synthetic Polynucleotide
taatacgactcactatagggtgccgcccaggcccggcgcctcgcaggccaaacagaggagatggcctatgaggcgccggaacctggcggcagcgcaaaagatg

SEQ ID NO: 178138 - DNA, 103 bp, Artificial Sequence
  Synthetic Polynucleotide
taatacgactcactataggggcgtgggccacgctgtgcaggccccccaggaacagaggagacctgggatgcctgcacagaacctggcggcagcgcaaaagatg

SEQ ID NO: 178139 - DNA, 103 bp, Artificial Sequence
  Synthetic Polynucleotide
taatacgactcactataggggtcgtgtaggtgccgcccaggcccggcgccaacagaggagaggcgccatgcctgggcggaacctggcggcagcgcaaaagatg

SEQ ID NO: 178140 - DNA, 103 bp, Artificial Sequence
  Synthetic Polynucleotide
taatacgactcactataggggggcgtgagcgtcgtgtaggtgccgcccagaacagaggagactgggcatgacctacacgaacctggcggcagcgcaaaagatg

SEQ ID NO: 178141 - DNA, 103 bp, Artificial Sequence
  Synthetic Polynucleotide
taatacgactcactatagggggtgctgcaggggcgtgagcgtcgtgtaggaacagaggagacctacaatgcgctcacgcaacctggcggcagcgcaaaagatg

SEQ ID NO: 178142 - DNA, 103 bp, Artificial Sequence
  Synthetic Polynucleotide
taatacgactcactatagggagcggcggcaggtgctgcaggggcgtgagcaacagaggagagctcacatgcctgcagcaaacctggcggcagcgcaaaagatg

SEQ ID NO: 178143 - DNA, 103 bp, Artificial Sequence
  Synthetic Polynucleotide
taatacgactcactatagggcacggccgcgagcggcggcaggtgctgcagaacagaggagactgcagatgctgccgccgaacctggcggcagcgcaaaagatg

SEQ ID NO: 178144 - DNA, 103 bp, Artificial Sequence
  Synthetic Polynucleotide
taatacgactcactatagggacttgtcggccacggccgcgagcggcggcaaacagaggagatgccgcatgtcgcggccgaacctggcggcagcgcaaaagatg

SEQ ID NO: 178145 - DNA, 103 bp, Artificial Sequence
  Synthetic Polynucleotide
taatacgactcactatagggtgctggtggaacttgtcggccacggccgcgaacagaggagacgcggcatgggccgacaaaacctggcggcagcgcaaaagatg

SEQ ID NO: 178146 - DNA, 103 bp, Artificial Sequence
  Synthetic Polynucleotide
taatacgactcactatagggggccgccgcgtgctggtggaacttgtcggcaacagaggagagccgacatgttccaccagaacctggcggcagcgcaaaagatg

SEQ ID NO: 178147 - DNA, 103 bp, Artificial Sequence
  Synthetic Polynucleotide
taatacgactcactatagggccacggccgcggccgccgcgtgctggtggaaacagaggagatccaccatgacgcggcggaacctggcggcagcgcaaaagatg

SEQ ID NO: 178148 - DNA, 103 bp, Artificial Sequence
  Synthetic Polynucleotide
taatacgactcactatagggtgcgccccggccacggccgcggccgccgcgaacagaggagacgcggcatgcgcggccgtaacctggcggcagcgcaaaagatg

SEQ ID NO: 178149 - DNA, 103 bp, Artificial Sequence
  Synthetic Polynucleotide
taatacgactcactataggggcccgcctgcgcgtgggccacgctgtgcagaacagaggagactgcacatggtggcccacaacctggcggcagcgcaaaagatg

SEQ ID NO: 178150 - DNA, 103 bp, Artificial Sequence
  Synthetic Polynucleotide
taatacgactcactatagggatggccgccgtgcgccccggccacggccgcaacagaggagagcggccatggccggggcgaacctggcggcagcgcaaaagatg

SEQ ID NO: 178151 - DNA, 103 bp, Artificial Sequence
  Synthetic Polynucleotide
taatacgactcactataggggcgcgtggggatggccgccgtgcgccccggaacagaggagaccggggatgacggcggccaacctggcggcagcgcaaaagatg

SEQ ID NO: 178152 - DNA, 103 bp, Artificial Sequence
  Synthetic Polynucleotide
taatacgactcactataggggggtgcgggtgcgcgtggggatggccgccgaacagaggagacggcggatgtccccacgcaacctggcggcagcgcaaaagatg

SEQ ID NO: 178153 - DNA, 103 bp, Artificial Sequence
  Synthetic Polynucleotide
taatacgactcactatagggcgcggccgccgggtgcgggtgcgcgtggggaacagaggagaccccacatgcacccgcacaacctggcggcagcgcaaaagatg

SEQ ID NO: 178154 - DNA, 103 bp, Artificial Sequence
  Synthetic Polynucleotide
taatacgactcactataggggcgggggcggcgcggccgccgggtgcgggtaacagaggagaacccgcatgcggcggccgaacctggcggcagcgcaaaagatg

SEQ ID NO: 178155 - DNA, 103 bp, Artificial Sequence
  Synthetic Polynucleotide
taatacgactcactatagggggcgggggtggcgggggcggcgcggccgccaacagaggagaggcggcatggccgcccccaacctggcggcagcgcaaaagatg

SEQ ID NO: 178156 - DNA, 103 bp, Artificial Sequence
  Synthetic Polynucleotide
taatacgactcactatagggcagacgctgcggcgggggtggcgggggcggaacagaggagaccgcccatgccacccccgaacctggcggcagcgcaaaagatg

SEQ ID NO: 178157 - DNA, 103 bp, Artificial Sequence
  Synthetic Polynucleotide
taatacgactcactatagggcgctggccgccagacgctgcggcgggggtgaacagaggagacaccccatgcgcagcgtcaacctggcggcagcgcaaaagatg

SEQ ID NO: 178158 - DNA, 103 bp, Artificial Sequence
  Synthetic Polynucleotide
taatacgactcactatagggctgccgctcacgctggccgccagacgctgcaacagaggagagcagcgatgggcggccagaacctggcggcagcgcaaaagatg

SEQ ID NO: 178159 - DNA, 103 bp, Artificial Sequence
  Synthetic Polynucleotide
taatacgactcactataggggagggtgaagctgccgctcacgctggccgcaacagaggagagcggccatggtgagcggcaacctggcggcagcgcaaaagatg

SEQ ID NO: 178160 - DNA, 103 bp, Artificial Sequence
  Synthetic Polynucleotide
taatacgactcactatagggtcagcagctcgcccgcctgcgcgtgggccaaacagaggagatggcccatgcgcaggcggaacctggcggcagcgcaaaagatg

SEQ ID NO: 178161 - DNA, 103 bp, Artificial Sequence
  Synthetic Polynucleotide
taatacgactcactatagggcgtcgcgcatgagggtgaagctgccgctcaaacagaggagatgagcgatggcttcacccaacctggcggcagcgcaaaagatg

SEQ ID NO: 178162 - DNA, 103 bp, Artificial Sequence
  Synthetic Polynucleotide
taatacgactcactataggggccgcccgctcgtcgcgcatgagggtgaagaacagaggagacttcacatgcatgcgcgaaacctggcggcagcgcaaaagatg

SEQ ID NO: 178163 - DNA, 103 bp, Artificial Sequence
  Synthetic Polynucleotide
taatacgactcactatagggggaggcgagcgccgcccgctcgtcgcgcataacagaggagaatgcgcatggagcgggcgaacctggcggcagcgcaaaagatg

SEQ ID NO: 178164 - DNA, 103 bp, Artificial Sequence
  Synthetic Polynucleotide
taatacgactcactatagggggtggcccacggaggcgagcgccgcccgctaacagaggagaagcgggatgcgctcgcctaacctggcggcagcgcaaaagatg

SEQ ID NO: 178165 - DNA, 103 bp, Artificial Sequence
  Synthetic Polynucleotide
taatacgactcactatagggggtccgtagaggtggcccacggaggcgagcaacagaggagagctcgcatgcgtgggccaaacctggcggcagcgcaaaagatg

SEQ ID NO: 178166 - DNA, 103 bp, Artificial Sequence
  Synthetic Polynucleotide
taatacgactcactatagggcttgccgtagggtccgtagaggtggcccacaacagaggagagtgggcatgctctacggaaacctggcggcagcgcaaaagatg

SEQ ID NO: 178167 - DNA, 103 bp, Artificial Sequence
  Synthetic Polynucleotide
taatacgactcactatagggcgggcagctccttgccgtagggtccgtagaaacagaggagatctacgatgcctacggcaaacctggcggcagcgcaaaagatg

SEQ ID NO: 178168 - DNA, 103 bp, Artificial Sequence
  Synthetic Polynucleotide
taatacgactcactataggggaccccatggcgggcagctccttgccgtagaacagaggagactacggatgggagctgccaacctggcggcagcgcaaaagatg

SEQ ID NO: 178169 - DNA, 103 bp, Artificial Sequence
  Synthetic Polynucleotide
taatacgactcactatagggcgacagcggcgaccccatggcgggcagctcaacagaggagagagctgatggccatggggaacctggcggcagcgcaaaagatg

SEQ ID NO: 178170 - DNA, 103 bp, Artificial Sequence
  Synthetic Polynucleotide
taatacgactcactatagggtgggcagcggcgacagcggcgaccccatggaacagaggagaccatggatgcgccgctgtaacctggcggcagcgcaaaagatg

SEQ ID NO: 178171 - DNA, 103 bp, Artificial Sequence
  Synthetic Polynucleotide
taatacgactcactatagggtggcccgggctcagcagctcgcccgcctgcaacagaggagagcaggcatgcgagctgctaacctggcggcagcgcaaaagatg

SEQ ID NO: 178172 - DNA, 103 bp, Artificial Sequence
  Synthetic Polynucleotide
taatacgactcactatagggggcagcgcgttgggcagcggcgacagcggcaacagaggagagccgctatggccgctgccaacctggcggcagcgcaaaagatg

SEQ ID NO: 178173 - DNA, 103 bp, Artificial Sequence
  Synthetic Polynucleotide
taatacgactcactatagggcagcgcgggcggcagcgcgttgggcagcggaacagaggagaccgctgatgaacgcgctgaacctggcggcagcgcaaaagatg

SEQ ID NO: 178174 - DNA, 103 bp, Artificial Sequence
  Synthetic Polynucleotide
taatacgactcactataggggggcgccgtgcagcgcgggcggcagcgcgtaacagaggagaacgcgcatgcgcccgcgcaacctggcggcagcgcaaaagatg

SEQ ID NO: 178175 - DNA, 103 bp, Artificial Sequence
  Synthetic Polynucleotide
taatacgactcactataggggggggctgcggggcgccgtgcagcgcgggcaacagaggagagcccgcatggcacggcgcaacctggcggcagcgcaaaagatg

SEQ ID NO: 178176 - DNA, 103 bp, Artificial Sequence
  Synthetic Polynucleotide
taatacgactcactatagggtggcggcggcgggggctgcggggcgccgtgaacagaggagacacggcatgccgcagcccaacctggcggcagcgcaaaagatg

SEQ ID NO: 178177 - DNA, 103 bp, Artificial Sequence
  Synthetic Polynucleotide
taatacgactcactataggggcgggggtggtggcggcggcgggggctgcgaacagaggagacgcagcatgcgccgccgcaacctggcggcagcgcaaaagatg

SEQ ID NO: 178178 - DNA, 103 bp, Artificial Sequence
  Synthetic Polynucleotide
taatacgactcactataggggcggccagcggcgggggtggtggcggcggcaacagaggagagccgccatgaccacccccaacctggcggcagcgcaaaagatg

SEQ ID NO: 178179 - DNA, 103 bp, Artificial Sequence
  Synthetic Polynucleotide
taatacgactcactatagggcgggccgtaggcggccagcggcgggggtggaacagaggagaccacccatgccgctggccaacctggcggcagcgcaaaagatg

SEQ ID NO: 178180 - DNA, 103 bp, Artificial Sequence
  Synthetic Polynucleotide
taatacgactcactatagggggtggcctggcgggccgtaggcggccagcgaacagaggagacgctggatgcctacggccaacctggcggcagcgcaaaagatg

SEQ ID NO: 178181 - DNA, 103 bp, Artificial Sequence
  Synthetic Polynucleotide
taatacgactcactatagggtccccagccaggtggcctggcgggccgtagaacagaggagactacggatggccaggccaaacctggcggcagcgcaaaagatg

SEQ ID NO: 178182 - DNA, 103 bp, Artificial Sequence
  Synthetic Polynucleotide
taatacgactcactatagggcgagcgcgcgtggcccgggctcagcagctcaacagaggagagagctgatgagcccgggcaacctggcggcagcgcaaaagatg

SEQ ID NO: 178183 - DNA, 103 bp, Artificial Sequence
  Synthetic Polynucleotide
taatacgactcactatagggcagcagcttgtccccagccaggtggcctggaacagaggagaccaggcatgctggctgggaacctggcggcagcgcaaaagatg

SEQ ID NO: 178184 - DNA, 103 bp, Artificial Sequence
  Synthetic Polynucleotide
taatacgactcactatagggcggcgggcggcagcagcttgtccccagccaaacagaggagatggctgatgacaagctgcaacctggcggcagcgcaaaagatg

SEQ ID NO: 178185 - DNA, 103 bp, Artificial Sequence
  Synthetic Polynucleotide
taatacgactcactatagggggctcgaaggcggcgggcggcagcagcttgaacagaggagacaagctatggccgcccgcaacctggcggcagcgcaaaagatg

SEQ ID NO: 178186 - DNA, 103 bp, Artificial Sequence
  Synthetic Polynucleotide
taatacgactcactatagggcgcggcgtgcggctcgaaggcggcgggcggaacagaggagaccgcccatggccttcgagaacctggcggcagcgcaaaagatg

SEQ ID NO: 178187 - DNA, 103 bp, Artificial Sequence
  Synthetic Polynucleotide
taatacgactcactataggggtcccagcagcgcggcgtgcggctcgaaggaacagaggagaccttcgatgcgcacgccgaacctggcggcagcgcaaaagatg

SEQ ID NO: 178188 - DNA, 103 bp, Artificial Sequence
  Synthetic Polynucleotide
taatacgactcactatagggtcctccgcgcgtcccagcagcgcggcgtgcaacagaggagagcacgcatggctgctgggaacctggcggcagcgcaaaagatg

SEQ ID NO: 178189 - DNA, 103 bp, Artificial Sequence
  Synthetic Polynucleotide
taatacgactcactatagggggccagtgcgtcctccgcgcgtcccagcagaacagaggagactgctgatgcgcgcggagaacctggcggcagcgcaaaagatg

SEQ ID NO: 178190 - DNA, 103 bp, Artificial Sequence
  Synthetic Polynucleotide
taatacgactcactataggggcagcccgcgggccagtgcgtcctccgcgcaacagaggagagcgcggatgacgcactggaacctggcggcagcgcaaaagatg

SEQ ID NO: 178191 - DNA, 103 bp, Artificial Sequence
  Synthetic Polynucleotide
taatacgactcactatagggccgcctccgggcagcccgcgggccagtgcgaacagaggagacgcactatgccgcgggctaacctggcggcagcgcaaaagatg

SEQ ID NO: 178192 - DNA, 103 bp, Artificial Sequence
  Synthetic Polynucleotide
taatacgactcactatagggtgtgccgccgccgcctccgggcagcccgcgaacagaggagacgcgggatgcccggaggcaacctggcggcagcgcaaaagatg

SEQ ID NO: 178193 - DNA, 103 bp, Artificial Sequence
  Synthetic Polynucleotide
taatacgactcactataggggcgccgccgccgagcgcgcgtggcccgggcaacagaggagagcccggatgacgcgcgctaacctggcggcagcgcaaaagatg

SEQ ID NO: 178194 - DNA, 103 bp, Artificial Sequence
  Synthetic Polynucleotide
taatacgactcactatagggcgccgctgcctgtgccgccgccgcctccggaacagaggagaccggagatggcggcggcaaacctggcggcagcgcaaaagatg

SEQ ID NO: 178195 - DNA, 103 bp, Artificial Sequence
  Synthetic Polynucleotide
taatacgactcactatagggctgcccgctccgccgctgcctgtgccgccgaacagaggagacggcggatgaggcagcggaacctggcggcagcgcaaaagatg

SEQ ID NO: 178196 - DNA, 103 bp, Artificial Sequence
  Synthetic Polynucleotide
taatacgactcactatagggggcgctcccgctgcccgctccgccgctgccaacagaggagaggcagcatgggagcgggcaacctggcggcagcgcaaaagatg

SEQ ID NO: 178197 - DNA, 103 bp, Artificial Sequence
  Synthetic Polynucleotide
taatacgactcactataggggcagccccgcggcgctcccgctgcccgctcaacagaggagagagcggatggcgggagcgaacctggcggcagcgcaaaagatg

SEQ ID NO: 178198 - DNA, 103 bp, Artificial Sequence
  Synthetic Polynucleotide
taatacgactcactatagggagcggcgccagcagccccgcggcgctcccgaacagaggagacgggagatgcgcggggctaacctggcggcagcgcaaaagatg

SEQ ID NO: 178199 - DNA, 103 bp, Artificial Sequence
  Synthetic Polynucleotide
taatacgactcactatagggcagcccgcccagcggcgccagcagccccgcaacagaggagagcggggatgctggcgccgaacctggcggcagcgcaaaagatg

SEQ ID NO: 178200 - DNA, 103 bp, Artificial Sequence
  Synthetic Polynucleotide
taatacgactcactatagggcggccgccgccagcccgcccagcggcgccaaacagaggagatggcgcatgtgggcgggcaacctggcggcagcgcaaaagatg

SEQ ID NO: 178201 - DNA, 103 bp, Artificial Sequence
  Synthetic Polynucleotide
taatacgactcactatagggccgtgcgccccggccgccgccagcccgcccaacagaggagagggcggatgggcggcggcaacctggcggcagcgcaaaagatg

SEQ ID NO: 178202 - DNA, 103 bp, Artificial Sequence
  Synthetic Polynucleotide
taatacgactcactatagggcccgtgcggcccgtgcgccccggccgccgcaacagaggagagcggcgatgggggcgcacaacctggcggcagcgcaaaagatg

SEQ ID NO: 178203 - DNA, 103 bp, Artificial Sequence
  Synthetic Polynucleotide
taatacgactcactatagggcgccgcctcccccgtgcggcccgtgcgcccaacagaggagagggcgcatgggccgcacgaacctggcggcagcgcaaaagatg

SEQ ID NO: 178204 - DNA, 103 bp, Artificial Sequence
  Synthetic Polynucleotide
taatacgactcactatagggccgcggtgctgcgccgccgccgagcgcgcgaacagaggagacgcgcgatgggcggcggcaacctggcggcagcgcaaaagatg

SEQ ID NO: 178205 - DNA, 103 bp, Artificial Sequence
  Synthetic Polynucleotide
taatacgactcactatagggccgccggggccgccgcctcccccgtgcggcaacagaggagagccgcaatggggaggcggaacctggcggcagcgcaaaagatg

SEQ ID NO: 178206 - DNA, 103 bp, Artificial Sequence
  Synthetic Polynucleotide
taatacgactcactataggggccgccgctcccgccggggccgccgcctccaacagaggagaggaggcatgggccccggcaacctggcggcagcgcaaaagatg

SEQ ID NO: 178207 - DNA, 103 bp, Artificial Sequence
  Synthetic Polynucleotide
taatacgactcactatagggcgctggggccgccgccgctcccgccggggcaacagaggagagccccgatgggagcggcgaacctggcggcagcgcaaaagatg

SEQ ID NO: 178208 - DNA, 103 bp, Artificial Sequence
  Synthetic Polynucleotide
taatacgactcactataggggctgcgcccgcgctggggccgccgccgctcaacagaggagagagcggatgcggccccagaacctggcggcagcgcaaaagatg

SEQ ID NO: 178209 - DNA, 103 bp, Artificial Sequence
  Synthetic Polynucleotide
taatacgactcactatagggctcctcggccgctgcgcccgcgctggggccaacagaggagaggccccatggcgggcgcaaacctggcggcagcgcaaaagatg

SEQ ID NO: 178210 - DNA, 103 bp, Artificial Sequence
  Synthetic Polynucleotide
taatacgactcactatagggtggtgttgatctcctcggccgctgcgcccgaacagaggagacgggcgatgcggccgaggaacctggcggcagcgcaaaagatg

SEQ ID NO: 178211 - DNA, 103 bp, Artificial Sequence
  Synthetic Polynucleotide
taatacgactcactataggggccacctccttggtgttgatctcctcggccaacagaggagaggccgaatggatcaacacaacctggcggcagcgcaaaagatg

SEQ ID NO: 178212 - DNA, 103 bp, Artificial Sequence
  Synthetic Polynucleotide
taatacgactcactataggggatgcgctgcgccacctccttggtgttgataacagaggagaatcaacatgaaggaggtgaacctggcggcagcgcaaaagatg

SEQ ID NO: 178213 - DNA, 103 bp, Artificial Sequence
  Synthetic Polynucleotide
taatacgactcactataggggctccgccgtgatgcgctgcgccacctcctaacagaggagaaggaggatgcgcagcgcaaacctggcggcagcgcaaaagatg

SEQ ID NO: 178214 - DNA, 103 bp, Artificial Sequence
  Synthetic Polynucleotide
taatacgactcactatagggtagcgcttcagctccgccgtgatgcgctgcaacagaggagagcagcgatgcacggcggaaacctggcggcagcgcaaaagatg

SEQ ID NO: 178215 - DNA, 103 bp, Artificial Sequence
  Synthetic Polynucleotide
taatacgactcactatagggcaccggcgccggcaaggttttgctgcccataacagaggagaatgggcatgaaaaccttgaacctggcggcagcgcaaaagatg

SEQ ID NO: 178216 - DNA, 103 bp, Artificial Sequence
  Synthetic Polynucleotide
taatacgactcactataggggttgggcagatggtccgaaggcactgtgggaacagaggagacccacaatgccttcggacaacctggcggcagcgcaaaagatg

SEQ ID NO: 178217 - DNA, 103 bp, Artificial Sequence
  Synthetic Polynucleotide
taatacgactcactatagggaaccatacaggttgggcagatggtccgaagaacagaggagacttcggatgatctgcccaaacctggcggcagcgcaaaagatg

SEQ ID NO: 178218 - DNA, 103 bp, Artificial Sequence
  Synthetic Polynucleotide
taatacgactcactatagggaacgcgctgaaaccatacaggttgggcagaaacagaggagatctgccatgcctgtatggaacctggcggcagcgcaaaagatg

SEQ ID NO: 178219 - DNA, 103 bp, Artificial Sequence
  Synthetic Polynucleotide
taatacgactcactatagggcacagcgtgcaacgcgctgaaaccatacagaacagaggagactgtatatgttcagcgcgaacctggcggcagcgcaaaagatg

SEQ ID NO: 178220 - DNA, 103 bp, Artificial Sequence
  Synthetic Polynucleotide
taatacgactcactataggggatgcaggtgcacagcgtgcaacgcgctgaaacagaggagatcagcgatgtgcacgctgaacctggcggcagcgcaaaagatg

SEQ ID NO: 178221 - DNA, 103 bp, Artificial Sequence
  Synthetic Polynucleotide
taatacgactcactatagggagcgtccactgatgcaggtgcacagcgtgcaacagaggagagcacgcatggcacctgcaaacctggcggcagcgcaaaagatg

SEQ ID NO: 178222 - DNA, 103 bp, Artificial Sequence
  Synthetic Polynucleotide
taatacgactcactatagggcgggtagcccagcgtccactgatgcaggtgaacagaggagacacctgatgcagtggacgaacctggcggcagcgcaaaagatg

SEQ ID NO: 178223 - DNA, 103 bp, Artificial Sequence
  Synthetic Polynucleotide
taatacgactcactatagggagtgcatggccgggtagcccagcgtccactaacagaggagaagtggaatgtgggctaccaacctggcggcagcgcaaaagatg

SEQ ID NO: 178224 - DNA, 103 bp, Artificial Sequence
  Synthetic Polynucleotide
taatacgactcactataggggagcgcggcaagtgcatggccgggtagcccaacagaggagagggctaatgggccatgcaaacctggcggcagcgcaaaagatg

SEQ ID NO: 178225 - DNA, 103 bp, Artificial Sequence
  Synthetic Polynucleotide
taatacgactcactatagggggagaaagaagagcgcggcaagtgcatggcaacagaggagagccatgatgttgccgcgcaacctggcggcagcgcaaaagatg

SEQ ID NO: 178226 - DNA, 103 bp, Artificial Sequence
  Synthetic Polynucleotide
taatacgactcactatagggggtggataggcaccggcgccggcaaggtttaacagaggagaaaacctatgcggcgccggaacctggcggcagcgcaaaagatg

SEQ ID NO: 178227 - DNA, 103 bp, Artificial Sequence
  Synthetic Polynucleotide
taatacgactcactatagggccggcactttggagaaagaagagcgcggcaaacagaggagatgccgcatgcttctttctaacctggcggcagcgcaaaagatg

SEQ ID NO: 178228 - DNA, 103 bp, Artificial Sequence
  Synthetic Polynucleotide
taatacgactcactataggggacaccgtgcccggcactttggagaaagaaaacagaggagattctttatgcaaagtgccaacctggcggcagcgcaaaagatg

SEQ ID NO: 178229 - DNA, 103 bp, Artificial Sequence
  Synthetic Polynucleotide
taatacgactcactatagggcaccaagctggacaccgtgcccggcactttaacagaggagaaaagtgatgggcacggtgaacctggcggcagcgcaaaagatg

SEQ ID NO: 178230 - DNA, 103 bp, Artificial Sequence
  Synthetic Polynucleotide
taatacgactcactatagggagcgcgcatccaccaagctggacaccgtgcaacagaggagagcacggatgccagcttggaacctggcggcagcgcaaaagatg

SEQ ID NO: 178231 - DNA, 103 bp, Artificial Sequence
  Synthetic Polynucleotide
taatacgactcactatagggggcagctggaagcgcgcatccaccaagctgaacagaggagacagcttatgggatgcgcgaacctggcggcagcgcaaaagatg

SEQ ID NO: 178232 - DNA, 103 bp, Artificial Sequence
  Synthetic Polynucleotide
taatacgactcactataggggggaaaggcgggcagctggaagcgcgcatcaacagaggagagatgcgatgttccagctgaacctggcggcagcgcaaaagatg

SEQ ID NO: 178233 - DNA, 103 bp, Artificial Sequence
  Synthetic Polynucleotide
taatacgactcactataggggagggaaccagggaaaggcgggcagctggaaacagaggagatccagcatgccgcctttcaacctggcggcagcgcaaaagatg

SEQ ID NO: 178234 - DNA, 103 bp, Artificial Sequence
  Synthetic Polynucleotide
taatacgactcactatagggtgaatgacatgagggaaccagggaaaggcgaacagaggagacgccttatgctggttcccaacctggcggcagcgcaaaagatg

SEQ ID NO: 178235 - DNA, 103 bp, Artificial Sequence
  Synthetic Polynucleotide
taatacgactcactataggggggcttgggttgaatgacatgagggaaccaaacagaggagatggttcatgcatgtcattaacctggcggcagcgcaaaagatg

SEQ ID NO: 178236 - DNA, 103 bp, Artificial Sequence
  Synthetic Polynucleotide
taatacgactcactatagggcggtgatctcgggcttgggttgaatgacataacagaggagaatgtcaatgaacccaagcaacctggcggcagcgcaaaagatg

SEQ ID NO: 178237 - DNA, 103 bp, Artificial Sequence
  Synthetic Polynucleotide
taatacgactcactatagggtgcagggaagggtggataggcaccggcgccaacagaggagaggcgccatggcctatccaaacctggcggcagcgcaaaagatg

SEQ ID NO: 178238 - DNA, 103 bp, Artificial Sequence
  Synthetic Polynucleotide
taatacgactcactatagggctgcctccagcggtgatctcgggcttgggtaacagaggagaacccaaatgcgagatcacaacctggcggcagcgcaaaagatg

SEQ ID NO: 178239 - DNA, 103 bp, Artificial Sequence
  Synthetic Polynucleotide
taatacgactcactatagggcgctggaacgctgcctccagcggtgatctcaacagaggagagagatcatggctggaggcaacctggcggcagcgcaaaagatg

SEQ ID NO: 178240 - DNA, 103 bp, Artificial Sequence
  Synthetic Polynucleotide
taatacgactcactatagggtggtcttgagcgctggaacgctgcctccagaacagaggagactggagatggcgttccagaacctggcggcagcgcaaaagatg

SEQ ID NO: 178241 - DNA, 103 bp, Artificial Sequence
  Synthetic Polynucleotide
taatacgactcactatagggaagcgcggcttggtcttgagcgctggaacgaacagaggagacgttccatggctcaagacaacctggcggcagcgcaaaagatg

SEQ ID NO: 178242 - DNA, 103 bp, Artificial Sequence
  Synthetic Polynucleotide
taatacgactcactatagggggcaaaatcaaagcgcggcttggtcttgagaacagaggagactcaagatgaagccgcgcaacctggcggcagcgcaaaagatg

SEQ ID NO: 178243 - DNA, 103 bp, Artificial Sequence
  Synthetic Polynucleotide
taatacgactcactatagggaggccaggttggcaaaatcaaagcgcggctaacagaggagaagccgcatgttgattttgaacctggcggcagcgcaaaagatg

SEQ ID NO: 178244 - DNA, 103 bp, Artificial Sequence
  Synthetic Polynucleotide
taatacgactcactataggggttgctgccaaggccaggttggcaaaatcaaacagaggagatgatttatgcaacctggcaacctggcggcagcgcaaaagatg

SEQ ID NO: 178245 - DNA, 103 bp, Artificial Sequence
  Synthetic Polynucleotide
taatacgactcactatagggatcttcttgcgttgctgccaaggccaggttaacagaggagaaacctgatgttggcagcaaacctggcggcagcgcaaaagatg

SEQ ID NO: 178246 - DNA, 103 bp, Artificial Sequence
  Synthetic Polynucleotide
taatacgactcactataggggcttggccggatcttcttgcgttgctgccaaacagaggagatggcagatgcgcaagaagaacctggcggcagcgcaaaagatg

SEQ ID NO: 178247 - DNA, 103 bp, Artificial Sequence
  Synthetic Polynucleotide
taatacgactcactatagggccgcgaccgagcttggccggatcttcttgcaacagaggagagcaagaatgtccggccaaaacctggcggcagcgcaaaagatg

SEQ ID NO: 178248 - DNA, 103 bp, Artificial Sequence
  Synthetic Polynucleotide
taatacgactcactataggggttggtgagctgcagggaagggtggataggaacagaggagacctatcatgccttccctgaacctggcggcagcgcaaaagatg

SEQ ID NO: 178249 - DNA, 103 bp, Artificial Sequence
  Synthetic Polynucleotide
taatacgactcactatagggtgggccctccccgcgaccgagcttggccggaacagaggagaccggccatgctcggtcgcaacctggcggcagcgcaaaagatg

SEQ ID NO: 178250 - DNA, 103 bp, Artificial Sequence
  Synthetic Polynucleotide
taatacgactcactatagggcaggggagcctgggccctccccgcgaccgaaacagaggagatcggtcatggggagggccaacctggcggcagcgcaaaagatg

SEQ ID NO: 178251 - DNA, 103 bp, Artificial Sequence
  Synthetic Polynucleotide
taatacgactcactatagggagcccacctgcaggggagcctgggccctccaacagaggagaggagggatgaggctccccaacctggcggcagcgcaaaagatg

SEQ ID NO: 178252 - DNA, 103 bp, Artificial Sequence
  Synthetic Polynucleotide
taatacgactcactataggggagggcacccagcccacctgcaggggagccaacagaggagaggctccatggcaggtgggaacctggcggcagcgcaaaagatg

SEQ ID NO: 178253 - DNA, 103 bp, Artificial Sequence
  Synthetic Polynucleotide
taatacgactcactatagggtcacgtcgaggagggcacccagcccacctgaacagaggagacaggtgatgtgggtgcccaacctggcggcagcgcaaaagatg

SEQ ID NO: 178254 - DNA, 103 bp, Artificial Sequence
  Synthetic Polynucleotide
taatacgactcactataggggacagcttggtcacgtcgaggagggcacccaacagaggagagggtgcatgcctcgacgtaacctggcggcagcgcaaaagatg

SEQ ID NO: 178255 - DNA, 103 bp, Artificial Sequence
  Synthetic Polynucleotide
taatacgactcactatagggcttttctggagacagcttggtcacgtcgagaacagaggagactcgacatgaccaagctgaacctggcggcagcgcaaaagatg

SEQ ID NO: 178256 - DNA, 103 bp, Artificial Sequence
  Synthetic Polynucleotide
taatacgactcactatagggttgtgggcttcttttctggagacagcttggaacagaggagaccaagcatgctccagaaaaacctggcggcagcgcaaaagatg

SEQ ID NO: 178257 - DNA, 103 bp, Artificial Sequence
  Synthetic Polynucleotide
taatacgactcactatagggagacgtccccttgtgggcttcttttctggaaacagaggagatccagaatggaagcccacaacctggcggcagcgcaaaagatg

SEQ ID NO: 178258 - DNA, 103 bp, Artificial Sequence
  Synthetic Polynucleotide
taatacgactcactatagggcttggaaggcagacgtccccttgtgggcttaacagaggagaaagcccatgaggggacgtaacctggcggcagcgcaaaagatg

SEQ ID NO: 178259 - DNA, 103 bp, Artificial Sequence
  Synthetic Polynucleotide
taatacgactcactatagggggaaggagtagttggtgagctgcagggaagaacagaggagacttcccatgagctcaccaaacctggcggcagcgcaaaagatg

SEQ ID NO: 178260 - DNA, 103 bp, Artificial Sequence
  Synthetic Polynucleotide
taatacgactcactatagggccttcttggtcttggaaggcagacgtccccaacagaggagaggggacatgtgccttccaaacctggcggcagcgcaaaagatg

SEQ ID NO: 178261 - DNA, 103 bp, Artificial Sequence
  Synthetic Polynucleotide
taatacgactcactatagggcagacgaattccttcttggtcttggaaggcaacagaggagagccttcatggaccaagaaaacctggcggcagcgcaaaagatg

SEQ ID NO: 178262 - DNA, 103 bp, Artificial Sequence
  Synthetic Polynucleotide
taatacgactcactatagggacagaacttgcagacgaattccttcttggtaacagaggagaaccaagatggaattcgtcaacctggcggcagcgcaaaagatg

SEQ ID NO: 178263 - DNA, 103 bp, Artificial Sequence
  Synthetic Polynucleotide
taatacgactcactatagggagtggcggccacagaacttgcagacgaattaacagaggagaaattcgatggcaagttctaacctggcggcagcgcaaaagatg

SEQ ID NO: 178264 - DNA, 103 bp, Artificial Sequence
  Synthetic Polynucleotide
taatacgactcactataggggacttggtgaagtggcggccacagaacttgaacagaggagacaagttatgtggccgccaaacctggcggcagcgcaaaagatg

SEQ ID NO: 178265 - DNA, 103 bp, Artificial Sequence
  Synthetic Polynucleotide
taatacgactcactatagggtaggttgtaggacttggtgaagtggcggccaacagaggagaggccgcatgttcaccaagaacctggcggcagcgcaaaagatg

SEQ ID NO: 178266 - DNA, 103 bp, Artificial Sequence
  Synthetic Polynucleotide
taatacgactcactatagggcatggataagtaggttgtaggacttggtgaaacagaggagatcaccaatgcctacaaccaacctggcggcagcgcaaaagatg

SEQ ID NO: 178267 - DNA, 103 bp, Artificial Sequence
  Synthetic Polynucleotide
taatacgactcactatagggtgcgtccgctcatggataagtaggttgtagaacagaggagactacaaatgacttatccaaacctggcggcagcgcaaaagatg

SEQ ID NO: 178268 - DNA, 103 bp, Artificial Sequence
  Synthetic Polynucleotide
taatacgactcactatagggctcgtcggtgtgcgtccgctcatggataagaacagaggagacttatcatggagcggacgaacctggcggcagcgcaaaagatg

SEQ ID NO: 178269 - DNA, 103 bp, Artificial Sequence
  Synthetic Polynucleotide
taatacgactcactatagggtgtagggccgctcgtcggtgtgcgtccgctaacagaggagaagcggaatgacaccgacgaacctggcggcagcgcaaaagatg

SEQ ID NO: 178270 - DNA, 103 bp, Artificial Sequence
  Synthetic Polynucleotide
taatacgactcactatagggactgcctgaaggaaggagtagttggtgagcaacagaggagagctcacatgctactccttaacctggcggcagcgcaaaagatg

SEQ ID NO: 178271 - DNA, 103 bp, Artificial Sequence
  Synthetic Polynucleotide
taatacgactcactatagggatgtcacaggtgtagggccgctcgtcggtgaacagaggagacaccgaatggcggccctaaacctggcggcagcgcaaaagatg

SEQ ID NO: 178272 - DNA, 103 bp, Artificial Sequence
  Synthetic Polynucleotide
taatacgactcactatagggtttgtggcagatgtcacaggtgtagggccgaacagaggagacggcccatgacctgtgacaacctggcggcagcgcaaaagatg

SEQ ID NO: 178273 - DNA, 103 bp, Artificial Sequence
  Synthetic Polynucleotide
taatacgactcactatagggtccggaaggctttgtggcagatgtcacaggaacagaggagacctgtgatgtctgccacaaacctggcggcagcgcaaaagatg

SEQ ID NO: 178274 - DNA, 103 bp, Artificial Sequence
  Synthetic Polynucleotide
taatacgactcactatagggtggtcttgcctccggaaggctttgtggcagaacagaggagactgccaatgagccttccgaacctggcggcagcgcaaaagatg

SEQ ID NO: 178275 - DNA, 103 bp, Artificial Sequence
  Synthetic Polynucleotide
taatacgactcactataggggtctcgcaggtggtcttgcctccggaaggcaacagaggagagccttcatgaggcaagacaacctggcggcagcgcaaaagatg

SEQ ID NO: 178276 - DNA, 103 bp, Artificial Sequence
  Synthetic Polynucleotide
taatacgactcactatagggtatatctgtggtctcgcaggtggtcttgccaacagaggagaggcaagatgacctgcgagaacctggcggcagcgcaaaagatg

SEQ ID NO: 178277 - DNA, 103 bp, Artificial Sequence
  Synthetic Polynucleotide
taatacgactcactatagggttggagtgaatatatctgtggtctcgcaggaacagaggagacctgcgatgccacagataaacctggcggcagcgcaaaagatg

SEQ ID NO: 178278 - DNA, 103 bp, Artificial Sequence
  Synthetic Polynucleotide
taatacgactcactataggggggcttctctttggagtgaatatatctgtgaacagaggagacacagaatgattcactccaacctggcggcagcgcaaaagatg

SEQ ID NO: 178279 - DNA, 103 bp, Artificial Sequence
  Synthetic Polynucleotide
taatacgactcactataggggacacttgaagggcttctctttggagtgaaaacagaggagattcactatgaagagaagcaacctggcggcagcgcaaaagatg

SEQ ID NO: 178280 - DNA, 103 bp, Artificial Sequence
  Synthetic Polynucleotide
taatacgactcactatagggccacactcttgacacttgaagggcttctctaacagaggagaagagaaatgcttcaagtgaacctggcggcagcgcaaaagatg

SEQ ID NO: 178281 - DNA, 103 bp, Artificial Sequence
  Synthetic Polynucleotide
taatacgactcactatagggcaggccgttcactgcctgaaggaaggagtaaacagaggagatactccatgcttcaggcaaacctggcggcagcgcaaaagatg

SEQ ID NO: 178282 - DNA, 103 bp, Artificial Sequence
  Synthetic Polynucleotide
taatacgactcactataggggaatcctttcccacactcttgacacttgaaaacagaggagattcaagatgcaagagtgtaacctggcggcagcgcaaaagatg

SEQ ID NO: 178283 - DNA, 103 bp, Artificial Sequence
  Synthetic Polynucleotide
taatacgactcactatagggtggactggcagaatcctttcccacactcttaacagaggagaaagagtatgggaaaggataacctggcggcagcgcaaaagatg

SEQ ID NO: 178284 - DNA, 103 bp, Artificial Sequence
  Synthetic Polynucleotide
taatacgactcactataggggcgagagtcctggactggcagaatcctttcaacagaggagagaaaggatgctgccagtcaacctggcggcagcgcaaaagatg

SEQ ID NO: 178285 - DNA, 103 bp, Artificial Sequence
  Synthetic Polynucleotide
taatacgactcactatagggcttgtggacagcgagagtcctggactggcaaacagaggagatgccagatgaggactctcaacctggcggcagcgcaaaagatg

SEQ ID NO: 178286 - DNA, 103 bp, Artificial Sequence
  Synthetic Polynucleotide
taatacgactcactatagggagtgtagcgtcttgtggacagcgagagtccaacagaggagaggactcatgctgtccacaaacctggcggcagcgcaaaagatg

SEQ ID NO: 178287 - DNA, 103 bp, Artificial Sequence
  Synthetic Polynucleotide
taatacgactcactatagggttcacctgtgagtgtagcgtcttgtggacaaacagaggagatgtccaatggacgctacaaacctggcggcagcgcaaaagatg

SEQ ID NO: 178288 - DNA, 103 bp, Artificial Sequence
  Synthetic Polynucleotide
taatacgactcactatagggtttgagctccttcacctgtgagtgtagcgtaacagaggagaacgctaatgtcacaggtgaacctggcggcagcgcaaaagatg

SEQ ID NO: 178289 - DNA, 103 bp, Artificial Sequence
  Synthetic Polynucleotide
taatacgactcactatagggtcttggaggttttgagctccttcacctgtgaacagaggagacacaggatgaggagctcaaacctggcggcagcgcaaaagatg

SEQ ID NO: 178290 - DNA, 103 bp, Artificial Sequence
  Synthetic Polynucleotide
taatacgactcactatagggtagcatttgatcttggaggttttgagctccaacagaggagaggagctatgaacctccaaaacctggcggcagcgcaaaagatg

SEQ ID NO: 178291 - DNA, 103 bp, Artificial Sequence
  Synthetic Polynucleotide
taatacgactcactataggggcactgtgggcaggccgttcactgcctgaaaacagaggagattcaggatgtgaacggccaacctggcggcagcgcaaaagatg

SEQ ID NO: 178292 - DNA, 103 bp, Artificial Sequence
  Synthetic Polynucleotide
taatacgactcactatagggtggtccgaaggcactgtgggcaggccgttcaacagaggagagaacggatggcccacagtaacctggcggcagcgcaaaagatg

SEQ ID NO: 178293 - DNA, 103 bp, Artificial Sequence
  Synthetic Polynucleotide
taatacgactcactataggggatgggcgctggcagagccttgctccccataacagaggagaatggggatgaaggctctgaacctggcggcagcgcaaaagatg

SEQ ID NO: 178294 - DNA, 103 bp, Artificial Sequence
  Synthetic Polynucleotide
taatacgactcactatagggcaggccctgcaggtggtccaccgtggccggaacagaggagaccggccatggtggaccacaacctggcggcagcgcaaaagatg

SEQ ID NO: 178295 - DNA, 103 bp, Artificial Sequence
  Synthetic Polynucleotide
taatacgactcactatagggtgagaccgtacaggccctgcaggtggtccaaacagaggagatggaccatgtgcagggccaacctggcggcagcgcaaaagatg

SEQ ID NO: 178296 - DNA, 103 bp, Artificial Sequence
  Synthetic Polynucleotide
taatacgactcactatagggtgtaccgcgctgagaccgtacaggccctgcaacagaggagagcagggatggtacggtctaacctggcggcagcgcaaaagatg

SEQ ID NO: 178297 - DNA, 103 bp, Artificial Sequence
  Synthetic Polynucleotide
taatacgactcactataggggtgcatggtctgtaccgcgctgagaccgtaaacagaggagatacggtatgagcgcggtaaacctggcggcagcgcaaaagatg

SEQ ID NO: 178298 - DNA, 103 bp, Artificial Sequence
  Synthetic Polynucleotide
taatacgactcactatagggagtggttcatgtgcatggtctgtaccgcgcaacagaggagagcgcggatgagaccatgcaacctggcggcagcgcaaaagatg

SEQ ID NO: 178299 - DNA, 103 bp, Artificial Sequence
  Synthetic Polynucleotide
taatacgactcactatagggcccagcgtccagtggttcatgtgcatggtcaacagaggagagaccatatgcatgaaccaaacctggcggcagcgcaaaagatg

SEQ ID NO: 178300 - DNA, 103 bp, Artificial Sequence
  Synthetic Polynucleotide
taatacgactcactatagggattgggataccccagcgtccagtggttcataacagaggagaatgaacatgtggacgctgaacctggcggcagcgcaaaagatg

SEQ ID NO: 178301 - DNA, 103 bp, Artificial Sequence
  Synthetic Polynucleotide
taatacgactcactatagggtctcgtgcacattgggataccccagcgtccaacagaggagaggacgcatgggtatcccaaacctggcggcagcgcaaaagatg

SEQ ID NO: 178302 - DNA, 103 bp, Artificial Sequence
  Synthetic Polynucleotide
taatacgactcactataggggagcgggtgatctcgtgcacattgggatacaacagaggagagtatccatgtgtgcacgaaacctggcggcagcgcaaaagatg

SEQ ID NO: 178303 - DNA, 103 bp, Artificial Sequence
  Synthetic Polynucleotide
taatacgactcactatagggcgtgatggtggagcgggtgatctcgtgcacaacagaggagagtgcacatgatcacccgcaacctggcggcagcgcaaaagatg

SEQ ID NO: 178304 - DNA, 103 bp, Artificial Sequence
  Synthetic Polynucleotide
taatacgactcactatagggggtggagcgggatgggcgctggcagagcctaacagaggagaaggctcatgcagcgcccaaacctggcggcagcgcaaaagatg

SEQ ID NO: 178305 - DNA, 103 bp, Artificial Sequence
  Synthetic Polynucleotide
taatacgactcactatagggccgccatctccgtgatggtggagcgggtgaaacagaggagatcacccatgccaccatcaaacctggcggcagcgcaaaagatg

SEQ ID NO: 178306 - DNA, 103 bp, Artificial Sequence
  Synthetic Polynucleotide
taatacgactcactatagggccctgcgccgccgccatctccgtgatggtgaacagaggagacaccatatgggagatggcaacctggcggcagcgcaaaagatg

SEQ ID NO: 178307 - DNA, 103 bp, Artificial Sequence
  Synthetic Polynucleotide
taatacgactcactataggggtccacgaggccctgcgccgccgccatctcaacagaggagagagatgatggcggcgcagaacctggcggcagcgcaaaagatg

SEQ ID NO: 178308 - DNA, 103 bp, Artificial Sequence
  Synthetic Polynucleotide
taatacgactcactatagggggaagcgcgcgtccacgaggccctgcgccgaacagaggagacggcgcatggcctcgtggaacctggcggcagcgcaaaagatg

SEQ ID NO: 178309 - DNA, 103 bp, Artificial Sequence
  Synthetic Polynucleotide
taatacgactcactataggggccgggaaggggaagcgcgcgtccacgaggaacagaggagacctcgtatgcgcgcgcttaacctggcggcagcgcaaaagatg

SEQ ID NO: 178310 - DNA, 103 bp, Artificial Sequence
  Synthetic Polynucleotide
taatacgactcactatagggaaaaggcagggccgggaaggggaagcgcgcaacagaggagagcgcgcatgcccttcccgaacctggcggcagcgcaaaagatg

SEQ ID NO: 178311 - DNA, 103 bp, Artificial Sequence
  Synthetic Polynucleotide
taatacgactcactatagggggtgggtggtaaaaggcagggccgggaaggaacagaggagaccttccatgccctgccttaacctggcggcagcgcaaaagatg

SEQ ID NO: 178312 - DNA, 103 bp, Artificial Sequence
  Synthetic Polynucleotide
taatacgactcactataggggggtggaataggtgggtggtaaaaggcaggaacagaggagacctgccatgtaccacccaaacctggcggcagcgcaaaagatg

SEQ ID NO: 178313 - DNA, 103 bp, Artificial Sequence
  Synthetic Polynucleotide
taatacgactcactatagggcccctgcttggggtggaataggtgggtggtaacagaggagaaccaccatgctattccacaacctggcggcagcgcaaaagatg

SEQ ID NO: 178314 - DNA, 103 bp, Artificial Sequence
  Synthetic Polynucleotide
taatacgactcactataggggggcaatggccccctgcttggggtggaataaacagaggagatattccatgccaagcaggaacctggcggcagcgcaaaagatg

SEQ ID NO: 178315 - DNA, 103 bp, Artificial Sequence
  Synthetic Polynucleotide
taatacgactcactatagggtgcagcgacgggtggagcgggatgggcgctaacagaggagaagcgccatgcccgctccaaacctggcggcagcgcaaaagatg

SEQ ID NO: 178316 - DNA, 103 bp, Artificial Sequence
  Synthetic Polynucleotide
taatacgactcactataggggggaggacgtgggcaatggccccctgcttgaacagaggagacaagcaatgggccattgcaacctggcggcagcgcaaaagatg

SEQ ID NO: 178317 - DNA, 103 bp, Artificial Sequence
  Synthetic Polynucleotide
taatacgactcactataggggtgcagggctgggaggacgtgggcaatggcaacagaggagagccattatgcacgtcctcaacctggcggcagcgcaaaagatg

SEQ ID NO: 178318 - DNA, 103 bp, Artificial Sequence
  Synthetic Polynucleotide
taatacgactcactataggggccggtccttgtgcagggctgggaggacgtaacagaggagaacgtccatgcagccctgcaacctggcggcagcgcaaaagatg

SEQ ID NO: 178319 - DNA, 103 bp, Artificial Sequence
  Synthetic Polynucleotide
taatacgactcactatagggtcaaaacggggccggtccttgtgcagggctaacagaggagaagccctatgcaaggaccgaacctggcggcagcgcaaaagatg

SEQ ID NO: 178320 - DNA, 103 bp, Artificial Sequence
  Synthetic Polynucleotide
taatacgactcactatagggattggcaaagtcaaaacggggccggtccttaacagaggagaaaggacatgccccgttttaacctggcggcagcgcaaaagatg

SEQ ID NO: 178321 - DNA, 103 bp, Artificial Sequence
  Synthetic Polynucleotide
taatacgactcactatagggccaccgccaaattggcaaagtcaaaacgggaacagaggagacccgttatgactttgccaaacctggcggcagcgcaaaagatg

SEQ ID NO: 178322 - DNA, 103 bp, Artificial Sequence
  Synthetic Polynucleotide
taatacgactcactatagggtgcgtggcagccaccgccaaattggcaaagaacagaggagactttgcatgtttggcggtaacctggcggcagcgcaaaagatg

SEQ ID NO: 178323 - DNA, 103 bp, Artificial Sequence
  Synthetic Polynucleotide
taatacgactcactatagggcggatcctcttgcgtggcagccaccgccaaaacagaggagattggcgatggctgccacgaacctggcggcagcgcaaaagatg

SEQ ID NO: 178324 - DNA, 103 bp, Artificial Sequence
  Synthetic Polynucleotide
taatacgactcactatagggccatcttaggcggatcctcttgcgtggcagaacagaggagactgccaatgaagaggatcaacctggcggcagcgcaaaagatg

SEQ ID NO: 178325 - DNA, 103 bp, Artificial Sequence
  Synthetic Polynucleotide
taatacgactcactatagggctcaggtctcccatcttaggcggatcctctaacagaggagaagaggaatggcctaagataacctggcggcagcgcaaaagatg

SEQ ID NO: 178326 - DNA, 103 bp, Artificial Sequence
  Synthetic Polynucleotide
taatacgactcactatagggattggtgagctgcagcgacgggtggagcggaacagaggagaccgctcatgccgtcgctgaacctggcggcagcgcaaaagatg

SEQ ID NO: 178327 - DNA, 103 bp, Artificial Sequence
  Synthetic Polynucleotide
taatacgactcactataggggctcagcttgctcaggtctcccatcttaggaacagaggagacctaagatgggagacctgaacctggcggcagcgcaaaagatg

SEQ ID NO: 178328 - DNA, 103 bp, Artificial Sequence
  Synthetic Polynucleotide
taatacgactcactatagggccagtcctgggctcagcttgctcaggtctcaacagaggagagagaccatggcaagctgaaacctggcggcagcgcaaaagatg

SEQ ID NO: 178329 - DNA, 103 bp, Artificial Sequence
  Synthetic Polynucleotide
taatacgactcactatagggatggggctacccagtcctgggctcagcttgaacagaggagacaagctatgcccaggactaacctggcggcagcgcaaaagatg

SEQ ID NO: 178330 - DNA, 103 bp, Artificial Sequence
  Synthetic Polynucleotide
taatacgactcactataggggaggcccgagatggggctacccagtcctggaacagaggagaccaggaatgggtagccccaacctggcggcagcgcaaaagatg

SEQ ID NO: 178331 - DNA, 103 bp, Artificial Sequence
  Synthetic Polynucleotide
taatacgactcactatagggtcaatttactgaggcccgagatggggctacaacagaggagagtagccatgtctcgggccaacctggcggcagcgcaaaagatg

SEQ ID NO: 178332 - DNA, 103 bp, Artificial Sequence
  Synthetic Polynucleotide
taatacgactcactatagggctgtccggagtcaatttactgaggcccgagaacagaggagactcgggatgcagtaaattaacctggcggcagcgcaaaagatg

SEQ ID NO: 178333 - DNA, 103 bp, Artificial Sequence
  Synthetic Polynucleotide
taatacgactcactatagggagagggctttctgtccggagtcaatttactaacagaggagaagtaaaatgactccggacaacctggcggcagcgcaaaagatg

SEQ ID NO: 178334 - DNA, 103 bp, Artificial Sequence
  Synthetic Polynucleotide
taatacgactcactatagggaccttcctcgagagggctttctgtccggagaacagaggagactccggatggaaagccctaacctggcggcagcgcaaaagatg

SEQ ID NO: 178335 - DNA, 103 bp, Artificial Sequence
  Synthetic Polynucleotide
taatacgactcactatagggttggagggcaaccttcctcgagagggctttaacagaggagaaaagccatgtcgaggaagaacctggcggcagcgcaaaagatg

SEQ ID NO: 178336 - DNA, 103 bp, Artificial Sequence
  Synthetic Polynucleotide
taatacgactcactatagggttttttcgttttggagggcaaccttcctcgaacagaggagacgaggaatgttgccctccaacctggcggcagcgcaaaagatg

SEQ ID NO: 178337 - DNA, 103 bp, Artificial Sequence
  Synthetic Polynucleotide
taatacgactcactatagggggaaggagtaattggtgagctgcagcgacgaacagaggagacgtcgcatgagctcaccaaacctggcggcagcgcaaaagatg

SEQ ID NO: 178338 - DNA, 103 bp, Artificial Sequence
  Synthetic Polynucleotide
taatacgactcactatagggagataaactcttttttcgttttggagggcaaacagaggagatgccctatgaaacgaaaaaacctggcggcagcgcaaaagatg

SEQ ID NO: 178339 - DNA, 103 bp, Artificial Sequence
  Synthetic Polynucleotide
taatacgactcactatagggcaaaacttgcagataaactcttttttcgttaacagaggagaaacgaaatgagagtttataacctggcggcagcgcaaaagatg

SEQ ID NO: 178340 - DNA, 103 bp, Artificial Sequence
  Synthetic Polynucleotide
taatacgactcactataggggtgtctgccgcaaaacttgcagataaactcaacagaggagagagtttatgtgcaagtttaacctggcggcagcgcaaaagatg

SEQ ID NO: 178341 - DNA, 103 bp, Artificial Sequence
  Synthetic Polynucleotide
taatacgactcactatagggatttggtaaagtgtctgccgcaaaacttgcaacagaggagagcaagtatggcggcagacaacctggcggcagcgcaaaagatg

SEQ ID NO: 178342 - DNA, 103 bp, Artificial Sequence
  Synthetic Polynucleotide
taatacgactcactatagggaaattgtaggatttggtaaagtgtctgccgaacagaggagacggcagatgctttaccaaaacctggcggcagcgcaaaagatg

SEQ ID NO: 178343 - DNA, 103 bp, Artificial Sequence
  Synthetic Polynucleotide
taatacgactcactatagggatggatgagcaaattgtaggatttggtaaaaacagaggagatttaccatgtcctacaataacctggcggcagcgcaaaagatg

SEQ ID NO: 178344 - DNA, 103 bp, Artificial Sequence
  Synthetic Polynucleotide
taatacgactcactataggggggtcctctcatggatgagcaaattgtaggaacagaggagacctacaatgtgctcatccaacctggcggcagcgcaaaagatg

SEQ ID NO: 178345 - DNA, 103 bp, Artificial Sequence
  Synthetic Polynucleotide
taatacgactcactatagggtcgtccgtgtgggtcctctcatggatgagcaacagaggagagctcatatgtgagaggacaacctggcggcagcgcaaaagatg

SEQ ID NO: 178346 - DNA, 103 bp, Artificial Sequence
  Synthetic Polynucleotide
taatacgactcactataggggtacggcctctcgtccgtgtgggtcctctcaacagaggagagagaggatgcacacggacaacctggcggcagcgcaaaagatg

SEQ ID NO: 178347 - DNA, 103 bp, Artificial Sequence
  Synthetic Polynucleotide
taatacgactcactatagggtgtcacacgtgtacggcctctcgtccgtgtaacagaggagaacacggatgagaggccgtaacctggcggcagcgcaaaagatg

SEQ ID NO: 178348 - DNA, 103 bp, Artificial Sequence
  Synthetic Polynucleotide
taatacgactcactatagggacggcctgcaggaaggagtaattggtgagcaacagaggagagctcacatgttactccttaacctggcggcagcgcaaaagatg

SEQ ID NO: 178349 - DNA, 103 bp, Artificial Sequence
  Synthetic Polynucleotide
taatacgactcactatagggttgtggcagatgtcacacgtgtacggcctcaacagaggagagaggccatgcacgtgtgaaacctggcggcagcgcaaaagatg

SEQ ID NO: 178350 - DNA, 103 bp, Artificial Sequence
  Synthetic Polynucleotide
taatacgactcactatagggccggaaggccttgtggcagatgtcacacgtaacagaggagaacgtgtatgatctgccacaacctggcggcagcgcaaaagatg

SEQ ID NO: 178351 - DNA, 103 bp, Artificial Sequence
  Synthetic Polynucleotide
taatacgactcactataggggatcttgcctccggaaggccttgtggcagaaacagaggagatctgccatgaggccttccaacctggcggcagcgcaaaagatg

SEQ ID NO: 178352 - DNA, 103 bp, Artificial Sequence
  Synthetic Polynucleotide
taatacgactcactatagggtcccgcaggtgatcttgcctccggaaggccaacagaggagaggccttatggaggcaagaaacctggcggcagcgcaaaagatg

SEQ ID NO: 178353 - DNA, 103 bp, Artificial Sequence
  Synthetic Polynucleotide
taatacgactcactataggggtatctgtgatcccgcaggtgatcttgcctaacagaggagaaggcaaatgcacctgcggaacctggcggcagcgcaaaagatg

SEQ ID NO: 178354 - DNA, 103 bp, Artificial Sequence
  Synthetic Polynucleotide
taatacgactcactatagggtggaatggatgtatctgtgatcccgcaggtaacagaggagaacctgcatgatcacagataacctggcggcagcgcaaaagatg

SEQ ID NO: 178355 - DNA, 103 bp, Artificial Sequence
  Synthetic Polynucleotide
taatacgactcactatagggggtttttctttggaatggatgtatctgtgaaacagaggagatcacagatgcatccattcaacctggcggcagcgcaaaagatg

SEQ ID NO: 178356 - DNA, 103 bp, Artificial Sequence
  Synthetic Polynucleotide
taatacgactcactatagggacatttgaagggtttttctttggaatggataacagaggagaatccatatgaaagaaaaaaacctggcggcagcgcaaaagatg

SEQ ID NO: 178357 - DNA, 103 bp, Artificial Sequence
  Synthetic Polynucleotide
taatacgactcactatagggcacactcctgacatttgaagggtttttcttaacagaggagaaagaaaatgccttcaaataacctggcggcagcgcaaaagatg

SEQ ID NO: 178358 - DNA, 103 bp, Artificial Sequence
  Synthetic Polynucleotide
taatacgactcactatagggaatcctttcccacactcctgacatttgaagaacagaggagacttcaaatgtcaggagtgaacctggcggcagcgcaaaagatg

SEQ ID NO: 178359 - DNA, 103 bp, Artificial Sequence
  Synthetic Polynucleotide
taatacgactcactataggggaaggtgttcacggcctgcaggaaggagtaaacagaggagatactccatgctgcaggccaacctggcggcagcgcaaaagatg

SEQ ID NO: 178360 - DNA, 103 bp, Artificial Sequence
  Synthetic Polynucleotide
taatacgactcactatagggagactgacaaaatcctttcccacactcctgaacagaggagacaggagatggggaaaggaaacctggcggcagcgcaaaagatg

SEQ ID NO: 178361 - DNA, 103 bp, Artificial Sequence
  Synthetic Polynucleotide
taatacgactcactatagggctagagttctagactgacaaaatcctttccaacagaggagaggaaagatgtttgtcagtaacctggcggcagcgcaaaagatg

SEQ ID NO: 178362 - DNA, 103 bp, Artificial Sequence
  Synthetic Polynucleotide
taatacgactcactatagggttgtgaactgctagagttctagactgacaaaacagaggagattgtcaatgtagaactctaacctggcggcagcgcaaaagatg

SEQ ID NO: 178363 - DNA, 103 bp, Artificial Sequence
  Synthetic Polynucleotide
taatacgactcactataggggtgtaaagttttgtgaactgctagagttctaacagaggagaagaactatggcagttcacaacctggcggcagcgcaaaagatg

SEQ ID NO: 178364 - DNA, 103 bp, Artificial Sequence
  Synthetic Polynucleotide
taatacgactcactatagggattcctgcatgtgtaaagttttgtgaactgaacagaggagacagttcatgaaactttacaacctggcggcagcgcaaaagatg

SEQ ID NO: 178365 - DNA, 103 bp, Artificial Sequence
  Synthetic Polynucleotide
taatacgactcactatagggttgtgtggagattcctgcatgtgtaaagttaacagaggagaaactttatgcatgcaggaaacctggcggcagcgcaaaagatg

SEQ ID NO: 178366 - DNA, 103 bp, Artificial Sequence
  Synthetic Polynucleotide
taatacgactcactatagggtgtgggacatttgtgtggagattcctgcataacagaggagaatgcagatgtctccacacaacctggcggcagcgcaaaagatg

SEQ ID NO: 178367 - DNA, 103 bp, Artificial Sequence
  Synthetic Polynucleotide
taatacgactcactatagggttcttccacatgtgggacatttgtgtggagaacagaggagactccacatgaatgtcccaaacctggcggcagcgcaaaagatg

SEQ ID NO: 178368 - DNA, 103 bp, Artificial Sequence
  Synthetic Polynucleotide
taatacgactcactatagggtgattaaaggttcttccacatgtgggacataacagaggagaatgtccatgatgtggaagaacctggcggcagcgcaaaagatg

SEQ ID NO: 178369 - DNA, 103 bp, Artificial Sequence
  Synthetic Polynucleotide
taatacgactcactatagggattacttctctgattaaaggttcttccacaaacagaggagatgtggaatgacctttaataacctggcggcagcgcaaaagatg

SEQ ID NO: 178370 - DNA, 103 bp, Artificial Sequence
  Synthetic Polynucleotide
taatacgactcactatagggccgtggccgggaaggtgttcacggcctgcaaacagaggagatgcaggatgtgaacacctaacctggcggcagcgcaaaagatg

SEQ ID NO: 178371 - DNA, 103 bp, Artificial Sequence
  Synthetic Polynucleotide
taatacgactcactataggggagttttcagattacttctctgattaaaggaacagaggagacctttaatgagagaagtaaacctggcggcagcgcaaaagatg

SEQ ID NO: 178372 - DNA, 103 bp, Artificial Sequence
  Synthetic Polynucleotide
taatacgactcactataggggtgagaaggtgagttttcagattacttctcaacagaggagagagaagatgtctgaaaacaacctggcggcagcgcaaaagatg

SEQ ID NO: 178373 - DNA, 103 bp, Artificial Sequence
  Synthetic Polynucleotide
taatacgactcactataggggtctgtatgggtgagaaggtgagttttcagaacagaggagactgaaaatgcaccttctcaacctggcggcagcgcaaaagatg

SEQ ID NO: 178374 - DNA, 103 bp, Artificial Sequence
  Synthetic Polynucleotide
taatacgactcactatagggagggcttgatgtctgtatgggtgagaaggtaacagaggagaaccttcatgcccatacagaacctggcggcagcgcaaaagatg

SEQ ID NO: 178375 - DNA, 103 bp, Artificial Sequence
  Synthetic Polynucleotide
taatacgactcactatagggtcgcagctgtagggcttgatgtctgtatggaacagaggagaccatacatgcatcaagccaacctggcggcagcgcaaaagatg

SEQ ID NO: 178376 - DNA, 103 bp, Artificial Sequence
  Synthetic Polynucleotide
taatacgactcactataggggccgcactgctcgcagctgtagggcttgataacagaggagaatcaagatgtacagctgcaacctggcggcagcgcaaaagatg

SEQ ID NO: 178377 - DNA, 103 bp, Artificial Sequence
  Synthetic Polynucleotide
taatacgactcactatagggtgaacactttgccgcactgctcgcagctgtaacagaggagaacagctatgagcagtgcgaacctggcggcagcgcaaaagatg

SEQ ID NO: 178378 - DNA, 103 bp, Artificial Sequence
  Synthetic Polynucleotide
taatacgactcactatagggcagtttcgcctgaacactttgccgcactgcaacagaggagagcagtgatgcaaagtgttaacctggcggcagcgcaaaagatg

SEQ ID NO: 178379 - DNA, 103 bp, Artificial Sequence
  Synthetic Polynucleotide
taatacgactcactatagggccgcagatcacagtttcgcctgaacactttaacagaggagaaaagtgatgaggcgaaacaacctggcggcagcgcaaaagatg

SEQ ID NO: 178380 - DNA, 103 bp, Artificial Sequence
  Synthetic Polynucleotide
taatacgactcactatagggggctgtgccgccgcagatcacagtttcgccaacagaggagaggcgaaatggtgatctgcaacctggcggcagcgcaaaagatg

SEQ ID NO: 178381 - DNA, 103 bp, Artificial Sequence
  Synthetic Polynucleotide
taatacgactcactatagggaggtggtccaccgtggccgggaaggtgttcaacagaggagagaacacatgcccggccacaacctggcggcagcgcaaaagatg

SEQ ID NO: 178382 - DNA, 103 bp, Artificial Sequence
  Synthetic Polynucleotide
taatacgactcactataggggtgtgagtcaggctgtgccgccgcagatcaaacagaggagatgatctatggcggcacagaacctggcggcagcgcaaaagatg

SEQ ID NO: 178383 - DNA, 103 bp, Artificial Sequence
  Synthetic Polynucleotide
taatacgactcactatagggctgccgcggggtgtgagtcaggctgtgccgaacagaggagacggcacatgctgactcacaacctggcggcagcgcaaaagatg

SEQ ID NO: 178384 - DNA, 103 bp, Artificial Sequence
  Synthetic Polynucleotide
taatacgactcactataggggtatgggggttgtttgaggtaagacatcataacagaggagaatgatgatgtacctcaaaaacctggcggcagcgcaaaagatg

SEQ ID NO: 178385 - DNA, 103 bp, Artificial Sequence
  Synthetic Polynucleotide
taatacgactcactatagggccgccgctgcttccgcggagtggccggataaacagaggagatatccgatgactccgcggaacctggcggcagcgcaaaagatg

SEQ ID NO: 178386 - DNA, 103 bp, Artificial Sequence
  Synthetic Polynucleotide
taatacgactcactatagggacagtcgggggagttgaagttgagtttccaaacagaggagatggaaaatgaacttcaacaacctggcggcagcgcaaaagatg

SEQ ID NO: 178387 - DNA, 103 bp, Artificial Sequence
  Synthetic Polynucleotide
taatacgactcactatagggtatagtccagacagtcgggggagttgaagtaacagaggagaacttcaatgcccccgactaacctggcggcagcgcaaaagatg

SEQ ID NO: 178388 - DNA, 103 bp, Artificial Sequence
  Synthetic Polynucleotide
taatacgactcactataggggcttggtccttatagtccagacagtcggggaacagaggagaccccgaatgtctggactaaacctggcggcagcgcaaaagatg

SEQ ID NO: 178389 - DNA, 103 bp, Artificial Sequence
  Synthetic Polynucleotide
taatacgactcactatagggccgccatgaggcttggtccttatagtccagaacagaggagactggacatgaaggaccaaaacctggcggcagcgcaaaagatg

SEQ ID NO: 178390 - DNA, 103 bp, Artificial Sequence
  Synthetic Polynucleotide
taatacgactcactatagggagacctggaaccgccatgaggcttggtcctaacagaggagaaggaccatgcctcatggcaacctggcggcagcgcaaaagatg

SEQ ID NO: 178391 - DNA, 103 bp, Artificial Sequence
  Synthetic Polynucleotide
taatacgactcactatagggtggtgcgctcccgccgctgcttccgcggagaacagaggagactccgcatgagcagcggcaacctggcggcagcgcaaaagatg

SEQ ID NO: 178392 - DNA, 103 bp, Artificial Sequence
  Synthetic Polynucleotide
taatacgactcactatagggcgcgtgaaggtggtgcgctcccgccgctgcaacagaggagagcagcgatgggagcgcacaacctggcggcagcgcaaaagatg

SEQ ID NO: 178393 - DNA, 103 bp, Artificial Sequence
  Synthetic Polynucleotide
taatacgactcactatagggcagctgtgaacgcgtgaaggtggtgcgctcaacagaggagagagcgcatgaccttcacgaacctggcggcagcgcaaaagatg

SEQ ID NO: 178394 - DNA, 103 bp, Artificial Sequence
  Synthetic Polynucleotide
taatacgactcactatagggcgagcacgtccagctgtgaacgcgtgaaggaacagaggagaccttcaatggttcacagcaacctggcggcagcgcaaaagatg

SEQ ID NO: 178395 - DNA, 103 bp, Artificial Sequence
  Synthetic Polynucleotide
taatacgactcactatagggaagagcgcctcgagcacgtccagctgtgaaaacagaggagattcacaatgggacgtgctaacctggcggcagcgcaaaagatg

SEQ ID NO: 178396 - DNA, 103 bp, Artificial Sequence
  Synthetic Polynucleotide
taatacgactcactatagggagtcttggcgaagagcgcctcgagcacgtcaacagaggagagacgtgatggaggcgctcaacctggcggcagcgcaaaagatg

SEQ ID NO: 178397 - DNA, 103 bp, Artificial Sequence
  Synthetic Polynucleotide
taatacgactcactatagggcagggtagcgagtcttggcgaagagcgcctaacagaggagaaggcgcatgtcgccaagaaacctggcggcagcgcaaaagatg

SEQ ID NO: 178398 - DNA, 103 bp, Artificial Sequence
  Synthetic Polynucleotide
taatacgactcactatagggatgaagatgtcagggtagcgagtcttggcgaacagaggagacgccaaatgtcgctacccaacctggcggcagcgcaaaagatg

SEQ ID NO: 178399 - DNA, 103 bp, Artificial Sequence
  Synthetic Polynucleotide
taatacgactcactatagggctcctcccgcatgaagatgtcagggtagcgaacagaggagacgctacatggacatcttcaacctggcggcagcgcaaaagatg

SEQ ID NO: 178400 - DNA, 103 bp, Artificial Sequence
  Synthetic Polynucleotide
taatacgactcactatagggcgttcatgccgtatgggggttgtttgaggtaacagaggagaacctcaatgaacccccataacctggcggcagcgcaaaagatg

SEQ ID NO: 178401 - DNA, 103 bp, Artificial Sequence
  Synthetic Polynucleotide
taatacgactcactatagggtgagcgccacctcctcccgcatgaagatgtaacagaggagaacatctatgtgcgggaggaacctggcggcagcgcaaaagatg

SEQ ID NO: 178402 - DNA, 103 bp, Artificial Sequence
  Synthetic Polynucleotide
taatacgactcactatagggaggttgatcttgagcgccacctcctcccgcaacagaggagagcgggaatgggtggcgctaacctggcggcagcgcaaaagatg

SEQ ID NO: 178403 - DNA, 103 bp, Artificial Sequence
  Synthetic Polynucleotide
taatacgactcactatagggagactccggcaggttgatcttgagcgccacaacagaggagagtggcgatgaagatcaacaacctggcggcagcgcaaaagatg

SEQ ID NO: 178404 - DNA, 103 bp, Artificial Sequence
  Synthetic Polynucleotide
taatacgactcactatagggcctggactctagactccggcaggttgatctaacagaggagaagatcaatgtgccggagtaacctggcggcagcgcaaaagatg

SEQ ID NO: 178405 - DNA, 103 bp, Artificial Sequence
  Synthetic Polynucleotide
taatacgactcactatagggttgaaccagacctggactctagactccggcaacagaggagagccggaatgtagagtccaaacctggcggcagcgcaaaagatg

SEQ ID NO: 178406 - DNA, 103 bp, Artificial Sequence
  Synthetic Polynucleotide
taatacgactcactataggggcggcggttcttgaaccagacctggactctaacagaggagaagagtcatggtctggttcaacctggcggcagcgcaaaagatg

SEQ ID NO: 178407 - DNA, 103 bp, Artificial Sequence
  Synthetic Polynucleotide
taatacgactcactatagggggcatttggcgcggcggttcttgaaccagaaacagaggagatctggtatgagaaccgccaacctggcggcagcgcaaaagatg

SEQ ID NO: 178408 - DNA, 103 bp, Artificial Sequence
  Synthetic Polynucleotide
taatacgactcactatagggtgctgctggcggcatttggcgcggcggttcaacagaggagagaaccgatgcgccaaatgaacctggcggcagcgcaaaagatg

SEQ ID NO: 178409 - DNA, 103 bp, Artificial Sequence
  Synthetic Polynucleotide
taatacgactcactatagggcccgctctgctgctgctggcggcatttggcaacagaggagagccaaaatgcgccagcagaacctggcggcagcgcaaaagatg

SEQ ID NO: 178410 - DNA, 103 bp, Artificial Sequence
  Synthetic Polynucleotide
taatacgactcactatagggtggttccgctcccgctctgctgctgctggcaacagaggagagccagcatgagcagagcgaacctggcggcagcgcaaaagatg

SEQ ID NO: 178411 - DNA, 103 bp, Artificial Sequence
  Synthetic Polynucleotide
taatacgactcactatagggaggcccagcccgttcatgccgtatgggggtaacagaggagaacccccatgcggcatgaaaacctggcggcagcgcaaaagatg

SEQ ID NO: 178412 - DNA, 103 bp, Artificial Sequence
  Synthetic Polynucleotide
taatacgactcactataggggggcggctcttggttccgctcccgctctgcaacagaggagagcagagatggagcggaacaacctggcggcagcgcaaaagatg

SEQ ID NO: 178413 - DNA, 103 bp, Artificial Sequence
  Synthetic Polynucleotide
taatacgactcactatagggcttcttggctgggcggctcttggttccgctaacagaggagaagcggaatgaagagccgcaacctggcggcagcgcaaaagatg

SEQ ID NO: 178414 - DNA, 103 bp, Artificial Sequence
  Synthetic Polynucleotide
taatacgactcactataggggagaggacttcttcttggctgggcggctctaacagaggagaagagccatgcagccaagaaacctggcggcagcgcaaaagatg

SEQ ID NO: 178415 - DNA, 103 bp, Artificial Sequence
  Synthetic Polynucleotide
taatacgactcactatagggtcccgcactggagaggacttcttcttggctaacagaggagaagccaaatggaagtcctcaacctggcggcagcgcaaaagatg

SEQ ID NO: 178416 - DNA, 103 bp, Artificial Sequence
  Synthetic Polynucleotide
taatacgactcactataggggcccgagctctcccgcactggagaggacttaacagaggagaaagtccatgccagtgcggaacctggcggcagcgcaaaagatg

SEQ ID NO: 178417 - DNA, 103 bp, Artificial Sequence
  Synthetic Polynucleotide
taatacgactcactatagggtgctttcggagcccgagctctcccgcactgaacagaggagacagtgcatgagagctcggaacctggcggcagcgcaaaagatg

SEQ ID NO: 178418 - DNA, 103 bp, Artificial Sequence
  Synthetic Polynucleotide
taatacgactcactatagggaattggccactgctttcggagcccgagctcaacagaggagagagctcatgctccgaaagaacctggcggcagcgcaaaagatg

SEQ ID NO: 178419 - DNA, 103 bp, Artificial Sequence
  Synthetic Polynucleotide
taatacgactcactatagggtggcggcgtgaattggccactgctttcggaaacagaggagatccgaaatgagtggccaaaacctggcggcagcgcaaaagatg

SEQ ID NO: 178420 - DNA, 103 bp, Artificial Sequence
  Synthetic Polynucleotide
taatacgactcactatagggtggacacagctggcggcgtgaattggccacaacagaggagagtggccatgtcacgccgcaacctggcggcagcgcaaaagatg

SEQ ID NO: 178421 - DNA, 103 bp, Artificial Sequence
  Synthetic Polynucleotide
taatacgactcactataggggaggcagagctggacacagctggcggcgtgaacagaggagacacgccatgagctgtgtcaacctggcggcagcgcaaaagatg

SEQ ID NO: 178422 - DNA, 103 bp, Artificial Sequence
  Synthetic Polynucleotide
taatacgactcactataggggggcccggccaggcccagcccgttcatgccaacagaggagaggcatgatggggctgggcaacctggcggcagcgcaaaagatg

SEQ ID NO: 178423 - DNA, 103 bp, Artificial Sequence
  Synthetic Polynucleotide
taatacgactcactataggggctagaggacgaggcagagctggacacagcaacagaggagagctgtgatgagctctgccaacctggcggcagcgcaaaagatg

SEQ ID NO: 178424 - DNA, 103 bp, Artificial Sequence
  Synthetic Polynucleotide
taatacgactcactatagggtggacgccgagctagaggacgaggcagagcaacagaggagagctctgatgcgtcctctaaacctggcggcagcgcaaaagatg

SEQ ID NO: 178425 - DNA, 103 bp, Artificial Sequence
  Synthetic Polynucleotide
taatacgactcactataggggcggaagagctggacgccgagctagaggacaacagaggagagtcctcatgctcggcgtcaacctggcggcagcgcaaaagatg

SEQ ID NO: 178426 - DNA, 103 bp, Artificial Sequence
  Synthetic Polynucleotide
taatacgactcactatagggcgctgggttggcggaagagctggacgccgaaacagaggagatcggcgatgagctcttccaacctggcggcagcgcaaaagatg

SEQ ID NO: 178427 - DNA, 103 bp, Artificial Sequence
  Synthetic Polynucleotide
taatacgactcactatagggccgctgcagccgctgggttggcggaagagcaacagaggagagctcttatgccaacccagaacctggcggcagcgcaaaagatg

SEQ ID NO: 178428 - DNA, 103 bp, Artificial Sequence
  Synthetic Polynucleotide
taatacgactcactatagggagtcccgcagccgctgcagccgctgggttgaacagaggagacaacccatgggctgcagcaacctggcggcagcgcaaaagatg

SEQ ID NO: 178429 - DNA, 103 bp, Artificial Sequence
  Synthetic Polynucleotide
taatacgactcactataggggttcccacctagtcccgcagccgctgcagcaacagaggagagctgcaatggctgcgggaaacctggcggcagcgcaaaagatg

SEQ ID NO: 178430 - DNA, 103 bp, Artificial Sequence
  Synthetic Polynucleotide
taatacgactcactatagggccgccaccgggttcccacctagtcccgcagaacagaggagactgcggatgtaggtgggaaacctggcggcagcgcaaaagatg

SEQ ID NO: 178431 - DNA, 103 bp, Artificial Sequence
  Synthetic Polynucleotide
taatacgactcactataggggacgacgcggccgccaccgggttcccacctaacagaggagaaggtggatgcccggtggcaacctggcggcagcgcaaaagatg

SEQ ID NO: 178432 - DNA, 103 bp, Artificial Sequence
  Synthetic Polynucleotide
taatacgactcactatagggtgtactcagcgacgacgcggccgccaccggaacagaggagaccggtgatggccgcgtcgaacctggcggcagcgcaaaagatg

SEQ ID NO: 178433 - DNA, 103 bp, Artificial Sequence
  Synthetic Polynucleotide
taatacgactcactatagggggtccatggcgggcccggccaggcccagccaacagaggagaggctggatgtggccgggcaacctggcggcagcgcaaaagatg

SEQ ID NO: 178434 - DNA, 103 bp, Artificial Sequence
  Synthetic Polynucleotide
taatacgactcactatagggaggcagctggtgtactcagcgacgacgcggaacagaggagaccgcgtatgcgctgagtaaacctggcggcagcgcaaaagatg

SEQ ID NO: 178435 - DNA, 103 bp, Artificial Sequence
  Synthetic Polynucleotide
taatacgactcactatagggcagatagatgaggcagctggtgtactcagcaacagaggagagctgagatgaccagctgcaacctggcggcagcgcaaaagatg

SEQ ID NO: 178436 - DNA, 103 bp, Artificial Sequence
  Synthetic Polynucleotide
taatacgactcactatagggggccgggctccagatagatgaggcagctggaacagaggagaccagctatgtcatctatcaacctggcggcagcgcaaaagatg

SEQ ID NO: 178437 - DNA, 103 bp, Artificial Sequence
  Synthetic Polynucleotide
taatacgactcactataggggcgagatggaggccgggctccagatagatgaacagaggagacatctaatgggagcccggaacctggcggcagcgcaaaagatg

SEQ ID NO: 178438 - DNA, 103 bp, Artificial Sequence
  Synthetic Polynucleotide
taatacgactcactataggggctgagcctggcgagatggaggccgggctcaacagaggagagagcccatgctccatctcaacctggcggcagcgcaaaagatg

SEQ ID NO: 178439 - DNA, 103 bp, Artificial Sequence
  Synthetic Polynucleotide
taatacgactcactatagggggacgcgggcgctgagcctggcgagatggaaacagaggagatccatcatgccaggctcaaacctggcggcagcgcaaaagatg

SEQ ID NO: 178440 - DNA, 103 bp, Artificial Sequence
  Synthetic Polynucleotide
taatacgactcactataggggcaccgacacggacgcgggcgctgagcctgaacagaggagacaggctatgcgcccgcgtaacctggcggcagcgcaaaagatg

SEQ ID NO: 178441 - DNA, 103 bp, Artificial Sequence
  Synthetic Polynucleotide
taatacgactcactatagggaatggctccggcaccgacacggacgcgggcaacagaggagagcccgcatgcgtgtcggtaacctggcggcagcgcaaaagatg

SEQ ID NO: 178442 - DNA, 103 bp, Artificial Sequence
  Synthetic Polynucleotide
taatacgactcactatagggaggcgcggccaatggctccggcaccgacacaacagaggagagtgtcgatgccggagccaaacctggcggcagcgcaaaagatg

SEQ ID NO: 178443 - DNA, 103 bp, Artificial Sequence
  Synthetic Polynucleotide
taatacgactcactatagggaggtgttgctaggcgcggccaatggctccgaacagaggagacggagcatgtggccgcgcaacctggcggcagcgcaaaagatg

SEQ ID NO: 178444 - DNA, 103 bp, Artificial Sequence
  Synthetic Polynucleotide
taatacgactcactataggggggtgcaggaggtccatggcgggcccggccaacagaggagaggccggatgcgccatggaaacctggcggcagcgcaaaagatg

SEQ ID NO: 178445 - DNA, 103 bp, Artificial Sequence
  Synthetic Polynucleotide
taatacgactcactatagggtgcatacacgaggtgttgctaggcgcggccaacagaggagaggccgcatgtagcaacacaacctggcggcagcgcaaaagatg

SEQ ID NO: 178446 - DNA, 103 bp, Artificial Sequence
  Synthetic Polynucleotide
taatacgactcactatagggtacggagcgctgcatacacgaggtgttgctaacagaggagaagcaacatgtcgtgtatgaacctggcggcagcgcaaaagatg

SEQ ID NO: 178447 - DNA, 103 bp, Artificial Sequence
  Synthetic Polynucleotide
taatacgactcactatagggcgcctgcagctacggagcgctgcatacacgaacagaggagacgtgtaatgagcgctccgaacctggcggcagcgcaaaagatg

SEQ ID NO: 178448 - DNA, 103 bp, Artificial Sequence
  Synthetic Polynucleotide
taatacgactcactataggggcggtggcggcgcctgcagctacggagcgcaacagaggagagcgctcatgagctgcaggaacctggcggcagcgcaaaagatg

SEQ ID NO: 178449 - DNA, 103 bp, Artificial Sequence
  Synthetic Polynucleotide
taatacgactcactatagggagaggctgctgcggtggcggcgcctgcagcaacagaggagagctgcaatggccgccaccaacctggcggcagcgcaaaagatg

SEQ ID NO: 178450 - DNA, 103 bp, Artificial Sequence
  Synthetic Polynucleotide
taatacgactcactatagggacatgggataagaggctgctgcggtggcggaacagaggagaccgccaatgcagcagcctaacctggcggcagcgcaaaagatg

SEQ ID NO: 178451 - DNA, 103 bp, Artificial Sequence
  Synthetic Polynucleotide
taatacgactcactatagggtggccgtaggacatgggataagaggctgctaacagaggagaagcagcatgttatcccataacctggcggcagcgcaaaagatg

SEQ ID NO: 178452 - DNA, 103 bp, Artificial Sequence
  Synthetic Polynucleotide
taatacgactcactataggggctgccgccctggccgtaggacatgggataaacagaggagatatcccatgtcctacggcaacctggcggcagcgcaaaagatg

SEQ ID NO: 178453 - DNA, 103 bp, Artificial Sequence
  Synthetic Polynucleotide
taatacgactcactatagggcttggccgtagctgccgccctggccgtaggaacagaggagacctacgatgagggcggcaaacctggcggcagcgcaaaagatg

SEQ ID NO: 178454 - DNA, 103 bp, Artificial Sequence
  Synthetic Polynucleotide
taatacgactcactataggggtagggtagccttggccgtagctgccgcccaacagaggagagggcggatgctacggccaaacctggcggcagcgcaaaagatg

SEQ ID NO: 178455 - DNA, 103 bp, Artificial Sequence
  Synthetic Polynucleotide
taatacgactcactataggggcccacggatgggtgcaggaggtccatggcaacagaggagagccatgatgctcctgcacaacctggcggcagcgcaaaagatg

SEQ ID NO: 178456 - DNA, 103 bp, Artificial Sequence
  Synthetic Polynucleotide
taatacgactcactatagggagaggagggcgtagggtagccttggccgtaaacagaggagatacggcatgggctaccctaacctggcggcagcgcaaaagatg

SEQ ID NO: 178457 - DNA, 103 bp, Artificial Sequence
  Synthetic Polynucleotide
taatacgactcactatagggcaaagtaggaagaggagggcgtagggtagcaacagaggagagctaccatgcgccctcctaacctggcggcagcgcaaaagatg

SEQ ID NO: 178458 - DNA, 103 bp, Artificial Sequence
  Synthetic Polynucleotide
taatacgactcactatagggtccacgccgccaaagtaggaagaggagggcaacagaggagagccctcatgttcctacttaacctggcggcagcgcaaaagatg

SEQ ID NO: 178459 - DNA, 103 bp, Artificial Sequence
  Synthetic Polynucleotide
taatacgactcactatagggtgagctgcagtccacgccgccaaagtaggaaacagaggagatcctacatgggcggcgtgaacctggcggcagcgcaaaagatg

SEQ ID NO: 178460 - DNA, 103 bp, Artificial Sequence
  Synthetic Polynucleotide
taatacgactcactataggggcgctaggtatgagctgcagtccacgccgcaacagaggagagcggcgatgactgcagctaacctggcggcagcgcaaaagatg

SEQ ID NO: 178461 - DNA, 103 bp, Artificial Sequence
  Synthetic Polynucleotide
taatacgactcactataggggagtgcatgggcgctaggtatgagctgcagaacagaggagactgcagatgatacctagcaacctggcggcagcgcaaaagatg

SEQ ID NO: 178462 - DNA, 103 bp, Artificial Sequence
  Synthetic Polynucleotide
taatacgactcactataggggtggtgatgtgagtgcatgggcgctaggtaaacagaggagatacctaatgcccatgcacaacctggcggcagcgcaaaagatg

SEQ ID NO: 178463 - DNA, 103 bp, Artificial Sequence
  Synthetic Polynucleotide
taatacgactcactataggggctggtgcgggtggtgatgtgagtgcatggaacagaggagaccatgcatgcacatcaccaacctggcggcagcgcaaaagatg

SEQ ID NO: 178464 - DNA, 103 bp, Artificial Sequence
  Synthetic Polynucleotide
taatacgactcactatagggatggggctgagctggtgcgggtggtgatgtaacagaggagaacatcaatgcccgcaccaaacctggcggcagcgcaaaagatg

SEQ ID NO: 178465 - DNA, 103 bp, Artificial Sequence
  Synthetic Polynucleotide
taatacgactcactatagggggagggtgccatggggctgagctggtgcggaacagaggagaccgcacatgctcagccccaacctggcggcagcgcaaaagatg

SEQ ID NO: 178466 - DNA, 103 bp, Artificial Sequence
  Synthetic Polynucleotide
taatacgactcactatagggtggccggatagcccacggatgggtgcaggaaacagaggagatcctgcatgcatccgtggaacctggcggcagcgcaaaagatg

SEQ ID NO: 178467 - DNA, 103 bp, Artificial Sequence
  Synthetic Polynucleotide
taatacgactcactatagggccgccatggaggagggtgccatggggctgaaacagaggagatcagccatgtggcaccctaacctggcggcagcgcaaaagatg

SEQ ID NO: 178468 - DNA, 103 bp, Artificial Sequence
  Synthetic Polynucleotide
taatacgactcactatagggtgatggtggcccgccatggaggagggtgccaacagaggagaggcaccatgctccatggcaacctggcggcagcgcaaaagatg

SEQ ID NO: 178469 - DNA, 103 bp, Artificial Sequence
  Synthetic Polynucleotide
taatacgactcactatagggtgggtggtgatgatggtggcccgccatggaaacagaggagatccatgatgggccaccataacctggcggcagcgcaaaagatg

SEQ ID NO: 178470 - DNA, 103 bp, Artificial Sequence
  Synthetic Polynucleotide
taatacgactcactatagggggtgcgcatgtgggtggtgatgatggtggcaacagaggagagccaccatgatcaccaccaacctggcggcagcgcaaaagatg

SEQ ID NO: 178471 - DNA, 103 bp, Artificial Sequence
  Synthetic Polynucleotide
taatacgactcactatagggctcaacgggtggtgcgcatgtgggtggtgaaacagaggagatcaccaatgacatgcgcaaacctggcggcagcgcaaaagatg

SEQ ID NO: 178472 - DNA, 103 bp, Artificial Sequence
  Synthetic Polynucleotide
taatacgactcactatagggtgaggactggctcaacgggtggtgcgcatgaacagaggagacatgcgatgcacccgttgaacctggcggcagcgcaaaagatg

SEQ ID NO: 178473 - DNA, 103 bp, Artificial Sequence
  Synthetic Polynucleotide
taatacgactcactatagggggtggtggcctgaggactggctcaacgggtaacagaggagaacccgtatggccagtcctaacctggcggcagcgcaaaagatg

SEQ ID NO: 178474 - DNA, 103 bp, Artificial Sequence
  Synthetic Polynucleotide
taatacgactcactatagggtgatggtggtggtggtggcctgaggactggaacagaggagaccagtcatgaggccaccaaacctggcggcagcgcaaaagatg

SEQ ID NO: 178475 - DNA, 103 bp, Artificial Sequence
  Synthetic Polynucleotide
taatacgactcactataggggtggtggtggtgatggtggtggtggtggccaacagaggagaggccacatgcaccaccataacctggcggcagcgcaaaagatg

SEQ ID NO: 178476 - DNA, 103 bp, Artificial Sequence
  Synthetic Polynucleotide
taatacgactcactatagggagccttggtggtggtggtggtgatggtggtaacagaggagaaccaccatgaccaccaccaacctggcggcagcgcaaaagatg

SEQ ID NO: 178477 - DNA, 103 bp, Artificial Sequence
  Synthetic Polynucleotide
taatacgactcactatagggttccgcggagtggccggatagcccacggataacagaggagaatccgtatgctatccggcaacctggcggcagcgcaaaagatg

SEQ ID NO: 178478 - DNA, 103 bp, Artificial Sequence
  Synthetic Polynucleotide
taatacgactcactataggggagccaccgtagccttggtggtggtggtggaacagaggagaccaccaatgccaccaaggaacctggcggcagcgcaaaagatg

SEQ ID NO: 178479 - DNA, 103 bp, Artificial Sequence
  Synthetic Polynucleotide
taatacgactcactatagggggcaagcccagagccaccgtagccttggtgaacagaggagacaccaaatgtacggtggcaacctggcggcagcgcaaaagatg

SEQ ID NO: 178480 - DNA, 103 bp, Artificial Sequence
  Synthetic Polynucleotide
taatacgactcactatagggcagagttgaaggcaagcccagagccaccgtaacagaggagaacggtgatgctgggcttgaacctggcggcagcgcaaaagatg

SEQ ID NO: 178481 - DNA, 103 bp, Artificial Sequence
  Synthetic Polynucleotide
taatacgactcactatagggaagcagtcggcagagttgaaggcaagcccaaacagaggagatgggctatgcttcaactcaacctggcggcagcgcaaaagatg

SEQ ID NO: 178482 - DNA, 103 bp, Artificial Sequence
  Synthetic Polynucleotide
taatacgactcactatagggcttgtaatccaagcagtcggcagagttgaaaacagaggagattcaacatggccgactgcaacctggcggcagcgcaaaagatg

SEQ ID NO: 178483 - DNA, 103 bp, Artificial Sequence
  Synthetic Polynucleotide
taatacgactcactatagggcgccaggctccttgtaatccaagcagtcggaacagaggagaccgactatgtggattacaaacctggcggcagcgcaaaagatg

SEQ ID NO: 178484 - DNA, 103 bp, Artificial Sequence
  Synthetic Polynucleotide
taatacgactcactataggggcagcagcggcgccaggctccttgtaatccaacagaggagaggattaatgggagcctggaacctggcggcagcgcaaaagatg

SEQ ID NO: 178485 - DNA, 103 bp, Artificial Sequence
  Synthetic Polynucleotide
taatacgactcactatagggggcggaggaagcagcagcggcgccaggctcaacagaggagagagcctatggccgctgctaacctggcggcagcgcaaaagatg

SEQ ID NO: 178486 - DNA, 103 bp, Artificial Sequence
  Synthetic Polynucleotide
taatacgactcactatagggtgagtttccaggcggaggaagcagcagcggaacagaggagaccgctgatgcttcctccgaacctggcggcagcgcaaaagatg

SEQ ID NO: 178487 - DNA, 103 bp, Artificial Sequence
  Synthetic Polynucleotide
taatacgactcactataggggagttgaagttgagtttccaggcggaggaaaacagaggagattcctcatgctggaaactaacctggcggcagcgcaaaagatg

SEQ ID NO: 178488 - DNA, 103 bp, Artificial Sequence
  Synthetic Polynucleotide
taatacgactcactataggggtaaggcggttgcttaagataagacatcataacagaggagaatgatgatgtatcttaagaacctggcggcagcgcaaaagatg

SEQ ID NO: 178489 - DNA, 103 bp, Artificial Sequence
  Synthetic Polynucleotide
taatacgactcactatagggtgcgggacaagaagcccagggccccgggtaaacagaggagatacccgatgccctgggctaacctggcggcagcgcaaaagatg

SEQ ID NO: 178490 - DNA, 103 bp, Artificial Sequence
  Synthetic Polynucleotide
taatacgactcactatagggggggggtggctgcgggacaagaagcccaggaacagaggagacctgggatgcttgtcccgaacctggcggcagcgcaaaagatg

SEQ ID NO: 178491 - DNA, 103 bp, Artificial Sequence
  Synthetic Polynucleotide
taatacgactcactatagggcgctgtttccggggggtggctgcgggacaaaacagaggagattgtccatgagccaccccaacctggcggcagcgcaaaagatg

SEQ ID NO: 178492 - DNA, 103 bp, Artificial Sequence
  Synthetic Polynucleotide
taatacgactcactatagggcctctcccggcgctgtttccggggggtggcaacagaggagagccaccatgcggaaacagaacctggcggcagcgcaaaagatg

SEQ ID NO: 178493 - DNA, 103 bp, Artificial Sequence
  Synthetic Polynucleotide
taatacgactcactatagggtgaacgtcgtcctctcccggcgctgtttccaacagaggagaggaaacatggccgggagaaacctggcggcagcgcaaaagatg

SEQ ID NO: 178494 - DNA, 103 bp, Artificial Sequence
  Synthetic Polynucleotide
taatacgactcactatagggtgcgcccgagtgaacgtcgtcctctcccggaacagaggagaccgggaatggacgacgttaacctggcggcagcgcaaaagatg

SEQ ID NO: 178495 - DNA, 103 bp, Artificial Sequence
  Synthetic Polynucleotide
taatacgactcactatagggcacatctagctgcgcccgagtgaacgtcgtaacagaggagaacgacgatgactcgggcgaacctggcggcagcgcaaaagatg

SEQ ID NO: 178496 - DNA, 103 bp, Artificial Sequence
  Synthetic Polynucleotide
taatacgactcactataggggtgcttccagcacatctagctgcgcccgagaacagaggagactcgggatgagctagatgaacctggcggcagcgcaaaagatg

SEQ ID NO: 178497 - DNA, 103 bp, Artificial Sequence
  Synthetic Polynucleotide
taatacgactcactatagggttggcaaacagtgcttccagcacatctagcaacagaggagagctagaatggctggaagcaacctggcggcagcgcaaaagatg

SEQ ID NO: 178498 - DNA, 103 bp, Artificial Sequence
  Synthetic Polynucleotide
taatacgactcactataggggtaccgggtcttggcaaacagtgcttccagaacagaggagactggaaatgctgtttgccaacctggcggcagcgcaaaagatg

SEQ ID NO: 178499 - DNA, 103 bp, Artificial Sequence
  Synthetic Polynucleotide
taatacgactcactatagggcattgactgcgtaaggcggttgcttaagataacagaggagaatcttaatgaaccgccttaacctggcggcagcgcaaaagatg

SEQ ID NO: 178500 - DNA, 103 bp, Artificial Sequence
  Synthetic Polynucleotide
taatacgactcactatagggagatgtctgggtaccgggtcttggcaaacaaacagaggagatgtttgatgagacccggtaacctggcggcagcgcaaaagatg

SEQ ID NO: 178501 - DNA, 103 bp, Artificial Sequence
  Synthetic Polynucleotide
taatacgactcactatagggtctcgcatgaagatgtctgggtaccgggtcaacagaggagagacccgatgcccagacataacctggcggcagcgcaaaagatg

SEQ ID NO: 178502 - DNA, 103 bp, Artificial Sequence
  Synthetic Polynucleotide
taatacgactcactatagggtgccacctcctctcgcatgaagatgtctggaacagaggagaccagacatgttcatgcgaaacctggcggcagcgcaaaagatg

SEQ ID NO: 178503 - DNA, 103 bp, Artificial Sequence
  Synthetic Polynucleotide
taatacgactcactatagggtgattttcagtgccacctcctctcgcatgaaacagaggagatcatgcatgaggaggtggaacctggcggcagcgcaaaagatg

SEQ ID NO: 178504 - DNA, 103 bp, Artificial Sequence
  Synthetic Polynucleotide
taatacgactcactatagggtcgggcaagttgattttcagtgccacctccaacagaggagaggaggtatgactgaaaataacctggcggcagcgcaaaagatg

SEQ ID NO: 178505 - DNA, 103 bp, Artificial Sequence
  Synthetic Polynucleotide
taatacgactcactatagggcaccctcgactcgggcaagttgattttcagaacagaggagactgaaaatgaacttgcccaacctggcggcagcgcaaaagatg

SEQ ID NO: 178506 - DNA, 103 bp, Artificial Sequence
  Synthetic Polynucleotide
taatacgactcactatagggaccatacctgcaccctcgactcgggcaagtaacagaggagaacttgcatgagtcgagggaacctggcggcagcgcaaaagatg

SEQ ID NO: 178507 - DNA, 103 bp, Artificial Sequence
  Synthetic Polynucleotide
taatacgactcactatagggcgattcttaaaccatacctgcaccctcgacaacagaggagagtcgagatggcaggtatgaacctggcggcagcgcaaaagatg

SEQ ID NO: 178508 - DNA, 103 bp, Artificial Sequence
  Synthetic Polynucleotide
taatacgactcactatagggcttagctcttcgattcttaaaccatacctgaacagaggagacaggtaatgtttaagaataacctggcggcagcgcaaaagatg

SEQ ID NO: 178509 - DNA, 103 bp, Artificial Sequence
  Synthetic Polynucleotide
taatacgactcactataggggttggcggcacttagctcttcgattcttaaaacagaggagattaagaatggaagagctaaacctggcggcagcgcaaaagatg

SEQ ID NO: 178510 - DNA, 103 bp, Artificial Sequence
  Synthetic Polynucleotide
taatacgactcactatagggagactcagcccattgactgcgtaaggcggtaacagaggagaaccgccatgcgcagtcaaaacctggcggcagcgcaaaagatg

SEQ ID NO: 178511 - DNA, 103 bp, Artificial Sequence
  Synthetic Polynucleotide
taatacgactcactatagggtgttgctgttgttggcggcacttagctcttaacagaggagaaagagcatggtgccgccaaacctggcggcagcgcaaaagatg

SEQ ID NO: 178512 - DNA, 103 bp, Artificial Sequence
  Synthetic Polynucleotide
taatacgactcactatagggattctgctgttgttgctgttgttggcggcaaacagaggagatgccgcatgcaacagcaaaacctggcggcagcgcaaaagatg

SEQ ID NO: 178513 - DNA, 103 bp, Artificial Sequence
  Synthetic Polynucleotide
taatacgactcactatagggtttgacctccattctgctgttgttgctgttaacagaggagaaacagcatgaacagcagaaacctggcggcagcgcaaaagatg

SEQ ID NO: 178514 - DNA, 103 bp, Artificial Sequence
  Synthetic Polynucleotide
taatacgactcactatagggctcactttgttttgacctccattctgctgtaacagaggagaacagcaatgtggaggtcaaacctggcggcagcgcaaaagatg

SEQ ID NO: 178515 - DNA, 103 bp, Artificial Sequence
  Synthetic Polynucleotide
taatacgactcactatagggtttggcaggtctcactttgttttgacctccaacagaggagaggaggtatgaacaaagtgaacctggcggcagcgcaaaagatg

SEQ ID NO: 178516 - DNA, 103 bp, Artificial Sequence
  Synthetic Polynucleotide
taatacgactcactatagggatgtcttctttttggcaggtctcactttgtaacagaggagaacaaagatggacctgccaaacctggcggcagcgcaaaagatg

SEQ ID NO: 178517 - DNA, 103 bp, Artificial Sequence
  Synthetic Polynucleotide
taatacgactcactatagggcgagctggagatgtcttctttttggcaggtaacagaggagaacctgcatgaaagaagacaacctggcggcagcgcaaaagatg

SEQ ID NO: 178518 - DNA, 103 bp, Artificial Sequence
  Synthetic Polynucleotide
taatacgactcactatagggactcacttcccgagctggagatgtcttcttaacagaggagaaagaagatgtctccagctaacctggcggcagcgcaaaagatg

SEQ ID NO: 178519 - DNA, 103 bp, Artificial Sequence
  Synthetic Polynucleotide
taatacgactcactatagggcactctctgaactcacttcccgagctggagaacagaggagactccagatggggaagtgaaacctggcggcagcgcaaaagatg

SEQ ID NO: 178520 - DNA, 103 bp, Artificial Sequence
  Synthetic Polynucleotide
taatacgactcactatagggccacttgttccactctctgaactcacttccaacagaggagaggaagtatgttcagagagaacctggcggcagcgcaaaagatg

SEQ ID NO: 178521 - DNA, 103 bp, Artificial Sequence
  Synthetic Polynucleotide
taatacgactcactatagggcgaagtggtcagactcagcccattgactgcaacagaggagagcagtcatggggctgagtaacctggcggcagcgcaaaagatg

SEQ ID NO: 178522 - DNA, 103 bp, Artificial Sequence
  Synthetic Polynucleotide
taatacgactcactatagggagtgaattggccacttgttccactctctgaaacagaggagatcagagatgggaacaagtaacctggcggcagcgcaaaagatg

SEQ ID NO: 178523 - DNA, 103 bp, Artificial Sequence
  Synthetic Polynucleotide
taatacgactcactatagggtagaggggggagtgaattggccacttgttcaacagaggagagaacaaatggccaattcaaacctggcggcagcgcaaaagatg

SEQ ID NO: 178524 - DNA, 103 bp, Artificial Sequence
  Synthetic Polynucleotide
taatacgactcactatagggactgaggtgctagaggggggagtgaattggaacagaggagaccaattatgtcccccctcaacctggcggcagcgcaaaagatg

SEQ ID NO: 178525 - DNA, 103 bp, Artificial Sequence
  Synthetic Polynucleotide
taatacgactcactatagggaatggtcgggactgaggtgctagaggggggaacagaggagaccccccatgagcacctcaaacctggcggcagcgcaaaagatg

SEQ ID NO: 178526 - DNA, 103 bp, Artificial Sequence
  Synthetic Polynucleotide
taatacgactcactatagggtgctgctggcaatggtcgggactgaggtgcaacagaggagagcacctatgtcccgaccaaacctggcggcagcgcaaaagatg

SEQ ID NO: 178527 - DNA, 103 bp, Artificial Sequence
  Synthetic Polynucleotide
taatacgactcactatagggacaggagcactgctgctggcaatggtcgggaacagaggagacccgacatgtgccagcagaacctggcggcagcgcaaaagatg

SEQ ID NO: 178528 - DNA, 103 bp, Artificial Sequence
  Synthetic Polynucleotide
taatacgactcactatagggccagatagacacaggagcactgctgctggcaacagaggagagccagcatgagtgctcctaacctggcggcagcgcaaaagatg

SEQ ID NO: 178529 - DNA, 103 bp, Artificial Sequence
  Synthetic Polynucleotide
taatacgactcactatagggaagctgggctccagatagacacaggagcacaacagaggagagtgctcatgtgtctatctaacctggcggcagcgcaaaagatg

SEQ ID NO: 178530 - DNA, 103 bp, Artificial Sequence
  Synthetic Polynucleotide
taatacgactcactatagggggggagatggaagctgggctccagatagacaacagaggagagtctatatggagcccagcaacctggcggcagcgcaaaagatg

SEQ ID NO: 178531 - DNA, 103 bp, Artificial Sequence
  Synthetic Polynucleotide
taatacgactcactatagggatctgacagtggggagatggaagctgggctaacagaggagaagcccaatgtccatctccaacctggcggcagcgcaaaagatg

SEQ ID NO: 178532 - DNA, 103 bp, Artificial Sequence
  Synthetic Polynucleotide
taatacgactcactatagggagtccatacccgaagtggtcagactcagccaacagaggagaggctgaatgtgaccacttaacctggcggcagcgcaaaagatg

SEQ ID NO: 178533 - DNA, 103 bp, Artificial Sequence
  Synthetic Polynucleotide
taatacgactcactatagggtggacaagggatctgacagtggggagatggaacagaggagaccatctatgcactgtcagaacctggcggcagcgcaaaagatg

SEQ ID NO: 178534 - DNA, 103 bp, Artificial Sequence
  Synthetic Polynucleotide
taatacgactcactataggggaagaggaggtggacaagggatctgacagtaacagaggagaactgtcatgtcccttgtcaacctggcggcagcgcaaaagatg

SEQ ID NO: 178535 - DNA, 103 bp, Artificial Sequence
  Synthetic Polynucleotide
taatacgactcactatagggctgcatgcaggaagaggaggtggacaagggaacagaggagacccttgatgacctcctctaacctggcggcagcgcaaaagatg

SEQ ID NO: 178536 - DNA, 103 bp, Artificial Sequence
  Synthetic Polynucleotide
taatacgactcactataggggataggacctctgcatgcaggaagaggaggaacagaggagacctcctatgcctgcatgcaacctggcggcagcgcaaaagatg

SEQ ID NO: 178537 - DNA, 103 bp, Artificial Sequence
  Synthetic Polynucleotide
taatacgactcactatagggtaggtcatgggataggacctctgcatgcagaacagaggagactgcatatggaggtcctaaacctggcggcagcgcaaaagatg

SEQ ID NO: 178538 - DNA, 103 bp, Artificial Sequence
  Synthetic Polynucleotide
taatacgactcactatagggagcctgagtataggtcatgggataggacctaacagaggagaaggtccatgcccatgaccaacctggcggcagcgcaaaagatg

SEQ ID NO: 178539 - DNA, 103 bp, Artificial Sequence
  Synthetic Polynucleotide
taatacgactcactatagggtataacctgaagcctgagtataggtcatggaacagaggagaccatgaatgatactcaggaacctggcggcagcgcaaaagatg

SEQ ID NO: 178540 - DNA, 103 bp, Artificial Sequence
  Synthetic Polynucleotide
taatacgactcactatagggtatccttgactataacctgaagcctgagtaaacagaggagatactcaatgttcaggttaaacctggcggcagcgcaaaagatg

SEQ ID NO: 178541 - DNA, 103 bp, Artificial Sequence
  Synthetic Polynucleotide
taatacgactcactatagggtgagccagcatatccttgactataacctgaaacagaggagatcaggtatgagtcaaggaaacctggcggcagcgcaaaagatg

SEQ ID NO: 178542 - DNA, 103 bp, Artificial Sequence
  Synthetic Polynucleotide
taatacgactcactatagggagtaggaagttgagccagcatatccttgacaacagaggagagtcaagatgatgctggctaacctggcggcagcgcaaaagatg

SEQ ID NO: 178543 - DNA, 103 bp, Artificial Sequence
  Synthetic Polynucleotide
taatacgactcactataggggggtgcagcaagtccatacccgaagtggtcaacagaggagagaccacatggggtatggaaacctggcggcagcgcaaaagatg

SEQ ID NO: 178544 - DNA, 103 bp, Artificial Sequence
  Synthetic Polynucleotide
taatacgactcactatagggatgcccccaaagtaggaagttgagccagcaaacagaggagatgctggatgaacttcctaaacctggcggcagcgcaaaagatg

SEQ ID NO: 178545 - DNA, 103 bp, Artificial Sequence
  Synthetic Polynucleotide
taatacgactcactatagggtccacagtccatgcccccaaagtaggaagtaacagaggagaacttccatgtttgggggcaacctggcggcagcgcaaaagatg

SEQ ID NO: 178546 - DNA, 103 bp, Artificial Sequence
  Synthetic Polynucleotide
taatacgactcactatagggtcaaatatgatccacagtccatgcccccaaaacagaggagattggggatgtggactgtgaacctggcggcagcgcaaaagatg

SEQ ID NO: 178547 - DNA, 103 bp, Artificial Sequence
  Synthetic Polynucleotide
taatacgactcactatagggtgcataggggtcaaatatgatccacagtccaacagaggagaggactgatgatcatatttaacctggcggcagcgcaaaagatg

SEQ ID NO: 178548 - DNA, 103 bp, Artificial Sequence
  Synthetic Polynucleotide
taatacgactcactatagggaagctggtgatgcataggggtcaaatatgaaacagaggagatcatatatgacccctatgaacctggcggcagcgcaaaagatg

SEQ ID NO: 178549 - DNA, 103 bp, Artificial Sequence
  Synthetic Polynucleotide
taatacgactcactatagggctggtccgggaagctggtgatgcataggggaacagaggagacccctaatgatcaccagcaacctggcggcagcgcaaaagatg

SEQ ID NO: 178550 - DNA, 103 bp, Artificial Sequence
  Synthetic Polynucleotide
taatacgactcactatagggagtgtggcccctggtccgggaagctggtgaaacagaggagatcaccaatgtcccggaccaacctggcggcagcgcaaaagatg

SEQ ID NO: 178551 - DNA, 103 bp, Artificial Sequence
  Synthetic Polynucleotide
taatacgactcactatagggcatgggactgagtgtggcccctggtccgggaacagaggagacccggaatgggggccacaaacctggcggcagcgcaaaagatg

SEQ ID NO: 178552 - DNA, 103 bp, Artificial Sequence
  Synthetic Polynucleotide
taatacgactcactatagggcattggtacccatgggactgagtgtggcccaacagaggagagggccaatgtcagtcccaaacctggcggcagcgcaaaagatg

SEQ ID NO: 178553 - DNA, 103 bp, Artificial Sequence
  Synthetic Polynucleotide
taatacgactcactatagggctggtgactgcattggtacccatgggactgaacagaggagacagtccatggggtaccaaaacctggcggcagcgcaaaagatg

SEQ ID NO: 178554 - DNA, 103 bp, Artificial Sequence
  Synthetic Polynucleotide
taatacgactcactataggggcccacggaggggtgcagcaagtccataccaacagaggagaggtatgatgttgctgcacaacctggcggcagcgcaaaagatg

SEQ ID NO: 178555 - DNA, 103 bp, Artificial Sequence
  Synthetic Polynucleotide
taatacgactcactatagggattgagatggctggtgactgcattggtaccaacagaggagaggtaccatggcagtcaccaacctggcggcagcgcaaaagatg

SEQ ID NO: 178556 - DNA, 103 bp, Artificial Sequence
  Synthetic Polynucleotide
taatacgactcactatagggctggggactgattgagatggctggtgactgaacagaggagacagtcaatggccatctcaaacctggcggcagcgcaaaagatg

SEQ ID NO: 178557 - DNA, 103 bp, Artificial Sequence
  Synthetic Polynucleotide
taatacgactcactataggggaaagagaagctggggactgattgagatggaacagaggagaccatctatgtcagtccccaacctggcggcagcgcaaaagatg

SEQ ID NO: 178558 - DNA, 103 bp, Artificial Sequence
  Synthetic Polynucleotide
taatacgactcactatagggtccctgggtggaaagagaagctggggactgaacagaggagacagtccatggcttctcttaacctggcggcagcgcaaaagatg

SEQ ID NO: 178559 - DNA, 103 bp, Artificial Sequence
  Synthetic Polynucleotide
taatacgactcactatagggaagctccatatccctgggtggaaagagaagaacagaggagacttctcatgccacccaggaacctggcggcagcgcaaaagatg

SEQ ID NO: 178560 - DNA, 103 bp, Artificial Sequence
  Synthetic Polynucleotide
taatacgactcactatagggcccaagcttgaagctccatatccctgggtgaacagaggagacacccaatgatatggagcaacctggcggcagcgcaaaagatg

SEQ ID NO: 178561 - DNA, 103 bp, Artificial Sequence
  Synthetic Polynucleotide
taatacgactcactatagggtgagttaaaacccaagcttgaagctccataaacagaggagatatggaatgtcaagcttgaacctggcggcagcgcaaaagatg

SEQ ID NO: 178562 - DNA, 103 bp, Artificial Sequence
  Synthetic Polynucleotide
taatacgactcactatagggaatcagtggttgagttaaaacccaagcttgaacagaggagacaagctatggttttaactaacctggcggcagcgcaaaagatg

SEQ ID NO: 178563 - DNA, 103 bp, Artificial Sequence
  Synthetic Polynucleotide
taatacgactcactatagggtaatccaagcaatcagtggttgagttaaaaaacagaggagattttaaatgaaccactgaaacctggcggcagcgcaaaagatg

SEQ ID NO: 178564 - DNA, 103 bp, Artificial Sequence
  Synthetic Polynucleotide
taatacgactcactatagggttggtccttataatccaagcaatcagtggtaacagaggagaaccactatgtgcttggataacctggcggcagcgcaaaagatg

SEQ ID NO: 178565 - DNA, 103 bp, Artificial Sequence
  Synthetic Polynucleotide
taatacgactcactataggggccccgggtagcccacggaggggtgcagcaaacagaggagatgctgcatgcctccgtggaacctggcggcagcgcaaaagatg

SEQ ID NO: 178566 - DNA, 103 bp, Artificial Sequence
  Synthetic Polynucleotide
taatacgactcactatagggaggaggcagtttggtccttataatccaagcaacagaggagagcttggatgataaggaccaacctggcggcagcgcaaaagatg

SEQ ID NO: 178567 - DNA, 103 bp, Artificial Sequence
  Synthetic Polynucleotide
taatacgactcactatagggttaagcttccaggaggcagtttggtccttaaacagaggagataaggaatgaactgcctcaacctggcggcagcgcaaaagatg

SEQ ID NO: 178568 - DNA, 103 bp, Artificial Sequence
  Synthetic Polynucleotide
taatacgactcactatagggagcattgaagttaagcttccaggaggcagtaacagaggagaactgccatgtggaagcttaacctggcggcagcgcaaaagatg

SEQ ID NO: 178569 - DNA, 103 bp, Artificial Sequence
  Synthetic Polynucleotide
taatacgactcactatagggccaagcagtcagcattgaagttaagcttccaacagaggagaggaagcatgacttcaatgaacctggcggcagcgcaaaagatg

SEQ ID NO: 178570 - DNA, 103 bp, Artificial Sequence
  Synthetic Polynucleotide
taatacgactcactatagggtctttataatccaagcagtcagcattgaagaacagaggagacttcaaatgtgactgcttaacctggcggcagcgcaaaagatg

SEQ ID NO: 178571 - DNA, 103 bp, Artificial Sequence
  Synthetic Polynucleotide
taatacgactcactatagggggatgtctgatctttataatccaagcagtcaacagaggagagactgcatggattataaaaacctggcggcagcgcaaaagatg

SEQ ID NO: 178572 - DNA, 103 bp, Artificial Sequence
  Synthetic Polynucleotide
taatacgactcactatagggatttccacgaggatgtctgatctttataataacagaggagaattataatgatcagacataacctggcggcagcgcaaaagatg

SEQ ID NO: 178573 - DNA, 103 bp, Artificial Sequence
  Synthetic Polynucleotide
taatacgactcactatagggaaaacctggaatttccacgaggatgtctgaaacagaggagatcagacatgctcgtggaaaacctggcggcagcgcaaaagatg

SEQ ID NO: 178574 - DNA, 103 bp, Artificial Sequence
  Synthetic Polynucleotide
taatacgactcactataggggaagcccagggccccgggtagcccacggagaacagaggagactccgtatgctacccgggaacctggcggcagcgcaaaagatg

SEQ ID NO: 178575 - DNA, 103 bp, Artificial Sequence
  Synthetic Polynucleotide
taatacgactcactatagggcggcttcttcaccaggaacgcgcggggcataacagaggagaatgcccatggcgttcctgaacctggcggcagcgcaaaagatg

SEQ ID NO: 178576 - DNA, 103 bp, Artificial Sequence
  Synthetic Polynucleotide
taatacgactcactatagggtgggcagaagcccaggctgactggcacgtaaacagaggagatacgtgatggtcagcctgaacctggcggcagcgcaaaagatg

SEQ ID NO: 178577 - DNA, 103 bp, Artificial Sequence
  Synthetic Polynucleotide
taatacgactcactatagggagggctgtggtgggcagaagcccaggctgaaacagaggagatcagccatggcttctgccaacctggcggcagcgcaaaagatg

SEQ ID NO: 178578 - DNA, 103 bp, Artificial Sequence
  Synthetic Polynucleotide
taatacgactcactatagggggctcccggtagggctgtggtgggcagaagaacagaggagacttctgatgaccacagccaacctggcggcagcgcaaaagatg

SEQ ID NO: 178579 - DNA, 103 bp, Artificial Sequence
  Synthetic Polynucleotide
taatacgactcactatagggagagggttccggctcccggtagggctgtggaacagaggagaccacagatgtaccgggagaacctggcggcagcgcaaaagatg

SEQ ID NO: 178580 - DNA, 103 bp, Artificial Sequence
  Synthetic Polynucleotide
taatacgactcactataggggttcggccacagagggttccggctcccggtaacagaggagaaccgggatgcggaaccctaacctggcggcagcgcaaaagatg

SEQ ID NO: 178581 - DNA, 103 bp, Artificial Sequence
  Synthetic Polynucleotide
taatacgactcactatagggcaggaagggggttcggccacagagggttccaacagaggagaggaaccatgtgtggccgaaacctggcggcagcgcaaaagatg

SEQ ID NO: 178582 - DNA, 103 bp, Artificial Sequence
  Synthetic Polynucleotide
taatacgactcactatagggagccagcgggcaggaagggggttcggccacaacagaggagagtggccatgcccccttccaacctggcggcagcgcaaaagatg

SEQ ID NO: 178583 - DNA, 103 bp, Artificial Sequence
  Synthetic Polynucleotide
taatacgactcactatagggtcatgttcaaagccagcgggcaggaaggggaacagaggagaccccttatggcccgctggaacctggcggcagcgcaaaagatg

SEQ ID NO: 178584 - DNA, 103 bp, Artificial Sequence
  Synthetic Polynucleotide
taatacgactcactatagggtctcgaaggctcatgttcaaagccagcgggaacagaggagacccgctatgtttgaacataacctggcggcagcgcaaaagatg

SEQ ID NO: 178585 - DNA, 103 bp, Artificial Sequence
  Synthetic Polynucleotide
taatacgactcactataggggtagctagagtctcgaaggctcatgttcaaaacagaggagattgaacatgagccttcgaaacctggcggcagcgcaaaagatg

SEQ ID NO: 178586 - DNA, 103 bp, Artificial Sequence
  Synthetic Polynucleotide
taatacgactcactatagggtggagacgcacggcttcttcaccaggaacgaacagaggagacgttccatgtgaagaagcaacctggcggcagcgcaaaagatg

SEQ ID NO: 178587 - DNA, 103 bp, Artificial Sequence
  Synthetic Polynucleotide
taatacgactcactataggggggccatgctgtagctagagtctcgaaggcaacagaggagagccttcatgactctagctaacctggcggcagcgcaaaagatg

SEQ ID NO: 178588 - DNA, 103 bp, Artificial Sequence
  Synthetic Polynucleotide
taatacgactcactatagggcagggcccgggggccatgctgtagctagagaacagaggagactctagatgcagcatggcaacctggcggcagcgcaaaagatg

SEQ ID NO: 178589 - DNA, 103 bp, Artificial Sequence
  Synthetic Polynucleotide
taatacgactcactatagggggccaccacacagggcccgggggccatgctaacagaggagaagcatgatgcccgggcccaacctggcggcagcgcaaaagatg

SEQ ID NO: 178590 - DNA, 103 bp, Artificial Sequence
  Synthetic Polynucleotide
taatacgactcactatagggagggcagctgggccaccacacagggcccggaacagaggagaccgggcatggtgtggtggaacctggcggcagcgcaaaagatg

SEQ ID NO: 178591 - DNA, 103 bp, Artificial Sequence
  Synthetic Polynucleotide
taatacgactcactatagggatgtcttcagagggcagctgggccaccacaaacagaggagatgtggtatgccagctgccaacctggcggcagcgcaaaagatg

SEQ ID NO: 178592 - DNA, 103 bp, Artificial Sequence
  Synthetic Polynucleotide
taatacgactcactatagggcaagtggcccatgtcttcagagggcagctgaacagaggagacagctgatgtctgaagacaacctggcggcagcgcaaaagatg

SEQ ID NO: 178593 - DNA, 103 bp, Artificial Sequence
  Synthetic Polynucleotide
taatacgactcactataggggggggtctgtcaagtggcccatgtcttcagaacagaggagactgaagatgtgggccactaacctggcggcagcgcaaaagatg

SEQ ID NO: 178594 - DNA, 103 bp, Artificial Sequence
  Synthetic Polynucleotide
taatacgactcactatagggtctctgctctgggggtctgtcaagtggcccaacagaggagagggccaatggacagacccaacctggcggcagcgcaaaagatg

SEQ ID NO: 178595 - DNA, 103 bp, Artificial Sequence
  Synthetic Polynucleotide
taatacgactcactataggggaagccatggtctctgctctgggggtctgtaacagaggagaacagacatgcagagcagaaacctggcggcagcgcaaaagatg

SEQ ID NO: 178596 - DNA, 103 bp, Artificial Sequence
  Synthetic Polynucleotide
taatacgactcactatagggtggtgcgcaggaagccatggtctctgctctaacagaggagaagagcaatgaccatggctaacctggcggcagcgcaaaagatg

SEQ ID NO: 178597 - DNA, 103 bp, Artificial Sequence
  Synthetic Polynucleotide
taatacgactcactatagggctcttgcacgtggagacgcacggcttcttcaacagaggagagaagaaatggtgcgtctcaacctggcggcagcgcaaaagatg

SEQ ID NO: 178598 - DNA, 103 bp, Artificial Sequence
  Synthetic Polynucleotide
taatacgactcactatagggaccttcatcttggtgcgcaggaagccatggaacagaggagaccatggatgcctgcgcacaacctggcggcagcgcaaaagatg

SEQ ID NO: 178599 - DNA, 103 bp, Artificial Sequence
  Synthetic Polynucleotide
taatacgactcactatagggcccaagggtcaccttcatcttggtgcgcagaacagaggagactgcgcatgaagatgaagaacctggcggcagcgcaaaagatg

SEQ ID NO: 178600 - DNA, 103 bp, Artificial Sequence
  Synthetic Polynucleotide
taatacgactcactatagggtgggactgtccccaagggtcaccttcatctaacagaggagaagatgaatgtgacccttgaacctggcggcagcgcaaaagatg

SEQ ID NO: 178601 - DNA, 103 bp, Artificial Sequence
  Synthetic Polynucleotide
taatacgactcactatagggaggtctccactgggactgtccccaagggtcaacagaggagagaccctatgggacagtccaacctggcggcagcgcaaaagatg

SEQ ID NO: 178602 - DNA, 103 bp, Artificial Sequence
  Synthetic Polynucleotide
taatacgactcactataggggcaggtgaacaggtctccactgggactgtcaacagaggagagacagtatgagtggagacaacctggcggcagcgcaaaagatg

SEQ ID NO: 178603 - DNA, 103 bp, Artificial Sequence
  Synthetic Polynucleotide
taatacgactcactatagggggcagacacggcaggtgaacaggtctccacaacagaggagagtggagatgtgttcacctaacctggcggcagcgcaaaagatg

SEQ ID NO: 178604 - DNA, 103 bp, Artificial Sequence
  Synthetic Polynucleotide
taatacgactcactatagggaaggccttctggcagacacggcaggtgaacaacagaggagagttcacatgccgtgtctgaacctggcggcagcgcaaaagatg

SEQ ID NO: 178605 - DNA, 103 bp, Artificial Sequence
  Synthetic Polynucleotide
taatacgactcactatagggctggtaggtgaaggccttctggcagacacgaacagaggagacgtgtcatgcagaaggccaacctggcggcagcgcaaaagatg

SEQ ID NO: 178606 - DNA, 103 bp, Artificial Sequence
  Synthetic Polynucleotide
taatacgactcactatagggtcagcatgcgctggtaggtgaaggccttctaacagaggagaagaaggatgtcacctaccaacctggcggcagcgcaaaagatg

SEQ ID NO: 178607 - DNA, 103 bp, Artificial Sequence
  Synthetic Polynucleotide
taatacgactcactatagggatgtggcggttcagcatgcgctggtaggtgaacagaggagacacctaatggcgcatgctaacctggcggcagcgcaaaagatg

SEQ ID NO: 178608 - DNA, 103 bp, Artificial Sequence
  Synthetic Polynucleotide
taatacgactcactataggggctccagttcctcttgcacgtggagacgcaaacagaggagatgcgtcatgacgtgcaagaacctggcggcagcgcaaaagatg

SEQ ID NO: 178609 - DNA, 103 bp, Artificial Sequence
  Synthetic Polynucleotide
taatacgactcactataggggtgacacttcatgtggcggttcagcatgcgaacagaggagacgcatgatgaaccgccacaacctggcggcagcgcaaaagatg

SEQ ID NO: 178610 - DNA, 103 bp, Artificial Sequence
  Synthetic Polynucleotide
taatacgactcactatagggtgacgtcgttgtgacacttcatgtggcggtaacagaggagaaccgccatgtgaagtgtcaacctggcggcagcgcaaaagatg

SEQ ID NO: 178611 - DNA, 103 bp, Artificial Sequence
  Synthetic Polynucleotide
taatacgactcactatagggaggtgcctcttgacgtcgttgtgacacttcaacagaggagagaagtgatgcaacgacgtaacctggcggcagcgcaaaagatg

SEQ ID NO: 178612 - DNA, 103 bp, Artificial Sequence
  Synthetic Polynucleotide
taatacgactcactataggggtacgtgcagaggtgcctcttgacgtcgttaacagaggagaaacgacatgaagaggcacaacctggcggcagcgcaaaagatg

SEQ ID NO: 178613 - DNA, 103 bp, Artificial Sequence
  Synthetic Polynucleotide
taatacgactcactatagggccttcccgcagtacgtgcagaggtgcctctaacagaggagaagaggcatgtctgcacgtaacctggcggcagcgcaaaagatg

SEQ ID NO: 178614 - DNA, 103 bp, Artificial Sequence
  Synthetic Polynucleotide
taatacgactcactatagggtcattgaagcccttcccgcagtacgtgcagaacagaggagactgcacatgctgcgggaaaacctggcggcagcgcaaaagatg

SEQ ID NO: 178615 - DNA, 103 bp, Artificial Sequence
  Synthetic Polynucleotide
taatacgactcactataggggtcgaaggtgtcattgaagcccttcccgcaaacagaggagatgcgggatgggcttcaataacctggcggcagcgcaaaagatg

SEQ ID NO: 178616 - DNA, 103 bp, Artificial Sequence
  Synthetic Polynucleotide
taatacgactcactataggggtctcttgaggtcgaaggtgtcattgaagcaacagaggagagcttcaatgacaccttcgaacctggcggcagcgcaaaagatg

SEQ ID NO: 178617 - DNA, 103 bp, Artificial Sequence
  Synthetic Polynucleotide
taatacgactcactataggggttcggacgtgtctcttgaggtcgaaggtgaacagaggagacaccttatgcctcaagagaacctggcggcagcgcaaaagatg

SEQ ID NO: 178618 - DNA, 103 bp, Artificial Sequence
  Synthetic Polynucleotide
taatacgactcactataggggccagtgtgagttcggacgtgtctcttgagaacagaggagactcaagatgcacgtccgaaacctggcggcagcgcaaaagatg

SEQ ID NO: 178619 - DNA, 103 bp, Artificial Sequence
  Synthetic Polynucleotide
taatacgactcactatagggcggggagctcgctccagttcctcttgcacgaacagaggagacgtgcaatgggaactggaaacctggcggcagcgcaaaagatg

SEQ ID NO: 178620 - DNA, 103 bp, Artificial Sequence
  Synthetic Polynucleotide
taatacgactcactatagggagggccgcacgccagtgtgagttcggacgtaacagaggagaacgtccatgctcacactgaacctggcggcagcgcaaaagatg

SEQ ID NO: 178621 - DNA, 103 bp, Artificial Sequence
  Synthetic Polynucleotide
taatacgactcactatagggctgcacttgtagggccgcacgccagtgtgaaacagaggagatcacacatgcgtgcggccaacctggcggcagcgcaaaagatg

SEQ ID NO: 178622 - DNA, 103 bp, Artificial Sequence
  Synthetic Polynucleotide
taatacgactcactataggggtcacacaggctgcacttgtagggccgcacaacagaggagagtgcggatgtacaagtgcaacctggcggcagcgcaaaagatg

SEQ ID NO: 178623 - DNA, 103 bp, Artificial Sequence
  Synthetic Polynucleotide
taatacgactcactatagggtgaaggccttgtcacacaggctgcacttgtaacagaggagaacaagtatggcctgtgtgaacctggcggcagcgcaaaagatg

SEQ ID NO: 178624 - DNA, 103 bp, Artificial Sequence
  Synthetic Polynucleotide
taatacgactcactatagggcagcgctgcgtgaaggccttgtcacacaggaacagaggagacctgtgatgcaaggccttaacctggcggcagcgcaaaagatg

SEQ ID NO: 178625 - DNA, 103 bp, Artificial Sequence
  Synthetic Polynucleotide
taatacgactcactatagggctccagagagcagcgctgcgtgaaggccttaacagaggagaaaggccatgacgcagcgcaacctggcggcagcgcaaaagatg

SEQ ID NO: 178626 - DNA, 103 bp, Artificial Sequence
  Synthetic Polynucleotide
taatacgactcactatagggtgaggtgagactccagagagcagcgctgcgaacagaggagacgcagcatggctctctggaacctggcggcagcgcaaaagatg

SEQ ID NO: 178627 - DNA, 103 bp, Artificial Sequence
  Synthetic Polynucleotide
taatacgactcactatagggtggatcttcttgaggtgagactccagagagaacagaggagactctctatggtctcacctaacctggcggcagcgcaaaagatg

SEQ ID NO: 178628 - DNA, 103 bp, Artificial Sequence
  Synthetic Polynucleotide
taatacgactcactatagggctgcacaccatggatcttcttgaggtgagaaacagaggagatctcacatgaagaagatcaacctggcggcagcgcaaaagatg

SEQ ID NO: 178629 - DNA, 103 bp, Artificial Sequence
  Synthetic Polynucleotide
taatacgactcactatagggcgtacttctgctgcacaccatggatcttctaacagaggagaagaagaatgatggtgtgcaacctggcggcagcgcaaaagatg

SEQ ID NO: 178630 - DNA, 103 bp, Artificial Sequence
  Synthetic Polynucleotide
taatacgactcactatagggcgctcctcgtcggggagctcgctccagttcaacagaggagagaactgatgcgagctcccaacctggcggcagcgcaaaagatg

SEQ ID NO: 178631 - DNA, 103 bp, Artificial Sequence
  Synthetic Polynucleotide
taatacgactcactatagggtccttgtacgcgtacttctgctgcacaccaaacagaggagatggtgtatggcagaagtaaacctggcggcagcgcaaaagatg

SEQ ID NO: 178632 - DNA, 103 bp, Artificial Sequence
  Synthetic Polynucleotide
taatacgactcactatagggggcccgccgctccttgtacgcgtacttctgaacagaggagacagaagatggcgtacaagaacctggcggcagcgcaaaagatg

SEQ ID NO: 178633 - DNA, 103 bp, Artificial Sequence
  Synthetic Polynucleotide
taatacgactcactatagggcgtacagcttggcccgccgctccttgtacgaacagaggagacgtacaatgagcggcgggaacctggcggcagcgcaaaagatg

SEQ ID NO: 178634 - DNA, 103 bp, Artificial Sequence
  Synthetic Polynucleotide
taatacgactcactatagggtcctcacacacgtacagcttggcccgccgcaacagaggagagcggcgatgcaagctgtaaacctggcggcagcgcaaaagatg

SEQ ID NO: 178635 - DNA, 103 bp, Artificial Sequence
  Synthetic Polynucleotide
taatacgactcactataggggcagccgcactcctcacacacgtacagcttaacagaggagaaagctgatggtgtgtgagaacctggcggcagcgcaaaagatg

SEQ ID NO: 178636 - DNA, 103 bp, Artificial Sequence
  Synthetic Polynucleotide
taatacgactcactatagggtctcagatgtgcagccgcactcctcacacaaacagaggagatgtgtgatgagtgcggctaacctggcggcagcgcaaaagatg

SEQ ID NO: 178637 - DNA, 103 bp, Artificial Sequence
  Synthetic Polynucleotide
taatacgactcactatagggccctcctggctctcagatgtgcagccgcacaacagaggagagtgcggatgcacatctgaaacctggcggcagcgcaaaagatg

SEQ ID NO: 178638 - DNA, 103 bp, Artificial Sequence
  Synthetic Polynucleotide
taatacgactcactatagggcaggacgtggccctcctggctctcagatgtaacagaggagaacatctatgagccaggagaacctggcggcagcgcaaaagatg

SEQ ID NO: 178639 - DNA, 103 bp, Artificial Sequence
  Synthetic Polynucleotide
taatacgactcactatagggccttcaggtgcaggacgtggccctcctggcaacagaggagagccaggatggccacgtccaacctggcggcagcgcaaaagatg

SEQ ID NO: 178640 - DNA, 103 bp, Artificial Sequence
  Synthetic Polynucleotide
taatacgactcactataggggggtggtgctccttcaggtgcaggacgtggaacagaggagaccacgtatggcacctgaaaacctggcggcagcgcaaaagatg

SEQ ID NO: 178641 - DNA, 103 bp, Artificial Sequence
  Synthetic Polynucleotide
taatacgactcactataggggatctcgccgcgctcctcgtcggggagctcaacagaggagagagctcatggacgaggagaacctggcggcagcgcaaaagatg

SEQ ID NO: 178642 - DNA, 103 bp, Artificial Sequence
  Synthetic Polynucleotide
taatacgactcactatagggcgggctgtcagggtggtgctccttcaggtgaacagaggagacacctgatggagcaccacaacctggcggcagcgcaaaagatg

SEQ ID NO: 178643 - DNA, 103 bp, Artificial Sequence
  Synthetic Polynucleotide
taatacgactcactatagggtgcgcagcagcgggctgtcagggtggtgctaacagaggagaagcaccatgctgacagccaacctggcggcagcgcaaaagatg

SEQ ID NO: 178644 - DNA, 103 bp, Artificial Sequence
  Synthetic Polynucleotide
taatacgactcactatagggttggaggtcttgcgcagcagcgggctgtcaaacagaggagatgacagatggctgctgcgaacctggcggcagcgcaaaagatg

SEQ ID NO: 178645 - DNA, 103 bp, Artificial Sequence
  Synthetic Polynucleotide
taatacgactcactatagggggccaccttcttggaggtcttgcgcagcagaacagaggagactgctgatgaagacctccaacctggcggcagcgcaaaagatg

SEQ ID NO: 178646 - DNA, 103 bp, Artificial Sequence
  Synthetic Polynucleotide
taatacgactcactataggggtagtgccacggccaccttcttggaggtctaacagaggagaagacctatgagaaggtggaacctggcggcagcgcaaaagatg

SEQ ID NO: 178647 - DNA, 103 bp, Artificial Sequence
  Synthetic Polynucleotide
taatacgactcactatagggacagtgttctgtagtgccacggccaccttcaacagaggagagaaggtatgcgtggcactaacctggcggcagcgcaaaagatg

SEQ ID NO: 178648 - DNA, 103 bp, Artificial Sequence
  Synthetic Polynucleotide
taatacgactcactatagggcagggaagtgacagtgttctgtagtgccacaacagaggagagtggcaatgcagaacactaacctggcggcagcgcaaaagatg

SEQ ID NO: 178649 - DNA, 103 bp, Artificial Sequence
  Synthetic Polynucleotide
taatacgactcactatagggtgccctgcagcagggaagtgacagtgttctaacagaggagaagaacaatgtcacttcccaacctggcggcagcgcaaaagatg

SEQ ID NO: 178650 - DNA, 103 bp, Artificial Sequence
  Synthetic Polynucleotide
taatacgactcactatagggaggtgggggctgccctgcagcagggaagtgaacagaggagacacttcatggctgcagggaacctggcggcagcgcaaaagatg

SEQ ID NO: 178651 - DNA, 103 bp, Artificial Sequence
  Synthetic Polynucleotide
taatacgactcactatagggctggcacgtagatctcgccgcgctcctcgtaacagaggagaacgaggatggcggcgagaaacctggcggcagcgcaaaagatg

SEQ ID NO: 178652 - DNA, 103 bp, Artificial Sequence
  Synthetic Polynucleotide
taatacgactcactatagggcccaggctgactggcacgtagatctcgccgaacagaggagacggcgaatgctacgtgccaacctggcggcagcgcaaaagatg

SEQ ID NO: 178653 - DNA, 103 bp, Artificial Sequence
  Synthetic Polynucleotide
taatacgactcactatagggtcgatagagcttatccgaagactccgccataacagaggagaatggcgatgtcttcggataacctggcggcagcgcaaaagatg

SEQ ID NO: 178654 - DNA, 103 bp, Artificial Sequence
  Synthetic Polynucleotide
taatacgactcactatagggctgcaccatgatggccatccggagcgagtcaacagaggagagactcgatgcggatggccaacctggcggcagcgcaaaagatg

SEQ ID NO: 178655 - DNA, 103 bp, Artificial Sequence
  Synthetic Polynucleotide
taatacgactcactatagggtcggaattcctttggggttacccactccttaacagaggagaaaggagatggtaaccccaaacctggcggcagcgcaaaagatg

SEQ ID NO: 178656 - DNA, 103 bp, Artificial Sequence
  Synthetic Polynucleotide
taatacgactcactatagggaagagatttctcggaattcctttggggttaaacagaggagataacccatgaggaattccaacctggcggcagcgcaaaagatg

SEQ ID NO: 178657 - DNA, 103 bp, Artificial Sequence
  Synthetic Polynucleotide
taatacgactcactatagggttcttgaggtaagagatttctcggaattccaacagaggagaggaattatgagaaatctcaacctggcggcagcgcaaaagatg

SEQ ID NO: 178658 - DNA, 103 bp, Artificial Sequence
  Synthetic Polynucleotide
taatacgactcactatagggaaccttcaatttcttgaggtaagagatttcaacagaggagagaaatcatgtacctcaagaacctggcggcagcgcaaaagatg

SEQ ID NO: 178659 - DNA, 103 bp, Artificial Sequence
  Synthetic Polynucleotide
taatacgactcactatagggcctgttttttaaccttcaatttcttgaggtaacagaggagaacctcaatgaattgaaggaacctggcggcagcgcaaaagatg

SEQ ID NO: 178660 - DNA, 103 bp, Artificial Sequence
  Synthetic Polynucleotide
taatacgactcactatagggaatatacggtcctgttttttaaccttcaataacagaggagaattgaaatgtaaaaaacaaacctggcggcagcgcaaaagatg

SEQ ID NO: 178661 - DNA, 103 bp, Artificial Sequence
  Synthetic Polynucleotide
taatacgactcactatagggttctggggggaatatacggtcctgttttttaacagaggagaaaaaaaatggaccgtataaacctggcggcagcgcaaaagatg

SEQ ID NO: 178662 - DNA, 103 bp, Artificial Sequence
  Synthetic Polynucleotide
taatacgactcactatagggaggcgctggtttctggggggaatatacggtaacagaggagaaccgtaatgtccccccagaacctggcggcagcgcaaaagatg

SEQ ID NO: 178663 - DNA, 103 bp, Artificial Sequence
  Synthetic Polynucleotide
taatacgactcactataggggccgccacggaggcgctggtttctggggggaacagaggagaccccccatgaaccagcgcaacctggcggcagcgcaaaagatg

SEQ ID NO: 178664 - DNA, 103 bp, Artificial Sequence
  Synthetic Polynucleotide
taatacgactcactatagggcggaggcgtggccgccacggaggcgctggtaacagaggagaaccagcatgtccgtggcgaacctggcggcagcgcaaaagatg

SEQ ID NO: 178665 - DNA, 103 bp, Artificial Sequence
  Synthetic Polynucleotide
taatacgactcactatagggacatgggcgactgcaccatgatggccatccaacagaggagaggatggatgtcatggtgcaacctggcggcagcgcaaaagatg

SEQ ID NO: 178666 - DNA, 103 bp, Artificial Sequence
  Synthetic Polynucleotide
taatacgactcactatagggctgtggagggcggaggcgtggccgccacggaacagaggagaccgtggatgccacgcctcaacctggcggcagcgcaaaagatg

SEQ ID NO: 178667 - DNA, 103 bp, Artificial Sequence
  Synthetic Polynucleotide
taatacgactcactatagggggagccgaggctgtggagggcggaggcgtgaacagaggagacacgccatggccctccacaacctggcggcagcgcaaaagatg

SEQ ID NO: 178668 - DNA, 103 bp, Artificial Sequence
  Synthetic Polynucleotide
taatacgactcactatagggcacagcagcaggagccgaggctgtggagggaacagaggagaccctccatggcctcggctaacctggcggcagcgcaaaagatg

SEQ ID NO: 178669 - DNA, 103 bp, Artificial Sequence
  Synthetic Polynucleotide
taatacgactcactatagggcagaggagttcacagcagcaggagccgaggaacagaggagacctcggatgctgctgctgaacctggcggcagcgcaaaagatg

SEQ ID NO: 178670 - DNA, 103 bp, Artificial Sequence
  Synthetic Polynucleotide
taatacgactcactatagggtctgctgaagcagaggagttcacagcagcaaacagaggagatgctgcatggaactcctcaacctggcggcagcgcaaaagatg

SEQ ID NO: 178671 - DNA, 103 bp, Artificial Sequence
  Synthetic Polynucleotide
taatacgactcactatagggtaatggcttatctgctgaagcagaggagttaacagaggagaaactccatggcttcagcaaacctggcggcagcgcaaaagatg

SEQ ID NO: 178672 - DNA, 103 bp, Artificial Sequence
  Synthetic Polynucleotide
taatacgactcactatagggtcatgttggataatggcttatctgctgaagaacagaggagacttcagatgataagccataacctggcggcagcgcaaaagatg

SEQ ID NO: 178673 - DNA, 103 bp, Artificial Sequence
  Synthetic Polynucleotide
taatacgactcactataggggtcaggatcttcatgttggataatggcttaaacagaggagataagccatgatccaacataacctggcggcagcgcaaaagatg

SEQ ID NO: 178674 - DNA, 103 bp, Artificial Sequence
  Synthetic Polynucleotide
taatacgactcactatagggcttcccgagagtcaggatcttcatgttggaaacagaggagatccaacatgaagatcctgaacctggcggcagcgcaaaagatg

SEQ ID NO: 178675 - DNA, 103 bp, Artificial Sequence
  Synthetic Polynucleotide
taatacgactcactatagggtccgggacagcttcccgagagtcaggatctaacagaggagaagatccatgctctcgggaaacctggcggcagcgcaaaagatg

SEQ ID NO: 178676 - DNA, 103 bp, Artificial Sequence
  Synthetic Polynucleotide
taatacgactcactatagggtttccatcaaacatgggcgactgcaccatgaacagaggagacatggtatggtcgcccataacctggcggcagcgcaaaagatg

SEQ ID NO: 178677 - DNA, 103 bp, Artificial Sequence
  Synthetic Polynucleotide
taatacgactcactatagggtcatccttgttccgggacagcttcccgagaaacagaggagatctcggatggctgtcccgaacctggcggcagcgcaaaagatg

SEQ ID NO: 178678 - DNA, 103 bp, Artificial Sequence
  Synthetic Polynucleotide
taatacgactcactatagggggccttcacttcatccttgttccgggacagaacagaggagactgtccatgaacaaggataacctggcggcagcgcaaaagatg

SEQ ID NO: 178679 - DNA, 103 bp, Artificial Sequence
  Synthetic Polynucleotide
taatacgactcactatagggtctcaatcatggccttcacttcatccttgtaacagaggagaacaaggatgaagtgaaggaacctggcggcagcgcaaaagatg

SEQ ID NO: 178680 - DNA, 103 bp, Artificial Sequence
  Synthetic Polynucleotide
taatacgactcactatagggcccccgagtttctcaatcatggccttcactaacagaggagaagtgaaatgcatgattgaaacctggcggcagcgcaaaagatg

SEQ ID NO: 178681 - DNA, 103 bp, Artificial Sequence
  Synthetic Polynucleotide
taatacgactcactatagggcgtcaacttccccccgagtttctcaatcataacagaggagaatgattatgaaactcgggaacctggcggcagcgcaaaagatg

SEQ ID NO: 178682 - DNA, 103 bp, Artificial Sequence
  Synthetic Polynucleotide
taatacgactcactatagggtggccgtccccgtcaacttccccccgagttaacagaggagaaactcgatgggaagttgaaacctggcggcagcgcaaaagatg

SEQ ID NO: 178683 - DNA, 103 bp, Artificial Sequence
  Synthetic Polynucleotide
taatacgactcactataggggaagccttgttggccgtccccgtcaacttcaacagaggagagaagttatgggggacggcaacctggcggcagcgcaaaagatg

SEQ ID NO: 178684 - DNA, 103 bp, Artificial Sequence
  Synthetic Polynucleotide
taatacgactcactataggggatgcacagggaagccttgttggccgtcccaacagaggagagggacgatgaacaaggctaacctggcggcagcgcaaaagatg

SEQ ID NO: 178685 - DNA, 103 bp, Artificial Sequence
  Synthetic Polynucleotide
taatacgactcactatagggttttggtgctgatgcacagggaagccttgtaacagaggagaacaaggatgccctgtgcaaacctggcggcagcgcaaaagatg

SEQ ID NO: 178686 - DNA, 103 bp, Artificial Sequence
  Synthetic Polynucleotide
taatacgactcactatagggtccacctcctttttggtgctgatgcacaggaacagaggagacctgtgatgcagcaccaaaacctggcggcagcgcaaaagatg

SEQ ID NO: 178687 - DNA, 103 bp, Artificial Sequence
  Synthetic Polynucleotide
taatacgactcactataggggtgtgggacttttccatcaaacatgggcgaaacagaggagatcgcccatgtttgatggaaacctggcggcagcgcaaaagatg

SEQ ID NO: 178688 - DNA, 103 bp, Artificial Sequence
  Synthetic Polynucleotide
taatacgactcactatagggattcatcttttccacctcctttttggtgctaacagaggagaagcaccatgaaggaggtgaacctggcggcagcgcaaaagatg

SEQ ID NO: 178689 - DNA, 103 bp, Artificial Sequence
  Synthetic Polynucleotide
taatacgactcactatagggccatcttcttattcatcttttccacctcctaacagaggagaaggaggatgaaaagatgaaacctggcggcagcgcaaaagatg

SEQ ID NO: 178690 - DNA, 103 bp, Artificial Sequence
  Synthetic Polynucleotide
taatacgactcactatagggtttacttcctccatcttcttattcatctttaacagaggagaaaagatatgtaagaagataacctggcggcagcgcaaaagatg

SEQ ID NO: 178691 - DNA, 103 bp, Artificial Sequence
  Synthetic Polynucleotide
taatacgactcactataggggttggcttcctttacttcctccatcttcttaacagaggagaaagaagatggaggaagtaaacctggcggcagcgcaaaagatg

SEQ ID NO: 178692 - DNA, 103 bp, Artificial Sequence
  Synthetic Polynucleotide
taatacgactcactatagggcaactcggatgttggcttcctttacttcctaacagaggagaaggaagatgaggaagccaaacctggcggcagcgcaaaagatg

SEQ ID NO: 178693 - DNA, 103 bp, Artificial Sequence
  Synthetic Polynucleotide
taatacgactcactatagggtcctcagacacaactcggatgttggcttccaacagaggagaggaagcatgcatccgagtaacctggcggcagcgcaaaagatg

SEQ ID NO: 178694 - DNA, 103 bp, Artificial Sequence
  Synthetic Polynucleotide
taatacgactcactatagggctggaggaagtcctcagacacaactcggataacagaggagaatccgaatggtgtctgagaacctggcggcagcgcaaaagatg

SEQ ID NO: 178695 - DNA, 103 bp, Artificial Sequence
  Synthetic Polynucleotide
taatacgactcactatagggcggagacgtcctggaggaagtcctcagacaaacagaggagatgtctgatgacttcctccaacctggcggcagcgcaaaagatg

SEQ ID NO: 178696 - DNA, 103 bp, Artificial Sequence
  Synthetic Polynucleotide
taatacgactcactatagggttggtggaggcggagacgtcctggaggaagaacagaggagacttcctatgggacgtctcaacctggcggcagcgcaaaagatg

SEQ ID NO: 178697 - DNA, 103 bp, Artificial Sequence
  Synthetic Polynucleotide
taatacgactcactatagggctgaaggctcttggtggaggcggagacgtcaacagaggagagacgtcatggcctccaccaacctggcggcagcgcaaaagatg

SEQ ID NO: 178698 - DNA, 103 bp, Artificial Sequence
  Synthetic Polynucleotide
taatacgactcactatagggagtggtaccagtgtgggacttttccatcaaaacagaggagattgatgatgaagtcccacaacctggcggcagcgcaaaagatg

SEQ ID NO: 178699 - DNA, 103 bp, Artificial Sequence
  Synthetic Polynucleotide
taatacgactcactatagggagaacaactcctgaaggctcttggtggaggaacagaggagacctccaatgagagccttcaacctggcggcagcgcaaaagatg

SEQ ID NO: 178700 - DNA, 103 bp, Artificial Sequence
  Synthetic Polynucleotide
taatacgactcactatagggatgtgcgctaagaacaactcctgaaggctcaacagaggagagagcctatgggagttgttaacctggcggcagcgcaaaagatg

SEQ ID NO: 178701 - DNA, 103 bp, Artificial Sequence
  Synthetic Polynucleotide
taatacgactcactatagggaggggacaagatgtgcgctaagaacaactcaacagaggagagagttgatgttagcgcacaacctggcggcagcgcaaaagatg

SEQ ID NO: 178702 - DNA, 103 bp, Artificial Sequence
  Synthetic Polynucleotide
taatacgactcactatagggctgccccccaaggggacaagatgtgcgctaaacagaggagatagcgcatgtcttgtcccaacctggcggcagcgcaaaagatg

SEQ ID NO: 178703 - DNA, 103 bp, Artificial Sequence
  Synthetic Polynucleotide
taatacgactcactataggggccttcacctctgccccccaaggggacaagaacagaggagacttgtcatgttggggggcaacctggcggcagcgcaaaagatg

SEQ ID NO: 178704 - DNA, 103 bp, Artificial Sequence
  Synthetic Polynucleotide
taatacgactcactatagggaacaggctctgccttcacctctgccccccaaacagaggagatgggggatggaggtgaagaacctggcggcagcgcaaaagatg

SEQ ID NO: 178705 - DNA, 103 bp, Artificial Sequence
  Synthetic Polynucleotide
taatacgactcactatagggccacaacttcaacaggctctgccttcacctaacagaggagaaggtgaatgcagagcctgaacctggcggcagcgcaaaagatg

SEQ ID NO: 178706 - DNA, 103 bp, Artificial Sequence
  Synthetic Polynucleotide
taatacgactcactatagggcctcttggggccacaacttcaacaggctctaacagaggagaagagccatgtgaagttgtaacctggcggcagcgcaaaagatg

SEQ ID NO: 178707 - DNA, 103 bp, Artificial Sequence
  Synthetic Polynucleotide
taatacgactcactatagggccctgacttccctcttggggccacaacttcaacagaggagagaagttatggccccaagaaacctggcggcagcgcaaaagatg

SEQ ID NO: 178708 - DNA, 103 bp, Artificial Sequence
  Synthetic Polynucleotide
taatacgactcactatagggagagcgcagcccctgacttccctcttggggaacagaggagaccccaaatgggaagtcagaacctggcggcagcgcaaaagatg

SEQ ID NO: 178709 - DNA, 103 bp, Artificial Sequence
  Synthetic Polynucleotide
taatacgactcactatagggaagcaggagaagtggtaccagtgtgggactaacagaggagaagtcccatgctggtaccaaacctggcggcagcgcaaaagatg

SEQ ID NO: 178710 - DNA, 103 bp, Artificial Sequence
  Synthetic Polynucleotide
taatacgactcactatagggctttttttggagagcgcagcccctgacttcaacagaggagagaagtcatgggctgcgctaacctggcggcagcgcaaaagatg

SEQ ID NO: 178711 - DNA, 103 bp, Artificial Sequence
  Synthetic Polynucleotide
taatacgactcactatagggctggcccttgctttttttggagagcgcagcaacagaggagagctgcgatgtccaaaaaaaacctggcggcagcgcaaaagatg

SEQ ID NO: 178712 - DNA, 103 bp, Artificial Sequence
  Synthetic Polynucleotide
taatacgactcactatagggcctccttgacctggcccttgctttttttggaacagaggagaccaaaaatggcaagggccaacctggcggcagcgcaaaagatg

SEQ ID NO: 178713 - DNA, 103 bp, Artificial Sequence
  Synthetic Polynucleotide
taatacgactcactatagggttgataccttcctccttgacctggcccttgaacagaggagacaagggatgggtcaaggaaacctggcggcagcgcaaaagatg

SEQ ID NO: 178714 - DNA, 103 bp, Artificial Sequence
  Synthetic Polynucleotide
taatacgactcactatagggttcagatttgttgataccttcctccttgacaacagaggagagtcaagatggaaggtatcaacctggcggcagcgcaaaagatg

SEQ ID NO: 178715 - DNA, 103 bp, Artificial Sequence
  Synthetic Polynucleotide
taatacgactcactatagggtcattctcttttcagatttgttgataccttaacagaggagaaaggtaatgacaaatctgaacctggcggcagcgcaaaagatg

SEQ ID NO: 178716 - DNA, 103 bp, Artificial Sequence
  Synthetic Polynucleotide
taatacgactcactatagggagagttaatttcattctcttttcagatttgaacagaggagacaaatcatgaaagagaataacctggcggcagcgcaaaagatg

SEQ ID NO: 178717 - DNA, 103 bp, Artificial Sequence
  Synthetic Polynucleotide
taatacgactcactatagggtcctcctttaagagttaatttcattctcttaacagaggagaaagagaatgaaattaactaacctggcggcagcgcaaaagatg

SEQ ID NO: 178718 - DNA, 103 bp, Artificial Sequence
  Synthetic Polynucleotide
taatacgactcactatagggccacagctgctcctcctttaagagttaattaacagaggagaaattaaatgttaaaggagaacctggcggcagcgcaaaagatg

SEQ ID NO: 178719 - DNA, 103 bp, Artificial Sequence
  Synthetic Polynucleotide
taatacgactcactataggggaatcaggatccacagctgctcctcctttaaacagaggagataaaggatgagcagctgtaacctggcggcagcgcaaaagatg

SEQ ID NO: 178720 - DNA, 103 bp, Artificial Sequence
  Synthetic Polynucleotide
taatacgactcactatagggcaccttccagaagcaggagaagtggtaccaaacagaggagatggtacatgttctcctgcaacctggcggcagcgcaaaagatg

SEQ ID NO: 178721 - DNA, 103 bp, Artificial Sequence
  Synthetic Polynucleotide
taatacgactcactatagggttccagtccagaatcaggatccacagctgcaacagaggagagcagctatggatcctgataacctggcggcagcgcaaaagatg

SEQ ID NO: 178722 - DNA, 103 bp, Artificial Sequence
  Synthetic Polynucleotide
taatacgactcactataggggcgcagagtgttccagtccagaatcaggataacagaggagaatcctgatgctggactggaacctggcggcagcgcaaaagatg

SEQ ID NO: 178723 - DNA, 103 bp, Artificial Sequence
  Synthetic Polynucleotide
taatacgactcactatagggtccaggacatgcgcagagtgttccagtccaaacagaggagatggactatgacactctgcaacctggcggcagcgcaaaagatg

SEQ ID NO: 178724 - DNA, 103 bp, Artificial Sequence
  Synthetic Polynucleotide
taatacgactcactatagggcccacctttctccaggacatgcgcagagtgaacagaggagacactctatgcatgtcctgaacctggcggcagcgcaaaagatg

SEQ ID NO: 178725 - DNA, 103 bp, Artificial Sequence
  Synthetic Polynucleotide
taatacgactcactatagggtgaagaccttcccacctttctccaggacataacagaggagaatgtccatgagaaaggtgaacctggcggcagcgcaaaagatg

SEQ ID NO: 178726 - DNA, 103 bp, Artificial Sequence
  Synthetic Polynucleotide
taatacgactcactatagggagggtggcactgaagaccttcccacctttcaacagaggagagaaaggatggaaggtcttaacctggcggcagcgcaaaagatg

SEQ ID NO: 178727 - DNA, 103 bp, Artificial Sequence
  Synthetic Polynucleotide
taatacgactcactatagggcaccaggccaagggtggcactgaagaccttaacagaggagaaaggtcatgagtgccaccaacctggcggcagcgcaaaagatg

SEQ ID NO: 178728 - DNA, 103 bp, Artificial Sequence
  Synthetic Polynucleotide
taatacgactcactatagggtaacgatgtccaccaggccaagggtggcacaacagaggagagtgccaatgttggcctggaacctggcggcagcgcaaaagatg

SEQ ID NO: 178729 - DNA, 103 bp, Artificial Sequence
  Synthetic Polynucleotide
taatacgactcactatagggttggttcctttaacgatgtccaccaggccaaacagaggagatggcctatgggacatcgtaacctggcggcagcgcaaaagatg

SEQ ID NO: 178730 - DNA, 103 bp, Artificial Sequence
  Synthetic Polynucleotide
taatacgactcactataggggtagtaggagttggttcctttaacgatgtcaacagaggagagacatcatgaaaggaaccaacctggcggcagcgcaaaagatg

SEQ ID NO: 178731 - DNA, 103 bp, Artificial Sequence
  Synthetic Polynucleotide
taatacgactcactatagggtggagtggcccaccttccagaagcaggagaaacagaggagatctcctatgtctggaaggaacctggcggcagcgcaaaagatg

SEQ ID NO: 178732 - DNA, 103 bp, Artificial Sequence
  Synthetic Polynucleotide
taatacgactcactataggggctgcagcttgtagtaggagttggttccttaacagaggagaaaggaaatgactcctactaacctggcggcagcgcaaaagatg

SEQ ID NO: 178733 - DNA, 103 bp, Artificial Sequence
  Synthetic Polynucleotide
taatacgactcactatagggtcctccagaagctgcagcttgtagtaggagaacagaggagactcctaatgcaagctgcaaacctggcggcagcgcaaaagatg

SEQ ID NO: 178734 - DNA, 103 bp, Artificial Sequence
  Synthetic Polynucleotide
taatacgactcactatagggttccttgtcgtcctccagaagctgcagcttaacagaggagaaagctgatgcttctggagaacctggcggcagcgcaaaagatg

SEQ ID NO: 178735 - DNA, 103 bp, Artificial Sequence
  Synthetic Polynucleotide
taatacgactcactatagggaatacctgttttccttgtcgtcctccagaaaacagaggagattctggatgacgacaaggaacctggcggcagcgcaaaagatg

SEQ ID NO: 178736 - DNA, 103 bp, Artificial Sequence
  Synthetic Polynucleotide
taatacgactcactatagggctgaatatccaatacctgttttccttgtcgaacagaggagacgacaaatgaaacaggtaaacctggcggcagcgcaaaagatg

SEQ ID NO: 178737 - DNA, 103 bp, Artificial Sequence
  Synthetic Polynucleotide
taatacgactcactataggggccccaggacctgaatatccaatacctgttaacagaggagaaacaggatgtggatattcaacctggcggcagcgcaaaagatg

SEQ ID NO: 178738 - DNA, 103 bp, Artificial Sequence
  Synthetic Polynucleotide
taatacgactcactatagggtacccacacggccccaggacctgaatatccaacagaggagaggatatatgggtcctgggaacctggcggcagcgcaaaagatg

SEQ ID NO: 178739 - DNA, 103 bp, Artificial Sequence
  Synthetic Polynucleotide
taatacgactcactatagggccgatcaccgtacccacacggccccaggacaacagaggagagtcctgatgccgtgtgggaacctggcggcagcgcaaaagatg

SEQ ID NO: 178740 - DNA, 103 bp, Artificial Sequence
  Synthetic Polynucleotide
taatacgactcactatagggtttgttgctaccgatcaccgtacccacacgaacagaggagacgtgtgatgacggtgatcaacctggcggcagcgcaaaagatg

SEQ ID NO: 178741 - DNA, 103 bp, Artificial Sequence
  Synthetic Polynucleotide
taatacgactcactatagggtctgttccagtttgttgctaccgatcaccgaacagaggagacggtgaatggtagcaacaaacctggcggcagcgcaaaagatg

SEQ ID NO: 178742 - DNA, 103 bp, Artificial Sequence
  Synthetic Polynucleotide
taatacgactcactataggggggtgccggatggagtggcccaccttccagaacagaggagactggaaatggggccactcaacctggcggcagcgcaaaagatg

SEQ ID NO: 178743 - DNA, 103 bp, Artificial Sequence
  Synthetic Polynucleotide
taatacgactcactatagggttggacggcatctgttccagtttgttgctaaacagaggagatagcaaatgactggaacaaacctggcggcagcgcaaaagatg

SEQ ID NO: 178744 - DNA, 103 bp, Artificial Sequence
  Synthetic Polynucleotide
taatacgactcactatagggggcatcctccttggacggcatctgttccagaacagaggagactggaaatgatgccgtccaacctggcggcagcgcaaaagatg

SEQ ID NO: 178745 - DNA, 103 bp, Artificial Sequence
  Synthetic Polynucleotide
taatacgactcactatagggagtgctcaatggcatcctccttggacggcaaacagaggagatgccgtatgaggaggatgaacctggcggcagcgcaaaagatg

SEQ ID NO: 178746 - DNA, 103 bp, Artificial Sequence
  Synthetic Polynucleotide
taatacgactcactatagggaatttcatgaagtgctcaatggcatcctccaacagaggagaggaggaatgcattgagcaaacctggcggcagcgcaaaagatg

SEQ ID NO: 178747 - DNA, 103 bp, Artificial Sequence
  Synthetic Polynucleotide
taatacgactcactatagggttcttcatataatttcatgaagtgctcaataacagaggagaattgagatgttcatgaaaaacctggcggcagcgcaaaagatg

SEQ ID NO: 178748 - DNA, 103 bp, Artificial Sequence
  Synthetic Polynucleotide
taatacgactcactatagggtcccggttttttcttcatataatttcatgaaacagaggagatcatgaatgtatatgaagaacctggcggcagcgcaaaagatg

SEQ ID NO: 178749 - DNA, 103 bp, Artificial Sequence
  Synthetic Polynucleotide
taatacgactcactatagggtgccaagcgttcccggttttttcttcatataacagaggagaatatgaatgaaaaaccggaacctggcggcagcgcaaaagatg

SEQ ID NO: 178750 - DNA, 103 bp, Artificial Sequence
  Synthetic Polynucleotide
taatacgactcactatagggatttttggagtgccaagcgttcccggttttaacagaggagaaaaaccatgaacgcttggaacctggcggcagcgcaaaagatg

SEQ ID NO: 178751 - DNA, 103 bp, Artificial Sequence
  Synthetic Polynucleotide
taatacgactcactatagggacttcgtgaaatttttggagtgccaagcgtaacagaggagaacgcttatgactccaaaaaacctggcggcagcgcaaaagatg

SEQ ID NO: 178752 - DNA, 103 bp, Artificial Sequence
  Synthetic Polynucleotide
taatacgactcactatagggtttttgggatacttcgtgaaatttttggagaacagaggagactccaaatgtttcacgaaaacctggcggcagcgcaaaagatg

SEQ ID NO: 178753 - DNA, 103 bp, Artificial Sequence
  Synthetic Polynucleotide
taatacgactcactatagggctcaacgtcagggtgccggatggagtggccaacagaggagaggccacatgatccggcacaacctggcggcagcgcaaaagatg

SEQ ID NO: 178754 - DNA, 103 bp, Artificial Sequence
  Synthetic Polynucleotide
taatacgactcactatagggggggtagaactttttgggatacttcgtgaaaacagaggagattcacgatgtatcccaaaaacctggcggcagcgcaaaagatg

SEQ ID NO: 178755 - DNA, 103 bp, Artificial Sequence
  Synthetic Polynucleotide
taatacgactcactatagggcaatctccagggggtagaactttttgggataacagaggagaatcccaatgagttctaccaacctggcggcagcgcaaaagatg

SEQ ID NO: 178756 - DNA, 103 bp, Artificial Sequence
  Synthetic Polynucleotide
taatacgactcactatagggtggccatagtcaatctccagggggtagaacaacagaggagagttctaatgcctggagataacctggcggcagcgcaaaagatg

SEQ ID NO: 178757 - DNA, 103 bp, Artificial Sequence
  Synthetic Polynucleotide
taatacgactcactatagggctcttcatcctggccatagtcaatctccagaacagaggagactggagatggactatggcaacctggcggcagcgcaaaagatg

SEQ ID NO: 178758 - DNA, 103 bp, Artificial Sequence
  Synthetic Polynucleotide
taatacgactcactatagggtcttcactgcctcttcatcctggccatagtaacagaggagaactatgatgaggatgaagaacctggcggcagcgcaaaagatg

SEQ ID NO: 178759 - DNA, 103 bp, Artificial Sequence
  Synthetic Polynucleotide
taatacgactcactatagggactgtcagcttcttcactgcctcttcatccaacagaggagaggatgaatgggcagtgaaaacctggcggcagcgcaaaagatg

SEQ ID NO: 178760 - DNA, 103 bp, Artificial Sequence
  Synthetic Polynucleotide
taatacgactcactataggggccaggatttactgtcagcttcttcactgcaacagaggagagcagtgatgaagctgacaaacctggcggcagcgcaaaagatg

SEQ ID NO: 178761 - DNA, 103 bp, Artificial Sequence
  Synthetic Polynucleotide
taatacgactcactatagggtggacttggtgccaggatttactgtcagctaacagaggagaagctgaatgtaaatcctgaacctggcggcagcgcaaaagatg

SEQ ID NO: 178762 - DNA, 103 bp, Artificial Sequence
  Synthetic Polynucleotide
taatacgactcactatagggttggggagcttggacttggtgccaggatttaacagaggagaaaatccatgcaccaagtcaacctggcggcagcgcaaaagatg

SEQ ID NO: 178763 - DNA, 103 bp, Artificial Sequence
  Synthetic Polynucleotide
taatacgactcactatagggctgaactggcttggggagcttggacttggtaacagaggagaaccaagatgaagctccccaacctggcggcagcgcaaaagatg

SEQ ID NO: 178764 - DNA, 103 bp, Artificial Sequence
  Synthetic Polynucleotide
taatacgactcactatagggcgtactcgactcgatagagcttatccgaagaacagaggagacttcggatgagctctatcaacctggcggcagcgcaaaagatg

SEQ ID NO: 178765 - DNA, 103 bp, Artificial Sequence
  Synthetic Polynucleotide
taatacgactcactatagggacccatccacctcaacgtcagggtgccggaaacagaggagatccggcatgctgacgttgaacctggcggcagcgcaaaagatg

SEQ ID NO: 178766 - DNA, 103 bp, Artificial Sequence
  Synthetic Polynucleotide
taatacgactcactatagggtgatgaggtcctgaactggcttggggagctaacagaggagaagctccatgagccagttcaacctggcggcagcgcaaaagatg

SEQ ID NO: 178767 - DNA, 103 bp, Artificial Sequence
  Synthetic Polynucleotide
taatacgactcactatagggaagatcatcttgatgaggtcctgaactggcaacagaggagagccagtatgggacctcataacctggcggcagcgcaaaagatg

SEQ ID NO: 178768 - DNA, 103 bp, Artificial Sequence
  Synthetic Polynucleotide
taatacgactcactatagggttccacatcaaagatcatcttgatgaggtcaacagaggagagacctcatgaagatgatcaacctggcggcagcgcaaaagatg

SEQ ID NO: 178769 - DNA, 103 bp, Artificial Sequence
  Synthetic Polynucleotide
taatacgactcactatagggtcttcatactttccacatcaaagatcatctaacagaggagaagatgaatgttgatgtggaacctggcggcagcgcaaaagatg

SEQ ID NO: 178770 - DNA, 103 bp, Artificial Sequence
  Synthetic Polynucleotide
taatacgactcactatagggaccatggctttcttcatactttccacatcaaacagaggagatgatgtatgaagtatgaaaacctggcggcagcgcaaaagatg

SEQ ID NO: 178771 - DNA, 103 bp, Artificial Sequence
  Synthetic Polynucleotide
taatacgactcactatagggctcatactccaccatggctttcttcatactaacagaggagaagtatgatgaaagccatgaacctggcggcagcgcaaaagatg

SEQ ID NO: 178772 - DNA, 103 bp, Artificial Sequence
  Synthetic Polynucleotide
taatacgactcactataggggaaggtcgatctcatactccaccatggcttaacagaggagaaagccaatgtggagtatgaacctggcggcagcgcaaaagatg

SEQ ID NO: 178773 - DNA, 103 bp, Artificial Sequence
  Synthetic Polynucleotide
taatacgactcactatagggggcatcttctgaaggtcgatctcatactccaacagaggagaggagtaatggatcgacctaacctggcggcagcgcaaaagatg

SEQ ID NO: 178774 - DNA, 103 bp, Artificial Sequence
  Synthetic Polynucleotide
taatacgactcactatagggcttccccaagggcatcttctgaaggtcgataacagaggagaatcgacatgcagaagatgaacctggcggcagcgcaaaagatg

SEQ ID NO: 178775 - DNA, 103 bp, Artificial Sequence
  Synthetic Polynucleotide
taatacgactcactatagggttttgctcagcttccccaagggcatcttctaacagaggagaagaagaatgccttggggaaacctggcggcagcgcaaaagatg

SEQ ID NO: 178776 - DNA, 103 bp, Artificial Sequence
  Synthetic Polynucleotide
taatacgactcactatagggagctcagagaacccatccacctcaacgtcaaacagaggagatgacgtatgggtggatggaacctggcggcagcgcaaaagatg

SEQ ID NO: 178777 - DNA, 103 bp, Artificial Sequence
  Synthetic Polynucleotide
taatacgactcactatagggtggatctgccttttgctcagcttccccaagaacagaggagacttgggatggctgagcaaaacctggcggcagcgcaaaagatg

SEQ ID NO: 178778 - DNA, 103 bp, Artificial Sequence
  Synthetic Polynucleotide
taatacgactcactataggggtatgcggcctggatctgccttttgctcagaacagaggagactgagcatgaggcagatcaacctggcggcagcgcaaaagatg

SEQ ID NO: 178779 - DNA, 103 bp, Artificial Sequence
  Synthetic Polynucleotide
taatacgactcactatagggtgaggatggagtatgcggcctggatctgccaacagaggagaggcagaatgaggccgcataacctggcggcagcgcaaaagatg

SEQ ID NO: 178780 - DNA, 103 bp, Artificial Sequence
  Synthetic Polynucleotide
taatacgactcactatagggtggacctcactgaggatggagtatgcggccaacagaggagaggccgcatgctccatcctaacctggcggcagcgcaaaagatg

SEQ ID NO: 178781 - DNA, 103 bp, Artificial Sequence
  Synthetic Polynucleotide
taatacgactcactatagggcaccgcctgctggacctcactgaggatggaaacagaggagatccatcatgagtgaggtcaacctggcggcagcgcaaaagatg

SEQ ID NO: 178782 - DNA, 103 bp, Artificial Sequence
  Synthetic Polynucleotide
taatacgactcactatagggtgccctgagacaccgcctgctggacctcacaacagaggagagtgaggatgagcaggcggaacctggcggcagcgcaaaagatg

SEQ ID NO: 178783 - DNA, 103 bp, Artificial Sequence
  Synthetic Polynucleotide
taatacgactcactataggggagtcgctgctgccctgagacaccgcctgcaacagaggagagcaggcatggtctcagggaacctggcggcagcgcaaaagatg

SEQ ID NO: 178784 - DNA, 103 bp, Artificial Sequence
  Synthetic Polynucleotide
taatacgactcactatagggcaggatctgagagtcgctgctgccctgagaaacagaggagatctcagatgagcagcgacaacctggcggcagcgcaaaagatg

SEQ ID NO: 178785 - DNA, 103 bp, Artificial Sequence
  Synthetic Polynucleotide
taatacgactcactatagggttgagagatccaggatctgagagtcgctgcaacagaggagagcagcgatgctcagatccaacctggcggcagcgcaaaagatg

SEQ ID NO: 178786 - DNA, 103 bp, Artificial Sequence
  Synthetic Polynucleotide
taatacgactcactatagggtaaaagcgatttgagagatccaggatctgaaacagaggagatcagatatgggatctctcaacctggcggcagcgcaaaagatg

SEQ ID NO: 178787 - DNA, 103 bp, Artificial Sequence
  Synthetic Polynucleotide
taatacgactcactatagggatcccaccgaagctcagagaacccatccacaacagaggagagtggatatgttctctgagaacctggcggcagcgcaaaagatg

SEQ ID NO: 178788 - DNA, 103 bp, Artificial Sequence
  Synthetic Polynucleotide
taatacgactcactataggggatcagggtgtaaaagcgatttgagagatcaacagaggagagatctcatgaatcgctttaacctggcggcagcgcaaaagatg

SEQ ID NO: 178789 - DNA, 103 bp, Artificial Sequence
  Synthetic Polynucleotide
taatacgactcactatagggagtcgtgggggatcagggtgtaaaagcgataacagaggagaatcgctatgacaccctgaaacctggcggcagcgcaaaagatg

SEQ ID NO: 178790 - DNA, 103 bp, Artificial Sequence
  Synthetic Polynucleotide
taatacgactcactatagggttcatcccaaagtcgtgggggatcagggtgaacagaggagacaccctatgcccccacgaaacctggcggcagcgcaaaagatg

SEQ ID NO: 178791 - DNA, 103 bp, Artificial Sequence
  Synthetic Polynucleotide
taatacgactcactatagggcggaggcttcttcatcccaaagtcgtggggaacagaggagaccccacatgtttgggatgaacctggcggcagcgcaaaagatg

SEQ ID NO: 178792 - DNA, 103 bp, Artificial Sequence
  Synthetic Polynucleotide
taatacgactcactatagggtgttcaggagcggaggcttcttcatcccaaaacagaggagattgggaatgagaagcctcaacctggcggcagcgcaaaagatg

SEQ ID NO: 178793 - DNA, 103 bp, Artificial Sequence
  Synthetic Polynucleotide
taatacgactcactatagggctgtctgcattgttcaggagcggaggcttcaacagaggagagaagccatggctcctgaaaacctggcggcagcgcaaaagatg

SEQ ID NO: 178794 - DNA, 103 bp, Artificial Sequence
  Synthetic Polynucleotide
taatacgactcactatagggggcctgcacactgtctgcattgttcaggagaacagaggagactcctgatgaatgcagacaacctggcggcagcgcaaaagatg

SEQ ID NO: 178795 - DNA, 103 bp, Artificial Sequence
  Synthetic Polynucleotide
taatacgactcactatagggtttccaccttggcctgcacactgtctgcataacagaggagaatgcagatggtgtgcaggaacctggcggcagcgcaaaagatg

SEQ ID NO: 178796 - DNA, 103 bp, Artificial Sequence
  Synthetic Polynucleotide
taatacgactcactatagggttgtcaagcatttccaccttggcctgcacaaacagaggagatgtgcaatgcaaggtggaaacctggcggcagcgcaaaagatg

SEQ ID NO: 178797 - DNA, 103 bp, Artificial Sequence
  Synthetic Polynucleotide
taatacgactcactataggggtccagcaggttgtcaagcatttccaccttaacagaggagaaaggtgatgatgcttgacaacctggcggcagcgcaaaagatg

SEQ ID NO: 178798 - DNA, 103 bp, Artificial Sequence
  Synthetic Polynucleotide
taatacgactcactatagggtctgctggtcatcccaccgaagctcagagaaacagaggagatctctgatgttcggtgggaacctggcggcagcgcaaaagatg

SEQ ID NO: 178799 - DNA, 103 bp, Artificial Sequence
  Synthetic Polynucleotide
taatacgactcactatagggccacctcgatgtccagcaggttgtcaagcaaacagaggagatgcttgatgacctgctggaacctggcggcagcgcaaaagatg

SEQ ID NO: 178800 - DNA, 103 bp, Artificial Sequence
  Synthetic Polynucleotide
taatacgactcactatagggagactgtaggccacctcgatgtccagcaggaacagaggagacctgctatgcatcgaggtaacctggcggcagcgcaaaagatg

SEQ ID NO: 178801 - DNA, 103 bp, Artificial Sequence
  Synthetic Polynucleotide
taatacgactcactatagggtcccctgagcagactgtaggccacctcgataacagaggagaatcgagatggcctacagtaacctggcggcagcgcaaaagatg

SEQ ID NO: 178802 - DNA, 103 bp, Artificial Sequence
  Synthetic Polynucleotide
taatacgactcactatagggcatcagaccctcccctgagcagactgtaggaacagaggagacctacaatgtgctcagggaacctggcggcagcgcaaaagatg

SEQ ID NO: 178803 - DNA, 103 bp, Artificial Sequence
  Synthetic Polynucleotide
taatacgactcactatagggttgctgctatcatcagaccctcccctgagcaacagaggagagctcagatgagggtctgaaacctggcggcagcgcaaaagatg

SEQ ID NO: 178804 - DNA, 103 bp, Artificial Sequence
  Synthetic Polynucleotide
taatacgactcactataggggatgggatccttgctgctatcatcagacccaacagaggagagggtctatggatagcagcaacctggcggcagcgcaaaagatg

SEQ ID NO: 178805 - DNA, 103 bp, Artificial Sequence
  Synthetic Polynucleotide
taatacgactcactatagggagttgacatcgatgggatccttgctgctataacagaggagaatagcaatgaggatcccaaacctggcggcagcgcaaaagatg

SEQ ID NO: 178806 - DNA, 103 bp, Artificial Sequence
  Synthetic Polynucleotide
taatacgactcactatagggagcttctcatagttgacatcgatgggatccaacagaggagaggatccatgcgatgtcaaaacctggcggcagcgcaaaagatg

SEQ ID NO: 178807 - DNA, 103 bp, Artificial Sequence
  Synthetic Polynucleotide
taatacgactcactataggggtcagttttgagcttctcatagttgacatcaacagaggagagatgtcatgtatgagaagaacctggcggcagcgcaaaagatg

SEQ ID NO: 178808 - DNA, 103 bp, Artificial Sequence
  Synthetic Polynucleotide
taatacgactcactatagggccaccttaatgtcagttttgagcttctcataacagaggagaatgagaatgtcaaaactgaacctggcggcagcgcaaaagatg

SEQ ID NO: 178809 - DNA, 103 bp, Artificial Sequence
  Synthetic Polynucleotide
taatacgactcactatagggttcttgactttctgctggtcatcccaccgaaacagaggagatcggtgatgtgaccagcaaacctggcggcagcgcaaaagatg

SEQ ID NO: 178810 - DNA, 103 bp, Artificial Sequence
  Synthetic Polynucleotide
taatacgactcactatagggtctctgtcaaccaccttaatgtcagttttgaacagaggagacaaaacatgcattaaggtaacctggcggcagcgcaaaagatg

SEQ ID NO: 178811 - DNA, 103 bp, Artificial Sequence
  Synthetic Polynucleotide
taatacgactcactatagggttcttcagaatctctgtcaaccaccttaataacagaggagaattaagatggttgacagaaacctggcggcagcgcaaaagatg

SEQ ID NO: 178812 - DNA, 103 bp, Artificial Sequence
  Synthetic Polynucleotide
taatacgactcactatagggtgatctcggcttcttcagaatctctgtcaaaacagaggagattgacaatgattctgaagaacctggcggcagcgcaaaagatg

SEQ ID NO: 178813 - DNA, 103 bp, Artificial Sequence
  Synthetic Polynucleotide
taatacgactcactatagggtacttcctgatgatctcggcttcttcagaaaacagaggagattctgaatgagccgagataacctggcggcagcgcaaaagatg

SEQ ID NO: 178814 - DNA, 103 bp, Artificial Sequence
  Synthetic Polynucleotide
taatacgactcactataggggttcttaacatacttcctgatgatctcggcaacagaggagagccgagatgatcaggaagaacctggcggcagcgcaaaagatg

SEQ ID NO: 178815 - DNA, 103 bp, Artificial Sequence
  Synthetic Polynucleotide
taatacgactcactatagggttgcatgagtgttcttaacatacttcctgaaacagaggagatcaggaatgatgttaagaaacctggcggcagcgcaaaagatg

SEQ ID NO: 178816 - DNA, 103 bp, Artificial Sequence
  Synthetic Polynucleotide
taatacgactcactatagggttgtgtgtggttgcatgagtgttcttaacaaacagaggagatgttaaatgcactcatgcaacctggcggcagcgcaaaagatg

SEQ ID NO: 178817 - DNA, 103 bp, Artificial Sequence
  Synthetic Polynucleotide
taatacgactcactataggggtcatacgcattgtgtgtggttgcatgagtaacagaggagaactcatatgaccacacacaacctggcggcagcgcaaaagatg

SEQ ID NO: 178818 - DNA, 103 bp, Artificial Sequence
  Synthetic Polynucleotide
taatacgactcactatagggtgacttccaagtcatacgcattgtgtgtggaacagaggagaccacacatgatgcgtatgaacctggcggcagcgcaaaagatg

SEQ ID NO: 178819 - DNA, 103 bp, Artificial Sequence
  Synthetic Polynucleotide
taatacgactcactatagggaagatatcgatgacttccaagtcatacgcaaacagaggagatgcgtaatgcttggaagtaacctggcggcagcgcaaaagatg

SEQ ID NO: 178820 - DNA, 103 bp, Artificial Sequence
  Synthetic Polynucleotide
taatacgactcactatagggttccgctgtcttcttgactttctgctggtcaacagaggagagaccagatgaaagtcaagaacctggcggcagcgcaaaagatg

SEQ ID NO: 178821 - DNA, 103 bp, Artificial Sequence
  Synthetic Polynucleotide
taatacgactcactatagggctctatcttaaagatatcgatgacttccaaaacagaggagattggaaatgatcgatatcaacctggcggcagcgcaaaagatg

SEQ ID NO: 178822 - DNA, 103 bp, Artificial Sequence
  Synthetic Polynucleotide
taatacgactcactatagggcgccttcacgctctatcttaaagatatcgaaacagaggagatcgataatgttaagatagaacctggcggcagcgcaaaagatg

SEQ ID NO: 178823 - DNA, 103 bp, Artificial Sequence
  Synthetic Polynucleotide
taatacgactcactatagggcgctggcattcgccttcacgctctatcttaaacagaggagataagatatggcgtgaaggaacctggcggcagcgcaaaagatg

SEQ ID NO: 178824 - DNA, 103 bp, Artificial Sequence
  Synthetic Polynucleotide
taatacgactcactataggggggcttgtaacgctggcattcgccttcacgaacagaggagacgtgaaatggaatgccagaacctggcggcagcgcaaaagatg

SEQ ID NO: 178825 - DNA, 103 bp, Artificial Sequence
  Synthetic Polynucleotide
taatacgactcactataggggctgcttaaagggcttgtaacgctggcattaacagaggagaaatgccatggttacaagcaacctggcggcagcgcaaaagatg

SEQ ID NO: 178826 - DNA, 103 bp, Artificial Sequence
  Synthetic Polynucleotide
taatacgactcactatagggcggttatgaagctgcttaaagggcttgtaaaacagaggagattacaaatgctttaagcaaacctggcggcagcgcaaaagatg

SEQ ID NO: 178827 - DNA, 103 bp, Artificial Sequence
  Synthetic Polynucleotide
taatacgactcactatagggcagcaatcttcggttatgaagctgcttaaaaacagaggagatttaagatgcttcataacaacctggcggcagcgcaaaagatg

SEQ ID NO: 178828 - DNA, 103 bp, Artificial Sequence
  Synthetic Polynucleotide
taatacgactcactatagggacccgtgccacagcaatcttcggttatgaaaacagaggagattcataatggaagattgcaacctggcggcagcgcaaaagatg

SEQ ID NO: 178829 - DNA, 103 bp, Artificial Sequence
  Synthetic Polynucleotide
taatacgactcactataggggtggtcctggacccgtgccacagcaatcttaacagaggagaaagattatggtggcacggaacctggcggcagcgcaaaagatg

SEQ ID NO: 178830 - DNA, 103 bp, Artificial Sequence
  Synthetic Polynucleotide
taatacgactcactatagggagcaaagttggtggtcctggacccgtgccaaacagaggagatggcacatgtccaggaccaacctggcggcagcgcaaaagatg

SEQ ID NO: 178831 - DNA, 103 bp, Artificial Sequence
  Synthetic Polynucleotide
taatacgactcactatagggctcctccagcttccgctgtcttcttgacttaacagaggagaaagtcaatgagacagcggaacctggcggcagcgcaaaagatg

SEQ ID NO: 178832 - DNA, 103 bp, Artificial Sequence
  Synthetic Polynucleotide
taatacgactcactatagggacaggatcccagcaaagttggtggtcctggaacagaggagaccaggaatgccaactttgaacctggcggcagcgcaaaagatg

SEQ ID NO: 178833 - DNA, 103 bp, Artificial Sequence
  Synthetic Polynucleotide
taatacgactcactatagggagaccctgggacaggatcccagcaaagttgaacagaggagacaacttatgtgggatcctaacctggcggcagcgcaaaagatg

SEQ ID NO: 178834 - DNA, 103 bp, Artificial Sequence
  Synthetic Polynucleotide
taatacgactcactatagggggctatccgaagaccctgggacaggatcccaacagaggagagggatcatgtcccagggtaacctggcggcagcgcaaaagatg

SEQ ID NO: 178835 - DNA, 103 bp, Artificial Sequence
  Synthetic Polynucleotide
taatacgactcactatagggcttcaggcggggctatccgaagaccctgggaacagaggagacccaggatgttcggatagaacctggcggcagcgcaaaagatg

SEQ ID NO: 178836 - DNA, 103 bp, Artificial Sequence
  Synthetic Polynucleotide
taatacgactcactataggggtcacgggcgcttcaggcggggctatccgaaacagaggagatcggatatgcccgcctgaaacctggcggcagcgcaaaagatg

SEQ ID NO: 178837 - DNA, 103 bp, Artificial Sequence
  Synthetic Polynucleotide
taatacgactcactatagggcatgtagcctgtcacgggcgcttcaggcggaacagaggagaccgcctatggcgcccgtgaacctggcggcagcgcaaaagatg

SEQ ID NO: 178838 - DNA, 103 bp, Artificial Sequence
  Synthetic Polynucleotide
taatacgactcactatagggctttaccaaacatgtagcctgtcacgggcgaacagaggagacgcccgatgcaggctacaaacctggcggcagcgcaaaagatg

SEQ ID NO: 178839 - DNA, 103 bp, Artificial Sequence
  Synthetic Polynucleotide
taatacgactcactatagggaaatagatccctttaccaaacatgtagcctaacagaggagaaggctaatggtttggtaaaacctggcggcagcgcaaaagatg

SEQ ID NO: 178840 - DNA, 103 bp, Artificial Sequence
  Synthetic Polynucleotide
taatacgactcactatagggcatgtcagcgaaatagatccctttaccaaaaacagaggagatttggtatggggatctataacctggcggcagcgcaaaagatg

SEQ ID NO: 178841 - DNA, 103 bp, Artificial Sequence
  Synthetic Polynucleotide
taatacgactcactatagggtcttggagaccatgtcagcgaaatagatccaacagaggagaggatctatgtcgctgacaaacctggcggcagcgcaaaagatg

SEQ ID NO: 178842 - DNA, 103 bp, Artificial Sequence
  Synthetic Polynucleotide
taatacgactcactatagggttgcctgtcactcctccagcttccgctgtcaacagaggagagacagcatgagctggaggaacctggcggcagcgcaaaagatg

SEQ ID NO: 178843 - DNA, 103 bp, Artificial Sequence
  Synthetic Polynucleotide
taatacgactcactatagggtagttggcactcttggagaccatgtcagcgaacagaggagacgctgaatgggtctccaaaacctggcggcagcgcaaaagatg

SEQ ID NO: 178844 - DNA, 103 bp, Artificial Sequence
  Synthetic Polynucleotide
taatacgactcactatagggcgtatggcagtagttggcactcttggagacaacagaggagagtctccatgagtgccaacaacctggcggcagcgcaaaagatg

SEQ ID NO: 178845 - DNA, 103 bp, Artificial Sequence
  Synthetic Polynucleotide
taatacgactcactatagggctccctgagacgtatggcagtagttggcacaacagaggagagtgccaatgactgccataaacctggcggcagcgcaaaagatg

SEQ ID NO: 178846 - DNA, 103 bp, Artificial Sequence
  Synthetic Polynucleotide
taatacgactcactatagggcctattgggtctccctgagacgtatggcagaacagaggagactgccaatggtctcagggaacctggcggcagcgcaaaagatg

SEQ ID NO: 178847 - DNA, 103 bp, Artificial Sequence
  Synthetic Polynucleotide
taatacgactcactatagggcaggattaagcctattgggtctccctgagaaacagaggagatctcagatggacccaataaacctggcggcagcgcaaaagatg

SEQ ID NO: 178848 - DNA, 103 bp, Artificial Sequence
  Synthetic Polynucleotide
taatacgactcactatagggcttctcccaacaggattaagcctattgggtaacagaggagaacccaaatggcttaatccaacctggcggcagcgcaaaagatg

SEQ ID NO: 178849 - DNA, 103 bp, Artificial Sequence
  Synthetic Polynucleotide
taatacgactcactatagggccaagggcaacttctcccaacaggattaagaacagaggagacttaatatggttgggagaaacctggcggcagcgcaaaagatg

SEQ ID NO: 178850 - DNA, 103 bp, Artificial Sequence
  Synthetic Polynucleotide
taatacgactcactatagggatacatgtttccaagggcaacttctcccaaaacagaggagattgggaatggttgcccttaacctggcggcagcgcaaaagatg

SEQ ID NO: 178851 - DNA, 103 bp, Artificial Sequence
  Synthetic Polynucleotide
taatacgactcactataggggcttcagttcatacatgtttccaagggcaaaacagaggagattgcccatggaaacatgtaacctggcggcagcgcaaaagatg

SEQ ID NO: 178852 - DNA, 103 bp, Artificial Sequence
  Synthetic Polynucleotide
taatacgactcactatagggtgtgaagcgtgcttcagttcatacatgtttaacagaggagaaaacatatgtgaactgaaaacctggcggcagcgcaaaagatg

SEQ ID NO: 178853 - DNA, 103 bp, Artificial Sequence
  Synthetic Polynucleotide
taatacgactcactatagggatcctggcctttgcctgtcactcctccagcaacagaggagagctggaatggtgacaggcaacctggcggcagcgcaaaagatg

SEQ ID NO: 178854 - DNA, 103 bp, Artificial Sequence
  Synthetic Polynucleotide
taatacgactcactatagggcttgctgatatgtgaagcgtgcttcagttcaacagaggagagaactgatgcacgcttcaaacctggcggcagcgcaaaagatg

SEQ ID NO: 178855 - DNA, 103 bp, Artificial Sequence
  Synthetic Polynucleotide
taatacgactcactatagggccttgggtaacttgctgatatgtgaagcgtaacagaggagaacgcttatgatatcagcaaacctggcggcagcgcaaaagatg

SEQ ID NO: 178856 - DNA, 103 bp, Artificial Sequence
  Synthetic Polynucleotide
taatacgactcactatagggctgtgcttgcccttgggtaacttgctgataaacagaggagatatcagatggttacccaaaacctggcggcagcgcaaaagatg

SEQ ID NO: 178857 - DNA, 103 bp, Artificial Sequence
  Synthetic Polynucleotide
taatacgactcactatagggacctttgacactgtgcttgcccttgggtaaaacagaggagattacccatgggcaagcacaacctggcggcagcgcaaaagatg

SEQ ID NO: 178858 - DNA, 103 bp, Artificial Sequence
  Synthetic Polynucleotide
taatacgactcactatagggttttgcccaaacctttgacactgtgcttgcaacagaggagagcaagcatggtgtcaaagaacctggcggcagcgcaaaagatg

SEQ ID NO: 178859 - DNA, 103 bp, Artificial Sequence
  Synthetic Polynucleotide
taatacgactcactatagggtcaggggtagttttgcccaaacctttgacaaacagaggagatgtcaaatgtttgggcaaaacctggcggcagcgcaaaagatg

SEQ ID NO: 178860 - DNA, 103 bp, Artificial Sequence
  Synthetic Polynucleotide
taatacgactcactatagggagctgaaggatcaggggtagttttgcccaaaacagaggagattgggcatgactacccctaacctggcggcagcgcaaaagatg

SEQ ID NO: 178861 - DNA, 103 bp, Artificial Sequence
  Synthetic Polynucleotide
taatacgactcactataggggactaatgttagctgaaggatcaggggtagaacagaggagactacccatgatccttcagaacctggcggcagcgcaaaagatg

SEQ ID NO: 178862 - DNA, 103 bp, Artificial Sequence
  Synthetic Polynucleotide
taatacgactcactatagggacaccatccagactaatgttagctgaaggaaacagaggagatccttcatgtaacattagaacctggcggcagcgcaaaagatg

SEQ ID NO: 178863 - DNA, 103 bp, Artificial Sequence
  Synthetic Polynucleotide
taatacgactcactatagggaggaacgtctacaccatccagactaatgttaacagaggagaaacattatgctggatggtaacctggcggcagcgcaaaagatg

SEQ ID NO: 178864 - DNA, 103 bp, Artificial Sequence
  Synthetic Polynucleotide
taatacgactcactatagggtaccaattccatcctggcctttgcctgtcaaacagaggagatgacagatgaaggccaggaacctggcggcagcgcaaaagatg

SEQ ID NO: 178865 - DNA, 103 bp, Artificial Sequence
  Synthetic Polynucleotide
taatacgactcactatagggcggtcccaagaggaacgtctacaccatccaaacagaggagatggatgatgtagacgttcaacctggcggcagcgcaaaagatg

SEQ ID NO: 178866 - DNA, 103 bp, Artificial Sequence
  Synthetic Polynucleotide
taatacgactcactataggggatgaaatcccggtcccaagaggaacgtctaacagaggagaagacgtatgtcttgggacaacctggcggcagcgcaaaagatg

SEQ ID NO: 178867 - DNA, 103 bp, Artificial Sequence
  Synthetic Polynucleotide
taatacgactcactatagggattcacaccagatgaaatcccggtcccaagaacagaggagacttgggatggggatttcaaacctggcggcagcgcaaaagatg

SEQ ID NO: 178868 - DNA, 103 bp, Artificial Sequence
  Synthetic Polynucleotide
taatacgactcactataggggagaggtgtcattcacaccagatgaaatccaacagaggagaggatttatgctggtgtgaaacctggcggcagcgcaaaagatg

SEQ ID NO: 178869 - DNA, 103 bp, Artificial Sequence
  Synthetic Polynucleotide
taatacgactcactatagggttatatagtagagaggtgtcattcacaccaaacagaggagatggtgtatgtgacacctcaacctggcggcagcgcaaaagatg

SEQ ID NO: 178870 - DNA, 103 bp, Artificial Sequence
  Synthetic Polynucleotide
taatacgactcactatagggaatgtactcgttatatagtagagaggtgtcaacagaggagagacaccatgctactatataacctggcggcagcgcaaaagatg

SEQ ID NO: 178871 - DNA, 103 bp, Artificial Sequence
  Synthetic Polynucleotide
taatacgactcactatagggtatcatagacaatgtactcgttatatagtaaacagaggagatactatatgacgagtacaaacctggcggcagcgcaaaagatg

SEQ ID NO: 178872 - DNA, 103 bp, Artificial Sequence
  Synthetic Polynucleotide
taatacgactcactatagggacctgagcaatatcatagacaatgtactcgaacagaggagacgagtaatgtgtctatgaaacctggcggcagcgcaaaagatg

SEQ ID NO: 178873 - DNA, 103 bp, Artificial Sequence
  Synthetic Polynucleotide
taatacgactcactatagggcttcagatttacctgagcaatatcatagacaacagaggagagtctatatgattgctcagaacctggcggcagcgcaaaagatg

SEQ ID NO: 178874 - DNA, 103 bp, Artificial Sequence
  Synthetic Polynucleotide
taatacgactcactatagggtcagcagatacttcagatttacctgagcaaaacagaggagattgctcatgtaaatctgaaacctggcggcagcgcaaaagatg

SEQ ID NO: 178875 - DNA, 103 bp, Artificial Sequence
  Synthetic Polynucleotide
taatacgactcactatagggccgctcttggcgtactcgactcgatagagcaacagaggagagctctaatgagtcgagtaaacctggcggcagcgcaaaagatg

SEQ ID NO: 178876 - DNA, 103 bp, Artificial Sequence
  Synthetic Polynucleotide
taatacgactcactatagggtctgccttgctaccaattccatcctggcctaacagaggagaaggccaatgtggaattggaacctggcggcagcgcaaaagatg

SEQ ID NO: 178877 - DNA, 103 bp, Artificial Sequence
  Synthetic Polynucleotide
taatacgactcactatagggaatttcagtttcagcagatacttcagatttaacagaggagaaaatctatggtatctgctaacctggcggcagcgcaaaagatg

SEQ ID NO: 178878 - DNA, 103 bp, Artificial Sequence
  Synthetic Polynucleotide
taatacgactcactatagggcttaaaattgaatttcagtttcagcagataaacagaggagatatctgatgaaactgaaaaacctggcggcagcgcaaaagatg

SEQ ID NO: 178879 - DNA, 103 bp, Artificial Sequence
  Synthetic Polynucleotide
taatacgactcactatagggacagggaggtcttaaaattgaatttcagttaacagaggagaaactgaatgtcaattttaaacctggcggcagcgcaaaagatg

SEQ ID NO: 178880 - DNA, 103 bp, Artificial Sequence
  Synthetic Polynucleotide
taatacgactcactatagggcagagtcttctctgccttgctaccaattccaacagaggagaggaattatgagcaaggcaaacctggcggcagcgcaaaagatg

SEQ ID NO: 178881 - DNA, 103 bp, Artificial Sequence
  Synthetic Polynucleotide
taatacgactcactatagggcaaagtcacccagagtcttctctgccttgcaacagaggagagcaaggatgagaagactcaacctggcggcagcgcaaaagatg

SEQ ID NO: 178882 - DNA, 103 bp, Artificial Sequence
  Synthetic Polynucleotide
taatacgactcactatagggtactctgctgcaaagtcacccagagtcttcaacagaggagagaagacatggggtgacttaacctggcggcagcgcaaaagatg

SEQ ID NO: 178883 - DNA, 103 bp, Artificial Sequence
  Synthetic Polynucleotide
taatacgactcactatagggggacttggcatactctgctgcaaagtcaccaacagaggagaggtgacatggcagcagagaacctggcggcagcgcaaaagatg

SEQ ID NO: 178884 - DNA, 103 bp, Artificial Sequence
  Synthetic Polynucleotide
taatacgactcactatagggtacttctgttggacttggcatactctgctgaacagaggagacagcagatgatgccaagtaacctggcggcagcgcaaaagatg

SEQ ID NO: 178885 - DNA, 103 bp, Artificial Sequence
  Synthetic Polynucleotide
taatacgactcactatagggcccttgcacgtacttctgttggacttggcaaacagaggagatgccaaatgcaacagaagaacctggcggcagcgcaaaagatg

SEQ ID NO: 178886 - DNA, 103 bp, Artificial Sequence
  Synthetic Polynucleotide
taatacgactcactatagggctccatacaccccttgcacgtacttctgttaacagaggagaaacagaatgacgtgcaagaacctggcggcagcgcaaaagatg

SEQ ID NO: 178887 - DNA, 103 bp, Artificial Sequence
  Synthetic Polynucleotide
taatacgactcactatagggtttctatcttctccatacaccccttgcacgaacagaggagacgtgcaatgggtgtatggaacctggcggcagcgcaaaagatg

SEQ ID NO: 178888 - DNA, 103 bp, Artificial Sequence
  Synthetic Polynucleotide
taatacgactcactatagggacctggcccttttctatcttctccatacacaacagaggagagtgtatatggaagatagaaacctggcggcagcgcaaaagatg

SEQ ID NO: 178889 - DNA, 103 bp, Artificial Sequence
  Synthetic Polynucleotide
taatacgactcactatagggagaggcgcgcccgctcttggcgtactcgacaacagaggagagtcgagatggccaagagcaacctggcggcagcgcaaaagatg

SEQ ID NO: 178890 - DNA, 103 bp, Artificial Sequence
  Synthetic Polynucleotide
taatacgactcactatagggggacaggcgcacctggcccttttctatcttaacagaggagaaagataatgaagggccagaacctggcggcagcgcaaaagatg

SEQ ID NO: 178891 - DNA, 103 bp, Artificial Sequence
  Synthetic Polynucleotide
taatacgactcactatagggccatcttcttggacaggcgcacctggccctaacagaggagaagggccatgtgcgcctgtaacctggcggcagcgcaaaagatg

SEQ ID NO: 178892 - DNA, 103 bp, Artificial Sequence
  Synthetic Polynucleotide
taatacgactcactatagggtccgggtccaccatcttcttggacaggcgcaacagaggagagcgcctatgcaagaagataacctggcggcagcgcaaaagatg

SEQ ID NO: 178893 - DNA, 103 bp, Artificial Sequence
  Synthetic Polynucleotide
taatacgactcactatagggctgtggcttctccgggtccaccatcttcttaacagaggagaaagaagatggtggacccgaacctggcggcagcgcaaaagatg

SEQ ID NO: 178894 - DNA, 103 bp, Artificial Sequence
  Synthetic Polynucleotide
taatacgactcactatagggtcatgcctagctgtggcttctccgggtccaaacagaggagatggaccatgagaagccacaacctggcggcagcgcaaaagatg

SEQ ID NO: 178895 - DNA, 103 bp, Artificial Sequence
  Synthetic Polynucleotide
taatacgactcactatagggcagcggtcaatcatgcctagctgtggcttcaacagaggagagaagccatggctaggcataacctggcggcagcgcaaaagatg

SEQ ID NO: 178896 - DNA, 103 bp, Artificial Sequence
  Synthetic Polynucleotide
taatacgactcactatagggtggatggtaccagcggtcaatcatgcctagaacagaggagactaggcatgattgaccgcaacctggcggcagcgcaaaagatg

SEQ ID NO: 178897 - DNA, 103 bp, Artificial Sequence
  Synthetic Polynucleotide
taatacgactcactatagggcaaagcagcctggatggtaccagcggtcaaaacagaggagattgaccatgggtaccatcaacctggcggcagcgcaaaagatg

SEQ ID NO: 178898 - DNA, 103 bp, Artificial Sequence
  Synthetic Polynucleotide
taatacgactcactatagggctgttcttgacaaagcagcctggatggtacaacagaggagagtaccaatgaggctgcttaacctggcggcagcgcaaaagatg

SEQ ID NO: 178899 - DNA, 103 bp, Artificial Sequence
  Synthetic Polynucleotide
taatacgactcactatagggcagctcctccctgttcttgacaaagcagccaacagaggagaggctgcatggtcaagaacaacctggcggcagcgcaaaagatg

SEQ ID NO: 178900 - DNA, 103 bp, Artificial Sequence
  Synthetic Polynucleotide
taatacgactcactatagggatttcttgcaagaggcgcgcccgctcttggaacagaggagaccaagaatgggcgcgcctaacctggcggcagcgcaaaagatg

SEQ ID NO: 178901 - DNA, 103 bp, Artificial Sequence
  Synthetic Polynucleotide
taatacgactcactataggggccggaaacccagctcctccctgttcttgaaacagaggagatcaagaatggggaggagcaacctggcggcagcgcaaaagatg

SEQ ID NO: 178902 - DNA, 103 bp, Artificial Sequence
  Synthetic Polynucleotide
taatacgactcactatagggctgtactcgggccggaaacccagctcctccaacagaggagaggaggaatggggtttccgaacctggcggcagcgcaaaagatg

SEQ ID NO: 178903 - DNA, 103 bp, Artificial Sequence
  Synthetic Polynucleotide
taatacgactcactatagggctgactcgcactgtactcgggccggaaaccaacagaggagaggtttcatgcccgagtacaacctggcggcagcgcaaaagatg

SEQ ID NO: 178904 - DNA, 103 bp, Artificial Sequence
  Synthetic Polynucleotide
taatacgactcactatagggagcccttgagctgactcgcactgtactcggaacagaggagaccgagtatggtgcgagtcaacctggcggcagcgcaaaagatg

SEQ ID NO: 178905 - DNA, 103 bp, Artificial Sequence
  Synthetic Polynucleotide
taatacgactcactatagggaggaggctgaagcccttgagctgactcgcaaacagaggagatgcgagatggctcaagggaacctggcggcagcgcaaaagatg

SEQ ID NO: 178906 - DNA, 103 bp, Artificial Sequence
  Synthetic Polynucleotide
taatacgactcactatagggctctgtagcaaggaggctgaagcccttgagaacagaggagactcaagatgttcagcctcaacctggcggcagcgcaaaagatg

SEQ ID NO: 178907 - DNA, 103 bp, Artificial Sequence
  Synthetic Polynucleotide
taatacgactcactatagggcttctttatcctctgtagcaaggaggctgaaacagaggagatcagccatgttgctacagaacctggcggcagcgcaaaagatg

SEQ ID NO: 178908 - DNA, 103 bp, Artificial Sequence
  Synthetic Polynucleotide
taatacgactcactatagggttcttcagggcttctttatcctctgtagcaaacagaggagatgctacatgggataaagaaacctggcggcagcgcaaaagatg

SEQ ID NO: 178909 - DNA, 103 bp, Artificial Sequence
  Synthetic Polynucleotide
taatacgactcactatagggtgggagctgcttcttcagggcttctttatcaacagaggagagataaaatggccctgaagaacctggcggcagcgcaaaagatg

SEQ ID NO: 178910 - DNA, 103 bp, Artificial Sequence
  Synthetic Polynucleotide
taatacgactcactatagggtcttgactcctgggagctgcttcttcagggaacagaggagaccctgaatgagcagctccaacctggcggcagcgcaaaagatg

SEQ ID NO: 178911 - DNA, 103 bp, Artificial Sequence
  Synthetic Polynucleotide
taatacgactcactatagggctctcgctgcatttcttgcaagaggcgcgcaacagaggagagcgcgcatgttgcaagaaaacctggcggcagcgcaaaagatg

SEQ ID NO: 178912 - DNA, 103 bp, Artificial Sequence
  Synthetic Polynucleotide
taatacgactcactatagggtttccttcactcttgactcctgggagctgcaacagaggagagcagctatgaggagtcaaaacctggcggcagcgcaaaagatg

SEQ ID NO: 178913 - DNA, 103 bp, Artificial Sequence
  Synthetic Polynucleotide
taatacgactcactataggggccttttctctttccttcactcttgactccaacagaggagaggagtcatgagtgaaggaaacctggcggcagcgcaaaagatg

SEQ ID NO: 178914 - DNA, 103 bp, Artificial Sequence
  Synthetic Polynucleotide
taatacgactcactatagggccacctcatcgccttttctctttccttcacaacagaggagagtgaagatgagagaaaagaacctggcggcagcgcaaaagatg

SEQ ID NO: 178915 - DNA, 103 bp, Artificial Sequence
  Synthetic Polynucleotide
taatacgactcactatagggtccactccatccacctcatcgccttttctcaacagaggagagagaaaatgcgatgaggtaacctggcggcagcgcaaaagatg

SEQ ID NO: 178916 - DNA, 103 bp, Artificial Sequence
  Synthetic Polynucleotide
taatacgactcactatagggcgccacttcatccactccatccacctcatcaacagaggagagatgagatggatggagtgaacctggcggcagcgcaaaagatg

SEQ ID NO: 178917 - DNA, 103 bp, Artificial Sequence
  Synthetic Polynucleotide
taatacgactcactatagggatttcttcttcgccacttcatccactccataacagaggagaatggagatgatgaagtggaacctggcggcagcgcaaaagatg

SEQ ID NO: 178918 - DNA, 103 bp, Artificial Sequence
  Synthetic Polynucleotide
taatacgactcactatagggtcttttttagatttcttcttcgccacttcaaacagaggagatgaagtatggaagaagaaaacctggcggcagcgcaaaagatg

SEQ ID NO: 178919 - DNA, 103 bp, Artificial Sequence
  Synthetic Polynucleotide
taatacgactcactatagggcttgtctttttcttttttagatttcttcttaacagaggagaaagaagatgtctaaaaaaaacctggcggcagcgcaaaagatg

SEQ ID NO: 178920 - DNA, 103 bp, Artificial Sequence
  Synthetic Polynucleotide
taatacgactcactataggggcttactatccttgtctttttcttttttagaacagaggagactaaaaatgaaaaagacaaacctggcggcagcgcaaaagatg

SEQ ID NO: 178921 - DNA, 103 bp, Artificial Sequence
  Synthetic Polynucleotide
taatacgactcactataggggctttttcaagcttactatccttgtcttttaacagaggagaaaaagaatgggatagtaaaacctggcggcagcgcaaaagatg

SEQ ID NO: 178922 - DNA, 103 bp, Artificial Sequence
  Synthetic Polynucleotide
taatacgactcactatagggcttggggatgctctcgctgcatttcttgcaaacagaggagatgcaagatgtgcagcgagaacctggcggcagcgcaaaagatg

SEQ ID NO: 178923 - DNA, 103 bp, Artificial Sequence
  Synthetic Polynucleotide
taatacgactcactatagggagcctttagggctttttcaagcttactatcaacagaggagagatagtatgcttgaaaaaaacctggcggcagcgcaaaagatg

SEQ ID NO: 178924 - DNA, 103 bp, Artificial Sequence
  Synthetic Polynucleotide
taatacgactcactatagggggtcgttctgagcctttagggctttttcaaaacagaggagattgaaaatgccctaaaggaacctggcggcagcgcaaaagatg

SEQ ID NO: 178925 - DNA, 103 bp, Artificial Sequence
  Synthetic Polynucleotide
taatacgactcactatagggttccagatcaggtcgttctgagcctttaggaacagaggagacctaaaatgtcagaacgaaacctggcggcagcgcaaaagatg

SEQ ID NO: 178926 - DNA, 103 bp, Artificial Sequence
  Synthetic Polynucleotide
taatacgactcactataggggtccttgatgttccagatcaggtcgttctgaacagaggagacagaacatgctgatctggaacctggcggcagcgcaaaagatg

SEQ ID NO: 178927 - DNA, 103 bp, Artificial Sequence
  Synthetic Polynucleotide
taatacgactcactatagggtctttagctcgtccttgatgttccagatcaaacagaggagatgatctatgacatcaaggaacctggcggcagcgcaaaagatg

SEQ ID NO: 178928 - DNA, 103 bp, Artificial Sequence
  Synthetic Polynucleotide
taatacgactcactataggggaacacactttctttagctcgtccttgatgaacagaggagacatcaaatgcgagctaaaaacctggcggcagcgcaaaagatg

SEQ ID NO: 178929 - DNA, 103 bp, Artificial Sequence
  Synthetic Polynucleotide
taatacgactcactataggggtcattagttgaacacactttctttagctcaacagaggagagagctaatgaaagtgtgtaacctggcggcagcgcaaaagatg

SEQ ID NO: 178930 - DNA, 103 bp, Artificial Sequence
  Synthetic Polynucleotide
taatacgactcactataggggctccttcaggtcattagttgaacacacttaacagaggagaaagtgtatgcaactaatgaacctggcggcagcgcaaaagatg

SEQ ID NO: 178931 - DNA, 103 bp, Artificial Sequence
  Synthetic Polynucleotide
taatacgactcactatagggaagatgagtagctccttcaggtcattagttaacagaggagaaactaaatgcctgaaggaaacctggcggcagcgcaaaagatg

SEQ ID NO: 178932 - DNA, 103 bp, Artificial Sequence
  Synthetic Polynucleotide
taatacgactcactatagggctgcttgttgaagatgagtagctccttcagaacagaggagactgaagatgctactcatcaacctggcggcagcgcaaaagatg

SEQ ID NO: 178933 - DNA, 103 bp, Artificial Sequence
  Synthetic Polynucleotide
taatacgactcactatagggggagcgagtccttggggatgctctcgctgcaacagaggagagcagcgatggcatccccaaacctggcggcagcgcaaaagatg

SEQ ID NO: 178934 - DNA, 103 bp, Artificial Sequence
  Synthetic Polynucleotide
taatacgactcactatagggaaggcacttgctgcttgttgaagatgagtaaacagaggagatactcaatgtcaacaagcaacctggcggcagcgcaaaagatg

SEQ ID NO: 178935 - DNA, 103 bp, Artificial Sequence
  Synthetic Polynucleotide
taatacgactcactataggggactccccagaaggcacttgctgcttgttgaacagaggagacaacaaatggcaagtgccaacctggcggcagcgcaaaagatg

SEQ ID NO: 178936 - DNA, 103 bp, Artificial Sequence
  Synthetic Polynucleotide
taatacgactcactatagggcaagatcgccgactccccagaaggcacttgaacagaggagacaagtgatgtctggggagaacctggcggcagcgcaaaagatg

SEQ ID NO: 178937 - DNA, 103 bp, Artificial Sequence
  Synthetic Polynucleotide
taatacgactcactatagggctactcggtccaagatcgccgactccccagaacagaggagactggggatgcggcgatctaacctggcggcagcgcaaaagatg

SEQ ID NO: 178938 - DNA, 103 bp, Artificial Sequence
  Synthetic Polynucleotide
taatacgactcactatagggatgccatcagctactcggtccaagatcgccaacagaggagaggcgatatgggaccgagtaacctggcggcagcgcaaaagatg

SEQ ID NO: 178939 - DNA, 103 bp, Artificial Sequence
  Synthetic Polynucleotide
taatacgactcactatagggaccgaacaccatgccatcagctactcggtcaacagaggagagaccgaatggctgatggcaacctggcggcagcgcaaaagatg

SEQ ID NO: 178940 - DNA, 103 bp, Artificial Sequence
  Synthetic Polynucleotide
taatacgactcactataggggaaggagggcaccgaacaccatgccatcagaacagaggagactgatgatgtggtgttcgaacctggcggcagcgcaaaagatg

SEQ ID NO: 178941 - DNA, 103 bp, Artificial Sequence
  Synthetic Polynucleotide
taatacgactcactatagggtcctcgcagggaaggagggcaccgaacaccaacagaggagaggtgttatgtgccctcctaacctggcggcagcgcaaaagatg

SEQ ID NO: 178942 - DNA, 103 bp, Artificial Sequence
  Synthetic Polynucleotide
taatacgactcactatagggacccgagcattcctcgcagggaaggagggcaacagaggagagccctcatgccctgcgagaacctggcggcagcgcaaaagatg

SEQ ID NO: 178943 - DNA, 103 bp, Artificial Sequence
  Synthetic Polynucleotide
taatacgactcactatagggagaccagctgacccgagcattcctcgcaggaacagaggagacctgcgatgaatgctcggaacctggcggcagcgcaaaagatg

SEQ ID NO: 178944 - DNA, 103 bp, Artificial Sequence
  Synthetic Polynucleotide
taatacgactcactatagggatggccatccggagcgagtccttggggatgaacagaggagacatcccatgggactcgctaacctggcggcagcgcaaaagatg

SEQ ID NO: 178945 - DNA, 103 bp, Artificial Sequence
  Synthetic Polynucleotide
taatacgactcactatagggtcgctcttgaagaccagctgacccgagcataacagaggagaatgctcatgtcagctggtaacctggcggcagcgcaaaagatg

SEQ ID NO: 178946 - DNA, 103 bp, Artificial Sequence
  Synthetic Polynucleotide
taatacgactcactataggggtaataggcatcgctcttgaagaccagctgaacagaggagacagctgatgttcaagagcaacctggcggcagcgcaaaagatg

SEQ ID NO: 178947 - DNA, 103 bp, Artificial Sequence
  Synthetic Polynucleotide
taatacgactcactatagggccccagtgcagtaataggcatcgctcttgaaacagaggagatcaagaatgatgcctattaacctggcggcagcgcaaaagatg

SEQ ID NO: 178948 - DNA, 103 bp, Artificial Sequence
  Synthetic Polynucleotide
taatacgactcactataggggcagtgacgtccccagtgcagtaataggcaaacagaggagatgcctaatgctgcactggaacctggcggcagcgcaaaagatg

SEQ ID NO: 178949 - DNA, 103 bp, Artificial Sequence
  Synthetic Polynucleotide
taatacgactcactatagggcttggtccaggcagtgacgtccccagtgcaaacagaggagatgcactatggacgtcactaacctggcggcagcgcaaaagatg

SEQ ID NO: 178950 - DNA, 103 bp, Artificial Sequence
  Synthetic Polynucleotide
taatacgactcactatagggtgaccatacacttggtccaggcagtgacgtaacagaggagaacgtcaatgcctggaccaaacctggcggcagcgcaaaagatg

SEQ ID NO: 178951 - DNA, 103 bp, Artificial Sequence
  Synthetic Polynucleotide
taatacgactcactataggggtctgtgtcttgaccatacacttggtccagaacagaggagactggacatggtgtatggtaacctggcggcagcgcaaaagatg

SEQ ID NO: 178952 - DNA, 103 bp, Artificial Sequence
  Synthetic Polynucleotide
taatacgactcactatagggccggttgggtgtctgtgtcttgaccatacaaacagaggagatgtatgatgaagacacagaacctggcggcagcgcaaaagatg

SEQ ID NO: 178953 - DNA, 103 bp, Artificial Sequence
  Synthetic Polynucleotide
taatacgactcactatagggcccactccttccggttgggtgtctgtgtctaacagaggagaagacacatgcacccaaccaacctggcggcagcgcaaaagatg

SEQ ID NO: 178954 - DNA, 103 bp, Artificial Sequence
  Synthetic Polynucleotide
taatacgactcactatagggtttggggttacccactccttccggttgggtaacagaggagaacccaaatggaaggagtgaacctggcggcagcgcaaaagatg

SEQ ID NO: 178955 - DNA, 103 bp, Artificial Sequence
  Synthetic Polynucleotide
taatacgactcactataggggccgcacgaagcgtcgttcacccgctccataacagaggagaatggagatggtgaacgacaacctggcggcagcgcaaaagatg

SEQ ID NO: 178956 - DNA, 103 bp, Artificial Sequence
  Synthetic Polynucleotide
taatacgactcactataggggaagcgcccgccgtttttgcgctgctggttaacagaggagaaaccagatgcgcaaaaacaacctggcggcagcgcaaaagatg

SEQ ID NO: 178957 - DNA, 103 bp, Artificial Sequence
  Synthetic Polynucleotide
taatacgactcactatagggttcagagatgggtagcccattctcacccagaacagaggagactgggtatgaatgggctaaacctggcggcagcgcaaaagatg

SEQ ID NO: 178958 - DNA, 103 bp, Artificial Sequence
  Synthetic Polynucleotide
taatacgactcactatagggcgtcggggtcttcagagatgggtagcccataacagaggagaatgggcatgccatctctgaacctggcggcagcgcaaaagatg

SEQ ID NO: 178959 - DNA, 103 bp, Artificial Sequence
  Synthetic Polynucleotide
taatacgactcactatagggtttcgggggccgtcggggtcttcagagatgaacagaggagacatctcatgagaccccgaaacctggcggcagcgcaaaagatg

SEQ ID NO: 178960 - DNA, 103 bp, Artificial Sequence
  Synthetic Polynucleotide
taatacgactcactatagggccggctcctctttcgggggccgtcggggtcaacagaggagagaccccatgggcccccgaaacctggcggcagcgcaaaagatg

SEQ ID NO: 178961 - DNA, 103 bp, Artificial Sequence
  Synthetic Polynucleotide
taatacgactcactataggggcttcctggtccggctcctctttcgggggcaacagaggagagcccccatgagaggagccaacctggcggcagcgcaaaagatg

SEQ ID NO: 178962 - DNA, 103 bp, Artificial Sequence
  Synthetic Polynucleotide
taatacgactcactatagggcaagccacctgcttcctggtccggctcctcaacagaggagagaggagatggaccaggaaaacctggcggcagcgcaaaagatg

SEQ ID NO: 178963 - DNA, 103 bp, Artificial Sequence
  Synthetic Polynucleotide
taatacgactcactataggggcagatctcacaagccacctgcttcctggtaacagaggagaaccaggatgcaggtggctaacctggcggcagcgcaaaagatg

SEQ ID NO: 178964 - DNA, 103 bp, Artificial Sequence
  Synthetic Polynucleotide
taatacgactcactatagggagatcttgccgcagatctcacaagccacctaacagaggagaaggtggatggtgagatctaacctggcggcagcgcaaaagatg

SEQ ID NO: 178965 - DNA, 103 bp, Artificial Sequence
  Synthetic Polynucleotide
taatacgactcactatagggacatcacggaagatcttgccgcagatctcaaacagaggagatgagatatgcggcaagataacctggcggcagcgcaaaagatg

SEQ ID NO: 178966 - DNA, 103 bp, Artificial Sequence
  Synthetic Polynucleotide
taatacgactcactatagggaagatgatacacatcacggaagatcttgccaacagaggagaggcaagatgttccgtgataacctggcggcagcgcaaaagatg

SEQ ID NO: 178967 - DNA, 103 bp, Artificial Sequence
  Synthetic Polynucleotide
taatacgactcactataggggcacgtcgcagaagcgcccgccgtttttgcaacagaggagagcaaaaatggcgggcgctaacctggcggcagcgcaaaagatg

SEQ ID NO: 178968 - DNA, 103 bp, Artificial Sequence
  Synthetic Polynucleotide
taatacgactcactatagggtgtgccggttaagatgatacacatcacggaaacagaggagatccgtgatgtgtatcatcaacctggcggcagcgcaaaagatg

SEQ ID NO: 178969 - DNA, 103 bp, Artificial Sequence
  Synthetic Polynucleotide
taatacgactcactatagggtgggacagcttgtgccggttaagatgatacaacagaggagagtatcaatgtaaccggcaaacctggcggcagcgcaaaagatg

SEQ ID NO: 178970 - DNA, 103 bp, Artificial Sequence
  Synthetic Polynucleotide
taatacgactcactatagggctccccagagtgggacagcttgtgccggttaacagaggagaaaccggatgaagctgtccaacctggcggcagcgcaaaagatg

SEQ ID NO: 178971 - DNA, 103 bp, Artificial Sequence
  Synthetic Polynucleotide
taatacgactcactatagggagtagggcttctccccagagtgggacagctaacagaggagaagctgtatgactctggggaacctggcggcagcgcaaaagatg

SEQ ID NO: 178972 - DNA, 103 bp, Artificial Sequence
  Synthetic Polynucleotide
taatacgactcactatagggacagggcaggagtagggcttctccccagagaacagaggagactctggatggaagccctaaacctggcggcagcgcaaaagatg

SEQ ID NO: 178973 - DNA, 103 bp, Artificial Sequence
  Synthetic Polynucleotide
taatacgactcactatagggcaacccacacacagggcaggagtagggcttaacagaggagaaagcccatgtcctgccctaacctggcggcagcgcaaaagatg

SEQ ID NO: 178974 - DNA, 103 bp, Artificial Sequence
  Synthetic Polynucleotide
taatacgactcactatagggtcttgaaccgcaacccacacacagggcaggaacagaggagacctgccatgtgtgtgggtaacctggcggcagcgcaaaagatg

SEQ ID NO: 178975 - DNA, 103 bp, Artificial Sequence
  Synthetic Polynucleotide
taatacgactcactatagggcggtcttttctcttgaaccgcaacccacacaacagaggagagtgtggatggcggttcaaaacctggcggcagcgcaaaagatg

SEQ ID NO: 178976 - DNA, 103 bp, Artificial Sequence
  Synthetic Polynucleotide
taatacgactcactataggggtaggacatgcggtcttttctcttgaaccgaacagaggagacggttcatgagaaaagacaacctggcggcagcgcaaaagatg

SEQ ID NO: 178977 - DNA, 103 bp, Artificial Sequence
  Synthetic Polynucleotide
taatacgactcactatagggaccgcacatggtaggacatgcggtcttttcaacagaggagagaaaagatggcatgtcctaacctggcggcagcgcaaaagatg

SEQ ID NO: 178978 - DNA, 103 bp, Artificial Sequence
  Synthetic Polynucleotide
taatacgactcactatagggacccgcaagagcacgtcgcagaagcgcccgaacagaggagacgggcgatgctgcgacgtaacctggcggcagcgcaaaagatg

SEQ ID NO: 178979 - DNA, 103 bp, Artificial Sequence
  Synthetic Polynucleotide
taatacgactcactatagggccatcatgggaccgcacatggtaggacatgaacagaggagacatgtcatgccatgtgcgaacctggcggcagcgcaaaagatg

SEQ ID NO: 178980 - DNA, 103 bp, Artificial Sequence
  Synthetic Polynucleotide
taatacgactcactataggggcccacggacccatcatgggaccgcacatgaacagaggagacatgtgatgtcccatgataacctggcggcagcgcaaaagatg

SEQ ID NO: 178981 - DNA, 103 bp, Artificial Sequence
  Synthetic Polynucleotide
taatacgactcactatagggtgtaaggcttgcccacggacccatcatgggaacagaggagacccatgatgggtccgtggaacctggcggcagcgcaaaagatg

SEQ ID NO: 178982 - DNA, 103 bp, Artificial Sequence
  Synthetic Polynucleotide
taatacgactcactatagggctctggcagatgtaaggcttgcccacggacaacagaggagagtccgtatgcaagccttaaacctggcggcagcgcaaaagatg

SEQ ID NO: 178983 - DNA, 103 bp, Artificial Sequence
  Synthetic Polynucleotide
taatacgactcactatagggtttcccacagctctggcagatgtaaggcttaacagaggagaaagcctatgatctgccagaacctggcggcagcgcaaaagatg

SEQ ID NO: 178984 - DNA, 103 bp, Artificial Sequence
  Synthetic Polynucleotide
taatacgactcactatagggtggagaagcctttcccacagctctggcagaaacagaggagatctgccatggctgtgggaaacctggcggcagcgcaaaagatg

SEQ ID NO: 178985 - DNA, 103 bp, Artificial Sequence
  Synthetic Polynucleotide
taatacgactcactatagggtgatcaggcctggagaagcctttcccacagaacagaggagactgtggatgaggcttctcaacctggcggcagcgcaaaagatg

SEQ ID NO: 178986 - DNA, 103 bp, Artificial Sequence
  Synthetic Polynucleotide
taatacgactcactatagggtccgttcaagtgatcaggcctggagaagccaacagaggagaggcttcatgaggcctgataacctggcggcagcgcaaaagatg

SEQ ID NO: 178987 - DNA, 103 bp, Artificial Sequence
  Synthetic Polynucleotide
taatacgactcactataggggcttgatatgtccgttcaagtgatcaggccaacagaggagaggcctgatgacttgaacgaacctggcggcagcgcaaaagatg

SEQ ID NO: 178988 - DNA, 103 bp, Artificial Sequence
  Synthetic Polynucleotide
taatacgactcactataggggtgtgcacctgcttgatatgtccgttcaagaacagaggagacttgaaatgacatatcaaaacctggcggcagcgcaaaagatg

SEQ ID NO: 178989 - DNA, 103 bp, Artificial Sequence
  Synthetic Polynucleotide
taatacgactcactatagggctcgtcgcctacccgcaagagcacgtcgcaaacagaggagatgcgacatgctcttgcggaacctggcggcagcgcaaaagatg

SEQ ID NO: 178990 - DNA, 103 bp, Artificial Sequence
  Synthetic Polynucleotide
taatacgactcactatagggccgctcagaagtgtgcacctgcttgatatgaacagaggagacatatcatgcaggtgcacaacctggcggcagcgcaaaagatg

SEQ ID NO: 178991 - DNA, 103 bp, Artificial Sequence
  Synthetic Polynucleotide
taatacgactcactatagggacttgtgaggccgctcagaagtgtgcacctaacagaggagaaggtgcatgcttctgagcaacctggcggcagcgcaaaagatg

SEQ ID NO: 178992 - DNA, 103 bp, Artificial Sequence
  Synthetic Polynucleotide
taatacgactcactatagggcaggtctgacacttgtgaggccgctcagaaaacagaggagattctgaatggcctcacaaaacctggcggcagcgcaaaagatg

SEQ ID NO: 178993 - DNA, 103 bp, Artificial Sequence
  Synthetic Polynucleotide
taatacgactcactatagggagaagcattgcaggtctgacacttgtgaggaacagaggagacctcacatgtgtcagaccaacctggcggcagcgcaaaagatg

SEQ ID NO: 178994 - DNA, 103 bp, Artificial Sequence
  Synthetic Polynucleotide
taatacgactcactataggggggtggcaaaagaagcattgcaggtctgacaacagaggagagtcagaatggcaatgcttaacctggcggcagcgcaaaagatg

SEQ ID NO: 178995 - DNA, 103 bp, Artificial Sequence
  Synthetic Polynucleotide
taatacgactcactatagggagacggtctcgggtggcaaaagaagcattgaacagaggagacaatgcatgttttgccacaacctggcggcagcgcaaaagatg

SEQ ID NO: 178996 - DNA, 103 bp, Artificial Sequence
  Synthetic Polynucleotide
taatacgactcactataggggtgggagcgcagacggtctcgggtggcaaaaacagaggagatttgccatgcgagaccgtaacctggcggcagcgcaaaagatg

SEQ ID NO: 178997 - DNA, 103 bp, Artificial Sequence
  Synthetic Polynucleotide
taatacgactcactataggggacaggccaggtgggagcgcagacggtctcaacagaggagagagaccatgtgcgctcccaacctggcggcagcgcaaaagatg

SEQ ID NO: 178998 - DNA, 103 bp, Artificial Sequence
  Synthetic Polynucleotide
taatacgactcactatagggttgtcttcatgacaggccaggtgggagcgcaacagaggagagcgctcatgcctggcctgaacctggcggcagcgcaaaagatg

SEQ ID NO: 178999 - DNA, 103 bp, Artificial Sequence
  Synthetic Polynucleotide
taatacgactcactataggggcagggcaccttgtcttcatgacaggccagaacagaggagactggccatgcatgaagacaacctggcggcagcgcaaaagatg

SEQ ID NO: 179000 - DNA, 103 bp, Artificial Sequence
  Synthetic Polynucleotide
taatacgactcactatagggctgggaagctctcgtcgcctacccgcaagaaacagaggagatcttgcatgtaggcgacgaacctggcggcagcgcaaaagatg

SEQ ID NO: 179001 - DNA, 103 bp, Artificial Sequence
  Synthetic Polynucleotide
taatacgactcactatagggcacacacctggcagggcaccttgtcttcataacagaggagaatgaagatgaggtgccctaacctggcggcagcgcaaaagatg

SEQ ID NO: 179002 - DNA, 103 bp, Artificial Sequence
  Synthetic Polynucleotide
taatacgactcactatagggaagtacttcccacacacctggcagggcaccaacagaggagaggtgccatgccaggtgtgaacctggcggcagcgcaaaagatg

SEQ ID NO: 179003 - DNA, 103 bp, Artificial Sequence
  Synthetic Polynucleotide
taatacgactcactatagggtgctgcccgcaagtacttcccacacacctgaacagaggagacaggtgatggggaagtacaacctggcggcagcgcaaaagatg

SEQ ID NO: 179004 - DNA, 103 bp, Artificial Sequence
  Synthetic Polynucleotide
taatacgactcactatagggctgccatgtatgctgcccgcaagtacttccaacagaggagaggaagtatgtgcgggcagaacctggcggcagcgcaaaagatg

SEQ ID NO: 179005 - DNA, 103 bp, Artificial Sequence
  Synthetic Polynucleotide
taatacgactcactatagggttcaggtggtctgccatgtatgctgcccgcaacagaggagagcgggcatgatacatggcaacctggcggcagcgcaaaagatg

SEQ ID NO: 179006 - DNA, 103 bp, Artificial Sequence
  Synthetic Polynucleotide
taatacgactcactataggggctgtgcttcttcaggtggtctgccatgtaaacagaggagatacatgatggaccacctgaacctggcggcagcgcaaaagatg

SEQ ID NO: 179007 - DNA, 103 bp, Artificial Sequence
  Synthetic Polynucleotide
taatacgactcactatagggtgggcccctcgctgtgcttcttcaggtggtaacagaggagaaccaccatgagaagcacaaacctggcggcagcgcaaaagatg

SEQ ID NO: 179008 - DNA, 103 bp, Artificial Sequence
  Synthetic Polynucleotide
taatacgactcactatagggcagaagttgctgggcccctcgctgtgcttcaacagaggagagaagcaatgcgaggggccaacctggcggcagcgcaaaagatg

SEQ ID NO: 179009 - DNA, 103 bp, Artificial Sequence
  Synthetic Polynucleotide
taatacgactcactatagggacagatactgcagaagttgctgggcccctcaacagaggagagaggggatgagcaacttcaacctggcggcagcgcaaaagatg

SEQ ID NO: 179010 - DNA, 103 bp, Artificial Sequence
  Synthetic Polynucleotide
taatacgactcactatagggaacctcggttacagatactgcagaagttgcaacagaggagagcaactatggcagtatctaacctggcggcagcgcaaaagatg

SEQ ID NO: 179011 - DNA, 103 bp, Artificial Sequence
  Synthetic Polynucleotide
taatacgactcactataggggcgcggtgcgctgggaagctctcgtcgcctaacagaggagaaggcgaatggagcttcccaacctggcggcagcgcaaaagatg

SEQ ID NO: 179012 - DNA, 103 bp, Artificial Sequence
  Synthetic Polynucleotide
taatacgactcactataggggcagaggagaaacctcggttacagatactgaacagaggagacagtatatgtaaccgaggaacctggcggcagcgcaaaagatg

SEQ ID NO: 179013 - DNA, 103 bp, Artificial Sequence
  Synthetic Polynucleotide
taatacgactcactatagggtaagtaggaggcagaggagaaacctcggttaacagaggagaaaccgaatgttctcctctaacctggcggcagcgcaaaagatg

SEQ ID NO: 179014 - DNA, 103 bp, Artificial Sequence
  Synthetic Polynucleotide
taatacgactcactatagggcatggacctttaagtaggaggcagaggagaaacagaggagatctcctatgcctcctactaacctggcggcagcgcaaaagatg

SEQ ID NO: 179015 - DNA, 103 bp, Artificial Sequence
  Synthetic Polynucleotide
taatacgactcactatagggtgggttttaacatggacctttaagtaggagaacagaggagactcctaatgaaaggtccaaacctggcggcagcgcaaaagatg

SEQ ID NO: 179016 - DNA, 103 bp, Artificial Sequence
  Synthetic Polynucleotide
taatacgactcactatagggaacaccgtggtgggttttaacatggaccttaacagaggagaaaggtcatggttaaaaccaacctggcggcagcgcaaaagatg

SEQ ID NO: 179017 - DNA, 103 bp, Artificial Sequence
  Synthetic Polynucleotide
taatacgactcactatagggggggaaggggaacaccgtggtgggttttaaaacagaggagattaaaaatgaccacggtgaacctggcggcagcgcaaaagatg

SEQ ID NO: 179018 - DNA, 103 bp, Artificial Sequence
  Synthetic Polynucleotide
taatacgactcactatagggctggagacctggggaaggggaacaccgtggaacagaggagaccacggatgtccccttccaacctggcggcagcgcaaaagatg

SEQ ID NO: 179019 - DNA, 103 bp, Artificial Sequence
  Synthetic Polynucleotide
taatacgactcactatagggctcctggtgcctggagacctggggaaggggaacagaggagaccccttatgcaggtctccaacctggcggcagcgcaaaagatg

SEQ ID NO: 179020 - DNA, 103 bp, Artificial Sequence
  Synthetic Polynucleotide
taatacgactcactatagggtcaggatgggctcctggtgcctggagacctaacagaggagaaggtctatgggcaccaggaacctggcggcagcgcaaaagatg

SEQ ID NO: 179021 - DNA, 103 bp, Artificial Sequence
  Synthetic Polynucleotide
taatacgactcactataggggctcccccattcaggatgggctcctggtgcaacagaggagagcaccaatggcccatcctaacctggcggcagcgcaaaagatg

SEQ ID NO: 179022 - DNA, 103 bp, Artificial Sequence
  Synthetic Polynucleotide
taatacgactcactatagggggccagcacggcgcggtgcgctgggaagctaacagaggagaagcttcatggcgcaccgcaacctggcggcagcgcaaaagatg

SEQ ID NO: 179023 - DNA, 103 bp, Artificial Sequence
  Synthetic Polynucleotide
taatacgactcactataggggtggaacgctgctcccccattcaggatgggaacagaggagacccatcatgaatgggggaaacctggcggcagcgcaaaagatg

SEQ ID NO: 179024 - DNA, 103 bp, Artificial Sequence
  Synthetic Polynucleotide
taatacgactcactatagggtcctggcgcagtggaacgctgctcccccataacagaggagaatggggatgcagcgttccaacctggcggcagcgcaaaagatg

SEQ ID NO: 179025 - DNA, 103 bp, Artificial Sequence
  Synthetic Polynucleotide
taatacgactcactatagggttgccataggtcctggcgcagtggaacgctaacagaggagaagcgttatgctgcgccagaacctggcggcagcgcaaaagatg

SEQ ID NO: 179026 - DNA, 103 bp, Artificial Sequence
  Synthetic Polynucleotide
taatacgactcactataggggccttctttgttgccataggtcctggcgcaaacagaggagatgcgccatgacctatggcaacctggcggcagcgcaaaagatg

SEQ ID NO: 179027 - DNA, 103 bp, Artificial Sequence
  Synthetic Polynucleotide
taatacgactcactatagggagcatttctggccttctttgttgccataggaacagaggagacctatgatgacaaagaagaacctggcggcagcgcaaaagatg

SEQ ID NO: 179028 - DNA, 103 bp, Artificial Sequence
  Synthetic Polynucleotide
taatacgactcactatagggtcctgatgtgagcatttctggccttctttgaacagaggagacaaagaatgccagaaatgaacctggcggcagcgcaaaagatg

SEQ ID NO: 179029 - DNA, 103 bp, Artificial Sequence
  Synthetic Polynucleotide
taatacgactcactatagggctcaatcggatcctgatgtgagcatttctgaacagaggagacagaaaatgtcacatcagaacctggcggcagcgcaaaagatg

SEQ ID NO: 179030 - DNA, 103 bp, Artificial Sequence
  Synthetic Polynucleotide
taatacgactcactatagggagtcagagctctcaatcggatcctgatgtgaacagaggagacacatcatgatccgattgaacctggcggcagcgcaaaagatg

SEQ ID NO: 179031 - DNA, 103 bp, Artificial Sequence
  Synthetic Polynucleotide
taatacgactcactatagggtcaccataggagtcagagctctcaatcggaaacagaggagatccgatatggagctctgaaacctggcggcagcgcaaaagatg

SEQ ID NO: 179032 - DNA, 103 bp, Artificial Sequence
  Synthetic Polynucleotide
taatacgactcactatagggatctgagaggtcaccataggagtcagagctaacagaggagaagctctatgtcctatggtaacctggcggcagcgcaaaagatg

SEQ ID NO: 179033 - DNA, 103 bp, Artificial Sequence
  Synthetic Polynucleotide
taatacgactcactatagggcgctgcaggcggccagcacggcgcggtgcgaacagaggagacgcaccatgccgtgctggaacctggcggcagcgcaaaagatg

SEQ ID NO: 179034 - DNA, 103 bp, Artificial Sequence
  Synthetic Polynucleotide
taatacgactcactatagggggtcgctggcatctgagaggtcaccataggaacagaggagacctatgatgacctctcagaacctggcggcagcgcaaaagatg

SEQ ID NO: 179035 - DNA, 103 bp, Artificial Sequence
  Synthetic Polynucleotide
taatacgactcactatagggggcgtcttcaggtcgctggcatctgagaggaacagaggagacctctcatgtgccagcgaaacctggcggcagcgcaaaagatg

SEQ ID NO: 179036 - DNA, 103 bp, Artificial Sequence
  Synthetic Polynucleotide
taatacgactcactatagggctgcttctctggcgtcttcaggtcgctggcaacagaggagagccagcatgctgaagacgaacctggcggcagcgcaaaagatg

SEQ ID NO: 179037 - DNA, 103 bp, Artificial Sequence
  Synthetic Polynucleotide
taatacgactcactatagggcattggcactctgcttctctggcgtcttcaaacagaggagatgaagaatgcagagaagcaacctggcggcagcgcaaaagatg

SEQ ID NO: 179038 - DNA, 103 bp, Artificial Sequence
  Synthetic Polynucleotide
taatacgactcactataggggagaaagagccattggcactctgcttctctaacagaggagaagagaaatggagtgccaaaacctggcggcagcgcaaaagatg

SEQ ID NO: 179039 - DNA, 103 bp, Artificial Sequence
  Synthetic Polynucleotide
taatacgactcactatagggcatgtcgcaggagaaagagccattggcactaacagaggagaagtgccatgggctctttcaacctggcggcagcgcaaaagatg

SEQ ID NO: 179040 - DNA, 103 bp, Artificial Sequence
  Synthetic Polynucleotide
taatacgactcactatagggtggggactgccatgtcgcaggagaaagagcaacagaggagagctcttatgcctgcgacaaacctggcggcagcgcaaaagatg

SEQ ID NO: 179041 - DNA, 103 bp, Artificial Sequence
  Synthetic Polynucleotide
taatacgactcactatagggattttgtttttggggactgccatgtcgcagaacagaggagactgcgaatgggcagtcccaacctggcggcagcgcaaaagatg

SEQ ID NO: 179042 - DNA, 103 bp, Artificial Sequence
  Synthetic Polynucleotide
taatacgactcactatagggatcagactccattttgtttttggggactgcaacagaggagagcagtcatgaaaaacaaaaacctggcggcagcgcaaaagatg

SEQ ID NO: 179043 - DNA, 103 bp, Artificial Sequence
  Synthetic Polynucleotide
taatacgactcactatagggtcttctccccatcagactccattttgttttaacagaggagaaaaacaatgtggagtctgaacctggcggcagcgcaaaagatg

SEQ ID NO: 179044 - DNA, 103 bp, Artificial Sequence
  Synthetic Polynucleotide
taatacgactcactatagggtcaaagtactcgctgcaggcggccagcacgaacagaggagacgtgctatgcgcctgcagaacctggcggcagcgcaaaagatg

SEQ ID NO: 179045 - DNA, 103 bp, Artificial Sequence
  Synthetic Polynucleotide
taatacgactcactatagggcatgggtacttcttctccccatcagactccaacagaggagaggagtcatgtggggagaaaacctggcggcagcgcaaaagatg

SEQ ID NO: 179046 - DNA, 103 bp, Artificial Sequence
  Synthetic Polynucleotide
taatacgactcactatagggacattcagggcatgggtacttcttctccccaacagaggagaggggagatgaagtacccaaacctggcggcagcgcaaaagatg

SEQ ID NO: 179047 - DNA, 103 bp, Artificial Sequence
  Synthetic Polynucleotide
taatacgactcactatagggagaagctcccacattcagggcatgggtactaacagaggagaagtaccatggccctgaataacctggcggcagcgcaaaagatg

SEQ ID NO: 179048 - DNA, 103 bp, Artificial Sequence
  Synthetic Polynucleotide
taatacgactcactatagggttagagcggaagaagctcccacattcagggaacagaggagaccctgaatgtgggagcttaacctggcggcagcgcaaaagatg

SEQ ID NO: 179049 - DNA, 103 bp, Artificial Sequence
  Synthetic Polynucleotide
taatacgactcactatagggcaagtaggacttagagcggaagaagctcccaacagaggagagggagcatgttccgctctaacctggcggcagcgcaaaagatg

SEQ ID NO: 179050 - DNA, 103 bp, Artificial Sequence
  Synthetic Polynucleotide
taatacgactcactatagggtgtgtttgttcaagtaggacttagagcggaaacagaggagatccgctatgagtcctactaacctggcggcagcgcaaaagatg

SEQ ID NO: 179051 - DNA, 103 bp, Artificial Sequence
  Synthetic Polynucleotide
taatacgactcactatagggaccttctggatgtgtttgttcaagtaggacaacagaggagagtcctaatggaacaaacaaacctggcggcagcgcaaaagatg

SEQ ID NO: 179052 - DNA, 103 bp, Artificial Sequence
  Synthetic Polynucleotide
taatacgactcactatagggccggacatgcaccttctggatgtgtttgttaacagaggagaaacaaaatgatccagaagaacctggcggcagcgcaaaagatg

SEQ ID NO: 179053 - DNA, 103 bp, Artificial Sequence
  Synthetic Polynucleotide
taatacgactcactatagggccccgagagcccggacatgcaccttctggaaacagaggagatccagaatgtgcatgtccaacctggcggcagcgcaaaagatg

SEQ ID NO: 179054 - DNA, 103 bp, Artificial Sequence
  Synthetic Polynucleotide
taatacgactcactatagggcccagggggcccccgagagcccggacatgcaacagaggagagcatgtatgggctctcggaacctggcggcagcgcaaaagatg

SEQ ID NO: 179055 - DNA, 103 bp, Artificial Sequence
  Synthetic Polynucleotide
taatacgactcactataggggaacaccgactcaaagtactcgctgcaggcaacagaggagagcctgcatggagtactttaacctggcggcagcgcaaaagatg

SEQ ID NO: 179056 - DNA, 103 bp, Artificial Sequence
  Synthetic Polynucleotide
taatacgactcactataggggcccaggtcccccagggggcccccgagagcaacagaggagagctctcatgggccccctgaacctggcggcagcgcaaaagatg

SEQ ID NO: 179057 - DNA, 103 bp, Artificial Sequence
  Synthetic Polynucleotide
taatacgactcactatagggcaagggcagggcccaggtcccccagggggcaacagaggagagcccccatggggacctggaacctggcggcagcgcaaaagatg

SEQ ID NO: 179058 - DNA, 103 bp, Artificial Sequence
  Synthetic Polynucleotide
taatacgactcactatagggaaaggtgagccaagggcagggcccaggtccaacagaggagaggacctatgccctgccctaacctggcggcagcgcaaaagatg

SEQ ID NO: 179059 - DNA, 103 bp, Artificial Sequence
  Synthetic Polynucleotide
taatacgactcactatagggctgaggagagaaaggtgagccaagggcaggaacagaggagacctgccatgggctcacctaacctggcggcagcgcaaaagatg

SEQ ID NO: 179060 - DNA, 103 bp, Artificial Sequence
  Synthetic Polynucleotide
taatacgactcactatagggacatgttctgctgaggagagaaaggtgagcaacagaggagagctcacatgtctctcctcaacctggcggcagcgcaaaagatg

SEQ ID NO: 179061 - DNA, 103 bp, Artificial Sequence
  Synthetic Polynucleotide
taatacgactcactatagggtcgaggagagacatgttctgctgaggagagaacagaggagactctccatggcagaacataacctggcggcagcgcaaaagatg

SEQ ID NO: 179062 - DNA, 103 bp, Artificial Sequence
  Synthetic Polynucleotide
taatacgactcactatagggcccaaaggactcgaggagagacatgttctgaacagaggagacagaacatgtctctcctcaacctggcggcagcgcaaaagatg

SEQ ID NO: 179063 - DNA, 103 bp, Artificial Sequence
  Synthetic Polynucleotide
taatacgactcactatagggcaatctgaaacccaaaggactcgaggagagaacagaggagactctccatgagtcctttgaacctggcggcagcgcaaaagatg

SEQ ID NO: 179064 - DNA, 103 bp, Artificial Sequence
  Synthetic Polynucleotide
taatacgactcactataggggccgactgaacaatctgaaacccaaaggacaacagaggagagtccttatggtttcagataacctggcggcagcgcaaaagatg

SEQ ID NO: 179065 - DNA, 103 bp, Artificial Sequence
  Synthetic Polynucleotide
taatacgactcactatagggtgacgcaaatgccgactgaacaatctgaaaaacagaggagatttcagatggttcagtcgaacctggcggcagcgcaaaagatg

SEQ ID NO: 179066 - DNA, 103 bp, Artificial Sequence
  Synthetic Polynucleotide
taatacgactcactatagggagccagacgggccgcacgaagcgtcgttcaaacagaggagatgaacgatgcttcgtgcgaacctggcggcagcgcaaaagatg

SEQ ID NO: 179067 - DNA, 103 bp, Artificial Sequence
  Synthetic Polynucleotide
taatacgactcactatagggactgggcgctgaacaccgactcaaagtactaacagaggagaagtactatgagtcggtgtaacctggcggcagcgcaaaagatg

SEQ ID NO: 179068 - DNA, 103 bp, Artificial Sequence
  Synthetic Polynucleotide
taatacgactcactatagggctactaaagatgacgcaaatgccgactgaaaacagaggagattcagtatgcatttgcgtaacctggcggcagcgcaaaagatg

SEQ ID NO: 179069 - DNA, 103 bp, Artificial Sequence
  Synthetic Polynucleotide
taatacgactcactatagggacctcaggatctactaaagatgacgcaaataacagaggagaatttgcatgatctttagtaacctggcggcagcgcaaaagatg

SEQ ID NO: 179070 - DNA, 103 bp, Artificial Sequence
  Synthetic Polynucleotide
taatacgactcactatagggctgctggtcaacctcaggatctactaaagaaacagaggagatctttaatggatcctgagaacctggcggcagcgcaaaagatg

SEQ ID NO: 179071 - DNA, 103 bp, Artificial Sequence
  Synthetic Polynucleotide
taatacgactcactataggggccccatgggctgctggtcaacctcaggataacagaggagaatcctgatgttgaccagcaacctggcggcagcgcaaaagatg

SEQ ID NO: 179072 - DNA, 103 bp, Artificial Sequence
  Synthetic Polynucleotide
taatacgactcactatagggttcccttcaggccccatgggctgctggtcaaacagaggagatgaccaatggcccatgggaacctggcggcagcgcaaaagatg

SEQ ID NO: 179073 - DNA, 103 bp, Artificial Sequence
  Synthetic Polynucleotide
taatacgactcactatagggccgtcgcccaactgggcgctgaacaccgacaacagaggagagtcggtatgcagcgcccaaacctggcggcagcgcaaaagatg

SEQ ID NO: 179074 - DNA, 103 bp, Artificial Sequence
  Synthetic Polynucleotide
taatacgactcactatagggcgcagctccgccgtcgcccaactgggcgctaacagaggagaagcgccatgttgggcgacaacctggcggcagcgcaaaagatg

SEQ ID NO: 179075 - DNA, 103 bp, Artificial Sequence
  Synthetic Polynucleotide
taatacgactcactataggggacccccgtccgcagctccgccgtcgcccaaacagaggagatgggcgatggcggagctgaacctggcggcagcgcaaaagatg

SEQ ID NO: 179076 - DNA, 103 bp, Artificial Sequence
  Synthetic Polynucleotide
taatacgactcactatagggacatcagccggacccccgtccgcagctccgaacagaggagacggagcatgggacgggggaacctggcggcagcgcaaaagatg

SEQ ID NO: 179077 - DNA, 103 bp, Artificial Sequence
  Synthetic Polynucleotide
taatacgactcactatagggcgcgccccctacatcagccggacccccgtcaacagaggagagacgggatgccggctgataacctggcggcagcgcaaaagatg

SEQ ID NO: 179078 - DNA, 103 bp, Artificial Sequence
  Synthetic Polynucleotide
taatacgactcactataggggtgctgccgtcgcgccccctacatcagccgaacagaggagacggctgatgtagggggcgaacctggcggcagcgcaaaagatg

SEQ ID NO: 179079 - DNA, 103 bp, Artificial Sequence
  Synthetic Polynucleotide
taatacgactcactatagggccgccgcctggtgctgccgtcgcgccccctaacagaggagaagggggatggacggcagcaacctggcggcagcgcaaaagatg

SEQ ID NO: 179080 - DNA, 103 bp, Artificial Sequence
  Synthetic Polynucleotide
taatacgactcactataggggcccccggccccgccgcctggtgctgccgtaacagaggagaacggcaatgccaggcggcaacctggcggcagcgcaaaagatg

SEQ ID NO: 179081 - DNA, 103 bp, Artificial Sequence
  Synthetic Polynucleotide
taatacgactcactataggggctcccggctgcccccggccccgccgcctgaacagaggagacaggcgatggggccggggaacctggcggcagcgcaaaagatg

SEQ ID NO: 179082 - DNA, 103 bp, Artificial Sequence
  Synthetic Polynucleotide
taatacgactcactatagggtatgtgtagcagccagacgggccgcacgaaaacagaggagattcgtgatgcccgtctggaacctggcggcagcgcaaaagatg

SEQ ID NO: 179083 - DNA, 103 bp, Artificial Sequence
  Synthetic Polynucleotide
taatacgactcactatagggtgcatctccagctcccggctgcccccggccaacagaggagaggccggatgcagccgggaaacctggcggcagcgcaaaagatg

SEQ ID NO: 179084 - DNA, 103 bp, Artificial Sequence
  Synthetic Polynucleotide
taatacgactcactataggggctgatagtgtgcatctccagctcccggctaacagaggagaagccggatgctggagatgaacctggcggcagcgcaaaagatg

SEQ ID NO: 179085 - DNA, 103 bp, Artificial Sequence
  Synthetic Polynucleotide
taatacgactcactatagggataccttggagctgatagtgtgcatctccaaacagaggagatggagaatgacactatcaaacctggcggcagcgcaaaagatg

SEQ ID NO: 179086 - DNA, 103 bp, Artificial Sequence
  Synthetic Polynucleotide
taatacgactcactatagggatgtccccaaataccttggagctgatagtgaacagaggagacactatatgctccaaggtaacctggcggcagcgcaaaagatg

SEQ ID NO: 179087 - DNA, 103 bp, Artificial Sequence
  Synthetic Polynucleotide
taatacgactcactataggggaagtccagaatgtccccaaataccttggaaacagaggagatccaagatgtttggggacaacctggcggcagcgcaaaagatg

SEQ ID NO: 179088 - DNA, 103 bp, Artificial Sequence
  Synthetic Polynucleotide
taatacgactcactatagggaagtgtaggcgaagtccagaatgtccccaaaacagaggagattggggatgttctggactaacctggcggcagcgcaaaagatg

SEQ ID NO: 179089 - DNA, 103 bp, Artificial Sequence
  Synthetic Polynucleotide
taatacgactcactatagggacgatgcgggaagtgtaggcgaagtccagaaacagaggagatctggaatgcgcctacacaacctggcggcagcgcaaaagatg

SEQ ID NO: 179090 - DNA, 103 bp, Artificial Sequence
  Synthetic Polynucleotide
taatacgactcactatagggcaagcgcaccacgatgcgggaagtgtaggcaacagaggagagcctacatgtcccgcatcaacctggcggcagcgcaaaagatg

SEQ ID NO: 179091 - DNA, 103 bp, Artificial Sequence
  Synthetic Polynucleotide
taatacgactcactataggggaaagctctccaagcgcaccacgatgcgggaacagaggagacccgcaatgtggtgcgctaacctggcggcagcgcaaaagatg

SEQ ID NO: 179092 - DNA, 103 bp, Artificial Sequence
  Synthetic Polynucleotide
taatacgactcactatagggatgagttcgggaaagctctccaagcgcaccaacagaggagaggtgcgatgggagagcttaacctggcggcagcgcaaaagatg

SEQ ID NO: 179093 - DNA, 103 bp, Artificial Sequence
  Synthetic Polynucleotide
taatacgactcactataggggctcacctggtatgtgtagcagccagacggaacagaggagaccgtctatgtgctacacaaacctggcggcagcgcaaaagatg

SEQ ID NO: 179094 - DNA, 103 bp, Artificial Sequence
  Synthetic Polynucleotide
taatacgactcactatagggggcggccgtcatgagttcgggaaagctctcaacagaggagagagagcatgcccgaactcaacctggcggcagcgcaaaagatg

SEQ ID NO: 179095 - DNA, 103 bp, Artificial Sequence
  Synthetic Polynucleotide
taatacgactcactataggggcaggaacttggcggccgtcatgagttcggaacagaggagaccgaacatgtgacggccgaacctggcggcagcgcaaaagatg

SEQ ID NO: 179096 - DNA, 103 bp, Artificial Sequence
  Synthetic Polynucleotide
taatacgactcactataggggacctcatcagcaggaacttggcggccgtcaacagaggagagacggcatgcaagttcctaacctggcggcagcgcaaaagatg

SEQ ID NO: 179097 - DNA, 103 bp, Artificial Sequence
  Synthetic Polynucleotide
taatacgactcactatagggctcgataaccgacctcatcagcaggaacttaacagaggagaaagttcatgctgatgaggaacctggcggcagcgcaaaagatg

SEQ ID NO: 179098 - DNA, 103 bp, Artificial Sequence
  Synthetic Polynucleotide
taatacgactcactatagggcctggcagatctcgataaccgacctcatcaaacagaggagatgatgaatgcggttatcgaacctggcggcagcgcaaaagatg

SEQ ID NO: 179099 - DNA, 103 bp, Artificial Sequence
  Synthetic Polynucleotide
taatacgactcactatagggttgatgacttcctggcagatctcgataaccaacagaggagaggttatatggatctgccaaacctggcggcagcgcaaaagatg

SEQ ID NO: 179100 - DNA, 103 bp, Artificial Sequence
  Synthetic Polynucleotide
taatacgactcactataggggttggactgtttgatgacttcctggcagataacagaggagaatctgcatggaagtcatcaacctggcggcagcgcaaaagatg

SEQ ID NO: 179101 - DNA, 103 bp, Artificial Sequence
  Synthetic Polynucleotide
taatacgactcactatagggggatctgtacgttggactgtttgatgacttaacagaggagaaagtcaatgaacagtccaaacctggcggcagcgcaaaagatg

SEQ ID NO: 179102 - DNA, 103 bp, Artificial Sequence
  Synthetic Polynucleotide
taatacgactcactataggggggggtaccaggatctgtacgttggactgtaacagaggagaacagtcatgcgtacagataacctggcggcagcgcaaaagatg

SEQ ID NO: 179103 - DNA, 103 bp, Artificial Sequence
  Synthetic Polynucleotide
taatacgactcactatagggggcgcgggcagggggtaccaggatctgtacaacagaggagagtacagatgctggtacccaacctggcggcagcgcaaaagatg

SEQ ID NO: 179104 - DNA, 103 bp, Artificial Sequence
  Synthetic Polynucleotide
taatacgactcactatagggtgctgtgtctgctcacctggtatgtgtagcaacagaggagagctacaatgaccaggtgaaacctggcggcagcgcaaaagatg

SEQ ID NO: 179105 - DNA, 103 bp, Artificial Sequence
  Synthetic Polynucleotide
taatacgactcactataggggcattatatcggcgcgggcagggggtaccaaacagaggagatggtacatgctgcccgcgaacctggcggcagcgcaaaagatg

SEQ ID NO: 179106 - DNA, 103 bp, Artificial Sequence
  Synthetic Polynucleotide
taatacgactcactataggggggcgaaagagcattatatcggcgcgggcaaacagaggagatgcccgatgcgatataataacctggcggcagcgcaaaagatg

SEQ ID NO: 179107 - DNA, 103 bp, Artificial Sequence
  Synthetic Polynucleotide
taatacgactcactatagggggtcccaggggggcgaaagagcattatatcaacagaggagagatataatgctctttcgcaacctggcggcagcgcaaaagatg

SEQ ID NO: 179108 - DNA, 103 bp, Artificial Sequence
  Synthetic Polynucleotide
taatacgactcactatagggccaagtccgaggtcccaggggggcgaaagaaacagaggagatctttcatgcccctgggaaacctggcggcagcgcaaaagatg

SEQ ID NO: 179109 - DNA, 103 bp, Artificial Sequence
  Synthetic Polynucleotide
taatacgactcactatagggaaagggaagcccaagtccgaggtcccagggaacagaggagaccctggatgctcggacttaacctggcggcagcgcaaaagatg

SEQ ID NO: 179110 - DNA, 103 bp, Artificial Sequence
  Synthetic Polynucleotide
taatacgactcactatagggggtcatgtccaaagggaagcccaagtccgaaacagaggagatcggacatgggcttccctaacctggcggcagcgcaaaagatg

SEQ ID NO: 179111 - DNA, 103 bp, Artificial Sequence
  Synthetic Polynucleotide
taatacgactcactatagggctgccccgttggtcatgtccaaagggaagcaacagaggagagcttccatgtggacatgaaacctggcggcagcgcaaaagatg

SEQ ID NO: 179112 - DNA, 103 bp, Artificial Sequence
  Synthetic Polynucleotide
taatacgactcactataggggctgccaaggctgccccgttggtcatgtccaacagaggagaggacatatgcaacggggcaacctggcggcagcgcaaaagatg

SEQ ID NO: 179113 - DNA, 103 bp, Artificial Sequence
  Synthetic Polynucleotide
taatacgactcactatagggattgctgttggctgccaaggctgccccgttaacagaggagaaacgggatggccttggcaaacctggcggcagcgcaaaagatg

SEQ ID NO: 179114 - DNA, 103 bp, Artificial Sequence
  Synthetic Polynucleotide
taatacgactcactatagggcggcgatgccattgctgttggctgccaaggaacagaggagaccttggatgccaacagcaaacctggcggcagcgcaaaagatg

SEQ ID NO: 179115 - DNA, 103 bp, Artificial Sequence
  Synthetic Polynucleotide
taatacgactcactatagggagcatctccgtgctgtgtctgctcacctggaacagaggagaccaggtatgcagacacagaacctggcggcagcgcaaaagatg

SEQ ID NO: 179116 - DNA, 103 bp, Artificial Sequence
  Synthetic Polynucleotide
taatacgactcactatagggtgcatgctgccggcgatgccattgctgttgaacagaggagacaacagatgtggcatcgcaacctggcggcagcgcaaaagatg

SEQ ID NO: 179117 - DNA, 103 bp, Artificial Sequence
  Synthetic Polynucleotide
taatacgactcactatagggctcctctggctgcatgctgccggcgatgccaacagaggagaggcatcatgggcagcatgaacctggcggcagcgcaaaagatg

SEQ ID NO: 179118 - DNA, 103 bp, Artificial Sequence
  Synthetic Polynucleotide
taatacgactcactataggggagctgcctcctcctctggctgcatgctgcaacagaggagagcagcaatgagccagaggaacctggcggcagcgcaaaagatg

SEQ ID NO: 179119 - DNA, 103 bp, Artificial Sequence
  Synthetic Polynucleotide
taatacgactcactatagggccagccgcccgagctgcctcctcctctggcaacagaggagagccagaatgggaggcagcaacctggcggcagcgcaaaagatg

SEQ ID NO: 179120 - DNA, 103 bp, Artificial Sequence
  Synthetic Polynucleotide
taatacgactcactatagggaatggctgcaccagccgcccgagctgcctcaacagaggagagaggcaatgcgggcggctaacctggcggcagcgcaaaagatg

SEQ ID NO: 179121 - DNA, 103 bp, Artificial Sequence
  Synthetic Polynucleotide
taatacgactcactatagggcttggcctgcaatggctgcaccagccgcccaacagaggagagggcggatggtgcagccaaacctggcggcagcgcaaaagatg

SEQ ID NO: 179122 - DNA, 103 bp, Artificial Sequence
  Synthetic Polynucleotide
taatacgactcactatagggggcaaagaggcttggcctgcaatggctgcaaacagaggagatgcagcatgtgcaggccaaacctggcggcagcgcaaaagatg

SEQ ID NO: 179123 - DNA, 103 bp, Artificial Sequence
  Synthetic Polynucleotide
taatacgactcactatagggaggtaacacaggcaaagaggcttggcctgcaacagaggagagcaggcatggcctctttgaacctggcggcagcgcaaaagatg

SEQ ID NO: 179124 - DNA, 103 bp, Artificial Sequence
  Synthetic Polynucleotide
taatacgactcactatagggggtccaccccaggtaacacaggcaaagaggaacagaggagacctcttatgctgtgttacaacctggcggcagcgcaaaagatg

SEQ ID NO: 179125 - DNA, 103 bp, Artificial Sequence
  Synthetic Polynucleotide
taatacgactcactatagggatgggcaagcggtccaccccaggtaacacaaacagaggagatgtgttatgtggggtggaaacctggcggcagcgcaaaagatg

SEQ ID NO: 179126 - DNA, 103 bp, Artificial Sequence
  Synthetic Polynucleotide
taatacgactcactatagggcaggttgtgcagcatctccgtgctgtgtctaacagaggagaagacacatgacggagatgaacctggcggcagcgcaaaagatg

SEQ ID NO: 179127 - DNA, 103 bp, Artificial Sequence
  Synthetic Polynucleotide
taatacgactcactatagggtccagccaccatgggcaagcggtccaccccaacagaggagaggggtgatgcgcttgcccaacctggcggcagcgcaaaagatg

SEQ ID NO: 179128 - DNA, 103 bp, Artificial Sequence
  Synthetic Polynucleotide
taatacgactcactataggggggataggggtccagccaccatgggcaagcaacagaggagagcttgcatgtggtggctgaacctggcggcagcgcaaaagatg

SEQ ID NO: 179129 - DNA, 103 bp, Artificial Sequence
  Synthetic Polynucleotide
taatacgactcactatagggagcagttggggggataggggtccagccaccaacagaggagaggtggcatgacccctatcaacctggcggcagcgcaaaagatg

SEQ ID NO: 179130 - DNA, 103 bp, Artificial Sequence
  Synthetic Polynucleotide
taatacgactcactatagggtggggaagtcagcagttggggggataggggaacagaggagacccctaatgccccaactgaacctggcggcagcgcaaaagatg

SEQ ID NO: 179131 - DNA, 103 bp, Artificial Sequence
  Synthetic Polynucleotide
taatacgactcactatagggcactggggaatggggaagtcagcagttgggaacagaggagacccaacatgtgacttcccaacctggcggcagcgcaaaagatg

SEQ ID NO: 179132 - DNA, 103 bp, Artificial Sequence
  Synthetic Polynucleotide
taatacgactcactatagggctggatgccacactggggaatggggaagtcaacagaggagagacttcatgattccccagaacctggcggcagcgcaaaagatg

SEQ ID NO: 179133 - DNA, 103 bp, Artificial Sequence
  Synthetic Polynucleotide
taatacgactcactataggggggaggggcactggatgccacactggggaaaacagaggagattccccatggtggcatccaacctggcggcagcgcaaaagatg

SEQ ID NO: 179134 - DNA, 103 bp, Artificial Sequence
  Synthetic Polynucleotide
taatacgactcactatagggtgccagtcaggggaggggcactggatgccaaacagaggagatggcatatggtgcccctcaacctggcggcagcgcaaaagatg

SEQ ID NO: 179135 - DNA, 103 bp, Artificial Sequence
  Synthetic Polynucleotide
taatacgactcactatagggcggcctcgcttgccagtcaggggaggggcaaacagaggagatgccccatgcctgactggaacctggcggcagcgcaaaagatg

SEQ ID NO: 179136 - DNA, 103 bp, Artificial Sequence
  Synthetic Polynucleotide
taatacgactcactatagggtgggcggccccggcctcgcttgccagtcagaacagaggagactgactatgaagcgaggcaacctggcggcagcgcaaaagatg

SEQ ID NO: 179137 - DNA, 103 bp, Artificial Sequence
  Synthetic Polynucleotide
taatacgactcactataggggctgctggttcaggttgtgcagcatctccgaacagaggagacggagaatgtgcacaaccaacctggcggcagcgcaaaagatg

SEQ ID NO: 179138 - DNA, 103 bp, Artificial Sequence
  Synthetic Polynucleotide
taatacgactcactatagggtggccttccttgggcggccccggcctcgctaacagaggagaagcgagatgggggccgccaacctggcggcagcgcaaaagatg

SEQ ID NO: 179139 - DNA, 103 bp, Artificial Sequence
  Synthetic Polynucleotide
taatacgactcactatagggtccagcaggttggccttccttgggcggcccaacagaggagagggccgatgaaggaaggcaacctggcggcagcgcaaaagatg

SEQ ID NO: 179140 - DNA, 103 bp, Artificial Sequence
  Synthetic Polynucleotide
taatacgactcactatagggaaacattgagtccagcaggttggccttcctaacagaggagaaggaagatgaacctgctgaacctggcggcagcgcaaaagatg

SEQ ID NO: 179141 - DNA, 103 bp, Artificial Sequence
  Synthetic Polynucleotide
taatacgactcactatagggctggggacccaaacattgagtccagcaggtaacagaggagaacctgcatgactcaatgtaacctggcggcagcgcaaaagatg

SEQ ID NO: 179142 - DNA, 103 bp, Artificial Sequence
  Synthetic Polynucleotide
taatacgactcactatagggctcaggccccctggggacccaaacattgagaacagaggagactcaatatgtgggtccccaacctggcggcagcgcaaaagatg

SEQ ID NO: 179143 - DNA, 103 bp, Artificial Sequence
  Synthetic Polynucleotide
taatacgactcactataggggcctgcctccctcaggccccctggggacccaacagaggagagggtccatggggggcctgaacctggcggcagcgcaaaagatg

SEQ ID NO: 179144 - DNA, 103 bp, Artificial Sequence
  Synthetic Polynucleotide
taatacgactcactatagggatggaaggatgcctgcctccctcaggccccaacagaggagaggggccatggggaggcagaacctggcggcagcgcaaaagatg

SEQ ID NO: 179145 - DNA, 103 bp, Artificial Sequence
  Synthetic Polynucleotide
taatacgactcactatagggcatagaccgcatggaaggatgcctgcctccaacagaggagaggaggcatgcatccttccaacctggcggcagcgcaaaagatg

SEQ ID NO: 179146 - DNA, 103 bp, Artificial Sequence
  Synthetic Polynucleotide
taatacgactcactatagggcaccttaccacatagaccgcatggaaggataacagaggagaatccttatgtgcggtctaaacctggcggcagcgcaaaagatg

SEQ ID NO: 179147 - DNA, 103 bp, Artificial Sequence
  Synthetic Polynucleotide
taatacgactcactatagggcatcagtgaacaccttaccacatagaccgcaacagaggagagcggtcatggtggtaaggaacctggcggcagcgcaaaagatg

SEQ ID NO: 179148 - DNA, 103 bp, Artificial Sequence
  Synthetic Polynucleotide
taatacgactcactatagggccgtttttgcgctgctggttcaggttgtgcaacagaggagagcacaaatggaaccagcaaacctggcggcagcgcaaaagatg

SEQ ID NO: 179149 - DNA, 103 bp, Artificial Sequence
  Synthetic Polynucleotide
taatacgactcactatagggagccggttggcatcagtgaacaccttaccaaacagaggagatggtaaatggttcactgaaacctggcggcagcgcaaaagatg

SEQ ID NO: 179150 - DNA, 103 bp, Artificial Sequence
  Synthetic Polynucleotide
taatacgactcactataggggtgctgccggagccggttggcatcagtgaaaacagaggagattcactatggccaaccggaacctggcggcagcgcaaaagatg

SEQ ID NO: 179151 - DNA, 103 bp, Artificial Sequence
  Synthetic Polynucleotide
taatacgactcactataggggctgggcctcgtgctgccggagccggttggaacagaggagaccaaccatgtccggcagcaacctggcggcagcgcaaaagatg

SEQ ID NO: 179152 - DNA, 103 bp, Artificial Sequence
  Synthetic Polynucleotide
taatacgactcactataggggtgacaccgtgctgggcctcgtgctgccggaacagaggagaccggcaatgcgaggcccaaacctggcggcagcgcaaaagatg

SEQ ID NO: 179153 - DNA, 103 bp, Artificial Sequence
  Synthetic Polynucleotide
taatacgactcactatagggctggaggctggtgacaccgtgctgggcctcaacagaggagagaggccatgcacggtgtcaacctggcggcagcgcaaaagatg

SEQ ID NO: 179154 - DNA, 103 bp, Artificial Sequence
  Synthetic Polynucleotide
taatacgactcactatagggtgtagcccagctggaggctggtgacaccgtaacagaggagaacggtgatgccagcctccaacctggcggcagcgcaaaagatg

SEQ ID NO: 179155 - DNA, 103 bp, Artificial Sequence
  Synthetic Polynucleotide
taatacgactcactatagggggaaggtcgatgtagcccagctggaggctgaacagaggagacagcctatggctgggctaaacctggcggcagcgcaaaagatg

SEQ ID NO: 179156 - DNA, 103 bp, Artificial Sequence
  Synthetic Polynucleotide
taatacgactcactatagggcctcggaggaggaaggtcgatgtagcccagaacagaggagactgggcatgatcgaccttaacctggcggcagcgcaaaagatg

SEQ ID NO: 179157 - DNA, 103 bp, Artificial Sequence
  Synthetic Polynucleotide
taatacgactcactatagggtctcacccagcctcggaggaggaaggtcgaaacagaggagatcgaccatgctcctccgaaacctggcggcagcgcaaaagatg

SEQ ID NO: 179158 - DNA, 103 bp, Artificial Sequence
  Synthetic Polynucleotide
taatacgactcactatagggggtagcccattctcacccagcctcggaggaaacagaggagatcctccatggctgggtgaaacctggcggcagcgcaaaagatg

SEQ ID NO: 179159 - DNA, 103 bp, Artificial Sequence
  Synthetic Polynucleotide
taatacgactcactatagggccgcgaccccaggcccagggtgaacttcataacagaggagaatgaagatgaccctgggcaacctggcggcagcgcaaaagatg

SEQ ID NO: 179160 - DNA, 103 bp, Artificial Sequence
  Synthetic Polynucleotide
taatacgactcactataggggacgcgctgtgcgcggcagcggagcgcgctaacagaggagaagcgcgatgcgctgccgcaacctggcggcagcgcaaaagatg

SEQ ID NO: 179161 - DNA, 103 bp, Artificial Sequence
  Synthetic Polynucleotide
taatacgactcactatagggtagcccattcactgcgggggtggcggggaaaacagaggagattccccatgacccccgcaaacctggcggcagcgcaaaagatg

SEQ ID NO: 179162 - DNA, 103 bp, Artificial Sequence
  Synthetic Polynucleotide
taatacgactcactatagggcaggtttctctagcccattcactgcgggggaacagaggagacccccgatgtgaatgggcaacctggcggcagcgcaaaagatg

SEQ ID NO: 179163 - DNA, 103 bp, Artificial Sequence
  Synthetic Polynucleotide
taatacgactcactataggggcctctaaggcaggtttctctagcccattcaacagaggagagaatggatgagagaaaccaacctggcggcagcgcaaaagatg

SEQ ID NO: 179164 - DNA, 103 bp, Artificial Sequence
  Synthetic Polynucleotide
taatacgactcactatagggtttaatgtctgcctctaaggcaggtttctcaacagaggagagagaaaatggccttagagaacctggcggcagcgcaaaagatg

SEQ ID NO: 179165 - DNA, 103 bp, Artificial Sequence
  Synthetic Polynucleotide
taatacgactcactatagggactgagtgtatttaatgtctgcctctaaggaacagaggagaccttagatgcagacattaaacctggcggcagcgcaaaagatg

SEQ ID NO: 179166 - DNA, 103 bp, Artificial Sequence
  Synthetic Polynucleotide
taatacgactcactataggggtggaggccgactgagtgtatttaatgtctaacagaggagaagacatatgatacactcaaacctggcggcagcgcaaaagatg

SEQ ID NO: 179167 - DNA, 103 bp, Artificial Sequence
  Synthetic Polynucleotide
taatacgactcactatagggggcagagagggtggaggccgactgagtgtaaacagaggagatacactatgtcggcctccaacctggcggcagcgcaaaagatg

SEQ ID NO: 179168 - DNA, 103 bp, Artificial Sequence
  Synthetic Polynucleotide
taatacgactcactatagggagccgcccacggcagagagggtggaggccgaacagaggagacggcctatgccctctctgaacctggcggcagcgcaaaagatg

SEQ ID NO: 179169 - DNA, 103 bp, Artificial Sequence
  Synthetic Polynucleotide
taatacgactcactataggggcggggagaaagccgcccacggcagagaggaacagaggagacctctcatgcgtgggcggaacctggcggcagcgcaaaagatg

SEQ ID NO: 179170 - DNA, 103 bp, Artificial Sequence
  Synthetic Polynucleotide
taatacgactcactataggggtaggcgcaggcggggagaaagccgcccacaacagaggagagtgggcatgtttctccccaacctggcggcagcgcaaaagatg

SEQ ID NO: 179171 - DNA, 103 bp, Artificial Sequence
  Synthetic Polynucleotide
taatacgactcactataggggcgggctggagacgcgctgtgcgcggcagcaacagaggagagctgccatgcacagcgcgaacctggcggcagcgcaaaagatg

SEQ ID NO: 179172 - DNA, 103 bp, Artificial Sequence
  Synthetic Polynucleotide
taatacgactcactatagggtggaggccgggtaggcgcaggcggggagaaaacagaggagattctccatgcctgcgcctaacctggcggcagcgcaaaagatg

SEQ ID NO: 179173 - DNA, 103 bp, Artificial Sequence
  Synthetic Polynucleotide
taatacgactcactatagggccgtgctggttggaggccgggtaggcgcagaacagaggagactgcgcatgcccggcctcaacctggcggcagcgcaaaagatg

SEQ ID NO: 179174 - DNA, 103 bp, Artificial Sequence
  Synthetic Polynucleotide
taatacgactcactataggggctgtacacgccgtgctggttggaggccggaacagaggagaccggccatgaaccagcacaacctggcggcagcgcaaaagatg

SEQ ID NO: 179175 - DNA, 103 bp, Artificial Sequence
  Synthetic Polynucleotide
taatacgactcactatagggcgcccggggcgctgtacacgccgtgctggtaacagaggagaaccagcatggcgtgtacaaacctggcggcagcgcaaaagatg

SEQ ID NO: 179176 - DNA, 103 bp, Artificial Sequence
  Synthetic Polynucleotide
taatacgactcactatagggaggtagccgccgcccggggcgctgtacacgaacagaggagacgtgtaatgcgccccgggaacctggcggcagcgcaaaagatg

SEQ ID NO: 179177 - DNA, 103 bp, Artificial Sequence
  Synthetic Polynucleotide
taatacgactcactataggggcccggggcgaggtagccgccgcccggggcaacagaggagagccccgatgggcggctacaacctggcggcagcgcaaaagatg

SEQ ID NO: 179178 - DNA, 103 bp, Artificial Sequence
  Synthetic Polynucleotide
taatacgactcactataggggccacggcgggcccggggcgaggtagccgcaacagaggagagcggctatgtcgccccggaacctggcggcagcgcaaaagatg

SEQ ID NO: 179179 - DNA, 103 bp, Artificial Sequence
  Synthetic Polynucleotide
taatacgactcactatagggtgcgcaggcggccacggcgggcccggggcgaacagaggagacgccccatgcccgccgtgaacctggcggcagcgcaaaagatg

SEQ ID NO: 179180 - DNA, 103 bp, Artificial Sequence
  Synthetic Polynucleotide
taatacgactcactatagggaggaggaccttgcgcaggcggccacggcggaacagaggagaccgccgatgccgcctgcgaacctggcggcagcgcaaaagatg

SEQ ID NO: 179181 - DNA, 103 bp, Artificial Sequence
  Synthetic Polynucleotide
taatacgactcactatagggggggcgccagaggaggaccttgcgcaggcgaacagaggagacgcctgatgaaggtcctcaacctggcggcagcgcaaaagatg

SEQ ID NO: 179182 - DNA, 103 bp, Artificial Sequence
  Synthetic Polynucleotide
taatacgactcactatagggcggcccagccgcgggctggagacgcgctgtaacagaggagaacagcgatgctccagcccaacctggcggcagcgcaaaagatg

SEQ ID NO: 179183 - DNA, 103 bp, Artificial Sequence
  Synthetic Polynucleotide
taatacgactcactatagggccggccccggggggcgccagaggaggacctaacagaggagaaggtccatgtctggcgccaacctggcggcagcgcaaaagatg

SEQ ID NO: 179184 - DNA, 103 bp, Artificial Sequence
  Synthetic Polynucleotide
taatacgactcactatagggcacagctacgccggccccggggggcgccagaacagaggagactggcgatgcccggggccaacctggcggcagcgcaaaagatg

SEQ ID NO: 179185 - DNA, 103 bp, Artificial Sequence
  Synthetic Polynucleotide
taatacgactcactatagggccccgccatgcacagctacgccggccccggaacagaggagaccggggatggcgtagctgaacctggcggcagcgcaaaagatg

SEQ ID NO: 179186 - DNA, 103 bp, Artificial Sequence
  Synthetic Polynucleotide
taatacgactcactataggggccgcgagttccccgccatgcacagctacgaacagaggagacgtagcatggcatggcggaacctggcggcagcgcaaaagatg

SEQ ID NO: 179187 - DNA, 103 bp, Artificial Sequence
  Synthetic Polynucleotide
taatacgactcactatagggggtcattgctgccgcgagttccccgccatgaacagaggagacatggcatggaactcgcgaacctggcggcagcgcaaaagatg

SEQ ID NO: 179188 - DNA, 103 bp, Artificial Sequence
  Synthetic Polynucleotide
taatacgactcactataggggatgcttgaaggtcattgctgccgcgagttaacagaggagaaactcgatgcagcaatgaaacctggcggcagcgcaaaagatg

SEQ ID NO: 179189 - DNA, 103 bp, Artificial Sequence
  Synthetic Polynucleotide
taatacgactcactatagggtctcggctgggatgcttgaaggtcattgctaacagaggagaagcaatatgcttcaagcaaacctggcggcagcgcaaaagatg

SEQ ID NO: 179190 - DNA, 103 bp, Artificial Sequence
  Synthetic Polynucleotide
taatacgactcactataggggaggcttccttctcggctgggatgcttgaaaacagaggagattcaagatgcccagccgaaacctggcggcagcgcaaaagatg

SEQ ID NO: 179191 - DNA, 103 bp, Artificial Sequence
  Synthetic Polynucleotide
taatacgactcactatagggccggagctgggaggcttccttctcggctggaacagaggagaccagccatgaaggaagccaacctggcggcagcgcaaaagatg

SEQ ID NO: 179192 - DNA, 103 bp, Artificial Sequence
  Synthetic Polynucleotide
taatacgactcactatagggggccttgctgccggagctgggaggcttcctaacagaggagaaggaagatgcccagctccaacctggcggcagcgcaaaagatg

SEQ ID NO: 179193 - DNA, 103 bp, Artificial Sequence
  Synthetic Polynucleotide
taatacgactcactatagggagagccgcggcggcccagccgcgggctggaaacagaggagatccagcatgcggctgggcaacctggcggcagcgcaaaagatg

SEQ ID NO: 179194 - DNA, 103 bp, Artificial Sequence
  Synthetic Polynucleotide
taatacgactcactataggggggcgtccggggccttgctgccggagctggaacagaggagaccagctatggcagcaaggaacctggcggcagcgcaaaagatg

SEQ ID NO: 179195 - DNA, 103 bp, Artificial Sequence
  Synthetic Polynucleotide
taatacgactcactatagggaagctactgagggcgtccggggccttgctgaacagaggagacagcaaatgcccggacgcaacctggcggcagcgcaaaagatg

SEQ ID NO: 179196 - DNA, 103 bp, Artificial Sequence
  Synthetic Polynucleotide
taatacgactcactatagggcagtccgtgtaagctactgagggcgtccggaacagaggagaccggacatgctcagtagcaacctggcggcagcgcaaaagatg

SEQ ID NO: 179197 - DNA, 103 bp, Artificial Sequence
  Synthetic Polynucleotide
taatacgactcactatagggccgggatgggcagtccgtgtaagctactgaaacagaggagatcagtaatgtacacggacaacctggcggcagcgcaaaagatg

SEQ ID NO: 179198 - DNA, 103 bp, Artificial Sequence
  Synthetic Polynucleotide
taatacgactcactataggggaggtcgaggccgggatgggcagtccgtgtaacagaggagaacacggatggcccatcccaacctggcggcagcgcaaaagatg

SEQ ID NO: 179199 - DNA, 103 bp, Artificial Sequence
  Synthetic Polynucleotide
taatacgactcactatagggctgcccctaggaggtcgaggccgggatgggaacagaggagacccatcatggcctcgaccaacctggcggcagcgcaaaagatg

SEQ ID NO: 179200 - DNA, 103 bp, Artificial Sequence
  Synthetic Polynucleotide
taatacgactcactatagggccggggagagctgcccctaggaggtcgaggaacagaggagacctcgaatgcctaggggcaacctggcggcagcgcaaaagatg

SEQ ID NO: 179201 - DNA, 103 bp, Artificial Sequence
  Synthetic Polynucleotide
taatacgactcactataggggggctcgggtccggggagagctgcccctagaacagaggagactagggatggctctccccaacctggcggcagcgcaaaagatg

SEQ ID NO: 179202 - DNA, 103 bp, Artificial Sequence
  Synthetic Polynucleotide
taatacgactcactatagggcgttccctccgggctcgggtccggggagagaacagaggagactctccatggacccgagcaacctggcggcagcgcaaaagatg

SEQ ID NO: 179203 - DNA, 103 bp, Artificial Sequence
  Synthetic Polynucleotide
taatacgactcactataggggtccgcctgccgttccctccgggctcgggtaacagaggagaacccgaatgcggagggaaaacctggcggcagcgcaaaagatg

SEQ ID NO: 179204 - DNA, 103 bp, Artificial Sequence
  Synthetic Polynucleotide
taatacgactcactatagggccgagagccgagagccgcggcggcccagccaacagaggagaggctggatggccgcggctaacctggcggcagcgcaaaagatg

SEQ ID NO: 179205 - DNA, 103 bp, Artificial Sequence
  Synthetic Polynucleotide
taatacgactcactataggggtgcgcccgggtccgcctgccgttccctccaacagaggagaggagggatgggcaggcggaacctggcggcagcgcaaaagatg

SEQ ID NO: 179206 - DNA, 103 bp, Artificial Sequence
  Synthetic Polynucleotide
taatacgactcactataggggcgcagacctgtgcgcccgggtccgcctgcaacagaggagagcaggcatgcccgggcgcaacctggcggcagcgcaaaagatg

SEQ ID NO: 179207 - DNA, 103 bp, Artificial Sequence
  Synthetic Polynucleotide
taatacgactcactatagggcggggccgccgcgcagacctgtgcgcccggaacagaggagaccgggcatgcaggtctgcaacctggcggcagcgcaaaagatg

SEQ ID NO: 179208 - DNA, 103 bp, Artificial Sequence
  Synthetic Polynucleotide
taatacgactcactatagggtgccgattgccggggccgccgcgcagacctaacagaggagaaggtctatgcggcggcccaacctggcggcagcgcaaaagatg

SEQ ID NO: 179209 - DNA, 103 bp, Artificial Sequence
  Synthetic Polynucleotide
taatacgactcactatagggatcctgcccgtgccgattgccggggccgccaacagaggagaggcggcatgggcaatcggaacctggcggcagcgcaaaagatg

SEQ ID NO: 179210 - DNA, 103 bp, Artificial Sequence
  Synthetic Polynucleotide
taatacgactcactataggggagtcctccgatcctgcccgtgccgattgcaacagaggagagcaatcatgacgggcaggaacctggcggcagcgcaaaagatg

SEQ ID NO: 179211 - DNA, 103 bp, Artificial Sequence
  Synthetic Polynucleotide
taatacgactcactatagggcctcctccgcgagtcctccgatcctgcccgaacagaggagacgggcaatgtcggaggacaacctggcggcagcgcaaaagatg

SEQ ID NO: 179212 - DNA, 103 bp, Artificial Sequence
  Synthetic Polynucleotide
taatacgactcactataggggcactggcttcctcctccgcgagtcctccgaacagaggagacggaggatgcgcggaggaaacctggcggcagcgcaaaagatg

SEQ ID NO: 179213 - DNA, 103 bp, Artificial Sequence
  Synthetic Polynucleotide
taatacgactcactatagggccgcgggccggcactggcttcctcctccgcaacagaggagagcggagatggaagccagtaacctggcggcagcgcaaaagatg

SEQ ID NO: 179214 - DNA, 103 bp, Artificial Sequence
  Synthetic Polynucleotide
taatacgactcactatagggggcgtgcaccccgcgggccggcactggcttaacagaggagaaagccaatgccggcccgcaacctggcggcagcgcaaaagatg

SEQ ID NO: 179215 - DNA, 103 bp, Artificial Sequence
  Synthetic Polynucleotide
taatacgactcactataggggggagggcgcccgagagccgagagccgcggaacagaggagaccgcggatgtcggctctcaacctggcggcagcgcaaaagatg

SEQ ID NO: 179216 - DNA, 103 bp, Artificial Sequence
  Synthetic Polynucleotide
taatacgactcactataggggggctggctgggcgtgcaccccgcgggccgaacagaggagacggcccatggggtgcacgaacctggcggcagcgcaaaagatg

SEQ ID NO: 179217 - DNA, 103 bp, Artificial Sequence
  Synthetic Polynucleotide
taatacgactcactatagggctgggcctgggggctggctgggcgtgcaccaacagaggagaggtgcaatgccagccagcaacctggcggcagcgcaaaagatg

SEQ ID NO: 179218 - DNA, 103 bp, Artificial Sequence
  Synthetic Polynucleotide
taatacgactcactatagggagaggcagggctgggcctgggggctggctgaacagaggagacagccaatgcccaggcccaacctggcggcagcgcaaaagatg

SEQ ID NO: 179219 - DNA, 103 bp, Artificial Sequence
  Synthetic Polynucleotide
taatacgactcactataggggggtccggccagaggcagggctgggcctggaacagaggagaccaggcatggccctgcctaacctggcggcagcgcaaaagatg

SEQ ID NO: 179220 - DNA, 103 bp, Artificial Sequence
  Synthetic Polynucleotide
taatacgactcactataggggaagtgtggtgggtccggccagaggcagggaacagaggagaccctgcatgtggccggacaacctggcggcagcgcaaaagatg

SEQ ID NO: 179221 - DNA, 103 bp, Artificial Sequence
  Synthetic Polynucleotide
taatacgactcactatagggaccaataaaggaagtgtggtgggtccggccaacagaggagaggccggatgcaccacactaacctggcggcagcgcaaaagatg

SEQ ID NO: 179222 - DNA, 103 bp, Artificial Sequence
  Synthetic Polynucleotide
taatacgactcactatagggaaaaacccagaccaataaaggaagtgtggtaacagaggagaaccacaatgcctttattgaacctggcggcagcgcaaaagatg

SEQ ID NO: 179223 - DNA, 103 bp, Artificial Sequence
  Synthetic Polynucleotide
taatacgactcactatagggagagaagcctaaaaacccagaccaataaagaacagaggagactttatatgtctgggtttaacctggcggcagcgcaaaagatg

SEQ ID NO: 179224 - DNA, 103 bp, Artificial Sequence
  Synthetic Polynucleotide
taatacgactcactatagggacccaagttcagagaagcctaaaaacccagaacagaggagactgggtatgtaggcttctaacctggcggcagcgcaaaagatg

SEQ ID NO: 179225 - DNA, 103 bp, Artificial Sequence
  Synthetic Polynucleotide
taatacgactcactataggggaggcatagagggagggcgcccgagagccgaacagaggagacggctcatgggcgccctcaacctggcggcagcgcaaaagatg

SEQ ID NO: 179226 - DNA, 103 bp, Artificial Sequence
  Synthetic Polynucleotide
taatacgactcactatagggcgccgcgtgagaggcatagagggagggcgcaacagaggagagcgcccatgctctatgccaacctggcggcagcgcaaaagatg

SEQ ID NO: 179227 - DNA, 103 bp, Artificial Sequence
  Synthetic Polynucleotide
taatacgactcactataggggcgccgccgccgccgcgtgagaggcatagaaacagaggagatctatgatgctcacgcggaacctggcggcagcgcaaaagatg

SEQ ID NO: 179228 - DNA, 103 bp, Artificial Sequence
  Synthetic Polynucleotide
taatacgactcactataggggagagcttgggcgccgccgccgccgcgtgaaacagaggagatcacgcatgggcggcggcaacctggcggcagcgcaaaagatg

SEQ ID NO: 179229 - DNA, 103 bp, Artificial Sequence
  Synthetic Polynucleotide
taatacgactcactatagggctctccacgcccgcgaccccaggcccagggaacagaggagaccctggatgtggggtcgcaacctggcggcagcgcaaaagatg

SEQ ID NO: 179230 - DNA, 103 bp, Artificial Sequence
  Synthetic Polynucleotide
taatacgactcactatagggcgcagtccgggagagcttgggcgccgccgcaacagaggagagcggcgatgcccaagctcaacctggcggcagcgcaaaagatg

SEQ ID NO: 179231 - DNA, 103 bp, Artificial Sequence
  Synthetic Polynucleotide
taatacgactcactatagggctgggcccggcgcagtccgggagagcttggaacagaggagaccaagcatgcccggactgaacctggcggcagcgcaaaagatg

SEQ ID NO: 179232 - DNA, 103 bp, Artificial Sequence
  Synthetic Polynucleotide
taatacgactcactataggggtggccggggctgggcccggcgcagtccggaacagaggagaccggacatggccgggcccaacctggcggcagcgcaaaagatg

SEQ ID NO: 179233 - DNA, 103 bp, Artificial Sequence
  Synthetic Polynucleotide
taatacgactcactatagggggtggccggggtggccggggctgggcccggaacagaggagaccgggcatggccccggccaacctggcggcagcgcaaaagatg

SEQ ID NO: 179234 - DNA, 103 bp, Artificial Sequence
  Synthetic Polynucleotide
taatacgactcactatagggctggcgccggggtggccggggtggccggggaacagaggagaccccggatgccccggccaaacctggcggcagcgcaaaagatg

SEQ ID NO: 179235 - DNA, 103 bp, Artificial Sequence
  Synthetic Polynucleotide
taatacgactcactatagggggccagctgcctggcgccggggtggccgggaacagaggagacccggcatgcccggcgccaacctggcggcagcgcaaaagatg

SEQ ID NO: 179236 - DNA, 103 bp, Artificial Sequence
  Synthetic Polynucleotide
taatacgactcactatagggcgagcgggccggccagctgcctggcgccggaacagaggagaccggcgatgggcagctggaacctggcggcagcgcaaaagatg

SEQ ID NO: 179237 - DNA, 103 bp, Artificial Sequence
  Synthetic Polynucleotide
taatacgactcactatagggtgctccatagcgagcgggccggccagctgcaacagaggagagcagctatgcggcccgctaacctggcggcagcgcaaaagatg

SEQ ID NO: 179238 - DNA, 103 bp, Artificial Sequence
  Synthetic Polynucleotide
taatacgactcactataggggccatacgtctgctccatagcgagcgggccaacagaggagaggcccgatggctatggagaacctggcggcagcgcaaaagatg

SEQ ID NO: 179239 - DNA, 103 bp, Artificial Sequence
  Synthetic Polynucleotide
taatacgactcactatagggggttcacctcgccatacgtctgctccatagaacagaggagactatggatgagacgtatgaacctggcggcagcgcaaaagatg

SEQ ID NO: 179240 - DNA, 103 bp, Artificial Sequence
  Synthetic Polynucleotide
taatacgactcactatagggtcccaggacactctccacgcccgcgaccccaacagaggagaggggtcatgggcgtggagaacctggcggcagcgcaaaagatg

SEQ ID NO: 179241 - DNA, 103 bp, Artificial Sequence
  Synthetic Polynucleotide
taatacgactcactatagggccgcccagctggttcacctcgccatacgtcaacagaggagagacgtaatgcgaggtgaaaacctggcggcagcgcaaaagatg

SEQ ID NO: 179242 - DNA, 103 bp, Artificial Sequence
  Synthetic Polynucleotide
taatacgactcactataggggacgaacacaccgcccagctggttcacctcaacagaggagagaggtgatgcagctgggcaacctggcggcagcgcaaaagatg

SEQ ID NO: 179243 - DNA, 103 bp, Artificial Sequence
  Synthetic Polynucleotide
taatacgactcactatagggggcggccgttgacgaacacaccgcccagctaacagaggagaagctggatggtgtgttcgaacctggcggcagcgcaaaagatg

SEQ ID NO: 179244 - DNA, 103 bp, Artificial Sequence
  Synthetic Polynucleotide
taatacgactcactatagggttgggcagggggcggccgttgacgaacacaaacagaggagatgtgttatgcaacggccgaacctggcggcagcgcaaaagatg

SEQ ID NO: 179245 - DNA, 103 bp, Artificial Sequence
  Synthetic Polynucleotide
taatacgactcactataggggcggatggcgttgggcagggggcggccgttaacagaggagaaacggcatgcccctgcccaacctggcggcagcgcaaaagatg

SEQ ID NO: 179246 - DNA, 103 bp, Artificial Sequence
  Synthetic Polynucleotide
taatacgactcactatagggcaatgcgcaagcggatggcgttgggcagggaacagaggagaccctgcatgacgccatccaacctggcggcagcgcaaaagatg

SEQ ID NO: 179247 - DNA, 103 bp, Artificial Sequence
  Synthetic Polynucleotide
taatacgactcactataggggccagctccacaatgcgcaagcggatggcgaacagaggagacgccatatgcttgcgcataacctggcggcagcgcaaaagatg

SEQ ID NO: 179248 - DNA, 103 bp, Artificial Sequence
  Synthetic Polynucleotide
taatacgactcactataggggcccagctgcgccagctccacaatgcgcaaaacagaggagattgcgcatggtggagctgaacctggcggcagcgcaaaagatg

SEQ ID NO: 179249 - DNA, 103 bp, Artificial Sequence
  Synthetic Polynucleotide
taatacgactcactatagggagggtcggatgcccagctgcgccagctccaaacagaggagatggagcatgcgcagctggaacctggcggcagcgcaaaagatg

SEQ ID NO: 179250 - DNA, 103 bp, Artificial Sequence
  Synthetic Polynucleotide
taatacgactcactatagggctgatgtcacagggtcggatgcccagctgcaacagaggagagcagctatgcatccgaccaacctggcggcagcgcaaaagatg

SEQ ID NO: 179251 - DNA, 103 bp, Artificial Sequence
  Synthetic Polynucleotide
taatacgactcactatagggtgctgccccctcccaggacactctccacgcaacagaggagagcgtggatggtgtcctggaacctggcggcagcgcaaaagatg

SEQ ID NO: 179252 - DNA, 103 bp, Artificial Sequence
  Synthetic Polynucleotide
taatacgactcactataggggagctgccgactgatgtcacagggtcggataacagaggagaatccgaatgtgtgacatcaacctggcggcagcgcaaaagatg

SEQ ID NO: 179253 - DNA, 103 bp, Artificial Sequence
  Synthetic Polynucleotide
taatacgactcactataggggggatacgcggagctgccgactgatgtcacaacagaggagagtgacaatggtcggcagcaacctggcggcagcgcaaaagatg

SEQ ID NO: 179254 - DNA, 103 bp, Artificial Sequence
  Synthetic Polynucleotide
taatacgactcactatagggacgcagccgtgggatacgcggagctgccgaaacagaggagatcggcaatgccgcgtatcaacctggcggcagcgcaaaagatg

SEQ ID NO: 179255 - DNA, 103 bp, Artificial Sequence
  Synthetic Polynucleotide
taatacgactcactataggggatcttgctcacgcagccgtgggatacgcgaacagaggagacgcgtaatgcacggctgcaacctggcggcagcgcaaaagatg

SEQ ID NO: 179256 - DNA, 103 bp, Artificial Sequence
  Synthetic Polynucleotide
taatacgactcactatagggagcgcgccaggatcttgctcacgcagccgtaacagaggagaacggctatgtgagcaagaaacctggcggcagcgcaaaagatg

SEQ ID NO: 179257 - DNA, 103 bp, Artificial Sequence
  Synthetic Polynucleotide
taatacgactcactataggggtctcgttgtagcgcgccaggatcttgctcaacagaggagagagcaaatgcctggcgcgaacctggcggcagcgcaaaagatg

SEQ ID NO: 179258 - DNA, 103 bp, Artificial Sequence
  Synthetic Polynucleotide
taatacgactcactatagggaatggagccggtctcgttgtagcgcgccagaacagaggagactggcgatgtacaacgagaacctggcggcagcgcaaaagatg

SEQ ID NO: 179259 - DNA, 103 bp, Artificial Sequence
  Synthetic Polynucleotide
taatacgactcactatagggccccgggcagaatggagccggtctcgttgtaacagaggagaacaacgatgccggctccaaacctggcggcagcgcaaaagatg

SEQ ID NO: 179260 - DNA, 103 bp, Artificial Sequence
  Synthetic Polynucleotide
taatacgactcactatagggcccccgatggccccgggcagaatggagccgaacagaggagacggctcatgtctgcccggaacctggcggcagcgcaaaagatg

SEQ ID NO: 179261 - DNA, 103 bp, Artificial Sequence
  Synthetic Polynucleotide
taatacgactcactataggggggcttgctccccccgatggccccgggcagaacagaggagactgcccatggccatcgggaacctggcggcagcgcaaaagatg

SEQ ID NO: 179262 - DNA, 103 bp, Artificial Sequence
  Synthetic Polynucleotide
taatacgactcactatagggccgccgccgctgctgccccctcccaggacaaacagaggagatgtcctatgagggggcagaacctggcggcagcgcaaaagatg

SEQ ID NO: 179263 - DNA, 103 bp, Artificial Sequence
  Synthetic Polynucleotide
taatacgactcactatagggtggtgacgcggggcttgctccccccgatggaacagaggagaccatcgatgggagcaagcaacctggcggcagcgcaaaagatg

SEQ ID NO: 179264 - DNA, 103 bp, Artificial Sequence
  Synthetic Polynucleotide
taatacgactcactatagggacgttgggagtggtgacgcggggcttgctcaacagaggagagagcaaatgccgcgtcacaacctggcggcagcgcaaaagatg

SEQ ID NO: 179265 - DNA, 103 bp, Artificial Sequence
  Synthetic Polynucleotide
taatacgactcactataggggtgcttgaccacgttgggagtggtgacgcgaacagaggagacgcgtcatgactcccaacaacctggcggcagcgcaaaagatg

SEQ ID NO: 179266 - DNA, 103 bp, Artificial Sequence
  Synthetic Polynucleotide
taatacgactcactatagggagtcccggatgtgcttgaccacgttgggagaacagaggagactcccaatgtggtcaagcaacctggcggcagcgcaaaagatg

SEQ ID NO: 179267 - DNA, 103 bp, Artificial Sequence
  Synthetic Polynucleotide
taatacgactcactatagggccttgcttgtagtcccggatgtgcttgaccaacagaggagaggtcaaatgcatccgggaaacctggcggcagcgcaaaagatg

SEQ ID NO: 179268 - DNA, 103 bp, Artificial Sequence
  Synthetic Polynucleotide
taatacgactcactataggggccagggtctccttgcttgtagtcccggataacagaggagaatccggatgtacaagcaaaacctggcggcagcgcaaaagatg

SEQ ID NO: 179269 - DNA, 103 bp, Artificial Sequence
  Synthetic Polynucleotide
taatacgactcactatagggaggcaaagatgccagggtctccttgcttgtaacagaggagaacaagcatggagaccctgaacctggcggcagcgcaaaagatg

SEQ ID NO: 179270 - DNA, 103 bp, Artificial Sequence
  Synthetic Polynucleotide
taatacgactcactatagggcggatctcccaggcaaagatgccagggtctaacagaggagaagacccatgcatctttgcaacctggcggcagcgcaaaagatg

SEQ ID NO: 179271 - DNA, 103 bp, Artificial Sequence
  Synthetic Polynucleotide
taatacgactcactatagggcagccggtcgcggatctcccaggcaaagataacagaggagaatctttatgtgggagatcaacctggcggcagcgcaaaagatg

SEQ ID NO: 179272 - DNA, 103 bp, Artificial Sequence
  Synthetic Polynucleotide
taatacgactcactatagggcgtcggccagcagccggtcgcggatctcccaacagaggagagggagaatggcgaccggcaacctggcggcagcgcaaaagatg

SEQ ID NO: 179273 - DNA, 103 bp, Artificial Sequence
  Synthetic Polynucleotide
taatacgactcactatagggccagggcctgccgccgccgctgctgcccccaacagaggagagggggcatgagcggcggcaacctggcggcagcgcaaaagatg

SEQ ID NO: 179274 - DNA, 103 bp, Artificial Sequence
  Synthetic Polynucleotide
taatacgactcactatagggtcacagacgccgtcggccagcagccggtcgaacagaggagacgaccgatggctggccgaaacctggcggcagcgcaaaagatg

SEQ ID NO: 179275 - DNA, 103 bp, Artificial Sequence
  Synthetic Polynucleotide
taatacgactcactatagggattgtacttgtcacagacgccgtcggccagaacagaggagactggccatgggcgtctgtaacctggcggcagcgcaaaagatg

SEQ ID NO: 179276 - DNA, 103 bp, Artificial Sequence
  Synthetic Polynucleotide
taatacgactcactatagggccgaaggcacattgtacttgtcacagacgcaacagaggagagcgtctatgacaagtacaaacctggcggcagcgcaaaagatg

SEQ ID NO: 179277 - DNA, 103 bp, Artificial Sequence
  Synthetic Polynucleotide
taatacgactcactatagggatggagctcaccgaaggcacattgtacttgaacagaggagacaagtaatgtgtgccttcaacctggcggcagcgcaaaagatg

SEQ ID NO: 179278 - DNA, 103 bp, Artificial Sequence
  Synthetic Polynucleotide
taatacgactcactataggggatgcggctgatggagctcaccgaaggcacaacagaggagagtgcctatggtgagctccaacctggcggcagcgcaaaagatg

SEQ ID NO: 179279 - DNA, 103 bp, Artificial Sequence
  Synthetic Polynucleotide
taatacgactcactatagggtgttgcgcaggatgcggctgatggagctcaaacagaggagatgagctatgtcagccgcaaacctggcggcagcgcaaaagatg

SEQ ID NO: 179280 - DNA, 103 bp, Artificial Sequence
  Synthetic Polynucleotide
taatacgactcactatagggctgccgatcttgttgcgcaggatgcggctgaacagaggagacagccgatgcctgcgcaaaacctggcggcagcgcaaaagatg

SEQ ID NO: 179281 - DNA, 103 bp, Artificial Sequence
  Synthetic Polynucleotide
taatacgactcactatagggctgcgccaggctgccgatcttgttgcgcagaacagaggagactgcgcatgaagatcggcaacctggcggcagcgcaaaagatg

SEQ ID NO: 179282 - DNA, 103 bp, Artificial Sequence
  Synthetic Polynucleotide
taatacgactcactatagggacggtccgggctgcgccaggctgccgatctaacagaggagaagatcgatggcctggcgcaacctggcggcagcgcaaaagatg

SEQ ID NO: 179283 - DNA, 103 bp, Artificial Sequence
  Synthetic Polynucleotide
taatacgactcactatagggcttgcctcgtacggtccgggctgcgccaggaacagaggagacctggcatggcccggaccaacctggcggcagcgcaaaagatg

SEQ ID NO: 179284 - DNA, 103 bp, Artificial Sequence
  Synthetic Polynucleotide
taatacgactcactataggggccgcccgctccagggcctgccgccgccgcaacagaggagagcggcgatggcaggccctaacctggcggcagcgcaaaagatg

SEQ ID NO: 179285 - DNA, 103 bp, Artificial Sequence
  Synthetic Polynucleotide
taatacgactcactatagggcggctgcttacttgcctcgtacggtccgggaacagaggagacccggaatgtacgaggcaaacctggcggcagcgcaaaagatg

SEQ ID NO: 179286 - DNA, 103 bp, Artificial Sequence
  Synthetic Polynucleotide
taatacgactcactataggggctgcgacggcggctgcttacttgcctcgtaacagaggagaacgaggatggtaagcagcaacctggcggcagcgcaaaagatg

SEQ ID NO: 179287 - DNA, 103 bp, Artificial Sequence
  Synthetic Polynucleotide
taatacgactcactatagggggcagcgtaggctgcgacggcggctgcttaaacagaggagataagcaatggccgtcgcaaacctggcggcagcgcaaaagatg

SEQ ID NO: 179288 - DNA, 103 bp, Artificial Sequence
  Synthetic Polynucleotide
taatacgactcactataggggtggttgtagggcagcgtaggctgcgacggaacagaggagaccgtcgatgcctacgctgaacctggcggcagcgcaaaagatg

SEQ ID NO: 179289 - DNA, 103 bp, Artificial Sequence
  Synthetic Polynucleotide
taatacgactcactatagggactggtagatgtggttgtagggcagcgtagaacagaggagactacgcatgcctacaaccaacctggcggcagcgcaaaagatg

SEQ ID NO: 179290 - DNA, 103 bp, Artificial Sequence
  Synthetic Polynucleotide
taatacgactcactataggggggtaggggtactggtagatgtggttgtagaacagaggagactacaaatgcatctaccaaacctggcggcagcgcaaaagatg

SEQ ID NO: 179291 - DNA, 103 bp, Artificial Sequence
  Synthetic Polynucleotide
taatacgactcactatagggcacgggactggggtaggggtactggtagataacagaggagaatctacatgtacccctacaacctggcggcagcgcaaaagatg

SEQ ID NO: 179292 - DNA, 103 bp, Artificial Sequence
  Synthetic Polynucleotide
taatacgactcactatagggccgtgggcgacacgggactggggtaggggtaacagaggagaacccctatgccagtcccgaacctggcggcagcgcaaaagatg

SEQ ID NO: 179293 - DNA, 103 bp, Artificial Sequence
  Synthetic Polynucleotide
taatacgactcactatagggatcttggcgcccgtgggcgacacgggactgaacagaggagacagtccatggtcgcccacaacctggcggcagcgcaaaagatg

SEQ ID NO: 179294 - DNA, 103 bp, Artificial Sequence
  Synthetic Polynucleotide
taatacgactcactataggggtggctgcccatcttggcgcccgtgggcgaaacagaggagatcgcccatgggcgccaagaacctggcggcagcgcaaaagatg

SEQ ID NO: 179295 - DNA, 103 bp, Artificial Sequence
  Synthetic Polynucleotide
taatacgactcactatagggggagcgcgctgccgcccgctccagggcctgaacagaggagacaggccatggagcgggcgaacctggcggcagcgcaaaagatg

SEQ ID NO: 179296 - DNA, 103 bp, Artificial Sequence
  Synthetic Polynucleotide
taatacgactcactatagggggaccccggggtggctgcccatcttggcgcaacagaggagagcgccaatgtgggcagccaacctggcggcagcgcaaaagatg

SEQ ID NO: 179297 - DNA, 103 bp, Artificial Sequence
  Synthetic Polynucleotide
taatacgactcactataggggccgtgcccgggaccccggggtggctgcccaacagaggagagggcagatgccccggggtaacctggcggcagcgcaaaagatg

SEQ ID NO: 179298 - DNA, 103 bp, Artificial Sequence
  Synthetic Polynucleotide
taatacgactcactataggggacgtggcccgccgtgcccgggaccccgggaacagaggagacccgggatgccgggcacgaacctggcggcagcgcaaaagatg

SEQ ID NO: 179299 - DNA, 103 bp, Artificial Sequence
  Synthetic Polynucleotide
taatacgactcactataggggcgggatgctgacgtggcccgccgtgcccgaacagaggagacgggcaatgcgggccacgaacctggcggcagcgcaaaagatg

SEQ ID NO: 179300 - DNA, 103 bp, Artificial Sequence
  Synthetic Polynucleotide
taatacgactcactatagggggccatgagcgcgggatgctgacgtggcccaacagaggagagggccaatgcagcatcccaacctggcggcagcgcaaaagatg

SEQ ID NO: 179301 - DNA, 103 bp, Artificial Sequence
  Synthetic Polynucleotide
taatacgactcactataggggtgtgccgagggccatgagcgcgggatgctaacagaggagaagcatcatgcgctcatggaacctggcggcagcgcaaaagatg

SEQ ID NO: 179302 - DNA, 103 bp, Artificial Sequence
  Synthetic Polynucleotide
taatacgactcactatagggtgctgaccgagtgtgccgagggccatgagcaacagaggagagctcatatgcctcggcacaacctggcggcagcgcaaaagatg

SEQ ID NO: 179303 - DNA, 103 bp, Artificial Sequence
  Synthetic Polynucleotide
taatacgactcactatagggcccaggatgttgctgaccgagtgtgccgagaacagaggagactcggcatgctcggtcagaacctggcggcagcgcaaaagatg

SEQ ID NO: 179304 - DNA, 103 bp, Artificial Sequence
  Synthetic Polynucleotide
taatacgactcactatagggcgtccggatgcccaggatgttgctgaccgaaacagaggagatcggtcatgaacatcctgaacctggcggcagcgcaaaagatg

SEQ ID NO: 179305 - DNA, 103 bp, Artificial Sequence
  Synthetic Polynucleotide
taatacgactcactataggggctccataaacgtccggatgcccaggatgtaacagaggagaacatccatggcatccggaaacctggcggcagcgcaaaagatg

SEQ ID NO: 179306 - DNA, 103 bp, Artificial Sequence
  Synthetic Polynucleotide
taatacgactcactataggggcgcggcagcggagcgcgctgccgcccgctaacagaggagaagcgggatgcagcgcgctaacctggcggcagcgcaaaagatg

SEQ ID NO: 179307 - DNA, 103 bp, Artificial Sequence
  Synthetic Polynucleotide
taatacgactcactataggggcccctgtttgctccataaacgtccggatgaacagaggagacatccgatggtttatggaaacctggcggcagcgcaaaagatg

SEQ ID NO: 179308 - DNA, 103 bp, Artificial Sequence
  Synthetic Polynucleotide
taatacgactcactatagggcccagccagggcccctgtttgctccataaaaacagaggagatttatgatgcaaacagggaacctggcggcagcgcaaaagatg

SEQ ID NO: 179309 - DNA, 103 bp, Artificial Sequence
  Synthetic Polynucleotide
taatacgactcactatagggtgccttcgctcccagccagggcccctgtttaacagaggagaaaacagatgccctggctgaacctggcggcagcgcaaaagatg

SEQ ID NO: 179310 - DNA, 103 bp, Artificial Sequence
  Synthetic Polynucleotide
taatacgactcactataggggagtaagcggtgccttcgctcccagccaggaacagaggagacctggcatggagcgaaggaacctggcggcagcgcaaaagatg

SEQ ID NO: 179311 - DNA, 103 bp, Artificial Sequence
  Synthetic Polynucleotide
taatacgactcactatagggcatcttgggagagtaagcggtgccttcgctaacagaggagaagcgaaatgaccgcttacaacctggcggcagcgcaaaagatg

SEQ ID NO: 179312 - DNA, 103 bp, Artificial Sequence
  Synthetic Polynucleotide
taatacgactcactatagggcccagtcttccatcttgggagagtaagcggaacagaggagaccgcttatgctcccaagaaacctggcggcagcgcaaaagatg

SEQ ID NO: 179313 - DNA, 103 bp, Artificial Sequence
  Synthetic Polynucleotide
taatacgactcactatagggttcacgccggcccagtcttccatcttgggaaacagaggagatcccaaatgggaagactgaacctggcggcagcgcaaaagatg

SEQ ID NO: 179314 - DNA, 103 bp, Artificial Sequence
  Synthetic Polynucleotide
taatacgactcactatagggggccgtgcggttcacgccggcccagtcttcaacagaggagagaagacatggccggcgtgaacctggcggcagcgcaaaagatg

SEQ ID NO: 179315 - DNA, 103 bp, Artificial Sequence
  Synthetic Polynucleotide
taatacgactcactatagggtggcggggaaggccgtgcggttcacgccggaacagaggagaccggcgatgaccgcacggaacctggcggcagcgcaaaagatg

SEQ ID NO: 179316 - DNA, 103 bp, Artificial Sequence
  Synthetic Polynucleotide
taatacgactcactatagggactgcgggggtggcggggaaggccgtgcggaacagaggagaccgcacatgcttccccgcaacctggcggcagcgcaaaagatg

SEQ ID NO: 179317 - DNA, 103 bp, Artificial Sequence
  Synthetic Polynucleotide
taatacgactcactataggggaaggggtctgctttgcagtgcatatccataacagaggagaatggatatgcactgcaaaaacctggcggcagcgcaaaagatg

SEQ ID NO: 179318 - DNA, 103 bp, Artificial Sequence
  Synthetic Polynucleotide
taatacgactcactataggggcgctgcctcaccacgtcgggtaggggccgaacagaggagacggcccatgcccgacgtgaacctggcggcagcgcaaaagatg

SEQ ID NO: 179319 - DNA, 103 bp, Artificial Sequence
  Synthetic Polynucleotide
taatacgactcactatagggaggcaccattcctgccagggtggaggtgggaacagaggagacccaccatgaccctggcaaacctggcggcagcgcaaaagatg

SEQ ID NO: 179320 - DNA, 103 bp, Artificial Sequence
  Synthetic Polynucleotide
taatacgactcactatagggactcgctcccaggcaccattcctgccagggaacagaggagaccctggatggaatggtgcaacctggcggcagcgcaaaagatg

SEQ ID NO: 179321 - DNA, 103 bp, Artificial Sequence
  Synthetic Polynucleotide
taatacgactcactatagggttgccggagaactcgctcccaggcaccattaacagaggagaaatggtatgtgggagcgaaacctggcggcagcgcaaaagatg

SEQ ID NO: 179322 - DNA, 103 bp, Artificial Sequence
  Synthetic Polynucleotide
taatacgactcactataggggctgtacgggttgccggagaactcgctcccaacagaggagagggagcatgttctccggcaacctggcggcagcgcaaaagatg

SEQ ID NO: 179323 - DNA, 103 bp, Artificial Sequence
  Synthetic Polynucleotide
taatacgactcactatagggactgggggtggctgtacgggttgccggagaaacagaggagatctccgatgacccgtacaaacctggcggcagcgcaaaagatg

SEQ ID NO: 179324 - DNA, 103 bp, Artificial Sequence
  Synthetic Polynucleotide
taatacgactcactatagggtaggccgtgtactgggggtggctgtacgggaacagaggagacccgtaatgccacccccaaacctggcggcagcgcaaaagatg

SEQ ID NO: 179325 - DNA, 103 bp, Artificial Sequence
  Synthetic Polynucleotide
taatacgactcactatagggagcctcgttgtaggccgtgtactgggggtgaacagaggagacaccccatgtacacggccaacctggcggcagcgcaaaagatg

SEQ ID NO: 179326 - DNA, 103 bp, Artificial Sequence
  Synthetic Polynucleotide
taatacgactcactatagggtgaatctccaagcctcgttgtaggccgtgtaacagaggagaacacggatgacaacgaggaacctggcggcagcgcaaaagatg

SEQ ID NO: 179327 - DNA, 103 bp, Artificial Sequence
  Synthetic Polynucleotide
taatacgactcactataggggcggggttgctgaatctccaagcctcgttgaacagaggagacaacgaatgttggagattaacctggcggcagcgcaaaagatg

SEQ ID NO: 179328 - DNA, 103 bp, Artificial Sequence
  Synthetic Polynucleotide
taatacgactcactatagggacttagtaaggcggggttgctgaatctccaaacagaggagatggagaatgagcaaccccaacctggcggcagcgcaaaagatg

SEQ ID NO: 179329 - DNA, 103 bp, Artificial Sequence
  Synthetic Polynucleotide
taatacgactcactataggggctccacgatgcgctgcctcaccacgtcggaacagaggagaccgacgatgtgaggcagcaacctggcggcagcgcaaaagatg

SEQ ID NO: 179330 - DNA, 103 bp, Artificial Sequence
  Synthetic Polynucleotide
taatacgactcactatagggaataaggggaacttagtaaggcggggttgcaacagaggagagcaaccatgccttactaaaacctggcggcagcgcaaaagatg

SEQ ID NO: 179331 - DNA, 103 bp, Artificial Sequence
  Synthetic Polynucleotide
taatacgactcactataggggcactataataataaggggaacttagtaagaacagaggagacttactatgttccccttaaacctggcggcagcgcaaaagatg

SEQ ID NO: 179332 - DNA, 103 bp, Artificial Sequence
  Synthetic Polynucleotide
taatacgactcactatagggccggggggcggcactataataataaggggaaacagaggagatcccctatgtattatagtaacctggcggcagcgcaaaagatg

SEQ ID NO: 179333 - DNA, 103 bp, Artificial Sequence
  Synthetic Polynucleotide
taatacgactcactataggggggcggagccccggggggcggcactataataacagaggagaattataatgccgccccccaacctggcggcagcgcaaaagatg

SEQ ID NO: 179334 - DNA, 103 bp, Artificial Sequence
  Synthetic Polynucleotide
taatacgactcactataggggcagcggcaggggcggagccccggggggcgaacagaggagacgccccatggggctccgcaacctggcggcagcgcaaaagatg

SEQ ID NO: 179335 - DNA, 103 bp, Artificial Sequence
  Synthetic Polynucleotide
taatacgactcactatagggggcagcggcagcagcggcaggggcggagccaacagaggagaggctccatgcctgccgctaacctggcggcagcgcaaaagatg

SEQ ID NO: 179336 - DNA, 103 bp, Artificial Sequence
  Synthetic Polynucleotide
taatacgactcactatagggggcggtcataggcagcggcagcagcggcagaacagaggagactgccgatgctgccgctgaacctggcggcagcgcaaaagatg

SEQ ID NO: 179337 - DNA, 103 bp, Artificial Sequence
  Synthetic Polynucleotide
taatacgactcactatagggtggtgggccagctccacgatgcgctgcctcaacagaggagagaggcaatgcatcgtggaaacctggcggcagcgcaaaagatg

SEQ ID NO: 179338 - DNA, 103 bp, Artificial Sequence
  Synthetic Polynucleotide
taatacgactcactatagggccgcacaccctggtgggccagctccacgataacagaggagaatcgtgatgctggcccacaacctggcggcagcgcaaaagatg

SEQ ID NO: 179339 - DNA, 103 bp, Artificial Sequence
  Synthetic Polynucleotide
taatacgactcactatagggtgtcacagggccgcacaccctggtgggccaaacagaggagatggcccatgagggtgtgcaacctggcggcagcgcaaaagatg

SEQ ID NO: 179340 - DNA, 103 bp, Artificial Sequence
  Synthetic Polynucleotide
taatacgactcactatagggtgccgggagatgtcacagggccgcacacccaacagaggagagggtgtatggccctgtgaaacctggcggcagcgcaaaagatg

SEQ ID NO: 179341 - DNA, 103 bp, Artificial Sequence
  Synthetic Polynucleotide
taatacgactcactataggggacccgcagctgccgggagatgtcacagggaacagaggagaccctgtatgatctcccggaacctggcggcagcgcaaaagatg

SEQ ID NO: 179342 - DNA, 103 bp, Artificial Sequence
  Synthetic Polynucleotide
taatacgactcactatagggagccgtggctgacccgcagctgccgggagaaacagaggagatctcccatgagctgcgggaacctggcggcagcgcaaaagatg

SEQ ID NO: 179343 - DNA, 103 bp, Artificial Sequence
  Synthetic Polynucleotide
taatacgactcactatagggttgctgacacagccgtggctgacccgcagcaacagaggagagctgcgatgcagccacggaacctggcggcagcgcaaaagatg

SEQ ID NO: 179344 - DNA, 103 bp, Artificial Sequence
  Synthetic Polynucleotide
taatacgactcactataggggcccaggattttgctgacacagccgtggctaacagaggagaagccacatgtgtgtcagcaacctggcggcagcgcaaaagatg

SEQ ID NO: 179345 - DNA, 103 bp, Artificial Sequence
  Synthetic Polynucleotide
taatacgactcactataggggcatcgcggagaaggggtctgctttgcagtaacagaggagaactgcaatgcagacccctaacctggcggcagcgcaaaagatg

SEQ ID NO: 179346 - DNA, 103 bp, Artificial Sequence
  Synthetic Polynucleotide
taatacgactcactatagggcgtagtacctgcccaggattttgctgacacaacagaggagagtgtcaatgaaatcctggaacctggcggcagcgcaaaagatg

SEQ ID NO: 179347 - DNA, 103 bp, Artificial Sequence
  Synthetic Polynucleotide
taatacgactcactatagggctgccggtctcgtagtacctgcccaggattaacagaggagaaatcctatgcaggtactaaacctggcggcagcgcaaaagatg

SEQ ID NO: 179348 - DNA, 103 bp, Artificial Sequence
  Synthetic Polynucleotide
taatacgactcactatagggcggcttgatgctgccggtctcgtagtacctaacagaggagaaggtacatggagaccggcaacctggcggcagcgcaaaagatg

SEQ ID NO: 179349 - DNA, 103 bp, Artificial Sequence
  Synthetic Polynucleotide
taatacgactcactatagggcgatcacacccggcttgatgctgccggtctaacagaggagaagaccgatggcatcaagcaacctggcggcagcgcaaaagatg

SEQ ID NO: 179350 - DNA, 103 bp, Artificial Sequence
  Synthetic Polynucleotide
taatacgactcactatagggttggagccaccgatcacacccggcttgatgaacagaggagacatcaaatggggtgtgataacctggcggcagcgcaaaagatg

SEQ ID NO: 179351 - DNA, 103 bp, Artificial Sequence
  Synthetic Polynucleotide
taatacgactcactatagggcactttgggcttggagccaccgatcacaccaacagaggagaggtgtgatgggtggctccaacctggcggcagcgcaaaagatg

SEQ ID NO: 179352 - DNA, 103 bp, Artificial Sequence
  Synthetic Polynucleotide
taatacgactcactatagggtgggcgtcgccactttgggcttggagccacaacagaggagagtggctatgagcccaaagaacctggcggcagcgcaaaagatg

SEQ ID NO: 179353 - DNA, 103 bp, Artificial Sequence
  Synthetic Polynucleotide
taatacgactcactatagggtccaccactttgggcgtcgccactttgggcaacagaggagagcccaaatgggcgacgccaacctggcggcagcgcaaaagatg

SEQ ID NO: 179354 - DNA, 103 bp, Artificial Sequence
  Synthetic Polynucleotide
taatacgactcactatagggagcaatcttgtccaccactttgggcgtcgcaacagaggagagcgacgatgaaagtggtgaacctggcggcagcgcaaaagatg

SEQ ID NO: 179355 - DNA, 103 bp, Artificial Sequence
  Synthetic Polynucleotide
taatacgactcactataggggtttgtattcagcaatcttgtccaccacttaacagaggagaaagtggatgacaagattgaacctggcggcagcgcaaaagatg

SEQ ID NO: 179356 - DNA, 103 bp, Artificial Sequence
  Synthetic Polynucleotide
taatacgactcactatagggtgccctgggtgcatcgcggagaaggggtctaacagaggagaagacccatgctccgcgataacctggcggcagcgcaaaagatg

SEQ ID NO: 179357 - DNA, 103 bp, Artificial Sequence
  Synthetic Polynucleotide
taatacgactcactataggggggttctgtcgtttgtattcagcaatcttgaacagaggagacaagatatgtgaatacaaaacctggcggcagcgcaaaagatg

SEQ ID NO: 179358 - DNA, 103 bp, Artificial Sequence
  Synthetic Polynucleotide
taatacgactcactataggggaacatagtcgggttctgtcgtttgtattcaacagaggagagaatacatgcgacagaacaacctggcggcagcgcaaaagatg

SEQ ID NO: 179359 - DNA, 103 bp, Artificial Sequence
  Synthetic Polynucleotide
taatacgactcactatagggtctcccaggcgaacatagtcgggttctgtcaacagaggagagacagaatgcgactatgtaacctggcggcagcgcaaaagatg

SEQ ID NO: 179360 - DNA, 103 bp, Artificial Sequence
  Synthetic Polynucleotide
taatacgactcactatagggcggtctcgaatctcccaggcgaacatagtcaacagaggagagactatatgcgcctgggaaacctggcggcagcgcaaaagatg

SEQ ID NO: 179361 - DNA, 103 bp, Artificial Sequence
  Synthetic Polynucleotide
taatacgactcactatagggggccaggagccggtctcgaatctcccaggcaacagaggagagcctggatgattcgagacaacctggcggcagcgcaaaagatg

SEQ ID NO: 179362 - DNA, 103 bp, Artificial Sequence
  Synthetic Polynucleotide
taatacgactcactatagggagatgccctcggccaggagccggtctcgaaaacagaggagattcgagatgggctcctggaacctggcggcagcgcaaaagatg

SEQ ID NO: 179363 - DNA, 103 bp, Artificial Sequence
  Synthetic Polynucleotide
taatacgactcactatagggtcattgtcacagatgccctcggccaggagcaacagaggagagctcctatgcgagggcataacctggcggcagcgcaaaagatg

SEQ ID NO: 179364 - DNA, 103 bp, Artificial Sequence
  Synthetic Polynucleotide
taatacgactcactataggggggcactgtgtcattgtcacagatgccctcaacagaggagagagggcatgtgtgacaataacctggcggcagcgcaaaagatg

SEQ ID NO: 179365 - DNA, 103 bp, Artificial Sequence
  Synthetic Polynucleotide
taatacgactcactatagggaagagacgctgggcactgtgtcattgtcacaacagaggagagtgacaatgacacagtgcaacctggcggcagcgcaaaagatg

SEQ ID NO: 179366 - DNA, 103 bp, Artificial Sequence
  Synthetic Polynucleotide
taatacgactcactatagggctgttgatggaagagacgctgggcactgtgaacagaggagacacagtatgcagcgtctcaacctggcggcagcgcaaaagatg

SEQ ID NO: 179367 - DNA, 103 bp, Artificial Sequence
  Synthetic Polynucleotide
taatacgactcactatagggcacacccccgtgccctgggtgcatcgcggaaacagaggagatccgcgatgcacccagggaacctggcggcagcgcaaaagatg

SEQ ID NO: 179368 - DNA, 103 bp, Artificial Sequence
  Synthetic Polynucleotide
taatacgactcactatagggccggatgattctgttgatggaagagacgctaacagaggagaagcgtcatgtccatcaacaacctggcggcagcgcaaaagatg

SEQ ID NO: 179369 - DNA, 103 bp, Artificial Sequence
  Synthetic Polynucleotide
taatacgactcactataggggaactttggtccggatgattctgttgatggaacagaggagaccatcaatggaatcatccaacctggcggcagcgcaaaagatg

SEQ ID NO: 179370 - DNA, 103 bp, Artificial Sequence
  Synthetic Polynucleotide
taatacgactcactatagggaaaggctgctgaactttggtccggatgattaacagaggagaaatcatatggaccaaagtaacctggcggcagcgcaaaagatg

SEQ ID NO: 179371 - DNA, 103 bp, Artificial Sequence
  Synthetic Polynucleotide
taatacgactcactatagggcgttgggtggaaaggctgctgaactttggtaacagaggagaaccaaaatgcagcagcctaacctggcggcagcgcaaaagatg

SEQ ID NO: 179372 - DNA, 103 bp, Artificial Sequence
  Synthetic Polynucleotide
taatacgactcactatagggccccatccggcgttgggtggaaaggctgctaacagaggagaagcagcatgtccacccaaaacctggcggcagcgcaaaagatg

SEQ ID NO: 179373 - DNA, 103 bp, Artificial Sequence
  Synthetic Polynucleotide
taatacgactcactatagggcctgtcccagccccatccggcgttgggtggaacagaggagaccacccatggccggatggaacctggcggcagcgcaaaagatg

SEQ ID NO: 179374 - DNA, 103 bp, Artificial Sequence
  Synthetic Polynucleotide
taatacgactcactatagggggcggtcactcctgtcccagccccatccggaacagaggagaccggatatggctgggacaaacctggcggcagcgcaaaagatg

SEQ ID NO: 179375 - DNA, 103 bp, Artificial Sequence
  Synthetic Polynucleotide
taatacgactcactatagggtgtggccaggggcggtcactcctgtcccagaacagaggagactgggaatggagtgaccgaacctggcggcagcgcaaaagatg

SEQ ID NO: 179376 - DNA, 103 bp, Artificial Sequence
  Synthetic Polynucleotide
taatacgactcactatagggggaacaatggtgtggccaggggcggtcactaacagaggagaagtgacatgccctggccaaacctggcggcagcgcaaaagatg

SEQ ID NO: 179377 - DNA, 103 bp, Artificial Sequence
  Synthetic Polynucleotide
taatacgactcactatagggggccgtgctgggaacaatggtgtggccaggaacagaggagacctggcatgaccattgttaacctggcggcagcgcaaaagatg

SEQ ID NO: 179378 - DNA, 103 bp, Artificial Sequence
  Synthetic Polynucleotide
taatacgactcactatagggcgagctggttcacacccccgtgccctgggtaacagaggagaacccagatgacgggggtgaacctggcggcagcgcaaaagatg

SEQ ID NO: 179379 - DNA, 103 bp, Artificial Sequence
  Synthetic Polynucleotide
taatacgactcactatagggcaggaggggaggccgtgctgggaacaatggaacagaggagaccattgatgccagcacggaacctggcggcagcgcaaaagatg

SEQ ID NO: 179380 - DNA, 103 bp, Artificial Sequence
  Synthetic Polynucleotide
taatacgactcactataggggcgctggaaacaggaggggaggccgtgctgaacagaggagacagcacatgctcccctccaacctggcggcagcgcaaaagatg

SEQ ID NO: 179381 - DNA, 103 bp, Artificial Sequence
  Synthetic Polynucleotide
taatacgactcactataggggtcattggaggcgctggaaacaggaggggaaacagaggagatcccctatggtttccagcaacctggcggcagcgcaaaagatg

SEQ ID NO: 179382 - DNA, 103 bp, Artificial Sequence
  Synthetic Polynucleotide
taatacgactcactatagggatcccactgggtcattggaggcgctggaaaaacagaggagatttccaatgcctccaatgaacctggcggcagcgcaaaagatg

SEQ ID NO: 179383 - DNA, 103 bp, Artificial Sequence
  Synthetic Polynucleotide
taatacgactcactatagggatggagtaggatcccactgggtcattggagaacagaggagactccaaatgcccagtgggaacctggcggcagcgcaaaagatg

SEQ ID NO: 179384 - DNA, 103 bp, Artificial Sequence
  Synthetic Polynucleotide
taatacgactcactataggggatcccattgatggagtaggatcccactggaacagaggagaccagtgatgtcctactccaacctggcggcagcgcaaaagatg

SEQ ID NO: 179385 - DNA, 103 bp, Artificial Sequence
  Synthetic Polynucleotide
taatacgactcactataggggaatccccaggatcccattgatggagtaggaacagaggagacctactatgtcaatgggaaacctggcggcagcgcaaaagatg

SEQ ID NO: 179386 - DNA, 103 bp, Artificial Sequence
  Synthetic Polynucleotide
taatacgactcactatagggttggagcgaggaatccccaggatcccattgaacagaggagacaatggatgcctggggataacctggcggcagcgcaaaagatg

SEQ ID NO: 179387 - DNA, 103 bp, Artificial Sequence
  Synthetic Polynucleotide
taatacgactcactatagggcttctcaccattggagcgaggaatccccagaacagaggagactggggatgcctcgctccaacctggcggcagcgcaaaagatg

SEQ ID NO: 179388 - DNA, 103 bp, Artificial Sequence
  Synthetic Polynucleotide
taatacgactcactatagggcacgtttcctcttctcaccattggagcgagaacagaggagactcgctatgatggtgagaaacctggcggcagcgcaaaagatg

SEQ ID NO: 179389 - DNA, 103 bp, Artificial Sequence
  Synthetic Polynucleotide
taatacgactcactatagggaacacccccccgagctggttcacacccccgaacagaggagacgggggatggaaccagctaacctggcggcagcgcaaaagatg

SEQ ID NO: 179390 - DNA, 103 bp, Artificial Sequence
  Synthetic Polynucleotide
taatacgactcactatagggacatcttcatcacgtttcctcttctcaccaaacagaggagatggtgaatggaggaaacgaacctggcggcagcgcaaaagatg

SEQ ID NO: 179391 - DNA, 103 bp, Artificial Sequence
  Synthetic Polynucleotide
taatacgactcactataggggccctcagacacatcttcatcacgtttcctaacagaggagaaggaaaatggatgaagataacctggcggcagcgcaaaagatg

SEQ ID NO: 179392 - DNA, 103 bp, Artificial Sequence
  Synthetic Polynucleotide
taatacgactcactatagggtggggactgagccctcagacacatcttcataacagaggagaatgaagatgtgtctgaggaacctggcggcagcgcaaaagatg

SEQ ID NO: 179393 - DNA, 103 bp, Artificial Sequence
  Synthetic Polynucleotide
taatacgactcactataggggaatctccattggggactgagccctcagacaacagaggagagtctgaatgctcagtcccaacctggcggcagcgcaaaagatg

SEQ ID NO: 179394 - DNA, 103 bp, Artificial Sequence
  Synthetic Polynucleotide
taatacgactcactatagggaccactctgggaatctccattggggactgaaacagaggagatcagtcatgaatggagataacctggcggcagcgcaaaagatg

SEQ ID NO: 179395 - DNA, 103 bp, Artificial Sequence
  Synthetic Polynucleotide
taatacgactcactatagggaactgtccacaccactctgggaatctccataacagaggagaatggagatgcccagagtgaacctggcggcagcgcaaaagatg

SEQ ID NO: 179396 - DNA, 103 bp, Artificial Sequence
  Synthetic Polynucleotide
taatacgactcactatagggtgcttccgcaaactgtccacaccactctggaacagaggagaccagagatgtgtggacagaacctggcggcagcgcaaaagatg

SEQ ID NO: 179397 - DNA, 103 bp, Artificial Sequence
  Synthetic Polynucleotide
taatacgactcactatagggagctcgcaagtgcttccgcaaactgtccacaacagaggagagtggacatgttgcggaagaacctggcggcagcgcaaaagatg

SEQ ID NO: 179398 - DNA, 103 bp, Artificial Sequence
  Synthetic Polynucleotide
taatacgactcactatagggtgaaggtgtcagctcgcaagtgcttccgcaaacagaggagatgcggaatgacttgcgagaacctggcggcagcgcaaaagatg

SEQ ID NO: 179399 - DNA, 103 bp, Artificial Sequence
  Synthetic Polynucleotide
taatacgactcactatagggtgctgctgggtgaaggtgtcagctcgcaagaacagaggagacttgcgatgtgacaccttaacctggcggcagcgcaaaagatg

SEQ ID NO: 179400 - DNA, 103 bp, Artificial Sequence
  Synthetic Polynucleotide
taatacgactcactataggggccgttcacaaacacccccccgagctggttaacagaggagaaaccagatggggggggtgaacctggcggcagcgcaaaagatg

SEQ ID NO: 179401 - DNA, 103 bp, Artificial Sequence
  Synthetic Polynucleotide
taatacgactcactatagggagcttccagctgctgctgggtgaaggtgtcaacagaggagagacaccatgacccagcagaacctggcggcagcgcaaaagatg

SEQ ID NO: 179402 - DNA, 103 bp, Artificial Sequence
  Synthetic Polynucleotide
taatacgactcactatagggcccgatccaaagcttccagctgctgctgggaacagaggagacccagcatgagctggaagaacctggcggcagcgcaaaagatg

SEQ ID NO: 179403 - DNA, 103 bp, Artificial Sequence
  Synthetic Polynucleotide
taatacgactcactatagggcgctcaaagacccgatccaaagcttccagcaacagaggagagctggaatgtttggatcgaacctggcggcagcgcaaaagatg

SEQ ID NO: 179404 - DNA, 103 bp, Artificial Sequence
  Synthetic Polynucleotide
taatacgactcactataggggtaggaaggacgctcaaagacccgatccaaaacagaggagattggatatggtctttgagaacctggcggcagcgcaaaagatg

SEQ ID NO: 179405 - DNA, 103 bp, Artificial Sequence
  Synthetic Polynucleotide
taatacgactcactatagggagacgtcagggtaggaaggacgctcaaagaaacagaggagatctttgatggtccttcctaacctggcggcagcgcaaaagatg

SEQ ID NO: 179406 - DNA, 103 bp, Artificial Sequence
  Synthetic Polynucleotide
taatacgactcactataggggatgcctggaagacgtcagggtaggaaggaaacagaggagatccttcatgccctgacgtaacctggcggcagcgcaaaagatg

SEQ ID NO: 179407 - DNA, 103 bp, Artificial Sequence
  Synthetic Polynucleotide
taatacgactcactataggggatgtgctctgatgcctggaagacgtcaggaacagaggagacctgacatgttccaggcaaacctggcggcagcgcaaaagatg

SEQ ID NO: 179408 - DNA, 103 bp, Artificial Sequence
  Synthetic Polynucleotide
taatacgactcactataggggttctgatttgatgtgctctgatgcctggaaacagaggagatccaggatgcagagcacaaacctggcggcagcgcaaaagatg

SEQ ID NO: 179409 - DNA, 103 bp, Artificial Sequence
  Synthetic Polynucleotide
taatacgactcactatagggtcgttcccctgttctgatttgatgtgctctaacagaggagaagagcaatgcaaatcagaaacctggcggcagcgcaaaagatg

SEQ ID NO: 179410 - DNA, 103 bp, Artificial Sequence
  Synthetic Polynucleotide
taatacgactcactataggggagggagtactcgttcccctgttctgatttaacagaggagaaaatcaatgcaggggaacaacctggcggcagcgcaaaagatg

SEQ ID NO: 179411 - DNA, 103 bp, Artificial Sequence
  Synthetic Polynucleotide
taatacgactcactataggggtaggggccggccgttcacaaacaccccccaacagaggagaggggggatgttgtgaacgaacctggcggcagcgcaaaagatg

SEQ ID NO: 179412 - DNA, 103 bp, Artificial Sequence
  Synthetic Polynucleotide
taatacgactcactatagggtcagggctgggagggagtactcgttcccctaacagaggagaaggggaatgagtactcccaacctggcggcagcgcaaaagatg

SEQ ID NO: 179413 - DNA, 103 bp, Artificial Sequence
  Synthetic Polynucleotide
taatacgactcactatagggagcccaggggtcagggctgggagggagtacaacagaggagagtactcatgcccagccctaacctggcggcagcgcaaaagatg

SEQ ID NO: 179414 - DNA, 103 bp, Artificial Sequence
  Synthetic Polynucleotide
taatacgactcactataggggacttcatcaagcccaggggtcagggctggaacagaggagaccagccatgacccctgggaacctggcggcagcgcaaaagatg

SEQ ID NO: 179415 - DNA, 103 bp, Artificial Sequence
  Synthetic Polynucleotide
taatacgactcactataggggactcgacttgacttcatcaagcccaggggaacagaggagacccctgatgttgatgaagaacctggcggcagcgcaaaagatg

SEQ ID NO: 179416 - DNA, 103 bp, Artificial Sequence
  Synthetic Polynucleotide
taatacgactcactataggggatgcagatagactcgacttgacttcatcaaacagaggagatgatgaatgcaagtcgagaacctggcggcagcgcaaaagatg

SEQ ID NO: 179417 - DNA, 103 bp, Artificial Sequence
  Synthetic Polynucleotide
taatacgactcactatagggagggttggtggatgcagatagactcgacttaacagaggagaaagtcgatgctatctgcaaacctggcggcagcgcaaaagatg

SEQ ID NO: 179418 - DNA, 103 bp, Artificial Sequence
  Synthetic Polynucleotide
taatacgactcactatagggtgcccagctcagggttggtggatgcagataaacagaggagatatctgatgccaccaaccaacctggcggcagcgcaaaagatg

SEQ ID NO: 179419 - DNA, 103 bp, Artificial Sequence
  Synthetic Polynucleotide
taatacgactcactataggggacacgttgctgcccagctcagggttggtgaacagaggagacaccaaatgtgagctgggaacctggcggcagcgcaaaagatg

SEQ ID NO: 179420 - DNA, 103 bp, Artificial Sequence
  Synthetic Polynucleotide
taatacgactcactatagggctgtgtgcctgacacgttgctgcccagctcaacagaggagagagctgatgagcaacgtgaacctggcggcagcgcaaaagatg

SEQ ID NO: 179421 - DNA, 103 bp, Artificial Sequence
  Synthetic Polynucleotide
taatacgactcactatagggctgggtatgtctgtgtgcctgacacgttgcaacagaggagagcaacgatgcaggcacacaacctggcggcagcgcaaaagatg

SEQ ID NO: 179422 - DNA, 103 bp, Artificial Sequence
  Synthetic Polynucleotide
taatacgactcactatagggaccacgtcgggtaggggccggccgttcacaaacagaggagatgtgaaatgccggcccctaacctggcggcagcgcaaaagatg

SEQ ID NO: 179423 - DNA, 103 bp, Artificial Sequence
  Synthetic Polynucleotide
taatacgactcactatagggccagtcacaactgggtatgtctgtgtgcctaacagaggagaaggcacatggacatacccaacctggcggcagcgcaaaagatg

SEQ ID NO: 179424 - DNA, 103 bp, Artificial Sequence
  Synthetic Polynucleotide
taatacgactcactatagggcatgtcacgaccagtcacaactgggtatgtaacagaggagaacatacatggttgtgactaacctggcggcagcgcaaaagatg

SEQ ID NO: 179425 - DNA, 103 bp, Artificial Sequence
  Synthetic Polynucleotide
taatacgactcactatagggtggtgctcgccatgtcacgaccagtcacaaaacagaggagattgtgaatggtcgtgacaaacctggcggcagcgcaaaagatg

SEQ ID NO: 179426 - DNA, 103 bp, Artificial Sequence
  Synthetic Polynucleotide
taatacgactcactatagggccaggcagagtggtgctcgccatgtcacgaaacagaggagatcgtgaatgggcgagcacaacctggcggcagcgcaaaagatg

SEQ ID NO: 179427 - DNA, 103 bp, Artificial Sequence
  Synthetic Polynucleotide
taatacgactcactatagggaggggggtaaccaggcagagtggtgctcgcaacagaggagagcgagcatgactctgcctaacctggcggcagcgcaaaagatg

SEQ ID NO: 179428 - DNA, 103 bp, Artificial Sequence
  Synthetic Polynucleotide
taatacgactcactatagggggggcacgtgaggggggtaaccaggcagagaacagaggagactctgcatggttacccccaacctggcggcagcgcaaaagatg

SEQ ID NO: 179429 - DNA, 103 bp, Artificial Sequence
  Synthetic Polynucleotide
taatacgactcactatagggtggccagtggggggcacgtgaggggggtaaaacagaggagattacccatgtcacgtgccaacctggcggcagcgcaaaagatg

SEQ ID NO: 179430 - DNA, 103 bp, Artificial Sequence
  Synthetic Polynucleotide
taatacgactcactataggggtagcttccctggccagtggggggcacgtgaacagaggagacacgtgatgcccactggcaacctggcggcagcgcaaaagatg

SEQ ID NO: 179431 - DNA, 103 bp, Artificial Sequence
  Synthetic Polynucleotide
taatacgactcactatagggtggaggtggggtagcttccctggccagtggaacagaggagaccactgatgagggaagctaacctggcggcagcgcaaaagatg

SEQ ID NO: 179432 - DNA, 103 bp, Artificial Sequence
  Synthetic Polynucleotide
taatacgactcactatagggcctgccagggtggaggtggggtagcttcccaacagaggagagggaagatgccccacctcaacctggcggcagcgcaaaagatg

SEQ ID NO: 179433 - DNA, 103 bp, Artificial Sequence
  Synthetic Polynucleotide
taatacgactcactatagggattcacaaagagccccccaagctggttcataacagaggagaatgaacatgcttggggggaacctggcggcagcgcaaaagatg

SEQ ID NO: 179434 - DNA, 103 bp, Artificial Sequence
  Synthetic Polynucleotide
taatacgactcactatagggcttaaggatccgtgagatgtcacagggccgaacagaggagacggcccatggacatctcaaacctggcggcagcgcaaaagatg

SEQ ID NO: 179435 - DNA, 103 bp, Artificial Sequence
  Synthetic Polynucleotide
taatacgactcactatagggatacagtagtgggcagccaggccagagcagaacagaggagactgctcatgcctggctgcaacctggcggcagcgcaaaagatg

SEQ ID NO: 179436 - DNA, 103 bp, Artificial Sequence
  Synthetic Polynucleotide
taatacgactcactatagggattccaagccatacagtagtgggcagccagaacagaggagactggctatgcactactgtaacctggcggcagcgcaaaagatg

SEQ ID NO: 179437 - DNA, 103 bp, Artificial Sequence
  Synthetic Polynucleotide
taatacgactcactatagggcattagataccttaaggatccgtgagatgtaacagaggagaacatctatgggatccttaaacctggcggcagcgcaaaagatg

SEQ ID NO: 179438 - DNA, 103 bp, Artificial Sequence
  Synthetic Polynucleotide
taatacgactcactatagggctcacacagccattagataccttaaggatcaacagaggagagatcctatgggtatctaaaacctggcggcagcgcaaaagatg

SEQ ID NO: 179439 - DNA, 103 bp, Artificial Sequence
  Synthetic Polynucleotide
taatacgactcactatagggtaggatcttgctcacacagccattagatacaacagaggagagtatctatgggctgtgtgaacctggcggcagcgcaaaagatg

SEQ ID NO: 179440 - DNA, 103 bp, Artificial Sequence
  Synthetic Polynucleotide
taatacgactcactatagggagtaacgccctaggatcttgctcacacagcaacagaggagagctgtgatggcaagatccaacctggcggcagcgcaaaagatg

SEQ ID NO: 179441 - DNA, 103 bp, Artificial Sequence
  Synthetic Polynucleotide
taatacgactcactatagggcctgtgcggtagtaacgccctaggatcttgaacagaggagacaagatatgagggcgttaaacctggcggcagcgcaaaagatg

SEQ ID NO: 179442 - DNA, 103 bp, Artificial Sequence
  Synthetic Polynucleotide
taatacgactcactatagggctccaagacacctgtgcggtagtaacgcccaacagaggagagggcgtatgtaccgcacaaacctggcggcagcgcaaaagatg

SEQ ID NO: 179443 - DNA, 103 bp, Artificial Sequence
  Synthetic Polynucleotide
taatacgactcactatagggtgccctttggctccaagacacctgtgcggtaacagaggagaaccgcaatggtgtcttggaacctggcggcagcgcaaaagatg

SEQ ID NO: 179444 - DNA, 103 bp, Artificial Sequence
  Synthetic Polynucleotide
taatacgactcactatagggcttcccccaatgccctttggctccaagacaaacagaggagatgtcttatggccaaagggaacctggcggcagcgcaaaagatg

SEQ ID NO: 179445 - DNA, 103 bp, Artificial Sequence
  Synthetic Polynucleotide
taatacgactcactatagggccgtggcttgcttcccccaatgccctttggaacagaggagaccaaagatgattgggggaaacctggcggcagcgcaaaagatg

SEQ ID NO: 179446 - DNA, 103 bp, Artificial Sequence
  Synthetic Polynucleotide
taatacgactcactatagggggggccggccattcacaaagagccccccaaaacagaggagattggggatgtctttgtgaaacctggcggcagcgcaaaagatg

SEQ ID NO: 179447 - DNA, 103 bp, Artificial Sequence
  Synthetic Polynucleotide
taatacgactcactataggggtgtagccagccgtggcttgcttcccccaaaacagaggagattggggatggcaagccacaacctggcggcagcgcaaaagatg

SEQ ID NO: 179448 - DNA, 103 bp, Artificial Sequence
  Synthetic Polynucleotide
taatacgactcactatagggaccacagggggtgtagccagccgtggcttgaacagaggagacaagccatggctggctacaacctggcggcagcgcaaaagatg

SEQ ID NO: 179449 - DNA, 103 bp, Artificial Sequence
  Synthetic Polynucleotide
taatacgactcactatagggaattcgagccaccacagggggtgtagccagaacagaggagactggctatgccccctgtgaacctggcggcagcgcaaaagatg

SEQ ID NO: 179450 - DNA, 103 bp, Artificial Sequence
  Synthetic Polynucleotide
taatacgactcactatagggtcagctgggcaattcgagccaccacaggggaacagaggagacccctgatgtggctcgaaaacctggcggcagcgcaaaagatg

SEQ ID NO: 179451 - DNA, 103 bp, Artificial Sequence
  Synthetic Polynucleotide
taatacgactcactatagggcactcacccttcagctgggcaattcgagccaacagaggagaggctcgatgtgcccagctaacctggcggcagcgcaaaagatg

SEQ ID NO: 179452 - DNA, 103 bp, Artificial Sequence
  Synthetic Polynucleotide
taatacgactcactataggggagggctggacactcacccttcagctgggcaacagaggagagcccagatgaagggtgagaacctggcggcagcgcaaaagatg

SEQ ID NO: 179453 - DNA, 103 bp, Artificial Sequence
  Synthetic Polynucleotide
taatacgactcactatagggcccaggcaaagagggctggacactcaccctaacagaggagaagggtgatggtccagcccaacctggcggcagcgcaaaagatg

SEQ ID NO: 179454 - DNA, 103 bp, Artificial Sequence
  Synthetic Polynucleotide
taatacgactcactatagggcgttggatttcccaggcaaagagggctggaaacagaggagatccagcatgctttgcctgaacctggcggcagcgcaaaagatg

SEQ ID NO: 179455 - DNA, 103 bp, Artificial Sequence
  Synthetic Polynucleotide
taatacgactcactatagggacaaagctggcgttggatttcccaggcaaaaacagaggagatttgccatggaaatccaaaacctggcggcagcgcaaaagatg

SEQ ID NO: 179456 - DNA, 103 bp, Artificial Sequence
  Synthetic Polynucleotide
taatacgactcactataggggcccttcagcacaaagctggcgttggatttaacagaggagaaaatccatggccagctttaacctggcggcagcgcaaaagatg

SEQ ID NO: 179457 - DNA, 103 bp, Artificial Sequence
  Synthetic Polynucleotide
taatacgactcactatagggtccagaggcaggggccggccattcacaaagaacagaggagactttgtatgtggccggccaacctggcggcagcgcaaaagatg

SEQ ID NO: 179458 - DNA, 103 bp, Artificial Sequence
  Synthetic Polynucleotide
taatacgactcactatagggtgggtgcaaagcccttcagcacaaagctggaacagaggagaccagctatgtgctgaaggaacctggcggcagcgcaaaagatg

SEQ ID NO: 179459 - DNA, 103 bp, Artificial Sequence
  Synthetic Polynucleotide
taatacgactcactatagggagtcttgtcctgggtgcaaagcccttcagcaacagaggagagctgaaatgctttgcaccaacctggcggcagcgcaaaagatg

SEQ ID NO: 179460 - DNA, 103 bp, Artificial Sequence
  Synthetic Polynucleotide
taatacgactcactatagggagacactgggagtcttgtcctgggtgcaaaaacagaggagatttgcaatgaggacaagaaacctggcggcagcgcaaaagatg

SEQ ID NO: 179461 - DNA, 103 bp, Artificial Sequence
  Synthetic Polynucleotide
taatacgactcactatagggttgatggaggagacactgggagtcttgtccaacagaggagaggacaaatgtcccagtgtaacctggcggcagcgcaaaagatg

SEQ ID NO: 179462 - DNA, 103 bp, Artificial Sequence
  Synthetic Polynucleotide
taatacgactcactatagggcaggactcggttgatggaggagacactgggaacagaggagacccagtatgtcctccatcaacctggcggcagcgcaaaagatg

SEQ ID NO: 179463 - DNA, 103 bp, Artificial Sequence
  Synthetic Polynucleotide
taatacgactcactataggggtaatgcccgcaggactcggttgatggaggaacagaggagacctccaatgaccgagtccaacctggcggcagcgcaaaagatg

SEQ ID NO: 179464 - DNA, 103 bp, Artificial Sequence
  Synthetic Polynucleotide
taatacgactcactatagggtggtcctcctgtaatgcccgcaggactcggaacagaggagaccgagtatggcgggcattaacctggcggcagcgcaaaagatg

SEQ ID NO: 179465 - DNA, 103 bp, Artificial Sequence
  Synthetic Polynucleotide
taatacgactcactatagggcggtagtccctggtcctcctgtaatgcccgaacagaggagacgggcaatgcaggaggacaacctggcggcagcgcaaaagatg

SEQ ID NO: 179466 - DNA, 103 bp, Artificial Sequence
  Synthetic Polynucleotide
taatacgactcactataggggccgtgtgcacggtagtccctggtcctcctaacagaggagaaggaggatgagggactacaacctggcggcagcgcaaaagatg

SEQ ID NO: 179467 - DNA, 103 bp, Artificial Sequence
  Synthetic Polynucleotide
taatacgactcactatagggggtgacctgagccgtgtgcacggtagtcccaacagaggagagggactatggtgcacacgaacctggcggcagcgcaaaagatg

SEQ ID NO: 179468 - DNA, 103 bp, Artificial Sequence
  Synthetic Polynucleotide
taatacgactcactatagggctgccgggtatccagaggcaggggccggccaacagaggagaggccggatgctgcctctgaacctggcggcagcgcaaaagatg

SEQ ID NO: 179469 - DNA, 103 bp, Artificial Sequence
  Synthetic Polynucleotide
taatacgactcactatagggcaaaacagctggtgacctgagccgtgtgcaaacagaggagatgcacaatgctcaggtcaaacctggcggcagcgcaaaagatg

SEQ ID NO: 179470 - DNA, 103 bp, Artificial Sequence
  Synthetic Polynucleotide
taatacgactcactatagggcagctggagccaaaacagctggtgacctgaaacagaggagatcaggtatgcagctgtttaacctggcggcagcgcaaaagatg

SEQ ID NO: 179471 - DNA, 103 bp, Artificial Sequence
  Synthetic Polynucleotide
taatacgactcactatagggggagtgaggacagctggagccaaaacagctaacagaggagaagctgtatgggctccagcaacctggcggcagcgcaaaagatg

SEQ ID NO: 179472 - DNA, 103 bp, Artificial Sequence
  Synthetic Polynucleotide
taatacgactcactataggggccactatggggagtgaggacagctggagcaacagaggagagctccaatggtcctcactaacctggcggcagcgcaaaagatg

SEQ ID NO: 179473 - DNA, 103 bp, Artificial Sequence
  Synthetic Polynucleotide
taatacgactcactataggggagtctcagagccactatggggagtgaggaaacagaggagatcctcaatgcccatagtgaacctggcggcagcgcaaaagatg

SEQ ID NO: 179474 - DNA, 103 bp, Artificial Sequence
  Synthetic Polynucleotide
taatacgactcactataggggtaccccggggagtctcagagccactatggaacagaggagaccatagatgctctgagacaacctggcggcagcgcaaaagatg

SEQ ID NO: 179475 - DNA, 103 bp, Artificial Sequence
  Synthetic Polynucleotide
taatacgactcactatagggccctgggtgggtaccccggggagtctcagaaacagaggagatctgagatgccccggggtaacctggcggcagcgcaaaagatg

SEQ ID NO: 179476 - DNA, 103 bp, Artificial Sequence
  Synthetic Polynucleotide
taatacgactcactatagggggtggccggtccctgggtgggtaccccgggaacagaggagacccgggatgcccacccagaacctggcggcagcgcaaaagatg

SEQ ID NO: 179477 - DNA, 103 bp, Artificial Sequence
  Synthetic Polynucleotide
taatacgactcactataggggtccgattccggtggccggtccctgggtggaacagaggagaccacccatggaccggccaaacctggcggcagcgcaaaagatg

SEQ ID NO: 179478 - DNA, 103 bp, Artificial Sequence
  Synthetic Polynucleotide
taatacgactcactatagggggagaagatagtccgattccggtggccggtaacagaggagaaccggcatgcggaatcggaacctggcggcagcgcaaaagatg

SEQ ID NO: 179479 - DNA, 103 bp, Artificial Sequence
  Synthetic Polynucleotide
taatacgactcactataggggcacaatctgctgccgggtatccagaggcaaacagaggagatgcctcatgatacccggcaacctggcggcagcgcaaaagatg

SEQ ID NO: 179480 - DNA, 103 bp, Artificial Sequence
  Synthetic Polynucleotide
taatacgactcactatagggcttggcttggggagaagatagtccgattccaacagaggagaggaatcatgctatcttctaacctggcggcagcgcaaaagatg

SEQ ID NO: 179481 - DNA, 103 bp, Artificial Sequence
  Synthetic Polynucleotide
taatacgactcactatagggagtgcctctgcttggcttggggagaagataaacagaggagatatcttatgcccaagccaaacctggcggcagcgcaaaagatg

SEQ ID NO: 179482 - DNA, 103 bp, Artificial Sequence
  Synthetic Polynucleotide
taatacgactcactatagggctctttctccagtgcctctgcttggcttggaacagaggagaccaagcatggcagaggcaaacctggcggcagcgcaaaagatg

SEQ ID NO: 179483 - DNA, 103 bp, Artificial Sequence
  Synthetic Polynucleotide
taatacgactcactatagggcacgctggaactctttctccagtgcctctgaacagaggagacagaggatgtggagaaagaacctggcggcagcgcaaaagatg

SEQ ID NO: 179484 - DNA, 103 bp, Artificial Sequence
  Synthetic Polynucleotide
taatacgactcactatagggggatactgcccacgctggaactctttctccaacagaggagaggagaaatggttccagcgaacctggcggcagcgcaaaagatg

SEQ ID NO: 179485 - DNA, 103 bp, Artificial Sequence
  Synthetic Polynucleotide
taatacgactcactatagggcactgaatcaggatactgcccacgctggaaaacagaggagattccagatggggcagtataacctggcggcagcgcaaaagatg

SEQ ID NO: 179486 - DNA, 103 bp, Artificial Sequence
  Synthetic Polynucleotide
taatacgactcactatagggttccacgggccactgaatcaggatactgccaacagaggagaggcagtatgctgattcagaacctggcggcagcgcaaaagatg

SEQ ID NO: 179487 - DNA, 103 bp, Artificial Sequence
  Synthetic Polynucleotide
taatacgactcactataggggtagccagctttccacgggccactgaatcaaacagaggagatgattcatgggcccgtggaacctggcggcagcgcaaaagatg

SEQ ID NO: 179488 - DNA, 103 bp, Artificial Sequence
  Synthetic Polynucleotide
taatacgactcactatagggagaggtggcagtagccagctttccacgggcaacagaggagagcccgtatgaagctggctaacctggcggcagcgcaaaagatg

SEQ ID NO: 179489 - DNA, 103 bp, Artificial Sequence
  Synthetic Polynucleotide
taatacgactcactatagggcctcaggcagagaggtggcagtagccagctaacagaggagaagctggatgctgccacctaacctggcggcagcgcaaaagatg

SEQ ID NO: 179490 - DNA, 103 bp, Artificial Sequence
  Synthetic Polynucleotide
taatacgactcactatagggactgctagccgcacaatctgctgccgggtaaacagaggagatacccgatggcagattgtaacctggcggcagcgcaaaagatg

SEQ ID NO: 179491 - DNA, 103 bp, Artificial Sequence
  Synthetic Polynucleotide
taatacgactcactatagggctcaccgtgtcctcaggcagagaggtggcaaacagaggagatgccacatgtctgcctgaaacctggcggcagcgcaaaagatg

SEQ ID NO: 179492 - DNA, 103 bp, Artificial Sequence
  Synthetic Polynucleotide
taatacgactcactatagggaaaccagaccctcaccgtgtcctcaggcagaacagaggagactgcctatggacacggtgaacctggcggcagcgcaaaagatg

SEQ ID NO: 179493 - DNA, 103 bp, Artificial Sequence
  Synthetic Polynucleotide
taatacgactcactatagggttctgttggaaaaccagaccctcaccgtgtaacagaggagaacacggatggggtctggtaacctggcggcagcgcaaaagatg

SEQ ID NO: 179494 - DNA, 103 bp, Artificial Sequence
  Synthetic Polynucleotide
taatacgactcactatagggcatttggctcttctgttggaaaaccagaccaacagaggagaggtctgatgttccaacagaacctggcggcagcgcaaaagatg

SEQ ID NO: 179495 - DNA, 103 bp, Artificial Sequence
  Synthetic Polynucleotide
taatacgactcactatagggttgccgacgccatttggctcttctgttggaaacagaggagatccaacatgagagccaaaaacctggcggcagcgcaaaagatg

SEQ ID NO: 179496 - DNA, 103 bp, Artificial Sequence
  Synthetic Polynucleotide
taatacgactcactatagggtgagcttctcttgccgacgccatttggctcaacagaggagagagccaatgggcgtcggcaacctggcggcagcgcaaaagatg

SEQ ID NO: 179497 - DNA, 103 bp, Artificial Sequence
  Synthetic Polynucleotide
taatacgactcactatagggatttcccacttgagcttctcttgccgacgcaacagaggagagcgtcgatgagagaagctaacctggcggcagcgcaaaagatg

SEQ ID NO: 179498 - DNA, 103 bp, Artificial Sequence
  Synthetic Polynucleotide
taatacgactcactatagggtggcagctgcatttcccacttgagcttctcaacagaggagagagaagatgaagtgggaaaacctggcggcagcgcaaaagatg

SEQ ID NO: 179499 - DNA, 103 bp, Artificial Sequence
  Synthetic Polynucleotide
taatacgactcactataggggggaagcacctggcagctgcatttcccactaacagaggagaagtgggatgtgcagctgcaacctggcggcagcgcaaaagatg

SEQ ID NO: 179500 - DNA, 103 bp, Artificial Sequence
  Synthetic Polynucleotide
taatacgactcactataggggtcagcccctgggaagcacctggcagctgcaacagaggagagcagctatgaggtgcttcaacctggcggcagcgcaaaagatg

SEQ ID NO: 179501 - DNA, 103 bp, Artificial Sequence
  Synthetic Polynucleotide
taatacgactcactatagggcattccactgactgctagccgcacaatctgaacagaggagacagattatgcggctagcaaacctggcggcagcgcaaaagatg

SEQ ID NO: 179502 - DNA, 103 bp, Artificial Sequence
  Synthetic Polynucleotide
taatacgactcactatagggccttggtacagtcagcccctgggaagcaccaacagaggagaggtgctatgcaggggctgaacctggcggcagcgcaaaagatg

SEQ ID NO: 179503 - DNA, 103 bp, Artificial Sequence
  Synthetic Polynucleotide
taatacgactcactatagggctggggcaacccttggtacagtcagcccctaacagaggagaaggggcatgctgtaccaaaacctggcggcagcgcaaaagatg

SEQ ID NO: 179504 - DNA, 103 bp, Artificial Sequence
  Synthetic Polynucleotide
taatacgactcactataggggagatgattcctggggcaacccttggtacaaacagaggagatgtaccatgggttgccccaacctggcggcagcgcaaaagatg

SEQ ID NO: 179505 - DNA, 103 bp, Artificial Sequence
  Synthetic Polynucleotide
taatacgactcactatagggctgctgtgcagagatgattcctggggcaacaacagaggagagttgccatgggaatcatcaacctggcggcagcgcaaaagatg

SEQ ID NO: 179506 - DNA, 103 bp, Artificial Sequence
  Synthetic Polynucleotide
taatacgactcactatagggtgccaggggactgctgtgcagagatgattcaacagaggagagaatcaatgctgcacagcaacctggcggcagcgcaaaagatg

SEQ ID NO: 179507 - DNA, 103 bp, Artificial Sequence
  Synthetic Polynucleotide
taatacgactcactataggggtgggcacactgccaggggactgctgtgcaaacagaggagatgcacaatggtcccctggaacctggcggcagcgcaaaagatg

SEQ ID NO: 179508 - DNA, 103 bp, Artificial Sequence
  Synthetic Polynucleotide
taatacgactcactatagggcagggctgctgtgggcacactgccaggggaaacagaggagatcccctatgagtgtgcccaacctggcggcagcgcaaaagatg

SEQ ID NO: 179509 - DNA, 103 bp, Artificial Sequence
  Synthetic Polynucleotide
taatacgactcactatagggccagggcaggcagggctgctgtgggcacacaacagaggagagtgtgcatgcagcagcccaacctggcggcagcgcaaaagatg

SEQ ID NO: 179510 - DNA, 103 bp, Artificial Sequence
  Synthetic Polynucleotide
taatacgactcactatagggcccagtggttccagggcaggcagggctgctaacagaggagaagcagcatggcctgccctaacctggcggcagcgcaaaagatg

SEQ ID NO: 179511 - DNA, 103 bp, Artificial Sequence
  Synthetic Polynucleotide
taatacgactcactataggggcaggagggacccagtggttccagggcaggaacagaggagacctgccatggaaccactgaacctggcggcagcgcaaaagatg

SEQ ID NO: 179512 - DNA, 103 bp, Artificial Sequence
  Synthetic Polynucleotide
taatacgactcactatagggcacagggccgcattccactgactgctagccaacagaggagaggctagatgtcagtggaaaacctggcggcagcgcaaaagatg

SEQ ID NO: 179513 - DNA, 103 bp, Artificial Sequence
  Synthetic Polynucleotide
taatacgactcactatagggacagctgatagcaggagggacccagtggttaacagaggagaaaccacatggtccctcctaacctggcggcagcgcaaaagatg

SEQ ID NO: 179514 - DNA, 103 bp, Artificial Sequence
  Synthetic Polynucleotide
taatacgactcactataggggttgcccagcacagctgatagcaggagggaaacagaggagatccctcatgctatcagctaacctggcggcagcgcaaaagatg

SEQ ID NO: 179515 - DNA, 103 bp, Artificial Sequence
  Synthetic Polynucleotide
taatacgactcactatagggttctggtgctgttgcccagcacagctgataaacagaggagatatcagatgtgctgggcaaacctggcggcagcgcaaaagatg

SEQ ID NO: 179516 - DNA, 103 bp, Artificial Sequence
  Synthetic Polynucleotide
taatacgactcactatagggtcagacacctttctggtgctgttgcccagcaacagaggagagctgggatgcagcaccagaacctggcggcagcgcaaaagatg

SEQ ID NO: 179517 - DNA, 103 bp, Artificial Sequence
  Synthetic Polynucleotide
taatacgactcactatagggggggtgtcactcagacacctttctggtgctaacagaggagaagcaccatgaaggtgtctaacctggcggcagcgcaaaagatg

SEQ ID NO: 179518 - DNA, 103 bp, Artificial Sequence
  Synthetic Polynucleotide
taatacgactcactatagggggctttaggtggggtgtcactcagacacctaacagaggagaaggtgtatgagtgacaccaacctggcggcagcgcaaaagatg

SEQ ID NO: 179519 - DNA, 103 bp, Artificial Sequence
  Synthetic Polynucleotide
taatacgactcactataggggcttgagacaggctttaggtggggtgtcacaacagaggagagtgacaatgcacctaaagaacctggcggcagcgcaaaagatg

SEQ ID NO: 179520 - DNA, 103 bp, Artificial Sequence
  Synthetic Polynucleotide
taatacgactcactatagggccccagcagggcttgagacaggctttaggtaacagaggagaacctaaatgctgtctcaaaacctggcggcagcgcaaaagatg

SEQ ID NO: 179521 - DNA, 103 bp, Artificial Sequence
  Synthetic Polynucleotide
taatacgactcactataggggggcaagtggccccagcagggcttgagacaaacagaggagatgtctcatgccctgctggaacctggcggcagcgcaaaagatg

SEQ ID NO: 179522 - DNA, 103 bp, Artificial Sequence
  Synthetic Polynucleotide
taatacgactcactatagggtcggctgtgggggcaagtggccccagcaggaacagaggagacctgctatggccacttgcaacctggcggcagcgcaaaagatg

SEQ ID NO: 179523 - DNA, 103 bp, Artificial Sequence
  Synthetic Polynucleotide
taatacgactcactatagggcgtgagatgtcacagggccgcattccactgaacagaggagacagtggatggcggccctgaacctggcggcagcgcaaaagatg

SEQ ID NO: 179524 - DNA, 103 bp, Artificial Sequence
  Synthetic Polynucleotide
taatacgactcactatagggtccagggaattcggctgtgggggcaagtggaacagaggagaccacttatgcccacagccaacctggcggcagcgcaaaagatg

SEQ ID NO: 179525 - DNA, 103 bp, Artificial Sequence
  Synthetic Polynucleotide
taatacgactcactatagggcagtcctgagtccagggaattcggctgtggaacagaggagaccacagatgaattccctgaacctggcggcagcgcaaaagatg

SEQ ID NO: 179526 - DNA, 103 bp, Artificial Sequence
  Synthetic Polynucleotide
taatacgactcactataggggaaggcaaagcagtcctgagtccagggaataacagaggagaattcccatgactcaggacaacctggcggcagcgcaaaagatg

SEQ ID NO: 179527 - DNA, 103 bp, Artificial Sequence
  Synthetic Polynucleotide
taatacgactcactataggggaagggcaaggaaggcaaagcagtcctgagaacagaggagactcaggatggctttgcctaacctggcggcagcgcaaaagatg

SEQ ID NO: 179528 - DNA, 103 bp, Artificial Sequence
  Synthetic Polynucleotide
taatacgactcactatagggacagtgggaggaagggcaaggaaggcaaagaacagaggagactttgcatgccttgccctaacctggcggcagcgcaaaagatg

SEQ ID NO: 179529 - DNA, 103 bp, Artificial Sequence
  Synthetic Polynucleotide
taatacgactcactatagggtggccaggtgacagtgggaggaagggcaagaacagaggagacttgccatgcctcccactaacctggcggcagcgcaaaagatg

SEQ ID NO: 179530 - DNA, 103 bp, Artificial Sequence
  Synthetic Polynucleotide
taatacgactcactatagggccactaagactggccaggtgacagtgggagaacagaggagactcccaatgtcacctggcaacctggcggcagcgcaaaagatg

SEQ ID NO: 179531 - DNA, 103 bp, Artificial Sequence
  Synthetic Polynucleotide
taatacgactcactatagggggcctgagagccactaagactggccaggtgaacagaggagacacctgatgagtcttagtaacctggcggcagcgcaaaagatg

SEQ ID NO: 179532 - DNA, 103 bp, Artificial Sequence
  Synthetic Polynucleotide
taatacgactcactataggggccagagcagggcctgagagccactaagacaacagaggagagtcttaatggctctcaggaacctggcggcagcgcaaaagatg

SEQ ID NO: 179533 - DNA, 103 bp, Artificial Sequence
  Synthetic Polynucleotide
taatacgactcactataggggggcagccaggccagagcagggcctgagagaacagaggagactctcaatgcctgctctgaacctggcggcagcgcaaaagatg

SEQ ID NO: 179534 - DNA, 103 bp, Artificial Sequence
  Synthetic Polynucleotide
taatacgactcactatagggaggagtcggataatttttctctaaatccataacagaggagaatggatatggagaaaaataacctggcggcagcgcaaaagatg

SEQ ID NO: 179535 - DNA, 103 bp, Artificial Sequence
  Synthetic Polynucleotide
taatacgactcactatagggcctctggcggactacatccgggagtggccgaacagaggagacggccaatgccggatgtaaacctggcggcagcgcaaaagatg

SEQ ID NO: 179536 - DNA, 103 bp, Artificial Sequence
  Synthetic Polynucleotide
taatacgactcactatagggctcactcccaggcaccatccctgtcagcgtaacagaggagaacgctgatggggatggtgaacctggcggcagcgcaaaagatg

SEQ ID NO: 179537 - DNA, 103 bp, Artificial Sequence
  Synthetic Polynucleotide
taatacgactcactatagggtcccggaaaactcactcccaggcaccatccaacagaggagaggatggatgctgggagtgaacctggcggcagcgcaaaagatg

SEQ ID NO: 179538 - DNA, 103 bp, Artificial Sequence
  Synthetic Polynucleotide
taatacgactcactatagggctgtagggactcccggaaaactcactcccaaacagaggagatgggagatggttttccggaacctggcggcagcgcaaaagatg

SEQ ID NO: 179539 - DNA, 103 bp, Artificial Sequence
  Synthetic Polynucleotide
taatacgactcactatagggctgagggtggctgtagggactcccggaaaaaacagaggagattttccatgagtccctacaacctggcggcagcgcaaaagatg

SEQ ID NO: 179540 - DNA, 103 bp, Artificial Sequence
  Synthetic Polynucleotide
taatacgactcactatagggacgaggaatactgagggtggctgtagggacaacagaggagagtccctatggccaccctcaacctggcggcagcgcaaaagatg

SEQ ID NO: 179541 - DNA, 103 bp, Artificial Sequence
  Synthetic Polynucleotide
taatacgactcactataggggagtcgttgtacgaggaatactgagggtggaacagaggagaccacccatggtattcctcaacctggcggcagcgcaaaagatg

SEQ ID NO: 179542 - DNA, 103 bp, Artificial Sequence
  Synthetic Polynucleotide
taatacgactcactataggggaacctccaggagtcgttgtacgaggaataaacagaggagatattccatgtacaacgacaacctggcggcagcgcaaaagatg

SEQ ID NO: 179543 - DNA, 103 bp, Artificial Sequence
  Synthetic Polynucleotide
taatacgactcactatagggccgggttggggaacctccaggagtcgttgtaacagaggagaacaacgatgcctggaggtaacctggcggcagcgcaaaagatg

SEQ ID NO: 179544 - DNA, 103 bp, Artificial Sequence
  Synthetic Polynucleotide
taatacgactcactatagggccaagcagccccgggttggggaacctccagaacagaggagactggagatgccccaacccaacctggcggcagcgcaaaagatg

SEQ ID NO: 179545 - DNA, 103 bp, Artificial Sequence
  Synthetic Polynucleotide
taatacgactcactataggggtagggggagccaagcagccccgggttgggaacagaggagacccaacatggggctgcttaacctggcggcagcgcaaaagatg

SEQ ID NO: 179546 - DNA, 103 bp, Artificial Sequence
  Synthetic Polynucleotide
taatacgactcactataggggttccactatcctctggcggactacatccgaacagaggagacggatgatgtccgccagaaacctggcggcagcgcaaaagatg

SEQ ID NO: 179547 - DNA, 103 bp, Artificial Sequence
  Synthetic Polynucleotide
taatacgactcactatagggcgctataatagtagggggagccaagcagccaacagaggagaggctgcatggctccccctaacctggcggcagcgcaaaagatg

SEQ ID NO: 179548 - DNA, 103 bp, Artificial Sequence
  Synthetic Polynucleotide
taatacgactcactatagggcgggcggcagcgctataatagtagggggagaacagaggagactccccatgctattatagaacctggcggcagcgcaaaagatg

SEQ ID NO: 179549 - DNA, 103 bp, Artificial Sequence
  Synthetic Polynucleotide
taatacgactcactatagggggcggctcctcgggcggcagcgctataataaacagaggagatattatatggctgccgccaacctggcggcagcgcaaaagatg

SEQ ID NO: 179550 - DNA, 103 bp, Artificial Sequence
  Synthetic Polynucleotide
taatacgactcactatagggctgcaggtggggcggctcctcgggcggcagaacagaggagactgccgatggaggagccgaacctggcggcagcgcaaaagatg

SEQ ID NO: 179551 - DNA, 103 bp, Artificial Sequence
  Synthetic Polynucleotide
taatacgactcactataggggcagtggcggctgcaggtggggcggctcctaacagaggagaaggagcatgcccacctgcaacctggcggcagcgcaaaagatg

SEQ ID NO: 179552 - DNA, 103 bp, Artificial Sequence
  Synthetic Polynucleotide
taatacgactcactatagggacggtcataggcagtggcggctgcaggtggaacagaggagaccacctatggccgccactaacctggcggcagcgcaaaagatg

SEQ ID NO: 179553 - DNA, 103 bp, Artificial Sequence
  Synthetic Polynucleotide
taatacgactcactatagggtgatgagcaagttccactatcctctggcggaacagaggagaccgccaatggatagtggaaacctggcggcagcgcaaaagatg

SEQ ID NO: 179554 - DNA, 103 bp, Artificial Sequence
  Synthetic Polynucleotide
taatacgactcactatagggcctgacaccttgatgagcaagttccactataacagaggagaatagtgatgcttgctcataacctggcggcagcgcaaaagatg

SEQ ID NO: 179555 - DNA, 103 bp, Artificial Sequence
  Synthetic Polynucleotide
taatacgactcactatagggtgtcgcagggcctgacaccttgatgagcaaaacagaggagattgctcatgaaggtgtcaaacctggcggcagcgcaaaagatg

SEQ ID NO: 179556 - DNA, 103 bp, Artificial Sequence
  Synthetic Polynucleotide
taatacgactcactatagggtgcctggagatgtcgcagggcctgacacctaacagaggagaaggtgtatggccctgcgaaacctggcggcagcgcaaaagatg

SEQ ID NO: 179557 - DNA, 103 bp, Artificial Sequence
  Synthetic Polynucleotide
taatacgactcactataggggacccgaagctgcctggagatgtcgcagggaacagaggagaccctgcatgatctccaggaacctggcggcagcgcaaaagatg

SEQ ID NO: 179558 - DNA, 103 bp, Artificial Sequence
  Synthetic Polynucleotide
taatacgactcactatagggaaccatggctgacccgaagctgcctggagaaacagaggagatctccaatgagcttcgggaacctggcggcagcgcaaaagatg

SEQ ID NO: 179559 - DNA, 103 bp, Artificial Sequence
  Synthetic Polynucleotide
taatacgactcactatagggttgctgacacaaccatggctgacccgaagcaacagaggagagcttcgatgcagccatggaacctggcggcagcgcaaaagatg

SEQ ID NO: 179560 - DNA, 103 bp, Artificial Sequence
  Synthetic Polynucleotide
taatacgactcactataggggccaagaattttgctgacacaaccatggctaacagaggagaagccatatgtgtgtcagcaacctggcggcagcgcaaaagatg

SEQ ID NO: 179561 - DNA, 103 bp, Artificial Sequence
  Synthetic Polynucleotide
taatacgactcactatagggtgctggtccgaggagtcggataatttttctaacagaggagaagaaaaatgatccgactcaacctggcggcagcgcaaaagatg

SEQ ID NO: 179562 - DNA, 103 bp, Artificial Sequence
  Synthetic Polynucleotide
taatacgactcactatagggcataatacctgccaagaattttgctgacacaacagaggagagtgtcaatgaaattcttgaacctggcggcagcgcaaaagatg

SEQ ID NO: 179563 - DNA, 103 bp, Artificial Sequence
  Synthetic Polynucleotide
taatacgactcactatagggcttcctgtctcataatacctgccaagaattaacagaggagaaattctatgcaggtattaaacctggcggcagcgcaaaagatg

SEQ ID NO: 179564 - DNA, 103 bp, Artificial Sequence
  Synthetic Polynucleotide
taatacgactcactatagggaggcttgatgcttcctgtctcataatacctaacagaggagaaggtatatggagacaggaaacctggcggcagcgcaaaagatg

SEQ ID NO: 179565 - DNA, 103 bp, Artificial Sequence
  Synthetic Polynucleotide
taatacgactcactatagggcaattaccccaggcttgatgcttcctgtctaacagaggagaagacagatggcatcaagcaacctggcggcagcgcaaaagatg

SEQ ID NO: 179566 - DNA, 103 bp, Artificial Sequence
  Synthetic Polynucleotide
taatacgactcactatagggttggatcctccaattaccccaggcttgatgaacagaggagacatcaaatgtggggtaataacctggcggcagcgcaaaagatg

SEQ ID NO: 179567 - DNA, 103 bp, Artificial Sequence
  Synthetic Polynucleotide
taatacgactcactataggggacctttggtttggatcctccaattaccccaacagaggagaggggtaatgggaggatccaacctggcggcagcgcaaaagatg

SEQ ID NO: 179568 - DNA, 103 bp, Artificial Sequence
  Synthetic Polynucleotide
taatacgactcactatagggtgggtgtggcgacctttggtttggatcctcaacagaggagagaggatatgaaccaaaggaacctggcggcagcgcaaaagatg

SEQ ID NO: 179569 - DNA, 103 bp, Artificial Sequence
  Synthetic Polynucleotide
taatacgactcactatagggtccaccactttgggtgtggcgacctttggtaacagaggagaaccaaaatgcgccacaccaacctggcggcagcgcaaaagatg

SEQ ID NO: 179570 - DNA, 103 bp, Artificial Sequence
  Synthetic Polynucleotide
taatacgactcactatagggagcgattttttccaccactttgggtgtggcaacagaggagagccacaatgaaagtggtgaacctggcggcagcgcaaaagatg

SEQ ID NO: 179571 - DNA, 103 bp, Artificial Sequence
  Synthetic Polynucleotide
taatacgactcactataggggtttatattcagcgattttttccaccacttaacagaggagaaagtggatgaaaaaatcgaacctggcggcagcgcaaaagatg

SEQ ID NO: 179572 - DNA, 103 bp, Artificial Sequence
  Synthetic Polynucleotide
taatacgactcactatagggtgtcctgtcctgctggtccgaggagtcggaaacagaggagatccgacatgtcggaccagaacctggcggcagcgcaaaagatg

SEQ ID NO: 179573 - DNA, 103 bp, Artificial Sequence
  Synthetic Polynucleotide
taatacgactcactatagggggattttggcgtttatattcagcgatttttaacagaggagaaaaaatatgtgaatataaaacctggcggcagcgcaaaagatg

SEQ ID NO: 179574 - DNA, 103 bp, Artificial Sequence
  Synthetic Polynucleotide
taatacgactcactatagggaaacatggtgggattttggcgtttatattcaacagaggagagaatatatgcgccaaaataacctggcggcagcgcaaaagatg

SEQ ID NO: 179575 - DNA, 103 bp, Artificial Sequence
  Synthetic Polynucleotide
taatacgactcactatagggtctcccaggcaaacatggtgggattttggcaacagaggagagccaaaatgccaccatgtaacctggcggcagcgcaaaagatg

SEQ ID NO: 179576 - DNA, 103 bp, Artificial Sequence
  Synthetic Polynucleotide
taatacgactcactatagggcggtccctgatctcccaggcaaacatggtgaacagaggagacaccatatgtgcctgggaaacctggcggcagcgcaaaagatg

SEQ ID NO: 179577 - DNA, 103 bp, Artificial Sequence
  Synthetic Polynucleotide
taatacgactcactatagggtgccagcagccggtccctgatctcccaggcaacagaggagagcctggatgatcagggacaacctggcggcagcgcaaaagatg

SEQ ID NO: 179578 - DNA, 103 bp, Artificial Sequence
  Synthetic Polynucleotide
taatacgactcactatagggacacccgctctgccagcagccggtccctgaaacagaggagatcagggatgggctgctggaacctggcggcagcgcaaaagatg

SEQ ID NO: 179579 - DNA, 103 bp, Artificial Sequence
  Synthetic Polynucleotide
taatacgactcactatagggtcattgtcacacacccgctctgccagcagcaacagaggagagctgctatgagagcgggtaacctggcggcagcgcaaaagatg

SEQ ID NO: 179580 - DNA, 103 bp, Artificial Sequence
  Synthetic Polynucleotide
taatacgactcactatagggaggcacggtgtcattgtcacacacccgctcaacagaggagagagcggatgtgtgacaataacctggcggcagcgcaaaagatg

SEQ ID NO: 179581 - DNA, 103 bp, Artificial Sequence
  Synthetic Polynucleotide
taatacgactcactatagggaactgacgctaggcacggtgtcattgtcacaacagaggagagtgacaatgacaccgtgcaacctggcggcagcgcaaaagatg

SEQ ID NO: 179582 - DNA, 103 bp, Artificial Sequence
  Synthetic Polynucleotide
taatacgactcactatagggctgttgatggaactgacgctaggcacggtgaacagaggagacaccgtatgtagcgtcagaacctggcggcagcgcaaaagatg

SEQ ID NO: 179583 - DNA, 103 bp, Artificial Sequence
  Synthetic Polynucleotide
taatacgactcactatagggcactcctccatgtcctgtcctgctggtccgaacagaggagacggaccatgaggacaggaaacctggcggcagcgcaaaagatg

SEQ ID NO: 179584 - DNA, 103 bp, Artificial Sequence
  Synthetic Polynucleotide
taatacgactcactatagggccggatgatcctgttgatggaactgacgctaacagaggagaagcgtcatgtccatcaacaacctggcggcagcgcaaaagatg

SEQ ID NO: 179585 - DNA, 103 bp, Artificial Sequence
  Synthetic Polynucleotide
taatacgactcactataggggtacttttgtccggatgatcctgttgatggaacagaggagaccatcaatgggatcatccaacctggcggcagcgcaaaagatg

SEQ ID NO: 179586 - DNA, 103 bp, Artificial Sequence
  Synthetic Polynucleotide
taatacgactcactatagggggtggctgctgtacttttgtccggatgatcaacagaggagagatcatatggacaaaagtaacctggcggcagcgcaaaagatg

SEQ ID NO: 179587 - DNA, 103 bp, Artificial Sequence
  Synthetic Polynucleotide
taatacgactcactatagggtggttggttgggtggctgctgtacttttgtaacagaggagaacaaaaatgcagcagccaaacctggcggcagcgcaaaagatg

SEQ ID NO: 179588 - DNA, 103 bp, Artificial Sequence
  Synthetic Polynucleotide
taatacgactcactatagggaagctgggactggttggttgggtggctgctaacagaggagaagcagcatgccaaccaacaacctggcggcagcgcaaaagatg

SEQ ID NO: 179589 - DNA, 103 bp, Artificial Sequence
  Synthetic Polynucleotide
taatacgactcactatagggctgtgactggaagctgggactggttggttgaacagaggagacaaccaatgagtcccagcaacctggcggcagcgcaaaagatg

SEQ ID NO: 179590 - DNA, 103 bp, Artificial Sequence
  Synthetic Polynucleotide
taatacgactcactatagggggacactatgctgtgactggaagctgggacaacagaggagagtcccaatgtccagtcacaacctggcggcagcgcaaaagatg

SEQ ID NO: 179591 - DNA, 103 bp, Artificial Sequence
  Synthetic Polynucleotide
taatacgactcactatagggcggagccagtggacactatgctgtgactggaacagaggagaccagtcatggcatagtgtaacctggcggcagcgcaaaagatg

SEQ ID NO: 179592 - DNA, 103 bp, Artificial Sequence
  Synthetic Polynucleotide
taatacgactcactatagggacctgcgtcacggagccagtggacactatgaacagaggagacatagtatgcactggctcaacctggcggcagcgcaaaagatg

SEQ ID NO: 179593 - DNA, 103 bp, Artificial Sequence
  Synthetic Polynucleotide
taatacgactcactatagggcaccgaggacacctgcgtcacggagccagtaacagaggagaactggcatggtgacgcagaacctggcggcagcgcaaaagatg

SEQ ID NO: 179594 - DNA, 103 bp, Artificial Sequence
  Synthetic Polynucleotide
taatacgactcactatagggcaagctgattcactcctccatgtcctgtccaacagaggagaggacagatgatggaggagaacctggcggcagcgcaaaagatg

SEQ ID NO: 179595 - DNA, 103 bp, Artificial Sequence
  Synthetic Polynucleotide
taatacgactcactatagggaatccgtgctcaccgaggacacctgcgtcaaacagaggagatgacgcatgtgtcctcggaacctggcggcagcgcaaaagatg

SEQ ID NO: 179596 - DNA, 103 bp, Artificial Sequence
  Synthetic Polynucleotide
taatacgactcactataggggagccggccgaatccgtgctcaccgaggacaacagaggagagtcctcatggagcacggaaacctggcggcagcgcaaaagatg

SEQ ID NO: 179597 - DNA, 103 bp, Artificial Sequence
  Synthetic Polynucleotide
taatacgactcactatagggggagtacgacgagccggccgaatccgtgctaacagaggagaagcacgatgtcggccggcaacctggcggcagcgcaaaagatg

SEQ ID NO: 179598 - DNA, 103 bp, Artificial Sequence
  Synthetic Polynucleotide
taatacgactcactatagggtgccgctgatggagtacgacgagccggccgaacagaggagacggccgatgcgtcgtactaacctggcggcagcgcaaaagatg

SEQ ID NO: 179599 - DNA, 103 bp, Artificial Sequence
  Synthetic Polynucleotide
taatacgactcactatagggatgcccaggatgccgctgatggagtacgacaacagaggagagtcgtaatgcatcagcggaacctggcggcagcgcaaaagatg

SEQ ID NO: 179600 - DNA, 103 bp, Artificial Sequence
  Synthetic Polynucleotide
taatacgactcactataggggggggacgtgatgcccaggatgccgctgataacagaggagaatcagcatgatcctgggcaacctggcggcagcgcaaaagatg

SEQ ID NO: 179601 - DNA, 103 bp, Artificial Sequence
  Synthetic Polynucleotide
taatacgactcactatagggtgtcggcgctgggggacgtgatgcccaggaaacagaggagatcctggatgtcacgtcccaacctggcggcagcgcaaaagatg

SEQ ID NO: 179602 - DNA, 103 bp, Artificial Sequence
  Synthetic Polynucleotide
taatacgactcactatagggcgcttgttggtgtcggcgctgggggacgtgaacagaggagacacgtcatgcagcgccgaaacctggcggcagcgcaaaagatg

SEQ ID NO: 179603 - DNA, 103 bp, Artificial Sequence
  Synthetic Polynucleotide
taatacgactcactataggggtctctcttgcgcttgttggtgtcggcgctaacagaggagaagcgccatgaccaacaagaacctggcggcagcgcaaaagatg

SEQ ID NO: 179604 - DNA, 103 bp, Artificial Sequence
  Synthetic Polynucleotide
taatacgactcactataggggaataccttcgtctctcttgcgcttgttggaacagaggagaccaacaatggcaagagagaacctggcggcagcgcaaaagatg

SEQ ID NO: 179605 - DNA, 103 bp, Artificial Sequence
  Synthetic Polynucleotide
taatacgactcactatagggaaaacccccccaagctgattcactcctccaaacagaggagatggaggatggaatcagctaacctggcggcagcgcaaaagatg

SEQ ID NO: 179606 - DNA, 103 bp, Artificial Sequence
  Synthetic Polynucleotide
taatacgactcactatagggggagactcctgaataccttcgtctctcttgaacagaggagacaagagatgcgaaggtataacctggcggcagcgcaaaagatg

SEQ ID NO: 179607 - DNA, 103 bp, Artificial Sequence
  Synthetic Polynucleotide
taatacgactcactataggggttcggcaccggagactcctgaataccttcaacagaggagagaaggtatgcaggagtctaacctggcggcagcgcaaaagatg

SEQ ID NO: 179608 - DNA, 103 bp, Artificial Sequence
  Synthetic Polynucleotide
taatacgactcactataggggcgagtggccgttcggcaccggagactcctaacagaggagaaggagtatgcggtgccgaaacctggcggcagcgcaaaagatg

SEQ ID NO: 179609 - DNA, 103 bp, Artificial Sequence
  Synthetic Polynucleotide
taatacgactcactatagggctgcccggaagcgagtggccgttcggcaccaacagaggagaggtgccatgcggccactcaacctggcggcagcgcaaaagatg

SEQ ID NO: 179610 - DNA, 103 bp, Artificial Sequence
  Synthetic Polynucleotide
taatacgactcactataggggaggaagtctctgcccggaagcgagtggccaacagaggagaggccacatgcttccgggcaacctggcggcagcgcaaaagatg

SEQ ID NO: 179611 - DNA, 103 bp, Artificial Sequence
  Synthetic Polynucleotide
taatacgactcactatagggtctgcttccggaggaagtctctgcccggaaaacagaggagattccggatggagacttccaacctggcggcagcgcaaaagatg

SEQ ID NO: 179612 - DNA, 103 bp, Artificial Sequence
  Synthetic Polynucleotide
taatacgactcactatagggtctccccgcatctgcttccggaggaagtctaacagaggagaagacttatgccggaagcaaacctggcggcagcgcaaaagatg

SEQ ID NO: 179613 - DNA, 103 bp, Artificial Sequence
  Synthetic Polynucleotide
taatacgactcactatagggtgtgaacaagtctccccgcatctgcttccgaacagaggagacggaagatgatgcggggaaacctggcggcagcgcaaaagatg

SEQ ID NO: 179614 - DNA, 103 bp, Artificial Sequence
  Synthetic Polynucleotide
taatacgactcactataggggctgctgctgtgtgaacaagtctccccgcaaacagaggagatgcgggatgacttgttcaaacctggcggcagcgcaaaagatg

SEQ ID NO: 179615 - DNA, 103 bp, Artificial Sequence
  Synthetic Polynucleotide
taatacgactcactatagggagcacctccagctgctgctgtgtgaacaagaacagaggagacttgttatgacagcagcaaacctggcggcagcgcaaaagatg

SEQ ID NO: 179616 - DNA, 103 bp, Artificial Sequence
  Synthetic Polynucleotide
taatacgactcactatagggtccattcacaaaaacccccccaagctgattaacagaggagaaatcagatggggggggttaacctggcggcagcgcaaaagatg

SEQ ID NO: 179617 - DNA, 103 bp, Artificial Sequence
  Synthetic Polynucleotide
taatacgactcactatagggcacgcggtccagcacctccagctgctgctgaacagaggagacagcagatgctggaggtgaacctggcggcagcgcaaaagatg

SEQ ID NO: 179618 - DNA, 103 bp, Artificial Sequence
  Synthetic Polynucleotide
taatacgactcactataggggcctctcaaacacgcggtccagcacctccaaacagaggagatggaggatgtggaccgcgaacctggcggcagcgcaaaagatg

SEQ ID NO: 179619 - DNA, 103 bp, Artificial Sequence
  Synthetic Polynucleotide
taatacgactcactataggggagtagtgctgcctctcaaacacgcggtccaacagaggagaggaccgatggtttgagagaacctggcggcagcgcaaaagatg

SEQ ID NO: 179620 - DNA, 103 bp, Artificial Sequence
  Synthetic Polynucleotide
taatacgactcactataggggaagatgtctgagtagtgctgcctctcaaaaacagaggagatttgagatgcagcactacaacctggcggcagcgcaaaagatg

SEQ ID NO: 179621 - DNA, 103 bp, Artificial Sequence
  Synthetic Polynucleotide
taatacgactcactatagggctgtggtggtgaagatgtctgagtagtgctaacagaggagaagcactatgcagacatctaacctggcggcagcgcaaaagatg

SEQ ID NO: 179622 - DNA, 103 bp, Artificial Sequence
  Synthetic Polynucleotide
taatacgactcactatagggttgatgggctctgtggtggtgaagatgtctaacagaggagaagacatatgcaccaccacaacctggcggcagcgcaaaagatg

SEQ ID NO: 179623 - DNA, 103 bp, Artificial Sequence
  Synthetic Polynucleotide
taatacgactcactatagggctgctcgggcttgatgggctctgtggtggtaacagaggagaaccaccatggagcccatcaacctggcggcagcgcaaaagatg

SEQ ID NO: 179624 - DNA, 103 bp, Artificial Sequence
  Synthetic Polynucleotide
taatacgactcactatagggactctgtggtctgctcgggcttgatgggctaacagaggagaagcccaatgagcccgagcaacctggcggcagcgcaaaagatg

SEQ ID NO: 179625 - DNA, 103 bp, Artificial Sequence
  Synthetic Polynucleotide
taatacgactcactatagggatggctgaatactctgtggtctgctcgggcaacagaggagagcccgaatggaccacagaaacctggcggcagcgcaaaagatg

SEQ ID NO: 179626 - DNA, 103 bp, Artificial Sequence
  Synthetic Polynucleotide
taatacgactcactatagggcagcgaggccatggctgaatactctgtggtaacagaggagaaccacaatgtattcagccaacctggcggcagcgcaaaagatg

SEQ ID NO: 179627 - DNA, 103 bp, Artificial Sequence
  Synthetic Polynucleotide
taatacgactcactatagggggagtggccgtccattcacaaaaaccccccaacagaggagaggggggatgttgtgaatgaacctggcggcagcgcaaaagatg

SEQ ID NO: 179628 - DNA, 103 bp, Artificial Sequence
  Synthetic Polynucleotide
taatacgactcactataggggcccaccagccagcgaggccatggctgaataacagaggagaattcagatgtggcctcgcaacctggcggcagcgcaaaagatg

SEQ ID NO: 179629 - DNA, 103 bp, Artificial Sequence
  Synthetic Polynucleotide
taatacgactcactatagggatgtcgtccagcccaccagccagcgaggccaacagaggagaggcctcatgggctggtggaacctggcggcagcgcaaaagatg

SEQ ID NO: 179630 - DNA, 103 bp, Artificial Sequence
  Synthetic Polynucleotide
taatacgactcactatagggattggccttcatgtcgtccagcccaccagcaacagaggagagctggtatgctggacgacaacctggcggcagcgcaaaagatg

SEQ ID NO: 179631 - DNA, 103 bp, Artificial Sequence
  Synthetic Polynucleotide
taatacgactcactatagggggctggccagattggccttcatgtcgtccaaacagaggagatggacgatgtgaaggccaaacctggcggcagcgcaaaagatg

SEQ ID NO: 179632 - DNA, 103 bp, Artificial Sequence
  Synthetic Polynucleotide
taatacgactcactataggggcaggggtggggctggccagattggccttcaacagaggagagaaggcatgtctggccagaacctggcggcagcgcaaaagatg

SEQ ID NO: 179633 - DNA, 103 bp, Artificial Sequence
  Synthetic Polynucleotide
taatacgactcactatagggcccgatgtcagcaggggtggggctggccagaacagaggagactggccatgcccacccctaacctggcggcagcgcaaaagatg

SEQ ID NO: 179634 - DNA, 103 bp, Artificial Sequence
  Synthetic Polynucleotide
taatacgactcactataggggcacactgctcccgatgtcagcaggggtggaacagaggagaccacccatgctgacatcgaacctggcggcagcgcaaaagatg

SEQ ID NO: 179635 - DNA, 103 bp, Artificial Sequence
  Synthetic Polynucleotide
taatacgactcactatagggtgcgggcctggcacactgctcccgatgtcaaacagaggagatgacatatggagcagtgtaacctggcggcagcgcaaaagatg

SEQ ID NO: 179636 - DNA, 103 bp, Artificial Sequence
  Synthetic Polynucleotide
taatacgactcactatagggggggtaggactgcgggcctggcacactgctaacagaggagaagcagtatgccaggcccgaacctggcggcagcgcaaaagatg

SEQ ID NO: 179637 - DNA, 103 bp, Artificial Sequence
  Synthetic Polynucleotide
taatacgactcactatagggctgtcacaatggggtaggactgcgggcctgaacagaggagacaggccatgagtcctaccaacctggcggcagcgcaaaagatg

SEQ ID NO: 179638 - DNA, 103 bp, Artificial Sequence
  Synthetic Polynucleotide
taatacgactcactatagggactacatccgggagtggccgtccattcacaaacagaggagatgtgaaatgacggccactaacctggcggcagcgcaaaagatg

SEQ ID NO: 179639 - DNA, 103 bp, Artificial Sequence
  Synthetic Polynucleotide
taatacgactcactatagggaagtcacggcctgtcacaatggggtaggacaacagaggagagtcctaatgcattgtgacaacctggcggcagcgcaaaagatg

SEQ ID NO: 179640 - DNA, 103 bp, Artificial Sequence
  Synthetic Polynucleotide
taatacgactcactatagggcgtgctcgccaagtcacggcctgtcacaataacagaggagaattgtgatgggccgtgacaacctggcggcagcgcaaaagatg

SEQ ID NO: 179641 - DNA, 103 bp, Artificial Sequence
  Synthetic Polynucleotide
taatacgactcactatagggcggggagggtcgtgctcgccaagtcacggcaacagaggagagccgtgatgtggcgagcaaacctggcggcagcgcaaaagatg

SEQ ID NO: 179642 - DNA, 103 bp, Artificial Sequence
  Synthetic Polynucleotide
taatacgactcactatagggggagggtacccggggagggtcgtgctcgccaacagaggagaggcgagatggaccctcccaacctggcggcagcgcaaaagatg

SEQ ID NO: 179643 - DNA, 103 bp, Artificial Sequence
  Synthetic Polynucleotide
taatacgactcactatagggggggacgtgtggagggtacccggggagggtaacagaggagaaccctcatggggtaccctaacctggcggcagcgcaaaagatg

SEQ ID NO: 179644 - DNA, 103 bp, Artificial Sequence
  Synthetic Polynucleotide
taatacgactcactataggggtccagcgggggggacgtgtggagggtaccaacagaggagaggtaccatgcacacgtccaacctggcggcagcgcaaaagatg

SEQ ID NO: 179645 - DNA, 103 bp, Artificial Sequence
  Synthetic Polynucleotide
taatacgactcactatagggtagctgccctgtccagcgggggggacgtgtaacagaggagaacacgtatgccccgctggaacctggcggcagcgcaaaagatg

SEQ ID NO: 179646 - DNA, 103 bp, Artificial Sequence
  Synthetic Polynucleotide
taatacgactcactatagggcggtgctgagtagctgccctgtccagcgggaacagaggagacccgctatgcagggcagcaacctggcggcagcgcaaaagatg

SEQ ID NO: 179647 - DNA, 103 bp, Artificial Sequence
  Synthetic Polynucleotide
taatacgactcactatagggctgtcagcgtcggtgctgagtagctgccctaacagaggagaagggcaatgactcagcacaacctggcggcagcgcaaaagatg

SEQ ID NO: 179648 - DNA, 103 bp, Artificial Sequence
  Synthetic Polynucleotide
taatacgactcactatagggggcaccatccctgtcagcgtcggtgctgagaacagaggagactcagcatggacgctgacaacctggcggcagcgcaaaagatg

SEQ ID NO: 179649 - DNA, 103 bp, Artificial Sequence
  Synthetic Polynucleotide
taatacgactcactatagggctgattcactccgctgtgactgttctgcataacagaggagaatgcagatgagtcacagcaacctggcggcagcgcaaaagatg

SEQ ID NO: 179650 - DNA, 103 bp, Artificial Sequence
  Synthetic Polynucleotide
taatacgactcactataggggcacggccgggccccgctgtgagctagctcaacagaggagagagctaatgcacagcgggaacctggcggcagcgcaaaagatg

SEQ ID NO: 179651 - DNA, 103 bp, Artificial Sequence
  Synthetic Polynucleotide
taatacgactcactataggggttatttgccatggtgaagctgggcataggaacagaggagacctatgatgagcttcaccaacctggcggcagcgcaaaagatg

SEQ ID NO: 179652 - DNA, 103 bp, Artificial Sequence
  Synthetic Polynucleotide
taatacgactcactataggggcataggcaggttatttgccatggtgaagcaacagaggagagcttcaatgtggcaaataaacctggcggcagcgcaaaagatg

SEQ ID NO: 179653 - DNA, 103 bp, Artificial Sequence
  Synthetic Polynucleotide
taatacgactcactatagggactgggggttgcataggcaggttatttgccaacagaggagaggcaaaatgcctgcctataacctggcggcagcgcaaaagatg

SEQ ID NO: 179654 - DNA, 103 bp, Artificial Sequence
  Synthetic Polynucleotide
taatacgactcactatagggctggctggggactgggggttgcataggcagaacagaggagactgcctatgcaacccccaaacctggcggcagcgcaaaagatg

SEQ ID NO: 179655 - DNA, 103 bp, Artificial Sequence
  Synthetic Polynucleotide
taatacgactcactatagggatgaggaggtctggctggggactgggggttaacagaggagaaaccccatgtccccagccaacctggcggcagcgcaaaagatg

SEQ ID NO: 179656 - DNA, 103 bp, Artificial Sequence
  Synthetic Polynucleotide
taatacgactcactatagggatgcaggagtatgaggaggtctggctggggaacagaggagaccccagatggacctcctcaacctggcggcagcgcaaaagatg

SEQ ID NO: 179657 - DNA, 103 bp, Artificial Sequence
  Synthetic Polynucleotide
taatacgactcactatagggggtgggcagcatgcaggagtatgaggaggtaacagaggagaacctccatgtactcctgcaacctggcggcagcgcaaaagatg

SEQ ID NO: 179658 - DNA, 103 bp, Artificial Sequence
  Synthetic Polynucleotide
taatacgactcactatagggccgaagggctggtgggcagcatgcaggagtaacagaggagaactcctatgtgctgcccaaacctggcggcagcgcaaaagatg

SEQ ID NO: 179659 - DNA, 103 bp, Artificial Sequence
  Synthetic Polynucleotide
taatacgactcactatagggcgcccattcaccgaagggctggtgggcagcaacagaggagagctgccatgcagcccttcaacctggcggcagcgcaaaagatg

SEQ ID NO: 179660 - DNA, 103 bp, Artificial Sequence
  Synthetic Polynucleotide
taatacgactcactatagggatcataactccgcccattcaccgaagggctaacagaggagaagccctatggtgaatgggaacctggcggcagcgcaaaagatg

SEQ ID NO: 179661 - DNA, 103 bp, Artificial Sequence
  Synthetic Polynucleotide
taatacgactcactataggggggaaatgtcgcacggccgggccccgctgtaacagaggagaacagcgatgcccggccgtaacctggcggcagcgcaaaagatg

SEQ ID NO: 179662 - DNA, 103 bp, Artificial Sequence
  Synthetic Polynucleotide
taatacgactcactataggggggtgtaggtatcataactccgcccattcaaacagaggagatgaatgatgggagttatgaacctggcggcagcgcaaaagatg

SEQ ID NO: 179663 - DNA, 103 bp, Artificial Sequence
  Synthetic Polynucleotide
taatacgactcactatagggatatgtgggggggtgtaggtatcataactcaacagaggagagagttaatgtacctacacaacctggcggcagcgcaaaagatg

SEQ ID NO: 179664 - DNA, 103 bp, Artificial Sequence
  Synthetic Polynucleotide
taatacgactcactataggggtgtgtctgcatatgtgggggggtgtaggtaacagaggagaacctacatgcccccacataacctggcggcagcgcaaaagatg

SEQ ID NO: 179665 - DNA, 103 bp, Artificial Sequence
  Synthetic Polynucleotide
taatacgactcactataggggactgttcatgtgtgtctgcatatgtggggaacagaggagaccccacatgtgcagacacaacctggcggcagcgcaaaagatg

SEQ ID NO: 179666 - DNA, 103 bp, Artificial Sequence
  Synthetic Polynucleotide
taatacgactcactatagggcccattggctgactgttcatgtgtgtctgcaacagaggagagcagacatgcatgaacagaacctggcggcagcgcaaaagatg

SEQ ID NO: 179667 - DNA, 103 bp, Artificial Sequence
  Synthetic Polynucleotide
taatacgactcactataggggcccgaggtgcccattggctgactgttcataacagaggagaatgaacatgcagccaatgaacctggcggcagcgcaaaagatg

SEQ ID NO: 179668 - DNA, 103 bp, Artificial Sequence
  Synthetic Polynucleotide
taatacgactcactatagggttgaagtggtgcccgaggtgcccattggctaacagaggagaagccaaatggcacctcggaacctggcggcagcgcaaaagatg

SEQ ID NO: 179669 - DNA, 103 bp, Artificial Sequence
  Synthetic Polynucleotide
taatacgactcactatagggatgagtcctgttgaagtggtgcccgaggtgaacagaggagacacctcatgcaccacttcaacctggcggcagcgcaaaagatg

SEQ ID NO: 179670 - DNA, 103 bp, Artificial Sequence
  Synthetic Polynucleotide
taatacgactcactatagggaccaggggaaatgagtcctgttgaagtggtaacagaggagaaccactatgacaggactcaacctggcggcagcgcaaaagatg

SEQ ID NO: 179671 - DNA, 103 bp, Artificial Sequence
  Synthetic Polynucleotide
taatacgactcactataggggaactgacacaccaggggaaatgagtcctgaacagaggagacaggacatgtttcccctgaacctggcggcagcgcaaaagatg

SEQ ID NO: 179672 - DNA, 103 bp, Artificial Sequence
  Synthetic Polynucleotide
taatacgactcactatagggtgcagaattcgggaaatgtcgcacggccggaacagaggagaccggccatgcgacatttcaacctggcggcagcgcaaaagatg

SEQ ID NO: 179673 - DNA, 103 bp, Artificial Sequence
  Synthetic Polynucleotide
taatacgactcactatagggacttgaactggaactgacacaccaggggaaaacagaggagattccccatgtgtgtcagtaacctggcggcagcgcaaaagatg

SEQ ID NO: 179674 - DNA, 103 bp, Artificial Sequence
  Synthetic Polynucleotide
taatacgactcactatagggacttccgggaacttgaactggaactgacacaacagaggagagtgtcaatgccagttcaaaacctggcggcagcgcaaaagatg

SEQ ID NO: 179675 - DNA, 103 bp, Artificial Sequence
  Synthetic Polynucleotide
taatacgactcactatagggtatcaggttcacttccgggaacttgaactgaacagaggagacagttcatgttcccggaaaacctggcggcagcgcaaaagatg

SEQ ID NO: 179676 - DNA, 103 bp, Artificial Sequence
  Synthetic Polynucleotide
taatacgactcactatagggtattgagacatatcaggttcacttccgggaaacagaggagatcccggatgtgaacctgaaacctggcggcagcgcaaaagatg

SEQ ID NO: 179677 - DNA, 103 bp, Artificial Sequence
  Synthetic Polynucleotide
taatacgactcactatagggtcttggccagtattgagacatatcaggttcaacagaggagagaacctatgatgtctcaaaacctggcggcagcgcaaaagatg

SEQ ID NO: 179678 - DNA, 103 bp, Artificial Sequence
  Synthetic Polynucleotide
taatacgactcactataggggttggacacctgcagaattcgggaaatgtcaacagaggagagacattatgcgaattctgaacctggcggcagcgcaaaagatg

SEQ ID NO: 179679 - DNA, 103 bp, Artificial Sequence
  Synthetic Polynucleotide
taatacgactcactatagggtcacacatccgttggacacctgcagaattcaacagaggagagaattcatgaggtgtccaaacctggcggcagcgcaaaagatg

SEQ ID NO: 179680 - DNA, 103 bp, Artificial Sequence
  Synthetic Polynucleotide
taatacgactcactatagggagaattttactcacacatccgttggacaccaacagaggagaggtgtcatgcggatgtgtaacctggcggcagcgcaaaagatg

SEQ ID NO: 179681 - DNA, 103 bp, Artificial Sequence
  Synthetic Polynucleotide
taatacgactcactatagggatacctgcccagaattttactcacacatccaacagaggagaggatgtatgagtaaaattaacctggcggcagcgcaaaagatg

SEQ ID NO: 179682 - DNA, 103 bp, Artificial Sequence
  Synthetic Polynucleotide
taatacgactcactatagggcagtctcgtaatacctgcccagaattttacaacagaggagagtaaaaatgtgggcaggtaacctggcggcagcgcaaaagatg

SEQ ID NO: 179683 - DNA, 103 bp, Artificial Sequence
  Synthetic Polynucleotide
taatacgactcactatagggctgatggagccagtctcgtaatacctgcccaacagaggagagggcagatgttacgagacaacctggcggcagcgcaaaagatg

SEQ ID NO: 179684 - DNA, 103 bp, Artificial Sequence
  Synthetic Polynucleotide
taatacgactcactatagggtgccctgggtctgatggagccagtctcgtaaacagaggagatacgagatgggctccatcaacctggcggcagcgcaaaagatg

SEQ ID NO: 179685 - DNA, 103 bp, Artificial Sequence
  Synthetic Polynucleotide
taatacgactcactatagggcaccaccgagctgattcactccgctgtgacaacagaggagagtcacaatggagtgaatcaacctggcggcagcgcaaaagatg

SEQ ID NO: 179686 - DNA, 103 bp, Artificial Sequence
  Synthetic Polynucleotide
taatacgactcactatagggtaccaccgattgccctgggtctgatggagcaacagaggagagctccaatggacccagggaacctggcggcagcgcaaaagatg

SEQ ID NO: 179687 - DNA, 103 bp, Artificial Sequence
  Synthetic Polynucleotide
taatacgactcactatagggctcggtttactaccaccgattgccctgggtaacagaggagaacccagatgaatcggtggaacctggcggcagcgcaaaagatg

SEQ ID NO: 179688 - DNA, 103 bp, Artificial Sequence
  Synthetic Polynucleotide
taatacgactcactatagggagtcgctactctcggtttactaccaccgataacagaggagaatcggtatgagtaaaccgaacctggcggcagcgcaaaagatg

SEQ ID NO: 179689 - DNA, 103 bp, Artificial Sequence
  Synthetic Polynucleotide
taatacgactcactatagggcaacttctggagtcgctactctcggtttacaacagaggagagtaaacatggagtagcgaaacctggcggcagcgcaaaagatg

SEQ ID NO: 179690 - DNA, 103 bp, Artificial Sequence
  Synthetic Polynucleotide
taatacgactcactatagggattttgcttacaacttctggagtcgctactaacagaggagaagtagcatgtccagaagtaacctggcggcagcgcaaaagatg

SEQ ID NO: 179691 - DNA, 103 bp, Artificial Sequence
  Synthetic Polynucleotide
taatacgactcactatagggatactgggctattttgcttacaacttctggaacagaggagaccagaaatggtaagcaaaaacctggcggcagcgcaaaagatg

SEQ ID NO: 179692 - DNA, 103 bp, Artificial Sequence
  Synthetic Polynucleotide
taatacgactcactatagggactcccgcttatactgggctattttgcttaaacagaggagataagcaatgtagcccagtaacctggcggcagcgcaaaagatg

SEQ ID NO: 179693 - DNA, 103 bp, Artificial Sequence
  Synthetic Polynucleotide
taatacgactcactatagggatggacgggcactcccgcttatactgggctaacagaggagaagcccaatgtaagcgggaaacctggcggcagcgcaaaagatg

SEQ ID NO: 179694 - DNA, 103 bp, Artificial Sequence
  Synthetic Polynucleotide
taatacgactcactatagggccaagcaaagatggacgggcactcccgcttaacagaggagaaagcggatgtgcccgtccaacctggcggcagcgcaaaagatg

SEQ ID NO: 179695 - DNA, 103 bp, Artificial Sequence
  Synthetic Polynucleotide
taatacgactcactatagggctcggatttcccaagcaaagatggacgggcaacagaggagagcccgtatgtctttgcttaacctggcggcagcgcaaaagatg

SEQ ID NO: 179696 - DNA, 103 bp, Artificial Sequence
  Synthetic Polynucleotide
taatacgactcactatagggttgacaaagacaccaccgagctgattcactaacagaggagaagtgaaatggctcggtggaacctggcggcagcgcaaaagatg

SEQ ID NO: 179697 - DNA, 103 bp, Artificial Sequence
  Synthetic Polynucleotide
taatacgactcactatagggagtaatctgtctcggatttcccaagcaaagaacagaggagactttgcatgggaaatccgaacctggcggcagcgcaaaagatg

SEQ ID NO: 179698 - DNA, 103 bp, Artificial Sequence
  Synthetic Polynucleotide
taatacgactcactatagggcccctcggacagtaatctgtctcggatttcaacagaggagagaaatcatggacagattaaacctggcggcagcgcaaaagatg

SEQ ID NO: 179699 - DNA, 103 bp, Artificial Sequence
  Synthetic Polynucleotide
taatacgactcactatagggtggtacagaccccctcggacagtaatctgtaacagaggagaacagatatgtgtccgaggaacctggcggcagcgcaaaagatg

SEQ ID NO: 179700 - DNA, 103 bp, Artificial Sequence
  Synthetic Polynucleotide
taatacgactcactatagggatgttatcgttggtacagaccccctcggacaacagaggagagtccgaatgggtctgtacaacctggcggcagcgcaaaagatg

SEQ ID NO: 179701 - DNA, 103 bp, Artificial Sequence
  Synthetic Polynucleotide
taatacgactcactatagggcacgcttggtatgttatcgttggtacagacaacagaggagagtctgtatgaacgataacaacctggcggcagcgcaaaagatg

SEQ ID NO: 179702 - DNA, 103 bp, Artificial Sequence
  Synthetic Polynucleotide
taatacgactcactatagggttattgatgacacgcttggtatgttatcgtaacagaggagaacgataatgtaccaagcgaacctggcggcagcgcaaaagatg

SEQ ID NO: 179703 - DNA, 103 bp, Artificial Sequence
  Synthetic Polynucleotide
taatacgactcactatagggagaactctgtttattgatgacacgcttggtaacagaggagaaccaagatggtcatcaataacctggcggcagcgcaaaagatg

SEQ ID NO: 179704 - DNA, 103 bp, Artificial Sequence
  Synthetic Polynucleotide
taatacgactcactatagggcaggttgcgaagaactctgtttattgatgaaacagaggagatcatcaatgaacagagttaacctggcggcagcgcaaaagatg

SEQ ID NO: 179705 - DNA, 103 bp, Artificial Sequence
  Synthetic Polynucleotide
taatacgactcactatagggtttcgctagccaggttgcgaagaactctgtaacagaggagaacagagatgttcgcaaccaacctggcggcagcgcaaaagatg

SEQ ID NO: 179706 - DNA, 103 bp, Artificial Sequence
  Synthetic Polynucleotide
taatacgactcactatagggatctgttgcttttcgctagccaggttgcgaaacagaggagatcgcaaatgggctagcgaaacctggcggcagcgcaaaagatg

SEQ ID NO: 179707 - DNA, 103 bp, Artificial Sequence
  Synthetic Polynucleotide
taatacgactcactatagggtggccgcccgttgacaaagacaccaccgagaacagaggagactcggtatggtctttgtcaacctggcggcagcgcaaaagatg

SEQ ID NO: 179708 - DNA, 103 bp, Artificial Sequence
  Synthetic Polynucleotide
taatacgactcactataggggtctgcgcccatctgttgcttttcgctagcaacagaggagagctagcatgaagcaacagaacctggcggcagcgcaaaagatg

SEQ ID NO: 179709 - DNA, 103 bp, Artificial Sequence
  Synthetic Polynucleotide
taatacgactcactatagggcatacatgccgtctgcgcccatctgttgctaacagaggagaagcaacatgtgggcgcagaacctggcggcagcgcaaaagatg

SEQ ID NO: 179710 - DNA, 103 bp, Artificial Sequence
  Synthetic Polynucleotide
taatacgactcactatagggcttagtttatcatacatgccgtctgcgcccaacagaggagagggcgcatgcggcatgtaaacctggcggcagcgcaaaagatg

SEQ ID NO: 179711 - DNA, 103 bp, Artificial Sequence
  Synthetic Polynucleotide
taatacgactcactataggggttcaacatccttagtttatcatacatgccaacagaggagaggcatgatggataaactaaacctggcggcagcgcaaaagatg

SEQ ID NO: 179712 - DNA, 103 bp, Artificial Sequence
  Synthetic Polynucleotide
taatacgactcactatagggcggtctgcccgttcaacatccttagtttataacagaggagaataaacatgggatgttgaaacctggcggcagcgcaaaagatg

SEQ ID NO: 179713 - DNA, 103 bp, Artificial Sequence
  Synthetic Polynucleotide
taatacgactcactatagggccccagcttccggtctgcccgttcaacatcaacagaggagagatgttatgcgggcagacaacctggcggcagcgcaaaagatg

SEQ ID NO: 179714 - DNA, 103 bp, Artificial Sequence
  Synthetic Polynucleotide
taatacgactcactatagggagggcgggtgccccagcttccggtctgcccaacagaggagagggcagatgggaagctggaacctggcggcagcgcaaaagatg

SEQ ID NO: 179715 - DNA, 103 bp, Artificial Sequence
  Synthetic Polynucleotide
taatacgactcactataggggataccaaccagggcgggtgccccagcttcaacagaggagagaagctatggcacccgccaacctggcggcagcgcaaaagatg

SEQ ID NO: 179716 - DNA, 103 bp, Artificial Sequence
  Synthetic Polynucleotide
taatacgactcactataggggaagtccccggataccaaccagggcgggtgaacagaggagacacccgatgtggttggtaaacctggcggcagcgcaaaagatg

SEQ ID NO: 179717 - DNA, 103 bp, Artificial Sequence
  Synthetic Polynucleotide
taatacgactcactatagggccctggcaccgaagtccccggataccaaccaacagaggagaggttggatgccggggactaacctggcggcagcgcaaaagatg

SEQ ID NO: 179718 - DNA, 103 bp, Artificial Sequence
  Synthetic Polynucleotide
taatacgactcactatagggagtccggcagtggccgcccgttgacaaagaaacagaggagatctttgatgacgggcggcaacctggcggcagcgcaaaagatg

SEQ ID NO: 179719 - DNA, 103 bp, Artificial Sequence
  Synthetic Polynucleotide
taatacgactcactataggggcgtaggttgccctggcaccgaagtccccgaacagaggagacggggaatgcggtgccagaacctggcggcagcgcaaaagatg

SEQ ID NO: 179720 - DNA, 103 bp, Artificial Sequence
  Synthetic Polynucleotide
taatacgactcactatagggcagccatcttgcgtaggttgccctggcaccaacagaggagaggtgccatggcaacctacaacctggcggcagcgcaaaagatg

SEQ ID NO: 179721 - DNA, 103 bp, Artificial Sequence
  Synthetic Polynucleotide
taatacgactcactatagggctgttgctggcagccatcttgcgtaggttgaacagaggagacaacctatgcaagatggcaacctggcggcagcgcaaaagatg

SEQ ID NO: 179722 - DNA, 103 bp, Artificial Sequence
  Synthetic Polynucleotide
taatacgactcactatagggcccctccttcctgttgctggcagccatcttaacagaggagaaagatgatggccagcaacaacctggcggcagcgcaaaagatg

SEQ ID NO: 179723 - DNA, 103 bp, Artificial Sequence
  Synthetic Polynucleotide
taatacgactcactataggggtattctctccccctccttcctgttgctggaacagaggagaccagcaatgggaaggaggaacctggcggcagcgcaaaagatg

SEQ ID NO: 179724 - DNA, 103 bp, Artificial Sequence
  Synthetic Polynucleotide
taatacgactcactataggggatggagttggtattctctccccctccttcaacagaggagagaaggaatgggagagaataacctggcggcagcgcaaaagatg

SEQ ID NO: 179725 - DNA, 103 bp, Artificial Sequence
  Synthetic Polynucleotide
taatacgactcactatagggcgttggaactgatggagttggtattctctcaacagaggagagagagaatgccaactccaaacctggcggcagcgcaaaagatg

SEQ ID NO: 179726 - DNA, 103 bp, Artificial Sequence
  Synthetic Polynucleotide
taatacgactcactataggggaatcttctccgttggaactgatggagttgaacagaggagacaactcatgcagttccaaaacctggcggcagcgcaaaagatg

SEQ ID NO: 179727 - DNA, 103 bp, Artificial Sequence
  Synthetic Polynucleotide
taatacgactcactatagggagcctcatctgaatcttctccgttggaactaacagaggagaagttccatgggagaagataacctggcggcagcgcaaaagatg

SEQ ID NO: 179728 - DNA, 103 bp, Artificial Sequence
  Synthetic Polynucleotide
taatacgactcactataggggtcgcatttgagcctcatctgaatcttctcaacagaggagagagaagatgcagatgaggaacctggcggcagcgcaaaagatg

SEQ ID NO: 179729 - DNA, 103 bp, Artificial Sequence
  Synthetic Polynucleotide
taatacgactcactatagggtgccgggtggagtccggcagtggccgcccgaacagaggagacgggcgatgactgccggaaacctggcggcagcgcaaaagatg

SEQ ID NO: 179730 - DNA, 103 bp, Artificial Sequence
  Synthetic Polynucleotide
taatacgactcactatagggttcagctgaagtcgcatttgagcctcatctaacagaggagaagatgaatgtcaaatgcgaacctggcggcagcgcaaaagatg

SEQ ID NO: 179731 - DNA, 103 bp, Artificial Sequence
  Synthetic Polynucleotide
taatacgactcactatagggcagcttccgcttcagctgaagtcgcatttgaacagaggagacaaatgatgcttcagctgaacctggcggcagcgcaaaagatg

SEQ ID NO: 179732 - DNA, 103 bp, Artificial Sequence
  Synthetic Polynucleotide
taatacgactcactatagggtatttctttgcagcttccgcttcagctgaaaacagaggagattcagcatgagcggaagcaacctggcggcagcgcaaaagatg

SEQ ID NO: 179733 - DNA, 103 bp, Artificial Sequence
  Synthetic Polynucleotide
taatacgactcactatagggaaggatgttctatttctttgcagcttccgcaacagaggagagcggaaatggcaaagaaaaacctggcggcagcgcaaaagatg

SEQ ID NO: 179734 - DNA, 103 bp, Artificial Sequence
  Synthetic Polynucleotide
taatacgactcactatagggctcttgggtaaaggatgttctatttctttgaacagaggagacaaagaatgagaacatccaacctggcggcagcgcaaaagatg

SEQ ID NO: 179735 - DNA, 103 bp, Artificial Sequence
  Synthetic Polynucleotide
taatacgactcactatagggcctcaatttgctcttgggtaaaggatgttcaacagaggagagaacatatgttacccaagaacctggcggcagcgcaaaagatg

SEQ ID NO: 179736 - DNA, 103 bp, Artificial Sequence
  Synthetic Polynucleotide
taatacgactcactatagggttctccagggcctcaatttgctcttgggtaaacagaggagatacccaatggcaaattgaaacctggcggcagcgcaaaagatg

SEQ ID NO: 179737 - DNA, 103 bp, Artificial Sequence
  Synthetic Polynucleotide
taatacgactcactatagggctcaaactctttctccagggcctcaatttgaacagaggagacaaattatggccctggagaacctggcggcagcgcaaaagatg

SEQ ID NO: 179738 - DNA, 103 bp, Artificial Sequence
  Synthetic Polynucleotide
taatacgactcactatagggaatgggttctctcaaactctttctccagggaacagaggagaccctggatgaagagtttgaacctggcggcagcgcaaaagatg

SEQ ID NO: 179739 - DNA, 103 bp, Artificial Sequence
  Synthetic Polynucleotide
taatacgactcactatagggacatctggataatgggttctctcaaactctaacagaggagaagagttatggagaacccaaacctggcggcagcgcaaaagatg

SEQ ID NO: 179740 - DNA, 103 bp, Artificial Sequence
  Synthetic Polynucleotide
taatacgactcactatagggtacaatcttctgccgggtggagtccggcagaacagaggagactgccgatgtccacccggaacctggcggcagcgcaaaagatg

SEQ ID NO: 179741 - DNA, 103 bp, Artificial Sequence
  Synthetic Polynucleotide
taatacgactcactatagggtcgggcaaacacatctggataatgggttctaacagaggagaagaaccatgtatccagataacctggcggcagcgcaaaagatg

SEQ ID NO: 179742 - DNA, 103 bp, Artificial Sequence
  Synthetic Polynucleotide
taatacgactcactatagggctagtctttctcgggcaaacacatctggataacagaggagaatccagatgtgtttgcccaacctggcggcagcgcaaaagatg

SEQ ID NO: 179743 - DNA, 103 bp, Artificial Sequence
  Synthetic Polynucleotide
taatacgactcactatagggattttggctgctagtctttctcgggcaaacaacagaggagagtttgcatgagaaagactaacctggcggcagcgcaaaagatg

SEQ ID NO: 179744 - DNA, 103 bp, Artificial Sequence
  Synthetic Polynucleotide
taatacgactcactatagggaggtagatctattttggctgctagtctttcaacagaggagagaaagaatggcagccaaaaacctggcggcagcgcaaaagatg

SEQ ID NO: 179745 - DNA, 103 bp, Artificial Sequence
  Synthetic Polynucleotide
taatacgactcactatagggttcttgcttcaggtagatctattttggctgaacagaggagacagccaatgtagatctacaacctggcggcagcgcaaaagatg

SEQ ID NO: 179746 - DNA, 103 bp, Artificial Sequence
  Synthetic Polynucleotide
taatacgactcactatagggcatacctgtattcttgcttcaggtagatctaacagaggagaagatctatgtgaagcaagaacctggcggcagcgcaaaagatg

SEQ ID NO: 179747 - DNA, 103 bp, Artificial Sequence
  Synthetic Polynucleotide
taatacgactcactatagggattagaaaaccatacctgtattcttgcttcaacagaggagagaagcaatgatacaggtaaacctggcggcagcgcaaaagatg

SEQ ID NO: 179748 - DNA, 103 bp, Artificial Sequence
  Synthetic Polynucleotide
taatacgactcactatagggtggcccttcgattagaaaaccatacctgtaaacagaggagatacaggatgggttttctaaacctggcggcagcgcaaaagatg

SEQ ID NO: 179749 - DNA, 103 bp, Artificial Sequence
  Synthetic Polynucleotide
taatacgactcactatagggcttctccatttggcccttcgattagaaaacaacagaggagagttttcatgtcgaagggcaacctggcggcagcgcaaaagatg

SEQ ID NO: 179750 - DNA, 103 bp, Artificial Sequence
  Synthetic Polynucleotide
taatacgactcactatagggtttttcttctcttctccatttggcccttcgaacagaggagacgaaggatgaaatggagaaacctggcggcagcgcaaaagatg

SEQ ID NO: 179751 - DNA, 103 bp, Artificial Sequence
  Synthetic Polynucleotide
taatacgactcactataggggagctagctctacaatcttctgccgggtggaacagaggagaccacccatgagaagattgaacctggcggcagcgcaaaagatg

SEQ ID NO: 179752 - DNA, 103 bp, Artificial Sequence
  Synthetic Polynucleotide
taatacgactcactataggggattcctcagtttttcttctcttctccattaacagaggagaaatggaatggagaagaaaaacctggcggcagcgcaaaagatg

SEQ ID NO: 179753 - DNA, 103 bp, Artificial Sequence
  Synthetic Polynucleotide
taatacgactcactatagggtgtcttctctgattcctcagtttttcttctaacagaggagaagaagaatgactgaggaaaacctggcggcagcgcaaaagatg

SEQ ID NO: 179754 - DNA, 103 bp, Artificial Sequence
  Synthetic Polynucleotide
taatacgactcactataggggttgctggcctgtcttctctgattcctcagaacagaggagactgaggatgcagagaagaaacctggcggcagcgcaaaagatg

SEQ ID NO: 179755 - DNA, 103 bp, Artificial Sequence
  Synthetic Polynucleotide
taatacgactcactataggggactaggtgtgttgctggcctgtcttctctaacagaggagaagagaaatgaggccagcaaacctggcggcagcgcaaaagatg

SEQ ID NO: 179756 - DNA, 103 bp, Artificial Sequence
  Synthetic Polynucleotide
taatacgactcactatagggataggaatatgactaggtgtgttgctggccaacagaggagaggccagatgcacacctagaacctggcggcagcgcaaaagatg

SEQ ID NO: 179757 - DNA, 103 bp, Artificial Sequence
  Synthetic Polynucleotide
taatacgactcactatagggactactgctgataggaatatgactaggtgtaacagaggagaacacctatgcatattcctaacctggcggcagcgcaaaagatg

SEQ ID NO: 179758 - DNA, 103 bp, Artificial Sequence
  Synthetic Polynucleotide
taatacgactcactatagggtggtgctgaaactactgctgataggaatataacagaggagaatattcatgtcagcagtaaacctggcggcagcgcaaaagatg

SEQ ID NO: 179759 - DNA, 103 bp, Artificial Sequence
  Synthetic Polynucleotide
taatacgactcactatagggtggtagacactggtgctgaaactactgctgaacagaggagacagcagatgtttcagcacaacctggcggcagcgcaaaagatg

SEQ ID NO: 179760 - DNA, 103 bp, Artificial Sequence
  Synthetic Polynucleotide
taatacgactcactatagggtggaattggttggtagacactggtgctgaaaacagaggagattcagcatgagtgtctacaacctggcggcagcgcaaaagatg

SEQ ID NO: 179761 - DNA, 103 bp, Artificial Sequence
  Synthetic Polynucleotide
taatacgactcactatagggtggtgggttgtggaattggttggtagacacaacagaggagagtgtctatgaaccaattcaacctggcggcagcgcaaaagatg

SEQ ID NO: 179762 - DNA, 103 bp, Artificial Sequence
  Synthetic Polynucleotide
taatacgactcactataggggccccgctgtgagctagctctacaatcttcaacagaggagagaagatatgagagctagcaacctggcggcagcgcaaaagatg

SEQ ID NO: 179763 - DNA, 103 bp, Artificial Sequence
  Synthetic Polynucleotide
taatacgactcactataggggaaaccggtgtggtgggttgtggaattggtaacagaggagaaccaatatgacaacccacaacctggcggcagcgcaaaagatg

SEQ ID NO: 179764 - DNA, 103 bp, Artificial Sequence
  Synthetic Polynucleotide
taatacgactcactatagggtgtgaaggaggaaaccggtgtggtgggttgaacagaggagacaacccatgacaccggttaacctggcggcagcgcaaaagatg

SEQ ID NO: 179765 - DNA, 103 bp, Artificial Sequence
  Synthetic Polynucleotide
taatacgactcactatagggtggagccagatgtgaaggaggaaaccggtgaacagaggagacaccggatgcctccttcaaacctggcggcagcgcaaaagatg

SEQ ID NO: 179766 - DNA, 103 bp, Artificial Sequence
  Synthetic Polynucleotide
taatacgactcactatagggcggcccaacatggagccagatgtgaaggagaacagaggagactccttatgatctggctcaacctggcggcagcgcaaaagatg

SEQ ID NO: 179767 - DNA, 103 bp, Artificial Sequence
  Synthetic Polynucleotide
taatacgactcactatagggtgtgtctgttcggcccaacatggagccagaaacagaggagatctggcatgatgttgggcaacctggcggcagcgcaaaagatg

SEQ ID NO: 179768 - DNA, 103 bp, Artificial Sequence
  Synthetic Polynucleotide
taatacgactcactatagggttgtgagggctgtgtctgttcggcccaacaaacagaggagatgttggatggaacagacaaacctggcggcagcgcaaaagatg

SEQ ID NO: 179769 - DNA, 103 bp, Artificial Sequence
  Synthetic Polynucleotide
taatacgactcactatagggctgtaggtgtttgtgagggctgtgtctgttaacagaggagaaacagaatgagccctcacaacctggcggcagcgcaaaagatg

SEQ ID NO: 179770 - DNA, 103 bp, Artificial Sequence
  Synthetic Polynucleotide
taatacgactcactatagggcggcagagcgctgtaggtgtttgtgagggcaacagaggagagccctcatgaacacctacaacctggcggcagcgcaaaagatg

SEQ ID NO: 179771 - DNA, 103 bp, Artificial Sequence
  Synthetic Polynucleotide
taatacgactcactatagggtgggcataggcggcagagcgctgtaggtgtaacagaggagaacacctatggcgctctgcaacctggcggcagcgcaaaagatg

SEQ ID NO: 179772 - DNA, 103 bp, Artificial Sequence
  Synthetic Polynucleotide
taatacgactcactatagggatggtgaagctgggcataggcggcagagcgaacagaggagacgctctatggcctatgccaacctggcggcagcgcaaaagatg

SEQ ID NO: 179773 - DNA, 103 bp, Artificial Sequence
  Synthetic Polynucleotide
taatacgactcactatagggatggccagatctgatggagttgtgaggcataacagaggagaatgcctatgaactccatcaacctggcggcagcgcaaaagatg

SEQ ID NO: 179774 - DNA, 103 bp, Artificial Sequence
  Synthetic Polynucleotide
taatacgactcactatagggctggtgggccaggtctacgatgcgctggcgaacagaggagacgccagatgatcgtagacaacctggcggcagcgcaaaagatg

SEQ ID NO: 179775 - DNA, 103 bp, Artificial Sequence
  Synthetic Polynucleotide
taatacgactcactataggggccttacaccctggtgggccaggtctacgaaacagaggagatcgtagatgtggcccaccaacctggcggcagcgcaaaagatg

SEQ ID NO: 179776 - DNA, 103 bp, Artificial Sequence
  Synthetic Polynucleotide
taatacgactcactatagggatgtcgcagggccttacaccctggtgggccaacagaggagaggcccaatggggtgtaagaacctggcggcagcgcaaaagatg

SEQ ID NO: 179777 - DNA, 103 bp, Artificial Sequence
  Synthetic Polynucleotide
taatacgactcactatagggctggcgagagatgtcgcagggccttacaccaacagaggagaggtgtaatgccctgcgacaacctggcggcagcgcaaaagatg

SEQ ID NO: 179778 - DNA, 103 bp, Artificial Sequence
  Synthetic Polynucleotide
taatacgactcactatagggtgacgcggagctggcgagagatgtcgcaggaacagaggagacctgcgatgtctctcgccaacctggcggcagcgcaaaagatg

SEQ ID NO: 179779 - DNA, 103 bp, Artificial Sequence
  Synthetic Polynucleotide
taatacgactcactatagggcagccatggctgacgcggagctggcgagagaacagaggagactctcgatggctccgcgtaacctggcggcagcgcaaaagatg

SEQ ID NO: 179780 - DNA, 103 bp, Artificial Sequence
  Synthetic Polynucleotide
taatacgactcactatagggcttgctgacgcagccatggctgacgcggagaacagaggagactccgcatgagccatggcaacctggcggcagcgcaaaagatg

SEQ ID NO: 179781 - DNA, 103 bp, Artificial Sequence
  Synthetic Polynucleotide
taatacgactcactatagggtgccaaggatcttgctgacgcagccatggcaacagaggagagccatgatggcgtcagcaaacctggcggcagcgcaaaagatg

SEQ ID NO: 179782 - DNA, 103 bp, Artificial Sequence
  Synthetic Polynucleotide
taatacgactcactatagggtcgtagtacctgccaaggatcttgctgacgaacagaggagacgtcagatggatccttggaacctggcggcagcgcaaaagatg

SEQ ID NO: 179783 - DNA, 103 bp, Artificial Sequence
  Synthetic Polynucleotide
taatacgactcactataggggctgccagtctcgtagtacctgccaaggataacagaggagaatccttatgaggtactacaacctggcggcagcgcaaaagatg

SEQ ID NO: 179784 - DNA, 103 bp, Artificial Sequence
  Synthetic Polynucleotide
taatacgactcactatagggtcagccctccatggccagatctgatggagtaacagaggagaactccaatggatctggccaacctggcggcagcgcaaaagatg

SEQ ID NO: 179785 - DNA, 103 bp, Artificial Sequence
  Synthetic Polynucleotide
taatacgactcactatagggcaggccggatgctgccagtctcgtagtaccaacagaggagaggtactatgagactggcaaacctggcggcagcgcaaaagatg

SEQ ID NO: 179786 - DNA, 103 bp, Artificial Sequence
  Synthetic Polynucleotide
taatacgactcactatagggcctatcactccaggccggatgctgccagtcaacagaggagagactggatgcatccggccaacctggcggcagcgcaaaagatg

SEQ ID NO: 179787 - DNA, 103 bp, Artificial Sequence
  Synthetic Polynucleotide
taatacgactcactatagggcttggagccccctatcactccaggccggataacagaggagaatccggatgggagtgataaacctggcggcagcgcaaaagatg

SEQ ID NO: 179788 - DNA, 103 bp, Artificial Sequence
  Synthetic Polynucleotide
taatacgactcactatagggccaccttgggcttggagccccctatcactcaacagaggagagagtgaatgggggctccaaacctggcggcagcgcaaaagatg

SEQ ID NO: 179789 - DNA, 103 bp, Artificial Sequence
  Synthetic Polynucleotide
taatacgactcactatagggttgggggtggccaccttgggcttggagcccaacagaggagagggctcatggcccaaggtaacctggcggcagcgcaaaagatg

SEQ ID NO: 179790 - DNA, 103 bp, Artificial Sequence
  Synthetic Polynucleotide
taatacgactcactatagggctccaccaccttgggggtggccaccttgggaacagaggagacccaagatggccacccccaacctggcggcagcgcaaaagatg

SEQ ID NO: 179791 - DNA, 103 bp, Artificial Sequence
  Synthetic Polynucleotide
taatacgactcactatagggccccaatcttctccaccaccttgggggtggaacagaggagaccacccatgaggtggtggaacctggcggcagcgcaaaagatg

SEQ ID NO: 179792 - DNA, 103 bp, Artificial Sequence
  Synthetic Polynucleotide
taatacgactcactatagggcgtttgtagtccccaatcttctccaccaccaacagaggagaggtggtatggaagattggaacctggcggcagcgcaaaagatg

SEQ ID NO: 179793 - DNA, 103 bp, Artificial Sequence
  Synthetic Polynucleotide
taatacgactcactatagggagggttctggcgtttgtagtccccaatcttaacagaggagaaagattatggactacaaaaacctggcggcagcgcaaaagatg

SEQ ID NO: 179794 - DNA, 103 bp, Artificial Sequence
  Synthetic Polynucleotide
taatacgactcactatagggcaaacatggtagggttctggcgtttgtagtaacagaggagaactacaatggccagaaccaacctggcggcagcgcaaaagatg

SEQ ID NO: 179795 - DNA, 103 bp, Artificial Sequence
  Synthetic Polynucleotide
taatacgactcactatagggcccagctggttcagccctccatggccagataacagaggagaatctggatgtggagggctaacctggcggcagcgcaaaagatg

SEQ ID NO: 179796 - DNA, 103 bp, Artificial Sequence
  Synthetic Polynucleotide
taatacgactcactatagggatctcccaggcaaacatggtagggttctggaacagaggagaccagaaatgtaccatgttaacctggcggcagcgcaaaagatg

SEQ ID NO: 179797 - DNA, 103 bp, Artificial Sequence
  Synthetic Polynucleotide
taatacgactcactatagggccggtctcggatctcccaggcaaacatggtaacagaggagaaccatgatggcctgggagaacctggcggcagcgcaaaagatg

SEQ ID NO: 179798 - DNA, 103 bp, Artificial Sequence
  Synthetic Polynucleotide
taatacgactcactatagggcagccaggagccggtctcggatctcccaggaacagaggagacctgggatgtccgagaccaacctggcggcagcgcaaaagatg

SEQ ID NO: 179799 - DNA, 103 bp, Artificial Sequence
  Synthetic Polynucleotide
taatacgactcactatagggcagacgccctcagccaggagccggtctcggaacagaggagaccgagaatggctcctggcaacctggcggcagcgcaaaagatg

SEQ ID NO: 179800 - DNA, 103 bp, Artificial Sequence
  Synthetic Polynucleotide
taatacgactcactataggggtcattgtcacagacgccctcagccaggagaacagaggagactcctgatggagggcgtcaacctggcggcagcgcaaaagatg

SEQ ID NO: 179801 - DNA, 103 bp, Artificial Sequence
  Synthetic Polynucleotide
taatacgactcactatagggtgggcacagtgtcattgtcacagacgccctaacagaggagaagggcgatggtgacaatgaacctggcggcagcgcaaaagatg

SEQ ID NO: 179802 - DNA, 103 bp, Artificial Sequence
  Synthetic Polynucleotide
taatacgactcactataggggagctgacactgggcacagtgtcattgtcaaacagaggagatgacaaatgcactgtgccaacctggcggcagcgcaaaagatg

SEQ ID NO: 179803 - DNA, 103 bp, Artificial Sequence
  Synthetic Polynucleotide
taatacgactcactatagggtctattaatggagctgacactgggcacagtaacagaggagaactgtgatgagtgtcagcaacctggcggcagcgcaaaagatg

SEQ ID NO: 179804 - DNA, 103 bp, Artificial Sequence
  Synthetic Polynucleotide
taatacgactcactatagggtccggatgattctattaatggagctgacacaacagaggagagtgtcaatgccattaataaacctggcggcagcgcaaaagatg

SEQ ID NO: 179805 - DNA, 103 bp, Artificial Sequence
  Synthetic Polynucleotide
taatacgactcactatagggtgcactttggtccggatgattctattaatgaacagaggagacattaaatgaatcatccgaacctggcggcagcgcaaaagatg

SEQ ID NO: 179806 - DNA, 103 bp, Artificial Sequence
  Synthetic Polynucleotide
taatacgactcactatagggaaaggcccctcccagctggttcagccctccaacagaggagaggagggatgaaccagctgaacctggcggcagcgcaaaagatg

SEQ ID NO: 179807 - DNA, 103 bp, Artificial Sequence
  Synthetic Polynucleotide
taatacgactcactataggggaatggttgctgcactttggtccggatgataacagaggagaatcatcatgaccaaagtgaacctggcggcagcgcaaaagatg

SEQ ID NO: 179808 - DNA, 103 bp, Artificial Sequence
  Synthetic Polynucleotide
taatacgactcactatagggtagggaggttgaatggttgctgcactttggaacagaggagaccaaagatgagcaaccataacctggcggcagcgcaaaagatg

SEQ ID NO: 179809 - DNA, 103 bp, Artificial Sequence
  Synthetic Polynucleotide
taatacgactcactatagggcagctgtccatagggaggttgaatggttgcaacagaggagagcaaccatgcaacctcccaacctggcggcagcgcaaaagatg

SEQ ID NO: 179810 - DNA, 103 bp, Artificial Sequence
  Synthetic Polynucleotide
taatacgactcactatagggggtggccacgcagctgtccatagggaggttaacagaggagaaacctcatgatggacagcaacctggcggcagcgcaaaagatg

SEQ ID NO: 179811 - DNA, 103 bp, Artificial Sequence
  Synthetic Polynucleotide
taatacgactcactatagggtcagggacttggtggccacgcagctgtccaaacagaggagatggacaatggcgtggccaaacctggcggcagcgcaaaagatg

SEQ ID NO: 179812 - DNA, 103 bp, Artificial Sequence
  Synthetic Polynucleotide
taatacgactcactatagggtgtccgggactcagggacttggtggccacgaacagaggagacgtggcatgcaagtccctaacctggcggcagcgcaaaagatg

SEQ ID NO: 179813 - DNA, 103 bp, Artificial Sequence
  Synthetic Polynucleotide
taatacgactcactataggggatcagcgtgtgtccgggactcagggacttaacagaggagaaagtccatgagtcccggaaacctggcggcagcgcaaaagatg

SEQ ID NO: 179814 - DNA, 103 bp, Artificial Sequence
  Synthetic Polynucleotide
taatacgactcactatagggctgagctggggatcagcgtgtgtccgggacaacagaggagagtcccgatgacacgctgaaacctggcggcagcgcaaaagatg

SEQ ID NO: 179815 - DNA, 103 bp, Artificial Sequence
  Synthetic Polynucleotide
taatacgactcactatagggggagttacagctgagctggggatcagcgtgaacagaggagacacgctatgccccagctcaacctggcggcagcgcaaaagatg

SEQ ID NO: 179816 - DNA, 103 bp, Artificial Sequence
  Synthetic Polynucleotide
taatacgactcactatagggtgactccgggggagttacagctgagctgggaacagaggagacccagcatggctgtaactaacctggcggcagcgcaaaagatg

SEQ ID NO: 179817 - DNA, 103 bp, Artificial Sequence
  Synthetic Polynucleotide
taatacgactcactatagggtgccattcacaaaggcccctcccagctggtaacagaggagaaccagcatggaggggcctaacctggcggcagcgcaaaagatg

SEQ ID NO: 179818 - DNA, 103 bp, Artificial Sequence
  Synthetic Polynucleotide
taatacgactcactatagggccgactggggtgactccgggggagttacagaacagaggagactgtaaatgccccggagtaacctggcggcagcgcaaaagatg

SEQ ID NO: 179819 - DNA, 103 bp, Artificial Sequence
  Synthetic Polynucleotide
taatacgactcactatagggcccagggaatccgactggggtgactccgggaacagaggagacccggaatgaccccagtcaacctggcggcagcgcaaaagatg

SEQ ID NO: 179820 - DNA, 103 bp, Artificial Sequence
  Synthetic Polynucleotide
taatacgactcactataggggtaggtggagcccagggaatccgactggggaacagaggagaccccagatggattccctgaacctggcggcagcgcaaaagatg

SEQ ID NO: 179821 - DNA, 103 bp, Artificial Sequence
  Synthetic Polynucleotide
taatacgactcactatagggcattgatggagtaggtggagcccagggaataacagaggagaattcccatggctccacctaacctggcggcagcgcaaaagatg

SEQ ID NO: 179822 - DNA, 103 bp, Artificial Sequence
  Synthetic Polynucleotide
taatacgactcactatagggcccaggagcccattgatggagtaggtggagaacagaggagactccacatgctccatcaaaacctggcggcagcgcaaaagatg

SEQ ID NO: 179823 - DNA, 103 bp, Artificial Sequence
  Synthetic Polynucleotide
taatacgactcactatagggctgagcgatgcccaggagcccattgatggaaacagaggagatccatcatggggctcctgaacctggcggcagcgcaaaagatg

SEQ ID NO: 179824 - DNA, 103 bp, Artificial Sequence
  Synthetic Polynucleotide
taatacgactcactatagggcgctgccaggctgagcgatgcccaggagccaacagaggagaggctccatggcatcgctcaacctggcggcagcgcaaaagatg

SEQ ID NO: 179825 - DNA, 103 bp, Artificial Sequence
  Synthetic Polynucleotide
taatacgactcactatagggttcctcttgtcgctgccaggctgagcgatgaacagaggagacatcgcatggcctggcagaacctggcggcagcgcaaaagatg

SEQ ID NO: 179826 - DNA, 103 bp, Artificial Sequence
  Synthetic Polynucleotide
taatacgactcactataggggtcatccattttcctcttgtcgctgccaggaacagaggagacctggcatggacaagaggaacctggcggcagcgcaaaagatg

SEQ ID NO: 179827 - DNA, 103 bp, Artificial Sequence
  Synthetic Polynucleotide
taatacgactcactatagggcctgatcactgtcatccattttcctcttgtaacagaggagaacaagaatgaaatggatgaacctggcggcagcgcaaaagatg

SEQ ID NO: 179828 - DNA, 103 bp, Artificial Sequence
  Synthetic Polynucleotide
taatacgactcactatagggggcagaggtctgccattcacaaaggcccctaacagaggagaaggggcatgtgtgaatggaacctggcggcagcgcaaaagatg

SEQ ID NO: 179829 - DNA, 103 bp, Artificial Sequence
  Synthetic Polynucleotide
taatacgactcactatagggcggcagctatcctgatcactgtcatccattaacagaggagaaatggaatgcagtgatcaaacctggcggcagcgcaaaagatg

SEQ ID NO: 179830 - DNA, 103 bp, Artificial Sequence
  Synthetic Polynucleotide
taatacgactcactatagggaatgcttagtcggcagctatcctgatcactaacagaggagaagtgatatggatagctgcaacctggcggcagcgcaaaagatg

SEQ ID NO: 179831 - DNA, 103 bp, Artificial Sequence
  Synthetic Polynucleotide
taatacgactcactatagggtctgtgagtcaatgcttagtcggcagctataacagaggagaatagctatggactaagcaaacctggcggcagcgcaaaagatg

SEQ ID NO: 179832 - DNA, 103 bp, Artificial Sequence
  Synthetic Polynucleotide
taatacgactcactatagggctgctgctgctctgtgagtcaatgcttagtaacagaggagaactaagatgtgactcacaaacctggcggcagcgcaaaagatg

SEQ ID NO: 179833 - DNA, 103 bp, Artificial Sequence
  Synthetic Polynucleotide
taatacgactcactatagggtcggggtccgctgctgctgctctgtgagtcaacagaggagagactcaatgagcagcagcaacctggcggcagcgcaaaagatg

SEQ ID NO: 179834 - DNA, 103 bp, Artificial Sequence
  Synthetic Polynucleotide
taatacgactcactataggggaaggtgctttcggggtccgctgctgctgcaacagaggagagcagcaatggcggaccccaacctggcggcagcgcaaaagatg

SEQ ID NO: 179835 - DNA, 103 bp, Artificial Sequence
  Synthetic Polynucleotide
taatacgactcactataggggcatccgtgcgaaggtgctttcggggtccgaacagaggagacggaccatgaaagcacctaacctggcggcagcgcaaaagatg

SEQ ID NO: 179836 - DNA, 103 bp, Artificial Sequence
  Synthetic Polynucleotide
taatacgactcactatagggctggctgaaggcatccgtgcgaaggtgcttaacagaggagaaagcacatgcgcacggataacctggcggcagcgcaaaagatg

SEQ ID NO: 179837 - DNA, 103 bp, Artificial Sequence
  Synthetic Polynucleotide
taatacgactcactatagggcgaggtggtgctggctgaaggcatccgtgcaacagaggagagcacggatgccttcagccaacctggcggcagcgcaaaagatg

SEQ ID NO: 179838 - DNA, 103 bp, Artificial Sequence
  Synthetic Polynucleotide
taatacgactcactatagggtcgagcggctcgaggtggtgctggctgaagaacagaggagacttcagatggcaccacctaacctggcggcagcgcaaaagatg

SEQ ID NO: 179839 - DNA, 103 bp, Artificial Sequence
  Synthetic Polynucleotide
taatacgactcactataggggaccacttccggcagaggtctgccattcacaacagaggagagtgaatatgagacctctgaacctggcggcagcgcaaaagatg

SEQ ID NO: 179840 - DNA, 103 bp, Artificial Sequence
  Synthetic Polynucleotide
taatacgactcactatagggaaatgggcactcgagcggctcgaggtggtgaacagaggagacaccacatggagccgctcaacctggcggcagcgcaaaagatg

SEQ ID NO: 179841 - DNA, 103 bp, Artificial Sequence
  Synthetic Polynucleotide
taatacgactcactataggggctgccgctcaaatgggcactcgagcggctaacagaggagaagccgcatgagtgcccataacctggcggcagcgcaaaagatg

SEQ ID NO: 179842 - DNA, 103 bp, Artificial Sequence
  Synthetic Polynucleotide
taatacgactcactatagggtctgggtagtgctgccgctcaaatgggcacaacagaggagagtgcccatgtgagcggcaaacctggcggcagcgcaaaagatg

SEQ ID NO: 179843 - DNA, 103 bp, Artificial Sequence
  Synthetic Polynucleotide
taatacgactcactatagggggcataggcctctgggtagtgctgccgctcaacagaggagagagcggatgcactacccaaacctggcggcagcgcaaaagatg

SEQ ID NO: 179844 - DNA, 103 bp, Artificial Sequence
  Synthetic Polynucleotide
taatacgactcactatagggggctgggggaggcataggcctctgggtagtaacagaggagaactaccatgaggcctatgaacctggcggcagcgcaaaagatg

SEQ ID NO: 179845 - DNA, 103 bp, Artificial Sequence
  Synthetic Polynucleotide
taatacgactcactatagggcctttggtgtggctgggggaggcataggccaacagaggagaggcctaatgctcccccagaacctggcggcagcgcaaaagatg

SEQ ID NO: 179846 - DNA, 103 bp, Artificial Sequence
  Synthetic Polynucleotide
taatacgactcactataggggccctgctcgcctttggtgtggctgggggaaacagaggagatcccccatgcacaccaaaaacctggcggcagcgcaaaagatg

SEQ ID NO: 179847 - DNA, 103 bp, Artificial Sequence
  Synthetic Polynucleotide
taatacgactcactatagggaccatctctcgccctgctcgcctttggtgtaacagaggagaacaccaatggcgagcaggaacctggcggcagcgcaaaagatg

SEQ ID NO: 179848 - DNA, 103 bp, Artificial Sequence
  Synthetic Polynucleotide
taatacgactcactatagggcgtgggccccaccatctctcgccctgctcgaacagaggagacgagcaatgcgagagatgaacctggcggcagcgcaaaagatg

SEQ ID NO: 179849 - DNA, 103 bp, Artificial Sequence
  Synthetic Polynucleotide
taatacgactcactatagggatccgggcagcgtgggccccaccatctctcaacagaggagagagagaatgtggggcccaaacctggcggcagcgcaaaagatg

SEQ ID NO: 179850 - DNA, 103 bp, Artificial Sequence
  Synthetic Polynucleotide
taatacgactcactatagggtgcgctggcggaccacttccggcagaggtcaacagaggagagacctcatgcggaagtggaacctggcggcagcgcaaaagatg

SEQ ID NO: 179851 - DNA, 103 bp, Artificial Sequence
  Synthetic Polynucleotide
taatacgactcactatagggtggggtgggtatccgggcagcgtgggccccaacagaggagaggggccatggctgcccggaacctggcggcagcgcaaaagatg

SEQ ID NO: 179852 - DNA, 103 bp, Artificial Sequence
  Synthetic Polynucleotide
taatacgactcactatagggggtggggatgtggggtgggtatccgggcagaacagaggagactgcccatgtacccacccaacctggcggcagcgcaaaagatg

SEQ ID NO: 179853 - DNA, 103 bp, Artificial Sequence
  Synthetic Polynucleotide
taatacgactcactatagggcctgtccgctggtggggatgtggggtgggtaacagaggagaacccacatgacatccccaaacctggcggcagcgcaaaagatg

SEQ ID NO: 179854 - DNA, 103 bp, Artificial Sequence
  Synthetic Polynucleotide
taatacgactcactataggggcatagctgccctgtccgctggtggggatgaacagaggagacatcccatgcagcggacaaacctggcggcagcgcaaaagatg

SEQ ID NO: 179855 - DNA, 103 bp, Artificial Sequence
  Synthetic Polynucleotide
taatacgactcactatagggggcagaggaggcatagctgccctgtccgctaacagaggagaagcggaatgggcagctataacctggcggcagcgcaaaagatg

SEQ ID NO: 179856 - DNA, 103 bp, Artificial Sequence
  Synthetic Polynucleotide
taatacgactcactatagggtgcctgcgatggcagaggaggcatagctgcaacagaggagagcagctatgcctcctctgaacctggcggcagcgcaaaagatg

SEQ ID NO: 179857 - DNA, 103 bp, Artificial Sequence
  Synthetic Polynucleotide
taatacgactcactatagggcctgccaccatgcctgcgatggcagaggagaacagaggagactcctcatgcatcgcaggaacctggcggcagcgcaaaagatg

SEQ ID NO: 179858 - DNA, 103 bp, Artificial Sequence
  Synthetic Polynucleotide
taatacgactcactataggggtattcacttcctgccaccatgcctgcgataacagaggagaatcgcaatgatggtggcaaacctggcggcagcgcaaaagatg

SEQ ID NO: 179859 - DNA, 103 bp, Artificial Sequence
  Synthetic Polynucleotide
taatacgactcactatagggcattgccagagtattcacttcctgccaccaaacagaggagatggtggatggaagtgaataacctggcggcagcgcaaaagatg

SEQ ID NO: 179860 - DNA, 103 bp, Artificial Sequence
  Synthetic Polynucleotide
taatacgactcactatagggtggccataggcattgccagagtattcacttaacagaggagaaagtgaatgctctggcaaaacctggcggcagcgcaaaagatg

SEQ ID NO: 179861 - DNA, 103 bp, Artificial Sequence
  Synthetic Polynucleotide
taatacgactcactatagggaggtctacgatgcgctggcggaccacttccaacagaggagaggaagtatgccgccagcgaacctggcggcagcgcaaaagatg

SEQ ID NO: 179862 - DNA, 103 bp, Artificial Sequence
  Synthetic Polynucleotide
taatacgactcactataggggtagggggtgtggccataggcattgccagaaacagaggagatctggcatggcctatggcaacctggcggcagcgcaaaagatg

SEQ ID NO: 179863 - DNA, 103 bp, Artificial Sequence
  Synthetic Polynucleotide
taatacgactcactatagggtgtaggaggagtagggggtgtggccataggaacagaggagacctatgatgacaccccctaacctggcggcagcgcaaaagatg

SEQ ID NO: 179864 - DNA, 103 bp, Artificial Sequence
  Synthetic Polynucleotide
taatacgactcactatagggcaggcctcgctgtaggaggagtagggggtgaacagaggagacaccccatgctcctcctaaacctggcggcagcgcaaaagatg

SEQ ID NO: 179865 - DNA, 103 bp, Artificial Sequence
  Synthetic Polynucleotide
taatacgactcactatagggggggaagcgccaggcctcgctgtaggaggaaacagaggagatcctccatgagcgaggccaacctggcggcagcgcaaaagatg

SEQ ID NO: 179866 - DNA, 103 bp, Artificial Sequence
  Synthetic Polynucleotide
taatacgactcactatagggagctggagttggggaagcgccaggcctcgcaacagaggagagcgaggatgggcgcttccaacctggcggcagcgcaaaagatg

SEQ ID NO: 179867 - DNA, 103 bp, Artificial Sequence
  Synthetic Polynucleotide
taatacgactcactatagggctggttcacctccccgaaggctggctccataacagaggagaatggagatggccttcgggaacctggcggcagcgcaaaagatg

SEQ ID NO: 179868 - DNA, 103 bp, Artificial Sequence
  Synthetic Polynucleotide
taatacgactcactatagggacacggtcggatgcccagttgggccagttcaacagaggagagaactgatgcaactgggcaacctggcggcagcgcaaaagatg

SEQ ID NO: 179869 - DNA, 103 bp, Artificial Sequence
  Synthetic Polynucleotide
taatacgactcactatagggcgcggaagccgtgacagaatgactaccttcaacagaggagagaaggtatgcattctgtcaacctggcggcagcgcaaaagatg

SEQ ID NO: 179870 - DNA, 103 bp, Artificial Sequence
  Synthetic Polynucleotide
taatacgactcactatagggggctgatgtcacacggtcggatgcccagttaacagaggagaaactggatgtccgaccgtaacctggcggcagcgcaaaagatg

SEQ ID NO: 179871 - DNA, 103 bp, Artificial Sequence
  Synthetic Polynucleotide
taatacgactcactatagggcgtagctggcggctgatgtcacacggtcggaacagaggagaccgaccatgtgacatcagaacctggcggcagcgcaaaagatg

SEQ ID NO: 179872 - DNA, 103 bp, Artificial Sequence
  Synthetic Polynucleotide
taatacgactcactataggggtgcgagacccgtagctggcggctgatgtcaacagaggagagacatcatgcgccagctaaacctggcggcagcgcaaaagatg

SEQ ID NO: 179873 - DNA, 103 bp, Artificial Sequence
  Synthetic Polynucleotide
taatacgactcactatagggtgacgcagccgtgcgagacccgtagctggcaacagaggagagccagcatggggtctcgcaacctggcggcagcgcaaaagatg

SEQ ID NO: 179874 - DNA, 103 bp, Artificial Sequence
  Synthetic Polynucleotide
taatacgactcactatagggaggatcttgctgacgcagccgtgcgagaccaacagaggagaggtctcatgcggctgcgtaacctggcggcagcgcaaaagatg

SEQ ID NO: 179875 - DNA, 103 bp, Artificial Sequence
  Synthetic Polynucleotide
taatacgactcactataggggtatcgcgccaggatcttgctgacgcagccaacagaggagaggctgcatgagcaagatcaacctggcggcagcgcaaaagatg

SEQ ID NO: 179876 - DNA, 103 bp, Artificial Sequence
  Synthetic Polynucleotide
taatacgactcactatagggccgtctcgttgtatcgcgccaggatcttgcaacagaggagagcaagaatgtggcgcgataacctggcggcagcgcaaaagatg

SEQ ID NO: 179877 - DNA, 103 bp, Artificial Sequence
  Synthetic Polynucleotide
taatacgactcactatagggaagatcgagcccgtctcgttgtatcgcgccaacagaggagaggcgcgatgcaacgagacaacctggcggcagcgcaaaagatg

SEQ ID NO: 179878 - DNA, 103 bp, Artificial Sequence
  Synthetic Polynucleotide
taatacgactcactatagggggctcctggcaagatcgagcccgtctcgttaacagaggagaaacgagatgggctcgatcaacctggcggcagcgcaaaagatg

SEQ ID NO: 179879 - DNA, 103 bp, Artificial Sequence
  Synthetic Polynucleotide
taatacgactcactatagggctcctcccagctggttcacctccccgaaggaacagaggagaccttcgatgaggtgaaccaacctggcggcagcgcaaaagatg

SEQ ID NO: 179880 - DNA, 103 bp, Artificial Sequence
  Synthetic Polynucleotide
taatacgactcactatagggtgcccccgatggctcctggcaagatcgagcaacagaggagagctcgaatgtgccaggagaacctggcggcagcgcaaaagatg

SEQ ID NO: 179881 - DNA, 103 bp, Artificial Sequence
  Synthetic Polynucleotide
taatacgactcactatagggcggggcttgctgcccccgatggctcctggcaacagaggagagccaggatgcatcgggggaacctggcggcagcgcaaaagatg

SEQ ID NO: 179882 - DNA, 103 bp, Artificial Sequence
  Synthetic Polynucleotide
taatacgactcactatagggggtagtgacccggggcttgctgcccccgataacagaggagaatcgggatgagcaagcccaacctggcggcagcgcaaaagatg

SEQ ID NO: 179883 - DNA, 103 bp, Artificial Sequence
  Synthetic Polynucleotide
taatacgactcactatagggccacggtgggggtagtgacccggggcttgcaacagaggagagcaagcatggggtcactaaacctggcggcagcgcaaaagatg

SEQ ID NO: 179884 - DNA, 103 bp, Artificial Sequence
  Synthetic Polynucleotide
taatacgactcactatagggatgtgtttcaccacggtgggggtagtgaccaacagaggagaggtcacatgccccaccgtaacctggcggcagcgcaaaagatg

SEQ ID NO: 179885 - DNA, 103 bp, Artificial Sequence
  Synthetic Polynucleotide
taatacgactcactataggggtaggtccggatgtgtttcaccacggtgggaacagaggagacccaccatggtgaaacacaacctggcggcagcgcaaaagatg

SEQ ID NO: 179886 - DNA, 103 bp, Artificial Sequence
  Synthetic Polynucleotide
taatacgactcactatagggctctctgcttgtaggtccggatgtgtttcaaacagaggagatgaaacatgtccggacctaacctggcggcagcgcaaaagatg

SEQ ID NO: 179887 - DNA, 103 bp, Artificial Sequence
  Synthetic Polynucleotide
taatacgactcactatagggatgccggggtctctctgcttgtaggtccggaacagaggagaccggacatgcaagcagagaacctggcggcagcgcaaaagatg

SEQ ID NO: 179888 - DNA, 103 bp, Artificial Sequence
  Synthetic Polynucleotide
taatacgactcactatagggccaggcgaagatgccggggtctctctgcttaacagaggagaaagcagatggaccccggcaacctggcggcagcgcaaaagatg

SEQ ID NO: 179889 - DNA, 103 bp, Artificial Sequence
  Synthetic Polynucleotide
taatacgactcactatagggcccggatctcccaggcgaagatgccggggtaacagaggagaaccccgatgtcttcgcctaacctggcggcagcgcaaaagatg

SEQ ID NO: 179890 - DNA, 103 bp, Artificial Sequence
  Synthetic Polynucleotide
taatacgactcactatagggttcacgaacactcctcccagctggttcaccaacagaggagaggtgaaatggctgggaggaacctggcggcagcgcaaaagatg

SEQ ID NO: 179891 - DNA, 103 bp, Artificial Sequence
  Synthetic Polynucleotide
taatacgactcactatagggagcaggcggtcccggatctcccaggcgaagaacagaggagacttcgcatgggagatccgaacctggcggcagcgcaaaagatg

SEQ ID NO: 179892 - DNA, 103 bp, Artificial Sequence
  Synthetic Polynucleotide
taatacgactcactataggggccgtccgccagcaggcggtcccggatctcaacagaggagagagatcatggaccgcctgaacctggcggcagcgcaaaagatg

SEQ ID NO: 179893 - DNA, 103 bp, Artificial Sequence
  Synthetic Polynucleotide
taatacgactcactatagggtgtcgcacacgccgtccgccagcaggcggtaacagaggagaaccgccatgtggcggacgaacctggcggcagcgcaaaagatg

SEQ ID NO: 179894 - DNA, 103 bp, Artificial Sequence
  Synthetic Polynucleotide
taatacgactcactatagggacattgtacttgtcgcacacgccgtccgccaacagaggagaggcggaatgcgtgtgcgaaacctggcggcagcgcaaaagatg

SEQ ID NO: 179895 - DNA, 103 bp, Artificial Sequence
  Synthetic Polynucleotide
taatacgactcactatagggcacggagggcacattgtacttgtcgcacacaacagaggagagtgtgcatgaagtacaataacctggcggcagcgcaaaagatg

SEQ ID NO: 179896 - DNA, 103 bp, Artificial Sequence
  Synthetic Polynucleotide
taatacgactcactatagggtgatggagctcacggagggcacattgtactaacagaggagaagtacaatgtgccctccgaacctggcggcagcgcaaaagatg

SEQ ID NO: 179897 - DNA, 103 bp, Artificial Sequence
  Synthetic Polynucleotide
taatacgactcactatagggagaatgcggctgatggagctcacggagggcaacagaggagagccctcatggagctccataacctggcggcagcgcaaaagatg

SEQ ID NO: 179898 - DNA, 103 bp, Artificial Sequence
  Synthetic Polynucleotide
taatacgactcactatagggcttgttgcgcagaatgcggctgatggagctaacagaggagaagctccatgagccgcattaacctggcggcagcgcaaaagatg

SEQ ID NO: 179899 - DNA, 103 bp, Artificial Sequence
  Synthetic Polynucleotide
taatacgactcactatagggagttgccgatcttgttgcgcagaatgcggcaacagaggagagccgcaatgtgcgcaacaaacctggcggcagcgcaaaagatg

SEQ ID NO: 179900 - DNA, 103 bp, Artificial Sequence
  Synthetic Polynucleotide
taatacgactcactatagggtgctgggccaagttgccgatcttgttgcgcaacagaggagagcgcaaatggatcggcaaaacctggcggcagcgcaaaagatg

SEQ ID NO: 179901 - DNA, 103 bp, Artificial Sequence
  Synthetic Polynucleotide
taatacgactcactatagggcggcctcccgttcacgaacactcctcccagaacagaggagactgggaatggtgttcgtgaacctggcggcagcgcaaaagatg

SEQ ID NO: 179902 - DNA, 103 bp, Artificial Sequence
  Synthetic Polynucleotide
taatacgactcactataggggtaatgaccctgctgggccaagttgccgataacagaggagaatcggcatgttggcccagaacctggcggcagcgcaaaagatg

SEQ ID NO: 179903 - DNA, 103 bp, Artificial Sequence
  Synthetic Polynucleotide
taatacgactcactatagggtgtatgagtcgtaatgaccctgctgggccaaacagaggagatggcccatgagggtcattaacctggcggcagcgcaaaagatg

SEQ ID NO: 179904 - DNA, 103 bp, Artificial Sequence
  Synthetic Polynucleotide
taatacgactcactatagggtggtgctgcttgtatgagtcgtaatgacccaacagaggagagggtcaatgcgactcataaacctggcggcagcgcaaaagatg

SEQ ID NO: 179905 - DNA, 103 bp, Artificial Sequence
  Synthetic Polynucleotide
taatacgactcactatagggcggcgtcggctggtgctgcttgtatgagtcaacagaggagagactcaatgaagcagcacaacctggcggcagcgcaaaagatg

SEQ ID NO: 179906 - DNA, 103 bp, Artificial Sequence
  Synthetic Polynucleotide
taatacgactcactataggggcgctggctgcggcgtcggctggtgctgctaacagaggagaagcagcatgagccgacgcaacctggcggcagcgcaaaagatg

SEQ ID NO: 179907 - DNA, 103 bp, Artificial Sequence
  Synthetic Polynucleotide
taatacgactcactatagggttgtagggcagcgctggctgcggcgtcggcaacagaggagagccgacatggcagccagcaacctggcggcagcgcaaaagatg

SEQ ID NO: 179908 - DNA, 103 bp, Artificial Sequence
  Synthetic Polynucleotide
taatacgactcactataggggtagatgtggttgtagggcagcgctggctgaacagaggagacagccaatgctgccctacaacctggcggcagcgcaaaagatg

SEQ ID NO: 179909 - DNA, 103 bp, Artificial Sequence
  Synthetic Polynucleotide
taatacgactcactatagggtggggtacgagtagatgtggttgtagggcaaacagaggagatgccctatgaccacatctaacctggcggcagcgcaaaagatg

SEQ ID NO: 179910 - DNA, 103 bp, Artificial Sequence
  Synthetic Polynucleotide
taatacgactcactataggggtgatagggctggggtacgagtagatgtggaacagaggagaccacatatgctcgtacccaacctggcggcagcgcaaaagatg

SEQ ID NO: 179911 - DNA, 103 bp, Artificial Sequence
  Synthetic Polynucleotide
taatacgactcactatagggggccgccgccgtgatagggctggggtacgaaacagaggagatcgtacatgagccctatcaacctggcggcagcgcaaaagatg

SEQ ID NO: 179912 - DNA, 103 bp, Artificial Sequence
  Synthetic Polynucleotide
taatacgactcactatagggcgttgggcagcggcctcccgttcacgaacaaacagaggagatgttcgatgacgggaggcaacctggcggcagcgcaaaagatg

SEQ ID NO: 179913 - DNA, 103 bp, Artificial Sequence
  Synthetic Polynucleotide
taatacgactcactataggggcaccttggcggccgccgccgtgatagggcaacagaggagagccctaatgcggcggcggaacctggcggcagcgcaaaagatg

SEQ ID NO: 179914 - DNA, 103 bp, Artificial Sequence
  Synthetic Polynucleotide
taatacgactcactatagggggtggcgtgggcaccttggcggccgccgccaacagaggagaggcggcatgcgccaaggtaacctggcggcagcgcaaaagatg

SEQ ID NO: 179915 - DNA, 103 bp, Artificial Sequence
  Synthetic Polynucleotide
taatacgactcactatagggaggcaccccgggtggcgtgggcaccttggcaacagaggagagccaagatgcccacgccaaacctggcggcagcgcaaaagatg

SEQ ID NO: 179916 - DNA, 103 bp, Artificial Sequence
  Synthetic Polynucleotide
taatacgactcactatagggcggggatggcaggcaccccgggtggcgtggaacagaggagaccacgcatgccggggtgcaacctggcggcagcgcaaaagatg

SEQ ID NO: 179917 - DNA, 103 bp, Artificial Sequence
  Synthetic Polynucleotide
taatacgactcactataggggccaccgaaccggggatggcaggcaccccgaacagaggagacggggtatgtgccatcccaacctggcggcagcgcaaaagatg

SEQ ID NO: 179918 - DNA, 103 bp, Artificial Sequence
  Synthetic Polynucleotide
taatacgactcactataggggcgcggcatggccaccgaaccggggatggcaacagaggagagccatcatgggttcggtgaacctggcggcagcgcaaaagatg

SEQ ID NO: 179919 - DNA, 103 bp, Artificial Sequence
  Synthetic Polynucleotide
taatacgactcactatagggagggccaggtgcgcggcatggccaccgaacaacagaggagagttcggatgccatgccgcaacctggcggcagcgcaaaagatg

SEQ ID NO: 179920 - DNA, 103 bp, Artificial Sequence
  Synthetic Polynucleotide
taatacgactcactataggggagtgcgaggagggccaggtgcgcggcatgaacagaggagacatgccatgcacctggccaacctggcggcagcgcaaaagatg

SEQ ID NO: 179921 - DNA, 103 bp, Artificial Sequence
  Synthetic Polynucleotide
taatacgactcactataggggtcggtgacggagtgcgaggagggccaggtaacagaggagaacctggatgtcctcgcacaacctggcggcagcgcaaaagatg

SEQ ID NO: 179922 - DNA, 103 bp, Artificial Sequence
  Synthetic Polynucleotide
taatacgactcactatagggtgcccaggatgtcggtgacggagtgcgaggaacagaggagacctcgcatgccgtcaccgaacctggcggcagcgcaaaagatg

SEQ ID NO: 179923 - DNA, 103 bp, Artificial Sequence
  Synthetic Polynucleotide
taatacgactcactatagggagccggatggcgttgggcagcggcctcccgaacagaggagacgggagatggctgcccaaaacctggcggcagcgcaaaagatg

SEQ ID NO: 179924 - DNA, 103 bp, Artificial Sequence
  Synthetic Polynucleotide
taatacgactcactatagggatggagcggatgcccaggatgtcggtgacgaacagaggagacgtcacatgcatcctgggaacctggcggcagcgcaaaagatg

SEQ ID NO: 179925 - DNA, 103 bp, Artificial Sequence
  Synthetic Polynucleotide
taatacgactcactatagggttggtcggtgatggagcggatgcccaggataacagaggagaatcctgatgatccgctccaacctggcggcagcgcaaaagatg

SEQ ID NO: 179926 - DNA, 103 bp, Artificial Sequence
  Synthetic Polynucleotide
taatacgactcactatagggtgtcgctcacttggtcggtgatggagcggaaacagaggagatccgctatgtcaccgaccaacctggcggcagcgcaaaagatg

SEQ ID NO: 179927 - DNA, 103 bp, Artificial Sequence
  Synthetic Polynucleotide
taatacgactcactatagggtagggggagctgtcgctcacttggtcggtgaacagaggagacaccgaatgagtgagcgaaacctggcggcagcgcaaaagatg

SEQ ID NO: 179928 - DNA, 103 bp, Artificial Sequence
  Synthetic Polynucleotide
taatacgactcactatagggggggctgtggtagggggagctgtcgctcacaacagaggagagtgagcatgagctcccccaacctggcggcagcgcaaaagatg

SEQ ID NO: 179929 - DNA, 103 bp, Artificial Sequence
  Synthetic Polynucleotide
taatacgactcactatagggcctccaccttggggctgtggtagggggagcaacagaggagagctcccatgaccacagccaacctggcggcagcgcaaaagatg

SEQ ID NO: 179930 - DNA, 103 bp, Artificial Sequence
  Synthetic Polynucleotide
taatacgactcactatagggctgctccactcctccaccttggggctgtggaacagaggagaccacagatgcaaggtggaaacctggcggcagcgcaaaagatg

SEQ ID NO: 179931 - DNA, 103 bp, Artificial Sequence
  Synthetic Polynucleotide
taatacgactcactataggggcggcccaggctgctccactcctccaccttaacagaggagaaaggtgatggagtggagcaacctggcggcagcgcaaaagatg

SEQ ID NO: 179932 - DNA, 103 bp, Artificial Sequence
  Synthetic Polynucleotide
taatacgactcactatagggggaagttgttgcggcccaggctgctccactaacagaggagaagtggaatggcctgggccaacctggcggcagcgcaaaagatg

SEQ ID NO: 179933 - DNA, 103 bp, Artificial Sequence
  Synthetic Polynucleotide
taatacgactcactataggggcggcggcggggaagttgttgcggcccaggaacagaggagacctgggatgcaacaacttaacctggcggcagcgcaaaagatg

SEQ ID NO: 179934 - DNA, 103 bp, Artificial Sequence
  Synthetic Polynucleotide
taatacgactcactatagggcacgatgcgaagccggatggcgttgggcagaacagaggagactgcccatggccatccggaacctggcggcagcgcaaaagatg

SEQ ID NO: 179935 - DNA, 103 bp, Artificial Sequence
  Synthetic Polynucleotide
taatacgactcactatagggcgcgtgcggggcggcggcggggaagttgttaacagaggagaaacaacatgcccgccgccaacctggcggcagcgcaaaagatg

SEQ ID NO: 179936 - DNA, 103 bp, Artificial Sequence
  Synthetic Polynucleotide
taatacgactcactatagggacccgttcaccgcgtgcggggcggcggcggaacagaggagaccgccgatgccccgcacgaacctggcggcagcgcaaaagatg

SEQ ID NO: 179937 - DNA, 103 bp, Artificial Sequence
  Synthetic Polynucleotide
taatacgactcactatagggcccttctccaacccgttcaccgcgtgcgggaacagaggagacccgcaatgggtgaacggaacctggcggcagcgcaaaagatg

SEQ ID NO: 179938 - DNA, 103 bp, Artificial Sequence
  Synthetic Polynucleotide
taatacgactcactatagggctccagggctcccttctccaacccgttcacaacagaggagagtgaacatgttggagaagaacctggcggcagcgcaaaagatg

SEQ ID NO: 179939 - DNA, 103 bp, Artificial Sequence
  Synthetic Polynucleotide
taatacgactcactatagggtggcttcctgctccagggctcccttctccaaacagaggagatggagaatggagccctggaacctggcggcagcgcaaaagatg

SEQ ID NO: 179940 - DNA, 103 bp, Artificial Sequence
  Synthetic Polynucleotide
taatacgactcactatagggtgaccgtacttggcttcctgctccagggctaacagaggagaagccctatggcaggaagcaacctggcggcagcgcaaaagatg

SEQ ID NO: 179941 - DNA, 103 bp, Artificial Sequence
  Synthetic Polynucleotide
taatacgactcactatagggatttggtgcctgaccgtacttggcttcctgaacagaggagacaggaaatgaagtacggtaacctggcggcagcgcaaaagatg

SEQ ID NO: 179942 - DNA, 103 bp, Artificial Sequence
  Synthetic Polynucleotide
taatacgactcactatagggctgggagaccatttggtgcctgaccgtactaacagaggagaagtacgatgaggcaccaaaacctggcggcagcgcaaaagatg

SEQ ID NO: 179943 - DNA, 103 bp, Artificial Sequence
  Synthetic Polynucleotide
taatacgactcactatagggctgcccacagctgggagaccatttggtgccaacagaggagaggcaccatgtggtctcccaacctggcggcagcgcaaaagatg

SEQ ID NO: 179944 - DNA, 103 bp, Artificial Sequence
  Synthetic Polynucleotide
taatacgactcactatagggtgacacaaaactgcccacagctgggagaccaacagaggagaggtctcatggctgtgggcaacctggcggcagcgcaaaagatg

SEQ ID NO: 179945 - DNA, 103 bp, Artificial Sequence
  Synthetic Polynucleotide
taatacgactcactataggggggccagttccacgatgcgaagccggatggaacagaggagaccatccatgttcgcatcgaacctggcggcagcgcaaaagatg

SEQ ID NO: 179946 - DNA, 103 bp, Artificial Sequence
  Synthetic Polynucleotide
taatacgactcactatagggtgctggatgctgacacaaaactgcccacagaacagaggagactgtggatggttttgtgtaacctggcggcagcgcaaaagatg

SEQ ID NO: 179947 - DNA, 103 bp, Artificial Sequence
  Synthetic Polynucleotide
taatacgactcactatagggtaaggagccatgctggatgctgacacaaaaaacagaggagattttgtatgagcatccagaacctggcggcagcgcaaaagatg

SEQ ID NO: 179948 - DNA, 103 bp, Artificial Sequence
  Synthetic Polynucleotide
taatacgactcactatagggtggggtagggtaaggagccatgctggatgcaacagaggagagcatccatgatggctcctaacctggcggcagcgcaaaagatg

SEQ ID NO: 179949 - DNA, 103 bp, Artificial Sequence
  Synthetic Polynucleotide
taatacgactcactatagggacacttgggctggggtagggtaaggagccaaacagaggagatggctcatgaccctacccaacctggcggcagcgcaaaagatg

SEQ ID NO: 179950 - DNA, 103 bp, Artificial Sequence
  Synthetic Polynucleotide
taatacgactcactatagggatgtaaggcgacacttgggctggggtagggaacagaggagaccctacatgagcccaagtaacctggcggcagcgcaaaagatg

SEQ ID NO: 179951 - DNA, 103 bp, Artificial Sequence
  Synthetic Polynucleotide
taatacgactcactatagggactgtaggtcatgtaaggcgacacttgggcaacagaggagagcccaaatgtcgccttacaacctggcggcagcgcaaaagatg

SEQ ID NO: 179952 - DNA, 103 bp, Artificial Sequence
  Synthetic Polynucleotide
taatacgactcactatagggaaggagcagcactgtaggtcatgtaaggcgaacagaggagacgccttatgtgacctacaaacctggcggcagcgcaaaagatg

SEQ ID NO: 179953 - DNA, 103 bp, Artificial Sequence
  Synthetic Polynucleotide
taatacgactcactatagggacataaccagaaggagcagcactgtaggtcaacagaggagagacctaatgtgctgctccaacctggcggcagcgcaaaagatg

SEQ ID NO: 179954 - DNA, 103 bp, Artificial Sequence
  Synthetic Polynucleotide
taatacgactcactatagggatgtccagcaacataaccagaaggagcagcaacagaggagagctgctatgtctggttataacctggcggcagcgcaaaagatg

SEQ ID NO: 179955 - DNA, 103 bp, Artificial Sequence
  Synthetic Polynucleotide
taatacgactcactataggggttgccacccatgtccagcaacataaccagaacagaggagactggttatgttgctggacaacctggcggcagcgcaaaagatg

SEQ ID NO: 179956 - DNA, 103 bp, Artificial Sequence
  Synthetic Polynucleotide
taatacgactcactatagggatgcccagttgggccagttccacgatgcgaaacagaggagatcgcatatgggaactggcaacctggcggcagcgcaaaagatg

SEQ ID NO: 179957 - DNA, 103 bp, Artificial Sequence
  Synthetic Polynucleotide
taatacgactcactatagggcccccagcatgttgccacccatgtccagcaaacagaggagatgctggatgtgggtggcaaacctggcggcagcgcaaaagatg

SEQ ID NO: 179958 - DNA, 103 bp, Artificial Sequence
  Synthetic Polynucleotide
taatacgactcactatagggcaatgaggtgcccccagcatgttgccacccaacagaggagagggtggatgcatgctgggaacctggcggcagcgcaaaagatg

SEQ ID NO: 179959 - DNA, 103 bp, Artificial Sequence
  Synthetic Polynucleotide
taatacgactcactatagggtgtggggagacaatgaggtgcccccagcataacagaggagaatgctgatggcacctcataacctggcggcagcgcaaaagatg

SEQ ID NO: 179960 - DNA, 103 bp, Artificial Sequence
  Synthetic Polynucleotide
taatacgactcactatagggatgtcacagttgtggggagacaatgaggtgaacagaggagacacctcatggtctccccaaacctggcggcagcgcaaaagatg

SEQ ID NO: 179961 - DNA, 103 bp, Artificial Sequence
  Synthetic Polynucleotide
taatacgactcactatagggcgatgccggaatgtcacagttgtggggagaaacagaggagatctcccatgaactgtgacaacctggcggcagcgcaaaagatg

SEQ ID NO: 179962 - DNA, 103 bp, Artificial Sequence
  Synthetic Polynucleotide
taatacgactcactatagggtgaacgccagcgatgccggaatgtcacagtaacagaggagaactgtgatgttccggcataacctggcggcagcgcaaaagatg

SEQ ID NO: 179963 - DNA, 103 bp, Artificial Sequence
  Synthetic Polynucleotide
taatacgactcactatagggtgcattcccttgaacgccagcgatgccggaaacagaggagatccggcatggctggcgttaacctggcggcagcgcaaaagatg

SEQ ID NO: 179964 - DNA, 103 bp, Artificial Sequence
  Synthetic Polynucleotide
taatacgactcactatagggtctggctgcctgcattcccttgaacgccagaacagaggagactggcgatgaagggaatgaacctggcggcagcgcaaaagatg

SEQ ID NO: 179965 - DNA, 103 bp, Artificial Sequence
  Synthetic Polynucleotide
taatacgactcactataggggactaccttctctggctgcctgcattccctaacagaggagaagggaaatgaggcagccaaacctggcggcagcgcaaaagatg

SEQ ID NO: 179966 - DNA, 103 bp, Artificial Sequence
  Synthetic Polynucleotide
taatacgactcactataggggtgacagaatgactaccttctctggctgccaacagaggagaggcagcatgagaaggtagaacctggcggcagcgcaaaagatg

SEQ ID NO: 179967 - DNA, 103 bp, Artificial Sequence
  Synthetic Polynucleotide
taatacgactcactatagggcacgttcacccgccgggcctttcggaacataacagaggagaatgttcatgaaggcccggaacctggcggcagcgcaaaagatg

SEQ ID NO: 179968 - DNA, 103 bp, Artificial Sequence
  Synthetic Polynucleotide
taatacgactcactatagggttcgcccgtgcccggcggcggcaacaacggaacagaggagaccgttgatgccgccgccgaacctggcggcagcgcaaaagatg

SEQ ID NO: 179969 - DNA, 103 bp, Artificial Sequence
  Synthetic Polynucleotide
taatacgactcactataggggttctggtagtacatattcacttctgcgggaacagaggagacccgcaatggtgaatatgaacctggcggcagcgcaaaagatg

SEQ ID NO: 179970 - DNA, 103 bp, Artificial Sequence
  Synthetic Polynucleotide
taatacgactcactatagggtctggtaagtgttctggtagtacatattcaaacagaggagatgaataatgactaccagaaacctggcggcagcgcaaaagatg

SEQ ID NO: 179971 - DNA, 103 bp, Artificial Sequence
  Synthetic Polynucleotide
taatacgactcactatagggtaaggcattgtctggtaagtgttctggtagaacagaggagactaccaatgcacttaccaaacctggcggcagcgcaaaagatg

SEQ ID NO: 179972 - DNA, 103 bp, Artificial Sequence
  Synthetic Polynucleotide
taatacgactcactatagggggatgagccgtaaggcattgtctggtaagtaacagaggagaacttacatgacaatgcctaacctggcggcagcgcaaaagatg

SEQ ID NO: 179973 - DNA, 103 bp, Artificial Sequence
  Synthetic Polynucleotide
taatacgactcactataggggaatgccataggatgagccgtaaggcattgaacagaggagacaatgcatgacggctcataacctggcggcagcgcaaaagatg

SEQ ID NO: 179974 - DNA, 103 bp, Artificial Sequence
  Synthetic Polynucleotide
taatacgactcactatagggtaactataaggaatgccataggatgagccgaacagaggagacggctcatgctatggcataacctggcggcagcgcaaaagatg

SEQ ID NO: 179975 - DNA, 103 bp, Artificial Sequence
  Synthetic Polynucleotide
taatacgactcactatagggataggccgtataactataaggaatgccataaacagaggagatatggcatgccttatagtaacctggcggcagcgcaaaagatg

SEQ ID NO: 179976 - DNA, 103 bp, Artificial Sequence
  Synthetic Polynucleotide
taatacgactcactatagggctgatgatccataggccgtataactataagaacagaggagacttataatgatacggcctaacctggcggcagcgcaaaagatg

SEQ ID NO: 179977 - DNA, 103 bp, Artificial Sequence
  Synthetic Polynucleotide
taatacgactcactataggggatttggcatctgatgatccataggccgtaaacagaggagatacggcatgtggatcatcaacctggcggcagcgcaaaagatg

SEQ ID NO: 179978 - DNA, 103 bp, Artificial Sequence
  Synthetic Polynucleotide
taatacgactcactatagggtgttttttgagatttggcatctgatgatccaacagaggagaggatcaatggatgccaaaaacctggcggcagcgcaaaagatg

SEQ ID NO: 179979 - DNA, 103 bp, Artificial Sequence
  Synthetic Polynucleotide
taatacgactcactatagggggcccgcctcttcgcccgtgcccggcggcgaacagaggagacgccgcatggcacgggcgaacctggcggcagcgcaaaagatg

SEQ ID NO: 179980 - DNA, 103 bp, Artificial Sequence
  Synthetic Polynucleotide
taatacgactcactatagggctgtattatctgttttttgagatttggcataacagaggagaatgccaatgctcaaaaaaaacctggcggcagcgcaaaagatg

SEQ ID NO: 179981 - DNA, 103 bp, Artificial Sequence
  Synthetic Polynucleotide
taatacgactcactatagggttgaaagggactgtattatctgttttttgaaacagaggagatcaaaaatgagataatacaacctggcggcagcgcaaaagatg

SEQ ID NO: 179982 - DNA, 103 bp, Artificial Sequence
  Synthetic Polynucleotide
taatacgactcactatagggactgggagttttgaaagggactgtattatcaacagaggagagataatatggtccctttcaacctggcggcagcgcaaaagatg

SEQ ID NO: 179983 - DNA, 103 bp, Artificial Sequence
  Synthetic Polynucleotide
taatacgactcactatagggtcatctcattactgggagttttgaaagggaaacagaggagatcccttatgaaactcccaaacctggcggcagcgcaaaagatg

SEQ ID NO: 179984 - DNA, 103 bp, Artificial Sequence
  Synthetic Polynucleotide
taatacgactcactataggggtaacgggagtcatctcattactgggagttaacagaggagaaactccatgtaatgagataacctggcggcagcgcaaaagatg

SEQ ID NO: 179985 - DNA, 103 bp, Artificial Sequence
  Synthetic Polynucleotide
taatacgactcactatagggcaaatcaatagtaacgggagtcatctcattaacagaggagaaatgagatgactcccgttaacctggcggcagcgcaaaagatg

SEQ ID NO: 179986 - DNA, 103 bp, Artificial Sequence
  Synthetic Polynucleotide
taatacgactcactataggggtttctttaccaaatcaatagtaacgggagaacagaggagactcccgatgctattgattaacctggcggcagcgcaaaagatg

SEQ ID NO: 179987 - DNA, 103 bp, Artificial Sequence
  Synthetic Polynucleotide
taatacgactcactatagggtctttaagctgtttctttaccaaatcaataaacagaggagatattgaatgggtaaagaaaacctggcggcagcgcaaaagatg

SEQ ID NO: 179988 - DNA, 103 bp, Artificial Sequence
  Synthetic Polynucleotide
taatacgactcactataggggtccaacctgtctttaagctgtttctttacaacagaggagagtaaagatgcagcttaaaaacctggcggcagcgcaaaagatg

SEQ ID NO: 179989 - DNA, 103 bp, Artificial Sequence
  Synthetic Polynucleotide
taatacgactcactatagggctttcatggagtccaacctgtctttaagctaacagaggagaagcttaatgacaggttggaacctggcggcagcgcaaaagatg

SEQ ID NO: 179990 - DNA, 103 bp, Artificial Sequence
  Synthetic Polynucleotide
taatacgactcactatagggccgccaccggggcccgcctcttcgcccgtgaacagaggagacacgggatgagaggcgggaacctggcggcagcgcaaaagatg

SEQ ID NO: 179991 - DNA, 103 bp, Artificial Sequence
  Synthetic Polynucleotide
taatacgactcactatagggttgtgcaattctttcatggagtccaacctgaacagaggagacaggttatgctccatgaaaacctggcggcagcgcaaaagatg

SEQ ID NO: 179992 - DNA, 103 bp, Artificial Sequence
  Synthetic Polynucleotide
taatacgactcactatagggtcgatttgttttgtgcaattctttcatggaaacagaggagatccatgatggaattgcacaacctggcggcagcgcaaaagatg

SEQ ID NO: 179993 - DNA, 103 bp, Artificial Sequence
  Synthetic Polynucleotide
taatacgactcactatagggcatgctgctgtcgatttgttttgtgcaattaacagaggagaaattgcatgaaacaaatcaacctggcggcagcgcaaaagatg

SEQ ID NO: 179994 - DNA, 103 bp, Artificial Sequence
  Synthetic Polynucleotide
taatacgactcactatagggagatgtttctcatgctgctgtcgatttgttaacagaggagaaacaaaatgacagcagcaaacctggcggcagcgcaaaagatg

SEQ ID NO: 179995 - DNA, 103 bp, Artificial Sequence
  Synthetic Polynucleotide
taatacgactcactatagggtcggctttgcagatgtttctcatgctgctgaacagaggagacagcagatggagaaacataacctggcggcagcgcaaaagatg

SEQ ID NO: 179996 - DNA, 103 bp, Artificial Sequence
  Synthetic Polynucleotide
taatacgactcactatagggtagagtccactcggctttgcagatgtttctaacagaggagaagaaacatgtgcaaagccaacctggcggcagcgcaaaagatg

SEQ ID NO: 179997 - DNA, 103 bp, Artificial Sequence
  Synthetic Polynucleotide
taatacgactcactatagggatagccctggtagagtccactcggctttgcaacagaggagagcaaagatgagtggactcaacctggcggcagcgcaaaagatg

SEQ ID NO: 179998 - DNA, 103 bp, Artificial Sequence
  Synthetic Polynucleotide
taatacgactcactatagggtaatctttcaatagccctggtagagtccacaacagaggagagtggacatgaccagggctaacctggcggcagcgcaaaagatg

SEQ ID NO: 179999 - DNA, 103 bp, Artificial Sequence
  Synthetic Polynucleotide
taatacgactcactatagggaagacccttctaatctttcaatagccctggaacagaggagaccagggatgttgaaagataacctggcggcagcgcaaaagatg

SEQ ID NO: 180000 - DNA, 103 bp, Artificial Sequence
  Synthetic Polynucleotide
taatacgactcactatagggatacccccagaagacccttctaatctttcaaacagaggagatgaaagatgagaagggtcaacctggcggcagcgcaaaagatg

SEQ ID NO: 180001 - DNA, 103 bp, Artificial Sequence
  Synthetic Polynucleotide
taatacgactcactatagggggccctgtcgccgccaccggggcccgcctcaacagaggagagaggcgatgcccggtggcaacctggcggcagcgcaaaagatg

SEQ ID NO: 180002 - DNA, 103 bp, Artificial Sequence
  Synthetic Polynucleotide
taatacgactcactatagggccgttcaccaatacccccagaagacccttcaacagaggagagaagggatgtctgggggtaacctggcggcagcgcaaaagatg

SEQ ID NO: 180003 - DNA, 103 bp, Artificial Sequence
  Synthetic Polynucleotide
taatacgactcactatagggaaaatttataccgttcaccaatacccccagaacagaggagactggggatgttggtgaacaacctggcggcagcgcaaaagatg

SEQ ID NO: 180004 - DNA, 103 bp, Artificial Sequence
  Synthetic Polynucleotide
taatacgactcactatagggatttcttgcaaaaatttataccgttcaccaaacagaggagatggtgaatggtataaattaacctggcggcagcgcaaaagatg

SEQ ID NO: 180005 - DNA, 103 bp, Artificial Sequence
  Synthetic Polynucleotide
taatacgactcactatagggataccctcgcatttcttgcaaaaatttataaacagaggagatataaaatgttgcaagaaaacctggcggcagcgcaaaagatg

SEQ ID NO: 180006 - DNA, 103 bp, Artificial Sequence
  Synthetic Polynucleotide
taatacgactcactatagggagtcttggacataccctcgcatttcttgcaaacagaggagatgcaagatgtgcgagggtaacctggcggcagcgcaaaagatg

SEQ ID NO: 180007 - DNA, 103 bp, Artificial Sequence
  Synthetic Polynucleotide
taatacgactcactatagggcactcaagcaagtcttggacataccctcgcaacagaggagagcgaggatgtgtccaagaaacctggcggcagcgcaaaagatg

SEQ ID NO: 180008 - DNA, 103 bp, Artificial Sequence
  Synthetic Polynucleotide
taatacgactcactatagggttcactgaaacactcaagcaagtcttggacaacagaggagagtccaaatgttgcttgagaacctggcggcagcgcaaaagatg

SEQ ID NO: 180009 - DNA, 103 bp, Artificial Sequence
  Synthetic Polynucleotide
taatacgactcactataggggtggcaccttttcactgaaacactcaagcaaacagaggagatgcttgatggtttcagtgaacctggcggcagcgcaaaagatg

SEQ ID NO: 180010 - DNA, 103 bp, Artificial Sequence
  Synthetic Polynucleotide
taatacgactcactatagggtcattaatcagtggcaccttttcactgaaaaacagaggagatttcagatgaaaggtgccaacctggcggcagcgcaaaagatg

SEQ ID NO: 180011 - DNA, 103 bp, Artificial Sequence
  Synthetic Polynucleotide
taatacgactcactatagggtgattcaagttcattaatcagtggcaccttaacagaggagaaaggtgatgctgattaataacctggcggcagcgcaaaagatg

SEQ ID NO: 180012 - DNA, 103 bp, Artificial Sequence
  Synthetic Polynucleotide
taatacgactcactatagggccccgccaggggccctgtcgccgccaccggaacagaggagaccggtgatggcgacagggaacctggcggcagcgcaaaagatg

SEQ ID NO: 180013 - DNA, 103 bp, Artificial Sequence
  Synthetic Polynucleotide
taatacgactcactataggggatgtattgctgattcaagttcattaatcaaacagaggagatgattaatgaacttgaataacctggcggcagcgcaaaagatg

SEQ ID NO: 180014 - DNA, 103 bp, Artificial Sequence
  Synthetic Polynucleotide
taatacgactcactatagggttgtacagctgatgtattgctgattcaagtaacagaggagaacttgaatgagcaatacaaacctggcggcagcgcaaaagatg

SEQ ID NO: 180015 - DNA, 103 bp, Artificial Sequence
  Synthetic Polynucleotide
taatacgactcactatagggagctcgctgtttgtacagctgatgtattgcaacagaggagagcaataatgcagctgtacaacctggcggcagcgcaaaagatg

SEQ ID NO: 180016 - DNA, 103 bp, Artificial Sequence
  Synthetic Polynucleotide
taatacgactcactatagggcaaggcgggaagctcgctgtttgtacagctaacagaggagaagctgtatgaacagcgagaacctggcggcagcgcaaaagatg

SEQ ID NO: 180017 - DNA, 103 bp, Artificial Sequence
  Synthetic Polynucleotide
taatacgactcactatagggcgtctttggacaaggcgggaagctcgctgtaacagaggagaacagcgatgttcccgcctaacctggcggcagcgcaaaagatg

SEQ ID NO: 180018 - DNA, 103 bp, Artificial Sequence
  Synthetic Polynucleotide
taatacgactcactatagggatcatcttgtcgtctttggacaaggcgggaaacagaggagatcccgcatggtccaaagaaacctggcggcagcgcaaaagatg

SEQ ID NO: 180019 - DNA, 103 bp, Artificial Sequence
  Synthetic Polynucleotide
taatacgactcactatagggcatctttaatatcatcttgtcgtctttggaaacagaggagatccaaaatggacaagatgaacctggcggcagcgcaaaagatg

SEQ ID NO: 180020 - DNA, 103 bp, Artificial Sequence
  Synthetic Polynucleotide
taatacgactcactatagggtccgaagattcatctttaatatcatcttgtaacagaggagaacaagaatgtattaaagaaacctggcggcagcgcaaaagatg

SEQ ID NO: 180021 - DNA, 103 bp, Artificial Sequence
  Synthetic Polynucleotide
taatacgactcactataggggcttgaaaactccgaagattcatctttaataacagaggagaattaaaatggaatcttcgaacctggcggcagcgcaaaagatg

SEQ ID NO: 180022 - DNA, 103 bp, Artificial Sequence
  Synthetic Polynucleotide
taatacgactcactatagggtgtttgaatggcttgaaaactccgaagattaacagaggagaaatcttatgagttttcaaaacctggcggcagcgcaaaagatg

SEQ ID NO: 180023 - DNA, 103 bp, Artificial Sequence
  Synthetic Polynucleotide
taatacgactcactatagggagcagcgactccccgccaggggccctgtcgaacagaggagacgacagatgccctggcggaacctggcggcagcgcaaaagatg

SEQ ID NO: 180024 - DNA, 103 bp, Artificial Sequence
  Synthetic Polynucleotide
taatacgactcactatagggatcagagctttgtttgaatggcttgaaaacaacagaggagagttttcatgccattcaaaaacctggcggcagcgcaaaagatg

SEQ ID NO: 180025 - DNA, 103 bp, Artificial Sequence
  Synthetic Polynucleotide
taatacgactcactatagggatttggtgccatcagagctttgtttgaatgaacagaggagacattcaatgaaagctctgaacctggcggcagcgcaaaagatg

SEQ ID NO: 180026 - DNA, 103 bp, Artificial Sequence
  Synthetic Polynucleotide
taatacgactcactatagggaggagtcaagatttggtgccatcagagcttaacagaggagaaagctcatgtggcaccaaaacctggcggcagcgcaaaagatg

SEQ ID NO: 180027 - DNA, 103 bp, Artificial Sequence
  Synthetic Polynucleotide
taatacgactcactatagggtcgcgtccaaaggagtcaagatttggtgccaacagaggagaggcaccatgtcttgactcaacctggcggcagcgcaaaagatg

SEQ ID NO: 180028 - DNA, 103 bp, Artificial Sequence
  Synthetic Polynucleotide
taatacgactcactatagggcagtgcccgatcgcgtccaaaggagtcaagaacagaggagacttgacatgtttggacgcaacctggcggcagcgcaaaagatg

SEQ ID NO: 180029 - DNA, 103 bp, Artificial Sequence
  Synthetic Polynucleotide
taatacgactcactataggggctcttgatacagtgcccgatcgcgtccaaaacagaggagattggacatgatcgggcacaacctggcggcagcgcaaaagatg

SEQ ID NO: 180030 - DNA, 103 bp, Artificial Sequence
  Synthetic Polynucleotide
taatacgactcactatagggcgttttgcatgctcttgatacagtgcccgaaacagaggagatcgggcatggtatcaagaaacctggcggcagcgcaaaagatg

SEQ ID NO: 180031 - DNA, 103 bp, Artificial Sequence
  Synthetic Polynucleotide
taatacgactcactatagggtgcaatgcgacgttttgcatgctcttgataaacagaggagatatcaaatgcatgcaaaaaacctggcggcagcgcaaaagatg

SEQ ID NO: 180032 - DNA, 103 bp, Artificial Sequence
  Synthetic Polynucleotide
taatacgactcactatagggcctcccgctctgcaatgcgacgttttgcataacagaggagaatgcaaatggtcgcattgaacctggcggcagcgcaaaagatg

SEQ ID NO: 180033 - DNA, 103 bp, Artificial Sequence
  Synthetic Polynucleotide
taatacgactcactataggggtcctcctggcctcccgctctgcaatgcgaaacagaggagatcgcatatgagagcgggaaacctggcggcagcgcaaaagatg

SEQ ID NO: 180034 - DNA, 103 bp, Artificial Sequence
  Synthetic Polynucleotide
taatacgactcactatagggccccgggcccagcagcgactccccgccaggaacagaggagacctggcatggagtcgctgaacctggcggcagcgcaaaagatg

SEQ ID NO: 180035 - DNA, 103 bp, Artificial Sequence
  Synthetic Polynucleotide
taatacgactcactatagggtctacgacgagtcctcctggcctcccgctcaacagaggagagagcggatggccaggaggaacctggcggcagcgcaaaagatg

SEQ ID NO: 180036 - DNA, 103 bp, Artificial Sequence
  Synthetic Polynucleotide
taatacgactcactatagggctctggcttgtctacgacgagtcctcctggaacagaggagaccaggaatgctcgtcgtaaacctggcggcagcgcaaaagatg

SEQ ID NO: 180037 - DNA, 103 bp, Artificial Sequence
  Synthetic Polynucleotide
taatacgactcactatagggccggtttgttctctggcttgtctacgacgaaacagaggagatcgtcgatgacaagccagaacctggcggcagcgcaaaagatg

SEQ ID NO: 180038 - DNA, 103 bp, Artificial Sequence
  Synthetic Polynucleotide
taatacgactcactatagggtgccatcttaccggtttgttctctggcttgaacagaggagacaagccatggaacaaaccaacctggcggcagcgcaaaagatg

SEQ ID NO: 180039 - DNA, 103 bp, Artificial Sequence
  Synthetic Polynucleotide
taatacgactcactatagggcaaggtgatctgccatcttaccggtttgttaacagaggagaaacaaaatggtaagatggaacctggcggcagcgcaaaagatg

SEQ ID NO: 180040 - DNA, 103 bp, Artificial Sequence
  Synthetic Polynucleotide
taatacgactcactataggggaaaggccttcaaggtgatctgccatcttaaacagaggagataagatatgagatcacctaacctggcggcagcgcaaaagatg

SEQ ID NO: 180041 - DNA, 103 bp, Artificial Sequence
  Synthetic Polynucleotide
taatacgactcactatagggatcatcactggaaaggccttcaaggtgatcaacagaggagagatcacatggaaggccttaacctggcggcagcgcaaaagatg

SEQ ID NO: 180042 - DNA, 103 bp, Artificial Sequence
  Synthetic Polynucleotide
taatacgactcactatagggaagtttcttcatcatcactggaaaggccttaacagaggagaaaggccatgccagtgatgaacctggcggcagcgcaaaagatg

SEQ ID NO: 180043 - DNA, 103 bp, Artificial Sequence
  Synthetic Polynucleotide
taatacgactcactatagggatatctgtagaagtttcttcatcatcactgaacagaggagacagtgaatgtgaagaaacaacctggcggcagcgcaaaagatg

SEQ ID NO: 180044 - DNA, 103 bp, Artificial Sequence
  Synthetic Polynucleotide
taatacgactcactataggggaaattagtaatatctgtagaagtttcttcaacagaggagagaagaaatgtctacagataacctggcggcagcgcaaaagatg

SEQ ID NO: 180045 - DNA, 103 bp, Artificial Sequence
  Synthetic Polynucleotide
taatacgactcactataggggcggcgacggccccgggcccagcagcgactaacagaggagaagtcgcatgtgggcccggaacctggcggcagcgcaaaagatg

SEQ ID NO: 180046 - DNA, 103 bp, Artificial Sequence
  Synthetic Polynucleotide
taatacgactcactatagggtttccagattgaaattagtaatatctgtagaacagaggagactacagatgttactaattaacctggcggcagcgcaaaagatg

SEQ ID NO: 180047 - DNA, 103 bp, Artificial Sequence
  Synthetic Polynucleotide
taatacgactcactatagggattcgatctttttccagattgaaattagtaaacagaggagatactaaatgcaatctggaaacctggcggcagcgcaaaagatg

SEQ ID NO: 180048 - DNA, 103 bp, Artificial Sequence
  Synthetic Polynucleotide
taatacgactcactatagggttcttttgaaattcgatctttttccagattaacagaggagaaatctgatgaaagatcgaaacctggcggcagcgcaaaagatg

SEQ ID NO: 180049 - DNA, 103 bp, Artificial Sequence
  Synthetic Polynucleotide
taatacgactcactatagggctttgccggattcttttgaaattcgatcttaacagaggagaaagatcatgtttcaaaagaacctggcggcagcgcaaaagatg

SEQ ID NO: 180050 - DNA, 103 bp, Artificial Sequence
  Synthetic Polynucleotide
taatacgactcactatagggtcttcaaaaactttgccggattcttttgaaaacagaggagattcaaaatgatccggcaaaacctggcggcagcgcaaaagatg

SEQ ID NO: 180051 - DNA, 103 bp, Artificial Sequence
  Synthetic Polynucleotide
taatacgactcactatagggttcaaggacatcttcaaaaactttgccggaaacagaggagatccggcatggtttttgaaaacctggcggcagcgcaaaagatg

SEQ ID NO: 180052 - DNA, 103 bp, Artificial Sequence
  Synthetic Polynucleotide
taatacgactcactatagggaatagaaactttcaaggacatcttcaaaaaaacagaggagatttttgatgatgtccttgaacctggcggcagcgcaaaagatg

SEQ ID NO: 180053 - DNA, 103 bp, Artificial Sequence
  Synthetic Polynucleotide
taatacgactcactatagggcagtcaattgaatagaaactttcaaggacaaacagaggagatgtcctatgaagtttctaaacctggcggcagcgcaaaagatg

SEQ ID NO: 180054 - DNA, 103 bp, Artificial Sequence
  Synthetic Polynucleotide
taatacgactcactatagggtgatttaatacagtcaattgaatagaaactaacagaggagaagtttcatgtcaattgacaacctggcggcagcgcaaaagatg

SEQ ID NO: 180055 - DNA, 103 bp, Artificial Sequence
  Synthetic Polynucleotide
taatacgactcactatagggcttcaaactgtgatttaatacagtcaattgaacagaggagacaattgatggtattaaataacctggcggcagcgcaaaagatg

SEQ ID NO: 180056 - DNA, 103 bp, Artificial Sequence
  Synthetic Polynucleotide
taatacgactcactatagggagcgcggaaggcggcgacggccccgggcccaacagaggagagggcccatggccgtcgccaacctggcggcagcgcaaaagatg

SEQ ID NO: 180057 - DNA, 103 bp, Artificial Sequence
  Synthetic Polynucleotide
taatacgactcactataggggaacgccatgcttcaaactgtgatttaataaacagaggagatattaaatgacagtttgaaacctggcggcagcgcaaaagatg

SEQ ID NO: 180058 - DNA, 103 bp, Artificial Sequence
  Synthetic Polynucleotide
taatacgactcactataggggtagtattttgaacgccatgcttcaaactgaacagaggagacagtttatggcatggcgtaacctggcggcagcgcaaaagatg

SEQ ID NO: 180059 - DNA, 103 bp, Artificial Sequence
  Synthetic Polynucleotide
taatacgactcactatagggtgtaggatgtgtagtattttgaacgccatgaacagaggagacatggcatgcaaaatactaacctggcggcagcgcaaaagatg

SEQ ID NO: 180060 - DNA, 103 bp, Artificial Sequence
  Synthetic Polynucleotide
taatacgactcactatagggtaagcatctttgtaggatgtgtagtattttaacagaggagaaaaataatgcacatcctaaacctggcggcagcgcaaaagatg

SEQ ID NO: 180061 - DNA, 103 bp, Artificial Sequence
  Synthetic Polynucleotide
taatacgactcactatagggaaggccaatgtaagcatctttgtaggatgtaacagaggagaacatccatgaaagatgctaacctggcggcagcgcaaaagatg

SEQ ID NO: 180062 - DNA, 103 bp, Artificial Sequence
  Synthetic Polynucleotide
taatacgactcactatagggttggcaaacaaaggccaatgtaagcatcttaacagaggagaaagatgatgacattggccaacctggcggcagcgcaaaagatg

SEQ ID NO: 180063 - DNA, 103 bp, Artificial Sequence
  Synthetic Polynucleotide
taatacgactcactatagggttgaataattttggcaaacaaaggccaatgaacagaggagacattggatgttgtttgccaacctggcggcagcgcaaaagatg

SEQ ID NO: 180064 - DNA, 103 bp, Artificial Sequence
  Synthetic Polynucleotide
taatacgactcactatagggtatgagggggttgaataattttggcaaacaaacagaggagatgtttgatgaaattattcaacctggcggcagcgcaaaagatg

SEQ ID NO: 180065 - DNA, 103 bp, Artificial Sequence
  Synthetic Polynucleotide
taatacgactcactataggggctgaagtcgtatgagggggttgaataattaacagaggagaaattatatgaccccctcaaacctggcggcagcgcaaaagatg

SEQ ID NO: 180066 - DNA, 103 bp, Artificial Sequence
  Synthetic Polynucleotide
taatacgactcactatagggcaagtgaggagctgaagtcgtatgagggggaacagaggagaccccctatgacgacttcaaacctggcggcagcgcaaaagatg

SEQ ID NO: 180067 - DNA, 103 bp, Artificial Sequence
  Synthetic Polynucleotide
taatacgactcactataggggcccggggtcagcgcggaaggcggcgacggaacagaggagaccgtcgatgccttccgcgaacctggcggcagcgcaaaagatg

SEQ ID NO: 180068 - DNA, 103 bp, Artificial Sequence
  Synthetic Polynucleotide
taatacgactcactatagggaagaggagtccaagtgaggagctgaagtcgaacagaggagacgacttatgctcctcactaacctggcggcagcgcaaaagatg

SEQ ID NO: 180069 - DNA, 103 bp, Artificial Sequence
  Synthetic Polynucleotide
taatacgactcactatagggattttgcctcaagaggagtccaagtgaggaaacagaggagatcctcaatgggactcctcaacctggcggcagcgcaaaagatg

SEQ ID NO: 180070 - DNA, 103 bp, Artificial Sequence
  Synthetic Polynucleotide
taatacgactcactatagggaagtcacgacattttgcctcaagaggagtcaacagaggagagactccatgtgaggcaaaaacctggcggcagcgcaaaagatg

SEQ ID NO: 180071 - DNA, 103 bp, Artificial Sequence
  Synthetic Polynucleotide
taatacgactcactatagggcatattctcaaagtcacgacattttgcctcaacagaggagagaggcaatgtgtcgtgacaacctggcggcagcgcaaaagatg

SEQ ID NO: 180072 - DNA, 103 bp, Artificial Sequence
  Synthetic Polynucleotide
taatacgactcactatagggcaaaccacagcatattctcaaagtcacgacaacagaggagagtcgtgatgttgagaataaacctggcggcagcgcaaaagatg

SEQ ID NO: 180073 - DNA, 103 bp, Artificial Sequence
  Synthetic Polynucleotide
taatacgactcactatagggagcaaagattcaaaccacagcatattctcaaacagaggagatgagaaatggctgtggttaacctggcggcagcgcaaaagatg

SEQ ID NO: 180074 - DNA, 103 bp, Artificial Sequence
  Synthetic Polynucleotide
taatacgactcactatagggaccataaaacagcaaagattcaaaccacagaacagaggagactgtggatggaatctttgaacctggcggcagcgcaaaagatg

SEQ ID NO: 180075 - DNA, 103 bp, Artificial Sequence
  Synthetic Polynucleotide
taatacgactcactataggggttcttcacaaccataaaacagcaaagattaacagaggagaaatcttatgtgttttatgaacctggcggcagcgcaaaagatg

SEQ ID NO: 180076 - DNA, 103 bp, Artificial Sequence
  Synthetic Polynucleotide
taatacgactcactatagggtcttgctctcgttcttcacaaccataaaacaacagaggagagttttaatgttgtgaagaaacctggcggcagcgcaaaagatg

SEQ ID NO: 180077 - DNA, 103 bp, Artificial Sequence
  Synthetic Polynucleotide
taatacgactcactatagggatcatctttttcttgctctcgttcttcacaaacagaggagatgtgaaatgcgagagcaaaacctggcggcagcgcaaaagatg

SEQ ID NO: 180078 - DNA, 103 bp, Artificial Sequence
  Synthetic Polynucleotide
taatacgactcactatagggtccgcttgcgcacgttcacccgccgggcctaacagaggagaaggcccatggggtgaacgaacctggcggcagcgcaaaagatg

SEQ ID NO: 180079 - DNA, 103 bp, Artificial Sequence
  Synthetic Polynucleotide
taatacgactcactatagggcagccccgaggcccggggtcagcgcggaagaacagaggagacttccgatgtgaccccggaacctggcggcagcgcaaaagatg

SEQ ID NO: 180080 - DNA, 103 bp, Artificial Sequence
  Synthetic Polynucleotide
taatacgactcactatagggcaacatctacatcatctttttcttgctctcaacagaggagagagagcatgaaaaagatgaacctggcggcagcgcaaaagatg

SEQ ID NO: 180081 - DNA, 103 bp, Artificial Sequence
  Synthetic Polynucleotide
taatacgactcactatagggggtagtagggcaacatctacatcatcttttaacagaggagaaaaagaatgtgtagatgtaacctggcggcagcgcaaaagatg

SEQ ID NO: 180082 - DNA, 103 bp, Artificial Sequence
  Synthetic Polynucleotide
taatacgactcactatagggcacaatggtaggtagtagggcaacatctacaacagaggagagtagatatggccctactaaacctggcggcagcgcaaaagatg

SEQ ID NO: 180083 - DNA, 103 bp, Artificial Sequence
  Synthetic Polynucleotide
taatacgactcactatagggtcaccttttccacaatggtaggtagtagggaacagaggagaccctacatgctaccattgaacctggcggcagcgcaaaagatg

SEQ ID NO: 180084 - DNA, 103 bp, Artificial Sequence
  Synthetic Polynucleotide
taatacgactcactatagggttaggaagaatcaccttttccacaatggtaaacagaggagataccatatgggaaaaggtaacctggcggcagcgcaaaagatg

SEQ ID NO: 180085 - DNA, 103 bp, Artificial Sequence
  Synthetic Polynucleotide
taatacgactcactatagggcactgttagtttaggaagaatcaccttttcaacagaggagagaaaagatgattcttcctaacctggcggcagcgcaaaagatg

SEQ ID NO: 180086 - DNA, 103 bp, Artificial Sequence
  Synthetic Polynucleotide
taatacgactcactatagggtttcagctatcactgttagtttaggaagaaaacagaggagattcttcatgaactaacagaacctggcggcagcgcaaaagatg

SEQ ID NO: 180087 - DNA, 103 bp, Artificial Sequence
  Synthetic Polynucleotide
taatacgactcactatagggtcccacatattttcagctatcactgttagtaacagaggagaactaacatggatagctgaaacctggcggcagcgcaaaagatg

SEQ ID NO: 180088 - DNA, 103 bp, Artificial Sequence
  Synthetic Polynucleotide
taatacgactcactatagggagaaaaagggtcccacatattttcagctataacagaggagaatagctatgaatatgtggaacctggcggcagcgcaaaagatg

SEQ ID NO: 180089 - DNA, 103 bp, Artificial Sequence
  Synthetic Polynucleotide
taatacgactcactatagggtctgtgttgtagaaaaagggtcccacatataacagaggagaatatgtatgaccctttttaacctggcggcagcgcaaaagatg

SEQ ID NO: 180090 - DNA, 103 bp, Artificial Sequence
  Synthetic Polynucleotide
taatacgactcactatagggcccccggcctcagccccgaggcccggggtcaacagaggagagaccccatgcctcggggcaacctggcggcagcgcaaaagatg

SEQ ID NO: 180091 - DNA, 103 bp, Artificial Sequence
  Synthetic Polynucleotide
taatacgactcactatagggattcttgaagtctgtgttgtagaaaaagggaacagaggagaccctttatgtacaacacaaacctggcggcagcgcaaaagatg

SEQ ID NO: 180092 - DNA, 103 bp, Artificial Sequence
  Synthetic Polynucleotide
taatacgactcactatagggaattcccaccattcttgaagtctgtgttgtaacagaggagaacaacaatgacttcaagaaacctggcggcagcgcaaaagatg

SEQ ID NO: 180093 - DNA, 103 bp, Artificial Sequence
  Synthetic Polynucleotide
taatacgactcactatagggattttagtgtaattcccaccattcttgaagaacagaggagacttcaaatgtggtgggaaaacctggcggcagcgcaaaagatg

SEQ ID NO: 180094 - DNA, 103 bp, Artificial Sequence
  Synthetic Polynucleotide
taatacgactcactatagggccattgattaattttagtgtaattcccaccaacagaggagaggtgggatgtacactaaaaacctggcggcagcgcaaaagatg

SEQ ID NO: 180095 - DNA, 103 bp, Artificial Sequence
  Synthetic Polynucleotide
taatacgactcactatagggtgaaggatatccattgattaattttagtgtaacagaggagaacactaatgttaatcaataacctggcggcagcgcaaaagatg

SEQ ID NO: 180096 - DNA, 103 bp, Artificial Sequence
  Synthetic Polynucleotide
taatacgactcactatagggcattcactactgaaggatatccattgattaaacagaggagataatcaatggatatccttaacctggcggcagcgcaaaagatg

SEQ ID NO: 180097 - DNA, 103 bp, Artificial Sequence
  Synthetic Polynucleotide
taatacgactcactatagggttattttctgcattcactactgaaggatataacagaggagaatatccatgagtagtgaaaacctggcggcagcgcaaaagatg

SEQ ID NO: 180098 - DNA, 103 bp, Artificial Sequence
  Synthetic Polynucleotide
taatacgactcactatagggctgtgtatttttattttctgcattcactacaacagaggagagtagtgatggcagaaaataacctggcggcagcgcaaaagatg

SEQ ID NO: 180099 - DNA, 103 bp, Artificial Sequence
  Synthetic Polynucleotide
taatacgactcactatagggttaggtatacctgtgtatttttattttctgaacagaggagacagaaaatgaaaatacacaacctggcggcagcgcaaaagatg

SEQ ID NO: 180100 - DNA, 103 bp, Artificial Sequence
  Synthetic Polynucleotide
taatacgactcactatagggaaaagtgcctttaggtatacctgtgtatttaacagaggagaaaatacatgggtatacctaacctggcggcagcgcaaaagatg

SEQ ID NO: 180101 - DNA, 103 bp, Artificial Sequence
  Synthetic Polynucleotide
taatacgactcactatagggggggaagccgcccccggcctcagccccgagaacagaggagactcgggatggaggccgggaacctggcggcagcgcaaaagatg

SEQ ID NO: 180102 - DNA, 103 bp, Artificial Sequence
  Synthetic Polynucleotide
taatacgactcactatagggcattctcaataaaagtgcctttaggtatacaacagaggagagtatacatgaaggcacttaacctggcggcagcgcaaaagatg

SEQ ID NO: 180103 - DNA, 103 bp, Artificial Sequence
  Synthetic Polynucleotide
taatacgactcactatagggaagttcttctcattctcaataaaagtgcctaacagaggagaaggcacatgtattgagaaaacctggcggcagcgcaaaagatg

SEQ ID NO: 180104 - DNA, 103 bp, Artificial Sequence
  Synthetic Polynucleotide
taatacgactcactatagggtcatcatctaaagttcttctcattctcaataacagaggagaattgagatggagaagaacaacctggcggcagcgcaaaagatg

SEQ ID NO: 180105 - DNA, 103 bp, Artificial Sequence
  Synthetic Polynucleotide
taatacgactcactatagggcataaatacatcatcatctaaagttcttctaacagaggagaagaagaatgttagatgataacctggcggcagcgcaaaagatg

SEQ ID NO: 180106 - DNA, 103 bp, Artificial Sequence
  Synthetic Polynucleotide
taatacgactcactataggggatataagggcataaatacatcatcatctaaacagaggagatagatgatgatgtatttaaacctggcggcagcgcaaaagatg

SEQ ID NO: 180107 - DNA, 103 bp, Artificial Sequence
  Synthetic Polynucleotide
taatacgactcactatagggacatttttgggatataagggcataaatacaaacagaggagatgtattatggcccttataaacctggcggcagcgcaaaagatg

SEQ ID NO: 180108 - DNA, 103 bp, Artificial Sequence
  Synthetic Polynucleotide
taatacgactcactatagggattttctaagacatttttgggatataagggaacagaggagacccttaatgcccaaaaataacctggcggcagcgcaaaagatg

SEQ ID NO: 180109 - DNA, 103 bp, Artificial Sequence
  Synthetic Polynucleotide
taatacgactcactatagggcagaatttttattttctaagacatttttggaacagaggagaccaaaaatgtcttagaaaaacctggcggcagcgcaaaagatg

SEQ ID NO: 180110 - DNA, 103 bp, Artificial Sequence
  Synthetic Polynucleotide
taatacgactcactatagggaagtaaggcccagaatttttattttctaagaacagaggagacttagaatgtaaaaattcaacctggcggcagcgcaaaagatg

SEQ ID NO: 180111 - DNA, 103 bp, Artificial Sequence
  Synthetic Polynucleotide
taatacgactcactatagggttgaaaaaacaagtaaggcccagaatttttaacagaggagaaaaaatatggggccttacaacctggcggcagcgcaaaagatg

SEQ ID NO: 180112 - DNA, 103 bp, Artificial Sequence
  Synthetic Polynucleotide
taatacgactcactatagggccgcgccgccggggaagccgcccccggcctaacagaggagaaggccgatggcggcttccaacctggcggcagcgcaaaagatg

SEQ ID NO: 180113 - DNA, 103 bp, Artificial Sequence
  Synthetic Polynucleotide
taatacgactcactatagggaaaactgtcgttgaaaaaacaagtaaggccaacagaggagaggccttatgtgttttttcaacctggcggcagcgcaaaagatg

SEQ ID NO: 180114 - DNA, 103 bp, Artificial Sequence
  Synthetic Polynucleotide
taatacgactcactatagggactgaagaccaaaactgtcgttgaaaaaacaacagaggagagtttttatgacgacagttaacctggcggcagcgcaaaagatg

SEQ ID NO: 180115 - DNA, 103 bp, Artificial Sequence
  Synthetic Polynucleotide
taatacgactcactatagggtatgaccttaactgaagaccaaaactgtcgaacagaggagacgacagatgtggtcttcaaacctggcggcagcgcaaaagatg

SEQ ID NO: 180116 - DNA, 103 bp, Artificial Sequence
  Synthetic Polynucleotide
taatacgactcactatagggatgggggttttatgaccttaactgaagaccaacagaggagaggtcttatgttaaggtcaaacctggcggcagcgcaaaagatg

SEQ ID NO: 180117 - DNA, 103 bp, Artificial Sequence
  Synthetic Polynucleotide
taatacgactcactatagggcctctctggaatgggggttttatgaccttaaacagaggagataaggtatgaaaacccccaacctggcggcagcgcaaaagatg

SEQ ID NO: 180118 - DNA, 103 bp, Artificial Sequence
  Synthetic Polynucleotide
taatacgactcactatagggggggcaggaccctctctggaatgggggtttaacagaggagaaaacccatgttccagagaaacctggcggcagcgcaaaagatg

SEQ ID NO: 180119 - DNA, 103 bp, Artificial Sequence
  Synthetic Polynucleotide
taatacgactcactatagggttctgggtatggggcaggaccctctctggaaacagaggagatccagaatgggtcctgccaacctggcggcagcgcaaaagatg

SEQ ID NO: 180120 - DNA, 103 bp, Artificial Sequence
  Synthetic Polynucleotide
taatacgactcactatagggcattctttccttctgggtatggggcaggacaacagaggagagtcctgatgcatacccagaacctggcggcagcgcaaaagatg

SEQ ID NO: 180121 - DNA, 103 bp, Artificial Sequence
  Synthetic Polynucleotide
taatacgactcactatagggctctgagcagcattctttccttctgggtataacagaggagaatacccatgaggaaagaaaacctggcggcagcgcaaaagatg

SEQ ID NO: 180122 - DNA, 103 bp, Artificial Sequence
  Synthetic Polynucleotide
taatacgactcactatagggttcttggcctctctgagcagcattctttccaacagaggagaggaaagatggctgctcagaacctggcggcagcgcaaaagatg

SEQ ID NO: 180123 - DNA, 103 bp, Artificial Sequence
  Synthetic Polynucleotide
taatacgactcactatagggttgccgggctccgcgccgccggggaagccgaacagaggagacggcttatgcggcggcgcaacctggcggcagcgcaaaagatg

SEQ ID NO: 180124 - DNA, 103 bp, Artificial Sequence
  Synthetic Polynucleotide
taatacgactcactataggggtccagattcttcttggcctctctgagcagaacagaggagactgctcatggaggccaagaacctggcggcagcgcaaaagatg

SEQ ID NO: 180125 - DNA, 103 bp, Artificial Sequence
  Synthetic Polynucleotide
taatacgactcactatagggaggcctgtccgtccagattcttcttggcctaacagaggagaaggccaatgagaatctggaacctggcggcagcgcaaaagatg

SEQ ID NO: 180126 - DNA, 103 bp, Artificial Sequence
  Synthetic Polynucleotide
taatacgactcactatagggagacaacacaaggcctgtccgtccagattcaacagaggagagaatctatgcggacaggcaacctggcggcagcgcaaaagatg

SEQ ID NO: 180127 - DNA, 103 bp, Artificial Sequence
  Synthetic Polynucleotide
taatacgactcactatagggcttcagcccgttgccgggctccgcgccgccaacagaggagaggcggcatggagcccggcaacctggcggcagcgcaaaagatg

SEQ ID NO: 180128 - DNA, 103 bp, Artificial Sequence
  Synthetic Polynucleotide
taatacgactcactatagggtcttgcgcggcttcagcccgttgccgggctaacagaggagaagcccgatgacgggctgaaacctggcggcagcgcaaaagatg

SEQ ID NO: 180129 - DNA, 103 bp, Artificial Sequence
  Synthetic Polynucleotide
taatacgactcactatagggtcgcgaggcctcttgcgcggcttcagcccgaacagaggagacgggctatggccgcgcaaaacctggcggcagcgcaaaagatg

SEQ ID NO: 180130 - DNA, 103 bp, Artificial Sequence
  Synthetic Polynucleotide
taatacgactcactatagggctctttgttctcgcgaggcctcttgcgcggaacagaggagaccgcgcatgaggcctcgcaacctggcggcagcgcaaaagatg

SEQ ID NO: 180131 - DNA, 103 bp, Artificial Sequence
  Synthetic Polynucleotide
taatacgactcactatagggcccggggcacctctttgttctcgcgaggccaacagaggagaggcctcatgagaacaaagaacctggcggcagcgcaaaagatg

SEQ ID NO: 180132 - DNA, 103 bp, Artificial Sequence
  Synthetic Polynucleotide
taatacgactcactatagggtcggagtcgttccgcttgcgcacgttcaccaacagaggagaggtgaaatggcgcaagcgaacctggcggcagcgcaaaagatg

SEQ ID NO: 180133 - DNA, 103 bp, Artificial Sequence
  Synthetic Polynucleotide
taatacgactcactatagggagcaggctggcccggggcacctctttgttcaacagaggagagaacaaatgggtgccccgaacctggcggcagcgcaaaagatg

SEQ ID NO: 180134 - DNA, 103 bp, Artificial Sequence
  Synthetic Polynucleotide
taatacgactcactatagggctggaagctgagcaggctggcccggggcacaacagaggagagtgcccatggccagcctgaacctggcggcagcgcaaaagatg

SEQ ID NO: 180135 - DNA, 103 bp, Artificial Sequence
  Synthetic Polynucleotide
taatacgactcactatagggcctcctcgtcctggaagctgagcaggctggaacagaggagaccagccatgtcagcttccaacctggcggcagcgcaaaagatg

SEQ ID NO: 180136 - DNA, 103 bp, Artificial Sequence
  Synthetic Polynucleotide
taatacgactcactatagggtcattttcttcctcctcgtcctggaagctgaacagaggagacagcttatgggacgaggaaacctggcggcagcgcaaaagatg

SEQ ID NO: 180137 - DNA, 103 bp, Artificial Sequence
  Synthetic Polynucleotide
taatacgactcactataggggaaaacttcttcattttcttcctcctcgtcaacagaggagagacgagatggaagaaaataacctggcggcagcgcaaaagatg

SEQ ID NO: 180138 - DNA, 103 bp, Artificial Sequence
  Synthetic Polynucleotide
taatacgactcactatagggtcttcactttgaaaacttcttcattttcttaacagaggagaaagaaaatgaagaagtttaacctggcggcagcgcaaaagatg

SEQ ID NO: 180139 - DNA, 103 bp, Artificial Sequence
  Synthetic Polynucleotide
taatacgactcactatagggtaacttgatttcttcactttgaaaacttctaacagaggagaagaagtatgcaaagtgaaaacctggcggcagcgcaaaagatg

SEQ ID NO: 180140 - DNA, 103 bp, Artificial Sequence
  Synthetic Polynucleotide
taatacgactcactatagggctttttgctataacttgatttcttcactttaacagaggagaaaagtgatgaaatcaagtaacctggcggcagcgcaaaagatg

SEQ ID NO: 180141 - DNA, 103 bp, Artificial Sequence
  Synthetic Polynucleotide
taatacgactcactatagggattttactatctttttgctataacttgattaacagaggagaaatcaaatgatagcaaaaaacctggcggcagcgcaaaagatg

SEQ ID NO: 180142 - DNA, 103 bp, Artificial Sequence
  Synthetic Polynucleotide
taatacgactcactatagggttcttgagcaattttactatctttttgctaaacagaggagatagcaaatggatagtaaaaacctggcggcagcgcaaaagatg

SEQ ID NO: 180143 - DNA, 103 bp, Artificial Sequence
  Synthetic Polynucleotide
taatacgactcactatagggctcttcctcttcggagtcgttccgcttgcgaacagaggagacgcaagatgaacgactccaacctggcggcagcgcaaaagatg

SEQ ID NO: 180144 - DNA, 103 bp, Artificial Sequence
  Synthetic Polynucleotide
taatacgactcactatagggtttatattccttcttgagcaattttactataacagaggagaatagtaatgttgctcaagaacctggcggcagcgcaaaagatg

SEQ ID NO: 180145 - DNA, 103 bp, Artificial Sequence
  Synthetic Polynucleotide
taatacgactcactatagggcaagatcttctttatattccttcttgagcaaacagaggagatgctcaatgaggaatataaacctggcggcagcgcaaaagatg

SEQ ID NO: 180146 - DNA, 103 bp, Artificial Sequence
  Synthetic Polynucleotide
taatacgactcactatagggttcgatttttcaagatcttctttatattccaacagaggagaggaataatgagaagatctaacctggcggcagcgcaaaagatg

SEQ ID NO: 180147 - DNA, 103 bp, Artificial Sequence
  Synthetic Polynucleotide
taatacgactcactatagggtgtcttaatcttcgatttttcaagatcttcaacagaggagagaagatatggaaaaatcgaacctggcggcagcgcaaaagatg

SEQ ID NO: 180148 - DNA, 103 bp, Artificial Sequence
  Synthetic Polynucleotide
taatacgactcactatagggagttgagttctgtcttaatcttcgatttttaacagaggagaaaaaatatgagattaagaaacctggcggcagcgcaaaagatg

SEQ ID NO: 180149 - DNA, 103 bp, Artificial Sequence
  Synthetic Polynucleotide
taatacgactcactatagggtcagctgatgagttgagttctgtcttaatcaacagaggagagattaaatgagaactcaaaacctggcggcagcgcaaaagatg

SEQ ID NO: 180150 - DNA, 103 bp, Artificial Sequence
  Synthetic Polynucleotide
taatacgactcactatagggttgttcactttcagctgatgagttgagttcaacagaggagagaactcatgtcatcagctaacctggcggcagcgcaaaagatg

SEQ ID NO: 180151 - DNA, 103 bp, Artificial Sequence
  Synthetic Polynucleotide
taatacgactcactatagggtgtccaaaggttgttcactttcagctgatgaacagaggagacatcagatgaaagtgaacaacctggcggcagcgcaaaagatg

SEQ ID NO: 180152 - DNA, 103 bp, Artificial Sequence
  Synthetic Polynucleotide
taatacgactcactatagggtgtcctgttttgtccaaaggttgttcacttaacagaggagaaagtgaatgacctttggaaacctggcggcagcgcaaaagatg

SEQ ID NO: 180153 - DNA, 103 bp, Artificial Sequence
  Synthetic Polynucleotide
taatacgactcactatagggatccttaacatgtcctgttttgtccaaaggaacagaggagacctttgatgaaaacaggaaacctggcggcagcgcaaaagatg

SEQ ID NO: 180154 - DNA, 103 bp, Artificial Sequence
  Synthetic Polynucleotide
taatacgactcactatagggcgcgttcccgctcttcctcttcggagtcgtaacagaggagaacgactatgaagaggaagaacctggcggcagcgcaaaagatg

SEQ ID NO: 180155 - DNA, 103 bp, Artificial Sequence
  Synthetic Polynucleotide
taatacgactcactatagggcttgatttgtatccttaacatgtcctgtttaacagaggagaaaacagatgatgttaaggaacctggcggcagcgcaaaagatg

SEQ ID NO: 180156 - DNA, 103 bp, Artificial Sequence
  Synthetic Polynucleotide
taatacgactcactatagggactccatcttcttgatttgtatccttaacaaacagaggagatgttaaatgtacaaatcaaacctggcggcagcgcaaaagatg

SEQ ID NO: 180157 - DNA, 103 bp, Artificial Sequence
  Synthetic Polynucleotide
taatacgactcactatagggactgatgataactccatcttcttgatttgtaacagaggagaacaaatatggaagatggaaacctggcggcagcgcaaaagatg

SEQ ID NO: 180158 - DNA, 103 bp, Artificial Sequence
  Synthetic Polynucleotide
taatacgactcactatagggcaccatgttcactgatgataactccatcttaacagaggagaaagatgatgttatcatcaaacctggcggcagcgcaaaagatg

SEQ ID NO: 180159 - DNA, 103 bp, Artificial Sequence
  Synthetic Polynucleotide
taatacgactcactatagggatttcatcttcaccatgttcactgatgataaacagaggagatatcatatgtgaacatggaacctggcggcagcgcaaaagatg

SEQ ID NO: 180160 - DNA, 103 bp, Artificial Sequence
  Synthetic Polynucleotide
taatacgactcactatagggttccatatccatttcatcttcaccatgttcaacagaggagagaacatatggaagatgaaaacctggcggcagcgcaaaagatg

SEQ ID NO: 180161 - DNA, 103 bp, Artificial Sequence
  Synthetic Polynucleotide
taatacgactcactatagggctttttcactttccatatccatttcatcttaacagaggagaaagatgatgtggatatggaacctggcggcagcgcaaaagatg

SEQ ID NO: 180162 - DNA, 103 bp, Artificial Sequence
  Synthetic Polynucleotide
taatacgactcactatagggttttcttcctctttttcactttccatatccaacagaggagaggatatatgaagtgaaaaaacctggcggcagcgcaaaagatg

SEQ ID NO: 180163 - DNA, 103 bp, Artificial Sequence
  Synthetic Polynucleotide
taatacgactcactatagggagtctttggcttttcttcctctttttcactaacagaggagaagtgaaatggaggaagaaaacctggcggcagcgcaaaagatg

SEQ ID NO: 180164 - DNA, 103 bp, Artificial Sequence
  Synthetic Polynucleotide
taatacgactcactatagggaagctccaccagtctttggcttttcttcctaacagaggagaaggaagatgagccaaagaaacctggcggcagcgcaaaagatg

SEQ ID NO: 180165 - DNA, 103 bp, Artificial Sequence
  Synthetic Polynucleotide
taatacgactcactatagggtgctcctcatcgcgttcccgctcttcctctaacagaggagaagaggaatggcgggaacgaacctggcggcagcgcaaaagatg

SEQ ID NO: 180166 - DNA, 103 bp, Artificial Sequence
  Synthetic Polynucleotide
taatacgactcactataggggcatttgaaaaagctccaccagtctttggcaacagaggagagccaaaatgtggtggagcaacctggcggcagcgcaaaagatg

SEQ ID NO: 180167 - DNA, 103 bp, Artificial Sequence
  Synthetic Polynucleotide
taatacgactcactatagggtgaagataaagcatttgaaaaagctccaccaacagaggagaggtggaatgttttcaaataacctggcggcagcgcaaaagatg

SEQ ID NO: 180168 - DNA, 103 bp, Artificial Sequence
  Synthetic Polynucleotide
taatacgactcactataggggaacattcaatgaagataaagcatttgaaaaacagaggagatttcaaatgctttatcttaacctggcggcagcgcaaaagatg

SEQ ID NO: 180169 - DNA, 103 bp, Artificial Sequence
  Synthetic Polynucleotide
taatacgactcactatagggcctggacgaagaacattcaatgaagataaaaacagaggagatttatcatgattgaatgtaacctggcggcagcgcaaaagatg

SEQ ID NO: 180170 - DNA, 103 bp, Artificial Sequence
  Synthetic Polynucleotide
taatacgactcactatagggtggaatttctcctggacgaagaacattcaaaacagaggagattgaatatgcttcgtccaaacctggcggcagcgcaaaagatg

SEQ ID NO: 180171 - DNA, 103 bp, Artificial Sequence
  Synthetic Polynucleotide
taatacgactcactatagggaagctgcatctggaatttctcctggacgaaaacagaggagattcgtcatggagaaattcaacctggcggcagcgcaaaagatg

SEQ ID NO: 180172 - DNA, 103 bp, Artificial Sequence
  Synthetic Polynucleotide
taatacgactcactataggggcatgtataaaagctgcatctggaatttctaacagaggagaagaaatatgagatgcagcaacctggcggcagcgcaaaagatg

SEQ ID NO: 180173 - DNA, 103 bp, Artificial Sequence
  Synthetic Polynucleotide
taatacgactcactatagggtttccttgcagcatgtataaaagctgcatcaacagaggagagatgcaatgtttatacataacctggcggcagcgcaaaagatg

SEQ ID NO: 180174 - DNA, 103 bp, Artificial Sequence
  Synthetic Polynucleotide
taatacgactcactatagggtttggcgctttttccttgcagcatgtataaaacagaggagattatacatgctgcaaggaaacctggcggcagcgcaaaagatg

SEQ ID NO: 180175 - DNA, 103 bp, Artificial Sequence
  Synthetic Polynucleotide
taatacgactcactatagggtctcgggccatttggcgctttttccttgcaaacagaggagatgcaagatgaaagcgccaaacctggcggcagcgcaaaagatg

SEQ ID NO: 180176 - DNA, 103 bp, Artificial Sequence
  Synthetic Polynucleotide
taatacgactcactatagggcggcggctcctgctcctcatcgcgttcccgaacagaggagacgggaaatggatgaggagaacctggcggcagcgcaaaagatg

SEQ ID NO: 180177 - DNA, 103 bp, Artificial Sequence
  Synthetic Polynucleotide
taatacgactcactatagggatctcccaattctcgggccatttggcgcttaacagaggagaaagcgcatgatggcccgaaacctggcggcagcgcaaaagatg

SEQ ID NO: 180178 - DNA, 103 bp, Artificial Sequence
  Synthetic Polynucleotide
taatacgactcactataggggaggagtgaaatctcccaattctcgggccaaacagaggagatggcccatgaattgggagaacctggcggcagcgcaaaagatg

SEQ ID NO: 180179 - DNA, 103 bp, Artificial Sequence
  Synthetic Polynucleotide
taatacgactcactatagggtcattatcatgaggagtgaaatctcccaataacagaggagaattgggatgtttcactccaacctggcggcagcgcaaaagatg

SEQ ID NO: 180180 - DNA, 103 bp, Artificial Sequence
  Synthetic Polynucleotide
taatacgactcactatagggtttaccaggctcattatcatgaggagtgaaaacagaggagattcactatgcatgataataacctggcggcagcgcaaaagatg

SEQ ID NO: 180181 - DNA, 103 bp, Artificial Sequence
  Synthetic Polynucleotide
taatacgactcactatagggcaaggcggcctttaccaggctcattatcataacagaggagaatgataatgagcctggtaaacctggcggcagcgcaaaagatg

SEQ ID NO: 180182 - DNA, 103 bp, Artificial Sequence
  Synthetic Polynucleotide
taatacgactcactatagggtcttctctaacaaggcggcctttaccaggcaacagaggagagcctggatgaggccgcctaacctggcggcagcgcaaaagatg

SEQ ID NO: 180183 - DNA, 103 bp, Artificial Sequence
  Synthetic Polynucleotide
taatacgactcactatagggatcattctcatcttctctaacaaggcggccaacagaggagaggccgcatggttagagaaaacctggcggcagcgcaaaagatg

SEQ ID NO: 180184 - DNA, 103 bp, Artificial Sequence
  Synthetic Polynucleotide
taatacgactcactatagggcatcactggcatcattctcatcttctctaaaacagaggagattagagatgatgagaatgaacctggcggcagcgcaaaagatg

SEQ ID NO: 180185 - DNA, 103 bp, Artificial Sequence
  Synthetic Polynucleotide
taatacgactcactatagggtcatcttcatcatcactggcatcattctcaaacagaggagatgagaaatgtgccagtgaaacctggcggcagcgcaaaagatg

SEQ ID NO: 180186 - DNA, 103 bp, Artificial Sequence
  Synthetic Polynucleotide
taatacgactcactatagggtttctcatcgtcatcttcatcatcactggcaacagaggagagccagtatggatgaagataacctggcggcagcgcaaaagatg

SEQ ID NO: 180187 - DNA, 103 bp, Artificial Sequence
  Synthetic Polynucleotide
taatacgactcactataggggcaacaacggcggcggctcctgctcctcataacagaggagaatgaggatgaggagccgcaacctggcggcagcgcaaaagatg

SEQ ID NO: 180188 - DNA, 103 bp, Artificial Sequence
  Synthetic Polynucleotide
taatacgactcactatagggctatccggcgtttctcatcgtcatcttcataacagaggagaatgaagatgacgatgagaaacctggcggcagcgcaaaagatg

SEQ ID NO: 180189 - DNA, 103 bp, Artificial Sequence
  Synthetic Polynucleotide
taatacgactcactatagggacagaaaaaactatccggcgtttctcatcgaacagaggagacgatgaatgacgccggataacctggcggcagcgcaaaagatg

SEQ ID NO: 180190 - DNA, 103 bp, Artificial Sequence
  Synthetic Polynucleotide
taatacgactcactatagggcttttctttcacagaaaaaactatccggcgaacagaggagacgccggatggttttttctaacctggcggcagcgcaaaagatg

SEQ ID NO: 180191 - DNA, 103 bp, Artificial Sequence
  Synthetic Polynucleotide
taatacgactcactataggggtctttgtgacttttctttcacagaaaaaaaacagaggagattttttatgtgaaagaaaaacctggcggcagcgcaaaagatg

SEQ ID NO: 180192 - DNA, 103 bp, Artificial Sequence
  Synthetic Polynucleotide
taatacgactcactataggggcaattttttgtctttgtgacttttctttcaacagaggagagaaagaatggtcacaaagaacctggcggcagcgcaaaagatg

SEQ ID NO: 180193 - DNA, 103 bp, Artificial Sequence
  Synthetic Polynucleotide
taatacgactcactatagggtatttcctcagcaattttttgtctttgtgaaacagaggagatcacaaatgcaaaaaattaacctggcggcagcgcaaaagatg

SEQ ID NO: 180194 - DNA, 103 bp, Artificial Sequence
  Synthetic Polynucleotide
taatacgactcactatagggcctcaattcctatttcctcagcaattttttaacagaggagaaaaaaaatgctgaggaaaaacctggcggcagcgcaaaagatg

SEQ ID NO: 180195 - DNA, 103 bp, Artificial Sequence
  Synthetic Polynucleotide
taatacgactcactatagggtcatcactcccctcaattcctatttcctcaaacagaggagatgaggaatgaggaattgaaacctggcggcagcgcaaaagatg

SEQ ID NO: 180196 - DNA, 103 bp, Artificial Sequence
  Synthetic Polynucleotide
taatacgactcactatagggtaaagcatcatcatcactcccctcaattccaacagaggagaggaattatggggagtgataacctggcggcagcgcaaaagatg

SEQ ID NO: 180197 - DNA, 103 bp, Artificial Sequence
  Synthetic Polynucleotide
taatacgactcactatagggctccagttactaaagcatcatcatcactccaacagaggagaggagtgatgatgatgcttaacctggcggcagcgcaaaagatg

SEQ ID NO: 180198 - DNA, 103 bp, Artificial Sequence
  Synthetic Polynucleotide
taatacgactcactatagggcccggcggcggcaacaacggcggcggctccaacagaggagaggagccatggccgttgttaacctggcggcagcgcaaaagatg

SEQ ID NO: 180199 - DNA, 103 bp, Artificial Sequence
  Synthetic Polynucleotide
taatacgactcactatagggtcatcctgttctccagttactaaagcatcaaacagaggagatgatgcatgagtaactggaacctggcggcagcgcaaaagatg

SEQ ID NO: 180200 - DNA, 103 bp, Artificial Sequence
  Synthetic Polynucleotide
taatacgactcactataggggctgagctcttcatcctgttctccagttacaacagaggagagtaactatggaacaggataacctggcggcagcgcaaaagatg

SEQ ID NO: 180201 - DNA, 103 bp, Artificial Sequence
  Synthetic Polynucleotide
taatacgactcactataggggttcccatcggctgagctcttcatcctgttaacagaggagaaacaggatgaagagctcaaacctggcggcagcgcaaaagatg

SEQ ID NO: 180202 - DNA, 103 bp, Artificial Sequence
  Synthetic Polynucleotide
taatacgactcactatagggatctgctcctgttcccatcggctgagctctaacagaggagaagagctatgccgatgggaaacctggcggcagcgcaaaagatg

SEQ ID NO: 180203 - DNA, 103 bp, Artificial Sequence
  Synthetic Polynucleotide
taatacgactcactatagggtcctttccttatctgctcctgttcccatcgaacagaggagacgatggatgcaggagcagaacctggcggcagcgcaaaagatg

SEQ ID NO: 180204 - DNA, 103 bp, Artificial Sequence
  Synthetic Polynucleotide
taatacgactcactatagggggatattaattcctttccttatctgctcctaacagaggagaaggagcatgtaaggaaagaacctggcggcagcgcaaaagatg

SEQ ID NO: 180205 - DNA, 103 bp, Artificial Sequence
  Synthetic Polynucleotide
taatacgactcactatagggtgaacctgagggatattaattcctttccttaacagaggagaaaggaaatgaattaatataacctggcggcagcgcaaaagatg

SEQ ID NO: 180206 - DNA, 103 bp, Artificial Sequence
  Synthetic Polynucleotide
taatacgactcactatagggttgactggcttgaacctgagggatattaataacagaggagaattaatatgcctcaggttaacctggcggcagcgcaaaagatg

SEQ ID NO: 180207 - DNA, 103 bp, Artificial Sequence
  Synthetic Polynucleotide
taatacgactcactatagggcttctgcgggttgactggcttgaacctgagaacagaggagactcaggatgaagccagtcaacctggcggcagcgcaaaagatg

SEQ ID NO: 180208 - DNA, 103 bp, Artificial Sequence
  Synthetic Polynucleotide
taatacgactcactatagggtacatattcacttctgcgggttgactggctaacagaggagaagccagatgacccgcagaaacctggcggcagcgcaaaagatg

SEQ ID NO: 180209 - DNA, 103 bp, Artificial Sequence
  Synthetic Polynucleotide
taatacgactcactatagggggaatgcatcagcctgggctgctcgtccataacagaggagaatggacatgcagcccaggaacctggcggcagcgcaaaagatg

SEQ ID NO: 180210 - DNA, 103 bp, Artificial Sequence
  Synthetic Polynucleotide
taatacgactcactatagggcttcctcccgccctccccctcggtccctccaacagaggagaggagggatggagggggagaacctggcggcagcgcaaaagatg

SEQ ID NO: 180211 - DNA, 103 bp, Artificial Sequence
  Synthetic Polynucleotide
taatacgactcactatagggcatgttaaaagaactggaagaaccagccgaaacagaggagatcggctatgtcttccagtaacctggcggcagcgcaaaagatg

SEQ ID NO: 180212 - DNA, 103 bp, Artificial Sequence
  Synthetic Polynucleotide
taatacgactcactatagggcagagtttgacatgttaaaagaactggaagaacagaggagacttccaatgcttttaacaaacctggcggcagcgcaaaagatg

SEQ ID NO: 180213 - DNA, 103 bp, Artificial Sequence
  Synthetic Polynucleotide
taatacgactcactatagggaacaaatctccagagtttgacatgttaaaaaacagaggagattttaaatggtcaaactcaacctggcggcagcgcaaaagatg

SEQ ID NO: 180214 - DNA, 103 bp, Artificial Sequence
  Synthetic Polynucleotide
taatacgactcactatagggcacgctcatgaacaaatctccagagtttgaaacagaggagatcaaacatgggagatttgaacctggcggcagcgcaaaagatg

SEQ ID NO: 180215 - DNA, 103 bp, Artificial Sequence
  Synthetic Polynucleotide
taatacgactcactatagggtgagtgactgcacgctcatgaacaaatctcaacagaggagagagattatgtcatgagcgaacctggcggcagcgcaaaagatg

SEQ ID NO: 180216 - DNA, 103 bp, Artificial Sequence
  Synthetic Polynucleotide
taatacgactcactataggggaatccccattgagtgactgcacgctcatgaacagaggagacatgagatggcagtcactaacctggcggcagcgcaaaagatg

SEQ ID NO: 180217 - DNA, 103 bp, Artificial Sequence
  Synthetic Polynucleotide
taatacgactcactatagggcccttggtaagaatccccattgagtgactgaacagaggagacagtcaatgaatggggataacctggcggcagcgcaaaagatg

SEQ ID NO: 180218 - DNA, 103 bp, Artificial Sequence
  Synthetic Polynucleotide
taatacgactcactatagggcaacctgggccccttggtaagaatccccataacagaggagaatggggatgcttaccaagaacctggcggcagcgcaaaagatg

SEQ ID NO: 180219 - DNA, 103 bp, Artificial Sequence
  Synthetic Polynucleotide
taatacgactcactatagggacgttggctccaacctgggccccttggtaaaacagaggagattaccaatgggcccaggtaacctggcggcagcgcaaaagatg

SEQ ID NO: 180220 - DNA, 103 bp, Artificial Sequence
  Synthetic Polynucleotide
taatacgactcactatagggctgtgattgcacgttggctccaacctgggcaacagaggagagcccagatgggagccaacaacctggcggcagcgcaaaagatg

SEQ ID NO: 180221 - DNA, 103 bp, Artificial Sequence
  Synthetic Polynucleotide
taatacgactcactatagggcaatgtcctgcttcctcccgccctccccctaacagaggagaagggggatggcgggaggaaacctggcggcagcgcaaaagatg

SEQ ID NO: 180222 - DNA, 103 bp, Artificial Sequence
  Synthetic Polynucleotide
taatacgactcactataggggggtatccacctgtgattgcacgttggctcaacagaggagagagccaatgtgcaatcacaacctggcggcagcgcaaaagatg

SEQ ID NO: 180223 - DNA, 103 bp, Artificial Sequence
  Synthetic Polynucleotide
taatacgactcactatagggacatggcgaagggtatccacctgtgattgcaacagaggagagcaatcatgggtggatacaacctggcggcagcgcaaaagatg

SEQ ID NO: 180224 - DNA, 103 bp, Artificial Sequence
  Synthetic Polynucleotide
taatacgactcactatagggctggctgataacatggcgaagggtatccacaacagaggagagtggatatgcttcgccataacctggcggcagcgcaaaagatg

SEQ ID NO: 180225 - DNA, 103 bp, Artificial Sequence
  Synthetic Polynucleotide
taatacgactcactatagggatcctcctgtctggctgataacatggcgaaaacagaggagattcgccatgttatcagccaacctggcggcagcgcaaaagatg

SEQ ID NO: 180226 - DNA, 103 bp, Artificial Sequence
  Synthetic Polynucleotide
taatacgactcactatagggccatcactgtatcctcctgtctggctgataaacagaggagatatcagatggacaggaggaacctggcggcagcgcaaaagatg

SEQ ID NO: 180227 - DNA, 103 bp, Artificial Sequence
  Synthetic Polynucleotide
taatacgactcactatagggggctgcgagtccatcactgtatcctcctgtaacagaggagaacaggaatgtacagtgataacctggcggcagcgcaaaagatg

SEQ ID NO: 180228 - DNA, 103 bp, Artificial Sequence
  Synthetic Polynucleotide
taatacgactcactatagggacatctgactggctgcgagtccatcactgtaacagaggagaacagtgatggactcgcagaacctggcggcagcgcaaaagatg

SEQ ID NO: 180229 - DNA, 103 bp, Artificial Sequence
  Synthetic Polynucleotide
taatacgactcactatagggtgcggactgtacatctgactggctgcgagtaacagaggagaactcgcatgcagtcagataacctggcggcagcgcaaaagatg

SEQ ID NO: 180230 - DNA, 103 bp, Artificial Sequence
  Synthetic Polynucleotide
taatacgactcactatagggactgatgccctgcggactgtacatctgactaacagaggagaagtcagatgtacagtccgaacctggcggcagcgcaaaagatg

SEQ ID NO: 180231 - DNA, 103 bp, Artificial Sequence
  Synthetic Polynucleotide
taatacgactcactatagggctccattagcactgatgccctgcggactgtaacagaggagaacagtcatgagggcatcaaacctggcggcagcgcaaaagatg

SEQ ID NO: 180232 - DNA, 103 bp, Artificial Sequence
  Synthetic Polynucleotide
taatacgactcactatagggaaaatgtctccaatgtcctgcttcctcccgaacagaggagacgggagatggcaggacataacctggcggcagcgcaaaagatg

SEQ ID NO: 180233 - DNA, 103 bp, Artificial Sequence
  Synthetic Polynucleotide
taatacgactcactatagggtcctgccaacctccattagcactgatgcccaacagaggagagggcatatgtgctaatggaacctggcggcagcgcaaaagatg

SEQ ID NO: 180234 - DNA, 103 bp, Artificial Sequence
  Synthetic Polynucleotide
taatacgactcactatagggggtagtagcatcctgccaacctccattagcaacagaggagagctaatatgggttggcagaacctggcggcagcgcaaaagatg

SEQ ID NO: 180235 - DNA, 103 bp, Artificial Sequence
  Synthetic Polynucleotide
taatacgactcactatagggctgatgaaggggtagtagcatcctgccaacaacagaggagagttggcatgatgctactaaacctggcggcagcgcaaaagatg

SEQ ID NO: 180236 - DNA, 103 bp, Artificial Sequence
  Synthetic Polynucleotide
taatacgactcactatagggggggaggtcactgatgaaggggtagtagcaaacagaggagatgctacatgcccttcatcaacctggcggcagcgcaaaagatg

SEQ ID NO: 180237 - DNA, 103 bp, Artificial Sequence
  Synthetic Polynucleotide
taatacgactcactataggggccttctgtaggggaggtcactgatgaaggaacagaggagaccttcaatggtgacctccaacctggcggcagcgcaaaagatg

SEQ ID NO: 180238 - DNA, 103 bp, Artificial Sequence
  Synthetic Polynucleotide
taatacgactcactatagggcactgccagggccttctgtaggggaggtcaaacagaggagatgacctatgctacagaagaacctggcggcagcgcaaaagatg

SEQ ID NO: 180239 - DNA, 103 bp, Artificial Sequence
  Synthetic Polynucleotide
taatacgactcactatagggtcagagtgaacactgccagggccttctgtaaacagaggagatacagaatgccctggcagaacctggcggcagcgcaaaagatg

SEQ ID NO: 180240 - DNA, 103 bp, Artificial Sequence
  Synthetic Polynucleotide
taatacgactcactataggggttggaggtatcagagtgaacactgccaggaacagaggagacctggcatggttcactctaacctggcggcagcgcaaaagatg

SEQ ID NO: 180241 - DNA, 103 bp, Artificial Sequence
  Synthetic Polynucleotide
taatacgactcactatagggaatttgctgtaaaatgtctccaatgtcctgaacagaggagacaggacatgggagacattaacctggcggcagcgcaaaagatg

SEQ ID NO: 180242 - DNA, 103 bp, Artificial Sequence
  Synthetic Polynucleotide
taatacgactcactatagggtgatggtcataatttgctgtaaaatgtctcaacagaggagagagacaatgtacagcaaaaacctggcggcagcgcaaaagatg

SEQ ID NO: 180243 - DNA, 103 bp, Artificial Sequence
  Synthetic Polynucleotide
taatacgactcactatagggctctggtctgtgatggtcataatttgctgtaacagaggagaacagcaatgtatgaccataacctggcggcagcgcaaaagatg

SEQ ID NO: 180244 - DNA, 103 bp, Artificial Sequence
  Synthetic Polynucleotide
taatacgactcactatagggctcatccaaactctggtctgtgatggtcataacagaggagaatgaccatgacagaccagaacctggcggcagcgcaaaagatg

SEQ ID NO: 180245 - DNA, 103 bp, Artificial Sequence
  Synthetic Polynucleotide
taatacgactcactatagggtggcctgcgcctcatccaaactctggtctgaacagaggagacagaccatggtttggatgaacctggcggcagcgcaaaagatg

SEQ ID NO: 180246 - DNA, 103 bp, Artificial Sequence
  Synthetic Polynucleotide
taatacgactcactataggggcatgttttctggcctgcgcctcatccaaaaacagaggagatttggaatgggcgcaggcaacctggcggcagcgcaaaagatg

SEQ ID NO: 180247 - DNA, 103 bp, Artificial Sequence
  Synthetic Polynucleotide
taatacgactcactataggggcagtttaaagcatgttttctggcctgcgcaacagaggagagcgcagatgagaaaacataacctggcggcagcgcaaaagatg

SEQ ID NO: 180248 - DNA, 103 bp, Artificial Sequence
  Synthetic Polynucleotide
taatacgactcactatagggccccagcatgggaatgcatcagcctgggctaacagaggagaagcccaatgtgatgcattaacctggcggcagcgcaaaagatg

SEQ ID NO: 180249 - DNA, 103 bp, Artificial Sequence
  Synthetic Polynucleotide
taatacgactcactatagggtcattctgtggcagtttaaagcatgttttcaacagaggagagaaaacatgctttaaactaacctggcggcagcgcaaaagatg

SEQ ID NO: 180250 - DNA, 103 bp, Artificial Sequence
  Synthetic Polynucleotide
taatacgactcactatagggaaggcaggcttcattctgtggcagtttaaaaacagaggagatttaaaatgccacagaataacctggcggcagcgcaaaagatg

SEQ ID NO: 180251 - DNA, 103 bp, Artificial Sequence
  Synthetic Polynucleotide
taatacgactcactatagggcacattaaacaaggcaggcttcattctgtgaacagaggagacacagaatgaagcctgccaacctggcggcagcgcaaaagatg

SEQ ID NO: 180252 - DNA, 103 bp, Artificial Sequence
  Synthetic Polynucleotide
taatacgactcactatagggtttcacacaacacattaaacaaggcaggctaacagaggagaagcctgatgtgtttaatgaacctggcggcagcgcaaaagatg

SEQ ID NO: 180253 - DNA, 103 bp, Artificial Sequence
  Synthetic Polynucleotide
taatacgactcactatagggttttctttgatttcacacaacacattaaacaacagaggagagtttaaatggttgtgtgaaacctggcggcagcgcaaaagatg

SEQ ID NO: 180254 - DNA, 103 bp, Artificial Sequence
  Synthetic Polynucleotide
taatacgactcactatagggcaaaactgttttttctttgatttcacacaaaacagaggagattgtgtatgatcaaagaaaacctggcggcagcgcaaaagatg

SEQ ID NO: 180255 - DNA, 103 bp, Artificial Sequence
  Synthetic Polynucleotide
taatacgactcactatagggctcggatactcaaaactgttttttctttgaaacagaggagatcaaagatgaaacagtttaacctggcggcagcgcaaaagatg

SEQ ID NO: 180256 - DNA, 103 bp, Artificial Sequence
  Synthetic Polynucleotide
taatacgactcactatagggtcctgggctcctcggatactcaaaactgttaacagaggagaaacagtatggagtatccgaacctggcggcagcgcaaaagatg

SEQ ID NO: 180257 - DNA, 103 bp, Artificial Sequence
  Synthetic Polynucleotide
taatacgactcactataggggggttcctcctcctgggctcctcggatactaacagaggagaagtatcatgggagcccagaacctggcggcagcgcaaaagatg

SEQ ID NO: 180258 - DNA, 103 bp, Artificial Sequence
  Synthetic Polynucleotide
taatacgactcactataggggggggtctgtgggttcctcctcctgggctcaacagaggagagagcccatgaggaggaacaacctggcggcagcgcaaaagatg

SEQ ID NO: 180259 - DNA, 103 bp, Artificial Sequence
  Synthetic Polynucleotide
taatacgactcactataggggccatcccgaccccagcatgggaatgcatcaacagaggagagatgcaatgccatgctggaacctggcggcagcgcaaaagatg

SEQ ID NO: 180260 - DNA, 103 bp, Artificial Sequence
  Synthetic Polynucleotide
taatacgactcactatagggcgcatcagctgggggtctgtgggttcctccaacagaggagaggaggaatgcacagacccaacctggcggcagcgcaaaagatg

SEQ ID NO: 180261 - DNA, 103 bp, Artificial Sequence
  Synthetic Polynucleotide
taatacgactcactataggggttgtccagccgcatcagctgggggtctgtaacagaggagaacagacatgcagctgatgaacctggcggcagcgcaaaagatg

SEQ ID NO: 180262 - DNA, 103 bp, Artificial Sequence
  Synthetic Polynucleotide
taatacgactcactatagggctaacagcatgttgtccagccgcatcagctaacagaggagaagctgaatgggctggacaaacctggcggcagcgcaaaagatg

SEQ ID NO: 180263 - DNA, 103 bp, Artificial Sequence
  Synthetic Polynucleotide
taatacgactcactatagggacgccttccgctaacagcatgttgtccagcaacagaggagagctggaatgcatgctgttaacctggcggcagcgcaaaagatg

SEQ ID NO: 180264 - DNA, 103 bp, Artificial Sequence
  Synthetic Polynucleotide
taatacgactcactatagggaggccccgccacgccttccgctaacagcataacagaggagaatgctgatggcggaaggcaacctggcggcagcgcaaaagatg

SEQ ID NO: 180265 - DNA, 103 bp, Artificial Sequence
  Synthetic Polynucleotide
taatacgactcactatagggcgcccttctcaggccccgccacgccttccgaacagaggagacggaagatgtggcggggcaacctggcggcagcgcaaaagatg

SEQ ID NO: 180266 - DNA, 103 bp, Artificial Sequence
  Synthetic Polynucleotide
taatacgactcactataggggccgaccctccgcccttctcaggccccgccaacagaggagaggcgggatgtgagaagggaacctggcggcagcgcaaaagatg

SEQ ID NO: 180267 - DNA, 103 bp, Artificial Sequence
  Synthetic Polynucleotide
taatacgactcactatagggcgccgctgccgccgaccctccgcccttctcaacagaggagagagaagatgggagggtcgaacctggcggcagcgcaaaagatg

SEQ ID NO: 180268 - DNA, 103 bp, Artificial Sequence
  Synthetic Polynucleotide
taatacgactcactatagggccgccgctgccgccgctgccgccgaccctcaacagaggagagagggtatgcggcagcggaacctggcggcagcgcaaaagatg

SEQ ID NO: 180269 - DNA, 103 bp, Artificial Sequence
  Synthetic Polynucleotide
taatacgactcactatagggccagaagccgccgccgctgccgccgctgccaacagaggagaggcagcatgggcagcggcaacctggcggcagcgcaaaagatg

SEQ ID NO: 180270 - DNA, 103 bp, Artificial Sequence
  Synthetic Polynucleotide
taatacgactcactatagggggggtgtccggccatcccgaccccagcatgaacagaggagacatgctatggtcgggatgaacctggcggcagcgcaaaagatg

SEQ ID NO: 180271 - DNA, 103 bp, Artificial Sequence
  Synthetic Polynucleotide
taatacgactcactatagggacctgcccctccagaagccgccgccgctgcaacagaggagagcagcgatggcggcttctaacctggcggcagcgcaaaagatg

SEQ ID NO: 180272 - DNA, 103 bp, Artificial Sequence
  Synthetic Polynucleotide
taatacgactcactatagggagttgtctgaacctgcccctccagaagccgaacagaggagacggcttatggaggggcagaacctggcggcagcgcaaaagatg

SEQ ID NO: 180273 - DNA, 103 bp, Artificial Sequence
  Synthetic Polynucleotide
taatacgactcactatagggtgctccactgagttgtctgaacctgcccctaacagaggagaaggggcatgttcagacaaaacctggcggcagcgcaaaagatg

SEQ ID NO: 180274 - DNA, 103 bp, Artificial Sequence
  Synthetic Polynucleotide
taatacgactcactataggggtaatctgaatgctccactgagttgtctgaaacagaggagatcagacatgtcagtggagaacctggcggcagcgcaaaagatg

SEQ ID NO: 180275 - DNA, 103 bp, Artificial Sequence
  Synthetic Polynucleotide
taatacgactcactataggggtttggctctgtaatctgaatgctccactgaacagaggagacagtggatgattcagattaacctggcggcagcgcaaaagatg

SEQ ID NO: 180276 - DNA, 103 bp, Artificial Sequence
  Synthetic Polynucleotide
taatacgactcactatagggatctgtgagagtttggctctgtaatctgaaaacagaggagattcagaatgcagagccaaaacctggcggcagcgcaaaagatg

SEQ ID NO: 180277 - DNA, 103 bp, Artificial Sequence
  Synthetic Polynucleotide
taatacgactcactataggggatttgtctgatctgtgagagtttggctctaacagaggagaagagccatgctctcacagaacctggcggcagcgcaaaagatg

SEQ ID NO: 180278 - DNA, 103 bp, Artificial Sequence
  Synthetic Polynucleotide
taatacgactcactatagggccgtatggtagatttgtctgatctgtgagaaacagaggagatctcacatgtcagacaaaaacctggcggcagcgcaaaagatg

SEQ ID NO: 180279 - DNA, 103 bp, Artificial Sequence
  Synthetic Polynucleotide
taatacgactcactatagggttctccagctccgtatggtagatttgtctgaacagaggagacagacaatgctaccatacaacctggcggcagcgcaaaagatg

SEQ ID NO: 180280 - DNA, 103 bp, Artificial Sequence
  Synthetic Polynucleotide
taatacgactcactatagggctgctcgtatttctccagctccgtatggtaaacagaggagataccatatggagctggagaacctggcggcagcgcaaaagatg

SEQ ID NO: 180281 - DNA, 103 bp, Artificial Sequence
  Synthetic Polynucleotide
taatacgactcactataggggggacaggccggggtgtccggccatcccgaaacagaggagatcgggaatgccggacaccaacctggcggcagcgcaaaagatg

SEQ ID NO: 180282 - DNA, 103 bp, Artificial Sequence
  Synthetic Polynucleotide
taatacgactcactatagggcgttgcaggcctgctcgtatttctccagctaacagaggagaagctggatgaatacgagcaacctggcggcagcgcaaaagatg

SEQ ID NO: 180283 - DNA, 103 bp, Artificial Sequence
  Synthetic Polynucleotide
taatacgactcactataggggtggtgaactcgttgcaggcctgctcgtataacagaggagaatacgaatgggcctgcaaaacctggcggcagcgcaaaagatg

SEQ ID NO: 180284 - DNA, 103 bp, Artificial Sequence
  Synthetic Polynucleotide
taatacgactcactatagggcatcacgtgggtggtgaactcgttgcaggcaacagaggagagcctgcatggagttcaccaacctggcggcagcgcaaaagatg

SEQ ID NO: 180285 - DNA, 103 bp, Artificial Sequence
  Synthetic Polynucleotide
taatacgactcactataggggcaggagattcatcacgtgggtggtgaactaacagaggagaagttcaatgcccacgtgaaacctggcggcagcgcaaaagatg

SEQ ID NO: 180286 - DNA, 103 bp, Artificial Sequence
  Synthetic Polynucleotide
taatacgactcactatagggctttgctctcgcaggagattcatcacgtggaacagaggagaccacgtatggaatctcctaacctggcggcagcgcaaaagatg

SEQ ID NO: 180287 - DNA, 103 bp, Artificial Sequence
  Synthetic Polynucleotide
taatacgactcactatagggcctggtccggctttgctctcgcaggagattaacagaggagaaatctcatgcgagagcaaaacctggcggcagcgcaaaagatg

SEQ ID NO: 180288 - DNA, 103 bp, Artificial Sequence
  Synthetic Polynucleotide
taatacgactcactataggggggagatgggcctggtccggctttgctctcaacagaggagagagagcatggccggaccaaacctggcggcagcgcaaaagatg

SEQ ID NO: 180289 - DNA, 103 bp, Artificial Sequence
  Synthetic Polynucleotide
taatacgactcactatagggatctcctttggggagatgggcctggtccggaacagaggagaccggacatggcccatctcaacctggcggcagcgcaaaagatg

SEQ ID NO: 180290 - DNA, 103 bp, Artificial Sequence
  Synthetic Polynucleotide
taatacgactcactatagggcatccgctcaatctcctttggggagatgggaacagaggagacccatcatgccaaaggagaacctggcggcagcgcaaaagatg

SEQ ID NO: 180291 - DNA, 103 bp, Artificial Sequence
  Synthetic Polynucleotide
taatacgactcactatagggtgatgctgaccatccgctcaatctcctttgaacagaggagacaaaggatgttgagcggaaacctggcggcagcgcaaaagatg

SEQ ID NO: 180292 - DNA, 103 bp, Artificial Sequence
  Synthetic Polynucleotide
taatacgactcactatagggtgcaagtgctgggacaggccggggtgtccgaacagaggagacggacaatgcggcctgtcaacctggcggcagcgcaaaagatg

SEQ ID NO: 180293 - DNA, 103 bp, Artificial Sequence
  Synthetic Polynucleotide
taatacgactcactatagggttgcggtggatgatgctgaccatccgctcaaacagaggagatgagcgatgggtcagcataacctggcggcagcgcaaaagatg

SEQ ID NO: 180294 - DNA, 103 bp, Artificial Sequence
  Synthetic Polynucleotide
taatacgactcactatagggggagctgaacttgcggtggatgatgctgacaacagaggagagtcagcatgatccaccgcaacctggcggcagcgcaaaagatg

SEQ ID NO: 180295 - DNA, 103 bp, Artificial Sequence
  Synthetic Polynucleotide
taatacgactcactataggggcatctggatggagctgaacttgcggtggaaacagaggagatccaccatgagttcagctaacctggcggcagcgcaaaagatg

SEQ ID NO: 180296 - DNA, 103 bp, Artificial Sequence
  Synthetic Polynucleotide
taatacgactcactatagggtgcttgagctgcatctggatggagctgaacaacagaggagagttcagatgcatccagataacctggcggcagcgcaaaagatg

SEQ ID NO: 180297 - DNA, 103 bp, Artificial Sequence
  Synthetic Polynucleotide
taatacgactcactataggggcacgtgctctgcttgagctgcatctggataacagaggagaatccagatgcagctcaagaacctggcggcagcgcaaaagatg

SEQ ID NO: 180298 - DNA, 103 bp, Artificial Sequence
  Synthetic Polynucleotide
taatacgactcactatagggtcaccgcctcgcacgtgctctgcttgagctaacagaggagaagctcaatgagagcacgtaacctggcggcagcgcaaaagatg

SEQ ID NO: 180299 - DNA, 103 bp, Artificial Sequence
  Synthetic Polynucleotide
taatacgactcactatagggcgcaggatcatcaccgcctcgcacgtgctcaacagaggagagagcacatgcgaggcggtaacctggcggcagcgcaaaagatg

SEQ ID NO: 180300 - DNA, 103 bp, Artificial Sequence
  Synthetic Polynucleotide
taatacgactcactatagggaaatcgggaacgcaggatcatcaccgcctcaacagaggagagaggcgatgatgatcctgaacctggcggcagcgcaaaagatg

SEQ ID NO: 180301 - DNA, 103 bp, Artificial Sequence
  Synthetic Polynucleotide
taatacgactcactataggggcgcatccagaaatcgggaacgcaggatcaaacagaggagatgatccatggttcccgataacctggcggcagcgcaaaagatg

SEQ ID NO: 180302 - DNA, 103 bp, Artificial Sequence
  Synthetic Polynucleotide
taatacgactcactatagggctcttccgccgcgcatccagaaatcgggaaaacagaggagattcccgatgtctggatgcaacctggcggcagcgcaaaagatg

SEQ ID NO: 180303 - DNA, 103 bp, Artificial Sequence
  Synthetic Polynucleotide
taatacgactcactatagggggccccatcctgcaagtgctgggacaggccaacagaggagaggcctgatgcagcacttgaacctggcggcagcgcaaaagatg

SEQ ID NO: 180304 - DNA, 103 bp, Artificial Sequence
  Synthetic Polynucleotide
taatacgactcactataggggaaattccgtctcttccgccgcgcatccagaacagaggagactggatatgcggcggaagaacctggcggcagcgcaaaagatg

SEQ ID NO: 180305 - DNA, 103 bp, Artificial Sequence
  Synthetic Polynucleotide
taatacgactcactatagggcttgcttgttgaaattccgtctcttccgccaacagaggagaggcggaatggacggaattaacctggcggcagcgcaaaagatg

SEQ ID NO: 180306 - DNA, 103 bp, Artificial Sequence
  Synthetic Polynucleotide
taatacgactcactatagggatttctgtcgcttgcttgttgaaattccgtaacagaggagaacggaaatgcaacaagcaaacctggcggcagcgcaaaagatg

SEQ ID NO: 180307 - DNA, 103 bp, Artificial Sequence
  Synthetic Polynucleotide
taatacgactcactatagggttcattcaggatttctgtcgcttgcttgttaacagaggagaaacaagatggcgacagaaaacctggcggcagcgcaaaagatg

SEQ ID NO: 180308 - DNA, 103 bp, Artificial Sequence
  Synthetic Polynucleotide
taatacgactcactatagggaatagaaatattcattcaggatttctgtcgaacagaggagacgacagatgtcctgaatgaacctggcggcagcgcaaaagatg

SEQ ID NO: 180309 - DNA, 103 bp, Artificial Sequence
  Synthetic Polynucleotide
taatacgactcactatagggctgagatgggaatagaaatattcattcaggaacagaggagacctgaaatgatatttctaaacctggcggcagcgcaaaagatg

SEQ ID NO: 180310 - DNA, 103 bp, Artificial Sequence
  Synthetic Polynucleotide
taatacgactcactataggggtaagggttgctgagatgggaatagaaataaacagaggagatatttcatgtcccatctcaacctggcggcagcgcaaaagatg

SEQ ID NO: 180311 - DNA, 103 bp, Artificial Sequence
  Synthetic Polynucleotide
taatacgactcactatagggcctcactggggtaagggttgctgagatgggaacagaggagacccatcatggcaacccttaacctggcggcagcgcaaaagatg

SEQ ID NO: 180312 - DNA, 103 bp, Artificial Sequence
  Synthetic Polynucleotide
taatacgactcactatagggtctttggcttcctcactggggtaagggttgaacagaggagacaacccatgccccagtgaaacctggcggcagcgcaaaagatg

SEQ ID NO: 180313 - DNA, 103 bp, Artificial Sequence
  Synthetic Polynucleotide
taatacgactcactatagggggctaactcctctttggcttcctcactgggaacagaggagacccagtatggaagccaaaaacctggcggcagcgcaaaagatg

SEQ ID NO: 180314 - DNA, 103 bp, Artificial Sequence
  Synthetic Polynucleotide
taatacgactcactatagggcggtccctccggccccatcctgcaagtgctaacagaggagaagcactatgaggatggggaacctggcggcagcgcaaaagatg

SEQ ID NO: 180315 - DNA, 103 bp, Artificial Sequence
  Synthetic Polynucleotide
taatacgactcactatagggcacacttcttggctaactcctctttggcttaacagaggagaaagccaatgaggagttagaacctggcggcagcgcaaaagatg

SEQ ID NO: 180316 - DNA, 103 bp, Artificial Sequence
  Synthetic Polynucleotide
taatacgactcactatagggactgtgatgccacacttcttggctaactccaacagaggagaggagttatgcaagaagtgaacctggcggcagcgcaaaagatg

SEQ ID NO: 180317 - DNA, 103 bp, Artificial Sequence
  Synthetic Polynucleotide
taatacgactcactatagggtacctgggagactgtgatgccacacttcttaacagaggagaaagaagatgggcatcacaaacctggcggcagcgcaaaagatg

SEQ ID NO: 180318 - DNA, 103 bp, Artificial Sequence
  Synthetic Polynucleotide
taatacgactcactatagggaccagtttgatacctgggagactgtgatgcaacagaggagagcatcaatgtctcccaggaacctggcggcagcgcaaaagatg

SEQ ID NO: 180319 - DNA, 103 bp, Artificial Sequence
  Synthetic Polynucleotide
taatacgactcactatagggttatttccaaaccagtttgatacctgggagaacagaggagactcccaatgatcaaactgaacctggcggcagcgcaaaagatg

SEQ ID NO: 180320 - DNA, 103 bp, Artificial Sequence
  Synthetic Polynucleotide
taatacgactcactatagggccggattcgcttatttccaaaccagtttgaaacagaggagatcaaacatgtttggaaataacctggcggcagcgcaaaagatg

SEQ ID NO: 180321 - DNA, 103 bp, Artificial Sequence
  Synthetic Polynucleotide
taatacgactcactatagggtcttcttgtaccggattcgcttatttccaaaacagaggagattggaaatgagcgaatccaacctggcggcagcgcaaaagatg

SEQ ID NO: 180322 - DNA, 103 bp, Artificial Sequence
  Synthetic Polynucleotide
taatacgactcactatagggttacctatgttcttcttgtaccggattcgcaacagaggagagcgaatatggtacaagaaaacctggcggcagcgcaaaagatg

SEQ ID NO: 180323 - DNA, 103 bp, Artificial Sequence
  Synthetic Polynucleotide
taatacgactcactatagggctcttgaaatttacctatgttcttcttgtaaacagaggagatacaagatgaacataggtaacctggcggcagcgcaaaagatg

SEQ ID NO: 180324 - DNA, 103 bp, Artificial Sequence
  Synthetic Polynucleotide
taatacgactcactatagggtattggcttcctcttgaaatttacctatgtaacagaggagaacatagatgaatttcaagaacctggcggcagcgcaaaagatg

SEQ ID NO: 180325 - DNA, 103 bp, Artificial Sequence
  Synthetic Polynucleotide
taatacgactcactatagggccctccccctcggtccctccggccccatccaacagaggagaggatggatgcggagggacaacctggcggcagcgcaaaagatg

SEQ ID NO: 180326 - DNA, 103 bp, Artificial Sequence
  Synthetic Polynucleotide
taatacgactcactataggggcagcataaatattggcttcctcttgaaataacagaggagaatttcaatgggaagccaaaacctggcggcagcgcaaaagatg

SEQ ID NO: 180327 - DNA, 103 bp, Artificial Sequence
  Synthetic Polynucleotide
taatacgactcactatagggagctgttttggcagcataaatattggcttcaacagaggagagaagccatgatttatgctaacctggcggcagcgcaaaagatg

SEQ ID NO: 180328 - DNA, 103 bp, Artificial Sequence
  Synthetic Polynucleotide
taatacgactcactatagggtagcagtgacagctgttttggcagcataaaaacagaggagatttatgatgccaaaacagaacctggcggcagcgcaaaagatg

SEQ ID NO: 180329 - DNA, 103 bp, Artificial Sequence
  Synthetic Polynucleotide
taatacgactcactataggggacacattggtagcagtgacagctgttttgaacagaggagacaaaacatgtgtcactgcaacctggcggcagcgcaaaagatg

SEQ ID NO: 180330 - DNA, 103 bp, Artificial Sequence
  Synthetic Polynucleotide
taatacgactcactatagggtccatgggctgacacattggtagcagtgacaacagaggagagtcactatgaccaatgtgaacctggcggcagcgcaaaagatg

SEQ ID NO: 180331 - DNA, 103 bp, Artificial Sequence
  Synthetic Polynucleotide
taatacgactcactatagggtagcttggcttccatgggctgacacattggaacagaggagaccaatgatgcagcccatgaacctggcggcagcgcaaaagatg

SEQ ID NO: 180332 - DNA, 103 bp, Artificial Sequence
  Synthetic Polynucleotide
taatacgactcactataggggagggcgagttagcttggcttccatgggctaacagaggagaagcccaatgaagccaagcaacctggcggcagcgcaaaagatg

SEQ ID NO: 180333 - DNA, 103 bp, Artificial Sequence
  Synthetic Polynucleotide
taatacgactcactataggggttgggagttgagggcgagttagcttggctaacagaggagaagccaaatgaactcgcccaacctggcggcagcgcaaaagatg

SEQ ID NO: 180334 - DNA, 103 bp, Artificial Sequence
  Synthetic Polynucleotide
taatacgactcactatagggaaccagccgagttgggagttgagggcgagtaacagaggagaactcgcatgcaactcccaaacctggcggcagcgcaaaagatg

SEQ ID NO: 180335 - DNA, 103 bp, Artificial Sequence
  Synthetic Polynucleotide
taatacgactcactataggggaactggaagaaccagccgagttgggagttaacagaggagaaactccatgctcggctggaacctggcggcagcgcaaaagatg

SEQ ID NO: 180336 - DNA, 103 bp, Artificial Sequence
  Synthetic Polynucleotide
taatacgactcactatagggagggggcggccccagtagccgttcgtccataacagaggagaatggacatgcggctactgaacctggcggcagcgcaaaagatg

SEQ ID NO: 180337 - DNA, 103 bp, Artificial Sequence
  Synthetic Polynucleotide
taatacgactcactatagggacccccaccggggtctccgccaccgggaggaacagaggagacctcccatgggcggagacaacctggcggcagcgcaaaagatg

SEQ ID NO: 180338 - DNA, 103 bp, Artificial Sequence
  Synthetic Polynucleotide
taatacgactcactatagggagaggaagggggtgtcggggagctggtgcgaacagaggagacgcaccatgtccccgacaaacctggcggcagcgcaaaagatg

SEQ ID NO: 180339 - DNA, 103 bp, Artificial Sequence
  Synthetic Polynucleotide
taatacgactcactatagggcagagcctgcagaggaagggggtgtcggggaacagaggagaccccgaatgccccttcctaacctggcggcagcgcaaaagatg

SEQ ID NO: 180340 - DNA, 103 bp, Artificial Sequence
  Synthetic Polynucleotide
taatacgactcactatagggaaagagccgccagagcctgcagaggaagggaacagaggagacccttcatgtgcaggctcaacctggcggcagcgcaaaagatg

SEQ ID NO: 180341 - DNA, 103 bp, Artificial Sequence
  Synthetic Polynucleotide
taatacgactcactatagggtgagagattgaaagagccgccagagcctgcaacagaggagagcaggcatgggcggctctaacctggcggcagcgcaaaagatg

SEQ ID NO: 180342 - DNA, 103 bp, Artificial Sequence
  Synthetic Polynucleotide
taatacgactcactatagggctccagatcctgagagattgaaagagccgcaacagaggagagcggctatgtcaatctctaacctggcggcagcgcaaaagatg

SEQ ID NO: 180343 - DNA, 103 bp, Artificial Sequence
  Synthetic Polynucleotide
taatacgactcactatagggagaaacatgtctccagatcctgagagattgaacagaggagacaatctatgaggatctggaacctggcggcagcgcaaaagatg

SEQ ID NO: 180344 - DNA, 103 bp, Artificial Sequence
  Synthetic Polynucleotide
taatacgactcactatagggaggcatccccagaaacatgtctccagatccaacagaggagaggatctatggacatgtttaacctggcggcagcgcaaaagatg

SEQ ID NO: 180345 - DNA, 103 bp, Artificial Sequence
  Synthetic Polynucleotide
taatacgactcactatagggcgttgagcccaggcatccccagaaacatgtaacagaggagaacatgtatgtggggatgcaacctggcggcagcgcaaaagatg

SEQ ID NO: 180346 - DNA, 103 bp, Artificial Sequence
  Synthetic Polynucleotide
taatacgactcactatagggtaggaatctccgttgagcccaggcatccccaacagaggagaggggatatgtgggctcaaaacctggcggcagcgcaaaagatg

SEQ ID NO: 180347 - DNA, 103 bp, Artificial Sequence
  Synthetic Polynucleotide
taatacgactcactatagggggaagcagaataggaatctccgttgagcccaacagaggagagggctcatgggagattccaacctggcggcagcgcaaaagatg

SEQ ID NO: 180348 - DNA, 103 bp, Artificial Sequence
  Synthetic Polynucleotide
taatacgactcactatagggcccccccgctacccccaccggggtctccgcaacagaggagagcggagatgccggtggggaacctggcggcagcgcaaaagatg

SEQ ID NO: 180349 - DNA, 103 bp, Artificial Sequence
  Synthetic Polynucleotide
taatacgactcactatagggattccacctgggaagcagaataggaatctcaacagaggagagagattatgattctgcttaacctggcggcagcgcaaaagatg

SEQ ID NO: 180350 - DNA, 103 bp, Artificial Sequence
  Synthetic Polynucleotide
taatacgactcactatagggtgtcggagtgattccacctgggaagcagaaaacagaggagattctgcatgccaggtggaaacctggcggcagcgcaaaagatg

SEQ ID NO: 180351 - DNA, 103 bp, Artificial Sequence
  Synthetic Polynucleotide
taatacgactcactatagggccccatcgagtgtcggagtgattccacctgaacagaggagacaggtgatgtcactccgaaacctggcggcagcgcaaaagatg

SEQ ID NO: 180352 - DNA, 103 bp, Artificial Sequence
  Synthetic Polynucleotide
taatacgactcactatagggagccccctggccccatcgagtgtcggagtgaacagaggagacactccatgactcgatggaacctggcggcagcgcaaaagatg

SEQ ID NO: 180353 - DNA, 103 bp, Artificial Sequence
  Synthetic Polynucleotide
taatacgactcactatagggttatccccatagccccctggccccatcgagaacagaggagactcgatatggccagggggaacctggcggcagcgcaaaagatg

SEQ ID NO: 180354 - DNA, 103 bp, Artificial Sequence
  Synthetic Polynucleotide
taatacgactcactatagggtcccccgaggttatccccatagccccctggaacagaggagaccagggatgtatggggataacctggcggcagcgcaaaagatg

SEQ ID NO: 180355 - DNA, 103 bp, Artificial Sequence
  Synthetic Polynucleotide
taatacgactcactatagggacatctggcctcccccgaggttatccccataacagaggagaatggggatgacctcggggaacctggcggcagcgcaaaagatg

SEQ ID NO: 180356 - DNA, 103 bp, Artificial Sequence
  Synthetic Polynucleotide
taatacgactcactatagggcgtgggctgtacatctggcctcccccgaggaacagaggagacctcggatgaggccagataacctggcggcagcgcaaaagatg

SEQ ID NO: 180357 - DNA, 103 bp, Artificial Sequence
  Synthetic Polynucleotide
taatacgactcactatagggcctcatttcccgtgggctgtacatctggccaacagaggagaggccagatgtacagcccaaacctggcggcagcgcaaaagatg

SEQ ID NO: 180358 - DNA, 103 bp, Artificial Sequence
  Synthetic Polynucleotide
taatacgactcactatagggtgccatttgccctcatttcccgtgggctgtaacagaggagaacagccatggggaaatgaaacctggcggcagcgcaaaagatg

SEQ ID NO: 180359 - DNA, 103 bp, Artificial Sequence
  Synthetic Polynucleotide
taatacgactcactatagggcctcccgggacccccccgctacccccaccgaacagaggagacggtggatgtagcgggggaacctggcggcagcgcaaaagatg

SEQ ID NO: 180360 - DNA, 103 bp, Artificial Sequence
  Synthetic Polynucleotide
taatacgactcactatagggtcttgccagctgccatttgccctcatttccaacagaggagaggaaatatgggcaaatggaacctggcggcagcgcaaaagatg

SEQ ID NO: 180361 - DNA, 103 bp, Artificial Sequence
  Synthetic Polynucleotide
taatacgactcactatagggggtcacagcctcttgccagctgccatttgcaacagaggagagcaaatatgagctggcaaaacctggcggcagcgcaaaagatg

SEQ ID NO: 180362 - DNA, 103 bp, Artificial Sequence
  Synthetic Polynucleotide
taatacgactcactatagggctgaagagggggtcacagcctcttgccagcaacagaggagagctggcatgaggctgtgaaacctggcggcagcgcaaaagatg

SEQ ID NO: 180363 - DNA, 103 bp, Artificial Sequence
  Synthetic Polynucleotide
taatacgactcactatagggggggatgtcactgaagagggggtcacagccaacagaggagaggctgtatgcccctcttcaacctggcggcagcgcaaaagatg

SEQ ID NO: 180364 - DNA, 103 bp, Artificial Sequence
  Synthetic Polynucleotide
taatacgactcactatagggtccctccgttggggatgtcactgaagagggaacagaggagaccctctatggtgacatccaacctggcggcagcgcaaaagatg

SEQ ID NO: 180365 - DNA, 103 bp, Artificial Sequence
  Synthetic Polynucleotide
taatacgactcactatagggcactccctggtccctccgttggggatgtcaaacagaggagatgacatatgcaacggaggaacctggcggcagcgcaaaagatg

SEQ ID NO: 180366 - DNA, 103 bp, Artificial Sequence
  Synthetic Polynucleotide
taatacgactcactatagggtcagagtgaacactccctggtccctccgttaacagaggagaaacggaatgaccagggagaacctggcggcagcgcaaaagatg

SEQ ID NO: 180367 - DNA, 103 bp, Artificial Sequence
  Synthetic Polynucleotide
taatacgactcactataggggttggaggtatcagagtgaacactccctggaacagaggagaccagggatggttcactctaacctggcggcagcgcaaaagatg

SEQ ID NO: 180368 - DNA, 103 bp, Artificial Sequence
  Synthetic Polynucleotide
taatacgactcactatagggcttccctcggcctcccgggacccccccgctaacagaggagaagcgggatggtcccgggaaacctggcggcagcgcaaaagatg

SEQ ID NO: 180369 - DNA, 103 bp, Artificial Sequence
  Synthetic Polynucleotide
taatacgactcactatagggcgatgtcttgcttccctcggcctcccgggaaacagaggagatcccggatggccgagggaaacctggcggcagcgcaaaagatg

SEQ ID NO: 180370 - DNA, 103 bp, Artificial Sequence
  Synthetic Polynucleotide
taatacgactcactatagggagaatgtccccgatgtcttgcttccctcggaacagaggagaccgaggatggcaagacataacctggcggcagcgcaaaagatg

SEQ ID NO: 180371 - DNA, 103 bp, Artificial Sequence
  Synthetic Polynucleotide
taatacgactcactatagggtatctgctgcagaatgtccccgatgtcttgaacagaggagacaagacatgggggacattaacctggcggcagcgcaaaagatg

SEQ ID NO: 180372 - DNA, 103 bp, Artificial Sequence
  Synthetic Polynucleotide
taatacgactcactatagggtgatggtcattatctgctgcagaatgtcccaacagaggagagggacaatgtgcagcagaaacctggcggcagcgcaaaagatg

SEQ ID NO: 180373 - DNA, 103 bp, Artificial Sequence
  Synthetic Polynucleotide
taatacgactcactatagggctctggtcggtgatggtcattatctgctgcaacagaggagagcagcaatgaatgaccataacctggcggcagcgcaaaagatg

SEQ ID NO: 180374 - DNA, 103 bp, Artificial Sequence
  Synthetic Polynucleotide
taatacgactcactatagggctcgtccaggctctggtcggtgatggtcataacagaggagaatgaccatgaccgaccagaacctggcggcagcgcaaaagatg

SEQ ID NO: 180375 - DNA, 103 bp, Artificial Sequence
  Synthetic Polynucleotide
taatacgactcactatagggccccgcctggagggggcggccccagtagccaacagaggagaggctacatgggccgccccaacctggcggcagcgcaaaagatg

SEQ ID NO: 180376 - DNA, 103 bp, Artificial Sequence
  Synthetic Polynucleotide
taatacgactcactatagggtggcctgggcctcgtccaggctctggtcggaacagaggagaccgaccatggcctggacgaacctggcggcagcgcaaaagatg

SEQ ID NO: 180377 - DNA, 103 bp, Artificial Sequence
  Synthetic Polynucleotide
taatacgactcactataggggcgtgtttcttggcctgggcctcgtccaggaacagaggagacctggaatgggcccaggcaacctggcggcagcgcaaaagatg

SEQ ID NO: 180378 - DNA, 103 bp, Artificial Sequence
  Synthetic Polynucleotide
taatacgactcactataggggcagtttagggcgtgtttcttggcctgggcaacagaggagagcccagatgaagaaacacaacctggcggcagcgcaaaagatg

SEQ ID NO: 180379 - DNA, 103 bp, Artificial Sequence
  Synthetic Polynucleotide
taatacgactcactatagggtcattcggtggcagtttagggcgtgtttctaacagaggagaagaaacatgccctaaactaacctggcggcagcgcaaaagatg

SEQ ID NO: 180380 - DNA, 103 bp, Artificial Sequence
  Synthetic Polynucleotide
taatacgactcactatagggagagcaggcttcattcggtggcagtttaggaacagaggagacctaaaatgccaccgaataacctggcggcagcgcaaaagatg

SEQ ID NO: 180381 - DNA, 103 bp, Artificial Sequence
  Synthetic Polynucleotide
taatacgactcactataggggacgctaaagagagcaggcttcattcggtgaacagaggagacaccgaatgaagcctgctaacctggcggcagcgcaaaagatg

SEQ ID NO: 180382 - DNA, 103 bp, Artificial Sequence
  Synthetic Polynucleotide
taatacgactcactatagggtttcacacaggacgctaaagagagcaggctaacagaggagaagcctgatgtctttagcgaacctggcggcagcgcaaaagatg

SEQ ID NO: 180383 - DNA, 103 bp, Artificial Sequence
  Synthetic Polynucleotide
taatacgactcactatagggttctccttgatttcacacaggacgctaaagaacagaggagactttagatgcctgtgtgaaacctggcggcagcgcaaaagatg

SEQ ID NO: 180384 - DNA, 103 bp, Artificial Sequence
  Synthetic Polynucleotide
taatacgactcactataggggaggccagttttctccttgatttcacacagaacagaggagactgtgtatgatcaaggagaacctggcggcagcgcaaaagatg

SEQ ID NO: 180385 - DNA, 103 bp, Artificial Sequence
  Synthetic Polynucleotide
taatacgactcactatagggtccgaatgctgaggccagttttctccttgaaacagaggagatcaaggatgaaactggccaacctggcggcagcgcaaaagatg

SEQ ID NO: 180386 - DNA, 103 bp, Artificial Sequence
  Synthetic Polynucleotide
taatacgactcactatagggcccccccggcccccgcctggagggggcggcaacagaggagagccgccatgtccaggcggaacctggcggcagcgcaaaagatg

SEQ ID NO: 180387 - DNA, 103 bp, Artificial Sequence
  Synthetic Polynucleotide
taatacgactcactatagggtcctgggagctccgaatgctgaggccagttaacagaggagaaactggatgcagcattcgaacctggcggcagcgcaaaagatg

SEQ ID NO: 180388 - DNA, 103 bp, Artificial Sequence
  Synthetic Polynucleotide
taatacgactcactatagggcggctcctcctcctgggagctccgaatgctaacagaggagaagcattatgagctcccagaacctggcggcagcgcaaaagatg

SEQ ID NO: 180389 - DNA, 103 bp, Artificial Sequence
  Synthetic Polynucleotide
taatacgactcactataggggtgggtccaccggctcctcctcctgggagcaacagaggagagctcccatgaggaggagcaacctggcggcagcgcaaaagatg

SEQ ID NO: 180390 - DNA, 103 bp, Artificial Sequence
  Synthetic Polynucleotide
taatacgactcactatagggcgcatcagctgtgggtccaccggctcctccaacagaggagaggaggaatgggtggacccaacctggcggcagcgcaaaagatg

SEQ ID NO: 180391 - DNA, 103 bp, Artificial Sequence
  Synthetic Polynucleotide
taatacgactcactataggggttgtccaagcgcatcagctgtgggtccacaacagaggagagtggacatgcagctgatgaacctggcggcagcgcaaaagatg

SEQ ID NO: 180392 - DNA, 103 bp, Artificial Sequence
  Synthetic Polynucleotide
taatacgactcactatagggccagaagcatgttgtccaagcgcatcagctaacagaggagaagctgaatggcttggacaaacctggcggcagcgcaaaagatg

SEQ ID NO: 180393 - DNA, 103 bp, Artificial Sequence
  Synthetic Polynucleotide
taatacgactcactatagggacaccctctgccagaagcatgttgtccaagaacagaggagacttggaatgcatgcttctaacctggcggcagcgcaaaagatg

SEQ ID NO: 180394 - DNA, 103 bp, Artificial Sequence
  Synthetic Polynucleotide
taatacgactcactataggggggcccagccacaccctctgccagaagcataacagaggagaatgcttatggcagagggtaacctggcggcagcgcaaaagatg

SEQ ID NO: 180395 - DNA, 103 bp, Artificial Sequence
  Synthetic Polynucleotide
taatacgactcactatagggcccctttctcgggcccagccacaccctctgaacagaggagacagaggatgtggctgggcaacctggcggcagcgcaaaagatg

SEQ ID NO: 180396 - DNA, 103 bp, Artificial Sequence
  Synthetic Polynucleotide
taatacgactcactataggggctgagccgccccctttctcgggcccagccaacagaggagaggctggatgcgagaaaggaacctggcggcagcgcaaaagatg

SEQ ID NO: 180397 - DNA, 103 bp, Artificial Sequence
  Synthetic Polynucleotide
taatacgactcactatagggcaatcccaggcccccccggcccccgcctggaacagaggagaccaggcatgggccgggggaacctggcggcagcgcaaaagatg

SEQ ID NO: 180398 - DNA, 103 bp, Artificial Sequence
  Synthetic Polynucleotide
taatacgactcactatagggagctgctgctgctgagccgccccctttctcaacagaggagagagaaaatgggcggctcaaacctggcggcagcgcaaaagatg

SEQ ID NO: 180399 - DNA, 103 bp, Artificial Sequence
  Synthetic Polynucleotide
taatacgactcactatagggcagcggctgcagctgctgctgctgagccgcaacagaggagagcggctatgcagcagcagaacctggcggcagcgcaaaagatg

SEQ ID NO: 180400 - DNA, 103 bp, Artificial Sequence
  Synthetic Polynucleotide
taatacgactcactatagggccagaggctgcagcggctgcagctgctgctaacagaggagaagcagcatgtgcagccgcaacctggcggcagcgcaaaagatg

SEQ ID NO: 180401 - DNA, 103 bp, Artificial Sequence
  Synthetic Polynucleotide
taatacgactcactatagggcacaccaccaccagaggctgcagcggctgcaacagaggagagcagccatggcagcctctaacctggcggcagcgcaaaagatg

SEQ ID NO: 180402 - DNA, 103 bp, Artificial Sequence
  Synthetic Polynucleotide
taatacgactcactatagggtgtcaggggacacaccaccaccagaggctgaacagaggagacagcctatggtggtggtgaacctggcggcagcgcaaaagatg

SEQ ID NO: 180403 - DNA, 103 bp, Artificial Sequence
  Synthetic Polynucleotide
taatacgactcactatagggtcgatggagttgtcaggggacacaccaccaaacagaggagatggtggatggtcccctgaaacctggcggcagcgcaaaagatg

SEQ ID NO: 180404 - DNA, 103 bp, Artificial Sequence
  Synthetic Polynucleotide
taatacgactcactataggggtccgagtgttcgatggagttgtcaggggaaacagaggagatcccctatgaactccatcaacctggcggcagcgcaaaagatg

SEQ ID NO: 180405 - DNA, 103 bp, Artificial Sequence
  Synthetic Polynucleotide
taatacgactcactatagggtgctgcgatagtccgagtgttcgatggagtaacagaggagaactccaatgaacactcggaacctggcggcagcgcaaaagatg

SEQ ID NO: 180406 - DNA, 103 bp, Artificial Sequence
  Synthetic Polynucleotide
taatacgactcactatagggtgggcaagtttgctgcgatagtccgagtgtaacagaggagaacactcatgctatcgcagaacctggcggcagcgcaaaagatg

SEQ ID NO: 180407 - DNA, 103 bp, Artificial Sequence
  Synthetic Polynucleotide
taatacgactcactataggggtgacggatctgggcaagtttgctgcgataaacagaggagatatcgcatgaaacttgccaacctggcggcagcgcaaaagatg

SEQ ID NO: 180408 - DNA, 103 bp, Artificial Sequence
  Synthetic Polynucleotide
taatacgactcactatagggccccactcaccaatcccaggcccccccggcaacagaggagagccgggatggcctgggataacctggcggcagcgcaaaagatg

SEQ ID NO: 180409 - DNA, 103 bp, Artificial Sequence
  Synthetic Polynucleotide
taatacgactcactatagggagtggtatatgtgacggatctgggcaagttaacagaggagaaacttgatgagatccgtcaacctggcggcagcgcaaaagatg

SEQ ID NO: 180410 - DNA, 103 bp, Artificial Sequence
  Synthetic Polynucleotide
taatacgactcactatagggtccagctccgagtggtatatgtgacggatcaacagaggagagatccgatgcatataccaaacctggcggcagcgcaaaagatg

SEQ ID NO: 180411 - DNA, 103 bp, Artificial Sequence
  Synthetic Polynucleotide
taatacgactcactatagggctcatacttctccagctccgagtggtatataacagaggagaatatacatgtcggagctgaacctggcggcagcgcaaaagatg

SEQ ID NO: 180412 - DNA, 103 bp, Artificial Sequence
  Synthetic Polynucleotide
taatacgactcactatagggtacatgcctgctcatacttctccagctccgaacagaggagacggagcatgagaagtatgaacctggcggcagcgcaaaagatg

SEQ ID NO: 180413 - DNA, 103 bp, Artificial Sequence
  Synthetic Polynucleotide
taatacgactcactataggggtgaactcattacatgcctgctcatacttcaacagaggagagaagtaatggcaggcatgaacctggcggcagcgcaaaagatg

SEQ ID NO: 180414 - DNA, 103 bp, Artificial Sequence
  Synthetic Polynucleotide
taatacgactcactataggggacatgggtcgtgaactcattacatgcctgaacagaggagacaggcaatgaatgagttcaacctggcggcagcgcaaaagatg

SEQ ID NO: 180415 - DNA, 103 bp, Artificial Sequence
  Synthetic Polynucleotide
taatacgactcactataggggcaggttcatgacatgggtcgtgaactcataacagaggagaatgagtatgcgacccatgaacctggcggcagcgcaaaagatg

SEQ ID NO: 180416 - DNA, 103 bp, Artificial Sequence
  Synthetic Polynucleotide
taatacgactcactatagggtgctccctcagcaggttcatgacatgggtcaacagaggagagacccaatgcatgaacctaacctggcggcagcgcaaaagatg

SEQ ID NO: 180417 - DNA, 103 bp, Artificial Sequence
  Synthetic Polynucleotide
taatacgactcactatagggggtgcggctctgctccctcagcaggttcataacagaggagaatgaacatgctgagggagaacctggcggcagcgcaaaagatg

SEQ ID NO: 180418 - DNA, 103 bp, Artificial Sequence
  Synthetic Polynucleotide
taatacgactcactatagggccacgggcctggtgcggctctgctccctcaaacagaggagatgagggatgagagccgcaaacctggcggcagcgcaaaagatg

SEQ ID NO: 180419 - DNA, 103 bp, Artificial Sequence
  Synthetic Polynucleotide
taatacgactcactatagggcccccaggctccccactcaccaatcccaggaacagaggagacctgggatgggtgagtggaacctggcggcagcgcaaaagatg

SEQ ID NO: 180420 - DNA, 103 bp, Artificial Sequence
  Synthetic Polynucleotide
taatacgactcactatagggtctttgggggccacgggcctggtgcggctcaacagaggagagagccgatgcaggcccgtaacctggcggcagcgcaaaagatg

SEQ ID NO: 180421 - DNA, 103 bp, Artificial Sequence
  Synthetic Polynucleotide
taatacgactcactataggggcgttccatctctttgggggccacgggcctaacagaggagaaggcccatggcccccaaaaacctggcggcagcgcaaaagatg

SEQ ID NO: 180422 - DNA, 103 bp, Artificial Sequence
  Synthetic Polynucleotide
taatacgactcactatagggtgctcaccatgcgttccatctctttgggggaacagaggagacccccaatgagatggaacaacctggcggcagcgcaaaagatg

SEQ ID NO: 180423 - DNA, 103 bp, Artificial Sequence
  Synthetic Polynucleotide
taatacgactcactatagggcgatggatgatgctcaccatgcgttccatcaacagaggagagatggaatgcatggtgagaacctggcggcagcgcaaaagatg

SEQ ID NO: 180424 - DNA, 103 bp, Artificial Sequence
  Synthetic Polynucleotide
taatacgactcactataggggctgaactttcgatggatgatgctcaccataacagaggagaatggtgatgatcatccataacctggcggcagcgcaaaagatg

SEQ ID NO: 180425 - DNA, 103 bp, Artificial Sequence
  Synthetic Polynucleotide
taatacgactcactatagggtctggatggcgctgaactttcgatggatgaaacagaggagatcatccatggaaagttcaaacctggcggcagcgcaaaagatg

SEQ ID NO: 180426 - DNA, 103 bp, Artificial Sequence
  Synthetic Polynucleotide
taatacgactcactatagggttcagctgcatctggatggcgctgaactttaacagaggagaaaagttatgcgccatccaaacctggcggcagcgcaaaagatg

SEQ ID NO: 180427 - DNA, 103 bp, Artificial Sequence
  Synthetic Polynucleotide
taatacgactcactatagggggtgctctgcttcagctgcatctggatggcaacagaggagagccatcatgatgcagctgaacctggcggcagcgcaaaagatg

SEQ ID NO: 180428 - DNA, 103 bp, Artificial Sequence
  Synthetic Polynucleotide
taatacgactcactatagggcagcctcgcaggtgctctgcttcagctgcaaacagaggagatgcagcatgagcagagcaaacctggcggcagcgcaaaagatg

SEQ ID NO: 180429 - DNA, 103 bp, Artificial Sequence
  Synthetic Polynucleotide
taatacgactcactatagggaggatcatcacagcctcgcaggtgctctgcaacagaggagagcagagatgctgcgaggcaacctggcggcagcgcaaaagatg

SEQ ID NO: 180430 - DNA, 103 bp, Artificial Sequence
  Synthetic Polynucleotide
taatacgactcactatagggctcgccagggcccccaggctccccactcacaacagaggagagtgagtatggagcctgggaacctggcggcagcgcaaaagatg

SEQ ID NO: 180431 - DNA, 103 bp, Artificial Sequence
  Synthetic Polynucleotide
taatacgactcactatagggacgggagcgcaggatcatcacagcctcgcaaacagaggagatgcgagatggtgatgatcaacctggcggcagcgcaaaagatg

SEQ ID NO: 180432 - DNA, 103 bp, Artificial Sequence
  Synthetic Polynucleotide
taatacgactcactatagggcatccaggaaacgggagcgcaggatcatcaaacagaggagatgatgaatgtgcgctcccaacctggcggcagcgcaaaagatg

SEQ ID NO: 180433 - DNA, 103 bp, Artificial Sequence
  Synthetic Polynucleotide
taatacgactcactatagggtttcgtctggcatccaggaaacgggagcgcaacagaggagagcgctcatgtttcctggaaacctggcggcagcgcaaaagatg

SEQ ID NO: 180434 - DNA, 103 bp, Artificial Sequence
  Synthetic Polynucleotide
taatacgactcactataggggttacggcgctttcgtctggcatccaggaaaacagaggagattcctgatggccagacgaaacctggcggcagcgcaaaagatg

SEQ ID NO: 180435 - DNA, 103 bp, Artificial Sequence
  Synthetic Polynucleotide
taatacgactcactataggggtttgctgaagttacggcgctttcgtctggaacagaggagaccagacatgagcgccgtaaacctggcggcagcgcaaaagatg

SEQ ID NO: 180436 - DNA, 103 bp, Artificial Sequence
  Synthetic Polynucleotide
taatacgactcactatagggtcagtggcctgtttgctgaagttacggcgcaacagaggagagcgccgatgcttcagcaaaacctggcggcagcgcaaaagatg

SEQ ID NO: 180437 - DNA, 103 bp, Artificial Sequence
  Synthetic Polynucleotide
taatacgactcactatagggatttaggacctcagtggcctgtttgctgaaaacagaggagattcagcatgcaggccactaacctggcggcagcgcaaaagatg

SEQ ID NO: 180438 - DNA, 103 bp, Artificial Sequence
  Synthetic Polynucleotide
taatacgactcactatagggagaaatactcatttaggacctcagtggcctaacagaggagaaggccaatgaggtcctaaaacctggcggcagcgcaaaagatg

SEQ ID NO: 180439 - DNA, 103 bp, Artificial Sequence
  Synthetic Polynucleotide
taatacgactcactatagggaggtgggagtagaaatactcatttaggaccaacagaggagaggtcctatgtgagtatttaacctggcggcagcgcaaaagatg

SEQ ID NO: 180440 - DNA, 103 bp, Artificial Sequence
  Synthetic Polynucleotide
taatacgactcactatagggtgggttactcaggtgggagtagaaatactcaacagaggagagagtatatgtactcccacaacctggcggcagcgcaaaagatg

SEQ ID NO: 180441 - DNA, 103 bp, Artificial Sequence
  Synthetic Polynucleotide
taatacgactcactatagggcaccgggaggctcgccagggcccccaggctaacagaggagaagcctgatggccctggcgaacctggcggcagcgcaaaagatg

SEQ ID NO: 180442 - DNA, 103 bp, Artificial Sequence
  Synthetic Polynucleotide
taatacgactcactatagggcactaggatatgggttactcaggtgggagtaacagaggagaactcccatgtgagtaaccaacctggcggcagcgcaaaagatg

SEQ ID NO: 180443 - DNA, 103 bp, Artificial Sequence
  Synthetic Polynucleotide
taatacgactcactatagggttggcctcctcactaggatatgggttactcaacagaggagagagtaaatgatatcctagaacctggcggcagcgcaaaagatg

SEQ ID NO: 180444 - DNA, 103 bp, Artificial Sequence
  Synthetic Polynucleotide
taatacgactcactatagggaagctcctccttggcctcctcactaggataaacagaggagatatcctatggaggaggccaacctggcggcagcgcaaaagatg

SEQ ID NO: 180445 - DNA, 103 bp, Artificial Sequence
  Synthetic Polynucleotide
taatacgactcactatagggacttcttggcaagctcctccttggcctcctaacagaggagaaggaggatgaggaggagcaacctggcggcagcgcaaaagatg

SEQ ID NO: 180446 - DNA, 103 bp, Artificial Sequence
  Synthetic Polynucleotide
taatacgactcactataggggtgatgccacacttcttggcaagctcctccaacagaggagaggaggaatgtgccaagaaaacctggcggcagcgcaaaagatg

SEQ ID NO: 180447 - DNA, 103 bp, Artificial Sequence
  Synthetic Polynucleotide
taatacgactcactatagggctgagacacggtgatgccacacttcttggcaacagaggagagccaagatgtgtggcatcaacctggcggcagcgcaaaagatg

SEQ ID NO: 180448 - DNA, 103 bp, Artificial Sequence
  Synthetic Polynucleotide
taatacgactcactatagggagttggagacctgagacacggtgatgccacaacagaggagagtggcaatgccgtgtctcaacctggcggcagcgcaaaagatg

SEQ ID NO: 180449 - DNA, 103 bp, Artificial Sequence
  Synthetic Polynucleotide
taatacgactcactatagggttgccaaaccagttggagacctgagacacgaacagaggagacgtgtcatgggtctccaaaacctggcggcagcgcaaaagatg

SEQ ID NO: 180450 - DNA, 103 bp, Artificial Sequence
  Synthetic Polynucleotide
taatacgactcactatagggaatcctcttgttgccaaaccagttggagacaacagaggagagtctccatgtggtttggcaacctggcggcagcgcaaaagatg

SEQ ID NO: 180451 - DNA, 103 bp, Artificial Sequence
  Synthetic Polynucleotide
taatacgactcactatagggtcttatagcgaatcctcttgttgccaaaccaacagaggagaggtttgatgacaagaggaaacctggcggcagcgcaaaagatg

SEQ ID NO: 180452 - DNA, 103 bp, Artificial Sequence
  Synthetic Polynucleotide
taatacgactcactataggggggtctccgccaccgggaggctcgccagggaacagaggagaccctggatggcctcccggaacctggcggcagcgcaaaagatg

SEQ ID NO: 180453 - DNA, 103 bp, Artificial Sequence
  Synthetic Polynucleotide
taatacgactcactatagggccgatgtttttcttatagcgaatcctcttgaacagaggagacaagagatgtcgctataaaacctggcggcagcgcaaaagatg

SEQ ID NO: 180454 - DNA, 103 bp, Artificial Sequence
  Synthetic Polynucleotide
taatacgactcactatagggttggaactttccgatgtttttcttatagcgaacagaggagacgctatatgaaaaacatcaacctggcggcagcgcaaaagatg

SEQ ID NO: 180455 - DNA, 103 bp, Artificial Sequence
  Synthetic Polynucleotide
taatacgactcactatagggttgcctcctcttggaactttccgatgttttaacagaggagaaaaacaatggaaagttccaacctggcggcagcgcaaaagatg

SEQ ID NO: 180456 - DNA, 103 bp, Artificial Sequence
  Synthetic Polynucleotide
taatacgactcactataggggcatagatgtttgcctcctcttggaactttaacagaggagaaaagttatgagaggaggcaacctggcggcagcgcaaaagatg

SEQ ID NO: 180457 - DNA, 103 bp, Artificial Sequence
  Synthetic Polynucleotide
taatacgactcactatagggggtcttgacagcatagatgtttgcctcctcaacagaggagagaggagatgaacatctataacctggcggcagcgcaaaagatg

SEQ ID NO: 180458 - DNA, 103 bp, Artificial Sequence
  Synthetic Polynucleotide
taatacgactcactatagggctgacacggcggtcttgacagcatagatgtaacagaggagaacatctatgctgtcaagaaacctggcggcagcgcaaaagatg

SEQ ID NO: 180459 - DNA, 103 bp, Artificial Sequence
  Synthetic Polynucleotide
taatacgactcactatagggccctgggtgactgacacggcggtcttgacaaacagaggagatgtcaaatgcgccgtgtcaacctggcggcagcgcaaaagatg

SEQ ID NO: 180460 - DNA, 103 bp, Artificial Sequence
  Synthetic Polynucleotide
taatacgactcactataggggctgtggcccccctgggtgactgacacggcaacagaggagagccgtgatggtcacccagaacctggcggcagcgcaaaagatg

SEQ ID NO: 180461 - DNA, 103 bp, Artificial Sequence
  Synthetic Polynucleotide
taatacgactcactatagggagctggtgcggctgtggcccccctgggtgaaacagaggagatcacccatgggggccacaaacctggcggcagcgcaaaagatg

SEQ ID NO: 180462 - DNA, 103 bp, Artificial Sequence
  Synthetic Polynucleotide
taatacgactcactatagggggtgtcggggagctggtgcggctgtggcccaacagaggagagggccaatgccgcaccagaacctggcggcagcgcaaaagatg

SEQ ID NO: 180463 - DNA, 103 bp, Artificial Sequence
  Synthetic Polynucleotide
taatacgactcactatagggagtctgcagcatcctggattgatcgtccataacagaggagaatggacatgcaatccaggaacctggcggcagcgcaaaagatg

SEQ ID NO: 180464 - DNA, 103 bp, Artificial Sequence
  Synthetic Polynucleotide
taatacgactcactataggggtcgccgtccgccccttcgtggccgtgcggaacagaggagaccgcacatgcacgaagggaacctggcggcagcgcaaaagatg

SEQ ID NO: 180465 - DNA, 103 bp, Artificial Sequence
  Synthetic Polynucleotide
taatacgactcactatagggaccagaagaaccggaatttggtgtggtgggaacagaggagacccaccatgccaaattccaacctggcggcagcgcaaaagatg

SEQ ID NO: 180466 - DNA, 103 bp, Artificial Sequence
  Synthetic Polynucleotide
taatacgactcactatagggggttaaaagaaccagaagaaccggaatttgaacagaggagacaaattatggttcttctgaacctggcggcagcgcaaaagatg

SEQ ID NO: 180467 - DNA, 103 bp, Artificial Sequence
  Synthetic Polynucleotide
taatacgactcactataggggaatttgggaggttaaaagaaccagaagaaaacagaggagattcttcatgttcttttaaaacctggcggcagcgcaaaagatg

SEQ ID NO: 180468 - DNA, 103 bp, Artificial Sequence
  Synthetic Polynucleotide
taatacgactcactatagggcatgtccccagaatttgggaggttaaaagaaacagaggagatcttttatgctcccaaataacctggcggcagcgcaaaagatg

SEQ ID NO: 180469 - DNA, 103 bp, Artificial Sequence
  Synthetic Polynucleotide
taatacgactcactatagggtgttcatgaacatgtccccagaatttgggaaacagaggagatcccaaatgctggggacaaacctggcggcagcgcaaaagatg

SEQ ID NO: 180470 - DNA, 103 bp, Artificial Sequence
  Synthetic Polynucleotide
taatacgactcactatagggagactctgcatgttcatgaacatgtccccaaacagaggagatggggaatggttcatgaaaacctggcggcagcgcaaaagatg

SEQ ID NO: 180471 - DNA, 103 bp, Artificial Sequence
  Synthetic Polynucleotide
taatacgactcactatagggatccccattcagactctgcatgttcatgaaaacagaggagattcatgatgatgcagagtaacctggcggcagcgcaaaagatg

SEQ ID NO: 180472 - DNA, 103 bp, Artificial Sequence
  Synthetic Polynucleotide
taatacgactcactatagggcttggtaagaatccccattcagactctgcaaacagaggagatgcagaatgtgaatggggaacctggcggcagcgcaaaagatg

SEQ ID NO: 180473 - DNA, 103 bp, Artificial Sequence
  Synthetic Polynucleotide
taatacgactcactatagggacttgggacccttggtaagaatccccattcaacagaggagagaatggatgttcttaccaaacctggcggcagcgcaaaagatg

SEQ ID NO: 180474 - DNA, 103 bp, Artificial Sequence
  Synthetic Polynucleotide
taatacgactcactatagggattggctccgacttgggacccttggtaagaaacagaggagatcttacatggggtcccaaaacctggcggcagcgcaaaagatg

SEQ ID NO: 180475 - DNA, 103 bp, Artificial Sequence
  Synthetic Polynucleotide
taatacgactcactataggggcttcctgccgtcgccgtccgccccttcgtaacagaggagaacgaagatgcggacggcgaacctggcggcagcgcaaaagatg

SEQ ID NO: 180476 - DNA, 103 bp, Artificial Sequence
  Synthetic Polynucleotide
taatacgactcactataggggtgattgcacattggctccgacttgggaccaacagaggagaggtcccatgtcggagccaaacctggcggcagcgcaaaagatg

SEQ ID NO: 180477 - DNA, 103 bp, Artificial Sequence
  Synthetic Polynucleotide
taatacgactcactataggggtatccacctgtgattgcacattggctccgaacagaggagacggagcatgtgtgcaatcaacctggcggcagcgcaaaagatg

SEQ ID NO: 180478 - DNA, 103 bp, Artificial Sequence
  Synthetic Polynucleotide
taatacgactcactatagggatgacggagggtatccacctgtgattgcacaacagaggagagtgcaaatgcaggtggataacctggcggcagcgcaaaagatg

SEQ ID NO: 180479 - DNA, 103 bp, Artificial Sequence
  Synthetic Polynucleotide
taatacgactcactataggggattgataacatgacggagggtatccacctaacagaggagaaggtggatgccctccgtcaacctggcggcagcgcaaaagatg

SEQ ID NO: 180480 - DNA, 103 bp, Artificial Sequence
  Synthetic Polynucleotide
taatacgactcactatagggcctcccgtctgattgataacatgacggaggaacagaggagacctccgatgtgttatcaaaacctggcggcagcgcaaaagatg

SEQ ID NO: 180481 - DNA, 103 bp, Artificial Sequence
  Synthetic Polynucleotide
taatacgactcactatagggatcactgtagcctcccgtctgattgataacaacagaggagagttatcatgcagacgggaaacctggcggcagcgcaaaagatg

SEQ ID NO: 180482 - DNA, 103 bp, Artificial Sequence
  Synthetic Polynucleotide
taatacgactcactatagggctccaaggccatcactgtagcctcccgtctaacagaggagaagacggatggctacagtgaacctggcggcagcgcaaaagatg

SEQ ID NO: 180483 - DNA, 103 bp, Artificial Sequence
  Synthetic Polynucleotide
taatacgactcactatagggagtgaatttcctccaaggccatcactgtagaacagaggagactacagatgtggccttggaacctggcggcagcgcaaaagatg

SEQ ID NO: 180484 - DNA, 103 bp, Artificial Sequence
  Synthetic Polynucleotide
taatacgactcactatagggtggactgtacagtgaatttcctccaaggccaacagaggagaggccttatgggaaattcaaacctggcggcagcgcaaaagatg

SEQ ID NO: 180485 - DNA, 103 bp, Artificial Sequence
  Synthetic Polynucleotide
taatacgactcactatagggttaaattatgtggactgtacagtgaatttcaacagaggagagaaattatgtgtacagtcaacctggcggcagcgcaaaagatg

SEQ ID NO: 180486 - DNA, 103 bp, Artificial Sequence
  Synthetic Polynucleotide
taatacgactcactatagggccgatgtcctgcttcctgccgtcgccgtccaacagaggagaggacggatgcggcaggaaaacctggcggcagcgcaaaagatg

SEQ ID NO: 180487 - DNA, 103 bp, Artificial Sequence
  Synthetic Polynucleotide
taatacgactcactatagggccattagcatttaaattatgtggactgtacaacagaggagagtacagatgacataatttaacctggcggcagcgcaaaagatg

SEQ ID NO: 180488 - DNA, 103 bp, Artificial Sequence
  Synthetic Polynucleotide
taatacgactcactatagggctgccagcctccattagcatttaaattatgaacagaggagacataatatgaatgctaataacctggcggcagcgcaaaagatg

SEQ ID NO: 180489 - DNA, 103 bp, Artificial Sequence
  Synthetic Polynucleotide
taatacgactcactatagggttgttgcgtcctgccagcctccattagcataacagaggagaatgctaatggaggctggcaacctggcggcagcgcaaaagatg

SEQ ID NO: 180490 - DNA, 103 bp, Artificial Sequence
  Synthetic Polynucleotide
taatacgactcactataggggaagatggagttgttgcgtcctgccagcctaacagaggagaaggctgatgggacgcaacaacctggcggcagcgcaaaagatg

SEQ ID NO: 180491 - DNA, 103 bp, Artificial Sequence
  Synthetic Polynucleotide
taatacgactcactatagggagaagtcacagaagatggagttgttgcgtcaacagaggagagacgcaatgactccatctaacctggcggcagcgcaaaagatg

SEQ ID NO: 180492 - DNA, 103 bp, Artificial Sequence
  Synthetic Polynucleotide
taatacgactcactatagggcttctgtaggagaagtcacagaagatggagaacagaggagactccatatgctgtgacttaacctggcggcagcgcaaaagatg

SEQ ID NO: 180493 - DNA, 103 bp, Artificial Sequence
  Synthetic Polynucleotide
taatacgactcactatagggcttcctgggccttctgtaggagaagtcacaaacagaggagatgtgacatgtcctacagaaacctggcggcagcgcaaaagatg

SEQ ID NO: 180494 - DNA, 103 bp, Artificial Sequence
  Synthetic Polynucleotide
taatacgactcactatagggcgagtgcacacttcctgggccttctgtaggaacagaggagacctacaatgggcccaggaaacctggcggcagcgcaaaagatg

SEQ ID NO: 180495 - DNA, 103 bp, Artificial Sequence
  Synthetic Polynucleotide
taatacgactcactatagggtagaggtatccgagtgcacacttcctgggcaacagaggagagcccagatggtgtgcactaacctggcggcagcgcaaaagatg

SEQ ID NO: 180496 - DNA, 103 bp, Artificial Sequence
  Synthetic Polynucleotide
taatacgactcactataggggaggatgtcgccgatgtcctgcttcctgccaacagaggagaggcaggatgcaggacatcaacctggcggcagcgcaaaagatg

SEQ ID NO: 180497 - DNA, 103 bp, Artificial Sequence
  Synthetic Polynucleotide
taatacgactcactatagggtgatctggtggaggatgtcgccgatgtcctaacagaggagaaggacaatggcgacatccaacctggcggcagcgcaaaagatg

SEQ ID NO: 180498 - DNA, 103 bp, Artificial Sequence
  Synthetic Polynucleotide
taatacgactcactataggggtgatggtcatgatctggtggaggatgtcgaacagaggagacgacatatgccaccagataacctggcggcagcgcaaaagatg

SEQ ID NO: 180499 - DNA, 103 bp, Artificial Sequence
  Synthetic Polynucleotide
taatacgactcactataggggctctggtcggtgatggtcatgatctggtgaacagaggagacaccagatgatgaccatcaacctggcggcagcgcaaaagatg

SEQ ID NO: 180500 - DNA, 103 bp, Artificial Sequence
  Synthetic Polynucleotide
taatacgactcactatagggcctcgtccaagctctggtcggtgatggtcaaacagaggagatgaccaatgccgaccagaaacctggcggcagcgcaaaagatg

SEQ ID NO: 180501 - DNA, 103 bp, Artificial Sequence
  Synthetic Polynucleotide
taatacgactcactatagggtttgcttgcgcctcgtccaagctctggtcgaacagaggagacgaccaatgcttggacgaaacctggcggcagcgcaaaagatg

SEQ ID NO: 180502 - DNA, 103 bp, Artificial Sequence
  Synthetic Polynucleotide
taatacgactcactatagggggcatgtttctttgcttgcgcctcgtccaaaacagaggagattggacatggcgcaagcaaacctggcggcagcgcaaaagatg

SEQ ID NO: 180503 - DNA, 103 bp, Artificial Sequence
  Synthetic Polynucleotide
taatacgactcactatagggccccggccagagtctgcagcatcctggattaacagaggagaaatccaatgtgctgcagaaacctggcggcagcgcaaaagatg

SEQ ID NO: 180504 - DNA, 103 bp, Artificial Sequence
  Synthetic Polynucleotide
taatacgactcactataggggacagttcagggcatgtttctttgcttgcgaacagaggagacgcaagatgagaaacatgaacctggcggcagcgcaaaagatg

SEQ ID NO: 180505 - DNA, 103 bp, Artificial Sequence
  Synthetic Polynucleotide
taatacgactcactatagggttcattctgtgacagttcagggcatgtttcaacagaggagagaaacaatgcctgaactgaacctggcggcagcgcaaaagatg

SEQ ID NO: 180506 - DNA, 103 bp, Artificial Sequence
  Synthetic Polynucleotide
taatacgactcactataggggagcgctggtttcattctgtgacagttcagaacagaggagactgaacatgcacagaatgaacctggcggcagcgcaaaagatg

SEQ ID NO: 180507 - DNA, 103 bp, Artificial Sequence
  Synthetic Polynucleotide
taatacgactcactatagggggacgctgaagagcgctggtttcattctgtaacagaggagaacagaaatgaaccagcgcaacctggcggcagcgcaaaagatg

SEQ ID NO: 180508 - DNA, 103 bp, Artificial Sequence
  Synthetic Polynucleotide
taatacgactcactatagggatctcacacaggacgctgaagagcgctggtaacagaggagaaccagcatgcttcagcgtaacctggcggcagcgcaaaagatg

SEQ ID NO: 180509 - DNA, 103 bp, Artificial Sequence
  Synthetic Polynucleotide
taatacgactcactatagggtttctctttgatctcacacaggacgctgaaaacagaggagattcagcatgctgtgtgagaacctggcggcagcgcaaaagatg

SEQ ID NO: 180510 - DNA, 103 bp, Artificial Sequence
  Synthetic Polynucleotide
taatacgactcactatagggtgagacctgttttctctttgatctcacacaaacagaggagatgtgtgatgtcaaagagaaacctggcggcagcgcaaaagatg

SEQ ID NO: 180511 - DNA, 103 bp, Artificial Sequence
  Synthetic Polynucleotide
taatacgactcactatagggcctctgatgctgagacctgttttctctttgaacagaggagacaaagaatgaacaggtctaacctggcggcagcgcaaaagatg

SEQ ID NO: 180512 - DNA, 103 bp, Artificial Sequence
  Synthetic Polynucleotide
taatacgactcactatagggctcctgggctcctctgatgctgagacctgtaacagaggagaacaggtatgagcatcagaaacctggcggcagcgcaaaagatg

SEQ ID NO: 180513 - DNA, 103 bp, Artificial Sequence
  Synthetic Polynucleotide
taatacgactcactataggggagggtcctcctcctgggctcctctgatgcaacagaggagagcatcaatggagcccaggaacctggcggcagcgcaaaagatg

SEQ ID NO: 180514 - DNA, 103 bp, Artificial Sequence
  Synthetic Polynucleotide
taatacgactcactataggggccaggttcaccccggccagagtctgcagcaacagaggagagctgcaatgtctggccggaacctggcggcagcgcaaaagatg

SEQ ID NO: 180515 - DNA, 103 bp, Artificial Sequence
  Synthetic Polynucleotide
taatacgactcactatagggtggggatcgggagggtcctcctcctgggctaacagaggagaagcccaatgggaggacccaacctggcggcagcgcaaaagatg

SEQ ID NO: 180516 - DNA, 103 bp, Artificial Sequence
  Synthetic Polynucleotide
taatacgactcactatagggtctcattagctggggatcgggagggtcctcaacagaggagagaggacatgcccgatcccaacctggcggcagcgcaaaagatg

SEQ ID NO: 180517 - DNA, 103 bp, Artificial Sequence
  Synthetic Polynucleotide
taatacgactcactatagggtattgtccagtctcattagctggggatcggaacagaggagaccgatcatgagctaatgaaacctggcggcagcgcaaaagatg

SEQ ID NO: 180518 - DNA, 103 bp, Artificial Sequence
  Synthetic Polynucleotide
taatacgactcactataggggccaaaagcatattgtccagtctcattagcaacagaggagagctaatatgactggacaaaacctggcggcagcgcaaaagatg

SEQ ID NO: 180519 - DNA, 103 bp, Artificial Sequence
  Synthetic Polynucleotide
taatacgactcactatagggaaccccttctgccaaaagcatattgtccagaacagaggagactggacatgatgcttttgaacctggcggcagcgcaaaagatg

SEQ ID NO: 180520 - DNA, 103 bp, Artificial Sequence
  Synthetic Polynucleotide
taatacgactcactatagggcaggacctgaaaccccttctgccaaaagcaaacagaggagatgctttatgcagaaggggaacctggcggcagcgcaaaagatg

SEQ ID NO: 180521 - DNA, 103 bp, Artificial Sequence
  Synthetic Polynucleotide
taatacgactcactatagggccacctttctcaggacctgaaaccccttctaacagaggagaagaaggatgttcaggtccaacctggcggcagcgcaaaagatg

SEQ ID NO: 180522 - DNA, 103 bp, Artificial Sequence
  Synthetic Polynucleotide
taatacgactcactatagggcgccgatcccccacctttctcaggacctgaaacagaggagatcaggtatggagaaaggtaacctggcggcagcgcaaaagatg

SEQ ID NO: 180523 - DNA, 103 bp, Artificial Sequence
  Synthetic Polynucleotide
taatacgactcactatagggcagctgctgccgccgatcccccacctttctaacagaggagaagaaagatgggggatcggaacctggcggcagcgcaaaagatg

SEQ ID NO: 180524 - DNA, 103 bp, Artificial Sequence
  Synthetic Polynucleotide
taatacgactcactataggggccgcggctgcagctgctgccgccgatcccaacagaggagagggatcatgggcagcagcaacctggcggcagcgcaaaagatg

SEQ ID NO: 180525 - DNA, 103 bp, Artificial Sequence
  Synthetic Polynucleotide
taatacgactcactatagggcgagtggccagccaggttcaccccggccagaacagaggagactggccatggtgaacctgaacctggcggcagcgcaaaagatg

SEQ ID NO: 180526 - DNA, 103 bp, Artificial Sequence
  Synthetic Polynucleotide
taatacgactcactatagggtccagaggctgccgcggctgcagctgctgcaacagaggagagcagcaatggcagccgcgaacctggcggcagcgcaaaagatg

SEQ ID NO: 180527 - DNA, 103 bp, Artificial Sequence
  Synthetic Polynucleotide
taatacgactcactatagggctgaagaacctccagaggctgccgcggctgaacagaggagacagccgatgcagcctctgaacctggcggcagcgcaaaagatg

SEQ ID NO: 180528 - DNA, 103 bp, Artificial Sequence
  Synthetic Polynucleotide
taatacgactcactatagggatagagttatctgaagaacctccagaggctaacagaggagaagcctcatgaggttcttcaacctggcggcagcgcaaaagatg

SEQ ID NO: 180529 - DNA, 103 bp, Artificial Sequence
  Synthetic Polynucleotide
taatacgactcactatagggtgagtgttcaatagagttatctgaagaaccaacagaggagaggttctatggataactctaacctggcggcagcgcaaaagatg

SEQ ID NO: 180530 - DNA, 103 bp, Artificial Sequence
  Synthetic Polynucleotide
taatacgactcactatagggctctgtaatctgagtgttcaatagagttataacagaggagaataactatgttgaacactaacctggcggcagcgcaaaagatg

SEQ ID NO: 180531 - DNA, 103 bp, Artificial Sequence
  Synthetic Polynucleotide
taatacgactcactataggggtcaatttggctctgtaatctgagtgttcaaacagaggagatgaacaatgagattacagaacctggcggcagcgcaaaagatg

SEQ ID NO: 180532 - DNA, 103 bp, Artificial Sequence
  Synthetic Polynucleotide
taatacgactcactatagggtctgatctgggtcaatttggctctgtaatcaacagaggagagattacatggccaaattgaacctggcggcagcgcaaaagatg

SEQ ID NO: 180533 - DNA, 103 bp, Artificial Sequence
  Synthetic Polynucleotide
taatacgactcactataggggatagatttgtctgatctgggtcaatttggaacagaggagaccaaatatgcccagatcaaacctggcggcagcgcaaaagatg

SEQ ID NO: 180534 - DNA, 103 bp, Artificial Sequence
  Synthetic Polynucleotide
taatacgactcactatagggagttctgtgtgatagatttgtctgatctggaacagaggagaccagatatgacaaatctaaacctggcggcagcgcaaaagatg

SEQ ID NO: 180535 - DNA, 103 bp, Artificial Sequence
  Synthetic Polynucleotide
taatacgactcactatagggatatttctccagttctgtgtgatagatttgaacagaggagacaaatcatgcacacagaaaacctggcggcagcgcaaaagatg

SEQ ID NO: 180536 - DNA, 103 bp, Artificial Sequence
  Synthetic Polynucleotide
taatacgactcactatagggccccctgcaccgagtggccagccaggttcaaacagaggagatgaaccatgctggccactaacctggcggcagcgcaaaagatg

SEQ ID NO: 180537 - DNA, 103 bp, Artificial Sequence
  Synthetic Polynucleotide
taatacgactcactatagggatgcctgttcatatttctccagttctgtgtaacagaggagaacacagatgtggagaaataacctggcggcagcgcaaaagatg

SEQ ID NO: 180538 - DNA, 103 bp, Artificial Sequence
  Synthetic Polynucleotide
taatacgactcactatagggaattcattacatgcctgttcatatttctccaacagaggagaggagaaatgtgaacaggcaacctggcggcagcgcaaaagatg

SEQ ID NO: 180539 - DNA, 103 bp, Artificial Sequence
  Synthetic Polynucleotide
taatacgactcactatagggatgtgtagtaaattcattacatgcctgttcaacagaggagagaacagatgtgtaatgaaaacctggcggcagcgcaaaagatg

SEQ ID NO: 180540 - DNA, 103 bp, Artificial Sequence
  Synthetic Polynucleotide
taatacgactcactatagggggttcatcacatgtgtagtaaattcattacaacagaggagagtaatgatgttactacacaacctggcggcagcgcaaaagatg

SEQ ID NO: 180541 - DNA, 103 bp, Artificial Sequence
  Synthetic Polynucleotide
taatacgactcactatagggtctcggagaaggttcatcacatgtgtagtaaacagaggagatactacatgtgtgatgaaaacctggcggcagcgcaaaagatg

SEQ ID NO: 180542 - DNA, 103 bp, Artificial Sequence
  Synthetic Polynucleotide
taatacgactcactatagggtctactctgttctcggagaaggttcatcacaacagaggagagtgatgatgcttctccgaaacctggcggcagcgcaaaagatg

SEQ ID NO: 180543 - DNA, 103 bp, Artificial Sequence
  Synthetic Polynucleotide
taatacgactcactatagggtgggacgtgttctactctgttctcggagaaaacagaggagattctccatgaacagagtaaacctggcggcagcgcaaaagatg

SEQ ID NO: 180544 - DNA, 103 bp, Artificial Sequence
  Synthetic Polynucleotide
taatacgactcactatagggtttggagaaatgggacgtgttctactctgtaacagaggagaacagagatgaacacgtccaacctggcggcagcgcaaaagatg

SEQ ID NO: 180545 - DNA, 103 bp, Artificial Sequence
  Synthetic Polynucleotide
taatacgactcactatagggttcaatctcttttggagaaatgggacgtgtaacagaggagaacacgtatgatttctccaaacctggcggcagcgcaaaagatg

SEQ ID NO: 180546 - DNA, 103 bp, Artificial Sequence
  Synthetic Polynucleotide
taatacgactcactatagggccaccattctttcaatctcttttggagaaaaacagaggagatttctcatgaagagattgaacctggcggcagcgcaaaagatg

SEQ ID NO: 180547 - DNA, 103 bp, Artificial Sequence
  Synthetic Polynucleotide
taatacgactcactatagggagggccatgcccccctgcaccgagtggccaaacagaggagatggccaatgggtgcagggaacctggcggcagcgcaaaagatg

SEQ ID NO: 180548 - DNA, 103 bp, Artificial Sequence
  Synthetic Polynucleotide
taatacgactcactatagggtggatgatgcccaccattctttcaatctctaacagaggagaagagatatgaagaatggtaacctggcggcagcgcaaaagatg

SEQ ID NO: 180549 - DNA, 103 bp, Artificial Sequence
  Synthetic Polynucleotide
taatacgactcactatagggaaattttcgatggatgatgcccaccattctaacagaggagaagaatgatgggcatcatcaacctggcggcagcgcaaaagatg

SEQ ID NO: 180550 - DNA, 103 bp, Artificial Sequence
  Synthetic Polynucleotide
taatacgactcactataggggaatggaactaaattttcgatggatgatgcaacagaggagagcatcaatgatcgaaaataacctggcggcagcgcaaaagatg

SEQ ID NO: 180551 - DNA, 103 bp, Artificial Sequence
  Synthetic Polynucleotide
taatacgactcactatagggagctgcatctgaatggaactaaattttcgaaacagaggagatcgaaaatgtagttccataacctggcggcagcgcaaaagatg

SEQ ID NO: 180552 - DNA, 103 bp, Artificial Sequence
  Synthetic Polynucleotide
taatacgactcactataggggctttgtttgagctgcatctgaatggaactaacagaggagaagttccatgcagatgcagaacctggcggcagcgcaaaagatg

SEQ ID NO: 180553 - DNA, 103 bp, Artificial Sequence
  Synthetic Polynucleotide
taatacgactcactatagggcttcacaagtgctttgtttgagctgcatctaacagaggagaagatgcatgtcaaacaaaaacctggcggcagcgcaaaagatg

SEQ ID NO: 180554 - DNA, 103 bp, Artificial Sequence
  Synthetic Polynucleotide
taatacgactcactatagggatcataactgcttcacaagtgctttgtttgaacagaggagacaaacaatgcacttgtgaaacctggcggcagcgcaaaagatg

SEQ ID NO: 180555 - DNA, 103 bp, Artificial Sequence
  Synthetic Polynucleotide
taatacgactcactatagggtgatcttaaaatcataactgcttcacaagtaacagaggagaacttgtatggcagttatgaacctggcggcagcgcaaaagatg

SEQ ID NO: 180556 - DNA, 103 bp, Artificial Sequence
  Synthetic Polynucleotide
taatacgactcactatagggcaaggaaccttgatcttaaaatcataactgaacagaggagacagttaatgttttaagataacctggcggcagcgcaaaagatg

SEQ ID NO: 180557 - DNA, 103 bp, Artificial Sequence
  Synthetic Polynucleotide
taatacgactcactatagggcgtctggcatcaaggaaccttgatcttaaaaacagaggagatttaagatgaaggttcctaacctggcggcagcgcaaaagatg

SEQ ID NO: 180558 - DNA, 103 bp, Artificial Sequence
  Synthetic Polynucleotide
taatacgactcactataggggggaggcggcagggccatgcccccctgcacaacagaggagagtgcagatgggcatggccaacctggcggcagcgcaaaagatg

SEQ ID NO: 180559 - DNA, 103 bp, Artificial Sequence
  Synthetic Polynucleotide
taatacgactcactatagggacgccttttccgtctggcatcaaggaacctaacagaggagaaggttcatggatgccagaaacctggcggcagcgcaaaagatg

SEQ ID NO: 180560 - DNA, 103 bp, Artificial Sequence
  Synthetic Polynucleotide
taatacgactcactatagggtactgaagttacgccttttccgtctggcataacagaggagaatgccaatgggaaaaggcaacctggcggcagcgcaaaagatg

SEQ ID NO: 180561 - DNA, 103 bp, Artificial Sequence
  Synthetic Polynucleotide
taatacgactcactataggggtggcctgtttactgaagttacgccttttcaacagaggagagaaaagatgtaacttcagaacctggcggcagcgcaaaagatg

SEQ ID NO: 180562 - DNA, 103 bp, Artificial Sequence
  Synthetic Polynucleotide
taatacgactcactatagggcaagatttctgtggcctgtttactgaagttaacagaggagaaacttcatgaaacaggccaacctggcggcagcgcaaaagatg

SEQ ID NO: 180563 - DNA, 103 bp, Artificial Sequence
  Synthetic Polynucleotide
taatacgactcactatagggaatattcattcaagatttctgtggcctgttaacagaggagaaacaggatgcagaaatctaacctggcggcagcgcaaaagatg

SEQ ID NO: 180564 - DNA, 103 bp, Artificial Sequence
  Synthetic Polynucleotide
taatacgactcactatagggtgtgagtaaaaatattcattcaagatttctaacagaggagaagaaatatggaatgaataaacctggcggcagcgcaaaagatg

SEQ ID NO: 180565 - DNA, 103 bp, Artificial Sequence
  Synthetic Polynucleotide
taatacgactcactataggggttgctgaggtgtgagtaaaaatattcattaacagaggagaaatgaaatgttttactcaaacctggcggcagcgcaaaagatg

SEQ ID NO: 180566 - DNA, 103 bp, Artificial Sequence
  Synthetic Polynucleotide
taatacgactcactatagggtggggtaggggttgctgaggtgtgagtaaaaacagaggagatttactatgacctcagcaaacctggcggcagcgcaaaagatg

SEQ ID NO: 180567 - DNA, 103 bp, Artificial Sequence
  Synthetic Polynucleotide
taatacgactcactataggggcttcttcactggggtaggggttgctgaggaacagaggagacctcagatgcccctacccaacctggcggcagcgcaaaagatg

SEQ ID NO: 180568 - DNA, 103 bp, Artificial Sequence
  Synthetic Polynucleotide
taatacgactcactatagggctcctctttggcttcttcactggggtagggaacagaggagaccctacatgagtgaagaaaacctggcggcagcgcaaaagatg

SEQ ID NO: 180569 - DNA, 103 bp, Artificial Sequence
  Synthetic Polynucleotide
taatacgactcactatagggggccgtgcgggggaggcggcagggccatgcaacagaggagagcatggatgtgccgcctcaacctggcggcagcgcaaaagatg

SEQ ID NO: 180570 - DNA, 103 bp, Artificial Sequence
  Synthetic Polynucleotide
taatacgactcactatagggtcttggccagctcctctttggcttcttcacaacagaggagagtgaagatgccaaagaggaacctggcggcagcgcaaaagatg

SEQ ID NO: 180571 - DNA, 103 bp, Artificial Sequence
  Synthetic Polynucleotide
taatacgactcactatagggatgctgcatttcttggccagctcctctttgaacagaggagacaaagaatggctggccaaaacctggcggcagcgcaaaagatg

SEQ ID NO: 180572 - DNA, 103 bp, Artificial Sequence
  Synthetic Polynucleotide
taatacgactcactatagggtgacactgtgatgctgcatttcttggccagaacagaggagactggccatgaaatgcagcaacctggcggcagcgcaaaagatg

SEQ ID NO: 180573 - DNA, 103 bp, Artificial Sequence
  Synthetic Polynucleotide
taatacgactcactatagggtggatacctgtgacactgtgatgctgcattaacagaggagaaatgcaatgtcacagtgtaacctggcggcagcgcaaaagatg

SEQ ID NO: 180574 - DNA, 103 bp, Artificial Sequence
  Synthetic Polynucleotide
taatacgactcactatagggccaaaccaattggatacctgtgacactgtgaacagaggagacacagtatgacaggtatcaacctggcggcagcgcaaaagatg

SEQ ID NO: 180575 - DNA, 103 bp, Artificial Sequence
  Synthetic Polynucleotide
taatacgactcactatagggtcgtttgttgccaaaccaattggatacctgaacagaggagacaggtaatgaattggtttaacctggcggcagcgcaaaagatg

SEQ ID NO: 180576 - DNA, 103 bp, Artificial Sequence
  Synthetic Polynucleotide
taatacgactcactatagggtgtacctgattcgtttgttgccaaaccaataacagaggagaattggtatggcaacaaacaacctggcggcagcgcaaaagatg

SEQ ID NO: 180577 - DNA, 103 bp, Artificial Sequence
  Synthetic Polynucleotide
taatacgactcactatagggatgttcttcttgtacctgattcgtttgttgaacagaggagacaacaaatgaatcaggtaaacctggcggcagcgcaaaagatg

SEQ ID NO: 180578 - DNA, 103 bp, Artificial Sequence
  Synthetic Polynucleotide
taatacgactcactatagggaaacttgccaatgttcttcttgtacctgataacagaggagaatcaggatgaagaagaacaacctggcggcagcgcaaaagatg

SEQ ID NO: 180579 - DNA, 103 bp, Artificial Sequence
  Synthetic Polynucleotide
taatacgactcactatagggcttcttcctgaaacttgccaatgttcttctaacagaggagaagaagaatgttggcaagtaacctggcggcagcgcaaaagatg

SEQ ID NO: 180580 - DNA, 103 bp, Artificial Sequence
  Synthetic Polynucleotide
taatacgactcactataggggccccttcgtggccgtgcgggggaggcggcaacagaggagagccgccatgcccgcacggaacctggcggcagcgcaaaagatg

SEQ ID NO: 180581 - DNA, 103 bp, Artificial Sequence
  Synthetic Polynucleotide
taatacgactcactatagggtagaggttggcttcttcctgaaacttgccaaacagaggagatggcaaatgtcaggaagaaacctggcggcagcgcaaaagatg

SEQ ID NO: 180582 - DNA, 103 bp, Artificial Sequence
  Synthetic Polynucleotide
taatacgactcactatagggctttgcagcatagaggttggcttcttcctgaacagaggagacaggaaatggccaacctcaacctggcggcagcgcaaaagatg

SEQ ID NO: 180583 - DNA, 103 bp, Artificial Sequence
  Synthetic Polynucleotide
taatacgactcactatagggtcacggccgtctttgcagcatagaggttggaacagaggagaccaaccatgatgctgcaaaacctggcggcagcgcaaaagatg

SEQ ID NO: 180584 - DNA, 103 bp, Artificial Sequence
  Synthetic Polynucleotide
taatacgactcactatagggtgtgcagctgtcacggccgtctttgcagcaaacagaggagatgctgcatggacggccgtaacctggcggcagcgcaaaagatg

SEQ ID NO: 180585 - DNA, 103 bp, Artificial Sequence
  Synthetic Polynucleotide
taatacgactcactatagggtgctactgcgtgtgcagctgtcacggccgtaacagaggagaacggccatgacagctgcaaacctggcggcagcgcaaaagatg

SEQ ID NO: 180586 - DNA, 103 bp, Artificial Sequence
  Synthetic Polynucleotide
taatacgactcactataggggcacagctgctgctactgcgtgtgcagctgaacagaggagacagctgatgacgcagtagaacctggcggcagcgcaaaagatg

SEQ ID NO: 180587 - DNA, 103 bp, Artificial Sequence
  Synthetic Polynucleotide
taatacgactcactatagggtggttgttctgcacagctgctgctactgcgaacagaggagacgcagtatgagcagctgtaacctggcggcagcgcaaaagatg

SEQ ID NO: 180588 - DNA, 103 bp, Artificial Sequence
  Synthetic Polynucleotide
taatacgactcactatagggcgaattggtctggttgttctgcacagctgcaacagaggagagcagctatgcagaacaacaacctggcggcagcgcaaaagatg

SEQ ID NO: 180589 - DNA, 103 bp, Artificial Sequence
  Synthetic Polynucleotide
taatacgactcactataggggtgtggtgggcgaattggtctggttgttctaacagaggagaagaacaatgagaccaattaacctggcggcagcgcaaaagatg

SEQ ID NO: 180590 - DNA, 103 bp, Artificial Sequence
  Synthetic Polynucleotide
taatacgactcactatagggccggaatttggtgtggtgggcgaattggtcaacagaggagagaccaaatggcccaccacaacctggcggcagcgcaaaagatg

SEQ ID NO: 180591 - DNA, 103 bp, Artificial Sequence
  Synthetic Polynucleotide
taatacgactcactataggggtcccacagcttgatcttcctggtcaacataacagaggagaatgttgatgaggaagatcaacctggcggcagcgcaaaagatg

SEQ ID NO: 180592 - DNA, 103 bp, Artificial Sequence
  Synthetic Polynucleotide
taatacgactcactataggggctcctgcagaaggtgtgcagacactcggtaacagaggagaaccgagatgctgcacaccaacctggcggcagcgcaaaagatg

SEQ ID NO: 180593 - DNA, 103 bp, Artificial Sequence
  Synthetic Polynucleotide
taatacgactcactatagggtcaccaggcagctcctgcagaaggtgtgcaaacagaggagatgcacaatgtctgcaggaaacctggcggcagcgcaaaagatg

SEQ ID NO: 180594 - DNA, 103 bp, Artificial Sequence
  Synthetic Polynucleotide
taatacgactcactatagggtccaggtacttcaccaggcagctcctgcagaacagaggagactgcagatgctgcctggtaacctggcggcagcgcaaaagatg

SEQ ID NO: 180595 - DNA, 103 bp, Artificial Sequence
  Synthetic Polynucleotide
taatacgactcactataggggttgttctcctccaggtacttcaccaggcaaacagaggagatgcctgatgaagtacctgaacctggcggcagcgcaaaagatg

SEQ ID NO: 180596 - DNA, 103 bp, Artificial Sequence
  Synthetic Polynucleotide
taatacgactcactatagggtggggcaggtgttgttctcctccaggtactaacagaggagaagtaccatgaggagaacaaacctggcggcagcgcaaaagatg

SEQ ID NO: 180597 - DNA, 103 bp, Artificial Sequence
  Synthetic Polynucleotide
taatacgactcactatagggatcctgcaggtggggcaggtgttgttctccaacagaggagaggagaaatgcacctgcccaacctggcggcagcgcaaaagatg

SEQ ID NO: 180598 - DNA, 103 bp, Artificial Sequence
  Synthetic Polynucleotide
taatacgactcactataggggtggatcacaatcctgcaggtggggcaggtaacagaggagaacctgcatgacctgcaggaacctggcggcagcgcaaaagatg

SEQ ID NO: 180599 - DNA, 103 bp, Artificial Sequence
  Synthetic Polynucleotide
taatacgactcactatagggggtggctctggtggatcacaatcctgcaggaacagaggagacctgcaatgttgtgatccaacctggcggcagcgcaaaagatg

SEQ ID NO: 180600 - DNA, 103 bp, Artificial Sequence
  Synthetic Polynucleotide
taatacgactcactatagggtactgcagggggtggctctggtggatcacaaacagaggagatgtgatatgccagagccaaacctggcggcagcgcaaaagatg

SEQ ID NO: 180601 - DNA, 103 bp, Artificial Sequence
  Synthetic Polynucleotide
taatacgactcactatagggatgaccgatgtactgcagggggtggctctgaacagaggagacagagcatgcccctgcagaacctggcggcagcgcaaaagatg

SEQ ID NO: 180602 - DNA, 103 bp, Artificial Sequence
  Synthetic Polynucleotide
taatacgactcactataggggggcgttgatgtcccacagcttgatcttccaacagaggagaggaagaatgagctgtgggaacctggcggcagcgcaaaagatg

SEQ ID NO: 180603 - DNA, 103 bp, Artificial Sequence
  Synthetic Polynucleotide
taatacgactcactatagggtggttctgtcatgaccgatgtactgcagggaacagaggagaccctgcatgacatcggtcaacctggcggcagcgcaaaagatg

SEQ ID NO: 180604 - DNA, 103 bp, Artificial Sequence
  Synthetic Polynucleotide
taatacgactcactatagggatatcttgcatggttctgtcatgaccgatgaacagaggagacatcggatgtgacagaacaacctggcggcagcgcaaaagatg

SEQ ID NO: 180605 - DNA, 103 bp, Artificial Sequence
  Synthetic Polynucleotide
taatacgactcactatagggtttgtaaacaatatcttgcatggttctgtcaacagaggagagacagaatgatgcaagataacctggcggcagcgcaaaagatg

SEQ ID NO: 180606 - DNA, 103 bp, Artificial Sequence
  Synthetic Polynucleotide
taatacgactcactatagggctggtaccaatttgtaaacaatatcttgcaaacagaggagatgcaagatgttgtttacaaacctggcggcagcgcaaaagatg

SEQ ID NO: 180607 - DNA, 103 bp, Artificial Sequence
  Synthetic Polynucleotide
taatacgactcactatagggtcttggaggcctggtaccaatttgtaaacaaacagaggagatgtttaatgattggtaccaacctggcggcagcgcaaaagatg

SEQ ID NO: 180608 - DNA, 103 bp, Artificial Sequence
  Synthetic Polynucleotide
taatacgactcactatagggcatttccgcttcttggaggcctggtaccaaaacagaggagattggtaatgggcctccaaaacctggcggcagcgcaaaagatg

SEQ ID NO: 180609 - DNA, 103 bp, Artificial Sequence
  Synthetic Polynucleotide
taatacgactcactatagggtctgctttctcatttccgcttcttggaggcaacagaggagagcctccatgaagcggaaaaacctggcggcagcgcaaaagatg

SEQ ID NO: 180610 - DNA, 103 bp, Artificial Sequence
  Synthetic Polynucleotide
taatacgactcactatagggtagaactccctctgctttctcatttccgctaacagaggagaagcggaatggagaaagcaaacctggcggcagcgcaaaagatg

SEQ ID NO: 180611 - DNA, 103 bp, Artificial Sequence
  Synthetic Polynucleotide
taatacgactcactatagggcaatttgtgatagaactccctctgctttctaacagaggagaagaaagatgagggagttcaacctggcggcagcgcaaaagatg

SEQ ID NO: 180612 - DNA, 103 bp, Artificial Sequence
  Synthetic Polynucleotide
taatacgactcactatagggcctccatgcccaatttgtgatagaactcccaacagaggagagggagtatgatcacaaataacctggcggcagcgcaaaagatg

SEQ ID NO: 180613 - DNA, 103 bp, Artificial Sequence
  Synthetic Polynucleotide
taatacgactcactatagggcaggtgatgtgggcgttgatgtcccacagcaacagaggagagctgtgatgcatcaacgcaacctggcggcagcgcaaaagatg

SEQ ID NO: 180614 - DNA, 103 bp, Artificial Sequence
  Synthetic Polynucleotide
taatacgactcactatagggtctcccggcacctccatgcccaatttgtgaaacagaggagatcacaaatggggcatggaaacctggcggcagcgcaaaagatg

SEQ ID NO: 180615 - DNA, 103 bp, Artificial Sequence
  Synthetic Polynucleotide
taatacgactcactatagggccccttgatgtctcccggcacctccatgccaacagaggagaggcatgatggtgccgggaaacctggcggcagcgcaaaagatg

SEQ ID NO: 180616 - DNA, 103 bp, Artificial Sequence
  Synthetic Polynucleotide
taatacgactcactatagggagcaggtctcccccttgatgtctcccggcaaacagaggagatgccggatgacatcaaggaacctggcggcagcgcaaaagatg

SEQ ID NO: 180617 - DNA, 103 bp, Artificial Sequence
  Synthetic Polynucleotide
taatacgactcactatagggtgttttgcagagcaggtctcccccttgatgaacagaggagacatcaaatgggagacctgaacctggcggcagcgcaaaagatg

SEQ ID NO: 180618 - DNA, 103 bp, Artificial Sequence
  Synthetic Polynucleotide
taatacgactcactatagggatctaagtgctgttttgcagagcaggtctcaacagaggagagagaccatgtctgcaaaaaacctggcggcagcgcaaaagatg

SEQ ID NO: 180619 - DNA, 103 bp, Artificial Sequence
  Synthetic Polynucleotide
taatacgactcactatagggtccgatgggaatctaagtgctgttttgcagaacagaggagactgcaaatgagcacttagaacctggcggcagcgcaaaagatg

SEQ ID NO: 180620 - DNA, 103 bp, Artificial Sequence
  Synthetic Polynucleotide
taatacgactcactataggggtttcaccattccgatgggaatctaagtgcaacagaggagagcacttatgttcccatcgaacctggcggcagcgcaaaagatg

SEQ ID NO: 180621 - DNA, 103 bp, Artificial Sequence
  Synthetic Polynucleotide
taatacgactcactataggggtctgctttggtttcaccattccgatgggaaacagaggagatcccatatgaatggtgaaaacctggcggcagcgcaaaagatg

SEQ ID NO: 180622 - DNA, 103 bp, Artificial Sequence
  Synthetic Polynucleotide
taatacgactcactatagggttgaactgtcgtctgctttggtttcaccataacagaggagaatggtgatgccaaagcagaacctggcggcagcgcaaaagatg

SEQ ID NO: 180623 - DNA, 103 bp, Artificial Sequence
  Synthetic Polynucleotide
taatacgactcactataggggcctctttgtttgaactgtcgtctgctttgaacagaggagacaaagcatgcgacagttcaacctggcggcagcgcaaaagatg

SEQ ID NO: 180624 - DNA, 103 bp, Artificial Sequence
  Synthetic Polynucleotide
taatacgactcactataggggcacaggcggcaggtgatgtgggcgttgataacagaggagaatcaacatgcacatcaccaacctggcggcagcgcaaaagatg

SEQ ID NO: 180625 - DNA, 103 bp, Artificial Sequence
  Synthetic Polynucleotide
taatacgactcactatagggctcctccgcggcctctttgtttgaactgtcaacagaggagagacagtatgaacaaagagaacctggcggcagcgcaaaagatg

SEQ ID NO: 180626 - DNA, 103 bp, Artificial Sequence
  Synthetic Polynucleotide
taatacgactcactatagggcctccggcttctcctccgcggcctctttgtaacagaggagaacaaagatgccgcggaggaacctggcggcagcgcaaaagatg

SEQ ID NO: 180627 - DNA, 103 bp, Artificial Sequence
  Synthetic Polynucleotide
taatacgactcactatagggtcgttgtcctcctccggcttctcctccgcgaacagaggagacgcggaatggaagccggaaacctggcggcagcgcaaaagatg

SEQ ID NO: 180628 - DNA, 103 bp, Artificial Sequence
  Synthetic Polynucleotide
taatacgactcactataggggcggtggtagtcgttgtcctcctccggcttaacagaggagaaagccgatggaggacaacaacctggcggcagcgcaaaagatg

SEQ ID NO: 180629 - DNA, 103 bp, Artificial Sequence
  Synthetic Polynucleotide
taatacgactcactataggggctcgtcgctgcggtggtagtcgttgtcctaacagaggagaaggacaatgactaccaccaacctggcggcagcgcaaaagatg

SEQ ID NO: 180630 - DNA, 103 bp, Artificial Sequence
  Synthetic Polynucleotide
taatacgactcactatagggatgctcacctgctcgtcgctgcggtggtagaacagaggagactaccaatgcagcgacgaaacctggcggcagcgcaaaagatg

SEQ ID NO: 180631 - DNA, 103 bp, Artificial Sequence
  Synthetic Polynucleotide
taatacgactcactatagggctccaggcagatgctcacctgctcgtcgctaacagaggagaagcgacatgcaggtgagcaacctggcggcagcgcaaaagatg

SEQ ID NO: 180632 - DNA, 103 bp, Artificial Sequence
  Synthetic Polynucleotide
taatacgactcactatagggtgctgttacactccaggcagatgctcacctaacagaggagaaggtgaatgtctgcctggaacctggcggcagcgcaaaagatg

SEQ ID NO: 180633 - DNA, 103 bp, Artificial Sequence
  Synthetic Polynucleotide
taatacgactcactatagggcgcagtttgctgctgttacactccaggcagaacagaggagactgcctatggtgtaacagaacctggcggcagcgcaaaagatg

SEQ ID NO: 180634 - DNA, 103 bp, Artificial Sequence
  Synthetic Polynucleotide
taatacgactcactatagggcttcagcccgcgcagtttgctgctgttacaaacagaggagatgtaacatgagcaaactgaacctggcggcagcgcaaaagatg

SEQ ID NO: 180635 - DNA, 103 bp, Artificial Sequence
  Synthetic Polynucleotide
taatacgactcactatagggggtacccgctgcacaggcggcaggtgatgtaacagaggagaacatcaatggccgcctgtaacctggcggcagcgcaaaagatg

SEQ ID NO: 180636 - DNA, 103 bp, Artificial Sequence
  Synthetic Polynucleotide
taatacgactcactatagggtccacttccgcttcagcccgcgcagtttgcaacagaggagagcaaacatggcgggctgaaacctggcggcagcgcaaaagatg

SEQ ID NO: 180637 - DNA, 103 bp, Artificial Sequence
  Synthetic Polynucleotide
taatacgactcactataggggagcagcggatccacttccgcttcagcccgaacagaggagacgggctatggcggaagtgaacctggcggcagcgcaaaagatg

SEQ ID NO: 180638 - DNA, 103 bp, Artificial Sequence
  Synthetic Polynucleotide
taatacgactcactatagggcgcctgggctgagcagcggatccacttccgaacagaggagacggaagatgatccgctgcaacctggcggcagcgcaaaagatg

SEQ ID NO: 180639 - DNA, 103 bp, Artificial Sequence
  Synthetic Polynucleotide
taatacgactcactataggggcaagacggtcgcctgggctgagcagcggaaacagaggagatccgctatgcagcccaggaacctggcggcagcgcaaaagatg

SEQ ID NO: 180640 - DNA, 103 bp, Artificial Sequence
  Synthetic Polynucleotide
taatacgactcactatagggttcttcagatgcaagacggtcgcctgggctaacagaggagaagcccaatggaccgtcttaacctggcggcagcgcaaaagatg

SEQ ID NO: 180641 - DNA, 103 bp, Artificial Sequence
  Synthetic Polynucleotide
taatacgactcactatagggggcgatgaacttcttcagatgcaagacggtaacagaggagaaccgtcatgcatctgaagaacctggcggcagcgcaaaagatg

SEQ ID NO: 180642 - DNA, 103 bp, Artificial Sequence
  Synthetic Polynucleotide
taatacgactcactatagggtgagttttttggcgatgaacttcttcagataacagaggagaatctgaatgagttcatcgaacctggcggcagcgcaaaagatg

SEQ ID NO: 180643 - DNA, 103 bp, Artificial Sequence
  Synthetic Polynucleotide
taatacgactcactataggggatgaaaggttgagttttttggcgatgaacaacagaggagagttcatatgcaaaaaactaacctggcggcagcgcaaaagatg

SEQ ID NO: 180644 - DNA, 103 bp, Artificial Sequence
  Synthetic Polynucleotide
taatacgactcactatagggctcgttaaaggatgaaaggttgagttttttaacagaggagaaaaaaaatgaacctttcaaacctggcggcagcgcaaaagatg

SEQ ID NO: 180645 - DNA, 103 bp, Artificial Sequence
  Synthetic Polynucleotide
taatacgactcactatagggaaatgtccagctcgttaaaggatgaaaggtaacagaggagaacctttatgcctttaacgaacctggcggcagcgcaaaagatg

SEQ ID NO: 180646 - DNA, 103 bp, Artificial Sequence
  Synthetic Polynucleotide
taatacgactcactataggggcgtcgatgaggtacccgctgcacaggcggaacagaggagaccgcctatgcagcgggtaaacctggcggcagcgcaaaagatg

SEQ ID NO: 180647 - DNA, 103 bp, Artificial Sequence
  Synthetic Polynucleotide
taatacgactcactatagggtcgttgcataaaatgtccagctcgttaaagaacagaggagactttaaatggctggacataacctggcggcagcgcaaaagatg

SEQ ID NO: 180648 - DNA, 103 bp, Artificial Sequence
  Synthetic Polynucleotide
taatacgactcactatagggcaggatctcctcgttgcataaaatgtccagaacagaggagactggacatgttatgcaacaacctggcggcagcgcaaaagatg

SEQ ID NO: 180649 - DNA, 103 bp, Artificial Sequence
  Synthetic Polynucleotide
taatacgactcactatagggggtccttgcccaggatctcctcgttgcataaacagaggagatatgcaatgaggagatccaacctggcggcagcgcaaaagatg

SEQ ID NO: 180650 - DNA, 103 bp, Artificial Sequence
  Synthetic Polynucleotide
taatacgactcactatagggttgagtgtgtggtccttgcccaggatctccaacagaggagaggagatatggggcaaggaaacctggcggcagcgcaaaagatg

SEQ ID NO: 180651 - DNA, 103 bp, Artificial Sequence
  Synthetic Polynucleotide
taatacgactcactatagggaaccacgaacttgagtgtgtggtccttgccaacagaggagaggcaagatgcacacactcaacctggcggcagcgcaaaagatg

SEQ ID NO: 180652 - DNA, 103 bp, Artificial Sequence
  Synthetic Polynucleotide
taatacgactcactatagggacctagtgacaaccacgaacttgagtgtgtaacagaggagaacacacatgagttcgtggaacctggcggcagcgcaaaagatg

SEQ ID NO: 180653 - DNA, 103 bp, Artificial Sequence
  Synthetic Polynucleotide
taatacgactcactatagggttgaatctccacctagtgacaaccacgaacaacagaggagagttcgtatgtgtcactagaacctggcggcagcgcaaaagatg

SEQ ID NO: 180654 - DNA, 103 bp, Artificial Sequence
  Synthetic Polynucleotide
taatacgactcactatagggcggcgccttcttgaatctccacctagtgacaacagaggagagtcactatgtggagattcaacctggcggcagcgcaaaagatg

SEQ ID NO: 180655 - DNA, 103 bp, Artificial Sequence
  Synthetic Polynucleotide
taatacgactcactataggggcagcaggagcggcgccttcttgaatctccaacagaggagaggagatatgagaaggcgcaacctggcggcagcgcaaaagatg

SEQ ID NO: 180656 - DNA, 103 bp, Artificial Sequence
  Synthetic Polynucleotide
taatacgactcactatagggggtctgtagtgcagcaggagcggcgccttcaacagaggagagaaggcatggctcctgctaacctggcggcagcgcaaaagatg

SEQ ID NO: 180657 - DNA, 103 bp, Artificial Sequence
  Synthetic Polynucleotide
taatacgactcactatagggcaccgtggtggcgtcgatgaggtacccgctaacagaggagaagcgggatgctcatcgacaacctggcggcagcgcaaaagatg

SEQ ID NO: 180658 - DNA, 103 bp, Artificial Sequence
  Synthetic Polynucleotide
taatacgactcactataggggtccatcttgggtctgtagtgcagcaggagaacagaggagactcctgatgcactacagaaacctggcggcagcgcaaaagatg

SEQ ID NO: 180659 - DNA, 103 bp, Artificial Sequence
  Synthetic Polynucleotide
taatacgactcactataggggacactcggtcaccgtggtggcgtcgatgaaacagaggagatcatcgatgccaccacggaacctggcggcagcgcaaaagatg

SEQ ID NO: 180660 - DNA, 103 bp, Artificial Sequence
  Synthetic Polynucleotide
taatacgactcactatagggaaggtgtgcagacactcggtcaccgtggtgaacagaggagacaccacatggaccgagtgaacctggcggcagcgcaaaagatg

SEQ ID NO: 180661 - DNA, 103 bp, Artificial Sequence
  Synthetic Polynucleotide
taatacgactcactatagggtttcaccaagtgtttcctttgggtagccataacagaggagaatggctatgcaaaggaaaaacctggcggcagcgcaaaagatg

SEQ ID NO: 180662 - DNA, 103 bp, Artificial Sequence
  Synthetic Polynucleotide
taatacgactcactatagggcttacagaatgtatggaggcattccgtcacaacagaggagagtgacgatgtgcctccataacctggcggcagcgcaaaagatg

SEQ ID NO: 180663 - DNA, 103 bp, Artificial Sequence
  Synthetic Polynucleotide
taatacgactcactatagggcaatacaagtcttacagaatgtatggaggcaacagaggagagcctccatgcattctgtaaacctggcggcagcgcaaaagatg

SEQ ID NO: 180664 - DNA, 103 bp, Artificial Sequence
  Synthetic Polynucleotide
taatacgactcactatagggaagtgctgaacaatacaagtcttacagaataacagaggagaattctgatggacttgtataacctggcggcagcgcaaaagatg

SEQ ID NO: 180665 - DNA, 103 bp, Artificial Sequence
  Synthetic Polynucleotide
taatacgactcactataggggctatcttcaaagtgctgaacaatacaagtaacagaggagaacttgtatggttcagcacaacctggcggcagcgcaaaagatg

SEQ ID NO: 180666 - DNA, 103 bp, Artificial Sequence
  Synthetic Polynucleotide
taatacgactcactatagggggcaatcattgctatcttcaaagtgctgaaaacagaggagattcagcatgttgaagataaacctggcggcagcgcaaaagatg

SEQ ID NO: 180667 - DNA, 103 bp, Artificial Sequence
  Synthetic Polynucleotide
taatacgactcactatagggccacaccttgggcaatcattgctatcttcaaacagaggagatgaagaatgcaatgattgaacctggcggcagcgcaaaagatg

SEQ ID NO: 180668 - DNA, 103 bp, Artificial Sequence
  Synthetic Polynucleotide
taatacgactcactatagggaacttggttgccacaccttgggcaatcattaacagaggagaaatgatatgccaaggtgtaacctggcggcagcgcaaaagatg

SEQ ID NO: 180669 - DNA, 103 bp, Artificial Sequence
  Synthetic Polynucleotide
taatacgactcactatagggttgtctcatgaacttggttgccacaccttgaacagaggagacaaggtatggcaaccaagaacctggcggcagcgcaaaagatg

SEQ ID NO: 180670 - DNA, 103 bp, Artificial Sequence
  Synthetic Polynucleotide
taatacgactcactatagggtctaatggatttgtctcatgaacttggttgaacagaggagacaaccaatgtcatgagacaacctggcggcagcgcaaaagatg

SEQ ID NO: 180671 - DNA, 103 bp, Artificial Sequence
  Synthetic Polynucleotide
taatacgactcactatagggcctcaacatttctaatggatttgtctcatgaacagaggagacatgagatgaatccattaaacctggcggcagcgcaaaagatg

SEQ ID NO: 180672 - DNA, 103 bp, Artificial Sequence
  Synthetic Polynucleotide
taatacgactcactataggggattaaaatctttcaccaagtgtttcctttaacagaggagaaaaggaatgacttggtgaaacctggcggcagcgcaaaagatg

SEQ ID NO: 180673 - DNA, 103 bp, Artificial Sequence
  Synthetic Polynucleotide
taatacgactcactatagggtattgtccaacctcaacatttctaatggataacagaggagaatccatatgaaatgttgaaacctggcggcagcgcaaaagatg

SEQ ID NO: 180674 - DNA, 103 bp, Artificial Sequence
  Synthetic Polynucleotide
taatacgactcactatagggtcctctaatgtattgtccaacctcaacattaacagaggagaaatgttatggttggacaaaacctggcggcagcgcaaaagatg

SEQ ID NO: 180675 - DNA, 103 bp, Artificial Sequence
  Synthetic Polynucleotide
taatacgactcactatagggaaatataatttcctctaatgtattgtccaaaacagaggagattggacatgacattagagaacctggcggcagcgcaaaagatg

SEQ ID NO: 180676 - DNA, 103 bp, Artificial Sequence
  Synthetic Polynucleotide
taatacgactcactatagggggaccagcttaaatataatttcctctaatgaacagaggagacattagatgaaattatataacctggcggcagcgcaaaagatg

SEQ ID NO: 180677 - DNA, 103 bp, Artificial Sequence
  Synthetic Polynucleotide
taatacgactcactatagggcgtagtccagggaccagcttaaatataattaacagaggagaaattatatgtaagctggtaacctggcggcagcgcaaaagatg

SEQ ID NO: 180678 - DNA, 103 bp, Artificial Sequence
  Synthetic Polynucleotide
taatacgactcactatagggttcttgttctcgtagtccagggaccagcttaacagaggagaaagctgatgcctggactaaacctggcggcagcgcaaaagatg

SEQ ID NO: 180679 - DNA, 103 bp, Artificial Sequence
  Synthetic Polynucleotide
taatacgactcactatagggcacgctcaagttcttgttctcgtagtccagaacagaggagactggacatggagaacaagaacctggcggcagcgcaaaagatg

SEQ ID NO: 180680 - DNA, 103 bp, Artificial Sequence
  Synthetic Polynucleotide
taatacgactcactatagggaattcagattcacgctcaagttcttgttctaacagaggagaagaacaatgacttgagcgaacctggcggcagcgcaaaagatg

SEQ ID NO: 180681 - DNA, 103 bp, Artificial Sequence
  Synthetic Polynucleotide
taatacgactcactatagggtttcttccaaaattcagattcacgctcaagaacagaggagacttgagatggaatctgaaaacctggcggcagcgcaaaagatg

SEQ ID NO: 180682 - DNA, 103 bp, Artificial Sequence
  Synthetic Polynucleotide
taatacgactcactataggggaggcttatttttcttccaaaattcagattaacagaggagaaatctgatgtttggaagaaacctggcggcagcgcaaaagatg

SEQ ID NO: 180683 - DNA, 103 bp, Artificial Sequence
  Synthetic Polynucleotide
taatacgactcactataggggtaatgtaaggattaaaatctttcaccaagaacagaggagacttggtatgagattttaaaacctggcggcagcgcaaaagatg

SEQ ID NO: 180684 - DNA, 103 bp, Artificial Sequence
  Synthetic Polynucleotide
taatacgactcactatagggccattttcttgaggcttatttttcttccaaaacagaggagattggaaatgaaataagccaacctggcggcagcgcaaaagatg

SEQ ID NO: 180685 - DNA, 103 bp, Artificial Sequence
  Synthetic Polynucleotide
taatacgactcactatagggatcatcttgtccattttcttgaggcttattaacagaggagaaataagatgcaagaaaataacctggcggcagcgcaaaagatg

SEQ ID NO: 180686 - DNA, 103 bp, Artificial Sequence
  Synthetic Polynucleotide
taatacgactcactatagggcttttgaagtatcatcttgtccattttcttaacagaggagaaagaaaatggacaagatgaacctggcggcagcgcaaaagatg

SEQ ID NO: 180687 - DNA, 103 bp, Artificial Sequence
  Synthetic Polynucleotide
taatacgactcactatagggggtttgtcagcttttgaagtatcatcttgtaacagaggagaacaagaatgtacttcaaaaacctggcggcagcgcaaaagatg

SEQ ID NO: 180688 - DNA, 103 bp, Artificial Sequence
  Synthetic Polynucleotide
taatacgactcactatagggatctactttcggtttgtcagcttttgaagtaacagaggagaacttcaatggctgacaaaaacctggcggcagcgcaaaagatg

SEQ ID NO: 180689 - DNA, 103 bp, Artificial Sequence
  Synthetic Polynucleotide
taatacgactcactatagggcaccttcttcatctactttcggtttgtcagaacagaggagactgacaatgcgaaagtagaacctggcggcagcgcaaaagatg

SEQ ID NO: 180690 - DNA, 103 bp, Artificial Sequence
  Synthetic Polynucleotide
taatacgactcactatagggtcattttcatcaccttcttcatctactttcaacagaggagagaaagtatgtgaagaaggaacctggcggcagcgcaaaagatg

SEQ ID NO: 180691 - DNA, 103 bp, Artificial Sequence
  Synthetic Polynucleotide
taatacgactcactatagggtttatcatcttcattttcatcaccttcttcaacagaggagagaagaaatggatgaaaataacctggcggcagcgcaaaagatg

SEQ ID NO: 180692 - DNA, 103 bp, Artificial Sequence
  Synthetic Polynucleotide
taatacgactcactatagggtgtgataatctttatcatcttcattttcataacagaggagaatgaaaatgaagatgataaacctggcggcagcgcaaaagatg

SEQ ID NO: 180693 - DNA, 103 bp, Artificial Sequence
  Synthetic Polynucleotide
taatacgactcactataggggggtcacttctgtgataatctttatcatctaacagaggagaagatgaatgagattatcaaacctggcggcagcgcaaaagatg

SEQ ID NO: 180694 - DNA, 103 bp, Artificial Sequence
  Synthetic Polynucleotide
taatacgactcactataggggatatagcaggtaatgtaaggattaaaatcaacagaggagagattttatgccttacattaacctggcggcagcgcaaaagatg

SEQ ID NO: 180695 - DNA, 103 bp, Artificial Sequence
  Synthetic Polynucleotide
taatacgactcactatagggagcaatttgtgggtcacttctgtgataatcaacagaggagagattatatgagaagtgacaacctggcggcagcgcaaaagatg

SEQ ID NO: 180696 - DNA, 103 bp, Artificial Sequence
  Synthetic Polynucleotide
taatacgactcactatagggctagacagatagcaatttgtgggtcacttcaacagaggagagaagtgatgcacaaattgaacctggcggcagcgcaaaagatg

SEQ ID NO: 180697 - DNA, 103 bp, Artificial Sequence
  Synthetic Polynucleotide
taatacgactcactatagggcgtaaacaatctagacagatagcaatttgtaacagaggagaacaaatatgtatctgtctaacctggcggcagcgcaaaagatg

SEQ ID NO: 180698 - DNA, 103 bp, Artificial Sequence
  Synthetic Polynucleotide
taatacgactcactatagggcccattatttcgtaaacaatctagacagataacagaggagaatctgtatggattgtttaaacctggcggcagcgcaaaagatg

SEQ ID NO: 180699 - DNA, 103 bp, Artificial Sequence
  Synthetic Polynucleotide
taatacgactcactatagggcccctgattgcccattatttcgtaaacaataacagaggagaattgttatggaaataatgaacctggcggcagcgcaaaagatg

SEQ ID NO: 180700 - DNA, 103 bp, Artificial Sequence
  Synthetic Polynucleotide
taatacgactcactatagggactacattgtcccctgattgcccattatttaacagaggagaaaataaatggcaatcaggaacctggcggcagcgcaaaagatg

SEQ ID NO: 180701 - DNA, 103 bp, Artificial Sequence
  Synthetic Polynucleotide
taatacgactcactatagggtaaaccctttactacattgtcccctgattgaacagaggagacaatcaatggacaatgtaaacctggcggcagcgcaaaagatg

SEQ ID NO: 180702 - DNA, 103 bp, Artificial Sequence
  Synthetic Polynucleotide
taatacgactcactatagggatttcttcattaaaccctttactacattgtaacagaggagaacaatgatgtaaagggttaacctggcggcagcgcaaaagatg

SEQ ID NO: 180703 - DNA, 103 bp, Artificial Sequence
  Synthetic Polynucleotide
taatacgactcactatagggcatcgaatgaatttcttcattaaaccctttaacagaggagaaaagggatgaatgaagaaaacctggcggcagcgcaaaagatg

SEQ ID NO: 180704 - DNA, 103 bp, Artificial Sequence
  Synthetic Polynucleotide
taatacgactcactatagggacgtgtagaacatcgaatgaatttcttcataacagaggagaatgaagatgttcattcgaaacctggcggcagcgcaaaagatg

SEQ ID NO: 180705 - DNA, 103 bp, Artificial Sequence
  Synthetic Polynucleotide
taatacgactcactatagggaccctttacagatatagcaggtaatgtaagaacagaggagacttacaatgcctgctataaacctggcggcagcgcaaaagatg

SEQ ID NO: 180706 - DNA, 103 bp, Artificial Sequence
  Synthetic Polynucleotide
taatacgactcactatagggccacagttacacgtgtagaacatcgaatgaaacagaggagatcattcatggttctacacaacctggcggcagcgcaaaagatg

SEQ ID NO: 180707 - DNA, 103 bp, Artificial Sequence
  Synthetic Polynucleotide
taatacgactcactatagggttaatagttcccacagttacacgtgtagaaaacagaggagattctacatgtgtaactgtaacctggcggcagcgcaaaagatg

SEQ ID NO: 180708 - DNA, 103 bp, Artificial Sequence
  Synthetic Polynucleotide
taatacgactcactatagggtagaaattttttaatagttcccacagttacaacagaggagagtaactatgggaactattaacctggcggcagcgcaaaagatg

SEQ ID NO: 180709 - DNA, 103 bp, Artificial Sequence
  Synthetic Polynucleotide
taatacgactcactataggggttttaaacttagaaattttttaatagttcaacagaggagagaactaatgaaaaatttcaacctggcggcagcgcaaaagatg

SEQ ID NO: 180710 - DNA, 103 bp, Artificial Sequence
  Synthetic Polynucleotide
taatacgactcactatagggggaagttttagttttaaacttagaaattttaacagaggagaaaaattatgaagtttaaaaacctggcggcagcgcaaaagatg

SEQ ID NO: 180711 - DNA, 103 bp, Artificial Sequence
  Synthetic Polynucleotide
taatacgactcactatagggataagaacttggaagttttagttttaaactaacagaggagaagtttaatgctaaaacttaacctggcggcagcgcaaaagatg

SEQ ID NO: 180712 - DNA, 103 bp, Artificial Sequence
  Synthetic Polynucleotide
taatacgactcactatagggcatccaactcataagaacttggaagttttaaacagaggagataaaacatgcaagttcttaacctggcggcagcgcaaaagatg

SEQ ID NO: 180713 - DNA, 103 bp, Artificial Sequence
  Synthetic Polynucleotide
taatacgactcactatagggttgcacagcacatccaactcataagaacttaacagaggagaaagttcatgtgagttggaaacctggcggcagcgcaaaagatg

SEQ ID NO: 180714 - DNA, 103 bp, Artificial Sequence
  Synthetic Polynucleotide
taatacgactcactatagggaatttcaccattgcacagcacatccaactcaacagaggagagagttgatggtgctgtgcaacctggcggcagcgcaaaagatg

SEQ ID NO: 180715 - DNA, 103 bp, Artificial Sequence
  Synthetic Polynucleotide
taatacgactcactatagggccttccccataatttcaccattgcacagcaaacagaggagatgctgtatgatggtgaaaaacctggcggcagcgcaaaagatg

SEQ ID NO: 180716 - DNA, 103 bp, Artificial Sequence
  Synthetic Polynucleotide
taatacgactcactatagggttgatcagataccctttacagatatagcagaacagaggagactgctaatgctgtaaaggaacctggcggcagcgcaaaagatg

SEQ ID NO: 180717 - DNA, 103 bp, Artificial Sequence
  Synthetic Polynucleotide
taatacgactcactatagggatagtatgatccttccccataatttcaccaaacagaggagatggtgaatgtatggggaaaacctggcggcagcgcaaaagatg

SEQ ID NO: 180718 - DNA, 103 bp, Artificial Sequence
  Synthetic Polynucleotide
taatacgactcactataggggatgaattccatagtatgatccttccccataacagaggagaatggggatggatcatactaacctggcggcagcgcaaaagatg

SEQ ID NO: 180719 - DNA, 103 bp, Artificial Sequence
  Synthetic Polynucleotide
taatacgactcactatagggttgtcatgtagatgaattccatagtatgataacagaggagaatcataatgtggaattcaaacctggcggcagcgcaaaagatg

SEQ ID NO: 180720 - DNA, 103 bp, Artificial Sequence
  Synthetic Polynucleotide
taatacgactcactatagggagtcgccatcttgtcatgtagatgaattccaacagaggagaggaattatgctacatgacaacctggcggcagcgcaaaagatg

SEQ ID NO: 180721 - DNA, 103 bp, Artificial Sequence
  Synthetic Polynucleotide
taatacgactcactatagggttcgcctcttagtcgccatcttgtcatgtaaacagaggagatacatgatgagatggcgaaacctggcggcagcgcaaaagatg

SEQ ID NO: 180722 - DNA, 103 bp, Artificial Sequence
  Synthetic Polynucleotide
taatacgactcactatagggaccgaaagttttcgcctcttagtcgccatcaacagaggagagatggcatgtaagaggcgaacctggcggcagcgcaaaagatg

SEQ ID NO: 180723 - DNA, 103 bp, Artificial Sequence
  Synthetic Polynucleotide
taatacgactcactatagggcagttcagacaccgaaagttttcgcctcttaacagaggagaaagaggatgaaactttcgaacctggcggcagcgcaaaagatg

SEQ ID NO: 180724 - DNA, 103 bp, Artificial Sequence
  Synthetic Polynucleotide
taatacgactcactatagggcgaagctgagcagttcagacaccgaaagttaacagaggagaaactttatgtgtctgaacaacctggcggcagcgcaaaagatg

SEQ ID NO: 180725 - DNA, 103 bp, Artificial Sequence
  Synthetic Polynucleotide
taatacgactcactatagggagcagacttgcgaagctgagcagttcagacaacagaggagagtctgaatggctcagcttaacctggcggcagcgcaaaagatg

SEQ ID NO: 180726 - DNA, 103 bp, Artificial Sequence
  Synthetic Polynucleotide
taatacgactcactatagggccatcctgagagcagacttgcgaagctgagaacagaggagactcagcatggcaagtctgaacctggcggcagcgcaaaagatg

SEQ ID NO: 180727 - DNA, 103 bp, Artificial Sequence
  Synthetic Polynucleotide
taatacgactcactatagggtgttgttggcttgatcagataccctttacaaacagaggagatgtaaaatgtatctgatcaacctggcggcagcgcaaaagatg

SEQ ID NO: 180728 - DNA, 103 bp, Artificial Sequence
  Synthetic Polynucleotide
taatacgactcactatagggatacaaagggccatcctgagagcagacttgaacagaggagacaagtcatgtctcaggataacctggcggcagcgcaaaagatg

SEQ ID NO: 180729 - DNA, 103 bp, Artificial Sequence
  Synthetic Polynucleotide
taatacgactcactatagggggtatgactgatacaaagggccatcctgagaacagaggagactcaggatggccctttgtaacctggcggcagcgcaaaagatg

SEQ ID NO: 180730 - DNA, 103 bp, Artificial Sequence
  Synthetic Polynucleotide
taatacgactcactatagggagtaccatagggtatgactgatacaaagggaacagaggagaccctttatgtcagtcataaacctggcggcagcgcaaaagatg

SEQ ID NO: 180731 - DNA, 103 bp, Artificial Sequence
  Synthetic Polynucleotide
taatacgactcactatagggtcgatactgcagtaccatagggtatgactgaacagaggagacagtcaatgcctatggtaaacctggcggcagcgcaaaagatg

SEQ ID NO: 180732 - DNA, 103 bp, Artificial Sequence
  Synthetic Polynucleotide
taatacgactcactatagggcaattcttggtcgatactgcagtaccatagaacagaggagactatggatgtgcagtatcaacctggcggcagcgcaaaagatg

SEQ ID NO: 180733 - DNA, 103 bp, Artificial Sequence
  Synthetic Polynucleotide
taatacgactcactatagggtaaccgaaatcaattcttggtcgatactgcaacagaggagagcagtaatgaccaagaataacctggcggcagcgcaaaagatg

SEQ ID NO: 180734 - DNA, 103 bp, Artificial Sequence
  Synthetic Polynucleotide
taatacgactcactatagggattccgtcactgttgttggcttgatcagataacagaggagaatctgaatgagccaacaaaacctggcggcagcgcaaaagatg

SEQ ID NO: 180735 - DNA, 103 bp, Artificial Sequence
  Synthetic Polynucleotide
taatacgactcactataggggtatggaggcattccgtcactgttgttggcaacagaggagagccaacatgagtgacggaaacctggcggcagcgcaaaagatg

SEQ ID NO: 180736 - DNA, 103 bp, Artificial Sequence
  Synthetic Polynucleotide
taatacgactcactataggggcccgccgtcaccaccgcgaccccctccataacagaggagaatggagatggtcgcggtgaacctggcggcagcgcaaaagatg

SEQ ID NO: 180737 - DNA, 103 bp, Artificial Sequence
  Synthetic Polynucleotide
taatacgactcactatagggcgctgcgggtgcaggggtgagggcgggcggaacagaggagaccgcccatgctcacccctaacctggcggcagcgcaaaagatg

SEQ ID NO: 180738 - DNA, 103 bp, Artificial Sequence
  Synthetic Polynucleotide
taatacgactcactatagggcctcctcacccgctgcgggtgcaggggtgaaacagaggagatcacccatgcacccgcagaacctggcggcagcgcaaaagatg

SEQ ID NO: 180739 - DNA, 103 bp, Artificial Sequence
  Synthetic Polynucleotide
taatacgactcactatagggggcgccggtccctcctcacccgctgcgggtaacagaggagaacccgcatggggtgaggaaacctggcggcagcgcaaaagatg

SEQ ID NO: 180740 - DNA, 103 bp, Artificial Sequence
  Synthetic Polynucleotide
taatacgactcactatagggctcagacagaggcgccggtccctcctcaccaacagaggagaggtgagatgggaccggcgaacctggcggcagcgcaaaagatg

SEQ ID NO: 180741 - DNA, 103 bp, Artificial Sequence
  Synthetic Polynucleotide
taatacgactcactataggggagcccccgtctcagacagaggcgccggtcaacagaggagagaccggatgctctgtctgaacctggcggcagcgcaaaagatg

SEQ ID NO: 180742 - DNA, 103 bp, Artificial Sequence
  Synthetic Polynucleotide
taatacgactcactataggggagcagccgggagcccccgtctcagacagaaacagaggagatctgtcatggacgggggcaacctggcggcagcgcaaaagatg

SEQ ID NO: 180743 - DNA, 103 bp, Artificial Sequence
  Synthetic Polynucleotide
taatacgactcactatagggccgggagccggagcagccgggagcccccgtaacagaggagaacggggatgcccggctgcaacctggcggcagcgcaaaagatg

SEQ ID NO: 180744 - DNA, 103 bp, Artificial Sequence
  Synthetic Polynucleotide
taatacgactcactataggggctcagggggccgggagccggagcagccggaacagaggagaccggctatgccggctcccaacctggcggcagcgcaaaagatg

SEQ ID NO: 180745 - DNA, 103 bp, Artificial Sequence
  Synthetic Polynucleotide
taatacgactcactatagggtccggctccagctcagggggccgggagccgaacagaggagacggctcatggccccctgaaacctggcggcagcgcaaaagatg

SEQ ID NO: 180746 - DNA, 103 bp, Artificial Sequence
  Synthetic Polynucleotide
taatacgactcactatagggcaggctgcgctccggctccagctcagggggaacagaggagaccccctatgctggagccgaacctggcggcagcgcaaaagatg

SEQ ID NO: 180747 - DNA, 103 bp, Artificial Sequence
  Synthetic Polynucleotide
taatacgactcactatagggcgcctacgctgcccgccgtcaccaccgcgaaacagaggagatcgcggatgtgacggcggaacctggcggcagcgcaaaagatg

SEQ ID NO: 180748 - DNA, 103 bp, Artificial Sequence
  Synthetic Polynucleotide
taatacgactcactatagggtgaagcggcccaggctgcgctccggctccaaacagaggagatggagcatgagcgcagccaacctggcggcagcgcaaaagatg

SEQ ID NO: 180749 - DNA, 103 bp, Artificial Sequence
  Synthetic Polynucleotide
taatacgactcactatagggaagcggcctctgaagcggcccaggctgcgcaacagaggagagcgcagatggggccgcttaacctggcggcagcgcaaaagatg

SEQ ID NO: 180750 - DNA, 103 bp, Artificial Sequence
  Synthetic Polynucleotide
taatacgactcactatagggctcgtcctcgaagcggcctctgaagcggccaacagaggagaggccgcatgagaggccgcaacctggcggcagcgcaaaagatg

SEQ ID NO: 180751 - DNA, 103 bp, Artificial Sequence
  Synthetic Polynucleotide
taatacgactcactatagggactcctcgtcctcgtcctcgaagcggcctcaacagaggagagaggccatgtcgaggacgaacctggcggcagcgcaaaagatg

SEQ ID NO: 180752 - DNA, 103 bp, Artificial Sequence
  Synthetic Polynucleotide
taatacgactcactatagggtcttcttccaactcctcgtcctcgtcctcgaacagaggagacgaggaatgggacgaggaaacctggcggcagcgcaaaagatg

SEQ ID NO: 180753 - DNA, 103 bp, Artificial Sequence
  Synthetic Polynucleotide
taatacgactcactatagggcagctcctcttcttcttccaactcctcgtcaacagaggagagacgagatgttggaagaaaacctggcggcagcgcaaaagatg

SEQ ID NO: 180754 - DNA, 103 bp, Artificial Sequence
  Synthetic Polynucleotide
taatacgactcactatagggcttcctcctccagctcctcttcttcttccaaacagaggagatggaagatgaagaggagcaacctggcggcagcgcaaaagatg

SEQ ID NO: 180755 - DNA, 103 bp, Artificial Sequence
  Synthetic Polynucleotide
taatacgactcactatagggtcctcctcttcttcctcctccagctcctctaacagaggagaagaggaatgggaggaggaaacctggcggcagcgcaaaagatg

SEQ ID NO: 180756 - DNA, 103 bp, Artificial Sequence
  Synthetic Polynucleotide
taatacgactcactataggggtcctcctcctcctcctcttcttcctcctcaacagaggagagaggagatggaagaggagaacctggcggcagcgcaaaagatg

SEQ ID NO: 180757 - DNA, 103 bp, Artificial Sequence
  Synthetic Polynucleotide
taatacgactcactatagggagtgactcatgtcctcctcctcctcctcttaacagaggagaaagaggatgaggaggaggaacctggcggcagcgcaaaagatg

SEQ ID NO: 180758 - DNA, 103 bp, Artificial Sequence
  Synthetic Polynucleotide
taatacgactcactataggggttttggcagcgcctacgctgcccgccgtcaacagaggagagacggcatgcagcgtaggaacctggcggcagcgcaaaagatg

SEQ ID NO: 180759 - DNA, 103 bp, Artificial Sequence
  Synthetic Polynucleotide
taatacgactcactatagggctcaacgagaagtgactcatgtcctcctccaacagaggagaggaggaatgcatgagtcaaacctggcggcagcgcaaaagatg

SEQ ID NO: 180760 - DNA, 103 bp, Artificial Sequence
  Synthetic Polynucleotide
taatacgactcactatagggtccctccagcctcaacgagaagtgactcataacagaggagaatgagtatgttctcgttgaacctggcggcagcgcaaaagatg

SEQ ID NO: 180761 - DNA, 103 bp, Artificial Sequence
  Synthetic Polynucleotide
taatacgactcactatagggcctgccggcctccctccagcctcaacgagaaacagaggagatctcgtatgggctggaggaacctggcggcagcgcaaaagatg

SEQ ID NO: 180762 - DNA, 103 bp, Artificial Sequence
  Synthetic Polynucleotide
taatacgactcactatagggtcctccgagtcctgccggcctccctccagcaacagaggagagctggaatgaggccggcaaacctggcggcagcgcaaaagatg

SEQ ID NO: 180763 - DNA, 103 bp, Artificial Sequence
  Synthetic Polynucleotide
taatacgactcactatagggctcctcctcgtcctccgagtcctgccggccaacagaggagaggccggatggactcggagaacctggcggcagcgcaaaagatg

SEQ ID NO: 180764 - DNA, 103 bp, Artificial Sequence
  Synthetic Polynucleotide
taatacgactcactatagggtaatcaggcgctcctcctcgtcctccgagtaacagaggagaactcggatgacgaggaggaacctggcggcagcgcaaaagatg

SEQ ID NO: 180765 - DNA, 103 bp, Artificial Sequence
  Synthetic Polynucleotide
taatacgactcactatagggtcagagagattaatcaggcgctcctcctcgaacagaggagacgaggaatggcgcctgataacctggcggcagcgcaaaagatg

SEQ ID NO: 180766 - DNA, 103 bp, Artificial Sequence
  Synthetic Polynucleotide
taatacgactcactatagggtggggtcagctcagagagattaatcaggcgaacagaggagacgcctgatgaatctctctaacctggcggcagcgcaaaagatg

SEQ ID NO: 180767 - DNA, 103 bp, Artificial Sequence
  Synthetic Polynucleotide
taatacgactcactatagggacaagatgtatggggtcagctcagagagataacagaggagaatctctatgagctgacccaacctggcggcagcgcaaaagatg

SEQ ID NO: 180768 - DNA, 103 bp, Artificial Sequence
  Synthetic Polynucleotide
taatacgactcactatagggcaaatggaacacaagatgtatggggtcagcaacagaggagagctgacatgatacatcttaacctggcggcagcgcaaaagatg

SEQ ID NO: 180769 - DNA, 103 bp, Artificial Sequence
  Synthetic Polynucleotide
taatacgactcactatagggagctccctcggttttggcagcgcctacgctaacagaggagaagcgtaatggctgccaaaaacctggcggcagcgcaaaagatg

SEQ ID NO: 180770 - DNA, 103 bp, Artificial Sequence
  Synthetic Polynucleotide
taatacgactcactataggggtaacctttgcaaatggaacacaagatgtaaacagaggagatacatcatgtgttccattaacctggcggcagcgcaaaagatg

SEQ ID NO: 180771 - DNA, 103 bp, Artificial Sequence
  Synthetic Polynucleotide
taatacgactcactatagggcatctattaagtaacctttgcaaatggaacaacagaggagagttccaatggcaaaggttaacctggcggcagcgcaaaagatg

SEQ ID NO: 180772 - DNA, 103 bp, Artificial Sequence
  Synthetic Polynucleotide
taatacgactcactatagggatggtagttgcatctattaagtaacctttgaacagaggagacaaaggatgcttaatagaaacctggcggcagcgcaaaagatg

SEQ ID NO: 180773 - DNA, 103 bp, Artificial Sequence
  Synthetic Polynucleotide
taatacgactcactatagggacattctgtgatggtagttgcatctattaaaacagaggagattaataatggcaactaccaacctggcggcagcgcaaaagatg

SEQ ID NO: 180774 - DNA, 103 bp, Artificial Sequence
  Synthetic Polynucleotide
taatacgactcactatagggaggtatgaagacattctgtgatggtagttgaacagaggagacaactaatgtcacagaataacctggcggcagcgcaaaagatg

SEQ ID NO: 180775 - DNA, 103 bp, Artificial Sequence
  Synthetic Polynucleotide
taatacgactcactatagggcttttacaaaaggtatgaagacattctgtgaacagaggagacacagaatgtcttcatacaacctggcggcagcgcaaaagatg

SEQ ID NO: 180776 - DNA, 103 bp, Artificial Sequence
  Synthetic Polynucleotide
taatacgactcactatagggtacgatgcagcttttacaaaaggtatgaagaacagaggagacttcatatgttttgtaaaaacctggcggcagcgcaaaagatg

SEQ ID NO: 180777 - DNA, 103 bp, Artificial Sequence
  Synthetic Polynucleotide
taatacgactcactatagggaaaaatgtcttacgatgcagcttttacaaaaacagaggagatttgtaatggctgcatcgaacctggcggcagcgcaaaagatg

SEQ ID NO: 180778 - DNA, 103 bp, Artificial Sequence
  Synthetic Polynucleotide
taatacgactcactatagggttgctgtagtaaaaatgtcttacgatgcagaacagaggagactgcatatgaagacatttaacctggcggcagcgcaaaagatg

SEQ ID NO: 180779 - DNA, 103 bp, Artificial Sequence
  Synthetic Polynucleotide
taatacgactcactatagggtggacatctgttgctgtagtaaaaatgtctaacagaggagaagacatatgtactacagcaacctggcggcagcgcaaaagatg

SEQ ID NO: 180780 - DNA, 103 bp, Artificial Sequence
  Synthetic Polynucleotide
taatacgactcactataggggcaaggctgcagctccctcggttttggcagaacagaggagactgccaatgccgagggagaacctggcggcagcgcaaaagatg

SEQ ID NO: 180781 - DNA, 103 bp, Artificial Sequence
  Synthetic Polynucleotide
taatacgactcactatagggtattgcattttggacatctgttgctgtagtaacagaggagaactacaatgacagatgtcaacctggcggcagcgcaaaagatg

SEQ ID NO: 180782 - DNA, 103 bp, Artificial Sequence
  Synthetic Polynucleotide
taatacgactcactatagggtgtactactatattgcattttggacatctgaacagaggagacagatgatgaaaatgcaaaacctggcggcagcgcaaaagatg

SEQ ID NO: 180783 - DNA, 103 bp, Artificial Sequence
  Synthetic Polynucleotide
taatacgactcactatagggttgtgtctgatgtactactatattgcatttaacagaggagaaaatgcatgatagtagtaaacctggcggcagcgcaaaagatg

SEQ ID NO: 180784 - DNA, 103 bp, Artificial Sequence
  Synthetic Polynucleotide
taatacgactcactatagggtataaagaggttgtgtctgatgtactactaaacagaggagatagtagatgatcagacacaacctggcggcagcgcaaaagatg

SEQ ID NO: 180785 - DNA, 103 bp, Artificial Sequence
  Synthetic Polynucleotide
taatacgactcactataggggcacttatgttataaagaggttgtgtctgaaacagaggagatcagacatgacctctttaaacctggcggcagcgcaaaagatg

SEQ ID NO: 180786 - DNA, 103 bp, Artificial Sequence
  Synthetic Polynucleotide
taatacgactcactataggggccttcattagcacttatgttataaagaggaacagaggagacctcttatgaacataagtaacctggcggcagcgcaaaagatg

SEQ ID NO: 180787 - DNA, 103 bp, Artificial Sequence
  Synthetic Polynucleotide
taatacgactcactatagggaatgtcccgtgccttcattagcacttatgtaacagaggagaacataaatgctaatgaagaacctggcggcagcgcaaaagatg

SEQ ID NO: 180788 - DNA, 103 bp, Artificial Sequence
  Synthetic Polynucleotide
taatacgactcactatagggaatggcttaaaatgtcccgtgccttcattaaacagaggagataatgaatgcacgggacaaacctggcggcagcgcaaaagatg

SEQ ID NO: 180789 - DNA, 103 bp, Artificial Sequence
  Synthetic Polynucleotide
taatacgactcactatagggcttcttttccaatggcttaaaatgtcccgtaacagaggagaacgggaatgtttaagccaaacctggcggcagcgcaaaagatg

SEQ ID NO: 180790 - DNA, 103 bp, Artificial Sequence
  Synthetic Polynucleotide
taatacgactcactatagggctcgaacaaacttcttttccaatggcttaaaacagaggagattaagcatgtggaaaagaaacctggcggcagcgcaaaagatg

SEQ ID NO: 180791 - DNA, 103 bp, Artificial Sequence
  Synthetic Polynucleotide
taatacgactcactatagggggcggaggcggcaaggctgcagctccctcgaacagaggagacgagggatgtgcagccttaacctggcggcagcgcaaaagatg

SEQ ID NO: 180792 - DNA, 103 bp, Artificial Sequence
  Synthetic Polynucleotide
taatacgactcactatagggtctcctgaaactcgaacaaacttcttttccaacagaggagaggaaaaatggtttgttcgaacctggcggcagcgcaaaagatg

SEQ ID NO: 180793 - DNA, 103 bp, Artificial Sequence
  Synthetic Polynucleotide
taatacgactcactatagggaatagttgcttctcctgaaactcgaacaaaaacagaggagatttgttatggtttcaggaaacctggcggcagcgcaaaagatg

SEQ ID NO: 180794 - DNA, 103 bp, Artificial Sequence
  Synthetic Polynucleotide
taatacgactcactatagggctacatgtccaatagttgcttctcctgaaaaacagaggagatttcagatgaagcaactaaacctggcggcagcgcaaaagatg

SEQ ID NO: 180795 - DNA, 103 bp, Artificial Sequence
  Synthetic Polynucleotide
taatacgactcactatagggaggaatttttctacatgtccaatagttgctaacagaggagaagcaacatgtggacatgtaacctggcggcagcgcaaaagatg

SEQ ID NO: 180796 - DNA, 103 bp, Artificial Sequence
  Synthetic Polynucleotide
taatacgactcactatagggttttcttctgaggaatttttctacatgtccaacagaggagaggacatatggaaaaattcaacctggcggcagcgcaaaagatg

SEQ ID NO: 180797 - DNA, 103 bp, Artificial Sequence
  Synthetic Polynucleotide
taatacgactcactatagggcaagacccatttttcttctgaggaatttttaacagaggagaaaaaatatgtcagaagaaaacctggcggcagcgcaaaagatg

SEQ ID NO: 180798 - DNA, 103 bp, Artificial Sequence
  Synthetic Polynucleotide
taatacgactcactatagggcaagctggatcaagacccatttttcttctgaacagaggagacagaagatgaatgggtctaacctggcggcagcgcaaaagatg

SEQ ID NO: 180799 - DNA, 103 bp, Artificial Sequence
  Synthetic Polynucleotide
taatacgactcactatagggatctacctgacaagctggatcaagacccataacagaggagaatgggtatggatccagctaacctggcggcagcgcaaaagatg

SEQ ID NO: 180800 - DNA, 103 bp, Artificial Sequence
  Synthetic Polynucleotide
taatacgactcactatagggcacagattatatctacctgacaagctggataacagaggagaatccagatggtcaggtagaacctggcggcagcgcaaaagatg

SEQ ID NO: 180801 - DNA, 103 bp, Artificial Sequence
  Synthetic Polynucleotide
taatacgactcactatagggaggtgatcaccacagattatatctacctgaaacagaggagatcaggtatgtataatctgaacctggcggcagcgcaaaagatg

SEQ ID NO: 180802 - DNA, 103 bp, Artificial Sequence
  Synthetic Polynucleotide
taatacgactcactatagggggagacaggaggcggaggcggcaaggctgcaacagaggagagcagccatgccgcctccgaacctggcggcagcgcaaaagatg

SEQ ID NO: 180803 - DNA, 103 bp, Artificial Sequence
  Synthetic Polynucleotide
taatacgactcactatagggctgctccaacaggtgatcaccacagattataacagaggagaataatcatgggtgatcacaacctggcggcagcgcaaaagatg

SEQ ID NO: 180804 - DNA, 103 bp, Artificial Sequence
  Synthetic Polynucleotide
taatacgactcactataggggagtttgatactgctccaacaggtgatcacaacagaggagagtgatcatgtgttggagcaacctggcggcagcgcaaaagatg

SEQ ID NO: 180805 - DNA, 103 bp, Artificial Sequence
  Synthetic Polynucleotide
taatacgactcactatagggatttcccttagagtttgatactgctccaacaacagaggagagttggaatggtatcaaacaacctggcggcagcgcaaaagatg

SEQ ID NO: 180806 - DNA, 103 bp, Artificial Sequence
  Synthetic Polynucleotide
taatacgactcactatagggtgcacgtcggatttcccttagagtttgataaacagaggagatatcaaatgctaagggaaaacctggcggcagcgcaaaagatg

SEQ ID NO: 180807 - DNA, 103 bp, Artificial Sequence
  Synthetic Polynucleotide
taatacgactcactatagggcatcacctattgcacgtcggatttcccttaaacagaggagataagggatgtccgacgtgaacctggcggcagcgcaaaagatg

SEQ ID NO: 180808 - DNA, 103 bp, Artificial Sequence
  Synthetic Polynucleotide
taatacgactcactatagggtgcattgctgcatcacctattgcacgtcggaacagaggagaccgacgatgaataggtgaaacctggcggcagcgcaaaagatg

SEQ ID NO: 180809 - DNA, 103 bp, Artificial Sequence
  Synthetic Polynucleotide
taatacgactcactatagggcagaccatcctgcattgctgcatcacctataacagaggagaataggtatggcagcaatgaacctggcggcagcgcaaaagatg

SEQ ID NO: 180810 - DNA, 103 bp, Artificial Sequence
  Synthetic Polynucleotide
taatacgactcactataggggaaggacaagcagaccatcctgcattgctgaacagaggagacagcaaatgaggatggtcaacctggcggcagcgcaaaagatg

SEQ ID NO: 180811 - DNA, 103 bp, Artificial Sequence
  Synthetic Polynucleotide
taatacgactcactatagggagaccataatgaaggacaagcagaccatccaacagaggagaggatggatggcttgtcctaacctggcggcagcgcaaaagatg

SEQ ID NO: 180812 - DNA, 103 bp, Artificial Sequence
  Synthetic Polynucleotide
taatacgactcactatagggagaaaccacaagaccataatgaaggacaagaacagaggagacttgtcatgcattatggtaacctggcggcagcgcaaaagatg

SEQ ID NO: 180813 - DNA, 103 bp, Artificial Sequence
  Synthetic Polynucleotide
taatacgactcactataggggggcgggcggggagacaggaggcggaggcgaacagaggagacgcctcatgctcctgtctaacctggcggcagcgcaaaagatg

SEQ ID NO: 180814 - DNA, 103 bp, Artificial Sequence
  Synthetic Polynucleotide
taatacgactcactatagggtcttcagaggagaaaccacaagaccataataacagaggagaattatgatgttgtggtttaacctggcggcagcgcaaaagatg

SEQ ID NO: 180815 - DNA, 103 bp, Artificial Sequence
  Synthetic Polynucleotide
taatacgactcactataggggcaggggtgagggcgggcggggagacaggaaacagaggagatcctgtatgcccgcccgcaacctggcggcagcgcaaaagatg

SEQ ID NO: 180816 - DNA, 103 bp, Artificial Sequence
  Synthetic Polynucleotide
taatacgactcactatagggggccgcgtagtactgctcctcgccgttcataacagaggagaatgaacatggaggagcagaacctggcggcagcgcaaaagatg

SEQ ID NO: 180817 - DNA, 103 bp, Artificial Sequence
  Synthetic Polynucleotide
taatacgactcactataggggcggcccatgtacaggcacgcaggggggctaacagaggagaagccccatggcgtgcctgaacctggcggcagcgcaaaagatg

SEQ ID NO: 180818 - DNA, 103 bp, Artificial Sequence
  Synthetic Polynucleotide
taatacgactcactataggggcgggggctggcggcccatgtacaggcacgaacagaggagacgtgccatgacatgggccaacctggcggcagcgcaaaagatg

SEQ ID NO: 180819 - DNA, 103 bp, Artificial Sequence
  Synthetic Polynucleotide
taatacgactcactatagggggcggcggcggcgggggctggcggcccatgaacagaggagacatgggatgccagcccccaacctggcggcagcgcaaaagatg

SEQ ID NO: 180820 - DNA, 103 bp, Artificial Sequence
  Synthetic Polynucleotide
taatacgactcactataggggaacgggtgcggcggcggcggcgggggctgaacagaggagacagcccatgccgccgccgaacctggcggcagcgcaaaagatg

SEQ ID NO: 180821 - DNA, 103 bp, Artificial Sequence
  Synthetic Polynucleotide
taatacgactcactataggggggcgccagggaacgggtgcggcggcggcgaacagaggagacgccgcatgcgcacccgtaacctggcggcagcgcaaaagatg

SEQ ID NO: 180822 - DNA, 103 bp, Artificial Sequence
  Synthetic Polynucleotide
taatacgactcactatagggagcgcgcccagggcgccagggaacgggtgcaacagaggagagcacccatgccctggcgcaacctggcggcagcgcaaaagatg

SEQ ID NO: 180823 - DNA, 103 bp, Artificial Sequence
  Synthetic Polynucleotide
taatacgactcactataggggccctgctccagcgcgcccagggcgccaggaacagaggagacctggcatgctgggcgcgaacctggcggcagcgcaaaagatg

SEQ ID NO: 180824 - DNA, 103 bp, Artificial Sequence
  Synthetic Polynucleotide
taatacgactcactatagggccggggggctgccctgctccagcgcgcccaaacagaggagatgggcgatgtggagcaggaacctggcggcagcgcaaaagatg

SEQ ID NO: 180825 - DNA, 103 bp, Artificial Sequence
  Synthetic Polynucleotide
taatacgactcactatagggggggagatgtccggggggctgccctgctccaacagaggagaggagcaatgcagccccccaacctggcggcagcgcaaaagatg

SEQ ID NO: 180826 - DNA, 103 bp, Artificial Sequence
  Synthetic Polynucleotide
taatacgactcactatagggcacctcgtacggggagatgtccggggggctaacagaggagaagccccatggacatctccaacctggcggcagcgcaaaagatg

SEQ ID NO: 180827 - DNA, 103 bp, Artificial Sequence
  Synthetic Polynucleotide
taatacgactcactatagggaaagctgcgtggccgcgtagtactgctcctaacagaggagaaggagcatgactacgcggaacctggcggcagcgcaaaagatg

SEQ ID NO: 180828 - DNA, 103 bp, Artificial Sequence
  Synthetic Polynucleotide
taatacgactcactatagggcgagggggggcacctcgtacggggagatgtaacagaggagaacatctatgcgtacgaggaacctggcggcagcgcaaaagatg

SEQ ID NO: 180829 - DNA, 103 bp, Artificial Sequence
  Synthetic Polynucleotide
taatacgactcactataggggggtcgtcggcgagggggggcacctcgtacaacagaggagagtacgaatggccccccctaacctggcggcagcgcaaaagatg

SEQ ID NO: 180830 - DNA, 103 bp, Artificial Sequence
  Synthetic Polynucleotide
taatacgactcactatagggcgccaccgcggggtcgtcggcgagggggggaacagaggagaccccccatggccgacgacaacctggcggcagcgcaaaagatg

SEQ ID NO: 180831 - DNA, 103 bp, Artificial Sequence
  Synthetic Polynucleotide
taatacgactcactatagggggtgaaggtgcgccaccgcggggtcgtcggaacagaggagaccgacgatgccgcggtggaacctggcggcagcgcaaaagatg

SEQ ID NO: 180832 - DNA, 103 bp, Artificial Sequence
  Synthetic Polynucleotide
taatacgactcactataggggggaggtggtggtgaaggtgcgccaccgcgaacagaggagacgcggtatggcaccttcaaacctggcggcagcgcaaaagatg

SEQ ID NO: 180833 - DNA, 103 bp, Artificial Sequence
  Synthetic Polynucleotide
taatacgactcactataggggagctgagccgggaggtggtggtgaaggtgaacagaggagacaccttatgcaccacctcaacctggcggcagcgcaaaagatg

SEQ ID NO: 180834 - DNA, 103 bp, Artificial Sequence
  Synthetic Polynucleotide
taatacgactcactataggggggggagcgcgagctgagccgggaggtggtaacagaggagaaccaccatgcggctcagcaacctggcggcagcgcaaaagatg

SEQ ID NO: 180835 - DNA, 103 bp, Artificial Sequence
  Synthetic Polynucleotide
taatacgactcactataggggcgggcgggtgggggagcgcgagctgagccaacagaggagaggctcaatgcgcgctcccaacctggcggcagcgcaaaagatg

SEQ ID NO: 180836 - DNA, 103 bp, Artificial Sequence
  Synthetic Polynucleotide
taatacgactcactataggggaagggcccggcgggcgggtgggggagcgcaacagaggagagcgctcatgcacccgcccaacctggcggcagcgcaaaagatg

SEQ ID NO: 180837 - DNA, 103 bp, Artificial Sequence
  Synthetic Polynucleotide
taatacgactcactatagggctccctccgggaagggcccggcgggcgggtaacagaggagaacccgcatgccgggccctaacctggcggcagcgcaaaagatg

SEQ ID NO: 180838 - DNA, 103 bp, Artificial Sequence
  Synthetic Polynucleotide
taatacgactcactataggggggtccttgtaaagctgcgtggccgcgtagaacagaggagactacgcatgcacgcagctaacctggcggcagcgcaaaagatg

SEQ ID NO: 180839 - DNA, 103 bp, Artificial Sequence
  Synthetic Polynucleotide
taatacgactcactatagggcccggctcggctccctccgggaagggcccgaacagaggagacgggccatgcccggagggaacctggcggcagcgcaaaagatg

SEQ ID NO: 180840 - DNA, 103 bp, Artificial Sequence
  Synthetic Polynucleotide
taatacgactcactatagggctccaggacgcccggctcggctccctccggaacagaggagaccggagatggccgagccgaacctggcggcagcgcaaaagatg

SEQ ID NO: 180841 - DNA, 103 bp, Artificial Sequence
  Synthetic Polynucleotide
taatacgactcactatagggggttgggctcctccaggacgcccggctcggaacagaggagaccgagcatggcgtcctggaacctggcggcagcgcaaaagatg

SEQ ID NO: 180842 - DNA, 103 bp, Artificial Sequence
  Synthetic Polynucleotide
taatacgactcactatagggagctggacgcggttgggctcctccaggacgaacagaggagacgtcctatgggagcccaaaacctggcggcagcgcaaaagatg

SEQ ID NO: 180843 - DNA, 103 bp, Artificial Sequence
  Synthetic Polynucleotide
taatacgactcactatagggtgggaaaggcagctggacgcggttgggctcaacagaggagagagcccatgcgcgtccagaacctggcggcagcgcaaaagatg

SEQ ID NO: 180844 - DNA, 103 bp, Artificial Sequence
  Synthetic Polynucleotide
taatacgactcactatagggacttcatccatgggaaaggcagctggacgcaacagaggagagcgtccatgtgcctttccaacctggcggcagcgcaaaagatg

SEQ ID NO: 180845 - DNA, 103 bp, Artificial Sequence
  Synthetic Polynucleotide
taatacgactcactataggggctttggtagacttcatccatgggaaaggcaacagaggagagcctttatgatggatgaaaacctggcggcagcgcaaaagatg

SEQ ID NO: 180846 - DNA, 103 bp, Artificial Sequence
  Synthetic Polynucleotide
taatacgactcactatagggccacgcgtgagctttggtagacttcatccaaacagaggagatggatgatgtctaccaaaaacctggcggcagcgcaaaagatg

SEQ ID NO: 180847 - DNA, 103 bp, Artificial Sequence
  Synthetic Polynucleotide
taatacgactcactatagggactggcctttccacgcgtgagctttggtagaacagaggagactaccaatgctcacgcgtaacctggcggcagcgcaaaagatg

SEQ ID NO: 180848 - DNA, 103 bp, Artificial Sequence
  Synthetic Polynucleotide
taatacgactcactatagggccgcctgcccactggcctttccacgcgtgaaacagaggagatcacgcatggaaaggccaaacctggcggcagcgcaaaagatg

SEQ ID NO: 180849 - DNA, 103 bp, Artificial Sequence
  Synthetic Polynucleotide
taatacgactcactataggggaacgcgcatgggtccttgtaaagctgcgtaacagaggagaacgcagatgtacaaggacaacctggcggcagcgcaaaagatg

SEQ ID NO: 180850 - DNA, 103 bp, Artificial Sequence
  Synthetic Polynucleotide
taatacgactcactatagggagcgtaggcgccgcctgcccactggcctttaacagaggagaaaaggcatgtgggcaggcaacctggcggcagcgcaaaagatg

SEQ ID NO: 180851 - DNA, 103 bp, Artificial Sequence
  Synthetic Polynucleotide
taatacgactcactatagggccggctccgcagcgtaggcgccgcctgcccaacagaggagagggcagatggcgcctacgaacctggcggcagcgcaaaagatg

SEQ ID NO: 180852 - DNA, 103 bp, Artificial Sequence
  Synthetic Polynucleotide
taatacgactcactatagggttgttctcctccggctccgcagcgtaggcgaacagaggagacgcctaatgtgcggagccaacctggcggcagcgcaaaagatg

SEQ ID NO: 180853 - DNA, 103 bp, Artificial Sequence
  Synthetic Polynucleotide
taatacgactcactataggggcgcgtccgcttgttctcctccggctccgcaacagaggagagcggagatggaggagaacaacctggcggcagcgcaaaagatg

SEQ ID NO: 180854 - DNA, 103 bp, Artificial Sequence
  Synthetic Polynucleotide
taatacgactcactatagggtgtaggccgtgcgcgtccgcttgttctcctaacagaggagaaggagaatgagcggacgcaacctggcggcagcgcaaaagatg

SEQ ID NO: 180855 - DNA, 103 bp, Artificial Sequence
  Synthetic Polynucleotide
taatacgactcactatagggtgtgcgcgcgtgtaggccgtgcgcgtccgcaacagaggagagcggacatgcacggcctaaacctggcggcagcgcaaaagatg

SEQ ID NO: 180856 - DNA, 103 bp, Artificial Sequence
  Synthetic Polynucleotide
taatacgactcactatagggctctagcagctgtgcgcgcgtgtaggccgtaacagaggagaacggccatgacgcgcgcaaacctggcggcagcgcaaaagatg

SEQ ID NO: 180857 - DNA, 103 bp, Artificial Sequence
  Synthetic Polynucleotide
taatacgactcactatagggccttctccagctctagcagctgtgcgcgcgaacagaggagacgcgcgatgagctgctagaacctggcggcagcgcaaaagatg

SEQ ID NO: 180858 - DNA, 103 bp, Artificial Sequence
  Synthetic Polynucleotide
taatacgactcactatagggaataggaactccttctccagctctagcagcaacagaggagagctgctatggctggagaaaacctggcggcagcgcaaaagatg

SEQ ID NO: 180859 - DNA, 103 bp, Artificial Sequence
  Synthetic Polynucleotide
taatacgactcactataggggtacttgttgaataggaactccttctccagaacagaggagactggagatggagttcctaaacctggcggcagcgcaaaagatg

SEQ ID NO: 180860 - DNA, 103 bp, Artificial Sequence
  Synthetic Polynucleotide
taatacgactcactatagggggcctcgctggaacgcgcatgggtccttgtaacagaggagaacaaggatgcatgcgcgtaacctggcggcagcgcaaaagatg

SEQ ID NO: 180861 - DNA, 103 bp, Artificial Sequence
  Synthetic Polynucleotide
taatacgactcactataggggccgtgagatgtacttgttgaataggaactaacagaggagaagttccatgtcaacaagtaacctggcggcagcgcaaaagatg

SEQ ID NO: 180862 - DNA, 103 bp, Artificial Sequence
  Synthetic Polynucleotide
taatacgactcactatagggacccggcgcggccgtgagatgtacttgttgaacagaggagacaacaaatgcatctcacgaacctggcggcagcgcaaaagatg

SEQ ID NO: 180863 - DNA, 103 bp, Artificial Sequence
  Synthetic Polynucleotide
taatacgactcactatagggagccagctccacccggcgcggccgtgagataacagaggagaatctcaatgccgcgccggaacctggcggcagcgcaaaagatg

SEQ ID NO: 180864 - DNA, 103 bp, Artificial Sequence
  Synthetic Polynucleotide
taatacgactcactatagggtcaacatgacagccagctccacccggcgcgaacagaggagacgcgccatgtggagctggaacctggcggcagcgcaaaagatg

SEQ ID NO: 180865 - DNA, 103 bp, Artificial Sequence
  Synthetic Polynucleotide
taatacgactcactatagggtcggtcaagttcaacatgacagccagctccaacagaggagaggagctatgtgtcatgttaacctggcggcagcgcaaaagatg

SEQ ID NO: 180866 - DNA, 103 bp, Artificial Sequence
  Synthetic Polynucleotide
taatacgactcactataggggatgtgtctctcggtcaagttcaacatgacaacagaggagagtcatgatgaacttgaccaacctggcggcagcgcaaaagatg

SEQ ID NO: 180867 - DNA, 103 bp, Artificial Sequence
  Synthetic Polynucleotide
taatacgactcactatagggaccagatcttgatgtgtctctcggtcaagtaacagaggagaacttgaatgagagacacaaacctggcggcagcgcaaaagatg

SEQ ID NO: 180868 - DNA, 103 bp, Artificial Sequence
  Synthetic Polynucleotide
taatacgactcactatagggcggttttggaaccagatcttgatgtgtctcaacagaggagagagacaatgcaagatctgaacctggcggcagcgcaaaagatg

SEQ ID NO: 180869 - DNA, 103 bp, Artificial Sequence
  Synthetic Polynucleotide
taatacgactcactatagggcttcatgcggcggttttggaaccagatcttaacagaggagaaagatcatgttccaaaacaacctggcggcagcgcaaaagatg

SEQ ID NO: 180870 - DNA, 103 bp, Artificial Sequence
  Synthetic Polynucleotide
taatacgactcactatagggcctttttccacttcatgcggcggttttggaaacagaggagatccaaaatggccgcatgaaacctggcggcagcgcaaaagatg

SEQ ID NO: 180871 - DNA, 103 bp, Artificial Sequence
  Synthetic Polynucleotide
taatacgactcactatagggtccggcgccgggcctcgctggaacgcgcataacagaggagaatgcgcatgccagcgaggaacctggcggcagcgcaaaagatg

SEQ ID NO: 180872 - DNA, 103 bp, Artificial Sequence
  Synthetic Polynucleotide
taatacgactcactatagggttgtcctcctcctttttccacttcatgcggaacagaggagaccgcatatggtggaaaaaaacctggcggcagcgcaaaagatg

SEQ ID NO: 180873 - DNA, 103 bp, Artificial Sequence
  Synthetic Polynucleotide
taatacgactcactataggggccgcgcttcttgtcctcctcctttttccaaacagaggagatggaaaatggaggaggacaacctggcggcagcgcaaaagatg

SEQ ID NO: 180874 - DNA, 103 bp, Artificial Sequence
  Synthetic Polynucleotide
taatacgactcactatagggctgtcccgccgccgcgcttcttgtcctcctaacagaggagaaggaggatgagaagcgcgaacctggcggcagcgcaaaagatg

SEQ ID NO: 180875 - DNA, 103 bp, Artificial Sequence
  Synthetic Polynucleotide
taatacgactcactatagggcccccgacagctgtcccgccgccgcgcttcaacagaggagagaagcgatgcggcgggacaacctggcggcagcgcaaaagatg

SEQ ID NO: 180876 - DNA, 103 bp, Artificial Sequence
  Synthetic Polynucleotide
taatacgactcactataggggaccccgccacccccgacagctgtcccgccaacagaggagaggcgggatggctgtcgggaacctggcggcagcgcaaaagatg

SEQ ID NO: 180877 - DNA, 103 bp, Artificial Sequence
  Synthetic Polynucleotide
taatacgactcactatagggcaggctccgcgaccccgccacccccgacagaacagaggagactgtcgatggtggcggggaacctggcggcagcgcaaaagatg

SEQ ID NO: 180878 - DNA, 103 bp, Artificial Sequence
  Synthetic Polynucleotide
taatacgactcactatagggcagtcctgctcaggctccgcgaccccgccaaacagaggagatggcggatgcgcggagccaacctggcggcagcgcaaaagatg

SEQ ID NO: 180879 - DNA, 103 bp, Artificial Sequence
  Synthetic Polynucleotide
taatacgactcactatagggggtcacggcgcagtcctgctcaggctccgcaacagaggagagcggagatggagcaggacaacctggcggcagcgcaaaagatg

SEQ ID NO: 180880 - DNA, 103 bp, Artificial Sequence
  Synthetic Polynucleotide
taatacgactcactatagggcctcgccggaggtcacggcgcagtcctgctaacagaggagaagcaggatggcgccgtgaaacctggcggcagcgcaaaagatg

SEQ ID NO: 180881 - DNA, 103 bp, Artificial Sequence
  Synthetic Polynucleotide
taatacgactcactataggggccagaagctcctcgccggaggtcacggcgaacagaggagacgccgtatgctccggcgaaacctggcggcagcgcaaaagatg

SEQ ID NO: 180882 - DNA, 103 bp, Artificial Sequence
  Synthetic Polynucleotide
taatacgactcactatagggggcgctgaactccggcgccgggcctcgctgaacagaggagacagcgaatgccggcgccgaacctggcggcagcgcaaaagatg

SEQ ID NO: 180883 - DNA, 103 bp, Artificial Sequence
  Synthetic Polynucleotide
taatacgactcactatagggcggcggcagcgccagaagctcctcgccggaaacagaggagatccggcatggagcttctgaacctggcggcagcgcaaaagatg

SEQ ID NO: 180884 - DNA, 103 bp, Artificial Sequence
  Synthetic Polynucleotide
taatacgactcactatagggggggcggcggcggcggcagcgccagaagctaacagaggagaagcttcatgcgctgccgcaacctggcggcagcgcaaaagatg

SEQ ID NO: 180885 - DNA, 103 bp, Artificial Sequence
  Synthetic Polynucleotide
taatacgactcactataggggcacctccggggggcggcggcggcggcagcaacagaggagagctgccatggccgccgccaacctggcggcagcgcaaaagatg

SEQ ID NO: 180886 - DNA, 103 bp, Artificial Sequence
  Synthetic Polynucleotide
taatacgactcactataggggggcggcacagcacctccggggggcggcggaacagaggagaccgccgatgcccggaggtaacctggcggcagcgcaaaagatg

SEQ ID NO: 180887 - DNA, 103 bp, Artificial Sequence
  Synthetic Polynucleotide
taatacgactcactatagggcgggggcagcgggcggcacagcacctccggaacagaggagaccggagatgctgtgccgcaacctggcggcagcgcaaaagatg

SEQ ID NO: 180888 - DNA, 103 bp, Artificial Sequence
  Synthetic Polynucleotide
taatacgactcactatagggcgggcggcaacgggggcagcgggcggcacaaacagaggagatgtgccatgcgctgccccaacctggcggcagcgcaaaagatg

SEQ ID NO: 180889 - DNA, 103 bp, Artificial Sequence
  Synthetic Polynucleotide
taatacgactcactataggggcggccctctcgggcggcaacgggggcagcaacagaggagagctgccatggttgccgccaacctggcggcagcgcaaaagatg

SEQ ID NO: 180890 - DNA, 103 bp, Artificial Sequence
  Synthetic Polynucleotide
taatacgactcactatagggcaggcggcaggcggccctctcgggcggcaaaacagaggagattgccgatggagagggccaacctggcggcagcgcaaaagatg

SEQ ID NO: 180891 - DNA, 103 bp, Artificial Sequence
  Synthetic Polynucleotide
taatacgactcactataggggcgctaaggccaggcggcaggcggccctctaacagaggagaagagggatgcctgccgccaacctggcggcagcgcaaaagatg

SEQ ID NO: 180892 - DNA, 103 bp, Artificial Sequence
  Synthetic Polynucleotide
taatacgactcactatagggctgtggcgacgcgctaaggccaggcggcagaacagaggagactgccgatgggccttagcaacctggcggcagcgcaaaagatg

SEQ ID NO: 180893 - DNA, 103 bp, Artificial Sequence
  Synthetic Polynucleotide
taatacgactcactatagggcaggggggctggcgctgaactccggcgccgaacagaggagacggcgcatgagttcagcgaacctggcggcagcgcaaaagatg

SEQ ID NO: 180894 - DNA, 103 bp, Artificial Sequence
  Synthetic Polynucleotide
taatacgactcactatagggcgctggagggctgtggcgacgcgctaaggcaacagaggagagccttaatgcgtcgccacaacctggcggcagcgcaaaagatg

SEQ ID NO: 180895 - DNA, 103 bp, Artificial Sequence
  Synthetic Polynucleotide
taatacgactcactatagggcgaggcgcgacgctggagggctgtggcgacaacagaggagagtcgccatggccctccagaacctggcggcagcgcaaaagatg

SEQ ID NO: 180896 - DNA, 103 bp, Artificial Sequence
  Synthetic Polynucleotide
taatacgactcactatagggctgcggccgccgaggcgcgacgctggagggaacagaggagaccctccatggtcgcgcctaacctggcggcagcgcaaaagatg

SEQ ID NO: 180897 - DNA, 103 bp, Artificial Sequence
  Synthetic Polynucleotide
taatacgactcactatagggatcgtggttcctgcggccgccgaggcgcgaaacagaggagatcgcgcatgggcggccgcaacctggcggcagcgcaaaagatg

SEQ ID NO: 180898 - DNA, 103 bp, Artificial Sequence
  Synthetic Polynucleotide
taatacgactcactatagggtacaggcacgcaggggggctggcgctgaacaacagaggagagttcagatgcagccccccaacctggcggcagcgcaaaagatg

SEQ ID NO: 180899 - DNA, 103 bp, Artificial Sequence
  Synthetic Polynucleotide
taatacgactcactatagggcccatcagccccttctagggggccactcataacagaggagaatgagtatgcccctagaaaacctggcggcagcgcaaaagatg

SEQ ID NO: 180900 - DNA, 103 bp, Artificial Sequence
  Synthetic Polynucleotide
taatacgactcactataggggctggggcctgggcaaggccggtgctgtggaacagaggagaccacagatgcggccttgcaacctggcggcagcgcaaaagatg

SEQ ID NO: 180901 - DNA, 103 bp, Artificial Sequence
  Synthetic Polynucleotide
taatacgactcactatagggaatcagcaggcagcacggctgtgcaggggcaacagaggagagcccctatgcagccgtgcaacctggcggcagcgcaaaagatg

SEQ ID NO: 180902 - DNA, 103 bp, Artificial Sequence
  Synthetic Polynucleotide
taatacgactcactatagggtgcgctctgcaatcagcaggcagcacggctaacagaggagaagccgtatggcctgctgaaacctggcggcagcgcaaaagatg

SEQ ID NO: 180903 - DNA, 103 bp, Artificial Sequence
  Synthetic Polynucleotide
taatacgactcactatagggcccgaatggatgcgctctgcaatcagcaggaacagaggagacctgctatgtgcagagcgaacctggcggcagcgcaaaagatg

SEQ ID NO: 180904 - DNA, 103 bp, Artificial Sequence
  Synthetic Polynucleotide
taatacgactcactatagggagcttcgtaacccgaatggatgcgctctgcaacagaggagagcagagatgatccattcgaacctggcggcagcgcaaaagatg

SEQ ID NO: 180905 - DNA, 103 bp, Artificial Sequence
  Synthetic Polynucleotide
taatacgactcactataggggtatccggggagcttcgtaacccgaatggaaacagaggagatccattatggttacgaagaacctggcggcagcgcaaaagatg

SEQ ID NO: 180906 - DNA, 103 bp, Artificial Sequence
  Synthetic Polynucleotide
taatacgactcactatagggttgtcagggggtatccggggagcttcgtaaaacagaggagattacgaatgtccccggataacctggcggcagcgcaaaagatg

SEQ ID NO: 180907 - DNA, 103 bp, Artificial Sequence
  Synthetic Polynucleotide
taatacgactcactataggggaaaatcctcttgtcagggggtatccggggaacagaggagaccccggatgccccctgacaacctggcggcagcgcaaaagatg

SEQ ID NO: 180908 - DNA, 103 bp, Artificial Sequence
  Synthetic Polynucleotide
taatacgactcactataggggccgcgtagtgaaaatcctcttgtcaggggaacagaggagacccctgatgagaggatttaacctggcggcagcgcaaaagatg

SEQ ID NO: 180909 - DNA, 103 bp, Artificial Sequence
  Synthetic Polynucleotide
taatacgactcactatagggctgggtgtgtgccgcgtagtgaaaatcctcaacagaggagagaggatatgcactacgcgaacctggcggcagcgcaaaagatg

SEQ ID NO: 180910 - DNA, 103 bp, Artificial Sequence
  Synthetic Polynucleotide
taatacgactcactataggggaagaggcagctgggtgtgtgccgcgtagtaacagaggagaactacgatgcacacacccaacctggcggcagcgcaaaagatg

SEQ ID NO: 180911 - DNA, 103 bp, Artificial Sequence
  Synthetic Polynucleotide
taatacgactcactatagggcatcggccaggctggggcctgggcaaggccaacagaggagaggccttatgcaggccccaaacctggcggcagcgcaaaagatg

SEQ ID NO: 180912 - DNA, 103 bp, Artificial Sequence
  Synthetic Polynucleotide
taatacgactcactatagggccacatcctggaagaggcagctgggtgtgtaacagaggagaacacacatggctgcctctaacctggcggcagcgcaaaagatg

SEQ ID NO: 180913 - DNA, 103 bp, Artificial Sequence
  Synthetic Polynucleotide
taatacgactcactataggggccctttcatccacatcctggaagaggcagaacagaggagactgcctatgccaggatgtaacctggcggcagcgcaaaagatg

SEQ ID NO: 180914 - DNA, 103 bp, Artificial Sequence
  Synthetic Polynucleotide
taatacgactcactatagggcaggggggcagccctttcatccacatcctgaacagaggagacaggatatggatgaaaggaacctggcggcagcgcaaaagatg

SEQ ID NO: 180915 - DNA, 103 bp, Artificial Sequence
  Synthetic Polynucleotide
taatacgactcactatagggggtagcccagcaggggggcagccctttcataacagaggagaatgaaaatgctgccccccaacctggcggcagcgcaaaagatg

SEQ ID NO: 180916 - DNA, 103 bp, Artificial Sequence
  Synthetic Polynucleotide
taatacgactcactatagggtcctggggcaggtagcccagcaggggggcaaacagaggagatgccccatggctgggctaaacctggcggcagcgcaaaagatg

SEQ ID NO: 180917 - DNA, 103 bp, Artificial Sequence
  Synthetic Polynucleotide
taatacgactcactatagggccccaggaggtcctggggcaggtagcccagaacagaggagactgggcatgctgccccagaacctggcggcagcgcaaaagatg

SEQ ID NO: 180918 - DNA, 103 bp, Artificial Sequence
  Synthetic Polynucleotide
taatacgactcactataggggcactggggcccccaggaggtcctggggcaaacagaggagatgccccatgacctcctggaacctggcggcagcgcaaaagatg

SEQ ID NO: 180919 - DNA, 103 bp, Artificial Sequence
  Synthetic Polynucleotide
taatacgactcactatagggaggaacaggagcactggggcccccaggaggaacagaggagacctcctatgggccccagtaacctggcggcagcgcaaaagatg

SEQ ID NO: 180920 - DNA, 103 bp, Artificial Sequence
  Synthetic Polynucleotide
taatacgactcactatagggctcaggatgcaggaacaggagcactggggcaacagaggagagccccaatgctcctgttcaacctggcggcagcgcaaaagatg

SEQ ID NO: 180921 - DNA, 103 bp, Artificial Sequence
  Synthetic Polynucleotide
taatacgactcactatagggggggtcggtcctcaggatgcaggaacaggaaacagaggagatcctgtatgtgcatcctgaacctggcggcagcgcaaaagatg

SEQ ID NO: 180922 - DNA, 103 bp, Artificial Sequence
  Synthetic Polynucleotide
taatacgactcactataggggcatcggtgtcatcggccaggctggggcctaacagaggagaaggcccatgcctggccgaaacctggcggcagcgcaaaagatg

SEQ ID NO: 180923 - DNA, 103 bp, Artificial Sequence
  Synthetic Polynucleotide
taatacgactcactataggggccagcatgaggggtcggtcctcaggatgcaacagaggagagcatccatgggaccgaccaacctggcggcagcgcaaaagatg

SEQ ID NO: 180924 - DNA, 103 bp, Artificial Sequence
  Synthetic Polynucleotide
taatacgactcactatagggcttgtggatagccagcatgaggggtcggtcaacagaggagagaccgaatgctcatgctgaacctggcggcagcgcaaaagatg

SEQ ID NO: 180925 - DNA, 103 bp, Artificial Sequence
  Synthetic Polynucleotide
taatacgactcactataggggcagaatcttcttgtggatagccagcatgaaacagaggagatcatgcatgctatccacaaacctggcggcagcgcaaaagatg

SEQ ID NO: 180926 - DNA, 103 bp, Artificial Sequence
  Synthetic Polynucleotide
taatacgactcactatagggcccgccaactgcagaatcttcttgtggataaacagaggagatatccaatggaagattctaacctggcggcagcgcaaaagatg

SEQ ID NO: 180927 - DNA, 103 bp, Artificial Sequence
  Synthetic Polynucleotide
taatacgactcactatagggaaagggctggcccgccaactgcagaatcttaacagaggagaaagattatgcagttggcgaacctggcggcagcgcaaaagatg

SEQ ID NO: 180928 - DNA, 103 bp, Artificial Sequence
  Synthetic Polynucleotide
taatacgactcactataggggggagtggtcaaagggctggcccgccaactaacagaggagaagttggatggccagccctaacctggcggcagcgcaaaagatg

SEQ ID NO: 180929 - DNA, 103 bp, Artificial Sequence
  Synthetic Polynucleotide
taatacgactcactatagggaagcggataggggagtggtcaaagggctggaacagaggagaccagccatgtgaccactcaacctggcggcagcgcaaaagatg

SEQ ID NO: 180930 - DNA, 103 bp, Artificial Sequence
  Synthetic Polynucleotide
taatacgactcactataggggcgggcacagaagcggataggggagtggtcaacagaggagagaccacatgcctatccgcaacctggcggcagcgcaaaagatg

SEQ ID NO: 180931 - DNA, 103 bp, Artificial Sequence
  Synthetic Polynucleotide
taatacgactcactatagggactccccgttgcgggcacagaagcggatagaacagaggagactatccatgtctgtgcccaacctggcggcagcgcaaaagatg

SEQ ID NO: 180932 - DNA, 103 bp, Artificial Sequence
  Synthetic Polynucleotide
taatacgactcactatagggatggtgacatactccccgttgcgggcacagaacagaggagactgtgcatgcaacggggaaacctggcggcagcgcaaaagatg

SEQ ID NO: 180933 - DNA, 103 bp, Artificial Sequence
  Synthetic Polynucleotide
taatacgactcactatagggattgctgttggcatcggtgtcatcggccagaacagaggagactggccatggacaccgataacctggcggcagcgcaaaagatg

SEQ ID NO: 180934 - DNA, 103 bp, Artificial Sequence
  Synthetic Polynucleotide
taatacgactcactataggggctggtgtccatggtgacatactccccgttaacagaggagaaacgggatgtatgtcaccaacctggcggcagcgcaaaagatg

SEQ ID NO: 180935 - DNA, 103 bp, Artificial Sequence
  Synthetic Polynucleotide
taatacgactcactatagggagccagcccagctggtgtccatggtgacataacagaggagaatgtcaatgtggacaccaaacctggcggcagcgcaaaagatg

SEQ ID NO: 180936 - DNA, 103 bp, Artificial Sequence
  Synthetic Polynucleotide
taatacgactcactataggggggtgcacaaagccagcccagctggtgtccaacagaggagaggacacatgctgggctggaacctggcggcagcgcaaaagatg

SEQ ID NO: 180937 - DNA, 103 bp, Artificial Sequence
  Synthetic Polynucleotide
taatacgactcactataggggcggctccaggggtgcacaaagccagcccaaacagaggagatgggctatgtttgtgcacaacctggcggcagcgcaaaagatg

SEQ ID NO: 180938 - DNA, 103 bp, Artificial Sequence
  Synthetic Polynucleotide
taatacgactcactatagggaggctaccttgcggctccaggggtgcacaaaacagaggagattgtgcatgcctggagccaacctggcggcagcgcaaaagatg

SEQ ID NO: 180939 - DNA, 103 bp, Artificial Sequence
  Synthetic Polynucleotide
taatacgactcactatagggcccaacacgaaggctaccttgcggctccagaacagaggagactggagatgcaaggtagcaacctggcggcagcgcaaaagatg

SEQ ID NO: 180940 - DNA, 103 bp, Artificial Sequence
  Synthetic Polynucleotide
taatacgactcactatagggtttgtggcggcccaacacgaaggctaccttaacagaggagaaaggtaatgttcgtgttgaacctggcggcagcgcaaaagatg

SEQ ID NO: 180941 - DNA, 103 bp, Artificial Sequence
  Synthetic Polynucleotide
taatacgactcactatagggccgtgcgtactttgtggcggcccaacacgaaacagaggagatcgtgtatggccgccacaaacctggcggcagcgcaaaagatg

SEQ ID NO: 180942 - DNA, 103 bp, Artificial Sequence
  Synthetic Polynucleotide
taatacgactcactatagggttcaggggggccgtgcgtactttgtggcggaacagaggagaccgccaatgagtacgcacaacctggcggcagcgcaaaagatg

SEQ ID NO: 180943 - DNA, 103 bp, Artificial Sequence
  Synthetic Polynucleotide
taatacgactcactatagggcacgtcctcattcaggggggccgtgcgtacaacagaggagagtacgcatggcccccctgaacctggcggcagcgcaaaagatg

SEQ ID NO: 180944 - DNA, 103 bp, Artificial Sequence
  Synthetic Polynucleotide
taatacgactcactatagggcacttgaaccattgctgttggcatcggtgtaacagaggagaacaccgatgccaacagcaaacctggcggcagcgcaaaagatg

SEQ ID NO: 180945 - DNA, 103 bp, Artificial Sequence
  Synthetic Polynucleotide
taatacgactcactatagggggggagtgaacacgtcctcattcaggggggaacagaggagaccccccatgatgaggacgaacctggcggcagcgcaaaagatg

SEQ ID NO: 180946 - DNA, 103 bp, Artificial Sequence
  Synthetic Polynucleotide
taatacgactcactatagggctgggggccgggggagtgaacacgtcctcaaacagaggagatgaggaatggttcactccaacctggcggcagcgcaaaagatg

SEQ ID NO: 180947 - DNA, 103 bp, Artificial Sequence
  Synthetic Polynucleotide
taatacgactcactataggggggagctgggctgggggccgggggagtgaaaacagaggagattcactatgccggcccccaacctggcggcagcgcaaaagatg

SEQ ID NO: 180948 - DNA, 103 bp, Artificial Sequence
  Synthetic Polynucleotide
taatacgactcactatagggtgtccagggagggagctgggctgggggccgaacagaggagacggcccatggcccagctcaacctggcggcagcgcaaaagatg

SEQ ID NO: 180949 - DNA, 103 bp, Artificial Sequence
  Synthetic Polynucleotide
taatacgactcactatagggtggatatcagtgtccagggagggagctgggaacagaggagacccagcatgctccctggaaacctggcggcagcgcaaaagatg

SEQ ID NO: 180950 - DNA, 103 bp, Artificial Sequence
  Synthetic Polynucleotide
taatacgactcactatagggtgacagctcctggatatcagtgtccagggaaacagaggagatccctgatgactgatatcaacctggcggcagcgcaaaagatg

SEQ ID NO: 180951 - DNA, 103 bp, Artificial Sequence
  Synthetic Polynucleotide
taatacgactcactatagggggatctgctctgacagctcctggatatcagaacagaggagactgataatgaggagctgtaacctggcggcagcgcaaaagatg

SEQ ID NO: 180952 - DNA, 103 bp, Artificial Sequence
  Synthetic Polynucleotide
taatacgactcactatagggagcagccggtggatctgctctgacagctccaacagaggagaggagctatgagagcagataacctggcggcagcgcaaaagatg

SEQ ID NO: 180953 - DNA, 103 bp, Artificial Sequence
  Synthetic Polynucleotide
taatacgactcactataggggggctgcagcagcagccggtggatctgctcaacagaggagagagcagatgcaccggctgaacctggcggcagcgcaaaagatg

SEQ ID NO: 180954 - DNA, 103 bp, Artificial Sequence
  Synthetic Polynucleotide
taatacgactcactatagggggctgtggacgggctgcagcagcagccggtaacagaggagaaccggcatgtgctgcagcaacctggcggcagcgcaaaagatg

SEQ ID NO: 180955 - DNA, 103 bp, Artificial Sequence
  Synthetic Polynucleotide
taatacgactcactataggggactcattgccacttgaaccattgctgttgaacagaggagacaacagatgtggttcaagaacctggcggcagcgcaaaagatg

SEQ ID NO: 180956 - DNA, 103 bp, Artificial Sequence
  Synthetic Polynucleotide
taatacgactcactataggggtggggctggggctgtggacgggctgcagcaacagaggagagctgcaatgcgtccacagaacctggcggcagcgcaaaagatg

SEQ ID NO: 180957 - DNA, 103 bp, Artificial Sequence
  Synthetic Polynucleotide
taatacgactcactatagggacagagtcccgtggggctggggctgtggacaacagaggagagtccacatgcccagccccaacctggcggcagcgcaaaagatg

SEQ ID NO: 180958 - DNA, 103 bp, Artificial Sequence
  Synthetic Polynucleotide
taatacgactcactatagggcgccgactccacagagtcccgtggggctggaacagaggagaccagccatgcgggactctaacctggcggcagcgcaaaagatg

SEQ ID NO: 180959 - DNA, 103 bp, Artificial Sequence
  Synthetic Polynucleotide
taatacgactcactataggggatgtcacggcgccgactccacagagtcccaacagaggagagggactatgtggagtcggaacctggcggcagcgcaaaagatg

SEQ ID NO: 180960 - DNA, 103 bp, Artificial Sequence
  Synthetic Polynucleotide
taatacgactcactatagggagggcctggggatgtcacggcgccgactccaacagaggagaggagtcatggccgtgacaaacctggcggcagcgcaaaagatg

SEQ ID NO: 180961 - DNA, 103 bp, Artificial Sequence
  Synthetic Polynucleotide
taatacgactcactatagggggctgtggagagggcctggggatgtcacggaacagaggagaccgtgaatgccccaggccaacctggcggcagcgcaaaagatg

SEQ ID NO: 180962 - DNA, 103 bp, Artificial Sequence
  Synthetic Polynucleotide
taatacgactcactataggggaggacccagggctgtggagagggcctgggaacagaggagacccaggatgtctccacagaacctggcggcagcgcaaaagatg

SEQ ID NO: 180963 - DNA, 103 bp, Artificial Sequence
  Synthetic Polynucleotide
taatacgactcactataggggctatcactggaggacccagggctgtggagaacagaggagactccacatgcctgggtccaacctggcggcagcgcaaaagatg

SEQ ID NO: 180964 - DNA, 103 bp, Artificial Sequence
  Synthetic Polynucleotide
taatacgactcactatagggcacccccgttgctatcactggaggacccagaacagaggagactgggtatgccagtgataaacctggcggcagcgcaaaagatg

SEQ ID NO: 180965 - DNA, 103 bp, Artificial Sequence
  Synthetic Polynucleotide
taatacgactcactatagggccctctgcatcacccccgttgctatcactgaacagaggagacagtgaatgcaacgggggaacctggcggcagcgcaaaagatg

SEQ ID NO: 180966 - DNA, 103 bp, Artificial Sequence
  Synthetic Polynucleotide
taatacgactcactatagggatgcccgttggactcattgccacttgaaccaacagaggagaggttcaatgggcaatgagaacctggcggcagcgcaaaagatg

SEQ ID NO: 180967 - DNA, 103 bp, Artificial Sequence
  Synthetic Polynucleotide
taatacgactcactatagggaggcccaggcccctctgcatcacccccgttaacagaggagaaacgggatggatgcagagaacctggcggcagcgcaaaagatg

SEQ ID NO: 180968 - DNA, 103 bp, Artificial Sequence
  Synthetic Polynucleotide
taatacgactcactatagggctggcgcaggaggcccaggcccctctgcataacagaggagaatgcagatgggcctgggcaacctggcggcagcgcaaaagatg

SEQ ID NO: 180969 - DNA, 103 bp, Artificial Sequence
  Synthetic Polynucleotide
taatacgactcactatagggtggaaagtcactggcgcaggaggcccaggcaacagaggagagcctggatgtcctgcgccaacctggcggcagcgcaaaagatg

SEQ ID NO: 180970 - DNA, 103 bp, Artificial Sequence
  Synthetic Polynucleotide
taatacgactcactatagggacagatctgctggaaagtcactggcgcaggaacagaggagacctgcgatggtgactttcaacctggcggcagcgcaaaagatg

SEQ ID NO: 180971 - DNA, 103 bp, Artificial Sequence
  Synthetic Polynucleotide
taatacgactcactataggggcacatccttacagatctgctggaaagtcaaacagaggagatgacttatgagcagatctaacctggcggcagcgcaaaagatg

SEQ ID NO: 180972 - DNA, 103 bp, Artificial Sequence
  Synthetic Polynucleotide
taatacgactcactatagggttcaccagatgcacatccttacagatctgcaacagaggagagcagatatgtaaggatgtaacctggcggcagcgcaaaagatg

SEQ ID NO: 180973 - DNA, 103 bp, Artificial Sequence
  Synthetic Polynucleotide
taatacgactcactataggggccctggtgcttcaccagatgcacatccttaacagaggagaaaggatatgcatctggtgaacctggcggcagcgcaaaagatg

SEQ ID NO: 180974 - DNA, 103 bp, Artificial Sequence
  Synthetic Polynucleotide
taatacgactcactatagggaaagctgctggccctggtgcttcaccagataacagaggagaatctggatgagcaccaggaacctggcggcagcgcaaaagatg

SEQ ID NO: 180975 - DNA, 103 bp, Artificial Sequence
  Synthetic Polynucleotide
taatacgactcactataggggactcaataaaaagctgctggccctggtgcaacagaggagagcaccaatgccagcagctaacctggcggcagcgcaaaagatg

SEQ ID NO: 180976 - DNA, 103 bp, Artificial Sequence
  Synthetic Polynucleotide
taatacgactcactatagggccgggcccgagactcaataaaaagctgctgaacagaggagacagcagatgtttattgagaacctggcggcagcgcaaaagatg

SEQ ID NO: 180977 - DNA, 103 bp, Artificial Sequence
  Synthetic Polynucleotide
taatacgactcactatagggctctagactcatgcccgttggactcattgcaacagaggagagcaatgatgccaacgggcaacctggcggcagcgcaaaagatg

SEQ ID NO: 180978 - DNA, 103 bp, Artificial Sequence
  Synthetic Polynucleotide
taatacgactcactataggggggactgaggccgggcccgagactcaataaaacagaggagattattgatgctcgggcccaacctggcggcagcgcaaaagatg

SEQ ID NO: 180979 - DNA, 103 bp, Artificial Sequence
  Synthetic Polynucleotide
taatacgactcactatagggaggcggggccgggactgaggccgggcccgaaacagaggagatcgggcatggcctcagtcaacctggcggcagcgcaaaagatg

SEQ ID NO: 180980 - DNA, 103 bp, Artificial Sequence
  Synthetic Polynucleotide
taatacgactcactatagggtgtagcagggaggcggggccgggactgaggaacagaggagacctcagatgcggccccgcaacctggcggcagcgcaaaagatg

SEQ ID NO: 180981 - DNA, 103 bp, Artificial Sequence
  Synthetic Polynucleotide
taatacgactcactatagggtgaacgtgcctgtagcagggaggcggggccaacagaggagaggccccatgtccctgctaaacctggcggcagcgcaaaagatg

SEQ ID NO: 180982 - DNA, 103 bp, Artificial Sequence
  Synthetic Polynucleotide
taatacgactcactataggggccttggccttgaacgtgcctgtagcagggaacagaggagaccctgcatgaggcacgttaacctggcggcagcgcaaaagatg

SEQ ID NO: 180983 - DNA, 103 bp, Artificial Sequence
  Synthetic Polynucleotide
taatacgactcactataggggcagggaagggccttggccttgaacgtgccaacagaggagaggcacgatgaaggccaagaacctggcggcagcgcaaaagatg

SEQ ID NO: 180984 - DNA, 103 bp, Artificial Sequence
  Synthetic Polynucleotide
taatacgactcactatagggctggggattggcagggaagggccttggcctaacagaggagaaggccaatgcccttccctaacctggcggcagcgcaaaagatg

SEQ ID NO: 180985 - DNA, 103 bp, Artificial Sequence
  Synthetic Polynucleotide
taatacgactcactatagggagctctgggtctggggattggcagggaaggaacagaggagaccttccatgccaatccccaacctggcggcagcgcaaaagatg

SEQ ID NO: 180986 - DNA, 103 bp, Artificial Sequence
  Synthetic Polynucleotide
taatacgactcactatagggacccgcctccagctctgggtctggggattgaacagaggagacaatccatggacccagagaacctggcggcagcgcaaaagatg

SEQ ID NO: 180987 - DNA, 103 bp, Artificial Sequence
  Synthetic Polynucleotide
taatacgactcactatagggcgggagcagaacccgcctccagctctgggtaacagaggagaacccagatgtggaggcggaacctggcggcagcgcaaaagatg

SEQ ID NO: 180988 - DNA, 103 bp, Artificial Sequence
  Synthetic Polynucleotide
taatacgactcactatagggtgagatgcgcctctagactcatgcccgttgaacagaggagacaacggatgtgagtctagaacctggcggcagcgcaaaagatg

SEQ ID NO: 180989 - DNA, 103 bp, Artificial Sequence
  Synthetic Polynucleotide
taatacgactcactatagggggggcctggacgggagcagaacccgcctccaacagaggagaggaggcatgttctgctccaacctggcggcagcgcaaaagatg

SEQ ID NO: 180990 - DNA, 103 bp, Artificial Sequence
  Synthetic Polynucleotide
taatacgactcactatagggcaaggctagtggggcctggacgggagcagaaacagaggagatctgctatggtccaggccaacctggcggcagcgcaaaagatg

SEQ ID NO: 180991 - DNA, 103 bp, Artificial Sequence
  Synthetic Polynucleotide
taatacgactcactatagggcctcagggaccaaggctagtggggcctggaaacagaggagatccaggatgcactagcctaacctggcggcagcgcaaaagatg

SEQ ID NO: 180992 - DNA, 103 bp, Artificial Sequence
  Synthetic Polynucleotide
taatacgactcactatagggctctcggcctcctcagggaccaaggctagtaacagaggagaactagcatgggtccctgaaacctggcggcagcgcaaaagatg

SEQ ID NO: 180993 - DNA, 103 bp, Artificial Sequence
  Synthetic Polynucleotide
taatacgactcactatagggggcttctttcctctcggcctcctcagggacaacagaggagagtccctatggaggccgagaacctggcggcagcgcaaaagatg

SEQ ID NO: 180994 - DNA, 103 bp, Artificial Sequence
  Synthetic Polynucleotide
taatacgactcactatagggagcagctggaggcttctttcctctcggcctaacagaggagaaggccgatgggaaagaagaacctggcggcagcgcaaaagatg

SEQ ID NO: 180995 - DNA, 103 bp, Artificial Sequence
  Synthetic Polynucleotide
taatacgactcactatagggtgctggtaggagcagctggaggcttctttcaacagaggagagaaagaatgctccagctgaacctggcggcagcgcaaaagatg

SEQ ID NO: 180996 - DNA, 103 bp, Artificial Sequence
  Synthetic Polynucleotide
taatacgactcactataggggcagttgatctgctggtaggagcagctggaaacagaggagatccagcatgtcctaccagaacctggcggcagcgcaaaagatg

SEQ ID NO: 180997 - DNA, 103 bp, Artificial Sequence
  Synthetic Polynucleotide
taatacgactcactatagggtgctgtccaggcagttgatctgctggtaggaacagaggagacctaccatgagatcaactaacctggcggcagcgcaaaagatg

SEQ ID NO: 180998 - DNA, 103 bp, Artificial Sequence
  Synthetic Polynucleotide
taatacgactcactatagggtacctgaggatgctgtccaggcagttgatcaacagaggagagatcaaatgcctggacagaacctggcggcagcgcaaaagatg

SEQ ID NO: 180999 - DNA, 103 bp, Artificial Sequence
  Synthetic Polynucleotide
taatacgactcactatagggtgagctccgctgagatgcgcctctagactcaacagaggagagagtctatgggcgcatctaacctggcggcagcgcaaaagatg

SEQ ID NO: 181000 - DNA, 103 bp, Artificial Sequence
  Synthetic Polynucleotide
taatacgactcactataggggctctccaggtacctgaggatgctgtccagaacagaggagactggacatgatcctcaggaacctggcggcagcgcaaaagatg

SEQ ID NO: 181001 - DNA, 103 bp, Artificial Sequence
  Synthetic Polynucleotide
taatacgactcactatagggggaggttgcagctctccaggtacctgaggaaacagaggagatcctcaatgacctggagaaacctggcggcagcgcaaaagatg

SEQ ID NO: 181002 - DNA, 103 bp, Artificial Sequence
  Synthetic Polynucleotide
taatacgactcactataggggtggtgctggggaggttgcagctctccaggaacagaggagacctggaatgctgcaacctaacctggcggcagcgcaaaagatg

SEQ ID NO: 181003 - DNA, 103 bp, Artificial Sequence
  Synthetic Polynucleotide
taatacgactcactatagggtttacgcttagtggtgctggggaggttgcaaacagaggagatgcaacatgcccagcaccaacctggcggcagcgcaaaagatg

SEQ ID NO: 181004 - DNA, 103 bp, Artificial Sequence
  Synthetic Polynucleotide
taatacgactcactatagggaggaggcacatttacgcttagtggtgctggaacagaggagaccagcaatgctaagcgtaaacctggcggcagcgcaaaagatg

SEQ ID NO: 181005 - DNA, 103 bp, Artificial Sequence
  Synthetic Polynucleotide
taatacgactcactatagggtaggaggaggaggaggcacatttacgcttaaacagaggagataagcgatgatgtgcctcaacctggcggcagcgcaaaagatg

SEQ ID NO: 181006 - DNA, 103 bp, Artificial Sequence
  Synthetic Polynucleotide
taatacgactcactatagggggaggtggtataggaggaggaggaggcacaaacagaggagatgtgccatgtcctcctccaacctggcggcagcgcaaaagatg

SEQ ID NO: 181007 - DNA, 103 bp, Artificial Sequence
  Synthetic Polynucleotide
taatacgactcactatagggcagaggctgaggaggtggtataggaggaggaacagaggagacctcctatgataccacctaacctggcggcagcgcaaaagatg

SEQ ID NO: 181008 - DNA, 103 bp, Artificial Sequence
  Synthetic Polynucleotide
taatacgactcactatagggctgtcgtcgtcagaggctgaggaggtggtaaacagaggagataccacatgctcagcctcaacctggcggcagcgcaaaagatg

SEQ ID NO: 181009 - DNA, 103 bp, Artificial Sequence
  Synthetic Polynucleotide
taatacgactcactatagggtgtcctctgcctgtcgtcgtcagaggctgaaacagaggagatcagccatggacgacgacaacctggcggcagcgcaaaagatg

SEQ ID NO: 181010 - DNA, 103 bp, Artificial Sequence
  Synthetic Polynucleotide
taatacgactcactatagggggtcccctcccccatcagccccttctagggaacagaggagaccctagatggggctgatgaacctggcggcagcgcaaaagatg

SEQ ID NO: 181011 - DNA, 103 bp, Artificial Sequence
  Synthetic Polynucleotide
taatacgactcactatagggaggagctgtgtgagctccgctgagatgcgcaacagaggagagcgcatatgagcggagctaacctggcggcagcgcaaaagatg

SEQ ID NO: 181012 - DNA, 103 bp, Artificial Sequence
  Synthetic Polynucleotide
taatacgactcactatagggagactggacctgtcctctgcctgtcgtcgtaacagaggagaacgacgatgggcagaggaaacctggcggcagcgcaaaagatg

SEQ ID NO: 181013 - DNA, 103 bp, Artificial Sequence
  Synthetic Polynucleotide
taatacgactcactataggggtccccacagagactggacctgtcctctgcaacagaggagagcagagatgaggtccagtaacctggcggcagcgcaaaagatg

SEQ ID NO: 181014 - DNA, 103 bp, Artificial Sequence
  Synthetic Polynucleotide
taatacgactcactatagggatctttcttggtccccacagagactggaccaacagaggagaggtccaatgtctgtggggaacctggcggcagcgcaaaagatg

SEQ ID NO: 181015 - DNA, 103 bp, Artificial Sequence
  Synthetic Polynucleotide
taatacgactcactatagggctgacggcggatctttcttggtccccacagaacagaggagactgtggatgccaagaaagaacctggcggcagcgcaaaagatg

SEQ ID NO: 181016 - DNA, 103 bp, Artificial Sequence
  Synthetic Polynucleotide
taatacgactcactataggggacagcgctgctgacggcggatctttcttgaacagaggagacaagaaatgtccgccgtcaacctggcggcagcgcaaaagatg

SEQ ID NO: 181017 - DNA, 103 bp, Artificial Sequence
  Synthetic Polynucleotide
taatacgactcactatagggcccctccccagacagcgctgctgacggcggaacagaggagaccgccgatggcagcgctgaacctggcggcagcgcaaaagatg

SEQ ID NO: 181018 - DNA, 103 bp, Artificial Sequence
  Synthetic Polynucleotide
taatacgactcactataggggtggggtggccccctccccagacagcgctgaacagaggagacagcgcatgctggggaggaacctggcggcagcgcaaaagatg

SEQ ID NO: 181019 - DNA, 103 bp, Artificial Sequence
  Synthetic Polynucleotide
taatacgactcactatagggggctccttccgtggggtggccccctccccaaacagaggagatggggaatgggccaccccaacctggcggcagcgcaaaagatg

SEQ ID NO: 181020 - DNA, 103 bp, Artificial Sequence
  Synthetic Polynucleotide
taatacgactcactatagggtcccaccactggctccttccgtggggtggcaacagaggagagccaccatgcggaaggagaacctggcggcagcgcaaaagatg

SEQ ID NO: 181021 - DNA, 103 bp, Artificial Sequence
  Synthetic Polynucleotide
taatacgactcactatagggtcagggtgcctcccaccactggctccttccaacagaggagaggaaggatgcagtggtggaacctggcggcagcgcaaaagatg

SEQ ID NO: 181022 - DNA, 103 bp, Artificial Sequence
  Synthetic Polynucleotide
taatacgactcactatagggttgcctgaggaggagctgtgtgagctccgcaacagaggagagcggagatgacacagctcaacctggcggcagcgcaaaagatg

SEQ ID NO: 181023 - DNA, 103 bp, Artificial Sequence
  Synthetic Polynucleotide
taatacgactcactataggggcgagcgggctcagggtgcctcccaccactaacagaggagaagtggtatgaggcaccctaacctggcggcagcgcaaaagatg

SEQ ID NO: 181024 - DNA, 103 bp, Artificial Sequence
  Synthetic Polynucleotide
taatacgactcactatagggattggccagggcgagcgggctcagggtgccaacagaggagaggcaccatgagcccgctcaacctggcggcagcgcaaaagatg

SEQ ID NO: 181025 - DNA, 103 bp, Artificial Sequence
  Synthetic Polynucleotide
taatacgactcactatagggtctccgccttattggccagggcgagcgggcaacagaggagagcccgcatgccctggccaaacctggcggcagcgcaaaagatg

SEQ ID NO: 181026 - DNA, 103 bp, Artificial Sequence
  Synthetic Polynucleotide
taatacgactcactataggggacaccacactctccgccttattggccaggaacagaggagacctggcatgtaaggcggaaacctggcggcagcgcaaaagatg

SEQ ID NO: 181027 - DNA, 103 bp, Artificial Sequence
  Synthetic Polynucleotide
taatacgactcactatagggactggtgacggacaccacactctccgccttaacagaggagaaaggcgatgagtgtggtgaacctggcggcagcgcaaaagatg

SEQ ID NO: 181028 - DNA, 103 bp, Artificial Sequence
  Synthetic Polynucleotide
taatacgactcactatagggagctacactgactggtgacggacaccacacaacagaggagagtgtggatgccgtcaccaaacctggcggcagcgcaaaagatg

SEQ ID NO: 181029 - DNA, 103 bp, Artificial Sequence
  Synthetic Polynucleotide
taatacgactcactataggggtggagctgaagctacactgactggtgacgaacagaggagacgtcacatgtcagtgtagaacctggcggcagcgcaaaagatg

SEQ ID NO: 181030 - DNA, 103 bp, Artificial Sequence
  Synthetic Polynucleotide
taatacgactcactatagggatggacgatggtggagctgaagctacactgaacagaggagacagtgtatgttcagctccaacctggcggcagcgcaaaagatg

SEQ ID NO: 181031 - DNA, 103 bp, Artificial Sequence
  Synthetic Polynucleotide
taatacgactcactatagggtgtctcccacatggacgatggtggagctgaaacagaggagatcagctatgccatcgtccaacctggcggcagcgcaaaagatg

SEQ ID NO: 181032 - DNA, 103 bp, Artificial Sequence
  Synthetic Polynucleotide
taatacgactcactataggggggggcttcttgtctcccacatggacgatgaacagaggagacatcgtatgtgtgggagaaacctggcggcagcgcaaaagatg

SEQ ID NO: 181033 - DNA, 103 bp, Artificial Sequence
  Synthetic Polynucleotide
taatacgactcactataggggtccttgccgttgcctgaggaggagctgtgaacagaggagacacagcatgtcctcaggcaacctggcggcagcgcaaaagatg

SEQ ID NO: 181034 - DNA, 103 bp, Artificial Sequence
  Synthetic Polynucleotide
taatacgactcactataggggtccgactccgggggcttcttgtctcccacaacagaggagagtgggaatgaagaagcccaacctggcggcagcgcaaaagatg

SEQ ID NO: 181035 - DNA, 103 bp, Artificial Sequence
  Synthetic Polynucleotide
taatacgactcactatagggtcatgatgatgtccgactccgggggcttctaacagaggagaagaagcatgcggagtcggaacctggcggcagcgcaaaagatg

SEQ ID NO: 181036 - DNA, 103 bp, Artificial Sequence
  Synthetic Polynucleotide
taatacgactcactatagggaggtcctccatcatgatgatgtccgactccaacagaggagaggagtcatgcatcatcataacctggcggcagcgcaaaagatg

SEQ ID NO: 181037 - DNA, 103 bp, Artificial Sequence
  Synthetic Polynucleotide
taatacgactcactatagggtaggccaggcaggtcctccatcatgatgataacagaggagaatcatcatgatggaggacaacctggcggcagcgcaaaagatg

SEQ ID NO: 181038 - DNA, 103 bp, Artificial Sequence
  Synthetic Polynucleotide
taatacgactcactatagggggcctggggctaggccaggcaggtcctccaaacagaggagatggaggatgtgcctggccaacctggcggcagcgcaaaagatg

SEQ ID NO: 181039 - DNA, 103 bp, Artificial Sequence
  Synthetic Polynucleotide
taatacgactcactatagggctgggggctgggcctggggctaggccaggcaacagaggagagcctggatgagccccaggaacctggcggcagcgcaaaagatg

SEQ ID NO: 181040 - DNA, 103 bp, Artificial Sequence
  Synthetic Polynucleotide
taatacgactcactataggggggggctgggctgggggctgggcctggggcaacagaggagagccccaatgccagcccccaacctggcggcagcgcaaaagatg

SEQ ID NO: 181041 - DNA, 103 bp, Artificial Sequence
  Synthetic Polynucleotide
taatacgactcactatagggctgtggggctgggggctgggctgggggctgaacagaggagacagcccatggcccagcccaacctggcggcagcgcaaaagatg

SEQ ID NO: 181042 - DNA, 103 bp, Artificial Sequence
  Synthetic Polynucleotide
taatacgactcactatagggtcaggggctactgtggggctgggggctgggaacagaggagacccagcatgcagccccacaacctggcggcagcgcaaaagatg

SEQ ID NO: 181043 - DNA, 103 bp, Artificial Sequence
  Synthetic Polynucleotide
taatacgactcactatagggtggggctgggtcaggggctactgtggggctaacagaggagaagccccatggtagcccctaacctggcggcagcgcaaaagatg

SEQ ID NO: 181044 - DNA, 103 bp, Artificial Sequence
  Synthetic Polynucleotide
taatacgactcactataggggcagggctgagtccttgccgttgcctgaggaacagaggagacctcagatgacggcaaggaacctggcggcagcgcaaaagatg

SEQ ID NO: 181045 - DNA, 103 bp, Artificial Sequence
  Synthetic Polynucleotide
taatacgactcactatagggggtaggcgtctggggctgggtcaggggctaaacagaggagatagcccatgacccagcccaacctggcggcagcgcaaaagatg

SEQ ID NO: 181046 - DNA, 103 bp, Artificial Sequence
  Synthetic Polynucleotide
taatacgactcactatagggcccactggacggtaggcgtctggggctgggaacagaggagacccagcatgagacgcctaaacctggcggcagcgcaaaagatg

SEQ ID NO: 181047 - DNA, 103 bp, Artificial Sequence
  Synthetic Polynucleotide
taatacgactcactatagggcttggtcagccccactggacggtaggcgtcaacagaggagagacgccatgcgtccagtgaacctggcggcagcgcaaaagatg

SEQ ID NO: 181048 - DNA, 103 bp, Artificial Sequence
  Synthetic Polynucleotide
taatacgactcactatagggacagcacggccttggtcagccccactggacaacagaggagagtccagatgggctgaccaaacctggcggcagcgcaaaagatg

SEQ ID NO: 181049 - DNA, 103 bp, Artificial Sequence
  Synthetic Polynucleotide
taatacgactcactataggggtgtgcagggacagcacggccttggtcagcaacagaggagagctgacatgggccgtgctaacctggcggcagcgcaaaagatg

SEQ ID NO: 181050 - DNA, 103 bp, Artificial Sequence
  Synthetic Polynucleotide
taatacgactcactatagggttccttctgtgtgtgcagggacagcacggcaacagaggagagccgtgatgtccctgcacaacctggcggcagcgcaaaagatg

SEQ ID NO: 181051 - DNA, 103 bp, Artificial Sequence
  Synthetic Polynucleotide
taatacgactcactatagggaggcttgctcttccttctgtgtgtgcagggaacagaggagaccctgcatgcacagaaggaacctggcggcagcgcaaaagatg

SEQ ID NO: 181052 - DNA, 103 bp, Artificial Sequence
  Synthetic Polynucleotide
taatacgactcactatagggcggctgaggaaggcttgctcttccttctgtaacagaggagaacagaaatgagagcaagcaacctggcggcagcgcaaaagatg

SEQ ID NO: 181053 - DNA, 103 bp, Artificial Sequence
  Synthetic Polynucleotide
taatacgactcactataggggtctcggaagcggctgaggaaggcttgctcaacagaggagagagcaaatgttcctcagcaacctggcggcagcgcaaaagatg

SEQ ID NO: 181054 - DNA, 103 bp, Artificial Sequence
  Synthetic Polynucleotide
taatacgactcactataggggcctgcccaggtctcggaagcggctgaggaaacagaggagatcctcaatggcttccgagaacctggcggcagcgcaaaagatg

SEQ ID NO: 181055 - DNA, 103 bp, Artificial Sequence
  Synthetic Polynucleotide
taatacgactcactataggggtggtctccagcagggctgagtccttgccgaacagaggagacggcaaatgctcagccctaacctggcggcagcgcaaaagatg

SEQ ID NO: 181056 - DNA, 103 bp, Artificial Sequence
  Synthetic Polynucleotide
taatacgactcactatagggagtccacgcagcctgcccaggtctcggaagaacagaggagacttccgatgcctgggcagaacctggcggcagcgcaaaagatg

SEQ ID NO: 181057 - DNA, 103 bp, Artificial Sequence
  Synthetic Polynucleotide
taatacgactcactatagggagagctgtcgagtccacgcagcctgcccagaacagaggagactgggcatgctgcgtggaaacctggcggcagcgcaaaagatg

SEQ ID NO: 181058 - DNA, 103 bp, Artificial Sequence
  Synthetic Polynucleotide
taatacgactcactataggggagctgtggaagagctgtcgagtccacgcaaacagaggagatgcgtgatgtcgacagctaacctggcggcagcgcaaaagatg

SEQ ID NO: 181059 - DNA, 103 bp, Artificial Sequence
  Synthetic Polynucleotide
taatacgactcactatagggagggctgagggagctgtggaagagctgtcgaacagaggagacgacagatgttccacagcaacctggcggcagcgcaaaagatg

SEQ ID NO: 181060 - DNA, 103 bp, Artificial Sequence
  Synthetic Polynucleotide
taatacgactcactatagggtcgctcgccaagggctgagggagctgtggaaacagaggagatccacaatgccctcagccaacctggcggcagcgcaaaagatg

SEQ ID NO: 181061 - DNA, 103 bp, Artificial Sequence
  Synthetic Polynucleotide
taatacgactcactatagggggtggcagcctcgctcgccaagggctgaggaacagaggagacctcagatgttggcgagcaacctggcggcagcgcaaaagatg

SEQ ID NO: 181062 - DNA, 103 bp, Artificial Sequence
  Synthetic Polynucleotide
taatacgactcactataggggcggggccgtggtggcagcctcgctcgccaaacagaggagatggcgaatgaggctgccaaacctggcggcagcgcaaaagatg

SEQ ID NO: 181063 - DNA, 103 bp, Artificial Sequence
  Synthetic Polynucleotide
taatacgactcactataggggcttgggggtgcggggccgtggtggcagccaacagaggagaggctgcatgcacggccccaacctggcggcagcgcaaaagatg

SEQ ID NO: 181064 - DNA, 103 bp, Artificial Sequence
  Synthetic Polynucleotide
taatacgactcactatagggggtgtcggcggcttgggggtgcggggccgtaacagaggagaacggccatgcacccccaaaacctggcggcagcgcaaaagatg

SEQ ID NO: 181065 - DNA, 103 bp, Artificial Sequence
  Synthetic Polynucleotide
taatacgactcactataggggatcggcagtggtgtcggcggcttgggggtaacagaggagaacccccatgccgccgacaaacctggcggcagcgcaaaagatg

SEQ ID NO: 181066 - DNA, 103 bp, Artificial Sequence
  Synthetic Polynucleotide
taatacgactcactataggggctgctctcagtggtctccagcagggctgaaacagaggagatcagccatgctggagaccaacctggcggcagcgcaaaagatg

SEQ ID NO: 181067 - DNA, 103 bp, Artificial Sequence
  Synthetic Polynucleotide
taatacgactcactatagggcttggctttggatcggcagtggtgtcggcgaacagaggagacgccgaatgcactgccgaaacctggcggcagcgcaaaagatg

SEQ ID NO: 181068 - DNA, 103 bp, Artificial Sequence
  Synthetic Polynucleotide
taatacgactcactatagggggcgtgagcgcttggctttggatcggcagtaacagaggagaactgccatgccaaagccaaacctggcggcagcgcaaaagatg

SEQ ID NO: 181069 - DNA, 103 bp, Artificial Sequence
  Synthetic Polynucleotide
taatacgactcactatagggttctggtggtggcgtgagcgcttggctttgaacagaggagacaaagcatggcgctcacgaacctggcggcagcgcaaaagatg

SEQ ID NO: 181070 - DNA, 103 bp, Artificial Sequence
  Synthetic Polynucleotide
taatacgactcactatagggagcccgagggttctggtggtggcgtgagcgaacagaggagacgctcaatgcaccaccagaacctggcggcagcgcaaaagatg

SEQ ID NO: 181071 - DNA, 103 bp, Artificial Sequence
  Synthetic Polynucleotide
taatacgactcactatagggagggcgcttcagcccgagggttctggtggtaacagaggagaaccaccatgaccctcgggaacctggcggcagcgcaaaagatg

SEQ ID NO: 181072 - DNA, 103 bp, Artificial Sequence
  Synthetic Polynucleotide
taatacgactcactataggggagacatagcagggcgcttcagcccgagggaacagaggagaccctcgatgtgaagcgccaacctggcggcagcgcaaaagatg

SEQ ID NO: 181073 - DNA, 103 bp, Artificial Sequence
  Synthetic Polynucleotide
taatacgactcactatagggtgaggggtgtgagacatagcagggcgcttcaacagaggagagaagcgatgtgctatgtcaacctggcggcagcgcaaaagatg

SEQ ID NO: 181074 - DNA, 103 bp, Artificial Sequence
  Synthetic Polynucleotide
taatacgactcactataggggtggcacgggtgaggggtgtgagacatagcaacagaggagagctatgatgcacacccctaacctggcggcagcgcaaaagatg

SEQ ID NO: 181075 - DNA, 103 bp, Artificial Sequence
  Synthetic Polynucleotide
taatacgactcactatagggggggtggagggtggcacgggtgaggggtgtaacagaggagaacacccatgacccgtgccaacctggcggcagcgcaaaagatg

SEQ ID NO: 181076 - DNA, 103 bp, Artificial Sequence
  Synthetic Polynucleotide
taatacgactcactatagggggtgggccagggggtggagggtggcacgggaacagaggagacccgtgatgccctccaccaacctggcggcagcgcaaaagatg

SEQ ID NO: 181077 - DNA, 103 bp, Artificial Sequence
  Synthetic Polynucleotide
taatacgactcactatagggttgtgctcttgctgctctcagtggtctccaaacagaggagatggagaatgctgagagcaaacctggcggcagcgcaaaagatg

SEQ ID NO: 181078 - DNA, 103 bp, Artificial Sequence
  Synthetic Polynucleotide
taatacgactcactatagggtggctggtggggtgggccagggggtggaggaacagaggagacctccaatgcctggcccaaacctggcggcagcgcaaaagatg

SEQ ID NO: 181079 - DNA, 103 bp, Artificial Sequence
  Synthetic Polynucleotide
taatacgactcactatagggaagggggtagtggctggtggggtgggccagaacagaggagactggccatgcccaccagcaacctggcggcagcgcaaaagatg

SEQ ID NO: 181080 - DNA, 103 bp, Artificial Sequence
  Synthetic Polynucleotide
taatacgactcactatagggaaccgctgggaagggggtagtggctggtggaacagaggagaccaccaatgactacccccaacctggcggcagcgcaaaagatg

SEQ ID NO: 181081 - DNA, 103 bp, Artificial Sequence
  Synthetic Polynucleotide
taatacgactcactatagggagggctggacaaccgctgggaagggggtagaacagaggagactacccatgtcccagcggaacctggcggcagcgcaaaagatg

SEQ ID NO: 181082 - DNA, 103 bp, Artificial Sequence
  Synthetic Polynucleotide
taatacgactcactataggggggagagggtagggctggacaaccgctgggaacagaggagacccagcatgtgtccagccaacctggcggcagcgcaaaagatg

SEQ ID NO: 181083 - DNA, 103 bp, Artificial Sequence
  Synthetic Polynucleotide
taatacgactcactatagggagagaacactgggagagggtagggctggacaacagaggagagtccagatgtaccctctcaacctggcggcagcgcaaaagatg

SEQ ID NO: 181084 - DNA, 103 bp, Artificial Sequence
  Synthetic Polynucleotide
taatacgactcactatagggctcctcgaggagagaacactgggagagggtaacagaggagaaccctcatgcagtgttctaacctggcggcagcgcaaaagatg

SEQ ID NO: 181085 - DNA, 103 bp, Artificial Sequence
  Synthetic Polynucleotide
taatacgactcactatagggggctgggggcctcctcgaggagagaacactaacagaggagaagtgttatgtcctcgaggaacctggcggcagcgcaaaagatg

SEQ ID NO: 181086 - DNA, 103 bp, Artificial Sequence
  Synthetic Polynucleotide
taatacgactcactatagggagggggaagaggctgggggcctcctcgaggaacagaggagacctcgaatgggcccccagaacctggcggcagcgcaaaagatg

SEQ ID NO: 181087 - DNA, 103 bp, Artificial Sequence
  Synthetic Polynucleotide
taatacgactcactatagggatgtgggagcagggggaagaggctgggggcaacagaggagagcccccatgctcttccccaacctggcggcagcgcaaaagatg

SEQ ID NO: 181088 - DNA, 103 bp, Artificial Sequence
  Synthetic Polynucleotide
taatacgactcactatagggctctgagagtttgtgctcttgctgctctcaaacagaggagatgagagatgcaagagcacaacctggcggcagcgcaaaagatg

SEQ ID NO: 181089 - DNA, 103 bp, Artificial Sequence
  Synthetic Polynucleotide
taatacgactcactataggggggggcacagatgtgggagcagggggaagaaacagaggagatcttccatgtgctcccacaacctggcggcagcgcaaaagatg

SEQ ID NO: 181090 - DNA, 103 bp, Artificial Sequence
  Synthetic Polynucleotide
taatacgactcactataggggaaagcagctgggggcacagatgtgggagcaacagaggagagctcccatgtctgtgcccaacctggcggcagcgcaaaagatg

SEQ ID NO: 181091 - DNA, 103 bp, Artificial Sequence
  Synthetic Polynucleotide
taatacgactcactatagggaaggggcggggaaagcagctgggggcacagaacagaggagactgtgcatgcagctgcttaacctggcggcagcgcaaaagatg

SEQ ID NO: 181092 - DNA, 103 bp, Artificial Sequence
  Synthetic Polynucleotide
taatacgactcactatagggggggtcaccaaaggggcggggaaagcagctaacagaggagaagctgcatgccccgccccaacctggcggcagcgcaaaagatg

SEQ ID NO: 181093 - DNA, 103 bp, Artificial Sequence
  Synthetic Polynucleotide
taatacgactcactatagggggccaccattggggtcaccaaaggggcgggaacagaggagacccgccatgttggtgaccaacctggcggcagcgcaaaagatg

SEQ ID NO: 181094 - DNA, 103 bp, Artificial Sequence
  Synthetic Polynucleotide
taatacgactcactatagggggagcaccaaggccaccattggggtcaccaaacagaggagatggtgaatgcaatggtggaacctggcggcagcgcaaaagatg

SEQ ID NO: 181095 - DNA, 103 bp, Artificial Sequence
  Synthetic Polynucleotide
taatacgactcactatagggagatagttagggagcaccaaggccaccattaacagaggagaaatggtatgcttggtgctaacctggcggcagcgcaaaagatg

SEQ ID NO: 181096 - DNA, 103 bp, Artificial Sequence
  Synthetic Polynucleotide
taatacgactcactatagggggttgggaacagatagttagggagcaccaaaacagaggagattggtgatgcctaactataacctggcggcagcgcaaaagatg

SEQ ID NO: 181097 - DNA, 103 bp, Artificial Sequence
  Synthetic Polynucleotide
taatacgactcactatagggagctggatggggttgggaacagatagttagaacagaggagactaactatgtgttcccaaaacctggcggcagcgcaaaagatg

SEQ ID NO: 181098 - DNA, 103 bp, Artificial Sequence
  Synthetic Polynucleotide
taatacgactcactatagggccataaggatagctggatggggttgggaacaacagaggagagttcccatgcccatccagaacctggcggcagcgcaaaagatg

SEQ ID NO: 181099 - DNA, 103 bp, Artificial Sequence
  Synthetic Polynucleotide
taatacgactcactatagggtggggatgggctctgagagtttgtgctcttaacagaggagaaagagcatgaactctcagaacctggcggcagcgcaaaagatg

SEQ ID NO: 181100 - DNA, 103 bp, Artificial Sequence
  Synthetic Polynucleotide
taatacgactcactatagggctggagtgccccataaggatagctggatggaacagaggagaccatccatgtatccttataacctggcggcagcgcaaaagatg

SEQ ID NO: 181101 - DNA, 103 bp, Artificial Sequence
  Synthetic Polynucleotide
taatacgactcactatagggcagcaggggtctggagtgccccataaggataacagaggagaatccttatggggcactccaacctggcggcagcgcaaaagatg

SEQ ID NO: 181102 - DNA, 103 bp, Artificial Sequence
  Synthetic Polynucleotide
taatacgactcactatagggggaggcccttcagcaggggtctggagtgccaacagaggagaggcactatggacccctgcaacctggcggcagcgcaaaagatg

SEQ ID NO: 181103 - DNA, 103 bp, Artificial Sequence
  Synthetic Polynucleotide
taatacgactcactatagggggcaggagtgggaggcccttcagcaggggtaacagaggagaacccctatggaagggcctaacctggcggcagcgcaaaagatg

SEQ ID NO: 181104 - DNA, 103 bp, Artificial Sequence
  Synthetic Polynucleotide
taatacgactcactataggggggagtgcgaggcaggagtgggaggcccttaacagaggagaaagggcatgccactcctgaacctggcggcagcgcaaaagatg

SEQ ID NO: 181105 - DNA, 103 bp, Artificial Sequence
  Synthetic Polynucleotide
taatacgactcactataggggatggagaaggggagtgcgaggcaggagtgaacagaggagacactccatgctcgcactcaacctggcggcagcgcaaaagatg

SEQ ID NO: 181106 - DNA, 103 bp, Artificial Sequence
  Synthetic Polynucleotide
taatacgactcactatagggggcgggcaaggatggagaaggggagtgcgaaacagaggagatcgcacatgccttctccaaacctggcggcagcgcaaaagatg

SEQ ID NO: 181107 - DNA, 103 bp, Artificial Sequence
  Synthetic Polynucleotide
taatacgactcactatagggtcggggcgagggcgggcaaggatggagaagaacagaggagacttctcatgccttgcccgaacctggcggcagcgcaaaagatg

SEQ ID NO: 181108 - DNA, 103 bp, Artificial Sequence
  Synthetic Polynucleotide
taatacgactcactatagggtgaggaggactcggggcgagggcgggcaagaacagaggagacttgccatgcctcgccccaacctggcggcagcgcaaaagatg

SEQ ID NO: 181109 - DNA, 103 bp, Artificial Sequence
  Synthetic Polynucleotide
taatacgactcactataggggtccgggcggtgaggaggactcggggcgagaacagaggagactcgccatgagtcctcctaacctggcggcagcgcaaaagatg

SEQ ID NO: 181110 - DNA, 103 bp, Artificial Sequence
  Synthetic Polynucleotide
taatacgactcactatagggaactgctgggtggggatgggctctgagagtaacagaggagaactctcatggcccatcccaacctggcggcagcgcaaaagatg

SEQ ID NO: 181111 - DNA, 103 bp, Artificial Sequence
  Synthetic Polynucleotide
taatacgactcactatagggacagtggagagtccgggcggtgaggaggacaacagaggagagtcctcatgaccgcccggaacctggcggcagcgcaaaagatg

SEQ ID NO: 181112 - DNA, 103 bp, Artificial Sequence
  Synthetic Polynucleotide
taatacgactcactatagggctcgagttgaacagtggagagtccgggcggaacagaggagaccgcccatgctctccactaacctggcggcagcgcaaaagatg

SEQ ID NO: 181113 - DNA, 103 bp, Artificial Sequence
  Synthetic Polynucleotide
taatacgactcactatagggagagctgcatctcgagttgaacagtggagaaacagaggagatctccaatgttcaactcgaacctggcggcagcgcaaaagatg

SEQ ID NO: 181114 - DNA, 103 bp, Artificial Sequence
  Synthetic Polynucleotide
taatacgactcactataggggctggagtggagagctgcatctcgagttgaaacagaggagatcaactatggatgcagctaacctggcggcagcgcaaaagatg

SEQ ID NO: 181115 - DNA, 103 bp, Artificial Sequence
  Synthetic Polynucleotide
taatacgactcactatagggagcagattgagctggagtggagagctgcataacagaggagaatgcagatgtccactccaaacctggcggcagcgcaaaagatg

SEQ ID NO: 181116 - DNA, 103 bp, Artificial Sequence
  Synthetic Polynucleotide
taatacgactcactatagggctccagctgcagcagattgagctggagtggaacagaggagaccactcatgctcaatctgaacctggcggcagcgcaaaagatg

SEQ ID NO: 181117 - DNA, 103 bp, Artificial Sequence
  Synthetic Polynucleotide
taatacgactcactataggggggggagctcctccagctgcagcagattgaaacagaggagatcaatcatgtgcagctggaacctggcggcagcgcaaaagatg

SEQ ID NO: 181118 - DNA, 103 bp, Artificial Sequence
  Synthetic Polynucleotide
taatacgactcactatagggccctcagcacgggggagctcctccagctgcaacagaggagagcagctatgggagctcccaacctggcggcagcgcaaaagatg

SEQ ID NO: 181119 - DNA, 103 bp, Artificial Sequence
  Synthetic Polynucleotide
taatacgactcactatagggaacagcagccccctcagcacgggggagctcaacagaggagagagctcatgcgtgctgagaacctggcggcagcgcaaaagatg

SEQ ID NO: 181120 - DNA, 103 bp, Artificial Sequence
  Synthetic Polynucleotide
taatacgactcactatagggggcctcctgcaacagcagccccctcagcacaacagaggagagtgctgatggggctgctgaacctggcggcagcgcaaaagatg

SEQ ID NO: 181121 - DNA, 103 bp, Artificial Sequence
  Synthetic Polynucleotide
taatacgactcactatagggccaggcctggggtcccctcccccatcagccaacagaggagaggctgaatggggaggggaaacctggcggcagcgcaaaagatg

SEQ ID NO: 181122 - DNA, 103 bp, Artificial Sequence
  Synthetic Polynucleotide
taatacgactcactatagggtaggcaatggaactgctgggtggggatgggaacagaggagacccatcatgacccagcagaacctggcggcagcgcaaaagatg

SEQ ID NO: 181123 - DNA, 103 bp, Artificial Sequence
  Synthetic Polynucleotide
taatacgactcactatagggctgctcccagggcctcctgcaacagcagccaacagaggagaggctgcatgtgcaggaggaacctggcggcagcgcaaaagatg

SEQ ID NO: 181124 - DNA, 103 bp, Artificial Sequence
  Synthetic Polynucleotide
taatacgactcactataggggggcccggcactgctcccagggcctcctgcaacagaggagagcaggaatgcctgggagcaacctggcggcagcgcaaaagatg

SEQ ID NO: 181125 - DNA, 103 bp, Artificial Sequence
  Synthetic Polynucleotide
taatacgactcactatagggtgggaggtgggggcccggcactgctcccagaacagaggagactgggaatggtgccgggcaacctggcggcagcgcaaaagatg

SEQ ID NO: 181126 - DNA, 103 bp, Artificial Sequence
  Synthetic Polynucleotide
taatacgactcactataggggcctccgcactgggaggtgggggcccggcaaacagaggagatgccggatgcccacctccaacctggcggcagcgcaaaagatg

SEQ ID NO: 181127 - DNA, 103 bp, Artificial Sequence
  Synthetic Polynucleotide
taatacgactcactatagggtggctcagcagcctccgcactgggaggtggaacagaggagaccacctatgagtgcggagaacctggcggcagcgcaaaagatg

SEQ ID NO: 181128 - DNA, 103 bp, Artificial Sequence
  Synthetic Polynucleotide
taatacgactcactataggggtctggcctctggctcagcagcctccgcacaacagaggagagtgcggatgctgctgagcaacctggcggcagcgcaaaagatg

SEQ ID NO: 181129 - DNA, 103 bp, Artificial Sequence
  Synthetic Polynucleotide
taatacgactcactatagggacctccgccagtctggcctctggctcagcaaacagaggagatgctgaatgagaggccagaacctggcggcagcgcaaaagatg

SEQ ID NO: 181130 - DNA, 103 bp, Artificial Sequence
  Synthetic Polynucleotide
taatacgactcactatagggggactcagtgacctccgccagtctggcctcaacagaggagagaggccatgctggcggagaacctggcggcagcgcaaaagatg

SEQ ID NO: 181131 - DNA, 103 bp, Artificial Sequence
  Synthetic Polynucleotide
taatacgactcactatagggcctgattggaggactcagtgacctccgccaaacagaggagatggcggatgtcactgagtaacctggcggcagcgcaaaagatg

SEQ ID NO: 181132 - DNA, 103 bp, Artificial Sequence
  Synthetic Polynucleotide
taatacgactcactataggggaaagtgcgtcctgattggaggactcagtgaacagaggagacactgaatgctccaatcaaacctggcggcagcgcaaaagatg

SEQ ID NO: 181133 - DNA, 103 bp, Artificial Sequence
  Synthetic Polynucleotide
taatacgactcactatagggcaggaggctgtaggcaatggaactgctgggaacagaggagacccagcatgtccattgccaacctggcggcagcgcaaaagatg

SEQ ID NO: 181134 - DNA, 103 bp, Artificial Sequence
  Synthetic Polynucleotide
taatacgactcactatagggactggagccggaaagtgcgtcctgattggaaacagaggagatccaatatggacgcacttaacctggcggcagcgcaaaagatg

SEQ ID NO: 181135 - DNA, 103 bp, Artificial Sequence
  Synthetic Polynucleotide
taatacgactcactatagggcgagcaggtcactggagccggaaagtgcgtaacagaggagaacgcacatgccggctccaaacctggcggcagcgcaaaagatg

SEQ ID NO: 181136 - DNA, 103 bp, Artificial Sequence
  Synthetic Polynucleotide
taatacgactcactatagggagcagaagttcgagcaggtcactggagccgaacagaggagacggctcatgtgacctgctaacctggcggcagcgcaaaagatg

SEQ ID NO: 181137 - DNA, 103 bp, Artificial Sequence
  Synthetic Polynucleotide
taatacgactcactataggggtcctcttgcagcagaagttcgagcaggtcaacagaggagagacctgatggaacttctgaacctggcggcagcgcaaaagatg

SEQ ID NO: 181138 - DNA, 103 bp, Artificial Sequence
  Synthetic Polynucleotide
taatacgactcactatagggcggagcgcgagtcctcttgcagcagaagttaacagaggagaaacttcatgtgcaagaggaacctggcggcagcgcaaaagatg

SEQ ID NO: 181139 - DNA, 103 bp, Artificial Sequence
  Synthetic Polynucleotide
taatacgactcactataggggagcctgtgccggagcgcgagtcctcttgcaacagaggagagcaagaatgctcgcgctcaacctggcggcagcgcaaaagatg

SEQ ID NO: 181140 - DNA, 103 bp, Artificial Sequence
  Synthetic Polynucleotide
taatacgactcactatagggcgaggctgcggagcctgtgccggagcgcgaaacagaggagatcgcgcatgggcacaggcaacctggcggcagcgcaaaagatg

SEQ ID NO: 181141 - DNA, 103 bp, Artificial Sequence
  Synthetic Polynucleotide
taatacgactcactatagggccaaggagcccgaggctgcggagcctgtgcaacagaggagagcacagatgccgcagcctaacctggcggcagcgcaaaagatg

SEQ ID NO: 181142 - DNA, 103 bp, Artificial Sequence
  Synthetic Polynucleotide
taatacgactcactatagggaagccagagcccaaggagcccgaggctgcgaacagaggagacgcagcatggggctccttaacctggcggcagcgcaaaagatg

SEQ ID NO: 181143 - DNA, 103 bp, Artificial Sequence
  Synthetic Polynucleotide
taatacgactcactatagggcccagagcccaagccagagcccaaggagccaacagaggagaggctccatgggctctggcaacctggcggcagcgcaaaagatg

SEQ ID NO: 181144 - DNA, 103 bp, Artificial Sequence
  Synthetic Polynucleotide
taatacgactcactatagggagctggcactcaggaggctgtaggcaatggaacagaggagaccattgatgacagcctccaacctggcggcagcgcaaaagatg

SEQ ID NO: 181145 - DNA, 103 bp, Artificial Sequence
  Synthetic Polynucleotide
taatacgactcactatagggctgaaccagacccagagcccaagccagagcaacagaggagagctctgatgtgggctctgaacctggcggcagcgcaaaagatg

SEQ ID NO: 181146 - DNA, 103 bp, Artificial Sequence
  Synthetic Polynucleotide
taatacgactcactatagggtcatgggagcctgaaccagacccagagcccaacagaggagagggctcatggtctggttcaacctggcggcagcgcaaaagatg

SEQ ID NO: 181147 - DNA, 103 bp, Artificial Sequence
  Synthetic Polynucleotide
taatacgactcactataggggctgcccccttcatgggagcctgaaccagaaacagaggagatctggtatgggctcccataacctggcggcagcgcaaaagatg

SEQ ID NO: 181148 - DNA, 103 bp, Artificial Sequence
  Synthetic Polynucleotide
taatacgactcactatagggtggctgaggtgctgcccccttcatgggagcaacagaggagagctcccatgaagggggcaaacctggcggcagcgcaaaagatg

SEQ ID NO: 181149 - DNA, 103 bp, Artificial Sequence
  Synthetic Polynucleotide
taatacgactcactatagggcgagtgatgctggctgaggtgctgccccctaacagaggagaagggggatgcacctcagcaacctggcggcagcgcaaaagatg

SEQ ID NO: 181150 - DNA, 103 bp, Artificial Sequence
  Synthetic Polynucleotide
taatacgactcactatagggctggctgctgcgagtgatgctggctgaggtaacagaggagaacctcaatgagcatcactaacctggcggcagcgcaaaagatg

SEQ ID NO: 181151 - DNA, 103 bp, Artificial Sequence
  Synthetic Polynucleotide
taatacgactcactatagggtgtggctgctctggctgctgcgagtgatgcaacagaggagagcatcaatggcagcagccaacctggcggcagcgcaaaagatg

SEQ ID NO: 181152 - DNA, 103 bp, Artificial Sequence
  Synthetic Polynucleotide
taatacgactcactatagggtatttgcttgtgtggctgctctggctgctgaacagaggagacagcagatggagcagccaaacctggcggcagcgcaaaagatg

SEQ ID NO: 181153 - DNA, 103 bp, Artificial Sequence
  Synthetic Polynucleotide
taatacgactcactataggggctgccaaagtatttgcttgtgtggctgctaacagaggagaagcagcatgacaagcaaaaacctggcggcagcgcaaaagatg

SEQ ID NO: 181154 - DNA, 103 bp, Artificial Sequence
  Synthetic Polynucleotide
taatacgactcactatagggaagagtcgatgctgccaaagtatttgcttgaacagaggagacaagcaatgactttggcaaacctggcggcagcgcaaaagatg

SEQ ID NO: 181155 - DNA, 103 bp, Artificial Sequence
  Synthetic Polynucleotide
taatacgactcactatagggtcctgctctgagctggcactcaggaggctgaacagaggagacagcctatggagtgccagaacctggcggcagcgcaaaagatg

SEQ ID NO: 181156 - DNA, 103 bp, Artificial Sequence
  Synthetic Polynucleotide
taatacgactcactatagggtcagcctcggaagagtcgatgctgccaaagaacagaggagactttggatgcatcgactcaacctggcggcagcgcaaaagatg

SEQ ID NO: 181157 - DNA, 103 bp, Artificial Sequence
  Synthetic Polynucleotide
taatacgactcactatagggagccccagcctcagcctcggaagagtcgataacagaggagaatcgacatgtccgaggctaacctggcggcagcgcaaaagatg

SEQ ID NO: 181158 - DNA, 103 bp, Artificial Sequence
  Synthetic Polynucleotide
taatacgactcactatagggcgccccgagcagccccagcctcagcctcggaacagaggagaccgaggatgaggctggggaacctggcggcagcgcaaaagatg

SEQ ID NO: 181159 - DNA, 103 bp, Artificial Sequence
  Synthetic Polynucleotide
taatacgactcactatagggggctcagccccgccccgagcagccccagccaacagaggagaggctggatgtgctcggggaacctggcggcagcgcaaaagatg

SEQ ID NO: 181160 - DNA, 103 bp, Artificial Sequence
  Synthetic Polynucleotide
taatacgactcactatagggctggtccccaggctcagccccgccccgagcaacagaggagagctcggatgggggctgagaacctggcggcagcgcaaaagatg

SEQ ID NO: 181161 - DNA, 103 bp, Artificial Sequence
  Synthetic Polynucleotide
taatacgactcactatagggacttaatcacctggtccccaggctcagcccaacagaggagagggctgatgctggggaccaacctggcggcagcgcaaaagatg

SEQ ID NO: 181162 - DNA, 103 bp, Artificial Sequence
  Synthetic Polynucleotide
taatacgactcactatagggtggagcacgtacttaatcacctggtccccaaacagaggagatggggaatgggtgattaaaacctggcggcagcgcaaaagatg

SEQ ID NO: 181163 - DNA, 103 bp, Artificial Sequence
  Synthetic Polynucleotide
taatacgactcactatagggaatgggatcctggagcacgtacttaatcacaacagaggagagtgattatgtacgtgctcaacctggcggcagcgcaaaagatg

SEQ ID NO: 181164 - DNA, 103 bp, Artificial Sequence
  Synthetic Polynucleotide
taatacgactcactatagggtgagcagccaaatgggatcctggagcacgtaacagaggagaacgtgcatgaggatcccaaacctggcggcagcgcaaaagatg

SEQ ID NO: 181165 - DNA, 103 bp, Artificial Sequence
  Synthetic Polynucleotide
taatacgactcactataggggcattggccatgagcagccaaatgggatccaacagaggagaggatccatgttggctgctaacctggcggcagcgcaaaagatg

SEQ ID NO: 181166 - DNA, 103 bp, Artificial Sequence
  Synthetic Polynucleotide
taatacgactcactatagggggacgggttgtcctgctctgagctggcactaacagaggagaagtgccatgtcagagcagaacctggcggcagcgcaaaagatg

SEQ ID NO: 181167 - DNA, 103 bp, Artificial Sequence
  Synthetic Polynucleotide
taatacgactcactataggggcgctggtcagcattggccatgagcagccaaacagaggagatggctgatgatggccaataacctggcggcagcgcaaaagatg

SEQ ID NO: 181168 - DNA, 103 bp, Artificial Sequence
  Synthetic Polynucleotide
taatacgactcactatagggtcatcatgacgcgctggtcagcattggccaaacagaggagatggccaatgctgaccagcaacctggcggcagcgcaaaagatg

SEQ ID NO: 181169 - DNA, 103 bp, Artificial Sequence
  Synthetic Polynucleotide
taatacgactcactatagggacctggtaggtcatcatgacgcgctggtcaaacagaggagatgaccaatgcgtcatgataacctggcggcagcgcaaaagatg

SEQ ID NO: 181170 - DNA, 103 bp, Artificial Sequence
  Synthetic Polynucleotide
taatacgactcactatagggcctggagggcacctggtaggtcatcatgacaacagaggagagtcatgatgacctaccagaacctggcggcagcgcaaaagatg

SEQ ID NO: 181171 - DNA, 103 bp, Artificial Sequence
  Synthetic Polynucleotide
taatacgactcactatagggaggtcatgtccctggagggcacctggtaggaacagaggagacctaccatgtgccctccaaacctggcggcagcgcaaaagatg

SEQ ID NO: 181172 - DNA, 103 bp, Artificial Sequence
  Synthetic Polynucleotide
taatacgactcactatagggttcagcacagaggtcatgtccctggagggcaacagaggagagccctcatgggacatgacaacctggcggcagcgcaaaagatg

SEQ ID NO: 181173 - DNA, 103 bp, Artificial Sequence
  Synthetic Polynucleotide
taatacgactcactatagggccgatcctgcttcagcacagaggtcatgtcaacagaggagagacatgatgtctgtgctgaacctggcggcagcgcaaaagatg

SEQ ID NO: 181174 - DNA, 103 bp, Artificial Sequence
  Synthetic Polynucleotide
taatacgactcactatagggggagccgctcccgatcctgcttcagcacagaacagaggagactgtgcatgagcaggatcaacctggcggcagcgcaaaagatg

SEQ ID NO: 181175 - DNA, 103 bp, Artificial Sequence
  Synthetic Polynucleotide
taatacgactcactatagggtgcatggctcggagccgctcccgatcctgcaacagaggagagcaggaatgggagcggctaacctggcggcagcgcaaaagatg

SEQ ID NO: 181176 - DNA, 103 bp, Artificial Sequence
  Synthetic Polynucleotide
taatacgactcactatagggctgctgcttctgcatggctcggagccgctcaacagaggagagagcggatgcgagccatgaacctggcggcagcgcaaaagatg

SEQ ID NO: 181177 - DNA, 103 bp, Artificial Sequence
  Synthetic Polynucleotide
taatacgactcactatagggagccactggtggacgggttgtcctgctctgaacagaggagacagagcatgacaacccgtaacctggcggcagcgcaaaagatg

SEQ ID NO: 181178 - DNA, 103 bp, Artificial Sequence
  Synthetic Polynucleotide
taatacgactcactatagggaaaaccgaggctgctgcttctgcatggctcaacagaggagagagccaatgagaagcagcaacctggcggcagcgcaaaagatg

SEQ ID NO: 181179 - DNA, 103 bp, Artificial Sequence
  Synthetic Polynucleotide
taatacgactcactatagggtggtcctcagaaaaccgaggctgctgcttcaacagaggagagaagcaatggcctcggttaacctggcggcagcgcaaaagatg

SEQ ID NO: 181180 - DNA, 103 bp, Artificial Sequence
  Synthetic Polynucleotide
taatacgactcactatagggttcccgccgctggtcctcagaaaaccgaggaacagaggagacctcggatgtctgaggacaacctggcggcagcgcaaaagatg

SEQ ID NO: 181181 - DNA, 103 bp, Artificial Sequence
  Synthetic Polynucleotide
taatacgactcactatagggcagcacccagttcccgccgctggtcctcagaacagaggagactgaggatgagcggcgggaacctggcggcagcgcaaaagatg

SEQ ID NO: 181182 - DNA, 103 bp, Artificial Sequence
  Synthetic Polynucleotide
taatacgactcactatagggcaggagtgcacagcacccagttcccgccgcaacagaggagagcggcgatgactgggtgcaacctggcggcagcgcaaaagatg

SEQ ID NO: 181183 - DNA, 103 bp, Artificial Sequence
  Synthetic Polynucleotide
taatacgactcactatagggcttccggacccaggagtgcacagcacccagaacagaggagactgggtatggtgcactccaacctggcggcagcgcaaaagatg

SEQ ID NO: 181184 - DNA, 103 bp, Artificial Sequence
  Synthetic Polynucleotide
taatacgactcactataggggcagttggcccttccggacccaggagtgcaaacagaggagatgcactatggggtccggaaacctggcggcagcgcaaaagatg

SEQ ID NO: 181185 - DNA, 103 bp, Artificial Sequence
  Synthetic Polynucleotide
taatacgactcactatagggagagcccgaggcagttggcccttccggaccaacagaggagaggtccgatggggccaactaacctggcggcagcgcaaaagatg

SEQ ID NO: 181186 - DNA, 103 bp, Artificial Sequence
  Synthetic Polynucleotide
taatacgactcactatagggcatcacatcaagagcccgaggcagttggccaacagaggagaggccaaatgcctcgggctaacctggcggcagcgcaaaagatg

SEQ ID NO: 181187 - DNA, 103 bp, Artificial Sequence
  Synthetic Polynucleotide
taatacgactcactatagggccacacaggccatcacatcaagagcccgagaacagaggagactcgggatgttgatgtgaaacctggcggcagcgcaaaagatg

SEQ ID NO: 181188 - DNA, 103 bp, Artificial Sequence
  Synthetic Polynucleotide
taatacgactcactatagggtcactgctgcagccactggtggacgggttgaacagaggagacaacccatgcaccagtggaacctggcggcagcgcaaaagatg

SEQ ID NO: 181189 - DNA, 103 bp, Artificial Sequence
  Synthetic Polynucleotide
taatacgactcactatagggctcccacagtccacacaggccatcacatcaaacagaggagatgatgtatgggcctgtgtaacctggcggcagcgcaaaagatg

SEQ ID NO: 181190 - DNA, 103 bp, Artificial Sequence
  Synthetic Polynucleotide
taatacgactcactatagggttgggtgctgctcccacagtccacacaggcaacagaggagagcctgtatggactgtgggaacctggcggcagcgcaaaagatg

SEQ ID NO: 181191 - DNA, 103 bp, Artificial Sequence
  Synthetic Polynucleotide
taatacgactcactataggggaccaggatcttgggtgctgctcccacagtaacagaggagaactgtgatggcagcacccaacctggcggcagcgcaaaagatg

SEQ ID NO: 181192 - DNA, 103 bp, Artificial Sequence
  Synthetic Polynucleotide
taatacgactcactatagggtcatcagggtgaccaggatcttgggtgctgaacagaggagacagcacatgagatcctggaacctggcggcagcgcaaaagatg

SEQ ID NO: 181193 - DNA, 103 bp, Artificial Sequence
  Synthetic Polynucleotide
taatacgactcactataggggaagagtgggtcatcagggtgaccaggatcaacagaggagagatcctatgcaccctgataacctggcggcagcgcaaaagatg

SEQ ID NO: 181194 - DNA, 103 bp, Artificial Sequence
  Synthetic Polynucleotide
taatacgactcactatagggccagctctgagaagagtgggtcatcagggtaacagaggagaaccctgatgacccactctaacctggcggcagcgcaaaagatg

SEQ ID NO: 181195 - DNA, 103 bp, Artificial Sequence
  Synthetic Polynucleotide
taatacgactcactatagggcccagtccatccagctctgagaagagtgggaacagaggagacccactatgctcagagctaacctggcggcagcgcaaaagatg

SEQ ID NO: 181196 - DNA, 103 bp, Artificial Sequence
  Synthetic Polynucleotide
taatacgactcactataggggggctccagccccagtccatccagctctgaaacagaggagatcagagatggatggactgaacctggcggcagcgcaaaagatg

SEQ ID NO: 181197 - DNA, 103 bp, Artificial Sequence
  Synthetic Polynucleotide
taatacgactcactatagggcctcttccatgggctccagccccagtccataacagaggagaatggacatgggctggagcaacctggcggcagcgcaaaagatg

SEQ ID NO: 181198 - DNA, 103 bp, Artificial Sequence
  Synthetic Polynucleotide
taatacgactcactatagggtcgcctccaccctcttccatgggctccagcaacagaggagagctggaatgcatggaagaaacctggcggcagcgcaaaagatg

SEQ ID NO: 181199 - DNA, 103 bp, Artificial Sequence
  Synthetic Polynucleotide
taatacgactcactatagggggctgactgttcactgctgcagccactggtaacagaggagaaccagtatgtgcagcagtaacctggcggcagcgcaaaagatg

SEQ ID NO: 181200 - DNA, 103 bp, Artificial Sequence
  Synthetic Polynucleotide
taatacgactcactataggggctgccctgctcgcctccaccctcttccataacagaggagaatggaaatgggtggaggcaacctggcggcagcgcaaaagatg

SEQ ID NO: 181201 - DNA, 103 bp, Artificial Sequence
  Synthetic Polynucleotide
taatacgactcactatagggcgccaccgctgctgccctgctcgcctccacaacagaggagagtggagatgagcagggcaaacctggcggcagcgcaaaagatg

SEQ ID NO: 181202 - DNA, 103 bp, Artificial Sequence
  Synthetic Polynucleotide
taatacgactcactatagggtcaccactgccgccaccgctgctgccctgcaacagaggagagcagggatgcagcggtggaacctggcggcagcgcaaaagatg

SEQ ID NO: 181203 - DNA, 103 bp, Artificial Sequence
  Synthetic Polynucleotide
taatacgactcactataggggccctctccctcaccactgccgccaccgctaacagaggagaagcggtatgggcagtggtaacctggcggcagcgcaaaagatg

SEQ ID NO: 181204 - DNA, 103 bp, Artificial Sequence
  Synthetic Polynucleotide
taatacgactcactatagggcctcctcgcagccctctccctcaccactgcaacagaggagagcagtgatgagggagaggaacctggcggcagcgcaaaagatg

SEQ ID NO: 181205 - DNA, 103 bp, Artificial Sequence
  Synthetic Polynucleotide
taatacgactcactatagggccgccttgggcctcctcgcagccctctcccaacagaggagagggagaatgctgcgaggaaacctggcggcagcgcaaaagatg

SEQ ID NO: 181206 - DNA, 103 bp, Artificial Sequence
  Synthetic Polynucleotide
taatacgactcactatagggagccttggccccgccttgggcctcctcgcaaacagaggagatgcgagatggcccaaggcaacctggcggcagcgcaaaagatg

SEQ ID NO: 181207 - DNA, 103 bp, Artificial Sequence
  Synthetic Polynucleotide
taatacgactcactataggggagagcttgaagccttggccccgccttgggaacagaggagacccaagatggggccaaggaacctggcggcagcgcaaaagatg

SEQ ID NO: 181208 - DNA, 103 bp, Artificial Sequence
  Synthetic Polynucleotide
taatacgactcactataggggccaagtcctgagagcttgaagccttggccaacagaggagaggccaaatgttcaagctcaacctggcggcagcgcaaaagatg

SEQ ID NO: 181209 - DNA, 103 bp, Artificial Sequence
  Synthetic Polynucleotide
taatacgactcactatagggctcctccatagccaagtcctgagagcttgaaacagaggagatcaagcatgcaggacttgaacctggcggcagcgcaaaagatg

SEQ ID NO: 181210 - DNA, 103 bp, Artificial Sequence
  Synthetic Polynucleotide
taatacgactcactatagggtccttgcccgggctgactgttcactgctgcaacagaggagagcagcaatgaacagtcagaacctggcggcagcgcaaaagatg

SEQ ID NO: 181211 - DNA, 103 bp, Artificial Sequence
  Synthetic Polynucleotide
taatacgactcactatagggcttcttcctcctcctccatagccaagtcctaacagaggagaaggactatgctatggaggaacctggcggcagcgcaaaagatg

SEQ ID NO: 181212 - DNA, 103 bp, Artificial Sequence
  Synthetic Polynucleotide
taatacgactcactataggggagctcctgccttcttcctcctcctccataaacagaggagatatggaatgggaggaagaaacctggcggcagcgcaaaagatg

SEQ ID NO: 181213 - DNA, 103 bp, Artificial Sequence
  Synthetic Polynucleotide
taatacgactcactatagggtggactggatgagctcctgccttcttcctcaacagaggagagaggaaatgggcaggagcaacctggcggcagcgcaaaagatg

SEQ ID NO: 181214 - DNA, 103 bp, Artificial Sequence
  Synthetic Polynucleotide
taatacgactcactatagggtaggtaaggctggactggatgagctcctgcaacagaggagagcaggaatgcatccagtcaacctggcggcagcgcaaaagatg

SEQ ID NO: 181215 - DNA, 103 bp, Artificial Sequence
  Synthetic Polynucleotide
taatacgactcactatagggtttcctgctgtaggtaaggctggactggataacagaggagaatccagatgagccttaccaacctggcggcagcgcaaaagatg

SEQ ID NO: 181216 - DNA, 103 bp, Artificial Sequence
  Synthetic Polynucleotide
taatacgactcactataggggctggtgcagtttcctgctgtaggtaaggcaacagaggagagccttaatgacagcaggaaacctggcggcagcgcaaaagatg

SEQ ID NO: 181217 - DNA, 103 bp, Artificial Sequence
  Synthetic Polynucleotide
taatacgactcactatagggtccttctgagtccttgcccgggctgactgtaacagaggagaacagtcatgccgggcaagaacctggcggcagcgcaaaagatg

SEQ ID NO: 181218 - DNA, 103 bp, Artificial Sequence
  Synthetic Polynucleotide
taatacgactcactatagggaaatgattccccaggcctggggtcccctccaacagaggagaggagggatgcccaggcctaacctggcggcagcgcaaaagatg

SEQ ID NO: 181219 - DNA, 103 bp, Artificial Sequence
  Synthetic Polynucleotide
taatacgactcactatagggtgtcatgagttccttctgagtccttgcccgaacagaggagacgggcaatgactcagaagaacctggcggcagcgcaaaagatg

SEQ ID NO: 181220 - DNA, 103 bp, Artificial Sequence
  Synthetic Polynucleotide
taatacgactcactatagggctcgaagtgctgtcatgagttccttctgagaacagaggagactcagaatgaactcatgaaacctggcggcagcgcaaaagatg

SEQ ID NO: 181221 - DNA, 103 bp, Artificial Sequence
  Synthetic Polynucleotide
taatacgactcactatagggagcttgagctctcgaagtgctgtcatgagtaacagaggagaactcatatgagcacttcgaacctggcggcagcgcaaaagatg

SEQ ID NO: 181222 - DNA, 103 bp, Artificial Sequence
  Synthetic Polynucleotide
taatacgactcactatagggcggcagtcgaagcttgagctctcgaagtgcaacagaggagagcacttatggagctcaagaacctggcggcagcgcaaaagatg

SEQ ID NO: 181223 - DNA, 103 bp, Artificial Sequence
  Synthetic Polynucleotide
taatacgactcactatagggggcgctctggcggcagtcgaagcttgagctaacagaggagaagctcaatgttcgactgcaacctggcggcagcgcaaaagatg

SEQ ID NO: 181224 - DNA, 103 bp, Artificial Sequence
  Synthetic Polynucleotide
taatacgactcactatagggcccttgccccggcgctctggcggcagtcgaaacagaggagatcgactatggccagagcgaacctggcggcagcgcaaaagatg

SEQ ID NO: 181225 - DNA, 103 bp, Artificial Sequence
  Synthetic Polynucleotide
taatacgactcactatagggcccagagcggcccttgccccggcgctctggaacagaggagaccagagatgcggggcaagaacctggcggcagcgcaaaagatg

SEQ ID NO: 181226 - DNA, 103 bp, Artificial Sequence
  Synthetic Polynucleotide
taatacgactcactatagggtggccagggtcccagagcggcccttgccccaacagaggagaggggcaatggccgctctgaacctggcggcagcgcaaaagatg

SEQ ID NO: 181227 - DNA, 103 bp, Artificial Sequence
  Synthetic Polynucleotide
taatacgactcactatagggtactgcagcgtggccagggtcccagagcggaacagaggagaccgctcatggaccctggcaacctggcggcagcgcaaaagatg

SEQ ID NO: 181228 - DNA, 103 bp, Artificial Sequence
  Synthetic Polynucleotide
taatacgactcactatagggggccagtgcgtactgcagcgtggccagggtaacagaggagaaccctgatgacgctgcagaacctggcggcagcgcaaaagatg

SEQ ID NO: 181229 - DNA, 103 bp, Artificial Sequence
  Synthetic Polynucleotide
taatacgactcactatagggccccaggacaaaatgattccccaggcctggaacagaggagaccaggcatggggaatcataacctggcggcagcgcaaaagatg

SEQ ID NO: 181230 - DNA, 103 bp, Artificial Sequence
  Synthetic Polynucleotide
taatacgactcactataggggcttgacacaggccagtgcgtactgcagcgaacagaggagacgctgcatgacgcactggaacctggcggcagcgcaaaagatg

SEQ ID NO: 181231 - DNA, 103 bp, Artificial Sequence
  Synthetic Polynucleotide
taatacgactcactataggggcctgcacctgcttgacacaggccagtgcgaacagaggagacgcactatgctgtgtcaaaacctggcggcagcgcaaaagatg

SEQ ID NO: 181232 - DNA, 103 bp, Artificial Sequence
  Synthetic Polynucleotide
taatacgactcactatagggttcctggttggcctgcacctgcttgacacaaacagaggagatgtgtcatgcaggtgcagaacctggcggcagcgcaaaagatg

SEQ ID NO: 181233 - DNA, 103 bp, Artificial Sequence
  Synthetic Polynucleotide
taatacgactcactataggggctggtagtattcctggttggcctgcacctaacagaggagaaggtgcatgccaaccaggaacctggcggcagcgcaaaagatg

SEQ ID NO: 181234 - DNA, 103 bp, Artificial Sequence
  Synthetic Polynucleotide
taatacgactcactatagggaggctccactgctggtagtattcctggttgaacagaggagacaaccaatgatactaccaaacctggcggcagcgcaaaagatg

SEQ ID NO: 181235 - DNA, 103 bp, Artificial Sequence
  Synthetic Polynucleotide
taatacgactcactataggggccctcctccaggctccactgctggtagtaaacagaggagatactacatgcagtggagcaacctggcggcagcgcaaaagatg

SEQ ID NO: 181236 - DNA, 103 bp, Artificial Sequence
  Synthetic Polynucleotide
taatacgactcactatagggagcaaggctcgccctcctccaggctccactaacagaggagaagtggaatgtggaggaggaacctggcggcagcgcaaaagatg

SEQ ID NO: 181237 - DNA, 103 bp, Artificial Sequence
  Synthetic Polynucleotide
taatacgactcactatagggatgtccatggagcaaggctcgccctcctccaacagaggagaggaggaatgcgagccttgaacctggcggcagcgcaaaagatg

SEQ ID NO: 181238 - DNA, 103 bp, Artificial Sequence
  Synthetic Polynucleotide
taatacgactcactatagggataggtggacatgtccatggagcaaggctcaacagaggagagagcctatgtccatggacaacctggcggcagcgcaaaagatg

SEQ ID NO: 181239 - DNA, 103 bp, Artificial Sequence
  Synthetic Polynucleotide
taatacgactcactatagggcctccagggtataggtggacatgtccatggaacagaggagaccatggatgtgtccacctaacctggcggcagcgcaaaagatg

SEQ ID NO: 181240 - DNA, 103 bp, Artificial Sequence
  Synthetic Polynucleotide
taatacgactcactataggggatgggacgcccccaggacaaaatgattccaacagaggagaggaatcatgttgtcctggaacctggcggcagcgcaaaagatg

SEQ ID NO: 181241 - DNA, 103 bp, Artificial Sequence
  Synthetic Polynucleotide
taatacgactcactatagggtgctccagctcctccagggtataggtggacaacagaggagagtccacatgtaccctggaaacctggcggcagcgcaaaagatg

SEQ ID NO: 181242 - DNA, 103 bp, Artificial Sequence
  Synthetic Polynucleotide
taatacgactcactatagggagacgtgatgtgctccagctcctccagggtaacagaggagaaccctgatggagctggagaacctggcggcagcgcaaaagatg

SEQ ID NO: 181243 - DNA, 103 bp, Artificial Sequence
  Synthetic Polynucleotide
taatacgactcactataggggtgtgtactcagacgtgatgtgctccagctaacagaggagaagctggatgacatcacgtaacctggcggcagcgcaaaagatg

SEQ ID NO: 181244 - DNA, 103 bp, Artificial Sequence
  Synthetic Polynucleotide
taatacgactcactatagggtggttctgaagtgtgtactcagacgtgatgaacagaggagacatcacatgtgagtacacaacctggcggcagcgcaaaagatg

SEQ ID NO: 181245 - DNA, 103 bp, Artificial Sequence
  Synthetic Polynucleotide
taatacgactcactataggggaaggtatcctggttctgaagtgtgtactcaacagaggagagagtacatgcttcagaacaacctggcggcagcgcaaaagatg

SEQ ID NO: 181246 - DNA, 103 bp, Artificial Sequence
  Synthetic Polynucleotide
taatacgactcactatagggcagccactgagaaggtatcctggttctgaaaacagaggagattcagaatgaggatacctaacctggcggcagcgcaaaagatg

SEQ ID NO: 181247 - DNA, 103 bp, Artificial Sequence
  Synthetic Polynucleotide
taatacgactcactatagggaggaaggagacagccactgagaaggtatccaacagaggagaggatacatgctcagtggcaacctggcggcagcgcaaaagatg

SEQ ID NO: 181248 - DNA, 103 bp, Artificial Sequence
  Synthetic Polynucleotide
taatacgactcactatagggtcggcccgtcaggaaggagacagccactgaaacagaggagatcagtgatggtctccttcaacctggcggcagcgcaaaagatg

SEQ ID NO: 181249 - DNA, 103 bp, Artificial Sequence
  Synthetic Polynucleotide
taatacgactcactatagggtgtagacgattcggcccgtcaggaaggagaaacagaggagatctcctatgtgacgggccaacctggcggcagcgcaaaagatg

SEQ ID NO: 181250 - DNA, 103 bp, Artificial Sequence
  Synthetic Polynucleotide
taatacgactcactatagggtgctccgaaatgtagacgattcggcccgtcaacagaggagagacgggatgaatcgtctaaacctggcggcagcgcaaaagatg

SEQ ID NO: 181251 - DNA, 103 bp, Artificial Sequence
  Synthetic Polynucleotide
taatacgactcactataggggggcccaggggatgggacgcccccaggacaaacagaggagatgtcctatgggcgtcccaaacctggcggcagcgcaaaagatg

SEQ ID NO: 181252 - DNA, 103 bp, Artificial Sequence
  Synthetic Polynucleotide
taatacgactcactataggggacggctgcctgctccgaaatgtagacgataacagaggagaatcgtcatgatttcggagaacctggcggcagcgcaaaagatg

SEQ ID NO: 181253 - DNA, 103 bp, Artificial Sequence
  Synthetic Polynucleotide
taatacgactcactatagggaacgcagcaggacggctgcctgctccgaaaaacagaggagatttcggatgaggcagccgaacctggcggcagcgcaaaagatg

SEQ ID NO: 181254 - DNA, 103 bp, Artificial Sequence
  Synthetic Polynucleotide
taatacgactcactatagggtcccgcttgcaacgcagcaggacggctgccaacagaggagaggcagcatgcctgctgcgaacctggcggcagcgcaaaagatg

SEQ ID NO: 181255 - DNA, 103 bp, Artificial Sequence
  Synthetic Polynucleotide
taatacgactcactatagggccggaacacgtcccgcttgcaacgcagcagaacagaggagactgctgatgtgcaagcggaacctggcggcagcgcaaaagatg

SEQ ID NO: 181256 - DNA, 103 bp, Artificial Sequence
  Synthetic Polynucleotide
taatacgactcactatagggagcgggtaccccggaacacgtcccgcttgcaacagaggagagcaagcatgacgtgttccaacctggcggcagcgcaaaagatg

SEQ ID NO: 181257 - DNA, 103 bp, Artificial Sequence
  Synthetic Polynucleotide
taatacgactcactatagggagctcagagaagcgggtaccccggaacacgaacagaggagacgtgttatggggtacccgaacctggcggcagcgcaaaagatg

SEQ ID NO: 181258 - DNA, 103 bp, Artificial Sequence
  Synthetic Polynucleotide
taatacgactcactataggggggagccaggagctcagagaagcgggtaccaacagaggagaggtaccatgttctctgagaacctggcggcagcgcaaaagatg

SEQ ID NO: 181259 - DNA, 103 bp, Artificial Sequence
  Synthetic Polynucleotide
taatacgactcactatagggccacatcctggggagccaggagctcagagaaacagaggagatctctgatgtcctggctcaacctggcggcagcgcaaaagatg

SEQ ID NO: 181260 - DNA, 103 bp, Artificial Sequence
  Synthetic Polynucleotide
taatacgactcactatagggtagaagactcccacatcctggggagccaggaacagaggagacctggcatgccaggatgtaacctggcggcagcgcaaaagatg

SEQ ID NO: 181261 - DNA, 103 bp, Artificial Sequence
  Synthetic Polynucleotide
taatacgactcactatagggagtggaaccatagaagactcccacatcctgaacagaggagacaggatatgggagtcttcaacctggcggcagcgcaaaagatg

SEQ ID NO: 181262 - DNA, 103 bp, Artificial Sequence
  Synthetic Polynucleotide
taatacgactcactatagggggtgctgtgggggcccaggggatgggacgcaacagaggagagcgtccatgcccctgggcaacctggcggcagcgcaaaagatg

SEQ ID NO: 181263 - DNA, 103 bp, Artificial Sequence
  Synthetic Polynucleotide
taatacgactcactataggggagatggagcagtggaaccatagaagactcaacagaggagagagtctatgatggttccaaacctggcggcagcgcaaaagatg

SEQ ID NO: 181264 - DNA, 103 bp, Artificial Sequence
  Synthetic Polynucleotide
taatacgactcactataggggtgggcaggcgagatggagcagtggaaccaaacagaggagatggttcatgtgctccatcaacctggcggcagcgcaaaagatg

SEQ ID NO: 181265 - DNA, 103 bp, Artificial Sequence
  Synthetic Polynucleotide
taatacgactcactatagggtgtgccccaggtgggcaggcgagatggagcaacagaggagagctccaatgcgcctgcccaacctggcggcagcgcaaaagatg

SEQ ID NO: 181266 - DNA, 103 bp, Artificial Sequence
  Synthetic Polynucleotide
taatacgactcactatagggctgaggcccctgtgccccaggtgggcaggcaacagaggagagcctgcatgcctggggcaaacctggcggcagcgcaaaagatg

SEQ ID NO: 181267 - DNA, 103 bp, Artificial Sequence
  Synthetic Polynucleotide
taatacgactcactatagggcctgaacctgctgaggcccctgtgccccagaacagaggagactggggatgaggggcctcaacctggcggcagcgcaaaagatg

SEQ ID NO: 181268 - DNA, 103 bp, Artificial Sequence
  Synthetic Polynucleotide
taatacgactcactataggggtccctgaggcctgaacctgctgaggccccaacagaggagaggggccatggcaggttcaaacctggcggcagcgcaaaagatg

SEQ ID NO: 181269 - DNA, 103 bp, Artificial Sequence
  Synthetic Polynucleotide
taatacgactcactatagggcctgggtaaagtccctgaggcctgaacctgaacagaggagacaggttatggcctcagggaacctggcggcagcgcaaaagatg

SEQ ID NO: 181270 - DNA, 103 bp, Artificial Sequence
  Synthetic Polynucleotide
taatacgactcactatagggacggacttctcctgggtaaagtccctgaggaacagaggagacctcagatgctttacccaaacctggcggcagcgcaaaagatg

SEQ ID NO: 181271 - DNA, 103 bp, Artificial Sequence
  Synthetic Polynucleotide
taatacgactcactatagggacggcagaagacggacttctcctgggtaaaaacagaggagatttaccatggagaagtccaacctggcggcagcgcaaaagatg

SEQ ID NO: 181272 - DNA, 103 bp, Artificial Sequence
  Synthetic Polynucleotide
taatacgactcactatagggctcctctgatacggcagaagacggacttctaacagaggagaagaagtatgtcttctgccaacctggcggcagcgcaaaagatg

SEQ ID NO: 181273 - DNA, 103 bp, Artificial Sequence
  Synthetic Polynucleotide
taatacgactcactataggggggcaaggccggtgctgtgggggcccagggaacagaggagaccctggatgcccacagcaaacctggcggcagcgcaaaagatg

SEQ ID NO: 181274 - DNA, 103 bp, Artificial Sequence
  Synthetic Polynucleotide
taatacgactcactatagggcggtcaggacctcctctgatacggcagaagaacagaggagacttctgatgtatcagaggaacctggcggcagcgcaaaagatg

SEQ ID NO: 181275 - DNA, 103 bp, Artificial Sequence
  Synthetic Polynucleotide
taatacgactcactatagggccctggatcccggtcaggacctcctctgataacagaggagaatcagaatgggtcctgacaacctggcggcagcgcaaaagatg

SEQ ID NO: 181276 - DNA, 103 bp, Artificial Sequence
  Synthetic Polynucleotide
taatacgactcactatagggggtaccgaggccctggatcccggtcaggacaacagaggagagtcctgatggggatccagaacctggcggcagcgcaaaagatg

SEQ ID NO: 181277 - DNA, 103 bp, Artificial Sequence
  Synthetic Polynucleotide
taatacgactcactatagggcggaatggctggtaccgaggccctggatccaacagaggagaggatccatggcctcggtaaacctggcggcagcgcaaaagatg

SEQ ID NO: 181278 - DNA, 103 bp, Artificial Sequence
  Synthetic Polynucleotide
taatacgactcactatagggcggggttaggcggaatggctggtaccgaggaacagaggagacctcggatgcagccattcaacctggcggcagcgcaaaagatg

SEQ ID NO: 181279 - DNA, 103 bp, Artificial Sequence
  Synthetic Polynucleotide
taatacgactcactatagggtggtcacatacggggttaggcggaatggctaacagaggagaagccatatggcctaacccaacctggcggcagcgcaaaagatg

SEQ ID NO: 181280 - DNA, 103 bp, Artificial Sequence
  Synthetic Polynucleotide
taatacgactcactatagggacccggatcttggtcacatacggggttaggaacagaggagacctaacatggtatgtgacaacctggcggcagcgcaaaagatg

SEQ ID NO: 181281 - DNA, 103 bp, Artificial Sequence
  Synthetic Polynucleotide
taatacgactcactatagggcccatctgagacccggatcttggtcacataaacagaggagatatgtgatgaagatccggaacctggcggcagcgcaaaagatg

SEQ ID NO: 181282 - DNA, 103 bp, Artificial Sequence
  Synthetic Polynucleotide
taatacgactcactataggggtgcaggggccccatctgagacccggatctaacagaggagaagatccatgtctcagatgaacctggcggcagcgcaaaagatg

SEQ ID NO: 181283 - DNA, 103 bp, Artificial Sequence
  Synthetic Polynucleotide
taatacgactcactatagggcagcacggctgtgcaggggccccatctgagaacagaggagactcagaatgggcccctgcaacctggcggcagcgcaaaagatg

SEQ ID NO: 181284 - DNA, 103 bp, Artificial Sequence
  Synthetic Polynucleotide
taatacgactcactataggggctgggcggaaattccgcgtatccattcataacagaggagaatgaatatgtacgcggaaaacctggcggcagcgcaaaagatg

SEQ ID NO: 181285 - DNA, 103 bp, Artificial Sequence
  Synthetic Polynucleotide
taatacgactcactatagggtccactggagccactgctcatgtccacatcaacagaggagagatgtgatgatgagcagtaacctggcggcagcgcaaaagatg

SEQ ID NO: 181286 - DNA, 103 bp, Artificial Sequence
  Synthetic Polynucleotide
taatacgactcactatagggatttggtgtatgggtggttgtaaaaattctaacagaggagaagaattatgacaaccaccaacctggcggcagcgcaaaagatg

SEQ ID NO: 181287 - DNA, 103 bp, Artificial Sequence
  Synthetic Polynucleotide
taatacgactcactatagggggaacaaacaatttggtgtatgggtggttgaacagaggagacaaccaatgatacaccaaaacctggcggcagcgcaaaagatg

SEQ ID NO: 181288 - DNA, 103 bp, Artificial Sequence
  Synthetic Polynucleotide
taatacgactcactatagggtccacatcctggaacaaacaatttggtgtaaacagaggagatacaccatgttgtttgttaacctggcggcagcgcaaaagatg

SEQ ID NO: 181289 - DNA, 103 bp, Artificial Sequence
  Synthetic Polynucleotide
taatacgactcactatagggcgccctttcatccacatcctggaacaaacaaacagaggagatgtttgatgcaggatgtgaacctggcggcagcgcaaaagatg

SEQ ID NO: 181290 - DNA, 103 bp, Artificial Sequence
  Synthetic Polynucleotide
taatacgactcactatagggggagagggaccgccctttcatccacatcctaacagaggagaaggatgatgatgaaagggaacctggcggcagcgcaaaagatg

SEQ ID NO: 181291 - DNA, 103 bp, Artificial Sequence
  Synthetic Polynucleotide
taatacgactcactatagggaggtagcccaggagagggaccgccctttcaaacagaggagatgaaagatgggtccctctaacctggcggcagcgcaaaagatg

SEQ ID NO: 181292 - DNA, 103 bp, Artificial Sequence
  Synthetic Polynucleotide
taatacgactcactataggggtcctgaggtaggtagcccaggagagggacaacagaggagagtccctatgctgggctacaacctggcggcagcgcaaaagatg

SEQ ID NO: 181293 - DNA, 103 bp, Artificial Sequence
  Synthetic Polynucleotide
taatacgactcactatagggtttcaatcaggtcctgaggtaggtagcccaaacagaggagatgggctatgtacctcaggaacctggcggcagcgcaaaagatg

SEQ ID NO: 181294 - DNA, 103 bp, Artificial Sequence
  Synthetic Polynucleotide
taatacgactcactatagggagcactggggtttcaatcaggtcctgaggtaacagaggagaacctcaatgcctgattgaaacctggcggcagcgcaaaagatg

SEQ ID NO: 181295 - DNA, 103 bp, Artificial Sequence
  Synthetic Polynucleotide
taatacgactcactataggggagctgcacgagcactggggtttcaatcagaacagaggagactgattatgaccccagtgaacctggcggcagcgcaaaagatg

SEQ ID NO: 181296 - DNA, 103 bp, Artificial Sequence
  Synthetic Polynucleotide
taatacgactcactatagggtggtctcatgtccactggagccactgctcaaacagaggagatgagcaatggctccagtgaacctggcggcagcgcaaaagatg

SEQ ID NO: 181297 - DNA, 103 bp, Artificial Sequence
  Synthetic Polynucleotide
taatacgactcactatagggcactagggtggagctgcacgagcactggggaacagaggagaccccagatgtcgtgcagcaacctggcggcagcgcaaaagatg

SEQ ID NO: 181298 - DNA, 103 bp, Artificial Sequence
  Synthetic Polynucleotide
taatacgactcactatagggaagggcctgtcactagggtggagctgcacgaacagaggagacgtgcaatgccaccctagaacctggcggcagcgcaaaagatg

SEQ ID NO: 181299 - DNA, 103 bp, Artificial Sequence
  Synthetic Polynucleotide
taatacgactcactatagggggccagcatcaagggcctgtcactagggtgaacagaggagacaccctatggacaggcccaacctggcggcagcgcaaaagatg

SEQ ID NO: 181300 - DNA, 103 bp, Artificial Sequence
  Synthetic Polynucleotide
taatacgactcactatagggttttgtggatggccagcatcaagggcctgtaacagaggagaacaggcatgtgatgctggaacctggcggcagcgcaaaagatg

SEQ ID NO: 181301 - DNA, 103 bp, Artificial Sequence
  Synthetic Polynucleotide
taatacgactcactatagggtgcaggatctttttgtggatggccagcatcaacagaggagagatgctatgcatccacaaaacctggcggcagcgcaaaagatg

SEQ ID NO: 181302 - DNA, 103 bp, Artificial Sequence
  Synthetic Polynucleotide
taatacgactcactatagggcccgcctgactgcaggatctttttgtggataacagaggagaatccacatgaagatcctgaacctggcggcagcgcaaaagatg

SEQ ID NO: 181303 - DNA, 103 bp, Artificial Sequence
  Synthetic Polynucleotide
taatacgactcactatagggcgaaaggctgcccgcctgactgcaggatctaacagaggagaagatccatgagtcaggcgaacctggcggcagcgcaaaagatg

SEQ ID NO: 181304 - DNA, 103 bp, Artificial Sequence
  Synthetic Polynucleotide
taatacgactcactatagggggagaatagtcgaaaggctgcccgcctgacaacagaggagagtcaggatggcagcctttaacctggcggcagcgcaaaagatg

SEQ ID NO: 181305 - DNA, 103 bp, Artificial Sequence
  Synthetic Polynucleotide
taatacgactcactatagggaaaccgaatgggagaatagtcgaaaggctgaacagaggagacagcctatggactattctaacctggcggcagcgcaaaagatg

SEQ ID NO: 181306 - DNA, 103 bp, Artificial Sequence
  Synthetic Polynucleotide
taatacgactcactatagggtccgggcgcgaaaccgaatgggagaatagtaacagaggagaactattatgccattcggtaacctggcggcagcgcaaaagatg

SEQ ID NO: 181307 - DNA, 103 bp, Artificial Sequence
  Synthetic Polynucleotide
taatacgactcactatagggcagttttcgttggtctcatgtccactggagaacagaggagactccagatgacatgagacaacctggcggcagcgcaaaagatg

SEQ ID NO: 181308 - DNA, 103 bp, Artificial Sequence
  Synthetic Polynucleotide
taatacgactcactatagggtactctccgttccgggcgcgaaaccgaatgaacagaggagacattcgatgtcgcgcccgaacctggcggcagcgcaaaagatg

SEQ ID NO: 181309 - DNA, 103 bp, Artificial Sequence
  Synthetic Polynucleotide
taatacgactcactatagggcaacgtgatgtactctccgttccgggcgcgaacagaggagacgcgccatgaacggagagaacctggcggcagcgcaaaagatg

SEQ ID NO: 181310 - DNA, 103 bp, Artificial Sequence
  Synthetic Polynucleotide
taatacgactcactatagggagctggtgtccaacgtgatgtactctccgtaacagaggagaacggagatgacatcacgtaacctggcggcagcgcaaaagatg

SEQ ID NO: 181311 - DNA, 103 bp, Artificial Sequence
  Synthetic Polynucleotide
taatacgactcactatagggaagctggaccagctggtgtccaacgtgatgaacagaggagacatcacatgggacaccagaacctggcggcagcgcaaaagatg

SEQ ID NO: 181312 - DNA, 103 bp, Artificial Sequence
  Synthetic Polynucleotide
taatacgactcactatagggtgggttgatgaagctggaccagctggtgtcaacagaggagagacaccatgtggtccagcaacctggcggcagcgcaaaagatg

SEQ ID NO: 181313 - DNA, 103 bp, Artificial Sequence
  Synthetic Polynucleotide
taatacgactcactatagggtcctgctccatgggttgatgaagctggaccaacagaggagaggtccaatgtcatcaaccaacctggcggcagcgcaaaagatg

SEQ ID NO: 181314 - DNA, 103 bp, Artificial Sequence
  Synthetic Polynucleotide
taatacgactcactatagggaaggagattttcctgctccatgggttgatgaacagaggagacatcaaatgatggagcagaacctggcggcagcgcaaaagatg

SEQ ID NO: 181315 - DNA, 103 bp, Artificial Sequence
  Synthetic Polynucleotide
taatacgactcactatagggcccaatgatgaaggagattttcctgctccaaacagaggagatggagcatgaaaatctccaacctggcggcagcgcaaaagatg

SEQ ID NO: 181316 - DNA, 103 bp, Artificial Sequence
  Synthetic Polynucleotide
taatacgactcactatagggctttgtgcctcccaatgatgaaggagatttaacagaggagaaaatctatgtcatcattgaacctggcggcagcgcaaaagatg

SEQ ID NO: 181317 - DNA, 103 bp, Artificial Sequence
  Synthetic Polynucleotide
taatacgactcactatagggcccaccctgactttgtgcctcccaatgatgaacagaggagacatcatatggaggcacaaaacctggcggcagcgcaaaagatg

SEQ ID NO: 181318 - DNA, 103 bp, Artificial Sequence
  Synthetic Polynucleotide
taatacgactcactatagggccccgtggagcagttttcgttggtctcatgaacagaggagacatgagatgaacgaaaacaacctggcggcagcgcaaaagatg

SEQ ID NO: 181319 - DNA, 103 bp, Artificial Sequence
  Synthetic Polynucleotide
taatacgactcactatagggattcaaagggcccaccctgactttgtgcctaacagaggagaaggcacatggtcagggtgaacctggcggcagcgcaaaagatg

SEQ ID NO: 181320 - DNA, 103 bp, Artificial Sequence
  Synthetic Polynucleotide
taatacgactcactatagggacacgtcctcattcaaagggcccaccctgaaacagaggagatcagggatggccctttgaaacctggcggcagcgcaaaagatg

SEQ ID NO: 181321 - DNA, 103 bp, Artificial Sequence
  Synthetic Polynucleotide
taatacgactcactatagggtgggctgcaaacacgtcctcattcaaagggaacagaggagaccctttatgtgaggacgtaacctggcggcagcgcaaaagatg

SEQ ID NO: 181322 - DNA, 103 bp, Artificial Sequence
  Synthetic Polynucleotide
taatacgactcactatagggtgtgcaggggtgggctgcaaacacgtcctcaacagaggagagaggacatgtttgcagccaacctggcggcagcgcaaaagatg

SEQ ID NO: 181323 - DNA, 103 bp, Artificial Sequence
  Synthetic Polynucleotide
taatacgactcactatagggccttctcctctgtgcaggggtgggctgcaaaacagaggagattgcagatgacccctgcaaacctggcggcagcgcaaaagatg

SEQ ID NO: 181324 - DNA, 103 bp, Artificial Sequence
  Synthetic Polynucleotide
taatacgactcactataggggggtgcagggccttctcctctgtgcaggggaacagaggagacccctgatgagaggagaaaacctggcggcagcgcaaaagatg

SEQ ID NO: 181325 - DNA, 103 bp, Artificial Sequence
  Synthetic Polynucleotide
taatacgactcactatagggctgaatgctggggtgcagggccttctcctcaacagaggagagaggagatggccctgcacaacctggcggcagcgcaaaagatg

SEQ ID NO: 181326 - DNA, 103 bp, Artificial Sequence
  Synthetic Polynucleotide
taatacgactcactatagggctgtgagctcctgaatgctggggtgcagggaacagaggagaccctgcatgccagcattcaacctggcggcagcgcaaaagatg

SEQ ID NO: 181327 - DNA, 103 bp, Artificial Sequence
  Synthetic Polynucleotide
taatacgactcactatagggtggatctgctctgtgagctcctgaatgctgaacagaggagacagcatatgggagctcacaacctggcggcagcgcaaaagatg

SEQ ID NO: 181328 - DNA, 103 bp, Artificial Sequence
  Synthetic Polynucleotide
taatacgactcactatagggcaggagccggtggatctgctctgtgagctcaacagaggagagagctcatggagcagatcaacctggcggcagcgcaaaagatg

SEQ ID NO: 181329 - DNA, 103 bp, Artificial Sequence
  Synthetic Polynucleotide
taatacgactcactataggggcgagtcccgccccgtggagcagttttcgtaacagaggagaacgaaaatggctccacggaacctggcggcagcgcaaaagatg

SEQ ID NO: 181330 - DNA, 103 bp, Artificial Sequence
  Synthetic Polynucleotide
taatacgactcactatagggcgggctgcagcaggagccggtggatctgctaacagaggagaagcagaatgaccggctccaacctggcggcagcgcaaaagatg

SEQ ID NO: 181331 - DNA, 103 bp, Artificial Sequence
  Synthetic Polynucleotide
taatacgactcactatagggctgtgggggacgggctgcagcaggagccggaacagaggagaccggctatggctgcagccaacctggcggcagcgcaaaagatg

SEQ ID NO: 181332 - DNA, 103 bp, Artificial Sequence
  Synthetic Polynucleotide
taatacgactcactatagggactggagccgctgtgggggacgggctgcagaacagaggagactgcagatggtcccccacaacctggcggcagcgcaaaagatg

SEQ ID NO: 181333 - DNA, 103 bp, Artificial Sequence
  Synthetic Polynucleotide
taatacgactcactatagggtcccgtagccactggagccgctgtgggggaaacagaggagatcccccatggcggctccaaacctggcggcagcgcaaaagatg

SEQ ID NO: 181334 - DNA, 103 bp, Artificial Sequence
  Synthetic Polynucleotide
taatacgactcactatagggctgcccagactcccgtagccactggagccgaacagaggagacggctcatgtggctacggaacctggcggcagcgcaaaagatg

SEQ ID NO: 181335 - DNA, 103 bp, Artificial Sequence
  Synthetic Polynucleotide
taatacgactcactatagggggacccgttgctgcccagactcccgtagccaacagaggagaggctacatgagtctgggcaacctggcggcagcgcaaaagatg

SEQ ID NO: 181336 - DNA, 103 bp, Artificial Sequence
  Synthetic Polynucleotide
taatacgactcactatagggggtgctcgtgggacccgttgctgcccagacaacagaggagagtctggatggcaacgggtaacctggcggcagcgcaaaagatg

SEQ ID NO: 181337 - DNA, 103 bp, Artificial Sequence
  Synthetic Polynucleotide
taatacgactcactatagggtggctcataaggtgctcgtgggacccgttgaacagaggagacaacggatgccacgagcaaacctggcggcagcgcaaaagatg

SEQ ID NO: 181338 - DNA, 103 bp, Artificial Sequence
  Synthetic Polynucleotide
taatacgactcactatagggggaggaggtctggctcataaggtgctcgtgaacagaggagacacgagatgcttatgagcaacctggcggcagcgcaaaagatg

SEQ ID NO: 181339 - DNA, 103 bp, Artificial Sequence
  Synthetic Polynucleotide
taatacgactcactatagggtgctgtcgctggaggaggtctggctcataaaacagaggagattatgaatgagacctcctaacctggcggcagcgcaaaagatg

SEQ ID NO: 181340 - DNA, 103 bp, Artificial Sequence
  Synthetic Polynucleotide
taatacgactcactatagggtcactgccctgcgagtcccgccccgtggagaacagaggagactccacatggcgggactcaacctggcggcagcgcaaaagatg

SEQ ID NO: 181341 - DNA, 103 bp, Artificial Sequence
  Synthetic Polynucleotide
taatacgactcactatagggtcatggccgttgctgtcgctggaggaggtcaacagaggagagacctcatgcagcgacagaacctggcggcagcgcaaaagatg

SEQ ID NO: 181342 - DNA, 103 bp, Artificial Sequence
  Synthetic Polynucleotide
taatacgactcactataggggcgtgagtcctcatggccgttgctgtcgctaacagaggagaagcgacatgaacggccataacctggcggcagcgcaaaagatg

SEQ ID NO: 181343 - DNA, 103 bp, Artificial Sequence
  Synthetic Polynucleotide
taatacgactcactatagggctctcctccggcgtgagtcctcatggccgtaacagaggagaacggccatgaggactcacaacctggcggcagcgcaaaagatg

SEQ ID NO: 181344 - DNA, 103 bp, Artificial Sequence
  Synthetic Polynucleotide
taatacgactcactatagggcaaatttcggctctcctccggcgtgagtccaacagaggagaggactcatgccggaggagaacctggcggcagcgcaaaagatg

SEQ ID NO: 181345 - DNA, 103 bp, Artificial Sequence
  Synthetic Polynucleotide
taatacgactcactatagggaccatttttacaaatttcggctctcctccgaacagaggagacggaggatggccgaaattaacctggcggcagcgcaaaagatg

SEQ ID NO: 181346 - DNA, 103 bp, Artificial Sequence
  Synthetic Polynucleotide
taatacgactcactatagggtggtcttgttaccatttttacaaatttcggaacagaggagaccgaaaatggtaaaaatgaacctggcggcagcgcaaaagatg

SEQ ID NO: 181347 - DNA, 103 bp, Artificial Sequence
  Synthetic Polynucleotide
taatacgactcactatagggcttctatttttggtcttgttaccatttttaaacagaggagataaaaaatgtaacaagacaacctggcggcagcgcaaaagatg

SEQ ID NO: 181348 - DNA, 103 bp, Artificial Sequence
  Synthetic Polynucleotide
taatacgactcactatagggagaataatgacttctatttttggtcttgttaacagaggagaaacaagatgaaaaatagaaacctggcggcagcgcaaaagatg

SEQ ID NO: 181349 - DNA, 103 bp, Artificial Sequence
  Synthetic Polynucleotide
taatacgactcactatagggcagattcatgagaataatgacttctattttaacagaggagaaaaataatggtcattattaacctggcggcagcgcaaaagatg

SEQ ID NO: 181350 - DNA, 103 bp, Artificial Sequence
  Synthetic Polynucleotide
taatacgactcactatagggttttgttctccagattcatgagaataatgaaacagaggagatcattaatgtcatgaatcaacctggcggcagcgcaaaagatg

SEQ ID NO: 181351 - DNA, 103 bp, Artificial Sequence
  Synthetic Polynucleotide
taatacgactcactataggggtcgtcacagtcactgccctgcgagtcccgaacagaggagacgggacatgcagggcagtaacctggcggcagcgcaaaagatg

SEQ ID NO: 181352 - DNA, 103 bp, Artificial Sequence
  Synthetic Polynucleotide
taatacgactcactatagggggattttttcttttgttctccagattcatgaacagaggagacatgaaatgggagaacaaaacctggcggcagcgcaaaagatg

SEQ ID NO: 181353 - DNA, 103 bp, Artificial Sequence
  Synthetic Polynucleotide
taatacgactcactatagggtttctgtaacggattttttcttttgttctcaacagaggagagagaacatgagaaaaaataacctggcggcagcgcaaaagatg

SEQ ID NO: 181354 - DNA, 103 bp, Artificial Sequence
  Synthetic Polynucleotide
taatacgactcactatagggttagtttgcatttctgtaacggattttttcaacagaggagagaaaaaatgcgttacagaaacctggcggcagcgcaaaagatg

SEQ ID NO: 181355 - DNA, 103 bp, Artificial Sequence
  Synthetic Polynucleotide
taatacgactcactatagggagctgggggattagtttgcatttctgtaacaacagaggagagttacaatgatgcaaactaacctggcggcagcgcaaaagatg

SEQ ID NO: 181356 - DNA, 103 bp, Artificial Sequence
  Synthetic Polynucleotide
taatacgactcactatagggctttcttctcagctgggggattagtttgcaaacagaggagatgcaaaatgatcccccagaacctggcggcagcgcaaaagatg

SEQ ID NO: 181357 - DNA, 103 bp, Artificial Sequence
  Synthetic Polynucleotide
taatacgactcactataggggcagggacagctttcttctcagctgggggaaacagaggagatcccccatgtgagaagaaaacctggcggcagcgcaaaagatg

SEQ ID NO: 181358 - DNA, 103 bp, Artificial Sequence
  Synthetic Polynucleotide
taatacgactcactatagggcttttccatggcagggacagctttcttctcaacagaggagagagaagatggctgtccctaacctggcggcagcgcaaaagatg

SEQ ID NO: 181359 - DNA, 103 bp, Artificial Sequence
  Synthetic Polynucleotide
taatacgactcactatagggccaggctgtccttttccatggcagggacagaacagaggagactgtccatgccatggaaaaacctggcggcagcgcaaaagatg

SEQ ID NO: 181360 - DNA, 103 bp, Artificial Sequence
  Synthetic Polynucleotide
taatacgactcactatagggaagctgacccccaggctgtccttttccatgaacagaggagacatggaatgggacagcctaacctggcggcagcgcaaaagatg

SEQ ID NO: 181361 - DNA, 103 bp, Artificial Sequence
  Synthetic Polynucleotide
taatacgactcactatagggctcctcggggaagctgacccccaggctgtcaacagaggagagacagcatgggggtcagcaacctggcggcagcgcaaaagatg

SEQ ID NO: 181362 - DNA, 103 bp, Artificial Sequence
  Synthetic Polynucleotide
taatacgactcactatagggccttcccactgtcgtcacagtcactgccctaacagaggagaagggcaatgactgtgacgaacctggcggcagcgcaaaagatg

SEQ ID NO: 181363 - DNA, 103 bp, Artificial Sequence
  Synthetic Polynucleotide
taatacgactcactatagggtgcaggccaactcctcggggaagctgacccaacagaggagagggtcaatgtccccgaggaacctggcggcagcgcaaaagatg

SEQ ID NO: 181364 - DNA, 103 bp, Artificial Sequence
  Synthetic Polynucleotide
taatacgactcactatagggggctggttcttgcaggccaactcctcggggaacagaggagaccccgaatggttggcctgaacctggcggcagcgcaaaagatg

SEQ ID NO: 181365 - DNA, 103 bp, Artificial Sequence
  Synthetic Polynucleotide
taatacgactcactatagggggagcaggtgggctggttcttgcaggccaaaacagaggagattggccatgaagaaccagaacctggcggcagcgcaaaagatg

SEQ ID NO: 181366 - DNA, 103 bp, Artificial Sequence
  Synthetic Polynucleotide
taatacgactcactatagggtctgctggtaggagcaggtgggctggttctaacagaggagaagaaccatgccacctgctaacctggcggcagcgcaaaagatg

SEQ ID NO: 181367 - DNA, 103 bp, Artificial Sequence
  Synthetic Polynucleotide
taatacgactcactatagggaagcagctgatctgctggtaggagcaggtgaacagaggagacacctgatgctaccagcaaacctggcggcagcgcaaaagatg

SEQ ID NO: 181368 - DNA, 103 bp, Artificial Sequence
  Synthetic Polynucleotide
taatacgactcactataggggacgctgtccaagcagctgatctgctggtaaacagaggagataccagatgatcagctgcaacctggcggcagcgcaaaagatg

SEQ ID NO: 181369 - DNA, 103 bp, Artificial Sequence
  Synthetic Polynucleotide
taatacgactcactatagggagtacctgatgacgctgtccaagcagctgaaacagaggagatcagctatgtggacagcgaacctggcggcagcgcaaaagatg

SEQ ID NO: 181370 - DNA, 103 bp, Artificial Sequence
  Synthetic Polynucleotide
taatacgactcactatagggcagctctccaagtacctgatgacgctgtccaacagaggagaggacagatgcatcaggtaaacctggcggcagcgcaaaagatg

SEQ ID NO: 181371 - DNA, 103 bp, Artificial Sequence
  Synthetic Polynucleotide
taatacgactcactatagggagcctcattgcagctctccaagtacctgataacagaggagaatcaggatgttggagagcaacctggcggcagcgcaaaagatg

SEQ ID NO: 181372 - DNA, 103 bp, Artificial Sequence
  Synthetic Polynucleotide
taatacgactcactatagggtcagggtggcagcctcattgcagctctccaaacagaggagatggagaatggcaatgaggaacctggcggcagcgcaaaagatg

SEQ ID NO: 181373 - DNA, 103 bp, Artificial Sequence
  Synthetic Polynucleotide
taatacgactcactatagggatccccagctccttcccactgtcgtcacagaacagaggagactgtgaatgcagtgggaaaacctggcggcagcgcaaaagatg

SEQ ID NO: 181374 - DNA, 103 bp, Artificial Sequence
  Synthetic Polynucleotide
taatacgactcactatagggcatttcctcttcagggtggcagcctcattgaacagaggagacaatgaatgtgccaccctaacctggcggcagcgcaaaagatg

SEQ ID NO: 181375 - DNA, 103 bp, Artificial Sequence
  Synthetic Polynucleotide
taatacgactcactatagggtgggaactcgcatttcctcttcagggtggcaacagaggagagccaccatgaagaggaaaaacctggcggcagcgcaaaagatg

SEQ ID NO: 181376 - DNA, 103 bp, Artificial Sequence
  Synthetic Polynucleotide
taatacgactcactatagggggacgtttgctgggaactcgcatttcctctaacagaggagaagaggaatggcgagttccaacctggcggcagcgcaaaagatg

SEQ ID NO: 181377 - DNA, 103 bp, Artificial Sequence
  Synthetic Polynucleotide
taatacgactcactatagggcttagcgctgggacgtttgctgggaactcgaacagaggagacgagttatgagcaaacgtaacctggcggcagcgcaaaagatg

SEQ ID NO: 181378 - DNA, 103 bp, Artificial Sequence
  Synthetic Polynucleotide
taatacgactcactatagggatcactggaccttagcgctgggacgtttgcaacagaggagagcaaacatgccagcgctaaacctggcggcagcgcaaaagatg

SEQ ID NO: 181379 - DNA, 103 bp, Artificial Sequence
  Synthetic Polynucleotide
taatacgactcactatagggccttccgcttatcactggaccttagcgctgaacagaggagacagcgcatgggtccagtgaacctggcggcagcgcaaaagatg

SEQ ID NO: 181380 - DNA, 103 bp, Artificial Sequence
  Synthetic Polynucleotide
taatacgactcactatagggctgactgtggccttccgcttatcactggacaacagaggagagtccagatgtaagcggaaaacctggcggcagcgcaaaagatg

SEQ ID NO: 181381 - DNA, 103 bp, Artificial Sequence
  Synthetic Polynucleotide
taatacgactcactatagggtggccctgggctgactgtggccttccgcttaacagaggagaaagcggatggccacagtcaacctggcggcagcgcaaaagatg

SEQ ID NO: 181382 - DNA, 103 bp, Artificial Sequence
  Synthetic Polynucleotide
taatacgactcactatagggctccagcgtgtggccctgggctgactgtggaacagaggagaccacagatggcccagggcaacctggcggcagcgcaaaagatg

SEQ ID NO: 181383 - DNA, 103 bp, Artificial Sequence
  Synthetic Polynucleotide
taatacgactcactatagggggctctgcctctccagcgtgtggccctgggaacagaggagacccaggatgacacgctggaacctggcggcagcgcaaaagatg

SEQ ID NO: 181384 - DNA, 103 bp, Artificial Sequence
  Synthetic Polynucleotide
taatacgactcactatagggctccaccagcatccccagctccttcccactaacagaggagaagtgggatggagctggggaacctggcggcagcgcaaaagatg

SEQ ID NO: 181385 - DNA, 103 bp, Artificial Sequence
  Synthetic Polynucleotide
taatacgactcactatagggcctggagggcggctctgcctctccagcgtgaacagaggagacacgctatggaggcagagaacctggcggcagcgcaaaagatg

SEQ ID NO: 181386 - DNA, 103 bp, Artificial Sequence
  Synthetic Polynucleotide
taatacgactcactatagggggctgttcaccctggagggcggctctgcctaacagaggagaaggcagatgcgccctccaaacctggcggcagcgcaaaagatg

SEQ ID NO: 181387 - DNA, 103 bp, Artificial Sequence
  Synthetic Polynucleotide
taatacgactcactatagggactcccgtgcggctgttcaccctggagggcaacagaggagagccctcatgggtgaacagaacctggcggcagcgcaaaagatg

SEQ ID NO: 181388 - DNA, 103 bp, Artificial Sequence
  Synthetic Polynucleotide
taatacgactcactataggggtgcgtacctactcccgtgcggctgttcacaacagaggagagtgaacatgcgcacgggaaacctggcggcagcgcaaaagatg

SEQ ID NO: 181389 - DNA, 103 bp, Artificial Sequence
  Synthetic Polynucleotide
taatacgactcactataggggcgaggtcaggtgcgtacctactcccgtgcaacagaggagagcacggatgtaggtacgcaacctggcggcagcgcaaaagatg

SEQ ID NO: 181390 - DNA, 103 bp, Artificial Sequence
  Synthetic Polynucleotide
taatacgactcactatagggggcagtgccagcgaggtcaggtgcgtacctaacagaggagaaggtacatgcctgacctcaacctggcggcagcgcaaaagatg

SEQ ID NO: 181391 - DNA, 103 bp, Artificial Sequence
  Synthetic Polynucleotide
taatacgactcactatagggtgccttgcccggcagtgccagcgaggtcagaacagaggagactgaccatgctggcactgaacctggcggcagcgcaaaagatg

SEQ ID NO: 181392 - DNA, 103 bp, Artificial Sequence
  Synthetic Polynucleotide
taatacgactcactatagggccacactctctgccttgcccggcagtgccaaacagaggagatggcacatgcgggcaaggaacctggcggcagcgcaaaagatg

SEQ ID NO: 181393 - DNA, 103 bp, Artificial Sequence
  Synthetic Polynucleotide
taatacgactcactataggggtgagcgacgccacactctctgccttgcccaacagaggagagggcaaatgagagagtgtaacctggcggcagcgcaaaagatg

SEQ ID NO: 181394 - DNA, 103 bp, Artificial Sequence
  Synthetic Polynucleotide
taatacgactcactataggggcactggctggtgagcgacgccacactctcaacagaggagagagagtatggcgtcgctcaacctggcggcagcgcaaaagatg

SEQ ID NO: 181395 - DNA, 103 bp, Artificial Sequence
  Synthetic Polynucleotide
taatacgactcactatagggggttactggggctgggcggaaattccgcgtaacagaggagaacgcggatgttccgcccaaacctggcggcagcgcaaaagatg

SEQ ID NO: 181396 - DNA, 103 bp, Artificial Sequence
  Synthetic Polynucleotide
taatacgactcactatagggcatccggtggctccaccagcatccccagctaacagaggagaagctggatgtgctggtggaacctggcggcagcgcaaaagatg

SEQ ID NO: 181397 - DNA, 103 bp, Artificial Sequence
  Synthetic Polynucleotide
taatacgactcactatagggtgctgtagctgcactggctggtgagcgacgaacagaggagacgtcgcatgccagccagtaacctggcggcagcgcaaaagatg

SEQ ID NO: 181398 - DNA, 103 bp, Artificial Sequence
  Synthetic Polynucleotide
taatacgactcactatagggacgatggtgctgctgtagctgcactggctgaacagaggagacagccaatgcagctacagaacctggcggcagcgcaaaagatg

SEQ ID NO: 181399 - DNA, 103 bp, Artificial Sequence
  Synthetic Polynucleotide
taatacgactcactatagggtcccacatggacgatggtgctgctgtagctaacagaggagaagctacatgagcaccatcaacctggcggcagcgcaaaagatg

SEQ ID NO: 181400 - DNA, 103 bp, Artificial Sequence
  Synthetic Polynucleotide
taatacgactcactataggggcttcttgtctcccacatggacgatggtgcaacagaggagagcaccaatgtccatgtggaacctggcggcagcgcaaaagatg

SEQ ID NO: 181401 - DNA, 103 bp, Artificial Sequence
  Synthetic Polynucleotide
taatacgactcactatagggtccggctgcggcttcttgtctcccacatggaacagaggagaccatgtatgagacaagaaaacctggcggcagcgcaaaagatg

SEQ ID NO: 181402 - DNA, 103 bp, Artificial Sequence
  Synthetic Polynucleotide
taatacgactcactatagggcatctctaactccggctgcggcttcttgtcaacagaggagagacaagatgccgcagccgaacctggcggcagcgcaaaagatg

SEQ ID NO: 181403 - DNA, 103 bp, Artificial Sequence
  Synthetic Polynucleotide
taatacgactcactatagggcatcttccaccatctctaactccggctgcgaacagaggagacgcagcatgagttagagaaacctggcggcagcgcaaaagatg

SEQ ID NO: 181404 - DNA, 103 bp, Artificial Sequence
  Synthetic Polynucleotide
taatacgactcactatagggccactcgcagcatcttccaccatctctaacaacagaggagagttagaatgggtggaagaaacctggcggcagcgcaaaagatg

SEQ ID NO: 181405 - DNA, 103 bp, Artificial Sequence
  Synthetic Polynucleotide
taatacgactcactatagggggattctggcccactcgcagcatcttccacaacagaggagagtggaaatggctgcgagtaacctggcggcagcgcaaaagatg

SEQ ID NO: 181406 - DNA, 103 bp, Artificial Sequence
  Synthetic Polynucleotide
taatacgactcactatagggggcagtccagggattctggcccactcgcagaacagaggagactgcgaatgggccagaataacctggcggcagcgcaaaagatg

SEQ ID NO: 181407 - DNA, 103 bp, Artificial Sequence
  Synthetic Polynucleotide
taatacgactcactatagggctctggcgggcatccggtggctccaccagcaacagaggagagctggtatggccaccggaaacctggcggcagcgcaaaagatg

SEQ ID NO: 181408 - DNA, 103 bp, Artificial Sequence
  Synthetic Polynucleotide
taatacgactcactataggggggcccgccaggcagtccagggattctggcaacagaggagagccagaatgcctggactgaacctggcggcagcgcaaaagatg

SEQ ID NO: 181409 - DNA, 103 bp, Artificial Sequence
  Synthetic Polynucleotide
taatacgactcactatagggggccagggcagggcccgccaggcagtccagaacagaggagactggacatgctggcgggcaacctggcggcagcgcaaaagatg

SEQ ID NO: 181410 - DNA, 103 bp, Artificial Sequence
  Synthetic Polynucleotide
taatacgactcactatagggtgagaccacaggccagggcagggcccgccaaacagaggagatggcggatgctgccctggaacctggcggcagcgcaaaagatg

SEQ ID NO: 181411 - DNA, 103 bp, Artificial Sequence
  Synthetic Polynucleotide
taatacgactcactatagggttctcttggctgagaccacaggccagggcaaacagaggagatgccctatgctgtggtctaacctggcggcagcgcaaaagatg

SEQ ID NO: 181412 - DNA, 103 bp, Artificial Sequence
  Synthetic Polynucleotide
taatacgactcactataggggaagggctccttctcttggctgagaccacaaacagaggagatgtggtatgagccaagagaacctggcggcagcgcaaaagatg

SEQ ID NO: 181413 - DNA, 103 bp, Artificial Sequence
  Synthetic Polynucleotide
taatacgactcactatagggccagcttcttgaagggctccttctcttggcaacagaggagagccaagatgaggagccctaacctggcggcagcgcaaaagatg

SEQ ID NO: 181414 - DNA, 103 bp, Artificial Sequence
  Synthetic Polynucleotide
taatacgactcactatagggttggtgaggcccagcttcttgaagggctccaacagaggagaggagccatgcaagaagctaacctggcggcagcgcaaaagatg

SEQ ID NO: 181415 - DNA, 103 bp, Artificial Sequence
  Synthetic Polynucleotide
taatacgactcactataggggagtacctccttggtgaggcccagcttcttaacagaggagaaagaagatgggcctcaccaacctggcggcagcgcaaaagatg

SEQ ID NO: 181416 - DNA, 103 bp, Artificial Sequence
  Synthetic Polynucleotide
taatacgactcactatagggtgtgtgcagcgagtacctccttggtgaggcaacagaggagagcctcaatgaggaggtacaacctggcggcagcgcaaaagatg

SEQ ID NO: 181417 - DNA, 103 bp, Artificial Sequence
  Synthetic Polynucleotide
taatacgactcactatagggtccttctgtgtgtgtgcagcgagtacctccaacagaggagaggaggtatgcgctgcacaaacctggcggcagcgcaaaagatg

SEQ ID NO: 181418 - DNA, 103 bp, Artificial Sequence
  Synthetic Polynucleotide
taatacgactcactatagggggtatctggactctggcgggcatccggtggaacagaggagaccaccgatggcccgccagaacctggcggcagcgcaaaagatg

SEQ ID NO: 181419 - DNA, 103 bp, Artificial Sequence
  Synthetic Polynucleotide
taatacgactcactataggggctctgctcctccttctgtgtgtgtgcagcaacagaggagagctgcaatgacacagaagaacctggcggcagcgcaaaagatg

SEQ ID NO: 181420 - DNA, 103 bp, Artificial Sequence
  Synthetic Polynucleotide
taatacgactcactatagggtctgcaggaagctctgctcctccttctgtgaacagaggagacacagaatgaggagcagaaacctggcggcagcgcaaaagatg

SEQ ID NO: 181421 - DNA, 103 bp, Artificial Sequence
  Synthetic Polynucleotide
taatacgactcactatagggtctttgaacttctgcaggaagctctgctccaacagaggagaggagcaatgcttcctgcaaacctggcggcagcgcaaaagatg

SEQ ID NO: 181422 - DNA, 103 bp, Artificial Sequence
  Synthetic Polynucleotide
taatacgactcactatagggttttcttatttctttgaacttctgcaggaaaacagaggagattcctgatgaagttcaaaaacctggcggcagcgcaaaagatg

SEQ ID NO: 181423 - DNA, 103 bp, Artificial Sequence
  Synthetic Polynucleotide
taatacgactcactatagggaaatgctgagttttcttatttctttgaactaacagaggagaagttcaatgaaataagaaaacctggcggcagcgcaaaagatg

SEQ ID NO: 181424 - DNA, 103 bp, Artificial Sequence
  Synthetic Polynucleotide
taatacgactcactatagggtgggactggaaaatgctgagttttcttattaacagaggagaaataagatgactcagcataacctggcggcagcgcaaaagatg

SEQ ID NO: 181425 - DNA, 103 bp, Artificial Sequence
  Synthetic Polynucleotide
taatacgactcactataggggtaatggcagtgggactggaaaatgctgagaacagaggagactcagcatgttccagtccaacctggcggcagcgcaaaagatg

SEQ ID NO: 181426 - DNA, 103 bp, Artificial Sequence
  Synthetic Polynucleotide
taatacgactcactatagggcttgcaagtagtaatggcagtgggactggaaacagaggagatccagtatgactgccattaacctggcggcagcgcaaaagatg

SEQ ID NO: 181427 - DNA, 103 bp, Artificial Sequence
  Synthetic Polynucleotide
taatacgactcactatagggttggatctttcttgcaagtagtaatggcagaacagaggagactgccaatgctacttgcaaacctggcggcagcgcaaaagatg

SEQ ID NO: 181428 - DNA, 103 bp, Artificial Sequence
  Synthetic Polynucleotide
taatacgactcactatagggtggctgccccttggatctttcttgcaagtaaacagaggagatacttgatggaaagatccaacctggcggcagcgcaaaagatg

SEQ ID NO: 181429 - DNA, 103 bp, Artificial Sequence
  Synthetic Polynucleotide
taatacgactcactatagggtcaggctaaaggtatctggactctggcgggaacagaggagacccgccatggtccagataaacctggcggcagcgcaaaagatg

SEQ ID NO: 181430 - DNA, 103 bp, Artificial Sequence
  Synthetic Polynucleotide
taatacgactcactatagggttcgttcacttggctgccccttggatctttaacagaggagaaaagatatgaggggcagcaacctggcggcagcgcaaaagatg

SEQ ID NO: 181431 - DNA, 103 bp, Artificial Sequence
  Synthetic Polynucleotide
taatacgactcactatagggccaggggcagttcgttcacttggctgccccaacagaggagaggggcaatgaagtgaacgaacctggcggcagcgcaaaagatg

SEQ ID NO: 181432 - DNA, 103 bp, Artificial Sequence
  Synthetic Polynucleotide
taatacgactcactatagggatttcttagtccaggggcagttcgttcactaacagaggagaagtgaaatgactgcccctaacctggcggcagcgcaaaagatg

SEQ ID NO: 181433 - DNA, 103 bp, Artificial Sequence
  Synthetic Polynucleotide
taatacgactcactatagggttccggaagtatttcttagtccaggggcagaacagaggagactgcccatggactaagaaaacctggcggcagcgcaaaagatg

SEQ ID NO: 181434 - DNA, 103 bp, Artificial Sequence
  Synthetic Polynucleotide
taatacgactcactatagggggtgaatctattccggaagtatttcttagtaacagaggagaactaagatgtacttccggaacctggcggcagcgcaaaagatg

SEQ ID NO: 181435 - DNA, 103 bp, Artificial Sequence
  Synthetic Polynucleotide
taatacgactcactatagggttttttccaaggtgaatctattccggaagtaacagaggagaacttccatgatagattcaaacctggcggcagcgcaaaagatg

SEQ ID NO: 181436 - DNA, 103 bp, Artificial Sequence
  Synthetic Polynucleotide
taatacgactcactatagggtctttcctgtttttttccaaggtgaatctaaacagaggagatagattatgcttggaaaaaacctggcggcagcgcaaaagatg

SEQ ID NO: 181437 - DNA, 103 bp, Artificial Sequence
  Synthetic Polynucleotide
taatacgactcactatagggaattttctgttctttcctgtttttttccaaaacagaggagattggaaatgaacaggaaaaacctggcggcagcgcaaaagatg

SEQ ID NO: 181438 - DNA, 103 bp, Artificial Sequence
  Synthetic Polynucleotide
taatacgactcactatagggcttggacttcaattttctgttctttcctgtaacagaggagaacaggaatgaacagaaaaaacctggcggcagcgcaaaagatg

SEQ ID NO: 181439 - DNA, 103 bp, Artificial Sequence
  Synthetic Polynucleotide
taatacgactcactataggggtttgacccgcttggacttcaattttctgtaacagaggagaacagaaatgtgaagtccaaacctggcggcagcgcaaaagatg

SEQ ID NO: 181440 - DNA, 103 bp, Artificial Sequence
  Synthetic Polynucleotide
taatacgactcactatagggtttgccatcatcaggctaaaggtatctggaaacagaggagatccagaatgctttagcctaacctggcggcagcgcaaaagatg

SEQ ID NO: 181441 - DNA, 103 bp, Artificial Sequence
  Synthetic Polynucleotide
taatacgactcactataggggagtctcgaggtttgacccgcttggacttcaacagaggagagaagtcatggcgggtcaaaacctggcggcagcgcaaaagatg

SEQ ID NO: 181442 - DNA, 103 bp, Artificial Sequence
  Synthetic Polynucleotide
taatacgactcactataggggctctcagatgagtctcgaggtttgacccgaacagaggagacgggtcatgcctcgagacaacctggcggcagcgcaaaagatg

SEQ ID NO: 181443 - DNA, 103 bp, Artificial Sequence
  Synthetic Polynucleotide
taatacgactcactatagggcagatccggtgctctcagatgagtctcgagaacagaggagactcgagatgcatctgagaaacctggcggcagcgcaaaagatg

SEQ ID NO: 181444 - DNA, 103 bp, Artificial Sequence
  Synthetic Polynucleotide
taatacgactcactatagggacgggccccccagatccggtgctctcagataacagaggagaatctgaatgcaccggatcaacctggcggcagcgcaaaagatg

SEQ ID NO: 181445 - DNA, 103 bp, Artificial Sequence
  Synthetic Polynucleotide
taatacgactcactatagggccgggcggacacgggccccccagatccggtaacagaggagaaccggaatgggggggcccaacctggcggcagcgcaaaagatg

SEQ ID NO: 181446 - DNA, 103 bp, Artificial Sequence
  Synthetic Polynucleotide
taatacgactcactatagggccagcgggggccgggcggacacgggcccccaacagaggagagggggcatgtgtccgcccaacctggcggcagcgcaaaagatg

SEQ ID NO: 181447 - DNA, 103 bp, Artificial Sequence
  Synthetic Polynucleotide
taatacgactcactatagggttcaagcccaccagcgggggccgggcggacaacagaggagagtccgcatggcccccgctaacctggcggcagcgcaaaagatg

SEQ ID NO: 181448 - DNA, 103 bp, Artificial Sequence
  Synthetic Polynucleotide
taatacgactcactatagggggctgtggcgttcaagcccaccagcgggggaacagaggagacccccgatggtgggcttgaacctggcggcagcgcaaaagatg

SEQ ID NO: 181449 - DNA, 103 bp, Artificial Sequence
  Synthetic Polynucleotide
taatacgactcactatagggagggtgaccaggctgtggcgttcaagcccaaacagaggagatgggctatgacgccacagaacctggcggcagcgcaaaagatg

SEQ ID NO: 181450 - DNA, 103 bp, Artificial Sequence
  Synthetic Polynucleotide
taatacgactcactataggggacgtgtctgagggtgaccaggctgtggcgaacagaggagacgccacatgctggtcaccaacctggcggcagcgcaaaagatg

SEQ ID NO: 181451 - DNA, 103 bp, Artificial Sequence
  Synthetic Polynucleotide
taatacgactcactataggggtgttcagattttgccatcatcaggctaaaaacagaggagatttagcatgatgatggcaaacctggcggcagcgcaaaagatg

SEQ ID NO: 181452 - DNA, 103 bp, Artificial Sequence
  Synthetic Polynucleotide
taatacgactcactataggggctggactgggacgtgtctgagggtgaccaaacagaggagatggtcaatgtcagacacgaacctggcggcagcgcaaaagatg

SEQ ID NO: 181453 - DNA, 103 bp, Artificial Sequence
  Synthetic Polynucleotide
taatacgactcactatagggcggctgggcagctggactgggacgtgtctgaacagaggagacagacaatgcccagtccaaacctggcggcagcgcaaaagatg

SEQ ID NO: 181454 - DNA, 103 bp, Artificial Sequence
  Synthetic Polynucleotide
taatacgactcactatagggggaaagggcacggctgggcagctggactggaacagaggagaccagtcatgctgcccagcaacctggcggcagcgcaaaagatg

SEQ ID NO: 181455 - DNA, 103 bp, Artificial Sequence
  Synthetic Polynucleotide
taatacgactcactatagggcactggggcgggaaagggcacggctgggcaaacagaggagatgcccaatggtgccctttaacctggcggcagcgcaaaagatg

SEQ ID NO: 181456 - DNA, 103 bp, Artificial Sequence
  Synthetic Polynucleotide
taatacgactcactatagggaagctgctggcactggggcgggaaagggcaaacagaggagatgccctatgccgccccagaacctggcggcagcgcaaaagatg

SEQ ID NO: 181457 - DNA, 103 bp, Artificial Sequence
  Synthetic Polynucleotide
taatacgactcactatagggggcagtgaataagctgctggcactggggcgaacagaggagacgccccatggccagcagcaacctggcggcagcgcaaaagatg

SEQ ID NO: 181458 - DNA, 103 bp, Artificial Sequence
  Synthetic Polynucleotide
taatacgactcactatagggtggaaacacgggcagtgaataagctgctggaacagaggagaccagcaatgtattcactgaacctggcggcagcgcaaaagatg

SEQ ID NO: 181459 - DNA, 103 bp, Artificial Sequence
  Synthetic Polynucleotide
taatacgactcactatagggtccctggcgctggaaacacgggcagtgaataacagaggagaattcacatgccgtgtttcaacctggcggcagcgcaaaagatg

SEQ ID NO: 181460 - DNA, 103 bp, Artificial Sequence
  Synthetic Polynucleotide
taatacgactcactataggggctgccacagtccctggcgctggaaacacgaacagaggagacgtgttatgagcgccaggaacctggcggcagcgcaaaagatg

SEQ ID NO: 181461 - DNA, 103 bp, Artificial Sequence
  Synthetic Polynucleotide
taatacgactcactatagggtgccgggggtgctgccacagtccctggcgcaacagaggagagcgccaatgactgtggcaaacctggcggcagcgcaaaagatg

SEQ ID NO: 181462 - DNA, 103 bp, Artificial Sequence
  Synthetic Polynucleotide
taatacgactcactatagggtagatgggttgtgttcagattttgccatcaaacagaggagatgatggatgaatctgaacaacctggcggcagcgcaaaagatg

SEQ ID NO: 181463 - DNA, 103 bp, Artificial Sequence
  Synthetic Polynucleotide
taatacgactcactatagggcgtggggaggtgccgggggtgctgccacagaacagaggagactgtggatgcacccccggaacctggcggcagcgcaaaagatg

SEQ ID NO: 181464 - DNA, 103 bp, Artificial Sequence
  Synthetic Polynucleotide
taatacgactcactataggggtgaagctggcgtggggaggtgccgggggtaacagaggagaacccccatgacctccccaaacctggcggcagcgcaaaagatg

SEQ ID NO: 181465 - DNA, 103 bp, Artificial Sequence
  Synthetic Polynucleotide
taatacgactcactatagggagcaggcactgtgaagctggcgtggggaggaacagaggagacctcccatggccagcttcaacctggcggcagcgcaaaagatg

SEQ ID NO: 181466 - DNA, 103 bp, Artificial Sequence
  Synthetic Polynucleotide
taatacgactcactatagggccacgggcacagcaggcactgtgaagctggaacagaggagaccagctatgcagtgcctgaacctggcggcagcgcaaaagatg

SEQ ID NO: 181467 - DNA, 103 bp, Artificial Sequence
  Synthetic Polynucleotide
taatacgactcactatagggtgctggaggtccacgggcacagcaggcactaacagaggagaagtgccatgtgtgcccgtaacctggcggcagcgcaaaagatg

SEQ ID NO: 181468 - DNA, 103 bp, Artificial Sequence
  Synthetic Polynucleotide
taatacgactcactatagggtgcaaactggtgctggaggtccacgggcacaacagaggagagtgcccatggacctccagaacctggcggcagcgcaaaagatg

SEQ ID NO: 181469 - DNA, 103 bp, Artificial Sequence
  Synthetic Polynucleotide
taatacgactcactatagggggggctggactgcaaactggtgctggaggtaacagaggagaacctccatgaccagtttgaacctggcggcagcgcaaaagatg

SEQ ID NO: 181470 - DNA, 103 bp, Artificial Sequence
  Synthetic Polynucleotide
taatacgactcactataggggggaaaggtgggggctggactgcaaactggaacagaggagaccagttatgagtccagccaacctggcggcagcgcaaaagatg

SEQ ID NO: 181471 - DNA, 103 bp, Artificial Sequence
  Synthetic Polynucleotide
taatacgactcactatagggcaaaggggcagggaaaggtgggggctggacaacagaggagagtccagatgccacctttcaacctggcggcagcgcaaaagatg

SEQ ID NO: 181472 - DNA, 103 bp, Artificial Sequence
  Synthetic Polynucleotide
taatacgactcactatagggtgacaggcgccaaaggggcagggaaaggtgaacagaggagacaccttatgctgccccttaacctggcggcagcgcaaaagatg

SEQ ID NO: 181473 - DNA, 103 bp, Artificial Sequence
  Synthetic Polynucleotide
taatacgactcactatagggcagccacttgtagatgggttgtgttcagataacagaggagaatctgaatgcaacccatcaacctggcggcagcgcaaaagatg

SEQ ID NO: 181474 - DNA, 103 bp, Artificial Sequence
  Synthetic Polynucleotide
taatacgactcactatagggatgaatgccatgacaggcgccaaaggggcaaacagaggagatgccccatgggcgcctgtaacctggcggcagcgcaaaagatg

SEQ ID NO: 181475 - DNA, 103 bp, Artificial Sequence
  Synthetic Polynucleotide
taatacgactcactatagggactgggtagcatgaatgccatgacaggcgcaacagaggagagcgcctatgatggcattcaacctggcggcagcgcaaaagatg

SEQ ID NO: 181476 - DNA, 103 bp, Artificial Sequence
  Synthetic Polynucleotide
taatacgactcactatagggggaaggaataactgggtagcatgaatgccaaacagaggagatggcatatgtgctacccaaacctggcggcagcgcaaaagatg

SEQ ID NO: 181477 - DNA, 103 bp, Artificial Sequence
  Synthetic Polynucleotide
taatacgactcactataggggtccccgaggggaaggaataactgggtagcaacagaggagagctaccatgttattccttaacctggcggcagcgcaaaagatg

SEQ ID NO: 181478 - DNA, 103 bp, Artificial Sequence
  Synthetic Polynucleotide
taatacgactcactatagggcaggtttggggtccccgaggggaaggaataaacagaggagatattccatgccctcggggaacctggcggcagcgcaaaagatg

SEQ ID NO: 181479 - DNA, 103 bp, Artificial Sequence
  Synthetic Polynucleotide
taatacgactcactatagggaggcctggggcaggtttggggtccccgaggaacagaggagacctcggatgccccaaaccaacctggcggcagcgcaaaagatg

SEQ ID NO: 181480 - DNA, 103 bp, Artificial Sequence
  Synthetic Polynucleotide
taatacgactcactatagggctggggaagaaggcctggggcaggtttgggaacagaggagacccaaaatggccccaggcaacctggcggcagcgcaaaagatg

SEQ ID NO: 181481 - DNA, 103 bp, Artificial Sequence
  Synthetic Polynucleotide
taatacgactcactatagggctgaggctggctggggaagaaggcctggggaacagaggagaccccagatgttcttccccaacctggcggcagcgcaaaagatg

SEQ ID NO: 181482 - DNA, 103 bp, Artificial Sequence
  Synthetic Polynucleotide
taatacgactcactatagggggctcggaaactgaggctggctggggaagaaacagaggagatcttccatggccagcctcaacctggcggcagcgcaaaagatg

SEQ ID NO: 181483 - DNA, 103 bp, Artificial Sequence
  Synthetic Polynucleotide
taatacgactcactatagggagtgtggggtggctcggaaactgaggctggaacagaggagaccagccatggtttccgagaacctggcggcagcgcaaaagatg

SEQ ID NO: 181484 - DNA, 103 bp, Artificial Sequence
  Synthetic Polynucleotide
taatacgactcactataggggtcgctactgcagccacttgtagatgggttaacagaggagaaacccaatgacaagtggcaacctggcggcagcgcaaaagatg

SEQ ID NO: 181485 - DNA, 103 bp, Artificial Sequence
  Synthetic Polynucleotide
taatacgactcactatagggctcggatgtgagtgtggggtggctcggaaaaacagaggagatttccgatgcaccccacaaacctggcggcagcgcaaaagatg

SEQ ID NO: 181486 - DNA, 103 bp, Artificial Sequence
  Synthetic Polynucleotide
taatacgactcactatagggcagaggccatctcggatgtgagtgtggggtaacagaggagaaccccaatgtcacatccgaacctggcggcagcgcaaaagatg

SEQ ID NO: 181487 - DNA, 103 bp, Artificial Sequence
  Synthetic Polynucleotide
taatacgactcactatagggggctgtgaggcagaggccatctcggatgtgaacagaggagacacatcatggatggcctcaacctggcggcagcgcaaaagatg

SEQ ID NO: 181488 - DNA, 103 bp, Artificial Sequence
  Synthetic Polynucleotide
taatacgactcactatagggggggaactcaggctgtgaggcagaggccataacagaggagaatggccatggcctcacagaacctggcggcagcgcaaaagatg

SEQ ID NO: 181489 - DNA, 103 bp, Artificial Sequence
  Synthetic Polynucleotide
taatacgactcactatagggaggtccggctggggaactcaggctgtgaggaacagaggagacctcacatgctgagttccaacctggcggcagcgcaaaagatg

SEQ ID NO: 181490 - DNA, 103 bp, Artificial Sequence
  Synthetic Polynucleotide
taatacgactcactatagggctggggatcgaggtccggctggggaactcaaacagaggagatgagttatgcagccggacaacctggcggcagcgcaaaagatg

SEQ ID NO: 181491 - DNA, 103 bp, Artificial Sequence
  Synthetic Polynucleotide
taatacgactcactatagggacatggctgtctggggatcgaggtccggctaacagaggagaagccggatgtcgatccccaacctggcggcagcgcaaaagatg

SEQ ID NO: 181492 - DNA, 103 bp, Artificial Sequence
  Synthetic Polynucleotide
taatacgactcactatagggctggacaagcacatggctgtctggggatcgaacagaggagacgatccatggacagccataacctggcggcagcgcaaaagatg

SEQ ID NO: 181493 - DNA, 103 bp, Artificial Sequence
  Synthetic Polynucleotide
taatacgactcactataggggcccgggtggctggacaagcacatggctgtaacagaggagaacagccatgtgcttgtccaacctggcggcagcgcaaaagatg

SEQ ID NO: 181494 - DNA, 103 bp, Artificial Sequence
  Synthetic Polynucleotide
taatacgactcactatagggtggtggggtggcccgggtggctggacaagcaacagaggagagcttgtatggccacccggaacctggcggcagcgcaaaagatg

SEQ ID NO: 181495 - DNA, 103 bp, Artificial Sequence
  Synthetic Polynucleotide
taatacgactcactatagggtcgaagactggtcgctactgcagccacttgaacagaggagacaagtgatggcagtagcgaacctggcggcagcgcaaaagatg

SEQ ID NO: 181496 - DNA, 103 bp, Artificial Sequence
  Synthetic Polynucleotide
taatacgactcactatagggccatggccgatggtggggtggcccgggtggaacagaggagaccacccatgccaccccacaacctggcggcagcgcaaaagatg

SEQ ID NO: 181497 - DNA, 103 bp, Artificial Sequence
  Synthetic Polynucleotide
taatacgactcactataggggaggccctacccatggccgatggtggggtgaacagaggagacaccccatgatcggccataacctggcggcagcgcaaaagatg

SEQ ID NO: 181498 - DNA, 103 bp, Artificial Sequence
  Synthetic Polynucleotide
taatacgactcactataggggagcggtggggaggccctacccatggccgaaacagaggagatcggccatgggtagggccaacctggcggcagcgcaaaagatg

SEQ ID NO: 181499 - DNA, 103 bp, Artificial Sequence
  Synthetic Polynucleotide
taatacgactcactataggggggactgaaagagcggtggggaggccctacaacagaggagagtagggatgccccaccgcaacctggcggcagcgcaaaagatg

SEQ ID NO: 181500 - DNA, 103 bp, Artificial Sequence
  Synthetic Polynucleotide
taatacgactcactataggggagctgctgcgggactgaaagagcggtgggaacagaggagacccaccatgctttcagtcaacctggcggcagcgcaaaagatg

SEQ ID NO: 181501 - DNA, 103 bp, Artificial Sequence
  Synthetic Polynucleotide
taatacgactcactatagggctgcaggggcgagctgctgcgggactgaaaaacagaggagatttcagatgcgcagcagcaacctggcggcagcgcaaaagatg

SEQ ID NO: 181502 - DNA, 103 bp, Artificial Sequence
  Synthetic Polynucleotide
taatacgactcactataggggcaggttgagctgcaggggcgagctgctgcaacagaggagagcagcaatgcgcccctgcaacctggcggcagcgcaaaagatg

SEQ ID NO: 181503 - DNA, 103 bp, Artificial Sequence
  Synthetic Polynucleotide
taatacgactcactatagggtccagctgcagcaggttgagctgcaggggcaacagaggagagcccctatggctcaacctaacctggcggcagcgcaaaagatg

SEQ ID NO: 181504 - DNA, 103 bp, Artificial Sequence
  Synthetic Polynucleotide
taatacgactcactatagggaggggcttcctccagctgcagcaggttgagaacagaggagactcaacatgctgcagctgaacctggcggcagcgcaaaagatg

SEQ ID NO: 181505 - DNA, 103 bp, Artificial Sequence
  Synthetic Polynucleotide
taatacgactcactatagggtgccaccctcaggggcttcctccagctgcaaacagaggagatgcagcatgaggaagcccaacctggcggcagcgcaaaagatg

SEQ ID NO: 181506 - DNA, 103 bp, Artificial Sequence
  Synthetic Polynucleotide
taatacgactcactatagggtccttggtggggttactggggctgggcggaaacagaggagatccgccatgccccagtaaaacctggcggcagcgcaaaagatg

SEQ ID NO: 181507 - DNA, 103 bp, Artificial Sequence
  Synthetic Polynucleotide
taatacgactcactataggggtgtccactttcgaagactggtcgctactgaacagaggagacagtagatgccagtcttcaacctggcggcagcgcaaaagatg

SEQ ID NO: 181508 - DNA, 103 bp, Artificial Sequence
  Synthetic Polynucleotide
taatacgactcactatagggatggctccagtgccaccctcaggggcttccaacagaggagaggaagcatgtgagggtggaacctggcggcagcgcaaaagatg

SEQ ID NO: 181509 - DNA, 103 bp, Artificial Sequence
  Synthetic Polynucleotide
taatacgactcactatagggtgtggtccccatggctccagtgccaccctcaacagaggagagagggtatgactggagccaacctggcggcagcgcaaaagatg

SEQ ID NO: 181510 - DNA, 103 bp, Artificial Sequence
  Synthetic Polynucleotide
taatacgactcactatagggctgtggcccctgtggtccccatggctccagaacagaggagactggagatgtggggaccaaacctggcggcagcgcaaaagatg

SEQ ID NO: 181511 - DNA, 103 bp, Artificial Sequence
  Synthetic Polynucleotide
taatacgactcactataggggctgctgtctctgtggcccctgtggtccccaacagaggagaggggacatgaggggccacaacctggcggcagcgcaaaagatg

SEQ ID NO: 181512 - DNA, 103 bp, Artificial Sequence
  Synthetic Polynucleotide
taatacgactcactatagggcgcccctacagctgctgtctctgtggccccaacagaggagaggggccatggagacagcaaacctggcggcagcgcaaaagatg

SEQ ID NO: 181513 - DNA, 103 bp, Artificial Sequence
  Synthetic Polynucleotide
taatacgactcactataggggtttgcagtccgcccctacagctgctgtctaacagaggagaagacagatgctgtaggggaacctggcggcagcgcaaaagatg

SEQ ID NO: 181514 - DNA, 103 bp, Artificial Sequence
  Synthetic Polynucleotide
taatacgactcactataggggaagtgccaggtttgcagtccgcccctacaaacagaggagatgtaggatgggactgcaaaacctggcggcagcgcaaaagatg

SEQ ID NO: 181515 - DNA, 103 bp, Artificial Sequence
  Synthetic Polynucleotide
taatacgactcactatagggctggtcccgagaagtgccaggtttgcagtcaacagaggagagactgcatgcctggcactaacctggcggcagcgcaaaagatg

SEQ ID NO: 181516 - DNA, 103 bp, Artificial Sequence
  Synthetic Polynucleotide
taatacgactcactatagggccttcggctgctggtcccgagaagtgccagaacagaggagactggcaatgctcgggaccaacctggcggcagcgcaaaagatg

SEQ ID NO: 181517 - DNA, 103 bp, Artificial Sequence
  Synthetic Polynucleotide
taatacgactcactataggggtcagaggcgccttcggctgctggtcccgaaacagaggagatcgggaatggcagccgaaaacctggcggcagcgcaaaagatg

SEQ ID NO: 181518 - DNA, 103 bp, Artificial Sequence
  Synthetic Polynucleotide
taatacgactcactatagggttctttgtgtgtgtccactttcgaagactgaacagaggagacagtctatgaaagtggacaacctggcggcagcgcaaaagatg

SEQ ID NO: 181519 - DNA, 103 bp, Artificial Sequence
  Synthetic Polynucleotide
taatacgactcactatagggttcatcacgggtcagaggcgccttcggctgaacagaggagacagccgatggcgcctctgaacctggcggcagcgcaaaagatg

SEQ ID NO: 181520 - DNA, 103 bp, Artificial Sequence
  Synthetic Polynucleotide
taatacgactcactatagggtgtctgagggttcatcacgggtcagaggcgaacagaggagacgcctcatgcccgtgatgaacctggcggcagcgcaaaagatg

SEQ ID NO: 181521 - DNA, 103 bp, Artificial Sequence
  Synthetic Polynucleotide
taatacgactcactatagggctgttctgtgtgtctgagggttcatcacggaacagaggagaccgtgaatgaccctcagaaacctggcggcagcgcaaaagatg

SEQ ID NO: 181522 - DNA, 103 bp, Artificial Sequence
  Synthetic Polynucleotide
taatacgactcactatagggaagggcgtcactgttctgtgtgtctgagggaacagaggagaccctcaatgacacagaacaacctggcggcagcgcaaaagatg

SEQ ID NO: 181523 - DNA, 103 bp, Artificial Sequence
  Synthetic Polynucleotide
taatacgactcactatagggttgacgtggaaagggcgtcactgttctgtgaacagaggagacacagaatggtgacgcccaacctggcggcagcgcaaaagatg

SEQ ID NO: 181524 - DNA, 103 bp, Artificial Sequence
  Synthetic Polynucleotide
taatacgactcactatagggaggaggccgcttgacgtggaaagggcgtcaaacagaggagatgacgcatgttccacgtcaacctggcggcagcgcaaaagatg

SEQ ID NO: 181525 - DNA, 103 bp, Artificial Sequence
  Synthetic Polynucleotide
taatacgactcactatagggcaggaggtttaggaggccgcttgacgtggaaacagaggagatccacgatgagcggcctcaacctggcggcagcgcaaaagatg

SEQ ID NO: 181526 - DNA, 103 bp, Artificial Sequence
  Synthetic Polynucleotide
taatacgactcactatagggcctcattcagcaggaggtttaggaggccgcaacagaggagagcggccatgtaaacctccaacctggcggcagcgcaaaagatg

SEQ ID NO: 181527 - DNA, 103 bp, Artificial Sequence
  Synthetic Polynucleotide
taatacgactcactataggggagcagaggtcctcattcagcaggaggtttaacagaggagaaaacctatggctgaatgaaacctggcggcagcgcaaaagatg

SEQ ID NO: 181528 - DNA, 103 bp, Artificial Sequence
  Synthetic Polynucleotide
taatacgactcactataggggcccgaggctgagcagaggtcctcattcagaacagaggagactgaatatggacctctgcaacctggcggcagcgcaaaagatg

SEQ ID NO: 181529 - DNA, 103 bp, Artificial Sequence
  Synthetic Polynucleotide
taatacgactcactatagggtttttatcagttctttgtgtgtgtccacttaacagaggagaaagtggatgcacacaaagaacctggcggcagcgcaaaagatg

SEQ ID NO: 181530 - DNA, 103 bp, Artificial Sequence
  Synthetic Polynucleotide
taatacgactcactatagggaagcagcagagcccgaggctgagcagaggtaacagaggagaacctctatgcagcctcggaacctggcggcagcgcaaaagatg

SEQ ID NO: 181531 - DNA, 103 bp, Artificial Sequence
  Synthetic Polynucleotide
taatacgactcactatagggagagactccgaagcagcagagcccgaggctaacagaggagaagcctcatgctctgctgcaacctggcggcagcgcaaaagatg

SEQ ID NO: 181532 - DNA, 103 bp, Artificial Sequence
  Synthetic Polynucleotide
taatacgactcactataggggccggagcccagagactccgaagcagcagaaacagaggagatctgctatgtcggagtctaacctggcggcagcgcaaaagatg

SEQ ID NO: 181533 - DNA, 103 bp, Artificial Sequence
  Synthetic Polynucleotide
taatacgactcactatagggagcccagtgagccggagcccagagactccgaacagaggagacggagtatgtgggctccgaacctggcggcagcgcaaaagatg

SEQ ID NO: 181534 - DNA, 103 bp, Artificial Sequence
  Synthetic Polynucleotide
taatacgactcactataggggaggcgtcgcagcccagtgagccggagcccaacagaggagagggctcatgctcactgggaacctggcggcagcgcaaaagatg

SEQ ID NO: 181535 - DNA, 103 bp, Artificial Sequence
  Synthetic Polynucleotide
taatacgactcactatagggcccactcggggaggcgtcgcagcccagtgaaacagaggagatcactgatgtgcgacgccaacctggcggcagcgcaaaagatg

SEQ ID NO: 181536 - DNA, 103 bp, Artificial Sequence
  Synthetic Polynucleotide
taatacgactcactatagggtactgcctgccccactcggggaggcgtcgcaacagaggagagcgacgatgccccgagtgaacctggcggcagcgcaaaagatg

SEQ ID NO: 181537 - DNA, 103 bp, Artificial Sequence
  Synthetic Polynucleotide
taatacgactcactatagggcttgtgtcactactgcctgccccactcgggaacagaggagacccgagatgggcaggcagaacctggcggcagcgcaaaagatg

SEQ ID NO: 181538 - DNA, 103 bp, Artificial Sequence
  Synthetic Polynucleotide
taatacgactcactataggggctggtatgacttgtgtcactactgcctgcaacagaggagagcaggcatgagtgacacaaacctggcggcagcgcaaaagatg

SEQ ID NO: 181539 - DNA, 103 bp, Artificial Sequence
  Synthetic Polynucleotide
taatacgactcactatagggcaaaatatttgctggtatgacttgtgtcacaacagaggagagtgacaatggtcataccaaacctggcggcagcgcaaaagatg

SEQ ID NO: 181540 - DNA, 103 bp, Artificial Sequence
  Synthetic Polynucleotide
taatacgactcactatagggtcctttagtgtttttatcagttctttgtgtaacagaggagaacacaaatgactgataaaaacctggcggcagcgcaaaagatg

SEQ ID NO: 181541 - DNA, 103 bp, Artificial Sequence
  Synthetic Polynucleotide
taatacgactcactatagggtcaatgcttccaaaatatttgctggtatgaaacagaggagatcatacatgcaaatatttaacctggcggcagcgcaaaagatg

SEQ ID NO: 181542 - DNA, 103 bp, Artificial Sequence
  Synthetic Polynucleotide
taatacgactcactatagggctctgaggagtcaatgcttccaaaatatttaacagaggagaaaatatatgggaagcattaacctggcggcagcgcaaaagatg

SEQ ID NO: 181543 - DNA, 103 bp, Artificial Sequence
  Synthetic Polynucleotide
taatacgactcactatagggtgtgattattctctgaggagtcaatgcttcaacagaggagagaagcaatgactcctcagaacctggcggcagcgcaaaagatg

SEQ ID NO: 181544 - DNA, 103 bp, Artificial Sequence
  Synthetic Polynucleotide
taatacgactcactatagggatttttgctttgtgattattctctgaggagaacagaggagactcctcatggaataatcaaacctggcggcagcgcaaaagatg

SEQ ID NO: 181545 - DNA, 103 bp, Artificial Sequence
  Synthetic Polynucleotide
taatacgactcactatagggaccagtgttcatttttgctttgtgattattaacagaggagaaataatatgaaagcaaaaaacctggcggcagcgcaaaagatg

SEQ ID NO: 181546 - DNA, 103 bp, Artificial Sequence
  Synthetic Polynucleotide
taatacgactcactatagggtttcttccataccagtgttcatttttgcttaacagaggagaaagcaaatgtgaacactgaacctggcggcagcgcaaaagatg

SEQ ID NO: 181547 - DNA, 103 bp, Artificial Sequence
  Synthetic Polynucleotide
taatacgactcactatagggaaatgctcactttcttccataccagtgttcaacagaggagagaacacatgtatggaagaaacctggcggcagcgcaaaagatg

SEQ ID NO: 181548 - DNA, 103 bp, Artificial Sequence
  Synthetic Polynucleotide
taatacgactcactataggggcacttaatgaaatgctcactttcttccataacagaggagaatggaaatgagtgagcataacctggcggcagcgcaaaagatg

SEQ ID NO: 181549 - DNA, 103 bp, Artificial Sequence
  Synthetic Polynucleotide
taatacgactcactatagggcctgcaggacgcacttaatgaaatgctcacaacagaggagagtgagcatgtcattaagtaacctggcggcagcgcaaaagatg

SEQ ID NO: 181550 - DNA, 103 bp, Artificial Sequence
  Synthetic Polynucleotide
taatacgactcactatagggcagatgggatcctgcaggacgcacttaatgaacagaggagacattaaatgcgtcctgcaaacctggcggcagcgcaaaagatg

SEQ ID NO: 181551 - DNA, 103 bp, Artificial Sequence
  Synthetic Polynucleotide
taatacgactcactataggggaccttcagctcctttagtgtttttatcagaacagaggagactgataatgacactaaagaacctggcggcagcgcaaaagatg

SEQ ID NO: 181552 - DNA, 103 bp, Artificial Sequence
  Synthetic Polynucleotide
taatacgactcactatagggcatcagcagccagatgggatcctgcaggacaacagaggagagtcctgatggatcccatcaacctggcggcagcgcaaaagatg

SEQ ID NO: 181553 - DNA, 103 bp, Artificial Sequence
  Synthetic Polynucleotide
taatacgactcactatagggccgcatctgccatcagcagccagatgggataacagaggagaatcccaatgggctgctgaaacctggcggcagcgcaaaagatg

SEQ ID NO: 181554 - DNA, 103 bp, Artificial Sequence
  Synthetic Polynucleotide
taatacgactcactatagggacgctgctgtccgcatctgccatcagcagcaacagaggagagctgctatgggcagatgcaacctggcggcagcgcaaaagatg

SEQ ID NO: 181555 - DNA, 103 bp, Artificial Sequence
  Synthetic Polynucleotide
taatacgactcactatagggcgtcatcatgacgctgctgtccgcatctgcaacagaggagagcagatatggacagcagcaacctggcggcagcgcaaaagatg

SEQ ID NO: 181556 - DNA, 103 bp, Artificial Sequence
  Synthetic Polynucleotide
taatacgactcactataggggcagctggtacgtcatcatgacgctgctgtaacagaggagaacagcaatgtcatgatgaaacctggcggcagcgcaaaagatg

SEQ ID NO: 181557 - DNA, 103 bp, Artificial Sequence
  Synthetic Polynucleotide
taatacgactcactatagggtttcgggaaggcagctggtacgtcatcatgaacagaggagacatgatatggtaccagctaacctggcggcagcgcaaaagatg

SEQ ID NO: 181558 - DNA, 103 bp, Artificial Sequence
  Synthetic Polynucleotide
taatacgactcactatagggcgcttctaaatttcgggaaggcagctggtaaacagaggagataccagatgccttcccgaaacctggcggcagcgcaaaagatg

SEQ ID NO: 181559 - DNA, 103 bp, Artificial Sequence
  Synthetic Polynucleotide
taatacgactcactatagggccttcaaaaccgcttctaaatttcgggaagaacagaggagacttcccatgatttagaagaacctggcggcagcgcaaaagatg

SEQ ID NO: 181560 - DNA, 103 bp, Artificial Sequence
  Synthetic Polynucleotide
taatacgactcactatagggtctctgtcctccttcaaaaccgcttctaaaaacagaggagatttagaatgggttttgaaaacctggcggcagcgcaaaagatg

SEQ ID NO: 181561 - DNA, 103 bp, Artificial Sequence
  Synthetic Polynucleotide
taatacgactcactatagggcttcagcttctctctgtcctccttcaaaacaacagaggagagttttgatggaggacagaaacctggcggcagcgcaaaagatg

SEQ ID NO: 181562 - DNA, 103 bp, Artificial Sequence
  Synthetic Polynucleotide
taatacgactcactatagggcagggaggtggaccttcagctcctttagtgaacagaggagacactaaatgagctgaaggaacctggcggcagcgcaaaagatg

SEQ ID NO: 181563 - DNA, 103 bp, Artificial Sequence
  Synthetic Polynucleotide
taatacgactcactatagggtctgtaggagcttcagcttctctctgtcctaacagaggagaaggacaatgagaagctgaaacctggcggcagcgcaaaagatg

SEQ ID NO: 181564 - DNA, 103 bp, Artificial Sequence
  Synthetic Polynucleotide
taatacgactcactatagggggctggagtttctgtaggagcttcagcttcaacagaggagagaagctatggctcctacaaacctggcggcagcgcaaaagatg

SEQ ID NO: 181565 - DNA, 103 bp, Artificial Sequence
  Synthetic Polynucleotide
taatacgactcactatagggcgtgaacctgggctggagtttctgtaggagaacagaggagactcctaatgaaactccagaacctggcggcagcgcaaaagatg

SEQ ID NO: 181566 - DNA, 103 bp, Artificial Sequence
  Synthetic Polynucleotide
taatacgactcactatagggtctgactctccgtgaacctgggctggagttaacagaggagaaactccatgccaggttcaaacctggcggcagcgcaaaagatg

SEQ ID NO: 181567 - DNA, 103 bp, Artificial Sequence
  Synthetic Polynucleotide
taatacgactcactatagggagctcctgcttctgactctccgtgaacctgaacagaggagacaggttatgggagagtcaaacctggcggcagcgcaaaagatg

SEQ ID NO: 181568 - DNA, 103 bp, Artificial Sequence
  Synthetic Polynucleotide
taatacgactcactataggggacctcgcgcagctcctgcttctgactctcaacagaggagagagagtatgaagcaggagaacctggcggcagcgcaaaagatg

SEQ ID NO: 181569 - DNA, 103 bp, Artificial Sequence
  Synthetic Polynucleotide
taatacgactcactatagggtccactggtggacctcgcgcagctcctgctaacagaggagaagcaggatgtgcgcgaggaacctggcggcagcgcaaaagatg

SEQ ID NO: 181570 - DNA, 103 bp, Artificial Sequence
  Synthetic Polynucleotide
taatacgactcactatagggcccgtctgcatccactggtggacctcgcgcaacagaggagagcgcgaatgccaccagtgaacctggcggcagcgcaaaagatg

SEQ ID NO: 181571 - DNA, 103 bp, Artificial Sequence
  Synthetic Polynucleotide
taatacgactcactataggggggcaggccgcccgtctgcatccactggtgaacagaggagacaccagatgatgcagacgaacctggcggcagcgcaaaagatg

SEQ ID NO: 181572 - DNA, 103 bp, Artificial Sequence
  Synthetic Polynucleotide
taatacgactcactatagggcgatggctgcgggcaggccgcccgtctgcaaacagaggagatgcagaatggcggcctgcaacctggcggcagcgcaaaagatg

SEQ ID NO: 181573 - DNA, 103 bp, Artificial Sequence
  Synthetic Polynucleotide
taatacgactcactatagggttcttgtctgcagggaggtggaccttcagcaacagaggagagctgaaatgccacctcccaacctggcggcagcgcaaaagatg

SEQ ID NO: 181574 - DNA, 103 bp, Artificial Sequence
  Synthetic Polynucleotide
taatacgactcactatagggtctgccacgtcgatggctgcgggcaggccgaacagaggagacggcctatgcgcagccataacctggcggcagcgcaaaagatg

SEQ ID NO: 181575 - DNA, 103 bp, Artificial Sequence
  Synthetic Polynucleotide
taatacgactcactataggggtaaacacattctgccacgtcgatggctgcaacagaggagagcagccatggacgtggcaaacctggcggcagcgcaaaagatg

SEQ ID NO: 181576 - DNA, 103 bp, Artificial Sequence
  Synthetic Polynucleotide
taatacgactcactatagggtgttttcacagtaaacacattctgccacgtaacagaggagaacgtggatgaatgtgtttaacctggcggcagcgcaaaagatg

SEQ ID NO: 181577 - DNA, 103 bp, Artificial Sequence
  Synthetic Polynucleotide
taatacgactcactatagggcctttttccttgttttcacagtaaacacataacagaggagaatgtgtatgctgtgaaaaaacctggcggcagcgcaaaagatg

SEQ ID NO: 181578 - DNA, 103 bp, Artificial Sequence
  Synthetic Polynucleotide
taatacgactcactataggggcaaatattacctttttccttgttttcacaaacagaggagatgtgaaatgaaggaaaaaaacctggcggcagcgcaaaagatg

SEQ ID NO: 181579 - DNA, 103 bp, Artificial Sequence
  Synthetic Polynucleotide
taatacgactcactatagggcatatggtatgcaaatattacctttttcctaacagaggagaaggaaaatggtaatatttaacctggcggcagcgcaaaagatg

SEQ ID NO: 181580 - DNA, 103 bp, Artificial Sequence
  Synthetic Polynucleotide
taatacgactcactatagggatatcttcctcatatggtatgcaaatattaaacagaggagataatatatgcataccataaacctggcggcagcgcaaaagatg

SEQ ID NO: 181581 - DNA, 103 bp, Artificial Sequence
  Synthetic Polynucleotide
taatacgactcactatagggcagagaaggaatatcttcctcatatggtataacagaggagaataccaatggaggaagataacctggcggcagcgcaaaagatg

SEQ ID NO: 181582 - DNA, 103 bp, Artificial Sequence
  Synthetic Polynucleotide
taatacgactcactatagggcgctgagtcccagagaaggaatatcttcctaacagaggagaaggaagatgttccttctcaacctggcggcagcgcaaaagatg

SEQ ID NO: 181583 - DNA, 103 bp, Artificial Sequence
  Synthetic Polynucleotide
taatacgactcactatagggtccgacacttcgctgagtcccagagaaggaaacagaggagatccttcatggggactcagaacctggcggcagcgcaaaagatg

SEQ ID NO: 181584 - DNA, 103 bp, Artificial Sequence
  Synthetic Polynucleotide
taatacgactcactataggggcccttggccttcttgtctgcagggaggtgaacagaggagacacctcatggcagacaagaacctggcggcagcgcaaaagatg

SEQ ID NO: 181585 - DNA, 103 bp, Artificial Sequence
  Synthetic Polynucleotide
taatacgactcactatagggttctttggtgtccgacacttcgctgagtccaacagaggagaggactcatggaagtgtcgaacctggcggcagcgcaaaagatg

SEQ ID NO: 181586 - DNA, 103 bp, Artificial Sequence
  Synthetic Polynucleotide
taatacgactcactatagggcattttcgtcttctttggtgtccgacacttaacagaggagaaagtgtatgacaccaaagaacctggcggcagcgcaaaagatg

SEQ ID NO: 181587 - DNA, 103 bp, Artificial Sequence
  Synthetic Polynucleotide
taatacgactcactatagggaagggggatccattttcgtcttctttggtgaacagaggagacaccaaatgagacgaaaaaacctggcggcagcgcaaaagatg

SEQ ID NO: 181588 - DNA, 103 bp, Artificial Sequence
  Synthetic Polynucleotide
taatacgactcactatagggcctgtgattcaagggggatccattttcgtcaacagaggagagacgaaatgggatcccccaacctggcggcagcgcaaaagatg

SEQ ID NO: 181589 - DNA, 103 bp, Artificial Sequence
  Synthetic Polynucleotide
taatacgactcactataggggctcttcgatcctgtgattcaagggggatcaacagaggagagatcccatgtgaatcacaaacctggcggcagcgcaaaagatg

SEQ ID NO: 181590 - DNA, 103 bp, Artificial Sequence
  Synthetic Polynucleotide
taatacgactcactatagggtactggccttgcccttggccttcttgtctgaacagaggagacagacaatgaggccaaggaacctggcggcagcgcaaaagatg

SEQ ID NO: 181591 - DNA, 103 bp, Artificial Sequence
  Synthetic Polynucleotide
taatacgactcactataggggtggccagcgtactggccttgcccttggccaacagaggagaggccaaatgcaaggccagaacctggcggcagcgcaaaagatg

SEQ ID NO: 181592 - DNA, 103 bp, Artificial Sequence
  Synthetic Polynucleotide
taatacgactcactatagggctccacgggctccttggtggggttactgggaacagaggagacccagtatgcccaccaagaacctggcggcagcgcaaaagatg

SEQ ID NO: 181593 - DNA, 103 bp, Artificial Sequence
  Synthetic Polynucleotide
taatacgactcactataggggtacttcaaggtggccagcgtactggccttaacagaggagaaaggccatgacgctggccaacctggcggcagcgcaaaagatg

SEQ ID NO: 181594 - DNA, 103 bp, Artificial Sequence
  Synthetic Polynucleotide
taatacgactcactatagggtcctgagggcgtacttcaaggtggccagcgaacagaggagacgctggatgccttgaagtaacctggcggcagcgcaaaagatg

SEQ ID NO: 181595 - DNA, 103 bp, Artificial Sequence
  Synthetic Polynucleotide
taatacgactcactatagggtgcttcacgctcctgagggcgtacttcaagaacagaggagacttgaaatgcgccctcagaacctggcggcagcgcaaaagatg

SEQ ID NO: 181596 - DNA, 103 bp, Artificial Sequence
  Synthetic Polynucleotide
taatacgactcactatagggggctttcacctgcttcacgctcctgagggcaacagaggagagccctcatgagcgtgaagaacctggcggcagcgcaaaagatg

SEQ ID NO: 181597 - DNA, 103 bp, Artificial Sequence
  Synthetic Polynucleotide
taatacgactcactatagggactcttcattggctttcacctgcttcacgcaacagaggagagcgtgaatgaggtgaaagaacctggcggcagcgcaaaagatg

SEQ ID NO: 181598 - DNA, 103 bp, Artificial Sequence
  Synthetic Polynucleotide
taatacgactcactatagggagctggtaatactcttcattggctttcaccaacagaggagaggtgaaatgcaatgaagaaacctggcggcagcgcaaaagatg

SEQ ID NO: 181599 - DNA, 103 bp, Artificial Sequence
  Synthetic Polynucleotide
taatacgactcactatagggggacatcagcagctggtaatactcttcattaacagaggagaaatgaaatgtattaccagaacctggcggcagcgcaaaagatg

SEQ ID NO: 181600 - DNA, 103 bp, Artificial Sequence
  Synthetic Polynucleotide
taatacgactcactataggggaccctcgctggacatcagcagctggtaataacagaggagaattaccatgtgctgatgtaacctggcggcagcgcaaaagatg

SEQ ID NO: 181601 - DNA, 103 bp, Artificial Sequence
  Synthetic Polynucleotide
taatacgactcactatagggccacaggggtgaccctcgctggacatcagcaacagaggagagctgatatgcagcgagggaacctggcggcagcgcaaaagatg

SEQ ID NO: 181602 - DNA, 103 bp, Artificial Sequence
  Synthetic Polynucleotide
taatacgactcactatagggcacgtctgctccacaggggtgaccctcgctaacagaggagaagcgagatgcacccctgtaacctggcggcagcgcaaaagatg

SEQ ID NO: 181603 - DNA, 103 bp, Artificial Sequence
  Synthetic Polynucleotide
taatacgactcactatagggtgggctggggctccacgggctccttggtggaacagaggagaccaccaatgagcccgtggaacctggcggcagcgcaaaagatg

SEQ ID NO: 181604 - DNA, 103 bp, Artificial Sequence
  Synthetic Polynucleotide
taatacgactcactatagggtgtaggagggcacgtctgctccacaggggtaacagaggagaacccctatggagcagacgaacctggcggcagcgcaaaagatg

SEQ ID NO: 181605 - DNA, 103 bp, Artificial Sequence
  Synthetic Polynucleotide
taatacgactcactatagggtcctccacggtgtaggagggcacgtctgctaacagaggagaagcagaatggccctcctaaacctggcggcagcgcaaaagatg

SEQ ID NO: 181606 - DNA, 103 bp, Artificial Sequence
  Synthetic Polynucleotide
taatacgactcactataggggctctccatctcctccacggtgtaggagggaacagaggagaccctccatgaccgtggagaacctggcggcagcgcaaaagatg

SEQ ID NO: 181607 - DNA, 103 bp, Artificial Sequence
  Synthetic Polynucleotide
taatacgactcactatagggcagaggtaacgctctccatctcctccacggaacagaggagaccgtggatgagatggagaaacctggcggcagcgcaaaagatg

SEQ ID NO: 181608 - DNA, 103 bp, Artificial Sequence
  Synthetic Polynucleotide
taatacgactcactatagggacaatgtgctcagaggtaacgctctccatcaacagaggagagatggaatgcgttacctcaacctggcggcagcgcaaaagatg

SEQ ID NO: 181609 - DNA, 103 bp, Artificial Sequence
  Synthetic Polynucleotide
taatacgactcactatagggggcattcttcacaatgtgctcagaggtaacaacagaggagagttaccatggagcacattaacctggcggcagcgcaaaagatg

SEQ ID NO: 181610 - DNA, 103 bp, Artificial Sequence
  Synthetic Polynucleotide
taatacgactcactatagggcaaacatatcggcattcttcacaatgtgctaacagaggagaagcacaatgtgaagaatgaacctggcggcagcgcaaaagatg

SEQ ID NO: 181611 - DNA, 103 bp, Artificial Sequence
  Synthetic Polynucleotide
taatacgactcactatagggacggccaccgcaaacatatcggcattcttcaacagaggagagaagaaatgcgatatgttaacctggcggcagcgcaaaagatg

SEQ ID NO: 181612 - DNA, 103 bp, Artificial Sequence
  Synthetic Polynucleotide
taatacgactcactatagggcaccagggacacggccaccgcaaacatatcaacagaggagagatatgatggcggtggccaacctggcggcagcgcaaaagatg

SEQ ID NO: 181613 - DNA, 103 bp, Artificial Sequence
  Synthetic Polynucleotide
taatacgactcactatagggtcttcccagacaccagggacacggccaccgaacagaggagacggtggatgtgtccctggaacctggcggcagcgcaaaagatg

SEQ ID NO: 181614 - DNA, 103 bp, Artificial Sequence
  Synthetic Polynucleotide
taatacgactcactataggggggacctggctgggctggggctccacgggcaacagaggagagcccgtatggccccagccaacctggcggcagcgcaaaagatg

SEQ ID NO: 181615 - DNA, 103 bp, Artificial Sequence
  Synthetic Polynucleotide
taatacgactcactatagggatgtacaggatcttcccagacaccagggacaacagaggagagtccctatggtctgggaaaacctggcggcagcgcaaaagatg

SEQ ID NO: 181616 - DNA, 103 bp, Artificial Sequence
  Synthetic Polynucleotide
taatacgactcactatagggctggtcagagatgtacaggatcttcccagaaacagaggagatctgggatgatcctgtacaacctggcggcagcgcaaaagatg

SEQ ID NO: 181617 - DNA, 103 bp, Artificial Sequence
  Synthetic Polynucleotide
taatacgactcactatagggtggatgcaacctggtcagagatgtacaggaaacagaggagatcctgtatgtctctgaccaacctggcggcagcgcaaaagatg

SEQ ID NO: 181618 - DNA, 103 bp, Artificial Sequence
  Synthetic Polynucleotide
taatacgactcactatagggcagtgaaatatggatgcaacctggtcagagaacagaggagactctgaatgggttgcatcaacctggcggcagcgcaaaagatg

SEQ ID NO: 181619 - DNA, 103 bp, Artificial Sequence
  Synthetic Polynucleotide
taatacgactcactatagggatctcttttacagtgaaatatggatgcaacaacagaggagagttgcaatgatatttcacaacctggcggcagcgcaaaagatg

SEQ ID NO: 181620 - DNA, 103 bp, Artificial Sequence
  Synthetic Polynucleotide
taatacgactcactatagggcgctgaaggcatctcttttacagtgaaataaacagaggagatatttcatggtaaaagagaacctggcggcagcgcaaaagatg

SEQ ID NO: 181621 - DNA, 103 bp, Artificial Sequence
  Synthetic Polynucleotide
taatacgactcactatagggaacttggcatcgctgaaggcatctcttttaaacagaggagataaaagatgtgccttcagaacctggcggcagcgcaaaagatg

SEQ ID NO: 181622 - DNA, 103 bp, Artificial Sequence
  Synthetic Polynucleotide
taatacgactcactataggggaactccacaaacttggcatcgctgaaggcaacagaggagagccttcatggatgccaagaacctggcggcagcgcaaaagatg

SEQ ID NO: 181623 - DNA, 103 bp, Artificial Sequence
  Synthetic Polynucleotide
taatacgactcactataggggaggcgccaggaactccacaaacttggcataacagaggagaatgccaatgttgtggagtaacctggcggcagcgcaaaagatg

SEQ ID NO: 181624 - DNA, 103 bp, Artificial Sequence
  Synthetic Polynucleotide
taatacgactcactatagggcccacatcgtgaggcgccaggaactccacaaacagaggagatgtggaatgcctggcgccaacctggcggcagcgcaaaagatg

SEQ ID NO: 181625 - DNA, 103 bp, Artificial Sequence
  Synthetic Polynucleotide
taatacgactcactatagggttcctgcagtgggacctggctgggctggggaacagaggagaccccagatgagccaggtcaacctggcggcagcgcaaaagatg

SEQ ID NO: 181626 - DNA, 103 bp, Artificial Sequence
  Synthetic Polynucleotide
taatacgactcactataggggtggaacacgcccacatcgtgaggcgccagaacagaggagactggcgatgcacgatgtgaacctggcggcagcgcaaaagatg

SEQ ID NO: 181627 - DNA, 103 bp, Artificial Sequence
  Synthetic Polynucleotide
taatacgactcactatagggaggtgaaactgtggaacacgcccacatcgtaacagaggagaacgatgatggcgtgttccaacctggcggcagcgcaaaagatg

SEQ ID NO: 181628 - DNA, 103 bp, Artificial Sequence
  Synthetic Polynucleotide
taatacgactcactatagggttgtacggggaggtgaaactgtggaacacgaacagaggagacgtgttatgcagtttcacaacctggcggcagcgcaaaagatg

SEQ ID NO: 181629 - DNA, 103 bp, Artificial Sequence
  Synthetic Polynucleotide
taatacgactcactatagggcaagggaagcttgtacggggaggtgaaactaacagaggagaagtttcatgtccccgtacaacctggcggcagcgcaaaagatg

SEQ ID NO: 181630 - DNA, 103 bp, Artificial Sequence
  Synthetic Polynucleotide
taatacgactcactatagggacatgctccacaagggaagcttgtacggggaacagaggagaccccgtatgagcttccctaacctggcggcagcgcaaaagatg

SEQ ID NO: 181631 - DNA, 103 bp, Artificial Sequence
  Synthetic Polynucleotide
taatacgactcactataggggctccactgcacatgctccacaagggaagcaacagaggagagcttccatggtggagcataacctggcggcagcgcaaaagatg

SEQ ID NO: 181632 - DNA, 103 bp, Artificial Sequence
  Synthetic Polynucleotide
taatacgactcactatagggaaaagaatctgctccactgcacatgctccaaacagaggagatggagcatgtgcagtggaaacctggcggcagcgcaaaagatg

SEQ ID NO: 181633 - DNA, 103 bp, Artificial Sequence
  Synthetic Polynucleotide
taatacgactcactatagggattcttgagtaaaagaatctgctccactgcaacagaggagagcagtgatgcagattcttaacctggcggcagcgcaaaagatg

SEQ ID NO: 181634 - DNA, 103 bp, Artificial Sequence
  Synthetic Polynucleotide
taatacgactcactatagggtcctccatgcattcttgagtaaaagaatctaacagaggagaagattcatgtactcaagaaacctggcggcagcgcaaaagatg

SEQ ID NO: 181635 - DNA, 103 bp, Artificial Sequence
  Synthetic Polynucleotide
taatacgactcactataggggaaagatttctcctccatgcattcttgagtaacagaggagaactcaaatgtgcatggagaacctggcggcagcgcaaaagatg

SEQ ID NO: 181636 - DNA, 103 bp, Artificial Sequence
  Synthetic Polynucleotide
taatacgactcactatagggtgtccacatcttcctgcagtgggacctggcaacagaggagagccaggatgcactgcaggaacctggcggcagcgcaaaagatg

SEQ ID NO: 181637 - DNA, 103 bp, Artificial Sequence
  Synthetic Polynucleotide
taatacgactcactatagggcacggcaaaagaaagatttctcctccatgcaacagaggagagcatggatgagaaatcttaacctggcggcagcgcaaaagatg

SEQ ID NO: 181638 - DNA, 103 bp, Artificial Sequence
  Synthetic Polynucleotide
taatacgactcactatagggcggacactgacacggcaaaagaaagatttcaacagaggagagaaatcatgcttttgccgaacctggcggcagcgcaaaagatg

SEQ ID NO: 181639 - DNA, 103 bp, Artificial Sequence
  Synthetic Polynucleotide
taatacgactcactataggggtggcttttccggacactgacacggcaaaaaacagaggagattttgcatggtcagtgtcaacctggcggcagcgcaaaagatg

SEQ ID NO: 181640 - DNA, 103 bp, Artificial Sequence
  Synthetic Polynucleotide
taatacgactcactatagggtttcattctcgtggcttttccggacactgaaacagaggagatcagtgatgggaaaagccaacctggcggcagcgcaaaagatg

SEQ ID NO: 181641 - DNA, 103 bp, Artificial Sequence
  Synthetic Polynucleotide
taatacgactcactatagggtggtagcggatttcattctcgtggcttttcaacagaggagagaaaagatgcgagaatgaaacctggcggcagcgcaaaagatg

SEQ ID NO: 181642 - DNA, 103 bp, Artificial Sequence
  Synthetic Polynucleotide
taatacgactcactataggggcggaaggggtggtagcggatttcattctcaacagaggagagagaatatgatccgctacaacctggcggcagcgcaaaagatg

SEQ ID NO: 181643 - DNA, 103 bp, Artificial Sequence
  Synthetic Polynucleotide
taatacgactcactatagggagggcgtcatgcggaaggggtggtagcggaaacagaggagatccgctatgaccccttccaacctggcggcagcgcaaaagatg

SEQ ID NO: 181644 - DNA, 103 bp, Artificial Sequence
  Synthetic Polynucleotide
taatacgactcactatagggttgaccaggtagggcgtcatgcggaaggggaacagaggagaccccttatgcatgacgccaacctggcggcagcgcaaaagatg

SEQ ID NO: 181645 - DNA, 103 bp, Artificial Sequence
  Synthetic Polynucleotide
taatacgactcactataggggtcccgcaccttgaccaggtagggcgtcataacagaggagaatgacgatgtacctggtcaacctggcggcagcgcaaaagatg

SEQ ID NO: 181646 - DNA, 103 bp, Artificial Sequence
  Synthetic Polynucleotide
taatacgactcactatagggcaccttgttggtcccgcaccttgaccaggtaacagaggagaacctggatgaggtgcgggaacctggcggcagcgcaaaagatg

SEQ ID NO: 181647 - DNA, 103 bp, Artificial Sequence
  Synthetic Polynucleotide
taatacgactcactatagggccactgctcatgtccacatcttcctgcagtaacagaggagaactgcaatgagatgtggaaacctggcggcagcgcaaaagatg

SEQ ID NO: 181648 - DNA, 103 bp, Artificial Sequence
  Synthetic Polynucleotide
taatacgactcactatagggtgactctcagcaccttgttggtcccgcaccaacagaggagaggtgcgatgccaacaaggaacctggcggcagcgcaaaagatg

SEQ ID NO: 181649 - DNA, 103 bp, Artificial Sequence
  Synthetic Polynucleotide
taatacgactcactataggggcagcaaagctgactctcagcaccttgttgaacagaggagacaacaaatggctgagagtaacctggcggcagcgcaaaagatg

SEQ ID NO: 181650 - DNA, 103 bp, Artificial Sequence
  Synthetic Polynucleotide
taatacgactcactatagggccagcagaaggcagcaaagctgactctcagaacagaggagactgagaatgagctttgctaacctggcggcagcgcaaaagatg

SEQ ID NO: 181651 - DNA, 103 bp, Artificial Sequence
  Synthetic Polynucleotide
taatacgactcactatagggactctctctgccagcagaaggcagcaaagcaacagaggagagctttgatgccttctgctaacctggcggcagcgcaaaagatg

SEQ ID NO: 181652 - DNA, 103 bp, Artificial Sequence
  Synthetic Polynucleotide
taatacgactcactatagggaccagagtgcactctctctgccagcagaagaacagaggagacttctgatggcagagagaaacctggcggcagcgcaaaagatg

SEQ ID NO: 181653 - DNA, 103 bp, Artificial Sequence
  Synthetic Polynucleotide
taatacgactcactataggggggcttcataaccagagtgcactctctctgaacagaggagacagagaatgtgcactctgaacctggcggcagcgcaaaagatg

SEQ ID NO: 181654 - DNA, 103 bp, Artificial Sequence
  Synthetic Polynucleotide
taatacgactcactatagggggaattctaggggcttcataaccagagtgcaacagaggagagcactcatgttatgaagcaacctggcggcagcgcaaaagatg

SEQ ID NO: 181655 - DNA, 103 bp, Artificial Sequence
  Synthetic Polynucleotide
taatacgactcactatagggcttttcaggaggaattctaggggcttcataaacagaggagatatgaaatgcctagaattaacctggcggcagcgcaaaagatg

SEQ ID NO: 181656 - DNA, 103 bp, Artificial Sequence
  Synthetic Polynucleotide
taatacgactcactatagggtaaaaattctcttttcaggaggaattctagaacagaggagactagaaatgctcctgaaaaacctggcggcagcgcaaaagatg

SEQ ID NO: 181657 - DNA, 103 bp, Artificial Sequence
  Synthetic Polynucleotide
taatacgactcactatagggtgggtggttgtaaaaattctcttttcaggaaacagaggagatcctgaatggagaattttaacctggcggcagcgcaaaagatg

SEQ ID NO: 181658 - DNA, 103 bp, Artificial Sequence
  Synthetic Polynucleotide
taatacgactcactatagggcccggggccaggagcttccccgcggggcataacagaggagaatgcccatgggggaagctaacctggcggcagcgcaaaagatg

SEQ ID NO: 181659 - DNA, 103 bp, Artificial Sequence
  Synthetic Polynucleotide
taatacgactcactataggggctgtccgccaatttcctctgcagatggaaaacagaggagattccatatgcagaggaaaaacctggcggcagcgcaaaagatg

SEQ ID NO: 181660 - DNA, 103 bp, Artificial Sequence
  Synthetic Polynucleotide
taatacgactcactataggggggagaatgttcaaagggaggatgccctgcaacagaggagagcagggatgcctccctttaacctggcggcagcgcaaaagatg

SEQ ID NO: 181661 - DNA, 103 bp, Artificial Sequence
  Synthetic Polynucleotide
taatacgactcactatagggaaaatcgaatgggagaatgttcaaagggagaacagaggagactccctatgaacattctcaacctggcggcagcgcaaaagatg

SEQ ID NO: 181662 - DNA, 103 bp, Artificial Sequence
  Synthetic Polynucleotide
taatacgactcactatagggttttgagtacaaaatcgaatgggagaatgtaacagaggagaacattcatgcattcgattaacctggcggcagcgcaaaagatg

SEQ ID NO: 181663 - DNA, 103 bp, Artificial Sequence
  Synthetic Polynucleotide
taatacgactcactataggggtagtctccgttttgagtacaaaatcgaataacagaggagaattcgaatgtgtactcaaaacctggcggcagcgcaaaagatg

SEQ ID NO: 181664 - DNA, 103 bp, Artificial Sequence
  Synthetic Polynucleotide
taatacgactcactatagggccagtatgatgtagtctccgttttgagtacaacagaggagagtactcatgacggagactaacctggcggcagcgcaaaagatg

SEQ ID NO: 181665 - DNA, 103 bp, Artificial Sequence
  Synthetic Polynucleotide
taatacgactcactatagggcaactggaatccagtatgatgtagtctccgaacagaggagacggagaatgcatcatactaacctggcggcagcgcaaaagatg

SEQ ID NO: 181666 - DNA, 103 bp, Artificial Sequence
  Synthetic Polynucleotide
taatacgactcactatagggaaagctggaccaactggaatccagtatgataacagaggagaatcataatggattccagtaacctggcggcagcgcaaaagatg

SEQ ID NO: 181667 - DNA, 103 bp, Artificial Sequence
  Synthetic Polynucleotide
taatacgactcactatagggagggattcacaaagctggaccaactggaataacagaggagaattccaatgggtccagctaacctggcggcagcgcaaaagatg

SEQ ID NO: 181668 - DNA, 103 bp, Artificial Sequence
  Synthetic Polynucleotide
taatacgactcactatagggttccggctccagggattcacaaagctggacaacagaggagagtccagatgtgtgaatccaacctggcggcagcgcaaaagatg

SEQ ID NO: 181669 - DNA, 103 bp, Artificial Sequence
  Synthetic Polynucleotide
taatacgactcactataggggaaagaaatcttccggctccagggattcacaacagaggagagtgaatatgtggagccggaacctggcggcagcgcaaaagatg

SEQ ID NO: 181670 - DNA, 103 bp, Artificial Sequence
  Synthetic Polynucleotide
taatacgactcactatagggcactgtggctgctgtccgccaatttcctctaacagaggagaagaggaatgtggcggacaaacctggcggcagcgcaaaagatg

SEQ ID NO: 181671 - DNA, 103 bp, Artificial Sequence
  Synthetic Polynucleotide
taatacgactcactataggggaccaatgatgaaagaaatcttccggctccaacagaggagaggagccatgagatttcttaacctggcggcagcgcaaaagatg

SEQ ID NO: 181672 - DNA, 103 bp, Artificial Sequence
  Synthetic Polynucleotide
taatacgactcactatagggactttatgccgaccaatgatgaaagaaatcaacagaggagagatttcatgcatcattggaacctggcggcagcgcaaaagatg

SEQ ID NO: 181673 - DNA, 103 bp, Artificial Sequence
  Synthetic Polynucleotide
taatacgactcactataggggctcgttcgaactttatgccgaccaatgataacagaggagaatcattatgcggcataaaaacctggcggcagcgcaaaagatg

SEQ ID NO: 181674 - DNA, 103 bp, Artificial Sequence
  Synthetic Polynucleotide
taatacgactcactatagggcatttagtgggctcgttcgaactttatgccaacagaggagaggcataatgttcgaacgaaacctggcggcagcgcaaaagatg

SEQ ID NO: 181675 - DNA, 103 bp, Artificial Sequence
  Synthetic Polynucleotide
taatacgactcactatagggaaaacatcctcatttagtgggctcgttcgaaacagaggagatcgaacatgcccactaaaaacctggcggcagcgcaaaagatg

SEQ ID NO: 181676 - DNA, 103 bp, Artificial Sequence
  Synthetic Polynucleotide
taatacgactcactatagggtttggtagcaaaaacatcctcatttagtggaacagaggagaccactaatggaggatgttaacctggcggcagcgcaaaagatg

SEQ ID NO: 181677 - DNA, 103 bp, Artificial Sequence
  Synthetic Polynucleotide
taatacgactcactatagggtctttttaattttggtagcaaaaacatcctaacagaggagaaggatgatgttgctaccaaacctggcggcagcgcaaaagatg

SEQ ID NO: 181678 - DNA, 103 bp, Artificial Sequence
  Synthetic Polynucleotide
taatacgactcactatagggttatcgttcatctttttaattttggtagcaaacagaggagatgctacatgaattaaaaaaacctggcggcagcgcaaaagatg

SEQ ID NO: 181679 - DNA, 103 bp, Artificial Sequence
  Synthetic Polynucleotide
taatacgactcactataggggtctttgtcattatcgttcatctttttaataacagaggagaattaaaatgatgaacgataacctggcggcagcgcaaaagatg

SEQ ID NO: 181680 - DNA, 103 bp, Artificial Sequence
  Synthetic Polynucleotide
taatacgactcactatagggattctgttatgtctttgtcattatcgttcaaacagaggagatgaacgatgatgacaaagaacctggcggcagcgcaaaagatg

SEQ ID NO: 181681 - DNA, 103 bp, Artificial Sequence
  Synthetic Polynucleotide
taatacgactcactatagggtcttgctgttcactgtggctgctgtccgccaacagaggagaggcggaatgcagccacagaacctggcggcagcgcaaaagatg

SEQ ID NO: 181682 - DNA, 103 bp, Artificial Sequence
  Synthetic Polynucleotide
taatacgactcactatagggtgttcttgtaattctgttatgtctttgtcaaacagaggagatgacaaatgcataacagaaacctggcggcagcgcaaaagatg

SEQ ID NO: 181683 - DNA, 103 bp, Artificial Sequence
  Synthetic Polynucleotide
taatacgactcactatagggtttgtaaatttgttcttgtaattctgttataacagaggagaataacaatgttacaagaaaacctggcggcagcgcaaaagatg

SEQ ID NO: 181684 - DNA, 103 bp, Artificial Sequence
  Synthetic Polynucleotide
taatacgactcactataggggtaagagaagtttgtaaatttgttcttgtaaacagaggagatacaagatgaaatttacaaacctggcggcagcgcaaaagatg

SEQ ID NO: 181685 - DNA, 103 bp, Artificial Sequence
  Synthetic Polynucleotide
taatacgactcactatagggtgaactggctgtaagagaagtttgtaaattaacagaggagaaatttaatgacttctcttaacctggcggcagcgcaaaagatg

SEQ ID NO: 181686 - DNA, 103 bp, Artificial Sequence
  Synthetic Polynucleotide
taatacgactcactatagggcacgctcacgtgaactggctgtaagagaagaacagaggagacttctcatgcagccagttaacctggcggcagcgcaaaagatg

SEQ ID NO: 181687 - DNA, 103 bp, Artificial Sequence
  Synthetic Polynucleotide
taatacgactcactatagggagccgctggacacgctcacgtgaactggctaacagaggagaagccagatgacgtgagcgaacctggcggcagcgcaaaagatg

SEQ ID NO: 181688 - DNA, 103 bp, Artificial Sequence
  Synthetic Polynucleotide
taatacgactcactatagggaggctcccgtagccgctggacacgctcacgaacagaggagacgtgagatggtccagcggaacctggcggcagcgcaaaagatg

SEQ ID NO: 181689 - DNA, 103 bp, Artificial Sequence
  Synthetic Polynucleotide
taatacgactcactataggggctgctccccaggctcccgtagccgctggaaacagaggagatccagcatgtacgggagcaacctggcggcagcgcaaaagatg

SEQ ID NO: 181690 - DNA, 103 bp, Artificial Sequence
  Synthetic Polynucleotide
taatacgactcactatagggcctgcgacccgctgctccccaggctcccgtaacagaggagaacgggaatgtggggagcaaacctggcggcagcgcaaaagatg

SEQ ID NO: 181691 - DNA, 103 bp, Artificial Sequence
  Synthetic Polynucleotide
taatacgactcactatagggacaagctgctcctgcgacccgctgctccccaacagaggagaggggagatgcgggtcgcaaacctggcggcagcgcaaaagatg

SEQ ID NO: 181692 - DNA, 103 bp, Artificial Sequence
  Synthetic Polynucleotide
taatacgactcactatagggtctgtttcgatcttgctgttcactgtggctaacagaggagaagccacatggaacagcaaaacctggcggcagcgcaaaagatg

SEQ ID NO: 181693 - DNA, 103 bp, Artificial Sequence
  Synthetic Polynucleotide
taatacgactcactatagggggcgatgctgacaagctgctcctgcgacccaacagaggagagggtcgatggagcagcttaacctggcggcagcgcaaaagatg

SEQ ID NO: 181694 - DNA, 103 bp, Artificial Sequence
  Synthetic Polynucleotide
taatacgactcactatagggcactggaggaggcgatgctgacaagctgctaacagaggagaagcagcatgtcagcatcgaacctggcggcagcgcaaaagatg

SEQ ID NO: 181695 - DNA, 103 bp, Artificial Sequence
  Synthetic Polynucleotide
taatacgactcactatagggccactggcctcactggaggaggcgatgctgaacagaggagacagcatatgctcctccagaacctggcggcagcgcaaaagatg

SEQ ID NO: 181696 - DNA, 103 bp, Artificial Sequence
  Synthetic Polynucleotide
taatacgactcactatagggcacacggtgcccactggcctcactggaggaaacagaggagatcctccatggaggccagtaacctggcggcagcgcaaaagatg

SEQ ID NO: 181697 - DNA, 103 bp, Artificial Sequence
  Synthetic Polynucleotide
taatacgactcactatagggtcgtctcctccacacggtgcccactggcctaacagaggagaaggccaatgggcaccgtgaacctggcggcagcgcaaaagatg

SEQ ID NO: 181698 - DNA, 103 bp, Artificial Sequence
  Synthetic Polynucleotide
taatacgactcactatagggtgctccgccttcgtctcctccacacggtgcaacagaggagagcaccgatgggaggagacaacctggcggcagcgcaaaagatg

SEQ ID NO: 181699 - DNA, 103 bp, Artificial Sequence
  Synthetic Polynucleotide
taatacgactcactatagggcaaggtcatctgctccgccttcgtctcctcaacagaggagagaggagatgaaggcggagaacctggcggcagcgcaaaagatg

SEQ ID NO: 181700 - DNA, 103 bp, Artificial Sequence
  Synthetic Polynucleotide
taatacgactcactatagggagacctgctgcaaggtcatctgctccgcctaacagaggagaaggcggatgagatgacctaacctggcggcagcgcaaaagatg

SEQ ID NO: 181701 - DNA, 103 bp, Artificial Sequence
  Synthetic Polynucleotide
taatacgactcactatagggacactggcatagacctgctgcaaggtcatcaacagaggagagatgacatggcagcaggtaacctggcggcagcgcaaaagatg

SEQ ID NO: 181702 - DNA, 103 bp, Artificial Sequence
  Synthetic Polynucleotide
taatacgactcactatagggaattttgttcacactggcatagacctgctgaacagaggagacagcagatgtatgccagtaacctggcggcagcgcaaaagatg

SEQ ID NO: 181703 - DNA, 103 bp, Artificial Sequence
  Synthetic Polynucleotide
taatacgactcactatagggcttcagaaactctgtttcgatcttgctgttaacagaggagaaacagcatgatcgaaacaaacctggcggcagcgcaaaagatg

SEQ ID NO: 181704 - DNA, 103 bp, Artificial Sequence
  Synthetic Polynucleotide
taatacgactcactatagggccagatttttaattttgttcacactggcataacagaggagaatgccaatgtgaacaaaaaacctggcggcagcgcaaaagatg

SEQ ID NO: 181705 - DNA, 103 bp, Artificial Sequence
  Synthetic Polynucleotide
taatacgactcactatagggagctgctgacccagatttttaattttgttcaacagaggagagaacaaatgtaaaaatctaacctggcggcagcgcaaaagatg

SEQ ID NO: 181706 - DNA, 103 bp, Artificial Sequence
  Synthetic Polynucleotide
taatacgactcactatagggctcaatgtagagctgctgacccagatttttaacagaggagaaaaaatatgggtcagcagaacctggcggcagcgcaaaagatg

SEQ ID NO: 181707 - DNA, 103 bp, Artificial Sequence
  Synthetic Polynucleotide
taatacgactcactatagggtggtcattgactcaatgtagagctgctgacaacagaggagagtcagcatgtctacattgaacctggcggcagcgcaaaagatg

SEQ ID NO: 181708 - DNA, 103 bp, Artificial Sequence
  Synthetic Polynucleotide
taatacgactcactatagggaatgatgatttggtcattgactcaatgtagaacagaggagactacatatggtcaatgacaacctggcggcagcgcaaaagatg

SEQ ID NO: 181709 - DNA, 103 bp, Artificial Sequence
  Synthetic Polynucleotide
taatacgactcactatagggcactggcttgaatgatgatttggtcattgaaacagaggagatcaatgatgaaatcatcaaacctggcggcagcgcaaaagatg

SEQ ID NO: 181710 - DNA, 103 bp, Artificial Sequence
  Synthetic Polynucleotide
taatacgactcactataggggtgtccccgtcactggcttgaatgatgattaacagaggagaaatcatatgtcaagccagaacctggcggcagcgcaaaagatg

SEQ ID NO: 181711 - DNA, 103 bp, Artificial Sequence
  Synthetic Polynucleotide
taatacgactcactatagggggttctgtgcgtgtccccgtcactggcttgaacagaggagacaagccatggacggggacaacctggcggcagcgcaaaagatg

SEQ ID NO: 181712 - DNA, 103 bp, Artificial Sequence
  Synthetic Polynucleotide
taatacgactcactatagggaccaccattcggttctgtgcgtgtccccgtaacagaggagaacggggatgcgcacagaaaacctggcggcagcgcaaaagatg

SEQ ID NO: 181713 - DNA, 103 bp, Artificial Sequence
  Synthetic Polynucleotide
taatacgactcactatagggctgactcaccaccaccattcggttctgtgcaacagaggagagcacagatgcgaatggtgaacctggcggcagcgcaaaagatg

SEQ ID NO: 181714 - DNA, 103 bp, Artificial Sequence
  Synthetic Polynucleotide
taatacgactcactatagggatgataagttcttcagaaactctgtttcgaaacagaggagatcgaaaatgagtttctgaaacctggcggcagcgcaaaagatg

SEQ ID NO: 181715 - DNA, 103 bp, Artificial Sequence
  Synthetic Polynucleotide
taatacgactcactatagggccaccattcgctgactcaccaccaccattcaacagaggagagaatggatgtggtgagtcaacctggcggcagcgcaaaagatg

SEQ ID NO: 181716 - DNA, 103 bp, Artificial Sequence
  Synthetic Polynucleotide
taatacgactcactatagggacattcaccaccaccattcgctgactcaccaacagaggagaggtgagatggcgaatggtaacctggcggcagcgcaaaagatg

SEQ ID NO: 181717 - DNA, 103 bp, Artificial Sequence
  Synthetic Polynucleotide
taatacgactcactatagggtaaaggtcttacattcaccaccaccattcgaacagaggagacgaatgatggtggtgaataacctggcggcagcgcaaaagatg

SEQ ID NO: 181718 - DNA, 103 bp, Artificial Sequence
  Synthetic Polynucleotide
taatacgactcactatagggtggaaggaagtaaaggtcttacattcaccaaacagaggagatggtgaatgtaagaccttaacctggcggcagcgcaaaagatg

SEQ ID NO: 181719 - DNA, 103 bp, Artificial Sequence
  Synthetic Polynucleotide
taatacgactcactatagggcagtgtttggtggaaggaagtaaaggtcttaacagaggagaaagaccatgacttccttcaacctggcggcagcgcaaaagatg

SEQ ID NO: 181720 - DNA, 103 bp, Artificial Sequence
  Synthetic Polynucleotide
taatacgactcactatagggtattgtttttcagtgtttggtggaaggaagaacagaggagacttcctatgaccaaacacaacctggcggcagcgcaaaagatg

SEQ ID NO: 181721 - DNA, 103 bp, Artificial Sequence
  Synthetic Polynucleotide
taatacgactcactataggggtgtacacactattgtttttcagtgtttggaacagaggagaccaaacatggaaaaacaaaacctggcggcagcgcaaaagatg

SEQ ID NO: 181722 - DNA, 103 bp, Artificial Sequence
  Synthetic Polynucleotide
taatacgactcactatagggacagggctcagtgtacacactattgtttttaacagaggagaaaaaacatgagtgtgtacaacctggcggcagcgcaaaagatg

SEQ ID NO: 181723 - DNA, 103 bp, Artificial Sequence
  Synthetic Polynucleotide
taatacgactcactatagggtcaaatcctcacagggctcagtgtacacacaacagaggagagtgtgtatgctgagccctaacctggcggcagcgcaaaagatg

SEQ ID NO: 181724 - DNA, 103 bp, Artificial Sequence
  Synthetic Polynucleotide
taatacgactcactatagggtcatcgttcctcaaatcctcacagggctcaaacagaggagatgagccatgtgaggatttaacctggcggcagcgcaaaagatg

SEQ ID NO: 181725 - DNA, 103 bp, Artificial Sequence
  Synthetic Polynucleotide
taatacgactcactatagggttggacaaccatgataagttcttcagaaacaacagaggagagtttctatggaacttatcaacctggcggcagcgcaaaagatg

SEQ ID NO: 181726 - DNA, 103 bp, Artificial Sequence
  Synthetic Polynucleotide
taatacgactcactatagggtgggctgtgctcatcgttcctcaaatcctcaacagaggagagaggatatgaggaacgataacctggcggcagcgcaaaagatg

SEQ ID NO: 181727 - DNA, 103 bp, Artificial Sequence
  Synthetic Polynucleotide
taatacgactcactataggggttgataggatgggctgtgctcatcgttccaacagaggagaggaacgatgagcacagccaacctggcggcagcgcaaaagatg

SEQ ID NO: 181728 - DNA, 103 bp, Artificial Sequence
  Synthetic Polynucleotide
taatacgactcactatagggcagttgatctgttgataggatgggctgtgcaacagaggagagcacagatgatcctatcaaacctggcggcagcgcaaaagatg

SEQ ID NO: 181729 - DNA, 103 bp, Artificial Sequence
  Synthetic Polynucleotide
taatacgactcactatagggactgtcgatacagttgatctgttgataggaaacagaggagatcctatatgcagatcaacaacctggcggcagcgcaaaagatg

SEQ ID NO: 181730 - DNA, 103 bp, Artificial Sequence
  Synthetic Polynucleotide
taatacgactcactatagggatctgatgacactgtcgatacagttgatctaacagaggagaagatcaatggtatcgacaaacctggcggcagcgcaaaagatg

SEQ ID NO: 181731 - DNA, 103 bp, Artificial Sequence
  Synthetic Polynucleotide
taatacgactcactatagggctcttcaggtatctgatgacactgtcgataaacagaggagatatcgaatgtgtcatcagaacctggcggcagcgcaaaagatg

SEQ ID NO: 181732 - DNA, 103 bp, Artificial Sequence
  Synthetic Polynucleotide
taatacgactcactatagggaatgttgtagctcttcaggtatctgatgacaacagaggagagtcatcatgtacctgaagaacctggcggcagcgcaaaagatg

SEQ ID NO: 181733 - DNA, 103 bp, Artificial Sequence
  Synthetic Polynucleotide
taatacgactcactatagggtcaaagctggaatgttgtagctcttcaggtaacagaggagaacctgaatggctacaacaaacctggcggcagcgcaaaagatg

SEQ ID NO: 181734 - DNA, 103 bp, Artificial Sequence
  Synthetic Polynucleotide
taatacgactcactatagggcactttcttttcaaagctggaatgttgtagaacagaggagactacaaatgtccagctttaacctggcggcagcgcaaaagatg

SEQ ID NO: 181735 - DNA, 103 bp, Artificial Sequence
  Synthetic Polynucleotide
taatacgactcactatagggacaggagatacactttcttttcaaagctggaacagaggagaccagctatgaaaagaaagaacctggcggcagcgcaaaagatg

SEQ ID NO: 181736 - DNA, 103 bp, Artificial Sequence
  Synthetic Polynucleotide
taatacgactcactatagggttttcatttcttggacaaccatgataagttaacagaggagaaacttaatgtggttgtccaacctggcggcagcgcaaaagatg

SEQ ID NO: 181737 - DNA, 103 bp, Artificial Sequence
  Synthetic Polynucleotide
taatacgactcactatagggttgtatttgtacaggagatacactttctttaacagaggagaaaagaaatggtatctcctaacctggcggcagcgcaaaagatg

SEQ ID NO: 181738 - DNA, 103 bp, Artificial Sequence
  Synthetic Polynucleotide
taatacgactcactataggggaggaagaagttgtatttgtacaggagataaacagaggagatatctcatgtacaaatacaacctggcggcagcgcaaaagatg

SEQ ID NO: 181739 - DNA, 103 bp, Artificial Sequence
  Synthetic Polynucleotide
taatacgactcactatagggttcttctgaggaggaagaagttgtatttgtaacagaggagaacaaatatgacttcttccaacctggcggcagcgcaaaagatg

SEQ ID NO: 181740 - DNA, 103 bp, Artificial Sequence
  Synthetic Polynucleotide
taatacgactcactatagggtctgtttgtcttcttctgaggaggaagaagaacagaggagacttcttatgcctcagaagaacctggcggcagcgcaaaagatg

SEQ ID NO: 181741 - DNA, 103 bp, Artificial Sequence
  Synthetic Polynucleotide
taatacgactcactataggggccttgtggttctgtttgtcttcttctgagaacagaggagactcagaatgagacaaacaaacctggcggcagcgcaaaagatg

SEQ ID NO: 181742 - DNA, 103 bp, Artificial Sequence
  Synthetic Polynucleotide
taatacgactcactataggggacatcatctgccttgtggttctgtttgtcaacagaggagagacaaaatgaaccacaagaacctggcggcagcgcaaaagatg

SEQ ID NO: 181743 - DNA, 103 bp, Artificial Sequence
  Synthetic Polynucleotide
taatacgactcactataggggtaaggcttggacatcatctgccttgtggtaacagaggagaaccacaatgcagatgatgaacctggcggcagcgcaaaagatg

SEQ ID NO: 181744 - DNA, 103 bp, Artificial Sequence
  Synthetic Polynucleotide
taatacgactcactatagggaaaccagcttgtaaggcttggacatcatctaacagaggagaagatgaatgccaagccttaacctggcggcagcgcaaaagatg

SEQ ID NO: 181745 - DNA, 103 bp, Artificial Sequence
  Synthetic Polynucleotide
taatacgactcactatagggtgggatttgcaaaccagcttgtaaggcttgaacagaggagacaagccatgcaagctggtaacctggcggcagcgcaaaagatg

SEQ ID NO: 181746 - DNA, 103 bp, Artificial Sequence
  Synthetic Polynucleotide
taatacgactcactatagggtaggtatggctgggatttgcaaaccagcttaacagaggagaaagctgatgtgcaaatccaacctggcggcagcgcaaaagatg

SEQ ID NO: 181747 - DNA, 103 bp, Artificial Sequence
  Synthetic Polynucleotide
taatacgactcactataggggggaagtattttttcatttcttggacaaccaacagaggagaggttgtatgagaaatgaaaacctggcggcagcgcaaaagatg

SEQ ID NO: 181748 - DNA, 103 bp, Artificial Sequence
  Synthetic Polynucleotide
taatacgactcactatagggatttctgatttaggtatggctgggatttgcaacagaggagagcaaatatgagccataccaacctggcggcagcgcaaaagatg

SEQ ID NO: 181749 - DNA, 103 bp, Artificial Sequence
  Synthetic Polynucleotide
taatacgactcactatagggatttgttggcatttctgatttaggtatggcaacagaggagagccataatgaaatcagaaaacctggcggcagcgcaaaagatg

SEQ ID NO: 181750 - DNA, 103 bp, Artificial Sequence
  Synthetic Polynucleotide
taatacgactcactatagggtggaccgtccatttgttggcatttctgattaacagaggagaaatcagatgtgccaacaaaacctggcggcagcgcaaaagatg

SEQ ID NO: 181751 - DNA, 103 bp, Artificial Sequence
  Synthetic Polynucleotide
taatacgactcactatagggcctgtgtctatggaccgtccatttgttggcaacagaggagagccaacatgtggacggtcaacctggcggcagcgcaaaagatg

SEQ ID NO: 181752 - DNA, 103 bp, Artificial Sequence
  Synthetic Polynucleotide
taatacgactcactatagggagctcctcctcctgtgtctatggaccgtccaacagaggagaggacggatgatagacacaaacctggcggcagcgcaaaagatg

SEQ ID NO: 181753 - DNA, 103 bp, Artificial Sequence
  Synthetic Polynucleotide
taatacgactcactatagggggatctgtggagctcctcctcctgtgtctaaacagaggagatagacaatggaggaggagaacctggcggcagcgcaaaagatg

SEQ ID NO: 181754 - DNA, 103 bp, Artificial Sequence
  Synthetic Polynucleotide
taatacgactcactataggggccgtggacaggatctgtggagctcctcctaacagaggagaaggaggatgtccacagataacctggcggcagcgcaaaagatg

SEQ ID NO: 181755 - DNA, 103 bp, Artificial Sequence
  Synthetic Polynucleotide
taatacgactcactataggggctcagcatcgccgtggacaggatctgtggaacagaggagaccacagatgctgtccacgaacctggcggcagcgcaaaagatg

SEQ ID NO: 181756 - DNA, 103 bp, Artificial Sequence
  Synthetic Polynucleotide
taatacgactcactatagggccgaccccaagctcagcatcgccgtggacaaacagaggagatgtccaatgcgatgctgaaacctggcggcagcgcaaaagatg

SEQ ID NO: 181757 - DNA, 103 bp, Artificial Sequence
  Synthetic Polynucleotide
taatacgactcactatagggtggcttatgcccgaccccaagctcagcatcaacagaggagagatgctatgcttggggtcaacctggcggcagcgcaaaagatg

SEQ ID NO: 181758 - DNA, 103 bp, Artificial Sequence
  Synthetic Polynucleotide
taatacgactcactatagggtctctccgaggggaagtattttttcatttcaacagaggagagaaatgatgaaatacttcaacctggcggcagcgcaaaagatg

SEQ ID NO: 181759 - DNA, 103 bp, Artificial Sequence
  Synthetic Polynucleotide
taatacgactcactataggggtaaccgcattggcttatgcccgaccccaaaacagaggagattggggatgggcataagcaacctggcggcagcgcaaaagatg

SEQ ID NO: 181760 - DNA, 103 bp, Artificial Sequence
  Synthetic Polynucleotide
taatacgactcactatagggtggtgctgctgtaaccgcattggcttatgcaacagaggagagcataaatgaatgcggttaacctggcggcagcgcaaaagatg

SEQ ID NO: 181761 - DNA, 103 bp, Artificial Sequence
  Synthetic Polynucleotide
taatacgactcactatagggacatggacaatggtgctgctgtaaccgcataacagaggagaatgcggatgcagcagcacaacctggcggcagcgcaaaagatg

SEQ ID NO: 181762 - DNA, 103 bp, Artificial Sequence
  Synthetic Polynucleotide
taatacgactcactatagggtgggggtgggacatggacaatggtgctgctaacagaggagaagcagcatgattgtccataacctggcggcagcgcaaaagatg

SEQ ID NO: 181763 - DNA, 103 bp, Artificial Sequence
  Synthetic Polynucleotide
taatacgactcactatagggtggctgtctctgggggtgggacatggacaaaacagaggagattgtccatgtcccaccccaacctggcggcagcgcaaaagatg

SEQ ID NO: 181764 - DNA, 103 bp, Artificial Sequence
  Synthetic Polynucleotide
taatacgactcactataggggtagcatccctggctgtctctgggggtgggaacagaggagacccaccatgagagacagcaacctggcggcagcgcaaaagatg

SEQ ID NO: 181765 - DNA, 103 bp, Artificial Sequence
  Synthetic Polynucleotide
taatacgactcactatagggacagaagagggtagcatccctggctgtctcaacagaggagagagacaatgagggatgctaacctggcggcagcgcaaaagatg

SEQ ID NO: 181766 - DNA, 103 bp, Artificial Sequence
  Synthetic Polynucleotide
taatacgactcactatagggtccagggctcacagaagagggtagcatcccaacagaggagagggatgatgccctcttctaacctggcggcagcgcaaaagatg

SEQ ID NO: 181767 - DNA, 103 bp, Artificial Sequence
  Synthetic Polynucleotide
taatacgactcactatagggatgttcagggtccagggctcacagaagaggaacagaggagacctcttatgtgagccctgaacctggcggcagcgcaaaagatg

SEQ ID NO: 181768 - DNA, 103 bp, Artificial Sequence
  Synthetic Polynucleotide
taatacgactcactatagggggctggctgcatgttcagggtccagggctcaacagaggagagagcccatgaccctgaacaacctggcggcagcgcaaaagatg

SEQ ID NO: 181769 - DNA, 103 bp, Artificial Sequence
  Synthetic Polynucleotide
taatacgactcactatagggccccccgtctcccggggccaggagcttcccaacagaggagagggaagatgctggccccgaacctggcggcagcgcaaaagatg

SEQ ID NO: 181770 - DNA, 103 bp, Artificial Sequence
  Synthetic Polynucleotide
taatacgactcactataggggtttattgcgtctctccgaggggaagtattaacagaggagaaatactatgcctcggagaaacctggcggcagcgcaaaagatg

SEQ ID NO: 181771 - DNA, 103 bp, Artificial Sequence
  Synthetic Polynucleotide
taatacgactcactatagggaggtcaaaggggctggctgcatgttcagggaacagaggagaccctgaatgtgcagccagaacctggcggcagcgcaaaagatg

SEQ ID NO: 181772 - DNA, 103 bp, Artificial Sequence
  Synthetic Polynucleotide
taatacgactcactatagggaattcttccgaggtcaaaggggctggctgcaacagaggagagcagccatgccctttgacaacctggcggcagcgcaaaagatg

SEQ ID NO: 181773 - DNA, 103 bp, Artificial Sequence
  Synthetic Polynucleotide
taatacgactcactatagggcacgtgtttaaattcttccgaggtcaaaggaacagaggagacctttgatgtcggaagaaaacctggcggcagcgcaaaagatg

SEQ ID NO: 181774 - DNA, 103 bp, Artificial Sequence
  Synthetic Polynucleotide
taatacgactcactatagggctgtgagccccacgtgtttaaattcttccgaacagaggagacggaagatgttaaacacgaacctggcggcagcgcaaaagatg

SEQ ID NO: 181775 - DNA, 103 bp, Artificial Sequence
  Synthetic Polynucleotide
taatacgactcactatagggagaacagccgctgtgagccccacgtgtttaaacagaggagataaacaatgggggctcacaacctggcggcagcgcaaaagatg

SEQ ID NO: 181776 - DNA, 103 bp, Artificial Sequence
  Synthetic Polynucleotide
taatacgactcactataggggtgcgctgacagaacagccgctgtgagcccaacagaggagagggctcatggcggctgttaacctggcggcagcgcaaaagatg

SEQ ID NO: 181777 - DNA, 103 bp, Artificial Sequence
  Synthetic Polynucleotide
taatacgactcactatagggccttctgggtgtgcgctgacagaacagccgaacagaggagacggctgatgtgtcagcgcaacctggcggcagcgcaaaagatg

SEQ ID NO: 181778 - DNA, 103 bp, Artificial Sequence
  Synthetic Polynucleotide
taatacgactcactatagggttctgctcttccttctgggtgtgcgctgacaacagaggagagtcagcatgcacccagaaaacctggcggcagcgcaaaagatg

SEQ ID NO: 181779 - DNA, 103 bp, Artificial Sequence
  Synthetic Polynucleotide
taatacgactcactatagggatcaacataattctgctcttccttctgggtaacagaggagaacccagatggaagagcagaacctggcggcagcgcaaaagatg

SEQ ID NO: 181780 - DNA, 103 bp, Artificial Sequence
  Synthetic Polynucleotide
taatacgactcactatagggctcggaatttatcaacataattctgctcttaacagaggagaaagagcatgattatgttgaacctggcggcagcgcaaaagatg

SEQ ID NO: 181781 - DNA, 103 bp, Artificial Sequence
  Synthetic Polynucleotide
taatacgactcactatagggagagtgcttggtttattgcgtctctccgagaacagaggagactcggaatgacgcaataaaacctggcggcagcgcaaaagatg

SEQ ID NO: 181782 - DNA, 103 bp, Artificial Sequence
  Synthetic Polynucleotide
taatacgactcactatagggaggatcttttctcggaatttatcaacataaaacagaggagattatgtatgtaaattccgaacctggcggcagcgcaaaagatg

SEQ ID NO: 181783 - DNA, 103 bp, Artificial Sequence
  Synthetic Polynucleotide
taatacgactcactataggggggtgatgacaggatcttttctcggaatttaacagaggagaaaattcatggaaaagatcaacctggcggcagcgcaaaagatg

SEQ ID NO: 181784 - DNA, 103 bp, Artificial Sequence
  Synthetic Polynucleotide
taatacgactcactatagggaggagctgtagggtgatgacaggatcttttaacagaggagaaaaagaatgtgtcatcacaacctggcggcagcgcaaaagatg

SEQ ID NO: 181785 - DNA, 103 bp, Artificial Sequence
  Synthetic Polynucleotide
taatacgactcactatagggtgctgaagataggagctgtagggtgatgacaacagaggagagtcatcatgctacagctcaacctggcggcagcgcaaaagatg

SEQ ID NO: 181786 - DNA, 103 bp, Artificial Sequence
  Synthetic Polynucleotide
taatacgactcactatagggcctgctttcttgctgaagataggagctgtaaacagaggagatacagcatgtatcttcagaacctggcggcagcgcaaaagatg

SEQ ID NO: 181787 - DNA, 103 bp, Artificial Sequence
  Synthetic Polynucleotide
taatacgactcactatagggtagctttgctcctgctttcttgctgaagataacagaggagaatcttcatgaagaaagcaaacctggcggcagcgcaaaagatg

SEQ ID NO: 181788 - DNA, 103 bp, Artificial Sequence
  Synthetic Polynucleotide
taatacgactcactatagggtatgaatatttagctttgctcctgctttctaacagaggagaagaaagatggagcaaagcaacctggcggcagcgcaaaagatg

SEQ ID NO: 181789 - DNA, 103 bp, Artificial Sequence
  Synthetic Polynucleotide
taatacgactcactatagggtccttgaaaatatgaatatttagctttgctaacagaggagaagcaaaatgaaatattcaaacctggcggcagcgcaaaagatg

SEQ ID NO: 181790 - DNA, 103 bp, Artificial Sequence
  Synthetic Polynucleotide
taatacgactcactatagggaagtagaatctccttgaaaatatgaatattaacagaggagaaatattatgattttcaagaacctggcggcagcgcaaaagatg

SEQ ID NO: 181791 - DNA, 103 bp, Artificial Sequence
  Synthetic Polynucleotide
taatacgactcactataggggtctgcttggaagtagaatctccttgaaaaaacagaggagattttcaatgagattctacaacctggcggcagcgcaaaagatg

SEQ ID NO: 181792 - DNA, 103 bp, Artificial Sequence
  Synthetic Polynucleotide
taatacgactcactataggggagggcatctagagtgcttggtttattgcgaacagaggagacgcaatatgccaagcactaacctggcggcagcgcaaaagatg

SEQ ID NO: 181793 - DNA, 103 bp, Artificial Sequence
  Synthetic Polynucleotide
taatacgactcactatagggggccgaccgcgtctgcttggaagtagaatcaacagaggagagattctatgtccaagcagaacctggcggcagcgcaaaagatg

SEQ ID NO: 181794 - DNA, 103 bp, Artificial Sequence
  Synthetic Polynucleotide
taatacgactcactatagggtcctgcagccggccgaccgcgtctgcttggaacagaggagaccaagcatgcgcggtcggaacctggcggcagcgcaaaagatg

SEQ ID NO: 181795 - DNA, 103 bp, Artificial Sequence
  Synthetic Polynucleotide
taatacgactcactatagggtgcttccctttcctgcagccggccgaccgcaacagaggagagcggtcatgcggctgcagaacctggcggcagcgcaaaagatg

SEQ ID NO: 181796 - DNA, 103 bp, Artificial Sequence
  Synthetic Polynucleotide
taatacgactcactatagggcttccgcttgtgcttccctttcctgcagccaacagaggagaggctgcatgaaagggaagaacctggcggcagcgcaaaagatg

SEQ ID NO: 181797 - DNA, 103 bp, Artificial Sequence
  Synthetic Polynucleotide
taatacgactcactatagggccggcagcttcttccgcttgtgcttcccttaacagaggagaaagggaatgacaagcggaaacctggcggcagcgcaaaagatg

SEQ ID NO: 181798 - DNA, 103 bp, Artificial Sequence
  Synthetic Polynucleotide
taatacgactcactatagggtctggcggctccggcagcttcttccgcttgaacagaggagacaagcgatggaagctgccaacctggcggcagcgcaaaagatg

SEQ ID NO: 181799 - DNA, 103 bp, Artificial Sequence
  Synthetic Polynucleotide
taatacgactcactataggggctgctgctgtctggcggctccggcagcttaacagaggagaaagctgatggagccgccaaacctggcggcagcgcaaaagatg

SEQ ID NO: 181800 - DNA, 103 bp, Artificial Sequence
  Synthetic Polynucleotide
taatacgactcactatagggcggtgttcgagctgctgctgtctggcggctaacagaggagaagccgcatgacagcagcaaacctggcggcagcgcaaaagatg

SEQ ID NO: 181801 - DNA, 103 bp, Artificial Sequence
  Synthetic Polynucleotide
taatacgactcactatagggggaccagagccggtgttcgagctgctgctgaacagaggagacagcagatgctcgaacacaacctggcggcagcgcaaaagatg

SEQ ID NO: 181802 - DNA, 103 bp, Artificial Sequence
  Synthetic Polynucleotide
taatacgactcactatagggtcccctgcggggaccagagccggtgttcgaaacagaggagatcgaacatgggctctggtaacctggcggcagcgcaaaagatg

SEQ ID NO: 181803 - DNA, 103 bp, Artificial Sequence
  Synthetic Polynucleotide
taatacgactcactataggggagcatagttgagggcatctagagtgcttgaacagaggagacaagcaatgtagatgcccaacctggcggcagcgcaaaagatg

SEQ ID NO: 181804 - DNA, 103 bp, Artificial Sequence
  Synthetic Polynucleotide
taatacgactcactatagggtctgatgcgctcccctgcggggaccagagcaacagaggagagctctgatgcccgcagggaacctggcggcagcgcaaaagatg

SEQ ID NO: 181805 - DNA, 103 bp, Artificial Sequence
  Synthetic Polynucleotide
taatacgactcactatagggggctgtgcgttctgatgcgctcccctgcggaacagaggagaccgcagatgagcgcatcaaacctggcggcagcgcaaaagatg

SEQ ID NO: 181806 - DNA, 103 bp, Artificial Sequence
  Synthetic Polynucleotide
taatacgactcactatagggggggcagcagggctgtgcgttctgatgcgcaacagaggagagcgcatatgaacgcacagaacctggcggcagcgcaaaagatg

SEQ ID NO: 181807 - DNA, 103 bp, Artificial Sequence
  Synthetic Polynucleotide
taatacgactcactatagggaggccgcggaggggcagcagggctgtgcgtaacagaggagaacgcacatgcctgctgccaacctggcggcagcgcaaaagatg

SEQ ID NO: 181808 - DNA, 103 bp, Artificial Sequence
  Synthetic Polynucleotide
taatacgactcactatagggtgcggagaggaggccgcggaggggcagcagaacagaggagactgctgatgctccgcggcaacctggcggcagcgcaaaagatg

SEQ ID NO: 181809 - DNA, 103 bp, Artificial Sequence
  Synthetic Polynucleotide
taatacgactcactataggggctcgaggtgtgcggagaggaggccgcggaaacagaggagatccgcgatgtcctctccgaacctggcggcagcgcaaaagatg

SEQ ID NO: 181810 - DNA, 103 bp, Artificial Sequence
  Synthetic Polynucleotide
taatacgactcactatagggggaaggtcgggctcgaggtgtgcggagaggaacagaggagacctctcatgacacctcgaaacctggcggcagcgcaaaagatg

SEQ ID NO: 181811 - DNA, 103 bp, Artificial Sequence
  Synthetic Polynucleotide
taatacgactcactataggggcggcaggtgggaaggtcgggctcgaggtgaacagaggagacacctcatgcccgaccttaacctggcggcagcgcaaaagatg

SEQ ID NO: 181812 - DNA, 103 bp, Artificial Sequence
  Synthetic Polynucleotide
taatacgactcactataggggggcaccatggcggcaggtgggaaggtcggaacagaggagaccgaccatgccacctgccaacctggcggcagcgcaaaagatg

SEQ ID NO: 181813 - DNA, 103 bp, Artificial Sequence
  Synthetic Polynucleotide
taatacgactcactataggggggcctggctgggcaccatggcggcaggtgaacagaggagacacctgatgccatggtgcaacctggcggcagcgcaaaagatg

SEQ ID NO: 181814 - DNA, 103 bp, Artificial Sequence
  Synthetic Polynucleotide
taatacgactcactatagggacacagcggagagcatagttgagggcatctaacagaggagaagatgcatgcaactatgcaacctggcggcagcgcaaaagatg

SEQ ID NO: 181815 - DNA, 103 bp, Artificial Sequence
  Synthetic Polynucleotide
taatacgactcactatagggacgaggtaaggggcctggctgggcaccatgaacagaggagacatggtatgcagccaggcaacctggcggcagcgcaaaagatg

SEQ ID NO: 181816 - DNA, 103 bp, Artificial Sequence
  Synthetic Polynucleotide
taatacgactcactatagggaaaagctgggacgaggtaaggggcctggctaacagaggagaagccagatgccttacctcaacctggcggcagcgcaaaagatg

SEQ ID NO: 181817 - DNA, 103 bp, Artificial Sequence
  Synthetic Polynucleotide
taatacgactcactatagggctgggaggggaaaagctgggacgaggtaagaacagaggagacttaccatgtcccagcttaacctggcggcagcgcaaaagatg

SEQ ID NO: 181818 - DNA, 103 bp, Artificial Sequence
  Synthetic Polynucleotide
taatacgactcactataggggaggtcgcggctgggaggggaaaagctgggaacagaggagacccagcatgtcccctcccaacctggcggcagcgcaaaagatg

SEQ ID NO: 181819 - DNA, 103 bp, Artificial Sequence
  Synthetic Polynucleotide
taatacgactcactatagggtcttccgggtgaggtcgcggctgggaggggaacagaggagacccctcatggccgcgaccaacctggcggcagcgcaaaagatg

SEQ ID NO: 181820 - DNA, 103 bp, Artificial Sequence
  Synthetic Polynucleotide
taatacgactcactatagggctgcgtattctcttccgggtgaggtcgcggaacagaggagaccgcgaatgcacccggaaaacctggcggcagcgcaaaagatg

SEQ ID NO: 181821 - DNA, 103 bp, Artificial Sequence
  Synthetic Polynucleotide
taatacgactcactataggggttccgggggctgcgtattctcttccgggtaacagaggagaacccggatgagaatacgcaacctggcggcagcgcaaaagatg

SEQ ID NO: 181822 - DNA, 103 bp, Artificial Sequence
  Synthetic Polynucleotide
taatacgactcactatagggttccggtgcagttccgggggctgcgtattcaacagaggagagaatacatggcccccggaaacctggcggcagcgcaaaagatg

SEQ ID NO: 181823 - DNA, 103 bp, Artificial Sequence
  Synthetic Polynucleotide
taatacgactcactatagggcatgcaggccttccggtgcagttccgggggaacagaggagacccccgatgctgcaccggaacctggcggcagcgcaaaagatg

SEQ ID NO: 181824 - DNA, 103 bp, Artificial Sequence
  Synthetic Polynucleotide
taatacgactcactatagggaagggcagcccatgcaggccttccggtgcaaacagaggagatgcaccatgaggcctgcaaacctggcggcagcgcaaaagatg

SEQ ID NO: 181825 - DNA, 103 bp, Artificial Sequence
  Synthetic Polynucleotide
taatacgactcactatagggaacgctgtggacacagcggagagcatagttaacagaggagaaactatatgctccgctgtaacctggcggcagcgcaaaagatg

SEQ ID NO: 181826 - DNA, 103 bp, Artificial Sequence
  Synthetic Polynucleotide
taatacgactcactataggggccctcggacaagggcagcccatgcaggccaacagaggagaggcctgatggggctgcccaacctggcggcagcgcaaaagatg

SEQ ID NO: 181827 - DNA, 103 bp, Artificial Sequence
  Synthetic Polynucleotide
taatacgactcactatagggaaggctgcaagccctcggacaagggcagccaacagaggagaggctgcatgtgtccgaggaacctggcggcagcgcaaaagatg

SEQ ID NO: 181828 - DNA, 103 bp, Artificial Sequence
  Synthetic Polynucleotide
taatacgactcactatagggaaagctgggtaaggctgcaagccctcggacaacagaggagagtccgaatgcttgcagccaacctggcggcagcgcaaaagatg

SEQ ID NO: 181829 - DNA, 103 bp, Artificial Sequence
  Synthetic Polynucleotide
taatacgactcactatagggaggaaaagggaaagctgggtaaggctgcaaaacagaggagattgcagatgtacccagctaacctggcggcagcgcaaaagatg

SEQ ID NO: 181830 - DNA, 103 bp, Artificial Sequence
  Synthetic Polynucleotide
taatacgactcactatagggtatccaagtaaggaaaagggaaagctgggtaacagaggagaacccagatgtcccttttcaacctggcggcagcgcaaaagatg

SEQ ID NO: 181831 - DNA, 103 bp, Artificial Sequence
  Synthetic Polynucleotide
taatacgactcactataggggtcataaaagtatccaagtaaggaaaagggaacagaggagaccctttatgttacttggaaacctggcggcagcgcaaaagatg

SEQ ID NO: 181832 - DNA, 103 bp, Artificial Sequence
  Synthetic Polynucleotide
taatacgactcactatagggcaggaaaacggtcataaaagtatccaagtaaacagaggagatacttgatgacttttatgaacctggcggcagcgcaaaagatg

SEQ ID NO: 181833 - DNA, 103 bp, Artificial Sequence
  Synthetic Polynucleotide
taatacgactcactataggggggggtcaggcaggaaaacggtcataaaagaacagaggagacttttaatgccgttttccaacctggcggcagcgcaaaagatg

SEQ ID NO: 181834 - DNA, 103 bp, Artificial Sequence
  Synthetic Polynucleotide
taatacgactcactatagggggacagacaggggggtcaggcaggaaaacgaacagaggagacgttttatggcctgacccaacctggcggcagcgcaaaagatg

SEQ ID NO: 181835 - DNA, 103 bp, Artificial Sequence
  Synthetic Polynucleotide
taatacgactcactatagggcgacaacagaggacagacaggggggtcaggaacagaggagacctgacatgcctgtctgtaacctggcggcagcgcaaaagatg

SEQ ID NO: 181836 - DNA, 103 bp, Artificial Sequence
  Synthetic Polynucleotide
taatacgactcactatagggtgtttgcttgaacgctgtggacacagcggaaacagaggagatccgctatgtccacagcgaacctggcggcagcgcaaaagatg

SEQ ID NO: 181837 - DNA, 103 bp, Artificial Sequence
  Synthetic Polynucleotide
taatacgactcactatagggaaaacgatggcgacaacagaggacagacagaacagaggagactgtctatgctctgttgtaacctggcggcagcgcaaaagatg

SEQ ID NO: 181838 - DNA, 103 bp, Artificial Sequence
  Synthetic Polynucleotide
taatacgactcactatagggggacatggcaaaaacgatggcgacaacagaaacagaggagatctgttatggccatcgttaacctggcggcagcgcaaaagatg

SEQ ID NO: 181839 - DNA, 103 bp, Artificial Sequence
  Synthetic Polynucleotide
taatacgactcactatagggccccaggaatggacatggcaaaaacgatggaacagaggagaccatcgatgttgccatgtaacctggcggcagcgcaaaagatg

SEQ ID NO: 181840 - DNA, 103 bp, Artificial Sequence
  Synthetic Polynucleotide
taatacgactcactatagggaggctgtcgcccccaggaatggacatggcaaacagaggagatgccatatgcattcctggaacctggcggcagcgcaaaagatg

SEQ ID NO: 181841 - DNA, 103 bp, Artificial Sequence
  Synthetic Polynucleotide
taatacgactcactatagggatcgcagaagaggctgtcgcccccaggaataacagaggagaattcctatgggcgacagcaacctggcggcagcgcaaaagatg

SEQ ID NO: 181842 - DNA, 103 bp, Artificial Sequence
  Synthetic Polynucleotide
taatacgactcactatagggtgagggtgatatcgcagaagaggctgtcgcaacagaggagagcgacaatgtcttctgcgaacctggcggcagcgcaaaagatg

SEQ ID NO: 181843 - DNA, 103 bp, Artificial Sequence
  Synthetic Polynucleotide
taatacgactcactatagggctgacgacattgagggtgatatcgcagaagaacagaggagacttctgatgtatcaccctaacctggcggcagcgcaaaagatg

SEQ ID NO: 181844 - DNA, 103 bp, Artificial Sequence
  Synthetic Polynucleotide
taatacgactcactatagggggactcattgctgacgacattgagggtgataacagaggagaatcaccatgaatgtcgtcaacctggcggcagcgcaaaagatg

SEQ ID NO: 181845 - DNA, 103 bp, Artificial Sequence
  Synthetic Polynucleotide
taatacgactcactataggggtccagagttggactcattgctgacgacataacagaggagaatgtcgatggcaatgagtaacctggcggcagcgcaaaagatg

SEQ ID NO: 181846 - DNA, 103 bp, Artificial Sequence
  Synthetic Polynucleotide
taatacgactcactatagggaagggggtgggtccagagttggactcattgaacagaggagacaatgaatgcaactctggaacctggcggcagcgcaaaagatg

SEQ ID NO: 181847 - DNA, 103 bp, Artificial Sequence
  Synthetic Polynucleotide
taatacgactcactatagggaaaaactcactgtttgcttgaacgctgtggaacagaggagaccacagatgtcaagcaaaaacctggcggcagcgcaaaagatg

SEQ ID NO: 181848 - DNA, 103 bp, Artificial Sequence
  Synthetic Polynucleotide
taatacgactcactatagggctggtgactgaagggggtgggtccagagttaacagaggagaaactctatgcccacccccaacctggcggcagcgcaaaagatg

SEQ ID NO: 181849 - DNA, 103 bp, Artificial Sequence
  Synthetic Polynucleotide
taatacgactcactatagggtctcctttggctggtgactgaagggggtggaacagaggagaccacccatgtcagtcaccaacctggcggcagcgcaaaagatg

SEQ ID NO: 181850 - DNA, 103 bp, Artificial Sequence
  Synthetic Polynucleotide
taatacgactcactatagggtttcctcctctctcctttggctggtgactgaacagaggagacagtcaatggccaaaggaaacctggcggcagcgcaaaagatg

SEQ ID NO: 181851 - DNA, 103 bp, Artificial Sequence
  Synthetic Polynucleotide
taatacgactcactataggggcctcccacttttcctcctctctcctttggaacagaggagaccaaagatgagaggaggaaacctggcggcagcgcaaaagatg

SEQ ID NO: 181852 - DNA, 103 bp, Artificial Sequence
  Synthetic Polynucleotide
taatacgactcactatagggctcgctttgtgcctcccacttttcctcctcaacagaggagagaggagatgaagtgggagaacctggcggcagcgcaaaagatg

SEQ ID NO: 181853 - DNA, 103 bp, Artificial Sequence
  Synthetic Polynucleotide
taatacgactcactatagggacgggtgcccctcgctttgtgcctcccactaacagaggagaagtgggatgcacaaagcgaacctggcggcagcgcaaaagatg

SEQ ID NO: 181854 - DNA, 103 bp, Artificial Sequence
  Synthetic Polynucleotide
taatacgactcactataggggaagtaatgaacgggtgcccctcgctttgtaacagaggagaacaaagatgggggcacccaacctggcggcagcgcaaaagatg

SEQ ID NO: 181855 - DNA, 103 bp, Artificial Sequence
  Synthetic Polynucleotide
taatacgactcactataggggctgcttctcgaagtaatgaacgggtgcccaacagaggagagggcacatgttcattactaacctggcggcagcgcaaaagatg

SEQ ID NO: 181856 - DNA, 103 bp, Artificial Sequence
  Synthetic Polynucleotide
taatacgactcactataggggcaagggtgagctgcttctcgaagtaatgaaacagaggagatcattaatgcgagaagcaaacctggcggcagcgcaaaagatg

SEQ ID NO: 181857 - DNA, 103 bp, Artificial Sequence
  Synthetic Polynucleotide
taatacgactcactatagggaagtttaactgcaagggtgagctgcttctcaacagaggagagagaagatgctcacccttaacctggcggcagcgcaaaagatg

SEQ ID NO: 181858 - DNA, 103 bp, Artificial Sequence
  Synthetic Polynucleotide
taatacgactcactataggggagaatctggaaaaactcactgtttgcttgaacagaggagacaagcaatgagtgagtttaacctggcggcagcgcaaaagatg

SEQ ID NO: 181859 - DNA, 103 bp, Artificial Sequence
  Synthetic Polynucleotide
taatacgactcactatagggttcctgaagtaagtttaactgcaagggtgaaacagaggagatcacccatgcagttaaacaacctggcggcagcgcaaaagatg

SEQ ID NO: 181860 - DNA, 103 bp, Artificial Sequence
  Synthetic Polynucleotide
taatacgactcactatagggtgggcatctcttcctgaagtaagtttaactaacagaggagaagttaaatgtacttcaggaacctggcggcagcgcaaaagatg

SEQ ID NO: 181861 - DNA, 103 bp, Artificial Sequence
  Synthetic Polynucleotide
taatacgactcactatagggtcagagggtctgggcatctcttcctgaagtaacagaggagaacttcaatgagagatgccaacctggcggcagcgcaaaagatg

SEQ ID NO: 181862 - DNA, 103 bp, Artificial Sequence
  Synthetic Polynucleotide
taatacgactcactatagggatctggagattcagagggtctgggcatctcaacagaggagagagatgatgagaccctctaacctggcggcagcgcaaaagatg

SEQ ID NO: 181863 - DNA, 103 bp, Artificial Sequence
  Synthetic Polynucleotide
taatacgactcactatagggttctcatctgatctggagattcagagggtcaacagaggagagaccctatgaatctccagaacctggcggcagcgcaaaagatg

SEQ ID NO: 181864 - DNA, 103 bp, Artificial Sequence
  Synthetic Polynucleotide
taatacgactcactatagggcacgtgttccttctcatctgatctggagataacagaggagaatctccatgtcagatgagaacctggcggcagcgcaaaagatg

SEQ ID NO: 181865 - DNA, 103 bp, Artificial Sequence
  Synthetic Polynucleotide
taatacgactcactatagggagtttgtgggcacgtgttccttctcatctgaacagaggagacagatgatgaggaacacgaacctggcggcagcgcaaaagatg

SEQ ID NO: 181866 - DNA, 103 bp, Artificial Sequence
  Synthetic Polynucleotide
taatacgactcactatagggactgatactcagtttgtgggcacgtgttccaacagaggagaggaacaatggcccacaaaaacctggcggcagcgcaaaagatg

SEQ ID NO: 181867 - DNA, 103 bp, Artificial Sequence
  Synthetic Polynucleotide
taatacgactcactatagggcctgtaacacactgatactcagtttgtgggaacagaggagacccacaatgtgagtatcaaacctggcggcagcgcaaaagatg

SEQ ID NO: 181868 - DNA, 103 bp, Artificial Sequence
  Synthetic Polynucleotide
taatacgactcactataggggccattgttgcctgtaacacactgatactcaacagaggagagagtatatgtgtgttacaaacctggcggcagcgcaaaagatg

SEQ ID NO: 181869 - DNA, 103 bp, Artificial Sequence
  Synthetic Polynucleotide
taatacgactcactatagggcattctgactgagaatctggaaaaactcacaacagaggagagtgagtatgtccagattcaacctggcggcagcgcaaaagatg

SEQ ID NO: 181870 - DNA, 103 bp, Artificial Sequence
  Synthetic Polynucleotide
taatacgactcactatagggtgctctcactgccattgttgcctgtaacacaacagaggagagtgttaatggcaacaatgaacctggcggcagcgcaaaagatg

SEQ ID NO: 181871 - DNA, 103 bp, Artificial Sequence
  Synthetic Polynucleotide
taatacgactcactataggggtagcaggactgctctcactgccattgttgaacagaggagacaacaaatgcagtgagagaacctggcggcagcgcaaaagatg

SEQ ID NO: 181872 - DNA, 103 bp, Artificial Sequence
  Synthetic Polynucleotide
taatacgactcactatagggtgcaccggtagtagcaggactgctctcactaacagaggagaagtgagatgagtcctgctaacctggcggcagcgcaaaagatg

SEQ ID NO: 181873 - DNA, 103 bp, Artificial Sequence
  Synthetic Polynucleotide
taatacgactcactatagggccgtggacagtgcaccggtagtagcaggacaacagaggagagtcctgatgctaccggtgaacctggcggcagcgcaaaagatg

SEQ ID NO: 181874 - DNA, 103 bp, Artificial Sequence
  Synthetic Polynucleotide
taatacgactcactatagggggaggtgaccccgtggacagtgcaccggtaaacagaggagataccggatgactgtccacaacctggcggcagcgcaaaagatg

SEQ ID NO: 181875 - DNA, 103 bp, Artificial Sequence
  Synthetic Polynucleotide
taatacgactcactatagggattctccctgggaggtgaccccgtggacagaacagaggagactgtccatggggtcacctaacctggcggcagcgcaaaagatg

SEQ ID NO: 181876 - DNA, 103 bp, Artificial Sequence
  Synthetic Polynucleotide
taatacgactcactataggggatgggatggattctccctgggaggtgaccaacagaggagaggtcacatgccagggagaaacctggcggcagcgcaaaagatg

SEQ ID NO: 181877 - DNA, 103 bp, Artificial Sequence
  Synthetic Polynucleotide
taatacgactcactatagggctggcagtaggatgggatggattctccctgaacagaggagacagggaatgtccatcccaaacctggcggcagcgcaaaagatg

SEQ ID NO: 181878 - DNA, 103 bp, Artificial Sequence
  Synthetic Polynucleotide
taatacgactcactatagggggacagagcgctggcagtaggatgggatggaacagaggagaccatccatgcctactgccaacctggcggcagcgcaaaagatg

SEQ ID NO: 181879 - DNA, 103 bp, Artificial Sequence
  Synthetic Polynucleotide
taatacgactcactataggggcgatcctgtggacagagcgctggcagtagaacagaggagactactgatggcgctctgtaacctggcggcagcgcaaaagatg

SEQ ID NO: 181880 - DNA, 103 bp, Artificial Sequence
  Synthetic Polynucleotide
taatacgactcactatagggtcgtccttagccccccgtctcccggggccaaacagaggagatggcccatggagacggggaacctggcggcagcgcaaaagatg

SEQ ID NO: 181881 - DNA, 103 bp, Artificial Sequence
  Synthetic Polynucleotide
taatacgactcactatagggtgaggtgctccattctgactgagaatctggaacagaggagaccagatatgcagtcagaaaacctggcggcagcgcaaaagatg

SEQ ID NO: 181882 - DNA, 103 bp, Artificial Sequence
  Synthetic Polynucleotide
taatacgactcactatagggttcatgggaggcgatcctgtggacagagcgaacagaggagacgctctatgcacaggatcaacctggcggcagcgcaaaagatg

SEQ ID NO: 181883 - DNA, 103 bp, Artificial Sequence
  Synthetic Polynucleotide
taatacgactcactatagggggatggattcttcatgggaggcgatcctgtaacagaggagaacaggaatgcctcccatgaacctggcggcagcgcaaaagatg

SEQ ID NO: 181884 - DNA, 103 bp, Artificial Sequence
  Synthetic Polynucleotide
taatacgactcactatagggcagtaggatgggatggattcttcatgggagaacagaggagactcccaatgagaatccataacctggcggcagcgcaaaagatg

SEQ ID NO: 181885 - DNA, 103 bp, Artificial Sequence
  Synthetic Polynucleotide
taatacgactcactatagggagagcgctggcagtaggatgggatggattcaacagaggagagaatccatgccatcctacaacctggcggcagcgcaaaagatg

SEQ ID NO: 181886 - DNA, 103 bp, Artificial Sequence
  Synthetic Polynucleotide
taatacgactcactatagggtcctgtggacagagcgctggcagtaggatgaacagaggagacatcctatggccagcgctaacctggcggcagcgcaaaagatg

SEQ ID NO: 181887 - DNA, 103 bp, Artificial Sequence
  Synthetic Polynucleotide
taatacgactcactatagggtgggaggcgatcctgtggacagagcgctggaacagaggagaccagcgatgtgtccacagaacctggcggcagcgcaaaagatg

SEQ ID NO: 181888 - DNA, 103 bp, Artificial Sequence
  Synthetic Polynucleotide
taatacgactcactatagggggattcttcatgggaggcgatcctgtggacaacagaggagagtccacatgatcgcctccaacctggcggcagcgcaaaagatg

SEQ ID NO: 181889 - DNA, 103 bp, Artificial Sequence
  Synthetic Polynucleotide
taatacgactcactatagggaggatgggatggattcttcatgggaggcgaaacagaggagatcgcctatgatgaagaataacctggcggcagcgcaaaagatg

SEQ ID NO: 181890 - DNA, 103 bp, Artificial Sequence
  Synthetic Polynucleotide
taatacgactcactatagggtgctggcagtaggatgggatggattcttcaaacagaggagatgaagaatgcatcccatcaacctggcggcagcgcaaaagatg

SEQ ID NO: 181891 - DNA, 103 bp, Artificial Sequence
  Synthetic Polynucleotide
taatacgactcactatagggatggacagtgtgctggcagtaggatgggataacagaggagaatcccaatgtactgccagaacctggcggcagcgcaaaagatg

SEQ ID NO: 181892 - DNA, 103 bp, Artificial Sequence
  Synthetic Polynucleotide
taatacgactcactatagggcacatctgcctgaggtgctccattctgactaacagaggagaagtcagatgggagcacctaacctggcggcagcgcaaaagatg

SEQ ID NO: 181893 - DNA, 103 bp, Artificial Sequence
  Synthetic Polynucleotide
taatacgactcactatagggaggcaatcccatggacagtgtgctggcagtaacagaggagaactgccatgacactgtccaacctggcggcagcgcaaaagatg

SEQ ID NO: 181894 - DNA, 103 bp, Artificial Sequence
  Synthetic Polynucleotide
taatacgactcactatagggtcctgctgggaggcaatcccatggacagtgaacagaggagacactgtatgtgggattgcaacctggcggcagcgcaaaagatg

SEQ ID NO: 181895 - DNA, 103 bp, Artificial Sequence
  Synthetic Polynucleotide
taatacgactcactatagggtgggatggagtcctgctgggaggcaatcccaacagaggagagggattatgtcccagcagaacctggcggcagcgcaaaagatg

SEQ ID NO: 181896 - DNA, 103 bp, Artificial Sequence
  Synthetic Polynucleotide
taatacgactcactatagggggcagtaggatgggatggagtcctgctgggaacagaggagacccagcatgactccatccaacctggcggcagcgcaaaagatg

SEQ ID NO: 181897 - DNA, 103 bp, Artificial Sequence
  Synthetic Polynucleotide
taatacgactcactatagggacagaacagtggcagtaggatgggatggagaacagaggagactccatatgatcctactgaacctggcggcagcgcaaaagatg

SEQ ID NO: 181898 - DNA, 103 bp, Artificial Sequence
  Synthetic Polynucleotide
taatacgactcactataggggaccccgtggacagaacagtggcagtaggaaacagaggagatcctacatgcactgttctaacctggcggcagcgcaaaagatg

SEQ ID NO: 181899 - DNA, 103 bp, Artificial Sequence
  Synthetic Polynucleotide
taatacgactcactataggggctgggaggtgaccccgtggacagaacagtaacagaggagaactgttatgtccacggggaacctggcggcagcgcaaaagatg

SEQ ID NO: 181900 - DNA, 103 bp, Artificial Sequence
  Synthetic Polynucleotide
taatacgactcactatagggatggggattcgctgggaggtgaccccgtggaacagaggagaccacggatgcacctcccaaacctggcggcagcgcaaaagatg

SEQ ID NO: 181901 - DNA, 103 bp, Artificial Sequence
  Synthetic Polynucleotide
taatacgactcactatagggccagttctggatggggattcgctgggaggtaacagaggagaacctccatgcgaatccccaacctggcggcagcgcaaaagatg

SEQ ID NO: 181902 - DNA, 103 bp, Artificial Sequence
  Synthetic Polynucleotide
taatacgactcactatagggtgctgctgaaccagttctggatggggattcaacagaggagagaatccatgtccagaactaacctggcggcagcgcaaaagatg

SEQ ID NO: 181903 - DNA, 103 bp, Artificial Sequence
  Synthetic Polynucleotide
taatacgactcactatagggtgtacatgctcacatctgcctgaggtgctcaacagaggagagagcacatgaggcagatgaacctggcggcagcgcaaaagatg

SEQ ID NO: 181904 - DNA, 103 bp, Artificial Sequence
  Synthetic Polynucleotide
taatacgactcactatagggtgcttcctgatgctgctgaaccagttctggaacagaggagaccagaaatggttcagcagaacctggcggcagcgcaaaagatg

SEQ ID NO: 181905 - DNA, 103 bp, Artificial Sequence
  Synthetic Polynucleotide
taatacgactcactatagggctgctgtcgctgcttcctgatgctgctgaaaacagaggagattcagcatgatcaggaagaacctggcggcagcgcaaaagatg

SEQ ID NO: 181906 - DNA, 103 bp, Artificial Sequence
  Synthetic Polynucleotide
taatacgactcactatagggaaggtatatactgctgtcgctgcttcctgaaacagaggagatcaggaatgagcgacagcaacctggcggcagcgcaaaagatg

SEQ ID NO: 181907 - DNA, 103 bp, Artificial Sequence
  Synthetic Polynucleotide
taatacgactcactatagggcactactagtaaggtatatactgctgtcgcaacagaggagagcgacaatggtatataccaacctggcggcagcgcaaaagatg

SEQ ID NO: 181908 - DNA, 103 bp, Artificial Sequence
  Synthetic Polynucleotide
taatacgactcactataggggaagaataaacactactagtaaggtatataaacagaggagatatataatgtactagtagaacctggcggcagcgcaaaagatg

SEQ ID NO: 181909 - DNA, 103 bp, Artificial Sequence
  Synthetic Polynucleotide
taatacgactcactatagggggagattttagaagaataaacactactagtaacagaggagaactagtatggtttattctaacctggcggcagcgcaaaagatg

SEQ ID NO: 181910 - DNA, 103 bp, Artificial Sequence
  Synthetic Polynucleotide
taatacgactcactataggggcccattttgggagattttagaagaataaaaacagaggagatttattatgctaaaatctaacctggcggcagcgcaaaagatg

SEQ ID NO: 181911 - DNA, 103 bp, Artificial Sequence
  Synthetic Polynucleotide
taatacgactcactatagggtgagattgctgcccattttgggagattttaaacagaggagataaaatatgccaaaatggaacctggcggcagcgcaaaagatg

SEQ ID NO: 181912 - DNA, 103 bp, Artificial Sequence
  Synthetic Polynucleotide
taatacgactcactatagggctgtacgtcctgagattgctgcccattttgaacagaggagacaaaatatgcagcaatctaacctggcggcagcgcaaaagatg

SEQ ID NO: 181913 - DNA, 103 bp, Artificial Sequence
  Synthetic Polynucleotide
taatacgactcactatagggtttcttttttctgtacgtcctgagattgctaacagaggagaagcaatatgaggacgtacaacctggcggcagcgcaaaagatg

SEQ ID NO: 181914 - DNA, 103 bp, Artificial Sequence
  Synthetic Polynucleotide
taatacgactcactatagggtcctcaagactgtacatgctcacatctgccaacagaggagaggcagaatggagcatgtaaacctggcggcagcgcaaaagatg

SEQ ID NO: 181915 - DNA, 103 bp, Artificial Sequence
  Synthetic Polynucleotide
taatacgactcactatagggttaggaaatgtttcttttttctgtacgtccaacagaggagaggacgtatggaaaaaagaaacctggcggcagcgcaaaagatg

SEQ ID NO: 181916 - DNA, 103 bp, Artificial Sequence
  Synthetic Polynucleotide
taatacgactcactatagggttcggcgacattaggaaatgtttcttttttaacagaggagaaaaaaaatgacatttcctaacctggcggcagcgcaaaagatg

SEQ ID NO: 181917 - DNA, 103 bp, Artificial Sequence
  Synthetic Polynucleotide
taatacgactcactatagggagatgggctcttcggcgacattaggaaatgaacagaggagacatttcatgatgtcgccgaacctggcggcagcgcaaaagatg

SEQ ID NO: 181918 - DNA, 103 bp, Artificial Sequence
  Synthetic Polynucleotide
taatacgactcactatagggatcattctccagatgggctcttcggcgacaaacagaggagatgtcgcatgagagcccataacctggcggcagcgcaaaagatg

SEQ ID NO: 181919 - DNA, 103 bp, Artificial Sequence
  Synthetic Polynucleotide
taatacgactcactatagggtgtctgccgtatcattctccagatgggctcaacagaggagagagcccatgtggagaatgaacctggcggcagcgcaaaagatg

SEQ ID NO: 181920 - DNA, 103 bp, Artificial Sequence
  Synthetic Polynucleotide
taatacgactcactatagggtgcgctcaggtgtctgccgtatcattctccaacagaggagaggagaaatgtacggcagaaacctggcggcagcgcaaaagatg

SEQ ID NO: 181921 - DNA, 103 bp, Artificial Sequence
  Synthetic Polynucleotide
taatacgactcactataggggtcatgagaatgcgctcaggtgtctgccgtaacagaggagaacggcaatgacctgagcgaacctggcggcagcgcaaaagatg

SEQ ID NO: 181922 - DNA, 103 bp, Artificial Sequence
  Synthetic Polynucleotide
taatacgactcactatagggtacctggtatgtcatgagaatgcgctcaggaacagaggagacctgagatgattctcatgaacctggcggcagcgcaaaagatg

SEQ ID NO: 181923 - DNA, 103 bp, Artificial Sequence
  Synthetic Polynucleotide
taatacgactcactatagggccctctcaggtacctggtatgtcatgagaaaacagaggagattctcaatgcataccaggaacctggcggcagcgcaaaagatg

SEQ ID NO: 181924 - DNA, 103 bp, Artificial Sequence
  Synthetic Polynucleotide
taatacgactcactatagggacttctttaaccctctcaggtacctggtataacagaggagaataccaatgacctgagagaacctggcggcagcgcaaaagatg

SEQ ID NO: 181925 - DNA, 103 bp, Artificial Sequence
  Synthetic Polynucleotide
taatacgactcactatagggagtggccagctcctcaagactgtacatgctaacagaggagaagcatgatgagtcttgagaacctggcggcagcgcaaaagatg

SEQ ID NO: 181926 - DNA, 103 bp, Artificial Sequence
  Synthetic Polynucleotide
taatacgactcactatagggttttagtacaacttctttaaccctctcaggaacagaggagacctgagatggttaaagaaaacctggcggcagcgcaaaagatg

SEQ ID NO: 181927 - DNA, 103 bp, Artificial Sequence
  Synthetic Polynucleotide
taatacgactcactatagggccaggtcttcttttagtacaacttctttaaaacagaggagattaaagatgttgtactaaaacctggcggcagcgcaaaagatg

SEQ ID NO: 181928 - DNA, 103 bp, Artificial Sequence
  Synthetic Polynucleotide
taatacgactcactatagggtctagcttttccaggtcttcttttagtacaaacagaggagatgtactatgagaagacctaacctggcggcagcgcaaaagatg

SEQ ID NO: 181929 - DNA, 103 bp, Artificial Sequence
  Synthetic Polynucleotide
taatacgactcactatagggcctcatactttctagcttttccaggtcttcaacagaggagagaagacatggaaaagctaaacctggcggcagcgcaaaagatg

SEQ ID NO: 181930 - DNA, 103 bp, Artificial Sequence
  Synthetic Polynucleotide
taatacgactcactataggggctgctgctgcctcatactttctagcttttaacagaggagaaaaagcatgaaagtatgaaacctggcggcagcgcaaaagatg

SEQ ID NO: 181931 - DNA, 103 bp, Artificial Sequence
  Synthetic Polynucleotide
taatacgactcactataggggaaaactggggctgctgctgcctcatacttaacagaggagaaagtatatggcagcagcaaacctggcggcagcgcaaaagatg

SEQ ID NO: 181932 - DNA, 103 bp, Artificial Sequence
  Synthetic Polynucleotide
taatacgactcactatagggttgcccatgagaaaactggggctgctgctgaacagaggagacagcagatgccccagtttaacctggcggcagcgcaaaagatg

SEQ ID NO: 181933 - DNA, 103 bp, Artificial Sequence
  Synthetic Polynucleotide
taatacgactcactataggggctcctccttttgcccatgagaaaactgggaacagaggagacccagtatgctcatgggcaacctggcggcagcgcaaaagatg

SEQ ID NO: 181934 - DNA, 103 bp, Artificial Sequence
  Synthetic Polynucleotide
taatacgactcactatagggaccttagccagctcctccttttgcccatgaaacagaggagatcatggatgaaaggaggaaacctggcggcagcgcaaaagatg

SEQ ID NO: 181935 - DNA, 103 bp, Artificial Sequence
  Synthetic Polynucleotide
taatacgactcactatagggccaattatacaccttagccagctcctccttaacagaggagaaaggagatgctggctaagaacctggcggcagcgcaaaagatg

SEQ ID NO: 181936 - DNA, 103 bp, Artificial Sequence
  Synthetic Polynucleotide
taatacgactcactatagggctgaagcgatagtggccagctcctcaagacaacagaggagagtcttgatgagctggccaaacctggcggcagcgcaaaagatg

SEQ ID NO: 181937 - DNA, 103 bp, Artificial Sequence
  Synthetic Polynucleotide
taatacgactcactatagggggctttgaatccaattatacaccttagccaaacagaggagatggctaatgtgtataattaacctggcggcagcgcaaaagatg

SEQ ID NO: 181938 - DNA, 103 bp, Artificial Sequence
  Synthetic Polynucleotide
taatacgactcactataggggtgacagtctggctttgaatccaattatacaacagaggagagtataaatggattcaaagaacctggcggcagcgcaaaagatg

SEQ ID NO: 181939 - DNA, 103 bp, Artificial Sequence
  Synthetic Polynucleotide
taatacgactcactataggggatttcttgagtgacagtctggctttgaataacagaggagaattcaaatgcagactgtcaacctggcggcagcgcaaaagatg

SEQ ID NO: 181940 - DNA, 103 bp, Artificial Sequence
  Synthetic Polynucleotide
taatacgactcactatagggcttgaatgtcgatttcttgagtgacagtctaacagaggagaagactgatgctcaagaaaaacctggcggcagcgcaaaagatg

SEQ ID NO: 181941 - DNA, 103 bp, Artificial Sequence
  Synthetic Polynucleotide
taatacgactcactataggggtgacacaggcttgaatgtcgatttcttgaaacagaggagatcaagaatgcgacattcaaacctggcggcagcgcaaaagatg

SEQ ID NO: 181942 - DNA, 103 bp, Artificial Sequence
  Synthetic Polynucleotide
taatacgactcactatagggattttcacaagtgacacaggcttgaatgtcaacagaggagagacattatggcctgtgtcaacctggcggcagcgcaaaagatg

SEQ ID NO: 181943 - DNA, 103 bp, Artificial Sequence
  Synthetic Polynucleotide
taatacgactcactatagggctgaatcttcattttcacaagtgacacaggaacagaggagacctgtgatgcttgtgaaaaacctggcggcagcgcaaaagatg

SEQ ID NO: 181944 - DNA, 103 bp, Artificial Sequence
  Synthetic Polynucleotide
taatacgactcactataggggcaccatcagctgaatcttcattttcacaaaacagaggagattgtgaatgtgaagattcaacctggcggcagcgcaaaagatg

SEQ ID NO: 181945 - DNA, 103 bp, Artificial Sequence
  Synthetic Polynucleotide
taatacgactcactatagggggatgtggccgcaccatcagctgaatcttcaacagaggagagaagatatggctgatggtaacctggcggcagcgcaaaagatg

SEQ ID NO: 181946 - DNA, 103 bp, Artificial Sequence
  Synthetic Polynucleotide
taatacgactcactatagggcctgaccacaggatgtggccgcaccatcagaacagaggagactgatgatgcggccacataacctggcggcagcgcaaaagatg

SEQ ID NO: 181947 - DNA, 103 bp, Artificial Sequence
  Synthetic Polynucleotide
taatacgactcactataggggaagtgtgttctgaagcgatagtggccagcaacagaggagagctggcatgtatcgcttcaacctggcggcagcgcaaaagatg

SEQ ID NO: 181948 - DNA, 103 bp, Artificial Sequence
  Synthetic Polynucleotide
taatacgactcactatagggtctaccagaacctgaccacaggatgtggccaacagaggagaggccacatgctgtggtcaaacctggcggcagcgcaaaagatg

SEQ ID NO: 181949 - DNA, 103 bp, Artificial Sequence
  Synthetic Polynucleotide
taatacgactcactatagggacagctgtcttctaccagaacctgaccacaaacagaggagatgtggtatggttctggtaaacctggcggcagcgcaaaagatg

SEQ ID NO: 181950 - DNA, 103 bp, Artificial Sequence
  Synthetic Polynucleotide
taatacgactcactatagggtgtgtttttggaagtgtgttctgaagcgataacagaggagaatcgctatggaacacactaacctggcggcagcgcaaaagatg

SEQ ID NO: 181951 - DNA, 103 bp, Artificial Sequence
  Synthetic Polynucleotide
taatacgactcactatagggcaaaggtatctgtgtttttggaagtgtgttaacagaggagaaacacaatgccaaaaacaaacctggcggcagcgcaaaagatg

SEQ ID NO: 181952 - DNA, 103 bp, Artificial Sequence
  Synthetic Polynucleotide
taatacgactcactatagggaatactgccacaaaggtatctgtgtttttgaacagaggagacaaaaaatgagataccttaacctggcggcagcgcaaaagatg

SEQ ID NO: 181953 - DNA, 103 bp, Artificial Sequence
  Synthetic Polynucleotide
taatacgactcactataggggcccagggcctcgtccttagccccccgtctaacagaggagaagacggatggctaaggacaacctggcggcagcgcaaaagatg

SEQ ID NO: 181954 - DNA, 103 bp, Artificial Sequence
  Synthetic Polynucleotide
taatacgactcactatagggcagaaatgaaaatactgccacaaaggtatcaacagaggagagataccatggtggcagtaaacctggcggcagcgcaaaagatg

SEQ ID NO: 181955 - DNA, 103 bp, Artificial Sequence
  Synthetic Polynucleotide
taatacgactcactatagggaccttccagacagaaatgaaaatactgccaaacagaggagatggcagatgtttcatttcaacctggcggcagcgcaaaagatg

SEQ ID NO: 181956 - DNA, 103 bp, Artificial Sequence
  Synthetic Polynucleotide
taatacgactcactatagggatgtgcactaaccttccagacagaaatgaaaacagaggagattcattatggtctggaagaacctggcggcagcgcaaaagatg

SEQ ID NO: 181957 - DNA, 103 bp, Artificial Sequence
  Synthetic Polynucleotide
taatacgactcactatagggctgttcagaaatgtgcactaaccttccagaaacagaggagatctggaatgttagtgcacaacctggcggcagcgcaaaagatg

SEQ ID NO: 181958 - DNA, 103 bp, Artificial Sequence
  Synthetic Polynucleotide
taatacgactcactatagggtcaaagcagcctgttcagaaatgtgcactaaacagaggagatagtgcatgtttctgaacaacctggcggcagcgcaaaagatg

SEQ ID NO: 181959 - DNA, 103 bp, Artificial Sequence
  Synthetic Polynucleotide
taatacgactcactatagggcgattcaggatcaaagcagcctgttcagaaaacagaggagattctgaatgggctgctttaacctggcggcagcgcaaaagatg

SEQ ID NO: 181960 - DNA, 103 bp, Artificial Sequence
  Synthetic Polynucleotide
taatacgactcactatagggatctttcttacgattcaggatcaaagcagcaacagaggagagctgctatgatcctgaataacctggcggcagcgcaaaagatg

SEQ ID NO: 181961 - DNA, 103 bp, Artificial Sequence
  Synthetic Polynucleotide
taatacgactcactatagggacgccaggacatctttcttacgattcaggaaacagaggagatcctgaatggtaagaaagaacctggcggcagcgcaaaagatg

SEQ ID NO: 181962 - DNA, 103 bp, Artificial Sequence
  Synthetic Polynucleotide
taatacgactcactatagggaagtgagaagacgccaggacatctttcttaaacagaggagataagaaatgtgtcctggcaacctggcggcagcgcaaaagatg

SEQ ID NO: 181963 - DNA, 103 bp, Artificial Sequence
  Synthetic Polynucleotide
taatacgactcactatagggcaggtcaacaaagtgagaagacgccaggacaacagaggagagtcctgatgtcttctcacaacctggcggcagcgcaaaagatg

SEQ ID NO: 181964 - DNA, 103 bp, Artificial Sequence
  Synthetic Polynucleotide
taatacgactcactatagggccgattcttcgcccagggcctcgtccttagaacagaggagactaaggatgaggccctggaacctggcggcagcgcaaaagatg

SEQ ID NO: 181965 - DNA, 103 bp, Artificial Sequence
  Synthetic Polynucleotide
taatacgactcactataggggaggtgcaagcaggtcaacaaagtgagaagaacagaggagacttctcatgttgttgaccaacctggcggcagcgcaaaagatg

SEQ ID NO: 181966 - DNA, 103 bp, Artificial Sequence
  Synthetic Polynucleotide
taatacgactcactatagggctcatgtcttgaggtgcaagcaggtcaacaaacagaggagatgttgaatggcttgcaccaacctggcggcagcgcaaaagatg

SEQ ID NO: 181967 - DNA, 103 bp, Artificial Sequence
  Synthetic Polynucleotide
taatacgactcactataggggtagaataccctcatgtcttgaggtgcaagaacagaggagacttgcaatgcaagacatgaacctggcggcagcgcaaaagatg

SEQ ID NO: 181968 - DNA, 103 bp, Artificial Sequence
  Synthetic Polynucleotide
taatacgactcactatagggcagtgtgcgcgtagaataccctcatgtcttaacagaggagaaagacaatggggtattctaacctggcggcagcgcaaaagatg

SEQ ID NO: 181969 - DNA, 103 bp, Artificial Sequence
  Synthetic Polynucleotide
taatacgactcactatagggtgagctctggcagtgtgcgcgtagaataccaacagaggagaggtattatgcgcgcacacaacctggcggcagcgcaaaagatg

SEQ ID NO: 181970 - DNA, 103 bp, Artificial Sequence
  Synthetic Polynucleotide
taatacgactcactataggggaaaggaagctgagctctggcagtgtgcgcaacagaggagagcgcacatggccagagctaacctggcggcagcgcaaaagatg

SEQ ID NO: 181971 - DNA, 103 bp, Artificial Sequence
  Synthetic Polynucleotide
taatacgactcactatagggagttgttccagaaaggaagctgagctctggaacagaggagaccagagatgagcttccttaacctggcggcagcgcaaaagatg

SEQ ID NO: 181972 - DNA, 103 bp, Artificial Sequence
  Synthetic Polynucleotide
taatacgactcactatagggctttgggtccagttgttccagaaaggaagcaacagaggagagcttccatgctggaacaaaacctggcggcagcgcaaaagatg

SEQ ID NO: 181973 - DNA, 103 bp, Artificial Sequence
  Synthetic Polynucleotide
taatacgactcactatagggtgcagctgctctttgggtccagttgttccaaacagaggagatggaacatgtggacccaaaacctggcggcagcgcaaaagatg

SEQ ID NO: 181974 - DNA, 103 bp, Artificial Sequence
  Synthetic Polynucleotide
taatacgactcactatagggattcataccgtgcagctgctctttgggtccaacagaggagaggacccatggagcagctgaacctggcggcagcgcaaaagatg

SEQ ID NO: 181975 - DNA, 103 bp, Artificial Sequence
  Synthetic Polynucleotide
taatacgactcactatagggcaccgctcccccgattcttcgcccagggccaacagaggagaggccctatgcgaagaatcaacctggcggcagcgcaaaagatg

SEQ ID NO: 181976 - DNA, 103 bp, Artificial Sequence
  Synthetic Polynucleotide
taatacgactcactatagggaccggagcacattcataccgtgcagctgctaacagaggagaagcagcatgacggtatgaaacctggcggcagcgcaaaagatg

SEQ ID NO: 181977 - DNA, 103 bp, Artificial Sequence
  Synthetic Polynucleotide
taatacgactcactatagggaaaaggtttcaccggagcacattcataccgaacagaggagacggtatatgtgtgctccgaacctggcggcagcgcaaaagatg

SEQ ID NO: 181978 - DNA, 103 bp, Artificial Sequence
  Synthetic Polynucleotide
taatacgactcactatagggtcctgcagaaaaaaggtttcaccggagcacaacagaggagagtgctcatgtgaaaccttaacctggcggcagcgcaaaagatg

SEQ ID NO: 181979 - DNA, 103 bp, Artificial Sequence
  Synthetic Polynucleotide
taatacgactcactatagggcctccacggatcctgcagaaaaaaggtttcaacagaggagagaaaccatgtttctgcagaacctggcggcagcgcaaaagatg

SEQ ID NO: 181980 - DNA, 103 bp, Artificial Sequence
  Synthetic Polynucleotide
taatacgactcactatagggtctgtcttcacctccacggatcctgcagaaaacagaggagattctgcatgatccgtggaaacctggcggcagcgcaaaagatg

SEQ ID NO: 181981 - DNA, 103 bp, Artificial Sequence
  Synthetic Polynucleotide
taatacgactcactatagggtctcttgctttctgtcttcacctccacggaaacagaggagatccgtgatggtgaagacaaacctggcggcagcgcaaaagatg

SEQ ID NO: 181982 - DNA, 103 bp, Artificial Sequence
  Synthetic Polynucleotide
taatacgactcactataggggagtgacacttctcttgctttctgtcttcaaacagaggagatgaagaatgaaagcaagaaacctggcggcagcgcaaaagatg

SEQ ID NO: 181983 - DNA, 103 bp, Artificial Sequence
  Synthetic Polynucleotide
taatacgactcactatagggccggaatggggagtgacacttctcttgcttaacagaggagaaagcaaatgaagtgtcacaacctggcggcagcgcaaaagatg

SEQ ID NO: 181984 - DNA, 103 bp, Artificial Sequence
  Synthetic Polynucleotide
taatacgactcactatagggaggggatgatccggaatggggagtgacactaacagaggagaagtgtcatgccccattccaacctggcggcagcgcaaaagatg

SEQ ID NO: 181985 - DNA, 103 bp, Artificial Sequence
  Synthetic Polynucleotide
taatacgactcactatagggtgaatcagataggggatgatccggaatgggaacagaggagacccattatggatcatcccaacctggcggcagcgcaaaagatg

SEQ ID NO: 181986 - DNA, 103 bp, Artificial Sequence
  Synthetic Polynucleotide
taatacgactcactatagggctcggggctccaccgctcccccgattcttcaacagaggagagaagaaatgggggagcggaacctggcggcagcgcaaaagatg

SEQ ID NO: 181987 - DNA, 103 bp, Artificial Sequence
  Synthetic Polynucleotide
taatacgactcactataggggtgatgtacatgaatcagataggggatgataacagaggagaatcatcatgtatctgattaacctggcggcagcgcaaaagatg

SEQ ID NO: 181988 - DNA, 103 bp, Artificial Sequence
  Synthetic Polynucleotide
taatacgactcactataggggctgggcagggtgatgtacatgaatcagataacagaggagaatctgaatgatgtacatcaacctggcggcagcgcaaaagatg

SEQ ID NO: 181989 - DNA, 103 bp, Artificial Sequence
  Synthetic Polynucleotide
taatacgactcactatagggtccaattctggctgggcagggtgatgtacaaacagaggagatgtacaatgccctgcccaaacctggcggcagcgcaaaagatg

SEQ ID NO: 181990 - DNA, 103 bp, Artificial Sequence
  Synthetic Polynucleotide
taatacgactcactatagggaggttccgattccaattctggctgggcaggaacagaggagacctgccatgccagaattgaacctggcggcagcgcaaaagatg

SEQ ID NO: 181991 - DNA, 103 bp, Artificial Sequence
  Synthetic Polynucleotide
taatacgactcactatagggtgagacagcaaggttccgattccaattctgaacagaggagacagaatatgaatcggaacaacctggcggcagcgcaaaagatg

SEQ ID NO: 181992 - DNA, 103 bp, Artificial Sequence
  Synthetic Polynucleotide
taatacgactcactatagggtcaaccacagtgagacagcaaggttccgataacagaggagaatcggaatgttgctgtctaacctggcggcagcgcaaaagatg

SEQ ID NO: 181993 - DNA, 103 bp, Artificial Sequence
  Synthetic Polynucleotide
taatacgactcactataggggtgaatcttttcaaccacagtgagacagcaaacagaggagatgctgtatgactgtggttaacctggcggcagcgcaaaagatg

SEQ ID NO: 181994 - DNA, 103 bp, Artificial Sequence
  Synthetic Polynucleotide
taatacgactcactatagggcataaccagagtgaatcttttcaaccacagaacagaggagactgtggatgaaaagattcaacctggcggcagcgcaaaagatg

SEQ ID NO: 181995 - DNA, 103 bp, Artificial Sequence
  Synthetic Polynucleotide
taatacgactcactatagggcgaggagcttcataaccagagtgaatctttaacagaggagaaaagatatgctctggttaaacctggcggcagcgcaaaagatg

SEQ ID NO: 181996 - DNA, 103 bp, Artificial Sequence
  Synthetic Polynucleotide
taatacgactcactatagggcactgggatccgaggagcttcataaccagaaacagaggagatctggtatggaagctcctaacctggcggcagcgcaaaagatg

SEQ ID NO: 181997 - DNA, 103 bp, Artificial Sequence
  Synthetic Polynucleotide
taatacgactcactataggggcagatggaactcggggctccaccgctcccaacagaggagagggagcatgggagccccgaacctggcggcagcgcaaaagatg

SEQ ID NO: 181998 - DNA, 103 bp, Artificial Sequence
  Synthetic Polynucleotide
taatacgactcactatagggttcttttattcactgggatccgaggagcttaacagaggagaaagctcatgggatcccagaacctggcggcagcgcaaaagatg

SEQ ID NO: 181999 - DNA, 103 bp, Artificial Sequence
  Synthetic Polynucleotide
taatacgactcactataggggtggtgaagattcttttattcactgggatcaacagaggagagatcccatggaataaaagaacctggcggcagcgcaaaagatg

SEQ ID NO: 182000 - DNA, 103 bp, Artificial Sequence
  Synthetic Polynucleotide
taatacgactcactatagggggtgtgtgtggtggtgaagattcttttattaacagaggagaaataaaatgatcttcaccaacctggcggcagcgcaaaagatg

SEQ ID NO: 182001 - DNA, 103 bp, Artificial Sequence
  Synthetic Polynucleotide
taatacgactcactatagggcacaccctggggtgtgtgtggtggtgaagaaacagaggagatcttcaatgccacacacaaacctggcggcagcgcaaaagatg

SEQ ID NO: 182002 - DNA, 103 bp, Artificial Sequence
  Synthetic Polynucleotide
taatacgactcactatagggtcaagaaaaacacaccctggggtgtgtgtgaacagaggagacacacaatgcccagggtgaacctggcggcagcgcaaaagatg

SEQ ID NO: 182003 - DNA, 103 bp, Artificial Sequence
  Synthetic Polynucleotide
taatacgactcactatagggttcatctacttcaagaaaaacacaccctggaacagaggagaccagggatggtttttcttaacctggcggcagcgcaaaagatg

SEQ ID NO: 182004 - DNA, 103 bp, Artificial Sequence
  Synthetic Polynucleotide
taatacgactcactataggggcactgctttttcatctacttcaagaaaaaaacagaggagatttttcatgaagtagatgaacctggcggcagcgcaaaagatg

SEQ ID NO: 182005 - DNA, 103 bp, Artificial Sequence
  Synthetic Polynucleotide
taatacgactcactatagggcccagcaaaggcactgctttttcatctactaacagaggagaagtagaatgaaaagcagtaacctggcggcagcgcaaaagatg

SEQ ID NO: 182006 - DNA, 103 bp, Artificial Sequence
  Synthetic Polynucleotide
taatacgactcactatagggaggtaggtaacccagcaaaggcactgctttaacagaggagaaaagcaatgcctttgctgaacctggcggcagcgcaaaagatg

SEQ ID NO: 182007 - DNA, 103 bp, Artificial Sequence
  Synthetic Polynucleotide
taatacgactcactatagggtcaggtcctgaggtaggtaacccagcaaagaacagaggagactttgcatggttacctacaacctggcggcagcgcaaaagatg

SEQ ID NO: 182008 - DNA, 103 bp, Artificial Sequence
  Synthetic Polynucleotide
taatacgactcactatagggaatttcctctgcagatggaactcggggctcaacagaggagagagcccatggttccatctaacctggcggcagcgcaaaagatg

SEQ ID NO: 182009 - DNA, 103 bp, Artificial Sequence
  Synthetic Polynucleotide
taatacgactcactataggggatgttccaatcaggtcctgaggtaggtaaaacagaggagattacctatgtcaggacctaacctggcggcagcgcaaaagatg

SEQ ID NO: 182010 - DNA, 103 bp, Artificial Sequence
  Synthetic Polynucleotide
taatacgactcactataggggcttaggatcgatgttccaatcaggtcctgaacagaggagacaggacatgattggaacaaacctggcggcagcgcaaaagatg

SEQ ID NO: 182011 - DNA, 103 bp, Artificial Sequence
  Synthetic Polynucleotide
taatacgactcactatagggggtgcaggtagcttaggatcgatgttccaaaacagaggagattggaaatgcgatcctaaaacctggcggcagcgcaaaagatg

SEQ ID NO: 182012 - DNA, 103 bp, Artificial Sequence
  Synthetic Polynucleotide
taatacgactcactatagggcgatcttcagggtgcaggtagcttaggatcaacagaggagagatcctatgctacctgcaaacctggcggcagcgcaaaagatg

SEQ ID NO: 182013 - DNA, 103 bp, Artificial Sequence
  Synthetic Polynucleotide
taatacgactcactatagggcatcagagaacgatcttcagggtgcaggtaaacagaggagatacctgatgcctgaagataacctggcggcagcgcaaaagatg

SEQ ID NO: 182014 - DNA, 103 bp, Artificial Sequence
  Synthetic Polynucleotide
taatacgactcactataggggtatggcaaccatcagagaacgatcttcagaacagaggagactgaagatggttctctgaaacctggcggcagcgcaaaagatg

SEQ ID NO: 182015 - DNA, 103 bp, Artificial Sequence
  Synthetic Polynucleotide
taatacgactcactatagggactttttggtgtatggcaaccatcagagaaaacagaggagattctctatgggttgccataacctggcggcagcgcaaaagatg

SEQ ID NO: 182016 - DNA, 103 bp, Artificial Sequence
  Synthetic Polynucleotide
taatacgactcactatagggatacttcaaaactttttggtgtatggcaacaacagaggagagttgccatgcaccaaaaaaacctggcggcagcgcaaaagatg

SEQ ID NO: 182017 - DNA, 103 bp, Artificial Sequence
  Synthetic Polynucleotide
taatacgactcactataggggatgccctgcatacttcaaaactttttggtaacagaggagaaccaaaatgttttgaagtaacctggcggcagcgcaaaagatg

SEQ ID NO: 182018 - DNA, 103 bp, Artificial Sequence
  Synthetic Polynucleotide
taatacgactcactatagggtcaaagggaggatgccctgcatacttcaaaaacagaggagatttgaaatgtgcagggcaaacctggcggcagcgcaaaagatg

SEQ ID NO: 182019 - DNA, 103 bp, Artificial Sequence
  Synthetic Polynucleotide
taatacgactcactatagggccggggaccctttgccttcagctcagtcataacagaggagaatgactatgctgaaggcaaacctggcggcagcgcaaaagatg

SEQ ID NO: 182020 - DNA, 103 bp, Artificial Sequence
  Synthetic Polynucleotide
taatacgactcactatagggctggctccccgggaacggacctgcggctggaacagaggagaccagccatgggtccgttcaacctggcggcagcgcaaaagatg

SEQ ID NO: 182021 - DNA, 103 bp, Artificial Sequence
  Synthetic Polynucleotide
taatacgactcactatagggggcaaaggcgctggcagccccggccccgccaacagaggagaggcgggatgggggctgccaacctggcggcagcgcaaaagatg

SEQ ID NO: 182022 - DNA, 103 bp, Artificial Sequence
  Synthetic Polynucleotide
taatacgactcactatagggtccgcggcggggcaaaggcgctggcagcccaacagaggagagggctgatggcgcctttgaacctggcggcagcgcaaaagatg

SEQ ID NO: 182023 - DNA, 103 bp, Artificial Sequence
  Synthetic Polynucleotide
taatacgactcactatagggcagggtgaactccgcggcggggcaaaggcgaacagaggagacgccttatgcccgccgcgaacctggcggcagcgcaaaagatg

SEQ ID NO: 182024 - DNA, 103 bp, Artificial Sequence
  Synthetic Polynucleotide
taatacgactcactatagggggacgaggcacagggtgaactccgcggcggaacagaggagaccgccgatgagttcacccaacctggcggcagcgcaaaagatg

SEQ ID NO: 182025 - DNA, 103 bp, Artificial Sequence
  Synthetic Polynucleotide
taatacgactcactatagggcgaccggggtggacgaggcacagggtgaacaacagaggagagttcacatggtgcctcgtaacctggcggcagcgcaaaagatg

SEQ ID NO: 182026 - DNA, 103 bp, Artificial Sequence
  Synthetic Polynucleotide
taatacgactcactatagggtcgcctacagcgaccggggtggacgaggcaaacagaggagatgcctcatgcaccccggtaacctggcggcagcgcaaaagatg

SEQ ID NO: 182027 - DNA, 103 bp, Artificial Sequence
  Synthetic Polynucleotide
taatacgactcactataggggtcggggaagtcgcctacagcgaccggggtaacagaggagaaccccgatggctgtaggcaacctggcggcagcgcaaaagatg

SEQ ID NO: 182028 - DNA, 103 bp, Artificial Sequence
  Synthetic Polynucleotide
taatacgactcactatagggggtacgcgcagtcggggaagtcgcctacagaacagaggagactgtagatgacttccccgaacctggcggcagcgcaaaagatg

SEQ ID NO: 182029 - DNA, 103 bp, Artificial Sequence
  Synthetic Polynucleotide
taatacgactcactataggggcgtcgggcgggtacgcgcagtcggggaagaacagaggagacttcccatgctgcgcgtaaacctggcggcagcgcaaaagatg

SEQ ID NO: 182030 - DNA, 103 bp, Artificial Sequence
  Synthetic Polynucleotide
taatacgactcactatagggcttgggctcggcgtcgggcgggtacgcgcaaacagaggagatgcgcgatgccgcccgacaacctggcggcagcgcaaaagatg

SEQ ID NO: 182031 - DNA, 103 bp, Artificial Sequence
  Synthetic Polynucleotide
taatacgactcactatagggtgtccgaggtctggctccccgggaacggacaacagaggagagtccgtatgcggggagccaacctggcggcagcgcaaaagatg

SEQ ID NO: 182032 - DNA, 103 bp, Artificial Sequence
  Synthetic Polynucleotide
taatacgactcactatagggacgcgtcgtccttgggctcggcgtcgggcgaacagaggagacgcccgatgccgagcccaaacctggcggcagcgcaaaagatg

SEQ ID NO: 182033 - DNA, 103 bp, Artificial Sequence
  Synthetic Polynucleotide
taatacgactcactatagggtagagagggtacgcgtcgtccttgggctcgaacagaggagacgagccatgggacgacgcaacctggcggcagcgcaaaagatg

SEQ ID NO: 182034 - DNA, 103 bp, Artificial Sequence
  Synthetic Polynucleotide
taatacgactcactataggggaagtcgctatagagagggtacgcgtcgtcaacagaggagagacgacatgtaccctctcaacctggcggcagcgcaaaagatg

SEQ ID NO: 182035 - DNA, 103 bp, Artificial Sequence
  Synthetic Polynucleotide
taatacgactcactatagggcgggcggctggaagtcgctatagagagggtaacagaggagaaccctcatgatagcgactaacctggcggcagcgcaaaagatg

SEQ ID NO: 182036 - DNA, 103 bp, Artificial Sequence
  Synthetic Polynucleotide
taatacgactcactatagggatctttagagcgggcggctggaagtcgctaaacagaggagatagcgaatgccagccgccaacctggcggcagcgcaaaagatg

SEQ ID NO: 182037 - DNA, 103 bp, Artificial Sequence
  Synthetic Polynucleotide
taatacgactcactatagggctcctcctttatctttagagcgggcggctgaacagaggagacagccgatggctctaaagaacctggcggcagcgcaaaagatg

SEQ ID NO: 182038 - DNA, 103 bp, Artificial Sequence
  Synthetic Polynucleotide
taatacgactcactatagggcgccttcctcctcctcctttatctttagagaacagaggagactctaaatgtaaaggaggaacctggcggcagcgcaaaagatg

SEQ ID NO: 182039 - DNA, 103 bp, Artificial Sequence
  Synthetic Polynucleotide
taatacgactcactataggggaggcctccgcgccttcctcctcctcctttaacagaggagaaaaggaatgggaggaaggaacctggcggcagcgcaaaagatg

SEQ ID NO: 182040 - DNA, 103 bp, Artificial Sequence
  Synthetic Polynucleotide
taatacgactcactatagggggagcgcgcggaggcctccgcgccttcctcaacagaggagagaggaaatggcggaggccaacctggcggcagcgcaaaagatg

SEQ ID NO: 182041 - DNA, 103 bp, Artificial Sequence
  Synthetic Polynucleotide
taatacgactcactatagggaggaacgcggggagcgcgcggaggcctccgaacagaggagacggaggatgccgcgcgctaacctggcggcagcgcaaaagatg

SEQ ID NO: 182042 - DNA, 103 bp, Artificial Sequence
  Synthetic Polynucleotide
taatacgactcactatagggtcaggcaaggtgtccgaggtctggctccccaacagaggagaggggagatggacctcggaaacctggcggcagcgcaaaagatg

SEQ ID NO: 182043 - DNA, 103 bp, Artificial Sequence
  Synthetic Polynucleotide
taatacgactcactataggggccacaaggtaggaacgcggggagcgcgcgaacagaggagacgcgcgatgcccgcgttcaacctggcggcagcgcaaaagatg

SEQ ID NO: 182044 - DNA, 103 bp, Artificial Sequence
  Synthetic Polynucleotide
taatacgactcactataggggttggcaccggccacaaggtaggaacgcggaacagaggagaccgcgtatgtaccttgtgaacctggcggcagcgcaaaagatg

SEQ ID NO: 182045 - DNA, 103 bp, Artificial Sequence
  Synthetic Polynucleotide
taatacgactcactatagggaggctgcggggttggcaccggccacaaggtaacagaggagaaccttgatgccggtgccaaacctggcggcagcgcaaaagatg

SEQ ID NO: 182046 - DNA, 103 bp, Artificial Sequence
  Synthetic Polynucleotide
taatacgactcactatagggaaatccgggaaggctgcggggttggcaccgaacagaggagacggtgcatgccccgcagcaacctggcggcagcgcaaaagatg

SEQ ID NO: 182047 - DNA, 103 bp, Artificial Sequence
  Synthetic Polynucleotide
taatacgactcactatagggccccaacgggaaatccgggaaggctgcgggaacagaggagacccgcaatgttcccggataacctggcggcagcgcaaaagatg

SEQ ID NO: 182048 - DNA, 103 bp, Artificial Sequence
  Synthetic Polynucleotide
taatacgactcactatagggggggcggtggccccaacgggaaatccgggaaacagaggagatcccggatgtcccgttggaacctggcggcagcgcaaaagatg

SEQ ID NO: 182049 - DNA, 103 bp, Artificial Sequence
  Synthetic Polynucleotide
taatacgactcactatagggggcggcagcgggggcggtggccccaacgggaacagaggagacccgttatggccaccgccaacctggcggcagcgcaaaagatg

SEQ ID NO: 182050 - DNA, 103 bp, Artificial Sequence
  Synthetic Polynucleotide
taatacgactcactatagggggtcgctcgcggcggcagcgggggcggtggaacagaggagaccaccgatgccgctgccgaacctggcggcagcgcaaaagatg

SEQ ID NO: 182051 - DNA, 103 bp, Artificial Sequence
  Synthetic Polynucleotide
taatacgactcactataggggtctggatggggtcgctcgcggcggcagcgaacagaggagacgctgcatgcgcgagcgaaacctggcggcagcgcaaaagatg

SEQ ID NO: 182052 - DNA, 103 bp, Artificial Sequence
  Synthetic Polynucleotide
taatacgactcactataggggcttccccgggtctggatggggtcgctcgcaacagaggagagcgagcatgcccatccagaacctggcggcagcgcaaaagatg

SEQ ID NO: 182053 - DNA, 103 bp, Artificial Sequence
  Synthetic Polynucleotide
taatacgactcactatagggggccgaaacttcaggcaaggtgtccgaggtaacagaggagaacctcgatgaccttgcctaacctggcggcagcgcaaaagatg

SEQ ID NO: 182054 - DNA, 103 bp, Artificial Sequence
  Synthetic Polynucleotide
taatacgactcactatagggcgtcaccgccgcttccccgggtctggatggaacagaggagaccatccatgcccggggaaaacctggcggcagcgcaaaagatg

SEQ ID NO: 182055 - DNA, 103 bp, Artificial Sequence
  Synthetic Polynucleotide
taatacgactcactatagggcgggtgcggccgtcaccgccgcttccccggaacagaggagaccggggatgcggcggtgaaacctggcggcagcgcaaaagatg

SEQ ID NO: 182056 - DNA, 103 bp, Artificial Sequence
  Synthetic Polynucleotide
taatacgactcactataggggaggcactggcgggtgcggccgtcaccgccaacagaggagaggcggtatgggccgcaccaacctggcggcagcgcaaaagatg

SEQ ID NO: 182057 - DNA, 103 bp, Artificial Sequence
  Synthetic Polynucleotide
taatacgactcactatagggagacgagactgaggcactggcgggtgcggcaacagaggagagccgcaatggccagtgccaacctggcggcagcgcaaaagatg

SEQ ID NO: 182058 - DNA, 103 bp, Artificial Sequence
  Synthetic Polynucleotide
taatacgactcactatagggaggaggacgcagacgagactgaggcactggaacagaggagaccagtgatgcagtctcgtaacctggcggcagcgcaaaagatg

SEQ ID NO: 182059 - DNA, 103 bp, Artificial Sequence
  Synthetic Polynucleotide
taatacgactcactataggggtcgaccccgaggaggacgcagacgagactaacagaggagaagtctcatgtgcgtcctcaacctggcggcagcgcaaaagatg

SEQ ID NO: 182060 - DNA, 103 bp, Artificial Sequence
  Synthetic Polynucleotide
taatacgactcactataggggcactccagggtcgaccccgaggaggacgcaacagaggagagcgtccatgtcggggtcgaacctggcggcagcgcaaaagatg

SEQ ID NO: 182061 - DNA, 103 bp, Artificial Sequence
  Synthetic Polynucleotide
taatacgactcactatagggtgtacaggatgcactccagggtcgaccccgaacagaggagacggggtatgccctggagtaacctggcggcagcgcaaaagatg

SEQ ID NO: 182062 - DNA, 103 bp, Artificial Sequence
  Synthetic Polynucleotide
taatacgactcactatagggccctccgctttgtacaggatgcactccaggaacagaggagacctggaatgcatcctgtaaacctggcggcagcgcaaaagatg

SEQ ID NO: 182063 - DNA, 103 bp, Artificial Sequence
  Synthetic Polynucleotide
taatacgactcactataggggggcggcgcgccctccgctttgtacaggataacagaggagaatcctgatgaaagcggagaacctggcggcagcgcaaaagatg

SEQ ID NO: 182064 - DNA, 103 bp, Artificial Sequence
  Synthetic Polynucleotide
taatacgactcactatagggagataggtatggccgaaacttcaggcaaggaacagaggagaccttgcatgaagtttcggaacctggcggcagcgcaaaagatg

SEQ ID NO: 182065 - DNA, 103 bp, Artificial Sequence
  Synthetic Polynucleotide
taatacgactcactatagggggccctgctggggcggcgcgccctccgcttaacagaggagaaagcggatggcgcgccgcaacctggcggcagcgcaaaagatg

SEQ ID NO: 182066 - DNA, 103 bp, Artificial Sequence
  Synthetic Polynucleotide
taatacgactcactatagggggcgcgaacgggccctgctggggcggcgcgaacagaggagacgcgccatgccagcagggaacctggcggcagcgcaaaagatg

SEQ ID NO: 182067 - DNA, 103 bp, Artificial Sequence
  Synthetic Polynucleotide
taatacgactcactataggggcagggcggcggcgcgaacgggccctgctgaacagaggagacagcagatgccgttcgcgaacctggcggcagcgcaaaagatg

SEQ ID NO: 182068 - DNA, 103 bp, Artificial Sequence
  Synthetic Polynucleotide
taatacgactcactatagggccggcgccttgcagggcggcggcgcgaacgaacagaggagacgttcgatgcgccgccctaacctggcggcagcgcaaaagatg

SEQ ID NO: 182069 - DNA, 103 bp, Artificial Sequence
  Synthetic Polynucleotide
taatacgactcactatagggccgctcgcgcccggcgccttgcagggcggcaacagaggagagccgccatgcaaggcgccaacctggcggcagcgcaaaagatg

SEQ ID NO: 182070 - DNA, 103 bp, Artificial Sequence
  Synthetic Polynucleotide
taatacgactcactataggggagcaggcagccgctcgcgcccggcgccttaacagaggagaaaggcgatgggcgcgagcaacctggcggcagcgcaaaagatg

SEQ ID NO: 182071 - DNA, 103 bp, Artificial Sequence
  Synthetic Polynucleotide
taatacgactcactatagggcgtcccgcgggagcaggcagccgctcgcgcaacagaggagagcgcgaatggctgcctgcaacctggcggcagcgcaaaagatg

SEQ ID NO: 182072 - DNA, 103 bp, Artificial Sequence
  Synthetic Polynucleotide
taatacgactcactataggggagggcaggccgtcccgcgggagcaggcagaacagaggagactgcctatgcccgcgggaaacctggcggcagcgcaaaagatg

SEQ ID NO: 182073 - DNA, 103 bp, Artificial Sequence
  Synthetic Polynucleotide
taatacgactcactatagggggcggaggtggagggcaggccgtcccgcggaacagaggagaccgcggatgggcctgcccaacctggcggcagcgcaaaagatg

SEQ ID NO: 182074 - DNA, 103 bp, Artificial Sequence
  Synthetic Polynucleotide
taatacgactcactatagggcggcggcagaggcggaggtggagggcaggcaacagaggagagcctgcatgccacctccgaacctggcggcagcgcaaaagatg

SEQ ID NO: 182075 - DNA, 103 bp, Artificial Sequence
  Synthetic Polynucleotide
taatacgactcactatagggccgtccagggagataggtatggccgaaactaacagaggagaagtttcatgcatacctataacctggcggcagcgcaaaagatg

SEQ ID NO: 182076 - DNA, 103 bp, Artificial Sequence
  Synthetic Polynucleotide
taatacgactcactataggggccccggcggcggcggcagaggcggaggtgaacagaggagacacctcatgctctgccgcaacctggcggcagcgcaaaagatg

SEQ ID NO: 182077 - DNA, 103 bp, Artificial Sequence
  Synthetic Polynucleotide
taatacgactcactatagggcgcgggggccgccccggcggcggcggcagaaacagaggagatctgccatggccgccgggaacctggcggcagcgcaaaagatg

SEQ ID NO: 182078 - DNA, 103 bp, Artificial Sequence
  Synthetic Polynucleotide
taatacgactcactatagggcagggtagagcgcgggggccgccccggcggaacagaggagaccgccgatgcggcccccgaacctggcggcagcgcaaaagatg

SEQ ID NO: 182079 - DNA, 103 bp, Artificial Sequence
  Synthetic Polynucleotide
taatacgactcactatagggaggccgagtgcagggtagagcgcgggggccaacagaggagaggccccatggctctacccaacctggcggcagcgcaaaagatg

SEQ ID NO: 182080 - DNA, 103 bp, Artificial Sequence
  Synthetic Polynucleotide
taatacgactcactataggggagcccgttgaggccgagtgcagggtagagaacagaggagactctacatggcactcggcaacctggcggcagcgcaaaagatg

SEQ ID NO: 182081 - DNA, 103 bp, Artificial Sequence
  Synthetic Polynucleotide
taatacgactcactatagggcgagctgcgggagcccgttgaggccgagtgaacagaggagacactcgatgtcaacgggcaacctggcggcagcgcaaaagatg

SEQ ID NO: 182082 - DNA, 103 bp, Artificial Sequence
  Synthetic Polynucleotide
taatacgactcactataggggcctggtagccgagctgcgggagcccgttgaacagaggagacaacggatgcccgcagctaacctggcggcagcgcaaaagatg

SEQ ID NO: 182083 - DNA, 103 bp, Artificial Sequence
  Synthetic Polynucleotide
taatacgactcactataggggagcacggcggcctggtagccgagctgcggaacagaggagaccgcagatgggctaccagaacctggcggcagcgcaaaagatg

SEQ ID NO: 182084 - DNA, 103 bp, Artificial Sequence
  Synthetic Polynucleotide
taatacgactcactatagggggccctccttgagcacggcggcctggtagcaacagaggagagctaccatgccgccgtgcaacctggcggcagcgcaaaagatg

SEQ ID NO: 182085 - DNA, 103 bp, Artificial Sequence
  Synthetic Polynucleotide
taatacgactcactatagggacctgcggcaggccctccttgagcacggcgaacagaggagacgccgtatgcaaggagggaacctggcggcagcgcaaaagatg

SEQ ID NO: 182086 - DNA, 103 bp, Artificial Sequence
  Synthetic Polynucleotide
taatacgactcactataggggaagagtagcccgtccagggagataggtataacagaggagaatacctatgtccctggacaacctggcggcagcgcaaaagatg

SEQ ID NO: 182087 - DNA, 103 bp, Artificial Sequence
  Synthetic Polynucleotide
taatacgactcactataggggggcgggtagacctgcggcaggccctccttaacagaggagaaaggagatgctgccgcagaacctggcggcagcgcaaaagatg

SEQ ID NO: 182088 - DNA, 103 bp, Artificial Sequence
  Synthetic Polynucleotide
taatacgactcactatagggagttgagatagggcgggtagacctgcggcaaacagaggagatgccgcatgtctacccgcaacctggcggcagcgcaaaagatg

SEQ ID NO: 182089 - DNA, 103 bp, Artificial Sequence
  Synthetic Polynucleotide
taatacgactcactatagggggcctcaggtagttgagatagggcgggtagaacagaggagactacccatgctatctcaaaacctggcggcagcgcaaaagatg

SEQ ID NO: 182090 - DNA, 103 bp, Artificial Sequence
  Synthetic Polynucleotide
taatacgactcactatagggttctgaatccggcctcaggtagttgagataaacagaggagatatctcatgtacctgaggaacctggcggcagcgcaaaagatg

SEQ ID NO: 182091 - DNA, 103 bp, Artificial Sequence
  Synthetic Polynucleotide
taatacgactcactatagggtctggctggcttctgaatccggcctcaggtaacagaggagaacctgaatgcggattcagaacctggcggcagcgcaaaagatg

SEQ ID NO: 182092 - DNA, 103 bp, Artificial Sequence
  Synthetic Polynucleotide
taatacgactcactatagggtattgtgggctctggctggcttctgaatccaacagaggagaggattcatgagccagccaaacctggcggcagcgcaaaagatg

SEQ ID NO: 182093 - DNA, 103 bp, Artificial Sequence
  Synthetic Polynucleotide
taatacgactcactatagggctcgaagctgtattgtgggctctggctggcaacagaggagagccagcatgagcccacaaaacctggcggcagcgcaaaagatg

SEQ ID NO: 182094 - DNA, 103 bp, Artificial Sequence
  Synthetic Polynucleotide
taatacgactcactataggggaggtaatgactcgaagctgtattgtgggcaacagaggagagcccacatgacagcttcgaacctggcggcagcgcaaaagatg

SEQ ID NO: 182095 - DNA, 103 bp, Artificial Sequence
  Synthetic Polynucleotide
taatacgactcactatagggcaaatcttctgaggtaatgactcgaagctgaacagaggagacagcttatggtcattaccaacctggcggcagcgcaaaagatg

SEQ ID NO: 182096 - DNA, 103 bp, Artificial Sequence
  Synthetic Polynucleotide
taatacgactcactatagggacagattaaacaaatcttctgaggtaatgaaacagaggagatcattaatgcagaagattaacctggcggcagcgcaaaagatg

SEQ ID NO: 182097 - DNA, 103 bp, Artificial Sequence
  Synthetic Polynucleotide
taatacgactcactatagggagggccgagggaagagtagcccgtccagggaacagaggagaccctggatgggctactctaacctggcggcagcgcaaaagatg

SEQ ID NO: 182098 - DNA, 103 bp, Artificial Sequence
  Synthetic Polynucleotide
taatacgactcactatagggcttcatccccacagattaaacaaatcttctaacagaggagaagaagaatggtttaatctaacctggcggcagcgcaaaagatg

SEQ ID NO: 182099 - DNA, 103 bp, Artificial Sequence
  Synthetic Polynucleotide
taatacgactcactatagggcagcctgatgcttcatccccacagattaaaaacagaggagatttaatatgtggggatgaaacctggcggcagcgcaaaagatg

SEQ ID NO: 182100 - DNA, 103 bp, Artificial Sequence
  Synthetic Polynucleotide
taatacgactcactatagggaccataatgacagcctgatgcttcatccccaacagaggagaggggatatggcatcaggcaacctggcggcagcgcaaaagatg

SEQ ID NO: 182101 - DNA, 103 bp, Artificial Sequence
  Synthetic Polynucleotide
taatacgactcactatagggaggtaaggacaccataatgacagcctgatgaacagaggagacatcagatggtcattatgaacctggcggcagcgcaaaagatg

SEQ ID NO: 182102 - DNA, 103 bp, Artificial Sequence
  Synthetic Polynucleotide
taatacgactcactatagggcagctcccacaggtaaggacaccataatgaaacagaggagatcattaatgtgtccttacaacctggcggcagcgcaaaagatg

SEQ ID NO: 182103 - DNA, 103 bp, Artificial Sequence
  Synthetic Polynucleotide
taatacgactcactataggggaagaccttacagctcccacaggtaaggacaacagaggagagtccttatgtgtgggagcaacctggcggcagcgcaaaagatg

SEQ ID NO: 182104 - DNA, 103 bp, Artificial Sequence
  Synthetic Polynucleotide
taatacgactcactatagggccctcttaaagaagaccttacagctcccacaacagaggagagtgggaatggtaaggtctaacctggcggcagcgcaaaagatg

SEQ ID NO: 182105 - DNA, 103 bp, Artificial Sequence
  Synthetic Polynucleotide
taatacgactcactatagggccttccattgccctcttaaagaagaccttaaacagaggagataaggtatgctttaagagaacctggcggcagcgcaaaagatg

SEQ ID NO: 182106 - DNA, 103 bp, Artificial Sequence
  Synthetic Polynucleotide
taatacgactcactataggggttgtgctgcccttccattgccctcttaaaaacagaggagatttaagatggcaatggaaaacctggcggcagcgcaaaagatg

SEQ ID NO: 182107 - DNA, 103 bp, Artificial Sequence
  Synthetic Polynucleotide
taatacgactcactatagggcacataagtagttgtgctgcccttccattgaacagaggagacaatggatgggcagcacaaacctggcggcagcgcaaaagatg

SEQ ID NO: 182108 - DNA, 103 bp, Artificial Sequence
  Synthetic Polynucleotide
taatacgactcactatagggtgtccctggcagggccgagggaagagtagcaacagaggagagctactatgccctcggccaacctggcggcagcgcaaaagatg

SEQ ID NO: 182109 - DNA, 103 bp, Artificial Sequence
  Synthetic Polynucleotide
taatacgactcactatagggtttcttccagcacataagtagttgtgctgcaacagaggagagcagcaatgctacttatgaacctggcggcagcgcaaaagatg

SEQ ID NO: 182110 - DNA, 103 bp, Artificial Sequence
  Synthetic Polynucleotide
taatacgactcactataggggatgcagtcatttcttccagcacataagtaaacagaggagatacttaatggctggaagaaacctggcggcagcgcaaaagatg

SEQ ID NO: 182111 - DNA, 103 bp, Artificial Sequence
  Synthetic Polynucleotide
taatacgactcactatagggttttatcaacgatgcagtcatttcttccagaacagaggagactggaaatgatgactgcaaacctggcggcagcgcaaaagatg

SEQ ID NO: 182112 - DNA, 103 bp, Artificial Sequence
  Synthetic Polynucleotide
taatacgactcactatagggtttctgcggattttatcaacgatgcagtcaaacagaggagatgactgatgcgttgataaaacctggcggcagcgcaaaagatg

SEQ ID NO: 182113 - DNA, 103 bp, Artificial Sequence
  Synthetic Polynucleotide
taatacgactcactatagggtgggcagttttttctgcggattttatcaacaacagaggagagttgatatgatccgcagaaacctggcggcagcgcaaaagatg

SEQ ID NO: 182114 - DNA, 103 bp, Artificial Sequence
  Synthetic Polynucleotide
taatacgactcactatagggggcgacatgctgggcagttttttctgcggaaacagaggagatccgcaatgaaaactgccaacctggcggcagcgcaaaagatg

SEQ ID NO: 182115 - DNA, 103 bp, Artificial Sequence
  Synthetic Polynucleotide
taatacgactcactatagggcactttctaaggcgacatgctgggcagtttaacagaggagaaaactgatgagcatgtcgaacctggcggcagcgcaaaagatg

SEQ ID NO: 182116 - DNA, 103 bp, Artificial Sequence
  Synthetic Polynucleotide
taatacgactcactatagggagcctgacagcactttctaaggcgacatgcaacagaggagagcatgtatgcttagaaagaacctggcggcagcgcaaaagatg

SEQ ID NO: 182117 - DNA, 103 bp, Artificial Sequence
  Synthetic Polynucleotide
taatacgactcactatagggggaccatgccagcctgacagcactttctaaaacagaggagattagaaatggctgtcaggaacctggcggcagcgcaaaagatg

SEQ ID NO: 182118 - DNA, 103 bp, Artificial Sequence
  Synthetic Polynucleotide
taatacgactcactatagggaaacctccaaggaccatgccagcctgacagaacagaggagactgtcaatgtggcatggtaacctggcggcagcgcaaaagatg

SEQ ID NO: 182119 - DNA, 103 bp, Artificial Sequence
  Synthetic Polynucleotide
taatacgactcactatagggggaggggtcctgtccctggcagggccgaggaacagaggagacctcggatgtgccagggaaacctggcggcagcgcaaaagatg

SEQ ID NO: 182120 - DNA, 103 bp, Artificial Sequence
  Synthetic Polynucleotide
taatacgactcactatagggtaagtttcgaaaacctccaaggaccatgccaacagaggagaggcatgatgcttggaggtaacctggcggcagcgcaaaagatg

SEQ ID NO: 182121 - DNA, 103 bp, Artificial Sequence
  Synthetic Polynucleotide
taatacgactcactatagggcatcaatatgtaagtttcgaaaacctccaaaacagaggagattggagatgttcgaaactaacctggcggcagcgcaaaagatg

SEQ ID NO: 182122 - DNA, 103 bp, Artificial Sequence
  Synthetic Polynucleotide
taatacgactcactataggggttatctggtcatcaatatgtaagtttcgaaacagaggagatcgaaaatgacatattgaaacctggcggcagcgcaaaagatg

SEQ ID NO: 182123 - DNA, 103 bp, Artificial Sequence
  Synthetic Polynucleotide
taatacgactcactatagggctgaatgagagttatctggtcatcaatatgaacagaggagacatattatggaccagataaacctggcggcagcgcaaaagatg

SEQ ID NO: 182124 - DNA, 103 bp, Artificial Sequence
  Synthetic Polynucleotide
taatacgactcactatagggtccaagaatactgaatgagagttatctggtaacagaggagaaccagaatgctctcattcaacctggcggcagcgcaaaagatg

SEQ ID NO: 182125 - DNA, 103 bp, Artificial Sequence
  Synthetic Polynucleotide
taatacgactcactatagggattaagctcatccaagaatactgaatgagaaacagaggagatctcatatggtattcttgaacctggcggcagcgcaaaagatg

SEQ ID NO: 182126 - DNA, 103 bp, Artificial Sequence
  Synthetic Polynucleotide
taatacgactcactatagggaccaaacaccattaagctcatccaagaataaacagaggagatattctatgatgagcttaaacctggcggcagcgcaaaagatg

SEQ ID NO: 182127 - DNA, 103 bp, Artificial Sequence
  Synthetic Polynucleotide
taatacgactcactatagggtccatcctagaccaaacaccattaagctcaaacagaggagatgagctatgtggtgtttgaacctggcggcagcgcaaaagatg

SEQ ID NO: 182128 - DNA, 103 bp, Artificial Sequence
  Synthetic Polynucleotide
taatacgactcactatagggttgtaggatctccatcctagaccaaacaccaacagaggagaggtgttatgtctaggatgaacctggcggcagcgcaaaagatg

SEQ ID NO: 182129 - DNA, 103 bp, Artificial Sequence
  Synthetic Polynucleotide
taatacgactcactatagggactgacgtgtttgtaggatctccatcctagaacagaggagactaggaatgagatcctacaacctggcggcagcgcaaaagatg

SEQ ID NO: 182130 - DNA, 103 bp, Artificial Sequence
  Synthetic Polynucleotide
taatacgactcactatagggcgtggggagcccggggaccctttgccttcaaacagaggagatgaaggatgagggtccccaacctggcggcagcgcaaaagatg

SEQ ID NO: 182131 - DNA, 103 bp, Artificial Sequence
  Synthetic Polynucleotide
taatacgactcactatagggtcttttcgtcggaggggtcctgtccctggcaacagaggagagccaggatgaggacccctaacctggcggcagcgcaaaagatg

SEQ ID NO: 182132 - DNA, 103 bp, Artificial Sequence
  Synthetic Polynucleotide
taatacgactcactataggggcatctgcccactgacgtgtttgtaggatcaacagaggagagatcctatgaacacgtcaaacctggcggcagcgcaaaagatg

SEQ ID NO: 182133 - DNA, 103 bp, Artificial Sequence
  Synthetic Polynucleotide
taatacgactcactataggggcaaaatacagcatctgcccactgacgtgtaacagaggagaacacgtatgtgggcagataacctggcggcagcgcaaaagatg

SEQ ID NO: 182134 - DNA, 103 bp, Artificial Sequence
  Synthetic Polynucleotide
taatacgactcactatagggtagatcaggtgcaaaatacagcatctgcccaacagaggagagggcagatgctgtattttaacctggcggcagcgcaaaagatg

SEQ ID NO: 182135 - DNA, 103 bp, Artificial Sequence
  Synthetic Polynucleotide
taatacgactcactatagggcatttagtattagatcaggtgcaaaatacaaacagaggagatgtattatgcacctgatcaacctggcggcagcgcaaaagatg

SEQ ID NO: 182136 - DNA, 103 bp, Artificial Sequence
  Synthetic Polynucleotide
taatacgactcactatagggatccgctgttcatttagtattagatcaggtaacagaggagaacctgaatgaatactaaaaacctggcggcagcgcaaaagatg

SEQ ID NO: 182137 - DNA, 103 bp, Artificial Sequence
  Synthetic Polynucleotide
taatacgactcactatagggtgattctttcatccgctgttcatttagtataacagaggagaatactaatggaacagcggaacctggcggcagcgcaaaagatg

SEQ ID NO: 182138 - DNA, 103 bp, Artificial Sequence
  Synthetic Polynucleotide
taatacgactcactatagggaatagaatgatgattctttcatccgctgttaacagaggagaaacagcatgtgaaagaataacctggcggcagcgcaaaagatg

SEQ ID NO: 182139 - DNA, 103 bp, Artificial Sequence
  Synthetic Polynucleotide
taatacgactcactatagggaggcataatgaatagaatgatgattctttcaacagaggagagaaagaatgatcattctaaacctggcggcagcgcaaaagatg

SEQ ID NO: 182140 - DNA, 103 bp, Artificial Sequence
  Synthetic Polynucleotide
taatacgactcactatagggccacatggtaaggcataatgaatagaatgaaacagaggagatcattcatgtcattatgcaacctggcggcagcgcaaaagatg

SEQ ID NO: 182141 - DNA, 103 bp, Artificial Sequence
  Synthetic Polynucleotide
taatacgactcactataggggtgggatctgccacatggtaaggcataatgaacagaggagacattatatgttaccatgtaacctggcggcagcgcaaaagatg

SEQ ID NO: 182142 - DNA, 103 bp, Artificial Sequence
  Synthetic Polynucleotide
taatacgactcactatagggtggtcctgcgtcttttcgtcggaggggtccaacagaggagaggacccatgcgacgaaaaaacctggcggcagcgcaaaagatg

SEQ ID NO: 182143 - DNA, 103 bp, Artificial Sequence
  Synthetic Polynucleotide
taatacgactcactatagggacaaactcctgtgggatctgccacatggtaaacagaggagataccatatggcagatcccaacctggcggcagcgcaaaagatg

SEQ ID NO: 182144 - DNA, 103 bp, Artificial Sequence
  Synthetic Polynucleotide
taatacgactcactatagggttgaagcttgacaaactcctgtgggatctgaacagaggagacagatcatgcaggagtttaacctggcggcagcgcaaaagatg

SEQ ID NO: 182145 - DNA, 103 bp, Artificial Sequence
  Synthetic Polynucleotide
taatacgactcactatagggcttggctaacttgaagcttgacaaactcctaacagaggagaaggagtatgtcaagcttcaacctggcggcagcgcaaaagatg

SEQ ID NO: 182146 - DNA, 103 bp, Artificial Sequence
  Synthetic Polynucleotide
taatacgactcactatagggaggaactcttcttggctaacttgaagcttgaacagaggagacaagctatgagttagccaaacctggcggcagcgcaaaagatg

SEQ ID NO: 182147 - DNA, 103 bp, Artificial Sequence
  Synthetic Polynucleotide
taatacgactcactatagggtttcatacagaggaactcttcttggctaacaacagaggagagttagcatggaagagttcaacctggcggcagcgcaaaagatg

SEQ ID NO: 182148 - DNA, 103 bp, Artificial Sequence
  Synthetic Polynucleotide
taatacgactcactataggggtaacaatactttcatacagaggaactcttaacagaggagaaagagtatgtctgtatgaaacctggcggcagcgcaaaagatg

SEQ ID NO: 182149 - DNA, 103 bp, Artificial Sequence
  Synthetic Polynucleotide
taatacgactcactataggggtattaagaagtaacaatactttcatacagaacagaggagactgtatatgagtattgttaacctggcggcagcgcaaaagatg

SEQ ID NO: 182150 - DNA, 103 bp, Artificial Sequence
  Synthetic Polynucleotide
taatacgactcactatagggcaaaggaattgtattaagaagtaacaatacaacagaggagagtattgatgcttcttaataacctggcggcagcgcaaaagatg

SEQ ID NO: 182151 - DNA, 103 bp, Artificial Sequence
  Synthetic Polynucleotide
taatacgactcactataggggtagcccttccaaaggaattgtattaagaaaacagaggagattcttaatgcaattccttaacctggcggcagcgcaaaagatg

SEQ ID NO: 182152 - DNA, 103 bp, Artificial Sequence
  Synthetic Polynucleotide
taatacgactcactataggggtttgacttcgtagcccttccaaaggaattaacagaggagaaattccatgggaagggctaacctggcggcagcgcaaaagatg

SEQ ID NO: 182153 - DNA, 103 bp, Artificial Sequence
  Synthetic Polynucleotide
taatacgactcactatagggcagcgactgctggtcctgcgtcttttcgtcaacagaggagagacgaaatgacgcaggacaacctggcggcagcgcaaaagatg

SEQ ID NO: 182154 - DNA, 103 bp, Artificial Sequence
  Synthetic Polynucleotide
taatacgactcactatagggctcaaactgggtttgacttcgtagcccttcaacagaggagagaagggatgcgaagtcaaaacctggcggcagcgcaaaagatg

SEQ ID NO: 182155 - DNA, 103 bp, Artificial Sequence
  Synthetic Polynucleotide
taatacgactcactatagggacctcatctcctcaaactgggtttgacttcaacagaggagagaagtcatgcccagtttgaacctggcggcagcgcaaaagatg

SEQ ID NO: 182156 - DNA, 103 bp, Artificial Sequence
  Synthetic Polynucleotide
taatacgactcactatagggatgtagcttgacctcatctcctcaaactggaacagaggagaccagttatgggagatgagaacctggcggcagcgcaaaagatg

SEQ ID NO: 182157 - DNA, 103 bp, Artificial Sequence
  Synthetic Polynucleotide
taatacgactcactataggggagctctctaatgtagcttgacctcatctcaacagaggagagagatgatgtcaagctacaacctggcggcagcgcaaaagatg

SEQ ID NO: 182158 - DNA, 103 bp, Artificial Sequence
  Synthetic Polynucleotide
taatacgactcactatagggttgccttgatgagctctctaatgtagcttgaacagaggagacaagctatgttagagagcaacctggcggcagcgcaaaagatg

SEQ ID NO: 182159 - DNA, 103 bp, Artificial Sequence
  Synthetic Polynucleotide
taatacgactcactatagggctcaaaccaattgccttgatgagctctctaaacagaggagatagagaatgcatcaaggcaacctggcggcagcgcaaaagatg

SEQ ID NO: 182160 - DNA, 103 bp, Artificial Sequence
  Synthetic Polynucleotide
taatacgactcactatagggtcctttttgcctcaaaccaattgccttgataacagaggagaatcaagatgattggtttgaacctggcggcagcgcaaaagatg

SEQ ID NO: 182161 - DNA, 103 bp, Artificial Sequence
  Synthetic Polynucleotide
taatacgactcactatagggtcgacacaactcctttttgcctcaaaccaaaacagaggagattggttatgggcaaaaagaacctggcggcagcgcaaaagatg

SEQ ID NO: 182162 - DNA, 103 bp, Artificial Sequence
  Synthetic Polynucleotide
taatacgactcactatagggcgctgtgagctcgacacaactcctttttgcaacagaggagagcaaaaatgagttgtgtcaacctggcggcagcgcaaaagatg

SEQ ID NO: 182163 - DNA, 103 bp, Artificial Sequence
  Synthetic Polynucleotide
taatacgactcactatagggttgatagaaacgctgtgagctcgacacaacaacagaggagagttgtgatgagctcacagaacctggcggcagcgcaaaagatg

SEQ ID NO: 182164 - DNA, 103 bp, Artificial Sequence
  Synthetic Polynucleotide
taatacgactcactatagggccacgtccgacagcgactgctggtcctgcgaacagaggagacgcaggatgagcagtcgcaacctggcggcagcgcaaaagatg

SEQ ID NO: 182165 - DNA, 103 bp, Artificial Sequence
  Synthetic Polynucleotide
taatacgactcactataggggttttgtaagttgatagaaacgctgtgagcaacagaggagagctcacatggtttctatcaacctggcggcagcgcaaaagatg

SEQ ID NO: 182166 - DNA, 103 bp, Artificial Sequence
  Synthetic Polynucleotide
taatacgactcactatagggttatcaagaagttttgtaagttgatagaaaaacagaggagatttctaatgacttacaaaaacctggcggcagcgcaaaagatg

SEQ ID NO: 182167 - DNA, 103 bp, Artificial Sequence
  Synthetic Polynucleotide
taatacgactcactatagggatcatgcaagttatcaagaagttttgtaagaacagaggagacttacaatgcttcttgataacctggcggcagcgcaaaagatg

SEQ ID NO: 182168 - DNA, 103 bp, Artificial Sequence
  Synthetic Polynucleotide
taatacgactcactataggggtttgacaagatcatgcaagttatcaagaaaacagaggagattcttgatgacttgcatgaacctggcggcagcgcaaaagatg

SEQ ID NO: 182169 - DNA, 103 bp, Artificial Sequence
  Synthetic Polynucleotide
taatacgactcactatagggagatgaagttgtttgacaagatcatgcaagaacagaggagacttgcaatgtcttgtcaaaacctggcggcagcgcaaaagatg

SEQ ID NO: 182170 - DNA, 103 bp, Artificial Sequence
  Synthetic Polynucleotide
taatacgactcactatagggcaagcagtacagatgaagttgtttgacaagaacagaggagacttgtcatgcaacttcataacctggcggcagcgcaaaagatg

SEQ ID NO: 182171 - DNA, 103 bp, Artificial Sequence
  Synthetic Polynucleotide
taatacgactcactatagggtaaatgtattcaagcagtacagatgaagttaacagaggagaaacttcatgtgtactgctaacctggcggcagcgcaaaagatg

SEQ ID NO: 182172 - DNA, 103 bp, Artificial Sequence
  Synthetic Polynucleotide
taatacgactcactatagggcgggactggataaatgtattcaagcagtacaacagaggagagtactgatggaatacattaacctggcggcagcgcaaaagatg

SEQ ID NO: 182173 - DNA, 103 bp, Artificial Sequence
  Synthetic Polynucleotide
taatacgactcactatagggactcagtgcccgggactggataaatgtattaacagaggagaaatacaatgatccagtccaacctggcggcagcgcaaaagatg

SEQ ID NO: 182174 - DNA, 103 bp, Artificial Sequence
  Synthetic Polynucleotide
taatacgactcactataggggaaattcaacactcagtgcccgggactggaaacagaggagatccagtatggggcactgaaacctggcggcagcgcaaaagatg

SEQ ID NO: 182175 - DNA, 103 bp, Artificial Sequence
  Synthetic Polynucleotide
taatacgactcactatagggtatgcgccctccacgtccgacagcgactgcaacagaggagagcagtcatggtcggacgtaacctggcggcagcgcaaaagatg

SEQ ID NO: 182176 - DNA, 103 bp, Artificial Sequence
  Synthetic Polynucleotide
taatacgactcactatagggatcatttctggaaattcaacactcagtgccaacagaggagaggcactatgtgttgaattaacctggcggcagcgcaaaagatg

SEQ ID NO: 182177 - DNA, 103 bp, Artificial Sequence
  Synthetic Polynucleotide
taatacgactcactatagggaacttcagacatcatttctggaaattcaacaacagaggagagttgaaatgccagaaatgaacctggcggcagcgcaaaagatg

SEQ ID NO: 182178 - DNA, 103 bp, Artificial Sequence
  Synthetic Polynucleotide
taatacgactcactataggggtgcagcaataacttcagacatcatttctgaacagaggagacagaaaatgtgtctgaagaacctggcggcagcgcaaaagatg

SEQ ID NO: 182179 - DNA, 103 bp, Artificial Sequence
  Synthetic Polynucleotide
taatacgactcactatagggttgggtaattgtgcagcaataacttcagacaacagaggagagtctgaatgtattgctgcaacctggcggcagcgcaaaagatg

SEQ ID NO: 182180 - DNA, 103 bp, Artificial Sequence
  Synthetic Polynucleotide
taatacgactcactatagggtgccaatatcttgggtaattgtgcagcaataacagaggagaattgctatgcaattacccaacctggcggcagcgcaaaagatg

SEQ ID NO: 182181 - DNA, 103 bp, Artificial Sequence
  Synthetic Polynucleotide
taatacgactcactatagggtcaccatccctgccaatatcttgggtaattaacagaggagaaattacatgagatattggaacctggcggcagcgcaaaagatg

SEQ ID NO: 182182 - DNA, 103 bp, Artificial Sequence
  Synthetic Polynucleotide
taatacgactcactatagggagaaggggtttcaccatccctgccaatatcaacagaggagagatattatgagggatggtaacctggcggcagcgcaaaagatg

SEQ ID NO: 182183 - DNA, 103 bp, Artificial Sequence
  Synthetic Polynucleotide
taatacgactcactatagggtttatgaaagagaaggggtttcaccatcccaacagaggagagggatgatgaaaccccttaacctggcggcagcgcaaaagatg

SEQ ID NO: 182184 - DNA, 103 bp, Artificial Sequence
  Synthetic Polynucleotide
taatacgactcactatagggagctctggaatatgcgccctccacgtccgaaacagaggagatcggacatggagggcgcaaacctggcggcagcgcaaaagatg

SEQ ID NO: 182185 - DNA, 103 bp, Artificial Sequence
  Synthetic Polynucleotide
taatacgactcactatagggttgtagcttcagctctggaatatgcgccctaacagaggagaagggcgatgattccagagaacctggcggcagcgcaaaagatg

SEQ ID NO: 182186 - DNA, 103 bp, Artificial Sequence
  Synthetic Polynucleotide
taatacgactcactatagggccagcaccccttgtagcttcagctctggaaaacagaggagattccagatgtgaagctacaacctggcggcagcgcaaaagatg

SEQ ID NO: 182187 - DNA, 103 bp, Artificial Sequence
  Synthetic Polynucleotide
taatacgactcactatagggactgctgcctccagcaccccttgtagcttcaacagaggagagaagctatgaggggtgctaacctggcggcagcgcaaaagatg

SEQ ID NO: 182188 - DNA, 103 bp, Artificial Sequence
  Synthetic Polynucleotide
taatacgactcactatagggggggactagaactgctgcctccagcaccccaacagaggagaggggtgatggaggcagcaaacctggcggcagcgcaaaagatg

SEQ ID NO: 182189 - DNA, 103 bp, Artificial Sequence
  Synthetic Polynucleotide
taatacgactcactatagggccgcccgccacgtggggagcccggggacccaacagaggagagggtccatgggctccccaaacctggcggcagcgcaaaagatg

SEQ ID NO: 182190 - DNA, 103 bp, Artificial Sequence
  Synthetic Polynucleotide
taatacgactcactatagggtccttttctgggggactagaactgctgcctaacagaggagaaggcagatgttctagtccaacctggcggcagcgcaaaagatg

SEQ ID NO: 182191 - DNA, 103 bp, Artificial Sequence
  Synthetic Polynucleotide
taatacgactcactatagggcagtccgctgtccttttctgggggactagaaacagaggagatctagtatgccagaaaagaacctggcggcagcgcaaaagatg

SEQ ID NO: 182192 - DNA, 103 bp, Artificial Sequence
  Synthetic Polynucleotide
taatacgactcactatagggcactgtccagcagtccgctgtccttttctgaacagaggagacagaaaatgacagcggacaacctggcggcagcgcaaaagatg

SEQ ID NO: 182193 - DNA, 103 bp, Artificial Sequence
  Synthetic Polynucleotide
taatacgactcactataggggtgtccaagacactgtccagcagtccgctgaacagaggagacagcggatggctggacagaacctggcggcagcgcaaaagatg

SEQ ID NO: 182194 - DNA, 103 bp, Artificial Sequence
  Synthetic Polynucleotide
taatacgactcactatagggcgccaacagagtgtccaagacactgtccagaacagaggagactggacatggtcttggacaacctggcggcagcgcaaaagatg

SEQ ID NO: 182195 - DNA, 103 bp, Artificial Sequence
  Synthetic Polynucleotide
taatacgactcactataggggacctgagggcgccaacagagtgtccaagaaacagaggagatcttggatgctctgttggaacctggcggcagcgcaaaagatg

SEQ ID NO: 182196 - DNA, 103 bp, Artificial Sequence
  Synthetic Polynucleotide
taatacgactcactatagggctctgcccgggacctgagggcgccaacagaaacagaggagatctgttatggccctcaggaacctggcggcagcgcaaaagatg

SEQ ID NO: 182197 - DNA, 103 bp, Artificial Sequence
  Synthetic Polynucleotide
taatacgactcactataggggctgggttggctctgcccgggacctgagggaacagaggagaccctcaatgcccgggcagaacctggcggcagcgcaaaagatg

SEQ ID NO: 182198 - DNA, 103 bp, Artificial Sequence
  Synthetic Polynucleotide
taatacgactcactatagggaggcgggagggctgggttggctctgcccggaacagaggagaccgggcatggccaacccaaacctggcggcagcgcaaaagatg

SEQ ID NO: 182199 - DNA, 103 bp, Artificial Sequence
  Synthetic Polynucleotide
taatacgactcactataggggtgacctcgcaggcgggagggctgggttggaacagaggagaccaaccatgccctcccgcaacctggcggcagcgcaaaagatg

SEQ ID NO: 182200 - DNA, 103 bp, Artificial Sequence
  Synthetic Polynucleotide
taatacgactcactatagggggagggcgggccgcccgccacgtggggagcaacagaggagagctcccatggtggcgggcaacctggcggcagcgcaaaagatg

SEQ ID NO: 182201 - DNA, 103 bp, Artificial Sequence
  Synthetic Polynucleotide
taatacgactcactatagggccaagagctggtgacctcgcaggcgggaggaacagaggagacctcccatgtgcgaggtcaacctggcggcagcgcaaaagatg

SEQ ID NO: 182202 - DNA, 103 bp, Artificial Sequence
  Synthetic Polynucleotide
taatacgactcactatagggcaaacaggcaccaagagctggtgacctcgcaacagaggagagcgaggatgccagctcttaacctggcggcagcgcaaaagatg

SEQ ID NO: 182203 - DNA, 103 bp, Artificial Sequence
  Synthetic Polynucleotide
taatacgactcactatagggagttcggggccaaacaggcaccaagagctgaacagaggagacagctcatggtgcctgttaacctggcggcagcgcaaaagatg

SEQ ID NO: 182204 - DNA, 103 bp, Artificial Sequence
  Synthetic Polynucleotide
taatacgactcactatagggatcttcgggaagttcggggccaaacaggcaaacagaggagatgcctgatgggccccgaaaacctggcggcagcgcaaaagatg

SEQ ID NO: 182205 - DNA, 103 bp, Artificial Sequence
  Synthetic Polynucleotide
taatacgactcactatagggcagccggtggatcttcgggaagttcggggcaacagaggagagccccgatgttcccgaagaacctggcggcagcgcaaaagatg

SEQ ID NO: 182206 - DNA, 103 bp, Artificial Sequence
  Synthetic Polynucleotide
taatacgactcactataggggtggcgggggcagccggtggatcttcgggaaacagaggagatcccgaatgtccaccggcaacctggcggcagcgcaaaagatg

SEQ ID NO: 182207 - DNA, 103 bp, Artificial Sequence
  Synthetic Polynucleotide
taatacgactcactatagggcacccgctgggtggcgggggcagccggtggaacagaggagaccaccgatggcccccgccaacctggcggcagcgcaaaagatg

SEQ ID NO: 182208 - DNA, 103 bp, Artificial Sequence
  Synthetic Polynucleotide
taatacgactcactataggggcggggacaacacccgctgggtggcgggggaacagaggagacccccgatgcccagcgggaacctggcggcagcgcaaaagatg

SEQ ID NO: 182209 - DNA, 103 bp, Artificial Sequence
  Synthetic Polynucleotide
taatacgactcactatagggcggctcatgagcggggacaacacccgctggaacagaggagaccagcgatggttgtccccaacctggcggcagcgcaaaagatg

SEQ ID NO: 182210 - DNA, 103 bp, Artificial Sequence
  Synthetic Polynucleotide
taatacgactcactataggggcacccggaccggctcatgagcggggacaaaacagaggagattgtccatgctcatgagcaacctggcggcagcgcaaaagatg

SEQ ID NO: 182211 - DNA, 103 bp, Artificial Sequence
  Synthetic Polynucleotide
taatacgactcactatagggcgacctcgggggagggcgggccgcccgccaaacagaggagatggcggatggcccgccctaacctggcggcagcgcaaaagatg

SEQ ID NO: 182212 - DNA, 103 bp, Artificial Sequence
  Synthetic Polynucleotide
taatacgactcactatagggctccaaccttgcacccggaccggctcatgaaacagaggagatcatgaatgggtccgggtaacctggcggcagcgcaaaagatg

SEQ ID NO: 182213 - DNA, 103 bp, Artificial Sequence
  Synthetic Polynucleotide
taatacgactcactatagggccggagctgtctccaaccttgcacccggacaacagaggagagtccggatgcaaggttggaacctggcggcagcgcaaaagatg

SEQ ID NO: 182214 - DNA, 103 bp, Artificial Sequence
  Synthetic Polynucleotide
taatacgactcactatagggagctgccgtcccggagctgtctccaaccttaacagaggagaaaggttatggacagctccaacctggcggcagcgcaaaagatg

SEQ ID NO: 182215 - DNA, 103 bp, Artificial Sequence
  Synthetic Polynucleotide
taatacgactcactatagggctttatgggcagctgccgtcccggagctgtaacagaggagaacagctatgggacggcagaacctggcggcagcgcaaaagatg

SEQ ID NO: 182216 - DNA, 103 bp, Artificial Sequence
  Synthetic Polynucleotide
taatacgactcactatagggcggggcagcactttatgggcagctgccgtcaacagaggagagacggcatgtgcccataaaacctggcggcagcgcaaaagatg

SEQ ID NO: 182217 - DNA, 103 bp, Artificial Sequence
  Synthetic Polynucleotide
taatacgactcactatagggtgacaggccccggggcagcactttatgggcaacagaggagagcccatatggtgctgcccaacctggcggcagcgcaaaagatg

SEQ ID NO: 182218 - DNA, 103 bp, Artificial Sequence
  Synthetic Polynucleotide
taatacgactcactataggggccgggctggtgacaggccccggggcagcaaacagaggagatgctgcatgggggcctgtaacctggcggcagcgcaaaagatg

SEQ ID NO: 182219 - DNA, 103 bp, Artificial Sequence
  Synthetic Polynucleotide
taatacgactcactatagggagcagcagctgccgggctggtgacaggcccaacagaggagagggcctatgaccagcccgaacctggcggcagcgcaaaagatg

SEQ ID NO: 182220 - DNA, 103 bp, Artificial Sequence
  Synthetic Polynucleotide
taatacgactcactatagggagaggccgggagcagcagctgccgggctggaacagaggagaccagccatgcagctgctgaacctggcggcagcgcaaaagatg

SEQ ID NO: 182221 - DNA, 103 bp, Artificial Sequence
  Synthetic Polynucleotide
taatacgactcactataggggagggctctcagaggccgggagcagcagctaacagaggagaagctgcatgtcccggcctaacctggcggcagcgcaaaagatg

SEQ ID NO: 182222 - DNA, 103 bp, Artificial Sequence
  Synthetic Polynucleotide
taatacgactcactatagggagtggggatccgacctcgggggagggcgggaacagaggagacccgccatgccccgaggtaacctggcggcagcgcaaaagatg

SEQ ID NO: 182223 - DNA, 103 bp, Artificial Sequence
  Synthetic Polynucleotide
taatacgactcactatagggccggaccagtgagggctctcagaggccgggaacagaggagacccggcatgtgagagcccaacctggcggcagcgcaaaagatg

SEQ ID NO: 182224 - DNA, 103 bp, Artificial Sequence
  Synthetic Polynucleotide
taatacgactcactatagggcactggggccccggaccagtgagggctctcaacagaggagagagagcatgcactggtccaacctggcggcagcgcaaaagatg

SEQ ID NO: 182225 - DNA, 103 bp, Artificial Sequence
  Synthetic Polynucleotide
taatacgactcactataggggagacggcttcactggggccccggaccagtaacagaggagaactggtatggggccccagaacctggcggcagcgcaaaagatg

SEQ ID NO: 182226 - DNA, 103 bp, Artificial Sequence
  Synthetic Polynucleotide
taatacgactcactataggggcggcctgcggagacggcttcactggggccaacagaggagaggccccatggaagccgtcaacctggcggcagcgcaaaagatg

SEQ ID NO: 182227 - DNA, 103 bp, Artificial Sequence
  Synthetic Polynucleotide
taatacgactcactatagggctccaccgcagcggcctgcggagacggcttaacagaggagaaagccgatgccgcaggccaacctggcggcagcgcaaaagatg

SEQ ID NO: 182228 - DNA, 103 bp, Artificial Sequence
  Synthetic Polynucleotide
taatacgactcactatagggcctcctcaacctccaccgcagcggcctgcgaacagaggagacgcaggatgctgcggtggaacctggcggcagcgcaaaagatg

SEQ ID NO: 182229 - DNA, 103 bp, Artificial Sequence
  Synthetic Polynucleotide
taatacgactcactataggggagccatcctcctcctcaacctccaccgcaaacagaggagatgcggtatgggttgaggaaacctggcggcagcgcaaaagatg

SEQ ID NO: 182230 - DNA, 103 bp, Artificial Sequence
  Synthetic Polynucleotide
taatacgactcactatagggctcggactcagagccatcctcctcctcaacaacagaggagagttgagatggaggatggcaacctggcggcagcgcaaaagatg

SEQ ID NO: 182231 - DNA, 103 bp, Artificial Sequence
  Synthetic Polynucleotide
taatacgactcactatagggccgcagactcctcggactcagagccatcctaacagaggagaaggatgatgctgagtccgaacctggcggcagcgcaaaagatg

SEQ ID NO: 182232 - DNA, 103 bp, Artificial Sequence
  Synthetic Polynucleotide
taatacgactcactatagggagaagcggacccgcagactcctcggactcaaacagaggagatgagtcatgggagtctgcaacctggcggcagcgcaaaagatg

SEQ ID NO: 182233 - DNA, 103 bp, Artificial Sequence
  Synthetic Polynucleotide
taatacgactcactataggggcgacacagcagtggggatccgacctcgggaacagaggagacccgagatgggatccccaaacctggcggcagcgcaaaagatg

SEQ ID NO: 182234 - DNA, 103 bp, Artificial Sequence
  Synthetic Polynucleotide
taatacgactcactatagggtttgcccttcagaagcggacccgcagactcaacagaggagagagtctatgggtccgcttaacctggcggcagcgcaaaagatg

SEQ ID NO: 182235 - DNA, 103 bp, Artificial Sequence
  Synthetic Polynucleotide
taatacgactcactataggggagcccgaggtttgcccttcagaagcggacaacagaggagagtccgcatgtgaagggcaaacctggcggcagcgcaaaagatg

SEQ ID NO: 182236 - DNA, 103 bp, Artificial Sequence
  Synthetic Polynucleotide
taatacgactcactataggggcgccacccagagcccgaggtttgcccttcaacagaggagagaagggatgacctcgggcaacctggcggcagcgcaaaagatg

SEQ ID NO: 182237 - DNA, 103 bp, Artificial Sequence
  Synthetic Polynucleotide
taatacgactcactatagggtccagccgccgcgccacccagagcccgaggaacagaggagacctcggatgctgggtggcaacctggcggcagcgcaaaagatg

SEQ ID NO: 182238 - DNA, 103 bp, Artificial Sequence
  Synthetic Polynucleotide
taatacgactcactatagggcggctcctcctccagccgccgcgccacccaaacagaggagatgggtgatgcggcggctgaacctggcggcagcgcaaaagatg

SEQ ID NO: 182239 - DNA, 103 bp, Artificial Sequence
  Synthetic Polynucleotide
taatacgactcactataggggggacagccgcggctcctcctccagccgccaacagaggagaggcggcatgaggaggagcaacctggcggcagcgcaaaagatg

SEQ ID NO: 182240 - DNA, 103 bp, Artificial Sequence
  Synthetic Polynucleotide
taatacgactcactatagggcgcccccggcgggacagccgcggctcctccaacagaggagaggaggaatggcggctgtcaacctggcggcagcgcaaaagatg

SEQ ID NO: 182241 - DNA, 103 bp, Artificial Sequence
  Synthetic Polynucleotide
taatacgactcactatagggctcctgctgccgcccccggcgggacagccgaacagaggagacggctgatgcgccgggggaacctggcggcagcgcaaaagatg

SEQ ID NO: 182242 - DNA, 103 bp, Artificial Sequence
  Synthetic Polynucleotide
taatacgactcactatagggagggcgacgcctcctgctgccgcccccggcaacagaggagagccgggatgggcagcaggaacctggcggcagcgcaaaagatg

SEQ ID NO: 182243 - DNA, 103 bp, Artificial Sequence
  Synthetic Polynucleotide
taatacgactcactatagggcttggggaccagggcgacgcctcctgctgcaacagaggagagcagcaatgggcgtcgccaacctggcggcagcgcaaaagatg

SEQ ID NO: 182244 - DNA, 103 bp, Artificial Sequence
  Synthetic Polynucleotide
taatacgactcactatagggctgcggctgggcgacacagcagtggggatcaacagaggagagatcccatgtgctgtgtcaacctggcggcagcgcaaaagatg

SEQ ID NO: 182245 - DNA, 103 bp, Artificial Sequence
  Synthetic Polynucleotide
taatacgactcactataggggggaatcttccttggggaccagggcgacgcaacagaggagagcgtcgatgtggtccccaaacctggcggcagcgcaaaagatg

SEQ ID NO: 182246 - DNA, 103 bp, Artificial Sequence
  Synthetic Polynucleotide
taatacgactcactataggggctgagaagcgggaatcttccttggggaccaacagaggagaggtcccatgggaagattcaacctggcggcagcgcaaaagatg

SEQ ID NO: 182247 - DNA, 103 bp, Artificial Sequence
  Synthetic Polynucleotide
taatacgactcactataggggaccctgggcgctgagaagcgggaatcttcaacagaggagagaagatatgcgcttctcaaacctggcggcagcgcaaaagatg

SEQ ID NO: 182248 - DNA, 103 bp, Artificial Sequence
  Synthetic Polynucleotide
taatacgactcactatagggccaccagggcgaccctgggcgctgagaagcaacagaggagagcttctatgcgcccagggaacctggcggcagcgcaaaagatg

SEQ ID NO: 182249 - DNA, 103 bp, Artificial Sequence
  Synthetic Polynucleotide
taatacgactcactataggggcgtcctgctccaccagggcgaccctgggcaacagaggagagcccagatgcgccctggtaacctggcggcagcgcaaaagatg

SEQ ID NO: 182250 - DNA, 103 bp, Artificial Sequence
  Synthetic Polynucleotide
taatacgactcactatagggcgccatcggcgcgtcctgctccaccagggcaacagaggagagccctgatggagcaggacaacctggcggcagcgcaaaagatg

SEQ ID NO: 182251 - DNA, 103 bp, Artificial Sequence
  Synthetic Polynucleotide
taatacgactcactatagggagcgcccgggcgccatcggcgcgtcctgctaacagaggagaagcaggatgcgccgatggaacctggcggcagcgcaaaagatg

SEQ ID NO: 182252 - DNA, 103 bp, Artificial Sequence
  Synthetic Polynucleotide
taatacgactcactataggggccagcggggagcgcccgggcgccatcggcaacagaggagagccgatatggcccgggcgaacctggcggcagcgcaaaagatg

SEQ ID NO: 182253 - DNA, 103 bp, Artificial Sequence
  Synthetic Polynucleotide
taatacgactcactatagggcaccgtggtggccagcggggagcgcccgggaacagaggagacccgggatgtccccgctgaacctggcggcagcgcaaaagatg

SEQ ID NO: 182254 - DNA, 103 bp, Artificial Sequence
  Synthetic Polynucleotide
taatacgactcactatagggtgaaatccatcaccgtggtggccagcggggaacagaggagaccccgcatgccaccacggaacctggcggcagcgcaaaagatg

SEQ ID NO: 182255 - DNA, 103 bp, Artificial Sequence
  Synthetic Polynucleotide
taatacgactcactataggggggaacggacctgcggctgggcgacacagcaacagaggagagctgtgatgcccagccgcaacctggcggcagcgcaaaagatg

SEQ ID NO: 182256 - DNA, 103 bp, Artificial Sequence
  Synthetic Polynucleotide
taatacgactcactatagggggcacgtggatgaaatccatcaccgtggtgaacagaggagacaccacatggatggatttaacctggcggcagcgcaaaagatg

SEQ ID NO: 182257 - DNA, 103 bp, Artificial Sequence
  Synthetic Polynucleotide
taatacgactcactatagggaggcaggataggcacgtggatgaaatccataacagaggagaatggatatgatccacgtgaacctggcggcagcgcaaaagatg

SEQ ID NO: 182258 - DNA, 103 bp, Artificial Sequence
  Synthetic Polynucleotide
taatacgactcactatagggcgtgattgagaggcaggataggcacgtggaaacagaggagatccacgatgctatcctgcaacctggcggcagcgcaaaagatg

SEQ ID NO: 182259 - DNA, 103 bp, Artificial Sequence
  Synthetic Polynucleotide
taatacgactcactataggggccaataaggcgtgattgagaggcaggataaacagaggagatatcctatgtctcaatcaaacctggcggcagcgcaaaagatg

SEQ ID NO: 182260 - DNA, 103 bp, Artificial Sequence
  Synthetic Polynucleotide
taatacgactcactatagggagtgcgggctgccaataaggcgtgattgagaacagaggagactcaatatggccttattgaacctggcggcagcgcaaaagatg

SEQ ID NO: 182261 - DNA, 103 bp, Artificial Sequence
  Synthetic Polynucleotide
taatacgactcactataggggcagctgccgagtgcgggctgccaataaggaacagaggagaccttatatgcagcccgcaaacctggcggcagcgcaaaagatg

SEQ ID NO: 182262 - DNA, 103 bp, Artificial Sequence
  Synthetic Polynucleotide
taatacgactcactatagggtcgtcttccagcagctgccgagtgcgggctaacagaggagaagcccgatgtcggcagctaacctggcggcagcgcaaaagatg

SEQ ID NO: 182263 - DNA, 103 bp, Artificial Sequence
  Synthetic Polynucleotide
taatacgactcactataggggtcgtaactttcgtcttccagcagctgccgaacagaggagacggcagatgctggaagacaacctggcggcagcgcaaaagatg

SEQ ID NO: 182264 - DNA, 103 bp, Artificial Sequence
  Synthetic Polynucleotide
taatacgactcactatagggcggccccgccgtcgtaactttcgtcttccaaacagaggagatggaagatgaaagttacgaacctggcggcagcgcaaaagatg

SEQ ID NO: 182265 - DNA, 103 bp, Artificial Sequence
  Synthetic Polynucleotide
taatacgactcactatagggctggcagccccggccccgccgtcgtaacttaacagaggagaaagttaatgcggcggggcaacctggcggcagcgcaaaagatg

SEQ ID NO: 182266 - DNA, 103 bp, Artificial Sequence
  Synthetic Polynucleotide
taatacgactcactataggggccaatggactcaaacactttggcagccataacagaggagaatggctatgaaagtgtttaacctggcggcagcgcaaaagatg

SEQ ID NO: 182267 - DNA, 103 bp, Artificial Sequence
  Synthetic Polynucleotide
taatacgactcactataggggtcaaagatgacagctctgtgcccagcatcaacagaggagagatgctatgcacagagctaacctggcggcagcgcaaaagatg

SEQ ID NO: 182268 - DNA, 103 bp, Artificial Sequence
  Synthetic Polynucleotide
taatacgactcactatagggcacggaatcggtcaaagatgacagctctgtaacagaggagaacagagatgtcatctttgaacctggcggcagcgcaaaagatg

SEQ ID NO: 182269 - DNA, 103 bp, Artificial Sequence
  Synthetic Polynucleotide
taatacgactcactatagggtcctgcactccacggaatcggtcaaagatgaacagaggagacatcttatgccgattccgaacctggcggcagcgcaaaagatg

SEQ ID NO: 182270 - DNA, 103 bp, Artificial Sequence
  Synthetic Polynucleotide
taatacgactcactatagggtaccacaatgtcctgcactccacggaatcgaacagaggagacgattcatgggagtgcagaacctggcggcagcgcaaaagatg

SEQ ID NO: 182271 - DNA, 103 bp, Artificial Sequence
  Synthetic Polynucleotide
taatacgactcactatagggtcccttcccctaccacaatgtcctgcactcaacagaggagagagtgcatgacattgtggaacctggcggcagcgcaaaagatg

SEQ ID NO: 182272 - DNA, 103 bp, Artificial Sequence
  Synthetic Polynucleotide
taatacgactcactatagggagaaaatgagtcccttcccctaccacaatgaacagaggagacattgtatgaggggaaggaacctggcggcagcgcaaaagatg

SEQ ID NO: 182273 - DNA, 103 bp, Artificial Sequence
  Synthetic Polynucleotide
taatacgactcactatagggccacgggatgagaaaatgagtcccttccccaacagaggagaggggaaatgactcattttaacctggcggcagcgcaaaagatg

SEQ ID NO: 182274 - DNA, 103 bp, Artificial Sequence
  Synthetic Polynucleotide
taatacgactcactataggggtttctgtacccacgggatgagaaaatgagaacagaggagactcattatgtcatcccgtaacctggcggcagcgcaaaagatg

SEQ ID NO: 182275 - DNA, 103 bp, Artificial Sequence
  Synthetic Polynucleotide
taatacgactcactatagggaagataattggtttctgtacccacgggatgaacagaggagacatcccatgggtacagaaaacctggcggcagcgcaaaagatg

SEQ ID NO: 182276 - DNA, 103 bp, Artificial Sequence
  Synthetic Polynucleotide
taatacgactcactatagggacggcagtcaaagataattggtttctgtacaacagaggagagtacagatgccaattatcaacctggcggcagcgcaaaagatg

SEQ ID NO: 182277 - DNA, 103 bp, Artificial Sequence
  Synthetic Polynucleotide
taatacgactcactatagggggccaaacttgccaatggactcaaacacttaacagaggagaaagtgtatgagtccattgaacctggcggcagcgcaaaagatg

SEQ ID NO: 182278 - DNA, 103 bp, Artificial Sequence
  Synthetic Polynucleotide
taatacgactcactataggggtggtcgagaacggcagtcaaagataattgaacagaggagacaattaatgttgactgccaacctggcggcagcgcaaaagatg

SEQ ID NO: 182279 - DNA, 103 bp, Artificial Sequence
  Synthetic Polynucleotide
taatacgactcactatagggggcacattacgtggtcgagaacggcagtcaaacagaggagatgactgatgttctcgaccaacctggcggcagcgcaaaagatg

SEQ ID NO: 182280 - DNA, 103 bp, Artificial Sequence
  Synthetic Polynucleotide
taatacgactcactatagggagtgatgactggcacattacgtggtcgagaaacagaggagatctcgaatgcgtaatgtgaacctggcggcagcgcaaaagatg

SEQ ID NO: 182281 - DNA, 103 bp, Artificial Sequence
  Synthetic Polynucleotide
taatacgactcactatagggctttgctaccagtgatgactggcacattacaacagaggagagtaatgatgcagtcatcaaacctggcggcagcgcaaaagatg

SEQ ID NO: 182282 - DNA, 103 bp, Artificial Sequence
  Synthetic Polynucleotide
taatacgactcactatagggttctgtaaatctttgctaccagtgatgactaacagaggagaagtcatatgtggtagcaaaacctggcggcagcgcaaaagatg

SEQ ID NO: 182283 - DNA, 103 bp, Artificial Sequence
  Synthetic Polynucleotide
taatacgactcactataggggatgttgacattctgtaaatctttgctaccaacagaggagaggtagcatggatttacagaacctggcggcagcgcaaaagatg

SEQ ID NO: 182284 - DNA, 103 bp, Artificial Sequence
  Synthetic Polynucleotide
taatacgactcactatagggtgcgcagtgtgatgttgacattctgtaaataacagaggagaatttacatgatgtcaacaaacctggcggcagcgcaaaagatg

SEQ ID NO: 182285 - DNA, 103 bp, Artificial Sequence
  Synthetic Polynucleotide
taatacgactcactatagggcggaagaggatgcgcagtgtgatgttgacaaacagaggagatgtcaaatgcacactgcgaacctggcggcagcgcaaaagatg

SEQ ID NO: 182286 - DNA, 103 bp, Artificial Sequence
  Synthetic Polynucleotide
taatacgactcactatagggggcgacaggccggaagaggatgcgcagtgtaacagaggagaacactgatgatcctcttcaacctggcggcagcgcaaaagatg

SEQ ID NO: 182287 - DNA, 103 bp, Artificial Sequence
  Synthetic Polynucleotide
taatacgactcactataggggaagctggctggcgacaggccggaagaggaaacagaggagatcctctatgggcctgtcgaacctggcggcagcgcaaaagatg

SEQ ID NO: 182288 - DNA, 103 bp, Artificial Sequence
  Synthetic Polynucleotide
taatacgactcactataggggctaaggccaggccaaacttgccaatggacaacagaggagagtccatatgcaagtttggaacctggcggcagcgcaaaagatg

SEQ ID NO: 182289 - DNA, 103 bp, Artificial Sequence
  Synthetic Polynucleotide
taatacgactcactatagggaagatgcgaggaagctggctggcgacaggcaacagaggagagcctgtatgcagccagctaacctggcggcagcgcaaaagatg

SEQ ID NO: 182290 - DNA, 103 bp, Artificial Sequence
  Synthetic Polynucleotide
taatacgactcactataggggatgctggtgaagatgcgaggaagctggctaacagaggagaagccagatgcctcgcatcaacctggcggcagcgcaaaagatg

SEQ ID NO: 182291 - DNA, 103 bp, Artificial Sequence
  Synthetic Polynucleotide
taatacgactcactatagggagtcctctccgatgctggtgaagatgcgagaacagaggagactcgcaatgtcaccagcaaacctggcggcagcgcaaaagatg

SEQ ID NO: 182292 - DNA, 103 bp, Artificial Sequence
  Synthetic Polynucleotide
taatacgactcactatagggcgctcatcatagtcctctccgatgctggtgaacagaggagacaccagatgcggagaggaaacctggcggcagcgcaaaagatg

SEQ ID NO: 182293 - DNA, 103 bp, Artificial Sequence
  Synthetic Polynucleotide
taatacgactcactatagggcggcagcacacgctcatcatagtcctctccaacagaggagaggagagatgtatgatgagaacctggcggcagcgcaaaagatg

SEQ ID NO: 182294 - DNA, 103 bp, Artificial Sequence
  Synthetic Polynucleotide
taatacgactcactatagggttgtgatggacggcagcacacgctcatcataacagaggagaatgatgatggtgtgctgcaacctggcggcagcgcaaaagatg

SEQ ID NO: 182295 - DNA, 103 bp, Artificial Sequence
  Synthetic Polynucleotide
taatacgactcactatagggaggatctcagttgtgatggacggcagcacaaacagaggagatgtgctatggtccatcacaacctggcggcagcgcaaaagatg

SEQ ID NO: 182296 - DNA, 103 bp, Artificial Sequence
  Synthetic Polynucleotide
taatacgactcactatagggcactgacttgaggatctcagttgtgatggaaacagaggagatccatcatgactgagatcaacctggcggcagcgcaaaagatg

SEQ ID NO: 182297 - DNA, 103 bp, Artificial Sequence
  Synthetic Polynucleotide
taatacgactcactatagggagcgagccaccactgacttgaggatctcagaacagaggagactgagaatgtcaagtcagaacctggcggcagcgcaaaagatg

SEQ ID NO: 182298 - DNA, 103 bp, Artificial Sequence
  Synthetic Polynucleotide
taatacgactcactatagggccagcatcaaagcgagccaccactgacttgaacagaggagacaagtcatgggtggctcgaacctggcggcagcgcaaaagatg

SEQ ID NO: 182299 - DNA, 103 bp, Artificial Sequence
  Synthetic Polynucleotide
taatacgactcactatagggtcctgcaacagctaaggccaggccaaacttaacagaggagaaagtttatgctggccttaaacctggcggcagcgcaaaagatg

SEQ ID NO: 182300 - DNA, 103 bp, Artificial Sequence
  Synthetic Polynucleotide
taatacgactcactataggggattagttctccagcatcaaagcgagccacaacagaggagagtggctatgtttgatgctaacctggcggcagcgcaaaagatg

SEQ ID NO: 182301 - DNA, 103 bp, Artificial Sequence
  Synthetic Polynucleotide
taatacgactcactatagggctctctgggtgattagttctccagcatcaaaacagaggagattgatgatggagaactaaaacctggcggcagcgcaaaagatg

SEQ ID NO: 182302 - DNA, 103 bp, Artificial Sequence
  Synthetic Polynucleotide
taatacgactcactataggggagaccagctctctctgggtgattagttctaacagaggagaagaactatgcacccagagaacctggcggcagcgcaaaagatg

SEQ ID NO: 182303 - DNA, 103 bp, Artificial Sequence
  Synthetic Polynucleotide
taatacgactcactatagggcacctgcctggagaccagctctctctgggtaacagaggagaacccagatggagctggtcaacctggcggcagcgcaaaagatg

SEQ ID NO: 182304 - DNA, 103 bp, Artificial Sequence
  Synthetic Polynucleotide
taatacgactcactatagggggtcgtcgctcacctgcctggagaccagctaacagaggagaagctggatgccaggcaggaacctggcggcagcgcaaaagatg

SEQ ID NO: 182305 - DNA, 103 bp, Artificial Sequence
  Synthetic Polynucleotide
taatacgactcactatagggcgctctgtaaggtcgtcgctcacctgcctgaacagaggagacaggcaatggagcgacgaaacctggcggcagcgcaaaagatg

SEQ ID NO: 182306 - DNA, 103 bp, Artificial Sequence
  Synthetic Polynucleotide
taatacgactcactatagggggtggcggctcgctctgtaaggtcgtcgctaacagaggagaagcgacatgcttacagagaacctggcggcagcgcaaaagatg

SEQ ID NO: 182307 - DNA, 103 bp, Artificial Sequence
  Synthetic Polynucleotide
taatacgactcactatagggtgagcccaaaggtggcggctcgctctgtaaaacagaggagattacagatggagccgccaaacctggcggcagcgcaaaagatg

SEQ ID NO: 182308 - DNA, 103 bp, Artificial Sequence
  Synthetic Polynucleotide
taatacgactcactatagggtcatccaggatgagcccaaaggtggcggctaacagaggagaagccgcatgctttgggctaacctggcggcagcgcaaaagatg

SEQ ID NO: 182309 - DNA, 103 bp, Artificial Sequence
  Synthetic Polynucleotide
taatacgactcactatagggcaaggacacgtcatccaggatgagcccaaaaacagaggagatttgggatgatcctggataacctggcggcagcgcaaaagatg

SEQ ID NO: 182310 - DNA, 103 bp, Artificial Sequence
  Synthetic Polynucleotide
taatacgactcactatagggtcaccacgcctcctgcaacagctaaggccaaacagaggagatggcctatgctgttgcagaacctggcggcagcgcaaaagatg

SEQ ID NO: 182311 - DNA, 103 bp, Artificial Sequence
  Synthetic Polynucleotide
taatacgactcactatagggtcagatgtgtcaaggacacgtcatccaggaaacagaggagatcctggatgacgtgtcctaacctggcggcagcgcaaaagatg

SEQ ID NO: 182312 - DNA, 103 bp, Artificial Sequence
  Synthetic Polynucleotide
taatacgactcactatagggttcccgaaggtcagatgtgtcaaggacacgaacagaggagacgtgtcatggacacatctaacctggcggcagcgcaaaagatg

SEQ ID NO: 182313 - DNA, 103 bp, Artificial Sequence
  Synthetic Polynucleotide
taatacgactcactatagggtgtgaactccttcccgaaggtcagatgtgtaacagaggagaacacatatgaccttcgggaacctggcggcagcgcaaaagatg

SEQ ID NO: 182314 - DNA, 103 bp, Artificial Sequence
  Synthetic Polynucleotide
taatacgactcactatagggccaccgcttctgtgaactccttcccgaaggaacagaggagaccttcgatgaggagttcaaacctggcggcagcgcaaaagatg

SEQ ID NO: 182315 - DNA, 103 bp, Artificial Sequence
  Synthetic Polynucleotide
taatacgactcactatagggtgtttggcttccaccgcttctgtgaactccaacagaggagaggagttatgagaagcggtaacctggcggcagcgcaaaagatg

SEQ ID NO: 182316 - DNA, 103 bp, Artificial Sequence
  Synthetic Polynucleotide
taatacgactcactatagggctgagccacctgtttggcttccaccgcttcaacagaggagagaagcgatggaagccaaaaacctggcggcagcgcaaaagatg

SEQ ID NO: 182317 - DNA, 103 bp, Artificial Sequence
  Synthetic Polynucleotide
taatacgactcactatagggctgcttcctgctgagccacctgtttggcttaacagaggagaaagccaatgaggtggctcaacctggcggcagcgcaaaagatg

SEQ ID NO: 182318 - DNA, 103 bp, Artificial Sequence
  Synthetic Polynucleotide
taatacgactcactatagggctggccctctctgcttcctgctgagccaccaacagaggagaggtggcatggcaggaagcaacctggcggcagcgcaaaagatg

SEQ ID NO: 182319 - DNA, 103 bp, Artificial Sequence
  Synthetic Polynucleotide
taatacgactcactatagggcaccacaaatctggccctctctgcttcctgaacagaggagacaggaaatggagagggccaacctggcggcagcgcaaaagatg

SEQ ID NO: 182320 - DNA, 103 bp, Artificial Sequence
  Synthetic Polynucleotide
taatacgactcactatagggcagccttttccaccacaaatctggccctctaacagaggagaagagggatggatttgtggaacctggcggcagcgcaaaagatg

SEQ ID NO: 182321 - DNA, 103 bp, Artificial Sequence
  Synthetic Polynucleotide
taatacgactcactatagggaaggcagagttcaccacgcctcctgcaacaaacagaggagatgttgcatgaggcgtggtaacctggcggcagcgcaaaagatg

SEQ ID NO: 182322 - DNA, 103 bp, Artificial Sequence
  Synthetic Polynucleotide
taatacgactcactatagggttctgttgctcagccttttccaccacaaataacagaggagaatttgtatgggaaaaggcaacctggcggcagcgcaaaagatg

SEQ ID NO: 182323 - DNA, 103 bp, Artificial Sequence
  Synthetic Polynucleotide
taatacgactcactatagggggccgcctttttctgttgctcagccttttcaacagaggagagaaaagatggagcaacagaacctggcggcagcgcaaaagatg

SEQ ID NO: 182324 - DNA, 103 bp, Artificial Sequence
  Synthetic Polynucleotide
taatacgactcactatagggcagagatgatggccgcctttttctgttgctaacagaggagaagcaacatgaaaaggcggaacctggcggcagcgcaaaagatg

SEQ ID NO: 182325 - DNA, 103 bp, Artificial Sequence
  Synthetic Polynucleotide
taatacgactcactatagggtcgccctcagcagagatgatggccgcctttaacagaggagaaaaggcatgcatcatctcaacctggcggcagcgcaaaagatg

SEQ ID NO: 182326 - DNA, 103 bp, Artificial Sequence
  Synthetic Polynucleotide
taatacgactcactatagggtgccttggagtcgccctcagcagagatgataacagaggagaatcatcatggctgagggcaacctggcggcagcgcaaaagatg

SEQ ID NO: 182327 - DNA, 103 bp, Artificial Sequence
  Synthetic Polynucleotide
taatacgactcactatagggtcagctcagctgccttggagtcgccctcagaacagaggagactgaggatgactccaaggaacctggcggcagcgcaaaagatg

SEQ ID NO: 182328 - DNA, 103 bp, Artificial Sequence
  Synthetic Polynucleotide
taatacgactcactataggggagttggcaatcagctcagctgccttggagaacagaggagactccaaatgagctgagctaacctggcggcagcgcaaaagatg

SEQ ID NO: 182329 - DNA, 103 bp, Artificial Sequence
  Synthetic Polynucleotide
taatacgactcactatagggagtggccagtgagttggcaatcagctcagcaacagaggagagctgagatgattgccaacaacctggcggcagcgcaaaagatg

SEQ ID NO: 182330 - DNA, 103 bp, Artificial Sequence
  Synthetic Polynucleotide
taatacgactcactatagggcatcccctgcagtggccagtgagttggcaaaacagaggagattgccaatgcactggccaaacctggcggcagcgcaaaagatg

SEQ ID NO: 182331 - DNA, 103 bp, Artificial Sequence
  Synthetic Polynucleotide
taatacgactcactatagggtcgatcaggccatcccctgcagtggccagtaacagaggagaactggcatgtgcaggggaaacctggcggcagcgcaaaagatg

SEQ ID NO: 182332 - DNA, 103 bp, Artificial Sequence
  Synthetic Polynucleotide
taatacgactcactatagggcacattatataaggcagagttcaccacgccaacagaggagaggcgtgatgaactctgccaacctggcggcagcgcaaaagatg

SEQ ID NO: 182333 - DNA, 103 bp, Artificial Sequence
  Synthetic Polynucleotide
taatacgactcactatagggcttgcgcagctcgatcaggccatcccctgcaacagaggagagcagggatgggcctgatcaacctggcggcagcgcaaaagatg

SEQ ID NO: 182334 - DNA, 103 bp, Artificial Sequence
  Synthetic Polynucleotide
taatacgactcactatagggcagcttccagcttgcgcagctcgatcaggcaacagaggagagcctgaatgagctgcgcaaacctggcggcagcgcaaaagatg

SEQ ID NO: 182335 - DNA, 103 bp, Artificial Sequence
  Synthetic Polynucleotide
taatacgactcactatagggatgtcctctgcagcttccagcttgcgcagcaacagaggagagctgcgatggctggaagcaacctggcggcagcgcaaaagatg

SEQ ID NO: 182336 - DNA, 103 bp, Artificial Sequence
  Synthetic Polynucleotide
taatacgactcactatagggctggtacgcgatgtcctctgcagcttccagaacagaggagactggaaatggcagaggacaacctggcggcagcgcaaaagatg

SEQ ID NO: 182337 - DNA, 103 bp, Artificial Sequence
  Synthetic Polynucleotide
taatacgactcactatagggagcgtgagagctggtacgcgatgtcctctgaacagaggagacagaggatgtcgcgtaccaacctggcggcagcgcaaaagatg

SEQ ID NO: 182338 - DNA, 103 bp, Artificial Sequence
  Synthetic Polynucleotide
taatacgactcactatagggatgttccgagagcgtgagagctggtacgcgaacagaggagacgcgtaatggctctcacgaacctggcggcagcgcaaaagatg

SEQ ID NO: 182339 - DNA, 103 bp, Artificial Sequence
  Synthetic Polynucleotide
taatacgactcactatagggcaggtaggtgatgttccgagagcgtgagagaacagaggagactctcaatgtctcggaacaacctggcggcagcgcaaaagatg

SEQ ID NO: 182340 - DNA, 103 bp, Artificial Sequence
  Synthetic Polynucleotide
taatacgactcactataggggccccgctggcaggtaggtgatgttccgagaacagaggagactcggaatgtcacctaccaacctggcggcagcgcaaaagatg

SEQ ID NO: 182341 - DNA, 103 bp, Artificial Sequence
  Synthetic Polynucleotide
taatacgactcactatagggagcacggactgccccgctggcaggtaggtgaacagaggagacacctaatggccagcgggaacctggcggcagcgcaaaagatg

SEQ ID NO: 182342 - DNA, 103 bp, Artificial Sequence
  Synthetic Polynucleotide
taatacgactcactatagggcagctggaggagcacggactgccccgctggaacagaggagaccagcgatgcagtccgtgaacctggcggcagcgcaaaagatg

SEQ ID NO: 182343 - DNA, 103 bp, Artificial Sequence
  Synthetic Polynucleotide
taatacgactcactataggggcccagcatccacattatataaggcagagtaacagaggagaactctgatgtatataatgaacctggcggcagcgcaaaagatg

SEQ ID NO: 182344 - DNA, 103 bp, Artificial Sequence
  Synthetic Polynucleotide
taatacgactcactatagggacagctctgtgcccagcatccacattatataacagaggagaatataaatgggatgctggaacctggcggcagcgcaaaagatg

SEQ ID NO: 182345 - DNA, 103 bp, Artificial Sequence
  Synthetic Polynucleotide
taatacgactcactataggggtcgtacgaattgaggtaggagtagtccataacagaggagaatggacatgtcctacctcaacctggcggcagcgcaaaagatg

SEQ ID NO: 182346 - DNA, 103 bp, Artificial Sequence
  Synthetic Polynucleotide
taatacgactcactataggggggccgcagggggctgtattggaagccgccaacagaggagaggcggcatgcaatacagcaacctggcggcagcgcaaaagatg

SEQ ID NO: 182347 - DNA, 103 bp, Artificial Sequence
  Synthetic Polynucleotide
taatacgactcactatagggcggggaaagcgggccgcagggggctgtattaacagaggagaaatacaatgccctgcggcaacctggcggcagcgcaaaagatg

SEQ ID NO: 182348 - DNA, 103 bp, Artificial Sequence
  Synthetic Polynucleotide
taatacgactcactatagggggccctgccgcggggaaagcgggccgcaggaacagaggagacctgcgatgcgctttcccaacctggcggcagcgcaaaagatg

SEQ ID NO: 182349 - DNA, 103 bp, Artificial Sequence
  Synthetic Polynucleotide
taatacgactcactatagggggggcagggcggccctgccgcggggaaagcaacagaggagagctttcatggcggcagggaacctggcggcagcgcaaaagatg

SEQ ID NO: 182350 - DNA, 103 bp, Artificial Sequence
  Synthetic Polynucleotide
taatacgactcactatagggagccgagcgcggggcagggcggccctgccgaacagaggagacggcagatgcgccctgccaacctggcggcagcgcaaaagatg

SEQ ID NO: 182351 - DNA, 103 bp, Artificial Sequence
  Synthetic Polynucleotide
taatacgactcactatagggcagttggaggagccgagcgcggggcagggcaacagaggagagccctgatgcgcgctcggaacctggcggcagcgcaaaagatg

SEQ ID NO: 182352 - DNA, 103 bp, Artificial Sequence
  Synthetic Polynucleotide
taatacgactcactataggggccaagtgcgcagttggaggagccgagcgcaacagaggagagcgctcatgtcctccaacaacctggcggcagcgcaaaagatg

SEQ ID NO: 182353 - DNA, 103 bp, Artificial Sequence
  Synthetic Polynucleotide
taatacgactcactatagggcgcgtagggcgccaagtgcgcagttggaggaacagaggagacctccaatggcgcacttgaacctggcggcagcgcaaaagatg

SEQ ID NO: 182354 - DNA, 103 bp, Artificial Sequence
  Synthetic Polynucleotide
taatacgactcactatagggggctggtggtcgcgtagggcgccaagtgcgaacagaggagacgcactatgcgccctacgaacctggcggcagcgcaaaagatg

SEQ ID NO: 182355 - DNA, 103 bp, Artificial Sequence
  Synthetic Polynucleotide
taatacgactcactataggggtagggcgcgggctggtggtcgcgtagggcaacagaggagagccctaatggaccaccagaacctggcggcagcgcaaaagatg

SEQ ID NO: 182356 - DNA, 103 bp, Artificial Sequence
  Synthetic Polynucleotide
taatacgactcactatagggccacgcacgagtcgtacgaattgaggtaggaacagaggagacctaccatgattcgtacgaacctggcggcagcgcaaaagatg

SEQ ID NO: 182357 - DNA, 103 bp, Artificial Sequence
  Synthetic Polynucleotide
taatacgactcactataggggcactgccgagtagggcgcgggctggtggtaacagaggagaaccaccatgccgcgccctaacctggcggcagcgcaaaagatg

SEQ ID NO: 182358 - DNA, 103 bp, Artificial Sequence
  Synthetic Polynucleotide
taatacgactcactatagggaacttgtagggcactgccgagtagggcgcgaacagaggagacgcgccatgctcggcagtaacctggcggcagcgcaaaagatg

SEQ ID NO: 182359 - DNA, 103 bp, Artificial Sequence
  Synthetic Polynucleotide
taatacgactcactatagggctctgggaagaacttgtagggcactgccgaaacagaggagatcggcaatgccctacaagaacctggcggcagcgcaaaagatg

SEQ ID NO: 182360 - DNA, 103 bp, Artificial Sequence
  Synthetic Polynucleotide
taatacgactcactatagggggccggatggctctgggaagaacttgtaggaacagaggagacctacaatgtcttcccagaacctggcggcagcgcaaaagatg

SEQ ID NO: 182361 - DNA, 103 bp, Artificial Sequence
  Synthetic Polynucleotide
taatacgactcactatagggttctcgtgcaggccggatggctctgggaagaacagaggagacttcccatggccatccggaacctggcggcagcgcaaaagatg

SEQ ID NO: 182362 - DNA, 103 bp, Artificial Sequence
  Synthetic Polynucleotide
taatacgactcactatagggctgcttgcgcttctcgtgcaggccggatggaacagaggagaccatccatgctgcacgagaacctggcggcagcgcaaaagatg

SEQ ID NO: 182363 - DNA, 103 bp, Artificial Sequence
  Synthetic Polynucleotide
taatacgactcactatagggggatgcgccgctgcttgcgcttctcgtgcaaacagaggagatgcacgatgagcgcaagcaacctggcggcagcgcaaaagatg

SEQ ID NO: 182364 - DNA, 103 bp, Artificial Sequence
  Synthetic Polynucleotide
taatacgactcactatagggaacgtggtgcggatgcgccgctgcttgcgcaacagaggagagcgcaaatggcggcgcataacctggcggcagcgcaaaagatg

SEQ ID NO: 182365 - DNA, 103 bp, Artificial Sequence
  Synthetic Polynucleotide
taatacgactcactatagggcgcgctggtgaacgtggtgcggatgcgccgaacagaggagacggcgcatgcgcaccacgaacctggcggcagcgcaaaagatg

SEQ ID NO: 182366 - DNA, 103 bp, Artificial Sequence
  Synthetic Polynucleotide
taatacgactcactatagggccttgagctgcgcgctggtgaacgtggtgcaacagaggagagcaccaatgtcaccagcgaacctggcggcagcgcaaaagatg

SEQ ID NO: 182367 - DNA, 103 bp, Artificial Sequence
  Synthetic Polynucleotide
taatacgactcactatagggtccatggccgccacgcacgagtcgtacgaaaacagaggagattcgtaatgctcgtgcgtaacctggcggcagcgcaaaagatg

SEQ ID NO: 182368 - DNA, 103 bp, Artificial Sequence
  Synthetic Polynucleotide
taatacgactcactatagggcgctccagctccttgagctgcgcgctggtgaacagaggagacaccagatggcagctcaaaacctggcggcagcgcaaaagatg

SEQ ID NO: 182369 - DNA, 103 bp, Artificial Sequence
  Synthetic Polynucleotide
taatacgactcactatagggagcgaaaacgcgctccagctccttgagctgaacagaggagacagctcatggagctggagaacctggcggcagcgcaaaagatg

SEQ ID NO: 182370 - DNA, 103 bp, Artificial Sequence
  Synthetic Polynucleotide
taatacgactcactatagggagtgggtctcagcgaaaacgcgctccagctaacagaggagaagctggatggcgttttcgaacctggcggcagcgcaaaagatg

SEQ ID NO: 182371 - DNA, 103 bp, Artificial Sequence
  Synthetic Polynucleotide
taatacgactcactatagggatgtcggggtagtgggtctcagcgaaaacgaacagaggagacgttttatgtgagacccaaacctggcggcagcgcaaaagatg

SEQ ID NO: 182372 - DNA, 103 bp, Artificial Sequence
  Synthetic Polynucleotide
taatacgactcactatagggacgcgtgtaaatgtcggggtagtgggtctcaacagaggagagagaccatgtaccccgacaacctggcggcagcgcaaaagatg

SEQ ID NO: 182373 - DNA, 103 bp, Artificial Sequence
  Synthetic Polynucleotide
taatacgactcactatagggccagctcctcacgcgtgtaaatgtcggggtaacagaggagaaccccgatgtttacacgcaacctggcggcagcgcaaaagatg

SEQ ID NO: 182374 - DNA, 103 bp, Artificial Sequence
  Synthetic Polynucleotide
taatacgactcactatagggatcttgagcgccagctcctcacgcgtgtaaaacagaggagattacacatgtgaggagctaacctggcggcagcgcaaaagatg

SEQ ID NO: 182375 - DNA, 103 bp, Artificial Sequence
  Synthetic Polynucleotide
taatacgactcactatagggagtgaggtcgatcttgagcgccagctcctcaacagaggagagaggagatggcgctcaagaacctggcggcagcgcaaaagatg

SEQ ID NO: 182376 - DNA, 103 bp, Artificial Sequence
  Synthetic Polynucleotide
taatacgactcactatagggcgcgagcctcagtgaggtcgatcttgagcgaacagaggagacgctcaatgtcgacctcaaacctggcggcagcgcaaaagatg

SEQ ID NO: 182377 - DNA, 103 bp, Artificial Sequence
  Synthetic Polynucleotide
taatacgactcactatagggcagacctgcacgcgagcctcagtgaggtcgaacagaggagacgacctatgtgaggctcgaacctggcggcagcgcaaaagatg

SEQ ID NO: 182378 - DNA, 103 bp, Artificial Sequence
  Synthetic Polynucleotide
taatacgactcactatagggggcggacgcctccatggccgccacgcacgaaacagaggagatcgtgcatggcggccatgaacctggcggcagcgcaaaagatg

SEQ ID NO: 182379 - DNA, 103 bp, Artificial Sequence
  Synthetic Polynucleotide
taatacgactcactataggggttctggaaccagacctgcacgcgagcctcaacagaggagagaggctatggtgcaggtcaacctggcggcagcgcaaaagatg

SEQ ID NO: 182380 - DNA, 103 bp, Artificial Sequence
  Synthetic Polynucleotide
taatacgactcactatagggtggcccggcggttctggaaccagacctgcaaacagaggagatgcaggatgggttccagaaacctggcggcagcgcaaaagatg

SEQ ID NO: 182381 - DNA, 103 bp, Artificial Sequence
  Synthetic Polynucleotide
taatacgactcactatagggttgcggaacttggcccggcggttctggaacaacagaggagagttccaatgccgccgggcaacctggcggcagcgcaaaagatg

SEQ ID NO: 182382 - DNA, 103 bp, Artificial Sequence
  Synthetic Polynucleotide
taatacgactcactataggggcgctcctgtttgcggaacttggcccggcgaacagaggagacgccggatgaagttccgcaacctggcggcagcgcaaaagatg

SEQ ID NO: 182383 - DNA, 103 bp, Artificial Sequence
  Synthetic Polynucleotide
taatacgactcactatagggcgctggccgcgcgctcctgtttgcggaactaacagaggagaagttccatgaacaggagcaacctggcggcagcgcaaaagatg

SEQ ID NO: 182384 - DNA, 103 bp, Artificial Sequence
  Synthetic Polynucleotide
taatacgactcactataggggcgcccttggcgctggccgcgcgctcctgtaacagaggagaacaggaatgcgcggccagaacctggcggcagcgcaaaagatg

SEQ ID NO: 182385 - DNA, 103 bp, Artificial Sequence
  Synthetic Polynucleotide
taatacgactcactatagggcgcgcccgccgcgcccttggcgctggccgcaacagaggagagcggccatggccaagggcaacctggcggcagcgcaaaagatg

SEQ ID NO: 182386 - DNA, 103 bp, Artificial Sequence
  Synthetic Polynucleotide
taatacgactcactatagggtggcgcccgccgcgcccgccgcgcccttggaacagaggagaccaaggatgcggcgggcgaacctggcggcagcgcaaaagatg

SEQ ID NO: 182387 - DNA, 103 bp, Artificial Sequence
  Synthetic Polynucleotide
taatacgactcactatagggtcgccctttttggcgcccgccgcgcccgccaacagaggagaggcgggatgggcgggcgcaacctggcggcagcgcaaaagatg

SEQ ID NO: 182388 - DNA, 103 bp, Artificial Sequence
  Synthetic Polynucleotide
taatacgactcactataggggcagcgcgcctcgccctttttggcgcccgcaacagaggagagcgggcatgaaaaagggcaacctggcggcagcgcaaaagatg

SEQ ID NO: 182389 - DNA, 103 bp, Artificial Sequence
  Synthetic Polynucleotide
taatacgactcactatagggagtcgccgtaggcggacgcctccatggccgaacagaggagacggccaatgaggcgtccgaacctggcggcagcgcaaaagatg

SEQ ID NO: 182390 - DNA, 103 bp, Artificial Sequence
  Synthetic Polynucleotide
taatacgactcactatagggcctcggaggagcagcgcgcctcgcccttttaacagaggagaaaaaggatgaggcgcgctaacctggcggcagcgcaaaagatg

SEQ ID NO: 182391 - DNA, 103 bp, Artificial Sequence
  Synthetic Polynucleotide
taatacgactcactataggggaatcgtcgtcctcggaggagcagcgcgccaacagaggagaggcgcgatgctcctccgaaacctggcggcagcgcaaaagatg

SEQ ID NO: 182392 - DNA, 103 bp, Artificial Sequence
  Synthetic Polynucleotide
taatacgactcactatagggggactccttggaatcgtcgtcctcggaggaaacagaggagatcctccatggacgacgataacctggcggcagcgcaaaagatg

SEQ ID NO: 182393 - DNA, 103 bp, Artificial Sequence
  Synthetic Polynucleotide
taatacgactcactatagggggctgcacgtggactccttggaatcgtcgtaacagaggagaacgacgatgccaaggagtaacctggcggcagcgcaaaagatg

SEQ ID NO: 182394 - DNA, 103 bp, Artificial Sequence
  Synthetic Polynucleotide
taatacgactcactatagggtcgggcgtggggctgcacgtggactccttgaacagaggagacaaggaatgcacgtgcagaacctggcggcagcgcaaaagatg

SEQ ID NO: 182395 - DNA, 103 bp, Artificial Sequence
  Synthetic Polynucleotide
taatacgactcactatagggggcggtgctatcgggcgtggggctgcacgtaacagaggagaacgtgcatgcccacgcccaacctggcggcagcgcaaaagatg

SEQ ID NO: 182396 - DNA, 103 bp, Artificial Sequence
  Synthetic Polynucleotide
taatacgactcactataggggcggcagcgaggcggtgctatcgggcgtggaacagaggagaccacgcatgatagcaccgaacctggcggcagcgcaaaagatg

SEQ ID NO: 182397 - DNA, 103 bp, Artificial Sequence
  Synthetic Polynucleotide
taatacgactcactataggggcaggcggcggcggcagcgaggcggtgctaaacagaggagatagcacatgctcgctgccaacctggcggcagcgcaaaagatg

SEQ ID NO: 182398 - DNA, 103 bp, Artificial Sequence
  Synthetic Polynucleotide
taatacgactcactatagggcaggccgggcgcaggcggcggcggcagcgaaacagaggagatcgctgatgccgccgcctaacctggcggcagcgcaaaagatg

SEQ ID NO: 182399 - DNA, 103 bp, Artificial Sequence
  Synthetic Polynucleotide
taatacgactcactataggggcgggctggccaggccgggcgcaggcggcgaacagaggagacgccgcatgcgcccggccaacctggcggcagcgcaaaagatg

SEQ ID NO: 182400 - DNA, 103 bp, Artificial Sequence
  Synthetic Polynucleotide
taatacgactcactatagggcaggcgccaaagtcgccgtaggcggacgccaacagaggagaggcgtcatgctacggcgaaacctggcggcagcgcaaaagatg

SEQ ID NO: 182401 - DNA, 103 bp, Artificial Sequence
  Synthetic Polynucleotide
taatacgactcactataggggggctcaggcgcgggctggccaggccgggcaacagaggagagcccggatgggccagcccaacctggcggcagcgcaaaagatg

SEQ ID NO: 182402 - DNA, 103 bp, Artificial Sequence
  Synthetic Polynucleotide
taatacgactcactatagggcagcgggctggggctcaggcgcgggctggcaacagaggagagccagcatgcgcctgagcaacctggcggcagcgcaaaagatg

SEQ ID NO: 182403 - DNA, 103 bp, Artificial Sequence
  Synthetic Polynucleotide
taatacgactcactataggggtgcgacgggcagcgggctggggctcaggcaacagaggagagcctgaatgccagcccgcaacctggcggcagcgcaaaagatg

SEQ ID NO: 182404 - DNA, 103 bp, Artificial Sequence
  Synthetic Polynucleotide
taatacgactcactatagggccggagcccagtgcgacgggcagcgggctgaacagaggagacagcccatggcccgtcgcaacctggcggcagcgcaaaagatg

SEQ ID NO: 182405 - DNA, 103 bp, Artificial Sequence
  Synthetic Polynucleotide
taatacgactcactatagggaggtcccggcccggagcccagtgcgacgggaacagaggagacccgtcatgctgggctccaacctggcggcagcgcaaaagatg

SEQ ID NO: 182406 - DNA, 103 bp, Artificial Sequence
  Synthetic Polynucleotide
taatacgactcactataggggccccggcccaggtcccggcccggagcccaaacagaggagatgggctatgggccgggacaacctggcggcagcgcaaaagatg

SEQ ID NO: 182407 - DNA, 103 bp, Artificial Sequence
  Synthetic Polynucleotide
taatacgactcactatagggagcggctgtggccccggcccaggtcccggcaacagaggagagccgggatgtgggccgggaacctggcggcagcgcaaaagatg

SEQ ID NO: 182408 - DNA, 103 bp, Artificial Sequence
  Synthetic Polynucleotide
taatacgactcactatagggtgcgcccttgagcggctgtggccccggcccaacagaggagagggccgatgccacagccgaacctggcggcagcgcaaaagatg

SEQ ID NO: 182409 - DNA, 103 bp, Artificial Sequence
  Synthetic Polynucleotide
taatacgactcactatagggcggcccacagtgcgcccttgagcggctgtgaacagaggagacacagcatgtcaagggcgaacctggcggcagcgcaaaagatg

SEQ ID NO: 182410 - DNA, 103 bp, Artificial Sequence
  Synthetic Polynucleotide
taatacgactcactatagggcccgccacaccggcccacagtgcgcccttgaacagaggagacaagggatgactgtgggcaacctggcggcagcgcaaaagatg

SEQ ID NO: 182411 - DNA, 103 bp, Artificial Sequence
  Synthetic Polynucleotide
taatacgactcactataggggggctggctgcaggcgccaaagtcgccgtaaacagaggagatacggcatgtttggcgccaacctggcggcagcgcaaaagatg

SEQ ID NO: 182412 - DNA, 103 bp, Artificial Sequence
  Synthetic Polynucleotide
taatacgactcactataggggcccccaccgcccgccacaccggcccacagaacagaggagactgtggatgggtgtggcgaacctggcggcagcgcaaaagatg

SEQ ID NO: 182413 - DNA, 103 bp, Artificial Sequence
  Synthetic Polynucleotide
taatacgactcactatagggcaggcccgccgcccccaccgcccgccacacaacagaggagagtgtggatggcggtggggaacctggcggcagcgcaaaagatg

SEQ ID NO: 182414 - DNA, 103 bp, Artificial Sequence
  Synthetic Polynucleotide
taatacgactcactataggggctcccgcgccaggcccgccgcccccaccgaacagaggagacggtggatgcggcgggccaacctggcggcagcgcaaaagatg

SEQ ID NO: 182415 - DNA, 103 bp, Artificial Sequence
  Synthetic Polynucleotide
taatacgactcactatagggtagttcggccgctcccgcgccaggcccgccaacagaggagaggcgggatgggcgcgggaaacctggcggcagcgcaaaagatg

SEQ ID NO: 182416 - DNA, 103 bp, Artificial Sequence
  Synthetic Polynucleotide
taatacgactcactatagggaagccttaagtagttcggccgctcccgcgcaacagaggagagcgcggatgcggccgaacaacctggcggcagcgcaaaagatg

SEQ ID NO: 182417 - DNA, 103 bp, Artificial Sequence
  Synthetic Polynucleotide
taatacgactcactataggggccggctgccaagccttaagtagttcggccaacagaggagaggccgaatgacttaaggcaacctggcggcagcgcaaaagatg

SEQ ID NO: 182418 - DNA, 103 bp, Artificial Sequence
  Synthetic Polynucleotide
taatacgactcactataggggccggactccgccggctgccaagccttaagaacagaggagacttaagatgtggcagccgaacctggcggcagcgcaaaagatg

SEQ ID NO: 182419 - DNA, 103 bp, Artificial Sequence
  Synthetic Polynucleotide
taatacgactcactatagggagggcccggggccggactccgccggctgccaacagaggagaggcagcatgcggagtccgaacctggcggcagcgcaaaagatg

SEQ ID NO: 182420 - DNA, 103 bp, Artificial Sequence
  Synthetic Polynucleotide
taatacgactcactatagggaccccggagaagggcccggggccggactccaacagaggagaggagtcatgccccgggccaacctggcggcagcgcaaaagatg

SEQ ID NO: 182421 - DNA, 103 bp, Artificial Sequence
  Synthetic Polynucleotide
taatacgactcactatagggggaggacagaaccccggagaagggcccgggaacagaggagacccgggatgttctccgggaacctggcggcagcgcaaaagatg

SEQ ID NO: 182422 - DNA, 103 bp, Artificial Sequence
  Synthetic Polynucleotide
taatacgactcactatagggggaagccgccgggctggctgcaggcgccaaaacagaggagattggcgatggcagccagcaacctggcggcagcgcaaaagatg

SEQ ID NO: 182423 - DNA, 103 bp, Artificial Sequence
  Synthetic Polynucleotide
taatacgactcactatagggtccggtgaaaggaggacagaaccccggagaaacagaggagatctccgatgttctgtcctaacctggcggcagcgcaaaagatg

SEQ ID NO: 182424 - DNA, 103 bp, Artificial Sequence
  Synthetic Polynucleotide
taatacgactcactataggggggccgggcttccggtgaaaggaggacagaaacagaggagatctgtcatgctttcaccgaacctggcggcagcgcaaaagatg

SEQ ID NO: 182425 - DNA, 103 bp, Artificial Sequence
  Synthetic Polynucleotide
taatacgactcactatagggcttcagggcggggccgggcttccggtgaaaaacagaggagatttcacatgaagcccggcaacctggcggcagcgcaaaagatg

SEQ ID NO: 182426 - DNA, 103 bp, Artificial Sequence
  Synthetic Polynucleotide
taatacgactcactatagggagagattggtcttcagggcggggccgggctaacagaggagaagcccgatgccgccctgaaacctggcggcagcgcaaaagatg

SEQ ID NO: 182427 - DNA, 103 bp, Artificial Sequence
  Synthetic Polynucleotide
taatacgactcactataggggggctgtattggaagccgccgggctggctgaacagaggagacagccaatgcggcggcttaacctggcggcagcgcaaaagatg

SEQ ID NO: 182428 - DNA, 103 bp, Artificial Sequence
  Synthetic Polynucleotide
taatacgactcactatagggattgaggtaagaatattccattttatacataacagaggagaatgtatatgatggaatataacctggcggcagcgcaaaagatg

SEQ ID NO: 182429 - DNA, 103 bp, Artificial Sequence
  Synthetic Polynucleotide
taatacgactcactatagggactggcctggctgcaggaactgaagtcagcaacagaggagagctgacatgagttcctgcaacctggcggcagcgcaaaagatg

SEQ ID NO: 182430 - DNA, 103 bp, Artificial Sequence
  Synthetic Polynucleotide
taatacgactcactatagggactggaagccactggcctggctgcaggaacaacagaggagagttcctatggccaggccaaacctggcggcagcgcaaaagatg

SEQ ID NO: 182431 - DNA, 103 bp, Artificial Sequence
  Synthetic Polynucleotide
taatacgactcactatagggatcgggttatactggaagccactggcctggaacagaggagaccaggcatgtggcttccaaacctggcggcagcgcaaaagatg

SEQ ID NO: 182432 - DNA, 103 bp, Artificial Sequence
  Synthetic Polynucleotide
taatacgactcactatagggagtggtccttatcgggttatactggaagccaacagaggagaggcttcatgtataacccgaacctggcggcagcgcaaaagatg

SEQ ID NO: 182433 - DNA, 103 bp, Artificial Sequence
  Synthetic Polynucleotide
taatacgactcactatagggtggccccaaaagtggtccttatcgggttataacagaggagaataaccatgtaaggaccaaacctggcggcagcgcaaaagatg

SEQ ID NO: 182434 - DNA, 103 bp, Artificial Sequence
  Synthetic Polynucleotide
taatacgactcactatagggcagccggacgtggccccaaaagtggtccttaacagaggagaaaggacatgttttggggcaacctggcggcagcgcaaaagatg

SEQ ID NO: 182435 - DNA, 103 bp, Artificial Sequence
  Synthetic Polynucleotide
taatacgactcactataggggagggaagggcagccggacgtggccccaaaaacagaggagatttgggatgacgtccggcaacctggcggcagcgcaaaagatg

SEQ ID NO: 182436 - DNA, 103 bp, Artificial Sequence
  Synthetic Polynucleotide
taatacgactcactatagggatcccggcgtgagggaagggcagccggacgaacagaggagacgtccgatggcccttcccaacctggcggcagcgcaaaagatg

SEQ ID NO: 182437 - DNA, 103 bp, Artificial Sequence
  Synthetic Polynucleotide
taatacgactcactatagggaggctgcaggatcccggcgtgagggaagggaacagaggagacccttcatgcacgccgggaacctggcggcagcgcaaaagatg

SEQ ID NO: 182438 - DNA, 103 bp, Artificial Sequence
  Synthetic Polynucleotide
taatacgactcactataggggagggtgcccaggctgcaggatcccggcgtaacagaggagaacgccgatgtcctgcagcaacctggcggcagcgcaaaagatg

SEQ ID NO: 182439 - DNA, 103 bp, Artificial Sequence
  Synthetic Polynucleotide
taatacgactcactatagggaggcagaggaattgaggtaagaatattccaaacagaggagatggaatatgcttacctcaaacctggcggcagcgcaaaagatg

SEQ ID NO: 182440 - DNA, 103 bp, Artificial Sequence
  Synthetic Polynucleotide
taatacgactcactatagggggtggtccctgagggtgcccaggctgcaggaacagaggagacctgcaatgtgggcacccaacctggcggcagcgcaaaagatg

SEQ ID NO: 182441 - DNA, 103 bp, Artificial Sequence
  Synthetic Polynucleotide
taatacgactcactatagggggactgctctggtggtccctgagggtgcccaacagaggagagggcacatgcagggaccaaacctggcggcagcgcaaaagatg

SEQ ID NO: 182442 - DNA, 103 bp, Artificial Sequence
  Synthetic Polynucleotide
taatacgactcactatagggtgcggcgtacggactgctctggtggtccctaacagaggagaagggacatgcagagcagtaacctggcggcagcgcaaaagatg

SEQ ID NO: 182443 - DNA, 103 bp, Artificial Sequence
  Synthetic Polynucleotide
taatacgactcactatagggtgtaaggaactgcggcgtacggactgctctaacagaggagaagagcaatgcgtacgccgaacctggcggcagcgcaaaagatg

SEQ ID NO: 182444 - DNA, 103 bp, Artificial Sequence
  Synthetic Polynucleotide
taatacgactcactataggggtgaagagtttgtaaggaactgcggcgtacaacagaggagagtacgcatgagttccttaaacctggcggcagcgcaaaagatg

SEQ ID NO: 182445 - DNA, 103 bp, Artificial Sequence
  Synthetic Polynucleotide
taatacgactcactataggggccgtggtccgtgaagagtttgtaaggaacaacagaggagagttcctatgaaactcttcaacctggcggcagcgcaaaagatg

SEQ ID NO: 182446 - DNA, 103 bp, Artificial Sequence
  Synthetic Polynucleotide
taatacgactcactatagggcgttgaggccgccgtggtccgtgaagagttaacagaggagaaactctatgcggaccacgaacctggcggcagcgcaaaagatg

SEQ ID NO: 182447 - DNA, 103 bp, Artificial Sequence
  Synthetic Polynucleotide
taatacgactcactatagggttgcgcttctcgttgaggccgccgtggtccaacagaggagaggaccaatgcggcctcaaaacctggcggcagcgcaaaagatg

SEQ ID NO: 182448 - DNA, 103 bp, Artificial Sequence
  Synthetic Polynucleotide
taatacgactcactataggggcgccgctgcttgcgcttctcgttgaggccaacagaggagaggcctcatggagaagcgcaacctggcggcagcgcaaaagatg

SEQ ID NO: 182449 - DNA, 103 bp, Artificial Sequence
  Synthetic Polynucleotide
taatacgactcactatagggtggtgcggatgcgccgctgcttgcgcttctaacagaggagaagaagcatgagcagcggcaacctggcggcagcgcaaaagatg

SEQ ID NO: 182450 - DNA, 103 bp, Artificial Sequence
  Synthetic Polynucleotide
taatacgactcactatagggcaggactcgtaggcagaggaattgaggtaaaacagaggagattacctatgttcctctgcaacctggcggcagcgcaaaagatg

SEQ ID NO: 182451 - DNA, 103 bp, Artificial Sequence
  Synthetic Polynucleotide
taatacgactcactatagggctggtgaaagtggtgcggatgcgccgctgcaacagaggagagcagcgatgcatccgcacaacctggcggcagcgcaaaagatg

SEQ ID NO: 182452 - DNA, 103 bp, Artificial Sequence
  Synthetic Polynucleotide
taatacgactcactataggggagctgggcactggtgaaagtggtgcggataacagaggagaatccgcatgactttcaccaacctggcggcagcgcaaaagatg

SEQ ID NO: 182453 - DNA, 103 bp, Artificial Sequence
  Synthetic Polynucleotide
taatacgactcactatagggccagctctttgagctgggcactggtgaaagaacagaggagactttcaatggtgcccagcaacctggcggcagcgcaaaagatg

SEQ ID NO: 182454 - DNA, 103 bp, Artificial Sequence
  Synthetic Polynucleotide
taatacgactcactatagggaagaccctttccagctctttgagctgggcaaacagaggagatgcccaatgcaaagagctaacctggcggcagcgcaaaagatg

SEQ ID NO: 182455 - DNA, 103 bp, Artificial Sequence
  Synthetic Polynucleotide
taatacgactcactatagggagtctccgcgaagaccctttccagctctttaacagaggagaaaagagatggaaagggtcaacctggcggcagcgcaaaagatg

SEQ ID NO: 182456 - DNA, 103 bp, Artificial Sequence
  Synthetic Polynucleotide
taatacgactcactatagggcggggtagtgagtctccgcgaagaccctttaacagaggagaaaagggatgtcgcggagaaacctggcggcagcgcaaaagatg

SEQ ID NO: 182457 - DNA, 103 bp, Artificial Sequence
  Synthetic Polynucleotide
taatacgactcactataggggtgtagatgtcggggtagtgagtctccgcgaacagaggagacgcggaatgtcactacccaacctggcggcagcgcaaaagatg

SEQ ID NO: 182458 - DNA, 103 bp, Artificial Sequence
  Synthetic Polynucleotide
taatacgactcactatagggctcctcccgagtgtagatgtcggggtagtgaacagaggagacactacatggacatctacaacctggcggcagcgcaaaagatg

SEQ ID NO: 182459 - DNA, 103 bp, Artificial Sequence
  Synthetic Polynucleotide
taatacgactcactatagggtcagggccagctcctcccgagtgtagatgtaacagaggagaacatctatgctcgggaggaacctggcggcagcgcaaaagatg

SEQ ID NO: 182460 - DNA, 103 bp, Artificial Sequence
  Synthetic Polynucleotide
taatacgactcactatagggaggtcgatcttcagggccagctcctcccgaaacagaggagatcgggaatggctggccctaacctggcggcagcgcaaaagatg

SEQ ID NO: 182461 - DNA, 103 bp, Artificial Sequence
  Synthetic Polynucleotide
taatacgactcactatagggcccagccatacaggactcgtaggcagaggaaacagaggagatcctctatgtacgagtccaacctggcggcagcgcaaaagatg

SEQ ID NO: 182462 - DNA, 103 bp, Artificial Sequence
  Synthetic Polynucleotide
taatacgactcactatagggcgcctctgtgaggtcgatcttcagggccagaacagaggagactggccatgaagatcgacaacctggcggcagcgcaaaagatg

SEQ ID NO: 182463 - DNA, 103 bp, Artificial Sequence
  Synthetic Polynucleotide
taatacgactcactatagggcctggactcgcgcctctgtgaggtcgatctaacagaggagaagatcgatgtcacagaggaacctggcggcagcgcaaaagatg

SEQ ID NO: 182464 - DNA, 103 bp, Artificial Sequence
  Synthetic Polynucleotide
taatacgactcactatagggtggaaccacacctggactcgcgcctctgtgaacagaggagacacagaatggcgagtccaaacctggcggcagcgcaaaagatg

SEQ ID NO: 182465 - DNA, 103 bp, Artificial Sequence
  Synthetic Polynucleotide
taatacgactcactataggggcggcggttctggaaccacacctggactcgaacagaggagacgagtcatggtgtggttcaacctggcggcagcgcaaaagatg

SEQ ID NO: 182466 - DNA, 103 bp, Artificial Sequence
  Synthetic Polynucleotide
taatacgactcactataggggaaacttggcgcggcggttctggaaccacaaacagaggagatgtggtatgagaaccgccaacctggcggcagcgcaaaagatg

SEQ ID NO: 182467 - DNA, 103 bp, Artificial Sequence
  Synthetic Polynucleotide
taatacgactcactatagggtcctgcttgcgaaacttggcgcggcggttcaacagaggagagaaccgatgcgccaagttaacctggcggcagcgcaaaagatg

SEQ ID NO: 182468 - DNA, 103 bp, Artificial Sequence
  Synthetic Polynucleotide
taatacgactcactatagggcgctgcgcgctcctgcttgcgaaacttggcaacagaggagagccaagatgcgcaagcagaacctggcggcagcgcaaaagatg

SEQ ID NO: 182469 - DNA, 103 bp, Artificial Sequence
  Synthetic Polynucleotide
taatacgactcactatagggctgcggctgccgctgcgcgctcctgcttgcaacagaggagagcaagcatgagcgcgcagaacctggcggcagcgcaaaagatg

SEQ ID NO: 182470 - DNA, 103 bp, Artificial Sequence
  Synthetic Polynucleotide
taatacgactcactataggggccgcggccgctgcggctgccgctgcgcgcaacagaggagagcgcgcatgggcagccgcaacctggcggcagcgcaaaagatg

SEQ ID NO: 182471 - DNA, 103 bp, Artificial Sequence
  Synthetic Polynucleotide
taatacgactcactataggggccgttcttggccgcggccgctgcggctgcaacagaggagagcagccatggcggccgcgaacctggcggcagcgcaaaagatg

SEQ ID NO: 182472 - DNA, 103 bp, Artificial Sequence
  Synthetic Polynucleotide
taatacgactcactatagggaggtgtccatcccagccatacaggactcgtaacagaggagaacgagtatggtatggctgaacctggcggcagcgcaaaagatg

SEQ ID NO: 182473 - DNA, 103 bp, Artificial Sequence
  Synthetic Polynucleotide
taatacgactcactatagggtgcccgaggagccgttcttggccgcggccgaacagaggagacggccgatgccaagaacgaacctggcggcagcgcaaaagatg

SEQ ID NO: 182474 - DNA, 103 bp, Artificial Sequence
  Synthetic Polynucleotide
taatacgactcactatagggtcagactttttgcccgaggagccgttcttgaacagaggagacaagaaatgctcctcgggaacctggcggcagcgcaaaagatg

SEQ ID NO: 182475 - DNA, 103 bp, Artificial Sequence
  Synthetic Polynucleotide
taatacgactcactatagggcctggaagagtcagactttttgcccgaggaaacagaggagatcctcgatgaaaaagtctaacctggcggcagcgcaaaagatg

SEQ ID NO: 182476 - DNA, 103 bp, Artificial Sequence
  Synthetic Polynucleotide
taatacgactcactatagggtctcgtcgtccctggaagagtcagacttttaacagaggagaaaaagtatgactcttccaaacctggcggcagcgcaaaagatg

SEQ ID NO: 182477 - DNA, 103 bp, Artificial Sequence
  Synthetic Polynucleotide
taatacgactcactataggggcctctttgctctcgtcgtccctggaagagaacagaggagactcttcatgggacgacgaaacctggcggcagcgcaaaagatg

SEQ ID NO: 182478 - DNA, 103 bp, Artificial Sequence
  Synthetic Polynucleotide
taatacgactcactatagggagtgctcttggcctctttgctctcgtcgtcaacagaggagagacgacatgagcaaagagaacctggcggcagcgcaaaagatg

SEQ ID NO: 182479 - DNA, 103 bp, Artificial Sequence
  Synthetic Polynucleotide
taatacgactcactatagggtgtccgggtcagtgctcttggcctctttgcaacagaggagagcaaagatgccaagagcaaacctggcggcagcgcaaaagatg

SEQ ID NO: 182480 - DNA, 103 bp, Artificial Sequence
  Synthetic Polynucleotide
taatacgactcactatagggcccccagtgctgtccgggtcagtgctcttgaacagaggagacaagagatgtgacccggaaacctggcggcagcgcaaaagatg

SEQ ID NO: 182481 - DNA, 103 bp, Artificial Sequence
  Synthetic Polynucleotide
taatacgactcactataggggggacctgggcccccagtgctgtccgggtcaacagaggagagacccgatgagcactgggaacctggcggcagcgcaaaagatg

SEQ ID NO: 182482 - DNA, 103 bp, Artificial Sequence
  Synthetic Polynucleotide
taatacgactcactatagggggttgggattgggacctgggcccccagtgcaacagaggagagcactgatggcccaggtcaacctggcggcagcgcaaaagatg

SEQ ID NO: 182483 - DNA, 103 bp, Artificial Sequence
  Synthetic Polynucleotide
taatacgactcactataggggccaggctcgaggtgtccatcccagccataaacagaggagatatggcatggatggacacaacctggcggcagcgcaaaagatg

SEQ ID NO: 182484 - DNA, 103 bp, Artificial Sequence
  Synthetic Polynucleotide
taatacgactcactatagggctgggggtggggttgggattgggacctgggaacagaggagacccaggatgcaatcccaaaacctggcggcagcgcaaaagatg

SEQ ID NO: 182485 - DNA, 103 bp, Artificial Sequence
  Synthetic Polynucleotide
taatacgactcactatagggcgccccgcagctgggggtggggttgggattaacagaggagaaatcccatgcccacccccaacctggcggcagcgcaaaagatg

SEQ ID NO: 182486 - DNA, 103 bp, Artificial Sequence
  Synthetic Polynucleotide
taatacgactcactatagggcgcctccattcgccccgcagctgggggtggaacagaggagaccacccatggctgcggggaacctggcggcagcgcaaaagatg

SEQ ID NO: 182487 - DNA, 103 bp, Artificial Sequence
  Synthetic Polynucleotide
taatacgactcactatagggccgccgccgccgcctccattcgccccgcagaacagaggagactgcggatggaatggaggaacctggcggcagcgcaaaagatg

SEQ ID NO: 182488 - DNA, 103 bp, Artificial Sequence
  Synthetic Polynucleotide
taatacgactcactatagggcgggctgggcccgccgccgccgcctccattaacagaggagaaatggaatgggcggcggcaacctggcggcagcgcaaaagatg

SEQ ID NO: 182489 - DNA, 103 bp, Artificial Sequence
  Synthetic Polynucleotide
taatacgactcactataggggagctccagccgggctgggcccgccgccgcaacagaggagagcggcgatgggcccagccaacctggcggcagcgcaaaagatg

SEQ ID NO: 182490 - DNA, 103 bp, Artificial Sequence
  Synthetic Polynucleotide
taatacgactcactataggggccgcccccggagctccagccgggctgggcaacagaggagagcccagatgggctggagcaacctggcggcagcgcaaaagatg

SEQ ID NO: 182491 - DNA, 103 bp, Artificial Sequence
  Synthetic Polynucleotide
taatacgactcactatagggcccgggccccgccgcccccggagctccagcaacagaggagagctggaatgccgggggcgaacctggcggcagcgcaaaagatg

SEQ ID NO: 182492 - DNA, 103 bp, Artificial Sequence
  Synthetic Polynucleotide
taatacgactcactatagggctcccgggcccccgggccccgccgcccccgaacagaggagacgggggatgcggggcccgaacctggcggcagcgcaaaagatg

SEQ ID NO: 182493 - DNA, 103 bp, Artificial Sequence
  Synthetic Polynucleotide
taatacgactcactatagggccgggttcgcctcccgggcccccgggccccaacagaggagaggggccatggggcccgggaacctggcggcagcgcaaaagatg

SEQ ID NO: 182494 - DNA, 103 bp, Artificial Sequence
  Synthetic Polynucleotide
taatacgactcactatagggataggctgaagccaggctcgaggtgtccataacagaggagaatggacatgtcgagcctgaacctggcggcagcgcaaaagatg

SEQ ID NO: 182495 - DNA, 103 bp, Artificial Sequence
  Synthetic Polynucleotide
taatacgactcactataggggccgcccttgccgggttcgcctcccgggccaacagaggagaggcccgatgggcgaacccaacctggcggcagcgcaaaagatg

SEQ ID NO: 182496 - DNA, 103 bp, Artificial Sequence
  Synthetic Polynucleotide
taatacgactcactatagggctgctgctgcgccgcccttgccgggttcgcaacagaggagagcgaacatggcaagggcgaacctggcggcagcgcaaaagatg

SEQ ID NO: 182497 - DNA, 103 bp, Artificial Sequence
  Synthetic Polynucleotide
taatacgactcactataggggccgccgccgctgctgctgcgccgcccttgaacagaggagacaagggatgcgcagcagcaacctggcggcagcgcaaaagatg

SEQ ID NO: 182498 - DNA, 103 bp, Artificial Sequence
  Synthetic Polynucleotide
taatacgactcactatagggcgctgccgcggccgccgccgctgctgctgcaacagaggagagcagcaatggcggcggcgaacctggcggcagcgcaaaagatg

SEQ ID NO: 182499 - DNA, 103 bp, Artificial Sequence
  Synthetic Polynucleotide
taatacgactcactatagggccgccgccgccgctgccgcggccgccgccgaacagaggagacggcggatgccgcggcagaacctggcggcagcgcaaaagatg

SEQ ID NO: 182500 - DNA, 103 bp, Artificial Sequence
  Synthetic Polynucleotide
taatacgactcactataggggctgccgctgccgccgccgccgctgccgcgaacagaggagacgcggcatgggcggcggcaacctggcggcagcgcaaaagatg

SEQ ID NO: 182501 - DNA, 103 bp, Artificial Sequence
  Synthetic Polynucleotide
taatacgactcactatagggagctgccgccgctgccgctgccgccgccgcaacagaggagagcggcgatggcagcggcaaacctggcggcagcgcaaaagatg

SEQ ID NO: 182502 - DNA, 103 bp, Artificial Sequence
  Synthetic Polynucleotide
taatacgactcactatagggccaggcctccagctgccgccgctgccgctgaacagaggagacagcggatgcggcggcagaacctggcggcagcgcaaaagatg

SEQ ID NO: 182503 - DNA, 103 bp, Artificial Sequence
  Synthetic Polynucleotide
taatacgactcactatagggccagccgcagccaggcctccagctgccgccaacagaggagaggcggcatgtggaggcctaacctggcggcagcgcaaaagatg

SEQ ID NO: 182504 - DNA, 103 bp, Artificial Sequence
  Synthetic Polynucleotide
taatacgactcactatagggtccagggcccccagccgcagccaggcctccaacagaggagaggaggcatggctgcggctaacctggcggcagcgcaaaagatg

SEQ ID NO: 182505 - DNA, 103 bp, Artificial Sequence
  Synthetic Polynucleotide
taatacgactcactatagggtgaagtcagcataggctgaagccaggctcgaacagaggagacgagccatgcttcagcctaacctggcggcagcgcaaaagatg

SEQ ID NO: 182506 - DNA, 103 bp, Artificial Sequence
  Synthetic Polynucleotide
taatacgactcactatagggcccagccttgtccagggcccccagccgcagaacagaggagactgcggatgggggccctgaacctggcggcagcgcaaaagatg

SEQ ID NO: 182507 - DNA, 103 bp, Artificial Sequence
  Synthetic Polynucleotide
taatacgactcactataggggggccgggagcccagccttgtccagggcccaacagaggagagggcccatgacaaggctgaacctggcggcagcgcaaaagatg

SEQ ID NO: 182508 - DNA, 103 bp, Artificial Sequence
  Synthetic Polynucleotide
taatacgactcactataggggatggggccggggccgggagcccagccttgaacagaggagacaaggcatggctcccggcaacctggcggcagcgcaaaagatg

SEQ ID NO: 182509 - DNA, 103 bp, Artificial Sequence
  Synthetic Polynucleotide
taatacgactcactatagggggatggaggtgatggggccggggccgggagaacagaggagactcccgatgccggccccaaacctggcggcagcgcaaaagatg

SEQ ID NO: 182510 - DNA, 103 bp, Artificial Sequence
  Synthetic Polynucleotide
taatacgactcactatagggagcgaatccgggatggaggtgatggggccgaacagaggagacggcccatgcacctccataacctggcggcagcgcaaaagatg

SEQ ID NO: 182511 - DNA, 103 bp, Artificial Sequence
  Synthetic Polynucleotide
taatacgactcactataggggggacccccaagcgaatccgggatggaggtaacagaggagaacctccatgccggattcgaacctggcggcagcgcaaaagatg

SEQ ID NO: 182512 - DNA, 103 bp, Artificial Sequence
  Synthetic Polynucleotide
taatacgactcactatagggcgctggcgaagggacccccaagcgaatccgaacagaggagacggattatgttgggggtcaacctggcggcagcgcaaaagatg

SEQ ID NO: 182513 - DNA, 103 bp, Artificial Sequence
  Synthetic Polynucleotide
taatacgactcactataggggaagataggacgctggcgaagggacccccaaacagaggagatgggggatgcttcgccagaacctggcggcagcgcaaaagatg

SEQ ID NO: 182514 - DNA, 103 bp, Artificial Sequence
  Synthetic Polynucleotide
taatacgactcactatagggtctttggagcgaagataggacgctggcgaaaacagaggagattcgccatggtcctatctaacctggcggcagcgcaaaagatg

SEQ ID NO: 182515 - DNA, 103 bp, Artificial Sequence
  Synthetic Polynucleotide
taatacgactcactatagggcaccgttgggtctttggagcgaagataggaaacagaggagatcctatatgcgctccaaaaacctggcggcagcgcaaaagatg

SEQ ID NO: 182516 - DNA, 103 bp, Artificial Sequence
  Synthetic Polynucleotide
taatacgactcactatagggctgcaggaactgaagtcagcataggctgaaaacagaggagattcagcatgtgctgacttaacctggcggcagcgcaaaagatg

SEQ ID NO: 182517 - DNA, 103 bp, Artificial Sequence
  Synthetic Polynucleotide
taatacgactcactataggggcggctttggcaccgttgggtctttggagcaacagaggagagctccaatgacccaacggaacctggcggcagcgcaaaagatg

SEQ ID NO: 182518 - DNA, 103 bp, Artificial Sequence
  Synthetic Polynucleotide
taatacgactcactatagggcttcactaaggcggctttggcaccgttgggaacagaggagacccaacatggccaaagccaacctggcggcagcgcaaaagatg

SEQ ID NO: 182519 - DNA, 103 bp, Artificial Sequence
  Synthetic Polynucleotide
taatacgactcactatagggacatactgctcttcactaaggcggctttggaacagaggagaccaaagatgccttagtgaaacctggcggcagcgcaaaagatg

SEQ ID NO: 182520 - DNA, 103 bp, Artificial Sequence
  Synthetic Polynucleotide
taatacgactcactatagggccccattcccagcagcttcgggttcgccataacagaggagaatggcgatgccgaagctgaacctggcggcagcgcaaaagatg

SEQ ID NO: 182521 - DNA, 103 bp, Artificial Sequence
  Synthetic Polynucleotide
taatacgactcactatagggtgtctgggcttgctggagctccttcgaggcaacagaggagagcctcgatggagctccagaacctggcggcagcgcaaaagatg

SEQ ID NO: 182522 - DNA, 103 bp, Artificial Sequence
  Synthetic Polynucleotide
taatacgactcactatagggctggtctggttgtctgggcttgctggagctaacagaggagaagctccatgaagcccagaaacctggcggcagcgcaaaagatg

SEQ ID NO: 182523 - DNA, 103 bp, Artificial Sequence
  Synthetic Polynucleotide
taatacgactcactatagggtgtgtcgattctggtctggttgtctgggctaacagaggagaagcccaatgaaccagaccaacctggcggcagcgcaaaagatg

SEQ ID NO: 182524 - DNA, 103 bp, Artificial Sequence
  Synthetic Polynucleotide
taatacgactcactatagggaggctggatttgtgtcgattctggtctggtaacagaggagaaccagaatggaatcgacaaacctggcggcagcgcaaaagatg

SEQ ID NO: 182525 - DNA, 103 bp, Artificial Sequence
  Synthetic Polynucleotide
taatacgactcactatagggaaccaggctgaggctggatttgtgtcgattaacagaggagaaatcgaatgaaatccagcaacctggcggcagcgcaaaagatg

SEQ ID NO: 182526 - DNA, 103 bp, Artificial Sequence
  Synthetic Polynucleotide
taatacgactcactatagggtttatgcagaaaccaggctgaggctggattaacagaggagaaatccaatgtcagcctggaacctggcggcagcgcaaaagatg

SEQ ID NO: 182527 - DNA, 103 bp, Artificial Sequence
  Synthetic Polynucleotide
taatacgactcactatagggggagttggtctttatgcagaaaccaggctgaacagaggagacagcctatgttctgcataaacctggcggcagcgcaaaagatg

SEQ ID NO: 182528 - DNA, 103 bp, Artificial Sequence
  Synthetic Polynucleotide
taatacgactcactatagggtcccttccgaggagttggtctttatgcagaaacagaggagatctgcaatgagaccaactaacctggcggcagcgcaaaagatg

SEQ ID NO: 182529 - DNA, 103 bp, Artificial Sequence
  Synthetic Polynucleotide
taatacgactcactatagggatgaaaaccttcccttccgaggagttggtcaacagaggagagaccaaatgctcggaaggaacctggcggcagcgcaaaagatg

SEQ ID NO: 182530 - DNA, 103 bp, Artificial Sequence
  Synthetic Polynucleotide
taatacgactcactataggggcagatgttgatgaaaaccttcccttccgaaacagaggagatcggaaatgaaggttttcaacctggcggcagcgcaaaagatg

SEQ ID NO: 182531 - DNA, 103 bp, Artificial Sequence
  Synthetic Polynucleotide
taatacgactcactatagggcctcgcttagccccattcccagcagcttcgaacagaggagacgaagcatgtgggaatggaacctggcggcagcgcaaaagatg

SEQ ID NO: 182532 - DNA, 103 bp, Artificial Sequence
  Synthetic Polynucleotide
taatacgactcactatagggagggggagtggcagatgttgatgaaaacctaacagaggagaaggtttatgtcaacatctaacctggcggcagcgcaaaagatg

SEQ ID NO: 182533 - DNA, 103 bp, Artificial Sequence
  Synthetic Polynucleotide
taatacgactcactatagggggagggatagagggggagtggcagatgttgaacagaggagacaacatatgccactccccaacctggcggcagcgcaaaagatg

SEQ ID NO: 182534 - DNA, 103 bp, Artificial Sequence
  Synthetic Polynucleotide
taatacgactcactataggggtcggcgggaggagggatagagggggagtgaacagaggagacactccatgtctatccctaacctggcggcagcgcaaaagatg

SEQ ID NO: 182535 - DNA, 103 bp, Artificial Sequence
  Synthetic Polynucleotide
taatacgactcactatagggcctcggtcacgtcggcgggaggagggatagaacagaggagactatccatgctcccgccgaacctggcggcagcgcaaaagatg

SEQ ID NO: 182536 - DNA, 103 bp, Artificial Sequence
  Synthetic Polynucleotide
taatacgactcactatagggagcagctcctcctcggtcacgtcggcgggaaacagaggagatcccgcatgcgtgaccgaaacctggcggcagcgcaaaagatg

SEQ ID NO: 182537 - DNA, 103 bp, Artificial Sequence
  Synthetic Polynucleotide
taatacgactcactatagggtagcatctgaagcagctcctcctcggtcacaacagaggagagtgaccatggaggagctgaacctggcggcagcgcaaaagatg

SEQ ID NO: 182538 - DNA, 103 bp, Artificial Sequence
  Synthetic Polynucleotide
taatacgactcactatagggggtcctcctctagcatctgaagcagctcctaacagaggagaaggagcatgttcagatgcaacctggcggcagcgcaaaagatg

SEQ ID NO: 182539 - DNA, 103 bp, Artificial Sequence
  Synthetic Polynucleotide
taatacgactcactatagggaacccagcttggtcctcctctagcatctgaaacagaggagatcagatatgagaggaggaaacctggcggcagcgcaaaagatg

SEQ ID NO: 182540 - DNA, 103 bp, Artificial Sequence
  Synthetic Polynucleotide
taatacgactcactatagggggggatgcgaaacccagcttggtcctcctcaacagaggagagaggagatgcaagctgggaacctggcggcagcgcaaaagatg

SEQ ID NO: 182541 - DNA, 103 bp, Artificial Sequence
  Synthetic Polynucleotide
taatacgactcactatagggccagactcatggggatgcgaaacccagcttaacagaggagaaagctgatgttcgcatccaacctggcggcagcgcaaaagatg

SEQ ID NO: 182542 - DNA, 103 bp, Artificial Sequence
  Synthetic Polynucleotide
taatacgactcactatagggatcgcctccgcctcgcttagccccattcccaacagaggagagggaatatggctaagcgaaacctggcggcagcgcaaaagatg

SEQ ID NO: 182543 - DNA, 103 bp, Artificial Sequence
  Synthetic Polynucleotide
taatacgactcactatagggtgaggctctcccagactcatggggatgcgaaacagaggagatcgcatatgcatgagtctaacctggcggcagcgcaaaagatg

SEQ ID NO: 182544 - DNA, 103 bp, Artificial Sequence
  Synthetic Polynucleotide
taatacgactcactatagggcagttctgcatgaggctctcccagactcataacagaggagaatgagtatgggagagcctaacctggcggcagcgcaaaagatg

SEQ ID NO: 182545 - DNA, 103 bp, Artificial Sequence
  Synthetic Polynucleotide
taatacgactcactatagggcttttgcatccagttctgcatgaggctctcaacagaggagagagagcatgatgcagaacaacctggcggcagcgcaaaagatg

SEQ ID NO: 182546 - DNA, 103 bp, Artificial Sequence
  Synthetic Polynucleotide
taatacgactcactatagggcatccctggccttttgcatccagttctgcaaacagaggagatgcagaatgggatgcaaaaacctggcggcagcgcaaaagatg

SEQ ID NO: 182547 - DNA, 103 bp, Artificial Sequence
  Synthetic Polynucleotide
taatacgactcactataggggtaggcggtacatccctggccttttgcatcaacagaggagagatgcaatgggccagggaaacctggcggcagcgcaaaagatg

SEQ ID NO: 182548 - DNA, 103 bp, Artificial Sequence
  Synthetic Polynucleotide
taatacgactcactatagggcagctacgtcgtaggcggtacatccctggcaacagaggagagccaggatggtaccgcctaacctggcggcagcgcaaaagatg

SEQ ID NO: 182549 - DNA, 103 bp, Artificial Sequence
  Synthetic Polynucleotide
taatacgactcactatagggtcgctgttgacagctacgtcgtaggcggtaaacagaggagataccgcatgcgacgtagcaacctggcggcagcgcaaaagatg

SEQ ID NO: 182550 - DNA, 103 bp, Artificial Sequence
  Synthetic Polynucleotide
taatacgactcactatagggccggtagaagtcgctgttgacagctacgtcaacagaggagagacgtaatggtcaacagcaacctggcggcagcgcaaaagatg

SEQ ID NO: 182551 - DNA, 103 bp, Artificial Sequence
  Synthetic Polynucleotide
taatacgactcactatagggtctgcatcctccggtagaagtcgctgttgaaacagaggagatcaacaatgacttctaccaacctggcggcagcgcaaaagatg

SEQ ID NO: 182552 - DNA, 103 bp, Artificial Sequence
  Synthetic Polynucleotide
taatacgactcactatagggaaatcgctgttctgcatcctccggtagaagaacagaggagacttctaatggaggatgcaaacctggcggcagcgcaaaagatg

SEQ ID NO: 182553 - DNA, 103 bp, Artificial Sequence
  Synthetic Polynucleotide
taatacgactcactatagggatcagcaccgatcgcctccgcctcgcttagaacagaggagactaagcatggcggaggcgaacctggcggcagcgcaaaagatg

SEQ ID NO: 182554 - DNA, 103 bp, Artificial Sequence
  Synthetic Polynucleotide
taatacgactcactatagggctcccgcaagaaatcgctgttctgcatcctaacagaggagaaggatgatgaacagcgataacctggcggcagcgcaaaagatg

SEQ ID NO: 182555 - DNA, 103 bp, Artificial Sequence
  Synthetic Polynucleotide
taatacgactcactatagggtgatcacgagctcccgcaagaaatcgctgtaacagaggagaacagcgatgtcttgcgggaacctggcggcagcgcaaaagatg

SEQ ID NO: 182556 - DNA, 103 bp, Artificial Sequence
  Synthetic Polynucleotide
taatacgactcactatagggctggcgatggtgatcacgagctcccgcaagaacagaggagacttgcgatggctcgtgataacctggcggcagcgcaaaagatg

SEQ ID NO: 182557 - DNA, 103 bp, Artificial Sequence
  Synthetic Polynucleotide
taatacgactcactatagggaaggccctccctggcgatggtgatcacgagaacagaggagactcgtgatgaccatcgccaacctggcggcagcgcaaaagatg

SEQ ID NO: 182558 - DNA, 103 bp, Artificial Sequence
  Synthetic Polynucleotide
taatacgactcactatagggatttgtcctcaaggccctccctggcgatggaacagaggagaccatcgatggggagggccaacctggcggcagcgcaaaagatg

SEQ ID NO: 182559 - DNA, 103 bp, Artificial Sequence
  Synthetic Polynucleotide
taatacgactcactatagggtgcaagttgtatttgtcctcaaggccctccaacagaggagaggagggatgtgaggacaaaacctggcggcagcgcaaaagatg

SEQ ID NO: 182560 - DNA, 103 bp, Artificial Sequence
  Synthetic Polynucleotide
taatacgactcactatagggcggattcagctgcaagttgtatttgtcctcaacagaggagagaggacatgtacaacttgaacctggcggcagcgcaaaagatg

SEQ ID NO: 182561 - DNA, 103 bp, Artificial Sequence
  Synthetic Polynucleotide
taatacgactcactatagggtgcgccattccggattcagctgcaagttgtaacagaggagaacaactatgagctgaatcaacctggcggcagcgcaaaagatg

SEQ ID NO: 182562 - DNA, 103 bp, Artificial Sequence
  Synthetic Polynucleotide
taatacgactcactatagggttcttcatcatgcgccattccggattcagcaacagaggagagctgaaatgggaatggcgaacctggcggcagcgcaaaagatg

SEQ ID NO: 182563 - DNA, 103 bp, Artificial Sequence
  Synthetic Polynucleotide
taatacgactcactataggggaatggccggttcttcatcatgcgccattcaacagaggagagaatggatgatgatgaagaacctggcggcagcgcaaaagatg

SEQ ID NO: 182564 - DNA, 103 bp, Artificial Sequence
  Synthetic Polynucleotide
taatacgactcactatagggatcgcgccgaatcagcaccgatcgcctccgaacagaggagacggaggatgtcggtgctgaacctggcggcagcgcaaaagatg

SEQ ID NO: 182565 - DNA, 103 bp, Artificial Sequence
  Synthetic Polynucleotide
taatacgactcactatagggtggagcccatgaatggccggttcttcatcaaacagaggagatgatgaatgaccggccataacctggcggcagcgcaaaagatg

SEQ ID NO: 182566 - DNA, 103 bp, Artificial Sequence
  Synthetic Polynucleotide
taatacgactcactatagggtgctgcgagatggagcccatgaatggccggaacagaggagaccggccatgcatgggctcaacctggcggcagcgcaaaagatg

SEQ ID NO: 182567 - DNA, 103 bp, Artificial Sequence
  Synthetic Polynucleotide
taatacgactcactataggggcggatgttctgctgcgagatggagcccataacagaggagaatgggcatgatctcgcagaacctggcggcagcgcaaaagatg

SEQ ID NO: 182568 - DNA, 103 bp, Artificial Sequence
  Synthetic Polynucleotide
taatacgactcactataggggctgctccgagcggatgttctgctgcgagaaacagaggagatctcgcatgagaacatccaacctggcggcagcgcaaaagatg

SEQ ID NO: 182569 - DNA, 103 bp, Artificial Sequence
  Synthetic Polynucleotide
taatacgactcactatagggatccgaggacgctgctccgagcggatgttcaacagaggagagaacatatgctcggagcaaacctggcggcagcgcaaaagatg

SEQ ID NO: 182570 - DNA, 103 bp, Artificial Sequence
  Synthetic Polynucleotide
taatacgactcactatagggcagctcctggatccgaggacgctgctccgaaacagaggagatcggagatgcgtcctcggaacctggcggcagcgcaaaagatg

SEQ ID NO: 182571 - DNA, 103 bp, Artificial Sequence
  Synthetic Polynucleotide
taatacgactcactatagggacaggtcccccagctcctggatccgaggacaacagaggagagtcctcatgtccaggagcaacctggcggcagcgcaaaagatg

SEQ ID NO: 182572 - DNA, 103 bp, Artificial Sequence
  Synthetic Polynucleotide
taatacgactcactataggggcgggcgtgtacaggtcccccagctcctggaacagaggagaccaggaatggggggacctaacctggcggcagcgcaaaagatg

SEQ ID NO: 182573 - DNA, 103 bp, Artificial Sequence
  Synthetic Polynucleotide
taatacgactcactatagggtctcccgggggcgggcgtgtacaggtccccaacagaggagaggggacatgtacacgcccaacctggcggcagcgcaaaagatg

SEQ ID NO: 182574 - DNA, 103 bp, Artificial Sequence
  Synthetic Polynucleotide
taatacgactcactatagggctgactcagctctcccgggggcgggcgtgtaacagaggagaacacgcatgcccccgggaaacctggcggcagcgcaaaagatg

SEQ ID NO: 182575 - DNA, 103 bp, Artificial Sequence
  Synthetic Polynucleotide
taatacgactcactatagggagctcctcaaatcgcgccgaatcagcaccgaacagaggagacggtgcatgttcggcgcgaacctggcggcagcgcaaaagatg

SEQ ID NO: 182576 - DNA, 103 bp, Artificial Sequence
  Synthetic Polynucleotide
taatacgactcactatagggttttcaggccctgactcagctctcccggggaacagaggagaccccggatgagctgagtcaacctggcggcagcgcaaaagatg

SEQ ID NO: 182577 - DNA, 103 bp, Artificial Sequence
  Synthetic Polynucleotide
taatacgactcactatagggcaggtgaggcttttcaggccctgactcagcaacagaggagagctgagatggggcctgaaaacctggcggcagcgcaaaagatg

SEQ ID NO: 182578 - DNA, 103 bp, Artificial Sequence
  Synthetic Polynucleotide
taatacgactcactataggggccacaggttcaggtgaggcttttcaggccaacagaggagaggcctgatgagcctcaccaacctggcggcagcgcaaaagatg

SEQ ID NO: 182579 - DNA, 103 bp, Artificial Sequence
  Synthetic Polynucleotide
taatacgactcactatagggggggcttccagccacaggttcaggtgaggcaacagaggagagcctcaatggaacctgtgaacctggcggcagcgcaaaagatg

SEQ ID NO: 182580 - DNA, 103 bp, Artificial Sequence
  Synthetic Polynucleotide
taatacgactcactataggggaggaggtcgggggcttccagccacaggttaacagaggagaaacctgatgctggaagccaacctggcggcagcgcaaaagatg

SEQ ID NO: 182581 - DNA, 103 bp, Artificial Sequence
  Synthetic Polynucleotide
taatacgactcactatagggcttcggccaagaggaggtcgggggcttccaaacagaggagatggaagatgccgacctccaacctggcggcagcgcaaaagatg

SEQ ID NO: 182582 - DNA, 103 bp, Artificial Sequence
  Synthetic Polynucleotide
taatacgactcactataggggggaggtcaacttcggccaagaggaggtcgaacagaggagacgacctatgcttggccgaaacctggcggcagcgcaaaagatg

SEQ ID NO: 182583 - DNA, 103 bp, Artificial Sequence
  Synthetic Polynucleotide
taatacgactcactatagggatccagtttggggaggtcaacttcggccaaaacagaggagattggccatggttgacctcaacctggcggcagcgcaaaagatg

SEQ ID NO: 182584 - DNA, 103 bp, Artificial Sequence
  Synthetic Polynucleotide
taatacgactcactatagggccagggctccatccagtttggggaggtcaaaacagaggagattgaccatgccaaactggaacctggcggcagcgcaaaagatg

SEQ ID NO: 182585 - DNA, 103 bp, Artificial Sequence
  Synthetic Polynucleotide
taatacgactcactatagggagcgacagccccagggctccatccagtttgaacagaggagacaaactatgtggagccctaacctggcggcagcgcaaaagatg

SEQ ID NO: 182586 - DNA, 103 bp, Artificial Sequence
  Synthetic Polynucleotide
taatacgactcactatagggctgcagcagcagctcctcaaatcgcgccgaaacagaggagatcggcgatgtttgaggagaacctggcggcagcgcaaaagatg

SEQ ID NO: 182587 - DNA, 103 bp, Artificial Sequence
  Synthetic Polynucleotide
taatacgactcactatagggcccgatctccagcgacagccccagggctccaacagaggagaggagccatggggctgtcgaacctggcggcagcgcaaaagatg

SEQ ID NO: 182588 - DNA, 103 bp, Artificial Sequence
  Synthetic Polynucleotide
taatacgactcactatagggggcggttctccccgatctccagcgacagccaacagaggagaggctgtatgtggagatcgaacctggcggcagcgcaaaagatg

SEQ ID NO: 182589 - DNA, 103 bp, Artificial Sequence
  Synthetic Polynucleotide
taatacgactcactatagggcccatcaccaggcggttctccccgatctccaacagaggagaggagatatgggagaaccgaacctggcggcagcgcaaaagatg

SEQ ID NO: 182590 - DNA, 103 bp, Artificial Sequence
  Synthetic Polynucleotide
taatacgactcactatagggctgggggccccccatcaccaggcggttctcaacagaggagagagaacatgctggtgatgaacctggcggcagcgcaaaagatg

SEQ ID NO: 182591 - DNA, 103 bp, Artificial Sequence
  Synthetic Polynucleotide
taatacgactcactataggggatacagctgctgggggccccccatcaccaaacagaggagatggtgaatgggggcccccaacctggcggcagcgcaaaagatg

SEQ ID NO: 182592 - DNA, 103 bp, Artificial Sequence
  Synthetic Polynucleotide
taatacgactcactataggggcgtctagatgatacagctgctgggggcccaacagaggagagggcccatggcagctgtaaacctggcggcagcgcaaaagatg

SEQ ID NO: 182593 - DNA, 103 bp, Artificial Sequence
  Synthetic Polynucleotide
taatacgactcactatagggcgggatataagcgtctagatgatacagctgaacagaggagacagctgatgcatctagacaacctggcggcagcgcaaaagatg

SEQ ID NO: 182594 - DNA, 103 bp, Artificial Sequence
  Synthetic Polynucleotide
taatacgactcactatagggtgatctgcagcgggatataagcgtctagataacagaggagaatctagatgcttatatccaacctggcggcagcgcaaaagatg

SEQ ID NO: 182595 - DNA, 103 bp, Artificial Sequence
  Synthetic Polynucleotide
taatacgactcactatagggtcatgagagttgatctgcagcgggatataaaacagaggagattatatatggctgcagataacctggcggcagcgcaaaagatg

SEQ ID NO: 182596 - DNA, 103 bp, Artificial Sequence
  Synthetic Polynucleotide
taatacgactcactatagggtgccttgctctcatgagagttgatctgcagaacagaggagactgcagatgaactctcataacctggcggcagcgcaaaagatg

SEQ ID NO: 182597 - DNA, 103 bp, Artificial Sequence
  Synthetic Polynucleotide
taatacgactcactatagggccttcgaggcctgcagcagcagctcctcaaaacagaggagattgaggatgtgctgctgcaacctggcggcagcgcaaaagatg

SEQ ID NO: 182598 - DNA, 103 bp, Artificial Sequence
  Synthetic Polynucleotide
taatacgactcactatagggggtggaaggctgccttgctctcatgagagtaacagaggagaactctcatgagagcaaggaacctggcggcagcgcaaaagatg

SEQ ID NO: 182599 - DNA, 103 bp, Artificial Sequence
  Synthetic Polynucleotide
taatacgactcactatagggtttctcttccggtggaaggctgccttgctcaacagaggagagagcaaatgagccttccaaacctggcggcagcgcaaaagatg

SEQ ID NO: 182600 - DNA, 103 bp, Artificial Sequence
  Synthetic Polynucleotide
taatacgactcactatagggcattaattgctttctcttccggtggaaggcaacagaggagagccttcatgcggaagagaaacctggcggcagcgcaaaagatg

SEQ ID NO: 182601 - DNA, 103 bp, Artificial Sequence
  Synthetic Polynucleotide
taatacgactcactataggggcatggccaccattaattgctttctcttccaacagaggagaggaagaatgagcaattaaaacctggcggcagcgcaaaagatg

SEQ ID NO: 182602 - DNA, 103 bp, Artificial Sequence
  Synthetic Polynucleotide
taatacgactcactatagggggcagaagcggcatggccaccattaattgcaacagaggagagcaattatgggtggccataacctggcggcagcgcaaaagatg

SEQ ID NO: 182603 - DNA, 103 bp, Artificial Sequence
  Synthetic Polynucleotide
taatacgactcactatagggagaaggcaccggcagaagcggcatggccacaacagaggagagtggccatgccgcttctgaacctggcggcagcgcaaaagatg

SEQ ID NO: 182604 - DNA, 103 bp, Artificial Sequence
  Synthetic Polynucleotide
taatacgactcactatagggtgctggagctccttcgaggcctgcagcagcaacagaggagagctgctatgggcctcgaaaacctggcggcagcgcaaaagatg

SEQ ID NO: 182605 - DNA, 103 bp, Artificial Sequence
  Synthetic Polynucleotide
taatacgactcactatagggcaggctcatgccccccttgaaggcgtccataacagaggagaatggacatgttcaaggggaacctggcggcagcgcaaaagatg

SEQ ID NO: 182606 - DNA, 103 bp, Artificial Sequence
  Synthetic Polynucleotide
taatacgactcactataggggcgggggtcggcgggccgggccaggtggaaaacagaggagattccacatggcccggcccaacctggcggcagcgcaaaagatg

SEQ ID NO: 182607 - DNA, 103 bp, Artificial Sequence
  Synthetic Polynucleotide
taatacgactcactatagggcgagcggctcgcgggggtcggcgggccgggaacagaggagacccggcatgccgacccccaacctggcggcagcgcaaaagatg

SEQ ID NO: 182608 - DNA, 103 bp, Artificial Sequence
  Synthetic Polynucleotide
taatacgactcactataggggcggagttctcgagcggctcgcgggggtcgaacagaggagacgacccatgcgagccgctaacctggcggcagcgcaaaagatg

SEQ ID NO: 182609 - DNA, 103 bp, Artificial Sequence
  Synthetic Polynucleotide
taatacgactcactatagggcgactcgctggcggagttctcgagcggctcaacagaggagagagccgatggagaactccaacctggcggcagcgcaaaagatg

SEQ ID NO: 182610 - DNA, 103 bp, Artificial Sequence
  Synthetic Polynucleotide
taatacgactcactatagggccgtgtcagacgactcgctggcggagttctaacagaggagaagaactatgccagcgagtaacctggcggcagcgcaaaagatg

SEQ ID NO: 182611 - DNA, 103 bp, Artificial Sequence
  Synthetic Polynucleotide
taatacgactcactatagggtctggcagctccgtgtcagacgactcgctgaacagaggagacagcgaatggtctgacacaacctggcggcagcgcaaaagatg

SEQ ID NO: 182612 - DNA, 103 bp, Artificial Sequence
  Synthetic Polynucleotide
taatacgactcactataggggcgctccttctctggcagctccgtgtcagaaacagaggagatctgacatggagctgccaaacctggcggcagcgcaaaagatg

SEQ ID NO: 182613 - DNA, 103 bp, Artificial Sequence
  Synthetic Polynucleotide
taatacgactcactataggggttccccgccgcgctccttctctggcagctaacagaggagaagctgcatgagaaggagcaacctggcggcagcgcaaaagatg

SEQ ID NO: 182614 - DNA, 103 bp, Artificial Sequence
  Synthetic Polynucleotide
taatacgactcactatagggggccccttgggttccccgccgcgctccttcaacagaggagagaaggaatgcggcggggaaacctggcggcagcgcaaaagatg

SEQ ID NO: 182615 - DNA, 103 bp, Artificial Sequence
  Synthetic Polynucleotide
taatacgactcactatagggactgtcctcgggccccttgggttccccgccaacagaggagaggcgggatgcccaaggggaacctggcggcagcgcaaaagatg

SEQ ID NO: 182616 - DNA, 103 bp, Artificial Sequence
  Synthetic Polynucleotide
taatacgactcactataggggcagccgctccaggctcatgccccccttgaaacagaggagatcaaggatggcatgagccaacctggcggcagcgcaaaagatg

SEQ ID NO: 182617 - DNA, 103 bp, Artificial Sequence
  Synthetic Polynucleotide
taatacgactcactatagggctcccgcaccactgtcctcgggccccttggaacagaggagaccaaggatgccgaggacaaacctggcggcagcgcaaaagatg

SEQ ID NO: 182618 - DNA, 103 bp, Artificial Sequence
  Synthetic Polynucleotide
taatacgactcactatagggcagcccgtgcctcccgcaccactgtcctcgaacagaggagacgaggaatgtggtgcgggaacctggcggcagcgcaaaagatg

SEQ ID NO: 182619 - DNA, 103 bp, Artificial Sequence
  Synthetic Polynucleotide
taatacgactcactatagggtgcgccgccgcagcccgtgcctcccgcaccaacagaggagaggtgcgatgggcacgggcaacctggcggcagcgcaaaagatg

SEQ ID NO: 182620 - DNA, 103 bp, Artificial Sequence
  Synthetic Polynucleotide
taatacgactcactatagggctgggtcgtctgcgccgccgcagcccgtgcaacagaggagagcacggatggcggcggcgaacctggcggcagcgcaaaagatg

SEQ ID NO: 182621 - DNA, 103 bp, Artificial Sequence
  Synthetic Polynucleotide
taatacgactcactatagggttcttcttggctgggtcgtctgcgccgccgaacagaggagacggcggatgagacgacccaacctggcggcagcgcaaaagatg

SEQ ID NO: 182622 - DNA, 103 bp, Artificial Sequence
  Synthetic Polynucleotide
taatacgactcactatagggccgctgcttcttcttcttggctgggtcgtcaacagaggagagacgacatggccaagaagaacctggcggcagcgcaaaagatg

SEQ ID NO: 182623 - DNA, 103 bp, Artificial Sequence
  Synthetic Polynucleotide
taatacgactcactatagggtacgttgccgccgctgcttcttcttcttggaacagaggagaccaagaatgagaagcagcaacctggcggcagcgcaaaagatg

SEQ ID NO: 182624 - DNA, 103 bp, Artificial Sequence
  Synthetic Polynucleotide
taatacgactcactataggggtgaagtgcgtacgttgccgccgctgcttcaacagaggagagaagcaatggcggcaacgaacctggcggcagcgcaaaagatg

SEQ ID NO: 182625 - DNA, 103 bp, Artificial Sequence
  Synthetic Polynucleotide
taatacgactcactatagggctgctggcttgtgaagtgcgtacgttgccgaacagaggagacggcaaatgacgcacttcaacctggcggcagcgcaaaagatg

SEQ ID NO: 182626 - DNA, 103 bp, Artificial Sequence
  Synthetic Polynucleotide
taatacgactcactataggggctcttgcaactgctggcttgtgaagtgcgaacagaggagacgcactatgcaagccagcaacctggcggcagcgcaaaagatg

SEQ ID NO: 182627 - DNA, 103 bp, Artificial Sequence
  Synthetic Polynucleotide
taatacgactcactatagggagcccctccggcagccgctccaggctcatgaacagaggagacatgagatgggagcggctaacctggcggcagcgcaaaagatg

SEQ ID NO: 182628 - DNA, 103 bp, Artificial Sequence
  Synthetic Polynucleotide
taatacgactcactataggggtggcctctagctcttgcaactgctggcttaacagaggagaaagccaatggttgcaagaaacctggcggcagcgcaaaagatg

SEQ ID NO: 182629 - DNA, 103 bp, Artificial Sequence
  Synthetic Polynucleotide
taatacgactcactatagggcctctggaacgtggcctctagctcttgcaaaacagaggagattgcaaatgctagaggccaacctggcggcagcgcaaaagatg

SEQ ID NO: 182630 - DNA, 103 bp, Artificial Sequence
  Synthetic Polynucleotide
taatacgactcactatagggggtagcggttcctctggaacgtggcctctaaacagaggagatagaggatgcgttccagaaacctggcggcagcgcaaaagatg

SEQ ID NO: 182631 - DNA, 103 bp, Artificial Sequence
  Synthetic Polynucleotide
taatacgactcactatagggctcatgtcggggtagcggttcctctggaacaacagaggagagttccaatggaaccgctaaacctggcggcagcgcaaaagatg

SEQ ID NO: 182632 - DNA, 103 bp, Artificial Sequence
  Synthetic Polynucleotide
taatacgactcactatagggctccctcatgctcatgtcggggtagcggttaacagaggagaaaccgcatgcccgacatgaacctggcggcagcgcaaaagatg

SEQ ID NO: 182633 - DNA, 103 bp, Artificial Sequence
  Synthetic Polynucleotide
taatacgactcactatagggcggcgatctcctccctcatgctcatgtcggaacagaggagaccgacaatggcatgagggaacctggcggcagcgcaaaagatg

SEQ ID NO: 182634 - DNA, 103 bp, Artificial Sequence
  Synthetic Polynucleotide
taatacgactcactatagggttggtccacacggcgatctcctccctcatgaacagaggagacatgagatgggagatcgcaacctggcggcagcgcaaaagatg

SEQ ID NO: 182635 - DNA, 103 bp, Artificial Sequence
  Synthetic Polynucleotide
taatacgactcactatagggctcggtgaggttggtccacacggcgatctcaacagaggagagagatcatggtgtggaccaacctggcggcagcgcaaaagatg

SEQ ID NO: 182636 - DNA, 103 bp, Artificial Sequence
  Synthetic Polynucleotide
taatacgactcactataggggcacgcgcggctcggtgaggttggtccacaaacagaggagatgtggaatgacctcaccgaacctggcggcagcgcaaaagatg

SEQ ID NO: 182637 - DNA, 103 bp, Artificial Sequence
  Synthetic Polynucleotide
taatacgactcactatagggaaccagacccgcacgcgcggctcggtgaggaacagaggagacctcacatggccgcgcgtaacctggcggcagcgcaaaagatg

SEQ ID NO: 182638 - DNA, 103 bp, Artificial Sequence
  Synthetic Polynucleotide
taatacgactcactatagggcggcggccggagcccctccggcagccgctcaacagaggagagagcggatgccggaggggaacctggcggcagcgcaaaagatg

SEQ ID NO: 182639 - DNA, 103 bp, Artificial Sequence
  Synthetic Polynucleotide
taatacgactcactatagggccggttcttgaaccagacccgcacgcgcggaacagaggagaccgcgcatgcgggtctggaacctggcggcagcgcaaaagatg

SEQ ID NO: 182640 - DNA, 103 bp, Artificial Sequence
  Synthetic Polynucleotide
taatacgactcactatagggacttggctcgccggttcttgaaccagacccaacagaggagagggtctatgtcaagaaccaacctggcggcagcgcaaaagatg

SEQ ID NO: 182641 - DNA, 103 bp, Artificial Sequence
  Synthetic Polynucleotide
taatacgactcactatagggcgcttacgccacttggctcgccggttcttgaacagaggagacaagaaatggcgagccaaaacctggcggcagcgcaaaagatg

SEQ ID NO: 182642 - DNA, 103 bp, Artificial Sequence
  Synthetic Polynucleotide
taatacgactcactataggggttacgctcgcgcttacgccacttggctcgaacagaggagacgagccatgtggcgtaagaacctggcggcagcgcaaaagatg

SEQ ID NO: 182643 - DNA, 103 bp, Artificial Sequence
  Synthetic Polynucleotide
taatacgactcactatagggccagctgctggttacgctcgcgcttacgccaacagaggagaggcgtaatggcgagcgtaaacctggcggcagcgcaaaagatg

SEQ ID NO: 182644 - DNA, 103 bp, Artificial Sequence
  Synthetic Polynucleotide
taatacgactcactatagggttgcacaggtccagctgctggttacgctcgaacagaggagacgagcgatgccagcagctaacctggcggcagcgcaaaagatg

SEQ ID NO: 182645 - DNA, 103 bp, Artificial Sequence
  Synthetic Polynucleotide
taatacgactcactataggggtagccacccttgcacaggtccagctgctgaacagaggagacagcagatggacctgtgcaacctggcggcagcgcaaaagatg

SEQ ID NO: 182646 - DNA, 103 bp, Artificial Sequence
  Synthetic Polynucleotide
taatacgactcactatagggactgcggcacgtagccacccttgcacaggtaacagaggagaacctgtatgagggtggctaacctggcggcagcgcaaaagatg

SEQ ID NO: 182647 - DNA, 103 bp, Artificial Sequence
  Synthetic Polynucleotide
taatacgactcactatagggaggccgctgaactgcggcacgtagccacccaacagaggagagggtggatgcgtgccgcaaacctggcggcagcgcaaaagatg

SEQ ID NO: 182648 - DNA, 103 bp, Artificial Sequence
  Synthetic Polynucleotide
taatacgactcactataggggggctgcactaggccgctgaactgcggcacaacagaggagagtgccgatgttcagcggcaacctggcggcagcgcaaaagatg

SEQ ID NO: 182649 - DNA, 103 bp, Artificial Sequence
  Synthetic Polynucleotide
taatacgactcactataggggtggcggcggcggcggccggagcccctccgaacagaggagacggaggatgtccggccgcaacctggcggcagcgcaaaagatg

SEQ ID NO: 182650 - DNA, 103 bp, Artificial Sequence
  Synthetic Polynucleotide
taatacgactcactatagggcgtcctcgtagggctgcactaggccgctgaaacagaggagatcagcgatgtagtgcagcaacctggcggcagcgcaaaagatg

SEQ ID NO: 182651 - DNA, 103 bp, Artificial Sequence
  Synthetic Polynucleotide
taatacgactcactataggggcggcgtacacgtcctcgtagggctgcactaacagaggagaagtgcaatgctacgaggaaacctggcggcagcgcaaaagatg

SEQ ID NO: 182652 - DNA, 103 bp, Artificial Sequence
  Synthetic Polynucleotide
taatacgactcactatagggggagtagccggcggcgtacacgtcctcgtaaacagaggagatacgagatggtgtacgccaacctggcggcagcgcaaaagatg

SEQ ID NO: 182653 - DNA, 103 bp, Artificial Sequence
  Synthetic Polynucleotide
taatacgactcactatagggagttgttgtaggagtagccggcggcgtacaaacagaggagatgtacgatgccggctactaacctggcggcagcgcaaaagatg

SEQ ID NO: 182654 - DNA, 103 bp, Artificial Sequence
  Synthetic Polynucleotide
taatacgactcactatagggttggcggcccagttgttgtaggagtagccgaacagaggagacggctaatgctacaacaaaacctggcggcagcgcaaaagatg

SEQ ID NO: 182655 - DNA, 103 bp, Artificial Sequence
  Synthetic Polynucleotide
taatacgactcactatagggcgccaggctcttggcggcccagttgttgtaaacagaggagatacaacatgtgggccgccaacctggcggcagcgcaaaagatg

SEQ ID NO: 182656 - DNA, 103 bp, Artificial Sequence
  Synthetic Polynucleotide
taatacgactcactataggggcggcgctggcgccaggctcttggcggcccaacagaggagagggccgatgagagcctggaacctggcggcagcgcaaaagatg

SEQ ID NO: 182657 - DNA, 103 bp, Artificial Sequence
  Synthetic Polynucleotide
taatacgactcactatagggttggtggagagcggcgctggcgccaggctcaacagaggagagagcctatggccagcgccaacctggcggcagcgcaaaagatg

SEQ ID NO: 182658 - DNA, 103 bp, Artificial Sequence
  Synthetic Polynucleotide
taatacgactcactatagggggtgaagctcttggtggagagcggcgctggaacagaggagaccagcgatgctctccaccaacctggcggcagcgcaaaagatg

SEQ ID NO: 182659 - DNA, 103 bp, Artificial Sequence
  Synthetic Polynucleotide
taatacgactcactatagggagttgaagaaggtgaagctcttggtggagaaacagaggagatctccaatgagagcttcaaacctggcggcagcgcaaaagatg

SEQ ID NO: 182660 - DNA, 103 bp, Artificial Sequence
  Synthetic Polynucleotide
taatacgactcactatagggatgtcatggggtggcggcggcggcggccggaacagaggagaccggccatggccgccgccaacctggcggcagcgcaaaagatg

SEQ ID NO: 182661 - DNA, 103 bp, Artificial Sequence
  Synthetic Polynucleotide
taatacgactcactataggggggctcatggagttgaagaaggtgaagctcaacagaggagagagcttatgcttcttcaaaacctggcggcagcgcaaaagatg

SEQ ID NO: 182662 - DNA, 103 bp, Artificial Sequence
  Synthetic Polynucleotide
taatacgactcactatagggcgacgacagcgggctcatggagttgaagaaaacagaggagattcttcatgtccatgagcaacctggcggcagcgcaaaagatg

SEQ ID NO: 182663 - DNA, 103 bp, Artificial Sequence
  Synthetic Polynucleotide
taatacgactcactatagggacatggactgcgacgacagcgggctcatggaacagaggagaccatgaatgcgctgtcgtaacctggcggcagcgcaaaagatg

SEQ ID NO: 182664 - DNA, 103 bp, Artificial Sequence
  Synthetic Polynucleotide
taatacgactcactatagggggtgctgagaacatggactgcgacgacagcaacagaggagagctgtcatggcagtccataacctggcggcagcgcaaaagatg

SEQ ID NO: 182665 - DNA, 103 bp, Artificial Sequence
  Synthetic Polynucleotide
taatacgactcactataggggatggagctgggtgctgagaacatggactgaacagaggagacagtccatgttctcagcaaacctggcggcagcgcaaaagatg

SEQ ID NO: 182666 - DNA, 103 bp, Artificial Sequence
  Synthetic Polynucleotide
taatacgactcactatagggtcatggaggagatggagctgggtgctgagaaacagaggagatctcagatgccagctccaaacctggcggcagcgcaaaagatg

SEQ ID NO: 182667 - DNA, 103 bp, Artificial Sequence
  Synthetic Polynucleotide
taatacgactcactataggggacggcatggtcatggaggagatggagctgaacagaggagacagctcatgctcctccataacctggcggcagcgcaaaagatg

SEQ ID NO: 182668 - DNA, 103 bp, Artificial Sequence
  Synthetic Polynucleotide
taatacgactcactataggggcccatgctggacggcatggtcatggaggaaacagaggagatcctccatgaccatgccgaacctggcggcagcgcaaaagatg

SEQ ID NO: 182669 - DNA, 103 bp, Artificial Sequence
  Synthetic Polynucleotide
taatacgactcactatagggcggcgcctgggcccatgctggacggcatggaacagaggagaccatgcatgccagcatggaacctggcggcagcgcaaaagatg

SEQ ID NO: 182670 - DNA, 103 bp, Artificial Sequence
  Synthetic Polynucleotide
taatacgactcactatagggatgccaggcacggcgcctgggcccatgctgaacagaggagacagcatatgcccaggcgcaacctggcggcagcgcaaaagatg

SEQ ID NO: 182671 - DNA, 103 bp, Artificial Sequence
  Synthetic Polynucleotide
taatacgactcactatagggggcgggccccatgtcatggggtggcggcggaacagaggagaccgccgatgccccatgacaacctggcggcagcgcaaaagatg

SEQ ID NO: 182672 - DNA, 103 bp, Artificial Sequence
  Synthetic Polynucleotide
taatacgactcactatagggcgagttgggcatgccaggcacggcgcctggaacagaggagaccaggcatggtgcctggcaacctggcggcagcgcaaaagatg

SEQ ID NO: 182673 - DNA, 103 bp, Artificial Sequence
  Synthetic Polynucleotide
taatacgactcactatagggtgttgaggcccgagttgggcatgccaggcaaacagaggagatgcctgatgtgcccaactaacctggcggcagcgcaaaagatg

SEQ ID NO: 182674 - DNA, 103 bp, Artificial Sequence
  Synthetic Polynucleotide
taatacgactcactatagggttgttgatgttgttgaggcccgagttgggcaacagaggagagcccaaatggggcctcaaaacctggcggcagcgcaaaagatg

SEQ ID NO: 182675 - DNA, 103 bp, Artificial Sequence
  Synthetic Polynucleotide
taatacgactcactataggggccggtgaggttgttgatgttgttgaggccaacagaggagaggcctcatgaacatcaacaacctggcggcagcgcaaaagatg

SEQ ID NO: 182676 - DNA, 103 bp, Artificial Sequence
  Synthetic Polynucleotide
taatacgactcactatagggtgagcgaggagccggtgaggttgttgatgtaacagaggagaacatcaatgacctcaccgaacctggcggcagcgcaaaagatg

SEQ ID NO: 182677 - DNA, 103 bp, Artificial Sequence
  Synthetic Polynucleotide
taatacgactcactatagggatggccgagttgagcgaggagccggtgaggaacagaggagacctcacatgctcctcgctaacctggcggcagcgcaaaagatg

SEQ ID NO: 182678 - DNA, 103 bp, Artificial Sequence
  Synthetic Polynucleotide
taatacgactcactataggggcccggcgacatggccgagttgagcgaggaaacagaggagatcctcgatgaactcggccaacctggcggcagcgcaaaagatg

SEQ ID NO: 182679 - DNA, 103 bp, Artificial Sequence
  Synthetic Polynucleotide
taatacgactcactatagggacgggcaagcgcccggcgacatggccgagtaacagaggagaactcggatgtgtcgccggaacctggcggcagcgcaaaagatg

SEQ ID NO: 182680 - DNA, 103 bp, Artificial Sequence
  Synthetic Polynucleotide
taatacgactcactatagggggagtgccgtacgggcaagcgcccggcgacaacagaggagagtcgccatgcgcttgcccaacctggcggcagcgcaaaagatg

SEQ ID NO: 182681 - DNA, 103 bp, Artificial Sequence
  Synthetic Polynucleotide
taatacgactcactataggggggcgaggcgggagtgccgtacgggcaagcaacagaggagagcttgcatgtacggcactaacctggcggcagcgcaaaagatg

SEQ ID NO: 182682 - DNA, 103 bp, Artificial Sequence
  Synthetic Polynucleotide
taatacgactcactatagggccaggtggaaggcgggccccatgtcatgggaacagaggagacccatgatgtggggcccgaacctggcggcagcgcaaaagatg

SEQ ID NO: 182683 - DNA, 103 bp, Artificial Sequence
  Synthetic Polynucleotide
taatacgactcactatagggagacgctgtagggcgaggcgggagtgccgtaacagaggagaacggcaatgccgcctcgcaacctggcggcagcgcaaaagatg

SEQ ID NO: 182684 - DNA, 103 bp, Artificial Sequence
  Synthetic Polynucleotide
taatacgactcactataggggtgtcccggtagacgctgtagggcgaggcgaacagaggagacgcctcatgctacagcgtaacctggcggcagcgcaaaagatg

SEQ ID NO: 182685 - DNA, 103 bp, Artificial Sequence
  Synthetic Polynucleotide
taatacgactcactatagggcgagttgcacgtgtcccggtagacgctgtaaacagaggagatacagcatgtaccgggacaacctggcggcagcgcaaaagatg

SEQ ID NO: 182686 - DNA, 103 bp, Artificial Sequence
  Synthetic Polynucleotide
taatacgactcactatagggtggctaggctcgagttgcacgtgtcccggtaacagaggagaaccgggatgcgtgcaactaacctggcggcagcgcaaaagatg

SEQ ID NO: 182687 - DNA, 103 bp, Artificial Sequence
  Synthetic Polynucleotide
taatacgactcactatagggagccgcaggctggctaggctcgagttgcacaacagaggagagtgcaaatggagcctagcaacctggcggcagcgcaaaagatg

SEQ ID NO: 182688 - DNA, 103 bp, Artificial Sequence
  Synthetic Polynucleotide
taatacgactcactatagggtttggacttgagccgcaggctggctaggctaacagaggagaagcctaatgagcctgcggaacctggcggcagcgcaaaagatg

SEQ ID NO: 182689 - DNA, 103 bp, Artificial Sequence
  Synthetic Polynucleotide
taatacgactcactatagggacgagtgctgtttggacttgagccgcaggcaacagaggagagcctgcatgtcaagtccaaacctggcggcagcgcaaaagatg

SEQ ID NO: 182690 - DNA, 103 bp, Artificial Sequence
  Synthetic Polynucleotide
taatacgactcactatagggtagccaaacgacgagtgctgtttggacttgaacagaggagacaagtcatgacagcactcaacctggcggcagcgcaaaagatg

SEQ ID NO: 182691 - DNA, 103 bp, Artificial Sequence
  Synthetic Polynucleotide
taatacgactcactatagggcaggccgccgtagccaaacgacgagtgctgaacagaggagacagcacatgtcgtttggcaacctggcggcagcgcaaaagatg

SEQ ID NO: 182692 - DNA, 103 bp, Artificial Sequence
  Synthetic Polynucleotide
taatacgactcactatagggccgggccctgcaggccgccgtagccaaacgaacagaggagacgtttgatgacggcggccaacctggcggcagcgcaaaagatg

SEQ ID NO: 182693 - DNA, 103 bp, Artificial Sequence
  Synthetic Polynucleotide
taatacgactcactataggggcgggccgggccaggtggaaggcgggccccaacagaggagaggggccatgcttccacctaacctggcggcagcgcaaaagatg

SEQ ID NO: 182694 - DNA, 103 bp, Artificial Sequence
  Synthetic Polynucleotide
taatacgactcactatagggaggcccgaggccgggccctgcaggccgccgaacagaggagacggcggatggcagggcccaacctggcggcagcgcaaaagatg

SEQ ID NO: 182695 - DNA, 103 bp, Artificial Sequence
  Synthetic Polynucleotide
taatacgactcactataggggcacgcgttgaggcccgaggccgggccctgaacagaggagacagggcatggcctcgggcaacctggcggcagcgcaaaagatg

SEQ ID NO: 182696 - DNA, 103 bp, Artificial Sequence
  Synthetic Polynucleotide
taatacgactcactatagggtgttgtactggcacgcgttgaggcccgaggaacagaggagacctcggatgtcaacgcgtaacctggcggcagcgcaaaagatg

SEQ ID NO: 182697 - DNA, 103 bp, Artificial Sequence
  Synthetic Polynucleotide
taatacgactcactatagggcaagtgaagcgggcctttcatgcagttcataacagaggagaatgaacatgatgaaaggcaacctggcggcagcgcaaaagatg

SEQ ID NO: 182698 - DNA, 103 bp, Artificial Sequence
  Synthetic Polynucleotide
taatacgactcactatagggagccagaaccgaagccatggctaacggctgaacagaggagacagccgatggccatggctaacctggcggcagcgcaaaagatg

SEQ ID NO: 182699 - DNA, 103 bp, Artificial Sequence
  Synthetic Polynucleotide
taatacgactcactataggggctgaccgggagccagaaccgaagccatggaacagaggagaccatggatgcggttctggaacctggcggcagcgcaaaagatg

SEQ ID NO: 182700 - DNA, 103 bp, Artificial Sequence
  Synthetic Polynucleotide
taatacgactcactatagggagcgaccggggctgaccgggagccagaaccaacagaggagaggttctatgtcccggtcaaacctggcggcagcgcaaaagatg

SEQ ID NO: 182701 - DNA, 103 bp, Artificial Sequence
  Synthetic Polynucleotide
taatacgactcactatagggggaggagtccagcgaccggggctgaccgggaacagaggagacccggtatgccccggtcgaacctggcggcagcgcaaaagatg

SEQ ID NO: 182702 - DNA, 103 bp, Artificial Sequence
  Synthetic Polynucleotide
taatacgactcactataggggcctgtgcttggaggagtccagcgaccgggaacagaggagacccggtatgtggactcctaacctggcggcagcgcaaaagatg

SEQ ID NO: 182703 - DNA, 103 bp, Artificial Sequence
  Synthetic Polynucleotide
taatacgactcactatagggtgcacctccagcctgtgcttggaggagtccaacagaggagaggactcatgcaagcacagaacctggcggcagcgcaaaagatg

SEQ ID NO: 182704 - DNA, 103 bp, Artificial Sequence
  Synthetic Polynucleotide
taatacgactcactatagggggagatggtgtgcacctccagcctgtgcttaacagaggagaaagcacatgctggaggtgaacctggcggcagcgcaaaagatg

SEQ ID NO: 182705 - DNA, 103 bp, Artificial Sequence
  Synthetic Polynucleotide
taatacgactcactatagggtggaggtgtcggagatggtgtgcacctccaaacagaggagatggaggatgacaccatctaacctggcggcagcgcaaaagatg

SEQ ID NO: 182706 - DNA, 103 bp, Artificial Sequence
  Synthetic Polynucleotide
taatacgactcactataggggcctccgggctggaggtgtcggagatggtgaacagaggagacaccatatgcgacacctcaacctggcggcagcgcaaaagatg

SEQ ID NO: 182707 - DNA, 103 bp, Artificial Sequence
  Synthetic Polynucleotide
taatacgactcactatagggtttctctgcggcctccgggctggaggtgtcaacagaggagagacaccatgagcccggagaacctggcggcagcgcaaaagatg

SEQ ID NO: 182708 - DNA, 103 bp, Artificial Sequence
  Synthetic Polynucleotide
taatacgactcactatagggctcggtgctccaagtgaagcgggcctttcaaacagaggagatgaaagatgcgcttcactaacctggcggcagcgcaaaagatg

SEQ ID NO: 182709 - DNA, 103 bp, Artificial Sequence
  Synthetic Polynucleotide
taatacgactcactatagggggcttttatctttctctgcggcctccgggcaacagaggagagcccggatgccgcagagaaacctggcggcagcgcaaaagatg

SEQ ID NO: 182710 - DNA, 103 bp, Artificial Sequence
  Synthetic Polynucleotide
taatacgactcactatagggttcccctgctggcttttatctttctctgcgaacagaggagacgcagaatgagataaaagaacctggcggcagcgcaaaagatg

SEQ ID NO: 182711 - DNA, 103 bp, Artificial Sequence
  Synthetic Polynucleotide
taatacgactcactataggggtcctcattcttcccctgctggcttttatcaacagaggagagataaaatgcagcaggggaacctggcggcagcgcaaaagatg

SEQ ID NO: 182712 - DNA, 103 bp, Artificial Sequence
  Synthetic Polynucleotide
taatacgactcactatagggcggcgcccacgtcctcattcttcccctgctaacagaggagaagcaggatgagaatgaggaacctggcggcagcgcaaaagatg

SEQ ID NO: 182713 - DNA, 103 bp, Artificial Sequence
  Synthetic Polynucleotide
taatacgactcactataggggacgggtcctcggcgcccacgtcctcattcaacagaggagagaatgaatgcgtgggcgcaacctggcggcagcgcaaaagatg

SEQ ID NO: 182714 - DNA, 103 bp, Artificial Sequence
  Synthetic Polynucleotide
taatacgactcactatagggcttcttcttagacgggtcctcggcgcccacaacagaggagagtgggcatggaggacccgaacctggcggcagcgcaaaagatg

SEQ ID NO: 182715 - DNA, 103 bp, Artificial Sequence
  Synthetic Polynucleotide
taatacgactcactataggggcctttgccgcttcttcttagacgggtcctaacagaggagaaggaccatgctaagaagaaacctggcggcagcgcaaaagatg

SEQ ID NO: 182716 - DNA, 103 bp, Artificial Sequence
  Synthetic Polynucleotide
taatacgactcactataggggtccgctgccgcctttgccgcttcttcttaaacagaggagataagaaatggcggcaaagaacctggcggcagcgcaaaagatg

SEQ ID NO: 182717 - DNA, 103 bp, Artificial Sequence
  Synthetic Polynucleotide
taatacgactcactatagggggtaaagtgagtccgctgccgcctttgccgaacagaggagacggcaaatgcggcagcggaacctggcggcagcgcaaaagatg

SEQ ID NO: 182718 - DNA, 103 bp, Artificial Sequence
  Synthetic Polynucleotide
taatacgactcactataggggctgctggctggtaaagtgagtccgctgccaacagaggagaggcagcatgctcactttaaacctggcggcagcgcaaaagatg

SEQ ID NO: 182719 - DNA, 103 bp, Artificial Sequence
  Synthetic Polynucleotide
taatacgactcactataggggtccccgctgctcggtgctccaagtgaagcaacagaggagagcttcaatgggagcaccgaacctggcggcagcgcaaaagatg

SEQ ID NO: 182720 - DNA, 103 bp, Artificial Sequence
  Synthetic Polynucleotide
taatacgactcactatagggagctcctggagctgctggctggtaaagtgaaacagaggagatcacttatgcagccagcaaacctggcggcagcgcaaaagatg

SEQ ID NO: 182721 - DNA, 103 bp, Artificial Sequence
  Synthetic Polynucleotide
taatacgactcactatagggagtggcctccagctcctggagctgctggctaacagaggagaagccagatgctccaggagaacctggcggcagcgcaaaagatg

SEQ ID NO: 182722 - DNA, 103 bp, Artificial Sequence
  Synthetic Polynucleotide
taatacgactcactatagggtcctctggaaagtggcctccagctcctggaaacagaggagatccaggatgtggaggccaaacctggcggcagcgcaaaagatg

SEQ ID NO: 182723 - DNA, 103 bp, Artificial Sequence
  Synthetic Polynucleotide
taatacgactcactataggggggtagcggttcctctggaaagtggcctccaacagaggagaggaggcatgtttccagagaacctggcggcagcgcaaaagatg

SEQ ID NO: 182724 - DNA, 103 bp, Artificial Sequence
  Synthetic Polynucleotide
taatacgactcactatagggggacatgtccgggtagcggttcctctggaaaacagaggagattccagatgaaccgctacaacctggcggcagcgcaaaagatg

SEQ ID NO: 182725 - DNA, 103 bp, Artificial Sequence
  Synthetic Polynucleotide
taatacgactcactatagggcttcgcgtgtggacatgtccgggtagcggtaacagaggagaaccgctatgcggacatgtaacctggcggcagcgcaaaagatg

SEQ ID NO: 182726 - DNA, 103 bp, Artificial Sequence
  Synthetic Polynucleotide
taatacgactcactatagggacagcgatttcttcgcgtgtggacatgtccaacagaggagaggacatatgcacacgcgaaacctggcggcagcgcaaaagatg

SEQ ID NO: 182727 - DNA, 103 bp, Artificial Sequence
  Synthetic Polynucleotide
taatacgactcactataggggttggtccacacagcgatttcttcgcgtgtaacagaggagaacacgcatggaaatcgctaacctggcggcagcgcaaaagatg

SEQ ID NO: 182728 - DNA, 103 bp, Artificial Sequence
  Synthetic Polynucleotide
taatacgactcactatagggcttccgtaaggttggtccacacagcgatttaacagaggagaaaatcgatgtgtggaccaaacctggcggcagcgcaaaagatg

SEQ ID NO: 182729 - DNA, 103 bp, Artificial Sequence
  Synthetic Polynucleotide
taatacgactcactatagggcggactcgggcttccgtaaggttggtccacaacagaggagagtggacatgccttacggaaacctggcggcagcgcaaaagatg

SEQ ID NO: 182730 - DNA, 103 bp, Artificial Sequence
  Synthetic Polynucleotide
taatacgactcactatagggcgacagcttggtccccgctgctcggtgctcaacagaggagagagcacatggcagcggggaacctggcggcagcgcaaaagatg

SEQ ID NO: 182731 - DNA, 103 bp, Artificial Sequence
  Synthetic Polynucleotide
taatacgactcactataggggaaccaaacccggactcgggcttccgtaagaacagaggagacttacgatggcccgagtcaacctggcggcagcgcaaaagatg

SEQ ID NO: 182732 - DNA, 103 bp, Artificial Sequence
  Synthetic Polynucleotide
taatacgactcactataggggacgattcttgaaccaaacccggactcgggaacagaggagacccgagatggggtttggtaacctggcggcagcgcaaaagatg

SEQ ID NO: 182733 - DNA, 103 bp, Artificial Sequence
  Synthetic Polynucleotide
taatacgactcactatagggcatttggcccgacgattcttgaaccaaaccaacagaggagaggtttgatgcaagaatcgaacctggcggcagcgcaaaagatg

SEQ ID NO: 182734 - DNA, 103 bp, Artificial Sequence
  Synthetic Polynucleotide
taatacgactcactatagggcctctttctccatttggcccgacgattcttaacagaggagaaagaatatgcgggccaaaaacctggcggcagcgcaaaagatg

SEQ ID NO: 182735 - DNA, 103 bp, Artificial Sequence
  Synthetic Polynucleotide
taatacgactcactatagggggttgcgctccctctttctccatttggcccaacagaggagagggccaatgggagaaagaaacctggcggcagcgcaaaagatg

SEQ ID NO: 182736 - DNA, 103 bp, Artificial Sequence
  Synthetic Polynucleotide
taatacgactcactatagggtcggcctgctggttgcgctccctctttctcaacagaggagagagaaaatgggagcgcaaaacctggcggcagcgcaaaagatg

SEQ ID NO: 182737 - DNA, 103 bp, Artificial Sequence
  Synthetic Polynucleotide
taatacgactcactatagggcttgcatagctcggcctgctggttgcgctcaacagaggagagagcgcatgcagcaggccaacctggcggcagcgcaaaagatg

SEQ ID NO: 182738 - DNA, 103 bp, Artificial Sequence
  Synthetic Polynucleotide
taatacgactcactatagggcgaagccattcttgcatagctcggcctgctaacagaggagaagcaggatgagctatgcaaacctggcggcagcgcaaaagatg

SEQ ID NO: 182739 - DNA, 103 bp, Artificial Sequence
  Synthetic Polynucleotide
taatacgactcactatagggaactgcggcccgaagccattcttgcatagcaacagaggagagctatgatggaatggcttaacctggcggcagcgcaaaagatg

SEQ ID NO: 182740 - DNA, 103 bp, Artificial Sequence
  Synthetic Polynucleotide
taatacgactcactataggggagcccattgaactgcggcccgaagccattaacagaggagaaatggcatggggccgcagaacctggcggcagcgcaaaagatg

SEQ ID NO: 182741 - DNA, 103 bp, Artificial Sequence
  Synthetic Polynucleotide
taatacgactcactatagggaggagacggccgacagcttggtccccgctgaacagaggagacagcggatgccaagctgtaacctggcggcagcgcaaaagatg

SEQ ID NO: 182742 - DNA, 103 bp, Artificial Sequence
  Synthetic Polynucleotide
taatacgactcactatagggagggctgcatgagcccattgaactgcggccaacagaggagaggccgcatgtcaatgggcaacctggcggcagcgcaaaagatg

SEQ ID NO: 182743 - DNA, 103 bp, Artificial Sequence
  Synthetic Polynucleotide
taatacgactcactatagggatgtcgtcgtagggctgcatgagcccattgaacagaggagacaatggatgcatgcagccaacctggcggcagcgcaaaagatg

SEQ ID NO: 182744 - DNA, 103 bp, Artificial Sequence
  Synthetic Polynucleotide
taatacgactcactataggggcctgggtacatgtcgtcgtagggctgcataacagaggagaatgcagatgtacgacgacaacctggcggcagcgcaaaagatg

SEQ ID NO: 182745 - DNA, 103 bp, Artificial Sequence
  Synthetic Polynucleotide
taatacgactcactatagggtgtaggaatagcctgggtacatgtcgtcgtaacagaggagaacgacgatgtgtacccagaacctggcggcagcgcaaaagatg

SEQ ID NO: 182746 - DNA, 103 bp, Artificial Sequence
  Synthetic Polynucleotide
taatacgactcactataggggcccagttgttgtaggaatagcctgggtacaacagaggagagtacccatgctattcctaaacctggcggcagcgcaaaagatg

SEQ ID NO: 182747 - DNA, 103 bp, Artificial Sequence
  Synthetic Polynucleotide
taatacgactcactataggggcccttggcggcccagttgttgtaggaataaacagaggagatattccatgaacaactggaacctggcggcagcgcaaaagatg

SEQ ID NO: 182748 - DNA, 103 bp, Artificial Sequence
  Synthetic Polynucleotide
taatacgactcactatagggcggatgtaaggcccttggcggcccagttgtaacagaggagaacaactatgccgccaaggaacctggcggcagcgcaaaagatg

SEQ ID NO: 182749 - DNA, 103 bp, Artificial Sequence
  Synthetic Polynucleotide
taatacgactcactataggggatagggaggcggatgtaaggcccttggcgaacagaggagacgccaaatgccttacatcaacctggcggcagcgcaaaagatg

SEQ ID NO: 182750 - DNA, 103 bp, Artificial Sequence
  Synthetic Polynucleotide
taatacgactcactataggggctcttggtggatagggaggcggatgtaagaacagaggagacttacaatggcctccctaaacctggcggcagcgcaaaagatg

SEQ ID NO: 182751 - DNA, 103 bp, Artificial Sequence
  Synthetic Polynucleotide
taatacgactcactatagggagaaggggaagctcttggtggatagggaggaacagaggagacctcccatgccaccaagaaacctggcggcagcgcaaaagatg

SEQ ID NO: 182752 - DNA, 103 bp, Artificial Sequence
  Synthetic Polynucleotide
taatacgactcactatagggcaggaagatgaggagacggccgacagcttgaacagaggagacaagctatgggccgtctcaacctggcggcagcgcaaaagatg

SEQ ID NO: 182753 - DNA, 103 bp, Artificial Sequence
  Synthetic Polynucleotide
taatacgactcactatagggatagagttgaagaaggggaagctcttggtgaacagaggagacaccaaatgcttccccttaacctggcggcagcgcaaaagatg

SEQ ID NO: 182754 - DNA, 103 bp, Artificial Sequence
  Synthetic Polynucleotide
taatacgactcactataggggttgacgttcatagagttgaagaaggggaaaacagaggagattccccatgttcaactctaacctggcggcagcgcaaaagatg

SEQ ID NO: 182755 - DNA, 103 bp, Artificial Sequence
  Synthetic Polynucleotide
taatacgactcactatagggatgacagggggttgacgttcatagagttgaaacagaggagatcaactatgtgaacgtcaaacctggcggcagcgcaaaagatg

SEQ ID NO: 182756 - DNA, 103 bp, Artificial Sequence
  Synthetic Polynucleotide
taatacgactcactatagggatgctctgtgatgacagggggttgacgttcaacagaggagagaacgtatgccccctgtcaacctggcggcagcgcaaaagatg

SEQ ID NO: 182757 - DNA, 103 bp, Artificial Sequence
  Synthetic Polynucleotide
taatacgactcactatagggtggggaaaacatgctctgtgatgacaggggaacagaggagacccctgatgtcacagagcaacctggcggcagcgcaaaagatg

SEQ ID NO: 182758 - DNA, 103 bp, Artificial Sequence
  Synthetic Polynucleotide
taatacgactcactatagggtagagttgggtggggaaaacatgctctgtgaacagaggagacacagaatgtgttttcccaacctggcggcagcgcaaaagatg

SEQ ID NO: 182759 - DNA, 103 bp, Artificial Sequence
  Synthetic Polynucleotide
taatacgactcactatagggatggacgagatagagttgggtggggaaaacaacagaggagagttttcatgacccaactcaacctggcggcagcgcaaaagatg

SEQ ID NO: 182760 - DNA, 103 bp, Artificial Sequence
  Synthetic Polynucleotide
taatacgactcactatagggcgacatgctcatggacgagatagagttgggaacagaggagacccaacatgatctcgtccaacctggcggcagcgcaaaagatg

SEQ ID NO: 182761 - DNA, 103 bp, Artificial Sequence
  Synthetic Polynucleotide
taatacgactcactatagggccatgctggacgacatgctcatggacgagaaacagaggagatctcgtatgtgagcatgtaacctggcggcagcgcaaaagatg

SEQ ID NO: 182762 - DNA, 103 bp, Artificial Sequence
  Synthetic Polynucleotide
taatacgactcactataggggctgagggcaccatgctggacgacatgctcaacagaggagagagcatatggtccagcataacctggcggcagcgcaaaagatg

SEQ ID NO: 182763 - DNA, 103 bp, Artificial Sequence
  Synthetic Polynucleotide
taatacgactcactataggggggatggtgacaggaagatgaggagacggcaacagaggagagccgtcatgtcatcttccaacctggcggcagcgcaaaagatg

SEQ ID NO: 182764 - DNA, 103 bp, Artificial Sequence
  Synthetic Polynucleotide
taatacgactcactataggggcctgtcactgctgagggcaccatgctggaaacagaggagatccagcatggtgccctcaaacctggcggcagcgcaaaagatg

SEQ ID NO: 182765 - DNA, 103 bp, Artificial Sequence
  Synthetic Polynucleotide
taatacgactcactatagggagcccgggacgcctgtcactgctgagggcaaacagaggagatgccctatgcagtgacagaacctggcggcagcgcaaaagatg

SEQ ID NO: 182766 - DNA, 103 bp, Artificial Sequence
  Synthetic Polynucleotide
taatacgactcactatagggttgagactggagcccgggacgcctgtcactaacagaggagaagtgacatgcgtcccgggaacctggcggcagcgcaaaagatg

SEQ ID NO: 182767 - DNA, 103 bp, Artificial Sequence
  Synthetic Polynucleotide
taatacgactcactatagggattcaggctgttgagactggagcccgggacaacagaggagagtcccgatgtccagtctcaacctggcggcagcgcaaaagatg

SEQ ID NO: 182768 - DNA, 103 bp, Artificial Sequence
  Synthetic Polynucleotide
taatacgactcactatagggtgttcaagttattcaggctgttgagactggaacagaggagaccagtcatgacagcctgaaacctggcggcagcgcaaaagatg

SEQ ID NO: 182769 - DNA, 103 bp, Artificial Sequence
  Synthetic Polynucleotide
taatacgactcactatagggctactcaggttgttcaagttattcaggctgaacagaggagacagcctatgtaacttgaaaacctggcggcagcgcaaaagatg

SEQ ID NO: 182770 - DNA, 103 bp, Artificial Sequence
  Synthetic Polynucleotide
taatacgactcactatagggcagcgacgggctactcaggttgttcaagttaacagaggagaaacttgatgaacctgagtaacctggcggcagcgcaaaagatg

SEQ ID NO: 182771 - DNA, 103 bp, Artificial Sequence
  Synthetic Polynucleotide
taatacgactcactatagggccgcggaattcagcgacgggctactcaggtaacagaggagaacctgaatggcccgtcgcaacctggcggcagcgcaaaagatg

SEQ ID NO: 182772 - DNA, 103 bp, Artificial Sequence
  Synthetic Polynucleotide
taatacgactcactatagggggcgtcggcaccgcggaattcagcgacgggaacagaggagacccgtcatggaattccgcaacctggcggcagcgcaaaagatg

SEQ ID NO: 182773 - DNA, 103 bp, Artificial Sequence
  Synthetic Polynucleotide
taatacgactcactatagggaggacaggcaggcgtcggcaccgcggaattaacagaggagaaattccatggtgccgacgaacctggcggcagcgcaaaagatg

SEQ ID NO: 182774 - DNA, 103 bp, Artificial Sequence
  Synthetic Polynucleotide
taatacgactcactatagggctaacggctggggatggtgacaggaagatgaacagaggagacatcttatggtcaccatcaacctggcggcagcgcaaaagatg

SEQ ID NO: 182775 - DNA, 103 bp, Artificial Sequence
  Synthetic Polynucleotide
taatacgactcactataggggcggcgcgtaaggacaggcaggcgtcggcaaacagaggagatgccgaatgctgcctgtcaacctggcggcagcgcaaaagatg

SEQ ID NO: 182776 - DNA, 103 bp, Artificial Sequence
  Synthetic Polynucleotide
taatacgactcactatagggggaggagtcggcggcgcgtaaggacaggcaaacagaggagatgcctgatgttacgcgccaacctggcggcagcgcaaaagatg

SEQ ID NO: 182777 - DNA, 103 bp, Artificial Sequence
  Synthetic Polynucleotide
taatacgactcactatagggataaacatacggaggagtcggcggcgcgtaaacagaggagatacgcgatgccgactcctaacctggcggcagcgcaaaagatg

SEQ ID NO: 182778 - DNA, 103 bp, Artificial Sequence
  Synthetic Polynucleotide
taatacgactcactatagggacgtgtccctataaacatacggaggagtcgaacagaggagacgactcatgcgtatgtttaacctggcggcagcgcaaaagatg

SEQ ID NO: 182779 - DNA, 103 bp, Artificial Sequence
  Synthetic Polynucleotide
taatacgactcactatagggctcgagttacacgtgtccctataaacatacaacagaggagagtatgtatgtagggacacaacctggcggcagcgcaaaagatg

SEQ ID NO: 182780 - DNA, 103 bp, Artificial Sequence
  Synthetic Polynucleotide
taatacgactcactataggggctggccaggctcgagttacacgtgtccctaacagaggagaagggacatgtgtaactcgaacctggcggcagcgcaaaagatg

SEQ ID NO: 182781 - DNA, 103 bp, Artificial Sequence
  Synthetic Polynucleotide
taatacgactcactatagggtcagtctcaggctggccaggctcgagttacaacagaggagagtaactatggcctggccaaacctggcggcagcgcaaaagatg

SEQ ID NO: 182782 - DNA, 103 bp, Artificial Sequence
  Synthetic Polynucleotide
taatacgactcactatagggtgctttgctttcagtctcaggctggccaggaacagaggagacctggcatgcctgagactaacctggcggcagcgcaaaagatg

SEQ ID NO: 182783 - DNA, 103 bp, Artificial Sequence
  Synthetic Polynucleotide
taatacgactcactataggggctggagtgctgctttgctttcagtctcagaacagaggagactgagaatgaaagcaaagaacctggcggcagcgcaaaagatg

SEQ ID NO: 182784 - DNA, 103 bp, Artificial Sequence
  Synthetic Polynucleotide
taatacgactcactatagggcgtagccgaagctggagtgctgctttgcttaacagaggagaaagcaaatgagcactccaaacctggcggcagcgcaaaagatg

SEQ ID NO: 182785 - DNA, 103 bp, Artificial Sequence
  Synthetic Polynucleotide
taatacgactcactataggggaagccatggctaacggctggggatggtgaaacagaggagatcaccaatgccagccgttaacctggcggcagcgcaaaagatg

SEQ ID NO: 182786 - DNA, 103 bp, Artificial Sequence
  Synthetic Polynucleotide
taatacgactcactatagggtgcacgctggcgtagccgaagctggagtgcaacagaggagagcactcatgcttcggctaaacctggcggcagcgcaaaagatg

SEQ ID NO: 182787 - DNA, 103 bp, Artificial Sequence
  Synthetic Polynucleotide
taatacgactcactatagggggccgggttctgcacgctggcgtagccgaaaacagaggagattcggcatggccagcgtgaacctggcggcagcgcaaaagatg

SEQ ID NO: 182788 - DNA, 103 bp, Artificial Sequence
  Synthetic Polynucleotide
taatacgactcactatagggtcaggttggaggccgggttctgcacgctggaacagaggagaccagcgatgagaacccggaacctggcggcagcgcaaaagatg

SEQ ID NO: 182789 - DNA, 103 bp, Artificial Sequence
  Synthetic Polynucleotide
taatacgactcactatagggtggcaagcactcaggttggaggccgggttcaacagaggagagaacccatgctccaacctaacctggcggcagcgcaaaagatg

SEQ ID NO: 182790 - DNA, 103 bp, Artificial Sequence
  Synthetic Polynucleotide
taatacgactcactatagggcactgcatactggcaagcactcaggttggaaacagaggagatccaacatgagtgcttgcaacctggcggcagcgcaaaagatg

SEQ ID NO: 182791 - DNA, 103 bp, Artificial Sequence
  Synthetic Polynucleotide
taatacgactcactatagggcgggccggtccactgcatactggcaagcacaacagaggagagtgcttatgagtatgcagaacctggcggcagcgcaaaagatg

SEQ ID NO: 182792 - DNA, 103 bp, Artificial Sequence
  Synthetic Polynucleotide
taatacgactcactatagggctctgcctcgctgagcaggccgaactccataacagaggagaatggagatgggcctgctcaacctggcggcagcgcaaaagatg

SEQ ID NO: 182793 - DNA, 103 bp, Artificial Sequence
  Synthetic Polynucleotide
taatacgactcactataggggtcgctgtgctcctggcccttgcagccgtgaacagaggagacacggcatgaagggccagaacctggcggcagcgcaaaagatg

SEQ ID NO: 182794 - DNA, 103 bp, Artificial Sequence
  Synthetic Polynucleotide
taatacgactcactatagggccttttctgagtcgctgtgctcctggccctaacagaggagaagggccatgagcacagcgaacctggcggcagcgcaaaagatg

SEQ ID NO: 182795 - DNA, 103 bp, Artificial Sequence
  Synthetic Polynucleotide
taatacgactcactataggggaagccgaggccttttctgagtcgctgtgcaacagaggagagcacagatgctcagaaaaaacctggcggcagcgcaaaagatg

SEQ ID NO: 182796 - DNA, 103 bp, Artificial Sequence
  Synthetic Polynucleotide
taatacgactcactataggggccgggcagcgaagccgaggccttttctgaaacagaggagatcagaaatggcctcggctaacctggcggcagcgcaaaagatg

SEQ ID NO: 182797 - DNA, 103 bp, Artificial Sequence
  Synthetic Polynucleotide
taatacgactcactatagggctggggagccgccgggcagcgaagccgaggaacagaggagacctcggatgcgctgcccgaacctggcggcagcgcaaaagatg

SEQ ID NO: 182798 - DNA, 103 bp, Artificial Sequence
  Synthetic Polynucleotide
taatacgactcactataggggaaccgtcctctggggagccgccgggcagcaacagaggagagctgccatgcggctccccaacctggcggcagcgcaaaagatg

SEQ ID NO: 182799 - DNA, 103 bp, Artificial Sequence
  Synthetic Polynucleotide
taatacgactcactatagggctttttcagcgaaccgtcctctggggagccaacagaggagaggctccatggaggacggtaacctggcggcagcgcaaaagatg

SEQ ID NO: 182800 - DNA, 103 bp, Artificial Sequence
  Synthetic Polynucleotide
taatacgactcactataggggccgctgcttctttttcagcgaaccgtcctaacagaggagaaggacgatgcgctgaaaaaacctggcggcagcgcaaaagatg

SEQ ID NO: 182801 - DNA, 103 bp, Artificial Sequence
  Synthetic Polynucleotide
taatacgactcactataggggtgcgctgccgccgctgcttctttttcagcaacagaggagagctgaaatggaagcagcgaacctggcggcagcgcaaaagatg

SEQ ID NO: 182802 - DNA, 103 bp, Artificial Sequence
  Synthetic Polynucleotide
taatacgactcactatagggggtgaagtgcgtgcgctgccgccgctgcttaacagaggagaaagcagatgcggcagcgcaacctggcggcagcgcaaaagatg

SEQ ID NO: 182803 - DNA, 103 bp, Artificial Sequence
  Synthetic Polynucleotide
taatacgactcactatagggggctccgggcctctgcctcgctgagcaggcaacagaggagagcctgcatggcgaggcagaacctggcggcagcgcaaaagatg

SEQ ID NO: 182804 - DNA, 103 bp, Artificial Sequence
  Synthetic Polynucleotide
taatacgactcactataggggctgctggctggtgaagtgcgtgcgctgccaacagaggagaggcagcatgcgcacttcaaacctggcggcagcgcaaaagatg

SEQ ID NO: 182805 - DNA, 103 bp, Artificial Sequence
  Synthetic Polynucleotide
taatacgactcactatagggagctcctgtagctgctggctggtgaagtgcaacagaggagagcacttatgcagccagcaaacctggcggcagcgcaaaagatg

SEQ ID NO: 182806 - DNA, 103 bp, Artificial Sequence
  Synthetic Polynucleotide
taatacgactcactatagggggtcgcctctagctcctgtagctgctggctaacagaggagaagccagatgctacaggagaacctggcggcagcgcaaaagatg

SEQ ID NO: 182807 - DNA, 103 bp, Artificial Sequence
  Synthetic Polynucleotide
taatacgactcactatagggtcctctggaaggtcgcctctagctcctgtaaacagaggagatacaggatgtagaggcgaaacctggcggcagcgcaaaagatg

SEQ ID NO: 182808 - DNA, 103 bp, Artificial Sequence
  Synthetic Polynucleotide
taatacgactcactataggggggtagcggttcctctggaaggtcgcctctaacagaggagaagaggcatgcttccagagaacctggcggcagcgcaaaagatg

SEQ ID NO: 182809 - DNA, 103 bp, Artificial Sequence
  Synthetic Polynucleotide
taatacgactcactataggggctcatgtcggggtagcggttcctctggaaaacagaggagattccagatgaaccgctacaacctggcggcagcgcaaaagatg

SEQ ID NO: 182810 - DNA, 103 bp, Artificial Sequence
  Synthetic Polynucleotide
taatacgactcactatagggcctcgcgcgtgctcatgtcggggtagcggtaacagaggagaaccgctatgccgacatgaaacctggcggcagcgcaaaagatg

SEQ ID NO: 182811 - DNA, 103 bp, Artificial Sequence
  Synthetic Polynucleotide
taatacgactcactatagggacggcgatctcctcgcgcgtgctcatgtcgaacagaggagacgacatatgcacgcgcgaaacctggcggcagcgcaaaagatg

SEQ ID NO: 182812 - DNA, 103 bp, Artificial Sequence
  Synthetic Polynucleotide
taatacgactcactataggggttggtccacacggcgatctcctcgcgcgtaacagaggagaacgcgcatggagatcgccaacctggcggcagcgcaaaagatg

SEQ ID NO: 182813 - DNA, 103 bp, Artificial Sequence
  Synthetic Polynucleotide
taatacgactcactatagggcctcggtgaggttggtccacacggcgatctaacagaggagaagatcgatgtgtggaccaaacctggcggcagcgcaaaagatg

SEQ ID NO: 182814 - DNA, 103 bp, Artificial Sequence
  Synthetic Polynucleotide
taatacgactcactataggggacagggcagggctccgggcctctgcctcgaacagaggagacgaggcatgggcccggagaacctggcggcagcgcaaaagatg

SEQ ID NO: 182815 - DNA, 103 bp, Artificial Sequence
  Synthetic Polynucleotide
taatacgactcactatagggcgcacgcgggcctcggtgaggttggtccacaacagaggagagtggacatgcctcaccgaaacctggcggcagcgcaaaagatg

SEQ ID NO: 182816 - DNA, 103 bp, Artificial Sequence
  Synthetic Polynucleotide
taatacgactcactataggggaaccacacccgcacgcgggcctcggtgagaacagaggagactcaccatggcccgcgtgaacctggcggcagcgcaaaagatg

SEQ ID NO: 182817 - DNA, 103 bp, Artificial Sequence
  Synthetic Polynucleotide
taatacgactcactataggggccggttcttgaaccacacccgcacgcgggaacagaggagacccgcgatggggtgtggtaacctggcggcagcgcaaaagatg

SEQ ID NO: 182818 - DNA, 103 bp, Artificial Sequence
  Synthetic Polynucleotide
taatacgactcactatagggcatttggcgcgccggttcttgaaccacaccaacagaggagaggtgtgatgcaagaaccgaacctggcggcagcgcaaaagatg

SEQ ID NO: 182819 - DNA, 103 bp, Artificial Sequence
  Synthetic Polynucleotide
taatacgactcactataggggcgcttccgccatttggcgcgccggttcttaacagaggagaaagaacatgcgcgccaaaaacctggcggcagcgcaaaagatg

SEQ ID NO: 182820 - DNA, 103 bp, Artificial Sequence
  Synthetic Polynucleotide
taatacgactcactatagggggctgcgctcgcgcttccgccatttggcgcaacagaggagagcgccaatgggcggaagcaacctggcggcagcgcaaaagatg

SEQ ID NO: 182821 - DNA, 103 bp, Artificial Sequence
  Synthetic Polynucleotide
taatacgactcactatagggtcggcctgctggctgcgctcgcgcttccgcaacagaggagagcggaaatgcgagcgcagaacctggcggcagcgcaaaagatg

SEQ ID NO: 182822 - DNA, 103 bp, Artificial Sequence
  Synthetic Polynucleotide
taatacgactcactatagggtttgcatagctcggcctgctggctgcgctcaacagaggagagagcgcatgcagcaggccaacctggcggcagcgcaaaagatg

SEQ ID NO: 182823 - DNA, 103 bp, Artificial Sequence
  Synthetic Polynucleotide
taatacgactcactatagggcgaagctgcctttgcatagctcggcctgctaacagaggagaagcaggatgagctatgcaaacctggcggcagcgcaaaagatg

SEQ ID NO: 182824 - DNA, 103 bp, Artificial Sequence
  Synthetic Polynucleotide
taatacgactcactatagggagcggcgccgcgaagctgcctttgcatagcaacagaggagagctatgatgaggcagcttaacctggcggcagcgcaaaagatg

SEQ ID NO: 182825 - DNA, 103 bp, Artificial Sequence
  Synthetic Polynucleotide
taatacgactcactataggggtctgacagcgacagggcagggctccgggcaacagaggagagcccggatgcctgccctgaacctggcggcagcgcaaaagatg

SEQ ID NO: 182826 - DNA, 103 bp, Artificial Sequence
  Synthetic Polynucleotide
taatacgactcactatagggcagccccccgagcggcgccgcgaagctgccaacagaggagaggcagcatggcggcgccgaacctggcggcagcgcaaaagatg

SEQ ID NO: 182827 - DNA, 103 bp, Artificial Sequence
  Synthetic Polynucleotide
taatacgactcactatagggagggcggcaccagccccccgagcggcgccgaacagaggagacggcgcatgtcggggggcaacctggcggcagcgcaaaagatg

SEQ ID NO: 182828 - DNA, 103 bp, Artificial Sequence
  Synthetic Polynucleotide
taatacgactcactatagggacctcctcgtagggcggcaccagccccccgaacagaggagacgggggatgggtgccgccaacctggcggcagcgcaaaagatg

SEQ ID NO: 182829 - DNA, 103 bp, Artificial Sequence
  Synthetic Polynucleotide
taatacgactcactataggggccggggtacacctcctcgtagggcggcacaacagaggagagtgccgatgtacgaggagaacctggcggcagcgcaaaagatg

SEQ ID NO: 182830 - DNA, 103 bp, Artificial Sequence
  Synthetic Polynucleotide
taatacgactcactatagggcgtacgagtagccggggtacacctcctcgtaacagaggagaacgaggatgtgtaccccgaacctggcggcagcgcaaaagatg

SEQ ID NO: 182831 - DNA, 103 bp, Artificial Sequence
  Synthetic Polynucleotide
taatacgactcactatagggggccagttgccgtacgagtagccggggtacaacagaggagagtacccatgctactcgtaaacctggcggcagcgcaaaagatg

SEQ ID NO: 182832 - DNA, 103 bp, Artificial Sequence
  Synthetic Polynucleotide
taatacgactcactatagggagccttgggcggccagttgccgtacgagtaaacagaggagatactcgatgggcaactggaacctggcggcagcgcaaaagatg

SEQ ID NO: 182833 - DNA, 103 bp, Artificial Sequence
  Synthetic Polynucleotide
taatacgactcactataggggcggggcaagagccttgggcggccagttgcaacagaggagagcaactatgcgcccaaggaacctggcggcagcgcaaaagatg

SEQ ID NO: 182834 - DNA, 103 bp, Artificial Sequence
  Synthetic Polynucleotide
taatacgactcactataggggcggcgagcggcggggcaagagccttgggcaacagaggagagcccaaatgtcttgccccaacctggcggcagcgcaaaagatg

SEQ ID NO: 182835 - DNA, 103 bp, Artificial Sequence
  Synthetic Polynucleotide
taatacgactcactatagggaaaggtcttggcggcgagcggcggggcaagaacagaggagacttgccatgccgctcgccaacctggcggcagcgcaaaagatg

SEQ ID NO: 182836 - DNA, 103 bp, Artificial Sequence
  Synthetic Polynucleotide
taatacgactcactataggggagtgccagcgtctgacagcgacagggcagaacagaggagactgcccatgcgctgtcagaacctggcggcagcgcaaaagatg

SEQ ID NO: 182837 - DNA, 103 bp, Artificial Sequence
  Synthetic Polynucleotide
taatacgactcactatagggaggcgaatggaaaggtcttggcggcgagcgaacagaggagacgctcgatgccaagacctaacctggcggcagcgcaaaagatg

SEQ ID NO: 182838 - DNA, 103 bp, Artificial Sequence
  Synthetic Polynucleotide
taatacgactcactatagggaccgagttgaaggcgaatggaaaggtcttgaacagaggagacaagacatgtccattcgcaacctggcggcagcgcaaaagatg

SEQ ID NO: 182839 - DNA, 103 bp, Artificial Sequence
  Synthetic Polynucleotide
taatacgactcactatagggccccacgttgaccgagttgaaggcgaatggaacagaggagaccattcatgttcaactcgaacctggcggcagcgcaaaagatg

SEQ ID NO: 182840 - DNA, 103 bp, Artificial Sequence
  Synthetic Polynucleotide
taatacgactcactatagggaagccagaggccccacgttgaccgagttgaaacagaggagatcaactatgtcaacgtggaacctggcggcagcgcaaaagatg

SEQ ID NO: 182841 - DNA, 103 bp, Artificial Sequence
  Synthetic Polynucleotide
taatacgactcactatagggacgggctgcgaagccagaggccccacgttgaacagaggagacaacgtatggcctctggcaacctggcggcagcgcaaaagatg

SEQ ID NO: 182842 - DNA, 103 bp, Artificial Sequence
  Synthetic Polynucleotide
taatacgactcactatagggtggcgagaagacgggctgcgaagccagaggaacagaggagacctctgatgtcgcagcccaacctggcggcagcgcaaaagatg

SEQ ID NO: 182843 - DNA, 103 bp, Artificial Sequence
  Synthetic Polynucleotide
taatacgactcactatagggtggagctgggtggcgagaagacgggctgcgaacagaggagacgcagcatgtcttctcgcaacctggcggcagcgcaaaagatg

SEQ ID NO: 182844 - DNA, 103 bp, Artificial Sequence
  Synthetic Polynucleotide
taatacgactcactataggggaggcggcgatggagctgggtggcgagaagaacagaggagacttctcatgacccagctcaacctggcggcagcgcaaaagatg

SEQ ID NO: 182845 - DNA, 103 bp, Artificial Sequence
  Synthetic Polynucleotide
taatacgactcactataggggggcaccatggaggcggcgatggagctgggaacagaggagacccagcatgatcgccgccaacctggcggcagcgcaaaagatg

SEQ ID NO: 182846 - DNA, 103 bp, Artificial Sequence
  Synthetic Polynucleotide
taatacgactcactatagggccgcggcggagggcaccatggaggcggcgaaacagaggagatcgccgatgccatggtgcaacctggcggcagcgcaaaagatg

SEQ ID NO: 182847 - DNA, 103 bp, Artificial Sequence
  Synthetic Polynucleotide
taatacgactcactatagggtgggggtgcggagtgccagcgtctgacagcaacagaggagagctgtcatgcgctggcacaacctggcggcagcgcaaaagatg

SEQ ID NO: 182848 - DNA, 103 bp, Artificial Sequence
  Synthetic Polynucleotide
taatacgactcactatagggcccggggcagccgcggcggagggcaccatgaacagaggagacatggtatgctccgccgcaacctggcggcagcgcaaaagatg

SEQ ID NO: 182849 - DNA, 103 bp, Artificial Sequence
  Synthetic Polynucleotide
taatacgactcactatagggtggcacggtgcccggggcagccgcggcggaaacagaggagatccgccatggctgccccgaacctggcggcagcgcaaaagatg

SEQ ID NO: 182850 - DNA, 103 bp, Artificial Sequence
  Synthetic Polynucleotide
taatacgactcactatagggccccaggccctggcacggtgcccggggcagaacagaggagactgcccatggcaccgtgcaacctggcggcagcgcaaaagatg

SEQ ID NO: 182851 - DNA, 103 bp, Artificial Sequence
  Synthetic Polynucleotide
taatacgactcactatagggccctgcagggccccaggccctggcacggtgaacagaggagacaccgtatgagggcctggaacctggcggcagcgcaaaagatg

SEQ ID NO: 182852 - DNA, 103 bp, Artificial Sequence
  Synthetic Polynucleotide
taatacgactcactatagggcccgcccaggccctgcagggccccaggcccaacagaggagagggcctatggccctgcagaacctggcggcagcgcaaaagatg

SEQ ID NO: 182853 - DNA, 103 bp, Artificial Sequence
  Synthetic Polynucleotide
taatacgactcactatagggcgggggggcccccgcccaggccctgcagggaacagaggagaccctgcatggcctgggcgaacctggcggcagcgcaaaagatg

SEQ ID NO: 182854 - DNA, 103 bp, Artificial Sequence
  Synthetic Polynucleotide
taatacgactcactatagggggagccagcccgggggggcccccgcccaggaacagaggagacctgggatggggccccccaacctggcggcagcgcaaaagatg

SEQ ID NO: 182855 - DNA, 103 bp, Artificial Sequence
  Synthetic Polynucleotide
taatacgactcactatagggcacggcggccggagccagcccgggggggccaacagaggagaggccccatggggctggctaacctggcggcagcgcaaaagatg

SEQ ID NO: 182856 - DNA, 103 bp, Artificial Sequence
  Synthetic Polynucleotide
taatacgactcactatagggccccggaggacacggcggccggagccagccaacagaggagaggctggatgcggccgccgaacctggcggcagcgcaaaagatg

SEQ ID NO: 182857 - DNA, 103 bp, Artificial Sequence
  Synthetic Polynucleotide
taatacgactcactatagggcaggacacggccccggaggacacggcggccaacagaggagaggccgcatggtcctccggaacctggcggcagcgcaaaagatg

SEQ ID NO: 182858 - DNA, 103 bp, Artificial Sequence
  Synthetic Polynucleotide
taatacgactcactatagggctctgggagctgggggtgcggagtgccagcaacagaggagagctggcatgccgcaccccaacctggcggcagcgcaaaagatg

SEQ ID NO: 182859 - DNA, 103 bp, Artificial Sequence
  Synthetic Polynucleotide
taatacgactcactatagggggcataagggcaggacacggccccggaggaaacagaggagatcctccatggccgtgtccaacctggcggcagcgcaaaagatg

SEQ ID NO: 182860 - DNA, 103 bp, Artificial Sequence
  Synthetic Polynucleotide
taatacgactcactatagggcggcggccgaggcataagggcaggacacggaacagaggagaccgtgtatggcccttatgaacctggcggcagcgcaaaagatg

SEQ ID NO: 182861 - DNA, 103 bp, Artificial Sequence
  Synthetic Polynucleotide
taatacgactcactataggggcggcggcggcggcggccgaggcataagggaacagaggagacccttaatgctcggccgcaacctggcggcagcgcaaaagatg

SEQ ID NO: 182862 - DNA, 103 bp, Artificial Sequence
  Synthetic Polynucleotide
taatacgactcactatagggggcggcagccgcggcggcggcggcggccgaaacagaggagatcggccatggccgccgccaacctggcggcagcgcaaaagatg

SEQ ID NO: 182863 - DNA, 103 bp, Artificial Sequence
  Synthetic Polynucleotide
taatacgactcactatagggagggggaagaggcggcagccgcggcggcggaacagaggagaccgccgatgcggctgccgaacctggcggcagcgcaaaagatg

SEQ ID NO: 182864 - DNA, 103 bp, Artificial Sequence
  Synthetic Polynucleotide
taatacgactcactatagggcgatagacgtagggggaagaggcggcagccaacagaggagaggctgcatgctcttccccaacctggcggcagcgcaaaagatg

SEQ ID NO: 182865 - DNA, 103 bp, Artificial Sequence
  Synthetic Polynucleotide
taatacgactcactatagggacacgggtcccgatagacgtagggggaagaaacagaggagatcttccatgtacgtctataacctggcggcagcgcaaaagatg

SEQ ID NO: 182866 - DNA, 103 bp, Artificial Sequence
  Synthetic Polynucleotide
taatacgactcactatagggggctcgagttacacgggtcccgatagacgtaacagaggagaacgtctatggggacccgtaacctggcggcagcgcaaaagatg

SEQ ID NO: 182867 - DNA, 103 bp, Artificial Sequence
  Synthetic Polynucleotide
taatacgactcactatagggaggctggccaggctcgagttacacgggtccaacagaggagaggacccatgtaactcgagaacctggcggcagcgcaaaagatg

SEQ ID NO: 182868 - DNA, 103 bp, Artificial Sequence
  Synthetic Polynucleotide
taatacgactcactatagggtttgagccgcaggctggccaggctcgagttaacagaggagaaactcgatgctggccagcaacctggcggcagcgcaaaagatg

SEQ ID NO: 182869 - DNA, 103 bp, Artificial Sequence
  Synthetic Polynucleotide
taatacgactcactatagggtgcagccgtgctctgggagctgggggtgcgaacagaggagacgcaccatgagctcccagaacctggcggcagcgcaaaagatg

SEQ ID NO: 182870 - DNA, 103 bp, Artificial Sequence
  Synthetic Polynucleotide
taatacgactcactataggggctgtttggctttgagccgcaggctggccaaacagaggagatggccaatgtgcggctcaaacctggcggcagcgcaaaagatg

SEQ ID NO: 182871 - DNA, 103 bp, Artificial Sequence
  Synthetic Polynucleotide
taatacgactcactatagggaaggaggcgtgctgtttggctttgagccgcaacagaggagagcggctatgagccaaacaaacctggcggcagcgcaaaagatg

SEQ ID NO: 182872 - DNA, 103 bp, Artificial Sequence
  Synthetic Polynucleotide
taatacgactcactatagggggggtagctgaaggaggcgtgctgtttggcaacagaggagagccaaaatgcacgcctccaacctggcggcagcgcaaaagatg

SEQ ID NO: 182873 - DNA, 103 bp, Artificial Sequence
  Synthetic Polynucleotide
taatacgactcactatagggcgtgcacagcggggtagctgaaggaggcgtaacagaggagaacgcctatgtcagctaccaacctggcggcagcgcaaaagatg

SEQ ID NO: 182874 - DNA, 103 bp, Artificial Sequence
  Synthetic Polynucleotide
taatacgactcactataggggggggcggcccgtgcacagcggggtagctgaacagaggagacagctaatgcgctgtgcaaacctggcggcagcgcaaaagatg

SEQ ID NO: 182875 - DNA, 103 bp, Artificial Sequence
  Synthetic Polynucleotide
taatacgactcactataggggttggctgccgggggcggcccgtgcacagcaacagaggagagctgtgatggggccgcccaacctggcggcagcgcaaaagatg

SEQ ID NO: 182876 - DNA, 103 bp, Artificial Sequence
  Synthetic Polynucleotide
taatacgactcactatagggacggactaaggttggctgccgggggcggccaacagaggagaggccgcatgcggcagccaaacctggcggcagcgcaaaagatg

SEQ ID NO: 182877 - DNA, 103 bp, Artificial Sequence
  Synthetic Polynucleotide
taatacgactcactataggggcgtactggcacggactaaggttggctgccaacagaggagaggcagcatgccttagtccaacctggcggcagcgcaaaagatg

SEQ ID NO: 182878 - DNA, 103 bp, Artificial Sequence
  Synthetic Polynucleotide
taatacgactcactatagggcctttccacggcgtactggcacggactaagaacagaggagacttagtatgtgccagtacaacctggcggcagcgcaaaagatg

SEQ ID NO: 182879 - DNA, 103 bp, Artificial Sequence
  Synthetic Polynucleotide
taatacgactcactatagggtcctggcccttgcagccgtgctctgggagcaacagaggagagctcccatggcacggctgaacctggcggcagcgcaaaagatg

SEQ ID NO: 182880 - DNA, 103 bp, Artificial Sequence
  Synthetic Polynucleotide
taatacgactcactatagggagcgggggctggggaggcatgttgcatcataacagaggagaatgatgatgcatgcctccaacctggcggcagcgcaaaagatg

SEQ ID NO: 182881 - DNA, 103 bp, Artificial Sequence
  Synthetic Polynucleotide
taatacgactcactatagggggccttggagggtggctgggcggttgccgtaacagaggagaacggcaatggcccagccaaacctggcggcagcgcaaaagatg

SEQ ID NO: 182882 - DNA, 103 bp, Artificial Sequence
  Synthetic Polynucleotide
taatacgactcactataggggatgaaccagttgtttacttgcaggagggtaacagaggagaaccctcatgcaagtaaacaacctggcggcagcgcaaaagatg

SEQ ID NO: 182883 - DNA, 103 bp, Artificial Sequence
  Synthetic Polynucleotide
taatacgactcactatagggtccgggcattgatgaaccagttgtttacttaacagaggagaaagtaaatgactggttcaaacctggcggcagcgcaaaagatg

SEQ ID NO: 182884 - DNA, 103 bp, Artificial Sequence
  Synthetic Polynucleotide
taatacgactcactatagggaggatgcgcctccgggcattgatgaaccagaacagaggagactggttatgcaatgcccgaacctggcggcagcgcaaaagatg

SEQ ID NO: 182885 - DNA, 103 bp, Artificial Sequence
  Synthetic Polynucleotide
taatacgactcactatagggcatgggctgcaggatgcgcctccgggcattaacagaggagaaatgccatgaggcgcatcaacctggcggcagcgcaaaagatg

SEQ ID NO: 182886 - DNA, 103 bp, Artificial Sequence
  Synthetic Polynucleotide
taatacgactcactatagggtggcatcaagcatgggctgcaggatgcgccaacagaggagaggcgcaatgtgcagcccaaacctggcggcagcgcaaaagatg

SEQ ID NO: 182887 - DNA, 103 bp, Artificial Sequence
  Synthetic Polynucleotide
taatacgactcactatagggtctgggttgctggcatcaagcatgggctgcaacagaggagagcagccatggcttgatgcaacctggcggcagcgcaaaagatg

SEQ ID NO: 182888 - DNA, 103 bp, Artificial Sequence
  Synthetic Polynucleotide
taatacgactcactataggggggggcaggatctgggttgctggcatcaagaacagaggagacttgatatgagcaacccaaacctggcggcagcgcaaaagatg

SEQ ID NO: 182889 - DNA, 103 bp, Artificial Sequence
  Synthetic Polynucleotide
taatacgactcactatagggtcttggctttgggggcaggatctgggttgcaacagaggagagcaaccatgatcctgcccaacctggcggcagcgcaaaagatg

SEQ ID NO: 182890 - DNA, 103 bp, Artificial Sequence
  Synthetic Polynucleotide
taatacgactcactataggggacttgatcttcttggctttgggggcaggaaacagaggagatcctgcatgcaaagccaaaacctggcggcagcgcaaaagatg

SEQ ID NO: 182891 - DNA, 103 bp, Artificial Sequence
  Synthetic Polynucleotide
taatacgactcactatagggccggtgctgagacttgatcttcttggctttaacagaggagaaaagccatgaagatcaagaacctggcggcagcgcaaaagatg

SEQ ID NO: 182892 - DNA, 103 bp, Artificial Sequence
  Synthetic Polynucleotide
taatacgactcactatagggggacagcctgggccttggagggtggctgggaacagaggagacccagcatgcctccaaggaacctggcggcagcgcaaaagatg

SEQ ID NO: 182893 - DNA, 103 bp, Artificial Sequence
  Synthetic Polynucleotide
taatacgactcactatagggtttgggtgggccggtgctgagacttgatctaacagaggagaagatcaatgctcagcaccaacctggcggcagcgcaaaagatg

SEQ ID NO: 182894 - DNA, 103 bp, Artificial Sequence
  Synthetic Polynucleotide
taatacgactcactatagggggccagaatctttgggtgggccggtgctgaaacagaggagatcagcaatggcccacccaaacctggcggcagcgcaaaagatg

SEQ ID NO: 182895 - DNA, 103 bp, Artificial Sequence
  Synthetic Polynucleotide
taatacgactcactataggggatggagttgggccagaatctttgggtgggaacagaggagacccaccatgagattctggaacctggcggcagcgcaaaagatg

SEQ ID NO: 182896 - DNA, 103 bp, Artificial Sequence
  Synthetic Polynucleotide
taatacgactcactatagggcccccgcagcgatggagttgggccagaatcaacagaggagagattctatgccaactccaaacctggcggcagcgcaaaagatg

SEQ ID NO: 182897 - DNA, 103 bp, Artificial Sequence
  Synthetic Polynucleotide
taatacgactcactatagggtgctgcagcacccccgcagcgatggagttgaacagaggagacaactcatgcgctgcgggaacctggcggcagcgcaaaagatg

SEQ ID NO: 182898 - DNA, 103 bp, Artificial Sequence
  Synthetic Polynucleotide
taatacgactcactatagggaccgccctgctgctgcagcacccccgcagcaacagaggagagctgcgatggtgctgcagaacctggcggcagcgcaaaagatg

SEQ ID NO: 182899 - DNA, 103 bp, Artificial Sequence
  Synthetic Polynucleotide
taatacgactcactatagggtccctggggcaccgccctgctgctgcagcaaacagaggagatgctgcatgagcagggcgaacctggcggcagcgcaaaagatg

SEQ ID NO: 182900 - DNA, 103 bp, Artificial Sequence
  Synthetic Polynucleotide
taatacgactcactatagggtcggggtttgtccctggggcaccgccctgcaacagaggagagcagggatgtgccccaggaacctggcggcagcgcaaaagatg

SEQ ID NO: 182901 - DNA, 103 bp, Artificial Sequence
  Synthetic Polynucleotide
taatacgactcactataggggatggaaccatcggggtttgtccctggggcaacagaggagagccccaatgacaaaccccaacctggcggcagcgcaaaagatg

SEQ ID NO: 182902 - DNA, 103 bp, Artificial Sequence
  Synthetic Polynucleotide
taatacgactcactatagggtgtccaagttgatggaaccatcggggtttgaacagaggagacaaaccatgatggttccaaacctggcggcagcgcaaaagatg

SEQ ID NO: 182903 - DNA, 103 bp, Artificial Sequence
  Synthetic Polynucleotide
taatacgactcactataggggcagagatgtggacagcctgggccttggagaacagaggagactccaaatgccaggctgtaacctggcggcagcgcaaaagatg

SEQ ID NO: 182904 - DNA, 103 bp, Artificial Sequence
  Synthetic Polynucleotide
taatacgactcactataggggactgcaggttgtccaagttgatggaaccaaacagaggagatggttcatgcaacttggaaacctggcggcagcgcaaaagatg

SEQ ID NO: 182905 - DNA, 103 bp, Artificial Sequence
  Synthetic Polynucleotide
taatacgactcactatagggtgaggacagggactgcaggttgtccaagttaacagaggagaaacttgatgaacctgcagaacctggcggcagcgcaaaagatg

SEQ ID NO: 182906 - DNA, 103 bp, Artificial Sequence
  Synthetic Polynucleotide
taatacgactcactatagggtggcactgtctgaggacagggactgcaggtaacagaggagaacctgcatgccctgtcctaacctggcggcagcgcaaaagatg

SEQ ID NO: 182907 - DNA, 103 bp, Artificial Sequence
  Synthetic Polynucleotide
taatacgactcactatagggatggccatggtggcactgtctgaggacaggaacagaggagacctgtcatgagacagtgcaacctggcggcagcgcaaaagatg

SEQ ID NO: 182908 - DNA, 103 bp, Artificial Sequence
  Synthetic Polynucleotide
taatacgactcactatagggagcctgctgcatggccatggtggcactgtcaacagaggagagacagtatgaccatggccaacctggcggcagcgcaaaagatg

SEQ ID NO: 182909 - DNA, 103 bp, Artificial Sequence
  Synthetic Polynucleotide
taatacgactcactatagggcagccatcatagcctgctgcatggccatggaacagaggagaccatggatgtgcagcaggaacctggcggcagcgcaaaagatg

SEQ ID NO: 182910 - DNA, 103 bp, Artificial Sequence
  Synthetic Polynucleotide
taatacgactcactatagggtcatcgtgtgcagccatcatagcctgctgcaacagaggagagcagcaatgtatgatggcaacctggcggcagcgcaaaagatg

SEQ ID NO: 182911 - DNA, 103 bp, Artificial Sequence
  Synthetic Polynucleotide
taatacgactcactatagggatccaatgagtcatcgtgtgcagccatcataacagaggagaatgatgatggcacacgataacctggcggcagcgcaaaagatg

SEQ ID NO: 182912 - DNA, 103 bp, Artificial Sequence
  Synthetic Polynucleotide
taatacgactcactatagggcttctgtcccatccaatgagtcatcgtgtgaacagaggagacacacgatgactcattggaacctggcggcagcgcaaaagatg

SEQ ID NO: 182913 - DNA, 103 bp, Artificial Sequence
  Synthetic Polynucleotide
taatacgactcactatagggtcatcctcttcttctgtcccatccaatgagaacagaggagactcattatgtgggacagaaacctggcggcagcgcaaaagatg

SEQ ID NO: 182914 - DNA, 103 bp, Artificial Sequence
  Synthetic Polynucleotide
taatacgactcactatagggagctgagggggcagagatgtggacagcctgaacagaggagacaggctatgcacatctctaacctggcggcagcgcaaaagatg

SEQ ID NO: 182915 - DNA, 103 bp, Artificial Sequence
  Synthetic Polynucleotide
taatacgactcactatagggcatctcatcctcatcctcttcttctgtcccaacagaggagagggacaatggaagaggataacctggcggcagcgcaaaagatg

SEQ ID NO: 182916 - DNA, 103 bp, Artificial Sequence
  Synthetic Polynucleotide
taatacgactcactatagggcctcctcttccatctcatcctcatcctcttaacagaggagaaagaggatgaggatgagaaacctggcggcagcgcaaaagatg

SEQ ID NO: 182917 - DNA, 103 bp, Artificial Sequence
  Synthetic Polynucleotide
taatacgactcactatagggtcctcctcctcctcctcttccatctcatccaacagaggagaggatgaatgggaagaggaaacctggcggcagcgcaaaagatg

SEQ ID NO: 182918 - DNA, 103 bp, Artificial Sequence
  Synthetic Polynucleotide
taatacgactcactatagggctcctccagctcctcctcctcctcctcttcaacagaggagagaagagatggaggaggagaacctggcggcagcgcaaaagatg

SEQ ID NO: 182919 - DNA, 103 bp, Artificial Sequence
  Synthetic Polynucleotide
taatacgactcactatagggcgtcgacctcctcctccagctcctcctcctaacagaggagaaggaggatgagctggaggaacctggcggcagcgcaaaagatg

SEQ ID NO: 182920 - DNA, 103 bp, Artificial Sequence
  Synthetic Polynucleotide
taatacgactcactataggggtctgcagctcgtcgacctcctcctccagcaacagaggagagctggaatgggaggtcgaaacctggcggcagcgcaaaagatg

SEQ ID NO: 182921 - DNA, 103 bp, Artificial Sequence
  Synthetic Polynucleotide
taatacgactcactataggggacatttgtcgtctgcagctcgtcgacctcaacagaggagagaggtcatggagctgcagaacctggcggcagcgcaaaagatg

SEQ ID NO: 182922 - DNA, 103 bp, Artificial Sequence
  Synthetic Polynucleotide
taatacgactcactatagggccaggtcgctgacatttgtcgtctgcagctaacagaggagaagctgcatgcgacaaatgaacctggcggcagcgcaaaagatg

SEQ ID NO: 182923 - DNA, 103 bp, Artificial Sequence
  Synthetic Polynucleotide
taatacgactcactatagggtgttccaagcccaggtcgctgacatttgtcaacagaggagagacaaaatgcagcgacctaacctggcggcagcgcaaaagatg

SEQ ID NO: 182924 - DNA, 103 bp, Artificial Sequence
  Synthetic Polynucleotide
taatacgactcactatagggggagtcactgtgttccaagcccaggtcgctaacagaggagaagcgacatgggcttggaaaacctggcggcagcgcaaaagatg

SEQ ID NO: 182925 - DNA, 103 bp, Artificial Sequence
  Synthetic Polynucleotide
taatacgactcactatagggtgctggcagcagctgagggggcagagatgtaacagaggagaacatctatgccccctcagaacctggcggcagcgcaaaagatg

SEQ ID NO: 182926 - DNA, 103 bp, Artificial Sequence
  Synthetic Polynucleotide
taatacgactcactatagggggcacaggtgtgctggcagcagctgaggggaacagaggagacccctcatgtgctgccagaacctggcggcagcgcaaaagatg

SEQ ID NO: 182927 - DNA, 103 bp, Artificial Sequence
  Synthetic Polynucleotide
taatacgactcactataggggggggcactgggcacaggtgtgctggcagcaacagaggagagctgccatgacacctgtgaacctggcggcagcgcaaaagatg

SEQ ID NO: 182928 - DNA, 103 bp, Artificial Sequence
  Synthetic Polynucleotide
taatacgactcactataggggggggtcgatgggggcactgggcacaggtgaacagaggagacacctgatgccagtgcccaacctggcggcagcgcaaaagatg

SEQ ID NO: 182929 - DNA, 103 bp, Artificial Sequence
  Synthetic Polynucleotide
taatacgactcactatagggagctgggcctgggggtcgatgggggcactgaacagaggagacagtgcatgcatcgacccaacctggcggcagcgcaaaagatg

SEQ ID NO: 182930 - DNA, 103 bp, Artificial Sequence
  Synthetic Polynucleotide
taatacgactcactataggggtcagcctccagctgggcctgggggtcgataacagaggagaatcgacatgcaggcccagaacctggcggcagcgcaaaagatg

SEQ ID NO: 182931 - DNA, 103 bp, Artificial Sequence
  Synthetic Polynucleotide
taatacgactcactatagggtcatcgtcagagcgggggctggggaggcataacagaggagaatgcctatgcagcccccgaacctggcggcagcgcaaaagatg

SEQ ID NO: 182932 - DNA, 103 bp, Artificial Sequence
  Synthetic Polynucleotide
taatacgactcactatagggcagctcgcttgtcagcctccagctgggcctaacagaggagaaggcccatgtggaggctgaacctggcggcagcgcaaaagatg

SEQ ID NO: 182933 - DNA, 103 bp, Artificial Sequence
  Synthetic Polynucleotide
taatacgactcactatagggtgcctgtatacagctcgcttgtcagcctccaacagaggagaggaggcatgcaagcgagcaacctggcggcagcgcaaaagatg

SEQ ID NO: 182934 - DNA, 103 bp, Artificial Sequence
  Synthetic Polynucleotide
taatacgactcactataggggaaaagagggtgcctgtatacagctcgcttaacagaggagaaagcgaatggtatacaggaacctggcggcagcgcaaaagatg

SEQ ID NO: 182935 - DNA, 103 bp, Artificial Sequence
  Synthetic Polynucleotide
taatacgactcactatagggtcaggagcgggaaaagagggtgcctgtataaacagaggagatatacaatgaccctctttaacctggcggcagcgcaaaagatg

SEQ ID NO: 182936 - DNA, 103 bp, Artificial Sequence
  Synthetic Polynucleotide
taatacgactcactatagggaacagcagcgtcaggagcgggaaaagagggaacagaggagaccctctatgcccgctcctaacctggcggcagcgcaaaagatg

SEQ ID NO: 182937 - DNA, 103 bp, Artificial Sequence
  Synthetic Polynucleotide
taatacgactcactatagggacatttctcaaacagcagcgtcaggagcggaacagaggagaccgctcatgacgctgctgaacctggcggcagcgcaaaagatg

SEQ ID NO: 182938 - DNA, 103 bp, Artificial Sequence
  Synthetic Polynucleotide
taatacgactcactatagggtggcctgttcacatttctcaaacagcagcgaacagaggagacgctgcatgttgagaaataacctggcggcagcgcaaaagatg

SEQ ID NO: 182939 - DNA, 103 bp, Artificial Sequence
  Synthetic Polynucleotide
taatacgactcactataggggagccctgggtggcctgttcacatttctcaaacagaggagatgagaaatgtgaacaggcaacctggcggcagcgcaaaagatg

SEQ ID NO: 182940 - DNA, 103 bp, Artificial Sequence
  Synthetic Polynucleotide
taatacgactcactataggggatgcactcagagccctgggtggcctgttcaacagaggagagaacagatgacccagggcaacctggcggcagcgcaaaagatg

SEQ ID NO: 182941 - DNA, 103 bp, Artificial Sequence
  Synthetic Polynucleotide
taatacgactcactatagggtggcggaggtgatgcactcagagccctgggaacagaggagacccaggatgctgagtgcaaacctggcggcagcgcaaaagatg

SEQ ID NO: 182942 - DNA, 103 bp, Artificial Sequence
  Synthetic Polynucleotide
taatacgactcactatagggtgcgtggccatcatcgtcagagcgggggctaacagaggagaagccccatgtctgacgataacctggcggcagcgcaaaagatg

SEQ ID NO: 182943 - DNA, 103 bp, Artificial Sequence
  Synthetic Polynucleotide
taatacgactcactatagggacatcaaagctggcggaggtgatgcactcaaacagaggagatgagtgatgcacctccgcaacctggcggcagcgcaaaagatg

SEQ ID NO: 182944 - DNA, 103 bp, Artificial Sequence
  Synthetic Polynucleotide
taatacgactcactatagggctcgatgtccacatcaaagctggcggaggtaacagaggagaacctccatgagctttgataacctggcggcagcgcaaaagatg

SEQ ID NO: 182945 - DNA, 103 bp, Artificial Sequence
  Synthetic Polynucleotide
taatacgactcactatagggggacaaagttctcgatgtccacatcaaagcaacagaggagagctttgatgtggacatcgaacctggcggcagcgcaaaagatg

SEQ ID NO: 182946 - DNA, 103 bp, Artificial Sequence
  Synthetic Polynucleotide
taatacgactcactatagggtcctgctggtggacaaagttctcgatgtccaacagaggagaggacatatggaactttgtaacctggcggcagcgcaaaagatg

SEQ ID NO: 182947 - DNA, 103 bp, Artificial Sequence
  Synthetic Polynucleotide
taatacgactcactataggggtgctcctgttcctgctggtggacaaagttaacagaggagaaactttatgcaccagcagaacctggcggcagcgcaaaagatg

SEQ ID NO: 182948 - DNA, 103 bp, Artificial Sequence
  Synthetic Polynucleotide
taatacgactcactatagggagaagggtttgtgctcctgttcctgctggtaacagaggagaaccagcatgaacaggagcaacctggcggcagcgcaaaagatg

SEQ ID NO: 182949 - DNA, 103 bp, Artificial Sequence
  Synthetic Polynucleotide
taatacgactcactatagggtcatcgctgaagaagggtttgtgctcctgtaacagaggagaacaggaatgcaaacccttaacctggcggcagcgcaaaagatg

SEQ ID NO: 182950 - DNA, 103 bp, Artificial Sequence
  Synthetic Polynucleotide
taatacgactcactatagggcagttctgggtcatcgctgaagaagggtttaacagaggagaaaacccatgttcagcgataacctggcggcagcgcaaaagatg

SEQ ID NO: 182951 - DNA, 103 bp, Artificial Sequence
  Synthetic Polynucleotide
taatacgactcactatagggtcagattgtccagttctgggtcatcgctgaaacagaggagatcagcgatgacccagaacaacctggcggcagcgcaaaagatg

SEQ ID NO: 182952 - DNA, 103 bp, Artificial Sequence
  Synthetic Polynucleotide
taatacgactcactataggggccttcaccatcagattgtccagttctgggaacagaggagacccagaatgggacaatctaacctggcggcagcgcaaaagatg

SEQ ID NO: 182953 - DNA, 103 bp, Artificial Sequence
  Synthetic Polynucleotide
taatacgactcactatagggcgggacattctgcgtggccatcatcgtcagaacagaggagactgacgatgatggccacgaacctggcggcagcgcaaaagatg

SEQ ID NO: 182954 - DNA, 103 bp, Artificial Sequence
  Synthetic Polynucleotide
taatacgactcactataggggacctggattgccttcaccatcagattgtcaacagaggagagacaatatgatggtgaagaacctggcggcagcgcaaaagatg

SEQ ID NO: 182955 - DNA, 103 bp, Artificial Sequence
  Synthetic Polynucleotide
taatacgactcactatagggggattctcaggacctggattgccttcaccaaacagaggagatggtgaatgcaatccaggaacctggcggcagcgcaaaagatg

SEQ ID NO: 182956 - DNA, 103 bp, Artificial Sequence
  Synthetic Polynucleotide
taatacgactcactatagggtccagcaggtggattctcaggacctggattaacagaggagaaatccaatgcctgagaataacctggcggcagcgcaaaagatg

SEQ ID NO: 182957 - DNA, 103 bp, Artificial Sequence
  Synthetic Polynucleotide
taatacgactcactatagggtttctccagctccagcaggtggattctcagaacagaggagactgagaatgcacctgctgaacctggcggcagcgcaaaagatg

SEQ ID NO: 182958 - DNA, 103 bp, Artificial Sequence
  Synthetic Polynucleotide
taatacgactcactataggggttcattgactttctccagctccagcaggtaacagaggagaacctgcatgagctggagaaacctggcggcagcgcaaaagatg

SEQ ID NO: 182959 - DNA, 103 bp, Artificial Sequence
  Synthetic Polynucleotide
taatacgactcactatagggtccttgcagagttcattgactttctccagcaacagaggagagctggaatgagtcaatgaaacctggcggcagcgcaaaagatg

SEQ ID NO: 182960 - DNA, 103 bp, Artificial Sequence
  Synthetic Polynucleotide
taatacgactcactataggggttacaaaagtccttgcagagttcattgacaacagaggagagtcaatatgctctgcaagaacctggcggcagcgcaaaagatg

SEQ ID NO: 182961 - DNA, 103 bp, Artificial Sequence
  Synthetic Polynucleotide
taatacgactcactatagggtgatgtaacggttacaaaagtccttgcagaaacagaggagatctgcaatgacttttgtaaacctggcggcagcgcaaaagatg

SEQ ID NO: 182962 - DNA, 103 bp, Artificial Sequence
  Synthetic Polynucleotide
taatacgactcactatagggttgaggcaggtgatgtaacggttacaaaagaacagaggagacttttgatgccgttacataacctggcggcagcgcaaaagatg

SEQ ID NO: 182963 - DNA, 103 bp, Artificial Sequence
  Synthetic Polynucleotide
taatacgactcactatagggcatcttggttttgaggcaggtgatgtaacgaacagaggagacgttacatgacctgcctcaacctggcggcagcgcaaaagatg

SEQ ID NO: 182964 - DNA, 103 bp, Artificial Sequence
  Synthetic Polynucleotide
taatacgactcactatagggagggtgggggcgggacattctgcgtggccaaacagaggagatggccaatgagaatgtccaacctggcggcagcgcaaaagatg

SEQ ID NO: 182965 - DNA, 103 bp, Artificial Sequence
  Synthetic Polynucleotide
taatacgactcactatagggtgtcgctgtgcatcttggttttgaggcaggaacagaggagacctgccatgaaaccaagaaacctggcggcagcgcaaaagatg

SEQ ID NO: 182966 - DNA, 103 bp, Artificial Sequence
  Synthetic Polynucleotide
taatacgactcactatagggctgagcaggttgtcgctgtgcatcttggttaacagaggagaaaccaaatggcacagcgaaacctggcggcagcgcaaaagatg

SEQ ID NO: 182967 - DNA, 103 bp, Artificial Sequence
  Synthetic Polynucleotide
taatacgactcactatagggtagatcattcctgagcaggttgtcgctgtgaacagaggagacacagcatgaacctgctcaacctggcggcagcgcaaaagatg

SEQ ID NO: 182968 - DNA, 103 bp, Artificial Sequence
  Synthetic Polynucleotide
taatacgactcactatagggagggcccccctagatcattcctgagcaggtaacagaggagaacctgcatgggaatgatcaacctggcggcagcgcaaaagatg

SEQ ID NO: 182969 - DNA, 103 bp, Artificial Sequence
  Synthetic Polynucleotide
taatacgactcactatagggttgggggagtagggcccccctagatcattcaacagaggagagaatgaatgaggggggccaacctggcggcagcgcaaaagatg

SEQ ID NO: 182970 - DNA, 103 bp, Artificial Sequence
  Synthetic Polynucleotide
taatacgactcactatagggggagggctggttgggggagtagggccccccaacagaggagaggggggatgtactcccccaacctggcggcagcgcaaaagatg

SEQ ID NO: 182971 - DNA, 103 bp, Artificial Sequence
  Synthetic Polynucleotide
taatacgactcactataggggaaggttgatggagggctggttgggggagtaacagaggagaactcccatgaccagccctaacctggcggcagcgcaaaagatg

SEQ ID NO: 182972 - DNA, 103 bp, Artificial Sequence
  Synthetic Polynucleotide
taatacgactcactatagggtcctgtgagtgaaggttgatggagggctggaacagaggagaccagccatgcatcaacctaacctggcggcagcgcaaaagatg

SEQ ID NO: 182973 - DNA, 103 bp, Artificial Sequence
  Synthetic Polynucleotide
taatacgactcactatagggctgcaggaggtcctgtgagtgaaggttgataacagaggagaatcaacatgcactcacagaacctggcggcagcgcaaaagatg

SEQ ID NO: 182974 - DNA, 103 bp, Artificial Sequence
  Synthetic Polynucleotide
taatacgactcactatagggtgggggaattctgcaggaggtcctgtgagtaacagaggagaactcacatgacctcctgcaacctggcggcagcgcaaaagatg

SEQ ID NO: 182975 - DNA, 103 bp, Artificial Sequence
  Synthetic Polynucleotide
taatacgactcactatagggctgtcctggtagggtgggggcgggacattcaacagaggagagaatgtatggcccccaccaacctggcggcagcgcaaaagatg

SEQ ID NO: 182976 - DNA, 103 bp, Artificial Sequence
  Synthetic Polynucleotide
taatacgactcactataggggacatggaattgggggaattctgcaggaggaacagaggagacctcctatggaattccccaacctggcggcagcgcaaaagatg

SEQ ID NO: 182977 - DNA, 103 bp, Artificial Sequence
  Synthetic Polynucleotide
taatacgactcactatagggggagactccggacatggaattgggggaattaacagaggagaaattccatgaattccatgaacctggcggcagcgcaaaagatg

SEQ ID NO: 182978 - DNA, 103 bp, Artificial Sequence
  Synthetic Polynucleotide
taatacgactcactataggggggggttattggagactccggacatggaataacagaggagaattccaatgccggagtctaacctggcggcagcgcaaaagatg

SEQ ID NO: 182979 - DNA, 103 bp, Artificial Sequence
  Synthetic Polynucleotide
taatacgactcactatagggacaatcccctgggggttattggagactccgaacagaggagacggagtatgcaataacccaacctggcggcagcgcaaaagatg

SEQ ID NO: 182980 - DNA, 103 bp, Artificial Sequence
  Synthetic Polynucleotide
taatacgactcactatagggggctgggaccacaatcccctgggggttattaacagaggagaaataacatgcaggggattaacctggcggcagcgcaaaagatg

SEQ ID NO: 182981 - DNA, 103 bp, Artificial Sequence
  Synthetic Polynucleotide
taatacgactcactatagggggagcgctgaggctgggaccacaatcccctaacagaggagaaggggaatgtggtcccagaacctggcggcagcgcaaaagatg

SEQ ID NO: 182982 - DNA, 103 bp, Artificial Sequence
  Synthetic Polynucleotide
taatacgactcactatagggttgccctgctggagcgctgaggctgggaccaacagaggagaggtcccatgctcagcgctaacctggcggcagcgcaaaagatg

SEQ ID NO: 182983 - DNA, 103 bp, Artificial Sequence
  Synthetic Polynucleotide
taatacgactcactatagggcatggcgatgttgccctgctggagcgctgaaacagaggagatcagcgatgcagcagggcaacctggcggcagcgcaaaagatg

SEQ ID NO: 182984 - DNA, 103 bp, Artificial Sequence
  Synthetic Polynucleotide
taatacgactcactatagggtgacggttgtcatggcgatgttgccctgctaacagaggagaagcaggatgacatcgccaaacctggcggcagcgcaaaagatg

SEQ ID NO: 182985 - DNA, 103 bp, Artificial Sequence
  Synthetic Polynucleotide
taatacgactcactatagggacttgtgagttgacggttgtcatggcgatgaacagaggagacatcgcatggacaaccgtaacctggcggcagcgcaaaagatg

SEQ ID NO: 182986 - DNA, 103 bp, Artificial Sequence
  Synthetic Polynucleotide
taatacgactcactatagggcatctgtgggctgtcctggtagggtgggggaacagaggagacccccaatgtaccaggacaacctggcggcagcgcaaaagatg

SEQ ID NO: 182987 - DNA, 103 bp, Artificial Sequence
  Synthetic Polynucleotide
taatacgactcactatagggacctgacacaacttgtgagttgacggttgtaacagaggagaacaaccatgaactcacaaaacctggcggcagcgcaaaagatg

SEQ ID NO: 182988 - DNA, 103 bp, Artificial Sequence
  Synthetic Polynucleotide
taatacgactcactatagggataaggctccacctgacacaacttgtgagtaacagaggagaactcacatgttgtgtcagaacctggcggcagcgcaaaagatg

SEQ ID NO: 182989 - DNA, 103 bp, Artificial Sequence
  Synthetic Polynucleotide
taatacgactcactatagggaccggttggtataaggctccacctgacacaaacagaggagatgtgtcatgtggagccttaacctggcggcagcgcaaaagatg

SEQ ID NO: 182990 - DNA, 103 bp, Artificial Sequence
  Synthetic Polynucleotide
taatacgactcactatagggtaccatggtaaccggttggtataaggctccaacagaggagaggagccatgtaccaaccgaacctggcggcagcgcaaaagatg

SEQ ID NO: 182991 - DNA, 103 bp, Artificial Sequence
  Synthetic Polynucleotide
taatacgactcactatagggcctgggaggttaccatggtaaccggttggtaacagaggagaaccaacatgttaccatggaacctggcggcagcgcaaaagatg

SEQ ID NO: 182992 - DNA, 103 bp, Artificial Sequence
  Synthetic Polynucleotide
taatacgactcactatagggaccacctgaccctgggaggttaccatggtaaacagaggagataccatatgaacctcccaaacctggcggcagcgcaaaagatg

SEQ ID NO: 182993 - DNA, 103 bp, Artificial Sequence
  Synthetic Polynucleotide
taatacgactcactatagggtgcttgggtgaccacctgaccctgggaggtaacagaggagaacctccatgggtcaggtgaacctggcggcagcgcaaaagatg

SEQ ID NO: 182994 - DNA, 103 bp, Artificial Sequence
  Synthetic Polynucleotide
taatacgactcactatagggcctgggggattgcttgggtgaccacctgacaacagaggagagtcaggatgtcacccaagaacctggcggcagcgcaaaagatg

SEQ ID NO: 182995 - DNA, 103 bp, Artificial Sequence
  Synthetic Polynucleotide
taatacgactcactatagggtggatggctccctgggggattgcttgggtgaacagaggagacacccaatgaatcccccaaacctggcggcagcgcaaaagatg

SEQ ID NO: 182996 - DNA, 103 bp, Artificial Sequence
  Synthetic Polynucleotide
taatacgactcactataggggttctggatctggatggctccctgggggataacagaggagaatccccatgggagccatcaacctggcggcagcgcaaaagatg

SEQ ID NO: 182997 - DNA, 103 bp, Artificial Sequence
  Synthetic Polynucleotide
taatacgactcactatagggcggttgccgtcatctgtgggctgtcctggtaacagaggagaaccaggatggcccacagaaacctggcggcagcgcaaaagatg

SEQ ID NO: 182998 - DNA, 103 bp, Artificial Sequence
  Synthetic Polynucleotide
taatacgactcactatagggtaacctgtgtgttctggatctggatggctcaacagaggagagagccaatgagatccagaaacctggcggcagcgcaaaagatg

SEQ ID NO: 182999 - DNA, 103 bp, Artificial Sequence
  Synthetic Polynucleotide
taatacgactcactatagggaggtcaaggttaacctgtgtgttctggatcaacagaggagagatccaatgcacacaggtaacctggcggcagcgcaaaagatg

SEQ ID NO: 183000 - DNA, 103 bp, Artificial Sequence
  Synthetic Polynucleotide
taatacgactcactataggggagggaggtgaggtcaaggttaacctgtgtaacagaggagaacacagatgaaccttgacaacctggcggcagcgcaaaagatg

SEQ ID NO: 183001 - DNA, 103 bp, Artificial Sequence
  Synthetic Polynucleotide
taatacgactcactatagggcattgtccaggagggaggtgaggtcaaggtaacagaggagaaccttgatgtcacctcccaacctggcggcagcgcaaaagatg

SEQ ID NO: 183002 - DNA, 103 bp, Artificial Sequence
  Synthetic Polynucleotide
taatacgactcactatagggttcttatcctcattgtccaggagggaggtgaacagaggagacacctcatgcctggacaaaacctggcggcagcgcaaaagatg

SEQ ID NO: 183003 - DNA, 103 bp, Artificial Sequence
  Synthetic Polynucleotide
taatacgactcactataggggttcttggacttcttatcctcattgtccagaacagaggagactggacatggaggataagaacctggcggcagcgcaaaagatg

SEQ ID NO: 183004 - DNA, 103 bp, Artificial Sequence
  Synthetic Polynucleotide
taatacgactcactatagggctcctcgtttgttcttggacttcttatcctaacagaggagaaggataatgagtccaagaaacctggcggcagcgcaaaagatg

SEQ ID NO: 183005 - DNA, 103 bp, Artificial Sequence
  Synthetic Polynucleotide
taatacgactcactatagggttgggcaagactcctcgtttgttcttggacaacagaggagagtccaaatgcaaacgaggaacctggcggcagcgcaaaagatg

SEQ ID NO: 183006 - DNA, 103 bp, Artificial Sequence
  Synthetic Polynucleotide
taatacgactcactatagggggtggcatgcttgggcaagactcctcgtttaacagaggagaaaacgaatggtcttgcccaacctggcggcagcgcaaaagatg

SEQ ID NO: 183007 - DNA, 103 bp, Artificial Sequence
  Synthetic Polynucleotide
taatacgactcactataggggcattatattggtggcatgcttgggcaagaaacagaggagatcttgcatgagcatgccaaacctggcggcagcgcaaaagatg

SEQ ID NO: 183008 - DNA, 103 bp, Artificial Sequence
  Synthetic Polynucleotide
taatacgactcactatagggggtggctgggcggttgccgtcatctgtgggaacagaggagacccacaatggacggcaacaacctggcggcagcgcaaaagatg

SEQ ID NO: 183009 - DNA, 103 bp, Artificial Sequence
  Synthetic Polynucleotide
taatacgactcactatagggagccaagaacgcattatattggtggcatgcaacagaggagagcatgcatgcaatataataacctggcggcagcgcaaaagatg

SEQ ID NO: 183010 - DNA, 103 bp, Artificial Sequence
  Synthetic Polynucleotide
taatacgactcactatagggatgctggaagagccaagaacgcattatattaacagaggagaaatataatgcgttcttggaacctggcggcagcgcaaaagatg

SEQ ID NO: 183011 - DNA, 103 bp, Artificial Sequence
  Synthetic Polynucleotide
taatacgactcactatagggggtgcatgagatgctggaagagccaagaacaacagaggagagttcttatgtcttccagcaacctggcggcagcgcaaaagatg

SEQ ID NO: 183012 - DNA, 103 bp, Artificial Sequence
  Synthetic Polynucleotide
taatacgactcactataggggtggggtaggggtgcatgagatgctggaagaacagaggagacttccaatgtctcatgcaaacctggcggcagcgcaaaagatg

SEQ ID NO: 183013 - DNA, 103 bp, Artificial Sequence
  Synthetic Polynucleotide
taatacgactcactatagggctcatcctccgtggggtaggggtgcatgagaacagaggagactcatgatgccctaccccaacctggcggcagcgcaaaagatg

SEQ ID NO: 183014 - DNA, 103 bp, Artificial Sequence
  Synthetic Polynucleotide
taatacgactcactatagggtctgcctcttctcatcctccgtggggtaggaacagaggagacctaccatgcggaggatgaacctggcggcagcgcaaaagatg

SEQ ID NO: 183015 - DNA, 103 bp, Artificial Sequence
  Synthetic Polynucleotide
taatacgactcactatagggtgggctgcgatctgcctcttctcatcctccaacagaggagaggaggaatggaagaggcaaacctggcggcagcgcaaaagatg

SEQ ID NO: 183016 - DNA, 103 bp, Artificial Sequence
  Synthetic Polynucleotide
taatacgactcactataggggaggttggtctgggctgcgatctgcctcttaacagaggagaaagaggatgatcgcagccaacctggcggcagcgcaaaagatg

SEQ ID NO: 183017 - DNA, 103 bp, Artificial Sequence
  Synthetic Polynucleotide
taatacgactcactataggggcaggagggtgaggttggtctgggctgcgaaacagaggagatcgcagatgagaccaaccaacctggcggcagcgcaaaagatg

SEQ ID NO: 183018 - DNA, 103 bp, Artificial Sequence
  Synthetic Polynucleotide
taatacgactcactatagggttgtttacttgcaggagggtgaggttggtcaacagaggagagaccaaatgcaccctcctaacctggcggcagcgcaaaagatg

SEQ ID NO: 183019 - DNA, 103 bp, Artificial Sequence
  Synthetic Polynucleotide
taatacgactcactatagggtgacaaatcaccaggaatgacagtggccataacagaggagaatggccatggtcattcctaacctggcggcagcgcaaaagatg

SEQ ID NO: 183020 - DNA, 103 bp, Artificial Sequence
  Synthetic Polynucleotide
taatacgactcactataggggtcacacagttggcaaggaaagttttttctaacagaggagaagaaaaatgtttccttgcaacctggcggcagcgcaaaagatg

SEQ ID NO: 183021 - DNA, 103 bp, Artificial Sequence
  Synthetic Polynucleotide
taatacgactcactatagggtgaggtagaactgaacggatatttgaaagaaacagaggagatctttcatgtatccgttcaacctggcggcagcgcaaaagatg

SEQ ID NO: 183022 - DNA, 103 bp, Artificial Sequence
  Synthetic Polynucleotide
taatacgactcactatagggaaattgcatatgaggtagaactgaacggataacagaggagaatccgtatggttctacctaacctggcggcagcgcaaaagatg

SEQ ID NO: 183023 - DNA, 103 bp, Artificial Sequence
  Synthetic Polynucleotide
taatacgactcactatagggtcaggaatagaaattgcatatgaggtagaaaacagaggagattctacatgatatgcaataacctggcggcagcgcaaaagatg

SEQ ID NO: 183024 - DNA, 103 bp, Artificial Sequence
  Synthetic Polynucleotide
taatacgactcactatagggctgttctttttcaggaatagaaattgcataaacagaggagatatgcaatgtctattcctaacctggcggcagcgcaaaagatg

SEQ ID NO: 183025 - DNA, 103 bp, Artificial Sequence
  Synthetic Polynucleotide
taatacgactcactatagggcctttaatggctgttctttttcaggaatagaacagaggagactattcatgaaaaagaacaacctggcggcagcgcaaaagatg

SEQ ID NO: 183026 - DNA, 103 bp, Artificial Sequence
  Synthetic Polynucleotide
taatacgactcactatagggtcaatttccccctttaatggctgttcttttaacagaggagaaaaagaatggccattaaaaacctggcggcagcgcaaaagatg

SEQ ID NO: 183027 - DNA, 103 bp, Artificial Sequence
  Synthetic Polynucleotide
taatacgactcactatagggcaggtaactctcaatttccccctttaatggaacagaggagaccattaatgggggaaattaacctggcggcagcgcaaaagatg

SEQ ID NO: 183028 - DNA, 103 bp, Artificial Sequence
  Synthetic Polynucleotide
taatacgactcactataggggtaactccatcaggtaactctcaatttcccaacagaggagagggaaaatgagagttaccaacctggcggcagcgcaaaagatg

SEQ ID NO: 183029 - DNA, 103 bp, Artificial Sequence
  Synthetic Polynucleotide
taatacgactcactatagggacgccaccttgtaactccatcaggtaactcaacagaggagagagttaatggatggagttaacctggcggcagcgcaaaagatg

SEQ ID NO: 183030 - DNA, 103 bp, Artificial Sequence
  Synthetic Polynucleotide
taatacgactcactatagggtgaagagggcacgccaccttgtaactccataacagaggagaatggagatgcaaggtggcaacctggcggcagcgcaaaagatg

SEQ ID NO: 183031 - DNA, 103 bp, Artificial Sequence
  Synthetic Polynucleotide
taatacgactcactatagggtaaaggccttgtcacacagttggcaaggaaaacagaggagattccttatgaactgtgtgaacctggcggcagcgcaaaagatg

SEQ ID NO: 183032 - DNA, 103 bp, Artificial Sequence
  Synthetic Polynucleotide
taatacgactcactatagggaatcttgggatgaagagggcacgccaccttaacagaggagaaaggtgatgtgccctcttaacctggcggcagcgcaaaagatg

SEQ ID NO: 183033 - DNA, 103 bp, Artificial Sequence
  Synthetic Polynucleotide
taatacgactcactataggggatgcttgagaatcttgggatgaagagggcaacagaggagagccctcatgatcccaagaaacctggcggcagcgcaaaagatg

SEQ ID NO: 183034 - DNA, 103 bp, Artificial Sequence
  Synthetic Polynucleotide
taatacgactcactatagggagatgatgacgatgcttgagaatcttgggaaacagaggagatcccaaatgtctcaagcaaacctggcggcagcgcaaaagatg

SEQ ID NO: 183035 - DNA, 103 bp, Artificial Sequence
  Synthetic Polynucleotide
taatacgactcactatagggaccctagcttagatgatgacgatgcttgagaacagaggagactcaagatgcgtcatcataacctggcggcagcgcaaaagatg

SEQ ID NO: 183036 - DNA, 103 bp, Artificial Sequence
  Synthetic Polynucleotide
taatacgactcactatagggtgaggatccaaccctagcttagatgatgacaacagaggagagtcatcatgtaagctaggaacctggcggcagcgcaaaagatg

SEQ ID NO: 183037 - DNA, 103 bp, Artificial Sequence
  Synthetic Polynucleotide
taatacgactcactatagggggacccaatctgaggatccaaccctagcttaacagaggagaaagctaatgttggatcctaacctggcggcagcgcaaaagatg

SEQ ID NO: 183038 - DNA, 103 bp, Artificial Sequence
  Synthetic Polynucleotide
taatacgactcactatagggcatcatctagggacccaatctgaggatccaaacagaggagatggatcatgagattgggtaacctggcggcagcgcaaaagatg

SEQ ID NO: 183039 - DNA, 103 bp, Artificial Sequence
  Synthetic Polynucleotide
taatacgactcactatagggtctcctgcaccatcatctagggacccaatcaacagaggagagattggatgcctagatgaaacctggcggcagcgcaaaagatg

SEQ ID NO: 183040 - DNA, 103 bp, Artificial Sequence
  Synthetic Polynucleotide
taatacgactcactatagggtagggagaggtctcctgcaccatcatctagaacagaggagactagatatgggtgcaggaaacctggcggcagcgcaaaagatg

SEQ ID NO: 183041 - DNA, 103 bp, Artificial Sequence
  Synthetic Polynucleotide
taatacgactcactatagggagcttttggatagggagaggtctcctgcacaacagaggagagtgcagatgacctctcccaacctggcggcagcgcaaaagatg

SEQ ID NO: 183042 - DNA, 103 bp, Artificial Sequence
  Synthetic Polynucleotide
taatacgactcactatagggtcaacactgttaaaggccttgtcacacagtaacagaggagaactgtgatgcaaggccttaacctggcggcagcgcaaaagatg

SEQ ID NO: 183043 - DNA, 103 bp, Artificial Sequence
  Synthetic Polynucleotide
taatacgactcactatagggatggagatagagcttttggatagggagaggaacagaggagacctctcatgatccaaaagaacctggcggcagcgcaaaagatg

SEQ ID NO: 183044 - DNA, 103 bp, Artificial Sequence
  Synthetic Polynucleotide
taatacgactcactatagggggggtcactgatggagatagagcttttggaaacagaggagatccaaaatgtctatctccaacctggcggcagcgcaaaagatg

SEQ ID NO: 183045 - DNA, 103 bp, Artificial Sequence
  Synthetic Polynucleotide
taatacgactcactataggggtgtgtttagggggtcactgatggagatagaacagaggagactatctatgtcagtgaccaacctggcggcagcgcaaaagatg

SEQ ID NO: 183046 - DNA, 103 bp, Artificial Sequence
  Synthetic Polynucleotide
taatacgactcactatagggtccaatgctggtgtgtttagggggtcactgaacagaggagacagtgaatgcctaaacacaacctggcggcagcgcaaaagatg

SEQ ID NO: 183047 - DNA, 103 bp, Artificial Sequence
  Synthetic Polynucleotide
taatacgactcactatagggctgagaaaaatccaatgctggtgtgtttagaacagaggagactaaacatgccagcattgaacctggcggcagcgcaaaagatg

SEQ ID NO: 183048 - DNA, 103 bp, Artificial Sequence
  Synthetic Polynucleotide
taatacgactcactatagggaattaaacaactgagaaaaatccaatgctgaacagaggagacagcatatgatttttctcaacctggcggcagcgcaaaagatg

SEQ ID NO: 183049 - DNA, 103 bp, Artificial Sequence
  Synthetic Polynucleotide
taatacgactcactatagggaaaggtatgaaattaaacaactgagaaaaaaacagaggagatttttcatggttgtttaaaacctggcggcagcgcaaaagatg

SEQ ID NO: 183050 - DNA, 103 bp, Artificial Sequence
  Synthetic Polynucleotide
taatacgactcactatagggaggaccatttaaaggtatgaaattaaacaaaacagaggagattgtttatgttcatacctaacctggcggcagcgcaaaagatg

SEQ ID NO: 183051 - DNA, 103 bp, Artificial Sequence
  Synthetic Polynucleotide
taatacgactcactataggggattatagggaggaccatttaaaggtatgaaacagaggagatcatacatgtaaatggtcaacctggcggcagcgcaaaagatg

SEQ ID NO: 183052 - DNA, 103 bp, Artificial Sequence
  Synthetic Polynucleotide
taatacgactcactatagggactgatagaggattatagggaggaccatttaacagaggagaaaatggatgtccctataaaacctggcggcagcgcaaaagatg

SEQ ID NO: 183053 - DNA, 103 bp, Artificial Sequence
  Synthetic Polynucleotide
taatacgactcactatagggctttaatttctcaacactgttaaaggccttaacagaggagaaaggccatgaacagtgttaacctggcggcagcgcaaaagatg

SEQ ID NO: 183054 - DNA, 103 bp, Artificial Sequence
  Synthetic Polynucleotide
taatacgactcactatagggaaggctccccactgatagaggattatagggaacagaggagaccctatatgcctctatcaaacctggcggcagcgcaaaagatg

SEQ ID NO: 183055 - DNA, 103 bp, Artificial Sequence
  Synthetic Polynucleotide
taatacgactcactatagggagctcattccaaggctccccactgatagagaacagaggagactctatatgtggggagccaacctggcggcagcgcaaaagatg

SEQ ID NO: 183056 - DNA, 103 bp, Artificial Sequence
  Synthetic Polynucleotide
taatacgactcactatagggtcctgggaatagctcattccaaggctccccaacagaggagaggggagatgtggaatgagaacctggcggcagcgcaaaagatg

SEQ ID NO: 183057 - DNA, 103 bp, Artificial Sequence
  Synthetic Polynucleotide
taatacgactcactatagggatgtgcttcttcctgggaatagctcattccaacagaggagaggaatgatgtattcccagaacctggcggcagcgcaaaagatg

SEQ ID NO: 183058 - DNA, 103 bp, Artificial Sequence
  Synthetic Polynucleotide
taatacgactcactatagggaaacagaagaatgtgcttcttcctgggaataacagaggagaattcccatgaagaagcacaacctggcggcagcgcaaaagatg

SEQ ID NO: 183059 - DNA, 103 bp, Artificial Sequence
  Synthetic Polynucleotide
taatacgactcactataggggggagctgggaaacagaagaatgtgcttctaacagaggagaagaagcatgttcttctgtaacctggcggcagcgcaaaagatg

SEQ ID NO: 183060 - DNA, 103 bp, Artificial Sequence
  Synthetic Polynucleotide
taatacgactcactatagggtgtttgtggggggagctgggaaacagaagaaacagaggagatcttctatgtcccagctcaacctggcggcagcgcaaaagatg

SEQ ID NO: 183061 - DNA, 103 bp, Artificial Sequence
  Synthetic Polynucleotide
taatacgactcactataggggaagatcctgtgtttgtggggggagctgggaacagaggagacccagcatgccccacaaaaacctggcggcagcgcaaaagatg

SEQ ID NO: 183062 - DNA, 103 bp, Artificial Sequence
  Synthetic Polynucleotide
taatacgactcactataggggcaggatcctgaagatcctgtgtttgtgggaacagaggagacccacaatgacaggatctaacctggcggcagcgcaaaagatg

SEQ ID NO: 183063 - DNA, 103 bp, Artificial Sequence
  Synthetic Polynucleotide
taatacgactcactatagggtatagtgtttgcaggatcctgaagatcctgaacagaggagacaggatatgcaggatcctaacctggcggcagcgcaaaagatg

SEQ ID NO: 183064 - DNA, 103 bp, Artificial Sequence
  Synthetic Polynucleotide
taatacgactcactatagggaggagtgaacctttaatttctcaacactgtaacagaggagaacagtgatgagaaattaaaacctggcggcagcgcaaaagatg

SEQ ID NO: 183065 - DNA, 103 bp, Artificial Sequence
  Synthetic Polynucleotide
taatacgactcactatagggacccaagccctatagtgtttgcaggatcctaacagaggagaaggatcatgcaaacactaaacctggcggcagcgcaaaagatg

SEQ ID NO: 183066 - DNA, 103 bp, Artificial Sequence
  Synthetic Polynucleotide
taatacgactcactataggggagtgcagagacccaagccctatagtgtttaacagaggagaaaacacatgagggcttggaacctggcggcagcgcaaaagatg

SEQ ID NO: 183067 - DNA, 103 bp, Artificial Sequence
  Synthetic Polynucleotide
taatacgactcactatagggtgctgacagtgagtgcagagacccaagcccaacagaggagagggcttatgtctctgcacaacctggcggcagcgcaaaagatg

SEQ ID NO: 183068 - DNA, 103 bp, Artificial Sequence
  Synthetic Polynucleotide
taatacgactcactatagggtggtgaaagctgctgacagtgagtgcagagaacagaggagactctgcatgcactgtcagaacctggcggcagcgcaaaagatg

SEQ ID NO: 183069 - DNA, 103 bp, Artificial Sequence
  Synthetic Polynucleotide
taatacgactcactatagggcttaaactgctggtgaaagctgctgacagtaacagaggagaactgtcatgagctttcacaacctggcggcagcgcaaaagatg

SEQ ID NO: 183070 - DNA, 103 bp, Artificial Sequence
  Synthetic Polynucleotide
taatacgactcactatagggggtacttgtgcttaaactgctggtgaaagcaacagaggagagctttcatgagcagtttaaacctggcggcagcgcaaaagatg

SEQ ID NO: 183071 - DNA, 103 bp, Artificial Sequence
  Synthetic Polynucleotide
taatacgactcactataggggtgggagggtggtacttgtgcttaaactgcaacagaggagagcagttatggcacaagtaaacctggcggcagcgcaaaagatg

SEQ ID NO: 183072 - DNA, 103 bp, Artificial Sequence
  Synthetic Polynucleotide
taatacgactcactatagggtgatggaaacgtgggagggtggtacttgtgaacagaggagacacaagatgcaccctcccaacctggcggcagcgcaaaagatg

SEQ ID NO: 183073 - DNA, 103 bp, Artificial Sequence
  Synthetic Polynucleotide
taatacgactcactatagggctgaaaagcttgatggaaacgtgggagggtaacagaggagaaccctcatgcgtttccataacctggcggcagcgcaaaagatg

SEQ ID NO: 183074 - DNA, 103 bp, Artificial Sequence
  Synthetic Polynucleotide
taatacgactcactataggggtgtgagagtaggagtgaacctttaatttcaacagaggagagaaattatgggttcactcaacctggcggcagcgcaaaagatg

SEQ ID NO: 183075 - DNA, 103 bp, Artificial Sequence
  Synthetic Polynucleotide
taatacgactcactatagggcctctctcctgtgtgagagtaggagtgaacaacagaggagagttcacatgtactctcacaacctggcggcagcgcaaaagatg

SEQ ID NO: 183076 - DNA, 103 bp, Artificial Sequence
  Synthetic Polynucleotide
taatacgactcactatagggacttgtagggcctctctcctgtgtgagagtaacagaggagaactctcatgcaggagagaaacctggcggcagcgcaaaagatg

SEQ ID NO: 183077 - DNA, 103 bp, Artificial Sequence
  Synthetic Polynucleotide
taatacgactcactatagggtgttgtatgcacttgtagggcctctctcctaacagaggagaaggagaatggccctacaaaacctggcggcagcgcaaaagatg

SEQ ID NO: 183078 - DNA, 103 bp, Artificial Sequence
  Synthetic Polynucleotide
taatacgactcactatagggggtgcagtcttgttgtatgcacttgtagggaacagaggagaccctacatgtgcatacaaaacctggcggcagcgcaaaagatg

SEQ ID NO: 183079 - DNA, 103 bp, Artificial Sequence
  Synthetic Polynucleotide
taatacgactcactatagggctcttacttctgacaaatcaccaggaatgaaacagaggagatcattcatggtgatttgtaacctggcggcagcgcaaaagatg

SEQ ID NO: 183080 - DNA, 103 bp, Artificial Sequence
  Synthetic Polynucleotide
taatacgactcactatagggcaaaggccttggtgcagtcttgttgtatgcaacagaggagagcatacatgaagactgcaaacctggcggcagcgcaaaagatg

SEQ ID NO: 183081 - DNA, 103 bp, Artificial Sequence
  Synthetic Polynucleotide
taatacgactcactatagggtacttagaaacaaaggccttggtgcagtctaacagaggagaagactgatgcaaggccttaacctggcggcagcgcaaaagatg

SEQ ID NO: 183082 - DNA, 103 bp, Artificial Sequence
  Synthetic Polynucleotide
taatacgactcactatagggttgtaatttgtacttagaaacaaaggccttaacagaggagaaaggccatggtttctaagaacctggcggcagcgcaaaagatg

SEQ ID NO: 183083 - DNA, 103 bp, Artificial Sequence
  Synthetic Polynucleotide
taatacgactcactatagggccatgtgcctttgtaatttgtacttagaaaaacagaggagatttctaatgacaaattacaacctggcggcagcgcaaaagatg

SEQ ID NO: 183084 - DNA, 103 bp, Artificial Sequence
  Synthetic Polynucleotide
taatacgactcactataggggaatgagtagccatgtgcctttgtaatttgaacagaggagacaaattatgaaggcacataacctggcggcagcgcaaaagatg

SEQ ID NO: 183085 - DNA, 103 bp, Artificial Sequence
  Synthetic Polynucleotide
taatacgactcactatagggtttctcaggagaatgagtagccatgtgcctaacagaggagaaggcacatggctactcataacctggcggcagcgcaaaagatg

SEQ ID NO: 183086 - DNA, 103 bp, Artificial Sequence
  Synthetic Polynucleotide
taatacgactcactatagggacttgtgggttttctcaggagaatgagtagaacagaggagactactcatgctcctgagaaacctggcggcagcgcaaaagatg

SEQ ID NO: 183087 - DNA, 103 bp, Artificial Sequence
  Synthetic Polynucleotide
taatacgactcactatagggcaataattacacttgtgggttttctcaggaaacagaggagatcctgaatgaacccacaaaacctggcggcagcgcaaaagatg

SEQ ID NO: 183088 - DNA, 103 bp, Artificial Sequence
  Synthetic Polynucleotide
taatacgactcactatagggcattttctcacaataattacacttgtgggtaacagaggagaacccacatgtgtaattataacctggcggcagcgcaaaagatg

SEQ ID NO: 183089 - DNA, 103 bp, Artificial Sequence
  Synthetic Polynucleotide
taatacgactcactatagggtccggtgaaacattttctcacaataattacaacagaggagagtaattatggtgagaaaaaacctggcggcagcgcaaaagatg

SEQ ID NO: 183090 - DNA, 103 bp, Artificial Sequence
  Synthetic Polynucleotide
taatacgactcactatagggttctgggtatctcttacttctgacaaatcaaacagaggagatgatttatgagaagtaagaacctggcggcagcgcaaaagatg

SEQ ID NO: 183091 - DNA, 103 bp, Artificial Sequence
  Synthetic Polynucleotide
taatacgactcactatagggagatgatctttccggtgaaacattttctcaaacagaggagatgagaaatggtttcaccgaacctggcggcagcgcaaaagatg

SEQ ID NO: 183092 - DNA, 103 bp, Artificial Sequence
  Synthetic Polynucleotide
taatacgactcactataggggtgattcttcagatgatctttccggtgaaaaacagaggagatttcacatgaaagatcataacctggcggcagcgcaaaagatg

SEQ ID NO: 183093 - DNA, 103 bp, Artificial Sequence
  Synthetic Polynucleotide
taatacgactcactataggggtgtatggaggtgattcttcagatgatcttaacagaggagaaagatcatgtgaagaatcaacctggcggcagcgcaaaagatg

SEQ ID NO: 183094 - DNA, 103 bp, Artificial Sequence
  Synthetic Polynucleotide
taatacgactcactatagggttagggtcgtgtgtatggaggtgattcttcaacagaggagagaagaaatgcctccatacaacctggcggcagcgcaaaagatg

SEQ ID NO: 183095 - DNA, 103 bp, Artificial Sequence
  Synthetic Polynucleotide
taatacgactcactatagggcgtctctttgttagggtcgtgtgtatggagaacagaggagactccatatgcacgaccctaacctggcggcagcgcaaaagatg

SEQ ID NO: 183096 - DNA, 103 bp, Artificial Sequence
  Synthetic Polynucleotide
taatacgactcactatagggcgcacttaaacgtctctttgttagggtcgtaacagaggagaacgaccatgacaaagagaaacctggcggcagcgcaaaagatg

SEQ ID NO: 183097 - DNA, 103 bp, Artificial Sequence
  Synthetic Polynucleotide
taatacgactcactatagggccacattcttcgcacttaaacgtctctttgaacagaggagacaaagaatggtttaagtgaacctggcggcagcgcaaaagatg

SEQ ID NO: 183098 - DNA, 103 bp, Artificial Sequence
  Synthetic Polynucleotide
taatacgactcactataggggtagttcttgccacattcttcgcacttaaaaacagaggagatttaagatggaagaatgtaacctggcggcagcgcaaaagatg

SEQ ID NO: 183099 - DNA, 103 bp, Artificial Sequence
  Synthetic Polynucleotide
taatacgactcactataggggcttggtattgtagttcttgccacattcttaacagaggagaaagaatatggcaagaactaacctggcggcagcgcaaaagatg

SEQ ID NO: 183100 - DNA, 103 bp, Artificial Sequence
  Synthetic Polynucleotide
taatacgactcactatagggttaaatccaagcttggtattgtagttcttgaacagaggagacaagaaatgcaataccaaaacctggcggcagcgcaaaagatg

SEQ ID NO: 183101 - DNA, 103 bp, Artificial Sequence
  Synthetic Polynucleotide
taatacgactcactatagggtgaagggactttctgggtatctcttacttcaacagaggagagaagtaatggatacccagaacctggcggcagcgcaaaagatg

SEQ ID NO: 183102 - DNA, 103 bp, Artificial Sequence
  Synthetic Polynucleotide
taatacgactcactatagggcaagtgacgtttaaatccaagcttggtattaacagaggagaaataccatgcttggatttaacctggcggcagcgcaaaagatg

SEQ ID NO: 183103 - DNA, 103 bp, Artificial Sequence
  Synthetic Polynucleotide
taatacgactcactatagggcatgcaaggccaagtgacgtttaaatccaaaacagaggagattggatatgaacgtcactaacctggcggcagcgcaaaagatg

SEQ ID NO: 183104 - DNA, 103 bp, Artificial Sequence
  Synthetic Polynucleotide
taatacgactcactatagggcttgttgcggcatgcaaggccaagtgacgtaacagaggagaacgtcaatgggccttgcaaacctggcggcagcgcaaaagatg

SEQ ID NO: 183105 - DNA, 103 bp, Artificial Sequence
  Synthetic Polynucleotide
taatacgactcactataggggaggtcaccacttgttgcggcatgcaaggcaacagaggagagccttgatggccgcaacaaacctggcggcagcgcaaaagatg

SEQ ID NO: 183106 - DNA, 103 bp, Artificial Sequence
  Synthetic Polynucleotide
taatacgactcactatagggccttacaggtgaggtcaccacttgttgcggaacagaggagaccgcaaatggtggtgaccaacctggcggcagcgcaaaagatg

SEQ ID NO: 183107 - DNA, 103 bp, Artificial Sequence
  Synthetic Polynucleotide
taatacgactcactatagggtgcaaacataccttacaggtgaggtcaccaaacagaggagatggtgaatgcacctgtaaaacctggcggcagcgcaaaagatg

SEQ ID NO: 183108 - DNA, 103 bp, Artificial Sequence
  Synthetic Polynucleotide
taatacgactcactatagggttcaaaagtttgcaaacataccttacaggtaacagaggagaacctgtatggtatgtttgaacctggcggcagcgcaaaagatg

SEQ ID NO: 183109 - DNA, 103 bp, Artificial Sequence
  Synthetic Polynucleotide
taatacgactcactatagggctcccgtgctttcaaaagtttgcaaacataaacagaggagatatgttatgaaacttttgaacctggcggcagcgcaaaagatg

SEQ ID NO: 183110 - DNA, 103 bp, Artificial Sequence
  Synthetic Polynucleotide
taatacgactcactatagggtccagaagcactcccgtgctttcaaaagttaacagaggagaaactttatgaagcacgggaacctggcggcagcgcaaaagatg

SEQ ID NO: 183111 - DNA, 103 bp, Artificial Sequence
  Synthetic Polynucleotide
taatacgactcactatagggtttaaggtgctccagaagcactcccgtgctaacagaggagaagcacgatggtgcttctgaacctggcggcagcgcaaaagatg

SEQ ID NO: 183112 - DNA, 103 bp, Artificial Sequence
  Synthetic Polynucleotide
taatacgactcactatagggtacgtttccctgaagggactttctgggtataacagaggagaatacccatgaagtcccttaacctggcggcagcgcaaaagatg

SEQ ID NO: 183113 - DNA, 103 bp, Artificial Sequence
  Synthetic Polynucleotide
taatacgactcactatagggctgcatgagatttaaggtgctccagaagcaaacagaggagatgcttcatgagcaccttaaacctggcggcagcgcaaaagatg

SEQ ID NO: 183114 - DNA, 103 bp, Artificial Sequence
  Synthetic Polynucleotide
taatacgactcactataggggacgacttgcctgcatgagatttaaggtgcaacagaggagagcacctatgatctcatgcaacctggcggcagcgcaaaagatg

SEQ ID NO: 183115 - DNA, 103 bp, Artificial Sequence
  Synthetic Polynucleotide
taatacgactcactatagggaaccccaccagacgacttgcctgcatgagaaacagaggagatctcatatgggcaagtcgaacctggcggcagcgcaaaagatg

SEQ ID NO: 183116 - DNA, 103 bp, Artificial Sequence
  Synthetic Polynucleotide
taatacgactcactatagggttttttctttaaccccaccagacgacttgcaacagaggagagcaagtatgctggtggggaacctggcggcagcgcaaaagatg

SEQ ID NO: 183117 - DNA, 103 bp, Artificial Sequence
  Synthetic Polynucleotide
taatacgactcactatagggcactggtgctttttttctttaaccccaccaaacagaggagatggtggatgtaaagaaaaaacctggcggcagcgcaaaagatg

SEQ ID NO: 183118 - DNA, 103 bp, Artificial Sequence
  Synthetic Polynucleotide
taatacgactcactatagggacaatgttcgcactggtgctttttttctttaacagaggagaaaagaaatgaagcaccagaacctggcggcagcgcaaaagatg

SEQ ID NO: 183119 - DNA, 103 bp, Artificial Sequence
  Synthetic Polynucleotide
taatacgactcactatagggaccggcgatcacaatgttcgcactggtgctaacagaggagaagcaccatggcgaacattaacctggcggcagcgcaaaagatg

SEQ ID NO: 183120 - DNA, 103 bp, Artificial Sequence
  Synthetic Polynucleotide
taatacgactcactatagggcgggtgtagaaccggcgatcacaatgttcgaacagaggagacgaacaatgtgatcgccgaacctggcggcagcgcaaaagatg

SEQ ID NO: 183121 - DNA, 103 bp, Artificial Sequence
  Synthetic Polynucleotide
taatacgactcactataggggacatcctttcgggtgtagaaccggcgatcaacagaggagagatcgcatgttctacaccaacctggcggcagcgcaaaagatg

SEQ ID NO: 183122 - DNA, 103 bp, Artificial Sequence
  Synthetic Polynucleotide
taatacgactcactatagggtgtgtctccggacatcctttcgggtgtagaaacagaggagatctacaatggaaaggatgaacctggcggcagcgcaaaagatg

SEQ ID NO: 183123 - DNA, 103 bp, Artificial Sequence
  Synthetic Polynucleotide
taatacgactcactatagggtcaccacgcttacgtttccctgaagggactaacagaggagaagtcccatgagggaaacgaacctggcggcagcgcaaaagatg

SEQ ID NO: 183124 - DNA, 103 bp, Artificial Sequence
  Synthetic Polynucleotide
taatacgactcactatagggtgcaccaccatgtgtctccggacatcctttaacagaggagaaaaggaatgccggagacaaacctggcggcagcgcaaaagatg

SEQ ID NO: 183125 - DNA, 103 bp, Artificial Sequence
  Synthetic Polynucleotide
taatacgactcactatagggtcttccagtgtgcaccaccatgtgtctccgaacagaggagacggagaatgatggtggtgaacctggcggcagcgcaaaagatg

SEQ ID NO: 183126 - DNA, 103 bp, Artificial Sequence
  Synthetic Polynucleotide
taatacgactcactatagggggaagtcctttcttccagtgtgcaccaccaaacagaggagatggtggatgacactggaaaacctggcggcagcgcaaaagatg

SEQ ID NO: 183127 - DNA, 103 bp, Artificial Sequence
  Synthetic Polynucleotide
taatacgactcactatagggtactgacagaggaagtcctttcttccagtgaacagaggagacactggatgaaaggacttaacctggcggcagcgcaaaagatg

SEQ ID NO: 183128 - DNA, 103 bp, Artificial Sequence
  Synthetic Polynucleotide
taatacgactcactatagggctgtgcacaatactgacagaggaagtccttaacagaggagaaaggacatgctctgtcagaacctggcggcagcgcaaaagatg

SEQ ID NO: 183129 - DNA, 103 bp, Artificial Sequence
  Synthetic Polynucleotide
taatacgactcactataggggcccaaatctctgtgcacaatactgacagaaacagaggagatctgtcatgattgtgcacaacctggcggcagcgcaaaagatg

SEQ ID NO: 183130 - DNA, 103 bp, Artificial Sequence
  Synthetic Polynucleotide
taatacgactcactatagggtgatcctttcgcccaaatctctgtgcacaaaacagaggagattgtgcatggagatttggaacctggcggcagcgcaaaagatg

SEQ ID NO: 183131 - DNA, 103 bp, Artificial Sequence
  Synthetic Polynucleotide
taatacgactcactatagggtcgagtcaggtgatcctttcgcccaaatctaacagaggagaagatttatgcgaaaggataacctggcggcagcgcaaaagatg

SEQ ID NO: 183132 - DNA, 103 bp, Artificial Sequence
  Synthetic Polynucleotide
taatacgactcactatagggtcttcatatgtcgagtcaggtgatcctttcaacagaggagagaaaggatgacctgactcaacctggcggcagcgcaaaagatg

SEQ ID NO: 183133 - DNA, 103 bp, Artificial Sequence
  Synthetic Polynucleotide
taatacgactcactatagggttgtgactcttcttcatatgtcgagtcaggaacagaggagacctgacatgacatatgaaaacctggcggcagcgcaaaagatg

SEQ ID NO: 183134 - DNA, 103 bp, Artificial Sequence
  Synthetic Polynucleotide
taatacgactcactatagggtggtttggtttcaccacgcttacgtttcccaacagaggagagggaaaatgaagcgtggtaacctggcggcagcgcaaaagatg

SEQ ID NO: 183135 - DNA, 103 bp, Artificial Sequence
  Synthetic Polynucleotide
taatacgactcactatagggaagctcttgattgtgactcttcttcatatgaacagaggagacatatgatgaagagtcacaacctggcggcagcgcaaaagatg

SEQ ID NO: 183136 - DNA, 103 bp, Artificial Sequence
  Synthetic Polynucleotide
taatacgactcactatagggtgaccttcagaagctcttgattgtgactctaacagaggagaagagtcatgatcaagagcaacctggcggcagcgcaaaagatg

SEQ ID NO: 183137 - DNA, 103 bp, Artificial Sequence
  Synthetic Polynucleotide
taatacgactcactatagggggttctgttttgaccttcagaagctcttgaaacagaggagatcaagaatgtctgaaggtaacctggcggcagcgcaaaagatg

SEQ ID NO: 183138 - DNA, 103 bp, Artificial Sequence
  Synthetic Polynucleotide
taatacgactcactataggggaaatccactggttctgttttgaccttcagaacagaggagactgaagatgaaaacagaaaacctggcggcagcgcaaaagatg

SEQ ID NO: 183139 - DNA, 103 bp, Artificial Sequence
  Synthetic Polynucleotide
taatacgactcactatagggatgggtcaaggaaatccactggttctgtttaacagaggagaaaacagatgcagtggattaacctggcggcagcgcaaaagatg

SEQ ID NO: 183140 - DNA, 103 bp, Artificial Sequence
  Synthetic Polynucleotide
taatacgactcactatagggttgcaggtaaatgggtcaaggaaatccactaacagaggagaagtggaatgccttgacccaacctggcggcagcgcaaaagatg

SEQ ID NO: 183141 - DNA, 103 bp, Artificial Sequence
  Synthetic Polynucleotide
taatacgactcactatagggcacagacacattgcaggtaaatgggtcaagaacagaggagacttgacatgtttacctgcaacctggcggcagcgcaaaagatg

SEQ ID NO: 183142 - DNA, 103 bp, Artificial Sequence
  Synthetic Polynucleotide
taatacgactcactatagggcttttataggcacagacacattgcaggtaaaacagaggagattacctatgatgtgtctgaacctggcggcagcgcaaaagatg

SEQ ID NO: 183143 - DNA, 103 bp, Artificial Sequence
  Synthetic Polynucleotide
taatacgactcactatagggaggagctcgtcttttataggcacagacacaaacagaggagatgtgtcatggcctataaaaacctggcggcagcgcaaaagatg

SEQ ID NO: 183144 - DNA, 103 bp, Artificial Sequence
  Synthetic Polynucleotide
taatacgactcactatagggcatcaccggaaggagctcgtcttttataggaacagaggagacctataatggacgagctcaacctggcggcagcgcaaaagatg

SEQ ID NO: 183145 - DNA, 103 bp, Artificial Sequence
  Synthetic Polynucleotide
taatacgactcactatagggagttttttcttggtttggtttcaccacgctaacagaggagaagcgtgatgaaaccaaacaacctggcggcagcgcaaaagatg

SEQ ID NO: 183146 - DNA, 103 bp, Artificial Sequence
  Synthetic Polynucleotide
taatacgactcactatagggaaggtaaggacatcaccggaaggagctcgtaacagaggagaacgagcatgttccggtgaaacctggcggcagcgcaaaagatg

SEQ ID NO: 183147 - DNA, 103 bp, Artificial Sequence
  Synthetic Polynucleotide
taatacgactcactatagggagttcactggaaggtaaggacatcaccggaaacagaggagatccggtatggtccttaccaacctggcggcagcgcaaaagatg

SEQ ID NO: 183148 - DNA, 103 bp, Artificial Sequence
  Synthetic Polynucleotide
taatacgactcactatagggctttgataacagttcactggaaggtaaggaaacagaggagatccttaatgtccagtgaaaacctggcggcagcgcaaaagatg

SEQ ID NO: 183149 - DNA, 103 bp, Artificial Sequence
  Synthetic Polynucleotide
taatacgactcactatagggttgtgaatggctttgataacagttcactggaacagaggagaccagtgatgtgttatcaaaacctggcggcagcgcaaaagatg

SEQ ID NO: 183150 - DNA, 103 bp, Artificial Sequence
  Synthetic Polynucleotide
taatacgactcactatagggtgcaaagtgtttgtgaatggctttgataacaacagaggagagttatcatggccattcacaacctggcggcagcgcaaaagatg

SEQ ID NO: 183151 - DNA, 103 bp, Artificial Sequence
  Synthetic Polynucleotide
taatacgactcactataggggaggtttaactgcaaagtgtttgtgaatggaacagaggagaccattcatgaacactttgaacctggcggcagcgcaaaagatg

SEQ ID NO: 183152 - DNA, 103 bp, Artificial Sequence
  Synthetic Polynucleotide
taatacgactcactataggggagtgttgtagaggtttaactgcaaagtgtaacagaggagaacacttatgagttaaaccaacctggcggcagcgcaaaagatg

SEQ ID NO: 183153 - DNA, 103 bp, Artificial Sequence
  Synthetic Polynucleotide
taatacgactcactataggggactgaaatggagtgttgtagaggtttaacaacagaggagagttaaaatgctacaacacaacctggcggcagcgcaaaagatg

SEQ ID NO: 183154 - DNA, 103 bp, Artificial Sequence
  Synthetic Polynucleotide
taatacgactcactataggggctctgcatggactgaaatggagtgttgtaaacagaggagatacaacatgccatttcagaacctggcggcagcgcaaaagatg

SEQ ID NO: 183155 - DNA, 103 bp, Artificial Sequence
  Synthetic Polynucleotide
taatacgactcactatagggcagatcccgagctctgcatggactgaaatgaacagaggagacatttcatgccatgcagaaacctggcggcagcgcaaaagatg

SEQ ID NO: 183156 - DNA, 103 bp, Artificial Sequence
  Synthetic Polynucleotide
taatacgactcactatagggtggcaaggaaagttttttcttggtttggttaacagaggagaaaccaaatgaagaaaaaaaacctggcggcagcgcaaaagatg

SEQ ID NO: 183157 - DNA, 103 bp, Artificial Sequence
  Synthetic Polynucleotide
taatacgactcactatagggatttggtgggcagatcccgagctctgcatgaacagaggagacatgcaatgctcgggatcaacctggcggcagcgcaaaagatg

SEQ ID NO: 183158 - DNA, 103 bp, Artificial Sequence
  Synthetic Polynucleotide
taatacgactcactatagggagttgtgatcatttggtgggcagatcccgaaacagaggagatcgggaatggcccaccaaaacctggcggcagcgcaaaagatg

SEQ ID NO: 183159 - DNA, 103 bp, Artificial Sequence
  Synthetic Polynucleotide
taatacgactcactatagggccaaaggtaaagttgtgatcatttggtgggaacagaggagacccaccatgtgatcacaaaacctggcggcagcgcaaaagatg

SEQ ID NO: 183160 - DNA, 103 bp, Artificial Sequence
  Synthetic Polynucleotide
taatacgactcactatagggcatgtcattcccaaaggtaaagttgtgatcaacagaggagagatcacatgtttacctttaacctggcggcagcgcaaaagatg

SEQ ID NO: 183161 - DNA, 103 bp, Artificial Sequence
  Synthetic Polynucleotide
taatacgactcactatagggatctattgggcatgtcattcccaaaggtaaaacagaggagattacctatgggaatgacaaacctggcggcagcgcaaaagatg

SEQ ID NO: 183162 - DNA, 103 bp, Artificial Sequence
  Synthetic Polynucleotide
taatacgactcactatagggcagtgtccatatctattgggcatgtcattcaacagaggagagaatgaatggcccaatagaacctggcggcagcgcaaaagatg

SEQ ID NO: 183163 - DNA, 103 bp, Artificial Sequence
  Synthetic Polynucleotide
taatacgactcactataggggagggatgaacagtgtccatatctattgggaacagaggagacccaatatgtatggacacaacctggcggcagcgcaaaagatg

SEQ ID NO: 183164 - DNA, 103 bp, Artificial Sequence
  Synthetic Polynucleotide
taatacgactcactatagggaaggtggtgagagggatgaacagtgtccataacagaggagaatggacatggttcatcccaacctggcggcagcgcaaaagatg

SEQ ID NO: 183165 - DNA, 103 bp, Artificial Sequence
  Synthetic Polynucleotide
taatacgactcactatagggatttgaaagaaaggtggtgagagggatgaaaacagaggagattcatcatgctcaccaccaacctggcggcagcgcaaaagatg

SEQ ID NO: 183166 - DNA, 103 bp, Artificial Sequence
  Synthetic Polynucleotide
taatacgactcactatagggctgaacggatatttgaaagaaaggtggtgaaacagaggagatcaccaatgttctttcaaaacctggcggcagcgcaaaagatg

SEQ ID NO: 183167 - DNA, 103 bp, Artificial Sequence
  Synthetic Polynucleotide
taatacgactcactataggggccacataactggcaggggaacgtggccataacagaggagaatggccatgttcccctgcaacctggcggcagcgcaaaagatg

SEQ ID NO: 183168 - DNA, 103 bp, Artificial Sequence
  Synthetic Polynucleotide
taatacgactcactataggggccacagtcaggctgcacacacttgtacggaacagaggagaccgtacatgtgtgtgcagaacctggcggcagcgcaaaagatg

SEQ ID NO: 183169 - DNA, 103 bp, Artificial Sequence
  Synthetic Polynucleotide
taatacgactcactatagggctgaggctcttgcagaggcaagtcctcaaaaacagaggagatttgagatgttgcctctgaacctggcggcagcgcaaaagatg

SEQ ID NO: 183170 - DNA, 103 bp, Artificial Sequence
  Synthetic Polynucleotide
taatacgactcactatagggtttgaggtgactgaggctcttgcagaggcaaacagaggagatgcctcatgaagagcctcaacctggcggcagcgcaaaagatg

SEQ ID NO: 183171 - DNA, 103 bp, Artificial Sequence
  Synthetic Polynucleotide
taatacgactcactataggggggttgagcttttgaggtgactgaggctctaacagaggagaagagccatggtcacctcaaacctggcggcagcgcaaaagatg

SEQ ID NO: 183172 - DNA, 103 bp, Artificial Sequence
  Synthetic Polynucleotide
taatacgactcactatagggatcaaaacctgggttgagcttttgaggtgaaacagaggagatcacctatgaagctcaacaacctggcggcagcgcaaaagatg

SEQ ID NO: 183173 - DNA, 103 bp, Artificial Sequence
  Synthetic Polynucleotide
taatacgactcactatagggccttagccagatcaaaacctgggttgagctaacagaggagaagctcaatgcaggttttgaacctggcggcagcgcaaaagatg

SEQ ID NO: 183174 - DNA, 103 bp, Artificial Sequence
  Synthetic Polynucleotide
taatacgactcactatagggccagcatttcccttagccagatcaaaacctaacagaggagaaggtttatgtctggctaaaacctggcggcagcgcaaaagatg

SEQ ID NO: 183175 - DNA, 103 bp, Artificial Sequence
  Synthetic Polynucleotide
taatacgactcactataggggtttactttaccagcatttcccttagccagaacagaggagactggctatgggaaatgctaacctggcggcagcgcaaaagatg

SEQ ID NO: 183176 - DNA, 103 bp, Artificial Sequence
  Synthetic Polynucleotide
taatacgactcactatagggccttgggcaggtttactttaccagcatttcaacagaggagagaaatgatggtaaagtaaaacctggcggcagcgcaaaagatg

SEQ ID NO: 183177 - DNA, 103 bp, Artificial Sequence
  Synthetic Polynucleotide
taatacgactcactataggggcaggcagctccttgggcaggtttactttaaacagaggagataaagtatgcctgcccaaaacctggcggcagcgcaaaagatg

SEQ ID NO: 183178 - DNA, 103 bp, Artificial Sequence
  Synthetic Polynucleotide
taatacgactcactatagggcacagcatctgcaggcagctccttgggcagaacagaggagactgcccatggagctgcctaacctggcggcagcgcaaaagatg

SEQ ID NO: 183179 - DNA, 103 bp, Artificial Sequence
  Synthetic Polynucleotide
taatacgactcactatagggcaaaggctttgccacagtcaggctgcacacaacagaggagagtgtgcatgctgactgtgaacctggcggcagcgcaaaagatg

SEQ ID NO: 183180 - DNA, 103 bp, Artificial Sequence
  Synthetic Polynucleotide
taatacgactcactatagggttgttaggttcacagcatctgcaggcagctaacagaggagaagctgcatgcagatgctgaacctggcggcagcgcaaaagatg

SEQ ID NO: 183181 - DNA, 103 bp, Artificial Sequence
  Synthetic Polynucleotide
taatacgactcactataggggaggcaggtattgttaggttcacagcatctaacagaggagaagatgcatggaacctaacaacctggcggcagcgcaaaagatg

SEQ ID NO: 183182 - DNA, 103 bp, Artificial Sequence
  Synthetic Polynucleotide
taatacgactcactatagggcaggtccagagaggcaggtattgttaggttaacagaggagaaacctaatgatacctgccaacctggcggcagcgcaaaagatg

SEQ ID NO: 183183 - DNA, 103 bp, Artificial Sequence
  Synthetic Polynucleotide
taatacgactcactatagggacaggggggacaggtccagagaggcaggtaaacagaggagatacctgatgctctggaccaacctggcggcagcgcaaaagatg

SEQ ID NO: 183184 - DNA, 103 bp, Artificial Sequence
  Synthetic Polynucleotide
taatacgactcactatagggcagaagcccaacaggggggacaggtccagaaacagaggagatctggaatggtcccccctaacctggcggcagcgcaaaagatg

SEQ ID NO: 183185 - DNA, 103 bp, Artificial Sequence
  Synthetic Polynucleotide
taatacgactcactataggggggcagctgccagaagcccaacaggggggaaacagaggagatcccccatgttgggcttcaacctggcggcagcgcaaaagatg

SEQ ID NO: 183186 - DNA, 103 bp, Artificial Sequence
  Synthetic Polynucleotide
taatacgactcactatagggtagcaggagggggcagctgccagaagcccaaacagaggagatgggctatgggcagctgcaacctggcggcagcgcaaaagatg

SEQ ID NO: 183187 - DNA, 103 bp, Artificial Sequence
  Synthetic Polynucleotide
taatacgactcactataggggtattttgggtagcaggagggggcagctgcaacagaggagagcagctatgccctcctgcaacctggcggcagcgcaaaagatg

SEQ ID NO: 183188 - DNA, 103 bp, Artificial Sequence
  Synthetic Polynucleotide
taatacgactcactatagggattcccaaaggtattttgggtagcaggaggaacagaggagacctcctatgacccaaaataacctggcggcagcgcaaaagatg

SEQ ID NO: 183189 - DNA, 103 bp, Artificial Sequence
  Synthetic Polynucleotide
taatacgactcactatagggcaagagtgctattcccaaaggtattttgggaacagaggagacccaaaatgcctttgggaaacctggcggcagcgcaaaagatg

SEQ ID NO: 183190 - DNA, 103 bp, Artificial Sequence
  Synthetic Polynucleotide
taatacgactcactatagggtatctggaaacaaaggctttgccacagtcaaacagaggagatgactgatgcaaagccttaacctggcggcagcgcaaaagatg

SEQ ID NO: 183191 - DNA, 103 bp, Artificial Sequence
  Synthetic Polynucleotide
taatacgactcactatagggggccccagggcaagagtgctattcccaaagaacagaggagactttggatgtagcactctaacctggcggcagcgcaaaagatg

SEQ ID NO: 183192 - DNA, 103 bp, Artificial Sequence
  Synthetic Polynucleotide
taatacgactcactatagggagattccccaggccccagggcaagagtgctaacagaggagaagcactatggccctggggaacctggcggcagcgcaaaagatg

SEQ ID NO: 183193 - DNA, 103 bp, Artificial Sequence
  Synthetic Polynucleotide
taatacgactcactatagggtgtggggcaaagattccccaggccccagggaacagaggagaccctggatgctggggaataacctggcggcagcgcaaaagatg

SEQ ID NO: 183194 - DNA, 103 bp, Artificial Sequence
  Synthetic Polynucleotide
taatacgactcactatagggcagcttaacctgtggggcaaagattccccaaacagaggagatggggaatgtttgccccaaacctggcggcagcgcaaaagatg

SEQ ID NO: 183195 - DNA, 103 bp, Artificial Sequence
  Synthetic Polynucleotide
taatacgactcactatagggctgccccagacagcttaacctgtggggcaaaacagaggagattgcccatgaggttaagcaacctggcggcagcgcaaaagatg

SEQ ID NO: 183196 - DNA, 103 bp, Artificial Sequence
  Synthetic Polynucleotide
taatacgactcactatagggcttgctgctgctgccccagacagcttaaccaacagaggagaggttaaatggtctggggcaacctggcggcagcgcaaaagatg

SEQ ID NO: 183197 - DNA, 103 bp, Artificial Sequence
  Synthetic Polynucleotide
taatacgactcactatagggagtgggggttcttgctgctgctgccccagaaacagaggagatctgggatggcagcagcaaacctggcggcagcgcaaaagatg

SEQ ID NO: 183198 - DNA, 103 bp, Artificial Sequence
  Synthetic Polynucleotide
taatacgactcactataggggcccatggcaagtgggggttcttgctgctgaacagaggagacagcagatggaacccccaaacctggcggcagcgcaaaagatg

SEQ ID NO: 183199 - DNA, 103 bp, Artificial Sequence
  Synthetic Polynucleotide
taatacgactcactatagggggctcacagtgcccatggcaagtgggggttaacagaggagaaaccccatgttgccatggaacctggcggcagcgcaaaagatg

SEQ ID NO: 183200 - DNA, 103 bp, Artificial Sequence
  Synthetic Polynucleotide
taatacgactcactatagggagctggcccaggctcacagtgcccatggcaaacagaggagatgccatatgcactgtgagaacctggcggcagcgcaaaagatg

SEQ ID NO: 183201 - DNA, 103 bp, Artificial Sequence
  Synthetic Polynucleotide
taatacgactcactatagggcatcaatttatatctggaaacaaaggctttaacagaggagaaaagccatggtttccagaaacctggcggcagcgcaaaagatg

SEQ ID NO: 183202 - DNA, 103 bp, Artificial Sequence
  Synthetic Polynucleotide
taatacgactcactataggggggcagggggagctggcccaggctcacagtaacagaggagaactgtgatgctgggccagaacctggcggcagcgcaaaagatg

SEQ ID NO: 183203 - DNA, 103 bp, Artificial Sequence
  Synthetic Polynucleotide
taatacgactcactataggggagggatggggggcagggggagctggcccaaacagaggagatgggccatgtccccctgcaacctggcggcagcgcaaaagatg

SEQ ID NO: 183204 - DNA, 103 bp, Artificial Sequence
  Synthetic Polynucleotide
taatacgactcactataggggagaacacatgagggatggggggcagggggaacagaggagaccccctatgccccatcccaacctggcggcagcgcaaaagatg

SEQ ID NO: 183205 - DNA, 103 bp, Artificial Sequence
  Synthetic Polynucleotide
taatacgactcactatagggagtgccagctgagaacacatgagggatgggaacagaggagacccatcatgcatgtgttcaacctggcggcagcgcaaaagatg

SEQ ID NO: 183206 - DNA, 103 bp, Artificial Sequence
  Synthetic Polynucleotide
taatacgactcactatagggtggcagagccagtgccagctgagaacacataacagaggagaatgtgtatgcagctggcaaacctggcggcagcgcaaaagatg

SEQ ID NO: 183207 - DNA, 103 bp, Artificial Sequence
  Synthetic Polynucleotide
taatacgactcactatagggtgaggcaggatggcagagccagtgccagctaacagaggagaagctggatgtggctctgcaacctggcggcagcgcaaaagatg

SEQ ID NO: 183208 - DNA, 103 bp, Artificial Sequence
  Synthetic Polynucleotide
taatacgactcactatagggatgatggaaatgaggcaggatggcagagccaacagaggagaggctctatgatcctgcctaacctggcggcagcgcaaaagatg

SEQ ID NO: 183209 - DNA, 103 bp, Artificial Sequence
  Synthetic Polynucleotide
taatacgactcactatagggatctgaatgcatgatggaaatgaggcaggaaacagaggagatcctgcatgatttccatcaacctggcggcagcgcaaaagatg

SEQ ID NO: 183210 - DNA, 103 bp, Artificial Sequence
  Synthetic Polynucleotide
taatacgactcactatagggccatatgcctcatcaatttatatctggaaaaacagaggagatttccaatgataaattgaaacctggcggcagcgcaaaagatg

SEQ ID NO: 183211 - DNA, 103 bp, Artificial Sequence
  Synthetic Polynucleotide
taatacgactcactataggggaatgggtagccatatgcctcatcaatttaaacagaggagataaattatggaggcatataacctggcggcagcgcaaaagatg

SEQ ID NO: 183212 - DNA, 103 bp, Artificial Sequence
  Synthetic Polynucleotide
taatacgactcactatagggtttctggggagaatgggtagccatatgcctaacagaggagaaggcatatggctacccataacctggcggcagcgcaaaagatg

SEQ ID NO: 183213 - DNA, 103 bp, Artificial Sequence
  Synthetic Polynucleotide
taatacgactcactatagggactggtgagatttctggggagaatgggtagaacagaggagactacccatgctccccagaaacctggcggcagcgcaaaagatg

SEQ ID NO: 183214 - DNA, 103 bp, Artificial Sequence
  Synthetic Polynucleotide
taatacgactcactatagggcagtgagcacactggtgagatttctggggaaacagaggagatccccaatgatctcaccaaacctggcggcagcgcaaaagatg

SEQ ID NO: 183215 - DNA, 103 bp, Artificial Sequence
  Synthetic Polynucleotide
taatacgactcactatagggcgtcttctcacagtgagcacactggtgagaaacagaggagatctcacatgtgtgctcacaacctggcggcagcgcaaaagatg

SEQ ID NO: 183216 - DNA, 103 bp, Artificial Sequence
  Synthetic Polynucleotide
taatacgactcactatagggggaacgtcttgccacataactggcaggggaaacagaggagatcccctatgagttatgtgaacctggcggcagcgcaaaagatg

SEQ ID NO: 183217 - DNA, 103 bp, Artificial Sequence
  Synthetic Polynucleotide
taatacgactcactatagggtccggttgaacgtcttctcacagtgagcacaacagaggagagtgctcatggtgagaagaaacctggcggcagcgcaaaagatg

SEQ ID NO: 183218 - DNA, 103 bp, Artificial Sequence
  Synthetic Polynucleotide
taatacgactcactatagggaggtggtctttccggttgaacgtcttctcaaacagaggagatgagaaatggttcaaccgaacctggcggcagcgcaaaagatg

SEQ ID NO: 183219 - DNA, 103 bp, Artificial Sequence
  Synthetic Polynucleotide
taatacgactcactataggggtggtttttcaggtggtctttccggttgaaaacagaggagattcaacatgaaagaccacaacctggcggcagcgcaaaagatg

SEQ ID NO: 183220 - DNA, 103 bp, Artificial Sequence
  Synthetic Polynucleotide
taatacgactcactataggggggtctggaggtggtttttcaggtggtcttaacagaggagaaagaccatgtgaaaaaccaacctggcggcagcgcaaaagatg

SEQ ID NO: 183221 - DNA, 103 bp, Artificial Sequence
  Synthetic Polynucleotide
taatacgactcactatagggttggggtcgtgggtctggaggtggtttttcaacagaggagagaaaaaatgcctccagacaacctggcggcagcgcaaaagatg

SEQ ID NO: 183222 - DNA, 103 bp, Artificial Sequence
  Synthetic Polynucleotide
taatacgactcactatagggggccattttgttggggtcgtgggtctggagaacagaggagactccagatgcacgaccccaacctggcggcagcgcaaaagatg

SEQ ID NO: 183223 - DNA, 103 bp, Artificial Sequence
  Synthetic Polynucleotide
taatacgactcactatagggcacacccaaaggccattttgttggggtcgtaacagaggagaacgaccatgacaaaatggaacctggcggcagcgcaaaagatg

SEQ ID NO: 183224 - DNA, 103 bp, Artificial Sequence
  Synthetic Polynucleotide
taatacgactcactatagggccacactcctcacacccaaaggccattttgaacagaggagacaaaatatgctttgggtgaacctggcggcagcgcaaaagatg

SEQ ID NO: 183225 - DNA, 103 bp, Artificial Sequence
  Synthetic Polynucleotide
taatacgactcactataggggtacttcttcccacactcctcacacccaaaaacagaggagatttgggatggaggagtgtaacctggcggcagcgcaaaagatg

SEQ ID NO: 183226 - DNA, 103 bp, Artificial Sequence
  Synthetic Polynucleotide
taatacgactcactataggggcatggtgttgtacttcttcccacactcctaacagaggagaaggagtatgggaagaagtaacctggcggcagcgcaaaagatg

SEQ ID NO: 183227 - DNA, 103 bp, Artificial Sequence
  Synthetic Polynucleotide
taatacgactcactatagggtccagggtgaggaacgtcttgccacataacaacagaggagagttatgatgcaagacgttaacctggcggcagcgcaaaagatg

SEQ ID NO: 183228 - DNA, 103 bp, Artificial Sequence
  Synthetic Polynucleotide
taatacgactcactatagggttatagcccagcatggtgttgtacttcttcaacagaggagagaagaaatgcaacaccataacctggcggcagcgcaaaagatg

SEQ ID NO: 183229 - DNA, 103 bp, Artificial Sequence
  Synthetic Polynucleotide
taatacgactcactatagggcaggtgcctcttatagcccagcatggtgttaacagaggagaaacaccatgctgggctataacctggcggcagcgcaaaagatg

SEQ ID NO: 183230 - DNA, 103 bp, Artificial Sequence
  Synthetic Polynucleotide
taatacgactcactatagggcatggagggccaggtgcctcttatagcccaaacagaggagatgggctatgagaggcaccaacctggcggcagcgcaaaagatg

SEQ ID NO: 183231 - DNA, 103 bp, Artificial Sequence
  Synthetic Polynucleotide
taatacgactcactatagggctgctggccgcatggagggccaggtgcctcaacagaggagagaggcaatgggccctccaaacctggcggcagcgcaaaagatg

SEQ ID NO: 183232 - DNA, 103 bp, Artificial Sequence
  Synthetic Polynucleotide
taatacgactcactataggggaggtccccactgctggccgcatggagggcaacagaggagagccctcatggcggccagcaacctggcggcagcgcaaaagatg

SEQ ID NO: 183233 - DNA, 103 bp, Artificial Sequence
  Synthetic Polynucleotide
taatacgactcactatagggccccacaggtgaggtccccactgctggccgaacagaggagacggccaatggtggggaccaacctggcggcagcgcaaaagatg

SEQ ID NO: 183234 - DNA, 103 bp, Artificial Sequence
  Synthetic Polynucleotide
taatacgactcactatagggagggcacagaccccacaggtgaggtccccaaacagaggagatggggaatgcacctgtggaacctggcggcagcgcaaaagatg

SEQ ID NO: 183235 - DNA, 103 bp, Artificial Sequence
  Synthetic Polynucleotide
taatacgactcactatagggccctagctccagggcacagaccccacaggtaacagaggagaacctgtatggtctgtgccaacctggcggcagcgcaaaagatg

SEQ ID NO: 183236 - DNA, 103 bp, Artificial Sequence
  Synthetic Polynucleotide
taatacgactcactatagggcctcggtgctccctagctccagggcacagaaacagaggagatctgtgatgtggagctagaacctggcggcagcgcaaaagatg

SEQ ID NO: 183237 - DNA, 103 bp, Artificial Sequence
  Synthetic Polynucleotide
taatacgactcactatagggtccagtagcacctcggtgctccctagctccaacagaggagaggagctatggagcaccgaaacctggcggcagcgcaaaagatg

SEQ ID NO: 183238 - DNA, 103 bp, Artificial Sequence
  Synthetic Polynucleotide
taatacgactcactatagggcgtgaacttctccagggtgaggaacgtcttaacagaggagaaagacgatgctcaccctgaacctggcggcagcgcaaaagatg

SEQ ID NO: 183239 - DNA, 103 bp, Artificial Sequence
  Synthetic Polynucleotide
taatacgactcactatagggtttgaggtggtccagtagcacctcggtgctaacagaggagaagcaccatggtgctactgaacctggcggcagcgcaaaagatg

SEQ ID NO: 183240 - DNA, 103 bp, Artificial Sequence
  Synthetic Polynucleotide
taatacgactcactatagggccgcatgggctttgaggtggtccagtagcaaacagaggagatgctacatgaccacctcaaacctggcggcagcgcaaaagatg

SEQ ID NO: 183241 - DNA, 103 bp, Artificial Sequence
  Synthetic Polynucleotide
taatacgactcactatagggggcttctcttccgcatgggctttgaggtggaacagaggagaccacctatgagcccatgcaacctggcggcagcgcaaaagatg

SEQ ID NO: 183242 - DNA, 103 bp, Artificial Sequence
  Synthetic Polynucleotide
taatacgactcactatagggtccgctagggggcttctcttccgcatgggcaacagaggagagcccatatggaagagaagaacctggcggcagcgcaaaagatg

SEQ ID NO: 183243 - DNA, 103 bp, Artificial Sequence
  Synthetic Polynucleotide
taatacgactcactatagggtttccttggttccgctagggggcttctcttaacagaggagaaagagaatgcccctagcgaacctggcggcagcgcaaaagatg

SEQ ID NO: 183244 - DNA, 103 bp, Artificial Sequence
  Synthetic Polynucleotide
taatacgactcactatagggtggtgcttcttttccttggttccgctagggaacagaggagaccctagatgaaccaaggaaacctggcggcagcgcaaaagatg

SEQ ID NO: 183245 - DNA, 103 bp, Artificial Sequence
  Synthetic Polynucleotide
taatacgactcactataggggtggtcgcactggtgcttcttttccttggtaacagaggagaaccaagatgaagaagcacaacctggcggcagcgcaaaagatg

SEQ ID NO: 183246 - DNA, 103 bp, Artificial Sequence
  Synthetic Polynucleotide
taatacgactcactatagggatctttcacagtggtcgcactggtgcttctaacagaggagaagaagcatgagtgcgaccaacctggcggcagcgcaaaagatg

SEQ ID NO: 183247 - DNA, 103 bp, Artificial Sequence
  Synthetic Polynucleotide
taatacgactcactataggggtgtagaagcatctttcacagtggtcgcacaacagaggagagtgcgaatgctgtgaaagaacctggcggcagcgcaaaagatg

SEQ ID NO: 183248 - DNA, 103 bp, Artificial Sequence
  Synthetic Polynucleotide
taatacgactcactatagggatccttccgggtgtagaagcatctttcacaaacagaggagatgtgaaatgtgcttctacaacctggcggcagcgcaaaagatg

SEQ ID NO: 183249 - DNA, 103 bp, Artificial Sequence
  Synthetic Polynucleotide
taatacgactcactatagggaattgtgaatcgtgaacttctccagggtgaaacagaggagatcacccatgagaagttcaaacctggcggcagcgcaaaagatg

SEQ ID NO: 183250 - DNA, 103 bp, Artificial Sequence
  Synthetic Polynucleotide
taatacgactcactatagggggcgtcgcacatccttccgggtgtagaagcaacagaggagagcttctatgcccggaaggaacctggcggcagcgcaaaagatg

SEQ ID NO: 183251 - DNA, 103 bp, Artificial Sequence
  Synthetic Polynucleotide
taatacgactcactatagggaccaccaggtggcgtcgcacatccttccggaacagaggagaccggaaatgtgtgcgacgaacctggcggcagcgcaaaagatg

SEQ ID NO: 183252 - DNA, 103 bp, Artificial Sequence
  Synthetic Polynucleotide
taatacgactcactatagggtcctgtgtggaccaccaggtggcgtcgcacaacagaggagagtgcgaatgcacctggtgaacctggcggcagcgcaaaagatg

SEQ ID NO: 183253 - DNA, 103 bp, Artificial Sequence
  Synthetic Polynucleotide
taatacgactcactatagggagtccttgcatcctgtgtggaccaccaggtaacagaggagaacctggatgtccacacagaacctggcggcagcgcaaaagatg

SEQ ID NO: 183254 - DNA, 103 bp, Artificial Sequence
  Synthetic Polynucleotide
taatacgactcactatagggtggcacaggaagtccttgcatcctgtgtggaacagaggagaccacacatgatgcaaggaaacctggcggcagcgcaaaagatg

SEQ ID NO: 183255 - DNA, 103 bp, Artificial Sequence
  Synthetic Polynucleotide
taatacgactcactatagggggcacagaactggcacaggaagtccttgcaaacagaggagatgcaagatgttcctgtgcaacctggcggcagcgcaaaagatg

SEQ ID NO: 183256 - DNA, 103 bp, Artificial Sequence
  Synthetic Polynucleotide
taatacgactcactatagggcaaatctctgggcacagaactggcacaggaaacagaggagatcctgtatgagttctgtgaacctggcggcagcgcaaaagatg

SEQ ID NO: 183257 - DNA, 103 bp, Artificial Sequence
  Synthetic Polynucleotide
taatacgactcactatagggtccttgcgcccaaatctctgggcacagaacaacagaggagagttctgatgccagagattaacctggcggcagcgcaaaagatg

SEQ ID NO: 183258 - DNA, 103 bp, Artificial Sequence
  Synthetic Polynucleotide
taatacgactcactatagggggtgaggtgatccttgcgcccaaatctctgaacagaggagacagagaatggggcgcaagaacctggcggcagcgcaaaagatg

SEQ ID NO: 183259 - DNA, 103 bp, Artificial Sequence
  Synthetic Polynucleotide
taatacgactcactatagggtggtatgccgggtgaggtgatccttgcgccaacagaggagaggcgcaatgatcacctcaaacctggcggcagcgcaaaagatg

SEQ ID NO: 183260 - DNA, 103 bp, Artificial Sequence
  Synthetic Polynucleotide
taatacgactcactataggggagtgggaataattgtgaatcgtgaacttcaacagaggagagaagttatggattcacaaaacctggcggcagcgcaaaagatg

SEQ ID NO: 183261 - DNA, 103 bp, Artificial Sequence
  Synthetic Polynucleotide
taatacgactcactatagggtgggtcttcttggtatgccgggtgaggtgaaacagaggagatcacctatgccggcatacaacctggcggcagcgcaaaagatg

SEQ ID NO: 183262 - DNA, 103 bp, Artificial Sequence
  Synthetic Polynucleotide
taatacgactcactatagggctcctgtgagtgggtcttcttggtatgccgaacagaggagacggcatatgaagaagaccaacctggcggcagcgcaaaagatg

SEQ ID NO: 183263 - DNA, 103 bp, Artificial Sequence
  Synthetic Polynucleotide
taatacgactcactatagggctttcatcagctcctgtgagtgggtcttctaacagaggagaagaagaatgactcacaggaacctggcggcagcgcaaaagatg

SEQ ID NO: 183264 - DNA, 103 bp, Artificial Sequence
  Synthetic Polynucleotide
taatacgactcactatagggtgcaagctctctttcatcagctcctgtgagaacagaggagactcacaatggctgatgaaaacctggcggcagcgcaaaagatg

SEQ ID NO: 183265 - DNA, 103 bp, Artificial Sequence
  Synthetic Polynucleotide
taatacgactcactataggggtctccggtctgcaagctctctttcatcagaacagaggagactgatgatggagagcttgaacctggcggcagcgcaaaagatg

SEQ ID NO: 183266 - DNA, 103 bp, Artificial Sequence
  Synthetic Polynucleotide
taatacgactcactatagggtgctcagaaggtctccggtctgcaagctctaacagaggagaagagctatgagaccggagaacctggcggcagcgcaaaagatg

SEQ ID NO: 183267 - DNA, 103 bp, Artificial Sequence
  Synthetic Polynucleotide
taatacgactcactataggggtgtggaaggtgctcagaaggtctccggtcaacagaggagagaccggatgccttctgagaacctggcggcagcgcaaaagatg

SEQ ID NO: 183268 - DNA, 103 bp, Artificial Sequence
  Synthetic Polynucleotide
taatacgactcactatagggaggcgagatggtgtggaaggtgctcagaagaacagaggagacttctgatgaccttccacaacctggcggcagcgcaaaagatg

SEQ ID NO: 183269 - DNA, 103 bp, Artificial Sequence
  Synthetic Polynucleotide
taatacgactcactataggggttggaatgaaggcgagatggtgtggaaggaacagaggagaccttccatgccatctcgcaacctggcggcagcgcaaaagatg

SEQ ID NO: 183270 - DNA, 103 bp, Artificial Sequence
  Synthetic Polynucleotide
taatacgactcactataggggcagccttcagttggaatgaaggcgagatgaacagaggagacatctcatgttcattccaaacctggcggcagcgcaaaagatg

SEQ ID NO: 183271 - DNA, 103 bp, Artificial Sequence
  Synthetic Polynucleotide
taatacgactcactatagggccgctccctggagtgggaataattgtgaataacagaggagaattcacatgtattcccacaacctggcggcagcgcaaaagatg

SEQ ID NO: 183272 - DNA, 103 bp, Artificial Sequence
  Synthetic Polynucleotide
taatacgactcactatagggaggcaaggcagcagccttcagttggaatgaaacagaggagatcattcatgctgaaggctaacctggcggcagcgcaaaagatg

SEQ ID NO: 183273 - DNA, 103 bp, Artificial Sequence
  Synthetic Polynucleotide
taatacgactcactatagggaagggaaaggaggcaaggcagcagccttcaaacagaggagatgaaggatgctgccttgcaacctggcggcagcgcaaaagatg

SEQ ID NO: 183274 - DNA, 103 bp, Artificial Sequence
  Synthetic Polynucleotide
taatacgactcactataggggaagctcctaaagggaaaggaggcaaggcaaacagaggagatgccttatgtcctttcccaacctggcggcagcgcaaaagatg

SEQ ID NO: 183275 - DNA, 103 bp, Artificial Sequence
  Synthetic Polynucleotide
taatacgactcactataggggttctgggcagaagctcctaaagggaaaggaacagaggagacctttcatgttaggagctaacctggcggcagcgcaaaagatg

SEQ ID NO: 183276 - DNA, 103 bp, Artificial Sequence
  Synthetic Polynucleotide
taatacgactcactatagggttgcaagcccgttctgggcagaagctcctaaacagaggagataggagatgctgcccagaaacctggcggcagcgcaaaagatg

SEQ ID NO: 183277 - DNA, 103 bp, Artificial Sequence
  Synthetic Polynucleotide
taatacgactcactatagggggcaagctacttgcaagcccgttctgggcaaacagaggagatgcccaatgcgggcttgcaacctggcggcagcgcaaaagatg

SEQ ID NO: 183278 - DNA, 103 bp, Artificial Sequence
  Synthetic Polynucleotide
taatacgactcactataggggacctcagctggcaagctacttgcaagcccaacagaggagagggcttatgagtagcttgaacctggcggcagcgcaaaagatg

SEQ ID NO: 183279 - DNA, 103 bp, Artificial Sequence
  Synthetic Polynucleotide
taatacgactcactatagggtgaggctatggacctcagctggcaagctacaacagaggagagtagctatgcagctgaggaacctggcggcagcgcaaaagatg

SEQ ID NO: 183280 - DNA, 103 bp, Artificial Sequence
  Synthetic Polynucleotide
taatacgactcactatagggggactgagggtgaggctatggacctcagctaacagaggagaagctgaatgccatagcctaacctggcggcagcgcaaaagatg

SEQ ID NO: 183281 - DNA, 103 bp, Artificial Sequence
  Synthetic Polynucleotide
taatacgactcactatagggttgttctgggggactgagggtgaggctatgaacagaggagacatagcatgaccctcagtaacctggcggcagcgcaaaagatg

SEQ ID NO: 183282 - DNA, 103 bp, Artificial Sequence
  Synthetic Polynucleotide
taatacgactcactatagggacttgtacggccgctccctggagtgggaataacagaggagaattcccatgccagggagcaacctggcggcagcgcaaaagatg

SEQ ID NO: 183283 - DNA, 103 bp, Artificial Sequence
  Synthetic Polynucleotide
taatacgactcactataggggctgggcggcttgttctgggggactgagggaacagaggagaccctcaatgccccagaacaacctggcggcagcgcaaaagatg

SEQ ID NO: 183284 - DNA, 103 bp, Artificial Sequence
  Synthetic Polynucleotide
taatacgactcactatagggggctgcataggctgggcggcttgttctgggaacagaggagacccagaatgagccgcccaaacctggcggcagcgcaaaagatg

SEQ ID NO: 183285 - DNA, 103 bp, Artificial Sequence
  Synthetic Polynucleotide
taatacgactcactatagggctctggcagcggctgcataggctgggcggcaacagaggagagccgccatgcctatgcagaacctggcggcagcgcaaaagatg

SEQ ID NO: 183286 - DNA, 103 bp, Artificial Sequence
  Synthetic Polynucleotide
taatacgactcactatagggaggccagggactctggcagcggctgcatagaacagaggagactatgcatgcgctgccagaacctggcggcagcgcaaaagatg

SEQ ID NO: 183287 - DNA, 103 bp, Artificial Sequence
  Synthetic Polynucleotide
taatacgactcactataggggggtggagggaggccagggactctggcagcaacagaggagagctgccatggtccctggcaacctggcggcagcgcaaaagatg

SEQ ID NO: 183288 - DNA, 103 bp, Artificial Sequence
  Synthetic Polynucleotide
taatacgactcactatagggggataccgaggggtggagggaggccagggaaacagaggagatccctgatgtccctccacaacctggcggcagcgcaaaagatg

SEQ ID NO: 183289 - DNA, 103 bp, Artificial Sequence
  Synthetic Polynucleotide
taatacgactcactataggggagagccaggggataccgaggggtggagggaacagaggagaccctccatgcctcggtataacctggcggcagcgcaaaagatg

SEQ ID NO: 183290 - DNA, 103 bp, Artificial Sequence
  Synthetic Polynucleotide
taatacgactcactatagggggtggcggaggagagccaggggataccgagaacagaggagactcggtatgccctggctcaacctggcggcagcgcaaaagatg

SEQ ID NO: 183291 - DNA, 103 bp, Artificial Sequence
  Synthetic Polynucleotide
taatacgactcactatagggattgggaaggggtggcggaggagagccaggaacagaggagacctggcatgcctccgccaaacctggcggcagcgcaaaagatg

SEQ ID NO: 183292 - DNA, 103 bp, Artificial Sequence
  Synthetic Polynucleotide
taatacgactcactatagggtgtacttgtgattgggaaggggtggcggagaacagaggagactccgcatgcccttcccaaacctggcggcagcgcaaaagatg

SEQ ID NO: 183293 - DNA, 103 bp, Artificial Sequence
  Synthetic Polynucleotide
taatacgactcactatagggggctgcacacacttgtacggccgctccctgaacagaggagacagggaatggccgtacaaaacctggcggcagcgcaaaagatg

SEQ ID NO: 183294 - DNA, 103 bp, Artificial Sequence
  Synthetic Polynucleotide
taatacgactcactataggggaagtggtgttgtacttgtgattgggaaggaacagaggagaccttccatgtcacaagtaaacctggcggcagcgcaaaagatg

SEQ ID NO: 183295 - DNA, 103 bp, Artificial Sequence
  Synthetic Polynucleotide
taatacgactcactataggggtatgaggtagaagtggtgttgtacttgtgaacagaggagacacaagatgaacaccactaacctggcggcagcgcaaaagatg

SEQ ID NO: 183296 - DNA, 103 bp, Artificial Sequence
  Synthetic Polynucleotide
taatacgactcactatagggcaagtggggagtatgaggtagaagtggtgtaacagaggagaacaccaatgctacctcataacctggcggcagcgcaaaagatg

SEQ ID NO: 183297 - DNA, 103 bp, Artificial Sequence
  Synthetic Polynucleotide
taatacgactcactatagggggcaggcttgcaagtggggagtatgaggtaaacagaggagatacctcatgctccccactaacctggcggcagcgcaaaagatg

SEQ ID NO: 183298 - DNA, 103 bp, Artificial Sequence
  Synthetic Polynucleotide
taatacgactcactatagggtgctttgaggggcaggcttgcaagtggggaaacagaggagatccccaatggcaagcctgaacctggcggcagcgcaaaagatg

SEQ ID NO: 183299 - DNA, 103 bp, Artificial Sequence
  Synthetic Polynucleotide
taatacgactcactatagggctttagtatctgctttgaggggcaggcttgaacagaggagacaagccatgccctcaaagaacctggcggcagcgcaaaagatg

SEQ ID NO: 183300 - DNA, 103 bp, Artificial Sequence
  Synthetic Polynucleotide
taatacgactcactatagggttgcaaaaacctttagtatctgctttgaggaacagaggagacctcaaatgagatactaaaacctggcggcagcgcaaaagatg

SEQ ID NO: 183301 - DNA, 103 bp, Artificial Sequence
  Synthetic Polynucleotide
taatacgactcactatagggcaaactgatattgcaaaaacctttagtatcaacagaggagagatactatgggtttttgcaacctggcggcagcgcaaaagatg

SEQ ID NO: 183302 - DNA, 103 bp, Artificial Sequence
  Synthetic Polynucleotide
taatacgactcactatagggagtcctcaaacaaactgatattgcaaaaacaacagaggagagtttttatgatatcagttaacctggcggcagcgcaaaagatg

SEQ ID NO: 183303 - DNA, 103 bp, Artificial Sequence
  Synthetic Polynucleotide
taatacgactcactatagggtgcagaggcaagtcctcaaacaaactgataaacagaggagatatcagatggtttgaggaaacctggcggcagcgcaaaagatg

SEQ ID NO: 183304 - DNA, 103 bp, Artificial Sequence
  Synthetic Polynucleotide
taatacgactcactatagggcgctccgcggccccagcaaagtgccgacataacagaggagaatgtcgatgctttgctggaacctggcggcagcgcaaaagatg

SEQ ID NO: 183305 - DNA, 103 bp, Artificial Sequence
  Synthetic Polynucleotide
taatacgactcactatagggcctcctggggccgcagacgccaccggcggtaacagaggagaaccgccatgggcgtctgcaacctggcggcagcgcaaaagatg

SEQ ID NO: 183306 - DNA, 103 bp, Artificial Sequence
  Synthetic Polynucleotide
taatacgactcactatagggagacagcagaacggcggtgaagagtgcctgaacagaggagacaggcaatgttcaccgccaacctggcggcagcgcaaaagatg

SEQ ID NO: 183307 - DNA, 103 bp, Artificial Sequence
  Synthetic Polynucleotide
taatacgactcactataggggatcctcctcagacagcagaacggcggtgaaacagaggagatcaccgatgttctgctgtaacctggcggcagcgcaaaagatg

SEQ ID NO: 183308 - DNA, 103 bp, Artificial Sequence
  Synthetic Polynucleotide
taatacgactcactatagggacagtggcccgatcctcctcagacagcagaaacagaggagatctgctatgtgaggaggaaacctggcggcagcgcaaaagatg

SEQ ID NO: 183309 - DNA, 103 bp, Artificial Sequence
  Synthetic Polynucleotide
taatacgactcactatagggggccttcagaacagtggcccgatcctcctcaacagaggagagaggagatgcgggccactaacctggcggcagcgcaaaagatg

SEQ ID NO: 183310 - DNA, 103 bp, Artificial Sequence
  Synthetic Polynucleotide
taatacgactcactatagggccttgtgcacggccttcagaacagtggcccaacagaggagagggccaatgttctgaaggaacctggcggcagcgcaaaagatg

SEQ ID NO: 183311 - DNA, 103 bp, Artificial Sequence
  Synthetic Polynucleotide
taatacgactcactataggggtgggcttcaccttgtgcacggccttcagaaacagaggagatctgaaatgcgtgcacaaaacctggcggcagcgcaaaagatg

SEQ ID NO: 183312 - DNA, 103 bp, Artificial Sequence
  Synthetic Polynucleotide
taatacgactcactataggggaggctgaaggtgggcttcaccttgtgcacaacagaggagagtgcacatggtgaagcccaacctggcggcagcgcaaaagatg

SEQ ID NO: 183313 - DNA, 103 bp, Artificial Sequence
  Synthetic Polynucleotide
taatacgactcactataggggctgcggcgggaggctgaaggtgggcttcaaacagaggagatgaagcatgccttcagccaacctggcggcagcgcaaaagatg

SEQ ID NO: 183314 - DNA, 103 bp, Artificial Sequence
  Synthetic Polynucleotide
taatacgactcactataggggggggcggcagctgcggcgggaggctgaagaacagaggagacttcagatgcccgccgcaaacctggcggcagcgcaaaagatg

SEQ ID NO: 183315 - DNA, 103 bp, Artificial Sequence
  Synthetic Polynucleotide
taatacgactcactatagggggtgttgaccgggggcggcagctgcggcggaacagaggagaccgccgatgctgccgcccaacctggcggcagcgcaaaagatg

SEQ ID NO: 183316 - DNA, 103 bp, Artificial Sequence
  Synthetic Polynucleotide
taatacgactcactatagggcggacgagctcctcctggggccgcagacgcaacagaggagagcgtctatggccccaggaaacctggcggcagcgcaaaagatg

SEQ ID NO: 183317 - DNA, 103 bp, Artificial Sequence
  Synthetic Polynucleotide
taatacgactcactataggggcagcttggaggtgttgaccgggggcggcaaacagaggagatgccgcatgcggtcaacaaacctggcggcagcgcaaaagatg

SEQ ID NO: 183318 - DNA, 103 bp, Artificial Sequence
  Synthetic Polynucleotide
taatacgactcactatagggacgtccctgagcagcttggaggtgttgaccaacagaggagaggtcaaatgctccaagctaacctggcggcagcgcaaaagatg

SEQ ID NO: 183319 - DNA, 103 bp, Artificial Sequence
  Synthetic Polynucleotide
taatacgactcactatagggcttggcatacacgtccctgagcagcttggaaacagaggagatccaagatgctcagggacaacctggcggcagcgcaaaagatg

SEQ ID NO: 183320 - DNA, 103 bp, Artificial Sequence
  Synthetic Polynucleotide
taatacgactcactatagggcacgcccatccttggcatacacgtccctgaaacagaggagatcagggatgtgtatgccaaacctggcggcagcgcaaaagatg

SEQ ID NO: 183321 - DNA, 103 bp, Artificial Sequence
  Synthetic Polynucleotide
taatacgactcactataggggggtaggacacacgcccatccttggcatacaacagaggagagtatgcatgggatgggcgaacctggcggcagcgcaaaagatg

SEQ ID NO: 183322 - DNA, 103 bp, Artificial Sequence
  Synthetic Polynucleotide
taatacgactcactataggggtgcagcttcgggtaggacacacgcccatcaacagaggagagatgggatggtgtcctacaacctggcggcagcgcaaaagatg

SEQ ID NO: 183323 - DNA, 103 bp, Artificial Sequence
  Synthetic Polynucleotide
taatacgactcactatagggtcaagggcaggtgcagcttcgggtaggacaaacagaggagatgtcctatgcgaagctgcaacctggcggcagcgcaaaagatg

SEQ ID NO: 183324 - DNA, 103 bp, Artificial Sequence
  Synthetic Polynucleotide
taatacgactcactatagggtgcagggtcttcaagggcaggtgcagcttcaacagaggagagaagctatgcctgcccttaacctggcggcagcgcaaaagatg

SEQ ID NO: 183325 - DNA, 103 bp, Artificial Sequence
  Synthetic Polynucleotide
taatacgactcactatagggaaagaggcactgcagggtcttcaagggcagaacagaggagactgcccatgaagaccctgaacctggcggcagcgcaaaagatg

SEQ ID NO: 183326 - DNA, 103 bp, Artificial Sequence
  Synthetic Polynucleotide
taatacgactcactataggggctgcttctcaaagaggcactgcagggtctaacagaggagaagacccatgagtgcctctaacctggcggcagcgcaaaagatg

SEQ ID NO: 183327 - DNA, 103 bp, Artificial Sequence
  Synthetic Polynucleotide
taatacgactcactatagggtgggggctggcggacgagctcctcctggggaacagaggagaccccagatggagctcgtcaacctggcggcagcgcaaaagatg

SEQ ID NO: 183328 - DNA, 103 bp, Artificial Sequence
  Synthetic Polynucleotide
taatacgactcactatagggtccatgtggagctgcttctcaaagaggcacaacagaggagagtgcctatgtgagaagcaaacctggcggcagcgcaaaagatg

SEQ ID NO: 183329 - DNA, 103 bp, Artificial Sequence
  Synthetic Polynucleotide
taatacgactcactataggggctggccagctccatgtggagctgcttctcaacagaggagagagaagatgctccacatgaacctggcggcagcgcaaaagatg

SEQ ID NO: 183330 - DNA, 103 bp, Artificial Sequence
  Synthetic Polynucleotide
taatacgactcactatagggcgcacaccctgctggccagctccatgtggaaacagaggagatccacaatgagctggccaaacctggcggcagcgcaaaagatg

SEQ ID NO: 183331 - DNA, 103 bp, Artificial Sequence
  Synthetic Polynucleotide
taatacgactcactatagggacggacaccacgcacaccctgctggccagcaacagaggagagctggcatgcagggtgtgaacctggcggcagcgcaaaagatg

SEQ ID NO: 183332 - DNA, 103 bp, Artificial Sequence
  Synthetic Polynucleotide
taatacgactcactataggggggcttctccacggacaccacgcacaccctaacagaggagaagggtgatggtggtgtccaacctggcggcagcgcaaaagatg

SEQ ID NO: 183333 - DNA, 103 bp, Artificial Sequence
  Synthetic Polynucleotide
taatacgactcactatagggttggcaacgtgggcttctccacggacaccaaacagaggagatggtgtatgtggagaagcaacctggcggcagcgcaaaagatg

SEQ ID NO: 183334 - DNA, 103 bp, Artificial Sequence
  Synthetic Polynucleotide
taatacgactcactatagggacctccttgcttggcaacgtgggcttctccaacagaggagaggagaaatgcacgttgccaacctggcggcagcgcaaaagatg

SEQ ID NO: 183335 - DNA, 103 bp, Artificial Sequence
  Synthetic Polynucleotide
taatacgactcactatagggcgcgtgcttgacctccttgcttggcaacgtaacagaggagaacgttgatgagcaaggagaacctggcggcagcgcaaaagatg

SEQ ID NO: 183336 - DNA, 103 bp, Artificial Sequence
  Synthetic Polynucleotide
taatacgactcactataggggggtcttccgcgcgtgcttgacctccttgcaacagaggagagcaaggatgtcaagcacgaacctggcggcagcgcaaaagatg

SEQ ID NO: 183337 - DNA, 103 bp, Artificial Sequence
  Synthetic Polynucleotide
taatacgactcactatagggagggtcttcagggtcttccgcgcgtgcttgaacagaggagacaagcaatggcggaagacaacctggcggcagcgcaaaagatg

SEQ ID NO: 183338 - DNA, 103 bp, Artificial Sequence
  Synthetic Polynucleotide
taatacgactcactataggggtcttgctcctgggggctggcggacgagctaacagaggagaagctcgatggccagccccaacctggcggcagcgcaaaagatg

SEQ ID NO: 183339 - DNA, 103 bp, Artificial Sequence
  Synthetic Polynucleotide
taatacgactcactatagggttggtcccgcagggtcttcagggtcttccgaacagaggagacggaagatgctgaagaccaacctggcggcagcgcaaaagatg

SEQ ID NO: 183340 - DNA, 103 bp, Artificial Sequence
  Synthetic Polynucleotide
taatacgactcactatagggctttctcccattggtcccgcagggtcttcaaacagaggagatgaagaatgtgcgggaccaacctggcggcagcgcaaaagatg

SEQ ID NO: 183341 - DNA, 103 bp, Artificial Sequence
  Synthetic Polynucleotide
taatacgactcactatagggcggcacagtgctttctcccattggtcccgcaacagaggagagcgggaatgatgggagaaaacctggcggcagcgcaaaagatg

SEQ ID NO: 183342 - DNA, 103 bp, Artificial Sequence
  Synthetic Polynucleotide
taatacgactcactatagggccgcagcgcccggcacagtgctttctcccaaacagaggagatgggagatggcactgtgcaacctggcggcagcgcaaaagatg

SEQ ID NO: 183343 - DNA, 103 bp, Artificial Sequence
  Synthetic Polynucleotide
taatacgactcactatagggtcttggtctcccgcagcgcccggcacagtgaacagaggagacactgtatggggcgctgcaacctggcggcagcgcaaaagatg

SEQ ID NO: 183344 - DNA, 103 bp, Artificial Sequence
  Synthetic Polynucleotide
taatacgactcactatagggtctaggcggttcttggtctcccgcagcgccaacagaggagaggcgctatgggagaccaaaacctggcggcagcgcaaaagatg

SEQ ID NO: 183345 - DNA, 103 bp, Artificial Sequence
  Synthetic Polynucleotide
taatacgactcactatagggcacctcgcgctctaggcggttcttggtctcaacagaggagagagaccatgaaccgcctaaacctggcggcagcgcaaaagatg

SEQ ID NO: 183346 - DNA, 103 bp, Artificial Sequence
  Synthetic Polynucleotide
taatacgactcactatagggggccctcgtacacctcgcgctctaggcggtaacagaggagaaccgccatgagcgcgaggaacctggcggcagcgcaaaagatg

SEQ ID NO: 183347 - DNA, 103 bp, Artificial Sequence
  Synthetic Polynucleotide
taatacgactcactatagggagtgagaaccggccctcgtacacctcgcgcaacagaggagagcgcgaatggtacgagggaacctggcggcagcgcaaaagatg

SEQ ID NO: 183348 - DNA, 103 bp, Artificial Sequence
  Synthetic Polynucleotide
taatacgactcactataggggaaggggtaaagtgagaaccggccctcgtaaacagaggagatacgagatgcggttctcaaacctggcggcagcgcaaaagatg

SEQ ID NO: 183349 - DNA, 103 bp, Artificial Sequence
  Synthetic Polynucleotide
taatacgactcactatagggtgcggtcttggtcttgctcctgggggctggaacagaggagaccagccatgaggagcaagaacctggcggcagcgcaaaagatg

SEQ ID NO: 183350 - DNA, 103 bp, Artificial Sequence
  Synthetic Polynucleotide
taatacgactcactataggggcaggcacaggaaggggtaaagtgagaaccaacagaggagaggttctatgtttacccctaacctggcggcagcgcaaaagatg

SEQ ID NO: 183351 - DNA, 103 bp, Artificial Sequence
  Synthetic Polynucleotide
taatacgactcactatagggcgctcgtccagcaggcacaggaaggggtaaaacagaggagattacccatgcctgtgcctaacctggcggcagcgcaaaagatg

SEQ ID NO: 183352 - DNA, 103 bp, Artificial Sequence
  Synthetic Polynucleotide
taatacgactcactatagggcaccacctcgcgctcgtccagcaggcacagaacagaggagactgtgcatgctggacgagaacctggcggcagcgcaaaagatg

SEQ ID NO: 183353 - DNA, 103 bp, Artificial Sequence
  Synthetic Polynucleotide
taatacgactcactatagggggagcatccgcaccacctcgcgctcgtccaaacagaggagatggacgatggcgaggtggaacctggcggcagcgcaaaagatg

SEQ ID NO: 183354 - DNA, 103 bp, Artificial Sequence
  Synthetic Polynucleotide
taatacgactcactatagggaggacctgcaggagcatccgcaccacctcgaacagaggagacgaggtatggcggatgctaacctggcggcagcgcaaaagatg

SEQ ID NO: 183355 - DNA, 103 bp, Artificial Sequence
  Synthetic Polynucleotide
taatacgactcactatagggcagcgcctgcaggacctgcaggagcatccgaacagaggagacggatgatgctgcaggtcaacctggcggcagcgcaaaagatg

SEQ ID NO: 183356 - DNA, 103 bp, Artificial Sequence
  Synthetic Polynucleotide
taatacgactcactatagggcttgggcgggcagcgcctgcaggacctgcaaacagaggagatgcaggatgtgcaggcgcaacctggcggcagcgcaaaagatg

SEQ ID NO: 183357 - DNA, 103 bp, Artificial Sequence
  Synthetic Polynucleotide
taatacgactcactatagggaaggactcaccttgggcgggcagcgcctgcaacagaggagagcaggcatggcccgcccaaacctggcggcagcgcaaaagatg

SEQ ID NO: 183358 - DNA, 103 bp, Artificial Sequence
  Synthetic Polynucleotide
taatacgactcactatagggcagggtggtgaaggactcaccttgggcgggaacagaggagacccgccatgggtgagtccaacctggcggcagcgcaaaagatg

SEQ ID NO: 183359 - DNA, 103 bp, Artificial Sequence
  Synthetic Polynucleotide
taatacgactcactataggggctcccgggccagggtggtgaaggactcacaacagaggagagtgagtatgtcaccacccaacctggcggcagcgcaaaagatg

SEQ ID NO: 183360 - DNA, 103 bp, Artificial Sequence
  Synthetic Polynucleotide
taatacgactcactatagggcagtccttcctgcggtcttggtcttgctccaacagaggagaggagcaatgccaagaccgaacctggcggcagcgcaaaagatg

SEQ ID NO: 183361 - DNA, 103 bp, Artificial Sequence
  Synthetic Polynucleotide
taatacgactcactatagggcgcgcactcagctcccgggccagggtggtgaacagaggagacaccacatgggcccgggaaacctggcggcagcgcaaaagatg

SEQ ID NO: 183362 - DNA, 103 bp, Artificial Sequence
  Synthetic Polynucleotide
taatacgactcactataggggctgaaagtgcgcgcactcagctcccgggcaacagaggagagcccggatgctgagtgcgaacctggcggcagcgcaaaagatg

SEQ ID NO: 183363 - DNA, 103 bp, Artificial Sequence
  Synthetic Polynucleotide
taatacgactcactatagggccacgtgccggctgaaagtgcgcgcactcaaacagaggagatgagtgatggcactttcaaacctggcggcagcgcaaaagatg

SEQ ID NO: 183364 - DNA, 103 bp, Artificial Sequence
  Synthetic Polynucleotide
taatacgactcactatagggtgcctctgcaccacgtgccggctgaaagtgaacagaggagacactttatgccggcacgtaacctggcggcagcgcaaaagatg

SEQ ID NO: 183365 - DNA, 103 bp, Artificial Sequence
  Synthetic Polynucleotide
taatacgactcactatagggactgacccgctgcctctgcaccacgtgccgaacagaggagacggcacatggtgcagaggaacctggcggcagcgcaaaagatg

SEQ ID NO: 183366 - DNA, 103 bp, Artificial Sequence
  Synthetic Polynucleotide
taatacgactcactataggggcacctggccactgacccgctgcctctgcaaacagaggagatgcagaatgagcgggtcaaacctggcggcagcgcaaaagatg

SEQ ID NO: 183367 - DNA, 103 bp, Artificial Sequence
  Synthetic Polynucleotide
taatacgactcactatagggtgcagcgcctgcacctggccactgacccgcaacagaggagagcgggtatgtggccaggtaacctggcggcagcgcaaaagatg

SEQ ID NO: 183368 - DNA, 103 bp, Artificial Sequence
  Synthetic Polynucleotide
taatacgactcactataggggtagtggttctgcagcgcctgcacctggccaacagaggagaggccagatgcaggcgctgaacctggcggcagcgcaaaagatg

SEQ ID NO: 183369 - DNA, 103 bp, Artificial Sequence
  Synthetic Polynucleotide
taatacgactcactatagggggtacttcctgtagtggttctgcagcgcctaacagaggagaaggcgcatgagaaccactaacctggcggcagcgcaaaagatg

SEQ ID NO: 183370 - DNA, 103 bp, Artificial Sequence
  Synthetic Polynucleotide
taatacgactcactatagggagcaagcagaggtacttcctgtagtggttcaacagaggagagaaccaatgcaggaagtaaacctggcggcagcgcaaaagatg

SEQ ID NO: 183371 - DNA, 103 bp, Artificial Sequence
  Synthetic Polynucleotide
taatacgactcactatagggcacgtggccccagtccttcctgcggtcttgaacagaggagacaagacatgaggaaggacaacctggcggcagcgcaaaagatg

SEQ ID NO: 183372 - DNA, 103 bp, Artificial Sequence
  Synthetic Polynucleotide
taatacgactcactataggggtcggaggccagcaagcagaggtacttcctaacagaggagaaggaagatgctctgcttgaacctggcggcagcgcaaaagatg

SEQ ID NO: 183373 - DNA, 103 bp, Artificial Sequence
  Synthetic Polynucleotide
taatacgactcactataggggcacctcggcgtcggaggccagcaagcagaaacagaggagatctgctatgtggcctccgaacctggcggcagcgcaaaagatg

SEQ ID NO: 183374 - DNA, 103 bp, Artificial Sequence
  Synthetic Polynucleotide
taatacgactcactatagggcagggctcgggcacctcggcgtcggaggccaacagaggagaggcctcatgcgccgaggtaacctggcggcagcgcaaaagatg

SEQ ID NO: 183375 - DNA, 103 bp, Artificial Sequence
  Synthetic Polynucleotide
taatacgactcactatagggccgcggcaggcagggctcgggcacctcggcaacagaggagagccgagatgcccgagcccaacctggcggcagcgcaaaagatg

SEQ ID NO: 183376 - DNA, 103 bp, Artificial Sequence
  Synthetic Polynucleotide
taatacgactcactatagggcccagtactgccgcggcaggcagggctcggaacagaggagaccgagcatggcctgccgcaacctggcggcagcgcaaaagatg

SEQ ID NO: 183377 - DNA, 103 bp, Artificial Sequence
  Synthetic Polynucleotide
taatacgactcactatagggcccagctcctcccagtactgccgcggcaggaacagaggagacctgccatggcagtactgaacctggcggcagcgcaaaagatg

SEQ ID NO: 183378 - DNA, 103 bp, Artificial Sequence
  Synthetic Polynucleotide
taatacgactcactatagggctcgggcgcccccagctcctcccagtactgaacagaggagacagtacatggaggagctgaacctggcggcagcgcaaaagatg

SEQ ID NO: 183379 - DNA, 103 bp, Artificial Sequence
  Synthetic Polynucleotide
taatacgactcactatagggcccgcagggcctcgggcgcccccagctcctaacagaggagaaggagcatggggcgcccgaacctggcggcagcgcaaaagatg

SEQ ID NO: 183380 - DNA, 103 bp, Artificial Sequence
  Synthetic Polynucleotide
taatacgactcactatagggcagggctgctcccgcagggcctcgggcgccaacagaggagaggcgccatgggccctgcgaacctggcggcagcgcaaaagatg

SEQ ID NO: 183381 - DNA, 103 bp, Artificial Sequence
  Synthetic Polynucleotide
taatacgactcactatagggtggcaggggccagggctgctcccgcagggcaacagaggagagccctgatggagcagcccaacctggcggcagcgcaaaagatg

SEQ ID NO: 183382 - DNA, 103 bp, Artificial Sequence
  Synthetic Polynucleotide
taatacgactcactatagggccagcagctccacgtggccccagtccttccaacagaggagaggaaggatgggggccacgaacctggcggcagcgcaaaagatg

SEQ ID NO: 183383 - DNA, 103 bp, Artificial Sequence
  Synthetic Polynucleotide
taatacgactcactatagggccatctgcactggcaggggccagggctgctaacagaggagaagcagcatgggcccctgcaacctggcggcagcgcaaaagatg

SEQ ID NO: 183384 - DNA, 103 bp, Artificial Sequence
  Synthetic Polynucleotide
taatacgactcactatagggttgcccagctccatctgcactggcaggggcaacagaggagagcccctatgagtgcagataacctggcggcagcgcaaaagatg

SEQ ID NO: 183385 - DNA, 103 bp, Artificial Sequence
  Synthetic Polynucleotide
taatacgactcactatagggcgccagcagcttgcccagctccatctgcacaacagaggagagtgcagatggagctgggcaacctggcggcagcgcaaaagatg

SEQ ID NO: 183386 - DNA, 103 bp, Artificial Sequence
  Synthetic Polynucleotide
taatacgactcactatagggccagcatctccgccagcagcttgcccagctaacagaggagaagctggatgagctgctggaacctggcggcagcgcaaaagatg

SEQ ID NO: 183387 - DNA, 103 bp, Artificial Sequence
  Synthetic Polynucleotide
taatacgactcactataggggtagcctgcaccagcatctccgccagcagcaacagaggagagctgctatgggagatgctaacctggcggcagcgcaaaagatg

SEQ ID NO: 183388 - DNA, 103 bp, Artificial Sequence
  Synthetic Polynucleotide
taatacgactcactatagggtggcatctgcgtagcctgcaccagcatctcaacagaggagagagatgatggtgcaggctaacctggcggcagcgcaaaagatg

SEQ ID NO: 183389 - DNA, 103 bp, Artificial Sequence
  Synthetic Polynucleotide
taatacgactcactatagggccaggctgcatggcatctgcgtagcctgcaaacagaggagatgcaggatgcgcagatgcaacctggcggcagcgcaaaagatg

SEQ ID NO: 183390 - DNA, 103 bp, Artificial Sequence
  Synthetic Polynucleotide
taatacgactcactatagggtgcggcttgtccaggctgcatggcatctgcaacagaggagagcagatatgatgcagcctaacctggcggcagcgcaaaagatg

SEQ ID NO: 183391 - DNA, 103 bp, Artificial Sequence
  Synthetic Polynucleotide
taatacgactcactatagggagaggaacgatgcggcttgtccaggctgcaaacagaggagatgcagcatggacaagccgaacctggcggcagcgcaaaagatg

SEQ ID NO: 183392 - DNA, 103 bp, Artificial Sequence
  Synthetic Polynucleotide
taatacgactcactatagggggacaagccgagaggaacgatgcggcttgtaacagaggagaacaagcatgatcgttcctaacctggcggcagcgcaaaagatg

SEQ ID NO: 183393 - DNA, 103 bp, Artificial Sequence
  Synthetic Polynucleotide
taatacgactcactatagggtggagcacctccagcagctccacgtggcccaacagaggagagggccaatgggagctgctaacctggcggcagcgcaaaagatg

SEQ ID NO: 183394 - DNA, 103 bp, Artificial Sequence
  Synthetic Polynucleotide
taatacgactcactatagggtagagcacggggacaagccgagaggaacgaaacagaggagatcgttcatgtcggcttgtaacctggcggcagcgcaaaagatg

SEQ ID NO: 183395 - DNA, 103 bp, Artificial Sequence
  Synthetic Polynucleotide
taatacgactcactatagggatacacgtggtagagcacggggacaagccgaacagaggagacggcttatgcccgtgctcaacctggcggcagcgcaaaagatg

SEQ ID NO: 183396 - DNA, 103 bp, Artificial Sequence
  Synthetic Polynucleotide
taatacgactcactatagggtgcggaaggaatacacgtggtagagcacggaacagaggagaccgtgcatgaccacgtgtaacctggcggcagcgcaaaagatg

SEQ ID NO: 183397 - DNA, 103 bp, Artificial Sequence
  Synthetic Polynucleotide
taatacgactcactatagggtgctggacgttgcggaaggaatacacgtggaacagaggagaccacgtatgttccttccgaacctggcggcagcgcaaaagatg

SEQ ID NO: 183398 - DNA, 103 bp, Artificial Sequence
  Synthetic Polynucleotide
taatacgactcactataggggatgccgatctgctggacgttgcggaaggaaacagaggagatccttcatgaacgtccagaacctggcggcagcgcaaaagatg

SEQ ID NO: 183399 - DNA, 103 bp, Artificial Sequence
  Synthetic Polynucleotide
taatacgactcactataggggcggcttcaggatgccgatctgctggacgtaacagaggagaacgtccatgagatcggcaaacctggcggcagcgcaaaagatg

SEQ ID NO: 183400 - DNA, 103 bp, Artificial Sequence
  Synthetic Polynucleotide
taatacgactcactatagggtaggccgggtgcggcttcaggatgccgatcaacagaggagagatcggatgcctgaagccaacctggcggcagcgcaaaagatg

SEQ ID NO: 183401 - DNA, 103 bp, Artificial Sequence
  Synthetic Polynucleotide
taatacgactcactatagggcagctgcacgtaggccgggtgcggcttcagaacagaggagactgaagatgcacccggccaacctggcggcagcgcaaaagatg

SEQ ID NO: 183402 - DNA, 103 bp, Artificial Sequence
  Synthetic Polynucleotide
taatacgactcactatagggccttctccagcagctgcacgtaggccgggtaacagaggagaacccggatgacgtgcagcaacctggcggcagcgcaaaagatg

SEQ ID NO: 183403 - DNA, 103 bp, Artificial Sequence
  Synthetic Polynucleotide
taatacgactcactatagggggctccgcggccttctccagcagctgcacgaacagaggagacgtgcaatggctggagaaaacctggcggcagcgcaaaagatg

SEQ ID NO: 183404 - DNA, 103 bp, Artificial Sequence
  Synthetic Polynucleotide
taatacgactcactatagggcacccgcgcctggagcacctccagcagctcaacagaggagagagctgatggaggtgctcaacctggcggcagcgcaaaagatg

SEQ ID NO: 183405 - DNA, 103 bp, Artificial Sequence
  Synthetic Polynucleotide
taatacgactcactatagggggtcagcgtgggctccgcggccttctccagaacagaggagactggagatggccgcggagaacctggcggcagcgcaaaagatg

SEQ ID NO: 183406 - DNA, 103 bp, Artificial Sequence
  Synthetic Polynucleotide
taatacgactcactatagggccgcctcgaaggtcagcgtgggctccgcggaacagaggagaccgcggatgccacgctgaaacctggcggcagcgcaaaagatg

SEQ ID NO: 183407 - DNA, 103 bp, Artificial Sequence
  Synthetic Polynucleotide
taatacgactcactatagggggtacatccaccgcctcgaaggtcagcgtgaacagaggagacacgctatgcttcgaggcaacctggcggcagcgcaaaagatg

SEQ ID NO: 183408 - DNA, 103 bp, Artificial Sequence
  Synthetic Polynucleotide
taatacgactcactataggggcaaagcatgggtacatccaccgcctcgaaaacagaggagattcgagatggtggatgtaaacctggcggcagcgcaaaagatg

SEQ ID NO: 183409 - DNA, 103 bp, Artificial Sequence
  Synthetic Polynucleotide
taatacgactcactataggggcagcggggggcaaagcatgggtacatccaaacagaggagatggatgatgccatgctttaacctggcggcagcgcaaaagatg

SEQ ID NO: 183410 - DNA, 103 bp, Artificial Sequence
  Synthetic Polynucleotide
taatacgactcactataggggatgtccagggcagcggggggcaaagcatgaacagaggagacatgctatgccccccgctaacctggcggcagcgcaaaagatg

SEQ ID NO: 183411 - DNA, 103 bp, Artificial Sequence
  Synthetic Polynucleotide
taatacgactcactatagggagagtgcggcgatgtccagggcagcgggggaacagaggagacccccgatgccctggacaaacctggcggcagcgcaaaagatg

SEQ ID NO: 183412 - DNA, 103 bp, Artificial Sequence
  Synthetic Polynucleotide
taatacgactcactatagggggaaagcaccagagtgcggcgatgtccaggaacagaggagacctggaatgcgccgcactaacctggcggcagcgcaaaagatg

SEQ ID NO: 183413 - DNA, 103 bp, Artificial Sequence
  Synthetic Polynucleotide
taatacgactcactataggggggctgagcaggaaagcaccagagtgcggcaacagaggagagccgcaatgtggtgctttaacctggcggcagcgcaaaagatg

SEQ ID NO: 183414 - DNA, 103 bp, Artificial Sequence
  Synthetic Polynucleotide
taatacgactcactatagggcagcttggtggggctgagcaggaaagcaccaacagaggagaggtgctatgctgctcagcaacctggcggcagcgcaaaagatg

SEQ ID NO: 183415 - DNA, 103 bp, Artificial Sequence
  Synthetic Polynucleotide
taatacgactcactatagggtgagccccgccgctccgcggccccagcaaaaacagaggagatttgctatggccgcggagaacctggcggcagcgcaaaagatg

SEQ ID NO: 183416 - DNA, 103 bp, Artificial Sequence
  Synthetic Polynucleotide
taatacgactcactataggggcagctgccgcacccgcgcctggagcacctaacagaggagaaggtgcatgaggcgcgggaacctggcggcagcgcaaaagatg

SEQ ID NO: 183417 - DNA, 103 bp, Artificial Sequence
  Synthetic Polynucleotide
taatacgactcactatagggccgtgcgcatcagcttggtggggctgagcaaacagaggagatgctcaatgccaccaagcaacctggcggcagcgcaaaagatg

SEQ ID NO: 183418 - DNA, 103 bp, Artificial Sequence
  Synthetic Polynucleotide
taatacgactcactataggggcgccttccaccgtgcgcatcagcttggtgaacagaggagacaccaaatggatgcgcacaacctggcggcagcgcaaaagatg

SEQ ID NO: 183419 - DNA, 103 bp, Artificial Sequence
  Synthetic Polynucleotide
taatacgactcactataggggtgctgcgtggcgccttccaccgtgcgcataacagaggagaatgcgcatggtggaaggcaacctggcggcagcgcaaaagatg

SEQ ID NO: 183420 - DNA, 103 bp, Artificial Sequence
  Synthetic Polynucleotide
taatacgactcactataggggcagctcctggtgctgcgtggcgccttccaaacagaggagatggaagatgccacgcagcaacctggcggcagcgcaaaagatg

SEQ ID NO: 183421 - DNA, 103 bp, Artificial Sequence
  Synthetic Polynucleotide
taatacgactcactatagggcaggtttccagcagctcctggtgctgcgtgaacagaggagacacgcaatgccaggagctaacctggcggcagcgcaaaagatg

SEQ ID NO: 183422 - DNA, 103 bp, Artificial Sequence
  Synthetic Polynucleotide
taatacgactcactatagggggtgggcgggcaggtttccagcagctcctgaacagaggagacaggagatgctggaaaccaacctggcggcagcgcaaaagatg

SEQ ID NO: 183423 - DNA, 103 bp, Artificial Sequence
  Synthetic Polynucleotide
taatacgactcactatagggcatgcagcgcggtgggcgggcaggtttccaaacagaggagatggaaaatggcccgcccaaacctggcggcagcgcaaaagatg

SEQ ID NO: 183424 - DNA, 103 bp, Artificial Sequence
  Synthetic Polynucleotide
taatacgactcactatagggtccagtgcgccatgcagcgcggtgggcgggaacagaggagacccgccatgcgcgctgcaaacctggcggcagcgcaaaagatg

SEQ ID NO: 183425 - DNA, 103 bp, Artificial Sequence
  Synthetic Polynucleotide
taatacgactcactatagggggtgagggcgtccagtgcgccatgcagcgcaacagaggagagcgctgatgggcgcactgaacctggcggcagcgcaaaagatg

SEQ ID NO: 183426 - DNA, 103 bp, Artificial Sequence
  Synthetic Polynucleotide
taatacgactcactatagggtgcccagttgggtgagggcgtccagtgcgcaacagaggagagcgcacatgacgccctcaaacctggcggcagcgcaaaagatg

SEQ ID NO: 183427 - DNA, 103 bp, Artificial Sequence
  Synthetic Polynucleotide
taatacgactcactatagggctctcagcctgcagctgccgcacccgcgccaacagaggagaggcgcgatggcggcagctaacctggcggcagcgcaaaagatg

SEQ ID NO: 183428 - DNA, 103 bp, Artificial Sequence
  Synthetic Polynucleotide
taatacgactcactatagggcaggcgcagttgcccagttgggtgagggcgaacagaggagacgccctatgccaactgggaacctggcggcagcgcaaaagatg

SEQ ID NO: 183429 - DNA, 103 bp, Artificial Sequence
  Synthetic Polynucleotide
taatacgactcactataggggttgacgcgccaggcgcagttgcccagttgaacagaggagacaactgatgaactgcgccaacctggcggcagcgcaaaagatg

SEQ ID NO: 183430 - DNA, 103 bp, Artificial Sequence
  Synthetic Polynucleotide
taatacgactcactataggggcacgcgcccgttgacgcgccaggcgcagtaacagaggagaactgcgatgggcgcgtcaaacctggcggcagcgcaaaagatg

SEQ ID NO: 183431 - DNA, 103 bp, Artificial Sequence
  Synthetic Polynucleotide
taatacgactcactatagggaccaggtccagcacgcgcccgttgacgcgcaacagaggagagcgcgtatgcgggcgcgtaacctggcggcagcgcaaaagatg

SEQ ID NO: 183432 - DNA, 103 bp, Artificial Sequence
  Synthetic Polynucleotide
taatacgactcactataggggagctgcagcaccaggtccagcacgcgcccaacagaggagagggcgcatgctggacctgaacctggcggcagcgcaaaagatg

SEQ ID NO: 183433 - DNA, 103 bp, Artificial Sequence
  Synthetic Polynucleotide
taatacgactcactatagggtggcctggaagagctgcagcaccaggtccaaacagaggagatggaccatgtgctgcagcaacctggcggcagcgcaaaagatg

SEQ ID NO: 183434 - DNA, 103 bp, Artificial Sequence
  Synthetic Polynucleotide
taatacgactcactataggggggcagcccttggcctggaagagctgcagcaacagaggagagctgcaatgcttccaggcaacctggcggcagcgcaaaagatg

SEQ ID NO: 183435 - DNA, 103 bp, Artificial Sequence
  Synthetic Polynucleotide
taatacgactcactataggggcctagctgggggcagcccttggcctggaaaacagaggagattccagatgaagggctgcaacctggcggcagcgcaaaagatg

SEQ ID NO: 183436 - DNA, 103 bp, Artificial Sequence
  Synthetic Polynucleotide
taatacgactcactataggggggccggcacgcctagctgggggcagccctaacagaggagaagggctatgcccagctagaacctggcggcagcgcaaaagatg

SEQ ID NO: 183437 - DNA, 103 bp, Artificial Sequence
  Synthetic Polynucleotide
taatacgactcactatagggtcggagggcggggccggcacgcctagctggaacagaggagaccagctatgcgtgccggcaacctggcggcagcgcaaaagatg

SEQ ID NO: 183438 - DNA, 103 bp, Artificial Sequence
  Synthetic Polynucleotide
taatacgactcactatagggctccgacacgctctcagcctgcagctgccgaacagaggagacggcagatgcaggctgagaacctggcggcagcgcaaaagatg

SEQ ID NO: 183439 - DNA, 103 bp, Artificial Sequence
  Synthetic Polynucleotide
taatacgactcactatagggctggggcgcctcggagggcggggccggcacaacagaggagagtgccgatgccgccctccaacctggcggcagcgcaaaagatg

SEQ ID NO: 183440 - DNA, 103 bp, Artificial Sequence
  Synthetic Polynucleotide
taatacgactcactatagggcctcgggcggctggggcgcctcggagggcgaacagaggagacgccctatgaggcgccccaacctggcggcagcgcaaaagatg

SEQ ID NO: 183441 - DNA, 103 bp, Artificial Sequence
  Synthetic Polynucleotide
taatacgactcactatagggggcaggtgggcctcgggcggctggggcgccaacagaggagaggcgccatggccgcccgaaacctggcggcagcgcaaaagatg

SEQ ID NO: 183442 - DNA, 103 bp, Artificial Sequence
  Synthetic Polynucleotide
taatacgactcactatagggggcgctgtgcggcaggtgggcctcgggcggaacagaggagaccgcccatggcccacctgaacctggcggcagcgcaaaagatg

SEQ ID NO: 183443 - DNA, 103 bp, Artificial Sequence
  Synthetic Polynucleotide
taatacgactcactataggggggcgggcgcggcgctgtgcggcaggtgggaacagaggagacccaccatgcgcacagcgaacctggcggcagcgcaaaagatg

SEQ ID NO: 183444 - DNA, 103 bp, Artificial Sequence
  Synthetic Polynucleotide
taatacgactcactatagggtcggccttgcgggcgggcgcggcgctgtgcaacagaggagagcacagatgcgcgcccgcaacctggcggcagcgcaaaagatg

SEQ ID NO: 183445 - DNA, 103 bp, Artificial Sequence
  Synthetic Polynucleotide
taatacgactcactatagggacggcgcagctcggccttgcgggcgggcgcaacagaggagagcgcccatgcgcaaggccaacctggcggcagcgcaaaagatg

SEQ ID NO: 183446 - DNA, 103 bp, Artificial Sequence
  Synthetic Polynucleotide
taatacgactcactataggggcgccagctcacggcgcagctcggccttgcaacagaggagagcaaggatgagctgcgccaacctggcggcagcgcaaaagatg

SEQ ID NO: 183447 - DNA, 103 bp, Artificial Sequence
  Synthetic Polynucleotide
taatacgactcactatagggttctggcagtgcgccagctcacggcgcagcaacagaggagagctgcgatgtgagctggcaacctggcggcagcgcaaaagatg

SEQ ID NO: 183448 - DNA, 103 bp, Artificial Sequence
  Synthetic Polynucleotide
taatacgactcactatagggccgggccaccttctggcagtgcgccagctcaacagaggagagagctgatgcactgccagaacctggcggcagcgcaaaagatg

SEQ ID NO: 183449 - DNA, 103 bp, Artificial Sequence
  Synthetic Polynucleotide
taatacgactcactatagggtcaccaccacctccgacacgctctcagcctaacagaggagaaggctgatggcgtgtcggaacctggcggcagcgcaaaagatg

SEQ ID NO: 183450 - DNA, 103 bp, Artificial Sequence
  Synthetic Polynucleotide
taatacgactcactatagggtgtgcatctcccgggccaccttctggcagtaacagaggagaactgccatgaggtggcccaacctggcggcagcgcaaaagatg

SEQ ID NO: 183451 - DNA, 103 bp, Artificial Sequence
  Synthetic Polynucleotide
taatacgactcactataggggcccgcaggctgtgcatctcccgggccaccaacagaggagaggtggcatgggagatgcaaacctggcggcagcgcaaaagatg

SEQ ID NO: 183452 - DNA, 103 bp, Artificial Sequence
  Synthetic Polynucleotide
taatacgactcactatagggcagcgcctccgcccgcaggctgtgcatctcaacagaggagagagatgatgagcctgcggaacctggcggcagcgcaaaagatg

SEQ ID NO: 183453 - DNA, 103 bp, Artificial Sequence
  Synthetic Polynucleotide
taatacgactcactatagggagaggcggtacagcgcctccgcccgcaggcaacagaggagagcctgcatgcggaggcgcaacctggcggcagcgcaaaagatg

SEQ ID NO: 183454 - DNA, 103 bp, Artificial Sequence
  Synthetic Polynucleotide
taatacgactcactatagggtgcgccagcgagaggcggtacagcgcctccaacagaggagaggaggcatggtaccgcctaacctggcggcagcgcaaaagatg

SEQ ID NO: 183455 - DNA, 103 bp, Artificial Sequence
  Synthetic Polynucleotide
taatacgactcactatagggccgcaggtgctgcgccagcgagaggcggtaaacagaggagataccgcatgtcgctggcgaacctggcggcagcgcaaaagatg

SEQ ID NO: 183456 - DNA, 103 bp, Artificial Sequence
  Synthetic Polynucleotide
taatacgactcactatagggagacgcggtcccgcaggtgctgcgccagcgaacagaggagacgctggatgagcacctgcaacctggcggcagcgcaaaagatg

SEQ ID NO: 183457 - DNA, 103 bp, Artificial Sequence
  Synthetic Polynucleotide
taatacgactcactatagggggcagccagaagacgcggtcccgcaggtgcaacagaggagagcacctatgggaccgcgtaacctggcggcagcgcaaaagatg

SEQ ID NO: 183458 - DNA, 103 bp, Artificial Sequence
  Synthetic Polynucleotide
taatacgactcactatagggcatgttgtgcggcagccagaagacgcggtcaacagaggagagaccgcatgttctggctgaacctggcggcagcgcaaaagatg

SEQ ID NO: 183459 - DNA, 103 bp, Artificial Sequence
  Synthetic Polynucleotide
taatacgactcactatagggcgcggaagtccatgttgtgcggcagccagaaacagaggagatctggcatgcgcacaacaaacctggcggcagcgcaaaagatg

SEQ ID NO: 183460 - DNA, 103 bp, Artificial Sequence
  Synthetic Polynucleotide
taatacgactcactatagggtccaccctgttcaccaccacctccgacacgaacagaggagacgtgtcatgggtggtggtaacctggcggcagcgcaaaagatg

SEQ ID NO: 183461 - DNA, 103 bp, Artificial Sequence
  Synthetic Polynucleotide
taatacgactcactatagggtaggtgcggccgcggaagtccatgttgtgcaacagaggagagcacaaatgggacttccgaacctggcggcagcgcaaaagatg

SEQ ID NO: 183462 - DNA, 103 bp, Artificial Sequence
  Synthetic Polynucleotide
taatacgactcactatagggcgggcaggggtaggtgcggccgcggaagtcaacagaggagagacttcatgggccgcaccaacctggcggcagcgcaaaagatg

SEQ ID NO: 183463 - DNA, 103 bp, Artificial Sequence
  Synthetic Polynucleotide
taatacgactcactatagggtgaagtgcggcgggcaggggtaggtgcggcaacagaggagagccgcaatgacccctgccaacctggcggcagcgcaaaagatg

SEQ ID NO: 183464 - DNA, 103 bp, Artificial Sequence
  Synthetic Polynucleotide
taatacgactcactatagggcccaggtggttgaagtgcggcgggcaggggaacagaggagacccctgatggccgcacttaacctggcggcagcgcaaaagatg

SEQ ID NO: 183465 - DNA, 103 bp, Artificial Sequence
  Synthetic Polynucleotide
taatacgactcactatagggcacgtcgctgcccaggtggttgaagtgcggaacagaggagaccgcacatgaaccacctgaacctggcggcagcgcaaaagatg

SEQ ID NO: 183466 - DNA, 103 bp, Artificial Sequence
  Synthetic Polynucleotide
taatacgactcactataggggggcccgcgccacgtcgctgcccaggtggtaacagaggagaaccaccatggcagcgacgaacctggcggcagcgcaaaagatg

SEQ ID NO: 183467 - DNA, 103 bp, Artificial Sequence
  Synthetic Polynucleotide
taatacgactcactatagggaactccagcagggcccgcgccacgtcgctgaacagaggagacagcgaatgggcgcgggcaacctggcggcagcgcaaaagatg

SEQ ID NO: 183468 - DNA, 103 bp, Artificial Sequence
  Synthetic Polynucleotide
taatacgactcactataggggccctgggcgaactccagcagggcccgcgcaacagaggagagcgcggatgctgctggagaacctggcggcagcgcaaaagatg

SEQ ID NO: 183469 - DNA, 103 bp, Artificial Sequence
  Synthetic Polynucleotide
taatacgactcactatagggcgagcgggcggccctgggcgaactccagcaaacagaggagatgctggatgtcgcccaggaacctggcggcagcgcaaaagatg

SEQ ID NO: 183470 - DNA, 103 bp, Artificial Sequence
  Synthetic Polynucleotide
taatacgactcactatagggccgtgcgggccgagcgggcggccctgggcgaacagaggagacgcccaatgccgcccgctaacctggcggcagcgcaaaagatg

SEQ ID NO: 183471 - DNA, 103 bp, Artificial Sequence
  Synthetic Polynucleotide
taatacgactcactatagggccgcgccacatccaccctgttcaccaccacaacagaggagagtggtgatgaacagggtgaacctggcggcagcgcaaaagatg

SEQ ID NO: 183472 - DNA, 103 bp, Artificial Sequence
  Synthetic Polynucleotide
taatacgactcactatagggccaatccaggccgtgcgggccgagcgggcgaacagaggagacgcccgatgggcccgcacaacctggcggcagcgcaaaagatg

SEQ ID NO: 183473 - DNA, 103 bp, Artificial Sequence
  Synthetic Polynucleotide
taatacgactcactatagggggatcttgagccaatccaggccgtgcgggcaacagaggagagcccgcatggcctggattaacctggcggcagcgcaaaagatg

SEQ ID NO: 183474 - DNA, 103 bp, Artificial Sequence
  Synthetic Polynucleotide
taatacgactcactatagggttgaccaggtggatcttgagccaatccaggaacagaggagacctggaatggctcaagataacctggcggcagcgcaaaagatg

SEQ ID NO: 183475 - DNA, 103 bp, Artificial Sequence
  Synthetic Polynucleotide
taatacgactcactatagggccccgtgagattgaccaggtggatcttgagaacagaggagactcaagatgcacctggtcaacctggcggcagcgcaaaagatg

SEQ ID NO: 183476 - DNA, 103 bp, Artificial Sequence
  Synthetic Polynucleotide
taatacgactcactataggggcttcttcaaccccgtgagattgaccaggtaacagaggagaacctggatgatctcacggaacctggcggcagcgcaaaagatg

SEQ ID NO: 183477 - DNA, 103 bp, Artificial Sequence
  Synthetic Polynucleotide
taatacgactcactatagggagcggctcccgcttcttcaaccccgtgagaaacagaggagatctcacatggttgaagaaaacctggcggcagcgcaaaagatg

SEQ ID NO: 183478 - DNA, 103 bp, Artificial Sequence
  Synthetic Polynucleotide
taatacgactcactataggggcgcttccgcagcggctcccgcttcttcaaaacagaggagattgaagatgcgggagccgaacctggcggcagcgcaaaagatg

SEQ ID NO: 183479 - DNA, 103 bp, Artificial Sequence
  Synthetic Polynucleotide
taatacgactcactatagggcaaaggccaggcgcttccgcagcggctcccaacagaggagagggagcatgtgcggaagcaacctggcggcagcgcaaaagatg

SEQ ID NO: 183480 - DNA, 103 bp, Artificial Sequence
  Synthetic Polynucleotide
taatacgactcactatagggacctcctccgcaaaggccaggcgcttccgcaacagaggagagcggaaatgcctggccttaacctggcggcagcgcaaaagatg

SEQ ID NO: 183481 - DNA, 103 bp, Artificial Sequence
  Synthetic Polynucleotide
taatacgactcactataggggtcatccatcacctcctccgcaaaggccagaacagaggagactggccatggcggaggagaacctggcggcagcgcaaaagatg

SEQ ID NO: 183482 - DNA, 103 bp, Artificial Sequence
  Synthetic Polynucleotide
taatacgactcactatagggattctgggagccgcgccacatccaccctgtaacagaggagaacagggatgatgtggcgcaacctggcggcagcgcaaaagatg

SEQ ID NO: 183483 - DNA, 103 bp, Artificial Sequence
  Synthetic Polynucleotide
taatacgactcactatagggagtccaggatgtcatccatcacctcctccgaacagaggagacggaggatgtgatggatgaacctggcggcagcgcaaaagatg

SEQ ID NO: 183484 - DNA, 103 bp, Artificial Sequence
  Synthetic Polynucleotide
taatacgactcactatagggtggtccgcggagtccaggatgtcatccatcaacagaggagagatggaatgcatcctggaaacctggcggcagcgcaaaagatg

SEQ ID NO: 183485 - DNA, 103 bp, Artificial Sequence
  Synthetic Polynucleotide
taatacgactcactatagggcgtcaagggttggtccgcggagtccaggataacagaggagaatcctgatgtccgcggacaacctggcggcagcgcaaaagatg

SEQ ID NO: 183486 - DNA, 103 bp, Artificial Sequence
  Synthetic Polynucleotide
taatacgactcactatagggactttcggcccgtcaagggttggtccgcggaacagaggagaccgcggatgaacccttgaaacctggcggcagcgcaaaagatg

SEQ ID NO: 183487 - DNA, 103 bp, Artificial Sequence
  Synthetic Polynucleotide
taatacgactcactatagggcccatccaccactttcggcccgtcaagggtaacagaggagaacccttatggggccgaaaaacctggcggcagcgcaaaagatg

SEQ ID NO: 183488 - DNA, 103 bp, Artificial Sequence
  Synthetic Polynucleotide
taatacgactcactatagggttcctccgcgcccatccaccactttcggccaacagaggagaggccgaatgtggtggatgaacctggcggcagcgcaaaagatg

SEQ ID NO: 183489 - DNA, 103 bp, Artificial Sequence
  Synthetic Polynucleotide
taatacgactcactatagggtctgccagggttcctccgcgcccatccaccaacagaggagaggtggaatggcgcggaggaacctggcggcagcgcaaaagatg

SEQ ID NO: 183490 - DNA, 103 bp, Artificial Sequence
  Synthetic Polynucleotide
taatacgactcactatagggcaggccagcgtctgccagggttcctccgcgaacagaggagacgcggaatgaccctggcaaacctggcggcagcgcaaaagatg

SEQ ID NO: 183491 - DNA, 103 bp, Artificial Sequence
  Synthetic Polynucleotide
taatacgactcactatagggctccatacagcaggccagcgtctgccagggaacagaggagaccctggatgacgctggccaacctggcggcagcgcaaaagatg

SEQ ID NO: 183492 - DNA, 103 bp, Artificial Sequence
  Synthetic Polynucleotide
taatacgactcactatagggcgttcgccacctccatacagcaggccagcgaacagaggagacgctggatggctgtatggaacctggcggcagcgcaaaagatg

SEQ ID NO: 183493 - DNA, 103 bp, Artificial Sequence
  Synthetic Polynucleotide
taatacgactcactatagggccactgccacattctgggagccgcgccacaaacagaggagatgtggcatggctcccagaaacctggcggcagcgcaaaagatg

SEQ ID NO: 183494 - DNA, 103 bp, Artificial Sequence
  Synthetic Polynucleotide
taatacgactcactataggggcgcgcacagcgttcgccacctccatacagaacagaggagactgtatatgggtggcgaaaacctggcggcagcgcaaaagatg

SEQ ID NO: 183495 - DNA, 103 bp, Artificial Sequence
  Synthetic Polynucleotide
taatacgactcactatagggagggtcggaggcgcgcacagcgttcgccacaacagaggagagtggcgatggctgtgcgcaacctggcggcagcgcaaaagatg

SEQ ID NO: 183496 - DNA, 103 bp, Artificial Sequence
  Synthetic Polynucleotide
taatacgactcactatagggcataggcggcagggtcggaggcgcgcacagaacagaggagactgtgcatgcctccgaccaacctggcggcagcgcaaaagatg

SEQ ID NO: 183497 - DNA, 103 bp, Artificial Sequence
  Synthetic Polynucleotide
taatacgactcactatagggaggtgggagacataggcggcagggtcggagaacagaggagactccgaatgtgccgcctaaacctggcggcagcgcaaaagatg

SEQ ID NO: 183498 - DNA, 103 bp, Artificial Sequence
  Synthetic Polynucleotide
taatacgactcactatagggatggacggggaggtgggagacataggcggcaacagaggagagccgccatggtctcccacaacctggcggcagcgcaaaagatg

SEQ ID NO: 183499 - DNA, 103 bp, Artificial Sequence
  Synthetic Polynucleotide
taatacgactcactatagggagccgtcctgatggacggggaggtgggagaaacagaggagatctcccatgtccccgtccaacctggcggcagcgcaaaagatg

SEQ ID NO: 183500 - DNA, 103 bp, Artificial Sequence
  Synthetic Polynucleotide
taatacgactcactatagggccgttgcaagagccgtcctgatggacggggaacagaggagaccccgtatgtcaggacggaacctggcggcagcgcaaaagatg

SEQ ID NO: 183501 - DNA, 103 bp, Artificial Sequence
  Synthetic Polynucleotide
taatacgactcactatagggatgctgcaggccgttgcaagagccgtcctgaacagaggagacaggacatgtcttgcaacaacctggcggcagcgcaaaagatg

SEQ ID NO: 183502 - DNA, 103 bp, Artificial Sequence
  Synthetic Polynucleotide
taatacgactcactataggggagcagcataatgctgcaggccgttgcaagaacagaggagacttgcaatggcctgcagcaacctggcggcagcgcaaaagatg

SEQ ID NO: 183503 - DNA, 103 bp, Artificial Sequence
  Synthetic Polynucleotide
taatacgactcactatagggtcgcggcccagagcagcataatgctgcaggaacagaggagacctgcaatgttatgctgcaacctggcggcagcgcaaaagatg

SEQ ID NO: 183504 - DNA, 103 bp, Artificial Sequence
  Synthetic Polynucleotide
taatacgactcactataggggctaccatctccactgccacattctgggagaacagaggagactcccaatgtgtggcagtaacctggcggcagcgcaaaagatg

SEQ ID NO: 183505 - DNA, 103 bp, Artificial Sequence
  Synthetic Polynucleotide
taatacgactcactataggggcccacgctgtcgcggcccagagcagcataaacagaggagatatgctatgctgggccgcaacctggcggcagcgcaaaagatg

SEQ ID NO: 183506 - DNA, 103 bp, Artificial Sequence
  Synthetic Polynucleotide
taatacgactcactatagggcggaggcggcgcccacgctgtcgcggcccaaacagaggagatgggccatgacagcgtggaacctggcggcagcgcaaaagatg

SEQ ID NO: 183507 - DNA, 103 bp, Artificial Sequence
  Synthetic Polynucleotide
taatacgactcactatagggtccaggttgacggaggcggcgcccacgctgaacagaggagacagcgtatgcgccgcctcaacctggcggcagcgcaaaagatg

SEQ ID NO: 183508 - DNA, 103 bp, Artificial Sequence
  Synthetic Polynucleotide
taatacgactcactatagggatccgagggctccaggttgacggaggcggcaacagaggagagccgccatggtcaacctgaacctggcggcagcgcaaaagatg

SEQ ID NO: 183509 - DNA, 103 bp, Artificial Sequence
  Synthetic Polynucleotide
taatacgactcactatagggcctgcggcacatccgagggctccaggttgaaacagaggagatcaaccatgagccctcggaacctggcggcagcgcaaaagatg

SEQ ID NO: 183510 - DNA, 103 bp, Artificial Sequence
  Synthetic Polynucleotide
taatacgactcactatagggctgtacacgtcctgcggcacatccgagggcaacagaggagagccctcatgtgtgccgcaaacctggcggcagcgcaaaagatg

SEQ ID NO: 183511 - DNA, 103 bp, Artificial Sequence
  Synthetic Polynucleotide
taatacgactcactatagggggccacgccgctgtacacgtcctgcggcacaacagaggagagtgccgatggacgtgtacaacctggcggcagcgcaaaagatg

SEQ ID NO: 183512 - DNA, 103 bp, Artificial Sequence
  Synthetic Polynucleotide
taatacgactcactatagggccacctgcgcggccacgccgctgtacacgtaacagaggagaacgtgtatggcggcgtggaacctggcggcagcgcaaaagatg

SEQ ID NO: 183513 - DNA, 103 bp, Artificial Sequence
  Synthetic Polynucleotide
taatacgactcactatagggcggaacacctccacctgcgcggccacgccgaacagaggagacggcgtatgcgcgcaggtaacctggcggcagcgcaaaagatg

SEQ ID NO: 183514 - DNA, 103 bp, Artificial Sequence
  Synthetic Polynucleotide
taatacgactcactataggggtcctgcctacggaacacctccacctgcgcaacagaggagagcgcagatggaggtgttcaacctggcggcagcgcaaaagatg

SEQ ID NO: 183515 - DNA, 103 bp, Artificial Sequence
  Synthetic Polynucleotide
taatacgactcactataggggtggctggaggctaccatctccactgccacaacagaggagagtggcaatggagatggtaaacctggcggcagcgcaaaagatg

SEQ ID NO: 183516 - DNA, 103 bp, Artificial Sequence
  Synthetic Polynucleotide
taatacgactcactatagggcccgctgggcgtcctgcctacggaacacctaacagaggagaaggtgtatggtaggcaggaacctggcggcagcgcaaaagatg

SEQ ID NO: 183517 - DNA, 103 bp, Artificial Sequence
  Synthetic Polynucleotide
taatacgactcactatagggacccgcatgccccgctgggcgtcctgcctaaacagaggagataggcaatgcgcccagcgaacctggcggcagcgcaaaagatg

SEQ ID NO: 183518 - DNA, 103 bp, Artificial Sequence
  Synthetic Polynucleotide
taatacgactcactatagggcacctgtgccacccgcatgccccgctgggcaacagaggagagcccagatgggcatgcggaacctggcggcagcgcaaaagatg

SEQ ID NO: 183519 - DNA, 103 bp, Artificial Sequence
  Synthetic Polynucleotide
taatacgactcactatagggaaccttccagcacctgtgccacccgcatgcaacagaggagagcatgcatgtggcacaggaacctggcggcagcgcaaaagatg

SEQ ID NO: 183520 - DNA, 103 bp, Artificial Sequence
  Synthetic Polynucleotide
taatacgactcactatagggcgggtgatgaaaccttccagcacctgtgccaacagaggagaggcacaatggctggaaggaacctggcggcagcgcaaaagatg

SEQ ID NO: 183521 - DNA, 103 bp, Artificial Sequence
  Synthetic Polynucleotide
taatacgactcactatagggcaccaccttgcgggtgatgaaaccttccagaacagaggagactggaaatgttcatcaccaacctggcggcagcgcaaaagatg

SEQ ID NO: 183522 - DNA, 103 bp, Artificial Sequence
  Synthetic Polynucleotide
taatacgactcactatagggccgtctgcttcaccaccttgcgggtgatgaaacagaggagatcatcaatggcaaggtggaacctggcggcagcgcaaaagatg

SEQ ID NO: 183523 - DNA, 103 bp, Artificial Sequence
  Synthetic Polynucleotide
taatacgactcactatagggaccgtcatcaccgtctgcttcaccaccttgaacagaggagacaaggtatggaagcagacaacctggcggcagcgcaaaagatg

SEQ ID NO: 183524 - DNA, 103 bp, Artificial Sequence
  Synthetic Polynucleotide
taatacgactcactatagggcccgtacaccaccgtcatcaccgtctgcttaacagaggagaaagcagatggtgatgacgaacctggcggcagcgcaaaagatg

SEQ ID NO: 183525 - DNA, 103 bp, Artificial Sequence
  Synthetic Polynucleotide
taatacgactcactatagggagcgcgtgaccccgtacaccaccgtcatcaaacagaggagatgatgaatgtggtgtacgaacctggcggcagcgcaaaagatg

SEQ ID NO: 183526 - DNA, 103 bp, Artificial Sequence
  Synthetic Polynucleotide
taatacgactcactatagggagggctcgtttgagccccgccgctccgcggaacagaggagaccgcggatgggcggggctaacctggcggcagcgcaaaagatg

SEQ ID NO: 183527 - DNA, 103 bp, Artificial Sequence
  Synthetic Polynucleotide
taatacgactcactatagggaccttcctgggtggctggaggctaccatctaacagaggagaagatggatgcctccagccaacctggcggcagcgcaaaagatg

SEQ ID NO: 183528 - DNA, 103 bp, Artificial Sequence
  Synthetic Polynucleotide
taatacgactcactatagggcgcccgccatagcgcgtgaccccgtacaccaacagaggagaggtgtaatgggtcacgcgaacctggcggcagcgcaaaagatg

SEQ ID NO: 183529 - DNA, 103 bp, Artificial Sequence
  Synthetic Polynucleotide
taatacgactcactatagggaatctgcaggcgcccgccatagcgcgtgacaacagaggagagtcacgatgtatggcgggaacctggcggcagcgcaaaagatg

SEQ ID NO: 183530 - DNA, 103 bp, Artificial Sequence
  Synthetic Polynucleotide
taatacgactcactatagggggcgcttctcaatctgcaggcgcccgccataacagaggagaatggcgatggcctgcagaaacctggcggcagcgcaaaagatg

SEQ ID NO: 183531 - DNA, 103 bp, Artificial Sequence
  Synthetic Polynucleotide
taatacgactcactatagggagctcccggaggcgcttctcaatctgcaggaacagaggagacctgcaatgtgagaagcgaacctggcggcagcgcaaaagatg

SEQ ID NO: 183532 - DNA, 103 bp, Artificial Sequence
  Synthetic Polynucleotide
taatacgactcactatagggaaagtcgctcagctcccggaggcgcttctcaacagaggagagagaagatgctccgggagaacctggcggcagcgcaaaagatg

SEQ ID NO: 183533 - DNA, 103 bp, Artificial Sequence
  Synthetic Polynucleotide
taatacgactcactatagggactcctggggaaagtcgctcagctcccggaaacagaggagatccgggatgtgagcgactaacctggcggcagcgcaaaagatg

SEQ ID NO: 183534 - DNA, 103 bp, Artificial Sequence
  Synthetic Polynucleotide
taatacgactcactatagggtcccacacgaactcctggggaaagtcgctcaacagaggagagagcgaatgtccccaggaaacctggcggcagcgcaaaagatg

SEQ ID NO: 183535 - DNA, 103 bp, Artificial Sequence
  Synthetic Polynucleotide
taatacgactcactataggggtgagaggcctcccacacgaactcctggggaacagaggagaccccagatgttcgtgtggaacctggcggcagcgcaaaagatg

SEQ ID NO: 183536 - DNA, 103 bp, Artificial Sequence
  Synthetic Polynucleotide
taatacgactcactataggggtacgagatagtgagaggcctcccacacgaaacagaggagatcgtgtatgaggcctctcaacctggcggcagcgcaaaagatg

SEQ ID NO: 183537 - DNA, 103 bp, Artificial Sequence
  Synthetic Polynucleotide
taatacgactcactatagggaagacctggcgtacgagatagtgagaggccaacagaggagaggcctcatgctatctcgtaacctggcggcagcgcaaaagatg

SEQ ID NO: 183538 - DNA, 103 bp, Artificial Sequence
  Synthetic Polynucleotide
taatacgactcactatagggccccatctggaccttcctgggtggctggagaacagaggagactccagatgcccaggaagaacctggcggcagcgcaaaagatg

SEQ ID NO: 183539 - DNA, 103 bp, Artificial Sequence
  Synthetic Polynucleotide
taatacgactcactatagggtagactcttgaagacctggcgtacgagataaacagaggagatatctcatgcgccaggtcaacctggcggcagcgcaaaagatg

SEQ ID NO: 183540 - DNA, 103 bp, Artificial Sequence
  Synthetic Polynucleotide
taatacgactcactatagggacatctcctgtagactcttgaagacctggcaacagaggagagccaggatgtcaagagtcaacctggcggcagcgcaaaagatg

SEQ ID NO: 183541 - DNA, 103 bp, Artificial Sequence
  Synthetic Polynucleotide
taatacgactcactataggggtccccgagaacatctcctgtagactcttgaacagaggagacaagagatgacaggagataacctggcggcagcgcaaaagatg

SEQ ID NO: 183542 - DNA, 103 bp, Artificial Sequence
  Synthetic Polynucleotide
taatacgactcactataggggatggcccgggtccccgagaacatctcctgaacagaggagacaggagatgttctcggggaacctggcggcagcgcaaaagatg

SEQ ID NO: 183543 - DNA, 103 bp, Artificial Sequence
  Synthetic Polynucleotide
taatacgactcactataggggccagtgctggatggcccgggtccccgagaaacagaggagatctcggatgcccgggccaaacctggcggcagcgcaaaagatg

SEQ ID NO: 183544 - DNA, 103 bp, Artificial Sequence
  Synthetic Polynucleotide
taatacgactcactatagggctctcggtcagccagtgctggatggcccggaacagaggagaccgggcatgccagcactgaacctggcggcagcgcaaaagatg

SEQ ID NO: 183545 - DNA, 103 bp, Artificial Sequence
  Synthetic Polynucleotide
taatacgactcactataggggaggcgggcactctcggtcagccagtgctgaacagaggagacagcacatgctgaccgagaacctggcggcagcgcaaaagatg

SEQ ID NO: 183546 - DNA, 103 bp, Artificial Sequence
  Synthetic Polynucleotide
taatacgactcactatagggtgtgggagatgaggcgggcactctcggtcaaacagaggagatgaccgatggtgcccgccaacctggcggcagcgcaaaagatg

SEQ ID NO: 183547 - DNA, 103 bp, Artificial Sequence
  Synthetic Polynucleotide
taatacgactcactatagggacagagcccatgtgggagatgaggcgggcaaacagaggagatgcccgatgcatctcccaaacctggcggcagcgcaaaagatg

SEQ ID NO: 183548 - DNA, 103 bp, Artificial Sequence
  Synthetic Polynucleotide
taatacgactcactatagggccactccaccacagagcccatgtgggagataacagaggagaatctccatgatgggctctaacctggcggcagcgcaaaagatg

SEQ ID NO: 183549 - DNA, 103 bp, Artificial Sequence
  Synthetic Polynucleotide
taatacgactcactatagggcatccttggcccccatctggaccttcctggaacagaggagaccaggaatgtccagatggaacctggcggcagcgcaaaagatg

SEQ ID NO: 183550 - DNA, 103 bp, Artificial Sequence
  Synthetic Polynucleotide
taatacgactcactatagggggggtgtgacccactccaccacagagcccaaacagaggagatgggctatgtggtggagtaacctggcggcagcgcaaaagatg

SEQ ID NO: 183551 - DNA, 103 bp, Artificial Sequence
  Synthetic Polynucleotide
taatacgactcactataggggggacgcccaggggtgtgacccactccaccaacagaggagaggtggaatgggtcacaccaacctggcggcagcgcaaaagatg

SEQ ID NO: 183552 - DNA, 103 bp, Artificial Sequence
  Synthetic Polynucleotide
taatacgactcactatagggctggatgacggggacgcccaggggtgtgacaacagaggagagtcacaatgctgggcgtcaacctggcggcagcgcaaaagatg

SEQ ID NO: 183553 - DNA, 103 bp, Artificial Sequence
  Synthetic Polynucleotide
taatacgactcactatagggggcgatagggctggatgacggggacgcccaaacagaggagatgggcgatgccgtcatccaacctggcggcagcgcaaaagatg

SEQ ID NO: 183554 - DNA, 103 bp, Artificial Sequence
  Synthetic Polynucleotide
taatacgactcactatagggttggagtccaggcgatagggctggatgacgaacagaggagacgtcatatggccctatcgaacctggcggcagcgcaaaagatg

SEQ ID NO: 183555 - DNA, 103 bp, Artificial Sequence
  Synthetic Polynucleotide
taatacgactcactatagggttgcttgaccttggagtccaggcgatagggaacagaggagaccctatatgctggactccaacctggcggcagcgcaaaagatg

SEQ ID NO: 183556 - DNA, 103 bp, Artificial Sequence
  Synthetic Polynucleotide
taatacgactcactatagggcacctcctatttgcttgaccttggagtccaaacagaggagatggactatgaggtcaagcaacctggcggcagcgcaaaagatg

SEQ ID NO: 183557 - DNA, 103 bp, Artificial Sequence
  Synthetic Polynucleotide
taatacgactcactatagggctctgaattccacctcctatttgcttgaccaacagaggagaggtcaaatgaataggaggaacctggcggcagcgcaaaagatg

SEQ ID NO: 183558 - DNA, 103 bp, Artificial Sequence
  Synthetic Polynucleotide
taatacgactcactataggggtaggtgatgctctgaattccacctcctataacagaggagaataggaatgggaattcagaacctggcggcagcgcaaaagatg

SEQ ID NO: 183559 - DNA, 103 bp, Artificial Sequence
  Synthetic Polynucleotide
taatacgactcactatagggcgttgtgggtgtaggtgatgctctgaattcaacagaggagagaattcatggcatcacctaacctggcggcagcgcaaaagatg

SEQ ID NO: 183560 - DNA, 103 bp, Artificial Sequence
  Synthetic Polynucleotide
taatacgactcactatagggaccggggtggcatccttggcccccatctggaacagaggagaccagatatgggccaaggaaacctggcggcagcgcaaaagatg

SEQ ID NO: 183561 - DNA, 103 bp, Artificial Sequence
  Synthetic Polynucleotide
taatacgactcactatagggctgatgtctccgttgtgggtgtaggtgatgaacagaggagacatcacatgcacccacaaaacctggcggcagcgcaaaagatg

SEQ ID NO: 183562 - DNA, 103 bp, Artificial Sequence
  Synthetic Polynucleotide
taatacgactcactataggggggctttcggctgatgtctccgttgtgggtaacagaggagaacccacatgggagacatcaacctggcggcagcgcaaaagatg

SEQ ID NO: 183563 - DNA, 103 bp, Artificial Sequence
  Synthetic Polynucleotide
taatacgactcactatagggtacgtgtgttgggctttcggctgatgtctcaacagaggagagagacaatggccgaaagcaacctggcggcagcgcaaaagatg

SEQ ID NO: 183564 - DNA, 103 bp, Artificial Sequence
  Synthetic Polynucleotide
taatacgactcactatagggttcttctgcttacgtgtgttgggctttcggaacagaggagaccgaaaatgcaacacacgaacctggcggcagcgcaaaagatg

SEQ ID NO: 183565 - DNA, 103 bp, Artificial Sequence
  Synthetic Polynucleotide
taatacgactcactatagggcgggaagccgttcttctgcttacgtgtgttaacagaggagaaacacaatgaagcagaagaacctggcggcagcgcaaaagatg

SEQ ID NO: 183566 - DNA, 103 bp, Artificial Sequence
  Synthetic Polynucleotide
taatacgactcactatagggtgaagttgggcgggaagccgttcttctgctaacagaggagaagcagaatgacggcttccaacctggcggcagcgcaaaagatg

SEQ ID NO: 183567 - DNA, 103 bp, Artificial Sequence
  Synthetic Polynucleotide
taatacgactcactatagggagcgagtggatgaagttgggcgggaagccgaacagaggagacggcttatggcccaacttaacctggcggcagcgcaaaagatg

SEQ ID NO: 183568 - DNA, 103 bp, Artificial Sequence
  Synthetic Polynucleotide
taatacgactcactatagggggaggagtccagcgagtggatgaagttgggaacagaggagacccaacatgatccactcgaacctggcggcagcgcaaaagatg

SEQ ID NO: 183569 - DNA, 103 bp, Artificial Sequence
  Synthetic Polynucleotide
taatacgactcactataggggcatcatgtgggaggagtccagcgagtggaaacagaggagatccactatgtggactcctaacctggcggcagcgcaaaagatg

SEQ ID NO: 183570 - DNA, 103 bp, Artificial Sequence
  Synthetic Polynucleotide
taatacgactcactatagggagggcggtgagcatcatgtgggaggagtccaacagaggagaggactcatgccacatgataacctggcggcagcgcaaaagatg

SEQ ID NO: 183571 - DNA, 103 bp, Artificial Sequence
  Synthetic Polynucleotide
taatacgactcactataggggccacagggcaccggggtggcatccttggcaacagaggagagccaagatggccaccccgaacctggcggcagcgcaaaagatg

SEQ ID NO: 183572 - DNA, 103 bp, Artificial Sequence
  Synthetic Polynucleotide
taatacgactcactataggggtagcagtgcagggcggtgagcatcatgtgaacagaggagacacatgatgctcaccgccaacctggcggcagcgcaaaagatg

SEQ ID NO: 183573 - DNA, 103 bp, Artificial Sequence
  Synthetic Polynucleotide
taatacgactcactatagggggcccttcctgtagcagtgcagggcggtgaaacagaggagatcaccgatgtgcactgctaacctggcggcagcgcaaaagatg

SEQ ID NO: 183574 - DNA, 103 bp, Artificial Sequence
  Synthetic Polynucleotide
taatacgactcactatagggacgaaggtcaggcccttcctgtagcagtgcaacagaggagagcactgatgcaggaagggaacctggcggcagcgcaaaagatg

SEQ ID NO: 183575 - DNA, 103 bp, Artificial Sequence
  Synthetic Polynucleotide
taatacgactcactataggggtgcacagagacgaaggtcaggcccttcctaacagaggagaaggaagatgctgaccttcaacctggcggcagcgcaaaagatg

SEQ ID NO: 183576 - DNA, 103 bp, Artificial Sequence
  Synthetic Polynucleotide
taatacgactcactatagggagtaacagtcgtgcacagagacgaaggtcaaacagaggagatgacctatgtctctgtgcaacctggcggcagcgcaaaagatg

SEQ ID NO: 183577 - DNA, 103 bp, Artificial Sequence
  Synthetic Polynucleotide
taatacgactcactataggggcgtgagtccagtaacagtcgtgcacagagaacagaggagactctgtatgcgactgttaaacctggcggcagcgcaaaagatg

SEQ ID NO: 183578 - DNA, 103 bp, Artificial Sequence
  Synthetic Polynucleotide
taatacgactcactataggggacatcagctgcgtgagtccagtaacagtcaacagaggagagactgtatgtggactcacaacctggcggcagcgcaaaagatg

SEQ ID NO: 183579 - DNA, 103 bp, Artificial Sequence
  Synthetic Polynucleotide
taatacgactcactatagggtcatgacggagacatcagctgcgtgagtccaacagaggagaggactcatgcagctgatgaacctggcggcagcgcaaaagatg

SEQ ID NO: 183580 - DNA, 103 bp, Artificial Sequence
  Synthetic Polynucleotide
taatacgactcactatagggcacacctggttcatgacggagacatcagctaacagaggagaagctgaatgctccgtcataacctggcggcagcgcaaaagatg

SEQ ID NO: 183581 - DNA, 103 bp, Artificial Sequence
  Synthetic Polynucleotide
taatacgactcactatagggctgctcccggcacacctggttcatgacggaaacagaggagatccgtcatgaaccaggtgaacctggcggcagcgcaaaagatg

SEQ ID NO: 183582 - DNA, 103 bp, Artificial Sequence
  Synthetic Polynucleotide
taatacgactcactatagggttgcccagcggccacagggcaccggggtggaacagaggagaccacccatgtgccctgtgaacctggcggcagcgcaaaagatg

SEQ ID NO: 183583 - DNA, 103 bp, Artificial Sequence
  Synthetic Polynucleotide
taatacgactcactatagggagcggacaaactgctcccggcacacctggtaacagaggagaaccaggatggccgggagcaacctggcggcagcgcaaaagatg

SEQ ID NO: 183584 - DNA, 103 bp, Artificial Sequence
  Synthetic Polynucleotide
taatacgactcactatagggtcgctgtgcaagcggacaaactgctcccggaacagaggagaccgggaatggtttgtccgaacctggcggcagcgcaaaagatg

SEQ ID NO: 183585 - DNA, 103 bp, Artificial Sequence
  Synthetic Polynucleotide
taatacgactcactatagggcaggatgggctcgctgtgcaagcggacaaaaacagaggagatttgtcatgttgcacagcaacctggcggcagcgcaaaagatg

SEQ ID NO: 183586 - DNA, 103 bp, Artificial Sequence
  Synthetic Polynucleotide
taatacgactcactatagggacaggtcctgcaggatgggctcgctgtgcaaacagaggagatgcacaatgagcccatccaacctggcggcagcgcaaaagatg

SEQ ID NO: 183587 - DNA, 103 bp, Artificial Sequence
  Synthetic Polynucleotide
taatacgactcactatagggaggaatctggacaggtcctgcaggatgggcaacagaggagagcccatatggcaggacctaacctggcggcagcgcaaaagatg

SEQ ID NO: 183588 - DNA, 103 bp, Artificial Sequence
  Synthetic Polynucleotide
taatacgactcactatagggccgcttgaccaggaatctggacaggtcctgaacagaggagacaggacatgtccagattcaacctggcggcagcgcaaaagatg

SEQ ID NO: 183589 - DNA, 103 bp, Artificial Sequence
  Synthetic Polynucleotide
taatacgactcactatagggcagagcagaaccgcttgaccaggaatctggaacagaggagaccagatatgtggtcaagcaacctggcggcagcgcaaaagatg

SEQ ID NO: 183590 - DNA, 103 bp, Artificial Sequence
  Synthetic Polynucleotide
taatacgactcactatagggttctggggctcagagcagaaccgcttgaccaacagaggagaggtcaaatggttctgctcaacctggcggcagcgcaaaagatg

SEQ ID NO: 183591 - DNA, 103 bp, Artificial Sequence
  Synthetic Polynucleotide
taatacgactcactatagggctccaagatcttctggggctcagagcagaaaacagaggagattctgcatggagccccagaacctggcggcagcgcaaaagatg

SEQ ID NO: 183592 - DNA, 103 bp, Artificial Sequence
  Synthetic Polynucleotide
taatacgactcactataggggctggctggcctccaagatcttctggggctaacagaggagaagccccatgagatcttggaacctggcggcagcgcaaaagatg

SEQ ID NO: 183593 - DNA, 103 bp, Artificial Sequence
  Synthetic Polynucleotide
taatacgactcactatagggtccagtatctttgcccagcggccacagggcaacagaggagagccctgatgccgctgggcaacctggcggcagcgcaaaagatg

SEQ ID NO: 183594 - DNA, 103 bp, Artificial Sequence
  Synthetic Polynucleotide
taatacgactcactataggggtctccttcagctggctggcctccaagatcaacagaggagagatcttatgggccagccaaacctggcggcagcgcaaaagatg

SEQ ID NO: 183595 - DNA, 103 bp, Artificial Sequence
  Synthetic Polynucleotide
taatacgactcactatagggcgcctgcagtgtctccttcagctggctggcaacagaggagagccagcatgctgaaggagaacctggcggcagcgcaaaagatg

SEQ ID NO: 183596 - DNA, 103 bp, Artificial Sequence
  Synthetic Polynucleotide
taatacgactcactataggggcttgggcaccgcctgcagtgtctccttcaaacagaggagatgaaggatgcactgcaggaacctggcggcagcgcaaaagatg

SEQ ID NO: 183597 - DNA, 103 bp, Artificial Sequence
  Synthetic Polynucleotide
taatacgactcactatagggaaggcccctggcttgggcaccgcctgcagtaacagaggagaactgcaatgggtgcccaaaacctggcggcagcgcaaaagatg

SEQ ID NO: 183598 - DNA, 103 bp, Artificial Sequence
  Synthetic Polynucleotide
taatacgactcactatagggctccaggtcgaaggcccctggcttgggcacaacagaggagagtgcccatgccaggggccaacctggcggcagcgcaaaagatg

SEQ ID NO: 183599 - DNA, 103 bp, Artificial Sequence
  Synthetic Polynucleotide
taatacgactcactataggggcttcacctgctccaggtcgaaggcccctgaacagaggagacaggggatgtcgacctggaacctggcggcagcgcaaaagatg

SEQ ID NO: 183600 - DNA, 103 bp, Artificial Sequence
  Synthetic Polynucleotide
taatacgactcactatagggtaggtggaacgcttcacctgctccaggtcgaacagaggagacgacctatggcaggtgaaaacctggcggcagcgcaaaagatg

SEQ ID NO: 183601 - DNA, 103 bp, Artificial Sequence
  Synthetic Polynucleotide
taatacgactcactataggggctgaagaagtaggtggaacgcttcacctgaacagaggagacaggtgatgcgttccaccaacctggcggcagcgcaaaagatg

SEQ ID NO: 183602 - DNA, 103 bp, Artificial Sequence
  Synthetic Polynucleotide
taatacgactcactatagggcttatccttctccagtatctttgcccagcgaacagaggagacgctggatgaagatactgaacctggcggcagcgcaaaagatg

SEQ ID NO: 183603 - DNA, 103 bp, Artificial Sequence
  Synthetic Polynucleotide
taatacgactcactataggggctgggtccgcttatccttctccagtatctaacagaggagaagatacatgagaaggataaacctggcggcagcgcaaaagatg

SEQ ID NO: 183604 - DNA, 103 bp, Artificial Sequence
  Synthetic Polynucleotide
taatacgactcactatagggatacgcatctgctgggtccgcttatccttcaacagaggagagaaggaatggcggacccaaacctggcggcagcgcaaaagatg

SEQ ID NO: 183605 - DNA, 103 bp, Artificial Sequence
  Synthetic Polynucleotide
taatacgactcactataggggcaaggccgtagggctcgtttgagccccgcaacagaggagagcggggatgaaacgagccaacctggcggcagcgcaaaagatg

SEQ ID NO: 183606 - DNA, 103 bp, Artificial Sequence
  Synthetic Polynucleotide
taatacgactcactatagggcaaccgctgcatacgcatctgctgggtccgaacagaggagacggaccatgcagatgcgtaacctggcggcagcgcaaaagatg

SEQ ID NO: 183607 - DNA, 103 bp, Artificial Sequence
  Synthetic Polynucleotide
taatacgactcactataggggcttcgccttcaaccgctgcatacgcatctaacagaggagaagatgcatgtgcagcggtaacctggcggcagcgcaaaagatg

SEQ ID NO: 183608 - DNA, 103 bp, Artificial Sequence
  Synthetic Polynucleotide
taatacgactcactatagggggcatctgcagcttcgccttcaaccgctgcaacagaggagagcagcgatggaaggcgaaaacctggcggcagcgcaaaagatg

SEQ ID NO: 183609 - DNA, 103 bp, Artificial Sequence
  Synthetic Polynucleotide
taatacgactcactataggggctctggaatggcatctgcagcttcgccttaacagaggagaaaggcgatgctgcagatgaacctggcggcagcgcaaaagatg

SEQ ID NO: 183610 - DNA, 103 bp, Artificial Sequence
  Synthetic Polynucleotide
taatacgactcactatagggtgaactccccgctctggaatggcatctgcaaacagaggagatgcagaatgcattccagaaacctggcggcagcgcaaaagatg

SEQ ID NO: 183611 - DNA, 103 bp, Artificial Sequence
  Synthetic Polynucleotide
taatacgactcactataggggtcagcgccttgaactccccgctctggaataacagaggagaattccaatgcggggagttaacctggcggcagcgcaaaagatg

SEQ ID NO: 183612 - DNA, 103 bp, Artificial Sequence
  Synthetic Polynucleotide
taatacgactcactatagggcaggcgcctggtcagcgccttgaactccccaacagaggagaggggagatgaaggcgctgaacctggcggcagcgcaaaagatg

SEQ ID NO: 183613 - DNA, 103 bp, Artificial Sequence
  Synthetic Polynucleotide
taatacgactcactataggggctccacctgcaggcgcctggtcagcgcctaacagaggagaaggcgcatgccaggcgccaacctggcggcagcgcaaaagatg

SEQ ID NO: 183614 - DNA, 103 bp, Artificial Sequence
  Synthetic Polynucleotide
taatacgactcactatagggaggagccggggctccacctgcaggcgcctgaacagaggagacaggcgatggcaggtggaaacctggcggcagcgcaaaagatg

SEQ ID NO: 183615 - DNA, 103 bp, Artificial Sequence
  Synthetic Polynucleotide
taatacgactcactatagggctgcttgctcaggagccggggctccacctgaacagaggagacaggtgatgccccggctcaacctggcggcagcgcaaaagatg

SEQ ID NO: 183616 - DNA, 103 bp, Artificial Sequence
  Synthetic Polynucleotide
taatacgactcactatagggccgggcggccgcaaggccgtagggctcgttaacagaggagaaacgagatgtacggccttaacctggcggcagcgcaaaagatg

SEQ ID NO: 183617 - DNA, 103 bp, Artificial Sequence
  Synthetic Polynucleotide
taatacgactcactatagggacccggccatctgcttgctcaggagccgggaacagaggagacccggcatgtgagcaagcaacctggcggcagcgcaaaagatg

SEQ ID NO: 183618 - DNA, 103 bp, Artificial Sequence
  Synthetic Polynucleotide
taatacgactcactatagggtcctccaggcacccggccatctgcttgctcaacagaggagagagcaaatggatggccggaacctggcggcagcgcaaaagatg

SEQ ID NO: 183619 - DNA, 103 bp, Artificial Sequence
  Synthetic Polynucleotide
taatacgactcactataggggcgcgtgcagtcctccaggcacccggccataacagaggagaatggccatgtgcctggagaacctggcggcagcgcaaaagatg

SEQ ID NO: 183620 - DNA, 103 bp, Artificial Sequence
  Synthetic Polynucleotide
taatacgactcactatagggcgggggcctggcgcgtgcagtcctccaggcaacagaggagagcctggatgactgcacgcaacctggcggcagcgcaaaagatg

SEQ ID NO: 183621 - DNA, 103 bp, Artificial Sequence
  Synthetic Polynucleotide
taatacgactcactatagggcaggggctctcgggggcctggcgcgtgcagaacagaggagactgcacatgccaggccccaacctggcggcagcgcaaaagatg

SEQ ID NO: 183622 - DNA, 103 bp, Artificial Sequence
  Synthetic Polynucleotide
taatacgactcactatagggctgctcctcccaggggctctcgggggcctgaacagaggagacaggccatggagagccccaacctggcggcagcgcaaaagatg

SEQ ID NO: 183623 - DNA, 103 bp, Artificial Sequence
  Synthetic Polynucleotide
taatacgactcactataggggccgggccagctgctcctcccaggggctctaacagaggagaagagccatggggaggagcaacctggcggcagcgcaaaagatg

SEQ ID NO: 183624 - DNA, 103 bp, Artificial Sequence
  Synthetic Polynucleotide
taatacgactcactatagggtcctgcagcagccgggccagctgctcctccaacagaggagaggaggaatggctggcccgaacctggcggcagcgcaaaagatg

SEQ ID NO: 183625 - DNA, 103 bp, Artificial Sequence
  Synthetic Polynucleotide
taatacgactcactatagggcccaggggcctcctgcagcagccgggccagaacagaggagactggccatgctgctgcagaacctggcggcagcgcaaaagatg

SEQ ID NO: 183626 - DNA, 103 bp, Artificial Sequence
  Synthetic Polynucleotide
taatacgactcactatagggggctcagcttcccaggggcctcctgcagcaaacagaggagatgctgcatgaggcccctgaacctggcggcagcgcaaaagatg

SEQ ID NO: 183627 - DNA, 103 bp, Artificial Sequence
  Synthetic Polynucleotide
taatacgactcactatagggccggggagtcccgggcggccgcaaggccgtaacagaggagaacggccatgcggccgcccaacctggcggcagcgcaaaagatg

SEQ ID NO: 183628 - DNA, 103 bp, Artificial Sequence
  Synthetic Polynucleotide
taatacgactcactatagggtccacatcgaggctcagcttcccaggggccaacagaggagaggccccatggaagctgagaacctggcggcagcgcaaaagatg

SEQ ID NO: 183629 - DNA, 103 bp, Artificial Sequence
  Synthetic Polynucleotide
taatacgactcactatagggcggggcctgctccacatcgaggctcagcttaacagaggagaaagctgatgctcgatgtgaacctggcggcagcgcaaaagatg

SEQ ID NO: 183630 - DNA, 103 bp, Artificial Sequence
  Synthetic Polynucleotide
taatacgactcactataggggctgccccgacggggcctgctccacatcgaaacagaggagatcgatgatgagcaggcccaacctggcggcagcgcaaaagatg

SEQ ID NO: 183631 - DNA, 103 bp, Artificial Sequence
  Synthetic Polynucleotide
taatacgactcactataggggcctgcgagtgctgccccgacggggcctgcaacagaggagagcaggcatggtcggggcaaacctggcggcagcgcaaaagatg

SEQ ID NO: 183632 - DNA, 103 bp, Artificial Sequence
  Synthetic Polynucleotide
taatacgactcactatagggtgagagctgggcctgcgagtgctgccccgaaacagaggagatcggggatgcactcgcagaacctggcggcagcgcaaaagatg

SEQ ID NO: 183633 - DNA, 103 bp, Artificial Sequence
  Synthetic Polynucleotide
taatacgactcactataggggctgctgacctgagagctgggcctgcgagtaacagaggagaactcgcatgcccagctctaacctggcggcagcgcaaaagatg

SEQ ID NO: 183634 - DNA, 103 bp, Artificial Sequence
  Synthetic Polynucleotide
taatacgactcactatagggaggagcctctgctgctgacctgagagctggaacagaggagaccagctatgaggtcagcaaacctggcggcagcgcaaaagatg

SEQ ID NO: 183635 - DNA, 103 bp, Artificial Sequence
  Synthetic Polynucleotide
taatacgactcactataggggaagaaggccaggagcctctgctgctgaccaacagaggagaggtcagatgcagaggctcaacctggcggcagcgcaaaagatg

SEQ ID NO: 183636 - DNA, 103 bp, Artificial Sequence
  Synthetic Polynucleotide
taatacgactcactatagggggcagcacttgaagaaggccaggagcctctaacagaggagaagaggcatgtggccttctaacctggcggcagcgcaaaagatg

SEQ ID NO: 183637 - DNA, 103 bp, Artificial Sequence
  Synthetic Polynucleotide
taatacgactcactatagggtcagtgagcaggcagcacttgaagaaggccaacagaggagaggccttatgcaagtgctgaacctggcggcagcgcaaaagatg

SEQ ID NO: 183638 - DNA, 103 bp, Artificial Sequence
  Synthetic Polynucleotide
taatacgactcactatagggcccttctttgccggggagtcccgggcggccaacagaggagaggccgcatgggactccccaacctggcggcagcgcaaaagatg

SEQ ID NO: 183639 - DNA, 103 bp, Artificial Sequence
  Synthetic Polynucleotide
taatacgactcactataggggggcagctggtcagtgagcaggcagcacttaacagaggagaaagtgcatgctgctcactaacctggcggcagcgcaaaagatg

SEQ ID NO: 183640 - DNA, 103 bp, Artificial Sequence
  Synthetic Polynucleotide
taatacgactcactatagggggtgggcgaggggcagctggtcagtgagcaaacagaggagatgctcaatgaccagctgcaacctggcggcagcgcaaaagatg

SEQ ID NO: 183641 - DNA, 103 bp, Artificial Sequence
  Synthetic Polynucleotide
taatacgactcactatagggaccagcaggtggtgggcgaggggcagctggaacagaggagaccagctatgcctcgcccaaacctggcggcagcgcaaaagatg

SEQ ID NO: 183642 - DNA, 103 bp, Artificial Sequence
  Synthetic Polynucleotide
taatacgactcactataggggtggtggacgaccagcaggtggtgggcgagaacagaggagactcgccatgcacctgctgaacctggcggcagcgcaaaagatg

SEQ ID NO: 183643 - DNA, 103 bp, Artificial Sequence
  Synthetic Polynucleotide
taatacgactcactataggggccgctggccgtggtggacgaccagcaggtaacagaggagaacctgcatgtcgtccaccaacctggcggcagcgcaaaagatg

SEQ ID NO: 183644 - DNA, 103 bp, Artificial Sequence
  Synthetic Polynucleotide
taatacgactcactatagggttccgcttctgccgctggccgtggtggacgaacagaggagacgtccaatgcggccagcgaacctggcggcagcgcaaaagatg

SEQ ID NO: 183645 - DNA, 103 bp, Artificial Sequence
  Synthetic Polynucleotide
taatacgactcactatagggcgtgagcagcttccgcttctgccgctggccaacagaggagaggccagatgcagaagcggaacctggcggcagcgcaaaagatg

SEQ ID NO: 183646 - DNA, 103 bp, Artificial Sequence
  Synthetic Polynucleotide
taatacgactcactatagggacatgtccagcgtgagcagcttccgcttctaacagaggagaagaagcatgagctgctcaaacctggcggcagcgcaaaagatg

SEQ ID NO: 183647 - DNA, 103 bp, Artificial Sequence
  Synthetic Polynucleotide
taatacgactcactatagggacggcgttgtacatgtccagcgtgagcagcaacagaggagagctgctatggctggacataacctggcggcagcgcaaaagatg

SEQ ID NO: 183648 - DNA, 103 bp, Artificial Sequence
  Synthetic Polynucleotide
taatacgactcactataggggccaagcatcacggcgttgtacatgtccagaacagaggagactggacatgtacaacgccaacctggcggcagcgcaaaagatg

SEQ ID NO: 183649 - DNA, 103 bp, Artificial Sequence
  Synthetic Polynucleotide
taatacgactcactatagggcaccggcggtcccttctttgccggggagtcaacagaggagagactccatggcaaagaagaacctggcggcagcgcaaaagatg

SEQ ID NO: 183650 - DNA, 103 bp, Artificial Sequence
  Synthetic Polynucleotide
taatacgactcactataggggccgcgcccagccaagcatcacggcgttgtaacagaggagaacaacgatgtgatgcttgaacctggcggcagcgcaaaagatg

SEQ ID NO: 183651 - DNA, 103 bp, Artificial Sequence
  Synthetic Polynucleotide
taatacgactcactatagggaaggcaccctgccgcgcccagccaagcatcaacagaggagagatgctatgctgggcgcgaacctggcggcagcgcaaaagatg

SEQ ID NO: 183652 - DNA, 103 bp, Artificial Sequence
  Synthetic Polynucleotide
taatacgactcactatagggcagctccttgaaggcaccctgccgcgcccaaacagaggagatgggcgatgcagggtgccaacctggcggcagcgcaaaagatg

SEQ ID NO: 183653 - DNA, 103 bp, Artificial Sequence
  Synthetic Polynucleotide
taatacgactcactatagggacacatataccagctccttgaaggcaccctaacagaggagaagggtgatgtcaaggagcaacctggcggcagcgcaaaagatg

SEQ ID NO: 183654 - DNA, 103 bp, Artificial Sequence
  Synthetic Polynucleotide
taatacgactcactatagggaccatgaataacacatataccagctccttgaacagaggagacaaggaatgggtatatgtaacctggcggcagcgcaaaagatg

SEQ ID NO: 183655 - DNA, 103 bp, Artificial Sequence
  Synthetic Polynucleotide
taatacgactcactatagggggcatccttcaccatgaataacacatatacaacagaggagagtatatatgttattcatgaacctggcggcagcgcaaaagatg

SEQ ID NO: 183656 - DNA, 103 bp, Artificial Sequence
  Synthetic Polynucleotide
taatacgactcactataggggagtcaagccggcatccttcaccatgaataaacagaggagatattcaatgtgaaggatgaacctggcggcagcgcaaaagatg

SEQ ID NO: 183657 - DNA, 103 bp, Artificial Sequence
  Synthetic Polynucleotide
taatacgactcactatagggagcaggtccggagtcaagccggcatccttcaacagaggagagaaggaatgcggcttgacaacctggcggcagcgcaaaagatg

SEQ ID NO: 183658 - DNA, 103 bp, Artificial Sequence
  Synthetic Polynucleotide
taatacgactcactatagggcgcataggacagcaggtccggagtcaagccaacagaggagaggcttgatgccggacctgaacctggcggcagcgcaaaagatg

SEQ ID NO: 183659 - DNA, 103 bp, Artificial Sequence
  Synthetic Polynucleotide
taatacgactcactatagggggagggcagccgcataggacagcaggtccgaacagaggagacggaccatgtgtcctatgaacctggcggcagcgcaaaagatg

SEQ ID NO: 183660 - DNA, 103 bp, Artificial Sequence
  Synthetic Polynucleotide
taatacgactcactatagggccgcagacgccaccggcggtcccttctttgaacagaggagacaaagaatggaccgccggaacctggcggcagcgcaaaagatg

SEQ ID NO: 183661 - DNA, 103 bp, Artificial Sequence
  Synthetic Polynucleotide
taatacgactcactatagggcccatgcactggagggcagccgcataggacaacagaggagagtcctaatgggctgccctaacctggcggcagcgcaaaagatg

SEQ ID NO: 183662 - DNA, 103 bp, Artificial Sequence
  Synthetic Polynucleotide
taatacgactcactataggggtcctgcctccccatgcactggagggcagcaacagaggagagctgccatgcagtgcatgaacctggcggcagcgcaaaagatg

SEQ ID NO: 183663 - DNA, 103 bp, Artificial Sequence
  Synthetic Polynucleotide
taatacgactcactatagggcggcgtcctggtcctgcctccccatgcactaacagaggagaagtgcaatgggaggcaggaacctggcggcagcgcaaaagatg

SEQ ID NO: 183664 - DNA, 103 bp, Artificial Sequence
  Synthetic Polynucleotide
taatacgactcactatagggtcgatggtcccggcgtcctggtcctgcctcaacagaggagagaggcaatgccaggacgcaacctggcggcagcgcaaaagatg

SEQ ID NO: 183665 - DNA, 103 bp, Artificial Sequence
  Synthetic Polynucleotide
taatacgactcactatagggcagacacctttcgatggtcccggcgtcctgaacagaggagacaggacatggggaccatcaacctggcggcagcgcaaaagatg

SEQ ID NO: 183666 - DNA, 103 bp, Artificial Sequence
  Synthetic Polynucleotide
taatacgactcactatagggtcatctgttccagacacctttcgatggtccaacagaggagaggaccaatgaaaggtgtcaacctggcggcagcgcaaaagatg

SEQ ID NO: 183667 - DNA, 103 bp, Artificial Sequence
  Synthetic Polynucleotide
taatacgactcactatagggccctcctggctcatctgttccagacaccttaacagaggagaaaggtgatgggaacagataacctggcggcagcgcaaaagatg

SEQ ID NO: 183668 - DNA, 103 bp, Artificial Sequence
  Synthetic Polynucleotide
taatacgactcactatagggcagcttcagcccctcctggctcatctgttcaacagaggagagaacagatgagccaggagaacctggcggcagcgcaaaagatg

SEQ ID NO: 183669 - DNA, 103 bp, Artificial Sequence
  Synthetic Polynucleotide
taatacgactcactatagggagagtgcctgcagcttcagcccctcctggcaacagaggagagccaggatgggctgaagcaacctggcggcagcgcaaaagatg

SEQ ID NO: 183670 - DNA, 103 bp, Artificial Sequence
  Synthetic Polynucleotide
taatacgactcactatagggacggcggtgaagagtgcctgcagcttcagcaacagaggagagctgaaatggcaggcactaacctggcggcagcgcaaaagatg

SEQ ID NO: 183671 - DNA, 103 bp, Artificial Sequence
  Synthetic Polynucleotide
taatacgactcactatagggatcagccgaagtaaaagcttggcaactcataacagaggagaatgagtatgcaagcttttaacctggcggcagcgcaaaagatg

SEQ ID NO: 183672 - DNA, 103 bp, Artificial Sequence
  Synthetic Polynucleotide
taatacgactcactatagggatggttggagactggtagacactcggcagcaacagaggagagctgccatgtgtctaccaaacctggcggcagcgcaaaagatg

SEQ ID NO: 183673 - DNA, 103 bp, Artificial Sequence
  Synthetic Polynucleotide
taatacgactcactatagggcattggtggcatggttggagactggtagacaacagaggagagtctacatgtctccaaccaacctggcggcagcgcaaaagatg

SEQ ID NO: 183674 - DNA, 103 bp, Artificial Sequence
  Synthetic Polynucleotide
taatacgactcactataggggtagacatcacattggtggcatggttggagaacagaggagactccaaatgtgccaccaaaacctggcggcagcgcaaaagatg

SEQ ID NO: 183675 - DNA, 103 bp, Artificial Sequence
  Synthetic Polynucleotide
taatacgactcactatagggagatgggactgtagacatcacattggtggcaacagaggagagccaccatggtgatgtctaacctggcggcagcgcaaaagatg

SEQ ID NO: 183676 - DNA, 103 bp, Artificial Sequence
  Synthetic Polynucleotide
taatacgactcactatagggaagacaaaatagatgggactgtagacatcaaacagaggagatgatgtatgcagtcccataacctggcggcagcgcaaaagatg

SEQ ID NO: 183677 - DNA, 103 bp, Artificial Sequence
  Synthetic Polynucleotide
taatacgactcactataggggtttggatcaaagacaaaatagatgggactaacagaggagaagtcccatgtattttgtcaacctggcggcagcgcaaaagatg

SEQ ID NO: 183678 - DNA, 103 bp, Artificial Sequence
  Synthetic Polynucleotide
taatacgactcactatagggacatttaggagtttggatcaaagacaaaataacagaggagaattttgatgttgatccaaaacctggcggcagcgcaaaagatg

SEQ ID NO: 183679 - DNA, 103 bp, Artificial Sequence
  Synthetic Polynucleotide
taatacgactcactataggggtgtgcacaaacatttaggagtttggatcaaacagaggagatgatccatgctcctaaataacctggcggcagcgcaaaagatg

SEQ ID NO: 183680 - DNA, 103 bp, Artificial Sequence
  Synthetic Polynucleotide
taatacgactcactatagggaccgagaaatgtgtgcacaaacatttaggaaacagaggagatcctaaatgtttgtgcacaacctggcggcagcgcaaaagatg

SEQ ID NO: 183681 - DNA, 103 bp, Artificial Sequence
  Synthetic Polynucleotide
taatacgactcactatagggcaacgttgtcaccgagaaatgtgtgcacaaaacagaggagattgtgcatgcatttctcgaacctggcggcagcgcaaaagatg

SEQ ID NO: 183682 - DNA, 103 bp, Artificial Sequence
  Synthetic Polynucleotide
taatacgactcactataggggtataaaggtatcagccgaagtaaaagcttaacagaggagaaagcttatgcttcggctgaacctggcggcagcgcaaaagatg

SEQ ID NO: 183683 - DNA, 103 bp, Artificial Sequence
  Synthetic Polynucleotide
taatacgactcactatagggctgtgtttcccaacgttgtcaccgagaaataacagaggagaatttctatgtgacaacgtaacctggcggcagcgcaaaagatg

SEQ ID NO: 183684 - DNA, 103 bp, Artificial Sequence
  Synthetic Polynucleotide
taatacgactcactatagggagtcctgttgctgtgtttcccaacgttgtcaacagaggagagacaacatggggaaacacaacctggcggcagcgcaaaagatg

SEQ ID NO: 183685 - DNA, 103 bp, Artificial Sequence
  Synthetic Polynucleotide
taatacgactcactatagggagaataatgaagtcctgttgctgtgtttccaacagaggagaggaaacatggcaacaggaaacctggcggcagcgcaaaagatg

SEQ ID NO: 183686 - DNA, 103 bp, Artificial Sequence
  Synthetic Polynucleotide
taatacgactcactatagggaggaaggaacagaataatgaagtcctgttgaacagaggagacaacagatgttcattattaacctggcggcagcgcaaaagatg

SEQ ID NO: 183687 - DNA, 103 bp, Artificial Sequence
  Synthetic Polynucleotide
taatacgactcactatagggccataatgacaggaaggaacagaataatgaaacagaggagatcattaatgtgttccttcaacctggcggcagcgcaaaagatg

SEQ ID NO: 183688 - DNA, 103 bp, Artificial Sequence
  Synthetic Polynucleotide
taatacgactcactatagggtggctggtttccataatgacaggaaggaacaacagaggagagttcctatgtgtcattataacctggcggcagcgcaaaagatg

SEQ ID NO: 183689 - DNA, 103 bp, Artificial Sequence
  Synthetic Polynucleotide
taatacgactcactatagggcataggttgatggctggtttccataatgacaacagaggagagtcattatggaaaccagcaacctggcggcagcgcaaaagatg

SEQ ID NO: 183690 - DNA, 103 bp, Artificial Sequence
  Synthetic Polynucleotide
taatacgactcactataggggccatcactccataggttgatggctggtttaacagaggagaaaaccaatgatcaacctaaacctggcggcagcgcaaaagatg

SEQ ID NO: 183691 - DNA, 103 bp, Artificial Sequence
  Synthetic Polynucleotide
taatacgactcactatagggtaaactacctgccatcactccataggttgaaacagaggagatcaaccatgggagtgatgaacctggcggcagcgcaaaagatg

SEQ ID NO: 183692 - DNA, 103 bp, Artificial Sequence
  Synthetic Polynucleotide
taatacgactcactataggggacaaggggttaaactacctgccatcactcaacagaggagagagtgaatgcaggtagttaacctggcggcagcgcaaaagatg

SEQ ID NO: 183693 - DNA, 103 bp, Artificial Sequence
  Synthetic Polynucleotide
taatacgactcactataggggaattcagaggtataaaggtatcagccgaaaacagaggagattcggcatgtacctttataacctggcggcagcgcaaaagatg

SEQ ID NO: 183694 - DNA, 103 bp, Artificial Sequence
  Synthetic Polynucleotide
taatacgactcactatagggaatttataaagacaaggggttaaactacctaacagaggagaaggtagatgaaccccttgaacctggcggcagcgcaaaagatg

SEQ ID NO: 183695 - DNA, 103 bp, Artificial Sequence
  Synthetic Polynucleotide
taatacgactcactataggggtggtcaggaaatttataaagacaaggggtaacagaggagaacccctatgctttataaaaacctggcggcagcgcaaaagatg

SEQ ID NO: 183696 - DNA, 103 bp, Artificial Sequence
  Synthetic Polynucleotide
taatacgactcactataggggactcaaggtgtggtcaggaaatttataaaaacagaggagatttataatgttcctgaccaacctggcggcagcgcaaaagatg

SEQ ID NO: 183697 - DNA, 103 bp, Artificial Sequence
  Synthetic Polynucleotide
taatacgactcactatagggggaaatccatgactcaaggtgtggtcaggaaacagaggagatcctgaatgcaccttgagaacctggcggcagcgcaaaagatg

SEQ ID NO: 183698 - DNA, 103 bp, Artificial Sequence
  Synthetic Polynucleotide
taatacgactcactataggggtgtataggaggaaatccatgactcaaggtaacagaggagaaccttgatgcatggatttaacctggcggcagcgcaaaagatg

SEQ ID NO: 183699 - DNA, 103 bp, Artificial Sequence
  Synthetic Polynucleotide
taatacgactcactataggggaagaggctggtgtataggaggaaatccataacagaggagaatggatatgctcctatacaacctggcggcagcgcaaaagatg

SEQ ID NO: 183700 - DNA, 103 bp, Artificial Sequence
  Synthetic Polynucleotide
taatacgactcactatagggtcctctgccagaagaggctggtgtataggaaacagaggagatcctatatgccagcctctaacctggcggcagcgcaaaagatg

SEQ ID NO: 183701 - DNA, 103 bp, Artificial Sequence
  Synthetic Polynucleotide
taatacgactcactatagggagctgtggggtcctctgccagaagaggctgaacagaggagacagcctatgctggcagagaacctggcggcagcgcaaaagatg

SEQ ID NO: 183702 - DNA, 103 bp, Artificial Sequence
  Synthetic Polynucleotide
taatacgactcactatagggtgaaatcagcagctgtggggtcctctgccaaacagaggagatggcagatgaccccacagaacctggcggcagcgcaaaagatg

SEQ ID NO: 183703 - DNA, 103 bp, Artificial Sequence
  Synthetic Polynucleotide
taatacgactcactatagggagttcctgcttgaaatcagcagctgtggggaacagaggagaccccacatgtgctgatttaacctggcggcagcgcaaaagatg

SEQ ID NO: 183704 - DNA, 103 bp, Artificial Sequence
  Synthetic Polynucleotide
taatacgactcactatagggagaggcgtcagaattcagaggtataaaggtaacagaggagaacctttatgcctctgaataacctggcggcagcgcaaaagatg

SEQ ID NO: 183705 - DNA, 103 bp, Artificial Sequence
  Synthetic Polynucleotide
taatacgactcactatagggtttccgcctgagttcctgcttgaaatcagcaacagaggagagctgatatgaagcaggaaaacctggcggcagcgcaaaagatg

SEQ ID NO: 183706 - DNA, 103 bp, Artificial Sequence
  Synthetic Polynucleotide
taatacgactcactatagggccaatttacttttccgcctgagttcctgctaacagaggagaagcaggatgtcaggcggaaacctggcggcagcgcaaaagatg

SEQ ID NO: 183707 - DNA, 103 bp, Artificial Sequence
  Synthetic Polynucleotide
taatacgactcactatagggggctcttccaccaatttacttttccgcctgaacagaggagacaggcgatgaagtaaattaacctggcggcagcgcaaaagatg

SEQ ID NO: 183708 - DNA, 103 bp, Artificial Sequence
  Synthetic Polynucleotide
taatacgactcactatagggcatgtctattggctcttccaccaatttactaacagaggagaagtaaaatggtggaagagaacctggcggcagcgcaaaagatg

SEQ ID NO: 183709 - DNA, 103 bp, Artificial Sequence
  Synthetic Polynucleotide
taatacgactcactatagggctggagaatccatgtctattggctcttccaaacagaggagatggaagatgcaatagacaaacctggcggcagcgcaaaagatg

SEQ ID NO: 183710 - DNA, 103 bp, Artificial Sequence
  Synthetic Polynucleotide
taatacgactcactatagggtctctgatttctggagaatccatgtctattaacagaggagaaatagaatgggattctccaacctggcggcagcgcaaaagatg

SEQ ID NO: 183711 - DNA, 103 bp, Artificial Sequence
  Synthetic Polynucleotide
taatacgactcactatagggcttttcaagttctctgatttctggagaatcaacagaggagagattctatggaaatcagaaacctggcggcagcgcaaaagatg

SEQ ID NO: 183712 - DNA, 103 bp, Artificial Sequence
  Synthetic Polynucleotide
taatacgactcactatagggcattggcaaacttttcaagttctctgatttaacagaggagaaaatcaatgaacttgaaaaacctggcggcagcgcaaaagatg

SEQ ID NO: 183713 - DNA, 103 bp, Artificial Sequence
  Synthetic Polynucleotide
taatacgactcactatagggactttaaattcattggcaaacttttcaagtaacagaggagaacttgaatggtttgccaaaacctggcggcagcgcaaaagatg

SEQ ID NO: 183714 - DNA, 103 bp, Artificial Sequence
  Synthetic Polynucleotide
taatacgactcactatagggaattcgtctcactttaaattcattggcaaaaacagaggagatttgccatggaatttaaaaacctggcggcagcgcaaaagatg

SEQ ID NO: 183715 - DNA, 103 bp, Artificial Sequence
  Synthetic Polynucleotide
taatacgactcactataggggcagagttgcagaggcgtcagaattcagagaacagaggagactctgaatgctgacgcctaacctggcggcagcgcaaaagatg

SEQ ID NO: 183716 - DNA, 103 bp, Artificial Sequence
  Synthetic Polynucleotide
taatacgactcactatagggatcctaatttaattcgtctcactttaaattaacagaggagaaatttaatgtgagacgaaaacctggcggcagcgcaaaagatg

SEQ ID NO: 183717 - DNA, 103 bp, Artificial Sequence
  Synthetic Polynucleotide
taatacgactcactataggggtctgggtgtatcctaatttaattcgtctcaacagaggagagagacgatgtaaattaggaacctggcggcagcgcaaaagatg

SEQ ID NO: 183718 - DNA, 103 bp, Artificial Sequence
  Synthetic Polynucleotide
taatacgactcactatagggcccaacatttgtctgggtgtatcctaatttaacagaggagaaaattaatgtacacccagaacctggcggcagcgcaaaagatg

SEQ ID NO: 183719 - DNA, 103 bp, Artificial Sequence
  Synthetic Polynucleotide
taatacgactcactatagggccagggcctccccaacatttgtctgggtgtaacagaggagaacacccatgcaaatgttgaacctggcggcagcgcaaaagatg

SEQ ID NO: 183720 - DNA, 103 bp, Artificial Sequence
  Synthetic Polynucleotide
taatacgactcactatagggtgcacagctgccagggcctccccaacatttaacagaggagaaaatgtatgggaggccctaacctggcggcagcgcaaaagatg

SEQ ID NO: 183721 - DNA, 103 bp, Artificial Sequence
  Synthetic Polynucleotide
taatacgactcactatagggttcagagccatgcacagctgccagggcctcaacagaggagagaggccatggcagctgtgaacctggcggcagcgcaaaagatg

SEQ ID NO: 183722 - DNA, 103 bp, Artificial Sequence
  Synthetic Polynucleotide
taatacgactcactatagggtttgactgaattcagagccatgcacagctgaacagaggagacagctgatgatggctctgaacctggcggcagcgcaaaagatg

SEQ ID NO: 183723 - DNA, 103 bp, Artificial Sequence
  Synthetic Polynucleotide
taatacgactcactatagggcagattgttgtttgactgaattcagagccaaacagaggagatggctcatgattcagtcaaacctggcggcagcgcaaaagatg

SEQ ID NO: 183724 - DNA, 103 bp, Artificial Sequence
  Synthetic Polynucleotide
taatacgactcactatagggttcaaatcggcagattgttgtttgactgaaaacagaggagattcagtatgacaacaatcaacctggcggcagcgcaaaagatg

SEQ ID NO: 183725 - DNA, 103 bp, Artificial Sequence
  Synthetic Polynucleotide
taatacgactcactataggggctgcagattttcaaatcggcagattgttgaacagaggagacaacaaatggccgatttgaacctggcggcagcgcaaaagatg

SEQ ID NO: 183726 - DNA, 103 bp, Artificial Sequence
  Synthetic Polynucleotide
taatacgactcactatagggattatcagaggcagagttgcagaggcgtcaaacagaggagatgacgcatgtgcaactctaacctggcggcagcgcaaaagatg

SEQ ID NO: 183727 - DNA, 103 bp, Artificial Sequence
  Synthetic Polynucleotide
taatacgactcactatagggttaaagctgagctgcagattttcaaatcggaacagaggagaccgattatgaaatctgcaaacctggcggcagcgcaaaagatg

SEQ ID NO: 183728 - DNA, 103 bp, Artificial Sequence
  Synthetic Polynucleotide
taatacgactcactataggggcatgcatttttaaagctgagctgcagattaacagaggagaaatctgatgctcagctttaacctggcggcagcgcaaaagatg

SEQ ID NO: 183729 - DNA, 103 bp, Artificial Sequence
  Synthetic Polynucleotide
taatacgactcactatagggctttcagtttgcatgcatttttaaagctgaaacagaggagatcagctatgaaaatgcataacctggcggcagcgcaaaagatg

SEQ ID NO: 183730 - DNA, 103 bp, Artificial Sequence
  Synthetic Polynucleotide
taatacgactcactataggggataatattgctttcagtttgcatgcatttaacagaggagaaaatgcatgcaaactgaaaacctggcggcagcgcaaaagatg

SEQ ID NO: 183731 - DNA, 103 bp, Artificial Sequence
  Synthetic Polynucleotide
taatacgactcactatagggcagccatttggataatattgctttcagtttaacagaggagaaaactgatggcaatattaaacctggcggcagcgcaaaagatg

SEQ ID NO: 183732 - DNA, 103 bp, Artificial Sequence
  Synthetic Polynucleotide
taatacgactcactatagggcagcttcctccagccatttggataatattgaacagaggagacaatatatgccaaatggcaacctggcggcagcgcaaaagatg

SEQ ID NO: 183733 - DNA, 103 bp, Artificial Sequence
  Synthetic Polynucleotide
taatacgactcactatagggcctacttgctcagcttcctccagccatttgaacagaggagacaaatgatgggaggaagcaacctggcggcagcgcaaaagatg

SEQ ID NO: 183734 - DNA, 103 bp, Artificial Sequence
  Synthetic Polynucleotide
taatacgactcactataggggtacaaagctcctacttgctcagcttcctcaacagaggagagaggaaatggagcaagtaaacctggcggcagcgcaaaagatg

SEQ ID NO: 183735 - DNA, 103 bp, Artificial Sequence
  Synthetic Polynucleotide
taatacgactcactatagggctttttcattgtacaaagctcctacttgctaacagaggagaagcaagatggagctttgtaacctggcggcagcgcaaaagatg

SEQ ID NO: 183736 - DNA, 103 bp, Artificial Sequence
  Synthetic Polynucleotide
taatacgactcactatagggtttgctcccactttttcattgtacaaagctaacagaggagaagctttatgcaatgaaaaaacctggcggcagcgcaaaagatg

SEQ ID NO: 183737 - DNA, 103 bp, Artificial Sequence
  Synthetic Polynucleotide
taatacgactcactatagggactgtgatgcattatcagaggcagagttgcaacagaggagagcaactatgcctctgataaacctggcggcagcgcaaaagatg

SEQ ID NO: 183738 - DNA, 103 bp, Artificial Sequence
  Synthetic Polynucleotide
taatacgactcactatagggtttcctttcatttgctcccactttttcattaacagaggagaaatgaaatggtgggagcaaacctggcggcagcgcaaaagatg

SEQ ID NO: 183739 - DNA, 103 bp, Artificial Sequence
  Synthetic Polynucleotide
taatacgactcactatagggttcgttttcttttcctttcatttgctcccaaacagaggagatgggagatgatgaaaggaaacctggcggcagcgcaaaagatg

SEQ ID NO: 183740 - DNA, 103 bp, Artificial Sequence
  Synthetic Polynucleotide
taatacgactcactatagggatagttgttcttcgttttcttttcctttcaaacagaggagatgaaagatgaagaaaacgaacctggcggcagcgcaaaagatg

SEQ ID NO: 183741 - DNA, 103 bp, Artificial Sequence
  Synthetic Polynucleotide
taatacgactcactatagggagcaatgcttatagttgttcttcgttttctaacagaggagaagaaaaatgagaacaactaacctggcggcagcgcaaaagatg

SEQ ID NO: 183742 - DNA, 103 bp, Artificial Sequence
  Synthetic Polynucleotide
taatacgactcactatagggcatctttagcagcaatgcttatagttgttcaacagaggagagaacaaatgtaagcattgaacctggcggcagcgcaaaagatg

SEQ ID NO: 183743 - DNA, 103 bp, Artificial Sequence
  Synthetic Polynucleotide
taatacgactcactatagggctctccagagcatctttagcagcaatgcttaacagaggagaaagcatatgtgctaaagaaacctggcggcagcgcaaaagatg

SEQ ID NO: 183744 - DNA, 103 bp, Artificial Sequence
  Synthetic Polynucleotide
taatacgactcactatagggtccaaagtgtctctccagagcatctttagcaacagaggagagctaaaatggctctggagaacctggcggcagcgcaaaagatg

SEQ ID NO: 183745 - DNA, 103 bp, Artificial Sequence
  Synthetic Polynucleotide
taatacgactcactatagggtattctgttctccaaagtgtctctccagagaacagaggagactctggatggacactttgaacctggcggcagcgcaaaagatg

SEQ ID NO: 183746 - DNA, 103 bp, Artificial Sequence
  Synthetic Polynucleotide
taatacgactcactataggggaagaaggtttattctgttctccaaagtgtaacagaggagaacacttatgagaacagaaaacctggcggcagcgcaaaagatg

SEQ ID NO: 183747 - DNA, 103 bp, Artificial Sequence
  Synthetic Polynucleotide
taatacgactcactataggggatctcttgagaagaaggtttattctgttcaacagaggagagaacagatgaaaccttctaacctggcggcagcgcaaaagatg

SEQ ID NO: 183748 - DNA, 103 bp, Artificial Sequence
  Synthetic Polynucleotide
taatacgactcactatagggactcggcagcactgtgatgcattatcagagaacagaggagactctgaatgtgcatcacaaacctggcggcagcgcaaaagatg

SEQ ID NO: 183749 - DNA, 103 bp, Artificial Sequence
  Synthetic Polynucleotide
taatacgactcactatagggccatcctcatgatctcttgagaagaaggttaacagaggagaaaccttatgctcaagagaaacctggcggcagcgcaaaagatg

SEQ ID NO: 183750 - DNA, 103 bp, Artificial Sequence
  Synthetic Polynucleotide
taatacgactcactatagggagttcttcagccatcctcatgatctcttgaaacagaggagatcaagaatgcatgaggataacctggcggcagcgcaaaagatg

SEQ ID NO: 183751 - DNA, 103 bp, Artificial Sequence
  Synthetic Polynucleotide
taatacgactcactatagggctccagattcagttcttcagccatcctcataacagaggagaatgaggatggctgaagaaaacctggcggcagcgcaaaagatg

SEQ ID NO: 183752 - DNA, 103 bp, Artificial Sequence
  Synthetic Polynucleotide
taatacgactcactatagggctacttctttctccagattcagttcttcagaacagaggagactgaagatgtgaatctggaacctggcggcagcgcaaaagatg

SEQ ID NO: 183753 - DNA, 103 bp, Artificial Sequence
  Synthetic Polynucleotide
taatacgactcactatagggcaaactcttactacttctttctccagattcaacagaggagagaatctatggaaagaagtaacctggcggcagcgcaaaagatg

SEQ ID NO: 183754 - DNA, 103 bp, Artificial Sequence
  Synthetic Polynucleotide
taatacgactcactataggggttgcaaaaccaaactcttactacttctttaacagaggagaaaagaaatggtaagagttaacctggcggcagcgcaaaagatg

SEQ ID NO: 183755 - DNA, 103 bp, Artificial Sequence
  Synthetic Polynucleotide
taatacgactcactatagggtctgcctccggttgcaaaaccaaactcttaaacagaggagataagagatgggttttgcaaacctggcggcagcgcaaaagatg

SEQ ID NO: 183756 - DNA, 103 bp, Artificial Sequence
  Synthetic Polynucleotide
taatacgactcactatagggcgtttttctctctgcctccggttgcaaaacaacagaggagagttttgatgccggaggcaaacctggcggcagcgcaaaagatg

SEQ ID NO: 183757 - DNA, 103 bp, Artificial Sequence
  Synthetic Polynucleotide
taatacgactcactatagggtgttttcacccgtttttctctctgcctccgaacagaggagacggaggatgagagaaaaaaacctggcggcagcgcaaaagatg

SEQ ID NO: 183758 - DNA, 103 bp, Artificial Sequence
  Synthetic Polynucleotide
taatacgactcactataggggattcagacttgttttcacccgtttttctcaacagaggagagagaaaatggggtgaaaaaacctggcggcagcgcaaaagatg

SEQ ID NO: 183759 - DNA, 103 bp, Artificial Sequence
  Synthetic Polynucleotide
taatacgactcactatagggactggtagacactcggcagcactgtgatgcaacagaggagagcatcaatgtgctgccgaaacctggcggcagcgcaaaagatg

SEQ ID NO: 183760 - DNA, 103 bp, Artificial Sequence
  Synthetic Polynucleotide
taatacgactcactatagggaataaactctgattcagacttgttttcaccaacagaggagaggtgaaatgaagtctgaaaacctggcggcagcgcaaaagatg

SEQ ID NO: 183761 - DNA, 103 bp, Artificial Sequence
  Synthetic Polynucleotide
taatacgactcactatagggagaaatagaaaataaactctgattcagactaacagaggagaagtctgatgcagagtttaaacctggcggcagcgcaaaagatg

SEQ ID NO: 183762 - DNA, 103 bp, Artificial Sequence
  Synthetic Polynucleotide
taatacgactcactataggggatgttccttagaaatagaaaataaactctaacagaggagaagagttatgtttctatttaacctggcggcagcgcaaaagatg

SEQ ID NO: 183763 - DNA, 103 bp, Artificial Sequence
  Synthetic Polynucleotide
taatacgactcactatagggctgcactcaagatgttccttagaaatagaaaacagaggagattctatatgtaaggaacaaacctggcggcagcgcaaaagatg

SEQ ID NO: 183764 - DNA, 103 bp, Artificial Sequence
  Synthetic Polynucleotide
taatacgactcactatagggctccggagctgtgggtttttgccagagcataacagaggagaatgctcatgcaaaaacccaacctggcggcagcgcaaaagatg

SEQ ID NO: 183765 - DNA, 103 bp, Artificial Sequence
  Synthetic Polynucleotide
taatacgactcactataggggctggcgtggcctcgcttcctcctcagcagaacagaggagactgctgatgaggaagcgaaacctggcggcagcgcaaaagatg

SEQ ID NO: 183766 - DNA, 103 bp, Artificial Sequence
  Synthetic Polynucleotide
taatacgactcactatagggctgccccactgctggcgtggcctcgcttccaacagaggagaggaagcatggccacgccaaacctggcggcagcgcaaaagatg

SEQ ID NO: 183767 - DNA, 103 bp, Artificial Sequence
  Synthetic Polynucleotide
taatacgactcactatagggggtgcaggtgctgccccactgctggcgtggaacagaggagaccacgcatgcagtggggcaacctggcggcagcgcaaaagatg

SEQ ID NO: 183768 - DNA, 103 bp, Artificial Sequence
  Synthetic Polynucleotide
taatacgactcactatagggcaccgccgtaggtgcaggtgctgccccactaacagaggagaagtgggatggcacctgcaaacctggcggcagcgcaaaagatg

SEQ ID NO: 183769 - DNA, 103 bp, Artificial Sequence
  Synthetic Polynucleotide
taatacgactcactatagggggggcagcaccaccgccgtaggtgcaggtgaacagaggagacacctgatgctacggcggaacctggcggcagcgcaaaagatg

SEQ ID NO: 183770 - DNA, 103 bp, Artificial Sequence
  Synthetic Polynucleotide
taatacgactcactatagggaggggctgatggggcagcaccaccgccgtaaacagaggagatacggcatgggtgctgccaacctggcggcagcgcaaaagatg

SEQ ID NO: 183771 - DNA, 103 bp, Artificial Sequence
  Synthetic Polynucleotide
taatacgactcactataggggtaggtcgccaggggctgatggggcagcacaacagaggagagtgctgatgcatcagcccaacctggcggcagcgcaaaagatg

SEQ ID NO: 183772 - DNA, 103 bp, Artificial Sequence
  Synthetic Polynucleotide
taatacgactcactatagggccactgtggtgtaggtcgccaggggctgataacagaggagaatcagcatgtggcgacctaacctggcggcagcgcaaaagatg

SEQ ID NO: 183773 - DNA, 103 bp, Artificial Sequence
  Synthetic Polynucleotide
taatacgactcactatagggcaggaaggacccactgtggtgtaggtcgccaacagaggagaggcgacatgcaccacagtaacctggcggcagcgcaaaagatg

SEQ ID NO: 183774 - DNA, 103 bp, Artificial Sequence
  Synthetic Polynucleotide
taatacgactcactatagggcatgtccaggcaggaaggacccactgtggtaacagaggagaaccacaatgggtccttccaacctggcggcagcgcaaaagatg

SEQ ID NO: 183775 - DNA, 103 bp, Artificial Sequence
  Synthetic Polynucleotide
taatacgactcactatagggctggggcttgctccggagctgtgggtttttaacagaggagaaaaaacatgcagctccggaacctggcggcagcgcaaaagatg

SEQ ID NO: 183776 - DNA, 103 bp, Artificial Sequence
  Synthetic Polynucleotide
taatacgactcactatagggcagaaccttccatgtccaggcaggaaggacaacagaggagagtccttatggcctggacaaacctggcggcagcgcaaaagatg

SEQ ID NO: 183777 - DNA, 103 bp, Artificial Sequence
  Synthetic Polynucleotide
taatacgactcactatagggactgcagacacagaaccttccatgtccaggaacagaggagacctggaatgggaaggttcaacctggcggcagcgcaaaagatg

SEQ ID NO: 183778 - DNA, 103 bp, Artificial Sequence
  Synthetic Polynucleotide
taatacgactcactatagggctcctctgtcactgcagacacagaaccttcaacagaggagagaaggtatggtgtctgcaaacctggcggcagcgcaaaagatg

SEQ ID NO: 183779 - DNA, 103 bp, Artificial Sequence
  Synthetic Polynucleotide
taatacgactcactatagggacagggcagcctcctctgtcactgcagacaaacagaggagatgtctgatgtgacagaggaacctggcggcagcgcaaaagatg

SEQ ID NO: 183780 - DNA, 103 bp, Artificial Sequence
  Synthetic Polynucleotide
taatacgactcactatagggcagccggcacacagggcagcctcctctgtcaacagaggagagacagaatgggctgccctaacctggcggcagcgcaaaagatg

SEQ ID NO: 183781 - DNA, 103 bp, Artificial Sequence
  Synthetic Polynucleotide
taatacgactcactatagggctgggagagccagccggcacacagggcagcaacagaggagagctgccatgtgtgccggcaacctggcggcagcgcaaaagatg

SEQ ID NO: 183782 - DNA, 103 bp, Artificial Sequence
  Synthetic Polynucleotide
taatacgactcactatagggccggggtgggctgggagagccagccggcacaacagaggagagtgccgatgggctctcccaacctggcggcagcgcaaaagatg

SEQ ID NO: 183783 - DNA, 103 bp, Artificial Sequence
  Synthetic Polynucleotide
taatacgactcactatagggtgcagggtggccggggtgggctgggagagcaacagaggagagctctcatggcccaccccaacctggcggcagcgcaaaagatg

SEQ ID NO: 183784 - DNA, 103 bp, Artificial Sequence
  Synthetic Polynucleotide
taatacgactcactatagggggccaggggctgcagggtggccggggtgggaacagaggagacccaccatggccaccctgaacctggcggcagcgcaaaagatg

SEQ ID NO: 183785 - DNA, 103 bp, Artificial Sequence
  Synthetic Polynucleotide
taatacgactcactataggggtgtccatggggccaggggctgcagggtggaacagaggagaccacccatgagcccctggaacctggcggcagcgcaaaagatg

SEQ ID NO: 183786 - DNA, 103 bp, Artificial Sequence
  Synthetic Polynucleotide
taatacgactcactatagggcgggccggggctggggcttgctccggagctaacagaggagaagctccatggcaagccccaacctggcggcagcgcaaaagatg

SEQ ID NO: 183787 - DNA, 103 bp, Artificial Sequence
  Synthetic Polynucleotide
taatacgactcactatagggtcggtgtaaggtgtccatggggccaggggcaacagaggagagcccctatgcccatggacaacctggcggcagcgcaaaagatg

SEQ ID NO: 183788 - DNA, 103 bp, Artificial Sequence
  Synthetic Polynucleotide
taatacgactcactataggggggcacatactcggtgtaaggtgtccatggaacagaggagaccatggatgccttacaccaacctggcggcagcgcaaaagatg

SEQ ID NO: 183789 - DNA, 103 bp, Artificial Sequence
  Synthetic Polynucleotide
taatacgactcactatagggcagcttcatggggcacatactcggtgtaagaacagaggagacttacaatgagtatgtgcaacctggcggcagcgcaaaagatg

SEQ ID NO: 183790 - DNA, 103 bp, Artificial Sequence
  Synthetic Polynucleotide
taatacgactcactataggggggcagctgacagcttcatggggcacatacaacagaggagagtatgtatgccatgaagcaacctggcggcagcgcaaaagatg

SEQ ID NO: 183791 - DNA, 103 bp, Artificial Sequence
  Synthetic Polynucleotide
taatacgactcactatagggagctgagtaggggcagctgacagcttcatgaacagaggagacatgaaatggtcagctgcaacctggcggcagcgcaaaagatg

SEQ ID NO: 183792 - DNA, 103 bp, Artificial Sequence
  Synthetic Polynucleotide
taatacgactcactatagggcatacatgtcagctgagtaggggcagctgaaacagaggagatcagctatgcctactcagaacctggcggcagcgcaaaagatg

SEQ ID NO: 183793 - DNA, 103 bp, Artificial Sequence
  Synthetic Polynucleotide
taatacgactcactatagggacgggctgcacatacatgtcagctgagtagaacagaggagactactcatgtgacatgtaaacctggcggcagcgcaaaagatg

SEQ ID NO: 183794 - DNA, 103 bp, Artificial Sequence
  Synthetic Polynucleotide
taatacgactcactataggggctggggcacacgggctgcacatacatgtcaacagaggagagacatgatggtgcagcccaacctggcggcagcgcaaaagatg

SEQ ID NO: 183795 - DNA, 103 bp, Artificial Sequence
  Synthetic Polynucleotide
taatacgactcactatagggccaccgtgtagctggggcacacgggctgcaaacagaggagatgcagcatgtgtgccccaaacctggcggcagcgcaaaagatg

SEQ ID NO: 183796 - DNA, 103 bp, Artificial Sequence
  Synthetic Polynucleotide
taatacgactcactataggggagggccccaccaccgtgtagctggggcacaacagaggagagtgcccatgctacacggtaacctggcggcagcgcaaaagatg

SEQ ID NO: 183797 - DNA, 103 bp, Artificial Sequence
  Synthetic Polynucleotide
taatacgactcactatagggctggtatggccgggccggggctggggcttgaacagaggagacaagccatggccccggccaacctggcggcagcgcaaaagatg

SEQ ID NO: 183798 - DNA, 103 bp, Artificial Sequence
  Synthetic Polynucleotide
taatacgactcactatagggcaacactgaggagggccccaccaccgtgtaaacagaggagatacacgatggtggggcccaacctggcggcagcgcaaaagatg

SEQ ID NO: 183799 - DNA, 103 bp, Artificial Sequence
  Synthetic Polynucleotide
taatacgactcactatagggaggcataggtcaacactgaggagggccccaaacagaggagatggggcatgcctcagtgtaacctggcggcagcgcaaaagatg

SEQ ID NO: 183800 - DNA, 103 bp, Artificial Sequence
  Synthetic Polynucleotide
taatacgactcactatagggagtggcggagaggcataggtcaacactgagaacagaggagactcagtatggacctatgcaacctggcggcagcgcaaaagatg

SEQ ID NO: 183801 - DNA, 103 bp, Artificial Sequence
  Synthetic Polynucleotide
taatacgactcactatagggattggtgatgagtggcggagaggcataggtaacagaggagaacctatatgtctccgccaaacctggcggcagcgcaaaagatg

SEQ ID NO: 183802 - DNA, 103 bp, Artificial Sequence
  Synthetic Polynucleotide
taatacgactcactatagggttgtcgtgacattggtgatgagtggcggagaacagaggagactccgcatgtcatcaccaaacctggcggcagcgcaaaagatg

SEQ ID NO: 183803 - DNA, 103 bp, Artificial Sequence
  Synthetic Polynucleotide
taatacgactcactataggggcggagcttcttgtcgtgacattggtgatgaacagaggagacatcacatgtgtcacgacaacctggcggcagcgcaaaagatg

SEQ ID NO: 183804 - DNA, 103 bp, Artificial Sequence
  Synthetic Polynucleotide
taatacgactcactatagggtgcgggcgtggcggagcttcttgtcgtgacaacagaggagagtcacgatgagaagctccaacctggcggcagcgcaaaagatg

SEQ ID NO: 183805 - DNA, 103 bp, Artificial Sequence
  Synthetic Polynucleotide
taatacgactcactatagggggggccccactgcgggcgtggcggagcttcaacagaggagagaagctatgccacgcccgaacctggcggcagcgcaaaagatg

SEQ ID NO: 183806 - DNA, 103 bp, Artificial Sequence
  Synthetic Polynucleotide
taatacgactcactatagggccctccagcgggggccccactgcgggcgtgaacagaggagacacgccatgagtggggccaacctggcggcagcgcaaaagatg

SEQ ID NO: 183807 - DNA, 103 bp, Artificial Sequence
  Synthetic Polynucleotide
taatacgactcactataggggtgctctgggccctccagcgggggccccacaacagaggagagtggggatgccgctggagaacctggcggcagcgcaaaagatg

SEQ ID NO: 183808 - DNA, 103 bp, Artificial Sequence
  Synthetic Polynucleotide
taatacgactcactatagggcacggacgccctggtatggccgggccggggaacagaggagaccccggatgggccataccaacctggcggcagcgcaaaagatg

SEQ ID NO: 183809 - DNA, 103 bp, Artificial Sequence
  Synthetic Polynucleotide
taatacgactcactatagggggggtgcctggtgctctgggccctccagcgaacagaggagacgctggatggcccagagcaacctggcggcagcgcaaaagatg

SEQ ID NO: 183810 - DNA, 103 bp, Artificial Sequence
  Synthetic Polynucleotide
taatacgactcactatagggaaataggtgaggggtgcctggtgctctgggaacagaggagacccagaatgccaggcaccaacctggcggcagcgcaaaagatg

SEQ ID NO: 183811 - DNA, 103 bp, Artificial Sequence
  Synthetic Polynucleotide
taatacgactcactatagggaggccacgggaaataggtgaggggtgcctgaacagaggagacaggcaatgctcacctataacctggcggcagcgcaaaagatg

SEQ ID NO: 183812 - DNA, 103 bp, Artificial Sequence
  Synthetic Polynucleotide
taatacgactcactatagggaaaggggctgaggccacgggaaataggtgaaacagaggagatcacctatgtcccgtggcaacctggcggcagcgcaaaagatg

SEQ ID NO: 183813 - DNA, 103 bp, Artificial Sequence
  Synthetic Polynucleotide
taatacgactcactatagggggtagtgtggaaaggggctgaggccacgggaacagaggagacccgtgatgtcagcccctaacctggcggcagcgcaaaagatg

SEQ ID NO: 183814 - DNA, 103 bp, Artificial Sequence
  Synthetic Polynucleotide
taatacgactcactatagggggtggaggtgggtagtgtggaaaggggctgaacagaggagacagcccatgtccacactaaacctggcggcagcgcaaaagatg

SEQ ID NO: 183815 - DNA, 103 bp, Artificial Sequence
  Synthetic Polynucleotide
taatacgactcactatagggggtactgcagggtggaggtgggtagtgtggaacagaggagaccacacatgccacctccaaacctggcggcagcgcaaaagatg

SEQ ID NO: 183816 - DNA, 103 bp, Artificial Sequence
  Synthetic Polynucleotide
taatacgactcactataggggccggaggctggtactgcagggtggaggtgaacagaggagacacctcatgcctgcagtaaacctggcggcagcgcaaaagatg

SEQ ID NO: 183817 - DNA, 103 bp, Artificial Sequence
  Synthetic Polynucleotide
taatacgactcactatagggtagggctggggccggaggctggtactgcagaacagaggagactgcagatgcagcctccgaacctggcggcagcgcaaaagatg

SEQ ID NO: 183818 - DNA, 103 bp, Artificial Sequence
  Synthetic Polynucleotide
taatacgactcactatagggggggcccaggtagggctggggccggaggctaacagaggagaagcctcatgccccagcccaacctggcggcagcgcaaaagatg

SEQ ID NO: 183819 - DNA, 103 bp, Artificial Sequence
  Synthetic Polynucleotide
taatacgactcactatagggggctccttcacacggacgccctggtatggcaacagaggagagccataatggggcgtccgaacctggcggcagcgcaaaagatg

SEQ ID NO: 183820 - DNA, 103 bp, Artificial Sequence
  Synthetic Polynucleotide
taatacgactcactatagggtggacaaactggggcccaggtagggctgggaacagaggagacccagcatgacctgggccaacctggcggcagcgcaaaagatg

SEQ ID NO: 183821 - DNA, 103 bp, Artificial Sequence
  Synthetic Polynucleotide
taatacgactcactataggggatggggagctggacaaactggggcccaggaacagaggagacctgggatgcagtttgtcaacctggcggcagcgcaaaagatg

SEQ ID NO: 183822 - DNA, 103 bp, Artificial Sequence
  Synthetic Polynucleotide
taatacgactcactatagggctgggatagagatggggagctggacaaactaacagaggagaagtttgatgagctccccaaacctggcggcagcgcaaaagatg

SEQ ID NO: 183823 - DNA, 103 bp, Artificial Sequence
  Synthetic Polynucleotide
taatacgactcactatagggaggactggctctgggatagagatggggagcaacagaggagagctcccatgctctatcccaacctggcggcagcgcaaaagatg

SEQ ID NO: 183824 - DNA, 103 bp, Artificial Sequence
  Synthetic Polynucleotide
taatacgactcactatagggcatgtcctgaaggactggctctgggatagaaacagaggagatctatcatggagccagtcaacctggcggcagcgcaaaagatg

SEQ ID NO: 183825 - DNA, 103 bp, Artificial Sequence
  Synthetic Polynucleotide
taatacgactcactatagggtggggtcttccatgtcctgaaggactggctaacagaggagaagccagatgttcaggacaaacctggcggcagcgcaaaagatg

SEQ ID NO: 183826 - DNA, 103 bp, Artificial Sequence
  Synthetic Polynucleotide
taatacgactcactataggggcggctcttctggggtcttccatgtcctgaaacagaggagatcaggaatgggaagacccaacctggcggcagcgcaaaagatg

SEQ ID NO: 183827 - DNA, 103 bp, Artificial Sequence
  Synthetic Polynucleotide
taatacgactcactatagggcaacgagctggcggctcttctggggtcttcaacagaggagagaagacatgagaagagccaacctggcggcagcgcaaaagatg

SEQ ID NO: 183828 - DNA, 103 bp, Artificial Sequence
  Synthetic Polynucleotide
taatacgactcactatagggtgtcgatggtcaacgagctggcggctcttcaacagaggagagaagagatgccagctcgtaacctggcggcagcgcaaaagatg

SEQ ID NO: 183829 - DNA, 103 bp, Artificial Sequence
  Synthetic Polynucleotide
taatacgactcactatagggaaaagcagcttgtcgatggtcaacgagctgaacagaggagacagctcatggaccatcgaaacctggcggcagcgcaaaagatg

SEQ ID NO: 183830 - DNA, 103 bp, Artificial Sequence
  Synthetic Polynucleotide
taatacgactcactatagggttccttcactggctccttcacacggacgccaacagaggagaggcgtcatggtgaaggagaacctggcggcagcgcaaaagatg

SEQ ID NO: 183831 - DNA, 103 bp, Artificial Sequence
  Synthetic Polynucleotide
taatacgactcactatagggctcttcctccaaaagcagcttgtcgatggtaacagaggagaaccatcatgaagctgcttaacctggcggcagcgcaaaagatg

SEQ ID NO: 183832 - DNA, 103 bp, Artificial Sequence
  Synthetic Polynucleotide
taatacgactcactatagggcgtcgctatcctcttcctccaaaagcagctaacagaggagaagctgcatgtggaggaagaacctggcggcagcgcaaaagatg

SEQ ID NO: 183833 - DNA, 103 bp, Artificial Sequence
  Synthetic Polynucleotide
taatacgactcactatagggagcgcataggcgtcgctatcctcttcctccaacagaggagaggaggaatgggatagcgaaacctggcggcagcgcaaaagatg

SEQ ID NO: 183834 - DNA, 103 bp, Artificial Sequence
  Synthetic Polynucleotide
taatacgactcactatagggagtgtggttaagcgcataggcgtcgctatcaacagaggagagatagcatggcctatgcgaacctggcggcagcgcaaaagatg

SEQ ID NO: 183835 - DNA, 103 bp, Artificial Sequence
  Synthetic Polynucleotide
taatacgactcactatagggccacagagagagtgtggttaagcgcataggaacagaggagacctatgatgttaaccacaaacctggcggcagcgcaaaagatg

SEQ ID NO: 183836 - DNA, 103 bp, Artificial Sequence
  Synthetic Polynucleotide
taatacgactcactatagggtaaaagccttccacagagagagtgtggttaaacagaggagataaccaatgtctctctgtaacctggcggcagcgcaaaagatg

SEQ ID NO: 183837 - DNA, 103 bp, Artificial Sequence
  Synthetic Polynucleotide
taatacgactcactatagggtcctcagcagttccttcactggctccttcaaacagaggagatgaaggatgcagtgaaggaacctggcggcagcgcaaaagatg

SEQ ID NO: 183838 - DNA, 103 bp, Artificial Sequence
  Synthetic Polynucleotide
taatacgactcactatagggcctcgcttcctcctcagcagttccttcactaacagaggagaagtgaaatgactgctgagaacctggcggcagcgcaaaagatg

SEQ ID NO: 183839 - DNA, 103 bp, Artificial Sequence
  Synthetic Polynucleotide
taatacgactcactataggggtctagaacatagtcactgcagtccagcataacagaggagaatgctgatgtgcagtgacaacctggcggcagcgcaaaagatg

SEQ ID NO: 183840 - DNA, 103 bp, Artificial Sequence
  Synthetic Polynucleotide
taatacgactcactatagggaaagtccagaccattggtttgtgtgcctgtaacagaggagaacaggcatgcaaaccaataacctggcggcagcgcaaaagatg

SEQ ID NO: 183841 - DNA, 103 bp, Artificial Sequence
  Synthetic Polynucleotide
taatacgactcactatagggtcgagagatggtagtttggctgaagtcattaacagaggagaaatgacatgagccaaactaacctggcggcagcgcaaaagatg

SEQ ID NO: 183842 - DNA, 103 bp, Artificial Sequence
  Synthetic Polynucleotide
taatacgactcactatagggaggcttcaaatcgagagatggtagtttggcaacagaggagagccaaaatgccatctctcaacctggcggcagcgcaaaagatg

SEQ ID NO: 183843 - DNA, 103 bp, Artificial Sequence
  Synthetic Polynucleotide
taatacgactcactatagggctgaggttcaaggcttcaaatcgagagatgaacagaggagacatctcatgatttgaagcaacctggcggcagcgcaaaagatg

SEQ ID NO: 183844 - DNA, 103 bp, Artificial Sequence
  Synthetic Polynucleotide
taatacgactcactataggggttcttaaagctgaggttcaaggcttcaaaaacagaggagatttgaaatgttgaacctcaacctggcggcagcgcaaaagatg

SEQ ID NO: 183845 - DNA, 103 bp, Artificial Sequence
  Synthetic Polynucleotide
taatacgactcactatagggacttgcacatgttcttaaagctgaggttcaaacagaggagatgaaccatggctttaagaaacctggcggcagcgcaaaagatg

SEQ ID NO: 183846 - DNA, 103 bp, Artificial Sequence
  Synthetic Polynucleotide
taatacgactcactatagggagtggcttcaacttgcacatgttcttaaagaacagaggagactttaaatgcatgtgcaaaacctggcggcagcgcaaaagatg

SEQ ID NO: 183847 - DNA, 103 bp, Artificial Sequence
  Synthetic Polynucleotide
taatacgactcactatagggcttctctaaaagtggcttcaacttgcacataacagaggagaatgtgcatgttgaagccaaacctggcggcagcgcaaaagatg

SEQ ID NO: 183848 - DNA, 103 bp, Artificial Sequence
  Synthetic Polynucleotide
taatacgactcactatagggcatttagccacttctctaaaagtggcttcaaacagaggagatgaagcatgttttagagaaacctggcggcagcgcaaaagatg

SEQ ID NO: 183849 - DNA, 103 bp, Artificial Sequence
  Synthetic Polynucleotide
taatacgactcactatagggttctctgcatcatttagccacttctctaaaaacagaggagatttagaatggtggctaaaaacctggcggcagcgcaaaagatg

SEQ ID NO: 183850 - DNA, 103 bp, Artificial Sequence
  Synthetic Polynucleotide
taatacgactcactatagggagatgagaggttctctgcatcatttagccaaacagaggagatggctaatggatgcagagaacctggcggcagcgcaaaagatg

SEQ ID NO: 183851 - DNA, 103 bp, Artificial Sequence
  Synthetic Polynucleotide
taatacgactcactataggggctgcttctgaaagtccagaccattggtttaacagaggagaaaaccaatggtctggactaacctggcggcagcgcaaaagatg

SEQ ID NO: 183852 - DNA, 103 bp, Artificial Sequence
  Synthetic Polynucleotide
taatacgactcactataggggggacgaatcagatgagaggttctctgcataacagaggagaatgcagatgacctctcataacctggcggcagcgcaaaagatg

SEQ ID NO: 183853 - DNA, 103 bp, Artificial Sequence
  Synthetic Polynucleotide
taatacgactcactataggggggctggagagggacgaatcagatgagaggaacagaggagacctctcatgtgattcgtcaacctggcggcagcgcaaaagatg

SEQ ID NO: 183854 - DNA, 103 bp, Artificial Sequence
  Synthetic Polynucleotide
taatacgactcactatagggcagggcacttgggctggagagggacgaatcaacagaggagagattcgatgctctccagcaacctggcggcagcgcaaaagatg

SEQ ID NO: 183855 - DNA, 103 bp, Artificial Sequence
  Synthetic Polynucleotide
taatacgactcactatagggctggagaattcagggcacttgggctggagaaacagaggagatctccaatgcaagtgcccaacctggcggcagcgcaaaagatg

SEQ ID NO: 183856 - DNA, 103 bp, Artificial Sequence
  Synthetic Polynucleotide
taatacgactcactatagggccctcaattcctggagaattcagggcacttaacagaggagaaagtgcatggaattctccaacctggcggcagcgcaaaagatg

SEQ ID NO: 183857 - DNA, 103 bp, Artificial Sequence
  Synthetic Polynucleotide
taatacgactcactatagggacggctcaagccctcaattcctggagaattaacagaggagaaattctatgggaattgagaacctggcggcagcgcaaaagatg

SEQ ID NO: 183858 - DNA, 103 bp, Artificial Sequence
  Synthetic Polynucleotide
taatacgactcactatagggtcttcctcctacggctcaagccctcaattcaacagaggagagaattgatggcttgagccaacctggcggcagcgcaaaagatg

SEQ ID NO: 183859 - DNA, 103 bp, Artificial Sequence
  Synthetic Polynucleotide
taatacgactcactatagggctggtgcgtttcttcctcctacggctcaagaacagaggagacttgagatgtaggaggaaaacctggcggcagcgcaaaagatg

SEQ ID NO: 183860 - DNA, 103 bp, Artificial Sequence
  Synthetic Polynucleotide
taatacgactcactatagggggtctctatgctggtgcgtttcttcctcctaacagaggagaaggaggatgaaacgcaccaacctggcggcagcgcaaaagatg

SEQ ID NO: 183861 - DNA, 103 bp, Artificial Sequence
  Synthetic Polynucleotide
taatacgactcactatagggcacggatgttggtctctatgctggtgcgttaacagaggagaaacgcaatggcatagagaaacctggcggcagcgcaaaagatg

SEQ ID NO: 183862 - DNA, 103 bp, Artificial Sequence
  Synthetic Polynucleotide
taatacgactcactatagggacaggcacaggctgcttctgaaagtccagaaacagaggagatctggaatgtcagaagcaaacctggcggcagcgcaaaagatg

SEQ ID NO: 183863 - DNA, 103 bp, Artificial Sequence
  Synthetic Polynucleotide
taatacgactcactatagggtctaaggccacacggatgttggtctctatgaacagaggagacatagaatgcaacatccgaacctggcggcagcgcaaaagatg

SEQ ID NO: 183864 - DNA, 103 bp, Artificial Sequence
  Synthetic Polynucleotide
taatacgactcactataggggaaactcttctctaaggccacacggatgttaacagaggagaaacatcatggtggccttaaacctggcggcagcgcaaaagatg

SEQ ID NO: 183865 - DNA, 103 bp, Artificial Sequence
  Synthetic Polynucleotide
taatacgactcactataggggattctccaagaaactcttctctaaggccaaacagaggagatggcctatgagaagagttaacctggcggcagcgcaaaagatg

SEQ ID NO: 183866 - DNA, 103 bp, Artificial Sequence
  Synthetic Polynucleotide
taatacgactcactataggggtaggcttttgattctccaagaaactcttcaacagaggagagaagagatgcttggagaaaacctggcggcagcgcaaaagatg

SEQ ID NO: 183867 - DNA, 103 bp, Artificial Sequence
  Synthetic Polynucleotide
taatacgactcactatagggctcttccgaggtaggcttttgattctccaaaacagaggagattggagatgcaaaagcctaacctggcggcagcgcaaaagatg

SEQ ID NO: 183868 - DNA, 103 bp, Artificial Sequence
  Synthetic Polynucleotide
taatacgactcactatagggtcatagtgatctcttccgaggtaggcttttaacagaggagaaaaagcatgcctcggaagaacctggcggcagcgcaaaagatg

SEQ ID NO: 183869 - DNA, 103 bp, Artificial Sequence
  Synthetic Polynucleotide
taatacgactcactatagggtgatcagcaatcatagtgatctcttccgagaacagaggagactcggaatggatcactataacctggcggcagcgcaaaagatg

SEQ ID NO: 183870 - DNA, 103 bp, Artificial Sequence
  Synthetic Polynucleotide
taatacgactcactatagggcatattgagctgatcagcaatcatagtgataacagaggagaatcactatgattgctgataacctggcggcagcgcaaaagatg

SEQ ID NO: 183871 - DNA, 103 bp, Artificial Sequence
  Synthetic Polynucleotide
taatacgactcactatagggcctctttttccatattgagctgatcagcaaaacagaggagattgctgatgagctcaataaacctggcggcagcgcaaaagatg

SEQ ID NO: 183872 - DNA, 103 bp, Artificial Sequence
  Synthetic Polynucleotide
taatacgactcactatagggacacgaatcacctctttttccatattgagcaacagaggagagctcaaatgggaaaaagaaacctggcggcagcgcaaaagatg

SEQ ID NO: 183873 - DNA, 103 bp, Artificial Sequence
  Synthetic Polynucleotide
taatacgactcactatagggtgctcctcctacaggcacaggctgcttctgaacagaggagacagaagatgcctgtgcctaacctggcggcagcgcaaaagatg

SEQ ID NO: 183874 - DNA, 103 bp, Artificial Sequence
  Synthetic Polynucleotide
taatacgactcactatagggacagaaccaaacacgaatcacctctttttcaacagaggagagaaaaaatggtgattcgtaacctggcggcagcgcaaaagatg

SEQ ID NO: 183875 - DNA, 103 bp, Artificial Sequence
  Synthetic Polynucleotide
taatacgactcactatagggggcggcggttacagaaccaaacacgaatcaaacagaggagatgattcatgtttggttctaacctggcggcagcgcaaaagatg

SEQ ID NO: 183876 - DNA, 103 bp, Artificial Sequence
  Synthetic Polynucleotide
taatacgactcactatagggttttctttctggcggcggttacagaaccaaaacagaggagattggttatgtaaccgccgaacctggcggcagcgcaaaagatg

SEQ ID NO: 183877 - DNA, 103 bp, Artificial Sequence
  Synthetic Polynucleotide
taatacgactcactataggggttgattcttttttctttctggcggcggttaacagaggagaaaccgcatgcagaaagaaaacctggcggcagcgcaaaagatg

SEQ ID NO: 183878 - DNA, 103 bp, Artificial Sequence
  Synthetic Polynucleotide
taatacgactcactatagggtgcttggtgggttgattcttttttctttctaacagaggagaagaaagatgaaagaatcaaacctggcggcagcgcaaaagatg

SEQ ID NO: 183879 - DNA, 103 bp, Artificial Sequence
  Synthetic Polynucleotide
taatacgactcactataggggtcccaccactgcttggtgggttgattcttaacagaggagaaagaatatgcccaccaagaacctggcggcagcgcaaaagatg

SEQ ID NO: 183880 - DNA, 103 bp, Artificial Sequence
  Synthetic Polynucleotide
taatacgactcactatagggtgagctgctggtcccaccactgcttggtggaacagaggagaccaccaatgagtggtgggaacctggcggcagcgcaaaagatg

SEQ ID NO: 183881 - DNA, 103 bp, Artificial Sequence
  Synthetic Polynucleotide
taatacgactcactatagggctttaataggtgagctgctggtcccaccacaacagaggagagtggtgatgccagcagctaacctggcggcagcgcaaaagatg

SEQ ID NO: 183882 - DNA, 103 bp, Artificial Sequence
  Synthetic Polynucleotide
taatacgactcactataggggggaaaattgctttaataggtgagctgctgaacagaggagacagcagatgacctattaaaacctggcggcagcgcaaaagatg

SEQ ID NO: 183883 - DNA, 103 bp, Artificial Sequence
  Synthetic Polynucleotide
taatacgactcactatagggagttgggctggggaaaattgctttaataggaacagaggagacctattatggcaattttcaacctggcggcagcgcaaaagatg

SEQ ID NO: 183884 - DNA, 103 bp, Artificial Sequence
  Synthetic Polynucleotide
taatacgactcactatagggctgttgagattgctcctcctacaggcacagaacagaggagactgtgcatgtaggaggagaacctggcggcagcgcaaaagatg

SEQ ID NO: 183885 - DNA, 103 bp, Artificial Sequence
  Synthetic Polynucleotide
taatacgactcactatagggccaccagtgaagttgggctggggaaaattgaacagaggagacaatttatgccagcccaaaacctggcggcagcgcaaaagatg

SEQ ID NO: 183886 - DNA, 103 bp, Artificial Sequence
  Synthetic Polynucleotide
taatacgactcactatagggggtgtggtcgccaccagtgaagttgggctgaacagaggagacagcccatgttcactggtaacctggcggcagcgcaaaagatg

SEQ ID NO: 183887 - DNA, 103 bp, Artificial Sequence
  Synthetic Polynucleotide
taatacgactcactatagggcacaaggcttggtgtggtcgccaccagtgaaacagaggagatcactgatggcgaccacaaacctggcggcagcgcaaaagatg

SEQ ID NO: 183888 - DNA, 103 bp, Artificial Sequence
  Synthetic Polynucleotide
taatacgactcactatagggcactgctagtcacaaggcttggtgtggtcgaacagaggagacgaccaatgcaagccttgaacctggcggcagcgcaaaagatg

SEQ ID NO: 183889 - DNA, 103 bp, Artificial Sequence
  Synthetic Polynucleotide
taatacgactcactataggggtagttgctgcactgctagtcacaaggcttaacagaggagaaagcctatggactagcagaacctggcggcagcgcaaaagatg

SEQ ID NO: 183890 - DNA, 103 bp, Artificial Sequence
  Synthetic Polynucleotide
taatacgactcactataggggactgtgagggtagttgctgcactgctagtaacagaggagaactagcatggcagcaactaacctggcggcagcgcaaaagatg

SEQ ID NO: 183891 - DNA, 103 bp, Artificial Sequence
  Synthetic Polynucleotide
taatacgactcactatagggggacagggctgactgtgagggtagttgctgaacagaggagacagcaaatgccctcacagaacctggcggcagcgcaaaagatg

SEQ ID NO: 183892 - DNA, 103 bp, Artificial Sequence
  Synthetic Polynucleotide
taatacgactcactataggggtcagagggaggacagggctgactgtgaggaacagaggagacctcacatgcagccctgtaacctggcggcagcgcaaaagatg

SEQ ID NO: 183893 - DNA, 103 bp, Artificial Sequence
  Synthetic Polynucleotide
taatacgactcactatagggagcagcactggtcagagggaggacagggctaacagaggagaagccctatgctccctctgaacctggcggcagcgcaaaagatg

SEQ ID NO: 183894 - DNA, 103 bp, Artificial Sequence
  Synthetic Polynucleotide
taatacgactcactataggggattcgtcacagcagcactggtcagagggaaacagaggagatccctcatgccagtgctgaacctggcggcagcgcaaaagatg

SEQ ID NO: 183895 - DNA, 103 bp, Artificial Sequence
  Synthetic Polynucleotide
taatacgactcactatagggtgcgcctgggctgttgagattgctcctcctaacagaggagaaggaggatgaatctcaacaacctggcggcagcgcaaaagatg

SEQ ID NO: 183896 - DNA, 103 bp, Artificial Sequence
  Synthetic Polynucleotide
taatacgactcactataggggtaactgaaagattcgtcacagcagcactgaacagaggagacagtgcatgtgtgacgaaaacctggcggcagcgcaaaagatg

SEQ ID NO: 183897 - DNA, 103 bp, Artificial Sequence
  Synthetic Polynucleotide
taatacgactcactatagggtgaagtgcctgtaactgaaagattcgtcacaacagaggagagtgacgatgctttcagttaacctggcggcagcgcaaaagatg

SEQ ID NO: 183898 - DNA, 103 bp, Artificial Sequence
  Synthetic Polynucleotide
taatacgactcactatagggaggtggtgtctgaagtgcctgtaactgaaaaacagaggagatttcagatgcaggcacttaacctggcggcagcgcaaaagatg

SEQ ID NO: 183899 - DNA, 103 bp, Artificial Sequence
  Synthetic Polynucleotide
taatacgactcactataggggtgttgttggaggtggtgtctgaagtgcctaacagaggagaaggcacatgagacaccacaacctggcggcagcgcaaaagatg

SEQ ID NO: 183900 - DNA, 103 bp, Artificial Sequence
  Synthetic Polynucleotide
taatacgactcactatagggcacggttgctgtgttgttggaggtggtgtcaacagaggagagacaccatgtccaacaacaacctggcggcagcgcaaaagatg

SEQ ID NO: 183901 - DNA, 103 bp, Artificial Sequence
  Synthetic Polynucleotide
taatacgactcactatagggctgtggaaatcacggttgctgtgttgttggaacagaggagaccaacaatgcagcaaccgaacctggcggcagcgcaaaagatg

SEQ ID NO: 183902 - DNA, 103 bp, Artificial Sequence
  Synthetic Polynucleotide
taatacgactcactataggggctggaggcgctgtggaaatcacggttgctaacagaggagaagcaacatggatttccacaacctggcggcagcgcaaaagatg

SEQ ID NO: 183903 - DNA, 103 bp, Artificial Sequence
  Synthetic Polynucleotide
taatacgactcactatagggtgctgaggaagctggaggcgctgtggaaataacagaggagaatttccatggcgcctccaaacctggcggcagcgcaaaagatg

SEQ ID NO: 183904 - DNA, 103 bp, Artificial Sequence
  Synthetic Polynucleotide
taatacgactcactataggggggacgtgactgctgaggaagctggaggcgaacagaggagacgcctcatgcttcctcagaacctggcggcagcgcaaaagatg

SEQ ID NO: 183905 - DNA, 103 bp, Artificial Sequence
  Synthetic Polynucleotide
taatacgactcactatagggctcagagagggggacgtgactgctgaggaaaacagaggagattcctcatgagtcacgtcaacctggcggcagcgcaaaagatg

SEQ ID NO: 183906 - DNA, 103 bp, Artificial Sequence
  Synthetic Polynucleotide
taatacgactcactatagggaaggaaagcctgcgcctgggctgttgagataacagaggagaatctcaatggcccaggcgaacctggcggcagcgcaaaagatg

SEQ ID NO: 183907 - DNA, 103 bp, Artificial Sequence
  Synthetic Polynucleotide
taatacgactcactatagggaggggagggactcagagagggggacgtgacaacagaggagagtcacgatgccctctctgaacctggcggcagcgcaaaagatg

SEQ ID NO: 183908 - DNA, 103 bp, Artificial Sequence
  Synthetic Polynucleotide
taatacgactcactatagggctgaggcagaaggggagggactcagagaggaacagaggagacctctcatggtccctcccaacctggcggcagcgcaaaagatg

SEQ ID NO: 183909 - DNA, 103 bp, Artificial Sequence
  Synthetic Polynucleotide
taatacgactcactataggggaggtggaggctgaggcagaaggggagggaaacagaggagatccctcatgttctgcctcaacctggcggcagcgcaaaagatg

SEQ ID NO: 183910 - DNA, 103 bp, Artificial Sequence
  Synthetic Polynucleotide
taatacgactcactatagggggatgcctcggaggtggaggctgaggcagaaacagaggagatctgccatggcctccaccaacctggcggcagcgcaaaagatg

SEQ ID NO: 183911 - DNA, 103 bp, Artificial Sequence
  Synthetic Polynucleotide
taatacgactcactatagggcactggcactggatgcctcggaggtggaggaacagaggagacctccaatgccgaggcataacctggcggcagcgcaaaagatg

SEQ ID NO: 183912 - DNA, 103 bp, Artificial Sequence
  Synthetic Polynucleotide
taatacgactcactataggggtgctggtctcactggcactggatgcctcgaacagaggagacgaggcatgcagtgccagaacctggcggcagcgcaaaagatg

SEQ ID NO: 183913 - DNA, 103 bp, Artificial Sequence
  Synthetic Polynucleotide
taatacgactcactatagggggtctgtgttgtgctggtctcactggcactaacagaggagaagtgccatggagaccagcaacctggcggcagcgcaaaagatg

SEQ ID NO: 183914 - DNA, 103 bp, Artificial Sequence
  Synthetic Polynucleotide
taatacgactcactataggggagtggaggtggtctgtgttgtgctggtctaacagaggagaagaccaatgcaacacagaaacctggcggcagcgcaaaagatg

SEQ ID NO: 183915 - DNA, 103 bp, Artificial Sequence
  Synthetic Polynucleotide
taatacgactcactataggggaggacaaaggagtggaggtggtctgtgttaacagaggagaaacacaatgcacctccacaacctggcggcagcgcaaaagatg

SEQ ID NO: 183916 - DNA, 103 bp, Artificial Sequence
  Synthetic Polynucleotide
taatacgactcactatagggcccaagaggggaggacaaaggagtggaggtaacagaggagaacctccatgcctttgtccaacctggcggcagcgcaaaagatg

SEQ ID NO: 183917 - DNA, 103 bp, Artificial Sequence
  Synthetic Polynucleotide
taatacgactcactatagggggagatgtccaaggaaagcctgcgcctgggaacagaggagacccaggatgaggctttccaacctggcggcagcgcaaaagatg

SEQ ID NO: 183918 - DNA, 103 bp, Artificial Sequence
  Synthetic Polynucleotide
taatacgactcactatagggcctggctggtcccaagaggggaggacaaagaacagaggagactttgtatgcccctcttgaacctggcggcagcgcaaaagatg

SEQ ID NO: 183919 - DNA, 103 bp, Artificial Sequence
  Synthetic Polynucleotide
taatacgactcactataggggtcaccatcacctggctggtcccaagagggaacagaggagaccctctatggaccagccaaacctggcggcagcgcaaaagatg

SEQ ID NO: 183920 - DNA, 103 bp, Artificial Sequence
  Synthetic Polynucleotide
taatacgactcactatagggacctgatgctgtcaccatcacctggctggtaacagaggagaaccagcatggtgatggtgaacctggcggcagcgcaaaagatg

SEQ ID NO: 183921 - DNA, 103 bp, Artificial Sequence
  Synthetic Polynucleotide
taatacgactcactatagggctgtttgcaaacctgatgctgtcaccatcaaacagaggagatgatggatgcagcatcagaacctggcggcagcgcaaaagatg

SEQ ID NO: 183922 - DNA, 103 bp, Artificial Sequence
  Synthetic Polynucleotide
taatacgactcactataggggcagctgctgctgtttgcaaacctgatgctaacagaggagaagcatcatgtttgcaaacaacctggcggcagcgcaaaagatg

SEQ ID NO: 183923 - DNA, 103 bp, Artificial Sequence
  Synthetic Polynucleotide
taatacgactcactatagggttgaagggcagcagctgctgctgtttgcaaaacagaggagattgcaaatggcagcagctaacctggcggcagcgcaaaagatg

SEQ ID NO: 183924 - DNA, 103 bp, Artificial Sequence
  Synthetic Polynucleotide
taatacgactcactataggggtgcagctccttgaagggcagcagctgctgaacagaggagacagcagatgctgcccttcaacctggcggcagcgcaaaagatg

SEQ ID NO: 183925 - DNA, 103 bp, Artificial Sequence
  Synthetic Polynucleotide
taatacgactcactataggggctggcaactgtgcagctccttgaagggcaaacagaggagatgccctatgaggagctgcaacctggcggcagcgcaaaagatg

SEQ ID NO: 183926 - DNA, 103 bp, Artificial Sequence
  Synthetic Polynucleotide
taatacgactcactatagggactggcatttgctggcaactgtgcagctccaacagaggagaggagctatgcagttgccaaacctggcggcagcgcaaaagatg

SEQ ID NO: 183927 - DNA, 103 bp, Artificial Sequence
  Synthetic Polynucleotide
taatacgactcactatagggtggcagcaagactggcatttgctggcaactaacagaggagaagttgcatgcaaatgccaaacctggcggcagcgcaaaagatg

SEQ ID NO: 183928 - DNA, 103 bp, Artificial Sequence
  Synthetic Polynucleotide
taatacgactcactatagggtggacctgatggagatgtccaaggaaagccaacagaggagaggctttatgtggacatctaacctggcggcagcgcaaaagatg

SEQ ID NO: 183929 - DNA, 103 bp, Artificial Sequence
  Synthetic Polynucleotide
taatacgactcactataggggcagctgccatggcagcaagactggcatttaacagaggagaaaatgcatgtcttgctgcaacctggcggcagcgcaaaagatg

SEQ ID NO: 183930 - DNA, 103 bp, Artificial Sequence
  Synthetic Polynucleotide
taatacgactcactatagggtagtcctgcagcagctgccatggcagcaagaacagaggagacttgctatgatggcagctaacctggcggcagcgcaaaagatg

SEQ ID NO: 183931 - DNA, 103 bp, Artificial Sequence
  Synthetic Polynucleotide
taatacgactcactatagggggcttgggtttagtcctgcagcagctgccaaacagaggagatggcagatgctgcaggacaacctggcggcagcgcaaaagatg

SEQ ID NO: 183932 - DNA, 103 bp, Artificial Sequence
  Synthetic Polynucleotide
taatacgactcactatagggggtgccatcaggcttgggtttagtcctgcaaacagaggagatgcaggatgaaacccaagaacctggcggcagcgcaaaagatg

SEQ ID NO: 183933 - DNA, 103 bp, Artificial Sequence
  Synthetic Polynucleotide
taatacgactcactatagggaaactgtgagggtgccatcaggcttgggttaacagaggagaaacccaatgctgatggcaaacctggcggcagcgcaaaagatg

SEQ ID NO: 183934 - DNA, 103 bp, Artificial Sequence
  Synthetic Polynucleotide
taatacgactcactatagggctccagccgcaaactgtgagggtgccatcaaacagaggagatgatggatgcctcacagtaacctggcggcagcgcaaaagatg

SEQ ID NO: 183935 - DNA, 103 bp, Artificial Sequence
  Synthetic Polynucleotide
taatacgactcactatagggagtaaggcacctccagccgcaaactgtgagaacagaggagactcacaatgtgcggctggaacctggcggcagcgcaaaagatg

SEQ ID NO: 183936 - DNA, 103 bp, Artificial Sequence
  Synthetic Polynucleotide
taatacgactcactatagggattcagactgagtaaggcacctccagccgcaacagaggagagcggctatgggtgccttaaacctggcggcagcgcaaaagatg

SEQ ID NO: 183937 - DNA, 103 bp, Artificial Sequence
  Synthetic Polynucleotide
taatacgactcactataggggggtccctggattcagactgagtaaggcacaacagaggagagtgcctatgtcagtctgaaacctggcggcagcgcaaaagatg

SEQ ID NO: 183938 - DNA, 103 bp, Artificial Sequence
  Synthetic Polynucleotide
taatacgactcactataggggcaccgctcagggtccctggattcagactgaacagaggagacagtctatgtccagggacaacctggcggcagcgcaaaagatg

SEQ ID NO: 183939 - DNA, 103 bp, Artificial Sequence
  Synthetic Polynucleotide
taatacgactcactatagggtccagcgagttggacctgatggagatgtccaacagaggagaggacatatgcatcaggtcaacctggcggcagcgcaaaagatg

SEQ ID NO: 183940 - DNA, 103 bp, Artificial Sequence
  Synthetic Polynucleotide
taatacgactcactatagggtgggctgagagcaccgctcagggtccctggaacagaggagaccagggatgctgagcggtaacctggcggcagcgcaaaagatg

SEQ ID NO: 183941 - DNA, 103 bp, Artificial Sequence
  Synthetic Polynucleotide
taatacgactcactatagggtcattagagctgggctgagagcaccgctcaaacagaggagatgagcgatgctctcagccaacctggcggcagcgcaaaagatg

SEQ ID NO: 183942 - DNA, 103 bp, Artificial Sequence
  Synthetic Polynucleotide
taatacgactcactataggggtactgttgctcattagagctgggctgagaaacagaggagatctcagatgagctctaataacctggcggcagcgcaaaagatg

SEQ ID NO: 183943 - DNA, 103 bp, Artificial Sequence
  Synthetic Polynucleotide
taatacgactcactatagggagttgccagtgtactgttgctcattagagcaacagaggagagctctaatgagcaacagtaacctggcggcagcgcaaaagatg

SEQ ID NO: 183944 - DNA, 103 bp, Artificial Sequence
  Synthetic Polynucleotide
taatacgactcactataggggagcttgaatagttgccagtgtactgttgcaacagaggagagcaacaatgcactggcaaaacctggcggcagcgcaaaagatg

SEQ ID NO: 183945 - DNA, 103 bp, Artificial Sequence
  Synthetic Polynucleotide
taatacgactcactatagggccagaagcaagagcttgaatagttgccagtaacagaggagaactggcatgtattcaagcaacctggcggcagcgcaaaagatg

SEQ ID NO: 183946 - DNA, 103 bp, Artificial Sequence
  Synthetic Polynucleotide
taatacgactcactatagggaagagagccaccagaagcaagagcttgaataacagaggagaattcaaatgcttgcttctaacctggcggcagcgcaaaagatg

SEQ ID NO: 183947 - DNA, 103 bp, Artificial Sequence
  Synthetic Polynucleotide
taatacgactcactatagggatgttattggaagagagccaccagaagcaaaacagaggagattgcttatggtggctctcaacctggcggcagcgcaaaagatg

SEQ ID NO: 183948 - DNA, 103 bp, Artificial Sequence
  Synthetic Polynucleotide
taatacgactcactataggggcatcaagtgatgttattggaagagagccaaacagaggagatggctcatgtccaataacaacctggcggcagcgcaaaagatg

SEQ ID NO: 183949 - DNA, 103 bp, Artificial Sequence
  Synthetic Polynucleotide
taatacgactcactataggggttcccagttgcatcaagtgatgttattggaacagaggagaccaataatgtcacttgataacctggcggcagcgcaaaagatg

SEQ ID NO: 183950 - DNA, 103 bp, Artificial Sequence
  Synthetic Polynucleotide
taatacgactcactatagggtcattcttgagtctagaacatagtcactgcaacagaggagagcagtgatgatgttctagaacctggcggcagcgcaaaagatg

SEQ ID NO: 183951 - DNA, 103 bp, Artificial Sequence
  Synthetic Polynucleotide
taatacgactcactataggggtaaacttgttccagcgagttggacctgataacagaggagaatcaggatgaactcgctgaacctggcggcagcgcaaaagatg

SEQ ID NO: 183952 - DNA, 103 bp, Artificial Sequence
  Synthetic Polynucleotide
taatacgactcactatagggcaaataccaggttcccagttgcatcaagtgaacagaggagacacttgatgcaactgggaaacctggcggcagcgcaaaagatg

SEQ ID NO: 183953 - DNA, 103 bp, Artificial Sequence
  Synthetic Polynucleotide
taatacgactcactatagggcccgcattggcaaataccaggttcccagttaacagaggagaaactggatgcctggtattaacctggcggcagcgcaaaagatg

SEQ ID NO: 183954 - DNA, 103 bp, Artificial Sequence
  Synthetic Polynucleotide
taatacgactcactataggggggggctcctcccgcattggcaaataccagaacagaggagactggtaatggccaatgcgaacctggcggcagcgcaaaagatg

SEQ ID NO: 183955 - DNA, 103 bp, Artificial Sequence
  Synthetic Polynucleotide
taatacgactcactatagggtcacgatgttgggggctcctcccgcattggaacagaggagaccaatgatggaggagcccaacctggcggcagcgcaaaagatg

SEQ ID NO: 183956 - DNA, 103 bp, Artificial Sequence
  Synthetic Polynucleotide
taatacgactcactatagggagaggggcagtcacgatgttgggggctcctaacagaggagaaggagcatgcaacatcgtaacctggcggcagcgcaaaagatg

SEQ ID NO: 183957 - DNA, 103 bp, Artificial Sequence
  Synthetic Polynucleotide
taatacgactcactataggggttcaggaacagaggggcagtcacgatgttaacagaggagaaacatcatgactgcccctaacctggcggcagcgcaaaagatg

SEQ ID NO: 183958 - DNA, 103 bp, Artificial Sequence
  Synthetic Polynucleotide
taatacgactcactatagggggttctgagggttcaggaacagaggggcagaacagaggagactgcccatgtgttcctgaaacctggcggcagcgcaaaagatg

SEQ ID NO: 183959 - DNA, 103 bp, Artificial Sequence
  Synthetic Polynucleotide
taatacgactcactatagggagcagagagaggttctgagggttcaggaacaacagaggagagttcctatgccctcagaaaacctggcggcagcgcaaaagatg

SEQ ID NO: 183960 - DNA, 103 bp, Artificial Sequence
  Synthetic Polynucleotide
taatacgactcactataggggttgctggtgagcagagagaggttctgaggaacagaggagacctcagatgctctctctgaacctggcggcagcgcaaaagatg

SEQ ID NO: 183961 - DNA, 103 bp, Artificial Sequence
  Synthetic Polynucleotide
taatacgactcactatagggagctaacagggttgctggtgagcagagagaaacagaggagatctctcatgtcaccagcaaacctggcggcagcgcaaaagatg

SEQ ID NO: 183962 - DNA, 103 bp, Artificial Sequence
  Synthetic Polynucleotide
taatacgactcactataggggcagcagcctgtaaacttgttccagcgagtaacagaggagaactcgcatgaacaagtttaacctggcggcagcgcaaaagatg

SEQ ID NO: 183963 - DNA, 103 bp, Artificial Sequence
  Synthetic Polynucleotide
taatacgactcactataggggcagagaccaagctaacagggttgctggtgaacagaggagacaccagatgccctgttagaacctggcggcagcgcaaaagatg

SEQ ID NO: 183964 - DNA, 103 bp, Artificial Sequence
  Synthetic Polynucleotide
taatacgactcactatagggtgctgcggcggcagagaccaagctaacaggaacagaggagacctgttatgttggtctctaacctggcggcagcgcaaaagatg

SEQ ID NO: 183965 - DNA, 103 bp, Artificial Sequence
  Synthetic Polynucleotide
taatacgactcactatagggtccctgcagatgctgcggcggcagagaccaaacagaggagatggtctatgccgccgcagaacctggcggcagcgcaaaagatg

SEQ ID NO: 183966 - DNA, 103 bp, Artificial Sequence
  Synthetic Polynucleotide
taatacgactcactatagggggtgcagagttccctgcagatgctgcggcgaacagaggagacgccgcatgatctgcaggaacctggcggcagcgcaaaagatg

SEQ ID NO: 183967 - DNA, 103 bp, Artificial Sequence
  Synthetic Polynucleotide
taatacgactcactataggggctggctacaggtgcagagttccctgcagaaacagaggagatctgcaatgaactctgcaaacctggcggcagcgcaaaagatg

SEQ ID NO: 183968 - DNA, 103 bp, Artificial Sequence
  Synthetic Polynucleotide
taatacgactcactatagggtggcgtgaaggctggctacaggtgcagagtaacagaggagaactctgatgctgtagccaaacctggcggcagcgcaaaagatg

SEQ ID NO: 183969 - DNA, 103 bp, Artificial Sequence
  Synthetic Polynucleotide
taatacgactcactataggggaggtggaggtggcgtgaaggctggctacaaacagaggagatgtagcatgccttcacgcaacctggcggcagcgcaaaagatg

SEQ ID NO: 183970 - DNA, 103 bp, Artificial Sequence
  Synthetic Polynucleotide
taatacgactcactatagggggactcagcagaggtggaggtggcgtgaagaacagaggagacttcacatgacctccaccaacctggcggcagcgcaaaagatg

SEQ ID NO: 183971 - DNA, 103 bp, Artificial Sequence
  Synthetic Polynucleotide
taatacgactcactatagggagttctggatggactcagcagaggtggaggaacagaggagacctccaatgctgctgagtaacctggcggcagcgcaaaagatg

SEQ ID NO: 183972 - DNA, 103 bp, Artificial Sequence
  Synthetic Polynucleotide
taatacgactcactataggggtgaagagagagttctggatggactcagcaaacagaggagatgctgaatgcatccagaaaacctggcggcagcgcaaaagatg

SEQ ID NO: 183973 - DNA, 103 bp, Artificial Sequence
  Synthetic Polynucleotide
taatacgactcactatagggtaaagactgagcagcagcctgtaaacttgtaacagaggagaacaagtatgcaggctgctaacctggcggcagcgcaaaagatg

SEQ ID NO: 183974 - DNA, 103 bp, Artificial Sequence
  Synthetic Polynucleotide
taatacgactcactatagggagaggccactgtgaagagagagttctggataacagaggagaatccagatgtctctcttcaacctggcggcagcgcaaaagatg

SEQ ID NO: 183975 - DNA, 103 bp, Artificial Sequence
  Synthetic Polynucleotide
taatacgactcactatagggccccgctggcagaggccactgtgaagagagaacagaggagactctctatgcagtggcctaacctggcggcagcgcaaaagatg

SEQ ID NO: 183976 - DNA, 103 bp, Artificial Sequence
  Synthetic Polynucleotide
taatacgactcactataggggtggacgcagccccgctggcagaggccactaacagaggagaagtggcatgtgccagcggaacctggcggcagcgcaaaagatg

SEQ ID NO: 183977 - DNA, 103 bp, Artificial Sequence
  Synthetic Polynucleotide
taatacgactcactatagggggtggtggtggtggacgcagccccgctggcaacagaggagagccagcatggctgcgtccaacctggcggcagcgcaaaagatg

SEQ ID NO: 183978 - DNA, 103 bp, Artificial Sequence
  Synthetic Polynucleotide
taatacgactcactatagggccttggaggcggtggtggtggtggacgcagaacagaggagactgcgtatgccaccaccaaacctggcggcagcgcaaaagatg

SEQ ID NO: 183979 - DNA, 103 bp, Artificial Sequence
  Synthetic Polynucleotide
taatacgactcactatagggactgtacatttaaagactgagcagcagcctaacagaggagaaggctgatgctcagtcttaacctggcggcagcgcaaaagatg

SEQ ID NO: 183980 - DNA, 103 bp, Artificial Sequence
  Synthetic Polynucleotide
taatacgactcactatagggttagatttagactgtacatttaaagactgaaacagaggagatcagtcatgaaatgtacaaacctggcggcagcgcaaaagatg

SEQ ID NO: 183981 - DNA, 103 bp, Artificial Sequence
  Synthetic Polynucleotide
taatacgactcactatagggcgattcttcattagatttagactgtacattaacagaggagaaatgtaatgtctaaatctaacctggcggcagcgcaaaagatg

SEQ ID NO: 183982 - DNA, 103 bp, Artificial Sequence
  Synthetic Polynucleotide
taatacgactcactataggggcgaatcccccgattcttcattagatttagaacagaggagactaaatatgatgaagaataacctggcggcagcgcaaaagatg

SEQ ID NO: 183983 - DNA, 103 bp, Artificial Sequence
  Synthetic Polynucleotide
taatacgactcactatagggcttggctgctgcgaatcccccgattcttcaaacagaggagatgaagaatggggggattcaacctggcggcagcgcaaaagatg

SEQ ID NO: 183984 - DNA, 103 bp, Artificial Sequence
  Synthetic Polynucleotide
taatacgactcactatagggggaaggctggcttggctgctgcgaatccccaacagaggagaggggatatgcagcagccaaacctggcggcagcgcaaaagatg

SEQ ID NO: 183985 - DNA, 103 bp, Artificial Sequence
  Synthetic Polynucleotide
taatacgactcactatagggaaggctgctgggaaggctggcttggctgctaacagaggagaagcagcatggccagccttaacctggcggcagcgcaaaagatg

SEQ ID NO: 183986 - DNA, 103 bp, Artificial Sequence
  Synthetic Polynucleotide
taatacgactcactataggggacggattgttcattcttgagtctagaacaaacagaggagatgttctatgctcaagaataacctggcggcagcgcaaaagatg

SEQ ID NO: 183987 - DNA, 103 bp, Artificial Sequence
  Synthetic Polynucleotide
taatacgactcactataggggcctgcactgaaggctgctgggaaggctggaacagaggagaccagccatgccagcagccaacctggcggcagcgcaaaagatg

SEQ ID NO: 183988 - DNA, 103 bp, Artificial Sequence
  Synthetic Polynucleotide
taatacgactcactataggggggaatggctgcctgcactgaaggctgctgaacagaggagacagcagatgtcagtgcagaacctggcggcagcgcaaaagatg

SEQ ID NO: 183989 - DNA, 103 bp, Artificial Sequence
  Synthetic Polynucleotide
taatacgactcactataggggctgggtctggggaatggctgcctgcactgaacagaggagacagtgcatgcagccattcaacctggcggcagcgcaaaagatg

SEQ ID NO: 183990 - DNA, 103 bp, Artificial Sequence
  Synthetic Polynucleotide
taatacgactcactataggggctagcataagctgggtctggggaatggctaacagaggagaagccatatgccagacccaaacctggcggcagcgcaaaagatg

SEQ ID NO: 183991 - DNA, 103 bp, Artificial Sequence
  Synthetic Polynucleotide
taatacgactcactatagggctgtcctccagctagcataagctgggtctgaacagaggagacagaccatgcttatgctaaacctggcggcagcgcaaaagatg

SEQ ID NO: 183992 - DNA, 103 bp, Artificial Sequence
  Synthetic Polynucleotide
taatacgactcactataggggcccagttatctgtcctccagctagcataaaacagaggagattatgcatgctggaggacaacctggcggcagcgcaaaagatg

SEQ ID NO: 183993 - DNA, 103 bp, Artificial Sequence
  Synthetic Polynucleotide
taatacgactcactataggggtcaaagtaagcccagttatctgtcctccaaacagaggagatggaggatggataactggaacctggcggcagcgcaaaagatg

SEQ ID NO: 183994 - DNA, 103 bp, Artificial Sequence
  Synthetic Polynucleotide
taatacgactcactatagggctgggcaggcgtcaaagtaagcccagttataacagaggagaataactatgcttactttgaacctggcggcagcgcaaaagatg

SEQ ID NO: 183995 - DNA, 103 bp, Artificial Sequence
  Synthetic Polynucleotide
taatacgactcactataggggtaactgttgctgggcaggcgtcaaagtaaaacagaggagattacttatgcgcctgcccaacctggcggcagcgcaaaagatg

SEQ ID NO: 183996 - DNA, 103 bp, Artificial Sequence
  Synthetic Polynucleotide
taatacgactcactatagggtgctggagtagtaactgttgctgggcaggcaacagaggagagcctgcatggcaacagttaacctggcggcagcgcaaaagatg

SEQ ID NO: 183997 - DNA, 103 bp, Artificial Sequence
  Synthetic Polynucleotide
taatacgactcactatagggactggtttctgacggattgttcattcttgaaacagaggagatcaagaatgaacaatccgaacctggcggcagcgcaaaagatg

SEQ ID NO: 183998 - DNA, 103 bp, Artificial Sequence
  Synthetic Polynucleotide
taatacgactcactatagggtgcctgtgcctgctggagtagtaactgttgaacagaggagacaacagatgctactccagaacctggcggcagcgcaaaagatg

SEQ ID NO: 183999 - DNA, 103 bp, Artificial Sequence
  Synthetic Polynucleotide
taatacgactcactataggggctgtgcctgtgcctgtgcctgctggagtaaacagaggagatactccatgaggcacaggaacctggcggcagcgcaaaagatg

SEQ ID NO: 184000 - DNA, 103 bp, Artificial Sequence
  Synthetic Polynucleotide
taatacgactcactataggggcagccagcagctgtgcctgtgcctgtgccaacagaggagaggcacaatgacaggcacaaacctggcggcagcgcaaaagatg

SEQ ID NO: 184001 - DNA, 103 bp, Artificial Sequence
  Synthetic Polynucleotide
taatacgactcactatagggctgcactgcagcagccagcagctgtgcctgaacagaggagacaggcaatgctgctggctaacctggcggcagcgcaaaagatg

SEQ ID NO: 184002 - DNA, 103 bp, Artificial Sequence
  Synthetic Polynucleotide
taatacgactcactatagggcggagtgctgctgcactgcagcagccagcaaacagaggagatgctggatgctgcagtgcaacctggcggcagcgcaaaagatg

SEQ ID NO: 184003 - DNA, 103 bp, Artificial Sequence
  Synthetic Polynucleotide
taatacgactcactatagggtgctggctggcggagtgctgctgcactgcaaacagaggagatgcagtatggcagcactcaacctggcggcagcgcaaaagatg

SEQ ID NO: 184004 - DNA, 103 bp, Artificial Sequence
  Synthetic Polynucleotide
taatacgactcactatagggagcactgtgctgctggctggcggagtgctgaacagaggagacagcacatggccagccagaacctggcggcagcgcaaaagatg

SEQ ID NO: 184005 - DNA, 103 bp, Artificial Sequence
  Synthetic Polynucleotide
taatacgactcactatagggtggctccagcagcactgtgctgctggctggaacagaggagaccagccatgagcacagtgaacctggcggcagcgcaaaagatg

SEQ ID NO: 184006 - DNA, 103 bp, Artificial Sequence
  Synthetic Polynucleotide
taatacgactcactataggggcggagatggtggctccagcagcactgtgcaacagaggagagcacagatgtgctggagcaacctggcggcagcgcaaaagatg

SEQ ID NO: 184007 - DNA, 103 bp, Artificial Sequence
  Synthetic Polynucleotide
taatacgactcactatagggggcagcagaggcggagatggtggctccagcaacagaggagagctggaatgaccatctccaacctggcggcagcgcaaaagatg

SEQ ID NO: 184008 - DNA, 103 bp, Artificial Sequence
  Synthetic Polynucleotide
taatacgactcactatagggtagatggtttactggtttctgacggattgtaacagaggagaacaatcatgcagaaaccaaacctggcggcagcgcaaaagatg

SEQ ID NO: 184009 - DNA, 103 bp, Artificial Sequence
  Synthetic Polynucleotide
taatacgactcactatagggtcatgggcgtggcagcagaggcggagatggaacagaggagaccatctatgcctctgctgaacctggcggcagcgcaaaagatg

SEQ ID NO: 184010 - DNA, 103 bp, Artificial Sequence
  Synthetic Polynucleotide
taatacgactcactataggggggatctgcgtcatgggcgtggcagcagagaacagaggagactctgcatgcacgcccataacctggcggcagcgcaaaagatg

SEQ ID NO: 184011 - DNA, 103 bp, Artificial Sequence
  Synthetic Polynucleotide
taatacgactcactatagggctgagacagggggatctgcgtcatgggcgtaacagaggagaacgcccatgacgcagatcaacctggcggcagcgcaaaagatg

SEQ ID NO: 184012 - DNA, 103 bp, Artificial Sequence
  Synthetic Polynucleotide
taatacgactcactatagggtctgtatgggctgagacagggggatctgcgaacagaggagacgcagaatgccctgtctcaacctggcggcagcgcaaaagatg

SEQ ID NO: 184013 - DNA, 103 bp, Artificial Sequence
  Synthetic Polynucleotide
taatacgactcactatagggtcctgtgcgatctgtatgggctgagacaggaacagaggagacctgtcatggcccatacaaacctggcggcagcgcaaaagatg

SEQ ID NO: 184014 - DNA, 103 bp, Artificial Sequence
  Synthetic Polynucleotide
taatacgactcactatagggttgttgaagatcctgtgcgatctgtatgggaacagaggagacccataatgatcgcacagaacctggcggcagcgcaaaagatg

SEQ ID NO: 184015 - DNA, 103 bp, Artificial Sequence
  Synthetic Polynucleotide
taatacgactcactataggggctgttgcagttgttgaagatcctgtgcgaaacagaggagatcgcacatgatcttcaacaacctggcggcagcgcaaaagatg

SEQ ID NO: 184016 - DNA, 103 bp, Artificial Sequence
  Synthetic Polynucleotide
taatacgactcactatagggtgctgttgaagctgttgcagttgttgaagaaacagaggagatcttcaatgactgcaacaaacctggcggcagcgcaaaagatg

SEQ ID NO: 184017 - DNA, 103 bp, Artificial Sequence
  Synthetic Polynucleotide
taatacgactcactataggggttgagattctgctgttgaagctgttgcagaacagaggagactgcaaatgcttcaacagaacctggcggcagcgcaaaagatg

SEQ ID NO: 184018 - DNA, 103 bp, Artificial Sequence
  Synthetic Polynucleotide
taatacgactcactatagggactgttgcaggttgagattctgctgttgaaaacagaggagattcaacatgagaatctcaaacctggcggcagcgcaaaagatg

SEQ ID NO: 184019 - DNA, 103 bp, Artificial Sequence
  Synthetic Polynucleotide
taatacgactcactatagggccactctccatagatggtttactggtttctaacagaggagaagaaacatgtaaaccatcaacctggcggcagcgcaaaagatg

SEQ ID NO: 184020 - DNA, 103 bp, Artificial Sequence
  Synthetic Polynucleotide
taatacgactcactatagggaccaacacaaactgttgcaggttgagattcaacagaggagagaatctatgcctgcaacaaacctggcggcagcgcaaaagatg

SEQ ID NO: 184021 - DNA, 103 bp, Artificial Sequence
  Synthetic Polynucleotide
taatacgactcactatagggggttggatgcaccaacacaaactgttgcagaacagaggagactgcaaatgtttgtgttgaacctggcggcagcgcaaaagatg

SEQ ID NO: 184022 - DNA, 103 bp, Artificial Sequence
  Synthetic Polynucleotide
taatacgactcactataggggcaaattggtggttggatgcaccaacacaaaacagaggagattgtgtatgtgcatccaaaacctggcggcagcgcaaaagatg

SEQ ID NO: 184023 - DNA, 103 bp, Artificial Sequence
  Synthetic Polynucleotide
taatacgactcactatagggtgcgctggctgcaaattggtggttggatgcaacagaggagagcatccatgcaccaatttaacctggcggcagcgcaaaagatg

SEQ ID NO: 184024 - DNA, 103 bp, Artificial Sequence
  Synthetic Polynucleotide
taatacgactcactataggggatgataaactgcgctggctgcaaattggtaacagaggagaaccaatatgcagccagcgaacctggcggcagcgcaaaagatg

SEQ ID NO: 184025 - DNA, 103 bp, Artificial Sequence
  Synthetic Polynucleotide
taatacgactcactataggggcgtctgtgagatgataaactgcgctggctaacagaggagaagccagatgagtttatcaaacctggcggcagcgcaaaagatg

SEQ ID NO: 184026 - DNA, 103 bp, Artificial Sequence
  Synthetic Polynucleotide
taatacgactcactatagggtggccctggggcgtctgtgagatgataaacaacagaggagagtttatatgctcacagacaacctggcggcagcgcaaaagatg

SEQ ID NO: 184027 - DNA, 103 bp, Artificial Sequence
  Synthetic Polynucleotide
taatacgactcactataggggagaccctgctggccctggggcgtctgtgaaacagaggagatcacagatgccccagggcaacctggcggcagcgcaaaagatg

SEQ ID NO: 184028 - DNA, 103 bp, Artificial Sequence
  Synthetic Polynucleotide
taatacgactcactataggggcgcttgcaggagaccctgctggccctgggaacagaggagacccaggatgagcagggtcaacctggcggcagcgcaaaagatg

SEQ ID NO: 184029 - DNA, 103 bp, Artificial Sequence
  Synthetic Polynucleotide
taatacgactcactatagggagaagattttgcgcttgcaggagaccctgcaacagaggagagcagggatgcctgcaagcaacctggcggcagcgcaaaagatg

SEQ ID NO: 184030 - DNA, 103 bp, Artificial Sequence
  Synthetic Polynucleotide
taatacgactcactataggggttgccatctccactctccatagatggtttaacagaggagaaaaccaatgatggagagtaacctggcggcagcgcaaaagatg

SEQ ID NO: 184031 - DNA, 103 bp, Artificial Sequence
  Synthetic Polynucleotide
taatacgactcactatagggtagttgcgttagaagattttgcgcttgcagaacagaggagactgcaaatgcaaaatcttaacctggcggcagcgcaaaagatg

SEQ ID NO: 184032 - DNA, 103 bp, Artificial Sequence
  Synthetic Polynucleotide
taatacgactcactatagggtttgctgaggtagttgcgttagaagattttaacagaggagaaaaatcatgtaacgcaacaacctggcggcagcgcaaaagatg

SEQ ID NO: 184033 - DNA, 103 bp, Artificial Sequence
  Synthetic Polynucleotide
taatacgactcactatagggttggcttggctttgctgaggtagttgcgttaacagaggagaaacgcaatgacctcagcaaacctggcggcagcgcaaaagatg

SEQ ID NO: 184034 - DNA, 103 bp, Artificial Sequence
  Synthetic Polynucleotide
taatacgactcactatagggctgtaggaggttggcttggctttgctgaggaacagaggagacctcagatgagccaagccaacctggcggcagcgcaaaagatg

SEQ ID NO: 184035 - DNA, 103 bp, Artificial Sequence
  Synthetic Polynucleotide
taatacgactcactatagggttggctgcgactgtaggaggttggcttggcaacagaggagagccaagatgacctcctacaacctggcggcagcgcaaaagatg

SEQ ID NO: 184036 - DNA, 103 bp, Artificial Sequence
  Synthetic Polynucleotide
taatacgactcactatagggagggtgatgcttggctgcgactgtaggaggaacagaggagacctcctatggtcgcagccaacctggcggcagcgcaaaagatg

SEQ ID NO: 184037 - DNA, 103 bp, Artificial Sequence
  Synthetic Polynucleotide
taatacgactcactatagggctgggaggtgagggtgatgcttggctgcgaaacagaggagatcgcagatgagcatcaccaacctggcggcagcgcaaaagatg

SEQ ID NO: 184038 - DNA, 103 bp, Artificial Sequence
  Synthetic Polynucleotide
taatacgactcactataggggggttgctggctgggaggtgagggtgatgcaacagaggagagcatcaatgtcacctcccaacctggcggcagcgcaaaagatg

SEQ ID NO: 184039 - DNA, 103 bp, Artificial Sequence
  Synthetic Polynucleotide
taatacgactcactataggggtgcgtgttggggttgctggctgggaggtgaacagaggagacacctcatggccagcaacaacctggcggcagcgcaaaagatg

SEQ ID NO: 184040 - DNA, 103 bp, Artificial Sequence
  Synthetic Polynucleotide
taatacgactcactatagggtgctgctattgtgcgtgttggggttgctggaacagaggagaccagcaatgccaacacgcaacctggcggcagcgcaaaagatg

SEQ ID NO: 184041 - DNA, 103 bp, Artificial Sequence
  Synthetic Polynucleotide
taatacgactcactataggggtgtgcctgtgttgccatctccactctccaaacagaggagatggagaatggagatggcaaacctggcggcagcgcaaaagatg

SEQ ID NO: 184042 - DNA, 103 bp, Artificial Sequence
  Synthetic Polynucleotide
taatacgactcactataggggaattggggttgctgctattgtgcgtgttgaacagaggagacaacacatgcaatagcagaacctggcggcagcgcaaaagatg

SEQ ID NO: 184043 - DNA, 103 bp, Artificial Sequence
  Synthetic Polynucleotide
taatacgactcactatagggggaagtgtctgaattggggttgctgctattaacagaggagaaatagcatgaaccccaataacctggcggcagcgcaaaagatg

SEQ ID NO: 184044 - DNA, 103 bp, Artificial Sequence
  Synthetic Polynucleotide
taatacgactcactatagggctggctctgtggaagtgtctgaattggggtaacagaggagaaccccaatgcagacacttaacctggcggcagcgcaaaagatg

SEQ ID NO: 184045 - DNA, 103 bp, Artificial Sequence
  Synthetic Polynucleotide
taatacgactcactatagggttggtgttgactggctctgtggaagtgtctaacagaggagaagacacatgcacagagccaacctggcggcagcgcaaaagatg

SEQ ID NO: 184046 - DNA, 103 bp, Artificial Sequence
  Synthetic Polynucleotide
taatacgactcactatagggtcaattcgctttggtgttgactggctctgtaacagaggagaacagagatggtcaacaccaacctggcggcagcgcaaaagatg

SEQ ID NO: 184047 - DNA, 103 bp, Artificial Sequence
  Synthetic Polynucleotide
taatacgactcactataggggctgggagtatcaattcgctttggtgttgaaacagaggagatcaacaatgaagcgaattaacctggcggcagcgcaaaagatg

SEQ ID NO: 184048 - DNA, 103 bp, Artificial Sequence
  Synthetic Polynucleotide
taatacgactcactataggggctcctccaagctgggagtatcaattcgctaacagaggagaagcgaaatgatactcccaaacctggcggcagcgcaaaagatg

SEQ ID NO: 184049 - DNA, 103 bp, Artificial Sequence
  Synthetic Polynucleotide
taatacgactcactatagggaggtcactgggctcctccaagctgggagtaaacagaggagatactccatgcttggaggaaacctggcggcagcgcaaaagatg

SEQ ID NO: 184050 - DNA, 103 bp, Artificial Sequence
  Synthetic Polynucleotide
taatacgactcactatagggaagctcctcaaggtcactgggctcctccaaaacagaggagattggagatgcccagtgacaacctggcggcagcgcaaaagatg

SEQ ID NO: 184051 - DNA, 103 bp, Artificial Sequence
  Synthetic Polynucleotide
taatacgactcactatagggcaaactgctcaagctcctcaaggtcactggaacagaggagaccagtgatgttgaggagcaacctggcggcagcgcaaaagatg

SEQ ID NO: 184052 - DNA, 103 bp, Artificial Sequence
  Synthetic Polynucleotide
taatacgactcactatagggccattggtttgtgtgcctgtgttgccatctaacagaggagaagatggatgcacaggcacaacctggcggcagcgcaaaagatg

SEQ ID NO: 184053 - DNA, 103 bp, Artificial Sequence
  Synthetic Polynucleotide
taatacgactcactatagggaaggtcttggcaaactgctcaagctcctcaaacagaggagatgaggaatgtgagcagttaacctggcggcagcgcaaaagatg

SEQ ID NO: 184054 - DNA, 103 bp, Artificial Sequence
  Synthetic Polynucleotide
taatacgactcactatagggtctttgtttgaaggtcttggcaaactgctcaacagaggagagagcagatggccaagaccaacctggcggcagcgcaaaagatg

SEQ ID NO: 184055 - DNA, 103 bp, Artificial Sequence
  Synthetic Polynucleotide
taatacgactcactataggggtttgattcgtctttgtttgaaggtcttggaacagaggagaccaagaatgtcaaacaaaaacctggcggcagcgcaaaagatg

SEQ ID NO: 184056 - DNA, 103 bp, Artificial Sequence
  Synthetic Polynucleotide
taatacgactcactataggggtgaatccaagtttgattcgtctttgtttgaacagaggagacaaacaatgacgaatcaaaacctggcggcagcgcaaaagatg

SEQ ID NO: 184057 - DNA, 103 bp, Artificial Sequence
  Synthetic Polynucleotide
taatacgactcactatagggatcaccctgagtgaatccaagtttgattcgaacagaggagacgaatcatgcttggattcaacctggcggcagcgcaaaagatg

SEQ ID NO: 184058 - DNA, 103 bp, Artificial Sequence
  Synthetic Polynucleotide
taatacgactcactatagggcgagcccaacatcaccctgagtgaatccaaaacagaggagattggatatgctcagggtgaacctggcggcagcgcaaaagatg

SEQ ID NO: 184059 - DNA, 103 bp, Artificial Sequence
  Synthetic Polynucleotide
taatacgactcactatagggttccccatagcgagcccaacatcaccctgaaacagaggagatcagggatgtgttgggctaacctggcggcagcgcaaaagatg

SEQ ID NO: 184060 - DNA, 103 bp, Artificial Sequence
  Synthetic Polynucleotide
taatacgactcactatagggtccatatagtttccccatagcgagcccaacaacagaggagagttgggatggctatggggaacctggcggcagcgcaaaagatg

SEQ ID NO: 184061 - DNA, 103 bp, Artificial Sequence
  Synthetic Polynucleotide
taatacgactcactatagggtgaagtcatttccatatagtttccccatagaacagaggagactatggatgaactatatgaacctggcggcagcgcaaaagatg

SEQ ID NO: 184062 - DNA, 103 bp, Artificial Sequence
  Synthetic Polynucleotide
taatacgactcactataggggtagtttggctgaagtcatttccatatagtaacagaggagaactataatgaaatgacttaacctggcggcagcgcaaaagatg

SEQ ID NO: 184063 - DNA, 103 bp, Artificial Sequence
  Synthetic Polynucleotide
taatacgactcactatagggttctggagcccccatgctggagtgaaccataacagaggagaatggttatgtccagcatgaacctggcggcagcgcaaaagatg

SEQ ID NO: 184064 - DNA, 103 bp, Artificial Sequence
  Synthetic Polynucleotide
taatacgactcactatagggagtgtctggtccatttctttcggtgtctgtaacagaggagaacagacatggaaagaaataacctggcggcagcgcaaaagatg

SEQ ID NO: 184065 - DNA, 103 bp, Artificial Sequence
  Synthetic Polynucleotide
taatacgactcactatagggcacttccttctccatgtgcagctgctcggcaacagaggagagccgagatgctgcacatgaacctggcggcagcgcaaaagatg

SEQ ID NO: 184066 - DNA, 103 bp, Artificial Sequence
  Synthetic Polynucleotide
taatacgactcactatagggagacgcggatcacttccttctccatgtgcaaacagaggagatgcacaatgagaaggaagaacctggcggcagcgcaaaagatg

SEQ ID NO: 184067 - DNA, 103 bp, Artificial Sequence
  Synthetic Polynucleotide
taatacgactcactatagggttgcagaaccagacgcggatcacttccttcaacagaggagagaaggaatggatccgcgtaacctggcggcagcgcaaaagatg

SEQ ID NO: 184068 - DNA, 103 bp, Artificial Sequence
  Synthetic Polynucleotide
taatacgactcactatagggctggcgccggttgcagaaccagacgcggataacagaggagaatccgcatgtggttctgcaacctggcggcagcgcaaaagatg

SEQ ID NO: 184069 - DNA, 103 bp, Artificial Sequence
  Synthetic Polynucleotide
taatacgactcactataggggtttctccttctggcgccggttgcagaaccaacagaggagaggttctatgaccggcgccaacctggcggcagcgcaaaagatg

SEQ ID NO: 184070 - DNA, 103 bp, Artificial Sequence
  Synthetic Polynucleotide
taatacgactcactataggggggttgatgcgtttctccttctggcgccggaacagaggagaccggcgatggaaggagaaaacctggcggcagcgcaaaagatg

SEQ ID NO: 184071 - DNA, 103 bp, Artificial Sequence
  Synthetic Polynucleotide
taatacgactcactatagggcgcactgcaggggttgatgcgtttctccttaacagaggagaaaggagatgcgcatcaacaacctggcggcagcgcaaaagatg

SEQ ID NO: 184072 - DNA, 103 bp, Artificial Sequence
  Synthetic Polynucleotide
taatacgactcactataggggcatgggggccgcactgcaggggttgatgcaacagaggagagcatcaatgcctgcagtgaacctggcggcagcgcaaaagatg

SEQ ID NO: 184073 - DNA, 103 bp, Artificial Sequence
  Synthetic Polynucleotide
taatacgactcactataggggggctgggcagcatgggggccgcactgcagaacagaggagactgcagatgggcccccataacctggcggcagcgcaaaagatg

SEQ ID NO: 184074 - DNA, 103 bp, Artificial Sequence
  Synthetic Polynucleotide
taatacgactcactatagggcggcttccctgggctgggcagcatgggggcaacagaggagagcccccatgctgcccagcaacctggcggcagcgcaaaagatg

SEQ ID NO: 184075 - DNA, 103 bp, Artificial Sequence
  Synthetic Polynucleotide
taatacgactcactatagggtctgatgattagtgtctggtccatttctttaacagaggagaaaagaaatggaccagacaaacctggcggcagcgcaaaagatg

SEQ ID NO: 184076 - DNA, 103 bp, Artificial Sequence
  Synthetic Polynucleotide
taatacgactcactatagggtgtagctggccggcttccctgggctgggcaaacagaggagatgcccaatgcagggaagcaacctggcggcagcgcaaaagatg

SEQ ID NO: 184077 - DNA, 103 bp, Artificial Sequence
  Synthetic Polynucleotide
taatacgactcactatagggatatgggggctgtagctggccggcttccctaacagaggagaagggaaatgggccagctaaacctggcggcagcgcaaaagatg

SEQ ID NO: 184078 - DNA, 103 bp, Artificial Sequence
  Synthetic Polynucleotide
taatacgactcactataggggggtgtgaccatatgggggctgtagctggcaacagaggagagccagcatgagcccccataacctggcggcagcgcaaaagatg

SEQ ID NO: 184079 - DNA, 103 bp, Artificial Sequence
  Synthetic Polynucleotide
taatacgactcactatagggcgcccccttggggtgtgaccatatgggggcaacagaggagagcccccatgtggtcacacaacctggcggcagcgcaaaagatg

SEQ ID NO: 184080 - DNA, 103 bp, Artificial Sequence
  Synthetic Polynucleotide
taatacgactcactatagggaaggtccccgcgcccccttggggtgtgaccaacagaggagaggtcacatgccaagggggaacctggcggcagcgcaaaagatg

SEQ ID NO: 184081 - DNA, 103 bp, Artificial Sequence
  Synthetic Polynucleotide
taatacgactcactatagggggacaacggtaaggtccccgcgcccccttgaacagaggagacaagggatggcggggaccaacctggcggcagcgcaaaagatg

SEQ ID NO: 184082 - DNA, 103 bp, Artificial Sequence
  Synthetic Polynucleotide
taatacgactcactatagggtggaagcttgggacaacggtaaggtccccgaacagaggagacggggaatgtaccgttgtaacctggcggcagcgcaaaagatg

SEQ ID NO: 184083 - DNA, 103 bp, Artificial Sequence
  Synthetic Polynucleotide
taatacgactcactatagggctcagactgctggaagcttgggacaacggtaacagaggagaaccgttatgccaagcttcaacctggcggcagcgcaaaagatg

SEQ ID NO: 184084 - DNA, 103 bp, Artificial Sequence
  Synthetic Polynucleotide
taatacgactcactatagggaactgttgtgctcagactgctggaagcttgaacagaggagacaagctatgagcagtctgaacctggcggcagcgcaaaagatg

SEQ ID NO: 184085 - DNA, 103 bp, Artificial Sequence
  Synthetic Polynucleotide
taatacgactcactatagggataaggtagtaactgttgtgctcagactgcaacagaggagagcagtcatggcacaacagaacctggcggcagcgcaaaagatg

SEQ ID NO: 184086 - DNA, 103 bp, Artificial Sequence
  Synthetic Polynucleotide
taatacgactcactatagggttttgggggttctgatgattagtgtctggtaacagaggagaaccagaatgtaatcatcaaacctggcggcagcgcaaaagatg

SEQ ID NO: 184087 - DNA, 103 bp, Artificial Sequence
  Synthetic Polynucleotide
taatacgactcactatagggacagctgaggataaggtagtaactgttgtgaacagaggagacacaacatgtactaccttaacctggcggcagcgcaaaagatg

SEQ ID NO: 184088 - DNA, 103 bp, Artificial Sequence
  Synthetic Polynucleotide
taatacgactcactataggggagcgtccccacagctgaggataaggtagtaacagaggagaactaccatgtcctcagctaacctggcggcagcgcaaaagatg

SEQ ID NO: 184089 - DNA, 103 bp, Artificial Sequence
  Synthetic Polynucleotide
taatacgactcactatagggggctggggtggagcgtccccacagctgaggaacagaggagacctcagatgtggggacgcaacctggcggcagcgcaaaagatg

SEQ ID NO: 184090 - DNA, 103 bp, Artificial Sequence
  Synthetic Polynucleotide
taatacgactcactatagggccagctgtccggctggggtggagcgtccccaacagaggagaggggacatgccaccccagaacctggcggcagcgcaaaagatg

SEQ ID NO: 184091 - DNA, 103 bp, Artificial Sequence
  Synthetic Polynucleotide
taatacgactcactatagggcccaccccctccagctgtccggctggggtgaacagaggagacaccccatgcggacagctaacctggcggcagcgcaaaagatg

SEQ ID NO: 184092 - DNA, 103 bp, Artificial Sequence
  Synthetic Polynucleotide
taatacgactcactatagggcgcccccgcccccaccccctccagctgtccaacagaggagaggacagatggagggggtgaacctggcggcagcgcaaaagatg

SEQ ID NO: 184093 - DNA, 103 bp, Artificial Sequence
  Synthetic Polynucleotide
taatacgactcactatagggggcgcagccccgcccccgcccccaccccctaacagaggagaagggggatggggcgggggaacctggcggcagcgcaaaagatg

SEQ ID NO: 184094 - DNA, 103 bp, Artificial Sequence
  Synthetic Polynucleotide
taatacgactcactatagggattgagggggggcgcagccccgcccccgccaacagaggagaggcgggatgggggctgcgaacctggcggcagcgcaaaagatg

SEQ ID NO: 184095 - DNA, 103 bp, Artificial Sequence
  Synthetic Polynucleotide
taatacgactcactatagggaggggatggaattgagggggggcgcagcccaacagaggagagggctgatgcccccctcaaacctggcggcagcgcaaaagatg

SEQ ID NO: 184096 - DNA, 103 bp, Artificial Sequence
  Synthetic Polynucleotide
taatacgactcactatagggggagtgacagaggggatggaattgagggggaacagaggagaccccctatgttccatcccaacctggcggcagcgcaaaagatg

SEQ ID NO: 184097 - DNA, 103 bp, Artificial Sequence
  Synthetic Polynucleotide
taatacgactcactatagggggaggtcttattttgggggttctgatgattaacagaggagaaatcatatgaacccccaaaacctggcggcagcgcaaaagatg

SEQ ID NO: 184098 - DNA, 103 bp, Artificial Sequence
  Synthetic Polynucleotide
taatacgactcactatagggcgggggtgggggagtgacagaggggatggaaacagaggagatccatcatgtctgtcactaacctggcggcagcgcaaaagatg

SEQ ID NO: 184099 - DNA, 103 bp, Artificial Sequence
  Synthetic Polynucleotide
taatacgactcactatagggtggtggtggccgggggtgggggagtgacagaacagaggagactgtcaatgccccaccccaacctggcggcagcgcaaaagatg

SEQ ID NO: 184100 - DNA, 103 bp, Artificial Sequence
  Synthetic Polynucleotide
taatacgactcactatagggtttgtgctgttggtggtggccgggggtgggaacagaggagacccaccatgggccaccacaacctggcggcagcgcaaaagatg

SEQ ID NO: 184101 - DNA, 103 bp, Artificial Sequence
  Synthetic Polynucleotide
taatacgactcactatagggagggctggggtttgtgctgttggtggtggcaacagaggagagccaccatgaacagcacaaacctggcggcagcgcaaaagatg

SEQ ID NO: 184102 - DNA, 103 bp, Artificial Sequence
  Synthetic Polynucleotide
taatacgactcactatagggggctgccttgagggctggggtttgtgctgtaacagaggagaacagcaatgaccccagccaacctggcggcagcgcaaaagatg

SEQ ID NO: 184103 - DNA, 103 bp, Artificial Sequence
  Synthetic Polynucleotide
taatacgactcactatagggatagccgagtggctgccttgagggctggggaacagaggagaccccagatgtcaaggcagaacctggcggcagcgcaaaagatg

SEQ ID NO: 184104 - DNA, 103 bp, Artificial Sequence
  Synthetic Polynucleotide
taatacgactcactatagggtgacaagccgatagccgagtggctgccttgaacagaggagacaaggcatgcactcggctaacctggcggcagcgcaaaagatg

SEQ ID NO: 184105 - DNA, 103 bp, Artificial Sequence
  Synthetic Polynucleotide
taatacgactcactatagggggttcaggcctgacaagccgatagccgagtaacagaggagaactcggatgtcggcttgtaacctggcggcagcgcaaaagatg

SEQ ID NO: 184106 - DNA, 103 bp, Artificial Sequence
  Synthetic Polynucleotide
taatacgactcactatagggcccgtgctggggttcaggcctgacaagccgaacagaggagacggcttatgaggcctgaaaacctggcggcagcgcaaaagatg

SEQ ID NO: 184107 - DNA, 103 bp, Artificial Sequence
  Synthetic Polynucleotide
taatacgactcactataggggaggccagggcccgtgctggggttcaggccaacagaggagaggcctgatgcccagcacgaacctggcggcagcgcaaaagatg

SEQ ID NO: 184108 - DNA, 103 bp, Artificial Sequence
  Synthetic Polynucleotide
taatacgactcactatagggcggagaatggggaggtcttattttgggggtaacagaggagaacccccatgataagacctaacctggcggcagcgcaaaagatg

SEQ ID NO: 184109 - DNA, 103 bp, Artificial Sequence
  Synthetic Polynucleotide
taatacgactcactatagggggttccaccagaggccagggcccgtgctggaacagaggagaccagcaatggccctggccaacctggcggcagcgcaaaagatg

SEQ ID NO: 184110 - DNA, 103 bp, Artificial Sequence
  Synthetic Polynucleotide
taatacgactcactatagggtaaggggcagggttccaccagaggccagggaacagaggagaccctggatgctggtggaaaacctggcggcagcgcaaaagatg

SEQ ID NO: 184111 - DNA, 103 bp, Artificial Sequence
  Synthetic Polynucleotide
taatacgactcactatagggtcaaggctggtaaggggcagggttccaccaaacagaggagatggtggatgcctgcccctaacctggcggcagcgcaaaagatg

SEQ ID NO: 184112 - DNA, 103 bp, Artificial Sequence
  Synthetic Polynucleotide
taatacgactcactataggggttggggacacggagaatggggaggtcttaaacagaggagataagacatgcccattctcaacctggcggcagcgcaaaagatg

SEQ ID NO: 184113 - DNA, 103 bp, Artificial Sequence
  Synthetic Polynucleotide
taatacgactcactatagggactggggccagttggggacacggagaatggaacagaggagaccattcatggtgtccccaaacctggcggcagcgcaaaagatg

SEQ ID NO: 184114 - DNA, 103 bp, Artificial Sequence
  Synthetic Polynucleotide
taatacgactcactatagggtgatctttgtactggggccagttggggacaaacagaggagatgtcccatgctggccccaaacctggcggcagcgcaaaagatg

SEQ ID NO: 184115 - DNA, 103 bp, Artificial Sequence
  Synthetic Polynucleotide
taatacgactcactatagggtcttcagccttgatctttgtactggggccaaacagaggagatggcccatgtacaaagataacctggcggcagcgcaaaagatg

SEQ ID NO: 184116 - DNA, 103 bp, Artificial Sequence
  Synthetic Polynucleotide
taatacgactcactataggggccactggggtcttcagccttgatctttgtaacagaggagaacaaagatgaaggctgaaaacctggcggcagcgcaaaagatg

SEQ ID NO: 184117 - DNA, 103 bp, Artificial Sequence
  Synthetic Polynucleotide
taatacgactcactatagggacattcttatttctggagcccccatgctggaacagaggagaccagcaatggggctccagaacctggcggcagcgcaaaagatg

SEQ ID NO: 184118 - DNA, 103 bp, Artificial Sequence
  Synthetic Polynucleotide
taatacgactcactataggggggctgaatcgccactggggtcttcagcctaacagaggagaaggctgatgaccccagtgaacctggcggcagcgcaaaagatg

SEQ ID NO: 184119 - DNA, 103 bp, Artificial Sequence
  Synthetic Polynucleotide
taatacgactcactatagggggtgctgctggggctgaatcgccactggggaacagaggagaccccagatgcgattcagcaacctggcggcagcgcaaaagatg

SEQ ID NO: 184120 - DNA, 103 bp, Artificial Sequence
  Synthetic Polynucleotide
taatacgactcactatagggagggggcaggggtgctgctggggctgaatcaacagaggagagattcaatgccagcagcaaacctggcggcagcgcaaaagatg

SEQ ID NO: 184121 - DNA, 103 bp, Artificial Sequence
  Synthetic Polynucleotide
taatacgactcactataggggggccggctgagggggcaggggtgctgctgaacagaggagacagcagatgccctgccccaacctggcggcagcgcaaaagatg

SEQ ID NO: 184122 - DNA, 103 bp, Artificial Sequence
  Synthetic Polynucleotide
taatacgactcactatagggagatgaggctgggccggctgagggggcaggaacagaggagacctgccatgtcagccggcaacctggcggcagcgcaaaagatg

SEQ ID NO: 184123 - DNA, 103 bp, Artificial Sequence
  Synthetic Polynucleotide
taatacgactcactatagggggcctggggcagatgaggctgggccggctgaacagaggagacagccgatgcagcctcataacctggcggcagcgcaaaagatg

SEQ ID NO: 184124 - DNA, 103 bp, Artificial Sequence
  Synthetic Polynucleotide
taatacgactcactatagggacatgagttgggcctggggcagatgaggctaacagaggagaagcctcatgtgccccaggaacctggcggcagcgcaaaagatg

SEQ ID NO: 184125 - DNA, 103 bp, Artificial Sequence
  Synthetic Polynucleotide
taatacgactcactatagggctgcccgtcaacatgagttgggcctggggcaacagaggagagccccaatgccaactcataacctggcggcagcgcaaaagatg

SEQ ID NO: 184126 - DNA, 103 bp, Artificial Sequence
  Synthetic Polynucleotide
taatacgactcactatagggagctagctggctgcccgtcaacatgagttgaacagaggagacaactcatgttgacgggcaacctggcggcagcgcaaaagatg

SEQ ID NO: 184127 - DNA, 103 bp, Artificial Sequence
  Synthetic Polynucleotide
taatacgactcactataggggtatgtccccagctagctggctgcccgtcaaacagaggagatgacggatggccagctagaacctggcggcagcgcaaaagatg

SEQ ID NO: 184128 - DNA, 103 bp, Artificial Sequence
  Synthetic Polynucleotide
taatacgactcactatagggaggggcttagacattcttatttctggagccaacagaggagaggctccatgaataagaataacctggcggcagcgcaaaagatg

SEQ ID NO: 184129 - DNA, 103 bp, Artificial Sequence
  Synthetic Polynucleotide
taatacgactcactatagggaggagctgctgtatgtccccagctagctggaacagaggagaccagctatgtggggacataacctggcggcagcgcaaaagatg

SEQ ID NO: 184130 - DNA, 103 bp, Artificial Sequence
  Synthetic Polynucleotide
taatacgactcactatagggctggagctggaggagctgctgtatgtccccaacagaggagaggggacatgcagcagctcaacctggcggcagcgcaaaagatg

SEQ ID NO: 184131 - DNA, 103 bp, Artificial Sequence
  Synthetic Polynucleotide
taatacgactcactataggggcaccagctgctggagctggaggagctgctaacagaggagaagcagcatgtccagctccaacctggcggcagcgcaaaagatg

SEQ ID NO: 184132 - DNA, 103 bp, Artificial Sequence
  Synthetic Polynucleotide
taatacgactcactatagggcctggcacaagcaccagctgctggagctggaacagaggagaccagctatggcagctggtaacctggcggcagcgcaaaagatg

SEQ ID NO: 184133 - DNA, 103 bp, Artificial Sequence
  Synthetic Polynucleotide
taatacgactcactataggggaggtggtggcctggcacaagcaccagctgaacagaggagacagctgatgcttgtgccaaacctggcggcagcgcaaaagatg

SEQ ID NO: 184134 - DNA, 103 bp, Artificial Sequence
  Synthetic Polynucleotide
taatacgactcactatagggcaggtggctggaggtggtggcctggcacaaaacagaggagattgtgcatggccaccaccaacctggcggcagcgcaaaagatg

SEQ ID NO: 184135 - DNA, 103 bp, Artificial Sequence
  Synthetic Polynucleotide
taatacgactcactatagggaggaactgagcaggtggctggaggtggtggaacagaggagaccaccaatgccagccaccaacctggcggcagcgcaaaagatg

SEQ ID NO: 184136 - DNA, 103 bp, Artificial Sequence
  Synthetic Polynucleotide
taatacgactcactatagggctgcggtagcaggaactgagcaggtggctgaacagaggagacagccaatggctcagttcaacctggcggcagcgcaaaagatg

SEQ ID NO: 184137 - DNA, 103 bp, Artificial Sequence
  Synthetic Polynucleotide
taatacgactcactatagggtctgctgggcctgcggtagcaggaactgagaacagaggagactcagtatgtgctaccgcaacctggcggcagcgcaaaagatg

SEQ ID NO: 184138 - DNA, 103 bp, Artificial Sequence
  Synthetic Polynucleotide
taatacgactcactatagggcctggctggctctgctgggcctgcggtagcaacagaggagagctaccatgggcccagcaaacctggcggcagcgcaaaagatg

SEQ ID NO: 184139 - DNA, 103 bp, Artificial Sequence
  Synthetic Polynucleotide
taatacgactcactatagggctcggcctccaggggcttagacattcttataacagaggagaataagaatgtctaagcccaacctggcggcagcgcaaaagatg

SEQ ID NO: 184140 - DNA, 103 bp, Artificial Sequence
  Synthetic Polynucleotide
taatacgactcactatagggcggtagcaggcctggctggctctgctgggcaacagaggagagcccagatgagccagccaaacctggcggcagcgcaaaagatg

SEQ ID NO: 184141 - DNA, 103 bp, Artificial Sequence
  Synthetic Polynucleotide
taatacgactcactataggggatttggtgtcggtagcaggcctggctggcaacagaggagagccagcatggcctgctacaacctggcggcagcgcaaaagatg

SEQ ID NO: 184142 - DNA, 103 bp, Artificial Sequence
  Synthetic Polynucleotide
taatacgactcactatagggagctggaatagatttggtgtcggtagcaggaacagaggagacctgctatggacaccaaaaacctggcggcagcgcaaaagatg

SEQ ID NO: 184143 - DNA, 103 bp, Artificial Sequence
  Synthetic Polynucleotide
taatacgactcactatagggttgctgaggtagctggaatagatttggtgtaacagaggagaacaccaatgctattccagaacctggcggcagcgcaaaagatg

SEQ ID NO: 184144 - DNA, 103 bp, Artificial Sequence
  Synthetic Polynucleotide
taatacgactcactatagggctccctgggtttgctgaggtagctggaataaacagaggagatattccatgtacctcagcaacctggcggcagcgcaaaagatg

SEQ ID NO: 184145 - DNA, 103 bp, Artificial Sequence
  Synthetic Polynucleotide
taatacgactcactataggggtcagaagagctccctgggtttgctgaggtaacagaggagaacctcaatgaacccagggaacctggcggcagcgcaaaagatg

SEQ ID NO: 184146 - DNA, 103 bp, Artificial Sequence
  Synthetic Polynucleotide
taatacgactcactataggggggctgggaggtcagaagagctccctgggtaacagaggagaacccagatggctcttctgaacctggcggcagcgcaaaagatg

SEQ ID NO: 184147 - DNA, 103 bp, Artificial Sequence
  Synthetic Polynucleotide
taatacgactcactataggggcccggcccggggctgggaggtcagaagagaacagaggagactcttcatgcctcccagcaacctggcggcagcgcaaaagatg

SEQ ID NO: 184148 - DNA, 103 bp, Artificial Sequence
  Synthetic Polynucleotide
taatacgactcactatagggtgtgtgggaagcccggcccggggctgggagaacagaggagactcccaatgccgggccggaacctggcggcagcgcaaaagatg

SEQ ID NO: 184149 - DNA, 103 bp, Artificial Sequence
  Synthetic Polynucleotide
taatacgactcactatagggggtcacggcctgtgtgggaagcccggcccgaacagaggagacgggccatgcttcccacaaacctggcggcagcgcaaaagatg

SEQ ID NO: 184150 - DNA, 103 bp, Artificial Sequence
  Synthetic Polynucleotide
taatacgactcactataggggaccttgcttctcggcctccaggggcttagaacagaggagactaagcatgtggaggccgaacctggcggcagcgcaaaagatg

SEQ ID NO: 184151 - DNA, 103 bp, Artificial Sequence
  Synthetic Polynucleotide
taatacgactcactataggggcgtagggcgggtcacggcctgtgtgggaaaacagaggagattcccaatgaggccgtgaaacctggcggcagcgcaaaagatg

SEQ ID NO: 184152 - DNA, 103 bp, Artificial Sequence
  Synthetic Polynucleotide
taatacgactcactataggggggtcgggcagcgtagggcgggtcacggccaacagaggagaggccgtatgccgccctacaacctggcggcagcgcaaaagatg

SEQ ID NO: 184153 - DNA, 103 bp, Artificial Sequence
  Synthetic Polynucleotide
taatacgactcactatagggcgagaggtgcgggtcgggcagcgtagggcgaacagaggagacgccctatgctgcccgacaacctggcggcagcgcaaaagatg

SEQ ID NO: 184154 - DNA, 103 bp, Artificial Sequence
  Synthetic Polynucleotide
taatacgactcactataggggctgcgggtgcgagaggtgcgggtcgggcaaacagaggagatgcccgatgcgcacctctaacctggcggcagcgcaaaagatg

SEQ ID NO: 184155 - DNA, 103 bp, Artificial Sequence
  Synthetic Polynucleotide
taatacgactcactatagggcatttggggggctgcgggtgcgagaggtgcaacagaggagagcacctatggcacccgcaaacctggcggcagcgcaaaagatg

SEQ ID NO: 184156 - DNA, 103 bp, Artificial Sequence
  Synthetic Polynucleotide
taatacgactcactatagggtggctccaagcatttggggggctgcgggtgaacagaggagacacccgatgccccccaaaaacctggcggcagcgcaaaagatg

SEQ ID NO: 184157 - DNA, 103 bp, Artificial Sequence
  Synthetic Polynucleotide
taatacgactcactatagggggtgggatggtggctccaagcatttgggggaacagaggagacccccaatggcttggagcaacctggcggcagcgcaaaagatg

SEQ ID NO: 184158 - DNA, 103 bp, Artificial Sequence
  Synthetic Polynucleotide
taatacgactcactatagggggctcctcggggtgggatggtggctccaagaacagaggagacttggaatgaccatcccaaacctggcggcagcgcaaaagatg

SEQ ID NO: 184159 - DNA, 103 bp, Artificial Sequence
  Synthetic Polynucleotide
taatacgactcactatagggcagatcactgggctcctcggggtgggatggaacagaggagaccatccatgcccgaggagaacctggcggcagcgcaaaagatg

SEQ ID NO: 184160 - DNA, 103 bp, Artificial Sequence
  Synthetic Polynucleotide
taatacgactcactatagggccagctcctccagatcactgggctcctcggaacagaggagaccgaggatgccagtgatcaacctggcggcagcgcaaaagatg

SEQ ID NO: 184161 - DNA, 103 bp, Artificial Sequence
  Synthetic Polynucleotide
taatacgactcactatagggggggagtccagaccttgcttctcggcctccaacagaggagaggaggcatggaagcaaggaacctggcggcagcgcaaaagatg

SEQ ID NO: 184162 - DNA, 103 bp, Artificial Sequence
  Synthetic Polynucleotide
taatacgactcactataggggcgaattgctccagctcctccagatcactgaacagaggagacagtgaatgggaggagctaacctggcggcagcgcaaaagatg

SEQ ID NO: 184163 - DNA, 103 bp, Artificial Sequence
  Synthetic Polynucleotide
taatacgactcactataggggaaggtgcgggcgaattgctccagctcctcaacagaggagagaggagatggagcaattcaacctggcggcagcgcaaaagatg

SEQ ID NO: 184164 - DNA, 103 bp, Artificial Sequence
  Synthetic Polynucleotide
taatacgactcactatagggggcgttgcttgaaggtgcgggcgaattgctaacagaggagaagcaatatgcccgcacctaacctggcggcagcgcaaaagatg

SEQ ID NO: 184165 - DNA, 103 bp, Artificial Sequence
  Synthetic Polynucleotide
taatacgactcactatagggagcttgatgcggcgttgcttgaaggtgcggaacagaggagaccgcacatgcaagcaacgaacctggcggcagcgcaaaagatg

SEQ ID NO: 184166 - DNA, 103 bp, Artificial Sequence
  Synthetic Polynucleotide
taatacgactcactatagggcgtgaagcccagcttgatgcggcgttgcttaacagaggagaaagcaaatgcgcatcaagaacctggcggcagcgcaaaagatg

SEQ ID NO: 184167 - DNA, 103 bp, Artificial Sequence
  Synthetic Polynucleotide
taatacgactcactatagggcatcaccctgcgtgaagcccagcttgatgcaacagaggagagcatcaatgtgggcttcaaacctggcggcagcgcaaaagatg

SEQ ID NO: 184168 - DNA, 103 bp, Artificial Sequence
  Synthetic Polynucleotide
taatacgactcactataggggccaggcccacatcaccctgcgtgaagcccaacagaggagagggcttatggcagggtgaaacctggcggcagcgcaaaagatg

SEQ ID NO: 184169 - DNA, 103 bp, Artificial Sequence
  Synthetic Polynucleotide
taatacgactcactatagggcttgcccatggccaggcccacatcaccctgaacagaggagacagggtatggtgggcctgaacctggcggcagcgcaaaagatg

SEQ ID NO: 184170 - DNA, 103 bp, Artificial Sequence
  Synthetic Polynucleotide
taatacgactcactatagggtgccgtagagcttgcccatggccaggcccaaacagaggagatgggccatgccatgggcaaacctggcggcagcgcaaaagatg

SEQ ID NO: 184171 - DNA, 103 bp, Artificial Sequence
  Synthetic Polynucleotide
taatacgactcactatagggctgaagtcgttgccgtagagcttgcccatgaacagaggagacatgggatggctctacggaacctggcggcagcgcaaaagatg

SEQ ID NO: 184172 - DNA, 103 bp, Artificial Sequence
  Synthetic Polynucleotide
taatacgactcactataggggtgctctgatggggagtccagaccttgcttaacagaggagaaagcaaatgctggactccaacctggcggcagcgcaaaagatg

SEQ ID NO: 184173 - DNA, 103 bp, Artificial Sequence
  Synthetic Polynucleotide
taatacgactcactatagggggtcgtctggctgaagtcgttgccgtagagaacagaggagactctacatgaacgacttcaacctggcggcagcgcaaaagatg

SEQ ID NO: 184174 - DNA, 103 bp, Artificial Sequence
  Synthetic Polynucleotide
taatacgactcactatagggagcgggaaatggtcgtctggctgaagtcgtaacagaggagaacgactatggccagacgaaacctggcggcagcgcaaaagatg

SEQ ID NO: 184175 - DNA, 103 bp, Artificial Sequence
  Synthetic Polynucleotide
taatacgactcactatagggagggcctcgaagcgggaaatggtcgtctggaacagaggagaccagacatgcatttcccgaacctggcggcagcgcaaaagatg

SEQ ID NO: 184176 - DNA, 103 bp, Artificial Sequence
  Synthetic Polynucleotide
taatacgactcactataggggctcaggttgagggcctcgaagcgggaaataacagaggagaatttccatgttcgaggccaacctggcggcagcgcaaaagatg

SEQ ID NO: 184177 - DNA, 103 bp, Artificial Sequence
  Synthetic Polynucleotide
taatacgactcactatagggtgttcttgaagctcaggttgagggcctcgaaacagaggagatcgaggatgtcaacctgaaacctggcggcagcgcaaaagatg

SEQ ID NO: 184178 - DNA, 103 bp, Artificial Sequence
  Synthetic Polynucleotide
taatacgactcactatagggagtttgcacatgttcttgaagctcaggttgaacagaggagacaacctatgcttcaagaaaacctggcggcagcgcaaaagatg

SEQ ID NO: 184179 - DNA, 103 bp, Artificial Sequence
  Synthetic Polynucleotide
taatacgactcactataggggaggggcttgagtttgcacatgttcttgaaaacagaggagattcaagatgatgtgcaaaaacctggcggcagcgcaaaagatg

SEQ ID NO: 184180 - DNA, 103 bp, Artificial Sequence
  Synthetic Polynucleotide
taatacgactcactatagggacttctccaggaggggcttgagtttgcacaaacagaggagatgtgcaatgtcaagccccaacctggcggcagcgcaaaagatg

SEQ ID NO: 184181 - DNA, 103 bp, Artificial Sequence
  Synthetic Polynucleotide
taatacgactcactatagggtcgttgagccacttctccaggaggggcttgaacagaggagacaagccatgcctggagaaaacctggcggcagcgcaaaagatg

SEQ ID NO: 184182 - DNA, 103 bp, Artificial Sequence
  Synthetic Polynucleotide
taatacgactcactatagggagtctctgcatcgttgagccacttctccagaacagaggagactggagatgtggctcaacaacctggcggcagcgcaaaagatg

SEQ ID NO: 184183 - DNA, 103 bp, Artificial Sequence
  Synthetic Polynucleotide
taatacgactcactatagggcggtgtctgtgtgctctgatggggagtccaaacagaggagatggactatgcatcagagcaacctggcggcagcgcaaaagatg

SEQ ID NO: 184184 - DNA, 103 bp, Artificial Sequence
  Synthetic Polynucleotide
taatacgactcactatagggccacagacatagtctctgcatcgttgagccaacagaggagaggctcaatgatgcagagaaacctggcggcagcgcaaaagatg

SEQ ID NO: 184185 - DNA, 103 bp, Artificial Sequence
  Synthetic Polynucleotide
taatacgactcactatagggaggcttgagtccacagacatagtctctgcaaacagaggagatgcagaatgtatgtctgtaacctggcggcagcgcaaaagatg

SEQ ID NO: 184186 - DNA, 103 bp, Artificial Sequence
  Synthetic Polynucleotide
taatacgactcactatagggggggctgggcaggcttgagtccacagacataacagaggagaatgtctatggactcaagcaacctggcggcagcgcaaaagatg

SEQ ID NO: 184187 - DNA, 103 bp, Artificial Sequence
  Synthetic Polynucleotide
taatacgactcactatagggtcagctggttggggctgggcaggcttgagtaacagaggagaactcaaatgtgcccagccaacctggcggcagcgcaaaagatg

SEQ ID NO: 184188 - DNA, 103 bp, Artificial Sequence
  Synthetic Polynucleotide
taatacgactcactatagggctggggctgctcagctggttggggctgggcaacagaggagagcccagatgcaaccagctaacctggcggcagcgcaaaagatg

SEQ ID NO: 184189 - DNA, 103 bp, Artificial Sequence
  Synthetic Polynucleotide
taatacgactcactataggggaaacccaggctggggctgctcagctggttaacagaggagaaaccagatgagcagccccaacctggcggcagcgcaaaagatg

SEQ ID NO: 184190 - DNA, 103 bp, Artificial Sequence
  Synthetic Polynucleotide
taatacgactcactataggggcaggccgtcgaaacccaggctggggctgcaacagaggagagcagccatggcctgggttaacctggcggcagcgcaaaagatg

SEQ ID NO: 184191 - DNA, 103 bp, Artificial Sequence
  Synthetic Polynucleotide
taatacgactcactatagggctccggccgggcaggccgtcgaaacccaggaacagaggagacctgggatgcgacggcctaacctggcggcagcgcaaaagatg

SEQ ID NO: 184192 - DNA, 103 bp, Artificial Sequence
  Synthetic Polynucleotide
taatacgactcactatagggcttcttgcgtctccggccgggcaggccgtcaacagaggagagacggcatgcccggccggaacctggcggcagcgcaaaagatg

SEQ ID NO: 184193 - DNA, 103 bp, Artificial Sequence
  Synthetic Polynucleotide
taatacgactcactatagggtgctggtcctcttcttgcgtctccggccggaacagaggagaccggccatggacgcaagaaacctggcggcagcgcaaaagatg

SEQ ID NO: 184194 - DNA, 103 bp, Artificial Sequence
  Synthetic Polynucleotide
taatacgactcactatagggccatttctttcggtgtctgtgtgctctgataacagaggagaatcagaatgcacagacacaacctggcggcagcgcaaaagatg

SEQ ID NO: 184195 - DNA, 103 bp, Artificial Sequence
  Synthetic Polynucleotide
taatacgactcactatagggtttgtctcgatgctggtcctcttcttgcgtaacagaggagaacgcaaatggaggaccagaacctggcggcagcgcaaaagatg

SEQ ID NO: 184196 - DNA, 103 bp, Artificial Sequence
  Synthetic Polynucleotide
taatacgactcactataggggaagcggacgtttgtctcgatgctggtcctaacagaggagaaggaccatgatcgagacaaacctggcggcagcgcaaaagatg

SEQ ID NO: 184197 - DNA, 103 bp, Artificial Sequence
  Synthetic Polynucleotide
taatacgactcactatagggtctctaaggcgaagcggacgtttgtctcgaaacagaggagatcgagaatgacgtccgctaacctggcggcagcgcaaaagatg

SEQ ID NO: 184198 - DNA, 103 bp, Artificial Sequence
  Synthetic Polynucleotide
taatacgactcactatagggagaaaactcttctctaaggcgaagcggacgaacagaggagacgtccgatgcgccttagaaacctggcggcagcgcaaaagatg

SEQ ID NO: 184199 - DNA, 103 bp, Artificial Sequence
  Synthetic Polynucleotide
taatacgactcactatagggctggttcgctagaaaactcttctctaaggcaacagaggagagccttaatgaagagttttaacctggcggcagcgcaaaagatg

SEQ ID NO: 184200 - DNA, 103 bp, Artificial Sequence
  Synthetic Polynucleotide
taatacgactcactatagggaggtaggcttctggttcgctagaaaactctaacagaggagaagagttatgtagcgaaccaacctggcggcagcgcaaaagatg

SEQ ID NO: 184201 - DNA, 103 bp, Artificial Sequence
  Synthetic Polynucleotide
taatacgactcactatagggatctcctctgaggtaggcttctggttcgctaacagaggagaagcgaaatggaagcctacaacctggcggcagcgcaaaagatg

SEQ ID NO: 184202 - DNA, 103 bp, Artificial Sequence
  Synthetic Polynucleotide
taatacgactcactataggggatcagcaggatctcctctgaggtaggcttaacagaggagaaagcctatgtcagaggagaacctggcggcagcgcaaaagatg

SEQ ID NO: 184203 - DNA, 103 bp, Artificial Sequence
  Synthetic Polynucleotide
taatacgactcactataggggctgctcggcgatcagcaggatctcctctgaacagaggagacagaggatgtcctgctgaaacctggcggcagcgcaaaagatg

SEQ ID NO: 184204 - DNA, 103 bp, Artificial Sequence
  Synthetic Polynucleotide
taatacgactcactatagggtccatgtgcagctgctcggcgatcagcaggaacagaggagacctgctatgcgccgagcaaacctggcggcagcgcaaaagatg

SEQ ID NO: 184205 - DNA, 103 bp, Artificial Sequence
  Synthetic Polynucleotide
taatacgactcactatagggtcctcctttagcagttcttggagactccataacagaggagaatggagatgccaagaactaacctggcggcagcgcaaaagatg

SEQ ID NO: 184206 - DNA, 103 bp, Artificial Sequence
  Synthetic Polynucleotide
taatacgactcactataggggccatttcgatcatttcctggctccacctgaacagaggagacaggtgatgccaggaaataacctggcggcagcgcaaaagatg

SEQ ID NO: 184207 - DNA, 103 bp, Artificial Sequence
  Synthetic Polynucleotide
taatacgactcactatagggtcgcttctccttttggcgtcggttgcagaaaacagaggagattctgcatgcgacgccaaaacctggcggcagcgcaaaagatg

SEQ ID NO: 184208 - DNA, 103 bp, Artificial Sequence
  Synthetic Polynucleotide
taatacgactcactatagggggcagttgattcgcttctccttttggcgtcaacagaggagagacgccatgaggagaagcaacctggcggcagcgcaaaagatg

SEQ ID NO: 184209 - DNA, 103 bp, Artificial Sequence
  Synthetic Polynucleotide
taatacgactcactataggggtggccacagggcagttgattcgcttctccaacagaggagaggagaaatgaatcaactgaacctggcggcagcgcaaaagatg

SEQ ID NO: 184210 - DNA, 103 bp, Artificial Sequence
  Synthetic Polynucleotide
taatacgactcactatagggtttgatgggtgtggccacagggcagttgataacagaggagaatcaacatgcctgtggccaacctggcggcagcgcaaaagatg

SEQ ID NO: 184211 - DNA, 103 bp, Artificial Sequence
  Synthetic Polynucleotide
taatacgactcactatagggagacaggtggtttgatgggtgtggccacagaacagaggagactgtggatgcacccatcaaacctggcggcagcgcaaaagatg

SEQ ID NO: 184212 - DNA, 103 bp, Artificial Sequence
  Synthetic Polynucleotide
taatacgactcactatagggcgggagttgtagacaggtggtttgatgggtaacagaggagaacccatatgaccacctgtaacctggcggcagcgcaaaagatg

SEQ ID NO: 184213 - DNA, 103 bp, Artificial Sequence
  Synthetic Polynucleotide
taatacgactcactatagggagataccagccgggagttgtagacaggtggaacagaggagaccacctatgtacaactccaacctggcggcagcgcaaaagatg

SEQ ID NO: 184214 - DNA, 103 bp, Artificial Sequence
  Synthetic Polynucleotide
taatacgactcactatagggaccctgagggagataccagccgggagttgtaacagaggagaacaactatgggctggtataacctggcggcagcgcaaaagatg

SEQ ID NO: 184215 - DNA, 103 bp, Artificial Sequence
  Synthetic Polynucleotide
taatacgactcactataggggggcccagagaccctgagggagataccagcaacagaggagagctggtatgtccctcaggaacctggcggcagcgcaaaagatg

SEQ ID NO: 184216 - DNA, 103 bp, Artificial Sequence
  Synthetic Polynucleotide
taatacgactcactataggggacagagagggggcccagagaccctgagggaacagaggagaccctcaatgtctctgggcaacctggcggcagcgcaaaagatg

SEQ ID NO: 184217 - DNA, 103 bp, Artificial Sequence
  Synthetic Polynucleotide
taatacgactcactatagggtgaaatctaggccatttcgatcatttcctgaacagaggagacaggaaatgatcgaaatgaacctggcggcagcgcaaaagatg

SEQ ID NO: 184218 - DNA, 103 bp, Artificial Sequence
  Synthetic Polynucleotide
taatacgactcactatagggggacaggagggacagagagggggcccagagaacagaggagactctggatgccctctctgaacctggcggcagcgcaaaagatg

SEQ ID NO: 184219 - DNA, 103 bp, Artificial Sequence
  Synthetic Polynucleotide
taatacgactcactatagggatggtactgtggacaggagggacagagaggaacagaggagacctctcatgccctcctgtaacctggcggcagcgcaaaagatg

SEQ ID NO: 184220 - DNA, 103 bp, Artificial Sequence
  Synthetic Polynucleotide
taatacgactcactatagggtgttccaggcatggtactgtggacaggaggaacagaggagacctcctatgcacagtaccaacctggcggcagcgcaaaagatg

SEQ ID NO: 184221 - DNA, 103 bp, Artificial Sequence
  Synthetic Polynucleotide
taatacgactcactatagggatgacgttactgttccaggcatggtactgtaacagaggagaacagtaatgtgcctggaaaacctggcggcagcgcaaaagatg

SEQ ID NO: 184222 - DNA, 103 bp, Artificial Sequence
  Synthetic Polynucleotide
taatacgactcactatagggggggaacaggatgacgttactgttccaggcaacagaggagagcctggatgagtaacgtcaacctggcggcagcgcaaaagatg

SEQ ID NO: 184223 - DNA, 103 bp, Artificial Sequence
  Synthetic Polynucleotide
taatacgactcactataggggttgttcccaggggaacaggatgacgttacaacagaggagagtaacgatgtcctgttccaacctggcggcagcgcaaaagatg

SEQ ID NO: 184224 - DNA, 103 bp, Artificial Sequence
  Synthetic Polynucleotide
taatacgactcactatagggaaggcctgctgttgttcccaggggaacaggaacagaggagacctgttatgctgggaacaaacctggcggcagcgcaaaagatg

SEQ ID NO: 184225 - DNA, 103 bp, Artificial Sequence
  Synthetic Polynucleotide
taatacgactcactatagggccaggagatgaaggcctgctgttgttcccaaacagaggagatgggaaatgcagcaggccaacctggcggcagcgcaaaagatg

SEQ ID NO: 184226 - DNA, 103 bp, Artificial Sequence
  Synthetic Polynucleotide
taatacgactcactataggggagtcctgagccaggagatgaaggcctgctaacagaggagaagcaggatgtcatctcctaacctggcggcagcgcaaaagatg

SEQ ID NO: 184227 - DNA, 103 bp, Artificial Sequence
  Synthetic Polynucleotide
taatacgactcactatagggtgctggcgtggagtcctgagccaggagatgaacagaggagacatctcatggctcaggacaacctggcggcagcgcaaaagatg

SEQ ID NO: 184228 - DNA, 103 bp, Artificial Sequence
  Synthetic Polynucleotide
taatacgactcactatagggatctgcctgttgaaatctaggccatttcgaaacagaggagatcgaaaatgcctagatttaacctggcggcagcgcaaaagatg

SEQ ID NO: 184229 - DNA, 103 bp, Artificial Sequence
  Synthetic Polynucleotide
taatacgactcactataggggcagtggggctgctggcgtggagtcctgagaacagaggagactcaggatgccacgccagaacctggcggcagcgcaaaagatg

SEQ ID NO: 184230 - DNA, 103 bp, Artificial Sequence
  Synthetic Polynucleotide
taatacgactcactatagggattttgagatgcagtggggctgctggcgtgaacagaggagacacgccatgagccccactaacctggcggcagcgcaaaagatg

SEQ ID NO: 184231 - DNA, 103 bp, Artificial Sequence
  Synthetic Polynucleotide
taatacgactcactatagggctttggagttattttgagatgcagtggggcaacagaggagagccccaatgcatctcaaaaacctggcggcagcgcaaaagatg

SEQ ID NO: 184232 - DNA, 103 bp, Artificial Sequence
  Synthetic Polynucleotide
taatacgactcactatagggttcactgctgctttggagttattttgagataacagaggagaatctcaatgtaactccaaaacctggcggcagcgcaaaagatg

SEQ ID NO: 184233 - DNA, 103 bp, Artificial Sequence
  Synthetic Polynucleotide
taatacgactcactatagggggaggcggagttcactgctgctttggagttaacagaggagaaactccatggcagcagtgaacctggcggcagcgcaaaagatg

SEQ ID NO: 184234 - DNA, 103 bp, Artificial Sequence
  Synthetic Polynucleotide
taatacgactcactatagggagttaaaactggaggcggagttcactgctgaacagaggagacagcagatgactccgcctaacctggcggcagcgcaaaagatg

SEQ ID NO: 184235 - DNA, 103 bp, Artificial Sequence
  Synthetic Polynucleotide
taatacgactcactataggggatcctgaagagttaaaactggaggcggagaacagaggagactccgcatgcagttttaaaacctggcggcagcgcaaaagatg

SEQ ID NO: 184236 - DNA, 103 bp, Artificial Sequence
  Synthetic Polynucleotide
taatacgactcactatagggtcggtaccaagatcctgaagagttaaaactaacagaggagaagttttatgtcttcaggaaacctggcggcagcgcaaaagatg

SEQ ID NO: 184237 - DNA, 103 bp, Artificial Sequence
  Synthetic Polynucleotide
taatacgactcactatagggaatgattccatcggtaccaagatcctgaagaacagaggagacttcagatgcttggtaccaacctggcggcagcgcaaaagatg

SEQ ID NO: 184238 - DNA, 103 bp, Artificial Sequence
  Synthetic Polynucleotide
taatacgactcactatagggaggtaggtggaatgattccatcggtaccaaaacagaggagattggtaatgatggaatcaaacctggcggcagcgcaaaagatg

SEQ ID NO: 184239 - DNA, 103 bp, Artificial Sequence
  Synthetic Polynucleotide
taatacgactcactatagggttcggttttaatctgcctgttgaaatctagaacagaggagactagatatgaacaggcagaacctggcggcagcgcaaaagatg

SEQ ID NO: 184240 - DNA, 103 bp, Artificial Sequence
  Synthetic Polynucleotide
taatacgactcactatagggcactgagatcttcggttttaatctgcctgtaacagaggagaacaggcatgttaaaaccgaacctggcggcagcgcaaaagatg

SEQ ID NO: 184241 - DNA, 103 bp, Artificial Sequence
  Synthetic Polynucleotide
taatacgactcactatagggtgcagggagtcactgagatcttcggttttaaacagaggagataaaacatgagatctcagaacctggcggcagcgcaaaagatg

SEQ ID NO: 184242 - DNA, 103 bp, Artificial Sequence
  Synthetic Polynucleotide
taatacgactcactataggggagggtctgctgcagggagtcactgagatcaacagaggagagatctcatggactccctgaacctggcggcagcgcaaaagatg

SEQ ID NO: 184243 - DNA, 103 bp, Artificial Sequence
  Synthetic Polynucleotide
taatacgactcactataggggccgatgggagagggtctgctgcagggagtaacagaggagaactcccatgagcagacccaacctggcggcagcgcaaaagatg

SEQ ID NO: 184244 - DNA, 103 bp, Artificial Sequence
  Synthetic Polynucleotide
taatacgactcactatagggaggtggcatggccgatgggagagggtctgcaacagaggagagcagacatgctcccatcgaacctggcggcagcgcaaaagatg

SEQ ID NO: 184245 - DNA, 103 bp, Artificial Sequence
  Synthetic Polynucleotide
taatacgactcactatagggtccttgactcaggtggcatggccgatgggaaacagaggagatcccatatgccatgccacaacctggcggcagcgcaaaagatg

SEQ ID NO: 184246 - DNA, 103 bp, Artificial Sequence
  Synthetic Polynucleotide
taatacgactcactatagggtgatatcccttcctcctttagcagttcttgaacagaggagacaagaaatgctaaaggagaacctggcggcagcgcaaaagatg

SEQ ID NO: 184247 - DNA, 103 bp, Artificial Sequence
  Synthetic Polynucleotide
taatacgactcactatagggtcatggcaggtccttgactcaggtggcatgaacagaggagacatgccatgtgagtcaagaacctggcggcagcgcaaaagatg

SEQ ID NO: 184248 - DNA, 103 bp, Artificial Sequence
  Synthetic Polynucleotide
taatacgactcactatagggtttccggacatcatggcaggtccttgactcaacagaggagagagtcaatgacctgccataacctggcggcagcgcaaaagatg

SEQ ID NO: 184249 - DNA, 103 bp, Artificial Sequence
  Synthetic Polynucleotide
taatacgactcactatagggagacatttggtttccggacatcatggcaggaacagaggagacctgccatgatgtccggaaacctggcggcagcgcaaaagatg

SEQ ID NO: 184250 - DNA, 103 bp, Artificial Sequence
  Synthetic Polynucleotide
taatacgactcactatagggcatttagcccagacatttggtttccggacaaacagaggagatgtccgatgaccaaatgtaacctggcggcagcgcaaaagatg

SEQ ID NO: 184251 - DNA, 103 bp, Artificial Sequence
  Synthetic Polynucleotide
taatacgactcactatagggcatgggctggcatttagcccagacatttggaacagaggagaccaaatatgtgggctaaaaacctggcggcagcgcaaaagatg

SEQ ID NO: 184252 - DNA, 103 bp, Artificial Sequence
  Synthetic Polynucleotide
taatacgactcactatagggcatgtcctgacatgggctggcatttagcccaacagaggagagggctaatggccagcccaaacctggcggcagcgcaaaagatg

SEQ ID NO: 184253 - DNA, 103 bp, Artificial Sequence
  Synthetic Polynucleotide
taatacgactcactatagggggagggaagccatgtcctgacatgggctggaacagaggagaccagccatggtcaggacaaacctggcggcagcgcaaaagatg

SEQ ID NO: 184254 - DNA, 103 bp, Artificial Sequence
  Synthetic Polynucleotide
taatacgactcactatagggtggagcggatggagggaagccatgtcctgaaacagaggagatcaggaatgggcttccctaacctggcggcagcgcaaaagatg

SEQ ID NO: 184255 - DNA, 103 bp, Artificial Sequence
  Synthetic Polynucleotide
taatacgactcactatagggcacaagctgctggagcggatggagggaagcaacagaggagagcttccatgcatccgctcaacctggcggcagcgcaaaagatg

SEQ ID NO: 184256 - DNA, 103 bp, Artificial Sequence
  Synthetic Polynucleotide
taatacgactcactatagggcgggaaccagcacaagctgctggagcggataacagaggagaatccgcatgagcagcttgaacctggcggcagcgcaaaagatg

SEQ ID NO: 184257 - DNA, 103 bp, Artificial Sequence
  Synthetic Polynucleotide
taatacgactcactatagggccactcatcttgatatcccttcctcctttaaacagaggagataaaggatgaagggatataacctggcggcagcgcaaaagatg

SEQ ID NO: 184258 - DNA, 103 bp, Artificial Sequence
  Synthetic Polynucleotide
taatacgactcactatagggtgtaagtggccgggaaccagcacaagctgcaacagaggagagcagctatggctggttccaacctggcggcagcgcaaaagatg

SEQ ID NO: 184259 - DNA, 103 bp, Artificial Sequence
  Synthetic Polynucleotide
taatacgactcactatagggggatacagactgtaagtggccgggaaccagaacagaggagactggttatgggccacttaaacctggcggcagcgcaaaagatg

SEQ ID NO: 184260 - DNA, 103 bp, Artificial Sequence
  Synthetic Polynucleotide
taatacgactcactataggggcaggaactgggatacagactgtaagtggcaacagaggagagccactatgagtctgtataacctggcggcagcgcaaaagatg

SEQ ID NO: 184261 - DNA, 103 bp, Artificial Sequence
  Synthetic Polynucleotide
taatacgactcactataggggtctgagatagcaggaactgggatacagacaacagaggagagtctgtatgccagttcctaacctggcggcagcgcaaaagatg

SEQ ID NO: 184262 - DNA, 103 bp, Artificial Sequence
  Synthetic Polynucleotide
taatacgactcactatagggcccaggctgggtctgagatagcaggaactgaacagaggagacagttcatgctatctcagaacctggcggcagcgcaaaagatg

SEQ ID NO: 184263 - DNA, 103 bp, Artificial Sequence
  Synthetic Polynucleotide
taatacgactcactataggggaccttgctgcccaggctgggtctgagataaacagaggagatatctcatgcccagcctgaacctggcggcagcgcaaaagatg

SEQ ID NO: 184264 - DNA, 103 bp, Artificial Sequence
  Synthetic Polynucleotide
taatacgactcactatagggtttggctgcagaccttgctgcccaggctggaacagaggagaccagccatggcagcaaggaacctggcggcagcgcaaaagatg

SEQ ID NO: 184265 - DNA, 103 bp, Artificial Sequence
  Synthetic Polynucleotide
taatacgactcactatagggggggaggagatttggctgcagaccttgctgaacagaggagacagcaaatgctgcagccaaacctggcggcagcgcaaaagatg

SEQ ID NO: 184266 - DNA, 103 bp, Artificial Sequence
  Synthetic Polynucleotide
taatacgactcactataggggctgtggaaaggggaggagatttggctgcaaacagaggagatgcagcatgatctcctccaacctggcggcagcgcaaaagatg

SEQ ID NO: 184267 - DNA, 103 bp, Artificial Sequence
  Synthetic Polynucleotide
taatacgactcactatagggccgctttgttgctgtggaaaggggaggagaaacagaggagatctcctatgctttccacaaacctggcggcagcgcaaaagatg

SEQ ID NO: 184268 - DNA, 103 bp, Artificial Sequence
  Synthetic Polynucleotide
taatacgactcactatagggggctacatccccactcatcttgatatccctaacagaggagaagggatatgaagatgagtaacctggcggcagcgcaaaagatg

SEQ ID NO: 184269 - DNA, 103 bp, Artificial Sequence
  Synthetic Polynucleotide
taatacgactcactataggggaggaggagaccgctttgttgctgtggaaaaacagaggagatttccaatgcaacaaagcaacctggcggcagcgcaaaagatg

SEQ ID NO: 184270 - DNA, 103 bp, Artificial Sequence
  Synthetic Polynucleotide
taatacgactcactatagggcagtctgtgggaggaggagaccgctttgttaacagaggagaaacaaaatggtctcctccaacctggcggcagcgcaaaagatg

SEQ ID NO: 184271 - DNA, 103 bp, Artificial Sequence
  Synthetic Polynucleotide
taatacgactcactatagggagtcccggcccagtctgtgggaggaggagaaacagaggagatctcctatgcccacagacaacctggcggcagcgcaaaagatg

SEQ ID NO: 184272 - DNA, 103 bp, Artificial Sequence
  Synthetic Polynucleotide
taatacgactcactatagggctgggatgccagtcccggcccagtctgtggaacagaggagaccacagatggggccgggaaacctggcggcagcgcaaaagatg

SEQ ID NO: 184273 - DNA, 103 bp, Artificial Sequence
  Synthetic Polynucleotide
taatacgactcactataggggcccaaatgcctgggatgccagtcccggccaacagaggagaggccggatgtggcatcccaacctggcggcagcgcaaaagatg

SEQ ID NO: 184274 - DNA, 103 bp, Artificial Sequence
  Synthetic Polynucleotide
taatacgactcactatagggagcccagggtgcccaaatgcctgggatgccaacagaggagaggcatcatgggcatttggaacctggcggcagcgcaaaagatg

SEQ ID NO: 184275 - DNA, 103 bp, Artificial Sequence
  Synthetic Polynucleotide
taatacgactcactatagggggatcctggcagcccagggtgcccaaatgcaacagaggagagcatttatgcaccctgggaacctggcggcagcgcaaaagatg

SEQ ID NO: 184276 - DNA, 103 bp, Artificial Sequence
  Synthetic Polynucleotide
taatacgactcactataggggttctaaagaggatcctggcagcccagggtaacagaggagaaccctgatgtgccaggataacctggcggcagcgcaaaagatg

SEQ ID NO: 184277 - DNA, 103 bp, Artificial Sequence
  Synthetic Polynucleotide
taatacgactcactatagggtccaggtggggttctaaagaggatcctggcaacagaggagagccaggatgctctttagaaacctggcggcagcgcaaaagatg

SEQ ID NO: 184278 - DNA, 103 bp, Artificial Sequence
  Synthetic Polynucleotide
taatacgactcactatagggctgggatgcttccaggtggggttctaaagaaacagaggagatctttaatgccccacctgaacctggcggcagcgcaaaagatg

SEQ ID NO: 184279 - DNA, 103 bp, Artificial Sequence
  Synthetic Polynucleotide
taatacgactcactatagggccgtggaatcggctacatccccactcatctaacagaggagaagatgaatggggatgtagaacctggcggcagcgcaaaagatg

SEQ ID NO: 184280 - DNA, 103 bp, Artificial Sequence
  Synthetic Polynucleotide
taatacgactcactatagggctgggagatgctgggatgcttccaggtgggaacagaggagacccaccatgaagcatcccaacctggcggcagcgcaaaagatg

SEQ ID NO: 184281 - DNA, 103 bp, Artificial Sequence
  Synthetic Polynucleotide
taatacgactcactatagggtgcttgggcactgggagatgctgggatgctaacagaggagaagcatcatggcatctcccaacctggcggcagcgcaaaagatg

SEQ ID NO: 184282 - DNA, 103 bp, Artificial Sequence
  Synthetic Polynucleotide
taatacgactcactataggggctgggtagatgcttgggcactgggagatgaacagaggagacatctcatggtgcccaagaacctggcggcagcgcaaaagatg

SEQ ID NO: 184283 - DNA, 103 bp, Artificial Sequence
  Synthetic Polynucleotide
taatacgactcactatagggcccctccagagctgggtagatgcttgggcaaacagaggagatgcccaatgatctacccaaacctggcggcagcgcaaaagatg

SEQ ID NO: 184284 - DNA, 103 bp, Artificial Sequence
  Synthetic Polynucleotide
taatacgactcactatagggggctcatcggcccctccagagctgggtagaaacagaggagatctaccatgctctggaggaacctggcggcagcgcaaaagatg

SEQ ID NO: 184285 - DNA, 103 bp, Artificial Sequence
  Synthetic Polynucleotide
taatacgactcactataggggaggtcactgggctcatcggcccctccagaaacagaggagatctggaatggccgatgagaacctggcggcagcgcaaaagatg

SEQ ID NO: 184286 - DNA, 103 bp, Artificial Sequence
  Synthetic Polynucleotide
taatacgactcactatagggccagctcctcgaggtcactgggctcatcggaacagaggagaccgatgatgccagtgaccaacctggcggcagcgcaaaagatg

SEQ ID NO: 184287 - DNA, 103 bp, Artificial Sequence
  Synthetic Polynucleotide
taatacgactcactataggggcaaacttctccagctcctcgaggtcactgaacagaggagacagtgaatgcgaggagctaacctggcggcagcgcaaaagatg

SEQ ID NO: 184288 - DNA, 103 bp, Artificial Sequence
  Synthetic Polynucleotide
taatacgactcactataggggaaggtcttggcaaacttctccagctcctcaacagaggagagaggagatggagaagtttaacctggcggcagcgcaaaagatg

SEQ ID NO: 184289 - DNA, 103 bp, Artificial Sequence
  Synthetic Polynucleotide
taatacgactcactataggggcctctgcttgaaggtcttggcaaacttctaacagaggagaagaagtatgccaagacctaacctggcggcagcgcaaaagatg

SEQ ID NO: 184290 - DNA, 103 bp, Artificial Sequence
  Synthetic Polynucleotide
taatacgactcactatagggctgcgagcatccgtggaatcggctacatccaacagaggagaggatgtatgcgattccacaacctggcggcagcgcaaaagatg

SEQ ID NO: 184291 - DNA, 103 bp, Artificial Sequence
  Synthetic Polynucleotide
taatacgactcactatagggagcttaatgcgcctctgcttgaaggtcttgaacagaggagacaagacatgcaagcagagaacctggcggcagcgcaaaagatg

SEQ ID NO: 184292 - DNA, 103 bp, Artificial Sequence
  Synthetic Polynucleotide
taatacgactcactatagggtgtgaagcccagcttaatgcgcctctgcttaacagaggagaaagcagatgcgcattaagaacctggcggcagcgcaaaagatg

SEQ ID NO: 184293 - DNA, 103 bp, Artificial Sequence
  Synthetic Polynucleotide
taatacgactcactatagggcatctccctgtgtgaagcccagcttaatgcaacagaggagagcattaatgtgggcttcaaacctggcggcagcgcaaaagatg

SEQ ID NO: 184294 - DNA, 103 bp, Artificial Sequence
  Synthetic Polynucleotide
taatacgactcactataggggccagccccacatctccctgtgtgaagcccaacagaggagagggcttatgacagggagaaacctggcggcagcgcaaaagatg

SEQ ID NO: 184295 - DNA, 103 bp, Artificial Sequence
  Synthetic Polynucleotide
taatacgactcactatagggctttcccatcgccagccccacatctccctgaacagaggagacagggaatggtggggctgaacctggcggcagcgcaaaagatg

SEQ ID NO: 184296 - DNA, 103 bp, Artificial Sequence
  Synthetic Polynucleotide
taatacgactcactatagggtgccatacagctttcccatcgccagccccaaacagaggagatggggcatgcgatgggaaaacctggcggcagcgcaaaagatg

SEQ ID NO: 184297 - DNA, 103 bp, Artificial Sequence
  Synthetic Polynucleotide
taatacgactcactatagggctgaagtcgttgccatacagctttcccatcaacagaggagagatgggatggctgtatggaacctggcggcagcgcaaaagatg

SEQ ID NO: 184298 - DNA, 103 bp, Artificial Sequence
  Synthetic Polynucleotide
taatacgactcactatagggggtggtctggctgaagtcgttgccatacagaacagaggagactgtatatgaacgacttcaacctggcggcagcgcaaaagatg

SEQ ID NO: 184299 - DNA, 103 bp, Artificial Sequence
  Synthetic Polynucleotide
taatacgactcactatagggatcgtgagatggtggtctggctgaagtcgtaacagaggagaacgactatggccagaccaaacctggcggcagcgcaaaagatg

SEQ ID NO: 184300 - DNA, 103 bp, Artificial Sequence
  Synthetic Polynucleotide
taatacgactcactatagggagggcctcaaatcgtgagatggtggtctggaacagaggagaccagacatgcatctcacgaacctggcggcagcgcaaaagatg

SEQ ID NO: 184301 - DNA, 103 bp, Artificial Sequence
  Synthetic Polynucleotide
taatacgactcactataggggctgagagtgctgcgagcatccgtggaatcaacagaggagagattccatggatgctcgcaacctggcggcagcgcaaaagatg

SEQ ID NO: 184302 - DNA, 103 bp, Artificial Sequence
  Synthetic Polynucleotide
taatacgactcactataggggctcaggttgagggcctcaaatcgtgagataacagaggagaatctcaatgtttgaggccaacctggcggcagcgcaaaagatg

SEQ ID NO: 184303 - DNA, 103 bp, Artificial Sequence
  Synthetic Polynucleotide
taatacgactcactatagggtgttcttgaagctcaggttgagggcctcaaaacagaggagattgaggatgtcaacctgaaacctggcggcagcgcaaaagatg

SEQ ID NO: 184304 - DNA, 103 bp, Artificial Sequence
  Synthetic Polynucleotide
taatacgactcactatagggagcttgcacatgttcttgaagctcaggttgaacagaggagacaacctatgcttcaagaaaacctggcggcagcgcaaaagatg

SEQ ID NO: 184305 - DNA, 103 bp, Artificial Sequence
  Synthetic Polynucleotide
taatacgactcactatagggcaggggcttgagcttgcacatgttcttgaaaacagaggagattcaagatgatgtgcaagaacctggcggcagcgcaaaagatg

SEQ ID NO: 184306 - DNA, 103 bp, Artificial Sequence
  Synthetic Polynucleotide
taatacgactcactatagggacttctccagcaggggcttgagcttgcacaaacagaggagatgtgcaatgtcaagccccaacctggcggcagcgcaaaagatg

SEQ ID NO: 184307 - DNA, 103 bp, Artificial Sequence
  Synthetic Polynucleotide
taatacgactcactatagggtcattcagccacttctccagcaggggcttgaacagaggagacaagccatggctggagaaaacctggcggcagcgcaaaagatg

SEQ ID NO: 184308 - DNA, 103 bp, Artificial Sequence
  Synthetic Polynucleotide
taatacgactcactatagggggactctgcatcattcagccacttctccagaacagaggagactggagatgtggctgaataacctggcggcagcgcaaaagatg

SEQ ID NO: 184309 - DNA, 103 bp, Artificial Sequence
  Synthetic Polynucleotide
taatacgactcactatagggctgacggagaggactctgcatcattcagccaacagaggagaggctgaatgatgcagagtaacctggcggcagcgcaaaagatg

SEQ ID NO: 184310 - DNA, 103 bp, Artificial Sequence
  Synthetic Polynucleotide
taatacgactcactatagggactgaggggtctgacggagaggactctgcaaacagaggagatgcagaatgctctccgtcaacctggcggcagcgcaaaagatg

SEQ ID NO: 184311 - DNA, 103 bp, Artificial Sequence
  Synthetic Polynucleotide
taatacgactcactataggggggcgtgctcactgaggggtctgacggagaaacagaggagatctccgatggacccctcaaacctggcggcagcgcaaaagatg

SEQ ID NO: 184312 - DNA, 103 bp, Artificial Sequence
  Synthetic Polynucleotide
taatacgactcactataggggctccacctggctgagagtgctgcgagcataacagaggagaatgctcatggcactctcaaacctggcggcagcgcaaaagatg

SEQ ID NO: 184313 - DNA, 103 bp, Artificial Sequence
  Synthetic Polynucleotide
taatacgactcactatagggggtaggagctgggcgtgctcactgaggggtaacagaggagaacccctatgtgagcacgcaacctggcggcagcgcaaaagatg

SEQ ID NO: 184314 - DNA, 103 bp, Artificial Sequence
  Synthetic Polynucleotide
taatacgactcactatagggctgaggctggggtaggagctgggcgtgctcaacagaggagagagcacatgcagctcctaaacctggcggcagcgcaaaagatg

SEQ ID NO: 184315 - DNA, 103 bp, Artificial Sequence
  Synthetic Polynucleotide
taatacgactcactatagggaaatacttcactgaggctggggtaggagctaacagaggagaagctccatgcccagcctcaacctggcggcagcgcaaaagatg

SEQ ID NO: 184316 - DNA, 103 bp, Artificial Sequence
  Synthetic Polynucleotide
taatacgactcactatagggtcttcctaccaaatacttcactgaggctggaacagaggagaccagccatggtgaagtataacctggcggcagcgcaaaagatg

SEQ ID NO: 184317 - DNA, 103 bp, Artificial Sequence
  Synthetic Polynucleotide
taatacgactcactatagggcgtttctttctcttcctaccaaatacttcaaacagaggagatgaagtatgtggtaggaaaacctggcggcagcgcaaaagatg

SEQ ID NO: 184318 - DNA, 103 bp, Artificial Sequence
  Synthetic Polynucleotide
taatacgactcactataggggatgctggtccgtttctttctcttcctaccaacagaggagaggtaggatgagaaagaaaaacctggcggcagcgcaaaagatg

SEQ ID NO: 184319 - DNA, 103 bp, Artificial Sequence
  Synthetic Polynucleotide
taatacgactcactatagggtgttggtctcgatgctggtccgtttctttcaacagaggagagaaagaatgggaccagcaaacctggcggcagcgcaaaagatg

SEQ ID NO: 184320 - DNA, 103 bp, Artificial Sequence
  Synthetic Polynucleotide
taatacgactcactataggggtcaggcggatgttggtctcgatgctggtcaacagaggagagaccagatgcgagaccaaaacctggcggcagcgcaaaagatg

SEQ ID NO: 184321 - DNA, 103 bp, Artificial Sequence
  Synthetic Polynucleotide
taatacgactcactatagggcttctccagagtcaggcggatgttggtctcaacagaggagagagaccatgatccgcctgaacctggcggcagcgcaaaagatg

SEQ ID NO: 184322 - DNA, 103 bp, Artificial Sequence
  Synthetic Polynucleotide
taatacgactcactatagggcttgaaacctcttctccagagtcaggcggaaacagaggagatccgccatgctctggagaaacctggcggcagcgcaaaagatg

SEQ ID NO: 184323 - DNA, 103 bp, Artificial Sequence
  Synthetic Polynucleotide
taatacgactcactatagggtcatttcctggctccacctggctgagagtgaacagaggagacactctatgccaggtggaaacctggcggcagcgcaaaagatg

SEQ ID NO: 184324 - DNA, 103 bp, Artificial Sequence
  Synthetic Polynucleotide
taatacgactcactatagggtttgggttatcttgaaacctcttctccagaaacagaggagatctggaatggaggtttcaaacctggcggcagcgcaaaagatg

SEQ ID NO: 184325 - DNA, 103 bp, Artificial Sequence
  Synthetic Polynucleotide
taatacgactcactatagggcgagctgggttttgggttatcttgaaacctaacagaggagaaggtttatggataacccaaacctggcggcagcgcaaaagatg

SEQ ID NO: 184326 - DNA, 103 bp, Artificial Sequence
  Synthetic Polynucleotide
taatacgactcactatagggagatctcctccgagctgggttttgggttataacagaggagaataaccatgaacccagctaacctggcggcagcgcaaaagatg

SEQ ID NO: 184327 - DNA, 103 bp, Artificial Sequence
  Synthetic Polynucleotide
taatacgactcactataggggcaatcatggagatctcctccgagctgggtaacagaggagaacccagatgggaggagataacctggcggcagcgcaaaagatg

SEQ ID NO: 184328 - DNA, 103 bp, Artificial Sequence
  Synthetic Polynucleotide
taatacgactcactatagggcaactgctctgcaatcatggagatctcctcaacagaggagagaggagatgtccatgattaacctggcggcagcgcaaaagatg

SEQ ID NO: 184329 - DNA, 103 bp, Artificial Sequence
  Synthetic Polynucleotide
taatacgactcactatagggtctccatggacaactgctctgcaatcatggaacagaggagaccatgaatgcagagcagtaacctggcggcagcgcaaaagatg

SEQ ID NO: 184330 - DNA, 103 bp, Artificial Sequence
  Synthetic Polynucleotide
taatacgactcactatagggaccacctccttctccatggacaactgctctaacagaggagaagagcaatggtccatggaaacctggcggcagcgcaaaagatg

SEQ ID NO: 184331 - DNA, 103 bp, Artificial Sequence
  Synthetic Polynucleotide
taatacgactcactatagggccagaccctcaccacctccttctccatggaaacagaggagatccatgatgaaggaggtgaacctggcggcagcgcaaaagatg

SEQ ID NO: 184332 - DNA, 103 bp, Artificial Sequence
  Synthetic Polynucleotide
taatacgactcactatagggggttgcagaaccagaccctcaccacctcctaacagaggagaaggaggatgtgagggtctaacctggcggcagcgcaaaagatg

SEQ ID NO: 184333 - DNA, 103 bp, Artificial Sequence
  Synthetic Polynucleotide
taatacgactcactatagggttttggcgtcggttgcagaaccagaccctcaacagaggagagagggtatggttctgcaaaacctggcggcagcgcaaaagatg

SEQ ID NO: 184334 - DNA, 103 bp, Artificial Sequence
  Synthetic Polynucleotide
taatacgactcactataggggctgtagtggttagacgctgcggtcgccataacagaggagaatggcgatggcagcgtctaacctggcggcagcgcaaaagatg

SEQ ID NO: 184335 - DNA, 103 bp, Artificial Sequence
  Synthetic Polynucleotide
taatacgactcactatagggcaggctctgcgcttcgcggtagccccccgcaacagaggagagcggggatgtaccgcgaaaacctggcggcagcgcaaaagatg

SEQ ID NO: 184336 - DNA, 103 bp, Artificial Sequence
  Synthetic Polynucleotide
taatacgactcactataggggcccgaggacgagtccgcctcctccaaccaaacagaggagatggttgatggaggcggacaacctggcggcagcgcaaaagatg

SEQ ID NO: 184337 - DNA, 103 bp, Artificial Sequence
  Synthetic Polynucleotide
taatacgactcactatagggtcgtggggctgcccgaggacgagtccgcctaacagaggagaaggcggatgcgtcctcggaacctggcggcagcgcaaaagatg

SEQ ID NO: 184338 - DNA, 103 bp, Artificial Sequence
  Synthetic Polynucleotide
taatacgactcactatagggttgtctatgctcgtggggctgcccgaggacaacagaggagagtcctcatgcagccccacaacctggcggcagcgcaaaagatg

SEQ ID NO: 184339 - DNA, 103 bp, Artificial Sequence
  Synthetic Polynucleotide
taatacgactcactatagggcgctgcgatcttgtctatgctcgtggggctaacagaggagaagccccatgagcatagacaacctggcggcagcgcaaaagatg

SEQ ID NO: 184340 - DNA, 103 bp, Artificial Sequence
  Synthetic Polynucleotide
taatacgactcactatagggtgcgcccttgcgctgcgatcttgtctatgcaacagaggagagcatagatgagatcgcagaacctggcggcagcgcaaaagatg

SEQ ID NO: 184341 - DNA, 103 bp, Artificial Sequence
  Synthetic Polynucleotide
taatacgactcactatagggtttttccgcttgcgcccttgcgctgcgatcaacagaggagagatcgcatggcaagggcgaacctggcggcagcgcaaaagatg

SEQ ID NO: 184342 - DNA, 103 bp, Artificial Sequence
  Synthetic Polynucleotide
taatacgactcactatagggggaggtccgctttttccgcttgcgcccttgaacagaggagacaagggatgaagcggaaaaacctggcggcagcgcaaaagatg

SEQ ID NO: 184343 - DNA, 103 bp, Artificial Sequence
  Synthetic Polynucleotide
taatacgactcactatagggtcacctcgatggaggtccgctttttccgctaacagaggagaagcggaatgagcggacctaacctggcggcagcgcaaaagatg

SEQ ID NO: 184344 - DNA, 103 bp, Artificial Sequence
  Synthetic Polynucleotide
taatacgactcactatagggcccttgacgctcacctcgatggaggtccgcaacagaggagagcggacatgcatcgaggtaacctggcggcagcgcaaaagatg

SEQ ID NO: 184345 - DNA, 103 bp, Artificial Sequence
  Synthetic Polynucleotide
taatacgactcactatagggctccagagcccccttgacgctcacctcgataacagaggagaatcgagatgagcgtcaagaacctggcggcagcgcaaaagatg

SEQ ID NO: 184346 - DNA, 103 bp, Artificial Sequence
  Synthetic Polynucleotide
taatacgactcactatagggcgccctgcaccaggctctgcgcttcgcggtaacagaggagaaccgcgatgcgcagagccaacctggcggcagcgcaaaagatg

SEQ ID NO: 184347 - DNA, 103 bp, Artificial Sequence
  Synthetic Polynucleotide
taatacgactcactatagggggaaatggctctccagagcccccttgacgcaacagaggagagcgtcaatggggctctggaacctggcggcagcgcaaaagatg

SEQ ID NO: 184348 - DNA, 103 bp, Artificial Sequence
  Synthetic Polynucleotide
taatacgactcactataggggggcatttgaggaaatggctctccagagccaacagaggagaggctctatggagccatttaacctggcggcagcgcaaaagatg

SEQ ID NO: 184349 - DNA, 103 bp, Artificial Sequence
  Synthetic Polynucleotide
taatacgactcactatagggcgagggcttggggcatttgaggaaatggctaacagaggagaagccatatgctcaaatgcaacctggcggcagcgcaaaagatg

SEQ ID NO: 184350 - DNA, 103 bp, Artificial Sequence
  Synthetic Polynucleotide
taatacgactcactatagggtctcctgggccgagggcttggggcatttgaaacagaggagatcaaatatgccaagccctaacctggcggcagcgcaaaagatg

SEQ ID NO: 184351 - DNA, 103 bp, Artificial Sequence
  Synthetic Polynucleotide
taatacgactcactatagggagggaggtgatctcctgggccgagggcttgaacagaggagacaagccatgggcccaggaaacctggcggcagcgcaaaagatg

SEQ ID NO: 184352 - DNA, 103 bp, Artificial Sequence
  Synthetic Polynucleotide
taatacgactcactataggggctgtccgcgagggaggtgatctcctgggcaacagaggagagcccagatgatcacctccaacctggcggcagcgcaaaagatg

SEQ ID NO: 184353 - DNA, 103 bp, Artificial Sequence
  Synthetic Polynucleotide
taatacgactcactatagggccagctgtaagctgtccgcgagggaggtgaaacagaggagatcacctatgtcgcggacaaacctggcggcagcgcaaaagatg

SEQ ID NO: 184354 - DNA, 103 bp, Artificial Sequence
  Synthetic Polynucleotide
taatacgactcactatagggacctccttctccagctgtaagctgtccgcgaacagaggagacgcggaatgcttacagctaacctggcggcagcgcaaaagatg

SEQ ID NO: 184355 - DNA, 103 bp, Artificial Sequence
  Synthetic Polynucleotide
taatacgactcactatagggaactctcaccacctccttctccagctgtaaaacagaggagattacagatggagaaggagaacctggcggcagcgcaaaagatg

SEQ ID NO: 184356 - DNA, 103 bp, Artificial Sequence
  Synthetic Polynucleotide
taatacgactcactatagggtacaaaaccaaactctcaccacctccttctaacagaggagaagaaggatgtggtgagagaacctggcggcagcgcaaaagatg

SEQ ID NO: 184357 - DNA, 103 bp, Artificial Sequence
  Synthetic Polynucleotide
taatacgactcactataggggcgccgtagtcgccctgcaccaggctctgcaacagaggagagcagagatgggtgcagggaacctggcggcagcgcaaaagatg

SEQ ID NO: 184358 - DNA, 103 bp, Artificial Sequence
  Synthetic Polynucleotide
taatacgactcactatagggtgtctcctgttacaaaaccaaactctcaccaacagaggagaggtgagatgttggttttgaacctggcggcagcgcaaaagatg

SEQ ID NO: 184359 - DNA, 103 bp, Artificial Sequence
  Synthetic Polynucleotide
taatacgactcactatagggtttctctttctgtctcctgttacaaaaccaaacagaggagatggtttatgaacaggagaaacctggcggcagcgcaaaagatg

SEQ ID NO: 184360 - DNA, 103 bp, Artificial Sequence
  Synthetic Polynucleotide
taatacgactcactataggggggtcatccttttctctttctgtctcctgtaacagaggagaacaggaatgagaaagagaaacctggcggcagcgcaaaagatg

SEQ ID NO: 184361 - DNA, 103 bp, Artificial Sequence
  Synthetic Polynucleotide
taatacgactcactatagggcctccgggaggggtcatccttttctctttcaacagaggagagaaagaatgaaggatgacaacctggcggcagcgcaaaagatg

SEQ ID NO: 184362 - DNA, 103 bp, Artificial Sequence
  Synthetic Polynucleotide
taatacgactcactatagggcggcagagtccctccgggaggggtcatcctaacagaggagaaggatgatgcctcccggaaacctggcggcagcgcaaaagatg

SEQ ID NO: 184363 - DNA, 103 bp, Artificial Sequence
  Synthetic Polynucleotide
taatacgactcactatagggcctcggcgcccggcagagtccctccgggagaacagaggagactcccgatgggactctgcaacctggcggcagcgcaaaagatg

SEQ ID NO: 184364 - DNA, 103 bp, Artificial Sequence
  Synthetic Polynucleotide
taatacgactcactatagggccgtacacatcctcggcgcccggcagagtcaacagaggagagactctatggggcgccgaaacctggcggcagcgcaaaagatg

SEQ ID NO: 184365 - DNA, 103 bp, Artificial Sequence
  Synthetic Polynucleotide
taatacgactcactatagggcctactccccccgtacacatcctcggcgccaacagaggagaggcgccatggatgtgtacaacctggcggcagcgcaaaagatg

SEQ ID NO: 184366 - DNA, 103 bp, Artificial Sequence
  Synthetic Polynucleotide
taatacgactcactataggggtggagtgtccctactccccccgtacacataacagaggagaatgtgtatggggggagtaaacctggcggcagcgcaaaagatg

SEQ ID NO: 184367 - DNA, 103 bp, Artificial Sequence
  Synthetic Polynucleotide
taatacgactcactatagggccgtggtgtggtggagtgtccctactccccaacagaggagaggggagatgggacactccaacctggcggcagcgcaaaagatg

SEQ ID NO: 184368 - DNA, 103 bp, Artificial Sequence
  Synthetic Polynucleotide
taatacgactcactataggggctctgcagagcgccgtagtcgccctgcacaacagaggagagtgcagatggactacggcaacctggcggcagcgcaaaagatg

SEQ ID NO: 184369 - DNA, 103 bp, Artificial Sequence
  Synthetic Polynucleotide
taatacgactcactatagggcgtctgcaccccgtggtgtggtggagtgtcaacagaggagagacactatgccacaccacaacctggcggcagcgcaaaagatg

SEQ ID NO: 184370 - DNA, 103 bp, Artificial Sequence
  Synthetic Polynucleotide
taatacgactcactatagggactggacgggcgtctgcaccccgtggtgtgaacagaggagacacaccatggggtgcagaaacctggcggcagcgcaaaagatg

SEQ ID NO: 184371 - DNA, 103 bp, Artificial Sequence
  Synthetic Polynucleotide
taatacgactcactatagggggtgtccgttgctctgcagagcgccgtagtaacagaggagaactacgatgctctgcagaaacctggcggcagcgcaaaagatg

SEQ ID NO: 184372 - DNA, 103 bp, Artificial Sequence
  Synthetic Polynucleotide
taatacgactcactatagggtggctgagcgggtgtccgttgctctgcagaaacagaggagatctgcaatgcaacggacaaacctggcggcagcgcaaaagatg

SEQ ID NO: 184373 - DNA, 103 bp, Artificial Sequence
  Synthetic Polynucleotide
taatacgactcactatagggctggtgagcgtggctgagcgggtgtccgttaacagaggagaaacggaatgccgctcagcaacctggcggcagcgcaaaagatg

SEQ ID NO: 184374 - DNA, 103 bp, Artificial Sequence
  Synthetic Polynucleotide
taatacgactcactatagggcggtgatccactggtgagcgtggctgagcgaacagaggagacgctcaatgacgctcaccaacctggcggcagcgcaaaagatg

SEQ ID NO: 184375 - DNA, 103 bp, Artificial Sequence
  Synthetic Polynucleotide
taatacgactcactatagggtgggacagcgcggtgatccactggtgagcgaacagaggagacgctcaatggtggatcacaacctggcggcagcgcaaaagatg

SEQ ID NO: 184376 - DNA, 103 bp, Artificial Sequence
  Synthetic Polynucleotide
taatacgactcactataggggccgccgccgtgggacagcgcggtgatccaaacagaggagatggatcatggcgctgtccaacctggcggcagcgcaaaagatg

SEQ ID NO: 184377 - DNA, 103 bp, Artificial Sequence
  Synthetic Polynucleotide
taatacgactcactatagggaggtgagcaggctgtagtggttagacgctgaacagaggagacagcgtatgaccactacaaacctggcggcagcgcaaaagatg

SEQ ID NO: 184378 - DNA, 103 bp, Artificial Sequence
  Synthetic Polynucleotide
taatacgactcactatagggcgcccccgccgccgccgccgtgggacagcgaacagaggagacgctgtatgacggcggcgaacctggcggcagcgcaaaagatg

SEQ ID NO: 184379 - DNA, 103 bp, Artificial Sequence
  Synthetic Polynucleotide
taatacgactcactatagggccgccgccaccgcccccgccgccgccgccgaacagaggagacggcggatgcggcgggggaacctggcggcagcgcaaaagatg

SEQ ID NO: 184380 - DNA, 103 bp, Artificial Sequence
  Synthetic Polynucleotide
taatacgactcactataggggccccccccgccgccgccaccgcccccgccaacagaggagaggcgggatgggtggcggcaacctggcggcagcgcaaaagatg

SEQ ID NO: 184381 - DNA, 103 bp, Artificial Sequence
  Synthetic Polynucleotide
taatacgactcactatagggcgccgcccccgccccccccgccgccgccacaacagaggagagtggcgatggcgggggggaacctggcggcagcgcaaaagatg

SEQ ID NO: 184382 - DNA, 103 bp, Artificial Sequence
  Synthetic Polynucleotide
taatacgactcactatagggccgcccccgccgccgcccccgccccccccgaacagaggagacgggggatgcgggggcggaacctggcggcagcgcaaaagatg

SEQ ID NO: 184383 - DNA, 103 bp, Artificial Sequence
  Synthetic Polynucleotide
taatacgactcactataggggccgtcgccgccgcccccgccgccgcccccaacagaggagagggggcatgggcgggggcaacctggcggcagcgcaaaagatg

SEQ ID NO: 184384 - DNA, 103 bp, Artificial Sequence
  Synthetic Polynucleotide
taatacgactcactatagggaccacggggagccgtcgccgccgcccccgcaacagaggagagcggggatggcggcgacgaacctggcggcagcgcaaaagatg

SEQ ID NO: 184385 - DNA, 103 bp, Artificial Sequence
  Synthetic Polynucleotide
taatacgactcactataggggggctggtggaccacggggagccgtcgccgaacagaggagacggcgaatgctccccgtgaacctggcggcagcgcaaaagatg

SEQ ID NO: 184386 - DNA, 103 bp, Artificial Sequence
  Synthetic Polynucleotide
taatacgactcactatagggctggcccagggggctggtggaccacggggaaacagaggagatccccgatgtccaccagcaacctggcggcagcgcaaaagatg

SEQ ID NO: 184387 - DNA, 103 bp, Artificial Sequence
  Synthetic Polynucleotide
taatacgactcactatagggtgatgtccggctggcccagggggctggtggaacagaggagaccaccaatgccctgggccaacctggcggcagcgcaaaagatg

SEQ ID NO: 184388 - DNA, 103 bp, Artificial Sequence
  Synthetic Polynucleotide
taatacgactcactataggggaggcgctggaggtgagcaggctgtagtggaacagaggagaccactaatgcctgctcacaacctggcggcagcgcaaaagatg

SEQ ID NO: 184389 - DNA, 103 bp, Artificial Sequence
  Synthetic Polynucleotide
taatacgactcactatagggaccgagggcttgatgtccggctggcccaggaacagaggagacctgggatggccggacataacctggcggcagcgcaaaagatg

SEQ ID NO: 184390 - DNA, 103 bp, Artificial Sequence
  Synthetic Polynucleotide
taatacgactcactatagggctgcaccaccaccgagggcttgatgtccggaacagaggagaccggacatgaagccctcgaacctggcggcagcgcaaaagatg

SEQ ID NO: 184391 - DNA, 103 bp, Artificial Sequence
  Synthetic Polynucleotide
taatacgactcactatagggggccgccctgctgcaccaccaccgagggctaacagaggagaagccctatgtggtggtgcaacctggcggcagcgcaaaagatg

SEQ ID NO: 184392 - DNA, 103 bp, Artificial Sequence
  Synthetic Polynucleotide
taatacgactcactatagggtcgtctccgcggccgccctgctgcaccaccaacagaggagaggtggtatggcagggcggaacctggcggcagcgcaaaagatg

SEQ ID NO: 184393 - DNA, 103 bp, Artificial Sequence
  Synthetic Polynucleotide
taatacgactcactatagggcccgtgcagctcgtctccgcggccgccctgaacagaggagacagggcatgcgcggagacaacctggcggcagcgcaaaagatg

SEQ ID NO: 184394 - DNA, 103 bp, Artificial Sequence
  Synthetic Polynucleotide
taatacgactcactataggggggcgcctggcccgtgcagctcgtctccgcaacagaggagagcggagatgagctgcacgaacctggcggcagcgcaaaagatg

SEQ ID NO: 184395 - DNA, 103 bp, Artificial Sequence
  Synthetic Polynucleotide
taatacgactcactatagggtgctgctgcagggcgcctggcccgtgcagcaacagaggagagctgcaatggccaggcgcaacctggcggcagcgcaaaagatg

SEQ ID NO: 184396 - DNA, 103 bp, Artificial Sequence
  Synthetic Polynucleotide
taatacgactcactatagggctgctgatgctgctgctgcagggcgcctggaacagaggagaccaggcatgctgcagcagaacctggcggcagcgcaaaagatg

SEQ ID NO: 184397 - DNA, 103 bp, Artificial Sequence
  Synthetic Polynucleotide
taatacgactcactataggggctgttgctgctgctgatgctgctgctgcaaacagaggagatgcagcatgagcatcagcaacctggcggcagcgcaaaagatg

SEQ ID NO: 184398 - DNA, 103 bp, Artificial Sequence
  Synthetic Polynucleotide
taatacgactcactatagggtgctgctgttgctgttgctgctgctgatgcaacagaggagagcatcaatggcagcaacaaacctggcggcagcgcaaaagatg

SEQ ID NO: 184399 - DNA, 103 bp, Artificial Sequence
  Synthetic Polynucleotide
taatacgactcactataggggtgcacgatggaggcgctggaggtgagcagaacagaggagactgctcatgtccagcgccaacctggcggcagcgcaaaagatg

SEQ ID NO: 184400 - DNA, 103 bp, Artificial Sequence
  Synthetic Polynucleotide
taatacgactcactatagggctgctgttgctgctgctgttgctgttgctgaacagaggagacagcaaatgcaacagcagaacctggcggcagcgcaaaagatg

SEQ ID NO: 184401 - DNA, 103 bp, Artificial Sequence
  Synthetic Polynucleotide
taatacgactcactataggggctgctgttgctgctgttgctgctgctgttaacagaggagaaacagcatgagcaacagcaacctggcggcagcgcaaaagatg

SEQ ID NO: 184402 - DNA, 103 bp, Artificial Sequence
  Synthetic Polynucleotide
taatacgactcactatagggtgctgctgctgctgctgttgctgctgttgcaacagaggagagcaacaatggcaacagcaaacctggcggcagcgcaaaagatg

SEQ ID NO: 184403 - DNA, 103 bp, Artificial Sequence
  Synthetic Polynucleotide
taatacgactcactatagggccgctgttgctgctgctgctgctgctgttgaacagaggagacaacagatgcagcagcagaacctggcggcagcgcaaaagatg

SEQ ID NO: 184404 - DNA, 103 bp, Artificial Sequence
  Synthetic Polynucleotide
taatacgactcactataggggatgcggcggccgctgttgctgctgctgctaacagaggagaagcagcatgagcaacagcaacctggcggcagcgcaaaagatg

SEQ ID NO: 184405 - DNA, 103 bp, Artificial Sequence
  Synthetic Polynucleotide
taatacgactcactatagggtggtgcaccagatgcggcggccgctgttgcaacagaggagagcaacaatggccgccgcaaacctggcggcagcgcaaaagatg

SEQ ID NO: 184406 - DNA, 103 bp, Artificial Sequence
  Synthetic Polynucleotide
taatacgactcactataggggttagcggcgtggtgcaccagatgcggcggaacagaggagaccgccgatgctggtgcacaacctggcggcagcgcaaaagatg

SEQ ID NO: 184407 - DNA, 103 bp, Artificial Sequence
  Synthetic Polynucleotide
taatacgactcactatagggccgggtggtggttagcggcgtggtgcaccaaacagaggagatggtgcatgacgccgctaaacctggcggcagcgcaaaagatg

SEQ ID NO: 184408 - DNA, 103 bp, Artificial Sequence
  Synthetic Polynucleotide
taatacgactcactataggggccccgggtcccgggtggtggttagcggcgaacagaggagacgccgcatgccaccacccaacctggcggcagcgcaaaagatg

SEQ ID NO: 184409 - DNA, 103 bp, Artificial Sequence
  Synthetic Polynucleotide
taatacgactcactataggggctccgccatgccccgggtcccgggtggtgaacagaggagacaccacatgggacccgggaacctggcggcagcgcaaaagatg

SEQ ID NO: 184410 - DNA, 103 bp, Artificial Sequence
  Synthetic Polynucleotide
taatacgactcactataggggcggctcggcgtgcacgatggaggcgctggaacagaggagaccagcgatgccatcgtgcaacctggcggcagcgcaaaagatg

SEQ ID NO: 184411 - DNA, 103 bp, Artificial Sequence
  Synthetic Polynucleotide
taatacgactcactatagggcagccgccgcgctccgccatgccccgggtcaacagaggagagacccgatgcatggcggaaacctggcggcagcgcaaaagatg

SEQ ID NO: 184412 - DNA, 103 bp, Artificial Sequence
  Synthetic Polynucleotide
taatacgactcactatagggaggtgcgctgcagccgccgcgctccgccataacagaggagaatggcgatgcgcggcggcaacctggcggcagcgcaaaagatg

SEQ ID NO: 184413 - DNA, 103 bp, Artificial Sequence
  Synthetic Polynucleotide
taatacgactcactatagggggagggtgggaggtgcgctgcagccgccgcaacagaggagagcggcgatggcagcgcacaacctggcggcagcgcaaaagatg

SEQ ID NO: 184414 - DNA, 103 bp, Artificial Sequence
  Synthetic Polynucleotide
taatacgactcactatagggacgctcccatggagggtgggaggtgcgctgaacagaggagacagcgcatgtcccaccctaacctggcggcagcgcaaaagatg

SEQ ID NO: 184415 - DNA, 103 bp, Artificial Sequence
  Synthetic Polynucleotide
taatacgactcactatagggccgccgttggacgctcccatggagggtgggaacagaggagacccaccatgcatgggagcaacctggcggcagcgcaaaagatg

SEQ ID NO: 184416 - DNA, 103 bp, Artificial Sequence
  Synthetic Polynucleotide
taatacgactcactataggggtagagcaagccgccgttggacgctcccataacagaggagaatgggaatgtccaacggcaacctggcggcagcgcaaaagatg

SEQ ID NO: 184417 - DNA, 103 bp, Artificial Sequence
  Synthetic Polynucleotide
taatacgactcactatagggtgggctgcgagtagagcaagccgccgttggaacagaggagaccaacgatggcttgctctaacctggcggcagcgcaaaagatg

SEQ ID NO: 184418 - DNA, 103 bp, Artificial Sequence
  Synthetic Polynucleotide
taatacgactcactatagggaccgtgaagctgggctgcgagtagagcaagaacagaggagacttgctatgctcgcagccaacctggcggcagcgcaaaagatg

SEQ ID NO: 184419 - DNA, 103 bp, Artificial Sequence
  Synthetic Polynucleotide
taatacgactcactatagggcatgccgttcaccgtgaagctgggctgcgaaacagaggagatcgcagatgagcttcacgaacctggcggcagcgcaaaagatg

SEQ ID NO: 184420 - DNA, 103 bp, Artificial Sequence
  Synthetic Polynucleotide
taatacgactcactatagggcggcgcccagcatgccgttcaccgtgaagcaacagaggagagcttcaatgtgaacggcaaacctggcggcagcgcaaaagatg

SEQ ID NO: 184421 - DNA, 103 bp, Artificial Sequence
  Synthetic Polynucleotide
taatacgactcactatagggatgccgccgggcggctcggcgtgcacgatgaacagaggagacatcgtatgcgccgagccaacctggcggcagcgcaaaagatg

SEQ ID NO: 184422 - DNA, 103 bp, Artificial Sequence
  Synthetic Polynucleotide
taatacgactcactatagggggctgcccgccggcgcccagcatgccgttcaacagaggagagaacggatggctgggcgcaacctggcggcagcgcaaaagatg

SEQ ID NO: 184423 - DNA, 103 bp, Artificial Sequence
  Synthetic Polynucleotide
taatacgactcactatagggcagaccggccggctgcccgccggcgcccagaacagaggagactgggcatgggcgggcagaacctggcggcagcgcaaaagatg

SEQ ID NO: 184424 - DNA, 103 bp, Artificial Sequence
  Synthetic Polynucleotide
taatacgactcactatagggcgtggtggtgcagaccggccggctgcccgcaacagaggagagcgggcatgcggccggtcaacctggcggcagcgcaaaagatg

SEQ ID NO: 184425 - DNA, 103 bp, Artificial Sequence
  Synthetic Polynucleotide
taatacgactcactatagggtcccgcaggccgtggtggtgcagaccggccaacagaggagaggccggatggcaccaccaaacctggcggcagcgcaaaagatg

SEQ ID NO: 184426 - DNA, 103 bp, Artificial Sequence
  Synthetic Polynucleotide
taatacgactcactataggggtcgtgcgcgtcccgcaggccgtggtggtgaacagaggagacaccacatgggcctgcggaacctggcggcagcgcaaaagatg

SEQ ID NO: 184427 - DNA, 103 bp, Artificial Sequence
  Synthetic Polynucleotide
taatacgactcactatagggggtgtggctcgtcgtgcgcgtcccgcaggcaacagaggagagcctgcatgacgcgcacgaacctggcggcagcgcaaaagatg

SEQ ID NO: 184428 - DNA, 103 bp, Artificial Sequence
  Synthetic Polynucleotide
taatacgactcactatagggtggtcggcatggtgtggctcgtcgtgcgcgaacagaggagacgcgcaatgcgagccacaaacctggcggcagcgcaaaagatg

SEQ ID NO: 184429 - DNA, 103 bp, Artificial Sequence
  Synthetic Polynucleotide
taatacgactcactataggggtgcgggtggtggtcggcatggtgtggctcaacagaggagagagccaatgcatgccgacaacctggcggcagcgcaaaagatg

SEQ ID NO: 184430 - DNA, 103 bp, Artificial Sequence
  Synthetic Polynucleotide
taatacgactcactataggggcgagtgcgggtgcgggtggtggtcggcataacagaggagaatgccgatgaccacccgcaacctggcggcagcgcaaaagatg

SEQ ID NO: 184431 - DNA, 103 bp, Artificial Sequence
  Synthetic Polynucleotide
taatacgactcactatagggtggtgtgggtgcgagtgcgggtgcgggtggaacagaggagaccacccatgcccgcactcaacctggcggcagcgcaaaagatg

SEQ ID NO: 184432 - DNA, 103 bp, Artificial Sequence
  Synthetic Polynucleotide
taatacgactcactataggggccctgctgcatgccgccgggcggctcggcaacagaggagagccgagatgcccggcggcaacctggcggcagcgcaaaagatg

SEQ ID NO: 184433 - DNA, 103 bp, Artificial Sequence
  Synthetic Polynucleotide
taatacgactcactatagggcggcggctgctggtgtgggtgcgagtgcggaacagaggagaccgcacatgcacccacacaacctggcggcagcgcaaaagatg

SEQ ID NO: 184434 - DNA, 103 bp, Artificial Sequence
  Synthetic Polynucleotide
taatacgactcactataggggcggcgggggcggcggctgctggtgtgggtaacagaggagaacccacatgagcagccgcaacctggcggcagcgcaaaagatg

SEQ ID NO: 184435 - DNA, 103 bp, Artificial Sequence
  Synthetic Polynucleotide
taatacgactcactatagggccctgcgggggcggcgggggcggcggctgcaacagaggagagcagccatggcccccgccaacctggcggcagcgcaaaagatg

SEQ ID NO: 184436 - DNA, 103 bp, Artificial Sequence
  Synthetic Polynucleotide
taatacgactcactataggggccaggcggaccctgcgggggcggcgggggaacagaggagacccccgatgcccccgcagaacctggcggcagcgcaaaagatg

SEQ ID NO: 184437 - DNA, 103 bp, Artificial Sequence
  Synthetic Polynucleotide
taatacgactcactatagggcgcctgggtggccaggcggaccctgcggggaacagaggagaccccgcatggtccgcctgaacctggcggcagcgcaaaagatg

SEQ ID NO: 184438 - DNA, 103 bp, Artificial Sequence
  Synthetic Polynucleotide
taatacgactcactatagggtcgtggtgcgcgcctgggtggccaggcggaaacagaggagatccgccatgccacccaggaacctggcggcagcgcaaaagatg

SEQ ID NO: 184439 - DNA, 103 bp, Artificial Sequence
  Synthetic Polynucleotide
taatacgactcactatagggcgagtgcgggtcgtggtgcgcgcctgggtgaacagaggagacacccaatggcgcaccacaacctggcggcagcgcaaaagatg

SEQ ID NO: 184440 - DNA, 103 bp, Artificial Sequence
  Synthetic Polynucleotide
taatacgactcactatagggtgtcctcgtccgagtgcgggtcgtggtgcgaacagaggagacgcaccatgacccgcactaacctggcggcagcgcaaaagatg

SEQ ID NO: 184441 - DNA, 103 bp, Artificial Sequence
  Synthetic Polynucleotide
taatacgactcactataggggaggtcggcgtgtcctcgtccgagtgcgggaacagaggagacccgcaatgggacgaggaaacctggcggcagcgcaaaagatg

SEQ ID NO: 184442 - DNA, 103 bp, Artificial Sequence
  Synthetic Polynucleotide
taatacgactcactatagggcaggtcgtccgaggtcggcgtgtcctcgtcaacagaggagagacgagatgacgccgaccaacctggcggcagcgcaaaagatg

SEQ ID NO: 184443 - DNA, 103 bp, Artificial Sequence
  Synthetic Polynucleotide
taatacgactcactatagggagccccccgcgccctgctgcatgccgccggaacagaggagaccggcgatgtgcagcaggaacctggcggcagcgcaaaagatg

SEQ ID NO: 184444 - DNA, 103 bp, Artificial Sequence
  Synthetic Polynucleotide
taatacgactcactatagggcgaactgctccaggtcgtccgaggtcggcgaacagaggagacgccgaatgcggacgaccaacctggcggcagcgcaaaagatg

SEQ ID NO: 184445 - DNA, 103 bp, Artificial Sequence
  Synthetic Polynucleotide
taatacgactcactatagggaactgcttggcgaactgctccaggtcgtccaacagaggagaggacgaatgggagcagttaacctggcggcagcgcaaaagatg

SEQ ID NO: 184446 - DNA, 103 bp, Artificial Sequence
  Synthetic Polynucleotide
taatacgactcactatagggccgctgcttgaactgcttggcgaactgctcaacagaggagagagcagatggccaagcagaacctggcggcagcgcaaaagatg

SEQ ID NO: 184447 - DNA, 103 bp, Artificial Sequence
  Synthetic Polynucleotide
taatacgactcactataggggtttgatccgccgctgcttgaactgcttggaacagaggagaccaagcatgtcaagcagcaacctggcggcagcgcaaaagatg

SEQ ID NO: 184448 - DNA, 103 bp, Artificial Sequence
  Synthetic Polynucleotide
taatacgactcactataggggtaaatcccagtttgatccgccgctgcttgaacagaggagacaagcaatggcggatcaaaacctggcggcagcgcaaaagatg

SEQ ID NO: 184449 - DNA, 103 bp, Artificial Sequence
  Synthetic Polynucleotide
taatacgactcactataggggtccgcttgggtaaatcccagtttgatccgaacagaggagacggatcatgctgggatttaacctggcggcagcgcaaaagatg

SEQ ID NO: 184450 - DNA, 103 bp, Artificial Sequence
  Synthetic Polynucleotide
taatacgactcactatagggccagccccacgtccgcttgggtaaatcccaaacagaggagatgggatatgcccaagcggaacctggcggcagcgcaaaagatg

SEQ ID NO: 184451 - DNA, 103 bp, Artificial Sequence
  Synthetic Polynucleotide
taatacgactcactataggggtgcccagagccagccccacgtccgcttggaacagaggagaccaagcatgcgtggggctaacctggcggcagcgcaaaagatg

SEQ ID NO: 184452 - DNA, 103 bp, Artificial Sequence
  Synthetic Polynucleotide
taatacgactcactataggggccatacagggtgcccagagccagccccacaacagaggagagtggggatggctctgggcaacctggcggcagcgcaaaagatg

SEQ ID NO: 184453 - DNA, 103 bp, Artificial Sequence
  Synthetic Polynucleotide
taatacgactcactatagggagaacacgttgccatacagggtgcccagagaacagaggagactctggatgccctgtatgaacctggcggcagcgcaaaagatg

SEQ ID NO: 184454 - DNA, 103 bp, Artificial Sequence
  Synthetic Polynucleotide
taatacgactcactataggggcttcgcggtagccccccgcgccctgctgcaacagaggagagcagcaatgcgcggggggaacctggcggcagcgcaaaagatg

SEQ ID NO: 184455 - DNA, 103 bp, Artificial Sequence
  Synthetic Polynucleotide
taatacgactcactataggggtggtctgcgagaacacgttgccatacaggaacagaggagacctgtaatgcaacgtgttaacctggcggcagcgcaaaagatg

SEQ ID NO: 184456 - DNA, 103 bp, Artificial Sequence
  Synthetic Polynucleotide
taatacgactcactatagggcctgcagatggtggtctgcgagaacacgttaacagaggagaaacgtgatgtcgcagaccaacctggcggcagcgcaaaagatg

SEQ ID NO: 184457 - DNA, 103 bp, Artificial Sequence
  Synthetic Polynucleotide
taatacgactcactataggggggcctcaaacctgcagatggtggtctgcgaacagaggagacgcagaatgccatctgcaaacctggcggcagcgcaaaagatg

SEQ ID NO: 184458 - DNA, 103 bp, Artificial Sequence
  Synthetic Polynucleotide
taatacgactcactatagggctcagctgcagggcctcaaacctgcagatgaacagaggagacatctgatggtttgaggcaacctggcggcagcgcaaaagatg

SEQ ID NO: 184459 - DNA, 103 bp, Artificial Sequence
  Synthetic Polynucleotide
taatacgactcactataggggttcttgaagctcagctgcagggcctcaaaaacagaggagatttgagatgctgcagctgaacctggcggcagcgcaaaagatg

SEQ ID NO: 184460 - DNA, 103 bp, Artificial Sequence
  Synthetic Polynucleotide
taatacgactcactataggggcttgcacatgttcttgaagctcagctgcaaacagaggagatgcagcatggcttcaagaaacctggcggcagcgcaaaagatg

SEQ ID NO: 184461 - DNA, 103 bp, Artificial Sequence
  Synthetic Polynucleotide
taatacgactcactatagggaaaggcttcagcttgcacatgttcttgaagaacagaggagacttcaaatgcatgtgcaaaacctggcggcagcgcaaaagatg

SEQ ID NO: 184462 - DNA, 103 bp, Artificial Sequence
  Synthetic Polynucleotide
taatacgactcactatagggcttgttcaacaaaggcttcagcttgcacataacagaggagaatgtgcatgctgaagcctaacctggcggcagcgcaaaagatg

SEQ ID NO: 184463 - DNA, 103 bp, Artificial Sequence
  Synthetic Polynucleotide
taatacgactcactatagggcctccaaccacttgttcaacaaaggcttcaaacagaggagatgaagcatgtgttgaacaaacctggcggcagcgcaaaagatg

SEQ ID NO: 184464 - DNA, 103 bp, Artificial Sequence
  Synthetic Polynucleotide
taatacgactcactataggggagtccgcctcctccaaccacttgttcaacaacagaggagagttgaaatggtggttggaaacctggcggcagcgcaaaagatg

SEQ ID NO: 184465 - DNA, 103 bp, Artificial Sequence
  Synthetic Polynucleotide
taatacgactcactataggggctgtagggattcgaggcagctgtggccataacagaggagaatggccatggctgcctcgaacctggcggcagcgcaaaagatg

SEQ ID NO: 184466 - DNA, 103 bp, Artificial Sequence
  Synthetic Polynucleotide
taatacgactcactatagggactttggagaagtttctgagggttgcggaaaacagaggagattccgcatgcctcagaaaaacctggcggcagcgcaaaagatg

SEQ ID NO: 184467 - DNA, 103 bp, Artificial Sequence
  Synthetic Polynucleotide
taatacgactcactatagggccctggcggagtcattcttttctctttttgaacagaggagacaaaaaatgaaaagaatgaacctggcggcagcgcaaaagatg

SEQ ID NO: 184468 - DNA, 103 bp, Artificial Sequence
  Synthetic Polynucleotide
taatacgactcactataggggctgctgatcccctggcggagtcattctttaacagaggagaaaagaaatgctccgccagaacctggcggcagcgcaaaagatg

SEQ ID NO: 184469 - DNA, 103 bp, Artificial Sequence
  Synthetic Polynucleotide
taatacgactcactatagggacctcatgcggctgctgatcccctggcggaaacagaggagatccgccatgggatcagcaaacctggcggcagcgcaaaagatg

SEQ ID NO: 184470 - DNA, 103 bp, Artificial Sequence
  Synthetic Polynucleotide
taatacgactcactataggggtgcgaataaacctcatgcggctgctgatcaacagaggagagatcagatgccgcatgagaacctggcggcagcgcaaaagatg

SEQ ID NO: 184471 - DNA, 103 bp, Artificial Sequence
  Synthetic Polynucleotide
taatacgactcactatagggttttcacggtgtgcgaataaacctcatgcgaacagaggagacgcatgatgtttattcgcaacctggcggcagcgcaaaagatg

SEQ ID NO: 184472 - DNA, 103 bp, Artificial Sequence
  Synthetic Polynucleotide
taatacgactcactataggggatgtgtctgttttcacggtgtgcgaataaaacagaggagattattcatgcaccgtgaaaacctggcggcagcgcaaaagatg

SEQ ID NO: 184473 - DNA, 103 bp, Artificial Sequence
  Synthetic Polynucleotide
taatacgactcactatagggatcatggcaagatgtgtctgttttcacggtaacagaggagaaccgtgatgacagacacaaacctggcggcagcgcaaaagatg

SEQ ID NO: 184474 - DNA, 103 bp, Artificial Sequence
  Synthetic Polynucleotide
taatacgactcactataggggcaagtaatcactttggagaagtttctgagaacagaggagactcagaatgttctccaaaaacctggcggcagcgcaaaagatg

SEQ ID NO: 184475 - DNA, 103 bp, Artificial Sequence
  Synthetic Polynucleotide
taatacgactcactatagggggaactccctgcaagtaatcactttggagaaacagaggagatctccaatgtgattacttaacctggcggcagcgcaaaagatg

SEQ ID NO: 184476 - DNA, 103 bp, Artificial Sequence
  Synthetic Polynucleotide
taatacgactcactatagggcccattgctgggaactccctgcaagtaatcaacagaggagagattacatgcagggagttaacctggcggcagcgcaaaagatg

SEQ ID NO: 184477 - DNA, 103 bp, Artificial Sequence
  Synthetic Polynucleotide
taatacgactcactatagggcgaggggatgcccattgctgggaactccctaacagaggagaagggagatgccagcaatgaacctggcggcagcgcaaaagatg

SEQ ID NO: 184478 - DNA, 103 bp, Artificial Sequence
  Synthetic Polynucleotide
taatacgactcactatagggcagtgatgcccgaggggatgcccattgctgaacagaggagacagcaaatggcatcccctaacctggcggcagcgcaaaagatg

SEQ ID NO: 184479 - DNA, 103 bp, Artificial Sequence
  Synthetic Polynucleotide
taatacgactcactatagggactggtcacccagtgatgcccgaggggatgaacagaggagacatcccatggggcatcacaacctggcggcagcgcaaaagatg

SEQ ID NO: 184480 - DNA, 103 bp, Artificial Sequence
  Synthetic Polynucleotide
taatacgactcactatagggcgtcgctcagactggtcacccagtgatgccaacagaggagaggcatcatggggtgaccaaacctggcggcagcgcaaaagatg

SEQ ID NO: 184481 - DNA, 103 bp, Artificial Sequence
  Synthetic Polynucleotide
taatacgactcactatagggcatgggcccccgtcgctcagactggtcaccaacagaggagaggtgacatgtctgagcgaaacctggcggcagcgcaaaagatg

SEQ ID NO: 184482 - DNA, 103 bp, Artificial Sequence
  Synthetic Polynucleotide
taatacgactcactatagggtgtggaggaccatgggcccccgtcgctcagaacagaggagactgagcatggggggcccaaacctggcggcagcgcaaaagatg

SEQ ID NO: 184483 - DNA, 103 bp, Artificial Sequence
  Synthetic Polynucleotide
taatacgactcactatagggaactgagaatgctgtagggattcgaggcagaacagaggagactgcctatgatccctacaaacctggcggcagcgcaaaagatg

SEQ ID NO: 184484 - DNA, 103 bp, Artificial Sequence
  Synthetic Polynucleotide
taatacgactcactatagggtggtggccagtgtggaggaccatgggccccaacagaggagaggggccatgggtcctccaaacctggcggcagcgcaaaagatg

SEQ ID NO: 184485 - DNA, 103 bp, Artificial Sequence
  Synthetic Polynucleotide
taatacgactcactatagggtccagggggctggtggccagtgtggaggacaacagaggagagtcctcatgactggccacaacctggcggcagcgcaaaagatg

SEQ ID NO: 184486 - DNA, 103 bp, Artificial Sequence
  Synthetic Polynucleotide
taatacgactcactataggggtcctgctggtccagggggctggtggccagaacagaggagactggccatgagccccctgaacctggcggcagcgcaaaagatg

SEQ ID NO: 184487 - DNA, 103 bp, Artificial Sequence
  Synthetic Polynucleotide
taatacgactcactatagggcgggcttcacgtcctgctggtccagggggcaacagaggagagcccccatgaccagcaggaacctggcggcagcgcaaaagatg

SEQ ID NO: 184488 - DNA, 103 bp, Artificial Sequence
  Synthetic Polynucleotide
taatacgactcactatagggtcttcgcgcccgggcttcacgtcctgctggaacagaggagaccagcaatgcgtgaagccaacctggcggcagcgcaaaagatg

SEQ ID NO: 184489 - DNA, 103 bp, Artificial Sequence
  Synthetic Polynucleotide
taatacgactcactatagggcagttgcaggtcttcgcgcccgggcttcacaacagaggagagtgaagatggggcgcgaaaacctggcggcagcgcaaaagatg

SEQ ID NO: 184490 - DNA, 103 bp, Artificial Sequence
  Synthetic Polynucleotide
taatacgactcactatagggtgatcgcacccagttgcaggtcttcgcgccaacagaggagaggcgcgatgacctgcaacaacctggcggcagcgcaaaagatg

SEQ ID NO: 184491 - DNA, 103 bp, Artificial Sequence
  Synthetic Polynucleotide
taatacgactcactatagggcggtgatggatgatcgcacccagttgcaggaacagaggagacctgcaatggggtgcgataacctggcggcagcgcaaaagatg

SEQ ID NO: 184492 - DNA, 103 bp, Artificial Sequence
  Synthetic Polynucleotide
taatacgactcactataggggtgtggcgagcggtgatggatgatcgcaccaacagaggagaggtgcgatgatccatcacaacctggcggcagcgcaaaagatg

SEQ ID NO: 184493 - DNA, 103 bp, Artificial Sequence
  Synthetic Polynucleotide
taatacgactcactatagggggtgggctacgtgtggcgagcggtgatggaaacagaggagatccatcatggctcgccacaacctggcggcagcgcaaaagatg

SEQ ID NO: 184494 - DNA, 103 bp, Artificial Sequence
  Synthetic Polynucleotide
taatacgactcactatagggagggaggtggaactgagaatgctgtagggaaacagaggagatccctaatgcattctcagaacctggcggcagcgcaaaagatg

SEQ ID NO: 184495 - DNA, 103 bp, Artificial Sequence
  Synthetic Polynucleotide
taatacgactcactatagggtgcggtgagtggtgggctacgtgtggcgagaacagaggagactcgccatgcgtagcccaaacctggcggcagcgcaaaagatg

SEQ ID NO: 184496 - DNA, 103 bp, Artificial Sequence
  Synthetic Polynucleotide
taatacgactcactataggggtggttagtgtgcggtgagtggtgggctacaacagaggagagtagccatgcactcaccgaacctggcggcagcgcaaaagatg

SEQ ID NO: 184497 - DNA, 103 bp, Artificial Sequence
  Synthetic Polynucleotide
taatacgactcactatagggaggcgttggggtggttagtgtgcggtgagtaacagaggagaactcacatgacactaaccaacctggcggcagcgcaaaagatg

SEQ ID NO: 184498 - DNA, 103 bp, Artificial Sequence
  Synthetic Polynucleotide
taatacgactcactatagggctggccccccaggcgttggggtggttagtgaacagaggagacactaaatgccccaacgcaacctggcggcagcgcaaaagatg

SEQ ID NO: 184499 - DNA, 103 bp, Artificial Sequence
  Synthetic Polynucleotide
taatacgactcactatagggcggtgccgggctggccccccaggcgttgggaacagaggagacccaacatgtggggggccaacctggcggcagcgcaaaagatg

SEQ ID NO: 184500 - DNA, 103 bp, Artificial Sequence
  Synthetic Polynucleotide
taatacgactcactatagggtagacgggttcggtgccgggctggccccccaacagaggagaggggggatggcccggcacaacctggcggcagcgcaaaagatg

SEQ ID NO: 184501 - DNA, 103 bp, Artificial Sequence
  Synthetic Polynucleotide
taatacgactcactatagggcttgacgtgatagacgggttcggtgccgggaacagaggagacccggcatggaacccgtcaacctggcggcagcgcaaaagatg

SEQ ID NO: 184502 - DNA, 103 bp, Artificial Sequence
  Synthetic Polynucleotide
taatacgactcactataggggggttggccgcttgacgtgatagacgggttaacagaggagaaacccgatgatcacgtcaaacctggcggcagcgcaaaagatg

SEQ ID NO: 184503 - DNA, 103 bp, Artificial Sequence
  Synthetic Polynucleotide
taatacgactcactatagggacacgttgaggggttggccgcttgacgtgaaacagaggagatcacgtatggcggccaacaacctggcggcagcgcaaaagatg

SEQ ID NO: 184504 - DNA, 103 bp, Artificial Sequence
  Synthetic Polynucleotide
taatacgactcactatagggggctgcgagtacacgttgaggggttggccgaacagaggagacggccaatgcctcaacgtaacctggcggcagcgcaaaagatg

SEQ ID NO: 184505 - DNA, 103 bp, Artificial Sequence
  Synthetic Polynucleotide
taatacgactcactatagggcgcatggactagggaggtggaactgagaataacagaggagaattctcatgtccacctccaacctggcggcagcgcaaaagatg

SEQ ID NO: 184506 - DNA, 103 bp, Artificial Sequence
  Synthetic Polynucleotide
taatacgactcactatagggggtgaagccaggctgcgagtacacgttgagaacagaggagactcaacatgtactcgcagaacctggcggcagcgcaaaagatg

SEQ ID NO: 184507 - DNA, 103 bp, Artificial Sequence
  Synthetic Polynucleotide
taatacgactcactatagggtgccgctcacggtgaagccaggctgcgagtaacagaggagaactcgcatgctggcttcaaacctggcggcagcgcaaaagatg

SEQ ID NO: 184508 - DNA, 103 bp, Artificial Sequence
  Synthetic Polynucleotide
taatacgactcactatagggtgttccagcatgccgctcacggtgaagccaaacagaggagatggcttatgcgtgagcggaacctggcggcagcgcaaaagatg

SEQ ID NO: 184509 - DNA, 103 bp, Artificial Sequence
  Synthetic Polynucleotide
taatacgactcactataggggagtcccccgtgttccagcatgccgctcacaacagaggagagtgagcatgatgctggaaaacctggcggcagcgcaaaagatg

SEQ ID NO: 184510 - DNA, 103 bp, Artificial Sequence
  Synthetic Polynucleotide
taatacgactcactataggggaggtggggtgagtcccccgtgttccagcaaacagaggagatgctggatgacgggggacaacctggcggcagcgcaaaagatg

SEQ ID NO: 184511 - DNA, 103 bp, Artificial Sequence
  Synthetic Polynucleotide
taatacgactcactataggggcggcagctggaggtggggtgagtcccccgaacagaggagacgggggatgcaccccaccaacctggcggcagcgcaaaagatg

SEQ ID NO: 184512 - DNA, 103 bp, Artificial Sequence
  Synthetic Polynucleotide
taatacgactcactatagggctgtgcagaggcggcagctggaggtggggtaacagaggagaaccccaatgccagctgccaacctggcggcagcgcaaaagatg

SEQ ID NO: 184513 - DNA, 103 bp, Artificial Sequence
  Synthetic Polynucleotide
taatacgactcactatagggggtgcaggctctgtgcagaggcggcagctgaacagaggagacagctgatgcctctgcacaacctggcggcagcgcaaaagatg

SEQ ID NO: 184514 - DNA, 103 bp, Artificial Sequence
  Synthetic Polynucleotide
taatacgactcactatagggcggagcaccgggtgcaggctctgtgcagagaacagaggagactctgcatggagcctgcaaacctggcggcagcgcaaaagatg

SEQ ID NO: 184515 - DNA, 103 bp, Artificial Sequence
  Synthetic Polynucleotide
taatacgactcactatagggcgggggctctcggagcaccgggtgcaggctaacagaggagaagcctgatgccggtgctcaacctggcggcagcgcaaaagatg

SEQ ID NO: 184516 - DNA, 103 bp, Artificial Sequence
  Synthetic Polynucleotide
taatacgactcactatagggccgcagagtccgcatggactagggaggtggaacagaggagaccacctatgtagtccatgaacctggcggcagcgcaaaagatg

SEQ ID NO: 184517 - DNA, 103 bp, Artificial Sequence
  Synthetic Polynucleotide
taatacgactcactatagggcgccgtgatccgggggctctcggagcaccgaacagaggagacggtgcatggagagccccaacctggcggcagcgcaaaagatg

SEQ ID NO: 184518 - DNA, 103 bp, Artificial Sequence
  Synthetic Polynucleotide
taatacgactcactataggggagcccagttcgccgtgatccgggggctctaacagaggagaagagccatgggatcacggaacctggcggcagcgcaaaagatg

SEQ ID NO: 184519 - DNA, 103 bp, Artificial Sequence
  Synthetic Polynucleotide
taatacgactcactataggggcaatggtgcgagcccagttcgccgtgatcaacagaggagagatcacatggaactgggcaacctggcggcagcgcaaaagatg

SEQ ID NO: 184520 - DNA, 103 bp, Artificial Sequence
  Synthetic Polynucleotide
taatacgactcactatagggagtgatcctggcaatggtgcgagcccagttaacagaggagaaactggatgcgcaccattaacctggcggcagcgcaaaagatg

SEQ ID NO: 184521 - DNA, 103 bp, Artificial Sequence
  Synthetic Polynucleotide
taatacgactcactatagggtcctcgtcggagtgatcctggcaatggtgcaacagaggagagcaccaatgccaggatcaaacctggcggcagcgcaaaagatg

SEQ ID NO: 184522 - DNA, 103 bp, Artificial Sequence
  Synthetic Polynucleotide
taatacgactcactatagggggttggcgtctcctcgtcggagtgatcctgaacagaggagacaggatatgtccgacgagaacctggcggcagcgcaaaagatg

SEQ ID NO: 184523 - DNA, 103 bp, Artificial Sequence
  Synthetic Polynucleotide
taatacgactcactatagggactcatcagaggttggcgtctcctcgtcggaacagaggagaccgacgatgagacgccaaaacctggcggcagcgcaaaagatg

SEQ ID NO: 184524 - DNA, 103 bp, Artificial Sequence
  Synthetic Polynucleotide
taatacgactcactatagggaactgttccaactcatcagaggttggcgtcaacagaggagagacgccatgctctgatgaaacctggcggcagcgcaaaagatg

SEQ ID NO: 184525 - DNA, 103 bp, Artificial Sequence
  Synthetic Polynucleotide
taatacgactcactatagggttgtttggcgaactgttccaactcatcagaaacagaggagatctgatatgttggaacagaacctggcggcagcgcaaaagatg

SEQ ID NO: 184526 - DNA, 103 bp, Artificial Sequence
  Synthetic Polynucleotide
taatacgactcactatagggtttgtttgaattgtttggcgaactgttccaaacagaggagatggaacatgtcgccaaacaacctggcggcagcgcaaaagatg

SEQ ID NO: 184527 - DNA, 103 bp, Artificial Sequence
  Synthetic Polynucleotide
taatacgactcactatagggtgctgcatgcccgcagagtccgcatggactaacagaggagaagtccaatgggactctgcaacctggcggcagcgcaaaagatg

SEQ ID NO: 184528 - DNA, 103 bp, Artificial Sequence
  Synthetic Polynucleotide
taatacgactcactatagggttgattcttctttgtttgaattgtttggcgaacagaggagacgccaaatgattcaaacaaacctggcggcagcgcaaaagatg

SEQ ID NO: 184529 - DNA, 103 bp, Artificial Sequence
  Synthetic Polynucleotide
taatacgactcactataggggaagcccaacttgattcttctttgtttgaaaacagaggagattcaaaatgagaagaatcaacctggcggcagcgcaaaagatg

SEQ ID NO: 184530 - DNA, 103 bp, Artificial Sequence
  Synthetic Polynucleotide
taatacgactcactatagggcggcctgcgtgaagcccaacttgattcttcaacagaggagagaagaaatgagttgggctaacctggcggcagcgcaaaagatg

SEQ ID NO: 184531 - DNA, 103 bp, Artificial Sequence
  Synthetic Polynucleotide
taatacgactcactatagggaaccccacgtcggcctgcgtgaagcccaacaacagaggagagttgggatgcacgcaggcaacctggcggcagcgcaaaagatg

SEQ ID NO: 184532 - DNA, 103 bp, Artificial Sequence
  Synthetic Polynucleotide
taatacgactcactataggggcccagcgccaaccccacgtcggcctgcgtaacagaggagaacgcagatggacgtggggaacctggcggcagcgcaaaagatg

SEQ ID NO: 184533 - DNA, 103 bp, Artificial Sequence
  Synthetic Polynucleotide
taatacgactcactatagggcatacagtgtgcccagcgccaaccccacgtaacagaggagaacgtggatgtggcgctggaacctggcggcagcgcaaaagatg

SEQ ID NO: 184534 - DNA, 103 bp, Artificial Sequence
  Synthetic Polynucleotide
taatacgactcactatagggaacacgttaccatacagtgtgcccagcgccaacagaggagaggcgctatgcacactgtaaacctggcggcagcgcaaaagatg

SEQ ID NO: 184535 - DNA, 103 bp, Artificial Sequence
  Synthetic Polynucleotide
taatacgactcactatagggggtctgcgagaacacgttaccatacagtgtaacagaggagaacactgatgggtaacgtgaacctggcggcagcgcaaaagatg

SEQ ID NO: 184536 - DNA, 103 bp, Artificial Sequence
  Synthetic Polynucleotide
taatacgactcactatagggtgcagatggtggtctgcgagaacacgttacaacagaggagagtaacgatgtctcgcagaaacctggcggcagcgcaaaagatg

SEQ ID NO: 184537 - DNA, 103 bp, Artificial Sequence
  Synthetic Polynucleotide
taatacgactcactataggggcctcgaacctgcagatggtggtctgcgagaacagaggagactcgcaatgcaccatctgaacctggcggcagcgcaaaagatg

SEQ ID NO: 184538 - DNA, 103 bp, Artificial Sequence
  Synthetic Polynucleotide
taatacgactcactatagggaggactcccctgctgcatgcccgcagagtcaacagaggagagactctatgggcatgcagaacctggcggcagcgcaaaagatg

SEQ ID NO: 184539 - DNA, 103 bp, Artificial Sequence
  Synthetic Polynucleotide
taatacgactcactatagggcagctgcaaggcctcgaacctgcagatggtaacagaggagaaccatcatgaggttcgagaacctggcggcagcgcaaaagatg

SEQ ID NO: 184540 - DNA, 103 bp, Artificial Sequence
  Synthetic Polynucleotide
taatacgactcactatagggttttgaagctcagctgcaaggcctcgaaccaacagaggagaggttcgatgccttgcagcaacctggcggcagcgcaaaagatg

SEQ ID NO: 184541 - DNA, 103 bp, Artificial Sequence
  Synthetic Polynucleotide
taatacgactcactatagggttgcacatatttttgaagctcagctgcaagaacagaggagacttgcaatggagcttcaaaacctggcggcagcgcaaaagatg

SEQ ID NO: 184542 - DNA, 103 bp, Artificial Sequence
  Synthetic Polynucleotide
taatacgactcactataggggggcttcagcttgcacatatttttgaagctaacagaggagaagcttcatgaatatgtgcaacctggcggcagcgcaaaagatg

SEQ ID NO: 184543 - DNA, 103 bp, Artificial Sequence
  Synthetic Polynucleotide
taatacgactcactatagggtgttcagcaggggcttcagcttgcacatataacagaggagaatatgtatgagctgaagcaacctggcggcagcgcaaaagatg

SEQ ID NO: 184544 - DNA, 103 bp, Artificial Sequence
  Synthetic Polynucleotide
taatacgactcactatagggtccagccacttgttcagcaggggcttcagcaacagaggagagctgaaatgcctgctgaaaacctggcggcagcgcaaaagatg

SEQ ID NO: 184545 - DNA, 103 bp, Artificial Sequence
  Synthetic Polynucleotide
taatacgactcactatagggatccgcctcctccagccacttgttcagcagaacagaggagactgctgatgaagtggctgaacctggcggcagcgcaaaagatg

SEQ ID NO: 184546 - DNA, 103 bp, Artificial Sequence
  Synthetic Polynucleotide
taatacgactcactatagggctgtggacgaatccgcctcctccagccactaacagaggagaagtggcatgaggaggcggaacctggcggcagcgcaaaagatg

SEQ ID NO: 184547 - DNA, 103 bp, Artificial Sequence
  Synthetic Polynucleotide
taatacgactcactataggggtcgggctccctgtggacgaatccgcctccaacagaggagaggaggcatgttcgtccacaacctggcggcagcgcaaaagatg

SEQ ID NO: 184548 - DNA, 103 bp, Artificial Sequence
  Synthetic Polynucleotide
taatacgactcactataggggtcaatgctggtcgggctccctgtggacgaaacagaggagatcgtccatggggagcccgaacctggcggcagcgcaaaagatg

SEQ ID NO: 184549 - DNA, 103 bp, Artificial Sequence
  Synthetic Polynucleotide
taatacgactcactatagggggttgcggaaaggactcccctgctgcatgcaacagaggagagcatgcatgaggggagtcaacctggcggcagcgcaaaagatg

SEQ ID NO: 184550 - DNA, 103 bp, Artificial Sequence
  Synthetic Polynucleotide
taatacgactcactatagggcagcgatcttgtcaatgctggtcgggctccaacagaggagaggagccatgccagcattgaacctggcggcagcgcaaaagatg

SEQ ID NO: 184551 - DNA, 103 bp, Artificial Sequence
  Synthetic Polynucleotide
taatacgactcactatagggcggccctgtgcagcgatcttgtcaatgctgaacagaggagacagcatatgcaagatcgcaacctggcggcagcgcaaaagatg

SEQ ID NO: 184552 - DNA, 103 bp, Artificial Sequence
  Synthetic Polynucleotide
taatacgactcactatagggcttgcgcttgcggccctgtgcagcgatcttaacagaggagaaagatcatggcacagggcaacctggcggcagcgcaaaagatg

SEQ ID NO: 184553 - DNA, 103 bp, Artificial Sequence
  Synthetic Polynucleotide
taatacgactcactatagggaggtccgcttcttgcgcttgcggccctgtgaacagaggagacacaggatggcaagcgcaaacctggcggcagcgcaaaagatg

SEQ ID NO: 184554 - DNA, 103 bp, Artificial Sequence
  Synthetic Polynucleotide
taatacgactcactatagggacctcgatggaggtccgcttcttgcgcttgaacagaggagacaagcgatggaagcggacaacctggcggcagcgcaaaagatg

SEQ ID NO: 184555 - DNA, 103 bp, Artificial Sequence
  Synthetic Polynucleotide
taatacgactcactatagggcttgacactcacctcgatggaggtccgcttaacagaggagaaagcggatgtccatcgagaacctggcggcagcgcaaaagatg

SEQ ID NO: 184556 - DNA, 103 bp, Artificial Sequence
  Synthetic Polynucleotide
taatacgactcactatagggccagtacgcccttgacactcacctcgatggaacagaggagaccatcgatgtgagtgtcaaacctggcggcagcgcaaaagatg

SEQ ID NO: 184557 - DNA, 103 bp, Artificial Sequence
  Synthetic Polynucleotide
taatacgactcactatagggaaatgcgtctccagtacgcccttgacactcaacagaggagagagtgtatggggcgtactaacctggcggcagcgcaaaagatg

SEQ ID NO: 184558 - DNA, 103 bp, Artificial Sequence
  Synthetic Polynucleotide
taatacgactcactatagggacacttgaggaaatgcgtctccagtacgccaacagaggagaggcgtaatggagacgcataacctggcggcagcgcaaaagatg

SEQ ID NO: 184559 - DNA, 103 bp, Artificial Sequence
  Synthetic Polynucleotide
taatacgactcactatagggcaggcttgggacacttgaggaaatgcgtctaacagaggagaagacgcatgtcctcaagtaacctggcggcagcgcaaaagatg

SEQ ID NO: 184560 - DNA, 103 bp, Artificial Sequence
  Synthetic Polynucleotide
taatacgactcactatagggagtttctgagggttgcggaaaggactccccaacagaggagaggggagatgtttccgcaaaacctggcggcagcgcaaaagatg

SEQ ID NO: 184561 - DNA, 103 bp, Artificial Sequence
  Synthetic Polynucleotide
taatacgactcactatagggtcctgcgcggcaggcttgggacacttgaggaacagaggagacctcaaatgtcccaagccaacctggcggcagcgcaaaagatg

SEQ ID NO: 184562 - DNA, 103 bp, Artificial Sequence
  Synthetic Polynucleotide
taatacgactcactatagggcgaggagatctcctgcgcggcaggcttgggaacagaggagacccaagatggccgcgcagaacctggcggcagcgcaaaagatg

SEQ ID NO: 184563 - DNA, 103 bp, Artificial Sequence
  Synthetic Polynucleotide
taatacgactcactatagggtgtctgccagcgaggagatctcctgcgcggaacagaggagaccgcgcatgagatctcctaacctggcggcagcgcaaaagatg

SEQ ID NO: 184564 - DNA, 103 bp, Artificial Sequence
  Synthetic Polynucleotide
taatacgactcactatagggaactggaggctgtctgccagcgaggagatcaacagaggagagatctcatggctggcagaaacctggcggcagcgcaaaagatg

SEQ ID NO: 184565 - DNA, 103 bp, Artificial Sequence
  Synthetic Polynucleotide
taatacgactcactatagggttccttctccaactggaggctgtctgccagaacagaggagactggcaatgagcctccagaacctggcggcagcgcaaaagatg

SEQ ID NO: 184566 - DNA, 103 bp, Artificial Sequence
  Synthetic Polynucleotide
taatacgactcactatagggcacgcaccacttccttctccaactggaggcaacagaggagagcctccatgtggagaaggaacctggcggcagcgcaaaagatg

SEQ ID NO: 184567 - DNA, 103 bp, Artificial Sequence
  Synthetic Polynucleotide
taatacgactcactatagggcagaaccagacacgcaccacttccttctccaacagaggagaggagaaatgagtggtgcgaacctggcggcagcgcaaaagatg

SEQ ID NO: 184568 - DNA, 103 bp, Artificial Sequence
  Synthetic Polynucleotide
taatacgactcactatagggtcttcgattacagaaccagacacgcaccacaacagaggagagtggtgatggtctggttcaacctggcggcagcgcaaaagatg

SEQ ID NO: 184569 - DNA, 103 bp, Artificial Sequence
  Synthetic Polynucleotide
taatacgactcactatagggtctctttttgtcttcgattacagaaccagaaacagaggagatctggtatggtaatcgaaaacctggcggcagcgcaaaagatg

SEQ ID NO: 184570 - DNA, 103 bp, Artificial Sequence
  Synthetic Polynucleotide
taatacgactcactataggggtcattcttttctctttttgtcttcgattaaacagaggagataatcgatgacaaaaagaaacctggcggcagcgcaaaagatg

SEQ ID NO: 184571 - DNA, 103 bp, Artificial Sequence
  Synthetic Polynucleotide
taatacgactcactataggggtgaggctgcttgctgttcatggacatcataacagaggagaatgatgatgatgaacagcaacctggcggcagcgcaaaagatg

SEQ ID NO: 184572 - DNA, 103 bp, Artificial Sequence
  Synthetic Polynucleotide
taatacgactcactatagggcggcgtgggcaggcaggcccgccggatggcaacagaggagagccatcatgcgggcctgcaacctggcggcagcgcaaaagatg

SEQ ID NO: 184573 - DNA, 103 bp, Artificial Sequence
  Synthetic Polynucleotide
taatacgactcactatagggctgggcgccctcggcctcctcgagccacgcaacagaggagagcgtggatggaggaggccaacctggcggcagcgcaaaagatg

SEQ ID NO: 184574 - DNA, 103 bp, Artificial Sequence
  Synthetic Polynucleotide
taatacgactcactatagggttttctcgcgctgggcgccctcggcctcctaacagaggagaaggaggatgagggcgcccaacctggcggcagcgcaaaagatg

SEQ ID NO: 184575 - DNA, 103 bp, Artificial Sequence
  Synthetic Polynucleotide
taatacgactcactatagggggcttgttcattttctcgcgctgggcgcccaacagaggagagggcgcatggcgcgagaaaacctggcggcagcgcaaaagatg

SEQ ID NO: 184576 - DNA, 103 bp, Artificial Sequence
  Synthetic Polynucleotide
taatacgactcactataggggaagagctcaggcttgttcattttctcgcgaacagaggagacgcgagatgatgaacaagaacctggcggcagcgcaaaagatg

SEQ ID NO: 184577 - DNA, 103 bp, Artificial Sequence
  Synthetic Polynucleotide
taatacgactcactatagggcgccgccgttgaagagctcaggcttgttcaaacagaggagatgaacaatgctgagctctaacctggcggcagcgcaaaagatg

SEQ ID NO: 184578 - DNA, 103 bp, Artificial Sequence
  Synthetic Polynucleotide
taatacgactcactatagggcgcttcttctcgccgccgttgaagagctcaaacagaggagatgagctatgcaacggcggaacctggcggcagcgcaaaagatg

SEQ ID NO: 184579 - DNA, 103 bp, Artificial Sequence
  Synthetic Polynucleotide
taatacgactcactatagggagtccgcttgcgcttcttctcgccgccgttaacagaggagaaacggcatggagaagaagaacctggcggcagcgcaaaagatg

SEQ ID NO: 184580 - DNA, 103 bp, Artificial Sequence
  Synthetic Polynucleotide
taatacgactcactatagggcggcgatggaagtccgcttgcgcttcttctaacagaggagaagaagaatggcaagcggaaacctggcggcagcgcaaaagatg

SEQ ID NO: 184581 - DNA, 103 bp, Artificial Sequence
  Synthetic Polynucleotide
taatacgactcactatagggttctcgggcgcggcgatggaagtccgcttgaacagaggagacaagcgatgttccatcgcaacctggcggcagcgcaaaagatg

SEQ ID NO: 184582 - DNA, 103 bp, Artificial Sequence
  Synthetic Polynucleotide
taatacgactcactataggggagggagcgcttctcgggcgcggcgatggaaacagaggagatccatcatggcgcccgagaacctggcggcagcgcaaaagatg

SEQ ID NO: 184583 - DNA, 103 bp, Artificial Sequence
  Synthetic Polynucleotide
taatacgactcactatagggtctgcagcggcggcgtgggcaggcaggcccaacagaggagagggcctatgtgcccacgcaacctggcggcagcgcaaaagatg

SEQ ID NO: 184584 - DNA, 103 bp, Artificial Sequence
  Synthetic Polynucleotide
taatacgactcactatagggagtaggcctcgagggagcgcttctcgggcgaacagaggagacgcccgatgagcgctcccaacctggcggcagcgcaaaagatg

SEQ ID NO: 184585 - DNA, 103 bp, Artificial Sequence
  Synthetic Polynucleotide
taatacgactcactatagggtgcacggcgaagtaggcctcgagggagcgcaacagaggagagcgctcatgcgaggcctaaacctggcggcagcgcaaaagatg

SEQ ID NO: 184586 - DNA, 103 bp, Artificial Sequence
  Synthetic Polynucleotide
taatacgactcactataggggggccggggctgcacggcgaagtaggcctcaacagaggagagaggccatgttcgccgtgaacctggcggcagcgcaaaagatg

SEQ ID NO: 184587 - DNA, 103 bp, Artificial Sequence
  Synthetic Polynucleotide
taatacgactcactatagggtctcggacgagggccggggctgcacggcgaaacagaggagatcgccgatgagccccggcaacctggcggcagcgcaaaagatg

SEQ ID NO: 184588 - DNA, 103 bp, Artificial Sequence
  Synthetic Polynucleotide
taatacgactcactataggggcggcgatcttctcggacgagggccggggcaacagaggagagccccgatgctcgtccgaaacctggcggcagcgcaaaagatg

SEQ ID NO: 184589 - DNA, 103 bp, Artificial Sequence
  Synthetic Polynucleotide
taatacgactcactatagggctcggcgatggcggcgatcttctcggacgaaacagaggagatcgtccatgaagatcgccaacctggcggcagcgcaaaagatg

SEQ ID NO: 184590 - DNA, 103 bp, Artificial Sequence
  Synthetic Polynucleotide
taatacgactcactatagggggtccagtttctcggcgatggcggcgatctaacagaggagaagatcgatgccatcgccgaacctggcggcagcgcaaaagatg

SEQ ID NO: 184591 - DNA, 103 bp, Artificial Sequence
  Synthetic Polynucleotide
taatacgactcactatagggttctttttgaggtccagtttctcggcgatgaacagaggagacatcgcatggaaactggaaacctggcggcagcgcaaaagatg

SEQ ID NO: 184592 - DNA, 103 bp, Artificial Sequence
  Synthetic Polynucleotide
taatacgactcactatagggccgcaccacgttctttttgaggtccagtttaacagaggagaaaactgatgctcaaaaagaacctggcggcagcgcaaaagatg

SEQ ID NO: 184593 - DNA, 103 bp, Artificial Sequence
  Synthetic Polynucleotide
taatacgactcactatagggaaaaccacacccgcaccacgttctttttgaaacagaggagatcaaaaatgacgtggtgcaacctggcggcagcgcaaaagatg

SEQ ID NO: 184594 - DNA, 103 bp, Artificial Sequence
  Synthetic Polynucleotide
taatacgactcactatagggaagaggttgctctgcagcggcggcgtgggcaacagaggagagcccacatggccgctgcaaacctggcggcagcgcaaaagatg

SEQ ID NO: 184595 - DNA, 103 bp, Artificial Sequence
  Synthetic Polynucleotide
taatacgactcactatagggctctggttgcaaaaccacacccgcaccacgaacagaggagacgtggtatgggtgtggttaacctggcggcagcgcaaaagatg

SEQ ID NO: 184596 - DNA, 103 bp, Artificial Sequence
  Synthetic Polynucleotide
taatacgactcactatagggctgcttctgtctctggttgcaaaaccacacaacagaggagagtgtggatgtgcaaccagaacctggcggcagcgcaaaagatg

SEQ ID NO: 184597 - DNA, 103 bp, Artificial Sequence
  Synthetic Polynucleotide
taatacgactcactatagggtcatccgcttctgcttctgtctctggttgcaacagaggagagcaaccatggacagaagcaacctggcggcagcgcaaaagatg

SEQ ID NO: 184598 - DNA, 103 bp, Artificial Sequence
  Synthetic Polynucleotide
taatacgactcactataggggcagagaatttcatccgcttctgcttctgtaacagaggagaacagaaatggaagcggataacctggcggcagcgcaaaagatg

SEQ ID NO: 184599 - DNA, 103 bp, Artificial Sequence
  Synthetic Polynucleotide
taatacgactcactatagggtcagtaagtggcagagaatttcatccgcttaacagaggagaaagcggatgaaattctctaacctggcggcagcgcaaaagatg

SEQ ID NO: 184600 - DNA, 103 bp, Artificial Sequence
  Synthetic Polynucleotide
taatacgactcactatagggcaggctggcgaagaggttgctctgcagcggaacagaggagaccgctgatgagcaacctcaacctggcggcagcgcaaaagatg

SEQ ID NO: 184601 - DNA, 103 bp, Artificial Sequence
  Synthetic Polynucleotide
taatacgactcactataggggcgtctcgtccaggctggcgaagaggttgcaacagaggagagcaaccatgtcgccagccaacctggcggcagcgcaaaagatg

SEQ ID NO: 184602 - DNA, 103 bp, Artificial Sequence
  Synthetic Polynucleotide
taatacgactcactatagggcgcgccagcagcgtctcgtccaggctggcgaacagaggagacgccagatgggacgagacaacctggcggcagcgcaaaagatg

SEQ ID NO: 184603 - DNA, 103 bp, Artificial Sequence
  Synthetic Polynucleotide
taatacgactcactatagggcgcctcggcccgcgccagcagcgtctcgtcaacagaggagagacgagatgctgctggcgaacctggcggcagcgcaaaagatg

SEQ ID NO: 184604 - DNA, 103 bp, Artificial Sequence
  Synthetic Polynucleotide
taatacgactcactatagggcggccgccagcgcctcggcccgcgccagcaaacagaggagatgctggatggggccgaggaacctggcggcagcgcaaaagatg

SEQ ID NO: 184605 - DNA, 103 bp, Artificial Sequence
  Synthetic Polynucleotide
taatacgactcactataggggcgatgtccacggccgccagcgcctcggccaacagaggagaggccgaatggctggcggcaacctggcggcagcgcaaaagatg

SEQ ID NO: 184606 - DNA, 103 bp, Artificial Sequence
  Synthetic Polynucleotide
taatacgactcactatagggctgggacacggcgatgtccacggccgccagaacagaggagactggcgatggtggacatcaacctggcggcagcgcaaaagatg

SEQ ID NO: 184607 - DNA, 103 bp, Artificial Sequence
  Synthetic Polynucleotide
taatacgactcactataggggcatggcaaagtgaggctgcttgctgttcaaacagaggagatgaacaatgagcagcctcaacctggcggcagcgcaaaagatg

SEQ ID NO: 184608 - DNA, 103 bp, Artificial Sequence
  Synthetic Polynucleotide
taatacgactcactatagggggctcttgccctgggacacggcgatgtccaaacagaggagatggacaatgccgtgtcccaacctggcggcagcgcaaaagatg

SEQ ID NO: 184609 - DNA, 103 bp, Artificial Sequence
  Synthetic Polynucleotide
taatacgactcactatagggttgaaaggatggctcttgccctgggacacgaacagaggagacgtgtcatggggcaagagaacctggcggcagcgcaaaagatg

SEQ ID NO: 184610 - DNA, 103 bp, Artificial Sequence
  Synthetic Polynucleotide
taatacgactcactatagggggcgtccggcttgaaaggatggctcttgccaacagaggagaggcaagatgcatcctttcaacctggcggcagcgcaaaagatg

SEQ ID NO: 184611 - DNA, 103 bp, Artificial Sequence
  Synthetic Polynucleotide
taatacgactcactatagggtgtggtacgtggcgtccggcttgaaaggataacagaggagaatccttatgagccggacgaacctggcggcagcgcaaaagatg

SEQ ID NO: 184612 - DNA, 103 bp, Artificial Sequence
  Synthetic Polynucleotide
taatacgactcactatagggctgttcatcgtgtggtacgtggcgtccggcaacagaggagagccggaatgcacgtaccaaacctggcggcagcgcaaaagatg

SEQ ID NO: 184613 - DNA, 103 bp, Artificial Sequence
  Synthetic Polynucleotide
taatacgactcactataggggcacggcacgctgttcatcgtgtggtacgtaacagaggagaacgtacatgacgatgaacaacctggcggcagcgcaaaagatg

SEQ ID NO: 184614 - DNA, 103 bp, Artificial Sequence
  Synthetic Polynucleotide
taatacgactcactatagggaagtggacgtgcacggcacgctgttcatcgaacagaggagacgatgaatggcgtgccgtaacctggcggcagcgcaaaagatg

SEQ ID NO: 184615 - DNA, 103 bp, Artificial Sequence
  Synthetic Polynucleotide
taatacgactcactatagggggcaccgtggaagtggacgtgcacggcacgaacagaggagacgtgccatgcacgtccacaacctggcggcagcgcaaaagatg

SEQ ID NO: 184616 - DNA, 103 bp, Artificial Sequence
  Synthetic Polynucleotide
taatacgactcactataggggtgcgccagaggcaccgtggaagtggacgtaacagaggagaacgtccatgtccacggtgaacctggcggcagcgcaaaagatg

SEQ ID NO: 184617 - DNA, 103 bp, Artificial Sequence
  Synthetic Polynucleotide
taatacgactcactatagggggtggtggtggtgcgccagaggcaccgtggaacagaggagaccacggatgctctggcgcaacctggcggcagcgcaaaagatg

SEQ ID NO: 184618 - DNA, 103 bp, Artificial Sequence
  Synthetic Polynucleotide
taatacgactcactatagggagggtgggatgcatggcaaagtgaggctgcaacagaggagagcagccatgctttgccataacctggcggcagcgcaaaagatg

SEQ ID NO: 184619 - DNA, 103 bp, Artificial Sequence
  Synthetic Polynucleotide
taatacgactcactatagggtggtggtggtggtggtggtggtgcgccagaaacagaggagatctggcatgccaccaccaaacctggcggcagcgcaaaagatg

SEQ ID NO: 184620 - DNA, 103 bp, Artificial Sequence
  Synthetic Polynucleotide
taatacgactcactatagggcgcctggtggtggtggtggtggtggtggtgaacagaggagacaccacatgcaccaccacaacctggcggcagcgcaaaagatg

SEQ ID NO: 184621 - DNA, 103 bp, Artificial Sequence
  Synthetic Polynucleotide
taatacgactcactatagggcgggttcgagcgcctggtggtggtggtggtaacagaggagaaccaccatgaccaccaggaacctggcggcagcgcaaaagatg

SEQ ID NO: 184622 - DNA, 103 bp, Artificial Sequence
  Synthetic Polynucleotide
taatacgactcactatagggagcagatcgccgggttcgagcgcctggtggaacagaggagaccaccaatggctcgaaccaacctggcggcagcgcaaaagatg

SEQ ID NO: 184623 - DNA, 103 bp, Artificial Sequence
  Synthetic Polynucleotide
taatacgactcactataggggatgtggtccagcagatcgccgggttcgagaacagaggagactcgaaatgggcgatctgaacctggcggcagcgcaaaagatg

SEQ ID NO: 184624 - DNA, 103 bp, Artificial Sequence
  Synthetic Polynucleotide
taatacgactcactatagggacggcgaggagatgtggtccagcagatcgcaacagaggagagcgatcatgtggaccacaaacctggcggcagcgcaaaagatg

SEQ ID NO: 184625 - DNA, 103 bp, Artificial Sequence
  Synthetic Polynucleotide
taatacgactcactatagggagcgcgagcgacggcgaggagatgtggtccaacagaggagaggaccaatgctcctcgccaacctggcggcagcgcaaaagatg

SEQ ID NO: 184626 - DNA, 103 bp, Artificial Sequence
  Synthetic Polynucleotide
taatacgactcactataggggccggccatgagcgcgagcgacggcgaggaaacagaggagatcctcgatgtcgctcgcgaacctggcggcagcgcaaaagatg

SEQ ID NO: 184627 - DNA, 103 bp, Artificial Sequence
  Synthetic Polynucleotide
taatacgactcactatagggcgccgcccgcgccggccatgagcgcgagcgaacagaggagacgctcgatgtcatggccgaacctggcggcagcgcaaaagatg

SEQ ID NO: 184628 - DNA, 103 bp, Artificial Sequence
  Synthetic Polynucleotide
taatacgactcactataggggccgcgcccgcgccgcccgcgccggccatgaacagaggagacatggcatgcgcgggcggaacctggcggcagcgcaaaagatg

SEQ ID NO: 184629 - DNA, 103 bp, Artificial Sequence
  Synthetic Polynucleotide
taatacgactcactataggggtgctcagggagggtgggatgcatggcaaaaacagaggagatttgccatgcatcccaccaacctggcggcagcgcaaaagatg

SEQ ID NO: 184630 - DNA, 103 bp, Artificial Sequence
  Synthetic Polynucleotide
taatacgactcactataggggccgccggccgccgcgcccgcgccgcccgcaacagaggagagcgggcatggcgggcgcgaacctggcggcagcgcaaaagatg

SEQ ID NO: 184631 - DNA, 103 bp, Artificial Sequence
  Synthetic Polynucleotide
taatacgactcactataggggggcgccgccgccgccggccgccgcgcccgaacagaggagacgggcgatgcggccggcgaacctggcggcagcgcaaaagatg

SEQ ID NO: 184632 - DNA, 103 bp, Artificial Sequence
  Synthetic Polynucleotide
taatacgactcactataggggggccgtcgtgggcgccgccgccgccggccaacagaggagaggccggatgcggcggcgcaacctggcggcagcgcaaaagatg

SEQ ID NO: 184633 - DNA, 103 bp, Artificial Sequence
  Synthetic Polynucleotide
taatacgactcactatagggaccgccccccgggccgtcgtgggcgccgccaacagaggagaggcggcatgcacgacggcaacctggcggcagcgcaaaagatg

SEQ ID NO: 184634 - DNA, 103 bp, Artificial Sequence
  Synthetic Polynucleotide
taatacgactcactatagggccgggccgccaccgccccccgggccgtcgtaacagaggagaacgacgatgcggggggcgaacctggcggcagcgcaaaagatg

SEQ ID NO: 184635 - DNA, 103 bp, Artificial Sequence
  Synthetic Polynucleotide
taatacgactcactatagggccgccgccgcccgggccgccaccgccccccaacagaggagaggggggatgtggcggcccaacctggcggcagcgcaaaagatg

SEQ ID NO: 184636 - DNA, 103 bp, Artificial Sequence
  Synthetic Polynucleotide
taatacgactcactataggggcccgggccgccgccgccgcccgggccgccaacagaggagaggcggcatgggcggcggcaacctggcggcagcgcaaaagatg

SEQ ID NO: 184637 - DNA, 103 bp, Artificial Sequence
  Synthetic Polynucleotide
taatacgactcactatagggcggggccgccgcccgggccgccgccgccgcaacagaggagagcggcgatggcggcccggaacctggcggcagcgcaaaagatg

SEQ ID NO: 184638 - DNA, 103 bp, Artificial Sequence
  Synthetic Polynucleotide
taatacgactcactatagggccgcctcccccggggccgccgcccgggccgaacagaggagacggcccatgcggcggcccaacctggcggcagcgcaaaagatg

SEQ ID NO: 184639 - DNA, 103 bp, Artificial Sequence
  Synthetic Polynucleotide
taatacgactcactataggggccgccaccgccgcctcccccggggccgccaacagaggagaggcggcatggggggaggcaacctggcggcagcgcaaaagatg

SEQ ID NO: 184640 - DNA, 103 bp, Artificial Sequence
  Synthetic Polynucleotide
taatacgactcactatagggacgggtacttgtgctcagggagggtgggataacagaggagaatcccaatgtccctgagcaacctggcggcagcgcaaaagatg

SEQ ID NO: 184641 - DNA, 103 bp, Artificial Sequence
  Synthetic Polynucleotide
taatacgactcactatagggcgccccccgggccgccaccgccgcctccccaacagaggagaggggagatggcggtggcgaacctggcggcagcgcaaaagatg

SEQ ID NO: 184642 - DNA, 103 bp, Artificial Sequence
  Synthetic Polynucleotide
taatacgactcactatagggccgccgccgccgccccccgggccgccaccgaacagaggagacggtggatgcccggggggaacctggcggcagcgcaaaagatg

SEQ ID NO: 184643 - DNA, 103 bp, Artificial Sequence
  Synthetic Polynucleotide
taatacgactcactataggggccgcccgggccgccgccgccgccccccggaacagaggagaccggggatgggcggcggcaacctggcggcagcgcaaaagatg

SEQ ID NO: 184644 - DNA, 103 bp, Artificial Sequence
  Synthetic Polynucleotide
taatacgactcactatagggccaggagcccgccgcccgggccgccgccgcaacagaggagagcggcgatggcccgggcgaacctggcggcagcgcaaaagatg

SEQ ID NO: 184645 - DNA, 103 bp, Artificial Sequence
  Synthetic Polynucleotide
taatacgactcactataggggcggagccgcccaggagcccgccgcccgggaacagaggagacccgggatgcgggctcctaacctggcggcagcgcaaaagatg

SEQ ID NO: 184646 - DNA, 103 bp, Artificial Sequence
  Synthetic Polynucleotide
taatacgactcactataggggtgagggtgcgcggagccgcccaggagcccaacagaggagagggctcatgggcggctccaacctggcggcagcgcaaaagatg

SEQ ID NO: 184647 - DNA, 103 bp, Artificial Sequence
  Synthetic Polynucleotide
taatacgactcactataggggcatatgcgggtgagggtgcgcggagccgcaacagaggagagcggctatgcgcaccctcaacctggcggcagcgcaaaagatg

SEQ ID NO: 184648 - DNA, 103 bp, Artificial Sequence
  Synthetic Polynucleotide
taatacgactcactatagggcccaggctgtgcatatgcgggtgagggtgcaacagaggagagcacccatgcccgcatataacctggcggcagcgcaaaagatg

SEQ ID NO: 184649 - DNA, 103 bp, Artificial Sequence
  Synthetic Polynucleotide
taatacgactcactatagggcgacaggtggcccaggctgtgcatatgcggaacagaggagaccgcatatgcacagcctgaacctggcggcagcgcaaaagatg

SEQ ID NO: 184650 - DNA, 103 bp, Artificial Sequence
  Synthetic Polynucleotide
taatacgactcactatagggccgcggggtgcgacaggtggcccaggctgtaacagaggagaacagccatggccacctgtaacctggcggcagcgcaaaagatg

SEQ ID NO: 184651 - DNA, 103 bp, Artificial Sequence
  Synthetic Polynucleotide
taatacgactcactataggggagtgcagcgacgggtacttgtgctcagggaacagaggagaccctgaatgcaagtacccaacctggcggcagcgcaaaagatg

SEQ ID NO: 184652 - DNA, 103 bp, Artificial Sequence
  Synthetic Polynucleotide
taatacgactcactataggggcggccgccgccgcggggtgcgacaggtggaacagaggagaccacctatggcaccccgcaacctggcggcagcgcaaaagatg

SEQ ID NO: 184653 - DNA, 103 bp, Artificial Sequence
  Synthetic Polynucleotide
taatacgactcactatagggcatgttcatggcggccgccgccgcggggtgaacagaggagacaccccatggcggcggccaacctggcggcagcgcaaaagatg

SEQ ID NO: 184654 - DNA, 103 bp, Artificial Sequence
  Synthetic Polynucleotide
taatacgactcactataggggcccggacggcatgttcatggcggccgccgaacagaggagacggcggatgccatgaacaaacctggcggcagcgcaaaagatg

SEQ ID NO: 184655 - DNA, 103 bp, Artificial Sequence
  Synthetic Polynucleotide
taatacgactcactataggggggtgcggcagcccggacggcatgttcatgaacagaggagacatgaaatggccgtccggaacctggcggcagcgcaaaagatg

SEQ ID NO: 184656 - DNA, 103 bp, Artificial Sequence
  Synthetic Polynucleotide
taatacgactcactatagggcaccagcccggggtgcggcagcccggacggaacagaggagaccgtccatgctgccgcacaacctggcggcagcgcaaaagatg

SEQ ID NO: 184657 - DNA, 103 bp, Artificial Sequence
  Synthetic Polynucleotide
taatacgactcactatagggccgccgccgccaccagcccggggtgcggcaaacagaggagatgccgcatgccgggctggaacctggcggcagcgcaaaagatg

SEQ ID NO: 184658 - DNA, 103 bp, Artificial Sequence
  Synthetic Polynucleotide
taatacgactcactatagggccgtggtgcgccgccgccgccaccagcccgaacagaggagacgggctatgggcggcggcaacctggcggcagcgcaaaagatg

SEQ ID NO: 184659 - DNA, 103 bp, Artificial Sequence
  Synthetic Polynucleotide
taatacgactcactatagggcgctgccgcgccgtggtgcgccgccgccgcaacagaggagagcggcgatggcgcaccacaacctggcggcagcgcaaaagatg

SEQ ID NO: 184660 - DNA, 103 bp, Artificial Sequence
  Synthetic Polynucleotide
taatacgactcactatagggccgccgctgccgctgccgcgccgtggtgcgaacagaggagacgcaccatggcgcggcagaacctggcggcagcgcaaaagatg

SEQ ID NO: 184661 - DNA, 103 bp, Artificial Sequence
  Synthetic Polynucleotide
taatacgactcactataggggccgccgccgccgccgctgccgctgccgcgaacagaggagacgcggcatgggcagcggcaacctggcggcagcgcaaaagatg

SEQ ID NO: 184662 - DNA, 103 bp, Artificial Sequence
  Synthetic Polynucleotide
taatacgactcactatagggctcggagctggagtgcagcgacgggtacttaacagaggagaaagtacatgtcgctgcacaacctggcggcagcgcaaaagatg

SEQ ID NO: 184663 - DNA, 103 bp, Artificial Sequence
  Synthetic Polynucleotide
taatacgactcactatagggcacctgcccggccgccgccgccgccgctgcaacagaggagagcagcgatggcggcggcgaacctggcggcagcgcaaaagatg

SEQ ID NO: 184664 - DNA, 103 bp, Artificial Sequence
  Synthetic Polynucleotide
taatacgactcactatagggatgccgctgccacctgcccggccgccgccgaacagaggagacggcggatgccgggcaggaacctggcggcagcgcaaaagatg

SEQ ID NO: 184665 - DNA, 103 bp, Artificial Sequence
  Synthetic Polynucleotide
taatacgactcactataggggccgccgccgatgccgctgccacctgcccgaacagaggagacgggcaatgggcagcggcaacctggcggcagcgcaaaagatg

SEQ ID NO: 184666 - DNA, 103 bp, Artificial Sequence
  Synthetic Polynucleotide
taatacgactcactatagggcaccacggccgccgccgccgatgccgctgcaacagaggagagcagcgatgtcggcggcgaacctggcggcagcgcaaaagatg

SEQ ID NO: 184667 - DNA, 103 bp, Artificial Sequence
  Synthetic Polynucleotide
taatacgactcactatagggccgctgcgcccaccacggccgccgccgccgaacagaggagacggcggatgcggccgtggaacctggcggcagcgcaaaagatg

SEQ ID NO: 184668 - DNA, 103 bp, Artificial Sequence
  Synthetic Polynucleotide
taatacgactcactataggggacgccaggcccgctgcgcccaccacggccaacagaggagaggccgtatggggcgcagcaacctggcggcagcgcaaaagatg

SEQ ID NO: 184669 - DNA, 103 bp, Artificial Sequence
  Synthetic Polynucleotide
taatacgactcactataggggtcgcagatggacgccaggcccgctgcgccaacagaggagaggcgcaatgggcctggcgaacctggcggcagcgcaaaagatg

SEQ ID NO: 184670 - DNA, 103 bp, Artificial Sequence
  Synthetic Polynucleotide
taatacgactcactatagggccgtgtccgagtcgcagatggacgccaggcaacagaggagagcctggatgccatctgcgaacctggcggcagcgcaaaagatg

SEQ ID NO: 184671 - DNA, 103 bp, Artificial Sequence
  Synthetic Polynucleotide
taatacgactcactatagggtcgcgcgggtccgtgtccgagtcgcagatgaacagaggagacatctgatgctcggacacaacctggcggcagcgcaaaagatg

SEQ ID NO: 184672 - DNA, 103 bp, Artificial Sequence
  Synthetic Polynucleotide
taatacgactcactatagggcgcctcgagctcgcgcgggtccgtgtccgaaacagaggagatcggacatggacccgcgcaacctggcggcagcgcaaaagatg

SEQ ID NO: 184673 - DNA, 103 bp, Artificial Sequence
  Synthetic Polynucleotide
taatacgactcactataggggccggatggcctcggagctggagtgcagcgaacagaggagacgctgcatgccagctccgaacctggcggcagcgcaaaagatg

SEQ ID NO: 184674 - DNA, 103 bp, Artificial Sequence
  Synthetic Polynucleotide
taatacgactcactataggggctccgcgaacgcctcgagctcgcgcgggtaacagaggagaacccgcatgagctcgaggaacctggcggcagcgcaaaagatg

SEQ ID NO: 184675 - DNA, 103 bp, Artificial Sequence
  Synthetic Polynucleotide
taatacgactcactatagggtgcttgaagcgctccgcgaacgcctcgagcaacagaggagagctcgaatggttcgcggaaacctggcggcagcgcaaaagatg

SEQ ID NO: 184676 - DNA, 103 bp, Artificial Sequence
  Synthetic Polynucleotide
taatacgactcactataggggatgcgccgctgcttgaagcgctccgcgaaaacagaggagattcgcgatgcgcttcaagaacctggcggcagcgcaaaagatg

SEQ ID NO: 184677 - DNA, 103 bp, Artificial Sequence
  Synthetic Polynucleotide
taatacgactcactatagggcgcccagcttgatgcgccgctgcttgaagcaacagaggagagcttcaatgagcggcgcaaacctggcggcagcgcaaaagatg

SEQ ID NO: 184678 - DNA, 103 bp, Artificial Sequence
  Synthetic Polynucleotide
taatacgactcactataggggcctgcgtcacgcccagcttgatgcgccgcaacagaggagagcggcgatgcaagctgggaacctggcggcagcgcaaaagatg

SEQ ID NO: 184679 - DNA, 103 bp, Artificial Sequence
  Synthetic Polynucleotide
taatacgactcactataggggcccacgtcggcctgcgtcacgcccagcttaacagaggagaaagctgatggtgacgcagaacctggcggcagcgcaaaagatg

SEQ ID NO: 184680 - DNA, 103 bp, Artificial Sequence
  Synthetic Polynucleotide
taatacgactcactatagggccagcgccgagcccacgtcggcctgcgtcaaacagaggagatgacgcatgccgacgtggaacctggcggcagcgcaaaagatg

SEQ ID NO: 184681 - DNA, 103 bp, Artificial Sequence
  Synthetic Polynucleotide
taatacgactcactatagggttgaggttggccagcgccgagcccacgtcgaacagaggagacgacgtatgctcggcgctaacctggcggcagcgcaaaagatg

SEQ ID NO: 184682 - DNA, 103 bp, Artificial Sequence
  Synthetic Polynucleotide
taatacgactcactataggggcccgggatcttgaggttggccagcgccgaaacagaggagatcggcgatggccaacctcaacctggcggcagcgcaaaagatg

SEQ ID NO: 184683 - DNA, 103 bp, Artificial Sequence
  Synthetic Polynucleotide
taatacgactcactataggggtgagcccacgcccgggatcttgaggttggaacagaggagaccaaccatgagatcccggaacctggcggcagcgcaaaagatg

SEQ ID NO: 184684 - DNA, 103 bp, Artificial Sequence
  Synthetic Polynucleotide
taatacgactcactatagggaggcaggcccgccggatggcctcggagctgaacagaggagacagctcatgggccatccgaacctggcggcagcgcaaaagatg

SEQ ID NO: 184685 - DNA, 103 bp, Artificial Sequence
  Synthetic Polynucleotide
taatacgactcactatagggctctggctgagtgagcccacgcccgggatcaacagaggagagatcccatgcgtgggctcaacctggcggcagcgcaaaagatg

SEQ ID NO: 184686 - DNA, 103 bp, Artificial Sequence
  Synthetic Polynucleotide
taatacgactcactataggggcagatggtgctctggctgagtgagcccacaacagaggagagtgggcatgctcagccagaacctggcggcagcgcaaaagatg

SEQ ID NO: 184687 - DNA, 103 bp, Artificial Sequence
  Synthetic Polynucleotide
taatacgactcactatagggactcgaacctgcagatggtgctctggctgaaacagaggagatcagccatggcaccatctaacctggcggcagcgcaaaagatg

SEQ ID NO: 184688 - DNA, 103 bp, Artificial Sequence
  Synthetic Polynucleotide
taatacgactcactatagggagcgtgagcgactcgaacctgcagatggtgaacagaggagacaccatatgcaggttcgaaacctggcggcagcgcaaaagatg

SEQ ID NO: 184689 - DNA, 103 bp, Artificial Sequence
  Synthetic Polynucleotide
taatacgactcactataggggttgtgcgagagcgtgagcgactcgaacctaacagaggagaaggttcatgtcgctcacgaacctggcggcagcgcaaaagatg

SEQ ID NO: 184690 - DNA, 103 bp, Artificial Sequence
  Synthetic Polynucleotide
taatacgactcactatagggcgatcatgttgttgtgcgagagcgtgagcgaacagaggagacgctcaatgtctcgcacaaacctggcggcagcgcaaaagatg

SEQ ID NO: 184691 - DNA, 103 bp, Artificial Sequence
  Synthetic Polynucleotide
taatacgactcactatagggggcttgagcgcgatcatgttgttgtgcgagaacagaggagactcgcaatgcaacatgataacctggcggcagcgcaaaagatg

SEQ ID NO: 184692 - DNA, 103 bp, Artificial Sequence
  Synthetic Polynucleotide
taatacgactcactatagggctgcaggatgggcttgagcgcgatcatgttaacagaggagaaacatgatggcgctcaagaacctggcggcagcgcaaaagatg

SEQ ID NO: 184693 - DNA, 103 bp, Artificial Sequence
  Synthetic Polynucleotide
taatacgactcactatagggcgagccacgcctgcaggatgggcttgagcgaacagaggagacgctcaatgccatcctgcaacctggcggcagcgcaaaagatg

SEQ ID NO: 184694 - DNA, 103 bp, Artificial Sequence
  Synthetic Polynucleotide
taatacgactcactatagggtcggcctcctcgagccacgcctgcaggatgaacagaggagacatcctatgggcgtggctaacctggcggcagcgcaaaagatg

SEQ ID NO: 184695 - DNA, 103 bp, Artificial Sequence
  Synthetic Polynucleotide
taatacgactcactatagggctgcttgctgttcagggacatcatcatcataacagaggagaatgatgatgatgtccctgaacctggcggcagcgcaaaagatg

SEQ ID NO: 184696 - DNA, 103 bp, Artificial Sequence
  Synthetic Polynucleotide
taatacgactcactataggggatgggagccgaggagcccggcgaggtgctaacagaggagaagcaccatgccgggctccaacctggcggcagcgcaaaagatg

SEQ ID NO: 184697 - DNA, 103 bp, Artificial Sequence
  Synthetic Polynucleotide
taatacgactcactataggggaagagttcaggcttggtgagcttctcgcgaacagaggagacgcgagatgctcaccaagaacctggcggcagcgcaaaagatg

SEQ ID NO: 184698 - DNA, 103 bp, Artificial Sequence
  Synthetic Polynucleotide
taatacgactcactatagggccgcgccattgaagagttcaggcttggtgaaacagaggagatcaccaatgctgaactctaacctggcggcagcgcaaaagatg

SEQ ID NO: 184699 - DNA, 103 bp, Artificial Sequence
  Synthetic Polynucleotide
taatacgactcactatagggcgcttcttctccgcgccattgaagagttcaaacagaggagatgaactatgcaatggcgcaacctggcggcagcgcaaaagatg

SEQ ID NO: 184700 - DNA, 103 bp, Artificial Sequence
  Synthetic Polynucleotide
taatacgactcactatagggcgtgcgcttgcgcttcttctccgcgccattaacagaggagaaatggcatggagaagaagaacctggcggcagcgcaaaagatg

SEQ ID NO: 184701 - DNA, 103 bp, Artificial Sequence
  Synthetic Polynucleotide
taatacgactcactatagggcagcgatggacgtgcgcttgcgcttcttctaacagaggagaagaagaatggcaagcgcaaacctggcggcagcgcaaaagatg

SEQ ID NO: 184702 - DNA, 103 bp, Artificial Sequence
  Synthetic Polynucleotide
taatacgactcactatagggttctctggcgcagcgatggacgtgcgcttgaacagaggagacaagcgatggtccatcgcaacctggcggcagcgcaaaagatg

SEQ ID NO: 184703 - DNA, 103 bp, Artificial Sequence
  Synthetic Polynucleotide
taatacgactcactataggggagcgagcgcttctctggcgcagcgatggaaacagaggagatccatcatggcgccagagaacctggcggcagcgcaaaagatg

SEQ ID NO: 184704 - DNA, 103 bp, Artificial Sequence
  Synthetic Polynucleotide
taatacgactcactatagggagtaggcttcgagcgagcgcttctctggcgaacagaggagacgccagatgagcgctcgcaacctggcggcagcgcaaaagatg

SEQ ID NO: 184705 - DNA, 103 bp, Artificial Sequence
  Synthetic Polynucleotide
taatacgactcactatagggtgaatggcaaagtaggcttcgagcgagcgcaacagaggagagcgctcatgcgaagcctaaacctggcggcagcgcaaaagatg

SEQ ID NO: 184706 - DNA, 103 bp, Artificial Sequence
  Synthetic Polynucleotide
taatacgactcactataggggggccgaggctgaatggcaaagtaggcttcaacagaggagagaagccatgtttgccattaacctggcggcagcgcaaaagatg

SEQ ID NO: 184707 - DNA, 103 bp, Artificial Sequence
  Synthetic Polynucleotide
taatacgactcactatagggccgagggcgcgatgggagccgaggagcccgaacagaggagacgggctatgcggctcccaaacctggcggcagcgcaaaagatg

SEQ ID NO: 184708 - DNA, 103 bp, Artificial Sequence
  Synthetic Polynucleotide
taatacgactcactatagggtttcagaggagggccgaggctgaatggcaaaacagaggagattgccaatgagcctcggcaacctggcggcagcgcaaaagatg

SEQ ID NO: 184709 - DNA, 103 bp, Artificial Sequence
  Synthetic Polynucleotide
taatacgactcactataggggcggcgatcttttcagaggagggccgaggcaacagaggagagcctcgatgctcctctgaaacctggcggcagcgcaaaagatg

SEQ ID NO: 184710 - DNA, 103 bp, Artificial Sequence
  Synthetic Polynucleotide
taatacgactcactatagggctccgcgatggcggcgatcttttcagaggaaacagaggagatcctctatgaagatcgccaacctggcggcagcgcaaaagatg

SEQ ID NO: 184711 - DNA, 103 bp, Artificial Sequence
  Synthetic Polynucleotide
taatacgactcactatagggggtccagcttctccgcgatggcggcgatctaacagaggagaagatcgatgccatcgcggaacctggcggcagcgcaaaagatg

SEQ ID NO: 184712 - DNA, 103 bp, Artificial Sequence
  Synthetic Polynucleotide
taatacgactcactatagggtttttcttcaggtccagcttctccgcgatgaacagaggagacatcgcatggaagctggaaacctggcggcagcgcaaaagatg

SEQ ID NO: 184713 - DNA, 103 bp, Artificial Sequence
  Synthetic Polynucleotide
taatacgactcactataggggcgcaccacgtttttcttcaggtccagcttaacagaggagaaagctgatgctgaagaaaaacctggcggcagcgcaaaagatg

SEQ ID NO: 184714 - DNA, 103 bp, Artificial Sequence
  Synthetic Polynucleotide
taatacgactcactatagggagaaccagacgcgcaccacgtttttcttcaaacagaggagatgaagaatgacgtggtgcaacctggcggcagcgcaaaagatg

SEQ ID NO: 184715 - DNA, 103 bp, Artificial Sequence
  Synthetic Polynucleotide
taatacgactcactatagggctctggttgcagaaccagacgcgcaccacgaacagaggagacgtggtatgcgtctggttaacctggcggcagcgcaaaagatg

SEQ ID NO: 184716 - DNA, 103 bp, Artificial Sequence
  Synthetic Polynucleotide
taatacgactcactatagggctgtttctgcctctggttgcagaaccagacaacagaggagagtctggatgtgcaaccagaacctggcggcagcgcaaaagatg

SEQ ID NO: 184717 - DNA, 103 bp, Artificial Sequence
  Synthetic Polynucleotide
taatacgactcactatagggtcattcttttctgtttctgcctctggttgcaacagaggagagcaaccatgggcagaaacaacctggcggcagcgcaaaagatg

SEQ ID NO: 184718 - DNA, 103 bp, Artificial Sequence
  Synthetic Polynucleotide
taatacgactcactatagggggggagctggccgagggcgcgatgggagccaacagaggagaggctccatgcgcgccctcaacctggcggcagcgcaaaagatg

SEQ ID NO: 184719 - DNA, 103 bp, Artificial Sequence
  Synthetic Polynucleotide
taatacgactcactataggggcggaatatttcattcttttctgtttctgcaacagaggagagcagaaatggaaaagaataacctggcggcagcgcaaaagatg

SEQ ID NO: 184720 - DNA, 103 bp, Artificial Sequence
  Synthetic Polynucleotide
taatacgactcactatagggctaaatgccggcggaatatttcattcttttaacagaggagaaaaagaatgaaatattccaacctggcggcagcgcaaaagatg

SEQ ID NO: 184721 - DNA, 103 bp, Artificial Sequence
  Synthetic Polynucleotide
taatacgactcactatagggcgagctgctgggggagctggccgagggcgcaacagaggagagcgcccatggccagctccaacctggcggcagcgcaaaagatg

SEQ ID NO: 184722 - DNA, 103 bp, Artificial Sequence
  Synthetic Polynucleotide
taatacgactcactatagggcagcgttgctcgagctgctgggggagctggaacagaggagaccagctatgccagcagctaacctggcggcagcgcaaaagatg

SEQ ID NO: 184723 - DNA, 103 bp, Artificial Sequence
  Synthetic Polynucleotide
taatacgactcactatagggccgccaccaccagcgttgctcgagctgctgaacagaggagacagcagatggagcaacgcaacctggcggcagcgcaaaagatg

SEQ ID NO: 184724 - DNA, 103 bp, Artificial Sequence
  Synthetic Polynucleotide
taatacgactcactataggggccgccgccgccgccaccaccagcgttgctaacagaggagaagcaacatgggtggtggcaacctggcggcagcgcaaaagatg

SEQ ID NO: 184725 - DNA, 103 bp, Artificial Sequence
  Synthetic Polynucleotide
taatacgactcactatagggcgccgccgccgccgccgccgccgccaccacaacagaggagagtggtgatggcggcggcgaacctggcggcagcgcaaaagatg

SEQ ID NO: 184726 - DNA, 103 bp, Artificial Sequence; identical to SEQ ID NO: 88507
  Synthetic Polynucleotide

SEQ ID NO: 184727 - DNA, 103 bp, Artificial Sequence
  Synthetic Polynucleotide
taatacgactcactataggggcttcggcctccgccgccgccgccgccgccaacagaggagaggcggcatgggcggcggcaacctggcggcagcgcaaaagatg

SEQ ID NO: 184728 - DNA, 103 bp, Artificial Sequence
  Synthetic Polynucleotide
taatacgactcactatagggtgctaaacgcctgcttgctgttcagggacaaacagaggagatgtcccatgacagcaagcaacctggcggcagcgcaaaagatg

SEQ ID NO: 184729 - DNA, 103 bp, Artificial Sequence
  Synthetic Polynucleotide
taatacgactcactatagggtggagctgctgcttcggcctccgccgccgcaacagaggagagcggcgatggaggccgaaaacctggcggcagcgcaaaagatg

SEQ ID NO: 184730 - DNA, 103 bp, Artificial Sequence
  Synthetic Polynucleotide
taatacgactcactatagggccactgctgctggagctgctgcttcggcctaacagaggagaaggccgatgcagcagctcaacctggcggcagcgcaaaagatg

SEQ ID NO: 184731 - DNA, 103 bp, Artificial Sequence
  Synthetic Polynucleotide
taatacgactcactataggggccgctgctgccactgctgctggagctgctaacagaggagaagcagcatgagcagcagtaacctggcggcagcgcaaaagatg

SEQ ID NO: 184732 - DNA, 103 bp, Artificial Sequence
  Synthetic Polynucleotide
taatacgactcactatagggagcccccgccgccgctgctgccactgctgcaacagaggagagcagcaatggcagcagcgaacctggcggcagcgcaaaagatg

SEQ ID NO: 184733 - DNA, 103 bp, Artificial Sequence
  Synthetic Polynucleotide
taatacgactcactatagggatagcctccgagcccccgccgccgctgctgaacagaggagacagcagatgcggcgggggaacctggcggcagcgcaaaagatg

SEQ ID NO: 184734 - DNA, 103 bp, Artificial Sequence
  Synthetic Polynucleotide
taatacgactcactatagggggctctccgcatagcctccgagcccccgccaacagaggagaggcgggatgtcggaggctaacctggcggcagcgcaaaagatg

SEQ ID NO: 184735 - DNA, 103 bp, Artificial Sequence
  Synthetic Polynucleotide
taatacgactcactatagggttggaagacaggctctccgcatagcctccgaacagaggagacggaggatgtgcggagagaacctggcggcagcgcaaaagatg

SEQ ID NO: 184736 - DNA, 103 bp, Artificial Sequence
  Synthetic Polynucleotide
taatacgactcactatagggctcggtggggttggaagacaggctctccgcaacagaggagagcggagatgctgtcttccaacctggcggcagcgcaaaagatg

SEQ ID NO: 184737 - DNA, 103 bp, Artificial Sequence
  Synthetic Polynucleotide
taatacgactcactataggggaatatattgctcggtggggttggaagacaaacagaggagatgtcttatgaccccaccgaacctggcggcagcgcaaaagatg

SEQ ID NO: 184738 - DNA, 103 bp, Artificial Sequence
  Synthetic Polynucleotide
taatacgactcactatagggccagcccgccgaatatattgctcggtggggaacagaggagaccccacatggcaatatataacctggcggcagcgcaaaagatg

SEQ ID NO: 184739 - DNA, 103 bp, Artificial Sequence
  Synthetic Polynucleotide
taatacgactcactatagggccgtgcggcatgctaaacgcctgcttgctgaacagaggagacagcaaatgggcgtttagaacctggcggcagcgcaaaagatg

SEQ ID NO: 184740 - DNA, 103 bp, Artificial Sequence
  Synthetic Polynucleotide
taatacgactcactatagggagactctcatccagcccgccgaatatattgaacagaggagacaatatatgcggcgggctaacctggcggcagcgcaaaagatg

SEQ ID NO: 184741 - DNA, 103 bp, Artificial Sequence
  Synthetic Polynucleotide
taatacgactcactataggggcgggccagcagactctcatccagcccgccaacagaggagaggcgggatggatgagagtaacctggcggcagcgcaaaagatg

SEQ ID NO: 184742 - DNA, 103 bp, Artificial Sequence
  Synthetic Polynucleotide
taatacgactcactataggggagcctcggcgcgggccagcagactctcataacagaggagaatgagaatgtgctggcccaacctggcggcagcgcaaaagatg

SEQ ID NO: 184743 - DNA, 103 bp, Artificial Sequence
  Synthetic Polynucleotide
taatacgactcactatagggacggctgccagagcctcggcgcgggccagcaacagaggagagctggcatgcgccgaggcaacctggcggcagcgcaaaagatg

SEQ ID NO: 184744 - DNA, 103 bp, Artificial Sequence
  Synthetic Polynucleotide
taatacgactcactataggggacgatgtccacggctgccagagcctcggcaacagaggagagccgagatgctggcagccaacctggcggcagcgcaaaagatg

SEQ ID NO: 184745 - DNA, 103 bp, Artificial Sequence
  Synthetic Polynucleotide
taatacgactcactatagggtgctctgggagacgatgtccacggctgccaaacagaggagatggcagatgtggacatcgaacctggcggcagcgcaaaagatg

SEQ ID NO: 184746 - DNA, 103 bp, Artificial Sequence
  Synthetic Polynucleotide
taatacgactcactatagggtggtggctcttgctctgggagacgatgtccaacagaggagaggacatatgctcccagagaacctggcggcagcgcaaaagatg

SEQ ID NO: 184747 - DNA, 103 bp, Artificial Sequence
  Synthetic Polynucleotide
taatacgactcactatagggtggatggtggtggtggctcttgctctgggaaacagaggagatcccagatgaagagccacaacctggcggcagcgcaaaagatg

SEQ ID NO: 184748 - DNA, 103 bp, Artificial Sequence
  Synthetic Polynucleotide
taatacgactcactatagggtgtggtggggtggatggtggtggtggctctaacagaggagaagagccatgaccaccatcaacctggcggcagcgcaaaagatg

SEQ ID NO: 184749 - DNA, 103 bp, Artificial Sequence
  Synthetic Polynucleotide
taatacgactcactatagggttgaaggggctgtggtggggtggatggtggaacagaggagaccaccaatgaccccaccaaacctggcggcagcgcaaaagatg

SEQ ID NO: 184750 - DNA, 103 bp, Artificial Sequence
  Synthetic Polynucleotide
taatacgactcactatagggcaggctgccgccgtgcggcatgctaaacgcaacagaggagagcgtttatgatgccgcacaacctggcggcagcgcaaaagatg

SEQ ID NO: 184751 - DNA, 103 bp, Artificial Sequence
  Synthetic Polynucleotide
taatacgactcactatagggggcgtccggtttgaaggggctgtggtggggaacagaggagaccccacatgagccccttcaacctggcggcagcgcaaaagatg

SEQ ID NO: 184752 - DNA, 103 bp, Artificial Sequence
  Synthetic Polynucleotide
taatacgactcactatagggtgtggtaggtggcgtccggtttgaaggggcaacagaggagagcccctatgaaccggacgaacctggcggcagcgcaaaagatg

SEQ ID NO: 184753 - DNA, 103 bp, Artificial Sequence
  Synthetic Polynucleotide
taatacgactcactataggggtattcatagtgtggtaggtggcgtccggtaacagaggagaaccggaatgcacctaccaaacctggcggcagcgcaaaagatg

SEQ ID NO: 184754 - DNA, 103 bp, Artificial Sequence
  Synthetic Polynucleotide
taatacgactcactataggggcacgggatggtattcatagtgtggtaggtaacagaggagaacctacatgactatgaataacctggcggcagcgcaaaagatg

SEQ ID NO: 184755 - DNA, 103 bp, Artificial Sequence
  Synthetic Polynucleotide
taatacgactcactatagggcggccgacgtgcacgggatggtattcatagaacagaggagactatgaatgccatcccgtaacctggcggcagcgcaaaagatg

SEQ ID NO: 184756 - DNA, 103 bp, Artificial Sequence
  Synthetic Polynucleotide
taatacgactcactataggggaagaagaggcggccgacgtgcacgggatgaacagaggagacatcccatgcacgtcggcaacctggcggcagcgcaaaagatg

SEQ ID NO: 184757 - DNA, 103 bp, Artificial Sequence
  Synthetic Polynucleotide
taatacgactcactataggggggcaccgatgaagaagaggcggccgacgtaacagaggagaacgtcgatggcctcttctaacctggcggcagcgcaaaagatg

SEQ ID NO: 184758 - DNA, 103 bp, Artificial Sequence
  Synthetic Polynucleotide
taatacgactcactatagggggtgcgagatgggcaccgatgaagaagaggaacagaggagacctcttatgcatcggtgcaacctggcggcagcgcaaaagatg

SEQ ID NO: 184759 - DNA, 103 bp, Artificial Sequence
  Synthetic Polynucleotide
taatacgactcactatagggaacgcggaagggtgcgagatgggcaccgataacagaggagaatcggtatgcatctcgcaaacctggcggcagcgcaaaagatg

SEQ ID NO: 184760 - DNA, 103 bp, Artificial Sequence
  Synthetic Polynucleotide
taatacgactcactatagggcgtgcccgccaacgcggaagggtgcgagataacagaggagaatctcgatgccttccgcgaacctggcggcagcgcaaaagatg

SEQ ID NO: 184761 - DNA, 103 bp, Artificial Sequence
  Synthetic Polynucleotide
taatacgactcactataggggctccacgtgcaggctgccgccgtgcggcaaacagaggagatgccgcatggcggcagccaacctggcggcagcgcaaaagatg

SEQ ID NO: 184762 - DNA, 103 bp, Artificial Sequence
  Synthetic Polynucleotide
taatacgactcactatagggggtggtggtgcgtgcccgccaacgcggaagaacagaggagacttccgatgtggcgggcaaacctggcggcagcgcaaaagatg

SEQ ID NO: 184763 - DNA, 103 bp, Artificial Sequence
  Synthetic Polynucleotide
taatacgactcactatagggtgatggtggtggtggtggtgcgtgcccgccaacagaggagaggcgggatggcaccaccaaacctggcggcagcgcaaaagatg

SEQ ID NO: 184764 - DNA, 103 bp, Artificial Sequence
  Synthetic Polynucleotide
taatacgactcactataggggtggtggtggtgatggtggtggtggtggtgaacagaggagacaccacatgcaccaccataacctggcggcagcgcaaaagatg

SEQ ID NO: 184765 - DNA, 103 bp, Artificial Sequence
  Synthetic Polynucleotide
taatacgactcactataggggttggtggtggtggtggtggtgatggtggtaacagaggagaaccaccatgaccaccaccaacctggcggcagcgcaaaagatg

SEQ ID NO: 184766 - DNA, 103 bp, Artificial Sequence
  Synthetic Polynucleotide
taatacgactcactataggggcctggtgcggttggtggtggtggtggtggaacagaggagaccaccaatgccaccaccaaacctggcggcagcgcaaaagatg

SEQ ID NO: 184767 - DNA, 103 bp, Artificial Sequence
  Synthetic Polynucleotide
taatacgactcactataggggccctccagcgcctggtgcggttggtggtgaacagaggagacaccacatgccgcaccagaacctggcggcagcgcaaaagatg

SEQ ID NO: 184768 - DNA, 103 bp, Artificial Sequence
  Synthetic Polynucleotide
taatacgactcactatagggccagcagctcgccctccagcgcctggtgcgaacagaggagacgcaccatgcgctggaggaacctggcggcagcgcaaaagatg

SEQ ID NO: 184769 - DNA, 103 bp, Artificial Sequence
  Synthetic Polynucleotide
taatacgactcactatagggctcaggtgctccagcagctcgccctccagcaacagaggagagctggaatgcgagctgctaacctggcggcagcgcaaaagatg

SEQ ID NO: 184770 - DNA, 103 bp, Artificial Sequence
  Synthetic Polynucleotide
taatacgactcactatagggcagcccgggactcaggtgctccagcagctcaacagaggagagagctgatggagcacctgaacctggcggcagcgcaaaagatg

SEQ ID NO: 184771 - DNA, 103 bp, Artificial Sequence
  Synthetic Polynucleotide
taatacgactcactatagggcgcccagggccagcccgggactcaggtgctaacagaggagaagcaccatggtcccgggcaacctggcggcagcgcaaaagatg

SEQ ID NO: 184772 - DNA, 103 bp, Artificial Sequence
  Synthetic Polynucleotide
taatacgactcactataggggagtacttgggctccacgtgcaggctgccgaacagaggagacggcagatggcacgtggaaacctggcggcagcgcaaaagatg

SEQ ID NO: 184773 - DNA, 103 bp, Artificial Sequence
  Synthetic Polynucleotide
taatacgactcactatagggcccgccatagcgcccagggccagcccgggaaacagaggagatcccggatgggccctgggaacctggcggcagcgcaaaagatg

SEQ ID NO: 184774 - DNA, 103 bp, Artificial Sequence
  Synthetic Polynucleotide
taatacgactcactataggggccgtcggggcccgccatagcgcccagggcaacagaggagagccctgatggctatggcgaacctggcggcagcgcaaaagatg

SEQ ID NO: 184775 - DNA, 103 bp, Artificial Sequence
  Synthetic Polynucleotide
taatacgactcactatagggacaccacagcgccgtcggggcccgccatagaacagaggagactatggatggccccgacgaacctggcggcagcgcaaaagatg

SEQ ID NO: 184776 - DNA, 103 bp, Artificial Sequence
  Synthetic Polynucleotide
taatacgactcactataggggccggcgtggacaccacagcgccgtcggggaacagaggagaccccgaatgcgctgtggtaacctggcggcagcgcaaaagatg

SEQ ID NO: 184777 - DNA, 103 bp, Artificial Sequence
  Synthetic Polynucleotide
taatacgactcactatagggcggcgcgtgagccggcgtggacaccacagcaacagaggagagctgtgatgtccacgccgaacctggcggcagcgcaaaagatg

SEQ ID NO: 184778 - DNA, 103 bp, Artificial Sequence
  Synthetic Polynucleotide
taatacgactcactatagggtggccatgtgcggcgcgtgagccggcgtggaacagaggagaccacgcatgctcacgcgcaacctggcggcagcgcaaaagatg

SEQ ID NO: 184779 - DNA, 103 bp, Artificial Sequence
  Synthetic Polynucleotide
taatacgactcactataggggggttcatggtggccatgtgcggcgcgtgaaacagaggagatcacgcatggcacatggcaacctggcggcagcgcaaaagatg

SEQ ID NO: 184780 - DNA, 103 bp, Artificial Sequence
  Synthetic Polynucleotide
taatacgactcactatagggttggtgcatggggttcatggtggccatgtgaacagaggagacacatgatgaccatgaacaacctggcggcagcgcaaaagatg

SEQ ID NO: 184781 - DNA, 103 bp, Artificial Sequence
  Synthetic Polynucleotide
taatacgactcactatagggtgagcgctgcttggtgcatggggttcatggaacagaggagaccatgaatgccatgcaccaacctggcggcagcgcaaaagatg

SEQ ID NO: 184782 - DNA, 103 bp, Artificial Sequence
  Synthetic Polynucleotide
taatacgactcactatagggtgggccatgctgagcgctgcttggtgcatgaacagaggagacatgcaatgagcagcgctaacctggcggcagcgcaaaagatg

SEQ ID NO: 184783 - DNA, 103 bp, Artificial Sequence
  Synthetic Polynucleotide
taatacgactcactataggggtgcagtgccgagtacttgggctccacgtgaacagaggagacacgtgatgcccaagtacaacctggcggcagcgcaaaagatg

SEQ ID NO: 184784 - DNA, 103 bp, Artificial Sequence
  Synthetic Polynucleotide
taatacgactcactatagggcccgtgcgcgtgggccatgctgagcgctgcaacagaggagagcagcgatgagcatggccaacctggcggcagcgcaaaagatg

SEQ ID NO: 184785 - DNA, 103 bp, Artificial Sequence
  Synthetic Polynucleotide
taatacgactcactataggggcgacggcagcccgtgcgcgtgggccatgcaacagaggagagcatggatgacgcgcacgaacctggcggcagcgcaaaagatg

SEQ ID NO: 184786 - DNA, 103 bp, Artificial Sequence
  Synthetic Polynucleotide
taatacgactcactatagggcagcccatgtgcgacggcagcccgtgcgcgaacagaggagacgcgcaatggctgccgtcaacctggcggcagcgcaaaagatg

SEQ ID NO: 184787 - DNA, 103 bp, Artificial Sequence
  Synthetic Polynucleotide
taatacgactcactataggggtcgctcatgcagcccatgtgcgacggcagaacagaggagactgccgatgcacatgggcaacctggcggcagcgcaaaagatg

SEQ ID NO: 184788 - DNA, 103 bp, Artificial Sequence
  Synthetic Polynucleotide
taatacgactcactatagggcggcgtccacgtcgctcatgcagcccatgtaacagaggagaacatggatggcatgagcgaacctggcggcagcgcaaaagatg

SEQ ID NO: 184789 - DNA, 103 bp, Artificial Sequence
  Synthetic Polynucleotide
taatacgactcactatagggtcccgcgggtcggcgtccacgtcgctcatgaacagaggagacatgagatgcgtggacgcaacctggcggcagcgcaaaagatg

SEQ ID NO: 184790 - DNA, 103 bp, Artificial Sequence
  Synthetic Polynucleotide
taatacgactcactatagggtgcctccaggtcccgcgggtcggcgtccacaacagaggagagtggacatggacccgcggaacctggcggcagcgcaaaagatg

SEQ ID NO: 184791 - DNA, 103 bp, Artificial Sequence
  Synthetic Polynucleotide
taatacgactcactataggggctcggcgaatgcctccaggtcccgcgggtaacagaggagaacccgcatgacctggaggaacctggcggcagcgcaaaagatg

SEQ ID NO: 184792 - DNA, 103 bp, Artificial Sequence
  Synthetic Polynucleotide
taatacgactcactatagggtgcttgaagcgctcggcgaatgcctccaggaacagaggagacctggaatgattcgccgaaacctggcggcagcgcaaaagatg

SEQ ID NO: 184793 - DNA, 103 bp, Artificial Sequence
  Synthetic Polynucleotide
taatacgactcactataggggatgcgtcgctgcttgaagcgctcggcgaaaacagaggagattcgccatgcgcttcaagaacctggcggcagcgcaaaagatg

SEQ ID NO: 184794 - DNA, 103 bp, Artificial Sequence
  Synthetic Polynucleotide
taatacgactcactataggggcgaggtgctgtgcagtgccgagtacttggaacagaggagaccaagtatgcggcactgcaacctggcggcagcgcaaaagatg

SEQ ID NO: 184795 - DNA, 103 bp, Artificial Sequence
  Synthetic Polynucleotide
taatacgactcactatagggcccccagcttgatgcgtcgctgcttgaagcaacagaggagagcttcaatgagcgacgcaaacctggcggcagcgcaaaagatg

SEQ ID NO: 184796 - DNA, 103 bp, Artificial Sequence
  Synthetic Polynucleotide
taatacgactcactataggggcctgggtcacccccagcttgatgcgtcgcaacagaggagagcgacgatgcaagctgggaacctggcggcagcgcaaaagatg

SEQ ID NO: 184797 - DNA, 103 bp, Artificial Sequence
  Synthetic Polynucleotide
taatacgactcactataggggcccacatctgcctgggtcacccccagcttaacagaggagaaagctgatggtgacccagaacctggcggcagcgcaaaagatg

SEQ ID NO: 184798 - DNA, 103 bp, Artificial Sequence
  Synthetic Polynucleotide
taatacgactcactatagggccagcgcggagcccacatctgcctgggtcaaacagaggagatgacccatgcagatgtggaacctggcggcagcgcaaaagatg

SEQ ID NO: 184799 - DNA, 103 bp, Artificial Sequence
  Synthetic Polynucleotide
taatacgactcactatagggttgaggttggccagcgcggagcccacatctaacagaggagaagatgtatgctccgcgctaacctggcggcagcgcaaaagatg

SEQ ID NO: 184800 - DNA, 103 bp, Artificial Sequence
  Synthetic Polynucleotide
taatacgactcactataggggccggggatcttgaggttggccagcgcggaaacagaggagatccgcgatggccaacctcaacctggcggcagcgcaaaagatg

SEQ ID NO: 184801 - DNA, 103 bp, Artificial Sequence
  Synthetic Polynucleotide
taatacgactcactataggggcgagcccacgccggggatcttgaggttggaacagaggagaccaaccatgagatccccgaacctggcggcagcgcaaaagatg

SEQ ID NO: 184802 - DNA, 103 bp, Artificial Sequence
  Synthetic Polynucleotide
taatacgactcactatagggctctggctaagcgagcccacgccggggatcaacagaggagagatcccatgcgtgggctcaacctggcggcagcgcaaaagatg

SEQ ID NO: 184803 - DNA, 103 bp, Artificial Sequence
  Synthetic Polynucleotide
taatacgactcactataggggcagatggtgctctggctaagcgagcccacaacagaggagagtgggcatgcttagccagaacctggcggcagcgcaaaagatg

SEQ ID NO: 184804 - DNA, 103 bp, Artificial Sequence
  Synthetic Polynucleotide
taatacgactcactatagggactcgaacctgcagatggtgctctggctaaaacagaggagattagccatggcaccatctaacctggcggcagcgcaaaagatg

SEQ ID NO: 184805 - DNA, 103 bp, Artificial Sequence
  Synthetic Polynucleotide
taatacgactcactataggggaggagcccggcgaggtgctgtgcagtgccaacagaggagaggcactatgcagcacctcaacctggcggcagcgcaaaagatg

SEQ ID NO: 184806 - DNA, 103 bp, Artificial Sequence
  Synthetic Polynucleotide
taatacgactcactatagggagtgtgagggactcgaacctgcagatggtgaacagaggagacaccatatgcaggttcgaaacctggcggcagcgcaaaagatg

SEQ ID NO: 184807 - DNA, 103 bp, Artificial Sequence
  Synthetic Polynucleotide
taatacgactcactatagggattgtgggacagtgtgagggactcgaacctaacagaggagaaggttcatgtccctcacaaacctggcggcagcgcaaaagatg

SEQ ID NO: 184808 - DNA, 103 bp, Artificial Sequence
  Synthetic Polynucleotide
taatacgactcactatagggcgatcatattattgtgggacagtgtgagggaacagaggagaccctcaatgtgtcccacaaacctggcggcagcgcaaaagatg

SEQ ID NO: 184809 - DNA, 103 bp, Artificial Sequence
  Synthetic Polynucleotide
taatacgactcactatagggggtttgagcgcgatcatattattgtgggacaacagaggagagtcccaatgtaatatgataacctggcggcagcgcaaaagatg

SEQ ID NO: 184810 - DNA, 103 bp, Artificial Sequence
  Synthetic Polynucleotide
taatacgactcactatagggctgcaggatgggtttgagcgcgatcatattaacagaggagaaatatgatggcgctcaaaaacctggcggcagcgcaaaagatg

SEQ ID NO: 184811 - DNA, 103 bp, Artificial Sequence
  Synthetic Polynucleotide
taatacgactcactatagggcgagccatgcctgcaggatgggtttgagcgaacagaggagacgctcaatgccatcctgcaacctggcggcagcgcaaaagatg

SEQ ID NO: 184812 - DNA, 103 bp, Artificial Sequence
  Synthetic Polynucleotide
taatacgactcactatagggtcggcctcctcgagccatgcctgcaggatgaacagaggagacatcctatgggcatggctaacctggcggcagcgcaaaagatg

SEQ ID NO: 184813 - DNA, 103 bp, Artificial Sequence
  Synthetic Polynucleotide
taatacgactcactataggggtgggacttctcggcctcctcgagccatgcaacagaggagagcatggatggaggaggccaacctggcggcagcgcaaaagatg

SEQ ID NO: 184814 - DNA, 103 bp, Artificial Sequence
  Synthetic Polynucleotide
taatacgactcactataggggcttctcgcggtgggacttctcggcctcctaacagaggagaaggaggatgagaagtcccaacctggcggcagcgcaaaagatg

SEQ ID NO: 184815 - DNA, 103 bp, Artificial Sequence
  Synthetic Polynucleotide
taatacgactcactatagggggcttggtgagcttctcgcggtgggacttcaacagaggagagaagtcatgccgcgagaaaacctggcggcagcgcaaaagatg

SEQ ID NO: 184816 - DNA, 103 bp, Artificial Sequence
  Synthetic Polynucleotide
taatacgactcactataggggaaaggctgcttggagttcatggccatcataacagaggagaatgatgatgatgaactccaacctggcggcagcgcaaaagatg

SEQ ID NO: 184817 - DNA, 103 bp, Artificial Sequence
  Synthetic Polynucleotide
taatacgactcactatagggctgcggggctgggagacagactcggcgcataacagaggagaatgcgcatggtctgtctcaacctggcggcagcgcaaaagatg

SEQ ID NO: 184818 - DNA, 103 bp, Artificial Sequence
  Synthetic Polynucleotide
taatacgactcactatagggtaccctgcagctgcggggctgggagacagaaacagaggagatctgtcatgcagccccgcaacctggcggcagcgcaaaagatg

SEQ ID NO: 184819 - DNA, 103 bp, Artificial Sequence
  Synthetic Polynucleotide
taatacgactcactatagggccaaatatattaccctgcagctgcggggctaacagaggagaagccccatggctgcagggaacctggcggcagcgcaaaagatg

SEQ ID NO: 184820 - DNA, 103 bp, Artificial Sequence
  Synthetic Polynucleotide
taatacgactcactatagggatcaaagcttccaaatatattaccctgcagaacagaggagactgcagatgaatatatttaacctggcggcagcgcaaaagatg

SEQ ID NO: 184821 - DNA, 103 bp, Artificial Sequence
  Synthetic Polynucleotide
taatacgactcactataggggcaggctctcatcaaagcttccaaatatataacagaggagaatatatatggaagctttgaacctggcggcagcgcaaaagatg

SEQ ID NO: 184822 - DNA, 103 bp, Artificial Sequence
  Synthetic Polynucleotide
taatacgactcactataggggcgcgtgccagcaggctctcatcaaagcttaacagaggagaaagcttatgtgagagcctaacctggcggcagcgcaaaagatg

SEQ ID NO: 184823 - DNA, 103 bp, Artificial Sequence
  Synthetic Polynucleotide
taatacgactcactatagggcagagcttcggcgcgtgccagcaggctctcaacagaggagagagagcatgctggcacgcaacctggcggcagcgcaaaagatg

SEQ ID NO: 184824 - DNA, 103 bp, Artificial Sequence
  Synthetic Polynucleotide
taatacgactcactatagggccaccgccgccagagcttcggcgcgtgccaaacagaggagatggcacatgccgaagctcaacctggcggcagcgcaaaagatg

SEQ ID NO: 184825 - DNA, 103 bp, Artificial Sequence
  Synthetic Polynucleotide
taatacgactcactataggggagacgatatccaccgccgccagagcttcgaacagaggagacgaagcatgggcggcggtaacctggcggcagcgcaaaagatg

SEQ ID NO: 184826 - DNA, 103 bp, Artificial Sequence
  Synthetic Polynucleotide
taatacgactcactatagggcttgccgtgggagacgatatccaccgccgcaacagaggagagcggcgatggatatcgtcaacctggcggcagcgcaaaagatg

SEQ ID NO: 184827 - DNA, 103 bp, Artificial Sequence
  Synthetic Polynucleotide
taatacgactcactatagggggtgcatgccgaaaggctgcttggagttcaaacagaggagatgaactatgagcagccttaacctggcggcagcgcaaaagatg

SEQ ID NO: 184828 - DNA, 103 bp, Artificial Sequence
  Synthetic Polynucleotide
taatacgactcactatagggacggatggttcttgccgtgggagacgatataacagaggagaatatcgatgcccacggcaaacctggcggcagcgcaaaagatg

SEQ ID NO: 184829 - DNA, 103 bp, Artificial Sequence
  Synthetic Polynucleotide
taatacgactcactatagggtcgggcttgaacggatggttcttgccgtggaacagaggagaccacggatggaaccatccaacctggcggcagcgcaaaagatg

SEQ ID NO: 184830 - DNA, 103 bp, Artificial Sequence
  Synthetic Polynucleotide
taatacgactcactataggggtaggtggcgtcgggcttgaacggatggttaacagaggagaaaccatatgttcaagcccaacctggcggcagcgcaaaagatg

SEQ ID NO: 184831 - DNA, 103 bp, Artificial Sequence
  Synthetic Polynucleotide
taatacgactcactatagggtcatggtatggtaggtggcgtcgggcttgaaacagaggagatcaagcatgacgccacctaacctggcggcagcgcaaaagatg

SEQ ID NO: 184832 - DNA, 103 bp, Artificial Sequence
  Synthetic Polynucleotide
taatacgactcactatagggggcacgctgctcatggtatggtaggtggcgaacagaggagacgccacatgccataccataacctggcggcagcgcaaaagatg

SEQ ID NO: 184833 - DNA, 103 bp, Artificial Sequence
  Synthetic Polynucleotide
taatacgactcactatagggggacgtgcagggcacgctgctcatggtatgaacagaggagacataccatgagcagcgtgaacctggcggcagcgcaaaagatg

SEQ ID NO: 184834 - DNA, 103 bp, Artificial Sequence
  Synthetic Polynucleotide
taatacgactcactatagggtggacgaagtggacgtgcagggcacgctgcaacagaggagagcagcgatgcctgcacgtaacctggcggcagcgcaaaagatg

SEQ ID NO: 184835 - DNA, 103 bp, Artificial Sequence
  Synthetic Polynucleotide
taatacgactcactatagggatgggcacggtggacgaagtggacgtgcagaacagaggagactgcacatgcacttcgtcaacctggcggcagcgcaaaagatg

SEQ ID NO: 184836 - DNA, 103 bp, Artificial Sequence
  Synthetic Polynucleotide
taatacgactcactatagggtgggtgggagatgggcacggtggacgaagtaacagaggagaacttcgatgaccgtgcccaacctggcggcagcgcaaaagatg

SEQ ID NO: 184837 - DNA, 103 bp, Artificial Sequence
  Synthetic Polynucleotide
taatacgactcactatagggtgagcgcagctgggtgggagatgggcacggaacagaggagaccgtgcatgtctcccaccaacctggcggcagcgcaaaagatg

SEQ ID NO: 184838 - DNA, 103 bp, Artificial Sequence
  Synthetic Polynucleotide
taatacgactcactatagggtgcagcaccgggtgcatgccgaaaggctgcaacagaggagagcagccatgcggcatgcaaacctggcggcagcgcaaaagatg

SEQ ID NO: 184839 - DNA, 103 bp, Artificial Sequence
  Synthetic Polynucleotide
taatacgactcactataggggggtgtgaggtgagcgcagctgggtgggagaacagaggagactcccaatgagctgcgctaacctggcggcagcgcaaaagatg

SEQ ID NO: 184840 - DNA, 103 bp, Artificial Sequence
  Synthetic Polynucleotide
taatacgactcactatagggggcgtggtgagggtgtgaggtgagcgcagcaacagaggagagctgcgatgacctcacacaacctggcggcagcgcaaaagatg

SEQ ID NO: 184841 - DNA, 103 bp, Artificial Sequence
  Synthetic Polynucleotide
taatacgactcactatagggcctggtgcacggcgtggtgagggtgtgaggaacagaggagacctcacatgctcaccacgaacctggcggcagcgcaaaagatg

SEQ ID NO: 184842 - DNA, 103 bp, Artificial Sequence
  Synthetic Polynucleotide
taatacgactcactatagggccttcgaggccctggtgcacggcgtggtgaaacagaggagatcaccaatgcgtgcaccaaacctggcggcagcgcaaaagatg

SEQ ID NO: 184843 - DNA, 103 bp, Artificial Sequence
  Synthetic Polynucleotide
taatacgactcactatagggcagcaggtcgccttcgaggccctggtgcacaacagaggagagtgcacatgggcctcgaaaacctggcggcagcgcaaaagatg

SEQ ID NO: 184844 - DNA, 103 bp, Artificial Sequence
  Synthetic Polynucleotide
taatacgactcactatagggagatgtgctccagcaggtcgccttcgaggcaacagaggagagcctcgatggcgacctgcaacctggcggcagcgcaaaagatg

SEQ ID NO: 184845 - DNA, 103 bp, Artificial Sequence
  Synthetic Polynucleotide
taatacgactcactatagggagcgtgggcgagatgtgctccagcaggtcgaacagaggagacgacctatgggagcacataacctggcggcagcgcaaaagatg

SEQ ID NO: 184846 - DNA, 103 bp, Artificial Sequence
  Synthetic Polynucleotide
taatacgactcactataggggctcacactcagcgtgggcgagatgtgctcaacagaggagagagcacatgtcgcccacgaacctggcggcagcgcaaaagatg

SEQ ID NO: 184847 - DNA, 103 bp, Artificial Sequence
  Synthetic Polynucleotide
taatacgactcactatagggcgcccaggccgctcacactcagcgtgggcgaacagaggagacgcccaatgtgagtgtgaaacctggcggcagcgcaaaagatg

SEQ ID NO: 184848 - DNA, 103 bp, Artificial Sequence
  Synthetic Polynucleotide
taatacgactcactatagggtgttccggagcgcccaggccgctcacactcaacagaggagagagtgtatgcggcctgggaacctggcggcagcgcaaaagatg

SEQ ID NO: 184849 - DNA, 103 bp, Artificial Sequence
  Synthetic Polynucleotide
taatacgactcactatagggtttgggttcttgcagcaccgggtgcatgccaacagaggagaggcatgatgccggtgctgaacctggcggcagcgcaaaagatg

SEQ ID NO: 184850 - DNA, 103 bp, Artificial Sequence
  Synthetic Polynucleotide
taatacgactcactatagggcatcaccgagtgttccggagcgcccaggccaacagaggagaggcctgatggctccggaaaacctggcggcagcgcaaaagatg

SEQ ID NO: 184851 - DNA, 103 bp, Artificial Sequence
  Synthetic Polynucleotide
taatacgactcactatagggtctgtgcgggcatcaccgagtgttccggagaacagaggagactccggatgactcggtgaaacctggcggcagcgcaaaagatg

SEQ ID NO: 184852 - DNA, 103 bp, Artificial Sequence
  Synthetic Polynucleotide
taatacgactcactatagggtgtggatggatctgtgcgggcatcaccgagaacagaggagactcggtatggcccgcacaaacctggcggcagcgcaaaagatg

SEQ ID NO: 184853 - DNA, 103 bp, Artificial Sequence
  Synthetic Polynucleotide
taatacgactcactataggggcccaggtggtgtggatggatctgtgcgggaacagaggagacccgcaatgatccatccaaacctggcggcagcgcaaaagatg

SEQ ID NO: 184854 - DNA, 103 bp, Artificial Sequence
  Synthetic Polynucleotide
taatacgactcactatagggggcccatggcgcccaggtggtgtggatggaaacagaggagatccatcatgaccacctggaacctggcggcagcgcaaaagatg

SEQ ID NO: 184855 - DNA, 103 bp, Artificial Sequence
  Synthetic Polynucleotide
taatacgactcactatagggtggtgcaggtggcccatggcgcccaggtggaacagaggagaccacctatgcgccatgggaacctggcggcagcgcaaaagatg

SEQ ID NO: 184856 - DNA, 103 bp, Artificial Sequence
  Synthetic Polynucleotide
taatacgactcactataggggcccatggcctggtgcaggtggcccatggcaacagaggagagccatgatgcacctgcacaacctggcggcagcgcaaaagatg

SEQ ID NO: 184857 - DNA, 103 bp, Artificial Sequence
  Synthetic Polynucleotide
taatacgactcactatagggggtgactcatgcccatggcctggtgcaggtaacagaggagaacctgcatgaggccatggaacctggcggcagcgcaaaagatg

SEQ ID NO: 184858 - DNA, 103 bp, Artificial Sequence
  Synthetic Polynucleotide
taatacgactcactatagggacggtgtgcgggtgactcatgcccatggccaacagaggagaggccatatgcatgagtcaaacctggcggcagcgcaaaagatg

SEQ ID NO: 184859 - DNA, 103 bp, Artificial Sequence
  Synthetic Polynucleotide
taatacgactcactatagggatgaggggccacggtgtgcgggtgactcataacagaggagaatgagtatgccgcacaccaacctggcggcagcgcaaaagatg

SEQ ID NO: 184860 - DNA, 103 bp, Artificial Sequence
  Synthetic Polynucleotide
taatacgactcactataggggactggagaatttgggttcttgcagcaccgaacagaggagacggtgcatgaagaacccaaacctggcggcagcgcaaaagatg

SEQ ID NO: 184861 - DNA, 103 bp, Artificial Sequence
  Synthetic Polynucleotide
taatacgactcactataggggcatggcgctatgaggggccacggtgtgcgaacagaggagacgcacaatgtggcccctcaacctggcggcagcgcaaaagatg

SEQ ID NO: 184862 - DNA, 103 bp, Artificial Sequence
  Synthetic Polynucleotide
taatacgactcactatagggaggcatgcaggcatggcgctatgaggggccaacagaggagaggccccatgtagcgccataacctggcggcagcgcaaaagatg

SEQ ID NO: 184863 - DNA, 103 bp, Artificial Sequence
  Synthetic Polynucleotide
taatacgactcactatagggcacgtcgctgaggcatgcaggcatggcgctaacagaggagaagcgccatgcctgcatgcaacctggcggcagcgcaaaagatg

SEQ ID NO: 184864 - DNA, 103 bp, Artificial Sequence
  Synthetic Polynucleotide
taatacgactcactatagggggtctgactccacgtcgctgaggcatgcagaacagaggagactgcatatgtcagcgacgaacctggcggcagcgcaaaagatg

SEQ ID NO: 184865 - DNA, 103 bp, Artificial Sequence
  Synthetic Polynucleotide
taatacgactcactatagggagctcgcgcgggtctgactccacgtcgctgaacagaggagacagcgaatgggagtcagaaacctggcggcagcgcaaaagatg

SEQ ID NO: 184866 - DNA, 103 bp, Artificial Sequence
  Synthetic Polynucleotide
taatacgactcactataggggaaggcttccagctcgcgcgggtctgactcaacagaggagagagtcaatgccgcgcgagaacctggcggcagcgcaaaagatg

SEQ ID NO: 184867 - DNA, 103 bp, Artificial Sequence
  Synthetic Polynucleotide
taatacgactcactatagggagcgctcggcgaaggcttccagctcgcgcgaacagaggagacgcgcgatgtggaagcctaacctggcggcagcgcaaaagatg

SEQ ID NO: 184868 - DNA, 103 bp, Artificial Sequence
  Synthetic Polynucleotide
taatacgactcactatagggcgctgcttgaagcgctcggcgaaggcttccaacagaggagaggaagcatgcgccgagcgaacctggcggcagcgcaaaagatg

SEQ ID NO: 184869 - DNA, 103 bp, Artificial Sequence
  Synthetic Polynucleotide
taatacgactcactatagggcttgatgcgccgctgcttgaagcgctcggcaacagaggagagccgagatgttcaagcagaacctggcggcagcgcaaaagatg

SEQ ID NO: 184870 - DNA, 103 bp, Artificial Sequence
  Synthetic Polynucleotide
taatacgactcactatagggtcacccccagcttgatgcgccgctgcttgaaacagaggagatcaagcatgggcgcatcaaacctggcggcagcgcaaaagatg

SEQ ID NO: 184871 - DNA, 103 bp, Artificial Sequence
  Synthetic Polynucleotide
taatacgactcactatagggccagagtgcagactggagaatttgggttctaacagaggagaagaaccatgattctccagaacctggcggcagcgcaaaagatg

SEQ ID NO: 184872 - DNA, 103 bp, Artificial Sequence
  Synthetic Polynucleotide
taatacgactcactatagggtccgcctgggtcacccccagcttgatgcgcaacagaggagagcgcatatggctgggggtaacctggcggcagcgcaaaagatg

SEQ ID NO: 184873 - DNA, 103 bp, Artificial Sequence
  Synthetic Polynucleotide
taatacgactcactatagggcgcgcccacgtccgcctgggtcacccccagaacagaggagactggggatgacccaggcgaacctggcggcagcgcaaaagatg

SEQ ID NO: 184874 - DNA, 103 bp, Artificial Sequence
  Synthetic Polynucleotide
taatacgactcactatagggtagccagagccgcgcccacgtccgcctgggaacagaggagacccaggatgacgtgggcgaacctggcggcagcgcaaaagatg

SEQ ID NO: 184875 - DNA, 103 bp, Artificial Sequence
  Synthetic Polynucleotide
taatacgactcactatagggatcttgagattagccagagccgcgcccacgaacagaggagacgtgggatgggctctggcaacctggcggcagcgcaaaagatg

SEQ ID NO: 184876 - DNA, 103 bp, Artificial Sequence
  Synthetic Polynucleotide
taatacgactcactatagggcacgccggggatcttgagattagccagagcaacagaggagagctctgatgaatctcaagaacctggcggcagcgcaaaagatg

SEQ ID NO: 184877 - DNA, 103 bp, Artificial Sequence
  Synthetic Polynucleotide
taatacgactcactatagggtcagcgagcccacgccggggatcttgagataacagaggagaatctcaatgtccccggcgaacctggcggcagcgcaaaagatg

SEQ ID NO: 184878 - DNA, 103 bp, Artificial Sequence
  Synthetic Polynucleotide
taatacgactcactataggggtgctttggctcagcgagcccacgccggggaacagaggagaccccggatggggctcgctaacctggcggcagcgcaaaagatg

SEQ ID NO: 184879 - DNA, 103 bp, Artificial Sequence
  Synthetic Polynucleotide
taatacgactcactatagggcctgcagatggtgctttggctcagcgagccaacagaggagaggctcgatgagccaaagcaacctggcggcagcgcaaaagatg

SEQ ID NO: 184880 - DNA, 103 bp, Artificial Sequence
  Synthetic Polynucleotide
taatacgactcactataggggagactcgaacctgcagatggtgctttggcaacagaggagagccaaaatgccatctgcaaacctggcggcagcgcaaaagatg

SEQ ID NO: 184881 - DNA, 103 bp, Artificial Sequence
  Synthetic Polynucleotide
taatacgactcactataggggagagagtgagagactcgaacctgcagatgaacagaggagacatctgatggttcgagtcaacctggcggcagcgcaaaagatg

SEQ ID NO: 184882 - DNA, 103 bp, Artificial Sequence
  Synthetic Polynucleotide
taatacgactcactatagggggcctcggagccagagtgcagactggagaaaacagaggagattctccatgctgcactctaacctggcggcagcgcaaaagatg

SEQ ID NO: 184883 - DNA, 103 bp, Artificial Sequence
  Synthetic Polynucleotide
taatacgactcactataggggttgttgtgcgagagagtgagagactcgaaaacagaggagattcgagatgctcactctcaacctggcggcagcgcaaaagatg

SEQ ID NO: 184884 - DNA, 103 bp, Artificial Sequence
  Synthetic Polynucleotide
taatacgactcactataggggagcgatcatgttgttgtgcgagagagtgaaacagaggagatcactcatgcgcacaacaaacctggcggcagcgcaaaagatg

SEQ ID NO: 184885 - DNA, 103 bp, Artificial Sequence
  Synthetic Polynucleotide
taatacgactcactatagggaccggcttgagagcgatcatgttgttgtgcaacagaggagagcacaaatgcatgatcgcaacctggcggcagcgcaaaagatg

SEQ ID NO: 184886 - DNA, 103 bp, Artificial Sequence
  Synthetic Polynucleotide
taatacgactcactatagggggcctggagcaccggcttgagagcgatcataacagaggagaatgatcatgctcaagccgaacctggcggcagcgcaaaagatg

SEQ ID NO: 184887 - DNA, 103 bp, Artificial Sequence
  Synthetic Polynucleotide
taatacgactcactatagggcctccaaccaggcctggagcaccggcttgaaacagaggagatcaagcatgtgctccaggaacctggcggcagcgcaaaagatg

SEQ ID NO: 184888 - DNA, 103 bp, Artificial Sequence
  Synthetic Polynucleotide
taatacgactcactataggggcctcggcctcctccaaccaggcctggagcaacagaggagagctccaatgctggttggaaacctggcggcagcgcaaaagatg

SEQ ID NO: 184889 - DNA, 103 bp, Artificial Sequence
  Synthetic Polynucleotide
taatacgactcactatagggtcggtaggcggcctcggcctcctccaaccaaacagaggagatggttgatggaggccgagaacctggcggcagcgcaaaagatg

SEQ ID NO: 184890 - DNA, 103 bp, Artificial Sequence
  Synthetic Polynucleotide
taatacgactcactatagggtgttcttctctcggtaggcggcctcggcctaacagaggagaaggccgatgccgcctaccaacctggcggcagcgcaaaagatg

SEQ ID NO: 184891 - DNA, 103 bp, Artificial Sequence
  Synthetic Polynucleotide
taatacgactcactatagggtctggcttgctgttcttctctcggtaggcgaacagaggagacgcctaatgagagaagaaaacctggcggcagcgcaaaagatg

SEQ ID NO: 184892 - DNA, 103 bp, Artificial Sequence
  Synthetic Polynucleotide
taatacgactcactataggggttgaagagctctggcttgctgttcttctcaacagaggagagagaagatgagcaagccaaacctggcggcagcgcaaaagatg

SEQ ID NO: 184893 - DNA, 103 bp, Artificial Sequence
  Synthetic Polynucleotide
taatacgactcactatagggctcggcgcatggcctcggagccagagtgcaaacagaggagatgcactatggctccgaggaacctggcggcagcgcaaaagatg

SEQ ID NO: 184894 - DNA, 103 bp, Artificial Sequence
  Synthetic Polynucleotide
taatacgactcactataggggttcgctgccgttgaagagctctggcttgcaacagaggagagcaagcatgagctcttcaaacctggcggcagcgcaaaagatg

SEQ ID NO: 184895 - DNA, 103 bp, Artificial Sequence
  Synthetic Polynucleotide
taatacgactcactatagggttgcgcttccgttcgctgccgttgaagagcaacagaggagagctcttatgcggcagcgaaacctggcggcagcgcaaaagatg

SEQ ID NO: 184896 - DNA, 103 bp, Artificial Sequence
  Synthetic Polynucleotide
taatacgactcactatagggggacgtgcgtttgcgcttccgttcgctgccaacagaggagaggcagcatgcggaagcgcaacctggcggcagcgcaaaagatg

SEQ ID NO: 184897 - DNA, 103 bp, Artificial Sequence
  Synthetic Polynucleotide
taatacgactcactataggggcgccgcgatggacgtgcgtttgcgcttccaacagaggagaggaagcatgaacgcacgtaacctggcggcagcgcaaaagatg

SEQ ID NO: 184898 - DNA, 103 bp, Artificial Sequence
  Synthetic Polynucleotide
taatacgactcactatagggcgcttctccggcgccgcgatggacgtgcgtaacagaggagaacgcacatgcatcgcggcaacctggcggcagcgcaaaagatg

SEQ ID NO: 184899 - DNA, 103 bp, Artificial Sequence
  Synthetic Polynucleotide
taatacgactcactatagggctcgagtgaacgcttctccggcgccgcgataacagaggagaatcgcgatgccggagaagaacctggcggcagcgcaaaagatg

SEQ ID NO: 184900 - DNA, 103 bp, Artificial Sequence
  Synthetic Polynucleotide
taatacgactcactatagggcgaaataggcctcgagtgaacgcttctccgaacagaggagacggagaatggttcactcgaacctggcggcagcgcaaaagatg

SEQ ID NO: 184901 - DNA, 103 bp, Artificial Sequence
  Synthetic Polynucleotide
taatacgactcactatagggggctggatagcgaaataggcctcgagtgaaaacagaggagattcactatgggcctatttaacctggcggcagcgcaaaagatg

SEQ ID NO: 184902 - DNA, 103 bp, Artificial Sequence
  Synthetic Polynucleotide
taatacgactcactatagggtgaaggacgtggctggatagcgaaataggcaacagaggagagcctatatggctatccagaacctggcggcagcgcaaaagatg

SEQ ID NO: 184903 - DNA, 103 bp, Artificial Sequence
  Synthetic Polynucleotide
taatacgactcactatagggtcttctcagatgaaggacgtggctggatagaacagaggagactatccatgcacgtccttaacctggcggcagcgcaaaagatg

SEQ ID NO: 184904 - DNA, 103 bp, Artificial Sequence
  Synthetic Polynucleotide
taatacgactcactataggggggagacagactcggcgcatggcctcggagaacagaggagactccgaatgcatgcgccgaacctggcggcagcgcaaaagatg

SEQ ID NO: 184905 - DNA, 103 bp, Artificial Sequence
  Synthetic Polynucleotide
taatacgactcactatagggatggccgcgatcttctcagatgaaggacgtaacagaggagaacgtccatgatctgagaaaacctggcggcagcgcaaaagatg

SEQ ID NO: 184906 - DNA, 103 bp, Artificial Sequence
  Synthetic Polynucleotide
taatacgactcactatagggtttctcagcgatggccgcgatcttctcagaaacagaggagatctgagatgatcgcggccaacctggcggcagcgcaaaagatg

SEQ ID NO: 184907 - DNA, 103 bp, Artificial Sequence
  Synthetic Polynucleotide
taatacgactcactatagggtaaggtccagtttctcagcgatggccgcgaaacagaggagatcgcggatgtcgctgagaaacctggcggcagcgcaaaagatg

SEQ ID NO: 184908 - DNA, 103 bp, Artificial Sequence
  Synthetic Polynucleotide
taatacgactcactatagggacgttctttttaaggtccagtttctcagcgaacagaggagacgctgaatgactggacctaacctggcggcagcgcaaaagatg

SEQ ID NO: 184909 - DNA, 103 bp, Artificial Sequence
  Synthetic Polynucleotide
taatacgactcactataggggactctcaccacgttctttttaaggtccagaacagaggagactggacatgaaaaagaacaacctggcggcagcgcaaaagatg

SEQ ID NO: 184910 - DNA, 103 bp, Artificial Sequence
  Synthetic Polynucleotide
taatacgactcactatagggtgcagaaccagactctcaccacgttcttttaacagaggagaaaaagaatgtggtgagagaacctggcggcagcgcaaaagatg

SEQ ID NO: 184911 - DNA, 103 bp, Artificial Sequence
  Synthetic Polynucleotide
taatacgactcactatagggtgtctctggttgcagaaccagactctcaccaacagaggagaggtgagatgctggttctgaacctggcggcagcgcaaaagatg

SEQ ID NO: 184912 - DNA, 103 bp, Artificial Sequence
  Synthetic Polynucleotide
taatacgactcactatagggtttctgtttctgtctctggttgcagaaccaaacagaggagatggttcatgaaccagagaaacctggcggcagcgcaaaagatg

SEQ ID NO: 184913 - DNA, 103 bp, Artificial Sequence
  Synthetic Polynucleotide
taatacgactcactatagggacttcattcgtttctgtttctgtctctggtaacagaggagaaccagaatgagaaacagaaacctggcggcagcgcaaaagatg

SEQ ID NO: 184914 - DNA, 103 bp, Artificial Sequence
  Synthetic Polynucleotide
taatacgactcactatagggacagccgaatacttcattcgtttctgtttcaacagaggagagaaacaatgacgaatgaaaacctggcggcagcgcaaaagatg

SEQ ID NO: 184915 - DNA, 103 bp, Artificial Sequence
  Synthetic Polynucleotide
taatacgactcactatagggggcgaaatccgaagccaggtgtcccgccataacagaggagaatggcgatgcacctggctaacctggcggcagcgcaaaagatg

SEQ ID NO: 184916 - DNA, 103 bp, Artificial Sequence
  Synthetic Polynucleotide
taatacgactcactataggggccttggaagcttagccaggtccgaggatcaacagaggagagatcctatgacctggctaaacctggcggcagcgcaaaagatg

SEQ ID NO: 184917 - DNA, 103 bp, Artificial Sequence
  Synthetic Polynucleotide
taatacgactcactatagggagggaaagggaccgaggagtacagtgcagtaacagaggagaactgcaatgtactcctcgaacctggcggcagcgcaaaagatg

SEQ ID NO: 184918 - DNA, 103 bp, Artificial Sequence
  Synthetic Polynucleotide
taatacgactcactatagggcttccccctcagggaaagggaccgaggagtaacagaggagaactcctatgtccctttccaacctggcggcagcgcaaaagatg

SEQ ID NO: 184919 - DNA, 103 bp, Artificial Sequence
  Synthetic Polynucleotide
taatacgactcactataggggggggaaaggcttccccctcagggaaagggaacagaggagaccctttatgtgagggggaaacctggcggcagcgcaaaagatg

SEQ ID NO: 184920 - DNA, 103 bp, Artificial Sequence
  Synthetic Polynucleotide
taatacgactcactataggggacggagacagggggaaaggcttccccctcaacagaggagagaggggatggcctttcccaacctggcggcagcgcaaaagatg

SEQ ID NO: 184921 - DNA, 103 bp, Artificial Sequence
  Synthetic Polynucleotide
taatacgactcactatagggccagagtggtgacggagacagggggaaaggaacagaggagacctttcatgctgtctccgaacctggcggcagcgcaaaagatg

SEQ ID NO: 184922 - DNA, 103 bp, Artificial Sequence
  Synthetic Polynucleotide
taatacgactcactatagggatgggagagcccagagtggtgacggagacaaacagaggagatgtctcatgcaccactctaacctggcggcagcgcaaaagatg

SEQ ID NO: 184923 - DNA, 103 bp, Artificial Sequence
  Synthetic Polynucleotide
taatacgactcactataggggtttgaatgcatgggagagcccagagtggtaacagaggagaaccactatgggctctcccaacctggcggcagcgcaaaagatg

SEQ ID NO: 184924 - DNA, 103 bp, Artificial Sequence
  Synthetic Polynucleotide
taatacgactcactatagggctccaggagggccttggaagcttagccaggaacagaggagacctggcatggcttccaagaacctggcggcagcgcaaaagatg

SEQ ID NO: 184925 - DNA, 103 bp, Artificial Sequence
  Synthetic Polynucleotide
taatacgactcactatagggattcctggccctccaggagggccttggaagaacagaggagacttccaatgccctcctggaacctggcggcagcgcaaaagatg

SEQ ID NO: 184926 - DNA, 103 bp, Artificial Sequence
  Synthetic Polynucleotide
taatacgactcactatagggccccggcccgattcctggccctccaggaggaacagaggagacctcctatggggccaggaaacctggcggcagcgcaaaagatg

SEQ ID NO: 184927 - DNA, 103 bp, Artificial Sequence
  Synthetic Polynucleotide
taatacgactcactatagggctggcccaacccccggcccgattcctggccaacagaggagaggccagatgtcgggccggaacctggcggcagcgcaaaagatg

SEQ ID NO: 184928 - DNA, 103 bp, Artificial Sequence
  Synthetic Polynucleotide
taatacgactcactatagggacctcagagcctggcccaacccccggcccgaacagaggagacgggccatgggttgggccaacctggcggcagcgcaaaagatg

SEQ ID NO: 184929 - DNA, 103 bp, Artificial Sequence
  Synthetic Polynucleotide
taatacgactcactatagggaatcccccacacctcagagcctggcccaacaacagaggagagttgggatgggctctgagaacctggcggcagcgcaaaagatg

SEQ ID NO: 184930 - DNA, 103 bp, Artificial Sequence
  Synthetic Polynucleotide
taatacgactcactatagggggcatgggggaatcccccacacctcagagcaacagaggagagctctgatgtgtgggggaaacctggcggcagcgcaaaagatg

SEQ ID NO: 184931 - DNA, 103 bp, Artificial Sequence
  Synthetic Polynucleotide
taatacgactcactatagggtacggcggggggcatgggggaatcccccacaacagaggagagtggggatgtcccccatgaacctggcggcagcgcaaaagatg

SEQ ID NO: 184932 - DNA, 103 bp, Artificial Sequence
  Synthetic Polynucleotide
taatacgactcactatagggacagaactcatacggcggggggcatgggggaacagaggagacccccaatgcccccgccgaacctggcggcagcgcaaaagatg

SEQ ID NO: 184933 - DNA, 103 bp, Artificial Sequence
  Synthetic Polynucleotide
taatacgactcactatagggggggcgagaaggcgaaatccgaagccaggtaacagaggagaacctggatgcggatttcgaacctggcggcagcgcaaaagatg

SEQ ID NO: 184934 - DNA, 103 bp, Artificial Sequence
  Synthetic Polynucleotide
taatacgactcactatagggccatccccccacagaactcatacggcggggaacagaggagaccccgcatgatgagttctaacctggcggcagcgcaaaagatg

SEQ ID NO: 184935 - DNA, 103 bp, Artificial Sequence
  Synthetic Polynucleotide
taatacgactcactatagggccacagtacgccatccccccacagaactcaaacagaggagatgagttatgtggggggataacctggcggcagcgcaaaagatg

SEQ ID NO: 184936 - DNA, 103 bp, Artificial Sequence
  Synthetic Polynucleotide
taatacgactcactatagggaacctggggcccacagtacgccatccccccaacagaggagaggggggatggcgtactgtaacctggcggcagcgcaaaagatg

SEQ ID NO: 184937 - DNA, 103 bp, Artificial Sequence
  Synthetic Polynucleotide
taatacgactcactataggggccccactccaacctggggcccacagtacgaacagaggagacgtactatgggccccaggaacctggcggcagcgcaaaagatg

SEQ ID NO: 184938 - DNA, 103 bp, Artificial Sequence
  Synthetic Polynucleotide
taatacgactcactatagggtggggcactagccccactccaacctggggcaacagaggagagccccaatgtggagtgggaacctggcggcagcgcaaaagatg

SEQ ID NO: 184939 - DNA, 103 bp, Artificial Sequence
  Synthetic Polynucleotide
taatacgactcactatagggcaagccgccttggggcactagccccactccaacagaggagaggagtgatgctagtgcccaacctggcggcagcgcaaaagatg

SEQ ID NO: 184940 - DNA, 103 bp, Artificial Sequence
  Synthetic Polynucleotide
taatacgactcactataggggagaggtctccaagccgccttggggcactaaacagaggagatagtgcatgaaggcggctaacctggcggcagcgcaaaagatg

SEQ ID NO: 184941 - DNA, 103 bp, Artificial Sequence
  Synthetic Polynucleotide
taatacgactcactatagggccctcaggctgagaggtctccaagccgcctaacagaggagaaggcggatgggagacctcaacctggcggcagcgcaaaagatg

SEQ ID NO: 184942 - DNA, 103 bp, Artificial Sequence
  Synthetic Polynucleotide
taatacgactcactatagggtcctgcttcgccctcaggctgagaggtctcaacagaggagagagaccatgcagcctgagaacctggcggcagcgcaaaagatg

SEQ ID NO: 184943 - DNA, 103 bp, Artificial Sequence
  Synthetic Polynucleotide
taatacgactcactatagggccaccccgactcctgcttcgccctcaggctaacagaggagaagcctgatggcgaagcagaacctggcggcagcgcaaaagatg

SEQ ID NO: 184944 - DNA, 103 bp, Artificial Sequence
  Synthetic Polynucleotide
taatacgactcactatagggccacctggagggggcgagaaggcgaaatccaacagaggagaggatttatgcttctcgccaacctggcggcagcgcaaaagatg

SEQ ID NO: 184945 - DNA, 103 bp, Artificial Sequence
  Synthetic Polynucleotide
taatacgactcactataggggagttgctctccaccccgactcctgcttcgaacagaggagacgaagcatgagtcggggtaacctggcggcagcgcaaaagatg

SEQ ID NO: 184946 - DNA, 103 bp, Artificial Sequence
  Synthetic Polynucleotide
taatacgactcactatagggggccccatcggagttgctctccaccccgacaacagaggagagtcgggatggagagcaacaacctggcggcagcgcaaaagatg

SEQ ID NO: 184947 - DNA, 103 bp, Artificial Sequence
  Synthetic Polynucleotide
taatacgactcactataggggctccggggaggccccatcggagttgctctaacagaggagaagagcaatgccgatggggaacctggcggcagcgcaaaagatg

SEQ ID NO: 184948 - DNA, 103 bp, Artificial Sequence
  Synthetic Polynucleotide
taatacgactcactatagggacggtgcagggctccggggaggccccatcgaacagaggagacgatggatgctccccggaaacctggcggcagcgcaaaagatg

SEQ ID NO: 184949 - DNA, 103 bp, Artificial Sequence
  Synthetic Polynucleotide
taatacgactcactatagggaccaggggtgacggtgcagggctccggggaaacagaggagatccccgatgccctgcaccaacctggcggcagcgcaaaagatg

SEQ ID NO: 184950 - DNA, 103 bp, Artificial Sequence
  Synthetic Polynucleotide
taatacgactcactataggggcttcacggcaccaggggtgacggtgcaggaacagaggagacctgcaatgtcacccctgaacctggcggcagcgcaaaagatg

SEQ ID NO: 184951 - DNA, 103 bp, Artificial Sequence
  Synthetic Polynucleotide
taatacgactcactatagggtccttctccagcttcacggcaccaggggtgaacagaggagacaccccatgtgccgtgaaaacctggcggcagcgcaaaagatg

SEQ ID NO: 184952 - DNA, 103 bp, Artificial Sequence
  Synthetic Polynucleotide
taatacgactcactatagggctccagcttctccttctccagcttcacggcaacagaggagagccgtgatgctggagaagaacctggcggcagcgcaaaagatg

SEQ ID NO: 184953 - DNA, 103 bp, Artificial Sequence
  Synthetic Polynucleotide
taatacgactcactatagggccgggttttgctccagcttctccttctccaaacagaggagatggagaatgagaagctggaacctggcggcagcgcaaaagatg

SEQ ID NO: 184954 - DNA, 103 bp, Artificial Sequence
  Synthetic Polynucleotide
taatacgactcactatagggtgggactcctccgggttttgctccagcttcaacagaggagagaagctatggcaaaacccaacctggcggcagcgcaaaagatg

SEQ ID NO: 184955 - DNA, 103 bp, Artificial Sequence
  Synthetic Polynucleotide
taatacgactcactatagggatcacctccaccacctggagggggcgagaaaacagaggagattctcgatgcctccaggtaacctggcggcagcgcaaaagatg

SEQ ID NO: 184956 - DNA, 103 bp, Artificial Sequence
  Synthetic Polynucleotide
taatacgactcactatagggtttgatgtcctgggactcctccgggttttgaacagaggagacaaaacatggaggagtccaacctggcggcagcgcaaaagatg

SEQ ID NO: 184957 - DNA, 103 bp, Artificial Sequence
  Synthetic Polynucleotide
taatacgactcactatagggtctgcagagctttgatgtcctgggactcctaacagaggagaaggagtatgaggacatcaaacctggcggcagcgcaaaagatg

SEQ ID NO: 184958 - DNA, 103 bp, Artificial Sequence
  Synthetic Polynucleotide
taatacgactcactatagggtcgagttctttctgcagagctttgatgtccaacagaggagaggacatatgagctctgcaaacctggcggcagcgcaaaagatg

SEQ ID NO: 184959 - DNA, 103 bp, Artificial Sequence
  Synthetic Polynucleotide
taatacgactcactatagggggcaaattgctcgagttctttctgcagagcaacagaggagagctctgatgaaagaactcaacctggcggcagcgcaaaagatg

SEQ ID NO: 184960 - DNA, 103 bp, Artificial Sequence
  Synthetic Polynucleotide
taatacgactcactatagggtcaggagcttggcaaattgctcgagttcttaacagaggagaaagaacatgagcaatttgaacctggcggcagcgcaaaagatg

SEQ ID NO: 184961 - DNA, 103 bp, Artificial Sequence
  Synthetic Polynucleotide
taatacgactcactatagggctcttctgcttcaggagcttggcaaattgcaacagaggagagcaattatgcaagctcctaacctggcggcagcgcaaaagatg

SEQ ID NO: 184962 - DNA, 103 bp, Artificial Sequence
  Synthetic Polynucleotide
taatacgactcactatagggcagggtgatcctcttctgcttcaggagcttaacagaggagaaagctcatgaagcagaagaacctggcggcagcgcaaaagatg

SEQ ID NO: 184963 - DNA, 103 bp, Artificial Sequence
  Synthetic Polynucleotide
taatacgactcactataggggtgtatatcccagggtgatcctcttctgctaacagaggagaagcagaatgggatcacccaacctggcggcagcgcaaaagatg

SEQ ID NO: 184964 - DNA, 103 bp, Artificial Sequence
  Synthetic Polynucleotide
taatacgactcactatagggacatcggcctgtgtatatcccagggtgatcaacagaggagagatcacatggggatatacaacctggcggcagcgcaaaagatg

SEQ ID NO: 184965 - DNA, 103 bp, Artificial Sequence
  Synthetic Polynucleotide
taatacgactcactatagggggtgagccccacatcggcctgtgtatatccaacagaggagaggatatatgcaggccgataacctggcggcagcgcaaaagatg

SEQ ID NO: 184966 - DNA, 103 bp, Artificial Sequence
  Synthetic Polynucleotide
taatacgactcactatagggcccctggcccatcacctccaccacctggagaacagaggagactccagatggtggaggtgaacctggcggcagcgcaaaagatg

SEQ ID NO: 184967 - DNA, 103 bp, Artificial Sequence
  Synthetic Polynucleotide
taatacgactcactataggggaacccccagggtgagccccacatcggcctaacagaggagaaggccgatgtggggctcaaacctggcggcagcgcaaaagatg

SEQ ID NO: 184968 - DNA, 103 bp, Artificial Sequence
  Synthetic Polynucleotide
taatacgactcactatagggttcccaaatagaacccccagggtgagccccaacagaggagaggggctatgcctgggggtaacctggcggcagcgcaaaagatg

SEQ ID NO: 184969 - DNA, 103 bp, Artificial Sequence
  Synthetic Polynucleotide
taatacgactcactataggggctgaataccttcccaaatagaacccccagaacagaggagactggggatgctatttgggaacctggcggcagcgcaaaagatg

SEQ ID NO: 184970 - DNA, 103 bp, Artificial Sequence
  Synthetic Polynucleotide
taatacgactcactatagggtggtcgtttggctgaataccttcccaaataaacagaggagatatttgatgaggtattcaaacctggcggcagcgcaaaagatg

SEQ ID NO: 184971 - DNA, 103 bp, Artificial Sequence
  Synthetic Polynucleotide
taatacgactcactatagggaagcggcagatggtcgtttggctgaataccaacagaggagaggtattatgccaaacgacaacctggcggcagcgcaaaagatg

SEQ ID NO: 184972 - DNA, 103 bp, Artificial Sequence
  Synthetic Polynucleotide
taatacgactcactatagggcagagcctcaaagcggcagatggtcgtttgaacagaggagacaaacgatgatctgccgcaacctggcggcagcgcaaaagatg

SEQ ID NO: 184973 - DNA, 103 bp, Artificial Sequence
  Synthetic Polynucleotide
taatacgactcactatagggagctaagctgcagagcctcaaagcggcagaaacagaggagatctgccatgttgaggctcaacctggcggcagcgcaaaagatg

SEQ ID NO: 184974 - DNA, 103 bp, Artificial Sequence
  Synthetic Polynucleotide
taatacgactcactatagggatgttcttgaagctaagctgcagagcctcaaacagaggagatgaggcatggcagcttagaacctggcggcagcgcaaaagatg

SEQ ID NO: 184975 - DNA, 103 bp, Artificial Sequence
  Synthetic Polynucleotide
taatacgactcactatagggcagcttacacatgttcttgaagctaagctgaacagaggagacagcttatgttcaagaacaacctggcggcagcgcaaaagatg

SEQ ID NO: 184976 - DNA, 103 bp, Artificial Sequence
  Synthetic Polynucleotide
taatacgactcactataggggcaagggccgcagcttacacatgttcttgaaacagaggagatcaagaatgtgtgtaagcaacctggcggcagcgcaaaagatg

SEQ ID NO: 184977 - DNA, 103 bp, Artificial Sequence
  Synthetic Polynucleotide
taatacgactcactatagggggctccggcccccctggcccatcacctccaaacagaggagatggaggatgtgggccaggaacctggcggcagcgcaaaagatg

SEQ ID NO: 184978 - DNA, 103 bp, Artificial Sequence
  Synthetic Polynucleotide
taatacgactcactatagggcacttctgcagcaagggccgcagcttacacaacagaggagagtgtaaatggcggcccttaacctggcggcagcgcaaaagatg

SEQ ID NO: 184979 - DNA, 103 bp, Artificial Sequence
  Synthetic Polynucleotide
taatacgactcactatagggttcctccacccacttctgcagcaagggccgaacagaggagacggcccatgctgcagaagaacctggcggcagcgcaaaagatg

SEQ ID NO: 184980 - DNA, 103 bp, Artificial Sequence
  Synthetic Polynucleotide
taatacgactcactatagggtgttgtcagcttcctccacccacttctgcaaacagaggagatgcagaatggggtggaggaacctggcggcagcgcaaaagatg

SEQ ID NO: 184981 - DNA, 103 bp, Artificial Sequence
  Synthetic Polynucleotide
taatacgactcactatagggagattttcattgttgtcagcttcctccaccaacagaggagaggtggaatgagctgacaaaacctggcggcagcgcaaaagatg

SEQ ID NO: 184982 - DNA, 103 bp, Artificial Sequence
  Synthetic Polynucleotide
taatacgactcactatagggtatctcctgaagattttcattgttgtcagcaacagaggagagctgacatgaatgaaaataacctggcggcagcgcaaaagatg

SEQ ID NO: 184983 - DNA, 103 bp, Artificial Sequence
  Synthetic Polynucleotide
taatacgactcactatagggctgctttgcatatctcctgaagattttcataacagaggagaatgaaaatgttcaggagaaacctggcggcagcgcaaaagatg

SEQ ID NO: 184984 - DNA, 103 bp, Artificial Sequence
  Synthetic Polynucleotide
taatacgactcactatagggacgagggtttctgctttgcatatctcctgaaacagaggagatcaggaatgatgcaaagcaacctggcggcagcgcaaaagatg

SEQ ID NO: 184985 - DNA, 103 bp, Artificial Sequence
  Synthetic Polynucleotide
taatacgactcactatagggtcgggcctgcacgagggtttctgctttgcaaacagaggagatgcaaaatggaaaccctcaacctggcggcagcgcaaaagatg

SEQ ID NO: 184986 - DNA, 103 bp, Artificial Sequence
  Synthetic Polynucleotide
taatacgactcactataggggctttctctttcgggcctgcacgagggtttaacagaggagaaaacccatgtgcaggcccaacctggcggcagcgcaaaagatg

SEQ ID NO: 184987 - DNA, 103 bp, Artificial Sequence
  Synthetic Polynucleotide
taatacgactcactatagggatactggttcgctttctctttcgggcctgcaacagaggagagcaggcatgaaagagaaaaacctggcggcagcgcaaaagatg

SEQ ID NO: 184988 - DNA, 103 bp, Artificial Sequence
  Synthetic Polynucleotide
taatacgactcactatagggaacccagcccggctccggcccccctggcccaacagaggagagggccaatggggccggagaacctggcggcagcgcaaaagatg

SEQ ID NO: 184989 - DNA, 103 bp, Artificial Sequence
  Synthetic Polynucleotide
taatacgactcactatagggtcggttctcgatactggttcgctttctcttaacagaggagaaagagaatgcgaaccagtaacctggcggcagcgcaaaagatg

SEQ ID NO: 184990 - DNA, 103 bp, Artificial Sequence
  Synthetic Polynucleotide
taatacgactcactatagggtgcctctcactcggttctcgatactggttcaacagaggagagaaccaatgtcgagaaccaacctggcggcagcgcaaaagatg

SEQ ID NO: 184991 - DNA, 103 bp, Artificial Sequence
  Synthetic Polynucleotide
taatacgactcactatagggttctccaggttgcctctcactcggttctcgaacagaggagacgagaaatgagtgagaggaacctggcggcagcgcaaaagatg

SEQ ID NO: 184992 - DNA, 103 bp, Artificial Sequence
  Synthetic Polynucleotide
taatacgactcactatagggcaggaacaaattctccaggttgcctctcacaacagaggagagtgagaatgaacctggagaacctggcggcagcgcaaaagatg

SEQ ID NO: 184993 - DNA, 103 bp, Artificial Sequence
  Synthetic Polynucleotide
taatacgactcactatagggtcgggcactgcaggaacaaattctccaggtaacagaggagaacctggatgatttgttccaacctggcggcagcgcaaaagatg

SEQ ID NO: 184994 - DNA, 103 bp, Artificial Sequence
  Synthetic Polynucleotide
taatacgactcactatagggagtgtgggtttcgggcactgcaggaacaaaaacagaggagatttgttatggcagtgcccaacctggcggcagcgcaaaagatg

SEQ ID NO: 184995 - DNA, 103 bp, Artificial Sequence
  Synthetic Polynucleotide
taatacgactcactataggggatctgctgcagtgtgggtttcgggcactgaacagaggagacagtgcatgaaacccacaaacctggcggcagcgcaaaagatg

SEQ ID NO: 184996 - DNA, 103 bp, Artificial Sequence
  Synthetic Polynucleotide
taatacgactcactatagggcgatgtggctgatctgctgcagtgtgggttaacagaggagaaacccaatgtgcagcagaaacctggcggcagcgcaaaagatg

SEQ ID NO: 184997 - DNA, 103 bp, Artificial Sequence
  Synthetic Polynucleotide
taatacgactcactatagggagctgctgggcgatgtggctgatctgctgcaacagaggagagcagcaatgcagccacataacctggcggcagcgcaaaagatg

SEQ ID NO: 184998 - DNA, 103 bp, Artificial Sequence
  Synthetic Polynucleotide
taatacgactcactatagggctcgagcccaagctgctgggcgatgtggctaacagaggagaagccacatggcccagcagaacctggcggcagcgcaaaagatg

SEQ ID NO: 184999 - DNA, 103 bp, Artificial Sequence
  Synthetic Polynucleotide
taatacgactcactatagggtccgaggatcaacccagcccggctccggccaacagaggagaggccggatgcgggctgggaacctggcggcagcgcaaaagatg

SEQ ID NO: 185000 - DNA, 103 bp, Artificial Sequence
  Synthetic Polynucleotide
taatacgactcactatagggccacatccttctcgagcccaagctgctgggaacagaggagacccagcatgttgggctcgaacctggcggcagcgcaaaagatg

SEQ ID NO: 185001 - DNA, 103 bp, Artificial Sequence
  Synthetic Polynucleotide
taatacgactcactatagggcacactcggaccacatccttctcgagcccaaacagaggagatgggctatggaaggatgtaacctggcggcagcgcaaaagatg

SEQ ID NO: 185002 - DNA, 103 bp, Artificial Sequence
  Synthetic Polynucleotide
taatacgactcactataggggttacagaaccacactcggaccacatccttaacagaggagaaaggatatggtccgagtgaacctggcggcagcgcaaaagatg

SEQ ID NO: 185003 - DNA, 103 bp, Artificial Sequence
  Synthetic Polynucleotide
taatacgactcactatagggtctggcgccggttacagaaccacactcggaaacagaggagatccgagatgggttctgtaaacctggcggcagcgcaaaagatg

SEQ ID NO: 185004 - DNA, 103 bp, Artificial Sequence
  Synthetic Polynucleotide
taatacgactcactatagggcgcttgcccttctggcgccggttacagaacaacagaggagagttctgatgccggcgccaaacctggcggcagcgcaaaagatg

SEQ ID NO: 185005 - DNA, 103 bp, Artificial Sequence
  Synthetic Polynucleotide
taatacgactcactataggggctgcttgatcgcttgcccttctggcgccgaacagaggagacggcgcatgaagggcaagaacctggcggcagcgcaaaagatg

SEQ ID NO: 185006 - DNA, 103 bp, Artificial Sequence
  Synthetic Polynucleotide
taatacgactcactataggggtgcatagtcgctgcttgatcgcttgccctaacagaggagaagggcaatggatcaagcaaacctggcggcagcgcaaaagatg

SEQ ID NO: 185007 - DNA, 103 bp, Artificial Sequence
  Synthetic Polynucleotide
taatacgactcactatagggtcctctcgttgtgcatagtcgctgcttgataacagaggagaatcaagatgcgactatgcaacctggcggcagcgcaaaagatg

SEQ ID NO: 185008 - DNA, 103 bp, Artificial Sequence
  Synthetic Polynucleotide
taatacgactcactatagggagcctcaaaatcctctcgttgtgcatagtcaacagaggagagactatatgcaacgagagaacctggcggcagcgcaaaagatg

SEQ ID NO: 185009 - DNA, 103 bp, Artificial Sequence
  Synthetic Polynucleotide
taatacgactcactataggggagacccagcagcctcaaaatcctctcgttaacagaggagaaacgagatgattttgaggaacctggcggcagcgcaaaagatg

SEQ ID NO: 185010 - DNA, 103 bp, Artificial Sequence
  Synthetic Polynucleotide
taatacgactcactatagggcttagccaggtccgaggatcaacccagcccaacagaggagagggctgatgtgatcctcgaacctggcggcagcgcaaaagatg

SEQ ID NO: 185011 - DNA, 103 bp, Artificial Sequence
  Synthetic Polynucleotide
taatacgactcactatagggcctgagaaaggagacccagcagcctcaaaaaacagaggagattttgaatgtgctgggtcaacctggcggcagcgcaaaagatg

SEQ ID NO: 185012 - DNA, 103 bp, Artificial Sequence
  Synthetic Polynucleotide
taatacgactcactatagggcactggtccccctgagaaaggagacccagcaacagaggagagctgggatgcctttctcaaacctggcggcagcgcaaaagatg

SEQ ID NO: 185013 - DNA, 103 bp, Artificial Sequence
  Synthetic Polynucleotide
taatacgactcactataggggaggaaaggacactggtccccctgagaaagaacagaggagactttctatgggggaccagaacctggcggcagcgcaaaagatg

SEQ ID NO: 185014 - DNA, 103 bp, Artificial Sequence
  Synthetic Polynucleotide
taatacgactcactatagggcctggggccagaggaaaggacactggtcccaacagaggagagggaccatggtcctttccaacctggcggcagcgcaaaagatg

SEQ ID NO: 185015 - DNA, 103 bp, Artificial Sequence
  Synthetic Polynucleotide
taatacgactcactatagggaaaatggggccctggggccagaggaaaggaaacagaggagatcctttatgctggccccaaacctggcggcagcgcaaaagatg

SEQ ID NO: 185016 - DNA, 103 bp, Artificial Sequence
  Synthetic Polynucleotide
taatacgactcactatagggctggggtaccaaaatggggccctggggccaaacagaggagatggcccatgggccccattaacctggcggcagcgcaaaagatg

SEQ ID NO: 185017 - DNA, 103 bp, Artificial Sequence
  Synthetic Polynucleotide
taatacgactcactatagggctcccatagcctggggtaccaaaatggggcaacagaggagagccccaatgtggtaccccaacctggcggcagcgcaaaagatg

SEQ ID NO: 185018 - DNA, 103 bp, Artificial Sequence
  Synthetic Polynucleotide
taatacgactcactataggggaagtgagggctcccatagcctggggtaccaacagaggagaggtaccatgggctatgggaacctggcggcagcgcaaaagatg

SEQ ID NO: 185019 - DNA, 103 bp, Artificial Sequence
  Synthetic Polynucleotide
taatacgactcactatagggacagtgcagtgaagtgagggctcccatagcaacagaggagagctatgatggccctcactaacctggcggcagcgcaaaagatg

SEQ ID NO: 185020 - DNA, 103 bp, Artificial Sequence
  Synthetic Polynucleotide
taatacgactcactatagggaccgaggagtacagtgcagtgaagtgagggaacagaggagaccctcaatgcactgcactaacctggcggcagcgcaaaagatg

SEQ ID NO: 185021 - DNA, 103 bp, Artificial Sequence
  Synthetic Polynucleotide
taatacgactcactatagggagatgtctctgacccggctccaggatccataacagaggagaatggatatgggagccgggaacctggcggcagcgcaaaagatg

SEQ ID NO: 185022 - DNA, 103 bp, Artificial Sequence
  Synthetic Polynucleotide
taatacgactcactatagggctcagcagggagttgggcatccactccgacaacagaggagagtcggaatggatgcccaaaacctggcggcagcgcaaaagatg

SEQ ID NO: 185023 - DNA, 103 bp, Artificial Sequence
  Synthetic Polynucleotide
taatacgactcactatagggcgccacactagctgagttcactacccatggaacagaggagaccatggatggtgaactcaaacctggcggcagcgcaaaagatg

SEQ ID NO: 185024 - DNA, 103 bp, Artificial Sequence
  Synthetic Polynucleotide
taatacgactcactataggggtgctggggccgccacactagctgagttcaaacagaggagatgaactatgctagtgtggaacctggcggcagcgcaaaagatg

SEQ ID NO: 185025 - DNA, 103 bp, Artificial Sequence
  Synthetic Polynucleotide
taatacgactcactatagggctttgggctggtgctggggccgccacactaaacagaggagatagtgtatgggccccagcaacctggcggcagcgcaaaagatg

SEQ ID NO: 185026 - DNA, 103 bp, Artificial Sequence
  Synthetic Polynucleotide
taatacgactcactataggggacctgcaggctttgggctggtgctggggcaacagaggagagccccaatgccagcccaaaacctggcggcagcgcaaaagatg

SEQ ID NO: 185027 - DNA, 103 bp, Artificial Sequence
  Synthetic Polynucleotide
taatacgactcactatagggtcacggcctggacctgcaggctttgggctgaacagaggagacagcccatggcctgcaggaacctggcggcagcgcaaaagatg

SEQ ID NO: 185028 - DNA, 103 bp, Artificial Sequence
  Synthetic Polynucleotide
taatacgactcactatagggagctggggggtcacggcctggacctgcaggaacagaggagacctgcaatgccaggccgtaacctggcggcagcgcaaaagatg

SEQ ID NO: 185029 - DNA, 103 bp, Artificial Sequence
  Synthetic Polynucleotide
taatacgactcactataggggttcaacaacagctggggggtcacggcctgaacagaggagacaggccatgaccccccagaacctggcggcagcgcaaaagatg

SEQ ID NO: 185030 - DNA, 103 bp, Artificial Sequence
  Synthetic Polynucleotide
taatacgactcactatagggggccctgggcgttcaacaacagctggggggaacagaggagaccccccatgtgttgttgaaacctggcggcagcgcaaaagatg

SEQ ID NO: 185031 - DNA, 103 bp, Artificial Sequence
  Synthetic Polynucleotide
taatacgactcactataggggcaatcacctggccctgggcgttcaacaacaacagaggagagttgttatgcgcccagggaacctggcggcagcgcaaaagatg

SEQ ID NO: 185032 - DNA, 103 bp, Artificial Sequence
  Synthetic Polynucleotide
taatacgactcactatagggagccagggtcgcaatcacctggccctgggcaacagaggagagcccagatgcaggtgattaacctggcggcagcgcaaaagatg

SEQ ID NO: 185033 - DNA, 103 bp, Artificial Sequence
  Synthetic Polynucleotide
taatacgactcactatagggtgctctcttcctcagcagggagttgggcataacagaggagaatgcccatgtccctgctgaacctggcggcagcgcaaaagatg

SEQ ID NO: 185034 - DNA, 103 bp, Artificial Sequence
  Synthetic Polynucleotide
taatacgactcactataggggggggctgctagccagggtcgcaatcacctaacagaggagaaggtgaatgcgaccctggaacctggcggcagcgcaaaagatg

SEQ ID NO: 185035 - DNA, 103 bp, Artificial Sequence
  Synthetic Polynucleotide
taatacgactcactatagggggtggaggcagggggctgctagccagggtcaacagaggagagaccctatgtagcagcccaacctggcggcagcgcaaaagatg

SEQ ID NO: 185036 - DNA, 103 bp, Artificial Sequence
  Synthetic Polynucleotide
taatacgactcactataggggacagccacaggtggaggcagggggctgctaacagaggagaagcagcatgctgcctccaaacctggcggcagcgcaaaagatg

SEQ ID NO: 185037 - DNA, 103 bp, Artificial Sequence
  Synthetic Polynucleotide
taatacgactcactatagggttggcttccggacagccacaggtggaggcaaacagaggagatgcctcatgctgtggctgaacctggcggcagcgcaaaagatg

SEQ ID NO: 185038 - DNA, 103 bp, Artificial Sequence
  Synthetic Polynucleotide
taatacgactcactatagggtcaggtgtgcttggcttccggacagccacaaacagaggagatgtggcatgccggaagccaacctggcggcagcgcaaaagatg

SEQ ID NO: 185039 - DNA, 103 bp, Artificial Sequence
  Synthetic Polynucleotide
taatacgactcactatagggagcaggggactcaggtgtgcttggcttccgaacagaggagacggaagatgagcacacctaacctggcggcagcgcaaaagatg

SEQ ID NO: 185040 - DNA, 103 bp, Artificial Sequence
  Synthetic Polynucleotide
taatacgactcactatagggcctcactcttagcaggggactcaggtgtgcaacagaggagagcacacatgagtcccctgaacctggcggcagcgcaaaagatg

SEQ ID NO: 185041 - DNA, 103 bp, Artificial Sequence
  Synthetic Polynucleotide
taatacgactcactatagggatgggctgcacctcactcttagcaggggacaacagaggagagtccccatgtaagagtgaaacctggcggcagcgcaaaagatg

SEQ ID NO: 185042 - DNA, 103 bp, Artificial Sequence
  Synthetic Polynucleotide
taatacgactcactatagggtgtgggctggatgggctgcacctcactcttaacagaggagaaagagtatggtgcagcccaacctggcggcagcgcaaaagatg

SEQ ID NO: 185043 - DNA, 103 bp, Artificial Sequence
  Synthetic Polynucleotide
taatacgactcactataggggcacggttggtgtgggctggatgggctgcaaacagaggagatgcagcatgtccagcccaaacctggcggcagcgcaaaagatg

SEQ ID NO: 185044 - DNA, 103 bp, Artificial Sequence
  Synthetic Polynucleotide
taatacgactcactatagggtccagtcctttgctctcttcctcagcagggaacagaggagaccctgcatgggaagagagaacctggcggcagcgcaaaagatg

SEQ ID NO: 185045 - DNA, 103 bp, Artificial Sequence
  Synthetic Polynucleotide
taatacgactcactataggggcaggctggggcacggttggtgtgggctggaacagaggagaccagccatgaccaaccgtaacctggcggcagcgcaaaagatg

SEQ ID NO: 185046 - DNA, 103 bp, Artificial Sequence
  Synthetic Polynucleotide
taatacgactcactatagggaatgaccacagcaggctggggcacggttggaacagaggagaccaaccatgccccagcctaacctggcggcagcgcaaaagatg

SEQ ID NO: 185047 - DNA, 103 bp, Artificial Sequence
  Synthetic Polynucleotide
taatacgactcactatagggctgggctggcaatgaccacagcaggctgggaacagaggagacccagcatgctgtggtcaaacctggcggcagcgcaaaagatg

SEQ ID NO: 185048 - DNA, 103 bp, Artificial Sequence
  Synthetic Polynucleotide
taatacgactcactataggggcggctggagctgggctggcaatgaccacaaacagaggagatgtggtatgtgccagcccaacctggcggcagcgcaaaagatg

SEQ ID NO: 185049 - DNA, 103 bp, Artificial Sequence
  Synthetic Polynucleotide
taatacgactcactatagggagatggcttggcggctggagctgggctggcaacagaggagagccagcatggctccagccaacctggcggcagcgcaaaagatg

SEQ ID NO: 185050 - DNA, 103 bp, Artificial Sequence
  Synthetic Polynucleotide
taatacgactcactataggggagcagaggcagatggcttggcggctggagaacagaggagactccagatgccaagccataacctggcggcagcgcaaaagatg

SEQ ID NO: 185051 - DNA, 103 bp, Artificial Sequence
  Synthetic Polynucleotide
taatacgactcactatagggattgggataggagcagaggcagatggcttgaacagaggagacaagccatgtgcctctgcaacctggcggcagcgcaaaagatg

SEQ ID NO: 185052 - DNA, 103 bp, Artificial Sequence
  Synthetic Polynucleotide
taatacgactcactatagggtgagcaggtaattgggataggagcagaggcaacagaggagagcctctatgcctatcccaaacctggcggcagcgcaaaagatg

SEQ ID NO: 185053 - DNA, 103 bp, Artificial Sequence
  Synthetic Polynucleotide
taatacgactcactatagggtgggggtctctgagcaggtaattgggatagaacagaggagactatccatgttacctgctaacctggcggcagcgcaaaagatg

SEQ ID NO: 185054 - DNA, 103 bp, Artificial Sequence
  Synthetic Polynucleotide
taatacgactcactatagggtggctgacggtgggggtctctgagcaggtaaacagaggagatacctgatgagagaccccaacctggcggcagcgcaaaagatg

SEQ ID NO: 185055 - DNA, 103 bp, Artificial Sequence
  Synthetic Polynucleotide
taatacgactcactatagggggccacaccctccagtcctttgctctcttcaacagaggagagaagagatgaaaggactgaacctggcggcagcgcaaaagatg

SEQ ID NO: 185056 - DNA, 103 bp, Artificial Sequence
  Synthetic Polynucleotide
taatacgactcactatagggggacaccaactggctgacggtgggggtctcaacagaggagagagaccatgaccgtcagcaacctggcggcagcgcaaaagatg

SEQ ID NO: 185057 - DNA, 103 bp, Artificial Sequence
  Synthetic Polynucleotide
taatacgactcactatagggtatgtggcttggacaccaactggctgacggaacagaggagaccgtcaatgagttggtgtaacctggcggcagcgcaaaagatg

SEQ ID NO: 185058 - DNA, 103 bp, Artificial Sequence
  Synthetic Polynucleotide
taatacgactcactatagggagacttggagtatgtggcttggacaccaacaacagaggagagttggtatgcaagccacaaacctggcggcagcgcaaaagatg

SEQ ID NO: 185059 - DNA, 103 bp, Artificial Sequence
  Synthetic Polynucleotide
taatacgactcactatagggatcctcatccagacttggagtatgtggcttaacagaggagaaagccaatgactccaagtaacctggcggcagcgcaaaagatg

SEQ ID NO: 185060 - DNA, 103 bp, Artificial Sequence
  Synthetic Polynucleotide
taatacgactcactatagggagttgatcccatcctcatccagacttggagaacagaggagactccaaatgtggatgaggaacctggcggcagcgcaaaagatg

SEQ ID NO: 185061 - DNA, 103 bp, Artificial Sequence
  Synthetic Polynucleotide
taatacgactcactatagggatctcttctaagttgatcccatcctcatccaacagaggagaggatgaatgtgggatcaaaacctggcggcagcgcaaaagatg

SEQ ID NO: 185062 - DNA, 103 bp, Artificial Sequence
  Synthetic Polynucleotide
taatacgactcactatagggaaactcccggatctcttctaagttgatcccaacagaggagagggatcatgttagaagagaacctggcggcagcgcaaaagatg

SEQ ID NO: 185063 - DNA, 103 bp, Artificial Sequence
  Synthetic Polynucleotide
taatacgactcactatagggagttcttggcaaactcccggatctcttctaaacagaggagatagaagatgtccgggagtaacctggcggcagcgcaaaagatg

SEQ ID NO: 185064 - DNA, 103 bp, Artificial Sequence
  Synthetic Polynucleotide
taatacgactcactatagggcggatcttaaagttcttggcaaactcccggaacagaggagaccgggaatgtgccaagaaaacctggcggcagcgcaaaagatg

SEQ ID NO: 185065 - DNA, 103 bp, Artificial Sequence
  Synthetic Polynucleotide
taatacgactcactatagggcgagagccgccggatcttaaagttcttggcaacagaggagagccaagatgtttaagatcaacctggcggcagcgcaaaagatg

SEQ ID NO: 185066 - DNA, 103 bp, Artificial Sequence
  Synthetic Polynucleotide
taatacgactcactatagggagccctcggcggccacaccctccagtccttaacagaggagaaaggacatgagggtgtggaacctggcggcagcgcaaaagatg

SEQ ID NO: 185067 - DNA, 103 bp, Artificial Sequence
  Synthetic Polynucleotide
taatacgactcactatagggtaaggcccagcgagagccgccggatcttaaaacagaggagattaagaatgggcggctctaacctggcggcagcgcaaaagatg

SEQ ID NO: 185068 - DNA, 103 bp, Artificial Sequence
  Synthetic Polynucleotide
taatacgactcactatagggtgggtctgtgtaaggcccagcgagagccgcaacagaggagagcggctatggctgggcctaacctggcggcagcgcaaaagatg

SEQ ID NO: 185069 - DNA, 103 bp, Artificial Sequence
  Synthetic Polynucleotide
taatacgactcactatagggctgacccacctgggtctgtgtaaggcccagaacagaggagactgggcatgacacagaccaacctggcggcagcgcaaaagatg

SEQ ID NO: 185070 - DNA, 103 bp, Artificial Sequence
  Synthetic Polynucleotide
taatacgactcactatagggcagtcagagcctgacccacctgggtctgtgaacagaggagacacagaatgaggtgggtcaacctggcggcagcgcaaaagatg

SEQ ID NO: 185071 - DNA, 103 bp, Artificial Sequence
  Synthetic Polynucleotide
taatacgactcactatagggccttccgttgcagtcagagcctgacccaccaacagaggagaggtgggatgggctctgacaacctggcggcagcgcaaaagatg

SEQ ID NO: 185072 - DNA, 103 bp, Artificial Sequence
  Synthetic Polynucleotide
taatacgactcactataggggtaggctggaccttccgttgcagtcagagcaacagaggagagctctgatggcaacggaaaacctggcggcagcgcaaaagatg

SEQ ID NO: 185073 - DNA, 103 bp, Artificial Sequence
  Synthetic Polynucleotide
taatacgactcactatagggctgactggctgtaggctggaccttccgttgaacagaggagacaacggatggtccagcctaacctggcggcagcgcaaaagatg

SEQ ID NO: 185074 - DNA, 103 bp, Artificial Sequence
  Synthetic Polynucleotide
taatacgactcactatagggcggcagatggctgactggctgtaggctggaaacagaggagatccagcatgcagccagtcaacctggcggcagcgcaaaagatg

SEQ ID NO: 185075 - DNA, 103 bp, Artificial Sequence
  Synthetic Polynucleotide
taatacgactcactatagggcttctcgaaccggcagatggctgactggctaacagaggagaagccagatggccatctgcaacctggcggcagcgcaaaagatg

SEQ ID NO: 185076 - DNA, 103 bp, Artificial Sequence
  Synthetic Polynucleotide
taatacgactcactatagggtgatgtctagcttctcgaaccggcagatggaacagaggagaccatctatgggttcgagaaacctggcggcagcgcaaaagatg

SEQ ID NO: 185077 - DNA, 103 bp, Artificial Sequence
  Synthetic Polynucleotide
taatacgactcactatagggccgctctgggagccctcggcggccacacccaacagaggagagggtgtatgcgccgagggaacctggcggcagcgcaaaagatg

SEQ ID NO: 185078 - DNA, 103 bp, Artificial Sequence
  Synthetic Polynucleotide
taatacgactcactatagggctcttgggtgtgatgtctagcttctcgaacaacagaggagagttcgaatggctagacataacctggcggcagcgcaaaagatg

SEQ ID NO: 185079 - DNA, 103 bp, Artificial Sequence
  Synthetic Polynucleotide
taatacgactcactatagggcttctgggcactcttgggtgtgatgtctagaacagaggagactagacatgacacccaagaacctggcggcagcgcaaaagatg

SEQ ID NO: 185080 - DNA, 103 bp, Artificial Sequence
  Synthetic Polynucleotide
taatacgactcactatagggccggctttagcttctgggcactcttgggtgaacagaggagacacccaatggtgcccagaaacctggcggcagcgcaaaagatg

SEQ ID NO: 185081 - DNA, 103 bp, Artificial Sequence
  Synthetic Polynucleotide
taatacgactcactatagggttttccagcaccggctttagcttctgggcaaacagaggagatgcccaatggctaaagccaacctggcggcagcgcaaaagatg

SEQ ID NO: 185082 - DNA, 103 bp, Artificial Sequence
  Synthetic Polynucleotide
taatacgactcactataggggtttagccacttttccagcaccggctttagaacagaggagactaaagatggtgctggaaaacctggcggcagcgcaaaagatg

SEQ ID NO: 185083 - DNA, 103 bp, Artificial Sequence
  Synthetic Polynucleotide
taatacgactcactataggggttcagcttcgtttagccacttttccagcaaacagaggagatgctggatgagtggctaaaacctggcggcagcgcaaaagatg

SEQ ID NO: 185084 - DNA, 103 bp, Artificial Sequence
  Synthetic Polynucleotide
taatacgactcactatagggtggttccgcagttcagcttcgtttagccacaacagaggagagtggctatgcgaagctgaaacctggcggcagcgcaaaagatg

SEQ ID NO: 185085 - DNA, 103 bp, Artificial Sequence
  Synthetic Polynucleotide
taatacgactcactatagggctggccttcctggttccgcagttcagcttcaacagaggagagaagctatgctgcggaacaacctggcggcagcgcaaaagatg

SEQ ID NO: 185086 - DNA, 103 bp, Artificial Sequence
  Synthetic Polynucleotide
taatacgactcactatagggtcaggttctgctggccttcctggttccgcaaacagaggagatgcggaatgaggaaggccaacctggcggcagcgcaaaagatg

SEQ ID NO: 185087 - DNA, 103 bp, Artificial Sequence
  Synthetic Polynucleotide
taatacgactcactatagggacaaactccatcaggttctgctggccttccaacagaggagaggaaggatggcagaacctaacctggcggcagcgcaaaagatg

SEQ ID NO: 185088 - DNA, 103 bp, Artificial Sequence
  Synthetic Polynucleotide
taatacgactcactatagggagcagggtctccgctctgggagccctcggcaacagaggagagccgagatgtcccagagcaacctggcggcagcgcaaaagatg

SEQ ID NO: 185089 - DNA, 103 bp, Artificial Sequence
  Synthetic Polynucleotide
taatacgactcactatagggctcgcctcccacaaactccatcaggttctgaacagaggagacagaacatgatggagtttaacctggcggcagcgcaaaagatg

SEQ ID NO: 185090 - DNA, 103 bp, Artificial Sequence
  Synthetic Polynucleotide
taatacgactcactatagggtcttggagggctcgcctcccacaaactccaaacagaggagatggagtatgtgggaggcgaacctggcggcagcgcaaaagatg

SEQ ID NO: 185091 - DNA, 103 bp, Artificial Sequence
  Synthetic Polynucleotide
taatacgactcactatagggcgtttgcgtttcttggagggctcgcctcccaacagaggagagggaggatggccctccaaaacctggcggcagcgcaaaagatg

SEQ ID NO: 185092 - DNA, 103 bp, Artificial Sequence
  Synthetic Polynucleotide
taatacgactcactatagggggaggtgcggcgtttgcgtttcttggagggaacagaggagaccctccatgaaacgcaaaaacctggcggcagcgcaaaagatg

SEQ ID NO: 185093 - DNA, 103 bp, Artificial Sequence
  Synthetic Polynucleotide
taatacgactcactatagggggggggtgaaggaggtgcggcgtttgcgttaacagaggagaaacgcaatggccgcacctaacctggcggcagcgcaaaagatg

SEQ ID NO: 185094 - DNA, 103 bp, Artificial Sequence
  Synthetic Polynucleotide
taatacgactcactatagggtctatggcctggggggtgaaggaggtgcggaacagaggagaccgcacatgcttcaccccaacctggcggcagcgcaaaagatg

SEQ ID NO: 185095 - DNA, 103 bp, Artificial Sequence
  Synthetic Polynucleotide
taatacgactcactatagggattgagagcctctatggcctggggggtgaaaacagaggagattcaccatgcaggccataaacctggcggcagcgcaaaagatg

SEQ ID NO: 185096 - DNA, 103 bp, Artificial Sequence
  Synthetic Polynucleotide
taatacgactcactatagggcaaaataggcattgagagcctctatggcctaacagaggagaaggccaatgaggctctcaaacctggcggcagcgcaaaagatg

SEQ ID NO: 185097 - DNA, 103 bp, Artificial Sequence
  Synthetic Polynucleotide
taatacgactcactataggggggttcttctcaaaataggcattgagagccaacagaggagaggctctatgtgcctatttaacctggcggcagcgcaaaagatg

SEQ ID NO: 185098 - DNA, 103 bp, Artificial Sequence
  Synthetic Polynucleotide
taatacgactcactatagggtgtgggcagtgggttcttctcaaaataggcaacagaggagagcctatatggagaagaacaacctggcggcagcgcaaaagatg

SEQ ID NO: 185099 - DNA, 103 bp, Artificial Sequence
  Synthetic Polynucleotide
taatacgactcactataggggactggcttcagcagggtctccgctctgggaacagaggagacccagaatggagaccctgaacctggcggcagcgcaaaagatg

SEQ ID NO: 185100 - DNA, 103 bp, Artificial Sequence
  Synthetic Polynucleotide
taatacgactcactatagggtctcctggcctgtgggcagtgggttcttctaacagaggagaagaagaatgcactgcccaaacctggcggcagcgcaaaagatg

SEQ ID NO: 185101 - DNA, 103 bp, Artificial Sequence
  Synthetic Polynucleotide
taatacgactcactatagggatttcagtgatctcctggcctgtgggcagtaacagaggagaactgccatgaggccaggaaacctggcggcagcgcaaaagatg

SEQ ID NO: 185102 - DNA, 103 bp, Artificial Sequence
  Synthetic Polynucleotide
taatacgactcactatagggctccttagcaatttcagtgatctcctggccaacagaggagaggccagatgatcactgaaaacctggcggcagcgcaaaagatg

SEQ ID NO: 185103 - DNA, 103 bp, Artificial Sequence
  Synthetic Polynucleotide
taatacgactcactatagggcgtagttgagctccttagcaatttcagtgaaacagaggagatcactgatgttgctaaggaacctggcggcagcgcaaaagatg

SEQ ID NO: 185104 - DNA, 103 bp, Artificial Sequence
  Synthetic Polynucleotide
taatacgactcactatagggacctcacggtcgtagttgagctccttagcaaacagaggagatgctaaatggctcaactaaacctggcggcagcgcaaaagatg

SEQ ID NO: 185105 - DNA, 103 bp, Artificial Sequence
  Synthetic Polynucleotide
taatacgactcactataggggacccgcactacctcacggtcgtagttgagaacagaggagactcaacatggaccgtgagaacctggcggcagcgcaaaagatg

SEQ ID NO: 185106 - DNA, 103 bp, Artificial Sequence
  Synthetic Polynucleotide
taatacgactcactatagggtgcagaaccagacccgcactacctcacggtaacagaggagaaccgtgatgtagtgcgggaacctggcggcagcgcaaaagatg

SEQ ID NO: 185107 - DNA, 103 bp, Artificial Sequence
  Synthetic Polynucleotide
taatacgactcactatagggtggcgccgattgcagaaccagacccgcactaacagaggagaagtgcgatgctggttctgaacctggcggcagcgcaaaagatg

SEQ ID NO: 185108 - DNA, 103 bp, Artificial Sequence
  Synthetic Polynucleotide
taatacgactcactatagggcttgagcgtctggcgccgattgcagaaccaaacagaggagatggttcatgaatcggcgcaacctggcggcagcgcaaaagatg

SEQ ID NO: 185109 - DNA, 103 bp, Artificial Sequence
  Synthetic Polynucleotide
taatacgactcactatagggtgctggtgttcttgagcgtctggcgccgataacagaggagaatcggcatgagacgctcaaacctggcggcagcgcaaaagatg

SEQ ID NO: 185110 - DNA, 103 bp, Artificial Sequence
  Synthetic Polynucleotide
taatacgactcactatagggccagcagcttgactggcttcagcagggtctaacagaggagaagacccatgtgaagccagaacctggcggcagcgcaaaagatg

SEQ ID NO: 185111 - DNA, 103 bp, Artificial Sequence
  Synthetic Polynucleotide
taatacgactcactatagggacgttcagcttgctggtgttcttgagcgtcaacagaggagagacgctatggaacaccagaacctggcggcagcgcaaaagatg

SEQ ID NO: 185112 - DNA, 103 bp, Artificial Sequence
  Synthetic Polynucleotide
taatacgactcactataggggatctgaaagacgttcagcttgctggtgttaacagaggagaaacaccatgaagctgaacaacctggcggcagcgcaaaagatg

SEQ ID NO: 185113 - DNA, 103 bp, Artificial Sequence
  Synthetic Polynucleotide
taatacgactcactatagggcccagcttcaccagcagcttgactggcttcaacagaggagagaagccatgcaagctgctaacctggcggcagcgcaaaagatg

SEQ ID NO: 185114 - DNA, 103 bp, Artificial Sequence
  Synthetic Polynucleotide
taatacgactcactatagggtgacagtcagagatgtctctgacccggctcaacagaggagagagccgatgcagagacataacctggcggcagcgcaaaagatg

SEQ ID NO: 185115 - DNA, 103 bp, Artificial Sequence
  Synthetic Polynucleotide
taatacgactcactatagggggttgtctggcccagcttcaccagcagcttaacagaggagaaagctgatggtgaagctgaacctggcggcagcgcaaaagatg

SEQ ID NO: 185116 - DNA, 103 bp, Artificial Sequence
  Synthetic Polynucleotide
taatacgactcactataggggaggagcccaggttgtctggcccagcttcaaacagaggagatgaagcatggccagacaaaacctggcggcagcgcaaaagatg

SEQ ID NO: 185117 - DNA, 103 bp, Artificial Sequence
  Synthetic Polynucleotide
taatacgactcactatagggtgcctctgcagaggagcccaggttgtctggaacagaggagaccagacatgctgggctccaacctggcggcagcgcaaaagatg

SEQ ID NO: 185118 - DNA, 103 bp, Artificial Sequence
  Synthetic Polynucleotide
taatacgactcactatagggacttcacagttgcctctgcagaggagcccaaacagaggagatgggctatgctgcagaggaacctggcggcagcgcaaaagatg

SEQ ID NO: 185119 - DNA, 103 bp, Artificial Sequence
  Synthetic Polynucleotide
taatacgactcactatagggcccgggggtgacttcacagttgcctctgcaaacagaggagatgcagaatgaactgtgaaaacctggcggcagcgcaaaagatg

SEQ ID NO: 185120 - DNA, 103 bp, Artificial Sequence
  Synthetic Polynucleotide
taatacgactcactatagggcggagggatccccgggggtgacttcacagtaacagaggagaactgtgatgtcacccccgaacctggcggcagcgcaaaagatg

SEQ ID NO: 185121 - DNA, 103 bp, Artificial Sequence
  Synthetic Polynucleotide
taatacgactcactatagggtggcagggctcggagggatccccgggggtgaacagaggagacaccccatgggatccctcaacctggcggcagcgcaaaagatg

SEQ ID NO: 185122 - DNA, 103 bp, Artificial Sequence
  Synthetic Polynucleotide
taatacgactcactataggggcaatggcagtggcagggctcggagggatcaacagaggagagatcccatggagccctgcaacctggcggcagcgcaaaagatg

SEQ ID NO: 185123 - DNA, 103 bp, Artificial Sequence
  Synthetic Polynucleotide
taatacgactcactataggggctgaaggtggcaatggcagtggcagggctaacagaggagaagccctatgactgccattaacctggcggcagcgcaaaagatg

SEQ ID NO: 185124 - DNA, 103 bp, Artificial Sequence
  Synthetic Polynucleotide
taatacgactcactatagggttggggcttggctgaaggtggcaatggcagaacagaggagactgccaatgccaccttcaaacctggcggcagcgcaaaagatg

SEQ ID NO: 185125 - DNA, 103 bp, Artificial Sequence
  Synthetic Polynucleotide
taatacgactcactatagggacctgctcattgacagtcagagatgtctctaacagaggagaagagacatgtctgactgtaacctggcggcagcgcaaaagatg

SEQ ID NO: 185126 - DNA, 103 bp, Artificial Sequence
  Synthetic Polynucleotide
taatacgactcactatagggtgaggctggcttggggcttggctgaaggtgaacagaggagacaccttatgccaagccccaacctggcggcagcgcaaaagatg

SEQ ID NO: 185127 - DNA, 103 bp, Artificial Sequence
  Synthetic Polynucleotide
taatacgactcactatagggctgcgatgcctgaggctggcttggggcttgaacagaggagacaagccatgagccagcctaacctggcggcagcgcaaaagatg

SEQ ID NO: 185128 - DNA, 103 bp, Artificial Sequence
  Synthetic Polynucleotide
taatacgactcactataggggcgtcagggtctgcgatgcctgaggctggcaacagaggagagccagcatgaggcatcgcaacctggcggcagcgcaaaagatg

SEQ ID NO: 185129 - DNA, 103 bp, Artificial Sequence
  Synthetic Polynucleotide
taatacgactcactatagggacagccagtggcgtcagggtctgcgatgccaacagaggagaggcatcatggaccctgacaacctggcggcagcgcaaaagatg

SEQ ID NO: 185130 - DNA, 103 bp, Artificial Sequence
  Synthetic Polynucleotide
taatacgactcactatagggggcagcttgtacagccagtggcgtcagggtaacagaggagaaccctgatgccactggctaacctggcggcagcgcaaaagatg

SEQ ID NO: 185131 - DNA, 103 bp, Artificial Sequence
  Synthetic Polynucleotide
taatacgactcactatagggagacctggggggcagcttgtacagccagtgaacagaggagacactggatgtacaagctgaacctggcggcagcgcaaaagatg

SEQ ID NO: 185132 - DNA, 103 bp, Artificial Sequence
  Synthetic Polynucleotide
taatacgactcactatagggtcctgagtcaagacctggggggcagcttgtaacagaggagaacaagcatgcccccaggtaacctggcggcagcgcaaaagatg

SEQ ID NO: 185133 - DNA, 103 bp, Artificial Sequence
  Synthetic Polynucleotide
taatacgactcactatagggggctaagttttcctgagtcaagacctggggaacagaggagaccccagatgttgactcagaacctggcggcagcgcaaaagatg

SEQ ID NO: 185134 - DNA, 103 bp, Artificial Sequence
  Synthetic Polynucleotide
taatacgactcactatagggtcagaactgtggctaagttttcctgagtcaaacagaggagatgactcatgaaaacttagaacctggcggcagcgcaaaagatg

SEQ ID NO: 185135 - DNA, 103 bp, Artificial Sequence
  Synthetic Polynucleotide
taatacgactcactatagggataactcctgtcagaactgtggctaagtttaacagaggagaaaacttatgcacagttctaacctggcggcagcgcaaaagatg

SEQ ID NO: 185136 - DNA, 103 bp, Artificial Sequence
  Synthetic Polynucleotide
taatacgactcactatagggcatcacgatgacctgctcattgacagtcagaacagaggagactgactatgaatgagcagaacctggcggcagcgcaaaagatg

SEQ ID NO: 185137 - DNA, 103 bp, Artificial Sequence
  Synthetic Polynucleotide
taatacgactcactatagggtgctggaaccataactcctgtcagaactgtaacagaggagaacagttatgacaggagttaacctggcggcagcgcaaaagatg

SEQ ID NO: 185138 - DNA, 103 bp, Artificial Sequence
  Synthetic Polynucleotide
taatacgactcactatagggtaactgcccctgctggaaccataactcctgaacagaggagacaggagatgtggttccagaacctggcggcagcgcaaaagatg

SEQ ID NO: 185139 - DNA, 103 bp, Artificial Sequence
  Synthetic Polynucleotide
taatacgactcactatagggagaggttgagtaactgcccctgctggaaccaacagaggagaggttccatgaggggcagtaacctggcggcagcgcaaaagatg

SEQ ID NO: 185140 - DNA, 103 bp, Artificial Sequence
  Synthetic Polynucleotide
taatacgactcactatagggggggataagaagaggttgagtaactgccccaacagaggagaggggcaatgactcaacctaacctggcggcagcgcaaaagatg

SEQ ID NO: 185141 - DNA, 103 bp, Artificial Sequence
  Synthetic Polynucleotide
taatacgactcactatagggcaatactgatggggataagaagaggttgagaacagaggagactcaacatgttcttatccaacctggcggcagcgcaaaagatg

SEQ ID NO: 185142 - DNA, 103 bp, Artificial Sequence
  Synthetic Polynucleotide
taatacgactcactatagggacttgacctgcaatactgatggggataagaaacagaggagatcttatatgcatcagtataacctggcggcagcgcaaaagatg

SEQ ID NO: 185143 - DNA, 103 bp, Artificial Sequence
  Synthetic Polynucleotide
taatacgactcactatagggctgaccagccacttgacctgcaatactgataacagaggagaatcagtatggcaggtcaaaacctggcggcagcgcaaaagatg

SEQ ID NO: 185144 - DNA, 103 bp, Artificial Sequence
  Synthetic Polynucleotide
taatacgactcactatagggccagcccctgctgaccagccacttgacctgaacagaggagacaggtcatgtggctggtcaacctggcggcagcgcaaaagatg

SEQ ID NO: 185145 - DNA, 103 bp, Artificial Sequence
  Synthetic Polynucleotide
taatacgactcactataggggtccacacggccagcccctgctgaccagccaacagaggagaggctggatggcaggggctaacctggcggcagcgcaaaagatg

SEQ ID NO: 185146 - DNA, 103 bp, Artificial Sequence
  Synthetic Polynucleotide
taatacgactcactatagggtgtaggaattgtccacacggccagcccctgaacagaggagacaggggatggccgtgtggaacctggcggcagcgcaaaagatg

SEQ ID NO: 185147 - DNA, 103 bp, Artificial Sequence
  Synthetic Polynucleotide
taatacgactcactatagggcatgacctgacatcacgatgacctgctcataacagaggagaatgagcatgtcatcgtgaaacctggcggcagcgcaaaagatg

SEQ ID NO: 185148 - DNA, 103 bp, Artificial Sequence
  Synthetic Polynucleotide
taatacgactcactatagggccacagttgctgtaggaattgtccacacggaacagaggagaccgtgtatgcaattcctaaacctggcggcagcgcaaaagatg

SEQ ID NO: 185149 - DNA, 103 bp, Artificial Sequence
  Synthetic Polynucleotide
taatacgactcactataggggggagggcagccacagttgctgtaggaattaacagaggagaaattccatgagcaactgtaacctggcggcagcgcaaaagatg

SEQ ID NO: 185150 - DNA, 103 bp, Artificial Sequence
  Synthetic Polynucleotide
taatacgactcactatagggggtcagtcctgggagggcagccacagttgcaacagaggagagcaactatggctgccctcaacctggcggcagcgcaaaagatg

SEQ ID NO: 185151 - DNA, 103 bp, Artificial Sequence
  Synthetic Polynucleotide
taatacgactcactataggggagaagcagcggtcagtcctgggagggcagaacagaggagactgcccatgcaggactgaaacctggcggcagcgcaaaagatg

SEQ ID NO: 185152 - DNA, 103 bp, Artificial Sequence
  Synthetic Polynucleotide
taatacgactcactatagggccccccgtaggagaagcagcggtcagtcctaacagaggagaaggactatgcgctgcttcaacctggcggcagcgcaaaagatg

SEQ ID NO: 185153 - DNA, 103 bp, Artificial Sequence
  Synthetic Polynucleotide
taatacgactcactatagggcttgaacactccccccgtaggagaagcagcaacagaggagagctgctatgcctacggggaacctggcggcagcgcaaaagatg

SEQ ID NO: 185154 - DNA, 103 bp, Artificial Sequence
  Synthetic Polynucleotide
taatacgactcactatagggctaaaggtggcttgaacactccccccgtagaacagaggagactacggatggagtgttcaaacctggcggcagcgcaaaagatg

SEQ ID NO: 185155 - DNA, 103 bp, Artificial Sequence
  Synthetic Polynucleotide
taatacgactcactatagggtggagaccggctaaaggtggcttgaacactaacagaggagaagtgttatggccacctttaacctggcggcagcgcaaaagatg

SEQ ID NO: 185156 - DNA, 103 bp, Artificial Sequence
  Synthetic Polynucleotide
taatacgactcactatagggagcagctgcttggagaccggctaaaggtggaacagaggagaccacctatggccggtctcaacctggcggcagcgcaaaagatg

SEQ ID NO: 185157 - DNA, 103 bp, Artificial Sequence
  Synthetic Polynucleotide
taatacgactcactatagggtgttcagcacagcagctgcttggagaccggaacagaggagaccggtcatgaagcagctgaacctggcggcagcgcaaaagatg

SEQ ID NO: 185158 - DNA, 103 bp, Artificial Sequence
  Synthetic Polynucleotide
taatacgactcactatagggcggatggtctcatgacctgacatcacgatgaacagaggagacatcgtatggtcaggtcaaacctggcggcagcgcaaaagatg

SEQ ID NO: 185159 - DNA, 103 bp, Artificial Sequence
  Synthetic Polynucleotide
taatacgactcactatagggggaagagcggtgttcagcacagcagctgctaacagaggagaagcagcatgtgtgctgaaaacctggcggcagcgcaaaagatg

SEQ ID NO: 185160 - DNA, 103 bp, Artificial Sequence
  Synthetic Polynucleotide
taatacgactcactatagggtaccggtgccggaagagcggtgttcagcacaacagaggagagtgctgatgaccgctcttaacctggcggcagcgcaaaagatg

SEQ ID NO: 185161 - DNA, 103 bp, Artificial Sequence
  Synthetic Polynucleotide
taatacgactcactatagggcggcagcttgtaccggtgccggaagagcggaacagaggagaccgctcatgcggcaccggaacctggcggcagcgcaaaagatg

SEQ ID NO: 185162 - DNA, 103 bp, Artificial Sequence
  Synthetic Polynucleotide
taatacgactcactatagggtgtactggtgcggcagcttgtaccggtgccaacagaggagaggcaccatgacaagctgcaacctggcggcagcgcaaaagatg

SEQ ID NO: 185163 - DNA, 103 bp, Artificial Sequence
  Synthetic Polynucleotide
taatacgactcactatagggcgaggaggcctgtactggtgcggcagcttgaacagaggagacaagctatggcaccagtaaacctggcggcagcgcaaaagatg

SEQ ID NO: 185164 - DNA, 103 bp, Artificial Sequence
  Synthetic Polynucleotide
taatacgactcactataggggttgggccgtcgaggaggcctgtactggtgaacagaggagacaccagatgaggcctcctaacctggcggcagcgcaaaagatg

SEQ ID NO: 185165 - DNA, 103 bp, Artificial Sequence
  Synthetic Polynucleotide
taatacgactcactatagggggtggccggggttgggccgtcgaggaggccaacagaggagaggcctcatggacggcccaaacctggcggcagcgcaaaagatg

SEQ ID NO: 185166 - DNA, 103 bp, Artificial Sequence
  Synthetic Polynucleotide
taatacgactcactataggggggctgggctggtggccggggttgggccgtaacagaggagaacggccatgccccggccaaacctggcggcagcgcaaaagatg

SEQ ID NO: 185167 - DNA, 103 bp, Artificial Sequence
  Synthetic Polynucleotide
taatacgactcactatagggacagcgtctggggctgggctggtggccgggaacagaggagacccggcatgcagcccagcaacctggcggcagcgcaaaagatg

SEQ ID NO: 185168 - DNA, 103 bp, Artificial Sequence
  Synthetic Polynucleotide
taatacgactcactatagggtgggtctggaacagcgtctggggctgggctaacagaggagaagcccaatgccagacgctaacctggcggcagcgcaaaagatg

SEQ ID NO: 185169 - DNA, 103 bp, Artificial Sequence
  Synthetic Polynucleotide
taatacgactcactatagggttccagcactcggatggtctcatgacctgaaacagaggagatcaggtatggagaccatcaacctggcggcagcgcaaaagatg

SEQ ID NO: 185170 - DNA, 103 bp, Artificial Sequence
  Synthetic Polynucleotide
taatacgactcactatagggcagcagcggctgggtctggaacagcgtctgaacagaggagacagacgatgttccagaccaacctggcggcagcgcaaaagatg

SEQ ID NO: 185171 - DNA, 103 bp, Artificial Sequence
  Synthetic Polynucleotide
taatacgactcactataggggtgtggtctgcagcagcggctgggtctggaaacagaggagatccagaatgagccgctgcaacctggcggcagcgcaaaagatg

SEQ ID NO: 185172 - DNA, 103 bp, Artificial Sequence
  Synthetic Polynucleotide
taatacgactcactatagggaggatggcaggtgtggtctgcagcagcggcaacagaggagagccgctatggcagaccacaacctggcggcagcgcaaaagatg

SEQ ID NO: 185173 - DNA, 103 bp, Artificial Sequence
  Synthetic Polynucleotide
taatacgactcactataggggggctgcgggaggatggcaggtgtggtctgaacagaggagacagaccatgcctgccatcaacctggcggcagcgcaaaagatg

SEQ ID NO: 185174 - DNA, 103 bp, Artificial Sequence
  Synthetic Polynucleotide
taatacgactcactatagggtggcagcagtgggctgcgggaggatggcagaacagaggagactgccaatgtcccgcagcaacctggcggcagcgcaaaagatg

SEQ ID NO: 185175 - DNA, 103 bp, Artificial Sequence
  Synthetic Polynucleotide
taatacgactcactataggggcagcagcggtggcagcagtgggctgcgggaacagaggagacccgcaatgcactgctgcaacctggcggcagcgcaaaagatg

SEQ ID NO: 185176 - DNA, 103 bp, Artificial Sequence
  Synthetic Polynucleotide
taatacgactcactataggggggggtaggggcagcagcggtggcagcagtaacagaggagaactgctatgaccgctgctaacctggcggcagcgcaaaagatg

SEQ ID NO: 185177 - DNA, 103 bp, Artificial Sequence
  Synthetic Polynucleotide
taatacgactcactatagggccactggcttgggggtaggggcagcagcggaacagaggagaccgctgatgcccctacccaacctggcggcagcgcaaaagatg

SEQ ID NO: 185178 - DNA, 103 bp, Artificial Sequence
  Synthetic Polynucleotide
taatacgactcactataggggggggggtgtccactggcttgggggtagggaacagaggagaccctacatgcaagccagtaacctggcggcagcgcaaaagatg

SEQ ID NO: 185179 - DNA, 103 bp, Artificial Sequence
  Synthetic Polynucleotide
taatacgactcactatagggggtgatctgtgggggggtgtccactggcttaacagaggagaaagccaatggacacccccaacctggcggcagcgcaaaagatg

SEQ ID NO: 185180 - DNA, 103 bp, Artificial Sequence
  Synthetic Polynucleotide
taatacgactcactatagggccactccgacttccagcactcggatggtctaacagaggagaagaccaatggagtgctggaacctggcggcagcgcaaaagatg

SEQ ID NO: 185181 - DNA, 103 bp, Artificial Sequence
  Synthetic Polynucleotide
taatacgactcactatagggcaggctggacggtgatctgtgggggggtgtaacagaggagaacacccatgcacagatcaaacctggcggcagcgcaaaagatg

SEQ ID NO: 185182 - DNA, 103 bp, Artificial Sequence
  Synthetic Polynucleotide
taatacgactcactataggggcgaagcctgcaggctggacggtgatctgtaacagaggagaacagatatgcgtccagccaacctggcggcagcgcaaaagatg

SEQ ID NO: 185183 - DNA, 103 bp, Artificial Sequence
  Synthetic Polynucleotide
taatacgactcactatagggtgggctaaatgcgaagcctgcaggctggacaacagaggagagtccagatggcaggcttcaacctggcggcagcgcaaaagatg

SEQ ID NO: 185184 - DNA, 103 bp, Artificial Sequence
  Synthetic Polynucleotide
taatacgactcactatagggtgatgattcctgggctaaatgcgaagcctgaacagaggagacaggctatgcatttagccaacctggcggcagcgcaaaagatg

SEQ ID NO: 185185 - DNA, 103 bp, Artificial Sequence
  Synthetic Polynucleotide
taatacgactcactataggggaagcagcactgatgattcctgggctaaataacagaggagaatttagatgaggaatcataacctggcggcagcgcaaaagatg

SEQ ID NO: 185186 - DNA, 103 bp, Artificial Sequence
  Synthetic Polynucleotide
taatacgactcactatagggtcccccgagggaagcagcactgatgattccaacagaggagaggaatcatgagtgctgctaacctggcggcagcgcaaaagatg

SEQ ID NO: 185187 - DNA, 103 bp, Artificial Sequence
  Synthetic Polynucleotide
taatacgactcactatagggtctgggtctgtcccccgagggaagcagcacaacagaggagagtgctgatgccctcggggaacctggcggcagcgcaaaagatg

SEQ ID NO: 185188 - DNA, 103 bp, Artificial Sequence
  Synthetic Polynucleotide
taatacgactcactataggggaccccaggatctgggtctgtcccccgaggaacagaggagacctcggatgacagacccaaacctggcggcagcgcaaaagatg

SEQ ID NO: 185189 - DNA, 103 bp, Artificial Sequence
  Synthetic Polynucleotide
taatacgactcactatagggtgtagtgagggaccccaggatctgggtctgaacagaggagacagaccatgatcctggggaacctggcggcagcgcaaaagatg

SEQ ID NO: 185190 - DNA, 103 bp, Artificial Sequence
  Synthetic Polynucleotide
taatacgactcactatagggtgactggagctgtagtgagggaccccaggaaacagaggagatcctggatgccctcactaaacctggcggcagcgcaaaagatg

SEQ ID NO: 185191 - DNA, 103 bp, Artificial Sequence
  Synthetic Polynucleotide
taatacgactcactatagggagttgggcatccactccgacttccagcactaacagaggagaagtgctatgagtcggagtaacctggcggcagcgcaaaagatg

SEQ ID NO: 185192 - DNA, 103 bp, Artificial Sequence
  Synthetic Polynucleotide
taatacgactcactataggggcgctggtaatgactggagctgtagtgaggaacagaggagacctcacatgagctccagtaacctggcggcagcgcaaaagatg

SEQ ID NO: 185193 - DNA, 103 bp, Artificial Sequence
  Synthetic Polynucleotide
taatacgactcactataggggctgggaatggcgctggtaatgactggagcaacagaggagagctccaatgattaccagcaacctggcggcagcgcaaaagatg

SEQ ID NO: 185194 - DNA, 103 bp, Artificial Sequence
  Synthetic Polynucleotide
taatacgactcactatagggtccctggcatgctgggaatggcgctggtaaaacagaggagattaccaatgccattcccaaacctggcggcagcgcaaaagatg

SEQ ID NO: 185195 - DNA, 103 bp, Artificial Sequence
  Synthetic Polynucleotide
taatacgactcactatagggtgactgctgatccctggcatgctgggaatgaacagaggagacattccatgcatgccaggaacctggcggcagcgcaaaagatg

SEQ ID NO: 185196 - DNA, 103 bp, Artificial Sequence
  Synthetic Polynucleotide
taatacgactcactatagggggtgaggatctgactgctgatccctggcataacagaggagaatgccaatgatcagcagtaacctggcggcagcgcaaaagatg

SEQ ID NO: 185197 - DNA, 103 bp, Artificial Sequence
  Synthetic Polynucleotide
taatacgactcactatagggcctgagcattggtgaggatctgactgctgaaacagaggagatcagcaatgagatcctcaaacctggcggcagcgcaaaagatg

SEQ ID NO: 185198 - DNA, 103 bp, Artificial Sequence
  Synthetic Polynucleotide
taatacgactcactatagggataacctgtccctgagcattggtgaggatcaacagaggagagatcctatgcaatgctcaaacctggcggcagcgcaaaagatg

SEQ ID NO: 185199 - DNA, 103 bp, Artificial Sequence
  Synthetic Polynucleotide
taatacgactcactatagggaagggttccaataacctgtccctgagcattaacagaggagaaatgctatgggacaggttaacctggcggcagcgcaaaagatg

SEQ ID NO: 185200 - DNA, 103 bp, Artificial Sequence
  Synthetic Polynucleotide
taatacgactcactatagggctacccatggaagggttccaataacctgtcaacagaggagagacaggatgttggaacccaacctggcggcagcgcaaaagatg

SEQ ID NO: 185201 - DNA, 103 bp, Artificial Sequence
  Synthetic Polynucleotide
taatacgactcactataggggctgagttcactacccatggaagggttccaaacagaggagatggaacatgtccatgggtaacctggcggcagcgcaaaagatg

SEQ ID NO: 185202 - DNA, 103 bp, Artificial Sequence
  Synthetic Polynucleotide
taatacgactcactatagggggggcagagtgggctttccgtgtccaccataacagaggagaatggtgatgacggaaagcaacctggcggcagcgcaaaagatg

SEQ ID NO: 185203 - DNA, 103 bp, Artificial Sequence
  Synthetic Polynucleotide
taatacgactcactatagggggattgcgaaatctcttggatgtttcccataacagaggagaatgggaatgatccaagagaacctggcggcagcgcaaaagatg

SEQ ID NO: 185204 - DNA, 103 bp, Artificial Sequence
  Synthetic Polynucleotide
taatacgactcactatagggagttataaacccatttccatacgctaccagaacagaggagactggtaatgtatggaaataacctggcggcagcgcaaaagatg

SEQ ID NO: 185205 - DNA, 103 bp, Artificial Sequence
  Synthetic Polynucleotide
taatacgactcactatagggggaattcacgagttataaacccatttccataacagaggagaatggaaatgggtttataaaacctggcggcagcgcaaaagatg

SEQ ID NO: 185206 - DNA, 103 bp, Artificial Sequence
  Synthetic Polynucleotide
taatacgactcactatagggaggctttttaggaattcacgagttataaacaacagaggagagtttatatgtcgtgaattaacctggcggcagcgcaaaagatg

SEQ ID NO: 185207 - DNA, 103 bp, Artificial Sequence
  Synthetic Polynucleotide
taatacgactcactatagggcggtttccttaggctttttaggaattcacgaacagaggagacgtgaaatgctaaaaagcaacctggcggcagcgcaaaagatg

SEQ ID NO: 185208 - DNA, 103 bp, Artificial Sequence
  Synthetic Polynucleotide
taatacgactcactatagggtatcacagaacggtttccttaggctttttaaacagaggagataaaaaatgtaaggaaacaacctggcggcagcgcaaaagatg

SEQ ID NO: 185209 - DNA, 103 bp, Artificial Sequence
  Synthetic Polynucleotide
taatacgactcactatagggggttccatgatatcacagaacggtttccttaacagaggagaaaggaaatggttctgtgaaacctggcggcagcgcaaaagatg

SEQ ID NO: 185210 - DNA, 103 bp, Artificial Sequence
  Synthetic Polynucleotide
taatacgactcactatagggatcaaacttgggttccatgatatcacagaaaacagaggagattctgtatgatcatggaaaacctggcggcagcgcaaaagatg

SEQ ID NO: 185211 - DNA, 103 bp, Artificial Sequence
  Synthetic Polynucleotide
taatacgactcactatagggtcatggcaaaatcaaacttgggttccatgaaacagaggagatcatggatgccaagtttgaacctggcggcagcgcaaaagatg

SEQ ID NO: 185212 - DNA, 103 bp, Artificial Sequence
  Synthetic Polynucleotide
taatacgactcactataggggcattgaacttcatggcaaaatcaaacttgaacagaggagacaagttatgttttgccataacctggcggcagcgcaaaagatg

SEQ ID NO: 185213 - DNA, 103 bp, Artificial Sequence
  Synthetic Polynucleotide
taatacgactcactatagggcagttccagtgcattgaacttcatggcaaaaacagaggagatttgccatgaagttcaataacctggcggcagcgcaaaagatg

SEQ ID NO: 185214 - DNA, 103 bp, Artificial Sequence
  Synthetic Polynucleotide
taatacgactcactatagggcctcgccgatggattgcgaaatctcttggaaacagaggagatccaagatgtttcgcaataacctggcggcagcgcaaaagatg

SEQ ID NO: 185215 - DNA, 103 bp, Artificial Sequence
  Synthetic Polynucleotide
taatacgactcactatagggcactgtcatccagttccagtgcattgaactaacagaggagaagttcaatgcactggaacaacctggcggcagcgcaaaagatg

SEQ ID NO: 185216 - DNA, 103 bp, Artificial Sequence
  Synthetic Polynucleotide
taatacgactcactatagggagggagatatcactgtcatccagttccagtaacagaggagaactggaatgggatgacagaacctggcggcagcgcaaaagatg

SEQ ID NO: 185217 - DNA, 103 bp, Artificial Sequence
  Synthetic Polynucleotide
taatacgactcactatagggagccacaaaaagggagatatcactgtcatcaacagaggagagatgacatggatatctccaacctggcggcagcgcaaaagatg

SEQ ID NO: 185218 - DNA, 103 bp, Artificial Sequence
  Synthetic Polynucleotide
taatacgactcactatagggaaatgatagcagccacaaaaagggagatataacagaggagaatatctatgtttttgtggaacctggcggcagcgcaaaagatg

SEQ ID NO: 185219 - DNA, 103 bp, Artificial Sequence
  Synthetic Polynucleotide
taatacgactcactatagggtctccacagcaaatgatagcagccacaaaaaacagaggagattttgtatgtgctatcataacctggcggcagcgcaaaagatg

SEQ ID NO: 185220 - DNA, 103 bp, Artificial Sequence
  Synthetic Polynucleotide
taatacgactcactataggggccaggacgatctccacagcaaatgatagcaacagaggagagctatcatgtgctgtggaaacctggcggcagcgcaaaagatg

SEQ ID NO: 185221 - DNA, 103 bp, Artificial Sequence
  Synthetic Polynucleotide
taatacgactcactatagggcgtttagaaggccaggacgatctccacagcaacagaggagagctgtgatgatcgtcctgaacctggcggcagcgcaaaagatg

SEQ ID NO: 185222 - DNA, 103 bp, Artificial Sequence
  Synthetic Polynucleotide
taatacgactcactatagggatgtgtcctacgtttagaaggccaggacgaaacagaggagatcgtccatgccttctaaaaacctggcggcagcgcaaaagatg

SEQ ID NO: 185223 - DNA, 103 bp, Artificial Sequence
  Synthetic Polynucleotide
taatacgactcactatagggcattttttcaatgtgtcctacgtttagaagaacagaggagacttctaatggtaggacacaacctggcggcagcgcaaaagatg

SEQ ID NO: 185224 - DNA, 103 bp, Artificial Sequence
  Synthetic Polynucleotide
taatacgactcactatagggtaccctcctgcattttttcaatgtgtcctaaacagaggagataggacatgttgaaaaaaaacctggcggcagcgcaaaagatg

SEQ ID NO: 185225 - DNA, 103 bp, Artificial Sequence
  Synthetic Polynucleotide
taatacgactcactatagggccagaactatcctcgccgatggattgcgaaaacagaggagattcgcaatgcatcggcgaaacctggcggcagcgcaaaagatg

SEQ ID NO: 185226 - DNA, 103 bp, Artificial Sequence
  Synthetic Polynucleotide
taatacgactcactatagggacatgtacaataccctcctgcattttttcaaacagaggagatgaaaaatggcaggagggaacctggcggcagcgcaaaagatg

SEQ ID NO: 185227 - DNA, 103 bp, Artificial Sequence
  Synthetic Polynucleotide
taatacgactcactataggggagtctgagcacatgtacaataccctcctgaacagaggagacaggagatgattgtacataacctggcggcagcgcaaaagatg

SEQ ID NO: 185228 - DNA, 103 bp, Artificial Sequence
  Synthetic Polynucleotide
taatacgactcactatagggtctgcaggtggagtctgagcacatgtacaaaacagaggagattgtacatgtgctcagacaacctggcggcagcgcaaaagatg

SEQ ID NO: 185229 - DNA, 103 bp, Artificial Sequence
  Synthetic Polynucleotide
taatacgactcactataggggggtggttgctctgcaggtggagtctgagcaacagaggagagctcagatgccacctgcaaacctggcggcagcgcaaaagatg

SEQ ID NO: 185230 - DNA, 103 bp, Artificial Sequence
  Synthetic Polynucleotide
taatacgactcactataggggatatcgtccgggtggttgctctgcaggtgaacagaggagacacctgatgagcaaccacaacctggcggcagcgcaaaagatg

SEQ ID NO: 185231 - DNA, 103 bp, Artificial Sequence
  Synthetic Polynucleotide
taatacgactcactatagggggaagagaaagatatcgtccgggtggttgcaacagaggagagcaaccatgcggacgataaacctggcggcagcgcaaaagatg

SEQ ID NO: 185232 - DNA, 103 bp, Artificial Sequence
  Synthetic Polynucleotide
taatacgactcactatagggagaagttttgggaagagaaagatatcgtccaacagaggagaggacgaatgctttctcttaacctggcggcagcgcaaaagatg

SEQ ID NO: 185233 - DNA, 103 bp, Artificial Sequence
  Synthetic Polynucleotide
taatacgactcactatagggcattttttgaagaagttttgggaagagaaaaacagaggagatttctcatgccaaaacttaacctggcggcagcgcaaaagatg

SEQ ID NO: 185234 - DNA, 103 bp, Artificial Sequence
  Synthetic Polynucleotide
taatacgactcactatagggggaggtctgccattttttgaagaagttttgaacagaggagacaaaacatgttcaaaaaaaacctggcggcagcgcaaaagatg

SEQ ID NO: 185235 - DNA, 103 bp, Artificial Sequence
  Synthetic Polynucleotide
taatacgactcactatagggaccagctgccggaggtctgccattttttgaaacagaggagatcaaaaatgggcagacctaacctggcggcagcgcaaaagatg

SEQ ID NO: 185236 - DNA, 103 bp, Artificial Sequence
  Synthetic Polynucleotide
taatacgactcactataggggccaaagcttccagaactatcctcgccgataacagaggagaatcggcatggatagttctaacctggcggcagcgcaaaagatg

SEQ ID NO: 185237 - DNA, 103 bp, Artificial Sequence
  Synthetic Polynucleotide
taatacgactcactatagggatgctccgtcaccagctgccggaggtctgcaacagaggagagcagacatgcggcagctgaacctggcggcagcgcaaaagatg

SEQ ID NO: 185238 - DNA, 103 bp, Artificial Sequence
  Synthetic Polynucleotide
taatacgactcactatagggccagctgcgcatgctccgtcaccagctgccaacagaggagaggcagcatgtgacggagcaacctggcggcagcgcaaaagatg

SEQ ID NO: 185239 - DNA, 103 bp, Artificial Sequence
  Synthetic Polynucleotide
taatacgactcactatagggatgatctgcaccagctgcgcatgctccgtcaacagaggagagacggaatgtgcgcagctaacctggcggcagcgcaaaagatg

SEQ ID NO: 185240 - DNA, 103 bp, Artificial Sequence
  Synthetic Polynucleotide
taatacgactcactatagggcgtcttcttgatgatctgcaccagctgcgcaacagaggagagcgcagatggtgcagatcaacctggcggcagcgcaaaagatg

SEQ ID NO: 185241 - DNA, 103 bp, Artificial Sequence
  Synthetic Polynucleotide
taatacgactcactatagggcatccgactccgtcttcttgatgatctgcaaacagaggagatgcagaatgtcaagaagaaacctggcggcagcgcaaaagatg

SEQ ID NO: 185242 - DNA, 103 bp, Artificial Sequence
  Synthetic Polynucleotide
taatacgactcactatagggtgcagcgcagcatccgactccgtcttcttgaacagaggagacaagaaatgggagtcggaaacctggcggcagcgcaaaagatg

SEQ ID NO: 185243 - DNA, 103 bp, Artificial Sequence
  Synthetic Polynucleotide
taatacgactcactatagggcagtagcgggtgcagcgcagcatccgactcaacagaggagagagtcgatggctgcgctgaacctggcggcagcgcaaaagatg

SEQ ID NO: 185244 - DNA, 103 bp, Artificial Sequence
  Synthetic Polynucleotide
taatacgactcactatagggagatctcctgcagtagcgggtgcagcgcagaacagaggagactgcgcatgacccgctacaacctggcggcagcgcaaaagatg

SEQ ID NO: 185245 - DNA, 103 bp, Artificial Sequence
  Synthetic Polynucleotide
taatacgactcactatagggatgtccctgtagatctcctgcagtagcgggaacagaggagacccgctatggcaggagataacctggcggcagcgcaaaagatg

SEQ ID NO: 185246 - DNA, 103 bp, Artificial Sequence
  Synthetic Polynucleotide
taatacgactcactatagggattccgtaaagccaaagcttccagaactataacagaggagaatagttatggaagctttgaacctggcggcagcgcaaaagatg

SEQ ID NO: 185247 - DNA, 103 bp, Artificial Sequence
  Synthetic Polynucleotide
taatacgactcactatagggaaatactggtattccgtaaagccaaagcttaacagaggagaaagcttatgctttacggaaacctggcggcagcgcaaaagatg

SEQ ID NO: 185248 - DNA, 103 bp, Artificial Sequence
  Synthetic Polynucleotide
taatacgactcactatagggacagcttcctaaatactggtattccgtaaaaacagaggagatttacgatgtaccagtataacctggcggcagcgcaaaagatg

SEQ ID NO: 185249 - DNA, 103 bp, Artificial Sequence
  Synthetic Polynucleotide
taatacgactcactatagggctgagccaggacagcttcctaaatactggtaacagaggagaaccagtatgtaggaagctaacctggcggcagcgcaaaagatg

SEQ ID NO: 185250 - DNA, 103 bp, Artificial Sequence
  Synthetic Polynucleotide
taatacgactcactatagggaccgagccatctgagccaggacagcttcctaacagaggagaaggaagatgtcctggctcaacctggcggcagcgcaaaagatg

SEQ ID NO: 185251 - DNA, 103 bp, Artificial Sequence
  Synthetic Polynucleotide
taatacgactcactataggggtccgtgatgaccgagccatctgagccaggaacagaggagacctggcatggatggctcgaacctggcggcagcgcaaaagatg

SEQ ID NO: 185252 - DNA, 103 bp, Artificial Sequence
  Synthetic Polynucleotide
taatacgactcactataggggtggggagagggggcagagtgggctttccgaacagaggagacggaaaatgcactctgccaacctggcggcagcgcaaaagatg

SEQ ID NO: 185253 - DNA, 103 bp, Artificial Sequence
  Synthetic Polynucleotide
taatacgactcactataggggtgaaagcgtgtccgtgatgaccgagccataacagaggagaatggctatgtcatcacggaacctggcggcagcgcaaaagatg

SEQ ID NO: 185254 - DNA, 103 bp, Artificial Sequence
  Synthetic Polynucleotide
taatacgactcactatagggctcgaagctggtgaaagcgtgtccgtgatgaacagaggagacatcacatgcacgctttcaacctggcggcagcgcaaaagatg

SEQ ID NO: 185255 - DNA, 103 bp, Artificial Sequence
  Synthetic Polynucleotide
taatacgactcactatagggcgaggaggggctcgaagctggtgaaagcgtaacagaggagaacgcttatgccagcttcgaacctggcggcagcgcaaaagatg

SEQ ID NO: 185256 - DNA, 103 bp, Artificial Sequence
  Synthetic Polynucleotide
taatacgactcactataggggataagtcaccgaggaggggctcgaagctgaacagaggagacagcttatggcccctcctaacctggcggcagcgcaaaagatg

SEQ ID NO: 185257 - DNA, 103 bp, Artificial Sequence
  Synthetic Polynucleotide
taatacgactcactataggggggaccacaggataagtcaccgaggaggggaacagaggagacccctcatgggtgacttaaacctggcggcagcgcaaaagatg

SEQ ID NO: 185258 - DNA, 103 bp, Artificial Sequence
  Synthetic Polynucleotide
taatacgactcactatagggcacgctgccggggaccacaggataagtcacaacagaggagagtgactatgcctgtggtcaacctggcggcagcgcaaaagatg

SEQ ID NO: 185259 - DNA, 103 bp, Artificial Sequence
  Synthetic Polynucleotide
taatacgactcactataggggagactcgtccacgctgccggggaccacagaacagaggagactgtggatgccggcagcgaacctggcggcagcgcaaaagatg

SEQ ID NO: 185260 - DNA, 103 bp, Artificial Sequence
  Synthetic Polynucleotide
taatacgactcactataggggctccactgggagactcgtccacgctgccgaacagaggagacggcagatgggacgagtcaacctggcggcagcgcaaaagatg

SEQ ID NO: 185261 - DNA, 103 bp, Artificial Sequence
  Synthetic Polynucleotide
taatacgactcactataggggatgttcaatgctccactgggagactcgtcaacagaggagagacgagatgcccagtggaaacctggcggcagcgcaaaagatg

SEQ ID NO: 185262 - DNA, 103 bp, Artificial Sequence
  Synthetic Polynucleotide
taatacgactcactatagggttctacattcgatgttcaatgctccactggaacagaggagaccagtgatgcattgaacaaacctggcggcagcgcaaaagatg

SEQ ID NO: 185263 - DNA, 103 bp, Artificial Sequence
  Synthetic Polynucleotide
taatacgactcactatagggccggcctcgagtggggagagggggcagagtaacagaggagaactctgatgcctctccccaacctggcggcagcgcaaaagatg

SEQ ID NO: 185264 - DNA, 103 bp, Artificial Sequence
  Synthetic Polynucleotide
taatacgactcactatagggtccccgcagattctacattcgatgttcaataacagaggagaattgaaatgcgaatgtagaacctggcggcagcgcaaaagatg

SEQ ID NO: 185265 - DNA, 103 bp, Artificial Sequence
  Synthetic Polynucleotide
taatacgactcactatagggtgaggccttgtccccgcagattctacattcaacagaggagagaatgtatgatctgcgggaacctggcggcagcgcaaaagatg

SEQ ID NO: 185266 - DNA, 103 bp, Artificial Sequence
  Synthetic Polynucleotide
taatacgactcactatagggaatgatagcctgaggccttgtccccgcagaaacagaggagatctgcgatgacaaggcctaacctggcggcagcgcaaaagatg

SEQ ID NO: 185267 - DNA, 103 bp, Artificial Sequence
  Synthetic Polynucleotide
taatacgactcactatagggtggactccgtaatgatagcctgaggccttgaacagaggagacaaggcatgaggctatcaaacctggcggcagcgcaaaagatg

SEQ ID NO: 185268 - DNA, 103 bp, Artificial Sequence
  Synthetic Polynucleotide
taatacgactcactatagggttcacacgcgtggactccgtaatgatagccaacagaggagaggctatatgtacggagtcaacctggcggcagcgcaaaagatg

SEQ ID NO: 185269 - DNA, 103 bp, Artificial Sequence
  Synthetic Polynucleotide
taatacgactcactatagggccttgcagccttcacacgcgtggactccgtaacagaggagaacggagatgacgcgtgtgaacctggcggcagcgcaaaagatg

SEQ ID NO: 185270 - DNA, 103 bp, Artificial Sequence
  Synthetic Polynucleotide
taatacgactcactatagggcgaaagaagcccttgcagccttcacacgcgaacagaggagacgcgtgatgaggctgcaaaacctggcggcagcgcaaaagatg

SEQ ID NO: 185271 - DNA, 103 bp, Artificial Sequence
  Synthetic Polynucleotide
taatacgactcactatagggaatcgttcgccgaaagaagcccttgcagccaacagaggagaggctgcatgggcttctttaacctggcggcagcgcaaaagatg

SEQ ID NO: 185272 - DNA, 103 bp, Artificial Sequence
  Synthetic Polynucleotide
taatacgactcactataggggcttgagtcgaatcgttcgccgaaagaagcaacagaggagagcttctatgggcgaacgaaacctggcggcagcgcaaaagatg

SEQ ID NO: 185273 - DNA, 103 bp, Artificial Sequence
  Synthetic Polynucleotide
taatacgactcactatagggtcatacaccagcttgagtcgaatcgttcgcaacagaggagagcgaacatgtcgactcaaaacctggcggcagcgcaaaagatg

SEQ ID NO: 185274 - DNA, 103 bp, Artificial Sequence
  Synthetic Polynucleotide
taatacgactcactatagggctctagatcgccggcctcgagtggggagagaacagaggagactctccatgctcgaggccaacctggcggcagcgcaaaagatg

SEQ ID NO: 185275 - DNA, 103 bp, Artificial Sequence
  Synthetic Polynucleotide
taatacgactcactataggggtcgcacttgtcatacaccagcttgagtcgaacagaggagacgactcatgctggtgtataacctggcggcagcgcaaaagatg

SEQ ID NO: 185276 - DNA, 103 bp, Artificial Sequence
  Synthetic Polynucleotide
taatacgactcactatagggtgcagctgcggtcgcacttgtcatacaccaaacagaggagatggtgtatgacaagtgcgaacctggcggcagcgcaaaagatg

SEQ ID NO: 185277 - DNA, 103 bp, Artificial Sequence
  Synthetic Polynucleotide
taatacgactcactatagggttctggatcttgcagctgcggtcgcacttgaacagaggagacaagtgatgccgcagctgaacctggcggcagcgcaaaagatg

SEQ ID NO: 185278 - DNA, 103 bp, Artificial Sequence
  Synthetic Polynucleotide
taatacgactcactatagggtctgttctttttctggatcttgcagctgcgaacagaggagacgcagcatgaagatccagaacctggcggcagcgcaaaagatg

SEQ ID NO: 185279 - DNA, 103 bp, Artificial Sequence
  Synthetic Polynucleotide
taatacgactcactatagggggcatttgtttctgttctttttctggatctaacagaggagaagatccatgaaaagaacaaacctggcggcagcgcaaaagatg

SEQ ID NO: 185280 - DNA, 103 bp, Artificial Sequence
  Synthetic Polynucleotide
taatacgactcactatagggcgacaatactggcatttgtttctgttctttaacagaggagaaaagaaatgaaacaaatgaacctggcggcagcgcaaaagatg

SEQ ID NO: 185281 - DNA, 103 bp, Artificial Sequence
  Synthetic Polynucleotide
taatacgactcactatagggcttgtgaaatcgacaatactggcatttgttaacagaggagaaacaaaatgcagtattgtaacctggcggcagcgcaaaagatg

SEQ ID NO: 185282 - DNA, 103 bp, Artificial Sequence
  Synthetic Polynucleotide
taatacgactcactatagggcagaaaggcacttgtgaaatcgacaatactaacagaggagaagtattatggatttcacaaacctggcggcagcgcaaaagatg

SEQ ID NO: 185283 - DNA, 103 bp, Artificial Sequence
  Synthetic Polynucleotide
taatacgactcactataggggacatcccgacagaaaggcacttgtgaaataacagaggagaatttcaatggtgcctttcaacctggcggcagcgcaaaagatg

SEQ ID NO: 185284 - DNA, 103 bp, Artificial Sequence
  Synthetic Polynucleotide
taatacgactcactatagggcgcgttgtgtgacatcccgacagaaaggcaaacagaggagatgccttatggtcgggatgaacctggcggcagcgcaaaagatg

SEQ ID NO: 185285 - DNA, 103 bp, Artificial Sequence
  Synthetic Polynucleotide
taatacgactcactatagggataacgggctctctagatcgccggcctcgaaacagaggagatcgaggatggcgatctagaacctggcggcagcgcaaaagatg

SEQ ID NO: 185286 - DNA, 103 bp, Artificial Sequence
  Synthetic Polynucleotide
taatacgactcactatagggcaaaacgaatcgcgttgtgtgacatcccgaaacagaggagatcgggaatgcacacaacgaacctggcggcagcgcaaaagatg

SEQ ID NO: 185287 - DNA, 103 bp, Artificial Sequence
  Synthetic Polynucleotide
taatacgactcactatagggggcattcgtccaaaacgaatcgcgttgtgtaacagaggagaacacaaatggattcgtttaacctggcggcagcgcaaaagatg

SEQ ID NO: 185288 - DNA, 103 bp, Artificial Sequence
  Synthetic Polynucleotide
taatacgactcactatagggctcagatcttggcattcgtccaaaacgaataacagaggagaattcgtatgggacgaatgaacctggcggcagcgcaaaagatg

SEQ ID NO: 185289 - DNA, 103 bp, Artificial Sequence
  Synthetic Polynucleotide
taatacgactcactataggggttttgctttctcagatcttggcattcgtcaacagaggagagacgaaatgcaagatctgaacctggcggcagcgcaaaagatg

SEQ ID NO: 185290 - DNA, 103 bp, Artificial Sequence
  Synthetic Polynucleotide
taatacgactcactatagggtctgctttcagttttgctttctcagatcttaacagaggagaaagatcatggaaagcaaaaacctggcggcagcgcaaaagatg

SEQ ID NO: 185291 - DNA, 103 bp, Artificial Sequence
  Synthetic Polynucleotide
taatacgactcactatagggggtaagaatttctgctttcagttttgctttaacagaggagaaaagcaatgctgaaagcaaacctggcggcagcgcaaaagatg

SEQ ID NO: 185292 - DNA, 103 bp, Artificial Sequence
  Synthetic Polynucleotide
taatacgactcactatagggcatgttcacaggtaagaatttctgctttcaaacagaggagatgaaagatgaaattcttaaacctggcggcagcgcaaaagatg

SEQ ID NO: 185293 - DNA, 103 bp, Artificial Sequence
  Synthetic Polynucleotide
taatacgactcactatagggtcttctatgtcatgttcacaggtaagaattaacagaggagaaattctatgctgtgaacaaacctggcggcagcgcaaaagatg

SEQ ID NO: 185294 - DNA, 103 bp, Artificial Sequence
  Synthetic Polynucleotide
taatacgactcactatagggagtttcagaatcttctatgtcatgttcacaaacagaggagatgtgaaatggacatagaaaacctggcggcagcgcaaaagatg

SEQ ID NO: 185295 - DNA, 103 bp, Artificial Sequence
  Synthetic Polynucleotide
taatacgactcactatagggtgagatctgcagtttcagaatcttctatgtaacagaggagaacatagatgattctgaaaaacctggcggcagcgcaaaagatg

SEQ ID NO: 185296 - DNA, 103 bp, Artificial Sequence
  Synthetic Polynucleotide
taatacgactcactatagggaactcttcagataacgggctctctagatcgaacagaggagacgatctatggagcccgttaacctggcggcagcgcaaaagatg

SEQ ID NO: 185297 - DNA, 103 bp, Artificial Sequence
  Synthetic Polynucleotide
taatacgactcactataggggccagagatttgagatctgcagtttcagaaaacagaggagattctgaatgtgcagatctaacctggcggcagcgcaaaagatg

SEQ ID NO: 185298 - DNA, 103 bp, Artificial Sequence
  Synthetic Polynucleotide
taatacgactcactataggggattctcttggccagagatttgagatctgcaacagaggagagcagatatgaaatctctgaacctggcggcagcgcaaaagatg

SEQ ID NO: 185299 - DNA, 103 bp, Artificial Sequence
  Synthetic Polynucleotide
taatacgactcactatagggaggcctcgtagattctcttggccagagattaacagaggagaaatctcatgccaagagaaaacctggcggcagcgcaaaagatg

SEQ ID NO: 185300 - DNA, 103 bp, Artificial Sequence
  Synthetic Polynucleotide
taatacgactcactatagggttcttcaagtaggcctcgtagattctcttgaacagaggagacaagagatgctacgaggcaacctggcggcagcgcaaaagatg

SEQ ID NO: 185301 - DNA, 103 bp, Artificial Sequence
  Synthetic Polynucleotide
taatacgactcactatagggcatgttgaagttcttcaagtaggcctcgtaaacagaggagatacgagatgtacttgaagaacctggcggcagcgcaaaagatg

SEQ ID NO: 185302 - DNA, 103 bp, Artificial Sequence
  Synthetic Polynucleotide
taatacgactcactatagggtgaccttgttcatgttgaagttcttcaagtaacagaggagaacttgaatgacttcaacaaacctggcggcagcgcaaaagatg

SEQ ID NO: 185303 - DNA, 103 bp, Artificial Sequence
  Synthetic Polynucleotide
taatacgactcactatagggacccgggctttgaccttgttcatgttgaagaacagaggagacttcaaatggaacaaggtaacctggcggcagcgcaaaagatg

SEQ ID NO: 185304 - DNA, 103 bp, Artificial Sequence
  Synthetic Polynucleotide
taatacgactcactatagggtgagaggatgacccgggctttgaccttgttaacagaggagaaacaagatgaaagcccggaacctggcggcagcgcaaaagatg

SEQ ID NO: 185305 - DNA, 103 bp, Artificial Sequence
  Synthetic Polynucleotide
taatacgactcactatagggtggcctttcctgagaggatgacccgggcttaacagaggagaaagcccatgtcatcctctaacctggcggcagcgcaaaagatg

SEQ ID NO: 185306 - DNA, 103 bp, Artificial Sequence
  Synthetic Polynucleotide
taatacgactcactatagggggattgttactggcctttcctgagaggatgaacagaggagacatcctatgaggaaaggcaacctggcggcagcgcaaaagatg

SEQ ID NO: 185307 - DNA, 103 bp, Artificial Sequence
  Synthetic Polynucleotide
taatacgactcactatagggttcttgcaggaactcttcagataacgggctaacagaggagaagcccgatgtctgaagagaacctggcggcagcgcaaaagatg

SEQ ID NO: 185308 - DNA, 103 bp, Artificial Sequence
  Synthetic Polynucleotide
taatacgactcactataggggacaaaaggtggattgttactggcctttccaacagaggagaggaaagatgagtaacaataacctggcggcagcgcaaaagatg

SEQ ID NO: 185309 - DNA, 103 bp, Artificial Sequence
  Synthetic Polynucleotide
taatacgactcactatagggtatcatgtatgacaaaaggtggattgttacaacagaggagagtaacaatgcaccttttgaacctggcggcagcgcaaaagatg

SEQ ID NO: 185310 - DNA, 103 bp, Artificial Sequence
  Synthetic Polynucleotide
taatacgactcactatagggagtgtctccatatcatgtatgacaaaaggtaacagaggagaacctttatgcatacatgaaacctggcggcagcgcaaaagatg

SEQ ID NO: 185311 - DNA, 103 bp, Artificial Sequence
  Synthetic Polynucleotide
taatacgactcactatagggagccatacacagtgtctccatatcatgtataacagaggagaatacatatgatggagacaaacctggcggcagcgcaaaagatg

SEQ ID NO: 185312 - DNA, 103 bp, Artificial Sequence
  Synthetic Polynucleotide
taatacgactcactataggggcgtcttctcagccatacacagtgtctccaaacagaggagatggagaatgtgtgtatggaacctggcggcagcgcaaaagatg

SEQ ID NO: 185313 - DNA, 103 bp, Artificial Sequence
  Synthetic Polynucleotide
taatacgactcactatagggttggccaccagcgtcttctcagccatacacaacagaggagagtgtatatgtgagaagacaacctggcggcagcgcaaaagatg

SEQ ID NO: 185314 - DNA, 103 bp, Artificial Sequence
  Synthetic Polynucleotide
taatacgactcactatagggggccaccagcttggccaccagcgtcttctcaacagaggagagagaagatgctggtggccaacctggcggcagcgcaaaagatg

SEQ ID NO: 185315 - DNA, 103 bp, Artificial Sequence
  Synthetic Polynucleotide
taatacgactcactatagggggatgccattggccaccagcttggccaccaaacagaggagatggtggatgagctggtggaacctggcggcagcgcaaaagatg

SEQ ID NO: 185316 - DNA, 103 bp, Artificial Sequence
  Synthetic Polynucleotide
taatacgactcactatagggtccttgttctggatgccattggccaccagcaacagaggagagctggtatgcaatggcataacctggcggcagcgcaaaagatg

SEQ ID NO: 185317 - DNA, 103 bp, Artificial Sequence
  Synthetic Polynucleotide
taatacgactcactataggggacctccgcctccttgttctggatgccattaacagaggagaaatggcatgcagaacaagaacctggcggcagcgcaaaagatg

SEQ ID NO: 185318 - DNA, 103 bp, Artificial Sequence
  Synthetic Polynucleotide
taatacgactcactatagggtgtttcccatttcttgcaggaactcttcagaacagaggagactgaagatgtcctgcaagaacctggcggcagcgcaaaagatg

SEQ ID NO: 185319 - DNA, 103 bp, Artificial Sequence
  Synthetic Polynucleotide
taatacgactcactataggggaaagatgcggacctccgcctccttgttctaacagaggagaagaacaatgaggcggaggaacctggcggcagcgcaaaagatg

SEQ ID NO: 185320 - DNA, 103 bp, Artificial Sequence
  Synthetic Polynucleotide
taatacgactcactatagggtggcagcagtgaaagatgcggacctccgccaacagaggagaggcggaatgccgcatcttaacctggcggcagcgcaaaagatg

SEQ ID NO: 185321 - DNA, 103 bp, Artificial Sequence
  Synthetic Polynucleotide
taatacgactcactatagggtgacgtgcactggcagcagtgaaagatgcgaacagaggagacgcatcatgcactgctgcaacctggcggcagcgcaaaagatg

SEQ ID NO: 185322 - DNA, 103 bp, Artificial Sequence
  Synthetic Polynucleotide
taatacgactcactatagggcggtctccactgacgtgcactggcagcagtaacagaggagaactgctatgagtgcacgtaacctggcggcagcgcaaaagatg

SEQ ID NO: 185323 - DNA, 103 bp, Artificial Sequence
  Synthetic Polynucleotide
taatacgactcactatagggagctccgtgacggtctccactgacgtgcacaacagaggagagtgcacatgagtggagacaacctggcggcagcgcaaaagatg

SEQ ID NO: 185324 - DNA, 103 bp, Artificial Sequence
  Synthetic Polynucleotide
taatacgactcactataggggaattccgtgagctccgtgacggtctccacaacagaggagagtggagatggtcacggagaacctggcggcagcgcaaaagatg

SEQ ID NO: 185325 - DNA, 103 bp, Artificial Sequence
  Synthetic Polynucleotide
taatacgactcactatagggtggccttggcgaattccgtgagctccgtgaaacagaggagatcacggatgtcacggaataacctggcggcagcgcaaaagatg

SEQ ID NO: 185326 - DNA, 103 bp, Artificial Sequence
  Synthetic Polynucleotide
taatacgactcactatagggaagcctgggatggccttggcgaattccgtgaacagaggagacacggaatgcgccaaggcaacctggcggcagcgcaaaagatg

SEQ ID NO: 185327 - DNA, 103 bp, Artificial Sequence
  Synthetic Polynucleotide
taatacgactcactatagggcaagtttgcgaagcctgggatggccttggcaacagaggagagccaagatgatcccaggcaacctggcggcagcgcaaaagatg

SEQ ID NO: 185328 - DNA, 103 bp, Artificial Sequence
  Synthetic Polynucleotide
taatacgactcactatagggcgttcaggtccaagtttgcgaagcctgggaaacagaggagatcccagatgtcgcaaactaacctggcggcagcgcaaaagatg

SEQ ID NO: 185329 - DNA, 103 bp, Artificial Sequence
  Synthetic Polynucleotide
taatacgactcactatagggatctcttggatgtttcccatttcttgcaggaacagaggagacctgcaatgaatgggaaaaacctggcggcagcgcaaaagatg

SEQ ID NO: 185330 - DNA, 103 bp, Artificial Sequence
  Synthetic Polynucleotide
taatacgactcactataggggtcacttgatcgttcaggtccaagtttgcgaacagaggagacgcaaaatgggacctgaaaacctggcggcagcgcaaaagatg

SEQ ID NO: 185331 - DNA, 103 bp, Artificial Sequence
  Synthetic Polynucleotide
taatacgactcactatagggttttagcaatgtcacttgatcgttcaggtcaacagaggagagacctgatggatcaagtgaacctggcggcagcgcaaaagatg

SEQ ID NO: 185332 - DNA, 103 bp, Artificial Sequence
  Synthetic Polynucleotide
taatacgactcactatagggaaactccgtattttagcaatgtcacttgataacagaggagaatcaagatgcattgctaaaacctggcggcagcgcaaaagatg

SEQ ID NO: 185333 - DNA, 103 bp, Artificial Sequence
  Synthetic Polynucleotide
taatacgactcactatagggatggcctcataaactccgtattttagcaataacagaggagaattgctatgatacggagtaacctggcggcagcgcaaaagatg

SEQ ID NO: 185334 - DNA, 103 bp, Artificial Sequence
  Synthetic Polynucleotide
taatacgactcactatagggcatggcgaatatggcctcataaactccgtaaacagaggagatacggaatgtatgaggccaacctggcggcagcgcaaaagatg

SEQ ID NO: 185335 - DNA, 103 bp, Artificial Sequence
  Synthetic Polynucleotide
taatacgactcactatagggcagaagacagcatggcgaatatggcctcataacagaggagaatgaggatgtattcgccaaacctggcggcagcgcaaaagatg

SEQ ID NO: 185336 - DNA, 103 bp, Artificial Sequence
  Synthetic Polynucleotide
taatacgactcactatagggttgttcatcacagaagacagcatggcgaataacagaggagaattcgcatggctgtcttcaacctggcggcagcgcaaaagatg

SEQ ID NO: 185337 - DNA, 103 bp, Artificial Sequence
  Synthetic Polynucleotide
taatacgactcactatagggcatcccgtctttgttcatcacagaagacagaacagaggagactgtctatggtgatgaacaacctggcggcagcgcaaaagatg

SEQ ID NO: 185338 - DNA, 103 bp, Artificial Sequence
  Synthetic Polynucleotide
taatacgactcactatagggacgctaccagcatcccgtctttgttcatcaaacagaggagatgatgaatgaagacgggaaacctggcggcagcgcaaaagatg

SEQ ID NO: 185339 - DNA, 103 bp, Artificial Sequence
  Synthetic Polynucleotide
taatacgactcactatagggccatttccatacgctaccagcatcccgtctaacagaggagaagacggatggctggtagcaacctggcggcagcgcaaaagatg

SEQ ID NO: 185340 - DNA, 103 bp, Artificial Sequence
  Synthetic Polynucleotide
taatacgactcactatagggctcaggggcttcctcctgtggctgctccataacagaggagaatggagatgccacaggagaacctggcggcagcgcaaaagatg

SEQ ID NO: 185341 - DNA, 103 bp, Artificial Sequence
  Synthetic Polynucleotide
taatacgactcactataggggctggaaggaagtgcatgctgtggtcccccaacagaggagagggggaatgcagcatgcaaacctggcggcagcgcaaaagatg

SEQ ID NO: 185342 - DNA, 103 bp, Artificial Sequence
  Synthetic Polynucleotide
taatacgactcactatagggggcgttgaacttgacagcaaattcaaacttaacagaggagaaagtttatgtttgctgtcaacctggcggcagcgcaaaagatg

SEQ ID NO: 185343 - DNA, 103 bp, Artificial Sequence
  Synthetic Polynucleotide
taatacgactcactatagggcaagttccagggcgttgaacttgacagcaaaacagaggagattgctgatgagttcaacgaacctggcggcagcgcaaaagatg

SEQ ID NO: 185344 - DNA, 103 bp, Artificial Sequence
  Synthetic Polynucleotide
taatacgactcactatagggtcactgtcatcaagttccagggcgttgaacaacagaggagagttcaaatgcctggaactaacctggcggcagcgcaaaagatg

SEQ ID NO: 185345 - DNA, 103 bp, Artificial Sequence
  Synthetic Polynucleotide
taatacgactcactatagggtagggccaggtcactgtcatcaagttccagaacagaggagactggaaatggatgacagtaacctggcggcagcgcaaaagatg

SEQ ID NO: 185346 - DNA, 103 bp, Artificial Sequence
  Synthetic Polynucleotide
taatacgactcactatagggccgcaatgaatagggccaggtcactgtcataacagaggagaatgacaatgacctggcccaacctggcggcagcgcaaaagatg

SEQ ID NO: 185347 - DNA, 103 bp, Artificial Sequence
  Synthetic Polynucleotide
taatacgactcactatagggagaatgatggccgcaatgaatagggccaggaacagaggagacctggcatgattcattgcaacctggcggcagcgcaaaagatg

SEQ ID NO: 185348 - DNA, 103 bp, Artificial Sequence
  Synthetic Polynucleotide
taatacgactcactatagggacctccacacagaatgatggccgcaatgaaaacagaggagattcattatggccatcattaacctggcggcagcgcaaaagatg

SEQ ID NO: 185349 - DNA, 103 bp, Artificial Sequence
  Synthetic Polynucleotide
taatacgactcactatagggctgtgtagctgctggaaggaagtgcatgctaacagaggagaagcatgatgttccttccaaacctggcggcagcgcaaaagatg

SEQ ID NO: 185350 - DNA, 103 bp, Artificial Sequence
  Synthetic Polynucleotide
taatacgactcactatagggcgggagaggtctgtgtagctgctggaaggaaacagaggagatccttcatgcagctacacaacctggcggcagcgcaaaagatg

SEQ ID NO: 185351 - DNA, 103 bp, Artificial Sequence
  Synthetic Polynucleotide
taatacgactcactatagggcgaggagctccgggagaggtctgtgtagctaacagaggagaagctacatggacctctccaacctggcggcagcgcaaaagatg

SEQ ID NO: 185352 - DNA, 103 bp, Artificial Sequence
  Synthetic Polynucleotide
taatacgactcactataggggtgagggtggcgaggagctccgggagaggtaacagaggagaacctctatgggagctcctaacctggcggcagcgcaaaagatg

SEQ ID NO: 185353 - DNA, 103 bp, Artificial Sequence
  Synthetic Polynucleotide
taatacgactcactatagggtggtccagcagtgagggtggcgaggagctcaacagaggagagagctcatggccaccctcaacctggcggcagcgcaaaagatg

SEQ ID NO: 185354 - DNA, 103 bp, Artificial Sequence
  Synthetic Polynucleotide
taatacgactcactatagggcatctgcagttggtccagcagtgagggtggaacagaggagaccacccatgctgctggacaacctggcggcagcgcaaaagatg

SEQ ID NO: 185355 - DNA, 103 bp, Artificial Sequence
  Synthetic Polynucleotide
taatacgactcactatagggcgtcacagcccatctgcagttggtccagcaaacagaggagatgctggatgaactgcagaaacctggcggcagcgcaaaagatg

SEQ ID NO: 185356 - DNA, 103 bp, Artificial Sequence
  Synthetic Polynucleotide
taatacgactcactatagggcatgaggccccgtcacagcccatctgcagtaacagaggagaactgcaatggggctgtgaaacctggcggcagcgcaaaagatg

SEQ ID NO: 185357 - DNA, 103 bp, Artificial Sequence
  Synthetic Polynucleotide
taatacgactcactataggggaggctgccgcatgaggccccgtcacagccaacagaggagaggctgtatgggggcctcaaacctggcggcagcgcaaaagatg

SEQ ID NO: 185358 - DNA, 103 bp, Artificial Sequence
  Synthetic Polynucleotide
taatacgactcactatagggcttcccggacctcaggggcttcctcctgtgaacagaggagacacaggatgaagcccctgaacctggcggcagcgcaaaagatg

SEQ ID NO: 185359 - DNA, 103 bp, Artificial Sequence
  Synthetic Polynucleotide
taatacgactcactatagggactccatgttgaggctgccgcatgaggcccaacagaggagagggcctatggcggcagccaacctggcggcagcgcaaaagatg

SEQ ID NO: 185360 - DNA, 103 bp, Artificial Sequence
  Synthetic Polynucleotide
taatacgactcactatagggcacacccggcactccatgttgaggctgccgaacagaggagacggcagatgcaacatggaaacctggcggcagcgcaaaagatg

SEQ ID NO: 185361 - DNA, 103 bp, Artificial Sequence
  Synthetic Polynucleotide
taatacgactcactatagggcttgtccccgcacacccggcactccatgttaacagaggagaaacatgatgtgccgggtgaacctggcggcagcgcaaaagatg

SEQ ID NO: 185362 - DNA, 103 bp, Artificial Sequence
  Synthetic Polynucleotide
taatacgactcactatagggagcccgatgccttgtccccgcacacccggcaacagaggagagccgggatggcggggacaaacctggcggcagcgcaaaagatg

SEQ ID NO: 185363 - DNA, 103 bp, Artificial Sequence
  Synthetic Polynucleotide
taatacgactcactatagggccgtagtggaagcccgatgccttgtccccgaacagaggagacggggaatgggcatcgggaacctggcggcagcgcaaaagatg

SEQ ID NO: 185364 - DNA, 103 bp, Artificial Sequence
  Synthetic Polynucleotide
taatacgactcactatagggtgcatgaacaccgtagtggaagcccgatgcaacagaggagagcatcgatgttccactacaacctggcggcagcgcaaaagatg

SEQ ID NO: 185365 - DNA, 103 bp, Artificial Sequence
  Synthetic Polynucleotide
taatacgactcactatagggacccctcacatgcatgaacaccgtagtggaaacagaggagatccactatggtgttcatgaacctggcggcagcgcaaaagatg

SEQ ID NO: 185366 - DNA, 103 bp, Artificial Sequence
  Synthetic Polynucleotide
taatacgactcactatagggaagcccttgcacccctcacatgcatgaacaaacagaggagatgttcaatgatgtgagggaacctggcggcagcgcaaaagatg

SEQ ID NO: 185367 - DNA, 103 bp, Artificial Sequence
  Synthetic Polynucleotide
taatacgactcactatagggacgacggaagaagcccttgcacccctcacaaacagaggagatgtgagatgtgcaagggcaacctggcggcagcgcaaaagatg

SEQ ID NO: 185368 - DNA, 103 bp, Artificial Sequence
  Synthetic Polynucleotide
taatacgactcactatagggtgcggatcgtacgacggaagaagcccttgcaacagaggagagcaaggatgtcttccgtcaacctggcggcagcgcaaaagatg

SEQ ID NO: 185369 - DNA, 103 bp, Artificial Sequence
  Synthetic Polynucleotide
taatacgactcactatagggttctcctcctcttcccggacctcaggggctaacagaggagaagccccatgggtccgggaaacctggcggcagcgcaaaagatg

SEQ ID NO: 185370 - DNA, 103 bp, Artificial Sequence
  Synthetic Polynucleotide
taatacgactcactatagggtccagcttcatgcggatcgtacgacggaagaacagaggagacttccgatgtacgatccgaacctggcggcagcgcaaaagatg

SEQ ID NO: 185371 - DNA, 103 bp, Artificial Sequence
  Synthetic Polynucleotide
taatacgactcactatagggcttctcgtactccagcttcatgcggatcgtaacagaggagaacgatcatgatgaagctgaacctggcggcagcgcaaaagatg

SEQ ID NO: 185372 - DNA, 103 bp, Artificial Sequence
  Synthetic Polynucleotide
taatacgactcactatagggtgcgctcacacttctcgtactccagcttcaaacagaggagatgaagcatgagtacgagaaacctggcggcagcgcaaaagatg

SEQ ID NO: 185373 - DNA, 103 bp, Artificial Sequence
  Synthetic Polynucleotide
taatacgactcactatagggatcttgcagctgcgctcacacttctcgtacaacagaggagagtacgaatggtgtgagcgaacctggcggcagcgcaaaagatg

SEQ ID NO: 185374 - DNA, 103 bp, Artificial Sequence
  Synthetic Polynucleotide
taatacgactcactatagggcttcttctgaatcttgcagctgcgctcacaaacagaggagatgtgagatgagctgcaagaacctggcggcagcgcaaaagatg

SEQ ID NO: 185375 - DNA, 103 bp, Artificial Sequence
  Synthetic Polynucleotide
taatacgactcactatagggtgttgcggttcttcttctgaatcttgcagcaacagaggagagctgcaatgttcagaagaaacctggcggcagcgcaaaagatg

SEQ ID NO: 185376 - DNA, 103 bp, Artificial Sequence
  Synthetic Polynucleotide
taatacgactcactatagggtactggcacttgttgcggttcttcttctgaaacagaggagatcagaaatggaaccgcaaaacctggcggcagcgcaaaagatg

SEQ ID NO: 185377 - DNA, 103 bp, Artificial Sequence
  Synthetic Polynucleotide
taatacgactcactataggggaagcggcagtactggcacttgttgcggttaacagaggagaaaccgcatgaagtgccagaacctggcggcagcgcaaaagatg

SEQ ID NO: 185378 - DNA, 103 bp, Artificial Sequence
  Synthetic Polynucleotide
taatacgactcactatagggggcacttctggaagcggcagtactggcactaacagaggagaagtgccatgactgccgctaacctggcggcagcgcaaaagatg

SEQ ID NO: 185379 - DNA, 103 bp, Artificial Sequence
  Synthetic Polynucleotide
taatacgactcactatagggcccagtgccaggcacttctggaagcggcagaacagaggagactgccgatgccagaagtgaacctggcggcagcgcaaaagatg

SEQ ID NO: 185380 - DNA, 103 bp, Artificial Sequence
  Synthetic Polynucleotide
taatacgactcactatagggcacttcctctttctcctcctcttcccggacaacagaggagagtccggatggaggaggagaacctggcggcagcgcaaaagatg

SEQ ID NO: 185381 - DNA, 103 bp, Artificial Sequence
  Synthetic Polynucleotide
taatacgactcactataggggtgtgacatgcccagtgccaggcacttctgaacagaggagacagaagatgctggcactgaacctggcggcagcgcaaaagatg

SEQ ID NO: 185382 - DNA, 103 bp, Artificial Sequence
  Synthetic Polynucleotide
taatacgactcactatagggggatagcgttgtgtgacatgcccagtgccaaacagaggagatggcacatggcatgtcacaacctggcggcagcgcaaaagatg

SEQ ID NO: 185383 - DNA, 103 bp, Artificial Sequence
  Synthetic Polynucleotide
taatacgactcactatagggcgaccaaaacggatagcgttgtgtgacatgaacagaggagacatgtcatgcaacgctataacctggcggcagcgcaaaagatg

SEQ ID NO: 185384 - DNA, 103 bp, Artificial Sequence
  Synthetic Polynucleotide
taatacgactcactatagggctccggcatccgaccaaaacggatagcgttaacagaggagaaacgctatgcgttttggtaacctggcggcagcgcaaaagatg

SEQ ID NO: 185385 - DNA, 103 bp, Artificial Sequence
  Synthetic Polynucleotide
taatacgactcactatagggtcttctcagcctccggcatccgaccaaaacaacagaggagagttttgatgggatgccggaacctggcggcagcgcaaaagatg

SEQ ID NO: 185386 - DNA, 103 bp, Artificial Sequence
  Synthetic Polynucleotide
taatacgactcactatagggaccagcttcctcttctcagcctccggcatcaacagaggagagatgccatgggctgagaaaacctggcggcagcgcaaaagatg

SEQ ID NO: 185387 - DNA, 103 bp, Artificial Sequence
  Synthetic Polynucleotide
taatacgactcactatagggcagccctgccaccagcttcctcttctcagcaacagaggagagctgagatgaggaagctgaacctggcggcagcgcaaaagatg

SEQ ID NO: 185388 - DNA, 103 bp, Artificial Sequence
  Synthetic Polynucleotide
taatacgactcactatagggcgtttgcagtcagccctgccaccagcttccaacagaggagaggaagcatgtggcagggcaacctggcggcagcgcaaaagatg

SEQ ID NO: 185389 - DNA, 103 bp, Artificial Sequence
  Synthetic Polynucleotide
taatacgactcactatagggtggctcccctcgtttgcagtcagccctgccaacagaggagaggcaggatggactgcaaaaacctggcggcagcgcaaaagatg

SEQ ID NO: 185390 - DNA, 103 bp, Artificial Sequence
  Synthetic Polynucleotide
taatacgactcactatagggtgggttgtactggctcccctcgtttgcagtaacagaggagaactgcaatggaggggagcaacctggcggcagcgcaaaagatg

SEQ ID NO: 185391 - DNA, 103 bp, Artificial Sequence
  Synthetic Polynucleotide
taatacgactcactatagggctgcctctgccacttcctctttctcctcctaacagaggagaaggaggatgaagaggaagaacctggcggcagcgcaaaagatg

SEQ ID NO: 185392 - DNA, 103 bp, Artificial Sequence
  Synthetic Polynucleotide
taatacgactcactatagggcggccacctgtgggttgtactggctcccctaacagaggagaaggggaatgagtacaaccaacctggcggcagcgcaaaagatg

SEQ ID NO: 185393 - DNA, 103 bp, Artificial Sequence
  Synthetic Polynucleotide
taatacgactcactataggggccttcaggtcggccacctgtgggttgtacaacagaggagagtacaaatgacaggtggcaacctggcggcagcgcaaaagatg

SEQ ID NO: 185394 - DNA, 103 bp, Artificial Sequence
  Synthetic Polynucleotide
taatacgactcactatagggcttggagaaggccttcaggtcggccacctgaacagaggagacaggtgatggacctgaagaacctggcggcagcgcaaaagatg

SEQ ID NO: 185395 - DNA, 103 bp, Artificial Sequence
  Synthetic Polynucleotide
taatacgactcactatagggtgtagatgtgcttggagaaggccttcaggtaacagaggagaacctgaatgccttctccaaacctggcggcagcgcaaaagatg

SEQ ID NO: 185396 - DNA, 103 bp, Artificial Sequence
  Synthetic Polynucleotide
taatacgactcactatagggaggtaggcattgtagatgtgcttggagaagaacagaggagacttctcatggcacatctaaacctggcggcagcgcaaaagatg

SEQ ID NO: 185397 - DNA, 103 bp, Artificial Sequence
  Synthetic Polynucleotide
taatacgactcactataggggaagtttttcaggtaggcattgtagatgtgaacagaggagacacatcatgaatgcctacaacctggcggcagcgcaaaagatg

SEQ ID NO: 185398 - DNA, 103 bp, Artificial Sequence
  Synthetic Polynucleotide
taatacgactcactatagggtggtcatgttgaagtttttcaggtaggcataacagaggagaatgcctatgtgaaaaactaacctggcggcagcgcaaaagatg

SEQ ID NO: 185399 - DNA, 103 bp, Artificial Sequence
  Synthetic Polynucleotide
taatacgactcactataggggccttctttttggtcatgttgaagtttttcaacagaggagagaaaaaatgcaacatgacaacctggcggcagcgcaaaagatg

SEQ ID NO: 185400 - DNA, 103 bp, Artificial Sequence
  Synthetic Polynucleotide
taatacgactcactataggggatgctgcgggccttctttttggtcatgttaacagaggagaaacatgatgaaaaagaagaacctggcggcagcgcaaaagatg

SEQ ID NO: 185401 - DNA, 103 bp, Artificial Sequence
  Synthetic Polynucleotide
taatacgactcactatagggtgccggtgaggatgctgcgggccttcttttaacagaggagaaaaagaatgcccgcagcaaacctggcggcagcgcaaaagatg

SEQ ID NO: 185402 - DNA, 103 bp, Artificial Sequence
  Synthetic Polynucleotide
taatacgactcactatagggggggctccttctgcctctgccacttcctctaacagaggagaagaggaatgggcagaggcaacctggcggcagcgcaaaagatg

SEQ ID NO: 185403 - DNA, 103 bp, Artificial Sequence
  Synthetic Polynucleotide
taatacgactcactatagggtggctggctttgccggtgaggatgctgcggaacagaggagaccgcagatgcctcaccggaacctggcggcagcgcaaaagatg

SEQ ID NO: 185404 - DNA, 103 bp, Artificial Sequence
  Synthetic Polynucleotide
taatacgactcactataggggggcgccgtgtggctggctttgccggtgagaacagaggagactcaccatgaaagccagcaacctggcggcagcgcaaaagatg

SEQ ID NO: 185405 - DNA, 103 bp, Artificial Sequence
  Synthetic Polynucleotide
taatacgactcactatagggggatcacaaagggcgccgtgtggctggcttaacagaggagaaagccaatgacacggcgcaacctggcggcagcgcaaaagatg

SEQ ID NO: 185406 - DNA, 103 bp, Artificial Sequence
  Synthetic Polynucleotide
taatacgactcactatagggtcgatgtcgtggatcacaaagggcgccgtgaacagaggagacacggcatgctttgtgataacctggcggcagcgcaaaagatg

SEQ ID NO: 185407 - DNA, 103 bp, Artificial Sequence
  Synthetic Polynucleotide
taatacgactcactatagggccacaatgtctcgatgtcgtggatcacaaaaacagaggagatttgtgatgcacgacatcaacctggcggcagcgcaaaagatg

SEQ ID NO: 185408 - DNA, 103 bp, Artificial Sequence
  Synthetic Polynucleotide
taatacgactcactatagggtctctgcctgccacaatgtctcgatgtcgtaacagaggagaacgacaatgagacattgtaacctggcggcagcgcaaaagatg

SEQ ID NO: 185409 - DNA, 103 bp, Artificial Sequence
  Synthetic Polynucleotide
taatacgactcactatagggaccagccccttctctgcctgccacaatgtcaacagaggagagacattatggcaggcagaaacctggcggcagcgcaaaagatg

SEQ ID NO: 185410 - DNA, 103 bp, Artificial Sequence
  Synthetic Polynucleotide
taatacgactcactatagggctgcttccacaccagccccttctctgcctgaacagaggagacaggcaatgaaggggctgaacctggcggcagcgcaaaagatg

SEQ ID NO: 185411 - DNA, 103 bp, Artificial Sequence
  Synthetic Polynucleotide
taatacgactcactatagggcattcaccaactgcttccacaccagcccctaacagaggagaaggggcatgtgtggaagcaacctggcggcagcgcaaaagatg

SEQ ID NO: 185412 - DNA, 103 bp, Artificial Sequence
  Synthetic Polynucleotide
taatacgactcactatagggggaggcaggccattcaccaactgcttccacaacagaggagagtggaaatggttggtgaaaacctggcggcagcgcaaaagatg

SEQ ID NO: 185413 - DNA, 103 bp, Artificial Sequence
  Synthetic Polynucleotide
taatacgactcactatagggattgagctctggggctccttctgcctctgcaacagaggagagcagagatggaaggagccaacctggcggcagcgcaaaagatg

SEQ ID NO: 185414 - DNA, 103 bp, Artificial Sequence
  Synthetic Polynucleotide
taatacgactcactatagggctccttgtagggaggcaggccattcaccaaaacagaggagattggtgatgggcctgcctaacctggcggcagcgcaaaagatg

SEQ ID NO: 185415 - DNA, 103 bp, Artificial Sequence
  Synthetic Polynucleotide
taatacgactcactataggggcacgctgatctccttgtagggaggcaggcaacagaggagagcctgcatgcctacaaggaacctggcggcagcgcaaaagatg

SEQ ID NO: 185416 - DNA, 103 bp, Artificial Sequence
  Synthetic Polynucleotide
taatacgactcactatagggtagaagacgtgcacgctgatctccttgtagaacagaggagactacaaatggatcagcgtaacctggcggcagcgcaaaagatg

SEQ ID NO: 185417 - DNA, 103 bp, Artificial Sequence
  Synthetic Polynucleotide
taatacgactcactatagggctggcagcggtagaagacgtgcacgctgataacagaggagaatcagcatgcacgtcttcaacctggcggcagcgcaaaagatg

SEQ ID NO: 185418 - DNA, 103 bp, Artificial Sequence
  Synthetic Polynucleotide
taatacgactcactatagggctgtggtgcactggcagcggtagaagacgtaacagaggagaacgtctatgaccgctgccaacctggcggcagcgcaaaagatg

SEQ ID NO: 185419 - DNA, 103 bp, Artificial Sequence
  Synthetic Polynucleotide
taatacgactcactatagggacggtctccactgtggtgcactggcagcggaacagaggagaccgctgatggtgcaccacaacctggcggcagcgcaaaagatg

SEQ ID NO: 185420 - DNA, 103 bp, Artificial Sequence
  Synthetic Polynucleotide
taatacgactcactataggggagctcccgcacggtctccactgtggtgcaaacagaggagatgcaccatggtggagaccaacctggcggcagcgcaaaagatg

SEQ ID NO: 185421 - DNA, 103 bp, Artificial Sequence
  Synthetic Polynucleotide
taatacgactcactatagggcgaactcagtgagctcccgcacggtctccaaacagaggagatggagaatgtgcgggagcaacctggcggcagcgcaaaagatg

SEQ ID NO: 185422 - DNA, 103 bp, Artificial Sequence
  Synthetic Polynucleotide
taatacgactcactatagggatgctcttggcgaactcagtgagctcccgcaacagaggagagcgggaatgcactgagttaacctggcggcagcgcaaaagatg

SEQ ID NO: 185423 - DNA, 103 bp, Artificial Sequence
  Synthetic Polynucleotide
taatacgactcactataggggaagctggggatgctcttggcgaactcagtaacagaggagaactgagatggccaagagcaacctggcggcagcgcaaaagatg

SEQ ID NO: 185424 - DNA, 103 bp, Artificial Sequence
  Synthetic Polynucleotide
taatacgactcactataggggtggtcccccattgagctctggggctccttaacagaggagaaaggagatgcagagctcaaacctggcggcagcgcaaaagatg

SEQ ID NO: 185425 - DNA, 103 bp, Artificial Sequence
  Synthetic Polynucleotide
taatacgactcactatagggagaggctgctgaagctggggatgctcttggaacagaggagaccaagaatgtccccagctaacctggcggcagcgcaaaagatg

SEQ ID NO: 185426 - DNA, 103 bp, Artificial Sequence
  Synthetic Polynucleotide
taatacgactcactatagggtcgttgaggaagaggctgctgaagctggggaacagaggagaccccagatgcagcagcctaacctggcggcagcgcaaaagatg

SEQ ID NO: 185427 - DNA, 103 bp, Artificial Sequence
  Synthetic Polynucleotide
taatacgactcactatagggggtaacctggtcgttgaggaagaggctgctaacagaggagaagcagcatgttcctcaacaacctggcggcagcgcaaaagatg

SEQ ID NO: 185428 - DNA, 103 bp, Artificial Sequence
  Synthetic Polynucleotide
taatacgactcactatagggacttgagaagggtaacctggtcgttgaggaaacagaggagatcctcaatgaccaggttaaacctggcggcagcgcaaaagatg

SEQ ID NO: 185429 - DNA, 103 bp, Artificial Sequence
  Synthetic Polynucleotide
taatacgactcactatagggtgcacgccatacttgagaagggtaacctggaacagaggagaccaggtatgccttctcaaaacctggcggcagcgcaaaagatg

SEQ ID NO: 185430 - DNA, 103 bp, Artificial Sequence
  Synthetic Polynucleotide
taatacgactcactataggggatggcctcgtgcacgccatacttgagaagaacagaggagacttctcatgtatggcgtgaacctggcggcagcgcaaaagatg

SEQ ID NO: 185431 - DNA, 103 bp, Artificial Sequence
  Synthetic Polynucleotide
taatacgactcactataggggcatggcgaagatggcctcgtgcacgccataacagaggagaatggcgatgacgaggccaaacctggcggcagcgcaaaagatg

SEQ ID NO: 185432 - DNA, 103 bp, Artificial Sequence
  Synthetic Polynucleotide
taatacgactcactatagggatagaggccagcatggcgaagatggcctcgaacagaggagacgaggcatgcttcgccataacctggcggcagcgcaaaagatg

SEQ ID NO: 185433 - DNA, 103 bp, Artificial Sequence
  Synthetic Polynucleotide
taatacgactcactatagggcttgttgacgatagaggccagcatggcgaaaacagaggagattcgccatgctggcctctaacctggcggcagcgcaaaagatg

SEQ ID NO: 185434 - DNA, 103 bp, Artificial Sequence
  Synthetic Polynucleotide
taatacgactcactataggggcagcccgtccttgttgacgatagaggccaaacagaggagatggcctatgtcgtcaacaaacctggcggcagcgcaaaagatg

SEQ ID NO: 185435 - DNA, 103 bp, Artificial Sequence
  Synthetic Polynucleotide
taatacgactcactatagggagtgcatgctgtggtcccccattgagctctaacagaggagaagagctatgtgggggaccaacctggcggcagcgcaaaagatg

SEQ ID NO: 185436 - DNA, 103 bp, Artificial Sequence
  Synthetic Polynucleotide
taatacgactcactatagggttggctaccagcagcccgtccttgttgacgaacagaggagacgtcaaatgggacgggctaacctggcggcagcgcaaaagatg

SEQ ID NO: 185437 - DNA, 103 bp, Artificial Sequence
  Synthetic Polynucleotide
taatacgactcactataggggccactgccgttggctaccagcagcccgtcaacagaggagagacgggatgctggtagccaacctggcggcagcgcaaaagatg

SEQ ID NO: 185438 - DNA, 103 bp, Artificial Sequence
  Synthetic Polynucleotide
taatacgactcactataggggggtgacaaagccactgccgttggctaccaaacagaggagatggtagatgacggcagtgaacctggcggcagcgcaaaagatg

SEQ ID NO: 185439 - DNA, 103 bp, Artificial Sequence
  Synthetic Polynucleotide
taatacgactcactatagggaggaactcacgggtgacaaagccactgccgaacagaggagacggcagatgctttgtcacaacctggcggcagcgcaaaagatg

SEQ ID NO: 185440 - DNA, 103 bp, Artificial Sequence
  Synthetic Polynucleotide
taatacgactcactataggggaggctgcgcaggaactcacgggtgacaaaaacagaggagatttgtcatgcgtgagttcaacctggcggcagcgcaaaagatg

SEQ ID NO: 185441 - DNA, 103 bp, Artificial Sequence
  Synthetic Polynucleotide
taatacgactcactatagggagggtttgcggaggctgcgcaggaactcacaacagaggagagtgagtatgtgcgcagccaacctggcggcagcgcaaaagatg

SEQ ID NO: 185442 - DNA, 103 bp, Artificial Sequence
  Synthetic Polynucleotide
taatacgactcactatagggatatcactgaagggtttgcggaggctgcgcaacagaggagagcgcagatgccgcaaaccaacctggcggcagcgcaaaagatg

SEQ ID NO: 185443 - DNA, 103 bp, Artificial Sequence
  Synthetic Polynucleotide
taatacgactcactatagggaggctcaatgatatcactgaagggtttgcgaacagaggagacgcaaaatgttcagtgataacctggcggcagcgcaaaagatg

SEQ ID NO: 185444 - DNA, 103 bp, Artificial Sequence
  Synthetic Polynucleotide
taatacgactcactatagggattcaaacttaggctcaatgatatcactgaaacagaggagatcagtgatgtcattgagcaacctggcggcagcgcaaaagatg

SEQ ID NO: 185445 - DNA, 103 bp, Artificial Sequence
  Synthetic Polynucleotide
taatacgactcactatagggttgacagcaaattcaaacttaggctcaatgaacagaggagacattgaatgtaagtttgaaacctggcggcagcgcaaaagatg

SEQ ID NO: 185446 - DNA, 103 bp, Artificial Sequence
  Synthetic Polynucleotide
taatacgactcactatagggaataggagaatctcccagagtttcacccataacagaggagaatgggtatgactctgggaaacctggcggcagcgcaaaagatg

SEQ ID NO: 185447 - DNA, 103 bp, Artificial Sequence
  Synthetic Polynucleotide
taatacgactcactataggggggccagaatggcatctctgtgtcaaccataacagaggagaatggttatgacagagatgaacctggcggcagcgcaaaagatg

SEQ ID NO: 185448 - DNA, 103 bp, Artificial Sequence
  Synthetic Polynucleotide
taatacgactcactataggggttcaagtcaagatttacaaaaccaggaataacagaggagaattcctatgtttgtaaataacctggcggcagcgcaaaagatg

SEQ ID NO: 185449 - DNA, 103 bp, Artificial Sequence
  Synthetic Polynucleotide
taatacgactcactatagggttacttggtcgttcaagtcaagatttacaaaacagaggagattgtaaatgttgacttgaaacctggcggcagcgcaaaagatg

SEQ ID NO: 185450 - DNA, 103 bp, Artificial Sequence
  Synthetic Polynucleotide
taatacgactcactatagggttgaggagagttacttggtcgttcaagtcaaacagaggagatgacttatgcgaccaagtaacctggcggcagcgcaaaagatg

SEQ ID NO: 185451 - DNA, 103 bp, Artificial Sequence
  Synthetic Polynucleotide
taatacgactcactataggggactccatatttgaggagagttacttggtcaacagaggagagaccaaatgactctcctcaacctggcggcagcgcaaaagatg

SEQ ID NO: 185452 - DNA, 103 bp, Artificial Sequence
  Synthetic Polynucleotide
taatacgactcactatagggtgatctcgtggactccatatttgaggagagaacagaggagactctccatgaatatggagaacctggcggcagcgcaaaagatg

SEQ ID NO: 185453 - DNA, 103 bp, Artificial Sequence
  Synthetic Polynucleotide
taatacgactcactatagggattgtgtaaatgatctcgtggactccatataacagaggagaatatggatgccacgagataacctggcggcagcgcaaaagatg

SEQ ID NO: 185454 - DNA, 103 bp, Artificial Sequence
  Synthetic Polynucleotide
taatacgactcactatagggggaggccagcattgtgtaaatgatctcgtgaacagaggagacacgagatgatttacacaaacctggcggcagcgcaaaagatg

SEQ ID NO: 185455 - DNA, 103 bp, Artificial Sequence
  Synthetic Polynucleotide
taatacgactcactatagggtattcatcaaggaggccagcattgtgtaaaaacagaggagatttacaatgtgctggcctaacctggcggcagcgcaaaagatg

SEQ ID NO: 185456 - DNA, 103 bp, Artificial Sequence
  Synthetic Polynucleotide
taatacgactcactatagggaccccatctttattcatcaaggaggccagcaacagaggagagctggcatgcttgatgaaaacctggcggcagcgcaaaagatg

SEQ ID NO: 185457 - DNA, 103 bp, Artificial Sequence
  Synthetic Polynucleotide
taatacgactcactatagggggatatgagaaccccatctttattcatcaaaacagaggagattgatgatgaaagatgggaacctggcggcagcgcaaaagatg

SEQ ID NO: 185458 - DNA, 103 bp, Artificial Sequence
  Synthetic Polynucleotide
taatacgactcactatagggcaaagttggtgggccagaatggcatctctgaacagaggagacagagaatgcattctggcaacctggcggcagcgcaaaagatg

SEQ ID NO: 185459 - DNA, 103 bp, Artificial Sequence
  Synthetic Polynucleotide
taatacgactcactatagggcttggccctcggatatgagaaccccatcttaacagaggagaaagatgatgttctcatataacctggcggcagcgcaaaagatg

SEQ ID NO: 185460 - DNA, 103 bp, Artificial Sequence
  Synthetic Polynucleotide
taatacgactcactataggggtcatgaagccttggccctcggatatgagaaacagaggagatctcatatgcgagggccaaacctggcggcagcgcaaaagatg

SEQ ID NO: 185461 - DNA, 103 bp, Artificial Sequence
  Synthetic Polynucleotide
taatacgactcactatagggaaactcccttgtcatgaagccttggccctcaacagaggagagagggcatgggcttcatgaacctggcggcagcgcaaaagatg

SEQ ID NO: 185462 - DNA, 103 bp, Artificial Sequence
  Synthetic Polynucleotide
taatacgactcactatagggggctctttagaaactcccttgtcatgaagcaacagaggagagcttcaatgcaagggagtaacctggcggcagcgcaaaagatg

SEQ ID NO: 185463 - DNA, 103 bp, Artificial Sequence
  Synthetic Polynucleotide
taatacgactcactatagggggctttcgcaggctctttagaaactcccttaacagaggagaaagggaatgtctaaagagaacctggcggcagcgcaaaagatg

SEQ ID NO: 185464 - DNA, 103 bp, Artificial Sequence
  Synthetic Polynucleotide
taatacgactcactataggggtcaccaaaaggctttcgcaggctctttagaacagaggagactaaagatgctgcgaaagaacctggcggcagcgcaaaagatg

SEQ ID NO: 185465 - DNA, 103 bp, Artificial Sequence
  Synthetic Polynucleotide
taatacgactcactataggggctccataaagtcaccaaaaggctttcgcaaacagaggagatgcgaaatgcttttggtgaacctggcggcagcgcaaaagatg

SEQ ID NO: 185466 - DNA, 103 bp, Artificial Sequence
  Synthetic Polynucleotide
taatacgactcactatagggtcaaacttgggctccataaagtcaccaaaaaacagaggagattttggatgctttatggaaacctggcggcagcgcaaaagatg

SEQ ID NO: 185467 - DNA, 103 bp, Artificial Sequence
  Synthetic Polynucleotide
taatacgactcactatagggcacagcaaactcaaacttgggctccataaaaacagaggagatttatgatgcccaagtttaacctggcggcagcgcaaaagatg

SEQ ID NO: 185468 - DNA, 103 bp, Artificial Sequence
  Synthetic Polynucleotide
taatacgactcactatagggcattgaacttcacagcaaactcaaacttggaacagaggagaccaagtatgagtttgctgaacctggcggcagcgcaaaagatg

SEQ ID NO: 185469 - DNA, 103 bp, Artificial Sequence
  Synthetic Polynucleotide
taatacgactcactataggggagctgatcccaaagttggtgggccagaataacagaggagaattctgatgcaccaacttaacctggcggcagcgcaaaagatg

SEQ ID NO: 185470 - DNA, 103 bp, Artificial Sequence
  Synthetic Polynucleotide
taatacgactcactatagggaattccagtgcattgaacttcacagcaaacaacagaggagagtttgcatggaagttcaaaacctggcggcagcgcaaaagatg

SEQ ID NO: 185471 - DNA, 103 bp, Artificial Sequence
  Synthetic Polynucleotide
taatacgactcactataggggctgtcatctaattccagtgcattgaacttaacagaggagaaagttcatggcactggaaaacctggcggcagcgcaaaagatg

SEQ ID NO: 185472 - DNA, 103 bp, Artificial Sequence
  Synthetic Polynucleotide
taatacgactcactatagggttgccaagtcgctgtcatctaattccagtgaacagaggagacactggatgtagatgacaaacctggcggcagcgcaaaagatg

SEQ ID NO: 185473 - DNA, 103 bp, Artificial Sequence
  Synthetic Polynucleotide
taatacgactcactataggggcaataaatattgccaagtcgctgtcatctaacagaggagaagatgaatgcgacttggcaacctggcggcagcgcaaaagatg

SEQ ID NO: 185474 - DNA, 103 bp, Artificial Sequence
  Synthetic Polynucleotide
taatacgactcactatagggaataatgacagcaataaatattgccaagtcaacagaggagagacttgatgatatttattaacctggcggcagcgcaaaagatg

SEQ ID NO: 185475 - DNA, 103 bp, Artificial Sequence
  Synthetic Polynucleotide
taatacgactcactatagggctccactgagaataatgacagcaataaataaacagaggagatatttaatgctgtcattaaacctggcggcagcgcaaaagatg

SEQ ID NO: 185476 - DNA, 103 bp, Artificial Sequence
  Synthetic Polynucleotide
taatacgactcactatagggcctgggcggtctccactgagaataatgacaaacagaggagatgtcatatgtctcagtggaacctggcggcagcgcaaaagatg

SEQ ID NO: 185477 - DNA, 103 bp, Artificial Sequence
  Synthetic Polynucleotide
taatacgactcactatagggattcagcaaacctgggcggtctccactgagaacagaggagactcagtatggaccgcccaaacctggcggcagcgcaaaagatg

SEQ ID NO: 185478 - DNA, 103 bp, Artificial Sequence
  Synthetic Polynucleotide
taatacgactcactatagggtgggcttcacattcagcaaacctgggcggtaacagaggagaaccgccatggtttgctgaaacctggcggcagcgcaaaagatg

SEQ ID NO: 185479 - DNA, 103 bp, Artificial Sequence
  Synthetic Polynucleotide
taatacgactcactatagggatgtcttcaatgggcttcacattcagcaaaaacagaggagatttgctatgtgtgaagccaacctggcggcagcgcaaaagatg

SEQ ID NO: 185480 - DNA, 103 bp, Artificial Sequence
  Synthetic Polynucleotide
taatacgactcactataggggagatccacggagctgatcccaaagttggtaacagaggagaaccaacatggggatcagcaacctggcggcagcgcaaaagatg

SEQ ID NO: 185481 - DNA, 103 bp, Artificial Sequence
  Synthetic Polynucleotide
taatacgactcactataggggttgtcttgaatgtcttcaatgggcttcacaacagaggagagtgaagatgattgaagacaacctggcggcagcgcaaaagatg

SEQ ID NO: 185482 - DNA, 103 bp, Artificial Sequence
  Synthetic Polynucleotide
taatacgactcactatagggcttgtagcaggttgtcttgaatgtcttcaaaacagaggagattgaagatgttcaagacaaacctggcggcagcgcaaaagatg

SEQ ID NO: 185483 - DNA, 103 bp, Artificial Sequence
  Synthetic Polynucleotide
taatacgactcactatagggagctccagggcttgtagcaggttgtcttgaaacagaggagatcaagaatgcctgctacaaacctggcggcagcgcaaaagatg

SEQ ID NO: 185484 - DNA, 103 bp, Artificial Sequence
  Synthetic Polynucleotide
taatacgactcactatagggcttcagctggagctccagggcttgtagcagaacagaggagactgctaatggccctggagaacctggcggcagcgcaaaagatg

SEQ ID NO: 185485 - DNA, 103 bp, Artificial Sequence
  Synthetic Polynucleotide
taatacgactcactatagggggtggttcagcttcagctggagctccagggaacagaggagaccctggatgtccagctgaaacctggcggcagcgcaaaagatg

SEQ ID NO: 185486 - DNA, 103 bp, Artificial Sequence
  Synthetic Polynucleotide
taatacgactcactataggggaggactcagggtggttcagcttcagctggaacagaggagaccagctatggctgaaccaaacctggcggcagcgcaaaagatg

SEQ ID NO: 185487 - DNA, 103 bp, Artificial Sequence
  Synthetic Polynucleotide
taatacgactcactatagggaaacagctgtgaggactcagggtggttcagaacagaggagactgaacatgcctgagtccaacctggcggcagcgcaaaagatg

SEQ ID NO: 185488 - DNA, 103 bp, Artificial Sequence
  Synthetic Polynucleotide
taatacgactcactataggggcagcttggcaaacagctgtgaggactcagaacagaggagactgagtatgcacagctgtaacctggcggcagcgcaaaagatg

SEQ ID NO: 185489 - DNA, 103 bp, Artificial Sequence
  Synthetic Polynucleotide
taatacgactcactatagggattttctggagcagcttggcaaacagctgtaacagaggagaacagctatgtgccaagctaacctggcggcagcgcaaaagatg

SEQ ID NO: 185490 - DNA, 103 bp, Artificial Sequence
  Synthetic Polynucleotide
taatacgactcactataggggaggtctgtcattttctggagcagcttggcaacagaggagagccaagatgctccagaaaaacctggcggcagcgcaaaagatg

SEQ ID NO: 185491 - DNA, 103 bp, Artificial Sequence
  Synthetic Polynucleotide
taatacgactcactatagggccattacggagagatccacggagctgatccaacagaggagaggatcaatgccgtggatcaacctggcggcagcgcaaaagatg

SEQ ID NO: 185492 - DNA, 103 bp, Artificial Sequence
  Synthetic Polynucleotide
taatacgactcactatagggcaatctgtctgaggtctgtcattttctggaaacagaggagatccagaatgtgacagaccaacctggcggcagcgcaaaagatg

SEQ ID NO: 185493 - DNA, 103 bp, Artificial Sequence
  Synthetic Polynucleotide
taatacgactcactatagggtgttccgtgacaatctgtctgaggtctgtcaacagaggagagacagaatgcagacagataacctggcggcagcgcaaaagatg

SEQ ID NO: 185494 - DNA, 103 bp, Artificial Sequence
  Synthetic Polynucleotide
taatacgactcactatagggtagctgcacgtgttccgtgacaatctgtctaacagaggagaagacagatggtcacggaaaacctggcggcagcgcaaaagatg

SEQ ID NO: 185495 - DNA, 103 bp, Artificial Sequence
  Synthetic Polynucleotide
taatacgactcactatagggtcacctgcagtagctgcacgtgttccgtgaaacagaggagatcacggatgacgtgcagcaacctggcggcagcgcaaaagatg

SEQ ID NO: 185496 - DNA, 103 bp, Artificial Sequence
  Synthetic Polynucleotide
taatacgactcactataggggtcttcttgatcacctgcagtagctgcacgaacagaggagacgtgcaatgactgcaggtaacctggcggcagcgcaaaagatg

SEQ ID NO: 185497 - DNA, 103 bp, Artificial Sequence
  Synthetic Polynucleotide
taatacgactcactataggggtctgtctccgtcttcttgatcacctgcagaacagaggagactgcagatgatcaagaagaacctggcggcagcgcaaaagatg

SEQ ID NO: 185498 - DNA, 103 bp, Artificial Sequence
  Synthetic Polynucleotide
taatacgactcactataggggaagactcatgtctgtctccgtcttcttgaaacagaggagatcaagaatgcggagacagaacctggcggcagcgcaaaagatg

SEQ ID NO: 185499 - DNA, 103 bp, Artificial Sequence
  Synthetic Polynucleotide
taatacgactcactatagggaggagcgggtgaagactcatgtctgtctccaacagaggagaggagacatgcatgagtctaacctggcggcagcgcaaaagatg

SEQ ID NO: 185500 - DNA, 103 bp, Artificial Sequence
  Synthetic Polynucleotide
taatacgactcactataggggatctcctgcaggagcgggtgaagactcataacagaggagaatgagtatgcacccgctcaacctggcggcagcgcaaaagatg

SEQ ID NO: 185501 - DNA, 103 bp, Artificial Sequence
  Synthetic Polynucleotide
taatacgactcactatagggagtccttgtagatctcctgcaggagcgggtaacagaggagaacccgcatgtgcaggagaaacctggcggcagcgcaaaagatg

SEQ ID NO: 185502 - DNA, 103 bp, Artificial Sequence
  Synthetic Polynucleotide
taatacgactcactataggggagtggtcttccattacggagagatccacgaacagaggagacgtggaatgctccgtaataacctggcggcagcgcaaaagatg

SEQ ID NO: 185503 - DNA, 103 bp, Artificial Sequence
  Synthetic Polynucleotide
taatacgactcactatagggaaaggagtgggagtggtcttccattacggaaacagaggagatccgtaatggaagaccacaacctggcggcagcgcaaaagatg

SEQ ID NO: 185504 - DNA, 103 bp, Artificial Sequence
  Synthetic Polynucleotide
taatacgactcactataggggcttgatatcaaaggagtgggagtggtcttaacagaggagaaagaccatgcccactcctaacctggcggcagcgcaaaagatg

SEQ ID NO: 185505 - DNA, 103 bp, Artificial Sequence
  Synthetic Polynucleotide
taatacgactcactataggggtagtgaagggcttgatatcaaaggagtggaacagaggagaccactcatgtgatatcaaaacctggcggcagcgcaaaagatg

SEQ ID NO: 185506 - DNA, 103 bp, Artificial Sequence
  Synthetic Polynucleotide
taatacgactcactataggggaagtcaacagtagtgaagggcttgatatcaacagaggagagatatcatgcccttcactaacctggcggcagcgcaaaagatg

SEQ ID NO: 185507 - DNA, 103 bp, Artificial Sequence
  Synthetic Polynucleotide
taatacgactcactatagggtttctgggtcaataggagaatctcccagagaacagaggagactctggatgattctcctaaacctggcggcagcgcaaaagatg

SEQ ID NO: 185508 - DNA, 103 bp, Artificial Sequence
  Synthetic Polynucleotide
taatacgactcactatagggaaatgctggagaagtcaacagtagtgaaggaacagaggagaccttcaatgctgttgactaacctggcggcagcgcaaaagatg

SEQ ID NO: 185509 - DNA, 103 bp, Artificial Sequence
  Synthetic Polynucleotide
taatacgactcactatagggtgtggagtagaaatgctggagaagtcaacaaacagaggagatgttgaatgctccagcataacctggcggcagcgcaaaagatg

SEQ ID NO: 185510 - DNA, 103 bp, Artificial Sequence
  Synthetic Polynucleotide
taatacgactcactataggggtcttcgtaatgtggagtagaaatgctggaaacagaggagatccagcatgtctactccaaacctggcggcagcgcaaaagatg

SEQ ID NO: 185511 - DNA, 103 bp, Artificial Sequence
  Synthetic Polynucleotide
taatacgactcactatagggtgaatggaatgtcttcgtaatgtggagtagaacagaggagactactcatgattacgaagaacctggcggcagcgcaaaagatg

SEQ ID NO: 185512 - DNA, 103 bp, Artificial Sequence
  Synthetic Polynucleotide
taatacgactcactatagggtctgttcttgtgaatggaatgtcttcgtaaaacagaggagattacgaatgcattccattaacctggcggcagcgcaaaagatg

SEQ ID NO: 185513 - DNA, 103 bp, Artificial Sequence
  Synthetic Polynucleotide
taatacgactcactatagggaaccactggatctgttcttgtgaatggaataacagaggagaattccaatgacaagaacaaacctggcggcagcgcaaaagatg

SEQ ID NO: 185514 - DNA, 103 bp, Artificial Sequence
  Synthetic Polynucleotide
taatacgactcactatagggtgtaatctgcaaccactggatctgttcttgaacagaggagacaagaaatgatccagtggaacctggcggcagcgcaaaagatg

SEQ ID NO: 185515 - DNA, 103 bp, Artificial Sequence
  Synthetic Polynucleotide
taatacgactcactatagggaggtcatacttgtaatctgcaaccactggaaacagaggagatccagtatgtgcagattaaacctggcggcagcgcaaaagatg

SEQ ID NO: 185516 - DNA, 103 bp, Artificial Sequence
  Synthetic Polynucleotide
taatacgactcactatagggttgaagtttcaggtcatacttgtaatctgcaacagaggagagcagatatgaagtatgacaacctggcggcagcgcaaaagatg

SEQ ID NO: 185517 - DNA, 103 bp, Artificial Sequence
  Synthetic Polynucleotide
taatacgactcactatagggtttggtactcttgaagtttcaggtcatactaacagaggagaagtatgatgtgaaacttcaacctggcggcagcgcaaaagatg

SEQ ID NO: 185518 - DNA, 103 bp, Artificial Sequence
  Synthetic Polynucleotide
taatacgactcactatagggaaggaatcgctttctgggtcaataggagaaaacagaggagattctccatgtgacccagaaacctggcggcagcgcaaaagatg

SEQ ID NO: 185519 - DNA, 103 bp, Artificial Sequence
  Synthetic Polynucleotide
taatacgactcactatagggttgattgcactttggtactcttgaagtttcaacagaggagagaaactatgagagtaccaaacctggcggcagcgcaaaagatg

SEQ ID NO: 185520 - DNA, 103 bp, Artificial Sequence
  Synthetic Polynucleotide
taatacgactcactatagggaggctccactttgattgcactttggtactcaacagaggagagagtacatgagtgcaatcaacctggcggcagcgcaaaagatg

SEQ ID NO: 185521 - DNA, 103 bp, Artificial Sequence
  Synthetic Polynucleotide
taatacgactcactataggggtggagatgcaggctccactttgattgcacaacagaggagagtgcaaatgaagtggagcaacctggcggcagcgcaaaagatg

SEQ ID NO: 185522 - DNA, 103 bp, Artificial Sequence
  Synthetic Polynucleotide
taatacgactcactataggggaataataaggtggagatgcaggctccactaacagaggagaagtggaatgtgcatctccaacctggcggcagcgcaaaagatg

SEQ ID NO: 185523 - DNA, 103 bp, Artificial Sequence
  Synthetic Polynucleotide
taatacgactcactatagggagtcttctcagaataataaggtggagatgcaacagaggagagcatctatgccttattataacctggcggcagcgcaaaagatg

SEQ ID NO: 185524 - DNA, 103 bp, Artificial Sequence
  Synthetic Polynucleotide
taatacgactcactatagggtgtagagctgagtcttctcagaataataagaacagaggagacttattatgctgagaagaaacctggcggcagcgcaaaagatg

SEQ ID NO: 185525 - DNA, 103 bp, Artificial Sequence
  Synthetic Polynucleotide
taatacgactcactatagggtgaggcttattgtagagctgagtcttctcaaacagaggagatgagaaatgtcagctctaaacctggcggcagcgcaaaagatg

SEQ ID NO: 185526 - DNA, 103 bp, Artificial Sequence
  Synthetic Polynucleotide
taatacgactcactatagggaggctcttcatgaggcttattgtagagctgaacagaggagacagctcatgaataagcctaacctggcggcagcgcaaaagatg

SEQ ID NO: 185527 - DNA, 103 bp, Artificial Sequence
  Synthetic Polynucleotide
taatacgactcactataggggggagttggaaggctcttcatgaggcttataacagaggagaataagcatgatgaagagcaacctggcggcagcgcaaaagatg

SEQ ID NO: 185528 - DNA, 103 bp, Artificial Sequence
  Synthetic Polynucleotide
taatacgactcactatagggattgccatgagggagttggaaggctcttcaaacagaggagatgaagaatgttccaactcaacctggcggcagcgcaaaagatg

SEQ ID NO: 185529 - DNA, 103 bp, Artificial Sequence
  Synthetic Polynucleotide
taatacgactcactatagggtgtatcagtgaaggaatcgctttctgggtcaacagaggagagacccaatgagcgattccaacctggcggcagcgcaaaagatg

SEQ ID NO: 185530 - DNA, 103 bp, Artificial Sequence
  Synthetic Polynucleotide
taatacgactcactatagggacgacattcaattgccatgagggagttggaaacagaggagatccaacatgctcatggcaaacctggcggcagcgcaaaagatg

SEQ ID NO: 185531 - DNA, 103 bp, Artificial Sequence
  Synthetic Polynucleotide
taatacgactcactatagggctccacagacacgacattcaattgccatgaaacagaggagatcatggatgttgaatgtcaacctggcggcagcgcaaaagatg

SEQ ID NO: 185532 - DNA, 103 bp, Artificial Sequence
  Synthetic Polynucleotide
taatacgactcactataggggaagctttatctccacagacacgacattcaaacagaggagatgaatgatgtgtctgtggaacctggcggcagcgcaaaagatg

SEQ ID NO: 185533 - DNA, 103 bp, Artificial Sequence
  Synthetic Polynucleotide
taatacgactcactataggggtgaaatccagaagctttatctccacagacaacagaggagagtctgtatggataaagctaacctggcggcagcgcaaaagatg

SEQ ID NO: 185534 - DNA, 103 bp, Artificial Sequence
  Synthetic Polynucleotide
taatacgactcactataggggaactccatagtgaaatccagaagctttataacagaggagaataaagatgctggatttcaacctggcggcagcgcaaaagatg

SEQ ID NO: 185535 - DNA, 103 bp, Artificial Sequence
  Synthetic Polynucleotide
taatacgactcactatagggtcacaagcatgaactccatagtgaaatccaaacagaggagatggattatgctatggagtaacctggcggcagcgcaaaagatg

SEQ ID NO: 185536 - DNA, 103 bp, Artificial Sequence
  Synthetic Polynucleotide
taatacgactcactatagggcttgcatccttcacaagcatgaactccataaacagaggagatatggaatgcatgcttgtaacctggcggcagcgcaaaagatg

SEQ ID NO: 185537 - DNA, 103 bp, Artificial Sequence
  Synthetic Polynucleotide
taatacgactcactatagggggaagaaacccttgcatccttcacaagcataacagaggagaatgcttatgaaggatgcaaacctggcggcagcgcaaaagatg

SEQ ID NO: 185538 - DNA, 103 bp, Artificial Sequence
  Synthetic Polynucleotide
taatacgactcactatagggattgttctccggaagaaacccttgcatcctaacagaggagaaggatgatggggtttcttaacctggcggcagcgcaaaagatg

SEQ ID NO: 185539 - DNA, 103 bp, Artificial Sequence
  Synthetic Polynucleotide
taatacgactcactatagggcttcaatctgattgttctccggaagaaaccaacagaggagaggtttcatgcggagaacaaacctggcggcagcgcaaaagatg

SEQ ID NO: 185540 - DNA, 103 bp, Artificial Sequence
  Synthetic Polynucleotide
taatacgactcactatagggttgcagacagtgtatcagtgaaggaatcgcaacagaggagagcgattatgtcactgataaacctggcggcagcgcaaaagatg

SEQ ID NO: 185541 - DNA, 103 bp, Artificial Sequence
  Synthetic Polynucleotide
taatacgactcactatagggcatagataagcttcaatctgattgttctccaacagaggagaggagaaatgtcagattgaaacctggcggcagcgcaaaagatg

SEQ ID NO: 185542 - DNA, 103 bp, Artificial Sequence
  Synthetic Polynucleotide
taatacgactcactatagggtcacatctgtcatagataagcttcaatctgaacagaggagacagattatggcttatctaaacctggcggcagcgcaaaagatg

SEQ ID NO: 185543 - DNA, 103 bp, Artificial Sequence
  Synthetic Polynucleotide
taatacgactcactatagggacagttaagatcacatctgtcatagataagaacagaggagacttatcatggacagatgtaacctggcggcagcgcaaaagatg

SEQ ID NO: 185544 - DNA, 103 bp, Artificial Sequence
  Synthetic Polynucleotide
taatacgactcactatagggtgtggatccgacagttaagatcacatctgtaacagaggagaacagatatgatcttaactaacctggcggcagcgcaaaagatg

SEQ ID NO: 185545 - DNA, 103 bp, Artificial Sequence
  Synthetic Polynucleotide
taatacgactcactatagggctactttttttgtggatccgacagttaagaaacagaggagatcttaaatgtcggatccaaacctggcggcagcgcaaaagatg

SEQ ID NO: 185546 - DNA, 103 bp, Artificial Sequence
  Synthetic Polynucleotide
taatacgactcactatagggacatttatttctactttttttgtggatccgaacagaggagacggatcatgaaaaaaagtaacctggcggcagcgcaaaagatg

SEQ ID NO: 185547 - DNA, 103 bp, Artificial Sequence
  Synthetic Polynucleotide
taatacgactcactataggggacagtactgacatttatttctacttttttaacagaggagaaaaaaaatggaaataaataacctggcggcagcgcaaaagatg

SEQ ID NO: 185548 - DNA, 103 bp, Artificial Sequence
  Synthetic Polynucleotide
taatacgactcactatagggttctgaaaccgacagtactgacatttatttaacagaggagaaaataaatgtcagtactgaacctggcggcagcgcaaaagatg

SEQ ID NO: 185549 - DNA, 103 bp, Artificial Sequence
  Synthetic Polynucleotide
taatacgactcactatagggtgcaaggcatttctgaaaccgacagtactgaacagaggagacagtacatgcggtttcagaacctggcggcagcgcaaaagatg

SEQ ID NO: 185550 - DNA, 103 bp, Artificial Sequence
  Synthetic Polynucleotide
taatacgactcactatagggacatccccactgcaaggcatttctgaaaccaacagaggagaggtttcatgaatgccttgaacctggcggcagcgcaaaagatg

SEQ ID NO: 185551 - DNA, 103 bp, Artificial Sequence
  Synthetic Polynucleotide
taatacgactcactatagggtgtgatatgtttgcagacagtgtatcagtgaacagaggagacactgaatgactgtctgcaacctggcggcagcgcaaaagatg

SEQ ID NO: 185552 - DNA, 103 bp, Artificial Sequence
  Synthetic Polynucleotide
taatacgactcactataggggcattatgagacatccccactgcaaggcataacagaggagaatgcctatgagtggggataacctggcggcagcgcaaaagatg

SEQ ID NO: 185553 - DNA, 103 bp, Artificial Sequence
  Synthetic Polynucleotide
taatacgactcactatagggaaacctgatggcattatgagacatccccacaacagaggagagtggggatgtctcataataacctggcggcagcgcaaaagatg

SEQ ID NO: 185554 - DNA, 103 bp, Artificial Sequence
  Synthetic Polynucleotide
taatacgactcactataggggcatccgcccaaacctgatggcattatgagaacagaggagactcataatgccatcaggtaacctggcggcagcgcaaaagatg

SEQ ID NO: 185555 - DNA, 103 bp, Artificial Sequence
  Synthetic Polynucleotide
taatacgactcactatagggtcggcctgtggcatccgcccaaacctgatgaacagaggagacatcagatgtgggcggataacctggcggcagcgcaaaagatg

SEQ ID NO: 185556 - DNA, 103 bp, Artificial Sequence
  Synthetic Polynucleotide
taatacgactcactatagggcttctccttctcggcctgtggcatccgcccaacagaggagagggcggatgccacaggccaacctggcggcagcgcaaaagatg

SEQ ID NO: 185557 - DNA, 103 bp, Artificial Sequence
  Synthetic Polynucleotide
taatacgactcactatagggccgccaacagcttctccttctcggcctgtgaacagaggagacacaggatgagaaggagaaacctggcggcagcgcaaaagatg

SEQ ID NO: 185558 - DNA, 103 bp, Artificial Sequence
  Synthetic Polynucleotide
taatacgactcactatagggctggagatctccgccaacagcttctccttcaacagaggagagaaggaatggctgttggcaacctggcggcagcgcaaaagatg

SEQ ID NO: 185559 - DNA, 103 bp, Artificial Sequence
  Synthetic Polynucleotide
taatacgactcactataggggtcgatatcactggagatctccgccaacagaacagaggagactgttgatggagatctccaacctggcggcagcgcaaaagatg

SEQ ID NO: 185560 - DNA, 103 bp, Artificial Sequence
  Synthetic Polynucleotide
taatacgactcactataggggattcagctggtcgatatcactggagatctaacagaggagaagatctatggtgatatcgaacctggcggcagcgcaaaagatg

SEQ ID NO: 185561 - DNA, 103 bp, Artificial Sequence
  Synthetic Polynucleotide
taatacgactcactataggggcggactctggattcagctggtcgatatcaaacagaggagatgatatatgccagctgaaaacctggcggcagcgcaaaagatg

SEQ ID NO: 185562 - DNA, 103 bp, Artificial Sequence
  Synthetic Polynucleotide
taatacgactcactatagggggtcatttcttgtgatatgtttgcagacagaacagaggagactgtctatgaacatatcaaacctggcggcagcgcaaaagatg

SEQ ID NO: 185563 - DNA, 103 bp, Artificial Sequence
  Synthetic Polynucleotide
taatacgactcactatagggccggaggtcagcggactctggattcagctgaacagaggagacagctgatgccagagtccaacctggcggcagcgcaaaagatg

SEQ ID NO: 185564 - DNA, 103 bp, Artificial Sequence
  Synthetic Polynucleotide
taatacgactcactatagggttgccagggcccggaggtcagcggactctgaacagaggagacagagtatgctgacctccaacctggcggcagcgcaaaagatg

SEQ ID NO: 185565 - DNA, 103 bp, Artificial Sequence
  Synthetic Polynucleotide
taatacgactcactatagggtacaaatgttttgccagggcccggaggtcaaacagaggagatgacctatgggccctggcaacctggcggcagcgcaaaagatg

SEQ ID NO: 185566 - DNA, 103 bp, Artificial Sequence
  Synthetic Polynucleotide
taatacgactcactataggggtatgagtcatacaaatgttttgccagggcaacagaggagagccctgatgaaacatttgaacctggcggcagcgcaaaagatg

SEQ ID NO: 185567 - DNA, 103 bp, Artificial Sequence
  Synthetic Polynucleotide
taatacgactcactatagggaggactttatgtatgagtcatacaaatgttaacagaggagaaacattatgatgactcataacctggcggcagcgcaaaagatg

SEQ ID NO: 185568 - DNA, 103 bp, Artificial Sequence
  Synthetic Polynucleotide
taatacgactcactataggggtcagcgggaaggactttatgtatgagtcaaacagaggagatgactcatgcataaagtcaacctggcggcagcgcaaaagatg

SEQ ID NO: 185569 - DNA, 103 bp, Artificial Sequence
  Synthetic Polynucleotide
taatacgactcactatagggctttgctttggtcagcgggaaggactttataacagaggagaataaagatgttcccgctgaacctggcggcagcgcaaaagatg

SEQ ID NO: 185570 - DNA, 103 bp, Artificial Sequence
  Synthetic Polynucleotide
taatacgactcactatagggtcgccctcgcctttgctttggtcagcgggaaacagaggagatcccgcatgccaaagcaaaacctggcggcagcgcaaaagatg

SEQ ID NO: 185571 - DNA, 103 bp, Artificial Sequence
  Synthetic Polynucleotide
taatacgactcactatagggcctgtcaagatcgccctcgcctttgctttgaacagaggagacaaagcatgggcgagggcaacctggcggcagcgcaaaagatg

SEQ ID NO: 185572 - DNA, 103 bp, Artificial Sequence
  Synthetic Polynucleotide
taatacgactcactatagggtgttgtctttcctgtcaagatcgccctcgcaacagaggagagcgaggatgatcttgacaaacctggcggcagcgcaaaagatg

SEQ ID NO: 185573 - DNA, 103 bp, Artificial Sequence
  Synthetic Polynucleotide
taatacgactcactatagggtgtcaaccatggtcatttcttgtgatatgtaacagaggagaacatatatgaagaaatgaaacctggcggcagcgcaaaagatg

SEQ ID NO: 185574 - DNA, 103 bp, Artificial Sequence
  Synthetic Polynucleotide
taatacgactcactataggggtgatttgtctgttgtctttcctgtcaagaaacagaggagatcttgaatggaaagacaaaacctggcggcagcgcaaaagatg

SEQ ID NO: 185575 - DNA, 103 bp, Artificial Sequence
  Synthetic Polynucleotide
taatacgactcactatagggataacgaatggtgatttgtctgttgtctttaacagaggagaaaagacatgagacaaatcaacctggcggcagcgcaaaagatg

SEQ ID NO: 185576 - DNA, 103 bp, Artificial Sequence
  Synthetic Polynucleotide
taatacgactcactatagggcatgtcatagataacgaatggtgatttgtcaacagaggagagacaaaatgccattcgttaacctggcggcagcgcaaaagatg

SEQ ID NO: 185577 - DNA, 103 bp, Artificial Sequence
  Synthetic Polynucleotide
taatacgactcactatagggttaaggaattcatgtcatagataacgaatgaacagaggagacattcgatgtctatgacaaacctggcggcagcgcaaaagatg

SEQ ID NO: 185578 - DNA, 103 bp, Artificial Sequence
  Synthetic Polynucleotide
taatacgactcactatagggtctcccatcattaaggaattcatgtcatagaacagaggagactatgaatggaattccttaacctggcggcagcgcaaaagatg

SEQ ID NO: 185579 - DNA, 103 bp, Artificial Sequence
  Synthetic Polynucleotide
taatacgactcactataggggattttatcttctcccatcattaaggaattaacagaggagaaattccatgatgatgggaaacctggcggcagcgcaaaagatg

SEQ ID NO: 185580 - DNA, 103 bp, Artificial Sequence
  Synthetic Polynucleotide
taatacgactcactataggggtttgaacttgattttatcttctcccatcaaacagaggagatgatggatgaagataaaaaacctggcggcagcgcaaaagatg

SEQ ID NO: 185581 - DNA, 103 bp, Artificial Sequence
  Synthetic Polynucleotide
taatacgactcactatagggggggtgatgtgtttgaacttgattttatctaacagaggagaagataaatgcaagttcaaaacctggcggcagcgcaaaagatg

SEQ ID NO: 185582 - DNA, 103 bp, Artificial Sequence
  Synthetic Polynucleotide
taatacgactcactatagggctcctgcaggggggtgatgtgtttgaacttaacagaggagaaagttcatgcacatcaccaacctggcggcagcgcaaaagatg

SEQ ID NO: 185583 - DNA, 103 bp, Artificial Sequence
  Synthetic Polynucleotide
taatacgactcactatagggctttgctctgctcctgcaggggggtgatgtaacagaggagaacatcaatgccctgcaggaacctggcggcagcgcaaaagatg

SEQ ID NO: 185584 - DNA, 103 bp, Artificial Sequence
  Synthetic Polynucleotide
taatacgactcactatagggggcatctctgtgtcaaccatggtcatttctaacagaggagaagaaatatgcatggttgaaacctggcggcagcgcaaaagatg

SEQ ID NO: 185585 - DNA, 103 bp, Artificial Sequence
  Synthetic Polynucleotide
taatacgactcactatagggatggccacctctttgctctgctcctgcaggaacagaggagacctgcaatggcagagcaaaacctggcggcagcgcaaaagatg

SEQ ID NO: 185586 - DNA, 103 bp, Artificial Sequence
  Synthetic Polynucleotide
taatacgactcactatagggaaagatgcggatggccacctctttgctctgaacagaggagacagagcatggaggtggccaacctggcggcagcgcaaaagatg

SEQ ID NO: 185587 - DNA, 103 bp, Artificial Sequence
  Synthetic Polynucleotide
taatacgactcactatagggggcagccctgaaagatgcggatggccacctaacagaggagaaggtggatgtccgcatctaacctggcggcagcgcaaaagatg

SEQ ID NO: 185588 - DNA, 103 bp, Artificial Sequence
  Synthetic Polynucleotide
taatacgactcactataggggagcgaaactggcagccctgaaagatgcggaacagaggagaccgcatatgtcagggctgaacctggcggcagcgcaaaagatg

SEQ ID NO: 185589 - DNA, 103 bp, Artificial Sequence
  Synthetic Polynucleotide
taatacgactcactatagggagcctccacggagcgaaactggcagccctgaacagaggagacagggcatgcagtttcgcaacctggcggcagcgcaaaagatg

SEQ ID NO: 185590 - DNA, 103 bp, Artificial Sequence
  Synthetic Polynucleotide
taatacgactcactatagggtctcctgcacagcctccacggagcgaaactaacagaggagaagtttcatgccgtggaggaacctggcggcagcgcaaaagatg

SEQ ID NO: 185591 - DNA, 103 bp, Artificial Sequence
  Synthetic Polynucleotide
taatacgactcactatagggtactctgtgatctcctgcacagcctccacgaacagaggagacgtggaatgtgtgcaggaaacctggcggcagcgcaaaagatg

SEQ ID NO: 185592 - DNA, 103 bp, Artificial Sequence
  Synthetic Polynucleotide
taatacgactcactataggggcttttggcatactctgtgatctcctgcacaacagaggagagtgcagatgatcacagagaacctggcggcagcgcaaaagatg

SEQ ID NO: 185593 - DNA, 103 bp, Artificial Sequence
  Synthetic Polynucleotide
taatacgactcactatagggaaccaggaatgcttttggcatactctgtgaaacagaggagatcacagatgatgccaaaaaacctggcggcagcgcaaaagatg

SEQ ID NO: 185594 - DNA, 103 bp, Artificial Sequence
  Synthetic Polynucleotide
taatacgactcactatagggagatttacaaaaccaggaatgcttttggcaaacagaggagatgccaaatgcattcctggaacctggcggcagcgcaaaagatg

SEQ ID NO: 185595 - DNA, 103 bp, Artificial Sequence
  Synthetic Polynucleotide
taatacgactcactatagggcatatccgcatcctccatgtccattttcataacagaggagaatgaaaatggacatggagaacctggcggcagcgcaaaagatg

SEQ ID NO: 185596 - DNA, 103 bp, Artificial Sequence
  Synthetic Polynucleotide
taatacgactcactatagggcgaagtaccgccatcagcaccagaatcccaaacagaggagatgggatatgggtgctgataacctggcggcagcgcaaaagatg

SEQ ID NO: 185597 - DNA, 103 bp, Artificial Sequence
  Synthetic Polynucleotide
taatacgactcactataggggtaagcgtaggagtcccggtgctcttgagaaacagaggagatctcaaatgcaccgggacaacctggcggcagcgcaaaagatg

SEQ ID NO: 185598 - DNA, 103 bp, Artificial Sequence
  Synthetic Polynucleotide
taatacgactcactatagggacgcgttcaagtaagcgtaggagtcccggtaacagaggagaaccgggatgcctacgcttaacctggcggcagcgcaaaagatg

SEQ ID NO: 185599 - DNA, 103 bp, Artificial Sequence
  Synthetic Polynucleotide
taatacgactcactataggggtgccgtaggacgcgttcaagtaagcgtagaacagaggagactacgcatgcttgaacgcaacctggcggcagcgcaaaagatg

SEQ ID NO: 185600 - DNA, 103 bp, Artificial Sequence
  Synthetic Polynucleotide
taatacgactcactatagggcaaaccttccgtgccgtaggacgcgttcaaaacagaggagattgaacatgtcctacggcaacctggcggcagcgcaaaagatg

SEQ ID NO: 185601 - DNA, 103 bp, Artificial Sequence
  Synthetic Polynucleotide
taatacgactcactatagggggtaggagcccaaaccttccgtgccgtaggaacagaggagacctacgatgcggaaggttaacctggcggcagcgcaaaagatg

SEQ ID NO: 185602 - DNA, 103 bp, Artificial Sequence
  Synthetic Polynucleotide
taatacgactcactataggggcgtagccagggtaggagcccaaaccttccaacagaggagaggaaggatggggctcctaaacctggcggcagcgcaaaagatg

SEQ ID NO: 185603 - DNA, 103 bp, Artificial Sequence
  Synthetic Polynucleotide
taatacgactcactataggggggcaggggtgcgtagccagggtaggagccaacagaggagaggctccatgcctggctacaacctggcggcagcgcaaaagatg

SEQ ID NO: 185604 - DNA, 103 bp, Artificial Sequence
  Synthetic Polynucleotide
taatacgactcactataggggcgggaggtggggcaggggtgcgtagccagaacagaggagactggctatgcacccctgcaacctggcggcagcgcaaaagatg

SEQ ID NO: 185605 - DNA, 103 bp, Artificial Sequence
  Synthetic Polynucleotide
taatacgactcactatagggatgaaagctggcgggaggtggggcaggggtaacagaggagaacccctatgccacctcccaacctggcggcagcgcaaaagatg

SEQ ID NO: 185606 - DNA, 103 bp, Artificial Sequence
  Synthetic Polynucleotide
taatacgactcactataggggtacgaggggatgaaagctggcgggaggtgaacagaggagacacctcatgccagctttcaacctggcggcagcgcaaaagatg

SEQ ID NO: 185607 - DNA, 103 bp, Artificial Sequence
  Synthetic Polynucleotide
taatacgactcactatagggccgcctgaaccgaagtaccgccatcagcacaacagaggagagtgctgatggcggtacttaacctggcggcagcgcaaaagatg

SEQ ID NO: 185608 - DNA, 103 bp, Artificial Sequence
  Synthetic Polynucleotide
taatacgactcactatagggagtgagcgttgtacgaggggatgaaagctgaacagaggagacagcttatgtcccctcgtaacctggcggcagcgcaaaagatg

SEQ ID NO: 185609 - DNA, 103 bp, Artificial Sequence
  Synthetic Polynucleotide
taatacgactcactatagggaacttggggtagtgagcgttgtacgaggggaacagaggagacccctcatgcaacgctcaaacctggcggcagcgcaaaagatg

SEQ ID NO: 185610 - DNA, 103 bp, Artificial Sequence
  Synthetic Polynucleotide
taatacgactcactataggggggcaagaggaacttggggtagtgagcgttaacagaggagaaacgctatgtaccccaagaacctggcggcagcgcaaaagatg

SEQ ID NO: 185611 - DNA, 103 bp, Artificial Sequence
  Synthetic Polynucleotide
taatacgactcactatagggtgccgtaggggggcaagaggaacttggggtaacagaggagaaccccaatgtcctcttgcaacctggcggcagcgcaaaagatg

SEQ ID NO: 185612 - DNA, 103 bp, Artificial Sequence
  Synthetic Polynucleotide
taatacgactcactatagggttacaattcatgccgtaggggggcaagaggaacagaggagacctcttatgcccctacggaacctggcggcagcgcaaaagatg

SEQ ID NO: 185613 - DNA, 103 bp, Artificial Sequence
  Synthetic Polynucleotide
taatacgactcactataggggctcaggccattacaattcatgccgtagggaacagaggagaccctacatgatgaattgtaacctggcggcagcgcaaaagatg

SEQ ID NO: 185614 - DNA, 103 bp, Artificial Sequence
  Synthetic Polynucleotide
taatacgactcactatagggtgctcacagcgctcaggccattacaattcaaacagaggagatgaattatgatggcctgaaacctggcggcagcgcaaaagatg

SEQ ID NO: 185615 - DNA, 103 bp, Artificial Sequence
  Synthetic Polynucleotide
taatacgactcactatagggccattcatgctgctcacagcgctcaggccaaacagaggagatggcctatgcgctgtgagaacctggcggcagcgcaaaagatg

SEQ ID NO: 185616 - DNA, 103 bp, Artificial Sequence
  Synthetic Polynucleotide
taatacgactcactataggggttgttgatgccattcatgctgctcacagcaacagaggagagctgtgatgagcatgaataacctggcggcagcgcaaaagatg

SEQ ID NO: 185617 - DNA, 103 bp, Artificial Sequence
  Synthetic Polynucleotide
taatacgactcactatagggagaggccaaagttgttgatgccattcatgcaacagaggagagcatgaatggcatcaacaaacctggcggcagcgcaaaagatg

SEQ ID NO: 185618 - DNA, 103 bp, Artificial Sequence
  Synthetic Polynucleotide
taatacgactcactatagggaaggatgcctccgcctgaaccgaagtaccgaacagaggagacggtacatgggttcaggcaacctggcggcagcgcaaaagatg

SEQ ID NO: 185619 - DNA, 103 bp, Artificial Sequence
  Synthetic Polynucleotide
taatacgactcactatagggagcctcgggaagaggccaaagttgttgatgaacagaggagacatcaaatgctttggcctaacctggcggcagcgcaaaagatg

SEQ ID NO: 185620 - DNA, 103 bp, Artificial Sequence
  Synthetic Polynucleotide
taatacgactcactataggggacagggcacagcctcgggaagaggccaaaaacagaggagatttggcatgttcccgaggaacctggcggcagcgcaaaagatg

SEQ ID NO: 185621 - DNA, 103 bp, Artificial Sequence
  Synthetic Polynucleotide
taatacgactcactataggggattgctgtagacagggcacagcctcgggaaacagaggagatcccgaatgtgtgccctgaacctggcggcagcgcaaaagatg

SEQ ID NO: 185622 - DNA, 103 bp, Artificial Sequence
  Synthetic Polynucleotide
taatacgactcactatagggccaccgaggagattgctgtagacagggcacaacagaggagagtgcccatgctacagcaaaacctggcggcagcgcaaaagatg

SEQ ID NO: 185623 - DNA, 103 bp, Artificial Sequence
  Synthetic Polynucleotide
taatacgactcactatagggcaggctgcccccaccgaggagattgctgtaaacagaggagatacagcatgctcctcggtaacctggcggcagcgcaaaagatg

SEQ ID NO: 185624 - DNA, 103 bp, Artificial Sequence
  Synthetic Polynucleotide
taatacgactcactatagggtggggtggggcaggctgcccccaccgaggaaacagaggagatcctcgatgggggcagccaacctggcggcagcgcaaaagatg

SEQ ID NO: 185625 - DNA, 103 bp, Artificial Sequence
  Synthetic Polynucleotide
taatacgactcactataggggggttgagcatggggtggggcaggctgcccaacagaggagagggcagatggccccacccaacctggcggcagcgcaaaagatg

SEQ ID NO: 185626 - DNA, 103 bp, Artificial Sequence
  Synthetic Polynucleotide
taatacgactcactataggggagagaagtggggttgagcatggggtggggaacagaggagaccccacatgatgctcaacaacctggcggcagcgcaaaagatg

SEQ ID NO: 185627 - DNA, 103 bp, Artificial Sequence
  Synthetic Polynucleotide
taatacgactcactataggggcgagctcgggagagaagtggggttgagcaaacagaggagatgctcaatgccacttctcaacctggcggcagcgcaaaagatg

SEQ ID NO: 185628 - DNA, 103 bp, Artificial Sequence
  Synthetic Polynucleotide
taatacgactcactatagggtctgagggcagcgagctcgggagagaagtgaacagaggagacacttcatgcccgagctcaacctggcggcagcgcaaaagatg

SEQ ID NO: 185629 - DNA, 103 bp, Artificial Sequence
  Synthetic Polynucleotide
taatacgactcactatagggattccttggtaaggatgcctccgcctgaacaacagaggagagttcagatggaggcatccaacctggcggcagcgcaaaagatg

SEQ ID NO: 185630 - DNA, 103 bp, Artificial Sequence
  Synthetic Polynucleotide
taatacgactcactatagggccgggctccatctgagggcagcgagctcggaacagaggagaccgagcatgctgccctcaaacctggcggcagcgcaaaagatg

SEQ ID NO: 185631 - DNA, 103 bp, Artificial Sequence
  Synthetic Polynucleotide
taatacgactcactatagggggagcaacctccgggctccatctgagggcaaacagaggagatgccctatgatggagcccaacctggcggcagcgcaaaagatg

SEQ ID NO: 185632 - DNA, 103 bp, Artificial Sequence
  Synthetic Polynucleotide
taatacgactcactatagggtgctccggctggagcaacctccgggctccaaacagaggagatggagcatggaggttgctaacctggcggcagcgcaaaagatg

SEQ ID NO: 185633 - DNA, 103 bp, Artificial Sequence
  Synthetic Polynucleotide
taatacgactcactatagggctccctgggatgctccggctggagcaacctaacagaggagaaggttgatgcagccggagaacctggcggcagcgcaaaagatg

SEQ ID NO: 185634 - DNA, 103 bp, Artificial Sequence
  Synthetic Polynucleotide
taatacgactcactatagggggacaagcacctccctgggatgctccggctaacagaggagaagccggatgatcccagggaacctggcggcagcgcaaaagatg

SEQ ID NO: 185635 - DNA, 103 bp, Artificial Sequence
  Synthetic Polynucleotide
taatacgactcactatagggtggggcgccgggacaagcacctccctgggaaacagaggagatcccagatgggtgcttgtaacctggcggcagcgcaaaagatg

SEQ ID NO: 185636 - DNA, 103 bp, Artificial Sequence
  Synthetic Polynucleotide
taatacgactcactataggggaaggcactgtggggcgccgggacaagcacaacagaggagagtgcttatgccggcgcccaacctggcggcagcgcaaaagatg

SEQ ID NO: 185637 - DNA, 103 bp, Artificial Sequence
  Synthetic Polynucleotide
taatacgactcactatagggcggtaaaggagaaggcactgtggggcgccgaacagaggagacggcgcatgacagtgcctaacctggcggcagcgcaaaagatg

SEQ ID NO: 185638 - DNA, 103 bp, Artificial Sequence
  Synthetic Polynucleotide
taatacgactcactataggggcggcggccccggtaaaggagaaggcactgaacagaggagacagtgcatgctcctttacaacctggcggcagcgcaaaagatg

SEQ ID NO: 185639 - DNA, 103 bp, Artificial Sequence
  Synthetic Polynucleotide
taatacgactcactatagggcttcatgctggcggcggccccggtaaaggaaacagaggagatcctttatgggggccgccaacctggcggcagcgcaaaagatg

SEQ ID NO: 185640 - DNA, 103 bp, Artificial Sequence
  Synthetic Polynucleotide
taatacgactcactatagggtgaaaagcagattccttggtaaggatgcctaacagaggagaaggcatatgtaccaaggaaacctggcggcagcgcaaaagatg

SEQ ID NO: 185641 - DNA, 103 bp, Artificial Sequence
  Synthetic Polynucleotide
taatacgactcactatagggaggccttgtccttcatgctggcggcggcccaacagaggagagggccgatgccagcatgaaacctggcggcagcgcaaaagatg

SEQ ID NO: 185642 - DNA, 103 bp, Artificial Sequence
  Synthetic Polynucleotide
taatacgactcactataggggtggggctacaggccttgtccttcatgctgaacagaggagacagcatatgggacaaggcaacctggcggcagcgcaaaagatg

SEQ ID NO: 185643 - DNA, 103 bp, Artificial Sequence
  Synthetic Polynucleotide
taatacgactcactatagggagacccgcttgtggggctacaggccttgtcaacagaggagagacaagatgtgtagccccaacctggcggcagcgcaaaagatg

SEQ ID NO: 185644 - DNA, 103 bp, Artificial Sequence
  Synthetic Polynucleotide
taatacgactcactatagggccgccgtgggagacccgcttgtggggctacaacagaggagagtagccatgcaagcgggtaacctggcggcagcgcaaaagatg

SEQ ID NO: 185645 - DNA, 103 bp, Artificial Sequence
  Synthetic Polynucleotide
taatacgactcactataggggcggctgttcccgccgtgggagacccgcttaacagaggagaaagcggatgtcccacggcaacctggcggcagcgcaaaagatg

SEQ ID NO: 185646 - DNA, 103 bp, Artificial Sequence
  Synthetic Polynucleotide
taatacgactcactatagggttctgccgtggcggctgttcccgccgtgggaacagaggagacccacgatgggaacagccaacctggcggcagcgcaaaagatg

SEQ ID NO: 185647 - DNA, 103 bp, Artificial Sequence
  Synthetic Polynucleotide
taatacgactcactataggggcaccacatgttctgccgtggcggctgttcaacagaggagagaacagatgccacggcagaacctggcggcagcgcaaaagatg

SEQ ID NO: 185648 - DNA, 103 bp, Artificial Sequence
  Synthetic Polynucleotide
taatacgactcactataggggctttgggctgcaccacatgttctgccgtgaacagaggagacacggcatgacatgtggtaacctggcggcagcgcaaaagatg

SEQ ID NO: 185649 - DNA, 103 bp, Artificial Sequence
  Synthetic Polynucleotide
taatacgactcactatagggtgctgaggtagctttgggctgcaccacatgaacagaggagacatgtgatgcagcccaaaaacctggcggcagcgcaaaagatg

SEQ ID NO: 185650 - DNA, 103 bp, Artificial Sequence
  Synthetic Polynucleotide
taatacgactcactatagggctgccatcgctgctgaggtagctttgggctaacagaggagaagcccaatgctacctcagaacctggcggcagcgcaaaagatg

SEQ ID NO: 185651 - DNA, 103 bp, Artificial Sequence
  Synthetic Polynucleotide
taatacgactcactataggggtggcatacttgaaaagcagattccttggtaacagaggagaaccaagatgtctgcttttaacctggcggcagcgcaaaagatg

SEQ ID NO: 185652 - DNA, 103 bp, Artificial Sequence
  Synthetic Polynucleotide
taatacgactcactatagggctgctgggggctgccatcgctgctgaggtaaacagaggagatacctcatgagcgatggcaacctggcggcagcgcaaaagatg

SEQ ID NO: 185653 - DNA, 103 bp, Artificial Sequence
  Synthetic Polynucleotide
taatacgactcactatagggggcttcgtcgctgctgggggctgccatcgcaacagaggagagcgatgatggcccccagcaacctggcggcagcgcaaaagatg

SEQ ID NO: 185654 - DNA, 103 bp, Artificial Sequence
  Synthetic Polynucleotide
taatacgactcactatagggtgagattcatggcttcgtcgctgctgggggaacagaggagacccccaatggcgacgaagaacctggcggcagcgcaaaagatg

SEQ ID NO: 185655 - DNA, 103 bp, Artificial Sequence
  Synthetic Polynucleotide
taatacgactcactatagggttgtttttaatgagattcatggcttcgtcgaacagaggagacgacgaatgcatgaatctaacctggcggcagcgcaaaagatg

SEQ ID NO: 185656 - DNA, 103 bp, Artificial Sequence
  Synthetic Polynucleotide
taatacgactcactatagggcatgtttcttttgtttttaatgagattcataacagaggagaatgaatatgattaaaaacaacctggcggcagcgcaaaagatg

SEQ ID NO: 185657 - DNA, 103 bp, Artificial Sequence
  Synthetic Polynucleotide
taatacgactcactatagggtgtagccggtcatgtttcttttgtttttaaaacagaggagattaaaaatgaaagaaacaaacctggcggcagcgcaaaagatg

SEQ ID NO: 185658 - DNA, 103 bp, Artificial Sequence
  Synthetic Polynucleotide
taatacgactcactatagggggaagggtcttgtagccggtcatgtttcttaacagaggagaaagaaaatggaccggctaaacctggcggcagcgcaaaagatg

SEQ ID NO: 185659 - DNA, 103 bp, Artificial Sequence
  Synthetic Polynucleotide
taatacgactcactatagggcagcgggtagggaagggtcttgtagccggtaacagaggagaaccggcatgaagacccttaacctggcggcagcgcaaaagatg

SEQ ID NO: 185660 - DNA, 103 bp, Artificial Sequence
  Synthetic Polynucleotide
taatacgactcactatagggtctgcttcttcagcgggtagggaagggtctaacagaggagaagacccatgcctacccgcaacctggcggcagcgcaaaagatg

SEQ ID NO: 185661 - DNA, 103 bp, Artificial Sequence
  Synthetic Polynucleotide
taatacgactcactatagggatcttgccgttctgcttcttcagcgggtagaacagaggagactacccatggaagaagcaaacctggcggcagcgcaaaagatg

SEQ ID NO: 185662 - DNA, 103 bp, Artificial Sequence
  Synthetic Polynucleotide
taatacgactcactatagggttcactgttggtggcatacttgaaaagcagaacagaggagactgcttatgaagtatgccaacctggcggcagcgcaaaagatg

SEQ ID NO: 185663 - DNA, 103 bp, Artificial Sequence
  Synthetic Polynucleotide
taatacgactcactatagggttcgtacttgatcttgccgttctgcttcttaacagaggagaaagaagatgaacggcaagaacctggcggcagcgcaaaagatg

SEQ ID NO: 185664 - DNA, 103 bp, Artificial Sequence
  Synthetic Polynucleotide
taatacgactcactatagggaaacgttgcattcgtacttgatcttgccgtaacagaggagaacggcaatgtcaagtacgaacctggcggcagcgcaaaagatg

SEQ ID NO: 185665 - DNA, 103 bp, Artificial Sequence
  Synthetic Polynucleotide
taatacgactcactataggggtcttggcgcaaacgttgcattcgtacttgaacagaggagacaagtaatgatgcaacgtaacctggcggcagcgcaaaagatg

SEQ ID NO: 185666 - DNA, 103 bp, Artificial Sequence
  Synthetic Polynucleotide
taatacgactcactatagggctggccgaaagtcttggcgcaaacgttgcaaacagaggagatgcaacatgtgcgccaagaacctggcggcagcgcaaaagatg

SEQ ID NO: 185667 - DNA, 103 bp, Artificial Sequence
  Synthetic Polynucleotide
taatacgactcactataggggattggagagctggccgaaagtcttggcgcaacagaggagagcgccaatgctttcggccaacctggcggcagcgcaaaagatg

SEQ ID NO: 185668 - DNA, 103 bp, Artificial Sequence
  Synthetic Polynucleotide
taatacgactcactatagggtggaccttcagattggagagctggccgaaaaacagaggagatttcggatggctctccaaaacctggcggcagcgcaaaagatg

SEQ ID NO: 185669 - DNA, 103 bp, Artificial Sequence
  Synthetic Polynucleotide
taatacgactcactatagggcactctcaggtggaccttcagattggagagaacagaggagactctccatgctgaaggtcaacctggcggcagcgcaaaagatg

SEQ ID NO: 185670 - DNA, 103 bp, Artificial Sequence
  Synthetic Polynucleotide
taatacgactcactatagggctccactgtgcactctcaggtggaccttcaaacagaggagatgaaggatgacctgagagaacctggcggcagcgcaaaagatg

SEQ ID NO: 185671 - DNA, 103 bp, Artificial Sequence
  Synthetic Polynucleotide
taatacgactcactatagggaaaggccgttctccactgtgcactctcaggaacagaggagacctgagatggcacagtggaacctggcggcagcgcaaaagatg

SEQ ID NO: 185672 - DNA, 103 bp, Artificial Sequence
  Synthetic Polynucleotide
taatacgactcactatagggctgacatttgaaaggccgttctccactgtgaacagaggagacacagtatggaacggcctaacctggcggcagcgcaaaagatg

SEQ ID NO: 185673 - DNA, 103 bp, Artificial Sequence
  Synthetic Polynucleotide
taatacgactcactatagggcaataacctcttcactgttggtggcatactaacagaggagaagtatgatgccaacagtgaacctggcggcagcgcaaaagatg

SEQ ID NO: 185674 - DNA, 103 bp, Artificial Sequence
  Synthetic Polynucleotide
taatacgactcactatagggtgttgcaagtctgacatttgaaaggccgttaacagaggagaaacggcatgtcaaatgtcaacctggcggcagcgcaaaagatg

SEQ ID NO: 185675 - DNA, 103 bp, Artificial Sequence
  Synthetic Polynucleotide
taatacgactcactataggggtaaagcccttgttgcaagtctgacatttgaacagaggagacaaatgatggacttgcaaaacctggcggcagcgcaaaagatg

SEQ ID NO: 185676 - DNA, 103 bp, Artificial Sequence
  Synthetic Polynucleotide
taatacgactcactatagggggcgagctgagtaaagcccttgttgcaagtaacagaggagaacttgcatgaagggctttaacctggcggcagcgcaaaagatg

SEQ ID NO: 185677 - DNA, 103 bp, Artificial Sequence
  Synthetic Polynucleotide
taatacgactcactatagggtctgcaggtgggcgagctgagtaaagccctaacagaggagaagggctatgctcagctcgaacctggcggcagcgcaaaagatg

SEQ ID NO: 185678 - DNA, 103 bp, Artificial Sequence
  Synthetic Polynucleotide
taatacgactcactatagggaggtagtgtttctgcaggtgggcgagctgaaacagaggagatcagctatgccacctgcaaacctggcggcagcgcaaaagatg

SEQ ID NO: 185679 - DNA, 103 bp, Artificial Sequence
  Synthetic Polynucleotide
taatacgactcactatagggcgtgtgtaccaggtagtgtttctgcaggtgaacagaggagacacctgatgaaacactacaacctggcggcagcgcaaaagatg

SEQ ID NO: 185680 - DNA, 103 bp, Artificial Sequence
  Synthetic Polynucleotide
taatacgactcactataggggcttttctcccgtgtgtaccaggtagtgttaacagaggagaaacactatgtggtacacaaacctggcggcagcgcaaaagatg

SEQ ID NO: 185681 - DNA, 103 bp, Artificial Sequence
  Synthetic Polynucleotide
taatacgactcactatagggcattcatgtggcttttctcccgtgtgtaccaacagaggagaggtacaatggggagaaaaaacctggcggcagcgcaaaagatg

SEQ ID NO: 185682 - DNA, 103 bp, Artificial Sequence
  Synthetic Polynucleotide
taatacgactcactataggggcagacctggcattcatgtggcttttctccaacagaggagaggagaaatgccacatgaaaacctggcggcagcgcaaaagatg

SEQ ID NO: 185683 - DNA, 103 bp, Artificial Sequence
  Synthetic Polynucleotide
taatacgactcactatagggatctcttgtggcagacctggcattcatgtgaacagaggagacacatgatggccaggtctaacctggcggcagcgcaaaagatg

SEQ ID NO: 185684 - DNA, 103 bp, Artificial Sequence
  Synthetic Polynucleotide
taatacgactcactatagggctcatcactccaataacctcttcactgttgaacagaggagacaacagatgagaggttataacctggcggcagcgcaaaagatg

SEQ ID NO: 185685 - DNA, 103 bp, Artificial Sequence
  Synthetic Polynucleotide
taatacgactcactataggggtgctgctaaatctcttgtggcagacctggaacagaggagaccaggtatgccacaagagaacctggcggcagcgcaaaagatg

SEQ ID NO: 185686 - DNA, 103 bp, Artificial Sequence
  Synthetic Polynucleotide
taatacgactcactataggggagattgctggtgctgctaaatctcttgtgaacagaggagacacaagatgtttagcagcaacctggcggcagcgcaaaagatg

SEQ ID NO: 185687 - DNA, 103 bp, Artificial Sequence
  Synthetic Polynucleotide
taatacgactcactatagggggtgggtcttgagattgctggtgctgctaaaacagaggagattagcaatgccagcaatcaacctggcggcagcgcaaaagatg

SEQ ID NO: 185688 - DNA, 103 bp, Artificial Sequence
  Synthetic Polynucleotide
taatacgactcactatagggtggagtcgcaggtgggtcttgagattgctgaacagaggagacagcaaatgcaagacccaaacctggcggcagcgcaaaagatg

SEQ ID NO: 185689 - DNA, 103 bp, Artificial Sequence
  Synthetic Polynucleotide
taatacgactcactatagggctctccagaatggagtcgcaggtgggtcttaacagaggagaaagaccatgctgcgactcaacctggcggcagcgcaaaagatg

SEQ ID NO: 185690 - DNA, 103 bp, Artificial Sequence
  Synthetic Polynucleotide
taatacgactcactatagggggtatggtttctctccagaatggagtcgcaaacagaggagatgcgacatgattctggagaacctggcggcagcgcaaaagatg

SEQ ID NO: 185691 - DNA, 103 bp, Artificial Sequence
  Synthetic Polynucleotide
taatacgactcactatagggaccttgcattggtatggtttctctccagaaaacagaggagattctggatggaaaccataaacctggcggcagcgcaaaagatg

SEQ ID NO: 185692 - DNA, 103 bp, Artificial Sequence
  Synthetic Polynucleotide
taatacgactcactatagggggcagggcacaccttgcattggtatggtttaacagaggagaaaaccaatgcaatgcaagaacctggcggcagcgcaaaagatg

SEQ ID NO: 185693 - DNA, 103 bp, Artificial Sequence
  Synthetic Polynucleotide
taatacgactcactataggggggtgaacttggcagggcacaccttgcattaacagaggagaaatgcaatgtgtgccctgaacctggcggcagcgcaaaagatg

SEQ ID NO: 185694 - DNA, 103 bp, Artificial Sequence
  Synthetic Polynucleotide
taatacgactcactatagggtgcacaaactgggtgaacttggcagggcacaacagaggagagtgcccatgcaagttcacaacctggcggcagcgcaaaagatg

SEQ ID NO: 185695 - DNA, 103 bp, Artificial Sequence
  Synthetic Polynucleotide
taatacgactcactataggggtattctttactcatcactccaataacctcaacagaggagagaggttatgggagtgatgaacctggcggcagcgcaaaagatg

SEQ ID NO: 185696 - DNA, 103 bp, Artificial Sequence
  Synthetic Polynucleotide
taatacgactcactatagggcagtttcaggtgcacaaactgggtgaacttaacagaggagaaagttcatgcagtttgtgaacctggcggcagcgcaaaagatg

SEQ ID NO: 185697 - DNA, 103 bp, Artificial Sequence
  Synthetic Polynucleotide
taatacgactcactataggggacgcttgtgcagtttcaggtgcacaaactaacagaggagaagtttgatgacctgaaacaacctggcggcagcgcaaaagatg

SEQ ID NO: 185698 - DNA, 103 bp, Artificial Sequence
  Synthetic Polynucleotide
taatacgactcactatagggcgggtgtgcagacgcttgtgcagtttcaggaacagaggagacctgaaatggcacaagcgaacctggcggcagcgcaaaagatg

SEQ ID NO: 185699 - DNA, 103 bp, Artificial Sequence
  Synthetic Polynucleotide
taatacgactcactataggggggccgctcccgggtgtgcagacgcttgtgaacagaggagacacaagatgctgcacaccaacctggcggcagcgcaaaagatg

SEQ ID NO: 185700 - DNA, 103 bp, Artificial Sequence
  Synthetic Polynucleotide
taatacgactcactatagggagcacttgtggggccgctcccgggtgtgcaaacagaggagatgcacaatggggagcggcaacctggcggcagcgcaaaagatg

SEQ ID NO: 185701 - DNA, 103 bp, Artificial Sequence
  Synthetic Polynucleotide
taatacgactcactatagggtggcactgggagcacttgtggggccgctccaacagaggagaggagcgatgccacaagtgaacctggcggcagcgcaaaagatg

SEQ ID NO: 185702 - DNA, 103 bp, Artificial Sequence
  Synthetic Polynucleotide
taatacgactcactataggggtagttcttgtggcactgggagcacttgtgaacagaggagacacaagatgtcccagtgcaacctggcggcagcgcaaaagatg

SEQ ID NO: 185703 - DNA, 103 bp, Artificial Sequence
  Synthetic Polynucleotide
taatacgactcactatagggagagatggatgtagttcttgtggcactgggaacagaggagacccagtatgacaagaactaacctggcggcagcgcaaaagatg

SEQ ID NO: 185704 - DNA, 103 bp, Artificial Sequence
  Synthetic Polynucleotide
taatacgactcactatagggttgaggctacagagatggatgtagttcttgaacagaggagacaagaaatgcatccatctaacctggcggcagcgcaaaagatg

SEQ ID NO: 185705 - DNA, 103 bp, Artificial Sequence
  Synthetic Polynucleotide
taatacgactcactatagggcaggtgaaccttgaggctacagagatggataacagaggagaatccatatgtgtagcctcaacctggcggcagcgcaaaagatg

SEQ ID NO: 185706 - DNA, 103 bp, Artificial Sequence
  Synthetic Polynucleotide
taatacgactcactatagggtccacagagtcatatccgcatcctccatgtaacagaggagaacatggatgatgcggataaacctggcggcagcgcaaaagatg

SEQ ID NO: 185707 - DNA, 103 bp, Artificial Sequence
  Synthetic Polynucleotide
taatacgactcactatagggcctttggtatgtattctttactcatcactcaacagaggagagagtgaatggtaaagaataacctggcggcagcgcaaaagatg

SEQ ID NO: 185708 - DNA, 103 bp, Artificial Sequence
  Synthetic Polynucleotide
taatacgactcactatagggagttccctttcaggtgaaccttgaggctacaacagaggagagtagccatgaggttcaccaacctggcggcagcgcaaaagatg

SEQ ID NO: 185709 - DNA, 103 bp, Artificial Sequence
  Synthetic Polynucleotide
taatacgactcactataggggccgcagcgcagttccctttcaggtgaaccaacagaggagaggttcaatggaaagggaaaacctggcggcagcgcaaaagatg

SEQ ID NO: 185710 - DNA, 103 bp, Artificial Sequence
  Synthetic Polynucleotide
taatacgactcactatagggaggcgccggggccgcagcgcagttccctttaacagaggagaaaagggatgtgcgctgcgaacctggcggcagcgcaaaagatg

SEQ ID NO: 185711 - DNA, 103 bp, Artificial Sequence
  Synthetic Polynucleotide
taatacgactcactatagggagggcagcccaggcgccggggccgcagcgcaacagaggagagcgctgatgccccggcgcaacctggcggcagcgcaaaagatg

SEQ ID NO: 185712 - DNA, 103 bp, Artificial Sequence
  Synthetic Polynucleotide
taatacgactcactatagggagatcttccaagggcagcccaggcgccgggaacagaggagacccggcatgtgggctgccaacctggcggcagcgcaaaagatg

SEQ ID NO: 185713 - DNA, 103 bp, Artificial Sequence
  Synthetic Polynucleotide
taatacgactcactataggggattcgggtcagatcttccaagggcagcccaacagaggagagggctgatgttggaagataacctggcggcagcgcaaaagatg

SEQ ID NO: 185714 - DNA, 103 bp, Artificial Sequence
  Synthetic Polynucleotide
taatacgactcactatagggtttcttcattgattcgggtcagatcttccaaacagaggagatggaagatgtgacccgaaaacctggcggcagcgcaaaagatg

SEQ ID NO: 185715 - DNA, 103 bp, Artificial Sequence
  Synthetic Polynucleotide
taatacgactcactatagggaacttctcgatttcttcattgattcgggtcaacagaggagagacccgatgcaatgaagaaacctggcggcagcgcaaaagatg

SEQ ID NO: 185716 - DNA, 103 bp, Artificial Sequence
  Synthetic Polynucleotide
taatacgactcactatagggactgatgtcaaacttctcgatttcttcattaacagaggagaaatgaaatgatcgagaagaacctggcggcagcgcaaaagatg

SEQ ID NO: 185717 - DNA, 103 bp, Artificial Sequence
  Synthetic Polynucleotide
taatacgactcactatagggcagcattgtcactgatgtcaaacttctcgaaacagaggagatcgagaatgttgacatcaaacctggcggcagcgcaaaagatg

SEQ ID NO: 185718 - DNA, 103 bp, Artificial Sequence
  Synthetic Polynucleotide
taatacgactcactatagggaaacgtgtgccctttggtatgtattctttaaacagaggagataaagaatgcataccaaaaacctggcggcagcgcaaaagatg

SEQ ID NO: 185719 - DNA, 103 bp, Artificial Sequence
  Synthetic Polynucleotide
taatacgactcactatagggtcgagccggtcagcattgtcactgatgtcaaacagaggagatgacatatgtgacaatgcaacctggcggcagcgcaaaagatg

SEQ ID NO: 185720 - DNA, 103 bp, Artificial Sequence
  Synthetic Polynucleotide
taatacgactcactatagggctccacgtcctcgagccggtcagcattgtcaacagaggagagacaatatggaccggctcaacctggcggcagcgcaaaagatg

SEQ ID NO: 185721 - DNA, 103 bp, Artificial Sequence
  Synthetic Polynucleotide
taatacgactcactatagggtgatgtcatcctccacgtcctcgagccggtaacagaggagaaccggcatgaggacgtggaacctggcggcagcgcaaaagatg

SEQ ID NO: 185722 - DNA, 103 bp, Artificial Sequence
  Synthetic Polynucleotide
taatacgactcactataggggagatcacactgatgtcatcctccacgtccaacagaggagaggacgtatgggatgacataacctggcggcagcgcaaaagatg

SEQ ID NO: 185723 - DNA, 103 bp, Artificial Sequence
  Synthetic Polynucleotide
taatacgactcactatagggctccactacagagatcacactgatgtcatcaacagaggagagatgacatgagtgtgatcaacctggcggcagcgcaaaagatg

SEQ ID NO: 185724 - DNA, 103 bp, Artificial Sequence
  Synthetic Polynucleotide
taatacgactcactataggggaatttccttctccactacagagatcacacaacagaggagagtgtgaatgctgtagtggaacctggcggcagcgcaaaagatg

SEQ ID NO: 185725 - DNA, 103 bp, Artificial Sequence
  Synthetic Polynucleotide
taatacgactcactatagggaccacggccagaatttccttctccactacaaacagaggagatgtagtatggaaggaaataacctggcggcagcgcaaaagatg

SEQ ID NO: 185726 - DNA, 103 bp, Artificial Sequence
  Synthetic Polynucleotide
taatacgactcactatagggctcttttctgaccacggccagaatttccttaacagaggagaaaggaaatgctggccgtgaacctggcggcagcgcaaaagatg

SEQ ID NO: 185727 - DNA, 103 bp, Artificial Sequence
  Synthetic Polynucleotide
taatacgactcactatagggtttcttctttctcttttctgaccacggccaaacagaggagatggccgatgtcagaaaagaacctggcggcagcgcaaaagatg

SEQ ID NO: 185728 - DNA, 103 bp, Artificial Sequence
  Synthetic Polynucleotide
taatacgactcactatagggttcaggccagtttcttctttctcttttctgaacagaggagacagaaaatggaaagaagaaacctggcggcagcgcaaaagatg

SEQ ID NO: 185729 - DNA, 103 bp, Artificial Sequence
  Synthetic Polynucleotide
taatacgactcactatagggtaggggtccaaaacgtgtgccctttggtataacagaggagaataccaatgggcacacgtaacctggcggcagcgcaaaagatg

SEQ ID NO: 185730 - DNA, 103 bp, Artificial Sequence
  Synthetic Polynucleotide
taatacgactcactatagggcaaagacactttcaggccagtttcttctttaacagaggagaaaagaaatgactggcctgaacctggcggcagcgcaaaagatg

SEQ ID NO: 185731 - DNA, 103 bp, Artificial Sequence
  Synthetic Polynucleotide
taatacgactcactatagggtgtttctttgcaaagacactttcaggccagaacagaggagactggccatgaagtgtcttaacctggcggcagcgcaaaagatg

SEQ ID NO: 185732 - DNA, 103 bp, Artificial Sequence
  Synthetic Polynucleotide
taatacgactcactatagggccattccccatgtttctttgcaaagacactaacagaggagaagtgtcatggcaaagaaaaacctggcggcagcgcaaaagatg

SEQ ID NO: 185733 - DNA, 103 bp, Artificial Sequence
  Synthetic Polynucleotide
taatacgactcactatagggggagaggagtccattccccatgtttctttgaacagaggagacaaagaatgatggggaataacctggcggcagcgcaaaagatg

SEQ ID NO: 185734 - DNA, 103 bp, Artificial Sequence
  Synthetic Polynucleotide
taatacgactcactatagggtgcaccctgaggagaggagtccattccccaaacagaggagatggggaatggactcctctaacctggcggcagcgcaaaagatg

SEQ ID NO: 185735 - DNA, 103 bp, Artificial Sequence
  Synthetic Polynucleotide
taatacgactcactatagggtcataaaggctgcaccctgaggagaggagtaacagaggagaactcctatgctcagggtgaacctggcggcagcgcaaaagatg

SEQ ID NO: 185736 - DNA, 103 bp, Artificial Sequence
  Synthetic Polynucleotide
taatacgactcactatagggatctgatgactcataaaggctgcaccctgaaacagaggagatcagggatgagcctttataacctggcggcagcgcaaaagatg

SEQ ID NO: 185737 - DNA, 103 bp, Artificial Sequence
  Synthetic Polynucleotide
taatacgactcactatagggtgaggggtagatctgatgactcataaaggcaacagaggagagcctttatgagtcatcagaacctggcggcagcgcaaaagatg

SEQ ID NO: 185738 - DNA, 103 bp, Artificial Sequence
  Synthetic Polynucleotide
taatacgactcactatagggggcaacttcatgaggggtagatctgatgacaacagaggagagtcatcatgtctacccctaacctggcggcagcgcaaaagatg

SEQ ID NO: 185739 - DNA, 103 bp, Artificial Sequence
  Synthetic Polynucleotide
taatacgactcactataggggttgctgggaggcaacttcatgaggggtagaacagaggagactacccatgatgaagttgaacctggcggcagcgcaaaagatg

SEQ ID NO: 185740 - DNA, 103 bp, Artificial Sequence
  Synthetic Polynucleotide
taatacgactcactatagggtttcacctattaggggtccaaaacgtgtgcaacagaggagagcacacatgttggaccccaacctggcggcagcgcaaaagatg

SEQ ID NO: 185741 - DNA, 103 bp, Artificial Sequence
  Synthetic Polynucleotide
taatacgactcactataggggaggtagtgggttgctgggaggcaacttcaaacagaggagatgaagtatgctcccagcaaacctggcggcagcgcaaaagatg

SEQ ID NO: 185742 - DNA, 103 bp, Artificial Sequence
  Synthetic Polynucleotide
taatacgactcactatagggacaggtaccagaggtagtgggttgctgggaaacagaggagatcccagatgcccactaccaacctggcggcagcgcaaaagatg

SEQ ID NO: 185743 - DNA, 103 bp, Artificial Sequence
  Synthetic Polynucleotide
taatacgactcactatagggtttgacctttacaggtaccagaggtagtggaacagaggagaccactaatgctggtacctaacctggcggcagcgcaaaagatg

SEQ ID NO: 185744 - DNA, 103 bp, Artificial Sequence
  Synthetic Polynucleotide
taatacgactcactatagggctgtttcttgtttgacctttacaggtaccaaacagaggagatggtacatgtaaaggtcaaacctggcggcagcgcaaaagatg

SEQ ID NO: 185745 - DNA, 103 bp, Artificial Sequence
  Synthetic Polynucleotide
taatacgactcactatagggattggttcaactgtttcttgtttgacctttaacagaggagaaaaggtatgacaagaaacaacctggcggcagcgcaaaagatg

SEQ ID NO: 185746 - DNA, 103 bp, Artificial Sequence
  Synthetic Polynucleotide
taatacgactcactatagggttaaggatccattggttcaactgtttcttgaacagaggagacaagaaatggttgaaccaaacctggcggcagcgcaaaagatg

SEQ ID NO: 185747 - DNA, 103 bp, Artificial Sequence
  Synthetic Polynucleotide
taatacgactcactatagggttggtgtagatttcacctattaggggtccaaacagaggagatggaccatgaataggtgaaacctggcggcagcgcaaaagatg

SEQ ID NO: 185748 - DNA, 103 bp, Artificial Sequence
  Synthetic Polynucleotide
taatacgactcactatagggaactgtgtcattggtgtagatttcacctataacagaggagaataggtatgatctacaccaacctggcggcagcgcaaaagatg

SEQ ID NO: 185749 - DNA, 103 bp, Artificial Sequence
  Synthetic Polynucleotide
taatacgactcactatagggcgttcttaggaactgtgtcattggtgtagaaacagaggagatctacaatgatgacacagaacctggcggcagcgcaaaagatg

SEQ ID NO: 185750 - DNA, 103 bp, Artificial Sequence
  Synthetic Polynucleotide
taatacgactcactatagggttcctgttggcgttcttaggaactgtgtcaaacagaggagatgacacatgtcctaagaaaacctggcggcagcgcaaaagatg

SEQ ID NO: 185751 - DNA, 103 bp, Artificial Sequence
  Synthetic Polynucleotide
taatacgactcactatagggccaaaaatatttcctgttggcgttcttaggaacagaggagacctaagatggccaacaggaacctggcggcagcgcaaaagatg

SEQ ID NO: 185752 - DNA, 103 bp, Artificial Sequence
  Synthetic Polynucleotide
taatacgactcactatagggaatagatcctccaaaaatatttcctgttggaacagaggagaccaacaatgaatatttttaacctggcggcagcgcaaaagatg

SEQ ID NO: 185753 - DNA, 103 bp, Artificial Sequence
  Synthetic Polynucleotide
taatacgactcactatagggtcagcctctgtccacagagtcatatccgcaaacagaggagatgcggaatggactctgtgaacctggcggcagcgcaaaagatg

SEQ ID NO: 185754 - DNA, 103 bp, Artificial Sequence
  Synthetic Polynucleotide
taatacgactcactatagggtcccctctggaatagatcctccaaaaatataacagaggagaatatttatggaggatctaaacctggcggcagcgcaaaagatg

SEQ ID NO: 185755 - DNA, 103 bp, Artificial Sequence
  Synthetic Polynucleotide
taatacgactcactataggggtggtgaagctcccctctggaatagatcctaacagaggagaaggatcatgtccagagggaacctggcggcagcgcaaaagatg

SEQ ID NO: 185756 - DNA, 103 bp, Artificial Sequence
  Synthetic Polynucleotide
taatacgactcactatagggcgtcaatgaagtggtgaagctcccctctggaacagaggagaccagagatgagcttcaccaacctggcggcagcgcaaaagatg

SEQ ID NO: 185757 - DNA, 103 bp, Artificial Sequence
  Synthetic Polynucleotide
taatacgactcactatagggtcattaaagccgtcaatgaagtggtgaagcaacagaggagagcttcaatgcttcattgaaacctggcggcagcgcaaaagatg

SEQ ID NO: 185758 - DNA, 103 bp, Artificial Sequence
  Synthetic Polynucleotide
taatacgactcactataggggcttttctcttcattaaagccgtcaatgaaaacagaggagattcattatgggctttaataacctggcggcagcgcaaaagatg

SEQ ID NO: 185759 - DNA, 103 bp, Artificial Sequence
  Synthetic Polynucleotide
taatacgactcactataggggcatccagttgcttttctcttcattaaagcaacagaggagagctttaatgaagagaaaaaacctggcggcagcgcaaaagatg

SEQ ID NO: 185760 - DNA, 103 bp, Artificial Sequence
  Synthetic Polynucleotide
taatacgactcactatagggttcacatagcgcatccagttgcttttctctaacagaggagaagagaaatgcaactggataacctggcggcagcgcaaaagatg

SEQ ID NO: 185761 - DNA, 103 bp, Artificial Sequence
  Synthetic Polynucleotide
taatacgactcactataggggtgtgctggattcacatagcgcatccagttaacagaggagaaactggatgcgctatgtgaacctggcggcagcgcaaaagatg

SEQ ID NO: 185762 - DNA, 103 bp, Artificial Sequence
  Synthetic Polynucleotide
taatacgactcactatagggcccggggagagtgtgctggattcacatagcaacagaggagagctatgatgatccagcacaacctggcggcagcgcaaaagatg

SEQ ID NO: 185763 - DNA, 103 bp, Artificial Sequence
  Synthetic Polynucleotide
taatacgactcactatagggaggttttgctcccggggagagtgtgctggaaacagaggagatccagcatgctctccccgaacctggcggcagcgcaaaagatg

SEQ ID NO: 185764 - DNA, 103 bp, Artificial Sequence
  Synthetic Polynucleotide
taatacgactcactatagggctcttcaaactcagcctctgtccacagagtaacagaggagaactctgatgacagaggctaacctggcggcagcgcaaaagatg

SEQ ID NO: 185765 - DNA, 103 bp, Artificial Sequence
  Synthetic Polynucleotide
taatacgactcactatagggacacgcagccaggttttgctcccggggagaaacagaggagatctcccatggagcaaaacaacctggcggcagcgcaaaagatg

SEQ ID NO: 185766 - DNA, 103 bp, Artificial Sequence
  Synthetic Polynucleotide
taatacgactcactatagggtcccgttctgacacgcagccaggttttgctaacagaggagaagcaaaatgtggctgcgtaacctggcggcagcgcaaaagatg

SEQ ID NO: 185767 - DNA, 103 bp, Artificial Sequence
  Synthetic Polynucleotide
taatacgactcactatagggtagatgttcatcccgttctgacacgcagccaacagaggagaggctgcatgtcagaacggaacctggcggcagcgcaaaagatg

SEQ ID NO: 185768 - DNA, 103 bp, Artificial Sequence
  Synthetic Polynucleotide
taatacgactcactatagggggtgtagaagtagatgttcatcccgttctgaacagaggagacagaacatgatgaacatcaacctggcggcagcgcaaaagatg

SEQ ID NO: 185769 - DNA, 103 bp, Artificial Sequence
  Synthetic Polynucleotide
taatacgactcactatagggtgggcttaatggtgtagaagtagatgttcaaacagaggagatgaacaatgacttctacaaacctggcggcagcgcaaaagatg

SEQ ID NO: 185770 - DNA, 103 bp, Artificial Sequence
  Synthetic Polynucleotide
taatacgactcactatagggttggcagggatgggcttaatggtgtagaagaacagaggagacttctaatgcattaagccaacctggcggcagcgcaaaagatg

SEQ ID NO: 185771 - DNA, 103 bp, Artificial Sequence
  Synthetic Polynucleotide
taatacgactcactatagggaagttcctggttggcagggatgggcttaataacagaggagaattaagatgatccctgccaacctggcggcagcgcaaaagatg

SEQ ID NO: 185772 - DNA, 103 bp, Artificial Sequence
  Synthetic Polynucleotide
taatacgactcactatagggaccacacaagaagttcctggttggcagggaaacagaggagatccctgatgaccaggaacaacctggcggcagcgcaaaagatg

SEQ ID NO: 185773 - DNA, 103 bp, Artificial Sequence
  Synthetic Polynucleotide
taatacgactcactatagggtcccgacaataccacacaagaagttcctggaacagaggagaccaggaatgtcttgtgtgaacctggcggcagcgcaaaagatg

SEQ ID NO: 185774 - DNA, 103 bp, Artificial Sequence
  Synthetic Polynucleotide
taatacgactcactatagggttctgcaaagtcccgacaataccacacaagaacagaggagacttgtgatgtattgtcggaacctggcggcagcgcaaaagatg

SEQ ID NO: 185775 - DNA, 103 bp, Artificial Sequence
  Synthetic Polynucleotide
taatacgactcactatagggatgtacacttctcttcaaactcagcctctgaacagaggagacagaggatgagtttgaagaacctggcggcagcgcaaaagatg

SEQ ID NO: 185776 - DNA, 103 bp, Artificial Sequence
  Synthetic Polynucleotide
taatacgactcactatagggagtgaagcctttctgcaaagtcccgacaataacagaggagaattgtcatgactttgcagaacctggcggcagcgcaaaagatg

SEQ ID NO: 185777 - DNA, 103 bp, Artificial Sequence
  Synthetic Polynucleotide
taatacgactcactatagggggataagggtagtgaagcctttctgcaaagaacagaggagactttgcatgaaggcttcaaacctggcggcagcgcaaaagatg

SEQ ID NO: 185778 - DNA, 103 bp, Artificial Sequence
  Synthetic Polynucleotide
taatacgactcactatagggcagctctccgggataagggtagtgaagcctaacagaggagaaggcttatgtacccttataacctggcggcagcgcaaaagatg

SEQ ID NO: 185779 - DNA, 103 bp, Artificial Sequence
  Synthetic Polynucleotide
taatacgactcactatagggtcatcattgtcagctctccgggataagggtaacagaggagaacccttatgccggagagcaacctggcggcagcgcaaaagatg

SEQ ID NO: 185780 - DNA, 103 bp, Artificial Sequence
  Synthetic Polynucleotide
taatacgactcactatagggtgtgtgagattcatcattgtcagctctccgaacagaggagacggagaatggacaatgataacctggcggcagcgcaaaagatg

SEQ ID NO: 185781 - DNA, 103 bp, Artificial Sequence
  Synthetic Polynucleotide
taatacgactcactataggggctctgtgtttgtgtgagattcatcattgtaacagaggagaacaatgatgaatctcacaaacctggcggcagcgcaaaagatg

SEQ ID NO: 185782 - DNA, 103 bp, Artificial Sequence
  Synthetic Polynucleotide
taatacgactcactataggggctttagactgctctgtgtttgtgtgagataacagaggagaatctcaatgaaacacagaaacctggcggcagcgcaaaagatg

SEQ ID NO: 185783 - DNA, 103 bp, Artificial Sequence
  Synthetic Polynucleotide
taatacgactcactataggggtgctcggttgctttagactgctctgtgttaacagaggagaaacacaatgcagtctaaaaacctggcggcagcgcaaaagatg

SEQ ID NO: 185784 - DNA, 103 bp, Artificial Sequence
  Synthetic Polynucleotide
taatacgactcactatagggatttttctcagtgctcggttgctttagactaacagaggagaagtctaatgcaaccgagcaacctggcggcagcgcaaaagatg

SEQ ID NO: 185785 - DNA, 103 bp, Artificial Sequence
  Synthetic Polynucleotide
taatacgactcactatagggggcagagttcatttttctcagtgctcggttaacagaggagaaaccgaatgctgagaaaaaacctggcggcagcgcaaaagatg

SEQ ID NO: 185786 - DNA, 103 bp, Artificial Sequence
  Synthetic Polynucleotide
taatacgactcactatagggttcacaatgtatgtacacttctcttcaaacaacagaggagagtttgaatggaagtgtacaacctggcggcagcgcaaaagatg

SEQ ID NO: 185787 - DNA, 103 bp, Artificial Sequence
  Synthetic Polynucleotide
taatacgactcactatagggacattctttgggcagagttcatttttctcaaacagaggagatgagaaatgtgaactctgaacctggcggcagcgcaaaagatg

SEQ ID NO: 185788 - DNA, 103 bp, Artificial Sequence
  Synthetic Polynucleotide
taatacgactcactatagggtctctttgggacattctttgggcagagttcaacagaggagagaactcatgccaaagaataacctggcggcagcgcaaaagatg

SEQ ID NO: 185789 - DNA, 103 bp, Artificial Sequence
  Synthetic Polynucleotide
taatacgactcactatagggcgctgtactctctctttgggacattctttgaacagaggagacaaagaatgtcccaaagaaacctggcggcagcgcaaaagatg

SEQ ID NO: 185790 - DNA, 103 bp, Artificial Sequence
  Synthetic Polynucleotide
taatacgactcactatagggatttctttcacgctgtactctctctttgggaacagaggagacccaaaatgagagtacagaacctggcggcagcgcaaaagatg

SEQ ID NO: 185791 - DNA, 103 bp, Artificial Sequence
  Synthetic Polynucleotide
taatacgactcactatagggcaattttaggatttctttcacgctgtactcaacagaggagagagtacatggtgaaagaaaacctggcggcagcgcaaaagatg

SEQ ID NO: 185792 - DNA, 103 bp, Artificial Sequence
  Synthetic Polynucleotide
taatacgactcactatagggggttggagtccaattttaggatttctttcaaacagaggagatgaaagatgtcctaaaataacctggcggcagcgcaaaagatg

SEQ ID NO: 185793 - DNA, 103 bp, Artificial Sequence
  Synthetic Polynucleotide
taatacgactcactatagggcctttggaggggttggagtccaattttaggaacagaggagacctaaaatgggactccaaaacctggcggcagcgcaaaagatg

SEQ ID NO: 185794 - DNA, 103 bp, Artificial Sequence
  Synthetic Polynucleotide
taatacgactcactataggggaggtcctttcctttggaggggttggagtcaacagaggagagactccatgccctccaaaaacctggcggcagcgcaaaagatg

SEQ ID NO: 185795 - DNA, 103 bp, Artificial Sequence
  Synthetic Polynucleotide
taatacgactcactatagggtagaacggtagaggtcctttcctttggaggaacagaggagacctccaatggaaaggaccaacctggcggcagcgcaaaagatg

SEQ ID NO: 185796 - DNA, 103 bp, Artificial Sequence
  Synthetic Polynucleotide
taatacgactcactatagggggtgaaatgttagaacggtagaggtcctttaacagaggagaaaaggaatgctaccgttcaacctggcggcagcgcaaaagatg

SEQ ID NO: 185797 - DNA, 103 bp, Artificial Sequence
  Synthetic Polynucleotide
taatacgactcactatagggggggtggtcgttcacaatgtatgtacacttaacagaggagaaagtgtatgtacattgtgaacctggcggcagcgcaaaagatg

SEQ ID NO: 185798 - DNA, 103 bp, Artificial Sequence
  Synthetic Polynucleotide
taatacgactcactatagggtgatgtgaggggtgaaatgttagaacggtaaacagaggagataccgtatgaacatttcaaacctggcggcagcgcaaaagatg

SEQ ID NO: 185799 - DNA, 103 bp, Artificial Sequence
  Synthetic Polynucleotide
taatacgactcactatagggggtccttttctgatgtgaggggtgaaatgtaacagaggagaacatttatgccctcacataacctggcggcagcgcaaaagatg

SEQ ID NO: 185800 - DNA, 103 bp, Artificial Sequence
  Synthetic Polynucleotide
taatacgactcactatagggaagtcatcgaggtccttttctgatgtgaggaacagaggagacctcacatgagaaaaggaaacctggcggcagcgcaaaagatg

SEQ ID NO: 185801 - DNA, 103 bp, Artificial Sequence
  Synthetic Polynucleotide
taatacgactcactatagggacgtcttctaaagtcatcgaggtccttttcaacagaggagagaaaagatgctcgatgacaacctggcggcagcgcaaaagatg

SEQ ID NO: 185802 - DNA, 103 bp, Artificial Sequence
  Synthetic Polynucleotide
taatacgactcactatagggcggggctcccacgtcttctaaagtcatcgaaacagaggagatcgatgatgttagaagacaacctggcggcagcgcaaaagatg

SEQ ID NO: 185803 - DNA, 103 bp, Artificial Sequence
  Synthetic Polynucleotide
taatacgactcactatagggaagggcatttcggggctcccacgtcttctaaacagaggagatagaagatgtgggagcccaacctggcggcagcgcaaaagatg

SEQ ID NO: 185804 - DNA, 103 bp, Artificial Sequence
  Synthetic Polynucleotide
taatacgactcactatagggccgagggtagaagggcatttcggggctcccaacagaggagagggagcatggaaatgcccaacctggcggcagcgcaaaagatg

SEQ ID NO: 185805 - DNA, 103 bp, Artificial Sequence
  Synthetic Polynucleotide
taatacgactcactatagggggtaaacgacccgagggtagaagggcatttaacagaggagaaaatgcatgtctaccctcaacctggcggcagcgcaaaagatg

SEQ ID NO: 185806 - DNA, 103 bp, Artificial Sequence
  Synthetic Polynucleotide
taatacgactcactataggggcccggatggggtaaacgacccgagggtagaacagaggagactacccatgggtcgtttaaacctggcggcagcgcaaaagatg

SEQ ID NO: 185807 - DNA, 103 bp, Artificial Sequence
  Synthetic Polynucleotide
taatacgactcactatagggtggcagaggggcccggatggggtaaacgacaacagaggagagtcgttatgcccatccggaacctggcggcagcgcaaaagatg

SEQ ID NO: 185808 - DNA, 103 bp, Artificial Sequence
  Synthetic Polynucleotide
taatacgactcactatagggcagaatcccaggggtggtcgttcacaatgtaacagaggagaacattgatgacgaccaccaacctggcggcagcgcaaaagatg

SEQ ID NO: 185809 - DNA, 103 bp, Artificial Sequence
  Synthetic Polynucleotide
taatacgactcactatagggaaaagtcttctggcagaggggcccggatggaacagaggagaccatccatgcccctctgcaacctggcggcagcgcaaaagatg

SEQ ID NO: 185810 - DNA, 103 bp, Artificial Sequence
  Synthetic Polynucleotide
taatacgactcactataggggaagctttcaaaaagtcttctggcagagggaacagaggagaccctctatgagaagacttaacctggcggcagcgcaaaagatg

SEQ ID NO: 185811 - DNA, 103 bp, Artificial Sequence
  Synthetic Polynucleotide
taatacgactcactataggggtaggccagggaagctttcaaaaagtcttcaacagaggagagaagacatgttgaaagctaacctggcggcagcgcaaaagatg

SEQ ID NO: 185812 - DNA, 103 bp, Artificial Sequence
  Synthetic Polynucleotide
taatacgactcactatagggtctcgatcccgtaggccagggaagctttcaaacagaggagatgaaagatgccctggcctaacctggcggcagcgcaaaagatg

SEQ ID NO: 185813 - DNA, 103 bp, Artificial Sequence
  Synthetic Polynucleotide
taatacgactcactatagggtacgtgggtctctcgatcccgtaggccaggaacagaggagacctggcatgcgggatcgaaacctggcggcagcgcaaaagatg

SEQ ID NO: 185814 - DNA, 103 bp, Artificial Sequence
  Synthetic Polynucleotide
taatacgactcactataggggcgagtgatgtacgtgggtctctcgatcccaacagaggagagggatcatgagacccacgaacctggcggcagcgcaaaagatg

SEQ ID NO: 185815 - DNA, 103 bp, Artificial Sequence
  Synthetic Polynucleotide
taatacgactcactataggggaatgggggagcgagtgatgtacgtgggtcaacagaggagagacccaatgacatcactcaacctggcggcagcgcaaaagatg

SEQ ID NO: 185816 - DNA, 103 bp, Artificial Sequence
  Synthetic Polynucleotide
taatacgactcactataggggtggaggatggaatgggggagcgagtgatgaacagaggagacatcacatgctcccccataacctggcggcagcgcaaaagatg

SEQ ID NO: 185817 - DNA, 103 bp, Artificial Sequence
  Synthetic Polynucleotide
taatacgactcactataggggcttggagtggtggaggatggaatgggggaaacagaggagatcccccatgccatcctccaacctggcggcagcgcaaaagatg

SEQ ID NO: 185818 - DNA, 103 bp, Artificial Sequence
  Synthetic Polynucleotide
taatacgactcactatagggttgcagaggggcttggagtggtggaggatgaacagaggagacatcctatgccactccaaaacctggcggcagcgcaaaagatg

SEQ ID NO: 185819 - DNA, 103 bp, Artificial Sequence
  Synthetic Polynucleotide
taatacgactcactatagggccatcagcaccagaatcccaggggtggtcgaacagaggagacgaccaatgctgggattcaacctggcggcagcgcaaaagatg

SEQ ID NO: 185820 - DNA, 103 bp, Artificial Sequence
  Synthetic Polynucleotide
taatacgactcactataggggggctgcttcttgcagaggggcttggagtgaacagaggagacactccatgcccctctgcaacctggcggcagcgcaaaagatg

SEQ ID NO: 185821 - DNA, 103 bp, Artificial Sequence
  Synthetic Polynucleotide
taatacgactcactataggggctttggtcggggctgcttcttgcagagggaacagaggagaccctctatgagaagcagcaacctggcggcagcgcaaaagatg

SEQ ID NO: 185822 - DNA, 103 bp, Artificial Sequence
  Synthetic Polynucleotide
taatacgactcactatagggagctcttgaggctttggtcggggctgcttcaacagaggagagaagcaatgccgaccaaaaacctggcggcagcgcaaaagatg

SEQ ID NO: 185823 - DNA, 103 bp, Artificial Sequence
  Synthetic Polynucleotide
taatacgactcactatagggtgagggctggagctcttgaggctttggtcgaacagaggagacgaccaatgcctcaagagaacctggcggcagcgcaaaagatg

SEQ ID NO: 185824 - DNA, 103 bp, Artificial Sequence
  Synthetic Polynucleotide
taatacgactcactatagggagggctgctgtgagggctggagctcttgagaacagaggagactcaagatgtccagccctaacctggcggcagcgcaaaagatg

SEQ ID NO: 185825 - DNA, 103 bp, Artificial Sequence
  Synthetic Polynucleotide
taatacgactcactatagggccgtattcccagggctgctgtgagggctggaacagaggagaccagccatgacagcagccaacctggcggcagcgcaaaagatg

SEQ ID NO: 185826 - DNA, 103 bp, Artificial Sequence
  Synthetic Polynucleotide
taatacgactcactatagggacaggggacaccgtattcccagggctgctgaacagaggagacagcagatgtgggaatacaacctggcggcagcgcaaaagatg

SEQ ID NO: 185827 - DNA, 103 bp, Artificial Sequence
  Synthetic Polynucleotide
taatacgactcactataggggccggggcccacaggggacaccgtattcccaacagaggagagggaatatggtgtcccctaacctggcggcagcgcaaaagatg

SEQ ID NO: 185828 - DNA, 103 bp, Artificial Sequence
  Synthetic Polynucleotide
taatacgactcactataggggctcttgagagccggggcccacaggggacaaacagaggagatgtcccatgtgggccccgaacctggcggcagcgcaaaagatg

SEQ ID NO: 185829 - DNA, 103 bp, Artificial Sequence
  Synthetic Polynucleotide
taatacgactcactataggggagtcccggtgctcttgagagccggggcccaacagaggagagggcccatgctctcaagaaacctggcggcagcgcaaaagatg

SEQ ID NO: 185830 - DNA, 103 bp, Artificial Sequence
  Synthetic Polynucleotide
taatacgactcactatagggggccaagcactccttcatgttctcggtcataacagaggagaatgaccatgaacatgaagaacctggcggcagcgcaaaagatg

SEQ ID NO: 185831 - DNA, 103 bp, Artificial Sequence
  Synthetic Polynucleotide
taatacgactcactataggggcagggctggccatactcctggtctcggagaacagaggagactccgaatgcaggagtataacctggcggcagcgcaaaagatg

SEQ ID NO: 185832 - DNA, 103 bp, Artificial Sequence
  Synthetic Polynucleotide
taatacgactcactataggggtcatcctggtatttggggactttcctgataacagaggagaatcaggatggtccccaaaaacctggcggcagcgcaaaagatg

SEQ ID NO: 185833 - DNA, 103 bp, Artificial Sequence
  Synthetic Polynucleotide
taatacgactcactataggggactgtaggcgtcatcctggtatttggggaaacagaggagatccccaatgaccaggatgaacctggcggcagcgcaaaagatg

SEQ ID NO: 185834 - DNA, 103 bp, Artificial Sequence
  Synthetic Polynucleotide
taatacgactcactataggggttgcacactgactgtaggcgtcatcctggaacagaggagaccaggaatgcgcctacagaacctggcggcagcgcaaaagatg

SEQ ID NO: 185835 - DNA, 103 bp, Artificial Sequence
  Synthetic Polynucleotide
taatacgactcactatagggggtcattgttgttgcacactgactgtaggcaacagaggagagcctacatgcagtgtgcaaacctggcggcagcgcaaaagatg

SEQ ID NO: 185836 - DNA, 103 bp, Artificial Sequence
  Synthetic Polynucleotide
taatacgactcactataggggcacaccatgggtcattgttgttgcacactaacagaggagaagtgtgatgcaacaatgaaacctggcggcagcgcaaaagatg

SEQ ID NO: 185837 - DNA, 103 bp, Artificial Sequence
  Synthetic Polynucleotide
taatacgactcactatagggcctatattctgcacaccatgggtcattgttaacagaggagaaacaatatgccatggtgtaacctggcggcagcgcaaaagatg

SEQ ID NO: 185838 - DNA, 103 bp, Artificial Sequence
  Synthetic Polynucleotide
taatacgactcactatagggctgggtctggcctatattctgcacaccatgaacagaggagacatggtatgcagaatataaacctggcggcagcgcaaaagatg

SEQ ID NO: 185839 - DNA, 103 bp, Artificial Sequence
  Synthetic Polynucleotide
taatacgactcactatagggccccctccccctgggtctggcctatattctaacagaggagaagaataatggccagacccaacctggcggcagcgcaaaagatg

SEQ ID NO: 185840 - DNA, 103 bp, Artificial Sequence
  Synthetic Polynucleotide
taatacgactcactatagggaccttccagtccccctccccctgggtctggaacagaggagaccagacatggggggagggaacctggcggcagcgcaaaagatg

SEQ ID NO: 185841 - DNA, 103 bp, Artificial Sequence
  Synthetic Polynucleotide
taatacgactcactatagggcccctgggggaccttccagtccccctccccaacagaggagaggggagatggactggaagaacctggcggcagcgcaaaagatg

SEQ ID NO: 185842 - DNA, 103 bp, Artificial Sequence
  Synthetic Polynucleotide
taatacgactcactataggggtctcctagagcagggctggccatactcctaacagaggagaaggagtatggccagccctaacctggcggcagcgcaaaagatg

SEQ ID NO: 185843 - DNA, 103 bp, Artificial Sequence
  Synthetic Polynucleotide
taatacgactcactatagggccttggagaccccctgggggaccttccagtaacagaggagaactggaatgtcccccaggaacctggcggcagcgcaaaagatg

SEQ ID NO: 185844 - DNA, 103 bp, Artificial Sequence
  Synthetic Polynucleotide
taatacgactcactatagggtggcctggctccttggagaccccctgggggaacagaggagacccccaatgggtctccaaaacctggcggcagcgcaaaagatg

SEQ ID NO: 185845 - DNA, 103 bp, Artificial Sequence
  Synthetic Polynucleotide
taatacgactcactatagggatcctccaattggcctggctccttggagacaacagaggagagtctccatggagccaggcaacctggcggcagcgcaaaagatg

SEQ ID NO: 185846 - DNA, 103 bp, Artificial Sequence
  Synthetic Polynucleotide
taatacgactcactatagggcctcttcttcatcctccaattggcctggctaacagaggagaagccagatgaattggaggaacctggcggcagcgcaaaagatg

SEQ ID NO: 185847 - DNA, 103 bp, Artificial Sequence
  Synthetic Polynucleotide
taatacgactcactataggggatgaaggctcctcttcttcatcctccaataacagaggagaattggaatgtgaagaagaaacctggcggcagcgcaaaagatg

SEQ ID NO: 185848 - DNA, 103 bp, Artificial Sequence
  Synthetic Polynucleotide
taatacgactcactatagggggccttgaatgatgaaggctcctcttcttcaacagaggagagaagaaatggagccttcaaacctggcggcagcgcaaaagatg

SEQ ID NO: 185849 - DNA, 103 bp, Artificial Sequence
  Synthetic Polynucleotide
taatacgactcactatagggcaggactgtcggccttgaatgatgaaggctaacagaggagaagccttatgcattcaaggaacctggcggcagcgcaaaagatg

SEQ ID NO: 185850 - DNA, 103 bp, Artificial Sequence
  Synthetic Polynucleotide
taatacgactcactataggggaggcctcggcaggactgtcggccttgaataacagaggagaattcaaatgcgacagtccaacctggcggcagcgcaaaagatg

SEQ ID NO: 185851 - DNA, 103 bp, Artificial Sequence
  Synthetic Polynucleotide
taatacgactcactatagggagatgcaagggaggcctcggcaggactgtcaacagaggagagacagtatggccgaggccaacctggcggcagcgcaaaagatg

SEQ ID NO: 185852 - DNA, 103 bp, Artificial Sequence
  Synthetic Polynucleotide
taatacgactcactatagggcatgagggtcagatgcaagggaggcctcggaacagaggagaccgaggatgcccttgcataacctggcggcagcgcaaaagatg

SEQ ID NO: 185853 - DNA, 103 bp, Artificial Sequence
  Synthetic Polynucleotide
taatacgactcactataggggaggagtccggtctcctagagcagggctggaacagaggagaccagccatgctctaggagaacctggcggcagcgcaaaagatg

SEQ ID NO: 185854 - DNA, 103 bp, Artificial Sequence
  Synthetic Polynucleotide
taatacgactcactataggggtgggaagttcatgagggtcagatgcaaggaacagaggagaccttgcatgtgaccctcaaacctggcggcagcgcaaaagatg

SEQ ID NO: 185855 - DNA, 103 bp, Artificial Sequence
  Synthetic Polynucleotide
taatacgactcactatagggaaaagaggtggtgggaagttcatgagggtcaacagaggagagaccctatggaacttcccaacctggcggcagcgcaaaagatg

SEQ ID NO: 185856 - DNA, 103 bp, Artificial Sequence
  Synthetic Polynucleotide
taatacgactcactatagggagttagggcaaaaagaggtggtgggaagttaacagaggagaaacttcatgccacctcttaacctggcggcagcgcaaaagatg

SEQ ID NO: 185857 - DNA, 103 bp, Artificial Sequence
  Synthetic Polynucleotide
taatacgactcactatagggaggcgaatacagttagggcaaaaagaggtgaacagaggagacacctcatgttgccctaaaacctggcggcagcgcaaaagatg

SEQ ID NO: 185858 - DNA, 103 bp, Artificial Sequence
  Synthetic Polynucleotide
taatacgactcactatagggcttcttctttaggcgaatacagttagggcaaacagaggagatgccctatgtgtattcgcaacctggcggcagcgcaaaagatg

SEQ ID NO: 185859 - DNA, 103 bp, Artificial Sequence
  Synthetic Polynucleotide
taatacgactcactataggggctcccgaaccttcttctttaggcgaatacaacagaggagagtattcatgtaaagaagaaacctggcggcagcgcaaaagatg

SEQ ID NO: 185860 - DNA, 103 bp, Artificial Sequence
  Synthetic Polynucleotide
taatacgactcactatagggtctgcctggagctcccgaaccttcttctttaacagaggagaaaagaaatgggttcgggaaacctggcggcagcgcaaaagatg

SEQ ID NO: 185861 - DNA, 103 bp, Artificial Sequence
  Synthetic Polynucleotide
taatacgactcactatagggcatgtctaattctgcctggagctcccgaacaacagaggagagttcggatgctccaggcaaacctggcggcagcgcaaaagatg

SEQ ID NO: 185862 - DNA, 103 bp, Artificial Sequence
  Synthetic Polynucleotide
taatacgactcactatagggcagacttaagcatgtctaattctgcctggaaacagaggagatccaggatgaattagacaaacctggcggcagcgcaaaagatg

SEQ ID NO: 185863 - DNA, 103 bp, Artificial Sequence
  Synthetic Polynucleotide
taatacgactcactatagggggaagtttcccagacttaagcatgtctaataacagaggagaattagaatggcttaagtcaacctggcggcagcgcaaaagatg

SEQ ID NO: 185864 - DNA, 103 bp, Artificial Sequence
  Synthetic Polynucleotide
taatacgactcactatagggttccatggccgaggagtccggtctcctagaaacagaggagatctaggatgccggactccaacctggcggcagcgcaaaagatg

SEQ ID NO: 185865 - DNA, 103 bp, Artificial Sequence
  Synthetic Polynucleotide
taatacgactcactatagggggggggctcaggaagtttcccagacttaagaacagaggagacttaagatggggaaacttaacctggcggcagcgcaaaagatg

SEQ ID NO: 185866 - DNA, 103 bp, Artificial Sequence
  Synthetic Polynucleotide
taatacgactcactataggggtggcaatacggggggctcaggaagtttccaacagaggagaggaaacatgctgagccccaacctggcggcagcgcaaaagatg

SEQ ID NO: 185867 - DNA, 103 bp, Artificial Sequence
  Synthetic Polynucleotide
taatacgactcactatagggagtacctgtggtggcaatacggggggctcaaacagaggagatgagccatgcgtattgccaacctggcggcagcgcaaaagatg

SEQ ID NO: 185868 - DNA, 103 bp, Artificial Sequence
  Synthetic Polynucleotide
taatacgactcactatagggtgggagctccagtacctgtggtggcaatacaacagaggagagtattgatgccacaggtaaacctggcggcagcgcaaaagatg

SEQ ID NO: 185869 - DNA, 103 bp, Artificial Sequence
  Synthetic Polynucleotide
taatacgactcactatagggccgagaactctgggagctccagtacctgtgaacagaggagacacaggatgtggagctccaacctggcggcagcgcaaaagatg

SEQ ID NO: 185870 - DNA, 103 bp, Artificial Sequence
  Synthetic Polynucleotide
taatacgactcactatagggcctgcagggtccgagaactctgggagctccaacagaggagaggagctatgagagttctcaacctggcggcagcgcaaaagatg

SEQ ID NO: 185871 - DNA, 103 bp, Artificial Sequence
  Synthetic Polynucleotide
taatacgactcactatagggaaccaacttacctgcagggtccgagaactcaacagaggagagagttcatggaccctgcaaacctggcggcagcgcaaaagatg

SEQ ID NO: 185872 - DNA, 103 bp, Artificial Sequence
  Synthetic Polynucleotide
taatacgactcactatagggatctcatccaaaccaacttacctgcagggtaacagaggagaaccctgatggtaagttggaacctggcggcagcgcaaaagatg

SEQ ID NO: 185873 - DNA, 103 bp, Artificial Sequence
  Synthetic Polynucleotide
taatacgactcactatagggtccgacaataatctcatccaaaccaacttaaacagaggagataagttatgttggatgagaacctggcggcagcgcaaaagatg

SEQ ID NO: 185874 - DNA, 103 bp, Artificial Sequence
  Synthetic Polynucleotide
taatacgactcactatagggtactctgccctccgacaataatctcatccaaacagaggagatggatgatgttattgtcgaacctggcggcagcgcaaaagatg

SEQ ID NO: 185875 - DNA, 103 bp, Artificial Sequence
  Synthetic Polynucleotide
taatacgactcactatagggtgggctcaacttccatggccgaggagtccgaacagaggagacggactatgcggccatggaacctggcggcagcgcaaaagatg

SEQ ID NO: 185876 - DNA, 103 bp, Artificial Sequence
  Synthetic Polynucleotide
taatacgactcactataggggcccactgcgtactctgccctccgacaataaacagaggagatattgtatgagggcagagaacctggcggcagcgcaaaagatg

SEQ ID NO: 185877 - DNA, 103 bp, Artificial Sequence
  Synthetic Polynucleotide
taatacgactcactatagggcctccacacagcccactgcgtactctgcccaacagaggagagggcagatgacgcagtggaacctggcggcagcgcaaaagatg

SEQ ID NO: 185878 - DNA, 103 bp, Artificial Sequence
  Synthetic Polynucleotide
taatacgactcactatagggttcagtttcttgggctcaacttccatggccaacagaggagaggccatatgagttgagccaacctggcggcagcgcaaaagatg

SEQ ID NO: 185879 - DNA, 103 bp, Artificial Sequence
  Synthetic Polynucleotide
taatacgactcactataggggcgcttccccttcagtttcttgggctcaacaacagaggagagttgagatgaagaaactgaacctggcggcagcgcaaaagatg

SEQ ID NO: 185880 - DNA, 103 bp, Artificial Sequence
  Synthetic Polynucleotide
taatacgactcactatagggcgatgaggtcgcgcttccccttcagtttctaacagaggagaagaaacatgaggggaagcaacctggcggcagcgcaaaagatg

SEQ ID NO: 185881 - DNA, 103 bp, Artificial Sequence
  Synthetic Polynucleotide
taatacgactcactatagggcttttgggcacgatgaggtcgcgcttccccaacagaggagaggggaaatgcgacctcataacctggcggcagcgcaaaagatg

SEQ ID NO: 185882 - DNA, 103 bp, Artificial Sequence
  Synthetic Polynucleotide
taatacgactcactatagggttgctggaagcttttgggcacgatgaggtcaacagaggagagacctcatggtgcccaaaaacctggcggcagcgcaaaagatg

SEQ ID NO: 185883 - DNA, 103 bp, Artificial Sequence
  Synthetic Polynucleotide
taatacgactcactatagggcattggtctgggccaagcactccttcatgtaacagaggagaacatgaatgagtgcttggaacctggcggcagcgcaaaagatg

SEQ ID NO: 185884 - DNA, 103 bp, Artificial Sequence
  Synthetic Polynucleotide
taatacgactcactatagggagaagtccacttgctggaagcttttgggcaaacagaggagatgcccaatggcttccagcaacctggcggcagcgcaaaagatg

SEQ ID NO: 185885 - DNA, 103 bp, Artificial Sequence
  Synthetic Polynucleotide
taatacgactcactatagggtcacagaaccagaagtccacttgctggaagaacagaggagacttccaatgagtggacttaacctggcggcagcgcaaaagatg

SEQ ID NO: 185886 - DNA, 103 bp, Artificial Sequence
  Synthetic Polynucleotide
taatacgactcactatagggctggcaggactcacagaaccagaagtccacaacagaggagagtggacatgtggttctgtaacctggcggcagcgcaaaagatg

SEQ ID NO: 185887 - DNA, 103 bp, Artificial Sequence
  Synthetic Polynucleotide
taatacgactcactatagggcgaagtactcctggcaggactcacagaaccaacagaggagaggttctatgagtcctgccaacctggcggcagcgcaaaagatg

SEQ ID NO: 185888 - DNA, 103 bp, Artificial Sequence
  Synthetic Polynucleotide
taatacgactcactatagggcattcatccacgaagtactcctggcaggacaacagaggagagtcctgatgggagtacttaacctggcggcagcgcaaaagatg

SEQ ID NO: 185889 - DNA, 103 bp, Artificial Sequence
  Synthetic Polynucleotide
taatacgactcactatagggatggtttgggcattcatccacgaagtactcaacagaggagagagtacatggtggatgaaaacctggcggcagcgcaaaagatg

SEQ ID NO: 185890 - DNA, 103 bp, Artificial Sequence
  Synthetic Polynucleotide
taatacgactcactatagggccggggggccatggtttgggcattcatccaaacagaggagatggatgatggcccaaaccaacctggcggcagcgcaaaagatg

SEQ ID NO: 185891 - DNA, 103 bp, Artificial Sequence
  Synthetic Polynucleotide
taatacgactcactataggggacacaaacaccggggggccatggtttgggaacagaggagacccaaaatgtggccccccaacctggcggcagcgcaaaagatg

SEQ ID NO: 185892 - DNA, 103 bp, Artificial Sequence
  Synthetic Polynucleotide
taatacgactcactatagggcggtgtgtcagacacaaacaccggggggccaacagaggagaggccccatggtgtttgtgaacctggcggcagcgcaaaagatg

SEQ ID NO: 185893 - DNA, 103 bp, Artificial Sequence
  Synthetic Polynucleotide
taatacgactcactatagggccacgggcaccggtgtgtcagacacaaacaaacagaggagatgtttgatgctgacacacaacctggcggcagcgcaaaagatg

SEQ ID NO: 185894 - DNA, 103 bp, Artificial Sequence
  Synthetic Polynucleotide
taatacgactcactatagggcccacggctgcattggtctgggccaagcacaacagaggagagtgcttatgccagaccaaaacctggcggcagcgcaaaagatg

SEQ ID NO: 185895 - DNA, 103 bp, Artificial Sequence
  Synthetic Polynucleotide
taatacgactcactatagggtctgggatgcccacgggcaccggtgtgtcaaacagaggagatgacacatgggtgcccgtaacctggcggcagcgcaaaagatg

SEQ ID NO: 185896 - DNA, 103 bp, Artificial Sequence
  Synthetic Polynucleotide
taatacgactcactatagggcgccgcccggtctgggatgcccacgggcacaacagaggagagtgcccatgggcatcccaaacctggcggcagcgcaaaagatg

SEQ ID NO: 185897 - DNA, 103 bp, Artificial Sequence
  Synthetic Polynucleotide
taatacgactcactatagggggatggtgagcgccgcccggtctgggatgcaacagaggagagcatccatgaccgggcggaacctggcggcagcgcaaaagatg

SEQ ID NO: 185898 - DNA, 103 bp, Artificial Sequence
  Synthetic Polynucleotide
taatacgactcactatagggatgccctgtgggatggtgagcgccgcccggaacagaggagaccgggcatggctcaccataacctggcggcagcgcaaaagatg

SEQ ID NO: 185899 - DNA, 103 bp, Artificial Sequence
  Synthetic Polynucleotide
taatacgactcactataggggaccacctccatgccctgtgggatggtgagaacagaggagactcaccatgccacagggcaacctggcggcagcgcaaaagatg

SEQ ID NO: 185900 - DNA, 103 bp, Artificial Sequence
  Synthetic Polynucleotide
taatacgactcactatagggtagtgtccttgaccacctccatgccctgtgaacagaggagacacaggatgtggaggtggaacctggcggcagcgcaaaagatg

SEQ ID NO: 185901 - DNA, 103 bp, Artificial Sequence
  Synthetic Polynucleotide
taatacgactcactatagggctctctccactagtgtccttgaccacctccaacagaggagaggaggtatgcaaggacacaacctggcggcagcgcaaaagatg

SEQ ID NO: 185902 - DNA, 103 bp, Artificial Sequence
  Synthetic Polynucleotide
taatacgactcactatagggtcgcacgtcactctctccactagtgtccttaacagaggagaaaggacatgagtggagagaacctggcggcagcgcaaaagatg

SEQ ID NO: 185903 - DNA, 103 bp, Artificial Sequence
  Synthetic Polynucleotide
taatacgactcactatagggcgtttacacatcgcacgtcactctctccacaacagaggagagtggagatggtgacgtgcaacctggcggcagcgcaaaagatg

SEQ ID NO: 185904 - DNA, 103 bp, Artificial Sequence
  Synthetic Polynucleotide
taatacgactcactataggggggatgacctcgtttacacatcgcacgtcaaacagaggagatgacgtatgatgtgtaaaaacctggcggcagcgcaaaagatg

SEQ ID NO: 185905 - DNA, 103 bp, Artificial Sequence
  Synthetic Polynucleotide
taatacgactcactatagggcaccatatcccccacggctgcattggtctgaacagaggagacagaccatggcagccgtgaacctggcggcagcgcaaaagatg

SEQ ID NO: 185906 - DNA, 103 bp, Artificial Sequence
  Synthetic Polynucleotide
taatacgactcactataggggtggcccttggggatgacctcgtttacacaaacagaggagatgtgtaatggaggtcatcaacctggcggcagcgcaaaagatg

SEQ ID NO: 185907 - DNA, 103 bp, Artificial Sequence
  Synthetic Polynucleotide
taatacgactcactatagggggccgaagatgtggcccttggggatgacctaacagaggagaaggtcaatgccaagggccaacctggcggcagcgcaaaagatg

SEQ ID NO: 185908 - DNA, 103 bp, Artificial Sequence
  Synthetic Polynucleotide
taatacgactcactatagggccctcataggggccgaagatgtggcccttgaacagaggagacaagggatgcatcttcggaacctggcggcagcgcaaaagatg

SEQ ID NO: 185909 - DNA, 103 bp, Artificial Sequence
  Synthetic Polynucleotide
taatacgactcactatagggggagatctgcccctcataggggccgaagataacagaggagaatcttcatgccctatgagaacctggcggcagcgcaaaagatg

SEQ ID NO: 185910 - DNA, 103 bp, Artificial Sequence
  Synthetic Polynucleotide
taatacgactcactatagggtgtcctgggtggagatctgcccctcataggaacagaggagacctatgatgggcagatctaacctggcggcagcgcaaaagatg

SEQ ID NO: 185911 - DNA, 103 bp, Artificial Sequence
  Synthetic Polynucleotide
taatacgactcactatagggccagctgatttgtcctgggtggagatctgcaacagaggagagcagatatgcacccaggaaacctggcggcagcgcaaaagatg

SEQ ID NO: 185912 - DNA, 103 bp, Artificial Sequence
  Synthetic Polynucleotide
taatacgactcactatagggggagaagaagccagctgatttgtcctgggtaacagaggagaacccagatgaaatcagctaacctggcggcagcgcaaaagatg

SEQ ID NO: 185913 - DNA, 103 bp, Artificial Sequence
  Synthetic Polynucleotide
taatacgactcactatagggcaatcagccaggagaagaagccagctgattaacagaggagaaatcagatggcttcttctaacctggcggcagcgcaaaagatg

SEQ ID NO: 185914 - DNA, 103 bp, Artificial Sequence
  Synthetic Polynucleotide
taatacgactcactatagggttcttgtccacaatcagccaggagaagaagaacagaggagacttcttatgctggctgataacctggcggcagcgcaaaagatg

SEQ ID NO: 185915 - DNA, 103 bp, Artificial Sequence
  Synthetic Polynucleotide
taatacgactcactatagggatagcggttgttcttgtccacaatcagccaaacagaggagatggctgatggtggacaagaacctggcggcagcgcaaaagatg

SEQ ID NO: 185916 - DNA, 103 bp, Artificial Sequence
  Synthetic Polynucleotide
taatacgactcactatagggtcaccaccgtcaccatatcccccacggctgaacagaggagacagccgatggggatatggaacctggcggcagcgcaaaagatg

SEQ ID NO: 185917 - DNA, 103 bp, Artificial Sequence
  Synthetic Polynucleotide
taatacgactcactatagggctatggacttatagcggttgttcttgtccaaacagaggagatggacaatgacaaccgctaacctggcggcagcgcaaaagatg

SEQ ID NO: 185918 - DNA, 103 bp, Artificial Sequence
  Synthetic Polynucleotide
taatacgactcactatagggtctgagccatctatggacttatagcggttgaacagaggagacaaccgatgtaagtccataacctggcggcagcgcaaaagatg

SEQ ID NO: 185919 - DNA, 103 bp, Artificial Sequence
  Synthetic Polynucleotide
taatacgactcactatagggtttggtctcgtctgagccatctatggacttaacagaggagaaagtccatggatggctcaaacctggcggcagcgcaaaagatg

SEQ ID NO: 185920 - DNA, 103 bp, Artificial Sequence
  Synthetic Polynucleotide
taatacgactcactatagggtccagttggctttggtctcgtctgagccataacagaggagaatggctatgacgagaccaaacctggcggcagcgcaaaagatg

SEQ ID NO: 185921 - DNA, 103 bp, Artificial Sequence
  Synthetic Polynucleotide
taatacgactcactatagggacgtacctcatccagttggctttggtctcgaacagaggagacgagacatgagccaactgaacctggcggcagcgcaaaagatg

SEQ ID NO: 185922 - DNA, 103 bp, Artificial Sequence
  Synthetic Polynucleotide
taatacgactcactatagggggagatgaccacgtacctcatccagttggcaacagaggagagccaacatgatgaggtacaacctggcggcagcgcaaaagatg

SEQ ID NO: 185923 - DNA, 103 bp, Artificial Sequence
  Synthetic Polynucleotide
taatacgactcactatagggtctcctcccgggagatgaccacgtacctcaaacagaggagatgaggtatgtggtcatctaacctggcggcagcgcaaaagatg

SEQ ID NO: 185924 - DNA, 103 bp, Artificial Sequence
  Synthetic Polynucleotide
taatacgactcactatagggttctgctccctctcctcccgggagatgaccaacagaggagaggtcatatgccgggaggaaacctggcggcagcgcaaaagatg

SEQ ID NO: 185925 - DNA, 103 bp, Artificial Sequence
  Synthetic Polynucleotide
taatacgactcactatagggcgccagcaggttctgctccctctcctcccgaacagaggagacgggagatgagggagcagaacctggcggcagcgcaaaagatg

SEQ ID NO: 185926 - DNA, 103 bp, Artificial Sequence
  Synthetic Polynucleotide
taatacgactcactatagggtgtgctggaacgccagcaggttctgctcccaacagaggagagggagcatgacctgctggaacctggcggcagcgcaaaagatg

SEQ ID NO: 185927 - DNA, 103 bp, Artificial Sequence
  Synthetic Polynucleotide
taatacgactcactatagggacctccgtcttcaccaccgtcaccatatccaacagaggagaggatatatggacggtggtaacctggcggcagcgcaaaagatg

SEQ ID NO: 185928 - DNA, 103 bp, Artificial Sequence
  Synthetic Polynucleotide
taatacgactcactatagggatgcgctcactgtgctggaacgccagcaggaacagaggagacctgctatggttccagcaaacctggcggcagcgcaaaagatg

SEQ ID NO: 185929 - DNA, 103 bp, Artificial Sequence
  Synthetic Polynucleotide
taatacgactcactatagggccggaagtagatgcgctcactgtgctggaaaacagaggagattccagatgagtgagcgcaacctggcggcagcgcaaaagatg

SEQ ID NO: 185930 - DNA, 103 bp, Artificial Sequence
  Synthetic Polynucleotide
taatacgactcactatagggccctgcacgcccggaagtagatgcgctcacaacagaggagagtgagcatgtctacttccaacctggcggcagcgcaaaagatg

SEQ ID NO: 185931 - DNA, 103 bp, Artificial Sequence
  Synthetic Polynucleotide
taatacgactcactatagggggccggatgtccctgcacgcccggaagtagaacagaggagactacttatgggcgtgcagaacctggcggcagcgcaaaagatg

SEQ ID NO: 185932 - DNA, 103 bp, Artificial Sequence
  Synthetic Polynucleotide
taatacgactcactatagggccactccccaggccggatgtccctgcacgcaacagaggagagcgtgcatggacatccggaacctggcggcagcgcaaaagatg

SEQ ID NO: 185933 - DNA, 103 bp, Artificial Sequence
  Synthetic Polynucleotide
taatacgactcactatagggagacccgcagccactccccaggccggatgtaacagaggagaacatccatgctggggagtaacctggcggcagcgcaaaagatg

SEQ ID NO: 185934 - DNA, 103 bp, Artificial Sequence
  Synthetic Polynucleotide
taatacgactcactatagggtcgctgtaccagacccgcagccactccccaaacagaggagatggggaatggctgcgggtaacctggcggcagcgcaaaagatg

SEQ ID NO: 185935 - DNA, 103 bp, Artificial Sequence
  Synthetic Polynucleotide
taatacgactcactatagggcatgtagtcctcgctgtaccagacccgcagaacagaggagactgcggatgtggtacagcaacctggcggcagcgcaaaagatg

SEQ ID NO: 185936 - DNA, 103 bp, Artificial Sequence
  Synthetic Polynucleotide
taatacgactcactataggggcaggcgcttcatgtagtcctcgctgtaccaacagaggagaggtacaatgaggactacaaacctggcggcagcgcaaaagatg

SEQ ID NO: 185937 - DNA, 103 bp, Artificial Sequence
  Synthetic Polynucleotide
taatacgactcactataggggacatgctgtgcaggcgcttcatgtagtccaacagaggagaggactaatggaagcgcctaacctggcggcagcgcaaaagatg

SEQ ID NO: 185938 - DNA, 103 bp, Artificial Sequence
  Synthetic Polynucleotide
taatacgactcactatagggtggtgagcagacctccgtcttcaccaccgtaacagaggagaacggtgatgaagacggagaacctggcggcagcgcaaaagatg

SEQ ID NO: 185939 - DNA, 103 bp, Artificial Sequence
  Synthetic Polynucleotide
taatacgactcactatagggggtttcctgggacatgctgtgcaggcgcttaacagaggagaaagcgcatgcacagcatgaacctggcggcagcgcaaaagatg

SEQ ID NO: 185940 - DNA, 103 bp, Artificial Sequence
  Synthetic Polynucleotide
taatacgactcactatagggtgcggtgaatggtttcctgggacatgctgtaacagaggagaacagcaatgcccaggaaaaacctggcggcagcgcaaaagatg

SEQ ID NO: 185941 - DNA, 103 bp, Artificial Sequence
  Synthetic Polynucleotide
taatacgactcactatagggctggccaggttgcggtgaatggtttcctggaacagaggagaccaggaatgcattcaccgaacctggcggcagcgcaaaagatg

SEQ ID NO: 185942 - DNA, 103 bp, Artificial Sequence
  Synthetic Polynucleotide
taatacgactcactatagggcttctctcctctggccaggttgcggtgaataacagaggagaattcacatgaacctggccaacctggcggcagcgcaaaagatg

SEQ ID NO: 185943 - DNA, 103 bp, Artificial Sequence
  Synthetic Polynucleotide
taatacgactcactatagggtctgcaacctcttctctcctctggccaggtaacagaggagaacctggatggaggagagaaacctggcggcagcgcaaaagatg

SEQ ID NO: 185944 - DNA, 103 bp, Artificial Sequence
  Synthetic Polynucleotide
taatacgactcactataggggacttctccctctgcaacctcttctctcctaacagaggagaaggagaatggaggttgcaaacctggcggcagcgcaaaagatg

SEQ ID NO: 185945 - DNA, 103 bp, Artificial Sequence
  Synthetic Polynucleotide
taatacgactcactatagggaacctgctcagacttctccctctgcaacctaacagaggagaaggttgatgagggagaagaacctggcggcagcgcaaaagatg

SEQ ID NO: 185946 - DNA, 103 bp, Artificial Sequence
  Synthetic Polynucleotide
taatacgactcactatagggggttatccagaacctgctcagacttctcccaacagaggagagggagaatgctgagcaggaacctggcggcagcgcaaaagatg

SEQ ID NO: 185947 - DNA, 103 bp, Artificial Sequence
  Synthetic Polynucleotide
taatacgactcactatagggaggtcttctgggttatccagaacctgctcaaacagaggagatgagcaatgtctggataaaacctggcggcagcgcaaaagatg

SEQ ID NO: 185948 - DNA, 103 bp, Artificial Sequence
  Synthetic Polynucleotide
taatacgactcactataggggggacccctcaggtcttctgggttatccagaacagaggagactggatatgccagaagacaacctggcggcagcgcaaaagatg

SEQ ID NO: 185949 - DNA, 103 bp, Artificial Sequence
  Synthetic Polynucleotide
taatacgactcactatagggggtctcggagtggtgagcagacctccgtctaacagaggagaagacggatgtctgctcacaacctggcggcagcgcaaaagatg

SEQ ID NO: 185950 - DNA, 103 bp, Artificial Sequence
  Synthetic Polynucleotide
taatacgactcactatagggagagatgaatgggacccctcaggtcttctgaacagaggagacagaagatgtgaggggtcaacctggcggcagcgcaaaagatg

SEQ ID NO: 185951 - DNA, 103 bp, Artificial Sequence
  Synthetic Polynucleotide
taatacgactcactatagggctcagcacagagagatgaatgggacccctcaacagaggagagaggggatgcattcatctaacctggcggcagcgcaaaagatg

SEQ ID NO: 185952 - DNA, 103 bp, Artificial Sequence
  Synthetic Polynucleotide
taatacgactcactatagggtttgccctgtctcagcacagagagatgaataacagaggagaattcatatgtctgtgctgaacctggcggcagcgcaaaagatg

SEQ ID NO: 185953 - DNA, 103 bp, Artificial Sequence
  Synthetic Polynucleotide
taatacgactcactatagggtgtagggacttttgccctgtctcagcacagaacagaggagactgtgcatggacagggcaaacctggcggcagcgcaaaagatg

SEQ ID NO: 185954 - DNA, 103 bp, Artificial Sequence
  Synthetic Polynucleotide
taatacgactcactatagggaagccacgcttgtagggacttttgccctgtaacagaggagaacagggatgaagtccctaaacctggcggcagcgcaaaagatg

SEQ ID NO: 185955 - DNA, 103 bp, Artificial Sequence
  Synthetic Polynucleotide
taatacgactcactatagggcccctcatcaaagccacgcttgtagggactaacagaggagaagtcccatgaagcgtggcaacctggcggcagcgcaaaagatg

SEQ ID NO: 185956 - DNA, 103 bp, Artificial Sequence
  Synthetic Polynucleotide
taatacgactcactatagggggtgtacatccccctcatcaaagccacgctaacagaggagaagcgtgatgttgatgaggaacctggcggcagcgcaaaagatg

SEQ ID NO: 185957 - DNA, 103 bp, Artificial Sequence
  Synthetic Polynucleotide
taatacgactcactatagggttagcttgggggtgtacatccccctcatcaaacagaggagatgatgaatgggatgtacaaacctggcggcagcgcaaaagatg

SEQ ID NO: 185958 - DNA, 103 bp, Artificial Sequence
  Synthetic Polynucleotide
taatacgactcactatagggtttcttcttcttagcttgggggtgtacatcaacagaggagagatgtaatgccccaagctaacctggcggcagcgcaaaagatg

SEQ ID NO: 185959 - DNA, 103 bp, Artificial Sequence
  Synthetic Polynucleotide
taatacgactcactatagggtcaggtcaattttcttcttcttagcttgggaacagaggagacccaagatgagaagaagaaacctggcggcagcgcaaaagatg

SEQ ID NO: 185960 - DNA, 103 bp, Artificial Sequence
  Synthetic Polynucleotide
taatacgactcactatagggccatactcctggtctcggagtggtgagcagaacagaggagactgctcatgactccgagaaacctggcggcagcgcaaaagatg

SEQ ID NO: 185961 - DNA, 103 bp, Artificial Sequence
  Synthetic Polynucleotide
taatacgactcactatagggtccttgaaaatcaggtcaattttcttcttcaacagaggagagaagaaatgaattgacctaacctggcggcagcgcaaaagatg

SEQ ID NO: 185962 - DNA, 103 bp, Artificial Sequence
  Synthetic Polynucleotide
taatacgactcactatagggctccagaacatccttgaaaatcaggtcaataacagaggagaattgacatgattttcaagaacctggcggcagcgcaaaagatg

SEQ ID NO: 185963 - DNA, 103 bp, Artificial Sequence
  Synthetic Polynucleotide
taatacgactcactatagggccagtgaggcctccagaacatccttgaaaaaacagaggagattttcaatgatgttctggaacctggcggcagcgcaaaagatg

SEQ ID NO: 185964 - DNA, 103 bp, Artificial Sequence
  Synthetic Polynucleotide
taatacgactcactatagggttcgcagattccagtgaggcctccagaacaaacagaggagatgttctatgggcctcactaacctggcggcagcgcaaaagatg

SEQ ID NO: 185965 - DNA, 103 bp, Artificial Sequence
  Synthetic Polynucleotide
taatacgactcactatagggggcttccaccttcgcagattccagtgaggcaacagaggagagcctcaatggaatctgcgaacctggcggcagcgcaaaagatg

SEQ ID NO: 185966 - DNA, 103 bp, Artificial Sequence
  Synthetic Polynucleotide
taatacgactcactatagggccaactggtgggcttccaccttcgcagattaacagaggagaaatctgatgaggtggaagaacctggcggcagcgcaaaagatg

SEQ ID NO: 185967 - DNA, 103 bp, Artificial Sequence
  Synthetic Polynucleotide
taatacgactcactataggggtgctcagggccaactggtgggcttccaccaacagaggagaggtggaatgccaccagttaacctggcggcagcgcaaaagatg

SEQ ID NO: 185968 - DNA, 103 bp, Artificial Sequence
  Synthetic Polynucleotide
taatacgactcactataggggaccagtgaggtgctcagggccaactggtgaacagaggagacaccagatggccctgagcaacctggcggcagcgcaaaagatg

SEQ ID NO: 185969 - DNA, 103 bp, Artificial Sequence
  Synthetic Polynucleotide
taatacgactcactatagggctttcctgatgaccagtgaggtgctcagggaacagaggagaccctgaatgcctcactggaacctggcggcagcgcaaaagatg

SEQ ID NO: 185970 - DNA, 103 bp, Artificial Sequence
  Synthetic Polynucleotide
taatacgactcactatagggtatttggggactttcctgatgaccagtgagaacagaggagactcactatgcatcaggaaaacctggcggcagcgcaaaagatg

SEQ ID NO: 185971 - DNA, 103 bp, Artificial Sequence
  Synthetic Polynucleotide
taatacgactcactatagggggcctcagccgggagcacggagcccatcataacagaggagaatgatgatgtccgtgctcaacctggcggcagcgcaaaagatg

SEQ ID NO: 185972 - DNA, 103 bp, Artificial Sequence
  Synthetic Polynucleotide
taatacgactcactataggggcggccgtacaggaagctgtgcaggatgtcaacagaggagagacatcatgcacagcttcaacctggcggcagcgcaaaagatg

SEQ ID NO: 185973 - DNA, 103 bp, Artificial Sequence
  Synthetic Polynucleotide
taatacgactcactatagggcggggcgggcagcgcgggcgagtgtgcctgaacagaggagacaggcaatgtcgcccgcgaacctggcggcagcgcaaaagatg

SEQ ID NO: 185974 - DNA, 103 bp, Artificial Sequence
  Synthetic Polynucleotide
taatacgactcactatagggcgtgcgcgtgcggggcgggcagcgcgggcgaacagaggagacgcccgatgtgcccgcccaacctggcggcagcgcaaaagatg

SEQ ID NO: 185975 - DNA, 103 bp, Artificial Sequence
  Synthetic Polynucleotide
taatacgactcactatagggagcgcgggcgcgtgcgcgtgcggggcgggcaacagaggagagcccgcatggcacgcgcaaacctggcggcagcgcaaaagatg

SEQ ID NO: 185976 - DNA, 103 bp, Artificial Sequence
  Synthetic Polynucleotide
taatacgactcactatagggggcggcggcgagcgcgggcgcgtgcgcgtgaacagaggagacacgcgatggcgcccgcgaacctggcggcagcgcaaaagatg

SEQ ID NO: 185977 - DNA, 103 bp, Artificial Sequence
  Synthetic Polynucleotide
taatacgactcactatagggcggcggcggcggcggcggcgagcgcgggcgaacagaggagacgcccgatgtcgccgccgaacctggcggcagcgcaaaagatg

SEQ ID NO: 185978 - DNA, 103 bp, Artificial Sequence
  Synthetic Polynucleotide
taatacgactcactataggggcggcggcggcggcggcggcggcggcggcgaacagaggagacgccgcatgcgccgccgcaacctggcggcagcgcaaaagatg

SEQ ID NO: 185979 - DNA, 103 bp, Artificial Sequence
  Synthetic Polynucleotide
taatacgactcactataggggtgcgcggcggcggcggcggcggcggcggcaacagaggagagccgccatggccgccgccaacctggcggcagcgcaaaagatg

SEQ ID NO: 185980 - DNA, 103 bp, Artificial Sequence
  Synthetic Polynucleotide
taatacgactcactatagggccggcaggtggtgcgcggcggcggcggcggaacagaggagaccgccgatgccgccgcgcaacctggcggcagcgcaaaagatg

SEQ ID NO: 185981 - DNA, 103 bp, Artificial Sequence
  Synthetic Polynucleotide
taatacgactcactatagggagcaccatggccggcaggtggtgcgcggcgaacagaggagacgccgcatgccacctgccaacctggcggcagcgcaaaagatg

SEQ ID NO: 185982 - DNA, 103 bp, Artificial Sequence
  Synthetic Polynucleotide
taatacgactcactatagggcgttgcgccagcggccgtacaggaagctgtaacagaggagaacagctatgtgtacggccaacctggcggcagcgcaaaagatg

SEQ ID NO: 185983 - DNA, 103 bp, Artificial Sequence
  Synthetic Polynucleotide
taatacgactcactatagggtccccgagcacgttgcgccagcggccgtacaacagaggagagtacggatgctggcgcaaaacctggcggcagcgcaaaagatg

SEQ ID NO: 185984 - DNA, 103 bp, Artificial Sequence
  Synthetic Polynucleotide
taatacgactcactataggggaagagctgctccccgagcacgttgcgccaaacagaggagatggcgcatggtgctcgggaacctggcggcagcgcaaaagatg

SEQ ID NO: 185985 - DNA, 103 bp, Artificial Sequence
  Synthetic Polynucleotide
taatacgactcactatagggtcttgtcctcgaagagctgctccccgagcaaacagaggagatgctcgatgagcagctctaacctggcggcagcgcaaaagatg

SEQ ID NO: 185986 - DNA, 103 bp, Artificial Sequence
  Synthetic Polynucleotide
taatacgactcactataggggcgtggtggctcttgtcctcgaagagctgcaacagaggagagcagctatgcgaggacaaaacctggcggcagcgcaaaagatg

SEQ ID NO: 185987 - DNA, 103 bp, Artificial Sequence
  Synthetic Polynucleotide
taatacgactcactatagggcttggggctggcgtggtggctcttgtcctcaacagaggagagaggacatgagccaccacaacctggcggcagcgcaaaagatg

SEQ ID NO: 185988 - DNA, 103 bp, Artificial Sequence
  Synthetic Polynucleotide
taatacgactcactatagggtgaaggctgtcttggggctggcgtggtggcaacagaggagagccaccatgccagccccaaacctggcggcagcgcaaaagatg

SEQ ID NO: 185989 - DNA, 103 bp, Artificial Sequence
  Synthetic Polynucleotide
taatacgactcactatagggacctcggcggtgaaggctgtcttggggctgaacagaggagacagcccatggacagccttaacctggcggcagcgcaaaagatg

SEQ ID NO: 185990 - DNA, 103 bp, Artificial Sequence
  Synthetic Polynucleotide
taatacgactcactatagggctgcgccagcacctcggcggtgaaggctgtaacagaggagaacagccatgaccgccgagaacctggcggcagcgcaaaagatg

SEQ ID NO: 185991 - DNA, 103 bp, Artificial Sequence
  Synthetic Polynucleotide
taatacgactcactatagggtgagcaccagggcctcagccgggagcacggaacagaggagaccgtgcatgcggctgaggaacctggcggcagcgcaaaagatg

SEQ ID NO: 185992 - DNA, 103 bp, Artificial Sequence
  Synthetic Polynucleotide
taatacgactcactatagggcggagaaggactgcgccagcacctcggcggaacagaggagaccgccgatgtgctggcgcaacctggcggcagcgcaaaagatg

SEQ ID NO: 185993 - DNA, 103 bp, Artificial Sequence
  Synthetic Polynucleotide
taatacgactcactatagggtgcacttcgccggagaaggactgcgccagcaacagaggagagctggcatggtccttctcaacctggcggcagcgcaaaagatg

SEQ ID NO: 185994 - DNA, 103 bp, Artificial Sequence
  Synthetic Polynucleotide
taatacgactcactatagggggacagcttctgcacttcgccggagaaggaaacagaggagatccttcatgggcgaagtgaacctggcggcagcgcaaaagatg

SEQ ID NO: 185995 - DNA, 103 bp, Artificial Sequence
  Synthetic Polynucleotide
taatacgactcactataggggcaccaggctggacagcttctgcacttcgcaacagaggagagcgaagatgagaagctgtaacctggcggcagcgcaaaagatg

SEQ ID NO: 185996 - DNA, 103 bp, Artificial Sequence
  Synthetic Polynucleotide
taatacgactcactatagggtccgcaggcagcaccaggctggacagcttcaacagaggagagaagctatgcagcctggtaacctggcggcagcgcaaaagatg

SEQ ID NO: 185997 - DNA, 103 bp, Artificial Sequence
  Synthetic Polynucleotide
taatacgactcactataggggatgatcacctccgcaggcagcaccaggctaacagaggagaagcctgatgctgcctgcgaacctggcggcagcgcaaaagatg

SEQ ID NO: 185998 - DNA, 103 bp, Artificial Sequence
  Synthetic Polynucleotide
taatacgactcactatagggagctctgagcgatgatcacctccgcaggcaaacagaggagatgcctgatgaggtgatcaaacctggcggcagcgcaaaagatg

SEQ ID NO: 185999 - DNA, 103 bp, Artificial Sequence
  Synthetic Polynucleotide
taatacgactcactatagggccagggatggagctctgagcgatgatcaccaacagaggagaggtgatatgcgctcagagaacctggcggcagcgcaaaagatg

SEQ ID NO: 186000 - DNA, 103 bp, Artificial Sequence
  Synthetic Polynucleotide
taatacgactcactataggggaggccctcgccagggatggagctctgagcaacagaggagagctcagatgtccatccctaacctggcggcagcgcaaaagatg

SEQ ID NO: 186001 - DNA, 103 bp, Artificial Sequence
  Synthetic Polynucleotide
taatacgactcactatagggagaagatgccgaggccctcgccagggatggaacagaggagaccatccatggcgagggccaacctggcggcagcgcaaaagatg

SEQ ID NO: 186002 - DNA, 103 bp, Artificial Sequence
  Synthetic Polynucleotide
taatacgactcactatagggagcccggtcttgagcaccagggcctcagccaacagaggagaggctgaatgcctggtgctaacctggcggcagcgcaaaagatg

SEQ ID NO: 186003 - DNA, 103 bp, Artificial Sequence
  Synthetic Polynucleotide
taatacgactcactatagggcacgtcttggagaagatgccgaggccctcgaacagaggagacgagggatgcggcatcttaacctggcggcagcgcaaaagatg

SEQ ID NO: 186004 - DNA, 103 bp, Artificial Sequence
  Synthetic Polynucleotide
taatacgactcactatagggcgccttgatccacgtcttggagaagatgccaacagaggagaggcatcatgtccaagacgaacctggcggcagcgcaaaagatg

SEQ ID NO: 186005 - DNA, 103 bp, Artificial Sequence
  Synthetic Polynucleotide
taatacgactcactatagggtctcggttcccgccttgatccacgtcttggaacagaggagaccaagaatgggatcaaggaacctggcggcagcgcaaaagatg

SEQ ID NO: 186006 - DNA, 103 bp, Artificial Sequence
  Synthetic Polynucleotide
taatacgactcactatagggaaggggcccatctcggttcccgccttgatcaacagaggagagatcaaatggggaaccgaaacctggcggcagcgcaaaagatg

SEQ ID NO: 186007 - DNA, 103 bp, Artificial Sequence
  Synthetic Polynucleotide
taatacgactcactataggggcggccggtgaaggggcccatctcggttccaacagaggagaggaaccatgatgggccccaacctggcggcagcgcaaaagatg

SEQ ID NO: 186008 - DNA, 103 bp, Artificial Sequence
  Synthetic Polynucleotide
taatacgactcactataggggggcgatcacgcggccggtgaaggggcccaaacagaggagatgggccatgtcaccggccaacctggcggcagcgcaaaagatg

SEQ ID NO: 186009 - DNA, 103 bp, Artificial Sequence
  Synthetic Polynucleotide
taatacgactcactatagggacgtgctccggggcgatcacgcggccggtgaacagaggagacaccggatgcgtgatcgcaacctggcggcagcgcaaaagatg

SEQ ID NO: 186010 - DNA, 103 bp, Artificial Sequence
  Synthetic Polynucleotide
taatacgactcactataggggcagatgtccacgtgctccggggcgatcacaacagaggagagtgatcatgccggagcacaacctggcggcagcgcaaaagatg

SEQ ID NO: 186011 - DNA, 103 bp, Artificial Sequence
  Synthetic Polynucleotide
taatacgactcactatagggtgttgttcttgcagatgtccacgtgctccgaacagaggagacggagcatgtggacatctaacctggcggcagcgcaaaagatg

SEQ ID NO: 186012 - DNA, 103 bp, Artificial Sequence
  Synthetic Polynucleotide
taatacgactcactatagggcacatgaggttgttgttcttgcagatgtccaacagaggagaggacatatgcaagaacaaaacctggcggcagcgcaaaagatg

SEQ ID NO: 186013 - DNA, 103 bp, Artificial Sequence
  Synthetic Polynucleotide
taatacgactcactatagggcggcgccttcagcccggtcttgagcaccagaacagaggagactggtgatgaagaccgggaacctggcggcagcgcaaaagatg

SEQ ID NO: 186014 - DNA, 103 bp, Artificial Sequence
  Synthetic Polynucleotide
taatacgactcactataggggaacacctcccacatgaggttgttgttcttaacagaggagaaagaacatgaacctcatgaacctggcggcagcgcaaaagatg

SEQ ID NO: 186015 - DNA, 103 bp, Artificial Sequence
  Synthetic Polynucleotide
taatacgactcactatagggcatcctcattgaacacctcccacatgaggtaacagaggagaacctcaatggggaggtgtaacctggcggcagcgcaaaagatg

SEQ ID NO: 186016 - DNA, 103 bp, Artificial Sequence
  Synthetic Polynucleotide
taatacgactcactatagggcgcaccgtgccatcctcattgaacacctccaacagaggagaggaggtatgcaatgaggaaacctggcggcagcgcaaaagatg

SEQ ID NO: 186017 - DNA, 103 bp, Artificial Sequence
  Synthetic Polynucleotide
taatacgactcactataggggatgaagtagcgcaccgtgccatcctcattaacagaggagaaatgagatgggcacggtgaacctggcggcagcgcaaaagatg

SEQ ID NO: 186018 - DNA, 103 bp, Artificial Sequence
  Synthetic Polynucleotide
taatacgactcactatagggggctggcatcgatgaagtagcgcaccgtgcaacagaggagagcacggatggctacttcaaacctggcggcagcgcaaaagatg

SEQ ID NO: 186019 - DNA, 103 bp, Artificial Sequence
  Synthetic Polynucleotide
taatacgactcactatagggtggtcctcctggctggcatcgatgaagtagaacagaggagactacttatgcgatgccagaacctggcggcagcgcaaaagatg

SEQ ID NO: 186020 - DNA, 103 bp, Artificial Sequence
  Synthetic Polynucleotide
taatacgactcactatagggccagctccggtggtcctcctggctggcatcaacagaggagagatgccatgcaggaggacaacctggcggcagcgcaaaagatg

SEQ ID NO: 186021 - DNA, 103 bp, Artificial Sequence
  Synthetic Polynucleotide
taatacgactcactatagggtgtaggtcatccagctccggtggtcctcctaacagaggagaaggaggatgaccggagctaacctggcggcagcgcaaaagatg

SEQ ID NO: 186022 - DNA, 103 bp, Artificial Sequence
  Synthetic Polynucleotide
taatacgactcactataggggcacacttgatgtaggtcatccagctccggaacagaggagaccggagatggatgacctaaacctggcggcagcgcaaaagatg

SEQ ID NO: 186023 - DNA, 103 bp, Artificial Sequence
  Synthetic Polynucleotide
taatacgactcactatagggttcgttacgtgcacacttgatgtaggtcataacagaggagaatgaccatgatcaagtgtaacctggcggcagcgcaaaagatg

SEQ ID NO: 186024 - DNA, 103 bp, Artificial Sequence
  Synthetic Polynucleotide
taatacgactcactataggggcgccagtcccggcgccttcagcccggtctaacagaggagaagaccgatgtgaaggcgcaacctggcggcagcgcaaaagatg

SEQ ID NO: 186025 - DNA, 103 bp, Artificial Sequence
  Synthetic Polynucleotide
taatacgactcactatagggtctgctcctgttcgttacgtgcacacttgaaacagaggagatcaagtatgcacgtaacgaacctggcggcagcgcaaaagatg

SEQ ID NO: 186026 - DNA, 103 bp, Artificial Sequence
  Synthetic Polynucleotide
taatacgactcactatagggacctccaggttctgctcctgttcgttacgtaacagaggagaacgtaaatgacaggagcaaacctggcggcagcgcaaaagatg

SEQ ID NO: 186027 - DNA, 103 bp, Artificial Sequence
  Synthetic Polynucleotide
taatacgactcactataggggatctggaccacctccaggttctgctcctgaacagaggagacaggagatgaacctggagaacctggcggcagcgcaaaagatg

SEQ ID NO: 186028 - DNA, 103 bp, Artificial Sequence
  Synthetic Polynucleotide
taatacgactcactatagggtgctggtgccgatctggaccacctccaggtaacagaggagaacctggatgtggtccagaaacctggcggcagcgcaaaagatg

SEQ ID NO: 186029 - DNA, 103 bp, Artificial Sequence
  Synthetic Polynucleotide
taatacgactcactatagggttgtagaagatgctggtgccgatctggaccaacagaggagaggtccaatgcggcaccagaacctggcggcagcgcaaaagatg

SEQ ID NO: 186030 - DNA, 103 bp, Artificial Sequence
  Synthetic Polynucleotide
taatacgactcactatagggctcaatggccttgtagaagatgctggtgccaacagaggagaggcaccatgatcttctacaacctggcggcagcgcaaaagatg

SEQ ID NO: 186031 - DNA, 103 bp, Artificial Sequence
  Synthetic Polynucleotide
taatacgactcactataggggtgggatcatctcaatggccttgtagaagaaacagaggagatcttctatgaggccattgaacctggcggcagcgcaaaagatg

SEQ ID NO: 186032 - DNA, 103 bp, Artificial Sequence
  Synthetic Polynucleotide
taatacgactcactatagggtcctggtcaggtgggatcatctcaatggccaacagaggagaggccatatggatgatcccaacctggcggcagcgcaaaagatg

SEQ ID NO: 186033 - DNA, 103 bp, Artificial Sequence
  Synthetic Polynucleotide
taatacgactcactatagggcaccagcagttcctggtcaggtgggatcataacagaggagaatgatcatgcctgaccagaacctggcggcagcgcaaaagatg

SEQ ID NO: 186034 - DNA, 103 bp, Artificial Sequence
  Synthetic Polynucleotide
taatacgactcactatagggttccgtaccacaccagcagttcctggtcagaacagaggagactgaccatgaactgctggaacctggcggcagcgcaaaagatg

SEQ ID NO: 186035 - DNA, 103 bp, Artificial Sequence
  Synthetic Polynucleotide
taatacgactcactatagggacctcggccagcgccagtcccggcgccttcaacagaggagagaaggcatggggactggcaacctggcggcagcgcaaaagatg

SEQ ID NO: 186036 - DNA, 103 bp, Artificial Sequence
  Synthetic Polynucleotide
taatacgactcactatagggttgtgtgagtttccgtaccacaccagcagtaacagaggagaactgctatggtggtacggaacctggcggcagcgcaaaagatg

SEQ ID NO: 186037 - DNA, 103 bp, Artificial Sequence
  Synthetic Polynucleotide
taatacgactcactatagggcaggaaggtgttgtgtgagtttccgtaccaaacagaggagatggtacatgaactcacacaacctggcggcagcgcaaaagatg

SEQ ID NO: 186038 - DNA, 103 bp, Artificial Sequence
  Synthetic Polynucleotide
taatacgactcactatagggctgggatccccaggaaggtgttgtgtgagtaacagaggagaactcacatgacaccttccaacctggcggcagcgcaaaagatg

SEQ ID NO: 186039 - DNA, 103 bp, Artificial Sequence
  Synthetic Polynucleotide
taatacgactcactatagggccgggcacacctgggatccccaggaaggtgaacagaggagacaccttatgggggatcccaacctggcggcagcgcaaaagatg

SEQ ID NO: 186040 - DNA, 103 bp, Artificial Sequence
  Synthetic Polynucleotide
taatacgactcactatagggctcctctagcccgggcacacctgggatcccaacagaggagagggatcatgggtgtgcccaacctggcggcagcgcaaaagatg

SEQ ID NO: 186041 - DNA, 103 bp, Artificial Sequence
  Synthetic Polynucleotide
taatacgactcactatagggttttctggtcctcctctagcccgggcacacaacagaggagagtgtgcatgggctagaggaacctggcggcagcgcaaaagatg

SEQ ID NO: 186042 - DNA, 103 bp, Artificial Sequence
  Synthetic Polynucleotide
taatacgactcactatagggtgcttgttctttttctggtcctcctctagcaacagaggagagctagaatgggaccagaaaacctggcggcagcgcaaaagatg

SEQ ID NO: 186043 - DNA, 103 bp, Artificial Sequence
  Synthetic Polynucleotide
taatacgactcactataggggaagtcctcatgcttgttctttttctggtcaacagaggagagaccagatgaagaacaagaacctggcggcagcgcaaaagatg

SEQ ID NO: 186044 - DNA, 103 bp, Artificial Sequence
  Synthetic Polynucleotide
taatacgactcactatagggccgccgggtggaagtcctcatgcttgttctaacagaggagaagaacaatgatgaggactaacctggcggcagcgcaaaagatg

SEQ ID NO: 186045 - DNA, 103 bp, Artificial Sequence
  Synthetic Polynucleotide
taatacgactcactataggggccgccgagtccgccgggtggaagtcctcaaacagaggagatgaggaatgccacccggcaacctggcggcagcgcaaaagatg

SEQ ID NO: 186046 - DNA, 103 bp, Artificial Sequence
  Synthetic Polynucleotide
taatacgactcactatagggggaggtgataacctcggccagcgccagtccaacagaggagaggactgatgctggccgagaacctggcggcagcgcaaaagatg

SEQ ID NO: 186047 - DNA, 103 bp, Artificial Sequence
  Synthetic Polynucleotide
taatacgactcactatagggcgcggggccagccgccgagtccgccgggtgaacagaggagacacccgatggactcggcgaacctggcggcagcgcaaaagatg

SEQ ID NO: 186048 - DNA, 103 bp, Artificial Sequence
  Synthetic Polynucleotide
taatacgactcactataggggcatgcggcccgcggggccagccgccgagtaacagaggagaactcggatgctggccccgaacctggcggcagcgcaaaagatg

SEQ ID NO: 186049 - DNA, 103 bp, Artificial Sequence
  Synthetic Polynucleotide
taatacgactcactatagggatgacgcatcgcatgcggcccgcggggccaaacagaggagatggcccatggggccgcataacctggcggcagcgcaaaagatg

SEQ ID NO: 186050 - DNA, 103 bp, Artificial Sequence
  Synthetic Polynucleotide
taatacgactcactataggggcggtggcagatgacgcatcgcatgcggccaacagaggagaggccgcatgcgatgcgtcaacctggcggcagcgcaaaagatg

SEQ ID NO: 186051 - DNA, 103 bp, Artificial Sequence
  Synthetic Polynucleotide
taatacgactcactatagggagttgaagccgcggtggcagatgacgcatcaacagaggagagatgcgatgtctgccaccaacctggcggcagcgcaaaagatg

SEQ ID NO: 186052 - DNA, 103 bp, Artificial Sequence
  Synthetic Polynucleotide
taatacgactcactatagggttgctgcgcgagttgaagccgcggtggcagaacagaggagactgccaatgcggcttcaaaacctggcggcagcgcaaaagatg

SEQ ID NO: 186053 - DNA, 103 bp, Artificial Sequence
  Synthetic Polynucleotide
taatacgactcactatagggcgagcgcaggttgctgcgcgagttgaagccaacagaggagaggcttcatgtcgcgcagcaacctggcggcagcgcaaaagatg

SEQ ID NO: 186054 - DNA, 103 bp, Artificial Sequence
  Synthetic Polynucleotide
taatacgactcactatagggtgcgcatgtgcgagcgcaggttgctgcgcgaacagaggagacgcgcaatgacctgcgctaacctggcggcagcgcaaaagatg

SEQ ID NO: 186055 - DNA, 103 bp, Artificial Sequence
  Synthetic Polynucleotide
taatacgactcactatagggagcgtgtggatgcgcatgtgcgagcgcaggaacagaggagacctgcgatggcacatgcgaacctggcggcagcgcaaaagatg

SEQ ID NO: 186056 - DNA, 103 bp, Artificial Sequence
  Synthetic Polynucleotide
taatacgactcactataggggggcttgtccagcgtgtggatgcgcatgtgaacagaggagacacatgatgatccacacgaacctggcggcagcgcaaaagatg

SEQ ID NO: 186057 - DNA, 103 bp, Artificial Sequence
  Synthetic Polynucleotide
taatacgactcactataggggcaggatgtcggaggtgataacctcggccaaacagaggagatggccgatgttatcacctaacctggcggcagcgcaaaagatg

SEQ ID NO: 186058 - DNA, 103 bp, Artificial Sequence
  Synthetic Polynucleotide
taatacgactcactatagggggcacacgaagggcttgtccagcgtgtggaaacagaggagatccacaatgtggacaagcaacctggcggcagcgcaaaagatg

SEQ ID NO: 186059 - DNA, 103 bp, Artificial Sequence
  Synthetic Polynucleotide
taatacgactcactatagggttgcagaagcggcacacgaagggcttgtccaacagaggagaggacaaatgcttcgtgtgaacctggcggcagcgcaaaagatg

SEQ ID NO: 186060 - DNA, 103 bp, Artificial Sequence
  Synthetic Polynucleotide
taatacgactcactataggggaagcggcggttgcagaagcggcacacgaaaacagaggagattcgtgatgcgcttctgcaacctggcggcagcgcaaaagatg

SEQ ID NO: 186061 - DNA, 103 bp, Artificial Sequence
  Synthetic Polynucleotide
taatacgactcactatagggacgactggctgaagcggcggttgcagaagcaacagaggagagcttctatgaccgccgctaacctggcggcagcgcaaaagatg

SEQ ID NO: 186062 - DNA, 103 bp, Artificial Sequence
  Synthetic Polynucleotide
taatacgactcactatagggcgcagcgtggacgactggctgaagcggcggaacagaggagaccgccgatgcagccagtcaacctggcggcagcgcaaaagatg

SEQ ID NO: 186063 - DNA, 103 bp, Artificial Sequence
  Synthetic Polynucleotide
taatacgactcactatagggcacgtggttgcgcagcgtggacgactggctaacagaggagaagccagatgtccacgctgaacctggcggcagcgcaaaagatg

SEQ ID NO: 186064 - DNA, 103 bp, Artificial Sequence
  Synthetic Polynucleotide
taatacgactcactatagggtgtgcaggcgcacgtggttgcgcagcgtggaacagaggagaccacgcatggcaaccacgaacctggcggcagcgcaaaagatg

SEQ ID NO: 186065 - DNA, 103 bp, Artificial Sequence
  Synthetic Polynucleotide
taatacgactcactatagggcgctcgcccgtgtgcaggcgcacgtggttgaacagaggagacaaccaatggcgcctgcaaacctggcggcagcgcaaaagatg

SEQ ID NO: 186066 - DNA, 103 bp, Artificial Sequence
  Synthetic Polynucleotide
taatacgactcactatagggcttgtaggggcgctcgcccgtgtgcaggcgaacagaggagacgcctgatgacgggcgagaacctggcggcagcgcaaaagatg

SEQ ID NO: 186067 - DNA, 103 bp, Artificial Sequence
  Synthetic Polynucleotide
taatacgactcactatagggacacctggcacttgtaggggcgctcgcccgaacagaggagacgggcgatggcccctacaaacctggcggcagcgcaaaagatg

SEQ ID NO: 186068 - DNA, 103 bp, Artificial Sequence
  Synthetic Polynucleotide
taatacgactcactatagggaggaagctgtgcaggatgtcggaggtgataaacagaggagatatcacatgcgacatcctaacctggcggcagcgcaaaagatg

SEQ ID NO: 186069 - DNA, 103 bp, Artificial Sequence
  Synthetic Polynucleotide
taatacgactcactataggggcgctctggcacacctggcacttgtaggggaacagaggagacccctaatggtgccaggtaacctggcggcagcgcaaaagatg

SEQ ID NO: 186070 - DNA, 103 bp, Artificial Sequence
  Synthetic Polynucleotide
taatacgactcactatagggctgcgagtaggcgctctggcacacctggcaaacagaggagatgccagatgtgccagagcaacctggcggcagcgcaaaagatg

SEQ ID NO: 186071 - DNA, 103 bp, Artificial Sequence
  Synthetic Polynucleotide
taatacgactcactatagggggccggccagctgcgagtaggcgctctggcaacagaggagagccagaatgcctactcgcaacctggcggcagcgcaaaagatg

SEQ ID NO: 186072 - DNA, 103 bp, Artificial Sequence
  Synthetic Polynucleotide
taatacgactcactatagggtgggcgcgcaggccggccagctgcgagtagaacagaggagactactcatggctggccggaacctggcggcagcgcaaaagatg

SEQ ID NO: 186073 - DNA, 103 bp, Artificial Sequence
  Synthetic Polynucleotide
taatacgactcactataggggctcttctggtgggcgcgcaggccggccagaacagaggagactggccatgctgcgcgccaacctggcggcagcgcaaaagatg

SEQ ID NO: 186074 - DNA, 103 bp, Artificial Sequence
  Synthetic Polynucleotide
taatacgactcactatagggggtgccgcgcgctcttctggtgggcgcgcaaacagaggagatgcgcgatgaccagaagaaacctggcggcagcgcaaaagatg

SEQ ID NO: 186075 - DNA, 103 bp, Artificial Sequence
  Synthetic Polynucleotide
taatacgactcactatagggctgggcggccggtgccgcgcgctcttctggaacagaggagaccagaaatgcgcgcggcaaacctggcggcagcgcaaaagatg

SEQ ID NO: 186076 - DNA, 103 bp, Artificial Sequence
  Synthetic Polynucleotide
taatacgactcactatagggcagcgcggtgctgggcggccggtgccgcgcaacagaggagagcgcggatgcggccgcccaacctggcggcagcgcaaaagatg

SEQ ID NO: 186077 - DNA, 103 bp, Artificial Sequence
  Synthetic Polynucleotide
taatacgactcactatagggagtgtgcctgcagcgcggtgctgggcggccaacagaggagaggccgcatggcaccgcgcaacctggcggcagcgcaaaagatg

SEQ ID NO: 186078 - DNA, 103 bp, Artificial Sequence
  Synthetic Polynucleotide
taatacgactcactatagggagcgcgggcgagtgtgcctgcagcgcggtgaacagaggagacaccgcatggcaggcacaaacctggcggcagcgcaaaagatg

SEQ ID NO: 186079 - DNA, 103 bp, Artificial Sequence
  Synthetic Polynucleotide
taatacgactcactatagggggtggctggcgctctggcggctccgtgcataacagaggagaatgcacatggccgccagaaacctggcggcagcgcaaaagatg

SEQ ID NO: 186080 - DNA, 103 bp, Artificial Sequence
  Synthetic Polynucleotide
taatacgactcactataggggcggtctgacaggtacttgcccagcttgaaaacagaggagattcaagatgggcaagtacaacctggcggcagcgcaaaagatg

SEQ ID NO: 186081 - DNA, 103 bp, Artificial Sequence
  Synthetic Polynucleotide
taatacgactcactatagggcccggggcgcccgcacgcccggcccccgccaacagaggagaggcgggatgcgggcgtgcaacctggcggcagcgcaaaagatg

SEQ ID NO: 186082 - DNA, 103 bp, Artificial Sequence
  Synthetic Polynucleotide
taatacgactcactatagggtctccccgctcccggggcgcccgcacgcccaacagaggagagggcgtatgggcgccccgaacctggcggcagcgcaaaagatg

SEQ ID NO: 186083 - DNA, 103 bp, Artificial Sequence
  Synthetic Polynucleotide
taatacgactcactataggggccgccgagttctccccgctcccggggcgcaacagaggagagcgcccatggagcggggaaacctggcggcagcgcaaaagatg

SEQ ID NO: 186084 - DNA, 103 bp, Artificial Sequence
  Synthetic Polynucleotide
taatacgactcactatagggcgcgccgcccgccgccgagttctccccgctaacagaggagaagcgggatgaactcggcgaacctggcggcagcgcaaaagatg

SEQ ID NO: 186085 - DNA, 103 bp, Artificial Sequence
  Synthetic Polynucleotide
taatacgactcactatagggggtggtgacccgcgccgcccgccgccgagtaacagaggagaactcggatgcgggcggcgaacctggcggcagcgcaaaagatg

SEQ ID NO: 186086 - DNA, 103 bp, Artificial Sequence
  Synthetic Polynucleotide
taatacgactcactatagggtggtggtgatggtggtgacccgcgccgcccaacagaggagagggcggatggggtcaccaaacctggcggcagcgcaaaagatg

SEQ ID NO: 186087 - DNA, 103 bp, Artificial Sequence
  Synthetic Polynucleotide
taatacgactcactataggggtggtgcgcgtggtggtgatggtggtgaccaacagaggagaggtcacatgcatcaccacaacctggcggcagcgcaaaagatg

SEQ ID NO: 186088 - DNA, 103 bp, Artificial Sequence
  Synthetic Polynucleotide
taatacgactcactataggggatggtggtggtggtgcgcgtggtggtgataacagaggagaatcaccatgacgcgcaccaacctggcggcagcgcaaaagatg

SEQ ID NO: 186089 - DNA, 103 bp, Artificial Sequence
  Synthetic Polynucleotide
taatacgactcactatagggaggcacttgggatggtggtggtggtgcgcgaacagaggagacgcgcaatgccaccaccaaacctggcggcagcgcaaaagatg

SEQ ID NO: 186090 - DNA, 103 bp, Artificial Sequence
  Synthetic Polynucleotide
taatacgactcactatagggcccagcgagcaggcacttgggatggtggtgaacagaggagacaccacatgcccaagtgcaacctggcggcagcgcaaaagatg

SEQ ID NO: 186091 - DNA, 103 bp, Artificial Sequence
  Synthetic Polynucleotide
taatacgactcactatagggcgggctccctgcggtctgacaggtacttgcaacagaggagagcaagtatgtgtcagaccaacctggcggcagcgcaaaagatg

SEQ ID NO: 186092 - DNA, 103 bp, Artificial Sequence
  Synthetic Polynucleotide
taatacgactcactataggggcggcgggtccccagcgagcaggcacttggaacagaggagaccaagtatgtgctcgctgaacctggcggcagcgcaaaagatg

SEQ ID NO: 186093 - DNA, 103 bp, Artificial Sequence
  Synthetic Polynucleotide
taatacgactcactatagggggcggcggcggcggcgggtccccagcgagcaacagaggagagctcgcatgggacccgccaacctggcggcagcgcaaaagatg

SEQ ID NO: 186094 - DNA, 103 bp, Artificial Sequence
  Synthetic Polynucleotide
taatacgactcactatagggcaggccaggcggcggcggcggcggcgggtcaacagaggagagacccgatgccgccgccgaacctggcggcagcgcaaaagatg

SEQ ID NO: 186095 - DNA, 103 bp, Artificial Sequence
  Synthetic Polynucleotide
taatacgactcactatagggcagagcagggcaggccaggcggcggcggcgaacagaggagacgccgcatgcgcctggccaacctggcggcagcgcaaaagatg

SEQ ID NO: 186096 - DNA, 103 bp, Artificial Sequence
  Synthetic Polynucleotide
taatacgactcactatagggcgcagggccccagagcagggcaggccaggcaacagaggagagcctggatggccctgctcaacctggcggcagcgcaaaagatg

SEQ ID NO: 186097 - DNA, 103 bp, Artificial Sequence
  Synthetic Polynucleotide
taatacgactcactatagggagggaagccgcgcagggccccagagcagggaacagaggagaccctgcatgggggccctgaacctggcggcagcgcaaaagatg

SEQ ID NO: 186098 - DNA, 103 bp, Artificial Sequence
  Synthetic Polynucleotide
taatacgactcactatagggcggagagcagagggaagccgcgcagggcccaacagaggagagggcccatggcggcttccaacctggcggcagcgcaaaagatg

SEQ ID NO: 186099 - DNA, 103 bp, Artificial Sequence
  Synthetic Polynucleotide
taatacgactcactatagggtccggggggacggagagcagagggaagccgaacagaggagacggcttatgtctgctctcaacctggcggcagcgcaaaagatg

SEQ ID NO: 186100 - DNA, 103 bp, Artificial Sequence
  Synthetic Polynucleotide
taatacgactcactatagggggacgcctcttccggggggacggagagcagaacagaggagactgctcatggtccccccgaacctggcggcagcgcaaaagatg

SEQ ID NO: 186101 - DNA, 103 bp, Artificial Sequence
  Synthetic Polynucleotide
taatacgactcactataggggcttgaaggcggacgcctcttccggggggaaacagaggagatcccccatgaagaggcgtaacctggcggcagcgcaaaagatg

SEQ ID NO: 186102 - DNA, 103 bp, Artificial Sequence
  Synthetic Polynucleotide
taatacgactcactatagggttcttaggcccgggctccctgcggtctgacaacagaggagagtcagaatgcagggagccaacctggcggcagcgcaaaagatg

SEQ ID NO: 186103 - DNA, 103 bp, Artificial Sequence
  Synthetic Polynucleotide
taatacgactcactatagggcgctccacgtgcttgaaggcggacgcctctaacagaggagaagaggcatgcgccttcaaaacctggcggcagcgcaaaagatg

SEQ ID NO: 186104 - DNA, 103 bp, Artificial Sequence
  Synthetic Polynucleotide
taatacgactcactataggggggcggggcgcgctccacgtgcttgaaggcaacagaggagagccttcatgcacgtggagaacctggcggcagcgcaaaagatg

SEQ ID NO: 186105 - DNA, 103 bp, Artificial Sequence
  Synthetic Polynucleotide
taatacgactcactatagggcggcggctgcgggcggggcgcgctccacgtaacagaggagaacgtggatggcgccccgcaacctggcggcagcgcaaaagatg

SEQ ID NO: 186106 - DNA, 103 bp, Artificial Sequence
  Synthetic Polynucleotide
taatacgactcactatagggcctggcagcgcggcggctgcgggcggggcgaacagaggagacgccccatgcgcagccgcaacctggcggcagcgcaaaagatg

SEQ ID NO: 186107 - DNA, 103 bp, Artificial Sequence
  Synthetic Polynucleotide
taatacgactcactatagggataacgcgctcctggcagcgcggcggctgcaacagaggagagcagccatggcgctgccaaacctggcggcagcgcaaaagatg

SEQ ID NO: 186108 - DNA, 103 bp, Artificial Sequence
  Synthetic Polynucleotide
taatacgactcactataggggcagctgcgcataacgcgctcctggcagcgaacagaggagacgctgcatggagcgcgttaacctggcggcagcgcaaaagatg

SEQ ID NO: 186109 - DNA, 103 bp, Artificial Sequence
  Synthetic Polynucleotide
taatacgactcactatagggggcgcagggggcagctgcgcataacgcgctaacagaggagaagcgcgatgtgcgcagctaacctggcggcagcgcaaaagatg

SEQ ID NO: 186110 - DNA, 103 bp, Artificial Sequence
  Synthetic Polynucleotide
taatacgactcactataggggggcaaccccggcgcagggggcagctgcgcaacagaggagagcgcagatgccccctgcgaacctggcggcagcgcaaaagatg

SEQ ID NO: 186111 - DNA, 103 bp, Artificial Sequence
  Synthetic Polynucleotide
taatacgactcactatagggagcgctcgaggggcaaccccggcgcaggggaacagaggagacccctgatgcggggttgcaacctggcggcagcgcaaaagatg

SEQ ID NO: 186112 - DNA, 103 bp, Artificial Sequence
  Synthetic Polynucleotide
taatacgactcactatagggggcagcgcgcagcgctcgaggggcaaccccaacagaggagaggggttatgcctcgagcgaacctggcggcagcgcaaaagatg

SEQ ID NO: 186113 - DNA, 103 bp, Artificial Sequence
  Synthetic Polynucleotide
taatacgactcactataggggcgcacctttttcttaggcccgggctccctaacagaggagaagggagatggggcctaagaacctggcggcagcgcaaaagatg

SEQ ID NO: 186114 - DNA, 103 bp, Artificial Sequence
  Synthetic Polynucleotide
taatacgactcactataggggtcgaggggcggcagcgcgcagcgctcgagaacagaggagactcgagatgtgcgcgctgaacctggcggcagcgcaaaagatg

SEQ ID NO: 186115 - DNA, 103 bp, Artificial Sequence
  Synthetic Polynucleotide
taatacgactcactataggggaccgcccgggtcgaggggcggcagcgcgcaacagaggagagcgcgcatgcgcccctcgaacctggcggcagcgcaaaagatg

SEQ ID NO: 186116 - DNA, 103 bp, Artificial Sequence
  Synthetic Polynucleotide
taatacgactcactatagggtaggctttgagaccgcccgggtcgaggggcaacagaggagagcccctatgcccgggcggaacctggcggcagcgcaaaagatg

SEQ ID NO: 186117 - DNA, 103 bp, Artificial Sequence
  Synthetic Polynucleotide
taatacgactcactatagggaccacccggataggctttgagaccgcccggaacagaggagaccgggcatgctcaaagccaacctggcggcagcgcaaaagatg

SEQ ID NO: 186118 - DNA, 103 bp, Artificial Sequence
  Synthetic Polynucleotide
taatacgactcactatagggggctgcactcaccacccggataggctttgaaacagaggagatcaaagatgatccgggtgaacctggcggcagcgcaaaagatg

SEQ ID NO: 186119 - DNA, 103 bp, Artificial Sequence
  Synthetic Polynucleotide
taatacgactcactataggggcgggcaggtggctgcactcaccacccggaaacagaggagatccgggatgtgagtgcagaacctggcggcagcgcaaaagatg

SEQ ID NO: 186120 - DNA, 103 bp, Artificial Sequence
  Synthetic Polynucleotide
taatacgactcactatagggcggcatgacggcgggcaggtggctgcactcaacagaggagagagtgcatgcacctgcccaacctggcggcagcgcaaaagatg

SEQ ID NO: 186121 - DNA, 103 bp, Artificial Sequence
  Synthetic Polynucleotide
taatacgactcactatagggctgtaaaggccggcatgacggcgggcaggtaacagaggagaacctgcatgccgtcatgcaacctggcggcagcgcaaaagatg

SEQ ID NO: 186122 - DNA, 103 bp, Artificial Sequence
  Synthetic Polynucleotide
taatacgactcactatagggccgttgtagactgtaaaggccggcatgacgaacagaggagacgtcatatgggcctttacaacctggcggcagcgcaaaagatg

SEQ ID NO: 186123 - DNA, 103 bp, Artificial Sequence
  Synthetic Polynucleotide
taatacgactcactataggggagcagctccccgttgtagactgtaaaggcaacagaggagagcctttatggtctacaacaacctggcggcagcgcaaaagatg

SEQ ID NO: 186124 - DNA, 103 bp, Artificial Sequence
  Synthetic Polynucleotide
taatacgactcactatagggctctcaccatgcgcacctttttcttaggccaacagaggagaggcctaatgaaaaggtgcaacctggcggcagcgcaaaagatg

SEQ ID NO: 186125 - DNA, 103 bp, Artificial Sequence
  Synthetic Polynucleotide
taatacgactcactataggggtgagccgtagagcagctccccgttgtagaaacagaggagatctacaatggggagctgcaacctggcggcagcgcaaaagatg

SEQ ID NO: 186126 - DNA, 103 bp, Artificial Sequence
  Synthetic Polynucleotide
taatacgactcactataggggtggtggccggtgagccgtagagcagctccaacagaggagaggagctatgctacggctcaacctggcggcagcgcaaaagatg

SEQ ID NO: 186127 - DNA, 103 bp, Artificial Sequence
  Synthetic Polynucleotide
taatacgactcactataggggtaataagcggtggtggccggtgagccgtaaacagaggagatacggcatgccggccaccaacctggcggcagcgcaaaagatg

SEQ ID NO: 186128 - DNA, 103 bp, Artificial Sequence
  Synthetic Polynucleotide
taatacgactcactatagggatttgagcgggtaataagcggtggtggccgaacagaggagacggccaatgccgcttattaacctggcggcagcgcaaaagatg

SEQ ID NO: 186129 - DNA, 103 bp, Artificial Sequence
  Synthetic Polynucleotide
taatacgactcactatagggccgaagtgcaatttgagcgggtaataagcgaacagaggagacgcttaatgcccgctcaaaacctggcggcagcgcaaaagatg

SEQ ID NO: 186130 - DNA, 103 bp, Artificial Sequence
  Synthetic Polynucleotide
taatacgactcactatagggcagcagcccgccgaagtgcaatttgagcggaacagaggagaccgctcatgttgcacttcaacctggcggcagcgcaaaagatg

SEQ ID NO: 186131 - DNA, 103 bp, Artificial Sequence
  Synthetic Polynucleotide
taatacgactcactatagggccggatacttcagcagcccgccgaagtgcaaacagaggagatgcactatggcgggctgcaacctggcggcagcgcaaaagatg

SEQ ID NO: 186132 - DNA, 103 bp, Artificial Sequence
  Synthetic Polynucleotide
taatacgactcactataggggagatggactccggatacttcagcagcccgaacagaggagacgggctatggaagtatccaacctggcggcagcgcaaaagatg

SEQ ID NO: 186133 - DNA, 103 bp, Artificial Sequence
  Synthetic Polynucleotide
taatacgactcactataggggctgaagtaggagatggactccggatacttaacagaggagaaagtatatggagtccatcaacctggcggcagcgcaaaagatg

SEQ ID NO: 186134 - DNA, 103 bp, Artificial Sequence
  Synthetic Polynucleotide
taatacgactcactatagggctgcaggcccgctgaagtaggagatggactaacagaggagaagtccaatgcctacttcaaacctggcggcagcgcaaaagatg

SEQ ID NO: 186135 - DNA, 103 bp, Artificial Sequence
  Synthetic Polynucleotide
taatacgactcactatagggaccagctcccctctcaccatgcgcacctttaacagaggagaaaaggtatgcatggtgagaacctggcggcagcgcaaaagatg

SEQ ID NO: 186136 - DNA, 103 bp, Artificial Sequence
  Synthetic Polynucleotide
taatacgactcactatagggagggcggccgctgcaggcccgctgaagtagaacagaggagactacttatgcgggcctgcaacctggcggcagcgcaaaagatg

SEQ ID NO: 186137 - DNA, 103 bp, Artificial Sequence
  Synthetic Polynucleotide
taatacgactcactatagggggcggggcttagggcggccgctgcaggcccaacagaggagagggcctatggcggccgccaacctggcggcagcgcaaaagatg

SEQ ID NO: 186138 - DNA, 103 bp, Artificial Sequence
  Synthetic Polynucleotide
taatacgactcactatagggaccccagctcggcggggcttagggcggccgaacagaggagacggccgatgtaagccccgaacctggcggcagcgcaaaagatg

SEQ ID NO: 186139 - DNA, 103 bp, Artificial Sequence
  Synthetic Polynucleotide
taatacgactcactatagggctggccagcgaccccagctcggcggggcttaacagaggagaaagcccatgcgagctgggaacctggcggcagcgcaaaagatg

SEQ ID NO: 186140 - DNA, 103 bp, Artificial Sequence
  Synthetic Polynucleotide
taatacgactcactatagggtcggtcgatgctggccagcgaccccagctcaacagaggagagagctgatgtcgctggccaacctggcggcagcgcaaaagatg

SEQ ID NO: 186141 - DNA, 103 bp, Artificial Sequence
  Synthetic Polynucleotide
taatacgactcactatagggtggcgatctctcggtcgatgctggccagcgaacagaggagacgctggatggcatcgaccaacctggcggcagcgcaaaagatg

SEQ ID NO: 186142 - DNA, 103 bp, Artificial Sequence
  Synthetic Polynucleotide
taatacgactcactatagggtgattgtgcatggcgatctctcggtcgatgaacagaggagacatcgaatgagagatcgcaacctggcggcagcgcaaaagatg

SEQ ID NO: 186143 - DNA, 103 bp, Artificial Sequence
  Synthetic Polynucleotide
taatacgactcactatagggggacagctgctgattgtgcatggcgatctcaacagaggagagagatcatgatgcacaataacctggcggcagcgcaaaagatg

SEQ ID NO: 186144 - DNA, 103 bp, Artificial Sequence
  Synthetic Polynucleotide
taatacgactcactatagggcagccatctcggacagctgctgattgtgcaaacagaggagatgcacaatgagcagctgtaacctggcggcagcgcaaaagatg

SEQ ID NO: 186145 - DNA, 103 bp, Artificial Sequence
  Synthetic Polynucleotide
taatacgactcactatagggcccttcccggcagccatctcggacagctgcaacagaggagagcagctatgcgagatggcaacctggcggcagcgcaaaagatg

SEQ ID NO: 186146 - DNA, 103 bp, Artificial Sequence
  Synthetic Polynucleotide
taatacgactcactatagggcgactcgtccaccagctcccctctcaccataacagaggagaatggtgatgggggagctgaacctggcggcagcgcaaaagatg

SEQ ID NO: 186147 - DNA, 103 bp, Artificial Sequence
  Synthetic Polynucleotide
taatacgactcactataggggcgtccgcgacccttcccggcagccatctcaacagaggagagagatgatggccgggaagaacctggcggcagcgcaaaagatg

SEQ ID NO: 186148 - DNA, 103 bp, Artificial Sequence
  Synthetic Polynucleotide
taatacgactcactatagggccgagtccaggcgtccgcgacccttcccggaacagaggagaccgggaatggtcgcggacaacctggcggcagcgcaaaagatg

SEQ ID NO: 186149 - DNA, 103 bp, Artificial Sequence
  Synthetic Polynucleotide
taatacgactcactatagggggcaacgtccccgagtccaggcgtccgcgaaacagaggagatcgcggatgcctggactcaacctggcggcagcgcaaaagatg

SEQ ID NO: 186150 - DNA, 103 bp, Artificial Sequence
  Synthetic Polynucleotide
taatacgactcactataggggacggccggtggcaacgtccccgagtccagaacagaggagactggacatggggacgttgaacctggcggcagcgcaaaagatg

SEQ ID NO: 186151 - DNA, 103 bp, Artificial Sequence
  Synthetic Polynucleotide
taatacgactcactatagggccgccgccgcgacggccggtggcaacgtccaacagaggagaggacgtatgcaccggccgaacctggcggcagcgcaaaagatg

SEQ ID NO: 186152 - DNA, 103 bp, Artificial Sequence
  Synthetic Polynucleotide
taatacgactcactatagggccggtgcctcccgccgccgcgacggccggtaacagaggagaaccggcatgcgcggcggcaacctggcggcagcgcaaaagatg

SEQ ID NO: 186153 - DNA, 103 bp, Artificial Sequence
  Synthetic Polynucleotide
taatacgactcactataggggccgccgcccccggtgcctcccgccgccgcaacagaggagagcggcgatgggaggcaccaacctggcggcagcgcaaaagatg

SEQ ID NO: 186154 - DNA, 103 bp, Artificial Sequence
  Synthetic Polynucleotide
taatacgactcactatagggtgcctccgctgccgccgcccccggtgcctcaacagaggagagaggcaatgggggcggcgaacctggcggcagcgcaaaagatg

SEQ ID NO: 186155 - DNA, 103 bp, Artificial Sequence
  Synthetic Polynucleotide
taatacgactcactatagggcctgcgccgctgcctccgctgccgccgcccaacagaggagagggcggatgcagcggaggaacctggcggcagcgcaaaagatg

SEQ ID NO: 186156 - DNA, 103 bp, Artificial Sequence
  Synthetic Polynucleotide
taatacgactcactatagggcttgggcttacctgcgccgctgcctccgctaacagaggagaagcggaatgagcggcgcaaacctggcggcagcgcaaaagatg

SEQ ID NO: 186157 - DNA, 103 bp, Artificial Sequence
  Synthetic Polynucleotide
taatacgactcactataggggggagccccccgactcgtccaccagctcccaacagaggagagggagcatgtggacgagtaacctggcggcagcgcaaaagatg

SEQ ID NO: 186158 - DNA, 103 bp, Artificial Sequence
  Synthetic Polynucleotide
taatacgactcactatagggggtggccggtcttgggcttacctgcgccgcaacagaggagagcggcgatggtaagcccaaacctggcggcagcgcaaaagatg

SEQ ID NO: 186159 - DNA, 103 bp, Artificial Sequence
  Synthetic Polynucleotide
taatacgactcactatagggtagaggcacaggtggccggtcttgggcttaaacagaggagataagccatggaccggccaaacctggcggcagcgcaaaagatg

SEQ ID NO: 186160 - DNA, 103 bp, Artificial Sequence
  Synthetic Polynucleotide
taatacgactcactatagggcttgccacagtagaggcacaggtggccggtaacagaggagaaccggcatgctgtgcctcaacctggcggcagcgcaaaagatg

SEQ ID NO: 186161 - DNA, 103 bp, Artificial Sequence
  Synthetic Polynucleotide
taatacgactcactataggggcgagtacagcttgccacagtagaggcacaaacagaggagatgtgccatgactgtggcaaacctggcggcagcgcaaaagatg

SEQ ID NO: 186162 - DNA, 103 bp, Artificial Sequence
  Synthetic Polynucleotide
taatacgactcactatagggccatacttgcgcgagtacagcttgccacagaacagaggagactgtggatggctgtactcaacctggcggcagcgcaaaagatg

SEQ ID NO: 186163 - DNA, 103 bp, Artificial Sequence
  Synthetic Polynucleotide
taatacgactcactataggggatcttgagcccatacttgcgcgagtacagaacagaggagactgtacatgcgcaagtataacctggcggcagcgcaaaagatg

SEQ ID NO: 186164 - DNA, 103 bp, Artificial Sequence
  Synthetic Polynucleotide
taatacgactcactatagggtccgcatgtggatcttgagcccatacttgcaacagaggagagcaagtatgggctcaagaaacctggcggcagcgcaaaagatg

SEQ ID NO: 186165 - DNA, 103 bp, Artificial Sequence
  Synthetic Polynucleotide
taatacgactcactatagggcccgtgtgcgtccgcatgtggatcttgagcaacagaggagagctcaaatgccacatgcgaacctggcggcagcgcaaaagatg

SEQ ID NO: 186166 - DNA, 103 bp, Artificial Sequence
  Synthetic Polynucleotide
taatacgactcactatagggtggcttgtagcccgtgtgcgtccgcatgtgaacagaggagacacatgatgacgcacacgaacctggcggcagcgcaaaagatg

SEQ ID NO: 186167 - DNA, 103 bp, Artificial Sequence
  Synthetic Polynucleotide
taatacgactcactatagggtgcacttgagtggcttgtagcccgtgtgcgaacagaggagacgcacaatggctacaagcaacctggcggcagcgcaaaagatg

SEQ ID NO: 186168 - DNA, 103 bp, Artificial Sequence
  Synthetic Polynucleotide
taatacgactcactatagggcactccagaggggagccccccgactcgtccaacagaggagaggacgaatgggggggctcaacctggcggcagcgcaaaagatg

SEQ ID NO: 186169 - DNA, 103 bp, Artificial Sequence
  Synthetic Polynucleotide
taatacgactcactatagggagacagactttgcacttgagtggcttgtagaacagaggagactacaaatgactcaagtgaacctggcggcagcgcaaaagatg

SEQ ID NO: 186170 - DNA, 103 bp, Artificial Sequence
  Synthetic Polynucleotide
taatacgactcactataggggaagggccgcagacagactttgcacttgagaacagaggagactcaagatgaaagtctgtaacctggcggcagcgcaaaagatg

SEQ ID NO: 186171 - DNA, 103 bp, Artificial Sequence
  Synthetic Polynucleotide
taatacgactcactatagggtggggtcgccgaagggccgcagacagacttaacagaggagaaagtctatgtgcggccctaacctggcggcagcgcaaaagatg

SEQ ID NO: 186172 - DNA, 103 bp, Artificial Sequence
  Synthetic Polynucleotide
taatacgactcactatagggttgagattgctggggtcgccgaagggccgcaacagaggagagcggccatgcggcgacccaacctggcggcagcgcaaaagatg

SEQ ID NO: 186173 - DNA, 103 bp, Artificial Sequence
  Synthetic Polynucleotide
taatacgactcactataggggatgtgcttgttgagattgctggggtcgccaacagaggagaggcgacatgagcaatctcaacctggcggcagcgcaaaagatg

SEQ ID NO: 186174 - DNA, 103 bp, Artificial Sequence
  Synthetic Polynucleotide
taatacgactcactatagggcgtgcagccggatgtgcttgttgagattgcaacagaggagagcaatcatgacaagcacaaacctggcggcagcgcaaaagatg

SEQ ID NO: 186175 - DNA, 103 bp, Artificial Sequence
  Synthetic Polynucleotide
taatacgactcactatagggttgccctcggcgtgcagccggatgtgcttgaacagaggagacaagcaatgccggctgcaaacctggcggcagcgcaaaagatg

SEQ ID NO: 186176 - DNA, 103 bp, Artificial Sequence
  Synthetic Polynucleotide
taatacgactcactataggggtagggcgtattgccctcggcgtgcagccgaacagaggagacggctgatggccgagggcaacctggcggcagcgcaaaagatg

SEQ ID NO: 186177 - DNA, 103 bp, Artificial Sequence
  Synthetic Polynucleotide
taatacgactcactatagggactcgcagcggtagggcgtattgccctcggaacagaggagaccgaggatgatacgccctaacctggcggcagcgcaaaagatg

SEQ ID NO: 186178 - DNA, 103 bp, Artificial Sequence
  Synthetic Polynucleotide
taatacgactcactatagggttgccgcagaactcgcagcggtagggcgtaaacagaggagatacgccatgccgctgcgaaacctggcggcagcgcaaaagatg

SEQ ID NO: 186179 - DNA, 103 bp, Artificial Sequence
  Synthetic Polynucleotide
taatacgactcactatagggtaaccctatccactccagaggggagcccccaacagaggagagggggcatgcctctggagaacctggcggcagcgcaaaagatg

SEQ ID NO: 186180 - DNA, 103 bp, Artificial Sequence
  Synthetic Polynucleotide
taatacgactcactatagggcacaagtaccttgccgcagaactcgcagcgaacagaggagacgctgcatgttctgcggcaacctggcggcagcgcaaaagatg

SEQ ID NO: 186181 - DNA, 103 bp, Artificial Sequence
  Synthetic Polynucleotide
taatacgactcactatagggcccggcggcgcacaagtaccttgccgcagaaacagaggagatctgcgatgaggtacttgaacctggcggcagcgcaaaagatg

SEQ ID NO: 186182 - DNA, 103 bp, Artificial Sequence
  Synthetic Polynucleotide
taatacgactcactatagggcgctccaggtcccggcggcgcacaagtaccaacagaggagaggtactatggcgccgccgaacctggcggcagcgcaaaagatg

SEQ ID NO: 186183 - DNA, 103 bp, Artificial Sequence
  Synthetic Polynucleotide
taatacgactcactatagggcttgacatgtcgctccaggtcccggcggcgaacagaggagacgccgcatggacctggagaacctggcggcagcgcaaaagatg

SEQ ID NO: 186184 - DNA, 103 bp, Artificial Sequence
  Synthetic Polynucleotide
taatacgactcactatagggggtggcgggacttgacatgtcgctccaggtaacagaggagaacctggatggacatgtcaaacctggcggcagcgcaaaagatg

SEQ ID NO: 186185 - DNA, 103 bp, Artificial Sequence
  Synthetic Polynucleotide
taatacgactcactatagggctctggccagggtggcgggacttgacatgtaacagaggagaacatgtatggtcccgccaaacctggcggcagcgcaaaagatg

SEQ ID NO: 186186 - DNA, 103 bp, Artificial Sequence
  Synthetic Polynucleotide
taatacgactcactatagggggcgagcagactctggccagggtggcgggaaacagaggagatcccgcatgcctggccagaacctggcggcagcgcaaaagatg

SEQ ID NO: 186187 - DNA, 103 bp, Artificial Sequence
  Synthetic Polynucleotide
taatacgactcactatagggcgcccgctttggcgagcagactctggccagaacagaggagactggccatggtctgctcgaacctggcggcagcgcaaaagatg

SEQ ID NO: 186188 - DNA, 103 bp, Artificial Sequence
  Synthetic Polynucleotide
taatacgactcactatagggcccgggccgtcgcccgctttggcgagcagaaacagaggagatctgctatgcaaagcgggaacctggcggcagcgcaaaagatg

SEQ ID NO: 186189 - DNA, 103 bp, Artificial Sequence
  Synthetic Polynucleotide
taatacgactcactataggggggctcggcacccgggccgtcgcccgctttaacagaggagaaaagcgatggacggcccgaacctggcggcagcgcaaaagatg

SEQ ID NO: 186190 - DNA, 103 bp, Artificial Sequence
  Synthetic Polynucleotide
taatacgactcactatagggcactcacgctggtggctggcgctctggcggaacagaggagaccgccaatgcgccagccaaacctggcggcagcgcaaaagatg

SEQ ID NO: 186191 - DNA, 103 bp, Artificial Sequence
  Synthetic Polynucleotide
taatacgactcactatagggctgcccggattaaccctatccactccagagaacagaggagactctggatgggatagggtaacctggcggcagcgcaaaagatg

SEQ ID NO: 186192 - DNA, 103 bp, Artificial Sequence
  Synthetic Polynucleotide
taatacgactcactatagggggggatagccgggctcggcacccgggccgtaacagaggagaacggccatggtgccgagcaacctggcggcagcgcaaaagatg

SEQ ID NO: 186193 - DNA, 103 bp, Artificial Sequence
  Synthetic Polynucleotide
taatacgactcactatagggccaggctccgggggatagccgggctcggcaaacagaggagatgccgaatgcggctatccaacctggcggcagcgcaaaagatg

SEQ ID NO: 186194 - DNA, 103 bp, Artificial Sequence
  Synthetic Polynucleotide
taatacgactcactatagggcttgggatccccaggctccgggggatagccaacagaggagaggctatatgccggagcctaacctggcggcagcgcaaaagatg

SEQ ID NO: 186195 - DNA, 103 bp, Artificial Sequence
  Synthetic Polynucleotide
taatacgactcactatagggtgtcgtcgctcttgggatccccaggctccgaacagaggagacggagcatggggatcccaaacctggcggcagcgcaaaagatg

SEQ ID NO: 186196 - DNA, 103 bp, Artificial Sequence
  Synthetic Polynucleotide
taatacgactcactatagggtccacgtcactgtcgtcgctcttgggatccaacagaggagaggatccatggagcgacgaaacctggcggcagcgcaaaagatg

SEQ ID NO: 186197 - DNA, 103 bp, Artificial Sequence
  Synthetic Polynucleotide
taatacgactcactataggggaagcagacgtccacgtcactgtcgtcgctaacagaggagaagcgacatgagtgacgtgaacctggcggcagcgcaaaagatg

SEQ ID NO: 186198 - DNA, 103 bp, Artificial Sequence
  Synthetic Polynucleotide
taatacgactcactatagggggtcgtctgtgaagcagacgtccacgtcacaacagaggagagtgacgatgacgtctgctaacctggcggcagcgcaaaagatg

SEQ ID NO: 186199 - DNA, 103 bp, Artificial Sequence
  Synthetic Polynucleotide
taatacgactcactataggggggtcgctctggtcgtctgtgaagcagacgaacagaggagacgtctgatgcacagacgaaacctggcggcagcgcaaaagatg

SEQ ID NO: 186200 - DNA, 103 bp, Artificial Sequence
  Synthetic Polynucleotide
taatacgactcactatagggcccaacctcggggtcgctctggtcgtctgtaacagaggagaacagacatgcagagcgacaacctggcggcagcgcaaaagatg

SEQ ID NO: 186201 - DNA, 103 bp, Artificial Sequence
  Synthetic Polynucleotide
taatacgactcactatagggccccgccgcccccaacctcggggtcgctctaacagaggagaagagcgatgccgaggttgaacctggcggcagcgcaaaagatg

SEQ ID NO: 186202 - DNA, 103 bp, Artificial Sequence
  Synthetic Polynucleotide
taatacgactcactataggggagtttctggctgcccggattaaccctatcaacagaggagagataggatgaatccgggcaacctggcggcagcgcaaaagatg

SEQ ID NO: 186203 - DNA, 103 bp, Artificial Sequence
  Synthetic Polynucleotide
taatacgactcactatagggaagtcgcgctccccgccgcccccaacctcgaacagaggagacgaggtatggggcggcggaacctggcggcagcgcaaaagatg

SEQ ID NO: 186204 - DNA, 103 bp, Artificial Sequence
  Synthetic Polynucleotide
taatacgactcactatagggctgttcctgggagtttctggctgcccggataacagaggagaatccggatggccagaaacaacctggcggcagcgcaaaagatg

SEQ ID NO: 186205 - DNA, 103 bp, Artificial Sequence
  Synthetic Polynucleotide
taatacgactcactatagggcttccagagtctgttcctgggagtttctggaacagaggagaccagaaatgcccaggaacaacctggcggcagcgcaaaagatg

SEQ ID NO: 186206 - DNA, 103 bp, Artificial Sequence
  Synthetic Polynucleotide
taatacgactcactatagggtctgcaatagcttccagagtctgttcctggaacagaggagaccaggaatggactctggaaacctggcggcagcgcaaaagatg

SEQ ID NO: 186207 - DNA, 103 bp, Artificial Sequence
  Synthetic Polynucleotide
taatacgactcactatagggtccgggtaagtctgcaatagcttccagagtaacagaggagaactctgatggctattgcaaacctggcggcagcgcaaaagatg

SEQ ID NO: 186208 - DNA, 103 bp, Artificial Sequence
  Synthetic Polynucleotide
taatacgactcactatagggagatctgtcctccgggtaagtctgcaatagaacagaggagactattgatgacttacccgaacctggcggcagcgcaaaagatg

SEQ ID NO: 186209 - DNA, 103 bp, Artificial Sequence
  Synthetic Polynucleotide
taatacgactcactataggggctcggtagaagatctgtcctccgggtaagaacagaggagacttaccatgaggacagataacctggcggcagcgcaaaagatg

SEQ ID NO: 186210 - DNA, 103 bp, Artificial Sequence
  Synthetic Polynucleotide
taatacgactcactataggggtctcgcaatgctcggtagaagatctgtccaacagaggagaggacagatgttctaccgaaacctggcggcagcgcaaaagatg

SEQ ID NO: 186211 - DNA, 103 bp, Artificial Sequence
  Synthetic Polynucleotide
taatacgactcactatagggctggctggacgtctcgcaatgctcggtagaaacagaggagatctaccatgcattgcgagaacctggcggcagcgcaaaagatg

SEQ ID NO: 186212 - DNA, 103 bp, Artificial Sequence
  Synthetic Polynucleotide
taatacgactcactatagggcagcagtcggcactcacgctggtggctggcaacagaggagagccagcatgcagcgtgagaacctggcggcagcgcaaaagatg

SEQ ID NO: 186213 - DNA, 103 bp, Artificial Sequence
  Synthetic Polynucleotide
taatacgactcactatagggagctcctcccctggctggacgtctcgcaataacagaggagaattgcgatgcgtccagccaacctggcggcagcgcaaaagatg

SEQ ID NO: 186214 - DNA, 103 bp, Artificial Sequence
  Synthetic Polynucleotide
taatacgactcactatagggccacactgtcagctcctcccctggctggacaacagaggagagtccagatgggggaggagaacctggcggcagcgcaaaagatg

SEQ ID NO: 186215 - DNA, 103 bp, Artificial Sequence
  Synthetic Polynucleotide
taatacgactcactatagggagttagaataccacactgtcagctcctcccaacagaggagagggaggatgtgacagtgtaacctggcggcagcgcaaaagatg

SEQ ID NO: 186216 - DNA, 103 bp, Artificial Sequence
  Synthetic Polynucleotide
taatacgactcactatagggtgagccaaggagttagaataccacactgtcaacagaggagagacagtatggtattctaaaacctggcggcagcgcaaaagatg

SEQ ID NO: 186217 - DNA, 103 bp, Artificial Sequence
  Synthetic Polynucleotide
taatacgactcactataggggtcgaaccactgagccaaggagttagaataaacagaggagatattctatgtccttggctaacctggcggcagcgcaaaagatg

SEQ ID NO: 186218 - DNA, 103 bp, Artificial Sequence
  Synthetic Polynucleotide
taatacgactcactatagggtggtggggatgtcgaaccactgagccaaggaacagaggagaccttggatgagtggttcgaacctggcggcagcgcaaaagatg

SEQ ID NO: 186219 - DNA, 103 bp, Artificial Sequence
  Synthetic Polynucleotide
taatacgactcactatagggggagtcgctgtggtggggatgtcgaaccacaacagaggagagtggttatgcatccccacaacctggcggcagcgcaaaagatg

SEQ ID NO: 186220 - DNA, 103 bp, Artificial Sequence
  Synthetic Polynucleotide
taatacgactcactataggggtcgtgagtcggagtcgctgtggtggggataacagaggagaatccccatgacagcgactaacctggcggcagcgcaaaagatg

SEQ ID NO: 186221 - DNA, 103 bp, Artificial Sequence
  Synthetic Polynucleotide
taatacgactcactatagggcccctttctcgtcgtgagtcggagtcgctgaacagaggagacagcgaatgcgactcacgaacctggcggcagcgcaaaagatg

SEQ ID NO: 186222 - DNA, 103 bp, Artificial Sequence
  Synthetic Polynucleotide
taatacgactcactatagggtagcgctcctcccctttctcgtcgtgagtcaacagaggagagactcaatgcgagaaaggaacctggcggcagcgcaaaagatg

SEQ ID NO: 186223 - DNA, 103 bp, Artificial Sequence
  Synthetic Polynucleotide
taatacgactcactatagggggccgggatgcagcagtcggcactcacgctaacagaggagaagcgtgatggccgactgcaacctggcggcagcgcaaaagatg

SEQ ID NO: 186224 - DNA, 103 bp, Artificial Sequence
  Synthetic Polynucleotide
taatacgactcactatagggccagcagatgtagcgctcctcccctttctcaacagaggagagagaaaatggaggagcgcaacctggcggcagcgcaaaagatg

SEQ ID NO: 186225 - DNA, 103 bp, Artificial Sequence
  Synthetic Polynucleotide
taatacgactcactatagggtccagcagtaccagcagatgtagcgctcctaacagaggagaaggagcatgacatctgctaacctggcggcagcgcaaaagatg

SEQ ID NO: 186226 - DNA, 103 bp, Artificial Sequence
  Synthetic Polynucleotide
taatacgactcactatagggctaaacgtcctccagcagtaccagcagatgaacagaggagacatctgatggtactgctgaacctggcggcagcgcaaaagatg

SEQ ID NO: 186227 - DNA, 103 bp, Artificial Sequence
  Synthetic Polynucleotide
taatacgactcactataggggttggggtatctaaacgtcctccagcagtaaacagaggagatactgcatgaggacgtttaacctggcggcagcgcaaaagatg

SEQ ID NO: 186228 - DNA, 103 bp, Artificial Sequence
  Synthetic Polynucleotide
taatacgactcactatagggccttaaggctgttggggtatctaaacgtccaacagaggagaggacgtatggataccccaaacctggcggcagcgcaaaagatg

SEQ ID NO: 186229 - DNA, 103 bp, Artificial Sequence
  Synthetic Polynucleotide
taatacgactcactatagggcgcaggtgtgccttaaggctgttggggtataacagaggagaatacccatgcagccttaaaacctggcggcagcgcaaaagatg

SEQ ID NO: 186230 - DNA, 103 bp, Artificial Sequence
  Synthetic Polynucleotide
taatacgactcactataggggcagtggaaacgcaggtgtgccttaaggctaacagaggagaagccttatggcacacctgaacctggcggcagcgcaaaagatg

SEQ ID NO: 186231 - DNA, 103 bp, Artificial Sequence
  Synthetic Polynucleotide
taatacgactcactatagggcgctgaacacgcagtggaaacgcaggtgtgaacagaggagacacaccatggtttccactaacctggcggcagcgcaaaagatg

SEQ ID NO: 186232 - DNA, 103 bp, Artificial Sequence
  Synthetic Polynucleotide
taatacgactcactatagggcctccaccgccgctgaacacgcagtggaaaaacagaggagatttccaatgcgtgttcagaacctggcggcagcgcaaaagatg

SEQ ID NO: 186233 - DNA, 103 bp, Artificial Sequence
  Synthetic Polynucleotide
taatacgactcactataggggaaggcgccgcctccaccgccgctgaacacaacagaggagagtgttcatgggcggtggaaacctggcggcagcgcaaaagatg

SEQ ID NO: 186234 - DNA, 103 bp, Artificial Sequence
  Synthetic Polynucleotide
taatacgactcactatagggggcgcaagccggccgggatgcagcagtcggaacagaggagaccgactatggcatcccggaacctggcggcagcgcaaaagatg

SEQ ID NO: 186235 - DNA, 103 bp, Artificial Sequence
  Synthetic Polynucleotide
taatacgactcactatagggcgtggtgcaggaaggcgccgcctccaccgcaacagaggagagcggtgatggcggcgcctaacctggcggcagcgcaaaagatg

SEQ ID NO: 186236 - DNA, 103 bp, Artificial Sequence
  Synthetic Polynucleotide
taatacgactcactataggggccgcgtgttcgtggtgcaggaaggcgccgaacagaggagacggcgcatgcctgcaccaaacctggcggcagcgcaaaagatg

SEQ ID NO: 186237 - DNA, 103 bp, Artificial Sequence
  Synthetic Polynucleotide
taatacgactcactataggggccttggcgagccgcgtgttcgtggtgcagaacagaggagactgcacatggaacacgcgaacctggcggcagcgcaaaagatg

SEQ ID NO: 186238 - DNA, 103 bp, Artificial Sequence
  Synthetic Polynucleotide
taatacgactcactatagggctgggacggcgccttggcgagccgcgtgttaacagaggagaaacacgatgctcgccaagaacctggcggcagcgcaaaagatg

SEQ ID NO: 186239 - DNA, 103 bp, Artificial Sequence
  Synthetic Polynucleotide
taatacgactcactatagggccatcagccgctgggacggcgccttggcgaaacagaggagatcgccaatgcgccgtcccaacctggcggcagcgcaaaagatg

SEQ ID NO: 186240 - DNA, 103 bp, Artificial Sequence
  Synthetic Polynucleotide
taatacgactcactataggggagaccgaggccatcagccgctgggacggcaacagaggagagccgtcatggcggctgataacctggcggcagcgcaaaagatg

SEQ ID NO: 186241 - DNA, 103 bp, Artificial Sequence
  Synthetic Polynucleotide
taatacgactcactataggggttttggggagagaccgaggccatcagccgaacagaggagacggctgatggcctcggtcaacctggcggcagcgcaaaagatg

SEQ ID NO: 186242 - DNA, 103 bp, Artificial Sequence
  Synthetic Polynucleotide
taatacgactcactatagggggcgccgggggttttggggagagaccgaggaacagaggagacctcggatgctccccaaaaacctggcggcagcgcaaaagatg

SEQ ID NO: 186243 - DNA, 103 bp, Artificial Sequence
  Synthetic Polynucleotide
taatacgactcactatagggggcgaaatcgggcgccgggggttttggggaaacagaggagatccccaatgcccccggcgaacctggcggcagcgcaaaagatg

SEQ ID NO: 186244 - DNA, 103 bp, Artificial Sequence
  Synthetic Polynucleotide
taatacgactcactataggggggaaggcgcggcgaaatcgggcgccggggaacagaggagaccccggatgccgatttcgaacctggcggcagcgcaaaagatg

SEQ ID NO: 186245 - DNA, 103 bp, Artificial Sequence
  Synthetic Polynucleotide
taatacgactcactatagggaccggtccgaggcgcaagccggccgggatgaacagaggagacatcccatgcggcttgcgaacctggcggcagcgcaaaagatg

SEQ ID NO: 186246 - DNA, 103 bp, Artificial Sequence
  Synthetic Polynucleotide
taatacgactcactataggggttcctgcctgggaaggcgcggcgaaatcgaacagaggagacgatttatgcgcgccttcaacctggcggcagcgcaaaagatg

SEQ ID NO: 186247 - DNA, 103 bp, Artificial Sequence
  Synthetic Polynucleotide
taatacgactcactataggggggtcgcaaagttcctgcctgggaaggcgcaacagaggagagcgcctatgcaggcaggaaacctggcggcagcgcaaaagatg

SEQ ID NO: 186248 - DNA, 103 bp, Artificial Sequence
  Synthetic Polynucleotide
taatacgactcactatagggccagggggtggggtcgcaaagttcctgcctaacagaggagaaggcagatgctttgcgacaacctggcggcagcgcaaaagatg

SEQ ID NO: 186249 - DNA, 103 bp, Artificial Sequence
  Synthetic Polynucleotide
taatacgactcactatagggggtggcgggcccagggggtggggtcgcaaaaacagaggagatttgcgatgccaccccctaacctggcggcagcgcaaaagatg

SEQ ID NO: 186250 - DNA, 103 bp, Artificial Sequence
  Synthetic Polynucleotide
taatacgactcactatagggggcctgaactggtggcgggcccagggggtgaacagaggagacaccccatgggcccgccaaacctggcggcagcgcaaaagatg

SEQ ID NO: 186251 - DNA, 103 bp, Artificial Sequence
  Synthetic Polynucleotide
taatacgactcactataggggcgcaccgcaggcctgaactggtggcgggcaacagaggagagcccgcatgcagttcaggaacctggcggcagcgcaaaagatg

SEQ ID NO: 186252 - DNA, 103 bp, Artificial Sequence
  Synthetic Polynucleotide
taatacgactcactatagggatgccctcccgcgcaccgcaggcctgaactaacagaggagaagttcaatgctgcggtgcaacctggcggcagcgcaaaagatg

SEQ ID NO: 186253 - DNA, 103 bp, Artificial Sequence
  Synthetic Polynucleotide
taatacgactcactatagggctcgcgcttgatgccctcccgcgcaccgcaaacagaggagatgcggtatgcgggagggcaacctggcggcagcgcaaaagatg

SEQ ID NO: 186254 - DNA, 103 bp, Artificial Sequence
  Synthetic Polynucleotide
taatacgactcactatagggcggaagaggcctcgcgcttgatgccctcccaacagaggagagggaggatgtcaagcgcgaacctggcggcagcgcaaaagatg

SEQ ID NO: 186255 - DNA, 103 bp, Artificial Sequence
  Synthetic Polynucleotide
taatacgactcactataggggccgagggcgcggaagaggcctcgcgcttgaacagaggagacaagcgatgggcctcttcaacctggcggcagcgcaaaagatg

SEQ ID NO: 186256 - DNA, 103 bp, Artificial Sequence
  Synthetic Polynucleotide
taatacgactcactatagggggtaccaggcaccggtccgaggcgcaagccaacagaggagaggcttgatgctcggaccgaacctggcggcagcgcaaaagatg

SEQ ID NO: 186257 - DNA, 103 bp, Artificial Sequence
  Synthetic Polynucleotide
taatacgactcactatagggcggcgaggtggccgagggcgcggaagaggcaacagaggagagcctctatggcgccctcgaacctggcggcagcgcaaaagatg

SEQ ID NO: 186258 - DNA, 103 bp, Artificial Sequence
  Synthetic Polynucleotide
taatacgactcactatagggtgcctggggtcggcgaggtggccgagggcgaacagaggagacgccctatgccacctcgcaacctggcggcagcgcaaaagatg

SEQ ID NO: 186259 - DNA, 103 bp, Artificial Sequence
  Synthetic Polynucleotide
taatacgactcactatagggtgcccccacttgcctggggtcggcgaggtgaacagaggagacacctcatggaccccaggaacctggcggcagcgcaaaagatg

SEQ ID NO: 186260 - DNA, 103 bp, Artificial Sequence
  Synthetic Polynucleotide
taatacgactcactatagggcttcttgggctgcccccacttgcctggggtaacagaggagaaccccaatgaagtgggggaacctggcggcagcgcaaaagatg

SEQ ID NO: 186261 - DNA, 103 bp, Artificial Sequence
  Synthetic Polynucleotide
taatacgactcactataggggctccttgcccttcttgggctgcccccactaacagaggagaagtgggatgagcccaagaaacctggcggcagcgcaaaagatg

SEQ ID NO: 186262 - DNA, 103 bp, Artificial Sequence
  Synthetic Polynucleotide
taatacgactcactatagggcggtccagctgctccttgcccttcttgggcaacagaggagagcccaaatggggcaaggaaacctggcggcagcgcaaaagatg

SEQ ID NO: 186263 - DNA, 103 bp, Artificial Sequence
  Synthetic Polynucleotide
taatacgactcactataggggtccagggcacggtccagctgctccttgccaacagaggagaggcaagatgcagctggacaacctggcggcagcgcaaaagatg

SEQ ID NO: 186264 - DNA, 103 bp, Artificial Sequence
  Synthetic Polynucleotide
taatacgactcactatagggctccgctcatgtccagggcacggtccagctaacagaggagaagctggatggtgccctggaacctggcggcagcgcaaaagatg

SEQ ID NO: 186265 - DNA, 103 bp, Artificial Sequence
  Synthetic Polynucleotide
taatacgactcactatagggcctcgggcggctccgctcatgtccagggcaaacagaggagatgccctatgcatgagcggaacctggcggcagcgcaaaagatg

SEQ ID NO: 186266 - DNA, 103 bp, Artificial Sequence
  Synthetic Polynucleotide
taatacgactcactataggggtgcccttgtcctcgggcggctccgctcataacagaggagaatgagcatggccgcccgaaacctggcggcagcgcaaaagatg

SEQ ID NO: 186267 - DNA, 103 bp, Artificial Sequence
  Synthetic Polynucleotide
taatacgactcactatagggccagcttgaaggtaccaggcaccggtccgaaacagaggagatcggacatgtgcctggtaaacctggcggcagcgcaaaagatg

SEQ ID NO: 186268 - DNA, 103 bp, Artificial Sequence
  Synthetic Polynucleotide
taatacgactcactatagggtgccgaggaagtgcccttgtcctcgggcggaacagaggagaccgcccatggacaagggcaacctggcggcagcgcaaaagatg

SEQ ID NO: 186269 - DNA, 103 bp, Artificial Sequence
  Synthetic Polynucleotide
taatacgactcactatagggccgcccacgatgccgaggaagtgcccttgtaacagaggagaacaaggatgcttcctcggaacctggcggcagcgcaaaagatg

SEQ ID NO: 186270 - DNA, 103 bp, Artificial Sequence
  Synthetic Polynucleotide
taatacgactcactatagggcgccgaggagccgcccacgatgccgaggaaaacagaggagattcctcatgatcgtgggcaacctggcggcagcgcaaaagatg

SEQ ID NO: 186271 - DNA, 103 bp, Artificial Sequence
  Synthetic Polynucleotide
taatacgactcactatagggtgccgacccccgccgaggagccgcccacgaaacagaggagatcgtggatggctcctcggaacctggcggcagcgcaaaagatg

SEQ ID NO: 186272 - DNA, 103 bp, Artificial Sequence
  Synthetic Polynucleotide
taatacgactcactatagggaaagccaggctgccgacccccgccgaggagaacagaggagactcctcatggggggtcggaacctggcggcagcgcaaaagatg

SEQ ID NO: 186273 - DNA, 103 bp, Artificial Sequence
  Synthetic Polynucleotide
taatacgactcactataggggccggggtagaaagccaggctgccgaccccaacagaggagaggggtcatgagcctggctaacctggcggcagcgcaaaagatg

SEQ ID NO: 186274 - DNA, 103 bp, Artificial Sequence
  Synthetic Polynucleotide
taatacgactcactatagggctgagcgcacgccggggtagaaagccaggcaacagaggagagcctggatgtctaccccgaacctggcggcagcgcaaaagatg

SEQ ID NO: 186275 - DNA, 103 bp, Artificial Sequence
  Synthetic Polynucleotide
taatacgactcactatagggggcttgaaagctgagcgcacgccggggtagaacagaggagactacccatgcgtgcgctcaacctggcggcagcgcaaaagatg

SEQ ID NO: 186276 - DNA, 103 bp, Artificial Sequence
  Synthetic Polynucleotide
taatacgactcactatagggtaggccggcgggcttgaaagctgagcgcacaacagaggagagtgcgcatggctttcaagaacctggcggcagcgcaaaagatg

SEQ ID NO: 186277 - DNA, 103 bp, Artificial Sequence
  Synthetic Polynucleotide
taatacgactcactatagggccgccctcgctaggccggcgggcttgaaagaacagaggagactttcaatgccgccggccaacctggcggcagcgcaaaagatg

SEQ ID NO: 186278 - DNA, 103 bp, Artificial Sequence
  Synthetic Polynucleotide
taatacgactcactatagggaggtacttgcccagcttgaaggtaccaggcaacagaggagagcctggatgcttcaagctaacctggcggcagcgcaaaagatg

SEQ ID NO: 186279 - DNA, 103 bp, Artificial Sequence
  Synthetic Polynucleotide
taatacgactcactataggggcggccgccgccgccctcgctaggccggcgaacagaggagacgccggatgagcgagggcaacctggcggcagcgcaaaagatg

SEQ ID NO: 186280 - DNA, 103 bp, Artificial Sequence
  Synthetic Polynucleotide
taatacgactcactataggggtcgccgtgagcggccgccgccgccctcgcaacagaggagagcgaggatggcggcggccaacctggcggcagcgcaaaagatg

SEQ ID NO: 186281 - DNA, 103 bp, Artificial Sequence
  Synthetic Polynucleotide
taatacgactcactatagggcccggtaggggtcgccgtgagcggccgccgaacagaggagacggcggatgctcacggcgaacctggcggcagcgcaaaagatg

SEQ ID NO: 186282 - DNA, 103 bp, Artificial Sequence
  Synthetic Polynucleotide
taatacgactcactatagggctgctctcctcccggtaggggtcgccgtgaaacagaggagatcacggatgcccctaccgaacctggcggcagcgcaaaagatg

SEQ ID NO: 186283 - DNA, 103 bp, Artificial Sequence
  Synthetic Polynucleotide
taatacgactcactatagggttgcttgctgctgctctcctcccggtagggaacagaggagaccctacatggaggagagcaacctggcggcagcgcaaaagatg

SEQ ID NO: 186284 - DNA, 103 bp, Artificial Sequence
  Synthetic Polynucleotide
taatacgactcactatagggggccggctccttgcttgctgctgctctcctaacagaggagaaggagaatggcagcaagcaacctggcggcagcgcaaaagatg

SEQ ID NO: 186285 - DNA, 103 bp, Artificial Sequence
  Synthetic Polynucleotide
taatacgactcactatagggcccaaagcgaggccggctccttgcttgctgaacagaggagacagcaaatgaggagccggaacctggcggcagcgcaaaagatg

SEQ ID NO: 186286 - DNA, 103 bp, Artificial Sequence
  Synthetic Polynucleotide
taatacgactcactatagggcagcagcctgcccaaagcgaggccggctccaacagaggagaggagccatgctcgctttgaacctggcggcagcgcaaaagatg

SEQ ID NO: 186287 - DNA, 103 bp, Artificial Sequence
  Synthetic Polynucleotide
taatacgactcactatagggggcccccgcccagcagcctgcccaaagcgaaacagaggagatcgcttatggcaggctgcaacctggcggcagcgcaaaagatg

SEQ ID NO: 186288 - DNA, 103 bp, Artificial Sequence
  Synthetic Polynucleotide
taatacgactcactatagggccgcacgcccggcccccgcccagcagcctgaacagaggagacaggctatggggcgggggaacctggcggcagcgcaaaagatg

SEQ ID NO: 186289 - DNA, 103 bp, Artificial Sequence
  Synthetic Polynucleotide
taatacgactcactatagggcacggcctcacttggccggggtagagccataacagaggagaatggctatgccccggccaaacctggcggcagcgcaaaagatg

SEQ ID NO: 186290 - DNA, 103 bp, Artificial Sequence
  Synthetic Polynucleotide
taatacgactcactatagggtctgtagtgtccataggacgggaaaggcgtaacagaggagaacgcctatgccgtcctataacctggcggcagcgcaaaagatg

SEQ ID NO: 186291 - DNA, 103 bp, Artificial Sequence
  Synthetic Polynucleotide
taatacgactcactatagggaactaggttctgctccttggggaagcgggcaacagaggagagcccgcatgcccaaggagaacctggcggcagcgcaaaagatg

SEQ ID NO: 186292 - DNA, 103 bp, Artificial Sequence
  Synthetic Polynucleotide
taatacgactcactatagggactgcacagcaactaggttctgctccttggaacagaggagaccaaggatgagaacctagaacctggcggcagcgcaaaagatg

SEQ ID NO: 186293 - DNA, 103 bp, Artificial Sequence
  Synthetic Polynucleotide
taatacgactcactatagggtgcccttgacactgcacagcaactaggttcaacagaggagagaacctatgtgctgtgcaaacctggcggcagcgcaaaagatg

SEQ ID NO: 186294 - DNA, 103 bp, Artificial Sequence
  Synthetic Polynucleotide
taatacgactcactatagggataaaatatatgcccttgacactgcacagcaacagaggagagctgtgatgtgtcaagggaacctggcggcagcgcaaaagatg

SEQ ID NO: 186295 - DNA, 103 bp, Artificial Sequence
  Synthetic Polynucleotide
taatacgactcactatagggtgcagctctcataaaatatatgcccttgacaacagaggagagtcaagatgatatattttaacctggcggcagcgcaaaagatg

SEQ ID NO: 186296 - DNA, 103 bp, Artificial Sequence
  Synthetic Polynucleotide
taatacgactcactatagggtggatctctttgcagctctcataaaatataaacagaggagatatattatgtgagagctgaacctggcggcagcgcaaaagatg

SEQ ID NO: 186297 - DNA, 103 bp, Artificial Sequence
  Synthetic Polynucleotide
taatacgactcactatagggttggttctgatggatctctttgcagctctcaacagaggagagagagcatgaaagagatcaacctggcggcagcgcaaaagatg

SEQ ID NO: 186298 - DNA, 103 bp, Artificial Sequence
  Synthetic Polynucleotide
taatacgactcactatagggcaaggagctcttggttctgatggatctcttaacagaggagaaagagaatgatcagaaccaacctggcggcagcgcaaaagatg

SEQ ID NO: 186299 - DNA, 103 bp, Artificial Sequence
  Synthetic Polynucleotide
taatacgactcactatagggccataccacacaaggagctcttggttctgaaacagaggagatcagaaatgagagctcctaacctggcggcagcgcaaaagatg

SEQ ID NO: 186300 - DNA, 103 bp, Artificial Sequence
  Synthetic Polynucleotide
taatacgactcactatagggatagcagtctccataccacacaaggagctcaacagaggagagagctcatggtgtggtataacctggcggcagcgcaaaagatg

SEQ ID NO: 186301 - DNA, 103 bp, Artificial Sequence
  Synthetic Polynucleotide
taatacgactcactatagggccaggctgtttctgtagtgtccataggacgaacagaggagacgtcctatggacactacaaacctggcggcagcgcaaaagatg

SEQ ID NO: 186302 - DNA, 103 bp, Artificial Sequence
  Synthetic Polynucleotide
taatacgactcactataggggaaatttctcatagcagtctccataccacaaacagaggagatgtggtatggagactgctaacctggcggcagcgcaaaagatg

SEQ ID NO: 186303 - DNA, 103 bp, Artificial Sequence
  Synthetic Polynucleotide
taatacgactcactatagggggaatatccagaaatttctcatagcagtctaacagaggagaagactgatgtgagaaattaacctggcggcagcgcaaaagatg

SEQ ID NO: 186304 - DNA, 103 bp, Artificial Sequence
  Synthetic Polynucleotide
taatacgactcactatagggaaggctcacaggaatatccagaaatttctcaacagaggagagagaaaatgctggatattaacctggcggcagcgcaaaagatg

SEQ ID NO: 186305 - DNA, 103 bp, Artificial Sequence
  Synthetic Polynucleotide
taatacgactcactatagggctgtgacctgaaggctcacaggaatatccaaacagaggagatggataatgctgtgagccaacctggcggcagcgcaaaagatg

SEQ ID NO: 186306 - DNA, 103 bp, Artificial Sequence
  Synthetic Polynucleotide
taatacgactcactatagggttccccggctctgtgacctgaaggctcacaaacagaggagatgtgagatgtcaggtcacaacctggcggcagcgcaaaagatg

SEQ ID NO: 186307 - DNA, 103 bp, Artificial Sequence
  Synthetic Polynucleotide
taatacgactcactatagggagatggctgcttccccggctctgtgacctgaacagaggagacaggtcatggagccggggaacctggcggcagcgcaaaagatg

SEQ ID NO: 186308 - DNA, 103 bp, Artificial Sequence
  Synthetic Polynucleotide
taatacgactcactatagggcagagggcccagatggctgcttccccggctaacagaggagaagccggatgagcagccataacctggcggcagcgcaaaagatg

SEQ ID NO: 186309 - DNA, 103 bp, Artificial Sequence
  Synthetic Polynucleotide
taatacgactcactataggggcagactcttcagagggcccagatggctgcaacagaggagagcagccatgtgggccctcaacctggcggcagcgcaaaagatg

SEQ ID NO: 186310 - DNA, 103 bp, Artificial Sequence
  Synthetic Polynucleotide
taatacgactcactataggggtagccttctgcagactcttcagagggcccaacagaggagagggcccatggaagagtctaacctggcggcagcgcaaaagatg

SEQ ID NO: 186311 - DNA, 103 bp, Artificial Sequence
  Synthetic Polynucleotide
taatacgactcactatagggtttcacatctgtagccttctgcagactcttaacagaggagaaagagtatgcagaaggctaacctggcggcagcgcaaaagatg

SEQ ID NO: 186312 - DNA, 103 bp, Artificial Sequence
  Synthetic Polynucleotide
taatacgactcactatagggtccacggtggccaggctgtttctgtagtgtaacagaggagaacactaatgaaacagcctaacctggcggcagcgcaaaagatg

SEQ ID NO: 186313 - DNA, 103 bp, Artificial Sequence
  Synthetic Polynucleotide
taatacgactcactatagggttcccacatctttcacatctgtagccttctaacagaggagaagaaggatgcagatgtgaaacctggcggcagcgcaaaagatg

SEQ ID NO: 186314 - DNA, 103 bp, Artificial Sequence
  Synthetic Polynucleotide
taatacgactcactatagggggtaaataccttcccacatctttcacatctaacagaggagaagatgtatgagatgtgggaacctggcggcagcgcaaaagatg

SEQ ID NO: 186315 - DNA, 103 bp, Artificial Sequence
  Synthetic Polynucleotide
taatacgactcactatagggaatatttgtaggtaaataccttcccacatcaacagaggagagatgtgatgaggtatttaaacctggcggcagcgcaaaagatg

SEQ ID NO: 186316 - DNA, 103 bp, Artificial Sequence
  Synthetic Polynucleotide
taatacgactcactatagggttatctctgtaatatttgtaggtaaataccaacagaggagaggtattatgctacaaataaacctggcggcagcgcaaaagatg

SEQ ID NO: 186317 - DNA, 103 bp, Artificial Sequence
  Synthetic Polynucleotide
taatacgactcactatagggcttgaggtgcttatctctgtaatatttgtaaacagaggagatacaaaatgtacagagataacctggcggcagcgcaaaagatg

SEQ ID NO: 186318 - DNA, 103 bp, Artificial Sequence
  Synthetic Polynucleotide
taatacgactcactatagggagggggtgtacttgaggtgcttatctctgtaacagaggagaacagagatgagcacctcaaacctggcggcagcgcaaaagatg

SEQ ID NO: 186319 - DNA, 103 bp, Artificial Sequence
  Synthetic Polynucleotide
taatacgactcactatagggttgtccacacagggggtgtacttgaggtgcaacagaggagagcacctatggtacaccccaacctggcggcagcgcaaaagatg

SEQ ID NO: 186320 - DNA, 103 bp, Artificial Sequence
  Synthetic Polynucleotide
taatacgactcactatagggcctatcgcccttgtccacacagggggtgtaaacagaggagatacaccatgtgtgtggacaacctggcggcagcgcaaaagatg

SEQ ID NO: 186321 - DNA, 103 bp, Artificial Sequence
  Synthetic Polynucleotide
taatacgactcactatagggagggaaatttcctatcgcccttgtccacacaacagaggagagtgtggatgagggcgataaacctggcggcagcgcaaaagatg

SEQ ID NO: 186322 - DNA, 103 bp, Artificial Sequence
  Synthetic Polynucleotide
taatacgactcactatagggcagagagaacagggaaatttcctatcgcccaacagaggagagggcgaatggaaatttccaacctggcggcagcgcaaaagatg

SEQ ID NO: 186323 - DNA, 103 bp, Artificial Sequence
  Synthetic Polynucleotide
taatacgactcactataggggaagtcttcctccacggtggccaggctgttaacagaggagaaacagcatggccaccgtgaacctggcggcagcgcaaaagatg

SEQ ID NO: 186324 - DNA, 103 bp, Artificial Sequence
  Synthetic Polynucleotide
taatacgactcactatagggggatcgtttgcagagagaacagggaaatttaacagaggagaaaatttatgtgttctctcaacctggcggcagcgcaaaagatg

SEQ ID NO: 186325 - DNA, 103 bp, Artificial Sequence
  Synthetic Polynucleotide
taatacgactcactataggggcttctcaaaggatcgtttgcagagagaacaacagaggagagttctcatggcaaacgataacctggcggcagcgcaaaagatg

SEQ ID NO: 186326 - DNA, 103 bp, Artificial Sequence
  Synthetic Polynucleotide
taatacgactcactatagggagccggtcccgcttctcaaaggatcgtttgaacagaggagacaaacgatgctttgagaaaacctggcggcagcgcaaaagatg

SEQ ID NO: 186327 - DNA, 103 bp, Artificial Sequence
  Synthetic Polynucleotide
taatacgactcactataggggtggatccgaagccggtcccgcttctcaaaaacagaggagatttgagatgcgggaccggaacctggcggcagcgcaaaagatg

SEQ ID NO: 186328 - DNA, 103 bp, Artificial Sequence
  Synthetic Polynucleotide
taatacgactcactatagggcatgaagaatgtggatccgaagccggtcccaacagaggagagggaccatgttcggatccaacctggcggcagcgcaaaagatg

SEQ ID NO: 186329 - DNA, 103 bp, Artificial Sequence
  Synthetic Polynucleotide
taatacgactcactatagggttctcatgaacatgaagaatgtggatccgaaacagaggagatcggatatgcattcttcaaacctggcggcagcgcaaaagatg

SEQ ID NO: 186330 - DNA, 103 bp, Artificial Sequence
  Synthetic Polynucleotide
taatacgactcactatagggaggccggtgcttctcatgaacatgaagaataacagaggagaattcttatggttcatgagaacctggcggcagcgcaaaagatg

SEQ ID NO: 186331 - DNA, 103 bp, Artificial Sequence
  Synthetic Polynucleotide
taatacgactcactatagggaacacttgtgaggccggtgcttctcatgaaaacagaggagattcatgatgagcaccggcaacctggcggcagcgcaaaagatg

SEQ ID NO: 186332 - DNA, 103 bp, Artificial Sequence
  Synthetic Polynucleotide
taatacgactcactatagggccacatgtagaacacttgtgaggccggtgcaacagaggagagcaccgatgtcacaagtgaacctggcggcagcgcaaaagatg

SEQ ID NO: 186333 - DNA, 103 bp, Artificial Sequence
  Synthetic Polynucleotide
taatacgactcactataggggaaacatttcccacatgtagaacacttgtgaacagaggagacacaagatgtctacatgtaacctggcggcagcgcaaaagatg

SEQ ID NO: 186334 - DNA, 103 bp, Artificial Sequence
  Synthetic Polynucleotide
taatacgactcactatagggggaaaggttggaagtcttcctccacggtggaacagaggagaccaccgatgaggaagactaacctggcggcagcgcaaaagatg

SEQ ID NO: 186335 - DNA, 103 bp, Artificial Sequence
  Synthetic Polynucleotide
taatacgactcactatagggaagattgagagaaacatttcccacatgtagaacagaggagactacatatgggaaatgttaacctggcggcagcgcaaaagatg

SEQ ID NO: 186336 - DNA, 103 bp, Artificial Sequence
  Synthetic Polynucleotide
taatacgactcactatagggtttaggctggaagattgagagaaacatttcaacagaggagagaaatgatgctctcaatcaacctggcggcagcgcaaaagatg

SEQ ID NO: 186337 - DNA, 103 bp, Artificial Sequence
  Synthetic Polynucleotide
taatacgactcactatagggcatgtgtttgtttaggctggaagattgagaaacagaggagatctcaaatgtccagcctaaacctggcggcagcgcaaaagatg

SEQ ID NO: 186338 - DNA, 103 bp, Artificial Sequence
  Synthetic Polynucleotide
taatacgactcactatagggagtggactcgcatgtgtttgtttaggctggaacagaggagaccagccatgacaaacacaaacctggcggcagcgcaaaagatg

SEQ ID NO: 186339 - DNA, 103 bp, Artificial Sequence
  Synthetic Polynucleotide
taatacgactcactatagggctgtctccagagtggactcgcatgtgtttgaacagaggagacaaacaatggcgagtccaaacctggcggcagcgcaaaagatg

SEQ ID NO: 186340 - DNA, 103 bp, Artificial Sequence
  Synthetic Polynucleotide
taatacgactcactatagggctggtatggtctgtctccagagtggactcgaacagaggagacgagtcatgtctggagacaacctggcggcagcgcaaaagatg

SEQ ID NO: 186341 - DNA, 103 bp, Artificial Sequence
  Synthetic Polynucleotide
taatacgactcactatagggaatacacacactggtatggtctgtctccagaacagaggagactggagatggaccataccaacctggcggcagcgcaaaagatg

SEQ ID NO: 186342 - DNA, 103 bp, Artificial Sequence
  Synthetic Polynucleotide
taatacgactcactatagggctcttagtacaatacacacactggtatggtaacagaggagaaccataatggtgtgtgtaaacctggcggcagcgcaaaagatg

SEQ ID NO: 186343 - DNA, 103 bp, Artificial Sequence
  Synthetic Polynucleotide
taatacgactcactatagggggctgtgaacctcttagtacaatacacacaaacagaggagatgtgtgatgtgtactaagaacctggcggcagcgcaaaagatg

SEQ ID NO: 186344 - DNA, 103 bp, Artificial Sequence
  Synthetic Polynucleotide
taatacgactcactataggggtatgctggaggctgtgaacctcttagtacaacagaggagagtactaatgggttcacagaacctggcggcagcgcaaaagatg

SEQ ID NO: 186345 - DNA, 103 bp, Artificial Sequence
  Synthetic Polynucleotide
taatacgactcactatagggtccagctgccggaaaggttggaagtcttccaacagaggagaggaagaatgccaacctttaacctggcggcagcgcaaaagatg

SEQ ID NO: 186346 - DNA, 103 bp, Artificial Sequence
  Synthetic Polynucleotide
taatacgactcactatagggtgtgtgcggagtatgctggaggctgtgaacaacagaggagagttcacatgctccagcataacctggcggcagcgcaaaagatg

SEQ ID NO: 186347 - DNA, 103 bp, Artificial Sequence
  Synthetic Polynucleotide
taatacgactcactatagggctgcctgatgtgtgtgcggagtatgctggaaacagaggagatccagcatgctccgcacaaacctggcggcagcgcaaaagatg

SEQ ID NO: 186348 - DNA, 103 bp, Artificial Sequence
  Synthetic Polynucleotide
taatacgactcactatagggccccggagtgctgcctgatgtgtgtgcggaaacagaggagatccgcaatgacatcaggcaacctggcggcagcgcaaaagatg

SEQ ID NO: 186349 - DNA, 103 bp, Artificial Sequence
  Synthetic Polynucleotide
taatacgactcactatagggaagggcttctccccggagtgctgcctgatgaacagaggagacatcagatggcactccggaacctggcggcagcgcaaaagatg

SEQ ID NO: 186350 - DNA, 103 bp, Artificial Sequence
  Synthetic Polynucleotide
taatacgactcactatagggcttgcatttgaagggcttctccccggagtgaacagaggagacactccatggagaagcccaacctggcggcagcgcaaaagatg

SEQ ID NO: 186351 - DNA, 103 bp, Artificial Sequence
  Synthetic Polynucleotide
taatacgactcactatagggtaccacagtacttgcatttgaagggcttctaacagaggagaagaagcatgtcaaatgcaaacctggcggcagcgcaaaagatg

SEQ ID NO: 186352 - DNA, 103 bp, Artificial Sequence
  Synthetic Polynucleotide
taatacgactcactataggggcaaaagatttaccacagtacttgcatttgaacagaggagacaaatgatggtactgtggaacctggcggcagcgcaaaagatg

SEQ ID NO: 186353 - DNA, 103 bp, Artificial Sequence
  Synthetic Polynucleotide
taatacgactcactatagggagcatgggatgcaaaagatttaccacagtaaacagaggagatactgtatgaaatcttttaacctggcggcagcgcaaaagatg

SEQ ID NO: 186354 - DNA, 103 bp, Artificial Sequence
  Synthetic Polynucleotide
taatacgactcactatagggtgtcatgggcagcatgggatgcaaaagattaacagaggagaaatcttatgcatcccatgaacctggcggcagcgcaaaagatg

SEQ ID NO: 186355 - DNA, 103 bp, Artificial Sequence
  Synthetic Polynucleotide
taatacgactcactatagggcggacatggctgtcatgggcagcatgggataacagaggagaatcccaatgtgcccatgaaacctggcggcagcgcaaaagatg

SEQ ID NO: 186356 - DNA, 103 bp, Artificial Sequence
  Synthetic Polynucleotide
taatacgactcactatagggcgctgcggcctccagctgccggaaaggttgaacagaggagacaacctatgcggcagctgaacctggcggcagcgcaaaagatg

SEQ ID NO: 186357 - DNA, 103 bp, Artificial Sequence
  Synthetic Polynucleotide
taatacgactcactataggggtgtgaacgccggacatggctgtcatgggcaacagaggagagcccatatgagccatgtcaacctggcggcagcgcaaaagatg

SEQ ID NO: 186358 - DNA, 103 bp, Artificial Sequence
  Synthetic Polynucleotide
taatacgactcactatagggcatcctccttgtgtgaacgccggacatggcaacagaggagagccatgatgggcgttcacaacctggcggcagcgcaaaagatg

SEQ ID NO: 186359 - DNA, 103 bp, Artificial Sequence
  Synthetic Polynucleotide
taatacgactcactataggggagcagccatcatcctccttgtgtgaacgcaacagaggagagcgttcatgcaaggaggaaacctggcggcagcgcaaaagatg

SEQ ID NO: 186360 - DNA, 103 bp, Artificial Sequence
  Synthetic Polynucleotide
taatacgactcactataggggatgctgcatgagcagccatcatcctccttaacagaggagaaaggagatggatggctgcaacctggcggcagcgcaaaagatg

SEQ ID NO: 186361 - DNA, 103 bp, Artificial Sequence
  Synthetic Polynucleotide
taatacgactcactatagggttttcccacagatgctgcatgagcagccataacagaggagaatggctatgcatgcagcaaacctggcggcagcgcaaaagatg

SEQ ID NO: 186362 - DNA, 103 bp, Artificial Sequence
  Synthetic Polynucleotide
taatacgactcactatagggtctgagaagattttcccacagatgctgcataacagaggagaatgcagatgctgtgggaaaacctggcggcagcgcaaaagatg

SEQ ID NO: 186363 - DNA, 103 bp, Artificial Sequence
  Synthetic Polynucleotide
taatacgactcactatagggtgtttcttgatctgagaagattttcccacaaacagaggagatgtgggatgatcttctcaaacctggcggcagcgcaaaagatg

SEQ ID NO: 186364 - DNA, 103 bp, Artificial Sequence
  Synthetic Polynucleotide
taatacgactcactataggggggagtagaatgtttcttgatctgagaagaaacagaggagatcttctatgatcaagaaaaacctggcggcagcgcaaaagatg

SEQ ID NO: 186365 - DNA, 103 bp, Artificial Sequence
  Synthetic Polynucleotide
taatacgactcactatagggaacttcatgtgggagtagaatgtttcttgaaacagaggagatcaagaatgattctactcaacctggcggcagcgcaaaagatg

SEQ ID NO: 186366 - DNA, 103 bp, Artificial Sequence
  Synthetic Polynucleotide
taatacgactcactataggggtcttcatgaaacttcatgtgggagtagaaaacagaggagattctacatgcacatgaagaacctggcggcagcgcaaaagatg

SEQ ID NO: 186367 - DNA, 103 bp, Artificial Sequence
  Synthetic Polynucleotide
taatacgactcactataggggggcagcagacgctgcggcctccagctgccaacagaggagaggcagcatgaggccgcagaacctggcggcagcgcaaaagatg

SEQ ID NO: 186368 - DNA, 103 bp, Artificial Sequence
  Synthetic Polynucleotide
taatacgactcactatagggggcatggcgggggcagcagacgctgcggccaacagaggagaggccgcatggtctgctgcaacctggcggcagcgcaaaagatg

SEQ ID NO: 186369 - DNA, 103 bp, Artificial Sequence
  Synthetic Polynucleotide
taatacgactcactatagggggggaaggggggcatggcgggggcagcagaaacagaggagatctgctatgcccgccatgaacctggcggcagcgcaaaagatg

SEQ ID NO: 186370 - DNA, 103 bp, Artificial Sequence
  Synthetic Polynucleotide
taatacgactcactatagggtgtcctgaggcacggcctcacttggccgggaacagaggagacccggcatggtgaggccgaacctggcggcagcgcaaaagatg

SEQ ID NO: 186371 - DNA, 103 bp, Artificial Sequence
  Synthetic Polynucleotide
taatacgactcactatagggccatccggaaggggaaggggggcatggcggaacagaggagaccgccaatgcccccttccaacctggcggcagcgcaaaagatg

SEQ ID NO: 186372 - DNA, 103 bp, Artificial Sequence
  Synthetic Polynucleotide
taatacgactcactatagggaagggaggcgccatccggaaggggaaggggaacagaggagaccccttatgcttccggataacctggcggcagcgcaaaagatg

SEQ ID NO: 186373 - DNA, 103 bp, Artificial Sequence
  Synthetic Polynucleotide
taatacgactcactatagggcgggctcagcaagggaggcgccatccggaaaacagaggagattccggatggcgcctcccaacctggcggcagcgcaaaagatg

SEQ ID NO: 186374 - DNA, 103 bp, Artificial Sequence
  Synthetic Polynucleotide
taatacgactcactatagggggcccagacccgggctcagcaagggaggcgaacagaggagacgcctcatgtgctgagccaacctggcggcagcgcaaaagatg

SEQ ID NO: 186375 - DNA, 103 bp, Artificial Sequence
  Synthetic Polynucleotide
taatacgactcactatagggtccctctgtaggcccagacccgggctcagcaacagaggagagctgagatggggtctgggaacctggcggcagcgcaaaagatg

SEQ ID NO: 186376 - DNA, 103 bp, Artificial Sequence
  Synthetic Polynucleotide
taatacgactcactataggggtagagaggctccctctgtaggcccagaccaacagaggagaggtctgatgctacagaggaacctggcggcagcgcaaaagatg

SEQ ID NO: 186377 - DNA, 103 bp, Artificial Sequence
  Synthetic Polynucleotide
taatacgactcactatagggagggcagatcgtagagaggctccctctgtaaacagaggagatacagaatgagcctctctaacctggcggcagcgcaaaagatg

SEQ ID NO: 186378 - DNA, 103 bp, Artificial Sequence
  Synthetic Polynucleotide
taatacgactcactatagggttgctgtaccagggcagatcgtagagaggcaacagaggagagcctctatgcgatctgccaacctggcggcagcgcaaaagatg

SEQ ID NO: 186379 - DNA, 103 bp, Artificial Sequence
  Synthetic Polynucleotide
taatacgactcactatagggcggtggcagcttgctgtaccagggcagatcaacagaggagagatctgatgtggtacagcaacctggcggcagcgcaaaagatg

SEQ ID NO: 186380 - DNA, 103 bp, Artificial Sequence
  Synthetic Polynucleotide
taatacgactcactatagggttgggtaccacggtggcagcttgctgtaccaacagaggagaggtacaatgagctgccacaacctggcggcagcgcaaaagatg

SEQ ID NO: 186381 - DNA, 103 bp, Artificial Sequence
  Synthetic Polynucleotide
taatacgactcactatagggtagcacaccttgtcctgaggcacggcctcaaacagaggagatgaggcatggcctcaggaaacctggcggcagcgcaaaagatg

SEQ ID NO: 186382 - DNA, 103 bp, Artificial Sequence
  Synthetic Polynucleotide
taatacgactcactatagggacgtggggaattgggtaccacggtggcagcaacagaggagagctgccatggtggtacccaacctggcggcagcgcaaaagatg

SEQ ID NO: 186383 - DNA, 103 bp, Artificial Sequence
  Synthetic Polynucleotide
taatacgactcactatagggttccctggggacgtggggaattgggtaccaaacagaggagatggtacatgattccccacaacctggcggcagcgcaaaagatg

SEQ ID NO: 186384 - DNA, 103 bp, Artificial Sequence
  Synthetic Polynucleotide
taatacgactcactatagggagggcggcacttccctggggacgtggggaaaacagaggagattccccatgtccccagggaacctggcggcagcgcaaaagatg

SEQ ID NO: 186385 - DNA, 103 bp, Artificial Sequence
  Synthetic Polynucleotide
taatacgactcactatagggctgctcaggaagggcggcacttccctggggaacagaggagaccccagatgagtgccgccaacctggcggcagcgcaaaagatg

SEQ ID NO: 186386 - DNA, 103 bp, Artificial Sequence
  Synthetic Polynucleotide
taatacgactcactatagggctcgtggctgctgctcaggaagggcggcacaacagaggagagtgccgatgttcctgagcaacctggcggcagcgcaaaagatg

SEQ ID NO: 186387 - DNA, 103 bp, Artificial Sequence
  Synthetic Polynucleotide
taatacgactcactatagggcacccgcgtactcgtggctgctgctcaggaaacagaggagatcctgaatggcagccacgaacctggcggcagcgcaaaagatg

SEQ ID NO: 186388 - DNA, 103 bp, Artificial Sequence
  Synthetic Polynucleotide
taatacgactcactatagggtcactgctggcacccgcgtactcgtggctgaacagaggagacagccaatggtacgcgggaacctggcggcagcgcaaaagatg

SEQ ID NO: 186389 - DNA, 103 bp, Artificial Sequence
  Synthetic Polynucleotide
taatacgactcactataggggcccagatcttcactgctggcacccgcgtaaacagaggagatacgcgatggccagcagtaacctggcggcagcgcaaaagatg

SEQ ID NO: 186390 - DNA, 103 bp, Artificial Sequence
  Synthetic Polynucleotide
taatacgactcactatagggtgatttggtggcccagatcttcactgctggaacagaggagaccagcaatgaagatctggaacctggcggcagcgcaaaagatg

SEQ ID NO: 186391 - DNA, 103 bp, Artificial Sequence
  Synthetic Polynucleotide
taatacgactcactatagggtcgccaccaatgatttggtggcccagatctaacagaggagaagatctatgccaccaaataacctggcggcagcgcaaaagatg

SEQ ID NO: 186392 - DNA, 103 bp, Artificial Sequence
  Synthetic Polynucleotide
taatacgactcactatagggctccggcgggtagcacaccttgtcctgaggaacagaggagacctcagatgaaggtgtgcaacctggcggcagcgcaaaagatg

SEQ ID NO: 186393 - DNA, 103 bp, Artificial Sequence
  Synthetic Polynucleotide
taatacgactcactatagggactctcgttgtcgccaccaatgatttggtgaacagaggagacaccaaatgattggtggcaacctggcggcagcgcaaaagatg

SEQ ID NO: 186394 - DNA, 103 bp, Artificial Sequence
  Synthetic Polynucleotide
taatacgactcactatagggaacacgggccactctcgttgtcgccaccaaaacagaggagattggtgatgacaacgagaaacctggcggcagcgcaaaagatg

SEQ ID NO: 186395 - DNA, 103 bp, Artificial Sequence
  Synthetic Polynucleotide
taatacgactcactatagggtcaggtccacaacacgggccactctcgttgaacagaggagacaacgaatgtggcccgtgaacctggcggcagcgcaaaagatg

SEQ ID NO: 186396 - DNA, 103 bp, Artificial Sequence
  Synthetic Polynucleotide
taatacgactcactatagggaattaaagtgtcaggtccacaacacgggccaacagaggagaggcccgatgtgtggacctaacctggcggcagcgcaaaagatg

SEQ ID NO: 186397 - DNA, 103 bp, Artificial Sequence
  Synthetic Polynucleotide
taatacgactcactatagggggggcggtggaattaaagtgtcaggtccacaacagaggagagtggacatgacactttaaaacctggcggcagcgcaaaagatg

SEQ ID NO: 186398 - DNA, 103 bp, Artificial Sequence
  Synthetic Polynucleotide
taatacgactcactataggggcatccgcagggggcggtggaattaaagtgaacagaggagacactttatgtccaccgccaacctggcggcagcgcaaaagatg

SEQ ID NO: 186399 - DNA, 103 bp, Artificial Sequence
  Synthetic Polynucleotide
taatacgactcactatagggtaacagagaagcatccgcagggggcggtggaacagaggagaccaccgatgcctgcggataacctggcggcagcgcaaaagatg

SEQ ID NO: 186400 - DNA, 103 bp, Artificial Sequence
  Synthetic Polynucleotide
taatacgactcactataggggcccctcaggtaacagagaagcatccgcagaacagaggagactgcggatgcttctctgtaacctggcggcagcgcaaaagatg

SEQ ID NO: 186401 - DNA, 103 bp, Artificial Sequence
  Synthetic Polynucleotide
taatacgactcactataggggaggtcctcagcccctcaggtaacagagaaaacagaggagattctctatgacctgagggaacctggcggcagcgcaaaagatg

SEQ ID NO: 186402 - DNA, 103 bp, Artificial Sequence
  Synthetic Polynucleotide
taatacgactcactatagggtaataactgggaggtcctcagcccctcaggaacagaggagacctgagatgctgaggaccaacctggcggcagcgcaaaagatg

SEQ ID NO: 186403 - DNA, 103 bp, Artificial Sequence
  Synthetic Polynucleotide
taatacgactcactataggggcgggctgctctccggcgggtagcacacctaacagaggagaaggtgtatgacccgccggaacctggcggcagcgcaaaagatg

SEQ ID NO: 186404 - DNA, 103 bp, Artificial Sequence
  Synthetic Polynucleotide
taatacgactcactataggggtgagcaaggtaataactgggaggtcctcaaacagaggagatgaggaatgcccagttataacctggcggcagcgcaaaagatg

SEQ ID NO: 186405 - DNA, 103 bp, Artificial Sequence
  Synthetic Polynucleotide
taatacgactcactatagggtgcttgctgggtgagcaaggtaataactggaacagaggagaccagttatgaccttgctcaacctggcggcagcgcaaaagatg

SEQ ID NO: 186406 - DNA, 103 bp, Artificial Sequence
  Synthetic Polynucleotide
taatacgactcactatagggatcctctgactgcttgctgggtgagcaaggaacagaggagaccttgcatgcccagcaagaacctggcggcagcgcaaaagatg

SEQ ID NO: 186407 - DNA, 103 bp, Artificial Sequence
  Synthetic Polynucleotide
taatacgactcactataggggtttgggaccatcctctgactgcttgctggaacagaggagaccagcaatgagtcagaggaacctggcggcagcgcaaaagatg

SEQ ID NO: 186408 - DNA, 103 bp, Artificial Sequence
  Synthetic Polynucleotide
taatacgactcactatagggtggttggagggtttgggaccatcctctgacaacagaggagagtcagaatgtggtcccaaaacctggcggcagcgcaaaagatg

SEQ ID NO: 186409 - DNA, 103 bp, Artificial Sequence
  Synthetic Polynucleotide
taatacgactcactatagggcttcccttcttggttggagggtttgggaccaacagaggagaggtcccatgccctccaacaacctggcggcagcgcaaaagatg

SEQ ID NO: 186410 - DNA, 103 bp, Artificial Sequence
  Synthetic Polynucleotide
taatacgactcactataggggagcaggggacttcccttcttggttggaggaacagaggagacctccaatgaagaagggaaacctggcggcagcgcaaaagatg

SEQ ID NO: 186411 - DNA, 103 bp, Artificial Sequence
  Synthetic Polynucleotide
taatacgactcactatagggaactggaaccgagcaggggacttcccttctaacagaggagaagaaggatggtcccctgcaacctggcggcagcgcaaaagatg

SEQ ID NO: 186412 - DNA, 103 bp, Artificial Sequence
  Synthetic Polynucleotide
taatacgactcactatagggctcctccgtgaactggaaccgagcaggggaaacagaggagatcccctatgcggttccagaacctggcggcagcgcaaaagatg

SEQ ID NO: 186413 - DNA, 103 bp, Artificial Sequence
  Synthetic Polynucleotide
taatacgactcactatagggagtgcaggtcctcctccgtgaactggaaccaacagaggagaggttccatgtcacggaggaacctggcggcagcgcaaaagatg

SEQ ID NO: 186414 - DNA, 103 bp, Artificial Sequence
  Synthetic Polynucleotide
taatacgactcactataggggccaggttctgcgggctgctctccggcgggaacagaggagacccgccatggagcagcccaacctggcggcagcgcaaaagatg

SEQ ID NO: 186415 - DNA, 103 bp, Artificial Sequence
  Synthetic Polynucleotide
taatacgactcactatagggtacagaacgaagtgcaggtcctcctccgtgaacagaggagacacggaatgggacctgcaaacctggcggcagcgcaaaagatg

SEQ ID NO: 186416 - DNA, 103 bp, Artificial Sequence
  Synthetic Polynucleotide
taatacgactcactatagggagtgaccccgtacagaacgaagtgcaggtcaacagaggagagacctgatgttcgttctgaacctggcggcagcgcaaaagatg

SEQ ID NO: 186417 - DNA, 103 bp, Artificial Sequence
  Synthetic Polynucleotide
taatacgactcactatagggccaggctgggagtgaccccgtacagaacgaaacagaggagatcgttcatgacggggtcaaacctggcggcagcgcaaaagatg

SEQ ID NO: 186418 - DNA, 103 bp, Artificial Sequence
  Synthetic Polynucleotide
taatacgactcactataggggctgggtgctccaggctgggagtgaccccgaacagaggagacggggtatgtcccagcctaacctggcggcagcgcaaaagatg

SEQ ID NO: 186419 - DNA, 103 bp, Artificial Sequence
  Synthetic Polynucleotide
taatacgactcactataggggtgcaggctggctgggtgctccaggctgggaacagaggagacccagcatggagcacccaaacctggcggcagcgcaaaagatg

SEQ ID NO: 186420 - DNA, 103 bp, Artificial Sequence
  Synthetic Polynucleotide
taatacgactcactatagggaaatcgcatggtgcaggctggctgggtgctaacagaggagaagcaccatgccagcctgcaacctggcggcagcgcaaaagatg

SEQ ID NO: 186421 - DNA, 103 bp, Artificial Sequence
  Synthetic Polynucleotide
taatacgactcactatagggaggaggcctgaaatcgcatggtgcaggctgaacagaggagacagcctatgccatgcgataacctggcggcagcgcaaaagatg

SEQ ID NO: 186422 - DNA, 103 bp, Artificial Sequence
  Synthetic Polynucleotide
taatacgactcactatagggtggggggaccaggaggcctgaaatcgcatgaacagaggagacatgcgatgtcaggcctcaacctggcggcagcgcaaaagatg

SEQ ID NO: 186423 - DNA, 103 bp, Artificial Sequence
  Synthetic Polynucleotide
taatacgactcactatagggcagagctgtctggggggaccaggaggcctgaacagaggagacaggccatgtggtcccccaacctggcggcagcgcaaaagatg

SEQ ID NO: 186424 - DNA, 103 bp, Artificial Sequence
  Synthetic Polynucleotide
taatacgactcactataggggaatcagatccagagctgtctggggggaccaacagaggagaggtcccatgagacagctcaacctggcggcagcgcaaaagatg

SEQ ID NO: 186425 - DNA, 103 bp, Artificial Sequence
  Synthetic Polynucleotide
taatacgactcactataggggtagtacgcggccaggttctgcgggctgctaacagaggagaagcagcatgcagaacctgaacctggcggcagcgcaaaagatg

SEQ ID NO: 186426 - DNA, 103 bp, Artificial Sequence
  Synthetic Polynucleotide
taatacgactcactatagggttgaggaagagaatcagatccagagctgtcaacagaggagagacagcatgggatctgataacctggcggcagcgcaaaagatg

SEQ ID NO: 186427 - DNA, 103 bp, Artificial Sequence
  Synthetic Polynucleotide
taatacgactcactatagggtatccagagtttgaggaagagaatcagatcaacagaggagagatctgatgctcttcctcaacctggcggcagcgcaaaagatg

SEQ ID NO: 186428 - DNA, 103 bp, Artificial Sequence
  Synthetic Polynucleotide
taatacgactcactatagggagggagtctttatccagagtttgaggaagaaacagaggagatcttccatgaactctggaaacctggcggcagcgcaaaagatg

SEQ ID NO: 186429 - DNA, 103 bp, Artificial Sequence
  Synthetic Polynucleotide
taatacgactcactatagggtggaagttgaagggagtctttatccagagtaacagaggagaactctgatgaaagactccaacctggcggcagcgcaaaagatg

SEQ ID NO: 186430 - DNA, 103 bp, Artificial Sequence
  Synthetic Polynucleotide
taatacgactcactatagggatagaccttctggaagttgaagggagtcttaacagaggagaaagactatgttcaacttcaacctggcggcagcgcaaaagatg

SEQ ID NO: 186431 - DNA, 103 bp, Artificial Sequence
  Synthetic Polynucleotide
taatacgactcactatagggtgcatgaggcatagaccttctggaagttgaaacagaggagatcaactatgagaaggtctaacctggcggcagcgcaaaagatg

SEQ ID NO: 186432 - DNA, 103 bp, Artificial Sequence
  Synthetic Polynucleotide
taatacgactcactatagggaaacaccgtctgcatgaggcatagaccttcaacagaggagagaaggtatgtgcctcatgaacctggcggcagcgcaaaagatg

SEQ ID NO: 186433 - DNA, 103 bp, Artificial Sequence
  Synthetic Polynucleotide
taatacgactcactatagggggacttcaccaaacaccgtctgcatgaggcaacagaggagagcctcaatgagacggtgtaacctggcggcagcgcaaaagatg

SEQ ID NO: 186434 - DNA, 103 bp, Artificial Sequence
  Synthetic Polynucleotide
taatacgactcactatagggccaaaatgtgggacttcaccaaacaccgtcaacagaggagagacggtatgtggtgaagtaacctggcggcagcgcaaaagatg

SEQ ID NO: 186435 - DNA, 103 bp, Artificial Sequence
  Synthetic Polynucleotide
taatacgactcactataggggcagaacacaccaaaatgtgggacttcaccaacagaggagaggtgaaatgccacattttaacctggcggcagcgcaaaagatg

SEQ ID NO: 186436 - DNA, 103 bp, Artificial Sequence
  Synthetic Polynucleotide
taatacgactcactatagggggaaaggcgtgtagtacgcggccaggttctaacagaggagaagaaccatgccgcgtactaacctggcggcagcgcaaaagatg

SEQ ID NO: 186437 - DNA, 103 bp, Artificial Sequence
  Synthetic Polynucleotide
taatacgactcactatagggtaaaactactgcagaacacaccaaaatgtgaacagaggagacacattatggtgtgttctaacctggcggcagcgcaaaagatg

SEQ ID NO: 186438 - DNA, 103 bp, Artificial Sequence
  Synthetic Polynucleotide
taatacgactcactatagggcctttggcgataaaactactgcagaacacaaacagaggagatgtgttatgcagtagtttaacctggcggcagcgcaaaagatg

SEQ ID NO: 186439 - DNA, 103 bp, Artificial Sequence
  Synthetic Polynucleotide
taatacgactcactatagggaaacctgactcctttggcgataaaactactaacagaggagaagtagtatgatcgccaaaaacctggcggcagcgcaaaagatg

SEQ ID NO: 186440 - DNA, 103 bp, Artificial Sequence
  Synthetic Polynucleotide
taatacgactcactataggggaaagggcccaaacctgactcctttggcgaaacagaggagatcgccaatggagtcaggtaacctggcggcagcgcaaaagatg

SEQ ID NO: 186441 - DNA, 103 bp, Artificial Sequence
  Synthetic Polynucleotide
taatacgactcactatagggactttaccttgaaagggcccaaacctgactaacagaggagaagtcagatgtgggcccttaacctggcggcagcgcaaaagatg

SEQ ID NO: 186442 - DNA, 103 bp, Artificial Sequence
  Synthetic Polynucleotide
taatacgactcactatagggggcattgaccactttaccttgaaagggcccaacagaggagagggcccatgcaaggtaaaaacctggcggcagcgcaaaagatg

SEQ ID NO: 186443 - DNA, 103 bp, Artificial Sequence
  Synthetic Polynucleotide
taatacgactcactatagggtcacttcactggcattgaccactttaccttaacagaggagaaaggtaatgtggtcaatgaacctggcggcagcgcaaaagatg

SEQ ID NO: 186444 - DNA, 103 bp, Artificial Sequence
  Synthetic Polynucleotide
taatacgactcactatagggccgtaggtcttcacttcactggcattgaccaacagaggagaggtcaaatgcagtgaagtaacctggcggcagcgcaaaagatg

SEQ ID NO: 186445 - DNA, 103 bp, Artificial Sequence
  Synthetic Polynucleotide
taatacgactcactatagggagaattgtctccgtaggtcttcacttcactaacagaggagaagtgaaatgaagacctacaacctggcggcagcgcaaaagatg

SEQ ID NO: 186446 - DNA, 103 bp, Artificial Sequence
  Synthetic Polynucleotide
taatacgactcactatagggcccacatcacagaattgtctccgtaggtctaacagaggagaagacctatggagacaattaacctggcggcagcgcaaaagatg

SEQ ID NO: 186447 - DNA, 103 bp, Artificial Sequence
  Synthetic Polynucleotide
taatacgactcactatagggccataggacgggaaaggcgtgtagtacgcgaacagaggagacgcgtaatgcacgcctttaacctggcggcagcgcaaaagatg

SEQ ID NO: 186448 - DNA, 103 bp, Artificial Sequence
  Synthetic Polynucleotide
taatacgactcactatagggtcaaagatctcccacatcacagaattgtctaacagaggagaagacaaatgtgtgatgtgaacctggcggcagcgcaaaagatg

SEQ ID NO: 186449 - DNA, 103 bp, Artificial Sequence
  Synthetic Polynucleotide
taatacgactcactatagggatgaccatcttcaaagatctcccacatcacaacagaggagagtgatgatggagatctttaacctggcggcagcgcaaaagatg

SEQ ID NO: 186450 - DNA, 103 bp, Artificial Sequence
  Synthetic Polynucleotide
taatacgactcactatagggagtggctcaaatgaccatcttcaaagatctaacagaggagaagatctatgaagatggtcaacctggcggcagcgcaaaagatg

SEQ ID NO: 186451 - DNA, 103 bp, Artificial Sequence
  Synthetic Polynucleotide
taatacgactcactatagggccatctataaagtggctcaaatgaccatctaacagaggagaagatggatgtttgagccaaacctggcggcagcgcaaaagatg

SEQ ID NO: 186452 - DNA, 103 bp, Artificial Sequence
  Synthetic Polynucleotide
taatacgactcactatagggacctccttttccatctataaagtggctcaaaacagaggagattgagcatgtttatagataacctggcggcagcgcaaaagatg

SEQ ID NO: 186453 - DNA, 103 bp, Artificial Sequence
  Synthetic Polynucleotide
taatacgactcactatagggagttccccgtacctccttttccatctataaaacagaggagattatagatggaaaaggagaacctggcggcagcgcaaaagatg

SEQ ID NO: 186454 - DNA, 103 bp, Artificial Sequence
  Synthetic Polynucleotide
taatacgactcactatagggtaggacatccagttccccgtacctccttttaacagaggagaaaaaggatgtacggggaaaacctggcggcagcgcaaaagatg

SEQ ID NO: 186455 - DNA, 103 bp, Artificial Sequence
  Synthetic Polynucleotide
taatacgactcactatagggacagttgacataggacatccagttccccgtaacagaggagaacggggatgtggatgtccaacctggcggcagcgcaaaagatg

SEQ ID NO: 186456 - DNA, 103 bp, Artificial Sequence
  Synthetic Polynucleotide
taatacgactcactatagggggaagcgggcacagttgacataggacatccaacagaggagaggatgtatgatgtcaactaacctggcggcagcgcaaaagatg

SEQ ID NO: 186457 - DNA, 103 bp, Artificial Sequence
  Synthetic Polynucleotide
taatacgactcactatagggtgctccttggggaagcgggcacagttgacaaacagaggagatgtcaaatgtgcccgcttaacctggcggcagcgcaaaagatg

SEQ ID NO: 186458 - DNA, 103 bp, Artificial Sequence
  Synthetic Polynucleotide
taatacgactcactatagggaccggaagccggggggcggcggcggggcataacagaggagaatgcccatgcgccgccccaacctggcggcagcgcaaaagatg

SEQ ID NO: 186459 - DNA, 103 bp, Artificial Sequence
  Synthetic Polynucleotide
taatacgactcactataggggaccggggcggcgcgcggctgcctttggaaaacagaggagattccaaatgcagccgcgcaacctggcggcagcgcaaaagatg

SEQ ID NO: 186460 - DNA, 103 bp, Artificial Sequence
  Synthetic Polynucleotide
taatacgactcactatagggtaacacaaaggagtctttgaccatgaccacaacagaggagagtggtcatggtcaaagacaacctggcggcagcgcaaaagatg

SEQ ID NO: 186461 - DNA, 103 bp, Artificial Sequence
  Synthetic Polynucleotide
taatacgactcactatagggttgccctgcttaacacaaaggagtctttgaaacagaggagatcaaagatgcctttgtgtaacctggcggcagcgcaaaagatg

SEQ ID NO: 186462 - DNA, 103 bp, Artificial Sequence
  Synthetic Polynucleotide
taatacgactcactatagggggccaagaccttgccctgcttaacacaaagaacagaggagactttgtatgaagcagggcaacctggcggcagcgcaaaagatg

SEQ ID NO: 186463 - DNA, 103 bp, Artificial Sequence
  Synthetic Polynucleotide
taatacgactcactatagggtccgctggcaggccaagaccttgccctgctaacagaggagaagcaggatgaggtcttggaacctggcggcagcgcaaaagatg

SEQ ID NO: 186464 - DNA, 103 bp, Artificial Sequence
  Synthetic Polynucleotide
taatacgactcactatagggtgtgcacgtgtccgctggcaggccaagaccaacagaggagaggtcttatgctgccagcgaacctggcggcagcgcaaaagatg

SEQ ID NO: 186465 - DNA, 103 bp, Artificial Sequence
  Synthetic Polynucleotide
taatacgactcactatagggcccgcctgggtgtgcacgtgtccgctggcaaacagaggagatgccagatgacacgtgcaaacctggcggcagcgcaaaagatg

SEQ ID NO: 186466 - DNA, 103 bp, Artificial Sequence
  Synthetic Polynucleotide
taatacgactcactatagggcatcccctgccccgcctgggtgtgcacgtgaacagaggagacacgtgatgacccaggcgaacctggcggcagcgcaaaagatg

SEQ ID NO: 186467 - DNA, 103 bp, Artificial Sequence
  Synthetic Polynucleotide
taatacgactcactatagggcataaccccgcatcccctgccccgcctgggaacagaggagacccaggatgggcaggggaaacctggcggcagcgcaaaagatg

SEQ ID NO: 186468 - DNA, 103 bp, Artificial Sequence
  Synthetic Polynucleotide
taatacgactcactatagggtccctgtcctcataaccccgcatcccctgcaacagaggagagcagggatggcggggttaaacctggcggcagcgcaaaagatg

SEQ ID NO: 186469 - DNA, 103 bp, Artificial Sequence
  Synthetic Polynucleotide
taatacgactcactataggggtcagccctgtccctgtcctcataaccccgaacagaggagacggggtatggaggacaggaacctggcggcagcgcaaaagatg

SEQ ID NO: 186470 - DNA, 103 bp, Artificial Sequence
  Synthetic Polynucleotide
taatacgactcactatagggatggcggctggaccggggcggcgcgcggctaacagaggagaagccgcatgccgccccggaacctggcggcagcgcaaaagatg

SEQ ID NO: 186471 - DNA, 103 bp, Artificial Sequence
  Synthetic Polynucleotide
taatacgactcactataggggctgctgtgggtcagccctgtccctgtcctaacagaggagaaggacaatgacagggctgaacctggcggcagcgcaaaagatg

SEQ ID NO: 186472 - DNA, 103 bp, Artificial Sequence
  Synthetic Polynucleotide
taatacgactcactataggggcttctggaagctgctgtgggtcagccctgaacagaggagacagggcatgcccacagcaaacctggcggcagcgcaaaagatg

SEQ ID NO: 186473 - DNA, 103 bp, Artificial Sequence
  Synthetic Polynucleotide
taatacgactcactatagggtgcagggactgcttctggaagctgctgtggaacagaggagaccacagatgcttccagaaaacctggcggcagcgcaaaagatg

SEQ ID NO: 186474 - DNA, 103 bp, Artificial Sequence
  Synthetic Polynucleotide
taatacgactcactatagggtcaccaggcctgcagggactgcttctggaaaacagaggagattccagatgcagtccctgaacctggcggcagcgcaaaagatg

SEQ ID NO: 186475 - DNA, 103 bp, Artificial Sequence
  Synthetic Polynucleotide
taatacgactcactatagggctgagccgcctcaccaggcctgcagggactaacagaggagaagtcccatgaggcctggtaacctggcggcagcgcaaaagatg

SEQ ID NO: 186476 - DNA, 103 bp, Artificial Sequence
  Synthetic Polynucleotide
taatacgactcactatagggctgctgcccactgagccgcctcaccaggccaacagaggagaggcctgatgaggcggctcaacctggcggcagcgcaaaagatg

SEQ ID NO: 186477 - DNA, 103 bp, Artificial Sequence
  Synthetic Polynucleotide
taatacgactcactatagggggcagggcagctgctgcccactgagccgccaacagaggagaggcggcatggtgggcagcaacctggcggcagcgcaaaagatg

SEQ ID NO: 186478 - DNA, 103 bp, Artificial Sequence
  Synthetic Polynucleotide
taatacgactcactatagggagggtggaacggcagggcagctgctgcccaaacagaggagatgggcaatggctgccctgaacctggcggcagcgcaaaagatg

SEQ ID NO: 186479 - DNA, 103 bp, Artificial Sequence
  Synthetic Polynucleotide
taatacgactcactatagggcccccaggtgagggtggaacggcagggcagaacagaggagactgcccatgcgttccaccaacctggcggcagcgcaaaagatg

SEQ ID NO: 186480 - DNA, 103 bp, Artificial Sequence
  Synthetic Polynucleotide
taatacgactcactatagggggcacagcctcccccaggtgagggtggaacaacagaggagagttccaatgtcacctgggaacctggcggcagcgcaaaagatg

SEQ ID NO: 186481 - DNA, 103 bp, Artificial Sequence
  Synthetic Polynucleotide
taatacgactcactatagggaacagtcggcatggcggctggaccggggcgaacagaggagacgccccatgccagccgccaacctggcggcagcgcaaaagatg

SEQ ID NO: 186482 - DNA, 103 bp, Artificial Sequence
  Synthetic Polynucleotide
taatacgactcactataggggccaccaggtggcacagcctcccccaggtgaacagaggagacacctgatggaggctgtgaacctggcggcagcgcaaaagatg

SEQ ID NO: 186483 - DNA, 103 bp, Artificial Sequence
  Synthetic Polynucleotide
taatacgactcactatagggcctgccctgggccaccaggtggcacagcctaacagaggagaaggctgatgcacctggtgaacctggcggcagcgcaaaagatg

SEQ ID NO: 186484 - DNA, 103 bp, Artificial Sequence
  Synthetic Polynucleotide
taatacgactcactataggggaagggatgacctgccctgggccaccaggtaacagaggagaacctggatgcccagggcaaacctggcggcagcgcaaaagatg

SEQ ID NO: 186485 - DNA, 103 bp, Artificial Sequence
  Synthetic Polynucleotide
taatacgactcactatagggaagttgggaggaagggatgacctgccctggaacagaggagaccagggatggtcatccctaacctggcggcagcgcaaaagatg

SEQ ID NO: 186486 - DNA, 103 bp, Artificial Sequence
  Synthetic Polynucleotide
taatacgactcactatagggtctgatctccaagttgggaggaagggatgaaacagaggagatcatccatgcctcccaacaacctggcggcagcgcaaaagatg

SEQ ID NO: 186487 - DNA, 103 bp, Artificial Sequence
  Synthetic Polynucleotide
taatacgactcactatagggcttccagtcgtctgatctccaagttgggagaacagaggagactcccaatgtggagatcaaacctggcggcagcgcaaaagatg

SEQ ID NO: 186488 - DNA, 103 bp, Artificial Sequence
  Synthetic Polynucleotide
taatacgactcactatagggtcggctccatcttccagtcgtctgatctccaacagaggagaggagatatgacgactggaaacctggcggcagcgcaaaagatg

SEQ ID NO: 186489 - DNA, 103 bp, Artificial Sequence
  Synthetic Polynucleotide
taatacgactcactataggggaacaccccctcggctccatcttccagtcgaacagaggagacgactgatggatggagccaacctggcggcagcgcaaaagatg

SEQ ID NO: 186490 - DNA, 103 bp, Artificial Sequence
  Synthetic Polynucleotide
taatacgactcactataggggagtgatggcgaacaccccctcggctccataacagaggagaatggagatgagggggtgtaacctggcggcagcgcaaaagatg

SEQ ID NO: 186491 - DNA, 103 bp, Artificial Sequence
  Synthetic Polynucleotide
taatacgactcactatagggttgacgagctgagtgatggcgaacacccccaacagaggagagggggtatgcgccatcacaacctggcggcagcgcaaaagatg

SEQ ID NO: 186492 - DNA, 103 bp, Artificial Sequence
  Synthetic Polynucleotide
taatacgactcactatagggtgtaacaaagaacagtcggcatggcggctgaacagaggagacagccgatgtgccgactgaacctggcggcagcgcaaaagatg

SEQ ID NO: 186493 - DNA, 103 bp, Artificial Sequence
  Synthetic Polynucleotide
taatacgactcactatagggctgtgtccgcttgacgagctgagtgatggcaacagaggagagccatcatgcagctcgtcaacctggcggcagcgcaaaagatg

SEQ ID NO: 186494 - DNA, 103 bp, Artificial Sequence
  Synthetic Polynucleotide
taatacgactcactatagggagggaccgaactgtgtccgcttgacgagctaacagaggagaagctcgatgagcggacacaacctggcggcagcgcaaaagatg

SEQ ID NO: 186495 - DNA, 103 bp, Artificial Sequence
  Synthetic Polynucleotide
taatacgactcactatagggctggactcaaagggaccgaactgtgtccgcaacagaggagagcggacatggttcggtccaacctggcggcagcgcaaaagatg

SEQ ID NO: 186496 - DNA, 103 bp, Artificial Sequence
  Synthetic Polynucleotide
taatacgactcactatagggggcgaccctcctggactcaaagggaccgaaaacagaggagattcggtatgtttgagtccaacctggcggcagcgcaaaagatg

SEQ ID NO: 186497 - DNA, 103 bp, Artificial Sequence
  Synthetic Polynucleotide
taatacgactcactatagggtttcccatttggcgaccctcctggactcaaaacagaggagattgagtatgggagggtcgaacctggcggcagcgcaaaagatg

SEQ ID NO: 186498 - DNA, 103 bp, Artificial Sequence
  Synthetic Polynucleotide
taatacgactcactataggggcagactccttttcccatttggcgaccctcaacagaggagagagggtatgcaaatgggaaacctggcggcagcgcaaaagatg

SEQ ID NO: 186499 - DNA, 103 bp, Artificial Sequence
  Synthetic Polynucleotide
taatacgactcactatagggcaggggaaatgcagactccttttcccatttaacagaggagaaaatggatgaaggagtctaacctggcggcagcgcaaaagatg

SEQ ID NO: 186500 - DNA, 103 bp, Artificial Sequence
  Synthetic Polynucleotide
taatacgactcactatagggggaacaccttcaggggaaatgcagactcctaacagaggagaaggagtatgcatttccccaacctggcggcagcgcaaaagatg

SEQ ID NO: 186501 - DNA, 103 bp, Artificial Sequence
  Synthetic Polynucleotide
taatacgactcactatagggccgtccttctggaacaccttcaggggaaataacagaggagaatttccatggaaggtgttaacctggcggcagcgcaaaagatg

SEQ ID NO: 186502 - DNA, 103 bp, Artificial Sequence
  Synthetic Polynucleotide
taatacgactcactatagggcacggggtgcccgtccttctggaacaccttaacagaggagaaaggtgatgcagaaggacaacctggcggcagcgcaaaagatg

SEQ ID NO: 186503 - DNA, 103 bp, Artificial Sequence
  Synthetic Polynucleotide
taatacgactcactatagggagccggcgaatgtaacaaagaacagtcggcaacagaggagagccgacatgtctttgttaaacctggcggcagcgcaaaagatg

SEQ ID NO: 186504 - DNA, 103 bp, Artificial Sequence
  Synthetic Polynucleotide
taatacgactcactatagggtgtcgaagcacacggggtgcccgtccttctaacagaggagaagaaggatgggcaccccgaacctggcggcagcgcaaaagatg

SEQ ID NO: 186505 - DNA, 103 bp, Artificial Sequence
  Synthetic Polynucleotide
taatacgactcactatagggtcgttggaggtgtcgaagcacacggggtgcaacagaggagagcacccatggtgcttcgaaacctggcggcagcgcaaaagatg

SEQ ID NO: 186506 - DNA, 103 bp, Artificial Sequence
  Synthetic Polynucleotide
taatacgactcactataggggcagtcatcctcgttggaggtgtcgaagcaaacagaggagatgcttcatgacctccaacaacctggcggcagcgcaaaagatg

SEQ ID NO: 186507 - DNA, 103 bp, Artificial Sequence
  Synthetic Polynucleotide
taatacgactcactatagggtcatccagttgcagtcatcctcgttggaggaacagaggagacctccaatgaggatgactaacctggcggcagcgcaaaagatg

SEQ ID NO: 186508 - DNA, 103 bp, Artificial Sequence
  Synthetic Polynucleotide
taatacgactcactatagggcgcaccagcatcatccagttgcagtcatccaacagaggagaggatgaatgcaactggataacctggcggcagcgcaaaagatg

SEQ ID NO: 186509 - DNA, 103 bp, Artificial Sequence
  Synthetic Polynucleotide
taatacgactcactatagggcgccgctggccgcaccagcatcatccagttaacagaggagaaactggatgatgctggtgaacctggcggcagcgcaaaagatg

SEQ ID NO: 186510 - DNA, 103 bp, Artificial Sequence
  Synthetic Polynucleotide
taatacgactcactataggggctcggcctccgccgctggccgcaccagcaaacagaggagatgctggatgggccagcggaacctggcggcagcgcaaaagatg

SEQ ID NO: 186511 - DNA, 103 bp, Artificial Sequence
  Synthetic Polynucleotide
taatacgactcactatagggaggttctggtgctcggcctccgccgctggcaacagaggagagccagcatgggaggccgaaacctggcggcagcgcaaaagatg

SEQ ID NO: 186512 - DNA, 103 bp, Artificial Sequence
  Synthetic Polynucleotide
taatacgactcactataggggtaggccgtcaggttctggtgctcggcctcaacagaggagagaggccatgcaccagaacaacctggcggcagcgcaaaagatg

SEQ ID NO: 186513 - DNA, 103 bp, Artificial Sequence
  Synthetic Polynucleotide
taatacgactcactatagggtgccgtgctggtaggccgtcaggttctggtaacagaggagaaccagaatgtgacggcctaacctggcggcagcgcaaaagatg

SEQ ID NO: 186514 - DNA, 103 bp, Artificial Sequence
  Synthetic Polynucleotide
taatacgactcactatagggcggtgcccgcagccggcgaatgtaacaaagaacagaggagactttgtatgattcgccggaacctggcggcagcgcaaaagatg

SEQ ID NO: 186515 - DNA, 103 bp, Artificial Sequence
  Synthetic Polynucleotide
taatacgactcactatagggtacacgtcgctgccgtgctggtaggccgtcaacagaggagagacggcatgccagcacggaacctggcggcagcgcaaaagatg

SEQ ID NO: 186516 - DNA, 103 bp, Artificial Sequence
  Synthetic Polynucleotide
taatacgactcactatagggggtggtgaagtacacgtcgctgccgtgctgaacagaggagacagcacatgagcgacgtgaacctggcggcagcgcaaaagatg

SEQ ID NO: 186517 - DNA, 103 bp, Artificial Sequence
  Synthetic Polynucleotide
taatacgactcactatagggtgtctctggaggtggtgaagtacacgtcgcaacagaggagagcgacgatgacttcaccaaacctggcggcagcgcaaaagatg

SEQ ID NO: 186518 - DNA, 103 bp, Artificial Sequence
  Synthetic Polynucleotide
taatacgactcactatagggcccggggggatgtctctggaggtggtgaagaacagaggagacttcacatgctccagagaaacctggcggcagcgcaaaagatg

SEQ ID NO: 186519 - DNA, 103 bp, Artificial Sequence
  Synthetic Polynucleotide
taatacgactcactatagggcagctcggtacccggggggatgtctctggaaacagaggagatccagaatgatccccccgaacctggcggcagcgcaaaagatg

SEQ ID NO: 186520 - DNA, 103 bp, Artificial Sequence
  Synthetic Polynucleotide
taatacgactcactatagggaccacacgcgcagctcggtacccggggggaaacagaggagatcccccatggtaccgagcaacctggcggcagcgcaaaagatg

SEQ ID NO: 186521 - DNA, 103 bp, Artificial Sequence
  Synthetic Polynucleotide
taatacgactcactatagggaaggccgcataccacacgcgcagctcggtaaacagaggagataccgaatggcgcgtgtgaacctggcggcagcgcaaaagatg

SEQ ID NO: 186522 - DNA, 103 bp, Artificial Sequence
  Synthetic Polynucleotide
taatacgactcactatagggcttggcatagaaggccgcataccacacgcgaacagaggagacgcgtgatgtatgcggccaacctggcggcagcgcaaaagatg

SEQ ID NO: 186523 - DNA, 103 bp, Artificial Sequence
  Synthetic Polynucleotide
taatacgactcactatagggtgtccatcttcttggcatagaaggccgcataacagaggagaatgcggatgtctatgccaaacctggcggcagcgcaaaagatg

SEQ ID NO: 186524 - DNA, 103 bp, Artificial Sequence
  Synthetic Polynucleotide
taatacgactcactatagggagcatgggcttgtccatcttcttggcatagaacagaggagactatgcatggaagatggaaacctggcggcagcgcaaaagatg

SEQ ID NO: 186525 - DNA, 103 bp, Artificial Sequence
  Synthetic Polynucleotide
taatacgactcactatagggcgatcgccaacggtgcccgcagccggcgaaaacagaggagattcgccatgtgcgggcacaacctggcggcagcgcaaaagatg

SEQ ID NO: 186526 - DNA, 103 bp, Artificial Sequence
  Synthetic Polynucleotide
taatacgactcactatagggggcctgcttcagcatgggcttgtccatcttaacagaggagaaagatgatgaagcccatgaacctggcggcagcgcaaaagatg

SEQ ID NO: 186527 - DNA, 103 bp, Artificial Sequence
  Synthetic Polynucleotide
taatacgactcactatagggcgccagagccggcctgcttcagcatgggctaacagaggagaagcccaatgtgaagcaggaacctggcggcagcgcaaaagatg

SEQ ID NO: 186528 - DNA, 103 bp, Artificial Sequence
  Synthetic Polynucleotide
taatacgactcactataggggcagcgtggacgccagagccggcctgcttcaacagaggagagaagcaatgcggctctggaacctggcggcagcgcaaaagatg

SEQ ID NO: 186529 - DNA, 103 bp, Artificial Sequence
  Synthetic Polynucleotide
taatacgactcactatagggtggggtgcctgcagcgtggacgccagagccaacagaggagaggctctatggtccacgctaacctggcggcagcgcaaaagatg

SEQ ID NO: 186530 - DNA, 103 bp, Artificial Sequence
  Synthetic Polynucleotide
taatacgactcactatagggcgctgttttctggggtgcctgcagcgtggaaacagaggagatccacgatgcaggcacccaacctggcggcagcgcaaaagatg

SEQ ID NO: 186531 - DNA, 103 bp, Artificial Sequence
  Synthetic Polynucleotide
taatacgactcactatagggtccacgggggcgctgttttctggggtgcctaacagaggagaaggcacatgagaaaacagaacctggcggcagcgcaaaagatg

SEQ ID NO: 186532 - DNA, 103 bp, Artificial Sequence
  Synthetic Polynucleotide
taatacgactcactataggggggctccgactccacgggggcgctgttttcaacagaggagagaaaacatggcccccgtgaacctggcggcagcgcaaaagatg

SEQ ID NO: 186533 - DNA, 103 bp, Artificial Sequence
  Synthetic Polynucleotide
taatacgactcactatagggcccactggctgggctccgactccacgggggaacagaggagacccccgatgagtcggagcaacctggcggcagcgcaaaagatg

SEQ ID NO: 186534 - DNA, 103 bp, Artificial Sequence
  Synthetic Polynucleotide
taatacgactcactatagggactttacacgcccactggctgggctccgacaacagaggagagtcggaatgcagccagtgaacctggcggcagcgcaaaagatg

SEQ ID NO: 186535 - DNA, 103 bp, Artificial Sequence
  Synthetic Polynucleotide
taatacgactcactatagggggcagaacacactttacacgcccactggctaacagaggagaagccagatggcgtgtaaaaacctggcggcagcgcaaaagatg

SEQ ID NO: 186536 - DNA, 103 bp, Artificial Sequence
  Synthetic Polynucleotide
taatacgactcactataggggttttgactccgatcgccaacggtgcccgcaacagaggagagcgggcatggttggcgataacctggcggcagcgcaaaagatg

SEQ ID NO: 186537 - DNA, 103 bp, Artificial Sequence
  Synthetic Polynucleotide
taatacgactcactatagggccaggaaggtggcagaacacactttacacgaacagaggagacgtgtaatgtgtgttctgaacctggcggcagcgcaaaagatg

SEQ ID NO: 186538 - DNA, 103 bp, Artificial Sequence
  Synthetic Polynucleotide
taatacgactcactatagggagctgcagctccaggaaggtggcagaacacaacagaggagagtgttcatgcaccttcctaacctggcggcagcgcaaaagatg

SEQ ID NO: 186539 - DNA, 103 bp, Artificial Sequence
  Synthetic Polynucleotide
taatacgactcactatagggttcattgaggagctgcagctccaggaaggtaacagaggagaaccttcatggagctgcagaacctggcggcagcgcaaaagatg

SEQ ID NO: 186540 - DNA, 103 bp, Artificial Sequence
  Synthetic Polynucleotide
taatacgactcactatagggccaacagatgttcattgaggagctgcagctaacagaggagaagctgcatgtcctcaatgaacctggcggcagcgcaaaagatg

SEQ ID NO: 186541 - DNA, 103 bp, Artificial Sequence
  Synthetic Polynucleotide
taatacgactcactatagggtctaagtggcccaacagatgttcattgaggaacagaggagacctcaaatgacatctgttaacctggcggcagcgcaaaagatg

SEQ ID NO: 186542 - DNA, 103 bp, Artificial Sequence
  Synthetic Polynucleotide
taatacgactcactatagggtttggcttgttctaagtggcccaacagatgaacagaggagacatctgatgggccacttaaacctggcggcagcgcaaaagatg

SEQ ID NO: 186543 - DNA, 103 bp, Artificial Sequence
  Synthetic Polynucleotide
taatacgactcactataggggaggaaggcttttggcttgttctaagtggcaacagaggagagccactatgaacaagccaaacctggcggcagcgcaaaagatg

SEQ ID NO: 186544 - DNA, 103 bp, Artificial Sequence
  Synthetic Polynucleotide
taatacgactcactatagggtggctgcctggaggaaggcttttggcttgtaacagaggagaacaagcatgaagccttccaacctggcggcagcgcaaaagatg

SEQ ID NO: 186545 - DNA, 103 bp, Artificial Sequence
  Synthetic Polynucleotide
taatacgactcactatagggtgcctcgctttggctgcctggaggaaggctaacagaggagaagccttatgccaggcagcaacctggcggcagcgcaaaagatg

SEQ ID NO: 186546 - DNA, 103 bp, Artificial Sequence
  Synthetic Polynucleotide
taatacgactcactatagggcgggagctgctgcctcgctttggctgcctgaacagaggagacaggcaatgaaagcgaggaacctggcggcagcgcaaaagatg

SEQ ID NO: 186547 - DNA, 103 bp, Artificial Sequence
  Synthetic Polynucleotide
taatacgactcactatagggatccagccgggttttgactccgatcgccaaaacagaggagattggcgatgggagtcaaaaacctggcggcagcgcaaaagatg

SEQ ID NO: 186548 - DNA, 103 bp, Artificial Sequence
  Synthetic Polynucleotide
taatacgactcactatagggtgctccttctcgggagctgctgcctcgcttaacagaggagaaagcgaatgagcagctccaacctggcggcagcgcaaaagatg

SEQ ID NO: 186549 - DNA, 103 bp, Artificial Sequence
  Synthetic Polynucleotide
taatacgactcactataggggggtgtgtcctgctccttctcgggagctgcaacagaggagagcagctatggagaaggagaacctggcggcagcgcaaaagatg

SEQ ID NO: 186550 - DNA, 103 bp, Artificial Sequence
  Synthetic Polynucleotide
taatacgactcactataggggttccccccggggtgtgtcctgctccttctaacagaggagaagaaggatgaggacacacaacctggcggcagcgcaaaagatg

SEQ ID NO: 186551 - DNA, 103 bp, Artificial Sequence
  Synthetic Polynucleotide
taatacgactcactatagggactgcagggggttccccccggggtgtgtccaacagaggagaggacacatgccggggggaaacctggcggcagcgcaaaagatg

SEQ ID NO: 186552 - DNA, 103 bp, Artificial Sequence
  Synthetic Polynucleotide
taatacgactcactataggggctctcgggcactgcagggggttccccccgaacagaggagacgggggatgccccctgcaaacctggcggcagcgcaaaagatg

SEQ ID NO: 186553 - DNA, 103 bp, Artificial Sequence
  Synthetic Polynucleotide
taatacgactcactatagggcaacattctcgctctcgggcactgcaggggaacagaggagacccctgatgtgcccgagaaacctggcggcagcgcaaaagatg

SEQ ID NO: 186554 - DNA, 103 bp, Artificial Sequence
  Synthetic Polynucleotide
taatacgactcactatagggtctttggtggcaacattctcgctctcgggcaacagaggagagcccgaatgcgagaatgtaacctggcggcagcgcaaaagatg

SEQ ID NO: 186555 - DNA, 103 bp, Artificial Sequence
  Synthetic Polynucleotide
taatacgactcactatagggtttcttctgttctttggtggcaacattctcaacagaggagagagaatatggccaccaaaaacctggcggcagcgcaaaagatg

SEQ ID NO: 186556 - DNA, 103 bp, Artificial Sequence
  Synthetic Polynucleotide
taatacgactcactatagggttcgaggctttttcttctgttctttggtggaacagaggagaccaccaatgaacagaagaaacctggcggcagcgcaaaagatg

SEQ ID NO: 186557 - DNA, 103 bp, Artificial Sequence
  Synthetic Polynucleotide
taatacgactcactatagggtttctcccccttcgaggctttttcttctgtaacagaggagaacagaaatgaaagcctcgaacctggcggcagcgcaaaagatg

SEQ ID NO: 186558 - DNA, 103 bp, Artificial Sequence
  Synthetic Polynucleotide
taatacgactcactataggggctccgggaaatccagccgggttttgactcaacagaggagagagtcaatgcccggctggaacctggcggcagcgcaaaagatg

SEQ ID NO: 186559 - DNA, 103 bp, Artificial Sequence
  Synthetic Polynucleotide
taatacgactcactatagggcactttgggttttctcccccttcgaggcttaacagaggagaaagcctatgagggggagaaacctggcggcagcgcaaaagatg

SEQ ID NO: 186560 - DNA, 103 bp, Artificial Sequence
  Synthetic Polynucleotide
taatacgactcactatagggcagctttggacactttgggttttctcccccaacagaggagagggggaatgaacccaaagaacctggcggcagcgcaaaagatg

SEQ ID NO: 186561 - DNA, 103 bp, Artificial Sequence
  Synthetic Polynucleotide
taatacgactcactatagggagaggctgctcagctttggacactttgggtaacagaggagaacccaaatggtccaaagcaacctggcggcagcgcaaaagatg

SEQ ID NO: 186562 - DNA, 103 bp, Artificial Sequence
  Synthetic Polynucleotide
taatacgactcactatagggcacgatgactagaggctgctcagctttggaaacagaggagatccaaaatggagcagcctaacctggcggcagcgcaaaagatg

SEQ ID NO: 186563 - DNA, 103 bp, Artificial Sequence
  Synthetic Polynucleotide
taatacgactcactatagggccttgtcttccacgatgactagaggctgctaacagaggagaagcagcatgtagtcatcgaacctggcggcagcgcaaaagatg

SEQ ID NO: 186564 - DNA, 103 bp, Artificial Sequence
  Synthetic Polynucleotide
taatacgactcactatagggtctgtgggttccttgtcttccacgatgactaacagaggagaagtcatatgggaagacaaaacctggcggcagcgcaaaagatg

SEQ ID NO: 186565 - DNA, 103 bp, Artificial Sequence
  Synthetic Polynucleotide
taatacgactcactatagggtgccacttgctctgtgggttccttgtcttcaacagaggagagaagacatggaacccacaaacctggcggcagcgcaaaagatg

SEQ ID NO: 186566 - DNA, 103 bp, Artificial Sequence
  Synthetic Polynucleotide
taatacgactcactatagggtaatgatctctgccacttgctctgtgggttaacagaggagaaacccaatgagcaagtggaacctggcggcagcgcaaaagatg

SEQ ID NO: 186567 - DNA, 103 bp, Artificial Sequence
  Synthetic Polynucleotide
taatacgactcactataggggggacctcggtaatgatctctgccacttgcaacagaggagagcaagtatgagagatcataacctggcggcagcgcaaaagatg

SEQ ID NO: 186568 - DNA, 103 bp, Artificial Sequence
  Synthetic Polynucleotide
taatacgactcactatagggctcatccggagggacctcggtaatgatctcaacagaggagagagatcatgaccgaggtcaacctggcggcagcgcaaaagatg

SEQ ID NO: 186569 - DNA, 103 bp, Artificial Sequence
  Synthetic Polynucleotide
taatacgactcactatagggactgcgcagcaccggaagccggggggcggcaacagaggagagccgccatgcggcttccgaacctggcggcagcgcaaaagatg

SEQ ID NO: 186570 - DNA, 103 bp, Artificial Sequence
  Synthetic Polynucleotide
taatacgactcactatagggtcccggagcggctccgggaaatccagccggaacagaggagaccggctatgtttcccggaaacctggcggcagcgcaaaagatg

SEQ ID NO: 186571 - DNA, 103 bp, Artificial Sequence
  Synthetic Polynucleotide
taatacgactcactatagggcactcacaggctcatccggagggacctcggaacagaggagaccgaggatgctccggatgaacctggcggcagcgcaaaagatg

SEQ ID NO: 186572 - DNA, 103 bp, Artificial Sequence
  Synthetic Polynucleotide
taatacgactcactatagggtctggcgttgcactcacaggctcatccggaaacagaggagatccggaatggcctgtgagaacctggcggcagcgcaaaagatg

SEQ ID NO: 186573 - DNA, 103 bp, Artificial Sequence
  Synthetic Polynucleotide
taatacgactcactataggggatccgctcatctggcgttgcactcacaggaacagaggagacctgtgatggcaacgccaaacctggcggcagcgcaaaagatg

SEQ ID NO: 186574 - DNA, 103 bp, Artificial Sequence
  Synthetic Polynucleotide
taatacgactcactatagggccagctccatgatccgctcatctggcgttgaacagaggagacaacgcatgatgagcggaaacctggcggcagcgcaaaagatg

SEQ ID NO: 186575 - DNA, 103 bp, Artificial Sequence
  Synthetic Polynucleotide
taatacgactcactatagggttccccagaaccagctccatgatccgctcaaacagaggagatgagcgatgcatggagctaacctggcggcagcgcaaaagatg

SEQ ID NO: 186576 - DNA, 103 bp, Artificial Sequence
  Synthetic Polynucleotide
taatacgactcactatagggggtggccagcttccccagaaccagctccataacagaggagaatggagatggttctggggaacctggcggcagcgcaaaagatg

SEQ ID NO: 186577 - DNA, 103 bp, Artificial Sequence
  Synthetic Polynucleotide
taatacgactcactatagggcagtggtggtggtggccagcttccccagaaaacagaggagattctggatgagctggccaaacctggcggcagcgcaaaagatg

SEQ ID NO: 186578 - DNA, 103 bp, Artificial Sequence
  Synthetic Polynucleotide
taatacgactcactataggggagctggtgtcagtggtggtggtggccagcaacagaggagagctggcatgcaccaccacaacctggcggcagcgcaaaagatg

SEQ ID NO: 186579 - DNA, 103 bp, Artificial Sequence
  Synthetic Polynucleotide
taatacgactcactatagggctttggaaccgagctggtgtcagtggtggtaacagaggagaaccaccatggacaccagcaacctggcggcagcgcaaaagatg

SEQ ID NO: 186580 - DNA, 103 bp, Artificial Sequence
  Synthetic Polynucleotide
taatacgactcactataggggatgggtgaactttggaaccgagctggtgtaacagaggagaacaccaatgcggttccaaaacctggcggcagcgcaaaagatg

SEQ ID NO: 186581 - DNA, 103 bp, Artificial Sequence
  Synthetic Polynucleotide
taatacgactcactatagggcgcagggcgatcccggagcggctccgggaaaacagaggagattcccgatgccgctccggaacctggcggcagcgcaaaagatg

SEQ ID NO: 186582 - DNA, 103 bp, Artificial Sequence
  Synthetic Polynucleotide
taatacgactcactatagggttattctgatgatgggtgaactttggaaccaacagaggagaggttccatggttcacccaaacctggcggcagcgcaaaagatg

SEQ ID NO: 186583 - DNA, 103 bp, Artificial Sequence
  Synthetic Polynucleotide
taatacgactcactatagggcgtgatggtgttattctgatgatgggtgaaaacagaggagattcaccatgcatcagaataacctggcggcagcgcaaaagatg

SEQ ID NO: 186584 - DNA, 103 bp, Artificial Sequence
  Synthetic Polynucleotide
taatacgactcactatagggtcctcttgagcgtgatggtgttattctgataacagaggagaatcagaatgacaccatcaaacctggcggcagcgcaaaagatg

SEQ ID NO: 186585 - DNA, 103 bp, Artificial Sequence
  Synthetic Polynucleotide
taatacgactcactatagggagaattaagctcctcttgagcgtgatggtgaacagaggagacaccatatggctcaagagaacctggcggcagcgcaaaagatg

SEQ ID NO: 186586 - DNA, 103 bp, Artificial Sequence
  Synthetic Polynucleotide
taatacgactcactatagggtctgcttgagagaattaagctcctcttgagaacagaggagactcaagatgagcttaattaacctggcggcagcgcaaaagatg

SEQ ID NO: 186587 - DNA, 103 bp, Artificial Sequence
  Synthetic Polynucleotide
taatacgactcactatagggggatgccgtgtctgcttgagagaattaagcaacagaggagagcttaaatgtctcaagcaaacctggcggcagcgcaaaagatg

SEQ ID NO: 186588 - DNA, 103 bp, Artificial Sequence
  Synthetic Polynucleotide
taatacgactcactatagggagcttgcgccggatgccgtgtctgcttgagaacagaggagactcaagatgacacggcataacctggcggcagcgcaaaagatg

SEQ ID NO: 186589 - DNA, 103 bp, Artificial Sequence
  Synthetic Polynucleotide
taatacgactcactatagggctgtttgatgagcttgcgccggatgccgtgaacagaggagacacggcatgcggcgcaagaacctggcggcagcgcaaaagatg

SEQ ID NO: 186590 - DNA, 103 bp, Artificial Sequence
  Synthetic Polynucleotide
taatacgactcactataggggctccccgagctgtttgatgagcttgcgccaacagaggagaggcgcaatgtcatcaaacaacctggcggcagcgcaaaagatg

SEQ ID NO: 186591 - DNA, 103 bp, Artificial Sequence
  Synthetic Polynucleotide
taatacgactcactatagggacccgcttgtgctccccgagctgtttgatgaacagaggagacatcaaatggctcggggaaacctggcggcagcgcaaaagatg

SEQ ID NO: 186592 - DNA, 103 bp, Artificial Sequence
  Synthetic Polynucleotide
taatacgactcactataggggcgggcggcgcgcagggcgatcccggagcgaacagaggagacgctccatgatcgccctgaacctggcggcagcgcaaaagatg

SEQ ID NO: 186593 - DNA, 103 bp, Artificial Sequence
  Synthetic Polynucleotide
taatacgactcactataggggcactggtaaacccgcttgtgctccccgagaacagaggagactcgggatgcacaagcggaacctggcggcagcgcaaaagatg

SEQ ID NO: 186594 - DNA, 103 bp, Artificial Sequence
  Synthetic Polynucleotide
taatacgactcactatagggtgcagatattgcactggtaaacccgcttgtaacagaggagaacaagcatgtttaccagtaacctggcggcagcgcaaaagatg

SEQ ID NO: 186595 - DNA, 103 bp, Artificial Sequence
  Synthetic Polynucleotide
taatacgactcactatagggaagatcttgctgcagatattgcactggtaaaacagaggagattaccaatgcaatatctgaacctggcggcagcgcaaaagatg

SEQ ID NO: 186596 - DNA, 103 bp, Artificial Sequence
  Synthetic Polynucleotide
taatacgactcactataggggctgttctggaagatcttgctgcagatattaacagaggagaaatatcatgagcaagatcaacctggcggcagcgcaaaagatg

SEQ ID NO: 186597 - DNA, 103 bp, Artificial Sequence
  Synthetic Polynucleotide
taatacgactcactatagggtcaggttgctgctgttctggaagatcttgcaacagaggagagcaagaatgtccagaacaaacctggcggcagcgcaaaagatg

SEQ ID NO: 186598 - DNA, 103 bp, Artificial Sequence
  Synthetic Polynucleotide
taatacgactcactatagggacgtgcctgctcaggttgctgctgttctggaacagaggagaccagaaatgcagcaacctaacctggcggcagcgcaaaagatg

SEQ ID NO: 186599 - DNA, 103 bp, Artificial Sequence
  Synthetic Polynucleotide
taatacgactcactatagggatgcgagcgcacgtgcctgctcaggttgctaacagaggagaagcaacatgagcaggcacaacctggcggcagcgcaaaagatg

SEQ ID NO: 186600 - DNA, 103 bp, Artificial Sequence
  Synthetic Polynucleotide
taatacgactcactataggggcttgtcaccatgcgagcgcacgtgcctgcaacagaggagagcaggcatgtgcgctcgcaacctggcggcagcgcaaaagatg

SEQ ID NO: 186601 - DNA, 103 bp, Artificial Sequence
  Synthetic Polynucleotide
taatacgactcactatagggcacttaaacagcttgtcaccatgcgagcgcaacagaggagagcgctcatgtggtgacaaaacctggcggcagcgcaaaagatg

SEQ ID NO: 186602 - DNA, 103 bp, Artificial Sequence
  Synthetic Polynucleotide
taatacgactcactatagggacactcttcgcacttaaacagcttgtcaccaacagaggagaggtgacatgctgtttaagaacctggcggcagcgcaaaagatg

SEQ ID NO: 186603 - DNA, 103 bp, Artificial Sequence
  Synthetic Polynucleotide
taatacgactcactatagggaccccggcgggcgggcggcgcgcagggcgaaacagaggagatcgcccatggcgccgcccaacctggcggcagcgcaaaagatg

SEQ ID NO: 186604 - DNA, 103 bp, Artificial Sequence
  Synthetic Polynucleotide
taatacgactcactatagggacaattttgcacactcttcgcacttaaacaaacagaggagatgtttaatggcgaagagtaacctggcggcagcgcaaaagatg

SEQ ID NO: 186605 - DNA, 103 bp, Artificial Sequence
  Synthetic Polynucleotide
taatacgactcactatagggttgcggctgaacaattttgcacactcttcgaacagaggagacgaagaatgtgcaaaattaacctggcggcagcgcaaaagatg

SEQ ID NO: 186606 - DNA, 103 bp, Artificial Sequence
  Synthetic Polynucleotide
taatacgactcactatagggtaggctctctttgcggctgaacaattttgcaacagaggagagcaaaaatgttcagccgcaacctggcggcagcgcaaaagatg

SEQ ID NO: 186607 - DNA, 103 bp, Artificial Sequence
  Synthetic Polynucleotide
taatacgactcactatagggcgtgctgctttaggctctctttgcggctgaaacagaggagatcagccatgaagagagccaacctggcggcagcgcaaaagatg

SEQ ID NO: 186608 - DNA, 103 bp, Artificial Sequence
  Synthetic Polynucleotide
taatacgactcactatagggttgtaggaaacgtgctgctttaggctctctaacagaggagaagagagatgaaagcagcaaacctggcggcagcgcaaaagatg

SEQ ID NO: 186609 - DNA, 103 bp, Artificial Sequence
  Synthetic Polynucleotide
taatacgactcactatagggcctgctgtgcttgtaggaaacgtgctgcttaacagaggagaaagcagatggtttcctacaacctggcggcagcgcaaaagatg

SEQ ID NO: 186610 - DNA, 103 bp, Artificial Sequence
  Synthetic Polynucleotide
taatacgactcactatagggccacctcgttcctgctgtgcttgtaggaaaaacagaggagatttcctatgagcacagcaaacctggcggcagcgcaaaagatg

SEQ ID NO: 186611 - DNA, 103 bp, Artificial Sequence
  Synthetic Polynucleotide
taatacgactcactatagggtactcgccgtccacctcgttcctgctgtgcaacagaggagagcacagatggaacgaggtaacctggcggcagcgcaaaagatg

SEQ ID NO: 186612 - DNA, 103 bp, Artificial Sequence
  Synthetic Polynucleotide
taatacgactcactataggggcggtacctgtactcgccgtccacctcgttaacagaggagaaacgagatggacggcgagaacctggcggcagcgcaaaagatg

SEQ ID NO: 186613 - DNA, 103 bp, Artificial Sequence
  Synthetic Polynucleotide
taatacgactcactatagggaagtgccgcagcggtacctgtactcgccgtaacagaggagaacggcgatgacaggtaccaacctggcggcagcgcaaaagatg

SEQ ID NO: 186614 - DNA, 103 bp, Artificial Sequence
  Synthetic Polynucleotide
taatacgactcactatagggggcggcgaagaccccggcgggcgggcggcgaacagaggagacgccgcatgcccgccgggaacctggcggcagcgcaaaagatg

SEQ ID NO: 186615 - DNA, 103 bp, Artificial Sequence
  Synthetic Polynucleotide
taatacgactcactataggggtcttctcacaagtgccgcagcggtacctgaacagaggagacaggtaatgctgcggcacaacctggcggcagcgcaaaagatg

SEQ ID NO: 186616 - DNA, 103 bp, Artificial Sequence
  Synthetic Polynucleotide
taatacgactcactataggggatgcggaaggtcttctcacaagtgccgcaaacagaggagatgcggcatgtgtgagaagaacctggcggcagcgcaaaagatg

SEQ ID NO: 186617 - DNA, 103 bp, Artificial Sequence
  Synthetic Polynucleotide
taatacgactcactataggggcgcgctctcgatgcggaaggtcttctcacaacagaggagagtgagaatgccttccgcaaacctggcggcagcgcaaaagatg

SEQ ID NO: 186618 - DNA, 103 bp, Artificial Sequence
  Synthetic Polynucleotide
taatacgactcactatagggtggaactccagcgcgctctcgatgcggaagaacagaggagacttccgatgcgagagcgcaacctggcggcagcgcaaaagatg

SEQ ID NO: 186619 - DNA, 103 bp, Artificial Sequence
  Synthetic Polynucleotide
taatacgactcactatagggcctgcagttgtggaactccagcgcgctctcaacagaggagagagagcatgctggagttcaacctggcggcagcgcaaaagatg

SEQ ID NO: 186620 - DNA, 103 bp, Artificial Sequence
  Synthetic Polynucleotide
taatacgactcactatagggtgtcatctgtcctgcagttgtggaactccaaacagaggagatggagtatgacaactgcaaacctggcggcagcgcaaaagatg

SEQ ID NO: 186621 - DNA, 103 bp, Artificial Sequence
  Synthetic Polynucleotide
taatacgactcactatagggtggaacgtcttgtcatctgtcctgcagttgaacagaggagacaactgatggacagatgaaacctggcggcagcgcaaaagatg

SEQ ID NO: 186622 - DNA, 103 bp, Artificial Sequence
  Synthetic Polynucleotide
taatacgactcactatagggcatctcacattggaacgtcttgtcatctgtaacagaggagaacagatatgaagacgttcaacctggcggcagcgcaaaagatg

SEQ ID NO: 186623 - DNA, 103 bp, Artificial Sequence
  Synthetic Polynucleotide
taatacgactcactatagggatctgaaacacatctcacattggaacgtctaacagaggagaagacgtatgaatgtgagaaacctggcggcagcgcaaaagatg

SEQ ID NO: 186624 - DNA, 103 bp, Artificial Sequence
  Synthetic Polynucleotide
taatacgactcactataggggtggagaagaatctgaaacacatctcacataacagaggagaatgtgaatggtgtttcagaacctggcggcagcgcaaaagatg

SEQ ID NO: 186625 - DNA, 103 bp, Artificial Sequence
  Synthetic Polynucleotide
taatacgactcactatagggcgcgggccggggcggcgaagaccccggcggaacagaggagaccgccgatgtcttcgccgaacctggcggcagcgcaaaagatg

SEQ ID NO: 186626 - DNA, 103 bp, Artificial Sequence
  Synthetic Polynucleotide
taatacgactcactataggggttgctgttggtggagaagaatctgaaacaaacagaggagatgtttcatgttcttctccaacctggcggcagcgcaaaagatg

SEQ ID NO: 186627 - DNA, 103 bp, Artificial Sequence
  Synthetic Polynucleotide
taatacgactcactataggggcttggagaggttgctgttggtggagaagaaacagaggagatcttctatgccaacagcaaacctggcggcagcgcaaaagatg

SEQ ID NO: 186628 - DNA, 103 bp, Artificial Sequence
  Synthetic Polynucleotide
taatacgactcactatagggttcttcttgtgcttggagaggttgctgttgaacagaggagacaacagatgcctctccaaaacctggcggcagcgcaaaagatg

SEQ ID NO: 186629 - DNA, 103 bp, Artificial Sequence
  Synthetic Polynucleotide
taatacgactcactataggggtcgccgtgcttcttcttgtgcttggagagaacagaggagactctccatgcacaagaagaacctggcggcagcgcaaaagatg

SEQ ID NO: 186630 - DNA, 103 bp, Artificial Sequence
  Synthetic Polynucleotide
taatacgactcactatagggcaaacttcttgtcgccgtgcttcttcttgtaacagaggagaacaagaatgagcacggcgaacctggcggcagcgcaaaagatg

SEQ ID NO: 186631 - DNA, 103 bp, Artificial Sequence
  Synthetic Polynucleotide
taatacgactcactatagggacctcacaggcaaacttcttgtcgccgtgcaacagaggagagcacggatgcaagaagttaacctggcggcagcgcaaaagatg

SEQ ID NO: 186632 - DNA, 103 bp, Artificial Sequence
  Synthetic Polynucleotide
taatacgactcactatagggcttgctgcagacctcacaggcaaacttcttaacagaggagaaagaagatggcctgtgagaacctggcggcagcgcaaaagatg

SEQ ID NO: 186633 - DNA, 103 bp, Artificial Sequence
  Synthetic Polynucleotide
taatacgactcactatagggggtagaacatcttgctgcagacctcacaggaacagaggagacctgtgatgtctgcagcaaacctggcggcagcgcaaaagatg

SEQ ID NO: 186634 - DNA, 103 bp, Artificial Sequence
  Synthetic Polynucleotide
taatacgactcactatagggacgtccttgcggtagaacatcttgctgcagaacagaggagactgcagatggatgttctaaacctggcggcagcgcaaaagatg

SEQ ID NO: 186635 - DNA, 103 bp, Artificial Sequence
  Synthetic Polynucleotide
taatacgactcactataggggtccagcatgacgtccttgcggtagaacataacagaggagaatgttcatgcgcaaggacaacctggcggcagcgcaaaagatg

SEQ ID NO: 186636 - DNA, 103 bp, Artificial Sequence
  Synthetic Polynucleotide
taatacgactcactataggggccgcggggccgcgggccggggcggcgaagaacagaggagacttcgcatgcccggcccgaacctggcggcagcgcaaaagatg

SEQ ID NO: 186637 - DNA, 103 bp, Artificial Sequence
  Synthetic Polynucleotide
taatacgactcactatagggggcgctggtggtccagcatgacgtccttgcaacagaggagagcaaggatgtcatgctggaacctggcggcagcgcaaaagatg

SEQ ID NO: 186638 - DNA, 103 bp, Artificial Sequence
  Synthetic Polynucleotide
taatacgactcactatagggtccaggtgccggcgctggtggtccagcatgaacagaggagacatgctatgccaccagcgaacctggcggcagcgcaaaagatg

SEQ ID NO: 186639 - DNA, 103 bp, Artificial Sequence
  Synthetic Polynucleotide
taatacgactcactatagggccgcactccttccaggtgccggcgctggtgaacagaggagacaccagatgcggcacctgaacctggcggcagcgcaaaagatg

SEQ ID NO: 186640 - DNA, 103 bp, Artificial Sequence
  Synthetic Polynucleotide
taatacgactcactataggggcttcactcgccgcactccttccaggtgccaacagaggagaggcaccatgaaggagtgcaacctggcggcagcgcaaaagatg

SEQ ID NO: 186641 - DNA, 103 bp, Artificial Sequence
  Synthetic Polynucleotide
taatacgactcactatagggaggtcctctcgcttcactcgccgcactcctaacagaggagaaggagtatggcgagtgaaaacctggcggcagcgcaaaagatg

SEQ ID NO: 186642 - DNA, 103 bp, Artificial Sequence
  Synthetic Polynucleotide
taatacgactcactatagggaccggcctccaggtcctctcgcttcactcgaacagaggagacgagtgatgcgagaggacaacctggcggcagcgcaaaagatg

SEQ ID NO: 186643 - DNA, 103 bp, Artificial Sequence
  Synthetic Polynucleotide
taatacgactcactatagggggttctccccaccggcctccaggtcctctcaacagaggagagagaggatgtggaggccgaacctggcggcagcgcaaaagatg

SEQ ID NO: 186644 - DNA, 103 bp, Artificial Sequence
  Synthetic Polynucleotide
taatacgactcactatagggtaacggaccaggttctccccaccggcctccaacagaggagaggaggcatgtggggagaaaacctggcggcagcgcaaaagatg

SEQ ID NO: 186645 - DNA, 103 bp, Artificial Sequence
  Synthetic Polynucleotide
taatacgactcactatagggctccttcttgtaacggaccaggttctccccaacagaggagaggggagatgctggtccgtaacctggcggcagcgcaaaagatg

SEQ ID NO: 186646 - DNA, 103 bp, Artificial Sequence
  Synthetic Polynucleotide
taatacgactcactatagggacccggaaggctccttcttgtaacggaccaaacagaggagatggtccatgacaagaaggaacctggcggcagcgcaaaagatg

SEQ ID NO: 186647 - DNA, 103 bp, Artificial Sequence
  Synthetic Polynucleotide
taatacgactcactatagggggcggcgggggccgcggggccgcgggccggaacagaggagaccggccatgggccccgcgaacctggcggcagcgcaaaagatg

SEQ ID NO: 186648 - DNA, 103 bp, Artificial Sequence
  Synthetic Polynucleotide
taatacgactcactatagggcacaccgggcacccggaaggctccttcttgaacagaggagacaagaaatggccttccggaacctggcggcagcgcaaaagatg

SEQ ID NO: 186649 - DNA, 103 bp, Artificial Sequence
  Synthetic Polynucleotide
taatacgactcactatagggcaccttgccacacaccgggcacccggaaggaacagaggagaccttccatgtgcccggtgaacctggcggcagcgcaaaagatg

SEQ ID NO: 186650 - DNA, 103 bp, Artificial Sequence
  Synthetic Polynucleotide
taatacgactcactatagggggcaggagaacaccttgccacacaccgggcaacagaggagagcccggatggtggcaaggaacctggcggcagcgcaaaagatg

SEQ ID NO: 186651 - DNA, 103 bp, Artificial Sequence
  Synthetic Polynucleotide
taatacgactcactatagggatattgctccggcaggagaacaccttgccaaacagaggagatggcaaatggttctcctgaacctggcggcagcgcaaaagatg

SEQ ID NO: 186652 - DNA, 103 bp, Artificial Sequence
  Synthetic Polynucleotide
taatacgactcactataggggtgcttgttcatattgctccggcaggagaaaacagaggagattctccatgcggagcaataacctggcggcagcgcaaaagatg

SEQ ID NO: 186653 - DNA, 103 bp, Artificial Sequence
  Synthetic Polynucleotide
taatacgactcactataggggggtgagcaggtgcttgttcatattgctccaacagaggagaggagcaatgtgaacaagcaacctggcggcagcgcaaaagatg

SEQ ID NO: 186654 - DNA, 103 bp, Artificial Sequence
  Synthetic Polynucleotide
taatacgactcactatagggttgtcgccgtgggtgagcaggtgcttgttcaacagaggagagaacaaatgcctgctcacaacctggcggcagcgcaaaagatg

SEQ ID NO: 186655 - DNA, 103 bp, Artificial Sequence
  Synthetic Polynucleotide
taatacgactcactatagggggtgtacttcttgtcgccgtgggtgagcagaacagaggagactgctcatgcacggcgacaacctggcggcagcgcaaaagatg

SEQ ID NO: 186656 - DNA, 103 bp, Artificial Sequence
  Synthetic Polynucleotide
taatacgactcactatagggagatctcgcaggtgtacttcttgtcgccgtaacagaggagaacggcgatgagaagtacaaacctggcggcagcgcaaaagatg

SEQ ID NO: 186657 - DNA, 103 bp, Artificial Sequence
  Synthetic Polynucleotide
taatacgactcactatagggttgcgcccgcagatctcgcaggtgtacttcaacagaggagagaagtaatgctgcgagataacctggcggcagcgcaaaagatg

SEQ ID NO: 186658 - DNA, 103 bp, Artificial Sequence
  Synthetic Polynucleotide
taatacgactcactataggggacgccgcccggcggcgggggccgcggggcaacagaggagagccccgatgcccccgccgaacctggcggcagcgcaaaagatg

SEQ ID NO: 186659 - DNA, 103 bp, Artificial Sequence
  Synthetic Polynucleotide
taatacgactcactataggggcggaagaacttgcgcccgcagatctcgcaaacagaggagatgcgagatgtgcgggcgcaacctggcggcagcgcaaaagatg

SEQ ID NO: 186660 - DNA, 103 bp, Artificial Sequence
  Synthetic Polynucleotide
taatacgactcactataggggcacatccacgcggaagaacttgcgcccgcaacagaggagagcgggcatgagttcttccaacctggcggcagcgcaaaagatg

SEQ ID NO: 186661 - DNA, 103 bp, Artificial Sequence
  Synthetic Polynucleotide
taatacgactcactatagggtggtccctgagcacatccacgcggaagaacaacagaggagagttcttatgcgtggatgtaacctggcggcagcgcaaaagatg

SEQ ID NO: 186662 - DNA, 103 bp, Artificial Sequence
  Synthetic Polynucleotide
taatacgactcactataggggacatggatgtggtccctgagcacatccacaacagaggagagtggatatgctcagggacaacctggcggcagcgcaaaagatg

SEQ ID NO: 186663 - DNA, 103 bp, Artificial Sequence
  Synthetic Polynucleotide
taatacgactcactatagggccttgaagtggacatggatgtggtccctgaaacagaggagatcagggatgacatccatgaacctggcggcagcgcaaaagatg

SEQ ID NO: 186664 - DNA, 103 bp, Artificial Sequence
  Synthetic Polynucleotide
taatacgactcactatagggaacgcgatgtccttgaagtggacatggatgaacagaggagacatccaatgccacttcaaaacctggcggcagcgcaaaagatg

SEQ ID NO: 186665 - DNA, 103 bp, Artificial Sequence
  Synthetic Polynucleotide
taatacgactcactataggggtcatccatcaacgcgatgtccttgaagtgaacagaggagacacttcatggacatcgcgaacctggcggcagcgcaaaagatg

SEQ ID NO: 186666 - DNA, 103 bp, Artificial Sequence
  Synthetic Polynucleotide
taatacgactcactatagggccctctggtggtcatccatcaacgcgatgtaacagaggagaacatcgatgtgatggatgaacctggcggcagcgcaaaagatg

SEQ ID NO: 186667 - DNA, 103 bp, Artificial Sequence
  Synthetic Polynucleotide
taatacgactcactatagggataaactcttccctctggtggtcatccatcaacagaggagagatggaatgccaccagagaacctggcggcagcgcaaaagatg

SEQ ID NO: 186668 - DNA, 103 bp, Artificial Sequence
  Synthetic Polynucleotide
taatacgactcactataggggatcttgccgataaactcttccctctggtgaacagaggagacaccagatggaagagtttaacctggcggcagcgcaaaagatg

SEQ ID NO: 186669 - DNA, 103 bp, Artificial Sequence
  Synthetic Polynucleotide
taatacgactcactatagggcctcggcgacgacgccgcccggcggcggggaacagaggagaccccgcatgcgggcggcgaacctggcggcagcgcaaaagatg

SEQ ID NO: 186670 - DNA, 103 bp, Artificial Sequence
  Synthetic Polynucleotide
taatacgactcactatagggaggagatcccgatcttgccgataaactcttaacagaggagaaagagtatgtcggcaagaaacctggcggcagcgcaaaagatg

SEQ ID NO: 186671 - DNA, 103 bp, Artificial Sequence
  Synthetic Polynucleotide
taatacgactcactatagggttttcttccgaggagatcccgatcttgccgaacagaggagacggcaaatgcgggatctcaacctggcggcagcgcaaaagatg

SEQ ID NO: 186672 - DNA, 103 bp, Artificial Sequence
  Synthetic Polynucleotide
taatacgactcactatagggattgtcatcgttttcttccgaggagatcccaacagaggagagggatcatgtcggaagaaaacctggcggcagcgcaaaagatg

SEQ ID NO: 186673 - DNA, 103 bp, Artificial Sequence
  Synthetic Polynucleotide
taatacgactcactatagggtctcgtcagaattgtcatcgttttcttccgaacagaggagacggaagatgacgatgacaaacctggcggcagcgcaaaagatg

SEQ ID NO: 186674 - DNA, 103 bp, Artificial Sequence
  Synthetic Polynucleotide
taatacgactcactataggggagtctgcgctctcgtcagaattgtcatcgaacagaggagacgatgaatgttctgacgaaacctggcggcagcgcaaaagatg

SEQ ID NO: 186675 - DNA, 103 bp, Artificial Sequence
  Synthetic Polynucleotide
taatacgactcactataggggtgaggctccgagtctgcgctctcgtcagaaacagaggagatctgacatgagcgcagacaacctggcggcagcgcaaaagatg

SEQ ID NO: 186676 - DNA, 103 bp, Artificial Sequence
  Synthetic Polynucleotide
taatacgactcactatagggagctgtacttgtgaggctccgagtctgcgcaacagaggagagcgcagatgcggagcctcaacctggcggcagcgcaaaagatg

SEQ ID NO: 186677 - DNA, 103 bp, Artificial Sequence
  Synthetic Polynucleotide
taatacgactcactatagggcaccgcttgcagctgtacttgtgaggctccaacagaggagaggagccatgcaagtacagaacctggcggcagcgcaaaagatg

SEQ ID NO: 186678 - DNA, 103 bp, Artificial Sequence
  Synthetic Polynucleotide
taatacgactcactatagggggtgagctggcaccgcttgcagctgtacttaacagaggagaaagtacatgtgcaagcggaacctggcggcagcgcaaaagatg

SEQ ID NO: 186679 - DNA, 103 bp, Artificial Sequence
  Synthetic Polynucleotide
taatacgactcactatagggcccggccgaaggtgagctggcaccgcttgcaacagaggagagcaagcatggccagctcaaacctggcggcagcgcaaaagatg

SEQ ID NO: 186680 - DNA, 103 bp, Artificial Sequence
  Synthetic Polynucleotide
taatacgactcactatagggcgctccggaaactgcgcagcaccggaagccaacagaggagaggcttcatgtgctgcgcaaacctggcggcagcgcaaaagatg

SEQ ID NO: 186681 - DNA, 103 bp, Artificial Sequence
  Synthetic Polynucleotide
taatacgactcactatagggtcccctggggcctcggcgacgacgccgcccaacagaggagagggcggatgcgtcgccgaaacctggcggcagcgcaaaagatg

SEQ ID NO: 186682 - DNA, 103 bp, Artificial Sequence
  Synthetic Polynucleotide
taatacgactcactatagggtactccttcccccggccgaaggtgagctggaacagaggagaccagctatgcttcggccgaacctggcggcagcgcaaaagatg

SEQ ID NO: 186683 - DNA, 103 bp, Artificial Sequence
  Synthetic Polynucleotide
taatacgactcactataggggtgcttcaggtactccttcccccggccgaaaacagaggagattcggcatggggaaggagaacctggcggcagcgcaaaagatg

SEQ ID NO: 186684 - DNA, 103 bp, Artificial Sequence
  Synthetic Polynucleotide
taatacgactcactatagggcctccatgatgtgcttcaggtactccttccaacagaggagaggaaggatgacctgaagcaacctggcggcagcgcaaaagatg

SEQ ID NO: 186685 - DNA, 103 bp, Artificial Sequence
  Synthetic Polynucleotide
taatacgactcactatagggtccttgtgcacctccatgatgtgcttcaggaacagaggagacctgaaatgcatcatggaaacctggcggcagcgcaaaagatg

SEQ ID NO: 186686 - DNA, 103 bp, Artificial Sequence
  Synthetic Polynucleotide
taatacgactcactatagggatagcccttctccttgtgcacctccatgataacagaggagaatcatgatggtgcacaagaacctggcggcagcgcaaaagatg

SEQ ID NO: 186687 - DNA, 103 bp, Artificial Sequence
  Synthetic Polynucleotide
taatacgactcactatagggtgctgcagccatagcccttctccttgtgcaaacagaggagatgcacaatgagaagggctaacctggcggcagcgcaaaagatg

SEQ ID NO: 186688 - DNA, 103 bp, Artificial Sequence
  Synthetic Polynucleotide
taatacgactcactatagggcggttgcagatgctgcagccatagcccttcaacagaggagagaagggatgtggctgcagaacctggcggcagcgcaaaagatg

SEQ ID NO: 186689 - DNA, 103 bp, Artificial Sequence
  Synthetic Polynucleotide
taatacgactcactatagggtgcaaagcgccggttgcagatgctgcagccaacagaggagaggctgcatgatctgcaacaacctggcggcagcgcaaaagatg

SEQ ID NO: 186690 - DNA, 103 bp, Artificial Sequence
  Synthetic Polynucleotide
taatacgactcactatagggtggccttcagtgcaaagcgccggttgcagaaacagaggagatctgcaatgggcgctttgaacctggcggcagcgcaaaagatg

SEQ ID NO: 186691 - DNA, 103 bp, Artificial Sequence
  Synthetic Polynucleotide
taatacgactcactataggggcgtggtaggtggccttcagtgcaaagcgcaacagaggagagcgcttatgactgaaggcaacctggcggcagcgcaaaagatg

SEQ ID NO: 186692 - DNA, 103 bp, Artificial Sequence
  Synthetic Polynucleotide
taatacgactcactataggggataacgacatcccctggggcctcggcgacaacagaggagagtcgccatggccccagggaacctggcggcagcgcaaaagatg

SEQ ID NO: 186693 - DNA, 103 bp, Artificial Sequence
  Synthetic Polynucleotide
taatacgactcactataggggaccatgtgggcgtggtaggtggccttcagaacagaggagactgaagatgacctaccacaacctggcggcagcgcaaaagatg

SEQ ID NO: 186694 - DNA, 103 bp, Artificial Sequence
  Synthetic Polynucleotide
taatacgactcactatagggcacggtggatgaccatgtgggcgtggtaggaacagaggagacctaccatgcccacatggaacctggcggcagcgcaaaagatg

SEQ ID NO: 186695 - DNA, 103 bp, Artificial Sequence
  Synthetic Polynucleotide
taatacgactcactatagggggcaggttttcacggtggatgaccatgtggaacagaggagaccacatatgcatccaccgaacctggcggcagcgcaaaagatg

SEQ ID NO: 186696 - DNA, 103 bp, Artificial Sequence
  Synthetic Polynucleotide
taatacgactcactataggggttggggtccggcaggttttcacggtggataacagaggagaatccacatggaaaacctgaacctggcggcagcgcaaaagatg

SEQ ID NO: 186697 - DNA, 103 bp, Artificial Sequence
  Synthetic Polynucleotide
taatacgactcactatagggacttctgcacgttggggtccggcaggttttaacagaggagaaaaaccatgcggaccccaaacctggcggcagcgcaaaagatg

SEQ ID NO: 186698 - DNA, 103 bp, Artificial Sequence
  Synthetic Polynucleotide
taatacgactcactataggggggtggatgtacttctgcacgttggggtccaacagaggagaggacccatgcgtgcagaaaacctggcggcagcgcaaaagatg

SEQ ID NO: 186699 - DNA, 103 bp, Artificial Sequence
  Synthetic Polynucleotide
taatacgactcactataggggatctcgcaggggtggatgtacttctgcacaacagaggagagtgcagatgtacatccacaacctggcggcagcgcaaaagatg

SEQ ID NO: 186700 - DNA, 103 bp, Artificial Sequence
  Synthetic Polynucleotide
taatacgactcactatagggtccgcccgcagatctcgcaggggtggatgtaacagaggagaacatccatgcctgcgagaaacctggcggcagcgcaaaagatg

SEQ ID NO: 186701 - DNA, 103 bp, Artificial Sequence
  Synthetic Polynucleotide
taatacgactcactatagggctgttgaagatccgcccgcagatctcgcagaacagaggagactgcgaatgctgcgggcgaacctggcggcagcgcaaaagatg

SEQ ID NO: 186702 - DNA, 103 bp, Artificial Sequence
  Synthetic Polynucleotide
taatacgactcactataggggttcccgatgctgttgaagatccgcccgcaaacagaggagatgcgggatgatcttcaacaacctggcggcagcgcaaaagatg

SEQ ID NO: 186703 - DNA, 103 bp, Artificial Sequence
  Synthetic Polynucleotide
taatacgactcactataggggagggcgggggataacgacatcccctggggaacagaggagaccccagatgatgtcgttaaacctggcggcagcgcaaaagatg

SEQ ID NO: 186704 - DNA, 103 bp, Artificial Sequence
  Synthetic Polynucleotide
taatacgactcactatagggggcgctccaggttcccgatgctgttgaagaaacagaggagatcttcaatggcatcgggaaacctggcggcagcgcaaaagatg

SEQ ID NO: 186705 - DNA, 103 bp, Artificial Sequence
  Synthetic Polynucleotide
taatacgactcactatagggatgagcttgtggcgctccaggttcccgatgaacagaggagacatcggatgcctggagcgaacctggcggcagcgcaaaagatg

SEQ ID NO: 186706 - DNA, 103 bp, Artificial Sequence
  Synthetic Polynucleotide
taatacgactcactatagggacctgtgtggatgagcttgtggcgctccagaacagaggagactggagatgcacaagctcaacctggcggcagcgcaaaagatg

SEQ ID NO: 186707 - DNA, 103 bp, Artificial Sequence
  Synthetic Polynucleotide
taatacgactcactatagggggctcttcacacctgtgtggatgagcttgtaacagaggagaacaagcatgtccacacagaacctggcggcagcgcaaaagatg

SEQ ID NO: 186708 - DNA, 103 bp, Artificial Sequence
  Synthetic Polynucleotide
taatacgactcactatagggtcgcaggcgtggctcttcacacctgtgtggaacagaggagaccacacatgtgtgaagagaacctggcggcagcgcaaaagatg

SEQ ID NO: 186709 - DNA, 103 bp, Artificial Sequence
  Synthetic Polynucleotide
taatacgactcactatagggcccacactgctcgcaggcgtggctcttcacaacagaggagagtgaagatgcacgcctgcaacctggcggcagcgcaaaagatg

SEQ ID NO: 186710 - DNA, 103 bp, Artificial Sequence
  Synthetic Polynucleotide
taatacgactcactatagggcaaaggacttcccacactgctcgcaggcgtaacagaggagaacgcctatgagcagtgtgaacctggcggcagcgcaaaagatg

SEQ ID NO: 186711 - DNA, 103 bp, Artificial Sequence
  Synthetic Polynucleotide
taatacgactcactatagggtccttcctggcaaaggacttcccacactgcaacagaggagagcagtgatggaagtccttaacctggcggcagcgcaaaagatg

SEQ ID NO: 186712 - DNA, 103 bp, Artificial Sequence
  Synthetic Polynucleotide
taatacgactcactatagggcttcagcatgtccttcctggcaaaggacttaacagaggagaaagtccatggccaggaagaacctggcggcagcgcaaaagatg

SEQ ID NO: 186713 - DNA, 103 bp, Artificial Sequence
  Synthetic Polynucleotide
taatacgactcactataggggcatgtgctccttcagcatgtccttcctggaacagaggagaccaggaatgacatgctgaaacctggcggcagcgcaaaagatg

SEQ ID NO: 186714 - DNA, 103 bp, Artificial Sequence
  Synthetic Polynucleotide
taatacgactcactatagggggctgtacccgagggcgggggataacgacaaacagaggagatgtcgtatgcccccgcccaacctggcggcagcgcaaaagatg

SEQ ID NO: 186715 - DNA, 103 bp, Artificial Sequence
  Synthetic Polynucleotide
taatacgactcactatagggtcgtgcacacgcatgtgctccttcagcatgaacagaggagacatgctatgggagcacataacctggcggcagcgcaaaagatg

SEQ ID NO: 186716 - DNA, 103 bp, Artificial Sequence
  Synthetic Polynucleotide
taatacgactcactataggggcggacattgtcgtgcacacgcatgtgctcaacagaggagagagcacatgcgtgtgcacaacctggcggcagcgcaaaagatg

SEQ ID NO: 186717 - DNA, 103 bp, Artificial Sequence
  Synthetic Polynucleotide
taatacgactcactatagggacaggtactcgcggacattgtcgtgcacacaacagaggagagtgtgcatgacaatgtccaacctggcggcagcgcaaaagatg

SEQ ID NO: 186718 - DNA, 103 bp, Artificial Sequence
  Synthetic Polynucleotide
taatacgactcactatagggcactcggcacacaggtactcgcggacattgaacagaggagacaatgtatgcgagtacctaacctggcggcagcgcaaaagatg

SEQ ID NO: 186719 - DNA, 103 bp, Artificial Sequence
  Synthetic Polynucleotide
taatacgactcactataggggcctttcccacactcggcacacaggtactcaacagaggagagagtacatgtgtgccgagaacctggcggcagcgcaaaagatg

SEQ ID NO: 186720 - DNA, 103 bp, Artificial Sequence
  Synthetic Polynucleotide
taatacgactcactatagggtggtcttcatgcctttcccacactcggcacaacagaggagagtgccgatggtgggaaagaacctggcggcagcgcaaaagatg

SEQ ID NO: 186721 - DNA, 103 bp, Artificial Sequence
  Synthetic Polynucleotide
taatacgactcactatagggagcgcgtgcttggtcttcatgcctttcccaaacagaggagatgggaaatgcatgaagacaacctggcggcagcgcaaaagatg

SEQ ID NO: 186722 - DNA, 103 bp, Artificial Sequence
  Synthetic Polynucleotide
taatacgactcactataggggtggtggcgcagcgcgtgcttggtcttcataacagaggagaatgaagatgaagcacgcgaacctggcggcagcgcaaaagatg

SEQ ID NO: 186723 - DNA, 103 bp, Artificial Sequence
  Synthetic Polynucleotide
taatacgactcactataggggcagcttcatgtggtggcgcagcgcgtgctaacagaggagaagcacgatgtgcgccaccaacctggcggcagcgcaaaagatg

SEQ ID NO: 186724 - DNA, 103 bp, Artificial Sequence
  Synthetic Polynucleotide
taatacgactcactatagggatgcccttgtgcagcttcatgtggtggcgcaacagaggagagcgccaatgcatgaagctaacctggcggcagcgcaaaagatg

SEQ ID NO: 186725 - DNA, 103 bp, Artificial Sequence
  Synthetic Polynucleotide
taatacgactcactataggggacccgcatgggctgtacccgagggcggggaacagaggagaccccgcatgcgggtacagaacctggcggcagcgcaaaagatg

SEQ ID NO: 186726 - DNA, 103 bp, Artificial Sequence
  Synthetic Polynucleotide
taatacgactcactataggggtactccttgatgcccttgtgcagcttcataacagaggagaatgaagatgcacaagggcaacctggcggcagcgcaaaagatg

SEQ ID NO: 186727 - DNA, 103 bp, Artificial Sequence
  Synthetic Polynucleotide
taatacgactcactatagggccttgcactcgtactccttgatgcccttgtaacagaggagaacaaggatgtcaaggagtaacctggcggcagcgcaaaagatg

SEQ ID NO: 186728 - DNA, 103 bp, Artificial Sequence
  Synthetic Polynucleotide
taatacgactcactatagggcggtggcactccttgcactcgtactccttgaacagaggagacaaggaatgcgagtgcaaaacctggcggcagcgcaaaagatg

SEQ ID NO: 186729 - DNA, 103 bp, Artificial Sequence
  Synthetic Polynucleotide
taatacgactcactatagggcgcgaacctgcggtggcactccttgcactcaacagaggagagagtgcatggagtgccacaacctggcggcagcgcaaaagatg

SEQ ID NO: 186730 - DNA, 103 bp, Artificial Sequence
  Synthetic Polynucleotide
taatacgactcactatagggtgaccttctgcgcgaacctgcggtggcactaacagaggagaagtgccatggcaggttcgaacctggcggcagcgcaaaagatg

SEQ ID NO: 186731 - DNA, 103 bp, Artificial Sequence
  Synthetic Polynucleotide
taatacgactcactatagggttgagcatgttgaccttctgcgcgaacctgaacagaggagacaggttatggcagaaggtaacctggcggcagcgcaaaagatg

SEQ ID NO: 186732 - DNA, 103 bp, Artificial Sequence
  Synthetic Polynucleotide
taatacgactcactatagggcttgcagtgcttgagcatgttgaccttctgaacagaggagacagaagatgaacatgctcaacctggcggcagcgcaaaagatg

SEQ ID NO: 186733 - DNA, 103 bp, Artificial Sequence
  Synthetic Polynucleotide
taatacgactcactatagggccgtgtgccgcttgcagtgcttgagcatgtaacagaggagaacatgcatgagcactgcaaacctggcggcagcgcaaaagatg

SEQ ID NO: 186734 - DNA, 103 bp, Artificial Sequence
  Synthetic Polynucleotide
taatacgactcactatagggtctttaatccccgtgtgccgcttgcagtgcaacagaggagagcactgatggcggcacacaacctggcggcagcgcaaaagatg

SEQ ID NO: 186735 - DNA, 103 bp, Artificial Sequence
  Synthetic Polynucleotide
taatacgactcactatagggacacatgaaatctttaatccccgtgtgccgaacagaggagacggcacatggggattaaaaacctggcggcagcgcaaaagatg

SEQ ID NO: 186736 - DNA, 103 bp, Artificial Sequence
  Synthetic Polynucleotide
taatacgactcactatagggccccccgtgcgacccgcatgggctgtacccaacagaggagagggtacatgccatgcgggaacctggcggcagcgcaaaagatg

SEQ ID NO: 186737 - DNA, 103 bp, Artificial Sequence
  Synthetic Polynucleotide
taatacgactcactatagggcacacaattcacacatgaaatctttaatccaacagaggagaggattaatgatttcatgtaacctggcggcagcgcaaaagatg

SEQ ID NO: 186738 - DNA, 103 bp, Artificial Sequence
  Synthetic Polynucleotide
taatacgactcactatagggaatgtcttcccacacaattcacacatgaaaaacagaggagatttcatatgtgaattgtgaacctggcggcagcgcaaaagatg

SEQ ID NO: 186739 - DNA, 103 bp, Artificial Sequence
  Synthetic Polynucleotide
taatacgactcactatagggcctctcgctgaatgtcttcccacacaattcaacagaggagagaattgatggggaagacaaacctggcggcagcgcaaaagatg

SEQ ID NO: 186740 - DNA, 103 bp, Artificial Sequence
  Synthetic Polynucleotide
taatacgactcactatagggccatggtgttcctctcgctgaatgtcttccaacagaggagaggaagaatgtcagcgagaaacctggcggcagcgcaaaagatg

SEQ ID NO: 186741 - DNA, 103 bp, Artificial Sequence
  Synthetic Polynucleotide
taatacgactcactatagggttgtgggtctccatggtgttcctctcgctgaacagaggagacagcgaatggaacaccataacctggcggcagcgcaaaagatg

SEQ ID NO: 186742 - DNA, 103 bp, Artificial Sequence
  Synthetic Polynucleotide
taatacgactcactataggggtggatgagcttgtgggtctccatggtgttaacagaggagaaacaccatggagacccacaacctggcggcagcgcaaaagatg

SEQ ID NO: 186743 - DNA, 103 bp, Artificial Sequence
  Synthetic Polynucleotide
taatacgactcactatagggtgcccactgtgtggatgagcttgtgggtctaacagaggagaagacccatgagctcatccaacctggcggcagcgcaaaagatg

SEQ ID NO: 186744 - DNA, 103 bp, Artificial Sequence
  Synthetic Polynucleotide
taatacgactcactataggggtccactgcttgcccactgtgtggatgagcaacagaggagagctcatatgcacagtgggaacctggcggcagcgcaaaagatg

SEQ ID NO: 186745 - DNA, 103 bp, Artificial Sequence
  Synthetic Polynucleotide
taatacgactcactatagggcacggagcacgtccactgcttgcccactgtaacagaggagaacagtgatgaagcagtggaacctggcggcagcgcaaaagatg

SEQ ID NO: 186746 - DNA, 103 bp, Artificial Sequence
  Synthetic Polynucleotide
taatacgactcactatagggtcttgtcgcacacggagcacgtccactgctaacagaggagaagcagtatgcgtgctccgaacctggcggcagcgcaaaagatg

SEQ ID NO: 186747 - DNA, 103 bp, Artificial Sequence
  Synthetic Polynucleotide
taatacgactcactataggggtccagggacccccccgtgcgacccgcatgaacagaggagacatgcgatgcgcacggggaacctggcggcagcgcaaaagatg

SEQ ID NO: 186748 - DNA, 103 bp, Artificial Sequence
  Synthetic Polynucleotide
taatacgactcactataggggtcacgtacttcttgtcgcacacggagcacaacagaggagagtgctcatggtgcgacaaaacctggcggcagcgcaaaagatg

SEQ ID NO: 186749 - DNA, 103 bp, Artificial Sequence
  Synthetic Polynucleotide
taatacgactcactatagggcatgtactcggtcacgtacttcttgtcgcaaacagaggagatgcgacatgaagtacgtgaacctggcggcagcgcaaaagatg

SEQ ID NO: 186750 - DNA, 103 bp, Artificial Sequence
  Synthetic Polynucleotide
taatacgactcactataggggcttctgcagcatgtactcggtcacgtactaacagaggagaagtacgatgccgagtacaaacctggcggcagcgcaaaagatg

SEQ ID NO: 186751 - DNA, 103 bp, Artificial Sequence
  Synthetic Polynucleotide
taatacgactcactatagggagctgaacgtgcttctgcagcatgtactcgaacagaggagacgagtaatggctgcagaaaacctggcggcagcgcaaaagatg

SEQ ID NO: 186752 - DNA, 103 bp, Artificial Sequence
  Synthetic Polynucleotide
taatacgactcactataggggtcgtgtgtgagctgaacgtgcttctgcagaacagaggagactgcagatgcacgttcagaacctggcggcagcgcaaaagatg

SEQ ID NO: 186753 - DNA, 103 bp, Artificial Sequence
  Synthetic Polynucleotide
taatacgactcactatagggcctccaccttgtcgtgtgtgagctgaacgtaacagaggagaacgttcatgtcacacacgaacctggcggcagcgcaaaagatg

SEQ ID NO: 186754 - DNA, 103 bp, Artificial Sequence
  Synthetic Polynucleotide
taatacgactcactatagggcagctctgcgcctccaccttgtcgtgtgtgaacagaggagacacacaatgcaaggtggaaacctggcggcagcgcaaaagatg

SEQ ID NO: 186755 - DNA, 103 bp, Artificial Sequence
  Synthetic Polynucleotide
taatacgactcactataggggcacagctggcagctctgcgcctccaccttaacagaggagaaaggtgatggcgcagagcaacctggcggcagcgcaaaagatg

SEQ ID NO: 186756 - DNA, 103 bp, Artificial Sequence
  Synthetic Polynucleotide
taatacgactcactatagggccttggtcccgcacagctggcagctctgcgaacagaggagacgcagaatggccagctgtaacctggcggcagcgcaaaagatg

SEQ ID NO: 186757 - DNA, 103 bp, Artificial Sequence
  Synthetic Polynucleotide
taatacgactcactatagggctggtggacaccttggtcccgcacagctggaacagaggagaccagctatgcgggaccaaaacctggcggcagcgcaaaagatg

SEQ ID NO: 186758 - DNA, 103 bp, Artificial Sequence
  Synthetic Polynucleotide
taatacgactcactatagggggggttgggggtccagggacccccccgtgcaacagaggagagcacggatgggtccctggaacctggcggcagcgcaaaagatg

SEQ ID NO: 186759 - DNA, 103 bp, Artificial Sequence
  Synthetic Polynucleotide
taatacgactcactatagggcatggaggccctggtggacaccttggtcccaacagaggagagggaccatggtgtccaccaacctggcggcagcgcaaaagatg

SEQ ID NO: 186760 - DNA, 103 bp, Artificial Sequence
  Synthetic Polynucleotide
taatacgactcactatagggtgtgtcggctcatggaggccctggtggacaaacagaggagatgtccaatggggcctccaaacctggcggcagcgcaaaagatg

SEQ ID NO: 186761 - DNA, 103 bp, Artificial Sequence
  Synthetic Polynucleotide
taatacgactcactatagggttgcgccgcatgtgtcggctcatggaggccaacagaggagaggcctcatggagccgacaaacctggcggcagcgcaaaagatg

SEQ ID NO: 186762 - DNA, 103 bp, Artificial Sequence
  Synthetic Polynucleotide
taatacgactcactatagggctcggggtgcttgcgccgcatgtgtcggctaacagaggagaagccgaatgatgcggcgcaacctggcggcagcgcaaaagatg

SEQ ID NO: 186763 - DNA, 103 bp, Artificial Sequence
  Synthetic Polynucleotide
taatacgactcactatagggccgcgagcacctcggggtgcttgcgccgcaaacagaggagatgcggcatgagcaccccgaacctggcggcagcgcaaaagatg

SEQ ID NO: 186764 - DNA, 103 bp, Artificial Sequence
  Synthetic Polynucleotide
taatacgactcactatagggtcgatcctcaccgcgagcacctcggggtgcaacagaggagagcacccatgggtgctcgcaacctggcggcagcgcaaaagatg

SEQ ID NO: 186765 - DNA, 103 bp, Artificial Sequence
  Synthetic Polynucleotide
taatacgactcactataggggtccaggtcatcgatcctcaccgcgagcacaacagaggagagtgctcatggtgaggatcaacctggcggcagcgcaaaagatg

SEQ ID NO: 186766 - DNA, 103 bp, Artificial Sequence
  Synthetic Polynucleotide
taatacgactcactatagggccgggaggtggtccaggtcatcgatcctcaaacagaggagatgaggaatgatgacctggaacctggcggcagcgcaaaagatg

SEQ ID NO: 186767 - DNA, 103 bp, Artificial Sequence
  Synthetic Polynucleotide
taatacgactcactataggggtggtggtctccgggaggtggtccaggtcaaacagaggagatgacctatgccacctcccaacctggcggcagcgcaaaagatg

SEQ ID NO: 186768 - DNA, 103 bp, Artificial Sequence
  Synthetic Polynucleotide
taatacgactcactatagggggcgtcgatggtggtggtctccgggaggtgaacagaggagacacctcatggagaccaccaacctggcggcagcgcaaaagatg

SEQ ID NO: 186769 - DNA, 103 bp, Artificial Sequence
  Synthetic Polynucleotide
taatacgactcactatagggctctaaacgcggggttgggggtccagggacaacagaggagagtccctatgcccccaaccaacctggcggcagcgcaaaagatg

SEQ ID NO: 186770 - DNA, 103 bp, Artificial Sequence
  Synthetic Polynucleotide
taatacgactcactatagggcaatggaggaggcgtcgatggtggtggtctaacagaggagaagaccaatgccatcgacgaacctggcggcagcgcaaaagatg

SEQ ID NO: 186771 - DNA, 103 bp, Artificial Sequence
  Synthetic Polynucleotide
taatacgactcactatagggtggacgatgccaatggaggaggcgtcgatgaacagaggagacatcgaatgctcctccataacctggcggcagcgcaaaagatg

SEQ ID NO: 186772 - DNA, 103 bp, Artificial Sequence
  Synthetic Polynucleotide
taatacgactcactatagggcagctcaggctggacgatgccaatggaggaaacagaggagatcctccatgggcatcgtcaacctggcggcagcgcaaaagatg

SEQ ID NO: 186773 - DNA, 103 bp, Artificial Sequence
  Synthetic Polynucleotide
taatacgactcactataggggctccagagtcagctcaggctggacgatgcaacagaggagagcatcgatgagcctgagcaacctggcggcagcgcaaaagatg

SEQ ID NO: 186774 - DNA, 103 bp, Artificial Sequence
  Synthetic Polynucleotide
taatacgactcactatagggaaatcctcctgctccagagtcagctcaggcaacagaggagagcctgaatggactctggaaacctggcggcagcgcaaaagatg

SEQ ID NO: 186775 - DNA, 103 bp, Artificial Sequence
  Synthetic Polynucleotide
taatacgactcactatagggcccttcggccaaatcctcctgctccagagtaacagaggagaactctgatgcaggaggataacctggcggcagcgcaaaagatg

SEQ ID NO: 186776 - DNA, 103 bp, Artificial Sequence
  Synthetic Polynucleotide
taatacgactcactatagggtcccgtgcttcccttcggccaaatcctcctaacagaggagaaggaggatgtggccgaagaacctggcggcagcgcaaaagatg

SEQ ID NO: 186777 - DNA, 103 bp, Artificial Sequence
  Synthetic Polynucleotide
taatacgactcactatagggttggcagctttcccgtgcttcccttcggccaacagaggagaggccgaatggaagcacggaacctggcggcagcgcaaaagatg

SEQ ID NO: 186778 - DNA, 103 bp, Artificial Sequence
  Synthetic Polynucleotide
taatacgactcactataggggtgacttcgcttggcagctttcccgtgcttaacagaggagaaagcacatgaaagctgccaacctggcggcagcgcaaaagatg

SEQ ID NO: 186779 - DNA, 103 bp, Artificial Sequence
  Synthetic Polynucleotide
taatacgactcactataggggctttctcttgtgacttcgcttggcagcttaacagaggagaaagctgatgagcgaagtcaacctggcggcagcgcaaaagatg

SEQ ID NO: 186780 - DNA, 103 bp, Artificial Sequence
  Synthetic Polynucleotide
taatacgactcactataggggactcagcttctctaaacgcggggttggggaacagaggagaccccaaatgcgcgtttagaacctggcggcagcgcaaaagatg

SEQ ID NO: 186781 - DNA, 103 bp, Artificial Sequence
  Synthetic Polynucleotide
taatacgactcactatagggtctggcttctgctttctcttgtgacttcgcaacagaggagagcgaagatgcaagagaaaaacctggcggcagcgcaaaagatg

SEQ ID NO: 186782 - DNA, 103 bp, Artificial Sequence
  Synthetic Polynucleotide
taatacgactcactatagggcgcctcctcttctggcttctgctttctcttaacagaggagaaagagaatgcagaagccaaacctggcggcagcgcaaaagatg

SEQ ID NO: 186783 - DNA, 103 bp, Artificial Sequence
  Synthetic Polynucleotide
taatacgactcactatagggccggagcacccgcctcctcttctggcttctaacagaggagaagaagcatgaagaggaggaacctggcggcagcgcaaaagatg

SEQ ID NO: 186784 - DNA, 103 bp, Artificial Sequence
  Synthetic Polynucleotide
taatacgactcactatagggtcctcgggcaccggagcacccgcctcctctaacagaggagaagaggaatggggtgctccaacctggcggcagcgcaaaagatg

SEQ ID NO: 186785 - DNA, 103 bp, Artificial Sequence
  Synthetic Polynucleotide
taatacgactcactataggggaaggtggcgtcctcgggcaccggagcaccaacagaggagaggtgctatggtgcccgagaacctggcggcagcgcaaaagatg

SEQ ID NO: 186786 - DNA, 103 bp, Artificial Sequence
  Synthetic Polynucleotide
taatacgactcactatagggagtattcgctgaaggtggcgtcctcgggcaaacagaggagatgcccgatgacgccacctaacctggcggcagcgcaaaagatg

SEQ ID NO: 186787 - DNA, 103 bp, Artificial Sequence
  Synthetic Polynucleotide
taatacgactcactatagggtctttctctgagtattcgctgaaggtggcgaacagaggagacgccacatgcagcgaataaacctggcggcagcgcaaaagatg

SEQ ID NO: 186788 - DNA, 103 bp, Artificial Sequence
  Synthetic Polynucleotide
taatacgactcactataggggaactccgtctctttctctgagtattcgctaacagaggagaagcgaaatgtcagagaaaaacctggcggcagcgcaaaagatg

SEQ ID NO: 186789 - DNA, 103 bp, Artificial Sequence
  Synthetic Polynucleotide
taatacgactcactatagggcactgcctgtgaactccgtctctttctctgaacagaggagacagagaatgagacggagtaacctggcggcagcgcaaaagatg

SEQ ID NO: 186790 - DNA, 103 bp, Artificial Sequence
  Synthetic Polynucleotide
taatacgactcactatagggtcgtcgcctacactgcctgtgaactccgtcaacagaggagagacggaatgcacaggcagaacctggcggcagcgcaaaagatg

SEQ ID NO: 186791 - DNA, 103 bp, Artificial Sequence
  Synthetic Polynucleotide
taatacgactcactatagggggttgcgatccgctccggaaactgcgcagcaacagaggagagctgcgatgtttccggagaacctggcggcagcgcaaaagatg

SEQ ID NO: 186792 - DNA, 103 bp, Artificial Sequence
  Synthetic Polynucleotide
taatacgactcactatagggctgggaccaggactcagcttctctaaacgcaacagaggagagcgtttatggaagctgagaacctggcggcagcgcaaaagatg

SEQ ID NO: 186793 - DNA, 103 bp, Artificial Sequence
  Synthetic Polynucleotide
taatacgactcactatagggggaattggtctcgtcgcctacactgcctgtaacagaggagaacaggcatggtaggcgacaacctggcggcagcgcaaaagatg

SEQ ID NO: 186794 - DNA, 103 bp, Artificial Sequence
  Synthetic Polynucleotide
taatacgactcactatagggtctgtactgcggaattggtctcgtcgcctaaacagaggagataggcgatgagaccaattaacctggcggcagcgcaaaagatg

SEQ ID NO: 186795 - DNA, 103 bp, Artificial Sequence
  Synthetic Polynucleotide
taatacgactcactatagggtgctgaatgctctgtactgcggaattggtcaacagaggagagaccaaatgcgcagtacaaacctggcggcagcgcaaaagatg

SEQ ID NO: 186796 - DNA, 103 bp, Artificial Sequence
  Synthetic Polynucleotide
taatacgactcactatagggcaccactacctgctgaatgctctgtactgcaacagaggagagcagtaatgagcattcagaacctggcggcagcgcaaaagatg

SEQ ID NO: 186797 - DNA, 103 bp, Artificial Sequence
  Synthetic Polynucleotide
taatacgactcactatagggcacccagggtcaccactacctgctgaatgcaacagaggagagcattcatgaggtagtggaacctggcggcagcgcaaaagatg

SEQ ID NO: 186798 - DNA, 103 bp, Artificial Sequence
  Synthetic Polynucleotide
taatacgactcactatagggacatttgggtcacccagggtcaccactaccaacagaggagaggtagtatggaccctgggaacctggcggcagcgcaaaagatg

SEQ ID NO: 186799 - DNA, 103 bp, Artificial Sequence
  Synthetic Polynucleotide
taatacgactcactatagggtggtgtggtcacatttgggtcacccagggtaacagaggagaaccctgatggacccaaataacctggcggcagcgcaaaagatg

SEQ ID NO: 186800 - DNA, 103 bp, Artificial Sequence
  Synthetic Polynucleotide
taatacgactcactatagggctgagctcgatggtgtggtcacatttgggtaacagaggagaacccaaatgtgaccacacaacctggcggcagcgcaaaagatg

SEQ ID NO: 186801 - DNA, 103 bp, Artificial Sequence
  Synthetic Polynucleotide
taatacgactcactataggggttaagccgactgagctcgatggtgtggtcaacagaggagagaccacatgatcgagctcaacctggcggcagcgcaaaagatg

SEQ ID NO: 186802 - DNA, 103 bp, Artificial Sequence
  Synthetic Polynucleotide
taatacgactcactatagggggtgatgttggttaagccgactgagctcgaaacagaggagatcgagcatggtcggcttaaacctggcggcagcgcaaaagatg

SEQ ID NO: 186803 - DNA, 103 bp, Artificial Sequence
  Synthetic Polynucleotide
taatacgactcactatagggggttcccaatctgggaccaggactcagcttaacagaggagaaagctgatgcctggtcccaacctggcggcagcgcaaaagatg

SEQ ID NO: 186804 - DNA, 103 bp, Artificial Sequence
  Synthetic Polynucleotide
taatacgactcactatagggtgggggtcacggtgatgttggttaagccgaaacagaggagatcggctatgccaacatcaaacctggcggcagcgcaaaagatg

SEQ ID NO: 186805 - DNA, 103 bp, Artificial Sequence
  Synthetic Polynucleotide
taatacgactcactataggggcagtggtgatgggggtcacggtgatgttgaacagaggagacaacatatgcgtgaccccaacctggcggcagcgcaaaagatg

SEQ ID NO: 186806 - DNA, 103 bp, Artificial Sequence
  Synthetic Polynucleotide
taatacgactcactatagggagtcgcggccgcagtggtgatgggggtcacaacagaggagagtgaccatgatcaccactaacctggcggcagcgcaaaagatg

SEQ ID NO: 186807 - DNA, 103 bp, Artificial Sequence
  Synthetic Polynucleotide
taatacgactcactatagggtggtaaactgagtcgcggccgcagtggtgaaacagaggagatcaccaatgcggccgcgaaacctggcggcagcgcaaaagatg

SEQ ID NO: 186808 - DNA, 103 bp, Artificial Sequence
  Synthetic Polynucleotide
taatacgactcactatagggggctggagattggtaaactgagtcgcggccaacagaggagaggccgcatgtcagtttacaacctggcggcagcgcaaaagatg

SEQ ID NO: 186809 - DNA, 103 bp, Artificial Sequence
  Synthetic Polynucleotide
taatacgactcactatagggcacggccaccggctggagattggtaaactgaacagaggagacagtttatgaatctccagaacctggcggcagcgcaaaagatg

SEQ ID NO: 186810 - DNA, 103 bp, Artificial Sequence
  Synthetic Polynucleotide
taatacgactcactatagggtaaggtgccccacggccaccggctggagataacagaggagaatctccatgcggtggccgaacctggcggcagcgcaaaagatg

SEQ ID NO: 186811 - DNA, 103 bp, Artificial Sequence
  Synthetic Polynucleotide
taatacgactcactatagggtcaggggtggtaaggtgccccacggccaccaacagaggagaggtggcatgggggcacctaacctggcggcagcgcaaaagatg

SEQ ID NO: 186812 - DNA, 103 bp, Artificial Sequence
  Synthetic Polynucleotide
taatacgactcactatagggtaactggcgttcaggggtggtaaggtgcccaacagaggagagggcacatgaccacccctaacctggcggcagcgcaaaagatg

SEQ ID NO: 186813 - DNA, 103 bp, Artificial Sequence
  Synthetic Polynucleotide
taatacgactcactatagggtgtccagctgtaactggcgttcaggggtggaacagaggagaccacccatgaacgccagtaacctggcggcagcgcaaaagatg

SEQ ID NO: 186814 - DNA, 103 bp, Artificial Sequence
  Synthetic Polynucleotide
taatacgactcactatagggctgaccctctggttcccaatctgggaccagaacagaggagactggtcatggattgggaaaacctggcggcagcgcaaaagatg

SEQ ID NO: 186815 - DNA, 103 bp, Artificial Sequence
  Synthetic Polynucleotide
taatacgactcactatagggaggattgagttgtccagctgtaactggcgtaacagaggagaacgccaatgacagctggaaacctggcggcagcgcaaaagatg

SEQ ID NO: 186816 - DNA, 103 bp, Artificial Sequence
  Synthetic Polynucleotide
taatacgactcactatagggggtcacggtcaggattgagttgtccagctgaacagaggagacagctgatgaactcaatcaacctggcggcagcgcaaaagatg

SEQ ID NO: 186817 - DNA, 103 bp, Artificial Sequence
  Synthetic Polynucleotide
taatacgactcactatagggcggtatcaaaggtcacggtcaggattgagtaacagaggagaactcaaatgtgaccgtgaaacctggcggcagcgcaaaagatg

SEQ ID NO: 186818 - DNA, 103 bp, Artificial Sequence
  Synthetic Polynucleotide
taatacgactcactataggggagccgctgacggtatcaaaggtcacggtcaacagaggagagaccgtatgctttgatacaacctggcggcagcgcaaaagatg

SEQ ID NO: 186819 - DNA, 103 bp, Artificial Sequence
  Synthetic Polynucleotide
taatacgactcactatagggcaacatggcagagccgctgacggtatcaaaaacagaggagatttgatatggtcagcggcaacctggcggcagcgcaaaagatg

SEQ ID NO: 186820 - DNA, 103 bp, Artificial Sequence
  Synthetic Polynucleotide
taatacgactcactatagggggcggttgtgcaacatggcagagccgctgaaacagaggagatcagcgatgctgccatgtaacctggcggcagcgcaaaagatg

SEQ ID NO: 186821 - DNA, 103 bp, Artificial Sequence
  Synthetic Polynucleotide
taatacgactcactatagggacgtcattttggcggttgtgcaacatggcaaacagaggagatgccatatggcacaaccgaacctggcggcagcgcaaaagatg

SEQ ID NO: 186822 - DNA, 103 bp, Artificial Sequence
  Synthetic Polynucleotide
taatacgactcactataggggtggatctggacgtcattttggcggttgtgaacagaggagacacaacatgcaaaatgacaacctggcggcagcgcaaaagatg

SEQ ID NO: 186823 - DNA, 103 bp, Artificial Sequence
  Synthetic Polynucleotide
taatacgactcactatagggccggctgggggtggatctggacgtcattttaacagaggagaaaaatgatgtccagatccaacctggcggcagcgcaaaagatg

SEQ ID NO: 186824 - DNA, 103 bp, Artificial Sequence
  Synthetic Polynucleotide
taatacgactcactatagggttcgaggcttccggctgggggtggatctggaacagaggagaccagatatgcccccagccaacctggcggcagcgcaaaagatg

SEQ ID NO: 186825 - DNA, 103 bp, Artificial Sequence
  Synthetic Polynucleotide
taatacgactcactataggggagctgctcactgaccctctggttcccaataacagaggagaattgggatgcagagggtcaacctggcggcagcgcaaaagatg

SEQ ID NO: 186826 - DNA, 103 bp, Artificial Sequence
  Synthetic Polynucleotide
taatacgactcactatagggagactgtgggttcgaggcttccggctggggaacagaggagaccccagatggaagcctcgaacctggcggcagcgcaaaagatg

SEQ ID NO: 186827 - DNA, 103 bp, Artificial Sequence
  Synthetic Polynucleotide
taatacgactcactatagggaatgggccacagactgtgggttcgaggcttaacagaggagaaagcctatgacccacagtaacctggcggcagcgcaaaagatg

SEQ ID NO: 186828 - DNA, 103 bp, Artificial Sequence
  Synthetic Polynucleotide
taatacgactcactatagggaggttgatgaaatgggccacagactgtgggaacagaggagacccacaatgtgtggcccaaacctggcggcagcgcaaaagatg

SEQ ID NO: 186829 - DNA, 103 bp, Artificial Sequence
  Synthetic Polynucleotide
taatacgactcactatagggcagggtcgtcaggttgatgaaatgggccacaacagaggagagtggccatgttcatcaacaacctggcggcagcgcaaaagatg

SEQ ID NO: 186830 - DNA, 103 bp, Artificial Sequence
  Synthetic Polynucleotide
taatacgactcactatagggtggagttgaccagggtcgtcaggttgatgaaacagaggagatcatcaatgtgacgacccaacctggcggcagcgcaaaagatg

SEQ ID NO: 186831 - DNA, 103 bp, Artificial Sequence
  Synthetic Polynucleotide
taatacgactcactatagggaggggcgtgatggagttgaccagggtcgtcaacagaggagagacgacatgggtcaactcaacctggcggcagcgcaaaagatg

SEQ ID NO: 186832 - DNA, 103 bp, Artificial Sequence
  Synthetic Polynucleotide
taatacgactcactatagggctggctccccaggggcgtgatggagttgacaacagaggagagtcaacatgatcacgcccaacctggcggcagcgcaaaagatg

SEQ ID NO: 186833 - DNA, 103 bp, Artificial Sequence
  Synthetic Polynucleotide
taatacgactcactatagggggtcactaagctggctccccaggggcgtgaaacagaggagatcacgcatgtggggagccaacctggcggcagcgcaaaagatg

SEQ ID NO: 186834 - DNA, 103 bp, Artificial Sequence
  Synthetic Polynucleotide
taatacgactcactatagggagcgggtgctggtcactaagctggctccccaacagaggagaggggagatggcttagtgaaacctggcggcagcgcaaaagatg

SEQ ID NO: 186835 - DNA, 103 bp, Artificial Sequence
  Synthetic Polynucleotide
taatacgactcactatagggccgccacgtgagcgggtgctggtcactaagaacagaggagacttagtatgcagcacccgaacctggcggcagcgcaaaagatg

SEQ ID NO: 186836 - DNA, 103 bp, Artificial Sequence
  Synthetic Polynucleotide
taatacgactcactatagggatgtttccaagagctgctcactgaccctctaacagaggagaagagggatggtgagcagcaacctggcggcagcgcaaaagatg

SEQ ID NO: 186837 - DNA, 103 bp, Artificial Sequence
  Synthetic Polynucleotide
taatacgactcactatagggggggcactgcccgccacgtgagcgggtgctaacagaggagaagcaccatgtcacgtggcaacctggcggcagcgcaaaagatg

SEQ ID NO: 186838 - DNA, 103 bp, Artificial Sequence
  Synthetic Polynucleotide
taatacgactcactatagggacgtcagtctggggcactgcccgccacgtgaacagaggagacacgtgatgggcagtgccaacctggcggcagcgcaaaagatg

SEQ ID NO: 186839 - DNA, 103 bp, Artificial Sequence
  Synthetic Polynucleotide
taatacgactcactataggggggtggcaagacgtcagtctggggcactgcaacagaggagagcagtgatgcagactgacaacctggcggcagcgcaaaagatg

SEQ ID NO: 186840 - DNA, 103 bp, Artificial Sequence
  Synthetic Polynucleotide
taatacgactcactataggggcggctgcgagggtggcaagacgtcagtctaacagaggagaagactgatgtcttgccacaacctggcggcagcgcaaaagatg

SEQ ID NO: 186841 - DNA, 103 bp, Artificial Sequence
  Synthetic Polynucleotide
taatacgactcactataggggggggtgcctgcggctgcgagggtggcaagaacagaggagacttgccatgctcgcagccaacctggcggcagcgcaaaagatg

SEQ ID NO: 186842 - DNA, 103 bp, Artificial Sequence
  Synthetic Polynucleotide
taatacgactcactatagggcgcctgctgtgggggtgcctgcggctgcgaaacagaggagatcgcagatgcaggcacccaacctggcggcagcgcaaaagatg

SEQ ID NO: 186843 - DNA, 103 bp, Artificial Sequence
  Synthetic Polynucleotide
taatacgactcactatagggggggctgggccgcctgctgtgggggtgcctaacagaggagaaggcacatgcacagcaggaacctggcggcagcgcaaaagatg

SEQ ID NO: 186844 - DNA, 103 bp, Artificial Sequence
  Synthetic Polynucleotide
taatacgactcactataggggcctgcacctggggctgggccgcctgctgtaacagaggagaacagcaatgggcccagccaacctggcggcagcgcaaaagatg

SEQ ID NO: 186845 - DNA, 103 bp, Artificial Sequence
  Synthetic Polynucleotide
taatacgactcactatagggctgctgctccgcctgcacctggggctgggcaacagaggagagcccagatgcaggtgcagaacctggcggcagcgcaaaagatg

SEQ ID NO: 186846 - DNA, 103 bp, Artificial Sequence
  Synthetic Polynucleotide
taatacgactcactatagggtctgctgctgctgctgctccgcctgcacctaacagaggagaaggtgcatgcggagcagcaacctggcggcagcgcaaaagatg

SEQ ID NO: 186847 - DNA, 103 bp, Artificial Sequence
  Synthetic Polynucleotide
taatacgactcactatagggttccctagagatgtttccaagagctgctcaaacagaggagatgagcaatgcttggaaacaacctggcggcagcgcaaaagatg

SEQ ID NO: 186848 - DNA, 103 bp, Artificial Sequence
  Synthetic Polynucleotide
taatacgactcactatagggtagctgtacatctgctgctgctgctgctccaacagaggagaggagcaatggcagcagcaaacctggcggcagcgcaaaagatg

SEQ ID NO: 186849 - DNA, 103 bp, Artificial Sequence
  Synthetic Polynucleotide
taatacgactcactatagggggacacctcattccctagagatgtttccaaaacagaggagattggaaatgtctctagggaacctggcggcagcgcaaaagatg

SEQ ID NO: 186850 - DNA, 103 bp, Artificial Sequence
  Synthetic Polynucleotide
taatacgactcactataggggctcagtgtcggacacctcattccctagagaacagaggagactctagatgatgaggtgtaacctggcggcagcgcaaaagatg

SEQ ID NO: 186851 - DNA, 103 bp, Artificial Sequence
  Synthetic Polynucleotide
taatacgactcactataggggggctcagtggctcagtgtcggacacctcaaacagaggagatgaggtatgcgacactgaaacctggcggcagcgcaaaagatg

SEQ ID NO: 186852 - DNA, 103 bp, Artificial Sequence
  Synthetic Polynucleotide
taatacgactcactatagggtgcactcgcagggctcagtggctcagtgtcaacagaggagagacactatgccactgagcaacctggcggcagcgcaaaagatg

SEQ ID NO: 186853 - DNA, 103 bp, Artificial Sequence
  Synthetic Polynucleotide
taatacgactcactatagggccggactccgggttgcgatccgctccggaaaacagaggagattccggatgggatcgcaaaacctggcggcagcgcaaaagatg

SEQ ID NO: 186854 - DNA, 103 bp, Artificial Sequence
  Synthetic Polynucleotide
taatacgactcactataggggtcgcaggcctgcactcgcagggctcagtgaacagaggagacactgaatgctgcgagtgaacctggcggcagcgcaaaagatg

SEQ ID NO: 186855 - DNA, 103 bp, Artificial Sequence
  Synthetic Polynucleotide
taatacgactcactataggggcaggattgcgtcgcaggcctgcactcgcaaacagaggagatgcgagatgaggcctgcgaacctggcggcagcgcaaaagatg

SEQ ID NO: 186856 - DNA, 103 bp, Artificial Sequence
  Synthetic Polynucleotide
taatacgactcactatagggaggaggtagggcaggattgcgtcgcaggccaacagaggagaggcctgatgcgcaatcctaacctggcggcagcgcaaaagatg

SEQ ID NO: 186857 - DNA, 103 bp, Artificial Sequence
  Synthetic Polynucleotide
taatacgactcactatagggcaaagggtccaggaggtagggcaggattgcaacagaggagagcaatcatgccctacctcaacctggcggcagcgcaaaagatg

SEQ ID NO: 186858 - DNA, 103 bp, Artificial Sequence
  Synthetic Polynucleotide
taatacgactcactatagggaagttttgtgcaaagggtccaggaggtaggaacagaggagacctaccatgtggacccttaacctggcggcagcgcaaaagatg

SEQ ID NO: 186859 - DNA, 103 bp, Artificial Sequence
  Synthetic Polynucleotide
taatacgactcactatagggcccccaggaaaagttttgtgcaaagggtccaacagaggagaggacccatggcacaaaacaacctggcggcagcgcaaaagatg

SEQ ID NO: 186860 - DNA, 103 bp, Artificial Sequence
  Synthetic Polynucleotide
taatacgactcactatagggtttcctggttcccccaggaaaagttttgtgaacagaggagacacaaaatgtttcctgggaacctggcggcagcgcaaaagatg

SEQ ID NO: 186861 - DNA, 103 bp, Artificial Sequence
  Synthetic Polynucleotide
taatacgactcactataggggggggcagattttcctggttcccccaggaaaacagaggagattcctgatggaaccaggaaacctggcggcagcgcaaaagatg

SEQ ID NO: 186862 - DNA, 103 bp, Artificial Sequence
  Synthetic Polynucleotide
taatacgactcactatagggccccagggctgggggcagattttcctggttaacagaggagaaaccagatgaatctgcccaacctggcggcagcgcaaaagatg

SEQ ID NO: 186863 - DNA, 103 bp, Artificial Sequence
  Synthetic Polynucleotide
taatacgactcactatagggtcgcaatcttccccagggctgggggcagataacagaggagaatctgcatgcagccctggaacctggcggcagcgcaaaagatg

SEQ ID NO: 186864 - DNA, 103 bp, Artificial Sequence
  Synthetic Polynucleotide
taatacgactcactataggggggatcggatccggactccgggttgcgatcaacagaggagagatcgcatgccggagtccaacctggcggcagcgcaaaagatg

SEQ ID NO: 186865 - DNA, 103 bp, Artificial Sequence
  Synthetic Polynucleotide
taatacgactcactatagggcctcctccgttcgcaatcttccccagggctaacagaggagaagccctatggaagattgcaacctggcggcagcgcaaaagatg

SEQ ID NO: 186866 - DNA, 103 bp, Artificial Sequence
  Synthetic Polynucleotide
taatacgactcactatagggtgccccagttcctcctccgttcgcaatcttaacagaggagaaagattatgaacggaggaaacctggcggcagcgcaaaagatg

SEQ ID NO: 186867 - DNA, 103 bp, Artificial Sequence
  Synthetic Polynucleotide
taatacgactcactatagggcggccttgcctgccccagttcctcctccgtaacagaggagaacggagatggaactggggaacctggcggcagcgcaaaagatg

SEQ ID NO: 186868 - DNA, 103 bp, Artificial Sequence
  Synthetic Polynucleotide
taatacgactcactatagggtagccgcattcggccttgcctgccccagttaacagaggagaaactggatgaggcaaggcaacctggcggcagcgcaaaagatg

SEQ ID NO: 186869 - DNA, 103 bp, Artificial Sequence
  Synthetic Polynucleotide
taatacgactcactatagggctcagtttcatagccgcattcggccttgccaacagaggagaggcaagatggaatgcggcaacctggcggcagcgcaaaagatg

SEQ ID NO: 186870 - DNA, 103 bp, Artificial Sequence
  Synthetic Polynucleotide
taatacgactcactataggggcaagtgtgactcagtttcatagccgcattaacagaggagaaatgcgatgatgaaactgaacctggcggcagcgcaaaagatg

SEQ ID NO: 186871 - DNA, 103 bp, Artificial Sequence
  Synthetic Polynucleotide
taatacgactcactatagggtgcggctctagcaagtgtgactcagtttcaaacagaggagatgaaacatggtcacacttaacctggcggcagcgcaaaagatg

SEQ ID NO: 186872 - DNA, 103 bp, Artificial Sequence
  Synthetic Polynucleotide
taatacgactcactatagggaggtatctcgtgcggctctagcaagtgtgaaacagaggagatcacacatgctagagccgaacctggcggcagcgcaaaagatg

SEQ ID NO: 186873 - DNA, 103 bp, Artificial Sequence
  Synthetic Polynucleotide
taatacgactcactatagggtcacgttcaaaggtatctcgtgcggctctaaacagaggagatagagcatgacgagatacaacctggcggcagcgcaaaagatg

SEQ ID NO: 186874 - DNA, 103 bp, Artificial Sequence
  Synthetic Polynucleotide
taatacgactcactatagggttgtgtgtattcacgttcaaaggtatctcgaacagaggagacgagatatgtttgaacgtaacctggcggcagcgcaaaagatg

SEQ ID NO: 186875 - DNA, 103 bp, Artificial Sequence
  Synthetic Polynucleotide
taatacgactcactatagggtgtgcagagcgggatcggatccggactccgaacagaggagacggagtatggatccgatcaacctggcggcagcgcaaaagatg

SEQ ID NO: 186876 - DNA, 103 bp, Artificial Sequence
  Synthetic Polynucleotide
taatacgactcactataggggtcactgaacttgtgtgtattcacgttcaaaacagaggagattgaacatgaatacacacaacctggcggcagcgcaaaagatg

SEQ ID NO: 186877 - DNA, 103 bp, Artificial Sequence
  Synthetic Polynucleotide
taatacgactcactataggggaaactcacagtcactgaacttgtgtgtataacagaggagaatacacatgagttcagtgaacctggcggcagcgcaaaagatg

SEQ ID NO: 186878 - DNA, 103 bp, Artificial Sequence
  Synthetic Polynucleotide
taatacgactcactatagggaactcatatggaaactcacagtcactgaacaacagaggagagttcagatgctgtgagttaacctggcggcagcgcaaaagatg

SEQ ID NO: 186879 - DNA, 103 bp, Artificial Sequence
  Synthetic Polynucleotide
taatacgactcactataggggaccgtgcaaaactcatatggaaactcacaaacagaggagatgtgagatgccatatgagaacctggcggcagcgcaaaagatg

SEQ ID NO: 186880 - DNA, 103 bp, Artificial Sequence
  Synthetic Polynucleotide
taatacgactcactataggggtgaaaagcagaccgtgcaaaactcatatgaacagaggagacatatgatgtttgcacggaacctggcggcagcgcaaaagatg

SEQ ID NO: 186881 - DNA, 103 bp, Artificial Sequence
  Synthetic Polynucleotide
taatacgactcactatagggagcttgaagggtgaaaagcagaccgtgcaaaacagaggagattgcacatgctgcttttcaacctggcggcagcgcaaaagatg

SEQ ID NO: 186882 - DNA, 103 bp, Artificial Sequence
  Synthetic Polynucleotide
taatacgactcactatagggcatccccagcagcttgaagggtgaaaagcaaacagaggagatgctttatgcccttcaagaacctggcggcagcgcaaaagatg

SEQ ID NO: 186883 - DNA, 103 bp, Artificial Sequence
  Synthetic Polynucleotide
taatacgactcactatagggccaccccgctcatccccagcagcttgaaggaacagaggagaccttcaatgtgctggggaaacctggcggcagcgcaaaagatg

SEQ ID NO: 186884 - DNA, 103 bp, Artificial Sequence
  Synthetic Polynucleotide
taatacgactcactatagggcacacgccctccaccccgctcatccccagcaacagaggagagctgggatggagcggggtaacctggcggcagcgcaaaagatg

SEQ ID NO: 186885 - DNA, 103 bp, Artificial Sequence
  Synthetic Polynucleotide
taatacgactcactatagggatgctgattccacacgccctccaccccgctaacagaggagaagcgggatggagggcgtgaacctggcggcagcgcaaaagatg

SEQ ID NO: 186886 - DNA, 103 bp, Artificial Sequence
  Synthetic Polynucleotide
taatacgactcactataggggcctttggaatgtgcagagcgggatcggataacagaggagaatccgaatgcgctctgcaaacctggcggcagcgcaaaagatg

SEQ ID NO: 186887 - DNA, 103 bp, Artificial Sequence
  Synthetic Polynucleotide
taatacgactcactatagggcacttcttgaatgctgattccacacgccctaacagaggagaagggcgatgggaatcagcaacctggcggcagcgcaaaagatg

SEQ ID NO: 186888 - DNA, 103 bp, Artificial Sequence
  Synthetic Polynucleotide
taatacgactcactatagggtgcatgctggcacttcttgaatgctgattcaacagaggagagaatcaatgttcaagaagaacctggcggcagcgcaaaagatg

SEQ ID NO: 186889 - DNA, 103 bp, Artificial Sequence
  Synthetic Polynucleotide
taatacgactcactatagggtaggaaagtgtgcatgctggcacttcttgaaacagaggagatcaagaatggccagcatgaacctggcggcagcgcaaaagatg

SEQ ID NO: 186890 - DNA, 103 bp, Artificial Sequence
  Synthetic Polynucleotide
taatacgactcactatagggctgagtggtttaggaaagtgtgcatgctggaacagaggagaccagcaatgacactttccaacctggcggcagcgcaaaagatg

SEQ ID NO: 186891 - DNA, 103 bp, Artificial Sequence
  Synthetic Polynucleotide
taatacgactcactatagggatgcccgttgctgagtggtttaggaaagtgaacagaggagacactttatgaaaccactcaacctggcggcagcgcaaaagatg

SEQ ID NO: 186892 - DNA, 103 bp, Artificial Sequence
  Synthetic Polynucleotide
taatacgactcactatagggtgcttctctgatgcccgttgctgagtggttaacagaggagaaaccacatggcaacgggcaacctggcggcagcgcaaaagatg

SEQ ID NO: 186893 - DNA, 103 bp, Artificial Sequence
  Synthetic Polynucleotide
taatacgactcactatagggtcctgcaacctgcttctctgatgcccgttgaacagaggagacaacggatgtcagagaagaacctggcggcagcgcaaaagatg

SEQ ID NO: 186894 - DNA, 103 bp, Artificial Sequence
  Synthetic Polynucleotide
taatacgactcactatagggggcatgtccttcctgcaacctgcttctctgaacagaggagacagagaatgaggttgcagaacctggcggcagcgcaaaagatg

SEQ ID NO: 186895 - DNA, 103 bp, Artificial Sequence
  Synthetic Polynucleotide
taatacgactcactatagggctctgacaccggcatgtccttcctgcaaccaacagaggagaggttgcatgaaggacatgaacctggcggcagcgcaaaagatg

SEQ ID NO: 186896 - DNA, 103 bp, Artificial Sequence
  Synthetic Polynucleotide
taatacgactcactatagggcttcagccatctctgacaccggcatgtcctaacagaggagaaggacaatgcggtgtcagaacctggcggcagcgcaaaagatg

SEQ ID NO: 186897 - DNA, 103 bp, Artificial Sequence
  Synthetic Polynucleotide
taatacgactcactataggggcgcgcggctgcctttggaatgtgcagagcaacagaggagagctctgatgattccaaagaacctggcggcagcgcaaaagatg

SEQ ID NO: 186898 - DNA, 103 bp, Artificial Sequence
  Synthetic Polynucleotide
taatacgactcactatagggtcgctcccatcttcagccatctctgacaccaacagaggagaggtgtcatggatggctgaaacctggcggcagcgcaaaagatg

SEQ ID NO: 186899 - DNA, 103 bp, Artificial Sequence
  Synthetic Polynucleotide
taatacgactcactatagggcatgatctcttcgctcccatcttcagccataacagaggagaatggctatggatgggagcaacctggcggcagcgcaaaagatg

SEQ ID NO: 186900 - DNA, 103 bp, Artificial Sequence
  Synthetic Polynucleotide
taatacgactcactatagggaccagatgaacatgatctcttcgctcccataacagaggagaatgggaatgaagagatcaaacctggcggcagcgcaaaagatg

SEQ ID NO: 186901 - DNA, 103 bp, Artificial Sequence
  Synthetic Polynucleotide
taatacgactcactatagggcagtcttcacaccagatgaacatgatctctaacagaggagaagagatatggttcatctgaacctggcggcagcgcaaaagatg

SEQ ID NO: 186902 - DNA, 103 bp, Artificial Sequence
  Synthetic Polynucleotide
taatacgactcactataggggtactggctgcagtcttcacaccagatgaaaacagaggagattcatcatgtgtgaagacaacctggcggcagcgcaaaagatg

SEQ ID NO: 186903 - DNA, 103 bp, Artificial Sequence
  Synthetic Polynucleotide
taatacgactcactatagggcggagtcgtggtactggctgcagtcttcacaacagaggagagtgaagatggcagccagtaacctggcggcagcgcaaaagatg

SEQ ID NO: 186904 - DNA, 103 bp, Artificial Sequence
  Synthetic Polynucleotide
taatacgactcactatagggtcgggacattcggagtcgtggtactggctgaacagaggagacagccaatgccacgactcaacctggcggcagcgcaaaagatg

SEQ ID NO: 186905 - DNA, 103 bp, Artificial Sequence
  Synthetic Polynucleotide
taatacgactcactatagggtgggcccagctcgggacattcggagtcgtgaacagaggagacacgacatggaatgtcccaacctggcggcagcgcaaaagatg

SEQ ID NO: 186906 - DNA, 103 bp, Artificial Sequence
  Synthetic Polynucleotide
taatacgactcactatagggccatgaccactgggcccagctcgggacattaacagaggagaaatgtcatgagctgggccaacctggcggcagcgcaaaagatg

SEQ ID NO: 186907 - DNA, 103 bp, Artificial Sequence
  Synthetic Polynucleotide
taatacgactcactataggggagtctttgaccatgaccactgggcccagcaacagaggagagctgggatgagtggtcataacctggcggcagcgcaaaagatg

SEQ ID NO: 186908 - DNA, 103 bp, Artificial Sequence
  Synthetic Polynucleotide
taatacgactcactatagggcgccacaggctcagtagtgttctgattcataacagaggagaatgaatatgaacactactaacctggcggcagcgcaaaagatg

SEQ ID NO: 186909 - DNA, 103 bp, Artificial Sequence
  Synthetic Polynucleotide
taatacgactcactatagggggtcttgtcaacagcagaagggaaaagcctaacagaggagaaggcttatgccttctgctaacctggcggcagcgcaaaagatg

SEQ ID NO: 186910 - DNA, 103 bp, Artificial Sequence
  Synthetic Polynucleotide
taatacgactcactatagggggcaggtgttacctctgagcagtcttcaagaacagaggagacttgaaatgtgctcagagaacctggcggcagcgcaaaagatg

SEQ ID NO: 186911 - DNA, 103 bp, Artificial Sequence
  Synthetic Polynucleotide
taatacgactcactatagggggatttgcatggcaggtgttacctctgagcaacagaggagagctcagatgtaacacctgaacctggcggcagcgcaaaagatg

SEQ ID NO: 186912 - DNA, 103 bp, Artificial Sequence
  Synthetic Polynucleotide
taatacgactcactatagggttagttctggggatttgcatggcaggtgttaacagaggagaaacaccatgcatgcaaataacctggcggcagcgcaaaagatg

SEQ ID NO: 186913 - DNA, 103 bp, Artificial Sequence
  Synthetic Polynucleotide
taatacgactcactatagggggcctcttctttagttctggggatttgcataacagaggagaatgcaaatgcccagaactaacctggcggcagcgcaaaagatg

SEQ ID NO: 186914 - DNA, 103 bp, Artificial Sequence
  Synthetic Polynucleotide
taatacgactcactatagggcatcaccattggcctcttctttagttctggaacagaggagaccagaaatgaagaagaggaacctggcggcagcgcaaaagatg

SEQ ID NO: 186915 - DNA, 103 bp, Artificial Sequence
  Synthetic Polynucleotide
taatacgactcactataggggtttcaaatacatcaccattggcctcttctaacagaggagaagaagaatgcaatggtgaaacctggcggcagcgcaaaagatg

SEQ ID NO: 186916 - DNA, 103 bp, Artificial Sequence
  Synthetic Polynucleotide
taatacgactcactatagggaaacataaacgtttcaaatacatcaccattaacagaggagaaatggtatggtatttgaaaacctggcggcagcgcaaaagatg

SEQ ID NO: 186917 - DNA, 103 bp, Artificial Sequence
  Synthetic Polynucleotide
taatacgactcactataggggttgacacggaaacataaacgtttcaaataaacagaggagatatttgatgcgtttatgtaacctggcggcagcgcaaaagatg

SEQ ID NO: 186918 - DNA, 103 bp, Artificial Sequence
  Synthetic Polynucleotide
taatacgactcactatagggctttcacaatgttgacacggaaacataaacaacagaggagagtttatatgtccgtgtcaaacctggcggcagcgcaaaagatg

SEQ ID NO: 186919 - DNA, 103 bp, Artificial Sequence
  Synthetic Polynucleotide
taatacgactcactatagggtgtaaacttcctttcacaatgttgacacggaacagaggagaccgtgtatgcattgtgaaaacctggcggcagcgcaaaagatg

SEQ ID NO: 186920 - DNA, 103 bp, Artificial Sequence
  Synthetic Polynucleotide
taatacgactcactatagggcaccaatccgggtcttgtcaacagcagaagaacagaggagacttctgatgttgacaagaaacctggcggcagcgcaaaagatg

SEQ ID NO: 186921 - DNA, 103 bp, Artificial Sequence
  Synthetic Polynucleotide
taatacgactcactatagggcctgtttggttgtaaacttcctttcacaataacagaggagaattgtgatgggaagtttaaacctggcggcagcgcaaaagatg

SEQ ID NO: 186922 - DNA, 103 bp, Artificial Sequence
  Synthetic Polynucleotide
taatacgactcactatagggcgctcaagcccctgtttggttgtaaacttcaacagaggagagaagttatgaaccaaacaaacctggcggcagcgcaaaagatg

SEQ ID NO: 186923 - DNA, 103 bp, Artificial Sequence
  Synthetic Polynucleotide
taatacgactcactatagggatgcatgtgacgctcaagcccctgtttggtaacagaggagaaccaaaatggggcttgagaacctggcggcagcgcaaaagatg

SEQ ID NO: 186924 - DNA, 103 bp, Artificial Sequence
  Synthetic Polynucleotide
taatacgactcactatagggatatatggatatgcatgtgacgctcaagccaacagaggagaggcttgatggtcacatgcaacctggcggcagcgcaaaagatg

SEQ ID NO: 186925 - DNA, 103 bp, Artificial Sequence
  Synthetic Polynucleotide
taatacgactcactatagggttgacggtggatatatggatatgcatgtgaaacagaggagatcacatatgtatccatataacctggcggcagcgcaaaagatg

SEQ ID NO: 186926 - DNA, 103 bp, Artificial Sequence
  Synthetic Polynucleotide
taatacgactcactataggggaaagcatgattgacggtggatatatggataacagaggagaatccatatgtccaccgtcaacctggcggcagcgcaaaagatg

SEQ ID NO: 186927 - DNA, 103 bp, Artificial Sequence
  Synthetic Polynucleotide
taatacgactcactatagggacttgcatttgaaagcatgattgacggtggaacagaggagaccaccgatgatcatgcttaacctggcggcagcgcaaaagatg

SEQ ID NO: 186928 - DNA, 103 bp, Artificial Sequence
  Synthetic Polynucleotide
taatacgactcactatagggttcccacagtacttgcatttgaaagcatgaaacagaggagatcatgcatgcaaatgcaaaacctggcggcagcgcaaaagatg

SEQ ID NO: 186929 - DNA, 103 bp, Artificial Sequence
  Synthetic Polynucleotide
taatacgactcactataggggccaaaggctttcccacagtacttgcatttaacagaggagaaaatgcatgtactgtgggaacctggcggcagcgcaaaagatg

SEQ ID NO: 186930 - DNA, 103 bp, Artificial Sequence
  Synthetic Polynucleotide
taatacgactcactatagggtaatctgtgtgccaaaggctttcccacagtaacagaggagaactgtgatgaagcctttgaacctggcggcagcgcaaaagatg

SEQ ID NO: 186931 - DNA, 103 bp, Artificial Sequence
  Synthetic Polynucleotide
taatacgactcactataggggtggcccagacaccaatccgggtcttgtcaaacagaggagatgacaaatgccggattggaacctggcggcagcgcaaaagatg

SEQ ID NO: 186932 - DNA, 103 bp, Artificial Sequence
  Synthetic Polynucleotide
taatacgactcactatagggcgccgccggttaatctgtgtgccaaaggctaacagaggagaagccttatgcacacagataacctggcggcagcgcaaaagatg

SEQ ID NO: 186933 - DNA, 103 bp, Artificial Sequence
  Synthetic Polynucleotide
taatacgactcactatagggccgctcatgtcgccgccggttaatctgtgtaacagaggagaacacagatgaaccggcggaacctggcggcagcgcaaaagatg

SEQ ID NO: 186934 - DNA, 103 bp, Artificial Sequence
  Synthetic Polynucleotide
taatacgactcactatagggcttcatggcgccgctcatgtcgccgccggtaacagaggagaaccggcatggacatgagcaacctggcggcagcgcaaaagatg

SEQ ID NO: 186935 - DNA, 103 bp, Artificial Sequence
  Synthetic Polynucleotide
taatacgactcactatagggtttaaccctgcttcatggcgccgctcatgtaacagaggagaacatgaatggcgccatgaaacctggcggcagcgcaaaagatg

SEQ ID NO: 186936 - DNA, 103 bp, Artificial Sequence
  Synthetic Polynucleotide
taatacgactcactataggggggtttccgctttaaccctgcttcatggcgaacagaggagacgccatatggcagggttaaacctggcggcagcgcaaaagatg

SEQ ID NO: 186937 - DNA, 103 bp, Artificial Sequence
  Synthetic Polynucleotide
taatacgactcactataggggtgtttggctgggtttccgctttaaccctgaacagaggagacagggtatgagcggaaacaacctggcggcagcgcaaaagatg

SEQ ID NO: 186938 - DNA, 103 bp, Artificial Sequence
  Synthetic Polynucleotide
taatacgactcactataggggacggctgtagtgtttggctgggtttccgcaacagaggagagcggaaatgcagccaaacaacctggcggcagcgcaaaagatg

SEQ ID NO: 186939 - DNA, 103 bp, Artificial Sequence
  Synthetic Polynucleotide
taatacgactcactatagggcagatcctctgacggctgtagtgtttggctaacagaggagaagccaaatgctacagccgaacctggcggcagcgcaaaagatg

SEQ ID NO: 186940 - DNA, 103 bp, Artificial Sequence
  Synthetic Polynucleotide
taatacgactcactatagggtgccatcagccagatcctctgacggctgtaaacagaggagatacagcatgcagaggatcaacctggcggcagcgcaaaagatg

SEQ ID NO: 186941 - DNA, 103 bp, Artificial Sequence
  Synthetic Polynucleotide
taatacgactcactatagggccagatgctttgccatcagccagatcctctaacagaggagaagaggaatgggctgatggaacctggcggcagcgcaaaagatg

SEQ ID NO: 186942 - DNA, 103 bp, Artificial Sequence
  Synthetic Polynucleotide
taatacgactcactatagggaattggtttagtggcccagacaccaatccgaacagaggagacggattatggtctgggccaacctggcggcagcgcaaaagatg

SEQ ID NO: 186943 - DNA, 103 bp, Artificial Sequence
  Synthetic Polynucleotide
taatacgactcactatagggaacgttttctccagatgctttgccatcagcaacagaggagagctgatatgaaagcatctaacctggcggcagcgcaaaagatg

SEQ ID NO: 186944 - DNA, 103 bp, Artificial Sequence
  Synthetic Polynucleotide
taatacgactcactatagggcttttgaagcaacgttttctccagatgcttaacagaggagaaagcatatggagaaaacgaacctggcggcagcgcaaaagatg

SEQ ID NO: 186945 - DNA, 103 bp, Artificial Sequence
  Synthetic Polynucleotide
taatacgactcactatagggctcgaatcatcttttgaagcaacgttttctaacagaggagaagaaaaatgtgcttcaaaaacctggcggcagcgcaaaagatg

SEQ ID NO: 186946 - DNA, 103 bp, Artificial Sequence
  Synthetic Polynucleotide
taatacgactcactatagggactgggaggactcgaatcatcttttgaagcaacagaggagagcttcaatggatgattcgaacctggcggcagcgcaaaagatg

SEQ ID NO: 186947 - DNA, 103 bp, Artificial Sequence
  Synthetic Polynucleotide
taatacgactcactatagggctggcccaagactgggaggactcgaatcataacagaggagaatgattatggtcctcccaaacctggcggcagcgcaaaagatg

SEQ ID NO: 186948 - DNA, 103 bp, Artificial Sequence
  Synthetic Polynucleotide
taatacgactcactatagggatcagacagtctggcccaagactgggaggaaacagaggagatcctccatgtcttgggccaacctggcggcagcgcaaaagatg

SEQ ID NO: 186949 - DNA, 103 bp, Artificial Sequence
  Synthetic Polynucleotide
taatacgactcactatagggtgaattcatgatcagacagtctggcccaagaacagaggagacttgggatggactgtctgaacctggcggcagcgcaaaagatg

SEQ ID NO: 186950 - DNA, 103 bp, Artificial Sequence
  Synthetic Polynucleotide
taatacgactcactatagggaagccttctctgaattcatgatcagacagtaacagaggagaactgtcatgtcatgaattaacctggcggcagcgcaaaagatg

SEQ ID NO: 186951 - DNA, 103 bp, Artificial Sequence
  Synthetic Polynucleotide
taatacgactcactataggggtgtcttgggaagccttctctgaattcatgaacagaggagacatgaaatgagagaaggcaacctggcggcagcgcaaaagatg

SEQ ID NO: 186952 - DNA, 103 bp, Artificial Sequence
  Synthetic Polynucleotide
taatacgactcactatagggagaatttattgtgtcttgggaagccttctcaacagaggagagagaagatgtcccaagacaacctggcggcagcgcaaaagatg

SEQ ID NO: 186953 - DNA, 103 bp, Artificial Sequence
  Synthetic Polynucleotide
taatacgactcactatagggtgccttttaaaattggtttagtggcccagaaacagaggagatctgggatgctaaaccaaaacctggcggcagcgcaaaagatg

SEQ ID NO: 186954 - DNA, 103 bp, Artificial Sequence
  Synthetic Polynucleotide
taatacgactcactatagggctacgacagaagaatttattgtgtcttgggaacagaggagacccaagatgcaataaattaacctggcggcagcgcaaaagatg

SEQ ID NO: 186955 - DNA, 103 bp, Artificial Sequence
  Synthetic Polynucleotide
taatacgactcactatagggccattctcttctacgacagaagaatttattaacagaggagaaataaaatgttctgtcgtaacctggcggcagcgcaaaagatg

SEQ ID NO: 186956 - DNA, 103 bp, Artificial Sequence
  Synthetic Polynucleotide
taatacgactcactatagggtttaacttccccattctcttctacgacagaaacagaggagatctgtcatggaagagaataacctggcggcagcgcaaaagatg

SEQ ID NO: 186957 - DNA, 103 bp, Artificial Sequence
  Synthetic Polynucleotide
taatacgactcactataggggatgaagttctttaacttccccattctcttaacagaggagaaagagaatggggaagttaaacctggcggcagcgcaaaagatg

SEQ ID NO: 186958 - DNA, 103 bp, Artificial Sequence
  Synthetic Polynucleotide
taatacgactcactatagggtatttgcacggatgaagttctttaacttccaacagaggagaggaagtatgagaacttcaaacctggcggcagcgcaaaagatg

SEQ ID NO: 186959 - DNA, 103 bp, Artificial Sequence
  Synthetic Polynucleotide
taatacgactcactatagggctttttacaatatttgcacggatgaagttcaacagaggagagaacttatgccgtgcaaaaacctggcggcagcgcaaaagatg

SEQ ID NO: 186960 - DNA, 103 bp, Artificial Sequence
  Synthetic Polynucleotide
taatacgactcactatagggttccaaaaacctttttacaatatttgcacgaacagaggagacgtgcaatgattgtaaaaaacctggcggcagcgcaaaagatg

SEQ ID NO: 186961 - DNA, 103 bp, Artificial Sequence
  Synthetic Polynucleotide
taatacgactcactatagggttagtatgagttccaaaaacctttttacaaaacagaggagattgtaaatgggtttttggaacctggcggcagcgcaaaagatg

SEQ ID NO: 186962 - DNA, 103 bp, Artificial Sequence
  Synthetic Polynucleotide
taatacgactcactatagggccgtctcatattagtatgagttccaaaaacaacagaggagagtttttatgactcatactaacctggcggcagcgcaaaagatg

SEQ ID NO: 186963 - DNA, 103 bp, Artificial Sequence
  Synthetic Polynucleotide
taatacgactcactatagggtacgctgatgccgtctcatattagtatgagaacagaggagactcataatgatatgagacaacctggcggcagcgcaaaagatg

SEQ ID NO: 186964 - DNA, 103 bp, Artificial Sequence
  Synthetic Polynucleotide
taatacgactcactatagggccaaattttttgccttttaaaattggtttaaacagaggagataaaccatgtttaaaaggaacctggcggcagcgcaaaagatg

SEQ ID NO: 186965 - DNA, 103 bp, Artificial Sequence
  Synthetic Polynucleotide
taatacgactcactatagggtcgtgaactctacgctgatgccgtctcataaacagaggagatatgagatggcatcagcgaacctggcggcagcgcaaaagatg

SEQ ID NO: 186966 - DNA, 103 bp, Artificial Sequence
  Synthetic Polynucleotide
taatacgactcactatagggcagatgacgttcgtgaactctacgctgatgaacagaggagacatcagatgagagttcacaacctggcggcagcgcaaaagatg

SEQ ID NO: 186967 - DNA, 103 bp, Artificial Sequence
  Synthetic Polynucleotide
taatacgactcactatagggctttgggaatcagatgacgttcgtgaactcaacagaggagagagttcatgaacgtcatcaacctggcggcagcgcaaaagatg

SEQ ID NO: 186968 - DNA, 103 bp, Artificial Sequence
  Synthetic Polynucleotide
taatacgactcactatagggcgccgtacacctttgggaatcagatgacgtaacagaggagaacgtcaatggattcccaaaacctggcggcagcgcaaaagatg

SEQ ID NO: 186969 - DNA, 103 bp, Artificial Sequence
  Synthetic Polynucleotide
taatacgactcactataggggcctccttttcgccgtacacctttgggaataacagaggagaattcccatgggtgtacggaacctggcggcagcgcaaaagatg

SEQ ID NO: 186970 - DNA, 103 bp, Artificial Sequence
  Synthetic Polynucleotide
taatacgactcactataggggctcttcaaggcctccttttcgccgtacacaacagaggagagtgtacatggaaaaggagaacctggcggcagcgcaaaagatg

SEQ ID NO: 186971 - DNA, 103 bp, Artificial Sequence
  Synthetic Polynucleotide
taatacgactcactatagggggaggctggggctcttcaaggcctccttttaacagaggagaaaaaggatgccttgaagaaacctggcggcagcgcaaaagatg

SEQ ID NO: 186972 - DNA, 103 bp, Artificial Sequence
  Synthetic Polynucleotide
taatacgactcactatagggctgttctgctggaggctggggctcttcaagaacagaggagacttgaaatgccccagcctaacctggcggcagcgcaaaagatg

SEQ ID NO: 186973 - DNA, 103 bp, Artificial Sequence
  Synthetic Polynucleotide
taatacgactcactatagggtggcctgggcctgttctgctggaggctgggaacagaggagacccagcatgcagcagaacaacctggcggcagcgcaaaagatg

SEQ ID NO: 186974 - DNA, 103 bp, Artificial Sequence
  Synthetic Polynucleotide
taatacgactcactatagggacgttctgggtggcctgggcctgttctgctaacagaggagaagcagaatgggcccaggcaacctggcggcagcgcaaaagatg

SEQ ID NO: 186975 - DNA, 103 bp, Artificial Sequence
  Synthetic Polynucleotide
taatacgactcactatagggaacaaatggcccaaattttttgccttttaaaacagaggagattaaaaatgaaaaaatttaacctggcggcagcgcaaaagatg

SEQ ID NO: 186976 - DNA, 103 bp, Artificial Sequence
  Synthetic Polynucleotide
taatacgactcactatagggtggtacatacacgttctgggtggcctgggcaacagaggagagcccagatgacccagaacaacctggcggcagcgcaaaagatg

SEQ ID NO: 186977 - DNA, 103 bp, Artificial Sequence
  Synthetic Polynucleotide
taatacgactcactataggggctctgtgcttggtacatacacgttctgggaacagaggagacccagaatgtgtatgtacaacctggcggcagcgcaaaagatg

SEQ ID NO: 186978 - DNA, 103 bp, Artificial Sequence
  Synthetic Polynucleotide
taatacgactcactatagggtcctcctccggctctgtgcttggtacatacaacagaggagagtatgtatgaagcacagaaacctggcggcagcgcaaaagatg

SEQ ID NO: 186979 - DNA, 103 bp, Artificial Sequence
  Synthetic Polynucleotide
taatacgactcactatagggtgcttccccttcctcctccggctctgtgctaacagaggagaagcacaatgccggaggagaacctggcggcagcgcaaaagatg

SEQ ID NO: 186980 - DNA, 103 bp, Artificial Sequence
  Synthetic Polynucleotide
taatacgactcactatagggacacatcatctgcttccccttcctcctccgaacagaggagacggaggatgaaggggaagaacctggcggcagcgcaaaagatg

SEQ ID NO: 186981 - DNA, 103 bp, Artificial Sequence
  Synthetic Polynucleotide
taatacgactcactatagggtccatgatgtacacatcatctgcttcccctaacagaggagaaggggaatgagatgatgtaacctggcggcagcgcaaaagatg

SEQ ID NO: 186982 - DNA, 103 bp, Artificial Sequence
  Synthetic Polynucleotide
taatacgactcactataggggctagaaatgtccatgatgtacacatcatcaacagaggagagatgatatgtacatcatgaacctggcggcagcgcaaaagatg

SEQ ID NO: 186983 - DNA, 103 bp, Artificial Sequence
  Synthetic Polynucleotide
taatacgactcactatagggcagagatattgctagaaatgtccatgatgtaacagaggagaacatcaatgacatttctaaacctggcggcagcgcaaaagatg

SEQ ID NO: 186984 - DNA, 103 bp, Artificial Sequence
  Synthetic Polynucleotide
taatacgactcactatagggtttaagttttcagagatattgctagaaatgaacagaggagacatttcatgcaatatctcaacctggcggcagcgcaaaagatg

SEQ ID NO: 186985 - DNA, 103 bp, Artificial Sequence
  Synthetic Polynucleotide
taatacgactcactatagggaatatagtaatttaagttttcagagatattaacagaggagaaatatcatggaaaacttaaacctggcggcagcgcaaaagatg

SEQ ID NO: 186986 - DNA, 103 bp, Artificial Sequence
  Synthetic Polynucleotide
taatacgactcactatagggtcttatcaccaacaaatggcccaaatttttaacagaggagaaaaaatatgggccatttgaacctggcggcagcgcaaaagatg

SEQ ID NO: 186987 - DNA, 103 bp, Artificial Sequence
  Synthetic Polynucleotide
taatacgactcactatagggttttaccatcaatatagtaatttaagttttaacagaggagaaaaactatgattactataaacctggcggcagcgcaaaagatg

SEQ ID NO: 186988 - DNA, 103 bp, Artificial Sequence
  Synthetic Polynucleotide
taatacgactcactatagggttagtttgaattttaccatcaatatagtaaaacagaggagattactaatgtgatggtaaaacctggcggcagcgcaaaagatg

SEQ ID NO: 186989 - DNA, 103 bp, Artificial Sequence
  Synthetic Polynucleotide
taatacgactcactatagggagtgttgttattagtttgaattttaccatcaacagaggagagatggtatgattcaaactaacctggcggcagcgcaaaagatg

SEQ ID NO: 186990 - DNA, 103 bp, Artificial Sequence
  Synthetic Polynucleotide
taatacgactcactatagggcacagttactagtgttgttattagtttgaaaacagaggagattcaaaatgataacaacaaacctggcggcagcgcaaaagatg

SEQ ID NO: 186991 - DNA, 103 bp, Artificial Sequence
  Synthetic Polynucleotide
taatacgactcactatagggtcaatcacatcacagttactagtgttgttaaacagaggagataacaaatgtagtaactgaacctggcggcagcgcaaaagatg

SEQ ID NO: 186992 - DNA, 103 bp, Artificial Sequence
  Synthetic Polynucleotide
taatacgactcactatagggagactccatctcaatcacatcacagttactaacagaggagaagtaacatggatgtgattaacctggcggcagcgcaaaagatg

SEQ ID NO: 186993 - DNA, 103 bp, Artificial Sequence
  Synthetic Polynucleotide
taatacgactcactatagggctgccgaagcagactccatctcaatcacataacagaggagaatgtgaatgagatggagtaacctggcggcagcgcaaaagatg

SEQ ID NO: 186994 - DNA, 103 bp, Artificial Sequence
  Synthetic Polynucleotide
taatacgactcactatagggccatacaaatctgccgaagcagactccatcaacagaggagagatggaatgtgcttcggcaacctggcggcagcgcaaaagatg

SEQ ID NO: 186995 - DNA, 103 bp, Artificial Sequence
  Synthetic Polynucleotide
taatacgactcactatagggacaatttataccatacaaatctgccgaagcaacagaggagagcttcgatggatttgtataacctggcggcagcgcaaaagatg

SEQ ID NO: 186996 - DNA, 103 bp, Artificial Sequence
  Synthetic Polynucleotide
taatacgactcactataggggagtgagcagacaatttataccatacaaataacagaggagaatttgtatggtataaattaacctggcggcagcgcaaaagatg

SEQ ID NO: 186997 - DNA, 103 bp, Artificial Sequence
  Synthetic Polynucleotide
taatacgactcactataggggatctttttttcttatcaccaacaaatggcaacagaggagagccattatgtggtgataaaacctggcggcagcgcaaaagatg

SEQ ID NO: 186998 - DNA, 103 bp, Artificial Sequence
  Synthetic Polynucleotide
taatacgactcactatagggactgtaactggagtgagcagacaatttataaacagaggagatataaaatgtctgctcacaacctggcggcagcgcaaaagatg

SEQ ID NO: 186999 - DNA, 103 bp, Artificial Sequence
  Synthetic Polynucleotide
taatacgactcactatagggagtaatttccactgtaactggagtgagcagaacagaggagactgctcatgccagttacaaacctggcggcagcgcaaaagatg

SEQ ID NO: 187000 - DNA, 103 bp, Artificial Sequence
  Synthetic Polynucleotide
taatacgactcactatagggttatattttgagtaatttccactgtaactgaacagaggagacagttaatgtggaaattaaacctggcggcagcgcaaaagatg

SEQ ID NO: 187001 - DNA, 103 bp, Artificial Sequence
  Synthetic Polynucleotide
taatacgactcactatagggtgtgtggtctttatattttgagtaatttccaacagaggagaggaaatatgtcaaaatataacctggcggcagcgcaaaagatg

SEQ ID NO: 187002 - DNA, 103 bp, Artificial Sequence
  Synthetic Polynucleotide
taatacgactcactatagggtacagggacctgtgtggtctttatattttgaacagaggagacaaaatatgaagaccacaaacctggcggcagcgcaaaagatg

SEQ ID NO: 187003 - DNA, 103 bp, Artificial Sequence
  Synthetic Polynucleotide
taatacgactcactataggggatcttctgttacagggacctgtgtggtctaacagaggagaagaccaatgaggtccctgaacctggcggcagcgcaaaagatg

SEQ ID NO: 187004 - DNA, 103 bp, Artificial Sequence
  Synthetic Polynucleotide
taatacgactcactatagggtctttaggaagatcttctgttacagggaccaacagaggagaggtcccatgaacagaagaaacctggcggcagcgcaaaagatg

SEQ ID NO: 187005 - DNA, 103 bp, Artificial Sequence
  Synthetic Polynucleotide
taatacgactcactataggggcccaaaggctctttaggaagatcttctgtaacagaggagaacagaaatgcttcctaaaaacctggcggcagcgcaaaagatg

SEQ ID NO: 187006 - DNA, 103 bp, Artificial Sequence
  Synthetic Polynucleotide
taatacgactcactatagggtatttgtgctgcccaaaggctctttaggaaaacagaggagattcctaatgagcctttggaacctggcggcagcgcaaaagatg

SEQ ID NO: 187007 - DNA, 103 bp, Artificial Sequence
  Synthetic Polynucleotide
taatacgactcactatagggttggcctcactatttgtgctgcccaaaggcaacagaggagagcctttatgcagcacaaaaacctggcggcagcgcaaaagatg

SEQ ID NO: 187008 - DNA, 103 bp, Artificial Sequence
  Synthetic Polynucleotide
taatacgactcactatagggcttaacctgagatctttttttcttatcaccaacagaggagaggtgatatgaaaaaaagaaacctggcggcagcgcaaaagatg

SEQ ID NO: 187009 - DNA, 103 bp, Artificial Sequence
  Synthetic Polynucleotide
taatacgactcactatagggtctccgcttcttggcctcactatttgtgctaacagaggagaagcacaatgagtgaggccaacctggcggcagcgcaaaagatg

SEQ ID NO: 187010 - DNA, 103 bp, Artificial Sequence
  Synthetic Polynucleotide
taatacgactcactatagggggctcgcagttctccgcttcttggcctcacaacagaggagagtgaggatgagaagcggaaacctggcggcagcgcaaaagatg

SEQ ID NO: 187011 - DNA, 103 bp, Artificial Sequence
  Synthetic Polynucleotide
taatacgactcactatagggagtgcaggtgggctcgcagttctccgcttcaacagaggagagaagcgatgaactgcgagaacctggcggcagcgcaaaagatg

SEQ ID NO: 187012 - DNA, 103 bp, Artificial Sequence
  Synthetic Polynucleotide
taatacgactcactatagggaattttgggcagtgcaggtgggctcgcagtaacagaggagaactgcgatgccacctgcaaacctggcggcagcgcaaaagatg

SEQ ID NO: 187013 - DNA, 103 bp, Artificial Sequence
  Synthetic Polynucleotide
taatacgactcactatagggtttcggccttaattttgggcagtgcaggtgaacagaggagacacctgatgtgcccaaaaaacctggcggcagcgcaaaagatg

SEQ ID NO: 187014 - DNA, 103 bp, Artificial Sequence
  Synthetic Polynucleotide
taatacgactcactatagggtcagagtctgtttcggccttaattttgggcaacagaggagagcccaaatgtaaggccgaaacctggcggcagcgcaaaagatg

SEQ ID NO: 187015 - DNA, 103 bp, Artificial Sequence
  Synthetic Polynucleotide
taatacgactcactataggggaccatggggtcagagtctgtttcggccttaacagaggagaaaggccatgacagactctaacctggcggcagcgcaaaagatg

SEQ ID NO: 187016 - DNA, 103 bp, Artificial Sequence
  Synthetic Polynucleotide
taatacgactcactatagggagcaagaggggaccatggggtcagagtctgaacagaggagacagactatgaccccatggaacctggcggcagcgcaaaagatg

SEQ ID NO: 187017 - DNA, 103 bp, Artificial Sequence
  Synthetic Polynucleotide
taatacgactcactatagggagacttaaagagcaagaggggaccatggggaacagaggagaccccatatgcccctcttgaacctggcggcagcgcaaaagatg

SEQ ID NO: 187018 - DNA, 103 bp, Artificial Sequence
  Synthetic Polynucleotide
taatacgactcactataggggctaagaggaagacttaaagagcaagagggaacagaggagaccctctatgtctttaagtaacctggcggcagcgcaaaagatg

SEQ ID NO: 187019 - DNA, 103 bp, Artificial Sequence
  Synthetic Polynucleotide
taatacgactcactatagggtctcggtggccgccacaggctcagtagtgtaacagaggagaacactaatgagcctgtggaacctggcggcagcgcaaaagatg

SEQ ID NO: 187020 - DNA, 103 bp, Artificial Sequence
  Synthetic Polynucleotide
taatacgactcactatagggatacattattcttaacctgagatcttttttaacagaggagaaaaaaaatgctcaggttaaacctggcggcagcgcaaaagatg

SEQ ID NO: 187021 - DNA, 103 bp, Artificial Sequence
  Synthetic Polynucleotide
taatacgactcactatagggttgttgatatgctaagaggaagacttaaagaacagaggagactttaaatgttcctcttaaacctggcggcagcgcaaaagatg

SEQ ID NO: 187022 - DNA, 103 bp, Artificial Sequence
  Synthetic Polynucleotide
taatacgactcactatagggactgcctctgttgttgatatgctaagaggaaacagaggagatcctctatgcatatcaacaacctggcggcagcgcaaaagatg

SEQ ID NO: 187023 - DNA, 103 bp, Artificial Sequence
  Synthetic Polynucleotide
taatacgactcactataggggtggaaagacactgcctctgttgttgatataacagaggagaatatcaatgacagaggcaaacctggcggcagcgcaaaagatg

SEQ ID NO: 187024 - DNA, 103 bp, Artificial Sequence
  Synthetic Polynucleotide
taatacgactcactatagggttttctctttgtggaaagacactgcctctgaacagaggagacagaggatgtgtctttccaacctggcggcagcgcaaaagatg

SEQ ID NO: 187025 - DNA, 103 bp, Artificial Sequence
  Synthetic Polynucleotide
taatacgactcactatagggaaataaacacttttctctttgtggaaagacaacagaggagagtctttatgcaaagagaaaacctggcggcagcgcaaaagatg

SEQ ID NO: 187026 - DNA, 103 bp, Artificial Sequence
  Synthetic Polynucleotide
taatacgactcactatagggctttgatgacaaataaacacttttctctttaacagaggagaaaagagatgagtgtttataacctggcggcagcgcaaaagatg

SEQ ID NO: 187027 - DNA, 103 bp, Artificial Sequence
  Synthetic Polynucleotide
taatacgactcactataggggttgtttgagctttgatgacaaataaacacaacagaggagagtgtttatgtgtcatcaaaacctggcggcagcgcaaaagatg

SEQ ID NO: 187028 - DNA, 103 bp, Artificial Sequence
  Synthetic Polynucleotide
taatacgactcactataggggtttgaagaagttgtttgagctttgatgacaacagaggagagtcatcatggctcaaacaaacctggcggcagcgcaaaagatg

SEQ ID NO: 187029 - DNA, 103 bp, Artificial Sequence
  Synthetic Polynucleotide
taatacgactcactatagggtttatcttgggtttgaagaagttgtttgagaacagaggagactcaaaatgcttcttcaaaacctggcggcagcgcaaaagatg

SEQ ID NO: 187030 - DNA, 103 bp, Artificial Sequence
  Synthetic Polynucleotide
taatacgactcactatagggcaggagttagtttatcttgggtttgaagaaaacagaggagattcttcatgcccaagataaacctggcggcagcgcaaaagatg

SEQ ID NO: 187031 - DNA, 103 bp, Artificial Sequence
  Synthetic Polynucleotide
taatacgactcactatagggtcccacatgtatacattattcttaacctgaaacagaggagatcaggtatggaataatgtaacctggcggcagcgcaaaagatg

SEQ ID NO: 187032 - DNA, 103 bp, Artificial Sequence
  Synthetic Polynucleotide
taatacgactcactataggggaaatccctgcaggagttagtttatcttggaacagaggagaccaagaatgactaactccaacctggcggcagcgcaaaagatg

SEQ ID NO: 187033 - DNA, 103 bp, Artificial Sequence
  Synthetic Polynucleotide
taatacgactcactatagggttcagttgctgaaatccctgcaggagttagaacagaggagactaactatggcagggattaacctggcggcagcgcaaaagatg

SEQ ID NO: 187034 - DNA, 103 bp, Artificial Sequence
  Synthetic Polynucleotide
taatacgactcactatagggatttagctatttcagttgctgaaatccctgaacagaggagacagggaatgcagcaactgaacctggcggcagcgcaaaagatg

SEQ ID NO: 187035 - DNA, 103 bp, Artificial Sequence
  Synthetic Polynucleotide
taatacgactcactatagggacaggacctaatttagctatttcagttgctaacagaggagaagcaacatgaatagctaaaacctggcggcagcgcaaaagatg

SEQ ID NO: 187036 - DNA, 103 bp, Artificial Sequence
  Synthetic Polynucleotide
taatacgactcactatagggagacacacaaacaggacctaatttagctataacagaggagaatagctatgttaggtcctaacctggcggcagcgcaaaagatg

SEQ ID NO: 187037 - DNA, 103 bp, Artificial Sequence
  Synthetic Polynucleotide
taatacgactcactatagggatgcaggagcagacacacaaacaggacctaaacagaggagataggtcatgtttgtgtgtaacctggcggcagcgcaaaagatg

SEQ ID NO: 187038 - DNA, 103 bp, Artificial Sequence
  Synthetic Polynucleotide
taatacgactcactatagggggcaacattgatgcaggagcagacacacaaaacagaggagattgtgtatgtgctcctgcaacctggcggcagcgcaaaagatg

SEQ ID NO: 187039 - DNA, 103 bp, Artificial Sequence
  Synthetic Polynucleotide
taatacgactcactatagggtgaggtcacaggcaacattgatgcaggagcaacagaggagagctcctatgtcaatgttgaacctggcggcagcgcaaaagatg

SEQ ID NO: 187040 - DNA, 103 bp, Artificial Sequence
  Synthetic Polynucleotide
taatacgactcactatagggtaaacctacttgaggtcacaggcaacattgaacagaggagacaatgtatgctgtgacctaacctggcggcagcgcaaaagatg

SEQ ID NO: 187041 - DNA, 103 bp, Artificial Sequence
  Synthetic Polynucleotide
taatacgactcactataggggtccgcctcttaaacctacttgaggtcacaaacagaggagatgtgacatgaagtaggttaacctggcggcagcgcaaaagatg

SEQ ID NO: 187042 - DNA, 103 bp, Artificial Sequence
  Synthetic Polynucleotide
taatacgactcactataggggtaatacacctcccacatgtatacattattaacagaggagaaataatatgtacatgtggaacctggcggcagcgcaaaagatg

SEQ ID NO: 187043 - DNA, 103 bp, Artificial Sequence
  Synthetic Polynucleotide
taatacgactcactatagggaggagagctggtccgcctcttaaacctactaacagaggagaagtaggatgaagaggcggaacctggcggcagcgcaaaagatg

SEQ ID NO: 187044 - DNA, 103 bp, Artificial Sequence
  Synthetic Polynucleotide
taatacgactcactataggggagaactgggaggagagctggtccgcctctaacagaggagaagaggcatgccagctctcaacctggcggcagcgcaaaagatg

SEQ ID NO: 187045 - DNA, 103 bp, Artificial Sequence
  Synthetic Polynucleotide
taatacgactcactatagggctgtgctgtggagaactgggaggagagctgaacagaggagacagctcatgtcccagttcaacctggcggcagcgcaaaagatg

SEQ ID NO: 187046 - DNA, 103 bp, Artificial Sequence
  Synthetic Polynucleotide
taatacgactcactatagggaagggcaggactgtgctgtggagaactgggaacagaggagacccagtatgccacagcacaacctggcggcagcgcaaaagatg

SEQ ID NO: 187047 - DNA, 103 bp, Artificial Sequence
  Synthetic Polynucleotide
taatacgactcactatagggcaaagtctcgaagggcaggactgtgctgtgaacagaggagacacagcatggtcctgcccaacctggcggcagcgcaaaagatg

SEQ ID NO: 187048 - DNA, 103 bp, Artificial Sequence
  Synthetic Polynucleotide
taatacgactcactatagggcttggctttccaaagtctcgaagggcaggaaacagaggagatcctgcatgtcgagacttaacctggcggcagcgcaaaagatg

SEQ ID NO: 187049 - DNA, 103 bp, Artificial Sequence
  Synthetic Polynucleotide
taatacgactcactatagggtttcccatcacttggctttccaaagtctcgaacagaggagacgagacatgggaaagccaaacctggcggcagcgcaaaagatg

SEQ ID NO: 187050 - DNA, 103 bp, Artificial Sequence
  Synthetic Polynucleotide
taatacgactcactatagggtccatgctgctttcccatcacttggctttcaacagaggagagaaagcatggtgatgggaaacctggcggcagcgcaaaagatg

SEQ ID NO: 187051 - DNA, 103 bp, Artificial Sequence
  Synthetic Polynucleotide
taatacgactcactatagggccggcatcggtccatgctgctttcccatcaaacagaggagatgatggatgagcagcatgaacctggcggcagcgcaaaagatg

SEQ ID NO: 187052 - DNA, 103 bp, Artificial Sequence
  Synthetic Polynucleotide
taatacgactcactatagggggaagtcagcccggcatcggtccatgctgcaacagaggagagcagcaatgaccgatgccaacctggcggcagcgcaaaagatg

SEQ ID NO: 187053 - DNA, 103 bp, Artificial Sequence
  Synthetic Polynucleotide
taatacgactcactatagggccaaatttgggtaatacacctcccacatgtaacagaggagaacatgtatgaggtgtattaacctggcggcagcgcaaaagatg

SEQ ID NO: 187054 - DNA, 103 bp, Artificial Sequence
  Synthetic Polynucleotide
taatacgactcactatagggtggattttttggaagtcagcccggcatcggaacagaggagaccgatgatgggctgacttaacctggcggcagcgcaaaagatg

SEQ ID NO: 187055 - DNA, 103 bp, Artificial Sequence
  Synthetic Polynucleotide
taatacgactcactatagggctttctaatttggattttttggaagtcagcaacagaggagagctgacatgcaaaaaatcaacctggcggcagcgcaaaagatg

SEQ ID NO: 187056 - DNA, 103 bp, Artificial Sequence
  Synthetic Polynucleotide
taatacgactcactataggggtcgctgtgactttctaatttggattttttaacagaggagaaaaaaaatgaaattagaaaacctggcggcagcgcaaaagatg

SEQ ID NO: 187057 - DNA, 103 bp, Artificial Sequence
  Synthetic Polynucleotide
taatacgactcactatagggatgctggtgagtcgctgtgactttctaattaacagaggagaaattagatggtcacagcgaacctggcggcagcgcaaaagatg

SEQ ID NO: 187058 - DNA, 103 bp, Artificial Sequence
  Synthetic Polynucleotide
taatacgactcactataggggacaaactccatgctggtgagtcgctgtgaaacagaggagatcacagatgctcaccagcaacctggcggcagcgcaaaagatg

SEQ ID NO: 187059 - DNA, 103 bp, Artificial Sequence
  Synthetic Polynucleotide
taatacgactcactatagggatctctcccagacaaactccatgctggtgaaacagaggagatcaccaatgtggagtttgaacctggcggcagcgcaaaagatg

SEQ ID NO: 187060 - DNA, 103 bp, Artificial Sequence
  Synthetic Polynucleotide
taatacgactcactatagggtttctctctcatctctcccagacaaactccaacagaggagaggagttatgctgggagagaacctggcggcagcgcaaaagatg

SEQ ID NO: 187061 - DNA, 103 bp, Artificial Sequence
  Synthetic Polynucleotide
taatacgactcactataggggggctcacagtttctctctcatctctcccaaacagaggagatgggagatgtgagagagaaacctggcggcagcgcaaaagatg

SEQ ID NO: 187062 - DNA, 103 bp, Artificial Sequence
  Synthetic Polynucleotide
taatacgactcactatagggaaagcatggagggctcacagtttctctctcaacagaggagagagagaatgactgtgagcaacctggcggcagcgcaaaagatg

SEQ ID NO: 187063 - DNA, 103 bp, Artificial Sequence
  Synthetic Polynucleotide
taatacgactcactatagggtatattcatcaaagcatggagggctcacagaacagaggagactgtgaatgctccatgctaacctggcggcagcgcaaaagatg

SEQ ID NO: 187064 - DNA, 103 bp, Artificial Sequence
  Synthetic Polynucleotide
taatacgactcactatagggcacatccatcccaaatttgggtaatacaccaacagaggagaggtgtaatgcccaaatttaacctggcggcagcgcaaaagatg

SEQ ID NO: 187065 - DNA, 103 bp, Artificial Sequence
  Synthetic Polynucleotide
taatacgactcactatagggttagacattttatattcatcaaagcatggaaacagaggagatccatgatgtgatgaataaacctggcggcagcgcaaaagatg

SEQ ID NO: 187066 - DNA, 103 bp, Artificial Sequence
  Synthetic Polynucleotide
taatacgactcactatagggtgtccactctttagacattttatattcatcaacagaggagagatgaaatgaaaatgtctaacctggcggcagcgcaaaagatg

SEQ ID NO: 187067 - DNA, 103 bp, Artificial Sequence
  Synthetic Polynucleotide
taatacgactcactatagggcagaactagctgtccactctttagacatttaacagaggagaaaatgtatgaagagtggaaacctggcggcagcgcaaaagatg

SEQ ID NO: 187068 - DNA, 103 bp, Artificial Sequence
  Synthetic Polynucleotide
taatacgactcactatagggctgctaaaagcagaactagctgtccactctaacagaggagaagagtgatgagctagttcaacctggcggcagcgcaaaagatg

SEQ ID NO: 187069 - DNA, 103 bp, Artificial Sequence
  Synthetic Polynucleotide
taatacgactcactataggggttgcacacactgctaaaagcagaactagcaacagaggagagctagtatggcttttagcaacctggcggcagcgcaaaagatg

SEQ ID NO: 187070 - DNA, 103 bp, Artificial Sequence
  Synthetic Polynucleotide
taatacgactcactataggggtggctgctggttgcacacactgctaaaagaacagaggagacttttaatggtgtgtgcaaacctggcggcagcgcaaaagatg

SEQ ID NO: 187071 - DNA, 103 bp, Artificial Sequence
  Synthetic Polynucleotide
taatacgactcactataggggataaatccagtggctgctggttgcacacaaacagaggagatgtgtgatgccagcagccaacctggcggcagcgcaaaagatg

SEQ ID NO: 187072 - DNA, 103 bp, Artificial Sequence
  Synthetic Polynucleotide
taatacgactcactataggggacaccgctggataaatccagtggctgctgaacagaggagacagcagatgctggatttaaacctggcggcagcgcaaaagatg

SEQ ID NO: 187073 - DNA, 103 bp, Artificial Sequence
  Synthetic Polynucleotide
taatacgactcactatagggccttctgtttgacaccgctggataaatccaaacagaggagatggattatgccagcggtgaacctggcggcagcgcaaaagatg

SEQ ID NO: 187074 - DNA, 103 bp, Artificial Sequence
  Synthetic Polynucleotide
taatacgactcactataggggtaccctcagccttctgtttgacaccgctgaacagaggagacagcggatgcaaacagaaaacctggcggcagcgcaaaagatg

SEQ ID NO: 187075 - DNA, 103 bp, Artificial Sequence
  Synthetic Polynucleotide
taatacgactcactatagggggcatcaatgcacatccatcccaaatttggaacagaggagaccaaatatgggatggatgaacctggcggcagcgcaaaagatg

SEQ ID NO: 187076 - DNA, 103 bp, Artificial Sequence
  Synthetic Polynucleotide
taatacgactcactatagggagtcttgcctgtaccctcagccttctgtttaacagaggagaaaacagatggctgagggtaacctggcggcagcgcaaaagatg

SEQ ID NO: 187077 - DNA, 103 bp, Artificial Sequence
  Synthetic Polynucleotide
taatacgactcactatagggactggactggagtcttgcctgtaccctcagaacagaggagactgaggatgcaggcaagaaacctggcggcagcgcaaaagatg

SEQ ID NO: 187078 - DNA, 103 bp, Artificial Sequence
  Synthetic Polynucleotide
taatacgactcactatagggacagattcccactggactggagtcttgcctaacagaggagaaggcaaatgtccagtccaaacctggcggcagcgcaaaagatg

SEQ ID NO: 187079 - DNA, 103 bp, Artificial Sequence
  Synthetic Polynucleotide
taatacgactcactataggggagatctaagacagattcccactggactggaacagaggagaccagtcatgtgggaatctaacctggcggcagcgcaaaagatg

SEQ ID NO: 187080 - DNA, 103 bp, Artificial Sequence
  Synthetic Polynucleotide
taatacgactcactatagggtatgcacactgagatctaagacagattcccaacagaggagagggaatatgtcttagatcaacctggcggcagcgcaaaagatg

SEQ ID NO: 187081 - DNA, 103 bp, Artificial Sequence
  Synthetic Polynucleotide
taatacgactcactatagggcaatgctttttatgcacactgagatctaagaacagaggagacttagaatgcagtgtgcaaacctggcggcagcgcaaaagatg

SEQ ID NO: 187082 - DNA, 103 bp, Artificial Sequence
  Synthetic Polynucleotide
taatacgactcactatagggagagtcactacaatgctttttatgcacactaacagaggagaagtgtgatgaaaaagcataacctggcggcagcgcaaaagatg

SEQ ID NO: 187083 - DNA, 103 bp, Artificial Sequence
  Synthetic Polynucleotide
taatacgactcactatagggccttgccttcagagtcactacaatgcttttaacagaggagaaaaagcatggtagtgactaacctggcggcagcgcaaaagatg

SEQ ID NO: 187084 - DNA, 103 bp, Artificial Sequence
  Synthetic Polynucleotide
taatacgactcactatagggtctttgaattccttgccttcagagtcactaaacagaggagatagtgaatgtgaaggcaaaacctggcggcagcgcaaaagatg

SEQ ID NO: 187085 - DNA, 103 bp, Artificial Sequence
  Synthetic Polynucleotide
taatacgactcactatagggtgaatgactttctttgaattccttgccttcaacagaggagagaaggcatggaattcaaaaacctggcggcagcgcaaaagatg

SEQ ID NO: 187086 - DNA, 103 bp, Artificial Sequence
  Synthetic Polynucleotide
taatacgactcactatagggctggatcagtggcatcaatgcacatccatcaacagaggagagatggaatggcattgatgaacctggcggcagcgcaaaagatg

SEQ ID NO: 187087 - DNA, 103 bp, Artificial Sequence
  Synthetic Polynucleotide
taatacgactcactatagggtaggctgcactgaatgactttctttgaattaacagaggagaaattcaatgaaagtcattaacctggcggcagcgcaaaagatg

SEQ ID NO: 187088 - DNA, 103 bp, Artificial Sequence
  Synthetic Polynucleotide
taatacgactcactataggggcactacacgtaggctgcactgaatgacttaacagaggagaaagtcaatgagtgcagccaacctggcggcagcgcaaaagatg

SEQ ID NO: 187089 - DNA, 103 bp, Artificial Sequence
  Synthetic Polynucleotide
taatacgactcactatagggtttctttacagcactacacgtaggctgcacaacagaggagagtgcagatgacgtgtagtaacctggcggcagcgcaaaagatg

SEQ ID NO: 187090 - DNA, 103 bp, Artificial Sequence
  Synthetic Polynucleotide
taatacgactcactatagggttggtttccttttctttacagcactacacgaacagaggagacgtgtaatgctgtaaagaaacctggcggcagcgcaaaagatg

SEQ ID NO: 187091 - DNA, 103 bp, Artificial Sequence
  Synthetic Polynucleotide
taatacgactcactatagggatgcaggtggttggtttccttttctttacaaacagaggagatgtaaaatgaaggaaaccaacctggcggcagcgcaaaagatg

SEQ ID NO: 187092 - DNA, 103 bp, Artificial Sequence
  Synthetic Polynucleotide
taatacgactcactatagggcttctgcagcatgcaggtggttggtttcctaacagaggagaaggaaaatgaccacctgcaacctggcggcagcgcaaaagatg

SEQ ID NO: 187093 - DNA, 103 bp, Artificial Sequence
  Synthetic Polynucleotide
taatacgactcactatagggtgagaagaaccttctgcagcatgcaggtggaacagaggagaccacctatgtgctgcagaaacctggcggcagcgcaaaagatg

SEQ ID NO: 187094 - DNA, 103 bp, Artificial Sequence
  Synthetic Polynucleotide
taatacgactcactatagggttatattcattgagaagaaccttctgcagcaacagaggagagctgcaatgggttcttctaacctggcggcagcgcaaaagatg

SEQ ID NO: 187095 - DNA, 103 bp, Artificial Sequence
  Synthetic Polynucleotide
taatacgactcactatagggatcgatgccattatattcattgagaagaacaacagaggagagttcttatgaatgaatataacctggcggcagcgcaaaagatg

SEQ ID NO: 187096 - DNA, 103 bp, Artificial Sequence
  Synthetic Polynucleotide
taatacgactcactatagggctacaggtaaatcgatgccattatattcataacagaggagaatgaatatgatggcatcgaacctggcggcagcgcaaaagatg

SEQ ID NO: 187097 - DNA, 103 bp, Artificial Sequence
  Synthetic Polynucleotide
taatacgactcactatagggtttcccttctctggatcagtggcatcaatgaacagaggagacattgaatgcactgatccaacctggcggcagcgcaaaagatg

SEQ ID NO: 187098 - DNA, 103 bp, Artificial Sequence
  Synthetic Polynucleotide
taatacgactcactataggggcagggttttctacaggtaaatcgatgccaaacagaggagatggcatatgtttacctgtaacctggcggcagcgcaaaagatg

SEQ ID NO: 187099 - DNA, 103 bp, Artificial Sequence
  Synthetic Polynucleotide
taatacgactcactatagggggtcccatctgcagggttttctacaggtaaaacagaggagattacctatggaaaaccctaacctggcggcagcgcaaaagatg

SEQ ID NO: 187100 - DNA, 103 bp, Artificial Sequence
  Synthetic Polynucleotide
taatacgactcactatagggttgggctcctggtcccatctgcagggttttaacagaggagaaaaaccatgcagatgggaaacctggcggcagcgcaaaagatg

SEQ ID NO: 187101 - DNA, 103 bp, Artificial Sequence
  Synthetic Polynucleotide
taatacgactcactatagggttacaaggacttgggctcctggtcccatctaacagaggagaagatggatgcaggagcccaacctggcggcagcgcaaaagatg

SEQ ID NO: 187102 - DNA, 103 bp, Artificial Sequence
  Synthetic Polynucleotide
taatacgactcactatagggttctagggatttacaaggacttgggctcctaacagaggagaaggagcatgagtccttgtaacctggcggcagcgcaaaagatg

SEQ ID NO: 187103 - DNA, 103 bp, Artificial Sequence
  Synthetic Polynucleotide
taatacgactcactatagggctggctgagcttctagggatttacaaggacaacagaggagagtccttatgaatccctagaacctggcggcagcgcaaaagatg

SEQ ID NO: 187104 - DNA, 103 bp, Artificial Sequence
  Synthetic Polynucleotide
taatacgactcactatagggaggtcaggatctggctgagcttctagggataacagaggagaatccctatgagctcagccaacctggcggcagcgcaaaagatg

SEQ ID NO: 187105 - DNA, 103 bp, Artificial Sequence
  Synthetic Polynucleotide
taatacgactcactataggggcccggaccgaggtcaggatctggctgagcaacagaggagagctcagatggatcctgacaacctggcggcagcgcaaaagatg

SEQ ID NO: 187106 - DNA, 103 bp, Artificial Sequence
  Synthetic Polynucleotide
taatacgactcactatagggggaaaccagagcccggaccgaggtcaggataacagaggagaatcctgatgtcggtccggaacctggcggcagcgcaaaagatg

SEQ ID NO: 187107 - DNA, 103 bp, Artificial Sequence
  Synthetic Polynucleotide
taatacgactcactataggggtaggggcagggaaaccagagcccggaccgaacagaggagacggtccatgctctggtttaacctggcggcagcgcaaaagatg

SEQ ID NO: 187108 - DNA, 103 bp, Artificial Sequence
  Synthetic Polynucleotide
taatacgactcactatagggtcgcagccagtttcccttctctggatcagtaacagaggagaactgatatggagaagggaaacctggcggcagcgcaaaagatg

SEQ ID NO: 187109 - DNA, 103 bp, Artificial Sequence
  Synthetic Polynucleotide
taatacgactcactatagggggactcaacagtaggggcagggaaaccagaaacagaggagatctggtatgcctgcccctaacctggcggcagcgcaaaagatg

SEQ ID NO: 187110 - DNA, 103 bp, Artificial Sequence
  Synthetic Polynucleotide
taatacgactcactatagggcatcaggtgtggactcaacagtaggggcagaacagaggagactgcccatgctgttgagtaacctggcggcagcgcaaaagatg

SEQ ID NO: 187111 - DNA, 103 bp, Artificial Sequence
  Synthetic Polynucleotide
taatacgactcactataggggaaggacaaacatcaggtgtggactcaacaaacagaggagatgttgaatgcacacctgaaacctggcggcagcgcaaaagatg

SEQ ID NO: 187112 - DNA, 103 bp, Artificial Sequence
  Synthetic Polynucleotide
taatacgactcactatagggggcaggtgatgaaggacaaacatcaggtgtaacagaggagaacacctatggtttgtcctaacctggcggcagcgcaaaagatg

SEQ ID NO: 187113 - DNA, 103 bp, Artificial Sequence
  Synthetic Polynucleotide
taatacgactcactataggggtgtctgcagggcaggtgatgaaggacaaaaacagaggagatttgtcatgcatcacctgaacctggcggcagcgcaaaagatg

SEQ ID NO: 187114 - DNA, 103 bp, Artificial Sequence
  Synthetic Polynucleotide
taatacgactcactataggggaaagggagggtgtctgcagggcaggtgataacagaggagaatcaccatgcctgcagacaacctggcggcagcgcaaaagatg

SEQ ID NO: 187115 - DNA, 103 bp, Artificial Sequence
  Synthetic Polynucleotide
taatacgactcactatagggctgaccggatgaaagggagggtgtctgcagaacagaggagactgcagatgccctcccttaacctggcggcagcgcaaaagatg

SEQ ID NO: 187116 - DNA, 103 bp, Artificial Sequence
  Synthetic Polynucleotide
taatacgactcactataggggaggaggcagctgaccggatgaaagggaggaacagaggagacctcccatgcatccggtcaacctggcggcagcgcaaaagatg

SEQ ID NO: 187117 - DNA, 103 bp, Artificial Sequence
  Synthetic Polynucleotide
taatacgactcactataggggggatcaagagaggaggcagctgaccggataacagaggagaatccggatggctgcctccaacctggcggcagcgcaaaagatg

SEQ ID NO: 187118 - DNA, 103 bp, Artificial Sequence
  Synthetic Polynucleotide
taatacgactcactataggggggatctgtggggatcaagagaggaggcagaacagaggagactgcctatgctcttgatcaacctggcggcagcgcaaaagatg

SEQ ID NO: 187119 - DNA, 103 bp, Artificial Sequence
  Synthetic Polynucleotide
taatacgactcactatagggaattcacatatcgcagccagtttcccttctaacagaggagaagaaggatgactggctgcaacctggcggcagcgcaaaagatg

SEQ ID NO: 187120 - DNA, 103 bp, Artificial Sequence
  Synthetic Polynucleotide
taatacgactcactataggggaggggaagagggatctgtggggatcaagaaacagaggagatcttgaatgccacagatcaacctggcggcagcgcaaaagatg

SEQ ID NO: 187121 - DNA, 103 bp, Artificial Sequence
  Synthetic Polynucleotide
taatacgactcactatagggggacagggtggaggggaagagggatctgtgaacagaggagacacagaatgctcttccccaacctggcggcagcgcaaaagatg

SEQ ID NO: 187122 - DNA, 103 bp, Artificial Sequence
  Synthetic Polynucleotide
taatacgactcactatagggtaataccgggggacagggtggaggggaagaaacagaggagatcttccatgccaccctgtaacctggcggcagcgcaaaagatg

SEQ ID NO: 187123 - DNA, 103 bp, Artificial Sequence
  Synthetic Polynucleotide
taatacgactcactatagggtggcaacagttaataccgggggacagggtgaacagaggagacaccctatgccccggtataacctggcggcagcgcaaaagatg

SEQ ID NO: 187124 - DNA, 103 bp, Artificial Sequence
  Synthetic Polynucleotide
taatacgactcactataggggggggcggagtggcaacagttaataccgggaacagaggagacccggtatgaactgttgcaacctggcggcagcgcaaaagatg

SEQ ID NO: 187125 - DNA, 103 bp, Artificial Sequence
  Synthetic Polynucleotide
taatacgactcactatagggaaggaggggagggggcggagtggcaacagtaacagaggagaactgttatgactccgcccaacctggcggcagcgcaaaagatg

SEQ ID NO: 187126 - DNA, 103 bp, Artificial Sequence
  Synthetic Polynucleotide
taatacgactcactataggggtacggtaggaaggaggggagggggcggagaacagaggagactccgcatgctcccctccaacctggcggcagcgcaaaagatg

SEQ ID NO: 187127 - DNA, 103 bp, Artificial Sequence
  Synthetic Polynucleotide
taatacgactcactataggggctggaagaggtacggtaggaaggaggggaaacagaggagatcccctatgtcctaccgtaacctggcggcagcgcaaaagatg

SEQ ID NO: 187128 - DNA, 103 bp, Artificial Sequence
  Synthetic Polynucleotide
taatacgactcactatagggggaagagggggctggaagaggtacggtaggaacagaggagacctaccatgcctcttccaaacctggcggcagcgcaaaagatg

SEQ ID NO: 187129 - DNA, 103 bp, Artificial Sequence
  Synthetic Polynucleotide
taatacgactcactataggggagatgcactggaagagggggctggaagagaacagaggagactcttcatgccccctcttaacctggcggcagcgcaaaagatg

SEQ ID NO: 187130 - DNA, 103 bp, Artificial Sequence
  Synthetic Polynucleotide
taatacgactcactatagggtcagccagggtctcggtggccgccacaggcaacagaggagagcctgtatgggccaccgaaacctggcggcagcgcaaaagatg

SEQ ID NO: 187131 - DNA, 103 bp, Artificial Sequence
  Synthetic Polynucleotide
taatacgactcactataggggagcaagcccaattcacatatcgcagccagaacagaggagactggctatgatatgtgaaaacctggcggcagcgcaaaagatg

SEQ ID NO: 187132 - DNA, 103 bp, Artificial Sequence
  Synthetic Polynucleotide
taatacgactcactatagggcatgggtgtggagatgcactggaagaggggaacagaggagacccctcatgcagtgcatcaacctggcggcagcgcaaaagatg

SEQ ID NO: 187133 - DNA, 103 bp, Artificial Sequence
  Synthetic Polynucleotide
taatacgactcactatagggtggagaggggcatgggtgtggagatgcactaacagaggagaagtgcaatgccacacccaaacctggcggcagcgcaaaagatg

SEQ ID NO: 187134 - DNA, 103 bp, Artificial Sequence
  Synthetic Polynucleotide
taatacgactcactatagggcatttgagagtggagaggggcatgggtgtgaacagaggagacacaccatggcccctctcaacctggcggcagcgcaaaagatg

SEQ ID NO: 187135 - DNA, 103 bp, Artificial Sequence
  Synthetic Polynucleotide
taatacgactcactatagggtgtgcggtggcatttgagagtggagaggggaacagaggagacccctcatgactctcaaaaacctggcggcagcgcaaaagatg

SEQ ID NO: 187136 - DNA, 103 bp, Artificial Sequence
  Synthetic Polynucleotide
taatacgactcactatagggaagtggggactgtgcggtggcatttgagagaacagaggagactctcaatggccaccgcaaacctggcggcagcgcaaaagatg

SEQ ID NO: 187137 - DNA, 103 bp, Artificial Sequence
  Synthetic Polynucleotide
taatacgactcactatagggacagaattggaagtggggactgtgcggtggaacagaggagaccaccgatgagtccccacaacctggcggcagcgcaaaagatg

SEQ ID NO: 187138 - DNA, 103 bp, Artificial Sequence
  Synthetic Polynucleotide
taatacgactcactatagggactgttggggacagaattggaagtggggacaacagaggagagtccccatgtccaattctaacctggcggcagcgcaaaagatg

SEQ ID NO: 187139 - DNA, 103 bp, Artificial Sequence
  Synthetic Polynucleotide
taatacgactcactatagggagagggggacactgttggggacagaattggaacagaggagaccaattatgtccccaacaaacctggcggcagcgcaaaagatg

SEQ ID NO: 187140 - DNA, 103 bp, Artificial Sequence
  Synthetic Polynucleotide
taatacgactcactatagggtgggagagggagagggggacactgttggggaacagaggagaccccaaatgtgtccccctaacctggcggcagcgcaaaagatg

SEQ ID NO: 187141 - DNA, 103 bp, Artificial Sequence
  Synthetic Polynucleotide
taatacgactcactatagggacgggaggaatgggagagggagagggggacaacagaggagagtccccatgtccctctccaacctggcggcagcgcaaaagatg

SEQ ID NO: 187142 - DNA, 103 bp, Artificial Sequence
  Synthetic Polynucleotide
taatacgactcactatagggctcttctcctgagcaagcccaattcacataaacagaggagatatgtgatgtgggcttgcaacctggcggcagcgcaaaagatg

SEQ ID NO: 187143 - DNA, 103 bp, Artificial Sequence
  Synthetic Polynucleotide
taatacgactcactatagggcaggggctccacgggaggaatgggagagggaacagaggagaccctctatgattcctcccaacctggcggcagcgcaaaagatg

SEQ ID NO: 187144 - DNA, 103 bp, Artificial Sequence
  Synthetic Polynucleotide
taatacgactcactatagggcggcagacatcaggggctccacgggaggaaaacagaggagattcctcatgtggagccccaacctggcggcagcgcaaaagatg

SEQ ID NO: 187145 - DNA, 103 bp, Artificial Sequence
  Synthetic Polynucleotide
taatacgactcactatagggccgggtgaggcggcagacatcaggggctccaacagaggagaggagccatggatgtctgcaacctggcggcagcgcaaaagatg

SEQ ID NO: 187146 - DNA, 103 bp, Artificial Sequence
  Synthetic Polynucleotide
taatacgactcactatagggtgttggaggcccgggtgaggcggcagacataacagaggagaatgtctatggcctcacccaacctggcggcagcgcaaaagatg

SEQ ID NO: 187147 - DNA, 103 bp, Artificial Sequence
  Synthetic Polynucleotide
taatacgactcactatagggaagaagaaagtgttggaggcccgggtgaggaacagaggagacctcacatgggcctccaaaacctggcggcagcgcaaaagatg

SEQ ID NO: 187148 - DNA, 103 bp, Artificial Sequence
  Synthetic Polynucleotide
taatacgactcactataggggaagaggaggaagaagaaagtgttggaggcaacagaggagagcctccatgactttcttcaacctggcggcagcgcaaaagatg

SEQ ID NO: 187149 - DNA, 103 bp, Artificial Sequence
  Synthetic Polynucleotide
taatacgactcactatagggggaggaagatgaagaggaggaagaagaaagaacagaggagactttctatgtcctcctctaacctggcggcagcgcaaaagatg

SEQ ID NO: 187150 - DNA, 103 bp, Artificial Sequence
  Synthetic Polynucleotide
taatacgactcactatagggacgaagaggaggaggaagatgaagaggaggaacagaggagacctcctatgcatcttcctaacctggcggcagcgcaaaagatg

SEQ ID NO: 187151 - DNA, 103 bp, Artificial Sequence
  Synthetic Polynucleotide
taatacgactcactataggggaagaagaaaacgaagaggaggaggaagataacagaggagaatcttcatgctcctcttcaacctggcggcagcgcaaaagatg

SEQ ID NO: 187152 - DNA, 103 bp, Artificial Sequence
  Synthetic Polynucleotide
taatacgactcactatagggggaggaagatgaagaagaaaacgaagaggaaacagaggagatcctctatgttttcttctaacctggcggcagcgcaaaagatg

SEQ ID NO: 187153 - DNA, 103 bp, Artificial Sequence
  Synthetic Polynucleotide
taatacgactcactatagggataaattttgctcttctcctgagcaagcccaacagaggagagggcttatgcaggagaagaacctggcggcagcgcaaaagatg

SEQ ID NO: 187154 - DNA, 103 bp, Artificial Sequence
  Synthetic Polynucleotide
taatacgactcactatagggaaggagaagaggaggaagatgaagaagaaaaacagaggagatttcttatgcatcttcctaacctggcggcagcgcaaaagatg

SEQ ID NO: 187155 - DNA, 103 bp, Artificial Sequence
  Synthetic Polynucleotide
taatacgactcactatagggggaggtggagaaggagaagaggaggaagataacagaggagaatcttcatgctcttctccaacctggcggcagcgcaaaagatg

SEQ ID NO: 187156 - DNA, 103 bp, Artificial Sequence
  Synthetic Polynucleotide
taatacgactcactatagggtgcggagagaggaggtggagaaggagaagaaacagaggagatcttctatgtctccacctaacctggcggcagcgcaaaagatg

SEQ ID NO: 187157 - DNA, 103 bp, Artificial Sequence
  Synthetic Polynucleotide
taatacgactcactatagggcagatgatattgcggagagaggaggtggagaacagaggagactccacatgctctctccgaacctggcggcagcgcaaaagatg

SEQ ID NO: 187158 - DNA, 103 bp, Artificial Sequence
  Synthetic Polynucleotide
taatacgactcactataggggaggaaacaacagatgatattgcggagagaaacagaggagatctctcatgaatatcatcaacctggcggcagcgcaaaagatg

SEQ ID NO: 187159 - DNA, 103 bp, Artificial Sequence
  Synthetic Polynucleotide
taatacgactcactatagggattatcaccagaggaaacaacagatgatataacagaggagaatatcaatggttgtttccaacctggcggcagcgcaaaagatg

SEQ ID NO: 187160 - DNA, 103 bp, Artificial Sequence
  Synthetic Polynucleotide
taatacgactcactatagggaagcctccagattatcaccagaggaaacaaaacagaggagattgtttatgctggtgataaacctggcggcagcgcaaaagatg

SEQ ID NO: 187161 - DNA, 103 bp, Artificial Sequence
  Synthetic Polynucleotide
taatacgactcactatagggatggggagagaagcctccagattatcaccaaacagaggagatggtgaatgtctggaggcaacctggcggcagcgcaaaagatg

SEQ ID NO: 187162 - DNA, 103 bp, Artificial Sequence
  Synthetic Polynucleotide
taatacgactcactataggggaaagatatcatggggagagaagcctccagaacagaggagactggagatgtctctccccaacctggcggcagcgcaaaagatg

SEQ ID NO: 187163 - DNA, 103 bp, Artificial Sequence
  Synthetic Polynucleotide
taatacgactcactatagggcctcctgtttgaaagatatcatggggagagaacagaggagactctccatgtgatatcttaacctggcggcagcgcaaaagatg

SEQ ID NO: 187164 - DNA, 103 bp, Artificial Sequence
  Synthetic Polynucleotide
taatacgactcactatagggtccagtgggaataaattttgctcttctcctaacagaggagaaggagaatggcaaaatttaacctggcggcagcgcaaaagatg

SEQ ID NO: 187165 - DNA, 103 bp, Artificial Sequence
  Synthetic Polynucleotide
taatacgactcactatagggttctctaattcctcctgtttgaaagatatcaacagaggagagatatcatgcaaacaggaaacctggcggcagcgcaaaagatg

SEQ ID NO: 187166 - DNA, 103 bp, Artificial Sequence
  Synthetic Polynucleotide
taatacgactcactatagggcagaccttcattctctaattcctcctgtttaacagaggagaaaacagatggaattagagaacctggcggcagcgcaaaagatg

SEQ ID NO: 187167 - DNA, 103 bp, Artificial Sequence
  Synthetic Polynucleotide
taatacgactcactatagggccctgggtttcagaccttcattctctaattaacagaggagaaattagatgatgaaggtcaacctggcggcagcgcaaaagatg

SEQ ID NO: 187168 - DNA, 103 bp, Artificial Sequence
  Synthetic Polynucleotide
taatacgactcactatagggtggggctcttccctgggtttcagaccttcaaacagaggagatgaaggatggaaacccagaacctggcggcagcgcaaaagatg

SEQ ID NO: 187169 - DNA, 103 bp, Artificial Sequence
  Synthetic Polynucleotide
taatacgactcactatagggagcagcagactggggctcttccctgggtttaacagaggagaaaacccatggaagagcccaacctggcggcagcgcaaaagatg

SEQ ID NO: 187170 - DNA, 103 bp, Artificial Sequence
  Synthetic Polynucleotide
taatacgactcactatagggcatcctgttcagcagcagactggggctcttaacagaggagaaagagcatgagtctgctgaacctggcggcagcgcaaaagatg

SEQ ID NO: 187171 - DNA, 103 bp, Artificial Sequence
  Synthetic Polynucleotide
taatacgactcactatagggtgaacaacaacatcctgttcagcagcagacaacagaggagagtctgcatgtgaacaggaaacctggcggcagcgcaaaagatg

SEQ ID NO: 187172 - DNA, 103 bp, Artificial Sequence
  Synthetic Polynucleotide
taatacgactcactataggggaatgtttcctgaacaacaacatcctgttcaacagaggagagaacagatggttgttgttaacctggcggcagcgcaaaagatg

SEQ ID NO: 187173 - DNA, 103 bp, Artificial Sequence
  Synthetic Polynucleotide
taatacgactcactatagggagtttttgttgaatgtttcctgaacaacaaaacagaggagattgttgatgaggaaacataacctggcggcagcgcaaaagatg

SEQ ID NO: 187174 - DNA, 103 bp, Artificial Sequence
  Synthetic Polynucleotide
taatacgactcactatagggttgcaaacaaagtttttgttgaatgtttccaacagaggagaggaaacatgcaacaaaaaaacctggcggcagcgcaaaagatg

SEQ ID NO: 187175 - DNA, 103 bp, Artificial Sequence
  Synthetic Polynucleotide
taatacgactcactatagggtctgttgatttccagtgggaataaattttgaacagaggagacaaaatatgttcccactgaacctggcggcagcgcaaaagatg

SEQ ID NO: 187176 - DNA, 103 bp, Artificial Sequence
  Synthetic Polynucleotide
taatacgactcactatagggttcacagacgttgcaaacaaagtttttgttaacagaggagaaacaaaatgtttgtttgcaacctggcggcagcgcaaaagatg

SEQ ID NO: 187177 - DNA, 103 bp, Artificial Sequence
  Synthetic Polynucleotide
taatacgactcactataggggaaaaggtgattcacagacgttgcaaacaaaacagaggagattgtttatgacgtctgtgaacctggcggcagcgcaaaagatg

SEQ ID NO: 187178 - DNA, 103 bp, Artificial Sequence
  Synthetic Polynucleotide
taatacgactcactatagggttaatggaaagaaaaggtgattcacagacgaacagaggagacgtctgatgatcacctttaacctggcggcagcgcaaaagatg

SEQ ID NO: 187179 - DNA, 103 bp, Artificial Sequence
  Synthetic Polynucleotide
taatacgactcactatagggggttagatctttaatggaaagaaaaggtgaaacagaggagatcacctatgctttccattaacctggcggcagcgcaaaagatg

SEQ ID NO: 187180 - DNA, 103 bp, Artificial Sequence
  Synthetic Polynucleotide
taatacgactcactatagggataaatgtttggttagatctttaatggaaaaacagaggagatttccaatgaagatctaaaacctggcggcagcgcaaaagatg

SEQ ID NO: 187181 - DNA, 103 bp, Artificial Sequence
  Synthetic Polynucleotide
taatacgactcactataggggcatgaatagataaatgtttggttagatctaacagaggagaagatctatgcaaacatttaacctggcggcagcgcaaaagatg

SEQ ID NO: 187182 - DNA, 103 bp, Artificial Sequence
  Synthetic Polynucleotide
taatacgactcactatagggccattcttcagcatgaatagataaatgtttaacagaggagaaaacatatgtctattcataacctggcggcagcgcaaaagatg

SEQ ID NO: 187183 - DNA, 103 bp, Artificial Sequence
  Synthetic Polynucleotide
taatacgactcactatagggatttgaagggccattcttcagcatgaatagaacagaggagactattcatgctgaagaataacctggcggcagcgcaaaagatg

SEQ ID NO: 187184 - DNA, 103 bp, Artificial Sequence
  Synthetic Polynucleotide
taatacgactcactatagggcaaaattcacatttgaagggccattcttcaaacagaggagatgaagaatggcccttcaaaacctggcggcagcgcaaaagatg

SEQ ID NO: 187185 - DNA, 103 bp, Artificial Sequence
  Synthetic Polynucleotide
taatacgactcactatagggaagctgcacacaaaattcacatttgaagggaacagaggagacccttcatgtgtgaatttaacctggcggcagcgcaaaagatg

SEQ ID NO: 187186 - DNA, 103 bp, Artificial Sequence
  Synthetic Polynucleotide
taatacgactcactatagggagtaaatggctctgttgatttccagtgggaaacagaggagatcccacatgaaatcaacaaacctggcggcagcgcaaaagatg

SEQ ID NO: 187187 - DNA, 103 bp, Artificial Sequence
  Synthetic Polynucleotide
taatacgactcactatagggtatccttaaaaagctgcacacaaaattcacaacagaggagagtgaatatggtgtgcagcaacctggcggcagcgcaaaagatg

SEQ ID NO: 187188 - DNA, 103 bp, Artificial Sequence
  Synthetic Polynucleotide
taatacgactcactatagggaagtccgttttatccttaaaaagctgcacaaacagaggagatgtgcaatgttttaaggaaacctggcggcagcgcaaaagatg

SEQ ID NO: 187189 - DNA, 103 bp, Artificial Sequence
  Synthetic Polynucleotide
taatacgactcactatagggatgttctgacaagtccgttttatccttaaaaacagaggagatttaagatgaaaacggacaacctggcggcagcgcaaaagatg

SEQ ID NO: 187190 - DNA, 103 bp, Artificial Sequence
  Synthetic Polynucleotide
taatacgactcactataggggcaaaaagcgatgttctgacaagtccgtttaacagaggagaaaacggatgtgtcagaacaacctggcggcagcgcaaaagatg

SEQ ID NO: 187191 - DNA, 103 bp, Artificial Sequence
  Synthetic Polynucleotide
taatacgactcactatagggactccatgaagcaaaaagcgatgttctgacaacagaggagagtcagaatgtcgctttttaacctggcggcagcgcaaaagatg

SEQ ID NO: 187192 - DNA, 103 bp, Artificial Sequence
  Synthetic Polynucleotide
taatacgactcactataggggatattcccaactccatgaagcaaaaagcgaacagaggagacgctttatgcttcatggaaacctggcggcagcgcaaaagatg

SEQ ID NO: 187193 - DNA, 103 bp, Artificial Sequence
  Synthetic Polynucleotide
taatacgactcactatagggaacacacaaagatattcccaactccatgaaaacagaggagattcatgatgttgggaataaacctggcggcagcgcaaaagatg

SEQ ID NO: 187194 - DNA, 103 bp, Artificial Sequence
  Synthetic Polynucleotide
taatacgactcactatagggttacaaacagaacacacaaagatattcccaaacagaggagatgggaaatgctttgtgtgaacctggcggcagcgcaaaagatg

SEQ ID NO: 187195 - DNA, 103 bp, Artificial Sequence
  Synthetic Polynucleotide
taatacgactcactatagggaaattcttttttacaaacagaacacacaaaaacagaggagatttgtgatgtctgtttgtaacctggcggcagcgcaaaagatg

SEQ ID NO: 187196 - DNA, 103 bp, Artificial Sequence
  Synthetic Polynucleotide
taatacgactcactatagggacaaaaaagcaaattcttttttacaaacagaacagaggagactgtttatgaaaaagaataacctggcggcagcgcaaaagatg

SEQ ID NO: 187197 - DNA, 103 bp, Artificial Sequence
  Synthetic Polynucleotide
taatacgactcactatagggaaagttttatagtaaatggctctgttgattaacagaggagaaatcaaatgagccatttaaacctggcggcagcgcaaaagatg

SEQ ID NO: 187198 - DNA, 103 bp, Artificial Sequence
  Synthetic Polynucleotide
taatacgactcactatagggtgcaaattgcacaaaaaagcaaattcttttaacagaggagaaaaagaatgtgcttttttaacctggcggcagcgcaaaagatg

SEQ ID NO: 187199 - DNA, 103 bp, Artificial Sequence
  Synthetic Polynucleotide
taatacgactcactatagggctggtgctgctgcaaattgcacaaaaaagcaacagaggagagcttttatgtgcaatttgaacctggcggcagcgcaaaagatg

SEQ ID NO: 187200 - DNA, 103 bp, Artificial Sequence
  Synthetic Polynucleotide
taatacgactcactatagggggagatctcgctggtgctgctgcaaattgcaacagaggagagcaattatgagcagcaccaacctggcggcagcgcaaaagatg

SEQ ID NO: 187201 - DNA, 103 bp, Artificial Sequence
  Synthetic Polynucleotide
taatacgactcactatagggttatctgggtggagatctcgctggtgctgcaacagaggagagcagcaatggcgagatctaacctggcggcagcgcaaaagatg

SEQ ID NO: 187202 - DNA, 103 bp, Artificial Sequence
  Synthetic Polynucleotide
taatacgactcactatagggtgtgcacaccttatctgggtggagatctcgaacagaggagacgagatatgcacccagataacctggcggcagcgcaaaagatg

SEQ ID NO: 187203 - DNA, 103 bp, Artificial Sequence
  Synthetic Polynucleotide
taatacgactcactatagggactcgtgatgtgtgcacaccttatctgggtaacagaggagaacccagatgaggtgtgcaaacctggcggcagcgcaaaagatg

SEQ ID NO: 187204 - DNA, 103 bp, Artificial Sequence
  Synthetic Polynucleotide
taatacgactcactatagggccgctttcaaactcgtgatgtgtgcacaccaacagaggagaggtgtgatgacatcacgaaacctggcggcagcgcaaaagatg

SEQ ID NO: 187205 - DNA, 103 bp, Artificial Sequence
  Synthetic Polynucleotide
taatacgactcactatagggcctcagagtcccgctttcaaactcgtgatgaacagaggagacatcacatgtttgaaagcaacctggcggcagcgcaaaagatg

SEQ ID NO: 187206 - DNA, 103 bp, Artificial Sequence
  Synthetic Polynucleotide
taatacgactcactatagggagttctggggcctcagagtcccgctttcaaaacagaggagattgaaaatgggactctgaaacctggcggcagcgcaaaagatg

SEQ ID NO: 187207 - DNA, 103 bp, Artificial Sequence
  Synthetic Polynucleotide
taatacgactcactatagggggatctgtaaagttctggggcctcagagtcaacagaggagagactctatggccccagaaaacctggcggcagcgcaaaagatg

SEQ ID NO: 187208 - DNA, 103 bp, Artificial Sequence
  Synthetic Polynucleotide
taatacgactcactataggggattggctttaaagttttatagtaaatggcaacagaggagagccattatgtataaaactaacctggcggcagcgcaaaagatg

SEQ ID NO: 187209 - DNA, 103 bp, Artificial Sequence
  Synthetic Polynucleotide
taatacgactcactatagggggccttgctgggatctgtaaagttctggggaacagaggagaccccagatgtttacagataacctggcggcagcgcaaaagatg

SEQ ID NO: 187210 - DNA, 103 bp, Artificial Sequence
  Synthetic Polynucleotide
taatacgactcactataggggctctacatgggccttgctgggatctgtaaaacagaggagattacagatgccagcaaggaacctggcggcagcgcaaaagatg

SEQ ID NO: 187211 - DNA, 103 bp, Artificial Sequence
  Synthetic Polynucleotide
taatacgactcactatagggctctgcatatgctctacatgggccttgctgaacagaggagacagcaaatgccatgtagaaacctggcggcagcgcaaaagatg

SEQ ID NO: 187212 - DNA, 103 bp, Artificial Sequence
  Synthetic Polynucleotide
taatacgactcactatagggttctggcaagctctgcatatgctctacatgaacagaggagacatgtaatgcatatgcagaacctggcggcagcgcaaaagatg

SEQ ID NO: 187213 - DNA, 103 bp, Artificial Sequence
  Synthetic Polynucleotide
taatacgactcactatagggctaaaggatcttctggcaagctctgcatataacagaggagaatatgcatggcttgccagaacctggcggcagcgcaaaagatg

SEQ ID NO: 187214 - DNA, 103 bp, Artificial Sequence
  Synthetic Polynucleotide
taatacgactcactatagggttagaagtttctaaaggatcttctggcaagaacagaggagacttgccatgagatcctttaacctggcggcagcgcaaaagatg

SEQ ID NO: 187215 - DNA, 103 bp, Artificial Sequence
  Synthetic Polynucleotide
taatacgactcactatagggctcttcttctttagaagtttctaaaggatcaacagaggagagatcctatggaaacttctaacctggcggcagcgcaaaagatg

SEQ ID NO: 187216 - DNA, 103 bp, Artificial Sequence
  Synthetic Polynucleotide
taatacgactcactatagggcatttaactcctcttcttctttagaagtttaacagaggagaaaacttatgaagaagaagaacctggcggcagcgcaaaagatg

SEQ ID NO: 187217 - DNA, 103 bp, Artificial Sequence
  Synthetic Polynucleotide
taatacgactcactatagggtcagaggaatcatttaactcctcttcttctaacagaggagaagaagaatgggagttaaaaacctggcggcagcgcaaaagatg

SEQ ID NO: 187218 - DNA, 103 bp, Artificial Sequence
  Synthetic Polynucleotide
taatacgactcactataggggtaaagctcttcagaggaatcatttaactcaacagaggagagagttaatggattcctctaacctggcggcagcgcaaaagatg

SEQ ID NO: 187219 - DNA, 103 bp, Artificial Sequence
  Synthetic Polynucleotide
taatacgactcactatagggcgcccggcgcgattggctttaaagttttataacagaggagaataaaaatgtaaagccaaaacctggcggcagcgcaaaagatg

SEQ ID NO: 187220 - DNA, 103 bp, Artificial Sequence
  Synthetic Polynucleotide
taatacgactcactatagggttatagtcgtgtaaagctcttcagaggaataacagaggagaattcctatgaagagctttaacctggcggcagcgcaaaagatg

SEQ ID NO: 187221 - DNA, 103 bp, Artificial Sequence
  Synthetic Polynucleotide
taatacgactcactataggggccattatttttatagtcgtgtaaagctctaacagaggagaagagctatgcacgactataacctggcggcagcgcaaaagatg

SEQ ID NO: 187222 - DNA, 103 bp, Artificial Sequence
  Synthetic Polynucleotide
taatacgactcactatagggtattccagaagccattatttttatagtcgtaacagaggagaacgactatgaaaataatgaacctggcggcagcgcaaaagatg

SEQ ID NO: 187223 - DNA, 103 bp, Artificial Sequence
  Synthetic Polynucleotide
taatacgactcactatagggcttttgtctttattccagaagccattatttaacagaggagaaaataaatgcttctggaaaacctggcggcagcgcaaaagatg

SEQ ID NO: 187224 - DNA, 103 bp, Artificial Sequence
  Synthetic Polynucleotide
taatacgactcactatagggacatctggatcttttgtctttattccagaaaacagaggagattctggatgaaagacaaaaacctggcggcagcgcaaaagatg

SEQ ID NO: 187225 - DNA, 103 bp, Artificial Sequence
  Synthetic Polynucleotide
taatacgactcactataggggcccaatcgaacatctggatcttttgtcttaacagaggagaaagacaatggatccagataacctggcggcagcgcaaaagatg

SEQ ID NO: 187226 - DNA, 103 bp, Artificial Sequence
  Synthetic Polynucleotide
taatacgactcactataggggctgattgaggcccaatcgaacatctggataacagaggagaatccagatgttcgattggaacctggcggcagcgcaaaagatg

SEQ ID NO: 187227 - DNA, 103 bp, Artificial Sequence
  Synthetic Polynucleotide
taatacgactcactatagggcttgggtaatgctgattgaggcccaatcgaaacagaggagatcgattatgcctcaatcaaacctggcggcagcgcaaaagatg

SEQ ID NO: 187228 - DNA, 103 bp, Artificial Sequence
  Synthetic Polynucleotide
taatacgactcactatagggtggtttaaagcttgggtaatgctgattgagaacagaggagactcaatatgcattacccaaacctggcggcagcgcaaaagatg

SEQ ID NO: 187229 - DNA, 103 bp, Artificial Sequence
  Synthetic Polynucleotide
taatacgactcactataggggaaatggaggtggtttaaagcttgggtaataacagaggagaattaccatggctttaaacaacctggcggcagcgcaaaagatg

SEQ ID NO: 187230 - DNA, 103 bp, Artificial Sequence
  Synthetic Polynucleotide
taatacgactcactatagggaggagctcctcgcccggcgcgattggctttaacagaggagaaaagccatgcgcgccgggaacctggcggcagcgcaaaagatg

SEQ ID NO: 187231 - DNA, 103 bp, Artificial Sequence
  Synthetic Polynucleotide
taatacgactcactatagggtgatggtactgaaatggaggtggtttaaagaacagaggagactttaaatgacctccattaacctggcggcagcgcaaaagatg

SEQ ID NO: 187232 - DNA, 103 bp, Artificial Sequence
  Synthetic Polynucleotide
taatacgactcactatagggggggttacggtgatggtactgaaatggaggaacagaggagacctccaatgcagtaccataacctggcggcagcgcaaaagatg

SEQ ID NO: 187233 - DNA, 103 bp, Artificial Sequence
  Synthetic Polynucleotide
taatacgactcactatagggcaatccccatggggttacggtgatggtactaacagaggagaagtaccatgaccgtaaccaacctggcggcagcgcaaaagatg

SEQ ID NO: 187234 - DNA, 103 bp, Artificial Sequence
  Synthetic Polynucleotide
taatacgactcactataggggctgtcacaccaatccccatggggttacggaacagaggagaccgtaaatgcatggggataacctggcggcagcgcaaaagatg

SEQ ID NO: 187235 - DNA, 103 bp, Artificial Sequence
  Synthetic Polynucleotide
taatacgactcactataggggaaatttgtggctgtcacaccaatccccataacagaggagaatggggatgggtgtgacaaacctggcggcagcgcaaaagatg

SEQ ID NO: 187236 - DNA, 103 bp, Artificial Sequence
  Synthetic Polynucleotide
taatacgactcactatagggtgtgtgtagtgaaatttgtggctgtcacacaacagaggagagtgtgaatgccacaaattaacctggcggcagcgcaaaagatg

SEQ ID NO: 187237 - DNA, 103 bp, Artificial Sequence
  Synthetic Polynucleotide
taatacgactcactatagggtgtggaatattgtgtgtagtgaaatttgtgaacagaggagacacaaaatgcactacacaaacctggcggcagcgcaaaagatg

SEQ ID NO: 187238 - DNA, 103 bp, Artificial Sequence
  Synthetic Polynucleotide
taatacgactcactatagggagtgaaagtctgtggaatattgtgtgtagtaacagaggagaactacaatgaatattccaaacctggcggcagcgcaaaagatg

SEQ ID NO: 187239 - DNA, 103 bp, Artificial Sequence
  Synthetic Polynucleotide
taatacgactcactataggggaatggcggtagtgaaagtctgtggaatataacagaggagaatattcatgagactttcaaacctggcggcagcgcaaaagatg

SEQ ID NO: 187240 - DNA, 103 bp, Artificial Sequence
  Synthetic Polynucleotide
taatacgactcactatagggtttgtgcagcgaatggcggtagtgaaagtcaacagaggagagactttatgtaccgccataacctggcggcagcgcaaaagatg

SEQ ID NO: 187241 - DNA, 103 bp, Artificial Sequence
  Synthetic Polynucleotide
taatacgactcactatagggttcgggtacctcagccagggtctcggtggcaacagaggagagccaccatgaccctggctaacctggcggcagcgcaaaagatg

SEQ ID NO: 187242 - DNA, 103 bp, Artificial Sequence
  Synthetic Polynucleotide
taatacgactcactataggggtaccagaccaggagctcctcgcccggcgcaacagaggagagcgccgatggaggagctcaacctggcggcagcgcaaaagatg

SEQ ID NO: 187243 - DNA, 103 bp, Artificial Sequence
  Synthetic Polynucleotide
taatacgactcactatagggttttccacactttgtgcagcgaatggcggtaacagaggagaaccgccatgcgctgcacaaacctggcggcagcgcaaaagatg

SEQ ID NO: 187244 - DNA, 103 bp, Artificial Sequence
  Synthetic Polynucleotide
taatacgactcactatagggtgtcgacaccttttccacactttgtgcagcaacagaggagagctgcaatgagtgtggaaaacctggcggcagcgcaaaagatg

SEQ ID NO: 187245 - DNA, 103 bp, Artificial Sequence
  Synthetic Polynucleotide
taatacgactcactatagggtccggcatattgtcgacaccttttccacacaacagaggagagtgtggatgaggtgtcgaaacctggcggcagcgcaaaagatg

SEQ ID NO: 187246 - DNA, 103 bp, Artificial Sequence
  Synthetic Polynucleotide
taatacgactcactatagggtttgtgcaactccggcatattgtcgacaccaacagaggagaggtgtcatgaatatgccgaacctggcggcagcgcaaaagatg

SEQ ID NO: 187247 - DNA, 103 bp, Artificial Sequence
  Synthetic Polynucleotide
taatacgactcactatagggccaggatatgtttgtgcaactccggcatataacagaggagaatatgcatgagttgcacaaacctggcggcagcgcaaaagatg

SEQ ID NO: 187248 - DNA, 103 bp, Artificial Sequence
  Synthetic Polynucleotide
taatacgactcactataggggaagcacaagccaggatatgtttgtgcaacaacagaggagagttgcaatgacatatcctaacctggcggcagcgcaaaagatg

SEQ ID NO: 187249 - DNA, 103 bp, Artificial Sequence
  Synthetic Polynucleotide
taatacgactcactataggggtcacttgcagaagcacaagccaggatatgaacagaggagacatatcatggcttgtgctaacctggcggcagcgcaaaagatg

SEQ ID NO: 187250 - DNA, 103 bp, Artificial Sequence
  Synthetic Polynucleotide
taatacgactcactatagggacctcttcttgtcacttgcagaagcacaagaacagaggagacttgtgatgctgcaagtgaacctggcggcagcgcaaaagatg

SEQ ID NO: 187251 - DNA, 103 bp, Artificial Sequence
  Synthetic Polynucleotide
taatacgactcactatagggttaggcgtgtacctcttcttgtcacttgcaaacagaggagatgcaagatgcaagaagagaacctggcggcagcgcaaaagatg

SEQ ID NO: 187252 - DNA, 103 bp, Artificial Sequence
  Synthetic Polynucleotide
taatacgactcactatagggtgggtttttcttaggcgtgtacctcttcttaacagaggagaaagaagatgtacacgcctaacctggcggcagcgcaaaagatg

SEQ ID NO: 187253 - DNA, 103 bp, Artificial Sequence
  Synthetic Polynucleotide
taatacgactcactatagggcttccccattgtaccagaccaggagctcctaacagaggagaaggagcatgtggtctggtaacctggcggcagcgcaaaagatg

SEQ ID NO: 187254 - DNA, 103 bp, Artificial Sequence
  Synthetic Polynucleotide
taatacgactcactatagggttaatggtactgggtttttcttaggcgtgtaacagaggagaacacgcatgagaaaaaccaacctggcggcagcgcaaaagatg

SEQ ID NO: 187255 - DNA, 103 bp, Artificial Sequence
  Synthetic Polynucleotide
taatacgactcactatagggacagtttgttttaatggtactgggtttttcaacagaggagagaaaaaatgagtaccattaacctggcggcagcgcaaaagatg

SEQ ID NO: 187256 - DNA, 103 bp, Artificial Sequence
  Synthetic Polynucleotide
taatacgactcactatagggtttgggttgcacagtttgttttaatggtacaacagaggagagtaccaatgaaacaaactaacctggcggcagcgcaaaagatg

SEQ ID NO: 187257 - DNA, 103 bp, Artificial Sequence
  Synthetic Polynucleotide
taatacgactcactatagggccacgccatttttgggttgcacagtttgttaacagaggagaaacaaaatgtgcaacccaaacctggcggcagcgcaaaagatg

SEQ ID NO: 187258 - DNA, 103 bp, Artificial Sequence
  Synthetic Polynucleotide
taatacgactcactatagggtctaaaaccaccacgccatttttgggttgcaacagaggagagcaaccatgaaatggcgtaacctggcggcagcgcaaaagatg

SEQ ID NO: 187259 - DNA, 103 bp, Artificial Sequence
  Synthetic Polynucleotide
taatacgactcactatagggcccagagttatctaaaaccaccacgccattaacagaggagaaatggcatggtggttttaaacctggcggcagcgcaaaagatg

SEQ ID NO: 187260 - DNA, 103 bp, Artificial Sequence
  Synthetic Polynucleotide
taatacgactcactatagggaggcatttttcccagagttatctaaaaccaaacagaggagatggtttatgataactctgaacctggcggcagcgcaaaagatg

SEQ ID NO: 187261 - DNA, 103 bp, Artificial Sequence
  Synthetic Polynucleotide
taatacgactcactatagggattcgtcggaaggcatttttcccagagttaaacagaggagataactcatggaaaaatgcaacctggcggcagcgcaaaagatg

SEQ ID NO: 187262 - DNA, 103 bp, Artificial Sequence
  Synthetic Polynucleotide
taatacgactcactataggggggctgtcccattcgtcggaaggcatttttaacagaggagaaaaaatatgttccgacgaaacctggcggcagcgcaaaagatg

SEQ ID NO: 187263 - DNA, 103 bp, Artificial Sequence
  Synthetic Polynucleotide
taatacgactcactatagggtaagccttttgggctgtcccattcgtcggaaacagaggagatccgacatgtgggacagcaacctggcggcagcgcaaaagatg

SEQ ID NO: 187264 - DNA, 103 bp, Artificial Sequence
  Synthetic Polynucleotide
taatacgactcactatagggtcagggttgtcttccccattgtaccagaccaacagaggagaggtctgatgcaatggggaaacctggcggcagcgcaaaagatg

SEQ ID NO: 187265 - DNA, 103 bp, Artificial Sequence
  Synthetic Polynucleotide
taatacgactcactatagggacactaaagttaagccttttgggctgtcccaacagaggagagggacaatgcaaaaggctaacctggcggcagcgcaaaagatg

SEQ ID NO: 187266 - DNA, 103 bp, Artificial Sequence
  Synthetic Polynucleotide
taatacgactcactataggggctgagctcaacactaaagttaagccttttaacagaggagaaaaaggatgaactttagtaacctggcggcagcgcaaaagatg

SEQ ID NO: 187267 - DNA, 103 bp, Artificial Sequence
  Synthetic Polynucleotide
taatacgactcactatagggacgacattttgctgagctcaacactaaagtaacagaggagaactttaatgttgagctcaaacctggcggcagcgcaaaagatg

SEQ ID NO: 187268 - DNA, 103 bp, Artificial Sequence
  Synthetic Polynucleotide
taatacgactcactatagggagcttattcgacgacattttgctgagctcaaacagaggagatgagctatgcaaaatgtcaacctggcggcagcgcaaaagatg

SEQ ID NO: 187269 - DNA, 103 bp, Artificial Sequence
  Synthetic Polynucleotide
taatacgactcactatagggatttaatttgagcttattcgacgacattttaacagaggagaaaaatgatgtcgaataagaacctggcggcagcgcaaaagatg

SEQ ID NO: 187270 - DNA, 103 bp, Artificial Sequence
  Synthetic Polynucleotide
taatacgactcactatagggtcttcaatgcatttaatttgagcttattcgaacagaggagacgaataatgtcaaattaaaacctggcggcagcgcaaaagatg

SEQ ID NO: 187271 - DNA, 103 bp, Artificial Sequence
  Synthetic Polynucleotide
taatacgactcactatagggtgattttttttcttcaatgcatttaatttgaacagaggagacaaattatgtgcattgaaaacctggcggcagcgcaaaagatg

SEQ ID NO: 187272 - DNA, 103 bp, Artificial Sequence
  Synthetic Polynucleotide
taatacgactcactatagggctgtactagctgattttttttcttcaatgcaacagaggagagcattgatgaaaaaaaataacctggcggcagcgcaaaagatg

SEQ ID NO: 187273 - DNA, 103 bp, Artificial Sequence
  Synthetic Polynucleotide
taatacgactcactataggggaattgctttctgtactagctgatttttttaacagaggagaaaaaaaatgagctagtacaacctggcggcagcgcaaaagatg

SEQ ID NO: 187274 - DNA, 103 bp, Artificial Sequence
  Synthetic Polynucleotide
taatacgactcactatagggtttttctgaagaattgctttctgtactagcaacagaggagagctagtatggaaagcaataacctggcggcagcgcaaaagatg

SEQ ID NO: 187275 - DNA, 103 bp, Artificial Sequence
  Synthetic Polynucleotide
taatacgactcactatagggagctgctatctcagggttgtcttccccattaacagaggagaaatgggatggacaaccctaacctggcggcagcgcaaaagatg

SEQ ID NO: 187276 - DNA, 103 bp, Artificial Sequence
  Synthetic Polynucleotide
taatacgactcactatagggtgcagatttgtttttctgaagaattgctttaacagaggagaaaagcaatgcttcagaaaaacctggcggcagcgcaaaagatg

SEQ ID NO: 187277 - DNA, 103 bp, Artificial Sequence
  Synthetic Polynucleotide
taatacgactcactatagggccttctgctttgcagatttgtttttctgaaaacagaggagattcagaatgacaaatctgaacctggcggcagcgcaaaagatg

SEQ ID NO: 187278 - DNA, 103 bp, Artificial Sequence
  Synthetic Polynucleotide
taatacgactcactatagggttcaagtcggccttctgctttgcagatttgaacagaggagacaaatcatgaaagcagaaaacctggcggcagcgcaaaagatg

SEQ ID NO: 187279 - DNA, 103 bp, Artificial Sequence
  Synthetic Polynucleotide
taatacgactcactatagggacaagcatttttcaagtcggccttctgcttaacagaggagaaagcagatggccgacttgaacctggcggcagcgcaaaagatg

SEQ ID NO: 187280 - DNA, 103 bp, Artificial Sequence
  Synthetic Polynucleotide
taatacgactcactatagggaggatgactcacaagcatttttcaagtcggaacagaggagaccgactatgaaaatgcttaacctggcggcagcgcaaaagatg

SEQ ID NO: 187281 - DNA, 103 bp, Artificial Sequence
  Synthetic Polynucleotide
taatacgactcactatagggcagatgtgagaggatgactcacaagcatttaacagaggagaaaatgcatgtgagtcatcaacctggcggcagcgcaaaagatg

SEQ ID NO: 187282 - DNA, 103 bp, Artificial Sequence
  Synthetic Polynucleotide
taatacgactcactatagggacagtaagggcagatgtgagaggatgactcaacagaggagagagtcaatgtctcacatcaacctggcggcagcgcaaaagatg

SEQ ID NO: 187283 - DNA, 103 bp, Artificial Sequence
  Synthetic Polynucleotide
taatacgactcactatagggactctcgattacagtaagggcagatgtgagaacagaggagactcacaatggcccttactaacctggcggcagcgcaaaagatg

SEQ ID NO: 187284 - DNA, 103 bp, Artificial Sequence
  Synthetic Polynucleotide
taatacgactcactatagggatgtaagtgaactctcgattacagtaagggaacagaggagacccttaatgtaatcgagaaacctggcggcagcgcaaaagatg

SEQ ID NO: 187285 - DNA, 103 bp, Artificial Sequence
  Synthetic Polynucleotide
taatacgactcactatagggcaggcttccaatgtaagtgaactctcgattaacagaggagaaatcgaatgttcacttacaacctggcggcagcgcaaaagatg

SEQ ID NO: 187286 - DNA, 103 bp, Artificial Sequence
  Synthetic Polynucleotide
taatacgactcactatagggcctcaatcgcagctgctatctcagggttgtaacagaggagaacaaccatgagatagcagaacctggcggcagcgcaaaagatg

SEQ ID NO: 187287 - DNA, 103 bp, Artificial Sequence
  Synthetic Polynucleotide
taatacgactcactatagggcgtgtttattcaggcttccaatgtaagtgaaacagaggagatcacttatgttggaagccaacctggcggcagcgcaaaagatg

SEQ ID NO: 187288 - DNA, 103 bp, Artificial Sequence
  Synthetic Polynucleotide
taatacgactcactatagggctgaaggcggcgtgtttattcaggcttccaaacagaggagatggaagatggaataaacaaacctggcggcagcgcaaaagatg

SEQ ID NO: 187289 - DNA, 103 bp, Artificial Sequence
  Synthetic Polynucleotide
taatacgactcactatagggtttgggacagctgaaggcggcgtgtttattaacagaggagaaataaaatggccgccttcaacctggcggcagcgcaaaagatg

SEQ ID NO: 187290 - DNA, 103 bp, Artificial Sequence
  Synthetic Polynucleotide
taatacgactcactatagggaaaggggttttttgggacagctgaaggcggaacagaggagaccgcctatggctgtcccaaacctggcggcagcgcaaaagatg

SEQ ID NO: 187291 - DNA, 103 bp, Artificial Sequence
  Synthetic Polynucleotide
taatacgactcactatagggttgggaggagaaaggggttttttgggacagaacagaggagactgtccatgaaaacccctaacctggcggcagcgcaaaagatg

SEQ ID NO: 187292 - DNA, 103 bp, Artificial Sequence
  Synthetic Polynucleotide
taatacgactcactatagggaactttttttttgggaggagaaaggggtttaacagaggagaaaacccatgtctcctcccaacctggcggcagcgcaaaagatg

SEQ ID NO: 187293 - DNA, 103 bp, Artificial Sequence
  Synthetic Polynucleotide
taatacgactcactatagggatgaatgagaaactttttttttgggaggagaacagaggagactcctcatgaaaaaaaagaacctggcggcagcgcaaaagatg

SEQ ID NO: 187294 - DNA, 103 bp, Artificial Sequence
  Synthetic Polynucleotide
taatacgactcactatagggcctttcttagatgaatgagaaactttttttaacagaggagaaaaaaaatgttctcattcaacctggcggcagcgcaaaagatg

SEQ ID NO: 187295 - DNA, 103 bp, Artificial Sequence
  Synthetic Polynucleotide
taatacgactcactatagggtgagtgtccacctttcttagatgaatgagaaacagaggagatctcatatgtctaagaaaaacctggcggcagcgcaaaagatg

SEQ ID NO: 187296 - DNA, 103 bp, Artificial Sequence
  Synthetic Polynucleotide
taatacgactcactatagggttgcaggtgatgagtgtccacctttcttagaacagaggagactaagaatggtggacactaacctggcggcagcgcaaaagatg

SEQ ID NO: 187297 - DNA, 103 bp, Artificial Sequence
  Synthetic Polynucleotide
taatacgactcactataggggctcgctcttcctcaatcgcagctgctatcaacagaggagagatagcatgtgcgattgaaacctggcggcagcgcaaaagatg

SEQ ID NO: 187298 - DNA, 103 bp, Artificial Sequence
  Synthetic Polynucleotide
taatacgactcactatagggttgtcactacttgcaggtgatgagtgtccaaacagaggagatggacaatgatcacctgcaacctggcggcagcgcaaaagatg

SEQ ID NO: 187299 - DNA, 103 bp, Artificial Sequence
  Synthetic Polynucleotide
taatacgactcactataggggttactgtttttgtcactacttgcaggtgaaacagaggagatcacctatgagtagtgacaacctggcggcagcgcaaaagatg

SEQ ID NO: 187300 - DNA, 103 bp, Artificial Sequence
  Synthetic Polynucleotide
taatacgactcactatagggggtggttgctgttactgtttttgtcactacaacagaggagagtagtgatgaaaacagtaaacctggcggcagcgcaaaagatg

SEQ ID NO: 187301 - DNA, 103 bp, Artificial Sequence
  Synthetic Polynucleotide
taatacgactcactataggggtccgtctgcggtggttgctgttactgtttaacagaggagaaaacagatgcagcaaccaaacctggcggcagcgcaaaagatg

SEQ ID NO: 187302 - DNA, 103 bp, Artificial Sequence
  Synthetic Polynucleotide
taatacgactcactatagggcgcatccgctgtccgtctgcggtggttgctaacagaggagaagcaacatgcgcagacggaacctggcggcagcgcaaaagatg

SEQ ID NO: 187303 - DNA, 103 bp, Artificial Sequence
  Synthetic Polynucleotide
taatacgactcactatagggttttaatctccgcatccgctgtccgtctgcaacagaggagagcagacatgcagcggatgaacctggcggcagcgcaaaagatg

SEQ ID NO: 187304 - DNA, 103 bp, Artificial Sequence
  Synthetic Polynucleotide
taatacgactcactatagggatgctttgcattttaatctccgcatccgctaacagaggagaagcggaatgggagattaaaacctggcggcagcgcaaaagatg

SEQ ID NO: 187305 - DNA, 103 bp, Artificial Sequence
  Synthetic Polynucleotide
taatacgactcactatagggcggagtctgcatgctttgcattttaatctcaacagaggagagagattatgatgcaaagcaacctggcggcagcgcaaaagatg

SEQ ID NO: 187306 - DNA, 103 bp, Artificial Sequence
  Synthetic Polynucleotide
taatacgactcactatagggtcttgcccaacggagtctgcatgctttgcaaacagaggagatgcaaaatgtgcagactcaacctggcggcagcgcaaaagatg

SEQ ID NO: 187307 - DNA, 103 bp, Artificial Sequence
  Synthetic Polynucleotide
taatacgactcactatagggcgggctctggtcttgcccaacggagtctgcaacagaggagagcagacatggttgggcaaaacctggcggcagcgcaaaagatg

SEQ ID NO: 187308 - DNA, 103 bp, Artificial Sequence
  Synthetic Polynucleotide
taatacgactcactatagggccgggcgctggctcgctcttcctcaatcgcaacagaggagagcgattatggaagagcgaaacctggcggcagcgcaaaagatg

SEQ ID NO: 187309 - DNA, 103 bp, Artificial Sequence
  Synthetic Polynucleotide
taatacgactcactataggggcctgagctgcgggctctggtcttgcccaaaacagaggagattgggcatgaccagagccaacctggcggcagcgcaaaagatg

SEQ ID NO: 187310 - DNA, 103 bp, Artificial Sequence
  Synthetic Polynucleotide
taatacgactcactatagggcttgggtggggcctgagctgcgggctctggaacagaggagaccagagatggcagctcagaacctggcggcagcgcaaaagatg

SEQ ID NO: 187311 - DNA, 103 bp, Artificial Sequence
  Synthetic Polynucleotide
taatacgactcactatagggggaagtgggacttgggtggggcctgagctgaacagaggagacagctcatgccccacccaaacctggcggcagcgcaaaagatg

SEQ ID NO: 187312 - DNA, 103 bp, Artificial Sequence
  Synthetic Polynucleotide
taatacgactcactatagggggatgaggagggaagtgggacttgggtgggaacagaggagacccaccatggtcccacttaacctggcggcagcgcaaaagatg

SEQ ID NO: 187313 - DNA, 103 bp, Artificial Sequence
  Synthetic Polynucleotide
taatacgactcactatagggtggacctgaaggatgaggagggaagtgggaaacagaggagatcccacatgcctcctcataacctggcggcagcgcaaaagatg

SEQ ID NO: 187314 - DNA, 103 bp, Artificial Sequence
  Synthetic Polynucleotide
taatacgactcactatagggacgttctgcttggacctgaaggatgaggagaacagaggagactcctcatgcttcaggtcaacctggcggcagcgcaaaagatg

SEQ ID NO: 187315 - DNA, 103 bp, Artificial Sequence
  Synthetic Polynucleotide
taatacgactcactatagggtgcaaacttgacgttctgcttggacctgaaaacagaggagattcaggatgaagcagaacaacctggcggcagcgcaaaagatg

SEQ ID NO: 187316 - DNA, 103 bp, Artificial Sequence
  Synthetic Polynucleotide
taatacgactcactatagggtcaccgaagctgcaaacttgacgttctgctaacagaggagaagcagaatgtcaagtttgaacctggcggcagcgcaaaagatg

SEQ ID NO: 187317 - DNA, 103 bp, Artificial Sequence
  Synthetic Polynucleotide
taatacgactcactatagggtttttggatttcaccgaagctgcaaacttgaacagaggagacaagttatgagcttcggtaacctggcggcagcgcaaaagatg

SEQ ID NO: 187318 - DNA, 103 bp, Artificial Sequence
  Synthetic Polynucleotide
taatacgactcactatagggggagcttggttttttggatttcaccgaagcaacagaggagagcttcgatgaaatccaaaaacctggcggcagcgcaaaagatg

SEQ ID NO: 187319 - DNA, 103 bp, Artificial Sequence
  Synthetic Polynucleotide
taatacgactcactatagggtccgcttgctccgggcgctggctcgctcttaacagaggagaaagagcatgccagcgcccaacctggcggcagcgcaaaagatg

SEQ ID NO: 187320 - DNA, 103 bp, Artificial Sequence
  Synthetic Polynucleotide
taatacgactcactatagggttaaagaggaggagcttggttttttggattaacagaggagaaatccaatgaaccaagctaacctggcggcagcgcaaaagatg

SEQ ID NO: 187321 - DNA, 103 bp, Artificial Sequence
  Synthetic Polynucleotide
taatacgactcactatagggctggagttccttaaagaggaggagcttggtaacagaggagaaccaagatgctcctctttaacctggcggcagcgcaaaagatg

SEQ ID NO: 187322 - DNA, 103 bp, Artificial Sequence
  Synthetic Polynucleotide
taatacgactcactatagggtcttatcgggctggagttccttaaagaggaaacagaggagatcctctatgaggaactccaacctggcggcagcgcaaaagatg

SEQ ID NO: 187323 - DNA, 103 bp, Artificial Sequence
  Synthetic Polynucleotide
taatacgactcactatagggttttggccattcttatcgggctggagttccaacagaggagaggaactatggcccgataaaacctggcggcagcgcaaaagatg

SEQ ID NO: 187324 - DNA, 103 bp, Artificial Sequence
  Synthetic Polynucleotide
taatacgactcactatagggacatgagttattttggccattcttatcgggaacagaggagacccgatatgaatggccaaaacctggcggcagcgcaaaagatg

SEQ ID NO: 187325 - DNA, 103 bp, Artificial Sequence
  Synthetic Polynucleotide
taatacgactcactatagggtttcccctcaacatgagttattttggccataacagaggagaatggccatgataactcataacctggcggcagcgcaaaagatg

SEQ ID NO: 187326 - DNA, 103 bp, Artificial Sequence
  Synthetic Polynucleotide
taatacgactcactatagggctttaggttttttcccctcaacatgagttaaacagaggagataactcatgttgaggggaaacctggcggcagcgcaaaagatg

SEQ ID NO: 187327 - DNA, 103 bp, Artificial Sequence
  Synthetic Polynucleotide
taatacgactcactatagggttggccacagctttaggttttttcccctcaaacagaggagatgagggatgaaaacctaaaacctggcggcagcgcaaaagatg

SEQ ID NO: 187328 - DNA, 103 bp, Artificial Sequence
  Synthetic Polynucleotide
taatacgactcactatagggagaatgattcttggccacagctttaggtttaacagaggagaaaacctatggctgtggccaacctggcggcagcgcaaaagatg

SEQ ID NO: 187329 - DNA, 103 bp, Artificial Sequence
  Synthetic Polynucleotide
taatacgactcactatagggaaagctgagcagaatgattcttggccacagaacagaggagactgtggatgagaatcattaacctggcggcagcgcaaaagatg

SEQ ID NO: 187330 - DNA, 103 bp, Artificial Sequence
  Synthetic Polynucleotide
taatacgactcactatagggttgggggagctccgcttgctccgggcgctgaacagaggagacagcgcatggagcaagcgaacctggcggcagcgcaaaagatg

SEQ ID NO: 187331 - DNA, 103 bp, Artificial Sequence
  Synthetic Polynucleotide
taatacgactcactataggggttttgctggaaagctgagcagaatgattcaacagaggagagaatcaatgtgctcagctaacctggcggcagcgcaaaagatg

SEQ ID NO: 187332 - DNA, 103 bp, Artificial Sequence
  Synthetic Polynucleotide
taatacgactcactataggggctccgtgatgttttgctggaaagctgagcaacagaggagagctcagatgtccagcaaaaacctggcggcagcgcaaaagatg

SEQ ID NO: 187333 - DNA, 103 bp, Artificial Sequence
  Synthetic Polynucleotide
taatacgactcactatagggtcacgtgcaggctccgtgatgttttgctggaacagaggagaccagcaatgcatcacggaaacctggcggcagcgcaaaagatg

SEQ ID NO: 187334 - DNA, 103 bp, Artificial Sequence
  Synthetic Polynucleotide
taatacgactcactatagggttctgtaccctcacgtgcaggctccgtgataacagaggagaatcacgatgcctgcacgtaacctggcggcagcgcaaaagatg

SEQ ID NO: 187335 - DNA, 103 bp, Artificial Sequence
  Synthetic Polynucleotide
taatacgactcactatagggagctttgcttttctgtaccctcacgtgcagaacagaggagactgcacatgagggtacagaacctggcggcagcgcaaaagatg

SEQ ID NO: 187336 - DNA, 103 bp, Artificial Sequence
  Synthetic Polynucleotide
taatacgactcactatagggtttgtaaaacagctttgcttttctgtacccaacagaggagagggtacatgaaagcaaagaacctggcggcagcgcaaaagatg

SEQ ID NO: 187337 - DNA, 103 bp, Artificial Sequence
  Synthetic Polynucleotide
taatacgactcactataggggtggatttgctttgtaaaacagctttgcttaacagaggagaaagcaaatgtgttttacaaacctggcggcagcgcaaaagatg

SEQ ID NO: 187338 - DNA, 103 bp, Artificial Sequence
  Synthetic Polynucleotide
taatacgactcactatagggactcgccaaggtggatttgctttgtaaaacaacagaggagagttttaatgagcaaatccaacctggcggcagcgcaaaagatg

SEQ ID NO: 187339 - DNA, 103 bp, Artificial Sequence
  Synthetic Polynucleotide
taatacgactcactatagggttcttttcttactcgccaaggtggatttgcaacagaggagagcaaatatgccttggcgaaacctggcggcagcgcaaaagatg

SEQ ID NO: 187340 - DNA, 103 bp, Artificial Sequence
  Synthetic Polynucleotide
taatacgactcactatagggaaccggtctgttcttttcttactcgccaagaacagaggagacttggcatgtaagaaaagaacctggcggcagcgcaaaagatg

SEQ ID NO: 187341 - DNA, 103 bp, Artificial Sequence
  Synthetic Polynucleotide
taatacgactcactatagggtttccggctcttgggggagctccgcttgctaacagaggagaagcaagatgagctcccccaacctggcggcagcgcaaaagatg

SEQ ID NO: 187342 - DNA, 103 bp, Artificial Sequence
  Synthetic Polynucleotide
taatacgactcactatagggttttatattgaaccggtctgttcttttcttaacagaggagaaagaaaatgacagaccggaacctggcggcagcgcaaaagatg

SEQ ID NO: 187343 - DNA, 103 bp, Artificial Sequence
  Synthetic Polynucleotide
taatacgactcactataggggctctctagattttatattgaaccggtctgaacagaggagacagaccatgtcaatataaaacctggcggcagcgcaaaagatg

SEQ ID NO: 187344 - DNA, 103 bp, Artificial Sequence
  Synthetic Polynucleotide
taatacgactcactatagggcccccactccgctctctagattttatattgaacagaggagacaatatatgatctagagaaacctggcggcagcgcaaaagatg

SEQ ID NO: 187345 - DNA, 103 bp, Artificial Sequence
  Synthetic Polynucleotide
taatacgactcactatagggggtgactggccccccactccgctctctagaaacagaggagatctagaatgcggagtgggaacctggcggcagcgcaaaagatg

SEQ ID NO: 187346 - DNA, 103 bp, Artificial Sequence
  Synthetic Polynucleotide
taatacgactcactataggggaaggctccgggtgactggccccccactccaacagaggagaggagtgatgggccagtcaaacctggcggcagcgcaaaagatg

SEQ ID NO: 187347 - DNA, 103 bp, Artificial Sequence
  Synthetic Polynucleotide
taatacgactcactataggggctgccagctgaaggctccgggtgactggcaacagaggagagccagtatgccggagcctaacctggcggcagcgcaaaagatg

SEQ ID NO: 187348 - DNA, 103 bp, Artificial Sequence
  Synthetic Polynucleotide
taatacgactcactataggggtcagcagcagctgccagctgaaggctccgaacagaggagacggagcatgcagctggcaaacctggcggcagcgcaaaagatg

SEQ ID NO: 187349 - DNA, 103 bp, Artificial Sequence
  Synthetic Polynucleotide
taatacgactcactatagggtctcactcaagtcagcagcagctgccagctaacagaggagaagctggatgctgctgctgaacctggcggcagcgcaaaagatg

SEQ ID NO: 187350 - DNA, 103 bp, Artificial Sequence
  Synthetic Polynucleotide
taatacgactcactatagggtctctcttgttctcactcaagtcagcagcaaacagaggagatgctgcatgcttgagtgaaacctggcggcagcgcaaaagatg

SEQ ID NO: 187351 - DNA, 103 bp, Artificial Sequence
  Synthetic Polynucleotide
taatacgactcactataggggctgccgtcctctctcttgttctcactcaaaacagaggagattgagtatgaacaagagaaacctggcggcagcgcaaaagatg

SEQ ID NO: 187352 - DNA, 103 bp, Artificial Sequence
  Synthetic Polynucleotide
taatacgactcactataggggcagcacatgttcgggtacctcagccagggaacagaggagaccctggatgaggtacccgaacctggcggcagcgcaaaagatg

SEQ ID NO: 187353 - DNA, 103 bp, Artificial Sequence
  Synthetic Polynucleotide
taatacgactcactatagggttttcttccctttccggctcttgggggagcaacagaggagagctcccatgagagccggaaacctggcggcagcgcaaaagatg

SEQ ID NO: 187354 - DNA, 103 bp, Artificial Sequence
  Synthetic Polynucleotide
taatacgactcactatagggcctgcttggcgctgccgtcctctctcttgtaacagaggagaacaagaatgaggacggcaaacctggcggcagcgcaaaagatg

SEQ ID NO: 187355 - DNA, 103 bp, Artificial Sequence
  Synthetic Polynucleotide
taatacgactcactatagggtccttcagctcctgcttggcgctgccgtccaacagaggagaggacggatgcgccaagcaaacctggcggcagcgcaaaagatg

SEQ ID NO: 187356 - DNA, 103 bp, Artificial Sequence
  Synthetic Polynucleotide
taatacgactcactataggggtagctgaagtccttcagctcctgcttggcaacagaggagagccaagatggagctgaagaacctggcggcagcgcaaaagatg

SEQ ID NO: 187357 - DNA, 103 bp, Artificial Sequence
  Synthetic Polynucleotide
taatacgactcactatagggagcggaggctgtagctgaagtccttcagctaacagaggagaagctgaatgacttcagctaacctggcggcagcgcaaaagatg

SEQ ID NO: 187358 - DNA, 103 bp, Artificial Sequence
  Synthetic Polynucleotide
taatacgactcactatagggcgggacgccaagcggaggctgtagctgaagaacagaggagacttcagatgcagcctccgaacctggcggcagcgcaaaagatg

SEQ ID NO: 187359 - DNA, 103 bp, Artificial Sequence
  Synthetic Polynucleotide
taatacgactcactatagggtggagagcatcgggacgccaagcggaggctaacagaggagaagcctcatgttggcgtccaacctggcggcagcgcaaaagatg

SEQ ID NO: 187360 - DNA, 103 bp, Artificial Sequence
  Synthetic Polynucleotide
taatacgactcactataggggggccgctggtggagagcatcgggacgccaaacagaggagatggcgtatggatgctctcaacctggcggcagcgcaaaagatg

SEQ ID NO: 187361 - DNA, 103 bp, Artificial Sequence
  Synthetic Polynucleotide
taatacgactcactataggggtgatgtacggggccgctggtggagagcataacagaggagaatgctcatgaccagcggcaacctggcggcagcgcaaaagatg

SEQ ID NO: 187362 - DNA, 103 bp, Artificial Sequence
  Synthetic Polynucleotide
taatacgactcactatagggatactgcctggtgatgtacggggccgctggaacagaggagaccagcgatgccgtacatcaacctggcggcagcgcaaaagatg

SEQ ID NO: 187363 - DNA, 103 bp, Artificial Sequence
  Synthetic Polynucleotide
taatacgactcactatagggtgaccttcctatactgcctggtgatgtacgaacagaggagacgtacaatgccaggcagtaacctggcggcagcgcaaaagatg

SEQ ID NO: 187364 - DNA, 103 bp, Artificial Sequence
  Synthetic Polynucleotide
taatacgactcactatagggtcctgggattttttcttccctttccggctcaacagaggagagagccgatgagggaagaaaacctggcggcagcgcaaaagatg

SEQ ID NO: 187365 - DNA, 103 bp, Artificial Sequence
  Synthetic Polynucleotide
taatacgactcactataggggctggagctttgaccttcctatactgcctgaacagaggagacaggcaatgtaggaaggtaacctggcggcagcgcaaaagatg

SEQ ID NO: 187366 - DNA, 103 bp, Artificial Sequence
  Synthetic Polynucleotide
taatacgactcactatagggctgggctgcagctggagctttgaccttcctaacagaggagaaggaagatgaaagctccaaacctggcggcagcgcaaaagatg

SEQ ID NO: 187367 - DNA, 103 bp, Artificial Sequence
  Synthetic Polynucleotide
taatacgactcactataggggtccctggaactgggctgcagctggagcttaacagaggagaaagctcatgctgcagcccaacctggcggcagcgcaaaagatg

SEQ ID NO: 187368 - DNA, 103 bp, Artificial Sequence
  Synthetic Polynucleotide
taatacgactcactatagggttgaagaatggtccctggaactgggctgcaaacagaggagatgcagcatggttccagggaacctggcggcagcgcaaaagatg

SEQ ID NO: 187369 - DNA, 103 bp, Artificial Sequence
  Synthetic Polynucleotide
taatacgactcactataggggtttttattttcctgggattttttcttcccaacagaggagagggaagatgaaatcccagaacctggcggcagcgcaaaagatg

SEQ ID NO: 187370 - DNA, 103 bp, Artificial Sequence
  Synthetic Polynucleotide
taatacgactcactatagggtgtttcctttgtttttattttcctgggattaacagaggagaaatcccatgaaaataaaaaacctggcggcagcgcaaaagatg

SEQ ID NO: 187371 - DNA, 103 bp, Artificial Sequence
  Synthetic Polynucleotide
taatacgactcactatagggtcttggattttgtttcctttgtttttatttaacagaggagaaaataaatgcaaaggaaaaacctggcggcagcgcaaaagatg

SEQ ID NO: 187372 - DNA, 103 bp, Artificial Sequence
  Synthetic Polynucleotide
taatacgactcactatagggcagttgtatgtcttggattttgtttcctttaacagaggagaaaaggaatgaaaatccaaaacctggcggcagcgcaaaagatg

SEQ ID NO: 187373 - DNA, 103 bp, Artificial Sequence
  Synthetic Polynucleotide
taatacgactcactatagggcacttgtcttcagttgtatgtcttggatttaacagaggagaaaatccatgacatacaacaacctggcggcagcgcaaaagatg

SEQ ID NO: 187374 - DNA, 103 bp, Artificial Sequence
  Synthetic Polynucleotide
taatacgactcactatagggaaatctggctcacttgtcttcagttgtatgaacagaggagacatacaatggaagacaagaacctggcggcagcgcaaaagatg

SEQ ID NO: 187375 - DNA, 103 bp, Artificial Sequence
  Synthetic Polynucleotide
taatacgactcactatagggtgcagaggtgaaatctggctcacttgtcttaacagaggagaaagacaatggagccagataacctggcggcagcgcaaaagatg

SEQ ID NO: 187376 - DNA, 103 bp, Artificial Sequence
  Synthetic Polynucleotide
taatacgactcactatagggctctcatatttgcagaggtgaaatctggctaacagaggagaagccagatgtcacctctgaacctggcggcagcgcaaaagatg

SEQ ID NO: 187377 - DNA, 103 bp, Artificial Sequence
  Synthetic Polynucleotide
taatacgactcactatagggggaagtcctcgcagcacatgttcgggtaccaacagaggagaggtaccatgacatgtgctaacctggcggcagcgcaaaagatg

SEQ ID NO: 187378 - DNA, 103 bp, Artificial Sequence
  Synthetic Polynucleotide
taatacgactcactatagggtctgcagaatctctcatatttgcagaggtgaacagaggagacacctcatgaaatatgagaacctggcggcagcgcaaaagatg

SEQ ID NO: 187379 - DNA, 103 bp, Artificial Sequence
  Synthetic Polynucleotide
taatacgactcactatagggtttaggaccttctgcagaatctctcatattaacagaggagaaatatgatggattctgcaaacctggcggcagcgcaaaagatg

SEQ ID NO: 187380 - DNA, 103 bp, Artificial Sequence
  Synthetic Polynucleotide
taatacgactcactatagggcttcgtcttctttaggaccttctgcagaataacagaggagaattctgatgaaggtcctaaacctggcggcagcgcaaaagatg

SEQ ID NO: 187381 - DNA, 103 bp, Artificial Sequence
  Synthetic Polynucleotide
taatacgactcactataggggaaggcttctcttcgtcttctttaggacctaacagaggagaaggtccatgagaagacgaaacctggcggcagcgcaaaagatg

SEQ ID NO: 187382 - DNA, 103 bp, Artificial Sequence
  Synthetic Polynucleotide
taatacgactcactatagggtgctgaggctgaaggcttctcttcgtcttcaacagaggagagaagacatggagaagcctaacctggcggcagcgcaaaagatg

SEQ ID NO: 187383 - DNA, 103 bp, Artificial Sequence
  Synthetic Polynucleotide
taatacgactcactataggggctgctcaagtgctgaggctgaaggcttctaacagaggagaagaagcatgcagcctcagaacctggcggcagcgcaaaagatg

SEQ ID NO: 187384 - DNA, 103 bp, Artificial Sequence
  Synthetic Polynucleotide
taatacgactcactatagggagggtggccggctgctcaagtgctgaggctaacagaggagaagcctcatgacttgagcaaacctggcggcagcgcaaaagatg

SEQ ID NO: 187385 - DNA, 103 bp, Artificial Sequence
  Synthetic Polynucleotide
taatacgactcactatagggcacctcctggagggtggccggctgctcaagaacagaggagacttgagatgccggccaccaacctggcggcagcgcaaaagatg

SEQ ID NO: 187386 - DNA, 103 bp, Artificial Sequence
  Synthetic Polynucleotide
taatacgactcactatagggcctgactggccacctcctggagggtggccgaacagaggagacggccaatgtccaggaggaacctggcggcagcgcaaaagatg

SEQ ID NO: 187387 - DNA, 103 bp, Artificial Sequence
  Synthetic Polynucleotide
taatacgactcactatagggggaggcacctcctgactggccacctcctggaacagaggagaccaggaatgggccagtcaaacctggcggcagcgcaaaagatg

SEQ ID NO: 187388 - DNA, 103 bp, Artificial Sequence
  Synthetic Polynucleotide
taatacgactcactatagggcacttcctccggaagtcctcgcagcacatgaacagaggagacatgtgatgcgaggacttaacctggcggcagcgcaaaagatg

SEQ ID NO: 187389 - DNA, 103 bp, Artificial Sequence
  Synthetic Polynucleotide
taatacgactcactatagggtgctagttctggaggcacctcctgactggcaacagaggagagccagtatggaggtgcctaacctggcggcagcgcaaaagatg

SEQ ID NO: 187390 - DNA, 103 bp, Artificial Sequence
  Synthetic Polynucleotide
taatacgactcactataggggggcaggggttgctagttctggaggcacctaacagaggagaaggtgcatgcagaactagaacctggcggcagcgcaaaagatg

SEQ ID NO: 187391 - DNA, 103 bp, Artificial Sequence
  Synthetic Polynucleotide
taatacgactcactatagggtcccaggcaggggcaggggttgctagttctaacagaggagaagaactatgaacccctgcaacctggcggcagcgcaaaagatg

SEQ ID NO: 187392 - DNA, 103 bp, Artificial Sequence
  Synthetic Polynucleotide
taatacgactcactatagggtggctgtggctcccaggcaggggcaggggtaacagaggagaacccctatgcctgcctggaacctggcggcagcgcaaaagatg

SEQ ID NO: 187393 - DNA, 103 bp, Artificial Sequence
  Synthetic Polynucleotide
taatacgactcactatagggcgtctggttctggctgtggctcccaggcagaacagaggagactgcctatgagccacagcaacctggcggcagcgcaaaagatg

SEQ ID NO: 187394 - DNA, 103 bp, Artificial Sequence
  Synthetic Polynucleotide
taatacgactcactatagggtctaatcgctcgtctggttctggctgtggcaacagaggagagccacaatgagaaccagaaacctggcggcagcgcaaaagatg

SEQ ID NO: 187395 - DNA, 103 bp, Artificial Sequence
  Synthetic Polynucleotide
taatacgactcactatagggagctgccgcttctaatcgctcgtctggttcaacagaggagagaaccaatggagcgattaaacctggcggcagcgcaaaagatg

SEQ ID NO: 187396 - DNA, 103 bp, Artificial Sequence
  Synthetic Polynucleotide
taatacgactcactatagggtcacctcacaagctgccgcttctaatcgctaacagaggagaagcgatatgaagcggcagaacctggcggcagcgcaaaagatg

SEQ ID NO: 187397 - DNA, 103 bp, Artificial Sequence
  Synthetic Polynucleotide
taatacgactcactatagggcccaaatcattcacctcacaagctgccgctaacagaggagaagcggcatgttgtgaggtaacctggcggcagcgcaaaagatg

SEQ ID NO: 187398 - DNA, 103 bp, Artificial Sequence
  Synthetic Polynucleotide
taatacgactcactatagggctcctcttcccccaaatcattcacctcacaaacagaggagatgtgagatgaatgatttgaacctggcggcagcgcaaaagatg

SEQ ID NO: 187399 - DNA, 103 bp, Artificial Sequence
  Synthetic Polynucleotide
taatacgactcactatagggggaaaagcctcacttcctccggaagtcctcaacagaggagagaggacatgcggaggaagaacctggcggcagcgcaaaagatg

SEQ ID NO: 187400 - DNA, 103 bp, Artificial Sequence
  Synthetic Polynucleotide
taatacgactcactatagggcttcctcctcctcctcttcccccaaatcataacagaggagaatgattatggggaagaggaacctggcggcagcgcaaaagatg

SEQ ID NO: 187401 - DNA, 103 bp, Artificial Sequence
  Synthetic Polynucleotide
taatacgactcactatagggtcctcctcctcttcctcctcctcctcttccaacagaggagaggaagaatgggaggaggaaacctggcggcagcgcaaaagatg

SEQ ID NO: 187402 - DNA, 103 bp, Artificial Sequence
  Synthetic Polynucleotide
taatacgactcactatagggttcttcttcatcctcctcctcttcctcctcaacagaggagagaggagatggaggaggagaacctggcggcagcgcaaaagatg

SEQ ID NO: 187403 - DNA, 103 bp, Artificial Sequence
  Synthetic Polynucleotide
taatacgactcactatagggcatcttcttcttcttcttcatcctcctcctaacagaggagaaggaggatgatgaagaagaacctggcggcagcgcaaaagatg

SEQ ID NO: 187404 - DNA, 103 bp, Artificial Sequence
  Synthetic Polynucleotide
taatacgactcactatagggtcatcatcatcatcttcttcttcttcttcaaacagaggagatgaagaatgagaagaagaaacctggcggcagcgcaaaagatg

SEQ ID NO: 187405 - DNA, 103 bp, Artificial Sequence
  Synthetic Polynucleotide
taatacgactcactatagggttccaactcatcatcatcatcatcttcttcaacagaggagagaagaaatggatgatgataacctggcggcagcgcaaaagatg

SEQ ID NO: 187406 - DNA, 103 bp, Artificial Sequence
  Synthetic Polynucleotide
taatacgactcactatagggccccctcgtcttccaactcatcatcatcataacagaggagaatgatgatgatgagttggaacctggcggcagcgcaaaagatg

SEQ ID NO: 187407 - DNA, 103 bp, Artificial Sequence
  Synthetic Polynucleotide
taatacgactcactataggggcttcttcttccccctcgtcttccaactcaaacagaggagatgagttatgagacgagggaacctggcggcagcgcaaaagatg

SEQ ID NO: 187408 - DNA, 103 bp, Artificial Sequence
  Synthetic Polynucleotide
taatacgactcactatagggtggcatgctggcttcttcttccccctcgtcaacagaggagagacgagatggaagaagaaaacctggcggcagcgcaaaagatg

SEQ ID NO: 187409 - DNA, 103 bp, Artificial Sequence
  Synthetic Polynucleotide
taatacgactcactatagggaattttcatttggcatgctggcttcttcttaacagaggagaaagaagatgccagcatgcaacctggcggcagcgcaaaagatg

SEQ ID NO: 187410 - DNA, 103 bp, Artificial Sequence
  Synthetic Polynucleotide
taatacgactcactatagggacagcagaagggaaaagcctcacttcctccaacagaggagaggaggaatggaggcttttaacctggcggcagcgcaaaagatg

SEQ ID NO: 187411 - DNA, 103 bp, Artificial Sequence
  Synthetic Polynucleotide
taatacgactcactatagggtctttcacagaattttcatttggcatgctgaacagaggagacagcatatgaaatgaaaaaacctggcggcagcgcaaaagatg

SEQ ID NO: 187412 - DNA, 103 bp, Artificial Sequence
  Synthetic Polynucleotide
taatacgactcactatagggtatttctggctctttcacagaattttcattaacagaggagaaatgaaatgtctgtgaaaaacctggcggcagcgcaaaagatg

SEQ ID NO: 187413 - DNA, 103 bp, Artificial Sequence
  Synthetic Polynucleotide
taatacgactcactatagggcatcacaccgtatttctggctctttcacagaacagaggagactgtgaatgagccagaaaaacctggcggcagcgcaaaagatg

SEQ ID NO: 187414 - DNA, 103 bp, Artificial Sequence
  Synthetic Polynucleotide
taatacgactcactatagggtctggcttctcatcacaccgtatttctggcaacagaggagagccagaatgacggtgtgaaacctggcggcagcgcaaaagatg

SEQ ID NO: 187415 - DNA, 103 bp, Artificial Sequence
  Synthetic Polynucleotide
taatacgactcactatagggtaataaatcttctggcttctcatcacaccgaacagaggagacggtgtatggagaagccaaacctggcggcagcgcaaaagatg

SEQ ID NO: 187416 - DNA, 103 bp, Artificial Sequence
  Synthetic Polynucleotide
taatacgactcactatagggttggttcctctaataaatcttctggcttctaacagaggagaagaagcatgaagatttataacctggcggcagcgcaaaagatg

SEQ ID NO: 187417 - DNA, 103 bp, Artificial Sequence
  Synthetic Polynucleotide
taatacgactcactataggggaagttgtttttggttcctctaataaatctaacagaggagaagatttatgagaggaaccaacctggcggcagcgcaaaagatg

SEQ ID NO: 187418 - DNA, 103 bp, Artificial Sequence
  Synthetic Polynucleotide
taatacgactcactatagggagtttcttctgaagttgtttttggttcctcaacagaggagagaggaaatgaaaacaactaacctggcggcagcgcaaaagatg

SEQ ID NO: 187419 - DNA, 103 bp, Artificial Sequence
  Synthetic Polynucleotide
taatacgactcactatagggagtcttcaagagtttcttctgaagttgtttaacagaggagaaaacaaatgcagaagaaaaacctggcggcagcgcaaaagatg

SEQ ID NO: 187420 - DNA, 103 bp, Artificial Sequence
  Synthetic Polynucleotide
taatacgactcactatagggacctctgagcagtcttcaagagtttcttctaacagaggagaagaagaatgtcttgaagaaacctggcggcagcgcaaaagatg

SEQ ID NO: 187421 - DNA, 103 bp, Artificial Sequence
  Synthetic Polynucleotide
taatacgactcactatagggcaggttcatttcattcatcctgtgatgcataacagaggagaatgcatatgaggatgaataacctggcggcagcgcaaaagatg

SEQ ID NO: 187422 - DNA, 103 bp, Artificial Sequence
  Synthetic Polynucleotide
taatacgactcactataggggggtgaggcagccaatcccaggtgacttccaacagaggagaggaagtatgctgggattgaacctggcggcagcgcaaaagatg

SEQ ID NO: 187423 - DNA, 103 bp, Artificial Sequence
  Synthetic Polynucleotide
taatacgactcactatagggtgtccccatagcaacctcctgggtgatggaaacagaggagatccatcatgcaggaggttaacctggcggcagcgcaaaagatg

SEQ ID NO: 187424 - DNA, 103 bp, Artificial Sequence
  Synthetic Polynucleotide
taatacgactcactatagggctacatgacctgtccccatagcaacctcctaacagaggagaaggaggatgctatggggaaacctggcggcagcgcaaaagatg

SEQ ID NO: 187425 - DNA, 103 bp, Artificial Sequence
  Synthetic Polynucleotide
taatacgactcactataggggaagatacatctacatgacctgtccccataaacagaggagatatgggatgaggtcatgtaacctggcggcagcgcaaaagatg

SEQ ID NO: 187426 - DNA, 103 bp, Artificial Sequence
  Synthetic Polynucleotide
taatacgactcactatagggaagactgtctgaagatacatctacatgaccaacagaggagaggtcatatggatgtatctaacctggcggcagcgcaaaagatg

SEQ ID NO: 187427 - DNA, 103 bp, Artificial Sequence
  Synthetic Polynucleotide
taatacgactcactatagggatacaaaagaaagactgtctgaagatacataacagaggagaatgtatatgcagacagtcaacctggcggcagcgcaaaagatg

SEQ ID NO: 187428 - DNA, 103 bp, Artificial Sequence
  Synthetic Polynucleotide
taatacgactcactatagggagtgaaggtgatacaaaagaaagactgtctaacagaggagaagacagatgttcttttgtaacctggcggcagcgcaaaagatg

SEQ ID NO: 187429 - DNA, 103 bp, Artificial Sequence
  Synthetic Polynucleotide
taatacgactcactatagggttccatttgcagtgaaggtgatacaaaagaaacagaggagatcttttatgtcaccttcaaacctggcggcagcgcaaaagatg

SEQ ID NO: 187430 - DNA, 103 bp, Artificial Sequence
  Synthetic Polynucleotide
taatacgactcactatagggaattggagtcttccatttgcagtgaaggtgaacagaggagacaccttatgtgcaaatggaacctggcggcagcgcaaaagatg

SEQ ID NO: 187431 - DNA, 103 bp, Artificial Sequence
  Synthetic Polynucleotide
taatacgactcactatagggtccttgtttgaattggagtcttccatttgcaacagaggagagcaaatatgagactccaaaacctggcggcagcgcaaaagatg

SEQ ID NO: 187432 - DNA, 103 bp, Artificial Sequence
  Synthetic Polynucleotide
taatacgactcactatagggtgccatgttctccttgtttgaattggagtcaacagaggagagactccatgtcaaacaagaacctggcggcagcgcaaaagatg

SEQ ID NO: 187433 - DNA, 103 bp, Artificial Sequence
  Synthetic Polynucleotide
taatacgactcactatagggcactgtgagtgggtgaggcagccaatcccaaacagaggagatgggatatgctgcctcacaacctggcggcagcgcaaaagatg

SEQ ID NO: 187434 - DNA, 103 bp, Artificial Sequence
  Synthetic Polynucleotide
taatacgactcactatagggtaaacaaggttgccatgttctccttgtttgaacagaggagacaaacaatgagaacatggaacctggcggcagcgcaaaagatg

SEQ ID NO: 187435 - DNA, 103 bp, Artificial Sequence
  Synthetic Polynucleotide
taatacgactcactatagggcaccaaattgtaaacaaggttgccatgttcaacagaggagagaacatatgaaccttgttaacctggcggcagcgcaaaagatg

SEQ ID NO: 187436 - DNA, 103 bp, Artificial Sequence
  Synthetic Polynucleotide
taatacgactcactatagggacacagagtacaccaaattgtaaacaaggtaacagaggagaaccttgatgacaatttggaacctggcggcagcgcaaaagatg

SEQ ID NO: 187437 - DNA, 103 bp, Artificial Sequence
  Synthetic Polynucleotide
taatacgactcactatagggaggcgcggtcacacagagtacaccaaattgaacagaggagacaatttatggtactctgtaacctggcggcagcgcaaaagatg

SEQ ID NO: 187438 - DNA, 103 bp, Artificial Sequence
  Synthetic Polynucleotide
taatacgactcactatagggtccgagggataggcgcggtcacacagagtaaacagaggagatactctatgtgaccgcgcaacctggcggcagcgcaaaagatg

SEQ ID NO: 187439 - DNA, 103 bp, Artificial Sequence
  Synthetic Polynucleotide
taatacgactcactatagggttcgggacagtccgagggataggcgcggtcaacagaggagagaccgcatgtatccctcgaacctggcggcagcgcaaaagatg

SEQ ID NO: 187440 - DNA, 103 bp, Artificial Sequence
  Synthetic Polynucleotide
taatacgactcactatagggctggtccatgttcgggacagtccgagggataacagaggagaatccctatgactgtcccgaacctggcggcagcgcaaaagatg

SEQ ID NO: 187441 - DNA, 103 bp, Artificial Sequence
  Synthetic Polynucleotide
taatacgactcactatagggacaaaagtcactggtccatgttcgggacagaacagaggagactgtccatgacatggaccaacctggcggcagcgcaaaagatg

SEQ ID NO: 187442 - DNA, 103 bp, Artificial Sequence
  Synthetic Polynucleotide
taatacgactcactatagggagtgtcaggaacaaaagtcactggtccatgaacagaggagacatggaatggtgacttttaacctggcggcagcgcaaaagatg

SEQ ID NO: 187443 - DNA, 103 bp, Artificial Sequence
  Synthetic Polynucleotide
taatacgactcactatagggtctctattggagtgtcaggaacaaaagtcaaacagaggagatgacttatgttcctgacaaacctggcggcagcgcaaaagatg

SEQ ID NO: 187444 - DNA, 103 bp, Artificial Sequence
  Synthetic Polynucleotide
taatacgactcactataggggcagggatggcactgtgagtgggtgaggcaaacagaggagatgcctcatgcactcacagaacctggcggcagcgcaaaagatg

SEQ ID NO: 187445 - DNA, 103 bp, Artificial Sequence
  Synthetic Polynucleotide
taatacgactcactatagggcttgctctgctctctattggagtgtcaggaaacagaggagatcctgaatgtccaatagaaacctggcggcagcgcaaaagatg

SEQ ID NO: 187446 - DNA, 103 bp, Artificial Sequence
  Synthetic Polynucleotide
taatacgactcactataggggagagaaagccttgctctgctctctattggaacagaggagaccaataatgagcagagcaaacctggcggcagcgcaaaagatg

SEQ ID NO: 187447 - DNA, 103 bp, Artificial Sequence
  Synthetic Polynucleotide
taatacgactcactataggggctgctttgggagagaaagccttgctctgcaacagaggagagcagagatgggctttctcaacctggcggcagcgcaaaagatg

SEQ ID NO: 187448 - DNA, 103 bp, Artificial Sequence
  Synthetic Polynucleotide
taatacgactcactatagggcggagaacaagctgctttgggagagaaagcaacagaggagagctttcatgcccaaagcaaacctggcggcagcgcaaaagatg

SEQ ID NO: 187449 - DNA, 103 bp, Artificial Sequence
  Synthetic Polynucleotide
taatacgactcactatagggaattgactgacggagaacaagctgctttggaacagaggagaccaaagatgcttgttctcaacctggcggcagcgcaaaagatg

SEQ ID NO: 187450 - DNA, 103 bp, Artificial Sequence
  Synthetic Polynucleotide
taatacgactcactatagggctgctcccacaattgactgacggagaacaaaacagaggagattgttcatggtcagtcaaaacctggcggcagcgcaaaagatg

SEQ ID NO: 187451 - DNA, 103 bp, Artificial Sequence
  Synthetic Polynucleotide
taatacgactcactatagggacaccaacttctgctcccacaattgactgaaacagaggagatcagtcatgtgtgggagcaacctggcggcagcgcaaaagatg

SEQ ID NO: 187452 - DNA, 103 bp, Artificial Sequence
  Synthetic Polynucleotide
taatacgactcactatagggtccagtccatacaccaacttctgctcccacaacagaggagagtgggaatggaagttggtaacctggcggcagcgcaaaagatg

SEQ ID NO: 187453 - DNA, 103 bp, Artificial Sequence
  Synthetic Polynucleotide
taatacgactcactataggggaatggtttctccagtccatacaccaacttaacagaggagaaagttgatgtatggactgaacctggcggcagcgcaaaagatg

SEQ ID NO: 187454 - DNA, 103 bp, Artificial Sequence
  Synthetic Polynucleotide
taatacgactcactataggggtccgcacaggaatggtttctccagtccataacagaggagaatggacatgagaaaccataacctggcggcagcgcaaaagatg

SEQ ID NO: 187455 - DNA, 103 bp, Artificial Sequence
  Synthetic Polynucleotide
taatacgactcactataggggaggcctggggcagggatggcactgtgagtaacagaggagaactcacatggccatccctaacctggcggcagcgcaaaagatg

SEQ ID NO: 187456 - DNA, 103 bp, Artificial Sequence
  Synthetic Polynucleotide
taatacgactcactatagggtccaaagcaagtccgcacaggaatggtttcaacagaggagagaaaccatgcctgtgcggaacctggcggcagcgcaaaagatg

SEQ ID NO: 187457 - DNA, 103 bp, Artificial Sequence
  Synthetic Polynucleotide
taatacgactcactatagggcaattagaggtccaaagcaagtccgcacagaacagaggagactgtgcatgcttgctttgaacctggcggcagcgcaaaagatg

SEQ ID NO: 187458 - DNA, 103 bp, Artificial Sequence
  Synthetic Polynucleotide
taatacgactcactatagggctctgctggccaattagaggtccaaagcaaaacagaggagattgcttatgacctctaataacctggcggcagcgcaaaagatg

SEQ ID NO: 187459 - DNA, 103 bp, Artificial Sequence
  Synthetic Polynucleotide
taatacgactcactatagggcatggagtgactctgctggccaattagaggaacagaggagacctctaatgggccagcagaacctggcggcagcgcaaaagatg

SEQ ID NO: 187460 - DNA, 103 bp, Artificial Sequence
  Synthetic Polynucleotide
taatacgactcactatagggctgctacttccatggagtgactctgctggcaacagaggagagccagcatggtcactccaaacctggcggcagcgcaaaagatg

SEQ ID NO: 187461 - DNA, 103 bp, Artificial Sequence
  Synthetic Polynucleotide
taatacgactcactatagggtctgtccattctgctacttccatggagtgaaacagaggagatcactcatgggaagtagcaacctggcggcagcgcaaaagatg

SEQ ID NO: 187462 - DNA, 103 bp, Artificial Sequence
  Synthetic Polynucleotide
taatacgactcactatagggaactgccttgtctgtccattctgctacttcaacagaggagagaagtaatggaatggacaaacctggcggcagcgcaaaagatg

SEQ ID NO: 187463 - DNA, 103 bp, Artificial Sequence
  Synthetic Polynucleotide
taatacgactcactatagggagatatggttaactgccttgtctgtccattaacagaggagaaatggaatgacaaggcagaacctggcggcagcgcaaaagatg

SEQ ID NO: 187464 - DNA, 103 bp, Artificial Sequence
  Synthetic Polynucleotide
taatacgactcactatagggtatatcttccagatatggttaactgccttgaacagaggagacaaggcatgtaaccatataacctggcggcagcgcaaaagatg

SEQ ID NO: 187465 - DNA, 103 bp, Artificial Sequence
  Synthetic Polynucleotide
taatacgactcactatagggaccattgtggtatatcttccagatatggttaacagaggagaaaccatatgtggaagataaacctggcggcagcgcaaaagatg

SEQ ID NO: 187466 - DNA, 103 bp, Artificial Sequence
  Synthetic Polynucleotide
taatacgactcactatagggttgccactgggaggcctggggcagggatggaacagaggagaccatccatgccccaggccaacctggcggcagcgcaaaagatg

SEQ ID NO: 187467 - DNA, 103 bp, Artificial Sequence
  Synthetic Polynucleotide
taatacgactcactatagggattctaggacaccattgtggtatatcttccaacagaggagaggaagaatgaccacaatgaacctggcggcagcgcaaaagatg

SEQ ID NO: 187468 - DNA, 103 bp, Artificial Sequence
  Synthetic Polynucleotide
taatacgactcactatagggatgatgcagaattctaggacaccattgtggaacagaggagaccacaaatgtgtcctagaaacctggcggcagcgcaaaagatg

SEQ ID NO: 187469 - DNA, 103 bp, Artificial Sequence
  Synthetic Polynucleotide
taatacgactcactatagggatcagttgtaatgatgcagaattctaggacaacagaggagagtcctaatgttctgcatcaacctggcggcagcgcaaaagatg

SEQ ID NO: 187470 - DNA, 103 bp, Artificial Sequence
  Synthetic Polynucleotide
taatacgactcactatagggattcattttcatcagttgtaatgatgcagaaacagaggagatctgcaatgttacaactgaacctggcggcagcgcaaaagatg

SEQ ID NO: 187471 - DNA, 103 bp, Artificial Sequence
  Synthetic Polynucleotide
taatacgactcactatagggatccaattacattcattttcatcagttgtaaacagaggagatacaacatgtgaaaatgaaacctggcggcagcgcaaaagatg

SEQ ID NO: 187472 - DNA, 103 bp, Artificial Sequence
  Synthetic Polynucleotide
taatacgactcactatagggcacaaacatcatccaattacattcattttcaacagaggagagaaaatatgtgtaattggaacctggcggcagcgcaaaagatg

SEQ ID NO: 187473 - DNA, 103 bp, Artificial Sequence
  Synthetic Polynucleotide
taatacgactcactatagggtggctttgcgcacaaacatcatccaattacaacagaggagagtaattatgtgatgtttgaacctggcggcagcgcaaaagatg

SEQ ID NO: 187474 - DNA, 103 bp, Artificial Sequence
  Synthetic Polynucleotide
taatacgactcactatagggtcccggttcctggctttgcgcacaaacatcaacagaggagagatgttatggcgcaaagcaacctggcggcagcgcaaaagatg

SEQ ID NO: 187475 - DNA, 103 bp, Artificial Sequence
  Synthetic Polynucleotide
taatacgactcactatagggattctgctcttcccggttcctggctttgcgaacagaggagacgcaaaatgaggaaccggaacctggcggcagcgcaaaagatg

SEQ ID NO: 187476 - DNA, 103 bp, Artificial Sequence
  Synthetic Polynucleotide
taatacgactcactatagggaagccaccaaattctgctcttcccggttccaacagaggagaggaaccatgaagagcagaaacctggcggcagcgcaaaagatg

SEQ ID NO: 187477 - DNA, 103 bp, Artificial Sequence
  Synthetic Polynucleotide
taatacgactcactatagggaggtttggaattgccactgggaggcctgggaacagaggagacccaggatgcccagtggcaacctggcggcagcgcaaaagatg

SEQ ID NO: 187478 - DNA, 103 bp, Artificial Sequence
  Synthetic Polynucleotide
taatacgactcactatagggtcatgaggataagccaccaaattctgctctaacagaggagaagagcaatgtttggtggcaacctggcggcagcgcaaaagatg

SEQ ID NO: 187479 - DNA, 103 bp, Artificial Sequence
  Synthetic Polynucleotide
taatacgactcactataggggatttttccatcatgaggataagccaccaaaacagaggagattggtgatgtatcctcataacctggcggcagcgcaaaagatg

SEQ ID NO: 187480 - DNA, 103 bp, Artificial Sequence
  Synthetic Polynucleotide
taatacgactcactatagggtgcagaaaaagatttttccatcatgaggataacagaggagaatcctcatgatggaaaaaaacctggcggcagcgcaaaagatg

SEQ ID NO: 187481 - DNA, 103 bp, Artificial Sequence
  Synthetic Polynucleotide
taatacgactcactatagggtcttgtgaggtgcagaaaaagatttttccaaacagaggagatggaaaatgctttttctgaacctggcggcagcgcaaaagatg

SEQ ID NO: 187482 - DNA, 103 bp, Artificial Sequence
  Synthetic Polynucleotide
taatacgactcactatagggaggagggatatcttgtgaggtgcagaaaaaaacagaggagatttttcatgacctcacaaaacctggcggcagcgcaaaagatg

SEQ ID NO: 187483 - DNA, 103 bp, Artificial Sequence
  Synthetic Polynucleotide
taatacgactcactataggggttcattttcaggagggatatcttgtgaggaacagaggagacctcacatgatatccctcaacctggcggcagcgcaaaagatg

SEQ ID NO: 187484 - DNA, 103 bp, Artificial Sequence
  Synthetic Polynucleotide
taatacgactcactatagggtaaaaaagcagttcattttcaggagggataaacagaggagatatcccatgtgaaaatgaaacctggcggcagcgcaaaagatg

SEQ ID NO: 187485 - DNA, 103 bp, Artificial Sequence
  Synthetic Polynucleotide
taatacgactcactatagggtcggctataataaaaaagcagttcattttcaacagaggagagaaaatatgctgctttttaacctggcggcagcgcaaaagatg

SEQ ID NO: 187486 - DNA, 103 bp, Artificial Sequence
  Synthetic Polynucleotide
taatacgactcactataggggagcataatctcggctataataaaaaagcaaacagaggagatgctttatgattatagccaacctggcggcagcgcaaaagatg

SEQ ID NO: 187487 - DNA, 103 bp, Artificial Sequence
  Synthetic Polynucleotide
taatacgactcactatagggccaatctgttgagcataatctcggctataaaacagaggagattatagatgagattatgcaacctggcggcagcgcaaaagatg

SEQ ID NO: 187488 - DNA, 103 bp, Artificial Sequence
  Synthetic Polynucleotide
taatacgactcactatagggggagggacccaggtttggaattgccactggaacagaggagaccagtgatgattccaaacaacctggcggcagcgcaaaagatg

SEQ ID NO: 187489 - DNA, 103 bp, Artificial Sequence
  Synthetic Polynucleotide
taatacgactcactatagggttcaggaacaccaatctgttgagcataatcaacagaggagagattatatgcaacagattaacctggcggcagcgcaaaagatg

SEQ ID NO: 187490 - DNA, 103 bp, Artificial Sequence
  Synthetic Polynucleotide
taatacgactcactatagggcatctgggtgttcaggaacaccaatctgttaacagaggagaaacagaatggtgttcctgaacctggcggcagcgcaaaagatg

SEQ ID NO: 187491 - DNA, 103 bp, Artificial Sequence
  Synthetic Polynucleotide
taatacgactcactatagggcagagatgcacatctgggtgttcaggaacaaacagaggagatgttccatgacacccagaaacctggcggcagcgcaaaagatg

SEQ ID NO: 187492 - DNA, 103 bp, Artificial Sequence
  Synthetic Polynucleotide
taatacgactcactataggggccacagttacagagatgcacatctgggtgaacagaggagacacccaatggtgcatctcaacctggcggcagcgcaaaagatg

SEQ ID NO: 187493 - DNA, 103 bp, Artificial Sequence
  Synthetic Polynucleotide
taatacgactcactatagggtgcactccttgccacagttacagagatgcaaacagaggagatgcatcatggtaactgtgaacctggcggcagcgcaaaagatg

SEQ ID NO: 187494 - DNA, 103 bp, Artificial Sequence
  Synthetic Polynucleotide
taatacgactcactataggggtgtaagaattgcactccttgccacagttaaacagaggagataactgatgcaaggagtgaacctggcggcagcgcaaaagatg

SEQ ID NO: 187495 - DNA, 103 bp, Artificial Sequence
  Synthetic Polynucleotide
taatacgactcactatagggtttgaactctgtgtaagaattgcactccttaacagaggagaaaggagatgaattcttacaacctggcggcagcgcaaaagatg

SEQ ID NO: 187496 - DNA, 103 bp, Artificial Sequence
  Synthetic Polynucleotide
taatacgactcactatagggtcagatgggctttgaactctgtgtaagaataacagaggagaattcttatgcagagttcaaacctggcggcagcgcaaaagatg

SEQ ID NO: 187497 - DNA, 103 bp, Artificial Sequence
  Synthetic Polynucleotide
taatacgactcactatagggatgtggctggtcagatgggctttgaactctaacagaggagaagagttatgagcccatctaacctggcggcagcgcaaaagatg

SEQ ID NO: 187498 - DNA, 103 bp, Artificial Sequence
  Synthetic Polynucleotide
taatacgactcactatagggatggttatggatgtggctggtcagatgggcaacagaggagagcccatatgaccagccacaacctggcggcagcgcaaaagatg

SEQ ID NO: 187499 - DNA, 103 bp, Artificial Sequence
  Synthetic Polynucleotide
taatacgactcactataggggagagctcagggagggacccaggtttggaaaacagaggagattccaaatgtgggtccctaacctggcggcagcgcaaaagatg

SEQ ID NO: 187500 - DNA, 103 bp, Artificial Sequence
  Synthetic Polynucleotide
taatacgactcactataggggggtaggaagatggttatggatgtggctggaacagaggagaccagccatgtccataaccaacctggcggcagcgcaaaagatg

SEQ ID NO: 187501 - DNA, 103 bp, Artificial Sequence
  Synthetic Polynucleotide
taatacgactcactatagggctatgtccctgggtaggaagatggttatggaacagaggagaccataaatgtcttcctacaacctggcggcagcgcaaaagatg

SEQ ID NO: 187502 - DNA, 103 bp, Artificial Sequence
  Synthetic Polynucleotide
taatacgactcactatagggatggctgccgctatgtccctgggtaggaagaacagaggagacttcctatgcagggacataacctggcggcagcgcaaaagatg

SEQ ID NO: 187503 - DNA, 103 bp, Artificial Sequence
  Synthetic Polynucleotide
taatacgactcactataggggacttggcccatggctgccgctatgtccctaacagaggagaagggacatggcggcagccaacctggcggcagcgcaaaagatg

SEQ ID NO: 187504 - DNA, 103 bp, Artificial Sequence
  Synthetic Polynucleotide
taatacgactcactatagggtctttgctgtgacttggcccatggctgccgaacagaggagacggcagatgtgggccaagaacctggcggcagcgcaaaagatg

SEQ ID NO: 187505 - DNA, 103 bp, Artificial Sequence
  Synthetic Polynucleotide
taatacgactcactatagggccacttcctttctttgctgtgacttggcccaacagaggagagggccaatgcacagcaaaaacctggcggcagcgcaaaagatg

SEQ ID NO: 187506 - DNA, 103 bp, Artificial Sequence
  Synthetic Polynucleotide
taatacgactcactatagggttgagcacttccacttcctttctttgctgtaacagaggagaacagcaatgaaaggaagtaacctggcggcagcgcaaaagatg

SEQ ID NO: 187507 - DNA, 103 bp, Artificial Sequence
  Synthetic Polynucleotide
taatacgactcactatagggtgggggcacattgagcacttccacttccttaacagaggagaaaggaaatggaagtgctcaacctggcggcagcgcaaaagatg

SEQ ID NO: 187508 - DNA, 103 bp, Artificial Sequence
  Synthetic Polynucleotide
taatacgactcactataggggataaaagcttgggggcacattgagcacttaacagaggagaaagtgcatgatgtgccccaacctggcggcagcgcaaaagatg

SEQ ID NO: 187509 - DNA, 103 bp, Artificial Sequence
  Synthetic Polynucleotide
taatacgactcactatagggtggaaggagagataaaagcttgggggcacaaacagaggagatgtgccatgaagcttttaaacctggcggcagcgcaaaagatg

SEQ ID NO: 187510 - DNA, 103 bp, Artificial Sequence
  Synthetic Polynucleotide
taatacgactcactataggggcagaaggcagagagctcagggagggacccaacagaggagagggtccatgcctgagctcaacctggcggcagcgcaaaagatg

SEQ ID NO: 187511 - DNA, 103 bp, Artificial Sequence
  Synthetic Polynucleotide
taatacgactcactatagggacatgaagtttggaaggagagataaaagctaacagaggagaagctttatgctctccttcaacctggcggcagcgcaaaagatg

SEQ ID NO: 187512 - DNA, 103 bp, Artificial Sequence
  Synthetic Polynucleotide
taatacgactcactatagggcataaagtggacatgaagtttggaaggagaaacagaggagatctcctatgaaacttcataacctggcggcagcgcaaaagatg

SEQ ID NO: 187513 - DNA, 103 bp, Artificial Sequence
  Synthetic Polynucleotide
taatacgactcactatagggccatgtgacccataaagtggacatgaagttaacagaggagaaacttcatgtccactttaaacctggcggcagcgcaaaagatg

SEQ ID NO: 187514 - DNA, 103 bp, Artificial Sequence
  Synthetic Polynucleotide
taatacgactcactatagggggcttcatacccatgtgacccataaagtggaacagaggagaccacttatggggtcacataacctggcggcagcgcaaaagatg

SEQ ID NO: 187515 - DNA, 103 bp, Artificial Sequence
  Synthetic Polynucleotide
taatacgactcactatagggacacttgtggggcttcatacccatgtgaccaacagaggagaggtcacatgggtatgaagaacctggcggcagcgcaaaagatg

SEQ ID NO: 187516 - DNA, 103 bp, Artificial Sequence
  Synthetic Polynucleotide
taatacgactcactatagggtacagaaatcacacttgtggggcttcatacaacagaggagagtatgaatgcccacaagtaacctggcggcagcgcaaaagatg

SEQ ID NO: 187517 - DNA, 103 bp, Artificial Sequence
  Synthetic Polynucleotide
taatacgactcactatagggaaagccttgctacagaaatcacacttgtggaacagaggagaccacaaatgtgatttctgaacctggcggcagcgcaaaagatg

SEQ ID NO: 187518 - DNA, 103 bp, Artificial Sequence
  Synthetic Polynucleotide
taatacgactcactataggggggatcactaaaagccttgctacagaaatcaacagaggagagatttcatgagcaaggctaacctggcggcagcgcaaaagatg

SEQ ID NO: 187519 - DNA, 103 bp, Artificial Sequence
  Synthetic Polynucleotide
taatacgactcactataggggcaggttgctgggatcactaaaagccttgcaacagaggagagcaaggatgttagtgatcaacctggcggcagcgcaaaagatg

SEQ ID NO: 187520 - DNA, 103 bp, Artificial Sequence
  Synthetic Polynucleotide
taatacgactcactatagggaggtgggtccgcaggttgctgggatcactaaacagaggagatagtgaatgcagcaacctaacctggcggcagcgcaaaagatg

SEQ ID NO: 187521 - DNA, 103 bp, Artificial Sequence
  Synthetic Polynucleotide
taatacgactcactatagggtaaagacagagcagaaggcagagagctcagaacagaggagactgagcatgctgccttctaacctggcggcagcgcaaaagatg

SEQ ID NO: 187522 - DNA, 103 bp, Artificial Sequence
  Synthetic Polynucleotide
taatacgactcactatagggatgtatcttgaggtgggtccgcaggttgctaacagaggagaagcaacatgcggacccacaacctggcggcagcgcaaaagatg

SEQ ID NO: 187523 - DNA, 103 bp, Artificial Sequence
  Synthetic Polynucleotide
taatacgactcactatagggtctgacctgtatgtatcttgaggtgggtccaacagaggagaggacccatgtcaagatacaacctggcggcagcgcaaaagatg

SEQ ID NO: 187524 - DNA, 103 bp, Artificial Sequence
  Synthetic Polynucleotide
taatacgactcactatagggctgtagttcttctgacctgtatgtatcttgaacagaggagacaagatatgtacaggtcaaacctggcggcagcgcaaaagatg

SEQ ID NO: 187525 - DNA, 103 bp, Artificial Sequence
  Synthetic Polynucleotide
taatacgactcactatagggcaaggtacacctgtagttcttctgacctgtaacagaggagaacaggtatgaagaactacaacctggcggcagcgcaaaagatg

SEQ ID NO: 187526 - DNA, 103 bp, Artificial Sequence
  Synthetic Polynucleotide
taatacgactcactatagggacttgtcacacaaggtacacctgtagttctaacagaggagaagaactatgggtgtacctaacctggcggcagcgcaaaagatg

SEQ ID NO: 187527 - DNA, 103 bp, Artificial Sequence
  Synthetic Polynucleotide
taatacgactcactatagggtgggtgaaagacttgtcacacaaggtacacaacagaggagagtgtacatggtgtgacaaaacctggcggcagcgcaaaagatg

SEQ ID NO: 187528 - DNA, 103 bp, Artificial Sequence
  Synthetic Polynucleotide
taatacgactcactataggggtgagccttctgggtgaaagacttgtcacaaacagaggagatgtgacatgtctttcaccaacctggcggcagcgcaaaagatg

SEQ ID NO: 187529 - DNA, 103 bp, Artificial Sequence
  Synthetic Polynucleotide
taatacgactcactataggggggactccaggtgagccttctgggtgaaagaacagaggagactttcaatgagaaggctcaacctggcggcagcgcaaaagatg

SEQ ID NO: 187530 - DNA, 103 bp, Artificial Sequence
  Synthetic Polynucleotide
taatacgactcactatagggataaccatgtgggactccaggtgagccttcaacagaggagagaaggcatgcctggagtcaacctggcggcagcgcaaaagatg

SEQ ID NO: 187531 - DNA, 103 bp, Artificial Sequence
  Synthetic Polynucleotide
taatacgactcactatagggcccagtgtggataaccatgtgggactccagaacagaggagactggagatgcacatggttaacctggcggcagcgcaaaagatg

SEQ ID NO: 187532 - DNA, 103 bp, Artificial Sequence
  Synthetic Polynucleotide
taatacgactcactatagggccactggactcaggttcatttcattcatccaacagaggagaggatgaatgaaatgaaccaacctggcggcagcgcaaaagatg

SEQ ID NO: 187533 - DNA, 103 bp, Artificial Sequence
  Synthetic Polynucleotide
taatacgactcactatagggttggtagcattaaagacagagcagaaggcaaacagaggagatgccttatgctctgtcttaacctggcggcagcgcaaaagatg

SEQ ID NO: 187534 - DNA, 103 bp, Artificial Sequence
  Synthetic Polynucleotide
taatacgactcactataggggattcttctccccagtgtggataaccatgtaacagaggagaacatggatgtccacactgaacctggcggcagcgcaaaagatg

SEQ ID NO: 187535 - DNA, 103 bp, Artificial Sequence
  Synthetic Polynucleotide
taatacgactcactatagggtcacacttaagattcttctccccagtgtggaacagaggagaccacacatgggagaagaaaacctggcggcagcgcaaaagatg

SEQ ID NO: 187536 - DNA, 103 bp, Artificial Sequence
  Synthetic Polynucleotide
taatacgactcactataggggtcacagtaatcacacttaagattcttctcaacagaggagagagaagatgcttaagtgtaacctggcggcagcgcaaaagatg

SEQ ID NO: 187537 - DNA, 103 bp, Artificial Sequence
  Synthetic Polynucleotide
taatacgactcactatagggtaaacaacttgtcacagtaatcacacttaaaacagaggagattaagtatgattactgtgaacctggcggcagcgcaaaagatg

SEQ ID NO: 187538 - DNA, 103 bp, Artificial Sequence
  Synthetic Polynucleotide
taatacgactcactatagggtgcctccgcataaacaacttgtcacagtaaaacagaggagattactgatgcaagttgttaacctggcggcagcgcaaaagatg

SEQ ID NO: 187539 - DNA, 103 bp, Artificial Sequence
  Synthetic Polynucleotide
taatacgactcactatagggcttgaggtcctgcctccgcataaacaacttaacagaggagaaagttgatgatgcggaggaacctggcggcagcgcaaaagatg

SEQ ID NO: 187540 - DNA, 103 bp, Artificial Sequence
  Synthetic Polynucleotide
taatacgactcactataggggcacgtgctgcttgaggtcctgcctccgcaaacagaggagatgcggaatgaggacctcaaacctggcggcagcgcaaaagatg

SEQ ID NO: 187541 - DNA, 103 bp, Artificial Sequence
  Synthetic Polynucleotide
taatacgactcactataggggtgtggatgagcacgtgctgcttgaggtccaacagaggagaggacctatggcagcacgtaacctggcggcagcgcaaaagatg

SEQ ID NO: 187542 - DNA, 103 bp, Artificial Sequence
  Synthetic Polynucleotide
taatacgactcactataggggcgttcttgagtgtggatgagcacgtgctgaacagaggagacagcacatgctcatccacaacctggcggcagcgcaaaagatg

SEQ ID NO: 187543 - DNA, 103 bp, Artificial Sequence
  Synthetic Polynucleotide
taatacgactcactatagggacttgatctggcgttcttgagtgtggatgaaacagaggagatcatccatgctcaagaacaacctggcggcagcgcaaaagatg

SEQ ID NO: 187544 - DNA, 103 bp, Artificial Sequence
  Synthetic Polynucleotide
taatacgactcactatagggccaatacccattggtagcattaaagacagaaacagaggagatctgtcatgaatgctaccaacctggcggcagcgcaaaagatg

SEQ ID NO: 187545 - DNA, 103 bp, Artificial Sequence
  Synthetic Polynucleotide
taatacgactcactatagggcacttgggacacttgatctggcgttcttgaaacagaggagatcaagaatgccagatcaaaacctggcggcagcgcaaaagatg

SEQ ID NO: 187546 - DNA, 103 bp, Artificial Sequence
  Synthetic Polynucleotide
taatacgactcactatagggcagcttatcacacttgggacacttgatctgaacagaggagacagatcatgtgtcccaagaacctggcggcagcgcaaaagatg

SEQ ID NO: 187547 - DNA, 103 bp, Artificial Sequence
  Synthetic Polynucleotide
taatacgactcactatagggttctcaagaacagcttatcacacttgggacaacagaggagagtcccaatggtgataagcaacctggcggcagcgcaaaagatg

SEQ ID NO: 187548 - DNA, 103 bp, Artificial Sequence
  Synthetic Polynucleotide
taatacgactcactatagggaagtgatttgttctcaagaacagcttatcaaacagaggagatgataaatggttcttgagaacctggcggcagcgcaaaagatg

SEQ ID NO: 187549 - DNA, 103 bp, Artificial Sequence
  Synthetic Polynucleotide
taatacgactcactatagggatgcttctttaagtgatttgttctcaagaaaacagaggagattcttgatgacaaatcacaacctggcggcagcgcaaaagatg

SEQ ID NO: 187550 - DNA, 103 bp, Artificial Sequence
  Synthetic Polynucleotide
taatacgactcactataggggagaattgagatgcttctttaagtgatttgaacagaggagacaaatcatgtaaagaagcaacctggcggcagcgcaaaagatg

SEQ ID NO: 187551 - DNA, 103 bp, Artificial Sequence
  Synthetic Polynucleotide
taatacgactcactatagggtttccttcatgagaattgagatgcttctttaacagaggagaaaagaaatgtctcaattcaacctggcggcagcgcaaaagatg

SEQ ID NO: 187552 - DNA, 103 bp, Artificial Sequence
  Synthetic Polynucleotide
taatacgactcactatagggataatcccgttttccttcatgagaattgagaacagaggagactcaatatgcatgaaggaaacctggcggcagcgcaaaagatg

SEQ ID NO: 187553 - DNA, 103 bp, Artificial Sequence
  Synthetic Polynucleotide
taatacgactcactatagggtttcacagacataatcccgttttccttcataacagaggagaatgaagatgaacgggattaacctggcggcagcgcaaaagatg

SEQ ID NO: 187554 - DNA, 103 bp, Artificial Sequence
  Synthetic Polynucleotide
taatacgactcactatagggtttgtacatttttcacagacataatcccgtaacagaggagaacgggaatgtgtctgtgaaacctggcggcagcgcaaaagatg

SEQ ID NO: 187555 - DNA, 103 bp, Artificial Sequence
  Synthetic Polynucleotide
taatacgactcactatagggccctcgatccccaatacccattggtagcataacagaggagaatgctaatgatgggtattaacctggcggcagcgcaaaagatg

SEQ ID NO: 187556 - DNA, 103 bp, Artificial Sequence
  Synthetic Polynucleotide
taatacgactcactatagggtagataagcctttgtacatttttcacagacaacagaggagagtctgtatgaaatgtacaaacctggcggcagcgcaaaagatg

SEQ ID NO: 187557 - DNA, 103 bp, Artificial Sequence
  Synthetic Polynucleotide
taatacgactcactatagggggtatttggttagataagcctttgtacattaacagaggagaaatgtaatgaggcttatcaacctggcggcagcgcaaaagatg

SEQ ID NO: 187558 - DNA, 103 bp, Artificial Sequence
  Synthetic Polynucleotide
taatacgactcactatagggcgggtgagatggtatttggttagataagccaacagaggagaggcttaatgaaccaaataaacctggcggcagcgcaaaagatg

SEQ ID NO: 187559 - DNA, 103 bp, Artificial Sequence
  Synthetic Polynucleotide
taatacgactcactatagggtttcaggtggcgggtgagatggtatttggtaacagaggagaaccaaaatgcatctcaccaacctggcggcagcgcaaaagatg

SEQ ID NO: 187560 - DNA, 103 bp, Artificial Sequence
  Synthetic Polynucleotide
taatacgactcactatagggctttgcaggttttcaggtggcgggtgagataacagaggagaatctcaatggccacctgaaacctggcggcagcgcaaaagatg

SEQ ID NO: 187561 - DNA, 103 bp, Artificial Sequence
  Synthetic Polynucleotide
taatacgactcactataggggaggtgggccctttgcaggttttcaggtggaacagaggagaccacctatgaacctgcaaaacctggcggcagcgcaaaagatg

SEQ ID NO: 187562 - DNA, 103 bp, Artificial Sequence
  Synthetic Polynucleotide
taatacgactcactatagggtgacgaactggaggtgggccctttgcaggtaacagaggagaacctgcatggggcccaccaacctggcggcagcgcaaaagatg

SEQ ID NO: 187563 - DNA, 103 bp, Artificial Sequence
  Synthetic Polynucleotide
taatacgactcactatagggcctctggtgctgacgaactggaggtgggccaacagaggagaggcccaatgccagttcgtaacctggcggcagcgcaaaagatg

SEQ ID NO: 187564 - DNA, 103 bp, Artificial Sequence
  Synthetic Polynucleotide
taatacgactcactatagggtcttcttcctcctctggtgctgacgaactgaacagaggagacagttcatgagcaccagaaacctggcggcagcgcaaaagatg

SEQ ID NO: 187565 - DNA, 103 bp, Artificial Sequence
  Synthetic Polynucleotide
taatacgactcactatagggtgagtcatcctcttcttcctcctctggtgcaacagaggagagcaccaatggaggaagaaaacctggcggcagcgcaaaagatg

SEQ ID NO: 187566 - DNA, 103 bp, Artificial Sequence
  Synthetic Polynucleotide
taatacgactcactatagggcacacatcacccctcgatccccaatacccaaacagaggagatgggtaatggggatcgagaacctggcggcagcgcaaaagatg

SEQ ID NO: 187567 - DNA, 103 bp, Artificial Sequence
  Synthetic Polynucleotide
taatacgactcactatagggcttcctcttctgagtcatcctcttcttcctaacagaggagaaggaagatgaggatgactaacctggcggcagcgcaaaagatg

SEQ ID NO: 187568 - DNA, 103 bp, Artificial Sequence
  Synthetic Polynucleotide
taatacgactcactatagggtctgctagatcttcctcttctgagtcatccaacagaggagaggatgaatgagaagaggaaacctggcggcagcgcaaaagatg

SEQ ID NO: 187569 - DNA, 103 bp, Artificial Sequence
  Synthetic Polynucleotide
taatacgactcactatagggccccacagagtctgctagatcttcctcttcaacagaggagagaagagatggatctagcaaacctggcggcagcgcaaaagatg

SEQ ID NO: 187570 - DNA, 103 bp, Artificial Sequence
  Synthetic Polynucleotide
taatacgactcactatagggagtcttctgtccccacagagtctgctagataacagaggagaatctagatgactctgtggaacctggcggcagcgcaaaagatg

SEQ ID NO: 187571 - DNA, 103 bp, Artificial Sequence
  Synthetic Polynucleotide
taatacgactcactatagggttaatcctacagtcttctgtccccacagagaacagaggagactctgtatggacagaagaaacctggcggcagcgcaaaagatg

SEQ ID NO: 187572 - DNA, 103 bp, Artificial Sequence
  Synthetic Polynucleotide
taatacgactcactatagggcacagcactgttaatcctacagtcttctgtaacagaggagaacagaaatgtgtaggattaacctggcggcagcgcaaaagatg

SEQ ID NO: 187573 - DNA, 103 bp, Artificial Sequence
  Synthetic Polynucleotide
taatacgactcactatagggccgctgaatacacagcactgttaatcctacaacagaggagagtaggaatgacagtgctgaacctggcggcagcgcaaaagatg

SEQ ID NO: 187574 - DNA, 103 bp, Artificial Sequence
  Synthetic Polynucleotide
taatacgactcactatagggagagactcatccgctgaatacacagcactgaacagaggagacagtgcatggtattcagcaacctggcggcagcgcaaaagatg

SEQ ID NO: 187575 - DNA, 103 bp, Artificial Sequence
  Synthetic Polynucleotide
taatacgactcactatagggatgtgcagaaagagactcatccgctgaataaacagaggagatattcaatggatgagtctaacctggcggcagcgcaaaagatg

SEQ ID NO: 187576 - DNA, 103 bp, Artificial Sequence
  Synthetic Polynucleotide
taatacgactcactatagggtcaggtaacccacacatcacccctcgatccaacagaggagaggatcgatgggtgatgtgaacctggcggcagcgcaaaagatg

SEQ ID NO: 187577 - DNA, 103 bp, Artificial Sequence
  Synthetic Polynucleotide
taatacgactcactataggggtagtttctttcaggtaacccacacatcacaacagaggagagtgatgatggggttacctaacctggcggcagcgcaaaagatg

SEQ ID NO: 187578 - DNA, 103 bp, Artificial Sequence
  Synthetic Polynucleotide
taatacgactcactataggggaggtagggtgtagtttctttcaggtaaccaacagaggagaggttacatgaaagaaactaacctggcggcagcgcaaaagatg

SEQ ID NO: 187579 - DNA, 103 bp, Artificial Sequence
  Synthetic Polynucleotide
taatacgactcactatagggtaaggtggtggaggtagggtgtagtttcttaacagaggagaaagaaaatgcaccctaccaacctggcggcagcgcaaaagatg

SEQ ID NO: 187580 - DNA, 103 bp, Artificial Sequence
  Synthetic Polynucleotide
taatacgactcactatagggcaggtgagggtaaggtggtggaggtagggtaacagaggagaaccctaatgccaccacctaacctggcggcagcgcaaaagatg

SEQ ID NO: 187581 - DNA, 103 bp, Artificial Sequence
  Synthetic Polynucleotide
taatacgactcactatagggaactgctctccaggtgagggtaaggtggtgaacagaggagacaccacatgaccctcaccaacctggcggcagcgcaaaagatg

SEQ ID NO: 187582 - DNA, 103 bp, Artificial Sequence
  Synthetic Polynucleotide
taatacgactcactatagggtgctccatccccactggactcaggttcattaacagaggagaaatgaaatggagtccagtaacctggcggcagcgcaaaagatg

SEQ ID NO: 187583 - DNA, 103 bp, Artificial Sequence
  Synthetic Polynucleotide
taatacgactcactataggggttctgaaataactgctctccaggtgagggaacagaggagaccctcaatgggagagcagaacctggcggcagcgcaaaagatg

SEQ ID NO: 187584 - DNA, 103 bp, Artificial Sequence
  Synthetic Polynucleotide
taatacgactcactatagggaggtagaatggttctgaaataactgctctcaacagaggagagagagcatgtatttcagaaacctggcggcagcgcaaaagatg

SEQ ID NO: 187585 - DNA, 103 bp, Artificial Sequence
  Synthetic Polynucleotide
taatacgactcactatagggataaaatgccaggtagaatggttctgaaataacagaggagaatttcaatgccattctacaacctggcggcagcgcaaaagatg

SEQ ID NO: 187586 - DNA, 103 bp, Artificial Sequence
  Synthetic Polynucleotide
taatacgactcactataggggctaaataagataaaatgccaggtagaatgaacagaggagacattctatgtggcattttaacctggcggcagcgcaaaagatg

SEQ ID NO: 187587 - DNA, 103 bp, Artificial Sequence
  Synthetic Polynucleotide
taatacgactcactatagggtggtctgtcagctaaataagataaaatgccaacagaggagaggcattatgtcttatttaaacctggcggcagcgcaaaagatg

SEQ ID NO: 187588 - DNA, 103 bp, Artificial Sequence
  Synthetic Polynucleotide
taatacgactcactatagggactgtggaggtggtctgtcagctaaataagaacagaggagacttattatgctgacagacaacctggcggcagcgcaaaagatg

SEQ ID NO: 187589 - DNA, 103 bp, Artificial Sequence
  Synthetic Polynucleotide
taatacgactcactataggggggtggatgtactgtggaggtggtctgtcaaacagaggagatgacagatgacctccacaaacctggcggcagcgcaaaagatg

SEQ ID NO: 187590 - DNA, 103 bp, Artificial Sequence
  Synthetic Polynucleotide
taatacgactcactatagggtatagagttagggtggatgtactgtggaggaacagaggagacctccaatgtacatccacaacctggcggcagcgcaaaagatg

SEQ ID NO: 187591 - DNA, 103 bp, Artificial Sequence
  Synthetic Polynucleotide
taatacgactcactatagggcatcaacatttatagagttagggtggatgtaacagaggagaacatccatgctaactctaaacctggcggcagcgcaaaagatg

SEQ ID NO: 187592 - DNA, 103 bp, Artificial Sequence
  Synthetic Polynucleotide
taatacgactcactataggggctgtattaccatcaacatttatagagttaaacagaggagataactcatgaaatgttgaaacctggcggcagcgcaaaagatg

SEQ ID NO: 187593 - DNA, 103 bp, Artificial Sequence
  Synthetic Polynucleotide
taatacgactcactatagggtgaagtcagctgctccatccccactggactaacagaggagaagtccaatggggatggagaacctggcggcagcgcaaaagatg

SEQ ID NO: 187594 - DNA, 103 bp, Artificial Sequence
  Synthetic Polynucleotide
taatacgactcactataggggatagataatgctgtattaccatcaacattaacagaggagaaatgttatgggtaatacaaacctggcggcagcgcaaaagatg

SEQ ID NO: 187595 - DNA, 103 bp, Artificial Sequence
  Synthetic Polynucleotide
taatacgactcactatagggggttattggtgatagataatgctgtattacaacagaggagagtaataatgcattatctaaacctggcggcagcgcaaaagatg

SEQ ID NO: 187596 - DNA, 103 bp, Artificial Sequence
  Synthetic Polynucleotide
taatacgactcactatagggagtgctgaagggttattggtgatagataataacagaggagaattatcatgcaccaataaaacctggcggcagcgcaaaagatg

SEQ ID NO: 187597 - DNA, 103 bp, Artificial Sequence
  Synthetic Polynucleotide
taatacgactcactatagggatagggatctagtgctgaagggttattggtaacagaggagaaccaatatgccttcagcaaacctggcggcagcgcaaaagatg

SEQ ID NO: 187598 - DNA, 103 bp, Artificial Sequence
  Synthetic Polynucleotide
taatacgactcactatagggcattggactgatagggatctagtgctgaagaacagaggagacttcagatgtagatccctaacctggcggcagcgcaaaagatg

SEQ ID NO: 187599 - DNA, 103 bp, Artificial Sequence
  Synthetic Polynucleotide
taatacgactcactatagggccaacatttccattggactgatagggatctaacagaggagaagatccatgtcagtccaaaacctggcggcagcgcaaaagatg

SEQ ID NO: 187600 - DNA, 103 bp, Artificial Sequence
  Synthetic Polynucleotide
taatacgactcactatagggtggttctaatccaacatttccattggactgaacagaggagacagtccatgggaaatgttaacctggcggcagcgcaaaagatg

SEQ ID NO: 187601 - DNA, 103 bp, Artificial Sequence
  Synthetic Polynucleotide
taatacgactcactatagggaaacaatgcctggttctaatccaacatttcaacagaggagagaaatgatggattagaacaacctggcggcagcgcaaaagatg

SEQ ID NO: 187602 - DNA, 103 bp, Artificial Sequence
  Synthetic Polynucleotide
taatacgactcactataggggagtctattgaaacaatgcctggttctaataacagaggagaattagaatgaggcattgtaacctggcggcagcgcaaaagatg

SEQ ID NO: 187603 - DNA, 103 bp, Artificial Sequence
  Synthetic Polynucleotide
taatacgactcactatagggcacagagcgagagtctattgaaacaatgccaacagaggagaggcattatgtcaatagacaacctggcggcagcgcaaaagatg

SEQ ID NO: 187604 - DNA, 103 bp, Artificial Sequence
  Synthetic Polynucleotide
taatacgactcactatagggtcacagaggatgaagtcagctgctccatccaacagaggagaggatggatgagctgacttaacctggcggcagcgcaaaagatg

SEQ ID NO: 187605 - DNA, 103 bp, Artificial Sequence
  Synthetic Polynucleotide
taatacgactcactatagggcatgtgtgttcacagagcgagagtctattgaacagaggagacaatagatgctcgctctgaacctggcggcagcgcaaaagatg

SEQ ID NO: 187606 - DNA, 103 bp, Artificial Sequence
  Synthetic Polynucleotide
taatacgactcactatagggctttgggcaccatgtgtgttcacagagcgaaacagaggagatcgctcatggaacacacaaacctggcggcagcgcaaaagatg

SEQ ID NO: 187607 - DNA, 103 bp, Artificial Sequence
  Synthetic Polynucleotide
taatacgactcactataggggggatgaagactttgggcaccatgtgtgttaacagaggagaaacacaatgggtgcccaaaacctggcggcagcgcaaaagatg

SEQ ID NO: 187608 - DNA, 103 bp, Artificial Sequence
  Synthetic Polynucleotide
taatacgactcactatagggggccatcactgggatgaagactttgggcacaacagaggagagtgcccatggtcttcatcaacctggcggcagcgcaaaagatg

SEQ ID NO: 187609 - DNA, 103 bp, Artificial Sequence
  Synthetic Polynucleotide
taatacgactcactataggggccacctcatggccatcactgggatgaagaaacagaggagatcttcaatgcagtgatggaacctggcggcagcgcaaaagatg

SEQ ID NO: 187610 - DNA, 103 bp, Artificial Sequence
  Synthetic Polynucleotide
taatacgactcactatagggtgtgtccaaggccacctcatggccatcactaacagaggagaagtgatatgcatgaggtgaacctggcggcagcgcaaaagatg

SEQ ID NO: 187611 - DNA, 103 bp, Artificial Sequence
  Synthetic Polynucleotide
taatacgactcactatagggtagtgattgctgtgtccaaggccacctcataacagaggagaatgaggatgccttggacaaacctggcggcagcgcaaaagatg

SEQ ID NO: 187612 - DNA, 103 bp, Artificial Sequence
  Synthetic Polynucleotide
taatacgactcactatagggacgttctccatagtgattgctgtgtccaagaacagaggagacttggaatgagcaatcacaacctggcggcagcgcaaaagatg

SEQ ID NO: 187613 - DNA, 103 bp, Artificial Sequence
  Synthetic Polynucleotide
taatacgactcactatagggaaccctagaaacgttctccatagtgattgcaacagaggagagcaatcatgatggagaacaacctggcggcagcgcaaaagatg

SEQ ID NO: 187614 - DNA, 103 bp, Artificial Sequence
  Synthetic Polynucleotide
taatacgactcactatagggttgggctggtaaccctagaaacgttctccaaacagaggagatggagaatgtttctagggaacctggcggcagcgcaaaagatg

SEQ ID NO: 187615 - DNA, 103 bp, Artificial Sequence
  Synthetic Polynucleotide
taatacgactcactatagggaaggcattgctcacagaggatgaagtcagcaacagaggagagctgacatgatcctctgtaacctggcggcagcgcaaaagatg

SEQ ID NO: 187616 - DNA, 103 bp, Artificial Sequence
  Synthetic Polynucleotide
taatacgactcactatagggtctgtcgaaattgggctggtaaccctagaaaacagaggagattctagatgtaccagcccaacctggcggcagcgcaaaagatg

SEQ ID NO: 187617 - DNA, 103 bp, Artificial Sequence
  Synthetic Polynucleotide
taatacgactcactatagggtgccattccatctgtcgaaattgggctggtaacagaggagaaccagcatgatttcgacaaacctggcggcagcgcaaaagatg

SEQ ID NO: 187618 - DNA, 103 bp, Artificial Sequence
  Synthetic Polynucleotide
taatacgactcactatagggtaagctcctctgccattccatctgtcgaaaaacagaggagatttcgaatgatggaatggaacctggcggcagcgcaaaagatg

SEQ ID NO: 187619 - DNA, 103 bp, Artificial Sequence
  Synthetic Polynucleotide
taatacgactcactatagggccgtccatcgtaagctcctctgccattccaaacagaggagatggaatatgagaggagctaacctggcggcagcgcaaaagatg

SEQ ID NO: 187620 - DNA, 103 bp, Artificial Sequence
  Synthetic Polynucleotide
taatacgactcactataggggcctgcaacaccgtccatcgtaagctcctcaacagaggagagaggagatgacgatggacaacctggcggcagcgcaaaagatg

SEQ ID NO: 187621 - DNA, 103 bp, Artificial Sequence
  Synthetic Polynucleotide
taatacgactcactataggggggaatgctcgcctgcaacaccgtccatcgaacagaggagacgatggatggtgttgcagaacctggcggcagcgcaaaagatg

SEQ ID NO: 187622 - DNA, 103 bp, Artificial Sequence
  Synthetic Polynucleotide
taatacgactcactatagggtttgggatttgggaatgctcgcctgcaacaaacagaggagatgttgcatgcgagcattcaacctggcggcagcgcaaaagatg

SEQ ID NO: 187623 - DNA, 103 bp, Artificial Sequence
  Synthetic Polynucleotide
taatacgactcactatagggtctggagccatttgggatttgggaatgctcaacagaggagagagcatatgcaaatcccaaacctggcggcagcgcaaaagatg

SEQ ID NO: 187624 - DNA, 103 bp, Artificial Sequence
  Synthetic Polynucleotide
taatacgactcactataggggttcatgacttctggagccatttgggatttaacagaggagaaaatccatgatggctccaaacctggcggcagcgcaaaagatg

SEQ ID NO: 187625 - DNA, 103 bp, Artificial Sequence
  Synthetic Polynucleotide
taatacgactcactatagggacagacagaggttcatgacttctggagccaaacagaggagatggctcatgaagtcatgaaacctggcggcagcgcaaaagatg

SEQ ID NO: 187626 - DNA, 103 bp, Artificial Sequence
  Synthetic Polynucleotide
taatacgactcactatagggtgagactggcaaggcattgctcacagaggaaacagaggagatcctctatgagcaatgccaacctggcggcagcgcaaaagatg

SEQ ID NO: 187627 - DNA, 103 bp, Artificial Sequence
  Synthetic Polynucleotide
taatacgactcactatagggcacagaatccacagacagaggttcatgactaacagaggagaagtcatatgcctctgtctaacctggcggcagcgcaaaagatg

SEQ ID NO: 187628 - DNA, 103 bp, Artificial Sequence
  Synthetic Polynucleotide
taatacgactcactatagggggttgttgctcacagaatccacagacagagaacagaggagactctgtatgtggattctgaacctggcggcagcgcaaaagatg

SEQ ID NO: 187629 - DNA, 103 bp, Artificial Sequence
  Synthetic Polynucleotide
taatacgactcactatagggtctgctgcaaggttgttgctcacagaatccaacagaggagaggattcatggagcaacaaaacctggcggcagcgcaaaagatg

SEQ ID NO: 187630 - DNA, 103 bp, Artificial Sequence
  Synthetic Polynucleotide
taatacgactcactatagggtcctacagcgtctgctgcaaggttgttgctaacagaggagaagcaacatgcttgcagcaaacctggcggcagcgcaaaagatg

SEQ ID NO: 187631 - DNA, 103 bp, Artificial Sequence
  Synthetic Polynucleotide
taatacgactcactatagggcaccaccatgtcctacagcgtctgctgcaaaacagaggagattgcagatgacgctgtagaacctggcggcagcgcaaaagatg

SEQ ID NO: 187632 - DNA, 103 bp, Artificial Sequence
  Synthetic Polynucleotide
taatacgactcactatagggatgggtatcacaccaccatgtcctacagcgaacagaggagacgctgtatgacatggtggaacctggcggcagcgcaaaagatg

SEQ ID NO: 187633 - DNA, 103 bp, Artificial Sequence
  Synthetic Polynucleotide
taatacgactcactatagggattcccatgcatgggtatcacaccaccatgaacagaggagacatggtatggtgatacccaacctggcggcagcgcaaaagatg

SEQ ID NO: 187634 - DNA, 103 bp, Artificial Sequence
  Synthetic Polynucleotide
taatacgactcactataggggctccaggccattcccatgcatgggtatcaaacagaggagatgatacatgtgcatgggaaacctggcggcagcgcaaaagatg

SEQ ID NO: 187635 - DNA, 103 bp, Artificial Sequence
  Synthetic Polynucleotide
taatacgactcactatagggaccacagggagctccaggccattcccatgcaacagaggagagcatggatgtggcctggaaacctggcggcagcgcaaaagatg

SEQ ID NO: 187636 - DNA, 103 bp, Artificial Sequence
  Synthetic Polynucleotide
taatacgactcactatagggtgtctccatgaccacagggagctccaggccaacagaggagaggcctgatgctccctgtgaacctggcggcagcgcaaaagatg

SEQ ID NO: 187637 - DNA, 103 bp, Artificial Sequence
  Synthetic Polynucleotide
taatacgactcactatagggggtgacttcctgagactggcaaggcattgcaacagaggagagcaatgatgtgccagtctaacctggcggcagcgcaaaagatg

SEQ ID NO: 187638 - DNA, 103 bp, Artificial Sequence
  Synthetic Polynucleotide
taatacgactcactatagggcaatgtggtctgtctccatgaccacagggaaacagaggagatccctgatgtcatggagaaacctggcggcagcgcaaaagatg

SEQ ID NO: 187639 - DNA, 103 bp, Artificial Sequence
  Synthetic Polynucleotide
taatacgactcactatagggacccgacttgcaatgtggtctgtctccatgaacagaggagacatggaatgagaccacataacctggcggcagcgcaaaagatg

SEQ ID NO: 187640 - DNA, 103 bp, Artificial Sequence
  Synthetic Polynucleotide
taatacgactcactatagggcatgccattgacccgacttgcaatgtggtcaacagaggagagaccacatggcaagtcggaacctggcggcagcgcaaaagatg

SEQ ID NO: 187641 - DNA, 103 bp, Artificial Sequence
  Synthetic Polynucleotide
taatacgactcactatagggcactgtcagacatgccattgacccgacttgaacagaggagacaagtcatgtcaatggcaaacctggcggcagcgcaaaagatg

SEQ ID NO: 187642 - DNA, 103 bp, Artificial Sequence
  Synthetic Polynucleotide
taatacgactcactatagggtcactgagggcactgtcagacatgccattgaacagaggagacaatggatggtctgacagaacctggcggcagcgcaaaagatg

SEQ ID NO: 187643 - DNA, 103 bp, Artificial Sequence
  Synthetic Polynucleotide
taatacgactcactataggggtgaatggagtcactgagggcactgtcagaaacagaggagatctgacatggccctcagtaacctggcggcagcgcaaaagatg

SEQ ID NO: 187644 - DNA, 103 bp, Artificial Sequence
  Synthetic Polynucleotide
taatacgactcactatagggtggccacagtgtgaatggagtcactgagggaacagaggagaccctcaatgactccattcaacctggcggcagcgcaaaagatg

SEQ ID NO: 187645 - DNA, 103 bp, Artificial Sequence
  Synthetic Polynucleotide
taatacgactcactatagggttggtgctcatggccacagtgtgaatggagaacagaggagactccatatgcactgtggcaacctggcggcagcgcaaaagatg

SEQ ID NO: 187646 - DNA, 103 bp, Artificial Sequence
  Synthetic Polynucleotide
taatacgactcactataggggcttacagagttggtgctcatggccacagtaacagaggagaactgtgatgatgagcaccaacctggcggcagcgcaaaagatg

SEQ ID NO: 187647 - DNA, 103 bp, Artificial Sequence
  Synthetic Polynucleotide
taatacgactcactatagggagagtgccacgcttacagagttggtgctcaaacagaggagatgagcaatgactctgtaaaacctggcggcagcgcaaaagatg

SEQ ID NO: 187648 - DNA, 103 bp, Artificial Sequence
  Synthetic Polynucleotide
taatacgactcactataggggccaatcccaggtgacttcctgagactggcaacagaggagagccagtatgaggaagtcaaacctggcggcagcgcaaaagatg

SEQ ID NO: 187649 - DNA, 103 bp, Artificial Sequence
  Synthetic Polynucleotide
taatacgactcactatagggtgtgaggtagagagtgccacgcttacagagaacagaggagactctgtatgcgtggcactaacctggcggcagcgcaaaagatg

SEQ ID NO: 187650 - DNA, 103 bp, Artificial Sequence
  Synthetic Polynucleotide
taatacgactcactatagggggcaaggttgtgtgaggtagagagtgccacaacagaggagagtggcaatgtctacctcaaacctggcggcagcgcaaaagatg

SEQ ID NO: 187651 - DNA, 103 bp, Artificial Sequence
  Synthetic Polynucleotide
taatacgactcactatagggattctagggaggcaaggttgtgtgaggtagaacagaggagactacctatgacaaccttgaacctggcggcagcgcaaaagatg

SEQ ID NO: 187652 - DNA, 103 bp, Artificial Sequence
  Synthetic Polynucleotide
taatacgactcactatagggagggaaacagattctagggaggcaaggttgaacagaggagacaacctatgctccctagaaacctggcggcagcgcaaaagatg

SEQ ID NO: 187653 - DNA, 103 bp, Artificial Sequence
  Synthetic Polynucleotide
taatacgactcactatagggaacttcatggagggaaacagattctagggaaacagaggagatccctaatgtctgtttccaacctggcggcagcgcaaaagatg

SEQ ID NO: 187654 - DNA, 103 bp, Artificial Sequence
  Synthetic Polynucleotide
taatacgactcactatagggggctgaggccaacttcatggagggaaacagaacagaggagactgtttatgtccatgaagaacctggcggcagcgcaaaagatg

SEQ ID NO: 187655 - DNA, 103 bp, Artificial Sequence
  Synthetic Polynucleotide
taatacgactcactatagggacaggttctaggctgaggccaacttcatggaacagaggagaccatgaatgtggcctcagaacctggcggcagcgcaaaagatg

SEQ ID NO: 187656 - DNA, 103 bp, Artificial Sequence
  Synthetic Polynucleotide
taatacgactcactatagggggagacagccacaggttctaggctgaggccaacagaggagaggcctcatgctagaacctaacctggcggcagcgcaaaagatg

SEQ ID NO: 187657 - DNA, 103 bp, Artificial Sequence
  Synthetic Polynucleotide
taatacgactcactataggggggtgatggaggagacagccacaggttctaaacagaggagatagaacatgtggctgtctaacctggcggcagcgcaaaagatg

SEQ ID NO: 187658 - DNA, 103 bp, Artificial Sequence
  Synthetic Polynucleotide
taatacgactcactataggggcaacctcctgggtgatggaggagacagccaacagaggagaggctgtatgctccatcacaacctggcggcagcgcaaaagatg

SEQ ID NO: 187659 - DNA, 103 bp, Artificial Sequence
  Synthetic Polynucleotide
taatacgactcactataggggaacctgtccggcacgtacatgcccagcataacagaggagaatgctgatgatgtacgtgaacctggcggcagcgcaaaagatg

SEQ ID NO: 187660 - DNA, 103 bp, Artificial Sequence
  Synthetic Polynucleotide
taatacgactcactatagggtccagcaaagggtccgaacttttcacccttaacagaggagaaagggtatgaagttcggaaacctggcggcagcgcaaaagatg

SEQ ID NO: 187661 - DNA, 103 bp, Artificial Sequence
  Synthetic Polynucleotide
taatacgactcactataggggatcatatgacgttttagctgattagctgaaacagaggagatcagctatgcagctaaaaaacctggcggcagcgcaaaagatg

SEQ ID NO: 187662 - DNA, 103 bp, Artificial Sequence
  Synthetic Polynucleotide
taatacgactcactatagggctgagtgggtgatcatatgacgttttagctaacagaggagaagctaaatggtcatatgaaacctggcggcagcgcaaaagatg

SEQ ID NO: 187663 - DNA, 103 bp, Artificial Sequence
  Synthetic Polynucleotide
taatacgactcactatagggggtcgtttttctgagtgggtgatcatatgaaacagaggagatcatatatgcacccactcaacctggcggcagcgcaaaagatg

SEQ ID NO: 187664 - DNA, 103 bp, Artificial Sequence
  Synthetic Polynucleotide
taatacgactcactataggggcaattatagggtcgtttttctgagtgggtaacagaggagaacccacatggaaaaacgaaacctggcggcagcgcaaaagatg

SEQ ID NO: 187665 - DNA, 103 bp, Artificial Sequence
  Synthetic Polynucleotide
taatacgactcactatagggtacaaatctcgcaattatagggtcgtttttaacagaggagaaaaaacatgcctataattaacctggcggcagcgcaaaagatg

SEQ ID NO: 187666 - DNA, 103 bp, Artificial Sequence
  Synthetic Polynucleotide
taatacgactcactatagggaaagacttattacaaatctcgcaattatagaacagaggagactataaatgcgagatttgaacctggcggcagcgcaaaagatg

SEQ ID NO: 187667 - DNA, 103 bp, Artificial Sequence
  Synthetic Polynucleotide
taatacgactcactatagggaagcctcttgaaagacttattacaaatctcaacagaggagagagattatgaataagtctaacctggcggcagcgcaaaagatg

SEQ ID NO: 187668 - DNA, 103 bp, Artificial Sequence
  Synthetic Polynucleotide
taatacgactcactatagggccacttgatcaagcctcttgaaagacttataacagaggagaataagtatgtcaagaggcaacctggcggcagcgcaaaagatg

SEQ ID NO: 187669 - DNA, 103 bp, Artificial Sequence
  Synthetic Polynucleotide
taatacgactcactatagggttgtgagcacccacttgatcaagcctcttgaacagaggagacaagagatgtgatcaagtaacctggcggcagcgcaaaagatg

SEQ ID NO: 187670 - DNA, 103 bp, Artificial Sequence
  Synthetic Polynucleotide
taatacgactcactataggggtgtattactttgtgagcacccacttgatcaacagaggagagatcaaatgggtgctcacaacctggcggcagcgcaaaagatg

SEQ ID NO: 187671 - DNA, 103 bp, Artificial Sequence
  Synthetic Polynucleotide
taatacgactcactatagggttctcttctctccagcaaagggtccgaactaacagaggagaagttcgatgcctttgctgaacctggcggcagcgcaaaagatg

SEQ ID NO: 187672 - DNA, 103 bp, Artificial Sequence
  Synthetic Polynucleotide
taatacgactcactatagggtgtcttcgctgtgtattactttgtgagcacaacagaggagagtgctcatgaagtaatacaacctggcggcagcgcaaaagatg

SEQ ID NO: 187673 - DNA, 103 bp, Artificial Sequence
  Synthetic Polynucleotide
taatacgactcactatagggttgtaaggtttgtcttcgctgtgtattactaacagaggagaagtaatatgcagcgaagaaacctggcggcagcgcaaaagatg

SEQ ID NO: 187674 - DNA, 103 bp, Artificial Sequence
  Synthetic Polynucleotide
taatacgactcactatagggaagtttgcatttgtaaggtttgtcttcgctaacagaggagaagcgaaatgaaaccttacaacctggcggcagcgcaaaagatg

SEQ ID NO: 187675 - DNA, 103 bp, Artificial Sequence
  Synthetic Polynucleotide
taatacgactcactatagggcctttccacaaagtttgcatttgtaaggttaacagaggagaaaccttatgaatgcaaacaacctggcggcagcgcaaaagatg

SEQ ID NO: 187676 - DNA, 103 bp, Artificial Sequence
  Synthetic Polynucleotide
taatacgactcactatagggtgggcaaatccctttccacaaagtttgcataacagaggagaatgcaaatgttgtggaaaaacctggcggcagcgcaaaagatg

SEQ ID NO: 187677 - DNA, 103 bp, Artificial Sequence
  Synthetic Polynucleotide
taatacgactcactatagggaacatttctgtgggcaaatccctttccacaaacagaggagatgtggaatgggatttgccaacctggcggcagcgcaaaagatg

SEQ ID NO: 187678 - DNA, 103 bp, Artificial Sequence
  Synthetic Polynucleotide
taatacgactcactataggggattcttgtaaacatttctgtgggcaaatcaacagaggagagatttgatgacagaaatgaacctggcggcagcgcaaaagatg

SEQ ID NO: 187679 - DNA, 103 bp, Artificial Sequence
  Synthetic Polynucleotide
taatacgactcactataggggtcttcttatgattcttgtaaacatttctgaacagaggagacagaaaatgttacaagaaaacctggcggcagcgcaaaagatg

SEQ ID NO: 187680 - DNA, 103 bp, Artificial Sequence
  Synthetic Polynucleotide
taatacgactcactatagggctcagagtgggtcttcttatgattcttgtaaacagaggagatacaagatgcataagaagaacctggcggcagcgcaaaagatg

SEQ ID NO: 187681 - DNA, 103 bp, Artificial Sequence
  Synthetic Polynucleotide
taatacgactcactatagggacggtctctcctcagagtgggtcttcttataacagaggagaataagaatgcccactctgaacctggcggcagcgcaaaagatg

SEQ ID NO: 187682 - DNA, 103 bp, Artificial Sequence
  Synthetic Polynucleotide
taatacgactcactatagggtcttcaggcattctcttctctccagcaaagaacagaggagactttgcatgagagaagagaacctggcggcagcgcaaaagatg

SEQ ID NO: 187683 - DNA, 103 bp, Artificial Sequence
  Synthetic Polynucleotide
taatacgactcactatagggtcacattggaacggtctctcctcagagtggaacagaggagaccactcatgggagagaccaacctggcggcagcgcaaaagatg

SEQ ID NO: 187684 - DNA, 103 bp, Artificial Sequence
  Synthetic Polynucleotide
taatacgactcactatagggtttacattcttcacattggaacggtctctcaacagaggagagagagaatgttccaatgtaacctggcggcagcgcaaaagatg

SEQ ID NO: 187685 - DNA, 103 bp, Artificial Sequence
  Synthetic Polynucleotide
taatacgactcactatagggggaacaaagctttacattcttcacattggaaacagaggagatccaatatgaagaatgtaaacctggcggcagcgcaaaagatg

SEQ ID NO: 187686 - DNA, 103 bp, Artificial Sequence
  Synthetic Polynucleotide
taatacgactcactatagggaatggggtccggaacaaagctttacattctaacagaggagaagaatgatgagctttgttaacctggcggcagcgcaaaagatg

SEQ ID NO: 187687 - DNA, 103 bp, Artificial Sequence
  Synthetic Polynucleotide
taatacgactcactatagggctgtaaagaaaatggggtccggaacaaagcaacagaggagagctttgatgcggaccccaaacctggcggcagcgcaaaagatg

SEQ ID NO: 187688 - DNA, 103 bp, Artificial Sequence
  Synthetic Polynucleotide
taatacgactcactataggggcaggtgtctctgtaaagaaaatggggtccaacagaggagaggacccatgtttctttacaacctggcggcagcgcaaaagatg

SEQ ID NO: 187689 - DNA, 103 bp, Artificial Sequence
  Synthetic Polynucleotide
taatacgactcactatagggttatgtattagcaggtgtctctgtaaagaaaacagaggagattctttatggagacacctaacctggcggcagcgcaaaagatg

SEQ ID NO: 187690 - DNA, 103 bp, Artificial Sequence
  Synthetic Polynucleotide
taatacgactcactatagggcctctcactgttatgtattagcaggtgtctaacagaggagaagacacatgctaatacataacctggcggcagcgcaaaagatg

SEQ ID NO: 187691 - DNA, 103 bp, Artificial Sequence
  Synthetic Polynucleotide
taatacgactcactatagggacttgaaagtcctctcactgttatgtattaaacagaggagataatacatgacagtgagaaacctggcggcagcgcaaaagatg

SEQ ID NO: 187692 - DNA, 103 bp, Artificial Sequence
  Synthetic Polynucleotide
taatacgactcactatagggcagtgatggcacttgaaagtcctctcactgaacagaggagacagtgaatggactttcaaaacctggcggcagcgcaaaagatg

SEQ ID NO: 187693 - DNA, 103 bp, Artificial Sequence
  Synthetic Polynucleotide
taatacgactcactatagggttcatccaagtcttcaggcattctcttctcaacagaggagagagaagatgatgcctgaaaacctggcggcagcgcaaaagatg

SEQ ID NO: 187694 - DNA, 103 bp, Artificial Sequence
  Synthetic Polynucleotide
taatacgactcactatagggggtagcatcgcagtgatggcacttgaaagtaacagaggagaactttcatgtgccatcacaacctggcggcagcgcaaaagatg

SEQ ID NO: 187695 - DNA, 103 bp, Artificial Sequence
  Synthetic Polynucleotide
taatacgactcactatagggtcctcttaaaggtagcatcgcagtgatggcaacagaggagagccatcatggcgatgctaaacctggcggcagcgcaaaagatg

SEQ ID NO: 187696 - DNA, 103 bp, Artificial Sequence
  Synthetic Polynucleotide
taatacgactcactatagggaatgtatccttcctcttaaaggtagcatcgaacagaggagacgatgcatgctttaagagaacctggcggcagcgcaaaagatg

SEQ ID NO: 187697 - DNA, 103 bp, Artificial Sequence
  Synthetic Polynucleotide
taatacgactcactatagggatgaacatttaatgtatccttcctcttaaaaacagaggagatttaagatgaaggatacaaacctggcggcagcgcaaaagatg

SEQ ID NO: 187698 - DNA, 103 bp, Artificial Sequence
  Synthetic Polynucleotide
taatacgactcactatagggccacctggacatgaacatttaatgtatcctaacagaggagaaggataatgtaaatgttcaacctggcggcagcgcaaaagatg

SEQ ID NO: 187699 - DNA, 103 bp, Artificial Sequence
  Synthetic Polynucleotide
taatacgactcactatagggctttcatgaaccacctggacatgaacatttaacagaggagaaaatgtatgtgtccaggtaacctggcggcagcgcaaaagatg

SEQ ID NO: 187700 - DNA, 103 bp, Artificial Sequence
  Synthetic Polynucleotide
taatacgactcactatagggcttcttgtgtctttcatgaaccacctggacaacagaggagagtccagatggttcatgaaaacctggcggcagcgcaaaagatg

SEQ ID NO: 187701 - DNA, 103 bp, Artificial Sequence
  Synthetic Polynucleotide
taatacgactcactatagggcacacctatacttcttgtgtctttcatgaaaacagaggagattcatgatggacacaagaaacctggcggcagcgcaaaagatg

SEQ ID NO: 187702 - DNA, 103 bp, Artificial Sequence
  Synthetic Polynucleotide
taatacgactcactatagggttacatagctcacacctatacttcttgtgtaacagaggagaacacaaatggtataggtgaacctggcggcagcgcaaaagatg

SEQ ID NO: 187703 - DNA, 103 bp, Artificial Sequence
  Synthetic Polynucleotide
taatacgactcactatagggaaaggccttattacatagctcacacctataaacagaggagatataggatggagctatgtaacctggcggcagcgcaaaagatg

SEQ ID NO: 187704 - DNA, 103 bp, Artificial Sequence
  Synthetic Polynucleotide
taatacgactcactatagggaatccatattttcatccaagtcttcaggcaaacagaggagatgcctgatgacttggatgaacctggcggcagcgcaaaagatg

SEQ ID NO: 187705 - DNA, 103 bp, Artificial Sequence
  Synthetic Polynucleotide
taatacgactcactatagggaaggtgtaacaaaggccttattacatagctaacagaggagaagctatatgataaggcctaacctggcggcagcgcaaaagatg

SEQ ID NO: 187706 - DNA, 103 bp, Artificial Sequence
  Synthetic Polynucleotide
taatacgactcactatagggctaagcactgaaggtgtaacaaaggccttaaacagaggagataaggcatgtgttacaccaacctggcggcagcgcaaaagatg

SEQ ID NO: 187707 - DNA, 103 bp, Artificial Sequence
  Synthetic Polynucleotide
taatacgactcactatagggcttatgacttctaagcactgaaggtgtaacaacagaggagagttacaatgtcagtgcttaacctggcggcagcgcaaaagatg

SEQ ID NO: 187708 - DNA, 103 bp, Artificial Sequence
  Synthetic Polynucleotide
taatacgactcactatagggtatgtgttttcttatgacttctaagcactgaacagaggagacagtgcatggaagtcataaacctggcggcagcgcaaaagatg

SEQ ID NO: 187709 - DNA, 103 bp, Artificial Sequence
  Synthetic Polynucleotide
taatacgactcactatagggttttctcctgtatgtgttttcttatgacttaacagaggagaaagtcaatggaaaacacaaacctggcggcagcgcaaaagatg

SEQ ID NO: 187710 - DNA, 103 bp, Artificial Sequence
  Synthetic Polynucleotide
taatacgactcactataggggattttctccttttctcctgtatgtgttttaacagaggagaaaaacaatgacaggagaaaacctggcggcagcgcaaaagatg

SEQ ID NO: 187711 - DNA, 103 bp, Artificial Sequence
  Synthetic Polynucleotide
taatacgactcactatagggaatatggacagattttctccttttctcctgaacagaggagacaggagatgaggagaaaaaacctggcggcagcgcaaaagatg

SEQ ID NO: 187712 - DNA, 103 bp, Artificial Sequence
  Synthetic Polynucleotide
taatacgactcactatagggttctggccacaatatggacagattttctccaacagaggagaggagaaatgctgtccataaacctggcggcagcgcaaaagatg

SEQ ID NO: 187713 - DNA, 103 bp, Artificial Sequence
  Synthetic Polynucleotide
taatacgactcactataggggctggcaaatttctggccacaatatggacaaacagaggagatgtccaatgtgtggccagaacctggcggcagcgcaaaagatg

SEQ ID NO: 187714 - DNA, 103 bp, Artificial Sequence
  Synthetic Polynucleotide
taatacgactcactataggggtgtaccactgctggcaaatttctggccacaacagaggagagtggccatgaatttgccaaacctggcggcagcgcaaaagatg

SEQ ID NO: 187715 - DNA, 103 bp, Artificial Sequence
  Synthetic Polynucleotide
taatacgactcactatagggatcaacctgtaatccatattttcatccaagaacagaggagacttggaatgaaatatggaaacctggcggcagcgcaaaagatg

SEQ ID NO: 187716 - DNA, 103 bp, Artificial Sequence
  Synthetic Polynucleotide
taatacgactcactatagggtgaactctgagtgtaccactgctggcaaataacagaggagaatttgcatgcagtggtacaacctggcggcagcgcaaaagatg

SEQ ID NO: 187717 - DNA, 103 bp, Artificial Sequence
  Synthetic Polynucleotide
taatacgactcactataggggctccggatatgaactctgagtgtaccactaacagaggagaagtggtatgctcagagttaacctggcggcagcgcaaaagatg

SEQ ID NO: 187718 - DNA, 103 bp, Artificial Sequence
  Synthetic Polynucleotide
taatacgactcactatagggcacctgtgtggctccggatatgaactctgaaacagaggagatcagagatgatatccggaaacctggcggcagcgcaaaagatg

SEQ ID NO: 187719 - DNA, 103 bp, Artificial Sequence
  Synthetic Polynucleotide
taatacgactcactatagggtagggacgctcacctgtgtggctccggataaacagaggagatatccgatgccacacaggaacctggcggcagcgcaaaagatg

SEQ ID NO: 187720 - DNA, 103 bp, Artificial Sequence
  Synthetic Polynucleotide
taatacgactcactatagggaggacattgatagggacgctcacctgtgtgaacagaggagacacacaatggagcgtcccaacctggcggcagcgcaaaagatg

SEQ ID NO: 187721 - DNA, 103 bp, Artificial Sequence
  Synthetic Polynucleotide
taatacgactcactatagggtttcacagtaaggacattgatagggacgctaacagaggagaagcgtcatgatcaatgtcaacctggcggcagcgcaaaagatg

SEQ ID NO: 187722 - DNA, 103 bp, Artificial Sequence
  Synthetic Polynucleotide
taatacgactcactatagggctgaatcctttttcacagtaaggacattgaaacagaggagatcaatgatgttactgtgaaacctggcggcagcgcaaaagatg

SEQ ID NO: 187723 - DNA, 103 bp, Artificial Sequence
  Synthetic Polynucleotide
taatacgactcactatagggatcatttttactgaatcctttttcacagtaaacagaggagatactgtatgaaaggattcaacctggcggcagcgcaaaagatg

SEQ ID NO: 187724 - DNA, 103 bp, Artificial Sequence
  Synthetic Polynucleotide
taatacgactcactatagggtcttcagtccatcatttttactgaatccttaacagaggagaaaggatatggtaaaaatgaacctggcggcagcgcaaaagatg

SEQ ID NO: 187725 - DNA, 103 bp, Artificial Sequence
  Synthetic Polynucleotide
taatacgactcactatagggcgaatgtgcatcttcagtccatcatttttaaacagaggagataaaaaatgtggactgaaaacctggcggcagcgcaaaagatg

SEQ ID NO: 187726 - DNA, 103 bp, Artificial Sequence
  Synthetic Polynucleotide
taatacgactcactatagggaacctcccacatcaacctgtaatccatattaacagaggagaaatatgatgtacaggttgaacctggcggcagcgcaaaagatg

SEQ ID NO: 187727 - DNA, 103 bp, Artificial Sequence
  Synthetic Polynucleotide
taatacgactcactatagggggtgtgagtacgaatgtgcatcttcagtccaacagaggagaggactgatgatgcacattaacctggcggcagcgcaaaagatg

SEQ ID NO: 187728 - DNA, 103 bp, Artificial Sequence
  Synthetic Polynucleotide
taatacgactcactataggggcttctccctggtgtgagtacgaatgtgcaaacagaggagatgcacaatggtactcacaaacctggcggcagcgcaaaagatg

SEQ ID NO: 187729 - DNA, 103 bp, Artificial Sequence
  Synthetic Polynucleotide
taatacgactcactatagggcacttgtacggcttctccctggtgtgagtaaacagaggagatactcaatgcagggagaaaacctggcggcagcgcaaaagatg

SEQ ID NO: 187730 - DNA, 103 bp, Artificial Sequence
  Synthetic Polynucleotide
taatacgactcactataggggcactctgagcacttgtacggcttctccctaacagaggagaagggagatgccgtacaagaacctggcggcagcgcaaaagatg

SEQ ID NO: 187731 - DNA, 103 bp, Artificial Sequence
  Synthetic Polynucleotide
taatacgactcactatagggaggccttgctgcactctgagcacttgtacgaacagaggagacgtacaatggctcagagtaacctggcggcagcgcaaaagatg

SEQ ID NO: 187732 - DNA, 103 bp, Artificial Sequence
  Synthetic Polynucleotide
taatacgactcactatagggttctggctgaaggccttgctgcactctgagaacagaggagactcagaatgcagcaaggcaacctggcggcagcgcaaaagatg

SEQ ID NO: 187733 - DNA, 103 bp, Artificial Sequence
  Synthetic Polynucleotide
taatacgactcactatagggcaggcctcgcttctggctgaaggccttgctaacagaggagaagcaagatgttcagccagaacctggcggcagcgcaaaagatg

SEQ ID NO: 187734 - DNA, 103 bp, Artificial Sequence
  Synthetic Polynucleotide
taatacgactcactatagggtgtgctcatccaggcctcgcttctggctgaaacagaggagatcagccatgagcgaggccaacctggcggcagcgcaaaagatg

SEQ ID NO: 187735 - DNA, 103 bp, Artificial Sequence
  Synthetic Polynucleotide
taatacgactcactatagggtgcgtcctcttgtgctcatccaggcctcgcaacagaggagagcgaggatgggatgagcaaacctggcggcagcgcaaaagatg

SEQ ID NO: 187736 - DNA, 103 bp, Artificial Sequence
  Synthetic Polynucleotide
taatacgactcactatagggttctccagtgtgcgtcctcttgtgctcatcaacagaggagagatgagatgaagaggacgaacctggcggcagcgcaaaagatg

SEQ ID NO: 187737 - DNA, 103 bp, Artificial Sequence
  Synthetic Polynucleotide
taatacgactcactatagggtactcccacgaacctcccacatcaacctgtaacagaggagaacaggtatgtgtgggaggaacctggcggcagcgcaaaagatg

SEQ ID NO: 187738 - DNA, 103 bp, Artificial Sequence
  Synthetic Polynucleotide
taatacgactcactataggggaaaaggcttttctccagtgtgcgtcctctaacagaggagaagaggaatgacactggagaacctggcggcagcgcaaaagatg

SEQ ID NO: 187739 - DNA, 103 bp, Artificial Sequence
  Synthetic Polynucleotide
taatacgactcactatagggacatcacactgaaaaggcttttctccagtgaacagaggagacactggatgaaagcctttaacctggcggcagcgcaaaagatg

SEQ ID NO: 187740 - DNA, 103 bp, Artificial Sequence
  Synthetic Polynucleotide
taatacgactcactatagggcaaatcacaaacatcacactgaaaaggcttaacagaggagaaagcctatgcagtgtgataacctggcggcagcgcaaaagatg

SEQ ID NO: 187741 - DNA, 103 bp, Artificial Sequence
  Synthetic Polynucleotide
taatacgactcactatagggggctaaaagccaaatcacaaacatcacactaacagaggagaagtgtgatgtttgtgattaacctggcggcagcgcaaaagatg

SEQ ID NO: 187742 - DNA, 103 bp, Artificial Sequence
  Synthetic Polynucleotide
taatacgactcactatagggattttcttcaggctaaaagccaaatcacaaaacagaggagattgtgaatgggcttttagaacctggcggcagcgcaaaagatg

SEQ ID NO: 187743 - DNA, 103 bp, Artificial Sequence
  Synthetic Polynucleotide
taatacgactcactatagggtcgaatcagcattttcttcaggctaaaagcaacagaggagagcttttatgctgaagaaaaacctggcggcagcgcaaaagatg

SEQ ID NO: 187744 - DNA, 103 bp, Artificial Sequence
  Synthetic Polynucleotide
taatacgactcactatagggtcatcttgtgtcgaatcagcattttcttcaaacagaggagatgaagaatgtgctgattcaacctggcggcagcgcaaaagatg

SEQ ID NO: 187745 - DNA, 103 bp, Artificial Sequence
  Synthetic Polynucleotide
taatacgactcactatagggggattatgagtcatcttgtgtcgaatcagcaacagaggagagctgatatgacacaagataacctggcggcagcgcaaaagatg

SEQ ID NO: 187746 - DNA, 103 bp, Artificial Sequence
  Synthetic Polynucleotide
taatacgactcactataggggggacgattgggattatgagtcatcttgtgaacagaggagacacaagatgactcataataacctggcggcagcgcaaaagatg

SEQ ID NO: 187747 - DNA, 103 bp, Artificial Sequence
  Synthetic Polynucleotide
taatacgactcactatagggattctgccaggggacgattgggattatgagaacagaggagactcataatgccaatcgtcaacctggcggcagcgcaaaagatg

SEQ ID NO: 187748 - DNA, 103 bp, Artificial Sequence
  Synthetic Polynucleotide
taatacgactcactatagggacttctcccttactcccacgaacctcccacaacagaggagagtgggaatgtcgtgggagaacctggcggcagcgcaaaagatg

SEQ ID NO: 187749 - DNA, 103 bp, Artificial Sequence
  Synthetic Polynucleotide
taatacgactcactatagggcaaaactggcattctgccaggggacgattgaacagaggagacaatcgatgcctggcagaaacctggcggcagcgcaaaagatg

SEQ ID NO: 187750 - DNA, 103 bp, Artificial Sequence
  Synthetic Polynucleotide
taatacgactcactatagggcttcttatggcaaaactggcattctgccagaacagaggagactggcaatgtgccagtttaacctggcggcagcgcaaaagatg

SEQ ID NO: 187751 - DNA, 103 bp, Artificial Sequence
  Synthetic Polynucleotide
taatacgactcactatagggtccttgtaaacttcttatggcaaaactggcaacagaggagagccagtatggccataagaaacctggcggcagcgcaaaagatg

SEQ ID NO: 187752 - DNA, 103 bp, Artificial Sequence
  Synthetic Polynucleotide
taatacgactcactatagggaggtagtcattccttgtaaacttcttatggaacagaggagaccataaatggtttacaagaacctggcggcagcgcaaaagatg

SEQ ID NO: 187753 - DNA, 103 bp, Artificial Sequence
  Synthetic Polynucleotide
taatacgactcactataggggtgcactttgaggtagtcattccttgtaaaaacagaggagatttacaatgaatgactacaacctggcggcagcgcaaaagatg

SEQ ID NO: 187754 - DNA, 103 bp, Artificial Sequence
  Synthetic Polynucleotide
taatacgactcactatagggtattgtccatgtgcactttgaggtagtcataacagaggagaatgactatgtcaaagtgcaacctggcggcagcgcaaaagatg

SEQ ID NO: 187755 - DNA, 103 bp, Artificial Sequence
  Synthetic Polynucleotide
taatacgactcactatagggacaccatggatattgtccatgtgcactttgaacagaggagacaaagtatgcatggacaaaacctggcggcagcgcaaaagatg

SEQ ID NO: 187756 - DNA, 103 bp, Artificial Sequence
  Synthetic Polynucleotide
taatacgactcactataggggctgtcagctacaccatggatattgtccataacagaggagaatggacatgatccatggtaacctggcggcagcgcaaaagatg

SEQ ID NO: 187757 - DNA, 103 bp, Artificial Sequence
  Synthetic Polynucleotide
taatacgactcactatagggaatgtacaaaacttctcccttactcccacgaacagaggagacgtgggatgaagggagaaaacctggcggcagcgcaaaagatg

SEQ ID NO: 187758 - DNA, 103 bp, Artificial Sequence
  Synthetic Polynucleotide
taatacgactcactatagggacttcagggagaacctgtccggcacgtacaaacagaggagatgtacgatgcggacaggtaacctggcggcagcgcaaaagatg

SEQ ID NO: 187759 - DNA, 103 bp, Artificial Sequence
  Synthetic Polynucleotide
taatacgactcactatagggtagcatccaaaatgtacaaaacttctccctaacagaggagaagggagatgttttgtacaaacctggcggcagcgcaaaagatg

SEQ ID NO: 187760 - DNA, 103 bp, Artificial Sequence
  Synthetic Polynucleotide
taatacgactcactatagggcgtgggttggtagcatccaaaatgtacaaaaacagaggagatttgtaatgtttggatgcaacctggcggcagcgcaaaagatg

SEQ ID NO: 187761 - DNA, 103 bp, Artificial Sequence
  Synthetic Polynucleotide
taatacgactcactataggggttggagtgccgtgggttggtagcatccaaaacagaggagattggatatgaccaacccaaacctggcggcagcgcaaaagatg

SEQ ID NO: 187762 - DNA, 103 bp, Artificial Sequence
  Synthetic Polynucleotide
taatacgactcactatagggagcgaagccagttggagtgccgtgggttggaacagaggagaccaaccatgggcactccaaacctggcggcagcgcaaaagatg

SEQ ID NO: 187763 - DNA, 103 bp, Artificial Sequence
  Synthetic Polynucleotide
taatacgactcactatagggtcatgaacgaagcgaagccagttggagtgcaacagaggagagcactcatgctggcttcgaacctggcggcagcgcaaaagatg

SEQ ID NO: 187764 - DNA, 103 bp, Artificial Sequence
  Synthetic Polynucleotide
taatacgactcactatagggagatggtgcctcatgaacgaagcgaagccaaacagaggagatggcttatgttcgttcataacctggcggcagcgcaaaagatg

SEQ ID NO: 187765 - DNA, 103 bp, Artificial Sequence
  Synthetic Polynucleotide
taatacgactcactatagggtctgctcctgagatggtgcctcatgaacgaaacagaggagatcgttcatgaggcaccataacctggcggcagcgcaaaagatg

SEQ ID NO: 187766 - DNA, 103 bp, Artificial Sequence
  Synthetic Polynucleotide
taatacgactcactataggggccaagttcttctgctcctgagatggtgccaacagaggagaggcaccatgtcaggagcaaacctggcggcagcgcaaaagatg

SEQ ID NO: 187767 - DNA, 103 bp, Artificial Sequence
  Synthetic Polynucleotide
taatacgactcactatagggttgaatggcagccaagttcttctgctcctgaacagaggagacaggagatgaagaacttgaacctggcggcagcgcaaaagatg

SEQ ID NO: 187768 - DNA, 103 bp, Artificial Sequence
  Synthetic Polynucleotide
taatacgactcactatagggtttctccttcttgaatggcagccaagttctaacagaggagaagaactatgctgccattcaacctggcggcagcgcaaaagatg

SEQ ID NO: 187769 - DNA, 103 bp, Artificial Sequence
  Synthetic Polynucleotide
taatacgactcactatagggacccgggaggacttcagggagaacctgtccaacagaggagaggacagatgctccctgaaaacctggcggcagcgcaaaagatg

SEQ ID NO: 187770 - DNA, 103 bp, Artificial Sequence
  Synthetic Polynucleotide
taatacgactcactatagggtagaaaatgttttctccttcttgaatggcaaacagaggagatgccatatgagaaggagaaacctggcggcagcgcaaaagatg

SEQ ID NO: 187771 - DNA, 103 bp, Artificial Sequence
  Synthetic Polynucleotide
taatacgactcactatagggaactgccaaatagaaaatgttttctccttcaacagaggagagaaggaatgaacattttcaacctggcggcagcgcaaaagatg

SEQ ID NO: 187772 - DNA, 103 bp, Artificial Sequence
  Synthetic Polynucleotide
taatacgactcactatagggctatatcttcaactgccaaatagaaaatgtaacagaggagaacatttatgatttggcagaacctggcggcagcgcaaaagatg

SEQ ID NO: 187773 - DNA, 103 bp, Artificial Sequence
  Synthetic Polynucleotide
taatacgactcactataggggtgtctgtttctatatcttcaactgccaaaaacagaggagatttggcatgtgaagatataacctggcggcagcgcaaaagatg

SEQ ID NO: 187774 - DNA, 103 bp, Artificial Sequence
  Synthetic Polynucleotide
taatacgactcactatagggcagaagctccgtgtctgtttctatatcttcaacagaggagagaagatatggaaacagacaacctggcggcagcgcaaaagatg

SEQ ID NO: 187775 - DNA, 103 bp, Artificial Sequence
  Synthetic Polynucleotide
taatacgactcactatagggggtagccaatcagaagctccgtgtctgtttaacagaggagaaaacagatgcggagcttcaacctggcggcagcgcaaaagatg

SEQ ID NO: 187776 - DNA, 103 bp, Artificial Sequence
  Synthetic Polynucleotide
taatacgactcactatagggtcactatccaggtagccaatcagaagctccaacagaggagaggagctatggattggctaaacctggcggcagcgcaaaagatg

SEQ ID NO: 187777 - DNA, 103 bp, Artificial Sequence
  Synthetic Polynucleotide
taatacgactcactatagggagcctccatgtcactatccaggtagccaataacagaggagaattggcatgctggatagtaacctggcggcagcgcaaaagatg

SEQ ID NO: 187778 - DNA, 103 bp, Artificial Sequence
  Synthetic Polynucleotide
taatacgactcactatagggcttcctcctcagcctccatgtcactatccaaacagaggagatggataatgacatggaggaacctggcggcagcgcaaaagatg

SEQ ID NO: 187779 - DNA, 103 bp, Artificial Sequence
  Synthetic Polynucleotide
taatacgactcactatagggatttgctgttcttcctcctcagcctccatgaacagaggagacatggaatgtgaggaggaaacctggcggcagcgcaaaagatg

SEQ ID NO: 187780 - DNA, 103 bp, Artificial Sequence
  Synthetic Polynucleotide
taatacgactcactataggggccgtcctgaacccgggaggacttcagggaaacagaggagatccctgatgtcctcccggaacctggcggcagcgcaaaagatg

SEQ ID NO: 187781 - DNA, 103 bp, Artificial Sequence
  Synthetic Polynucleotide
taatacgactcactataggggactgtcataatttgctgttcttcctcctcaacagaggagagaggagatggaacagcaaaacctggcggcagcgcaaaagatg

SEQ ID NO: 187782 - DNA, 103 bp, Artificial Sequence
  Synthetic Polynucleotide
taatacgactcactatagggcttctttgatgactgtcataatttgctgttaacagaggagaaacagcatgttatgacagaacctggcggcagcgcaaaagatg

SEQ ID NO: 187783 - DNA, 103 bp, Artificial Sequence
  Synthetic Polynucleotide
taatacgactcactatagggtcaacttccccttctttgatgactgtcataaacagaggagatatgacatgcatcaaagaaacctggcggcagcgcaaaagatg

SEQ ID NO: 187784 - DNA, 103 bp, Artificial Sequence
  Synthetic Polynucleotide
taatacgactcactatagggtctagaattttcaacttccccttctttgataacagaggagaatcaaaatgggggaagttaacctggcggcagcgcaaaagatg

SEQ ID NO: 187785 - DNA, 103 bp, Artificial Sequence
  Synthetic Polynucleotide
taatacgactcactatagggttgattgtcttctagaattttcaacttcccaacagaggagagggaagatgaaaattctaaacctggcggcagcgcaaaagatg

SEQ ID NO: 187786 - DNA, 103 bp, Artificial Sequence
  Synthetic Polynucleotide
taatacgactcactatagggctgcccgctgttgattgtcttctagaatttaacagaggagaaaattcatgaagacaatcaacctggcggcagcgcaaaagatg

SEQ ID NO: 187787 - DNA, 103 bp, Artificial Sequence
  Synthetic Polynucleotide
taatacgactcactataggggcgatcttttctgcccgctgttgattgtctaacagaggagaagacaaatgacagcgggcaacctggcggcagcgcaaaagatg

SEQ ID NO: 187788 - DNA, 103 bp, Artificial Sequence
  Synthetic Polynucleotide
taatacgactcactatagggtacagccaaggcgatcttttctgcccgctgaacagaggagacagcggatggaaaagatcaacctggcggcagcgcaaaagatg

SEQ ID NO: 187789 - DNA, 103 bp, Artificial Sequence
  Synthetic Polynucleotide
taatacgactcactatagggtagtcctctttacagccaaggcgatcttttaacagaggagaaaaagaatgccttggctgaacctggcggcagcgcaaaagatg

SEQ ID NO: 187790 - DNA, 103 bp, Artificial Sequence
  Synthetic Polynucleotide
taatacgactcactatagggaggacaagcatagtcctctttacagccaagaacagaggagacttggcatgaaagaggacaacctggcggcagcgcaaaagatg

SEQ ID NO: 187791 - DNA, 103 bp, Artificial Sequence
  Synthetic Polynucleotide
taatacgactcactatagggagagccccatgccgtcctgaacccgggaggaacagaggagacctcccatgttcaggacgaacctggcggcagcgcaaaagatg

SEQ ID NO: 187792 - DNA, 103 bp, Artificial Sequence
  Synthetic Polynucleotide
taatacgactcactatagggattcacattgaggacaagcatagtcctcttaacagaggagaaagaggatgatgcttgtcaacctggcggcagcgcaaaagatg

SEQ ID NO: 187793 - DNA, 103 bp, Artificial Sequence
  Synthetic Polynucleotide
taatacgactcactataggggtaaaactcgattcacattgaggacaagcaaacagaggagatgcttgatgtcaatgtgaaacctggcggcagcgcaaaagatg

SEQ ID NO: 187794 - DNA, 103 bp, Artificial Sequence
  Synthetic Polynucleotide
taatacgactcactatagggatcctcactggtaaaactcgattcacattgaacagaggagacaatgtatgtcgagttttaacctggcggcagcgcaaaagatg

SEQ ID NO: 187795 - DNA, 103 bp, Artificial Sequence
  Synthetic Polynucleotide
taatacgactcactatagggcagcaagaatatcctcactggtaaaactcgaacagaggagacgagttatgccagtgaggaacctggcggcagcgcaaaagatg

SEQ ID NO: 187796 - DNA, 103 bp, Artificial Sequence
  Synthetic Polynucleotide
taatacgactcactatagggtggagatgctcagcaagaatatcctcactgaacagaggagacagtgaatgtattcttgcaacctggcggcagcgcaaaagatg

SEQ ID NO: 187797 - DNA, 103 bp, Artificial Sequence
  Synthetic Polynucleotide
taatacgactcactataggggtgcaatgtctggagatgctcagcaagaataacagaggagaattcttatggagcatctcaacctggcggcagcgcaaaagatg

SEQ ID NO: 187798 - DNA, 103 bp, Artificial Sequence
  Synthetic Polynucleotide
taatacgactcactatagggtgggtttctggtgcaatgtctggagatgctaacagaggagaagcatcatgagacattgcaacctggcggcagcgcaaaagatg

SEQ ID NO: 187799 - DNA, 103 bp, Artificial Sequence
  Synthetic Polynucleotide
taatacgactcactatagggttctcctctgtgggtttctggtgcaatgtcaacagaggagagacattatgccagaaaccaacctggcggcagcgcaaaagatg

SEQ ID NO: 187800 - DNA, 103 bp, Artificial Sequence
  Synthetic Polynucleotide
taatacgactcactatagggcttaaattctttctcctctgtgggtttctgaacagaggagacagaaaatgacagaggagaacctggcggcagcgcaaaagatg

SEQ ID NO: 187801 - DNA, 103 bp, Artificial Sequence
  Synthetic Polynucleotide
taatacgactcactatagggagttcttgcacttaaattctttctcctctgaacagaggagacagaggatgaagaatttaaacctggcggcagcgcaaaagatg

SEQ ID NO: 187802 - DNA, 103 bp, Artificial Sequence
  Synthetic Polynucleotide
taatacgactcactatagggcgggccgtgtagagccccatgccgtcctgaaacagaggagatcaggaatgcatggggctaacctggcggcagcgcaaaagatg

SEQ ID NO: 187803 - DNA, 103 bp, Artificial Sequence
  Synthetic Polynucleotide
taatacgactcactatagggttcttcccacagttcttgcacttaaattctaacagaggagaagaattatggtgcaagaaaacctggcggcagcgcaaaagatg

SEQ ID NO: 187804 - DNA, 103 bp, Artificial Sequence
  Synthetic Polynucleotide
taatacgactcactatagggaactgggaatttcttcccacagttcttgcaaacagaggagatgcaagatgtgtgggaagaacctggcggcagcgcaaaagatg

SEQ ID NO: 187805 - DNA, 103 bp, Artificial Sequence
  Synthetic Polynucleotide
taatacgactcactatagggaagcctgcttaactgggaatttcttcccacaacagaggagagtgggaatgaattcccagaacctggcggcagcgcaaaagatg

SEQ ID NO: 187806 - DNA, 103 bp, Artificial Sequence
  Synthetic Polynucleotide
taatacgactcactatagggtgtctttgcaaagcctgcttaactgggaataacagaggagaattcccatgtaagcaggcaacctggcggcagcgcaaaagatg

SEQ ID NO: 187807 - DNA, 103 bp, Artificial Sequence
  Synthetic Polynucleotide
taatacgactcactatagggctgaagaacatgtctttgcaaagcctgcttaacagaggagaaagcagatgttgcaaagaaacctggcggcagcgcaaaagatg

SEQ ID NO: 187808 - DNA, 103 bp, Artificial Sequence
  Synthetic Polynucleotide
taatacgactcactatagggtcgctgtgcactgaagaacatgtctttgcaaacagaggagatgcaaaatgatgttcttcaacctggcggcagcgcaaaagatg

SEQ ID NO: 187809 - DNA, 103 bp, Artificial Sequence
  Synthetic Polynucleotide
taatacgactcactatagggagactgcttttcgctgtgcactgaagaacaaacagaggagatgttctatggtgcacagcaacctggcggcagcgcaaaagatg

SEQ ID NO: 187810 - DNA, 103 bp, Artificial Sequence
  Synthetic Polynucleotide
taatacgactcactatagggagactcctttagactgcttttcgctgtgcaaacagaggagatgcacaatgaaaagcagtaacctggcggcagcgcaaaagatg

SEQ ID NO: 187811 - DNA, 103 bp, Artificial Sequence
  Synthetic Polynucleotide
taatacgactcactatagggaacttcgcgaagactcctttagactgctttaacagaggagaaaagcaatgtaaaggagtaacctggcggcagcgcaaaagatg

SEQ ID NO: 187812 - DNA, 103 bp, Artificial Sequence
  Synthetic Polynucleotide
taatacgactcactataggggagcactgaaaacttcgcgaagactcctttaacagaggagaaaaggaatgttcgcgaagaacctggcggcagcgcaaaagatg

SEQ ID NO: 187813 - DNA, 103 bp, Artificial Sequence
  Synthetic Polynucleotide
taatacgactcactatagggtcgcactctgcgggccgtgtagagccccataacagaggagaatggggatgtacacggccaacctggcggcagcgcaaaagatg

SEQ ID NO: 187814 - DNA, 103 bp, Artificial Sequence
  Synthetic Polynucleotide
taatacgactcactatagggattgcaaacagagcactgaaaacttcgcgaaacagaggagatcgcgaatgtttcagtgcaacctggcggcagcgcaaaagatg

SEQ ID NO: 187815 - DNA, 103 bp, Artificial Sequence
  Synthetic Polynucleotide
taatacgactcactatagggtgaaggaagaattgcaaacagagcactgaaaacagaggagattcagtatgctgtttgcaaacctggcggcagcgcaaaagatg

SEQ ID NO: 187816 - DNA, 103 bp, Artificial Sequence
  Synthetic Polynucleotide
taatacgactcactataggggatgctgaactgaaggaagaattgcaaacaaacagaggagatgtttgatgttcttccttaacctggcggcagcgcaaaagatg

SEQ ID NO: 187817 - DNA, 103 bp, Artificial Sequence
  Synthetic Polynucleotide
taatacgactcactatagggctcaaaactcgatgctgaactgaaggaagaaacagaggagatcttccatgagttcagcaaacctggcggcagcgcaaaagatg

SEQ ID NO: 187818 - DNA, 103 bp, Artificial Sequence
  Synthetic Polynucleotide
taatacgactcactatagggcctggtgctgctcaaaactcgatgctgaacaacagaggagagttcagatgcgagttttgaacctggcggcagcgcaaaagatg

SEQ ID NO: 187819 - DNA, 103 bp, Artificial Sequence
  Synthetic Polynucleotide
taatacgactcactatagggcggcaagtctcctggtgctgctcaaaactcaacagaggagagagtttatggcagcaccaaacctggcggcagcgcaaaagatg

SEQ ID NO: 187820 - DNA, 103 bp, Artificial Sequence
  Synthetic Polynucleotide
taatacgactcactatagggggcatccccccggcaagtctcctggtgctgaacagaggagacagcacatggagacttgcaacctggcggcagcgcaaaagatg

SEQ ID NO: 187821 - DNA, 103 bp, Artificial Sequence
  Synthetic Polynucleotide
taatacgactcactatagggacacaaacctggcatccccccggcaagtctaacagaggagaagacttatgggggggatgaacctggcggcagcgcaaaagatg

SEQ ID NO: 187822 - DNA, 103 bp, Artificial Sequence
  Synthetic Polynucleotide
taatacgactcactatagggtcagccttgcacacaaacctggcatcccccaacagaggagagggggaatgcaggtttgtaacctggcggcagcgcaaaagatg

SEQ ID NO: 187823 - DNA, 103 bp, Artificial Sequence
  Synthetic Polynucleotide
taatacgactcactatagggtccacagctgtcagccttgcacacaaacctaacagaggagaaggtttatgtgcaaggctaacctggcggcagcgcaaaagatg

SEQ ID NO: 187824 - DNA, 103 bp, Artificial Sequence
  Synthetic Polynucleotide
taatacgactcactatagggtttcaccctttcgcactctgcgggccgtgtaacagaggagaacacggatggcagagtgcaacctggcggcagcgcaaaagatg

SEQ ID NO: 187825 - DNA, 103 bp, Artificial Sequence
  Synthetic Polynucleotide
taatacgactcactatagggtcagcctctttccacagctgtcagccttgcaacagaggagagcaaggatgacagctgtgaacctggcggcagcgcaaaagatg

SEQ ID NO: 187826 - DNA, 103 bp, Artificial Sequence
  Synthetic Polynucleotide
taatacgactcactatagggtccttgctcttcagcctctttccacagctgaacagaggagacagctgatgaaagaggctaacctggcggcagcgcaaaagatg

SEQ ID NO: 187827 - DNA, 103 bp, Artificial Sequence
  Synthetic Polynucleotide
taatacgactcactatagggtttcagggcatccttgctcttcagcctcttaacagaggagaaagaggatgaagagcaagaacctggcggcagcgcaaaagatg

SEQ ID NO: 187828 - DNA, 103 bp, Artificial Sequence
  Synthetic Polynucleotide
taatacgactcactatagggcctggtgtcttttcagggcatccttgctctaacagaggagaagagcaatgatgccctgaaacctggcggcagcgcaaaagatg

SEQ ID NO: 187829 - DNA, 103 bp, Artificial Sequence
  Synthetic Polynucleotide
taatacgactcactatagggtggacattttcctggtgtcttttcagggcaaacagaggagatgccctatgaagacaccaaacctggcggcagcgcaaaagatg

SEQ ID NO: 187830 - DNA, 103 bp, Artificial Sequence
  Synthetic Polynucleotide
taatacgactcactatagggatctccagtgtggacattttcctggtgtctaacagaggagaagacacatggaaaatgtcaacctggcggcagcgcaaaagatg

SEQ ID NO: 187831 - DNA, 103 bp, Artificial Sequence
  Synthetic Polynucleotide
taatacgactcactatagggttttcttaggatctccagtgtggacattttaacagaggagaaaaatgatgacactggagaacctggcggcagcgcaaaagatg

SEQ ID NO: 187832 - DNA, 103 bp, Artificial Sequence
  Synthetic Polynucleotide
taatacgactcactatagggcatataagctttttcttaggatctccagtgaacagaggagacactggatgtcctaagaaaacctggcggcagcgcaaaagatg

SEQ ID NO: 187833 - DNA, 103 bp, Artificial Sequence
  Synthetic Polynucleotide
taatacgactcactataggggcacactgaacatataagctttttcttaggaacagaggagacctaagatgaagcttataaacctggcggcagcgcaaaagatg

SEQ ID NO: 187834 - DNA, 103 bp, Artificial Sequence
  Synthetic Polynucleotide
taatacgactcactatagggactttttattgcacactgaacatataagctaacagaggagaagcttaatggttcagtgtaacctggcggcagcgcaaaagatg

SEQ ID NO: 187835 - DNA, 103 bp, Artificial Sequence
  Synthetic Polynucleotide
taatacgactcactatagggggtccgaacttttcaccctttcgcactctgaacagaggagacagagtatgaaagggtgaaacctggcggcagcgcaaaagatg

SEQ ID NO: 187836 - DNA, 103 bp, Artificial Sequence
  Synthetic Polynucleotide
taatacgactcactataggggctgaagaacactttttattgcacactgaaaacagaggagattcagtatgcaataaaaaaacctggcggcagcgcaaaagatg

SEQ ID NO: 187837 - DNA, 103 bp, Artificial Sequence
  Synthetic Polynucleotide
taatacgactcactatagggtaggcttgatgctgaagaacactttttattaacagaggagaaataaaatgtgttcttcaaacctggcggcagcgcaaaagatg

SEQ ID NO: 187838 - DNA, 103 bp, Artificial Sequence
  Synthetic Polynucleotide
taatacgactcactatagggtatgttcctgtaggcttgatgctgaagaacaacagaggagagttcttatgcatcaagccaacctggcggcagcgcaaaagatg

SEQ ID NO: 187839 - DNA, 103 bp, Artificial Sequence
  Synthetic Polynucleotide
taatacgactcactatagggtgaatctttctatgttcctgtaggcttgataacagaggagaatcaagatgacaggaacaaacctggcggcagcgcaaaagatg

SEQ ID NO: 187840 - DNA, 103 bp, Artificial Sequence
  Synthetic Polynucleotide
taatacgactcactatagggaaatatctcatgaatctttctatgttcctgaacagaggagacaggaaatgagaaagattaacctggcggcagcgcaaaagatg

SEQ ID NO: 187841 - DNA, 103 bp, Artificial Sequence
  Synthetic Polynucleotide
taatacgactcactatagggcttgacaatcaaatatctcatgaatctttcaacagaggagagaaagaatgatgagatataacctggcggcagcgcaaaagatg

SEQ ID NO: 187842 - DNA, 103 bp, Artificial Sequence
  Synthetic Polynucleotide
taatacgactcactatagggttcatacattcttgacaatcaaatatctcaaacagaggagatgagatatgtgattgtcaaacctggcggcagcgcaaaagatg

SEQ ID NO: 187843 - DNA, 103 bp, Artificial Sequence
  Synthetic Polynucleotide
taatacgactcactatagggaataaatttcttcatacattcttgacaatcaacagaggagagattgtatggaatgtatgaacctggcggcagcgcaaaagatg

SEQ ID NO: 187844 - DNA, 103 bp, Artificial Sequence
  Synthetic Polynucleotide
taatacgactcactataggggattagctgaaataaatttcttcatacattaacagaggagaaatgtaatgagaaatttaaacctggcggcagcgcaaaagatg

SEQ ID NO: 187845 - DNA, 103 bp, Artificial Sequence
  Synthetic Polynucleotide
taatacgactcactatagggcgttttagctgattagctgaaataaatttcaacagaggagagaaattatgttcagctaaaacctggcggcagcgcaaaagatg

SEQ ID NO: 187846 - DNA, 103 bp, Artificial Sequence
  Synthetic Polynucleotide
taatacgactcactatagggcgaaccgccggggtctccgggcttcagcataacagaggagaatgctgatgcccggagacaacctggcggcagcgcaaaagatg

SEQ ID NO: 187847 - DNA, 103 bp, Artificial Sequence
  Synthetic Polynucleotide
taatacgactcactatagggggcgccgctgcccttgagcgggcctgcgccaacagaggagaggcgcaatgccgctcaagaacctggcggcagcgcaaaagatg

SEQ ID NO: 187848 - DNA, 103 bp, Artificial Sequence
  Synthetic Polynucleotide
taatacgactcactatagggaactactgttagattctgttctccgcagtgaacagaggagacactgcatggaacagaataacctggcggcagcgcaaaagatg

SEQ ID NO: 187849 - DNA, 103 bp, Artificial Sequence
  Synthetic Polynucleotide
taatacgactcactatagggacctgtactgaactactgttagattctgttaacagaggagaaacagaatgtaacagtagaacctggcggcagcgcaaaagatg

SEQ ID NO: 187850 - DNA, 103 bp, Artificial Sequence
  Synthetic Polynucleotide
taatacgactcactatagggaatatattcgacctgtactgaactactgttaacagaggagaaacagtatgtcagtacagaacctggcggcagcgcaaaagatg

SEQ ID NO: 187851 - DNA, 103 bp, Artificial Sequence
  Synthetic Polynucleotide
taatacgactcactatagggggctcggtagaatatattcgacctgtactgaacagaggagacagtacatgtcgaatataaacctggcggcagcgcaaaagatg

SEQ ID NO: 187852 - DNA, 103 bp, Artificial Sequence
  Synthetic Polynucleotide
taatacgactcactatagggtatctatacaggctcggtagaatatattcgaacagaggagacgaataatgtctaccgagaacctggcggcagcgcaaaagatg

SEQ ID NO: 187853 - DNA, 103 bp, Artificial Sequence
  Synthetic Polynucleotide
taatacgactcactatagggcccctagggatatctatacaggctcggtagaacagaggagactaccgatgctgtatagaaacctggcggcagcgcaaaagatg

SEQ ID NO: 187854 - DNA, 103 bp, Artificial Sequence
  Synthetic Polynucleotide
taatacgactcactatagggaagctcggtgcccctagggatatctatacaaacagaggagatgtataatgatccctaggaacctggcggcagcgcaaaagatg

SEQ ID NO: 187855 - DNA, 103 bp, Artificial Sequence
  Synthetic Polynucleotide
taatacgactcactatagggaccacaccagaagctcggtgcccctagggaaacagaggagatccctaatggcaccgagcaacctggcggcagcgcaaaagatg

SEQ ID NO: 187856 - DNA, 103 bp, Artificial Sequence
  Synthetic Polynucleotide
taatacgactcactatagggctgtcattgtaccacaccagaagctcggtgaacagaggagacaccgaatgtctggtgtgaacctggcggcagcgcaaaagatg

SEQ ID NO: 187857 - DNA, 103 bp, Artificial Sequence
  Synthetic Polynucleotide
taatacgactcactatagggagacgtatagctgtcattgtaccacaccagaacagaggagactggtgatgtacaatgacaacctggcggcagcgcaaaagatg

SEQ ID NO: 187858 - DNA, 103 bp, Artificial Sequence
  Synthetic Polynucleotide
taatacgactcactatagggggagacccgcggcgccgctgcccttgagcgaacagaggagacgctcaatggcagcggcgaacctggcggcagcgcaaaagatg

SEQ ID NO: 187859 - DNA, 103 bp, Artificial Sequence
  Synthetic Polynucleotide
taatacgactcactatagggtcccaaagaaagacgtatagctgtcattgtaacagaggagaacaatgatggctatacgtaacctggcggcagcgcaaaagatg

SEQ ID NO: 187860 - DNA, 103 bp, Artificial Sequence
  Synthetic Polynucleotide
taatacgactcactatagggtgtaaggggatcccaaagaaagacgtatagaacagaggagactatacatgtttctttggaacctggcggcagcgcaaaagatg

SEQ ID NO: 187861 - DNA, 103 bp, Artificial Sequence
  Synthetic Polynucleotide
taatacgactcactatagggggcaatgcattgtaaggggatcccaaagaaaacagaggagattctttatgatccccttaaacctggcggcagcgcaaaagatg

SEQ ID NO: 187862 - DNA, 103 bp, Artificial Sequence
  Synthetic Polynucleotide
taatacgactcactatagggtttcatcctgggcaatgcattgtaaggggaaacagaggagatcccctatgaatgcattgaacctggcggcagcgcaaaagatg

SEQ ID NO: 187863 - DNA, 103 bp, Artificial Sequence
  Synthetic Polynucleotide
taatacgactcactatagggacatttaagttttcatcctgggcaatgcataacagaggagaatgcatatgccaggatgaaacctggcggcagcgcaaaagatg

SEQ ID NO: 187864 - DNA, 103 bp, Artificial Sequence
  Synthetic Polynucleotide
taatacgactcactatagggcgttgaagggacatttaagttttcatcctgaacagaggagacaggatatgaacttaaataacctggcggcagcgcaaaagatg

SEQ ID NO: 187865 - DNA, 103 bp, Artificial Sequence
  Synthetic Polynucleotide
taatacgactcactatagggcttccattaccgttgaagggacatttaagtaacagaggagaacttaaatgtcccttcaaaacctggcggcagcgcaaaagatg

SEQ ID NO: 187866 - DNA, 103 bp, Artificial Sequence
  Synthetic Polynucleotide
taatacgactcactatagggctgcacatggcttccattaccgttgaagggaacagaggagacccttcatgggtaatggaaacctggcggcagcgcaaaagatg

SEQ ID NO: 187867 - DNA, 103 bp, Artificial Sequence
  Synthetic Polynucleotide
taatacgactcactatagggggcgtcttgtctgcacatggcttccattacaacagaggagagtaatgatggccatgtgcaacctggcggcagcgcaaaagatg

SEQ ID NO: 187868 - DNA, 103 bp, Artificial Sequence
  Synthetic Polynucleotide
taatacgactcactatagggagggctgcagggcgtcttgtctgcacatggaacagaggagaccatgtatggacaagacgaacctggcggcagcgcaaaagatg

SEQ ID NO: 187869 - DNA, 103 bp, Artificial Sequence
  Synthetic Polynucleotide
taatacgactcactatagggggcgcgctcaggagacccgcggcgccgctgaacagaggagacagcggatgcgcgggtctaacctggcggcagcgcaaaagatg

SEQ ID NO: 187870 - DNA, 103 bp, Artificial Sequence
  Synthetic Polynucleotide
taatacgactcactatagggcttttgttgaagggctgcagggcgtcttgtaacagaggagaacaagaatgcctgcagccaacctggcggcagcgcaaaagatg

SEQ ID NO: 187871 - DNA, 103 bp, Artificial Sequence
  Synthetic Polynucleotide
taatacgactcactataggggagtttgctgcttttgttgaagggctgcagaacagaggagactgcagatgttcaacaaaaacctggcggcagcgcaaaagatg

SEQ ID NO: 187872 - DNA, 103 bp, Artificial Sequence
  Synthetic Polynucleotide
taatacgactcactatagggtggtaggggcgagtttgctgcttttgttgaaacagaggagatcaacaatggcagcaaacaacctggcggcagcgcaaaagatg

SEQ ID NO: 187873 - DNA, 103 bp, Artificial Sequence
  Synthetic Polynucleotide
taatacgactcactatagggcgctgctgggtggtaggggcgagtttgctgaacagaggagacagcaaatgcgcccctacaacctggcggcagcgcaaaagatg

SEQ ID NO: 187874 - DNA, 103 bp, Artificial Sequence
  Synthetic Polynucleotide
taatacgactcactatagggaacaacggagcgctgctgggtggtaggggcaacagaggagagcccctatgacccagcagaacctggcggcagcgcaaaagatg

SEQ ID NO: 187875 - DNA, 103 bp, Artificial Sequence
  Synthetic Polynucleotide
taatacgactcactatagggtctgggggaaaacaacggagcgctgctgggaacagaggagacccagcatggctccgttgaacctggcggcagcgcaaaagatg

SEQ ID NO: 187876 - DNA, 103 bp, Artificial Sequence
  Synthetic Polynucleotide
taatacgactcactatagggctgcacggagtctgggggaaaacaacggagaacagaggagactccgtatgtttcccccaaacctggcggcagcgcaaaagatg

SEQ ID NO: 187877 - DNA, 103 bp, Artificial Sequence
  Synthetic Polynucleotide
taatacgactcactataggggaagttcctgctgcacggagtctgggggaaaacagaggagattccccatgactccgtgcaacctggcggcagcgcaaaagatg

SEQ ID NO: 187878 - DNA, 103 bp, Artificial Sequence
  Synthetic Polynucleotide
taatacgactcactatagggccagaagagagaagttcctgctgcacggagaacagaggagactccgtatggcaggaactaacctggcggcagcgcaaaagatg

SEQ ID NO: 187879 - DNA, 103 bp, Artificial Sequence
  Synthetic Polynucleotide
taatacgactcactatagggccagacttatccagaagagagaagttcctgaacagaggagacaggaaatgctctcttctaacctggcggcagcgcaaaagatg

SEQ ID NO: 187880 - DNA, 103 bp, Artificial Sequence
  Synthetic Polynucleotide
taatacgactcactatagggaagaggctgcggcgcgctcaggagacccgcaacagaggagagcgggtatgctgagcgcgaacctggcggcagcgcaaaagatg

SEQ ID NO: 187881 - DNA, 103 bp, Artificial Sequence
  Synthetic Polynucleotide
taatacgactcactatagggttcaatgggcccagacttatccagaagagaaacagaggagatctcttatggataagtctaacctggcggcagcgcaaaagatg

SEQ ID NO: 187882 - DNA, 103 bp, Artificial Sequence
  Synthetic Polynucleotide
taatacgactcactatagggtaaatcctgattcaatgggcccagacttataacagaggagaataagtatgggcccattgaacctggcggcagcgcaaaagatg

SEQ ID NO: 187883 - DNA, 103 bp, Artificial Sequence
  Synthetic Polynucleotide
taatacgactcactatagggttgatttgattaaatcctgattcaatgggcaacagaggagagcccatatgatcaggattaacctggcggcagcgcaaaagatg

SEQ ID NO: 187884 - DNA, 103 bp, Artificial Sequence
  Synthetic Polynucleotide
taatacgactcactataggggtttttcacgttgatttgattaaatcctgaaacagaggagatcaggaatgaatcaaatcaacctggcggcagcgcaaaagatg

SEQ ID NO: 187885 - DNA, 103 bp, Artificial Sequence
  Synthetic Polynucleotide
taatacgactcactatagggggactcgctggtttttcacgttgatttgataacagaggagaatcaaaatgacgtgaaaaaacctggcggcagcgcaaaagatg

SEQ ID NO: 187886 - DNA, 103 bp, Artificial Sequence
  Synthetic Polynucleotide
taatacgactcactataggggggcttgccaggactcgctggtttttcacgaacagaggagacgtgaaatgccagcgagtaacctggcggcagcgcaaaagatg

SEQ ID NO: 187887 - DNA, 103 bp, Artificial Sequence
  Synthetic Polynucleotide
taatacgactcactatagggtgtggaagttgggcttgccaggactcgctgaacagaggagacagcgaatgctggcaagcaacctggcggcagcgcaaaagatg

SEQ ID NO: 187888 - DNA, 103 bp, Artificial Sequence
  Synthetic Polynucleotide
taatacgactcactatagggggagctggcttgtggaagttgggcttgccaaacagaggagatggcaaatgcaacttccaaacctggcggcagcgcaaaagatg

SEQ ID NO: 187889 - DNA, 103 bp, Artificial Sequence
  Synthetic Polynucleotide
taatacgactcactatagggaactccgagtggagctggcttgtggaagttaacagaggagaaacttcatgaagccagctaacctggcggcagcgcaaaagatg

SEQ ID NO: 187890 - DNA, 103 bp, Artificial Sequence
  Synthetic Polynucleotide
taatacgactcactatagggccagtcactgaactccgagtggagctggctaacagaggagaagccagatgcactcggagaacctggcggcagcgcaaaagatg

SEQ ID NO: 187891 - DNA, 103 bp, Artificial Sequence
  Synthetic Polynucleotide
taatacgactcactataggggcggcggctgaagaggctgcggcgcgctcaaacagaggagatgagcgatgcgcagcctcaacctggcggcagcgcaaaagatg

SEQ ID NO: 187892 - DNA, 103 bp, Artificial Sequence
  Synthetic Polynucleotide
taatacgactcactatagggtccaaagatgccagtcactgaactccgagtaacagaggagaactcggatgtcagtgactaacctggcggcagcgcaaaagatg

SEQ ID NO: 187893 - DNA, 103 bp, Artificial Sequence
  Synthetic Polynucleotide
taatacgactcactatagggtgcccacatttccaaagatgccagtcactgaacagaggagacagtgaatggcatctttgaacctggcggcagcgcaaaagatg

SEQ ID NO: 187894 - DNA, 103 bp, Artificial Sequence
  Synthetic Polynucleotide
taatacgactcactatagggcttaaagcactgcccacatttccaaagatgaacagaggagacatcttatgaaatgtgggaacctggcggcagcgcaaaagatg

SEQ ID NO: 187895 - DNA, 103 bp, Artificial Sequence
  Synthetic Polynucleotide
taatacgactcactataggggggtgaaagtcttaaagcactgcccacattaacagaggagaaatgtgatgagtgctttaaacctggcggcagcgcaaaagatg

SEQ ID NO: 187896 - DNA, 103 bp, Artificial Sequence
  Synthetic Polynucleotide
taatacgactcactatagggaggatccgctgggtgaaagtcttaaagcacaacagaggagagtgcttatggactttcacaacctggcggcagcgcaaaagatg

SEQ ID NO: 187897 - DNA, 103 bp, Artificial Sequence
  Synthetic Polynucleotide
taatacgactcactatagggcatctgtaagaggatccgctgggtgaaagtaacagaggagaactttcatgcagcggatcaacctggcggcagcgcaaaagatg

SEQ ID NO: 187898 - DNA, 103 bp, Artificial Sequence
  Synthetic Polynucleotide
taatacgactcactatagggtgcacacgtgcatctgtaagaggatccgctaacagaggagaagcggaatgtcttacagaaacctggcggcagcgcaaaagatg

SEQ ID NO: 187899 - DNA, 103 bp, Artificial Sequence
  Synthetic Polynucleotide
taatacgactcactataggggggttctgcgtgcacacgtgcatctgtaagaacagaggagacttacaatggcacgtgtgaacctggcggcagcgcaaaagatg

SEQ ID NO: 187900 - DNA, 103 bp, Artificial Sequence
  Synthetic Polynucleotide
taatacgactcactataggggggtctgtcggggttctgcgtgcacacgtgaacagaggagacacgtgatgacgcagaacaacctggcggcagcgcaaaagatg

SEQ ID NO: 187901 - DNA, 103 bp, Artificial Sequence
  Synthetic Polynucleotide
taatacgactcactatagggcgcattggtagggtctgtcggggttctgcgaacagaggagacgcagaatgccgacagacaacctggcggcagcgcaaaagatg

SEQ ID NO: 187902 - DNA, 103 bp, Artificial Sequence
  Synthetic Polynucleotide
taatacgactcactataggggggggcggcggcggcggctgaagaggctgcaacagaggagagcagccatgtcagccgccaacctggcggcagcgcaaaagatg

SEQ ID NO: 187903 - DNA, 103 bp, Artificial Sequence
  Synthetic Polynucleotide
taatacgactcactataggggagcagtggccgcattggtagggtctgtcgaacagaggagacgacagatgctaccaatgaacctggcggcagcgcaaaagatg

SEQ ID NO: 187904 - DNA, 103 bp, Artificial Sequence
  Synthetic Polynucleotide
taatacgactcactatagggaaaggactgggagcagtggccgcattggtaaacagaggagataccaaatgggccactgcaacctggcggcagcgcaaaagatg

SEQ ID NO: 187905 - DNA, 103 bp, Artificial Sequence
  Synthetic Polynucleotide
taatacgactcactatagggaaggctgggaaaaggactgggagcagtggcaacagaggagagccactatgcccagtcctaacctggcggcagcgcaaaagatg

SEQ ID NO: 187906 - DNA, 103 bp, Artificial Sequence
  Synthetic Polynucleotide
taatacgactcactatagggctcagttctgaaggctgggaaaaggactggaacagaggagaccagtcatgttcccagccaacctggcggcagcgcaaaagatg

SEQ ID NO: 187907 - DNA, 103 bp, Artificial Sequence
  Synthetic Polynucleotide
taatacgactcactatagggcacgtggttcctcagttctgaaggctgggaaacagaggagatcccagatgtcagaactgaacctggcggcagcgcaaaagatg

SEQ ID NO: 187908 - DNA, 103 bp, Artificial Sequence
  Synthetic Polynucleotide
taatacgactcactatagggagtgagtgaccacgtggttcctcagttctgaacagaggagacagaacatgggaaccacgaacctggcggcagcgcaaaagatg

SEQ ID NO: 187909 - DNA, 103 bp, Artificial Sequence
  Synthetic Polynucleotide
taatacgactcactatagggcggtcactagagtgagtgaccacgtggttcaacagaggagagaaccaatgggtcactcaaacctggcggcagcgcaaaagatg

SEQ ID NO: 187910 - DNA, 103 bp, Artificial Sequence
  Synthetic Polynucleotide
taatacgactcactatagggcttgaaaggccggtcactagagtgagtgacaacagaggagagtcactatgtctagtgacaacctggcggcagcgcaaaagatg

SEQ ID NO: 187911 - DNA, 103 bp, Artificial Sequence
  Synthetic Polynucleotide
taatacgactcactatagggagtagccgcacttgaaaggccggtcactagaacagaggagactagtgatgggcctttcaaacctggcggcagcgcaaaagatg

SEQ ID NO: 187912 - DNA, 103 bp, Artificial Sequence
  Synthetic Polynucleotide
taatacgactcactataggggcacgaccacagtagccgcacttgaaaggcaacagaggagagcctttatggtgcggctaaacctggcggcagcgcaaaagatg

SEQ ID NO: 187913 - DNA, 103 bp, Artificial Sequence
  Synthetic Polynucleotide
taatacgactcactatagggctccgggggcgggggcggcggcggcggctgaacagaggagacagccgatgccgccgcccaacctggcggcagcgcaaaagatg

SEQ ID NO: 187914 - DNA, 103 bp, Artificial Sequence
  Synthetic Polynucleotide
taatacgactcactatagggcccggcaaaggcacgaccacagtagccgcaaacagaggagatgcggcatgtgtggtcgtaacctggcggcagcgcaaaagatg

SEQ ID NO: 187915 - DNA, 103 bp, Artificial Sequence
  Synthetic Polynucleotide
taatacgactcactataggggggtggtggccccggcaaaggcacgaccacaacagaggagagtggtcatgcctttgccgaacctggcggcagcgcaaaagatg

SEQ ID NO: 187916 - DNA, 103 bp, Artificial Sequence
  Synthetic Polynucleotide
taatacgactcactatagggtggttgttgagggtggtggccccggcaaagaacagaggagactttgcatgggccaccacaacctggcggcagcgcaaaagatg

SEQ ID NO: 187917 - DNA, 103 bp, Artificial Sequence
  Synthetic Polynucleotide
taatacgactcactatagggggttcggatgtggttgttgagggtggtggcaacagaggagagccaccatgctcaacaacaacctggcggcagcgcaaaagatg

SEQ ID NO: 187918 - DNA, 103 bp, Artificial Sequence
  Synthetic Polynucleotide
taatacgactcactatagggctccagtgtgggttcggatgtggttgttgaaacagaggagatcaacaatgacatccgaaaacctggcggcagcgcaaaagatg

SEQ ID NO: 187919 - DNA, 103 bp, Artificial Sequence
  Synthetic Polynucleotide
taatacgactcactatagggaagggcttttctccagtgtgggttcggatgaacagaggagacatccgatgccacactggaacctggcggcagcgcaaaagatg

SEQ ID NO: 187920 - DNA, 103 bp, Artificial Sequence
  Synthetic Polynucleotide
taatacgactcactatagggctcgcacttgaagggcttttctccagtgtgaacagaggagacacactatggaaaagcccaacctggcggcagcgcaaaagatg

SEQ ID NO: 187921 - DNA, 103 bp, Artificial Sequence
  Synthetic Polynucleotide
taatacgactcactatagggtctcacacctctcgcacttgaagggcttttaacagaggagaaaaagcatgtcaagtgcgaacctggcggcagcgcaaaagatg

SEQ ID NO: 187922 - DNA, 103 bp, Artificial Sequence
  Synthetic Polynucleotide
taatacgactcactataggggtgaagctcctctcacacctctcgcacttgaacagaggagacaagtgatggaggtgtgaaacctggcggcagcgcaaaagatg

SEQ ID NO: 187923 - DNA, 103 bp, Artificial Sequence
  Synthetic Polynucleotide
taatacgactcactatagggggtggcctgcgtgaagctcctctcacacctaacagaggagaaggtgtatgaggagcttcaacctggcggcagcgcaaaagatg

SEQ ID NO: 187924 - DNA, 103 bp, Artificial Sequence
  Synthetic Polynucleotide
taatacgactcactataggggctcagcgcgctccgggggcgggggcggcgaacagaggagacgccgcatgcgcccccggaacctggcggcagcgcaaaagatg

SEQ ID NO: 187925 - DNA, 103 bp, Artificial Sequence
  Synthetic Polynucleotide
taatacgactcactatagggggctcagctgggtggcctgcgtgaagctccaacagaggagaggagctatgcgcaggccaaacctggcggcagcgcaaaagatg

SEQ ID NO: 187926 - DNA, 103 bp, Artificial Sequence
  Synthetic Polynucleotide
taatacgactcactatagggcgctggtgtcggctcagctgggtggcctgcaacagaggagagcaggcatgccagctgagaacctggcggcagcgcaaaagatg

SEQ ID NO: 187927 - DNA, 103 bp, Artificial Sequence
  Synthetic Polynucleotide
taatacgactcactatagggattgggcatccgctggtgtcggctcagctgaacagaggagacagctgatgcgacaccagaacctggcggcagcgcaaaagatg

SEQ ID NO: 187928 - DNA, 103 bp, Artificial Sequence
  Synthetic Polynucleotide
taatacgactcactataggggcttgcactcattgggcatccgctggtgtcaacagaggagagacaccatgggatgcccaaacctggcggcagcgcaaaagatg

SEQ ID NO: 187929 - DNA, 103 bp, Artificial Sequence
  Synthetic Polynucleotide
taatacgactcactatagggtcagttattggcttgcactcattgggcatcaacagaggagagatgccatgtgagtgcaaaacctggcggcagcgcaaaagatg

SEQ ID NO: 187930 - DNA, 103 bp, Artificial Sequence
  Synthetic Polynucleotide
taatacgactcactatagggttctgggctctcagttattggcttgcactcaacagaggagagagtgcatgccaataactaacctggcggcagcgcaaaagatg

SEQ ID NO: 187931 - DNA, 103 bp, Artificial Sequence
  Synthetic Polynucleotide
taatacgactcactatagggcttcgattgattctgggctctcagttattgaacagaggagacaataaatgagagcccagaacctggcggcagcgcaaaagatg

SEQ ID NO: 187932 - DNA, 103 bp, Artificial Sequence
  Synthetic Polynucleotide
taatacgactcactatagggtccggcggaggctcagcgcgctccgggggcaacagaggagagcccccatggcgcgctgaaacctggcggcagcgcaaaagatg

SEQ ID NO: 187933 - DNA, 103 bp, Artificial Sequence
  Synthetic Polynucleotide
taatacgactcactataggggcgcaggctgtccggcggaggctcagcgcgaacagaggagacgcgctatgcctccgccgaacctggcggcagcgcaaaagatg

SEQ ID NO: 187934 - DNA, 103 bp, Artificial Sequence
  Synthetic Polynucleotide
taatacgactcactatagggtgaggaaggccgaaccgccggggtctccggaacagaggagaccggagatgccggcggttaacctggcggcagcgcaaaagatg

SEQ ID NO: 187935 - DNA, 103 bp, Artificial Sequence
  Synthetic Polynucleotide
taatacgactcactatagggcgggccgcgggcgcaggctgtccggcggagaacagaggagactccgcatgacagcctgcaacctggcggcagcgcaaaagatg

SEQ ID NO: 187936 - DNA, 103 bp, Artificial Sequence
  Synthetic Polynucleotide
taatacgactcactataggggagagagaggcgggccgcgggcgcaggctgaacagaggagacagcctatgcccgcggccaacctggcggcagcgcaaaagatg

SEQ ID NO: 187937 - DNA, 103 bp, Artificial Sequence
  Synthetic Polynucleotide
taatacgactcactatagggcgaggcggaggagagagaggcgggccgcggaacagaggagaccgcggatggcctctctcaacctggcggcagcgcaaaagatg

SEQ ID NO: 187938 - DNA, 103 bp, Artificial Sequence
  Synthetic Polynucleotide
taatacgactcactatagggccggcgtggacgaggcggaggagagagaggaacagaggagacctctcatgcctccgcctaacctggcggcagcgcaaaagatg

SEQ ID NO: 187939 - DNA, 103 bp, Artificial Sequence
  Synthetic Polynucleotide
taatacgactcactataggggaagaggaagccggcgtggacgaggcggagaacagaggagactccgcatggtccacgccaacctggcggcagcgcaaaagatg

SEQ ID NO: 187940 - DNA, 103 bp, Artificial Sequence
  Synthetic Polynucleotide
taatacgactcactatagggggcggaggtggaagaggaagccggcgtggaaacagaggagatccacgatggcttcctctaacctggcggcagcgcaaaagatg

SEQ ID NO: 187941 - DNA, 103 bp, Artificial Sequence
  Synthetic Polynucleotide
taatacgactcactatagggaggcggaggaggcggaggtggaagaggaagaacagaggagacttcctatgccacctccgaacctggcggcagcgcaaaagatg

SEQ ID NO: 187942 - DNA, 103 bp, Artificial Sequence
  Synthetic Polynucleotide
taatacgactcactataggggcgcaggaggaggcggaggaggcggaggtgaacagaggagacacctcatgctcctccgcaacctggcggcagcgcaaaagatg

SEQ ID NO: 187943 - DNA, 103 bp, Artificial Sequence
  Synthetic Polynucleotide
taatacgactcactatagggggccgcagcagcgcaggaggaggcggaggaaacagaggagatcctccatgtcctcctgcaacctggcggcagcgcaaaagatg

SEQ ID NO: 187944 - DNA, 103 bp, Artificial Sequence
  Synthetic Polynucleotide
taatacgactcactatagggcggcggcagcggccgcagcagcgcaggaggaacagaggagacctcctatgctgctgcggaacctggcggcagcgcaaaagatg

SEQ ID NO: 187945 - DNA, 103 bp, Artificial Sequence
  Synthetic Polynucleotide
taatacgactcactataggggggtccactttgaggaaggccgaaccgccgaacagaggagacggcggatgggccttcctaacctggcggcagcgcaaaagatg

SEQ ID NO: 187946 - DNA, 103 bp, Artificial Sequence
  Synthetic Polynucleotide
taatacgactcactatagggccagccagcgcggcggcagcggccgcagcaaacagaggagatgctgcatgcgctgccgcaacctggcggcagcgcaaaagatg

SEQ ID NO: 187947 - DNA, 103 bp, Artificial Sequence
  Synthetic Polynucleotide
taatacgactcactatagggggccgagagaccagccagcgcggcggcagcaacagaggagagctgccatggcgctggctaacctggcggcagcgcaaaagatg

SEQ ID NO: 187948 - DNA, 103 bp, Artificial Sequence
  Synthetic Polynucleotide
taatacgactcactatagggacaccggcagggccgagagaccagccagcgaacagaggagacgctggatggtctctcggaacctggcggcagcgcaaaagatg

SEQ ID NO: 187949 - DNA, 103 bp, Artificial Sequence
  Synthetic Polynucleotide
taatacgactcactatagggggcagctgcgacaccggcagggccgagagaaacagaggagatctctcatgcctgccggtaacctggcggcagcgcaaaagatg

SEQ ID NO: 187950 - DNA, 103 bp, Artificial Sequence
  Synthetic Polynucleotide
taatacgactcactatagggcgcgaacaccggcagctgcgacaccggcagaacagaggagactgccgatgtcgcagctgaacctggcggcagcgcaaaagatg

SEQ ID NO: 187951 - DNA, 103 bp, Artificial Sequence
  Synthetic Polynucleotide
taatacgactcactatagggcggctagaggcgcgaacaccggcagctgcgaacagaggagacgcagcatgcggtgttcgaacctggcggcagcgcaaaagatg

SEQ ID NO: 187952 - DNA, 103 bp, Artificial Sequence
  Synthetic Polynucleotide
taatacgactcactatagggacggcagcggcggctagaggcgcgaacaccaacagaggagaggtgttatggcctctagcaacctggcggcagcgcaaaagatg

SEQ ID NO: 187953 - DNA, 103 bp, Artificial Sequence
  Synthetic Polynucleotide
taatacgactcactatagggctcggcggcgacggcagcggcggctagaggaacagaggagacctctaatggccgctgccaacctggcggcagcgcaaaagatg

SEQ ID NO: 187954 - DNA, 103 bp, Artificial Sequence
  Synthetic Polynucleotide
taatacgactcactatagggggggcagcggctcggcggcgacggcagcggaacagaggagaccgctgatgtcgccgccgaacctggcggcagcgcaaaagatg

SEQ ID NO: 187955 - DNA, 103 bp, Artificial Sequence
  Synthetic Polynucleotide
taatacgactcactatagggagttccttggggggcagcggctcggcggcgaacagaggagacgccgcatggccgctgccaacctggcggcagcgcaaaagatg

SEQ ID NO: 187956 - DNA, 103 bp, Artificial Sequence
  Synthetic Polynucleotide
taatacgactcactatagggcaggtaggctgggtccactttgaggaaggcaacagaggagagccttcatgaaagtggacaacctggcggcagcgcaaaagatg

SEQ ID NO: 187957 - DNA, 103 bp, Artificial Sequence
  Synthetic Polynucleotide
taatacgactcactataggggccgaggcacagttccttggggggcagcggaacagaggagaccgctgatgcccaaggaaaacctggcggcagcgcaaaagatg

SEQ ID NO: 187958 - DNA, 103 bp, Artificial Sequence
  Synthetic Polynucleotide
taatacgactcactatagggcggaggtggcgccgaggcacagttccttggaacagaggagaccaaggatgtgtgcctcgaacctggcggcagcgcaaaagatg

SEQ ID NO: 187959 - DNA, 103 bp, Artificial Sequence
  Synthetic Polynucleotide
taatacgactcactatagggggcccggggccggaggtggcgccgaggcacaacagaggagagtgcctatgcgccacctcaacctggcggcagcgcaaaagatg

SEQ ID NO: 187960 - DNA, 103 bp, Artificial Sequence
  Synthetic Polynucleotide
taatacgactcactataggggcacttgacgggcccggggccggaggtggcaacagaggagagccaccatgggccccgggaacctggcggcagcgcaaaagatg

SEQ ID NO: 187961 - DNA, 103 bp, Artificial Sequence
  Synthetic Polynucleotide
taatacgactcactatagggcaccaccaccgcacttgacgggcccggggcaacagaggagagccccgatgccgtcaagtaacctggcggcagcgcaaaagatg

SEQ ID NO: 187962 - DNA, 103 bp, Artificial Sequence
  Synthetic Polynucleotide
taatacgactcactatagggccgccgccgccaccaccaccgcacttgacgaacagaggagacgtcaaatgcggtggtggaacctggcggcagcgcaaaagatg

SEQ ID NO: 187963 - DNA, 103 bp, Artificial Sequence
  Synthetic Polynucleotide
taatacgactcactatagggaccctccccgccgccgccgccaccaccaccaacagaggagaggtggtatgggcggcggcaacctggcggcagcgcaaaagatg

SEQ ID NO: 187964 - DNA, 103 bp, Artificial Sequence
  Synthetic Polynucleotide
taatacgactcactataggggggcgccgcgaccctccccgccgccgccgcaacagaggagagcggcgatggcggggaggaacctggcggcagcgcaaaagatg

SEQ ID NO: 187965 - DNA, 103 bp, Artificial Sequence
  Synthetic Polynucleotide
taatacgactcactatagggcggaagcgcggggcgccgcgaccctccccgaacagaggagacggggaatgtcgcggcgcaacctggcggcagcgcaaaagatg

SEQ ID NO: 187966 - DNA, 103 bp, Artificial Sequence
  Synthetic Polynucleotide
taatacgactcactatagggtgcgctgcagcggaagcgcggggcgccgcgaacagaggagacgcggcatgccgcgcttcaacctggcggcagcgcaaaagatg

SEQ ID NO: 187967 - DNA, 103 bp, Artificial Sequence
  Synthetic Polynucleotide
taatacgactcactataggggccagtgctgcaggtaggctgggtccacttaacagaggagaaagtggatgcagcctaccaacctggcggcagcgcaaaagatg

SEQ ID NO: 187968 - DNA, 103 bp, Artificial Sequence
  Synthetic Polynucleotide
taatacgactcactatagggccagctcctctgcgctgcagcggaagcgcgaacagaggagacgcgctatggctgcagcgaacctggcggcagcgcaaaagatg

SEQ ID NO: 187969 - DNA, 103 bp, Artificial Sequence
  Synthetic Polynucleotide
taatacgactcactatagggaggtaatagtccagctcctctgcgctgcagaacagaggagactgcagatgagaggagctaacctggcggcagcgcaaaagatg

SEQ ID NO: 187970 - DNA, 103 bp, Artificial Sequence
  Synthetic Polynucleotide
taatacgactcactatagggctggccatacaggtaatagtccagctcctcaacagaggagagaggagatggactattacaacctggcggcagcgcaaaagatg

SEQ ID NO: 187971 - DNA, 103 bp, Artificial Sequence
  Synthetic Polynucleotide
taatacgactcactatagggccatgcgctgctggccatacaggtaatagtaacagaggagaactattatgtgtatggccaacctggcggcagcgcaaaagatg

SEQ ID NO: 187972 - DNA, 103 bp, Artificial Sequence
  Synthetic Polynucleotide
taatacgactcactataggggggatgatctccatgcgctgctggccatacaacagaggagagtatggatggcagcgcataacctggcggcagcgcaaaagatg

SEQ ID NO: 187973 - DNA, 103 bp, Artificial Sequence
  Synthetic Polynucleotide
taatacgactcactatagggctggttgagcgggatgatctccatgcgctgaacagaggagacagcgcatggagatcatcaacctggcggcagcgcaaaagatg

SEQ ID NO: 187974 - DNA, 103 bp, Artificial Sequence
  Synthetic Polynucleotide
taatacgactcactatagggcgctggtgtgctggttgagcgggatgatctaacagaggagaagatcaatgcgctcaaccaacctggcggcagcgcaaaagatg

SEQ ID NO: 187975 - DNA, 103 bp, Artificial Sequence
  Synthetic Polynucleotide
taatacgactcactatagggttgttggggtcgctggtgtgctggttgagcaacagaggagagctcaaatggcacaccagaacctggcggcagcgcaaaagatg

SEQ ID NO: 187976 - DNA, 103 bp, Artificial Sequence
  Synthetic Polynucleotide
taatacgactcactataggggtcgcaacggttgttggggtcgctggtgtgaacagaggagacacaccatggaccccaacaacctggcggcagcgcaaaagatg

SEQ ID NO: 187977 - DNA, 103 bp, Artificial Sequence
  Synthetic Polynucleotide
taatacgactcactatagggccgcgcacatgtcgcaacggttgttggggtaacagaggagaaccccaatgaccgttgcgaacctggcggcagcgcaaaagatg

SEQ ID NO: 187978 - DNA, 103 bp, Artificial Sequence
  Synthetic Polynucleotide
taatacgactcactatagggaagagttgctgccagtgctgcaggtaggctaacagaggagaagcctaatggcagcactgaacctggcggcagcgcaaaagatg

SEQ ID NO: 187979 - DNA, 103 bp, Artificial Sequence
  Synthetic Polynucleotide
taatacgactcactatagggttgcggttgtccgcgcacatgtcgcaacggaacagaggagaccgttgatgcatgtgcgcaacctggcggcagcgcaaaagatg

SEQ ID NO: 187980 - DNA, 103 bp, Artificial Sequence
  Synthetic Polynucleotide
taatacgactcactataggggcactcgccgttgcggttgtccgcgcacataacagaggagaatgtgcatggacaaccgcaacctggcggcagcgcaaaagatg

SEQ ID NO: 187981 - DNA, 103 bp, Artificial Sequence
  Synthetic Polynucleotide
taatacgactcactatagggcatgcatagggcactcgccgttgcggttgtaacagaggagaacaaccatgacggcgagtaacctggcggcagcgcaaaagatg

SEQ ID NO: 187982 - DNA, 103 bp, Artificial Sequence
  Synthetic Polynucleotide
taatacgactcactatagggtgcagtggcccatgcatagggcactcgccgaacagaggagacggcgaatgccctatgcaaacctggcggcagcgcaaaagatg

SEQ ID NO: 187983 - DNA, 103 bp, Artificial Sequence
  Synthetic Polynucleotide
taatacgactcactataggggcgcagcgagtgcagtggcccatgcataggaacagaggagacctatgatggggccactgaacctggcggcagcgcaaaagatg

SEQ ID NO: 187984 - DNA, 103 bp, Artificial Sequence
  Synthetic Polynucleotide
taatacgactcactatagggccacaagccggcgcagcgagtgcagtggccaacagaggagaggccacatgactcgctgcaacctggcggcagcgcaaaagatg

SEQ ID NO: 187985 - DNA, 103 bp, Artificial Sequence
  Synthetic Polynucleotide
taatacgactcactatagggctgctggtgcccacaagccggcgcagcgagaacagaggagactcgctatgccggcttgtaacctggcggcagcgcaaaagatg

SEQ ID NO: 187986 - DNA, 103 bp, Artificial Sequence
  Synthetic Polynucleotide
taatacgactcactatagggggccgcagcgctgctggtgcccacaagccgaacagaggagacggcttatgggcaccagcaacctggcggcagcgcaaaagatg

SEQ ID NO: 187987 - DNA, 103 bp, Artificial Sequence
  Synthetic Polynucleotide
taatacgactcactatagggggggcgcggcggccgcagcgctgctggtgcaacagaggagagcaccaatggcgctgcggaacctggcggcagcgcaaaagatg

SEQ ID NO: 187988 - DNA, 103 bp, Artificial Sequence
  Synthetic Polynucleotide
taatacgactcactatagggagctccggcgggggcgcggcggccgcagcgaacagaggagacgctgcatgcgccgcgccaacctggcggcagcgcaaaagatg

SEQ ID NO: 187989 - DNA, 103 bp, Artificial Sequence
  Synthetic Polynucleotide
taatacgactcactatagggtccgtgagggaagagttgctgccagtgctgaacagaggagacagcacatgcagcaactcaacctggcggcagcgcaaaagatg

SEQ ID NO: 187990 - DNA, 103 bp, Artificial Sequence
  Synthetic Polynucleotide
taatacgactcactatagggccactccggcagctccggcgggggcgcggcaacagaggagagccgcgatgccgccggagaacctggcggcagcgcaaaagatg

SEQ ID NO: 187991 - DNA, 103 bp, Artificial Sequence
  Synthetic Polynucleotide
taatacgactcactatagggggtcccgcagccactccggcagctccggcgaacagaggagacgccggatgtgccggagtaacctggcggcagcgcaaaagatg

SEQ ID NO: 187992 - DNA, 103 bp, Artificial Sequence
  Synthetic Polynucleotide
taatacgactcactatagggtcgcgaggcaggtcccgcagccactccggcaacagaggagagccggaatggctgcgggaaacctggcggcagcgcaaaagatg

SEQ ID NO: 187993 - DNA, 103 bp, Artificial Sequence
  Synthetic Polynucleotide
taatacgactcactataggggaggcacacctcgcgaggcaggtcccgcagaacagaggagactgcggatgctgcctcgcaacctggcggcagcgcaaaagatg

SEQ ID NO: 187994 - DNA, 103 bp, Artificial Sequence
  Synthetic Polynucleotide
taatacgactcactatagggtactggtgcagaggcacacctcgcgaggcaaacagaggagatgcctcatgaggtgtgccaacctggcggcagcgcaaaagatg

SEQ ID NO: 187995 - DNA, 103 bp, Artificial Sequence
  Synthetic Polynucleotide
taatacgactcactatagggccgggcacagtactggtgcagaggcacaccaacagaggagaggtgtgatgctgcaccagaacctggcggcagcgcaaaagatg

SEQ ID NO: 187996 - DNA, 103 bp, Artificial Sequence
  Synthetic Polynucleotide
taatacgactcactataggggtaggccaggccgggcacagtactggtgcaaacagaggagatgcaccatgactgtgcccaacctggcggcagcgcaaaagatg

SEQ ID NO: 187997 - DNA, 103 bp, Artificial Sequence
  Synthetic Polynucleotide
taatacgactcactatagggcgcagatgccgtaggccaggccgggcacagaacagaggagactgtgcatggcctggcctaacctggcggcagcgcaaaagatg

SEQ ID NO: 187998 - DNA, 103 bp, Artificial Sequence
  Synthetic Polynucleotide
taatacgactcactatagggctctgcgccgcgcagatgccgtaggccaggaacagaggagacctggcatgcggcatctgaacctggcggcagcgcaaaagatg

SEQ ID NO: 187999 - DNA, 103 bp, Artificial Sequence
  Synthetic Polynucleotide
taatacgactcactatagggttgctggatcctctgcgccgcgcagatgccaacagaggagaggcatcatggcggcgcagaacctggcggcagcgcaaaagatg

SEQ ID NO: 188000 - DNA, 103 bp, Artificial Sequence
  Synthetic Polynucleotide
taatacgactcactatagggggcctgcgcctccgtgagggaagagttgctaacagaggagaagcaacatgtccctcacgaacctggcggcagcgcaaaagatg

SEQ ID NO: 188001 - DNA, 103 bp, Artificial Sequence
  Synthetic Polynucleotide
taatacgactcactatagggtccaggtgccttgctggatcctctgcgccgaacagaggagacggcgcatgggatccagcaacctggcggcagcgcaaaagatg

SEQ ID NO: 188002 - DNA, 103 bp, Artificial Sequence
  Synthetic Polynucleotide
taatacgactcactatagggaaaggtccaatccaggtgccttgctggatcaacagaggagagatccaatgaggcacctgaacctggcggcagcgcaaaagatg

SEQ ID NO: 188003 - DNA, 103 bp, Artificial Sequence
  Synthetic Polynucleotide
taatacgactcactatagggcacgccttggaaaggtccaatccaggtgccaacagaggagaggcaccatgattggacctaacctggcggcagcgcaaaagatg

SEQ ID NO: 188004 - DNA, 103 bp, Artificial Sequence
  Synthetic Polynucleotide
taatacgactcactatagggggggcagaagcacgccttggaaaggtccaaaacagaggagattggacatgtccaaggcgaacctggcggcagcgcaaaagatg

SEQ ID NO: 188005 - DNA, 103 bp, Artificial Sequence
  Synthetic Polynucleotide
taatacgactcactatagggaccttctctgggggcagaagcacgccttggaacagaggagaccaaggatggcttctgccaacctggcggcagcgcaaaagatg

SEQ ID NO: 188006 - DNA, 103 bp, Artificial Sequence
  Synthetic Polynucleotide
taatacgactcactataggggcctgcctgcaccttctctgggggcagaagaacagaggagacttctgatgccagagaagaacctggcggcagcgcaaaagatg

SEQ ID NO: 188007 - DNA, 103 bp, Artificial Sequence
  Synthetic Polynucleotide
taatacgactcactatagggtcctcacggcgcctgcctgcaccttctctgaacagaggagacagagaatgtgcaggcagaacctggcggcagcgcaaaagatg

SEQ ID NO: 188008 - DNA, 103 bp, Artificial Sequence
  Synthetic Polynucleotide
taatacgactcactatagggtgctgcgtgttcctcacggcgcctgcctgcaacagaggagagcaggcatgcgccgtgagaacctggcggcagcgcaaaagatg

SEQ ID NO: 188009 - DNA, 103 bp, Artificial Sequence
  Synthetic Polynucleotide
taatacgactcactatagggctcccagagatgctgcgtgttcctcacggcaacagaggagagccgtgatgaacacgcagaacctggcggcagcgcaaaagatg

SEQ ID NO: 188010 - DNA, 103 bp, Artificial Sequence
  Synthetic Polynucleotide
taatacgactcactatagggggtcatatatctcccagagatgctgcgtgtaacagaggagaacacgcatgatctctgggaacctggcggcagcgcaaaagatg

SEQ ID NO: 188011 - DNA, 103 bp, Artificial Sequence
  Synthetic Polynucleotide
taatacgactcactatagggcccttgagcgggcctgcgcctccgtgagggaacagaggagaccctcaatgaggcgcaggaacctggcggcagcgcaaaagatg

SEQ ID NO: 188012 - DNA, 103 bp, Artificial Sequence
  Synthetic Polynucleotide
taatacgactcactataggggtcccatcctggtcatatatctcccagagaaacagaggagatctctgatggatatatgaaacctggcggcagcgcaaaagatg

SEQ ID NO: 188013 - DNA, 103 bp, Artificial Sequence
  Synthetic Polynucleotide
taatacgactcactataggggtgctgtagtgtcccatcctggtcatatataacagaggagaatatatatgcaggatgggaacctggcggcagcgcaaaagatg

SEQ ID NO: 188014 - DNA, 103 bp, Artificial Sequence
  Synthetic Polynucleotide
taatacgactcactatagggcatcaataaagtgctgtagtgtcccatcctaacagaggagaaggatgatgcactacagcaacctggcggcagcgcaaaagatg

SEQ ID NO: 188015 - DNA, 103 bp, Artificial Sequence
  Synthetic Polynucleotide
taatacgactcactatagggggttccccaccatcaataaagtgctgtagtaacagaggagaactacaatgctttattgaaacctggcggcagcgcaaaagatg

SEQ ID NO: 188016 - DNA, 103 bp, Artificial Sequence
  Synthetic Polynucleotide
taatacgactcactatagggcgacttactaggttccccaccatcaataaaaacagaggagatttattatgggtggggaaaacctggcggcagcgcaaaagatg

SEQ ID NO: 188017 - DNA, 103 bp, Artificial Sequence
  Synthetic Polynucleotide
taatacgactcactatagggtcatccagctcgacttactaggttccccacaacagaggagagtggggatgctagtaagtaacctggcggcagcgcaaaagatg

SEQ ID NO: 188018 - DNA, 103 bp, Artificial Sequence
  Synthetic Polynucleotide
taatacgactcactatagggcggatatacctcatccagctcgacttactaaacagaggagatagtaaatggagctggataacctggcggcagcgcaaaagatg

SEQ ID NO: 188019 - DNA, 103 bp, Artificial Sequence
  Synthetic Polynucleotide
taatacgactcactatagggccttgcacatcggatatacctcatccagctaacagaggagaagctggatgaggtatatcaacctggcggcagcgcaaaagatg

SEQ ID NO: 188020 - DNA, 103 bp, Artificial Sequence
  Synthetic Polynucleotide
taatacgactcactatagggctccgcagtgccttgcacatcggatataccaacagaggagaggtataatggatgtgcaaaacctggcggcagcgcaaaagatg

SEQ ID NO: 188021 - DNA, 103 bp, Artificial Sequence
  Synthetic Polynucleotide
taatacgactcactatagggagattctgttctccgcagtgccttgcacataacagaggagaatgtgcatggcactgcggaacctggcggcagcgcaaaagatg

SEQ ID NO: 188022 - DNA, 103 bp, Artificial Sequence
  Synthetic Polynucleotide
taatacgactcactataggggctctcctcttgggacctttcagggctcataacagaggagaatgagcatggaaaggtccaacctggcggcagcgcaaaagatg

SEQ ID NO: 188023 - DNA, 103 bp, Artificial Sequence
  Synthetic Polynucleotide
taatacgactcactatagggccattcttccttggtgaagtatatggaaataacagaggagaatttccatgtacttcaccaacctggcggcagcgcaaaagatg

SEQ ID NO: 188024 - DNA, 103 bp, Artificial Sequence
  Synthetic Polynucleotide
taatacgactcactataggggaagatctgcctgtggtactggaaggccacaacagaggagagtggccatgcagtaccacaacctggcggcagcgcaaaagatg

SEQ ID NO: 188025 - DNA, 103 bp, Artificial Sequence
  Synthetic Polynucleotide
taatacgactcactatagggaggttctatagaagatctgcctgtggtactaacagaggagaagtaccatgggcagatctaacctggcggcagcgcaaaagatg

SEQ ID NO: 188026 - DNA, 103 bp, Artificial Sequence
  Synthetic Polynucleotide
taatacgactcactatagggatgactcggcaggttctatagaagatctgcaacagaggagagcagatatgctatagaacaacctggcggcagcgcaaaagatg

SEQ ID NO: 188027 - DNA, 103 bp, Artificial Sequence
  Synthetic Polynucleotide
taatacgactcactataggggcctggcctaatgactcggcaggttctataaacagaggagatatagaatgtgccgagtcaacctggcggcagcgcaaaagatg

SEQ ID NO: 188028 - DNA, 103 bp, Artificial Sequence
  Synthetic Polynucleotide
taatacgactcactataggggcagttcacagcctggcctaatgactcggcaacagaggagagccgagatgttaggccagaacctggcggcagcgcaaaagatg

SEQ ID NO: 188029 - DNA, 103 bp, Artificial Sequence
  Synthetic Polynucleotide
taatacgactcactataggggaccagaccagcagttcacagcctggcctaaacagaggagataggccatgctgtgaactaacctggcggcagcgcaaaagatg

SEQ ID NO: 188030 - DNA, 103 bp, Artificial Sequence
  Synthetic Polynucleotide
taatacgactcactatagggctcatccccagaccagaccagcagttcacaaacagaggagatgtgaaatgctggtctggaacctggcggcagcgcaaaagatg

SEQ ID NO: 188031 - DNA, 103 bp, Artificial Sequence
  Synthetic Polynucleotide
taatacgactcactatagggcctggccatactcatccccagaccagaccaaacagaggagatggtctatgctggggatgaacctggcggcagcgcaaaagatg

SEQ ID NO: 188032 - DNA, 103 bp, Artificial Sequence
  Synthetic Polynucleotide
taatacgactcactatagggatgcccagttcctggccatactcatccccaaacagaggagatggggaatggtatggccaaacctggcggcagcgcaaaagatg

SEQ ID NO: 188033 - DNA, 103 bp, Artificial Sequence
  Synthetic Polynucleotide
taatacgactcactatagggagaagatctgatgcccagttcctggccataaacagaggagatatggcatggaactgggcaacctggcggcagcgcaaaagatg

SEQ ID NO: 188034 - DNA, 103 bp, Artificial Sequence
  Synthetic Polynucleotide
taatacgactcactatagggccatttctgcccattcttccttggtgaagtaacagaggagaacttcaatgaggaagaataacctggcggcagcgcaaaagatg

SEQ ID NO: 188035 - DNA, 103 bp, Artificial Sequence
  Synthetic Polynucleotide
taatacgactcactatagggcaggttctatagaagatctgatgcccagttaacagaggagaaactggatgtcagatcttaacctggcggcagcgcaaaagatg

SEQ ID NO: 188036 - DNA, 103 bp, Artificial Sequence
  Synthetic Polynucleotide
taatacgactcactatagggaatgactcggcaggttctatagaagatctgaacagaggagacagatcatgtatagaaccaacctggcggcagcgcaaaagatg

SEQ ID NO: 188037 - DNA, 103 bp, Artificial Sequence
  Synthetic Polynucleotide
taatacgactcactatagggagcctggcctaatgactcggcaggttctataacagaggagaatagaaatggccgagtcaaacctggcggcagcgcaaaagatg

SEQ ID NO: 188038 - DNA, 103 bp, Artificial Sequence
  Synthetic Polynucleotide
taatacgactcactatagggagcagttcacagcctggcctaatgactcggaacagaggagaccgagtatgtaggccaggaacctggcggcagcgcaaaagatg

SEQ ID NO: 188039 - DNA, 103 bp, Artificial Sequence
  Synthetic Polynucleotide
taatacgactcactatagggataccagaccagcagttcacagcctggcctaacagaggagaaggccaatgtgtgaactgaacctggcggcagcgcaaaagatg

SEQ ID NO: 188040 - DNA, 103 bp, Artificial Sequence
  Synthetic Polynucleotide
taatacgactcactatagggactcatccccataccagaccagcagttcacaacagaggagagtgaacatgtggtctggtaacctggcggcagcgcaaaagatg

SEQ ID NO: 188041 - DNA, 103 bp, Artificial Sequence
  Synthetic Polynucleotide
taatacgactcactatagggtcctggccatactcatccccataccagaccaacagaggagaggtctgatgtggggatgaaacctggcggcagcgcaaaagatg

SEQ ID NO: 188042 - DNA, 103 bp, Artificial Sequence
  Synthetic Polynucleotide
taatacgactcactataggggatgcccagttcctggccatactcatccccaacagaggagaggggatatgtatggccagaacctggcggcagcgcaaaagatg

SEQ ID NO: 188043 - DNA, 103 bp, Artificial Sequence
  Synthetic Polynucleotide
taatacgactcactatagggtgccccacttgatgcccagttcctggccataacagaggagaatggccatgaactgggcaaacctggcggcagcgcaaaagatg

SEQ ID NO: 188044 - DNA, 103 bp, Artificial Sequence
  Synthetic Polynucleotide
taatacgactcactatagggttccacttgctgccccacttgatgcccagtaacagaggagaactgggatgcaagtggggaacctggcggcagcgcaaaagatg

SEQ ID NO: 188045 - DNA, 103 bp, Artificial Sequence
  Synthetic Polynucleotide
taatacgactcactatagggtcccagtctcccatttctgcccattcttccaacagaggagaggaagaatgggcagaaataacctggcggcagcgcaaaagatg

SEQ ID NO: 188046 - DNA, 103 bp, Artificial Sequence
  Synthetic Polynucleotide
taatacgactcactataggggagctctttcttccacttgctgccccacttaacagaggagaaagtggatgagcaagtggaacctggcggcagcgcaaaagatg

SEQ ID NO: 188047 - DNA, 103 bp, Artificial Sequence
  Synthetic Polynucleotide
taatacgactcactatagggtccctgccatgagctctttcttccacttgcaacagaggagagcaagtatgagaaagagcaacctggcggcagcgcaaaagatg

SEQ ID NO: 188048 - DNA, 103 bp, Artificial Sequence
  Synthetic Polynucleotide
taatacgactcactatagggtttggttctctccctgccatgagctctttcaacagaggagagaaagaatgcatggcaggaacctggcggcagcgcaaaagatg

SEQ ID NO: 188049 - DNA, 103 bp, Artificial Sequence
  Synthetic Polynucleotide
taatacgactcactataggggatctctggctttggttctctccctgccataacagaggagaatggcaatgagagaaccaaacctggcggcagcgcaaaagatg

SEQ ID NO: 188050 - DNA, 103 bp, Artificial Sequence
  Synthetic Polynucleotide
taatacgactcactataggggacatggatggatctctggctttggttctcaacagaggagagagaacatgagccagagaaacctggcggcagcgcaaaagatg

SEQ ID NO: 188051 - DNA, 103 bp, Artificial Sequence
  Synthetic Polynucleotide
taatacgactcactatagggcagcatgagggacatggatggatctctggcaacagaggagagccagaatgccatccatgaacctggcggcagcgcaaaagatg

SEQ ID NO: 188052 - DNA, 103 bp, Artificial Sequence
  Synthetic Polynucleotide
taatacgactcactatagggaaaggccagacagcatgagggacatggatgaacagaggagacatccaatgccctcatgcaacctggcggcagcgcaaaagatg

SEQ ID NO: 188053 - DNA, 103 bp, Artificial Sequence
  Synthetic Polynucleotide
taatacgactcactatagggtttgacttgaaaaggccagacagcatgaggaacagaggagacctcatatggtctggcctaacctggcggcagcgcaaaagatg

SEQ ID NO: 188054 - DNA, 103 bp, Artificial Sequence
  Synthetic Polynucleotide
taatacgactcactatagggctgagaaatttttgacttgaaaaggccagaaacagaggagatctggcatgttcaagtcaaacctggcggcagcgcaaaagatg

SEQ ID NO: 188055 - DNA, 103 bp, Artificial Sequence
  Synthetic Polynucleotide
taatacgactcactatagggcacatgttgactgagaaatttttgacttgaaacagaggagatcaagtatgaaatttctcaacctggcggcagcgcaaaagatg

SEQ ID NO: 188056 - DNA, 103 bp, Artificial Sequence
  Synthetic Polynucleotide
taatacgactcactataggggcgagttttctcccagtctcccatttctgcaacagaggagagcagaaatgggagactggaacctggcggcagcgcaaaagatg

SEQ ID NO: 188057 - DNA, 103 bp, Artificial Sequence
  Synthetic Polynucleotide
taatacgactcactataggggattgcgttccacatgttgactgagaaattaacagaggagaaatttcatggtcaacatgaacctggcggcagcgcaaaagatg

SEQ ID NO: 188058 - DNA, 103 bp, Artificial Sequence
  Synthetic Polynucleotide
taatacgactcactatagggtgagaggagtgattgcgttccacatgttgaaacagaggagatcaacaatgggaacgcaaaacctggcggcagcgcaaaagatg

SEQ ID NO: 188059 - DNA, 103 bp, Artificial Sequence
  Synthetic Polynucleotide
taatacgactcactatagggtgggaagttctgagaggagtgattgcgttcaacagaggagagaacgcatgcactcctctaacctggcggcagcgcaaaagatg

SEQ ID NO: 188060 - DNA, 103 bp, Artificial Sequence
  Synthetic Polynucleotide
taatacgactcactatagggcagatggtcctgggaagttctgagaggagtaacagaggagaactcctatgagaacttccaacctggcggcagcgcaaaagatg

SEQ ID NO: 188061 - DNA, 103 bp, Artificial Sequence
  Synthetic Polynucleotide
taatacgactcactatagggagttttcttgcagatggtcctgggaagttcaacagaggagagaacttatgaggaccatcaacctggcggcagcgcaaaagatg

SEQ ID NO: 188062 - DNA, 103 bp, Artificial Sequence
  Synthetic Polynucleotide
taatacgactcactatagggtggttggagaagttttcttgcagatggtccaacagaggagaggaccaatggcaagaaaaaacctggcggcagcgcaaaagatg

SEQ ID NO: 188063 - DNA, 103 bp, Artificial Sequence
  Synthetic Polynucleotide
taatacgactcactatagggagggattctctggttggagaagttttcttgaacagaggagacaagaaatgttctccaacaacctggcggcagcgcaaaagatg

SEQ ID NO: 188064 - DNA, 103 bp, Artificial Sequence
  Synthetic Polynucleotide
taatacgactcactatagggtcccctgggcagggattctctggttggagaaacagaggagatctccaatgagagaatccaacctggcggcagcgcaaaagatg

SEQ ID NO: 188065 - DNA, 103 bp, Artificial Sequence
  Synthetic Polynucleotide
taatacgactcactatagggctgattctgatcccctgggcagggattctcaacagaggagagagaatatgtgcccagggaacctggcggcagcgcaaaagatg

SEQ ID NO: 188066 - DNA, 103 bp, Artificial Sequence
  Synthetic Polynucleotide
taatacgactcactatagggattgccgctcctgattctgatcccctgggcaacagaggagagcccagatgatcagaatcaacctggcggcagcgcaaaagatg

SEQ ID NO: 188067 - DNA, 103 bp, Artificial Sequence
  Synthetic Polynucleotide
taatacgactcactatagggcattcctatagcgagttttctcccagtctcaacagaggagagagactatgagaaaactcaacctggcggcagcgcaaaagatg

SEQ ID NO: 188068 - DNA, 103 bp, Artificial Sequence
  Synthetic Polynucleotide
taatacgactcactatagggggatcagaatattgccgctcctgattctgaaacagaggagatcagaaatgggagcggcaaacctggcggcagcgcaaaagatg

SEQ ID NO: 188069 - DNA, 103 bp, Artificial Sequence
  Synthetic Polynucleotide
taatacgactcactatagggacagcagcgtggatcagaatattgccgctcaacagaggagagagcggatgtattctgataacctggcggcagcgcaaaagatg

SEQ ID NO: 188070 - DNA, 103 bp, Artificial Sequence
  Synthetic Polynucleotide
taatacgactcactatagggttttgtcattacagcagcgtggatcagaataacagaggagaattctgatgcacgctgctaacctggcggcagcgcaaaagatg

SEQ ID NO: 188071 - DNA, 103 bp, Artificial Sequence
  Synthetic Polynucleotide
taatacgactcactatagggtgacctttggttttgtcattacagcagcgtaacagaggagaacgctgatgtaatgacaaaacctggcggcagcgcaaaagatg

SEQ ID NO: 188072 - DNA, 103 bp, Artificial Sequence
  Synthetic Polynucleotide
taatacgactcactatagggtttgatctcttgacctttggttttgtcattaacagaggagaaatgacatgaccaaaggtaacctggcggcagcgcaaaagatg

SEQ ID NO: 188073 - DNA, 103 bp, Artificial Sequence
  Synthetic Polynucleotide
taatacgactcactatagggtggacctttctttgatctcttgacctttggaacagaggagaccaaagatgaagagatcaaacctggcggcagcgcaaaagatg

SEQ ID NO: 188074 - DNA, 103 bp, Artificial Sequence
  Synthetic Polynucleotide
taatacgactcactatagggttcattttcacattcctatagcgagttttcaacagaggagagaaaacatgctataggaaaacctggcggcagcgcaaaagatg

SEQ ID NO: 188075 - DNA, 103 bp, Artificial Sequence
  Synthetic Polynucleotide
taatacgactcactatagggtgcattatagttcattttcacattcctataaacagaggagatataggatggtgaaaatgaacctggcggcagcgcaaaagatg

SEQ ID NO: 188076 - DNA, 103 bp, Artificial Sequence
  Synthetic Polynucleotide
taatacgactcactatagggcagtaatcagtgcattatagttcattttcaaacagaggagatgaaaaatgactataatgaacctggcggcagcgcaaaagatg

SEQ ID NO: 188077 - DNA, 103 bp, Artificial Sequence
  Synthetic Polynucleotide
taatacgactcactatagggctgagacctacagtaatcagtgcattatagaacagaggagactataaatgactgattacaacctggcggcagcgcaaaagatg

SEQ ID NO: 188078 - DNA, 103 bp, Artificial Sequence
  Synthetic Polynucleotide
taatacgactcactatagggtcgagtggctctgagacctacagtaatcagaacagaggagactgattatggtaggtctcaacctggcggcagcgcaaaagatg

SEQ ID NO: 188079 - DNA, 103 bp, Artificial Sequence
  Synthetic Polynucleotide
taatacgactcactatagggctccttctgggctctcctcttgggacctttaacagaggagaaaaggtatgaagaggagaaacctggcggcagcgcaaaagatg

SEQ ID NO: 188080 - DNA, 103 bp, Artificial Sequence
  Synthetic Polynucleotide
taatacgactcactatagggtgaaagctggtcgagtggctctgagacctaaacagaggagataggtcatggagccactcaacctggcggcagcgcaaaagatg

SEQ ID NO: 188081 - DNA, 103 bp, Artificial Sequence
  Synthetic Polynucleotide
taatacgactcactatagggcggtgacacatgaaagctggtcgagtggctaacagaggagaagccacatgaccagctttaacctggcggcagcgcaaaagatg

SEQ ID NO: 188082 - DNA, 103 bp, Artificial Sequence
  Synthetic Polynucleotide
taatacgactcactatagggggcctgccttcggtgacacatgaaagctggaacagaggagaccagctatgatgtgtcacaacctggcggcagcgcaaaagatg

SEQ ID NO: 188083 - DNA, 103 bp, Artificial Sequence
  Synthetic Polynucleotide
taatacgactcactatagggggagtttgatggcctgccttcggtgacacaaacagaggagatgtgtcatggaaggcaggaacctggcggcagcgcaaaagatg

SEQ ID NO: 188084 - DNA, 103 bp, Artificial Sequence
  Synthetic Polynucleotide
taatacgactcactatagggtcatccacctggagtttgatggcctgccttaacagaggagaaaggcaatgcatcaaactaacctggcggcagcgcaaaagatg

SEQ ID NO: 188085 - DNA, 103 bp, Artificial Sequence
  Synthetic Polynucleotide
taatacgactcactatagggatcttctgtgtcatccacctggagtttgataacagaggagaatcaaaatgcaggtggataacctggcggcagcgcaaaagatg

SEQ ID NO: 188086 - DNA, 103 bp, Artificial Sequence
  Synthetic Polynucleotide
taatacgactcactatagggcttcatcggaatcttctgtgtcatccacctaacagaggagaaggtggatgacacagaagaacctggcggcagcgcaaaagatg

SEQ ID NO: 188087 - DNA, 103 bp, Artificial Sequence
  Synthetic Polynucleotide
taatacgactcactatagggggtgtccattcttcatcggaatcttctgtgaacagaggagacacagaatgttccgatgaaacctggcggcagcgcaaaagatg

SEQ ID NO: 188088 - DNA, 103 bp, Artificial Sequence
  Synthetic Polynucleotide
taatacgactcactatagggttgctgcctaggtgtccattcttcatcggaaacagaggagatccgatatggaatggacaaacctggcggcagcgcaaaagatg

SEQ ID NO: 188089 - DNA, 103 bp, Artificial Sequence
  Synthetic Polynucleotide
taatacgactcactataggggaggtttgacttgctgcctaggtgtccattaacagaggagaaatggaatgctaggcagcaacctggcggcagcgcaaaagatg

SEQ ID NO: 188090 - DNA, 103 bp, Artificial Sequence
  Synthetic Polynucleotide
taatacgactcactatagggctctctgtgtctccttctgggctctcctctaacagaggagaagaggaatgcccagaaggaacctggcggcagcgcaaaagatg

SEQ ID NO: 188091 - DNA, 103 bp, Artificial Sequence
  Synthetic Polynucleotide
taatacgactcactataggggccatccaaggaggtttgacttgctgcctaaacagaggagataggcaatgagtcaaaccaacctggcggcagcgcaaaagatg

SEQ ID NO: 188092 - DNA, 103 bp, Artificial Sequence
  Synthetic Polynucleotide
taatacgactcactatagggtcctctgaaggccatccaaggaggtttgacaacagaggagagtcaaaatgccttggatgaacctggcggcagcgcaaaagatg

SEQ ID NO: 188093 - DNA, 103 bp, Artificial Sequence
  Synthetic Polynucleotide
taatacgactcactatagggtactctgttctcctctgaaggccatccaagaacagaggagacttggaatgccttcagagaacctggcggcagcgcaaaagatg

SEQ ID NO: 188094 - DNA, 103 bp, Artificial Sequence
  Synthetic Polynucleotide
taatacgactcactatagggttctggtgtttactctgttctcctctgaagaacagaggagacttcagatgagaacagagaacctggcggcagcgcaaaagatg

SEQ ID NO: 188095 - DNA, 103 bp, Artificial Sequence
  Synthetic Polynucleotide
taatacgactcactataggggggcattcccttctggtgtttactctgttcaacagaggagagaacagatgaaacaccagaacctggcggcagcgcaaaagatg

SEQ ID NO: 188096 - DNA, 103 bp, Artificial Sequence
  Synthetic Polynucleotide
taatacgactcactatagggatgacgccttgggcattcccttctggtgttaacagaggagaaacaccatgagggaatgcaacctggcggcagcgcaaaagatg

SEQ ID NO: 188097 - DNA, 103 bp, Artificial Sequence
  Synthetic Polynucleotide
taatacgactcactatagggtcattattgaatgacgccttgggcattcccaacagaggagagggaatatgcaaggcgtcaacctggcggcagcgcaaaagatg

SEQ ID NO: 188098 - DNA, 103 bp, Artificial Sequence
  Synthetic Polynucleotide
taatacgactcactatagggcaaactagattcattattgaatgacgccttaacagaggagaaaggcgatgttcaataataacctggcggcagcgcaaaagatg

SEQ ID NO: 188099 - DNA, 103 bp, Artificial Sequence
  Synthetic Polynucleotide
taatacgactcactatagggacaattctctcaaactagattcattattgaaacagaggagatcaataatgaatctagttaacctggcggcagcgcaaaagatg

SEQ ID NO: 188100 - DNA, 103 bp, Artificial Sequence
  Synthetic Polynucleotide
taatacgactcactatagggggcgttcctgacaattctctcaaactagataacagaggagaatctagatggagagaattaacctggcggcagcgcaaaagatg

SEQ ID NO: 188101 - DNA, 103 bp, Artificial Sequence
  Synthetic Polynucleotide
taatacgactcactatagggccgctctgttctctctgtgtctccttctggaacagaggagaccagaaatggacacagagaacctggcggcagcgcaaaagatg

SEQ ID NO: 188102 - DNA, 103 bp, Artificial Sequence
  Synthetic Polynucleotide
taatacgactcactatagggcagtaaatttggcgttcctgacaattctctaacagaggagaagagaaatgtcaggaacgaacctggcggcagcgcaaaagatg

SEQ ID NO: 188103 - DNA, 103 bp, Artificial Sequence
  Synthetic Polynucleotide
taatacgactcactatagggcacttgtattcagtaaatttggcgttcctgaacagaggagacaggaaatgcaaatttacaacctggcggcagcgcaaaagatg

SEQ ID NO: 188104 - DNA, 103 bp, Artificial Sequence
  Synthetic Polynucleotide
taatacgactcactatagggtgctctgagtcacttgtattcagtaaatttaacagaggagaaaatttatggaatacaagaacctggcggcagcgcaaaagatg

SEQ ID NO: 188105 - DNA, 103 bp, Artificial Sequence
  Synthetic Polynucleotide
taatacgactcactatagggtttctgagcctgctctgagtcacttgtattaacagaggagaaatacaatggactcagagaacctggcggcagcgcaaaagatg

SEQ ID NO: 188106 - DNA, 103 bp, Artificial Sequence
  Synthetic Polynucleotide
taatacgactcactataggggggacactggtttctgagcctgctctgagtaacagaggagaactcagatgaggctcagaaacctggcggcagcgcaaaagatg

SEQ ID NO: 188107 - DNA, 103 bp, Artificial Sequence
  Synthetic Polynucleotide
taatacgactcactatagggtctccaggaggggacactggtttctgagccaacagaggagaggctcaatgaccagtgtcaacctggcggcagcgcaaaagatg

SEQ ID NO: 188108 - DNA, 103 bp, Artificial Sequence
  Synthetic Polynucleotide
taatacgactcactatagggggtacttgcttctccaggaggggacactggaacagaggagaccagtgatgcctcctggaaacctggcggcagcgcaaaagatg

SEQ ID NO: 188109 - DNA, 103 bp, Artificial Sequence
  Synthetic Polynucleotide
taatacgactcactataggggctgtccagaggtacttgcttctccaggagaacagaggagactcctgatgaagcaagtaaacctggcggcagcgcaaaagatg

SEQ ID NO: 188110 - DNA, 103 bp, Artificial Sequence
  Synthetic Polynucleotide
taatacgactcactatagggagtctagagtgctgtccagaggtacttgctaacagaggagaagcaagatgctctggacaaacctggcggcagcgcaaaagatg

SEQ ID NO: 188111 - DNA, 103 bp, Artificial Sequence
  Synthetic Polynucleotide
taatacgactcactatagggttccagttttagtctagagtgctgtccagaaacagaggagatctggaatgcactctagaaacctggcggcagcgcaaaagatg

SEQ ID NO: 188112 - DNA, 103 bp, Artificial Sequence
  Synthetic Polynucleotide
taatacgactcactatagggccatgggcttccgctctgttctctctgtgtaacagaggagaacacagatggaacagagcaacctggcggcagcgcaaaagatg

SEQ ID NO: 188113 - DNA, 103 bp, Artificial Sequence
  Synthetic Polynucleotide
taatacgactcactatagggtcctcctgagttccagttttagtctagagtaacagaggagaactctaatgtaaaactggaacctggcggcagcgcaaaagatg

SEQ ID NO: 188114 - DNA, 103 bp, Artificial Sequence
  Synthetic Polynucleotide
taatacgactcactatagggtcagtctccttcctcctgagttccagttttaacagaggagaaaaactatgactcaggagaacctggcggcagcgcaaaagatg

SEQ ID NO: 188115 - DNA, 103 bp, Artificial Sequence
  Synthetic Polynucleotide
taatacgactcactatagggcatctttccttcagtctccttcctcctgagaacagaggagactcaggatgaaggagactaacctggcggcagcgcaaaagatg

SEQ ID NO: 188116 - DNA, 103 bp, Artificial Sequence
  Synthetic Polynucleotide
taatacgactcactataggggcaggctatacatctttccttcagtctcctaacagaggagaaggagaatgaaggaaagaaacctggcggcagcgcaaaagatg

SEQ ID NO: 188117 - DNA, 103 bp, Artificial Sequence
  Synthetic Polynucleotide
taatacgactcactatagggtttctttctcgcaggctatacatctttcctaacagaggagaaggaaaatggtatagcctaacctggcggcagcgcaaaagatg

SEQ ID NO: 188118 - DNA, 103 bp, Artificial Sequence
  Synthetic Polynucleotide
taatacgactcactatagggtgcatgaccctttctttctcgcaggctataaacagaggagatatagcatgcgagaaagaaacctggcggcagcgcaaaagatg

SEQ ID NO: 188119 - DNA, 103 bp, Artificial Sequence
  Synthetic Polynucleotide
taatacgactcactatagggtctctttgtatgcatgaccctttctttctcaacagaggagagagaaaatgagggtcatgaacctggcggcagcgcaaaagatg

SEQ ID NO: 188120 - DNA, 103 bp, Artificial Sequence
  Synthetic Polynucleotide
taatacgactcactatagggggctcgctgatctctttgtatgcatgacccaacagaggagagggtcaatgatacaaagaaacctggcggcagcgcaaaagatg

SEQ ID NO: 188121 - DNA, 103 bp, Artificial Sequence
  Synthetic Polynucleotide
taatacgactcactatagggatcatcctgtggctcgctgatctctttgtaaacagaggagatacaaaatgatcagcgagaacctggcggcagcgcaaaagatg

SEQ ID NO: 188122 - DNA, 103 bp, Artificial Sequence
  Synthetic Polynucleotide
taatacgactcactatagggagaggtagtcatcatcctgtggctcgctgaaacagaggagatcagcgatgcacaggatgaacctggcggcagcgcaaaagatg

SEQ ID NO: 188123 - DNA, 103 bp, Artificial Sequence
  Synthetic Polynucleotide
taatacgactcactataggggcatctttgaccatgggcttccgctctgttaacagaggagaaacagaatggaagcccataacctggcggcagcgcaaaagatg

SEQ ID NO: 188124 - DNA, 103 bp, Artificial Sequence
  Synthetic Polynucleotide
taatacgactcactatagggatctcacaatagaggtagtcatcatcctgtaacagaggagaacaggaatgtgactacctaacctggcggcagcgcaaaagatg

SEQ ID NO: 188125 - DNA, 103 bp, Artificial Sequence
  Synthetic Polynucleotide
taatacgactcactataggggttctgacacatctcacaatagaggtagtcaacagaggagagactacatgtattgtgagaacctggcggcagcgcaaaagatg

SEQ ID NO: 188126 - DNA, 103 bp, Artificial Sequence
  Synthetic Polynucleotide
taatacgactcactatagggcaatgaagaagttctgacacatctcacaataacagaggagaattgtgatgtgtgtcagaaacctggcggcagcgcaaaagatg

SEQ ID NO: 188127 - DNA, 103 bp, Artificial Sequence
  Synthetic Polynucleotide
taatacgactcactataggggcacagctgtcaatgaagaagttctgacacaacagaggagagtgtcaatgcttcttcataacctggcggcagcgcaaaagatg

SEQ ID NO: 188128 - DNA, 103 bp, Artificial Sequence
  Synthetic Polynucleotide
taatacgactcactatagggcccatgagcagcacagctgtcaatgaagaaaacagaggagattcttcatggacagctgtaacctggcggcagcgcaaaagatg

SEQ ID NO: 188129 - DNA, 103 bp, Artificial Sequence
  Synthetic Polynucleotide
taatacgactcactatagggatgtagggggcccatgagcagcacagctgtaacagaggagaacagctatgctgctcatgaacctggcggcagcgcaaaagatg

SEQ ID NO: 188130 - DNA, 103 bp, Artificial Sequence
  Synthetic Polynucleotide
taatacgactcactatagggtcctttacaaatgtagggggcccatgagcaaacagaggagatgctcaatggccccctacaacctggcggcagcgcaaaagatg

SEQ ID NO: 188131 - DNA, 103 bp, Artificial Sequence
  Synthetic Polynucleotide
taatacgactcactatagggcactgcactgtcctttacaaatgtagggggaacagaggagaccccctatgtttgtaaagaacctggcggcagcgcaaaagatg

SEQ ID NO: 188132 - DNA, 103 bp, Artificial Sequence
  Synthetic Polynucleotide
taatacgactcactataggggccccttgtccactgcactgtcctttacaaaacagaggagattgtaaatgacagtgcagaacctggcggcagcgcaaaagatg

SEQ ID NO: 188133 - DNA, 103 bp, Artificial Sequence
  Synthetic Polynucleotide
taatacgactcactatagggcggttgggatgccccttgtccactgcactgaacagaggagacagtgcatgggacaagggaacctggcggcagcgcaaaagatg

SEQ ID NO: 188134 - DNA, 103 bp, Artificial Sequence
  Synthetic Polynucleotide
taatacgactcactataggggtctttgaaggcatctttgaccatgggcttaacagaggagaaagcccatggtcaaagataacctggcggcagcgcaaaagatg

SEQ ID NO: 188135 - DNA, 103 bp, Artificial Sequence
  Synthetic Polynucleotide
taatacgactcactataggggagggctgaacggttgggatgccccttgtcaacagaggagagacaagatgcatcccaacaacctggcggcagcgcaaaagatg

SEQ ID NO: 188136 - DNA, 103 bp, Artificial Sequence
  Synthetic Polynucleotide
taatacgactcactatagggggggcagactgagggctgaacggttgggataacagaggagaatcccaatggttcagcccaacctggcggcagcgcaaaagatg

SEQ ID NO: 188137 - DNA, 103 bp, Artificial Sequence
  Synthetic Polynucleotide
taatacgactcactatagggctcagccccgggggcagactgagggctgaaaacagaggagattcagcatgcagtctgccaacctggcggcagcgcaaaagatg

SEQ ID NO: 188138 - DNA, 103 bp, Artificial Sequence
  Synthetic Polynucleotide
taatacgactcactatagggtggcccaattctcagccccgggggcagactaacagaggagaagtctgatgccggggctgaacctggcggcagcgcaaaagatg

SEQ ID NO: 188139 - DNA, 103 bp, Artificial Sequence
  Synthetic Polynucleotide
taatacgactcactatagggggatgcctgatggcccaattctcagccccgaacagaggagacggggcatggaattgggcaacctggcggcagcgcaaaagatg

SEQ ID NO: 188140 - DNA, 103 bp, Artificial Sequence
  Synthetic Polynucleotide
taatacgactcactatagggccagcctgagggatgcctgatggcccaattaacagaggagaaattggatgatcaggcataacctggcggcagcgcaaaagatg

SEQ ID NO: 188141 - DNA, 103 bp, Artificial Sequence
  Synthetic Polynucleotide
taatacgactcactatagggtactccaagcccagcctgagggatgcctgaaacagaggagatcaggcatgcctcaggctaacctggcggcagcgcaaaagatg

SEQ ID NO: 188142 - DNA, 103 bp, Artificial Sequence
  Synthetic Polynucleotide
taatacgactcactatagggcctcgttccatactccaagcccagcctgagaacagaggagactcaggatgggcttggagaacctggcggcagcgcaaaagatg

SEQ ID NO: 188143 - DNA, 103 bp, Artificial Sequence
  Synthetic Polynucleotide
taatacgactcactatagggagatcagatgcctcgttccatactccaagcaacagaggagagcttggatgatggaacgaaacctggcggcagcgcaaaagatg

SEQ ID NO: 188144 - DNA, 103 bp, Artificial Sequence
  Synthetic Polynucleotide
taatacgactcactatagggacccagtggcagatcagatgcctcgttccaaacagaggagatggaacatggcatctgataacctggcggcagcgcaaaagatg

SEQ ID NO: 188145 - DNA, 103 bp, Artificial Sequence
  Synthetic Polynucleotide
taatacgactcactatagggatatggaaatgtctttgaaggcatctttgaaacagaggagatcaaagatgccttcaaagaacctggcggcagcgcaaaagatg

SEQ ID NO: 188146 - DNA, 103 bp, Artificial Sequence
  Synthetic Polynucleotide
taatacgactcactatagggcaaagtgcagacccagtggcagatcagatgaacagaggagacatctgatgtgccactggaacctggcggcagcgcaaaagatg

SEQ ID NO: 188147 - DNA, 103 bp, Artificial Sequence
  Synthetic Polynucleotide
taatacgactcactatagggtcataggggccaaagtgcagacccagtggcaacagaggagagccactatgtctgcacttaacctggcggcagcgcaaaagatg

SEQ ID NO: 188148 - DNA, 103 bp, Artificial Sequence
  Synthetic Polynucleotide
taatacgactcactatagggaattcggccctcataggggccaaagtgcagaacagaggagactgcacatgggcccctataacctggcggcagcgcaaaagatg

SEQ ID NO: 188149 - DNA, 103 bp, Artificial Sequence
  Synthetic Polynucleotide
taatacgactcactatagggcgtcttctgtaattcggccctcataggggcaacagaggagagcccctatgagggccgaaaacctggcggcagcgcaaaagatg

SEQ ID NO: 188150 - DNA, 103 bp, Artificial Sequence
  Synthetic Polynucleotide
taatacgactcactataggggctgcctcttcgtcttctgtaattcggcccaacagaggagagggccgatgtacagaagaaacctggcggcagcgcaaaagatg

SEQ ID NO: 188151 - DNA, 103 bp, Artificial Sequence
  Synthetic Polynucleotide
taatacgactcactatagggtccactgttggctgcctcttcgtcttctgtaacagaggagaacagaaatggaagaggcaaacctggcggcagcgcaaaagatg

SEQ ID NO: 188152 - DNA, 103 bp, Artificial Sequence
  Synthetic Polynucleotide
taatacgactcactataggggccaggaatatccactgttggctgcctcttaacagaggagaaagaggatgccaacagtgaacctggcggcagcgcaaaagatg

SEQ ID NO: 188153 - DNA, 103 bp, Artificial Sequence
  Synthetic Polynucleotide
taatacgactcactatagggttggtgattagccaggaatatccactgttgaacagaggagacaacagatgatattcctgaacctggcggcagcgcaaaagatg

SEQ ID NO: 188154 - DNA, 103 bp, Artificial Sequence
  Synthetic Polynucleotide
taatacgactcactataggggtttctccccttggtgattagccaggaataaacagaggagatattccatgctaatcaccaacctggcggcagcgcaaaagatg

SEQ ID NO: 188155 - DNA, 103 bp, Artificial Sequence
  Synthetic Polynucleotide
taatacgactcactatagggactcatagcagtttctccccttggtgattaaacagaggagataatcaatgaggggagaaaacctggcggcagcgcaaaagatg

SEQ ID NO: 188156 - DNA, 103 bp, Artificial Sequence
  Synthetic Polynucleotide
taatacgactcactatagggttggtgaagtatatggaaatgtctttgaagaacagaggagacttcaaatgcatttccataacctggcggcagcgcaaaagatg

SEQ ID NO: 188157 - DNA, 103 bp, Artificial Sequence
  Synthetic Polynucleotide
taatacgactcactatagggccatccacatactcatagcagtttctccccaacagaggagaggggagatgctgctatgaaacctggcggcagcgcaaaagatg

SEQ ID NO: 188158 - DNA, 103 bp, Artificial Sequence
  Synthetic Polynucleotide
taatacgactcactatagggtttatcttttccatccacatactcatagcaaacagaggagatgctatatgtatgtggataacctggcggcagcgcaaaagatg

SEQ ID NO: 188159 - DNA, 103 bp, Artificial Sequence
  Synthetic Polynucleotide
taatacgactcactatagggtggccgaggatttatcttttccatccacataacagaggagaatgtggatggaaaagataaacctggcggcagcgcaaaagatg

SEQ ID NO: 188160 - DNA, 103 bp, Artificial Sequence
  Synthetic Polynucleotide
taatacgactcactatagggctcatccagttggccgaggatttatcttttaacagaggagaaaaagaatgatcctcggcaacctggcggcagcgcaaaagatg

SEQ ID NO: 188161 - DNA, 103 bp, Artificial Sequence
  Synthetic Polynucleotide
taatacgactcactataggggttcacatacctcatccagttggccgaggaaacagaggagatcctcgatgaactggatgaacctggcggcagcgcaaaagatg

SEQ ID NO: 188162 - DNA, 103 bp, Artificial Sequence
  Synthetic Polynucleotide
taatacgactcactatagggcccgggcacagttcacatacctcatccagtaacagaggagaactggaatgggtatgtgaaacctggcggcagcgcaaaagatg

SEQ ID NO: 188163 - DNA, 103 bp, Artificial Sequence
  Synthetic Polynucleotide
taatacgactcactatagggtcttcatcatcccgggcacagttcacatacaacagaggagagtatgtatgctgtgcccgaacctggcggcagcgcaaaagatg

SEQ ID NO: 188164 - DNA, 103 bp, Artificial Sequence
  Synthetic Polynucleotide
taatacgactcactatagggcaggttctgctcttcatcatcccgggcacaaacagaggagatgtgccatggatgatgaaaacctggcggcagcgcaaaagatg

SEQ ID NO: 188165 - DNA, 103 bp, Artificial Sequence
  Synthetic Polynucleotide
taatacgactcactatagggggaaggccaccaggttctgctcttcatcataacagaggagaatgatgatgagcagaaccaacctggcggcagcgcaaaagatg

SEQ ID NO: 188166 - DNA, 103 bp, Artificial Sequence
  Synthetic Polynucleotide
taatacgactcactatagggctgtggtactggaaggccaccaggttctgcaacagaggagagcagaaatgggtggccttaacctggcggcagcgcaaaagatg

SEQ ID NO: 188167 - DNA, 103 bp, Artificial Sequence
  Synthetic Polynucleotide
taatacgactcactataggggctctcctcttgggacttttcagggctcataacagaggagaatgagcatggaaaagtccaacctggcggcagcgcaaaagatg

SEQ ID NO: 188168 - DNA, 103 bp, Artificial Sequence; identical to SEQ ID NO: 188023
  Synthetic Polynucleotide

SEQ ID NO: 188169 - DNA, 103 bp, Artificial Sequence; identical to SEQ ID NO: 188024
  Synthetic Polynucleotide

SEQ ID NO: 188170 - DNA, 103 bp, Artificial Sequence; identical to SEQ ID NO: 188025
  Synthetic Polynucleotide

SEQ ID NO: 188171 - DNA, 103 bp, Artificial Sequence; identical to SEQ ID NO: 188026
  Synthetic Polynucleotide

SEQ ID NO: 188172 - DNA, 103 bp, Artificial Sequence; identical to SEQ ID NO: 188027
  Synthetic Polynucleotide

SEQ ID NO: 188173 - DNA, 103 bp, Artificial Sequence; identical to SEQ ID NO: 188028
  Synthetic Polynucleotide

SEQ ID NO: 188174 - DNA, 103 bp, Artificial Sequence
  Synthetic Polynucleotide
taatacgactcactatagggtaccagaccagcagttcacagcctggcctaaacagaggagataggccatgctgtgaactaacctggcggcagcgcaaaagatg

SEQ ID NO: 188175 - DNA, 103 bp, Artificial Sequence
  Synthetic Polynucleotide
taatacgactcactatagggttcatccccataccagaccagcagttcacaaacagaggagatgtgaaatgctggtctggaacctggcggcagcgcaaaagatg

SEQ ID NO: 188176 - DNA, 103 bp, Artificial Sequence
  Synthetic Polynucleotide
taatacgactcactatagggcctggccgtattcatccccataccagaccaaacagaggagatggtctatgatggggatgaacctggcggcagcgcaaaagatg

SEQ ID NO: 188177 - DNA, 103 bp, Artificial Sequence
  Synthetic Polynucleotide
taatacgactcactatagggatgcccagttcctggccgtattcatccccaaacagaggagatggggaatgatacggccaaacctggcggcagcgcaaaagatg

SEQ ID NO: 188178 - DNA, 103 bp, Artificial Sequence
  Synthetic Polynucleotide
taatacgactcactataggggccccacttgatgcccagttcctggccgtaaacagaggagatacggcatggaactgggcaacctggcggcagcgcaaaagatg

SEQ ID NO: 188179 - DNA, 103 bp, Artificial Sequence
  Synthetic Polynucleotide
taatacgactcactatagggccatctctgcccattcttccttggtgaagtaacagaggagaacttcaatgaggaagaataacctggcggcagcgcaaaagatg

SEQ ID NO: 188180 - DNA, 103 bp, Artificial Sequence
  Synthetic Polynucleotide
taatacgactcactatagggtccacttgctgccccacttgatgcccagttaacagaggagaaactggatgtcaagtgggaacctggcggcagcgcaaaagatg

SEQ ID NO: 188181 - DNA, 103 bp, Artificial Sequence
  Synthetic Polynucleotide
taatacgactcactatagggagctctttcttccacttgctgccccacttgaacagaggagacaagtgatgcagcaagtgaacctggcggcagcgcaaaagatg

SEQ ID NO: 188182 - DNA, 103 bp, Artificial Sequence
  Synthetic Polynucleotide
taatacgactcactatagggccctgccatgagctctttcttccacttgctaacagaggagaagcaagatgaagaaagagaacctggcggcagcgcaaaagatg

SEQ ID NO: 188183 - DNA, 103 bp, Artificial Sequence
  Synthetic Polynucleotide
taatacgactcactatagggttggttctctccctgccatgagctctttctaacagaggagaagaaagatgtcatggcagaacctggcggcagcgcaaaagatg

SEQ ID NO: 188184 - DNA, 103 bp, Artificial Sequence
  Synthetic Polynucleotide
taatacgactcactatagggatctctggctttggttctctccctgccatgaacagaggagacatggcatggagagaaccaacctggcggcagcgcaaaagatg

SEQ ID NO: 188185 - DNA, 103 bp, Artificial Sequence
  Synthetic Polynucleotide
taatacgactcactatagggacatggatggatctctggctttggttctctaacagaggagaagagaaatgaagccagagaacctggcggcagcgcaaaagatg

SEQ ID NO: 188186 - DNA, 103 bp, Artificial Sequence
  Synthetic Polynucleotide
taatacgactcactatagggagcatgagggacatggatggatctctggctaacagaggagaagccagatgtccatccataacctggcggcagcgcaaaagatg

SEQ ID NO: 188187 - DNA, 103 bp, Artificial Sequence
  Synthetic Polynucleotide
taatacgactcactatagggaaggccagacagcatgagggacatggatggaacagaggagaccatccatgtccctcatgaacctggcggcagcgcaaaagatg

SEQ ID NO: 188188 - DNA, 103 bp, Artificial Sequence
  Synthetic Polynucleotide
taatacgactcactatagggctgacttgaaaaggccagacagcatgagggaacagaggagaccctcaatgtgtctggccaacctggcggcagcgcaaaagatg

SEQ ID NO: 188189 - DNA, 103 bp, Artificial Sequence
  Synthetic Polynucleotide
taatacgactcactatagggtgagaaatttctgacttgaaaaggccagacaacagaggagagtctggatgtttcaagtcaacctggcggcagcgcaaaagatg

SEQ ID NO: 188190 - DNA, 103 bp, Artificial Sequence
  Synthetic Polynucleotide
taatacgactcactatagggtcccagtctcccatctctgcccattcttccaacagaggagaggaagaatgggcagagataacctggcggcagcgcaaaagatg

SEQ ID NO: 188191 - DNA, 103 bp, Artificial Sequence
  Synthetic Polynucleotide
taatacgactcactatagggacatgttgactgagaaatttctgacttgaaaacagaggagattcaagatggaaatttctaacctggcggcagcgcaaaagatg

SEQ ID NO: 188192 - DNA, 103 bp, Artificial Sequence
  Synthetic Polynucleotide
taatacgactcactatagggattgcgttctacatgttgactgagaaatttaacagaggagaaaatttatgagtcaacataacctggcggcagcgcaaaagatg

SEQ ID NO: 188193 - DNA, 103 bp, Artificial Sequence
  Synthetic Polynucleotide
taatacgactcactataggggagaggagtgattgcgttctacatgttgacaacagaggagagtcaacatgtagaacgcaaacctggcggcagcgcaaaagatg

SEQ ID NO: 188194 - DNA, 103 bp, Artificial Sequence
  Synthetic Polynucleotide
taatacgactcactataggggggaagttctgagaggagtgattgcgttctaacagaggagaagaacgatgtcactcctcaacctggcggcagcgcaaaagatg

SEQ ID NO: 188195 - DNA, 103 bp, Artificial Sequence
  Synthetic Polynucleotide
taatacgactcactatagggagatggtcctgggaagttctgagaggagtgaacagaggagacactccatgcagaacttcaacctggcggcagcgcaaaagatg

SEQ ID NO: 188196 - DNA, 103 bp, Artificial Sequence
  Synthetic Polynucleotide
taatacgactcactataggggttttcttgcagatggtcctgggaagttctaacagaggagaagaactatgcaggaccataacctggcggcagcgcaaaagatg

SEQ ID NO: 188197 - DNA, 103 bp, Artificial Sequence
  Synthetic Polynucleotide
taatacgactcactatagggggttggaggagttttcttgcagatggtcctaacagaggagaaggaccatgtgcaagaaaaacctggcggcagcgcaaaagatg

SEQ ID NO: 188198 - DNA, 103 bp, Artificial Sequence
  Synthetic Polynucleotide
taatacgactcactataggggggattctctggttggaggagttttcttgcaacagaggagagcaagaatgctcctccaaaacctggcggcagcgcaaaagatg

SEQ ID NO: 188199 - DNA, 103 bp, Artificial Sequence
  Synthetic Polynucleotide
taatacgactcactatagggcccctgggcagggattctctggttggaggaaacagaggagatcctccatgcagagaatcaacctggcggcagcgcaaaagatg

SEQ ID NO: 188200 - DNA, 103 bp, Artificial Sequence
  Synthetic Polynucleotide
taatacgactcactatagggtgattctgatcccctgggcagggattctctaacagaggagaagagaaatgctgcccaggaacctggcggcagcgcaaaagatg

SEQ ID NO: 188201 - DNA, 103 bp, Artificial Sequence
  Synthetic Polynucleotide
taatacgactcactataggggcgagttttctcccagtctcccatctctgcaacagaggagagcagagatgggagactggaacctggcggcagcgcaaaagatg

SEQ ID NO: 188202 - DNA, 103 bp, Artificial Sequence
  Synthetic Polynucleotide
taatacgactcactatagggttgctgctcctgattctgatcccctgggcaaacagaggagatgcccaatggatcagaataacctggcggcagcgcaaaagatg

SEQ ID NO: 188203 - DNA, 103 bp, Artificial Sequence
  Synthetic Polynucleotide
taatacgactcactataggggatctggatattgctgctcctgattctgataacagaggagaatcagaatgaggagcagcaacctggcggcagcgcaaaagatg

SEQ ID NO: 188204 - DNA, 103 bp, Artificial Sequence
  Synthetic Polynucleotide
taatacgactcactatagggcggctgtgtggatctggatattgctgctccaacagaggagaggagcaatgatatccagaaacctggcggcagcgcaaaagatg

SEQ ID NO: 188205 - DNA, 103 bp, Artificial Sequence
  Synthetic Polynucleotide
taatacgactcactatagggtttgtcattacggctgtgtggatctggataaacagaggagatatccaatgccacacagcaacctggcggcagcgcaaaagatg

SEQ ID NO: 188206 - DNA, 103 bp, Artificial Sequence
  Synthetic Polynucleotide
taatacgactcactataggggacctttggttttgtcattacggctgtgtgaacagaggagacacacaatggtaatgacaaacctggcggcagcgcaaaagatg

SEQ ID NO: 188207 - DNA, 103 bp, Artificial Sequence
  Synthetic Polynucleotide
taatacgactcactatagggttgatctcttgacctttggttttgtcattaaacagaggagataatgaatgaaccaaaggaacctggcggcagcgcaaaagatg

SEQ ID NO: 188208 - DNA, 103 bp, Artificial Sequence
  Synthetic Polynucleotide
taatacgactcactatagggggacctttctttgatctcttgacctttggtaacagaggagaaccaaaatgcaagagatcaacctggcggcagcgcaaaagatg

SEQ ID NO: 188209 - DNA, 103 bp, Artificial Sequence
  Synthetic Polynucleotide
taatacgactcactatagggtcaagagtttggacctttctttgatctcttaacagaggagaaagagaatgaagaaaggtaacctggcggcagcgcaaaagatg

SEQ ID NO: 188210 - DNA, 103 bp, Artificial Sequence
  Synthetic Polynucleotide
taatacgactcactataggggtccttttattcaagagtttggacctttctaacagaggagaagaaagatgcaaactcttaacctggcggcagcgcaaaagatg

SEQ ID NO: 188211 - DNA, 103 bp, Artificial Sequence
  Synthetic Polynucleotide
taatacgactcactatagggcctctgccatgtccttttattcaagagtttaacagaggagaaaactcatgaataaaaggaacctggcggcagcgcaaaagatg

SEQ ID NO: 188212 - DNA, 103 bp, Artificial Sequence; identical to SEQ ID NO: 188067
  Synthetic Polynucleotide

SEQ ID NO: 188213 - DNA, 103 bp, Artificial Sequence
  Synthetic Polynucleotide
taatacgactcactatagggttgaaatctccctctgccatgtccttttataacagaggagaataaaaatgcatggcagaaacctggcggcagcgcaaaagatg

SEQ ID NO: 188214 - DNA, 103 bp, Artificial Sequence
  Synthetic Polynucleotide
taatacgactcactataggggaaaaggcccttgaaatctccctctgccataacagaggagaatggcaatgggagatttcaacctggcggcagcgcaaaagatg

SEQ ID NO: 188215 - DNA, 103 bp, Artificial Sequence
  Synthetic Polynucleotide
taatacgactcactataggggggtgggctagaaaaggcccttgaaatctcaacagaggagagagattatgagggcctttaacctggcggcagcgcaaaagatg

SEQ ID NO: 188216 - DNA, 103 bp, Artificial Sequence
  Synthetic Polynucleotide
taatacgactcactatagggtttgtcctttgggtgggctagaaaaggcccaacagaggagagggcctatgctagcccacaacctggcggcagcgcaaaagatg

SEQ ID NO: 188217 - DNA, 103 bp, Artificial Sequence
  Synthetic Polynucleotide
taatacgactcactatagggcagctccccatttgtcctttgggtgggctaaacagaggagatagcccatgcaaaggacaaacctggcggcagcgcaaaagatg

SEQ ID NO: 188218 - DNA, 103 bp, Artificial Sequence
  Synthetic Polynucleotide
taatacgactcactatagggtcccactctacagctccccatttgtcctttaacagaggagaaaaggaatgatggggagcaacctggcggcagcgcaaaagatg

SEQ ID NO: 188219 - DNA, 103 bp, Artificial Sequence
  Synthetic Polynucleotide
taatacgactcactatagggttattctttttcccactctacagctccccaaacagaggagatggggaatggtagagtggaacctggcggcagcgcaaaagatg

SEQ ID NO: 188220 - DNA, 103 bp, Artificial Sequence
  Synthetic Polynucleotide
taatacgactcactatagggtcttcttccattattctttttcccactctaaacagaggagatagagtatgaaaaagaataacctggcggcagcgcaaaagatg
